United States Patent 7,888,497 (BIOINFORMATICALLY DETECTABLE GROUP OF NOVEL REGULATORY OLIGONUCLEOTIDES AND USES THEREOF) - sequence listing, part 33

SEQ ID NO: 1370734 - DNA, 11 bp, Homo sapiens
gcccctgggct

SEQ ID NO: 1370735 - DNA, 18 bp, Homo sapiens
gcccctgggcttggcctg

SEQ ID NO: 1370736 - DNA, 21 bp, Homo sapiens
gcccctgggcttggcctgctg

SEQ ID NO: 1370737 - DNA, 22 bp, Homo sapiens
gcccctgggcttggcctgctgt

SEQ ID NO: 1370738 - DNA, 16 bp, Homo sapiens
gcccgacatggctccg

SEQ ID NO: 1370739 - DNA, 13 bp, Homo sapiens
gcccgtcctgcct

SEQ ID NO: 1370740 - DNA, 14 bp, Homo sapiens
gcccgtcctgcctg

SEQ ID NO: 1370741 - DNA, 21 bp, Homo sapiens
gccttcgcttcttgcctctgt

SEQ ID NO: 1370742 - DNA, 15 bp, Homo sapiens
gccttcttttgatta

SEQ ID NO: 1370743 - DNA, 22 bp, Homo sapiens
gccttcttttgattatgttttt

SEQ ID NO: 1370744 - DNA, 15 bp, Homo sapiens
gccttgagttccagt

SEQ ID NO: 1370745 - DNA, 16 bp, Homo sapiens
gcctttgcagctcaga

SEQ ID NO: 1370746 - DNA, 13 bp, Homo sapiens
gcctttggcttca

SEQ ID NO: 1370747 - DNA, 17 bp, Homo sapiens
gcctttgtaagtgcagg

SEQ ID NO: 1370748 - DNA, 22 bp, Homo sapiens
gcctttttaaaacacatgtttt

SEQ ID NO: 1370749 - DNA, 19 bp, Homo sapiens
gcgaagaccctcttgccca

SEQ ID NO: 1370750 - DNA, 17 bp, Homo sapiens
gcgactttctgcctgga

SEQ ID NO: 1370751 - DNA, 18 bp, Homo sapiens
gcgatctctccactgtgc

SEQ ID NO: 1370752 - DNA, 16 bp, Homo sapiens
gcgatctctcctggcc

SEQ ID NO: 1370753 - DNA, 21 bp, Homo sapiens
gcgccccctccgccctgccac

SEQ ID NO: 1370754 - DNA, 22 bp, Homo sapiens
gcgcccctagccggttcctgtc

SEQ ID NO: 1370755 - DNA, 12 bp, Homo sapiens
gcgccctttccc

SEQ ID NO: 1370756 - DNA, 18 bp, Homo sapiens
gcgccctttccccgacgc

SEQ ID NO: 1370757 - DNA, 22 bp, Homo sapiens
gcgccgtctccaggggctgctt

SEQ ID NO: 1370758 - DNA, 14 bp, Homo sapiens
gcgcctccctccac

SEQ ID NO: 1370759 - DNA, 18 bp, Homo sapiens
gcgcctccctccacccca

SEQ ID NO: 1370760 - DNA, 16 bp, Homo sapiens
gcgcctgctgcatgcc

SEQ ID NO: 1370761 - DNA, 14 bp, Homo sapiens
gcgcgcccctagcc

SEQ ID NO: 1370762 - DNA, 17 bp, Homo sapiens
gcgcggacgtgctgggc

SEQ ID NO: 1370763 - DNA, 20 bp, Homo sapiens
gcgcggtggcgggcacctgt

SEQ ID NO: 1370764 - DNA, 15 bp, Homo sapiens
gcgcggtggctcacg

SEQ ID NO: 1370765 - DNA, 19 bp, Homo sapiens
gccaagaatattgcaaaat

SEQ ID NO: 1370766 - DNA, 15 bp, Homo sapiens
gccaagattttcctc

SEQ ID NO: 1370767 - DNA, 23 bp, Homo sapiens
gccaagattttcctcttgtgatt

SEQ ID NO: 1370768 - DNA, 19 bp, Homo sapiens
gccaagggaacctgtgtcc

SEQ ID NO: 1370769 - DNA, 14 bp, Homo sapiens
gccaaggtgggagg

SEQ ID NO: 1370770 - DNA, 20 bp, Homo sapiens
gccaagtggggtgctgggag

SEQ ID NO: 1370771 - DNA, 23 bp, Homo sapiens
gccaagtggggtgctgggaggag

SEQ ID NO: 1370772 - DNA, 12 bp, Homo sapiens
gccacaggaccc

SEQ ID NO: 1370773 - DNA, 15 bp, Homo sapiens
gccacatcaaacctt

SEQ ID NO: 1370774 - DNA, 16 bp, Homo sapiens
gccacatcaaaccttt

SEQ ID NO: 1370775 - DNA, 19 bp, Homo sapiens
gccaccaaagctgcccact

SEQ ID NO: 1370776 - DNA, 12 bp, Homo sapiens
gccaccaggcca

SEQ ID NO: 1370777 - DNA, 18 bp, Homo sapiens
gccaccaggccacctccc

SEQ ID NO: 1370778 - DNA, 17 bp, Homo sapiens
gccacccaggaggcagg

SEQ ID NO: 1370779 - DNA, 22 bp, Homo sapiens
gccaccctagccaatgtctcct

SEQ ID NO: 1370780 - DNA, 18 bp, Homo sapiens
gccactcactaggccccc

SEQ ID NO: 1370781 - DNA, 14 bp, Homo sapiens
gccactcatttcat

SEQ ID NO: 1370782 - DNA, 18 bp, Homo sapiens
gccactcatttcatctca

SEQ ID NO: 1370783 - DNA, 15 bp, Homo sapiens
ggtccagctctggag

SEQ ID NO: 1370784 - DNA, 14 bp, Homo sapiens
ggtccctctgtgta

SEQ ID NO: 1370785 - DNA, 13 bp, Homo sapiens
ggtccgtgggacg

SEQ ID NO: 1370786 - DNA, 21 bp, Homo sapiens
ggtcctaaggcatctatctgt

SEQ ID NO: 1370787 - DNA, 22 bp, Homo sapiens
ggtcctagaggccctttgctgt

SEQ ID NO: 1370788 - DNA, 15 bp, Homo sapiens
ggtcctctggagccc

SEQ ID NO: 1370789 - DNA, 20 bp, Homo sapiens
ggtcggtaggttcagccaag

SEQ ID NO: 1370790 - DNA, 12 bp, Homo sapiens
ggtctccctggc

SEQ ID NO: 1370791 - DNA, 15 bp, Homo sapiens
ggtctccctggctcc

SEQ ID NO: 1370792 - DNA, 20 bp, Homo sapiens
ggtctcttcttggggcccag

SEQ ID NO: 1370793 - DNA, 21 bp, Homo sapiens
ggtctcttcttggggcccagt

SEQ ID NO: 1370794 - DNA, 18 bp, Homo sapiens
ggtctgttggcaggctgg

SEQ ID NO: 1370795 - DNA, 19 bp, Homo sapiens
ggtctgttggcaggctggc

SEQ ID NO: 1370796 - DNA, 23 bp, Homo sapiens
ggtcttaagaaatgtataaactt

SEQ ID NO: 1370797 - DNA, 21 bp, Homo sapiens
ggtcttgaactcctggactca

SEQ ID NO: 1370798 - DNA, 20 bp, Homo sapiens
ggtctttcagtactttttta

SEQ ID NO: 1370799 - DNA, 16 bp, Homo sapiens
ggtgagggttggcgct

SEQ ID NO: 1370800 - DNA, 18 bp, Homo sapiens
ggtgagtccattctccca

SEQ ID NO: 1370801 - DNA, 20 bp, Homo sapiens
ggtgagtttgagctgccttc

SEQ ID NO: 1370802 - DNA, 11 bp, Homo sapiens
ggtgcagaggt

SEQ ID NO: 1370803 - DNA, 22 bp, Homo sapiens
ggtgcagaggtaccctgggtgt

SEQ ID NO: 1370804 - DNA, 14 bp, Homo sapiens
ggtgcccaagccag

SEQ ID NO: 1370805 - DNA, 20 bp, Homo sapiens
ggtgctgggaggagggagag

SEQ ID NO: 1370806 - DNA, 14 bp, Homo sapiens
ggtgctgtgaggga

SEQ ID NO: 1370807 - DNA, 17 bp, Homo sapiens
ggtgctgtgagggaggg

SEQ ID NO: 1370808 - DNA, 20 bp, Homo sapiens
ggtggaagggtagagaggcg

SEQ ID NO: 1370809 - DNA, 14 bp, Homo sapiens
ggtggcaccagcag

SEQ ID NO: 1370810 - DNA, 20 bp, Homo sapiens
ggtggcaccagcagcctgga

SEQ ID NO: 1370811 - DNA, 13 bp, Homo sapiens
ggtggccacagcg

SEQ ID NO: 1370812 - DNA, 20 bp, Homo sapiens
ggtggccgctgagtggcagg

SEQ ID NO: 1370813 - DNA, 11 bp, Homo sapiens
ggtgggacccc

SEQ ID NO: 1370814 - DNA, 14 bp, Homo sapiens
ggtgggctggactt

SEQ ID NO: 1370815 - DNA, 16 bp, Homo sapiens
ggtggtctgttggcag

SEQ ID NO: 1370816 - DNA, 21 bp, Homo sapiens
ggtggtctgttggcaggctgg

SEQ ID NO: 1370817 - DNA, 20 bp, Homo sapiens
ggtgtcttgggcagagctgg

SEQ ID NO: 1370818 - DNA, 14 bp, Homo sapiens
ggtgtggagaagcg

SEQ ID NO: 1370819 - DNA, 23 bp, Homo sapiens
ggtgtggagaagcggctggcagc

SEQ ID NO: 1370820 - DNA, 13 bp, Homo sapiens
ggtgtttgaaaat

SEQ ID NO: 1370821 - DNA, 14 bp, Homo sapiens
ggtgtttgaaaata

SEQ ID NO: 1370822 - DNA, 20 bp, Homo sapiens
ggtgtttgaaaatagtttat

SEQ ID NO: 1370823 - DNA, 17 bp, Homo sapiens
ggttacttcttctctta

SEQ ID NO: 1370824 - DNA, 13 bp, Homo sapiens
ggttatggagagg

SEQ ID NO: 1370825 - DNA, 21 bp, Homo sapiens
ggttcccttgagggctgcagt

SEQ ID NO: 1370826 - DNA, 15 bp, Homo sapiens
ggttcctctgcctgc

SEQ ID NO: 1370827 - DNA, 17 bp, Homo sapiens
ggttcctctgcctgccc

SEQ ID NO: 1370828 - DNA, 12 bp, Homo sapiens
ggttctcaatga

SEQ ID NO: 1370829 - DNA, 13 bp, Homo sapiens
ggttctcaatgaa

SEQ ID NO: 1370830 - DNA, 13 bp, Homo sapiens
ggttgaggtttca

SEQ ID NO: 1370831 - DNA, 13 bp, Homo sapiens
ggttggtgggggc

SEQ ID NO: 1370832 - DNA, 14 bp, Homo sapiens
ggttgtgcactgtt

SEQ ID NO: 1370833 - DNA, 13 bp, Homo sapiens
ggtttaagctgtt

SEQ ID NO: 1370834 - DNA, 12 bp, Homo sapiens
ggtttccaggga

SEQ ID NO: 1370835 - DNA, 22 bp, Homo sapiens
ggtttctctgtggctccaggcc

SEQ ID NO: 1370836 - DNA, 12 bp, Homo sapiens
ggtttgagaaat

SEQ ID NO: 1370837 - DNA, 20 bp, Homo sapiens
ggttttgtaatttgtttgaa

SEQ ID NO: 1370838 - DNA, 15 bp, Homo sapiens
gtaaaatattttgaa

SEQ ID NO: 1370839 - DNA, 16 bp, Homo sapiens
gtaaacttctgcaaca

SEQ ID NO: 1370840 - DNA, 15 bp, Homo sapiens
gtaaagactggcttt

SEQ ID NO: 1370841 - DNA, 18 bp, Homo sapiens
gtaaagactggttttctg

SEQ ID NO: 1370842 - DNA, 21 bp, Homo sapiens
gtaaagcccatttttaaaata

SEQ ID NO: 1370843 - DNA, 23 bp, Homo sapiens
gtaaagctatttatgggcccctg

SEQ ID NO: 1370844 - DNA, 23 bp, Homo sapiens
gtaaagtatgtattatttacatt

SEQ ID NO: 1370845 - DNA, 15 bp, Homo sapiens
gtaaagttaaaagaa

SEQ ID NO: 1370846 - DNA, 23 bp, Homo sapiens
gtaaagtttccgtgcgtggcact

SEQ ID NO: 1370847 - DNA, 14 bp, Homo sapiens
gtaaataaaccact

SEQ ID NO: 1370848 - DNA, 11 bp, Homo sapiens
gtaaatgtttc

SEQ ID NO: 1370849 - DNA, 14 bp, Homo sapiens
gtaaatgtttcttt

SEQ ID NO: 1370850 - DNA, 13 bp, Homo sapiens
gtaaattctgatt

SEQ ID NO: 1370851 - DNA, 14 bp, Homo sapiens
gtaaattctgattt

SEQ ID NO: 1370852 - DNA, 20 bp, Homo sapiens
gtaacactagggccttggaa

SEQ ID NO: 1370853 - DNA, 15 bp, Homo sapiens
gtaacactcctctgc

SEQ ID NO: 1370854 - DNA, 13 bp, Homo sapiens
gtaacattcatgt

SEQ ID NO: 1370855 - DNA, 12 bp, Homo sapiens
gtccccacccct

SEQ ID NO: 1370856 - DNA, 15 bp, Homo sapiens
gtccccacccctgcc

SEQ ID NO: 1370857 - DNA, 17 bp, Homo sapiens
gtccccacccctgcccc

SEQ ID NO: 1370858 - DNA, 14 bp, Homo sapiens
gtccctctgtgtat

SEQ ID NO: 1370859 - DNA, 21 bp, Homo sapiens
gtccctgcgcctttccttttc

SEQ ID NO: 1370860 - DNA, 13 bp, Homo sapiens
gtccgagctttga

SEQ ID NO: 1370861 - DNA, 19 bp, Homo sapiens
gtcctagaggccctttgct

SEQ ID NO: 1370862 - DNA, 22 bp, Homo sapiens
gtcctagaggccctttgctgtc

SEQ ID NO: 1370863 - DNA, 14 bp, Homo sapiens
gtcctagtaagaag

SEQ ID NO: 1370864 - DNA, 17 bp, Homo sapiens
gtcctagtaagaagaca

SEQ ID NO: 1370865 - DNA, 17 bp, Homo sapiens
gtcctcctcacctcatg

SEQ ID NO: 1370866 - DNA, 13 bp, Homo sapiens
gtcctctggagcc

SEQ ID NO: 1370867 - DNA, 15 bp, Homo sapiens
gtcctgcctgtggcg

SEQ ID NO: 1370868 - DNA, 22 bp, Homo sapiens
gtcctgcctgtggcgccgtctc

SEQ ID NO: 1370869 - DNA, 15 bp, Homo sapiens
gtccttcctgaaact

SEQ ID NO: 1370870 - DNA, 19 bp, Homo sapiens
gtccttgagtgctcttgct

SEQ ID NO: 1370871 - DNA, 11 bp, Homo sapiens
gtcgctcctgc

SEQ ID NO: 1370872 - DNA, 18 bp, Homo sapiens
gtcggctgaccatgctca

SEQ ID NO: 1370873 - DNA, 13 bp, Homo sapiens
gtcgtgcctgtgt

SEQ ID NO: 1370874 - DNA, 17 bp, Homo sapiens
gtcgtgcctgtgtccat

SEQ ID NO: 1370875 - DNA, 17 bp, Homo sapiens
gtctcaaaaaaagaaaa

SEQ ID NO: 1370876 - DNA, 13 bp, Homo sapiens
gtctcacccatgc

SEQ ID NO: 1370877 - DNA, 23 bp, Homo sapiens
gtctcacccatgcaagcagagga

SEQ ID NO: 1370878 - DNA, 21 bp, Homo sapiens
gtctccaggggctgcttcctc

SEQ ID NO: 1370879 - DNA, 22 bp, Homo sapiens
gtctccaggggctgcttcctcc

SEQ ID NO: 1370880 - DNA, 12 bp, Homo sapiens
gtctccctggct

SEQ ID NO: 1370881 - DNA, 14 bp, Homo sapiens
gtctcctccccttc

SEQ ID NO: 1370882 - DNA, 18 bp, Homo sapiens
gtctctcttctcagagtg

SEQ ID NO: 1370883 - DNA, 20 bp, Homo sapiens
gtctcttcttggggcccagt

SEQ ID NO: 1370884 - DNA, 21 bp, Homo sapiens
gtctcttcttggggcccagtg

SEQ ID NO: 1370885 - DNA, 20 bp, Homo sapiens
gtctgagggcttgtagttct

SEQ ID NO: 1370886 - DNA, 20 bp, Homo sapiens
gtctggtggccccgtttctg

SEQ ID NO: 1370887 - DNA, 16 bp, Homo sapiens
gtctgtctttcctgaa

SEQ ID NO: 1370888 - DNA, 20 bp, Homo sapiens
gtctgtctttcctgaaccat

SEQ ID NO: 1370889 - DNA, 14 bp, Homo sapiens
gtctgttggcaggc

SEQ ID NO: 1370890 - DNA, 16 bp, Homo sapiens
gtctgttggcaggctg

SEQ ID NO: 1370891 - DNA, 21 bp, Homo sapiens
gtcttaaaaagtggaaaaata

SEQ ID NO: 1370892 - DNA, 17 bp, Homo sapiens
gtcttaagaaatgtata

SEQ ID NO: 1370893 - DNA, 21 bp, Homo sapiens
gtcttaagaaatgtataaact

SEQ ID NO: 1370894 - DNA, 16 bp, Homo sapiens
gtcttcagtaagccgt

SEQ ID NO: 1370895 - DNA, 23 bp, Homo sapiens
gtcttcctcaaaataaagaagta

SEQ ID NO: 1370896 - DNA, 15 bp, Homo sapiens
gtcttggatatatag

SEQ ID NO: 1370897 - DNA, 22 bp, Homo sapiens
gtcttgggcagagctggctctg

SEQ ID NO: 1370898 - DNA, 22 bp, Homo sapiens
gtctttcagtacttttttaaat

SEQ ID NO: 1370899 - DNA, 19 bp, Homo sapiens
gtctttcatggctgctgtt

SEQ ID NO: 1370900 - DNA, 16 bp, Homo sapiens
gtctttctcaaagaaa

SEQ ID NO: 1370901 - DNA, 23 bp, Homo sapiens
gtctttctcaaagaaatattaag

SEQ ID NO: 1370902 - DNA, 12 bp, Homo sapiens
gtcttttgcttt

SEQ ID NO: 1370903 - DNA, 13 bp, Homo sapiens
gtcttttgctttt

SEQ ID NO: 1370904 - DNA, 14 bp, Homo sapiens
gtcttttgcttttg

SEQ ID NO: 1370905 - DNA, 16 bp, Homo sapiens
gtcttttgcttttggc

SEQ ID NO: 1370906 - DNA, 14 bp, Homo sapiens
gtcttttttttcct

SEQ ID NO: 1370907 - DNA, 14 bp, Homo sapiens
gtgaaaagaaaaat

SEQ ID NO: 1370908 - DNA, 14 bp, Homo sapiens
ccatgtagccccct

SEQ ID NO: 1370909 - DNA, 13 bp, Homo sapiens
ccatgtccaaaga

SEQ ID NO: 1370910 - DNA, 18 bp, Homo sapiens
ccatgtccaaagaggctg

SEQ ID NO: 1370911 - DNA, 22 bp, Homo sapiens
ccatgtgatggacactccaggg

SEQ ID NO: 1370912 - DNA, 22 bp, Homo sapiens
ccattacagaggtattaaaact

SEQ ID NO: 1370913 - DNA, 20 bp, Homo sapiens
ccattccaggcagcctctgt

SEQ ID NO: 1370914 - DNA, 21 bp, Homo sapiens
ccattccaggcagcctctgtc

SEQ ID NO: 1370915 - DNA, 20 bp, Homo sapiens
ccattcgtacataatactga

SEQ ID NO: 1370916 - DNA, 22 bp, Homo sapiens
ccattctcccaggtaccagctg

SEQ ID NO: 1370917 - DNA, 12 bp, Homo sapiens
ccattctgactc

SEQ ID NO: 1370918 - DNA, 15 bp, Homo sapiens
ccatttccattgctt

SEQ ID NO: 1370919 - DNA, 14 bp, Homo sapiens
ccatttcccatctg

SEQ ID NO: 1370920 - DNA, 15 bp, Homo sapiens
ccatttcccatctgc

SEQ ID NO: 1370921 - DNA, 18 bp, Homo sapiens
ccatttcccatctgcacc

SEQ ID NO: 1370922 - DNA, 22 bp, Homo sapiens
ccatttgccaattttcctactc

SEQ ID NO: 1370923 - DNA, 19 bp, Homo sapiens
ccatttgctcttcagatgc

SEQ ID NO: 1370924 - DNA, 14 bp, Homo sapiens
ccatttgtgccaga

SEQ ID NO: 1370925 - DNA, 16 bp, Homo sapiens
ccatttgtgccagagg

SEQ ID NO: 1370926 - DNA, 23 bp, Homo sapiens
cccaaactgttgattattagcca

SEQ ID NO: 1370927 - DNA, 18 bp, Homo sapiens
cccaaagctgagcctgca

SEQ ID NO: 1370928 - DNA, 16 bp, Homo sapiens
cccaaatcaatacact

SEQ ID NO: 1370929 - DNA, 18 bp, Homo sapiens
cccaaccccaagccagcc

SEQ ID NO: 1370930 - DNA, 20 bp, Homo sapiens
cccaaccctatctcctgaca

SEQ ID NO: 1370931 - DNA, 15 bp, Homo sapiens
cccaacctcagggct

SEQ ID NO: 1370932 - DNA, 19 bp, Homo sapiens
cccaacctcagggctccca

SEQ ID NO: 1370933 - DNA, 20 bp, Homo sapiens
cccaacctcagggctcccag

SEQ ID NO: 1370934 - DNA, 15 bp, Homo sapiens
cccaacctttccctc

SEQ ID NO: 1370935 - DNA, 20 bp, Homo sapiens
cccaacctttccctcacccc

SEQ ID NO: 1370936 - DNA, 14 bp, Homo sapiens
cccaagaatgcaag

SEQ ID NO: 1370937 - DNA, 17 bp, Homo sapiens
cccaatccctttattac

SEQ ID NO: 1370938 - DNA, 21 bp, Homo sapiens
cccacaaaggagagctagcag

SEQ ID NO: 1370939 - DNA, 21 bp, Homo sapiens
cccacagtctccggcctctcc

SEQ ID NO: 1370940 - DNA, 15 bp, Homo sapiens
cccacagttgctcta

SEQ ID NO: 1370941 - DNA, 19 bp, Homo sapiens
cccacatccaactccagca

SEQ ID NO: 1370942 - DNA, 14 bp, Homo sapiens
cccacatgtccagc

SEQ ID NO: 1370943 - DNA, 16 bp, Homo sapiens
cccacccccagccccg

SEQ ID NO: 1370944 - DNA, 13 bp, Homo sapiens
cccaccccctgcc

SEQ ID NO: 1370945 - DNA, 14 bp, Homo sapiens
cccaccccctgccc

SEQ ID NO: 1370946 - DNA, 13 bp, Homo sapiens
cccaccccgggga

SEQ ID NO: 1370947 - DNA, 21 bp, Homo sapiens
cccaccccggggaccctgtga

SEQ ID NO: 1370948 - DNA, 12 bp, Homo sapiens
cccacccctgcc

SEQ ID NO: 1370949 - DNA, 14 bp, Homo sapiens
cccaccctgggccc

SEQ ID NO: 1370950 - DNA, 16 bp, Homo sapiens
cccaccggtccagctg

SEQ ID NO: 1370951 - DNA, 17 bp, Homo sapiens
cccaccggtccagctgg

SEQ ID NO: 1370952 - DNA, 17 bp, Homo sapiens
cccacctcggtcactcc

SEQ ID NO: 1370953 - DNA, 20 bp, Homo sapiens
cccacgactgcccggcaggg

SEQ ID NO: 1370954 - DNA, 17 bp, Homo sapiens
cccactaatgcaaactg

SEQ ID NO: 1370955 - DNA, 13 bp, Homo sapiens
cccactgccagca

SEQ ID NO: 1370956 - DNA, 15 bp, Homo sapiens
cccactgccagcagc

SEQ ID NO: 1370957 - DNA, 21 bp, Homo sapiens
cccactgccagcagcagcagg

SEQ ID NO: 1370958 - DNA, 23 bp, Homo sapiens
cccactgtttctcttgagctggc

SEQ ID NO: 1370959 - DNA, 14 bp, Homo sapiens
cccacttgcctctt

SEQ ID NO: 1370960 - DNA, 15 bp, Homo sapiens
cccacttgcctcttc

SEQ ID NO: 1370961 - DNA, 22 bp, Homo sapiens
cccactttgctgttccttactt

SEQ ID NO: 1370962 - DNA, 22 bp, Homo sapiens
cccagaataagttattgcagtt

SEQ ID NO: 1370963 - DNA, 11 bp, Homo sapiens
cccagagactt

SEQ ID NO: 1370964 - DNA, 19 bp, Homo sapiens
cccagagactttgtagatc

SEQ ID NO: 1370965 - DNA, 19 bp, Homo sapiens
cccagcattccagcccctc

SEQ ID NO: 1370966 - DNA, 17 bp, Homo sapiens
cccagccatgccagctg

SEQ ID NO: 1370967 - DNA, 18 bp, Homo sapiens
cccagccatgccagctgg

SEQ ID NO: 1370968 - DNA, 22 bp, Homo sapiens
cccagccatgccagctggcctt

SEQ ID NO: 1370969 - DNA, 17 bp, Homo sapiens
cccagccccgactccag

SEQ ID NO: 1370970 - DNA, 19 bp, Homo sapiens
cccagccccgactccagcc

SEQ ID NO: 1370971 - DNA, 15 bp, Homo sapiens
cccagccctgctggg

SEQ ID NO: 1370972 - DNA, 18 bp, Homo sapiens
cccagcctgcgcctgctg

SEQ ID NO: 1370973 - DNA, 22 bp, Homo sapiens
cccagcctgcgcctgctgcatg

SEQ ID NO: 1370974 - DNA, 12 bp, Homo sapiens
cccagcctgcta

SEQ ID NO: 1370975 - DNA, 14 bp, Homo sapiens
cccagcctgctagc

SEQ ID NO: 1370976 - DNA, 15 bp, Homo sapiens
cccagcctgctagct

SEQ ID NO: 1370977 - DNA, 17 bp, Homo sapiens
cccagctacttgggagg

SEQ ID NO: 1370978 - DNA, 23 bp, Homo sapiens
cccaggacgccactcatttcatc

SEQ ID NO: 1370979 - DNA, 17 bp, Homo sapiens
cccaggagcctgcccag

SEQ ID NO: 1370980 - DNA, 21 bp, Homo sapiens
cccaggaggcagggaggcagc

SEQ ID NO: 1370981 - DNA, 23 bp, Homo sapiens
cccaggaggcagggaggcagccg

SEQ ID NO: 1370982 - DNA, 18 bp, Homo sapiens
cccagggcaagctccgca

SEQ ID NO: 1370983 - DNA, 19 bp, Homo sapiens
cccagggggcatgaccaga

SEQ ID NO: 1370984 - DNA, 20 bp, Homo sapiens
ccccagcccagggctcctgc

SEQ ID NO: 1370985 - DNA, 13 bp, Homo sapiens
ccccagccccggg

SEQ ID NO: 1370986 - DNA, 16 bp, Homo sapiens
ccccagccctgctggg

SEQ ID NO: 1370987 - DNA, 12 bp, Homo sapiens
ccccagcctgcg

SEQ ID NO: 1370988 - DNA, 18 bp, Homo sapiens
ccccagcctgcgcctgct

SEQ ID NO: 1370989 - DNA, 19 bp, Homo sapiens
ccccagcctgcgcctgctg

SEQ ID NO: 1370990 - DNA, 15 bp, Homo sapiens
ccccaggctcgtgga

SEQ ID NO: 1370991 - DNA, 21 bp, Homo sapiens
ccccagttcctcccaggaagc

SEQ ID NO: 1370992 - DNA, 17 bp, Homo sapiens
ccccatctccctgcctg

SEQ ID NO: 1370993 - DNA, 16 bp, Homo sapiens
ccccatttcccatctg

SEQ ID NO: 1370994 - DNA, 19 bp, Homo sapiens
ccccatttcccatctgcac

SEQ ID NO: 1370995 - DNA, 19 bp, Homo sapiens
cccccaaagatagacaggt

SEQ ID NO: 1370996 - DNA, 24 bp, Homo sapiens
cccccaaagatagacaggtcctga

SEQ ID NO: 1370997 - DNA, 15 bp, Homo sapiens
cccccaacctcaggg

SEQ ID NO: 1370998 - DNA, 15 bp, Homo sapiens
cccccagtccccacc

SEQ ID NO: 1370999 - DNA, 20 bp, Homo sapiens
cccccagtccccacccctgc

SEQ ID NO: 1371000 - DNA, 16 bp, Homo sapiens
ccccctcccaccccca

SEQ ID NO: 1371001 - DNA, 13 bp, Homo sapiens
ccccctgccctgc

SEQ ID NO: 1371002 - DNA, 18 bp, Homo sapiens
ccccctgcttcagtccct

SEQ ID NO: 1371003 - DNA, 15 bp, Homo sapiens
ccccctggcctctgt

SEQ ID NO: 1371004 - DNA, 22 bp, Homo sapiens
ccccctggcctctgtgccttct

SEQ ID NO: 1371005 - DNA, 17 bp, Homo sapiens
ccccgactccagccagc

SEQ ID NO: 1371006 - DNA, 18 bp, Homo sapiens
ccccgactccagccagcg

SEQ ID NO: 1371007 - DNA, 12 bp, Homo sapiens
ccccgcccccag

SEQ ID NO: 1371008 - DNA, 16 bp, Homo sapiens
ccccgcccccagtccc

SEQ ID NO: 1371009 - DNA, 16 bp, Homo sapiens
ccccgcctggccagga

SEQ ID NO: 1371010 - DNA, 14 bp, Homo sapiens
ccccgcttctgcct

SEQ ID NO: 1371011 - DNA, 17 bp, Homo sapiens
ccccggggaccctgtga

SEQ ID NO: 1371012 - DNA, 13 bp, Homo sapiens
ccccgtggggcag

SEQ ID NO: 1371013 - DNA, 21 bp, Homo sapiens
cccctaaaagcactcctgctt

SEQ ID NO: 1371014 - DNA, 14 bp, Homo sapiens
cccctcagctcggc

SEQ ID NO: 1371015 - DNA, 18 bp, Homo sapiens
cccctccgccctgccact

SEQ ID NO: 1371016 - DNA, 13 bp, Homo sapiens
cccctccttcaga

SEQ ID NO: 1371017 - DNA, 18 bp, Homo sapiens
cccctctgcacccagaac

SEQ ID NO: 1371018 - DNA, 19 bp, Homo sapiens
cccctctgcacccagaaca

SEQ ID NO: 1371019 - DNA, 19 bp, Homo sapiens
cccctctggtcgctcctgc

SEQ ID NO: 1371020 - DNA, 12 bp, Homo sapiens
cccctgccctgc

SEQ ID NO: 1371021 - DNA, 16 bp, Homo sapiens
cccctggccgcgctcc

SEQ ID NO: 1371022 - DNA, 18 bp, Homo sapiens
cccctgggcttggcctgc

SEQ ID NO: 1371023 - DNA, 22 bp, Homo sapiens
cccctgggcttggcctgctgtg

SEQ ID NO: 1371024 - DNA, 19 bp, Homo sapiens
ccccttcctcttgtctgat

SEQ ID NO: 1371025 - DNA, 12 bp, Homo sapiens
cccgacatggct

SEQ ID NO: 1371026 - DNA, 20 bp, Homo sapiens
cccgactccagccagcgcct

SEQ ID NO: 1371027 - DNA, 13 bp, Homo sapiens
cccgcagagcgcg

SEQ ID NO: 1371028 - DNA, 22 bp, Homo sapiens
cccgcagagcgcgcccctagcc

SEQ ID NO: 1371029 - DNA, 16 bp, Homo sapiens
cccgcctggccaggag

SEQ ID NO: 1371030 - DNA, 16 bp, Homo sapiens
cccggctgcagaggcc

SEQ ID NO: 1371031 - DNA, 20 bp, Homo sapiens
cccggcttcctttcccaagc

SEQ ID NO: 1371032 - DNA, 23 bp, Homo sapiens
cccgggaacctccccagcctgcg

SEQ ID NO: 1371033 - DNA, 16 bp, Homo sapiens
cccggggcccagggca

SEQ ID NO: 1371034 - DNA, 16 bp, Homo sapiens
cccggggtggccacag

SEQ ID NO: 1371035 - DNA, 14 bp, Homo sapiens
cccgtcctgcctgt

SEQ ID NO: 1371036 - DNA, 22 bp, Homo sapiens
cccgtggggcagggagctgggc

SEQ ID NO: 1371037 - DNA, 17 bp, Homo sapiens
ccctaaccccttccaga

SEQ ID NO: 1371038 - DNA, 13 bp, Homo sapiens
ccctaaggtccta

SEQ ID NO: 1371039 - DNA, 22 bp, Homo sapiens
ccctaatctatggtcgggagac

SEQ ID NO: 1371040 - DNA, 23 bp, Homo sapiens
ccctactattcagtggcgagaaa

SEQ ID NO: 1371041 - DNA, 15 bp, Homo sapiens
ccctactccctgcag

SEQ ID NO: 1371042 - DNA, 16 bp, Homo sapiens
ccctactccctgcaga

SEQ ID NO: 1371043 - DNA, 19 bp, Homo sapiens
ccctactccctgcagatgc

SEQ ID NO: 1371044 - DNA, 21 bp, Homo sapiens
ccctactccctgcagatgcca

SEQ ID NO: 1371045 - DNA, 23 bp, Homo sapiens
ccctagcagcccaccctgctgct

SEQ ID NO: 1371046 - DNA, 13 bp, Homo sapiens
ccctatctcctga

SEQ ID NO: 1371047 - DNA, 18 bp, Homo sapiens
ccctattagagaagagat

SEQ ID NO: 1371048 - DNA, 15 bp, Homo sapiens
ccctcccacccccag

SEQ ID NO: 1371049 - DNA, 16 bp, Homo sapiens
ccctcccacccccagc

SEQ ID NO: 1371050 - DNA, 20 bp, Homo sapiens
ccctcccacccccagccccg

SEQ ID NO: 1371051 - DNA, 14 bp, Homo sapiens
ccctccgccctgcc

SEQ ID NO: 1371052 - DNA, 15 bp, Homo sapiens
ccctcctccaggcct

SEQ ID NO: 1371053 - DNA, 12 bp, Homo sapiens
ccctccttcaga

SEQ ID NO: 1371054 - DNA, 16 bp, Homo sapiens
ccctcggtgggagcca

SEQ ID NO: 1371055 - DNA, 19 bp, Homo sapiens
ccctctaacctcgccctct

SEQ ID NO: 1371056 - DNA, 19 bp, Homo sapiens
catcagttttgtttactca

SEQ ID NO: 1371057 - DNA, 12 bp, Homo sapiens
catcatgcatgt

SEQ ID NO: 1371058 - DNA, 20 bp, Homo sapiens
catcattcctttttatttat

SEQ ID NO: 1371059 - DNA, 15 bp, Homo sapiens
catccaactccagca

SEQ ID NO: 1371060 - DNA, 18 bp, Homo sapiens
catccacaataaccaaga

SEQ ID NO: 1371061 - DNA, 17 bp, Homo sapiens
catccagactcagagct

SEQ ID NO: 1371062 - DNA, 14 bp, Homo sapiens
catccagatgtggc

SEQ ID NO: 1371063 - DNA, 15 bp, Homo sapiens
catccagatgtggct

SEQ ID NO: 1371064 - DNA, 23 bp, Homo sapiens
catccagtctcccaacttgtatt

SEQ ID NO: 1371065 - DNA, 23 bp, Homo sapiens
catccctaccgacccagggttcc

SEQ ID NO: 1371066 - DNA, 14 bp, Homo sapiens
catcctaccctttt

SEQ ID NO: 1371067 - DNA, 20 bp, Homo sapiens
catcctcctcccacccggct

SEQ ID NO: 1371068 - DNA, 23 bp, Homo sapiens
catcctgtgccactaaactacat

SEQ ID NO: 1371069 - DNA, 19 bp, Homo sapiens
catcgcaccattctgactc

SEQ ID NO: 1371070 - DNA, 15 bp, Homo sapiens
catcgccacaaactc

SEQ ID NO: 1371071 - DNA, 21 bp, Homo sapiens
catctaattctctgtggaatg

SEQ ID NO: 1371072 - DNA, 15 bp, Homo sapiens
catctaattctgatt

SEQ ID NO: 1371073 - DNA, 13 bp, Homo sapiens
catctatctagtt

SEQ ID NO: 1371074 - DNA, 20 bp, Homo sapiens
catctatctcatctatctca

SEQ ID NO: 1371075 - DNA, 23 bp, Homo sapiens
catctcatttaagggaaaaatat

SEQ ID NO: 1371076 - DNA, 21 bp, Homo sapiens
catctcccctcagctcggctc

SEQ ID NO: 1371077 - DNA, 17 bp, Homo sapiens
catctccctgcctggcc

SEQ ID NO: 1371078 - DNA, 18 bp, Homo sapiens
catctccctgcctggccc

SEQ ID NO: 1371079 - DNA, 14 bp, Homo sapiens
catctgaaatgtta

SEQ ID NO: 1371080 - DNA, 15 bp, Homo sapiens
catctgaggttttat

SEQ ID NO: 1371081 - DNA, 12 bp, Homo sapiens
catctgcaaaag

SEQ ID NO: 1371082 - DNA, 23 bp, Homo sapiens
catctgcaaaaggcctcttgtaa

SEQ ID NO: 1371083 - DNA, 21 bp, Homo sapiens
ccaaagctgagcctgcaggga

SEQ ID NO: 1371084 - DNA, 13 bp, Homo sapiens
ccaaagctgccca

SEQ ID NO: 1371085 - DNA, 14 bp, Homo sapiens
ccaaaggaaaatgt

SEQ ID NO: 1371086 - DNA, 20 bp, Homo sapiens
ccaaaggaaaatgtctgtaa

SEQ ID NO: 1371087 - DNA, 21 bp, Homo sapiens
ccaaagtgccggtgagaccca

SEQ ID NO: 1371088 - DNA, 20 bp, Homo sapiens
ccaaatattaggcttaaaaa

SEQ ID NO: 1371089 - DNA, 20 bp, Homo sapiens
ccaacctcagggctcccagg

SEQ ID NO: 1371090 - DNA, 16 bp, Homo sapiens
ccaacctttccctcac

SEQ ID NO: 1371091 - DNA, 16 bp, Homo sapiens
ccaactatttattgac

SEQ ID NO: 1371092 - DNA, 23 bp, Homo sapiens
ccaactatttattgactctgggt

SEQ ID NO: 1371093 - DNA, 21 bp, Homo sapiens
ccaagaaagctcactgtagct

SEQ ID NO: 1371094 - DNA, 18 bp, Homo sapiens
ccaagaagcagtggcctt

SEQ ID NO: 1371095 - DNA, 16 bp, Homo sapiens
ccaagaatattgcaaa

SEQ ID NO: 1371096 - DNA, 21 bp, Homo sapiens
ccaagaatattgcaaaataca

SEQ ID NO: 1371097 - DNA, 17 bp, Homo sapiens
ccaagatttaaatgcca

SEQ ID NO: 1371098 - DNA, 16 bp, Homo sapiens
ccaagattttcctctt

SEQ ID NO: 1371099 - DNA, 22 bp, Homo sapiens
ccaagcatcttgggggggtggc

SEQ ID NO: 1371100 - DNA, 15 bp, Homo sapiens
ccaagcctccacagc

SEQ ID NO: 1371101 - DNA, 19 bp, Homo sapiens
ccaagcctccacagcgagg

SEQ ID NO: 1371102 - DNA, 20 bp, Homo sapiens
ccaagcctccacagcgaggg

SEQ ID NO: 1371103 - DNA, 17 bp, Homo sapiens
ccaagctccaagcccca

SEQ ID NO: 1371104 - DNA, 14 bp, Homo sapiens
ccaaggctggcagg

SEQ ID NO: 1371105 - DNA, 17 bp, Homo sapiens
ccaagggaaaggggtgc

SEQ ID NO: 1371106 - DNA, 16 bp, Homo sapiens
ccaagggaacctgtgt

SEQ ID NO: 1371107 - DNA, 18 bp, Homo sapiens
ccaaggtgggaggattgc

SEQ ID NO: 1371108 - DNA, 20 bp, Homo sapiens
ccaagtaactgggattacag

SEQ ID NO: 1371109 - DNA, 15 bp, Homo sapiens
ccaatcttactttgt

SEQ ID NO: 1371110 - DNA, 15 bp, Homo sapiens
ccacaacctcttccc

SEQ ID NO: 1371111 - DNA, 15 bp, Homo sapiens
ccacacagaatgcaa

SEQ ID NO: 1371112 - DNA, 19 bp, Homo sapiens
ccacaccccaacacttcca

SEQ ID NO: 1371113 - DNA, 21 bp, Homo sapiens
ccacaccccaacacttccagc

SEQ ID NO: 1371114 - DNA, 17 bp, Homo sapiens
ccacacttgaaaccttt

SEQ ID NO: 1371115 - DNA, 15 bp, Homo sapiens
ccacagcgagggcag

SEQ ID NO: 1371116 - DNA, 21 bp, Homo sapiens
ccacagcgagggcagctgcta

SEQ ID NO: 1371117 - DNA, 13 bp, Homo sapiens
ccacagcgccagc

SEQ ID NO: 1371118 - DNA, 24 bp, Homo sapiens
ccacagcgccagcctcagactgga

SEQ ID NO: 1371119 - DNA, 16 bp, Homo sapiens
ccacagcgtccctggc

SEQ ID NO: 1371120 - DNA, 21 bp, Homo sapiens
ccacagcgtccctggcgcagg

SEQ ID NO: 1371121 - DNA, 14 bp, Homo sapiens
ccacatcaaacctt

SEQ ID NO: 1371122 - DNA, 13 bp, Homo sapiens
ccacatctgcctt

SEQ ID NO: 1371123 - DNA, 14 bp, Homo sapiens
ccacatctgcctta

SEQ ID NO: 1371124 - DNA, 20 bp, Homo sapiens
ccaccacagccagcacctgg

SEQ ID NO: 1371125 - DNA, 18 bp, Homo sapiens
ccaccagcatcacctgcc

SEQ ID NO: 1371126 - DNA, 13 bp, Homo sapiens
ccaccaggccacc

SEQ ID NO: 1371127 - DNA, 21 bp, Homo sapiens
ccaccaggccacctccccagc

SEQ ID NO: 1371128 - DNA, 19 bp, Homo sapiens
ccacccaaccctatctcct

SEQ ID NO: 1371129 - DNA, 14 bp, Homo sapiens
ccaccccctgccct

SEQ ID NO: 1371130 - DNA, 19 bp, Homo sapiens
ccaccccggccccctgccc

SEQ ID NO: 1371131 - DNA, 18 bp, Homo sapiens
ccaccccggggaccctgt

SEQ ID NO: 1371132 - DNA, 13 bp, Homo sapiens
ccacccctgcccc

SEQ ID NO: 1371133 - DNA, 22 bp, Homo sapiens
ccacccctgcccccagccccgg

SEQ ID NO: 1371134 - DNA, 16 bp, Homo sapiens
ccaccctgaaagccct

SEQ ID NO: 1371135 - DNA, 13 bp, Homo sapiens
ccaccctgggccc

SEQ ID NO: 1371136 - DNA, 22 bp, Homo sapiens
ccaccctgggccctgggctgga

SEQ ID NO: 1371137 - DNA, 15 bp, Homo sapiens
ccaccggtccagctg

SEQ ID NO: 1371138 - DNA, 13 bp, Homo sapiens
ccaccgtggagga

SEQ ID NO: 1371139 - DNA, 14 bp, Homo sapiens
ccacctagaacact

SEQ ID NO: 1371140 - DNA, 19 bp, Homo sapiens
ccacctcacctagcctgat

SEQ ID NO: 1371141 - DNA, 19 bp, Homo sapiens
ccacctcggtcactccaac

SEQ ID NO: 1371142 - DNA, 21 bp, Homo sapiens
ccacgaatttctgtgccctcc

SEQ ID NO: 1371143 - DNA, 21 bp, Homo sapiens
ccacgcccgtcctgcctgtgg

SEQ ID NO: 1371144 - DNA, 19 bp, Homo sapiens
ccacgcctcttgaccaggc

SEQ ID NO: 1371145 - DNA, 20 bp, Homo sapiens
ccacgggacatcacagggtg

SEQ ID NO: 1371146 - DNA, 21 bp, Homo sapiens
ccacgttggagaagcccgtgt

SEQ ID NO: 1371147 - DNA, 12 bp, Homo sapiens
ccactaaaaata

SEQ ID NO: 1371148 - DNA, 13 bp, Homo sapiens
ccactaaaaatat

SEQ ID NO: 1371149 - DNA, 14 bp, Homo sapiens
ccactaaaaatatt

SEQ ID NO: 1371150 - DNA, 17 bp, Homo sapiens
ccactacacctggctga

SEQ ID NO: 1371151 - DNA, 18 bp, Homo sapiens
ccactcccttgctggccc

SEQ ID NO: 1371152 - DNA, 20 bp, Homo sapiens
ccactcccttgctggcccca

SEQ ID NO: 1371153 - DNA, 23 bp, Homo sapiens
ccactccgagaggtgggccagtc

SEQ ID NO: 1371154 - DNA, 18 bp, Homo sapiens
ccactcgtgcatccctga

SEQ ID NO: 1371155 - DNA, 14 bp, Homo sapiens
ccactctgcttctc

SEQ ID NO: 1371156 - DNA, 13 bp, Homo sapiens
ccactgccagcag

SEQ ID NO: 1371157 - DNA, 17 bp, Homo sapiens
ccactgccagcagcagc

SEQ ID NO: 1371158 - DNA, 11 bp, Homo sapiens
ccactgggagg

SEQ ID NO: 1371159 - DNA, 20 bp, Homo sapiens
ccactggtccccaacaatgt

SEQ ID NO: 1371160 - DNA, 14 bp, Homo sapiens
ccactgtgaagaga

SEQ ID NO: 1371161 - DNA, 18 bp, Homo sapiens
ccactgtttctcttgagc

SEQ ID NO: 1371162 - DNA, 13 bp, Homo sapiens
ccacttcactgcg

SEQ ID NO: 1371163 - DNA, 14 bp, Homo sapiens
ccacttcagctgac

SEQ ID NO: 1371164 - DNA, 15 bp, Homo sapiens
ccacttcccaccctg

SEQ ID NO: 1371165 - DNA, 13 bp, Homo sapiens
ccacttcctttta

SEQ ID NO: 1371166 - DNA, 18 bp, Homo sapiens
ccacttgaggcctgatct

SEQ ID NO: 1371167 - DNA, 16 bp, Homo sapiens
ccacttgcctcttcct

SEQ ID NO: 1371168 - DNA, 12 bp, Homo sapiens
ccacttgtagat

SEQ ID NO: 1371169 - DNA, 20 bp, Homo sapiens
ccacttgtagatttgatttt

SEQ ID NO: 1371170 - DNA, 13 bp, Homo sapiens
ccagcccagggct

SEQ ID NO: 1371171 - DNA, 15 bp, Homo sapiens
ccagcccagggctcc

SEQ ID NO: 1371172 - DNA, 19 bp, Homo sapiens
ccagccccgactccagcca

SEQ ID NO: 1371173 - DNA, 21 bp, Homo sapiens
ccagccccgactccagccagc

SEQ ID NO: 1371174 - DNA, 22 bp, Homo sapiens
ccagccccgactccagccagcg

SEQ ID NO: 1371175 - DNA, 17 bp, Homo sapiens
ccagccccggggtgagt

SEQ ID NO: 1371176 - DNA, 13 bp, Homo sapiens
ccagcccctctgg

SEQ ID NO: 1371177 - DNA, 17 bp, Homo sapiens
ccagcccctctggtcgc

SEQ ID NO: 1371178 - DNA, 15 bp, Homo sapiens
ccagcccctcttccc

SEQ ID NO: 1371179 - DNA, 22 bp, Homo sapiens
ccagcccggccgctccaccagc

SEQ ID NO: 1371180 - DNA, 14 bp, Homo sapiens
ccagccctccccat

SEQ ID NO: 1371181 - DNA, 20 bp, Homo sapiens
ccagccctccccatggagcc

SEQ ID NO: 1371182 - DNA, 19 bp, Homo sapiens
ccagccctgctggggatcc

SEQ ID NO: 1371183 - DNA, 20 bp, Homo sapiens
ccagccctgctggggatccc

SEQ ID NO: 1371184 - DNA, 22 bp, Homo sapiens
ccagccctgctggggatccccg

SEQ ID NO: 1371185 - DNA, 14 bp, Homo sapiens
ccagccgccatgct

SEQ ID NO: 1371186 - DNA, 11 bp, Homo sapiens
ccagcctccct

SEQ ID NO: 1371187 - DNA, 14 bp, Homo sapiens
ccagcctcctctgg

SEQ ID NO: 1371188 - DNA, 15 bp, Homo sapiens
ccagcctcctctgga

SEQ ID NO: 1371189 - DNA, 13 bp, Homo sapiens
ccagcctgcgcct

SEQ ID NO: 1371190 - DNA, 16 bp, Homo sapiens
ccagcctgcgcctgct

SEQ ID NO: 1371191 - DNA, 17 bp, Homo sapiens
ccagcctgcgcctgctg

SEQ ID NO: 1371192 - DNA, 21 bp, Homo sapiens
ccagcctgctagctagctcaa

SEQ ID NO: 1371193 - DNA, 19 bp, Homo sapiens
ccagcgatctctccactgt

SEQ ID NO: 1371194 - DNA, 18 bp, Homo sapiens
ccagcgcctccctccacc

SEQ ID NO: 1371195 - DNA, 23 bp, Homo sapiens
ccagcgcctccctccaccccagg

SEQ ID NO: 1371196 - DNA, 15 bp, Homo sapiens
ccagctacttgggag

SEQ ID NO: 1371197 - DNA, 19 bp, Homo sapiens
ccagctacttgggaggctg

SEQ ID NO: 1371198 - DNA, 16 bp, Homo sapiens
ccagctccctctattt

SEQ ID NO: 1371199 - DNA, 21 bp, Homo sapiens
ccagctgcccttccgcagtgt

SEQ ID NO: 1371200 - DNA, 17 bp, Homo sapiens
ccagctgcgcttgcttt

SEQ ID NO: 1371201 - DNA, 18 bp, Homo sapiens
ccagctgcgcttgctttt

SEQ ID NO: 1371202 - DNA, 22 bp, Homo sapiens
ccagctgctccgaggacccagg

SEQ ID NO: 1371203 - DNA, 12 bp, Homo sapiens
ccagctggcctg

SEQ ID NO: 1371204 - DNA, 13 bp, Homo sapiens
ccagctggccttt

SEQ ID NO: 1371205 - DNA, 14 bp, Homo sapiens
ccagctggcctttg

SEQ ID NO: 1371206 - DNA, 16 bp, Homo sapiens
ccagctgttcagctgg

SEQ ID NO: 1371207 - DNA, 19 bp, Homo sapiens
ccagcttaaaggggctaga

SEQ ID NO: 1371208 - DNA, 16 bp, Homo sapiens
ccagcttatctcaggg

SEQ ID NO: 1371209 - DNA, 19 bp, Homo sapiens
ccagcttggggccaccaaa

SEQ ID NO: 1371210 - DNA, 21 bp, Homo sapiens
ccagcttggggccaccaaagc

SEQ ID NO: 1371211 - DNA, 22 bp, Homo sapiens
ccagcttggggccaccaaagct

SEQ ID NO: 1371212 - DNA, 22 bp, Homo sapiens
ccaggaaactccacatctgcct

SEQ ID NO: 1371213 - DNA, 18 bp, Homo sapiens
ccaggaacagcaaatgca

SEQ ID NO: 1371214 - DNA, 11 bp, Homo sapiens
ccaggaagccg

SEQ ID NO: 1371215 - DNA, 20 bp, Homo sapiens
ccaggacgccactcatttca

SEQ ID NO: 1371216 - DNA, 21 bp, Homo sapiens
ccaggacgccactcatttcat

SEQ ID NO: 1371217 - DNA, 23 bp, Homo sapiens
ccaggacgccactcatttcatct

SEQ ID NO: 1371218 - DNA, 13 bp, Homo sapiens
ccaggagcctcac

SEQ ID NO: 1371219 - DNA, 20 bp, Homo sapiens
ccaggaggcagggaggcagc

SEQ ID NO: 1371220 - DNA, 21 bp, Homo sapiens
ccaggatcccaagcctcctgc

SEQ ID NO: 1371221 - DNA, 22 bp, Homo sapiens
ccaggatcccaagcctcctgct

SEQ ID NO: 1371222 - DNA, 16 bp, Homo sapiens
ccaggcacctcttcct

SEQ ID NO: 1371223 - DNA, 23 bp, Homo sapiens
ccaggcagcctctgtcaggcctt

SEQ ID NO: 1371224 - DNA, 15 bp, Homo sapiens
ccaggcaggggtggg

SEQ ID NO: 1371225 - DNA, 21 bp, Homo sapiens
ccaggcaggggtgggggtgga

SEQ ID NO: 1371226 - DNA, 13 bp, Homo sapiens
ccaggccacctcc

SEQ ID NO: 1371227 - DNA, 13 bp, Homo sapiens
ccaggccagcctc

SEQ ID NO: 1371228 - DNA, 18 bp, Homo sapiens
ccaggccctcctctccca

SEQ ID NO: 1371229 - DNA, 13 bp, Homo sapiens
ccaggcctgcctc

SEQ ID NO: 1371230 - DNA, 17 bp, Homo sapiens
ccaggctcactcacaga

SEQ ID NO: 1371231 - DNA, 18 bp, Homo sapiens
ccaggctcgtggactgag

SEQ ID NO: 1371232 - DNA, 21 bp, Homo sapiens
ccaggctcgtggactgagtgg

SEQ ID NO: 1371233 - DNA, 14 bp, Homo sapiens
ccaggctgccgtgg

SEQ ID NO: 1371234 - DNA, 18 bp, Homo sapiens
ccaggctgccgtggggcc

SEQ ID NO: 1371235 - DNA, 23 bp, Homo sapiens
ccaggctgcctcccttgtggcag

SEQ ID NO: 1371236 - DNA, 17 bp, Homo sapiens
ccagggaatccaagcct

SEQ ID NO: 1371237 - DNA, 13 bp, Homo sapiens
ccagggagccttt

SEQ ID NO: 1371238 - DNA, 18 bp, Homo sapiens
ccagggagcctttggttc

SEQ ID NO: 1371239 - DNA, 23 bp, Homo sapiens
ccagggaggggccggccctgtgt

SEQ ID NO: 1371240 - DNA, 13 bp, Homo sapiens
ccagggccctcgg

SEQ ID NO: 1371241 - DNA, 21 bp, Homo sapiens
ccagggccttttctggcaccg

SEQ ID NO: 1371242 - DNA, 20 bp, Homo sapiens
ccaggggaaaatcagcctgc

SEQ ID NO: 1371243 - DNA, 21 bp, Homo sapiens
ccaggggaaaatcagcctgct

SEQ ID NO: 1371244 - DNA, 20 bp, Homo sapiens
ccaggggctgcttcctcctg

SEQ ID NO: 1371245 - DNA, 21 bp, Homo sapiens
ccaggggctgcttcctcctgg

SEQ ID NO: 1371246 - DNA, 13 bp, Homo sapiens
ccaggggtttctc

SEQ ID NO: 1371247 - DNA, 18 bp, Homo sapiens
ccagggtccctctgtgta

SEQ ID NO: 1371248 - DNA, 15 bp, Homo sapiens
ccaggtaccagctgc

SEQ ID NO: 1371249 - DNA, 23 bp, Homo sapiens
ccaggtaccagctgcgcttgctt

SEQ ID NO: 1371250 - DNA, 20 bp, Homo sapiens
ccaggtgcagaggtaccctg

SEQ ID NO: 1371251 - DNA, 14 bp, Homo sapiens
cagcctcctctgga

SEQ ID NO: 1371252 - DNA, 23 bp, Homo sapiens
cagcctctccccaggtccagctc

SEQ ID NO: 1371253 - DNA, 17 bp, Homo sapiens
cagcctctgaaaaccaa

SEQ ID NO: 1371254 - DNA, 14 bp, Homo sapiens
cagcctgccccgga

SEQ ID NO: 1371255 - DNA, 13 bp, Homo sapiens
cagcctgcgcctg

SEQ ID NO: 1371256 - DNA, 15 bp, Homo sapiens
cagcctgcgcctgct

SEQ ID NO: 1371257 - DNA, 21 bp, Homo sapiens
cagcctgcgcctgctgcatgc

SEQ ID NO: 1371258 - DNA, 16 bp, Homo sapiens
cagcctgctagctagc

SEQ ID NO: 1371259 - DNA, 17 bp, Homo sapiens
cagcctgctccagctgt

SEQ ID NO: 1371260 - DNA, 19 bp, Homo sapiens
cagcctgctccagctgttc

SEQ ID NO: 1371261 - DNA, 16 bp, Homo sapiens
cagcctgggcaatgtg

SEQ ID NO: 1371262 - DNA, 12 bp, Homo sapiens
cagcctgggccc

SEQ ID NO: 1371263 - DNA, 16 bp, Homo sapiens
cagccttgagccctgg

SEQ ID NO: 1371264 - DNA, 15 bp, Homo sapiens
cagcgagggcagctg

SEQ ID NO: 1371265 - DNA, 12 bp, Homo sapiens
cagcgcctccct

SEQ ID NO: 1371266 - DNA, 16 bp, Homo sapiens
cagcgcctccctccac

SEQ ID NO: 1371267 - DNA, 18 bp, Homo sapiens
cagcgcctccctccaccc

SEQ ID NO: 1371268 - DNA, 21 bp, Homo sapiens
cagcgcctccctccaccccag

SEQ ID NO: 1371269 - DNA, 17 bp, Homo sapiens
cagcgcggccctcccga

SEQ ID NO: 1371270 - DNA, 16 bp, Homo sapiens
cagcgtggctctaaaa

SEQ ID NO: 1371271 - DNA, 22 bp, Homo sapiens
cagctaattctactcacagtgc

SEQ ID NO: 1371272 - DNA, 16 bp, Homo sapiens
cagctacacagagctt

SEQ ID NO: 1371273 - DNA, 19 bp, Homo sapiens
cagctacttgggaggctga

SEQ ID NO: 1371274 - DNA, 14 bp, Homo sapiens
cagctcattaaact

SEQ ID NO: 1371275 - DNA, 14 bp, Homo sapiens
cagctcggctcagc

SEQ ID NO: 1371276 - DNA, 16 bp, Homo sapiens
cagctcggtacccggg

SEQ ID NO: 1371277 - DNA, 16 bp, Homo sapiens
cagctctgcaagaatt

SEQ ID NO: 1371278 - DNA, 19 bp, Homo sapiens
cagctctgccgtctctgga

SEQ ID NO: 1371279 - DNA, 22 bp, Homo sapiens
cagctctgccgtctctggagcg

SEQ ID NO: 1371280 - DNA, 11 bp, Homo sapiens
cagctctggag

SEQ ID NO: 1371281 - DNA, 21 bp, Homo sapiens
cagctgacttttctgtccgag

SEQ ID NO: 1371282 - DNA, 18 bp, Homo sapiens
cagctgcaattccctgga

SEQ ID NO: 1371283 - DNA, 19 bp, Homo sapiens
cagctgcgcttgcttttct

SEQ ID NO: 1371284 - DNA, 22 bp, Homo sapiens
cagctgctatttattttcctaa

SEQ ID NO: 1371285 - DNA, 23 bp, Homo sapiens
cagctgctccgaggacccaggaa

SEQ ID NO: 1371286 - DNA, 14 bp, Homo sapiens
cagctggcctggac

SEQ ID NO: 1371287 - DNA, 16 bp, Homo sapiens
cagctggcctttgtaa

SEQ ID NO: 1371288 - DNA, 15 bp, Homo sapiens
cagctgttcagctgg

SEQ ID NO: 1371289 - DNA, 17 bp, Homo sapiens
cagcttgacctgaggct

SEQ ID NO: 1371290 - DNA, 21 bp, Homo sapiens
cagcttgacctgaggctgtgg

SEQ ID NO: 1371291 - DNA, 23 bp, Homo sapiens
cagcttgacctgaggctgtggtc

SEQ ID NO: 1371292 - DNA, 14 bp, Homo sapiens
cagcttgagccggg

SEQ ID NO: 1371293 - DNA, 21 bp, Homo sapiens
cagctttcatctttgtggatg

SEQ ID NO: 1371294 - DNA, 20 bp, Homo sapiens
cagctttcatgattagcaag

SEQ ID NO: 1371295 - DNA, 19 bp, Homo sapiens
cagctttgagaagccttca

SEQ ID NO: 1371296 - DNA, 12 bp, Homo sapiens
cagctttgtttg

SEQ ID NO: 1371297 - DNA, 23 bp, Homo sapiens
cagctttgtttgttgtcagctga

SEQ ID NO: 1371298 - DNA, 16 bp, Homo sapiens
caggaaagtggccaag

SEQ ID NO: 1371299 - DNA, 18 bp, Homo sapiens
caggaagcccaggagcct

SEQ ID NO: 1371300 - DNA, 15 bp, Homo sapiens
caggacatgcaataa

SEQ ID NO: 1371301 - DNA, 21 bp, Homo sapiens
caggacatgcaataaaattta

SEQ ID NO: 1371302 - DNA, 13 bp, Homo sapiens
caggacctcaggt

SEQ ID NO: 1371303 - DNA, 18 bp, Homo sapiens
caggacgccactcatttc

SEQ ID NO: 1371304 - DNA, 20 bp, Homo sapiens
caggacgccactcatttcat

SEQ ID NO: 1371305 - DNA, 19 bp, Homo sapiens
caggaggatcacttgagtc

SEQ ID NO: 1371306 - DNA, 23 bp, Homo sapiens
caggaggcaggcatggccctggg

SEQ ID NO: 1371307 - DNA, 22 bp, Homo sapiens
caggaggcgcccttggcttctg

SEQ ID NO: 1371308 - DNA, 14 bp, Homo sapiens
caggagtccacttt

SEQ ID NO: 1371309 - DNA, 17 bp, Homo sapiens
caggcaaagaaaatgaa

SEQ ID NO: 1371310 - DNA, 15 bp, Homo sapiens
caggcacctcttcct

SEQ ID NO: 1371311 - DNA, 13 bp, Homo sapiens
caggcagcctctg

SEQ ID NO: 1371312 - DNA, 17 bp, Homo sapiens
caggcagcctctgtcag

SEQ ID NO: 1371313 - DNA, 21 bp, Homo sapiens
caggcaggggtgggggtggag

SEQ ID NO: 1371314 - DNA, 22 bp, Homo sapiens
caggcaggggtgggggtggagg

SEQ ID NO: 1371315 - DNA, 15 bp, Homo sapiens
caggcaggtgggatg

SEQ ID NO: 1371316 - DNA, 17 bp, Homo sapiens
caggcatggtggcccac

SEQ ID NO: 1371317 - DNA, 19 bp, Homo sapiens
caggccacctccccagcat

SEQ ID NO: 1371318 - DNA, 11 bp, Homo sapiens
caggccagcct

SEQ ID NO: 1371319 - DNA, 16 bp, Homo sapiens
caggccagcctccgag

SEQ ID NO: 1371320 - DNA, 23 bp, Homo sapiens
caggccagcctccgagagggaga

SEQ ID NO: 1371321 - DNA, 16 bp, Homo sapiens
caggccattctgccgc

SEQ ID NO: 1371322 - DNA, 15 bp, Homo sapiens
caggccctggcctcc

SEQ ID NO: 1371323 - DNA, 20 bp, Homo sapiens
caggccctggcctcccctgc

SEQ ID NO: 1371324 - DNA, 17 bp, Homo sapiens
caggcctctccatttgc

SEQ ID NO: 1371325 - DNA, 18 bp, Homo sapiens
caggctcactgccaggcc

SEQ ID NO: 1371326 - DNA, 21 bp, Homo sapiens
caggctcactgccaggccagc

SEQ ID NO: 1371327 - DNA, 22 bp, Homo sapiens
caggctcactgccaggccagcc

SEQ ID NO: 1371328 - DNA, 24 bp, Homo sapiens
caggctcccaggagcctgcccagc

SEQ ID NO: 1371329 - DNA, 14 bp, Homo sapiens
caggctggccagtc

SEQ ID NO: 1371330 - DNA, 10 bp, Homo sapiens
caggctgggc

SEQ ID NO: 1371331 - DNA, 13 bp, Homo sapiens
caggctttcccac

SEQ ID NO: 1371332 - DNA, 22 bp, Homo sapiens
cagggaagccccacatgtccag

SEQ ID NO: 1371333 - DNA, 14 bp, Homo sapiens
cagggaatccaagc

SEQ ID NO: 1371334 - DNA, 18 bp, Homo sapiens
cagggaatccaagcctcc

SEQ ID NO: 1371335 - DNA, 21 bp, Homo sapiens
cagggagacggtttccaggga

SEQ ID NO: 1371336 - DNA, 23 bp, Homo sapiens
cagggagacggtttccagggagg

SEQ ID NO: 1371337 - DNA, 13 bp, Homo sapiens
cagggaggcagcc

SEQ ID NO: 1371338 - DNA, 21 bp, Homo sapiens
cagggaggcagccgccccatc

SEQ ID NO: 1371339 - DNA, 12 bp, Homo sapiens
cagggaggggcc

SEQ ID NO: 1371340 - DNA, 13 bp, Homo sapiens
cagggcaagctcc

SEQ ID NO: 1371341 - DNA, 15 bp, Homo sapiens
cagggcaagctccgc

SEQ ID NO: 1371342 - DNA, 18 bp, Homo sapiens
cagggccatgctgaggcc

SEQ ID NO: 1371343 - DNA, 21 bp, Homo sapiens
cagggccatgctgaggcctgg

SEQ ID NO: 1371344 - DNA, 23 bp, Homo sapiens
cagggccatgctgaggcctgggc

SEQ ID NO: 1371345 - DNA, 23 bp, Homo sapiens
cagggccgaccagaggagccttt

SEQ ID NO: 1371346 - DNA, 12 bp, Homo sapiens
cagggctcccag

SEQ ID NO: 1371347 - DNA, 21 bp, Homo sapiens
cagggctgctgggggcaactg

SEQ ID NO: 1371348 - DNA, 20 bp, Homo sapiens
caggggaaaatcagcctgct

SEQ ID NO: 1371349 - DNA, 22 bp, Homo sapiens
caggggacaggagtccactttg

SEQ ID NO: 1371350 - DNA, 15 bp, Homo sapiens
caggggcctggagat

SEQ ID NO: 1371351 - DNA, 16 bp, Homo sapiens
caggggctgcttcctc

SEQ ID NO: 1371352 - DNA, 20 bp, Homo sapiens
caggggctgcttcctcctgg

SEQ ID NO: 1371353 - DNA, 17 bp, Homo sapiens
cagggggcatgaccaga

SEQ ID NO: 1371354 - DNA, 14 bp, Homo sapiens
caggggtctccctg

SEQ ID NO: 1371355 - DNA, 23 bp, Homo sapiens
cagggtatggactatctgtctgg

SEQ ID NO: 1371356 - DNA, 21 bp, Homo sapiens
cagggtattccagagtgggga

SEQ ID NO: 1371357 - DNA, 16 bp, Homo sapiens
cagggtccctctgtgt

SEQ ID NO: 1371358 - DNA, 15 bp, Homo sapiens
cagggtgcagcccaa

SEQ ID NO: 1371359 - DNA, 19 bp, Homo sapiens
cagggttcccgcggggctg

SEQ ID NO: 1371360 - DNA, 13 bp, Homo sapiens
caggtaccagctg

SEQ ID NO: 1371361 - DNA, 15 bp, Homo sapiens
caggtaccagctgcg

SEQ ID NO: 1371362 - DNA, 14 bp, Homo sapiens
caggtccagctctg

SEQ ID NO: 1371363 - DNA, 16 bp, Homo sapiens
caggtccagctctgga

SEQ ID NO: 1371364 - DNA, 21 bp, Homo sapiens
caggtgagaagcagaggaagg

SEQ ID NO: 1371365 - DNA, 23 bp, Homo sapiens
caggtgcagaggtaccctgggtg

SEQ ID NO: 1371366 - DNA, 22 bp, Homo sapiens
caggtgctggagcactgggctc

SEQ ID NO: 1371367 - DNA, 18 bp, Homo sapiens
caggtggttatggagagg

SEQ ID NO: 1371368 - DNA, 20 bp, Homo sapiens
caggttctccgttagctcct

SEQ ID NO: 1371369 - DNA, 21 bp, Homo sapiens
caggttctccgttagctcctg

SEQ ID NO: 1371370 - DNA, 14 bp, Homo sapiens
caggtttaagctgt

SEQ ID NO: 1371371 - DNA, 18 bp, Homo sapiens
cagaagttagtttgtata

SEQ ID NO: 1371372 - DNA, 19 bp, Homo sapiens
cagaagttagtttgtatat

SEQ ID NO: 1371373 - DNA, 23 bp, Homo sapiens
cagaagtttgagatcagcctggg

SEQ ID NO: 1371374 - DNA, 18 bp, Homo sapiens
cagaataagttattgcag

SEQ ID NO: 1371375 - DNA, 23 bp, Homo sapiens
cagaataagttattgcagtttat

SEQ ID NO: 1371376 - DNA, 21 bp, Homo sapiens
cagaatatttttatatttcct

SEQ ID NO: 1371377 - DNA, 20 bp, Homo sapiens
cagaatgcaaccaagtcaca

SEQ ID NO: 1371378 - DNA, 21 bp, Homo sapiens
cagaatgcaaccaagtcacac

SEQ ID NO: 1371379 - DNA, 18 bp, Homo sapiens
cagaatgctgcaggactt

SEQ ID NO: 1371380 - DNA, 13 bp, Homo sapiens
cagaatgtaagtg

SEQ ID NO: 1371381 - DNA, 21 bp, Homo sapiens
cagaatgtaagtgggcccacc

SEQ ID NO: 1371382 - DNA, 23 bp, Homo sapiens
cagaatgtaagtgggcccacccg

SEQ ID NO: 1371383 - DNA, 20 bp, Homo sapiens
cagacaataaaccctcagag

SEQ ID NO: 1371384 - DNA, 23 bp, Homo sapiens
cagacaataaaccctcagagcct

SEQ ID NO: 1371385 - DNA, 14 bp, Homo sapiens
cagacaccctcaac

SEQ ID NO: 1371386 - DNA, 21 bp, Homo sapiens
cagacaccctcaacctcttct

SEQ ID NO: 1371387 - DNA, 20 bp, Homo sapiens
cagacagaacttgaatgtgt

SEQ ID NO: 1371388 - DNA, 20 bp, Homo sapiens
cagacatctgaggttttatt

SEQ ID NO: 1371389 - DNA, 22 bp, Homo sapiens
cagaccacgcccgtcctgcctg

SEQ ID NO: 1371390 - DNA, 21 bp, Homo sapiens
cagacctggaagaacaggcct

SEQ ID NO: 1371391 - DNA, 16 bp, Homo sapiens
cagactcagagctctc

SEQ ID NO: 1371392 - DNA, 20 bp, Homo sapiens
cagactcagagctctctcta

SEQ ID NO: 1371393 - DNA, 16 bp, Homo sapiens
cagactggggcatcct

SEQ ID NO: 1371394 - DNA, 22 bp, Homo sapiens
cagactggggcatcctgtgcca

SEQ ID NO: 1371395 - DNA, 24 bp, Homo sapiens
cagacttccttgagacacggagcc

SEQ ID NO: 1371396 - DNA, 14 bp, Homo sapiens
cagacttggctcag

SEQ ID NO: 1371397 - DNA, 20 bp, Homo sapiens
cagagaaaaatgctccccac

SEQ ID NO: 1371398 - DNA, 21 bp, Homo sapiens
cagagacactgttgataaaaa

SEQ ID NO: 1371399 - DNA, 22 bp, Homo sapiens
cagagacactgttgataaaaac

SEQ ID NO: 1371400 - DNA, 16 bp, Homo sapiens
cagagacagatacctc

SEQ ID NO: 1371401 - DNA, 14 bp, Homo sapiens
cagagactttgtag

SEQ ID NO: 1371402 - DNA, 20 bp, Homo sapiens
cagagagcctggtgctgctg

SEQ ID NO: 1371403 - DNA, 19 bp, Homo sapiens
cagagaggaaattctccac

SEQ ID NO: 1371404 - DNA, 16 bp, Homo sapiens
cagagatttctcattg

SEQ ID NO: 1371405 - DNA, 15 bp, Homo sapiens
cagagccttctcaga

SEQ ID NO: 1371406 - DNA, 16 bp, Homo sapiens
cagagccttctcagaa

SEQ ID NO: 1371407 - DNA, 19 bp, Homo sapiens
cagagccttctcagaagca

SEQ ID NO: 1371408 - DNA, 20 bp, Homo sapiens
cagagccttctcagaagcac

SEQ ID NO: 1371409 - DNA, 21 bp, Homo sapiens
cagagccttctcagaagcaca

SEQ ID NO: 1371410 - DNA, 17 bp, Homo sapiens
cagagcgcgcccctagc

SEQ ID NO: 1371411 - DNA, 12 bp, Homo sapiens
cagagctctctc

SEQ ID NO: 1371412 - DNA, 17 bp, Homo sapiens
cagagctctctctacag

SEQ ID NO: 1371413 - DNA, 13 bp, Homo sapiens
cagagctggctct

SEQ ID NO: 1371414 - DNA, 15 bp, Homo sapiens
cagagctttggtctg

SEQ ID NO: 1371415 - DNA, 20 bp, Homo sapiens
cagagctttggtctgtgtgt

SEQ ID NO: 1371416 - DNA, 16 bp, Homo sapiens
cagaggaatcctggca

SEQ ID NO: 1371417 - DNA, 16 bp, Homo sapiens
cagaggaccagggcct

SEQ ID NO: 1371418 - DNA, 15 bp, Homo sapiens
cagaggagccttttt

SEQ ID NO: 1371419 - DNA, 23 bp, Homo sapiens
cagaggcccccagcccagggctc

SEQ ID NO: 1371420 - DNA, 24 bp, Homo sapiens
cagaggcccccagcccagggctcc

SEQ ID NO: 1371421 - DNA, 12 bp, Homo sapiens
cagaggctgggt

SEQ ID NO: 1371422 - DNA, 14 bp, Homo sapiens
cagaggctgggttc

SEQ ID NO: 1371423 - DNA, 17 bp, Homo sapiens
cagaggtaccctgggtg

SEQ ID NO: 1371424 - DNA, 18 bp, Homo sapiens
cagaggtaccctgggtgt

SEQ ID NO: 1371425 - DNA, 18 bp, Homo sapiens
cagaggttgtgcactgtt

SEQ ID NO: 1371426 - DNA, 15 bp, Homo sapiens
cagagtcagccagga

SEQ ID NO: 1371427 - DNA, 15 bp, Homo sapiens
cagagtggtggggga

SEQ ID NO: 1371428 - DNA, 19 bp, Homo sapiens
cagatacctccaaccctgc

SEQ ID NO: 1371429 - DNA, 20 bp, Homo sapiens
cagatacctccaaccctgcc

SEQ ID NO: 1371430 - DNA, 21 bp, Homo sapiens
cagatacctccaaccctgccg

SEQ ID NO: 1371431 - DNA, 13 bp, Homo sapiens
cagatcactgcca

SEQ ID NO: 1371432 - DNA, 14 bp, Homo sapiens
cagatcactgccac

SEQ ID NO: 1371433 - DNA, 17 bp, Homo sapiens
cagatctttcagaaata

SEQ ID NO: 1371434 - DNA, 22 bp, Homo sapiens
cagatgtcctaatggtgatgca

SEQ ID NO: 1371435 - DNA, 19 bp, Homo sapiens
cagatgtggctactgacat

SEQ ID NO: 1371436 - DNA, 17 bp, Homo sapiens
cagatgttagatatttt

SEQ ID NO: 1371437 - DNA, 15 bp, Homo sapiens
cagatgtttccagac

SEQ ID NO: 1371438 - DNA, 16 bp, Homo sapiens
cagatgtttccagact

SEQ ID NO: 1371439 - DNA, 23 bp, Homo sapiens
cagatgtttccagacttccttga

SEQ ID NO: 1371440 - DNA, 14 bp, Homo sapiens
cagattaaacttca

SEQ ID NO: 1371441 - DNA, 16 bp, Homo sapiens
cagattgcctgtttct

SEQ ID NO: 1371442 - DNA, 15 bp, Homo sapiens
cagatttctgaggaa

SEQ ID NO: 1371443 - DNA, 24 bp, Homo sapiens
cagatttgtctttttgttgtaaaa

SEQ ID NO: 1371444 - DNA, 19 bp, Homo sapiens
cagattttacagagcgcac

SEQ ID NO: 1371445 - DNA, 14 bp, Homo sapiens
cagcaaaggaaact

SEQ ID NO: 1371446 - DNA, 13 bp, Homo sapiens
cagcaaattttca

SEQ ID NO: 1371447 - DNA, 16 bp, Homo sapiens
cagcaacacagcctgg

SEQ ID NO: 1371448 - DNA, 20 bp, Homo sapiens
cagcaacgatcacaaatgac

SEQ ID NO: 1371449 - DNA, 22 bp, Homo sapiens
cagcaacgatcacaaatgactt

SEQ ID NO: 1371450 - DNA, 20 bp, Homo sapiens
cagcaacggcacagctaatt

SEQ ID NO: 1371451 - DNA, 22 bp, Homo sapiens
cagcaacttcttctccatccct

SEQ ID NO: 1371452 - DNA, 18 bp, Homo sapiens
cagcaccgaggggccttt

SEQ ID NO: 1371453 - DNA, 15 bp, Homo sapiens
cagcacctcagcctg

SEQ ID NO: 1371454 - DNA, 17 bp, Homo sapiens
cagcaccttgtgcctgg

SEQ ID NO: 1371455 - DNA, 20 bp, Homo sapiens
cagcaccttgtgcctggggt

SEQ ID NO: 1371456 - DNA, 22 bp, Homo sapiens
cagcagaggcccagatattaga

SEQ ID NO: 1371457 - DNA, 13 bp, Homo sapiens
cagcagcagcagg

SEQ ID NO: 1371458 - DNA, 13 bp, Homo sapiens
cagcagcaggtga

SEQ ID NO: 1371459 - DNA, 14 bp, Homo sapiens
cagcagcctggacc

SEQ ID NO: 1371460 - DNA, 20 bp, Homo sapiens
cagcagggagggcttctgcc

SEQ ID NO: 1371461 - DNA, 23 bp, Homo sapiens
cagcaggtgattggaccaggcca

SEQ ID NO: 1371462 - DNA, 17 bp, Homo sapiens
cagcatagaagtaactt

SEQ ID NO: 1371463 - DNA, 17 bp, Homo sapiens
cagcatcacctgcctgt

SEQ ID NO: 1371464 - DNA, 21 bp, Homo sapiens
cagccaaagcctcctccagcc

SEQ ID NO: 1371465 - DNA, 16 bp, Homo sapiens
cagccaagattttcct

SEQ ID NO: 1371466 - DNA, 16 bp, Homo sapiens
cagccactccccggca

SEQ ID NO: 1371467 - DNA, 12 bp, Homo sapiens
cagccagcacct

SEQ ID NO: 1371468 - DNA, 13 bp, Homo sapiens
cagccagcacctg

SEQ ID NO: 1371469 - DNA, 14 bp, Homo sapiens
cagccagcacctgg

SEQ ID NO: 1371470 - DNA, 19 bp, Homo sapiens
cagccagcgcctccctcca

SEQ ID NO: 1371471 - DNA, 22 bp, Homo sapiens
cagccagcgcctccctccaccc

SEQ ID NO: 1371472 - DNA, 17 bp, Homo sapiens
cagcccagagactttgt

SEQ ID NO: 1371473 - DNA, 16 bp, Homo sapiens
cagcccagggctcctg

SEQ ID NO: 1371474 - DNA, 17 bp, Homo sapiens
cagcccagggctcctgc

SEQ ID NO: 1371475 - DNA, 18 bp, Homo sapiens
cagcccagggctcctgca

SEQ ID NO: 1371476 - DNA, 14 bp, Homo sapiens
cagccccactgcca

SEQ ID NO: 1371477 - DNA, 16 bp, Homo sapiens
cagccccactgccagc

SEQ ID NO: 1371478 - DNA, 18 bp, Homo sapiens
cagccccactgccagcag

SEQ ID NO: 1371479 - DNA, 19 bp, Homo sapiens
cagccccactgccagcagc

SEQ ID NO: 1371480 - DNA, 12 bp, Homo sapiens
cagccccagcct

SEQ ID NO: 1371481 - DNA, 17 bp, Homo sapiens
cagccccagcctgctag

SEQ ID NO: 1371482 - DNA, 18 bp, Homo sapiens
cagccccagcctgctagc

SEQ ID NO: 1371483 - DNA, 19 bp, Homo sapiens
cagccccctaaaagcactc

SEQ ID NO: 1371484 - DNA, 16 bp, Homo sapiens
cagccccctgcttcag

SEQ ID NO: 1371485 - DNA, 16 bp, Homo sapiens
cagccccgactccagc

SEQ ID NO: 1371486 - DNA, 20 bp, Homo sapiens
cagccccgactccagccagc

SEQ ID NO: 1371487 - DNA, 12 bp, Homo sapiens
cagccctgctgg

SEQ ID NO: 1371488 - DNA, 15 bp, Homo sapiens
cagccctgctgggga

SEQ ID NO: 1371489 - DNA, 17 bp, Homo sapiens
cagcctccgagagggag

SEQ ID NO: 1371490 - DNA, 19 bp, Homo sapiens
cagcctccgagagggagag

SEQ ID NO: 1371491 - DNA, 18 bp, Homo sapiens
cacccctgcccccagccc

SEQ ID NO: 1371492 - DNA, 21 bp, Homo sapiens
caccccttctctcctccccaa

SEQ ID NO: 1371493 - DNA, 21 bp, Homo sapiens
cacccggtgggacccccgtgg

SEQ ID NO: 1371494 - DNA, 12 bp, Homo sapiens
caccctgggccc

SEQ ID NO: 1371495 - DNA, 14 bp, Homo sapiens
caccctgggccctg

SEQ ID NO: 1371496 - DNA, 22 bp, Homo sapiens
caccctgggccctgggctggaa

SEQ ID NO: 1371497 - DNA, 15 bp, Homo sapiens
caccgactgaaaata

SEQ ID NO: 1371498 - DNA, 14 bp, Homo sapiens
caccgaggggcctt

SEQ ID NO: 1371499 - DNA, 16 bp, Homo sapiens
caccgaggggcctttg

SEQ ID NO: 1371500 - DNA, 14 bp, Homo sapiens
caccgcccatcagg

SEQ ID NO: 1371501 - DNA, 22 bp, Homo sapiens
caccgcctccccacctccaggc

SEQ ID NO: 1371502 - DNA, 19 bp, Homo sapiens
caccgcgggtgtgggaaag

SEQ ID NO: 1371503 - DNA, 14 bp, Homo sapiens
cacctcagcctgca

SEQ ID NO: 1371504 - DNA, 12 bp, Homo sapiens
cacctcatgccc

SEQ ID NO: 1371505 - DNA, 14 bp, Homo sapiens
cacctcatgcccac

SEQ ID NO: 1371506 - DNA, 21 bp, Homo sapiens
cacctcatgcccaccccctgc

SEQ ID NO: 1371507 - DNA, 20 bp, Homo sapiens
cacctggctgaggttcctct

SEQ ID NO: 1371508 - DNA, 23 bp, Homo sapiens
cacctggctgaggttcctctgcc

SEQ ID NO: 1371509 - DNA, 22 bp, Homo sapiens
cacctgtagcacttactggtag

SEQ ID NO: 1371510 - DNA, 16 bp, Homo sapiens
cacctgtagtcccagc

SEQ ID NO: 1371511 - DNA, 21 bp, Homo sapiens
caccttctatagcatcactta

SEQ ID NO: 1371512 - DNA, 16 bp, Homo sapiens
caccttggacatcctc

SEQ ID NO: 1371513 - DNA, 18 bp, Homo sapiens
caccttggacatcctcct

SEQ ID NO: 1371514 - DNA, 13 bp, Homo sapiens
caccttgtgcctg

SEQ ID NO: 1371515 - DNA, 16 bp, Homo sapiens
caccttgtgcctgggg

SEQ ID NO: 1371516 - DNA, 17 bp, Homo sapiens
caccttgtgcctggggt

SEQ ID NO: 1371517 - DNA, 18 bp, Homo sapiens
caccttgtgcctggggtg

SEQ ID NO: 1371518 - DNA, 15 bp, Homo sapiens
cacgaggtcaggaga

SEQ ID NO: 1371519 - DNA, 14 bp, Homo sapiens
cacgcccgtcctgc

SEQ ID NO: 1371520 - DNA, 16 bp, Homo sapiens
cacgcctgtaatccca

SEQ ID NO: 1371521 - DNA, 23 bp, Homo sapiens
cacggaggcatcctacccttttc

SEQ ID NO: 1371522 - DNA, 17 bp, Homo sapiens
cacgttggggtgattta

SEQ ID NO: 1371523 - DNA, 13 bp, Homo sapiens
cacgttttaagga

SEQ ID NO: 1371524 - DNA, 14 bp, Homo sapiens
cacgttttaaggac

SEQ ID NO: 1371525 - DNA, 22 bp, Homo sapiens
cactaaaaatattgtttctgca

SEQ ID NO: 1371526 - DNA, 16 bp, Homo sapiens
cactaaagcatgaaat

SEQ ID NO: 1371527 - DNA, 13 bp, Homo sapiens
cactaaatcagag

SEQ ID NO: 1371528 - DNA, 14 bp, Homo sapiens
cactaactcaccag

SEQ ID NO: 1371529 - DNA, 23 bp, Homo sapiens
cactaattggtacttttaaaaac

SEQ ID NO: 1371530 - DNA, 15 bp, Homo sapiens
cactaatttttgtat

SEQ ID NO: 1371531 - DNA, 18 bp, Homo sapiens
cactaatttttgtattat

SEQ ID NO: 1371532 - DNA, 19 bp, Homo sapiens
cactaatttttgtattatt

SEQ ID NO: 1371533 - DNA, 16 bp, Homo sapiens
cactacaccttgcctt

SEQ ID NO: 1371534 - DNA, 18 bp, Homo sapiens
cactacagtattactctt

SEQ ID NO: 1371535 - DNA, 23 bp, Homo sapiens
cactaggcccccacttgcctctt

SEQ ID NO: 1371536 - DNA, 23 bp, Homo sapiens
cactcacagagtcaaggcctgct

SEQ ID NO: 1371537 - DNA, 13 bp, Homo sapiens
cactcatttcatc

SEQ ID NO: 1371538 - DNA, 16 bp, Homo sapiens
cactcatttcatctca

SEQ ID NO: 1371539 - DNA, 18 bp, Homo sapiens
cactcatttcatctcatt

SEQ ID NO: 1371540 - DNA, 22 bp, Homo sapiens
cactcatttcatctcatttaag

SEQ ID NO: 1371541 - DNA, 22 bp, Homo sapiens
cactccacataaggggtttagt

SEQ ID NO: 1371542 - DNA, 16 bp, Homo sapiens
cactccagcctgggcg

SEQ ID NO: 1371543 - DNA, 16 bp, Homo sapiens
cactccagcctgggtg

SEQ ID NO: 1371544 - DNA, 21 bp, Homo sapiens
cactccagggacacacagcct

SEQ ID NO: 1371545 - DNA, 19 bp, Homo sapiens
cactccgagaggtgggcca

SEQ ID NO: 1371546 - DNA, 21 bp, Homo sapiens
cactcctgcttaatcttcaaa

SEQ ID NO: 1371547 - DNA, 20 bp, Homo sapiens
cactcgggtttctctgtggc

SEQ ID NO: 1371548 - DNA, 21 bp, Homo sapiens
cactcgggtttctctgtggct

SEQ ID NO: 1371549 - DNA, 15 bp, Homo sapiens
cactcgtgtgtttct

SEQ ID NO: 1371550 - DNA, 18 bp, Homo sapiens
cactctaagtcatgtatg

SEQ ID NO: 1371551 - DNA, 15 bp, Homo sapiens
cactctgcttctctg

SEQ ID NO: 1371552 - DNA, 18 bp, Homo sapiens
cactctgcttctctgact

SEQ ID NO: 1371553 - DNA, 17 bp, Homo sapiens
cactgaaagttttgtaa

SEQ ID NO: 1371554 - DNA, 19 bp, Homo sapiens
cactgaaagttttgtaaaa

SEQ ID NO: 1371555 - DNA, 23 bp, Homo sapiens
cactgaaagttttgtaaaagaaa

SEQ ID NO: 1371556 - DNA, 13 bp, Homo sapiens
cactgcaacctcc

SEQ ID NO: 1371557 - DNA, 18 bp, Homo sapiens
cactgcactccagcctgg

SEQ ID NO: 1371558 - DNA, 19 bp, Homo sapiens
cactgcactccagcctggg

SEQ ID NO: 1371559 - DNA, 20 bp, Homo sapiens
cactgcactccagcctgggt

SEQ ID NO: 1371560 - DNA, 20 bp, Homo sapiens
cactgccagcagcagcaggt

SEQ ID NO: 1371561 - DNA, 22 bp, Homo sapiens
cactgccagcagcagcaggtga

SEQ ID NO: 1371562 - DNA, 16 bp, Homo sapiens
cactgcctgccttaag

SEQ ID NO: 1371563 - DNA, 20 bp, Homo sapiens
cactgcctgccttaagtgag

SEQ ID NO: 1371564 - DNA, 11 bp, Homo sapiens
cactgcctggg

SEQ ID NO: 1371565 - DNA, 21 bp, Homo sapiens
cactgccttcgcttcttgcct

SEQ ID NO: 1371566 - DNA, 23 bp, Homo sapiens
cactgccttcgcttcttgcctct

SEQ ID NO: 1371567 - DNA, 16 bp, Homo sapiens
cactggaaaggggaga

SEQ ID NO: 1371568 - DNA, 17 bp, Homo sapiens
cactggaccccagcaag

SEQ ID NO: 1371569 - DNA, 20 bp, Homo sapiens
cactggaggttgaagccaag

SEQ ID NO: 1371570 - DNA, 15 bp, Homo sapiens
cactgggctcccggg

SEQ ID NO: 1371571 - DNA, 13 bp, Homo sapiens
cactgtgaagaga

SEQ ID NO: 1371572 - DNA, 19 bp, Homo sapiens
cactgtgatcaatattttt

SEQ ID NO: 1371573 - DNA, 21 bp, Homo sapiens
cactgtgtatatttgatttat

SEQ ID NO: 1371574 - DNA, 20 bp, Homo sapiens
cactgtttagatttgccata

SEQ ID NO: 1371575 - DNA, 22 bp, Homo sapiens
cactgtttctcttgagctggcc

SEQ ID NO: 1371576 - DNA, 21 bp, Homo sapiens
cacttaaacgaagagttccct

SEQ ID NO: 1371577 - DNA, 15 bp, Homo sapiens
cacttaaagaagtat

SEQ ID NO: 1371578 - DNA, 16 bp, Homo sapiens
cacttaaagaagtatt

SEQ ID NO: 1371579 - DNA, 18 bp, Homo sapiens
cacttaaagaagtatttt

SEQ ID NO: 1371580 - DNA, 15 bp, Homo sapiens
cacttactggtagga

SEQ ID NO: 1371581 - DNA, 16 bp, Homo sapiens
cacttacttgcttatt

SEQ ID NO: 1371582 - DNA, 12 bp, Homo sapiens
cacttcagctga

SEQ ID NO: 1371583 - DNA, 19 bp, Homo sapiens
cacttcatgtaaagtgtca

SEQ ID NO: 1371584 - DNA, 14 bp, Homo sapiens
cacttcccaccctg

SEQ ID NO: 1371585 - DNA, 23 bp, Homo sapiens
cacttcgcaccggagtgtctgga

SEQ ID NO: 1371586 - DNA, 21 bp, Homo sapiens
cacttcgggaggtcgaggcag

SEQ ID NO: 1371587 - DNA, 23 bp, Homo sapiens
cacttcgggaggtcgaggcagga

SEQ ID NO: 1371588 - DNA, 19 bp, Homo sapiens
cacttctaagaaaagccta

SEQ ID NO: 1371589 - DNA, 19 bp, Homo sapiens
cacttgaagccatctaaag

SEQ ID NO: 1371590 - DNA, 14 bp, Homo sapiens
cacttgaggcctga

SEQ ID NO: 1371591 - DNA, 13 bp, Homo sapiens
cacttgcctcttc

SEQ ID NO: 1371592 - DNA, 13 bp, Homo sapiens
cacttgcctgggt

SEQ ID NO: 1371593 - DNA, 14 bp, Homo sapiens
cacttgtagatttg

SEQ ID NO: 1371594 - DNA, 16 bp, Homo sapiens
cacttgtagatttgat

SEQ ID NO: 1371595 - DNA, 17 bp, Homo sapiens
cacttgtgattatttat

SEQ ID NO: 1371596 - DNA, 15 bp, Homo sapiens
cactttgttgcaaga

SEQ ID NO: 1371597 - DNA, 23 bp, Homo sapiens
cactttgttgcaagatgtgaatt

SEQ ID NO: 1371598 - DNA, 14 bp, Homo sapiens
cactttttatgcta

SEQ ID NO: 1371599 - DNA, 21 bp, Homo sapiens
cagaaaaaaagagtgaaaaag

SEQ ID NO: 1371600 - DNA, 20 bp, Homo sapiens
cagaaaaaatgtctgtaaat

SEQ ID NO: 1371601 - DNA, 21 bp, Homo sapiens
cagaaaaagaaatgaacataa

SEQ ID NO: 1371602 - DNA, 14 bp, Homo sapiens
cagaaaatgaaaaa

SEQ ID NO: 1371603 - DNA, 14 bp, Homo sapiens
cagaaacactgcct

SEQ ID NO: 1371604 - DNA, 19 bp, Homo sapiens
cagaaacactgccttttta

SEQ ID NO: 1371605 - DNA, 21 bp, Homo sapiens
cagaaatataacacatttttt

SEQ ID NO: 1371606 - DNA, 21 bp, Homo sapiens
cagaaattgtatattgtaatt

SEQ ID NO: 1371607 - DNA, 17 bp, Homo sapiens
cagaacagtggtggcaa

SEQ ID NO: 1371608 - DNA, 13 bp, Homo sapiens
cagaactacttct

SEQ ID NO: 1371609 - DNA, 20 bp, Homo sapiens
cagaagtcacacattacaaa

SEQ ID NO: 1371610 - DNA, 16 bp, Homo sapiens
cagaagttagtttgta

SEQ ID NO: 1371611 - DNA, 23 bp, Homo sapiens
atttttttgaactcttctcatta

SEQ ID NO: 1371612 - DNA, 15 bp, Homo sapiens
atttttttgtaataa

SEQ ID NO: 1371613 - DNA, 22 bp, Homo sapiens
attttttttaaaatagaaattt

SEQ ID NO: 1371614 - DNA, 16 bp, Homo sapiens
attttttttaaagaaa

SEQ ID NO: 1371615 - DNA, 22 bp, Homo sapiens
attttttttaattgtatttttg

SEQ ID NO: 1371616 - DNA, 15 bp, Homo sapiens
atttttttttctaag

SEQ ID NO: 1371617 - DNA, 18 bp, Homo sapiens
atttttttttctaagaga

SEQ ID NO: 1371618 - DNA, 18 bp, Homo sapiens
atttttttttttaatcta

SEQ ID NO: 1371619 - DNA, 21 bp, Homo sapiens
caaaaaaaatttagccgggcg

SEQ ID NO: 1371620 - DNA, 15 bp, Homo sapiens
caaaaaatgttttaa

SEQ ID NO: 1371621 - DNA, 16 bp, Homo sapiens
caaaaaatgttttaaa

SEQ ID NO: 1371622 - DNA, 15 bp, Homo sapiens
caaaaagaaatgatg

SEQ ID NO: 1371623 - DNA, 13 bp, Homo sapiens
caaaaaggcagga

SEQ ID NO: 1371624 - DNA, 17 bp, Homo sapiens
caaaaattagccgggcg

SEQ ID NO: 1371625 - DNA, 16 bp, Homo sapiens
caaaagatgcttctca

SEQ ID NO: 1371626 - DNA, 18 bp, Homo sapiens
caaaagatgcttctcact

SEQ ID NO: 1371627 - DNA, 17 bp, Homo sapiens
caaaagcgcttttcctt

SEQ ID NO: 1371628 - DNA, 15 bp, Homo sapiens
caaaagctgggcagg

SEQ ID NO: 1371629 - DNA, 13 bp, Homo sapiens
caaaaggaagtct

SEQ ID NO: 1371630 - DNA, 19 bp, Homo sapiens
caaaagtagaactttgtat

SEQ ID NO: 1371631 - DNA, 21 bp, Homo sapiens
caaaagtagaactttgtatag

SEQ ID NO: 1371632 - DNA, 15 bp, Homo sapiens
caaaatatttcccat

SEQ ID NO: 1371633 - DNA, 23 bp, Homo sapiens
caaaatgtaggcttagtttgtgt

SEQ ID NO: 1371634 - DNA, 16 bp, Homo sapiens
caaaattaaggtgttt

SEQ ID NO: 1371635 - DNA, 19 bp, Homo sapiens
caaaattaaggtgtttgaa

SEQ ID NO: 1371636 - DNA, 14 bp, Homo sapiens
caaaatttgactaa

SEQ ID NO: 1371637 - DNA, 15 bp, Homo sapiens
caaaccttatctcca

SEQ ID NO: 1371638 - DNA, 21 bp, Homo sapiens
caaaccttatctccacaacct

SEQ ID NO: 1371639 - DNA, 18 bp, Homo sapiens
caaacctttattttagaa

SEQ ID NO: 1371640 - DNA, 23 bp, Homo sapiens
caaacgctaaagagcccttgcct

SEQ ID NO: 1371641 - DNA, 17 bp, Homo sapiens
caaactgaagcagcctc

SEQ ID NO: 1371642 - DNA, 12 bp, Homo sapiens
caaagaggctgc

SEQ ID NO: 1371643 - DNA, 13 bp, Homo sapiens
caaagaggctgcc

SEQ ID NO: 1371644 - DNA, 17 bp, Homo sapiens
caaagatagacaggtcc

SEQ ID NO: 1371645 - DNA, 13 bp, Homo sapiens
caaagatttaatc

SEQ ID NO: 1371646 - DNA, 17 bp, Homo sapiens
caaagctgagcctgcag

SEQ ID NO: 1371647 - DNA, 22 bp, Homo sapiens
caaagctgagcctgcagggaag

SEQ ID NO: 1371648 - DNA, 24 bp, Homo sapiens
caaagctgagcctgcagggaagcc

SEQ ID NO: 1371649 - DNA, 16 bp, Homo sapiens
caaagctggctcacct

SEQ ID NO: 1371650 - DNA, 20 bp, Homo sapiens
caaagcttggattaaataca

SEQ ID NO: 1371651 - DNA, 18 bp, Homo sapiens
caaaggaaactttgcaga

SEQ ID NO: 1371652 - DNA, 17 bp, Homo sapiens
caaaggaaggtggatgg

SEQ ID NO: 1371653 - DNA, 18 bp, Homo sapiens
caaaggagcgagcatgtc

SEQ ID NO: 1371654 - DNA, 21 bp, Homo sapiens
caaaggcattataaaaagaat

SEQ ID NO: 1371655 - DNA, 21 bp, Homo sapiens
caaagggcctgcccagacaag

SEQ ID NO: 1371656 - DNA, 23 bp, Homo sapiens
caaagtctgctctcatataagac

SEQ ID NO: 1371657 - DNA, 16 bp, Homo sapiens
caaagtgccaaagaaa

SEQ ID NO: 1371658 - DNA, 22 bp, Homo sapiens
caaagtgctattacgaagttca

SEQ ID NO: 1371659 - DNA, 19 bp, Homo sapiens
caaagtttgacaggaacct

SEQ ID NO: 1371660 - DNA, 23 bp, Homo sapiens
caaataaagagagaacaggacta

SEQ ID NO: 1371661 - DNA, 18 bp, Homo sapiens
caaatattgttgacaact

SEQ ID NO: 1371662 - DNA, 14 bp, Homo sapiens
caaatcaatacact

SEQ ID NO: 1371663 - DNA, 17 bp, Homo sapiens
caaatcaatacactagt

SEQ ID NO: 1371664 - DNA, 16 bp, Homo sapiens
caaatctgatggcctt

SEQ ID NO: 1371665 - DNA, 17 bp, Homo sapiens
caaatgactttattatt

SEQ ID NO: 1371666 - DNA, 18 bp, Homo sapiens
caaatgactttattattt

SEQ ID NO: 1371667 - DNA, 15 bp, Homo sapiens
caaatgcatctttga

SEQ ID NO: 1371668 - DNA, 22 bp, Homo sapiens
caaatgcatctttgatgtgttg

SEQ ID NO: 1371669 - DNA, 16 bp, Homo sapiens
caaattaattgtgtga

SEQ ID NO: 1371670 - DNA, 19 bp, Homo sapiens
caaattaattgtgtgaact

SEQ ID NO: 1371671 - DNA, 20 bp, Homo sapiens
caaattaattgtgtgaactt

SEQ ID NO: 1371672 - DNA, 13 bp, Homo sapiens
caaattatcttga

SEQ ID NO: 1371673 - DNA, 15 bp, Homo sapiens
caaattttttgactt

SEQ ID NO: 1371674 - DNA, 23 bp, Homo sapiens
caaattttttgactttttttgta

SEQ ID NO: 1371675 - DNA, 12 bp, Homo sapiens
caacaaagaaat

SEQ ID NO: 1371676 - DNA, 22 bp, Homo sapiens
caacaaatattcactggcccct

SEQ ID NO: 1371677 - DNA, 18 bp, Homo sapiens
caacaatgtgaggggtcc

SEQ ID NO: 1371678 - DNA, 14 bp, Homo sapiens
caacaattggtaaa

SEQ ID NO: 1371679 - DNA, 18 bp, Homo sapiens
caacaattggtaaaactc

SEQ ID NO: 1371680 - DNA, 19 bp, Homo sapiens
caacaattggtaaaactca

SEQ ID NO: 1371681 - DNA, 24 bp, Homo sapiens
caacacttccagcatttagctggc

SEQ ID NO: 1371682 - DNA, 22 bp, Homo sapiens
caacatgttgggaaacttggct

SEQ ID NO: 1371683 - DNA, 23 bp, Homo sapiens
caacatgttgggaaacttggctc

SEQ ID NO: 1371684 - DNA, 21 bp, Homo sapiens
caaccactaagaattcaaact

SEQ ID NO: 1371685 - DNA, 12 bp, Homo sapiens
caaccagacctg

SEQ ID NO: 1371686 - DNA, 19 bp, Homo sapiens
caaccaggcacctcttcct

SEQ ID NO: 1371687 - DNA, 22 bp, Homo sapiens
caaccatgtcatttcagaagtt

SEQ ID NO: 1371688 - DNA, 17 bp, Homo sapiens
caaccccaagccagccc

SEQ ID NO: 1371689 - DNA, 22 bp, Homo sapiens
caaccctatctcctgacagaag

SEQ ID NO: 1371690 - DNA, 14 bp, Homo sapiens
caacctcagggctc

SEQ ID NO: 1371691 - DNA, 18 bp, Homo sapiens
caacctcagggctcccag

SEQ ID NO: 1371692 - DNA, 20 bp, Homo sapiens
caacctcagggctcccaggg

SEQ ID NO: 1371693 - DNA, 18 bp, Homo sapiens
caacctcttctggctcaa

SEQ ID NO: 1371694 - DNA, 19 bp, Homo sapiens
caacctttccctcaccccc

SEQ ID NO: 1371695 - DNA, 20 bp, Homo sapiens
caacgatcacaaatgacttt

SEQ ID NO: 1371696 - DNA, 17 bp, Homo sapiens
caactaaaatttgaagt

SEQ ID NO: 1371697 - DNA, 12 bp, Homo sapiens
caactgtgactg

SEQ ID NO: 1371698 - DNA, 22 bp, Homo sapiens
caacttctgcctcccatgctta

SEQ ID NO: 1371699 - DNA, 23 bp, Homo sapiens
caacttgtattaaagacagaggc

SEQ ID NO: 1371700 - DNA, 22 bp, Homo sapiens
caactttgtaaaaatcttttga

SEQ ID NO: 1371701 - DNA, 20 bp, Homo sapiens
caagaaagctcactgtagct

SEQ ID NO: 1371702 - DNA, 18 bp, Homo sapiens
caagaagcagtggcctta

SEQ ID NO: 1371703 - DNA, 15 bp, Homo sapiens
caagaatattgcaaa

SEQ ID NO: 1371704 - DNA, 20 bp, Homo sapiens
caagaatattgcaaaataca

SEQ ID NO: 1371705 - DNA, 16 bp, Homo sapiens
caagaccgatcggcgg

SEQ ID NO: 1371706 - DNA, 24 bp, Homo sapiens
caagagaactcgcgctcagtaaac

SEQ ID NO: 1371707 - DNA, 16 bp, Homo sapiens
caagagatgggaatga

SEQ ID NO: 1371708 - DNA, 12 bp, Homo sapiens
caagagccttaa

SEQ ID NO: 1371709 - DNA, 15 bp, Homo sapiens
caagagccttaaaac

SEQ ID NO: 1371710 - DNA, 12 bp, Homo sapiens
caagaggaatga

SEQ ID NO: 1371711 - DNA, 18 bp, Homo sapiens
caagagggggtggagggg

SEQ ID NO: 1371712 - DNA, 13 bp, Homo sapiens
caagatgtgaatt

SEQ ID NO: 1371713 - DNA, 14 bp, Homo sapiens
caagatgtgaatta

SEQ ID NO: 1371714 - DNA, 18 bp, Homo sapiens
caagatgtgaattattga

SEQ ID NO: 1371715 - DNA, 19 bp, Homo sapiens
caagatgttgatttttact

SEQ ID NO: 1371716 - DNA, 18 bp, Homo sapiens
caagattttcctcttgtg

SEQ ID NO: 1371717 - DNA, 16 bp, Homo sapiens
caagattttttaattg

SEQ ID NO: 1371718 - DNA, 14 bp, Homo sapiens
caagcagaggacca

SEQ ID NO: 1371719 - DNA, 18 bp, Homo sapiens
caagcagaggaccagggc

SEQ ID NO: 1371720 - DNA, 19 bp, Homo sapiens
caagcagaggaccagggcc

SEQ ID NO: 1371721 - DNA, 21 bp, Homo sapiens
caagcagaggaccagggcctt

SEQ ID NO: 1371722 - DNA, 21 bp, Homo sapiens
caagcatcttgggggggtggc

SEQ ID NO: 1371723 - DNA, 22 bp, Homo sapiens
caagccaagggaacctgtgtcc

SEQ ID NO: 1371724 - DNA, 13 bp, Homo sapiens
caagccaggctca

SEQ ID NO: 1371725 - DNA, 13 bp, Homo sapiens
caagcctccacag

SEQ ID NO: 1371726 - DNA, 16 bp, Homo sapiens
caagctccgcaggact

SEQ ID NO: 1371727 - DNA, 17 bp, Homo sapiens
caagctccgcaggactt

SEQ ID NO: 1371728 - DNA, 16 bp, Homo sapiens
caaggcctgctccctg

SEQ ID NO: 1371729 - DNA, 14 bp, Homo sapiens
caaggctatgtgat

SEQ ID NO: 1371730 - DNA, 12 bp, Homo sapiens
caagggaaaggg

SEQ ID NO: 1371731 - DNA, 20 bp, Homo sapiens
atgtataaaatacatagtga

SEQ ID NO: 1371732 - DNA, 22 bp, Homo sapiens
atgtataaaatacatagtgaaa

SEQ ID NO: 1371733 - DNA, 16 bp, Homo sapiens
atgtataaatatacag

SEQ ID NO: 1371734 - DNA, 17 bp, Homo sapiens
atgtataaatatacagt

SEQ ID NO: 1371735 - DNA, 18 bp, Homo sapiens
atgtatgtgtttagaatt

SEQ ID NO: 1371736 - DNA, 14 bp, Homo sapiens
atgtatgtttctct

SEQ ID NO: 1371737 - DNA, 15 bp, Homo sapiens
atgtcaaaagtagaa

SEQ ID NO: 1371738 - DNA, 20 bp, Homo sapiens
atgtcaaaagtagaactttg

SEQ ID NO: 1371739 - DNA, 21 bp, Homo sapiens
atgtcaaacatgagatgtgtg

SEQ ID NO: 1371740 - DNA, 16 bp, Homo sapiens
atgtcaagtaccaaaa

SEQ ID NO: 1371741 - DNA, 16 bp, Homo sapiens
atgtcaatttctgtgt

SEQ ID NO: 1371742 - DNA, 17 bp, Homo sapiens
atgtcatttcagaagtt

SEQ ID NO: 1371743 - DNA, 22 bp, Homo sapiens
atgtccaaagaggctgcccctc

SEQ ID NO: 1371744 - DNA, 20 bp, Homo sapiens
atgtccagtaagatcactgt

SEQ ID NO: 1371745 - DNA, 16 bp, Homo sapiens
atgtcctaatggtgat

SEQ ID NO: 1371746 - DNA, 22 bp, Homo sapiens
atgtctttttattaaaatattt

SEQ ID NO: 1371747 - DNA, 20 bp, Homo sapiens
atgtgaattattgacactga

SEQ ID NO: 1371748 - DNA, 17 bp, Homo sapiens
atgtgaatttttaagct

SEQ ID NO: 1371749 - DNA, 19 bp, Homo sapiens
atgtgaatttttaagctgc

SEQ ID NO: 1371750 - DNA, 21 bp, Homo sapiens
atgtgaatttttaagctgcaa

SEQ ID NO: 1371751 - DNA, 21 bp, Homo sapiens
atgtgacaattttgtacaaat

SEQ ID NO: 1371752 - DNA, 21 bp, Homo sapiens
atgtgacattaacaaataaaa

SEQ ID NO: 1371753 - DNA, 12 bp, Homo sapiens
atgtgaccctcc

SEQ ID NO: 1371754 - DNA, 14 bp, Homo sapiens
atgtgaccctccaa

SEQ ID NO: 1371755 - DNA, 14 bp, Homo sapiens
atgtgagaagccag

SEQ ID NO: 1371756 - DNA, 19 bp, Homo sapiens
atgtgaggggtccctagca

SEQ ID NO: 1371757 - DNA, 19 bp, Homo sapiens
atgtgagtggttgaatatg

SEQ ID NO: 1371758 - DNA, 22 bp, Homo sapiens
atgtgatacattttttaagctt

SEQ ID NO: 1371759 - DNA, 18 bp, Homo sapiens
atgtgatggacactccag

SEQ ID NO: 1371760 - DNA, 18 bp, Homo sapiens
atgtgcaaaaccttttac

SEQ ID NO: 1371761 - DNA, 21 bp, Homo sapiens
atgtgcaaaaccttttactgg

SEQ ID NO: 1371762 - DNA, 16 bp, Homo sapiens
atgtgcatagtttctt

SEQ ID NO: 1371763 - DNA, 20 bp, Homo sapiens
atgtggcctttgaattctgt

SEQ ID NO: 1371764 - DNA, 13 bp, Homo sapiens
atgtggctggaag

SEQ ID NO: 1371765 - DNA, 14 bp, Homo sapiens
atgtggctggaaga

SEQ ID NO: 1371766 - DNA, 17 bp, Homo sapiens
atgtgggatattgaatg

SEQ ID NO: 1371767 - DNA, 19 bp, Homo sapiens
atgtgggatattgaatgtt

SEQ ID NO: 1371768 - DNA, 14 bp, Homo sapiens
atgtgtgttttttc

SEQ ID NO: 1371769 - DNA, 12 bp, Homo sapiens
atgtgtttagaa

SEQ ID NO: 1371770 - DNA, 20 bp, Homo sapiens
atgttacaagtttatatata

SEQ ID NO: 1371771 - DNA, 14 bp, Homo sapiens
atgttacctctgaa

SEQ ID NO: 1371772 - DNA, 17 bp, Homo sapiens
atgttactctcttgcac

SEQ ID NO: 1371773 - DNA, 14 bp, Homo sapiens
atgttagagtaatg

SEQ ID NO: 1371774 - DNA, 15 bp, Homo sapiens
atgttattagatgtt

SEQ ID NO: 1371775 - DNA, 16 bp, Homo sapiens
atgttcagattattgg

SEQ ID NO: 1371776 - DNA, 20 bp, Homo sapiens
atgttgggaaacttggctcg

SEQ ID NO: 1371777 - DNA, 12 bp, Homo sapiens
atgttgggactg

SEQ ID NO: 1371778 - DNA, 19 bp, Homo sapiens
atgttgtagtgtcccccac

SEQ ID NO: 1371779 - DNA, 23 bp, Homo sapiens
atgtttatatctgcaaaaaacct

SEQ ID NO: 1371780 - DNA, 20 bp, Homo sapiens
atgtttcctctagttctttg

SEQ ID NO: 1371781 - DNA, 18 bp, Homo sapiens
atgtttgaatttttctct

SEQ ID NO: 1371782 - DNA, 17 bp, Homo sapiens
atgtttggcatgtaaat

SEQ ID NO: 1371783 - DNA, 15 bp, Homo sapiens
atgtttttatacaaa

SEQ ID NO: 1371784 - DNA, 16 bp, Homo sapiens
attaaaaaagagacat

SEQ ID NO: 1371785 - DNA, 12 bp, Homo sapiens
attaaaatattt

SEQ ID NO: 1371786 - DNA, 14 bp, Homo sapiens
attaaaatatttca

SEQ ID NO: 1371787 - DNA, 19 bp, Homo sapiens
attaaatacatatggatgt

SEQ ID NO: 1371788 - DNA, 14 bp, Homo sapiens
attaaattctgagc

SEQ ID NO: 1371789 - DNA, 14 bp, Homo sapiens
attaagcaaatgtt

SEQ ID NO: 1371790 - DNA, 20 bp, Homo sapiens
attaatatatgtattattta

SEQ ID NO: 1371791 - DNA, 12 bp, Homo sapiens
attaatatttaa

SEQ ID NO: 1371792 - DNA, 12 bp, Homo sapiens
attaatcactgt

SEQ ID NO: 1371793 - DNA, 17 bp, Homo sapiens
attaatcactgtgtata

SEQ ID NO: 1371794 - DNA, 18 bp, Homo sapiens
attaatcactgtgtatat

SEQ ID NO: 1371795 - DNA, 21 bp, Homo sapiens
attaatcactgtgtatatttg

SEQ ID NO: 1371796 - DNA, 22 bp, Homo sapiens
attaatcactgtgtatatttga

SEQ ID NO: 1371797 - DNA, 17 bp, Homo sapiens
attaatgttttcaaaag

SEQ ID NO: 1371798 - DNA, 18 bp, Homo sapiens
attaattgtgtgaacttg

SEQ ID NO: 1371799 - DNA, 20 bp, Homo sapiens
attaattgtgtgaacttgga

SEQ ID NO: 1371800 - DNA, 21 bp, Homo sapiens
attaattgtgtgaacttggaa

SEQ ID NO: 1371801 - DNA, 15 bp, Homo sapiens
attaatttgcatctg

SEQ ID NO: 1371802 - DNA, 21 bp, Homo sapiens
attaatttgcatctgaaatag

SEQ ID NO: 1371803 - DNA, 13 bp, Homo sapiens
attacaaaaacaa

SEQ ID NO: 1371804 - DNA, 13 bp, Homo sapiens
attacaaagttaa

SEQ ID NO: 1371805 - DNA, 14 bp, Homo sapiens
attacaattttatc

SEQ ID NO: 1371806 - DNA, 21 bp, Homo sapiens
attacagaggtattaaaacta

SEQ ID NO: 1371807 - DNA, 16 bp, Homo sapiens
attacatgtaatttga

SEQ ID NO: 1371808 - DNA, 19 bp, Homo sapiens
attacattgctttttcttg

SEQ ID NO: 1371809 - DNA, 18 bp, Homo sapiens
attacatttatttatcca

SEQ ID NO: 1371810 - DNA, 21 bp, Homo sapiens
attaccccctccttcagacac

SEQ ID NO: 1371811 - DNA, 17 bp, Homo sapiens
attacgaagttcaagat

SEQ ID NO: 1371812 - DNA, 15 bp, Homo sapiens
attactgacatttct

SEQ ID NO: 1371813 - DNA, 15 bp, Homo sapiens
attactgccttgaaa

SEQ ID NO: 1371814 - DNA, 16 bp, Homo sapiens
attacttccatgaatt

SEQ ID NO: 1371815 - DNA, 15 bp, Homo sapiens
attacttgttgccta

SEQ ID NO: 1371816 - DNA, 17 bp, Homo sapiens
attacttgttgcctata

SEQ ID NO: 1371817 - DNA, 15 bp, Homo sapiens
attagaagacaacag

SEQ ID NO: 1371818 - DNA, 14 bp, Homo sapiens
attagagaacatcc

SEQ ID NO: 1371819 - DNA, 23 bp, Homo sapiens
attaggtgatcccgttttcccca

SEQ ID NO: 1371820 - DNA, 19 bp, Homo sapiens
attagtgttatatgaacat

SEQ ID NO: 1371821 - DNA, 19 bp, Homo sapiens
attataataaatatataca

SEQ ID NO: 1371822 - DNA, 18 bp, Homo sapiens
attataatcttataattg

SEQ ID NO: 1371823 - DNA, 22 bp, Homo sapiens
attatacatgtgatacattttt

SEQ ID NO: 1371824 - DNA, 17 bp, Homo sapiens
attatataactgtattt

SEQ ID NO: 1371825 - DNA, 22 bp, Homo sapiens
attatcaaagggataaagaaaa

SEQ ID NO: 1371826 - DNA, 20 bp, Homo sapiens
attatcttgatacattcaaa

SEQ ID NO: 1371827 - DNA, 23 bp, Homo sapiens
attatcttgatacattcaaattt

SEQ ID NO: 1371828 - DNA, 15 bp, Homo sapiens
attatggaaaactgt

SEQ ID NO: 1371829 - DNA, 22 bp, Homo sapiens
attattatcaggggagaaaaat

SEQ ID NO: 1371830 - DNA, 12 bp, Homo sapiens
attattctctgc

SEQ ID NO: 1371831 - DNA, 15 bp, Homo sapiens
attattgacactgaa

SEQ ID NO: 1371832 - DNA, 14 bp, Homo sapiens
attatttaagacta

SEQ ID NO: 1371833 - DNA, 13 bp, Homo sapiens
attatttatatgg

SEQ ID NO: 1371834 - DNA, 15 bp, Homo sapiens
attatttgattattt

SEQ ID NO: 1371835 - DNA, 19 bp, Homo sapiens
attatttgattatttaaga

SEQ ID NO: 1371836 - DNA, 14 bp, Homo sapiens
attatttgcatgtt

SEQ ID NO: 1371837 - DNA, 17 bp, Homo sapiens
attatttgcatgttatg

SEQ ID NO: 1371838 - DNA, 19 bp, Homo sapiens
attatttttttaaaatttt

SEQ ID NO: 1371839 - DNA, 15 bp, Homo sapiens
attcaactttgtaaa

SEQ ID NO: 1371840 - DNA, 12 bp, Homo sapiens
attcactcccac

SEQ ID NO: 1371841 - DNA, 13 bp, Homo sapiens
attcactcccaca

SEQ ID NO: 1371842 - DNA, 15 bp, Homo sapiens
attcagacatctgag

SEQ ID NO: 1371843 - DNA, 18 bp, Homo sapiens
attcagtaactgtcaggc

SEQ ID NO: 1371844 - DNA, 17 bp, Homo sapiens
attcatctgtctatatt

SEQ ID NO: 1371845 - DNA, 18 bp, Homo sapiens
attcatctgtctatattt

SEQ ID NO: 1371846 - DNA, 12 bp, Homo sapiens
attcatttctaa

SEQ ID NO: 1371847 - DNA, 16 bp, Homo sapiens
attccactacacctgg

SEQ ID NO: 1371848 - DNA, 17 bp, Homo sapiens
attccactacacctggc

SEQ ID NO: 1371849 - DNA, 18 bp, Homo sapiens
attccactacacctggct

SEQ ID NO: 1371850 - DNA, 13 bp, Homo sapiens
atttcaaaatata

SEQ ID NO: 1371851 - DNA, 19 bp, Homo sapiens
atttcaaagttttgttgta

SEQ ID NO: 1371852 - DNA, 18 bp, Homo sapiens
atttcagaaaatgaaaaa

SEQ ID NO: 1371853 - DNA, 12 bp, Homo sapiens
atttcagaagtt

SEQ ID NO: 1371854 - DNA, 19 bp, Homo sapiens
atttcagaagttagtttgt

SEQ ID NO: 1371855 - DNA, 15 bp, Homo sapiens
atttcagggtgcagc

SEQ ID NO: 1371856 - DNA, 19 bp, Homo sapiens
atttcatcacaagaacaca

SEQ ID NO: 1371857 - DNA, 14 bp, Homo sapiens
atttcccatctgca

SEQ ID NO: 1371858 - DNA, 15 bp, Homo sapiens
atttcccatctgcac

SEQ ID NO: 1371859 - DNA, 22 bp, Homo sapiens
atttcccatttgtgccagagga

SEQ ID NO: 1371860 - DNA, 23 bp, Homo sapiens
atttcccctctgcacccagaaca

SEQ ID NO: 1371861 - DNA, 17 bp, Homo sapiens
atttcctttttgacact

SEQ ID NO: 1371862 - DNA, 19 bp, Homo sapiens
atttcctttttgacactga

SEQ ID NO: 1371863 - DNA, 14 bp, Homo sapiens
atttctagaaacaa

SEQ ID NO: 1371864 - DNA, 14 bp, Homo sapiens
atttctataaatag

SEQ ID NO: 1371865 - DNA, 17 bp, Homo sapiens
atttctcattgactttt

SEQ ID NO: 1371866 - DNA, 14 bp, Homo sapiens
atttctcctccctt

SEQ ID NO: 1371867 - DNA, 16 bp, Homo sapiens
atttcttatgtgacat

SEQ ID NO: 1371868 - DNA, 21 bp, Homo sapiens
atttcttatgtgacattaaca

SEQ ID NO: 1371869 - DNA, 15 bp, Homo sapiens
atttcttcagggctg

SEQ ID NO: 1371870 - DNA, 16 bp, Homo sapiens
atttctttttttcctt

SEQ ID NO: 1371871 - DNA, 15 bp, Homo sapiens
atttgaaaaatataa

SEQ ID NO: 1371872 - DNA, 19 bp, Homo sapiens
atttgaacaatgaagttga

SEQ ID NO: 1371873 - DNA, 20 bp, Homo sapiens
atttgaacaatgaagttgaa

SEQ ID NO: 1371874 - DNA, 14 bp, Homo sapiens
atttgaagggtctt

SEQ ID NO: 1371875 - DNA, 17 bp, Homo sapiens
atttgactaattttaca

SEQ ID NO: 1371876 - DNA, 23 bp, Homo sapiens
atttgagaatagacccttactag

SEQ ID NO: 1371877 - DNA, 18 bp, Homo sapiens
atttgattgggatgaatg

SEQ ID NO: 1371878 - DNA, 16 bp, Homo sapiens
atttgcaataacagct

SEQ ID NO: 1371879 - DNA, 19 bp, Homo sapiens
atttgcaataacagctgca

SEQ ID NO: 1371880 - DNA, 15 bp, Homo sapiens
atttgcatctgaaat

SEQ ID NO: 1371881 - DNA, 12 bp, Homo sapiens
atttgcatgtta

SEQ ID NO: 1371882 - DNA, 13 bp, Homo sapiens
atttgcatgttat

SEQ ID NO: 1371883 - DNA, 15 bp, Homo sapiens
atttgccatagagta

SEQ ID NO: 1371884 - DNA, 13 bp, Homo sapiens
atttgtaaattta

SEQ ID NO: 1371885 - DNA, 16 bp, Homo sapiens
atttgtaaatttagtg

SEQ ID NO: 1371886 - DNA, 20 bp, Homo sapiens
atttgtaaatttagtgtttt

SEQ ID NO: 1371887 - DNA, 14 bp, Homo sapiens
atttgtgccagagg

SEQ ID NO: 1371888 - DNA, 14 bp, Homo sapiens
atttgttaaaatta

SEQ ID NO: 1371889 - DNA, 11 bp, Homo sapiens
atttgttgcat

SEQ ID NO: 1371890 - DNA, 13 bp, Homo sapiens
attttaaaacaat

SEQ ID NO: 1371891 - DNA, 22 bp, Homo sapiens
attttaaaatctgagggaaatg

SEQ ID NO: 1371892 - DNA, 17 bp, Homo sapiens
attttaaagtgcaaaag

SEQ ID NO: 1371893 - DNA, 19 bp, Homo sapiens
attttaacttaactgaaat

SEQ ID NO: 1371894 - DNA, 15 bp, Homo sapiens
attttacacagaaac

SEQ ID NO: 1371895 - DNA, 18 bp, Homo sapiens
attttacacagaaacact

SEQ ID NO: 1371896 - DNA, 13 bp, Homo sapiens
attttacagagcg

SEQ ID NO: 1371897 - DNA, 18 bp, Homo sapiens
attttacagctcattaaa

SEQ ID NO: 1371898 - DNA, 17 bp, Homo sapiens
attttacctagctaatt

SEQ ID NO: 1371899 - DNA, 19 bp, Homo sapiens
attttacctagctaattat

SEQ ID NO: 1371900 - DNA, 22 bp, Homo sapiens
attttacctagctaattattta

SEQ ID NO: 1371901 - DNA, 12 bp, Homo sapiens
attttcaagtaa

SEQ ID NO: 1371902 - DNA, 13 bp, Homo sapiens
attttcagagccg

SEQ ID NO: 1371903 - DNA, 19 bp, Homo sapiens
attttcagcattaagctgt

SEQ ID NO: 1371904 - DNA, 17 bp, Homo sapiens
attttcatgaaaatacc

SEQ ID NO: 1371905 - DNA, 20 bp, Homo sapiens
attttcatgaaaataccatt

SEQ ID NO: 1371906 - DNA, 21 bp, Homo sapiens
attttcatgaaaataccattt

SEQ ID NO: 1371907 - DNA, 17 bp, Homo sapiens
attttccaaatgtaata

SEQ ID NO: 1371908 - DNA, 21 bp, Homo sapiens
attttccatttttatttcaaa

SEQ ID NO: 1371909 - DNA, 15 bp, Homo sapiens
attttcctcttgtga

SEQ ID NO: 1371910 - DNA, 16 bp, Homo sapiens
attttctattttaaga

SEQ ID NO: 1371911 - DNA, 14 bp, Homo sapiens
attttctctgtact

SEQ ID NO: 1371912 - DNA, 17 bp, Homo sapiens
attttctctgtactttt

SEQ ID NO: 1371913 - DNA, 17 bp, Homo sapiens
attttgaaaagtaatat

SEQ ID NO: 1371914 - DNA, 21 bp, Homo sapiens
attttgaaaagtaatatttat

SEQ ID NO: 1371915 - DNA, 11 bp, Homo sapiens
attttgaatca

SEQ ID NO: 1371916 - DNA, 14 bp, Homo sapiens
attttgaatcaata

SEQ ID NO: 1371917 - DNA, 19 bp, Homo sapiens
attttgctatcaacaataa

SEQ ID NO: 1371918 - DNA, 19 bp, Homo sapiens
attttggagattataataa

SEQ ID NO: 1371919 - DNA, 12 bp, Homo sapiens
attttgtaagaa

SEQ ID NO: 1371920 - DNA, 17 bp, Homo sapiens
attttgtaagaaggcaa

SEQ ID NO: 1371921 - DNA, 10 bp, Homo sapiens
attttgtatg

SEQ ID NO: 1371922 - DNA, 19 bp, Homo sapiens
atttttaaaaaatattttc

SEQ ID NO: 1371923 - DNA, 23 bp, Homo sapiens
atttttaaaaaatattttctctg

SEQ ID NO: 1371924 - DNA, 23 bp, Homo sapiens
atttttagaataagaatttgcat

SEQ ID NO: 1371925 - DNA, 24 bp, Homo sapiens
atttttagaataagaatttgcata

SEQ ID NO: 1371926 - DNA, 13 bp, Homo sapiens
atttttatagcaa

SEQ ID NO: 1371927 - DNA, 13 bp, Homo sapiens
atttttatatcat

SEQ ID NO: 1371928 - DNA, 17 bp, Homo sapiens
atttttatatcatgcaa

SEQ ID NO: 1371929 - DNA, 22 bp, Homo sapiens
atttttatatcatgcaaaatat

SEQ ID NO: 1371930 - DNA, 14 bp, Homo sapiens
atttttatatttcc

SEQ ID NO: 1371931 - DNA, 17 bp, Homo sapiens
atttttatatttccttt

SEQ ID NO: 1371932 - DNA, 14 bp, Homo sapiens
atttttatttcaaa

SEQ ID NO: 1371933 - DNA, 20 bp, Homo sapiens
atttttcaatagcacatatg

SEQ ID NO: 1371934 - DNA, 18 bp, Homo sapiens
atttttcaatatattgaa

SEQ ID NO: 1371935 - DNA, 15 bp, Homo sapiens
atttttcataaacaa

SEQ ID NO: 1371936 - DNA, 10 bp, Homo sapiens
atttttctct

SEQ ID NO: 1371937 - DNA, 19 bp, Homo sapiens
atttttgcaataccaagta

SEQ ID NO: 1371938 - DNA, 19 bp, Homo sapiens
atttttgtaaatgtgtaca

SEQ ID NO: 1371939 - DNA, 12 bp, Homo sapiens
atttttgttgtt

SEQ ID NO: 1371940 - DNA, 21 bp, Homo sapiens
attttttaagcttcagttgct

SEQ ID NO: 1371941 - DNA, 14 bp, Homo sapiens
attttttaattgtt

SEQ ID NO: 1371942 - DNA, 16 bp, Homo sapiens
attttttgaaaagcag

SEQ ID NO: 1371943 - DNA, 23 bp, Homo sapiens
attttttgactttttttgtatgt

SEQ ID NO: 1371944 - DNA, 13 bp, Homo sapiens
atttttttctatt

SEQ ID NO: 1371945 - DNA, 21 bp, Homo sapiens
atttttttgaactcttctcat

SEQ ID NO: 1371946 - DNA, 17 bp, Homo sapiens
caagggctgtcattgca

SEQ ID NO: 1371947 - DNA, 14 bp, Homo sapiens
caaggtataataaa

SEQ ID NO: 1371948 - DNA, 20 bp, Homo sapiens
caaggtcactgtttcctggg

SEQ ID NO: 1371949 - DNA, 17 bp, Homo sapiens
caaggttataatttttt

SEQ ID NO: 1371950 - DNA, 13 bp, Homo sapiens
caagtagttctgt

SEQ ID NO: 1371951 - DNA, 21 bp, Homo sapiens
caagtagttctgtatttgaaa

SEQ ID NO: 1371952 - DNA, 13 bp, Homo sapiens
caagtcaagtgaa

SEQ ID NO: 1371953 - DNA, 15 bp, Homo sapiens
caagtcagctccagc

SEQ ID NO: 1371954 - DNA, 13 bp, Homo sapiens
caagtgaaattat

SEQ ID NO: 1371955 - DNA, 14 bp, Homo sapiens
caagtgagaccctg

SEQ ID NO: 1371956 - DNA, 15 bp, Homo sapiens
caagtgagaccctgt

SEQ ID NO: 1371957 - DNA, 19 bp, Homo sapiens
caagtgagaccctgtctca

SEQ ID NO: 1371958 - DNA, 21 bp, Homo sapiens
caagtggaccttaggccttcc

SEQ ID NO: 1371959 - DNA, 23 bp, Homo sapiens
caagtggaccttaggccttcctc

SEQ ID NO: 1371960 - DNA, 16 bp, Homo sapiens
caagtgtaaaatattt

SEQ ID NO: 1371961 - DNA, 16 bp, Homo sapiens
caagtgtgaatactgc

SEQ ID NO: 1371962 - DNA, 14 bp, Homo sapiens
caataaaatttaaa

SEQ ID NO: 1371963 - DNA, 20 bp, Homo sapiens
caataaaatttaaaaaataa

SEQ ID NO: 1371964 - DNA, 20 bp, Homo sapiens
caataaaatttttttaaagt

SEQ ID NO: 1371965 - DNA, 19 bp, Homo sapiens
caataaaccctcagagcct

SEQ ID NO: 1371966 - DNA, 13 bp, Homo sapiens
caataaagcttgt

SEQ ID NO: 1371967 - DNA, 17 bp, Homo sapiens
caataaagcttgttgac

SEQ ID NO: 1371968 - DNA, 22 bp, Homo sapiens
caataaattttgaaaagtaata

SEQ ID NO: 1371969 - DNA, 13 bp, Homo sapiens
caataacagctgc

SEQ ID NO: 1371970 - DNA, 17 bp, Homo sapiens
caatagcacatatggaa

SEQ ID NO: 1371971 - DNA, 15 bp, Homo sapiens
caataggctgttccc

SEQ ID NO: 1371972 - DNA, 17 bp, Homo sapiens
caatatctaatatatat

SEQ ID NO: 1371973 - DNA, 16 bp, Homo sapiens
caatattgattgggaa

SEQ ID NO: 1371974 - DNA, 17 bp, Homo sapiens
caatattgattgggaaa

SEQ ID NO: 1371975 - DNA, 19 bp, Homo sapiens
caatatttgaattttaaat

SEQ ID NO: 1371976 - DNA, 16 bp, Homo sapiens
caatatttgttactgt

SEQ ID NO: 1371977 - DNA, 16 bp, Homo sapiens
caatatttttatatca

SEQ ID NO: 1371978 - DNA, 23 bp, Homo sapiens
caatatttttatatcatgcaaaa

SEQ ID NO: 1371979 - DNA, 23 bp, Homo sapiens
caatcaaataagtatttataata

SEQ ID NO: 1371980 - DNA, 18 bp, Homo sapiens
caatcaaggttataattt

SEQ ID NO: 1371981 - DNA, 21 bp, Homo sapiens
caatcctgattcctctctaag

SEQ ID NO: 1371982 - DNA, 19 bp, Homo sapiens
caatctattgcttcaccat

SEQ ID NO: 1371983 - DNA, 15 bp, Homo sapiens
caatctcttcattat

SEQ ID NO: 1371984 - DNA, 22 bp, Homo sapiens
caatctcttcattattctctgc

SEQ ID NO: 1371985 - DNA, 14 bp, Homo sapiens
caatcttactttgt

SEQ ID NO: 1371986 - DNA, 19 bp, Homo sapiens
caatcttactttgtaaatt

SEQ ID NO: 1371987 - DNA, 23 bp, Homo sapiens
caatcttactttgtaaattctga

SEQ ID NO: 1371988 - DNA, 21 bp, Homo sapiens
caatgaagttgaaaatcatag

SEQ ID NO: 1371989 - DNA, 13 bp, Homo sapiens
caatgagagcata

SEQ ID NO: 1371990 - DNA, 20 bp, Homo sapiens
caatgatcaccgactgaaaa

SEQ ID NO: 1371991 - DNA, 22 bp, Homo sapiens
caatgattgttaatttacagct

SEQ ID NO: 1371992 - DNA, 14 bp, Homo sapiens
caatgctgatttgg

SEQ ID NO: 1371993 - DNA, 21 bp, Homo sapiens
caatgctgatttggtgaccaa

SEQ ID NO: 1371994 - DNA, 18 bp, Homo sapiens
caatgcttctagagtttt

SEQ ID NO: 1371995 - DNA, 17 bp, Homo sapiens
caatgctttatttgtaa

SEQ ID NO: 1371996 - DNA, 15 bp, Homo sapiens
caatgtgataaaacc

SEQ ID NO: 1371997 - DNA, 14 bp, Homo sapiens
caatgttctctctt

SEQ ID NO: 1371998 - DNA, 16 bp, Homo sapiens
caattctagtcatata

SEQ ID NO: 1371999 - DNA, 23 bp, Homo sapiens
caattctgtttttaatgctattt

SEQ ID NO: 1372000 - DNA, 16 bp, Homo sapiens
caattgtcacttttta

SEQ ID NO: 1372001 - DNA, 13 bp, Homo sapiens
caattgtcttttt

SEQ ID NO: 1372002 - DNA, 22 bp, Homo sapiens
caatttctgtgttgccaagctc

SEQ ID NO: 1372003 - DNA, 14 bp, Homo sapiens
cacaaatgacttta

SEQ ID NO: 1372004 - DNA, 15 bp, Homo sapiens
cacaaatgactttat

SEQ ID NO: 1372005 - DNA, 17 bp, Homo sapiens
cacaagctgcaccctca

SEQ ID NO: 1372006 - DNA, 23 bp, Homo sapiens
cacaagctgcaccctcaggcagg

SEQ ID NO: 1372007 - DNA, 11 bp, Homo sapiens
cacacacctgt

SEQ ID NO: 1372008 - DNA, 15 bp, Homo sapiens
cacacagcagcagtt

SEQ ID NO: 1372009 - DNA, 21 bp, Homo sapiens
cacaccaatcttactttgtaa

SEQ ID NO: 1372010 - DNA, 23 bp, Homo sapiens
cacaccaatcttactttgtaaat

SEQ ID NO: 1372011 - DNA, 22 bp, Homo sapiens
cacacccaaagctgagcctgca

SEQ ID NO: 1372012 - DNA, 15 bp, Homo sapiens
cacactggttctcaa

SEQ ID NO: 1372013 - DNA, 16 bp, Homo sapiens
cacactggttctcaat

SEQ ID NO: 1372014 - DNA, 11 bp, Homo sapiens
cacagaaacac

SEQ ID NO: 1372015 - DNA, 15 bp, Homo sapiens
cacagaaacactgcc

SEQ ID NO: 1372016 - DNA, 20 bp, Homo sapiens
cacagaaacactgccttttt

SEQ ID NO: 1372017 - DNA, 16 bp, Homo sapiens
cacagaatatttttat

SEQ ID NO: 1372018 - DNA, 12 bp, Homo sapiens
cacagaatgcaa

SEQ ID NO: 1372019 - DNA, 23 bp, Homo sapiens
cacagagcaagagataagtcttt

SEQ ID NO: 1372020 - DNA, 22 bp, Homo sapiens
cacagagctttggtctgtgtgt

SEQ ID NO: 1372021 - DNA, 16 bp, Homo sapiens
cacagagtcaaggcct

SEQ ID NO: 1372022 - DNA, 22 bp, Homo sapiens
cacagcaacgatcacaaatgac

SEQ ID NO: 1372023 - DNA, 20 bp, Homo sapiens
cacagcctagcacagcagct

SEQ ID NO: 1372024 - DNA, 11 bp, Homo sapiens
cacagcctctg

SEQ ID NO: 1372025 - DNA, 12 bp, Homo sapiens
cacagcctgggc

SEQ ID NO: 1372026 - DNA, 21 bp, Homo sapiens
cacagcctgggccccagctcg

SEQ ID NO: 1372027 - DNA, 19 bp, Homo sapiens
cacagcgagggcagctgct

SEQ ID NO: 1372028 - DNA, 21 bp, Homo sapiens
cacagcggaggtgtggagccg

SEQ ID NO: 1372029 - DNA, 14 bp, Homo sapiens
cacagcgtccctgg

SEQ ID NO: 1372030 - DNA, 15 bp, Homo sapiens
cacagcgtccctggc

SEQ ID NO: 1372031 - DNA, 16 bp, Homo sapiens
cacagcgtccctggcg

SEQ ID NO: 1372032 - DNA, 22 bp, Homo sapiens
cacagcgtccctggcgcaggtg

SEQ ID NO: 1372033 - DNA, 15 bp, Homo sapiens
cacaggaccctcgcc

SEQ ID NO: 1372034 - DNA, 21 bp, Homo sapiens
cacaggaggcaggcatggccc

SEQ ID NO: 1372035 - DNA, 18 bp, Homo sapiens
cacagtctccggcctctc

SEQ ID NO: 1372036 - DNA, 17 bp, Homo sapiens
cacagtttttcctggaa

SEQ ID NO: 1372037 - DNA, 14 bp, Homo sapiens
cacatcaaataaga

SEQ ID NO: 1372038 - DNA, 18 bp, Homo sapiens
cacatcaaataagaaata

SEQ ID NO: 1372039 - DNA, 23 bp, Homo sapiens
cacatccgcgtgtgcctgtgtgc

SEQ ID NO: 1372040 - DNA, 13 bp, Homo sapiens
cacatctgcctta

SEQ ID NO: 1372041 - DNA, 20 bp, Homo sapiens
cacatgactcgggggtgggg

SEQ ID NO: 1372042 - DNA, 13 bp, Homo sapiens
cacattgaagaat

SEQ ID NO: 1372043 - DNA, 23 bp, Homo sapiens
cacattgaagaatgttagagtaa

SEQ ID NO: 1372044 - DNA, 21 bp, Homo sapiens
cacatttgctactgttgtaag

SEQ ID NO: 1372045 - DNA, 17 bp, Homo sapiens
caccaatcttactttgt

SEQ ID NO: 1372046 - DNA, 14 bp, Homo sapiens
caccacccctacca

SEQ ID NO: 1372047 - DNA, 22 bp, Homo sapiens
caccagcccatcgccacaaact

SEQ ID NO: 1372048 - DNA, 12 bp, Homo sapiens
caccagccccac

SEQ ID NO: 1372049 - DNA, 20 bp, Homo sapiens
caccagccccactgccagca

SEQ ID NO: 1372050 - DNA, 15 bp, Homo sapiens
caccaggccacctcc

SEQ ID NO: 1372051 - DNA, 22 bp, Homo sapiens
caccaggccacctccccagcat

SEQ ID NO: 1372052 - DNA, 15 bp, Homo sapiens
caccatcaatcctga

SEQ ID NO: 1372053 - DNA, 16 bp, Homo sapiens
cacccaaagctgagcc

SEQ ID NO: 1372054 - DNA, 22 bp, Homo sapiens
cacccaaccctatctcctgaca

SEQ ID NO: 1372055 - DNA, 11 bp, Homo sapiens
caccccaggac

SEQ ID NO: 1372056 - DNA, 18 bp, Homo sapiens
caccccaggacgccactc

SEQ ID NO: 1372057 - DNA, 21 bp, Homo sapiens
cacccccagccccgactccag

SEQ ID NO: 1372058 - DNA, 23 bp, Homo sapiens
cacccccagccccgactccagcc

SEQ ID NO: 1372059 - DNA, 15 bp, Homo sapiens
caccccctcccaccc

SEQ ID NO: 1372060 - DNA, 16 bp, Homo sapiens
caccccctcccacccc

SEQ ID NO: 1372061 - DNA, 13 bp, Homo sapiens
caccccctgccct

SEQ ID NO: 1372062 - DNA, 14 bp, Homo sapiens
caccccctgccctg

SEQ ID NO: 1372063 - DNA, 17 bp, Homo sapiens
caccccctgccctgcac

SEQ ID NO: 1372064 - DNA, 20 bp, Homo sapiens
caccccggggaccctgtgac

SEQ ID NO: 1372065 - DNA, 20 bp, Homo sapiens
cacccctcaacacctctgca

SEQ ID NO: 1372066 - DNA, 22 bp, Homo sapiens
aaaaatataaaattatgagatt

SEQ ID NO: 1372067 - DNA, 14 bp, Homo sapiens
aaaaatatcaaatt

SEQ ID NO: 1372068 - DNA, 16 bp, Homo sapiens
aaaaatatcaaattaa

SEQ ID NO: 1372069 - DNA, 23 bp, Homo sapiens
aaaaatattgtttctgcattcat

SEQ ID NO: 1372070 - DNA, 13 bp, Homo sapiens
aaaaatattttct

SEQ ID NO: 1372071 - DNA, 22 bp, Homo sapiens
aaaaatattttctctgtacttt

SEQ ID NO: 1372072 - DNA, 17 bp, Homo sapiens
aaaacaataggatgggc

SEQ ID NO: 1372073 - DNA, 16 bp, Homo sapiens
aaaacacatgttttta

SEQ ID NO: 1372074 - DNA, 21 bp, Homo sapiens
aaaacatcattcctttttatt

SEQ ID NO: 1372075 - DNA, 14 bp, Homo sapiens
ttgagctatgactt

SEQ ID NO: 1372076 - DNA, 22 bp, Homo sapiens
ttgagctcccacttctgccaga

SEQ ID NO: 1372077 - DNA, 11 bp, Homo sapiens
ttgagctgcct

SEQ ID NO: 1372078 - DNA, 15 bp, Homo sapiens
ttgagctgccttccc

SEQ ID NO: 1372079 - DNA, 21 bp, Homo sapiens
ttgaggccaagaatattgcaa

SEQ ID NO: 1372080 - DNA, 14 bp, Homo sapiens
ttgagggctgcagt

SEQ ID NO: 1372081 - DNA, 15 bp, Homo sapiens
ttgagggctgcagtt

SEQ ID NO: 1372082 - DNA, 13 bp, Homo sapiens
ttgagtattgttt

SEQ ID NO: 1372083 - DNA, 14 bp, Homo sapiens
ttgagtattgttta

SEQ ID NO: 1372084 - DNA, 22 bp, Homo sapiens
ttgagtattgtttaaaatgtaa

SEQ ID NO: 1372085 - DNA, 17 bp, Homo sapiens
ttgagtctgtactaaac

SEQ ID NO: 1372086 - DNA, 17 bp, Homo sapiens
ttgatacattcaaattt

SEQ ID NO: 1372087 - DNA, 21 bp, Homo sapiens
ttgatacattcaaatttgtct

SEQ ID NO: 1372088 - DNA, 21 bp, Homo sapiens
ttgatgatacaatgaacactt

SEQ ID NO: 1372089 - DNA, 12 bp, Homo sapiens
ttgatggctgcg

SEQ ID NO: 1372090 - DNA, 12 bp, Homo sapiens
ttgatgtcagca

SEQ ID NO: 1372091 - DNA, 16 bp, Homo sapiens
ttgattcagctctgca

SEQ ID NO: 1372092 - DNA, 19 bp, Homo sapiens
ttgattgggaaaacatttg

SEQ ID NO: 1372093 - DNA, 21 bp, Homo sapiens
ttgattggtgattaggtggtg

SEQ ID NO: 1372094 - DNA, 23 bp, Homo sapiens
ttcctgtccctgcgcctttcctt

SEQ ID NO: 1372095 - DNA, 19 bp, Homo sapiens
ttcctgttcagtaataaaa

SEQ ID NO: 1372096 - DNA, 20 bp, Homo sapiens
ttccttgagttgattcagct

SEQ ID NO: 1372097 - DNA, 20 bp, Homo sapiens
ttccttgtagcgactaaact

SEQ ID NO: 1372098 - DNA, 14 bp, Homo sapiens
ttcctttcccaagc

SEQ ID NO: 1372099 - DNA, 17 bp, Homo sapiens
ttccttttccctgcttc

SEQ ID NO: 1372100 - DNA, 18 bp, Homo sapiens
ttcctttttatttatatg

SEQ ID NO: 1372101 - DNA, 20 bp, Homo sapiens
ttcctttttatttatatgta

SEQ ID NO: 1372102 - DNA, 15 bp, Homo sapiens
ttcctttttgacact

SEQ ID NO: 1372103 - DNA, 18 bp, Homo sapiens
ttcctttttgacactgaa

SEQ ID NO: 1372104 - DNA, 22 bp, Homo sapiens
ttcgaaacctgggattcaggaa

SEQ ID NO: 1372105 - DNA, 19 bp, Homo sapiens
ttcgcgggtaactggggtt

SEQ ID NO: 1372106 - DNA, 22 bp, Homo sapiens
ttcgcgggtaactggggttgag

SEQ ID NO: 1372107 - DNA, 18 bp, Homo sapiens
ttcgtacataatactgaa

SEQ ID NO: 1372108 - DNA, 16 bp, Homo sapiens
ttctaagaaaagccta

SEQ ID NO: 1372109 - DNA, 21 bp, Homo sapiens
ttctaccacacagcagcagtt

SEQ ID NO: 1372110 - DNA, 20 bp, Homo sapiens
ttctaccggctttgccatgt

SEQ ID NO: 1372111 - DNA, 23 bp, Homo sapiens
ttctactgtcaaatgatgtgcaa

SEQ ID NO: 1372112 - DNA, 21 bp, Homo sapiens
ttctataaaactctgcatgta

SEQ ID NO: 1372113 - DNA, 17 bp, Homo sapiens
ttctataaatagatgct

SEQ ID NO: 1372114 - DNA, 19 bp, Homo sapiens
ttctatagcatcacttaaa

SEQ ID NO: 1372115 - DNA, 15 bp, Homo sapiens
ttctatcctctgtaa

SEQ ID NO: 1372116 - DNA, 18 bp, Homo sapiens
ttctattatggaaaactg

SEQ ID NO: 1372117 - DNA, 22 bp, Homo sapiens
ttctattttaagactgatttta

SEQ ID NO: 1372118 - DNA, 18 bp, Homo sapiens
tggcaataaattttgaaa

SEQ ID NO: 1372119 - DNA, 13 bp, Homo sapiens
tggcacacagcag

SEQ ID NO: 1372120 - DNA, 16 bp, Homo sapiens
tggcaccgcctcccca

SEQ ID NO: 1372121 - DNA, 14 bp, Homo sapiens
tggcactcgctgta

SEQ ID NO: 1372122 - DNA, 16 bp, Homo sapiens
tggcactggaccccag

SEQ ID NO: 1372123 - DNA, 15 bp, Homo sapiens
tggcactggatgcag

SEQ ID NO: 1372124 - DNA, 11 bp, Homo sapiens
tggcagcccag

SEQ ID NO: 1372125 - DNA, 12 bp, Homo sapiens
tggcagcccaga

SEQ ID NO: 1372126 - DNA, 18 bp, Homo sapiens
tggcaggggacaggagtc

SEQ ID NO: 1372127 - DNA, 15 bp, Homo sapiens
tggcataaattgcat

SEQ ID NO: 1372128 - DNA, 21 bp, Homo sapiens
tggcatcgcaccattctgact

SEQ ID NO: 1372129 - DNA, 17 bp, Homo sapiens
tggcatgtaaatgtaaa

SEQ ID NO: 1372130 - DNA, 13 bp, Homo sapiens
tggccacagcgcc

SEQ ID NO: 1372131 - DNA, 18 bp, Homo sapiens
tggccacagcgccagcct

SEQ ID NO: 1372132 - DNA, 18 bp, Homo sapiens
tggccactccgagaggtg

SEQ ID NO: 1372133 - DNA, 13 bp, Homo sapiens
tggccagagagcc

SEQ ID NO: 1372134 - DNA, 12 bp, Homo sapiens
tggccaggagca

SEQ ID NO: 1372135 - DNA, 13 bp, Homo sapiens
tggccccaccctg

SEQ ID NO: 1372136 - DNA, 22 bp, Homo sapiens
tggccccaccctgggccctggg

SEQ ID NO: 1372137 - DNA, 16 bp, Homo sapiens
tggccccagccctgct

SEQ ID NO: 1372138 - DNA, 21 bp, Homo sapiens
tggccccagccctgctgggga

SEQ ID NO: 1372139 - DNA, 16 bp, Homo sapiens
tggccccgtttctggt

SEQ ID NO: 1372140 - DNA, 13 bp, Homo sapiens
tggccctagactc

SEQ ID NO: 1372141 - DNA, 16 bp, Homo sapiens
tggccgcgctccgggc

SEQ ID NO: 1372142 - DNA, 13 bp, Homo sapiens
tggcctcatgtgg

SEQ ID NO: 1372143 - DNA, 19 bp, Homo sapiens
tggcctcatgtggctggaa

SEQ ID NO: 1372144 - DNA, 15 bp, Homo sapiens
tggcctcccctgcca

SEQ ID NO: 1372145 - DNA, 13 bp, Homo sapiens
tggcctctctagc

SEQ ID NO: 1372146 - DNA, 11 bp, Homo sapiens
tggcctgctgt

SEQ ID NO: 1372147 - DNA, 12 bp, Homo sapiens
tggcctgctgtg

SEQ ID NO: 1372148 - DNA, 16 bp, Homo sapiens
tggcctgtggctgtcg

SEQ ID NO: 1372149 - DNA, 20 bp, Homo sapiens
tggccttgtcctcagccagt

SEQ ID NO: 1372150 - DNA, 17 bp, Homo sapiens
tggcctttgtaagtgca

SEQ ID NO: 1372151 - DNA, 18 bp, Homo sapiens
tggcgccgtctccagggg

SEQ ID NO: 1372152 - DNA, 14 bp, Homo sapiens
tggcggccccagca

SEQ ID NO: 1372153 - DNA, 13 bp, Homo sapiens
tggctatcctgat

SEQ ID NO: 1372154 - DNA, 14 bp, Homo sapiens
tggctatcctgatt

SEQ ID NO: 1372155 - DNA, 18 bp, Homo sapiens
tggctcagacatgttttc

SEQ ID NO: 1372156 - DNA, 15 bp, Homo sapiens
tggctccaggccaaa

SEQ ID NO: 1372157 - DNA, 15 bp, Homo sapiens
tggctccggcctctg

SEQ ID NO: 1372158 - DNA, 19 bp, Homo sapiens
tggctccggcctctgcctt

SEQ ID NO: 1372159 - DNA, 20 bp, Homo sapiens
tggctcgaatctctgtgcct

SEQ ID NO: 1372160 - DNA, 19 bp, Homo sapiens
tggctctgagcgcctccat

SEQ ID NO: 1372161 - DNA, 16 bp, Homo sapiens
tggctgaaattctcct

SEQ ID NO: 1372162 - DNA, 19 bp, Homo sapiens
tggctgaaattctcctgga

SEQ ID NO: 1372163 - DNA, 20 bp, Homo sapiens
tggctgaaattctcctggag

SEQ ID NO: 1372164 - DNA, 21 bp, Homo sapiens
tggctgaaattctcctggagg

SEQ ID NO: 1372165 - DNA, 21 bp, Homo sapiens
tggctgaggttcctctgcctg

SEQ ID NO: 1372166 - DNA, 16 bp, Homo sapiens
tggctgctgcccccac

SEQ ID NO: 1372167 - DNA, 14 bp, Homo sapiens
tggctgctgttgct

SEQ ID NO: 1372168 - DNA, 21 bp, Homo sapiens
tggctggaagatcctgcgggt

SEQ ID NO: 1372169 - DNA, 16 bp, Homo sapiens
tggctgtaatcatttg

SEQ ID NO: 1372170 - DNA, 18 bp, Homo sapiens
tggctgtcaatgggacct

SEQ ID NO: 1372171 - DNA, 14 bp, Homo sapiens
tggcttctgtgatg

SEQ ID NO: 1372172 - DNA, 17 bp, Homo sapiens
tggcttctgtgatgagc

SEQ ID NO: 1372173 - DNA, 21 bp, Homo sapiens
tggcttctgtgatgagctgat

SEQ ID NO: 1372174 - DNA, 22 bp, Homo sapiens
tggcttctgtgatgagctgatc

SEQ ID NO: 1372175 - DNA, 13 bp, Homo sapiens
tggcttgtctata

SEQ ID NO: 1372176 - DNA, 12 bp, Homo sapiens
tggcttgttcat

SEQ ID NO: 1372177 - DNA, 22 bp, Homo sapiens
tggcttgttcatcatccagatg

SEQ ID NO: 1372178 - DNA, 23 bp, Homo sapiens
tgggaaagcgcggacgtgctggg

SEQ ID NO: 1372179 - DNA, 22 bp, Homo sapiens
tgggaagcccatcctgaccagc

SEQ ID NO: 1372180 - DNA, 16 bp, Homo sapiens
tgggaatgaggaaaat

SEQ ID NO: 1372181 - DNA, 14 bp, Homo sapiens
tgggaatgaggtgg

SEQ ID NO: 1372182 - DNA, 17 bp, Homo sapiens
tgggaatgaggtgggag

SEQ ID NO: 1372183 - DNA, 14 bp, Homo sapiens
tgggacccccgtgg

SEQ ID NO: 1372184 - DNA, 22 bp, Homo sapiens
tgggacccccgtggggcaggga

SEQ ID NO: 1372185 - DNA, 19 bp, Homo sapiens
tgggacctgccaggcaggg

SEQ ID NO: 1372186 - DNA, 18 bp, Homo sapiens
tgtggcctcttctgagct

SEQ ID NO: 1372187 - DNA, 11 bp, Homo sapiens
tgtggcctgca

SEQ ID NO: 1372188 - DNA, 17 bp, Homo sapiens
tgtggcctgcacagtga

SEQ ID NO: 1372189 - DNA, 19 bp, Homo sapiens
tgtggcgccgtctccaggg

SEQ ID NO: 1372190 - DNA, 16 bp, Homo sapiens
tgtgggcttgaccagg

SEQ ID NO: 1372191 - DNA, 13 bp, Homo sapiens
tgtggttcctctg

SEQ ID NO: 1372192 - DNA, 18 bp, Homo sapiens
tgtggtttactagcagga

SEQ ID NO: 1372193 - DNA, 12 bp, Homo sapiens
tgtggtttcatt

SEQ ID NO: 1372194 - DNA, 20 bp, Homo sapiens
tgtgtaaacaaaatgaagct

SEQ ID NO: 1372195 - DNA, 13 bp, Homo sapiens
tgtgtaatgaaaa

SEQ ID NO: 1372196 - DNA, 13 bp, Homo sapiens
tgtgtatatggta

SEQ ID NO: 1372197 - DNA, 15 bp, Homo sapiens
tgtgtatatttgatt

SEQ ID NO: 1372198 - DNA, 20 bp, Homo sapiens
tgtgtccatgcgctcagggc

SEQ ID NO: 1372199 - DNA, 23 bp, Homo sapiens
tgtgtggattgcctctgaaaagt

SEQ ID NO: 1372200 - DNA, 11 bp, Homo sapiens
tgtgtggcctg

SEQ ID NO: 1372201 - DNA, 14 bp, Homo sapiens
tgtgtggtagaaac

SEQ ID NO: 1372202 - DNA, 16 bp, Homo sapiens
tgtgtgtcccaggcag

SEQ ID NO: 1372203 - DNA, 19 bp, Homo sapiens
tgtgtgtcccaggcaggga

SEQ ID NO: 1372204 - DNA, 16 bp, Homo sapiens
tgtgtgtgacaattct

SEQ ID NO: 1372205 - DNA, 14 bp, Homo sapiens
tgtgtgtgtgtgca

SEQ ID NO: 1372206 - DNA, 14 bp, Homo sapiens
tgtgttaatttaag

SEQ ID NO: 1372207 - DNA, 19 bp, Homo sapiens
tgtgttgtctcttgagttt

SEQ ID NO: 1372208 - DNA, 18 bp, Homo sapiens
tgtgtttagaattgaagg

SEQ ID NO: 1372209 - DNA, 14 bp, Homo sapiens
tgtgtttatttcac

SEQ ID NO: 1372210 - DNA, 15 bp, Homo sapiens
tgttaaaagttttat

SEQ ID NO: 1372211 - DNA, 19 bp, Homo sapiens
tgttaatggatttcagaag

SEQ ID NO: 1372212 - DNA, 19 bp, Homo sapiens
tgttacaagtttatatata

SEQ ID NO: 1372213 - DNA, 14 bp, Homo sapiens
tgttacctctgaat

SEQ ID NO: 1372214 - DNA, 15 bp, Homo sapiens
tgttactgggccctg

SEQ ID NO: 1372215 - DNA, 15 bp, Homo sapiens
tgttactgtcttcag

SEQ ID NO: 1372216 - DNA, 21 bp, Homo sapiens
tgttaggattttcacattctt

SEQ ID NO: 1372217 - DNA, 15 bp, Homo sapiens
tgttatatgaacata

SEQ ID NO: 1372218 - DNA, 13 bp, Homo sapiens
tgttatcaaaata

SEQ ID NO: 1372219 - DNA, 17 bp, Homo sapiens
tgttatgtttaataagc

SEQ ID NO: 1372220 - DNA, 18 bp, Homo sapiens
tgttattttctgttgaag

SEQ ID NO: 1372221 - DNA, 16 bp, Homo sapiens
tgttcacaatatattt

SEQ ID NO: 1372222 - DNA, 20 bp, Homo sapiens
tgttcatagcccagtagacc

SEQ ID NO: 1372223 - DNA, 16 bp, Homo sapiens
tgttcatcatccagat

SEQ ID NO: 1372224 - DNA, 21 bp, Homo sapiens
tgttcggaaggggttcctcaa

SEQ ID NO: 1372225 - DNA, 20 bp, Homo sapiens
tgtagcaaccttctgcattc

SEQ ID NO: 1372226 - DNA, 19 bp, Homo sapiens
tgtagcacttactggtagg

SEQ ID NO: 1372227 - DNA, 22 bp, Homo sapiens
tgtagcagtgagtcatatctta

SEQ ID NO: 1372228 - DNA, 13 bp, Homo sapiens
tgtaggagacttg

SEQ ID NO: 1372229 - DNA, 22 bp, Homo sapiens
tgtaggagacttgccagagccg

SEQ ID NO: 1372230 - DNA, 14 bp, Homo sapiens
tgtaggtaagactg

SEQ ID NO: 1372231 - DNA, 14 bp, Homo sapiens
tgtagttctttaaa

SEQ ID NO: 1372232 - DNA, 17 bp, Homo sapiens
tgtagttctttaaactg

SEQ ID NO: 1372233 - DNA, 14 bp, Homo sapiens
tgtataaaatacat

SEQ ID NO: 1372234 - DNA, 14 bp, Homo sapiens
tgtataaatataca

SEQ ID NO: 1372235 - DNA, 19 bp, Homo sapiens
tgtataaatatacagtata

SEQ ID NO: 1372236 - DNA, 13 bp, Homo sapiens
tgtataatataaa

SEQ ID NO: 1372237 - DNA, 19 bp, Homo sapiens
tgtatagttatgtaaataa

SEQ ID NO: 1372238 - DNA, 14 bp, Homo sapiens
tgtatattggtttt

SEQ ID NO: 1372239 - DNA, 13 bp, Homo sapiens
tgtatattgtaat

SEQ ID NO: 1372240 - DNA, 14 bp, Homo sapiens
tgtatatttgattt

SEQ ID NO: 1372241 - DNA, 18 bp, Homo sapiens
tgtatcctggaacaatat

SEQ ID NO: 1372242 - DNA, 20 bp, Homo sapiens
tgtatgaaaaattggggagg

SEQ ID NO: 1372243 - DNA, 21 bp, Homo sapiens
tgtatgaaaaattggggagga

SEQ ID NO: 1372244 - DNA, 13 bp, Homo sapiens
tgtatgaaaacat

SEQ ID NO: 1372245 - DNA, 16 bp, Homo sapiens
tgtatgagtagccagg

SEQ ID NO: 1372246 - DNA, 15 bp, Homo sapiens
tgtatgtagaagcat

SEQ ID NO: 1372247 - DNA, 12 bp, Homo sapiens
tgtatgtgttta

SEQ ID NO: 1372248 - DNA, 15 bp, Homo sapiens
tgtatgttaaagaga

SEQ ID NO: 1372249 - DNA, 21 bp, Homo sapiens
tgtattatttacatttaatag

SEQ ID NO: 1372250 - DNA, 18 bp, Homo sapiens
tgtattcttttctcagtg

SEQ ID NO: 1372251 - DNA, 14 bp, Homo sapiens
tgtatttaacagaa

SEQ ID NO: 1372252 - DNA, 15 bp, Homo sapiens
tgtatttaacagaaa

SEQ ID NO: 1372253 - DNA, 17 bp, Homo sapiens
tgtatttgaaataagaa

SEQ ID NO: 1372254 - DNA, 14 bp, Homo sapiens
tgtattttgattat

SEQ ID NO: 1372255 - DNA, 17 bp, Homo sapiens
tgtcaaaagtagaactt

SEQ ID NO: 1372256 - DNA, 17 bp, Homo sapiens
tgtcaaatgatgtgcaa

SEQ ID NO: 1372257 - DNA, 19 bp, Homo sapiens
tgtcaaatgatgtgcaaaa

SEQ ID NO: 1372258 - DNA, 14 bp, Homo sapiens
tgtcacgaatatgg

SEQ ID NO: 1372259 - DNA, 23 bp, Homo sapiens
tgtcactcattgctgagcctctg

SEQ ID NO: 1372260 - DNA, 12 bp, Homo sapiens
tgtcacttttta

SEQ ID NO: 1372261 - DNA, 17 bp, Homo sapiens
tgtcagaagtgcagaat

SEQ ID NO: 1372262 - DNA, 21 bp, Homo sapiens
tgtcagacagaacttgaatgt

SEQ ID NO: 1372263 - DNA, 20 bp, Homo sapiens
tgtcagcagttgctggtaaa

SEQ ID NO: 1372264 - DNA, 19 bp, Homo sapiens
tgtcagctgaacctgggta

SEQ ID NO: 1372265 - DNA, 11 bp, Homo sapiens
tgtcaggcctt

SEQ ID NO: 1372266 - DNA, 19 bp, Homo sapiens
tgtcaggccttcagggttc

SEQ ID NO: 1372267 - DNA, 15 bp, Homo sapiens
tgtcaggttatttat

SEQ ID NO: 1372268 - DNA, 14 bp, Homo sapiens
tgtcagttttcata

SEQ ID NO: 1372269 - DNA, 22 bp, Homo sapiens
tgtcattcagagtcagccagga

SEQ ID NO: 1372270 - DNA, 17 bp, Homo sapiens
tgtccaaacgtcctctt

SEQ ID NO: 1372271 - DNA, 19 bp, Homo sapiens
tgtccaaagaggctgcccc

SEQ ID NO: 1372272 - DNA, 12 bp, Homo sapiens
tgtccagcacct

SEQ ID NO: 1372273 - DNA, 19 bp, Homo sapiens
tgtccagcaccttgtgcct

SEQ ID NO: 1372274 - DNA, 16 bp, Homo sapiens
tgtccagtaagatcac

SEQ ID NO: 1372275 - DNA, 22 bp, Homo sapiens
tgtccagtaagatcactgttta

SEQ ID NO: 1372276 - DNA, 20 bp, Homo sapiens
tgtccatacactttgttgca

SEQ ID NO: 1372277 - DNA, 17 bp, Homo sapiens
tgtcccaggcagggaga

SEQ ID NO: 1372278 - DNA, 16 bp, Homo sapiens
tgtccccgcagccctg

SEQ ID NO: 1372279 - DNA, 18 bp, Homo sapiens
tgtccccgctgctgtgca

SEQ ID NO: 1372280 - DNA, 13 bp, Homo sapiens
tgtccgagctttg

SEQ ID NO: 1372281 - DNA, 18 bp, Homo sapiens
tgtcctaatggtgatgca

SEQ ID NO: 1372282 - DNA, 11 bp, Homo sapiens
tgtcctgtcct

SEQ ID NO: 1372283 - DNA, 14 bp, Homo sapiens
tgtcgctcatgtgt

SEQ ID NO: 1372284 - DNA, 22 bp, Homo sapiens
tgtcgctcatgtgtgcaacagg

SEQ ID NO: 1372285 - DNA, 16 bp, Homo sapiens
tgtctaaacaatgctg

SEQ ID NO: 1372286 - DNA, 22 bp, Homo sapiens
tgtctaaacaatgctgatttgg

SEQ ID NO: 1372287 - DNA, 23 bp, Homo sapiens
tgtctaaagtgtattttcagagc

SEQ ID NO: 1372288 - DNA, 19 bp, Homo sapiens
tgtctaggattttggatgt

SEQ ID NO: 1372289 - DNA, 15 bp, Homo sapiens
tgtctataaaagaaa

SEQ ID NO: 1372290 - DNA, 16 bp, Homo sapiens
tgtctataaaagaaac

SEQ ID NO: 1372291 - DNA, 21 bp, Homo sapiens
tgtctccttaagctgcagaga

SEQ ID NO: 1372292 - DNA, 16 bp, Homo sapiens
tgtctgggtttgagaa

SEQ ID NO: 1372293 - DNA, 14 bp, Homo sapiens
tgtctggtggcccc

SEQ ID NO: 1372294 - DNA, 14 bp, Homo sapiens
tgtctggttaaaaa

SEQ ID NO: 1372295 - DNA, 16 bp, Homo sapiens
tgtctggttaaaaaat

SEQ ID NO: 1372296 - DNA, 12 bp, Homo sapiens
tgtctgtaaata

SEQ ID NO: 1372297 - DNA, 19 bp, Homo sapiens
tgtctgtgaacagagagac

SEQ ID NO: 1372298 - DNA, 13 bp, Homo sapiens
tgtcttgggcaga

SEQ ID NO: 1372299 - DNA, 15 bp, Homo sapiens
tgtctttttgttgta

SEQ ID NO: 1372300 - DNA, 23 bp, Homo sapiens
tgtgaaaagaaaaatgagcctgg

SEQ ID NO: 1372301 - DNA, 14 bp, Homo sapiens
tgtgaaaatgtgtt

SEQ ID NO: 1372302 - DNA, 15 bp, Homo sapiens
tgtgaacagagagac

SEQ ID NO: 1372303 - DNA, 15 bp, Homo sapiens
tgtgaacttggaagc

SEQ ID NO: 1372304 - DNA, 18 bp, Homo sapiens
tgtgaacttggaagcaca

SEQ ID NO: 1372305 - DNA, 14 bp, Homo sapiens
tgtgaagagaacca

SEQ ID NO: 1372306 - DNA, 12 bp, Homo sapiens
tgtgaataaatt

SEQ ID NO: 1372307 - DNA, 16 bp, Homo sapiens
tgtgaattattgacac

SEQ ID NO: 1372308 - DNA, 21 bp, Homo sapiens
tgtgaattattgacactgaac

SEQ ID NO: 1372309 - DNA, 22 bp, Homo sapiens
tgtgaatttttaagctgcaaat

SEQ ID NO: 1372310 - DNA, 15 bp, Homo sapiens
tgtgacaattctgtt

SEQ ID NO: 1372311 - DNA, 22 bp, Homo sapiens
tgtgacatggtgcctgagaggc

SEQ ID NO: 1372312 - DNA, 20 bp, Homo sapiens
tgtgactgtacccaaatgga

SEQ ID NO: 1372313 - DNA, 23 bp, Homo sapiens
tgtgagaagtgaatgctgggact

SEQ ID NO: 1372314 - DNA, 14 bp, Homo sapiens
tgtgatgagctgat

SEQ ID NO: 1372315 - DNA, 19 bp, Homo sapiens
tgtgatttctttaaaagaa

SEQ ID NO: 1372316 - DNA, 21 bp, Homo sapiens
tgtgatttctttaaaagaatg

SEQ ID NO: 1372317 - DNA, 20 bp, Homo sapiens
tgtgcaaaaccttttactgg

SEQ ID NO: 1372318 - DNA, 21 bp, Homo sapiens
tgtgcaacggtctcctgactg

SEQ ID NO: 1372319 - DNA, 21 bp, Homo sapiens
tgtgcacatccgcgtgtgcct

SEQ ID NO: 1372320 - DNA, 22 bp, Homo sapiens
tgtgcacatccgcgtgtgcctg

SEQ ID NO: 1372321 - DNA, 15 bp, Homo sapiens
tgtgcatagtttctt

SEQ ID NO: 1372322 - DNA, 21 bp, Homo sapiens
tgtgccactaaactacattgt

SEQ ID NO: 1372323 - DNA, 20 bp, Homo sapiens
tgtgccagaggaatcctggc

SEQ ID NO: 1372324 - DNA, 21 bp, Homo sapiens
tgtgccagaggaatcctggca

SEQ ID NO: 1372325 - DNA, 23 bp, Homo sapiens
tgtgccagaggaatcctggcagc

SEQ ID NO: 1372326 - DNA, 21 bp, Homo sapiens
tgtgcccagaatactgatgga

SEQ ID NO: 1372327 - DNA, 13 bp, Homo sapiens
tgtgccctcctga

SEQ ID NO: 1372328 - DNA, 17 bp, Homo sapiens
tgtgccctcctgaccca

SEQ ID NO: 1372329 - DNA, 23 bp, Homo sapiens
tgtgccctcctgacccattgctg

SEQ ID NO: 1372330 - DNA, 14 bp, Homo sapiens
tgtgccttcgtctt

SEQ ID NO: 1372331 - DNA, 16 bp, Homo sapiens
tgtgccttcttttgat

SEQ ID NO: 1372332 - DNA, 15 bp, Homo sapiens
tgtgctcagagacac

SEQ ID NO: 1372333 - DNA, 10 bp, Homo sapiens
tgtgctggga

SEQ ID NO: 1372334 - DNA, 21 bp, Homo sapiens
tgtgctgggagctccactctg

SEQ ID NO: 1372335 - DNA, 12 bp, Homo sapiens
tgtgctgtgtgt

SEQ ID NO: 1372336 - DNA, 23 bp, Homo sapiens
tgtgcttcacagtagagccagct

SEQ ID NO: 1372337 - DNA, 22 bp, Homo sapiens
tgtggaaggcaagccaggctca

SEQ ID NO: 1372338 - DNA, 23 bp, Homo sapiens
tgtggactgtggcacttgcctgg

SEQ ID NO: 1372339 - DNA, 12 bp, Homo sapiens
tgtggagaagcg

SEQ ID NO: 1372340 - DNA, 19 bp, Homo sapiens
tgtggagccgaggcctacc

SEQ ID NO: 1372341 - DNA, 20 bp, Homo sapiens
tgtggagccgaggcctaccc

SEQ ID NO: 1372342 - DNA, 15 bp, Homo sapiens
tgtggcacttgcctg

SEQ ID NO: 1372343 - DNA, 12 bp, Homo sapiens
tgtggccaggct

SEQ ID NO: 1372344 - DNA, 19 bp, Homo sapiens
tgtggccccaccctgggcc

SEQ ID NO: 1372345 - DNA, 23 bp, Homo sapiens
tgtggccccaccctgggccctgg

SEQ ID NO: 1372346 - DNA, 18 bp, Homo sapiens
tgggacctgtggctgtcg

SEQ ID NO: 1372347 - DNA, 13 bp, Homo sapiens
tgggacggcggca

SEQ ID NO: 1372348 - DNA, 23 bp, Homo sapiens
tgggacgggatggttctggctgt

SEQ ID NO: 1372349 - DNA, 13 bp, Homo sapiens
tgggactcagcct

SEQ ID NO: 1372350 - DNA, 18 bp, Homo sapiens
tgggactcgtggctgtca

SEQ ID NO: 1372351 - DNA, 14 bp, Homo sapiens
tgggaggagggaga

SEQ ID NO: 1372352 - DNA, 19 bp, Homo sapiens
tgggaggagggagagggag

SEQ ID NO: 1372353 - DNA, 18 bp, Homo sapiens
tgggaggatctcttgagc

SEQ ID NO: 1372354 - DNA, 18 bp, Homo sapiens
tgggaggattgcttgagc

SEQ ID NO: 1372355 - DNA, 22 bp, Homo sapiens
tgggaggattgcttgagctcag

SEQ ID NO: 1372356 - DNA, 14 bp, Homo sapiens
tgggaggctgaggc

SEQ ID NO: 1372357 - DNA, 15 bp, Homo sapiens
tgggaggctgaggca

SEQ ID NO: 1372358 - DNA, 17 bp, Homo sapiens
tgggaggtcaaggctgc

SEQ ID NO: 1372359 - DNA, 23 bp, Homo sapiens
tgggaggtcaaggctgcagtgag

SEQ ID NO: 1372360 - DNA, 20 bp, Homo sapiens
tgggagtactctcatcacta

SEQ ID NO: 1372361 - DNA, 20 bp, Homo sapiens
tgggagtttttatgagaaac

SEQ ID NO: 1372362 - DNA, 18 bp, Homo sapiens
tgggatattgaatgttaa

SEQ ID NO: 1372363 - DNA, 16 bp, Homo sapiens
tgggatgaaactaaag

SEQ ID NO: 1372364 - DNA, 16 bp, Homo sapiens
tgggcagagctggctc

SEQ ID NO: 1372365 - DNA, 15 bp, Homo sapiens
tgggcattgccatgt

SEQ ID NO: 1372366 - DNA, 14 bp, Homo sapiens
tgggccctgggctg

SEQ ID NO: 1372367 - DNA, 13 bp, Homo sapiens
tgggccgctgcca

SEQ ID NO: 1372368 - DNA, 15 bp, Homo sapiens
tgggcctcggcccct

SEQ ID NO: 1372369 - DNA, 19 bp, Homo sapiens
tgggcctcggcccctccca

SEQ ID NO: 1372370 - DNA, 21 bp, Homo sapiens
tgggctgaccccggtggcggc

SEQ ID NO: 1372371 - DNA, 23 bp, Homo sapiens
tgggctggacttctacctgccct

SEQ ID NO: 1372372 - DNA, 13 bp, Homo sapiens
tgggcttatatct

SEQ ID NO: 1372373 - DNA, 22 bp, Homo sapiens
tgggcttatatctggcctctgc

SEQ ID NO: 1372374 - DNA, 14 bp, Homo sapiens
tgggcttgaccagg

SEQ ID NO: 1372375 - DNA, 15 bp, Homo sapiens
tgggcttggcctgct

SEQ ID NO: 1372376 - DNA, 19 bp, Homo sapiens
tgggcttggcctgctgtga

SEQ ID NO: 1372377 - DNA, 17 bp, Homo sapiens
tggggaaaggaggtggg

SEQ ID NO: 1372378 - DNA, 21 bp, Homo sapiens
tggggatccccgcctggccag

SEQ ID NO: 1372379 - DNA, 15 bp, Homo sapiens
tggggcaggctgggc

SEQ ID NO: 1372380 - DNA, 18 bp, Homo sapiens
tggggcaggctgggccat

SEQ ID NO: 1372381 - DNA, 20 bp, Homo sapiens
tggggcaggctgggccatgt

SEQ ID NO: 1372382 - DNA, 12 bp, Homo sapiens
tggggcagggag

SEQ ID NO: 1372383 - DNA, 17 bp, Homo sapiens
tggggcatcctgtgcca

SEQ ID NO: 1372384 - DNA, 21 bp, Homo sapiens
tggggccaccaaagctgccca

SEQ ID NO: 1372385 - DNA, 22 bp, Homo sapiens
tggggcccagtgcatggtggcc

SEQ ID NO: 1372386 - DNA, 22 bp, Homo sapiens
tggggcctagcgatctctcctg

SEQ ID NO: 1372387 - DNA, 14 bp, Homo sapiens
tggggcctccagaa

SEQ ID NO: 1372388 - DNA, 20 bp, Homo sapiens
tgggggatcacagcctctga

SEQ ID NO: 1372389 - DNA, 15 bp, Homo sapiens
tggggggcattgagt

SEQ ID NO: 1372390 - DNA, 19 bp, Homo sapiens
tggggggctgaggtgggag

SEQ ID NO: 1372391 - DNA, 12 bp, Homo sapiens
tggggttttgta

SEQ ID NO: 1372392 - DNA, 16 bp, Homo sapiens
tgggtaactagggaag

SEQ ID NO: 1372393 - DNA, 20 bp, Homo sapiens
tgggtggcaccagcagcctg

SEQ ID NO: 1372394 - DNA, 14 bp, Homo sapiens
tgggttcctcctct

SEQ ID NO: 1372395 - DNA, 14 bp, Homo sapiens
tgggtttgagaaat

SEQ ID NO: 1372396 - DNA, 15 bp, Homo sapiens
tggtaaaatgaagaa

SEQ ID NO: 1372397 - DNA, 13 bp, Homo sapiens
tggtaaatgtttc

SEQ ID NO: 1372398 - DNA, 21 bp, Homo sapiens
tggtaatcccctaaaataaca

SEQ ID NO: 1372399 - DNA, 20 bp, Homo sapiens
tggtacaacggaggcctgcg

SEQ ID NO: 1372400 - DNA, 21 bp, Homo sapiens
tggtaccaatcatgaatcttt

SEQ ID NO: 1372401 - DNA, 16 bp, Homo sapiens
tggtaggaccaagcat

SEQ ID NO: 1372402 - DNA, 22 bp, Homo sapiens
tggtaggaccaagcatcttggg

SEQ ID NO: 1372403 - DNA, 14 bp, Homo sapiens
tggtagtttctgtg

SEQ ID NO: 1372404 - DNA, 20 bp, Homo sapiens
tggtcacgtttggtgcttct

SEQ ID NO: 1372405 - DNA, 22 bp, Homo sapiens
tggtccctccagaaccaccccg

SEQ ID NO: 1372406 - DNA, 21 bp, Homo sapiens
tggtcctagaggccctttgct

SEQ ID NO: 1372407 - DNA, 19 bp, Homo sapiens
tggtctcttcttggggccc

SEQ ID NO: 1372408 - DNA, 18 bp, Homo sapiens
tggtctgttggcaggctg

SEQ ID NO: 1372409 - DNA, 11 bp, Homo sapiens
tggtctttgag

SEQ ID NO: 1372410 - DNA, 20 bp, Homo sapiens
tggtgatttgaaaaatataa

SEQ ID NO: 1372411 - DNA, 14 bp, Homo sapiens
tggtgcctgagagg

SEQ ID NO: 1372412 - DNA, 15 bp, Homo sapiens
tggtgcctgagaggc

SEQ ID NO: 1372413 - DNA, 17 bp, Homo sapiens
tggtgcctgagaggcag

SEQ ID NO: 1372414 - DNA, 18 bp, Homo sapiens
tggtgcctgagaggcagg

SEQ ID NO: 1372415 - DNA, 19 bp, Homo sapiens
tggtgcttccaaatattgt

SEQ ID NO: 1372416 - DNA, 23 bp, Homo sapiens
tggtgcttctcagatttctgagg

SEQ ID NO: 1372417 - DNA, 19 bp, Homo sapiens
tggtggcaacattcattgc

SEQ ID NO: 1372418 - DNA, 18 bp, Homo sapiens
tggtgggggcctcggtgt

SEQ ID NO: 1372419 - DNA, 14 bp, Homo sapiens
tggtggtagagaag

SEQ ID NO: 1372420 - DNA, 15 bp, Homo sapiens
tggtggtctgttggc

SEQ ID NO: 1372421 - DNA, 15 bp, Homo sapiens
tggttacttcttctc

SEQ ID NO: 1372422 - DNA, 21 bp, Homo sapiens
tggttacttcttctcttagat

SEQ ID NO: 1372423 - DNA, 12 bp, Homo sapiens
tggttctggcca

SEQ ID NO: 1372424 - DNA, 11 bp, Homo sapiens
tggttgcatgg

SEQ ID NO: 1372425 - DNA, 20 bp, Homo sapiens
tggttgtgtgtccccttgca

SEQ ID NO: 1372426 - DNA, 22 bp, Homo sapiens
tggtttcctccatttgagaaaa

SEQ ID NO: 1372427 - DNA, 21 bp, Homo sapiens
tggttttctgccaatgaccaa

SEQ ID NO: 1372428 - DNA, 23 bp, Homo sapiens
tggtttttaaaaaactgctgact

SEQ ID NO: 1372429 - DNA, 14 bp, Homo sapiens
tgtaaaaaaaccac

SEQ ID NO: 1372430 - DNA, 23 bp, Homo sapiens
tgtaaaaaaaccaccaaaaacaa

SEQ ID NO: 1372431 - DNA, 16 bp, Homo sapiens
tgtaaaaatcttttga

SEQ ID NO: 1372432 - DNA, 21 bp, Homo sapiens
tgtaaaatattttgaatcaat

SEQ ID NO: 1372433 - DNA, 18 bp, Homo sapiens
tgtaaacagcctcttttt

SEQ ID NO: 1372434 - DNA, 22 bp, Homo sapiens
tgtaaactcatctgaaatgtta

SEQ ID NO: 1372435 - DNA, 19 bp, Homo sapiens
tgtaaagtatgtattattt

SEQ ID NO: 1372436 - DNA, 15 bp, Homo sapiens
tgtaaataatttatt

SEQ ID NO: 1372437 - DNA, 21 bp, Homo sapiens
tgtaaatacacatagcatgta

SEQ ID NO: 1372438 - DNA, 18 bp, Homo sapiens
tgtaaatatttatttatg

SEQ ID NO: 1372439 - DNA, 15 bp, Homo sapiens
tgtaaatgtaaactc

SEQ ID NO: 1372440 - DNA, 15 bp, Homo sapiens
tgtaaattctgattt

SEQ ID NO: 1372441 - DNA, 19 bp, Homo sapiens
tgtaaattctgatttcttt

SEQ ID NO: 1372442 - DNA, 20 bp, Homo sapiens
tgtaacttccaaataaataa

SEQ ID NO: 1372443 - DNA, 17 bp, Homo sapiens
tgtaagaaggcaatatt

SEQ ID NO: 1372444 - DNA, 22 bp, Homo sapiens
tgtaagcatactttgtaaatag

SEQ ID NO: 1372445 - DNA, 14 bp, Homo sapiens
tgtaagtgggccca

SEQ ID NO: 1372446 - DNA, 18 bp, Homo sapiens
tgtaatgaaaatgaatat

SEQ ID NO: 1372447 - DNA, 17 bp, Homo sapiens
tgtaattacttattgta

SEQ ID NO: 1372448 - DNA, 16 bp, Homo sapiens
tgtaatttaaatgaaa

SEQ ID NO: 1372449 - DNA, 14 bp, Homo sapiens
tgtaatttgtttga

SEQ ID NO: 1372450 - DNA, 11 bp, Homo sapiens
tgtacaaaagc

SEQ ID NO: 1372451 - DNA, 15 bp, Homo sapiens
tgtacaaaagcaatg

SEQ ID NO: 1372452 - DNA, 24 bp, Homo sapiens
tgtacaaaattaagcaaatgttaa

SEQ ID NO: 1372453 - DNA, 14 bp, Homo sapiens
tgtacagattcttt

SEQ ID NO: 1372454 - DNA, 17 bp, Homo sapiens
tgtacagtagattttcc

SEQ ID NO: 1372455 - DNA, 18 bp, Homo sapiens
tgtacatacgatttaagg

SEQ ID NO: 1372456 - DNA, 18 bp, Homo sapiens
tgtacatttctataaata

SEQ ID NO: 1372457 - DNA, 22 bp, Homo sapiens
tgtacgacgtcagatgtttaaa

SEQ ID NO: 1372458 - DNA, 22 bp, Homo sapiens
tgtacttaaatggtaataagca

SEQ ID NO: 1372459 - DNA, 12 bp, Homo sapiens
tgtacttttcat

SEQ ID NO: 1372460 - DNA, 13 bp, Homo sapiens
tgtacttttcatt

SEQ ID NO: 1372461 - DNA, 17 bp, Homo sapiens
tgtacttttcattctct

SEQ ID NO: 1372462 - DNA, 13 bp, Homo sapiens
tgtagagtgggag

SEQ ID NO: 1372463 - DNA, 15 bp, Homo sapiens
tgtagatgatgtatt

SEQ ID NO: 1372464 - DNA, 12 bp, Homo sapiens
tgtagatttgat

SEQ ID NO: 1372465 - DNA, 22 bp, Homo sapiens
tgtagcaaaattcttaagtatg

SEQ ID NO: 1372466 - DNA, 17 bp, Homo sapiens
tgctgactgttttctct

SEQ ID NO: 1372467 - DNA, 17 bp, Homo sapiens
tgctgagcctctgctcc

SEQ ID NO: 1372468 - DNA, 13 bp, Homo sapiens
tgctgaggcctgg

SEQ ID NO: 1372469 - DNA, 19 bp, Homo sapiens
tgctgagtctgttctggta

SEQ ID NO: 1372470 - DNA, 23 bp, Homo sapiens
tgctgcagcaccgaggggccttt

SEQ ID NO: 1372471 - DNA, 18 bp, Homo sapiens
tgctgcatgccctctcag

SEQ ID NO: 1372472 - DNA, 19 bp, Homo sapiens
tgctgcatgccctctcagg

SEQ ID NO: 1372473 - DNA, 19 bp, Homo sapiens
tgctgccattacagaggta

SEQ ID NO: 1372474 - DNA, 20 bp, Homo sapiens
tgctgcccccaccccgggga

SEQ ID NO: 1372475 - DNA, 17 bp, Homo sapiens
tgctgctgcctctttcc

SEQ ID NO: 1372476 - DNA, 18 bp, Homo sapiens
tgctgctggtgcacagcc

SEQ ID NO: 1372477 - DNA, 19 bp, Homo sapiens
tgctgcttgaggcaactca

SEQ ID NO: 1372478 - DNA, 16 bp, Homo sapiens
tgctggccccagccct

SEQ ID NO: 1372479 - DNA, 18 bp, Homo sapiens
tgctggccccagccctgc

SEQ ID NO: 1372480 - DNA, 20 bp, Homo sapiens
tgctggccccagccctgctg

SEQ ID NO: 1372481 - DNA, 21 bp, Homo sapiens
tgctggccccagccctgctgg

SEQ ID NO: 1372482 - DNA, 22 bp, Homo sapiens
tgctggccccagccctgctggg

SEQ ID NO: 1372483 - DNA, 16 bp, Homo sapiens
tgctgggactcagcct

SEQ ID NO: 1372484 - DNA, 18 bp, Homo sapiens
tgctgggactcagccttc

SEQ ID NO: 1372485 - DNA, 16 bp, Homo sapiens
tgctgggagctccact

SEQ ID NO: 1372486 - DNA, 21 bp, Homo sapiens
tgctgggagctccactctgct

SEQ ID NO: 1372487 - DNA, 22 bp, Homo sapiens
tgctgggagctccactctgctt

SEQ ID NO: 1372488 - DNA, 17 bp, Homo sapiens
tgctgggaggagggaga

SEQ ID NO: 1372489 - DNA, 19 bp, Homo sapiens
tgctgggcattttcccaga

SEQ ID NO: 1372490 - DNA, 19 bp, Homo sapiens
tgctggggtcaaggcagta

SEQ ID NO: 1372491 - DNA, 17 bp, Homo sapiens
tgctggtaaaatgaaga

SEQ ID NO: 1372492 - DNA, 23 bp, Homo sapiens
tgctgtacacatatttgaagggt

SEQ ID NO: 1372493 - DNA, 22 bp, Homo sapiens
tgctgtatatggaattctttta

SEQ ID NO: 1372494 - DNA, 17 bp, Homo sapiens
tgctgtgagggagggga

SEQ ID NO: 1372495 - DNA, 21 bp, Homo sapiens
tgctgtgtgtcccaggcaggg

SEQ ID NO: 1372496 - DNA, 23 bp, Homo sapiens
tgctgtgtgtcccaggcagggag

SEQ ID NO: 1372497 - DNA, 18 bp, Homo sapiens
tgctgttgtccaactatt

SEQ ID NO: 1372498 - DNA, 23 bp, Homo sapiens
tgctgttgtccaactatttattg

SEQ ID NO: 1372499 - DNA, 16 bp, Homo sapiens
tgcttaaatttcttat

SEQ ID NO: 1372500 - DNA, 15 bp, Homo sapiens
tgcttaataaattgt

SEQ ID NO: 1372501 - DNA, 20 bp, Homo sapiens
tgcttaatcttcaaagcctt

SEQ ID NO: 1372502 - DNA, 21 bp, Homo sapiens
tgcttaatcttcaaagccttc

SEQ ID NO: 1372503 - DNA, 17 bp, Homo sapiens
tgcttattatgtaggta

SEQ ID NO: 1372504 - DNA, 22 bp, Homo sapiens
tgcttcacagtagagccagctt

SEQ ID NO: 1372505 - DNA, 19 bp, Homo sapiens
tgcttccaggaaactccac

SEQ ID NO: 1372506 - DNA, 15 bp, Homo sapiens
tgcttcctcctggaa

SEQ ID NO: 1372507 - DNA, 12 bp, Homo sapiens
tgcttctcactg

SEQ ID NO: 1372508 - DNA, 12 bp, Homo sapiens
tgcttctctgac

SEQ ID NO: 1372509 - DNA, 12 bp, Homo sapiens
tgcttctgccac

SEQ ID NO: 1372510 - DNA, 12 bp, Homo sapiens
tgcttgaataaa

SEQ ID NO: 1372511 - DNA, 21 bp, Homo sapiens
tgcttgaggcaactcatctta

SEQ ID NO: 1372512 - DNA, 18 bp, Homo sapiens
tgcttgcctgcagggcca

SEQ ID NO: 1372513 - DNA, 22 bp, Homo sapiens
tgcttggaacatactgttcact

SEQ ID NO: 1372514 - DNA, 15 bp, Homo sapiens
tgcttgtcttctggt

SEQ ID NO: 1372515 - DNA, 22 bp, Homo sapiens
tgcttgtcttctggtactttct

SEQ ID NO: 1372516 - DNA, 18 bp, Homo sapiens
tgctttaccttttcaggg

SEQ ID NO: 1372517 - DNA, 19 bp, Homo sapiens
tgctttagacttgaaaaga

SEQ ID NO: 1372518 - DNA, 17 bp, Homo sapiens
tgctttattaatgtttt

SEQ ID NO: 1372519 - DNA, 16 bp, Homo sapiens
tgctttatttgtaaat

SEQ ID NO: 1372520 - DNA, 16 bp, Homo sapiens
tgctttcagaagtgcc

SEQ ID NO: 1372521 - DNA, 18 bp, Homo sapiens
tgctttgaataaatgtgt

SEQ ID NO: 1372522 - DNA, 18 bp, Homo sapiens
tgctttggacctaaatgg

SEQ ID NO: 1372523 - DNA, 21 bp, Homo sapiens
tgctttggacctaaatggcct

SEQ ID NO: 1372524 - DNA, 22 bp, Homo sapiens
tgctttggacctaaatggcctc

SEQ ID NO: 1372525 - DNA, 16 bp, Homo sapiens
tgctttgtagagtttt

SEQ ID NO: 1372526 - DNA, 22 bp, Homo sapiens
tgctttgtagagttttgtcatt

SEQ ID NO: 1372527 - DNA, 12 bp, Homo sapiens
tatttattgact

SEQ ID NO: 1372528 - DNA, 15 bp, Homo sapiens
tatttattgactctt

SEQ ID NO: 1372529 - DNA, 21 bp, Homo sapiens
tatttattgactcttgagttg

SEQ ID NO: 1372530 - DNA, 18 bp, Homo sapiens
tatttatttatgtacttt

SEQ ID NO: 1372531 - DNA, 20 bp, Homo sapiens
tatttattttttttaattgt

SEQ ID NO: 1372532 - DNA, 14 bp, Homo sapiens
tatttccactaaaa

SEQ ID NO: 1372533 - DNA, 15 bp, Homo sapiens
tatttccactaaaaa

SEQ ID NO: 1372534 - DNA, 21 bp, Homo sapiens
tatttcccatttgtgccagag

SEQ ID NO: 1372535 - DNA, 17 bp, Homo sapiens
tatttcctttatgtgaa

SEQ ID NO: 1372536 - DNA, 11 bp, Homo sapiens
tatttctactg

SEQ ID NO: 1372537 - DNA, 14 bp, Homo sapiens
tatttgaaagtgcc

SEQ ID NO: 1372538 - DNA, 16 bp, Homo sapiens
tatttgaacaatgaag

SEQ ID NO: 1372539 - DNA, 18 bp, Homo sapiens
tatttgaacaatgaagtt

SEQ ID NO: 1372540 - DNA, 18 bp, Homo sapiens
tatttgaattttaaatct

SEQ ID NO: 1372541 - DNA, 21 bp, Homo sapiens
tatttgaattttaaatctaaa

SEQ ID NO: 1372542 - DNA, 13 bp, Homo sapiens
tatttgattattt

SEQ ID NO: 1372543 - DNA, 13 bp, Homo sapiens
tatttgatttatt

SEQ ID NO: 1372544 - DNA, 19 bp, Homo sapiens
tatttgatttattaactta

SEQ ID NO: 1372545 - DNA, 11 bp, Homo sapiens
tatttgcatgt

SEQ ID NO: 1372546 - DNA, 15 bp, Homo sapiens
tatttgcatgttatg

SEQ ID NO: 1372547 - DNA, 18 bp, Homo sapiens
tatttgcatgttatgttt

SEQ ID NO: 1372548 - DNA, 14 bp, Homo sapiens
tattttaaaaatat

SEQ ID NO: 1372549 - DNA, 14 bp, Homo sapiens
tattttacacagaa

SEQ ID NO: 1372550 - DNA, 18 bp, Homo sapiens
tattttacagctcattaa

SEQ ID NO: 1372551 - DNA, 20 bp, Homo sapiens
tattttcatgaaaataccat

SEQ ID NO: 1372552 - DNA, 12 bp, Homo sapiens
tattttcctaaa

SEQ ID NO: 1372553 - DNA, 16 bp, Homo sapiens
tattttcctaaagaga

SEQ ID NO: 1372554 - DNA, 14 bp, Homo sapiens
tattttctacgttt

SEQ ID NO: 1372555 - DNA, 20 bp, Homo sapiens
tattttctacgtttctttaa

SEQ ID NO: 1372556 - DNA, 15 bp, Homo sapiens
tattttgtgtgaaat

SEQ ID NO: 1372557 - DNA, 20 bp, Homo sapiens
tatttttagaataagaattt

SEQ ID NO: 1372558 - DNA, 17 bp, Homo sapiens
tatttttatacaaacct

SEQ ID NO: 1372559 - DNA, 19 bp, Homo sapiens
tatttttatatcatgcaaa

SEQ ID NO: 1372560 - DNA, 22 bp, Homo sapiens
tatttttcactctaagtcatgt

SEQ ID NO: 1372561 - DNA, 13 bp, Homo sapiens
tatttttgttgtt

SEQ ID NO: 1372562 - DNA, 11 bp, Homo sapiens
tattttttcaa

SEQ ID NO: 1372563 - DNA, 13 bp, Homo sapiens
tattttttgaaaa

SEQ ID NO: 1372564 - DNA, 16 bp, Homo sapiens
tatttttttaaaattt

SEQ ID NO: 1372565 - DNA, 13 bp, Homo sapiens
tatttttttgaac

SEQ ID NO: 1372566 - DNA, 15 bp, Homo sapiens
tattttttttaaaga

SEQ ID NO: 1372567 - DNA, 18 bp, Homo sapiens
tattttttttaattgtat

SEQ ID NO: 1372568 - DNA, 21 bp, Homo sapiens
tattttttttttcttcttggg

SEQ ID NO: 1372569 - DNA, 15 bp, Homo sapiens
tcaaaaaaagaaaaa

SEQ ID NO: 1372570 - DNA, 21 bp, Homo sapiens
tcaaaaaggcttataaaacag

SEQ ID NO: 1372571 - DNA, 20 bp, Homo sapiens
tcaaaaggtattatacatgt

SEQ ID NO: 1372572 - DNA, 12 bp, Homo sapiens
tcaaaagtgcct

SEQ ID NO: 1372573 - DNA, 16 bp, Homo sapiens
tcaaaagtgcctcaag

SEQ ID NO: 1372574 - DNA, 17 bp, Homo sapiens
tcaaaataaagaagtat

SEQ ID NO: 1372575 - DNA, 16 bp, Homo sapiens
tcaaactcaatgcttt

SEQ ID NO: 1372576 - DNA, 23 bp, Homo sapiens
tcaaactcaatgctttatttgta

SEQ ID NO: 1372577 - DNA, 19 bp, Homo sapiens
tcaaactggggcctccaga

SEQ ID NO: 1372578 - DNA, 23 bp, Homo sapiens
tcaaagacctggggctgctgtga

SEQ ID NO: 1372579 - DNA, 20 bp, Homo sapiens
tcaaaggagcgagcatgtcg

SEQ ID NO: 1372580 - DNA, 17 bp, Homo sapiens
tcaaagggataaagaaa

SEQ ID NO: 1372581 - DNA, 18 bp, Homo sapiens
tcaaagtcattaaagaca

SEQ ID NO: 1372582 - DNA, 15 bp, Homo sapiens
tcaaagttgaaaatt

SEQ ID NO: 1372583 - DNA, 17 bp, Homo sapiens
tcaaagttgaaaattca

SEQ ID NO: 1372584 - DNA, 13 bp, Homo sapiens
tcaaagttttgtt

SEQ ID NO: 1372585 - DNA, 20 bp, Homo sapiens
tcaaataagtatttataata

SEQ ID NO: 1372586 - DNA, 14 bp, Homo sapiens
tcaaatacacattt

SEQ ID NO: 1372587 - DNA, 16 bp, Homo sapiens
tcaaattaattgtgtg

SEQ ID NO: 1372588 - DNA, 17 bp, Homo sapiens
tcaaattaattgtgtga

SEQ ID NO: 1372589 - DNA, 15 bp, Homo sapiens
tcaacagcaagtgtg

SEQ ID NO: 1372590 - DNA, 16 bp, Homo sapiens
tcaacagcaagtgtga

SEQ ID NO: 1372591 - DNA, 17 bp, Homo sapiens
tcaacctcttctggctc

SEQ ID NO: 1372592 - DNA, 18 bp, Homo sapiens
tcaacctcttctggctca

SEQ ID NO: 1372593 - DNA, 23 bp, Homo sapiens
tcaactgtcttcctcaaaataaa

SEQ ID NO: 1372594 - DNA, 18 bp, Homo sapiens
tcaagagccttaaaacat

SEQ ID NO: 1372595 - DNA, 22 bp, Homo sapiens
tcaagaggaatgaaaaaagctt

SEQ ID NO: 1372596 - DNA, 19 bp, Homo sapiens
tcaagatcaaaaaggctta

SEQ ID NO: 1372597 - DNA, 13 bp, Homo sapiens
tcaaggcctgctc

SEQ ID NO: 1372598 - DNA, 18 bp, Homo sapiens
tcaaggtcactgtttcct

SEQ ID NO: 1372599 - DNA, 23 bp, Homo sapiens
tcaagtgaaaaaggaggaagaga

SEQ ID NO: 1372600 - DNA, 18 bp, Homo sapiens
tcaataatatattttctg

SEQ ID NO: 1372601 - DNA, 18 bp, Homo sapiens
tcaatacactagttgttt

SEQ ID NO: 1372602 - DNA, 16 bp, Homo sapiens
tcaatagatctccagc

SEQ ID NO: 1372603 - DNA, 13 bp, Homo sapiens
tcaatatctaata

SEQ ID NO: 1372604 - DNA, 15 bp, Homo sapiens
tcaatatctaatata

SEQ ID NO: 1372605 - DNA, 19 bp, Homo sapiens
tcaatatctaatatatatg

SEQ ID NO: 1372606 - DNA, 21 bp, Homo sapiens
tcaatcctaatttctcctccc

SEQ ID NO: 1372607 - DNA, 20 bp, Homo sapiens
tcaatcctgattcctctcta

SEQ ID NO: 1372608 - DNA, 16 bp, Homo sapiens
tcaatctgtttttcat

SEQ ID NO: 1372609 - DNA, 22 bp, Homo sapiens
tcaatgaaaaatagtgtctttg

SEQ ID NO: 1372610 - DNA, 16 bp, Homo sapiens
tcaatgaaccataaat

SEQ ID NO: 1372611 - DNA, 18 bp, Homo sapiens
tcaatgctttatttgtaa

SEQ ID NO: 1372612 - DNA, 16 bp, Homo sapiens
tcaatgggacctgtgg

SEQ ID NO: 1372613 - DNA, 15 bp, Homo sapiens
tcaatgtcaagtacc

SEQ ID NO: 1372614 - DNA, 20 bp, Homo sapiens
tcaattagtaacattcatgt

SEQ ID NO: 1372615 - DNA, 13 bp, Homo sapiens
tcacaaatgactt

SEQ ID NO: 1372616 - DNA, 19 bp, Homo sapiens
tcacaacttgatggctgcg

SEQ ID NO: 1372617 - DNA, 19 bp, Homo sapiens
tcacactggttctcaatga

SEQ ID NO: 1372618 - DNA, 12 bp, Homo sapiens
tcacagagtcaa

SEQ ID NO: 1372619 - DNA, 17 bp, Homo sapiens
tcacagagtcaaggcct

SEQ ID NO: 1372620 - DNA, 21 bp, Homo sapiens
tcacagagtcaaggcctgctc

SEQ ID NO: 1372621 - DNA, 17 bp, Homo sapiens
tcacagtagagccagct

SEQ ID NO: 1372622 - DNA, 18 bp, Homo sapiens
tcacagtagagccagctt

SEQ ID NO: 1372623 - DNA, 19 bp, Homo sapiens
tcacagtagagccagcttg

SEQ ID NO: 1372624 - DNA, 15 bp, Homo sapiens
tcacagtttttcctg

SEQ ID NO: 1372625 - DNA, 12 bp, Homo sapiens
tcaccaccaccc

SEQ ID NO: 1372626 - DNA, 24 bp, Homo sapiens
tcaccagccccactgccagcagca

SEQ ID NO: 1372627 - DNA, 15 bp, Homo sapiens
tcaccatcaatcctg

SEQ ID NO: 1372628 - DNA, 18 bp, Homo sapiens
tgatacattttttaagct

SEQ ID NO: 1372629 - DNA, 14 bp, Homo sapiens
tgataccagctgga

SEQ ID NO: 1372630 - DNA, 16 bp, Homo sapiens
tgatagcattgtaagc

SEQ ID NO: 1372631 - DNA, 20 bp, Homo sapiens
tgatatatgagactttatgt

SEQ ID NO: 1372632 - DNA, 23 bp, Homo sapiens
tgatatctataaaatagatataa

SEQ ID NO: 1372633 - DNA, 21 bp, Homo sapiens
tgatattccccccacttaaga

SEQ ID NO: 1372634 - DNA, 21 bp, Homo sapiens
tgatcaatatttttatatcat

SEQ ID NO: 1372635 - DNA, 14 bp, Homo sapiens
tgatcatgtacttt

SEQ ID NO: 1372636 - DNA, 15 bp, Homo sapiens
tgatcatgtactttt

SEQ ID NO: 1372637 - DNA, 17 bp, Homo sapiens
tgatcatgtacttttta

SEQ ID NO: 1372638 - DNA, 17 bp, Homo sapiens
tgatcccgttttcccca

SEQ ID NO: 1372639 - DNA, 20 bp, Homo sapiens
tgatcccgttttccccatga

SEQ ID NO: 1372640 - DNA, 17 bp, Homo sapiens
tgatcccttgagatatg

SEQ ID NO: 1372641 - DNA, 19 bp, Homo sapiens
tgatcccttgagatatgga

SEQ ID NO: 1372642 - DNA, 18 bp, Homo sapiens
tgatgacaataaagcttg

SEQ ID NO: 1372643 - DNA, 21 bp, Homo sapiens
tgatgacgtacaagtagttct

SEQ ID NO: 1372644 - DNA, 22 bp, Homo sapiens
tgatgacgtacaagtagttctg

SEQ ID NO: 1372645 - DNA, 16 bp, Homo sapiens
tgatgaggtatttttt

SEQ ID NO: 1372646 - DNA, 20 bp, Homo sapiens
tgatgatcctaggcatttgc

SEQ ID NO: 1372647 - DNA, 14 bp, Homo sapiens
tgatggaaccttaa

SEQ ID NO: 1372648 - DNA, 15 bp, Homo sapiens
tgatggagtgtgagc

SEQ ID NO: 1372649 - DNA, 19 bp, Homo sapiens
tgatggccttaatttcctt

SEQ ID NO: 1372650 - DNA, 20 bp, Homo sapiens
tgatggtgtggcctgtggct

SEQ ID NO: 1372651 - DNA, 18 bp, Homo sapiens
tgatgtcaatttctgtgt

SEQ ID NO: 1372652 - DNA, 19 bp, Homo sapiens
tgatgtcaatttctgtgtt

SEQ ID NO: 1372653 - DNA, 23 bp, Homo sapiens
tgatgtcaatttctgtgttgcca

SEQ ID NO: 1372654 - DNA, 19 bp, Homo sapiens
tgatgtggccctggctgcc

SEQ ID NO: 1372655 - DNA, 15 bp, Homo sapiens
tgattaaaaatatca

SEQ ID NO: 1372656 - DNA, 19 bp, Homo sapiens
tgattaaccacttcagctg

SEQ ID NO: 1372657 - DNA, 19 bp, Homo sapiens
tgattatttgcatgttatg

SEQ ID NO: 1372658 - DNA, 21 bp, Homo sapiens
tgattattttttttttcttct

SEQ ID NO: 1372659 - DNA, 14 bp, Homo sapiens
tgattcagtcacat

SEQ ID NO: 1372660 - DNA, 15 bp, Homo sapiens
tgattcagtcacatg

SEQ ID NO: 1372661 - DNA, 19 bp, Homo sapiens
tgattccactacacctggc

SEQ ID NO: 1372662 - DNA, 17 bp, Homo sapiens
tgattccttttttcaaa

SEQ ID NO: 1372663 - DNA, 17 bp, Homo sapiens
tgattctggctttaagc

SEQ ID NO: 1372664 - DNA, 17 bp, Homo sapiens
tgattggaccaggccat

SEQ ID NO: 1372665 - DNA, 17 bp, Homo sapiens
tgattgggaaaacattt

SEQ ID NO: 1372666 - DNA, 12 bp, Homo sapiens
tgatttattaac

SEQ ID NO: 1372667 - DNA, 20 bp, Homo sapiens
tgatttcaaagttttgttgt

SEQ ID NO: 1372668 - DNA, 18 bp, Homo sapiens
tgatttctttaaaagaat

SEQ ID NO: 1372669 - DNA, 20 bp, Homo sapiens
tgatttctttaaaagaatga

SEQ ID NO: 1372670 - DNA, 19 bp, Homo sapiens
tgatttggtgaccaactgt

SEQ ID NO: 1372671 - DNA, 20 bp, Homo sapiens
tgatttttttttttaatcta

SEQ ID NO: 1372672 - DNA, 17 bp, Homo sapiens
tgcaaaaccttttactg

SEQ ID NO: 1372673 - DNA, 15 bp, Homo sapiens
tgcaaaatacatgaa

SEQ ID NO: 1372674 - DNA, 21 bp, Homo sapiens
tgcaaatgagctctgaaatct

SEQ ID NO: 1372675 - DNA, 15 bp, Homo sapiens
tgcaacaagcatgca

SEQ ID NO: 1372676 - DNA, 16 bp, Homo sapiens
tgcaaccaagtcacac

SEQ ID NO: 1372677 - DNA, 17 bp, Homo sapiens
tgcaaccaagtcacacg

SEQ ID NO: 1372678 - DNA, 12 bp, Homo sapiens
tgcaaccaggaa

SEQ ID NO: 1372679 - DNA, 22 bp, Homo sapiens
tgcaacggtctcctgactggtg

SEQ ID NO: 1372680 - DNA, 16 bp, Homo sapiens
taggaacatatgaaaa

SEQ ID NO: 1372681 - DNA, 17 bp, Homo sapiens
taggaccaagcatcttg

SEQ ID NO: 1372682 - DNA, 20 bp, Homo sapiens
taggagaaccaaatctggaa

SEQ ID NO: 1372683 - DNA, 22 bp, Homo sapiens
taggagttaacccctgcgctct

SEQ ID NO: 1372684 - DNA, 21 bp, Homo sapiens
taggatagctaactgtaaatc

SEQ ID NO: 1372685 - DNA, 22 bp, Homo sapiens
taggattttggatgttgagagg

SEQ ID NO: 1372686 - DNA, 18 bp, Homo sapiens
taggcaccttttactgtg

SEQ ID NO: 1372687 - DNA, 14 bp, Homo sapiens
taggcatgtaaaca

SEQ ID NO: 1372688 - DNA, 16 bp, Homo sapiens
taggcatttgctgaat

SEQ ID NO: 1372689 - DNA, 20 bp, Homo sapiens
taggcatttgctgaatacag

SEQ ID NO: 1372690 - DNA, 21 bp, Homo sapiens
taggcccccacttgcctcttc

SEQ ID NO: 1372691 - DNA, 21 bp, Homo sapiens
taggccttcctctctccagat

SEQ ID NO: 1372692 - DNA, 23 bp, Homo sapiens
taggccttcctctctccagatgt

SEQ ID NO: 1372693 - DNA, 20 bp, Homo sapiens
taggctattttctaaagact

SEQ ID NO: 1372694 - DNA, 20 bp, Homo sapiens
tagggaaaaaccagcgtgtg

SEQ ID NO: 1372695 - DNA, 21 bp, Homo sapiens
tagggaaaaaccagcgtgtga

SEQ ID NO: 1372696 - DNA, 19 bp, Homo sapiens
tagggactacccatagaca

SEQ ID NO: 1372697 - DNA, 20 bp, Homo sapiens
tagggactacccatagacat

SEQ ID NO: 1372698 - DNA, 15 bp, Homo sapiens
tagggtcggaaccca

SEQ ID NO: 1372699 - DNA, 17 bp, Homo sapiens
taggtgtgggggaagca

SEQ ID NO: 1372700 - DNA, 15 bp, Homo sapiens
taggttcagccaagg

SEQ ID NO: 1372701 - DNA, 22 bp, Homo sapiens
tagtaagattgatatctataaa

SEQ ID NO: 1372702 - DNA, 20 bp, Homo sapiens
tagtaatttctttttttcct

SEQ ID NO: 1372703 - DNA, 16 bp, Homo sapiens
tagtatctatatgact

SEQ ID NO: 1372704 - DNA, 16 bp, Homo sapiens
tagtatttatttatgt

SEQ ID NO: 1372705 - DNA, 15 bp, Homo sapiens
tagtcaataagaaaa

SEQ ID NO: 1372706 - DNA, 15 bp, Homo sapiens
tagtcaccagagact

SEQ ID NO: 1372707 - DNA, 23 bp, Homo sapiens
tagtcccagctacttgggaggct

SEQ ID NO: 1372708 - DNA, 16 bp, Homo sapiens
tagtccctgccacgaa

SEQ ID NO: 1372709 - DNA, 12 bp, Homo sapiens
tagtcctgtgaa

SEQ ID NO: 1372710 - DNA, 18 bp, Homo sapiens
tagtctttgccagtcatt

SEQ ID NO: 1372711 - DNA, 13 bp, Homo sapiens
tagtgaaactttt

SEQ ID NO: 1372712 - DNA, 19 bp, Homo sapiens
tagtgaaacttttctagaa

SEQ ID NO: 1372713 - DNA, 14 bp, Homo sapiens
tagtgtcactgctt

SEQ ID NO: 1372714 - DNA, 18 bp, Homo sapiens
tagtgttatatgaacata

SEQ ID NO: 1372715 - DNA, 22 bp, Homo sapiens
tagtgttatatgaacatacaaa

SEQ ID NO: 1372716 - DNA, 15 bp, Homo sapiens
tagttactgtgtaaa

SEQ ID NO: 1372717 - DNA, 21 bp, Homo sapiens
tagttactgtgtaaactcatc

SEQ ID NO: 1372718 - DNA, 20 bp, Homo sapiens
tagttatgtaaataattctt

SEQ ID NO: 1372719 - DNA, 19 bp, Homo sapiens
tagttcaatatttgttact

SEQ ID NO: 1372720 - DNA, 20 bp, Homo sapiens
tagttcctcattagcatttt

SEQ ID NO: 1372721 - DNA, 18 bp, Homo sapiens
tagttctgagctgccagt

SEQ ID NO: 1372722 - DNA, 12 bp, Homo sapiens
tagttctgtatt

SEQ ID NO: 1372723 - DNA, 13 bp, Homo sapiens
tagttgaatactt

SEQ ID NO: 1372724 - DNA, 15 bp, Homo sapiens
tagttgaatacttga

SEQ ID NO: 1372725 - DNA, 16 bp, Homo sapiens
tagttgcaattgaatt

SEQ ID NO: 1372726 - DNA, 13 bp, Homo sapiens
tagttgctatttt

SEQ ID NO: 1372727 - DNA, 19 bp, Homo sapiens
tagttgctatttttgtaaa

SEQ ID NO: 1372728 - DNA, 19 bp, Homo sapiens
tagtttgtgtgttgtctct

SEQ ID NO: 1372729 - DNA, 13 bp, Homo sapiens
tagttttgtcaaa

SEQ ID NO: 1372730 - DNA, 10 bp, Homo sapiens
tataaaacaa

SEQ ID NO: 1372731 - DNA, 17 bp, Homo sapiens
tataaacagaaatggaa

SEQ ID NO: 1372732 - DNA, 16 bp, Homo sapiens
tataaaggataaagaa

SEQ ID NO: 1372733 - DNA, 14 bp, Homo sapiens
tataaatgtataaa

SEQ ID NO: 1372734 - DNA, 20 bp, Homo sapiens
tataaatgtataaatataca

SEQ ID NO: 1372735 - DNA, 13 bp, Homo sapiens
tataactgtattt

SEQ ID NO: 1372736 - DNA, 18 bp, Homo sapiens
tataagccaaaattaagg

SEQ ID NO: 1372737 - DNA, 23 bp, Homo sapiens
tataagccaaaattaaggtgttt

SEQ ID NO: 1372738 - DNA, 16 bp, Homo sapiens
tataaggaaagcaata

SEQ ID NO: 1372739 - DNA, 14 bp, Homo sapiens
tataagtgaagtga

SEQ ID NO: 1372740 - DNA, 12 bp, Homo sapiens
tataataaaaat

SEQ ID NO: 1372741 - DNA, 12 bp, Homo sapiens
tataataaatat

SEQ ID NO: 1372742 - DNA, 19 bp, Homo sapiens
tataatccttaaatcttaa

SEQ ID NO: 1372743 - DNA, 16 bp, Homo sapiens
tataatcttataattg

SEQ ID NO: 1372744 - DNA, 13 bp, Homo sapiens
tataatgaataaa

SEQ ID NO: 1372745 - DNA, 15 bp, Homo sapiens
tataatgaataaatc

SEQ ID NO: 1372746 - DNA, 22 bp, Homo sapiens
tataattcctatatcctgtgac

SEQ ID NO: 1372747 - DNA, 23 bp, Homo sapiens
tataattgtacaaaattaagcaa

SEQ ID NO: 1372748 - DNA, 21 bp, Homo sapiens
tataattgttctcagaatccc

SEQ ID NO: 1372749 - DNA, 14 bp, Homo sapiens
tatacaaaataaga

SEQ ID NO: 1372750 - DNA, 21 bp, Homo sapiens
tatacaaaataagaacgagga

SEQ ID NO: 1372751 - DNA, 21 bp, Homo sapiens
tatacacgaatagacatcaaa

SEQ ID NO: 1372752 - DNA, 17 bp, Homo sapiens
tataccagcaatatatc

SEQ ID NO: 1372753 - DNA, 23 bp, Homo sapiens
tatagaaaaataaaaatctcttt

SEQ ID NO: 1372754 - DNA, 16 bp, Homo sapiens
tatagcaacaacaatt

SEQ ID NO: 1372755 - DNA, 18 bp, Homo sapiens
tatagcatcacttaaaac

SEQ ID NO: 1372756 - DNA, 20 bp, Homo sapiens
tatagcctatggcagaaaaa

SEQ ID NO: 1372757 - DNA, 14 bp, Homo sapiens
tatagcctggactg

SEQ ID NO: 1372758 - DNA, 15 bp, Homo sapiens
tatagcttgcagaac

SEQ ID NO: 1372759 - DNA, 19 bp, Homo sapiens
tatagtctaagactatata

SEQ ID NO: 1372760 - DNA, 13 bp, Homo sapiens
tatataaatgtat

SEQ ID NO: 1372761 - DNA, 18 bp, Homo sapiens
tatatacaaaaagaaaat

SEQ ID NO: 1372762 - DNA, 14 bp, Homo sapiens
tatataggctattt

SEQ ID NO: 1372763 - DNA, 18 bp, Homo sapiens
tatataggctattttcta

SEQ ID NO: 1372764 - DNA, 15 bp, Homo sapiens
tatatatacatatat

SEQ ID NO: 1372765 - DNA, 11 bp, Homo sapiens
tatatatataa

SEQ ID NO: 1372766 - DNA, 21 bp, Homo sapiens
tatatatgtgtatgcacagta

SEQ ID NO: 1372767 - DNA, 13 bp, Homo sapiens
tatatatttctat

SEQ ID NO: 1372768 - DNA, 23 bp, Homo sapiens
tatatattttgtgtgaaattgca

SEQ ID NO: 1372769 - DNA, 14 bp, Homo sapiens
tatatcatgcaaaa

SEQ ID NO: 1372770 - DNA, 17 bp, Homo sapiens
tatatctatctatttga

SEQ ID NO: 1372771 - DNA, 22 bp, Homo sapiens
tatatggtatatatacatatat

SEQ ID NO: 1372772 - DNA, 15 bp, Homo sapiens
tatatgtatgtgttt

SEQ ID NO: 1372773 - DNA, 16 bp, Homo sapiens
tatatgtattatttat

SEQ ID NO: 1372774 - DNA, 18 bp, Homo sapiens
tatattaaaaaagagaca

SEQ ID NO: 1372775 - DNA, 16 bp, Homo sapiens
tatattactgacattt

SEQ ID NO: 1372776 - DNA, 23 bp, Homo sapiens
tatattactgacatttcttctag

SEQ ID NO: 1372777 - DNA, 16 bp, Homo sapiens
tatattctttcaaagg

SEQ ID NO: 1372778 - DNA, 12 bp, Homo sapiens
tatattgaactt

SEQ ID NO: 1372779 - DNA, 16 bp, Homo sapiens
tatattggttttatga

SEQ ID NO: 1372780 - DNA, 19 bp, Homo sapiens
tatattggttttatgatga

SEQ ID NO: 1372781 - DNA, 14 bp, Homo sapiens
tatatttcctttat

SEQ ID NO: 1372782 - DNA, 16 bp, Homo sapiens
tatatttcctttatgt

SEQ ID NO: 1372783 - DNA, 19 bp, Homo sapiens
tatatttcctttatgtgaa

SEQ ID NO: 1372784 - DNA, 20 bp, Homo sapiens
tatatttcctttatgtgaat

SEQ ID NO: 1372785 - DNA, 22 bp, Homo sapiens
tatatttcctttatgtgaattt

SEQ ID NO: 1372786 - DNA, 13 bp, Homo sapiens
tatatttctatta

SEQ ID NO: 1372787 - DNA, 16 bp, Homo sapiens
tatatttgatttatta

SEQ ID NO: 1372788 - DNA, 15 bp, Homo sapiens
tatatttgtaaagct

SEQ ID NO: 1372789 - DNA, 15 bp, Homo sapiens
tatattttatattac

SEQ ID NO: 1372790 - DNA, 17 bp, Homo sapiens
tacataaaagaaataaa

SEQ ID NO: 1372791 - DNA, 19 bp, Homo sapiens
tacatacgatttaaggtat

SEQ ID NO: 1372792 - DNA, 20 bp, Homo sapiens
tacatataaaatgtaattac

SEQ ID NO: 1372793 - DNA, 20 bp, Homo sapiens
tacatcttttcaacaagtaa

SEQ ID NO: 1372794 - DNA, 19 bp, Homo sapiens
tacatgaggaactgtagat

SEQ ID NO: 1372795 - DNA, 20 bp, Homo sapiens
tacatgaggaactgtagatg

SEQ ID NO: 1372796 - DNA, 17 bp, Homo sapiens
tacatgtgatacatttt

SEQ ID NO: 1372797 - DNA, 13 bp, Homo sapiens
tacatgtttataa

SEQ ID NO: 1372798 - DNA, 17 bp, Homo sapiens
tacatgtttataaatct

SEQ ID NO: 1372799 - DNA, 17 bp, Homo sapiens
tacatttatttatccag

SEQ ID NO: 1372800 - DNA, 19 bp, Homo sapiens
tacatttgggagtttttat

SEQ ID NO: 1372801 - DNA, 18 bp, Homo sapiens
taccaaggtcttcttaat

SEQ ID NO: 1372802 - DNA, 15 bp, Homo sapiens
tacccatagacatga

SEQ ID NO: 1372803 - DNA, 16 bp, Homo sapiens
tacccatagacatgaa

SEQ ID NO: 1372804 - DNA, 18 bp, Homo sapiens
tacccatagacatgaaag

SEQ ID NO: 1372805 - DNA, 18 bp, Homo sapiens
tacccggggcccagggca

SEQ ID NO: 1372806 - DNA, 16 bp, Homo sapiens
tacctagtgaaacttt

SEQ ID NO: 1372807 - DNA, 22 bp, Homo sapiens
tacctagtgaaacttttctaga

SEQ ID NO: 1372808 - DNA, 17 bp, Homo sapiens
tacctccaaccctgccg

SEQ ID NO: 1372809 - DNA, 21 bp, Homo sapiens
tacctgatttcttcagggctg

SEQ ID NO: 1372810 - DNA, 20 bp, Homo sapiens
tacctgtatacagtgcagag

SEQ ID NO: 1372811 - DNA, 14 bp, Homo sapiens
taccttatcttaca

SEQ ID NO: 1372812 - DNA, 15 bp, Homo sapiens
tacctttcaaagctt

SEQ ID NO: 1372813 - DNA, 23 bp, Homo sapiens
tacgtttctttaaccttgtataa

SEQ ID NO: 1372814 - DNA, 19 bp, Homo sapiens
tactaaaaagtataaaata

SEQ ID NO: 1372815 - DNA, 19 bp, Homo sapiens
tactaaacagtaagatatc

SEQ ID NO: 1372816 - DNA, 22 bp, Homo sapiens
tactactttgttaggattttca

SEQ ID NO: 1372817 - DNA, 23 bp, Homo sapiens
tactaggaagaacgttttttcct

SEQ ID NO: 1372818 - DNA, 17 bp, Homo sapiens
tactatccagttactgc

SEQ ID NO: 1372819 - DNA, 19 bp, Homo sapiens
tactattcaggtaacacta

SEQ ID NO: 1372820 - DNA, 12 bp, Homo sapiens
tactatttaaga

SEQ ID NO: 1372821 - DNA, 19 bp, Homo sapiens
tactatttaagatgtgaaa

SEQ ID NO: 1372822 - DNA, 13 bp, Homo sapiens
tactccctgcaga

SEQ ID NO: 1372823 - DNA, 21 bp, Homo sapiens
tactctccttgagtgtatgag

SEQ ID NO: 1372824 - DNA, 17 bp, Homo sapiens
tactgaaccacttgtag

SEQ ID NO: 1372825 - DNA, 19 bp, Homo sapiens
tactgaaccacttgtagat

SEQ ID NO: 1372826 - DNA, 12 bp, Homo sapiens
tactgaaggaaa

SEQ ID NO: 1372827 - DNA, 14 bp, Homo sapiens
tactgatggaattt

SEQ ID NO: 1372828 - DNA, 18 bp, Homo sapiens
tactggatttgttgttct

SEQ ID NO: 1372829 - DNA, 18 bp, Homo sapiens
tactggcttacctcctca

SEQ ID NO: 1372830 - DNA, 14 bp, Homo sapiens
tactgtcaaatgat

SEQ ID NO: 1372831 - DNA, 16 bp, Homo sapiens
tactgtcaaatgatgt

SEQ ID NO: 1372832 - DNA, 21 bp, Homo sapiens
tactgtcaaatgatgtgcaaa

SEQ ID NO: 1372833 - DNA, 13 bp, Homo sapiens
tactgtgtaaact

SEQ ID NO: 1372834 - DNA, 19 bp, Homo sapiens
tactgtgtctcatggattt

SEQ ID NO: 1372835 - DNA, 18 bp, Homo sapiens
tactgtgttttataaaat

SEQ ID NO: 1372836 - DNA, 17 bp, Homo sapiens
tactgttactgggccct

SEQ ID NO: 1372837 - DNA, 16 bp, Homo sapiens
tactgttgtaagaatt

SEQ ID NO: 1372838 - DNA, 22 bp, Homo sapiens
tactgttgtaagaattctgatt

SEQ ID NO: 1372839 - DNA, 18 bp, Homo sapiens
tacttacctagtgaaact

SEQ ID NO: 1372840 - DNA, 22 bp, Homo sapiens
tacttcttttttcaaaagaaag

SEQ ID NO: 1372841 - DNA, 16 bp, Homo sapiens
tacttgaaccataaaa

SEQ ID NO: 1372842 - DNA, 20 bp, Homo sapiens
tacttgaaccataaaatgtc

SEQ ID NO: 1372843 - DNA, 19 bp, Homo sapiens
tacttgctttaccttttca

SEQ ID NO: 1372844 - DNA, 23 bp, Homo sapiens
tacttgctttaccttttcagggc

SEQ ID NO: 1372845 - DNA, 12 bp, Homo sapiens
tacttgggaggc

SEQ ID NO: 1372846 - DNA, 14 bp, Homo sapiens
tactttgtaaattc

SEQ ID NO: 1372847 - DNA, 18 bp, Homo sapiens
tactttgtaaattctgat

SEQ ID NO: 1372848 - DNA, 19 bp, Homo sapiens
tactttgtaaattctgatt

SEQ ID NO: 1372849 - DNA, 12 bp, Homo sapiens
tactttgtattg

SEQ ID NO: 1372850 - DNA, 16 bp, Homo sapiens
tactttgtattgtcct

SEQ ID NO: 1372851 - DNA, 15 bp, Homo sapiens
tagaaaaaaaattat

SEQ ID NO: 1372852 - DNA, 18 bp, Homo sapiens
tagaaaatgtgaccctcc

SEQ ID NO: 1372853 - DNA, 20 bp, Homo sapiens
tagaaaatgtgaccctccaa

SEQ ID NO: 1372854 - DNA, 17 bp, Homo sapiens
tagaaattttgtaagaa

SEQ ID NO: 1372855 - DNA, 18 bp, Homo sapiens
tagaaattttgtaagaag

SEQ ID NO: 1372856 - DNA, 22 bp, Homo sapiens
tagaaattttgtaagaaggcaa

SEQ ID NO: 1372857 - DNA, 16 bp, Homo sapiens
tagaaccactatgaag

SEQ ID NO: 1372858 - DNA, 16 bp, Homo sapiens
tagaactccaggccct

SEQ ID NO: 1372859 - DNA, 15 bp, Homo sapiens
tagaactgtctgtga

SEQ ID NO: 1372860 - DNA, 13 bp, Homo sapiens
tagaactttgtat

SEQ ID NO: 1372861 - DNA, 22 bp, Homo sapiens
tagaagagagaggttgaaaaac

SEQ ID NO: 1372862 - DNA, 19 bp, Homo sapiens
tagaataagaatttgcata

SEQ ID NO: 1372863 - DNA, 13 bp, Homo sapiens
tagaatccctgtg

SEQ ID NO: 1372864 - DNA, 15 bp, Homo sapiens
tagaatccctgtgtt

SEQ ID NO: 1372865 - DNA, 16 bp, Homo sapiens
tagaatccctgtgtta

SEQ ID NO: 1372866 - DNA, 21 bp, Homo sapiens
tagaattaaaaaagcatactt

SEQ ID NO: 1372867 - DNA, 22 bp, Homo sapiens
tagaattatttttcactctaag

SEQ ID NO: 1372868 - DNA, 16 bp, Homo sapiens
tagaattgaaggtttt

SEQ ID NO: 1372869 - DNA, 19 bp, Homo sapiens
tagaattgaaggtttttga

SEQ ID NO: 1372870 - DNA, 18 bp, Homo sapiens
tagacagccaaaggctgg

SEQ ID NO: 1372871 - DNA, 20 bp, Homo sapiens
tagacagccaaaggctggcg

SEQ ID NO: 1372872 - DNA, 23 bp, Homo sapiens
tagacagcttttctcaactgggt

SEQ ID NO: 1372873 - DNA, 14 bp, Homo sapiens
tagacatcaaactc

SEQ ID NO: 1372874 - DNA, 11 bp, Homo sapiens
tagacatgaaa

SEQ ID NO: 1372875 - DNA, 20 bp, Homo sapiens
tagactcggggtgcttcctt

SEQ ID NO: 1372876 - DNA, 18 bp, Homo sapiens
tagacttgaaaagagaca

SEQ ID NO: 1372877 - DNA, 20 bp, Homo sapiens
tagacttgaaaagagacagg

SEQ ID NO: 1372878 - DNA, 13 bp, Homo sapiens
tagagaagcaagt

SEQ ID NO: 1372879 - DNA, 22 bp, Homo sapiens
tagagaggacaatactggggtt

SEQ ID NO: 1372880 - DNA, 13 bp, Homo sapiens
tagagccagcttg

SEQ ID NO: 1372881 - DNA, 20 bp, Homo sapiens
tagaggcttctccgccagcc

SEQ ID NO: 1372882 - DNA, 22 bp, Homo sapiens
tagaggcttctccgccagcctc

SEQ ID NO: 1372883 - DNA, 22 bp, Homo sapiens
tagagggacggccaagaatgta

SEQ ID NO: 1372884 - DNA, 17 bp, Homo sapiens
tagagtaatgaaatgga

SEQ ID NO: 1372885 - DNA, 22 bp, Homo sapiens
tagagtacactgcctgccttaa

SEQ ID NO: 1372886 - DNA, 15 bp, Homo sapiens
tagagtctgagggct

SEQ ID NO: 1372887 - DNA, 17 bp, Homo sapiens
tagagtgtagactgtgg

SEQ ID NO: 1372888 - DNA, 15 bp, Homo sapiens
tagataatattgttt

SEQ ID NO: 1372889 - DNA, 23 bp, Homo sapiens
tagatataaatttttaagagaaa

SEQ ID NO: 1372890 - DNA, 15 bp, Homo sapiens
tagatgttgccatgt

SEQ ID NO: 1372891 - DNA, 21 bp, Homo sapiens
tagatttgccatagagtacac

SEQ ID NO: 1372892 - DNA, 12 bp, Homo sapiens
tagattttccaa

SEQ ID NO: 1372893 - DNA, 19 bp, Homo sapiens
tagcaaaataaaacatagc

SEQ ID NO: 1372894 - DNA, 14 bp, Homo sapiens
tagcatactggctt

SEQ ID NO: 1372895 - DNA, 15 bp, Homo sapiens
tagcatgaaataaaa

SEQ ID NO: 1372896 - DNA, 22 bp, Homo sapiens
tagcatgtttatatctgcaaaa

SEQ ID NO: 1372897 - DNA, 15 bp, Homo sapiens
tagccagatttgtct

SEQ ID NO: 1372898 - DNA, 14 bp, Homo sapiens
tagcccaaaaccaa

SEQ ID NO: 1372899 - DNA, 17 bp, Homo sapiens
tagccccctggcctctg

SEQ ID NO: 1372900 - DNA, 18 bp, Homo sapiens
tagccccctggcctctgt

SEQ ID NO: 1372901 - DNA, 13 bp, Homo sapiens
tagccctcccact

SEQ ID NO: 1372902 - DNA, 17 bp, Homo sapiens
tagccctcccactttgc

SEQ ID NO: 1372903 - DNA, 16 bp, Homo sapiens
tagccggttcctgtcc

SEQ ID NO: 1372904 - DNA, 15 bp, Homo sapiens
agaatactgatggaa

SEQ ID NO: 1372905 - DNA, 21 bp, Homo sapiens
agaatatcctttaaaatttaa

SEQ ID NO: 1372906 - DNA, 16 bp, Homo sapiens
agaatattgcaaaata

SEQ ID NO: 1372907 - DNA, 18 bp, Homo sapiens
agaatattgcaaaataca

SEQ ID NO: 1372908 - DNA, 19 bp, Homo sapiens
agaatattgcaaaatacat

SEQ ID NO: 1372909 - DNA, 21 bp, Homo sapiens
agaatattgcaaaatacatga

SEQ ID NO: 1372910 - DNA, 15 bp, Homo sapiens
agaatccctgtgtta

SEQ ID NO: 1372911 - DNA, 16 bp, Homo sapiens
agaatgaaagctgttc

SEQ ID NO: 1372912 - DNA, 21 bp, Homo sapiens
agaatgagtccttgatttcaa

SEQ ID NO: 1372913 - DNA, 15 bp, Homo sapiens
agaatgcaaccaagt

SEQ ID NO: 1372914 - DNA, 21 bp, Homo sapiens
agaatgtacgtccagcctgcc

SEQ ID NO: 1372915 - DNA, 21 bp, Homo sapiens
agaattaagccctaaggtcct

SEQ ID NO: 1372916 - DNA, 16 bp, Homo sapiens
agaattgaaggttttt

SEQ ID NO: 1372917 - DNA, 14 bp, Homo sapiens
agaatttagtatta

SEQ ID NO: 1372918 - DNA, 17 bp, Homo sapiens
agaatttgcatacttac

SEQ ID NO: 1372919 - DNA, 12 bp, Homo sapiens
agacaaatattc

SEQ ID NO: 1372920 - DNA, 20 bp, Homo sapiens
agacaagattttttaattgt

SEQ ID NO: 1372921 - DNA, 22 bp, Homo sapiens
agacaagattttttaattgttt

SEQ ID NO: 1372922 - DNA, 12 bp, Homo sapiens
agacaataaacc

SEQ ID NO: 1372923 - DNA, 17 bp, Homo sapiens
agacaataaaccctcag

SEQ ID NO: 1372924 - DNA, 22 bp, Homo sapiens
agacaataaaccctcagagcct

SEQ ID NO: 1372925 - DNA, 16 bp, Homo sapiens
agacactgcctgggct

SEQ ID NO: 1372926 - DNA, 14 bp, Homo sapiens
agacactgttgata

SEQ ID NO: 1372927 - DNA, 19 bp, Homo sapiens
agacactgttgataaaaac

SEQ ID NO: 1372928 - DNA, 15 bp, Homo sapiens
agacagagaggactg

SEQ ID NO: 1372929 - DNA, 20 bp, Homo sapiens
agacagagaggactgtaggg

SEQ ID NO: 1372930 - DNA, 18 bp, Homo sapiens
agacagcttttctcaact

SEQ ID NO: 1372931 - DNA, 15 bp, Homo sapiens
agacaggagacaaaa

SEQ ID NO: 1372932 - DNA, 17 bp, Homo sapiens
agacagtgtatgtagaa

SEQ ID NO: 1372933 - DNA, 23 bp, Homo sapiens
agacagtgtatgtagaagcatga

SEQ ID NO: 1372934 - DNA, 22 bp, Homo sapiens
agacatactccttccatcaaat

SEQ ID NO: 1372935 - DNA, 19 bp, Homo sapiens
agacatctgaggttttatt

SEQ ID NO: 1372936 - DNA, 18 bp, Homo sapiens
agacatgttttccgtgaa

SEQ ID NO: 1372937 - DNA, 19 bp, Homo sapiens
agaccacgcccgtcctgcc

SEQ ID NO: 1372938 - DNA, 15 bp, Homo sapiens
agaccagattaaact

SEQ ID NO: 1372939 - DNA, 15 bp, Homo sapiens
agaccatcctggcta

SEQ ID NO: 1372940 - DNA, 21 bp, Homo sapiens
agaccccggcttcctttccca

SEQ ID NO: 1372941 - DNA, 19 bp, Homo sapiens
agaccctcttgcccatcct

SEQ ID NO: 1372942 - DNA, 20 bp, Homo sapiens
agaccctcttgcccatcctg

SEQ ID NO: 1372943 - DNA, 17 bp, Homo sapiens
agaccctgggtgggctc

SEQ ID NO: 1372944 - DNA, 20 bp, Homo sapiens
agaccctgggtgggctctgt

SEQ ID NO: 1372945 - DNA, 13 bp, Homo sapiens
taaaacccaagtg

SEQ ID NO: 1372946 - DNA, 17 bp, Homo sapiens
taaaagttgcattttaa

SEQ ID NO: 1372947 - DNA, 19 bp, Homo sapiens
taaaagttttatatgcttt

SEQ ID NO: 1372948 - DNA, 17 bp, Homo sapiens
taaaataaaatgaaaat

SEQ ID NO: 1372949 - DNA, 19 bp, Homo sapiens
taaaataaaatgaaaattg

SEQ ID NO: 1372950 - DNA, 17 bp, Homo sapiens
taaaataaggatttttc

SEQ ID NO: 1372951 - DNA, 19 bp, Homo sapiens
taaaataattatataactg

SEQ ID NO: 1372952 - DNA, 19 bp, Homo sapiens
taaaatacatagtgaaaat

SEQ ID NO: 1372953 - DNA, 16 bp, Homo sapiens
taaaatagtatgaaaa

SEQ ID NO: 1372954 - DNA, 23 bp, Homo sapiens
taaaatattgttgaacacttgaa

SEQ ID NO: 1372955 - DNA, 12 bp, Homo sapiens
taaaatcatgaa

SEQ ID NO: 1372956 - DNA, 15 bp, Homo sapiens
taaaatcctgtgcaa

SEQ ID NO: 1372957 - DNA, 17 bp, Homo sapiens
taaaatctgagggaaat

SEQ ID NO: 1372958 - DNA, 22 bp, Homo sapiens
taaaatctgagggaaatgtttt

SEQ ID NO: 1372959 - DNA, 15 bp, Homo sapiens
taaaatgaaaattgt

SEQ ID NO: 1372960 - DNA, 16 bp, Homo sapiens
taaaatgaaaattgta

SEQ ID NO: 1372961 - DNA, 15 bp, Homo sapiens
taaaatgcaatgtaa

SEQ ID NO: 1372962 - DNA, 17 bp, Homo sapiens
taaaatgtaatttaaat

SEQ ID NO: 1372963 - DNA, 20 bp, Homo sapiens
taaaatgtaatttaaatgaa

SEQ ID NO: 1372964 - DNA, 14 bp, Homo sapiens
taaaatttgttgca

SEQ ID NO: 1372965 - DNA, 15 bp, Homo sapiens
taaaatttgttgcat

SEQ ID NO: 1372966 - DNA, 16 bp, Homo sapiens
taaacaaaatgaagct

SEQ ID NO: 1372967 - DNA, 17 bp, Homo sapiens
taaacactcaccttcta

SEQ ID NO: 1372968 - DNA, 13 bp, Homo sapiens
taaaccctcagag

SEQ ID NO: 1372969 - DNA, 21 bp, Homo sapiens
taaacctaggacttccgagct

SEQ ID NO: 1372970 - DNA, 18 bp, Homo sapiens
taaactcatctgaaatgt

SEQ ID NO: 1372971 - DNA, 23 bp, Homo sapiens
taaacttctgcaacaagcatgca

SEQ ID NO: 1372972 - DNA, 14 bp, Homo sapiens
taaagaaaaaaatg

SEQ ID NO: 1372973 - DNA, 20 bp, Homo sapiens
taaagaaaaatatcttggcc

SEQ ID NO: 1372974 - DNA, 16 bp, Homo sapiens
taaagaaaagatgaaa

SEQ ID NO: 1372975 - DNA, 14 bp, Homo sapiens
taaagaagtatttt

SEQ ID NO: 1372976 - DNA, 19 bp, Homo sapiens
taaagaatatgacttttta

SEQ ID NO: 1372977 - DNA, 19 bp, Homo sapiens
taaagaccctcctattcta

SEQ ID NO: 1372978 - DNA, 15 bp, Homo sapiens
taaagactggctttt

SEQ ID NO: 1372979 - DNA, 19 bp, Homo sapiens
taaagactggttttctgcc

SEQ ID NO: 1372980 - DNA, 16 bp, Homo sapiens
taaagagcccttgcct

SEQ ID NO: 1372981 - DNA, 17 bp, Homo sapiens
taaagagcccttgcctc

SEQ ID NO: 1372982 - DNA, 14 bp, Homo sapiens
taaagcaatagaaa

SEQ ID NO: 1372983 - DNA, 13 bp, Homo sapiens
taaagcagtattt

SEQ ID NO: 1372984 - DNA, 20 bp, Homo sapiens
taaagcatgaaatgtgaatt

SEQ ID NO: 1372985 - DNA, 15 bp, Homo sapiens
taaagctaaggacct

SEQ ID NO: 1372986 - DNA, 20 bp, Homo sapiens
taaagcttgttgactcagct

SEQ ID NO: 1372987 - DNA, 18 bp, Homo sapiens
taaagtattcttctcttc

SEQ ID NO: 1372988 - DNA, 17 bp, Homo sapiens
taaagtttgcttagaaa

SEQ ID NO: 1372989 - DNA, 14 bp, Homo sapiens
taaataaaaactaa

SEQ ID NO: 1372990 - DNA, 14 bp, Homo sapiens
taaataaaatttgt

SEQ ID NO: 1372991 - DNA, 14 bp, Homo sapiens
taaataaaccactg

SEQ ID NO: 1372992 - DNA, 12 bp, Homo sapiens
taaataattctt

SEQ ID NO: 1372993 - DNA, 14 bp, Homo sapiens
taaataatttattt

SEQ ID NO: 1372994 - DNA, 17 bp, Homo sapiens
taaataatttatttaat

SEQ ID NO: 1372995 - DNA, 16 bp, Homo sapiens
taaatacatatggatg

SEQ ID NO: 1372996 - DNA, 16 bp, Homo sapiens
taaatacatgcatata

SEQ ID NO: 1372997 - DNA, 23 bp, Homo sapiens
taaataggaatcattcagaaatg

SEQ ID NO: 1372998 - DNA, 16 bp, Homo sapiens
taaatattttctattt

SEQ ID NO: 1372999 - DNA, 14 bp, Homo sapiens
taaatctaaatcta

SEQ ID NO: 1373000 - DNA, 16 bp, Homo sapiens
taaatctatttattaa

SEQ ID NO: 1373001 - DNA, 20 bp, Homo sapiens
taaatctatttattaatatt

SEQ ID NO: 1373002 - DNA, 15 bp, Homo sapiens
taaatcttaatgttc

SEQ ID NO: 1373003 - DNA, 17 bp, Homo sapiens
taaatcttaatgttcct

SEQ ID NO: 1373004 - DNA, 19 bp, Homo sapiens
taaatcttaatgttcctca

SEQ ID NO: 1373005 - DNA, 15 bp, Homo sapiens
taaatgccatagaaa

SEQ ID NO: 1373006 - DNA, 23 bp, Homo sapiens
taaatggcctcatgtggctggaa

SEQ ID NO: 1373007 - DNA, 12 bp, Homo sapiens
taaatgtaaact

SEQ ID NO: 1373008 - DNA, 17 bp, Homo sapiens
taaatgttacctctgaa

SEQ ID NO: 1373009 - DNA, 13 bp, Homo sapiens
taaatgttattat

SEQ ID NO: 1373010 - DNA, 21 bp, Homo sapiens
taaatgtttcttttaaagacc

SEQ ID NO: 1373011 - DNA, 13 bp, Homo sapiens
taaattacaattt

SEQ ID NO: 1373012 - DNA, 23 bp, Homo sapiens
taaattacaattttatctgtttc

SEQ ID NO: 1373013 - DNA, 17 bp, Homo sapiens
taaattaggaataaata

SEQ ID NO: 1373014 - DNA, 10 bp, Homo sapiens
taaattattt

SEQ ID NO: 1373015 - DNA, 13 bp, Homo sapiens
taaattatttatg

SEQ ID NO: 1373016 - DNA, 23 bp, Homo sapiens
taaattatttgattatttaagac

SEQ ID NO: 1373017 - DNA, 13 bp, Homo sapiens
taaattctgattt

SEQ ID NO: 1373018 - DNA, 16 bp, Homo sapiens
taaattctgatttctt

SEQ ID NO: 1373019 - DNA, 21 bp, Homo sapiens
taaatttcactactagattga

SEQ ID NO: 1373020 - DNA, 16 bp, Homo sapiens
taaatttcttatgtga

SEQ ID NO: 1373021 - DNA, 22 bp, Homo sapiens
taaatttcttatgtgacattaa

SEQ ID NO: 1373022 - DNA, 13 bp, Homo sapiens
taaatttttaaga

SEQ ID NO: 1373023 - DNA, 22 bp, Homo sapiens
taaatttttttgtatgaaaaca

SEQ ID NO: 1373024 - DNA, 13 bp, Homo sapiens
taacaaagacaaa

SEQ ID NO: 1373025 - DNA, 19 bp, Homo sapiens
taacacatttttttgcatg

SEQ ID NO: 1373026 - DNA, 21 bp, Homo sapiens
taacacatttttttgcatgca

SEQ ID NO: 1373027 - DNA, 18 bp, Homo sapiens
taacaccatgattaacca

SEQ ID NO: 1373028 - DNA, 13 bp, Homo sapiens
taacagaaattgt

SEQ ID NO: 1373029 - DNA, 23 bp, Homo sapiens
taacagttgtatttaacagaaat

SEQ ID NO: 1373030 - DNA, 12 bp, Homo sapiens
taacataaattt

SEQ ID NO: 1373031 - DNA, 12 bp, Homo sapiens
taacattattta

SEQ ID NO: 1373032 - DNA, 16 bp, Homo sapiens
taacccataattgaag

SEQ ID NO: 1373033 - DNA, 14 bp, Homo sapiens
taacctcgccctct

SEQ ID NO: 1373034 - DNA, 17 bp, Homo sapiens
taacctcgccctctcct

SEQ ID NO: 1373035 - DNA, 13 bp, Homo sapiens
taaccttgtataa

SEQ ID NO: 1373036 - DNA, 20 bp, Homo sapiens
taactcaaatacacatttgc

SEQ ID NO: 1373037 - DNA, 21 bp, Homo sapiens
taactcaaatacacatttgct

SEQ ID NO: 1373038 - DNA, 21 bp, Homo sapiens
taactcaccagccccactgcc

SEQ ID NO: 1373039 - DNA, 15 bp, Homo sapiens
taactccccacccca

SEQ ID NO: 1373040 - DNA, 16 bp, Homo sapiens
taactgcatttttaga

SEQ ID NO: 1373041 - DNA, 13 bp, Homo sapiens
taactgtaaatca

SEQ ID NO: 1373042 - DNA, 21 bp, Homo sapiens
taactgtcaggctgaaaacaa

SEQ ID NO: 1373043 - DNA, 22 bp, Homo sapiens
taactgtcaggctgaaaacaat

SEQ ID NO: 1373044 - DNA, 16 bp, Homo sapiens
taacttaactgaaatg

SEQ ID NO: 1373045 - DNA, 19 bp, Homo sapiens
taacttgcttaaatttctt

SEQ ID NO: 1373046 - DNA, 21 bp, Homo sapiens
taagaaaatatattctttcaa

SEQ ID NO: 1373047 - DNA, 23 bp, Homo sapiens
taagaaaatatattctttcaaag

SEQ ID NO: 1373048 - DNA, 24 bp, Homo sapiens
taagaaacttatttctcatatcaa

SEQ ID NO: 1373049 - DNA, 15 bp, Homo sapiens
taagaacgaggattt

SEQ ID NO: 1373050 - DNA, 14 bp, Homo sapiens
taagaattcaaact

SEQ ID NO: 1373051 - DNA, 22 bp, Homo sapiens
taagaattcaaactggggcctc

SEQ ID NO: 1373052 - DNA, 15 bp, Homo sapiens
taagaattcagacat

SEQ ID NO: 1373053 - DNA, 20 bp, Homo sapiens
taagaattctgattgatttg

SEQ ID NO: 1373054 - DNA, 14 bp, Homo sapiens
taagaatttgcata

SEQ ID NO: 1373055 - DNA, 18 bp, Homo sapiens
taagaatttgcatactta

SEQ ID NO: 1373056 - DNA, 15 bp, Homo sapiens
taagatagtgtaact

SEQ ID NO: 1373057 - DNA, 20 bp, Homo sapiens
taagatagtgtaacttgctt

SEQ ID NO: 1373058 - DNA, 12 bp, Homo sapiens
taagatcactgt

SEQ ID NO: 1373059 - DNA, 15 bp, Homo sapiens
taagatcactgttta

SEQ ID NO: 1373060 - DNA, 16 bp, Homo sapiens
aaagcatttttcaata

SEQ ID NO: 1373061 - DNA, 10 bp, Homo sapiens
aaagccttcc

SEQ ID NO: 1373062 - DNA, 19 bp, Homo sapiens
aaagctagtcaacagtacc

SEQ ID NO: 1373063 - DNA, 20 bp, Homo sapiens
aaagctcctggggcgtccag

SEQ ID NO: 1373064 - DNA, 13 bp, Homo sapiens
aaagctgagcctg

SEQ ID NO: 1373065 - DNA, 14 bp, Homo sapiens
aaagctgttccttg

SEQ ID NO: 1373066 - DNA, 11 bp, Homo sapiens
aaagcttcccc

SEQ ID NO: 1373067 - DNA, 19 bp, Homo sapiens
aaagcttggattaaataca

SEQ ID NO: 1373068 - DNA, 18 bp, Homo sapiens
aaagcttggttctgtgaa

SEQ ID NO: 1373069 - DNA, 15 bp, Homo sapiens
aaaggaaagaaaaca

SEQ ID NO: 1373070 - DNA, 17 bp, Homo sapiens
aaaggaacattgtgtct

SEQ ID NO: 1373071 - DNA, 13 bp, Homo sapiens
aaaggagagcatc

SEQ ID NO: 1373072 - DNA, 22 bp, Homo sapiens
aaaggataaagaaggatgatgt

SEQ ID NO: 1373073 - DNA, 21 bp, Homo sapiens
aaaggatagtaagcatagaaa

SEQ ID NO: 1373074 - DNA, 14 bp, Homo sapiens
aaaggcttataaaa

SEQ ID NO: 1373075 - DNA, 13 bp, Homo sapiens
aagttaaaattgt

SEQ ID NO: 1373076 - DNA, 17 bp, Homo sapiens
aagttagtttgtatata

SEQ ID NO: 1373077 - DNA, 15 bp, Homo sapiens
aagttattgcagttt

SEQ ID NO: 1373078 - DNA, 11 bp, Homo sapiens
aagttcttatg

SEQ ID NO: 1373079 - DNA, 19 bp, Homo sapiens
aagttcttatgaggagggg

SEQ ID NO: 1373080 - DNA, 20 bp, Homo sapiens
aagttcttatgaggagggga

SEQ ID NO: 1373081 - DNA, 15 bp, Homo sapiens
aagttgaaaatcata

SEQ ID NO: 1373082 - DNA, 21 bp, Homo sapiens
aagttgaaaatcataggcacc

SEQ ID NO: 1373083 - DNA, 18 bp, Homo sapiens
aagttgagctatgactta

SEQ ID NO: 1373084 - DNA, 22 bp, Homo sapiens
aagttgcagatgttagatattt

SEQ ID NO: 1373085 - DNA, 14 bp, Homo sapiens
aagttgtaaagtat

SEQ ID NO: 1373086 - DNA, 17 bp, Homo sapiens
aagttgtaaagtatgta

SEQ ID NO: 1373087 - DNA, 18 bp, Homo sapiens
aagtttacaatcaaagga

SEQ ID NO: 1373088 - DNA, 15 bp, Homo sapiens
aagtttgcttagaaa

SEQ ID NO: 1373089 - DNA, 13 bp, Homo sapiens
aagttttatatgc

SEQ ID NO: 1373090 - DNA, 15 bp, Homo sapiens
aagttttgacaagct

SEQ ID NO: 1373091 - DNA, 12 bp, Homo sapiens
aagttttgttgt

SEQ ID NO: 1373092 - DNA, 23 bp, Homo sapiens
aagtttttttgctgctgcctctt

SEQ ID NO: 1373093 - DNA, 20 bp, Homo sapiens
aataaaaatatattttcaac

SEQ ID NO: 1373094 - DNA, 19 bp, Homo sapiens
aataaaatgaaaattgtat

SEQ ID NO: 1373095 - DNA, 12 bp, Homo sapiens
aataaaatttaa

SEQ ID NO: 1373096 - DNA, 14 bp, Homo sapiens
aataaaatttgttg

SEQ ID NO: 1373097 - DNA, 13 bp, Homo sapiens
aataaactttaat

SEQ ID NO: 1373098 - DNA, 16 bp, Homo sapiens
aataaataattttcat

SEQ ID NO: 1373099 - DNA, 21 bp, Homo sapiens
aataaatcattcttactaaaa

SEQ ID NO: 1373100 - DNA, 15 bp, Homo sapiens
aataaattttgaaaa

SEQ ID NO: 1373101 - DNA, 13 bp, Homo sapiens
aataacagctgca

SEQ ID NO: 1373102 - DNA, 18 bp, Homo sapiens
aataaccctttggttttt

SEQ ID NO: 1373103 - DNA, 20 bp, Homo sapiens
aataactggaacaaattatt

SEQ ID NO: 1373104 - DNA, 15 bp, Homo sapiens
aataactgtgtactg

SEQ ID NO: 1373105 - DNA, 19 bp, Homo sapiens
aataagcactgtaaacttc

SEQ ID NO: 1373106 - DNA, 23 bp, Homo sapiens
aataagctagttgaatacttgaa

SEQ ID NO: 1373107 - DNA, 14 bp, Homo sapiens
aataaggatttttc

SEQ ID NO: 1373108 - DNA, 21 bp, Homo sapiens
aataagtgtgtggtagaaaca

SEQ ID NO: 1373109 - DNA, 11 bp, Homo sapiens
aataatcaaga

SEQ ID NO: 1373110 - DNA, 15 bp, Homo sapiens
aataatcaagagcct

SEQ ID NO: 1373111 - DNA, 14 bp, Homo sapiens
aataatcttgtttc

SEQ ID NO: 1373112 - DNA, 18 bp, Homo sapiens
aatacaacttaaataata

SEQ ID NO: 1373113 - DNA, 16 bp, Homo sapiens
aaattacaattttatc

SEQ ID NO: 1373114 - DNA, 16 bp, Homo sapiens
aaattaggaataaata

SEQ ID NO: 1373115 - DNA, 16 bp, Homo sapiens
aaattatcaatatcta

SEQ ID NO: 1373116 - DNA, 15 bp, Homo sapiens
aaattcaactttgta

SEQ ID NO: 1373117 - DNA, 16 bp, Homo sapiens
aaattcatttctaatt

SEQ ID NO: 1373118 - DNA, 11 bp, Homo sapiens
aaattcctgta

SEQ ID NO: 1373119 - DNA, 16 bp, Homo sapiens
aaattctcctggaggt

SEQ ID NO: 1373120 - DNA, 12 bp, Homo sapiens
aaattctgattt

SEQ ID NO: 1373121 - DNA, 16 bp, Homo sapiens
aaattctgatttcttt

SEQ ID NO: 1373122 - DNA, 17 bp, Homo sapiens
aaattctgatttctttt

SEQ ID NO: 1373123 - DNA, 15 bp, Homo sapiens
aaattgcatactttg

SEQ ID NO: 1373124 - DNA, 17 bp, Homo sapiens
aaattgcatactttgta

SEQ ID NO: 1373125 - DNA, 23 bp, Homo sapiens
aaattgcatactttgtattttga

SEQ ID NO: 1373126 - DNA, 19 bp, Homo sapiens
aaattgttatcaaaatagt

SEQ ID NO: 1373127 - DNA, 15 bp, Homo sapiens
aaattgtttagtgat

SEQ ID NO: 1373128 - DNA, 13 bp, Homo sapiens
aaatttaaaaaat

SEQ ID NO: 1373129 - DNA, 16 bp, Homo sapiens
aaatttaaaaaataaa

SEQ ID NO: 1373130 - DNA, 12 bp, Homo sapiens
aaatttagaaca

SEQ ID NO: 1373131 - DNA, 15 bp, Homo sapiens
aaatttcttatgtga

SEQ ID NO: 1373132 - DNA, 21 bp, Homo sapiens
aaatttgtctggttaaaaaat

SEQ ID NO: 1373133 - DNA, 13 bp, Homo sapiens
aaatttgttgcat

SEQ ID NO: 1373134 - DNA, 19 bp, Homo sapiens
acttaaatggtaataagca

SEQ ID NO: 1373135 - DNA, 20 bp, Homo sapiens
acttaacatagccaaaatgt

SEQ ID NO: 1373136 - DNA, 15 bp, Homo sapiens
acttaataactgtgt

SEQ ID NO: 1373137 - DNA, 17 bp, Homo sapiens
acttaataactgtgtac

SEQ ID NO: 1373138 - DNA, 22 bp, Homo sapiens
acttagaatccctgtgttaatt

SEQ ID NO: 1373139 - DNA, 15 bp, Homo sapiens
acttaggtgtggggg

SEQ ID NO: 1373140 - DNA, 23 bp, Homo sapiens
acttataagtgaagtgatactat

SEQ ID NO: 1373141 - DNA, 16 bp, Homo sapiens
acttcaaagcaagctg

SEQ ID NO: 1373142 - DNA, 11 bp, Homo sapiens
acttcagctga

SEQ ID NO: 1373143 - DNA, 16 bp, Homo sapiens
acttcagctgactttt

SEQ ID NO: 1373144 - DNA, 13 bp, Homo sapiens
acttcccaccctg

SEQ ID NO: 1373145 - DNA, 17 bp, Homo sapiens
acttcccaccctgcccc

SEQ ID NO: 1373146 - DNA, 14 bp, Homo sapiens
acttccttgagaca

SEQ ID NO: 1373147 - DNA, 14 bp, Homo sapiens
acttctacctgccc

SEQ ID NO: 1373148 - DNA, 16 bp, Homo sapiens
acttctacctgccctc

SEQ ID NO: 1373149 - DNA, 24 bp, Homo sapiens
acttctgcaacaagcatgcagctt

SEQ ID NO: 1373150 - DNA, 19 bp, Homo sapiens
acttctgccagatgtccta

SEQ ID NO: 1373151 - DNA, 16 bp, Homo sapiens
acttctgcctggagac

SEQ ID NO: 1373152 - DNA, 14 bp, Homo sapiens
acttcttctccatc

SEQ ID NO: 1373153 - DNA, 17 bp, Homo sapiens
acttcttctccatccct

SEQ ID NO: 1373154 - DNA, 13 bp, Homo sapiens
acttcttctctta

SEQ ID NO: 1373155 - DNA, 11 bp, Homo sapiens
acttgaaaaga

SEQ ID NO: 1373156 - DNA, 16 bp, Homo sapiens
acttgaaccataaaat

SEQ ID NO: 1373157 - DNA, 20 bp, Homo sapiens
acttgaagccatctaaagta

SEQ ID NO: 1373158 - DNA, 15 bp, Homo sapiens
acttgaatgtgtcag

SEQ ID NO: 1373159 - DNA, 13 bp, Homo sapiens
acttgaggcctga

SEQ ID NO: 1373160 - DNA, 16 bp, Homo sapiens
acttgcttaaatttct

SEQ ID NO: 1373161 - DNA, 16 bp, Homo sapiens
acttgcttatttgaca

SEQ ID NO: 1373162 - DNA, 23 bp, Homo sapiens
acttggaagcacaccaatcttac

SEQ ID NO: 1373163 - DNA, 13 bp, Homo sapiens
acttggttttatg

SEQ ID NO: 1373164 - DNA, 13 bp, Homo sapiens
acttgtagatttg

SEQ ID NO: 1373165 - DNA, 14 bp, Homo sapiens
acttgtagatttga

SEQ ID NO: 1373166 - DNA, 15 bp, Homo sapiens
acttgtagatttgat

SEQ ID NO: 1373167 - DNA, 16 bp, Homo sapiens
acttgtagatttgatt

SEQ ID NO: 1373168 - DNA, 10 bp, Homo sapiens
acttgtgttt

SEQ ID NO: 1373169 - DNA, 16 bp, Homo sapiens
acttgttgcctataag

SEQ ID NO: 1373170 - DNA, 14 bp, Homo sapiens
actttacagaaatg

SEQ ID NO: 1373171 - DNA, 18 bp, Homo sapiens
actttacccacctagaac

SEQ ID NO: 1373172 - DNA, 18 bp, Homo sapiens
actttctgttatgggctt

SEQ ID NO: 1373173 - DNA, 17 bp, Homo sapiens
actttgatgtcagcagt

SEQ ID NO: 1373174 - DNA, 19 bp, Homo sapiens
actttgctgttccttactt

SEQ ID NO: 1373175 - DNA, 14 bp, Homo sapiens
actttgggggagga

SEQ ID NO: 1373176 - DNA, 17 bp, Homo sapiens
actttgtaaattctgat

SEQ ID NO: 1373177 - DNA, 21 bp, Homo sapiens
actttgtaaattctgatttct

SEQ ID NO: 1373178 - DNA, 17 bp, Homo sapiens
actttgtacatttggga

SEQ ID NO: 1373179 - DNA, 12 bp, Homo sapiens
actttgtatagt

SEQ ID NO: 1373180 - DNA, 17 bp, Homo sapiens
actttgtatagttatgt

SEQ ID NO: 1373181 - DNA, 16 bp, Homo sapiens
aactccacatctgcct

SEQ ID NO: 1373182 - DNA, 13 bp, Homo sapiens
aactccagcaact

SEQ ID NO: 1373183 - DNA, 15 bp, Homo sapiens
aactctgcatgtaga

SEQ ID NO: 1373184 - DNA, 18 bp, Homo sapiens
aactgaagcagcctctcc

SEQ ID NO: 1373185 - DNA, 23 bp, Homo sapiens
aactgagtattaatatctgagga

SEQ ID NO: 1373186 - DNA, 16 bp, Homo sapiens
aactgcaggccctggc

SEQ ID NO: 1373187 - DNA, 17 bp, Homo sapiens
aactgcaggccctggcc

SEQ ID NO: 1373188 - DNA, 21 bp, Homo sapiens
aactgctgactgttttctctt

SEQ ID NO: 1373189 - DNA, 23 bp, Homo sapiens
aactgctgactgttttctcttga

SEQ ID NO: 1373190 - DNA, 22 bp, Homo sapiens
aactgcttcccttactttgctg

SEQ ID NO: 1373191 - DNA, 19 bp, Homo sapiens
aactggtcaccatgaaact

SEQ ID NO: 1373192 - DNA, 15 bp, Homo sapiens
aactgtagaaatgat

SEQ ID NO: 1373193 - DNA, 16 bp, Homo sapiens
aactgtagaaatgatg

SEQ ID NO: 1373194 - DNA, 21 bp, Homo sapiens
aactgtcaggctgaaaacaat

SEQ ID NO: 1373195 - DNA, 16 bp, Homo sapiens
aactgtcctgtcctgc

SEQ ID NO: 1373196 - DNA, 20 bp, Homo sapiens
aactgtcgtgtcatactcga

SEQ ID NO: 1373197 - DNA, 14 bp, Homo sapiens
aactgtcttcctca

SEQ ID NO: 1373198 - DNA, 16 bp, Homo sapiens
aactgtgatttcagga

SEQ ID NO: 1373199 - DNA, 18 bp, Homo sapiens
aactgttgtagaagacaa

SEQ ID NO: 1373200 - DNA, 19 bp, Homo sapiens
aactgttgtagaagacaaa

SEQ ID NO: 1373201 - DNA, 14 bp, Homo sapiens
aacttaaataataa

SEQ ID NO: 1373202 - DNA, 21 bp, Homo sapiens
aacttaaatgttattatctgg

SEQ ID NO: 1373203 - DNA, 13 bp, Homo sapiens
aacttaactgaaa

SEQ ID NO: 1373204 - DNA, 23 bp, Homo sapiens
aacttccaaataaataattttca

SEQ ID NO: 1373205 - DNA, 21 bp, Homo sapiens
aacttcttctccatccctcta

SEQ ID NO: 1373206 - DNA, 19 bp, Homo sapiens
aacttgcttaaatttctta

SEQ ID NO: 1373207 - DNA, 16 bp, Homo sapiens
accctcttcctgtgat

SEQ ID NO: 1373208 - DNA, 17 bp, Homo sapiens
accctcttcctgtgatc

SEQ ID NO: 1373209 - DNA, 19 bp, Homo sapiens
accctcttcctgtgatcca

SEQ ID NO: 1373210 - DNA, 20 bp, Homo sapiens
accctcttcctgtgatccac

SEQ ID NO: 1373211 - DNA, 22 bp, Homo sapiens
accctcttgcccatcctgactg

SEQ ID NO: 1373212 - DNA, 10 bp, Homo sapiens
accctgcccc

SEQ ID NO: 1373213 - DNA, 14 bp, Homo sapiens
accctgctgagtct

SEQ ID NO: 1373214 - DNA, 16 bp, Homo sapiens
accctgctgctggtgc

SEQ ID NO: 1373215 - DNA, 17 bp, Homo sapiens
accctgggccctgggct

SEQ ID NO: 1373216 - DNA, 14 bp, Homo sapiens
accctgggggcaca

SEQ ID NO: 1373217 - DNA, 19 bp, Homo sapiens
accctgggtgggctctgtg

SEQ ID NO: 1373218 - DNA, 20 bp, Homo sapiens
accctttcccccttctctta

SEQ ID NO: 1373219 - DNA, 13 bp, Homo sapiens
accctttgggggt

SEQ ID NO: 1373220 - DNA, 21 bp, Homo sapiens
accctttggtttttttcttct

SEQ ID NO: 1373221 - DNA, 17 bp, Homo sapiens
acccttttaaagttgat

SEQ ID NO: 1373222 - DNA, 15 bp, Homo sapiens
accgaataaatgttt

SEQ ID NO: 1373223 - DNA, 18 bp, Homo sapiens
accgagtagaaaatgtga

SEQ ID NO: 1373224 - DNA, 18 bp, Homo sapiens
accgcacagctcaggagg

SEQ ID NO: 1373225 - DNA, 11 bp, Homo sapiens
accgcccatca

SEQ ID NO: 1373226 - DNA, 16 bp, Homo sapiens
accgcccctggccgcg

SEQ ID NO: 1373227 - DNA, 18 bp, Homo sapiens
accgcgggtgtgggaaag

SEQ ID NO: 1373228 - DNA, 19 bp, Homo sapiens
accgcgggtgtgggaaagc

SEQ ID NO: 1373229 - DNA, 12 bp, Homo sapiens
accggcaggtgc

SEQ ID NO: 1373230 - DNA, 15 bp, Homo sapiens
accgggccctgggtt

SEQ ID NO: 1373231 - DNA, 19 bp, Homo sapiens
accgggccctgggttcctc

SEQ ID NO: 1373232 - DNA, 21 bp, Homo sapiens
accgggtcttgattcagtcac

SEQ ID NO: 1373233 - DNA, 23 bp, Homo sapiens
accgggtcttgattcagtcacat

SEQ ID NO: 1373234 - DNA, 23 bp, Homo sapiens
accggtccagctggcctggacag

SEQ ID NO: 1373235 - DNA, 20 bp, Homo sapiens
acctagtgaaacttttctag

SEQ ID NO: 1373236 - DNA, 16 bp, Homo sapiens
acctatttccagaaat

SEQ ID NO: 1373237 - DNA, 13 bp, Homo sapiens
acctcagggctcc

SEQ ID NO: 1373238 - DNA, 18 bp, Homo sapiens
acctcagttattacatgt

SEQ ID NO: 1373239 - DNA, 21 bp, Homo sapiens
acctcatgcccaccccctgcc

SEQ ID NO: 1373240 - DNA, 23 bp, Homo sapiens
acctcatgcccaccccctgccct

SEQ ID NO: 1373241 - DNA, 15 bp, Homo sapiens
acctccaaccctgcc

SEQ ID NO: 1373242 - DNA, 19 bp, Homo sapiens
acctccacacccgtgagaa

SEQ ID NO: 1373243 - DNA, 20 bp, Homo sapiens
acctcccacaaaggagagct

SEQ ID NO: 1373244 - DNA, 14 bp, Homo sapiens
acctccccagcctg

SEQ ID NO: 1373245 - DNA, 15 bp, Homo sapiens
acctccccagcctgc

SEQ ID NO: 1373246 - DNA, 16 bp, Homo sapiens
acctccccagcctgcg

SEQ ID NO: 1373247 - DNA, 17 bp, Homo sapiens
acctccccagcctgcgc

SEQ ID NO: 1373248 - DNA, 15 bp, Homo sapiens
acctcgccctctcct

SEQ ID NO: 1373249 - DNA, 18 bp, Homo sapiens
acctctgcacaagctgca

SEQ ID NO: 1373250 - DNA, 21 bp, Homo sapiens
acctgaagtttttttgctgct

SEQ ID NO: 1373251 - DNA, 13 bp, Homo sapiens
acctgccaggcag

SEQ ID NO: 1373252 - DNA, 15 bp, Homo sapiens
acctgccaggcaggg

SEQ ID NO: 1373253 - DNA, 20 bp, Homo sapiens
acctggaagaacaggcctct

SEQ ID NO: 1373254 - DNA, 23 bp, Homo sapiens
acctggaagaacaggcctctcca

SEQ ID NO: 1373255 - DNA, 19 bp, Homo sapiens
acctggggctgctgtgaag

SEQ ID NO: 1373256 - DNA, 20 bp, Homo sapiens
acctgtatatttgtaaagct

SEQ ID NO: 1373257 - DNA, 18 bp, Homo sapiens
acctgtatttaaaaatag

SEQ ID NO: 1373258 - DNA, 23 bp, Homo sapiens
acctgtatttaaaaatagaaaca

SEQ ID NO: 1373259 - DNA, 19 bp, Homo sapiens
accttaagtaatcatctaa

SEQ ID NO: 1373260 - DNA, 13 bp, Homo sapiens
accttactaatta

SEQ ID NO: 1373261 - DNA, 14 bp, Homo sapiens
accttaggccttcc

SEQ ID NO: 1373262 - DNA, 16 bp, Homo sapiens
accttaggccttcctc

SEQ ID NO: 1373263 - DNA, 18 bp, Homo sapiens
accttaggccttcctctc

SEQ ID NO: 1373264 - DNA, 17 bp, Homo sapiens
aattaaggtgtttgaaa

SEQ ID NO: 1373265 - DNA, 18 bp, Homo sapiens
aattaaggtgtttgaaaa

SEQ ID NO: 1373266 - DNA, 15 bp, Homo sapiens
aattagccaagtgtg

SEQ ID NO: 1373267 - DNA, 20 bp, Homo sapiens
aattaggcaaggctatgtga

SEQ ID NO: 1373268 - DNA, 18 bp, Homo sapiens
aattatcttgatacattc

SEQ ID NO: 1373269 - DNA, 19 bp, Homo sapiens
aattatcttgatacattca

SEQ ID NO: 1373270 - DNA, 16 bp, Homo sapiens
aattattgacactgaa

SEQ ID NO: 1373271 - DNA, 19 bp, Homo sapiens
aattattgacactgaactt

SEQ ID NO: 1373272 - DNA, 14 bp, Homo sapiens
aattatttgattat

SEQ ID NO: 1373273 - DNA, 20 bp, Homo sapiens
aattcaaactggggcctcca

SEQ ID NO: 1373274 - DNA, 16 bp, Homo sapiens
aattcaactttgtaaa

SEQ ID NO: 1373275 - DNA, 22 bp, Homo sapiens
aattcaactttgtaaaaatctt

SEQ ID NO: 1373276 - DNA, 13 bp, Homo sapiens
aattcactcccac

SEQ ID NO: 1373277 - DNA, 23 bp, Homo sapiens
aattcactcccacacccaagaag

SEQ ID NO: 1373278 - DNA, 22 bp, Homo sapiens
aattcagacatctgaggtttta

SEQ ID NO: 1373279 - DNA, 18 bp, Homo sapiens
aattcatagtaagattga

SEQ ID NO: 1373280 - DNA, 13 bp, Homo sapiens
aattcatttctaa

SEQ ID NO: 1373281 - DNA, 14 bp, Homo sapiens
aattctccactgtg

SEQ ID NO: 1373282 - DNA, 20 bp, Homo sapiens
aattctctgtggaatgaata

SEQ ID NO: 1373283 - DNA, 23 bp, Homo sapiens
aattctgattctggctttaagcc

SEQ ID NO: 1373284 - DNA, 13 bp, Homo sapiens
aattctgatttct

SEQ ID NO: 1373285 - DNA, 14 bp, Homo sapiens
aattctgatttctt

SEQ ID NO: 1373286 - DNA, 16 bp, Homo sapiens
aattctgatttctttt

SEQ ID NO: 1373287 - DNA, 14 bp, Homo sapiens
aattctgtttttct

SEQ ID NO: 1373288 - DNA, 18 bp, Homo sapiens
aattcttttttattaatc

SEQ ID NO: 1373289 - DNA, 16 bp, Homo sapiens
aattgaaggtttttga

SEQ ID NO: 1373290 - DNA, 21 bp, Homo sapiens
aattggtaaaactcactgtga

SEQ ID NO: 1373291 - DNA, 23 bp, Homo sapiens
aattggtacttttaaaaacataa

SEQ ID NO: 1373292 - DNA, 12 bp, Homo sapiens
aattgtacaaaa

SEQ ID NO: 1373293 - DNA, 14 bp, Homo sapiens
aattgtatattgta

SEQ ID NO: 1373294 - DNA, 11 bp, Homo sapiens
aattgtatttt

SEQ ID NO: 1373295 - DNA, 12 bp, Homo sapiens
aattgtattttt

SEQ ID NO: 1373296 - DNA, 19 bp, Homo sapiens
aattgtcactttttatgct

SEQ ID NO: 1373297 - DNA, 12 bp, Homo sapiens
aattgtgaaaaa

SEQ ID NO: 1373298 - DNA, 11 bp, Homo sapiens
aattgtggcta

SEQ ID NO: 1373299 - DNA, 15 bp, Homo sapiens
aattgtgtgaacttg

SEQ ID NO: 1373300 - DNA, 13 bp, Homo sapiens
aattgtttaaaaa

SEQ ID NO: 1373301 - DNA, 12 bp, Homo sapiens
aatttaaatgaa

SEQ ID NO: 1373302 - DNA, 12 bp, Homo sapiens
aatttaagtttt

SEQ ID NO: 1373303 - DNA, 20 bp, Homo sapiens
aatttaataccagatacctt

SEQ ID NO: 1373304 - DNA, 16 bp, Homo sapiens
aatttacctgatttct

SEQ ID NO: 1373305 - DNA, 15 bp, Homo sapiens
aatttacttgttttg

SEQ ID NO: 1373306 - DNA, 13 bp, Homo sapiens
aatttagtgtttt

SEQ ID NO: 1373307 - DNA, 18 bp, Homo sapiens
aatttcctttttgacact

SEQ ID NO: 1373308 - DNA, 19 bp, Homo sapiens
aatttcctttttgacactg

SEQ ID NO: 1373309 - DNA, 20 bp, Homo sapiens
aatttctgtgccctcctgac

SEQ ID NO: 1373310 - DNA, 16 bp, Homo sapiens
aatttcttatgtgaca

SEQ ID NO: 1373311 - DNA, 23 bp, Homo sapiens
acactgcctttttatttatatgt

SEQ ID NO: 1373312 - DNA, 21 bp, Homo sapiens
acactgctgctccagtgcagg

SEQ ID NO: 1373313 - DNA, 15 bp, Homo sapiens
acactggttctcaat

SEQ ID NO: 1373314 - DNA, 18 bp, Homo sapiens
acactggttctcaatgaa

SEQ ID NO: 1373315 - DNA, 19 bp, Homo sapiens
acactggttctcaatgaaa

SEQ ID NO: 1373316 - DNA, 20 bp, Homo sapiens
acacttcttacgcaatgctt

SEQ ID NO: 1373317 - DNA, 14 bp, Homo sapiens
acacttgaaacctt

SEQ ID NO: 1373318 - DNA, 12 bp, Homo sapiens
acagaaacactg

SEQ ID NO: 1373319 - DNA, 13 bp, Homo sapiens
acagaaacactgc

SEQ ID NO: 1373320 - DNA, 20 bp, Homo sapiens
acagaaagagactccgtctc

SEQ ID NO: 1373321 - DNA, 16 bp, Homo sapiens
acagaaattgtatatt

SEQ ID NO: 1373322 - DNA, 23 bp, Homo sapiens
acagaaattgtatattgtaattt

SEQ ID NO: 1373323 - DNA, 19 bp, Homo sapiens
acagaatcttccttttatt

SEQ ID NO: 1373324 - DNA, 17 bp, Homo sapiens
acagactatttttagat

SEQ ID NO: 1373325 - DNA, 15 bp, Homo sapiens
acagagtcaaggcct

SEQ ID NO: 1373326 - DNA, 13 bp, Homo sapiens
acagatacctcca

SEQ ID NO: 1373327 - DNA, 19 bp, Homo sapiens
acagatacctccaaccctg

SEQ ID NO: 1373328 - DNA, 21 bp, Homo sapiens
acagatacctccaaccctgcc

SEQ ID NO: 1373329 - DNA, 19 bp, Homo sapiens
acagatggaaaaactgagg

SEQ ID NO: 1373330 - DNA, 19 bp, Homo sapiens
acagattctttcagttctt

SEQ ID NO: 1373331 - DNA, 16 bp, Homo sapiens
acagcaaatgcaaaaa

SEQ ID NO: 1373332 - DNA, 22 bp, Homo sapiens
acagcaacgatcacaaatgact

SEQ ID NO: 1373333 - DNA, 13 bp, Homo sapiens
acagccagcacct

SEQ ID NO: 1373334 - DNA, 16 bp, Homo sapiens
acagccagcacctggc

SEQ ID NO: 1373335 - DNA, 12 bp, Homo sapiens
acagcctgggcc

SEQ ID NO: 1373336 - DNA, 15 bp, Homo sapiens
acagcctgggcccca

SEQ ID NO: 1373337 - DNA, 18 bp, Homo sapiens
acagcctgggccccagct

SEQ ID NO: 1373338 - DNA, 14 bp, Homo sapiens
acagcgagggcagc

SEQ ID NO: 1373339 - DNA, 15 bp, Homo sapiens
acagcgagggcagct

SEQ ID NO: 1373340 - DNA, 18 bp, Homo sapiens
acagcgccagcctcagac

SEQ ID NO: 1373341 - DNA, 18 bp, Homo sapiens
acagctgcaattccctgg

SEQ ID NO: 1373342 - DNA, 19 bp, Homo sapiens
acagcttgacctgaggctg

SEQ ID NO: 1373343 - DNA, 21 bp, Homo sapiens
acagcttgacctgaggctgtg

SEQ ID NO: 1373344 - DNA, 22 bp, Homo sapiens
acagcttgacctgaggctgtgg

SEQ ID NO: 1373345 - DNA, 23 bp, Homo sapiens
acagcttgacctgaggctgtggt

SEQ ID NO: 1373346 - DNA, 21 bp, Homo sapiens
acagcttgagccgggcccctg

SEQ ID NO: 1373347 - DNA, 14 bp, Homo sapiens
acaggagacctggc

SEQ ID NO: 1373348 - DNA, 16 bp, Homo sapiens
acaggcatgtgtcacc

SEQ ID NO: 1373349 - DNA, 19 bp, Homo sapiens
acaggcatgtgtcaccatg

SEQ ID NO: 1373350 - DNA, 23 bp, Homo sapiens
acaggcctctccatttgctcttc

SEQ ID NO: 1373351 - DNA, 18 bp, Homo sapiens
acagggataaggcctgtg

SEQ ID NO: 1373352 - DNA, 20 bp, Homo sapiens
acagtaccctggttgtgtgt

SEQ ID NO: 1373353 - DNA, 13 bp, Homo sapiens
acagtagaactgt

SEQ ID NO: 1373354 - DNA, 13 bp, Homo sapiens
acagtagagccag

SEQ ID NO: 1373355 - DNA, 15 bp, Homo sapiens
acagtatcccacatc

SEQ ID NO: 1373356 - DNA, 13 bp, Homo sapiens
acagtgtatgtag

SEQ ID NO: 1373357 - DNA, 15 bp, Homo sapiens
acagtgtcccccagg

SEQ ID NO: 1373358 - DNA, 17 bp, Homo sapiens
acagtgtgtaaacaaaa

SEQ ID NO: 1373359 - DNA, 18 bp, Homo sapiens
acagtgtgtaaacaaaat

SEQ ID NO: 1373360 - DNA, 19 bp, Homo sapiens
acagttgctctatgctttc

SEQ ID NO: 1373361 - DNA, 12 bp, Homo sapiens
acagttgtattt

SEQ ID NO: 1373362 - DNA, 14 bp, Homo sapiens
acagttttcagaaa

SEQ ID NO: 1373363 - DNA, 18 bp, Homo sapiens
aagctgcccactgtttct

SEQ ID NO: 1373364 - DNA, 13 bp, Homo sapiens
aagctgggcaggt

SEQ ID NO: 1373365 - DNA, 21 bp, Homo sapiens
aagcttcatgcacttaaagaa

SEQ ID NO: 1373366 - DNA, 22 bp, Homo sapiens
aagcttcatgcacttaaagaag

SEQ ID NO: 1373367 - DNA, 17 bp, Homo sapiens
aagcttggttctgtgaa

SEQ ID NO: 1373368 - DNA, 20 bp, Homo sapiens
aaggaaaaacacaagcaaaa

SEQ ID NO: 1373369 - DNA, 16 bp, Homo sapiens
aaggaaaactacctgt

SEQ ID NO: 1373370 - DNA, 23 bp, Homo sapiens
aaggaaaactacctgtatttaaa

SEQ ID NO: 1373371 - DNA, 12 bp, Homo sapiens
aaggaaagaaaa

SEQ ID NO: 1373372 - DNA, 15 bp, Homo sapiens
aaggaaagaaaacat

SEQ ID NO: 1373373 - DNA, 13 bp, Homo sapiens
aaggaaagcaata

SEQ ID NO: 1373374 - DNA, 20 bp, Homo sapiens
aaggaagcactctgtatatt

SEQ ID NO: 1373375 - DNA, 18 bp, Homo sapiens
aaggaaggtggatggccc

SEQ ID NO: 1373376 - DNA, 13 bp, Homo sapiens
tatttcatcacaa

SEQ ID NO: 1373377 - DNA, 16 bp, Homo sapiens
tatttcctttatgtga

SEQ ID NO: 1373378 - DNA, 12 bp, Homo sapiens
tatttctactgt

SEQ ID NO: 1373379 - DNA, 16 bp, Homo sapiens
tatttctactgtcaaa

SEQ ID NO: 1373380 - DNA, 14 bp, Homo sapiens
tatttctattatta

SEQ ID NO: 1373381 - DNA, 16 bp, Homo sapiens
tcagaaacttgtgaag

SEQ ID NO: 1373382 - DNA, 17 bp, Homo sapiens
tcagaaacttgtgaagt

SEQ ID NO: 1373383 - DNA, 18 bp, Homo sapiens
tcagaagcacagaatatt

SEQ ID NO: 1373384 - DNA, 16 bp, Homo sapiens
tcagacagaacttgaa

SEQ ID NO: 1373385 - DNA, 22 bp, Homo sapiens
tcagacagagaggactgtaggg

SEQ ID NO: 1373386 - DNA, 12 bp, Homo sapiens
tcagagacagat

SEQ ID NO: 1373387 - DNA, 18 bp, Homo sapiens
tcagagatgaacatctaa

SEQ ID NO: 1373388 - DNA, 16 bp, Homo sapiens
tcagatgccacttcta

SEQ ID NO: 1373389 - DNA, 15 bp, Homo sapiens
tcagatgtttaaaac

SEQ ID NO: 1373390 - DNA, 23 bp, Homo sapiens
tcagccaaggttttataaggctg

SEQ ID NO: 1373391 - DNA, 14 bp, Homo sapiens
tcagccaagtttta

SEQ ID NO: 1373392 - DNA, 15 bp, Homo sapiens
tcagccaagttttat

SEQ ID NO: 1373393 - DNA, 13 bp, Homo sapiens
tcagccaggacca

SEQ ID NO: 1373394 - DNA, 16 bp, Homo sapiens
tcagccccctgcttca

SEQ ID NO: 1373395 - DNA, 23 bp, Homo sapiens
tcagccgtgtaaccatggaccca

SEQ ID NO: 1373396 - DNA, 16 bp, Homo sapiens
tcagcctgctccagct

SEQ ID NO: 1373397 - DNA, 22 bp, Homo sapiens
tcagctccagggaatccaagcc

SEQ ID NO: 1373398 - DNA, 13 bp, Homo sapiens
tcagctcggctca

SEQ ID NO: 1373399 - DNA, 18 bp, Homo sapiens
tcagctcggggagcctta

SEQ ID NO: 1373400 - DNA, 12 bp, Homo sapiens
tcaggaggcgcc

SEQ ID NO: 1373401 - DNA, 16 bp, Homo sapiens
tcaggcaaagaaaatg

SEQ ID NO: 1373402 - DNA, 12 bp, Homo sapiens
tcaggctcccag

SEQ ID NO: 1373403 - DNA, 16 bp, Homo sapiens
tcaggctgaaaacaat

SEQ ID NO: 1373404 - DNA, 14 bp, Homo sapiens
tcagggccatgctg

SEQ ID NO: 1373405 - DNA, 23 bp, Homo sapiens
tcaggggtgtgcggcctttggct

SEQ ID NO: 1373406 - DNA, 23 bp, Homo sapiens
tcagggtggtctcttcttggggc

SEQ ID NO: 1373407 - DNA, 19 bp, Homo sapiens
tcaggtagttgcaattgaa

SEQ ID NO: 1373408 - DNA, 21 bp, Homo sapiens
tcaggtgagaagcagaggaag

SEQ ID NO: 1373409 - DNA, 22 bp, Homo sapiens
tcagtaacccccttaaatttaa

SEQ ID NO: 1373410 - DNA, 13 bp, Homo sapiens
tcagtaagccgtg

SEQ ID NO: 1373411 - DNA, 18 bp, Homo sapiens
tcagtaggactccttatt

SEQ ID NO: 1373412 - DNA, 19 bp, Homo sapiens
tcagtagtttaaaagttct

SEQ ID NO: 1373413 - DNA, 20 bp, Homo sapiens
tcagtattagatgcacttaa

SEQ ID NO: 1373414 - DNA, 17 bp, Homo sapiens
tcagtattatgtagttg

SEQ ID NO: 1373415 - DNA, 17 bp, Homo sapiens
tcagtcacatggcatgg

SEQ ID NO: 1373416 - DNA, 14 bp, Homo sapiens
tcagtgccctccag

SEQ ID NO: 1373417 - DNA, 17 bp, Homo sapiens
tcagtgggttaacatca

SEQ ID NO: 1373418 - DNA, 20 bp, Homo sapiens
tcagtgggttaacatcagtt

SEQ ID NO: 1373419 - DNA, 23 bp, Homo sapiens
tcagtgggttaacatcagttttg

SEQ ID NO: 1373420 - DNA, 17 bp, Homo sapiens
tcagtgtttttgtgaat

SEQ ID NO: 1373421 - DNA, 19 bp, Homo sapiens
tcagttcattgtggtcctt

SEQ ID NO: 1373422 - DNA, 14 bp, Homo sapiens
tcagtttgttggaa

SEQ ID NO: 1373423 - DNA, 11 bp, Homo sapiens
tcataaattat

SEQ ID NO: 1373424 - DNA, 17 bp, Homo sapiens
tcatactcgagtctgag

SEQ ID NO: 1373425 - DNA, 15 bp, Homo sapiens
tcatagttaaatgtt

SEQ ID NO: 1373426 - DNA, 14 bp, Homo sapiens
tcatagttactgtg

SEQ ID NO: 1373427 - DNA, 16 bp, Homo sapiens
tcatagttttatttat

SEQ ID NO: 1373428 - DNA, 17 bp, Homo sapiens
tcatataccagcaatat

SEQ ID NO: 1373429 - DNA, 21 bp, Homo sapiens
tcatatcaacttagtcaataa

SEQ ID NO: 1373430 - DNA, 12 bp, Homo sapiens
tcatatgaaaaa

SEQ ID NO: 1373431 - DNA, 13 bp, Homo sapiens
tcatcaatcaaat

SEQ ID NO: 1373432 - DNA, 21 bp, Homo sapiens
tcatcaatcaaataagtattt

SEQ ID NO: 1373433 - DNA, 15 bp, Homo sapiens
tcatcacaagaacac

SEQ ID NO: 1373434 - DNA, 23 bp, Homo sapiens
tcatcacaagaacacacacatat

SEQ ID NO: 1373435 - DNA, 23 bp, Homo sapiens
tcatcacatttctatgccaaaca

SEQ ID NO: 1373436 - DNA, 20 bp, Homo sapiens
tcatccagatgtggctactg

SEQ ID NO: 1373437 - DNA, 17 bp, Homo sapiens
tcatcccattccaggca

SEQ ID NO: 1373438 - DNA, 23 bp, Homo sapiens
tcatcccattccaggcagcctct

SEQ ID NO: 1373439 - DNA, 19 bp, Homo sapiens
tcatctaagtcagtaccca

SEQ ID NO: 1373440 - DNA, 14 bp, Homo sapiens
tcatctcatttaag

SEQ ID NO: 1373441 - DNA, 14 bp, Homo sapiens
tcatctgctggtcc

SEQ ID NO: 1373442 - DNA, 16 bp, Homo sapiens
tcatgaaaataccatt

SEQ ID NO: 1373443 - DNA, 16 bp, Homo sapiens
tcatgattagcaagtt

SEQ ID NO: 1373444 - DNA, 16 bp, Homo sapiens
tcatgcccaccccctg

SEQ ID NO: 1373445 - DNA, 18 bp, Homo sapiens
tcatgcccaccccctgcc

SEQ ID NO: 1373446 - DNA, 22 bp, Homo sapiens
tcatgcccaccccctgccctgc

SEQ ID NO: 1373447 - DNA, 23 bp, Homo sapiens
tcatgcccaccccctgccctgca

SEQ ID NO: 1373448 - DNA, 23 bp, Homo sapiens
tcatgtaaattttgtatgaaaaa

SEQ ID NO: 1373449 - DNA, 12 bp, Homo sapiens
tcatgtatgttt

SEQ ID NO: 1373450 - DNA, 13 bp, Homo sapiens
tcatgtggctgga

SEQ ID NO: 1373451 - DNA, 16 bp, Homo sapiens
tcatgtggctggaaga

SEQ ID NO: 1373452 - DNA, 21 bp, Homo sapiens
tcatgtggctggaagatcctg

SEQ ID NO: 1373453 - DNA, 19 bp, Homo sapiens
tcatgttgatcatgtactt

SEQ ID NO: 1373454 - DNA, 14 bp, Homo sapiens
tcattattctctgc

SEQ ID NO: 1373455 - DNA, 13 bp, Homo sapiens
tcattcagaaatg

SEQ ID NO: 1373456 - DNA, 20 bp, Homo sapiens
tcattcagagtcagccagga

SEQ ID NO: 1373457 - DNA, 22 bp, Homo sapiens
tcattcagagtcagccaggacc

SEQ ID NO: 1373458 - DNA, 20 bp, Homo sapiens
tcattcttactaaaaagtat

SEQ ID NO: 1373459 - DNA, 11 bp, Homo sapiens
tcattgacttt

SEQ ID NO: 1373460 - DNA, 12 bp, Homo sapiens
tcattgactttt

SEQ ID NO: 1373461 - DNA, 19 bp, Homo sapiens
tcattgccaagggcccaaa

SEQ ID NO: 1373462 - DNA, 15 bp, Homo sapiens
tcattgctgagcctc

SEQ ID NO: 1373463 - DNA, 23 bp, Homo sapiens
tcatttaagggaaaaatatatat

SEQ ID NO: 1373464 - DNA, 18 bp, Homo sapiens
tcatttgtttacatttga

SEQ ID NO: 1373465 - DNA, 15 bp, Homo sapiens
tccaaaccttatctc

SEQ ID NO: 1373466 - DNA, 17 bp, Homo sapiens
tccaaagactcttggga

SEQ ID NO: 1373467 - DNA, 20 bp, Homo sapiens
tccaaatggagaagctgcag

SEQ ID NO: 1373468 - DNA, 21 bp, Homo sapiens
tccaaccctgccgtcaccacc

SEQ ID NO: 1373469 - DNA, 13 bp, Homo sapiens
tccaactccagca

SEQ ID NO: 1373470 - DNA, 14 bp, Homo sapiens
tccaactccagcaa

SEQ ID NO: 1373471 - DNA, 18 bp, Homo sapiens
tccaactcccttaaaata

SEQ ID NO: 1373472 - DNA, 21 bp, Homo sapiens
tccaagcctccacagcgaggg

SEQ ID NO: 1373473 - DNA, 16 bp, Homo sapiens
tccacacagaatgcaa

SEQ ID NO: 1373474 - DNA, 20 bp, Homo sapiens
tccacagcgagggcagctgc

SEQ ID NO: 1373475 - DNA, 21 bp, Homo sapiens
tccacagcgagggcagctgct

SEQ ID NO: 1373476 - DNA, 15 bp, Homo sapiens
tccacatctgcctta

SEQ ID NO: 1373477 - DNA, 12 bp, Homo sapiens
tccaccagcatc

SEQ ID NO: 1373478 - DNA, 14 bp, Homo sapiens
tccactgtgcacac

SEQ ID NO: 1373479 - DNA, 16 bp, Homo sapiens
tccactgtgctttcag

SEQ ID NO: 1373480 - DNA, 19 bp, Homo sapiens
tccactttgtttcgtgggg

SEQ ID NO: 1373481 - DNA, 23 bp, Homo sapiens
tccactttgtttcgtggggaggt

SEQ ID NO: 1373482 - DNA, 18 bp, Homo sapiens
tccagactcagagctctc

SEQ ID NO: 1373483 - DNA, 16 bp, Homo sapiens
tccagatcactgccac

SEQ ID NO: 1373484 - DNA, 13 bp, Homo sapiens
tccagatgtggct

SEQ ID NO: 1373485 - DNA, 17 bp, Homo sapiens
tccagcaacacagcctg

SEQ ID NO: 1373486 - DNA, 21 bp, Homo sapiens
tccagcaacacagcctgggcc

SEQ ID NO: 1373487 - DNA, 20 bp, Homo sapiens
tccagcaacttcttctccat

SEQ ID NO: 1373488 - DNA, 21 bp, Homo sapiens
tccagcaccttgtgcctgggg

SEQ ID NO: 1373489 - DNA, 20 bp, Homo sapiens
tccagcatttagctggccac

SEQ ID NO: 1373490 - DNA, 10 bp, Homo sapiens
tccagccagc

SEQ ID NO: 1373491 - DNA, 12 bp, Homo sapiens
tccagccagcgc

SEQ ID NO: 1373492 - DNA, 21 bp, Homo sapiens
tccagccagcgcctccctcca

SEQ ID NO: 1373493 - DNA, 15 bp, Homo sapiens
tccagcccctctggt

SEQ ID NO: 1373494 - DNA, 16 bp, Homo sapiens
tccagcctgccccgga

SEQ ID NO: 1373495 - DNA, 11 bp, Homo sapiens
tccagcctggg

SEQ ID NO: 1373496 - DNA, 13 bp, Homo sapiens
tccagctctggag

SEQ ID NO: 1373497 - DNA, 11 bp, Homo sapiens
tccagctggcc

SEQ ID NO: 1373498 - DNA, 13 bp, Homo sapiens
tccagctggcctg

SEQ ID NO: 1373499 - DNA, 17 bp, Homo sapiens
tccagctgttcagctgg

SEQ ID NO: 1373500 - DNA, 19 bp, Homo sapiens
tctaaatctatttattaat

SEQ ID NO: 1373501 - DNA, 16 bp, Homo sapiens
tctaagactatatata

SEQ ID NO: 1373502 - DNA, 21 bp, Homo sapiens
tctaagtcagtacccaccacc

SEQ ID NO: 1373503 - DNA, 15 bp, Homo sapiens
tctaagtcatgtatg

SEQ ID NO: 1373504 - DNA, 18 bp, Homo sapiens
tctaagtgggcattgcca

SEQ ID NO: 1373505 - DNA, 12 bp, Homo sapiens
tctaatagtctt

SEQ ID NO: 1373506 - DNA, 19 bp, Homo sapiens
tctaatatatatgaataaa

SEQ ID NO: 1373507 - DNA, 19 bp, Homo sapiens
tctaatctagatatcgact

SEQ ID NO: 1373508 - DNA, 20 bp, Homo sapiens
tctaatctagatatcgactt

SEQ ID NO: 1373509 - DNA, 18 bp, Homo sapiens
tctaattaaccttactaa

SEQ ID NO: 1373510 - DNA, 20 bp, Homo sapiens
tctacatgaggaactgtaga

SEQ ID NO: 1373511 - DNA, 21 bp, Homo sapiens
tctaccctcttagaaaaacca

SEQ ID NO: 1373512 - DNA, 17 bp, Homo sapiens
tctagaagccaagggaa

SEQ ID NO: 1373513 - DNA, 20 bp, Homo sapiens
tctagaagccaagggaaagg

SEQ ID NO: 1373514 - DNA, 23 bp, Homo sapiens
tctagaagccaagggaaaggggt

SEQ ID NO: 1373515 - DNA, 17 bp, Homo sapiens
tctagaattatttttca

SEQ ID NO: 1373516 - DNA, 22 bp, Homo sapiens
tctagggaaaaaccagcgtgtg

SEQ ID NO: 1373517 - DNA, 13 bp, Homo sapiens
tctagttttgtca

SEQ ID NO: 1373518 - DNA, 12 bp, Homo sapiens
tctataaaactc

SEQ ID NO: 1373519 - DNA, 19 bp, Homo sapiens
tctataaaatagatataaa

SEQ ID NO: 1373520 - DNA, 17 bp, Homo sapiens
tctatagcatcacttaa

SEQ ID NO: 1373521 - DNA, 20 bp, Homo sapiens
tctatagcatcacttaaaac

SEQ ID NO: 1373522 - DNA, 15 bp, Homo sapiens
tctatctatttgagg

SEQ ID NO: 1373523 - DNA, 12 bp, Homo sapiens
tctatctcatct

SEQ ID NO: 1373524 - DNA, 17 bp, Homo sapiens
tctattatggaaaactg

SEQ ID NO: 1373525 - DNA, 16 bp, Homo sapiens
tctattatttttataa

SEQ ID NO: 1373526 - DNA, 16 bp, Homo sapiens
tctattgcttcaccat

SEQ ID NO: 1373527 - DNA, 12 bp, Homo sapiens
tctattttaaga

SEQ ID NO: 1373528 - DNA, 13 bp, Homo sapiens
tctcaatgaaaaa

SEQ ID NO: 1373529 - DNA, 14 bp, Homo sapiens
tctcaatgaaaaat

SEQ ID NO: 1373530 - DNA, 23 bp, Homo sapiens
tctcacactggttctcaatgaaa

SEQ ID NO: 1373531 - DNA, 17 bp, Homo sapiens
tctcacagctatgcaaa

SEQ ID NO: 1373532 - DNA, 22 bp, Homo sapiens
tctcacccatgcaagcagagga

SEQ ID NO: 1373533 - DNA, 23 bp, Homo sapiens
tctcacccatgcaagcagaggac

SEQ ID NO: 1373534 - DNA, 12 bp, Homo sapiens
tctcacctcagc

SEQ ID NO: 1373535 - DNA, 12 bp, Homo sapiens
tctcagaagcac

SEQ ID NO: 1373536 - DNA, 16 bp, Homo sapiens
tctcagaagcacagaa

SEQ ID NO: 1373537 - DNA, 16 bp, Homo sapiens
tctcagtgccctccag

SEQ ID NO: 1373538 - DNA, 13 bp, Homo sapiens
tctcagtgttggt

SEQ ID NO: 1373539 - DNA, 23 bp, Homo sapiens
tctcattaatactctttatttat

SEQ ID NO: 1373540 - DNA, 18 bp, Homo sapiens
tctcatttaagggaaaaa

SEQ ID NO: 1373541 - DNA, 21 bp, Homo sapiens
tctccactgtgcacacccacc

SEQ ID NO: 1373542 - DNA, 22 bp, Homo sapiens
tctccaggggctgcttcctcct

SEQ ID NO: 1373543 - DNA, 19 bp, Homo sapiens
tctccattgtgcctaagtc

SEQ ID NO: 1373544 - DNA, 23 bp, Homo sapiens
tctccatttgctcttcagatgcc

SEQ ID NO: 1373545 - DNA, 15 bp, Homo sapiens
tctccccaggtccag

SEQ ID NO: 1373546 - DNA, 14 bp, Homo sapiens
tctcccctcagctc

SEQ ID NO: 1373547 - DNA, 15 bp, Homo sapiens
tctccctagctcctc

SEQ ID NO: 1373548 - DNA, 20 bp, Homo sapiens
tctccgccagcctcctctgg

SEQ ID NO: 1373549 - DNA, 21 bp, Homo sapiens
tctccggctcccagcctcagc

SEQ ID NO: 1373550 - DNA, 22 bp, Homo sapiens
tctccggctcccagcctcagcg

SEQ ID NO: 1373551 - DNA, 16 bp, Homo sapiens
tctccggggccatttg

SEQ ID NO: 1373552 - DNA, 16 bp, Homo sapiens
tctccgttagctcctg

SEQ ID NO: 1373553 - DNA, 18 bp, Homo sapiens
tctccgttagctcctgtg

SEQ ID NO: 1373554 - DNA, 19 bp, Homo sapiens
tctccgttagctcctgtgg

SEQ ID NO: 1373555 - DNA, 14 bp, Homo sapiens
tctcctccccttcc

SEQ ID NO: 1373556 - DNA, 15 bp, Homo sapiens
tctcctgactggtgc

SEQ ID NO: 1373557 - DNA, 19 bp, Homo sapiens
tctcctggcctatccgctg

SEQ ID NO: 1373558 - DNA, 21 bp, Homo sapiens
tctcctggcctatccgctgcc

SEQ ID NO: 1373559 - DNA, 20 bp, Homo sapiens
tctccttaagctgcagagat

SEQ ID NO: 1373560 - DNA, 20 bp, Homo sapiens
tctctaagtgggcattgcca

SEQ ID NO: 1373561 - DNA, 13 bp, Homo sapiens
tctctagcacaat

SEQ ID NO: 1373562 - DNA, 14 bp, Homo sapiens
tctctattaaaatg

SEQ ID NO: 1373563 - DNA, 13 bp, Homo sapiens
tctctatttgaga

SEQ ID NO: 1373564 - DNA, 11 bp, Homo sapiens
tctctcctggc

SEQ ID NO: 1373565 - DNA, 16 bp, Homo sapiens
tctctgtacttttcat

SEQ ID NO: 1373566 - DNA, 19 bp, Homo sapiens
tctctgtcacccttgtcct

SEQ ID NO: 1373567 - DNA, 18 bp, Homo sapiens
tctctgtggctccaggcc

SEQ ID NO: 1373568 - DNA, 17 bp, Homo sapiens
tctcttctcagagtggt

SEQ ID NO: 1373569 - DNA, 19 bp, Homo sapiens
tctcttctcagagtggtgg

SEQ ID NO: 1373570 - DNA, 13 bp, Homo sapiens
tctcttgagcctg

SEQ ID NO: 1373571 - DNA, 18 bp, Homo sapiens
tctcttgagcctgggagg

SEQ ID NO: 1373572 - DNA, 14 bp, Homo sapiens
tctcttgagtttgt

SEQ ID NO: 1373573 - DNA, 19 bp, Homo sapiens
tctctttaaaaggaaagaa

SEQ ID NO: 1373574 - DNA, 19 bp, Homo sapiens
tctctttgattatttgcat

SEQ ID NO: 1373575 - DNA, 14 bp, Homo sapiens
tctctttttgtttg

SEQ ID NO: 1373576 - DNA, 18 bp, Homo sapiens
tctgaaataggaaacaag

SEQ ID NO: 1373577 - DNA, 20 bp, Homo sapiens
tctgaaatgttacaaaaata

SEQ ID NO: 1373578 - DNA, 12 bp, Homo sapiens
tctgaacttgcc

SEQ ID NO: 1373579 - DNA, 13 bp, Homo sapiens
tctgactaattag

SEQ ID NO: 1373580 - DNA, 14 bp, Homo sapiens
tctgagaaaacaag

SEQ ID NO: 1373581 - DNA, 14 bp, Homo sapiens
tctgagctgccagt

SEQ ID NO: 1373582 - DNA, 17 bp, Homo sapiens
tctgagcttacgtagtt

SEQ ID NO: 1373583 - DNA, 17 bp, Homo sapiens
tctgaggccgttgctga

SEQ ID NO: 1373584 - DNA, 14 bp, Homo sapiens
tcacttgatgatac

SEQ ID NO: 1373585 - DNA, 18 bp, Homo sapiens
tcagaaaatgaaaaatct

SEQ ID NO: 1373586 - DNA, 15 bp, Homo sapiens
tcagaaacttgtgaa

SEQ ID NO: 1373587 - DNA, 19 bp, Homo sapiens
tcagaaagctttattttga

SEQ ID NO: 1373588 - DNA, 20 bp, Homo sapiens
tcagaaatataacacatttt

SEQ ID NO: 1373589 - DNA, 15 bp, Homo sapiens
tcagaaggagctaca

SEQ ID NO: 1373590 - DNA, 13 bp, Homo sapiens
tcagaagggctat

SEQ ID NO: 1373591 - DNA, 17 bp, Homo sapiens
tcagaagttagtttgta

SEQ ID NO: 1373592 - DNA, 18 bp, Homo sapiens
tcagaatcccttaacagt

SEQ ID NO: 1373593 - DNA, 15 bp, Homo sapiens
tcagacaccctcaac

SEQ ID NO: 1373594 - DNA, 17 bp, Homo sapiens
tcagacaccctcaacct

SEQ ID NO: 1373595 - DNA, 22 bp, Homo sapiens
tcagacaccctcaacctcttct

SEQ ID NO: 1373596 - DNA, 23 bp, Homo sapiens
tcagacaccctcaacctcttctg

SEQ ID NO: 1373597 - DNA, 15 bp, Homo sapiens
tcagacagaacttga

SEQ ID NO: 1373598 - DNA, 23 bp, Homo sapiens
tcagacagaacttgaatgtgtca

SEQ ID NO: 1373599 - DNA, 15 bp, Homo sapiens
tcagacatgttttcc

SEQ ID NO: 1373600 - DNA, 13 bp, Homo sapiens
tcagcagttgctg

SEQ ID NO: 1373601 - DNA, 14 bp, Homo sapiens
tcagcagttgctgg

SEQ ID NO: 1373602 - DNA, 16 bp, Homo sapiens
tcagcagttgctggta

SEQ ID NO: 1373603 - DNA, 20 bp, Homo sapiens
tcagcagttgctggtaaaat

SEQ ID NO: 1373604 - DNA, 23 bp, Homo sapiens
tcagcagttgctggtaaaatgaa

SEQ ID NO: 1373605 - DNA, 13 bp, Homo sapiens
tcagcatgaaaat

SEQ ID NO: 1373606 - DNA, 16 bp, Homo sapiens
tcagccaagttttata

SEQ ID NO: 1373607 - DNA, 12 bp, Homo sapiens
tcagcctgcaca

SEQ ID NO: 1373608 - DNA, 16 bp, Homo sapiens
tcagctcaatgcagtt

SEQ ID NO: 1373609 - DNA, 15 bp, Homo sapiens
tcagctgaacctggg

SEQ ID NO: 1373610 - DNA, 16 bp, Homo sapiens
tcagctgaacctgggt

SEQ ID NO: 1373611 - DNA, 15 bp, Homo sapiens
tcagctgctccctgg

SEQ ID NO: 1373612 - DNA, 19 bp, Homo sapiens
tcagctgctccctggcatt

SEQ ID NO: 1373613 - DNA, 22 bp, Homo sapiens
tcagctttgagaagccttcagc

SEQ ID NO: 1373614 - DNA, 14 bp, Homo sapiens
tcaggaggcgccct

SEQ ID NO: 1373615 - DNA, 21 bp, Homo sapiens
tcaggccggcagccccagcct

SEQ ID NO: 1373616 - DNA, 22 bp, Homo sapiens
tcaggccggcagccccagcctg

SEQ ID NO: 1373617 - DNA, 19 bp, Homo sapiens
tcagggccatgctgaggcc

SEQ ID NO: 1373618 - DNA, 14 bp, Homo sapiens
tcagggctcccagg

SEQ ID NO: 1373619 - DNA, 16 bp, Homo sapiens
tcagggctcccagggg

SEQ ID NO: 1373620 - DNA, 19 bp, Homo sapiens
tcagggctggctcctgatc

SEQ ID NO: 1373621 - DNA, 14 bp, Homo sapiens
tcaggggagaaaaa

SEQ ID NO: 1373622 - DNA, 12 bp, Homo sapiens
tcaggggtgtgc

SEQ ID NO: 1373623 - DNA, 15 bp, Homo sapiens
tcaggtgagaagcag

SEQ ID NO: 1373624 - DNA, 16 bp, Homo sapiens
tcaggtgagaagcaga

SEQ ID NO: 1373625 - DNA, 21 bp, Homo sapiens
tcagtaaacgggaacatgccc

SEQ ID NO: 1373626 - DNA, 22 bp, Homo sapiens
tcagtaaacgggaacatgcccc

SEQ ID NO: 1373627 - DNA, 21 bp, Homo sapiens
tcagtaacccccttaaattta

SEQ ID NO: 1373628 - DNA, 23 bp, Homo sapiens
tcagtaagttatctttgaatatg

SEQ ID NO: 1373629 - DNA, 23 bp, Homo sapiens
tcagtaggtgcccagaataagtt

SEQ ID NO: 1373630 - DNA, 18 bp, Homo sapiens
tcagtcccttccccatgc

SEQ ID NO: 1373631 - DNA, 14 bp, Homo sapiens
tcagtgcatttgtg

SEQ ID NO: 1373632 - DNA, 15 bp, Homo sapiens
tcagtgttggtatat

SEQ ID NO: 1373633 - DNA, 23 bp, Homo sapiens
tcagttgagcttcatataccagc

SEQ ID NO: 1373634 - DNA, 15 bp, Homo sapiens
tcagttgcttgtctt

SEQ ID NO: 1373635 - DNA, 15 bp, Homo sapiens
tcagtttgttggaaa

SEQ ID NO: 1373636 - DNA, 16 bp, Homo sapiens
tcagtttgttggaaag

SEQ ID NO: 1373637 - DNA, 13 bp, Homo sapiens
tcataaattattt

SEQ ID NO: 1373638 - DNA, 19 bp, Homo sapiens
tcataacatccagagcttt

SEQ ID NO: 1373639 - DNA, 20 bp, Homo sapiens
tcatagtatccatattttat

SEQ ID NO: 1373640 - DNA, 15 bp, Homo sapiens
tcatagttactgtgt

SEQ ID NO: 1373641 - DNA, 20 bp, Homo sapiens
tcatagttactgtgtaaact

SEQ ID NO: 1373642 - DNA, 22 bp, Homo sapiens
tcatagttactgtgtaaactca

SEQ ID NO: 1373643 - DNA, 21 bp, Homo sapiens
tcatagttctgagctgccagt

SEQ ID NO: 1373644 - DNA, 15 bp, Homo sapiens
tcatagttttattta

SEQ ID NO: 1373645 - DNA, 17 bp, Homo sapiens
tcatagttttatttata

SEQ ID NO: 1373646 - DNA, 16 bp, Homo sapiens
tcatataccagcaata

SEQ ID NO: 1373647 - DNA, 20 bp, Homo sapiens
tcatatattaaacatccaca

SEQ ID NO: 1373648 - DNA, 18 bp, Homo sapiens
tcatcactacagtattac

SEQ ID NO: 1373649 - DNA, 17 bp, Homo sapiens
tcatcatccagatgtgg

SEQ ID NO: 1373650 - DNA, 20 bp, Homo sapiens
tcatccagactcagagctct

SEQ ID NO: 1373651 - DNA, 16 bp, Homo sapiens
tcatcccattccaggc

SEQ ID NO: 1373652 - DNA, 20 bp, Homo sapiens
tcatcccattccaggcagcc

SEQ ID NO: 1373653 - DNA, 15 bp, Homo sapiens
tcatctgaaatgtta

SEQ ID NO: 1373654 - DNA, 13 bp, Homo sapiens
tcatctgctggtc

SEQ ID NO: 1373655 - DNA, 20 bp, Homo sapiens
tcatctggagttctcaaaga

SEQ ID NO: 1373656 - DNA, 20 bp, Homo sapiens
tcatctgtctatattttatt

SEQ ID NO: 1373657 - DNA, 14 bp, Homo sapiens
tcatgaaaatacca

SEQ ID NO: 1373658 - DNA, 17 bp, Homo sapiens
tcatgaaacttgtttca

SEQ ID NO: 1373659 - DNA, 13 bp, Homo sapiens
tcatgcaaaatat

SEQ ID NO: 1373660 - DNA, 16 bp, Homo sapiens
tcatgcacttaaagaa

SEQ ID NO: 1373661 - DNA, 17 bp, Homo sapiens
tcatgcacttaaagaag

SEQ ID NO: 1373662 - DNA, 17 bp, Homo sapiens
tcatgcatgtcaaacat

SEQ ID NO: 1373663 - DNA, 15 bp, Homo sapiens
tcatgcccaccccct

SEQ ID NO: 1373664 - DNA, 20 bp, Homo sapiens
tcatgcccaccccctgccct

SEQ ID NO: 1373665 - DNA, 15 bp, Homo sapiens
tcatgtaaaacagaa

SEQ ID NO: 1373666 - DNA, 16 bp, Homo sapiens
tcatgtaaattttgta

SEQ ID NO: 1373667 - DNA, 17 bp, Homo sapiens
tcatgtaaattttgtat

SEQ ID NO: 1373668 - DNA, 13 bp, Homo sapiens
tcatgtacttttt

SEQ ID NO: 1373669 - DNA, 15 bp, Homo sapiens
tcatgtactttttag

SEQ ID NO: 1373670 - DNA, 16 bp, Homo sapiens
tcatgtatgtttctct

SEQ ID NO: 1373671 - DNA, 15 bp, Homo sapiens
tcatgtatttgagca

SEQ ID NO: 1373672 - DNA, 20 bp, Homo sapiens
tcatgtgtgcaacagggtat

SEQ ID NO: 1373673 - DNA, 16 bp, Homo sapiens
tcattaaactttttta

SEQ ID NO: 1373674 - DNA, 17 bp, Homo sapiens
tcattaaacttttttaa

SEQ ID NO: 1373675 - DNA, 15 bp, Homo sapiens
tcattaaagacagga

SEQ ID NO: 1373676 - DNA, 18 bp, Homo sapiens
tcattcctttttatttat

SEQ ID NO: 1373677 - DNA, 14 bp, Homo sapiens
tcattgacttttat

SEQ ID NO: 1373678 - DNA, 16 bp, Homo sapiens
tcattgacttttataa

SEQ ID NO: 1373679 - DNA, 20 bp, Homo sapiens
tctgggacctgccaggcagg

SEQ ID NO: 1373680 - DNA, 21 bp, Homo sapiens
tctgggacctgccaggcaggg

SEQ ID NO: 1373681 - DNA, 20 bp, Homo sapiens
tctggggaaagacactgcct

SEQ ID NO: 1373682 - DNA, 19 bp, Homo sapiens
tctggggcaggctgggcca

SEQ ID NO: 1373683 - DNA, 20 bp, Homo sapiens
tctggggcaggctgggccat

SEQ ID NO: 1373684 - DNA, 20 bp, Homo sapiens
tctggggggacccagtgcag

SEQ ID NO: 1373685 - DNA, 15 bp, Homo sapiens
tctgggtccttcctg

SEQ ID NO: 1373686 - DNA, 16 bp, Homo sapiens
tctgggtttgagaaat

SEQ ID NO: 1373687 - DNA, 15 bp, Homo sapiens
tctggtcgctcctgc

SEQ ID NO: 1373688 - DNA, 14 bp, Homo sapiens
tctggtctcgaact

SEQ ID NO: 1373689 - DNA, 16 bp, Homo sapiens
tctggtggtctgttgg

SEQ ID NO: 1373690 - DNA, 12 bp, Homo sapiens
tctggttccagg

SEQ ID NO: 1373691 - DNA, 16 bp, Homo sapiens
tctgtaaatatgtttt

SEQ ID NO: 1373692 - DNA, 14 bp, Homo sapiens
tctgtacttttcat

SEQ ID NO: 1373693 - DNA, 20 bp, Homo sapiens
tctgtagctataatgagcat

SEQ ID NO: 1373694 - DNA, 12 bp, Homo sapiens
tctgtatttgaa

SEQ ID NO: 1373695 - DNA, 15 bp, Homo sapiens
tctgtatttgaaagt

SEQ ID NO: 1373696 - DNA, 17 bp, Homo sapiens
tctgtctggtggccccg

SEQ ID NO: 1373697 - DNA, 19 bp, Homo sapiens
tctgtgagaaggtttattg

SEQ ID NO: 1373698 - DNA, 14 bp, Homo sapiens
tctgtgatgagctg

SEQ ID NO: 1373699 - DNA, 16 bp, Homo sapiens
tctgtgccttcgtctt

SEQ ID NO: 1373700 - DNA, 12 bp, Homo sapiens
tctgtgctgtgt

SEQ ID NO: 1373701 - DNA, 18 bp, Homo sapiens
tctgtggttcctctgctc

SEQ ID NO: 1373702 - DNA, 12 bp, Homo sapiens
tctgtggttggc

SEQ ID NO: 1373703 - DNA, 14 bp, Homo sapiens
tctgtggttggctg

SEQ ID NO: 1373704 - DNA, 18 bp, Homo sapiens
tctgtgtgtcagttttca

SEQ ID NO: 1373705 - DNA, 14 bp, Homo sapiens
tctgtgttgccaag

SEQ ID NO: 1373706 - DNA, 12 bp, Homo sapiens
tctgttgaagtt

SEQ ID NO: 1373707 - DNA, 15 bp, Homo sapiens
tctgttggcaggctg

SEQ ID NO: 1373708 - DNA, 18 bp, Homo sapiens
tctgttggcaggctggcc

SEQ ID NO: 1373709 - DNA, 20 bp, Homo sapiens
tctgttggcaggctggccag

SEQ ID NO: 1373710 - DNA, 14 bp, Homo sapiens
tctgttgtgtgtca

SEQ ID NO: 1373711 - DNA, 18 bp, Homo sapiens
tcttaaagtattcttctc

SEQ ID NO: 1373712 - DNA, 16 bp, Homo sapiens
tcttaaggacaaagtg

SEQ ID NO: 1373713 - DNA, 19 bp, Homo sapiens
tcttaatatgttcttttaa

SEQ ID NO: 1373714 - DNA, 21 bp, Homo sapiens
tcttaatgttcctcaaagctt

SEQ ID NO: 1373715 - DNA, 21 bp, Homo sapiens
tcttacaatattgattgggaa

SEQ ID NO: 1373716 - DNA, 17 bp, Homo sapiens
tcttactaaaaagtata

SEQ ID NO: 1373717 - DNA, 15 bp, Homo sapiens
tcttactttgtaaat

SEQ ID NO: 1373718 - DNA, 13 bp, Homo sapiens
tcttagattctta

SEQ ID NO: 1373719 - DNA, 23 bp, Homo sapiens
tcttaggttggcaaaaaggcagg

SEQ ID NO: 1373720 - DNA, 21 bp, Homo sapiens
tcttataaagtggaagtatgt

SEQ ID NO: 1373721 - DNA, 13 bp, Homo sapiens
tcttatgtgacat

SEQ ID NO: 1373722 - DNA, 19 bp, Homo sapiens
tcttatgtgacattaacaa

SEQ ID NO: 1373723 - DNA, 14 bp, Homo sapiens
tcttcagagaaatc

SEQ ID NO: 1373724 - DNA, 14 bp, Homo sapiens
tcttcagatgccac

SEQ ID NO: 1373725 - DNA, 17 bp, Homo sapiens
tcttcattattctctgc

SEQ ID NO: 1373726 - DNA, 19 bp, Homo sapiens
tcttccctacagttgaaaa

SEQ ID NO: 1373727 - DNA, 22 bp, Homo sapiens
tcttccctacagttgaaaaaca

SEQ ID NO: 1373728 - DNA, 17 bp, Homo sapiens
tcttcctatccctctcc

SEQ ID NO: 1373729 - DNA, 19 bp, Homo sapiens
tcttcctatccctctccta

SEQ ID NO: 1373730 - DNA, 15 bp, Homo sapiens
tcttccttgatgttt

SEQ ID NO: 1373731 - DNA, 12 bp, Homo sapiens
tcttctaaatgg

SEQ ID NO: 1373732 - DNA, 19 bp, Homo sapiens
tcttctagtgatgatggtt

SEQ ID NO: 1373733 - DNA, 18 bp, Homo sapiens
tcttctggggcaggctgg

SEQ ID NO: 1373734 - DNA, 22 bp, Homo sapiens
tcttctgtatttttttttctaa

SEQ ID NO: 1373735 - DNA, 20 bp, Homo sapiens
tcttcttggggcccagtgca

SEQ ID NO: 1373736 - DNA, 16 bp, Homo sapiens
tcttgaatccttccat

SEQ ID NO: 1373737 - DNA, 12 bp, Homo sapiens
tcttgagctggc

SEQ ID NO: 1373738 - DNA, 13 bp, Homo sapiens
tcttgagtttgtc

SEQ ID NO: 1373739 - DNA, 22 bp, Homo sapiens
tcttgagtttgtcgctcatgtg

SEQ ID NO: 1373740 - DNA, 13 bp, Homo sapiens
tcttgatacattc

SEQ ID NO: 1373741 - DNA, 22 bp, Homo sapiens
tcttgcaccaaattatcttgat

SEQ ID NO: 1373742 - DNA, 15 bp, Homo sapiens
tcttgcctccaggtg

SEQ ID NO: 1373743 - DNA, 17 bp, Homo sapiens
tcttgcctccaggtgca

SEQ ID NO: 1373744 - DNA, 19 bp, Homo sapiens
tcttgcctccaggtgcaga

SEQ ID NO: 1373745 - DNA, 12 bp, Homo sapiens
tcttgcctctgt

SEQ ID NO: 1373746 - DNA, 19 bp, Homo sapiens
tcttgcctctgtgctgtgt

SEQ ID NO: 1373747 - DNA, 23 bp, Homo sapiens
tcttgcttccctaatctatggtc

SEQ ID NO: 1373748 - DNA, 13 bp, Homo sapiens
tcttggccagcca

SEQ ID NO: 1373749 - DNA, 16 bp, Homo sapiens
tcttggcttaatcatt

SEQ ID NO: 1373750 - DNA, 18 bp, Homo sapiens
tcttggcttaatcatttt

SEQ ID NO: 1373751 - DNA, 19 bp, Homo sapiens
tcttggcttaatcattttc

SEQ ID NO: 1373752 - DNA, 18 bp, Homo sapiens
tcttggggcccagtgcat

SEQ ID NO: 1373753 - DNA, 20 bp, Homo sapiens
tcttgggggggtggccgctg

SEQ ID NO: 1373754 - DNA, 15 bp, Homo sapiens
tcttgtaaagactgg

SEQ ID NO: 1373755 - DNA, 16 bp, Homo sapiens
tcttgtctgatttctt

SEQ ID NO: 1373756 - DNA, 21 bp, Homo sapiens
tcttgttgctcaaaaaatgag

SEQ ID NO: 1373757 - DNA, 16 bp, Homo sapiens
tctttaaaagaatgac

SEQ ID NO: 1373758 - DNA, 15 bp, Homo sapiens
ggcacttgcctgggt

SEQ ID NO: 1373759 - DNA, 16 bp, Homo sapiens
ggcacttgcctgggtc

SEQ ID NO: 1373760 - DNA, 21 bp, Homo sapiens
ggcagcccagagactttgtag

SEQ ID NO: 1373761 - DNA, 22 bp, Homo sapiens
ggcagcccagagactttgtaga

SEQ ID NO: 1373762 - DNA, 14 bp, Homo sapiens
ggcagccccagcct

SEQ ID NO: 1373763 - DNA, 19 bp, Homo sapiens
ggcagccccagcctgctag

SEQ ID NO: 1373764 - DNA, 18 bp, Homo sapiens
ggcaggaggatcacttga

SEQ ID NO: 1373765 - DNA, 15 bp, Homo sapiens
ggcaggcatggccct

SEQ ID NO: 1373766 - DNA, 20 bp, Homo sapiens
ggcaggcatggccctgggcg

SEQ ID NO: 1373767 - DNA, 22 bp, Homo sapiens
ggcaggctcactgccaggccag

SEQ ID NO: 1373768 - DNA, 12 bp, Homo sapiens
ggcaggctggcc

SEQ ID NO: 1373769 - DNA, 12 bp, Homo sapiens
ggcaggctgggc

SEQ ID NO: 1373770 - DNA, 15 bp, Homo sapiens
ggcaggctgggccat

SEQ ID NO: 1373771 - DNA, 16 bp, Homo sapiens
ggcaggctgggccatg

SEQ ID NO: 1373772 - DNA, 16 bp, Homo sapiens
ggcaggggcctggaga

SEQ ID NO: 1373773 - DNA, 16 bp, Homo sapiens
ggcaggggctggaggg

SEQ ID NO: 1373774 - DNA, 14 bp, Homo sapiens
ggcaggggtggggg

SEQ ID NO: 1373775 - DNA, 15 bp, Homo sapiens
ggcaggttggtgggg

SEQ ID NO: 1373776 - DNA, 21 bp, Homo sapiens
ggcagtagaactccaggccct

SEQ ID NO: 1373777 - DNA, 12 bp, Homo sapiens
ggcataaagtaa

SEQ ID NO: 1373778 - DNA, 16 bp, Homo sapiens
ggcatagaggcttctc

SEQ ID NO: 1373779 - DNA, 22 bp, Homo sapiens
ggcatagaggcttctccgccag

SEQ ID NO: 1373780 - DNA, 13 bp, Homo sapiens
ggcatcatgcatg

SEQ ID NO: 1373781 - DNA, 11 bp, Homo sapiens
ggcatgtaaat

SEQ ID NO: 1373782 - DNA, 21 bp, Homo sapiens
ggcatgtaaatgtaaactcag

SEQ ID NO: 1373783 - DNA, 23 bp, Homo sapiens
ggccaaagtgccggtgagaccca

SEQ ID NO: 1373784 - DNA, 17 bp, Homo sapiens
ggccaagaatattgcaa

SEQ ID NO: 1373785 - DNA, 21 bp, Homo sapiens
ggccaagaatgtacgtccagc

SEQ ID NO: 1373786 - DNA, 13 bp, Homo sapiens
ggccaaggtggga

SEQ ID NO: 1373787 - DNA, 17 bp, Homo sapiens
ggccacagcgccagcct

SEQ ID NO: 1373788 - DNA, 23 bp, Homo sapiens
ggccacgtgggcaaacaggcagt

SEQ ID NO: 1373789 - DNA, 13 bp, Homo sapiens
ggccactccgaga

SEQ ID NO: 1373790 - DNA, 21 bp, Homo sapiens
ggccagagagcctggtgctgc

SEQ ID NO: 1373791 - DNA, 23 bp, Homo sapiens
ggccagagagcctggtgctgctg

SEQ ID NO: 1373792 - DNA, 19 bp, Homo sapiens
ggccagaggcccccagccc

SEQ ID NO: 1373793 - DNA, 21 bp, Homo sapiens
ggccagaggcccccagcccag

SEQ ID NO: 1373794 - DNA, 20 bp, Homo sapiens
ggccagcctccgagagggag

SEQ ID NO: 1373795 - DNA, 22 bp, Homo sapiens
ggccagcctccgagagggagag

SEQ ID NO: 1373796 - DNA, 13 bp, Homo sapiens
ggccagcgtggct

SEQ ID NO: 1373797 - DNA, 20 bp, Homo sapiens
ggccagtccaccctgcctgc

SEQ ID NO: 1373798 - DNA, 14 bp, Homo sapiens
ggccagtccaggct

SEQ ID NO: 1373799 - DNA, 13 bp, Homo sapiens
ggccatgctgagg

SEQ ID NO: 1373800 - DNA, 16 bp, Homo sapiens
ggccatgtccaaagag

SEQ ID NO: 1373801 - DNA, 22 bp, Homo sapiens
ggccatgtccaaagaggctgcc

SEQ ID NO: 1373802 - DNA, 23 bp, Homo sapiens
ggccatgtccaaagaggctgccc

SEQ ID NO: 1373803 - DNA, 14 bp, Homo sapiens
ggccatttgcaata

SEQ ID NO: 1373804 - DNA, 21 bp, Homo sapiens
ggccatttgcaataacagctg

SEQ ID NO: 1373805 - DNA, 20 bp, Homo sapiens
ggcccacccggtgggacccc

SEQ ID NO: 1373806 - DNA, 15 bp, Homo sapiens
ggcccagtgcatggt

SEQ ID NO: 1373807 - DNA, 18 bp, Homo sapiens
ggcccatagcagccagtt

SEQ ID NO: 1373808 - DNA, 20 bp, Homo sapiens
ggccccagcacctcagcctg

SEQ ID NO: 1373809 - DNA, 21 bp, Homo sapiens
ggccccagccctgctggggat

SEQ ID NO: 1373810 - DNA, 22 bp, Homo sapiens
ggccccagccctgctggggatc

SEQ ID NO: 1373811 - DNA, 15 bp, Homo sapiens
ggcccccacttgcct

SEQ ID NO: 1373812 - DNA, 14 bp, Homo sapiens
ggcccccagcccag

SEQ ID NO: 1373813 - DNA, 17 bp, Homo sapiens
ggcccccagcccagggc

SEQ ID NO: 1373814 - DNA, 13 bp, Homo sapiens
ggcccctggcact

SEQ ID NO: 1373815 - DNA, 21 bp, Homo sapiens
ggcccctgggcttggcctgct

SEQ ID NO: 1373816 - DNA, 23 bp, Homo sapiens
ggcccctgggcttggcctgctgt

SEQ ID NO: 1373817 - DNA, 17 bp, Homo sapiens
ggcccgcgccacaggac

SEQ ID NO: 1373818 - DNA, 19 bp, Homo sapiens
ggccctgagtctgggcagc

SEQ ID NO: 1373819 - DNA, 17 bp, Homo sapiens
ggccctggcctcccctg

SEQ ID NO: 1373820 - DNA, 13 bp, Homo sapiens
ggccctgggctgg

SEQ ID NO: 1373821 - DNA, 15 bp, Homo sapiens
ggccctgggctggaa

SEQ ID NO: 1373822 - DNA, 12 bp, Homo sapiens
ggccgaggcggg

SEQ ID NO: 1373823 - DNA, 14 bp, Homo sapiens
ggccgaggcgggtg

SEQ ID NO: 1373824 - DNA, 14 bp, Homo sapiens
ggccgccgcctctt

SEQ ID NO: 1373825 - DNA, 16 bp, Homo sapiens
ggccgcgccctttccc

SEQ ID NO: 1373826 - DNA, 12 bp, Homo sapiens
ggccggccctgt

SEQ ID NO: 1373827 - DNA, 16 bp, Homo sapiens
ggccgtatctccggct

SEQ ID NO: 1373828 - DNA, 21 bp, Homo sapiens
ggccgtatctccggctcccag

SEQ ID NO: 1373829 - DNA, 20 bp, Homo sapiens
ggcctacagctttgatccct

SEQ ID NO: 1373830 - DNA, 19 bp, Homo sapiens
ggcctagcgatctctcctg

SEQ ID NO: 1373831 - DNA, 23 bp, Homo sapiens
ggcctagcgatctctcctggcct

SEQ ID NO: 1373832 - DNA, 14 bp, Homo sapiens
ggcctatttcatca

SEQ ID NO: 1373833 - DNA, 17 bp, Homo sapiens
ggcctcatgtggctgga

SEQ ID NO: 1373834 - DNA, 19 bp, Homo sapiens
ggcctcatgtggctggaag

SEQ ID NO: 1373835 - DNA, 17 bp, Homo sapiens
ggcctcccctgccacca

SEQ ID NO: 1373836 - DNA, 22 bp, Homo sapiens
ggcctcccctgccaccaggcca

SEQ ID NO: 1373837 - DNA, 15 bp, Homo sapiens
ggcctctccatttgc

SEQ ID NO: 1373838 - DNA, 20 bp, Homo sapiens
ggcctctccatttgctcttc

SEQ ID NO: 1373839 - DNA, 16 bp, Homo sapiens
ggcctgcgaccctggg

SEQ ID NO: 1373840 - DNA, 13 bp, Homo sapiens
ggccttaatttcc

SEQ ID NO: 1373841 - DNA, 15 bp, Homo sapiens
ggccttaatttcctt

SEQ ID NO: 1373842 - DNA, 17 bp, Homo sapiens
ggccttaatttcctttt

SEQ ID NO: 1373843 - DNA, 19 bp, Homo sapiens
ggccttgtcctcagccagt

SEQ ID NO: 1373844 - DNA, 17 bp, Homo sapiens
ggccttttctggcaccg

SEQ ID NO: 1373845 - DNA, 20 bp, Homo sapiens
ggcgacagagcgagactccg

SEQ ID NO: 1373846 - DNA, 21 bp, Homo sapiens
ggcgaccaccgcccctggccg

SEQ ID NO: 1373847 - DNA, 15 bp, Homo sapiens
ggcgcaggtgggctg

SEQ ID NO: 1373848 - DNA, 16 bp, Homo sapiens
ggcgcaggtgggctgg

SEQ ID NO: 1373849 - DNA, 17 bp, Homo sapiens
ggcggcaggggcctgga

SEQ ID NO: 1373850 - DNA, 14 bp, Homo sapiens
ggcgtacaggctgg

SEQ ID NO: 1373851 - DNA, 17 bp, Homo sapiens
ggcgtggagggaggccc

SEQ ID NO: 1373852 - DNA, 16 bp, Homo sapiens
ggcgtggcccaaggct

SEQ ID NO: 1373853 - DNA, 18 bp, Homo sapiens
ggcgtgggagccagcctc

SEQ ID NO: 1373854 - DNA, 22 bp, Homo sapiens
ggctagggagacgccatgtgat

SEQ ID NO: 1373855 - DNA, 17 bp, Homo sapiens
ggctatgtataaaatac

SEQ ID NO: 1373856 - DNA, 18 bp, Homo sapiens
ggctcacacacctgtagc

SEQ ID NO: 1373857 - DNA, 13 bp, Homo sapiens
ggctcactgccag

SEQ ID NO: 1373858 - DNA, 14 bp, Homo sapiens
ggctcactgccagg

SEQ ID NO: 1373859 - DNA, 19 bp, Homo sapiens
ggctcactgccaggccagc

SEQ ID NO: 1373860 - DNA, 22 bp, Homo sapiens
ggctcactgccaggccagcctc

SEQ ID NO: 1373861 - DNA, 21 bp, Homo sapiens
ggctcagctcggggagcctta

SEQ ID NO: 1373862 - DNA, 13 bp, Homo sapiens
ggctcccagcctc

SEQ ID NO: 1373863 - DNA, 23 bp, Homo sapiens
ggctcccaggggtctccctggct

SEQ ID NO: 1373864 - DNA, 15 bp, Homo sapiens
ggctccggcctctgc

SEQ ID NO: 1373865 - DNA, 13 bp, Homo sapiens
ggctcgaatctct

SEQ ID NO: 1373866 - DNA, 18 bp, Homo sapiens
ggctcgaatctctgtgcc

SEQ ID NO: 1373867 - DNA, 20 bp, Homo sapiens
ggctcgaatctctgtgcctt

SEQ ID NO: 1373868 - DNA, 19 bp, Homo sapiens
ggctcgtggactgagtggg

SEQ ID NO: 1373869 - DNA, 14 bp, Homo sapiens
ggctctgagcgcct

SEQ ID NO: 1373870 - DNA, 13 bp, Homo sapiens
ggctgaaaacaat

SEQ ID NO: 1373871 - DNA, 16 bp, Homo sapiens
ggctgaaattctcctg

SEQ ID NO: 1373872 - DNA, 17 bp, Homo sapiens
ggctgaaattctcctgg

SEQ ID NO: 1373873 - DNA, 19 bp, Homo sapiens
ggctgaaattctcctggag

SEQ ID NO: 1373874 - DNA, 15 bp, Homo sapiens
ggctgaggtgggagg

SEQ ID NO: 1373875 - DNA, 16 bp, Homo sapiens
ggctgaggttcctctg

SEQ ID NO: 1373876 - DNA, 19 bp, Homo sapiens
ggctgaggttcctctgcct

SEQ ID NO: 1373877 - DNA, 23 bp, Homo sapiens
ggctgaggttcctctgcctgccc

SEQ ID NO: 1373878 - DNA, 24 bp, Homo sapiens
ggctgatgtcaatttctgtgttgc

SEQ ID NO: 1373879 - DNA, 18 bp, Homo sapiens
ggctgcagaggccagagg

SEQ ID NO: 1373880 - DNA, 19 bp, Homo sapiens
ggctgcagaggccagaggc

SEQ ID NO: 1373881 - DNA, 17 bp, Homo sapiens
ggctgcagttctactca

SEQ ID NO: 1373882 - DNA, 19 bp, Homo sapiens
ggctgcggcgtacaggctg

SEQ ID NO: 1373883 - DNA, 18 bp, Homo sapiens
ggctgctgcccccacccc

SEQ ID NO: 1373884 - DNA, 15 bp, Homo sapiens
ggctgcttcctcctg

SEQ ID NO: 1373885 - DNA, 17 bp, Homo sapiens
ggctgcttcctcctgga

SEQ ID NO: 1373886 - DNA, 18 bp, Homo sapiens
ggctgcttcctcctggaa

SEQ ID NO: 1373887 - DNA, 19 bp, Homo sapiens
ggctgcttcctcctggaaa

SEQ ID NO: 1373888 - DNA, 22 bp, Homo sapiens
ggctggccagtccaggctgccg

SEQ ID NO: 1373889 - DNA, 11 bp, Homo sapiens
ggctgggaaat

SEQ ID NO: 1373890 - DNA, 17 bp, Homo sapiens
ggctgggccatgtccaa

SEQ ID NO: 1373891 - DNA, 20 bp, Homo sapiens
ggctgggccatgtccaaaga

SEQ ID NO: 1373892 - DNA, 19 bp, Homo sapiens
ggctgggtggcaccagcag

SEQ ID NO: 1373893 - DNA, 20 bp, Homo sapiens
ggctggtacaacggaggcct

SEQ ID NO: 1373894 - DNA, 22 bp, Homo sapiens
ggctggtggagaactctggctt

SEQ ID NO: 1373895 - DNA, 23 bp, Homo sapiens
ggctgtcaatgggacctgtggct

SEQ ID NO: 1373896 - DNA, 18 bp, Homo sapiens
ggctgtcagtatgacatt

SEQ ID NO: 1373897 - DNA, 15 bp, Homo sapiens
ggctgtggtcacagc

SEQ ID NO: 1373898 - DNA, 14 bp, Homo sapiens
ggctgtgttggtgt

SEQ ID NO: 1373899 - DNA, 14 bp, Homo sapiens
ggcttaatcatttt

SEQ ID NO: 1373900 - DNA, 22 bp, Homo sapiens
ggcttagtttgtgtgttgtctc

SEQ ID NO: 1373901 - DNA, 16 bp, Homo sapiens
ggcttctgtgcccaga

SEQ ID NO: 1373902 - DNA, 13 bp, Homo sapiens
ggcttgaagccaa

SEQ ID NO: 1373903 - DNA, 13 bp, Homo sapiens
ggcttggcctgct

SEQ ID NO: 1373904 - DNA, 14 bp, Homo sapiens
ggcttggcctgctg

SEQ ID NO: 1373905 - DNA, 16 bp, Homo sapiens
ggcttgtagttcttta

SEQ ID NO: 1373906 - DNA, 22 bp, Homo sapiens
ggcttgtctatactccttccct

SEQ ID NO: 1373907 - DNA, 14 bp, Homo sapiens
ggctttctggggcc

SEQ ID NO: 1373908 - DNA, 15 bp, Homo sapiens
ggctttctgttgcca

SEQ ID NO: 1373909 - DNA, 17 bp, Homo sapiens
ggctttgccattgtgaa

SEQ ID NO: 1373910 - DNA, 13 bp, Homo sapiens
gggaaaatcagcc

SEQ ID NO: 1373911 - DNA, 23 bp, Homo sapiens
gggaaaatcagcctgctccagct

SEQ ID NO: 1373912 - DNA, 18 bp, Homo sapiens
gggaaagacactgcctgg

SEQ ID NO: 1373913 - DNA, 14 bp, Homo sapiens
gggaacatgccccc

SEQ ID NO: 1373914 - DNA, 19 bp, Homo sapiens
gggaacctccccagcctgc

SEQ ID NO: 1373915 - DNA, 16 bp, Homo sapiens
gggaagagatccaaag

SEQ ID NO: 1373916 - DNA, 17 bp, Homo sapiens
gggaagagatccaaaga

SEQ ID NO: 1373917 - DNA, 13 bp, Homo sapiens
gggacaagggatt

SEQ ID NO: 1373918 - DNA, 22 bp, Homo sapiens
gggacagagtagccaggttctg

SEQ ID NO: 1373919 - DNA, 19 bp, Homo sapiens
gggaccaccctgagccggc

SEQ ID NO: 1373920 - DNA, 15 bp, Homo sapiens
gggacccagtgcaga

SEQ ID NO: 1373921 - DNA, 23 bp, Homo sapiens
gggacccccgtggggcagggagc

SEQ ID NO: 1373922 - DNA, 18 bp, Homo sapiens
gggacctgccaggcaggg

SEQ ID NO: 1373923 - DNA, 19 bp, Homo sapiens
gggacctgccaggcagggg

SEQ ID NO: 1373924 - DNA, 20 bp, Homo sapiens
gggactacccatagacatga

SEQ ID NO: 1373925 - DNA, 22 bp, Homo sapiens
gggactcagccttcagacagag

SEQ ID NO: 1373926 - DNA, 20 bp, Homo sapiens
gggagacggtttccagggag

SEQ ID NO: 1373927 - DNA, 22 bp, Homo sapiens
gggagccaaaatctcaagaaat

SEQ ID NO: 1373928 - DNA, 18 bp, Homo sapiens
gggagccttagccgccca

SEQ ID NO: 1373929 - DNA, 13 bp, Homo sapiens
gggagcggaggtt

SEQ ID NO: 1373930 - DNA, 19 bp, Homo sapiens
gggagctgggcccgacatg

SEQ ID NO: 1373931 - DNA, 23 bp, Homo sapiens
gggaggatctcttgagcctggga

SEQ ID NO: 1373932 - DNA, 20 bp, Homo sapiens
gggaggcggagcttgcagtg

SEQ ID NO: 1373933 - DNA, 19 bp, Homo sapiens
gggaggctgaggcaggaga

SEQ ID NO: 1373934 - DNA, 13 bp, Homo sapiens
gggaggcttcccc

SEQ ID NO: 1373935 - DNA, 15 bp, Homo sapiens
gggagggggatccga

SEQ ID NO: 1373936 - DNA, 18 bp, Homo sapiens
gggaggtcaaggctgcag

SEQ ID NO: 1373937 - DNA, 15 bp, Homo sapiens
gggaggtcactggaa

SEQ ID NO: 1373938 - DNA, 19 bp, Homo sapiens
gggatccccgcctggccag

SEQ ID NO: 1373939 - DNA, 22 bp, Homo sapiens
gggatccccgcctggccaggag

SEQ ID NO: 1373940 - DNA, 19 bp, Homo sapiens
gggattctggttccagggt

SEQ ID NO: 1373941 - DNA, 18 bp, Homo sapiens
gggcacaggaggcaggca

SEQ ID NO: 1373942 - DNA, 15 bp, Homo sapiens
gggcagctgtccctt

SEQ ID NO: 1373943 - DNA, 15 bp, Homo sapiens
gggcaggctgggcca

SEQ ID NO: 1373944 - DNA, 17 bp, Homo sapiens
gggccatgctgaggcct

SEQ ID NO: 1373945 - DNA, 16 bp, Homo sapiens
gggccatgtccaaaga

SEQ ID NO: 1373946 - DNA, 17 bp, Homo sapiens
gggccatgtccaaagag

SEQ ID NO: 1373947 - DNA, 21 bp, Homo sapiens
gggccatgtccaaagaggctg

SEQ ID NO: 1373948 - DNA, 14 bp, Homo sapiens
gggccatttgcaat

SEQ ID NO: 1373949 - DNA, 11 bp, Homo sapiens
gggccccagct

SEQ ID NO: 1373950 - DNA, 14 bp, Homo sapiens
gggcccctgggctt

SEQ ID NO: 1373951 - DNA, 14 bp, Homo sapiens
gggccctgagtctg

SEQ ID NO: 1373952 - DNA, 15 bp, Homo sapiens
gggccctgggctgga

SEQ ID NO: 1373953 - DNA, 13 bp, Homo sapiens
gggccgaccagag

SEQ ID NO: 1373954 - DNA, 17 bp, Homo sapiens
gggccgccgcctctttc

SEQ ID NO: 1373955 - DNA, 16 bp, Homo sapiens
gggccgtatctccggc

SEQ ID NO: 1373956 - DNA, 20 bp, Homo sapiens
gggccgtatctccggctccc

SEQ ID NO: 1373957 - DNA, 20 bp, Homo sapiens
gggcctagcgatctctcctg

SEQ ID NO: 1373958 - DNA, 18 bp, Homo sapiens
gggcctggtcgttttcaa

SEQ ID NO: 1373959 - DNA, 10 bp, Homo sapiens
gggctcagca

SEQ ID NO: 1373960 - DNA, 18 bp, Homo sapiens
gggctcagcaaaagatgc

SEQ ID NO: 1373961 - DNA, 18 bp, Homo sapiens
gggctcctgcacttactt

SEQ ID NO: 1373962 - DNA, 16 bp, Homo sapiens
gggctctgtgcagtca

SEQ ID NO: 1373963 - DNA, 18 bp, Homo sapiens
gggctgcttcctcctgga

SEQ ID NO: 1373964 - DNA, 20 bp, Homo sapiens
gggctgcttcctcctggaaa

SEQ ID NO: 1373965 - DNA, 14 bp, Homo sapiens
gggcttatatctgg

SEQ ID NO: 1373966 - DNA, 17 bp, Homo sapiens
gggcttgaagccaaaga

SEQ ID NO: 1373967 - DNA, 17 bp, Homo sapiens
gggcttgtagttcttta

SEQ ID NO: 1373968 - DNA, 12 bp, Homo sapiens
ggggaatctaag

SEQ ID NO: 1373969 - DNA, 13 bp, Homo sapiens
ggggacccagtgc

SEQ ID NO: 1373970 - DNA, 21 bp, Homo sapiens
ggggacccagtgcagaatgta

SEQ ID NO: 1373971 - DNA, 11 bp, Homo sapiens
ggggaccctgt

SEQ ID NO: 1373972 - DNA, 16 bp, Homo sapiens
ggggagagcctgctgg

SEQ ID NO: 1373973 - DNA, 18 bp, Homo sapiens
ggggagagcctgctggca

SEQ ID NO: 1373974 - DNA, 15 bp, Homo sapiens
ggggagggattctgg

SEQ ID NO: 1373975 - DNA, 15 bp, Homo sapiens
ggggagggggatccg

SEQ ID NO: 1373976 - DNA, 22 bp, Homo sapiens
ggggatccccgcctggccagga

SEQ ID NO: 1373977 - DNA, 14 bp, Homo sapiens
ggggcaggctgggc

SEQ ID NO: 1373978 - DNA, 16 bp, Homo sapiens
ggggcaggctgggcca

SEQ ID NO: 1373979 - DNA, 19 bp, Homo sapiens
ggggcagggagctgggccc

SEQ ID NO: 1373980 - DNA, 17 bp, Homo sapiens
ggggcatgaccagatgc

SEQ ID NO: 1373981 - DNA, 14 bp, Homo sapiens
ggggccaccaaagc

SEQ ID NO: 1373982 - DNA, 19 bp, Homo sapiens
ggggcccagggcaagctcc

SEQ ID NO: 1373983 - DNA, 12 bp, Homo sapiens
ggggcccagtgc

SEQ ID NO: 1373984 - DNA, 21 bp, Homo sapiens
ggggccgggcgcggtggctca

SEQ ID NO: 1373985 - DNA, 19 bp, Homo sapiens
ggggcctggagatcctcct

SEQ ID NO: 1373986 - DNA, 19 bp, Homo sapiens
ggggcgtggagggaggccc

SEQ ID NO: 1373987 - DNA, 16 bp, Homo sapiens
ggggctgcttcctcct

SEQ ID NO: 1373988 - DNA, 17 bp, Homo sapiens
ggggctggcactgactg

SEQ ID NO: 1373989 - DNA, 22 bp, Homo sapiens
ggggcttagggtcggaacccaa

SEQ ID NO: 1373990 - DNA, 15 bp, Homo sapiens
gtacataatactgaa

SEQ ID NO: 1373991 - DNA, 21 bp, Homo sapiens
gtacatttctataaatagatg

SEQ ID NO: 1373992 - DNA, 17 bp, Homo sapiens
gtacccggggcccaggg

SEQ ID NO: 1373993 - DNA, 19 bp, Homo sapiens
gtacgacgtcagatgttta

SEQ ID NO: 1373994 - DNA, 21 bp, Homo sapiens
gtactctcatcactacagtat

SEQ ID NO: 1373995 - DNA, 22 bp, Homo sapiens
gtactgttcggaaggggttcct

SEQ ID NO: 1373996 - DNA, 15 bp, Homo sapiens
gtacttggcctttgg

SEQ ID NO: 1373997 - DNA, 21 bp, Homo sapiens
gtactttctgttatgggcttt

SEQ ID NO: 1373998 - DNA, 17 bp, Homo sapiens
gtacttttaaaaacata

SEQ ID NO: 1373999 - DNA, 23 bp, Homo sapiens
gtacttttattttacacagaaac

SEQ ID NO: 1374000 - DNA, 21 bp, Homo sapiens
gtacttttcattctcttttaa

SEQ ID NO: 1374001 - DNA, 20 bp, Homo sapiens
gtacttttttaaatattttc

SEQ ID NO: 1374002 - DNA, 17 bp, Homo sapiens
gtagaaaatgtgaccct

SEQ ID NO: 1374003 - DNA, 14 bp, Homo sapiens
gtagaaatgatgat

SEQ ID NO: 1374004 - DNA, 16 bp, Homo sapiens
gtagaactgtctgtga

SEQ ID NO: 1374005 - DNA, 20 bp, Homo sapiens
gtagagtgtagactgtggct

SEQ ID NO: 1374006 - DNA, 15 bp, Homo sapiens
gtagagtgtgcctga

SEQ ID NO: 1374007 - DNA, 17 bp, Homo sapiens
gtagatatgtattcttt

SEQ ID NO: 1374008 - DNA, 12 bp, Homo sapiens
gtagatttgatt

SEQ ID NO: 1374009 - DNA, 14 bp, Homo sapiens
gtagattttccaaa

SEQ ID NO: 1374010 - DNA, 14 bp, Homo sapiens
gtagccctcccact

SEQ ID NO: 1374011 - DNA, 14 bp, Homo sapiens
gtaggagctgcctt

SEQ ID NO: 1374012 - DNA, 17 bp, Homo sapiens
gtaggagggtgggaagg

SEQ ID NO: 1374013 - DNA, 13 bp, Homo sapiens
gtaggtaagactg

SEQ ID NO: 1374014 - DNA, 17 bp, Homo sapiens
gtaggttcagccaaggt

SEQ ID NO: 1374015 - DNA, 15 bp, Homo sapiens
gtagttctgtatttg

SEQ ID NO: 1374016 - DNA, 13 bp, Homo sapiens
gtataataaaatt

SEQ ID NO: 1374017 - DNA, 14 bp, Homo sapiens
gtataataaaatta

SEQ ID NO: 1374018 - DNA, 12 bp, Homo sapiens
gtataataggct

SEQ ID NO: 1374019 - DNA, 20 bp, Homo sapiens
gtatagcatgaaataaaata

SEQ ID NO: 1374020 - DNA, 21 bp, Homo sapiens
gtatagcctatggcagaaaaa

SEQ ID NO: 1374021 - DNA, 23 bp, Homo sapiens
gtatagcctatggcagaaaaaat

SEQ ID NO: 1374022 - DNA, 13 bp, Homo sapiens
gtatatattttgt

SEQ ID NO: 1374023 - DNA, 19 bp, Homo sapiens
gtatattaaaaaagagaca

SEQ ID NO: 1374024 - DNA, 18 bp, Homo sapiens
gtatatttgatttattaa

SEQ ID NO: 1374025 - DNA, 22 bp, Homo sapiens
gtatctagagcttaatgctaca

SEQ ID NO: 1374026 - DNA, 13 bp, Homo sapiens
gtatgaaaacatg

SEQ ID NO: 1374027 - DNA, 20 bp, Homo sapiens
gtatgaaaacatggaacagt

SEQ ID NO: 1374028 - DNA, 21 bp, Homo sapiens
gtatggctttatttttttgaa

SEQ ID NO: 1374029 - DNA, 15 bp, Homo sapiens
gtatgtgggatattg

SEQ ID NO: 1374030 - DNA, 20 bp, Homo sapiens
gtatgtgggatattgaatgt

SEQ ID NO: 1374031 - DNA, 16 bp, Homo sapiens
gtatgtggttttgtaa

SEQ ID NO: 1374032 - DNA, 13 bp, Homo sapiens
gtatgtgtttaga

SEQ ID NO: 1374033 - DNA, 22 bp, Homo sapiens
gtatgtgtttagaattgaaggt

SEQ ID NO: 1374034 - DNA, 18 bp, Homo sapiens
gtatgttaaagagaatga

SEQ ID NO: 1374035 - DNA, 16 bp, Homo sapiens
gtattatcaaagggat

SEQ ID NO: 1374036 - DNA, 22 bp, Homo sapiens
gtattatcaaagggataaagaa

SEQ ID NO: 1374037 - DNA, 16 bp, Homo sapiens
gtattatttacattta

SEQ ID NO: 1374038 - DNA, 16 bp, Homo sapiens
gtattcttctcttcct

SEQ ID NO: 1374039 - DNA, 22 bp, Homo sapiens
gtattcttctcttccttttatc

SEQ ID NO: 1374040 - DNA, 21 bp, Homo sapiens
gtattgtcctattagtgttat

SEQ ID NO: 1374041 - DNA, 18 bp, Homo sapiens
gtattgtttaaaatgtaa

SEQ ID NO: 1374042 - DNA, 17 bp, Homo sapiens
gtatttaaaaatagaaa

SEQ ID NO: 1374043 - DNA, 19 bp, Homo sapiens
gtatttaaaaatagaaaca

SEQ ID NO: 1374044 - DNA, 20 bp, Homo sapiens
gtatttaacagaaattgtat

SEQ ID NO: 1374045 - DNA, 12 bp, Homo sapiens
gtatttataata

SEQ ID NO: 1374046 - DNA, 19 bp, Homo sapiens
gtattttcatgaaaatacc

SEQ ID NO: 1374047 - DNA, 19 bp, Homo sapiens
gtattttgtttttgtctta

SEQ ID NO: 1374048 - DNA, 16 bp, Homo sapiens
gtcaaaagtagaactt

SEQ ID NO: 1374049 - DNA, 20 bp, Homo sapiens
gtcaaactgtagaaatgatg

SEQ ID NO: 1374050 - DNA, 15 bp, Homo sapiens
gtcaaagttgaaaat

SEQ ID NO: 1374051 - DNA, 17 bp, Homo sapiens
gtcaaatgatgtgcaaa

SEQ ID NO: 1374052 - DNA, 16 bp, Homo sapiens
gtcaaggcctgctccc

SEQ ID NO: 1374053 - DNA, 22 bp, Homo sapiens
gtcaagggctgtcattgcacat

SEQ ID NO: 1374054 - DNA, 15 bp, Homo sapiens
gtcaagtgaaaaagg

SEQ ID NO: 1374055 - DNA, 18 bp, Homo sapiens
gtcaagttgtcaggttat

SEQ ID NO: 1374056 - DNA, 13 bp, Homo sapiens
gtcaatggcttgt

SEQ ID NO: 1374057 - DNA, 19 bp, Homo sapiens
gtcaatgggacctgtggct

SEQ ID NO: 1374058 - DNA, 19 bp, Homo sapiens
gtcacacattacaaagtta

SEQ ID NO: 1374059 - DNA, 13 bp, Homo sapiens
gtcaccaccaccc

SEQ ID NO: 1374060 - DNA, 15 bp, Homo sapiens
gtcaccaccacccct

SEQ ID NO: 1374061 - DNA, 13 bp, Homo sapiens
gtcaccagagact

SEQ ID NO: 1374062 - DNA, 21 bp, Homo sapiens
gtcacccaaaccggcaggtgc

SEQ ID NO: 1374063 - DNA, 14 bp, Homo sapiens
gtcactcattgctg

SEQ ID NO: 1374064 - DNA, 18 bp, Homo sapiens
gtcactcattgctgagcc

SEQ ID NO: 1374065 - DNA, 22 bp, Homo sapiens
gtcactcattgctgagcctctg

SEQ ID NO: 1374066 - DNA, 23 bp, Homo sapiens
gtcactcattgctgagcctctgc

SEQ ID NO: 1374067 - DNA, 24 bp, Homo sapiens
gtcactcattgctgagcctctgct

SEQ ID NO: 1374068 - DNA, 23 bp, Homo sapiens
gtcactggaaaggggagagcctg

SEQ ID NO: 1374069 - DNA, 14 bp, Homo sapiens
gtcactgtttcctg

SEQ ID NO: 1374070 - DNA, 14 bp, Homo sapiens
gtcagcagttgctg

SEQ ID NO: 1374071 - DNA, 11 bp, Homo sapiens
gtcagttttca

SEQ ID NO: 1374072 - DNA, 22 bp, Homo sapiens
gtcatatcaaataaagagagaa

SEQ ID NO: 1374073 - DNA, 18 bp, Homo sapiens
gtcatccagactcagagc

SEQ ID NO: 1374074 - DNA, 12 bp, Homo sapiens
gtcattaaactg

SEQ ID NO: 1374075 - DNA, 13 bp, Homo sapiens
gtcattaaactgg

SEQ ID NO: 1374076 - DNA, 20 bp, Homo sapiens
gtcattcagagtcagccagg

SEQ ID NO: 1374077 - DNA, 19 bp, Homo sapiens
gtccaaagaggctgcccct

SEQ ID NO: 1374078 - DNA, 19 bp, Homo sapiens
gtccacgcgtgccgtggca

SEQ ID NO: 1374079 - DNA, 16 bp, Homo sapiens
gtccagctctggaggg

SEQ ID NO: 1374080 - DNA, 19 bp, Homo sapiens
gtccagctgcccttccgca

SEQ ID NO: 1374081 - DNA, 13 bp, Homo sapiens
gtccagctggcct

SEQ ID NO: 1374082 - DNA, 19 bp, Homo sapiens
gtccagctggcctggacag

SEQ ID NO: 1374083 - DNA, 14 bp, Homo sapiens
gtccagtaagatca

SEQ ID NO: 1374084 - DNA, 19 bp, Homo sapiens
gtccagtaagatcactgtt

SEQ ID NO: 1374085 - DNA, 20 bp, Homo sapiens
gtccagtaagatcactgttt

SEQ ID NO: 1374086 - DNA, 15 bp, Homo sapiens
gtccagtgtttcttt

SEQ ID NO: 1374087 - DNA, 12 bp, Homo sapiens
gtcccagtgccg

SEQ ID NO: 1374088 - DNA, 17 bp, Homo sapiens
gtcccatagtccctgcc

SEQ ID NO: 1374089 - DNA, 18 bp, Homo sapiens
gtcccatagtccctgcca

SEQ ID NO: 1374090 - DNA, 14 bp, Homo sapiens
gtccccgctgctgt

SEQ ID NO: 1374091 - DNA, 15 bp, Homo sapiens
gtccctatgcatatc

SEQ ID NO: 1374092 - DNA, 11 bp, Homo sapiens
gtccctctgtg

SEQ ID NO: 1374093 - DNA, 20 bp, Homo sapiens
gtcccttccccatgcttcct

SEQ ID NO: 1374094 - DNA, 21 bp, Homo sapiens
gtcctaatggtgatgcagtct

SEQ ID NO: 1374095 - DNA, 23 bp, Homo sapiens
gtcctagaaattccccaccctga

SEQ ID NO: 1374096 - DNA, 20 bp, Homo sapiens
gtcctagaggccctttgctg

SEQ ID NO: 1374097 - DNA, 23 bp, Homo sapiens
gtcctagcttgggaggcttcccc

SEQ ID NO: 1374098 - DNA, 17 bp, Homo sapiens
gtcctattagtgttata

SEQ ID NO: 1374099 - DNA, 20 bp, Homo sapiens
gtcctattagtgttatatga

SEQ ID NO: 1374100 - DNA, 22 bp, Homo sapiens
gtcctattagtgttatatgaac

SEQ ID NO: 1374101 - DNA, 21 bp, Homo sapiens
gtcctcctcacctcatgccca

SEQ ID NO: 1374102 - DNA, 17 bp, Homo sapiens
gtcctgcctgcaatatt

SEQ ID NO: 1374103 - DNA, 21 bp, Homo sapiens
gtcctgctcattatgccactt

SEQ ID NO: 1374104 - DNA, 22 bp, Homo sapiens
gtcctggcgcctggcagtccgt

SEQ ID NO: 1374105 - DNA, 16 bp, Homo sapiens
gtccttgatttcaaag

SEQ ID NO: 1374106 - DNA, 12 bp, Homo sapiens
gtcgaggcagga

SEQ ID NO: 1374107 - DNA, 18 bp, Homo sapiens
gtcgtgcctgtgtccatg

SEQ ID NO: 1374108 - DNA, 21 bp, Homo sapiens
gtcgtggggtgtgctgggagc

SEQ ID NO: 1374109 - DNA, 17 bp, Homo sapiens
gtctataaaagaaacac

SEQ ID NO: 1374110 - DNA, 19 bp, Homo sapiens
aaaattgaacaaagactac

SEQ ID NO: 1374111 - DNA, 20 bp, Homo sapiens
aaaattgagttgcacttatt

SEQ ID NO: 1374112 - DNA, 16 bp, Homo sapiens
aaaattgtttagtgat

SEQ ID NO: 1374113 - DNA, 18 bp, Homo sapiens
aaaattttgtatgttaaa

SEQ ID NO: 1374114 - DNA, 12 bp, Homo sapiens
aaacaaaatttg

SEQ ID NO: 1374115 - DNA, 17 bp, Homo sapiens
aaacaaaatttgactaa

SEQ ID NO: 1374116 - DNA, 15 bp, Homo sapiens
aaacaaccatgtcat

SEQ ID NO: 1374117 - DNA, 18 bp, Homo sapiens
aaacaatggagtattctc

SEQ ID NO: 1374118 - DNA, 19 bp, Homo sapiens
aaacacaaacgggctcagc

SEQ ID NO: 1374119 - DNA, 17 bp, Homo sapiens
aaacacgttttaaggac

SEQ ID NO: 1374120 - DNA, 22 bp, Homo sapiens
aaacactgcctttttatttata

SEQ ID NO: 1374121 - DNA, 17 bp, Homo sapiens
aaacagagtaatcttgt

SEQ ID NO: 1374122 - DNA, 18 bp, Homo sapiens
aaacagagtaatcttgtt

SEQ ID NO: 1374123 - DNA, 17 bp, Homo sapiens
aaacagtgtgtaaacaa

SEQ ID NO: 1374124 - DNA, 17 bp, Homo sapiens
aaacataacataaattt

SEQ ID NO: 1374125 - DNA, 14 bp, Homo sapiens
aaacatagaaatgg

SEQ ID NO: 1374126 - DNA, 21 bp, Homo sapiens
aaacatagaaatggaaatttt

SEQ ID NO: 1374127 - DNA, 18 bp, Homo sapiens
aaacatcattccttttta

SEQ ID NO: 1374128 - DNA, 21 bp, Homo sapiens
aaacatcattcctttttattt

SEQ ID NO: 1374129 - DNA, 16 bp, Homo sapiens
aaacatgttaatgaca

SEQ ID NO: 1374130 - DNA, 16 bp, Homo sapiens
aaacattgaagtaatg

SEQ ID NO: 1374131 - DNA, 12 bp, Homo sapiens
aaacatttattt

SEQ ID NO: 1374132 - DNA, 23 bp, Homo sapiens
aaacatttattttttttaaagaa

SEQ ID NO: 1374133 - DNA, 21 bp, Homo sapiens
aaaccaaagagggcttcctct

SEQ ID NO: 1374134 - DNA, 14 bp, Homo sapiens
aaaccctcagagcc

SEQ ID NO: 1374135 - DNA, 16 bp, Homo sapiens
aaaccgaataaatgtt

SEQ ID NO: 1374136 - DNA, 11 bp, Homo sapiens
aaacctaggtc

SEQ ID NO: 1374137 - DNA, 18 bp, Homo sapiens
aaacctgggattcaggaa

SEQ ID NO: 1374138 - DNA, 21 bp, Homo sapiens
aaacctgggattcaggaatgt

SEQ ID NO: 1374139 - DNA, 15 bp, Homo sapiens
aaacgggctcagcaa

SEQ ID NO: 1374140 - DNA, 20 bp, Homo sapiens
aaactaaagcaatagaaaca

SEQ ID NO: 1374141 - DNA, 13 bp, Homo sapiens
aaactaaatttca

SEQ ID NO: 1374142 - DNA, 15 bp, Homo sapiens
aaactacatattgta

SEQ ID NO: 1374143 - DNA, 21 bp, Homo sapiens
aaactacctgtatttaaaaat

SEQ ID NO: 1374144 - DNA, 22 bp, Homo sapiens
aaactcactgtgatcaatattt

SEQ ID NO: 1374145 - DNA, 17 bp, Homo sapiens
aaactcaggcaaagaaa

SEQ ID NO: 1374146 - DNA, 16 bp, Homo sapiens
aaactcatctgaaatg

SEQ ID NO: 1374147 - DNA, 17 bp, Homo sapiens
aaactccacatctgcct

SEQ ID NO: 1374148 - DNA, 18 bp, Homo sapiens
aaactccacatctgcctt

SEQ ID NO: 1374149 - DNA, 19 bp, Homo sapiens
aaactccacatctgcctta

SEQ ID NO: 1374150 - DNA, 12 bp, Homo sapiens
aaactcttaaaa

SEQ ID NO: 1374151 - DNA, 15 bp, Homo sapiens
aaactgtagaaatga

SEQ ID NO: 1374152 - DNA, 14 bp, Homo sapiens
aaactgtgttgcca

SEQ ID NO: 1374153 - DNA, 17 bp, Homo sapiens
aaacttaaatgttatta

SEQ ID NO: 1374154 - DNA, 13 bp, Homo sapiens
aaagaaataaacc

SEQ ID NO: 1374155 - DNA, 15 bp, Homo sapiens
aaagaatatgacttt

SEQ ID NO: 1374156 - DNA, 16 bp, Homo sapiens
aaagacagtgtatgta

SEQ ID NO: 1374157 - DNA, 22 bp, Homo sapiens
aaagacctggggctgctgtgaa

SEQ ID NO: 1374158 - DNA, 18 bp, Homo sapiens
aaagactttaaaagtgat

SEQ ID NO: 1374159 - DNA, 14 bp, Homo sapiens
aaagaggctgcccc

SEQ ID NO: 1374160 - DNA, 22 bp, Homo sapiens
aaagaggctgcccctctcacca

SEQ ID NO: 1374161 - DNA, 19 bp, Homo sapiens
aaagagggcttcctctaga

SEQ ID NO: 1374162 - DNA, 11 bp, Homo sapiens
aaagaggtttt

SEQ ID NO: 1374163 - DNA, 19 bp, Homo sapiens
aaagatgcttctcactgcc

SEQ ID NO: 1374164 - DNA, 15 bp, Homo sapiens
aaagcaacaaagaaa

SEQ ID NO: 1374165 - DNA, 17 bp, Homo sapiens
aaagcaataaatgaatg

SEQ ID NO: 1374166 - DNA, 12 bp, Homo sapiens
aaagcaatagaa

SEQ ID NO: 1374167 - DNA, 13 bp, Homo sapiens
aaagcaatagaaa

SEQ ID NO: 1374168 - DNA, 16 bp, Homo sapiens
aaagcagtatttttct

SEQ ID NO: 1374169 - DNA, 11 bp, Homo sapiens
aaagcattttt

SEQ ID NO: 1374170 - DNA, 13 bp, Homo sapiens
aaagcatttttca

SEQ ID NO: 1374171 - DNA, 16 bp, Homo sapiens
aaagcctcctccagcc

SEQ ID NO: 1374172 - DNA, 18 bp, Homo sapiens
aaagctatttatgggccc

SEQ ID NO: 1374173 - DNA, 14 bp, Homo sapiens
aaagctctgaccac

SEQ ID NO: 1374174 - DNA, 22 bp, Homo sapiens
aaagctgcccactgtttctctt

SEQ ID NO: 1374175 - DNA, 20 bp, Homo sapiens
aaagcttggattaaatacat

SEQ ID NO: 1374176 - DNA, 18 bp, Homo sapiens
aaaggaaaatagtaatgt

SEQ ID NO: 1374177 - DNA, 16 bp, Homo sapiens
aaaggaaaatgtctgt

SEQ ID NO: 1374178 - DNA, 15 bp, Homo sapiens
aaaggaagcactctg

SEQ ID NO: 1374179 - DNA, 15 bp, Homo sapiens
aaaggagagcatcgg

SEQ ID NO: 1374180 - DNA, 21 bp, Homo sapiens
aaaggcctcttgtaaagactg

SEQ ID NO: 1374181 - DNA, 13 bp, Homo sapiens
aaaggcgctgaga

SEQ ID NO: 1374182 - DNA, 23 bp, Homo sapiens
aaaggctgtgctgccctgaagaa

SEQ ID NO: 1374183 - DNA, 17 bp, Homo sapiens
aaaggcttgaagctgtg

SEQ ID NO: 1374184 - DNA, 23 bp, Homo sapiens
aaagggcccacagtgacttttgc

SEQ ID NO: 1374185 - DNA, 21 bp, Homo sapiens
aaaggtgagtttgagctgcct

SEQ ID NO: 1374186 - DNA, 18 bp, Homo sapiens
aaagtaatatttattaaa

SEQ ID NO: 1374187 - DNA, 16 bp, Homo sapiens
aaagtagaactttgta

SEQ ID NO: 1374188 - DNA, 16 bp, Homo sapiens
aaagtatgtattattt

SEQ ID NO: 1374189 - DNA, 17 bp, Homo sapiens
aaagtatgtattattta

SEQ ID NO: 1374190 - DNA, 12 bp, Homo sapiens
aaagtattcttc

SEQ ID NO: 1374191 - DNA, 23 bp, Homo sapiens
aaagtctgctctcatataagaca

SEQ ID NO: 1374192 - DNA, 16 bp, Homo sapiens
aaagtctgtctttcct

SEQ ID NO: 1374193 - DNA, 18 bp, Homo sapiens
aaagtcttttttttcctg

SEQ ID NO: 1374194 - DNA, 23 bp, Homo sapiens
aaagtgaagcaaatcagaaactt

SEQ ID NO: 1374195 - DNA, 14 bp, Homo sapiens
aaagtgccaaagaa

SEQ ID NO: 1374196 - DNA, 19 bp, Homo sapiens
aaagtggccaagaagcagt

SEQ ID NO: 1374197 - DNA, 20 bp, Homo sapiens
aaagtgtgtatatattttgt

SEQ ID NO: 1374198 - DNA, 16 bp, Homo sapiens
aaagttaaacattgaa

SEQ ID NO: 1374199 - DNA, 14 bp, Homo sapiens
aaataaaatatatc

SEQ ID NO: 1374200 - DNA, 15 bp, Homo sapiens
aaataaaatgaaaat

SEQ ID NO: 1374201 - DNA, 18 bp, Homo sapiens
aaataaaatttgttgcat

SEQ ID NO: 1374202 - DNA, 22 bp, Homo sapiens
aaataaaccaaaggaaaatgtc

SEQ ID NO: 1374203 - DNA, 11 bp, Homo sapiens
aaataaagaag

SEQ ID NO: 1374204 - DNA, 13 bp, Homo sapiens
aaataaagaagta

SEQ ID NO: 1374205 - DNA, 20 bp, Homo sapiens
aaataaagtttgcttagaaa

SEQ ID NO: 1374206 - DNA, 11 bp, Homo sapiens
aaataaataat

SEQ ID NO: 1374207 - DNA, 12 bp, Homo sapiens
aaataacagtat

SEQ ID NO: 1374208 - DNA, 15 bp, Homo sapiens
aaataacccataatt

SEQ ID NO: 1374209 - DNA, 20 bp, Homo sapiens
aaataagccccctcaactac

SEQ ID NO: 1374210 - DNA, 13 bp, Homo sapiens
aaataatgctaca

SEQ ID NO: 1374211 - DNA, 19 bp, Homo sapiens
aaataatgctacaatttta

SEQ ID NO: 1374212 - DNA, 23 bp, Homo sapiens
aaataattatataactgtatttg

SEQ ID NO: 1374213 - DNA, 13 bp, Homo sapiens
aaataattctttt

SEQ ID NO: 1374214 - DNA, 14 bp, Homo sapiens
aaataattcttttt

SEQ ID NO: 1374215 - DNA, 18 bp, Homo sapiens
aaataattcttttttatt

SEQ ID NO: 1374216 - DNA, 19 bp, Homo sapiens
aaataattcttttttatta

SEQ ID NO: 1374217 - DNA, 21 bp, Homo sapiens
aaataattcttttttattaat

SEQ ID NO: 1374218 - DNA, 12 bp, Homo sapiens
aaatacacattt

SEQ ID NO: 1374219 - DNA, 15 bp, Homo sapiens
aaatacacatttgct

SEQ ID NO: 1374220 - DNA, 15 bp, Homo sapiens
aaatacatagtgaaa

SEQ ID NO: 1374221 - DNA, 17 bp, Homo sapiens
aaatacatagtgaaaat

SEQ ID NO: 1374222 - DNA, 19 bp, Homo sapiens
aaatacatgcatataatga

SEQ ID NO: 1374223 - DNA, 23 bp, Homo sapiens
aaatacatgccacatcaaacctt

SEQ ID NO: 1374224 - DNA, 15 bp, Homo sapiens
aaatactatttaaga

SEQ ID NO: 1374225 - DNA, 16 bp, Homo sapiens
aaatactatttaagat

SEQ ID NO: 1374226 - DNA, 18 bp, Homo sapiens
aaatactatttaagatgt

SEQ ID NO: 1374227 - DNA, 14 bp, Homo sapiens
aaatagaaattttg

SEQ ID NO: 1374228 - DNA, 19 bp, Homo sapiens
aaatagaaattttgtaaga

SEQ ID NO: 1374229 - DNA, 19 bp, Homo sapiens
aagatgaaaggcaggccta

SEQ ID NO: 1374230 - DNA, 17 bp, Homo sapiens
aagatgactgtgttgta

SEQ ID NO: 1374231 - DNA, 13 bp, Homo sapiens
aagatgatcattt

SEQ ID NO: 1374232 - DNA, 17 bp, Homo sapiens
aagatgcttctcactgc

SEQ ID NO: 1374233 - DNA, 11 bp, Homo sapiens
aagatgtgaat

SEQ ID NO: 1374234 - DNA, 15 bp, Homo sapiens
aagatgtgaattatt

SEQ ID NO: 1374235 - DNA, 22 bp, Homo sapiens
aagatgttgatttttactgtgt

SEQ ID NO: 1374236 - DNA, 12 bp, Homo sapiens
aagatttatgtt

SEQ ID NO: 1374237 - DNA, 19 bp, Homo sapiens
aagattttcctcttgtgat

SEQ ID NO: 1374238 - DNA, 19 bp, Homo sapiens
aagcaaatgttaaaagttt

SEQ ID NO: 1374239 - DNA, 19 bp, Homo sapiens
aagcaagtaaaaaggctaa

SEQ ID NO: 1374240 - DNA, 14 bp, Homo sapiens
aagcaataaatgaa

SEQ ID NO: 1374241 - DNA, 12 bp, Homo sapiens
aagcaatagaaa

SEQ ID NO: 1374242 - DNA, 13 bp, Homo sapiens
aagcaatagaaac

SEQ ID NO: 1374243 - DNA, 15 bp, Homo sapiens
aagcaatagaaacaa

SEQ ID NO: 1374244 - DNA, 17 bp, Homo sapiens
aagcaatattttggagt

SEQ ID NO: 1374245 - DNA, 19 bp, Homo sapiens
aagcacaccaatcttactt

SEQ ID NO: 1374246 - DNA, 20 bp, Homo sapiens
aagcacagtctgatgacaca

SEQ ID NO: 1374247 - DNA, 23 bp, Homo sapiens
aagcactacaccttgccttgctg

SEQ ID NO: 1374248 - DNA, 15 bp, Homo sapiens
aagcagagttttcat

SEQ ID NO: 1374249 - DNA, 17 bp, Homo sapiens
aagcagtatttttcttg

SEQ ID NO: 1374250 - DNA, 18 bp, Homo sapiens
aagcagtcgtgcctgtgt

SEQ ID NO: 1374251 - DNA, 21 bp, Homo sapiens
aagcatgcttgtgaaaatgtg

SEQ ID NO: 1374252 - DNA, 18 bp, Homo sapiens
aagcatttttcaatatat

SEQ ID NO: 1374253 - DNA, 15 bp, Homo sapiens
aagccaaagaaaaat

SEQ ID NO: 1374254 - DNA, 21 bp, Homo sapiens
aagccaaagaaaaataaccct

SEQ ID NO: 1374255 - DNA, 18 bp, Homo sapiens
aagccaagggaacctgtg

SEQ ID NO: 1374256 - DNA, 19 bp, Homo sapiens
aagccaagggaacctgtgt

SEQ ID NO: 1374257 - DNA, 13 bp, Homo sapiens
aagccaagtgggg

SEQ ID NO: 1374258 - DNA, 16 bp, Homo sapiens
aagccagcccggccgc

SEQ ID NO: 1374259 - DNA, 19 bp, Homo sapiens
aagccaggctcactcacag

SEQ ID NO: 1374260 - DNA, 22 bp, Homo sapiens
aagccaggctcactcacagagt

SEQ ID NO: 1374261 - DNA, 22 bp, Homo sapiens
aagccattctcctgcctcagcc

SEQ ID NO: 1374262 - DNA, 18 bp, Homo sapiens
aagcccatcctgaccagc

SEQ ID NO: 1374263 - DNA, 20 bp, Homo sapiens
aagcccatcctgaccagctg

SEQ ID NO: 1374264 - DNA, 17 bp, Homo sapiens
aagccgagagccttttg

SEQ ID NO: 1374265 - DNA, 22 bp, Homo sapiens
aagccggggaagagatccaaag

SEQ ID NO: 1374266 - DNA, 23 bp, Homo sapiens
aagcctccacagcgagggcagct

SEQ ID NO: 1374267 - DNA, 17 bp, Homo sapiens
aagccttcagctccagg

SEQ ID NO: 1374268 - DNA, 23 bp, Homo sapiens
aagcgcttttccttggcattccg

SEQ ID NO: 1374269 - DNA, 22 bp, Homo sapiens
aagctactagcaaaataaaaca

SEQ ID NO: 1374270 - DNA, 17 bp, Homo sapiens
aagctagtcaacagtac

SEQ ID NO: 1374271 - DNA, 13 bp, Homo sapiens
aagctagttgaat

SEQ ID NO: 1374272 - DNA, 18 bp, Homo sapiens
aagctattcacattgtta

SEQ ID NO: 1374273 - DNA, 18 bp, Homo sapiens
aagctatttatgggcccc

SEQ ID NO: 1374274 - DNA, 16 bp, Homo sapiens
aagctctgaccacttg

SEQ ID NO: 1374275 - DNA, 15 bp, Homo sapiens
aagctgcaaatctga

SEQ ID NO: 1374276 - DNA, 19 bp, Homo sapiens
aagctgcaaatctgatggc

SEQ ID NO: 1374277 - DNA, 17 bp, Homo sapiens
aagctgcagagatttct

SEQ ID NO: 1374278 - DNA, 23 bp, Homo sapiens
aagctgcagagatttctcattga

SEQ ID NO: 1374279 - DNA, 11 bp, Homo sapiens
aagctgggcag

SEQ ID NO: 1374280 - DNA, 18 bp, Homo sapiens
aagctgttactgtcttca

SEQ ID NO: 1374281 - DNA, 10 bp, Homo sapiens
aagcttagaa

SEQ ID NO: 1374282 - DNA, 11 bp, Homo sapiens
aagcttagaac

SEQ ID NO: 1374283 - DNA, 15 bp, Homo sapiens
aagcttcagttgctt

SEQ ID NO: 1374284 - DNA, 18 bp, Homo sapiens
aagcttggattaaataca

SEQ ID NO: 1374285 - DNA, 21 bp, Homo sapiens
aagcttggttctgtgaacaag

SEQ ID NO: 1374286 - DNA, 22 bp, Homo sapiens
aagctttactggggctggggaa

SEQ ID NO: 1374287 - DNA, 20 bp, Homo sapiens
aaggaaagcaataaatgaat

SEQ ID NO: 1374288 - DNA, 13 bp, Homo sapiens
aaggaaattttac

SEQ ID NO: 1374289 - DNA, 12 bp, Homo sapiens
aaggaaggtgga

SEQ ID NO: 1374290 - DNA, 14 bp, Homo sapiens
aaggacaaagtgcc

SEQ ID NO: 1374291 - DNA, 14 bp, Homo sapiens
aaggactttgtaca

SEQ ID NO: 1374292 - DNA, 20 bp, Homo sapiens
aaggatagtaagcatagaaa

SEQ ID NO: 1374293 - DNA, 22 bp, Homo sapiens
aaggatatttactacttttgca

SEQ ID NO: 1374294 - DNA, 12 bp, Homo sapiens
aaggatttttct

SEQ ID NO: 1374295 - DNA, 13 bp, Homo sapiens
aaggcaagagggg

SEQ ID NO: 1374296 - DNA, 11 bp, Homo sapiens
aaggcaagcca

SEQ ID NO: 1374297 - DNA, 15 bp, Homo sapiens
aaggcaagccaggct

SEQ ID NO: 1374298 - DNA, 15 bp, Homo sapiens
aaggcaggcctattt

SEQ ID NO: 1374299 - DNA, 17 bp, Homo sapiens
aaggcaggcctatttca

SEQ ID NO: 1374300 - DNA, 19 bp, Homo sapiens
aaggcattataaaaagaat

SEQ ID NO: 1374301 - DNA, 20 bp, Homo sapiens
aaggcctcttgtaaagactg

SEQ ID NO: 1374302 - DNA, 13 bp, Homo sapiens
aaggctggcaggt

SEQ ID NO: 1374303 - DNA, 19 bp, Homo sapiens
aaggctgggggaagaagct

SEQ ID NO: 1374304 - DNA, 22 bp, Homo sapiens
aaggctggtacaacggaggcct

SEQ ID NO: 1374305 - DNA, 14 bp, Homo sapiens
aaggcttataaaac

SEQ ID NO: 1374306 - DNA, 15 bp, Homo sapiens
aaggcttataaaaca

SEQ ID NO: 1374307 - DNA, 16 bp, Homo sapiens
aaggcttataaaacag

SEQ ID NO: 1374308 - DNA, 14 bp, Homo sapiens
aagggaagaaactg

SEQ ID NO: 1374309 - DNA, 12 bp, Homo sapiens
aagggagaagaa

SEQ ID NO: 1374310 - DNA, 21 bp, Homo sapiens
aagggccagcgtggctctaaa

SEQ ID NO: 1374311 - DNA, 16 bp, Homo sapiens
aagggcccagattcta

SEQ ID NO: 1374312 - DNA, 12 bp, Homo sapiens
aaggggagagcc

SEQ ID NO: 1374313 - DNA, 14 bp, Homo sapiens
aaggggagagcctg

SEQ ID NO: 1374314 - DNA, 19 bp, Homo sapiens
aaggggagagcctgctggc

SEQ ID NO: 1374315 - DNA, 18 bp, Homo sapiens
aaggggttcctcaaattt

SEQ ID NO: 1374316 - DNA, 16 bp, Homo sapiens
aaggtataataaaatt

SEQ ID NO: 1374317 - DNA, 22 bp, Homo sapiens
aaggtattatacatgtgataca

SEQ ID NO: 1374318 - DNA, 14 bp, Homo sapiens
aaggtcactgtttc

SEQ ID NO: 1374319 - DNA, 15 bp, Homo sapiens
aaggtcactgtttcc

SEQ ID NO: 1374320 - DNA, 12 bp, Homo sapiens
aaggtctttcag

SEQ ID NO: 1374321 - DNA, 20 bp, Homo sapiens
aaggtgagtttgagctgcct

SEQ ID NO: 1374322 - DNA, 22 bp, Homo sapiens
aaggtgagtttgagctgccttc

SEQ ID NO: 1374323 - DNA, 21 bp, Homo sapiens
aaggtgtttgaaaatagttta

SEQ ID NO: 1374324 - DNA, 14 bp, Homo sapiens
aaggtttattgtta

SEQ ID NO: 1374325 - DNA, 20 bp, Homo sapiens
aaggtttattgttaatacaa

SEQ ID NO: 1374326 - DNA, 20 bp, Homo sapiens
aaggttttataaggctgatg

SEQ ID NO: 1374327 - DNA, 19 bp, Homo sapiens
aaggtttttgatagcattg

SEQ ID NO: 1374328 - DNA, 18 bp, Homo sapiens
aagtaaatacatgcatat

SEQ ID NO: 1374329 - DNA, 14 bp, Homo sapiens
aagtaactcatttg

SEQ ID NO: 1374330 - DNA, 16 bp, Homo sapiens
aagtaactcatttgtt

SEQ ID NO: 1374331 - DNA, 14 bp, Homo sapiens
aagtaactgtgaga

SEQ ID NO: 1374332 - DNA, 21 bp, Homo sapiens
aagtaatgaatttttatgata

SEQ ID NO: 1374333 - DNA, 14 bp, Homo sapiens
aagtactctggagc

SEQ ID NO: 1374334 - DNA, 18 bp, Homo sapiens
aagtagaactttgtatag

SEQ ID NO: 1374335 - DNA, 21 bp, Homo sapiens
aagtagaactttgtatagtta

SEQ ID NO: 1374336 - DNA, 16 bp, Homo sapiens
aagtagttctgtattt

SEQ ID NO: 1374337 - DNA, 20 bp, Homo sapiens
aagtataaaatagtatgaaa

SEQ ID NO: 1374338 - DNA, 22 bp, Homo sapiens
aagtatagcctatggcagaaaa

SEQ ID NO: 1374339 - DNA, 22 bp, Homo sapiens
aagtatgtatattaaaaaagag

SEQ ID NO: 1374340 - DNA, 12 bp, Homo sapiens
aagtatttataa

SEQ ID NO: 1374341 - DNA, 17 bp, Homo sapiens
aagtcattaaactggtt

SEQ ID NO: 1374342 - DNA, 19 bp, Homo sapiens
aagtcttaaggacaaagtg

SEQ ID NO: 1374343 - DNA, 18 bp, Homo sapiens
aagtctttaataaataac

SEQ ID NO: 1374344 - DNA, 15 bp, Homo sapiens
aagtgaatgctggga

SEQ ID NO: 1374345 - DNA, 21 bp, Homo sapiens
aagtgaggaaatcaaagtgct

SEQ ID NO: 1374346 - DNA, 14 bp, Homo sapiens
aagtgcatttttgt

SEQ ID NO: 1374347 - DNA, 19 bp, Homo sapiens
aagtgccaaagaaagtggt

SEQ ID NO: 1374348 - DNA, 20 bp, Homo sapiens
acagcaacgatcacaaatga

SEQ ID NO: 1374349 - DNA, 15 bp, Homo sapiens
acagcaagtgtgaat

SEQ ID NO: 1374350 - DNA, 20 bp, Homo sapiens
acagccaagattttcctctt

SEQ ID NO: 1374351 - DNA, 16 bp, Homo sapiens
acagccactccccggc

SEQ ID NO: 1374352 - DNA, 18 bp, Homo sapiens
acagcgagggcagctgct

SEQ ID NO: 1374353 - DNA, 19 bp, Homo sapiens
acagcgagggcagctgcta

SEQ ID NO: 1374354 - DNA, 23 bp, Homo sapiens
acagcgagggcagctgctattta

SEQ ID NO: 1374355 - DNA, 15 bp, Homo sapiens
acagcgccagcctca

SEQ ID NO: 1374356 - DNA, 14 bp, Homo sapiens
acagcgtccctggc

SEQ ID NO: 1374357 - DNA, 17 bp, Homo sapiens
acagcgtccctggcgca

SEQ ID NO: 1374358 - DNA, 14 bp, Homo sapiens
acagctatgcaaaa

SEQ ID NO: 1374359 - DNA, 21 bp, Homo sapiens
acagctatgcaaaaagctagt

SEQ ID NO: 1374360 - DNA, 16 bp, Homo sapiens
acagctcattaaactt

SEQ ID NO: 1374361 - DNA, 17 bp, Homo sapiens
acagctcattaaacttt

SEQ ID NO: 1374362 - DNA, 15 bp, Homo sapiens
acagcttgacctgag

SEQ ID NO: 1374363 - DNA, 22 bp, Homo sapiens
acagcttgagccgggcccctgg

SEQ ID NO: 1374364 - DNA, 20 bp, Homo sapiens
acagctttcatgattagcaa

SEQ ID NO: 1374365 - DNA, 14 bp, Homo sapiens
acaggaaccttaag

SEQ ID NO: 1374366 - DNA, 15 bp, Homo sapiens
acaggagacaaaaga

SEQ ID NO: 1374367 - DNA, 21 bp, Homo sapiens
acaggaggcaggcatggccct

SEQ ID NO: 1374368 - DNA, 18 bp, Homo sapiens
acagtagaactgtctgtg

SEQ ID NO: 1374369 - DNA, 14 bp, Homo sapiens
acagtagagccagc

SEQ ID NO: 1374370 - DNA, 15 bp, Homo sapiens
acagtagagccagct

SEQ ID NO: 1374371 - DNA, 23 bp, Homo sapiens
acagtagttagaattatatcact

SEQ ID NO: 1374372 - DNA, 23 bp, Homo sapiens
acagtgaagttttactgtctatt

SEQ ID NO: 1374373 - DNA, 24 bp, Homo sapiens
acagtgatgctgtgctatgaattt

SEQ ID NO: 1374374 - DNA, 20 bp, Homo sapiens
acagtgcagagccttctcag

SEQ ID NO: 1374375 - DNA, 18 bp, Homo sapiens
acagtggaatataaggaa

SEQ ID NO: 1374376 - DNA, 21 bp, Homo sapiens
acagtggtggcaacattcatt

SEQ ID NO: 1374377 - DNA, 22 bp, Homo sapiens
acagtggttttatactgaagga

SEQ ID NO: 1374378 - DNA, 12 bp, Homo sapiens
acagtgtatgta

SEQ ID NO: 1374379 - DNA, 16 bp, Homo sapiens
acagtgtcccccaggt

SEQ ID NO: 1374380 - DNA, 13 bp, Homo sapiens
acagtgtgtaaac

SEQ ID NO: 1374381 - DNA, 18 bp, Homo sapiens
acagttgcagcccttgtg

SEQ ID NO: 1374382 - DNA, 19 bp, Homo sapiens
acagtttcttttttcttac

SEQ ID NO: 1374383 - DNA, 15 bp, Homo sapiens
acataaaagaaataa

SEQ ID NO: 1374384 - DNA, 14 bp, Homo sapiens
acataatactgaac

SEQ ID NO: 1374385 - DNA, 18 bp, Homo sapiens
acataatactgaaccact

SEQ ID NO: 1374386 - DNA, 15 bp, Homo sapiens
acatacgatttaagg

SEQ ID NO: 1374387 - DNA, 19 bp, Homo sapiens
acatacgatttaaggtatt

SEQ ID NO: 1374388 - DNA, 14 bp, Homo sapiens
acatactgttcact

SEQ ID NO: 1374389 - DNA, 14 bp, Homo sapiens
acatagtgaaaatt

SEQ ID NO: 1374390 - DNA, 16 bp, Homo sapiens
acatatcatctgtgga

SEQ ID NO: 1374391 - DNA, 16 bp, Homo sapiens
acatatcccttccaga

SEQ ID NO: 1374392 - DNA, 17 bp, Homo sapiens
acatatggaattttgca

SEQ ID NO: 1374393 - DNA, 20 bp, Homo sapiens
acatatggaattttgcaaag

SEQ ID NO: 1374394 - DNA, 14 bp, Homo sapiens
acatatggatgtta

SEQ ID NO: 1374395 - DNA, 13 bp, Homo sapiens
acatcaaaccttt

SEQ ID NO: 1374396 - DNA, 19 bp, Homo sapiens
acatcacagggtgggcctc

SEQ ID NO: 1374397 - DNA, 16 bp, Homo sapiens
acatccaactccagca

SEQ ID NO: 1374398 - DNA, 17 bp, Homo sapiens
acatccgcgtgtgcctg

SEQ ID NO: 1374399 - DNA, 21 bp, Homo sapiens
acatccgcgtgtgcctgtgtg

SEQ ID NO: 1374400 - DNA, 22 bp, Homo sapiens
acatccgcgtgtgcctgtgtgc

SEQ ID NO: 1374401 - DNA, 18 bp, Homo sapiens
acatctaataagtatata

SEQ ID NO: 1374402 - DNA, 23 bp, Homo sapiens
acatctgccttaaaaccaaagag

SEQ ID NO: 1374403 - DNA, 11 bp, Homo sapiens
acatctttaag

SEQ ID NO: 1374404 - DNA, 20 bp, Homo sapiens
acatctttaaggggaggaac

SEQ ID NO: 1374405 - DNA, 15 bp, Homo sapiens
acatgaagcttcatg

SEQ ID NO: 1374406 - DNA, 20 bp, Homo sapiens
acatgagatgtgtggactgt

SEQ ID NO: 1374407 - DNA, 14 bp, Homo sapiens
acatgaggaactgt

SEQ ID NO: 1374408 - DNA, 23 bp, Homo sapiens
acatgcatataatgaataaatca

SEQ ID NO: 1374409 - DNA, 22 bp, Homo sapiens
acatgccacatcaaacctttga

SEQ ID NO: 1374410 - DNA, 12 bp, Homo sapiens
acatgccccctg

SEQ ID NO: 1374411 - DNA, 21 bp, Homo sapiens
acatgctggtgaatattttca

SEQ ID NO: 1374412 - DNA, 16 bp, Homo sapiens
acatggtgcctgagag

SEQ ID NO: 1374413 - DNA, 19 bp, Homo sapiens
acatggtgcctgagaggca

SEQ ID NO: 1374414 - DNA, 23 bp, Homo sapiens
acatggtgcctgagaggcaggca

SEQ ID NO: 1374415 - DNA, 15 bp, Homo sapiens
acatgtgatacattt

SEQ ID NO: 1374416 - DNA, 16 bp, Homo sapiens
acatgtttcctctagt

SEQ ID NO: 1374417 - DNA, 17 bp, Homo sapiens
acatgtttttatacaaa

SEQ ID NO: 1374418 - DNA, 19 bp, Homo sapiens
acatgtttttatacaaaat

SEQ ID NO: 1374419 - DNA, 21 bp, Homo sapiens
acattaaaggcataaatgact

SEQ ID NO: 1374420 - DNA, 15 bp, Homo sapiens
acattaacaaataaa

SEQ ID NO: 1374421 - DNA, 22 bp, Homo sapiens
acattacaaagttaaaattgtt

SEQ ID NO: 1374422 - DNA, 22 bp, Homo sapiens
acattcttggcttaatcatttt

SEQ ID NO: 1374423 - DNA, 15 bp, Homo sapiens
acattgaagtaatga

SEQ ID NO: 1374424 - DNA, 15 bp, Homo sapiens
acattgtgtctagga

SEQ ID NO: 1374425 - DNA, 15 bp, Homo sapiens
acatttctataaata

SEQ ID NO: 1374426 - DNA, 19 bp, Homo sapiens
acatttgctactgttgtaa

SEQ ID NO: 1374427 - DNA, 20 bp, Homo sapiens
acatttgggagtttttatga

SEQ ID NO: 1374428 - DNA, 21 bp, Homo sapiens
acatttgggagtttttatgag

SEQ ID NO: 1374429 - DNA, 20 bp, Homo sapiens
acattttaaaaaatggtcac

SEQ ID NO: 1374430 - DNA, 14 bp, Homo sapiens
acattttttaagct

SEQ ID NO: 1374431 - DNA, 18 bp, Homo sapiens
acatttttttgcatgcat

SEQ ID NO: 1374432 - DNA, 12 bp, Homo sapiens
accaaaaacaaa

SEQ ID NO: 1374433 - DNA, 13 bp, Homo sapiens
accaaaattcatc

SEQ ID NO: 1374434 - DNA, 15 bp, Homo sapiens
accaaagagggcttc

SEQ ID NO: 1374435 - DNA, 13 bp, Homo sapiens
accaaagctgccc

SEQ ID NO: 1374436 - DNA, 20 bp, Homo sapiens
accaagccaagggaacctgt

SEQ ID NO: 1374437 - DNA, 23 bp, Homo sapiens
accaagccaagggaacctgtgtc

SEQ ID NO: 1374438 - DNA, 24 bp, Homo sapiens
accaagtaaaacaaaaccactggg

SEQ ID NO: 1374439 - DNA, 17 bp, Homo sapiens
accaatcttactttgta

SEQ ID NO: 1374440 - DNA, 19 bp, Homo sapiens
accaatcttactttgtaaa

SEQ ID NO: 1374441 - DNA, 17 bp, Homo sapiens
accacatcaaataagaa

SEQ ID NO: 1374442 - DNA, 20 bp, Homo sapiens
accaccccggccccctgccc

SEQ ID NO: 1374443 - DNA, 18 bp, Homo sapiens
accacgcccgtcctgcct

SEQ ID NO: 1374444 - DNA, 23 bp, Homo sapiens
accacgcccgtcctgcctgtggc

SEQ ID NO: 1374445 - DNA, 18 bp, Homo sapiens
accacgcctcttgaccag

SEQ ID NO: 1374446 - DNA, 15 bp, Homo sapiens
accactatgaagcta

SEQ ID NO: 1374447 - DNA, 21 bp, Homo sapiens
accactcgtgcatccctgaga

SEQ ID NO: 1374448 - DNA, 15 bp, Homo sapiens
accacttcagctgac

SEQ ID NO: 1374449 - DNA, 13 bp, Homo sapiens
accacttgtagat

SEQ ID NO: 1374450 - DNA, 22 bp, Homo sapiens
accagacctggaagaacaggcc

SEQ ID NO: 1374451 - DNA, 22 bp, Homo sapiens
accagagtgctgaaggaatgga

SEQ ID NO: 1374452 - DNA, 22 bp, Homo sapiens
accagataccttatcttacaat

SEQ ID NO: 1374453 - DNA, 17 bp, Homo sapiens
accagcaatatatctga

SEQ ID NO: 1374454 - DNA, 13 bp, Homo sapiens
accagcagcctgg

SEQ ID NO: 1374455 - DNA, 16 bp, Homo sapiens
accagcatcacctgcc

SEQ ID NO: 1374456 - DNA, 20 bp, Homo sapiens
accagccccactgccagcag

SEQ ID NO: 1374457 - DNA, 23 bp, Homo sapiens
accagccccactgccagcagcag

SEQ ID NO: 1374458 - DNA, 20 bp, Homo sapiens
accaggaactctggagttca

SEQ ID NO: 1374459 - DNA, 16 bp, Homo sapiens
accaggcacctcttcc

SEQ ID NO: 1374460 - DNA, 17 bp, Homo sapiens
accaggctgcctccctt

SEQ ID NO: 1374461 - DNA, 14 bp, Homo sapiens
accaggggtttctc

SEQ ID NO: 1374462 - DNA, 17 bp, Homo sapiens
accaggggtttctcgca

SEQ ID NO: 1374463 - DNA, 24 bp, Homo sapiens
accagtttttggataaagaatact

SEQ ID NO: 1374464 - DNA, 17 bp, Homo sapiens
accatgcctcactaatt

SEQ ID NO: 1374465 - DNA, 20 bp, Homo sapiens
actgcactccagcctggggg

SEQ ID NO: 1374466 - DNA, 19 bp, Homo sapiens
actgcactccagcctgggt

SEQ ID NO: 1374467 - DNA, 13 bp, Homo sapiens
actgcaggccctg

SEQ ID NO: 1374468 - DNA, 22 bp, Homo sapiens
actgcaggccctggcctcccct

SEQ ID NO: 1374469 - DNA, 14 bp, Homo sapiens
actgcatccagcct

SEQ ID NO: 1374470 - DNA, 14 bp, Homo sapiens
actgcatttaggga

SEQ ID NO: 1374471 - DNA, 23 bp, Homo sapiens
actgccaatatagaaaaataaaa

SEQ ID NO: 1374472 - DNA, 21 bp, Homo sapiens
actgccacactctccatcacc

SEQ ID NO: 1374473 - DNA, 14 bp, Homo sapiens
actgccagcagcag

SEQ ID NO: 1374474 - DNA, 14 bp, Homo sapiens
actgccatgccagc

SEQ ID NO: 1374475 - DNA, 22 bp, Homo sapiens
actgcccggcagggtcctagaa

SEQ ID NO: 1374476 - DNA, 13 bp, Homo sapiens
actgcctgcctta

SEQ ID NO: 1374477 - DNA, 18 bp, Homo sapiens
actgcctgccttaagtga

SEQ ID NO: 1374478 - DNA, 11 bp, Homo sapiens
actgcctgggc

SEQ ID NO: 1374479 - DNA, 12 bp, Homo sapiens
actgcctgggct

SEQ ID NO: 1374480 - DNA, 17 bp, Homo sapiens
actgccttcgcttcttg

SEQ ID NO: 1374481 - DNA, 12 bp, Homo sapiens
actgccttgaaa

SEQ ID NO: 1374482 - DNA, 22 bp, Homo sapiens
actgcgactttctgcctggagt

SEQ ID NO: 1374483 - DNA, 13 bp, Homo sapiens
actgctaaataaa

SEQ ID NO: 1374484 - DNA, 17 bp, Homo sapiens
actggaaaggggagagc

SEQ ID NO: 1374485 - DNA, 20 bp, Homo sapiens
actggaaaggggagagcctg

SEQ ID NO: 1374486 - DNA, 17 bp, Homo sapiens
actggaggttgaagcca

SEQ ID NO: 1374487 - DNA, 18 bp, Homo sapiens
actggaggttgaagccaa

SEQ ID NO: 1374488 - DNA, 19 bp, Homo sapiens
actggaggttgaagccaag

SEQ ID NO: 1374489 - DNA, 17 bp, Homo sapiens
actgggccctgagtctg

SEQ ID NO: 1374490 - DNA, 16 bp, Homo sapiens
actgggctcccgggcc

SEQ ID NO: 1374491 - DNA, 22 bp, Homo sapiens
actgggctcccgggccccacag

SEQ ID NO: 1374492 - DNA, 16 bp, Homo sapiens
actggggcctccagaa

SEQ ID NO: 1374493 - DNA, 17 bp, Homo sapiens
actggggcctccagaac

SEQ ID NO: 1374494 - DNA, 22 bp, Homo sapiens
actggggctggggaaggaagcc

SEQ ID NO: 1374495 - DNA, 14 bp, Homo sapiens
actggttgcatgga

SEQ ID NO: 1374496 - DNA, 14 bp, Homo sapiens
actggttttctgcc

SEQ ID NO: 1374497 - DNA, 11 bp, Homo sapiens
actgtaaatca

SEQ ID NO: 1374498 - DNA, 22 bp, Homo sapiens
actgtaacttccaaataaataa

SEQ ID NO: 1374499 - DNA, 13 bp, Homo sapiens
actgtagatgatg

SEQ ID NO: 1374500 - DNA, 14 bp, Homo sapiens
actgtatcattttc

SEQ ID NO: 1374501 - DNA, 15 bp, Homo sapiens
actgtatcattttct

SEQ ID NO: 1374502 - DNA, 22 bp, Homo sapiens
actgtcaaatgatgtgcaaaac

SEQ ID NO: 1374503 - DNA, 14 bp, Homo sapiens
actgtcactcattg

SEQ ID NO: 1374504 - DNA, 23 bp, Homo sapiens
actgtcactcattgctgagcctc

SEQ ID NO: 1374505 - DNA, 15 bp, Homo sapiens
actgtctgtgaacag

SEQ ID NO: 1374506 - DNA, 12 bp, Homo sapiens
actgtcttcagt

SEQ ID NO: 1374507 - DNA, 14 bp, Homo sapiens
actgtcttcctcaa

SEQ ID NO: 1374508 - DNA, 20 bp, Homo sapiens
actgtcttcctcaaaataaa

SEQ ID NO: 1374509 - DNA, 17 bp, Homo sapiens
actgtgagaacccagtt

SEQ ID NO: 1374510 - DNA, 13 bp, Homo sapiens
actgtgcacaccc

SEQ ID NO: 1374511 - DNA, 22 bp, Homo sapiens
actgtggcacttgcctgggtca

SEQ ID NO: 1374512 - DNA, 14 bp, Homo sapiens
actgtgtactgttc

SEQ ID NO: 1374513 - DNA, 16 bp, Homo sapiens
actgtgtatatttgat

SEQ ID NO: 1374514 - DNA, 14 bp, Homo sapiens
actgtgttgccaca

SEQ ID NO: 1374515 - DNA, 21 bp, Homo sapiens
actgtgttgtaccaaaattca

SEQ ID NO: 1374516 - DNA, 17 bp, Homo sapiens
actgtgttttataaaat

SEQ ID NO: 1374517 - DNA, 22 bp, Homo sapiens
actgttgtaagaattctgattg

SEQ ID NO: 1374518 - DNA, 14 bp, Homo sapiens
actgtttaatcata

SEQ ID NO: 1374519 - DNA, 20 bp, Homo sapiens
actgtttagatttgccatag

SEQ ID NO: 1374520 - DNA, 24 bp, Homo sapiens
actgtttattacttccatgaattt

SEQ ID NO: 1374521 - DNA, 16 bp, Homo sapiens
actgtttctcttgagc

SEQ ID NO: 1374522 - DNA, 18 bp, Homo sapiens
actgtttctcttgagctg

SEQ ID NO: 1374523 - DNA, 12 bp, Homo sapiens
acttaaaacacg

SEQ ID NO: 1374524 - DNA, 18 bp, Homo sapiens
acttaaatgttattatct

SEQ ID NO: 1374525 - DNA, 13 bp, Homo sapiens
acttaactgaaat

SEQ ID NO: 1374526 - DNA, 22 bp, Homo sapiens
acttaactgaaatgcctgcttt

SEQ ID NO: 1374527 - DNA, 13 bp, Homo sapiens
acttaataactgt

SEQ ID NO: 1374528 - DNA, 13 bp, Homo sapiens
acttaataatcaa

SEQ ID NO: 1374529 - DNA, 15 bp, Homo sapiens
acttaataatcaaga

SEQ ID NO: 1374530 - DNA, 19 bp, Homo sapiens
acttaataatcaagagcct

SEQ ID NO: 1374531 - DNA, 23 bp, Homo sapiens
acttaataatcaagagccttaaa

SEQ ID NO: 1374532 - DNA, 16 bp, Homo sapiens
acttacctagtgaaac

SEQ ID NO: 1374533 - DNA, 14 bp, Homo sapiens
acttacttgcttat

SEQ ID NO: 1374534 - DNA, 16 bp, Homo sapiens
acttacttgcttattt

SEQ ID NO: 1374535 - DNA, 18 bp, Homo sapiens
acttagaatccctgtgtt

SEQ ID NO: 1374536 - DNA, 21 bp, Homo sapiens
acttagaatccctgtgttaat

SEQ ID NO: 1374537 - DNA, 17 bp, Homo sapiens
acttagcgaacccttta

SEQ ID NO: 1374538 - DNA, 20 bp, Homo sapiens
acttatgaatgatttgcata

SEQ ID NO: 1374539 - DNA, 18 bp, Homo sapiens
acttattgaatatatgat

SEQ ID NO: 1374540 - DNA, 15 bp, Homo sapiens
acttcaaagcaagct

SEQ ID NO: 1374541 - DNA, 17 bp, Homo sapiens
acttcagaagcaaacaa

SEQ ID NO: 1374542 - DNA, 18 bp, Homo sapiens
acttcagaagcaaacaat

SEQ ID NO: 1374543 - DNA, 16 bp, Homo sapiens
acttcatgtaaagtgt

SEQ ID NO: 1374544 - DNA, 15 bp, Homo sapiens
acttccatgaatttt

SEQ ID NO: 1374545 - DNA, 14 bp, Homo sapiens
acttcccaccctgc

SEQ ID NO: 1374546 - DNA, 14 bp, Homo sapiens
acttccttttaact

SEQ ID NO: 1374547 - DNA, 17 bp, Homo sapiens
acttcgggaggtcgagg

SEQ ID NO: 1374548 - DNA, 22 bp, Homo sapiens
acttcgggaggtcgaggcagga

SEQ ID NO: 1374549 - DNA, 18 bp, Homo sapiens
acttctgcaacaagcatg

SEQ ID NO: 1374550 - DNA, 12 bp, Homo sapiens
acttctgccaga

SEQ ID NO: 1374551 - DNA, 12 bp, Homo sapiens
acttctgcctgg

SEQ ID NO: 1374552 - DNA, 17 bp, Homo sapiens
acttcttacgcaatgct

SEQ ID NO: 1374553 - DNA, 21 bp, Homo sapiens
acttcttttttcaaaagaaag

SEQ ID NO: 1374554 - DNA, 17 bp, Homo sapiens
acttgaaaagagacagg

SEQ ID NO: 1374555 - DNA, 22 bp, Homo sapiens
acttgaaaagagacaggcaggt

SEQ ID NO: 1374556 - DNA, 14 bp, Homo sapiens
acttgaaccataaa

SEQ ID NO: 1374557 - DNA, 15 bp, Homo sapiens
acttgaaccataaaa

SEQ ID NO: 1374558 - DNA, 17 bp, Homo sapiens
acttgaaccataaaatg

SEQ ID NO: 1374559 - DNA, 22 bp, Homo sapiens
acttgaaccataaaatgtccag

SEQ ID NO: 1374560 - DNA, 12 bp, Homo sapiens
acttgcctgggt

SEQ ID NO: 1374561 - DNA, 18 bp, Homo sapiens
acttgcttaaatttctta

SEQ ID NO: 1374562 - DNA, 23 bp, Homo sapiens
acttgcttaaatttcttatgtga

SEQ ID NO: 1374563 - DNA, 21 bp, Homo sapiens
acttggctcgaatctctgtgc

SEQ ID NO: 1374564 - DNA, 22 bp, Homo sapiens
acttggctcgaatctctgtgcc

SEQ ID NO: 1374565 - DNA, 22 bp, Homo sapiens
acttgggaggctgaggcaggag

SEQ ID NO: 1374566 - DNA, 14 bp, Homo sapiens
acttgggccactgt

SEQ ID NO: 1374567 - DNA, 15 bp, Homo sapiens
acttgggccactgtg

SEQ ID NO: 1374568 - DNA, 12 bp, Homo sapiens
acttgtagattt

SEQ ID NO: 1374569 - DNA, 17 bp, Homo sapiens
acttgtagatttgattt

SEQ ID NO: 1374570 - DNA, 18 bp, Homo sapiens
acttgtagatttgatttt

SEQ ID NO: 1374571 - DNA, 18 bp, Homo sapiens
acttgtattaaagacaga

SEQ ID NO: 1374572 - DNA, 19 bp, Homo sapiens
acttgttttggatggcttg

SEQ ID NO: 1374573 - DNA, 19 bp, Homo sapiens
actttacagaaatggactg

SEQ ID NO: 1374574 - DNA, 13 bp, Homo sapiens
actttacccacct

SEQ ID NO: 1374575 - DNA, 21 bp, Homo sapiens
actttccgaaaaataaagaca

SEQ ID NO: 1374576 - DNA, 13 bp, Homo sapiens
actttctgcctgg

SEQ ID NO: 1374577 - DNA, 14 bp, Homo sapiens
actttctgttatgg

SEQ ID NO: 1374578 - DNA, 10 bp, Homo sapiens
actttgatgt

SEQ ID NO: 1374579 - DNA, 22 bp, Homo sapiens
actttgatgtcagcagttgctg

SEQ ID NO: 1374580 - DNA, 12 bp, Homo sapiens
actttgggaggc

SEQ ID NO: 1374581 - DNA, 21 bp, Homo sapiens
actttgtaaaaatcttttgaa

SEQ ID NO: 1374582 - DNA, 13 bp, Homo sapiens
actttgtaaatag

SEQ ID NO: 1374583 - DNA, 23 bp, Homo sapiens
actttgtaaataggatttttaga

SEQ ID NO: 1374584 - DNA, 21 bp, Homo sapiens
agcactttgggaggccgaggc

SEQ ID NO: 1374585 - DNA, 14 bp, Homo sapiens
agcagaggaccagg

SEQ ID NO: 1374586 - DNA, 23 bp, Homo sapiens
agcagagttttcattaaatcctt

SEQ ID NO: 1374587 - DNA, 15 bp, Homo sapiens
agcagcaaattttca

SEQ ID NO: 1374588 - DNA, 13 bp, Homo sapiens
agcagcccaccct

SEQ ID NO: 1374589 - DNA, 16 bp, Homo sapiens
agcagcccaccctgct

SEQ ID NO: 1374590 - DNA, 20 bp, Homo sapiens
agcagcccaccctgctgctg

SEQ ID NO: 1374591 - DNA, 22 bp, Homo sapiens
agcagcttataatgggctctcc

SEQ ID NO: 1374592 - DNA, 19 bp, Homo sapiens
agcaggcacgggtggtccc

SEQ ID NO: 1374593 - DNA, 19 bp, Homo sapiens
agcaggtgattggaccagg

SEQ ID NO: 1374594 - DNA, 15 bp, Homo sapiens
agcagtaagggaaca

SEQ ID NO: 1374595 - DNA, 19 bp, Homo sapiens
agcagtcgtgcctgtgtcc

SEQ ID NO: 1374596 - DNA, 17 bp, Homo sapiens
agcagttgctggtaaaa

SEQ ID NO: 1374597 - DNA, 20 bp, Homo sapiens
agcagttgctggtaaaatga

SEQ ID NO: 1374598 - DNA, 21 bp, Homo sapiens
agcagttgctggtaaaatgaa

SEQ ID NO: 1374599 - DNA, 23 bp, Homo sapiens
agcagttgctggtaaaatgaaga

SEQ ID NO: 1374600 - DNA, 19 bp, Homo sapiens
agcataaaaattagccaag

SEQ ID NO: 1374601 - DNA, 23 bp, Homo sapiens
agcataaaaattagccaagtgtg

SEQ ID NO: 1374602 - DNA, 22 bp, Homo sapiens
agcataatttaaaaatatattt

SEQ ID NO: 1374603 - DNA, 22 bp, Homo sapiens
agcatactttgtaaataggatt

SEQ ID NO: 1374604 - DNA, 20 bp, Homo sapiens
agcatagaaaccactagaaa

SEQ ID NO: 1374605 - DNA, 20 bp, Homo sapiens
agcatatgggttagatgttg

SEQ ID NO: 1374606 - DNA, 13 bp, Homo sapiens
agcatcacctgcc

SEQ ID NO: 1374607 - DNA, 15 bp, Homo sapiens
agcatcacctgcctg

SEQ ID NO: 1374608 - DNA, 22 bp, Homo sapiens
agcatcagggttaagaagactt

SEQ ID NO: 1374609 - DNA, 15 bp, Homo sapiens
agcatcggcctaggg

SEQ ID NO: 1374610 - DNA, 19 bp, Homo sapiens
agcatcttgggggggtggc

SEQ ID NO: 1374611 - DNA, 21 bp, Homo sapiens
agcatcttgggggggtggccg

SEQ ID NO: 1374612 - DNA, 23 bp, Homo sapiens
agcatcttgggggggtggccgct

SEQ ID NO: 1374613 - DNA, 19 bp, Homo sapiens
agcatgaaataaaatatat

SEQ ID NO: 1374614 - DNA, 17 bp, Homo sapiens
agcatgaaatgtgaatt

SEQ ID NO: 1374615 - DNA, 22 bp, Homo sapiens
agcatgaaatgtgaatttttat

SEQ ID NO: 1374616 - DNA, 20 bp, Homo sapiens
agcatgaagtcttaaggaca

SEQ ID NO: 1374617 - DNA, 17 bp, Homo sapiens
agcatgcttgtgaaaat

SEQ ID NO: 1374618 - DNA, 21 bp, Homo sapiens
agcatggtacttggcctttgg

SEQ ID NO: 1374619 - DNA, 22 bp, Homo sapiens
agcattgtaagcgtatggcttt

SEQ ID NO: 1374620 - DNA, 16 bp, Homo sapiens
agcatttagctggcca

SEQ ID NO: 1374621 - DNA, 18 bp, Homo sapiens
agcatttagtcttgccag

SEQ ID NO: 1374622 - DNA, 17 bp, Homo sapiens
agccaaaatgtaggctt

SEQ ID NO: 1374623 - DNA, 18 bp, Homo sapiens
agccaaaattaaggtgtt

SEQ ID NO: 1374624 - DNA, 22 bp, Homo sapiens
agccaagattttcctcttgtga

SEQ ID NO: 1374625 - DNA, 17 bp, Homo sapiens
agccaagggaacctgtg

SEQ ID NO: 1374626 - DNA, 20 bp, Homo sapiens
agccaagtggggtgctggga

SEQ ID NO: 1374627 - DNA, 22 bp, Homo sapiens
agccaagttttataatccttaa

SEQ ID NO: 1374628 - DNA, 19 bp, Homo sapiens
agccaatctacaatctctt

SEQ ID NO: 1374629 - DNA, 22 bp, Homo sapiens
agccaatctacaatctcttttt

SEQ ID NO: 1374630 - DNA, 15 bp, Homo sapiens
agccagaccagatta

SEQ ID NO: 1374631 - DNA, 18 bp, Homo sapiens
agccagaggctgggttca

SEQ ID NO: 1374632 - DNA, 18 bp, Homo sapiens
agccagatttgtcttttt

SEQ ID NO: 1374633 - DNA, 17 bp, Homo sapiens
agccagcccctcttccc

SEQ ID NO: 1374634 - DNA, 15 bp, Homo sapiens
agccagcgcctccct

SEQ ID NO: 1374635 - DNA, 19 bp, Homo sapiens
agccagcgcctccctccac

SEQ ID NO: 1374636 - DNA, 19 bp, Homo sapiens
agccagctccctctattta

SEQ ID NO: 1374637 - DNA, 22 bp, Homo sapiens
agccagctccctctatttatgt

SEQ ID NO: 1374638 - DNA, 15 bp, Homo sapiens
agccaggctcactca

SEQ ID NO: 1374639 - DNA, 13 bp, Homo sapiens
agccataaatgat

SEQ ID NO: 1374640 - DNA, 21 bp, Homo sapiens
agccatacataaaagaaataa

SEQ ID NO: 1374641 - DNA, 23 bp, Homo sapiens
agccatacataaaagaaataaac

SEQ ID NO: 1374642 - DNA, 16 bp, Homo sapiens
agccatgccagctggc

SEQ ID NO: 1374643 - DNA, 17 bp, Homo sapiens
agccatgccagctggcc

SEQ ID NO: 1374644 - DNA, 16 bp, Homo sapiens
agccatgcgccccctc

SEQ ID NO: 1374645 - DNA, 23 bp, Homo sapiens
agccatgcgccccctccgccctg

SEQ ID NO: 1374646 - DNA, 22 bp, Homo sapiens
agcccaccctgctgctggtgca

SEQ ID NO: 1374647 - DNA, 15 bp, Homo sapiens
agcccagtagacctt

SEQ ID NO: 1374648 - DNA, 16 bp, Homo sapiens
agcccatcctgaccag

SEQ ID NO: 1374649 - DNA, 23 bp, Homo sapiens
agcccatcctgaccagctgctcc

SEQ ID NO: 1374650 - DNA, 18 bp, Homo sapiens
agcccatcgccacaaact

SEQ ID NO: 1374651 - DNA, 12 bp, Homo sapiens
agccccactgcc

SEQ ID NO: 1374652 - DNA, 14 bp, Homo sapiens
agccccactgccag

SEQ ID NO: 1374653 - DNA, 19 bp, Homo sapiens
agccccactgccagcagca

SEQ ID NO: 1374654 - DNA, 15 bp, Homo sapiens
agccccagcctgcta

SEQ ID NO: 1374655 - DNA, 15 bp, Homo sapiens
agccccctggcctct

SEQ ID NO: 1374656 - DNA, 14 bp, Homo sapiens
agccccgactccag

SEQ ID NO: 1374657 - DNA, 22 bp, Homo sapiens
agccccgactccagccagcgcc

SEQ ID NO: 1374658 - DNA, 23 bp, Homo sapiens
agccccgactccagccagcgcct

SEQ ID NO: 1374659 - DNA, 20 bp, Homo sapiens
agccccgcgaccatgtggcc

SEQ ID NO: 1374660 - DNA, 23 bp, Homo sapiens
agccccgcgaccatgtggccaca

SEQ ID NO: 1374661 - DNA, 24 bp, Homo sapiens
agccccggggtgagtccattctcc

SEQ ID NO: 1374662 - DNA, 12 bp, Homo sapiens
agcccctctggt

SEQ ID NO: 1374663 - DNA, 20 bp, Homo sapiens
agcccctctggtcgctcctg

SEQ ID NO: 1374664 - DNA, 22 bp, Homo sapiens
agcccctctggtcgctcctgcc

SEQ ID NO: 1374665 - DNA, 14 bp, Homo sapiens
agcccggccgctcc

SEQ ID NO: 1374666 - DNA, 19 bp, Homo sapiens
agccctaaggtcctaaggc

SEQ ID NO: 1374667 - DNA, 13 bp, Homo sapiens
agccctactccct

SEQ ID NO: 1374668 - DNA, 15 bp, Homo sapiens
agccctactccctgc

SEQ ID NO: 1374669 - DNA, 16 bp, Homo sapiens
agccctactccctgca

SEQ ID NO: 1374670 - DNA, 18 bp, Homo sapiens
agccctactccctgcaga

SEQ ID NO: 1374671 - DNA, 21 bp, Homo sapiens
agccctactccctgcagatgc

SEQ ID NO: 1374672 - DNA, 12 bp, Homo sapiens
agccctggctgt

SEQ ID NO: 1374673 - DNA, 13 bp, Homo sapiens
agcccttgcctcc

SEQ ID NO: 1374674 - DNA, 14 bp, Homo sapiens
agcccttgcctccc

SEQ ID NO: 1374675 - DNA, 21 bp, Homo sapiens
agccgccatgctcctggccca

SEQ ID NO: 1374676 - DNA, 18 bp, Homo sapiens
agccggtaactgtcctgt

SEQ ID NO: 1374677 - DNA, 20 bp, Homo sapiens
agccggtaactgtcctgtcc

SEQ ID NO: 1374678 - DNA, 19 bp, Homo sapiens
agcctagaagagcttctga

SEQ ID NO: 1374679 - DNA, 14 bp, Homo sapiens
agcctatggcagaa

SEQ ID NO: 1374680 - DNA, 17 bp, Homo sapiens
agcctcagccccctgct

SEQ ID NO: 1374681 - DNA, 15 bp, Homo sapiens
agcctccacagcgag

SEQ ID NO: 1374682 - DNA, 16 bp, Homo sapiens
agcctccgagagggag

SEQ ID NO: 1374683 - DNA, 17 bp, Homo sapiens
agcctcctgctgccaca

SEQ ID NO: 1374684 - DNA, 17 bp, Homo sapiens
agcctccttagaaaaaa

SEQ ID NO: 1374685 - DNA, 18 bp, Homo sapiens
agcctctccccaggtcca

SEQ ID NO: 1374686 - DNA, 23 bp, Homo sapiens
agcctctgaaaaccaatgttctc

SEQ ID NO: 1374687 - DNA, 16 bp, Homo sapiens
agcctctgtcaggcct

SEQ ID NO: 1374688 - DNA, 22 bp, Homo sapiens
agcctgagtaaagttaaaagaa

SEQ ID NO: 1374689 - DNA, 19 bp, Homo sapiens
agcctgatgagatttttaa

SEQ ID NO: 1374690 - DNA, 23 bp, Homo sapiens
agcctgcagggaagccccacatg

SEQ ID NO: 1374691 - DNA, 12 bp, Homo sapiens
agcctgcccagc

SEQ ID NO: 1374692 - DNA, 16 bp, Homo sapiens
agcctgcctcttctct

SEQ ID NO: 1374693 - DNA, 15 bp, Homo sapiens
agcctgcgcctgctg

SEQ ID NO: 1374694 - DNA, 16 bp, Homo sapiens
agcctgcgcctgctgc

SEQ ID NO: 1374695 - DNA, 17 bp, Homo sapiens
agcctgcgcctgctgca

SEQ ID NO: 1374696 - DNA, 9 bp, Homo sapiens
agcctgcta

SEQ ID NO: 1374697 - DNA, 12 bp, Homo sapiens
agcctgctagct

SEQ ID NO: 1374698 - DNA, 18 bp, Homo sapiens
agcctgctagctagctca

SEQ ID NO: 1374699 - DNA, 17 bp, Homo sapiens
agcctgctccagctgtt

SEQ ID NO: 1374700 - DNA, 22 bp, Homo sapiens
agcctgctccagctgttcagct

SEQ ID NO: 1374701 - DNA, 14 bp, Homo sapiens
aggacccaggaaag

SEQ ID NO: 1374702 - DNA, 19 bp, Homo sapiens
aggacgccactcatttcat

SEQ ID NO: 1374703 - DNA, 20 bp, Homo sapiens
aggacgccactcatttcatc

SEQ ID NO: 1374704 - DNA, 23 bp, Homo sapiens
aggacgccactcatttcatctca

SEQ ID NO: 1374705 - DNA, 16 bp, Homo sapiens
aggactgactgaggca

SEQ ID NO: 1374706 - DNA, 13 bp, Homo sapiens
aggactttgtaca

SEQ ID NO: 1374707 - DNA, 20 bp, Homo sapiens
aggagaatggcgtgaacccg

SEQ ID NO: 1374708 - DNA, 16 bp, Homo sapiens
aggagacaaaagagca

SEQ ID NO: 1374709 - DNA, 14 bp, Homo sapiens
aggagaggggcaca

SEQ ID NO: 1374710 - DNA, 20 bp, Homo sapiens
aggagatcgagaccatcctg

SEQ ID NO: 1374711 - DNA, 16 bp, Homo sapiens
aggagcaggcacgggt

SEQ ID NO: 1374712 - DNA, 18 bp, Homo sapiens
aggagctgccttggctca

SEQ ID NO: 1374713 - DNA, 14 bp, Homo sapiens
aggaggaaggcaag

SEQ ID NO: 1374714 - DNA, 20 bp, Homo sapiens
aggaggcaggcatggccctg

SEQ ID NO: 1374715 - DNA, 22 bp, Homo sapiens
aggaggcaggcatggccctggg

SEQ ID NO: 1374716 - DNA, 14 bp, Homo sapiens
aggagggagaggga

SEQ ID NO: 1374717 - DNA, 14 bp, Homo sapiens
aggagggtgggaag

SEQ ID NO: 1374718 - DNA, 13 bp, Homo sapiens
aggagggtggggg

SEQ ID NO: 1374719 - DNA, 20 bp, Homo sapiens
aggagtccactttgtttcgt

SEQ ID NO: 1374720 - DNA, 20 bp, Homo sapiens
aggatagctaactgtaaatc

SEQ ID NO: 1374721 - DNA, 18 bp, Homo sapiens
aggatcccctccaagcct

SEQ ID NO: 1374722 - DNA, 23 bp, Homo sapiens
aggatgatgtctttttattaaaa

SEQ ID NO: 1374723 - DNA, 15 bp, Homo sapiens
aggattagtttagaa

SEQ ID NO: 1374724 - DNA, 18 bp, Homo sapiens
aggattagtttagaacag

SEQ ID NO: 1374725 - DNA, 21 bp, Homo sapiens
aggattttggatgttgagagg

SEQ ID NO: 1374726 - DNA, 17 bp, Homo sapiens
aggcaaagaaaatgaaa

SEQ ID NO: 1374727 - DNA, 14 bp, Homo sapiens
aggcaaagctggct

SEQ ID NO: 1374728 - DNA, 20 bp, Homo sapiens
aggcaaggctatgtgattac

SEQ ID NO: 1374729 - DNA, 13 bp, Homo sapiens
aggcaccaggaag

SEQ ID NO: 1374730 - DNA, 14 bp, Homo sapiens
aggcacctcttcct

SEQ ID NO: 1374731 - DNA, 16 bp, Homo sapiens
aggcacgggtggtccc

SEQ ID NO: 1374732 - DNA, 17 bp, Homo sapiens
aggcacgggtggtcccc

SEQ ID NO: 1374733 - DNA, 20 bp, Homo sapiens
aggcagattttacagagcgc

SEQ ID NO: 1374734 - DNA, 19 bp, Homo sapiens
aggcagccaacctaagcaa

SEQ ID NO: 1374735 - DNA, 21 bp, Homo sapiens
aggcagcctctgtcaggcctt

SEQ ID NO: 1374736 - DNA, 18 bp, Homo sapiens
aggcaggagaatggtgtg

SEQ ID NO: 1374737 - DNA, 18 bp, Homo sapiens
aggcaggattgaaaatgt

SEQ ID NO: 1374738 - DNA, 14 bp, Homo sapiens
aggcaggcatggcc

SEQ ID NO: 1374739 - DNA, 15 bp, Homo sapiens
aggcagtttgaggat

SEQ ID NO: 1374740 - DNA, 23 bp, Homo sapiens
aggcagtttgaggattagtttag

SEQ ID NO: 1374741 - DNA, 22 bp, Homo sapiens
aggcatagaggcttctccgcca

SEQ ID NO: 1374742 - DNA, 19 bp, Homo sapiens
aggcatctgtgggcatggt

SEQ ID NO: 1374743 - DNA, 14 bp, Homo sapiens
aggcatggccctgg

SEQ ID NO: 1374744 - DNA, 16 bp, Homo sapiens
aggcatttgctgaata

SEQ ID NO: 1374745 - DNA, 16 bp, Homo sapiens
aggccaagaatattgc

SEQ ID NO: 1374746 - DNA, 22 bp, Homo sapiens
aggccagcctccgagagggaga

SEQ ID NO: 1374747 - DNA, 16 bp, Homo sapiens
aggccattctgccgcc

SEQ ID NO: 1374748 - DNA, 13 bp, Homo sapiens
aggcccccacttg

SEQ ID NO: 1374749 - DNA, 17 bp, Homo sapiens
aggcccccacttgcctc

SEQ ID NO: 1374750 - DNA, 17 bp, Homo sapiens
aggcccccagcccaggg

SEQ ID NO: 1374751 - DNA, 15 bp, Homo sapiens
aggccctgagacagg

SEQ ID NO: 1374752 - DNA, 14 bp, Homo sapiens
aggccctggcctcc

SEQ ID NO: 1374753 - DNA, 22 bp, Homo sapiens
aggccctggcctcccctgccac

SEQ ID NO: 1374754 - DNA, 14 bp, Homo sapiens
aggccctttgctgt

SEQ ID NO: 1374755 - DNA, 19 bp, Homo sapiens
aggccggcagccccagcct

SEQ ID NO: 1374756 - DNA, 23 bp, Homo sapiens
aggccggcagccccagcctgcta

SEQ ID NO: 1374757 - DNA, 21 bp, Homo sapiens
aggccgttgctgacttagaat

SEQ ID NO: 1374758 - DNA, 19 bp, Homo sapiens
aggcctaccccgcagacac

SEQ ID NO: 1374759 - DNA, 22 bp, Homo sapiens
aggcctaccccgcagacacctt

SEQ ID NO: 1374760 - DNA, 13 bp, Homo sapiens
aggcctatttcat

SEQ ID NO: 1374761 - DNA, 14 bp, Homo sapiens
aggcctatttcatc

SEQ ID NO: 1374762 - DNA, 22 bp, Homo sapiens
aggcctgcctcccacttcactg

SEQ ID NO: 1374763 - DNA, 17 bp, Homo sapiens
aggcctgcgaccctggg

SEQ ID NO: 1374764 - DNA, 23 bp, Homo sapiens
aggcctgctccctgtagggtcca

SEQ ID NO: 1374765 - DNA, 20 bp, Homo sapiens
aggcctgggccgctgccacg

SEQ ID NO: 1374766 - DNA, 17 bp, Homo sapiens
aggcctggtgtttcttg

SEQ ID NO: 1374767 - DNA, 21 bp, Homo sapiens
aggccttcagggttcagcagt

SEQ ID NO: 1374768 - DNA, 19 bp, Homo sapiens
aggccttcctctctccaga

SEQ ID NO: 1374769 - DNA, 19 bp, Homo sapiens
aggctaaggcaggaaaatt

SEQ ID NO: 1374770 - DNA, 15 bp, Homo sapiens
aggctagcttctgct

SEQ ID NO: 1374771 - DNA, 19 bp, Homo sapiens
aggctatgtataaaataca

SEQ ID NO: 1374772 - DNA, 22 bp, Homo sapiens
aggctcactgcaacttctgcct

SEQ ID NO: 1374773 - DNA, 14 bp, Homo sapiens
aggctcccctgagg

SEQ ID NO: 1374774 - DNA, 23 bp, Homo sapiens
aggctctattccaataaactatg

SEQ ID NO: 1374775 - DNA, 21 bp, Homo sapiens
aggctgatgtcaatttctgtg

SEQ ID NO: 1374776 - DNA, 19 bp, Homo sapiens
aggctgcagtgagccgaga

SEQ ID NO: 1374777 - DNA, 15 bp, Homo sapiens
aggctggccagtcca

SEQ ID NO: 1374778 - DNA, 17 bp, Homo sapiens
aggctggccagtccagg

SEQ ID NO: 1374779 - DNA, 18 bp, Homo sapiens
aggctgggccatgtccaa

SEQ ID NO: 1374780 - DNA, 21 bp, Homo sapiens
aggctgggccatgtccaaaga

SEQ ID NO: 1374781 - DNA, 22 bp, Homo sapiens
aggctgggccatgtccaaagag

SEQ ID NO: 1374782 - DNA, 17 bp, Homo sapiens
aggctgggggaagaagc

SEQ ID NO: 1374783 - DNA, 22 bp, Homo sapiens
aggctgggggaagaagctctct

SEQ ID NO: 1374784 - DNA, 19 bp, Homo sapiens
aggctggtacaacggaggc

SEQ ID NO: 1374785 - DNA, 15 bp, Homo sapiens
aggctgtgctgccct

SEQ ID NO: 1374786 - DNA, 16 bp, Homo sapiens
aggctgtgctgccctg

SEQ ID NO: 1374787 - DNA, 16 bp, Homo sapiens
aggcttataaaacaga

SEQ ID NO: 1374788 - DNA, 21 bp, Homo sapiens
aggcttcctgcgtcctcctca

SEQ ID NO: 1374789 - DNA, 14 bp, Homo sapiens
aggcttctccgcca

SEQ ID NO: 1374790 - DNA, 16 bp, Homo sapiens
aggcttctccgccagc

SEQ ID NO: 1374791 - DNA, 18 bp, Homo sapiens
aggcttctccgccagcct

SEQ ID NO: 1374792 - DNA, 19 bp, Homo sapiens
agggaaaggggtgctttta

SEQ ID NO: 1374793 - DNA, 14 bp, Homo sapiens
agggaacctgtgtc

SEQ ID NO: 1374794 - DNA, 15 bp, Homo sapiens
agggacacacagcct

SEQ ID NO: 1374795 - DNA, 16 bp, Homo sapiens
agggagaagaaaggtg

SEQ ID NO: 1374796 - DNA, 21 bp, Homo sapiens
agggagactgggtaggaaaga

SEQ ID NO: 1374797 - DNA, 14 bp, Homo sapiens
agggagagggaggt

SEQ ID NO: 1374798 - DNA, 15 bp, Homo sapiens
agggagctgggcccg

SEQ ID NO: 1374799 - DNA, 20 bp, Homo sapiens
agggaggcgggggctgccct

SEQ ID NO: 1374800 - DNA, 15 bp, Homo sapiens
agggagggcttctgc

SEQ ID NO: 1374801 - DNA, 21 bp, Homo sapiens
agggaggggaaaagcattttt

SEQ ID NO: 1374802 - DNA, 15 bp, Homo sapiens
agggagtattctaat

SEQ ID NO: 1374803 - DNA, 20 bp, Homo sapiens
agggataaagaaaaaaatac

SEQ ID NO: 1374804 - DNA, 23 bp, Homo sapiens
agggataaagaaaaaaatactat

SEQ ID NO: 1374805 - DNA, 20 bp, Homo sapiens
agggatgcaggctcccctga

SEQ ID NO: 1374806 - DNA, 12 bp, Homo sapiens
agggcagctgct

SEQ ID NO: 1374807 - DNA, 13 bp, Homo sapiens
agggcagctgcta

SEQ ID NO: 1374808 - DNA, 20 bp, Homo sapiens
agggcataaagtaaatacat

SEQ ID NO: 1374809 - DNA, 16 bp, Homo sapiens
agggccatggctcagg

SEQ ID NO: 1374810 - DNA, 18 bp, Homo sapiens
agggcccccacagttgct

SEQ ID NO: 1374811 - DNA, 21 bp, Homo sapiens
agggccttggaaattcctgta

SEQ ID NO: 1374812 - DNA, 15 bp, Homo sapiens
agggcggcaggggcc

SEQ ID NO: 1374813 - DNA, 14 bp, Homo sapiens
agggctcccagggg

SEQ ID NO: 1374814 - DNA, 22 bp, Homo sapiens
agggctcccaggggtctccctg

SEQ ID NO: 1374815 - DNA, 21 bp, Homo sapiens
agggctgcggcgtacaggctg

SEQ ID NO: 1374816 - DNA, 12 bp, Homo sapiens
agggctgctggg

SEQ ID NO: 1374817 - DNA, 20 bp, Homo sapiens
agggctgctgggggcaactg

SEQ ID NO: 1374818 - DNA, 14 bp, Homo sapiens
ataaattttgaaaa

SEQ ID NO: 1374819 - DNA, 13 bp, Homo sapiens
ataacagctgcaa

SEQ ID NO: 1374820 - DNA, 18 bp, Homo sapiens
ataactgtatttgaaata

SEQ ID NO: 1374821 - DNA, 15 bp, Homo sapiens
ataactgtgtactgt

SEQ ID NO: 1374822 - DNA, 16 bp, Homo sapiens
ataagaaaatatattc

SEQ ID NO: 1374823 - DNA, 14 bp, Homo sapiens
ataagaatttgcat

SEQ ID NO: 1374824 - DNA, 15 bp, Homo sapiens
ataagaatttgcata

SEQ ID NO: 1374825 - DNA, 23 bp, Homo sapiens
ataagacaaatattcctttgcat

SEQ ID NO: 1374826 - DNA, 17 bp, Homo sapiens
ataagcaatcaaggtta

SEQ ID NO: 1374827 - DNA, 17 bp, Homo sapiens
ataagcactgtaaactt

SEQ ID NO: 1374828 - DNA, 22 bp, Homo sapiens
ataagctactagcaaaataaaa

SEQ ID NO: 1374829 - DNA, 14 bp, Homo sapiens
ataagctagttgaa

SEQ ID NO: 1374830 - DNA, 16 bp, Homo sapiens
ataagttattgcagtt

SEQ ID NO: 1374831 - DNA, 24 bp, Homo sapiens
ataagttattgcagtttatcattc

SEQ ID NO: 1374832 - DNA, 14 bp, Homo sapiens
ataatactgaacca

SEQ ID NO: 1374833 - DNA, 15 bp, Homo sapiens
ataatactgaaccac

SEQ ID NO: 1374834 - DNA, 12 bp, Homo sapiens
ataatataaaaa

SEQ ID NO: 1374835 - DNA, 15 bp, Homo sapiens
ataatatattttctg

SEQ ID NO: 1374836 - DNA, 16 bp, Homo sapiens
ataatattgtttggta

SEQ ID NO: 1374837 - DNA, 21 bp, Homo sapiens
ataatcaagagccttaaaaca

SEQ ID NO: 1374838 - DNA, 14 bp, Homo sapiens
ataatgaataaatc

SEQ ID NO: 1374839 - DNA, 14 bp, Homo sapiens
ataatgctacaatt

SEQ ID NO: 1374840 - DNA, 20 bp, Homo sapiens
ataatgctacaattttaaga

SEQ ID NO: 1374841 - DNA, 15 bp, Homo sapiens
ataattgttctcaga

SEQ ID NO: 1374842 - DNA, 21 bp, Homo sapiens
ataatttaaaaatatatttat

SEQ ID NO: 1374843 - DNA, 15 bp, Homo sapiens
atacaaatgcatctt

SEQ ID NO: 1374844 - DNA, 17 bp, Homo sapiens
atacaaatgcatctttg

SEQ ID NO: 1374845 - DNA, 15 bp, Homo sapiens
atacacatatagtgt

SEQ ID NO: 1374846 - DNA, 19 bp, Homo sapiens
atacacgaatagacatcaa

SEQ ID NO: 1374847 - DNA, 18 bp, Homo sapiens
atacataaaagaaataaa

SEQ ID NO: 1374848 - DNA, 20 bp, Homo sapiens
atacataaaagaaataaacc

SEQ ID NO: 1374849 - DNA, 16 bp, Homo sapiens
atacatagtgaaaatt

SEQ ID NO: 1374850 - DNA, 18 bp, Homo sapiens
atacatatggatgttact

SEQ ID NO: 1374851 - DNA, 13 bp, Homo sapiens
atacatgaagctt

SEQ ID NO: 1374852 - DNA, 21 bp, Homo sapiens
atacattcaaatttgtctggt

SEQ ID NO: 1374853 - DNA, 20 bp, Homo sapiens
atacattttttaagcttcag

SEQ ID NO: 1374854 - DNA, 22 bp, Homo sapiens
ataccatttagtaagaatacca

SEQ ID NO: 1374855 - DNA, 13 bp, Homo sapiens
atactatttaaga

SEQ ID NO: 1374856 - DNA, 15 bp, Homo sapiens
atactgaaggaaaaa

SEQ ID NO: 1374857 - DNA, 22 bp, Homo sapiens
atactgaaggaaaaacacaagc

SEQ ID NO: 1374858 - DNA, 22 bp, Homo sapiens
atactgatggaatttttttgta

SEQ ID NO: 1374859 - DNA, 22 bp, Homo sapiens
atactgcgactttctgcctgga

SEQ ID NO: 1374860 - DNA, 23 bp, Homo sapiens
atactggcttcaccatcaatcct

SEQ ID NO: 1374861 - DNA, 16 bp, Homo sapiens
atacttgaaccataaa

SEQ ID NO: 1374862 - DNA, 17 bp, Homo sapiens
atacttgaaccataaaa

SEQ ID NO: 1374863 - DNA, 13 bp, Homo sapiens
atactttgtattg

SEQ ID NO: 1374864 - DNA, 13 bp, Homo sapiens
atactttgtattt

SEQ ID NO: 1374865 - DNA, 20 bp, Homo sapiens
atagaaatggaaattttgct

SEQ ID NO: 1374866 - DNA, 16 bp, Homo sapiens
atagaaattttgtaag

SEQ ID NO: 1374867 - DNA, 12 bp, Homo sapiens
atagacatgaaa

SEQ ID NO: 1374868 - DNA, 19 bp, Homo sapiens
atagactgtaacttccaaa

SEQ ID NO: 1374869 - DNA, 12 bp, Homo sapiens
atagaggctagc

SEQ ID NO: 1374870 - DNA, 21 bp, Homo sapiens
atagaggcttctccgccagcc

SEQ ID NO: 1374871 - DNA, 23 bp, Homo sapiens
atagaggcttctccgccagcctc

SEQ ID NO: 1374872 - DNA, 15 bp, Homo sapiens
atagataatattgtt

SEQ ID NO: 1374873 - DNA, 19 bp, Homo sapiens
atagatctccagcgtcagc

SEQ ID NO: 1374874 - DNA, 13 bp, Homo sapiens
atagcatcactta

SEQ ID NO: 1374875 - DNA, 18 bp, Homo sapiens
atagcatcacttaaaaca

SEQ ID NO: 1374876 - DNA, 18 bp, Homo sapiens
atagcctggactgctacc

SEQ ID NO: 1374877 - DNA, 17 bp, Homo sapiens
atagctaactgtaaatc

SEQ ID NO: 1374878 - DNA, 18 bp, Homo sapiens
ataggaatcattcagaaa

SEQ ID NO: 1374879 - DNA, 14 bp, Homo sapiens
ataggacctttcca

SEQ ID NO: 1374880 - DNA, 22 bp, Homo sapiens
ataggctattttctaaagactt

SEQ ID NO: 1374881 - DNA, 22 bp, Homo sapiens
atagtagatgtggcctttgaat

SEQ ID NO: 1374882 - DNA, 15 bp, Homo sapiens
atagtgggatttcca

SEQ ID NO: 1374883 - DNA, 12 bp, Homo sapiens
atagttactgtg

SEQ ID NO: 1374884 - DNA, 16 bp, Homo sapiens
atagttactgtgtaaa

SEQ ID NO: 1374885 - DNA, 17 bp, Homo sapiens
atagttactgtgtaaac

SEQ ID NO: 1374886 - DNA, 20 bp, Homo sapiens
atagttactgtgtaaactca

SEQ ID NO: 1374887 - DNA, 14 bp, Homo sapiens
atagttatgtaaat

SEQ ID NO: 1374888 - DNA, 18 bp, Homo sapiens
atagttatgtaaataatt

SEQ ID NO: 1374889 - DNA, 19 bp, Homo sapiens
atagttatgtaaataattc

SEQ ID NO: 1374890 - DNA, 23 bp, Homo sapiens
atagttggaggtgattccagtga

SEQ ID NO: 1374891 - DNA, 18 bp, Homo sapiens
atagtttctttattttgt

SEQ ID NO: 1374892 - DNA, 22 bp, Homo sapiens
atagtttctttattttgtgtaa

SEQ ID NO: 1374893 - DNA, 17 bp, Homo sapiens
atagtttggcatttgca

SEQ ID NO: 1374894 - DNA, 19 bp, Homo sapiens
atataaagtagtcctgtga

SEQ ID NO: 1374895 - DNA, 18 bp, Homo sapiens
atataaatgtataaatat

SEQ ID NO: 1374896 - DNA, 17 bp, Homo sapiens
atataactgtatttgaa

SEQ ID NO: 1374897 - DNA, 13 bp, Homo sapiens
atatagtgtacag

SEQ ID NO: 1374898 - DNA, 21 bp, Homo sapiens
atatataaaacggtgctgtga

SEQ ID NO: 1374899 - DNA, 14 bp, Homo sapiens
atatatacatatat

SEQ ID NO: 1374900 - DNA, 16 bp, Homo sapiens
atatatataaatgtat

SEQ ID NO: 1374901 - DNA, 15 bp, Homo sapiens
atatatatatataac

SEQ ID NO: 1374902 - DNA, 15 bp, Homo sapiens
atatatatctatata

SEQ ID NO: 1374903 - DNA, 21 bp, Homo sapiens
atatatatctatctatttgag

SEQ ID NO: 1374904 - DNA, 15 bp, Homo sapiens
atatatctatctatt

SEQ ID NO: 1374905 - DNA, 16 bp, Homo sapiens
atatatctctatttga

SEQ ID NO: 1374906 - DNA, 17 bp, Homo sapiens
atatattacaagggata

SEQ ID NO: 1374907 - DNA, 13 bp, Homo sapiens
atatattattata

SEQ ID NO: 1374908 - DNA, 14 bp, Homo sapiens
atatattattataa

SEQ ID NO: 1374909 - DNA, 19 bp, Homo sapiens
atatatttctaaatgtttg

SEQ ID NO: 1374910 - DNA, 19 bp, Homo sapiens
atatattttgtgtgaaatt

SEQ ID NO: 1374911 - DNA, 22 bp, Homo sapiens
atatattttgtgtgaaattgca

SEQ ID NO: 1374912 - DNA, 13 bp, Homo sapiens
atatcaaagtcat

SEQ ID NO: 1374913 - DNA, 21 bp, Homo sapiens
atatcaaagtcattaaagaca

SEQ ID NO: 1374914 - DNA, 23 bp, Homo sapiens
atatcagtaacccccttaaattt

SEQ ID NO: 1374915 - DNA, 13 bp, Homo sapiens
atatcatgcaaaa

SEQ ID NO: 1374916 - DNA, 13 bp, Homo sapiens
atatcctgtgact

SEQ ID NO: 1374917 - DNA, 14 bp, Homo sapiens
atatctaatatata

SEQ ID NO: 1374918 - DNA, 18 bp, Homo sapiens
atatctaatatatatgaa

SEQ ID NO: 1374919 - DNA, 14 bp, Homo sapiens
atatctataaaata

SEQ ID NO: 1374920 - DNA, 15 bp, Homo sapiens
atatctataaaatag

SEQ ID NO: 1374921 - DNA, 14 bp, Homo sapiens
atatctatctattt

SEQ ID NO: 1374922 - DNA, 15 bp, Homo sapiens
atatctattaatata

SEQ ID NO: 1374923 - DNA, 18 bp, Homo sapiens
atatctattaatatatgt

SEQ ID NO: 1374924 - DNA, 17 bp, Homo sapiens
atatcttaatatatttc

SEQ ID NO: 1374925 - DNA, 19 bp, Homo sapiens
atatcttctgatttgtccc

SEQ ID NO: 1374926 - DNA, 23 bp, Homo sapiens
atatgaaaatacaacttaaataa

SEQ ID NO: 1374927 - DNA, 17 bp, Homo sapiens
atatgaacatacaaatg

SEQ ID NO: 1374928 - DNA, 11 bp, Homo sapiens
atatgattaaa

SEQ ID NO: 1374929 - DNA, 22 bp, Homo sapiens
atatgattaaaaatatcaaatt

SEQ ID NO: 1374930 - DNA, 14 bp, Homo sapiens
atatgcaacattgt

SEQ ID NO: 1374931 - DNA, 19 bp, Homo sapiens
atatgctttattaatgttt

SEQ ID NO: 1374932 - DNA, 20 bp, Homo sapiens
atatgctttattaatgtttt

SEQ ID NO: 1374933 - DNA, 22 bp, Homo sapiens
atatggatgttactctcttgca

SEQ ID NO: 1374934 - DNA, 14 bp, Homo sapiens
atatgtatgtgttt

SEQ ID NO: 1374935 - DNA, 22 bp, Homo sapiens
atattaaggaagacaatgtgaa

SEQ ID NO: 1374936 - DNA, 18 bp, Homo sapiens
atgtgacaattttgtaca

SEQ ID NO: 1374937 - DNA, 20 bp, Homo sapiens
atgtgacaattttgtacaaa

SEQ ID NO: 1374938 - DNA, 15 bp, Homo sapiens
atgtgagctcttcct

SEQ ID NO: 1374939 - DNA, 15 bp, Homo sapiens
atgtgagtggttgaa

SEQ ID NO: 1374940 - DNA, 22 bp, Homo sapiens
atgtgagtggttgaatatgatt

SEQ ID NO: 1374941 - DNA, 15 bp, Homo sapiens
atgtgatacattttt

SEQ ID NO: 1374942 - DNA, 15 bp, Homo sapiens
atgtgattacaaggc

SEQ ID NO: 1374943 - DNA, 22 bp, Homo sapiens
atgtggccctggctgccggcac

SEQ ID NO: 1374944 - DNA, 15 bp, Homo sapiens
atgtgtatgcacagt

SEQ ID NO: 1374945 - DNA, 20 bp, Homo sapiens
atgtgttctcggagtgtgta

SEQ ID NO: 1374946 - DNA, 22 bp, Homo sapiens
atgttaaagagaatgagtcctt

SEQ ID NO: 1374947 - DNA, 21 bp, Homo sapiens
atgttattttctgttgaagtt

SEQ ID NO: 1374948 - DNA, 17 bp, Homo sapiens
atgttcctcaaagcttg

SEQ ID NO: 1374949 - DNA, 21 bp, Homo sapiens
atgttctagtctgctttggta

SEQ ID NO: 1374950 - DNA, 16 bp, Homo sapiens
atgttctctcttctcc

SEQ ID NO: 1374951 - DNA, 15 bp, Homo sapiens
atgttgagaggttct

SEQ ID NO: 1374952 - DNA, 18 bp, Homo sapiens
atgttgatcatgtacttt

SEQ ID NO: 1374953 - DNA, 17 bp, Homo sapiens
atgttgatttttactgt

SEQ ID NO: 1374954 - DNA, 21 bp, Homo sapiens
atgttgatttttactgtgttt

SEQ ID NO: 1374955 - DNA, 16 bp, Homo sapiens
atgttgccatgtgttt

SEQ ID NO: 1374956 - DNA, 18 bp, Homo sapiens
atgttgccatgtgtttta

SEQ ID NO: 1374957 - DNA, 12 bp, Homo sapiens
atgttgtagtgt

SEQ ID NO: 1374958 - DNA, 18 bp, Homo sapiens
atgttgtagtgtccccca

SEQ ID NO: 1374959 - DNA, 18 bp, Homo sapiens
atgttgtttataataaaa

SEQ ID NO: 1374960 - DNA, 22 bp, Homo sapiens
atgttgtttataataaaaatat

SEQ ID NO: 1374961 - DNA, 21 bp, Homo sapiens
atgtttaaaacaccttctata

SEQ ID NO: 1374962 - DNA, 15 bp, Homo sapiens
atgtttaaaataaaa

SEQ ID NO: 1374963 - DNA, 17 bp, Homo sapiens
atgtttaaaataaaatg

SEQ ID NO: 1374964 - DNA, 19 bp, Homo sapiens
atgtttaaaataaaatgaa

SEQ ID NO: 1374965 - DNA, 20 bp, Homo sapiens
atgtttatatctgcaaaaaa

SEQ ID NO: 1374966 - DNA, 23 bp, Homo sapiens
atgtttctctttgattatttgca

SEQ ID NO: 1374967 - DNA, 24 bp, Homo sapiens
atgtttctctttgattatttgcat

SEQ ID NO: 1374968 - DNA, 13 bp, Homo sapiens
atgtttggctctg

SEQ ID NO: 1374969 - DNA, 15 bp, Homo sapiens
atgtttggctctgct

SEQ ID NO: 1374970 - DNA, 16 bp, Homo sapiens
atgttttcaaaaggta

SEQ ID NO: 1374971 - DNA, 22 bp, Homo sapiens
atgttttttaaaatatttatct

SEQ ID NO: 1374972 - DNA, 13 bp, Homo sapiens
attaaaaaagaga

SEQ ID NO: 1374973 - DNA, 18 bp, Homo sapiens
attaaaaaagcatacttc

SEQ ID NO: 1374974 - DNA, 16 bp, Homo sapiens
attaaaactaaatttc

SEQ ID NO: 1374975 - DNA, 13 bp, Homo sapiens
attaaaatatttc

SEQ ID NO: 1374976 - DNA, 17 bp, Homo sapiens
attaaaatatttcaggt

SEQ ID NO: 1374977 - DNA, 22 bp, Homo sapiens
attaaagacaggagacaaaaga

SEQ ID NO: 1374978 - DNA, 18 bp, Homo sapiens
attaaatttttttgtatg

SEQ ID NO: 1374979 - DNA, 19 bp, Homo sapiens
attaaatttttttgtatga

SEQ ID NO: 1374980 - DNA, 21 bp, Homo sapiens
attaaatttttttgtatgaaa

SEQ ID NO: 1374981 - DNA, 20 bp, Homo sapiens
attaaccacttcagctgact

SEQ ID NO: 1374982 - DNA, 19 bp, Homo sapiens
attaacttaataatcaaga

SEQ ID NO: 1374983 - DNA, 13 bp, Homo sapiens
attaaggaagaca

SEQ ID NO: 1374984 - DNA, 18 bp, Homo sapiens
attaaggggaagaatgaa

SEQ ID NO: 1374985 - DNA, 19 bp, Homo sapiens
attaaggggaagaatgaaa

SEQ ID NO: 1374986 - DNA, 17 bp, Homo sapiens
attaaggtgtttgaaaa

SEQ ID NO: 1374987 - DNA, 20 bp, Homo sapiens
attaaggtgtttgaaaatag

SEQ ID NO: 1374988 - DNA, 23 bp, Homo sapiens
attaatatttaacattatttata

SEQ ID NO: 1374989 - DNA, 14 bp, Homo sapiens
attaatcactgtgt

SEQ ID NO: 1374990 - DNA, 15 bp, Homo sapiens
attaatcactgtgta

SEQ ID NO: 1374991 - DNA, 19 bp, Homo sapiens
attaatcactgtgtatatt

SEQ ID NO: 1374992 - DNA, 15 bp, Homo sapiens
attaatgcactttct

SEQ ID NO: 1374993 - DNA, 16 bp, Homo sapiens
attaatgcactttcta

SEQ ID NO: 1374994 - DNA, 15 bp, Homo sapiens
attaatgttttcaaa

SEQ ID NO: 1374995 - DNA, 11 bp, Homo sapiens
attaattgtgt

SEQ ID NO: 1374996 - DNA, 23 bp, Homo sapiens
attacaaagttaaaattgttatc

SEQ ID NO: 1374997 - DNA, 24 bp, Homo sapiens
attacaaagttaaaattgttatca

SEQ ID NO: 1374998 - DNA, 13 bp, Homo sapiens
attacaattttat

SEQ ID NO: 1374999 - DNA, 13 bp, Homo sapiens
attaccccctcct

SEQ ID NO: 1375000 - DNA, 19 bp, Homo sapiens
attaccccctccttcagac

SEQ ID NO: 1375001 - DNA, 22 bp, Homo sapiens
attacgaagttcaagatcaaaa

SEQ ID NO: 1375002 - DNA, 13 bp, Homo sapiens
attactgacattt

SEQ ID NO: 1375003 - DNA, 17 bp, Homo sapiens
attactgtttattactt

SEQ ID NO: 1375004 - DNA, 13 bp, Homo sapiens
attagtttagaac

SEQ ID NO: 1375005 - DNA, 21 bp, Homo sapiens
attagtttagaacaggttttt

SEQ ID NO: 1375006 - DNA, 17 bp, Homo sapiens
attataaatatcattgt

SEQ ID NO: 1375007 - DNA, 15 bp, Homo sapiens
attatacatgtgata

SEQ ID NO: 1375008 - DNA, 15 bp, Homo sapiens
attatagtgtagaaa

SEQ ID NO: 1375009 - DNA, 18 bp, Homo sapiens
attatcttgatacattca

SEQ ID NO: 1375010 - DNA, 20 bp, Homo sapiens
attatgagaggcaatgattg

SEQ ID NO: 1375011 - DNA, 20 bp, Homo sapiens
attatgttttttaaaatatt

SEQ ID NO: 1375012 - DNA, 12 bp, Homo sapiens
attattgacact

SEQ ID NO: 1375013 - DNA, 16 bp, Homo sapiens
attattgacactgaac

SEQ ID NO: 1375014 - DNA, 14 bp, Homo sapiens
attatttttataat

SEQ ID NO: 1375015 - DNA, 17 bp, Homo sapiens
attatttttcactctaa

SEQ ID NO: 1375016 - DNA, 17 bp, Homo sapiens
attatttttttaaaatt

SEQ ID NO: 1375017 - DNA, 21 bp, Homo sapiens
attatttttttaaaattttgt

SEQ ID NO: 1375018 - DNA, 19 bp, Homo sapiens
attcaaactggggcctcca

SEQ ID NO: 1375019 - DNA, 18 bp, Homo sapiens
attcaacagcaagtgtga

SEQ ID NO: 1375020 - DNA, 18 bp, Homo sapiens
attcaactttgtaaaaat

SEQ ID NO: 1375021 - DNA, 20 bp, Homo sapiens
attcaagtgtaaaatatttt

SEQ ID NO: 1375022 - DNA, 21 bp, Homo sapiens
attcaagtgtaaaatattttg

SEQ ID NO: 1375023 - DNA, 16 bp, Homo sapiens
attcacactgttccag

SEQ ID NO: 1375024 - DNA, 18 bp, Homo sapiens
attcacattgttaagaaa

SEQ ID NO: 1375025 - DNA, 11 bp, Homo sapiens
attcagacatc

SEQ ID NO: 1375026 - DNA, 12 bp, Homo sapiens
attcagatgtat

SEQ ID NO: 1375027 - DNA, 14 bp, Homo sapiens
attcagatgtatgt

SEQ ID NO: 1375028 - DNA, 20 bp, Homo sapiens
attcagcagcaaattttcag

SEQ ID NO: 1375029 - DNA, 14 bp, Homo sapiens
attcagctctgcaa

SEQ ID NO: 1375030 - DNA, 21 bp, Homo sapiens
attcaggaatgtgtggcctgc

SEQ ID NO: 1375031 - DNA, 14 bp, Homo sapiens
attcaggtaacact

SEQ ID NO: 1375032 - DNA, 12 bp, Homo sapiens
attcataaatct

SEQ ID NO: 1375033 - DNA, 17 bp, Homo sapiens
attcatagtaagattga

SEQ ID NO: 1375034 - DNA, 13 bp, Homo sapiens
attcatctgtcta

SEQ ID NO: 1375035 - DNA, 16 bp, Homo sapiens
attcatgaggagggtg

SEQ ID NO: 1375036 - DNA, 16 bp, Homo sapiens
attccagatctttcag

SEQ ID NO: 1375037 - DNA, 22 bp, Homo sapiens
attccggaaactagtgtacatt

SEQ ID NO: 1375038 - DNA, 21 bp, Homo sapiens
attcctgtactgtgtctcatg

SEQ ID NO: 1375039 - DNA, 22 bp, Homo sapiens
attcgtacataatactgaacca

SEQ ID NO: 1375040 - DNA, 20 bp, Homo sapiens
attcgttgtgttttttaaga

SEQ ID NO: 1375041 - DNA, 14 bp, Homo sapiens
attctaataagcta

SEQ ID NO: 1375042 - DNA, 20 bp, Homo sapiens
attctaataagctagttgaa

SEQ ID NO: 1375043 - DNA, 17 bp, Homo sapiens
attctagttttgtcaaa

SEQ ID NO: 1375044 - DNA, 13 bp, Homo sapiens
attctataaaact

SEQ ID NO: 1375045 - DNA, 15 bp, Homo sapiens
attctataaaactct

SEQ ID NO: 1375046 - DNA, 17 bp, Homo sapiens
attctcaaaggagcgag

SEQ ID NO: 1375047 - DNA, 13 bp, Homo sapiens
attctccactgtg

SEQ ID NO: 1375048 - DNA, 12 bp, Homo sapiens
attctcttttaa

SEQ ID NO: 1375049 - DNA, 14 bp, Homo sapiens
attctgagaaaaca

SEQ ID NO: 1375050 - DNA, 15 bp, Homo sapiens
attctgagaaaacaa

SEQ ID NO: 1375051 - DNA, 14 bp, Homo sapiens
attctgatttcttt

SEQ ID NO: 1375052 - DNA, 20 bp, Homo sapiens
attctgccgccccctcctga

SEQ ID NO: 1375053 - DNA, 21 bp, Homo sapiens
attctgccgccccctcctgaa

SEQ ID NO: 1375054 - DNA, 14 bp, Homo sapiens
caatggtagtttct

SEQ ID NO: 1375055 - DNA, 16 bp, Homo sapiens
caatggtagtttctgt

SEQ ID NO: 1375056 - DNA, 17 bp, Homo sapiens
caatggtagtttctgtg

SEQ ID NO: 1375057 - DNA, 22 bp, Homo sapiens
caatgtgaaaagaaaaatgagc

SEQ ID NO: 1375058 - DNA, 20 bp, Homo sapiens
caatgtgaggggtccctagc

SEQ ID NO: 1375059 - DNA, 14 bp, Homo sapiens
caatgttgtagtgt

SEQ ID NO: 1375060 - DNA, 18 bp, Homo sapiens
caattagtaacattcatg

SEQ ID NO: 1375061 - DNA, 15 bp, Homo sapiens
caattgtcacttttt

SEQ ID NO: 1375062 - DNA, 20 bp, Homo sapiens
caatttgcactaaatcagag

SEQ ID NO: 1375063 - DNA, 21 bp, Homo sapiens
caatttgcactaaatcagaga

SEQ ID NO: 1375064 - DNA, 15 bp, Homo sapiens
cacaaatgctcaaag

SEQ ID NO: 1375065 - DNA, 13 bp, Homo sapiens
cacaatttgcact

SEQ ID NO: 1375066 - DNA, 15 bp, Homo sapiens
cacacagaatgcaac

SEQ ID NO: 1375067 - DNA, 22 bp, Homo sapiens
cacacagacccctcgcaactgt

SEQ ID NO: 1375068 - DNA, 15 bp, Homo sapiens
cacacagactatttt

SEQ ID NO: 1375069 - DNA, 19 bp, Homo sapiens
cacacccaaagctgagcct

SEQ ID NO: 1375070 - DNA, 16 bp, Homo sapiens
cacacctgtagcactt

SEQ ID NO: 1375071 - DNA, 22 bp, Homo sapiens
cacacggacactcaaaagctgg

SEQ ID NO: 1375072 - DNA, 22 bp, Homo sapiens
cacactctccatcaccctcttc

SEQ ID NO: 1375073 - DNA, 14 bp, Homo sapiens
cacactggttctca

SEQ ID NO: 1375074 - DNA, 18 bp, Homo sapiens
cacactggttctcaatga

SEQ ID NO: 1375075 - DNA, 20 bp, Homo sapiens
cacactggttctcaatgaaa

SEQ ID NO: 1375076 - DNA, 16 bp, Homo sapiens
cacacttgaaaccttt

SEQ ID NO: 1375077 - DNA, 16 bp, Homo sapiens
cacagaaacactgcct

SEQ ID NO: 1375078 - DNA, 17 bp, Homo sapiens
cacagaaacactgcctt

SEQ ID NO: 1375079 - DNA, 14 bp, Homo sapiens
cacagactattttt

SEQ ID NO: 1375080 - DNA, 21 bp, Homo sapiens
cacagagctttggtctgtgtg

SEQ ID NO: 1375081 - DNA, 18 bp, Homo sapiens
cacagagtcaaggcctgc

SEQ ID NO: 1375082 - DNA, 21 bp, Homo sapiens
cacagagtcaaggcctgctcc

SEQ ID NO: 1375083 - DNA, 17 bp, Homo sapiens
cacagccagcacctggc

SEQ ID NO: 1375084 - DNA, 18 bp, Homo sapiens
cacagcctagcacagcag

SEQ ID NO: 1375085 - DNA, 14 bp, Homo sapiens
cacagcctgggccc

SEQ ID NO: 1375086 - DNA, 14 bp, Homo sapiens
cacagcgagggcag

SEQ ID NO: 1375087 - DNA, 17 bp, Homo sapiens
cacagcgagggcagctg

SEQ ID NO: 1375088 - DNA, 18 bp, Homo sapiens
cacagcgagggcagctgc

SEQ ID NO: 1375089 - DNA, 14 bp, Homo sapiens
cacagcgccagcct

SEQ ID NO: 1375090 - DNA, 16 bp, Homo sapiens
cacagcgccagcctca

SEQ ID NO: 1375091 - DNA, 14 bp, Homo sapiens
cacaggaggcaggc

SEQ ID NO: 1375092 - DNA, 22 bp, Homo sapiens
cacaggaggcaggcatggccct

SEQ ID NO: 1375093 - DNA, 14 bp, Homo sapiens
cacagggtgggcct

SEQ ID NO: 1375094 - DNA, 21 bp, Homo sapiens
cacagtaaaaatggaaactat

SEQ ID NO: 1375095 - DNA, 20 bp, Homo sapiens
cacagtctccggcctctcca

SEQ ID NO: 1375096 - DNA, 15 bp, Homo sapiens
cacagtgaagtgctg

SEQ ID NO: 1375097 - DNA, 14 bp, Homo sapiens
cacagttttgacct

SEQ ID NO: 1375098 - DNA, 18 bp, Homo sapiens
cacatccaactccagcaa

SEQ ID NO: 1375099 - DNA, 19 bp, Homo sapiens
cacatccaactccagcaac

SEQ ID NO: 1375100 - DNA, 14 bp, Homo sapiens
cacatgtttcctct

SEQ ID NO: 1375101 - DNA, 15 bp, Homo sapiens
cacatgtttcctcta

SEQ ID NO: 1375102 - DNA, 13 bp, Homo sapiens
cacattcttggct

SEQ ID NO: 1375103 - DNA, 17 bp, Homo sapiens
cacattgagctgtgcaa

SEQ ID NO: 1375104 - DNA, 13 bp, Homo sapiens
caccaaaaacaaa

SEQ ID NO: 1375105 - DNA, 13 bp, Homo sapiens
caccaagccaagg

SEQ ID NO: 1375106 - DNA, 19 bp, Homo sapiens
caccaatcttactttgtaa

SEQ ID NO: 1375107 - DNA, 13 bp, Homo sapiens
caccacagccagc

SEQ ID NO: 1375108 - DNA, 14 bp, Homo sapiens
caccagcagcctgg

SEQ ID NO: 1375109 - DNA, 15 bp, Homo sapiens
caccagcagcctgga

SEQ ID NO: 1375110 - DNA, 15 bp, Homo sapiens
caccagcatcacctg

SEQ ID NO: 1375111 - DNA, 19 bp, Homo sapiens
caccagcatcacctgcctg

SEQ ID NO: 1375112 - DNA, 23 bp, Homo sapiens
caccagccccactgccagcagca

SEQ ID NO: 1375113 - DNA, 22 bp, Homo sapiens
caccagctctgccgtctctgga

SEQ ID NO: 1375114 - DNA, 11 bp, Homo sapiens
caccatgaaac

SEQ ID NO: 1375115 - DNA, 14 bp, Homo sapiens
caccattctgactc

SEQ ID NO: 1375116 - DNA, 21 bp, Homo sapiens
cacccaaaccggcaggtgcga

SEQ ID NO: 1375117 - DNA, 15 bp, Homo sapiens
cacccaaagctgagc

SEQ ID NO: 1375118 - DNA, 19 bp, Homo sapiens
cacccaaagctgagcctgc

SEQ ID NO: 1375119 - DNA, 22 bp, Homo sapiens
cacccaaagctgagcctgcagg

SEQ ID NO: 1375120 - DNA, 13 bp, Homo sapiens
cacccatggtacc

SEQ ID NO: 1375121 - DNA, 12 bp, Homo sapiens
caccccaagaga

SEQ ID NO: 1375122 - DNA, 17 bp, Homo sapiens
caccccaggacgccact

SEQ ID NO: 1375123 - DNA, 13 bp, Homo sapiens
cacccccagcccc

SEQ ID NO: 1375124 - DNA, 12 bp, Homo sapiens
caccccccaggc

SEQ ID NO: 1375125 - DNA, 23 bp, Homo sapiens
caccccggccccctgcccgttct

SEQ ID NO: 1375126 - DNA, 18 bp, Homo sapiens
caccccggggaccctgtg

SEQ ID NO: 1375127 - DNA, 18 bp, Homo sapiens
caccctcaacctcttctg

SEQ ID NO: 1375128 - DNA, 17 bp, Homo sapiens
caccctgaaagccctga

SEQ ID NO: 1375129 - DNA, 17 bp, Homo sapiens
caccctgcccctcagag

SEQ ID NO: 1375130 - DNA, 13 bp, Homo sapiens
caccctgcctgcc

SEQ ID NO: 1375131 - DNA, 17 bp, Homo sapiens
caccctgctgctggtgc

SEQ ID NO: 1375132 - DNA, 15 bp, Homo sapiens
caccgcccctggccg

SEQ ID NO: 1375133 - DNA, 23 bp, Homo sapiens
cacctagaacactaactcaccag

SEQ ID NO: 1375134 - DNA, 18 bp, Homo sapiens
cacctcatgcccaccccc

SEQ ID NO: 1375135 - DNA, 14 bp, Homo sapiens
cacctccccagcat

SEQ ID NO: 1375136 - DNA, 16 bp, Homo sapiens
cacctccccagcattc

SEQ ID NO: 1375137 - DNA, 18 bp, Homo sapiens
cacctctgcacaagctgc

SEQ ID NO: 1375138 - DNA, 19 bp, Homo sapiens
cacctctgcacaagctgca

SEQ ID NO: 1375139 - DNA, 19 bp, Homo sapiens
cacctggctgaggttcctc

SEQ ID NO: 1375140 - DNA, 21 bp, Homo sapiens
cacctggctgaggttcctctg

SEQ ID NO: 1375141 - DNA, 22 bp, Homo sapiens
cacctggctgaggttcctctgc

SEQ ID NO: 1375142 - DNA, 18 bp, Homo sapiens
cacctgtagcacttactg

SEQ ID NO: 1375143 - DNA, 21 bp, Homo sapiens
caccttggacatcctcctccc

SEQ ID NO: 1375144 - DNA, 16 bp, Homo sapiens
cacgaatagacatcaa

SEQ ID NO: 1375145 - DNA, 17 bp, Homo sapiens
cacgaatttctgtgccc

SEQ ID NO: 1375146 - DNA, 16 bp, Homo sapiens
cacgactgcccggcag

SEQ ID NO: 1375147 - DNA, 16 bp, Homo sapiens
cacgagaccccggctt

SEQ ID NO: 1375148 - DNA, 20 bp, Homo sapiens
cacgcctgtaatcctagcac

SEQ ID NO: 1375149 - DNA, 17 bp, Homo sapiens
cacgcgtgccgtggcac

SEQ ID NO: 1375150 - DNA, 14 bp, Homo sapiens
cacgcttctccgga

SEQ ID NO: 1375151 - DNA, 22 bp, Homo sapiens
cacggaagagccttgcggaagg

SEQ ID NO: 1375152 - DNA, 13 bp, Homo sapiens
cacgggtggtccc

SEQ ID NO: 1375153 - DNA, 15 bp, Homo sapiens
cacgttttaaggact

SEQ ID NO: 1375154 - DNA, 22 bp, Homo sapiens
cacgttttaaggactgactgag

SEQ ID NO: 1375155 - DNA, 22 bp, Homo sapiens
cactaaagcatgaaatgtgaat

SEQ ID NO: 1375156 - DNA, 16 bp, Homo sapiens
cactaaatcagagaca

SEQ ID NO: 1375157 - DNA, 21 bp, Homo sapiens
cactacaagtcagctccagct

SEQ ID NO: 1375158 - DNA, 17 bp, Homo sapiens
cactaggcccccacttg

SEQ ID NO: 1375159 - DNA, 18 bp, Homo sapiens
cactagggccttggaaat

SEQ ID NO: 1375160 - DNA, 17 bp, Homo sapiens
cactatgaagctacctc

SEQ ID NO: 1375161 - DNA, 20 bp, Homo sapiens
cactcaaaagctgggcaggt

SEQ ID NO: 1375162 - DNA, 18 bp, Homo sapiens
cactcacagagtcaaggc

SEQ ID NO: 1375163 - DNA, 17 bp, Homo sapiens
cactcactaggccccca

SEQ ID NO: 1375164 - DNA, 17 bp, Homo sapiens
cactcatttcatctcat

SEQ ID NO: 1375165 - DNA, 19 bp, Homo sapiens
cactcatttcatctcattt

SEQ ID NO: 1375166 - DNA, 14 bp, Homo sapiens
cactcccttgctgg

SEQ ID NO: 1375167 - DNA, 18 bp, Homo sapiens
cactcccttgctggcccc

SEQ ID NO: 1375168 - DNA, 19 bp, Homo sapiens
cactcccttgctggcccca

SEQ ID NO: 1375169 - DNA, 16 bp, Homo sapiens
cactcctcagggcagc

SEQ ID NO: 1375170 - DNA, 19 bp, Homo sapiens
cactcctgcttaatcttca

SEQ ID NO: 1375171 - DNA, 19 bp, Homo sapiens
cactctgcttctctgactt

SEQ ID NO: 1375172 - DNA, 13 bp, Homo sapiens
catacataaaaga

SEQ ID NO: 1375173 - DNA, 20 bp, Homo sapiens
catacataaaagaaataaac

SEQ ID NO: 1375174 - DNA, 20 bp, Homo sapiens
catactccttccatcaaata

SEQ ID NO: 1375175 - DNA, 18 bp, Homo sapiens
catagaaaccactagaaa

SEQ ID NO: 1375176 - DNA, 20 bp, Homo sapiens
catagaaatggaaattttgc

SEQ ID NO: 1375177 - DNA, 22 bp, Homo sapiens
catagaaatgtaggtcctcaga

SEQ ID NO: 1375178 - DNA, 13 bp, Homo sapiens
catagacatgaaa

SEQ ID NO: 1375179 - DNA, 12 bp, Homo sapiens
catagaggcttc

SEQ ID NO: 1375180 - DNA, 15 bp, Homo sapiens
catagaggcttctcc

SEQ ID NO: 1375181 - DNA, 21 bp, Homo sapiens
catagaggcttctccgccagc

SEQ ID NO: 1375182 - DNA, 14 bp, Homo sapiens
catagagtacactg

SEQ ID NO: 1375183 - DNA, 16 bp, Homo sapiens
catagataatattgtt

SEQ ID NO: 1375184 - DNA, 22 bp, Homo sapiens
catagataatattgtttggtaa

SEQ ID NO: 1375185 - DNA, 24 bp, Homo sapiens
catagataatattgtttggtaaat

SEQ ID NO: 1375186 - DNA, 14 bp, Homo sapiens
catagccaaaatgt

SEQ ID NO: 1375187 - DNA, 17 bp, Homo sapiens
catagccataaatgatg

SEQ ID NO: 1375188 - DNA, 16 bp, Homo sapiens
cataggacctttccac

SEQ ID NO: 1375189 - DNA, 14 bp, Homo sapiens
catagttactgtgt

SEQ ID NO: 1375190 - DNA, 12 bp, Homo sapiens
catagtttcttt

SEQ ID NO: 1375191 - DNA, 16 bp, Homo sapiens
catagtttctttattt

SEQ ID NO: 1375192 - DNA, 13 bp, Homo sapiens
catagtttggcat

SEQ ID NO: 1375193 - DNA, 18 bp, Homo sapiens
catataagacaaatattc

SEQ ID NO: 1375194 - DNA, 14 bp, Homo sapiens
catataatgaataa

SEQ ID NO: 1375195 - DNA, 14 bp, Homo sapiens
catatagtgtacag

SEQ ID NO: 1375196 - DNA, 13 bp, Homo sapiens
catatatattaca

SEQ ID NO: 1375197 - DNA, 20 bp, Homo sapiens
catatcaacttagtcaataa

SEQ ID NO: 1375198 - DNA, 13 bp, Homo sapiens
catatcagttgag

SEQ ID NO: 1375199 - DNA, 18 bp, Homo sapiens
catatgaaaatacaactt

SEQ ID NO: 1375200 - DNA, 11 bp, Homo sapiens
catatggatgt

SEQ ID NO: 1375201 - DNA, 12 bp, Homo sapiens
catatggatgtt

SEQ ID NO: 1375202 - DNA, 17 bp, Homo sapiens
catattataaaggataa

SEQ ID NO: 1375203 - DNA, 18 bp, Homo sapiens
catattttattactgttt

SEQ ID NO: 1375204 - DNA, 23 bp, Homo sapiens
catattttattactgtttattac

SEQ ID NO: 1375205 - DNA, 18 bp, Homo sapiens
catcaaacctttgagtag

SEQ ID NO: 1375206 - DNA, 17 bp, Homo sapiens
catcacaagaacacaca

SEQ ID NO: 1375207 - DNA, 13 bp, Homo sapiens
catcacagggtgg

SEQ ID NO: 1375208 - DNA, 14 bp, Homo sapiens
catcacagggtggg

SEQ ID NO: 1375209 - DNA, 18 bp, Homo sapiens
catcacagggtgggcctc

SEQ ID NO: 1375210 - DNA, 21 bp, Homo sapiens
catcacagggtgggcctcggc

SEQ ID NO: 1375211 - DNA, 14 bp, Homo sapiens
catcaccctcttcc

SEQ ID NO: 1375212 - DNA, 14 bp, Homo sapiens
catcacctgcctgt

SEQ ID NO: 1375213 - DNA, 14 bp, Homo sapiens
catcacttaaaaca

SEQ ID NO: 1375214 - DNA, 16 bp, Homo sapiens
catcatccagatgtgg

SEQ ID NO: 1375215 - DNA, 17 bp, Homo sapiens
catcatccagatgtggc

SEQ ID NO: 1375216 - DNA, 18 bp, Homo sapiens
catccaactccagcaact

SEQ ID NO: 1375217 - DNA, 21 bp, Homo sapiens
catccagactcagagctctct

SEQ ID NO: 1375218 - DNA, 13 bp, Homo sapiens
catcccattccag

SEQ ID NO: 1375219 - DNA, 13 bp, Homo sapiens
catcctcctccca

SEQ ID NO: 1375220 - DNA, 16 bp, Homo sapiens
catcctcctcccaccc

SEQ ID NO: 1375221 - DNA, 18 bp, Homo sapiens
catcgcaccattctgact

SEQ ID NO: 1375222 - DNA, 17 bp, Homo sapiens
catcggcctagggcccc

SEQ ID NO: 1375223 - DNA, 15 bp, Homo sapiens
catcggcgtggccca

SEQ ID NO: 1375224 - DNA, 16 bp, Homo sapiens
catcgtgaagaagcct

SEQ ID NO: 1375225 - DNA, 17 bp, Homo sapiens
catcgtgaagaagcctg

SEQ ID NO: 1375226 - DNA, 16 bp, Homo sapiens
catctaattctgattc

SEQ ID NO: 1375227 - DNA, 13 bp, Homo sapiens
catctagccagcc

SEQ ID NO: 1375228 - DNA, 22 bp, Homo sapiens
catctagccagcccctcttccc

SEQ ID NO: 1375229 - DNA, 15 bp, Homo sapiens
catctatctcaatcc

SEQ ID NO: 1375230 - DNA, 14 bp, Homo sapiens
catctatctgtgct

SEQ ID NO: 1375231 - DNA, 13 bp, Homo sapiens
catctcacagcta

SEQ ID NO: 1375232 - DNA, 18 bp, Homo sapiens
catctcaggagatttcat

SEQ ID NO: 1375233 - DNA, 18 bp, Homo sapiens
catctcatttaagggaaa

SEQ ID NO: 1375234 - DNA, 21 bp, Homo sapiens
catctcatttaagggaaaaat

SEQ ID NO: 1375235 - DNA, 15 bp, Homo sapiens
catctcccctcagct

SEQ ID NO: 1375236 - DNA, 14 bp, Homo sapiens
catctccctgcctg

SEQ ID NO: 1375237 - DNA, 16 bp, Homo sapiens
catctccctgcctggc

SEQ ID NO: 1375238 - DNA, 21 bp, Homo sapiens
catctccctgcctggccccca

SEQ ID NO: 1375239 - DNA, 16 bp, Homo sapiens
catctctacaaaaagc

SEQ ID NO: 1375240 - DNA, 21 bp, Homo sapiens
catctgaggttttatttcatt

SEQ ID NO: 1375241 - DNA, 20 bp, Homo sapiens
catctgcaaaaggcctcttg

SEQ ID NO: 1375242 - DNA, 16 bp, Homo sapiens
catctggaatctggag

SEQ ID NO: 1375243 - DNA, 16 bp, Homo sapiens
catctggagttctcaa

SEQ ID NO: 1375244 - DNA, 17 bp, Homo sapiens
catcttgaatccttcca

SEQ ID NO: 1375245 - DNA, 22 bp, Homo sapiens
catcttgcctccaggtgcagag

SEQ ID NO: 1375246 - DNA, 23 bp, Homo sapiens
catcttgcctccaggtgcagagg

SEQ ID NO: 1375247 - DNA, 13 bp, Homo sapiens
catcttgcttccc

SEQ ID NO: 1375248 - DNA, 12 bp, Homo sapiens
catctttgatgt

SEQ ID NO: 1375249 - DNA, 19 bp, Homo sapiens
catgaaatgtgaattttta

SEQ ID NO: 1375250 - DNA, 20 bp, Homo sapiens
catgaaatgtgaatttttat

SEQ ID NO: 1375251 - DNA, 24 bp, Homo sapiens
catgaagtcttaaggacaaagtgc

SEQ ID NO: 1375252 - DNA, 15 bp, Homo sapiens
catgaattttaaaat

SEQ ID NO: 1375253 - DNA, 16 bp, Homo sapiens
catgacaatgttgtag

SEQ ID NO: 1375254 - DNA, 14 bp, Homo sapiens
catgaccagtaaag

SEQ ID NO: 1375255 - DNA, 12 bp, Homo sapiens
catgagatgtgt

SEQ ID NO: 1375256 - DNA, 14 bp, Homo sapiens
catgagatgtgtgg

SEQ ID NO: 1375257 - DNA, 15 bp, Homo sapiens
catgagatgtgtgga

SEQ ID NO: 1375258 - DNA, 21 bp, Homo sapiens
catgagtaaaatagattttat

SEQ ID NO: 1375259 - DNA, 22 bp, Homo sapiens
catgagtagataatttcagggt

SEQ ID NO: 1375260 - DNA, 14 bp, Homo sapiens
catgccagctggcc

SEQ ID NO: 1375261 - DNA, 19 bp, Homo sapiens
catgccagcttatctcagg

SEQ ID NO: 1375262 - DNA, 20 bp, Homo sapiens
catgccagcttatctcaggg

SEQ ID NO: 1375263 - DNA, 18 bp, Homo sapiens
catgcccaccccctgccc

SEQ ID NO: 1375264 - DNA, 19 bp, Homo sapiens
catgcccaccccctgccct

SEQ ID NO: 1375265 - DNA, 22 bp, Homo sapiens
catgcccaccccctgccctgca

SEQ ID NO: 1375266 - DNA, 14 bp, Homo sapiens
catgccccctgcag

SEQ ID NO: 1375267 - DNA, 16 bp, Homo sapiens
catgccccctgcagac

SEQ ID NO: 1375268 - DNA, 13 bp, Homo sapiens
catgccctctcag

SEQ ID NO: 1375269 - DNA, 15 bp, Homo sapiens
catgccctctcaggc

SEQ ID NO: 1375270 - DNA, 17 bp, Homo sapiens
catgctcctggcccact

SEQ ID NO: 1375271 - DNA, 18 bp, Homo sapiens
catgctgaggcctgggcc

SEQ ID NO: 1375272 - DNA, 19 bp, Homo sapiens
catgcttgtgaaaatgtgt

SEQ ID NO: 1375273 - DNA, 19 bp, Homo sapiens
catggccttatgaggcagg

SEQ ID NO: 1375274 - DNA, 11 bp, Homo sapiens
catggggaggg

SEQ ID NO: 1375275 - DNA, 20 bp, Homo sapiens
catggggagggattctggtt

SEQ ID NO: 1375276 - DNA, 23 bp, Homo sapiens
catggtgaagtgcttggaacata

SEQ ID NO: 1375277 - DNA, 13 bp, Homo sapiens
catggtggccaga

SEQ ID NO: 1375278 - DNA, 14 bp, Homo sapiens
catggtttgactca

SEQ ID NO: 1375279 - DNA, 20 bp, Homo sapiens
catggttttgtgccatctgt

SEQ ID NO: 1375280 - DNA, 24 bp, Homo sapiens
catggttttgtgccatctgtagct

SEQ ID NO: 1375281 - DNA, 15 bp, Homo sapiens
catgtaaaacagaaa

SEQ ID NO: 1375282 - DNA, 22 bp, Homo sapiens
catgtagccccctggcctctgt

SEQ ID NO: 1375283 - DNA, 12 bp, Homo sapiens
catgtatgtttc

SEQ ID NO: 1375284 - DNA, 15 bp, Homo sapiens
catgtatttgagcat

SEQ ID NO: 1375285 - DNA, 21 bp, Homo sapiens
catgtcaaacatgagatgtgt

SEQ ID NO: 1375286 - DNA, 12 bp, Homo sapiens
catgtccaaaga

SEQ ID NO: 1375287 - DNA, 15 bp, Homo sapiens
catgtccaaagaggc

SEQ ID NO: 1375288 - DNA, 20 bp, Homo sapiens
catgtccaaagaggctgccc

SEQ ID NO: 1375289 - DNA, 19 bp, Homo sapiens
catgtccagcaccttgtgc

SEQ ID NO: 1375290 - DNA, 20 bp, Homo sapiens
catgtccagcaccttgtgcc

SEQ ID NO: 1375291 - DNA, 14 bp, Homo sapiens
ccagccctgctggg

SEQ ID NO: 1375292 - DNA, 19 bp, Homo sapiens
ccagccgccatgctcctgg

SEQ ID NO: 1375293 - DNA, 21 bp, Homo sapiens
ccagcctcagcgcggccctcc

SEQ ID NO: 1375294 - DNA, 12 bp, Homo sapiens
ccagcctcctct

SEQ ID NO: 1375295 - DNA, 16 bp, Homo sapiens
ccagcctcctctggac

SEQ ID NO: 1375296 - DNA, 15 bp, Homo sapiens
ccagcctgcgcctgc

SEQ ID NO: 1375297 - DNA, 21 bp, Homo sapiens
ccagcctgcgcctgctgcatg

SEQ ID NO: 1375298 - DNA, 10 bp, Homo sapiens
ccagcctgct

SEQ ID NO: 1375299 - DNA, 14 bp, Homo sapiens
ccagcctgctagct

SEQ ID NO: 1375300 - DNA, 21 bp, Homo sapiens
ccagccttgagccctggctgt

SEQ ID NO: 1375301 - DNA, 18 bp, Homo sapiens
ccagcgatctctccactg

SEQ ID NO: 1375302 - DNA, 14 bp, Homo sapiens
ccagcgcctccctc

SEQ ID NO: 1375303 - DNA, 16 bp, Homo sapiens
ccagcgcctccctcca

SEQ ID NO: 1375304 - DNA, 21 bp, Homo sapiens
ccagcgcctccctccacccca

SEQ ID NO: 1375305 - DNA, 14 bp, Homo sapiens
ccagctccctctat

SEQ ID NO: 1375306 - DNA, 14 bp, Homo sapiens
ccagctctggaggg

SEQ ID NO: 1375307 - DNA, 16 bp, Homo sapiens
ccagctgcccttccgc

SEQ ID NO: 1375308 - DNA, 20 bp, Homo sapiens
ccagctgcccttccgcagtg

SEQ ID NO: 1375309 - DNA, 15 bp, Homo sapiens
ccagctgcctattga

SEQ ID NO: 1375310 - DNA, 16 bp, Homo sapiens
ccagctgcgcttgctt

SEQ ID NO: 1375311 - DNA, 20 bp, Homo sapiens
ccagctgcgcttgcttttct

SEQ ID NO: 1375312 - DNA, 21 bp, Homo sapiens
ccagctgcgcttgcttttctg

SEQ ID NO: 1375313 - DNA, 13 bp, Homo sapiens
ccagctggcctgg

SEQ ID NO: 1375314 - DNA, 16 bp, Homo sapiens
ccagctggcctggaca

SEQ ID NO: 1375315 - DNA, 17 bp, Homo sapiens
ccagctggcctggacag

SEQ ID NO: 1375316 - DNA, 12 bp, Homo sapiens
ccagctggcctt

SEQ ID NO: 1375317 - DNA, 16 bp, Homo sapiens
ccagctggcctttgta

SEQ ID NO: 1375318 - DNA, 16 bp, Homo sapiens
ccagcttggggccacc

SEQ ID NO: 1375319 - DNA, 21 bp, Homo sapiens
ccaggaaactccacatctgcc

SEQ ID NO: 1375320 - DNA, 19 bp, Homo sapiens
ccaggaacagcaaatgcaa

SEQ ID NO: 1375321 - DNA, 15 bp, Homo sapiens
ccaggaagcccagga

SEQ ID NO: 1375322 - DNA, 16 bp, Homo sapiens
ccaggacgccactcat

SEQ ID NO: 1375323 - DNA, 16 bp, Homo sapiens
ccaggagcctgcccag

SEQ ID NO: 1375324 - DNA, 21 bp, Homo sapiens
ccaggaggcagggaggcagcc

SEQ ID NO: 1375325 - DNA, 21 bp, Homo sapiens
ccaggagtgtggccacgtggg

SEQ ID NO: 1375326 - DNA, 19 bp, Homo sapiens
ccaggatcccaagcctcct

SEQ ID NO: 1375327 - DNA, 14 bp, Homo sapiens
ccaggcagcctctg

SEQ ID NO: 1375328 - DNA, 10 bp, Homo sapiens
ccaggcaggg

SEQ ID NO: 1375329 - DNA, 16 bp, Homo sapiens
ccaggccacctcccca

SEQ ID NO: 1375330 - DNA, 17 bp, Homo sapiens
ccaggccacctccccag

SEQ ID NO: 1375331 - DNA, 11 bp, Homo sapiens
ccaggccagcc

SEQ ID NO: 1375332 - DNA, 12 bp, Homo sapiens
ccaggccagcct

SEQ ID NO: 1375333 - DNA, 15 bp, Homo sapiens
ccaggccagcctccg

SEQ ID NO: 1375334 - DNA, 15 bp, Homo sapiens
ccaggccattctgcc

SEQ ID NO: 1375335 - DNA, 17 bp, Homo sapiens
ccaggccattctgccgc

SEQ ID NO: 1375336 - DNA, 19 bp, Homo sapiens
ccaggccctcctctcccat

SEQ ID NO: 1375337 - DNA, 16 bp, Homo sapiens
ccaggcctgcctccca

SEQ ID NO: 1375338 - DNA, 20 bp, Homo sapiens
ccaggctatgtataaaatac

SEQ ID NO: 1375339 - DNA, 18 bp, Homo sapiens
ccaggctcactcacagag

SEQ ID NO: 1375340 - DNA, 20 bp, Homo sapiens
ccaggctcgtggactgagtg

SEQ ID NO: 1375341 - DNA, 18 bp, Homo sapiens
ccagggaatccaagcctc

SEQ ID NO: 1375342 - DNA, 16 bp, Homo sapiens
ccagggacacacagcc

SEQ ID NO: 1375343 - DNA, 19 bp, Homo sapiens
ccagggacacacagcctag

SEQ ID NO: 1375344 - DNA, 21 bp, Homo sapiens
ccagggacacacagcctagca

SEQ ID NO: 1375345 - DNA, 14 bp, Homo sapiens
ccagggagcctttg

SEQ ID NO: 1375346 - DNA, 22 bp, Homo sapiens
ccagggcaagctccgcaggact

SEQ ID NO: 1375347 - DNA, 12 bp, Homo sapiens
ccagggcctttt

SEQ ID NO: 1375348 - DNA, 14 bp, Homo sapiens
ccagggctcctgca

SEQ ID NO: 1375349 - DNA, 23 bp, Homo sapiens
ccaggggctgcttcctcctggaa

SEQ ID NO: 1375350 - DNA, 15 bp, Homo sapiens
ccagggggcaagagg

SEQ ID NO: 1375351 - DNA, 15 bp, Homo sapiens
ccaggggtctccctg

SEQ ID NO: 1375352 - DNA, 18 bp, Homo sapiens
ccaggtaccagctgcgct

SEQ ID NO: 1375353 - DNA, 14 bp, Homo sapiens
ccaggtagaaactt

SEQ ID NO: 1375354 - DNA, 15 bp, Homo sapiens
ccaggtccagctctg

SEQ ID NO: 1375355 - DNA, 16 bp, Homo sapiens
ccaggtccagctctgg

SEQ ID NO: 1375356 - DNA, 13 bp, Homo sapiens
ccaggtgcagagg

SEQ ID NO: 1375357 - DNA, 14 bp, Homo sapiens
ccaggttccgaaga

SEQ ID NO: 1375358 - DNA, 21 bp, Homo sapiens
ccaggttctccgttagctcct

SEQ ID NO: 1375359 - DNA, 23 bp, Homo sapiens
ccaggttctccgttagctcctgt

SEQ ID NO: 1375360 - DNA, 16 bp, Homo sapiens
ccagtaagatcactgt

SEQ ID NO: 1375361 - DNA, 21 bp, Homo sapiens
ccagtaagatcactgtttaga

SEQ ID NO: 1375362 - DNA, 18 bp, Homo sapiens
ccagtccaccctgcctgc

SEQ ID NO: 1375363 - DNA, 14 bp, Homo sapiens
ccagtccaggctgc

SEQ ID NO: 1375364 - DNA, 15 bp, Homo sapiens
ccagtccccacccct

SEQ ID NO: 1375365 - DNA, 16 bp, Homo sapiens
ccagtccccacccctg

SEQ ID NO: 1375366 - DNA, 22 bp, Homo sapiens
ccagtccccacccctgccccca

SEQ ID NO: 1375367 - DNA, 16 bp, Homo sapiens
ccagtctgtggatcag

SEQ ID NO: 1375368 - DNA, 18 bp, Homo sapiens
ccagtgagggacgtcaga

SEQ ID NO: 1375369 - DNA, 22 bp, Homo sapiens
ccagtgagggacgtcagacttg

SEQ ID NO: 1375370 - DNA, 12 bp, Homo sapiens
ccagttcaaaaa

SEQ ID NO: 1375371 - DNA, 19 bp, Homo sapiens
ccatacataaaagaaataa

SEQ ID NO: 1375372 - DNA, 19 bp, Homo sapiens
ccatagagtacactgcctg

SEQ ID NO: 1375373 - DNA, 19 bp, Homo sapiens
ccatcagggttctcttagc

SEQ ID NO: 1375374 - DNA, 20 bp, Homo sapiens
ccatcatctatagaaagcta

SEQ ID NO: 1375375 - DNA, 18 bp, Homo sapiens
ccatcgtgaagaagcctg

SEQ ID NO: 1375376 - DNA, 20 bp, Homo sapiens
ccatcgtgaagaagcctgta

SEQ ID NO: 1375377 - DNA, 15 bp, Homo sapiens
ccatctcccctcagc

SEQ ID NO: 1375378 - DNA, 16 bp, Homo sapiens
ccatctcccctcagct

SEQ ID NO: 1375379 - DNA, 17 bp, Homo sapiens
ccatctcccctcagctc

SEQ ID NO: 1375380 - DNA, 18 bp, Homo sapiens
ccatctcccctcagctcg

SEQ ID NO: 1375381 - DNA, 23 bp, Homo sapiens
ccatctgcaccccttctctcctc

SEQ ID NO: 1375382 - DNA, 19 bp, Homo sapiens
ccatctgccccacagtctc

SEQ ID NO: 1375383 - DNA, 21 bp, Homo sapiens
ccatgattaaccacttcagct

SEQ ID NO: 1375384 - DNA, 19 bp, Homo sapiens
ccatgcaagcagaggacca

SEQ ID NO: 1375385 - DNA, 23 bp, Homo sapiens
ccatgcaagcagaggaccagggc

SEQ ID NO: 1375386 - DNA, 12 bp, Homo sapiens
ccatgccagctg

SEQ ID NO: 1375387 - DNA, 17 bp, Homo sapiens
ccatgccgtctgccgga

SEQ ID NO: 1375388 - DNA, 14 bp, Homo sapiens
ccatgcgccccctc

SEQ ID NO: 1375389 - DNA, 17 bp, Homo sapiens
ccatgctcatctgctgg

SEQ ID NO: 1375390 - DNA, 18 bp, Homo sapiens
ccatgctcatctgctggt

SEQ ID NO: 1375391 - DNA, 13 bp, Homo sapiens
ccatgctcctggc

SEQ ID NO: 1375392 - DNA, 20 bp, Homo sapiens
ccatgctgaggcctgggccg

SEQ ID NO: 1375393 - DNA, 19 bp, Homo sapiens
ccatgcttacgtgatcctc

SEQ ID NO: 1375394 - DNA, 17 bp, Homo sapiens
ccatggagccagctccc

SEQ ID NO: 1375395 - DNA, 14 bp, Homo sapiens
ccatggccttatga

SEQ ID NO: 1375396 - DNA, 17 bp, Homo sapiens
ccatggctcagggtggt

SEQ ID NO: 1375397 - DNA, 18 bp, Homo sapiens
ccatggggagggattctg

SEQ ID NO: 1375398 - DNA, 16 bp, Homo sapiens
ccatggtgatggtgta

SEQ ID NO: 1375399 - DNA, 20 bp, Homo sapiens
ccatgtagccccctggcctc

SEQ ID NO: 1375400 - DNA, 21 bp, Homo sapiens
ccatgtgatggacactccagg

SEQ ID NO: 1375401 - DNA, 21 bp, Homo sapiens
ccatgtgcatagtttctttat

SEQ ID NO: 1375402 - DNA, 20 bp, Homo sapiens
ccatgtggaaggcaagccag

SEQ ID NO: 1375403 - DNA, 21 bp, Homo sapiens
ccatgtggaaggcaagccagg

SEQ ID NO: 1375404 - DNA, 14 bp, Homo sapiens
ccatgtggccacaa

SEQ ID NO: 1375405 - DNA, 17 bp, Homo sapiens
ccattagccagatttgt

SEQ ID NO: 1375406 - DNA, 14 bp, Homo sapiens
ccattctcccaggt

SEQ ID NO: 1375407 - DNA, 23 bp, Homo sapiens
ccattctcccaggtaccagctgc

SEQ ID NO: 1375408 - DNA, 20 bp, Homo sapiens
ccattgtgcctaagtccagt

SEQ ID NO: 1375409 - DNA, 17 bp, Homo sapiens
ccatttcccatctgcac

SEQ ID NO: 1375410 - DNA, 14 bp, Homo sapiens
ccgaggggcctttg

SEQ ID NO: 1375411 - DNA, 17 bp, Homo sapiens
ccgagtagaaaatgtga

SEQ ID NO: 1375412 - DNA, 18 bp, Homo sapiens
ccgagtagaaaatgtgac

SEQ ID NO: 1375413 - DNA, 21 bp, Homo sapiens
ccgagtagaaaatgtgaccct

SEQ ID NO: 1375414 - DNA, 18 bp, Homo sapiens
ccgatagagggacggcca

SEQ ID NO: 1375415 - DNA, 19 bp, Homo sapiens
ccgatgttattagatgtta

SEQ ID NO: 1375416 - DNA, 18 bp, Homo sapiens
ccgcacagctcaggaggc

SEQ ID NO: 1375417 - DNA, 22 bp, Homo sapiens
ccgcagagcgcgcccctagccg

SEQ ID NO: 1375418 - DNA, 18 bp, Homo sapiens
ccgcagtgtggccaggct

SEQ ID NO: 1375419 - DNA, 17 bp, Homo sapiens
ccgccaaggctggggga

SEQ ID NO: 1375420 - DNA, 13 bp, Homo sapiens
ccgccagcctcct

SEQ ID NO: 1375421 - DNA, 15 bp, Homo sapiens
ccgccagcctcctct

SEQ ID NO: 1375422 - DNA, 23 bp, Homo sapiens
ccgcccctggccgcgctccgggc

SEQ ID NO: 1375423 - DNA, 12 bp, Homo sapiens
ccgccctgccac

SEQ ID NO: 1375424 - DNA, 14 bp, Homo sapiens
ccgccctgccactc

SEQ ID NO: 1375425 - DNA, 23 bp, Homo sapiens
ccgcctctcctcggttcaaggtc

SEQ ID NO: 1375426 - DNA, 20 bp, Homo sapiens
ccgcctggccaggagcaggc

SEQ ID NO: 1375427 - DNA, 18 bp, Homo sapiens
ccgcgaccatgtggccac

SEQ ID NO: 1375428 - DNA, 17 bp, Homo sapiens
ccgcgcgtccagctgcc

SEQ ID NO: 1375429 - DNA, 21 bp, Homo sapiens
ccgcggggctgtcggcgctgc

SEQ ID NO: 1375430 - DNA, 14 bp, Homo sapiens
ccgcgtgtgcctgt

SEQ ID NO: 1375431 - DNA, 13 bp, Homo sapiens
ccgctgccagcct

SEQ ID NO: 1375432 - DNA, 15 bp, Homo sapiens
ccgctgccagccttg

SEQ ID NO: 1375433 - DNA, 18 bp, Homo sapiens
ccggcagccccagcctgc

SEQ ID NO: 1375434 - DNA, 20 bp, Homo sapiens
ccggcagccccagcctgcta

SEQ ID NO: 1375435 - DNA, 20 bp, Homo sapiens
ccggcatgagactcagtgca

SEQ ID NO: 1375436 - DNA, 20 bp, Homo sapiens
ccggccacccaggaggcagg

SEQ ID NO: 1375437 - DNA, 14 bp, Homo sapiens
ccggccccctgccc

SEQ ID NO: 1375438 - DNA, 14 bp, Homo sapiens
ccggccctgtgtgc

SEQ ID NO: 1375439 - DNA, 15 bp, Homo sapiens
ccggccctgtgtgca

SEQ ID NO: 1375440 - DNA, 16 bp, Homo sapiens
ccggccggccacccag

SEQ ID NO: 1375441 - DNA, 14 bp, Homo sapiens
ccggcctctccagc

SEQ ID NO: 1375442 - DNA, 19 bp, Homo sapiens
ccggcttcctttcccaagc

SEQ ID NO: 1375443 - DNA, 21 bp, Homo sapiens
ccgggaccaccctgagccggc

SEQ ID NO: 1375444 - DNA, 13 bp, Homo sapiens
ccgggccccacag

SEQ ID NO: 1375445 - DNA, 16 bp, Homo sapiens
ccgggcccctgggctt

SEQ ID NO: 1375446 - DNA, 20 bp, Homo sapiens
ccgggcgcggtggctcacgc

SEQ ID NO: 1375447 - DNA, 15 bp, Homo sapiens
ccggggaccctgtga

SEQ ID NO: 1375448 - DNA, 21 bp, Homo sapiens
ccggggtggccacagcgccag

SEQ ID NO: 1375449 - DNA, 14 bp, Homo sapiens
ccggtccagctggc

SEQ ID NO: 1375450 - DNA, 20 bp, Homo sapiens
ccggtggcggccccagcacc

SEQ ID NO: 1375451 - DNA, 17 bp, Homo sapiens
ccggttcctgtccctgc

SEQ ID NO: 1375452 - DNA, 19 bp, Homo sapiens
ccggttcctgtccctgcgc

SEQ ID NO: 1375453 - DNA, 16 bp, Homo sapiens
ccgtcaccaccacccc

SEQ ID NO: 1375454 - DNA, 18 bp, Homo sapiens
ccgtgaaaacggagctga

SEQ ID NO: 1375455 - DNA, 17 bp, Homo sapiens
ccgtgaagatactttgt

SEQ ID NO: 1375456 - DNA, 21 bp, Homo sapiens
ccgtgccgcctgcactcctca

SEQ ID NO: 1375457 - DNA, 16 bp, Homo sapiens
ccgtggaggaggaagg

SEQ ID NO: 1375458 - DNA, 22 bp, Homo sapiens
ccgtggaggaggaaggcaagag

SEQ ID NO: 1375459 - DNA, 17 bp, Homo sapiens
ccgttagctcctgtggc

SEQ ID NO: 1375460 - DNA, 17 bp, Homo sapiens
ccgttccaccccaagag

SEQ ID NO: 1375461 - DNA, 17 bp, Homo sapiens
ccgttttccccatgaca

SEQ ID NO: 1375462 - DNA, 13 bp, Homo sapiens
cctaaaagcactc

SEQ ID NO: 1375463 - DNA, 19 bp, Homo sapiens
cctaaaataacagtatgtg

SEQ ID NO: 1375464 - DNA, 23 bp, Homo sapiens
cctaaagagagtatttttataca

SEQ ID NO: 1375465 - DNA, 14 bp, Homo sapiens
cctaaatggcctca

SEQ ID NO: 1375466 - DNA, 21 bp, Homo sapiens
cctaacatctgacctggcatc

SEQ ID NO: 1375467 - DNA, 15 bp, Homo sapiens
cctaaccccttccag

SEQ ID NO: 1375468 - DNA, 16 bp, Homo sapiens
cctaaccccttccaga

SEQ ID NO: 1375469 - DNA, 18 bp, Homo sapiens
cctaaccccttccagatc

SEQ ID NO: 1375470 - DNA, 21 bp, Homo sapiens
cctaaggcatctatctgtgct

SEQ ID NO: 1375471 - DNA, 23 bp, Homo sapiens
cctaaggcatctatctgtgctag

SEQ ID NO: 1375472 - DNA, 17 bp, Homo sapiens
cctacagctttgatccc

SEQ ID NO: 1375473 - DNA, 22 bp, Homo sapiens
cctacagttgaaaaacagctga

SEQ ID NO: 1375474 - DNA, 12 bp, Homo sapiens
cctaccccatag

SEQ ID NO: 1375475 - DNA, 21 bp, Homo sapiens
cctaccccgcagacaccttgg

SEQ ID NO: 1375476 - DNA, 23 bp, Homo sapiens
cctactcaagcgggtggctctgg

SEQ ID NO: 1375477 - DNA, 21 bp, Homo sapiens
cctagaacactaactcaccag

SEQ ID NO: 1375478 - DNA, 15 bp, Homo sapiens
cctagcacagcagct

SEQ ID NO: 1375479 - DNA, 16 bp, Homo sapiens
cctagcacagcagctt

SEQ ID NO: 1375480 - DNA, 15 bp, Homo sapiens
cctagcagcccaccc

SEQ ID NO: 1375481 - DNA, 22 bp, Homo sapiens
cctagcgatctctcctggccta

SEQ ID NO: 1375482 - DNA, 21 bp, Homo sapiens
cctagcttgggaggcttcccc

SEQ ID NO: 1375483 - DNA, 17 bp, Homo sapiens
cctagctttagaccctg

SEQ ID NO: 1375484 - DNA, 18 bp, Homo sapiens
cctagctttagaccctgg

SEQ ID NO: 1375485 - DNA, 23 bp, Homo sapiens
cctagctttagaccctgggtggg

SEQ ID NO: 1375486 - DNA, 23 bp, Homo sapiens
cctaggcatttgctgaatacaga

SEQ ID NO: 1375487 - DNA, 14 bp, Homo sapiens
cctagtgaaacttt

SEQ ID NO: 1375488 - DNA, 20 bp, Homo sapiens
cctagtttgggaggagcaga

SEQ ID NO: 1375489 - DNA, 15 bp, Homo sapiens
cctatccctctccta

SEQ ID NO: 1375490 - DNA, 15 bp, Homo sapiens
cctatccgctgccag

SEQ ID NO: 1375491 - DNA, 17 bp, Homo sapiens
cctatccgctgccagcc

SEQ ID NO: 1375492 - DNA, 23 bp, Homo sapiens
cctatggcagaaaaaatgtctgt

SEQ ID NO: 1375493 - DNA, 16 bp, Homo sapiens
cctattagagaagaga

SEQ ID NO: 1375494 - DNA, 11 bp, Homo sapiens
cctattagtgt

SEQ ID NO: 1375495 - DNA, 19 bp, Homo sapiens
cctattagtgttatatgaa

SEQ ID NO: 1375496 - DNA, 16 bp, Homo sapiens
cctatttccagaaata

SEQ ID NO: 1375497 - DNA, 15 bp, Homo sapiens
cctcaaattttttga

SEQ ID NO: 1375498 - DNA, 16 bp, Homo sapiens
cctcaaattttttgac

SEQ ID NO: 1375499 - DNA, 22 bp, Homo sapiens
cctcaaattttttgactttttt

SEQ ID NO: 1375500 - DNA, 16 bp, Homo sapiens
cctcaacacctctgca

SEQ ID NO: 1375501 - DNA, 12 bp, Homo sapiens
cctcacctcatg

SEQ ID NO: 1375502 - DNA, 23 bp, Homo sapiens
cctcacctcatgcccaccccctg

SEQ ID NO: 1375503 - DNA, 12 bp, Homo sapiens
cctcagcctgca

SEQ ID NO: 1375504 - DNA, 18 bp, Homo sapiens
cctcagctcggctcagct

SEQ ID NO: 1375505 - DNA, 16 bp, Homo sapiens
cctcagggctcccagg

SEQ ID NO: 1375506 - DNA, 17 bp, Homo sapiens
cctcagggctcccaggg

SEQ ID NO: 1375507 - DNA, 14 bp, Homo sapiens
cctcatgcccaccc

SEQ ID NO: 1375508 - DNA, 15 bp, Homo sapiens
cctcatgcccacccc

SEQ ID NO: 1375509 - DNA, 21 bp, Homo sapiens
cctcatgcccaccccctgccc

SEQ ID NO: 1375510 - DNA, 13 bp, Homo sapiens
cctcatgtggctg

SEQ ID NO: 1375511 - DNA, 18 bp, Homo sapiens
cctcattagcattttgct

SEQ ID NO: 1375512 - DNA, 15 bp, Homo sapiens
cctccaaccctgccg

SEQ ID NO: 1375513 - DNA, 13 bp, Homo sapiens
cctccaccccagg

SEQ ID NO: 1375514 - DNA, 14 bp, Homo sapiens
cctccaccccagga

SEQ ID NO: 1375515 - DNA, 20 bp, Homo sapiens
cctccagccccgcgaccatg

SEQ ID NO: 1375516 - DNA, 18 bp, Homo sapiens
cctccaggcctgcctccc

SEQ ID NO: 1375517 - DNA, 16 bp, Homo sapiens
cctccagtgtgggctt

SEQ ID NO: 1375518 - DNA, 16 bp, Homo sapiens
cctcccaggaagccca

SEQ ID NO: 1375519 - DNA, 20 bp, Homo sapiens
cctccccaaatcaatacact

SEQ ID NO: 1375520 - DNA, 23 bp, Homo sapiens
cctcccccagccatgccagctgg

SEQ ID NO: 1375521 - DNA, 14 bp, Homo sapiens
cctcccctgccacc

SEQ ID NO: 1375522 - DNA, 17 bp, Homo sapiens
cctcccctgccaccagg

SEQ ID NO: 1375523 - DNA, 16 bp, Homo sapiens
cctccctccaccccag

SEQ ID NO: 1375524 - DNA, 16 bp, Homo sapiens
cctcccttccttttcc

SEQ ID NO: 1375525 - DNA, 16 bp, Homo sapiens
cctccgagagggagag

SEQ ID NO: 1375526 - DNA, 16 bp, Homo sapiens
cctccgccctgccact

SEQ ID NO: 1375527 - DNA, 13 bp, Homo sapiens
cctccgtttttct

SEQ ID NO: 1375528 - DNA, 14 bp, Homo sapiens
cgccgtgggctgcg

SEQ ID NO: 1375529 - DNA, 17 bp, Homo sapiens
cgcctccccacctccag

SEQ ID NO: 1375530 - DNA, 18 bp, Homo sapiens
cgcctccccacctccagg

SEQ ID NO: 1375531 - DNA, 16 bp, Homo sapiens
cgcctcccctgcccca

SEQ ID NO: 1375532 - DNA, 16 bp, Homo sapiens
cgcctggccaggagca

SEQ ID NO: 1375533 - DNA, 20 bp, Homo sapiens
cgcctgtaatcccagcactt

SEQ ID NO: 1375534 - DNA, 20 bp, Homo sapiens
cgcctgtaatcccagctact

SEQ ID NO: 1375535 - DNA, 20 bp, Homo sapiens
cgcctgtagtcccagctact

SEQ ID NO: 1375536 - DNA, 13 bp, Homo sapiens
cgcctttcctctc

SEQ ID NO: 1375537 - DNA, 14 bp, Homo sapiens
cgcgccacaggacc

SEQ ID NO: 1375538 - DNA, 16 bp, Homo sapiens
cgcgcttgctggccag

SEQ ID NO: 1375539 - DNA, 23 bp, Homo sapiens
cgcgggagccatgcgccccctcc

SEQ ID NO: 1375540 - DNA, 20 bp, Homo sapiens
cgcggggctgtcggcgctgc

SEQ ID NO: 1375541 - DNA, 13 bp, Homo sapiens
cgcggtggctcac

SEQ ID NO: 1375542 - DNA, 15 bp, Homo sapiens
cgcgtcgccgccacc

SEQ ID NO: 1375543 - DNA, 17 bp, Homo sapiens
cgcgtgccgtggcacca

SEQ ID NO: 1375544 - DNA, 15 bp, Homo sapiens
cgctaaagagccctt

SEQ ID NO: 1375545 - DNA, 19 bp, Homo sapiens
cgctaaagagcccttgcct

SEQ ID NO: 1375546 - DNA, 20 bp, Homo sapiens
cgctcagggccatgctgagg

SEQ ID NO: 1375547 - DNA, 21 bp, Homo sapiens
cgctcagggccatgctgaggc

SEQ ID NO: 1375548 - DNA, 19 bp, Homo sapiens
cgctgcccacctgccggcc

SEQ ID NO: 1375549 - DNA, 14 bp, Homo sapiens
cgctgccccatctc

SEQ ID NO: 1375550 - DNA, 23 bp, Homo sapiens
cgctgccccatctcccctcagct

SEQ ID NO: 1375551 - DNA, 22 bp, Homo sapiens
cgctgtatgaaaggagagagca

SEQ ID NO: 1375552 - DNA, 17 bp, Homo sapiens
cgcttcttgcctctgtg

SEQ ID NO: 1375553 - DNA, 19 bp, Homo sapiens
cgcttcttgcctctgtgct

SEQ ID NO: 1375554 - DNA, 19 bp, Homo sapiens
cggaaactagtgtacattt

SEQ ID NO: 1375555 - DNA, 19 bp, Homo sapiens
cggaatttacctgatttct

SEQ ID NO: 1375556 - DNA, 16 bp, Homo sapiens
cggacttttctgcaaa

SEQ ID NO: 1375557 - DNA, 16 bp, Homo sapiens
cggaggtgtggagccg

SEQ ID NO: 1375558 - DNA, 15 bp, Homo sapiens
cggagtcgtggggtg

SEQ ID NO: 1375559 - DNA, 18 bp, Homo sapiens
cggagtgtctggaattgt

SEQ ID NO: 1375560 - DNA, 19 bp, Homo sapiens
cggagtgtgtatgccaaga

SEQ ID NO: 1375561 - DNA, 17 bp, Homo sapiens
cggatagttgctatttt

SEQ ID NO: 1375562 - DNA, 16 bp, Homo sapiens
cggatcaggctcccag

SEQ ID NO: 1375563 - DNA, 16 bp, Homo sapiens
cggcagccccagcctg

SEQ ID NO: 1375564 - DNA, 17 bp, Homo sapiens
cggcaggctcactgcca

SEQ ID NO: 1375565 - DNA, 17 bp, Homo sapiens
cggcaggggcctggaga

SEQ ID NO: 1375566 - DNA, 19 bp, Homo sapiens
cggcaggggcctggagatc

SEQ ID NO: 1375567 - DNA, 18 bp, Homo sapiens
cggcatgagactcagtgc

SEQ ID NO: 1375568 - DNA, 13 bp, Homo sapiens
cggccaagaatgt

SEQ ID NO: 1375569 - DNA, 22 bp, Homo sapiens
cggccccagcacctcagcctgc

SEQ ID NO: 1375570 - DNA, 14 bp, Homo sapiens
cggcccgcctctcc

SEQ ID NO: 1375571 - DNA, 17 bp, Homo sapiens
cggcccgcctctcctcg

SEQ ID NO: 1375572 - DNA, 13 bp, Homo sapiens
cggcctctgcctt

SEQ ID NO: 1375573 - DNA, 15 bp, Homo sapiens
cggcgtacaggctgg

SEQ ID NO: 1375574 - DNA, 17 bp, Homo sapiens
cggcgtggcccaaggct

SEQ ID NO: 1375575 - DNA, 13 bp, Homo sapiens
cggctctgcagtc

SEQ ID NO: 1375576 - DNA, 11 bp, Homo sapiens
cggctgaccat

SEQ ID NO: 1375577 - DNA, 14 bp, Homo sapiens
cggctgaccatgct

SEQ ID NO: 1375578 - DNA, 15 bp, Homo sapiens
cggctgaccatgctc

SEQ ID NO: 1375579 - DNA, 20 bp, Homo sapiens
cggctgcagaggccagaggc

SEQ ID NO: 1375580 - DNA, 14 bp, Homo sapiens
cggctggcagccca

SEQ ID NO: 1375581 - DNA, 16 bp, Homo sapiens
cgggaacctccccagc

SEQ ID NO: 1375582 - DNA, 18 bp, Homo sapiens
cgggaacctccccagcct

SEQ ID NO: 1375583 - DNA, 19 bp, Homo sapiens
cgggaacctccccagcctg

SEQ ID NO: 1375584 - DNA, 14 bp, Homo sapiens
cgggacagagtagc

SEQ ID NO: 1375585 - DNA, 16 bp, Homo sapiens
cgggaccaccctgagc

SEQ ID NO: 1375586 - DNA, 14 bp, Homo sapiens
cgggacccagggcc

SEQ ID NO: 1375587 - DNA, 22 bp, Homo sapiens
cgggagccatgcgccccctccg

SEQ ID NO: 1375588 - DNA, 17 bp, Homo sapiens
cgggaggtcgaggcagg

SEQ ID NO: 1375589 - DNA, 15 bp, Homo sapiens
cgggcccctgggctt

SEQ ID NO: 1375590 - DNA, 16 bp, Homo sapiens
cgggcgcggtggctca

SEQ ID NO: 1375591 - DNA, 19 bp, Homo sapiens
cggggaagagatccaaaga

SEQ ID NO: 1375592 - DNA, 12 bp, Homo sapiens
cggggaccctgt

SEQ ID NO: 1375593 - DNA, 18 bp, Homo sapiens
cgggtcgggggcaggtgc

SEQ ID NO: 1375594 - DNA, 18 bp, Homo sapiens
cgggtggctctgggatcc

SEQ ID NO: 1375595 - DNA, 16 bp, Homo sapiens
cgggtggggcttgggg

SEQ ID NO: 1375596 - DNA, 15 bp, Homo sapiens
cgggtgtgggaaagc

SEQ ID NO: 1375597 - DNA, 15 bp, Homo sapiens
cgggtttctctgtgg

SEQ ID NO: 1375598 - DNA, 17 bp, Homo sapiens
cggtaactgtcctgtcc

SEQ ID NO: 1375599 - DNA, 12 bp, Homo sapiens
cggtactcccat

SEQ ID NO: 1375600 - DNA, 18 bp, Homo sapiens
cggtatccccccatcttg

SEQ ID NO: 1375601 - DNA, 11 bp, Homo sapiens
cggtccagctg

SEQ ID NO: 1375602 - DNA, 14 bp, Homo sapiens
cggtccagctggcc

SEQ ID NO: 1375603 - DNA, 21 bp, Homo sapiens
cggtccagctggcctggacag

SEQ ID NO: 1375604 - DNA, 23 bp, Homo sapiens
cggtctcggatcaggctcccagg

SEQ ID NO: 1375605 - DNA, 17 bp, Homo sapiens
cggtgccatgaagggac

SEQ ID NO: 1375606 - DNA, 15 bp, Homo sapiens
cggtgcccaagccag

SEQ ID NO: 1375607 - DNA, 16 bp, Homo sapiens
cggtgggactcgtggc

SEQ ID NO: 1375608 - DNA, 22 bp, Homo sapiens
cggtgggactcgtggctgtcaa

SEQ ID NO: 1375609 - DNA, 20 bp, Homo sapiens
cggtttccagggaggggccg

SEQ ID NO: 1375610 - DNA, 18 bp, Homo sapiens
cgtacaagtagttctgta

SEQ ID NO: 1375611 - DNA, 15 bp, Homo sapiens
cgtacataatactga

SEQ ID NO: 1375612 - DNA, 15 bp, Homo sapiens
cgtataggcatgtaa

SEQ ID NO: 1375613 - DNA, 22 bp, Homo sapiens
cgtatctccggctcccagcctc

SEQ ID NO: 1375614 - DNA, 17 bp, Homo sapiens
cgtcaacgtgcatttta

SEQ ID NO: 1375615 - DNA, 13 bp, Homo sapiens
cgtccagcctgcc

SEQ ID NO: 1375616 - DNA, 17 bp, Homo sapiens
cgtctcaacccctcaca

SEQ ID NO: 1375617 - DNA, 22 bp, Homo sapiens
cgtcttggtgtaatttgaagat

SEQ ID NO: 1375618 - DNA, 16 bp, Homo sapiens
cgtgaaagcagatgag

SEQ ID NO: 1375619 - DNA, 17 bp, Homo sapiens
cgtgaaagtgcattttt

SEQ ID NO: 1375620 - DNA, 17 bp, Homo sapiens
cgtgaagatactttgta

SEQ ID NO: 1375621 - DNA, 12 bp, Homo sapiens
cgtgcctgtgtc

SEQ ID NO: 1375622 - DNA, 19 bp, Homo sapiens
cgtgctgggcggctgtgct

SEQ ID NO: 1375623 - DNA, 17 bp, Homo sapiens
cgtggaggaggaaggca

SEQ ID NO: 1375624 - DNA, 13 bp, Homo sapiens
cgtggagggaggc

SEQ ID NO: 1375625 - DNA, 19 bp, Homo sapiens
cgtggagggaggccccagg

SEQ ID NO: 1375626 - DNA, 18 bp, Homo sapiens
cgtggcactcgctgtatg

SEQ ID NO: 1375627 - DNA, 21 bp, Homo sapiens
cgtggcctcccaaagtgctgg

SEQ ID NO: 1375628 - DNA, 14 bp, Homo sapiens
cgtgggagccagcc

SEQ ID NO: 1375629 - DNA, 15 bp, Homo sapiens
cgtggggcagggagc

SEQ ID NO: 1375630 - DNA, 23 bp, Homo sapiens
cgtggggcagggagctgggcccg

SEQ ID NO: 1375631 - DNA, 20 bp, Homo sapiens
cgtgtaaccatggacccaat

SEQ ID NO: 1375632 - DNA, 22 bp, Homo sapiens
cgtgtgtgtgtgtgtgtgtgca

SEQ ID NO: 1375633 - DNA, 14 bp, Homo sapiens
cgttagctcctgtg

SEQ ID NO: 1375634 - DNA, 18 bp, Homo sapiens
cgtttataaacagaaatg

SEQ ID NO: 1375635 - DNA, 22 bp, Homo sapiens
cgtttctttaaccttgtataaa

SEQ ID NO: 1375636 - DNA, 14 bp, Homo sapiens
cgttttccccatga

SEQ ID NO: 1375637 - DNA, 15 bp, Homo sapiens
cgtttttgtattttc

SEQ ID NO: 1375638 - DNA, 16 bp, Homo sapiens
ctaaaaagtataaaat

SEQ ID NO: 1375639 - DNA, 13 bp, Homo sapiens
ctaaaatcatgaa

SEQ ID NO: 1375640 - DNA, 16 bp, Homo sapiens
ctaaagagcccttgcc

SEQ ID NO: 1375641 - DNA, 17 bp, Homo sapiens
ctaaagagcccttgcct

SEQ ID NO: 1375642 - DNA, 20 bp, Homo sapiens
ctaaagagcccttgcctccc

SEQ ID NO: 1375643 - DNA, 21 bp, Homo sapiens
ctaaagagcccttgcctcccc

SEQ ID NO: 1375644 - DNA, 22 bp, Homo sapiens
ctaaagagcccttgcctcccca

SEQ ID NO: 1375645 - DNA, 14 bp, Homo sapiens
ctaaagcatgaaat

SEQ ID NO: 1375646 - DNA, 20 bp, Homo sapiens
ctaaagcatgaaatgtgaat

SEQ ID NO: 1375647 - DNA, 14 bp, Homo sapiens
ctccctccacccca

SEQ ID NO: 1375648 - DNA, 15 bp, Homo sapiens
ctccctccaccccag

SEQ ID NO: 1375649 - DNA, 17 bp, Homo sapiens
ctccctccaccccagga

SEQ ID NO: 1375650 - DNA, 19 bp, Homo sapiens
ctccctccaccccaggacg

SEQ ID NO: 1375651 - DNA, 16 bp, Homo sapiens
ctccctgcagatgcca

SEQ ID NO: 1375652 - DNA, 12 bp, Homo sapiens
ctccctgcctgg

SEQ ID NO: 1375653 - DNA, 15 bp, Homo sapiens
ctccctgcctggccc

SEQ ID NO: 1375654 - DNA, 19 bp, Homo sapiens
ctcccttccttttccctgc

SEQ ID NO: 1375655 - DNA, 12 bp, Homo sapiens
ctcccttgctgg

SEQ ID NO: 1375656 - DNA, 14 bp, Homo sapiens
ctcccttgctggcc

SEQ ID NO: 1375657 - DNA, 14 bp, Homo sapiens
ctccgagagggaga

SEQ ID NO: 1375658 - DNA, 13 bp, Homo sapiens
ctccgagaggtgg

SEQ ID NO: 1375659 - DNA, 15 bp, Homo sapiens
ctccgagaggtgggc

SEQ ID NO: 1375660 - DNA, 18 bp, Homo sapiens
ctccgagaggtgggccag

SEQ ID NO: 1375661 - DNA, 15 bp, Homo sapiens
ctccgaggacccagg

SEQ ID NO: 1375662 - DNA, 17 bp, Homo sapiens
ctccgaggacccaggaa

SEQ ID NO: 1375663 - DNA, 22 bp, Homo sapiens
ctccgcaggacttccccggagg

SEQ ID NO: 1375664 - DNA, 18 bp, Homo sapiens
ctccgccagcctcctctg

SEQ ID NO: 1375665 - DNA, 20 bp, Homo sapiens
ctccgccagcctcctctgga

SEQ ID NO: 1375666 - DNA, 21 bp, Homo sapiens
ctccgccagcctcctctggac

SEQ ID NO: 1375667 - DNA, 13 bp, Homo sapiens
ctccgccctgcca

SEQ ID NO: 1375668 - DNA, 14 bp, Homo sapiens
ctccgccctgccac

SEQ ID NO: 1375669 - DNA, 15 bp, Homo sapiens
ctccgccctgccact

SEQ ID NO: 1375670 - DNA, 21 bp, Homo sapiens
ctccgctgccgtgccgcctgc

SEQ ID NO: 1375671 - DNA, 16 bp, Homo sapiens
ctccggctcccagcct

SEQ ID NO: 1375672 - DNA, 19 bp, Homo sapiens
ctccggctcccagcctcag

SEQ ID NO: 1375673 - DNA, 14 bp, Homo sapiens
ctccggggccattt

SEQ ID NO: 1375674 - DNA, 19 bp, Homo sapiens
ctccggggccatttgcaat

SEQ ID NO: 1375675 - DNA, 18 bp, Homo sapiens
ctccgttagctcctgtgg

SEQ ID NO: 1375676 - DNA, 12 bp, Homo sapiens
ctccgttggcca

SEQ ID NO: 1375677 - DNA, 21 bp, Homo sapiens
ctcctacatatcccttccaga

SEQ ID NO: 1375678 - DNA, 17 bp, Homo sapiens
ctcctagtttgggagga

SEQ ID NO: 1375679 - DNA, 22 bp, Homo sapiens
ctcctattctcttaatttttct

SEQ ID NO: 1375680 - DNA, 14 bp, Homo sapiens
ctcctcacctcatg

SEQ ID NO: 1375681 - DNA, 15 bp, Homo sapiens
ctcctcacctcatgc

SEQ ID NO: 1375682 - DNA, 18 bp, Homo sapiens
ctcctcagggcagcctcc

SEQ ID NO: 1375683 - DNA, 20 bp, Homo sapiens
ctcctcatggcagcctactc

SEQ ID NO: 1375684 - DNA, 14 bp, Homo sapiens
ctcctccaggcctg

SEQ ID NO: 1375685 - DNA, 15 bp, Homo sapiens
ctcctccaggcctgc

SEQ ID NO: 1375686 - DNA, 17 bp, Homo sapiens
ctcctccaggcctgcct

SEQ ID NO: 1375687 - DNA, 18 bp, Homo sapiens
ctcctccaggcctgcctc

SEQ ID NO: 1375688 - DNA, 23 bp, Homo sapiens
ctcctccagtgtgggcttgacca

SEQ ID NO: 1375689 - DNA, 15 bp, Homo sapiens
ctcctcccacccggc

SEQ ID NO: 1375690 - DNA, 20 bp, Homo sapiens
ctcctcccacccggctgcag

SEQ ID NO: 1375691 - DNA, 22 bp, Homo sapiens
ctcctcccacccggctgcagag

SEQ ID NO: 1375692 - DNA, 13 bp, Homo sapiens
ctcctcccttcct

SEQ ID NO: 1375693 - DNA, 15 bp, Homo sapiens
ctcctcccttccttt

SEQ ID NO: 1375694 - DNA, 19 bp, Homo sapiens
ctcctgaaccgcacagctc

SEQ ID NO: 1375695 - DNA, 20 bp, Homo sapiens
ctcctgaaccgcacagctca

SEQ ID NO: 1375696 - DNA, 15 bp, Homo sapiens
ctcctgactggtgct

SEQ ID NO: 1375697 - DNA, 18 bp, Homo sapiens
ctcctgcacttacttgct

SEQ ID NO: 1375698 - DNA, 13 bp, Homo sapiens
ctcctgcccacgg

SEQ ID NO: 1375699 - DNA, 14 bp, Homo sapiens
ctcctgctgccaca

SEQ ID NO: 1375700 - DNA, 18 bp, Homo sapiens
ctcctggcccactgcatc

SEQ ID NO: 1375701 - DNA, 19 bp, Homo sapiens
ctcctggcccactgcatcg

SEQ ID NO: 1375702 - DNA, 22 bp, Homo sapiens
ctcctggcctatccgctgccag

SEQ ID NO: 1375703 - DNA, 16 bp, Homo sapiens
ctcctggggcgtccag

SEQ ID NO: 1375704 - DNA, 13 bp, Homo sapiens
ctcctgtggcccc

SEQ ID NO: 1375705 - DNA, 19 bp, Homo sapiens
ctcctgtggccccaccctg

SEQ ID NO: 1375706 - DNA, 21 bp, Homo sapiens
ctcctgtggccccaccctggg

SEQ ID NO: 1375707 - DNA, 23 bp, Homo sapiens
ctccttaagctgcagagatttct

SEQ ID NO: 1375708 - DNA, 13 bp, Homo sapiens
ctccttcagacac

SEQ ID NO: 1375709 - DNA, 20 bp, Homo sapiens
ctccttctaaaaacttctca

SEQ ID NO: 1375710 - DNA, 19 bp, Homo sapiens
ctccttgagtgtatgagta

SEQ ID NO: 1375711 - DNA, 17 bp, Homo sapiens
ctcctttgttcccggct

SEQ ID NO: 1375712 - DNA, 13 bp, Homo sapiens
ctcgaatctctgt

SEQ ID NO: 1375713 - DNA, 15 bp, Homo sapiens
ctcgaatctctgtgc

SEQ ID NO: 1375714 - DNA, 13 bp, Homo sapiens
ctcgactctgtgc

SEQ ID NO: 1375715 - DNA, 19 bp, Homo sapiens
ctcgcagcctctcagtgcc

SEQ ID NO: 1375716 - DNA, 19 bp, Homo sapiens
ctcgcataggacctttcca

SEQ ID NO: 1375717 - DNA, 22 bp, Homo sapiens
ctcgcatttgtcaatgacagtt

SEQ ID NO: 1375718 - DNA, 16 bp, Homo sapiens
ctcgcgctcagtaaac

SEQ ID NO: 1375719 - DNA, 16 bp, Homo sapiens
ctcgcgcttgctggcc

SEQ ID NO: 1375720 - DNA, 21 bp, Homo sapiens
ctcggagtgtgtatgccaaga

SEQ ID NO: 1375721 - DNA, 13 bp, Homo sapiens
ctcggggagcctt

SEQ ID NO: 1375722 - DNA, 21 bp, Homo sapiens
ctcggtacccggggcccaggg

SEQ ID NO: 1375723 - DNA, 22 bp, Homo sapiens
ctcggtacccggggcccagggc

SEQ ID NO: 1375724 - DNA, 22 bp, Homo sapiens
ctcggtttgccaaaattcattt

SEQ ID NO: 1375725 - DNA, 19 bp, Homo sapiens
ctcgtgcatccctgagaca

SEQ ID NO: 1375726 - DNA, 14 bp, Homo sapiens
ctcgtgtgtttcta

SEQ ID NO: 1375727 - DNA, 22 bp, Homo sapiens
ctctaaaaggtaatgtgtggat

SEQ ID NO: 1375728 - DNA, 18 bp, Homo sapiens
ctctaagtcatgtatgtt

SEQ ID NO: 1375729 - DNA, 22 bp, Homo sapiens
ctctaagtcatgtatgtttctc

SEQ ID NO: 1375730 - DNA, 19 bp, Homo sapiens
ctctaagtgggcattgcca

SEQ ID NO: 1375731 - DNA, 17 bp, Homo sapiens
ctctagcagcacctcct

SEQ ID NO: 1375732 - DNA, 16 bp, Homo sapiens
ctctatgctttccaaa

SEQ ID NO: 1375733 - DNA, 13 bp, Homo sapiens
ctctcacctcagc

SEQ ID NO: 1375734 - DNA, 18 bp, Homo sapiens
ctctcaggccggcagccc

SEQ ID NO: 1375735 - DNA, 17 bp, Homo sapiens
ctctcagtgccctccag

SEQ ID NO: 1375736 - DNA, 19 bp, Homo sapiens
ctctccactgtgctttcag

SEQ ID NO: 1375737 - DNA, 18 bp, Homo sapiens
ctctccccaggtccagct

SEQ ID NO: 1375738 - DNA, 18 bp, Homo sapiens
ctctcctactcggctctg

SEQ ID NO: 1375739 - DNA, 12 bp, Homo sapiens
ctctcctggcct

SEQ ID NO: 1375740 - DNA, 13 bp, Homo sapiens
ctctcctggccta

SEQ ID NO: 1375741 - DNA, 20 bp, Homo sapiens
ctctcctggcctatccgctg

SEQ ID NO: 1375742 - DNA, 14 bp, Homo sapiens
ctctccttgagtgt

SEQ ID NO: 1375743 - DNA, 19 bp, Homo sapiens
ctctctacagagaggaaat

SEQ ID NO: 1375744 - DNA, 13 bp, Homo sapiens
ctctctcctccct

SEQ ID NO: 1375745 - DNA, 17 bp, Homo sapiens
ctctcttctcagagtgg

SEQ ID NO: 1375746 - DNA, 17 bp, Homo sapiens
ctctgaatgccccataa

SEQ ID NO: 1375747 - DNA, 13 bp, Homo sapiens
ctctgaccacttg

SEQ ID NO: 1375748 - DNA, 18 bp, Homo sapiens
ctctgacttctgcctgga

SEQ ID NO: 1375749 - DNA, 17 bp, Homo sapiens
ctctgatccttcttcct

SEQ ID NO: 1375750 - DNA, 15 bp, Homo sapiens
ctctgcacaagctgc

SEQ ID NO: 1375751 - DNA, 16 bp, Homo sapiens
ctctgcacaagctgca

SEQ ID NO: 1375752 - DNA, 19 bp, Homo sapiens
ctctgcacaagctgcaccc

SEQ ID NO: 1375753 - DNA, 15 bp, Homo sapiens
ctctgcacccagaac

SEQ ID NO: 1375754 - DNA, 17 bp, Homo sapiens
ctctgcacccagaacag

SEQ ID NO: 1375755 - DNA, 17 bp, Homo sapiens
ctctgcatttaaaaaaa

SEQ ID NO: 1375756 - DNA, 19 bp, Homo sapiens
ctctgcccctcccccagcc

SEQ ID NO: 1375757 - DNA, 23 bp, Homo sapiens
ctctgcccctcccccagccatgc

SEQ ID NO: 1375758 - DNA, 11 bp, Homo sapiens
ctctgcctgcc

SEQ ID NO: 1375759 - DNA, 12 bp, Homo sapiens
ctctgcctgccc

SEQ ID NO: 1375760 - DNA, 23 bp, Homo sapiens
ctctgcctttgcaccacgggaca

SEQ ID NO: 1375761 - DNA, 15 bp, Homo sapiens
ctctgcgtctatcct

SEQ ID NO: 1375762 - DNA, 23 bp, Homo sapiens
ctctgctatatataaaacggtgc

SEQ ID NO: 1375763 - DNA, 22 bp, Homo sapiens
ctctgctcaccgcccatcaggg

SEQ ID NO: 1375764 - DNA, 13 bp, Homo sapiens
ctctgctccccag

SEQ ID NO: 1375765 - DNA, 15 bp, Homo sapiens
ctctgcttctctgac

SEQ ID NO: 1375766 - DNA, 16 bp, Homo sapiens
ctggatgatggattcc

SEQ ID NO: 1375767 - DNA, 20 bp, Homo sapiens
ctggcaaggactttgtacat

SEQ ID NO: 1375768 - DNA, 16 bp, Homo sapiens
ctggcaatggtagttt

SEQ ID NO: 1375769 - DNA, 21 bp, Homo sapiens
ctggcaatggtagtttctgtg

SEQ ID NO: 1375770 - DNA, 17 bp, Homo sapiens
ctggcactggaccccag

SEQ ID NO: 1375771 - DNA, 18 bp, Homo sapiens
ctggcactggaccccagc

SEQ ID NO: 1375772 - DNA, 16 bp, Homo sapiens
ctggcagtccgtggga

SEQ ID NO: 1375773 - DNA, 17 bp, Homo sapiens
ctggcatcgcaccattc

SEQ ID NO: 1375774 - DNA, 18 bp, Homo sapiens
ctggcatcgcaccattct

SEQ ID NO: 1375775 - DNA, 22 bp, Homo sapiens
ctggcatcgcaccattctgact

SEQ ID NO: 1375776 - DNA, 18 bp, Homo sapiens
ctggcatcttagacctcc

SEQ ID NO: 1375777 - DNA, 15 bp, Homo sapiens
ctggccaggagcagg

SEQ ID NO: 1375778 - DNA, 15 bp, Homo sapiens
ctggccagtccaggc

SEQ ID NO: 1375779 - DNA, 13 bp, Homo sapiens
ctggcccactgca

SEQ ID NO: 1375780 - DNA, 16 bp, Homo sapiens
ctggccccagccctgc

SEQ ID NO: 1375781 - DNA, 20 bp, Homo sapiens
ctggccccaggtagaaactt

SEQ ID NO: 1375782 - DNA, 17 bp, Homo sapiens
ctggcccccaacctcag

SEQ ID NO: 1375783 - DNA, 23 bp, Homo sapiens
ctggcccccaacctcagggctcc

SEQ ID NO: 1375784 - DNA, 13 bp, Homo sapiens
ctggccctagact

SEQ ID NO: 1375785 - DNA, 17 bp, Homo sapiens
ctggcctcccctgccac

SEQ ID NO: 1375786 - DNA, 18 bp, Homo sapiens
ctggcctcccctgccacc

SEQ ID NO: 1375787 - DNA, 14 bp, Homo sapiens
ctggcctctctagc

SEQ ID NO: 1375788 - DNA, 16 bp, Homo sapiens
ctggcctctctagcac

SEQ ID NO: 1375789 - DNA, 14 bp, Homo sapiens
ctggcctctgcttt

SEQ ID NO: 1375790 - DNA, 15 bp, Homo sapiens
ctggcctctgctttc

SEQ ID NO: 1375791 - DNA, 14 bp, Homo sapiens
ctggcctctgtgcc

SEQ ID NO: 1375792 - DNA, 16 bp, Homo sapiens
ctggcctctgtgcctt

SEQ ID NO: 1375793 - DNA, 19 bp, Homo sapiens
ctggcctttgtaagtgcag

SEQ ID NO: 1375794 - DNA, 19 bp, Homo sapiens
ctggcgagagtctggccct

SEQ ID NO: 1375795 - DNA, 14 bp, Homo sapiens
ctggcgcaggtggg

SEQ ID NO: 1375796 - DNA, 21 bp, Homo sapiens
ctggctccctcctccaggcct

SEQ ID NO: 1375797 - DNA, 21 bp, Homo sapiens
ctggctctgagcgcctccatc

SEQ ID NO: 1375798 - DNA, 16 bp, Homo sapiens
ctggctgctgccccca

SEQ ID NO: 1375799 - DNA, 21 bp, Homo sapiens
ctggctgggtggcaccagcag

SEQ ID NO: 1375800 - DNA, 19 bp, Homo sapiens
ctggctgtcagtatgacat

SEQ ID NO: 1375801 - DNA, 23 bp, Homo sapiens
ctggctgttctgtggttcctctg

SEQ ID NO: 1375802 - DNA, 17 bp, Homo sapiens
ctggctttaagccttca

SEQ ID NO: 1375803 - DNA, 14 bp, Homo sapiens
ctggcttttattaa

SEQ ID NO: 1375804 - DNA, 15 bp, Homo sapiens
ctggcttttgagcac

SEQ ID NO: 1375805 - DNA, 19 bp, Homo sapiens
ctgggacctgccaggcagg

SEQ ID NO: 1375806 - DNA, 13 bp, Homo sapiens
ctgggactcagcc

SEQ ID NO: 1375807 - DNA, 15 bp, Homo sapiens
ctgggactcagcctt

SEQ ID NO: 1375808 - DNA, 16 bp, Homo sapiens
ctgggactcagccttc

SEQ ID NO: 1375809 - DNA, 21 bp, Homo sapiens
ctgggactcagccttcagaca

SEQ ID NO: 1375810 - DNA, 16 bp, Homo sapiens
ctgggagctccactct

SEQ ID NO: 1375811 - DNA, 20 bp, Homo sapiens
ctgggagctccactctgctt

SEQ ID NO: 1375812 - DNA, 23 bp, Homo sapiens
ctgggagctccactctgcttctc

SEQ ID NO: 1375813 - DNA, 23 bp, Homo sapiens
ctgggaggagggagagggaggtc

SEQ ID NO: 1375814 - DNA, 18 bp, Homo sapiens
ctgggaggtcaaggctgc

SEQ ID NO: 1375815 - DNA, 21 bp, Homo sapiens
ctgggaggtcaaggctgcagt

SEQ ID NO: 1375816 - DNA, 21 bp, Homo sapiens
ctgggatgaaactaaagcaat

SEQ ID NO: 1375817 - DNA, 20 bp, Homo sapiens
ctgggcaatgtgataaaacc

SEQ ID NO: 1375818 - DNA, 23 bp, Homo sapiens
ctgggccatgtccaaagaggctg

SEQ ID NO: 1375819 - DNA, 20 bp, Homo sapiens
ctgggcccgacatggctccg

SEQ ID NO: 1375820 - DNA, 11 bp, Homo sapiens
ctgggccctga

SEQ ID NO: 1375821 - DNA, 13 bp, Homo sapiens
ctgggccctgagt

SEQ ID NO: 1375822 - DNA, 22 bp, Homo sapiens
ctgggccctgagtctgggcagc

SEQ ID NO: 1375823 - DNA, 18 bp, Homo sapiens
ctgggccctgggctggaa

SEQ ID NO: 1375824 - DNA, 14 bp, Homo sapiens
ctgggcggctgtgc

SEQ ID NO: 1375825 - DNA, 18 bp, Homo sapiens
ctgggctcccgggcccca

SEQ ID NO: 1375826 - DNA, 20 bp, Homo sapiens
ctgggcttatatctggcctc

SEQ ID NO: 1375827 - DNA, 13 bp, Homo sapiens
ctgggcttggcct

SEQ ID NO: 1375828 - DNA, 18 bp, Homo sapiens
ctgggcttggcctgctgt

SEQ ID NO: 1375829 - DNA, 18 bp, Homo sapiens
ctgggcttgtctgtagat

SEQ ID NO: 1375830 - DNA, 19 bp, Homo sapiens
ctggggaaagacactgcct

SEQ ID NO: 1375831 - DNA, 20 bp, Homo sapiens
ctggggaaagacactgcctg

SEQ ID NO: 1375832 - DNA, 21 bp, Homo sapiens
ctggggaaagacactgcctgg

SEQ ID NO: 1375833 - DNA, 22 bp, Homo sapiens
ctggggaaagacactgcctggg

SEQ ID NO: 1375834 - DNA, 15 bp, Homo sapiens
ctggggcaggctggg

SEQ ID NO: 1375835 - DNA, 19 bp, Homo sapiens
ctggggcaggctgggccat

SEQ ID NO: 1375836 - DNA, 23 bp, Homo sapiens
ctggggcctagcgatctctcctg

SEQ ID NO: 1375837 - DNA, 24 bp, Homo sapiens
ctggggcctagcgatctctcctgg

SEQ ID NO: 1375838 - DNA, 12 bp, Homo sapiens
ctggggcctcca

SEQ ID NO: 1375839 - DNA, 17 bp, Homo sapiens
ctgggggcaactggcca

SEQ ID NO: 1375840 - DNA, 20 bp, Homo sapiens
ctgggtaactagggaagata

SEQ ID NO: 1375841 - DNA, 22 bp, Homo sapiens
ctgggtaactagggaagataat

SEQ ID NO: 1375842 - DNA, 13 bp, Homo sapiens
ctgggtccagaag

SEQ ID NO: 1375843 - DNA, 18 bp, Homo sapiens
ctgggtggcaccagcagc

SEQ ID NO: 1375844 - DNA, 16 bp, Homo sapiens
ctgggttgcgggacag

SEQ ID NO: 1375845 - DNA, 17 bp, Homo sapiens
ctggtaaaatgaagaat

SEQ ID NO: 1375846 - DNA, 19 bp, Homo sapiens
ctggtaaaatgaagaattt

SEQ ID NO: 1375847 - DNA, 16 bp, Homo sapiens
ctggtacaacggaggc

SEQ ID NO: 1375848 - DNA, 18 bp, Homo sapiens
ctggtacaacggaggcct

SEQ ID NO: 1375849 - DNA, 15 bp, Homo sapiens
ctggtccgtgggacg

SEQ ID NO: 1375850 - DNA, 21 bp, Homo sapiens
ctggtccgtgggacggtgccc

SEQ ID NO: 1375851 - DNA, 14 bp, Homo sapiens
ctggtcgctcctgc

SEQ ID NO: 1375852 - DNA, 18 bp, Homo sapiens
ctggtcttgaactcctgg

SEQ ID NO: 1375853 - DNA, 19 bp, Homo sapiens
ctggtctttgagctcccac

SEQ ID NO: 1375854 - DNA, 12 bp, Homo sapiens
ctggtgctgctg

SEQ ID NO: 1375855 - DNA, 17 bp, Homo sapiens
ctggtgcttccaaatat

SEQ ID NO: 1375856 - DNA, 20 bp, Homo sapiens
ctggtggccccgtttctggt

SEQ ID NO: 1375857 - DNA, 21 bp, Homo sapiens
ctggtggccccgtttctggtg

SEQ ID NO: 1375858 - DNA, 13 bp, Homo sapiens
ctggttccagggt

SEQ ID NO: 1375859 - DNA, 15 bp, Homo sapiens
ctggttccagggtcc

SEQ ID NO: 1375860 - DNA, 16 bp, Homo sapiens
ctggttccagggtccc

SEQ ID NO: 1375861 - DNA, 18 bp, Homo sapiens
ctggttccagggtccctc

SEQ ID NO: 1375862 - DNA, 17 bp, Homo sapiens
ctggttctcaatgaaaa

SEQ ID NO: 1375863 - DNA, 18 bp, Homo sapiens
ctggttctcaatgaaaaa

SEQ ID NO: 1375864 - DNA, 16 bp, Homo sapiens
ctgtaacactcctctg

SEQ ID NO: 1375865 - DNA, 16 bp, Homo sapiens
ctgtaacttccaaata

SEQ ID NO: 1375866 - DNA, 19 bp, Homo sapiens
ctgtaacttccaaataaat

SEQ ID NO: 1375867 - DNA, 18 bp, Homo sapiens
ctgtaatcatttgtttac

SEQ ID NO: 1375868 - DNA, 22 bp, Homo sapiens
ctgtaatcccagctactcggga

SEQ ID NO: 1375869 - DNA, 19 bp, Homo sapiens
ctgtaatcctagcactttg

SEQ ID NO: 1375870 - DNA, 22 bp, Homo sapiens
ctgtactgttactgggccctga

SEQ ID NO: 1375871 - DNA, 18 bp, Homo sapiens
ctgtacttttcattctct

SEQ ID NO: 1375872 - DNA, 23 bp, Homo sapiens
ctgtagggtccaaccagacctgg

SEQ ID NO: 1375873 - DNA, 13 bp, Homo sapiens
ctgtatacagtgc

SEQ ID NO: 1375874 - DNA, 22 bp, Homo sapiens
ctgtatacagtgcagagccttc

SEQ ID NO: 1375875 - DNA, 15 bp, Homo sapiens
ctgtatataaaggtg

SEQ ID NO: 1375876 - DNA, 16 bp, Homo sapiens
ctgtatcattttcttt

SEQ ID NO: 1375877 - DNA, 20 bp, Homo sapiens
ctgtatgaaaaattggggag

SEQ ID NO: 1375878 - DNA, 18 bp, Homo sapiens
ctgtatttaaaaatagaa

SEQ ID NO: 1375879 - DNA, 19 bp, Homo sapiens
ctgtatttgaaagtgcctt

SEQ ID NO: 1375880 - DNA, 21 bp, Homo sapiens
ctgtattttatttagacaaga

SEQ ID NO: 1375881 - DNA, 22 bp, Homo sapiens
ctgtattttatttagacaagag

SEQ ID NO: 1375882 - DNA, 20 bp, Homo sapiens
ctgtattttgtttttgtctt

SEQ ID NO: 1375883 - DNA, 19 bp, Homo sapiens
gaaaaatcgcgagtgtttc

SEQ ID NO: 1375884 - DNA, 16 bp, Homo sapiens
gaaaacatggaacagt

SEQ ID NO: 1375885 - DNA, 16 bp, Homo sapiens
gaaaacatgttaatga

SEQ ID NO: 1375886 - DNA, 23 bp, Homo sapiens
gaaaagattcttctgtgtttata

SEQ ID NO: 1375887 - DNA, 23 bp, Homo sapiens
gaaaagtggcgtgggagccagcc

SEQ ID NO: 1375888 - DNA, 15 bp, Homo sapiens
gaaaatagtttattt

SEQ ID NO: 1375889 - DNA, 20 bp, Homo sapiens
gaaaatcagcctgctccagc

SEQ ID NO: 1375890 - DNA, 18 bp, Homo sapiens
gaaaatgaaatgcatatt

SEQ ID NO: 1375891 - DNA, 14 bp, Homo sapiens
gaaaatgtccagga

SEQ ID NO: 1375892 - DNA, 15 bp, Homo sapiens
gaaaatgtccaggaa

SEQ ID NO: 1375893 - DNA, 22 bp, Homo sapiens
gaaaatgtgaccctccaaatgg

SEQ ID NO: 1375894 - DNA, 22 bp, Homo sapiens
gaaaattacagtccaaaatact

SEQ ID NO: 1375895 - DNA, 21 bp, Homo sapiens
gaaaattcatagtaagattga

SEQ ID NO: 1375896 - DNA, 19 bp, Homo sapiens
gaaaattgaaataaagcta

SEQ ID NO: 1375897 - DNA, 21 bp, Homo sapiens
gaaaattgtttagtgatatta

SEQ ID NO: 1375898 - DNA, 16 bp, Homo sapiens
gaaacaaccatgtcat

SEQ ID NO: 1375899 - DNA, 17 bp, Homo sapiens
gaaacactgccttttta

SEQ ID NO: 1375900 - DNA, 23 bp, Homo sapiens
gaaaccatgtagcagtgagtcat

SEQ ID NO: 1375901 - DNA, 19 bp, Homo sapiens
gaaactaaagcaatagaaa

SEQ ID NO: 1375902 - DNA, 19 bp, Homo sapiens
gaaactatattttgtcata

SEQ ID NO: 1375903 - DNA, 17 bp, Homo sapiens
gaaacttgtttcactga

SEQ ID NO: 1375904 - DNA, 21 bp, Homo sapiens
gaaactttgggaaaacatgtt

SEQ ID NO: 1375905 - DNA, 14 bp, Homo sapiens
gaaacttttctaga

SEQ ID NO: 1375906 - DNA, 15 bp, Homo sapiens
gaaacttttctagaa

SEQ ID NO: 1375907 - DNA, 19 bp, Homo sapiens
gaaagacactgcctgggct

SEQ ID NO: 1375908 - DNA, 17 bp, Homo sapiens
gaaagaggcaccaggaa

SEQ ID NO: 1375909 - DNA, 23 bp, Homo sapiens
gaaagcatatgggttagatgttg

SEQ ID NO: 1375910 - DNA, 22 bp, Homo sapiens
gaaagctttattttgagatgta

SEQ ID NO: 1375911 - DNA, 20 bp, Homo sapiens
gaaaggcaggcctatttcat

SEQ ID NO: 1375912 - DNA, 14 bp, Homo sapiens
gaaagtgcattttt

SEQ ID NO: 1375913 - DNA, 19 bp, Homo sapiens
gaaagtggtcttaagaaat

SEQ ID NO: 1375914 - DNA, 15 bp, Homo sapiens
gaaagttttgtaaaa

SEQ ID NO: 1375915 - DNA, 18 bp, Homo sapiens
gaaagttttgtaaaagaa

SEQ ID NO: 1375916 - DNA, 21 bp, Homo sapiens
gaaagttttgtaaaagaaatc

SEQ ID NO: 1375917 - DNA, 14 bp, Homo sapiens
gaaataggaaacaa

SEQ ID NO: 1375918 - DNA, 16 bp, Homo sapiens
gaaatatcaaagtcat

SEQ ID NO: 1375919 - DNA, 23 bp, Homo sapiens
gaaatatcaaagtcattaaagac

SEQ ID NO: 1375920 - DNA, 12 bp, Homo sapiens
gaaatcaaagtg

SEQ ID NO: 1375921 - DNA, 15 bp, Homo sapiens
gaaatcagccaagtt

SEQ ID NO: 1375922 - DNA, 20 bp, Homo sapiens
gaaatgaaaacagtgtgtaa

SEQ ID NO: 1375923 - DNA, 21 bp, Homo sapiens
gaaatgaaatattgtttccaa

SEQ ID NO: 1375924 - DNA, 15 bp, Homo sapiens
gaaatgaggaggatg

SEQ ID NO: 1375925 - DNA, 20 bp, Homo sapiens
gaaatgtgaatttttattgt

SEQ ID NO: 1375926 - DNA, 18 bp, Homo sapiens
gaaatgttttgtaaacat

SEQ ID NO: 1375927 - DNA, 22 bp, Homo sapiens
gaaatgttttgtaaacatttat

SEQ ID NO: 1375928 - DNA, 16 bp, Homo sapiens
gaaattctcctggagg

SEQ ID NO: 1375929 - DNA, 16 bp, Homo sapiens
gaaattgcatactttg

SEQ ID NO: 1375930 - DNA, 23 bp, Homo sapiens
gaaatttgggagagccatacata

SEQ ID NO: 1375931 - DNA, 19 bp, Homo sapiens
gaaattttgtaagaaggca

SEQ ID NO: 1375932 - DNA, 20 bp, Homo sapiens
gaacaagttgagctatgact

SEQ ID NO: 1375933 - DNA, 22 bp, Homo sapiens
gaacaagttgagctatgactta

SEQ ID NO: 1375934 - DNA, 16 bp, Homo sapiens
gaacacacacatatac

SEQ ID NO: 1375935 - DNA, 17 bp, Homo sapiens
gaacacacacatataca

SEQ ID NO: 1375936 - DNA, 22 bp, Homo sapiens
gaacactaactcaccagcccca

SEQ ID NO: 1375937 - DNA, 18 bp, Homo sapiens
gaacatccaaccttccca

SEQ ID NO: 1375938 - DNA, 19 bp, Homo sapiens
gaaccacattgaagaatgt

SEQ ID NO: 1375939 - DNA, 13 bp, Homo sapiens
gaaccacttgtag

SEQ ID NO: 1375940 - DNA, 20 bp, Homo sapiens
gaaccacttgtagatttgat

SEQ ID NO: 1375941 - DNA, 14 bp, Homo sapiens
gaaccataaaatgt

SEQ ID NO: 1375942 - DNA, 13 bp, Homo sapiens
gaaccctttattt

SEQ ID NO: 1375943 - DNA, 17 bp, Homo sapiens
gaacctccccagcctgc

SEQ ID NO: 1375944 - DNA, 18 bp, Homo sapiens
gaacctccccagcctgcg

SEQ ID NO: 1375945 - DNA, 21 bp, Homo sapiens
gaacgaaccttggcctgggcc

SEQ ID NO: 1375946 - DNA, 19 bp, Homo sapiens
gaactatattagtatgtat

SEQ ID NO: 1375947 - DNA, 14 bp, Homo sapiens
gaactcactggggc

SEQ ID NO: 1375948 - DNA, 16 bp, Homo sapiens
gaactcactggggcct

SEQ ID NO: 1375949 - DNA, 17 bp, Homo sapiens
gaactccaggccctcct

SEQ ID NO: 1375950 - DNA, 14 bp, Homo sapiens
gaactcttctcatt

SEQ ID NO: 1375951 - DNA, 12 bp, Homo sapiens
gaactgcaggcc

SEQ ID NO: 1375952 - DNA, 16 bp, Homo sapiens
gaactgcaggccctgg

SEQ ID NO: 1375953 - DNA, 14 bp, Homo sapiens
gaacttgaatgtgt

SEQ ID NO: 1375954 - DNA, 13 bp, Homo sapiens
gaacttggaagca

SEQ ID NO: 1375955 - DNA, 12 bp, Homo sapiens
gaactttgtata

SEQ ID NO: 1375956 - DNA, 21 bp, Homo sapiens
gaactttgtatagttatgtaa

SEQ ID NO: 1375957 - DNA, 19 bp, Homo sapiens
gaagaacaggcctctccat

SEQ ID NO: 1375958 - DNA, 14 bp, Homo sapiens
gaagaactgcaggc

SEQ ID NO: 1375959 - DNA, 19 bp, Homo sapiens
gaagaactgcaggccctgg

SEQ ID NO: 1375960 - DNA, 14 bp, Homo sapiens
gaagaagctctctc

SEQ ID NO: 1375961 - DNA, 15 bp, Homo sapiens
gaagaagggagaaga

SEQ ID NO: 1375962 - DNA, 18 bp, Homo sapiens
gaagaagggagaagaaag

SEQ ID NO: 1375963 - DNA, 19 bp, Homo sapiens
gaagaagggagaagaaagg

SEQ ID NO: 1375964 - DNA, 12 bp, Homo sapiens
gaagaatgaaag

SEQ ID NO: 1375965 - DNA, 17 bp, Homo sapiens
gaagagatccaaagact

SEQ ID NO: 1375966 - DNA, 17 bp, Homo sapiens
gaagagctattatataa

SEQ ID NO: 1375967 - DNA, 12 bp, Homo sapiens
gaagatactttg

SEQ ID NO: 1375968 - DNA, 15 bp, Homo sapiens
gaagatactttgtat

SEQ ID NO: 1375969 - DNA, 19 bp, Homo sapiens
gaagatcattttgaaattg

SEQ ID NO: 1375970 - DNA, 14 bp, Homo sapiens
gaagatcctgcggg

SEQ ID NO: 1375971 - DNA, 20 bp, Homo sapiens
gaagcaagtaaaaaggctaa

SEQ ID NO: 1375972 - DNA, 23 bp, Homo sapiens
gaagcacaccaatcttactttgt

SEQ ID NO: 1375973 - DNA, 15 bp, Homo sapiens
gaagcacagaatatt

SEQ ID NO: 1375974 - DNA, 17 bp, Homo sapiens
gaagcacagaatatttt

SEQ ID NO: 1375975 - DNA, 15 bp, Homo sapiens
gaagcagaggaagga

SEQ ID NO: 1375976 - DNA, 15 bp, Homo sapiens
gaagccaagggaaag

SEQ ID NO: 1375977 - DNA, 16 bp, Homo sapiens
gaagccaagggaaagg

SEQ ID NO: 1375978 - DNA, 17 bp, Homo sapiens
gaagccaagggaaaggg

SEQ ID NO: 1375979 - DNA, 20 bp, Homo sapiens
gaagccaagggaaaggggtg

SEQ ID NO: 1375980 - DNA, 13 bp, Homo sapiens
gaagccaagtggg

SEQ ID NO: 1375981 - DNA, 19 bp, Homo sapiens
gaagccaagtggggtgctg

SEQ ID NO: 1375982 - DNA, 21 bp, Homo sapiens
gaagccaagtggggtgctggg

SEQ ID NO: 1375983 - DNA, 19 bp, Homo sapiens
gaagccatctaaagtaaaa

SEQ ID NO: 1375984 - DNA, 14 bp, Homo sapiens
gaagcccaggagcc

SEQ ID NO: 1375985 - DNA, 19 bp, Homo sapiens
gaagcccatcctgaccagc

SEQ ID NO: 1375986 - DNA, 21 bp, Homo sapiens
gaagcccatcctgaccagctg

SEQ ID NO: 1375987 - DNA, 22 bp, Homo sapiens
gaagcctgtaacactcctctgc

SEQ ID NO: 1375988 - DNA, 16 bp, Homo sapiens
gaagccttcagctcca

SEQ ID NO: 1375989 - DNA, 15 bp, Homo sapiens
gaagctgcaggcttt

SEQ ID NO: 1375990 - DNA, 13 bp, Homo sapiens
gaagctgcatcca

SEQ ID NO: 1375991 - DNA, 20 bp, Homo sapiens
gaaggaagccggggaagaga

SEQ ID NO: 1375992 - DNA, 17 bp, Homo sapiens
gaaggcaagagggggtg

SEQ ID NO: 1375993 - DNA, 23 bp, Homo sapiens
gaaggcaagagggggtggagggg

SEQ ID NO: 1375994 - DNA, 16 bp, Homo sapiens
gaaggcaagccaggct

SEQ ID NO: 1375995 - DNA, 14 bp, Homo sapiens
gaagggaaagtttt

SEQ ID NO: 1375996 - DNA, 13 bp, Homo sapiens
gaagggcaagttt

SEQ ID NO: 1375997 - DNA, 13 bp, Homo sapiens
gaagggtttctct

SEQ ID NO: 1375998 - DNA, 14 bp, Homo sapiens
gaaggtttattgtt

SEQ ID NO: 1375999 - DNA, 22 bp, Homo sapiens
gaaggtttattgttaatacaag

SEQ ID NO: 1376000 - DNA, 21 bp, Homo sapiens
gaagtatgtatattaaaaaag

SEQ ID NO: 1376001 - DNA, 12 bp, Homo sapiens
gaggaggggagg

SEQ ID NO: 1376002 - DNA, 12 bp, Homo sapiens
gaggagggtggg

SEQ ID NO: 1376003 - DNA, 14 bp, Homo sapiens
gaggattagtttag

SEQ ID NO: 1376004 - DNA, 16 bp, Homo sapiens
gaggattgcttgagct

SEQ ID NO: 1376005 - DNA, 20 bp, Homo sapiens
gaggcaggcatggccctggg

SEQ ID NO: 1376006 - DNA, 14 bp, Homo sapiens
gaggcaggctccag

SEQ ID NO: 1376007 - DNA, 20 bp, Homo sapiens
gaggcatcctacccttttct

SEQ ID NO: 1376008 - DNA, 17 bp, Homo sapiens
gaggccaaggtgggagg

SEQ ID NO: 1376009 - DNA, 12 bp, Homo sapiens
gaggccccaggg

SEQ ID NO: 1376010 - DNA, 16 bp, Homo sapiens
gaggcccccagcccag

SEQ ID NO: 1376011 - DNA, 17 bp, Homo sapiens
gaggcccccagcccagg

SEQ ID NO: 1376012 - DNA, 17 bp, Homo sapiens
gaggccctttgctgtcc

SEQ ID NO: 1376013 - DNA, 19 bp, Homo sapiens
gaggcctgcgaccctgggg

SEQ ID NO: 1376014 - DNA, 20 bp, Homo sapiens
gaggcctgcgaccctggggg

SEQ ID NO: 1376015 - DNA, 22 bp, Homo sapiens
gaggcgcccttggcttctgtga

SEQ ID NO: 1376016 - DNA, 15 bp, Homo sapiens
gaggctgaggcagga

SEQ ID NO: 1376017 - DNA, 15 bp, Homo sapiens
gaggctgcccctctc

SEQ ID NO: 1376018 - DNA, 19 bp, Homo sapiens
gaggctgcccctctcacca

SEQ ID NO: 1376019 - DNA, 15 bp, Homo sapiens
gaggcttcctgcgtc

SEQ ID NO: 1376020 - DNA, 20 bp, Homo sapiens
gagggacggccaagaatgta

SEQ ID NO: 1376021 - DNA, 22 bp, Homo sapiens
gagggacgtcagacttggctca

SEQ ID NO: 1376022 - DNA, 13 bp, Homo sapiens
gagggagagggag

SEQ ID NO: 1376023 - DNA, 12 bp, Homo sapiens
gagggaggcccc

SEQ ID NO: 1376024 - DNA, 21 bp, Homo sapiens
gagggaggggaaaagcatttt

SEQ ID NO: 1376025 - DNA, 18 bp, Homo sapiens
gagggattctggttccag

SEQ ID NO: 1376026 - DNA, 21 bp, Homo sapiens
gagggcagactggggcatcct

SEQ ID NO: 1376027 - DNA, 23 bp, Homo sapiens
gagggcagactggggcatcctgt

SEQ ID NO: 1376028 - DNA, 19 bp, Homo sapiens
gagggcggcaggggcctgg

SEQ ID NO: 1376029 - DNA, 14 bp, Homo sapiens
gagggggccgggcg

SEQ ID NO: 1376030 - DNA, 21 bp, Homo sapiens
gagggggccgggcgcggtggc

SEQ ID NO: 1376031 - DNA, 21 bp, Homo sapiens
gagggggcttgaagccaaaga

SEQ ID NO: 1376032 - DNA, 14 bp, Homo sapiens
gaggggtgtggcag

SEQ ID NO: 1376033 - DNA, 15 bp, Homo sapiens
gagggtgggggaggg

SEQ ID NO: 1376034 - DNA, 15 bp, Homo sapiens
gaggtcactggaaag

SEQ ID NO: 1376035 - DNA, 14 bp, Homo sapiens
gaggtcctctggag

SEQ ID NO: 1376036 - DNA, 23 bp, Homo sapiens
gaggtcggtaggttcagccaagg

SEQ ID NO: 1376037 - DNA, 21 bp, Homo sapiens
gaggtgattccagtgaagata

SEQ ID NO: 1376038 - DNA, 17 bp, Homo sapiens
gaggtggaagaagggag

SEQ ID NO: 1376039 - DNA, 18 bp, Homo sapiens
gaggtgggaggtggaaga

SEQ ID NO: 1376040 - DNA, 17 bp, Homo sapiens
gaggttcctctgcctgc

SEQ ID NO: 1376041 - DNA, 19 bp, Homo sapiens
gaggttcctctgcctgccc

SEQ ID NO: 1376042 - DNA, 13 bp, Homo sapiens
gaggttgaagcca

SEQ ID NO: 1376043 - DNA, 16 bp, Homo sapiens
gaggttgtgcactgtt

SEQ ID NO: 1376044 - DNA, 19 bp, Homo sapiens
gaggttttaaaaaaatccc

SEQ ID NO: 1376045 - DNA, 16 bp, Homo sapiens
gaggttttatttcatt

SEQ ID NO: 1376046 - DNA, 17 bp, Homo sapiens
gagtaatcttgttggtt

SEQ ID NO: 1376047 - DNA, 23 bp, Homo sapiens
gagtagaaaatgtgaccctccaa

SEQ ID NO: 1376048 - DNA, 21 bp, Homo sapiens
gagtagccaggttctgccggt

SEQ ID NO: 1376049 - DNA, 18 bp, Homo sapiens
gagtattgaatggtggtg

SEQ ID NO: 1376050 - DNA, 21 bp, Homo sapiens
gagtattgtttaaaatgtaat

SEQ ID NO: 1376051 - DNA, 14 bp, Homo sapiens
gagtcaaggcctgc

SEQ ID NO: 1376052 - DNA, 22 bp, Homo sapiens
gagtctgttgtgtgtcatgcca

SEQ ID NO: 1376053 - DNA, 19 bp, Homo sapiens
gagtgccgcatctcacagc

SEQ ID NO: 1376054 - DNA, 14 bp, Homo sapiens
gagtggcaggggac

SEQ ID NO: 1376055 - DNA, 17 bp, Homo sapiens
gagtgtctggaattgtg

SEQ ID NO: 1376056 - DNA, 18 bp, Homo sapiens
gagtgtgagccacctaag

SEQ ID NO: 1376057 - DNA, 23 bp, Homo sapiens
gagtgtgagccacctaagatctc

SEQ ID NO: 1376058 - DNA, 17 bp, Homo sapiens
gagtgtgcctgaagtcc

SEQ ID NO: 1376059 - DNA, 17 bp, Homo sapiens
gagtgtgtatgccaaga

SEQ ID NO: 1376060 - DNA, 13 bp, Homo sapiens
gagttgtttttgt

SEQ ID NO: 1376061 - DNA, 17 bp, Homo sapiens
gagtttgtcgctcatgt

SEQ ID NO: 1376062 - DNA, 16 bp, Homo sapiens
gagttttgtcattcag

SEQ ID NO: 1376063 - DNA, 22 bp, Homo sapiens
gataatattgtttggtaaatgt

SEQ ID NO: 1376064 - DNA, 15 bp, Homo sapiens
gataatgtattttaa

SEQ ID NO: 1376065 - DNA, 19 bp, Homo sapiens
gatacagttttcagaaaaa

SEQ ID NO: 1376066 - DNA, 13 bp, Homo sapiens
gataccagctgga

SEQ ID NO: 1376067 - DNA, 17 bp, Homo sapiens
gatacctccaaccctgc

SEQ ID NO: 1376068 - DNA, 23 bp, Homo sapiens
gatactgcgactttctgcctgga

SEQ ID NO: 1376069 - DNA, 16 bp, Homo sapiens
gatagctaactgtaaa

SEQ ID NO: 1376070 - DNA, 19 bp, Homo sapiens
gatagctaactgtaaatca

SEQ ID NO: 1376071 - DNA, 23 bp, Homo sapiens
gatagtcttttgcttttggcaaa

SEQ ID NO: 1376072 - DNA, 23 bp, Homo sapiens
gatagttgctatttttgtaaagt

SEQ ID NO: 1376073 - DNA, 21 bp, Homo sapiens
gatatataggctattttctaa

SEQ ID NO: 1376074 - DNA, 16 bp, Homo sapiens
gatatcatgcaaattt

SEQ ID NO: 1376075 - DNA, 23 bp, Homo sapiens
gatatctataaaatagatataaa

SEQ ID NO: 1376076 - DNA, 15 bp, Homo sapiens
gatattcagatgtat

SEQ ID NO: 1376077 - DNA, 20 bp, Homo sapiens
gatcaaaaaggcttataaaa

SEQ ID NO: 1376078 - DNA, 23 bp, Homo sapiens
gatcaaaaaggcttataaaacag

SEQ ID NO: 1376079 - DNA, 20 bp, Homo sapiens
gatcacaaatgactttatta

SEQ ID NO: 1376080 - DNA, 14 bp, Homo sapiens
gatcactgtttaga

SEQ ID NO: 1376081 - DNA, 23 bp, Homo sapiens
gatcacttagcgaaccctttatt

SEQ ID NO: 1376082 - DNA, 14 bp, Homo sapiens
gatcaggctcccag

SEQ ID NO: 1376083 - DNA, 12 bp, Homo sapiens
gatcatagtttt

SEQ ID NO: 1376084 - DNA, 13 bp, Homo sapiens
gatcatagtttta

SEQ ID NO: 1376085 - DNA, 14 bp, Homo sapiens
gatcatagttttat

SEQ ID NO: 1376086 - DNA, 19 bp, Homo sapiens
gatcatagttttatttata

SEQ ID NO: 1376087 - DNA, 20 bp, Homo sapiens
gatcatgtactttttagtaa

SEQ ID NO: 1376088 - DNA, 14 bp, Homo sapiens
gatccactttgggg

SEQ ID NO: 1376089 - DNA, 17 bp, Homo sapiens
gatccatttccattgct

SEQ ID NO: 1376090 - DNA, 23 bp, Homo sapiens
gatccatttccattgcttattat

SEQ ID NO: 1376091 - DNA, 18 bp, Homo sapiens
gatccccgcctggccagg

SEQ ID NO: 1376092 - DNA, 22 bp, Homo sapiens
gatccccgcctggccaggagca

SEQ ID NO: 1376093 - DNA, 18 bp, Homo sapiens
gatccgactgctttggac

SEQ ID NO: 1376094 - DNA, 16 bp, Homo sapiens
gatcctcctgcagacc

SEQ ID NO: 1376095 - DNA, 21 bp, Homo sapiens
gatcctcctgcagaccacgcc

SEQ ID NO: 1376096 - DNA, 15 bp, Homo sapiens
gatcctctcacctca

SEQ ID NO: 1376097 - DNA, 18 bp, Homo sapiens
gatcctgcgggtggggct

SEQ ID NO: 1376098 - DNA, 14 bp, Homo sapiens
gatctcagctttga

SEQ ID NO: 1376099 - DNA, 22 bp, Homo sapiens
gatctcagctttgagaagcctt

SEQ ID NO: 1376100 - DNA, 14 bp, Homo sapiens
gatctctcctggcc

SEQ ID NO: 1376101 - DNA, 16 bp, Homo sapiens
gatctctcctggccta

SEQ ID NO: 1376102 - DNA, 18 bp, Homo sapiens
gatctgcccatcgtgaag

SEQ ID NO: 1376103 - DNA, 19 bp, Homo sapiens
gatctgcccatcgtgaaga

SEQ ID NO: 1376104 - DNA, 23 bp, Homo sapiens
gatctgcccatcgtgaagaagcc

SEQ ID NO: 1376105 - DNA, 17 bp, Homo sapiens
gatctgcggatctcagc

SEQ ID NO: 1376106 - DNA, 18 bp, Homo sapiens
gatctgcggatctcagct

SEQ ID NO: 1376107 - DNA, 19 bp, Homo sapiens
gatctgcggatctcagctt

SEQ ID NO: 1376108 - DNA, 16 bp, Homo sapiens
gatctgctgcagagca

SEQ ID NO: 1376109 - DNA, 16 bp, Homo sapiens
gatctttcagaaatat

SEQ ID NO: 1376110 - DNA, 14 bp, Homo sapiens
gatgaaaacatagc

SEQ ID NO: 1376111 - DNA, 22 bp, Homo sapiens
gatgaaactaaagcaatagaaa

SEQ ID NO: 1376112 - DNA, 14 bp, Homo sapiens
gatgaatgtattta

SEQ ID NO: 1376113 - DNA, 15 bp, Homo sapiens
gatgacaataaagct

SEQ ID NO: 1376114 - DNA, 16 bp, Homo sapiens
gatgacaataaagctt

SEQ ID NO: 1376115 - DNA, 15 bp, Homo sapiens
gatgactgtgttgta

SEQ ID NO: 1376116 - DNA, 18 bp, Homo sapiens
gatgataaatatggttaa

SEQ ID NO: 1376117 - DNA, 14 bp, Homo sapiens
gatgatgctgccag

SEQ ID NO: 1376118 - DNA, 17 bp, Homo sapiens
gatgcaggctcccctga

SEQ ID NO: 1376119 - DNA, 21 bp, Homo sapiens
gccagcgcctccctccacccc

SEQ ID NO: 1376120 - DNA, 16 bp, Homo sapiens
gccagctggcctttgt

SEQ ID NO: 1376121 - DNA, 21 bp, Homo sapiens
gccaggagcaggcacgggtgg

SEQ ID NO: 1376122 - DNA, 12 bp, Homo sapiens
gccaggccagcc

SEQ ID NO: 1376123 - DNA, 19 bp, Homo sapiens
gccaggccagcctccgaga

SEQ ID NO: 1376124 - DNA, 22 bp, Homo sapiens
gccaggggaaaatcagcctgct

SEQ ID NO: 1376125 - DNA, 15 bp, Homo sapiens
gccaggtaatgtgaa

SEQ ID NO: 1376126 - DNA, 16 bp, Homo sapiens
gccaggtgagaaactg

SEQ ID NO: 1376127 - DNA, 21 bp, Homo sapiens
gccagtccaggctgccgtggg

SEQ ID NO: 1376128 - DNA, 13 bp, Homo sapiens
gccagtctgtgga

SEQ ID NO: 1376129 - DNA, 20 bp, Homo sapiens
gccagtctgtggatcagaga

SEQ ID NO: 1376130 - DNA, 15 bp, Homo sapiens
gccatgaagggaccc

SEQ ID NO: 1376131 - DNA, 18 bp, Homo sapiens
gccatgccagcttatctc

SEQ ID NO: 1376132 - DNA, 12 bp, Homo sapiens
gccatgtgcata

SEQ ID NO: 1376133 - DNA, 16 bp, Homo sapiens
gccatgtgcttctgcc

SEQ ID NO: 1376134 - DNA, 20 bp, Homo sapiens
gccattagccagatttgtct

SEQ ID NO: 1376135 - DNA, 20 bp, Homo sapiens
gccattctcctgcctcagcc

SEQ ID NO: 1376136 - DNA, 13 bp, Homo sapiens
gccatttatttat

SEQ ID NO: 1376137 - DNA, 20 bp, Homo sapiens
gccatttgcaataacagctg

SEQ ID NO: 1376138 - DNA, 16 bp, Homo sapiens
gcccaagccagaggct

SEQ ID NO: 1376139 - DNA, 18 bp, Homo sapiens
gcccaagccagaggctgg

SEQ ID NO: 1376140 - DNA, 18 bp, Homo sapiens
gcccaccccctgccctgc

SEQ ID NO: 1376141 - DNA, 20 bp, Homo sapiens
gcccaccccctgccctgcac

SEQ ID NO: 1376142 - DNA, 16 bp, Homo sapiens
gcccaccctgctgctg

SEQ ID NO: 1376143 - DNA, 18 bp, Homo sapiens
gcccaccctgctgctggt

SEQ ID NO: 1376144 - DNA, 20 bp, Homo sapiens
gcccaccctgctgctggtgc

SEQ ID NO: 1376145 - DNA, 21 bp, Homo sapiens
gcccaccctgctgctggtgca

SEQ ID NO: 1376146 - DNA, 22 bp, Homo sapiens
gcccaccctgctgctggtgcac

SEQ ID NO: 1376147 - DNA, 14 bp, Homo sapiens
gcccacctgccggc

SEQ ID NO: 1376148 - DNA, 15 bp, Homo sapiens
gcccacctgccggcc

SEQ ID NO: 1376149 - DNA, 20 bp, Homo sapiens
gcccagaataagttattgca

SEQ ID NO: 1376150 - DNA, 19 bp, Homo sapiens
gcccaggctggagtgcagt

SEQ ID NO: 1376151 - DNA, 18 bp, Homo sapiens
gcccagggcaagctccgc

SEQ ID NO: 1376152 - DNA, 12 bp, Homo sapiens
gcccagggctcc

SEQ ID NO: 1376153 - DNA, 21 bp, Homo sapiens
gcccagtgcatggtggccaga

SEQ ID NO: 1376154 - DNA, 17 bp, Homo sapiens
gcccatcgtgaagaagc

SEQ ID NO: 1376155 - DNA, 18 bp, Homo sapiens
gccccaatccctttatta

SEQ ID NO: 1376156 - DNA, 23 bp, Homo sapiens
gccccacagtctccggcctctcc

SEQ ID NO: 1376157 - DNA, 16 bp, Homo sapiens
gccccaccctgggccc

SEQ ID NO: 1376158 - DNA, 23 bp, Homo sapiens
gccccaccctgggccctgggctg

SEQ ID NO: 1376159 - DNA, 15 bp, Homo sapiens
gccccactgccagca

SEQ ID NO: 1376160 - DNA, 20 bp, Homo sapiens
gccccactgccagcagcagc

SEQ ID NO: 1376161 - DNA, 23 bp, Homo sapiens
gccccactgccagcagcagcagg

SEQ ID NO: 1376162 - DNA, 14 bp, Homo sapiens
gccccagccctgct

SEQ ID NO: 1376163 - DNA, 16 bp, Homo sapiens
gccccagccctgctgg

SEQ ID NO: 1376164 - DNA, 20 bp, Homo sapiens
gccccagccctgctggggat

SEQ ID NO: 1376165 - DNA, 12 bp, Homo sapiens
gccccagcctgc

SEQ ID NO: 1376166 - DNA, 12 bp, Homo sapiens
gccccatctccc

SEQ ID NO: 1376167 - DNA, 18 bp, Homo sapiens
gcccccacagttgctcta

SEQ ID NO: 1376168 - DNA, 17 bp, Homo sapiens
gcccccaccccggggac

SEQ ID NO: 1376169 - DNA, 17 bp, Homo sapiens
gcccccacttgcctctt

SEQ ID NO: 1376170 - DNA, 17 bp, Homo sapiens
gcccccagcccagggct

SEQ ID NO: 1376171 - DNA, 20 bp, Homo sapiens
gcccccagccccggggtgag

SEQ ID NO: 1376172 - DNA, 21 bp, Homo sapiens
gcccccagccccggggtgagt

SEQ ID NO: 1376173 - DNA, 16 bp, Homo sapiens
gccccctccgccctgc

SEQ ID NO: 1376174 - DNA, 13 bp, Homo sapiens
gccccctcctgaa

SEQ ID NO: 1376175 - DNA, 22 bp, Homo sapiens
gccccctcctgaaccgcacagc

SEQ ID NO: 1376176 - DNA, 19 bp, Homo sapiens
gccccctggcctctgtgcc

SEQ ID NO: 1376177 - DNA, 12 bp, Homo sapiens
gccccgactcca

SEQ ID NO: 1376178 - DNA, 18 bp, Homo sapiens
gccccgactccagccagc

SEQ ID NO: 1376179 - DNA, 21 bp, Homo sapiens
gccccgactccagccagcgcc

SEQ ID NO: 1376180 - DNA, 19 bp, Homo sapiens
gcccctagccggttcctgt

SEQ ID NO: 1376181 - DNA, 15 bp, Homo sapiens
gcccctctcaccaaa

SEQ ID NO: 1376182 - DNA, 14 bp, Homo sapiens
gcccctctggtcgc

SEQ ID NO: 1376183 - DNA, 18 bp, Homo sapiens
gcccctctggtcgctcct

SEQ ID NO: 1376184 - DNA, 13 bp, Homo sapiens
gcccctggcactc

SEQ ID NO: 1376185 - DNA, 19 bp, Homo sapiens
gcccctgggcttggcctgc

SEQ ID NO: 1376186 - DNA, 20 bp, Homo sapiens
gcccctgggcttggcctgct

SEQ ID NO: 1376187 - DNA, 22 bp, Homo sapiens
gcccgacatggctccggcctct

SEQ ID NO: 1376188 - DNA, 24 bp, Homo sapiens
gcccgacatggctccggcctctgc

SEQ ID NO: 1376189 - DNA, 23 bp, Homo sapiens
gcccgcagagcgcgcccctagcc

SEQ ID NO: 1376190 - DNA, 20 bp, Homo sapiens
gcccggccgctccaccagca

SEQ ID NO: 1376191 - DNA, 16 bp, Homo sapiens
gccctaagtttgtact

SEQ ID NO: 1376192 - DNA, 17 bp, Homo sapiens
gccctactccctgcaga

SEQ ID NO: 1376193 - DNA, 14 bp, Homo sapiens
gccctcccactttg

SEQ ID NO: 1376194 - DNA, 23 bp, Homo sapiens
gccctcccactttgctgttcctt

SEQ ID NO: 1376195 - DNA, 16 bp, Homo sapiens
gccctctcctttgttc

SEQ ID NO: 1376196 - DNA, 17 bp, Homo sapiens
gccctctgaacttgcct

SEQ ID NO: 1376197 - DNA, 14 bp, Homo sapiens
gccctgagctttct

SEQ ID NO: 1376198 - DNA, 16 bp, Homo sapiens
gccctgagctttctgc

SEQ ID NO: 1376199 - DNA, 11 bp, Homo sapiens
gccctgccact

SEQ ID NO: 1376200 - DNA, 15 bp, Homo sapiens
gccctggcagggggc

SEQ ID NO: 1376201 - DNA, 14 bp, Homo sapiens
gccctggcctcccc

SEQ ID NO: 1376202 - DNA, 16 bp, Homo sapiens
gccctggcctcccctg

SEQ ID NO: 1376203 - DNA, 17 bp, Homo sapiens
gccctggcctcccctgc

SEQ ID NO: 1376204 - DNA, 10 bp, Homo sapiens
gccctggctg

SEQ ID NO: 1376205 - DNA, 11 bp, Homo sapiens
gccctggctgc

SEQ ID NO: 1376206 - DNA, 12 bp, Homo sapiens
gccctggctgct

SEQ ID NO: 1376207 - DNA, 22 bp, Homo sapiens
gccctggctgctgcccccaccc

SEQ ID NO: 1376208 - DNA, 23 bp, Homo sapiens
gccctggctgttctgtggttcct

SEQ ID NO: 1376209 - DNA, 11 bp, Homo sapiens
gccctgggctg

SEQ ID NO: 1376210 - DNA, 14 bp, Homo sapiens
gccctgggctggaa

SEQ ID NO: 1376211 - DNA, 16 bp, Homo sapiens
gccctgggctggaatc

SEQ ID NO: 1376212 - DNA, 13 bp, Homo sapiens
gcccttgcctccc

SEQ ID NO: 1376213 - DNA, 14 bp, Homo sapiens
gcccttgggccacc

SEQ ID NO: 1376214 - DNA, 21 bp, Homo sapiens
gccctttccccgacgcccacc

SEQ ID NO: 1376215 - DNA, 22 bp, Homo sapiens
gccctttccccgacgcccaccc

SEQ ID NO: 1376216 - DNA, 13 bp, Homo sapiens
gcccttttcccct

SEQ ID NO: 1376217 - DNA, 19 bp, Homo sapiens
gccgaccagaggagccttt

SEQ ID NO: 1376218 - DNA, 17 bp, Homo sapiens
gccgagattgcaccact

SEQ ID NO: 1376219 - DNA, 14 bp, Homo sapiens
gccgatagagggac

SEQ ID NO: 1376220 - DNA, 15 bp, Homo sapiens
gccgccatgctcctg

SEQ ID NO: 1376221 - DNA, 20 bp, Homo sapiens
gccgccgctaggtagagtct

SEQ ID NO: 1376222 - DNA, 22 bp, Homo sapiens
gccgcctgcactcctcagggca

SEQ ID NO: 1376223 - DNA, 18 bp, Homo sapiens
gccgcgcgtccagctgcc

SEQ ID NO: 1376224 - DNA, 16 bp, Homo sapiens
gccgcgtggtgccatc

SEQ ID NO: 1376225 - DNA, 20 bp, Homo sapiens
gccgcgtggtgccatcccca

SEQ ID NO: 1376226 - DNA, 15 bp, Homo sapiens
gccgctccaccagca

SEQ ID NO: 1376227 - DNA, 16 bp, Homo sapiens
gccgctgagtggcagg

SEQ ID NO: 1376228 - DNA, 12 bp, Homo sapiens
gccgctgccacg

SEQ ID NO: 1376229 - DNA, 19 bp, Homo sapiens
gccggcagccccagcctgc

SEQ ID NO: 1376230 - DNA, 20 bp, Homo sapiens
gccggcagccccagcctgct

SEQ ID NO: 1376231 - DNA, 18 bp, Homo sapiens
gccggccctgtgtgcagg

SEQ ID NO: 1376232 - DNA, 20 bp, Homo sapiens
gccgggaccaccctgagccg

SEQ ID NO: 1376233 - DNA, 16 bp, Homo sapiens
gccgggacccagggcc

SEQ ID NO: 1376234 - DNA, 17 bp, Homo sapiens
gccgggcccctgggctt

SEQ ID NO: 1376235 - DNA, 19 bp, Homo sapiens
gccgggcccctgggcttgg

SEQ ID NO: 1376236 - DNA, 21 bp, Homo sapiens
gccgggcgcggtggctcacgc

SEQ ID NO: 1376237 - DNA, 18 bp, Homo sapiens
gctgcccactgtttctct

SEQ ID NO: 1376238 - DNA, 15 bp, Homo sapiens
gctgcccctctcacc

SEQ ID NO: 1376239 - DNA, 13 bp, Homo sapiens
gctgccgtggggc

SEQ ID NO: 1376240 - DNA, 21 bp, Homo sapiens
gctgcctcccttgtggcagca

SEQ ID NO: 1376241 - DNA, 13 bp, Homo sapiens
gctgccttcccta

SEQ ID NO: 1376242 - DNA, 15 bp, Homo sapiens
gctgccttccctagc

SEQ ID NO: 1376243 - DNA, 16 bp, Homo sapiens
gctgccttggctcaga

SEQ ID NO: 1376244 - DNA, 17 bp, Homo sapiens
gctgccttggctcagac

SEQ ID NO: 1376245 - DNA, 19 bp, Homo sapiens
gctgccttggctcagacat

SEQ ID NO: 1376246 - DNA, 21 bp, Homo sapiens
gctgccttggctcagacatgt

SEQ ID NO: 1376247 - DNA, 17 bp, Homo sapiens
gctgcggcgtacaggct

SEQ ID NO: 1376248 - DNA, 21 bp, Homo sapiens
gctgctatccccatctccctg

SEQ ID NO: 1376249 - DNA, 18 bp, Homo sapiens
gctgctatttattttcct

SEQ ID NO: 1376250 - DNA, 19 bp, Homo sapiens
gctgctatttattttccta

SEQ ID NO: 1376251 - DNA, 21 bp, Homo sapiens
gctgctgggggcaactggcca

SEQ ID NO: 1376252 - DNA, 17 bp, Homo sapiens
gctgctggtgcacagcc

SEQ ID NO: 1376253 - DNA, 22 bp, Homo sapiens
gctgctgtgcaacggtctcctg

SEQ ID NO: 1376254 - DNA, 13 bp, Homo sapiens
gctgcttcctcct

SEQ ID NO: 1376255 - DNA, 14 bp, Homo sapiens
gctgcttcctcctg

SEQ ID NO: 1376256 - DNA, 15 bp, Homo sapiens
gctgcttcctcctgg

SEQ ID NO: 1376257 - DNA, 16 bp, Homo sapiens
gctgcttcctcctgga

SEQ ID NO: 1376258 - DNA, 15 bp, Homo sapiens
gctggaagatcctgc

SEQ ID NO: 1376259 - DNA, 23 bp, Homo sapiens
gctggagggaggcgggggctgcc

SEQ ID NO: 1376260 - DNA, 16 bp, Homo sapiens
gctggcacccaccgtg

SEQ ID NO: 1376261 - DNA, 21 bp, Homo sapiens
gctggcacccaccgtggagga

SEQ ID NO: 1376262 - DNA, 15 bp, Homo sapiens
gctggccagtccagg

SEQ ID NO: 1376263 - DNA, 17 bp, Homo sapiens
gctggccagtccaggct

SEQ ID NO: 1376264 - DNA, 17 bp, Homo sapiens
gctggccccagccctgc

SEQ ID NO: 1376265 - DNA, 21 bp, Homo sapiens
gctggccccagccctgctggg

SEQ ID NO: 1376266 - DNA, 14 bp, Homo sapiens
gctggcctggacag

SEQ ID NO: 1376267 - DNA, 17 bp, Homo sapiens
gctggcgagagtctggc

SEQ ID NO: 1376268 - DNA, 20 bp, Homo sapiens
gctggcgagagtctggccct

SEQ ID NO: 1376269 - DNA, 16 bp, Homo sapiens
gctgggactcagcctt

SEQ ID NO: 1376270 - DNA, 23 bp, Homo sapiens
gctgggactcagccttcagacag

SEQ ID NO: 1376271 - DNA, 16 bp, Homo sapiens
gctgggaggagggaga

SEQ ID NO: 1376272 - DNA, 17 bp, Homo sapiens
gctgggaggagggagag

SEQ ID NO: 1376273 - DNA, 22 bp, Homo sapiens
gctgggaggagggagagggagg

SEQ ID NO: 1376274 - DNA, 17 bp, Homo sapiens
gctgggccgggacccag

SEQ ID NO: 1376275 - DNA, 23 bp, Homo sapiens
gctggggatccccgcctggccag

SEQ ID NO: 1376276 - DNA, 23 bp, Homo sapiens
gctgggggaagaagctctctcct

SEQ ID NO: 1376277 - DNA, 14 bp, Homo sapiens
gctgggggcaactg

SEQ ID NO: 1376278 - DNA, 22 bp, Homo sapiens
gctgggtggcaccagcagcctg

SEQ ID NO: 1376279 - DNA, 16 bp, Homo sapiens
gctgggttcatttgtg

SEQ ID NO: 1376280 - DNA, 12 bp, Homo sapiens
gctggtgcacag

SEQ ID NO: 1376281 - DNA, 21 bp, Homo sapiens
gctggtggagaactctggctt

SEQ ID NO: 1376282 - DNA, 18 bp, Homo sapiens
gctgtcccatagtccctg

SEQ ID NO: 1376283 - DNA, 16 bp, Homo sapiens
gctgtgctatgaattt

SEQ ID NO: 1376284 - DNA, 14 bp, Homo sapiens
gctgtgtgtcccag

SEQ ID NO: 1376285 - DNA, 16 bp, Homo sapiens
gctgtgtgtcccaggc

SEQ ID NO: 1376286 - DNA, 18 bp, Homo sapiens
gctgtgtgtcccaggcag

SEQ ID NO: 1376287 - DNA, 19 bp, Homo sapiens
gctgtgttggtgtggccca

SEQ ID NO: 1376288 - DNA, 13 bp, Homo sapiens
gctgttcagctgg

SEQ ID NO: 1376289 - DNA, 15 bp, Homo sapiens
gctgttggtgggacc

SEQ ID NO: 1376290 - DNA, 19 bp, Homo sapiens
gctgtttgagattctcaaa

SEQ ID NO: 1376291 - DNA, 17 bp, Homo sapiens
gctgtttgtcctgagat

SEQ ID NO: 1376292 - DNA, 13 bp, Homo sapiens
gcttaaatttctt

SEQ ID NO: 1376293 - DNA, 21 bp, Homo sapiens
gcttaaatttcttatgtgaca

SEQ ID NO: 1376294 - DNA, 12 bp, Homo sapiens
gcttaataccaa

SEQ ID NO: 1376295 - DNA, 18 bp, Homo sapiens
gcttaatggagttcttgt

SEQ ID NO: 1376296 - DNA, 20 bp, Homo sapiens
gcttagtttgtgtgttgtct

SEQ ID NO: 1376297 - DNA, 13 bp, Homo sapiens
gcttataaaacag

SEQ ID NO: 1376298 - DNA, 19 bp, Homo sapiens
gcttataaaacagagtaat

SEQ ID NO: 1376299 - DNA, 11 bp, Homo sapiens
gcttatatctg

SEQ ID NO: 1376300 - DNA, 20 bp, Homo sapiens
gcttatatctggcctctgct

SEQ ID NO: 1376301 - DNA, 13 bp, Homo sapiens
gcttatctcaggg

SEQ ID NO: 1376302 - DNA, 15 bp, Homo sapiens
gcttcacggaagagc

SEQ ID NO: 1376303 - DNA, 15 bp, Homo sapiens
gcttcagttgcttgt

SEQ ID NO: 1376304 - DNA, 20 bp, Homo sapiens
gcttcatgcacttaaagaag

SEQ ID NO: 1376305 - DNA, 19 bp, Homo sapiens
gcttccaggaaactccaca

SEQ ID NO: 1376306 - DNA, 13 bp, Homo sapiens
gcttccctaatct

SEQ ID NO: 1376307 - DNA, 14 bp, Homo sapiens
gcttccctaatcta

SEQ ID NO: 1376308 - DNA, 20 bp, Homo sapiens
gcttcctcccaacaagcagc

SEQ ID NO: 1376309 - DNA, 12 bp, Homo sapiens
gcttcctcctgg

SEQ ID NO: 1376310 - DNA, 20 bp, Homo sapiens
gcttcctgcgtcctcctcac

SEQ ID NO: 1376311 - DNA, 17 bp, Homo sapiens
gcttctcactgccatgc

SEQ ID NO: 1376312 - DNA, 22 bp, Homo sapiens
gcttctcactgccatgccagct

SEQ ID NO: 1376313 - DNA, 22 bp, Homo sapiens
gcttctcagatttctgaggaaa

SEQ ID NO: 1376314 - DNA, 17 bp, Homo sapiens
gcttctccgccagcctc

SEQ ID NO: 1376315 - DNA, 20 bp, Homo sapiens
gcttctccgccagcctcctc

SEQ ID NO: 1376316 - DNA, 13 bp, Homo sapiens
gcttctctgactt

SEQ ID NO: 1376317 - DNA, 13 bp, Homo sapiens
gcttctgcctgca

SEQ ID NO: 1376318 - DNA, 15 bp, Homo sapiens
gcttctgcttttctg

SEQ ID NO: 1376319 - DNA, 19 bp, Homo sapiens
gcttctgcttttctgccct

SEQ ID NO: 1376320 - DNA, 21 bp, Homo sapiens
gcttctgcttttctgccctgg

SEQ ID NO: 1376321 - DNA, 19 bp, Homo sapiens
gcttctgtgatgagctgat

SEQ ID NO: 1376322 - DNA, 19 bp, Homo sapiens
gcttctgtgcccagaatac

SEQ ID NO: 1376323 - DNA, 12 bp, Homo sapiens
gcttcttgcctc

SEQ ID NO: 1376324 - DNA, 20 bp, Homo sapiens
gcttcttgcctctgtgctgt

SEQ ID NO: 1376325 - DNA, 21 bp, Homo sapiens
gcttcttgcctctgtgctgtg

SEQ ID NO: 1376326 - DNA, 15 bp, Homo sapiens
gcttgaagccaaaga

SEQ ID NO: 1376327 - DNA, 18 bp, Homo sapiens
gcttgaagccaaagaaaa

SEQ ID NO: 1376328 - DNA, 14 bp, Homo sapiens
gcttgacctgaggc

SEQ ID NO: 1376329 - DNA, 18 bp, Homo sapiens
gcttgagccgggcccctg

SEQ ID NO: 1376330 - DNA, 21 bp, Homo sapiens
gcttgagccgggcccctgggc

SEQ ID NO: 1376331 - DNA, 11 bp, Homo sapiens
gcttgcagaac

SEQ ID NO: 1376332 - DNA, 19 bp, Homo sapiens
gcttgcagtgagccgagat

SEQ ID NO: 1376333 - DNA, 22 bp, Homo sapiens
gcttgcctgcagggccatggct

SEQ ID NO: 1376334 - DNA, 11 bp, Homo sapiens
gcttgctggcc

SEQ ID NO: 1376335 - DNA, 19 bp, Homo sapiens
gcttggggccaccaaagct

SEQ ID NO: 1376336 - DNA, 22 bp, Homo sapiens
gcttggggccaccaaagctgcc

SEQ ID NO: 1376337 - DNA, 23 bp, Homo sapiens
gcttggggccaccaaagctgccc

SEQ ID NO: 1376338 - DNA, 16 bp, Homo sapiens
gcttgtttacctttct

SEQ ID NO: 1376339 - DNA, 20 bp, Homo sapiens
gctttaaaaagggaagaaac

SEQ ID NO: 1376340 - DNA, 21 bp, Homo sapiens
gctttaccttttcagggctgg

SEQ ID NO: 1376341 - DNA, 16 bp, Homo sapiens
gctttattaatgtttt

SEQ ID NO: 1376342 - DNA, 20 bp, Homo sapiens
gctttattttgagatgtaaa

SEQ ID NO: 1376343 - DNA, 16 bp, Homo sapiens
gctttatttttttgaa

SEQ ID NO: 1376344 - DNA, 22 bp, Homo sapiens
gctttcccacttcccaccctgc

SEQ ID NO: 1376345 - DNA, 14 bp, Homo sapiens
gctttctggggcct

SEQ ID NO: 1376346 - DNA, 14 bp, Homo sapiens
gctttgagaagcct

SEQ ID NO: 1376347 - DNA, 16 bp, Homo sapiens
gctttgagaagccttc

SEQ ID NO: 1376348 - DNA, 15 bp, Homo sapiens
gctttgatccctgac

SEQ ID NO: 1376349 - DNA, 23 bp, Homo sapiens
gcttttaactttataaatccagt

SEQ ID NO: 1376350 - DNA, 19 bp, Homo sapiens
gcttttatagaggctagct

SEQ ID NO: 1376351 - DNA, 21 bp, Homo sapiens
gcttttccttggcattccgca

SEQ ID NO: 1376352 - DNA, 16 bp, Homo sapiens
gcttttctgccctggc

SEQ ID NO: 1376353 - DNA, 17 bp, Homo sapiens
gcttttttgttttggct

SEQ ID NO: 1376354 - DNA, 16 bp, Homo sapiens
ggaaaaggctggtaca

SEQ ID NO: 1376355 - DNA, 23 bp, Homo sapiens
ggctgaggcaggagaatggtgtg

SEQ ID NO: 1376356 - DNA, 20 bp, Homo sapiens
ggctgaggttcctctgcctg

SEQ ID NO: 1376357 - DNA, 21 bp, Homo sapiens
ggctgaggttcctctgcctgc

SEQ ID NO: 1376358 - DNA, 22 bp, Homo sapiens
ggctgaggttcctctgcctgcc

SEQ ID NO: 1376359 - DNA, 13 bp, Homo sapiens
ggctgcagaggcc

SEQ ID NO: 1376360 - DNA, 13 bp, Homo sapiens
ggctgcccctctc

SEQ ID NO: 1376361 - DNA, 23 bp, Homo sapiens
ggctgccgtggggccgccgcctc

SEQ ID NO: 1376362 - DNA, 20 bp, Homo sapiens
ggctgcctcccttgtggcag

SEQ ID NO: 1376363 - DNA, 21 bp, Homo sapiens
ggctgcggcgtacaggctggc

SEQ ID NO: 1376364 - DNA, 13 bp, Homo sapiens
ggctgcttcctcc

SEQ ID NO: 1376365 - DNA, 15 bp, Homo sapiens
ggctggaagatcctg

SEQ ID NO: 1376366 - DNA, 15 bp, Homo sapiens
ggctggacgtggtgg

SEQ ID NO: 1376367 - DNA, 21 bp, Homo sapiens
ggctggacttctacctgccct

SEQ ID NO: 1376368 - DNA, 11 bp, Homo sapiens
ggctgggccat

SEQ ID NO: 1376369 - DNA, 16 bp, Homo sapiens
ggctgggggaagaagc

SEQ ID NO: 1376370 - DNA, 13 bp, Homo sapiens
ggctgtcggcgct

SEQ ID NO: 1376371 - DNA, 21 bp, Homo sapiens
ggctgttctgtggttcctctg

SEQ ID NO: 1376372 - DNA, 21 bp, Homo sapiens
ggcttcctctagaagccaagg

SEQ ID NO: 1376373 - DNA, 23 bp, Homo sapiens
ggcttctccgccagcctcctctg

SEQ ID NO: 1376374 - DNA, 18 bp, Homo sapiens
ggcttctgtgatgagctg

SEQ ID NO: 1376375 - DNA, 17 bp, Homo sapiens
ggctttatttttttgaa

SEQ ID NO: 1376376 - DNA, 22 bp, Homo sapiens
gggaaagacactgcctgggctg

SEQ ID NO: 1376377 - DNA, 13 bp, Homo sapiens
gggaaaggggtgc

SEQ ID NO: 1376378 - DNA, 13 bp, Homo sapiens
gggaacctgtgtc

SEQ ID NO: 1376379 - DNA, 15 bp, Homo sapiens
gggaatccaagcctc

SEQ ID NO: 1376380 - DNA, 21 bp, Homo sapiens
gggaatccaagcctccacagc

SEQ ID NO: 1376381 - DNA, 17 bp, Homo sapiens
gggacatcacagggtgg

SEQ ID NO: 1376382 - DNA, 17 bp, Homo sapiens
gggaccaccctgagccg

SEQ ID NO: 1376383 - DNA, 21 bp, Homo sapiens
gggacccaatgtaggagctgc

SEQ ID NO: 1376384 - DNA, 23 bp, Homo sapiens
gggaccctgtgacatggtgcctg

SEQ ID NO: 1376385 - DNA, 20 bp, Homo sapiens
gggacgctccgctgccgtgc

SEQ ID NO: 1376386 - DNA, 16 bp, Homo sapiens
gggactgctaaataaa

SEQ ID NO: 1376387 - DNA, 18 bp, Homo sapiens
gggagacggtttccaggg

SEQ ID NO: 1376388 - DNA, 21 bp, Homo sapiens
gggagacggtttccagggagg

SEQ ID NO: 1376389 - DNA, 14 bp, Homo sapiens
gggagactttgatg

SEQ ID NO: 1376390 - DNA, 14 bp, Homo sapiens
gggagagagagaga

SEQ ID NO: 1376391 - DNA, 12 bp, Homo sapiens
gggagagcctgc

SEQ ID NO: 1376392 - DNA, 16 bp, Homo sapiens
gggagagcctgctggc

SEQ ID NO: 1376393 - DNA, 11 bp, Homo sapiens
gggagccagcc

SEQ ID NO: 1376394 - DNA, 20 bp, Homo sapiens
gggagccggtaactgtcctg

SEQ ID NO: 1376395 - DNA, 21 bp, Homo sapiens
gggagcctttggttctggcca

SEQ ID NO: 1376396 - DNA, 23 bp, Homo sapiens
gggagctccactctgcttctctg

SEQ ID NO: 1376397 - DNA, 18 bp, Homo sapiens
gggaggagggagagggag

SEQ ID NO: 1376398 - DNA, 19 bp, Homo sapiens
gggaggccaaggtgggagg

SEQ ID NO: 1376399 - DNA, 22 bp, Homo sapiens
gggagggcggcaggggcctgga

SEQ ID NO: 1376400 - DNA, 16 bp, Homo sapiens
gggaggggagactttg

SEQ ID NO: 1376401 - DNA, 17 bp, Homo sapiens
gggatccccgcctggcc

SEQ ID NO: 1376402 - DNA, 17 bp, Homo sapiens
gggatccgactgctttg

SEQ ID NO: 1376403 - DNA, 20 bp, Homo sapiens
gggcaagctccgcaggactt

SEQ ID NO: 1376404 - DNA, 13 bp, Homo sapiens
gggcacagggtct

SEQ ID NO: 1376405 - DNA, 20 bp, Homo sapiens
gggcaccaggggtttctcgc

SEQ ID NO: 1376406 - DNA, 18 bp, Homo sapiens
gggcagcctcccccggct

SEQ ID NO: 1376407 - DNA, 16 bp, Homo sapiens
gggccaccaaagctgc

SEQ ID NO: 1376408 - DNA, 17 bp, Homo sapiens
gggccaccaaagctgcc

SEQ ID NO: 1376409 - DNA, 13 bp, Homo sapiens
gggccacccctcc

SEQ ID NO: 1376410 - DNA, 14 bp, Homo sapiens
gggccacccctcct

SEQ ID NO: 1376411 - DNA, 20 bp, Homo sapiens
gggccatgctgaggcctggg

SEQ ID NO: 1376412 - DNA, 15 bp, Homo sapiens
gggccatgtccaaag

SEQ ID NO: 1376413 - DNA, 22 bp, Homo sapiens
gggccatgtccaaagaggctgc

SEQ ID NO: 1376414 - DNA, 23 bp, Homo sapiens
gggccatgtccaaagaggctgcc

SEQ ID NO: 1376415 - DNA, 22 bp, Homo sapiens
gggcccagtgcatggtggccag

SEQ ID NO: 1376416 - DNA, 12 bp, Homo sapiens
gggcccctggca

SEQ ID NO: 1376417 - DNA, 15 bp, Homo sapiens
gggcccctggcactc

SEQ ID NO: 1376418 - DNA, 21 bp, Homo sapiens
gggcccctgggcttggcctgc

SEQ ID NO: 1376419 - DNA, 23 bp, Homo sapiens
gggcccctgggcttggcctgctg

SEQ ID NO: 1376420 - DNA, 18 bp, Homo sapiens
gggcccgacatggctccg

SEQ ID NO: 1376421 - DNA, 23 bp, Homo sapiens
gggcccggcccgcgccacaggac

SEQ ID NO: 1376422 - DNA, 20 bp, Homo sapiens
gggccgcgtggtgccatccc

SEQ ID NO: 1376423 - DNA, 23 bp, Homo sapiens
gggccgcgtggtgccatccccag

SEQ ID NO: 1376424 - DNA, 12 bp, Homo sapiens
gggccgctgcca

SEQ ID NO: 1376425 - DNA, 20 bp, Homo sapiens
gggccgggcgcggtggctca

SEQ ID NO: 1376426 - DNA, 23 bp, Homo sapiens
gggccgtatctccggctcccagc

SEQ ID NO: 1376427 - DNA, 23 bp, Homo sapiens
gggcctagcgatctctcctggcc

SEQ ID NO: 1376428 - DNA, 14 bp, Homo sapiens
gggcctccagaact

SEQ ID NO: 1376429 - DNA, 16 bp, Homo sapiens
gggcctgcccagacaa

SEQ ID NO: 1376430 - DNA, 21 bp, Homo sapiens
gggcctggagatcctcctgca

SEQ ID NO: 1376431 - DNA, 18 bp, Homo sapiens
gggccttttctggcaccg

SEQ ID NO: 1376432 - DNA, 21 bp, Homo sapiens
gggccttttctggcaccgcag

SEQ ID NO: 1376433 - DNA, 13 bp, Homo sapiens
gggcgtggaggga

SEQ ID NO: 1376434 - DNA, 14 bp, Homo sapiens
gggctcacacacct

SEQ ID NO: 1376435 - DNA, 22 bp, Homo sapiens
gggctcccaggggtctccctgg

SEQ ID NO: 1376436 - DNA, 16 bp, Homo sapiens
gggctgagctgcctgt

SEQ ID NO: 1376437 - DNA, 16 bp, Homo sapiens
gggctgtcggcgctgc

SEQ ID NO: 1376438 - DNA, 20 bp, Homo sapiens
gggcttaatggagttcttgt

SEQ ID NO: 1376439 - DNA, 16 bp, Homo sapiens
gggcttctgtgcccag

SEQ ID NO: 1376440 - DNA, 16 bp, Homo sapiens
gggcttggcctgctgt

SEQ ID NO: 1376441 - DNA, 15 bp, Homo sapiens
gggctttctggggcc

SEQ ID NO: 1376442 - DNA, 19 bp, Homo sapiens
ggggaaaatcagcctgctc

SEQ ID NO: 1376443 - DNA, 16 bp, Homo sapiens
ggggacgctccgctgc

SEQ ID NO: 1376444 - DNA, 18 bp, Homo sapiens
ggggagactttgatgtca

SEQ ID NO: 1376445 - DNA, 14 bp, Homo sapiens
ggggagagcctgct

SEQ ID NO: 1376446 - DNA, 14 bp, Homo sapiens
ggggagggattctg

SEQ ID NO: 1376447 - DNA, 17 bp, Homo sapiens
ggggatcacagcctctg

SEQ ID NO: 1376448 - DNA, 23 bp, Homo sapiens
ggggatccccgcctggccaggag

SEQ ID NO: 1376449 - DNA, 13 bp, Homo sapiens
ggggcacaggagg

SEQ ID NO: 1376450 - DNA, 13 bp, Homo sapiens
ggggcagggagct

SEQ ID NO: 1376451 - DNA, 15 bp, Homo sapiens
ggggcatgaccagat

SEQ ID NO: 1376452 - DNA, 13 bp, Homo sapiens
ggggcgtccaggc

SEQ ID NO: 1376453 - DNA, 17 bp, Homo sapiens
ggggctgaggtgggagg

SEQ ID NO: 1376454 - DNA, 21 bp, Homo sapiens
ggggtctccctggctccctcc

SEQ ID NO: 1376455 - DNA, 12 bp, Homo sapiens
ggggtctttgtg

SEQ ID NO: 1376456 - DNA, 16 bp, Homo sapiens
ggggtgcttccttgta

SEQ ID NO: 1376457 - DNA, 19 bp, Homo sapiens
ggggtttcctggcactgga

SEQ ID NO: 1376458 - DNA, 24 bp, Homo sapiens
gggtaggggaagaagagctatcag

SEQ ID NO: 1376459 - DNA, 13 bp, Homo sapiens
gggtccttcctga

SEQ ID NO: 1376460 - DNA, 15 bp, Homo sapiens
gggtcggctgaccat

SEQ ID NO: 1376461 - DNA, 13 bp, Homo sapiens
gggtctccctggc

SEQ ID NO: 1376462 - DNA, 17 bp, Homo sapiens
gggtctccctggctccc

SEQ ID NO: 1376463 - DNA, 21 bp, Homo sapiens
gggtctccctggctccctcct

SEQ ID NO: 1376464 - DNA, 19 bp, Homo sapiens
gggtcttgattcagtcaca

SEQ ID NO: 1376465 - DNA, 22 bp, Homo sapiens
gggtctttgtggtagcttatct

SEQ ID NO: 1376466 - DNA, 21 bp, Homo sapiens
gggtggccgctgagtggcagg

SEQ ID NO: 1376467 - DNA, 13 bp, Homo sapiens
gggtggggaaagg

SEQ ID NO: 1376468 - DNA, 19 bp, Homo sapiens
gggtgtccccgctgctgtg

SEQ ID NO: 1376469 - DNA, 12 bp, Homo sapiens
gggtgtggcagt

SEQ ID NO: 1376470 - DNA, 18 bp, Homo sapiens
gggttagatgttgccatg

SEQ ID NO: 1376471 - DNA, 19 bp, Homo sapiens
ggtaaaactcactgtgatc

SEQ ID NO: 1376472 - DNA, 16 bp, Homo sapiens
ggtaaagactggcttt

SEQ ID NO: 1376473 - DNA, 23 bp, Homo sapiens
gtgtctggaattgtggctatcct

SEQ ID NO: 1376474 - DNA, 20 bp, Homo sapiens
gtgtcttgggcagagctggc

SEQ ID NO: 1376475 - DNA, 21 bp, Homo sapiens
gtgtctttgtgattttgagta

SEQ ID NO: 1376476 - DNA, 17 bp, Homo sapiens
gtgtgaacttggaagca

SEQ ID NO: 1376477 - DNA, 22 bp, Homo sapiens
gtgtgagaagtgaatgctggga

SEQ ID NO: 1376478 - DNA, 16 bp, Homo sapiens
gtgtgcgctctgtgga

SEQ ID NO: 1376479 - DNA, 13 bp, Homo sapiens
gtgtggagaagcg

SEQ ID NO: 1376480 - DNA, 19 bp, Homo sapiens
gtgtggattgcctctgaaa

SEQ ID NO: 1376481 - DNA, 15 bp, Homo sapiens
gtgtggcctgtggct

SEQ ID NO: 1376482 - DNA, 16 bp, Homo sapiens
gtgtggtagagtgtgc

SEQ ID NO: 1376483 - DNA, 17 bp, Homo sapiens
gtgtgtggtagaaacaa

SEQ ID NO: 1376484 - DNA, 13 bp, Homo sapiens
gtgttaatttaag

SEQ ID NO: 1376485 - DNA, 15 bp, Homo sapiens
gtgttagtggcaccg

SEQ ID NO: 1376486 - DNA, 17 bp, Homo sapiens
gtgttatatgaacatac

SEQ ID NO: 1376487 - DNA, 16 bp, Homo sapiens
gtgttttgcaagtgct

SEQ ID NO: 1376488 - DNA, 15 bp, Homo sapiens
gtgttttttaagata

SEQ ID NO: 1376489 - DNA, 19 bp, Homo sapiens
gtgtttttttatttctact

SEQ ID NO: 1376490 - DNA, 14 bp, Homo sapiens
gttaatacaaggta

SEQ ID NO: 1376491 - DNA, 16 bp, Homo sapiens
gttaatacaaggtata

SEQ ID NO: 1376492 - DNA, 19 bp, Homo sapiens
gttaatttaagttttgaca

SEQ ID NO: 1376493 - DNA, 22 bp, Homo sapiens
gttactggatttgttgttcttt

SEQ ID NO: 1376494 - DNA, 14 bp, Homo sapiens
gttactgggccctg

SEQ ID NO: 1376495 - DNA, 15 bp, Homo sapiens
gttactgtgtaaact

SEQ ID NO: 1376496 - DNA, 18 bp, Homo sapiens
gttactgtgtaaactcat

SEQ ID NO: 1376497 - DNA, 14 bp, Homo sapiens
gttacttctgaggt

SEQ ID NO: 1376498 - DNA, 15 bp, Homo sapiens
gttacttcttctctt

SEQ ID NO: 1376499 - DNA, 12 bp, Homo sapiens
gttagctcctgt

SEQ ID NO: 1376500 - DNA, 14 bp, Homo sapiens
gttagctcctgtgg

SEQ ID NO: 1376501 - DNA, 16 bp, Homo sapiens
gttagctcctgtggcc

SEQ ID NO: 1376502 - DNA, 20 bp, Homo sapiens
gttagctcctgtggccccac

SEQ ID NO: 1376503 - DNA, 13 bp, Homo sapiens
gttataagaagaa

SEQ ID NO: 1376504 - DNA, 21 bp, Homo sapiens
gttatgtaaataattcttttt

SEQ ID NO: 1376505 - DNA, 13 bp, Homo sapiens
gttattagatgtt

SEQ ID NO: 1376506 - DNA, 15 bp, Homo sapiens
gttattttctacagt

SEQ ID NO: 1376507 - DNA, 20 bp, Homo sapiens
gttattttctacagtggttt

SEQ ID NO: 1376508 - DNA, 14 bp, Homo sapiens
gttcaagatcaaaa

SEQ ID NO: 1376509 - DNA, 20 bp, Homo sapiens
gttcaagatcaaaaaggctt

SEQ ID NO: 1376510 - DNA, 14 bp, Homo sapiens
gttcagcagtacag

SEQ ID NO: 1376511 - DNA, 12 bp, Homo sapiens
gttcagccaagg

SEQ ID NO: 1376512 - DNA, 13 bp, Homo sapiens
gttcatagcccag

SEQ ID NO: 1376513 - DNA, 14 bp, Homo sapiens
gttcatcatccaga

SEQ ID NO: 1376514 - DNA, 13 bp, Homo sapiens
gttcatttgtgta

SEQ ID NO: 1376515 - DNA, 17 bp, Homo sapiens
gttccagggtccctctg

SEQ ID NO: 1376516 - DNA, 19 bp, Homo sapiens
gttccagggtccctctgtg

SEQ ID NO: 1376517 - DNA, 20 bp, Homo sapiens
gttccagggtccctctgtgt

SEQ ID NO: 1376518 - DNA, 17 bp, Homo sapiens
gttcccatgtagccccc

SEQ ID NO: 1376519 - DNA, 14 bp, Homo sapiens
gttcccggctggac

SEQ ID NO: 1376520 - DNA, 15 bp, Homo sapiens
gttcctcaaattttt

SEQ ID NO: 1376521 - DNA, 22 bp, Homo sapiens
gttcctcccccagttcctccca

SEQ ID NO: 1376522 - DNA, 14 bp, Homo sapiens
gttcctctgcctgc

SEQ ID NO: 1376523 - DNA, 15 bp, Homo sapiens
gttcctctgcctgcc

SEQ ID NO: 1376524 - DNA, 22 bp, Homo sapiens
gttcctctttggtgtacagact

SEQ ID NO: 1376525 - DNA, 20 bp, Homo sapiens
gttcctgttcagtaataaaa

SEQ ID NO: 1376526 - DNA, 21 bp, Homo sapiens
gttccttggtcctagtaagaa

SEQ ID NO: 1376527 - DNA, 14 bp, Homo sapiens
gttcgttggttata

SEQ ID NO: 1376528 - DNA, 12 bp, Homo sapiens
gttctcaatgaa

SEQ ID NO: 1376529 - DNA, 14 bp, Homo sapiens
gttctcaatgaaaa

SEQ ID NO: 1376530 - DNA, 22 bp, Homo sapiens
gttctccgttagctcctgtggc

SEQ ID NO: 1376531 - DNA, 20 bp, Homo sapiens
gttctctcaacaagaaataa

SEQ ID NO: 1376532 - DNA, 16 bp, Homo sapiens
gttctgagctgccagt

SEQ ID NO: 1376533 - DNA, 18 bp, Homo sapiens
gttctgagctgccagtgg

SEQ ID NO: 1376534 - DNA, 16 bp, Homo sapiens
gttctggggggaccca

SEQ ID NO: 1376535 - DNA, 12 bp, Homo sapiens
gttctgtatttg

SEQ ID NO: 1376536 - DNA, 20 bp, Homo sapiens
gttctgtatttgaaagtgcc

SEQ ID NO: 1376537 - DNA, 14 bp, Homo sapiens
gttctgtggttcct

SEQ ID NO: 1376538 - DNA, 14 bp, Homo sapiens
gttctttggattct

SEQ ID NO: 1376539 - DNA, 21 bp, Homo sapiens
gttctttgttcatagcccagt

SEQ ID NO: 1376540 - DNA, 17 bp, Homo sapiens
gttgaaaaacagctgag

SEQ ID NO: 1376541 - DNA, 13 bp, Homo sapiens
gttgaatatgatt

SEQ ID NO: 1376542 - DNA, 16 bp, Homo sapiens
gttgagctatgactta

SEQ ID NO: 1376543 - DNA, 18 bp, Homo sapiens
gttgccaagctccaagcc

SEQ ID NO: 1376544 - DNA, 23 bp, Homo sapiens
gttgcctataagccaaaattaag

SEQ ID NO: 1376545 - DNA, 18 bp, Homo sapiens
gttgctcaaaaaatgagc

SEQ ID NO: 1376546 - DNA, 15 bp, Homo sapiens
gttgctgacttagaa

SEQ ID NO: 1376547 - DNA, 13 bp, Homo sapiens
gttggcaggctgg

SEQ ID NO: 1376548 - DNA, 15 bp, Homo sapiens
gttggcaggctggcc

SEQ ID NO: 1376549 - DNA, 17 bp, Homo sapiens
gttggcaggctggccag

SEQ ID NO: 1376550 - DNA, 14 bp, Homo sapiens
gttgtaccaagtga

SEQ ID NO: 1376551 - DNA, 16 bp, Homo sapiens
gttgtaccaagtgaaa

SEQ ID NO: 1376552 - DNA, 15 bp, Homo sapiens
gttgtagtgtccccc

SEQ ID NO: 1376553 - DNA, 14 bp, Homo sapiens
gttgtccaactatt

SEQ ID NO: 1376554 - DNA, 16 bp, Homo sapiens
gttgtttataataaaa

SEQ ID NO: 1376555 - DNA, 19 bp, Homo sapiens
gtttaaaaaccgaataaat

SEQ ID NO: 1376556 - DNA, 20 bp, Homo sapiens
gtttaaaatgtaatttaaat

SEQ ID NO: 1376557 - DNA, 13 bp, Homo sapiens
gtttacagaaaaa

SEQ ID NO: 1376558 - DNA, 16 bp, Homo sapiens
gtttagaattgaaggt

SEQ ID NO: 1376559 - DNA, 12 bp, Homo sapiens
gtttagatttgc

SEQ ID NO: 1376560 - DNA, 13 bp, Homo sapiens
gtttataaaatat

SEQ ID NO: 1376561 - DNA, 15 bp, Homo sapiens
gtttataataaaaat

SEQ ID NO: 1376562 - DNA, 17 bp, Homo sapiens
gtttatcattcaagtgt

SEQ ID NO: 1376563 - DNA, 19 bp, Homo sapiens
gtttattacttccatgaat

SEQ ID NO: 1376564 - DNA, 21 bp, Homo sapiens
gtttattacttccatgaattt

SEQ ID NO: 1376565 - DNA, 16 bp, Homo sapiens
gtttatttcacttgat

SEQ ID NO: 1376566 - DNA, 17 bp, Homo sapiens
gtttattttctacgttt

SEQ ID NO: 1376567 - DNA, 21 bp, Homo sapiens
gtttattttctacgtttcttt

SEQ ID NO: 1376568 - DNA, 21 bp, Homo sapiens
gtttcagtttgttggaaagta

SEQ ID NO: 1376569 - DNA, 22 bp, Homo sapiens
gtttcctctagttctttgttca

SEQ ID NO: 1376570 - DNA, 15 bp, Homo sapiens
gtttcctgacattgt

SEQ ID NO: 1376571 - DNA, 18 bp, Homo sapiens
gtttctatgcaaagttct

SEQ ID NO: 1376572 - DNA, 17 bp, Homo sapiens
gtttctcttgagctggc

SEQ ID NO: 1376573 - DNA, 22 bp, Homo sapiens
gtttctctttgattatttgcat

SEQ ID NO: 1376574 - DNA, 21 bp, Homo sapiens
gtttctgatttgctgctcttc

SEQ ID NO: 1376575 - DNA, 20 bp, Homo sapiens
gtttctgcattcatttttat

SEQ ID NO: 1376576 - DNA, 20 bp, Homo sapiens
gtttctttattttgtgtaaa

SEQ ID NO: 1376577 - DNA, 14 bp, Homo sapiens
gtttgaaaacttca

SEQ ID NO: 1376578 - DNA, 13 bp, Homo sapiens
gtttgagctgcct

SEQ ID NO: 1376579 - DNA, 13 bp, Homo sapiens
gtttggtgcttct

SEQ ID NO: 1376580 - DNA, 20 bp, Homo sapiens
gtttgtcttggatatatagg

SEQ ID NO: 1376581 - DNA, 15 bp, Homo sapiens
gttttactgcagctt

SEQ ID NO: 1376582 - DNA, 13 bp, Homo sapiens
gttttactgtcta

SEQ ID NO: 1376583 - DNA, 12 bp, Homo sapiens
gttttatttata

SEQ ID NO: 1376584 - DNA, 22 bp, Homo sapiens
gttttatttatatttattgact

SEQ ID NO: 1376585 - DNA, 12 bp, Homo sapiens
gttttatttcat

SEQ ID NO: 1376586 - DNA, 19 bp, Homo sapiens
gttttctcttgagagggtg

SEQ ID NO: 1376587 - DNA, 22 bp, Homo sapiens
gttttggctgaaattctcctgg

SEQ ID NO: 1376588 - DNA, 17 bp, Homo sapiens
gttttgtaggagacttg

SEQ ID NO: 1376589 - DNA, 17 bp, Homo sapiens
gttttgtcaaactgtag

SEQ ID NO: 1376590 - DNA, 17 bp, Homo sapiens
gtttttacaagatgtat

SEQ ID NO: 1376591 - DNA, 16 bp, Homo sapiens
gtttttctgctttaga

SEQ ID NO: 1376592 - DNA, 18 bp, Homo sapiens
tacacgaatagacatcaa

SEQ ID NO: 1376593 - DNA, 14 bp, Homo sapiens
tacactagttgttt

SEQ ID NO: 1376594 - DNA, 16 bp, Homo sapiens
tacactgcctgcctta

SEQ ID NO: 1376595 - DNA, 17 bp, Homo sapiens
tacactgcctgccttaa

SEQ ID NO: 1376596 - DNA, 18 bp, Homo sapiens
tacactggcaatggtagt

SEQ ID NO: 1376597 - DNA, 13 bp, Homo sapiens
tacactttgttgc

SEQ ID NO: 1376598 - DNA, 11 bp, Homo sapiens
tacagaactac

SEQ ID NO: 1376599 - DNA, 19 bp, Homo sapiens
tacagccagaccagattaa

SEQ ID NO: 1376600 - DNA, 22 bp, Homo sapiens
tacagtggttttatactgaagg

SEQ ID NO: 1376601 - DNA, 20 bp, Homo sapiens
tacagttgaaaaacagctga

SEQ ID NO: 1376602 - DNA, 23 bp, Homo sapiens
tacataatactgaaccacttgta

SEQ ID NO: 1376603 - DNA, 15 bp, Homo sapiens
tacatacgatttaag

SEQ ID NO: 1376604 - DNA, 13 bp, Homo sapiens
tacatagtgaaaa

SEQ ID NO: 1376605 - DNA, 11 bp, Homo sapiens
tacatatatat

SEQ ID NO: 1376606 - DNA, 18 bp, Homo sapiens
tacatatatatatataac

SEQ ID NO: 1376607 - DNA, 16 bp, Homo sapiens
tacatatcccttccag

SEQ ID NO: 1376608 - DNA, 19 bp, Homo sapiens
tacatatcccttccagatg

SEQ ID NO: 1376609 - DNA, 17 bp, Homo sapiens
tacatatggatgttact

SEQ ID NO: 1376610 - DNA, 19 bp, Homo sapiens
tacatatggatgttactct

SEQ ID NO: 1376611 - DNA, 20 bp, Homo sapiens
tacatgaagaatagaaacaa

SEQ ID NO: 1376612 - DNA, 18 bp, Homo sapiens
tacatgaagcttcatgca

SEQ ID NO: 1376613 - DNA, 14 bp, Homo sapiens
tacatgcatataat

SEQ ID NO: 1376614 - DNA, 14 bp, Homo sapiens
tacatgctggggtc

SEQ ID NO: 1376615 - DNA, 13 bp, Homo sapiens
tacatgtaatttg

SEQ ID NO: 1376616 - DNA, 19 bp, Homo sapiens
tacatgtgatacatttttt

SEQ ID NO: 1376617 - DNA, 15 bp, Homo sapiens
tacatgtttataaat

SEQ ID NO: 1376618 - DNA, 13 bp, Homo sapiens
tacattcaaattt

SEQ ID NO: 1376619 - DNA, 14 bp, Homo sapiens
tacattcaaatttg

SEQ ID NO: 1376620 - DNA, 15 bp, Homo sapiens
tacattcaaatttgt

SEQ ID NO: 1376621 - DNA, 18 bp, Homo sapiens
tacattcaaatttgtctg

SEQ ID NO: 1376622 - DNA, 11 bp, Homo sapiens
tacatttaata

SEQ ID NO: 1376623 - DNA, 20 bp, Homo sapiens
taccaagtatagcctatggc

SEQ ID NO: 1376624 - DNA, 22 bp, Homo sapiens
taccagctgcgcttgcttttct

SEQ ID NO: 1376625 - DNA, 17 bp, Homo sapiens
taccatcccctgtagag

SEQ ID NO: 1376626 - DNA, 18 bp, Homo sapiens
taccatttagtaagaata

SEQ ID NO: 1376627 - DNA, 17 bp, Homo sapiens
taccccctccttcagac

SEQ ID NO: 1376628 - DNA, 12 bp, Homo sapiens
taccctgggtgt

SEQ ID NO: 1376629 - DNA, 18 bp, Homo sapiens
tacctgtatttaaaaata

SEQ ID NO: 1376630 - DNA, 21 bp, Homo sapiens
tacctgtatttaaaaatagaa

SEQ ID NO: 1376631 - DNA, 23 bp, Homo sapiens
taccttatcttacaatattgatt

SEQ ID NO: 1376632 - DNA, 18 bp, Homo sapiens
tacctttctctctctaag

SEQ ID NO: 1376633 - DNA, 14 bp, Homo sapiens
taccttttcagggc

SEQ ID NO: 1376634 - DNA, 16 bp, Homo sapiens
taccttttttttttct

SEQ ID NO: 1376635 - DNA, 16 bp, Homo sapiens
tacgaagttcaagatc

SEQ ID NO: 1376636 - DNA, 17 bp, Homo sapiens
tacgaagttcaagatca

SEQ ID NO: 1376637 - DNA, 12 bp, Homo sapiens
tacgtagttcta

SEQ ID NO: 1376638 - DNA, 21 bp, Homo sapiens
tactaaaaagtataaaatagt

SEQ ID NO: 1376639 - DNA, 19 bp, Homo sapiens
tactaataatcttgtttct

SEQ ID NO: 1376640 - DNA, 12 bp, Homo sapiens
tactactttgtt

SEQ ID NO: 1376641 - DNA, 23 bp, Homo sapiens
tactactttgttaggattttcac

SEQ ID NO: 1376642 - DNA, 17 bp, Homo sapiens
tactagcaaaataaaac

SEQ ID NO: 1376643 - DNA, 18 bp, Homo sapiens
tactagcaaaataaaaca

SEQ ID NO: 1376644 - DNA, 24 bp, Homo sapiens
tactagcaaaataaaacatagcaa

SEQ ID NO: 1376645 - DNA, 22 bp, Homo sapiens
tactagtcaccagagactttag

SEQ ID NO: 1376646 - DNA, 15 bp, Homo sapiens
tactatttaagatgt

SEQ ID NO: 1376647 - DNA, 18 bp, Homo sapiens
tactatttaagatgtgaa

SEQ ID NO: 1376648 - DNA, 11 bp, Homo sapiens
tactatttcca

SEQ ID NO: 1376649 - DNA, 16 bp, Homo sapiens
tactccctgcagatgc

SEQ ID NO: 1376650 - DNA, 19 bp, Homo sapiens
tactccctgcagatgccac

SEQ ID NO: 1376651 - DNA, 16 bp, Homo sapiens
tactctaccctcttag

SEQ ID NO: 1376652 - DNA, 22 bp, Homo sapiens
tactctcacactggttctcaat

SEQ ID NO: 1376653 - DNA, 23 bp, Homo sapiens
tactgaaccacttgtagatttga

SEQ ID NO: 1376654 - DNA, 13 bp, Homo sapiens
tactgaaggaaaa

SEQ ID NO: 1376655 - DNA, 14 bp, Homo sapiens
tactgaaggaaaaa

SEQ ID NO: 1376656 - DNA, 18 bp, Homo sapiens
tactgaaggaaaaacaca

SEQ ID NO: 1376657 - DNA, 20 bp, Homo sapiens
tactgaaggaaaaacacaag

SEQ ID NO: 1376658 - DNA, 23 bp, Homo sapiens
tactgaaggaaaaacacaagcaa

SEQ ID NO: 1376659 - DNA, 12 bp, Homo sapiens
tactgaattttt

SEQ ID NO: 1376660 - DNA, 17 bp, Homo sapiens
tactgcactccagcctg

SEQ ID NO: 1376661 - DNA, 15 bp, Homo sapiens
tactgcctgaataaa

SEQ ID NO: 1376662 - DNA, 16 bp, Homo sapiens
tactgcgactttctgc

SEQ ID NO: 1376663 - DNA, 17 bp, Homo sapiens
tactgcgactttctgcc

SEQ ID NO: 1376664 - DNA, 20 bp, Homo sapiens
tactgcgactttctgcctgg

SEQ ID NO: 1376665 - DNA, 18 bp, Homo sapiens
tactgcttgaataaacac

SEQ ID NO: 1376666 - DNA, 21 bp, Homo sapiens
tactggaacccttttaaagtt

SEQ ID NO: 1376667 - DNA, 23 bp, Homo sapiens
tactgggccctgagtctgggcag

SEQ ID NO: 1376668 - DNA, 15 bp, Homo sapiens
tactggggctgggga

SEQ ID NO: 1376669 - DNA, 21 bp, Homo sapiens
tactggggctggggaaggaag

SEQ ID NO: 1376670 - DNA, 20 bp, Homo sapiens
tactggttgcatggaaatca

SEQ ID NO: 1376671 - DNA, 15 bp, Homo sapiens
tactgtcaaatgatg

SEQ ID NO: 1376672 - DNA, 17 bp, Homo sapiens
tactgtcaaatgatgtg

SEQ ID NO: 1376673 - DNA, 15 bp, Homo sapiens
tactgtgtaaactca

SEQ ID NO: 1376674 - DNA, 23 bp, Homo sapiens
tactgtgtaaactcatctgaaat

SEQ ID NO: 1376675 - DNA, 23 bp, Homo sapiens
tactgttcggaaggggttcctca

SEQ ID NO: 1376676 - DNA, 23 bp, Homo sapiens
tactgttgcacaattttgataaa

SEQ ID NO: 1376677 - DNA, 22 bp, Homo sapiens
tactgtttattacttccatgaa

SEQ ID NO: 1376678 - DNA, 14 bp, Homo sapiens
tacttaaatggtaa

SEQ ID NO: 1376679 - DNA, 24 bp, Homo sapiens
tacttaaatggtaataagcactgt

SEQ ID NO: 1376680 - DNA, 19 bp, Homo sapiens
tacttacctagtgaaactt

SEQ ID NO: 1376681 - DNA, 13 bp, Homo sapiens
tacttctgaggta

SEQ ID NO: 1376682 - DNA, 19 bp, Homo sapiens
tacttgaaccataaaatgt

SEQ ID NO: 1376683 - DNA, 14 bp, Homo sapiens
tacttgttgcctat

SEQ ID NO: 1376684 - DNA, 13 bp, Homo sapiens
tacttgttttgga

SEQ ID NO: 1376685 - DNA, 13 bp, Homo sapiens
tactttgtaaata

SEQ ID NO: 1376686 - DNA, 14 bp, Homo sapiens
tactttgtattgtc

SEQ ID NO: 1376687 - DNA, 21 bp, Homo sapiens
tactttgtattttgattattt

SEQ ID NO: 1376688 - DNA, 15 bp, Homo sapiens
tacttttaaaaacat

SEQ ID NO: 1376689 - DNA, 23 bp, Homo sapiens
tacttttttaaatattttctatt

SEQ ID NO: 1376690 - DNA, 16 bp, Homo sapiens
tagaaaagaactggaa

SEQ ID NO: 1376691 - DNA, 21 bp, Homo sapiens
tagaaaatgtgaccctccaaa

SEQ ID NO: 1376692 - DNA, 11 bp, Homo sapiens
tagaaagctat

SEQ ID NO: 1376693 - DNA, 19 bp, Homo sapiens
tagaaatgatgatgtggaa

SEQ ID NO: 1376694 - DNA, 21 bp, Homo sapiens
tagaaatggaaattttgctat

SEQ ID NO: 1376695 - DNA, 20 bp, Homo sapiens
tagaaatgtaggtcctcaga

SEQ ID NO: 1376696 - DNA, 13 bp, Homo sapiens
tagaaattttgta

SEQ ID NO: 1376697 - DNA, 16 bp, Homo sapiens
tagaaattttgtaaga

SEQ ID NO: 1376698 - DNA, 12 bp, Homo sapiens
tagaacaggttt

SEQ ID NO: 1376699 - DNA, 14 bp, Homo sapiens
tagaacaggttttt

SEQ ID NO: 1376700 - DNA, 15 bp, Homo sapiens
tagaaccactatgaa

SEQ ID NO: 1376701 - DNA, 12 bp, Homo sapiens
tagaactttgta

SEQ ID NO: 1376702 - DNA, 14 bp, Homo sapiens
tagaactttgtata

SEQ ID NO: 1376703 - DNA, 18 bp, Homo sapiens
tagaagacaaaatgttca

SEQ ID NO: 1376704 - DNA, 21 bp, Homo sapiens
tagaagcactacaccttgcct

SEQ ID NO: 1376705 - DNA, 15 bp, Homo sapiens
tagaagccaagggaa

SEQ ID NO: 1376706 - DNA, 19 bp, Homo sapiens
tagaagccaagggaaaggg

SEQ ID NO: 1376707 - DNA, 16 bp, Homo sapiens
tagaagtttggctgct

SEQ ID NO: 1376708 - DNA, 23 bp, Homo sapiens
tagaatacagttttgagtagagt

SEQ ID NO: 1376709 - DNA, 19 bp, Homo sapiens
tagaattatttttcactct

SEQ ID NO: 1376710 - DNA, 19 bp, Homo sapiens
tataaagtggaagtatgta

SEQ ID NO: 1376711 - DNA, 14 bp, Homo sapiens
tataaatatacagt

SEQ ID NO: 1376712 - DNA, 15 bp, Homo sapiens
tataaatatacagta

SEQ ID NO: 1376713 - DNA, 12 bp, Homo sapiens
tataaatgtata

SEQ ID NO: 1376714 - DNA, 22 bp, Homo sapiens
tataacacatttttttgcatgc

SEQ ID NO: 1376715 - DNA, 19 bp, Homo sapiens
tataagccaaaattaaggt

SEQ ID NO: 1376716 - DNA, 18 bp, Homo sapiens
tataagtgaagtgatact

SEQ ID NO: 1376717 - DNA, 13 bp, Homo sapiens
tataataaaaata

SEQ ID NO: 1376718 - DNA, 14 bp, Homo sapiens
tataataaaaatat

SEQ ID NO: 1376719 - DNA, 18 bp, Homo sapiens
tataataaaaatatattt

SEQ ID NO: 1376720 - DNA, 14 bp, Homo sapiens
tataataaatatat

SEQ ID NO: 1376721 - DNA, 13 bp, Homo sapiens
tataatataaaaa

SEQ ID NO: 1376722 - DNA, 17 bp, Homo sapiens
tataatcttataattgt

SEQ ID NO: 1376723 - DNA, 13 bp, Homo sapiens
tataattgtacaa

SEQ ID NO: 1376724 - DNA, 16 bp, Homo sapiens
tataattgtacaaaat

SEQ ID NO: 1376725 - DNA, 18 bp, Homo sapiens
tatacagtgcagagcctt

SEQ ID NO: 1376726 - DNA, 21 bp, Homo sapiens
tatacatgaagaatagaaaca

SEQ ID NO: 1376727 - DNA, 18 bp, Homo sapiens
tatacatgtgatacattt

SEQ ID NO: 1376728 - DNA, 20 bp, Homo sapiens
tatacatgtgatacattttt

SEQ ID NO: 1376729 - DNA, 21 bp, Homo sapiens
tatactactttgttaggattt

SEQ ID NO: 1376730 - DNA, 22 bp, Homo sapiens
tatactgaaggaaaaacacaag

SEQ ID NO: 1376731 - DNA, 22 bp, Homo sapiens
tatactggaacccttttaaagt

SEQ ID NO: 1376732 - DNA, 22 bp, Homo sapiens
tatagaaaaataaaaatctctt

SEQ ID NO: 1376733 - DNA, 13 bp, Homo sapiens
tatagaaagctat

SEQ ID NO: 1376734 - DNA, 24 bp, Homo sapiens
tatagaaagctatataagacaaga

SEQ ID NO: 1376735 - DNA, 14 bp, Homo sapiens
tatagcatcactta

SEQ ID NO: 1376736 - DNA, 17 bp, Homo sapiens
tatagcatcacttaaaa

SEQ ID NO: 1376737 - DNA, 20 bp, Homo sapiens
tatagcatgaaataaaatat

SEQ ID NO: 1376738 - DNA, 17 bp, Homo sapiens
tataggctattttctaa

SEQ ID NO: 1376739 - DNA, 21 bp, Homo sapiens
tataggctattttctaaagac

SEQ ID NO: 1376740 - DNA, 22 bp, Homo sapiens
tatagtcaatggcttgttcatc

SEQ ID NO: 1376741 - DNA, 17 bp, Homo sapiens
tatagtgtagaaaagaa

SEQ ID NO: 1376742 - DNA, 20 bp, Homo sapiens
tatagttatgtaaataattc

SEQ ID NO: 1376743 - DNA, 17 bp, Homo sapiens
tatataacatatatgga

SEQ ID NO: 1376744 - DNA, 14 bp, Homo sapiens
tatatatataaaca

SEQ ID NO: 1376745 - DNA, 16 bp, Homo sapiens
tatatatataaatgta

SEQ ID NO: 1376746 - DNA, 13 bp, Homo sapiens
tatatcatgcaaa

SEQ ID NO: 1376747 - DNA, 14 bp, Homo sapiens
tatatcctgtgact

SEQ ID NO: 1376748 - DNA, 19 bp, Homo sapiens
tatatctatctatttgagg

SEQ ID NO: 1376749 - DNA, 19 bp, Homo sapiens
tatatgaacatacaaatgc

SEQ ID NO: 1376750 - DNA, 16 bp, Homo sapiens
tatatgaataaagtgt

SEQ ID NO: 1376751 - DNA, 18 bp, Homo sapiens
tatatgagactttatgtg

SEQ ID NO: 1376752 - DNA, 18 bp, Homo sapiens
tatatgtatgtgtttaga

SEQ ID NO: 1376753 - DNA, 22 bp, Homo sapiens
tatatgtatgtgtttagaattg

SEQ ID NO: 1376754 - DNA, 13 bp, Homo sapiens
tatattacaatga

SEQ ID NO: 1376755 - DNA, 12 bp, Homo sapiens
tatattattata

SEQ ID NO: 1376756 - DNA, 13 bp, Homo sapiens
tatattgaacttt

SEQ ID NO: 1376757 - DNA, 12 bp, Homo sapiens
tatattgtaatt

SEQ ID NO: 1376758 - DNA, 15 bp, Homo sapiens
tatatttataaggaa

SEQ ID NO: 1376759 - DNA, 13 bp, Homo sapiens
tatatttattgac

SEQ ID NO: 1376760 - DNA, 13 bp, Homo sapiens
tatatttccttta

SEQ ID NO: 1376761 - DNA, 16 bp, Homo sapiens
tatatttctaaatgtt

SEQ ID NO: 1376762 - DNA, 13 bp, Homo sapiens
tatatttgattta

SEQ ID NO: 1376763 - DNA, 22 bp, Homo sapiens
tatattttaacctgcataaaaa

SEQ ID NO: 1376764 - DNA, 14 bp, Homo sapiens
tatattttgtcata

SEQ ID NO: 1376765 - DNA, 18 bp, Homo sapiens
tatattttgtgtgaaatt

SEQ ID NO: 1376766 - DNA, 12 bp, Homo sapiens
tatcaaagtcat

SEQ ID NO: 1376767 - DNA, 21 bp, Homo sapiens
tatcaaattaattgtgtgaac

SEQ ID NO: 1376768 - DNA, 22 bp, Homo sapiens
tatcaatatctaatatatatga

SEQ ID NO: 1376769 - DNA, 21 bp, Homo sapiens
tatcagttgagcttcatatac

SEQ ID NO: 1376770 - DNA, 15 bp, Homo sapiens
tatcatatatttaat

SEQ ID NO: 1376771 - DNA, 20 bp, Homo sapiens
tatcatctgtggactgacct

SEQ ID NO: 1376772 - DNA, 15 bp, Homo sapiens
tatcatgcaaaatat

SEQ ID NO: 1376773 - DNA, 14 bp, Homo sapiens
tatcattcaagtgt

SEQ ID NO: 1376774 - DNA, 14 bp, Homo sapiens
tatccagaaaactg

SEQ ID NO: 1376775 - DNA, 14 bp, Homo sapiens
tatccatattttat

SEQ ID NO: 1376776 - DNA, 22 bp, Homo sapiens
tatccatattttattactgttt

SEQ ID NO: 1376777 - DNA, 18 bp, Homo sapiens
tatcccaagaatgcaaga

SEQ ID NO: 1376778 - DNA, 17 bp, Homo sapiens
tatccccatctccctgc

SEQ ID NO: 1376779 - DNA, 12 bp, Homo sapiens
tatcctctgtaa

SEQ ID NO: 1376780 - DNA, 16 bp, Homo sapiens
tatcctgtgactgtct

SEQ ID NO: 1376781 - DNA, 23 bp, Homo sapiens
tatcctgtgactgtctcacttaa

SEQ ID NO: 1376782 - DNA, 23 bp, Homo sapiens
tatcgacttgtttttgcacatgt

SEQ ID NO: 1376783 - DNA, 18 bp, Homo sapiens
tatcgtttttgtattttc

SEQ ID NO: 1376784 - DNA, 20 bp, Homo sapiens
tatcgtttttgtattttcat

SEQ ID NO: 1376785 - DNA, 20 bp, Homo sapiens
tatctaatatatatgaataa

SEQ ID NO: 1376786 - DNA, 12 bp, Homo sapiens
tatctataaaat

SEQ ID NO: 1376787 - DNA, 12 bp, Homo sapiens
tatctattaata

SEQ ID NO: 1376788 - DNA, 17 bp, Homo sapiens
tatctattaatatatgt

SEQ ID NO: 1376789 - DNA, 18 bp, Homo sapiens
tatctattctgagaaaac

SEQ ID NO: 1376790 - DNA, 22 bp, Homo sapiens
tatctcaatgaaccataaattc

SEQ ID NO: 1376791 - DNA, 13 bp, Homo sapiens
tatctcagggcct

SEQ ID NO: 1376792 - DNA, 14 bp, Homo sapiens
tatctcctgacaga

SEQ ID NO: 1376793 - DNA, 21 bp, Homo sapiens
tatctcctgacagaaggtgcc

SEQ ID NO: 1376794 - DNA, 22 bp, Homo sapiens
tatctggccccaggtagaaact

SEQ ID NO: 1376795 - DNA, 15 bp, Homo sapiens
tatctggcctctgct

SEQ ID NO: 1376796 - DNA, 22 bp, Homo sapiens
tatcttataaagtggaagtatg

SEQ ID NO: 1376797 - DNA, 23 bp, Homo sapiens
tatcttataaagtggaagtatgt

SEQ ID NO: 1376798 - DNA, 17 bp, Homo sapiens
tatcttgatacattcaa

SEQ ID NO: 1376799 - DNA, 15 bp, Homo sapiens
tatctttgaatatgt

SEQ ID NO: 1376800 - DNA, 14 bp, Homo sapiens
tatgaaaatggaaa

SEQ ID NO: 1376801 - DNA, 23 bp, Homo sapiens
tatgaatgatttgcatatgaaag

SEQ ID NO: 1376802 - DNA, 14 bp, Homo sapiens
tatgacagtaaaca

SEQ ID NO: 1376803 - DNA, 15 bp, Homo sapiens
tatgagactttatgt

SEQ ID NO: 1376804 - DNA, 14 bp, Homo sapiens
tatgaggaggggag

SEQ ID NO: 1376805 - DNA, 14 bp, Homo sapiens
tatgattaaaaata

SEQ ID NO: 1376806 - DNA, 23 bp, Homo sapiens
tatgattaaaaatatcaaattaa

SEQ ID NO: 1376807 - DNA, 14 bp, Homo sapiens
tatgcacttggcct

SEQ ID NO: 1376808 - DNA, 18 bp, Homo sapiens
tatgctctcactgtttgt

SEQ ID NO: 1376809 - DNA, 15 bp, Homo sapiens
tatggaaaactgtgt

SEQ ID NO: 1376810 - DNA, 16 bp, Homo sapiens
tatggatgatttaagt

SEQ ID NO: 1376811 - DNA, 21 bp, Homo sapiens
tatggctttatttttttgaac

SEQ ID NO: 1376812 - DNA, 23 bp, Homo sapiens
tatgggcttttggggagccagaa

SEQ ID NO: 1376813 - DNA, 19 bp, Homo sapiens
tatggttacttcttctctt

SEQ ID NO: 1376814 - DNA, 18 bp, Homo sapiens
tatgtagtatctatatga

SEQ ID NO: 1376815 - DNA, 19 bp, Homo sapiens
tatgtagtatctatatgac

SEQ ID NO: 1376816 - DNA, 18 bp, Homo sapiens
tatgtatattaaaaaaga

SEQ ID NO: 1376817 - DNA, 20 bp, Homo sapiens
tatgtatgtgtttagaattg

SEQ ID NO: 1376818 - DNA, 21 bp, Homo sapiens
tatgtatgtgtttagaattga

SEQ ID NO: 1376819 - DNA, 21 bp, Homo sapiens
tatgtattatttataattcct

SEQ ID NO: 1376820 - DNA, 12 bp, Homo sapiens
tatgtgaatttt

SEQ ID NO: 1376821 - DNA, 19 bp, Homo sapiens
tatgtgacaattttgtaca

SEQ ID NO: 1376822 - DNA, 14 bp, Homo sapiens
tatgtgacattaac

SEQ ID NO: 1376823 - DNA, 13 bp, Homo sapiens
tatgtgattacaa

SEQ ID NO: 1376824 - DNA, 21 bp, Homo sapiens
tatgtgggatattgaatgtta

SEQ ID NO: 1376825 - DNA, 15 bp, Homo sapiens
tatgtggttttgtaa

SEQ ID NO: 1376826 - DNA, 12 bp, Homo sapiens
tattaaaactaa

SEQ ID NO: 1376827 - DNA, 18 bp, Homo sapiens
tattaaatttttttgtat

SEQ ID NO: 1376828 - DNA, 22 bp, Homo sapiens
tcaggagatcgagaccatcctg

SEQ ID NO: 1376829 - DNA, 17 bp, Homo sapiens
tcaggcaggtgggatgg

SEQ ID NO: 1376830 - DNA, 18 bp, Homo sapiens
tcaggccggcagccccag

SEQ ID NO: 1376831 - DNA, 15 bp, Homo sapiens
tcaggctgaaaacaa

SEQ ID NO: 1376832 - DNA, 13 bp, Homo sapiens
tcagggccatgct

SEQ ID NO: 1376833 - DNA, 17 bp, Homo sapiens
tcagggccatgctgagg

SEQ ID NO: 1376834 - DNA, 17 bp, Homo sapiens
tcagggtaaataggaat

SEQ ID NO: 1376835 - DNA, 22 bp, Homo sapiens
tcagggtgcagcccaatctgcc

SEQ ID NO: 1376836 - DNA, 23 bp, Homo sapiens
tcaggtgagaagcagaggaagga

SEQ ID NO: 1376837 - DNA, 20 bp, Homo sapiens
tcaggttatttattttataa

SEQ ID NO: 1376838 - DNA, 18 bp, Homo sapiens
tcaggttcagtattatgt

SEQ ID NO: 1376839 - DNA, 14 bp, Homo sapiens
tcagtaagttatct

SEQ ID NO: 1376840 - DNA, 23 bp, Homo sapiens
tcagtacttttttaaatattttc

SEQ ID NO: 1376841 - DNA, 14 bp, Homo sapiens
tcagtcatgtgtaa

SEQ ID NO: 1376842 - DNA, 16 bp, Homo sapiens
tcagtgcatttgtgct

SEQ ID NO: 1376843 - DNA, 13 bp, Homo sapiens
tcagttgcttgtc

SEQ ID NO: 1376844 - DNA, 13 bp, Homo sapiens
tcataaaagagac

SEQ ID NO: 1376845 - DNA, 14 bp, Homo sapiens
tcatagcccagtag

SEQ ID NO: 1376846 - DNA, 21 bp, Homo sapiens
tcataggcaccttttactgtg

SEQ ID NO: 1376847 - DNA, 22 bp, Homo sapiens
tcataggcaccttttactgtga

SEQ ID NO: 1376848 - DNA, 24 bp, Homo sapiens
tcatagtatccatattttattact

SEQ ID NO: 1376849 - DNA, 12 bp, Homo sapiens
tcatataagaca

SEQ ID NO: 1376850 - DNA, 17 bp, Homo sapiens
tcatatattaaacatcc

SEQ ID NO: 1376851 - DNA, 19 bp, Homo sapiens
tcatatcttaatatatttc

SEQ ID NO: 1376852 - DNA, 19 bp, Homo sapiens
tcatccagactcagagctc

SEQ ID NO: 1376853 - DNA, 14 bp, Homo sapiens
tcatcccattccag

SEQ ID NO: 1376854 - DNA, 16 bp, Homo sapiens
tcatctcatttaaggg

SEQ ID NO: 1376855 - DNA, 20 bp, Homo sapiens
tcatctcatttaagggaaaa

SEQ ID NO: 1376856 - DNA, 22 bp, Homo sapiens
tcatctcatttaagggaaaaat

SEQ ID NO: 1376857 - DNA, 23 bp, Homo sapiens
tcatctcatttaagggaaaaata

SEQ ID NO: 1376858 - DNA, 12 bp, Homo sapiens
tcatctgcaaaa

SEQ ID NO: 1376859 - DNA, 19 bp, Homo sapiens
tcatctgctggtccgtggg

SEQ ID NO: 1376860 - DNA, 23 bp, Homo sapiens
tcatcttaggttggcaaaaaggc

SEQ ID NO: 1376861 - DNA, 12 bp, Homo sapiens
tcatgaaaatac

SEQ ID NO: 1376862 - DNA, 20 bp, Homo sapiens
tcatgaaacttgtttcactg

SEQ ID NO: 1376863 - DNA, 14 bp, Homo sapiens
tcatgattagcaag

SEQ ID NO: 1376864 - DNA, 11 bp, Homo sapiens
tcatgcaaaat

SEQ ID NO: 1376865 - DNA, 22 bp, Homo sapiens
tcatgcacttaaagaagtattt

SEQ ID NO: 1376866 - DNA, 13 bp, Homo sapiens
tcatgcccacccc

SEQ ID NO: 1376867 - DNA, 19 bp, Homo sapiens
tcatgcccaccccctgccc

SEQ ID NO: 1376868 - DNA, 21 bp, Homo sapiens
tcatgcccaccccctgccctg

SEQ ID NO: 1376869 - DNA, 23 bp, Homo sapiens
tcatgggagggggcttgaagcca

SEQ ID NO: 1376870 - DNA, 13 bp, Homo sapiens
tcatgtaaaacag

SEQ ID NO: 1376871 - DNA, 22 bp, Homo sapiens
tcatgtactttttagtaatttc

SEQ ID NO: 1376872 - DNA, 13 bp, Homo sapiens
tcatgtatgtttc

SEQ ID NO: 1376873 - DNA, 14 bp, Homo sapiens
tcatgtatgtttct

SEQ ID NO: 1376874 - DNA, 18 bp, Homo sapiens
tcatgtatttgagcatat

SEQ ID NO: 1376875 - DNA, 19 bp, Homo sapiens
tcatgtggtttctatgcaa

SEQ ID NO: 1376876 - DNA, 21 bp, Homo sapiens
tcatgttgatcatgtactttt

SEQ ID NO: 1376877 - DNA, 12 bp, Homo sapiens
tcattacttgtt

SEQ ID NO: 1376878 - DNA, 22 bp, Homo sapiens
tcattcaagtgtaaaatatttt

SEQ ID NO: 1376879 - DNA, 14 bp, Homo sapiens
tcattcagagtcag

SEQ ID NO: 1376880 - DNA, 23 bp, Homo sapiens
tcattgcacataagcttccattt

SEQ ID NO: 1376881 - DNA, 16 bp, Homo sapiens
tcattgctgagcctct

SEQ ID NO: 1376882 - DNA, 22 bp, Homo sapiens
tcattgctgagcctctgctccc

SEQ ID NO: 1376883 - DNA, 15 bp, Homo sapiens
tcatttaagggaaaa

SEQ ID NO: 1376884 - DNA, 16 bp, Homo sapiens
tcatttaagggaaaaa

SEQ ID NO: 1376885 - DNA, 17 bp, Homo sapiens
tcatttaagggaaaaat

SEQ ID NO: 1376886 - DNA, 13 bp, Homo sapiens
tcatttcagaagt

SEQ ID NO: 1376887 - DNA, 11 bp, Homo sapiens
tcatttcatct

SEQ ID NO: 1376888 - DNA, 14 bp, Homo sapiens
tcatttcatctcat

SEQ ID NO: 1376889 - DNA, 20 bp, Homo sapiens
tcatttcatctcatttaagg

SEQ ID NO: 1376890 - DNA, 15 bp, Homo sapiens
tcatttgtttacatt

SEQ ID NO: 1376891 - DNA, 13 bp, Homo sapiens
tcatttttatagc

SEQ ID NO: 1376892 - DNA, 14 bp, Homo sapiens
tcatttttatagca

SEQ ID NO: 1376893 - DNA, 13 bp, Homo sapiens
tccaaagaggctg

SEQ ID NO: 1376894 - DNA, 14 bp, Homo sapiens
tccaaagaggctgc

SEQ ID NO: 1376895 - DNA, 19 bp, Homo sapiens
tccaaatggagaagctgca

SEQ ID NO: 1376896 - DNA, 14 bp, Homo sapiens
tccaaccagacctg

SEQ ID NO: 1376897 - DNA, 16 bp, Homo sapiens
tccaaccagacctgga

SEQ ID NO: 1376898 - DNA, 13 bp, Homo sapiens
tccaaccctgccg

SEQ ID NO: 1376899 - DNA, 13 bp, Homo sapiens
tccaaccttccca

SEQ ID NO: 1376900 - DNA, 14 bp, Homo sapiens
tccaaccttcccaa

SEQ ID NO: 1376901 - DNA, 15 bp, Homo sapiens
tccaagccccatctt

SEQ ID NO: 1376902 - DNA, 14 bp, Homo sapiens
tccaagcctccaca

SEQ ID NO: 1376903 - DNA, 17 bp, Homo sapiens
tccacagcgagggcagc

SEQ ID NO: 1376904 - DNA, 18 bp, Homo sapiens
tccacagcgagggcagct

SEQ ID NO: 1376905 - DNA, 19 bp, Homo sapiens
tccacagcgagggcagctg

SEQ ID NO: 1376906 - DNA, 13 bp, Homo sapiens
tccacatctgcct

SEQ ID NO: 1376907 - DNA, 15 bp, Homo sapiens
tccacccaaccctat

SEQ ID NO: 1376908 - DNA, 23 bp, Homo sapiens
tccacccaaccctatctcctgac

SEQ ID NO: 1376909 - DNA, 19 bp, Homo sapiens
tccaccccaagagaactcg

SEQ ID NO: 1376910 - DNA, 13 bp, Homo sapiens
tccaccccaggac

SEQ ID NO: 1376911 - DNA, 19 bp, Homo sapiens
tccaccccaggacgccact

SEQ ID NO: 1376912 - DNA, 14 bp, Homo sapiens
tccaccctgcctgc

SEQ ID NO: 1376913 - DNA, 17 bp, Homo sapiens
tccactaaaaatattgt

SEQ ID NO: 1376914 - DNA, 17 bp, Homo sapiens
tccactacacctggctg

SEQ ID NO: 1376915 - DNA, 15 bp, Homo sapiens
tccactccattgtcg

SEQ ID NO: 1376916 - DNA, 12 bp, Homo sapiens
tccactctgctt

SEQ ID NO: 1376917 - DNA, 21 bp, Homo sapiens
tccactctgcttctctgactt

SEQ ID NO: 1376918 - DNA, 14 bp, Homo sapiens
tccagaaaactgtg

SEQ ID NO: 1376919 - DNA, 22 bp, Homo sapiens
tccagaactcactggggcctac

SEQ ID NO: 1376920 - DNA, 22 bp, Homo sapiens
tccagaagtttgagatcagcct

SEQ ID NO: 1376921 - DNA, 20 bp, Homo sapiens
tccagacttccttgagacac

SEQ ID NO: 1376922 - DNA, 15 bp, Homo sapiens
tccagatcactgcca

SEQ ID NO: 1376923 - DNA, 17 bp, Homo sapiens
tccagatcactgccaca

SEQ ID NO: 1376924 - DNA, 17 bp, Homo sapiens
tccagatggtcatccag

SEQ ID NO: 1376925 - DNA, 21 bp, Homo sapiens
tccagatgtggctactgacat

SEQ ID NO: 1376926 - DNA, 18 bp, Homo sapiens
tccagatgtttccagact

SEQ ID NO: 1376927 - DNA, 16 bp, Homo sapiens
tccagcaacacagcct

SEQ ID NO: 1376928 - DNA, 20 bp, Homo sapiens
tccagcaacacagcctgggc

SEQ ID NO: 1376929 - DNA, 18 bp, Homo sapiens
tccagcaacttcttctcc

SEQ ID NO: 1376930 - DNA, 18 bp, Homo sapiens
tccagcaccttgtgcctg

SEQ ID NO: 1376931 - DNA, 11 bp, Homo sapiens
tccagccagcg

SEQ ID NO: 1376932 - DNA, 20 bp, Homo sapiens
tccagccagcgcctccctcc

SEQ ID NO: 1376933 - DNA, 16 bp, Homo sapiens
tccagcccctctggtc

SEQ ID NO: 1376934 - DNA, 15 bp, Homo sapiens
tccagcctcagcccc

SEQ ID NO: 1376935 - DNA, 19 bp, Homo sapiens
tccagcctggggctgaggc

SEQ ID NO: 1376936 - DNA, 13 bp, Homo sapiens
tccagcctgggtg

SEQ ID NO: 1376937 - DNA, 22 bp, Homo sapiens
tccagcgatctctccactgtgc

SEQ ID NO: 1376938 - DNA, 15 bp, Homo sapiens
tccagctctggaggg

SEQ ID NO: 1376939 - DNA, 17 bp, Homo sapiens
tccagctgcctattgat

SEQ ID NO: 1376940 - DNA, 18 bp, Homo sapiens
tccagctggcctggacag

SEQ ID NO: 1376941 - DNA, 21 bp, Homo sapiens
tccaggaaactccacatctgc

SEQ ID NO: 1376942 - DNA, 18 bp, Homo sapiens
tccaggcagcctctgtca

SEQ ID NO: 1376943 - DNA, 21 bp, Homo sapiens
tccaggccgcgccctttcccc

SEQ ID NO: 1376944 - DNA, 17 bp, Homo sapiens
tccaggcctgcctccca

SEQ ID NO: 1376945 - DNA, 19 bp, Homo sapiens
tccaggctatgtataaaat

SEQ ID NO: 1376946 - DNA, 18 bp, Homo sapiens
tccaggctttcccacttc

SEQ ID NO: 1376947 - DNA, 14 bp, Homo sapiens
tctccagatgtttc

SEQ ID NO: 1376948 - DNA, 18 bp, Homo sapiens
tctccagatgtttccaga

SEQ ID NO: 1376949 - DNA, 19 bp, Homo sapiens
tctccagatgtttccagac

SEQ ID NO: 1376950 - DNA, 21 bp, Homo sapiens
tctccagcgtcagctgctccc

SEQ ID NO: 1376951 - DNA, 20 bp, Homo sapiens
tctccaggggctgcttcctc

SEQ ID NO: 1376952 - DNA, 21 bp, Homo sapiens
tctccatcaccctcttcctgt

SEQ ID NO: 1376953 - DNA, 13 bp, Homo sapiens
tctccatttgctc

SEQ ID NO: 1376954 - DNA, 19 bp, Homo sapiens
tctccccaggtccagctct

SEQ ID NO: 1376955 - DNA, 20 bp, Homo sapiens
tctccccaggtccagctctg

SEQ ID NO: 1376956 - DNA, 22 bp, Homo sapiens
tctccccaggtccagctctgga

SEQ ID NO: 1376957 - DNA, 16 bp, Homo sapiens
tctccctagctcctcc

SEQ ID NO: 1376958 - DNA, 12 bp, Homo sapiens
tctccctgcctg

SEQ ID NO: 1376959 - DNA, 13 bp, Homo sapiens
tctccctgcctgg

SEQ ID NO: 1376960 - DNA, 17 bp, Homo sapiens
tctccctgcctggcccc

SEQ ID NO: 1376961 - DNA, 15 bp, Homo sapiens
tctccctggctccct

SEQ ID NO: 1376962 - DNA, 20 bp, Homo sapiens
tctccctggctccctcctcc

SEQ ID NO: 1376963 - DNA, 15 bp, Homo sapiens
tctccgccagcctcc

SEQ ID NO: 1376964 - DNA, 17 bp, Homo sapiens
tctccggcctctccagc

SEQ ID NO: 1376965 - DNA, 21 bp, Homo sapiens
tctccggcctctccagcctca

SEQ ID NO: 1376966 - DNA, 15 bp, Homo sapiens
tctccggctcccagc

SEQ ID NO: 1376967 - DNA, 16 bp, Homo sapiens
tctccggctcccagcc

SEQ ID NO: 1376968 - DNA, 19 bp, Homo sapiens
tctccggggccatttgcaa

SEQ ID NO: 1376969 - DNA, 21 bp, Homo sapiens
tctccgttagctcctgtggcc

SEQ ID NO: 1376970 - DNA, 22 bp, Homo sapiens
tctccgttagctcctgtggccc

SEQ ID NO: 1376971 - DNA, 23 bp, Homo sapiens
tctccgttagctcctgtggcccc

SEQ ID NO: 1376972 - DNA, 20 bp, Homo sapiens
tctcctacatatcccttcca

SEQ ID NO: 1376973 - DNA, 18 bp, Homo sapiens
tctcctatatatttctat

SEQ ID NO: 1376974 - DNA, 23 bp, Homo sapiens
tctcctggcctatccgctgccag

SEQ ID NO: 1376975 - DNA, 22 bp, Homo sapiens
tctccttaagctgcagagattt

SEQ ID NO: 1376976 - DNA, 17 bp, Homo sapiens
tctcctttaattgtaaa

SEQ ID NO: 1376977 - DNA, 23 bp, Homo sapiens
tctcgcataggacctttccacca

SEQ ID NO: 1376978 - DNA, 23 bp, Homo sapiens
tctctaagtgggcattgccatgt

SEQ ID NO: 1376979 - DNA, 15 bp, Homo sapiens
tctctacaaaaagca

SEQ ID NO: 1376980 - DNA, 16 bp, Homo sapiens
tctctccagatgtttc

SEQ ID NO: 1376981 - DNA, 13 bp, Homo sapiens
tctctcctggcct

SEQ ID NO: 1376982 - DNA, 16 bp, Homo sapiens
tctctcctggcctatc

SEQ ID NO: 1376983 - DNA, 19 bp, Homo sapiens
tctctgtgagaaggtttat

SEQ ID NO: 1376984 - DNA, 20 bp, Homo sapiens
tctcttccttttatcagtag

SEQ ID NO: 1376985 - DNA, 14 bp, Homo sapiens
tctcttgagagggt

SEQ ID NO: 1376986 - DNA, 17 bp, Homo sapiens
tctcttgagctggcctc

SEQ ID NO: 1376987 - DNA, 22 bp, Homo sapiens
tctcttttccactccattgtcg

SEQ ID NO: 1376988 - DNA, 23 bp, Homo sapiens
tctgaaaagtgtgtatatatttt

SEQ ID NO: 1376989 - DNA, 18 bp, Homo sapiens
tctgaaatgttacaaaaa

SEQ ID NO: 1376990 - DNA, 22 bp, Homo sapiens
tctgaaatgttacaaaaataaa

SEQ ID NO: 1376991 - DNA, 17 bp, Homo sapiens
tctgaacttgccttaaa

SEQ ID NO: 1376992 - DNA, 23 bp, Homo sapiens
tctgaaggcgtcaacgtgcattt

SEQ ID NO: 1376993 - DNA, 23 bp, Homo sapiens
tctgacctggcatctaattctga

SEQ ID NO: 1376994 - DNA, 15 bp, Homo sapiens
tctgactaattaggc

SEQ ID NO: 1376995 - DNA, 17 bp, Homo sapiens
tctgacttctgcctgga

SEQ ID NO: 1376996 - DNA, 24 bp, Homo sapiens
tctgagatcaaaacggttttactg

SEQ ID NO: 1376997 - DNA, 17 bp, Homo sapiens
tctgagggaaatgtttt

SEQ ID NO: 1376998 - DNA, 22 bp, Homo sapiens
tctgagggaaatgttttgtaaa

SEQ ID NO: 1376999 - DNA, 19 bp, Homo sapiens
tctgagggcttgtagttct

SEQ ID NO: 1377000 - DNA, 15 bp, Homo sapiens
tctgaggttttattt

SEQ ID NO: 1377001 - DNA, 13 bp, Homo sapiens
tctgatggcctta

SEQ ID NO: 1377002 - DNA, 19 bp, Homo sapiens
tctgattctggctttaagc

SEQ ID NO: 1377003 - DNA, 23 bp, Homo sapiens
tctgattctggctttaagccttc

SEQ ID NO: 1377004 - DNA, 22 bp, Homo sapiens
tctgattgatttgattgggatg

SEQ ID NO: 1377005 - DNA, 21 bp, Homo sapiens
tctgcaagaattgaagcagga

SEQ ID NO: 1377006 - DNA, 18 bp, Homo sapiens
tctgcaccccttctctcc

SEQ ID NO: 1377007 - DNA, 20 bp, Homo sapiens
tctgcaccccttctctcctc

SEQ ID NO: 1377008 - DNA, 21 bp, Homo sapiens
tctgcaccccttctctcctcc

SEQ ID NO: 1377009 - DNA, 19 bp, Homo sapiens
tctgcagtcctactcaagc

SEQ ID NO: 1377010 - DNA, 13 bp, Homo sapiens
tctgccctggctg

SEQ ID NO: 1377011 - DNA, 15 bp, Homo sapiens
tctgccctggctgct

SEQ ID NO: 1377012 - DNA, 17 bp, Homo sapiens
tctgccctggctgctgc

SEQ ID NO: 1377013 - DNA, 14 bp, Homo sapiens
tctgccgtctctgg

SEQ ID NO: 1377014 - DNA, 15 bp, Homo sapiens
tctgccgtctctgga

SEQ ID NO: 1377015 - DNA, 13 bp, Homo sapiens
tctgcctggagtg

SEQ ID NO: 1377016 - DNA, 17 bp, Homo sapiens
tctgcggatctcagctt

SEQ ID NO: 1377017 - DNA, 15 bp, Homo sapiens
tctgctatatataaa

SEQ ID NO: 1377018 - DNA, 21 bp, Homo sapiens
tctgctcaccgcccatcaggg

SEQ ID NO: 1377019 - DNA, 16 bp, Homo sapiens
tctgctgcagagcagt

SEQ ID NO: 1377020 - DNA, 22 bp, Homo sapiens
tctgctgcagagcagtaaggga

SEQ ID NO: 1377021 - DNA, 22 bp, Homo sapiens
tctgcttctctgacttctgcct

SEQ ID NO: 1377022 - DNA, 18 bp, Homo sapiens
tctgcttgctcttgtcct

SEQ ID NO: 1377023 - DNA, 15 bp, Homo sapiens
tctgcttttctgccc

SEQ ID NO: 1377024 - DNA, 21 bp, Homo sapiens
tctgcttttctgccctggctg

SEQ ID NO: 1377025 - DNA, 22 bp, Homo sapiens
tctgcttttctgccctggctgc

SEQ ID NO: 1377026 - DNA, 15 bp, Homo sapiens
tctggaattgtggct

SEQ ID NO: 1377027 - DNA, 14 bp, Homo sapiens
tctggacggcaggc

SEQ ID NO: 1377028 - DNA, 21 bp, Homo sapiens
tctggacggcaggctcactgc

SEQ ID NO: 1377029 - DNA, 15 bp, Homo sapiens
tctggagaccaggga

SEQ ID NO: 1377030 - DNA, 19 bp, Homo sapiens
tctggagaccagggagcct

SEQ ID NO: 1377031 - DNA, 21 bp, Homo sapiens
tctggagaccagggagccttt

SEQ ID NO: 1377032 - DNA, 23 bp, Homo sapiens
tctggagccctaaccccttccag

SEQ ID NO: 1377033 - DNA, 23 bp, Homo sapiens
tctggcaaggactttgtacattt

SEQ ID NO: 1377034 - DNA, 13 bp, Homo sapiens
tctggccctagac

SEQ ID NO: 1377035 - DNA, 17 bp, Homo sapiens
tctggctttaagccttc

SEQ ID NO: 1377036 - DNA, 21 bp, Homo sapiens
tctgggcttatatctggcctc

SEQ ID NO: 1377037 - DNA, 18 bp, Homo sapiens
tctggggggacccagtgc

SEQ ID NO: 1377038 - DNA, 21 bp, Homo sapiens
tctggggggacccagtgcaga

SEQ ID NO: 1377039 - DNA, 21 bp, Homo sapiens
tctggtaatcggggtataata

SEQ ID NO: 1377040 - DNA, 15 bp, Homo sapiens
tctggtactttctgt

SEQ ID NO: 1377041 - DNA, 14 bp, Homo sapiens
tctggtggccccgt

SEQ ID NO: 1377042 - DNA, 13 bp, Homo sapiens
tctggttaaaaaa

SEQ ID NO: 1377043 - DNA, 13 bp, Homo sapiens
tctggttccaggg

SEQ ID NO: 1377044 - DNA, 21 bp, Homo sapiens
tctggttccagggtccctctg

SEQ ID NO: 1377045 - DNA, 23 bp, Homo sapiens
tctggttccagggtccctctgtg

SEQ ID NO: 1377046 - DNA, 15 bp, Homo sapiens
tctgtaataatagac

SEQ ID NO: 1377047 - DNA, 16 bp, Homo sapiens
tctgtaataatagact

SEQ ID NO: 1377048 - DNA, 23 bp, Homo sapiens
tctgtactgttactgggccctga

SEQ ID NO: 1377049 - DNA, 20 bp, Homo sapiens
tctgtacttttcattctctt

SEQ ID NO: 1377050 - DNA, 12 bp, Homo sapiens
tctgtctggcac

SEQ ID NO: 1377051 - DNA, 13 bp, Homo sapiens
tctgtctggtggc

SEQ ID NO: 1377052 - DNA, 16 bp, Homo sapiens
tctgtctggtggcccc

SEQ ID NO: 1377053 - DNA, 14 bp, Homo sapiens
tctgtctttcctga

SEQ ID NO: 1377054 - DNA, 20 bp, Homo sapiens
tctgtgagaaggtttattgt

SEQ ID NO: 1377055 - DNA, 22 bp, Homo sapiens
tctgtgccttcttttgattatg

SEQ ID NO: 1377056 - DNA, 19 bp, Homo sapiens
tctgtggactgaccttgta

SEQ ID NO: 1377057 - DNA, 19 bp, Homo sapiens
tctgtggatgccagggccg

SEQ ID NO: 1377058 - DNA, 17 bp, Homo sapiens
tctgtggttcctctgct

SEQ ID NO: 1377059 - DNA, 19 bp, Homo sapiens
tctgtggttcctctgctca

SEQ ID NO: 1377060 - DNA, 20 bp, Homo sapiens
tctgtggttcctctgctcac

SEQ ID NO: 1377061 - DNA, 13 bp, Homo sapiens
tctgtggttggct

SEQ ID NO: 1377062 - DNA, 19 bp, Homo sapiens
tctgtggttggctgggaaa

SEQ ID NO: 1377063 - DNA, 15 bp, Homo sapiens
tctgtgtgtcagttt

SEQ ID NO: 1377064 - DNA, 19 bp, Homo sapiens
tgagaagtgaatgctggga

SEQ ID NO: 1377065 - DNA, 15 bp, Homo sapiens
tgagacagtcttgct

SEQ ID NO: 1377066 - DNA, 12 bp, Homo sapiens
tgagaccctgtc

SEQ ID NO: 1377067 - DNA, 13 bp, Homo sapiens
tgagactgtgctg

SEQ ID NO: 1377068 - DNA, 15 bp, Homo sapiens
tgagagcataattta

SEQ ID NO: 1377069 - DNA, 12 bp, Homo sapiens
tgagaggcaggc

SEQ ID NO: 1377070 - DNA, 15 bp, Homo sapiens
tgagatcaaaacggt

SEQ ID NO: 1377071 - DNA, 21 bp, Homo sapiens
tgagatcgtgctactgcactc

SEQ ID NO: 1377072 - DNA, 23 bp, Homo sapiens
tgagatcgtgctactgcactcca

SEQ ID NO: 1377073 - DNA, 15 bp, Homo sapiens
tgagattctcaaagg

SEQ ID NO: 1377074 - DNA, 22 bp, Homo sapiens
tgagattggttttcctgtggca

SEQ ID NO: 1377075 - DNA, 18 bp, Homo sapiens
tgagcatgtttgcctaga

SEQ ID NO: 1377076 - DNA, 23 bp, Homo sapiens
tgagccctactccctgcagatgc

SEQ ID NO: 1377077 - DNA, 12 bp, Homo sapiens
tgagccctggct

SEQ ID NO: 1377078 - DNA, 17 bp, Homo sapiens
tgagccgggcccctggg

SEQ ID NO: 1377079 - DNA, 12 bp, Homo sapiens
tgagcctctgct

SEQ ID NO: 1377080 - DNA, 18 bp, Homo sapiens
tgagcctctgctccccag

SEQ ID NO: 1377081 - DNA, 14 bp, Homo sapiens
tgagcctgagcaga

SEQ ID NO: 1377082 - DNA, 17 bp, Homo sapiens
tgagcctgcagggaagc

SEQ ID NO: 1377083 - DNA, 10 bp, Homo sapiens
tgagcctggc

SEQ ID NO: 1377084 - DNA, 16 bp, Homo sapiens
tgagcctggcaagaat

SEQ ID NO: 1377085 - DNA, 20 bp, Homo sapiens
tgagcgcctccatccaaggc

SEQ ID NO: 1377086 - DNA, 23 bp, Homo sapiens
tgagcgcctccatccaaggccag

SEQ ID NO: 1377087 - DNA, 14 bp, Homo sapiens
tgagctatgactta

SEQ ID NO: 1377088 - DNA, 15 bp, Homo sapiens
tgagctatgacttaa

SEQ ID NO: 1377089 - DNA, 19 bp, Homo sapiens
tgagctcaggagtttgaga

SEQ ID NO: 1377090 - DNA, 19 bp, Homo sapiens
tgagctcccacttctgcca

SEQ ID NO: 1377091 - DNA, 15 bp, Homo sapiens
tgagctctgaaatct

SEQ ID NO: 1377092 - DNA, 16 bp, Homo sapiens
tgagctctgaaatctt

SEQ ID NO: 1377093 - DNA, 17 bp, Homo sapiens
tgagctctgaaatcttc

SEQ ID NO: 1377094 - DNA, 21 bp, Homo sapiens
tgagctcttcctatccctctc

SEQ ID NO: 1377095 - DNA, 20 bp, Homo sapiens
tgagctgcctgtaacttgag

SEQ ID NO: 1377096 - DNA, 12 bp, Homo sapiens
tgagctgccttc

SEQ ID NO: 1377097 - DNA, 18 bp, Homo sapiens
tgagctggcctctctagc

SEQ ID NO: 1377098 - DNA, 21 bp, Homo sapiens
tgagctggcctctctagcaca

SEQ ID NO: 1377099 - DNA, 18 bp, Homo sapiens
tgaggaaatcaaagtgct

SEQ ID NO: 1377100 - DNA, 12 bp, Homo sapiens
tgaggaggggag

SEQ ID NO: 1377101 - DNA, 13 bp, Homo sapiens
tgaggaggggagg

SEQ ID NO: 1377102 - DNA, 16 bp, Homo sapiens
tgaggaggggagggta

SEQ ID NO: 1377103 - DNA, 22 bp, Homo sapiens
tgaggaggggagggtaaataaa

SEQ ID NO: 1377104 - DNA, 13 bp, Homo sapiens
tgaggagggtggg

SEQ ID NO: 1377105 - DNA, 20 bp, Homo sapiens
tgaggagggtgggggaggga

SEQ ID NO: 1377106 - DNA, 21 bp, Homo sapiens
tgaggattagtttagaacagg

SEQ ID NO: 1377107 - DNA, 20 bp, Homo sapiens
tgaggcaataaaaatcatag

SEQ ID NO: 1377108 - DNA, 20 bp, Homo sapiens
tgaggccgttgctgacttag

SEQ ID NO: 1377109 - DNA, 12 bp, Homo sapiens
tgaggcctgggc

SEQ ID NO: 1377110 - DNA, 13 bp, Homo sapiens
tgaggcctgggcc

SEQ ID NO: 1377111 - DNA, 21 bp, Homo sapiens
tgaggctgtggtcacagcgga

SEQ ID NO: 1377112 - DNA, 14 bp, Homo sapiens
tgagggaggggaaa

SEQ ID NO: 1377113 - DNA, 22 bp, Homo sapiens
tgagggccaaaatatttggaat

SEQ ID NO: 1377114 - DNA, 13 bp, Homo sapiens
tgagggcttgtag

SEQ ID NO: 1377115 - DNA, 16 bp, Homo sapiens
tgaggtattttttcct

SEQ ID NO: 1377116 - DNA, 13 bp, Homo sapiens
tgaggtgggaggt

SEQ ID NO: 1377117 - DNA, 18 bp, Homo sapiens
tgaggtgggaggtggaag

SEQ ID NO: 1377118 - DNA, 16 bp, Homo sapiens
tgaggttcctctgcct

SEQ ID NO: 1377119 - DNA, 17 bp, Homo sapiens
tgaggttcctctgcctg

SEQ ID NO: 1377120 - DNA, 18 bp, Homo sapiens
tgaggttcctctgcctgc

SEQ ID NO: 1377121 - DNA, 19 bp, Homo sapiens
tgaggtttcaaacctccct

SEQ ID NO: 1377122 - DNA, 21 bp, Homo sapiens
tgagtaaaatagattttataa

SEQ ID NO: 1377123 - DNA, 15 bp, Homo sapiens
tgagtacagcagaaa

SEQ ID NO: 1377124 - DNA, 19 bp, Homo sapiens
tgagtattgtttaaaatgt

SEQ ID NO: 1377125 - DNA, 18 bp, Homo sapiens
tgagtcatatcttaatat

SEQ ID NO: 1377126 - DNA, 22 bp, Homo sapiens
tgagtccattctcccaggtacc

SEQ ID NO: 1377127 - DNA, 21 bp, Homo sapiens
tgagtctgggcagctgtccct

SEQ ID NO: 1377128 - DNA, 19 bp, Homo sapiens
tgagttgattcagctctgc

SEQ ID NO: 1377129 - DNA, 18 bp, Homo sapiens
tgagtttgagctgccttc

SEQ ID NO: 1377130 - DNA, 19 bp, Homo sapiens
tgagtttgtcgctcatgtg

SEQ ID NO: 1377131 - DNA, 13 bp, Homo sapiens
tgatacattcaaa

SEQ ID NO: 1377132 - DNA, 18 bp, Homo sapiens
tgatactatccagttact

SEQ ID NO: 1377133 - DNA, 14 bp, Homo sapiens
tgatagcattgtaa

SEQ ID NO: 1377134 - DNA, 16 bp, Homo sapiens
tgatagtcttttgctt

SEQ ID NO: 1377135 - DNA, 16 bp, Homo sapiens
tgatatctataaaata

SEQ ID NO: 1377136 - DNA, 17 bp, Homo sapiens
tgatatctataaaatag

SEQ ID NO: 1377137 - DNA, 19 bp, Homo sapiens
tgatcaaaatcaattaaaa

SEQ ID NO: 1377138 - DNA, 16 bp, Homo sapiens
tgatcaatatttttat

SEQ ID NO: 1377139 - DNA, 17 bp, Homo sapiens
tgatcaccgactgaaaa

SEQ ID NO: 1377140 - DNA, 19 bp, Homo sapiens
tgatcaccgactgaaaata

SEQ ID NO: 1377141 - DNA, 16 bp, Homo sapiens
tgatccacccaaccct

SEQ ID NO: 1377142 - DNA, 13 bp, Homo sapiens
tgatcctccaaca

SEQ ID NO: 1377143 - DNA, 14 bp, Homo sapiens
tgatcctctcacct

SEQ ID NO: 1377144 - DNA, 15 bp, Homo sapiens
tgatctacatgagga

SEQ ID NO: 1377145 - DNA, 18 bp, Homo sapiens
tgatgacaaaaaatgttt

SEQ ID NO: 1377146 - DNA, 20 bp, Homo sapiens
tgatgacaaaaaatgtttta

SEQ ID NO: 1377147 - DNA, 17 bp, Homo sapiens
tgatgacaataaagctt

SEQ ID NO: 1377148 - DNA, 19 bp, Homo sapiens
tgatgacgtacaagtagtt

SEQ ID NO: 1377149 - DNA, 13 bp, Homo sapiens
tgatgaggtattt

SEQ ID NO: 1377150 - DNA, 19 bp, Homo sapiens
tgatgaggtattttttcct

SEQ ID NO: 1377151 - DNA, 13 bp, Homo sapiens
tgatgcatgtctt

SEQ ID NO: 1377152 - DNA, 18 bp, Homo sapiens
tgatggccttaatttcct

SEQ ID NO: 1377153 - DNA, 20 bp, Homo sapiens
tgatggccttaatttccttt

SEQ ID NO: 1377154 - DNA, 17 bp, Homo sapiens
tgatgtcaatttctgtg

SEQ ID NO: 1377155 - DNA, 18 bp, Homo sapiens
tgatgtcagcagttgctg

SEQ ID NO: 1377156 - DNA, 22 bp, Homo sapiens
tgatgtcagcagttgctggtaa

SEQ ID NO: 1377157 - DNA, 23 bp, Homo sapiens
tgatgtcagcagttgctggtaaa

SEQ ID NO: 1377158 - DNA, 22 bp, Homo sapiens
tgatgtgcaaaaccttttactg

SEQ ID NO: 1377159 - DNA, 13 bp, Homo sapiens
tgatgtttgtcct

SEQ ID NO: 1377160 - DNA, 19 bp, Homo sapiens
tgattaaaaatatcaaatt

SEQ ID NO: 1377161 - DNA, 20 bp, Homo sapiens
tgattaaaaatatcaaatta

SEQ ID NO: 1377162 - DNA, 22 bp, Homo sapiens
tgattaaaaatatcaaattaat

SEQ ID NO: 1377163 - DNA, 20 bp, Homo sapiens
tgattaaccacttcagctga

SEQ ID NO: 1377164 - DNA, 13 bp, Homo sapiens
tgattagcaagtt

SEQ ID NO: 1377165 - DNA, 18 bp, Homo sapiens
tgattagcaagttacagt

SEQ ID NO: 1377166 - DNA, 22 bp, Homo sapiens
tgattatttaagactaaaagtt

SEQ ID NO: 1377167 - DNA, 13 bp, Homo sapiens
tgattatttgcat

SEQ ID NO: 1377168 - DNA, 14 bp, Homo sapiens
tgattatttgcatg

SEQ ID NO: 1377169 - DNA, 15 bp, Homo sapiens
tgattatttgcatgt

SEQ ID NO: 1377170 - DNA, 22 bp, Homo sapiens
tgattccactacacctggctga

SEQ ID NO: 1377171 - DNA, 18 bp, Homo sapiens
tgattcccttgttattca

SEQ ID NO: 1377172 - DNA, 19 bp, Homo sapiens
tgattcccttgttattcaa

SEQ ID NO: 1377173 - DNA, 20 bp, Homo sapiens
tgattcccttgttattcaac

SEQ ID NO: 1377174 - DNA, 14 bp, Homo sapiens
tgattctggcttta

SEQ ID NO: 1377175 - DNA, 18 bp, Homo sapiens
tgattctggctttaagcc

SEQ ID NO: 1377176 - DNA, 19 bp, Homo sapiens
tgattgaataatgccacca

SEQ ID NO: 1377177 - DNA, 16 bp, Homo sapiens
tgattggaccaggcca

SEQ ID NO: 1377178 - DNA, 15 bp, Homo sapiens
tgattgggaaaacat

SEQ ID NO: 1377179 - DNA, 16 bp, Homo sapiens
tgattgggaaaacatt

SEQ ID NO: 1377180 - DNA, 20 bp, Homo sapiens
tgattgggaaaacatttgct

SEQ ID NO: 1377181 - DNA, 19 bp, Homo sapiens
tgattgttaatttacagct

SEQ ID NO: 1377182 - DNA, 20 bp, Homo sapiens
tgcttcacagtagagccagc

SEQ ID NO: 1377183 - DNA, 21 bp, Homo sapiens
tgcttcaccatggccttatga

SEQ ID NO: 1377184 - DNA, 16 bp, Homo sapiens
tgcttccaggaaactc

SEQ ID NO: 1377185 - DNA, 15 bp, Homo sapiens
tgcttcccttacttt

SEQ ID NO: 1377186 - DNA, 13 bp, Homo sapiens
tgcttcctcctgg

SEQ ID NO: 1377187 - DNA, 22 bp, Homo sapiens
tgcttctcagatttctgaggaa

SEQ ID NO: 1377188 - DNA, 13 bp, Homo sapiens
tgcttctctgact

SEQ ID NO: 1377189 - DNA, 20 bp, Homo sapiens
tgcttctctgacttctgcct

SEQ ID NO: 1377190 - DNA, 22 bp, Homo sapiens
tgcttctctgacttctgcctgg

SEQ ID NO: 1377191 - DNA, 23 bp, Homo sapiens
tgcttctctgacttctgcctgga

SEQ ID NO: 1377192 - DNA, 20 bp, Homo sapiens
tgcttgtcttctggtacttt

SEQ ID NO: 1377193 - DNA, 20 bp, Homo sapiens
tgcttgtgaaaatgtgttct

SEQ ID NO: 1377194 - DNA, 21 bp, Homo sapiens
tgctttaccttttcagggctg

SEQ ID NO: 1377195 - DNA, 15 bp, Homo sapiens
tgctttagacttgaa

SEQ ID NO: 1377196 - DNA, 15 bp, Homo sapiens
tgctttattaatgtt

SEQ ID NO: 1377197 - DNA, 13 bp, Homo sapiens
tgctttatttgta

SEQ ID NO: 1377198 - DNA, 23 bp, Homo sapiens
tgctttatttgtaaatttagtgt

SEQ ID NO: 1377199 - DNA, 15 bp, Homo sapiens
tgcttttctgccctg

SEQ ID NO: 1377200 - DNA, 22 bp, Homo sapiens
tgctttttcttgtttgtttaaa

SEQ ID NO: 1377201 - DNA, 20 bp, Homo sapiens
tggaaaactgtgttgccaca

SEQ ID NO: 1377202 - DNA, 16 bp, Homo sapiens
tggaaaagtgtccttc

SEQ ID NO: 1377203 - DNA, 13 bp, Homo sapiens
tggaaaggggaga

SEQ ID NO: 1377204 - DNA, 19 bp, Homo sapiens
tggaaagtaactcatttgt

SEQ ID NO: 1377205 - DNA, 19 bp, Homo sapiens
tggaaattcctgtactgtg

SEQ ID NO: 1377206 - DNA, 22 bp, Homo sapiens
tggaaattcctgtactgtgtct

SEQ ID NO: 1377207 - DNA, 14 bp, Homo sapiens
tggaacatactgtt

SEQ ID NO: 1377208 - DNA, 16 bp, Homo sapiens
tggaacatactgttca

SEQ ID NO: 1377209 - DNA, 17 bp, Homo sapiens
tggaacatactgttcac

SEQ ID NO: 1377210 - DNA, 19 bp, Homo sapiens
tggaaccacattgaagaat

SEQ ID NO: 1377211 - DNA, 18 bp, Homo sapiens
tggaagaacaggcctctc

SEQ ID NO: 1377212 - DNA, 19 bp, Homo sapiens
tggaagaagggagaagaaa

SEQ ID NO: 1377213 - DNA, 13 bp, Homo sapiens
tggaagatcctgc

SEQ ID NO: 1377214 - DNA, 14 bp, Homo sapiens
tggaatataaggaa

SEQ ID NO: 1377215 - DNA, 18 bp, Homo sapiens
tggaatataaggaaagca

SEQ ID NO: 1377216 - DNA, 22 bp, Homo sapiens
tggaatcaggaatattttccaa

SEQ ID NO: 1377217 - DNA, 15 bp, Homo sapiens
tggaattgccagctg

SEQ ID NO: 1377218 - DNA, 22 bp, Homo sapiens
tggaattgtggctatcctgatt

SEQ ID NO: 1377219 - DNA, 16 bp, Homo sapiens
tggacacacacagact

SEQ ID NO: 1377220 - DNA, 19 bp, Homo sapiens
tggacactccagggacaca

SEQ ID NO: 1377221 - DNA, 22 bp, Homo sapiens
tggacagattgcctgtttctga

SEQ ID NO: 1377222 - DNA, 18 bp, Homo sapiens
tggacatcctcctcccac

SEQ ID NO: 1377223 - DNA, 20 bp, Homo sapiens
tggacatcctcctcccaccc

SEQ ID NO: 1377224 - DNA, 23 bp, Homo sapiens
tggacatcctcctcccacccggc

SEQ ID NO: 1377225 - DNA, 16 bp, Homo sapiens
tggaccttaggccttc

SEQ ID NO: 1377226 - DNA, 15 bp, Homo sapiens
tggacggcaggctca

SEQ ID NO: 1377227 - DNA, 21 bp, Homo sapiens
tggacggcaggctcactgcca

SEQ ID NO: 1377228 - DNA, 17 bp, Homo sapiens
tggactatctgtctggt

SEQ ID NO: 1377229 - DNA, 20 bp, Homo sapiens
tggactatctgtctggtggc

SEQ ID NO: 1377230 - DNA, 22 bp, Homo sapiens
tggactatctgtctggtggccc

SEQ ID NO: 1377231 - DNA, 18 bp, Homo sapiens
tggactgtggcacttgcc

SEQ ID NO: 1377232 - DNA, 22 bp, Homo sapiens
tggactgtggcacttgcctggg

SEQ ID NO: 1377233 - DNA, 22 bp, Homo sapiens
tggagaagcggctggcagccca

SEQ ID NO: 1377234 - DNA, 22 bp, Homo sapiens
tggagacgtttataaacagaaa

SEQ ID NO: 1377235 - DNA, 14 bp, Homo sapiens
tggagatcctcctg

SEQ ID NO: 1377236 - DNA, 16 bp, Homo sapiens
tggagatcctcctgca

SEQ ID NO: 1377237 - DNA, 15 bp, Homo sapiens
tggagattataataa

SEQ ID NO: 1377238 - DNA, 16 bp, Homo sapiens
tggagattataataaa

SEQ ID NO: 1377239 - DNA, 17 bp, Homo sapiens
tggaggaagaactgaaa

SEQ ID NO: 1377240 - DNA, 13 bp, Homo sapiens
tggaggaggaagg

SEQ ID NO: 1377241 - DNA, 14 bp, Homo sapiens
tggaggaggaaggc

SEQ ID NO: 1377242 - DNA, 21 bp, Homo sapiens
tggaggatcccctccaagcct

SEQ ID NO: 1377243 - DNA, 15 bp, Homo sapiens
tggaggcttcctgcg

SEQ ID NO: 1377244 - DNA, 19 bp, Homo sapiens
tggagggaggccccagggg

SEQ ID NO: 1377245 - DNA, 17 bp, Homo sapiens
tggagggagggaagggt

SEQ ID NO: 1377246 - DNA, 17 bp, Homo sapiens
tggaggggtgtggcagt

SEQ ID NO: 1377247 - DNA, 15 bp, Homo sapiens
tggaggttgaagcca

SEQ ID NO: 1377248 - DNA, 14 bp, Homo sapiens
tggatggccccagc

SEQ ID NO: 1377249 - DNA, 21 bp, Homo sapiens
tggattaaatacatatggatg

SEQ ID NO: 1377250 - DNA, 18 bp, Homo sapiens
tggatttggcactagcca

SEQ ID NO: 1377251 - DNA, 16 bp, Homo sapiens
tggcaaaaaggcagga

SEQ ID NO: 1377252 - DNA, 17 bp, Homo sapiens
tggcaataaattttgaa

SEQ ID NO: 1377253 - DNA, 20 bp, Homo sapiens
tggcaataaattttgaaaag

SEQ ID NO: 1377254 - DNA, 17 bp, Homo sapiens
tggcaatggtagtttct

SEQ ID NO: 1377255 - DNA, 21 bp, Homo sapiens
tggcaatggtagtttctgtgg

SEQ ID NO: 1377256 - DNA, 16 bp, Homo sapiens
tggcaccagcagcctg

SEQ ID NO: 1377257 - DNA, 19 bp, Homo sapiens
tggcactgactgggcatag

SEQ ID NO: 1377258 - DNA, 15 bp, Homo sapiens
tggcacttgcctggg

SEQ ID NO: 1377259 - DNA, 16 bp, Homo sapiens
tggcacttgcctgggt

SEQ ID NO: 1377260 - DNA, 17 bp, Homo sapiens
tggcacttgcctgggtc

SEQ ID NO: 1377261 - DNA, 18 bp, Homo sapiens
tggcacttgcctgggtca

SEQ ID NO: 1377262 - DNA, 21 bp, Homo sapiens
tggcagaaaaaatgtctgtaa

SEQ ID NO: 1377263 - DNA, 14 bp, Homo sapiens
tggcaggctggcca

SEQ ID NO: 1377264 - DNA, 15 bp, Homo sapiens
tggcaggctggccag

SEQ ID NO: 1377265 - DNA, 15 bp, Homo sapiens
tggcaggggacagga

SEQ ID NO: 1377266 - DNA, 18 bp, Homo sapiens
tggcagtccgtgggacgg

SEQ ID NO: 1377267 - DNA, 20 bp, Homo sapiens
tggcatcttagacctccaca

SEQ ID NO: 1377268 - DNA, 22 bp, Homo sapiens
tggcatggttttgtgccatctg

SEQ ID NO: 1377269 - DNA, 19 bp, Homo sapiens
tggcatgtaaatgtaaact

SEQ ID NO: 1377270 - DNA, 21 bp, Homo sapiens
tggccaagaagcagtggcctt

SEQ ID NO: 1377271 - DNA, 22 bp, Homo sapiens
tggccaagaagcagtggcctta

SEQ ID NO: 1377272 - DNA, 16 bp, Homo sapiens
tggccacatggcggag

SEQ ID NO: 1377273 - DNA, 18 bp, Homo sapiens
tggccagaggtgtcaccc

SEQ ID NO: 1377274 - DNA, 20 bp, Homo sapiens
tggccaggctggtcttgaac

SEQ ID NO: 1377275 - DNA, 21 bp, Homo sapiens
tggccagtccaccctgcctgc

SEQ ID NO: 1377276 - DNA, 15 bp, Homo sapiens
tggccagtccaggct

SEQ ID NO: 1377277 - DNA, 16 bp, Homo sapiens
tggccagtccaggctg

SEQ ID NO: 1377278 - DNA, 21 bp, Homo sapiens
tggccagtccaggctgccgtg

SEQ ID NO: 1377279 - DNA, 12 bp, Homo sapiens
tggcccaaggct

SEQ ID NO: 1377280 - DNA, 17 bp, Homo sapiens
tggcccaaggctggcag

SEQ ID NO: 1377281 - DNA, 18 bp, Homo sapiens
tggcccaaggctggcagg

SEQ ID NO: 1377282 - DNA, 13 bp, Homo sapiens
tggcccacgcact

SEQ ID NO: 1377283 - DNA, 19 bp, Homo sapiens
tggcccacgcacttcggga

SEQ ID NO: 1377284 - DNA, 14 bp, Homo sapiens
tggcccactgcatc

SEQ ID NO: 1377285 - DNA, 15 bp, Homo sapiens
tggccccaccctggg

SEQ ID NO: 1377286 - DNA, 16 bp, Homo sapiens
tggccccaccctgggc

SEQ ID NO: 1377287 - DNA, 18 bp, Homo sapiens
tggccccaccctgggccc

SEQ ID NO: 1377288 - DNA, 19 bp, Homo sapiens
tggccccagcacagcttga

SEQ ID NO: 1377289 - DNA, 13 bp, Homo sapiens
tggccccagccct

SEQ ID NO: 1377290 - DNA, 19 bp, Homo sapiens
tggccccagccctgctggg

SEQ ID NO: 1377291 - DNA, 14 bp, Homo sapiens
tggccctggctgcc

SEQ ID NO: 1377292 - DNA, 21 bp, Homo sapiens
tggccctgggcggggcgtggg

SEQ ID NO: 1377293 - DNA, 17 bp, Homo sapiens
tggccgcggagcctgca

SEQ ID NO: 1377294 - DNA, 21 bp, Homo sapiens
tggcctaaacctcagttatta

SEQ ID NO: 1377295 - DNA, 15 bp, Homo sapiens
tggcctatccgctgc

SEQ ID NO: 1377296 - DNA, 17 bp, Homo sapiens
tggcctcatgtggctgg

SEQ ID NO: 1377297 - DNA, 14 bp, Homo sapiens
tggcctcccctgcc

SEQ ID NO: 1377298 - DNA, 19 bp, Homo sapiens
tggcctcccctgccaccag

SEQ ID NO: 1377299 - DNA, 17 bp, Homo sapiens
tgtttagtgatattaca

SEQ ID NO: 1377300 - DNA, 23 bp, Homo sapiens
tgtttataaaatataaacaaaga

SEQ ID NO: 1377301 - DNA, 22 bp, Homo sapiens
tgtttatggcaatttaacatgt

SEQ ID NO: 1377302 - DNA, 15 bp, Homo sapiens
tgtttattacttcca

SEQ ID NO: 1377303 - DNA, 22 bp, Homo sapiens
tgtttcaggttcagtattatgt

SEQ ID NO: 1377304 - DNA, 23 bp, Homo sapiens
tgtttccagacttccttgagaca

SEQ ID NO: 1377305 - DNA, 23 bp, Homo sapiens
tgtttcgcgggtaactggggttg

SEQ ID NO: 1377306 - DNA, 13 bp, Homo sapiens
tgtttctctgaaa

SEQ ID NO: 1377307 - DNA, 18 bp, Homo sapiens
tgtttctcttgagctggc

SEQ ID NO: 1377308 - DNA, 19 bp, Homo sapiens
tgtttgaaaacttcagaag

SEQ ID NO: 1377309 - DNA, 17 bp, Homo sapiens
tgtttgaaaatagttta

SEQ ID NO: 1377310 - DNA, 18 bp, Homo sapiens
tgtttgccaggacatgca

SEQ ID NO: 1377311 - DNA, 12 bp, Homo sapiens
tgtttggtaaat

SEQ ID NO: 1377312 - DNA, 17 bp, Homo sapiens
tgttttaaaataaggat

SEQ ID NO: 1377313 - DNA, 12 bp, Homo sapiens
tgttttaaagaa

SEQ ID NO: 1377314 - DNA, 22 bp, Homo sapiens
tgttttaaagaatatgactttt

SEQ ID NO: 1377315 - DNA, 22 bp, Homo sapiens
tgttttacaatagttctgtggg

SEQ ID NO: 1377316 - DNA, 13 bp, Homo sapiens
tgttttataaaat

SEQ ID NO: 1377317 - DNA, 15 bp, Homo sapiens
tgttttctcttgaga

SEQ ID NO: 1377318 - DNA, 11 bp, Homo sapiens
tgttttgcaag

SEQ ID NO: 1377319 - DNA, 20 bp, Homo sapiens
tgttttgccaaagactgtaa

SEQ ID NO: 1377320 - DNA, 17 bp, Homo sapiens
tgttttgtaaacattta

SEQ ID NO: 1377321 - DNA, 13 bp, Homo sapiens
tgtttttaatgct

SEQ ID NO: 1377322 - DNA, 21 bp, Homo sapiens
tgtttttatacaaaataagaa

SEQ ID NO: 1377323 - DNA, 18 bp, Homo sapiens
tgtttttctgctttagac

SEQ ID NO: 1377324 - DNA, 13 bp, Homo sapiens
tgtttttgtctta

SEQ ID NO: 1377325 - DNA, 14 bp, Homo sapiens
tgttttttaagata

SEQ ID NO: 1377326 - DNA, 21 bp, Homo sapiens
tgttttttaagatagtgtaac

SEQ ID NO: 1377327 - DNA, 15 bp, Homo sapiens
tgtttttttgtttgt

SEQ ID NO: 1377328 - DNA, 15 bp, Homo sapiens
ttaaaaaagagacat

SEQ ID NO: 1377329 - DNA, 23 bp, Homo sapiens
ttaaaaaataggtggtagatatt

SEQ ID NO: 1377330 - DNA, 18 bp, Homo sapiens
ttaaaaagggaagaaact

SEQ ID NO: 1377331 - DNA, 15 bp, Homo sapiens
ttaaaaatagaaaca

SEQ ID NO: 1377332 - DNA, 13 bp, Homo sapiens
ttaaaaatatcaa

SEQ ID NO: 1377333 - DNA, 14 bp, Homo sapiens
ttaaaaattgttat

SEQ ID NO: 1377334 - DNA, 20 bp, Homo sapiens
ttaaaacacatgtttttata

SEQ ID NO: 1377335 - DNA, 14 bp, Homo sapiens
ttaaaataaaatga

SEQ ID NO: 1377336 - DNA, 14 bp, Homo sapiens
ttaaaataaatatt

SEQ ID NO: 1377337 - DNA, 15 bp, Homo sapiens
ttaaaataaggattt

SEQ ID NO: 1377338 - DNA, 12 bp, Homo sapiens
ttaaaatagaaa

SEQ ID NO: 1377339 - DNA, 21 bp, Homo sapiens
ttaaaatagaaattttgtaag

SEQ ID NO: 1377340 - DNA, 18 bp, Homo sapiens
ttaaaatctgagggaaat

SEQ ID NO: 1377341 - DNA, 22 bp, Homo sapiens
ttaaaatctgagggaaatgttt

SEQ ID NO: 1377342 - DNA, 11 bp, Homo sapiens
ttaaaatgtaa

SEQ ID NO: 1377343 - DNA, 13 bp, Homo sapiens
ttaaaattcatgt

SEQ ID NO: 1377344 - DNA, 16 bp, Homo sapiens
ttaaaattttgtatgt

SEQ ID NO: 1377345 - DNA, 15 bp, Homo sapiens
ttaaacattgaagta

SEQ ID NO: 1377346 - DNA, 17 bp, Homo sapiens
ttaaaccgccaaggctg

SEQ ID NO: 1377347 - DNA, 19 bp, Homo sapiens
ttaaacgaagagttccctt

SEQ ID NO: 1377348 - DNA, 16 bp, Homo sapiens
ttaaagaaaaaaatgt

SEQ ID NO: 1377349 - DNA, 15 bp, Homo sapiens
ttaaagaaaagatga

SEQ ID NO: 1377350 - DNA, 20 bp, Homo sapiens
ttaaagaatatgacttttta

SEQ ID NO: 1377351 - DNA, 15 bp, Homo sapiens
ttaaagagaatgagt

SEQ ID NO: 1377352 - DNA, 14 bp, Homo sapiens
ttaaagtattttct

SEQ ID NO: 1377353 - DNA, 19 bp, Homo sapiens
ttaaatacatatggatgtt

SEQ ID NO: 1377354 - DNA, 23 bp, Homo sapiens
ttaaatacatatggatgttactc

SEQ ID NO: 1377355 - DNA, 15 bp, Homo sapiens
ttaaatcttaatgtt

SEQ ID NO: 1377356 - DNA, 15 bp, Homo sapiens
ttaaattacaatttt

SEQ ID NO: 1377357 - DNA, 16 bp, Homo sapiens
ttaaattacaatttta

SEQ ID NO: 1377358 - DNA, 17 bp, Homo sapiens
ttaaattacaattttat

SEQ ID NO: 1377359 - DNA, 18 bp, Homo sapiens
ttaaatttcttatgtgac

SEQ ID NO: 1377360 - DNA, 21 bp, Homo sapiens
ttaaatttttttgtatgaaaa

SEQ ID NO: 1377361 - DNA, 21 bp, Homo sapiens
ttaacagaaattgtatattgt

SEQ ID NO: 1377362 - DNA, 13 bp, Homo sapiens
ttaacagttgtat

SEQ ID NO: 1377363 - DNA, 15 bp, Homo sapiens
ttaacagttgtattt

SEQ ID NO: 1377364 - DNA, 13 bp, Homo sapiens
ttaacattattta

SEQ ID NO: 1377365 - DNA, 21 bp, Homo sapiens
ttaaccggtaagagtttcagt

SEQ ID NO: 1377366 - DNA, 16 bp, Homo sapiens
ttaacttaataatcaa

SEQ ID NO: 1377367 - DNA, 17 bp, Homo sapiens
ttaacttaataatcaag

SEQ ID NO: 1377368 - DNA, 14 bp, Homo sapiens
ttaagactgatttt

SEQ ID NO: 1377369 - DNA, 18 bp, Homo sapiens
ttaagactgattttaata

SEQ ID NO: 1377370 - DNA, 12 bp, Homo sapiens
ttaagatgtgaa

SEQ ID NO: 1377371 - DNA, 14 bp, Homo sapiens
ttaagatgtgaaaa

SEQ ID NO: 1377372 - DNA, 19 bp, Homo sapiens
ttaagcaaatgttaaaagt

SEQ ID NO: 1377373 - DNA, 19 bp, Homo sapiens
ttaagctgcaaatctgatg

SEQ ID NO: 1377374 - DNA, 15 bp, Homo sapiens
ttaagggaaaaatat

SEQ ID NO: 1377375 - DNA, 18 bp, Homo sapiens
ttaaggggaagaatgaaa

SEQ ID NO: 1377376 - DNA, 18 bp, Homo sapiens
ttaaggggtatcatgtat

SEQ ID NO: 1377377 - DNA, 22 bp, Homo sapiens
ttaaggtgtttgaaaatagttt

SEQ ID NO: 1377378 - DNA, 20 bp, Homo sapiens
ttaagtgaggaaatcaaagt

SEQ ID NO: 1377379 - DNA, 12 bp, Homo sapiens
ttaagttcttat

SEQ ID NO: 1377380 - DNA, 20 bp, Homo sapiens
ttaagttttgacaagctggc

SEQ ID NO: 1377381 - DNA, 22 bp, Homo sapiens
ttaataagctactagcaaaata

SEQ ID NO: 1377382 - DNA, 23 bp, Homo sapiens
ttaataccagataccttatctta

SEQ ID NO: 1377383 - DNA, 23 bp, Homo sapiens
ttaatataaagtagtcctgtgaa

SEQ ID NO: 1377384 - DNA, 12 bp, Homo sapiens
ttaatatttaac

SEQ ID NO: 1377385 - DNA, 12 bp, Homo sapiens
ttaatccaatgg

SEQ ID NO: 1377386 - DNA, 18 bp, Homo sapiens
ttaatccagttataagaa

SEQ ID NO: 1377387 - DNA, 14 bp, Homo sapiens
ttaatctactgcat

SEQ ID NO: 1377388 - DNA, 20 bp, Homo sapiens
ttaatctgtttatttacaag

SEQ ID NO: 1377389 - DNA, 14 bp, Homo sapiens
ttaatgacaatatt

SEQ ID NO: 1377390 - DNA, 14 bp, Homo sapiens
ttaatgctacatgt

SEQ ID NO: 1377391 - DNA, 20 bp, Homo sapiens
ttaatggaagtgtatttatt

SEQ ID NO: 1377392 - DNA, 15 bp, Homo sapiens
ttaatgttttcaaaa

SEQ ID NO: 1377393 - DNA, 15 bp, Homo sapiens
ttaattcatgaggag

SEQ ID NO: 1377394 - DNA, 16 bp, Homo sapiens
ttaattgtgtgaactt

SEQ ID NO: 1377395 - DNA, 11 bp, Homo sapiens
ttaatttcctt

SEQ ID NO: 1377396 - DNA, 13 bp, Homo sapiens
ttaatttcctttt

SEQ ID NO: 1377397 - DNA, 23 bp, Homo sapiens
ttaatttcctttttgacactgaa

SEQ ID NO: 1377398 - DNA, 16 bp, Homo sapiens
ttaattttaaagtgca

SEQ ID NO: 1377399 - DNA, 18 bp, Homo sapiens
ttaattttaaagtgcaaa

SEQ ID NO: 1377400 - DNA, 21 bp, Homo sapiens
ttacaaagttaaaattgttat

SEQ ID NO: 1377401 - DNA, 17 bp, Homo sapiens
ttacaataggagtggtg

SEQ ID NO: 1377402 - DNA, 15 bp, Homo sapiens
ttacaatagttctgt

SEQ ID NO: 1377403 - DNA, 17 bp, Homo sapiens
ttacaatagttctgtgg

SEQ ID NO: 1377404 - DNA, 16 bp, Homo sapiens
ttacacagaaacactg

SEQ ID NO: 1377405 - DNA, 13 bp, Homo sapiens
ttacagaaaaaga

SEQ ID NO: 1377406 - DNA, 19 bp, Homo sapiens
ttacagaaatggactggag

SEQ ID NO: 1377407 - DNA, 19 bp, Homo sapiens
ttacagctcattaaacttt

SEQ ID NO: 1377408 - DNA, 16 bp, Homo sapiens
ttacatgtaatttgat

SEQ ID NO: 1377409 - DNA, 22 bp, Homo sapiens
ttaccagaggttgtgcactgtt

SEQ ID NO: 1377410 - DNA, 22 bp, Homo sapiens
ttacccacctagaacactaact

SEQ ID NO: 1377411 - DNA, 15 bp, Homo sapiens
ttacctagtgaaact

SEQ ID NO: 1377412 - DNA, 17 bp, Homo sapiens
ttactaattatactact

SEQ ID NO: 1377413 - DNA, 23 bp, Homo sapiens
ttactctcttgcaccaaattatc

SEQ ID NO: 1377414 - DNA, 14 bp, Homo sapiens
ttactgacatttct

SEQ ID NO: 1377415 - DNA, 19 bp, Homo sapiens
ttactgccggtttgaaaat

SEQ ID NO: 1377416 - DNA, 11 bp, Homo sapiens
ttactgccttg

SEQ ID NO: 1377417 - DNA, 14 bp, Homo sapiens
ttactgggccctga

SEQ ID NO: 1377418 - DNA, 21 bp, Homo sapiens
ttctgtgtgtcagttttcata

SEQ ID NO: 1377419 - DNA, 14 bp, Homo sapiens
ttctgtttaatttt

SEQ ID NO: 1377420 - DNA, 16 bp, Homo sapiens
ttcttacgcaatgctt

SEQ ID NO: 1377421 - DNA, 18 bp, Homo sapiens
ttcttactaaaaagtata

SEQ ID NO: 1377422 - DNA, 18 bp, Homo sapiens
ttcttaggggaaggagaa

SEQ ID NO: 1377423 - DNA, 18 bp, Homo sapiens
ttcttatgaggaggggag

SEQ ID NO: 1377424 - DNA, 13 bp, Homo sapiens
ttcttatgtgaca

SEQ ID NO: 1377425 - DNA, 16 bp, Homo sapiens
ttcttatgtgacatta

SEQ ID NO: 1377426 - DNA, 19 bp, Homo sapiens
ttcttatgtgacattaaca

SEQ ID NO: 1377427 - DNA, 18 bp, Homo sapiens
ttcttcagatatactgga

SEQ ID NO: 1377428 - DNA, 19 bp, Homo sapiens
ttcttctcttagattctta

SEQ ID NO: 1377429 - DNA, 20 bp, Homo sapiens
ttcttctgtgtttataaaat

SEQ ID NO: 1377430 - DNA, 22 bp, Homo sapiens
ttcttgcctctgtgctgtgtgt

SEQ ID NO: 1377431 - DNA, 21 bp, Homo sapiens
ttcttggcaataaattttgaa

SEQ ID NO: 1377432 - DNA, 22 bp, Homo sapiens
ttcttggcaataaattttgaaa

SEQ ID NO: 1377433 - DNA, 17 bp, Homo sapiens
ttcttggggcccagtgc

SEQ ID NO: 1377434 - DNA, 19 bp, Homo sapiens
ttctttcagttctttggat

SEQ ID NO: 1377435 - DNA, 14 bp, Homo sapiens
ttcttttgtttggt

SEQ ID NO: 1377436 - DNA, 15 bp, Homo sapiens
ttcttttgtttggta

SEQ ID NO: 1377437 - DNA, 14 bp, Homo sapiens
ttcttttttattaa

SEQ ID NO: 1377438 - DNA, 22 bp, Homo sapiens
ttcttttttattaatcactgtg

SEQ ID NO: 1377439 - DNA, 18 bp, Homo sapiens
ttctttttttccttttta

SEQ ID NO: 1377440 - DNA, 21 bp, Homo sapiens
ttctttttttttaagttctta

SEQ ID NO: 1377441 - DNA, 17 bp, Homo sapiens
ttgaaaaatataaaatt

SEQ ID NO: 1377442 - DNA, 19 bp, Homo sapiens
ttgaaaaatataaaattat

SEQ ID NO: 1377443 - DNA, 14 bp, Homo sapiens
ttgaaaatagttta

SEQ ID NO: 1377444 - DNA, 23 bp, Homo sapiens
ttgaaaatagtttattttaaaac

SEQ ID NO: 1377445 - DNA, 16 bp, Homo sapiens
ttgaaaatgtccagga

SEQ ID NO: 1377446 - DNA, 22 bp, Homo sapiens
ttgaaactttgggaaaacatgt

SEQ ID NO: 1377447 - DNA, 21 bp, Homo sapiens
ttgaaataagaattcagacat

SEQ ID NO: 1377448 - DNA, 23 bp, Homo sapiens
ttgaacaatgaagttgaaaatca

SEQ ID NO: 1377449 - DNA, 17 bp, Homo sapiens
ttgaaccataaaatgtc

SEQ ID NO: 1377450 - DNA, 19 bp, Homo sapiens
ttgaactcttctcattact

SEQ ID NO: 1377451 - DNA, 13 bp, Homo sapiens
ttgaacttttgta

SEQ ID NO: 1377452 - DNA, 16 bp, Homo sapiens
ttgaagaactgcaggc

SEQ ID NO: 1377453 - DNA, 23 bp, Homo sapiens
ttgaagcatagataatattgttt

SEQ ID NO: 1377454 - DNA, 15 bp, Homo sapiens
ttgaagccaaagaaa

SEQ ID NO: 1377455 - DNA, 20 bp, Homo sapiens
ttgaagccaagtggggtgct

SEQ ID NO: 1377456 - DNA, 19 bp, Homo sapiens
ttgaagtctataaaaaata

SEQ ID NO: 1377457 - DNA, 20 bp, Homo sapiens
ttgaagtctttaataaataa

SEQ ID NO: 1377458 - DNA, 17 bp, Homo sapiens
ttgaatacttgaaccat

SEQ ID NO: 1377459 - DNA, 15 bp, Homo sapiens
ttgaatatgattaaa

SEQ ID NO: 1377460 - DNA, 13 bp, Homo sapiens
ttgaatgtgtcag

SEQ ID NO: 1377461 - DNA, 23 bp, Homo sapiens
ttgaattaaattaggaataaata

SEQ ID NO: 1377462 - DNA, 23 bp, Homo sapiens
ttgaattatccacatgaaaataa

SEQ ID NO: 1377463 - DNA, 15 bp, Homo sapiens
ttgacaagctggctt

SEQ ID NO: 1377464 - DNA, 18 bp, Homo sapiens
ttgacacaagtggacctt

SEQ ID NO: 1377465 - DNA, 17 bp, Homo sapiens
ttgacactgaaagtttt

SEQ ID NO: 1377466 - DNA, 15 bp, Homo sapiens
ttgacactgaactta

SEQ ID NO: 1377467 - DNA, 13 bp, Homo sapiens
ttgacctgaggct

SEQ ID NO: 1377468 - DNA, 20 bp, Homo sapiens
ttgactaactcaaatacaca

SEQ ID NO: 1377469 - DNA, 23 bp, Homo sapiens
ttgactaactcaaatacacattt

SEQ ID NO: 1377470 - DNA, 13 bp, Homo sapiens
ttgactctgggtc

SEQ ID NO: 1377471 - DNA, 20 bp, Homo sapiens
ttgacttttataaagcatgt

SEQ ID NO: 1377472 - DNA, 21 bp, Homo sapiens
ttgacttttataaagcatgtt

SEQ ID NO: 1377473 - DNA, 21 bp, Homo sapiens
ttgagaagccttcagctccag

SEQ ID NO: 1377474 - DNA, 23 bp, Homo sapiens
ttgagaagccttcagctccaggg

SEQ ID NO: 1377475 - DNA, 16 bp, Homo sapiens
ttgagaccgtgaagat

SEQ ID NO: 1377476 - DNA, 16 bp, Homo sapiens
ttgagatcagcctggg

SEQ ID NO: 1377477 - DNA, 15 bp, Homo sapiens
ttgagccctggctgt

SEQ ID NO: 1377478 - DNA, 14 bp, Homo sapiens
ttgagcctgggagg

SEQ ID NO: 1377479 - DNA, 16 bp, Homo sapiens
ttgagctatgacttaa

SEQ ID NO: 1377480 - DNA, 12 bp, Homo sapiens
ttgagctcccac

SEQ ID NO: 1377481 - DNA, 16 bp, Homo sapiens
ttgagctgccttccct

SEQ ID NO: 1377482 - DNA, 12 bp, Homo sapiens
ttgagctggcct

SEQ ID NO: 1377483 - DNA, 11 bp, Homo sapiens
ttgagtttgtc

SEQ ID NO: 1377484 - DNA, 23 bp, Homo sapiens
ttgagtttgtcgctcatgtgtgc

SEQ ID NO: 1377485 - DNA, 15 bp, Homo sapiens
ttgatacattcaaat

SEQ ID NO: 1377486 - DNA, 18 bp, Homo sapiens
ttgatacattcaaatttg

SEQ ID NO: 1377487 - DNA, 16 bp, Homo sapiens
ttgatagggaactggg

SEQ ID NO: 1377488 - DNA, 16 bp, Homo sapiens
ttgatatctataaaat

SEQ ID NO: 1377489 - DNA, 17 bp, Homo sapiens
ttgatatctataaaata

SEQ ID NO: 1377490 - DNA, 15 bp, Homo sapiens
ttgatcatgtacttt

SEQ ID NO: 1377491 - DNA, 16 bp, Homo sapiens
ttgatggagtgtgagc

SEQ ID NO: 1377492 - DNA, 20 bp, Homo sapiens
ttgatgtggccctggctgcc

SEQ ID NO: 1377493 - DNA, 13 bp, Homo sapiens
ttgatgtgttgtt

SEQ ID NO: 1377494 - DNA, 13 bp, Homo sapiens
ttgattatttgca

SEQ ID NO: 1377495 - DNA, 14 bp, Homo sapiens
ttgattatttgcat

SEQ ID NO: 1377496 - DNA, 15 bp, Homo sapiens
ttgattatttgcatg

SEQ ID NO: 1377497 - DNA, 23 bp, Homo sapiens
ttgattattttttttttcttctt

SEQ ID NO: 1377498 - DNA, 17 bp, Homo sapiens
ttgattgggaaaacatt

SEQ ID NO: 1377499 - DNA, 16 bp, Homo sapiens
ttgatttttactgtgt

SEQ ID NO: 1377500 - DNA, 17 bp, Homo sapiens
ttgatttttactgtgtt

SEQ ID NO: 1377501 - DNA, 18 bp, Homo sapiens
ttgcaaccaggaacagca

SEQ ID NO: 1377502 - DNA, 15 bp, Homo sapiens
ttgcaagatgtgaat

SEQ ID NO: 1377503 - DNA, 20 bp, Homo sapiens
ttgcaagatgtgaattattg

SEQ ID NO: 1377504 - DNA, 16 bp, Homo sapiens
ttgcaataacagctgc

SEQ ID NO: 1377505 - DNA, 20 bp, Homo sapiens
ttgcaataacagctgcaatt

SEQ ID NO: 1377506 - DNA, 16 bp, Homo sapiens
ttgcacatgtttcctc

SEQ ID NO: 1377507 - DNA, 20 bp, Homo sapiens
ttgcaccaaattatcttgat

SEQ ID NO: 1377508 - DNA, 15 bp, Homo sapiens
ttgcaccactgcact

SEQ ID NO: 1377509 - DNA, 16 bp, Homo sapiens
ttgcaccactgcactc

SEQ ID NO: 1377510 - DNA, 18 bp, Homo sapiens
ttgcaccactgcactcca

SEQ ID NO: 1377511 - DNA, 17 bp, Homo sapiens
ttgcacttgtgattatt

SEQ ID NO: 1377512 - DNA, 16 bp, Homo sapiens
ttgcagtgagctgaga

SEQ ID NO: 1377513 - DNA, 19 bp, Homo sapiens
ttgcatattataaaggata

SEQ ID NO: 1377514 - DNA, 20 bp, Homo sapiens
ttgcatcactgtatcatttt

SEQ ID NO: 1377515 - DNA, 17 bp, Homo sapiens
ttgcatctgaaatagga

SEQ ID NO: 1377516 - DNA, 11 bp, Homo sapiens
ttgcatgcatg

SEQ ID NO: 1377517 - DNA, 13 bp, Homo sapiens
ttgcatgcatgca

SEQ ID NO: 1377518 - DNA, 16 bp, Homo sapiens
ttgcatgcatgcaaat

SEQ ID NO: 1377519 - DNA, 17 bp, Homo sapiens
ttgcatgcatgcaaatg

SEQ ID NO: 1377520 - DNA, 21 bp, Homo sapiens
ttgcatggaaatcagccaagt

SEQ ID NO: 1377521 - DNA, 23 bp, Homo sapiens
ttgcatggaaatcagccaagttt

SEQ ID NO: 1377522 - DNA, 17 bp, Homo sapiens
ttgcatgttatgtttaa

SEQ ID NO: 1377523 - DNA, 22 bp, Homo sapiens
ttgccaagctccaagccccatc

SEQ ID NO: 1377524 - DNA, 17 bp, Homo sapiens
ttgccacagtagaactg

SEQ ID NO: 1377525 - DNA, 13 bp, Homo sapiens
ttgccatgtgctt

SEQ ID NO: 1377526 - DNA, 20 bp, Homo sapiens
ttgccatgtgcttctgccac

SEQ ID NO: 1377527 - DNA, 17 bp, Homo sapiens
ttgcccatcctgactga

SEQ ID NO: 1377528 - DNA, 12 bp, Homo sapiens
ttgcctccaggt

SEQ ID NO: 1377529 - DNA, 22 bp, Homo sapiens
ttgcctccccatttcccatctg

SEQ ID NO: 1377530 - DNA, 12 bp, Homo sapiens
ttgcctctgtgc

SEQ ID NO: 1377531 - DNA, 13 bp, Homo sapiens
ttgccttaaaata

SEQ ID NO: 1377532 - DNA, 14 bp, Homo sapiens
ttgcgggacagagt

SEQ ID NO: 1377533 - DNA, 15 bp, Homo sapiens
ttgctgctgcctctt

SEQ ID NO: 1377534 - DNA, 16 bp, Homo sapiens
ttgctgcttgaggcaa

SEQ ID NO: 1377535 - DNA, 23 bp, Homo sapiens
ttgctggccccagccctgctggg

SEQ ID NO: 1377536 - DNA, 21 bp, Homo sapiens
tttgcactaaatcagagacaa

SEQ ID NO: 1377537 - DNA, 18 bp, Homo sapiens
tttgcactgaggatattc

SEQ ID NO: 1377538 - DNA, 21 bp, Homo sapiens
tttgcacttgtgattatttat

SEQ ID NO: 1377539 - DNA, 13 bp, Homo sapiens
tttgcatgcatgc

SEQ ID NO: 1377540 - DNA, 22 bp, Homo sapiens
tttgccatagagtacactgcct

SEQ ID NO: 1377541 - DNA, 14 bp, Homo sapiens
tttgccatgtgctt

SEQ ID NO: 1377542 - DNA, 20 bp, Homo sapiens
tttgccatgtgcttctgcca

SEQ ID NO: 1377543 - DNA, 20 bp, Homo sapiens
tttgctaattaactgaaaca

SEQ ID NO: 1377544 - DNA, 18 bp, Homo sapiens
tttgctcttcagatgcca

SEQ ID NO: 1377545 - DNA, 16 bp, Homo sapiens
tttgcttagaaaagaa

SEQ ID NO: 1377546 - DNA, 20 bp, Homo sapiens
tttggaaaagtggcgtggga

SEQ ID NO: 1377547 - DNA, 23 bp, Homo sapiens
tttggcatgtaaatgtaaactca

SEQ ID NO: 1377548 - DNA, 22 bp, Homo sapiens
tttggctgaaattctcctggag

SEQ ID NO: 1377549 - DNA, 23 bp, Homo sapiens
tttgggagtttttatgagaaact

SEQ ID NO: 1377550 - DNA, 23 bp, Homo sapiens
tttgggtggggggcattgagtat

SEQ ID NO: 1377551 - DNA, 22 bp, Homo sapiens
tttgtaaaaatcttttgaagca

SEQ ID NO: 1377552 - DNA, 20 bp, Homo sapiens
tttgtaaattctgatttctt

SEQ ID NO: 1377553 - DNA, 16 bp, Homo sapiens
tttgtatagttatgta

SEQ ID NO: 1377554 - DNA, 21 bp, Homo sapiens
tttgtatagttatgtaaataa

SEQ ID NO: 1377555 - DNA, 20 bp, Homo sapiens
tttgtatattggttttatga

SEQ ID NO: 1377556 - DNA, 12 bp, Homo sapiens
tttgtatgtgtg

SEQ ID NO: 1377557 - DNA, 15 bp, Homo sapiens
tttgtattgtcctat

SEQ ID NO: 1377558 - DNA, 13 bp, Homo sapiens
tttgtattttcat

SEQ ID NO: 1377559 - DNA, 16 bp, Homo sapiens
tttgtcaaactgtaga

SEQ ID NO: 1377560 - DNA, 17 bp, Homo sapiens
tttgtcaaactgtagaa

SEQ ID NO: 1377561 - DNA, 23 bp, Homo sapiens
tttgtcaaactgtagaaatgatg

SEQ ID NO: 1377562 - DNA, 12 bp, Homo sapiens
tttgtcattcag

SEQ ID NO: 1377563 - DNA, 13 bp, Homo sapiens
tttgtcccttcta

SEQ ID NO: 1377564 - DNA, 14 bp, Homo sapiens
tttgtcttaaaaag

SEQ ID NO: 1377565 - DNA, 23 bp, Homo sapiens
tttgtcttaaaaagtggaaaaat

SEQ ID NO: 1377566 - DNA, 15 bp, Homo sapiens
tttgtgcaaagccaa

SEQ ID NO: 1377567 - DNA, 13 bp, Homo sapiens
tttgtgccagagg

SEQ ID NO: 1377568 - DNA, 21 bp, Homo sapiens
tttgtgtaactcccagtgatg

SEQ ID NO: 1377569 - DNA, 13 bp, Homo sapiens
tttgttcccggct

SEQ ID NO: 1377570 - DNA, 12 bp, Homo sapiens
tttgttgtaaaa

SEQ ID NO: 1377571 - DNA, 15 bp, Homo sapiens
tttgttgtcagctga

SEQ ID NO: 1377572 - DNA, 18 bp, Homo sapiens
tttgtttttatttaaatt

SEQ ID NO: 1377573 - DNA, 15 bp, Homo sapiens
tttgtttttctgctt

SEQ ID NO: 1377574 - DNA, 18 bp, Homo sapiens
tttgttttttgtttttct

SEQ ID NO: 1377575 - DNA, 17 bp, Homo sapiens
ttttaaaaaatggtcac

SEQ ID NO: 1377576 - DNA, 20 bp, Homo sapiens
ttttaaaaacataacataaa

SEQ ID NO: 1377577 - DNA, 20 bp, Homo sapiens
ttttaaaacacatgttttta

SEQ ID NO: 1377578 - DNA, 18 bp, Homo sapiens
ttttaaaatagaaatttt

SEQ ID NO: 1377579 - DNA, 21 bp, Homo sapiens
ttttaaaatctgagggaaatg

SEQ ID NO: 1377580 - DNA, 11 bp, Homo sapiens
ttttaaagaaa

SEQ ID NO: 1377581 - DNA, 18 bp, Homo sapiens
ttttaaagaaaagatgaa

SEQ ID NO: 1377582 - DNA, 11 bp, Homo sapiens
ttttaaagaat

SEQ ID NO: 1377583 - DNA, 23 bp, Homo sapiens
ttttaaagaccctcctattctat

SEQ ID NO: 1377584 - DNA, 15 bp, Homo sapiens
ttttaaatattttct

SEQ ID NO: 1377585 - DNA, 21 bp, Homo sapiens
ttttaaatctaaatctattta

SEQ ID NO: 1377586 - DNA, 14 bp, Homo sapiens
ttttaagatagtgt

SEQ ID NO: 1377587 - DNA, 23 bp, Homo sapiens
ttttaagatagtgtaacttgctt

SEQ ID NO: 1377588 - DNA, 19 bp, Homo sapiens
ttttaaggactgactgagg

SEQ ID NO: 1377589 - DNA, 18 bp, Homo sapiens
ttttaaggtctttcagta

SEQ ID NO: 1377590 - DNA, 23 bp, Homo sapiens
ttttaaggtctttcagtactttt

SEQ ID NO: 1377591 - DNA, 17 bp, Homo sapiens
ttttaatgatgacaaaa

SEQ ID NO: 1377592 - DNA, 20 bp, Homo sapiens
ttttaatgctatttgaacaa

SEQ ID NO: 1377593 - DNA, 22 bp, Homo sapiens
ttttaattgtatttttgttgtt

SEQ ID NO: 1377594 - DNA, 12 bp, Homo sapiens
ttttaattttta

SEQ ID NO: 1377595 - DNA, 18 bp, Homo sapiens
ttttacacagaaacactg

SEQ ID NO: 1377596 - DNA, 19 bp, Homo sapiens
ttttacctagctaattatt

SEQ ID NO: 1377597 - DNA, 17 bp, Homo sapiens
ttttactggttgcatgg

SEQ ID NO: 1377598 - DNA, 13 bp, Homo sapiens
ttttagaataaga

SEQ ID NO: 1377599 - DNA, 21 bp, Homo sapiens
ttttagaataagaatttgcat

SEQ ID NO: 1377600 - DNA, 21 bp, Homo sapiens
ttttagaccctattgctgctt

SEQ ID NO: 1377601 - DNA, 20 bp, Homo sapiens
ttttagtatttatttatgta

SEQ ID NO: 1377602 - DNA, 22 bp, Homo sapiens
ttttataaaatggctgtaatca

SEQ ID NO: 1377603 - DNA, 15 bp, Homo sapiens
ttttataaagcatgt

SEQ ID NO: 1377604 - DNA, 16 bp, Homo sapiens
ttttataattgtacaa

SEQ ID NO: 1377605 - DNA, 20 bp, Homo sapiens
ttttatagcctggactgcta

SEQ ID NO: 1377606 - DNA, 13 bp, Homo sapiens
ttttatatgcttt

SEQ ID NO: 1377607 - DNA, 22 bp, Homo sapiens
ttttatatttcctttatgtgaa

SEQ ID NO: 1377608 - DNA, 15 bp, Homo sapiens
ttttatctgtttcct

SEQ ID NO: 1377609 - DNA, 13 bp, Homo sapiens
ttttatgatgacg

SEQ ID NO: 1377610 - DNA, 15 bp, Homo sapiens
ttttatggttatgtt

SEQ ID NO: 1377611 - DNA, 18 bp, Homo sapiens
ttttatgtgagagaaagt

SEQ ID NO: 1377612 - DNA, 14 bp, Homo sapiens
ttttattaaaacat

SEQ ID NO: 1377613 - DNA, 13 bp, Homo sapiens
ttttattaatcac

SEQ ID NO: 1377614 - DNA, 14 bp, Homo sapiens
ttttattaatcact

SEQ ID NO: 1377615 - DNA, 18 bp, Homo sapiens
ttttattaatcactgtgt

SEQ ID NO: 1377616 - DNA, 20 bp, Homo sapiens
ttttattaatcactgtgtat

SEQ ID NO: 1377617 - DNA, 14 bp, Homo sapiens
ttttattaatgcac

SEQ ID NO: 1377618 - DNA, 13 bp, Homo sapiens
ttttcaagttgta

SEQ ID NO: 1377619 - DNA, 22 bp, Homo sapiens
ttttcaatatattgaacttttg

SEQ ID NO: 1377620 - DNA, 23 bp, Homo sapiens
ttttcaccattcgtacataatac

SEQ ID NO: 1377621 - DNA, 18 bp, Homo sapiens
ttttcagaaaaagaaatg

SEQ ID NO: 1377622 - DNA, 20 bp, Homo sapiens
ttttcatagtatccatattt

SEQ ID NO: 1377623 - DNA, 13 bp, Homo sapiens
ttttcatgaaaat

SEQ ID NO: 1377624 - DNA, 17 bp, Homo sapiens
ttttcattcctaaagaa

SEQ ID NO: 1377625 - DNA, 20 bp, Homo sapiens
ttttcctggaattgccagct

SEQ ID NO: 1377626 - DNA, 16 bp, Homo sapiens
ttttctacgtttcttt

SEQ ID NO: 1377627 - DNA, 15 bp, Homo sapiens
ttttctagaattatt

SEQ ID NO: 1377628 - DNA, 22 bp, Homo sapiens
ttttctagaattatttttcact

SEQ ID NO: 1377629 - DNA, 19 bp, Homo sapiens
ttttctattatggaaaact

SEQ ID NO: 1377630 - DNA, 23 bp, Homo sapiens
ttttctattatggaaaactgtgt

SEQ ID NO: 1377631 - DNA, 18 bp, Homo sapiens
ttttctctgtacttttca

SEQ ID NO: 1377632 - DNA, 15 bp, Homo sapiens
ttttctgccctggct

SEQ ID NO: 1377633 - DNA, 16 bp, Homo sapiens
ttttctgccctggctg

SEQ ID NO: 1377634 - DNA, 14 bp, Homo sapiens
ttttctgtttctgt

SEQ ID NO: 1377635 - DNA, 22 bp, Homo sapiens
ttttctttttttttaagttctt

SEQ ID NO: 1377636 - DNA, 20 bp, Homo sapiens
ttttgaaaagtaatatttat

SEQ ID NO: 1377637 - DNA, 13 bp, Homo sapiens
ttttgaagcatag

SEQ ID NO: 1377638 - DNA, 13 bp, Homo sapiens
ttttgaatcaata

SEQ ID NO: 1377639 - DNA, 12 bp, Homo sapiens
ttttgacactga

SEQ ID NO: 1377640 - DNA, 14 bp, Homo sapiens
ttttgacactgaaa

SEQ ID NO: 1377641 - DNA, 18 bp, Homo sapiens
ttttgacactgaaagttt

SEQ ID NO: 1377642 - DNA, 15 bp, Homo sapiens
ttttgagacagtctt

SEQ ID NO: 1377643 - DNA, 14 bp, Homo sapiens
ttttgagatgtaaa

SEQ ID NO: 1377644 - DNA, 21 bp, Homo sapiens
ttttgcactgaggatattcag

SEQ ID NO: 1377645 - DNA, 19 bp, Homo sapiens
ttttgcatgcatgcaaatg

SEQ ID NO: 1377646 - DNA, 21 bp, Homo sapiens
ttttgcatgcatgcaaatgag

SEQ ID NO: 1377647 - DNA, 12 bp, Homo sapiens
ttttgtaaaaga

SEQ ID NO: 1377648 - DNA, 15 bp, Homo sapiens
ttttgtaaacattta

SEQ ID NO: 1377649 - DNA, 17 bp, Homo sapiens
ttttgtaaacatttatt

SEQ ID NO: 1377650 - DNA, 11 bp, Homo sapiens
ttttgtaagaa

SEQ ID NO: 1377651 - DNA, 16 bp, Homo sapiens
ttttgtaataagcaat

SEQ ID NO: 1377652 - DNA, 14 bp, Homo sapiens
ttttgtatgtgtgt

SEQ ID NO: 1377653 - DNA, 17 bp, Homo sapiens
ttttgtatgttaaagag

SEQ ID NO: 1377654 - DNA, 14 bp, Homo sapiens
gcctgacaattatg

SEQ ID NO: 1377655 - DNA, 22 bp, Homo sapiens
gcctgacaattatgaaaaaatg

SEQ ID NO: 1377656 - DNA, 16 bp, Homo sapiens
gctgatggagaaggaa

SEQ ID NO: 1377657 - DNA, 19 bp, Homo sapiens
gctggaataagaggacact

SEQ ID NO: 1377658 - DNA, 20 bp, Homo sapiens
gctgtgtacaacaatgcttt

SEQ ID NO: 1377659 - DNA, 17 bp, Homo sapiens
gcttgagcccaggagtt

SEQ ID NO: 1377660 - DNA, 20 bp, Homo sapiens
gctttaaacatgattatctt

SEQ ID NO: 1377661 - DNA, 15 bp, Homo sapiens
gctttggttatgaaa

SEQ ID NO: 1377662 - DNA, 17 bp, Homo sapiens
gcttttatgtgatatgt

SEQ ID NO: 1377663 - DNA, 21 bp, Homo sapiens
tgctgtgtacaacaatgcttt

SEQ ID NO: 1377664 - DNA, 15 bp, Homo sapiens
tgctttgataaaata

SEQ ID NO: 1377665 - DNA, 17 bp, Homo sapiens
tggacaaatgcatttag

SEQ ID NO: 1377666 - DNA, 13 bp, Homo sapiens
tggagaaggaagg

SEQ ID NO: 1377667 - DNA, 13 bp, Homo sapiens
tggtggtagaaat

SEQ ID NO: 1377668 - DNA, 12 bp, Homo sapiens
tggttatgaaac

SEQ ID NO: 1377669 - DNA, 16 bp, Homo sapiens
tgtacaacaatgcttt

SEQ ID NO: 1377670 - DNA, 19 bp, Homo sapiens
tgtagcttttatgtgatat

SEQ ID NO: 1377671 - DNA, 20 bp, Homo sapiens
tgtcattgttaaatacacat

SEQ ID NO: 1377672 - DNA, 16 bp, Homo sapiens
tgtgaatcttaacatt

SEQ ID NO: 1377673 - DNA, 13 bp, Homo sapiens
tgtgatatgtttt

SEQ ID NO: 1377674 - DNA, 18 bp, Homo sapiens
tgtgatcatatatcataa

SEQ ID NO: 1377675 - DNA, 22 bp, Homo sapiens
tgtgtacaacaatgctttgata

SEQ ID NO: 1377676 - DNA, 19 bp, Homo sapiens
tgttaaatacacattatca

SEQ ID NO: 1377677 - DNA, 13 bp, Homo sapiens
tgttcaaattcac

SEQ ID NO: 1377678 - DNA, 22 bp, Homo sapiens
attttcaaaggaaaacaccttt

SEQ ID NO: 1377679 - DNA, 19 bp, Homo sapiens
attttcccttcatgtttta

SEQ ID NO: 1377680 - DNA, 15 bp, Homo sapiens
atttttataaaactg

SEQ ID NO: 1377681 - DNA, 18 bp, Homo sapiens
atttttatttcattcaca

SEQ ID NO: 1377682 - DNA, 19 bp, Homo sapiens
atttttatttcattcacat

SEQ ID NO: 1377683 - DNA, 12 bp, Homo sapiens
attttttttcaa

SEQ ID NO: 1377684 - DNA, 13 bp, Homo sapiens
attttttttcaaa

SEQ ID NO: 1377685 - DNA, 14 bp, Homo sapiens
attttttttcaaaa

SEQ ID NO: 1377686 - DNA, 17 bp, Homo sapiens
attttttttcaaaatga

SEQ ID NO: 1377687 - DNA, 19 bp, Homo sapiens
caaaatgaagatacacatt

SEQ ID NO: 1377688 - DNA, 20 bp, Homo sapiens
caaagaaggaggatggcttg

SEQ ID NO: 1377689 - DNA, 16 bp, Homo sapiens
caaatattaagaaaat

SEQ ID NO: 1377690 - DNA, 18 bp, Homo sapiens
caaatgattatgattagt

SEQ ID NO: 1377691 - DNA, 24 bp, Homo sapiens
caaatgattatgattagttatgtc

SEQ ID NO: 1377692 - DNA, 13 bp, Homo sapiens
caacaatgctttg

SEQ ID NO: 1377693 - DNA, 20 bp, Homo sapiens
caacaatgctttgataaaat

SEQ ID NO: 1377694 - DNA, 21 bp, Homo sapiens
caacaatgctttgataaaata

SEQ ID NO: 1377695 - DNA, 14 bp, Homo sapiens
caagaccagcctgg

SEQ ID NO: 1377696 - DNA, 15 bp, Homo sapiens
caagaccagcctgga

SEQ ID NO: 1377697 - DNA, 20 bp, Homo sapiens
caatgctttgataaaatatt

SEQ ID NO: 1377698 - DNA, 21 bp, Homo sapiens
caatgttgttcaccagtgctt

SEQ ID NO: 1377699 - DNA, 22 bp, Homo sapiens
caatgttgttcaccagtgcttg

SEQ ID NO: 1377700 - DNA, 20 bp, Homo sapiens
caattatgaaaaaatgttca

SEQ ID NO: 1377701 - DNA, 14 bp, Homo sapiens
cacctttattttat

SEQ ID NO: 1377702 - DNA, 23 bp, Homo sapiens
cactaaaggtggttttattttcc

SEQ ID NO: 1377703 - DNA, 20 bp, Homo sapiens
cagaaggaaggcagggagga

SEQ ID NO: 1377704 - DNA, 22 bp, Homo sapiens
cagaaggaaggcagggaggagg

SEQ ID NO: 1377705 - DNA, 22 bp, Homo sapiens
cagactctgctagtgaaaagaa

SEQ ID NO: 1377706 - DNA, 13 bp, Homo sapiens
cagagaagaaaga

SEQ ID NO: 1377707 - DNA, 18 bp, Homo sapiens
cagagaagaaagaacgga

SEQ ID NO: 1377708 - DNA, 21 bp, Homo sapiens
cagagctgatggagaaggaag

SEQ ID NO: 1377709 - DNA, 22 bp, Homo sapiens
cagagctgatggagaaggaagg

SEQ ID NO: 1377710 - DNA, 17 bp, Homo sapiens
cagatgaaaaaaactaa

SEQ ID NO: 1377711 - DNA, 22 bp, Homo sapiens
cagctctatgtcaattgatatt

SEQ ID NO: 1377712 - DNA, 20 bp, Homo sapiens
cagcttgacattatgtttta

SEQ ID NO: 1377713 - DNA, 15 bp, Homo sapiens
cagttcaaagcagga

SEQ ID NO: 1377714 - DNA, 16 bp, Homo sapiens
cataaaggatatttca

SEQ ID NO: 1377715 - DNA, 16 bp, Homo sapiens
catctggattccagag

SEQ ID NO: 1377716 - DNA, 22 bp, Homo sapiens
catgaatgttcatatagccagg

SEQ ID NO: 1377717 - DNA, 18 bp, Homo sapiens
catgttttaacttattgt

SEQ ID NO: 1377718 - DNA, 23 bp, Homo sapiens
cattaatgagaagagttttctca

SEQ ID NO: 1377719 - DNA, 24 bp, Homo sapiens
cattaatgagaagagttttctcag

SEQ ID NO: 1377720 - DNA, 13 bp, Homo sapiens
cattacagccagg

SEQ ID NO: 1377721 - DNA, 17 bp, Homo sapiens
catttgataattttgaa

SEQ ID NO: 1377722 - DNA, 14 bp, Homo sapiens
cccttcatgtttta

SEQ ID NO: 1377723 - DNA, 22 bp, Homo sapiens
cctaaggaaactgctttatttt

SEQ ID NO: 1377724 - DNA, 15 bp, Homo sapiens
cctggacagcttagt

SEQ ID NO: 1377725 - DNA, 16 bp, Homo sapiens
ccttcatgttttaact

SEQ ID NO: 1377726 - DNA, 13 bp, Homo sapiens
cctttattttatt

SEQ ID NO: 1377727 - DNA, 16 bp, Homo sapiens
cctttattttattttt

SEQ ID NO: 1377728 - DNA, 16 bp, Homo sapiens
cctttttgcttatttt

SEQ ID NO: 1377729 - DNA, 17 bp, Homo sapiens
cctttttgcttatttta

SEQ ID NO: 1377730 - DNA, 16 bp, Homo sapiens
cgttctagtgaaactg

SEQ ID NO: 1377731 - DNA, 22 bp, Homo sapiens
cgttctagtgaaactgcattat

SEQ ID NO: 1377732 - DNA, 19 bp, Homo sapiens
ctaaaggtggttttatttt

SEQ ID NO: 1377733 - DNA, 21 bp, Homo sapiens
ctaaaggtggttttattttcc

SEQ ID NO: 1377734 - DNA, 18 bp, Homo sapiens
ctaacatttgataatttt

SEQ ID NO: 1377735 - DNA, 21 bp, Homo sapiens
ctaaggtgactcgagtgttta

SEQ ID NO: 1377736 - DNA, 20 bp, Homo sapiens
ctaattggcagattgttttt

SEQ ID NO: 1377737 - DNA, 20 bp, Homo sapiens
ctaggcagttcaaagcagga

SEQ ID NO: 1377738 - DNA, 20 bp, Homo sapiens
ctatatttttatttcattca

SEQ ID NO: 1377739 - DNA, 14 bp, Homo sapiens
ctatgtcaattgat

SEQ ID NO: 1377740 - DNA, 22 bp, Homo sapiens
ctatgtcaattgatatttctgt

SEQ ID NO: 1377741 - DNA, 16 bp, Homo sapiens
ctccaccgcagaagga

SEQ ID NO: 1377742 - DNA, 17 bp, Homo sapiens
ctccaccgcagaaggaa

SEQ ID NO: 1377743 - DNA, 18 bp, Homo sapiens
ctccaccgcagaaggaag

SEQ ID NO: 1377744 - DNA, 20 bp, Homo sapiens
ctcgagtgtttaaatgctgt

SEQ ID NO: 1377745 - DNA, 13 bp, Homo sapiens
ctctatattttta

SEQ ID NO: 1377746 - DNA, 22 bp, Homo sapiens
ctctatgtcaattgatatttct

SEQ ID NO: 1377747 - DNA, 20 bp, Homo sapiens
ctctatgtccggctttaact

SEQ ID NO: 1377748 - DNA, 15 bp, Homo sapiens
ctctgctagtgaaaa

SEQ ID NO: 1377749 - DNA, 15 bp, Homo sapiens
ctgacaattatgaaa

SEQ ID NO: 1377750 - DNA, 18 bp, Homo sapiens
ctgaccctccaccgcaga

SEQ ID NO: 1377751 - DNA, 19 bp, Homo sapiens
ctgtgtacaacaatgcttt

SEQ ID NO: 1377752 - DNA, 13 bp, Homo sapiens
ctgtgtagtattt

SEQ ID NO: 1377753 - DNA, 13 bp, Homo sapiens
cttattttacaaa

SEQ ID NO: 1377754 - DNA, 17 bp, Homo sapiens
cttattttacaaatatt

SEQ ID NO: 1377755 - DNA, 12 bp, Homo sapiens
cttcatgtttta

SEQ ID NO: 1377756 - DNA, 13 bp, Homo sapiens
cttcatgttttaa

SEQ ID NO: 1377757 - DNA, 17 bp, Homo sapiens
cttcgggtgtgatcata

SEQ ID NO: 1377758 - DNA, 14 bp, Homo sapiens
cttcttctatatcc

SEQ ID NO: 1377759 - DNA, 18 bp, Homo sapiens
cttcttctatatccaaaa

SEQ ID NO: 1377760 - DNA, 16 bp, Homo sapiens
cttgacattatgtttt

SEQ ID NO: 1377761 - DNA, 13 bp, Homo sapiens
cttgatttcccaa

SEQ ID NO: 1377762 - DNA, 15 bp, Homo sapiens
cttgatttcccaaaa

SEQ ID NO: 1377763 - DNA, 20 bp, Homo sapiens
cttgatttcccaaaaacact

SEQ ID NO: 1377764 - DNA, 22 bp, Homo sapiens
cttgcttgtgaatcttaacatt

SEQ ID NO: 1377765 - DNA, 21 bp, Homo sapiens
cttgtgaatcttaacattttg

SEQ ID NO: 1377766 - DNA, 20 bp, Homo sapiens
ctttaaacatgattatcttg

SEQ ID NO: 1377767 - DNA, 21 bp, Homo sapiens
ctttattttattttttttcaa

SEQ ID NO: 1377768 - DNA, 16 bp, Homo sapiens
cttttaataaaaagga

SEQ ID NO: 1377769 - DNA, 18 bp, Homo sapiens
gaaaatattctaacattt

SEQ ID NO: 1377770 - DNA, 14 bp, Homo sapiens
gaaactgcattatt

SEQ ID NO: 1377771 - DNA, 13 bp, Homo sapiens
gaaactgctttat

SEQ ID NO: 1377772 - DNA, 19 bp, Homo sapiens
gaaactgctttatttttat

SEQ ID NO: 1377773 - DNA, 14 bp, Homo sapiens
gaaatatttttcaa

SEQ ID NO: 1377774 - DNA, 15 bp, Homo sapiens
gaaatatttttcaac

SEQ ID NO: 1377775 - DNA, 15 bp, Homo sapiens
gaaatgattcatctt

SEQ ID NO: 1377776 - DNA, 18 bp, Homo sapiens
gaaatgattcatctttca

SEQ ID NO: 1377777 - DNA, 16 bp, Homo sapiens
gaagaaagaacggaag

SEQ ID NO: 1377778 - DNA, 14 bp, Homo sapiens
gaagagaaggagca

SEQ ID NO: 1377779 - DNA, 16 bp, Homo sapiens
gaagagatcaggaaga

SEQ ID NO: 1377780 - DNA, 17 bp, Homo sapiens
gaagagatcaggaagag

SEQ ID NO: 1377781 - DNA, 20 bp, Homo sapiens
gaagtttattattttcaaag

SEQ ID NO: 1377782 - DNA, 13 bp, Homo sapiens
gacagcttagtga

SEQ ID NO: 1377783 - DNA, 13 bp, Homo sapiens
gacattatgtttt

SEQ ID NO: 1377784 - DNA, 14 bp, Homo sapiens
gacattatgtttta

SEQ ID NO: 1377785 - DNA, 20 bp, Homo sapiens
gacattatgttttatttaaa

SEQ ID NO: 1377786 - DNA, 23 bp, Homo sapiens
gacattatgttttatttaaatgc

SEQ ID NO: 1377787 - DNA, 19 bp, Homo sapiens
gaccctccaccgcagaagg

SEQ ID NO: 1377788 - DNA, 21 bp, Homo sapiens
gaccctccaccgcagaaggaa

SEQ ID NO: 1377789 - DNA, 16 bp, Homo sapiens
gactcgagtgtttaaa

SEQ ID NO: 1377790 - DNA, 20 bp, Homo sapiens
gactcgagtgtttaaatgct

SEQ ID NO: 1377791 - DNA, 16 bp, Homo sapiens
gagaagaaagaacgga

SEQ ID NO: 1377792 - DNA, 16 bp, Homo sapiens
gagattaaaaaaggta

SEQ ID NO: 1377793 - DNA, 18 bp, Homo sapiens
gagctgatggagaaggaa

SEQ ID NO: 1377794 - DNA, 19 bp, Homo sapiens
gagctgatggagaaggaag

SEQ ID NO: 1377795 - DNA, 16 bp, Homo sapiens
gaggaggcagagaaga

SEQ ID NO: 1377796 - DNA, 20 bp, Homo sapiens
gaggaggcagagaagaaaga

SEQ ID NO: 1377797 - DNA, 16 bp, Homo sapiens
gaggatggcttgagcc

SEQ ID NO: 1377798 - DNA, 18 bp, Homo sapiens
agtccatgaatgttcata

SEQ ID NO: 1377799 - DNA, 21 bp, Homo sapiens
agtccctttggacaaatgcat

SEQ ID NO: 1377800 - DNA, 19 bp, Homo sapiens
agtgaaactgcattatttg

SEQ ID NO: 1377801 - DNA, 19 bp, Homo sapiens
agttaaaactggatggaaa

SEQ ID NO: 1377802 - DNA, 17 bp, Homo sapiens
agtttattattttcaaa

SEQ ID NO: 1377803 - DNA, 22 bp, Homo sapiens
ataaaactgcctgacaattatg

SEQ ID NO: 1377804 - DNA, 15 bp, Homo sapiens
ataaaatattttaag

SEQ ID NO: 1377805 - DNA, 19 bp, Homo sapiens
ataagtccatgaatgttca

SEQ ID NO: 1377806 - DNA, 20 bp, Homo sapiens
ataagtccatgaatgttcat

SEQ ID NO: 1377807 - DNA, 23 bp, Homo sapiens
ataagtccatgaatgttcatata

SEQ ID NO: 1377808 - DNA, 22 bp, Homo sapiens
atatatcataaaggatatttca

SEQ ID NO: 1377809 - DNA, 19 bp, Homo sapiens
atattaagaaaatattcta

SEQ ID NO: 1377810 - DNA, 22 bp, Homo sapiens
atattaagaaaatattctaaca

SEQ ID NO: 1377811 - DNA, 13 bp, Homo sapiens
atatttaaattat

SEQ ID NO: 1377812 - DNA, 21 bp, Homo sapiens
atatttctgtgtagtatttat

SEQ ID NO: 1377813 - DNA, 13 bp, Homo sapiens
atatttttatttc

SEQ ID NO: 1377814 - DNA, 16 bp, Homo sapiens
atatttttatttcatt

SEQ ID NO: 1377815 - DNA, 23 bp, Homo sapiens
atatttttatttcattcacatta

SEQ ID NO: 1377816 - DNA, 21 bp, Homo sapiens
atcacagactctgctagtgaa

SEQ ID NO: 1377817 - DNA, 22 bp, Homo sapiens
atcactgaaaaaatgtagcttt

SEQ ID NO: 1377818 - DNA, 14 bp, Homo sapiens
atcataaaggatat

SEQ ID NO: 1377819 - DNA, 20 bp, Homo sapiens
atcataaaggatatttcaaa

SEQ ID NO: 1377820 - DNA, 21 bp, Homo sapiens
atcataaaggatatttcaaat

SEQ ID NO: 1377821 - DNA, 16 bp, Homo sapiens
atcatatatcataaag

SEQ ID NO: 1377822 - DNA, 23 bp, Homo sapiens
atcttgatttcccaaaaacacta

SEQ ID NO: 1377823 - DNA, 14 bp, Homo sapiens
atctttcagaaata

SEQ ID NO: 1377824 - DNA, 18 bp, Homo sapiens
ctcgagtgtttaaatgct

SEQ ID NO: 1377825 - DNA, 19 bp, Homo sapiens
ctcgagtgtttaaatgctg

SEQ ID NO: 1377826 - DNA, 19 bp, Homo sapiens
ctctatgtcaattgatatt

SEQ ID NO: 1377827 - DNA, 18 bp, Homo sapiens
ctctatgtccggctttaa

SEQ ID NO: 1377828 - DNA, 16 bp, Homo sapiens
ctgacaattatgaaaa

SEQ ID NO: 1377829 - DNA, 23 bp, Homo sapiens
ctgaccctccaccgcagaaggaa

SEQ ID NO: 1377830 - DNA, 15 bp, Homo sapiens
ctgatggagaaggaa

SEQ ID NO: 1377831 - DNA, 17 bp, Homo sapiens
ctgatggagaaggaagg

SEQ ID NO: 1377832 - DNA, 19 bp, Homo sapiens
ctgcctgacaattatgaaa

SEQ ID NO: 1377833 - DNA, 20 bp, Homo sapiens
ctgcctgacaattatgaaaa

SEQ ID NO: 1377834 - DNA, 13 bp, Homo sapiens
ctggattccagag

SEQ ID NO: 1377835 - DNA, 21 bp, Homo sapiens
ctggattccagagcactgctc

SEQ ID NO: 1377836 - DNA, 21 bp, Homo sapiens
ctgtgtagtatttatatttaa

SEQ ID NO: 1377837 - DNA, 19 bp, Homo sapiens
cttattgttgctgaaaact

SEQ ID NO: 1377838 - DNA, 14 bp, Homo sapiens
cttcgggtgtgatc

SEQ ID NO: 1377839 - DNA, 14 bp, Homo sapiens
cttctctatatttt

SEQ ID NO: 1377840 - DNA, 12 bp, Homo sapiens
cttgagcccagg

SEQ ID NO: 1377841 - DNA, 14 bp, Homo sapiens
cttgcttgtgaatc

SEQ ID NO: 1377842 - DNA, 19 bp, Homo sapiens
cttgtgaatcttaacattt

SEQ ID NO: 1377843 - DNA, 14 bp, Homo sapiens
ctttaaacatgatt

SEQ ID NO: 1377844 - DNA, 16 bp, Homo sapiens
ctttaaacatgattat

SEQ ID NO: 1377845 - DNA, 23 bp, Homo sapiens
ctttattttattttttttcaaaa

SEQ ID NO: 1377846 - DNA, 15 bp, Homo sapiens
ctttcagaaataaaa

SEQ ID NO: 1377847 - DNA, 14 bp, Homo sapiens
ctttgataaaatat

SEQ ID NO: 1377848 - DNA, 18 bp, Homo sapiens
ctttgataaaatatttta

SEQ ID NO: 1377849 - DNA, 14 bp, Homo sapiens
ctttggttatgaaa

SEQ ID NO: 1377850 - DNA, 19 bp, Homo sapiens
cttttatgtgatatgtttt

SEQ ID NO: 1377851 - DNA, 21 bp, Homo sapiens
cttttatgtgatatgttttaa

SEQ ID NO: 1377852 - DNA, 15 bp, Homo sapiens
gaaaacacctttatt

SEQ ID NO: 1377853 - DNA, 23 bp, Homo sapiens
gaaaactctatgtccggctttaa

SEQ ID NO: 1377854 - DNA, 13 bp, Homo sapiens
gaaaatattctaa

SEQ ID NO: 1377855 - DNA, 22 bp, Homo sapiens
gaaacatgtggagtgtattaag

SEQ ID NO: 1377856 - DNA, 15 bp, Homo sapiens
gaaactgctttattt

SEQ ID NO: 1377857 - DNA, 16 bp, Homo sapiens
gaaagaacggaagaag

SEQ ID NO: 1377858 - DNA, 17 bp, Homo sapiens
gaaataaaagtatgaat

SEQ ID NO: 1377859 - DNA, 13 bp, Homo sapiens
gaaatatttttca

SEQ ID NO: 1377860 - DNA, 20 bp, Homo sapiens
gaagaaagaacggaagaaga

SEQ ID NO: 1377861 - DNA, 15 bp, Homo sapiens
gaagagaaggagcag

SEQ ID NO: 1377862 - DNA, 23 bp, Homo sapiens
gaagctttggttatgaaacatgt

SEQ ID NO: 1377863 - DNA, 18 bp, Homo sapiens
gaaggaaggcagggagga

SEQ ID NO: 1377864 - DNA, 19 bp, Homo sapiens
gaaggaaggcagggaggag

SEQ ID NO: 1377865 - DNA, 22 bp, Homo sapiens
gaaggaaggctccatctccagt

SEQ ID NO: 1377866 - DNA, 17 bp, Homo sapiens
gaaggcagggaggaggc

SEQ ID NO: 1377867 - DNA, 18 bp, Homo sapiens
gaaggcagggaggaggca

SEQ ID NO: 1377868 - DNA, 19 bp, Homo sapiens
gacaattatgaaaaaatgt

SEQ ID NO: 1377869 - DNA, 22 bp, Homo sapiens
gacattatgttttatttaaatg

SEQ ID NO: 1377870 - DNA, 13 bp, Homo sapiens
gagcactgctcca

SEQ ID NO: 1377871 - DNA, 20 bp, Homo sapiens
gagcagagctgatggagaag

SEQ ID NO: 1377872 - DNA, 16 bp, Homo sapiens
gagctgatggagaagg

SEQ ID NO: 1377873 - DNA, 16 bp, Homo sapiens
gaggacactagatgat

SEQ ID NO: 1377874 - DNA, 18 bp, Homo sapiens
gaggcagagaagaaagaa

SEQ ID NO: 1377875 - DNA, 12 bp, Homo sapiens
gatcaggaagag

SEQ ID NO: 1377876 - DNA, 15 bp, Homo sapiens
gatcaggaagagaag

SEQ ID NO: 1377877 - DNA, 15 bp, Homo sapiens
gattagttatgtctt

SEQ ID NO: 1377878 - DNA, 13 bp, Homo sapiens
gcacaataatttg

SEQ ID NO: 1377879 - DNA, 13 bp, Homo sapiens
gcagaaggaaggc

SEQ ID NO: 1377880 - DNA, 19 bp, Homo sapiens
gcagagctgatggagaagg

SEQ ID NO: 1377881 - DNA, 23 bp, Homo sapiens
gcagagctgatggagaaggaagg

SEQ ID NO: 1377882 - DNA, 16 bp, Homo sapiens
gctctatgtcaattga

SEQ ID NO: 1377883 - DNA, 17 bp, Homo sapiens
gcttgacattatgtttt

SEQ ID NO: 1377884 - DNA, 15 bp, Homo sapiens
gctttaaacatgatt

SEQ ID NO: 1377885 - DNA, 12 bp, Homo sapiens
gctttattttta

SEQ ID NO: 1377886 - DNA, 20 bp, Homo sapiens
gctttatttttataaaactg

SEQ ID NO: 1377887 - DNA, 16 bp, Homo sapiens
gctttgataaaatatt

SEQ ID NO: 1377888 - DNA, 16 bp, Homo sapiens
gctttggttatgaaac

SEQ ID NO: 1377889 - DNA, 20 bp, Homo sapiens
gctttggttatgaaacatgt

SEQ ID NO: 1377890 - DNA, 19 bp, Homo sapiens
gcttttatgtgatatgttt

SEQ ID NO: 1377891 - DNA, 20 bp, Homo sapiens
gcttttatgtgatatgtttt

SEQ ID NO: 1377892 - DNA, 12 bp, Homo sapiens
ggaagagaagga

SEQ ID NO: 1377893 - DNA, 17 bp, Homo sapiens
ggaaggcagggaggagg

SEQ ID NO: 1377894 - DNA, 12 bp, Homo sapiens
ggagaaggaagg

SEQ ID NO: 1377895 - DNA, 22 bp, Homo sapiens
ggattgaagtttattattttca

SEQ ID NO: 1377896 - DNA, 17 bp, Homo sapiens
ggcagattgttttttcc

SEQ ID NO: 1377897 - DNA, 15 bp, Homo sapiens
ggtagaaatgattca

SEQ ID NO: 1377898 - DNA, 15 bp, Homo sapiens
ggtagtttttctgtc

SEQ ID NO: 1377899 - DNA, 19 bp, Homo sapiens
ggtgactcgagtgtttaaa

SEQ ID NO: 1377900 - DNA, 20 bp, Homo sapiens
ggtgactcgagtgtttaaat

SEQ ID NO: 1377901 - DNA, 11 bp, Homo sapiens
ggttatgaaac

SEQ ID NO: 1377902 - DNA, 17 bp, Homo sapiens
gtagtatttatatttaa

SEQ ID NO: 1377903 - DNA, 22 bp, Homo sapiens
gtatttatatttaaattatatt

SEQ ID NO: 1377904 - DNA, 15 bp, Homo sapiens
gtgaatcttaacatt

SEQ ID NO: 1377905 - DNA, 17 bp, Homo sapiens
gtgactcgagtgtttaa

SEQ ID NO: 1377906 - DNA, 13 bp, Homo sapiens
gtgatatgtttta

SEQ ID NO: 1377907 - DNA, 18 bp, Homo sapiens
gtgcagcttgacattatg

SEQ ID NO: 1377908 - DNA, 18 bp, Homo sapiens
gtggtggtagaaatgatt

SEQ ID NO: 1377909 - DNA, 13 bp, Homo sapiens
gtgtttaaatgct

SEQ ID NO: 1377910 - DNA, 20 bp, Homo sapiens
gttaaatacacattatcact

SEQ ID NO: 1377911 - DNA, 12 bp, Homo sapiens
gtttaaatgctg

SEQ ID NO: 1377912 - DNA, 15 bp, Homo sapiens
gttttatttaaatgc

SEQ ID NO: 1377913 - DNA, 18 bp, Homo sapiens
gttttatttaaatgcttt

SEQ ID NO: 1377914 - DNA, 21 bp, Homo sapiens
taaaaaaggtagtttttctgt

SEQ ID NO: 1377915 - DNA, 20 bp, Homo sapiens
taaaaaggaaatatttttca

SEQ ID NO: 1377916 - DNA, 22 bp, Homo sapiens
taaaaaggaaatatttttcaac

SEQ ID NO: 1377917 - DNA, 15 bp, Homo sapiens
taaaagtatgaatct

SEQ ID NO: 1377918 - DNA, 17 bp, Homo sapiens
taaaggtggttttattt

SEQ ID NO: 1377919 - DNA, 20 bp, Homo sapiens
taaatacacattatcactga

SEQ ID NO: 1377920 - DNA, 16 bp, Homo sapiens
taaatgctgtgtacaa

SEQ ID NO: 1377921 - DNA, 22 bp, Homo sapiens
taaatgctgtgtacaacaatgc

SEQ ID NO: 1377922 - DNA, 15 bp, Homo sapiens
taactatcttctcta

SEQ ID NO: 1377923 - DNA, 21 bp, Homo sapiens
taagaaaatattctaacattt

SEQ ID NO: 1377924 - DNA, 22 bp, Homo sapiens
taaggaaactgctttattttta

SEQ ID NO: 1377925 - DNA, 15 bp, Homo sapiens
taataaaaaggaaat

SEQ ID NO: 1377926 - DNA, 23 bp, Homo sapiens
taataaaaaggaaatatttttca

SEQ ID NO: 1377927 - DNA, 20 bp, Homo sapiens
taatgagaagagttttctca

SEQ ID NO: 1377928 - DNA, 15 bp, Homo sapiens
taatttgttttcatt

SEQ ID NO: 1377929 - DNA, 14 bp, Homo sapiens
tacaacaatgcttt

SEQ ID NO: 1377930 - DNA, 15 bp, Homo sapiens
tacaacaatgctttg

SEQ ID NO: 1377931 - DNA, 13 bp, Homo sapiens
tacacattatcac

SEQ ID NO: 1377932 - DNA, 22 bp, Homo sapiens
tactcgagaggccaaagaagga

SEQ ID NO: 1377933 - DNA, 14 bp, Homo sapiens
tagtttttctgtca

SEQ ID NO: 1377934 - DNA, 20 bp, Homo sapiens
tataagtccatgaatgttca

SEQ ID NO: 1377935 - DNA, 15 bp, Homo sapiens
tatatccaaaattca

SEQ ID NO: 1377936 - DNA, 13 bp, Homo sapiens
tatatttaaatta

SEQ ID NO: 1377937 - DNA, 14 bp, Homo sapiens
tatatttttatttc

SEQ ID NO: 1377938 - DNA, 21 bp, Homo sapiens
tatcacagactctgctagtga

SEQ ID NO: 1377939 - DNA, 19 bp, Homo sapiens
tatcataaaggatatttca

SEQ ID NO: 1377940 - DNA, 13 bp, Homo sapiens
tatgaaaaaatgt

SEQ ID NO: 1377941 - DNA, 15 bp, Homo sapiens
tatgaaaaaatgttc

SEQ ID NO: 1377942 - DNA, 23 bp, Homo sapiens
tatgtccggctttaactatcttc

SEQ ID NO: 1377943 - DNA, 17 bp, Homo sapiens
tattaagaaaatattct

SEQ ID NO: 1377944 - DNA, 18 bp, Homo sapiens
tattacaggactgcagaa

SEQ ID NO: 1377945 - DNA, 14 bp, Homo sapiens
tattctaacatttg

SEQ ID NO: 1377946 - DNA, 14 bp, Homo sapiens
tattgttgctgaaa

SEQ ID NO: 1377947 - DNA, 15 bp, Homo sapiens
tatttatatttaaat

SEQ ID NO: 1377948 - DNA, 17 bp, Homo sapiens
tatttcaaatgattatg

SEQ ID NO: 1377949 - DNA, 20 bp, Homo sapiens
tatttcattcacattaatga

SEQ ID NO: 1377950 - DNA, 18 bp, Homo sapiens
tattttattttttttcaa

SEQ ID NO: 1377951 - DNA, 20 bp, Homo sapiens
tattttattttttttcaaaa

SEQ ID NO: 1377952 - DNA, 14 bp, Homo sapiens
tatttttatttcat

SEQ ID NO: 1377953 - DNA, 22 bp, Homo sapiens
tatttttatttcattcacatta

SEQ ID NO: 1377954 - DNA, 17 bp, Homo sapiens
tattttttttcaaaatg

SEQ ID NO: 1377955 - DNA, 23 bp, Homo sapiens
tcaaaatgaagatacacattaca

SEQ ID NO: 1377956 - DNA, 22 bp, Homo sapiens
tcaaaggaaaacacctttattt

SEQ ID NO: 1377957 - DNA, 22 bp, Homo sapiens
tcaagaccagcctggacagctt

SEQ ID NO: 1377958 - DNA, 15 bp, Homo sapiens
tcaaggtctgctttt

SEQ ID NO: 1377959 - DNA, 22 bp, Homo sapiens
tcacagactctgctagtgaaaa

SEQ ID NO: 1377960 - DNA, 23 bp, Homo sapiens
tcacgttctagtgaaactgcatt

SEQ ID NO: 1377961 - DNA, 14 bp, Homo sapiens
tcagctctatgtca

SEQ ID NO: 1377962 - DNA, 20 bp, Homo sapiens
tcataaaggatatttcaaat

SEQ ID NO: 1377963 - DNA, 14 bp, Homo sapiens
tcatatatcataaa

SEQ ID NO: 1377964 - DNA, 20 bp, Homo sapiens
tcattgttaaatacacatta

SEQ ID NO: 1377965 - DNA, 21 bp, Homo sapiens
tcattgttaaatacacattat

SEQ ID NO: 1377966 - DNA, 23 bp, Homo sapiens
tcatttgtataagtccatgaatg

SEQ ID NO: 1377967 - DNA, 15 bp, Homo sapiens
tcccttcatgtttta

SEQ ID NO: 1377968 - DNA, 13 bp, Homo sapiens
tccgaagaaaaga

SEQ ID NO: 1377969 - DNA, 19 bp, Homo sapiens
tcctaaggaaactgcttta

SEQ ID NO: 1377970 - DNA, 19 bp, Homo sapiens
tcgagtgtttaaatgctgt

SEQ ID NO: 1377971 - DNA, 20 bp, Homo sapiens
tcgagtgtttaaatgctgtg

SEQ ID NO: 1377972 - DNA, 21 bp, Homo sapiens
tctaggagcacaataatttgt

SEQ ID NO: 1377973 - DNA, 18 bp, Homo sapiens
tctatatttttatttcat

SEQ ID NO: 1377974 - DNA, 16 bp, Homo sapiens
tctctatatttttatt

SEQ ID NO: 1377975 - DNA, 13 bp, Homo sapiens
tctgtcattgtta

SEQ ID NO: 1377976 - DNA, 17 bp, Homo sapiens
tcttctatatccaaaat

SEQ ID NO: 1377977 - DNA, 22 bp, Homo sapiens
tcttctctatatttttatttca

SEQ ID NO: 1377978 - DNA, 15 bp, Homo sapiens
tcttgatttcccaaa

SEQ ID NO: 1377979 - DNA, 13 bp, Homo sapiens
tctttcagaaata

SEQ ID NO: 1377980 - DNA, 16 bp, Homo sapiens
tgaaaaaatgttcaaa

SEQ ID NO: 1377981 - DNA, 18 bp, Homo sapiens
tgaaaagaactagtttct

SEQ ID NO: 1377982 - DNA, 21 bp, Homo sapiens
tgaatgttcatatagccaggg

SEQ ID NO: 1377983 - DNA, 14 bp, Homo sapiens
tgacaattatgaaa

SEQ ID NO: 1377984 - DNA, 15 bp, Homo sapiens
tgacaattatgaaaa

SEQ ID NO: 1377985 - DNA, 15 bp, Homo sapiens
tgacattatgtttta

SEQ ID NO: 1377986 - DNA, 19 bp, Homo sapiens
tgagaagagttttctcaga

SEQ ID NO: 1377987 - DNA, 16 bp, Homo sapiens
tgataaaatattttaa

SEQ ID NO: 1377988 - DNA, 21 bp, Homo sapiens
tgataattttgaaatgattca

SEQ ID NO: 1377989 - DNA, 16 bp, Homo sapiens
tgatcatatatcataa

SEQ ID NO: 1377990 - DNA, 19 bp, Homo sapiens
tgattatcttgatttccca

SEQ ID NO: 1377991 - DNA, 22 bp, Homo sapiens
tgattatgattagttatgtctt

SEQ ID NO: 1377992 - DNA, 15 bp, Homo sapiens
tgattcatctttcag

SEQ ID NO: 1377993 - DNA, 22 bp, Homo sapiens
tgatttcccaaaaacactaaag

SEQ ID NO: 1377994 - DNA, 13 bp, Homo sapiens
tgcagatgaaaaa

SEQ ID NO: 1377995 - DNA, 22 bp, Homo sapiens
tgcagcttgacattatgtttta

SEQ ID NO: 1377996 - DNA, 12 bp, Homo sapiens
tgctagtgaaaa

SEQ ID NO: 1377997 - DNA, 14 bp, Homo sapiens
tgcttattttacaa

SEQ ID NO: 1377998 - DNA, 20 bp, Homo sapiens
tgcttattttacaaatatta

SEQ ID NO: 1377999 - DNA, 21 bp, Homo sapiens
tgctttgataaaatattttaa

SEQ ID NO: 1378000 - DNA, 14 bp, Homo sapiens
tgcttttcatcctt

SEQ ID NO: 1378001 - DNA, 20 bp, Homo sapiens
tggaagctttggttatgaaa

SEQ ID NO: 1378002 - DNA, 14 bp, Homo sapiens
tggagaaggaaggc

SEQ ID NO: 1378003 - DNA, 12 bp, Homo sapiens
tggattccagag

SEQ ID NO: 1378004 - DNA, 16 bp, Homo sapiens
tggcttgagcccagga

SEQ ID NO: 1378005 - DNA, 20 bp, Homo sapiens
tgtacaacaatgctttgata

SEQ ID NO: 1378006 - DNA, 22 bp, Homo sapiens
tgtattaagtgcagcttgacat

SEQ ID NO: 1378007 - DNA, 21 bp, Homo sapiens
tgtcaattgatatttctgtgt

SEQ ID NO: 1378008 - DNA, 21 bp, Homo sapiens
tgtcttttaataaaaaggaaa

SEQ ID NO: 1378009 - DNA, 23 bp, Homo sapiens
tgtgaatcttaacattttggtga

SEQ ID NO: 1378010 - DNA, 20 bp, Homo sapiens
tgtgatatgttttaaagtta

SEQ ID NO: 1378011 - DNA, 17 bp, Homo sapiens
tgtgatcatatatcata

SEQ ID NO: 1378012 - DNA, 19 bp, Homo sapiens
tgtgatcatatatcataaa

SEQ ID NO: 1378013 - DNA, 15 bp, Homo sapiens
tgtggagtgtattaa

SEQ ID NO: 1378014 - DNA, 16 bp, Homo sapiens
tgttcatatagccagg

SEQ ID NO: 1378015 - DNA, 13 bp, Homo sapiens
tgtttaaatgctg

SEQ ID NO: 1378016 - DNA, 19 bp, Homo sapiens
tgtttaaatgctgtgtaca

SEQ ID NO: 1378017 - DNA, 17 bp, Homo sapiens
tgttttatttaaatgct

SEQ ID NO: 1378018 - DNA, 18 bp, Homo sapiens
tgttttatttaaatgctt

SEQ ID NO: 1378019 - DNA, 19 bp, Homo sapiens
tgttttatttaaatgcttt

SEQ ID NO: 1378020 - DNA, 19 bp, Homo sapiens
ttaaaactggatggaaata

SEQ ID NO: 1378021 - DNA, 14 bp, Homo sapiens
ttaaatacacatta

SEQ ID NO: 1378022 - DNA, 15 bp, Homo sapiens
ttaaatgctgtgtac

SEQ ID NO: 1378023 - DNA, 22 bp, Homo sapiens
ttaaattatatttacctttttg

SEQ ID NO: 1378024 - DNA, 17 bp, Homo sapiens
ttaagaaaatattctaa

SEQ ID NO: 1378025 - DNA, 20 bp, Homo sapiens
ttaagaaaatattctaacat

SEQ ID NO: 1378026 - DNA, 13 bp, Homo sapiens
ttaagtgcagctt

SEQ ID NO: 1378027 - DNA, 22 bp, Homo sapiens
ttatatttacctttttgcttat

SEQ ID NO: 1378028 - DNA, 14 bp, Homo sapiens
ttatcactgaaaaa

SEQ ID NO: 1378029 - DNA, 17 bp, Homo sapiens
ttatgaaaaaatgttca

SEQ ID NO: 1378030 - DNA, 22 bp, Homo sapiens
ttatgaaaaaatgttcaaattc

SEQ ID NO: 1378031 - DNA, 21 bp, Homo sapiens
ttatgtcttttaataaaaagg

SEQ ID NO: 1378032 - DNA, 22 bp, Homo sapiens
ttatgtgatatgttttaaagtt

SEQ ID NO: 1378033 - DNA, 20 bp, Homo sapiens
ttatgttttatttaaatgct

SEQ ID NO: 1378034 - DNA, 21 bp, Homo sapiens
ttatgttttatttaaatgctt

SEQ ID NO: 1378035 - DNA, 14 bp, Homo sapiens
ttattattttcaaa

SEQ ID NO: 1378036 - DNA, 16 bp, Homo sapiens
ttatttcattcacatt

SEQ ID NO: 1378037 - DNA, 20 bp, Homo sapiens
ttcaaaggaaaacaccttta

SEQ ID NO: 1378038 - DNA, 22 bp, Homo sapiens
ttcaacttcttctatatccaaa

SEQ ID NO: 1378039 - DNA, 19 bp, Homo sapiens
ttcagggctttaaacatga

SEQ ID NO: 1378040 - DNA, 21 bp, Homo sapiens
ttcagggctttaaacatgatt

SEQ ID NO: 1378041 - DNA, 15 bp, Homo sapiens
ttcatatagccaggg

SEQ ID NO: 1378042 - DNA, 15 bp, Homo sapiens
ttcatctttcagaaa

SEQ ID NO: 1378043 - DNA, 16 bp, Homo sapiens
ttcatctttcagaaat

SEQ ID NO: 1378044 - DNA, 19 bp, Homo sapiens
ttcatctttcagaaataaa

SEQ ID NO: 1378045 - DNA, 18 bp, Homo sapiens
ttctaattggcagattgt

SEQ ID NO: 1378046 - DNA, 13 bp, Homo sapiens
ttctagtgaaact

SEQ ID NO: 1378047 - DNA, 18 bp, Homo sapiens
ttctagtgaaactgcatt

SEQ ID NO: 1378048 - DNA, 13 bp, Homo sapiens
ttctctatatttt

SEQ ID NO: 1378049 - DNA, 22 bp, Homo sapiens
ttctctatatttttatttcatt

SEQ ID NO: 1378050 - DNA, 22 bp, Homo sapiens
ttgaaatgattcatctttcaga

SEQ ID NO: 1378051 - DNA, 16 bp, Homo sapiens
ttgaagtttattattt

SEQ ID NO: 1378052 - DNA, 16 bp, Homo sapiens
ttgacattatgtttta

SEQ ID NO: 1378053 - DNA, 22 bp, Homo sapiens
ttgataattttgaaatgattca

SEQ ID NO: 1378054 - DNA, 14 bp, Homo sapiens
ttgcagatgaaaaa

SEQ ID NO: 1378055 - DNA, 20 bp, Homo sapiens
ttgctgaaaactctatgtcc

SEQ ID NO: 1378056 - DNA, 22 bp, Homo sapiens
ttgcttgtgaatcttaacattt

SEQ ID NO: 1378057 - DNA, 23 bp, Homo sapiens
ttgcttgtgaatcttaacatttt

SEQ ID NO: 1378058 - DNA, 21 bp, Homo sapiens
ttggaagctttggttatgaaa

SEQ ID NO: 1378059 - DNA, 17 bp, Homo sapiens
ttggttatgaaacatgt

SEQ ID NO: 1378060 - DNA, 17 bp, Homo sapiens
ttgttaaatacacatta

SEQ ID NO: 1378061 - DNA, 12 bp, Homo sapiens
aaaaaaggtagt

SEQ ID NO: 1378062 - DNA, 11 bp, Homo sapiens
aaaaaatgttc

SEQ ID NO: 1378063 - DNA, 12 bp, Homo sapiens
aaaaaggaaata

SEQ ID NO: 1378064 - DNA, 19 bp, Homo sapiens
aaaaatgtagcttttatgt

SEQ ID NO: 1378065 - DNA, 16 bp, Homo sapiens
aaaacacctttatttt

SEQ ID NO: 1378066 - DNA, 14 bp, Homo sapiens
aaaagatatgtatt

SEQ ID NO: 1378067 - DNA, 18 bp, Homo sapiens
aaaaggtagtttttctgt

SEQ ID NO: 1378068 - DNA, 21 bp, Homo sapiens
aaaatattctaacatttgata

SEQ ID NO: 1378069 - DNA, 18 bp, Homo sapiens
aaaatattttaagtatga

SEQ ID NO: 1378070 - DNA, 14 bp, Homo sapiens
aaaatgttcaaatt

SEQ ID NO: 1378071 - DNA, 22 bp, Homo sapiens
aaacacctttattttatttttt

SEQ ID NO: 1378072 - DNA, 13 bp, Homo sapiens
aaaggaaatattt

SEQ ID NO: 1378073 - DNA, 12 bp, Homo sapiens
aaatattaagaa

SEQ ID NO: 1378074 - DNA, 17 bp, Homo sapiens
aaatattctaacatttg

SEQ ID NO: 1378075 - DNA, 14 bp, Homo sapiens
aaatattttaagta

SEQ ID NO: 1378076 - DNA, 13 bp, Homo sapiens
aaatgctttttat

SEQ ID NO: 1378077 - DNA, 15 bp, Homo sapiens
aaatgtagcttttat

SEQ ID NO: 1378078 - DNA, 16 bp, Homo sapiens
aaatgtagcttttatg

SEQ ID NO: 1378079 - DNA, 17 bp, Homo sapiens
aaatgtagcttttatgt

SEQ ID NO: 1378080 - DNA, 20 bp, Homo sapiens
aaatgtagcttttatgtgat

SEQ ID NO: 1378081 - DNA, 17 bp, Homo sapiens
aaatgttcaaattcacg

SEQ ID NO: 1378082 - DNA, 19 bp, Homo sapiens
aaattatatttaccttttt

SEQ ID NO: 1378083 - DNA, 14 bp, Homo sapiens
aaattcagggcttt

SEQ ID NO: 1378084 - DNA, 14 bp, Homo sapiens
aacatttgataatt

SEQ ID NO: 1378085 - DNA, 22 bp, Homo sapiens
aactaaggtgactcgagtgttt

SEQ ID NO: 1378086 - DNA, 16 bp, Homo sapiens
aactgcattatttgtt

SEQ ID NO: 1378087 - DNA, 20 bp, Homo sapiens
aactgcctgacaattatgaa

SEQ ID NO: 1378088 - DNA, 14 bp, Homo sapiens
aacttcttctatat

SEQ ID NO: 1378089 - DNA, 15 bp, Homo sapiens
aacttcttctatatc

SEQ ID NO: 1378090 - DNA, 18 bp, Homo sapiens
aacttcttctatatccaa

SEQ ID NO: 1378091 - DNA, 14 bp, Homo sapiens
aagaaaatattcta

SEQ ID NO: 1378092 - DNA, 14 bp, Homo sapiens
aagaaagaacggaa

SEQ ID NO: 1378093 - DNA, 14 bp, Homo sapiens
aagaccagcctgga

SEQ ID NO: 1378094 - DNA, 15 bp, Homo sapiens
aagagatcaggaaga

SEQ ID NO: 1378095 - DNA, 22 bp, Homo sapiens
aagagatcaggaagagaaggag

SEQ ID NO: 1378096 - DNA, 22 bp, Homo sapiens
aagaggacactagatgatatta

SEQ ID NO: 1378097 - DNA, 13 bp, Homo sapiens
aagagttttctca

SEQ ID NO: 1378098 - DNA, 20 bp, Homo sapiens
aaggaaactgctttattttt

SEQ ID NO: 1378099 - DNA, 14 bp, Homo sapiens
aaggaaatattttt

SEQ ID NO: 1378100 - DNA, 17 bp, Homo sapiens
aaggaaatatttttcaa

SEQ ID NO: 1378101 - DNA, 17 bp, Homo sapiens
aaggaaggcagggagga

SEQ ID NO: 1378102 - DNA, 17 bp, Homo sapiens
aaggaaggctccatctc

SEQ ID NO: 1378103 - DNA, 24 bp, Homo sapiens
aaggaggatggcttgagcccagga

SEQ ID NO: 1378104 - DNA, 15 bp, Homo sapiens
aaggatatttcaaat

SEQ ID NO: 1378105 - DNA, 21 bp, Homo sapiens
aaggtggttttattttccctt

SEQ ID NO: 1378106 - DNA, 16 bp, Homo sapiens
aagtccatgaatgttc

SEQ ID NO: 1378107 - DNA, 18 bp, Homo sapiens
aagtccatgaatgttcat

SEQ ID NO: 1378108 - DNA, 20 bp, Homo sapiens
aagtccatgaatgttcatat

SEQ ID NO: 1378109 - DNA, 21 bp, Homo sapiens
aataaaaaggaaatatttttc

SEQ ID NO: 1378110 - DNA, 17 bp, Homo sapiens
aataatttgttttcatt

SEQ ID NO: 1378111 - DNA, 18 bp, Homo sapiens
aatattaagaaaatattc

SEQ ID NO: 1378112 - DNA, 19 bp, Homo sapiens
aatgaagatacacattaca

SEQ ID NO: 1378113 - DNA, 20 bp, Homo sapiens
aatgacttgcagatgaaaaa

SEQ ID NO: 1378114 - DNA, 15 bp, Homo sapiens
aatgattcaccaggt

SEQ ID NO: 1378115 - DNA, 22 bp, Homo sapiens
aatgattcaccaggtccaatgt

SEQ ID NO: 1378116 - DNA, 13 bp, Homo sapiens
aatgattcatctt

SEQ ID NO: 1378117 - DNA, 16 bp, Homo sapiens
aatgattcatctttca

SEQ ID NO: 1378118 - DNA, 23 bp, Homo sapiens
aatgctgtgtacaacaatgcttt

SEQ ID NO: 1378119 - DNA, 21 bp, Homo sapiens
aatgttgttcaccagtgcttg

SEQ ID NO: 1378120 - DNA, 11 bp, Homo sapiens
aattatgaaaa

SEQ ID NO: 1378121 - DNA, 23 bp, Homo sapiens
aattatgaaaaaatgttcaaatt

SEQ ID NO: 1378122 - DNA, 23 bp, Homo sapiens
aattcagggctttaaacatgatt

SEQ ID NO: 1378123 - DNA, 15 bp, Homo sapiens
acaaatattaagaaa

SEQ ID NO: 1378124 - DNA, 15 bp, Homo sapiens
acaaatgcatttagt

SEQ ID NO: 1378125 - DNA, 13 bp, Homo sapiens
acaacaatgcttt

SEQ ID NO: 1378126 - DNA, 23 bp, Homo sapiens
acaataatttgttttcatttgta

SEQ ID NO: 1378127 - DNA, 20 bp, Homo sapiens
acaatgctttgataaaatat

SEQ ID NO: 1378128 - DNA, 13 bp, Homo sapiens
acaattatgaaaa

SEQ ID NO: 1378129 - DNA, 17 bp, Homo sapiens
acaattatgaaaaaatg

SEQ ID NO: 1378130 - DNA, 18 bp, Homo sapiens
acaattatgaaaaaatgt

SEQ ID NO: 1378131 - DNA, 15 bp, Homo sapiens
acacctttattttat

SEQ ID NO: 1378132 - DNA, 22 bp, Homo sapiens
acatgattatcttgatttccca

SEQ ID NO: 1378133 - DNA, 22 bp, Homo sapiens
acattaatgagaagagttttct

SEQ ID NO: 1378134 - DNA, 15 bp, Homo sapiens
acattacagccaggt

SEQ ID NO: 1378135 - DNA, 20 bp, Homo sapiens
acattatcactgaaaaaatg

SEQ ID NO: 1378136 - DNA, 23 bp, Homo sapiens
acattatgttttatttaaatgct

SEQ ID NO: 1378137 - DNA, 18 bp, Homo sapiens
acctttttgcttatttta

SEQ ID NO: 1378138 - DNA, 22 bp, Homo sapiens
acctttttgcttattttacaaa

SEQ ID NO: 1378139 - DNA, 23 bp, Homo sapiens
actaaaggtggttttattttccc

SEQ ID NO: 1378140 - DNA, 20 bp, Homo sapiens
actcgagaggccaaagaagg

SEQ ID NO: 1378141 - DNA, 14 bp, Homo sapiens
actcgagtgtttaa

SEQ ID NO: 1378142 - DNA, 17 bp, Homo sapiens
actcgagtgtttaaatg

SEQ ID NO: 1378143 - DNA, 18 bp, Homo sapiens
actcgagtgtttaaatgc

SEQ ID NO: 1378144 - DNA, 22 bp, Homo sapiens
actgcctgacaattatgaaaaa

SEQ ID NO: 1378145 - DNA, 15 bp, Homo sapiens
acttgcagatgaaaa

SEQ ID NO: 1378146 - DNA, 14 bp, Homo sapiens
agaaaatattctaa

SEQ ID NO: 1378147 - DNA, 21 bp, Homo sapiens
agaaaatattctaacatttga

SEQ ID NO: 1378148 - DNA, 14 bp, Homo sapiens
agaactagtttcta

SEQ ID NO: 1378149 - DNA, 16 bp, Homo sapiens
agaagaaagaacggaa

SEQ ID NO: 1378150 - DNA, 20 bp, Homo sapiens
agaaggaaggcagggaggag

SEQ ID NO: 1378151 - DNA, 13 bp, Homo sapiens
agagaagaaagaa

SEQ ID NO: 1378152 - DNA, 13 bp, Homo sapiens
agagaaggagcag

SEQ ID NO: 1378153 - DNA, 19 bp, Homo sapiens
agagatcaggaagagaagg

SEQ ID NO: 1378154 - DNA, 20 bp, Homo sapiens
agagatcaggaagagaagga

SEQ ID NO: 1378155 - DNA, 21 bp, Homo sapiens
agagctgatggagaaggaagg

SEQ ID NO: 1378156 - DNA, 16 bp, Homo sapiens
agaggccaaagaagga

SEQ ID NO: 1378157 - DNA, 16 bp, Homo sapiens
agatgaaaaaaactaa

SEQ ID NO: 1378158 - DNA, 13 bp, Homo sapiens
agatgatattaca

SEQ ID NO: 1378159 - DNA, 14 bp, Homo sapiens
agcacaataatttg

SEQ ID NO: 1378160 - DNA, 21 bp, Homo sapiens
agctctatgtcaattgatatt

SEQ ID NO: 1378161 - DNA, 22 bp, Homo sapiens
agctctatgtcaattgatattt

SEQ ID NO: 1378162 - DNA, 23 bp, Homo sapiens
agctctatgtcaattgatatttc

SEQ ID NO: 1378163 - DNA, 14 bp, Homo sapiens
agctgatggagaag

SEQ ID NO: 1378164 - DNA, 15 bp, Homo sapiens
agctgatggagaagg

SEQ ID NO: 1378165 - DNA, 17 bp, Homo sapiens
agctgatggagaaggaa

SEQ ID NO: 1378166 - DNA, 18 bp, Homo sapiens
agctttggttatgaaaca

SEQ ID NO: 1378167 - DNA, 20 bp, Homo sapiens
agcttttatgtgatatgttt

SEQ ID NO: 1378168 - DNA, 17 bp, Homo sapiens
aggaaatatttttcaac

SEQ ID NO: 1378169 - DNA, 19 bp, Homo sapiens
aggatggcttgagcccagg

SEQ ID NO: 1378170 - DNA, 22 bp, Homo sapiens
aggcagggaggaggcagagaag

SEQ ID NO: 1378171 - DNA, 18 bp, Homo sapiens
aggcagttcaaagcagga

SEQ ID NO: 1378172 - DNA, 19 bp, Homo sapiens
aggcagttcaaagcaggat

SEQ ID NO: 1378173 - DNA, 18 bp, Homo sapiens
agggattgaagtttatta

SEQ ID NO: 1378174 - DNA, 17 bp, Homo sapiens
aggtagtttttctgtca

SEQ ID NO: 1378175 - DNA, 14 bp, Homo sapiens
agtatttatattta

SEQ ID NO: 1378176 - DNA, 14 bp, Homo sapiens
agtgaaactgcatt

SEQ ID NO: 1378177 - DNA, 15 bp, Homo sapiens
agtgtttaaatgctg

SEQ ID NO: 1378178 - DNA, 16 bp, Homo sapiens
agtgtttaaatgctgt

SEQ ID NO: 1378179 - DNA, 11 bp, Homo sapiens
agttatgtctt

SEQ ID NO: 1378180 - DNA, 14 bp, Homo sapiens
agtttttctgtcat

SEQ ID NO: 1378181 - DNA, 12 bp, Homo sapiens
ataaaaaggaaa

SEQ ID NO: 1378182 - DNA, 13 bp, Homo sapiens
ataaaaaggaaat

SEQ ID NO: 1378183 - DNA, 16 bp, Homo sapiens
ataaaggatatttcaa

SEQ ID NO: 1378184 - DNA, 18 bp, Homo sapiens
atatatcataaaggatat

SEQ ID NO: 1378185 - DNA, 13 bp, Homo sapiens
atatgtattctaa

SEQ ID NO: 1378186 - DNA, 14 bp, Homo sapiens
atatgtattctaat

SEQ ID NO: 1378187 - DNA, 15 bp, Homo sapiens
atatgtattctaatt

SEQ ID NO: 1378188 - DNA, 11 bp, Homo sapiens
atatgttttaa

SEQ ID NO: 1378189 - DNA, 12 bp, Homo sapiens
atattaagaaaa

SEQ ID NO: 1378190 - DNA, 13 bp, Homo sapiens
atattaagaaaat

SEQ ID NO: 1378191 - DNA, 15 bp, Homo sapiens
atattaagaaaatat

SEQ ID NO: 1378192 - DNA, 16 bp, Homo sapiens
atattaagaaaatatt

SEQ ID NO: 1378193 - DNA, 14 bp, Homo sapiens
atattctaacattt

SEQ ID NO: 1378194 - DNA, 15 bp, Homo sapiens
atatttcaaatgatt

SEQ ID NO: 1378195 - DNA, 20 bp, Homo sapiens
atatttcaaatgattatgat

SEQ ID NO: 1378196 - DNA, 20 bp, Homo sapiens
atatttttcaacttcttcta

SEQ ID NO: 1378197 - DNA, 14 bp, Homo sapiens
atcaggaagagaag

SEQ ID NO: 1378198 - DNA, 22 bp, Homo sapiens
atccttcatctggattccagag

SEQ ID NO: 1378199 - DNA, 22 bp, Homo sapiens
atcttctctatatttttatttc

SEQ ID NO: 1378200 - DNA, 20 bp, Homo sapiens
atcttgatttcccaaaaaca

SEQ ID NO: 1378201 - DNA, 12 bp, Homo sapiens
atctttcagaaa

SEQ ID NO: 1378202 - DNA, 15 bp, Homo sapiens
atgaagatacacatt

SEQ ID NO: 1378203 - DNA, 16 bp, Homo sapiens
atgaagatacacatta

SEQ ID NO: 1378204 - DNA, 18 bp, Homo sapiens
atgaagatacacattaca

SEQ ID NO: 1378205 - DNA, 22 bp, Homo sapiens
atgaatgttcatatagccaggg

SEQ ID NO: 1378206 - DNA, 19 bp, Homo sapiens
atgagaagagttttctcag

SEQ ID NO: 1378207 - DNA, 17 bp, Homo sapiens
atgctttgataaaatat

SEQ ID NO: 1378208 - DNA, 18 bp, Homo sapiens
atgctttgataaaatatt

SEQ ID NO: 1378209 - DNA, 22 bp, Homo sapiens
atgctttttatcgctaaatgac

SEQ ID NO: 1378210 - DNA, 17 bp, Homo sapiens
atggcttgagcccagga

SEQ ID NO: 1378211 - DNA, 17 bp, Homo sapiens
atgtccggctttaacta

SEQ ID NO: 1378212 - DNA, 13 bp, Homo sapiens
atgttcaaattca

SEQ ID NO: 1378213 - DNA, 18 bp, Homo sapiens
atgttttaaagttaaaac

SEQ ID NO: 1378214 - DNA, 15 bp, Homo sapiens
attaagaaaatattc

SEQ ID NO: 1378215 - DNA, 17 bp, Homo sapiens
attaagaaaatattcta

SEQ ID NO: 1378216 - DNA, 23 bp, Homo sapiens
attaagtgcagcttgacattatg

SEQ ID NO: 1378217 - DNA, 18 bp, Homo sapiens
attagttatgtcttttaa

SEQ ID NO: 1378218 - DNA, 11 bp, Homo sapiens
attatatttac

SEQ ID NO: 1378219 - DNA, 15 bp, Homo sapiens
attatcactgaaaaa

SEQ ID NO: 1378220 - DNA, 17 bp, Homo sapiens
attatcttgatttccca

SEQ ID NO: 1378221 - DNA, 18 bp, Homo sapiens
attatgaaaaaatgttca

SEQ ID NO: 1378222 - DNA, 18 bp, Homo sapiens
attattttcaaaggaaaa

SEQ ID NO: 1378223 - DNA, 18 bp, Homo sapiens
attcacgttctagtgaaa

SEQ ID NO: 1378224 - DNA, 15 bp, Homo sapiens
attcagggctttaaa

SEQ ID NO: 1378225 - DNA, 14 bp, Homo sapiens
attcatctttcaga

SEQ ID NO: 1378226 - DNA, 13 bp, Homo sapiens
attgttaaataca

SEQ ID NO: 1378227 - DNA, 16 bp, Homo sapiens
attgttaaatacacat

SEQ ID NO: 1378228 - DNA, 22 bp, Homo sapiens
attgttaaatacacattatcac

SEQ ID NO: 1378229 - DNA, 22 bp, Homo sapiens
attgttttttcctaaggaaact

SEQ ID NO: 1378230 - DNA, 20 bp, Homo sapiens
atttaaatgctttttatcgc

SEQ ID NO: 1378231 - DNA, 21 bp, Homo sapiens
atttaaatgctttttatcgct

SEQ ID NO: 1378232 - DNA, 23 bp, Homo sapiens
atttcccaaaaacactaaaggtg

SEQ ID NO: 1378233 - DNA, 19 bp, Homo sapiens
atttgataattttgaaatg

SEQ ID NO: 1378234 - DNA, 22 bp, Homo sapiens
atttgataattttgaaatgatt

SEQ ID NO: 1378235 - DNA, 20 bp, Homo sapiens
atttgttttcatttgtataa

SEQ ID NO: 1378236 - DNA, 22 bp, Homo sapiens
atttgttttcatttgtataagt

SEQ ID NO: 1378237 - DNA, 14 bp, Homo sapiens
attttacaaatatt

SEQ ID NO: 1378238 - DNA, 20 bp, Homo sapiens
attttattttttttcaaaat

SEQ ID NO: 1378239 - DNA, 22 bp, Homo sapiens
attttattttttttcaaaatga

SEQ ID NO: 1378240 - DNA, 15 bp, Homo sapiens
attttcaaaggaaaa

SEQ ID NO: 1378241 - DNA, 19 bp, Homo sapiens
attttgaaatgattcatct

SEQ ID NO: 1378242 - DNA, 14 bp, Homo sapiens
atttttataaaact

SEQ ID NO: 1378243 - DNA, 13 bp, Homo sapiens
atttttatttcat

SEQ ID NO: 1378244 - DNA, 18 bp, Homo sapiens
attttttttcaaaatgaa

SEQ ID NO: 1378245 - DNA, 20 bp, Homo sapiens
attttttttcaaaatgaaga

SEQ ID NO: 1378246 - DNA, 10 bp, Homo sapiens
caaaggaaaa

SEQ ID NO: 1378247 - DNA, 13 bp, Homo sapiens
caaatattaagaa

SEQ ID NO: 1378248 - DNA, 18 bp, Homo sapiens
caaatattaagaaaatat

SEQ ID NO: 1378249 - DNA, 21 bp, Homo sapiens
caaatattaagaaaatattct

SEQ ID NO: 1378250 - DNA, 17 bp, Homo sapiens
caaattcacgttctagt

SEQ ID NO: 1378251 - DNA, 21 bp, Homo sapiens
caaattcacgttctagtgaaa

SEQ ID NO: 1378252 - DNA, 17 bp, Homo sapiens
caattatgaaaaaatgt

SEQ ID NO: 1378253 - DNA, 20 bp, Homo sapiens
cacattatcactgaaaaaat

SEQ ID NO: 1378254 - DNA, 22 bp, Homo sapiens
cacattatcactgaaaaaatgt

SEQ ID NO: 1378255 - DNA, 13 bp, Homo sapiens
caccgcagaagga

SEQ ID NO: 1378256 - DNA, 15 bp, Homo sapiens
cacctttattttatt

SEQ ID NO: 1378257 - DNA, 15 bp, Homo sapiens
cactgaaaaaatgta

SEQ ID NO: 1378258 - DNA, 15 bp, Homo sapiens
cagaaataaaagtat

SEQ ID NO: 1378259 - DNA, 13 bp, Homo sapiens
cagagcactgctc

SEQ ID NO: 1378260 - DNA, 20 bp, Homo sapiens
cagagctgatggagaaggaa

SEQ ID NO: 1378261 - DNA, 22 bp, Homo sapiens
cagcttgacattatgttttatt

SEQ ID NO: 1378262 - DNA, 15 bp, Homo sapiens
caggaagagaaggag

SEQ ID NO: 1378263 - DNA, 14 bp, Homo sapiens
caggagttcaagac

SEQ ID NO: 1378264 - DNA, 15 bp, Homo sapiens
cagggaggaggcaga

SEQ ID NO: 1378265 - DNA, 19 bp, Homo sapiens
cataaaggatatttcaaat

SEQ ID NO: 1378266 - DNA, 21 bp, Homo sapiens
cataaaggatatttcaaatga

SEQ ID NO: 1378267 - DNA, 23 bp, Homo sapiens
cataaaggatatttcaaatgatt

SEQ ID NO: 1378268 - DNA, 23 bp, Homo sapiens
catccttcatctggattccagag

SEQ ID NO: 1378269 - DNA, 15 bp, Homo sapiens
catgattatcttgat

SEQ ID NO: 1378270 - DNA, 16 bp, Homo sapiens
catgttttaacttatt

SEQ ID NO: 1378271 - DNA, 17 bp, Homo sapiens
cattatcactgaaaaaa

SEQ ID NO: 1378272 - DNA, 18 bp, Homo sapiens
cattgttaaatacacatt

SEQ ID NO: 1378273 - DNA, 21 bp, Homo sapiens
catttagtggtggtagaaatg

SEQ ID NO: 1378274 - DNA, 16 bp, Homo sapiens
ccaccgcagaaggaag

SEQ ID NO: 1378275 - DNA, 16 bp, Homo sapiens
ccagagcactgctcca

SEQ ID NO: 1378276 - DNA, 13 bp, Homo sapiens
ccgcagaaggaag

SEQ ID NO: 1378277 - DNA, 15 bp, Homo sapiens
ccgcagaaggaaggc

SEQ ID NO: 1378278 - DNA, 18 bp, Homo sapiens
ccgcagaaggaaggcagg

SEQ ID NO: 1378279 - DNA, 19 bp, Homo sapiens
cctgacaattatgaaaaaa

SEQ ID NO: 1378280 - DNA, 14 bp, Homo sapiens
cctgtagtcttagc

SEQ ID NO: 1378281 - DNA, 14 bp, Homo sapiens
ccttcatgttttaa

SEQ ID NO: 1378282 - DNA, 15 bp, Homo sapiens
cctttattttatttt

SEQ ID NO: 1378283 - DNA, 20 bp, Homo sapiens
cgagtgtttaaatgctgtgt

SEQ ID NO: 1378284 - DNA, 22 bp, Homo sapiens
ctaaatgacttgcagatgaaaa

SEQ ID NO: 1378285 - DNA, 10 bp, Homo sapiens
ctaacatttg

SEQ ID NO: 1378286 - DNA, 20 bp, Homo sapiens
ctaaggaaactgctttattt

SEQ ID NO: 1378287 - DNA, 18 bp, Homo sapiens
ctagtgaaactgcattat

SEQ ID NO: 1378288 - DNA, 20 bp, Homo sapiens
ctagtgaaactgcattattt

SEQ ID NO: 1378289 - DNA, 15 bp, Homo sapiens
ctatatccaaaattc

SEQ ID NO: 1378290 - DNA, 15 bp, Homo sapiens
ctatcttctctatat

SEQ ID NO: 1378291 - DNA, 20 bp, Homo sapiens
ctatgtcaattgatatttct

SEQ ID NO: 1378292 - DNA, 20 bp, Homo sapiens
ctcgagaggccaaagaagga

SEQ ID NO: 1378293 - DNA, 14 bp, Homo sapiens
ctctgctagtgaaa

SEQ ID NO: 1378294 - DNA, 12 bp, Homo sapiens
ctgaaaaaatgt

SEQ ID NO: 1378295 - DNA, 13 bp, Homo sapiens
ctgatggagaagg

SEQ ID NO: 1378296 - DNA, 16 bp, Homo sapiens
ctgatggagaaggaag

SEQ ID NO: 1378297 - DNA, 18 bp, Homo sapiens
ctgcctgacaattatgaa

SEQ ID NO: 1378298 - DNA, 18 bp, Homo sapiens
ctgtcattgttaaataca

SEQ ID NO: 1378299 - DNA, 19 bp, Homo sapiens
cttcatctggattccagag

SEQ ID NO: 1378300 - DNA, 23 bp, Homo sapiens
cttcatgttttaacttattgttg

SEQ ID NO: 1378301 - DNA, 16 bp, Homo sapiens
cttctctatattttta

SEQ ID NO: 1378302 - DNA, 14 bp, Homo sapiens
cttgacattatgtt

SEQ ID NO: 1378303 - DNA, 19 bp, Homo sapiens
cttgcagatgaaaaaaact

SEQ ID NO: 1378304 - DNA, 20 bp, Homo sapiens
cttgtgaatcttaacatttt

SEQ ID NO: 1378305 - DNA, 19 bp, Homo sapiens
ctttaaacatgattatctt

SEQ ID NO: 1378306 - DNA, 22 bp, Homo sapiens
ctttaactatcttctctatatt

SEQ ID NO: 1378307 - DNA, 22 bp, Homo sapiens
ctttattttattttttttcaaa

SEQ ID NO: 1378308 - DNA, 18 bp, Homo sapiens
ctttatttttataaaact

SEQ ID NO: 1378309 - DNA, 15 bp, Homo sapiens
ctttgataaaatatt

SEQ ID NO: 1378310 - DNA, 15 bp, Homo sapiens
ctttggttatgaaac

SEQ ID NO: 1378311 - DNA, 20 bp, Homo sapiens
cttttaataaaaaggaaata

SEQ ID NO: 1378312 - DNA, 13 bp, Homo sapiens
cttttatgtgata

SEQ ID NO: 1378313 - DNA, 18 bp, Homo sapiens
cttttatgtgatatgttt

SEQ ID NO: 1378314 - DNA, 20 bp, Homo sapiens
gaaaagatatgtattctaat

SEQ ID NO: 1378315 - DNA, 18 bp, Homo sapiens
gaaactgcattatttgtt

SEQ ID NO: 1378316 - DNA, 21 bp, Homo sapiens
gaaactgctttatttttataa

SEQ ID NO: 1378317 - DNA, 14 bp, Homo sapiens
gaaataaaagtatg

SEQ ID NO: 1378318 - DNA, 19 bp, Homo sapiens
gaagaaagaacggaagaag

SEQ ID NO: 1378319 - DNA, 12 bp, Homo sapiens
gaagagaaggag

SEQ ID NO: 1378320 - DNA, 13 bp, Homo sapiens
gaagagaaggagc

SEQ ID NO: 1378321 - DNA, 12 bp, Homo sapiens
gaagatacacat

SEQ ID NO: 1378322 - DNA, 22 bp, Homo sapiens
gaagatacacattacagccagg

SEQ ID NO: 1378323 - DNA, 18 bp, Homo sapiens
gaagctttggttatgaaa

SEQ ID NO: 1378324 - DNA, 14 bp, Homo sapiens
gaaggcagggagga

SEQ ID NO: 1378325 - DNA, 17 bp, Homo sapiens
gaagtttattattttca

SEQ ID NO: 1378326 - DNA, 13 bp, Homo sapiens
gacaattatgaaa

SEQ ID NO: 1378327 - DNA, 22 bp, Homo sapiens
gaccctccaccgcagaaggaag

SEQ ID NO: 1378328 - DNA, 22 bp, Homo sapiens
gagcacaataatttgttttcat

SEQ ID NO: 1378329 - DNA, 23 bp, Homo sapiens
gagcagagctgatggagaaggaa

SEQ ID NO: 1378330 - DNA, 15 bp, Homo sapiens
gagctgatggagaag

SEQ ID NO: 1378331 - DNA, 21 bp, Homo sapiens
gaggatggcttgagcccagga

SEQ ID NO: 1378332 - DNA, 16 bp, Homo sapiens
gaggcagagaagaaag

SEQ ID NO: 1378333 - DNA, 20 bp, Homo sapiens
gataaaatattttaagtatg

SEQ ID NO: 1378334 - DNA, 14 bp, Homo sapiens
gataattttgaaat

SEQ ID NO: 1378335 - DNA, 12 bp, Homo sapiens
gatatttcaaat

SEQ ID NO: 1378336 - DNA, 18 bp, Homo sapiens
gatcaggaagagaaggag

SEQ ID NO: 1378337 - DNA, 13 bp, Homo sapiens
gatggagaaggaa

SEQ ID NO: 1378338 - DNA, 15 bp, Homo sapiens
gatggagaaggaagg

SEQ ID NO: 1378339 - DNA, 22 bp, Homo sapiens
gattatgattagttatgtcttt

SEQ ID NO: 1378340 - DNA, 17 bp, Homo sapiens
gattgaagtttattatt

SEQ ID NO: 1378341 - DNA, 20 bp, Homo sapiens
gcacaataatttgttttcat

SEQ ID NO: 1378342 - DNA, 22 bp, Homo sapiens
gcagaaggaaggcagggaggag

SEQ ID NO: 1378343 - DNA, 18 bp, Homo sapiens
gcagagctgatggagaag

SEQ ID NO: 1378344 - DNA, 20 bp, Homo sapiens
gccagggattgaagtttatt

SEQ ID NO: 1378345 - DNA, 18 bp, Homo sapiens
actatcttctctatattt

SEQ ID NO: 1378346 - DNA, 21 bp, Homo sapiens
actatcttctctatattttta

SEQ ID NO: 1378347 - DNA, 20 bp, Homo sapiens
actcttcaaggtctgctttt

SEQ ID NO: 1378348 - DNA, 13 bp, Homo sapiens
actgaaaaaatgt

SEQ ID NO: 1378349 - DNA, 19 bp, Homo sapiens
actgcctgacaattatgaa

SEQ ID NO: 1378350 - DNA, 15 bp, Homo sapiens
actgctttattttta

SEQ ID NO: 1378351 - DNA, 16 bp, Homo sapiens
acttcttctatatcca

SEQ ID NO: 1378352 - DNA, 13 bp, Homo sapiens
agaaaatattcta

SEQ ID NO: 1378353 - DNA, 18 bp, Homo sapiens
agaaatgattcaccaggt

SEQ ID NO: 1378354 - DNA, 15 bp, Homo sapiens
agaagagttttctca

SEQ ID NO: 1378355 - DNA, 17 bp, Homo sapiens
agaagagttttctcaga

SEQ ID NO: 1378356 - DNA, 16 bp, Homo sapiens
agaaggaggatggctt

SEQ ID NO: 1378357 - DNA, 17 bp, Homo sapiens
agactctgctagtgaaa

SEQ ID NO: 1378358 - DNA, 14 bp, Homo sapiens
agagatcaggaaga

SEQ ID NO: 1378359 - DNA, 12 bp, Homo sapiens
agagcactgctc

SEQ ID NO: 1378360 - DNA, 18 bp, Homo sapiens
agagctgatggagaagga

SEQ ID NO: 1378361 - DNA, 20 bp, Homo sapiens
agagctgatggagaaggaag

SEQ ID NO: 1378362 - DNA, 14 bp, Homo sapiens
agatatgtattcta

SEQ ID NO: 1378363 - DNA, 19 bp, Homo sapiens
agatcaggaagagaaggag

SEQ ID NO: 1378364 - DNA, 23 bp, Homo sapiens
agatcccgtctccgaagaaaaga

SEQ ID NO: 1378365 - DNA, 16 bp, Homo sapiens
agatgatattacagga

SEQ ID NO: 1378366 - DNA, 18 bp, Homo sapiens
agatgatattacaggact

SEQ ID NO: 1378367 - DNA, 12 bp, Homo sapiens
agcactgctcca

SEQ ID NO: 1378368 - DNA, 22 bp, Homo sapiens
agcagagctgatggagaaggaa

SEQ ID NO: 1378369 - DNA, 23 bp, Homo sapiens
agcagagctgatggagaaggaag

SEQ ID NO: 1378370 - DNA, 23 bp, Homo sapiens
agccaggtgtggtagcaggcacc

SEQ ID NO: 1378371 - DNA, 19 bp, Homo sapiens
agctgatggagaaggaagg

SEQ ID NO: 1378372 - DNA, 16 bp, Homo sapiens
agcttgacattatgtt

SEQ ID NO: 1378373 - DNA, 20 bp, Homo sapiens
agcttgacattatgttttat

SEQ ID NO: 1378374 - DNA, 15 bp, Homo sapiens
agctttggttatgaa

SEQ ID NO: 1378375 - DNA, 22 bp, Homo sapiens
agcttttatgtgatatgtttta

SEQ ID NO: 1378376 - DNA, 16 bp, Homo sapiens
aggaaaacacctttat

SEQ ID NO: 1378377 - DNA, 14 bp, Homo sapiens
aggaaactgcttta

SEQ ID NO: 1378378 - DNA, 21 bp, Homo sapiens
aggaaactgctttatttttat

SEQ ID NO: 1378379 - DNA, 14 bp, Homo sapiens
aggaggcagagaag

SEQ ID NO: 1378380 - DNA, 15 bp, Homo sapiens
aggatatttcaaatg

SEQ ID NO: 1378381 - DNA, 17 bp, Homo sapiens
aggatatttcaaatgat

SEQ ID NO: 1378382 - DNA, 15 bp, Homo sapiens
aggcagagaagaaag

SEQ ID NO: 1378383 - DNA, 16 bp, Homo sapiens
aggccaaagaaggagg

SEQ ID NO: 1378384 - DNA, 13 bp, Homo sapiens
agggattgaagtt

SEQ ID NO: 1378385 - DNA, 19 bp, Homo sapiens
agggattgaagtttattat

SEQ ID NO: 1378386 - DNA, 20 bp, Homo sapiens
aggtggttttattttccctt

SEQ ID NO: 1378387 - DNA, 18 bp, Homo sapiens
agtatttatatttaaatt

SEQ ID NO: 1378388 - DNA, 22 bp, Homo sapiens
agtgaaactgcattatttgttg

SEQ ID NO: 1378389 - DNA, 19 bp, Homo sapiens
agtggtggtagaaatgatt

SEQ ID NO: 1378390 - DNA, 15 bp, Homo sapiens
agtgtattaagtgca

SEQ ID NO: 1378391 - DNA, 13 bp, Homo sapiens
agtgtttaaatgc

SEQ ID NO: 1378392 - DNA, 14 bp, Homo sapiens
agtgtttaaatgct

SEQ ID NO: 1378393 - DNA, 21 bp, Homo sapiens
agttaaaactggatggaaata

SEQ ID NO: 1378394 - DNA, 20 bp, Homo sapiens
agttatcagctctatgtcaa

SEQ ID NO: 1378395 - DNA, 15 bp, Homo sapiens
agtttattattttca

SEQ ID NO: 1378396 - DNA, 18 bp, Homo sapiens
agtttattattttcaaag

SEQ ID NO: 1378397 - DNA, 23 bp, Homo sapiens
agtttattattttcaaaggaaaa

SEQ ID NO: 1378398 - DNA, 14 bp, Homo sapiens
ataaaaaggaaata

SEQ ID NO: 1378399 - DNA, 16 bp, Homo sapiens
ataaaaaggaaatatt

SEQ ID NO: 1378400 - DNA, 13 bp, Homo sapiens
ataaaagtatgaa

SEQ ID NO: 1378401 - DNA, 14 bp, Homo sapiens
ataaaatattttaa

SEQ ID NO: 1378402 - DNA, 18 bp, Homo sapiens
ataaaggatatttcaaat

SEQ ID NO: 1378403 - DNA, 21 bp, Homo sapiens
ataagaggacactagatgata

SEQ ID NO: 1378404 - DNA, 13 bp, Homo sapiens
ataattttgaaat

SEQ ID NO: 1378405 - DNA, 17 bp, Homo sapiens
ataattttgaaatgatt

SEQ ID NO: 1378406 - DNA, 23 bp, Homo sapiens
ataattttgaaatgattcatctt

SEQ ID NO: 1378407 - DNA, 17 bp, Homo sapiens
atacacattatcactga

SEQ ID NO: 1378408 - DNA, 21 bp, Homo sapiens
atacacattatcactgaaaaa

SEQ ID NO: 1378409 - DNA, 18 bp, Homo sapiens
atagccagggattgaagt

SEQ ID NO: 1378410 - DNA, 19 bp, Homo sapiens
atagccatttggaagcttt

SEQ ID NO: 1378411 - DNA, 15 bp, Homo sapiens
atatatcataaagga

SEQ ID NO: 1378412 - DNA, 17 bp, Homo sapiens
atatatcataaaggata

SEQ ID NO: 1378413 - DNA, 21 bp, Homo sapiens
atatcataaaggatatttcaa

SEQ ID NO: 1378414 - DNA, 13 bp, Homo sapiens
atatccaaaattc

SEQ ID NO: 1378415 - DNA, 20 bp, Homo sapiens
atatgttttaaagttaaaac

SEQ ID NO: 1378416 - DNA, 21 bp, Homo sapiens
atattacaggactgcagaaca

SEQ ID NO: 1378417 - DNA, 11 bp, Homo sapiens
atatttaaatt

SEQ ID NO: 1378418 - DNA, 19 bp, Homo sapiens
atatttcaaatgattatga

SEQ ID NO: 1378419 - DNA, 22 bp, Homo sapiens
atatttttatttcattcacatt

SEQ ID NO: 1378420 - DNA, 12 bp, Homo sapiens
atcactgaaaaa

SEQ ID NO: 1378421 - DNA, 17 bp, Homo sapiens
atcaggaagagaaggag

SEQ ID NO: 1378422 - DNA, 14 bp, Homo sapiens
atcatatatcataa

SEQ ID NO: 1378423 - DNA, 15 bp, Homo sapiens
atctggattccagag

SEQ ID NO: 1378424 - DNA, 15 bp, Homo sapiens
atcttctctatattt

SEQ ID NO: 1378425 - DNA, 17 bp, Homo sapiens
atcttctctatattttt

SEQ ID NO: 1378426 - DNA, 16 bp, Homo sapiens
atcttgatttcccaaa

SEQ ID NO: 1378427 - DNA, 19 bp, Homo sapiens
atgaaaaaatgttcaaatt

SEQ ID NO: 1378428 - DNA, 17 bp, Homo sapiens
atgattagttatgtctt

SEQ ID NO: 1378429 - DNA, 21 bp, Homo sapiens
atgattagttatgtcttttaa

SEQ ID NO: 1378430 - DNA, 17 bp, Homo sapiens
atgattcatctttcaga

SEQ ID NO: 1378431 - DNA, 22 bp, Homo sapiens
atgctttgataaaatattttaa

SEQ ID NO: 1378432 - DNA, 12 bp, Homo sapiens
atggagaaggaa

SEQ ID NO: 1378433 - DNA, 14 bp, Homo sapiens
atggagaaggaagg

SEQ ID NO: 1378434 - DNA, 20 bp, Homo sapiens
atgtcaattgatatttctgt

SEQ ID NO: 1378435 - DNA, 22 bp, Homo sapiens
atgtcttttaataaaaaggaaa

SEQ ID NO: 1378436 - DNA, 18 bp, Homo sapiens
atgttcatatagccaggg

SEQ ID NO: 1378437 - DNA, 19 bp, Homo sapiens
atgttttaaagttaaaact

SEQ ID NO: 1378438 - DNA, 19 bp, Homo sapiens
atgttttatttaaatgctt

SEQ ID NO: 1378439 - DNA, 20 bp, Homo sapiens
atgttttatttaaatgcttt

SEQ ID NO: 1378440 - DNA, 20 bp, Homo sapiens
attaatgagaagagttttct

SEQ ID NO: 1378441 - DNA, 22 bp, Homo sapiens
attaatgagaagagttttctca

SEQ ID NO: 1378442 - DNA, 14 bp, Homo sapiens
attagttatgtctt

SEQ ID NO: 1378443 - DNA, 15 bp, Homo sapiens
attatatttaccttt

SEQ ID NO: 1378444 - DNA, 16 bp, Homo sapiens
attatgaaaaaatgtt

SEQ ID NO: 1378445 - DNA, 21 bp, Homo sapiens
attatgaaaaaatgttcaaat

SEQ ID NO: 1378446 - DNA, 22 bp, Homo sapiens
attatgaaaaaatgttcaaatt

SEQ ID NO: 1378447 - DNA, 21 bp, Homo sapiens
attatgttttatttaaatgct

SEQ ID NO: 1378448 - DNA, 22 bp, Homo sapiens
attatgttttatttaaatgctt

SEQ ID NO: 1378449 - DNA, 14 bp, Homo sapiens
attcacattaatga

SEQ ID NO: 1378450 - DNA, 17 bp, Homo sapiens
attcacgttctagtgaa

SEQ ID NO: 1378451 - DNA, 20 bp, Homo sapiens
attcacgttctagtgaaact

SEQ ID NO: 1378452 - DNA, 19 bp, Homo sapiens
attcagggctttaaacatg

SEQ ID NO: 1378453 - DNA, 16 bp, Homo sapiens
attcatctttcagaaa

SEQ ID NO: 1378454 - DNA, 17 bp, Homo sapiens
attccagagcactgctc

SEQ ID NO: 1378455 - DNA, 21 bp, Homo sapiens
attgaagtttattattttcaa

SEQ ID NO: 1378456 - DNA, 22 bp, Homo sapiens
attgaagtttattattttcaaa

SEQ ID NO: 1378457 - DNA, 14 bp, Homo sapiens
atttaaatgctttt

SEQ ID NO: 1378458 - DNA, 15 bp, Homo sapiens
atttaaattatattt

SEQ ID NO: 1378459 - DNA, 14 bp, Homo sapiens
atttatatttaaat

SEQ ID NO: 1378460 - DNA, 12 bp, Homo sapiens
atttctgtgtag

SEQ ID NO: 1378461 - DNA, 20 bp, Homo sapiens
atttctgtgtagtatttata

SEQ ID NO: 1378462 - DNA, 15 bp, Homo sapiens
attttacaaatatta

SEQ ID NO: 1378463 - DNA, 19 bp, Homo sapiens
attttacaaatattaagaa

SEQ ID NO: 1378464 - DNA, 14 bp, Homo sapiens
attttcaaaggaaa

SEQ ID NO: 1378465 - DNA, 22 bp, Homo sapiens
tgaccctccaccgcagaaggaa

SEQ ID NO: 1378466 - DNA, 21 bp, Homo sapiens
tgactcgagtgtttaaatgct

SEQ ID NO: 1378467 - DNA, 18 bp, Homo sapiens
tgagatcccgtctccgaa

SEQ ID NO: 1378468 - DNA, 12 bp, Homo sapiens
tgataaaatatt

SEQ ID NO: 1378469 - DNA, 13 bp, Homo sapiens
tgatatgttttaa

SEQ ID NO: 1378470 - DNA, 19 bp, Homo sapiens
tgatatttctgtgtagtat

SEQ ID NO: 1378471 - DNA, 19 bp, Homo sapiens
tgatcatatatcataaagg

SEQ ID NO: 1378472 - DNA, 12 bp, Homo sapiens
tgatggagaagg

SEQ ID NO: 1378473 - DNA, 16 bp, Homo sapiens
tgatggagaaggaagg

SEQ ID NO: 1378474 - DNA, 17 bp, Homo sapiens
tgatggagaaggaaggc

SEQ ID NO: 1378475 - DNA, 14 bp, Homo sapiens
tgattcatctttca

SEQ ID NO: 1378476 - DNA, 17 bp, Homo sapiens
tgattcatctttcagaa

SEQ ID NO: 1378477 - DNA, 18 bp, Homo sapiens
tgattcatctttcagaaa

SEQ ID NO: 1378478 - DNA, 20 bp, Homo sapiens
tgatttcccaaaaacactaa

SEQ ID NO: 1378479 - DNA, 22 bp, Homo sapiens
tgcattatttgttgactagatg

SEQ ID NO: 1378480 - DNA, 22 bp, Homo sapiens
tgcatttagtggtggtagaaat

SEQ ID NO: 1378481 - DNA, 18 bp, Homo sapiens
tgcctgacaattatgaaa

SEQ ID NO: 1378482 - DNA, 19 bp, Homo sapiens
tgcctgacaattatgaaaa

SEQ ID NO: 1378483 - DNA, 20 bp, Homo sapiens
tgcctgacaattatgaaaaa

SEQ ID NO: 1378484 - DNA, 21 bp, Homo sapiens
tggaagctttggttatgaaac

SEQ ID NO: 1378485 - DNA, 12 bp, Homo sapiens
tggagaaggaag

SEQ ID NO: 1378486 - DNA, 17 bp, Homo sapiens
tggtggtagaaatgatt

SEQ ID NO: 1378487 - DNA, 17 bp, Homo sapiens
tggttatgaaacatgtg

SEQ ID NO: 1378488 - DNA, 18 bp, Homo sapiens
tgtacaacaatgctttga

SEQ ID NO: 1378489 - DNA, 21 bp, Homo sapiens
tgtacaacaatgctttgataa

SEQ ID NO: 1378490 - DNA, 19 bp, Homo sapiens
tgtataagtccatgaatgt

SEQ ID NO: 1378491 - DNA, 24 bp, Homo sapiens
tgtataagtccatgaatgttcata

SEQ ID NO: 1378492 - DNA, 23 bp, Homo sapiens
tgtattaagtgcagcttgacatt

SEQ ID NO: 1378493 - DNA, 13 bp, Homo sapiens
tgtcaattgatat

SEQ ID NO: 1378494 - DNA, 15 bp, Homo sapiens
tgtcttttaataaaa

SEQ ID NO: 1378495 - DNA, 19 bp, Homo sapiens
tgtgaatcttaacattttg

SEQ ID NO: 1378496 - DNA, 14 bp, Homo sapiens
tgtgatatgtttta

SEQ ID NO: 1378497 - DNA, 15 bp, Homo sapiens
tgtgatatgttttaa

SEQ ID NO: 1378498 - DNA, 23 bp, Homo sapiens
tgttcaaattcacgttctagtga

SEQ ID NO: 1378499 - DNA, 12 bp, Homo sapiens
tgtttaaatgct

SEQ ID NO: 1378500 - DNA, 16 bp, Homo sapiens
tgtttaaatgctgtgt

SEQ ID NO: 1378501 - DNA, 13 bp, Homo sapiens
tgttttatttaaa

SEQ ID NO: 1378502 - DNA, 14 bp, Homo sapiens
tgttttatttaaat

SEQ ID NO: 1378503 - DNA, 13 bp, Homo sapiens
ttaaacatgatta

SEQ ID NO: 1378504 - DNA, 18 bp, Homo sapiens
ttaaacatgattatcttg

SEQ ID NO: 1378505 - DNA, 16 bp, Homo sapiens
ttaaagttaaaactgg

SEQ ID NO: 1378506 - DNA, 21 bp, Homo sapiens
ttaagaaaatattctaacatt

SEQ ID NO: 1378507 - DNA, 17 bp, Homo sapiens
ttaagtatgagttatca

SEQ ID NO: 1378508 - DNA, 17 bp, Homo sapiens
ttaataaaaaggaaata

SEQ ID NO: 1378509 - DNA, 15 bp, Homo sapiens
ttaatgagaagagtt

SEQ ID NO: 1378510 - DNA, 15 bp, Homo sapiens
ttacaaatattaaga

SEQ ID NO: 1378511 - DNA, 21 bp, Homo sapiens
ttagtggtggtagaaatgatt

SEQ ID NO: 1378512 - DNA, 16 bp, Homo sapiens
ttatcactgaaaaaat

SEQ ID NO: 1378513 - DNA, 14 bp, Homo sapiens
ttatgaaaaaatgt

SEQ ID NO: 1378514 - DNA, 20 bp, Homo sapiens
ttatgattagttatgtcttt

SEQ ID NO: 1378515 - DNA, 13 bp, Homo sapiens
ttatgtgatatgt

SEQ ID NO: 1378516 - DNA, 12 bp, Homo sapiens
ttattattttca

SEQ ID NO: 1378517 - DNA, 13 bp, Homo sapiens
ttatttaaatgct

SEQ ID NO: 1378518 - DNA, 15 bp, Homo sapiens
ttatttaaatgcttt

SEQ ID NO: 1378519 - DNA, 16 bp, Homo sapiens
ttatttaaatgctttt

SEQ ID NO: 1378520 - DNA, 12 bp, Homo sapiens
ttattttacaaa

SEQ ID NO: 1378521 - DNA, 16 bp, Homo sapiens
ttattttcaaaggaaa

SEQ ID NO: 1378522 - DNA, 18 bp, Homo sapiens
ttattttcccttcatgtt

SEQ ID NO: 1378523 - DNA, 23 bp, Homo sapiens
ttattttttttcaaaatgaagat

SEQ ID NO: 1378524 - DNA, 14 bp, Homo sapiens
ttcatctttcagaa

SEQ ID NO: 1378525 - DNA, 23 bp, Homo sapiens
ttcatctttcagaaataaaagta

SEQ ID NO: 1378526 - DNA, 18 bp, Homo sapiens
ttcctaaggaaactgctt

SEQ ID NO: 1378527 - DNA, 12 bp, Homo sapiens
ttctaacatttg

SEQ ID NO: 1378528 - DNA, 17 bp, Homo sapiens
ttctcagagattaaaaa

SEQ ID NO: 1378529 - DNA, 18 bp, Homo sapiens
ttctcagagattaaaaaa

SEQ ID NO: 1378530 - DNA, 13 bp, Homo sapiens
ttctgtcattgtt

SEQ ID NO: 1378531 - DNA, 22 bp, Homo sapiens
ttctgtgtagtatttatattta

SEQ ID NO: 1378532 - DNA, 19 bp, Homo sapiens
ttgaagtttattattttca

SEQ ID NO: 1378533 - DNA, 14 bp, Homo sapiens
ttgatatttctgtg

SEQ ID NO: 1378534 - DNA, 22 bp, Homo sapiens
ttggaagctttggttatgaaac

SEQ ID NO: 1378535 - DNA, 18 bp, Homo sapiens
ttgtataagtccatgaat

SEQ ID NO: 1378536 - DNA, 21 bp, Homo sapiens
ttgtataagtccatgaatgtt

SEQ ID NO: 1378537 - DNA, 16 bp, Homo sapiens
ttgttaaatacacatt

SEQ ID NO: 1378538 - DNA, 16 bp, Homo sapiens
ttgttcaccagtgctt

SEQ ID NO: 1378539 - DNA, 18 bp, Homo sapiens
tttagtggtggtagaaat

SEQ ID NO: 1378540 - DNA, 19 bp, Homo sapiens
tttagtggtggtagaaatg

SEQ ID NO: 1378541 - DNA, 13 bp, Homo sapiens
tttataaaactgc

SEQ ID NO: 1378542 - DNA, 17 bp, Homo sapiens
tttatgtgatatgtttt

SEQ ID NO: 1378543 - DNA, 15 bp, Homo sapiens
tttatttaaatgctt

SEQ ID NO: 1378544 - DNA, 18 bp, Homo sapiens
tttattttttttcaaaat

SEQ ID NO: 1378545 - DNA, 12 bp, Homo sapiens
tttcaaatgatt

SEQ ID NO: 1378546 - DNA, 22 bp, Homo sapiens
tttcagaaataaaagtatgaat

SEQ ID NO: 1378547 - DNA, 14 bp, Homo sapiens
tttcctaaggaaac

SEQ ID NO: 1378548 - DNA, 18 bp, Homo sapiens
tttctcagagattaaaaa

SEQ ID NO: 1378549 - DNA, 15 bp, Homo sapiens
tttgttttcatttgt

SEQ ID NO: 1378550 - DNA, 21 bp, Homo sapiens
ttttaataaaaaggaaatatt

SEQ ID NO: 1378551 - DNA, 14 bp, Homo sapiens
ttttatgtgatatg

SEQ ID NO: 1378552 - DNA, 16 bp, Homo sapiens
ttttcccttcatgttt

SEQ ID NO: 1378553 - DNA, 16 bp, Homo sapiens
ttttcctaaggaaact

SEQ ID NO: 1378554 - DNA, 20 bp, Homo sapiens
ttttcctaaggaaactgctt

SEQ ID NO: 1378555 - DNA, 22 bp, Homo sapiens
ttttctgtcattgttaaataca

SEQ ID NO: 1378556 - DNA, 13 bp, Homo sapiens
ttttgaaatgatt

SEQ ID NO: 1378557 - DNA, 18 bp, Homo sapiens
ttttgaaatgattcatct

SEQ ID NO: 1378558 - DNA, 13 bp, Homo sapiens
tttttataaaact

SEQ ID NO: 1378559 - DNA, 21 bp, Homo sapiens
tttttgcttattttacaaata

SEQ ID NO: 1378560 - DNA, 13 bp, Homo sapiens
ttttttttcaaaa

SEQ ID NO: 1378561 - DNA, 11 bp, Homo sapiens
aaaaaggaaat

SEQ ID NO: 1378562 - DNA, 19 bp, Homo sapiens
aaaaaggaaatatttttca

SEQ ID NO: 1378563 - DNA, 14 bp, Homo sapiens
aaaaatgttcaaat

SEQ ID NO: 1378564 - DNA, 22 bp, Homo sapiens
aaaactgcctgacaattatgaa

SEQ ID NO: 1378565 - DNA, 22 bp, Homo sapiens
aaaaggtagtttttctgtcatt

SEQ ID NO: 1378566 - DNA, 19 bp, Homo sapiens
aaaatattctaacatttga

SEQ ID NO: 1378567 - DNA, 19 bp, Homo sapiens
aaactgcctgacaattatg

SEQ ID NO: 1378568 - DNA, 20 bp, Homo sapiens
aaactgcctgacaattatga

SEQ ID NO: 1378569 - DNA, 18 bp, Homo sapiens
aaaggaaaacacctttat

SEQ ID NO: 1378570 - DNA, 16 bp, Homo sapiens
aaaggaaatatttttc

SEQ ID NO: 1378571 - DNA, 17 bp, Homo sapiens
aaaggaaatatttttca

SEQ ID NO: 1378572 - DNA, 20 bp, Homo sapiens
aaaggatatttcaaatgatt

SEQ ID NO: 1378573 - DNA, 17 bp, Homo sapiens
aaaggtggttttatttt

SEQ ID NO: 1378574 - DNA, 16 bp, Homo sapiens
aaatattttaagtatg

SEQ ID NO: 1378575 - DNA, 15 bp, Homo sapiens
aaatatttttcaact

SEQ ID NO: 1378576 - DNA, 16 bp, Homo sapiens
aaatatttttcaactt

SEQ ID NO: 1378577 - DNA, 18 bp, Homo sapiens
aaatgaagatacacatta

SEQ ID NO: 1378578 - DNA, 16 bp, Homo sapiens
aaatgattcatctttc

SEQ ID NO: 1378579 - DNA, 21 bp, Homo sapiens
aaatgattcatctttcagaaa

SEQ ID NO: 1378580 - DNA, 19 bp, Homo sapiens
aaatgtagcttttatgtga

SEQ ID NO: 1378581 - DNA, 15 bp, Homo sapiens
aacatgattatcttg

SEQ ID NO: 1378582 - DNA, 14 bp, Homo sapiens
aacggaagaagaga

SEQ ID NO: 1378583 - DNA, 14 bp, Homo sapiens
aactatcttctcta

SEQ ID NO: 1378584 - DNA, 19 bp, Homo sapiens
aactatcttctctatattt

SEQ ID NO: 1378585 - DNA, 19 bp, Homo sapiens
aactcttcaaggtctgctt

SEQ ID NO: 1378586 - DNA, 19 bp, Homo sapiens
aactgctttatttttataa

SEQ ID NO: 1378587 - DNA, 14 bp, Homo sapiens
aactggatggaaat

SEQ ID NO: 1378588 - DNA, 16 bp, Homo sapiens
aactggatggaaatag

SEQ ID NO: 1378589 - DNA, 20 bp, Homo sapiens
aagaaaagatatgtattcta

SEQ ID NO: 1378590 - DNA, 11 bp, Homo sapiens
aagaaaatatt

SEQ ID NO: 1378591 - DNA, 15 bp, Homo sapiens
aagaaaatattctaa

SEQ ID NO: 1378592 - DNA, 16 bp, Homo sapiens
aagaaagaacggaaga

SEQ ID NO: 1378593 - DNA, 13 bp, Homo sapiens
aagagaaggagca

SEQ ID NO: 1378594 - DNA, 18 bp, Homo sapiens
aagatatgtattctaatt

SEQ ID NO: 1378595 - DNA, 22 bp, Homo sapiens
aaggaaactgctttatttttat

SEQ ID NO: 1378596 - DNA, 23 bp, Homo sapiens
aaggagcagagctgatggagaag

SEQ ID NO: 1378597 - DNA, 19 bp, Homo sapiens
aaggcagggaggaggcaga

SEQ ID NO: 1378598 - DNA, 12 bp, Homo sapiens
aaggtctgcttt

SEQ ID NO: 1378599 - DNA, 16 bp, Homo sapiens
aagtttattattttca

SEQ ID NO: 1378600 - DNA, 14 bp, Homo sapiens
aatattaagaaaat

SEQ ID NO: 1378601 - DNA, 15 bp, Homo sapiens
aatattaagaaaata

SEQ ID NO: 1378602 - DNA, 19 bp, Homo sapiens
aatattaagaaaatattct

SEQ ID NO: 1378603 - DNA, 13 bp, Homo sapiens
aatatttttcaac

SEQ ID NO: 1378604 - DNA, 15 bp, Homo sapiens
aatgagaagagtttt

SEQ ID NO: 1378605 - DNA, 18 bp, Homo sapiens
aatgattcatctttcaga

SEQ ID NO: 1378606 - DNA, 19 bp, Homo sapiens
aatgctttgataaaatatt

SEQ ID NO: 1378607 - DNA, 20 bp, Homo sapiens
aatgtagcttttatgtgata

SEQ ID NO: 1378608 - DNA, 19 bp, Homo sapiens
aatgttcatatagccaggg

SEQ ID NO: 1378609 - DNA, 16 bp, Homo sapiens
aattatatttaccttt

SEQ ID NO: 1378610 - DNA, 18 bp, Homo sapiens
aattatgaaaaaatgttc

SEQ ID NO: 1378611 - DNA, 19 bp, Homo sapiens
aattatgaaaaaatgttca

SEQ ID NO: 1378612 - DNA, 11 bp, Homo sapiens
aattgatattt

SEQ ID NO: 1378613 - DNA, 14 bp, Homo sapiens
aatttgttttcatt

SEQ ID NO: 1378614 - DNA, 16 bp, Homo sapiens
acaattatgaaaaaat

SEQ ID NO: 1378615 - DNA, 21 bp, Homo sapiens
acaattatgaaaaaatgttca

SEQ ID NO: 1378616 - DNA, 23 bp, Homo sapiens
acacattatcactgaaaaaatgt

SEQ ID NO: 1378617 - DNA, 14 bp, Homo sapiens
acacctttatttta

SEQ ID NO: 1378618 - DNA, 14 bp, Homo sapiens
acagcttagtgaga

SEQ ID NO: 1378619 - DNA, 20 bp, Homo sapiens
acagtccctttggacaaatg

SEQ ID NO: 1378620 - DNA, 21 bp, Homo sapiens
acattaatgagaagagttttc

SEQ ID NO: 1378621 - DNA, 19 bp, Homo sapiens
acattatcactgaaaaaat

SEQ ID NO: 1378622 - DNA, 14 bp, Homo sapiens
acattatgttttat

SEQ ID NO: 1378623 - DNA, 19 bp, Homo sapiens
acattatgttttatttaaa

SEQ ID NO: 1378624 - DNA, 18 bp, Homo sapiens
accctccaccgcagaagg

SEQ ID NO: 1378625 - DNA, 13 bp, Homo sapiens
accgcagaaggaa

SEQ ID NO: 1378626 - DNA, 18 bp, Homo sapiens
actaaaggtggttttatt

SEQ ID NO: 1378627 - DNA, 13 bp, Homo sapiens
actcgagtgttta

SEQ ID NO: 1378628 - DNA, 19 bp, Homo sapiens
actcgagtgtttaaatgct

SEQ ID NO: 1378629 - DNA, 19 bp, Homo sapiens
actcttcaaggtctgcttt

SEQ ID NO: 1378630 - DNA, 21 bp, Homo sapiens
acttattgttgctgaaaactc

SEQ ID NO: 1378631 - DNA, 23 bp, Homo sapiens
acttcttctatatccaaaattca

SEQ ID NO: 1378632 - DNA, 16 bp, Homo sapiens
acttgcagatgaaaaa

SEQ ID NO: 1378633 - DNA, 20 bp, Homo sapiens
agaaagaacggaagaagaga

SEQ ID NO: 1378634 - DNA, 12 bp, Homo sapiens
agaacggaagaa

SEQ ID NO: 1378635 - DNA, 18 bp, Homo sapiens
agaagaaagaacggaaga

SEQ ID NO: 1378636 - DNA, 17 bp, Homo sapiens
agaagagatcaggaaga

SEQ ID NO: 1378637 - DNA, 15 bp, Homo sapiens
agagatcaggaagag

SEQ ID NO: 1378638 - DNA, 13 bp, Homo sapiens
agagattaaaaaa

SEQ ID NO: 1378639 - DNA, 22 bp, Homo sapiens
agagattaaaaaaggtagtttt

SEQ ID NO: 1378640 - DNA, 16 bp, Homo sapiens
agagcactgctccagt

SEQ ID NO: 1378641 - DNA, 13 bp, Homo sapiens
agatcaggaagag

SEQ ID NO: 1378642 - DNA, 17 bp, Homo sapiens
agatcaggaagagaagg

SEQ ID NO: 1378643 - DNA, 18 bp, Homo sapiens
agatcaggaagagaagga

SEQ ID NO: 1378644 - DNA, 19 bp, Homo sapiens
agatgatattacaggactg

SEQ ID NO: 1378645 - DNA, 22 bp, Homo sapiens
agattaaaaaaggtagtttttc

SEQ ID NO: 1378646 - DNA, 16 bp, Homo sapiens
agcacaataatttgtt

SEQ ID NO: 1378647 - DNA, 21 bp, Homo sapiens
agcacaataatttgttttcat

SEQ ID NO: 1378648 - DNA, 19 bp, Homo sapiens
agcagagctgatggagaag

SEQ ID NO: 1378649 - DNA, 21 bp, Homo sapiens
agcagagctgatggagaagga

SEQ ID NO: 1378650 - DNA, 17 bp, Homo sapiens
agcttgacattatgttt

SEQ ID NO: 1378651 - DNA, 19 bp, Homo sapiens
agcttgacattatgtttta

SEQ ID NO: 1378652 - DNA, 16 bp, Homo sapiens
agctttggttatgaaa

SEQ ID NO: 1378653 - DNA, 15 bp, Homo sapiens
agcttttatgtgata

SEQ ID NO: 1378654 - DNA, 21 bp, Homo sapiens
agcttttatgtgatatgtttt

SEQ ID NO: 1378655 - DNA, 12 bp, Homo sapiens
aggaaactgctt

SEQ ID NO: 1378656 - DNA, 15 bp, Homo sapiens
aggaaactgctttat

SEQ ID NO: 1378657 - DNA, 12 bp, Homo sapiens
aggaagagaagg

SEQ ID NO: 1378658 - DNA, 14 bp, Homo sapiens
aggaagagaaggag

SEQ ID NO: 1378659 - DNA, 16 bp, Homo sapiens
aggaagagaaggagca

SEQ ID NO: 1378660 - DNA, 17 bp, Homo sapiens
aggaagagaaggagcag

SEQ ID NO: 1378661 - DNA, 16 bp, Homo sapiens
aggaaggcagggagga

SEQ ID NO: 1378662 - DNA, 23 bp, Homo sapiens
aggagcacaataatttgttttca

SEQ ID NO: 1378663 - DNA, 14 bp, Homo sapiens
aggaggatggcttg

SEQ ID NO: 1378664 - DNA, 14 bp, Homo sapiens
aggatatttcaaat

SEQ ID NO: 1378665 - DNA, 13 bp, Homo sapiens
aggcagagaagaa

SEQ ID NO: 1378666 - DNA, 14 bp, Homo sapiens
aggcagagaagaaa

SEQ ID NO: 1378667 - DNA, 20 bp, Homo sapiens
agggaggaggcagagaagaa

SEQ ID NO: 1378668 - DNA, 15 bp, Homo sapiens
aggtccaatgttgtt

SEQ ID NO: 1378669 - DNA, 22 bp, Homo sapiens
aggtgactcgagtgtttaaatg

SEQ ID NO: 1378670 - DNA, 17 bp, Homo sapiens
aggtgtggtagcaggca

SEQ ID NO: 1378671 - DNA, 21 bp, Homo sapiens
agtatttatatttaaattata

SEQ ID NO: 1378672 - DNA, 23 bp, Homo sapiens
atctttcagaaataaaagtatga

SEQ ID NO: 1378673 - DNA, 22 bp, Homo sapiens
atgaaacatgtggagtgtatta

SEQ ID NO: 1378674 - DNA, 14 bp, Homo sapiens
atgaagatacacat

SEQ ID NO: 1378675 - DNA, 17 bp, Homo sapiens
atgacttgcagatgaaa

SEQ ID NO: 1378676 - DNA, 13 bp, Homo sapiens
atgagaagagttt

SEQ ID NO: 1378677 - DNA, 20 bp, Homo sapiens
atgattcatctttcagaaat

SEQ ID NO: 1378678 - DNA, 23 bp, Homo sapiens
atgcatttagtggtggtagaaat

SEQ ID NO: 1378679 - DNA, 21 bp, Homo sapiens
atgctgtgtacaacaatgctt

SEQ ID NO: 1378680 - DNA, 23 bp, Homo sapiens
atgctgtgtacaacaatgctttg

SEQ ID NO: 1378681 - DNA, 13 bp, Homo sapiens
atgctttgataaa

SEQ ID NO: 1378682 - DNA, 20 bp, Homo sapiens
atggaaatagccatttggaa

SEQ ID NO: 1378683 - DNA, 19 bp, Homo sapiens
atgtagcttttatgtgata

SEQ ID NO: 1378684 - DNA, 13 bp, Homo sapiens
atgtcaattgata

SEQ ID NO: 1378685 - DNA, 22 bp, Homo sapiens
atgtcaattgatatttctgtgt

SEQ ID NO: 1378686 - DNA, 14 bp, Homo sapiens
atgtgatatgtttt

SEQ ID NO: 1378687 - DNA, 16 bp, Homo sapiens
atgtgatatgttttaa

SEQ ID NO: 1378688 - DNA, 16 bp, Homo sapiens
atgttttatttaaatg

SEQ ID NO: 1378689 - DNA, 18 bp, Homo sapiens
atgttttatttaaatgct

SEQ ID NO: 1378690 - DNA, 12 bp, Homo sapiens
attaagaaaata

SEQ ID NO: 1378691 - DNA, 18 bp, Homo sapiens
attaagaaaatattctaa

SEQ ID NO: 1378692 - DNA, 21 bp, Homo sapiens
attaatgagaagagttttctc

SEQ ID NO: 1378693 - DNA, 13 bp, Homo sapiens
attacagccaggt

SEQ ID NO: 1378694 - DNA, 15 bp, Homo sapiens
attagttatgtcttt

SEQ ID NO: 1378695 - DNA, 19 bp, Homo sapiens
attatgaaaaaatgttcaa

SEQ ID NO: 1378696 - DNA, 12 bp, Homo sapiens
attatgattagt

SEQ ID NO: 1378697 - DNA, 23 bp, Homo sapiens
attatgttttatttaaatgcttt

SEQ ID NO: 1378698 - DNA, 19 bp, Homo sapiens
attcacgttctagtgaaac

SEQ ID NO: 1378699 - DNA, 23 bp, Homo sapiens
attcacgttctagtgaaactgca

SEQ ID NO: 1378700 - DNA, 13 bp, Homo sapiens
attcatctttcag

SEQ ID NO: 1378701 - DNA, 15 bp, Homo sapiens
attcatctttcagaa

SEQ ID NO: 1378702 - DNA, 19 bp, Homo sapiens
attcatctttcagaaataa

SEQ ID NO: 1378703 - DNA, 16 bp, Homo sapiens
attctaacatttgata

SEQ ID NO: 1378704 - DNA, 21 bp, Homo sapiens
attctaattggcagattgttt

SEQ ID NO: 1378705 - DNA, 20 bp, Homo sapiens
attgaagtttattattttca

SEQ ID NO: 1378706 - DNA, 14 bp, Homo sapiens
attgatatttctgt

SEQ ID NO: 1378707 - DNA, 16 bp, Homo sapiens
attggcagattgtttt

SEQ ID NO: 1378708 - DNA, 17 bp, Homo sapiens
attgttaaatacacatt

SEQ ID NO: 1378709 - DNA, 18 bp, Homo sapiens
attgttaaatacacatta

SEQ ID NO: 1378710 - DNA, 20 bp, Homo sapiens
attgttttttcctaaggaaa

SEQ ID NO: 1378711 - DNA, 23 bp, Homo sapiens
atttaaatgctttttatcgctaa

SEQ ID NO: 1378712 - DNA, 12 bp, Homo sapiens
atttaaattata

SEQ ID NO: 1378713 - DNA, 18 bp, Homo sapiens
atttacctttttgcttat

SEQ ID NO: 1378714 - DNA, 23 bp, Homo sapiens
atttagtggtggtagaaatgatt

SEQ ID NO: 1378715 - DNA, 13 bp, Homo sapiens
atttcaaatgatt

SEQ ID NO: 1378716 - DNA, 21 bp, Homo sapiens
atttcattcacattaatgaga

SEQ ID NO: 1378717 - DNA, 14 bp, Homo sapiens
atttcccaaaaaca

SEQ ID NO: 1378718 - DNA, 12 bp, Homo sapiens
attttacaaata

SEQ ID NO: 1378719 - DNA, 20 bp, Homo sapiens
attttacaaatattaagaaa

SEQ ID NO: 1378720 - DNA, 16 bp, Homo sapiens
attttattttttttca

SEQ ID NO: 1378721 - DNA, 17 bp, Homo sapiens
attttcccttcatgttt

SEQ ID NO: 1378722 - DNA, 18 bp, Homo sapiens
attttcccttcatgtttt

SEQ ID NO: 1378723 - DNA, 14 bp, Homo sapiens
attttgaaatgatt

SEQ ID NO: 1378724 - DNA, 21 bp, Homo sapiens
attttgaaatgattcatcttt

SEQ ID NO: 1378725 - DNA, 23 bp, Homo sapiens
attttgaaatgattcatctttca

SEQ ID NO: 1378726 - DNA, 12 bp, Homo sapiens
atttttataaaa

SEQ ID NO: 1378727 - DNA, 13 bp, Homo sapiens
atttttataaaac

SEQ ID NO: 1378728 - DNA, 14 bp, Homo sapiens
atttttatttcatt

SEQ ID NO: 1378729 - DNA, 15 bp, Homo sapiens
attttttttcaaaat

SEQ ID NO: 1378730 - DNA, 12 bp, Homo sapiens
caaaatgaagat

SEQ ID NO: 1378731 - DNA, 21 bp, Homo sapiens
caaaggaaaacacctttattt

SEQ ID NO: 1378732 - DNA, 14 bp, Homo sapiens
caaggtctgctttt

SEQ ID NO: 1378733 - DNA, 19 bp, Homo sapiens
caatgctttgataaaatat

SEQ ID NO: 1378734 - DNA, 22 bp, Homo sapiens
caatgctttgataaaatatttt

SEQ ID NO: 1378735 - DNA, 18 bp, Homo sapiens
caattatgaaaaaatgtt

SEQ ID NO: 1378736 - DNA, 23 bp, Homo sapiens
caattatgaaaaaatgttcaaat

SEQ ID NO: 1378737 - DNA, 14 bp, Homo sapiens
caattgatatttct

SEQ ID NO: 1378738 - DNA, 18 bp, Homo sapiens
caattgatatttctgtgt

SEQ ID NO: 1378739 - DNA, 16 bp, Homo sapiens
cacagactctgctagt

SEQ ID NO: 1378740 - DNA, 17 bp, Homo sapiens
caccagtgcttgcttgt

SEQ ID NO: 1378741 - DNA, 15 bp, Homo sapiens
caccgcagaaggaag

SEQ ID NO: 1378742 - DNA, 15 bp, Homo sapiens
cacgttctagtgaaa

SEQ ID NO: 1378743 - DNA, 15 bp, Homo sapiens
cagaaggaaggcagg

SEQ ID NO: 1378744 - DNA, 14 bp, Homo sapiens
cagagaagaaagaa

SEQ ID NO: 1378745 - DNA, 19 bp, Homo sapiens
cagagaagaaagaacggaa

SEQ ID NO: 1378746 - DNA, 14 bp, Homo sapiens
cagagattaaaaaa

SEQ ID NO: 1378747 - DNA, 15 bp, Homo sapiens
cagagcactgctcca

SEQ ID NO: 1378748 - DNA, 20 bp, Homo sapiens
cagatgctatcacagactct

SEQ ID NO: 1378749 - DNA, 14 bp, Homo sapiens
cagctctatgtcaa

SEQ ID NO: 1378750 - DNA, 19 bp, Homo sapiens
cagcttgacattatgtttt

SEQ ID NO: 1378751 - DNA, 23 bp, Homo sapiens
caggagttcaagaccagcctgga

SEQ ID NO: 1378752 - DNA, 21 bp, Homo sapiens
cagggaggaggcagagaagaa

SEQ ID NO: 1378753 - DNA, 15 bp, Homo sapiens
cagtccctttggaca

SEQ ID NO: 1378754 - DNA, 18 bp, Homo sapiens
cataaaggatatttcaaa

SEQ ID NO: 1378755 - DNA, 19 bp, Homo sapiens
catatatcataaaggatat

SEQ ID NO: 1378756 - DNA, 13 bp, Homo sapiens
catctttcagaaa

SEQ ID NO: 1378757 - DNA, 21 bp, Homo sapiens
catgattggtttctaggcagt

SEQ ID NO: 1378758 - DNA, 12 bp, Homo sapiens
cattaatgagaa

SEQ ID NO: 1378759 - DNA, 20 bp, Homo sapiens
cattatcactgaaaaaatgt

SEQ ID NO: 1378760 - DNA, 13 bp, Homo sapiens
cattatgttttat

SEQ ID NO: 1378761 - DNA, 16 bp, Homo sapiens
cattatgttttattta

SEQ ID NO: 1378762 - DNA, 22 bp, Homo sapiens
catttagtggtggtagaaatga

SEQ ID NO: 1378763 - DNA, 15 bp, Homo sapiens
ccaccgcagaaggaa

SEQ ID NO: 1378764 - DNA, 19 bp, Homo sapiens
ccctccaccgcagaaggaa

SEQ ID NO: 1378765 - DNA, 16 bp, Homo sapiens
ccgtctccgaagaaaa

SEQ ID NO: 1378766 - DNA, 11 bp, Homo sapiens
cctaaggaaac

SEQ ID NO: 1378767 - DNA, 15 bp, Homo sapiens
cctgacaattatgaa

SEQ ID NO: 1378768 - DNA, 22 bp, Homo sapiens
cctgacaattatgaaaaaatgt

SEQ ID NO: 1378769 - DNA, 23 bp, Homo sapiens
cctgaccctccaccgcagaagga

SEQ ID NO: 1378770 - DNA, 19 bp, Homo sapiens
cctttttgcttattttaca

SEQ ID NO: 1378771 - DNA, 23 bp, Homo sapiens
cgaagaaaagatatgtattctaa

SEQ ID NO: 1378772 - DNA, 16 bp, Homo sapiens
cgagtgtttaaatgct

SEQ ID NO: 1378773 - DNA, 12 bp, Homo sapiens
cgcagaaggaag

SEQ ID NO: 1378774 - DNA, 21 bp, Homo sapiens
cggaagaagagatcaggaaga

SEQ ID NO: 1378775 - DNA, 22 bp, Homo sapiens
cggaagaagagatcaggaagag

SEQ ID NO: 1378776 - DNA, 18 bp, Homo sapiens
cgtctccgaagaaaagat

SEQ ID NO: 1378777 - DNA, 20 bp, Homo sapiens
ctaaatgacttgcagatgaa

SEQ ID NO: 1378778 - DNA, 19 bp, Homo sapiens
ctaacatttgataattttg

SEQ ID NO: 1378779 - DNA, 20 bp, Homo sapiens
ctagatggtggggttcttcg

SEQ ID NO: 1378780 - DNA, 16 bp, Homo sapiens
ctagtgaaactgcatt

SEQ ID NO: 1378781 - DNA, 16 bp, Homo sapiens
ctatatccaaaattca

SEQ ID NO: 1378782 - DNA, 22 bp, Homo sapiens
ctatatccaaaattcagggctt

SEQ ID NO: 1378783 - DNA, 23 bp, Homo sapiens
ctatatccaaaattcagggcttt

SEQ ID NO: 1378784 - DNA, 17 bp, Homo sapiens
ctatatttttatttcat

SEQ ID NO: 1378785 - DNA, 21 bp, Homo sapiens
ctatgtcaattgatatttctg

SEQ ID NO: 1378786 - DNA, 19 bp, Homo sapiens
ctccgaagaaaagatatgt

SEQ ID NO: 1378787 - DNA, 21 bp, Homo sapiens
ctcgagaggccaaagaaggag

SEQ ID NO: 1378788 - DNA, 16 bp, Homo sapiens
ctcgagtgtttaaatg

SEQ ID NO: 1378789 - DNA, 14 bp, Homo sapiens
tgttcaaattcacg

SEQ ID NO: 1378790 - DNA, 17 bp, Homo sapiens
tgttcatatagccaggg

SEQ ID NO: 1378791 - DNA, 18 bp, Homo sapiens
tgttttttcctaaggaaa

SEQ ID NO: 1378792 - DNA, 12 bp, Homo sapiens
ttaaatacacat

SEQ ID NO: 1378793 - DNA, 16 bp, Homo sapiens
ttaagaaaatattcta

SEQ ID NO: 1378794 - DNA, 23 bp, Homo sapiens
ttaagaaaatattctaacatttg

SEQ ID NO: 1378795 - DNA, 17 bp, Homo sapiens
ttagtggtggtagaaat

SEQ ID NO: 1378796 - DNA, 14 bp, Homo sapiens
ttatatttaaatta

SEQ ID NO: 1378797 - DNA, 18 bp, Homo sapiens
ttatcactgaaaaaatgt

SEQ ID NO: 1378798 - DNA, 19 bp, Homo sapiens
ttatcactgaaaaaatgta

SEQ ID NO: 1378799 - DNA, 13 bp, Homo sapiens
ttatgaaacatgt

SEQ ID NO: 1378800 - DNA, 17 bp, Homo sapiens
ttatgtcttttaataaa

SEQ ID NO: 1378801 - DNA, 22 bp, Homo sapiens
ttatgttttatttaaatgcttt

SEQ ID NO: 1378802 - DNA, 14 bp, Homo sapiens
ttatttaaatgctt

SEQ ID NO: 1378803 - DNA, 19 bp, Homo sapiens
ttattttcccttcatgttt

SEQ ID NO: 1378804 - DNA, 13 bp, Homo sapiens
ttatttttataaa

SEQ ID NO: 1378805 - DNA, 16 bp, Homo sapiens
ttattttttttcaaaa

SEQ ID NO: 1378806 - DNA, 17 bp, Homo sapiens
ttattttttttcaaaat

SEQ ID NO: 1378807 - DNA, 19 bp, Homo sapiens
ttattttttttcaaaatga

SEQ ID NO: 1378808 - DNA, 23 bp, Homo sapiens
ttcaaaggaaaacacctttattt

SEQ ID NO: 1378809 - DNA, 19 bp, Homo sapiens
ttcaaatgattatgattag

SEQ ID NO: 1378810 - DNA, 20 bp, Homo sapiens
ttcaacttcttctatatcca

SEQ ID NO: 1378811 - DNA, 22 bp, Homo sapiens
ttcaccagtgcttgcttgtgaa

SEQ ID NO: 1378812 - DNA, 16 bp, Homo sapiens
ttcacgttctagtgaa

SEQ ID NO: 1378813 - DNA, 18 bp, Homo sapiens
ttccagagcactgctcca

SEQ ID NO: 1378814 - DNA, 17 bp, Homo sapiens
ttctaacatttgataat

SEQ ID NO: 1378815 - DNA, 18 bp, Homo sapiens
ttctaacatttgataatt

SEQ ID NO: 1378816 - DNA, 16 bp, Homo sapiens
ttctcagagattaaaa

SEQ ID NO: 1378817 - DNA, 21 bp, Homo sapiens
ttctctatatttttatttcat

SEQ ID NO: 1378818 - DNA, 20 bp, Homo sapiens
ttctgtgtagtatttatatt

SEQ ID NO: 1378819 - DNA, 23 bp, Homo sapiens
ttcttcgggtgtgatcatatatc

SEQ ID NO: 1378820 - DNA, 22 bp, Homo sapiens
ttcttctatatccaaaattcag

SEQ ID NO: 1378821 - DNA, 18 bp, Homo sapiens
ttgaaatgattcatcttt

SEQ ID NO: 1378822 - DNA, 23 bp, Homo sapiens
ttgaaatgattcatctttcagaa

SEQ ID NO: 1378823 - DNA, 20 bp, Homo sapiens
ttgaagtttattattttcaa

SEQ ID NO: 1378824 - DNA, 11 bp, Homo sapiens
ttgataatttt

SEQ ID NO: 1378825 - DNA, 14 bp, Homo sapiens
ttgatttcccaaaa

SEQ ID NO: 1378826 - DNA, 21 bp, Homo sapiens
ttggcagattgttttttccta

SEQ ID NO: 1378827 - DNA, 19 bp, Homo sapiens
ttggtgacagtttccagat

SEQ ID NO: 1378828 - DNA, 23 bp, Homo sapiens
ttgttgctgaaaactctatgtcc

SEQ ID NO: 1378829 - DNA, 13 bp, Homo sapiens
tttaacttattgt

SEQ ID NO: 1378830 - DNA, 14 bp, Homo sapiens
tttaacttattgtt

SEQ ID NO: 1378831 - DNA, 16 bp, Homo sapiens
tttaataaaaaggaaa

SEQ ID NO: 1378832 - DNA, 20 bp, Homo sapiens
tttacaaatattaagaaaat

SEQ ID NO: 1378833 - DNA, 22 bp, Homo sapiens
tttacctttttgcttattttac

SEQ ID NO: 1378834 - DNA, 15 bp, Homo sapiens
tttatatttaaatta

SEQ ID NO: 1378835 - DNA, 16 bp, Homo sapiens
tttattattttcaaag

SEQ ID NO: 1378836 - DNA, 19 bp, Homo sapiens
tttattttcccttcatgtt

SEQ ID NO: 1378837 - DNA, 15 bp, Homo sapiens
tttatttttataaaa

SEQ ID NO: 1378838 - DNA, 18 bp, Homo sapiens
tttcaacttcttctatat

SEQ ID NO: 1378839 - DNA, 18 bp, Homo sapiens
tttctgtcattgttaaat

SEQ ID NO: 1378840 - DNA, 21 bp, Homo sapiens
tttgaaatgattcatctttca

SEQ ID NO: 1378841 - DNA, 18 bp, Homo sapiens
tttgataaaatattttaa

SEQ ID NO: 1378842 - DNA, 20 bp, Homo sapiens
tttgataattttgaaatgat

SEQ ID NO: 1378843 - DNA, 17 bp, Homo sapiens
tttggacaaatgcattt

SEQ ID NO: 1378844 - DNA, 13 bp, Homo sapiens
tttgttttcattt

SEQ ID NO: 1378845 - DNA, 13 bp, Homo sapiens
ttttacaaatatt

SEQ ID NO: 1378846 - DNA, 21 bp, Homo sapiens
ttttacaaatattaagaaaat

SEQ ID NO: 1378847 - DNA, 21 bp, Homo sapiens
ttttatttcattcacattaat

SEQ ID NO: 1378848 - DNA, 12 bp, Homo sapiens
ttttcaaaatga

SEQ ID NO: 1378849 - DNA, 23 bp, Homo sapiens
ttttcaacttcttctatatccaa

SEQ ID NO: 1378850 - DNA, 17 bp, Homo sapiens
ttttcctaaggaaactg

SEQ ID NO: 1378851 - DNA, 15 bp, Homo sapiens
ttttctgtcattgtt

SEQ ID NO: 1378852 - DNA, 12 bp, Homo sapiens
ttttgcttattt

SEQ ID NO: 1378853 - DNA, 16 bp, Homo sapiens
tttttatcgctaaatg

SEQ ID NO: 1378854 - DNA, 12 bp, Homo sapiens
ttttttttcaaa

SEQ ID NO: 1378855 - DNA, 13 bp, Homo sapiens
aaaaaggaaatat

SEQ ID NO: 1378856 - DNA, 15 bp, Homo sapiens
aaaaatgtagctttt

SEQ ID NO: 1378857 - DNA, 15 bp, Homo sapiens
aaaacacctttattt

SEQ ID NO: 1378858 - DNA, 18 bp, Homo sapiens
aaaagatatgtattctaa

SEQ ID NO: 1378859 - DNA, 14 bp, Homo sapiens
aaaaggtagttttt

SEQ ID NO: 1378860 - DNA, 15 bp, Homo sapiens
aaaaggtagtttttc

SEQ ID NO: 1378861 - DNA, 20 bp, Homo sapiens
aaaatattctaacatttgat

SEQ ID NO: 1378862 - DNA, 15 bp, Homo sapiens
aaaatgtagctttta

SEQ ID NO: 1378863 - DNA, 15 bp, Homo sapiens
aaacatgattatctt

SEQ ID NO: 1378864 - DNA, 17 bp, Homo sapiens
aaacatgtggagtgtat

SEQ ID NO: 1378865 - DNA, 20 bp, Homo sapiens
aaacatgtggagtgtattaa

SEQ ID NO: 1378866 - DNA, 22 bp, Homo sapiens
aaactgcctgacaattatgaaa

SEQ ID NO: 1378867 - DNA, 13 bp, Homo sapiens
aaactgctttatt

SEQ ID NO: 1378868 - DNA, 23 bp, Homo sapiens
aaactgctttatttttataaaac

SEQ ID NO: 1378869 - DNA, 15 bp, Homo sapiens
aaactggatggaaat

SEQ ID NO: 1378870 - DNA, 15 bp, Homo sapiens
aaagaacggaagaag

SEQ ID NO: 1378871 - DNA, 17 bp, Homo sapiens
aaagaactagtttctag

SEQ ID NO: 1378872 - DNA, 15 bp, Homo sapiens
aaagatatgtattct

SEQ ID NO: 1378873 - DNA, 21 bp, Homo sapiens
aaaggaaaacacctttatttt

SEQ ID NO: 1378874 - DNA, 12 bp, Homo sapiens
aaaggatatttc

SEQ ID NO: 1378875 - DNA, 16 bp, Homo sapiens
aaaggatatttcaaat

SEQ ID NO: 1378876 - DNA, 13 bp, Homo sapiens
aaatattaagaaa

SEQ ID NO: 1378877 - DNA, 17 bp, Homo sapiens
aaatattttaagtatga

SEQ ID NO: 1378878 - DNA, 14 bp, Homo sapiens
aaatatttttcaac

SEQ ID NO: 1378879 - DNA, 15 bp, Homo sapiens
aaatgacttgcagat

SEQ ID NO: 1378880 - DNA, 19 bp, Homo sapiens
aaatgattcatctttcaga

SEQ ID NO: 1378881 - DNA, 11 bp, Homo sapiens
aaatgctgtgt

SEQ ID NO: 1378882 - DNA, 18 bp, Homo sapiens
aaatgtagcttttatgtg

SEQ ID NO: 1378883 - DNA, 18 bp, Homo sapiens
aaattcacgttctagtga

SEQ ID NO: 1378884 - DNA, 22 bp, Homo sapiens
aaattcagggctttaaacatga

SEQ ID NO: 1378885 - DNA, 21 bp, Homo sapiens
aacaatgctttgataaaatat

SEQ ID NO: 1378886 - DNA, 22 bp, Homo sapiens
aacaatgctttgataaaatatt

SEQ ID NO: 1378887 - DNA, 23 bp, Homo sapiens
aacaatgctttgataaaatattt

SEQ ID NO: 1378888 - DNA, 16 bp, Homo sapiens
aacacctttattttat

SEQ ID NO: 1378889 - DNA, 12 bp, Homo sapiens
aacactcaccat

SEQ ID NO: 1378890 - DNA, 18 bp, Homo sapiens
aacattttggtgacagtt

SEQ ID NO: 1378891 - DNA, 16 bp, Homo sapiens
aactcttcaaggtctg

SEQ ID NO: 1378892 - DNA, 21 bp, Homo sapiens
aactgctttatttttataaaa

SEQ ID NO: 1378893 - DNA, 15 bp, Homo sapiens
aagagttttctcaga

SEQ ID NO: 1378894 - DNA, 17 bp, Homo sapiens
aagctttggttatgaaa

SEQ ID NO: 1378895 - DNA, 14 bp, Homo sapiens
aaggcagggaggag

SEQ ID NO: 1378896 - DNA, 14 bp, Homo sapiens
aaggtagtttttct

SEQ ID NO: 1378897 - DNA, 23 bp, Homo sapiens
aaggtgactcgagtgtttaaatg

SEQ ID NO: 1378898 - DNA, 17 bp, Homo sapiens
aagtatgagttatcagc

SEQ ID NO: 1378899 - DNA, 18 bp, Homo sapiens
aagtttattattttcaaa

SEQ ID NO: 1378900 - DNA, 14 bp, Homo sapiens
aataaaaaggaaat

SEQ ID NO: 1378901 - DNA, 18 bp, Homo sapiens
aataaaaaggaaatattt

SEQ ID NO: 1378902 - DNA, 15 bp, Homo sapiens
aataatttgttttca

SEQ ID NO: 1378903 - DNA, 13 bp, Homo sapiens
aatattttaagta

SEQ ID NO: 1378904 - DNA, 16 bp, Homo sapiens
aatattttaagtatga

SEQ ID NO: 1378905 - DNA, 14 bp, Homo sapiens
aatcttaacatttt

SEQ ID NO: 1378906 - DNA, 12 bp, Homo sapiens
aatgattatgat

SEQ ID NO: 1378907 - DNA, 22 bp, Homo sapiens
aatgattatgattagttatgtc

SEQ ID NO: 1378908 - DNA, 20 bp, Homo sapiens
aatgattcatctttcagaaa

SEQ ID NO: 1378909 - DNA, 22 bp, Homo sapiens
aatgattcatctttcagaaata

SEQ ID NO: 1378910 - DNA, 14 bp, Homo sapiens
aatgttcaaattca

SEQ ID NO: 1378911 - DNA, 19 bp, Homo sapiens
aattcacgttctagtgaaa

SEQ ID NO: 1378912 - DNA, 20 bp, Homo sapiens
aattcagggctttaaacatg

SEQ ID NO: 1378913 - DNA, 17 bp, Homo sapiens
aattgatatttctgtgt

SEQ ID NO: 1378914 - DNA, 17 bp, Homo sapiens
aattggcagattgtttt

SEQ ID NO: 1378915 - DNA, 23 bp, Homo sapiens
aattggcagattgttttttccta

SEQ ID NO: 1378916 - DNA, 16 bp, Homo sapiens
acaaatattaagaaaa

SEQ ID NO: 1378917 - DNA, 17 bp, Homo sapiens
acaaatattaagaaaat

SEQ ID NO: 1378918 - DNA, 14 bp, Homo sapiens
acaacaatgctttg

SEQ ID NO: 1378919 - DNA, 18 bp, Homo sapiens
acaataatttgttttcat

SEQ ID NO: 1378920 - DNA, 18 bp, Homo sapiens
acaatgctttgataaaat

SEQ ID NO: 1378921 - DNA, 19 bp, Homo sapiens
acaatgctttgataaaata

SEQ ID NO: 1378922 - DNA, 17 bp, Homo sapiens
acacattacagccaggt

SEQ ID NO: 1378923 - DNA, 15 bp, Homo sapiens
acactagatgatatt

SEQ ID NO: 1378924 - DNA, 21 bp, Homo sapiens
acactagatgatattacagga

SEQ ID NO: 1378925 - DNA, 12 bp, Homo sapiens
acattatgtttt

SEQ ID NO: 1378926 - DNA, 20 bp, Homo sapiens
acattatgttttatttaaat

SEQ ID NO: 1378927 - DNA, 21 bp, Homo sapiens
acattatgttttatttaaatg

SEQ ID NO: 1378928 - DNA, 22 bp, Homo sapiens
acattatgttttatttaaatgc

SEQ ID NO: 1378929 - DNA, 13 bp, Homo sapiens
acatttgataatt

SEQ ID NO: 1378930 - DNA, 15 bp, Homo sapiens
acatttgataatttt

SEQ ID NO: 1378931 - DNA, 20 bp, Homo sapiens
accctccaccgcagaaggaa

SEQ ID NO: 1378932 - DNA, 14 bp, Homo sapiens
accgcagaaggaag

SEQ ID NO: 1378933 - DNA, 15 bp, Homo sapiens
accgcagaaggaagg

SEQ ID NO: 1378934 - DNA, 12 bp, Homo sapiens
acctttatttta

SEQ ID NO: 1378935 - DNA, 20 bp, Homo sapiens
acctttttgcttattttaca

SEQ ID NO: 1378936 - DNA, 22 bp, Homo sapiens
acggaagaagagatcaggaaga

SEQ ID NO: 1378937 - DNA, 22 bp, Homo sapiens
actatcttctctatatttttat

SEQ ID NO: 1378938 - DNA, 17 bp, Homo sapiens
actctgctagtgaaaag

SEQ ID NO: 1378939 - DNA, 14 bp, Homo sapiens
actgaaaaaatgta

SEQ ID NO: 1378940 - DNA, 20 bp, Homo sapiens
actgcctgacaattatgaaa

SEQ ID NO: 1378941 - DNA, 19 bp, Homo sapiens
actgctttatttttataaa

SEQ ID NO: 1378942 - DNA, 23 bp, Homo sapiens
acttattgttgctgaaaactcta

SEQ ID NO: 1378943 - DNA, 13 bp, Homo sapiens
agaaaagatatgt

SEQ ID NO: 1378944 - DNA, 19 bp, Homo sapiens
agaaaagatatgtattcta

SEQ ID NO: 1378945 - DNA, 10 bp, Homo sapiens
agaaaatatt

SEQ ID NO: 1378946 - DNA, 15 bp, Homo sapiens
agaaataaaagtatg

SEQ ID NO: 1378947 - DNA, 16 bp, Homo sapiens
agaaataaaagtatga

SEQ ID NO: 1378948 - DNA, 13 bp, Homo sapiens
agaacggaagaag

SEQ ID NO: 1378949 - DNA, 12 bp, Homo sapiens
agaagagttttc

SEQ ID NO: 1378950 - DNA, 11 bp, Homo sapiens
agaaggaaggc

SEQ ID NO: 1378951 - DNA, 17 bp, Homo sapiens
agaaggaaggcagggag

SEQ ID NO: 1378952 - DNA, 19 bp, Homo sapiens
agaaggaaggcagggagga

SEQ ID NO: 1378953 - DNA, 21 bp, Homo sapiens
agaaggaaggcagggaggagg

SEQ ID NO: 1378954 - DNA, 17 bp, Homo sapiens
agagaagaaagaacgga

SEQ ID NO: 1378955 - DNA, 16 bp, Homo sapiens
agagctgatggagaag

SEQ ID NO: 1378956 - DNA, 17 bp, Homo sapiens
agagctgatggagaagg

SEQ ID NO: 1378957 - DNA, 19 bp, Homo sapiens
agagctgatggagaaggaa

SEQ ID NO: 1378958 - DNA, 20 bp, Homo sapiens
agaggacactagatgatatt

SEQ ID NO: 1378959 - DNA, 21 bp, Homo sapiens
agatacacattacagccaggt

SEQ ID NO: 1378960 - DNA, 18 bp, Homo sapiens
agatgctatcacagactc

SEQ ID NO: 1378961 - DNA, 23 bp, Homo sapiens
agattgttttttcctaaggaaac

SEQ ID NO: 1378962 - DNA, 17 bp, Homo sapiens
agcagagctgatggaga

SEQ ID NO: 1378963 - DNA, 16 bp, Homo sapiens
agctgatggagaagga

SEQ ID NO: 1378964 - DNA, 18 bp, Homo sapiens
agcttgacattatgtttt

SEQ ID NO: 1378965 - DNA, 23 bp, Homo sapiens
agcttttatgtgatatgttttaa

SEQ ID NO: 1378966 - DNA, 15 bp, Homo sapiens
aggaaatatttttca

SEQ ID NO: 1378967 - DNA, 18 bp, Homo sapiens
aggaaggcagggaggagg

SEQ ID NO: 1378968 - DNA, 20 bp, Homo sapiens
aggaaggcagggaggaggca

SEQ ID NO: 1378969 - DNA, 22 bp, Homo sapiens
aggaaggcagggaggaggcaga

SEQ ID NO: 1378970 - DNA, 17 bp, Homo sapiens
aggagcacaataatttg

SEQ ID NO: 1378971 - DNA, 13 bp, Homo sapiens
aggagttcaagac

SEQ ID NO: 1378972 - DNA, 18 bp, Homo sapiens
aggatatttcaaatgatt

SEQ ID NO: 1378973 - DNA, 20 bp, Homo sapiens
aggatggcttgagcccagga

SEQ ID NO: 1378974 - DNA, 14 bp, Homo sapiens
aggtccaatgttgt

SEQ ID NO: 1378975 - DNA, 13 bp, Homo sapiens
agtatgagttatc

SEQ ID NO: 1378976 - DNA, 15 bp, Homo sapiens
agtatttatatttaa

SEQ ID NO: 1378977 - DNA, 16 bp, Homo sapiens
agtccatgaatgttca

SEQ ID NO: 1378978 - DNA, 17 bp, Homo sapiens
agtccatgaatgttcat

SEQ ID NO: 1378979 - DNA, 23 bp, Homo sapiens
agtgcagcttgacattatgtttt

SEQ ID NO: 1378980 - DNA, 20 bp, Homo sapiens
agtgtttaaatgctgtgtac

SEQ ID NO: 1378981 - DNA, 19 bp, Homo sapiens
agttatcagctctatgtca

SEQ ID NO: 1378982 - DNA, 12 bp, Homo sapiens
agttatgtcttt

SEQ ID NO: 1378983 - DNA, 13 bp, Homo sapiens
agttatgtctttt

SEQ ID NO: 1378984 - DNA, 21 bp, Homo sapiens
agtttattattttcaaaggaa

SEQ ID NO: 1378985 - DNA, 17 bp, Homo sapiens
agtttctaggagcacaa

SEQ ID NO: 1378986 - DNA, 15 bp, Homo sapiens
ataaaagtatgaatc

SEQ ID NO: 1378987 - DNA, 15 bp, Homo sapiens
ataaaggatatttca

SEQ ID NO: 1378988 - DNA, 17 bp, Homo sapiens
ataaaggatatttcaaa

SEQ ID NO: 1378989 - DNA, 19 bp, Homo sapiens
atacacattacagccaggt

SEQ ID NO: 1378990 - DNA, 12 bp, Homo sapiens
atatagccaggg

SEQ ID NO: 1378991 - DNA, 15 bp, Homo sapiens
atatcataaaggata

SEQ ID NO: 1378992 - DNA, 22 bp, Homo sapiens
atatcataaaggatatttcaaa

SEQ ID NO: 1378993 - DNA, 21 bp, Homo sapiens
atatccaaaattcagggcttt

SEQ ID NO: 1378994 - DNA, 15 bp, Homo sapiens
atatgttttaaagtt

SEQ ID NO: 1378995 - DNA, 21 bp, Homo sapiens
atattaagaaaatattctaac

SEQ ID NO: 1378996 - DNA, 18 bp, Homo sapiens
atattctaacatttgata

SEQ ID NO: 1378997 - DNA, 14 bp, Homo sapiens
atatttaaattata

SEQ ID NO: 1378998 - DNA, 13 bp, Homo sapiens
atatttacctttt

SEQ ID NO: 1378999 - DNA, 16 bp, Homo sapiens
atatttctgtgtagta

SEQ ID NO: 1379000 - DNA, 15 bp, Homo sapiens
atatttttatttcat

SEQ ID NO: 1379001 - DNA, 19 bp, Homo sapiens
atcaggaagagaaggagca

SEQ ID NO: 1379002 - DNA, 19 bp, Homo sapiens
atcataaaggatatttcaa

SEQ ID NO: 1379003 - DNA, 21 bp, Homo sapiens
atcatatatcataaaggatat

SEQ ID NO: 1379004 - DNA, 18 bp, Homo sapiens
atcttctctatattttta

SEQ ID NO: 1379005 - DNA, 19 bp, Homo sapiens
atcttctctatatttttat

SEQ ID NO: 1379006 - DNA, 13 bp, Homo sapiens
atctttcagaaat

SEQ ID NO: 1379007 - DNA, 21 bp, Homo sapiens
atctttcagaaataaaagtat

SEQ ID NO: 1379008 - DNA, 14 bp, Homo sapiens
atgaaaaaatgttc

SEQ ID NO: 1379009 - DNA, 18 bp, Homo sapiens
atgaaaaaatgttcaaat

SEQ ID NO: 1379010 - DNA, 11 bp, Homo sapiens
atgagaagagt

SEQ ID NO: 1379011 - DNA, 18 bp, Homo sapiens
atgattagttatgtcttt

SEQ ID NO: 1379012 - DNA, 21 bp, Homo sapiens
atgattatcttgatttcccaa

SEQ ID NO: 1379013 - DNA, 16 bp, Homo sapiens
atgattcatctttcag

SEQ ID NO: 1379014 - DNA, 22 bp, Homo sapiens
atgctgtgtacaacaatgcttt

SEQ ID NO: 1379015 - DNA, 21 bp, Homo sapiens
atgctttgataaaatatttta

SEQ ID NO: 1379016 - DNA, 13 bp, Homo sapiens
atggagaaggaag

SEQ ID NO: 1379017 - DNA, 15 bp, Homo sapiens
atggagaaggaaggc

SEQ ID NO: 1379018 - DNA, 16 bp, Homo sapiens
atggcttgagcccagg

SEQ ID NO: 1379019 - DNA, 22 bp, Homo sapiens
atgtagcttttatgtgatatgt

SEQ ID NO: 1379020 - DNA, 13 bp, Homo sapiens
atgtccggcttta

SEQ ID NO: 1379021 - DNA, 23 bp, Homo sapiens
atgtcttttaataaaaaggaaat

SEQ ID NO: 1379022 - DNA, 13 bp, Homo sapiens
atgtgatatgttt

SEQ ID NO: 1379023 - DNA, 16 bp, Homo sapiens
atgtggagtgtattaa

SEQ ID NO: 1379024 - DNA, 14 bp, Homo sapiens
atgttcaaattcac

SEQ ID NO: 1379025 - DNA, 18 bp, Homo sapiens
atgttcaaattcacgttc

SEQ ID NO: 1379026 - DNA, 19 bp, Homo sapiens
atgttgttcaccagtgctt

SEQ ID NO: 1379027 - DNA, 15 bp, Homo sapiens
atgttttaaagttaa

SEQ ID NO: 1379028 - DNA, 10 bp, Homo sapiens
atgttttaac

SEQ ID NO: 1379029 - DNA, 20 bp, Homo sapiens
attaagtgcagcttgacatt

SEQ ID NO: 1379030 - DNA, 20 bp, Homo sapiens
attatcactgaaaaaatgta

SEQ ID NO: 1379031 - DNA, 13 bp, Homo sapiens
attattttcaaag

SEQ ID NO: 1379032 - DNA, 17 bp, Homo sapiens
attattttcaaaggaaa

SEQ ID NO: 1379033 - DNA, 21 bp, Homo sapiens
attattttcaaaggaaaacac

SEQ ID NO: 1379034 - DNA, 22 bp, Homo sapiens
attcacgttctagtgaaactgc

SEQ ID NO: 1379035 - DNA, 17 bp, Homo sapiens
attcatctttcagaaat

SEQ ID NO: 1379036 - DNA, 20 bp, Homo sapiens
attcatctttcagaaataaa

SEQ ID NO: 1379037 - DNA, 12 bp, Homo sapiens
attgatatttct

SEQ ID NO: 1379038 - DNA, 21 bp, Homo sapiens
attgttaaatacacattatca

SEQ ID NO: 1379039 - DNA, 16 bp, Homo sapiens
attgttgctgaaaact

SEQ ID NO: 1379040 - DNA, 21 bp, Homo sapiens
attgttttttcctaaggaaac

SEQ ID NO: 1379041 - DNA, 12 bp, Homo sapiens
atttaaatgctt

SEQ ID NO: 1379042 - DNA, 13 bp, Homo sapiens
atttaaatgcttt

SEQ ID NO: 1379043 - DNA, 16 bp, Homo sapiens
atttatatttaaatta

SEQ ID NO: 1379044 - DNA, 17 bp, Homo sapiens
atttatatttaaattat

SEQ ID NO: 1379045 - DNA, 18 bp, Homo sapiens
atttcaaatgattatgat

SEQ ID NO: 1379046 - DNA, 15 bp, Homo sapiens
atttctgtgtagtat

SEQ ID NO: 1379047 - DNA, 19 bp, Homo sapiens
atttctgtgtagtatttat

SEQ ID NO: 1379048 - DNA, 20 bp, Homo sapiens
atttgataattttgaaatga

SEQ ID NO: 1379049 - DNA, 22 bp, Homo sapiens
atttgtataagtccatgaatgt

SEQ ID NO: 1379050 - DNA, 19 bp, Homo sapiens
atttgttttcatttgtata

SEQ ID NO: 1379051 - DNA, 16 bp, Homo sapiens
attttacaaatattaa

SEQ ID NO: 1379052 - DNA, 21 bp, Homo sapiens
attttacaaatattaagaaaa

SEQ ID NO: 1379053 - DNA, 18 bp, Homo sapiens
attttattttttttcaaa

SEQ ID NO: 1379054 - DNA, 19 bp, Homo sapiens
attttattttttttcaaaa

SEQ ID NO: 1379055 - DNA, 13 bp, Homo sapiens
attttgaaatgat

SEQ ID NO: 1379056 - DNA, 15 bp, Homo sapiens
atttttatttcattc

SEQ ID NO: 1379057 - DNA, 22 bp, Homo sapiens
caaaggaaaacacctttatttt

SEQ ID NO: 1379058 - DNA, 14 bp, Homo sapiens
caaatattaagaaa

SEQ ID NO: 1379059 - DNA, 22 bp, Homo sapiens
caacaatgctttgataaaatat

SEQ ID NO: 1379060 - DNA, 15 bp, Homo sapiens
caacttcttctatat

SEQ ID NO: 1379061 - DNA, 13 bp, Homo sapiens
caaggtctgcttt

SEQ ID NO: 1379062 - DNA, 13 bp, Homo sapiens
caatgctttgata

SEQ ID NO: 1379063 - DNA, 16 bp, Homo sapiens
cacattacagccaggt

SEQ ID NO: 1379064 - DNA, 14 bp, Homo sapiens
caccgcagaaggaa

SEQ ID NO: 1379065 - DNA, 14 bp, Homo sapiens
cactgaaaaaatgt

SEQ ID NO: 1379066 - DNA, 14 bp, Homo sapiens
cagaaataaaagta

SEQ ID NO: 1379067 - DNA, 11 bp, Homo sapiens
cagaaggaagg

SEQ ID NO: 1379068 - DNA, 18 bp, Homo sapiens
cagactctgctagtgaaa

SEQ ID NO: 1379069 - DNA, 15 bp, Homo sapiens
cagagattaaaaaag

SEQ ID NO: 1379070 - DNA, 19 bp, Homo sapiens
cagagctgatggagaagga

SEQ ID NO: 1379071 - DNA, 23 bp, Homo sapiens
cagattgttttttcctaaggaaa

SEQ ID NO: 1379072 - DNA, 21 bp, Homo sapiens
cagcttgacattatgttttat

SEQ ID NO: 1379073 - DNA, 14 bp, Homo sapiens
caggaagagaagga

SEQ ID NO: 1379074 - DNA, 17 bp, Homo sapiens
caggaagagaaggagca

SEQ ID NO: 1379075 - DNA, 22 bp, Homo sapiens
cagggctttaaacatgattatc

SEQ ID NO: 1379076 - DNA, 17 bp, Homo sapiens
cagtgcttgcttgtgaa

SEQ ID NO: 1379077 - DNA, 22 bp, Homo sapiens
cataaaggatatttcaaatgat

SEQ ID NO: 1379078 - DNA, 13 bp, Homo sapiens
catatagccaggg

SEQ ID NO: 1379079 - DNA, 23 bp, Homo sapiens
catctttcagaaataaaagtatg

SEQ ID NO: 1379080 - DNA, 23 bp, Homo sapiens
catgaatgttcatatagccaggg

SEQ ID NO: 1379081 - DNA, 16 bp, Homo sapiens
catgattatcttgatt

SEQ ID NO: 1379082 - DNA, 15 bp, Homo sapiens
catgtggagtgtatt

SEQ ID NO: 1379083 - DNA, 14 bp, Homo sapiens
cattacagccaggt

SEQ ID NO: 1379084 - DNA, 22 bp, Homo sapiens
cattgttaaatacacattatca

SEQ ID NO: 1379085 - DNA, 23 bp, Homo sapiens
catttagtggtggtagaaatgat

SEQ ID NO: 1379086 - DNA, 23 bp, Homo sapiens
catttgataattttgaaatgatt

SEQ ID NO: 1379087 - DNA, 18 bp, Homo sapiens
ccctccaccgcagaagga

SEQ ID NO: 1379088 - DNA, 21 bp, Homo sapiens
ccctccaccgcagaaggaagg

SEQ ID NO: 1379089 - DNA, 18 bp, Homo sapiens
cctccaccgcagaaggaa

SEQ ID NO: 1379090 - DNA, 16 bp, Homo sapiens
cctgacaattatgaaa

SEQ ID NO: 1379091 - DNA, 18 bp, Homo sapiens
cctgacaattatgaaaaa

SEQ ID NO: 1379092 - DNA, 20 bp, Homo sapiens
ccttcatctggattccagag

SEQ ID NO: 1379093 - DNA, 13 bp, Homo sapiens
ccttcatgtttta

SEQ ID NO: 1379094 - DNA, 22 bp, Homo sapiens
cctttattttattttttttcaa

SEQ ID NO: 1379095 - DNA, 23 bp, Homo sapiens
cctttattttattttttttcaaa

SEQ ID NO: 1379096 - DNA, 20 bp, Homo sapiens
cctttggacaaatgcattta

SEQ ID NO: 1379097 - DNA, 13 bp, Homo sapiens
cgcagaaggaagg

SEQ ID NO: 1379098 - DNA, 19 bp, Homo sapiens
cgctaaatgacttgcagat

SEQ ID NO: 1379099 - DNA, 20 bp, Homo sapiens
ctaacatttgataattttga

SEQ ID NO: 1379100 - DNA, 15 bp, Homo sapiens
ctaaggaaactgctt

SEQ ID NO: 1379101 - DNA, 18 bp, Homo sapiens
ctaaggaaactgctttat

SEQ ID NO: 1379102 - DNA, 21 bp, Homo sapiens
ctaattggcagattgtttttt

SEQ ID NO: 1379103 - DNA, 12 bp, Homo sapiens
ctagtttctagg

SEQ ID NO: 1379104 - DNA, 16 bp, Homo sapiens
ctatatttttatttca

SEQ ID NO: 1379105 - DNA, 21 bp, Homo sapiens
ctatcttctctatatttttat

SEQ ID NO: 1379106 - DNA, 13 bp, Homo sapiens
ctccgaagaaaag

SEQ ID NO: 1379107 - DNA, 14 bp, Homo sapiens
ctccgaagaaaaga

SEQ ID NO: 1379108 - DNA, 12 bp, Homo sapiens
ctctatattttt

SEQ ID NO: 1379109 - DNA, 17 bp, Homo sapiens
ctgaaaaaatgtagctt

SEQ ID NO: 1379110 - DNA, 21 bp, Homo sapiens
ctgacaattatgaaaaaatgt

SEQ ID NO: 1379111 - DNA, 14 bp, Homo sapiens
ctgatggagaagga

SEQ ID NO: 1379112 - DNA, 15 bp, Homo sapiens
ctgctagtgaaaaga

SEQ ID NO: 1379113 - DNA, 15 bp, Homo sapiens
ctgtcattgttaaat

SEQ ID NO: 1379114 - DNA, 18 bp, Homo sapiens
ctgtgtagtatttatatt

SEQ ID NO: 1379115 - DNA, 15 bp, Homo sapiens
cttattttacaaata

SEQ ID NO: 1379116 - DNA, 22 bp, Homo sapiens
cttattttacaaatattaagaa

SEQ ID NO: 1379117 - DNA, 22 bp, Homo sapiens
cttcgggtgtgatcatatatca

SEQ ID NO: 1379118 - DNA, 20 bp, Homo sapiens
cttctatatccaaaattcag

SEQ ID NO: 1379119 - DNA, 17 bp, Homo sapiens
cttctctatatttttat

SEQ ID NO: 1379120 - DNA, 21 bp, Homo sapiens
cttctctatatttttatttca

SEQ ID NO: 1379121 - DNA, 17 bp, Homo sapiens
cttgacattatgtttta

SEQ ID NO: 1379122 - DNA, 13 bp, Homo sapiens
cttgcttgtgaat

SEQ ID NO: 1379123 - DNA, 17 bp, Homo sapiens
ctttatttttataaaac

SEQ ID NO: 1379124 - DNA, 20 bp, Homo sapiens
ctttggttatgaaacatgtg

SEQ ID NO: 1379125 - DNA, 12 bp, Homo sapiens
cttttaataaaa

SEQ ID NO: 1379126 - DNA, 14 bp, Homo sapiens
cttttatgtgatat

SEQ ID NO: 1379127 - DNA, 20 bp, Homo sapiens
cttttatgtgatatgtttta

SEQ ID NO: 1379128 - DNA, 12 bp, Homo sapiens
gaaaaaatgtag

SEQ ID NO: 1379129 - DNA, 13 bp, Homo sapiens
gaaaaaatgttca

SEQ ID NO: 1379130 - DNA, 20 bp, Homo sapiens
gaaaacacctttattttatt

SEQ ID NO: 1379131 - DNA, 21 bp, Homo sapiens
gaaaagatatgtattctaatt

SEQ ID NO: 1379132 - DNA, 16 bp, Homo sapiens
gaaactgctttatttt

SEQ ID NO: 1379133 - DNA, 14 bp, Homo sapiens
gaaatgattcatct

SEQ ID NO: 1379134 - DNA, 20 bp, Homo sapiens
gaaatgattcatctttcaga

SEQ ID NO: 1379135 - DNA, 23 bp, Homo sapiens
gaagatacacattacagccaggt

SEQ ID NO: 1379136 - DNA, 20 bp, Homo sapiens
gaaggaaggcagggaggagg

SEQ ID NO: 1379137 - DNA, 16 bp, Homo sapiens
gaaggcagggaggagg

SEQ ID NO: 1379138 - DNA, 20 bp, Homo sapiens
gaaggcagggaggaggcaga

SEQ ID NO: 1379139 - DNA, 19 bp, Homo sapiens
gaagtttattattttcaaa

SEQ ID NO: 1379140 - DNA, 14 bp, Homo sapiens
gaatcttaacattt

SEQ ID NO: 1379141 - DNA, 20 bp, Homo sapiens
gaatgttcatatagccaggg

SEQ ID NO: 1379142 - DNA, 14 bp, Homo sapiens
gacaattatgaaaa

SEQ ID NO: 1379143 - DNA, 15 bp, Homo sapiens
gacaattatgaaaaa

SEQ ID NO: 1379144 - DNA, 19 bp, Homo sapiens
gactcgagtgtttaaatgc

SEQ ID NO: 1379145 - DNA, 21 bp, Homo sapiens
gagaagaaagaacggaagaag

SEQ ID NO: 1379146 - DNA, 14 bp, Homo sapiens
gagaagagttttct

SEQ ID NO: 1379147 - DNA, 13 bp, Homo sapiens
gagaaggagcaga

SEQ ID NO: 1379148 - DNA, 13 bp, Homo sapiens
gagatcaggaaga

SEQ ID NO: 1379149 - DNA, 20 bp, Homo sapiens
gagatcaggaagagaaggag

SEQ ID NO: 1379150 - DNA, 23 bp, Homo sapiens
gagatcccgtctccgaagaaaag

SEQ ID NO: 1379151 - DNA, 15 bp, Homo sapiens
gagcacaataatttg

SEQ ID NO: 1379152 - DNA, 14 bp, Homo sapiens
gagtgtttaaatgc

SEQ ID NO: 1379153 - DNA, 22 bp, Homo sapiens
gagtgtttaaatgctgtgtaca

SEQ ID NO: 1379154 - DNA, 18 bp, Homo sapiens
gataattttgaaatgatt

SEQ ID NO: 1379155 - DNA, 20 bp, Homo sapiens
gatacacattacagccaggt

SEQ ID NO: 1379156 - DNA, 14 bp, Homo sapiens
gatatgtattctaa

SEQ ID NO: 1379157 - DNA, 16 bp, Homo sapiens
gatatttcaaatgatt

SEQ ID NO: 1379158 - DNA, 16 bp, Homo sapiens
gatcaggaagagaagg

SEQ ID NO: 1379159 - DNA, 17 bp, Homo sapiens
gatcaggaagagaagga

SEQ ID NO: 1379160 - DNA, 15 bp, Homo sapiens
gatgaaaaaaactaa

SEQ ID NO: 1379161 - DNA, 15 bp, Homo sapiens
gattcatctttcaga

SEQ ID NO: 1379162 - DNA, 19 bp, Homo sapiens
gattcatctttcagaaata

SEQ ID NO: 1379163 - DNA, 19 bp, Homo sapiens
gattgaagtttattatttt

SEQ ID NO: 1379164 - DNA, 21 bp, Homo sapiens
gattgaagtttattattttca

SEQ ID NO: 1379165 - DNA, 23 bp, Homo sapiens
gattgaagtttattattttcaaa

SEQ ID NO: 1379166 - DNA, 22 bp, Homo sapiens
gattgttttttcctaaggaaac

SEQ ID NO: 1379167 - DNA, 19 bp, Homo sapiens
gatttcccaaaaacactaa

SEQ ID NO: 1379168 - DNA, 12 bp, Homo sapiens
gcagaaggaagg

SEQ ID NO: 1379169 - DNA, 22 bp, Homo sapiens
gcagagctgatggagaaggaag

SEQ ID NO: 1379170 - DNA, 18 bp, Homo sapiens
gcagcttgacattatgtt

SEQ ID NO: 1379171 - DNA, 21 bp, Homo sapiens
gcagcttgacattatgtttta

SEQ ID NO: 1379172 - DNA, 21 bp, Homo sapiens
gcatttagtggtggtagaaat

SEQ ID NO: 1379173 - DNA, 22 bp, Homo sapiens
gcatttagtggtggtagaaatg

SEQ ID NO: 1379174 - DNA, 23 bp, Homo sapiens
gcatttagtggtggtagaaatga

SEQ ID NO: 1379175 - DNA, 17 bp, Homo sapiens
gcctgacaattatgaaa

SEQ ID NO: 1379176 - DNA, 20 bp, Homo sapiens
gctaaatgacttgcagatga

SEQ ID NO: 1379177 - DNA, 17 bp, Homo sapiens
gctgatggagaaggaag

SEQ ID NO: 1379178 - DNA, 16 bp, Homo sapiens
gcttattttacaaata

SEQ ID NO: 1379179 - DNA, 16 bp, Homo sapiens
gctttaaacatgatta

SEQ ID NO: 1379180 - DNA, 11 bp, Homo sapiens
gctttttatcg

SEQ ID NO: 1379181 - DNA, 20 bp, Homo sapiens
ggaaactgctttatttttat

SEQ ID NO: 1379182 - DNA, 22 bp, Homo sapiens
ggaaactgctttatttttataa

SEQ ID NO: 1379183 - DNA, 17 bp, Homo sapiens
ggaaatatttttcaact

SEQ ID NO: 1379184 - DNA, 22 bp, Homo sapiens
ggaagaagagatcaggaagaga

SEQ ID NO: 1379185 - DNA, 17 bp, Homo sapiens
ggaagagaaggagcaga

SEQ ID NO: 1379186 - DNA, 17 bp, Homo sapiens
ggaggaggcagagaaga

SEQ ID NO: 1379187 - DNA, 19 bp, Homo sapiens
ggaggcagagaagaaagaa

SEQ ID NO: 1379188 - DNA, 13 bp, Homo sapiens
ggcagattgtttt

SEQ ID NO: 1379189 - DNA, 12 bp, Homo sapiens
ggccaaagaagg

SEQ ID NO: 1379190 - DNA, 15 bp, Homo sapiens
ggctggaataagagg

SEQ ID NO: 1379191 - DNA, 14 bp, Homo sapiens
gtagaaatgattca

SEQ ID NO: 1379192 - DNA, 13 bp, Homo sapiens
gtagtatttatat

SEQ ID NO: 1379193 - DNA, 22 bp, Homo sapiens
gtataagtccatgaatgttcat

SEQ ID NO: 1379194 - DNA, 18 bp, Homo sapiens
gtattaagtgcagcttga

SEQ ID NO: 1379195 - DNA, 16 bp, Homo sapiens
gtcaattgatatttct

SEQ ID NO: 1379196 - DNA, 23 bp, Homo sapiens
gtctccgaagaaaagatatgtat

SEQ ID NO: 1379197 - DNA, 19 bp, Homo sapiens
gtcttttaataaaaaggaa

SEQ ID NO: 1379198 - DNA, 18 bp, Homo sapiens
gtgaaactgcattatttg

SEQ ID NO: 1379199 - DNA, 23 bp, Homo sapiens
gtgacagtttccagatgctatca

SEQ ID NO: 1379200 - DNA, 14 bp, Homo sapiens
gtgatatgttttaa

SEQ ID NO: 1379201 - DNA, 14 bp, Homo sapiens
gtgatcatatatca

SEQ ID NO: 1379202 - DNA, 17 bp, Homo sapiens
gtgtacaacaatgcttt

SEQ ID NO: 1379203 - DNA, 14 bp, Homo sapiens
gtgtttaaatgctg

SEQ ID NO: 1379204 - DNA, 19 bp, Homo sapiens
gttaaaactggatggaaat

SEQ ID NO: 1379205 - DNA, 16 bp, Homo sapiens
gttatcagctctatgt

SEQ ID NO: 1379206 - DNA, 16 bp, Homo sapiens
gttcatatagccaggg

SEQ ID NO: 1379207 - DNA, 17 bp, Homo sapiens
gttcatatagccaggga

SEQ ID NO: 1379208 - DNA, 15 bp, Homo sapiens
gttctagtgaaactg

SEQ ID NO: 1379209 - DNA, 23 bp, Homo sapiens
gttctagtgaaactgcattattt

SEQ ID NO: 1379210 - DNA, 20 bp, Homo sapiens
gttcttcgggtgtgatcata

SEQ ID NO: 1379211 - DNA, 23 bp, Homo sapiens
gttcttcgggtgtgatcatatat

SEQ ID NO: 1379212 - DNA, 16 bp, Homo sapiens
gttttatttaaatgct

SEQ ID NO: 1379213 - DNA, 22 bp, Homo sapiens
gttttatttaaatgctttttat

SEQ ID NO: 1379214 - DNA, 14 bp, Homo sapiens
taaaaaggaaatat

SEQ ID NO: 1379215 - DNA, 21 bp, Homo sapiens
taaaaaggaaatatttttcaa

SEQ ID NO: 1379216 - DNA, 21 bp, Homo sapiens
taaaactgcctgacaattatg

SEQ ID NO: 1379217 - DNA, 17 bp, Homo sapiens
taaacatgattatcttg

SEQ ID NO: 1379218 - DNA, 16 bp, Homo sapiens
taaaggatatttcaaa

SEQ ID NO: 1379219 - DNA, 16 bp, Homo sapiens
taaaggtggttttatt

SEQ ID NO: 1379220 - DNA, 19 bp, Homo sapiens
taaaggtggttttattttc

SEQ ID NO: 1379221 - DNA, 22 bp, Homo sapiens
taaatgacttgcagatgaaaaa

SEQ ID NO: 1379222 - DNA, 12 bp, Homo sapiens
taaatgctgtgt

SEQ ID NO: 1379223 - DNA, 12 bp, Homo sapiens
taaatgcttttt

SEQ ID NO: 1379224 - DNA, 21 bp, Homo sapiens
taacattttggtgacagtttc

SEQ ID NO: 1379225 - DNA, 22 bp, Homo sapiens
taacattttggtgacagtttcc

SEQ ID NO: 1379226 - DNA, 16 bp, Homo sapiens
taagtatgagttatca

SEQ ID NO: 1379227 - DNA, 16 bp, Homo sapiens
tacaaatattaagaaa

SEQ ID NO: 1379228 - DNA, 20 bp, Homo sapiens
tacaaatattaagaaaatat

SEQ ID NO: 1379229 - DNA, 14 bp, Homo sapiens
tagcttttatgtga

SEQ ID NO: 1379230 - DNA, 15 bp, Homo sapiens
tagcttttatgtgat

SEQ ID NO: 1379231 - DNA, 23 bp, Homo sapiens
tagcttttatgtgatatgtttta

SEQ ID NO: 1379232 - DNA, 18 bp, Homo sapiens
tagtatttatatttaaat

SEQ ID NO: 1379233 - DNA, 12 bp, Homo sapiens
tagttatgtctt

SEQ ID NO: 1379234 - DNA, 13 bp, Homo sapiens
tagttatgtcttt

SEQ ID NO: 1379235 - DNA, 17 bp, Homo sapiens
tataagtccatgaatgt

SEQ ID NO: 1379236 - DNA, 22 bp, Homo sapiens
tatatttttatttcattcacat

SEQ ID NO: 1379237 - DNA, 22 bp, Homo sapiens
tatcagctctatgtcaattgat

SEQ ID NO: 1379238 - DNA, 21 bp, Homo sapiens
tatcataaaggatatttcaaa

SEQ ID NO: 1379239 - DNA, 16 bp, Homo sapiens
tatcgctaaatgactt

SEQ ID NO: 1379240 - DNA, 16 bp, Homo sapiens
tatgaaaaaatgttca

SEQ ID NO: 1379241 - DNA, 20 bp, Homo sapiens
tatgaaaaaatgttcaaatt

SEQ ID NO: 1379242 - DNA, 13 bp, Homo sapiens
tatgaaacatgtg

SEQ ID NO: 1379243 - DNA, 22 bp, Homo sapiens
tatgattagttatgtcttttaa

SEQ ID NO: 1379244 - DNA, 17 bp, Homo sapiens
tatgtcaattgatattt

SEQ ID NO: 1379245 - DNA, 19 bp, Homo sapiens
tatgtcaattgatatttct

SEQ ID NO: 1379246 - DNA, 13 bp, Homo sapiens
tatgtgatatgtt

SEQ ID NO: 1379247 - DNA, 19 bp, Homo sapiens
tatgttttatttaaatgct

SEQ ID NO: 1379248 - DNA, 13 bp, Homo sapiens
tattaagaaaata

SEQ ID NO: 1379249 - DNA, 21 bp, Homo sapiens
tattaagtgcagcttgacatt

SEQ ID NO: 1379250 - DNA, 14 bp, Homo sapiens
tattacaggactgc

SEQ ID NO: 1379251 - DNA, 18 bp, Homo sapiens
tattattttcaaaggaaa

SEQ ID NO: 1379252 - DNA, 16 bp, Homo sapiens
tattctaacatttgat

SEQ ID NO: 1379253 - DNA, 12 bp, Homo sapiens
tatttaaatgct

SEQ ID NO: 1379254 - DNA, 14 bp, Homo sapiens
tatttaaatgcttt

SEQ ID NO: 1379255 - DNA, 23 bp, Homo sapiens
tatttacctttttgcttatttta

SEQ ID NO: 1379256 - DNA, 16 bp, Homo sapiens
tatttcaaatgattat

SEQ ID NO: 1379257 - DNA, 19 bp, Homo sapiens
tattttattttttttcaaa

SEQ ID NO: 1379258 - DNA, 21 bp, Homo sapiens
tattttattttttttcaaaat

SEQ ID NO: 1379259 - DNA, 15 bp, Homo sapiens
tattttcaaaggaaa

SEQ ID NO: 1379260 - DNA, 16 bp, Homo sapiens
tattttcaaaggaaaa

SEQ ID NO: 1379261 - DNA, 12 bp, Homo sapiens
tatttttataaa

SEQ ID NO: 1379262 - DNA, 16 bp, Homo sapiens
tatttttataaaactg

SEQ ID NO: 1379263 - DNA, 14 bp, Homo sapiens
tattttttttcaaa

SEQ ID NO: 1379264 - DNA, 18 bp, Homo sapiens
tattttttttcaaaatga

SEQ ID NO: 1379265 - DNA, 15 bp, Homo sapiens
tcaaaatgaagatac

SEQ ID NO: 1379266 - DNA, 14 bp, Homo sapiens
tcaaggtctgcttt

SEQ ID NO: 1379267 - DNA, 20 bp, Homo sapiens
tcaccaggtccaatgttgtt

SEQ ID NO: 1379268 - DNA, 14 bp, Homo sapiens
tcagagattaaaaa

SEQ ID NO: 1379269 - DNA, 19 bp, Homo sapiens
tcagagattaaaaaaggta

SEQ ID NO: 1379270 - DNA, 16 bp, Homo sapiens
tcaggaagagaaggag

SEQ ID NO: 1379271 - DNA, 20 bp, Homo sapiens
tcaggaagagaaggagcaga

SEQ ID NO: 1379272 - DNA, 18 bp, Homo sapiens
tcataaaggatatttcaa

SEQ ID NO: 1379273 - DNA, 14 bp, Homo sapiens
tcatatagccaggg

SEQ ID NO: 1379274 - DNA, 17 bp, Homo sapiens
tcatctggattccagag

SEQ ID NO: 1379275 - DNA, 21 bp, Homo sapiens
tccaaaattcagggctttaaa

SEQ ID NO: 1379276 - DNA, 15 bp, Homo sapiens
tccaccgcagaagga

SEQ ID NO: 1379277 - DNA, 16 bp, Homo sapiens
tccaccgcagaaggaa

SEQ ID NO: 1379278 - DNA, 18 bp, Homo sapiens
tccaccgcagaaggaagg

SEQ ID NO: 1379279 - DNA, 15 bp, Homo sapiens
tccatgaatgttcat

SEQ ID NO: 1379280 - DNA, 21 bp, Homo sapiens
tccgaagaaaagatatgtatt

SEQ ID NO: 1379281 - DNA, 15 bp, Homo sapiens
tcctaaggaaactgc

SEQ ID NO: 1379282 - DNA, 22 bp, Homo sapiens
tcctaaggaaactgctttattt

SEQ ID NO: 1379283 - DNA, 16 bp, Homo sapiens
tcgagtgtttaaatgc

SEQ ID NO: 1379284 - DNA, 17 bp, Homo sapiens
tcgagtgtttaaatgct

SEQ ID NO: 1379285 - DNA, 21 bp, Homo sapiens
tctaggcagttcaaagcagga

SEQ ID NO: 1379286 - DNA, 21 bp, Homo sapiens
tctagtgaaactgcattattt

SEQ ID NO: 1379287 - DNA, 14 bp, Homo sapiens
tctatatccaaaat

SEQ ID NO: 1379288 - DNA, 15 bp, Homo sapiens
tctatatccaaaatt

SEQ ID NO: 1379289 - DNA, 17 bp, Homo sapiens
tctatatccaaaattca

SEQ ID NO: 1379290 - DNA, 17 bp, Homo sapiens
tctatgtcaattgatat

SEQ ID NO: 1379291 - DNA, 23 bp, Homo sapiens
tctatgtcaattgatatttctgt

SEQ ID NO: 1379292 - DNA, 16 bp, Homo sapiens
tctcagagattaaaaa

SEQ ID NO: 1379293 - DNA, 14 bp, Homo sapiens
tctggattccagag

SEQ ID NO: 1379294 - DNA, 22 bp, Homo sapiens
tctggattccagagcactgctc

SEQ ID NO: 1379295 - DNA, 13 bp, Homo sapiens
tcttctctatatt

SEQ ID NO: 1379296 - DNA, 17 bp, Homo sapiens
tcttctctatattttta

SEQ ID NO: 1379297 - DNA, 12 bp, Homo sapiens
tcttttaataaa

SEQ ID NO: 1379298 - DNA, 11 bp, Homo sapiens
tgaaaaaatgt

SEQ ID NO: 1379299 - DNA, 15 bp, Homo sapiens
tgaaaaaatgttcaa

SEQ ID NO: 1379300 - DNA, 21 bp, Homo sapiens
tgaaatgattcatctttcaga

SEQ ID NO: 1379301 - DNA, 13 bp, Homo sapiens
tgaagatacacat

SEQ ID NO: 1379302 - DNA, 23 bp, Homo sapiens
tgaagatacacattacagccagg

SEQ ID NO: 1379303 - DNA, 19 bp, Homo sapiens
tgaagtttattattttcaa

SEQ ID NO: 1379304 - DNA, 16 bp, Homo sapiens
tgaatcttaacatttt

SEQ ID NO: 1379305 - DNA, 23 bp, Homo sapiens
tgaccctccaccgcagaaggaag

SEQ ID NO: 1379306 - DNA, 19 bp, Homo sapiens
tgactcgagtgtttaaatg

SEQ ID NO: 1379307 - DNA, 18 bp, Homo sapiens
tgagaagagttttctcag

SEQ ID NO: 1379308 - DNA, 20 bp, Homo sapiens
tgagaagagttttctcagag

SEQ ID NO: 1379309 - DNA, 23 bp, Homo sapiens
tgagatcccgtctccgaagaaaa

SEQ ID NO: 1379310 - DNA, 15 bp, Homo sapiens
tgataattttgaaat

SEQ ID NO: 1379311 - DNA, 19 bp, Homo sapiens
tgataattttgaaatgatt

SEQ ID NO: 1379312 - DNA, 22 bp, Homo sapiens
tgataattttgaaatgattcat

SEQ ID NO: 1379313 - DNA, 21 bp, Homo sapiens
tgatattacaggactgcagaa

SEQ ID NO: 1379314 - DNA, 16 bp, Homo sapiens
tgatatttctgtgtag

SEQ ID NO: 1379315 - DNA, 14 bp, Homo sapiens
tgatggagaaggaa

SEQ ID NO: 1379316 - DNA, 15 bp, Homo sapiens
tgatggagaaggaag

SEQ ID NO: 1379317 - DNA, 24 bp, Homo sapiens
tgctatcacagactctgctagtga

SEQ ID NO: 1379318 - DNA, 15 bp, Homo sapiens
tgcttgcttgtgaat

SEQ ID NO: 1379319 - DNA, 11 bp, Homo sapiens
tggagaaggaa

SEQ ID NO: 1379320 - DNA, 15 bp, Homo sapiens
tgtacaacaatgctt

SEQ ID NO: 1379321 - DNA, 16 bp, Homo sapiens
tgtagcttttatgtga

SEQ ID NO: 1379322 - DNA, 15 bp, Homo sapiens
tgtagtatttatatt

SEQ ID NO: 1379323 - DNA, 18 bp, Homo sapiens
tgtagtatttatatttaa

SEQ ID NO: 1379324 - DNA, 21 bp, Homo sapiens
tgtagtatttatatttaaatt

SEQ ID NO: 1379325 - DNA, 23 bp, Homo sapiens
tgtataagtccatgaatgttcat

SEQ ID NO: 1379326 - DNA, 18 bp, Homo sapiens
tgtcaattgatatttctg

SEQ ID NO: 1379327 - DNA, 22 bp, Homo sapiens
tgtcttttaataaaaaggaaat

SEQ ID NO: 1379328 - DNA, 15 bp, Homo sapiens
tgtgaatcttaacat

SEQ ID NO: 1379329 - DNA, 16 bp, Homo sapiens
tgtgatatgttttaaa

SEQ ID NO: 1379330 - DNA, 12 bp, Homo sapiens
tgttcaaattca

SEQ ID NO: 1379331 - DNA, 23 bp, Homo sapiens
tgttcaccagtgcttgcttgtga

SEQ ID NO: 1379332 - DNA, 16 bp, Homo sapiens
tgttttcatttgtata

SEQ ID NO: 1379333 - DNA, 16 bp, Homo sapiens
ttaaacatgattatct

SEQ ID NO: 1379334 - DNA, 13 bp, Homo sapiens
ttaaagttaaaac

SEQ ID NO: 1379335 - DNA, 12 bp, Homo sapiens
ttaaatgctgtg

SEQ ID NO: 1379336 - DNA, 12 bp, Homo sapiens
ttacagccaggt

SEQ ID NO: 1379337 - DNA, 17 bp, Homo sapiens
ttatcagctctatgtca

SEQ ID NO: 1379338 - DNA, 16 bp, Homo sapiens
ttatgaaaaaatgttc

SEQ ID NO: 1379339 - DNA, 21 bp, Homo sapiens
ttatgaaaaaatgttcaaatt

SEQ ID NO: 1379340 - DNA, 13 bp, Homo sapiens
ttattattttcaa

SEQ ID NO: 1379341 - DNA, 15 bp, Homo sapiens
ttattattttcaaag

SEQ ID NO: 1379342 - DNA, 21 bp, Homo sapiens
ttattgttgctgaaaactcta

SEQ ID NO: 1379343 - DNA, 14 bp, Homo sapiens
ttatttcattcaca

SEQ ID NO: 1379344 - DNA, 15 bp, Homo sapiens
ttatttttataaaac

SEQ ID NO: 1379345 - DNA, 14 bp, Homo sapiens
ttattttttttcaa

SEQ ID NO: 1379346 - DNA, 20 bp, Homo sapiens
ttattttttttcaaaatgaa

SEQ ID NO: 1379347 - DNA, 11 bp, Homo sapiens
ttcaaaatgaa

SEQ ID NO: 1379348 - DNA, 20 bp, Homo sapiens
ttcaaaatgaagatacacat

SEQ ID NO: 1379349 - DNA, 22 bp, Homo sapiens
ttcaaaatgaagatacacatta

SEQ ID NO: 1379350 - DNA, 13 bp, Homo sapiens
ttcaaatgattat

SEQ ID NO: 1379351 - DNA, 17 bp, Homo sapiens
ttcaaggtctgcttttc

SEQ ID NO: 1379352 - DNA, 16 bp, Homo sapiens
ttcatgttttaactta

SEQ ID NO: 1379353 - DNA, 18 bp, Homo sapiens
ttcatgttttaacttatt

SEQ ID NO: 1379354 - DNA, 15 bp, Homo sapiens
ttcattcacattaat

SEQ ID NO: 1379355 - DNA, 18 bp, Homo sapiens
ttccagatgctatcacag

SEQ ID NO: 1379356 - DNA, 16 bp, Homo sapiens
ttcccttcatgtttta

SEQ ID NO: 1379357 - DNA, 20 bp, Homo sapiens
ttctgtcattgttaaataca

SEQ ID NO: 1379358 - DNA, 22 bp, Homo sapiens
ttctgtcattgttaaatacaca

SEQ ID NO: 1379359 - DNA, 18 bp, Homo sapiens
ttcttctatatccaaaat

SEQ ID NO: 1379360 - DNA, 14 bp, Homo sapiens
ttgacattatgttt

SEQ ID NO: 1379361 - DNA, 22 bp, Homo sapiens
ttgacattatgttttatttaaa

SEQ ID NO: 1379362 - DNA, 21 bp, Homo sapiens
ttgagcccaggagttcaagac

SEQ ID NO: 1379363 - DNA, 12 bp, Homo sapiens
ttggttatgaaa

SEQ ID NO: 1379364 - DNA, 17 bp, Homo sapiens
ttgtgaatcttaacatt

SEQ ID NO: 1379365 - DNA, 19 bp, Homo sapiens
ttgtgaatcttaacatttt

SEQ ID NO: 1379366 - DNA, 16 bp, Homo sapiens
tttaaagttaaaactg

SEQ ID NO: 1379367 - DNA, 12 bp, Homo sapiens
tttaaatgcttt

SEQ ID NO: 1379368 - DNA, 18 bp, Homo sapiens
tttaactatcttctctat

SEQ ID NO: 1379369 - DNA, 22 bp, Homo sapiens
tttaactatcttctctatattt

SEQ ID NO: 1379370 - DNA, 14 bp, Homo sapiens
tttaagtatgagtt

SEQ ID NO: 1379371 - DNA, 14 bp, Homo sapiens
tttaataaaaagga

SEQ ID NO: 1379372 - DNA, 17 bp, Homo sapiens
tttaataaaaaggaaat

SEQ ID NO: 1379373 - DNA, 22 bp, Homo sapiens
tttagtggtggtagaaatgatt

SEQ ID NO: 1379374 - DNA, 24 bp, Homo sapiens
tttatatttaaattatatttacct

SEQ ID NO: 1379375 - DNA, 16 bp, Homo sapiens
tttatcgctaaatgac

SEQ ID NO: 1379376 - DNA, 17 bp, Homo sapiens
tttatcgctaaatgact

SEQ ID NO: 1379377 - DNA, 16 bp, Homo sapiens
tttatgtgatatgttt

SEQ ID NO: 1379378 - DNA, 13 bp, Homo sapiens
tttattattttca

SEQ ID NO: 1379379 - DNA, 14 bp, Homo sapiens
tttatttaaatgct

SEQ ID NO: 1379380 - DNA, 10 bp, Homo sapiens
tttattttat

SEQ ID NO: 1379381 - DNA, 17 bp, Homo sapiens
tttattttttttcaaaa

SEQ ID NO: 1379382 - DNA, 14 bp, Homo sapiens
tttcaaaatgaaga

SEQ ID NO: 1379383 - DNA, 13 bp, Homo sapiens
tttcaaaggaaaa

SEQ ID NO: 1379384 - DNA, 14 bp, Homo sapiens
tttcaaatgattat

SEQ ID NO: 1379385 - DNA, 15 bp, Homo sapiens
tttcaacttcttcta

SEQ ID NO: 1379386 - DNA, 19 bp, Homo sapiens
tttcaacttcttctatatc

SEQ ID NO: 1379387 - DNA, 19 bp, Homo sapiens
tttcagaaataaaagtatg

SEQ ID NO: 1379388 - DNA, 16 bp, Homo sapiens
tttcccttcatgtttt

SEQ ID NO: 1379389 - DNA, 13 bp, Homo sapiens
tttcctaaggaaa

SEQ ID NO: 1379390 - DNA, 21 bp, Homo sapiens
tttgataattttgaaatgatt

SEQ ID NO: 1379391 - DNA, 20 bp, Homo sapiens
tttgcttattttacaaatat

SEQ ID NO: 1379392 - DNA, 14 bp, Homo sapiens
tttggttatgaaac

SEQ ID NO: 1379393 - DNA, 22 bp, Homo sapiens
tttgtataagtccatgaatgtt

SEQ ID NO: 1379394 - DNA, 18 bp, Homo sapiens
ttttaataaaaaggaaat

SEQ ID NO: 1379395 - DNA, 20 bp, Homo sapiens
ttttacaaatattaagaaaa

SEQ ID NO: 1379396 - DNA, 16 bp, Homo sapiens
ttttatttcattcaca

SEQ ID NO: 1379397 - DNA, 23 bp, Homo sapiens
ttttcaaaggaaaacacctttat

SEQ ID NO: 1379398 - DNA, 16 bp, Homo sapiens
ttttcaacttcttcta

SEQ ID NO: 1379399 - DNA, 12 bp, Homo sapiens
ttttctgtcatt

SEQ ID NO: 1379400 - DNA, 15 bp, Homo sapiens
tttaaacatgattat

SEQ ID NO: 1379401 - DNA, 18 bp, Homo sapiens
tttaaacatgattatctt

SEQ ID NO: 1379402 - DNA, 18 bp, Homo sapiens
tttacaaatattaagaaa

SEQ ID NO: 1379403 - DNA, 23 bp, Homo sapiens
tttacaaatattaagaaaatatt

SEQ ID NO: 1379404 - DNA, 17 bp, Homo sapiens
tttacctttttgcttat

SEQ ID NO: 1379405 - DNA, 21 bp, Homo sapiens
tttagtggtggtagaaatgat

SEQ ID NO: 1379406 - DNA, 13 bp, Homo sapiens
tttatatttaaat

SEQ ID NO: 1379407 - DNA, 15 bp, Homo sapiens
tttattattttcaaa

SEQ ID NO: 1379408 - DNA, 15 bp, Homo sapiens
tttattttttttcaa

SEQ ID NO: 1379409 - DNA, 22 bp, Homo sapiens
tttcaaaatgaagatacacatt

SEQ ID NO: 1379410 - DNA, 12 bp, Homo sapiens
tttcaaaggaaa

SEQ ID NO: 1379411 - DNA, 23 bp, Homo sapiens
tttcaaatgattatgattagtta

SEQ ID NO: 1379412 - DNA, 17 bp, Homo sapiens
tttcagaaataaaagta

SEQ ID NO: 1379413 - DNA, 15 bp, Homo sapiens
tttcctaaggaaact

SEQ ID NO: 1379414 - DNA, 16 bp, Homo sapiens
tttcctaaggaaactg

SEQ ID NO: 1379415 - DNA, 19 bp, Homo sapiens
tttcctaaggaaactgctt

SEQ ID NO: 1379416 - DNA, 20 bp, Homo sapiens
tttcctaaggaaactgcttt

SEQ ID NO: 1379417 - DNA, 22 bp, Homo sapiens
tttcctaaggaaactgctttat

SEQ ID NO: 1379418 - DNA, 19 bp, Homo sapiens
tttctgtcattgttaaata

SEQ ID NO: 1379419 - DNA, 20 bp, Homo sapiens
tttctgtgtagtatttatat

SEQ ID NO: 1379420 - DNA, 17 bp, Homo sapiens
tttgataattttgaaat

SEQ ID NO: 1379421 - DNA, 14 bp, Homo sapiens
tttgcttattttac

SEQ ID NO: 1379422 - DNA, 13 bp, Homo sapiens
tttggttatgaaa

SEQ ID NO: 1379423 - DNA, 14 bp, Homo sapiens
ttttaaagttaaaa

SEQ ID NO: 1379424 - DNA, 14 bp, Homo sapiens
ttttaacttattgt

SEQ ID NO: 1379425 - DNA, 22 bp, Homo sapiens
ttttacaaatattaagaaaata

SEQ ID NO: 1379426 - DNA, 15 bp, Homo sapiens
ttttatttaaatgct

SEQ ID NO: 1379427 - DNA, 16 bp, Homo sapiens
ttttatttaaatgctt

SEQ ID NO: 1379428 - DNA, 15 bp, Homo sapiens
ttttattttcccttc

SEQ ID NO: 1379429 - DNA, 14 bp, Homo sapiens
ttttcaaaatgaag

SEQ ID NO: 1379430 - DNA, 17 bp, Homo sapiens
ttttcccttcatgtttt

SEQ ID NO: 1379431 - DNA, 13 bp, Homo sapiens
ttttctcagagat

SEQ ID NO: 1379432 - DNA, 17 bp, Homo sapiens
tttttcaacttcttcta

SEQ ID NO: 1379433 - DNA, 15 bp, Homo sapiens
tttttcctaaggaaa

SEQ ID NO: 1379434 - DNA, 21 bp, Homo sapiens
ttttttcaaaatgaagataca

SEQ ID NO: 1379435 - DNA, 12 bp, Homo sapiens
tttttttcaaaa

SEQ ID NO: 1379436 - DNA, 20 bp, Homo sapiens
atttagtggtggtagaaatg

SEQ ID NO: 1379437 - DNA, 21 bp, Homo sapiens
atttagtggtggtagaaatga

SEQ ID NO: 1379438 - DNA, 24 bp, Homo sapiens
atttagtggtggtagaaatgattc

SEQ ID NO: 1379439 - DNA, 18 bp, Homo sapiens
atttatatttaaattata

SEQ ID NO: 1379440 - DNA, 21 bp, Homo sapiens
gcttttatgtgatatgtttta

SEQ ID NO: 1379441 - DNA, 20 bp, Homo sapiens
ggaaaacacctttattttat

SEQ ID NO: 1379442 - DNA, 14 bp, Homo sapiens
ggaaatatttttca

SEQ ID NO: 1379443 - DNA, 21 bp, Homo sapiens
ggaagaagagatcaggaagag

SEQ ID NO: 1379444 - DNA, 14 bp, Homo sapiens
ggaggcagagaaga

SEQ ID NO: 1379445 - DNA, 15 bp, Homo sapiens
ggaggcagagaagaa

SEQ ID NO: 1379446 - DNA, 15 bp, Homo sapiens
ggctttaaacatgat

SEQ ID NO: 1379447 - DNA, 20 bp, Homo sapiens
gtatttatatttaaattata

SEQ ID NO: 1379448 - DNA, 19 bp, Homo sapiens
gtcaattgatatttctgtg

SEQ ID NO: 1379449 - DNA, 19 bp, Homo sapiens
gtccctttggacaaatgca

SEQ ID NO: 1379450 - DNA, 14 bp, Homo sapiens
gtggagtgtattaa

SEQ ID NO: 1379451 - DNA, 13 bp, Homo sapiens
gttaaatacacat

SEQ ID NO: 1379452 - DNA, 17 bp, Homo sapiens
gttttatttaaatgctt

SEQ ID NO: 1379453 - DNA, 19 bp, Homo sapiens
gttttttcctaaggaaact

SEQ ID NO: 1379454 - DNA, 15 bp, Homo sapiens
taaacatgattatct

SEQ ID NO: 1379455 - DNA, 16 bp, Homo sapiens
taaacatgattatctt

SEQ ID NO: 1379456 - DNA, 14 bp, Homo sapiens
taaaggatatttca

SEQ ID NO: 1379457 - DNA, 21 bp, Homo sapiens
taaaggatatttcaaatgatt

SEQ ID NO: 1379458 - DNA, 16 bp, Homo sapiens
taaatacacattatca

SEQ ID NO: 1379459 - DNA, 15 bp, Homo sapiens
taaatgacttgcaga

SEQ ID NO: 1379460 - DNA, 23 bp, Homo sapiens
taaatgacttgcagatgaaaaaa

SEQ ID NO: 1379461 - DNA, 13 bp, Homo sapiens
taaatgcttttta

SEQ ID NO: 1379462 - DNA, 23 bp, Homo sapiens
taacattttggtgacagtttcca

SEQ ID NO: 1379463 - DNA, 16 bp, Homo sapiens
taactatcttctctat

SEQ ID NO: 1379464 - DNA, 12 bp, Homo sapiens
taagaaaatatt

SEQ ID NO: 1379465 - DNA, 20 bp, Homo sapiens
taagaaaatattctaacatt

SEQ ID NO: 1379466 - DNA, 13 bp, Homo sapiens
taagtatgagtta

SEQ ID NO: 1379467 - DNA, 21 bp, Homo sapiens
taagtatgagttatcagctct

SEQ ID NO: 1379468 - DNA, 18 bp, Homo sapiens
taagtccatgaatgttca

SEQ ID NO: 1379469 - DNA, 14 bp, Homo sapiens
taatttgttttcat

SEQ ID NO: 1379470 - DNA, 19 bp, Homo sapiens
taatttgttttcatttgta

SEQ ID NO: 1379471 - DNA, 15 bp, Homo sapiens
tacaaatattaagaa

SEQ ID NO: 1379472 - DNA, 13 bp, Homo sapiens
tacctttttgctt

SEQ ID NO: 1379473 - DNA, 18 bp, Homo sapiens
tagtggtggtagaaatga

SEQ ID NO: 1379474 - DNA, 21 bp, Homo sapiens
tatatcataaaggatatttca

SEQ ID NO: 1379475 - DNA, 11 bp, Homo sapiens
tatatttaaat

SEQ ID NO: 1379476 - DNA, 20 bp, Homo sapiens
tatatttttatttcattcac

SEQ ID NO: 1379477 - DNA, 18 bp, Homo sapiens
tatcagctctatgtcaat

SEQ ID NO: 1379478 - DNA, 15 bp, Homo sapiens
tatcataaaggatat

SEQ ID NO: 1379479 - DNA, 23 bp, Homo sapiens
tatcataaaggatatttcaaatg

SEQ ID NO: 1379480 - DNA, 19 bp, Homo sapiens
tatgaaaaaatgttcaaat

SEQ ID NO: 1379481 - DNA, 15 bp, Homo sapiens
tatgattagttatgt

SEQ ID NO: 1379482 - DNA, 18 bp, Homo sapiens
tatgattagttatgtctt

SEQ ID NO: 1379483 - DNA, 20 bp, Homo sapiens
tatgattagttatgtctttt

SEQ ID NO: 1379484 - DNA, 18 bp, Homo sapiens
tatgtccggctttaacta

SEQ ID NO: 1379485 - DNA, 16 bp, Homo sapiens
tatgttttatttaaat

SEQ ID NO: 1379486 - DNA, 18 bp, Homo sapiens
tattaagaaaatattcta

SEQ ID NO: 1379487 - DNA, 20 bp, Homo sapiens
tattaagtgcagcttgacat

SEQ ID NO: 1379488 - DNA, 13 bp, Homo sapiens
tattattttcaaa

SEQ ID NO: 1379489 - DNA, 19 bp, Homo sapiens
tattattttcaaaggaaaa

SEQ ID NO: 1379490 - DNA, 13 bp, Homo sapiens
tattctaacattt

SEQ ID NO: 1379491 - DNA, 17 bp, Homo sapiens
tattgttgctgaaaact

SEQ ID NO: 1379492 - DNA, 15 bp, Homo sapiens
tatttcattcacatt

SEQ ID NO: 1379493 - DNA, 16 bp, Homo sapiens
tattttacaaatatta

SEQ ID NO: 1379494 - DNA, 18 bp, Homo sapiens
tattttcccttcatgttt

SEQ ID NO: 1379495 - DNA, 19 bp, Homo sapiens
tattttcccttcatgtttt

SEQ ID NO: 1379496 - DNA, 20 bp, Homo sapiens
tattttcccttcatgtttta

SEQ ID NO: 1379497 - DNA, 23 bp, Homo sapiens
tattttttttcaaaatgaagata

SEQ ID NO: 1379498 - DNA, 21 bp, Homo sapiens
tcaaaggaaaacacctttatt

SEQ ID NO: 1379499 - DNA, 21 bp, Homo sapiens
tcaaattcacgttctagtgaa

SEQ ID NO: 1379500 - DNA, 22 bp, Homo sapiens
tcaaattcacgttctagtgaaa

SEQ ID NO: 1379501 - DNA, 13 bp, Homo sapiens
tcaacttcttcta

SEQ ID NO: 1379502 - DNA, 20 bp, Homo sapiens
tcaattgatatttctgtgta

SEQ ID NO: 1379503 - DNA, 19 bp, Homo sapiens
tcacagactctgctagtga

SEQ ID NO: 1379504 - DNA, 22 bp, Homo sapiens
tcactgaaaaaatgtagctttt

SEQ ID NO: 1379505 - DNA, 15 bp, Homo sapiens
tcaggaagagaagga

SEQ ID NO: 1379506 - DNA, 23 bp, Homo sapiens
tcataaaggatatttcaaatgat

SEQ ID NO: 1379507 - DNA, 13 bp, Homo sapiens
tcatatatcataa

SEQ ID NO: 1379508 - DNA, 15 bp, Homo sapiens
tcatatatcataaag

SEQ ID NO: 1379509 - DNA, 17 bp, Homo sapiens
tcatatatcataaagga

SEQ ID NO: 1379510 - DNA, 15 bp, Homo sapiens
tcatctttcagaaat

SEQ ID NO: 1379511 - DNA, 19 bp, Homo sapiens
tcatctttcagaaataaaa

SEQ ID NO: 1379512 - DNA, 14 bp, Homo sapiens
tcatgttttaactt

SEQ ID NO: 1379513 - DNA, 17 bp, Homo sapiens
tccagagcactgctcca

SEQ ID NO: 1379514 - DNA, 18 bp, Homo sapiens
tccctttggacaaatgca

SEQ ID NO: 1379515 - DNA, 15 bp, Homo sapiens
tccgaagaaaagata

SEQ ID NO: 1379516 - DNA, 16 bp, Homo sapiens
tccgaagaaaagatat

SEQ ID NO: 1379517 - DNA, 12 bp, Homo sapiens
tcctaaggaaac

SEQ ID NO: 1379518 - DNA, 17 bp, Homo sapiens
tctatatttttatttca

SEQ ID NO: 1379519 - DNA, 18 bp, Homo sapiens
tctatgtcaattgatatt

SEQ ID NO: 1379520 - DNA, 20 bp, Homo sapiens
tctatgtccggctttaacta

SEQ ID NO: 1379521 - DNA, 17 bp, Homo sapiens
tcttcgggtgtgatcat

SEQ ID NO: 1379522 - DNA, 21 bp, Homo sapiens
tcttcgggtgtgatcatatat

SEQ ID NO: 1379523 - DNA, 15 bp, Homo sapiens
tcttctatatccaaa

SEQ ID NO: 1379524 - DNA, 19 bp, Homo sapiens
tcttttaataaaaaggaaa

SEQ ID NO: 1379525 - DNA, 21 bp, Homo sapiens
tgaaaaaatgtagcttttatg

SEQ ID NO: 1379526 - DNA, 20 bp, Homo sapiens
tgaaacatgtggagtgtatt

SEQ ID NO: 1379527 - DNA, 13 bp, Homo sapiens
tgaaatgattcat

SEQ ID NO: 1379528 - DNA, 18 bp, Homo sapiens
tgaagtttattattttca

SEQ ID NO: 1379529 - DNA, 20 bp, Homo sapiens
tgaagtttattattttcaaa

SEQ ID NO: 1379530 - DNA, 14 bp, Homo sapiens
tgaatcttaacatt

SEQ ID NO: 1379531 - DNA, 14 bp, Homo sapiens
tgacattatgtttt

SEQ ID NO: 1379532 - DNA, 22 bp, Homo sapiens
tgacattatgttttatttaaat

SEQ ID NO: 1379533 - DNA, 15 bp, Homo sapiens
tgacttgcagatgaa

SEQ ID NO: 1379534 - DNA, 17 bp, Homo sapiens
tgacttgcagatgaaaa

SEQ ID NO: 1379535 - DNA, 18 bp, Homo sapiens
tgacttgcagatgaaaaa

SEQ ID NO: 1379536 - DNA, 17 bp, Homo sapiens
tgataattttgaaatga

SEQ ID NO: 1379537 - DNA, 16 bp, Homo sapiens
tgatatgttttaaagt

SEQ ID NO: 1379538 - DNA, 13 bp, Homo sapiens
tgatcatatatca

SEQ ID NO: 1379539 - DNA, 13 bp, Homo sapiens
tgatggagaagga

SEQ ID NO: 1379540 - DNA, 13 bp, Homo sapiens
tgattagttatgt

SEQ ID NO: 1379541 - DNA, 15 bp, Homo sapiens
tgattagttatgtct

SEQ ID NO: 1379542 - DNA, 22 bp, Homo sapiens
tgattagttatgtcttttaata

SEQ ID NO: 1379543 - DNA, 19 bp, Homo sapiens
tgattatgattagttatgt

SEQ ID NO: 1379544 - DNA, 19 bp, Homo sapiens
tgattcatctttcagaaat

SEQ ID NO: 1379545 - DNA, 24 bp, Homo sapiens
tgcagatgaaaaaaactaaggtga

SEQ ID NO: 1379546 - DNA, 13 bp, Homo sapiens
tgcattatttgtt

SEQ ID NO: 1379547 - DNA, 22 bp, Homo sapiens
tgcctgacaattatgaaaaaat

SEQ ID NO: 1379548 - DNA, 13 bp, Homo sapiens
aaaaaatgtagct

SEQ ID NO: 1379549 - DNA, 18 bp, Homo sapiens
aaaaaggtagtttttctg

SEQ ID NO: 1379550 - DNA, 18 bp, Homo sapiens
aaaaatgtagcttttatg

SEQ ID NO: 1379551 - DNA, 17 bp, Homo sapiens
aaaactggatggaaata

SEQ ID NO: 1379552 - DNA, 20 bp, Homo sapiens
aaaagatatgtattctaatt

SEQ ID NO: 1379553 - DNA, 13 bp, Homo sapiens
aaaaggaaatatt

SEQ ID NO: 1379554 - DNA, 15 bp, Homo sapiens
aaaaggaaatatttt

SEQ ID NO: 1379555 - DNA, 15 bp, Homo sapiens
aaaatattctaacat

SEQ ID NO: 1379556 - DNA, 18 bp, Homo sapiens
aaaatgaagatacacatt

SEQ ID NO: 1379557 - DNA, 23 bp, Homo sapiens
aaaatgtagcttttatgtgatat

SEQ ID NO: 1379558 - DNA, 19 bp, Homo sapiens
aaaattcagggctttaaac

SEQ ID NO: 1379559 - DNA, 21 bp, Homo sapiens
aaaattcagggctttaaacat

SEQ ID NO: 1379560 - DNA, 14 bp, Homo sapiens
aaacatgattatct

SEQ ID NO: 1379561 - DNA, 15 bp, Homo sapiens
aaactgctttatttt

SEQ ID NO: 1379562 - DNA, 19 bp, Homo sapiens
aaagaacggaagaagagat

SEQ ID NO: 1379563 - DNA, 19 bp, Homo sapiens
aaaggaaatatttttcaac

SEQ ID NO: 1379564 - DNA, 15 bp, Homo sapiens
aaaggatatttcaaa

SEQ ID NO: 1379565 - DNA, 17 bp, Homo sapiens
aaaggatatttcaaatg

SEQ ID NO: 1379566 - DNA, 21 bp, Homo sapiens
aaaggatatttcaaatgatta

SEQ ID NO: 1379567 - DNA, 19 bp, Homo sapiens
aaaggtggttttattttcc

SEQ ID NO: 1379568 - DNA, 14 bp, Homo sapiens
aaataaaagtatga

SEQ ID NO: 1379569 - DNA, 17 bp, Homo sapiens
aaatacacattatcact

SEQ ID NO: 1379570 - DNA, 15 bp, Homo sapiens
aaatattaagaaaat

SEQ ID NO: 1379571 - DNA, 22 bp, Homo sapiens
aaatatttttcaacttcttcta

SEQ ID NO: 1379572 - DNA, 18 bp, Homo sapiens
aaatgacttgcagatgaa

SEQ ID NO: 1379573 - DNA, 23 bp, Homo sapiens
aaatgattatgattagttatgtc

SEQ ID NO: 1379574 - DNA, 13 bp, Homo sapiens
aaatgattcatct

SEQ ID NO: 1379575 - DNA, 20 bp, Homo sapiens
aaatgattcatctttcagaa

SEQ ID NO: 1379576 - DNA, 22 bp, Homo sapiens
aaatgattcatctttcagaaat

SEQ ID NO: 1379577 - DNA, 12 bp, Homo sapiens
aaatgcttttta

SEQ ID NO: 1379578 - DNA, 15 bp, Homo sapiens
aaattatatttacct

SEQ ID NO: 1379579 - DNA, 14 bp, Homo sapiens
aacacctttatttt

SEQ ID NO: 1379580 - DNA, 16 bp, Homo sapiens
aacatgtggagtgtat

SEQ ID NO: 1379581 - DNA, 16 bp, Homo sapiens
aacatttgataatttt

SEQ ID NO: 1379582 - DNA, 18 bp, Homo sapiens
aactatcttctctatatt

SEQ ID NO: 1379583 - DNA, 22 bp, Homo sapiens
aactgctttatttttataaaac

SEQ ID NO: 1379584 - DNA, 11 bp, Homo sapiens
aacttattgtt

SEQ ID NO: 1379585 - DNA, 14 bp, Homo sapiens
aagaacggaagaag

SEQ ID NO: 1379586 - DNA, 16 bp, Homo sapiens
aagagatcaggaagag

SEQ ID NO: 1379587 - DNA, 21 bp, Homo sapiens
aagatacacattacagccagg

SEQ ID NO: 1379588 - DNA, 22 bp, Homo sapiens
aagatacacattacagccaggt

SEQ ID NO: 1379589 - DNA, 18 bp, Homo sapiens
aagctttggttatgaaac

SEQ ID NO: 1379590 - DNA, 16 bp, Homo sapiens
aaggaaactgctttat

SEQ ID NO: 1379591 - DNA, 15 bp, Homo sapiens
aaggaaatatttttc

SEQ ID NO: 1379592 - DNA, 13 bp, Homo sapiens
aaggtggttttat

SEQ ID NO: 1379593 - DNA, 15 bp, Homo sapiens
aagtccatgaatgtt

SEQ ID NO: 1379594 - DNA, 17 bp, Homo sapiens
aagtccatgaatgttca

SEQ ID NO: 1379595 - DNA, 22 bp, Homo sapiens
aagttaaaactggatggaaata

SEQ ID NO: 1379596 - DNA, 17 bp, Homo sapiens
aagtttattattttcaa

SEQ ID NO: 1379597 - DNA, 19 bp, Homo sapiens
aagtttattattttcaaag

SEQ ID NO: 1379598 - DNA, 22 bp, Homo sapiens
aataaaaaggaaatatttttca

SEQ ID NO: 1379599 - DNA, 12 bp, Homo sapiens
aataatttgttt

SEQ ID NO: 1379600 - DNA, 14 bp, Homo sapiens
aatacacattatca

SEQ ID NO: 1379601 - DNA, 15 bp, Homo sapiens
aatattctaacattt

SEQ ID NO: 1379602 - DNA, 21 bp, Homo sapiens
aatatttttcaacttcttcta

SEQ ID NO: 1379603 - DNA, 13 bp, Homo sapiens
aatcttaacattt

SEQ ID NO: 1379604 - DNA, 19 bp, Homo sapiens
aatgattcatctttcagaa

SEQ ID NO: 1379605 - DNA, 14 bp, Homo sapiens
aattcagggcttta

SEQ ID NO: 1379606 - DNA, 14 bp, Homo sapiens
aattgatatttctg

SEQ ID NO: 1379607 - DNA, 21 bp, Homo sapiens
aatttgttttcatttgtataa

SEQ ID NO: 1379608 - DNA, 15 bp, Homo sapiens
aattttgaaatgatt

SEQ ID NO: 1379609 - DNA, 17 bp, Homo sapiens
aattttgaaatgattca

SEQ ID NO: 1379610 - DNA, 22 bp, Homo sapiens
aattttgaaatgattcatcttt

SEQ ID NO: 1379611 - DNA, 19 bp, Homo sapiens
acaataatttgttttcatt

SEQ ID NO: 1379612 - DNA, 21 bp, Homo sapiens
acaatgctttgataaaatatt

SEQ ID NO: 1379613 - DNA, 16 bp, Homo sapiens
acacattacagccagg

SEQ ID NO: 1379614 - DNA, 22 bp, Homo sapiens
acagactctgctagtgaaaaga

SEQ ID NO: 1379615 - DNA, 13 bp, Homo sapiens
acagcttagtgag

SEQ ID NO: 1379616 - DNA, 13 bp, Homo sapiens
acagtttccagat

SEQ ID NO: 1379617 - DNA, 13 bp, Homo sapiens
acattaatgagaa

SEQ ID NO: 1379618 - DNA, 17 bp, Homo sapiens
acattatcactgaaaaa

SEQ ID NO: 1379619 - DNA, 21 bp, Homo sapiens
acattatcactgaaaaaatgt

SEQ ID NO: 1379620 - DNA, 23 bp, Homo sapiens
acatttgataattttgaaatgat

SEQ ID NO: 1379621 - DNA, 21 bp, Homo sapiens
accctccaccgcagaaggaag

SEQ ID NO: 1379622 - DNA, 12 bp, Homo sapiens
accgcagaagga

SEQ ID NO: 1379623 - DNA, 14 bp, Homo sapiens
acctttattttatt

SEQ ID NO: 1379624 - DNA, 21 bp, Homo sapiens
actaaaggtggttttattttc

SEQ ID NO: 1379625 - DNA, 21 bp, Homo sapiens
actaaggtgactcgagtgttt

SEQ ID NO: 1379626 - DNA, 13 bp, Homo sapiens
actatcttctcta

SEQ ID NO: 1379627 - DNA, 13 bp, Homo sapiens
gatatgttttaaa

SEQ ID NO: 1379628 - DNA, 21 bp, Homo sapiens
gatatttcaaatgattatgat

SEQ ID NO: 1379629 - DNA, 21 bp, Homo sapiens
gatatttctgtgtagtattta

SEQ ID NO: 1379630 - DNA, 20 bp, Homo sapiens
gatcccgtctccgaagaaaa

SEQ ID NO: 1379631 - DNA, 21 bp, Homo sapiens
gatcccgtctccgaagaaaag

SEQ ID NO: 1379632 - DNA, 17 bp, Homo sapiens
gatgatattacaggact

SEQ ID NO: 1379633 - DNA, 12 bp, Homo sapiens
gatggagaagga

SEQ ID NO: 1379634 - DNA, 14 bp, Homo sapiens
gatggagaaggaag

SEQ ID NO: 1379635 - DNA, 16 bp, Homo sapiens
gatggagaaggaaggc

SEQ ID NO: 1379636 - DNA, 12 bp, Homo sapiens
gattcatctttc

SEQ ID NO: 1379637 - DNA, 19 bp, Homo sapiens
gattccagagcactgctcc

SEQ ID NO: 1379638 - DNA, 20 bp, Homo sapiens
gattgaagtttattattttc

SEQ ID NO: 1379639 - DNA, 15 bp, Homo sapiens
gcacaataatttgtt

SEQ ID NO: 1379640 - DNA, 15 bp, Homo sapiens
gcagaaggaaggcag

SEQ ID NO: 1379641 - DNA, 16 bp, Homo sapiens
gcagaaggaaggcagg

SEQ ID NO: 1379642 - DNA, 21 bp, Homo sapiens
gcagagctgatggagaaggaa

SEQ ID NO: 1379643 - DNA, 16 bp, Homo sapiens
gccatttggaagcttt

SEQ ID NO: 1379644 - DNA, 23 bp, Homo sapiens
gcctgacaattatgaaaaaatgt

SEQ ID NO: 1379645 - DNA, 14 bp, Homo sapiens
gctgaaaactctat

SEQ ID NO: 1379646 - DNA, 20 bp, Homo sapiens
gcttgacattatgttttatt

SEQ ID NO: 1379647 - DNA, 13 bp, Homo sapiens
gctttaaacatga

SEQ ID NO: 1379648 - DNA, 19 bp, Homo sapiens
gctttgataaaatatttta

SEQ ID NO: 1379649 - DNA, 16 bp, Homo sapiens
ggaaatatttttcaac

SEQ ID NO: 1379650 - DNA, 20 bp, Homo sapiens
ggaagaagagatcaggaaga

SEQ ID NO: 1379651 - DNA, 21 bp, Homo sapiens
ggaaggcagggaggaggcaga

SEQ ID NO: 1379652 - DNA, 19 bp, Homo sapiens
ggagcagagctgatggaga

SEQ ID NO: 1379653 - DNA, 23 bp, Homo sapiens
ggagcagagctgatggagaagga

SEQ ID NO: 1379654 - DNA, 18 bp, Homo sapiens
ggaggaggcagagaagaa

SEQ ID NO: 1379655 - DNA, 12 bp, Homo sapiens
ggatatttcaaa

SEQ ID NO: 1379656 - DNA, 13 bp, Homo sapiens
ggatatttcaaat

SEQ ID NO: 1379657 - DNA, 20 bp, Homo sapiens
ggcagagaagaaagaacgga

SEQ ID NO: 1379658 - DNA, 20 bp, Homo sapiens
ggctggaataagaggacact

SEQ ID NO: 1379659 - DNA, 15 bp, Homo sapiens
gggaggaggcagaga

SEQ ID NO: 1379660 - DNA, 17 bp, Homo sapiens
ggtccaatgttgttcac

SEQ ID NO: 1379661 - DNA, 16 bp, Homo sapiens
ggtggtagaaatgatt

SEQ ID NO: 1379662 - DNA, 16 bp, Homo sapiens
ggtggttttattttcc

SEQ ID NO: 1379663 - DNA, 12 bp, Homo sapiens
gtagaaatgatt

SEQ ID NO: 1379664 - DNA, 21 bp, Homo sapiens
gtataagtccatgaatgttca

SEQ ID NO: 1379665 - DNA, 15 bp, Homo sapiens
gtatttatatttaaa

SEQ ID NO: 1379666 - DNA, 16 bp, Homo sapiens
gtgtgatcatatatca

SEQ ID NO: 1379667 - DNA, 20 bp, Homo sapiens
gttatgtcttttaataaaaa

SEQ ID NO: 1379668 - DNA, 15 bp, Homo sapiens
gtttattattttcaa

SEQ ID NO: 1379669 - DNA, 23 bp, Homo sapiens
gtttctaggagcacaataatttg

SEQ ID NO: 1379670 - DNA, 14 bp, Homo sapiens
gttttaaagttaaa

SEQ ID NO: 1379671 - DNA, 17 bp, Homo sapiens
gttttaacttattgttg

SEQ ID NO: 1379672 - DNA, 17 bp, Homo sapiens
taaaactggatggaaat

SEQ ID NO: 1379673 - DNA, 14 bp, Homo sapiens
taaacatgattatc

SEQ ID NO: 1379674 - DNA, 15 bp, Homo sapiens
taaaggatatttcaa

SEQ ID NO: 1379675 - DNA, 17 bp, Homo sapiens
taaaggatatttcaaat

SEQ ID NO: 1379676 - DNA, 19 bp, Homo sapiens
taaaggatatttcaaatga

SEQ ID NO: 1379677 - DNA, 21 bp, Homo sapiens
taaaggtggttttattttccc

SEQ ID NO: 1379678 - DNA, 18 bp, Homo sapiens
taaatacacattatcact

SEQ ID NO: 1379679 - DNA, 13 bp, Homo sapiens
taaatgctgtgta

SEQ ID NO: 1379680 - DNA, 20 bp, Homo sapiens
taaatgctttttatcgctaa

SEQ ID NO: 1379681 - DNA, 19 bp, Homo sapiens
taacttattgttgctgaaa

SEQ ID NO: 1379682 - DNA, 17 bp, Homo sapiens
taaggaaactgctttat

SEQ ID NO: 1379683 - DNA, 20 bp, Homo sapiens
taaggaaactgctttatttt

SEQ ID NO: 1379684 - DNA, 19 bp, Homo sapiens
taagtatgagttatcagct

SEQ ID NO: 1379685 - DNA, 22 bp, Homo sapiens
taagtgcagcttgacattatgt

SEQ ID NO: 1379686 - DNA, 13 bp, Homo sapiens
taatttgttttca

SEQ ID NO: 1379687 - DNA, 22 bp, Homo sapiens
taatttgttttcatttgtataa

SEQ ID NO: 1379688 - DNA, 18 bp, Homo sapiens
taattttgaaatgattca

SEQ ID NO: 1379689 - DNA, 13 bp, Homo sapiens
tacaaatattaag

SEQ ID NO: 1379690 - DNA, 18 bp, Homo sapiens
tacaaatattaagaaaat

SEQ ID NO: 1379691 - DNA, 17 bp, Homo sapiens
tacaacaatgctttgat

SEQ ID NO: 1379692 - DNA, 18 bp, Homo sapiens
tacacattacagccaggt

SEQ ID NO: 1379693 - DNA, 16 bp, Homo sapiens
tacacattatcactga

SEQ ID NO: 1379694 - DNA, 20 bp, Homo sapiens
tacacattatcactgaaaaa

SEQ ID NO: 1379695 - DNA, 11 bp, Homo sapiens
tagaaatgatt

SEQ ID NO: 1379696 - DNA, 20 bp, Homo sapiens
tagctactcgagaggccaaa

SEQ ID NO: 1379697 - DNA, 14 bp, Homo sapiens
tagtatttatattt

SEQ ID NO: 1379698 - DNA, 15 bp, Homo sapiens
tagtttttctgtcat

SEQ ID NO: 1379699 - DNA, 20 bp, Homo sapiens
tatcataaaggatatttcaa

SEQ ID NO: 1379700 - DNA, 22 bp, Homo sapiens
tatcataaaggatatttcaaat

SEQ ID NO: 1379701 - DNA, 14 bp, Homo sapiens
tatgtcttttaata

SEQ ID NO: 1379702 - DNA, 21 bp, Homo sapiens
tatgtcttttaataaaaagga

SEQ ID NO: 1379703 - DNA, 15 bp, Homo sapiens
tatgtgatatgtttt

SEQ ID NO: 1379704 - DNA, 21 bp, Homo sapiens
tatgttttaaagttaaaactg

SEQ ID NO: 1379705 - DNA, 18 bp, Homo sapiens
tatgttttatttaaatgc

SEQ ID NO: 1379706 - DNA, 15 bp, Homo sapiens
tattaagaaaatatt

SEQ ID NO: 1379707 - DNA, 12 bp, Homo sapiens
tattattttcaa

SEQ ID NO: 1379708 - DNA, 14 bp, Homo sapiens
tattattttcaaag

SEQ ID NO: 1379709 - DNA, 15 bp, Homo sapiens
tatttaaatgctttt

SEQ ID NO: 1379710 - DNA, 13 bp, Homo sapiens
tatttcaaatgat

SEQ ID NO: 1379711 - DNA, 14 bp, Homo sapiens
tatttcaaatgatt

SEQ ID NO: 1379712 - DNA, 17 bp, Homo sapiens
tattttaagtatgagtt

SEQ ID NO: 1379713 - DNA, 18 bp, Homo sapiens
tattttcaaaggaaaaca

SEQ ID NO: 1379714 - DNA, 15 bp, Homo sapiens
tatttttatttcatt

SEQ ID NO: 1379715 - DNA, 10 bp, Homo sapiens
tatttttcaa

SEQ ID NO: 1379716 - DNA, 11 bp, Homo sapiens
tatttttcaac

SEQ ID NO: 1379717 - DNA, 22 bp, Homo sapiens
tatttttcaacttcttctatat

SEQ ID NO: 1379718 - DNA, 15 bp, Homo sapiens
tattttttttcaaaa

SEQ ID NO: 1379719 - DNA, 16 bp, Homo sapiens
tattttttttcaaaat

SEQ ID NO: 1379720 - DNA, 22 bp, Homo sapiens
tattttttttcaaaatgaagat

SEQ ID NO: 1379721 - DNA, 11 bp, Homo sapiens
tcaaaatgaag

SEQ ID NO: 1379722 - DNA, 14 bp, Homo sapiens
tcaaaatgaagata

SEQ ID NO: 1379723 - DNA, 11 bp, Homo sapiens
tcaaaggaaaa

SEQ ID NO: 1379724 - DNA, 20 bp, Homo sapiens
tcactgaaaaaatgtagctt

SEQ ID NO: 1379725 - DNA, 17 bp, Homo sapiens
tcataaaggatatttca

SEQ ID NO: 1379726 - DNA, 14 bp, Homo sapiens
tcatctttcagaaa

SEQ ID NO: 1379727 - DNA, 15 bp, Homo sapiens
tcattcacattaatg

SEQ ID NO: 1379728 - DNA, 19 bp, Homo sapiens
tcattcacattaatgagaa

SEQ ID NO: 1379729 - DNA, 15 bp, Homo sapiens
tcattgttaaataca

SEQ ID NO: 1379730 - DNA, 18 bp, Homo sapiens
tccaaaattcagggcttt

SEQ ID NO: 1379731 - DNA, 14 bp, Homo sapiens
tccaatgttgttca

SEQ ID NO: 1379732 - DNA, 15 bp, Homo sapiens
tccaatgttgttcac

SEQ ID NO: 1379733 - DNA, 17 bp, Homo sapiens
tccaccgcagaaggaag

SEQ ID NO: 1379734 - DNA, 16 bp, Homo sapiens
tccatgaatgttcata

SEQ ID NO: 1379735 - DNA, 22 bp, Homo sapiens
tcccttcatgttttaacttatt

SEQ ID NO: 1379736 - DNA, 18 bp, Homo sapiens
tcctaaggaaactgcttt

SEQ ID NO: 1379737 - DNA, 14 bp, Homo sapiens
tctagtgaaactgc

SEQ ID NO: 1379738 - DNA, 24 bp, Homo sapiens
tctccgaagaaaagatatgtattc

SEQ ID NO: 1379739 - DNA, 19 bp, Homo sapiens
tctgtcattgttaaataca

SEQ ID NO: 1379740 - DNA, 23 bp, Homo sapiens
tcttctctatatttttatttcat

SEQ ID NO: 1379741 - DNA, 19 bp, Homo sapiens
tgaaaagaactagtttcta

SEQ ID NO: 1379742 - DNA, 17 bp, Homo sapiens
tgaagtttattattttc

SEQ ID NO: 1379743 - DNA, 21 bp, Homo sapiens
tgaagtttattattttcaaag

SEQ ID NO: 1379744 - DNA, 16 bp, Homo sapiens
tgacaattatgaaaaa

SEQ ID NO: 1379745 - DNA, 19 bp, Homo sapiens
tgacattatgttttattta

SEQ ID NO: 1379746 - DNA, 23 bp, Homo sapiens
tgacattatgttttatttaaatg

SEQ ID NO: 1379747 - DNA, 22 bp, Homo sapiens
caagacagtgagacagtctgga

SEQ ID NO: 1379748 - DNA, 15 bp, Homo sapiens
caagcaatcctcctg

SEQ ID NO: 1379749 - DNA, 17 bp, Homo sapiens
caagcaatcctcctgcc

SEQ ID NO: 1379750 - DNA, 14 bp, Homo sapiens
caatcctcctgcct

SEQ ID NO: 1379751 - DNA, 24 bp, Homo sapiens
caatcctcctgcctcagcctcctg

SEQ ID NO: 1379752 - DNA, 19 bp, Homo sapiens
cacacatgacgcaccagtt

SEQ ID NO: 1379753 - DNA, 20 bp, Homo sapiens
cacaggcttacgctgctctc

SEQ ID NO: 1379754 - DNA, 22 bp, Homo sapiens
cacaggcttacgctgctctcct

SEQ ID NO: 1379755 - DNA, 16 bp, Homo sapiens
cacatcgccagccctg

SEQ ID NO: 1379756 - DNA, 14 bp, Homo sapiens
caccacacctggct

SEQ ID NO: 1379757 - DNA, 20 bp, Homo sapiens
cacccagactggagtgcagt

SEQ ID NO: 1379758 - DNA, 16 bp, Homo sapiens
caccgcgcctggccca

SEQ ID NO: 1379759 - DNA, 20 bp, Homo sapiens
cacgccaccacacctggctt

SEQ ID NO: 1379760 - DNA, 14 bp, Homo sapiens
cacgtgggcctccc

SEQ ID NO: 1379761 - DNA, 14 bp, Homo sapiens
cactcctccagcca

SEQ ID NO: 1379762 - DNA, 21 bp, Homo sapiens
cactttgaactcctcaagggc

SEQ ID NO: 1379763 - DNA, 14 bp, Homo sapiens
cagaaagggaaagt

SEQ ID NO: 1379764 - DNA, 16 bp, Homo sapiens
cagaatggctgtcctt

SEQ ID NO: 1379765 - DNA, 20 bp, Homo sapiens
cagagaactgtctttcattt

SEQ ID NO: 1379766 - DNA, 19 bp, Homo sapiens
cagagcaggaggcagggct

SEQ ID NO: 1379767 - DNA, 14 bp, Homo sapiens
cagaggcggctctg

SEQ ID NO: 1379768 - DNA, 14 bp, Homo sapiens
cagagtgcagaggc

SEQ ID NO: 1379769 - DNA, 20 bp, Homo sapiens
cagagtgcagaggcggctct

SEQ ID NO: 1379770 - DNA, 12 bp, Homo sapiens
cagagtgtcctt

SEQ ID NO: 1379771 - DNA, 17 bp, Homo sapiens
cagccaccactcagtgc

SEQ ID NO: 1379772 - DNA, 15 bp, Homo sapiens
cagccctgggcctgg

SEQ ID NO: 1379773 - DNA, 16 bp, Homo sapiens
cagccctgggcctggg

SEQ ID NO: 1379774 - DNA, 17 bp, Homo sapiens
cagcctcattctgaggc

SEQ ID NO: 1379775 - DNA, 17 bp, Homo sapiens
cagctctcttctggctt

SEQ ID NO: 1379776 - DNA, 22 bp, Homo sapiens
cagctctcttctggctttctga

SEQ ID NO: 1379777 - DNA, 14 bp, Homo sapiens
cagctgcattccag

SEQ ID NO: 1379778 - DNA, 19 bp, Homo sapiens
caggaagcgagcagaggct

SEQ ID NO: 1379779 - DNA, 23 bp, Homo sapiens
caggctgagggaggcagaaaggg

SEQ ID NO: 1379780 - DNA, 16 bp, Homo sapiens
caggctggtcttgaac

SEQ ID NO: 1379781 - DNA, 19 bp, Homo sapiens
caggcttacgctgctctcc

SEQ ID NO: 1379782 - DNA, 16 bp, Homo sapiens
cagtgagacagtctgg

SEQ ID NO: 1379783 - DNA, 22 bp, Homo sapiens
cagtgcttctctgtgcaggagc

SEQ ID NO: 1379784 - DNA, 12 bp, Homo sapiens
cataataattct

SEQ ID NO: 1379785 - DNA, 21 bp, Homo sapiens
catcccagtcctgatggccgc

SEQ ID NO: 1379786 - DNA, 18 bp, Homo sapiens
catctctaaggctaagga

SEQ ID NO: 1379787 - DNA, 16 bp, Homo sapiens
ccaagacagtgagaca

SEQ ID NO: 1379788 - DNA, 19 bp, Homo sapiens
ccacacgcgaccctcggtg

SEQ ID NO: 1379789 - DNA, 23 bp, Homo sapiens
ccaccgcgcctggcccaagccct

SEQ ID NO: 1379790 - DNA, 19 bp, Homo sapiens
ccatgcctggtcccaagac

SEQ ID NO: 1379791 - DNA, 23 bp, Homo sapiens
ccatgcctggtcccaagacagtg

SEQ ID NO: 1379792 - DNA, 19 bp, Homo sapiens
cccaatgctgtacctggct

SEQ ID NO: 1379793 - DNA, 16 bp, Homo sapiens
ccctcaacctcctggg

SEQ ID NO: 1379794 - DNA, 19 bp, Homo sapiens
ccctgcctcccatgcctgg

SEQ ID NO: 1379795 - DNA, 18 bp, Homo sapiens
ccgagccctcacaccctg

SEQ ID NO: 1379796 - DNA, 12 bp, Homo sapiens
cctattccttca

SEQ ID NO: 1379797 - DNA, 16 bp, Homo sapiens
cctcaagggcagagaa

SEQ ID NO: 1379798 - DNA, 12 bp, Homo sapiens
cctcagcctcct

SEQ ID NO: 1379799 - DNA, 22 bp, Homo sapiens
cctcagcctcctgaacagctgg

SEQ ID NO: 1379800 - DNA, 23 bp, Homo sapiens
cctcagcctcctgaacagctggg

SEQ ID NO: 1379801 - DNA, 15 bp, Homo sapiens
cctcctgaacagctg

SEQ ID NO: 1379802 - DNA, 16 bp, Homo sapiens
cctcctgaacagctgg

SEQ ID NO: 1379803 - DNA, 22 bp, Homo sapiens
cctgattaatatgtgggaatta

SEQ ID NO: 1379804 - DNA, 18 bp, Homo sapiens
cctgcctcccatgcctgg

SEQ ID NO: 1379805 - DNA, 22 bp, Homo sapiens
cctgcctcccatgcctggtccc

SEQ ID NO: 1379806 - DNA, 22 bp, Homo sapiens
ccttcccagcacatcgccagcc

SEQ ID NO: 1379807 - DNA, 16 bp, Homo sapiens
cgctgctctcctgaca

SEQ ID NO: 1379808 - DNA, 17 bp, Homo sapiens
cgctgctctcctgacag

SEQ ID NO: 1379809 - DNA, 13 bp, Homo sapiens
cgggaagggacag

SEQ ID NO: 1379810 - DNA, 22 bp, Homo sapiens
cgtgggcctcccaaaacgctgg

SEQ ID NO: 1379811 - DNA, 16 bp, Homo sapiens
ctaaatttgtctttca

SEQ ID NO: 1379812 - DNA, 15 bp, Homo sapiens
ctaaggatagggaaa

SEQ ID NO: 1379813 - DNA, 21 bp, Homo sapiens
ctagggtccatatgagggaaa

SEQ ID NO: 1379814 - DNA, 21 bp, Homo sapiens
ctatgctttcacttcccacct

SEQ ID NO: 1379815 - DNA, 13 bp, Homo sapiens
ctatggcctccct

SEQ ID NO: 1379816 - DNA, 13 bp, Homo sapiens
ctcaggctggtct

SEQ ID NO: 1379817 - DNA, 15 bp, Homo sapiens
ctcaggctggtcttg

SEQ ID NO: 1379818 - DNA, 13 bp, Homo sapiens
ctccacattttct

SEQ ID NO: 1379819 - DNA, 17 bp, Homo sapiens
ctccactcctccagcca

SEQ ID NO: 1379820 - DNA, 17 bp, Homo sapiens
ctcctgacagccacacg

SEQ ID NO: 1379821 - DNA, 17 bp, Homo sapiens
ctcctgcctcagcctcc

SEQ ID NO: 1379822 - DNA, 22 bp, Homo sapiens
ctcggtgcagagtgcagaggcg

SEQ ID NO: 1379823 - DNA, 14 bp, Homo sapiens
ctctcttctggctt

SEQ ID NO: 1379824 - DNA, 18 bp, Homo sapiens
ctctgtgcaggagccagt

SEQ ID NO: 1379825 - DNA, 12 bp, Homo sapiens
ctgaacagctgg

SEQ ID NO: 1379826 - DNA, 17 bp, Homo sapiens
ctgagggaggcagaaag

SEQ ID NO: 1379827 - DNA, 16 bp, Homo sapiens
ctgcctcagcctcctg

SEQ ID NO: 1379828 - DNA, 20 bp, Homo sapiens
ctgcctcagcctcctgaaca

SEQ ID NO: 1379829 - DNA, 11 bp, Homo sapiens
ctgcctcccat

SEQ ID NO: 1379830 - DNA, 16 bp, Homo sapiens
ctgcctcccatgcctg

SEQ ID NO: 1379831 - DNA, 15 bp, Homo sapiens
ctgctctcctgacag

SEQ ID NO: 1379832 - DNA, 16 bp, Homo sapiens
ctgctctcctgacagc

SEQ ID NO: 1379833 - DNA, 17 bp, Homo sapiens
ctggcccaagccctcca

SEQ ID NO: 1379834 - DNA, 18 bp, Homo sapiens
ctggcccaagccctccac

SEQ ID NO: 1379835 - DNA, 15 bp, Homo sapiens
ctggggcctggaggc

SEQ ID NO: 1379836 - DNA, 15 bp, Homo sapiens
ctggtggcctgcccc

SEQ ID NO: 1379837 - DNA, 18 bp, Homo sapiens
ctgtcctctcatcccagt

SEQ ID NO: 1379838 - DNA, 15 bp, Homo sapiens
ctgtgttgtgtcctg

SEQ ID NO: 1379839 - DNA, 20 bp, Homo sapiens
cttaactaaatttgtctttc

SEQ ID NO: 1379840 - DNA, 17 bp, Homo sapiens
cttcaactgtctgtctt

SEQ ID NO: 1379841 - DNA, 19 bp, Homo sapiens
cttccaataaagcagcctc

SEQ ID NO: 1379842 - DNA, 13 bp, Homo sapiens
cttccataataat

SEQ ID NO: 1379843 - DNA, 13 bp, Homo sapiens
cttcctctgtcct

SEQ ID NO: 1379844 - DNA, 11 bp, Homo sapiens
cttctgtggca

SEQ ID NO: 1379845 - DNA, 20 bp, Homo sapiens
cttgagctagaccaaggtca

SEQ ID NO: 1379846 - DNA, 20 bp, Homo sapiens
ctttgaactcctcaagggca

SEQ ID NO: 1379847 - DNA, 15 bp, Homo sapiens
gaaaagaacagaagg

SEQ ID NO: 1379848 - DNA, 16 bp, Homo sapiens
gaactcctcaagggca

SEQ ID NO: 1379849 - DNA, 14 bp, Homo sapiens
aactgtctttcatt

SEQ ID NO: 1379850 - DNA, 13 bp, Homo sapiens
aagcagcctcatt

SEQ ID NO: 1379851 - DNA, 14 bp, Homo sapiens
aagcagtaccctac

SEQ ID NO: 1379852 - DNA, 21 bp, Homo sapiens
aagggcagagaactgtctttc

SEQ ID NO: 1379853 - DNA, 22 bp, Homo sapiens
aaggtcagatttgaaaagaaca

SEQ ID NO: 1379854 - DNA, 19 bp, Homo sapiens
aagtattagcatgagcttt

SEQ ID NO: 1379855 - DNA, 13 bp, Homo sapiens
aagtggcagctca

SEQ ID NO: 1379856 - DNA, 16 bp, Homo sapiens
aataattctgctttag

SEQ ID NO: 1379857 - DNA, 17 bp, Homo sapiens
aataattctgctttaga

SEQ ID NO: 1379858 - DNA, 19 bp, Homo sapiens
aatattttacttttacagt

SEQ ID NO: 1379859 - DNA, 22 bp, Homo sapiens
aattgaagtgaaattttgcaga

SEQ ID NO: 1379860 - DNA, 12 bp, Homo sapiens
aatttgtctttc

SEQ ID NO: 1379861 - DNA, 14 bp, Homo sapiens
aatttgtctttcaa

SEQ ID NO: 1379862 - DNA, 17 bp, Homo sapiens
acagctgcattccagag

SEQ ID NO: 1379863 - DNA, 22 bp, Homo sapiens
acaggcttacgctgctctcctg

SEQ ID NO: 1379864 - DNA, 15 bp, Homo sapiens
acctattccttcaga

SEQ ID NO: 1379865 - DNA, 18 bp, Homo sapiens
accttcaactgtctgtct

SEQ ID NO: 1379866 - DNA, 18 bp, Homo sapiens
acgccaccacacctggct

SEQ ID NO: 1379867 - DNA, 20 bp, Homo sapiens
acgcgaccctcggtgcagag

SEQ ID NO: 1379868 - DNA, 23 bp, Homo sapiens
acgctgctctcctgacagccaca

SEQ ID NO: 1379869 - DNA, 16 bp, Homo sapiens
actaaatttgtctttc

SEQ ID NO: 1379870 - DNA, 17 bp, Homo sapiens
actaaatttgtctttca

SEQ ID NO: 1379871 - DNA, 22 bp, Homo sapiens
actaaatttgtctttcaagtga

SEQ ID NO: 1379872 - DNA, 23 bp, Homo sapiens
actttgaactcctcaagggcaga

SEQ ID NO: 1379873 - DNA, 19 bp, Homo sapiens
agaattcccctctggaggg

SEQ ID NO: 1379874 - DNA, 14 bp, Homo sapiens
agacagggtcttgc

SEQ ID NO: 1379875 - DNA, 17 bp, Homo sapiens
agacagtctggaaagtg

SEQ ID NO: 1379876 - DNA, 19 bp, Homo sapiens
agacagtgagacagtctgg

SEQ ID NO: 1379877 - DNA, 14 bp, Homo sapiens
agacatcagggagt

SEQ ID NO: 1379878 - DNA, 22 bp, Homo sapiens
agaccagctgtgtttcttaact

SEQ ID NO: 1379879 - DNA, 14 bp, Homo sapiens
agagaactgtcttt

SEQ ID NO: 1379880 - DNA, 9 bp, Homo sapiens
agagacagg

SEQ ID NO: 1379881 - DNA, 19 bp, Homo sapiens
agatttgaaaagaacagaa

SEQ ID NO: 1379882 - DNA, 15 bp, Homo sapiens
agcacatccacccag

SEQ ID NO: 1379883 - DNA, 13 bp, Homo sapiens
agcagaggctcca

SEQ ID NO: 1379884 - DNA, 15 bp, Homo sapiens
agccaccgcgcctgg

SEQ ID NO: 1379885 - DNA, 16 bp, Homo sapiens
agccctcacaccctgg

SEQ ID NO: 1379886 - DNA, 17 bp, Homo sapiens
agccctccacattttca

SEQ ID NO: 1379887 - DNA, 17 bp, Homo sapiens
agccctccacattttct

SEQ ID NO: 1379888 - DNA, 15 bp, Homo sapiens
agccctgggcctggg

SEQ ID NO: 1379889 - DNA, 20 bp, Homo sapiens
agcctcctgaacagctggga

SEQ ID NO: 1379890 - DNA, 22 bp, Homo sapiens
agctcagccaccactcagtgct

SEQ ID NO: 1379891 - DNA, 23 bp, Homo sapiens
agctgggaccacaggtgcacgcc

SEQ ID NO: 1379892 - DNA, 17 bp, Homo sapiens
agcttccttcatctcta

SEQ ID NO: 1379893 - DNA, 13 bp, Homo sapiens
agctttccagtta

SEQ ID NO: 1379894 - DNA, 21 bp, Homo sapiens
aggaggcagggctctggggcc

SEQ ID NO: 1379895 - DNA, 14 bp, Homo sapiens
aggctgagggaggc

SEQ ID NO: 1379896 - DNA, 13 bp, Homo sapiens
aggctggtcttga

SEQ ID NO: 1379897 - DNA, 18 bp, Homo sapiens
agggaaaacccaatgtca

SEQ ID NO: 1379898 - DNA, 19 bp, Homo sapiens
agggacagctgcattccag

SEQ ID NO: 1379899 - DNA, 20 bp, Homo sapiens
agggcagagaactgtctttc

SEQ ID NO: 1379900 - DNA, 21 bp, Homo sapiens
agggctgttgatttatgcttt

SEQ ID NO: 1379901 - DNA, 15 bp, Homo sapiens
agtaccctaccctga

SEQ ID NO: 1379902 - DNA, 21 bp, Homo sapiens
agtctgtgttgtgtcctgaca

SEQ ID NO: 1379903 - DNA, 22 bp, Homo sapiens
agtctgtgttgtgtcctgacac

SEQ ID NO: 1379904 - DNA, 19 bp, Homo sapiens
agtgagacatcagggagta

SEQ ID NO: 1379905 - DNA, 17 bp, Homo sapiens
agtgcagaggcggctct

SEQ ID NO: 1379906 - DNA, 21 bp, Homo sapiens
agtgtgagccaccgcgcctgg

SEQ ID NO: 1379907 - DNA, 21 bp, Homo sapiens
ataaagcagcctcattctgag

SEQ ID NO: 1379908 - DNA, 11 bp, Homo sapiens
ataatgtacct

SEQ ID NO: 1379909 - DNA, 22 bp, Homo sapiens
ataatgtacctattccttcaga

SEQ ID NO: 1379910 - DNA, 13 bp, Homo sapiens
atccaagctaatt

SEQ ID NO: 1379911 - DNA, 15 bp, Homo sapiens
atcccagcaggaggg

SEQ ID NO: 1379912 - DNA, 14 bp, Homo sapiens
atcgccagccctgg

SEQ ID NO: 1379913 - DNA, 13 bp, Homo sapiens
atgagctttccag

SEQ ID NO: 1379914 - DNA, 19 bp, Homo sapiens
atgtacctattccttcaga

SEQ ID NO: 1379915 - DNA, 14 bp, Homo sapiens
atgtgtatacagaa

SEQ ID NO: 1379916 - DNA, 17 bp, Homo sapiens
atgtgtatacagaaaat

SEQ ID NO: 1379917 - DNA, 18 bp, Homo sapiens
attagcatgagctttcca

SEQ ID NO: 1379918 - DNA, 16 bp, Homo sapiens
attcccctctggaggg

SEQ ID NO: 1379919 - DNA, 13 bp, Homo sapiens
attctgaggcctg

SEQ ID NO: 1379920 - DNA, 12 bp, Homo sapiens
attctgctttag

SEQ ID NO: 1379921 - DNA, 13 bp, Homo sapiens
attgtttttcaaa

SEQ ID NO: 1379922 - DNA, 16 bp, Homo sapiens
attttacttttacagt

SEQ ID NO: 1379923 - DNA, 21 bp, Homo sapiens
attttcctacatcggaatcca

SEQ ID NO: 1379924 - DNA, 14 bp, Homo sapiens
caacctcctgggtt

SEQ ID NO: 1379925 - DNA, 20 bp, Homo sapiens
caagcaatcctcctgcctca

SEQ ID NO: 1379926 - DNA, 14 bp, Homo sapiens
caatgctgtacctg

SEQ ID NO: 1379927 - DNA, 15 bp, Homo sapiens
caatgctgtacctgg

SEQ ID NO: 1379928 - DNA, 13 bp, Homo sapiens
cacaccctggacg

SEQ ID NO: 1379929 - DNA, 21 bp, Homo sapiens
cacaggcttacgctgctctcc

SEQ ID NO: 1379930 - DNA, 23 bp, Homo sapiens
cacatcgccagccctgggcctgg

SEQ ID NO: 1379931 - DNA, 15 bp, Homo sapiens
caccacacctggctt

SEQ ID NO: 1379932 - DNA, 15 bp, Homo sapiens
cacgccaccacacct

SEQ ID NO: 1379933 - DNA, 17 bp, Homo sapiens
cacgccaccacacctgg

SEQ ID NO: 1379934 - DNA, 14 bp, Homo sapiens
cactcagtgcttct

SEQ ID NO: 1379935 - DNA, 20 bp, Homo sapiens
cactgcaccctcaacctcct

SEQ ID NO: 1379936 - DNA, 13 bp, Homo sapiens
cagaggcggctct

SEQ ID NO: 1379937 - DNA, 15 bp, Homo sapiens
cagaggcggctctgg

SEQ ID NO: 1379938 - DNA, 13 bp, Homo sapiens
cagaggctccaca

SEQ ID NO: 1379939 - DNA, 14 bp, Homo sapiens
cagaggctccacag

SEQ ID NO: 1379940 - DNA, 15 bp, Homo sapiens
cagagtgcagaggcg

SEQ ID NO: 1379941 - DNA, 23 bp, Homo sapiens
cagagtgtccttcctctgtcctc

SEQ ID NO: 1379942 - DNA, 16 bp, Homo sapiens
cagatacagcacatcc

SEQ ID NO: 1379943 - DNA, 15 bp, Homo sapiens
cagcaggagggattg

SEQ ID NO: 1379944 - DNA, 19 bp, Homo sapiens
cagccacacgcgaccctcg

SEQ ID NO: 1379945 - DNA, 14 bp, Homo sapiens
cagccctgggcctg

SEQ ID NO: 1379946 - DNA, 20 bp, Homo sapiens
cagcctcattctgaggcctg

SEQ ID NO: 1379947 - DNA, 19 bp, Homo sapiens
cagcctcctgaacagctgg

SEQ ID NO: 1379948 - DNA, 21 bp, Homo sapiens
cagctcagccaccactcagtg

SEQ ID NO: 1379949 - DNA, 17 bp, Homo sapiens
cagctgcattccagagc

SEQ ID NO: 1379950 - DNA, 18 bp, Homo sapiens
caggaagcgagcagaggc

SEQ ID NO: 1379951 - DNA, 16 bp, Homo sapiens
caggaggcagggctct

SEQ ID NO: 1379952 - DNA, 19 bp, Homo sapiens
caggaggcagggctctggg

SEQ ID NO: 1379953 - DNA, 21 bp, Homo sapiens
caggctggtcttgaactcctg

SEQ ID NO: 1379954 - DNA, 16 bp, Homo sapiens
cagggtcttgctctgt

SEQ ID NO: 1379955 - DNA, 14 bp, Homo sapiens
cagtaccctaccct

SEQ ID NO: 1379956 - DNA, 16 bp, Homo sapiens
cagtaccctaccctga

SEQ ID NO: 1379957 - DNA, 17 bp, Homo sapiens
cagtgagacagtctgga

SEQ ID NO: 1379958 - DNA, 18 bp, Homo sapiens
cagtgagacagtctggaa

SEQ ID NO: 1379959 - DNA, 19 bp, Homo sapiens
cagtgagacagtctggaaa

SEQ ID NO: 1379960 - DNA, 17 bp, Homo sapiens
catagctcactgcaccc

SEQ ID NO: 1379961 - DNA, 15 bp, Homo sapiens
catatgagggaaaac

SEQ ID NO: 1379962 - DNA, 11 bp, Homo sapiens
catcagggagt

SEQ ID NO: 1379963 - DNA, 15 bp, Homo sapiens
catctctaaggctaa

SEQ ID NO: 1379964 - DNA, 14 bp, Homo sapiens
cattttcaatccag

SEQ ID NO: 1379965 - DNA, 14 bp, Homo sapiens
ccacacctggcttt

SEQ ID NO: 1379966 - DNA, 11 bp, Homo sapiens
ccacattttca

SEQ ID NO: 1379967 - DNA, 15 bp, Homo sapiens
ccaccactccactcc

SEQ ID NO: 1379968 - DNA, 17 bp, Homo sapiens
ccacccaggtcccgagc

SEQ ID NO: 1379969 - DNA, 20 bp, Homo sapiens
ccagagcaggaggcagggct

SEQ ID NO: 1379970 - DNA, 18 bp, Homo sapiens
ccagctctcttctggctt

SEQ ID NO: 1379971 - DNA, 22 bp, Homo sapiens
ccagttacaggggttgttttta

SEQ ID NO: 1379972 - DNA, 20 bp, Homo sapiens
cccaatgctgtacctggctg

SEQ ID NO: 1379973 - DNA, 21 bp, Homo sapiens
cccacccctgcctcccatgcc

SEQ ID NO: 1379974 - DNA, 21 bp, Homo sapiens
cccagactggagtgcagtggt

SEQ ID NO: 1379975 - DNA, 16 bp, Homo sapiens
cccagtcctgatggcc

SEQ ID NO: 1379976 - DNA, 19 bp, Homo sapiens
cccagtcctgatggccgct

SEQ ID NO: 1379977 - DNA, 17 bp, Homo sapiens
cccctgcctcccatgcc

SEQ ID NO: 1379978 - DNA, 20 bp, Homo sapiens
ccctgcctcccatgcctggt

SEQ ID NO: 1379979 - DNA, 18 bp, Homo sapiens
ccctggtggcctgcccca

SEQ ID NO: 1379980 - DNA, 20 bp, Homo sapiens
ccctggtggcctgccccagc

SEQ ID NO: 1379981 - DNA, 15 bp, Homo sapiens
cctaagttccttccc

SEQ ID NO: 1379982 - DNA, 22 bp, Homo sapiens
cctacatcggaatccaagctaa

SEQ ID NO: 1379983 - DNA, 18 bp, Homo sapiens
cctatgctttcacttccc

SEQ ID NO: 1379984 - DNA, 14 bp, Homo sapiens
cctattccttcaga

SEQ ID NO: 1379985 - DNA, 17 bp, Homo sapiens
cctcaagggcagagaac

SEQ ID NO: 1379986 - DNA, 13 bp, Homo sapiens
cctcagcctcctg

SEQ ID NO: 1379987 - DNA, 18 bp, Homo sapiens
cctcattctgaggcctga

SEQ ID NO: 1379988 - DNA, 23 bp, Homo sapiens
cctcctgcctcagcctcctgaac

SEQ ID NO: 1379989 - DNA, 19 bp, Homo sapiens
cctcggtgcagagtgcaga

SEQ ID NO: 1379990 - DNA, 13 bp, Homo sapiens
cctgaacagctgg

SEQ ID NO: 1379991 - DNA, 17 bp, Homo sapiens
cctgcctcagcctcctg

SEQ ID NO: 1379992 - DNA, 17 bp, Homo sapiens
cctgcctcccatgcctg

SEQ ID NO: 1379993 - DNA, 20 bp, Homo sapiens
cctggacgggaagggacagc

SEQ ID NO: 1379994 - DNA, 22 bp, Homo sapiens
cctggacgggaagggacagctg

SEQ ID NO: 1379995 - DNA, 15 bp, Homo sapiens
ccttcctctgtcctc

SEQ ID NO: 1379996 - DNA, 12 bp, Homo sapiens
cgagcagaggct

SEQ ID NO: 1379997 - DNA, 17 bp, Homo sapiens
cgagccctcacaccctg

SEQ ID NO: 1379998 - DNA, 18 bp, Homo sapiens
cgccaccacacctggctt

SEQ ID NO: 1379999 - DNA, 13 bp, Homo sapiens
cggctctggttcc

SEQ ID NO: 1380000 - DNA, 19 bp, Homo sapiens
cggctctggttcctccagc

SEQ ID NO: 1380001 - DNA, 23 bp, Homo sapiens
cggtggggctggggcctggaggc

SEQ ID NO: 1380002 - DNA, 22 bp, Homo sapiens
cgtagagccctccacattttct

SEQ ID NO: 1380003 - DNA, 19 bp, Homo sapiens
ctaaatttgtctttcaagt

SEQ ID NO: 1380004 - DNA, 21 bp, Homo sapiens
ctaaatttgtctttcaagtga

SEQ ID NO: 1380005 - DNA, 13 bp, Homo sapiens
ctagaccaaggtc

SEQ ID NO: 1380006 - DNA, 12 bp, Homo sapiens
ctcacaccctgg

SEQ ID NO: 1380007 - DNA, 20 bp, Homo sapiens
ctcatcccagtcctgatggc

SEQ ID NO: 1380008 - DNA, 16 bp, Homo sapiens
ctccagccaccaccca

SEQ ID NO: 1380009 - DNA, 22 bp, Homo sapiens
ctcccaccactccactcctcca

SEQ ID NO: 1380010 - DNA, 15 bp, Homo sapiens
ctcccatgcctggtc

SEQ ID NO: 1380011 - DNA, 16 bp, Homo sapiens
ctcccatgcctggtcc

SEQ ID NO: 1380012 - DNA, 14 bp, Homo sapiens
ctcctgacagccac

SEQ ID NO: 1380013 - DNA, 17 bp, Homo sapiens
ctctcatcccagtcctg

SEQ ID NO: 1380014 - DNA, 14 bp, Homo sapiens
ctctggttcctcca

SEQ ID NO: 1380015 - DNA, 13 bp, Homo sapiens
ctctgtcacccag

SEQ ID NO: 1380016 - DNA, 15 bp, Homo sapiens
ctgaagaccagctgt

SEQ ID NO: 1380017 - DNA, 23 bp, Homo sapiens
ctgagcaggaagcgagcagaggc

SEQ ID NO: 1380018 - DNA, 22 bp, Homo sapiens
ctgccccagctctcttctggct

SEQ ID NO: 1380019 - DNA, 18 bp, Homo sapiens
ctgcctcagcctcctgaa

SEQ ID NO: 1380020 - DNA, 17 bp, Homo sapiens
ctgcctcccatgcctgg

SEQ ID NO: 1380021 - DNA, 13 bp, Homo sapiens
ctgctctcctgac

SEQ ID NO: 1380022 - DNA, 22 bp, Homo sapiens
ctgggaccacaggtgcacgcca

SEQ ID NO: 1380023 - DNA, 11 bp, Homo sapiens
ctggggcctgg

SEQ ID NO: 1380024 - DNA, 20 bp, Homo sapiens
ctggggcctggaggcccaga

SEQ ID NO: 1380025 - DNA, 17 bp, Homo sapiens
ctggtgccctggtggcc

SEQ ID NO: 1380026 - DNA, 22 bp, Homo sapiens
ctggtgccctggtggcctgccc

SEQ ID NO: 1380027 - DNA, 12 bp, Homo sapiens
ctggttcctcca

SEQ ID NO: 1380028 - DNA, 13 bp, Homo sapiens
ctggttcctccag

SEQ ID NO: 1380029 - DNA, 13 bp, Homo sapiens
ctgtacctggctg

SEQ ID NO: 1380030 - DNA, 12 bp, Homo sapiens
ctgtgcaggagc

SEQ ID NO: 1380031 - DNA, 15 bp, Homo sapiens
ctgtggcaaatgcca

SEQ ID NO: 1380032 - DNA, 20 bp, Homo sapiens
cttacgctgctctcctgaca

SEQ ID NO: 1380033 - DNA, 16 bp, Homo sapiens
cttcaactgtctgtct

SEQ ID NO: 1380034 - DNA, 15 bp, Homo sapiens
cttcccagcacatcg

SEQ ID NO: 1380035 - DNA, 17 bp, Homo sapiens
cttctctgtgcaggagc

SEQ ID NO: 1380036 - DNA, 19 bp, Homo sapiens
ctttgaactcctcaagggc

SEQ ID NO: 1380037 - DNA, 21 bp, Homo sapiens
ctttttcttttttgagacagg

SEQ ID NO: 1380038 - DNA, 12 bp, Homo sapiens
gaactgtctttc

SEQ ID NO: 1380039 - DNA, 19 bp, Homo sapiens
gaagggacagctgcattcc

SEQ ID NO: 1380040 - DNA, 13 bp, Homo sapiens
gacacctccaagt

SEQ ID NO: 1380041 - DNA, 19 bp, Homo sapiens
gacagctgcattccagagc

SEQ ID NO: 1380042 - DNA, 18 bp, Homo sapiens
gacagtgagacagtctgg

SEQ ID NO: 1380043 - DNA, 14 bp, Homo sapiens
gagaactgtctttc

SEQ ID NO: 1380044 - DNA, 18 bp, Homo sapiens
gagacagggtcttgctct

SEQ ID NO: 1380045 - DNA, 12 bp, Homo sapiens
gagccctccaca

SEQ ID NO: 1380046 - DNA, 17 bp, Homo sapiens
gagctagaccaaggtca

SEQ ID NO: 1380047 - DNA, 16 bp, Homo sapiens
gaggcagaaagggaaa

SEQ ID NO: 1380048 - DNA, 13 bp, Homo sapiens
gaggcggctctgg

SEQ ID NO: 1380049 - DNA, 14 bp, Homo sapiens
tgtgtatacagaaa

SEQ ID NO: 1380050 - DNA, 19 bp, Homo sapiens
ttaactaaatttgtctttc

SEQ ID NO: 1380051 - DNA, 18 bp, Homo sapiens
ttacgctgctctcctgac

SEQ ID NO: 1380052 - DNA, 12 bp, Homo sapiens
ctggtggcctgc

SEQ ID NO: 1380053 - DNA, 19 bp, Homo sapiens
ctggtggcctgccccagct

SEQ ID NO: 1380054 - DNA, 16 bp, Homo sapiens
ctgtcacccagactgg

SEQ ID NO: 1380055 - DNA, 19 bp, Homo sapiens
ctgtgttgtgtcctgacac

SEQ ID NO: 1380056 - DNA, 19 bp, Homo sapiens
cttaactaaatttgtcttt

SEQ ID NO: 1380057 - DNA, 16 bp, Homo sapiens
cttcatctctaaggct

SEQ ID NO: 1380058 - DNA, 17 bp, Homo sapiens
cttcccacgtgggcctc

SEQ ID NO: 1380059 - DNA, 17 bp, Homo sapiens
cttcctctgtcctctca

SEQ ID NO: 1380060 - DNA, 18 bp, Homo sapiens
cttctggctttctgagca

SEQ ID NO: 1380061 - DNA, 21 bp, Homo sapiens
cttgtcgtagagccctccaca

SEQ ID NO: 1380062 - DNA, 20 bp, Homo sapiens
ctttagatgtgtatacagaa

SEQ ID NO: 1380063 - DNA, 11 bp, Homo sapiens
ctttcaagtga

SEQ ID NO: 1380064 - DNA, 18 bp, Homo sapiens
ctttccagttagggctgt

SEQ ID NO: 1380065 - DNA, 20 bp, Homo sapiens
cttttacagtcattttccta

SEQ ID NO: 1380066 - DNA, 15 bp, Homo sapiens
gaacagaaggactga

SEQ ID NO: 1380067 - DNA, 18 bp, Homo sapiens
gaactcctcaagggcaga

SEQ ID NO: 1380068 - DNA, 16 bp, Homo sapiens
gaagattcccacccct

SEQ ID NO: 1380069 - DNA, 16 bp, Homo sapiens
gacagctgcattccag

SEQ ID NO: 1380070 - DNA, 13 bp, Homo sapiens
gacatcagggagt

SEQ ID NO: 1380071 - DNA, 14 bp, Homo sapiens
gacatcagggagta

SEQ ID NO: 1380072 - DNA, 20 bp, Homo sapiens
gaccacaggtgcacgccacc

SEQ ID NO: 1380073 - DNA, 16 bp, Homo sapiens
gagacatcagggagta

SEQ ID NO: 1380074 - DNA, 18 bp, Homo sapiens
gagcagaggctccacagg

SEQ ID NO: 1380075 - DNA, 22 bp, Homo sapiens
gagcaggaagcgagcagaggct

SEQ ID NO: 1380076 - DNA, 17 bp, Homo sapiens
gagccctcacaccctgg

SEQ ID NO: 1380077 - DNA, 15 bp, Homo sapiens
gaggcagaaagggaa

SEQ ID NO: 1380078 - DNA, 15 bp, Homo sapiens
gaggcagggctctgg

SEQ ID NO: 1380079 - DNA, 18 bp, Homo sapiens
gagtgtctggtgccctgg

SEQ ID NO: 1380080 - DNA, 13 bp, Homo sapiens
gatgctctcaggc

SEQ ID NO: 1380081 - DNA, 16 bp, Homo sapiens
gatttatgctttaact

SEQ ID NO: 1380082 - DNA, 15 bp, Homo sapiens
gcaatcctcctgcct

SEQ ID NO: 1380083 - DNA, 18 bp, Homo sapiens
gcacgccaccacacctgg

SEQ ID NO: 1380084 - DNA, 22 bp, Homo sapiens
gcacgccaccacacctggcttt

SEQ ID NO: 1380085 - DNA, 13 bp, Homo sapiens
gcagaaagggaaa

SEQ ID NO: 1380086 - DNA, 17 bp, Homo sapiens
gcagagaactgtctttc

SEQ ID NO: 1380087 - DNA, 18 bp, Homo sapiens
gcagagaactgtctttca

SEQ ID NO: 1380088 - DNA, 17 bp, Homo sapiens
gcaggaggcagggctct

SEQ ID NO: 1380089 - DNA, 16 bp, Homo sapiens
gcagggctctggggcc

SEQ ID NO: 1380090 - DNA, 14 bp, Homo sapiens
gccaccacacctgg

SEQ ID NO: 1380091 - DNA, 15 bp, Homo sapiens
gccaccactcagtgc

SEQ ID NO: 1380092 - DNA, 16 bp, Homo sapiens
gccaccgcgcctggcc

SEQ ID NO: 1380093 - DNA, 16 bp, Homo sapiens
gccagccctgggcctg

SEQ ID NO: 1380094 - DNA, 14 bp, Homo sapiens
gccctccacatttt

SEQ ID NO: 1380095 - DNA, 16 bp, Homo sapiens
gccctccacattttct

SEQ ID NO: 1380096 - DNA, 12 bp, Homo sapiens
gccctgggcctg

SEQ ID NO: 1380097 - DNA, 23 bp, Homo sapiens
gcctcccatgcctggtcccaaga

SEQ ID NO: 1380098 - DNA, 14 bp, Homo sapiens
gcctccctatgctt

SEQ ID NO: 1380099 - DNA, 18 bp, Homo sapiens
gcgagcagaggctccaca

SEQ ID NO: 1380100 - DNA, 19 bp, Homo sapiens
gcggctctggttcctccag

SEQ ID NO: 1380101 - DNA, 22 bp, Homo sapiens
gctcagccaccactcagtgctt

SEQ ID NO: 1380102 - DNA, 14 bp, Homo sapiens
gctcaggctggtct

SEQ ID NO: 1380103 - DNA, 12 bp, Homo sapiens
gctctcaggctg

SEQ ID NO: 1380104 - DNA, 16 bp, Homo sapiens
gctctcttctggcttt

SEQ ID NO: 1380105 - DNA, 16 bp, Homo sapiens
gctctggttcctccag

SEQ ID NO: 1380106 - DNA, 22 bp, Homo sapiens
gctgagggaggcagaaagggaa

SEQ ID NO: 1380107 - DNA, 16 bp, Homo sapiens
gctgctctcctgacag

SEQ ID NO: 1380108 - DNA, 22 bp, Homo sapiens
gctgggaccacaggtgcacgcc

SEQ ID NO: 1380109 - DNA, 22 bp, Homo sapiens
gcttccttcatctctaaggcta

SEQ ID NO: 1380110 - DNA, 22 bp, Homo sapiens
ggaagcgagcagaggctccaca

SEQ ID NO: 1380111 - DNA, 15 bp, Homo sapiens
ggaatccaagctaat

SEQ ID NO: 1380112 - DNA, 17 bp, Homo sapiens
ggattgttttttcttta

SEQ ID NO: 1380113 - DNA, 16 bp, Homo sapiens
ggcagggctctggggc

SEQ ID NO: 1380114 - DNA, 17 bp, Homo sapiens
ggcctgccccagctctc

SEQ ID NO: 1380115 - DNA, 23 bp, Homo sapiens
ggcggctctggttcctccagcca

SEQ ID NO: 1380116 - DNA, 14 bp, Homo sapiens
ggctgagggaggca

SEQ ID NO: 1380117 - DNA, 17 bp, Homo sapiens
ggctgagggaggcagaa

SEQ ID NO: 1380118 - DNA, 14 bp, Homo sapiens
ggcttacgctgctc

SEQ ID NO: 1380119 - DNA, 20 bp, Homo sapiens
gggccagaatggctgtcctt

SEQ ID NO: 1380120 - DNA, 13 bp, Homo sapiens
ggggttgttttta

SEQ ID NO: 1380121 - DNA, 12 bp, Homo sapiens
ggtggcctgccc

SEQ ID NO: 1380122 - DNA, 17 bp, Homo sapiens
gtacctattccttcaga

SEQ ID NO: 1380123 - DNA, 14 bp, Homo sapiens
gtagagccctccac

SEQ ID NO: 1380124 - DNA, 21 bp, Homo sapiens
gtattagcatgagctttccag

SEQ ID NO: 1380125 - DNA, 22 bp, Homo sapiens
gtcccgagccctcacaccctgg

SEQ ID NO: 1380126 - DNA, 22 bp, Homo sapiens
gtcctctcatcccagtcctgat

SEQ ID NO: 1380127 - DNA, 16 bp, Homo sapiens
gtccttcctctgtcct

SEQ ID NO: 1380128 - DNA, 23 bp, Homo sapiens
gtcgtagagccctccacattttc

SEQ ID NO: 1380129 - DNA, 20 bp, Homo sapiens
gtctggaaagtgatgtcaga

SEQ ID NO: 1380130 - DNA, 20 bp, Homo sapiens
gtcttgaactcctgggctca

SEQ ID NO: 1380131 - DNA, 21 bp, Homo sapiens
gtgacactttgaactcctcaa

SEQ ID NO: 1380132 - DNA, 22 bp, Homo sapiens
gtgacactttgaactcctcaag

SEQ ID NO: 1380133 - DNA, 19 bp, Homo sapiens
gtgagacagtctggaaagt

SEQ ID NO: 1380134 - DNA, 20 bp, Homo sapiens
gtgagccaccgcgcctggcc

SEQ ID NO: 1380135 - DNA, 16 bp, Homo sapiens
gtgagtgtctggtgcc

SEQ ID NO: 1380136 - DNA, 15 bp, Homo sapiens
gtgatcttcccacgt

SEQ ID NO: 1380137 - DNA, 13 bp, Homo sapiens
gtggcagctcagc

SEQ ID NO: 1380138 - DNA, 23 bp, Homo sapiens
gttacaggggttgtttttaaaga

SEQ ID NO: 1380139 - DNA, 15 bp, Homo sapiens
gttcctccagccacc

SEQ ID NO: 1380140 - DNA, 18 bp, Homo sapiens
gttccttcccagcacatc

SEQ ID NO: 1380141 - DNA, 23 bp, Homo sapiens
taaagaaaaaaacaatcccagca

SEQ ID NO: 1380142 - DNA, 18 bp, Homo sapiens
taactaaatttgtctttc

SEQ ID NO: 1380143 - DNA, 17 bp, Homo sapiens
taaggctaaggataggg

SEQ ID NO: 1380144 - DNA, 15 bp, Homo sapiens
taattctgctttaga

SEQ ID NO: 1380145 - DNA, 17 bp, Homo sapiens
tagatgtgtatacagaa

SEQ ID NO: 1380146 - DNA, 18 bp, Homo sapiens
tagcatgagctttccagt

SEQ ID NO: 1380147 - DNA, 16 bp, Homo sapiens
tagcttccaataaagc

SEQ ID NO: 1380148 - DNA, 18 bp, Homo sapiens
tagtgagacatcagggag

SEQ ID NO: 1380149 - DNA, 20 bp, Homo sapiens
tagtgagacatcagggagta

SEQ ID NO: 1380150 - DNA, 18 bp, Homo sapiens
tatgctttcacttcccac

SEQ ID NO: 1380151 - DNA, 18 bp, Homo sapiens
tattgctcaggctggtct

SEQ ID NO: 1380152 - DNA, 13 bp, Homo sapiens
tcacaagaagatt

SEQ ID NO: 1380153 - DNA, 20 bp, Homo sapiens
tcaccgatattagtcctaca

SEQ ID NO: 1380154 - DNA, 22 bp, Homo sapiens
tcagaatagcttccaataaagc

SEQ ID NO: 1380155 - DNA, 16 bp, Homo sapiens
tcatcccagtcctgat

SEQ ID NO: 1380156 - DNA, 19 bp, Homo sapiens
tcatctctaaggctaagga

SEQ ID NO: 1380157 - DNA, 17 bp, Homo sapiens
tccaataaagcagcctc

SEQ ID NO: 1380158 - DNA, 14 bp, Homo sapiens
tccacccaggtccc

SEQ ID NO: 1380159 - DNA, 12 bp, Homo sapiens
tccactcctcca

SEQ ID NO: 1380160 - DNA, 22 bp, Homo sapiens
tccagccacctcagtccctctt

SEQ ID NO: 1380161 - DNA, 14 bp, Homo sapiens
tccataataattct

SEQ ID NO: 1380162 - DNA, 20 bp, Homo sapiens
tccataataattctgcttta

SEQ ID NO: 1380163 - DNA, 12 bp, Homo sapiens
tcccaagacagt

SEQ ID NO: 1380164 - DNA, 16 bp, Homo sapiens
tcccatgcctggtccc

SEQ ID NO: 1380165 - DNA, 14 bp, Homo sapiens
tcctccagccacct

SEQ ID NO: 1380166 - DNA, 15 bp, Homo sapiens
tcctgacagccacac

SEQ ID NO: 1380167 - DNA, 17 bp, Homo sapiens
tcctgcctcagcctcct

SEQ ID NO: 1380168 - DNA, 15 bp, Homo sapiens
tcggaatccaagcta

SEQ ID NO: 1380169 - DNA, 15 bp, Homo sapiens
tcgtagagccctcca

SEQ ID NO: 1380170 - DNA, 21 bp, Homo sapiens
tctaatggccttccataataa

SEQ ID NO: 1380171 - DNA, 15 bp, Homo sapiens
tctcaggctgaggga

SEQ ID NO: 1380172 - DNA, 22 bp, Homo sapiens
tctctaaggctaaggataggga

SEQ ID NO: 1380173 - DNA, 21 bp, Homo sapiens
tctgagcaggaagcgagcaga

SEQ ID NO: 1380174 - DNA, 21 bp, Homo sapiens
tctggaaagtgatgtcagaat

SEQ ID NO: 1380175 - DNA, 17 bp, Homo sapiens
tctgtcacccagactgg

SEQ ID NO: 1380176 - DNA, 23 bp, Homo sapiens
tcttgagctagaccaaggtcaga

SEQ ID NO: 1380177 - DNA, 18 bp, Homo sapiens
tcttgctctgtcacccag

SEQ ID NO: 1380178 - DNA, 16 bp, Homo sapiens
aaacaatcccagcagg

SEQ ID NO: 1380179 - DNA, 14 bp, Homo sapiens
aaacccaatgtcaa

SEQ ID NO: 1380180 - DNA, 17 bp, Homo sapiens
aactaaatttgtctttc

SEQ ID NO: 1380181 - DNA, 18 bp, Homo sapiens
aactaaatttgtctttca

SEQ ID NO: 1380182 - DNA, 19 bp, Homo sapiens
aactaaatttgtctttcaa

SEQ ID NO: 1380183 - DNA, 13 bp, Homo sapiens
aacttcagagtga

SEQ ID NO: 1380184 - DNA, 13 bp, Homo sapiens
aagaagaatgtta

SEQ ID NO: 1380185 - DNA, 22 bp, Homo sapiens
aagaatgttaatattttacttt

SEQ ID NO: 1380186 - DNA, 23 bp, Homo sapiens
aagtattagcatgagctttccag

SEQ ID NO: 1380187 - DNA, 13 bp, Homo sapiens
aagtgatgtcaga

SEQ ID NO: 1380188 - DNA, 17 bp, Homo sapiens
aataaagcagcctcatt

SEQ ID NO: 1380189 - DNA, 18 bp, Homo sapiens
aatagcttccaataaagc

SEQ ID NO: 1380190 - DNA, 13 bp, Homo sapiens
aatctcagacaca

SEQ ID NO: 1380191 - DNA, 19 bp, Homo sapiens
aatgcaagaatctcagaca

SEQ ID NO: 1380192 - DNA, 16 bp, Homo sapiens
aatttctaatggcctt

SEQ ID NO: 1380193 - DNA, 16 bp, Homo sapiens
aatttgtctttcaagt

SEQ ID NO: 1380194 - DNA, 19 bp, Homo sapiens
acagaaaatgaaagaaact

SEQ ID NO: 1380195 - DNA, 12 bp, Homo sapiens
acagctgggacc

SEQ ID NO: 1380196 - DNA, 21 bp, Homo sapiens
acagtgagacagtctggaaag

SEQ ID NO: 1380197 - DNA, 12 bp, Homo sapiens
acatccacccag

SEQ ID NO: 1380198 - DNA, 22 bp, Homo sapiens
acatcgccagccctgggcctgg

SEQ ID NO: 1380199 - DNA, 14 bp, Homo sapiens
accacacctggctt

SEQ ID NO: 1380200 - DNA, 20 bp, Homo sapiens
acccagactggagtgcagtg

SEQ ID NO: 1380201 - DNA, 15 bp, Homo sapiens
accgatattagtcct

SEQ ID NO: 1380202 - DNA, 16 bp, Homo sapiens
actcctcaagggcaga

SEQ ID NO: 1380203 - DNA, 22 bp, Homo sapiens
actcctgggctcaagtgatctt

SEQ ID NO: 1380204 - DNA, 14 bp, Homo sapiens
agaaaatgaaagaa

SEQ ID NO: 1380205 - DNA, 14 bp, Homo sapiens
agaactgtctttca

SEQ ID NO: 1380206 - DNA, 15 bp, Homo sapiens
agaactgtctttcat

SEQ ID NO: 1380207 - DNA, 15 bp, Homo sapiens
agacagtctggaaag

SEQ ID NO: 1380208 - DNA, 13 bp, Homo sapiens
agaccaaggtcag

SEQ ID NO: 1380209 - DNA, 12 bp, Homo sapiens
agagccctccac

SEQ ID NO: 1380210 - DNA, 18 bp, Homo sapiens
agcaatcctcctgcctca

SEQ ID NO: 1380211 - DNA, 22 bp, Homo sapiens
agcacatcgccagccctgggcc

SEQ ID NO: 1380212 - DNA, 15 bp, Homo sapiens
agcatgagctttcca

SEQ ID NO: 1380213 - DNA, 17 bp, Homo sapiens
agccctgggcctgggga

SEQ ID NO: 1380214 - DNA, 18 bp, Homo sapiens
agcctcctgaacagctgg

SEQ ID NO: 1380215 - DNA, 19 bp, Homo sapiens
agctcagccaccactcagt

SEQ ID NO: 1380216 - DNA, 16 bp, Homo sapiens
agctgcattccagagc

SEQ ID NO: 1380217 - DNA, 14 bp, Homo sapiens
agctgtgtttctta

SEQ ID NO: 1380218 - DNA, 15 bp, Homo sapiens
aggcagaaagggaaa

SEQ ID NO: 1380219 - DNA, 21 bp, Homo sapiens
aggcggctctggttcctccag

SEQ ID NO: 1380220 - DNA, 13 bp, Homo sapiens
agggaaagggtgg

SEQ ID NO: 1380221 - DNA, 18 bp, Homo sapiens
agggtggatgctctcagg

SEQ ID NO: 1380222 - DNA, 23 bp, Homo sapiens
aggtcccgagccctcacaccctg

SEQ ID NO: 1380223 - DNA, 13 bp, Homo sapiens
agtctggaaagtg

SEQ ID NO: 1380224 - DNA, 20 bp, Homo sapiens
agtctggaaagtgatgtcag

SEQ ID NO: 1380225 - DNA, 13 bp, Homo sapiens
agtggcagctcag

SEQ ID NO: 1380226 - DNA, 13 bp, Homo sapiens
agtgtaggggtgg

SEQ ID NO: 1380227 - DNA, 17 bp, Homo sapiens
agtgtctggtgccctgg

SEQ ID NO: 1380228 - DNA, 22 bp, Homo sapiens
ataaagcagcctcattctgagg

SEQ ID NO: 1380229 - DNA, 23 bp, Homo sapiens
ataaagcagcctcattctgaggc

SEQ ID NO: 1380230 - DNA, 15 bp, Homo sapiens
ataattctgctttag

SEQ ID NO: 1380231 - DNA, 13 bp, Homo sapiens
atattagtcctac

SEQ ID NO: 1380232 - DNA, 14 bp, Homo sapiens
atcctcctgcctca

SEQ ID NO: 1380233 - DNA, 16 bp, Homo sapiens
atctcagacacacatg

SEQ ID NO: 1380234 - DNA, 12 bp, Homo sapiens
atggctgtcctt

SEQ ID NO: 1380235 - DNA, 22 bp, Homo sapiens
atgttaatattttacttttaca

SEQ ID NO: 1380236 - DNA, 22 bp, Homo sapiens
attaatatgtgggaattagtga

SEQ ID NO: 1380237 - DNA, 20 bp, Homo sapiens
atttatgctttaacttcaga

SEQ ID NO: 1380238 - DNA, 12 bp, Homo sapiens
gcctcccatgcc

SEQ ID NO: 1380239 - DNA, 15 bp, Homo sapiens
gcctggaggcccaga

SEQ ID NO: 1380240 - DNA, 15 bp, Homo sapiens
gccttgagtctgtgt

SEQ ID NO: 1380241 - DNA, 18 bp, Homo sapiens
gctcagccaccactcagt

SEQ ID NO: 1380242 - DNA, 12 bp, Homo sapiens
gctctcctgaca

SEQ ID NO: 1380243 - DNA, 19 bp, Homo sapiens
gctctcttctggctttctg

SEQ ID NO: 1380244 - DNA, 23 bp, Homo sapiens
gctctcttctggctttctgagca

SEQ ID NO: 1380245 - DNA, 21 bp, Homo sapiens
gctctggttcctccagccacc

SEQ ID NO: 1380246 - DNA, 14 bp, Homo sapiens
gctctgtcacccag

SEQ ID NO: 1380247 - DNA, 15 bp, Homo sapiens
gctctgtcacccaga

SEQ ID NO: 1380248 - DNA, 13 bp, Homo sapiens
gctgcattccaga

SEQ ID NO: 1380249 - DNA, 21 bp, Homo sapiens
gctgggattgttttttcttta

SEQ ID NO: 1380250 - DNA, 13 bp, Homo sapiens
gctggggcctgga

SEQ ID NO: 1380251 - DNA, 18 bp, Homo sapiens
gctggtcttgaactcctg

SEQ ID NO: 1380252 - DNA, 13 bp, Homo sapiens
gctgtacctggct

SEQ ID NO: 1380253 - DNA, 20 bp, Homo sapiens
gctttagatgtgtatacaga

SEQ ID NO: 1380254 - DNA, 23 bp, Homo sapiens
ggaattagtgagacatcagggag

SEQ ID NO: 1380255 - DNA, 19 bp, Homo sapiens
ggagccttgagtctgtgtt

SEQ ID NO: 1380256 - DNA, 22 bp, Homo sapiens
ggatgtccccaatgctgtacct

SEQ ID NO: 1380257 - DNA, 11 bp, Homo sapiens
ggcctggaggc

SEQ ID NO: 1380258 - DNA, 14 bp, Homo sapiens
ggctaaggataggg

SEQ ID NO: 1380259 - DNA, 23 bp, Homo sapiens
ggctccacaggcttacgctgctc

SEQ ID NO: 1380260 - DNA, 15 bp, Homo sapiens
ggctgagggaggcag

SEQ ID NO: 1380261 - DNA, 18 bp, Homo sapiens
ggctggggcctggaggcc

SEQ ID NO: 1380262 - DNA, 20 bp, Homo sapiens
ggctggtcttgaactcctgg

SEQ ID NO: 1380263 - DNA, 12 bp, Homo sapiens
gtaccctaccct

SEQ ID NO: 1380264 - DNA, 20 bp, Homo sapiens
gtattagcatgagctttcca

SEQ ID NO: 1380265 - DNA, 17 bp, Homo sapiens
gtcagatttgaaaagaa

SEQ ID NO: 1380266 - DNA, 15 bp, Homo sapiens
gtccatatgagggaa

SEQ ID NO: 1380267 - DNA, 23 bp, Homo sapiens
gtccccaatgctgtacctggctg

SEQ ID NO: 1380268 - DNA, 21 bp, Homo sapiens
gtcccgagccctcacaccctg

SEQ ID NO: 1380269 - DNA, 21 bp, Homo sapiens
gtcctctcatcccagtcctga

SEQ ID NO: 1380270 - DNA, 12 bp, Homo sapiens
gtcctgacacct

SEQ ID NO: 1380271 - DNA, 10 bp, Homo sapiens
gtctggaaag

SEQ ID NO: 1380272 - DNA, 19 bp, Homo sapiens
gtctggtgccctggtggcc

SEQ ID NO: 1380273 - DNA, 20 bp, Homo sapiens
gtctggtgccctggtggcct

SEQ ID NO: 1380274 - DNA, 20 bp, Homo sapiens
gtctgtgttgtgtcctgaca

SEQ ID NO: 1380275 - DNA, 21 bp, Homo sapiens
gtctgtgttgtgtcctgacac

SEQ ID NO: 1380276 - DNA, 16 bp, Homo sapiens
gtcttgctctgtcacc

SEQ ID NO: 1380277 - DNA, 15 bp, Homo sapiens
gtgagacagtctgga

SEQ ID NO: 1380278 - DNA, 18 bp, Homo sapiens
gtgagacagtctggaaag

SEQ ID NO: 1380279 - DNA, 22 bp, Homo sapiens
gtgcacgccaccacacctggct

SEQ ID NO: 1380280 - DNA, 23 bp, Homo sapiens
gtgcacgccaccacacctggctt

SEQ ID NO: 1380281 - DNA, 16 bp, Homo sapiens
gtgcagaggcggctct

SEQ ID NO: 1380282 - DNA, 21 bp, Homo sapiens
gtgcagaggcggctctggttc

SEQ ID NO: 1380283 - DNA, 14 bp, Homo sapiens
gtggatgctctcag

SEQ ID NO: 1380284 - DNA, 17 bp, Homo sapiens
gtggatgctctcaggct

SEQ ID NO: 1380285 - DNA, 13 bp, Homo sapiens
gtgtatacagaaa

SEQ ID NO: 1380286 - DNA, 13 bp, Homo sapiens
gtgtcctgacacc

SEQ ID NO: 1380287 - DNA, 20 bp, Homo sapiens
gtgtcctgacacctccaagt

SEQ ID NO: 1380288 - DNA, 18 bp, Homo sapiens
gtgtccttcctctgtcct

SEQ ID NO: 1380289 - DNA, 17 bp, Homo sapiens
gttcctccagccacctc

SEQ ID NO: 1380290 - DNA, 19 bp, Homo sapiens
gttctagggccgtcaggac

SEQ ID NO: 1380291 - DNA, 19 bp, Homo sapiens
gttgtaaagcagtacccta

SEQ ID NO: 1380292 - DNA, 16 bp, Homo sapiens
taaatttgtctttcaa

SEQ ID NO: 1380293 - DNA, 14 bp, Homo sapiens
taaggatagggaaa

SEQ ID NO: 1380294 - DNA, 15 bp, Homo sapiens
taaggatagggaaag

SEQ ID NO: 1380295 - DNA, 20 bp, Homo sapiens
taaggctaaggatagggaaa

SEQ ID NO: 1380296 - DNA, 13 bp, Homo sapiens
taataatgtacct

SEQ ID NO: 1380297 - DNA, 20 bp, Homo sapiens
taatattttacttttacagt

SEQ ID NO: 1380298 - DNA, 19 bp, Homo sapiens
taatggccttccataataa

SEQ ID NO: 1380299 - DNA, 15 bp, Homo sapiens
tagatgtgtatacag

SEQ ID NO: 1380300 - DNA, 20 bp, Homo sapiens
tagggtccatatgagggaaa

SEQ ID NO: 1380301 - DNA, 11 bp, Homo sapiens
tatgagcacaa

SEQ ID NO: 1380302 - DNA, 21 bp, Homo sapiens
tatgctttaacttcagagtga

SEQ ID NO: 1380303 - DNA, 22 bp, Homo sapiens
tatgctttcacttcccacctct

SEQ ID NO: 1380304 - DNA, 21 bp, Homo sapiens
tattagcatgagctttccagt

SEQ ID NO: 1380305 - DNA, 22 bp, Homo sapiens
tattagcatgagctttccagtt

SEQ ID NO: 1380306 - DNA, 15 bp, Homo sapiens
tattttacttttaca

SEQ ID NO: 1380307 - DNA, 16 bp, Homo sapiens
tattttacttttacag

SEQ ID NO: 1380308 - DNA, 15 bp, Homo sapiens
tcaagggcagagaac

SEQ ID NO: 1380309 - DNA, 18 bp, Homo sapiens
tcaagggcagagaactgt

SEQ ID NO: 1380310 - DNA, 14 bp, Homo sapiens
tcacaccctggacg

SEQ ID NO: 1380311 - DNA, 13 bp, Homo sapiens
tcagcctcctgaa

SEQ ID NO: 1380312 - DNA, 20 bp, Homo sapiens
tcagcctcctgaacagctgg

SEQ ID NO: 1380313 - DNA, 14 bp, Homo sapiens
tcatctctaaggct

SEQ ID NO: 1380314 - DNA, 12 bp, Homo sapiens
tccacattttct

SEQ ID NO: 1380315 - DNA, 23 bp, Homo sapiens
tccagagcaggaggcagggctct

SEQ ID NO: 1380316 - DNA, 15 bp, Homo sapiens
tccatatgagggaaa

SEQ ID NO: 1380317 - DNA, 19 bp, Homo sapiens
tcccacccctgcctcccat

SEQ ID NO: 1380318 - DNA, 13 bp, Homo sapiens
tcccacctctcta

SEQ ID NO: 1380319 - DNA, 21 bp, Homo sapiens
tccccaatgctgtacctggct

SEQ ID NO: 1380320 - DNA, 14 bp, Homo sapiens
tcctcaagggcaga

SEQ ID NO: 1380321 - DNA, 13 bp, Homo sapiens
tcctcctgcctca

SEQ ID NO: 1380322 - DNA, 14 bp, Homo sapiens
tcctgaacagctgg

SEQ ID NO: 1380323 - DNA, 13 bp, Homo sapiens
tcctgattaatat

SEQ ID NO: 1380324 - DNA, 20 bp, Homo sapiens
tctaaggctaaggataggga

SEQ ID NO: 1380325 - DNA, 22 bp, Homo sapiens
tctcactatattgctcaggctg

SEQ ID NO: 1380326 - DNA, 16 bp, Homo sapiens
tctctaaggctaagga

SEQ ID NO: 1380327 - DNA, 15 bp, Homo sapiens
tctctgtgcaggagc

SEQ ID NO: 1380328 - DNA, 17 bp, Homo sapiens
tctggttcctccagcca

SEQ ID NO: 1380329 - DNA, 15 bp, Homo sapiens
tctgtgcaggagcca

SEQ ID NO: 1380330 - DNA, 21 bp, Homo sapiens
tcttaactaaatttgtctttc

SEQ ID NO: 1380331 - DNA, 23 bp, Homo sapiens
tgaaaccagcttccttcatctct

SEQ ID NO: 1380332 - DNA, 23 bp, Homo sapiens
tgaactcctcaagggcagagaac

SEQ ID NO: 1380333 - DNA, 12 bp, Homo sapiens
tgagacatcagg

SEQ ID NO: 1380334 - DNA, 23 bp, Homo sapiens
tgagcaggaagcgagcagaggct

SEQ ID NO: 1380335 - DNA, 13 bp, Homo sapiens
gagtgcagaggcg

SEQ ID NO: 1380336 - DNA, 16 bp, Homo sapiens
gatattagtcctacac

SEQ ID NO: 1380337 - DNA, 13 bp, Homo sapiens
gatttatgcttta

SEQ ID NO: 1380338 - DNA, 15 bp, Homo sapiens
gcacatcgccagccc

SEQ ID NO: 1380339 - DNA, 20 bp, Homo sapiens
gcacatcgccagccctgggc

SEQ ID NO: 1380340 - DNA, 14 bp, Homo sapiens
gcaccctcaacctc

SEQ ID NO: 1380341 - DNA, 16 bp, Homo sapiens
gcagaggcggctctgg

SEQ ID NO: 1380342 - DNA, 12 bp, Homo sapiens
gcagggctctgg

SEQ ID NO: 1380343 - DNA, 19 bp, Homo sapiens
gcagggctctggggccaga

SEQ ID NO: 1380344 - DNA, 18 bp, Homo sapiens
gccaccgcgcctggccca

SEQ ID NO: 1380345 - DNA, 14 bp, Homo sapiens
gccagccctgggcc

SEQ ID NO: 1380346 - DNA, 16 bp, Homo sapiens
gccctccacattttca

SEQ ID NO: 1380347 - DNA, 13 bp, Homo sapiens
gccctgggcctgg

SEQ ID NO: 1380348 - DNA, 19 bp, Homo sapiens
gccctggtggcctgcccca

SEQ ID NO: 1380349 - DNA, 15 bp, Homo sapiens
gcctcagcctcctga

SEQ ID NO: 1380350 - DNA, 16 bp, Homo sapiens
gcctcccatgcctggt

SEQ ID NO: 1380351 - DNA, 17 bp, Homo sapiens
gcctcctgaacagctgg

SEQ ID NO: 1380352 - DNA, 17 bp, Homo sapiens
gctctcctgacagccac

SEQ ID NO: 1380353 - DNA, 19 bp, Homo sapiens
gctctcctgacagccacac

SEQ ID NO: 1380354 - DNA, 14 bp, Homo sapiens
gctctcttctggct

SEQ ID NO: 1380355 - DNA, 15 bp, Homo sapiens
gctctggttcctcca

SEQ ID NO: 1380356 - DNA, 22 bp, Homo sapiens
gctctggttcctccagccacct

SEQ ID NO: 1380357 - DNA, 23 bp, Homo sapiens
gctctggttcctccagccacctc

SEQ ID NO: 1380358 - DNA, 15 bp, Homo sapiens
gctgagggaggcaga

SEQ ID NO: 1380359 - DNA, 15 bp, Homo sapiens
gctgctctcctgaca

SEQ ID NO: 1380360 - DNA, 16 bp, Homo sapiens
gctggggcctggaggc

SEQ ID NO: 1380361 - DNA, 17 bp, Homo sapiens
gctggggcctggaggcc

SEQ ID NO: 1380362 - DNA, 23 bp, Homo sapiens
gctggtcttgaactcctgggctc

SEQ ID NO: 1380363 - DNA, 18 bp, Homo sapiens
gcttacgctgctctcctg

SEQ ID NO: 1380364 - DNA, 15 bp, Homo sapiens
gcttctctgtgcagg

SEQ ID NO: 1380365 - DNA, 13 bp, Homo sapiens
ggatgctctcagg

SEQ ID NO: 1380366 - DNA, 14 bp, Homo sapiens
ggatgctctcaggc

SEQ ID NO: 1380367 - DNA, 15 bp, Homo sapiens
ggcagaaagggaaag

SEQ ID NO: 1380368 - DNA, 18 bp, Homo sapiens
ggcagagaactgtctttc

SEQ ID NO: 1380369 - DNA, 13 bp, Homo sapiens
ggcctgccccagc

SEQ ID NO: 1380370 - DNA, 17 bp, Homo sapiens
ggctctggttcctccag

SEQ ID NO: 1380371 - DNA, 21 bp, Homo sapiens
ggctctggttcctccagccac

SEQ ID NO: 1380372 - DNA, 12 bp, Homo sapiens
ggctgagggagg

SEQ ID NO: 1380373 - DNA, 23 bp, Homo sapiens
ggctggtcttgaactcctgggct

SEQ ID NO: 1380374 - DNA, 22 bp, Homo sapiens
ggctgtccttgtcgtagagccc

SEQ ID NO: 1380375 - DNA, 22 bp, Homo sapiens
gggtcttgctctgtcacccaga

SEQ ID NO: 1380376 - DNA, 14 bp, Homo sapiens
ggtcccaagacagt

SEQ ID NO: 1380377 - DNA, 21 bp, Homo sapiens
ggtgcacgccaccacacctgg

SEQ ID NO: 1380378 - DNA, 17 bp, Homo sapiens
ggtgccctggtggcctg

SEQ ID NO: 1380379 - DNA, 22 bp, Homo sapiens
gtattagcatgagctttccagt

SEQ ID NO: 1380380 - DNA, 22 bp, Homo sapiens
gtccccaatgctgtacctggct

SEQ ID NO: 1380381 - DNA, 19 bp, Homo sapiens
gtctgtgttgtgtcctgac

SEQ ID NO: 1380382 - DNA, 18 bp, Homo sapiens
gtgcacgccaccacacct

SEQ ID NO: 1380383 - DNA, 19 bp, Homo sapiens
gtgccctggtggcctgccc

SEQ ID NO: 1380384 - DNA, 20 bp, Homo sapiens
gtgccctggtggcctgcccc

SEQ ID NO: 1380385 - DNA, 16 bp, Homo sapiens
gtggatgctctcaggc

SEQ ID NO: 1380386 - DNA, 19 bp, Homo sapiens
gtggatgctctcaggctga

SEQ ID NO: 1380387 - DNA, 12 bp, Homo sapiens
gtgtacacagag

SEQ ID NO: 1380388 - DNA, 19 bp, Homo sapiens
gttacaggggttgttttta

SEQ ID NO: 1380389 - DNA, 22 bp, Homo sapiens
gttcaagcaatcctcctgcctc

SEQ ID NO: 1380390 - DNA, 14 bp, Homo sapiens
gttcctccagccac

SEQ ID NO: 1380391 - DNA, 16 bp, Homo sapiens
gttgtgtcctgacacc

SEQ ID NO: 1380392 - DNA, 17 bp, Homo sapiens
taaatttgtctttcaag

SEQ ID NO: 1380393 - DNA, 22 bp, Homo sapiens
taactaaatttgtctttcaagt

SEQ ID NO: 1380394 - DNA, 17 bp, Homo sapiens
taaggatagggaaaggg

SEQ ID NO: 1380395 - DNA, 16 bp, Homo sapiens
taataattctgcttta

SEQ ID NO: 1380396 - DNA, 13 bp, Homo sapiens
taattctgcttta

SEQ ID NO: 1380397 - DNA, 17 bp, Homo sapiens
tacaggggttgttttta

SEQ ID NO: 1380398 - DNA, 18 bp, Homo sapiens
tacatcggaatccaagct

SEQ ID NO: 1380399 - DNA, 14 bp, Homo sapiens
tacctattccttca

SEQ ID NO: 1380400 - DNA, 10 bp, Homo sapiens
tagagacagg

SEQ ID NO: 1380401 - DNA, 16 bp, Homo sapiens
tagagccctccacatt

SEQ ID NO: 1380402 - DNA, 16 bp, Homo sapiens
tattagcatgagcttt

SEQ ID NO: 1380403 - DNA, 17 bp, Homo sapiens
tcaagcaatcctcctgc

SEQ ID NO: 1380404 - DNA, 22 bp, Homo sapiens
tcaagggcagagaactgtcttt

SEQ ID NO: 1380405 - DNA, 12 bp, Homo sapiens
tcaagtggcagc

SEQ ID NO: 1380406 - DNA, 17 bp, Homo sapiens
tcaccgatattagtcct

SEQ ID NO: 1380407 - DNA, 17 bp, Homo sapiens
tcagagtgagtgtaggg

SEQ ID NO: 1380408 - DNA, 14 bp, Homo sapiens
tcagatttgaaaag

SEQ ID NO: 1380409 - DNA, 18 bp, Homo sapiens
tcaggctgagggaggcag

SEQ ID NO: 1380410 - DNA, 15 bp, Homo sapiens
tccagccaccaccca

SEQ ID NO: 1380411 - DNA, 19 bp, Homo sapiens
tccataataattctgcttt

SEQ ID NO: 1380412 - DNA, 22 bp, Homo sapiens
tcccaagacagtgagacagtct

SEQ ID NO: 1380413 - DNA, 18 bp, Homo sapiens
tcccacgtgggcctccca

SEQ ID NO: 1380414 - DNA, 22 bp, Homo sapiens
tcccagcacatcgccagccctg

SEQ ID NO: 1380415 - DNA, 17 bp, Homo sapiens
tcccagtcctgatggcc

SEQ ID NO: 1380416 - DNA, 15 bp, Homo sapiens
tcccatgcctggtcc

SEQ ID NO: 1380417 - DNA, 14 bp, Homo sapiens
tcccctctggaggg

SEQ ID NO: 1380418 - DNA, 17 bp, Homo sapiens
tcctcaagggcagagaa

SEQ ID NO: 1380419 - DNA, 18 bp, Homo sapiens
tcctcaagggcagagaac

SEQ ID NO: 1380420 - DNA, 22 bp, Homo sapiens
tcctgaacagctgggaccacag

SEQ ID NO: 1380421 - DNA, 14 bp, Homo sapiens
tcctgatggccgct

SEQ ID NO: 1380422 - DNA, 17 bp, Homo sapiens
tcgccagccctgggcct

SEQ ID NO: 1380423 - DNA, 16 bp, Homo sapiens
tcggtgtacacagagg

SEQ ID NO: 1380424 - DNA, 13 bp, Homo sapiens
tctcattttctca

SEQ ID NO: 1380425 - DNA, 12 bp, Homo sapiens
tctggggccaga

SEQ ID NO: 1380426 - DNA, 21 bp, Homo sapiens
tctgtgcaggagccagtcctg

SEQ ID NO: 1380427 - DNA, 17 bp, Homo sapiens
tcttctggctttctgag

SEQ ID NO: 1380428 - DNA, 21 bp, Homo sapiens
tcttgagctagaccaaggtca

SEQ ID NO: 1380429 - DNA, 16 bp, Homo sapiens
tgaaagaaactagggt

SEQ ID NO: 1380430 - DNA, 17 bp, Homo sapiens
tgaactcctcaagggca

SEQ ID NO: 1380431 - DNA, 19 bp, Homo sapiens
tgaactcctcaagggcaga

SEQ ID NO: 1380432 - DNA, 16 bp, Homo sapiens
tgaactcctgggctca

SEQ ID NO: 1380433 - DNA, 14 bp, Homo sapiens
tgagacagtctgga

SEQ ID NO: 1380434 - DNA, 17 bp, Homo sapiens
tgagacagtctggaaag

SEQ ID NO: 1380435 - DNA, 23 bp, Homo sapiens
tgagacagtctggaaagtgatgt

SEQ ID NO: 1380436 - DNA, 16 bp, Homo sapiens
tgagacatcagggagt

SEQ ID NO: 1380437 - DNA, 20 bp, Homo sapiens
tgagacatcagggagtaagt

SEQ ID NO: 1380438 - DNA, 21 bp, Homo sapiens
tgagcacaaacttctgtggca

SEQ ID NO: 1380439 - DNA, 18 bp, Homo sapiens
tgagctagaccaaggtca

SEQ ID NO: 1380440 - DNA, 19 bp, Homo sapiens
tgagggaaaacccaatgtc

SEQ ID NO: 1380441 - DNA, 22 bp, Homo sapiens
tgagggaggcagaaagggaaag

SEQ ID NO: 1380442 - DNA, 18 bp, Homo sapiens
tgatcatagctcactgca

SEQ ID NO: 1380443 - DNA, 17 bp, Homo sapiens
tgcagaggcggctctgg

SEQ ID NO: 1380444 - DNA, 22 bp, Homo sapiens
tgccccagctctcttctggctt

SEQ ID NO: 1380445 - DNA, 13 bp, Homo sapiens
tgccctggtggcc

SEQ ID NO: 1380446 - DNA, 15 bp, Homo sapiens
tgcctcccatgcctg

SEQ ID NO: 1380447 - DNA, 20 bp, Homo sapiens
tgctctcaggctgagggagg

SEQ ID NO: 1380448 - DNA, 23 bp, Homo sapiens
tgctctcaggctgagggaggcag

SEQ ID NO: 1380449 - DNA, 14 bp, Homo sapiens
tgctgtacctggct

SEQ ID NO: 1380450 - DNA, 15 bp, Homo sapiens
tgctgtacctggctg

SEQ ID NO: 1380451 - DNA, 22 bp, Homo sapiens
tgcttctctgtgcaggagccag

SEQ ID NO: 1380452 - DNA, 22 bp, Homo sapiens
tgctttagatgtgtatacagaa

SEQ ID NO: 1380453 - DNA, 12 bp, Homo sapiens
tggatgctctca

SEQ ID NO: 1380454 - DNA, 17 bp, Homo sapiens
tggcccaagccctccac

SEQ ID NO: 1380455 - DNA, 23 bp, Homo sapiens
tgggaattagtgagacatcaggg

SEQ ID NO: 1380456 - DNA, 20 bp, Homo sapiens
tggtgccctggtggcctgcc

SEQ ID NO: 1380457 - DNA, 13 bp, Homo sapiens
tgtacctggctga

SEQ ID NO: 1380458 - DNA, 16 bp, Homo sapiens
tgtctggtgccctggt

SEQ ID NO: 1380459 - DNA, 14 bp, Homo sapiens
tgtctttcaagtga

SEQ ID NO: 1380460 - DNA, 20 bp, Homo sapiens
tgtgatcatagctcactgca

SEQ ID NO: 1380461 - DNA, 13 bp, Homo sapiens
ttacttttacagt

SEQ ID NO: 1380462 - DNA, 15 bp, Homo sapiens
ttacttttacagtca

SEQ ID NO: 1380463 - DNA, 16 bp, Homo sapiens
ttacttttacagtcat

SEQ ID NO: 1380464 - DNA, 21 bp, Homo sapiens
ttagatgtgtatacagaaaat

SEQ ID NO: 1380465 - DNA, 18 bp, Homo sapiens
ttatgctttaacttcaga

SEQ ID NO: 1380466 - DNA, 13 bp, Homo sapiens
ttcctctgtcctc

SEQ ID NO: 1380467 - DNA, 13 bp, Homo sapiens
ttccttcccagca

SEQ ID NO: 1380468 - DNA, 18 bp, Homo sapiens
ttgaaaagaacagaagga

SEQ ID NO: 1380469 - DNA, 22 bp, Homo sapiens
ttgaaccctcggtgtacacaga

SEQ ID NO: 1380470 - DNA, 15 bp, Homo sapiens
ttgaactcctgggct

SEQ ID NO: 1380471 - DNA, 16 bp, Homo sapiens
tttacttttacagtca

SEQ ID NO: 1380472 - DNA, 21 bp, Homo sapiens
tttagatgtgtatacagaaaa

SEQ ID NO: 1380473 - DNA, 13 bp, Homo sapiens
tttgaaaagaaca

SEQ ID NO: 1380474 - DNA, 15 bp, Homo sapiens
tttgaaaagaacaga

SEQ ID NO: 1380475 - DNA, 19 bp, Homo sapiens
tttgaactcctcaagggca

SEQ ID NO: 1380476 - DNA, 13 bp, Homo sapiens
tttttaaagaaaa

SEQ ID NO: 1380477 - DNA, 14 bp, Homo sapiens
aaaacccaatgtca

SEQ ID NO: 1380478 - DNA, 19 bp, Homo sapiens
aaagcagcctcattctgag

SEQ ID NO: 1380479 - DNA, 20 bp, Homo sapiens
aacaatcccagcaggaggga

SEQ ID NO: 1380480 - DNA, 21 bp, Homo sapiens
aactagggtccatatgaggga

SEQ ID NO: 1380481 - DNA, 15 bp, Homo sapiens
aactcctcaagggca

SEQ ID NO: 1380482 - DNA, 16 bp, Homo sapiens
aagaagattcccaccc

SEQ ID NO: 1380483 - DNA, 17 bp, Homo sapiens
aagccctccacattttc

SEQ ID NO: 1380484 - DNA, 14 bp, Homo sapiens
aagtattagcatga

SEQ ID NO: 1380485 - DNA, 20 bp, Homo sapiens
aataattctgctttagatgt

SEQ ID NO: 1380486 - DNA, 14 bp, Homo sapiens
aatcctcctgcctc

SEQ ID NO: 1380487 - DNA, 17 bp, Homo sapiens
aatgctgtacctggctg

SEQ ID NO: 1380488 - DNA, 14 bp, Homo sapiens
aatggccttccata

SEQ ID NO: 1380489 - DNA, 11 bp, Homo sapiens
acacctggctt

SEQ ID NO: 1380490 - DNA, 21 bp, Homo sapiens
acacgggagggtttggggaca

SEQ ID NO: 1380491 - DNA, 15 bp, Homo sapiens
acagctgcattccag

SEQ ID NO: 1380492 - DNA, 23 bp, Homo sapiens
acaggcttacgctgctctcctga

SEQ ID NO: 1380493 - DNA, 16 bp, Homo sapiens
acagggtcttgctctg

SEQ ID NO: 1380494 - DNA, 22 bp, Homo sapiens
acatgacgcaccagttacaggg

SEQ ID NO: 1380495 - DNA, 22 bp, Homo sapiens
accaaggtcagatttgaaaaga

SEQ ID NO: 1380496 - DNA, 13 bp, Homo sapiens
accacccacaatc

SEQ ID NO: 1380497 - DNA, 14 bp, Homo sapiens
accactcagtgctt

SEQ ID NO: 1380498 - DNA, 17 bp, Homo sapiens
accagcttccttcatct

SEQ ID NO: 1380499 - DNA, 22 bp, Homo sapiens
acccctgcctcccatgcctggt

SEQ ID NO: 1380500 - DNA, 12 bp, Homo sapiens
accctcaacctc

SEQ ID NO: 1380501 - DNA, 19 bp, Homo sapiens
acgccaccacacctggctt

SEQ ID NO: 1380502 - DNA, 17 bp, Homo sapiens
acgctgctctcctgaca

SEQ ID NO: 1380503 - DNA, 15 bp, Homo sapiens
actcctcaagggcag

SEQ ID NO: 1380504 - DNA, 21 bp, Homo sapiens
actcctcaagggcagagaact

SEQ ID NO: 1380505 - DNA, 13 bp, Homo sapiens
actgaagaccagc

SEQ ID NO: 1380506 - DNA, 13 bp, Homo sapiens
agaactgtctttc

SEQ ID NO: 1380507 - DNA, 15 bp, Homo sapiens
agaatagcttccaat

SEQ ID NO: 1380508 - DNA, 20 bp, Homo sapiens
agaatagcttccaataaagc

SEQ ID NO: 1380509 - DNA, 13 bp, Homo sapiens
agacagtctggaa

SEQ ID NO: 1380510 - DNA, 14 bp, Homo sapiens
agacagtctggaaa

SEQ ID NO: 1380511 - DNA, 12 bp, Homo sapiens
agacatcaggga

SEQ ID NO: 1380512 - DNA, 18 bp, Homo sapiens
agagccctccacattttc

SEQ ID NO: 1380513 - DNA, 22 bp, Homo sapiens
agagtgtccttcctctgtcctc

SEQ ID NO: 1380514 - DNA, 20 bp, Homo sapiens
agatgtgcctatgagcacaa

SEQ ID NO: 1380515 - DNA, 16 bp, Homo sapiens
agcaatcctcctgcct

SEQ ID NO: 1380516 - DNA, 16 bp, Homo sapiens
agcagcctcattctga

SEQ ID NO: 1380517 - DNA, 16 bp, Homo sapiens
agcatgagctttccag

SEQ ID NO: 1380518 - DNA, 16 bp, Homo sapiens
agccctccacattttc

SEQ ID NO: 1380519 - DNA, 19 bp, Homo sapiens
agccctccacattttcaat

SEQ ID NO: 1380520 - DNA, 16 bp, Homo sapiens
agctagaccaaggtca

SEQ ID NO: 1380521 - DNA, 13 bp, Homo sapiens
agctcactgcacc

SEQ ID NO: 1380522 - DNA, 21 bp, Homo sapiens
agctcagccaccactcagtgc

SEQ ID NO: 1380523 - DNA, 15 bp, Homo sapiens
agctctcttctggct

SEQ ID NO: 1380524 - DNA, 20 bp, Homo sapiens
agctctcttctggctttctg

SEQ ID NO: 1380525 - DNA, 16 bp, Homo sapiens
aggagccttgagtctg

SEQ ID NO: 1380526 - DNA, 19 bp, Homo sapiens
aggatagggaaagggtgga

SEQ ID NO: 1380527 - DNA, 17 bp, Homo sapiens
aggctgagggaggcaga

SEQ ID NO: 1380528 - DNA, 21 bp, Homo sapiens
aggctggtcttgaactcctgg

SEQ ID NO: 1380529 - DNA, 23 bp, Homo sapiens
aggcttacgctgctctcctgaca

SEQ ID NO: 1380530 - DNA, 22 bp, Homo sapiens
agggaaagtattagcatgagct

SEQ ID NO: 1380531 - DNA, 17 bp, Homo sapiens
agggaggcagaaaggga

SEQ ID NO: 1380532 - DNA, 17 bp, Homo sapiens
agggctatggcctccct

SEQ ID NO: 1380533 - DNA, 23 bp, Homo sapiens
agggctgttgatttatgctttaa

SEQ ID NO: 1380534 - DNA, 18 bp, Homo sapiens
agtctgtgttgtgtcctg

SEQ ID NO: 1380535 - DNA, 14 bp, Homo sapiens
agtgacactttgaa

SEQ ID NO: 1380536 - DNA, 16 bp, Homo sapiens
agtgagacagtctgga

SEQ ID NO: 1380537 - DNA, 18 bp, Homo sapiens
agtgagacatcagggagt

SEQ ID NO: 1380538 - DNA, 17 bp, Homo sapiens
agtgagtgtaggggtgg

SEQ ID NO: 1380539 - DNA, 18 bp, Homo sapiens
agtgcagaggcggctctg

SEQ ID NO: 1380540 - DNA, 22 bp, Homo sapiens
agtgcttctctgtgcaggagcc

SEQ ID NO: 1380541 - DNA, 14 bp, Homo sapiens
agtggcagctcagc

SEQ ID NO: 1380542 - DNA, 15 bp, Homo sapiens
atattagtcctacac

SEQ ID NO: 1380543 - DNA, 17 bp, Homo sapiens
atattttacttttacag

SEQ ID NO: 1380544 - DNA, 14 bp, Homo sapiens
atccaggagccttg

SEQ ID NO: 1380545 - DNA, 20 bp, Homo sapiens
atcgccagccctgggcctgg

SEQ ID NO: 1380546 - DNA, 13 bp, Homo sapiens
atcttcccacgtg

SEQ ID NO: 1380547 - DNA, 15 bp, Homo sapiens
atgagcacaaacttc

SEQ ID NO: 1380548 - DNA, 15 bp, Homo sapiens
atgcctggtcccaag

SEQ ID NO: 1380549 - DNA, 20 bp, Homo sapiens
atgctctcaggctgagggag

SEQ ID NO: 1380550 - DNA, 15 bp, Homo sapiens
atgctgtacctggct

SEQ ID NO: 1380551 - DNA, 17 bp, Homo sapiens
atgctgtacctggctga

SEQ ID NO: 1380552 - DNA, 18 bp, Homo sapiens
atgtacctattccttcag

SEQ ID NO: 1380553 - DNA, 16 bp, Homo sapiens
atgtcaagtggcagct

SEQ ID NO: 1380554 - DNA, 18 bp, Homo sapiens
atgtcaagtggcagctca

SEQ ID NO: 1380555 - DNA, 16 bp, Homo sapiens
attagtgagacatcag

SEQ ID NO: 1380556 - DNA, 19 bp, Homo sapiens
attagtgagacatcaggga

SEQ ID NO: 1380557 - DNA, 21 bp, Homo sapiens
attagtgagacatcagggagt

SEQ ID NO: 1380558 - DNA, 13 bp, Homo sapiens
atttatgctttaa

SEQ ID NO: 1380559 - DNA, 19 bp, Homo sapiens
atttgaaaagaacagaagg

SEQ ID NO: 1380560 - DNA, 15 bp, Homo sapiens
atttgtctttcaagt

SEQ ID NO: 1380561 - DNA, 21 bp, Homo sapiens
caagacagtgagacagtctgg

SEQ ID NO: 1380562 - DNA, 16 bp, Homo sapiens
caagctaatttctaat

SEQ ID NO: 1380563 - DNA, 17 bp, Homo sapiens
caagtgaaaccagcttc

SEQ ID NO: 1380564 - DNA, 15 bp, Homo sapiens
caatcctcctgcctc

SEQ ID NO: 1380565 - DNA, 16 bp, Homo sapiens
caatcctcctgcctca

SEQ ID NO: 1380566 - DNA, 18 bp, Homo sapiens
caatgctgtacctggctg

SEQ ID NO: 1380567 - DNA, 13 bp, Homo sapiens
caatgtcaagtgg

SEQ ID NO: 1380568 - DNA, 20 bp, Homo sapiens
cacacatgacgcaccagtta

SEQ ID NO: 1380569 - DNA, 21 bp, Homo sapiens
cacatgacgcaccagttacag

SEQ ID NO: 1380570 - DNA, 22 bp, Homo sapiens
cacatgacgcaccagttacagg

SEQ ID NO: 1380571 - DNA, 13 bp, Homo sapiens
caccactcagtgc

SEQ ID NO: 1380572 - DNA, 20 bp, Homo sapiens
caccactccactcctccagc

SEQ ID NO: 1380573 - DNA, 22 bp, Homo sapiens
cacccctgcctcccatgcctgg

SEQ ID NO: 1380574 - DNA, 21 bp, Homo sapiens
cacctccaagttctagggccg

SEQ ID NO: 1380575 - DNA, 15 bp, Homo sapiens
cacgtgggcctccca

SEQ ID NO: 1380576 - DNA, 21 bp, Homo sapiens
cagaatagcttccaataaagc

SEQ ID NO: 1380577 - DNA, 22 bp, Homo sapiens
cagagcaggaggcagggctctg

SEQ ID NO: 1380578 - DNA, 23 bp, Homo sapiens
cagagcaggaggcagggctctgg

SEQ ID NO: 1380579 - DNA, 16 bp, Homo sapiens
cagaggcggctctggt

SEQ ID NO: 1380580 - DNA, 19 bp, Homo sapiens
cagagtgagtgtaggggtg

SEQ ID NO: 1380581 - DNA, 20 bp, Homo sapiens
cagagtgtccttcctctgtc

SEQ ID NO: 1380582 - DNA, 17 bp, Homo sapiens
cagcacatccacccagg

SEQ ID NO: 1380583 - DNA, 12 bp, Homo sapiens
cagccctgggcc

SEQ ID NO: 1380584 - DNA, 13 bp, Homo sapiens
cagctgggaccac

SEQ ID NO: 1380585 - DNA, 15 bp, Homo sapiens
caggaagcgagcaga

SEQ ID NO: 1380586 - DNA, 22 bp, Homo sapiens
caggctggtcttgaactcctgg

SEQ ID NO: 1380587 - DNA, 17 bp, Homo sapiens
caggcttacgctgctct

SEQ ID NO: 1380588 - DNA, 17 bp, Homo sapiens
cagggctctggggccag

SEQ ID NO: 1380589 - DNA, 20 bp, Homo sapiens
cagtgagacagtctggaaag

SEQ ID NO: 1380590 - DNA, 21 bp, Homo sapiens
cagtgagacagtctggaaagt

SEQ ID NO: 1380591 - DNA, 21 bp, Homo sapiens
cagtgcttctctgtgcaggag

SEQ ID NO: 1380592 - DNA, 18 bp, Homo sapiens
cataataattctgcttta

SEQ ID NO: 1380593 - DNA, 17 bp, Homo sapiens
catcagggagtaagtga

SEQ ID NO: 1380594 - DNA, 15 bp, Homo sapiens
catcgccagccctgg

SEQ ID NO: 1380595 - DNA, 21 bp, Homo sapiens
catgacgcaccagttacaggg

SEQ ID NO: 1380596 - DNA, 15 bp, Homo sapiens
catgagctttccagt

SEQ ID NO: 1380597 - DNA, 22 bp, Homo sapiens
ccaagacagtgagacagtctgg

SEQ ID NO: 1380598 - DNA, 18 bp, Homo sapiens
ccaatgctgtacctggct

SEQ ID NO: 1380599 - DNA, 12 bp, Homo sapiens
ccacacctggct

SEQ ID NO: 1380600 - DNA, 20 bp, Homo sapiens
ccacaggcttacgctgctct

SEQ ID NO: 1380601 - DNA, 12 bp, Homo sapiens
ccaccacacctg

SEQ ID NO: 1380602 - DNA, 23 bp, Homo sapiens
ccacccacaatcacaagaagatt

SEQ ID NO: 1380603 - DNA, 14 bp, Homo sapiens
ccacctcagtccct

SEQ ID NO: 1380604 - DNA, 23 bp, Homo sapiens
ccagatacagcacatccacccag

SEQ ID NO: 1380605 - DNA, 19 bp, Homo sapiens
ccagcacatcgccagccct

SEQ ID NO: 1380606 - DNA, 16 bp, Homo sapiens
ccagccctgggcctgg

SEQ ID NO: 1380607 - DNA, 17 bp, Homo sapiens
ccagctctcttctggct

SEQ ID NO: 1380608 - DNA, 21 bp, Homo sapiens
ccaggtcccgagccctcacac

SEQ ID NO: 1380609 - DNA, 14 bp, Homo sapiens
ccagttagggctgt

SEQ ID NO: 1380610 - DNA, 14 bp, Homo sapiens
ccatgcctggtccc

SEQ ID NO: 1380611 - DNA, 19 bp, Homo sapiens
cccaatgtcaagtggcagc

SEQ ID NO: 1380612 - DNA, 20 bp, Homo sapiens
cccacaatcacaagaagatt

SEQ ID NO: 1380613 - DNA, 18 bp, Homo sapiens
cccagactggagtgcagt

SEQ ID NO: 1380614 - DNA, 22 bp, Homo sapiens
cccagcacatcgccagccctgg

SEQ ID NO: 1380615 - DNA, 20 bp, Homo sapiens
ccccagctctcttctggctt

SEQ ID NO: 1380616 - DNA, 14 bp, Homo sapiens
ccctcacaccctgg

SEQ ID NO: 1380617 - DNA, 12 bp, Homo sapiens
ccctctggaggg

SEQ ID NO: 1380618 - DNA, 21 bp, Homo sapiens
ccctctggagggctatggcct

SEQ ID NO: 1380619 - DNA, 15 bp, Homo sapiens
ccctgggcctgggga

SEQ ID NO: 1380620 - DNA, 15 bp, Homo sapiens
ccctggtggcctgcc

SEQ ID NO: 1380621 - DNA, 12 bp, Homo sapiens
ccgcgcctggcc

SEQ ID NO: 1380622 - DNA, 14 bp, Homo sapiens
ccgcgcctggccca

SEQ ID NO: 1380623 - DNA, 17 bp, Homo sapiens
cctcaacctcctgggtt

SEQ ID NO: 1380624 - DNA, 22 bp, Homo sapiens
cctcaccttcaactgtctgtct

SEQ ID NO: 1380625 - DNA, 13 bp, Homo sapiens
cctccagccacct

SEQ ID NO: 1380626 - DNA, 14 bp, Homo sapiens
cctcctgcctcagc

SEQ ID NO: 1380627 - DNA, 16 bp, Homo sapiens
cctgcctcccatgcct

SEQ ID NO: 1380628 - DNA, 15 bp, Homo sapiens
cctggaggcccagat

SEQ ID NO: 1380629 - DNA, 21 bp, Homo sapiens
cctggcccaagccctccacat

SEQ ID NO: 1380630 - DNA, 14 bp, Homo sapiens
cctggtggcctgcc

SEQ ID NO: 1380631 - DNA, 16 bp, Homo sapiens
cctggtggcctgcccc

SEQ ID NO: 1380632 - DNA, 19 bp, Homo sapiens
ccttcatctctaaggctaa

SEQ ID NO: 1380633 - DNA, 14 bp, Homo sapiens
ccttcctctgtcct

SEQ ID NO: 1380634 - DNA, 17 bp, Homo sapiens
cgccagccctgggcctg

SEQ ID NO: 1380635 - DNA, 22 bp, Homo sapiens
cgcctggcccaagccctccaca

SEQ ID NO: 1380636 - DNA, 19 bp, Homo sapiens
cgggagggtttggggacag

SEQ ID NO: 1380637 - DNA, 15 bp, Homo sapiens
cgtagagccctccac

SEQ ID NO: 1380638 - DNA, 15 bp, Homo sapiens
ctaaatttgtctttc

SEQ ID NO: 1380639 - DNA, 21 bp, Homo sapiens
ctaatggccttccataataat

SEQ ID NO: 1380640 - DNA, 16 bp, Homo sapiens
ctcaagggcagagaac

SEQ ID NO: 1380641 - DNA, 22 bp, Homo sapiens
ctcaagggcagagaactgtctt

SEQ ID NO: 1380642 - DNA, 21 bp, Homo sapiens
ctcatcccagtcctgatggcc

SEQ ID NO: 1380643 - DNA, 13 bp, Homo sapiens
ctccacattttca

SEQ ID NO: 1380644 - DNA, 23 bp, Homo sapiens
ctccacattttcaatccaggagc

SEQ ID NO: 1380645 - DNA, 17 bp, Homo sapiens
ctcccaccactccactc

SEQ ID NO: 1380646 - DNA, 15 bp, Homo sapiens
ctcctcaagggcaga

SEQ ID NO: 1380647 - DNA, 23 bp, Homo sapiens
ctcctgcctcagcctcctgaaca

SEQ ID NO: 1380648 - DNA, 21 bp, Homo sapiens
ctcggtgcagagtgcagaggc

SEQ ID NO: 1380649 - DNA, 18 bp, Homo sapiens
ctcggtgtacacagaggc

SEQ ID NO: 1380650 - DNA, 15 bp, Homo sapiens
ctctcttctggcttt

SEQ ID NO: 1380651 - DNA, 22 bp, Homo sapiens
ctctcttctggctttctgagca

SEQ ID NO: 1380652 - DNA, 15 bp, Homo sapiens
ctctggttcctccag

SEQ ID NO: 1380653 - DNA, 17 bp, Homo sapiens
ctctgtcacccagactg

SEQ ID NO: 1380654 - DNA, 22 bp, Homo sapiens
ctctgtgcaggagccagtcctg

SEQ ID NO: 1380655 - DNA, 14 bp, Homo sapiens
ctgcattccagagc

SEQ ID NO: 1380656 - DNA, 23 bp, Homo sapiens
ctgccccagctctcttctggctt

SEQ ID NO: 1380657 - DNA, 20 bp, Homo sapiens
ctgctctcctgacagccaca

SEQ ID NO: 1380658 - DNA, 22 bp, Homo sapiens
ctggacgggaagggacagctgc

SEQ ID NO: 1380659 - DNA, 19 bp, Homo sapiens
ctggtcttgaactcctggg

SEQ ID NO: 1380660 - DNA, 13 bp, Homo sapiens
ctggtgccctggt

SEQ ID NO: 1380661 - DNA, 14 bp, Homo sapiens
ctggtggcctgccc

SEQ ID NO: 1380662 - DNA, 17 bp, Homo sapiens
ctggtggcctgccccag

SEQ ID NO: 1380663 - DNA, 21 bp, Homo sapiens
ctggtggcctgccccagctct

SEQ ID NO: 1380664 - DNA, 17 bp, Homo sapiens
ctggttcctccagccac

SEQ ID NO: 1380665 - DNA, 17 bp, Homo sapiens
ctgtcacccagactgga

SEQ ID NO: 1380666 - DNA, 18 bp, Homo sapiens
ctgtgttgtgtcctgaca

SEQ ID NO: 1380667 - DNA, 21 bp, Homo sapiens
cttaactaaatttgtctttca

SEQ ID NO: 1380668 - DNA, 22 bp, Homo sapiens
cttagaattcccctctggaggg

SEQ ID NO: 1380669 - DNA, 17 bp, Homo sapiens
cttgctctgtcacccag

SEQ ID NO: 1380670 - DNA, 23 bp, Homo sapiens
gaacagctgggaccacaggtgca

SEQ ID NO: 1380671 - DNA, 15 bp, Homo sapiens
gaactcctcaagggc

SEQ ID NO: 1380672 - DNA, 17 bp, Homo sapiens
gaactcctcaagggcag

SEQ ID NO: 1380673 - DNA, 20 bp, Homo sapiens
gaactcctcaagggcagaga

SEQ ID NO: 1380674 - DNA, 14 bp, Homo sapiens
gaactcctgggctc

SEQ ID NO: 1380675 - DNA, 19 bp, Homo sapiens
gaaggactgaagaccagct

SEQ ID NO: 1380676 - DNA, 14 bp, Homo sapiens
gaagggacagctgc

SEQ ID NO: 1380677 - DNA, 20 bp, Homo sapiens
gacacacatgacgcaccagt

SEQ ID NO: 1380678 - DNA, 16 bp, Homo sapiens
gacatcagggagtaag

SEQ ID NO: 1380679 - DNA, 21 bp, Homo sapiens
gaccacaggtgcacgccacca

SEQ ID NO: 1380680 - DNA, 16 bp, Homo sapiens
gactgaagaccagctg

SEQ ID NO: 1380681 - DNA, 16 bp, Homo sapiens
gagccaccgcgcctgg

SEQ ID NO: 1380682 - DNA, 19 bp, Homo sapiens
gagccaccgcgcctggccc

SEQ ID NO: 1380683 - DNA, 21 bp, Homo sapiens
gagctttccagttagggctgt

SEQ ID NO: 1380684 - DNA, 20 bp, Homo sapiens
gatcttcccacgtgggcctc

SEQ ID NO: 1380685 - DNA, 22 bp, Homo sapiens
gatgtccccaatgctgtacctg

SEQ ID NO: 1380686 - DNA, 17 bp, Homo sapiens
gcaatcctcctgcctca

SEQ ID NO: 1380687 - DNA, 18 bp, Homo sapiens
gcacatccacccaggtcc

SEQ ID NO: 1380688 - DNA, 21 bp, Homo sapiens
gcacgccaccacacctggctt

SEQ ID NO: 1380689 - DNA, 15 bp, Homo sapiens
gcagaaagggaaagt

SEQ ID NO: 1380690 - DNA, 21 bp, Homo sapiens
gcagcctcattctgaggcctg

SEQ ID NO: 1380691 - DNA, 23 bp, Homo sapiens
gcagctcagccaccactcagtgc

SEQ ID NO: 1380692 - DNA, 15 bp, Homo sapiens
gcaggaggcagggct

SEQ ID NO: 1380693 - DNA, 15 bp, Homo sapiens
gccaccacacctggc

SEQ ID NO: 1380694 - DNA, 17 bp, Homo sapiens
gccagaatggctgtcct

SEQ ID NO: 1380695 - DNA, 22 bp, Homo sapiens
gccctccacattttcaatccag

SEQ ID NO: 1380696 - DNA, 18 bp, Homo sapiens
gccctggtggcctgcccc

SEQ ID NO: 1380697 - DNA, 23 bp, Homo sapiens
gcctcagcctcctgaacagctgg

SEQ ID NO: 1380698 - DNA, 15 bp, Homo sapiens
gcctgccccagctct

SEQ ID NO: 1380699 - DNA, 20 bp, Homo sapiens
gcctggcccaagccctccac

SEQ ID NO: 1380700 - DNA, 13 bp, Homo sapiens
gcgagcagaggct

SEQ ID NO: 1380701 - DNA, 18 bp, Homo sapiens
gcggctctggttcctcca

SEQ ID NO: 1380702 - DNA, 19 bp, Homo sapiens
gctcagccaccactcagtg

SEQ ID NO: 1380703 - DNA, 15 bp, Homo sapiens
gctcaggctggtctt

SEQ ID NO: 1380704 - DNA, 18 bp, Homo sapiens
gctctcaggctgagggag

SEQ ID NO: 1380705 - DNA, 19 bp, Homo sapiens
gctctcaggctgagggagg

SEQ ID NO: 1380706 - DNA, 18 bp, Homo sapiens
gctctcctgacagccaca

SEQ ID NO: 1380707 - DNA, 16 bp, Homo sapiens
gctgcattccagagca

SEQ ID NO: 1380708 - DNA, 12 bp, Homo sapiens
gctggggcctgg

SEQ ID NO: 1380709 - DNA, 21 bp, Homo sapiens
gctggtcttgaactcctgggc

SEQ ID NO: 1380710 - DNA, 14 bp, Homo sapiens
gctgtacctggctg

SEQ ID NO: 1380711 - DNA, 14 bp, Homo sapiens
gctttaacttcaga

SEQ ID NO: 1380712 - DNA, 21 bp, Homo sapiens
gctttagatgtgtatacagaa

SEQ ID NO: 1380713 - DNA, 13 bp, Homo sapiens
ggaagcgagcaga

SEQ ID NO: 1380714 - DNA, 17 bp, Homo sapiens
ggaagcgagcagaggct

SEQ ID NO: 1380715 - DNA, 19 bp, Homo sapiens
ggagggctatggcctccct

SEQ ID NO: 1380716 - DNA, 21 bp, Homo sapiens
ggcaatcaacaaacgtttctt

SEQ ID NO: 1380717 - DNA, 18 bp, Homo sapiens
ggcccaagccctccacat

SEQ ID NO: 1380718 - DNA, 18 bp, Homo sapiens
ggcctggggatgtcccca

SEQ ID NO: 1380719 - DNA, 22 bp, Homo sapiens
ggctctggttcctccagccacc

SEQ ID NO: 1380720 - DNA, 13 bp, Homo sapiens
ggctgagggaggc

SEQ ID NO: 1380721 - DNA, 19 bp, Homo sapiens
ggctgagggaggcagaaag

SEQ ID NO: 1380722 - DNA, 17 bp, Homo sapiens
ggctggtcttgaactcc

SEQ ID NO: 1380723 - DNA, 20 bp, Homo sapiens
ggctgttgatttatgcttta

SEQ ID NO: 1380724 - DNA, 13 bp, Homo sapiens
gggaaagggtgga

SEQ ID NO: 1380725 - DNA, 20 bp, Homo sapiens
ggggccagaatggctgtcct

SEQ ID NO: 1380726 - DNA, 23 bp, Homo sapiens
gggttcaagcaatcctcctgcct

SEQ ID NO: 1380727 - DNA, 23 bp, Homo sapiens
ggtcccaagacagtgagacagtc

SEQ ID NO: 1380728 - DNA, 22 bp, Homo sapiens
ggtgcacgccaccacacctggc

SEQ ID NO: 1380729 - DNA, 23 bp, Homo sapiens
ggtgcacgccaccacacctggct

SEQ ID NO: 1380730 - DNA, 24 bp, Homo sapiens
ggttcaagcaatcctcctgcctca

SEQ ID NO: 1380731 - DNA, 22 bp, Homo sapiens
ggttgtaaagcagtaccctacc

SEQ ID NO: 1380732 - DNA, 17 bp, Homo sapiens
ggttgtttttaaagaaa

SEQ ID NO: 1380733 - DNA, 20 bp, Homo sapiens
gtcacccagactggagtgca

SEQ ID NO: 1380734 - DNA, 22 bp, Homo sapiens
gtctgtgttgtgtcctgacacc

SEQ ID NO: 1380735 - DNA, 15 bp, Homo sapiens
gtcttgaactcctgg

SEQ ID NO: 1380736 - DNA, 13 bp, Homo sapiens
gtctttcaagtga

SEQ ID NO: 1380737 - DNA, 17 bp, Homo sapiens
gtgagacatcagggagt

SEQ ID NO: 1380738 - DNA, 20 bp, Homo sapiens
gtgagacatcagggagtaag

SEQ ID NO: 1380739 - DNA, 21 bp, Homo sapiens
gtgatcatagctcactgcacc

SEQ ID NO: 1380740 - DNA, 18 bp, Homo sapiens
gtgcagagtgcagaggcg

SEQ ID NO: 1380741 - DNA, 22 bp, Homo sapiens
gtggatgctctcaggctgaggg

SEQ ID NO: 1380742 - DNA, 19 bp, Homo sapiens
gtgtccttcctctgtcctc

SEQ ID NO: 1380743 - DNA, 13 bp, Homo sapiens
gtgtgagccaccg

SEQ ID NO: 1380744 - DNA, 20 bp, Homo sapiens
gttaatattttacttttaca

SEQ ID NO: 1380745 - DNA, 21 bp, Homo sapiens
gttcaagcaatcctcctgcct

SEQ ID NO: 1380746 - DNA, 18 bp, Homo sapiens
gttgtttttagagacagg

SEQ ID NO: 1380747 - DNA, 20 bp, Homo sapiens
gttttttctttaaagaagaa

SEQ ID NO: 1380748 - DNA, 15 bp, Homo sapiens
taaatttgtctttca

SEQ ID NO: 1380749 - DNA, 15 bp, Homo sapiens
taacttcagagtgag

SEQ ID NO: 1380750 - DNA, 21 bp, Homo sapiens
taatatgtgggaattagtgag

SEQ ID NO: 1380751 - DNA, 21 bp, Homo sapiens
tagatgtgtatacagaaaatg

SEQ ID NO: 1380752 - DNA, 19 bp, Homo sapiens
tagtgagacatcagggagt

SEQ ID NO: 1380753 - DNA, 21 bp, Homo sapiens
tatgctttcacttcccacctc

SEQ ID NO: 1380754 - DNA, 17 bp, Homo sapiens
tcaacctcctgggttca

SEQ ID NO: 1380755 - DNA, 19 bp, Homo sapiens
tcaagcaatcctcctgcct

SEQ ID NO: 1380756 - DNA, 14 bp, Homo sapiens
tcaagggcagagaa

SEQ ID NO: 1380757 - DNA, 23 bp, Homo sapiens
tcaagggcagagaactgtctttc

SEQ ID NO: 1380758 - DNA, 20 bp, Homo sapiens
tcagccaccactcagtgctt

SEQ ID NO: 1380759 - DNA, 19 bp, Homo sapiens
tcaggctgagggaggcaga

SEQ ID NO: 1380760 - DNA, 21 bp, Homo sapiens
tcaggctgagggaggcagaaa

SEQ ID NO: 1380761 - DNA, 21 bp, Homo sapiens
tcagtgcttctctgtgcagga

SEQ ID NO: 1380762 - DNA, 14 bp, Homo sapiens
tcatagctcactgc

SEQ ID NO: 1380763 - DNA, 15 bp, Homo sapiens
tcattctgaggcctg

SEQ ID NO: 1380764 - DNA, 15 bp, Homo sapiens
tccaagctaatttct

SEQ ID NO: 1380765 - DNA, 12 bp, Homo sapiens
tccacattttca

SEQ ID NO: 1380766 - DNA, 21 bp, Homo sapiens
tccagagcaggaggcagggct

SEQ ID NO: 1380767 - DNA, 13 bp, Homo sapiens
tcccatgcctggt

SEQ ID NO: 1380768 - DNA, 19 bp, Homo sapiens
tcccatgcctggtcccaag

SEQ ID NO: 1380769 - DNA, 19 bp, Homo sapiens
tcctcaagggcagagaact

SEQ ID NO: 1380770 - DNA, 13 bp, Homo sapiens
tcctgaacagctg

SEQ ID NO: 1380771 - DNA, 15 bp, Homo sapiens
tcctgaacagctggg

SEQ ID NO: 1380772 - DNA, 14 bp, Homo sapiens
tcctgacacctcca

SEQ ID NO: 1380773 - DNA, 16 bp, Homo sapiens
tcctgacagccacacg

SEQ ID NO: 1380774 - DNA, 21 bp, Homo sapiens
tccttgtcgtagagccctcca

SEQ ID NO: 1380775 - DNA, 16 bp, Homo sapiens
tcggtgcagagtgcag

SEQ ID NO: 1380776 - DNA, 23 bp, Homo sapiens
tcgtagagccctccacattttct

SEQ ID NO: 1380777 - DNA, 21 bp, Homo sapiens
tctcactatattgctcaggct

SEQ ID NO: 1380778 - DNA, 12 bp, Homo sapiens
tctcaggctgag

SEQ ID NO: 1380779 - DNA, 13 bp, Homo sapiens
tctcatcccagtc

SEQ ID NO: 1380780 - DNA, 16 bp, Homo sapiens
tctcatcccagtcctg

SEQ ID NO: 1380781 - DNA, 15 bp, Homo sapiens
tctctaaggctaagg

SEQ ID NO: 1380782 - DNA, 21 bp, Homo sapiens
tctggagggctatggcctccc

SEQ ID NO: 1380783 - DNA, 23 bp, Homo sapiens
tctggtgccctggtggcctgccc

SEQ ID NO: 1380784 - DNA, 13 bp, Homo sapiens
tctgtgcaggagc

SEQ ID NO: 1380785 - DNA, 20 bp, Homo sapiens
tcttaactaaatttgtcttt

SEQ ID NO: 1380786 - DNA, 22 bp, Homo sapiens
tcttaactaaatttgtctttca

SEQ ID NO: 1380787 - DNA, 21 bp, Homo sapiens
tcttcccacgtgggcctccca

SEQ ID NO: 1380788 - DNA, 15 bp, Homo sapiens
tctttaaagaagaat

SEQ ID NO: 1380789 - DNA, 16 bp, Homo sapiens
tcttttttgagacagg

SEQ ID NO: 1380790 - DNA, 14 bp, Homo sapiens
tgaactcctgggct

SEQ ID NO: 1380791 - DNA, 13 bp, Homo sapiens
tgaagaccagctg

SEQ ID NO: 1380792 - DNA, 21 bp, Homo sapiens
tgaagaccagctgtgtttctt

SEQ ID NO: 1380793 - DNA, 23 bp, Homo sapiens
tgacactttgaactcctcaaggg

SEQ ID NO: 1380794 - DNA, 13 bp, Homo sapiens
tgagacagggtct

SEQ ID NO: 1380795 - DNA, 22 bp, Homo sapiens
tgagcaggaagcgagcagaggc

SEQ ID NO: 1380796 - DNA, 17 bp, Homo sapiens
tgagctagaccaaggtc

SEQ ID NO: 1380797 - DNA, 20 bp, Homo sapiens
tgagctagaccaaggtcaga

SEQ ID NO: 1380798 - DNA, 22 bp, Homo sapiens
tgagctttccagttagggctgt

SEQ ID NO: 1380799 - DNA, 18 bp, Homo sapiens
tgagggaggcagaaaggg

SEQ ID NO: 1380800 - DNA, 23 bp, Homo sapiens
tgatcttcccacgtgggcctccc

SEQ ID NO: 1380801 - DNA, 14 bp, Homo sapiens
tgatttatgcttta

SEQ ID NO: 1380802 - DNA, 19 bp, Homo sapiens
tgcaccctcaacctcctgg

SEQ ID NO: 1380803 - DNA, 19 bp, Homo sapiens
tgcacgccaccacacctgg

SEQ ID NO: 1380804 - DNA, 21 bp, Homo sapiens
tgcacgccaccacacctggct

SEQ ID NO: 1380805 - DNA, 22 bp, Homo sapiens
tgcagaggcggctctggttcct

SEQ ID NO: 1380806 - DNA, 17 bp, Homo sapiens
tgcagagtgcagaggcg

SEQ ID NO: 1380807 - DNA, 13 bp, Homo sapiens
tgcattccagagc

SEQ ID NO: 1380808 - DNA, 16 bp, Homo sapiens
tgcattccagagcagg

SEQ ID NO: 1380809 - DNA, 17 bp, Homo sapiens
tgccctggtggcctgcc

SEQ ID NO: 1380810 - DNA, 18 bp, Homo sapiens
tgcctcagcctcctgaac

SEQ ID NO: 1380811 - DNA, 17 bp, Homo sapiens
tgcctcccatgcctggt

SEQ ID NO: 1380812 - DNA, 22 bp, Homo sapiens
tgctctcctgacagccacacgc

SEQ ID NO: 1380813 - DNA, 16 bp, Homo sapiens
tgctctgtcacccaga

SEQ ID NO: 1380814 - DNA, 19 bp, Homo sapiens
tgctttcacttcccacctc

SEQ ID NO: 1380815 - DNA, 15 bp, Homo sapiens
tggatgctctcaggc

SEQ ID NO: 1380816 - DNA, 15 bp, Homo sapiens
tggggacagagtgtc

SEQ ID NO: 1380817 - DNA, 20 bp, Homo sapiens
tggggctggggcctggaggc

SEQ ID NO: 1380818 - DNA, 18 bp, Homo sapiens
tggtcccaagacagtgag

SEQ ID NO: 1380819 - DNA, 17 bp, Homo sapiens
tggtcttgaactcctgg

SEQ ID NO: 1380820 - DNA, 22 bp, Homo sapiens
tggtgccctggtggcctgcccc

SEQ ID NO: 1380821 - DNA, 23 bp, Homo sapiens
tggtgccctggtggcctgcccca

SEQ ID NO: 1380822 - DNA, 23 bp, Homo sapiens
tgtccttgtcgtagagccctcca

SEQ ID NO: 1380823 - DNA, 14 bp, Homo sapiens
tgtgcaggagccag

SEQ ID NO: 1380824 - DNA, 17 bp, Homo sapiens
tgtgttgtgtcctgaca

SEQ ID NO: 1380825 - DNA, 21 bp, Homo sapiens
tgttaatattttacttttaca

SEQ ID NO: 1380826 - DNA, 18 bp, Homo sapiens
tgtttaataatgtaccta

SEQ ID NO: 1380827 - DNA, 14 bp, Homo sapiens
ttaaagaagaatgt

SEQ ID NO: 1380828 - DNA, 18 bp, Homo sapiens
ttagatgtgtatacagaa

SEQ ID NO: 1380829 - DNA, 20 bp, Homo sapiens
ttagtgagacatcagggagt

SEQ ID NO: 1380830 - DNA, 13 bp, Homo sapiens
ttccataataatt

SEQ ID NO: 1380831 - DNA, 19 bp, Homo sapiens
ttcccacgtgggcctccca

SEQ ID NO: 1380832 - DNA, 18 bp, Homo sapiens
ttcctacatcggaatcca

SEQ ID NO: 1380833 - DNA, 22 bp, Homo sapiens
ttcctccagccacctcagtccc

SEQ ID NO: 1380834 - DNA, 16 bp, Homo sapiens
ttcctctgtcctctca

SEQ ID NO: 1380835 - DNA, 16 bp, Homo sapiens
ttctaatggccttcca

SEQ ID NO: 1380836 - DNA, 20 bp, Homo sapiens
ttctctgtgcaggagccagt

SEQ ID NO: 1380837 - DNA, 18 bp, Homo sapiens
ttcttgagctagaccaag

SEQ ID NO: 1380838 - DNA, 18 bp, Homo sapiens
ttgagctagaccaaggtc

SEQ ID NO: 1380839 - DNA, 21 bp, Homo sapiens
ttgagtctgtgttgtgtcctg

SEQ ID NO: 1380840 - DNA, 23 bp, Homo sapiens
ttgctgggattgttttttcttta

SEQ ID NO: 1380841 - DNA, 20 bp, Homo sapiens
ttgttttttctttaaagaag

SEQ ID NO: 1380842 - DNA, 14 bp, Homo sapiens
tttacttttacagt

SEQ ID NO: 1380843 - DNA, 19 bp, Homo sapiens
tttctaatggccttccata

SEQ ID NO: 1380844 - DNA, 16 bp, Homo sapiens
tttgaaaagaacagaa

SEQ ID NO: 1380845 - DNA, 16 bp, Homo sapiens
ttttagagacagggtc

SEQ ID NO: 1380846 - DNA, 17 bp, Homo sapiens
ttttgttgtttttagag

SEQ ID NO: 1380847 - DNA, 23 bp, Homo sapiens
tttttgaaccctcggtgtacaca

SEQ ID NO: 1380848 - DNA, 16 bp, Homo sapiens
tttttgagacagggtc

SEQ ID NO: 1380849 - DNA, 20 bp, Homo sapiens
tgagctttccagttagggct

SEQ ID NO: 1380850 - DNA, 17 bp, Homo sapiens
tgcaagaatctcagaca

SEQ ID NO: 1380851 - DNA, 20 bp, Homo sapiens
tgcaccctcaacctcctggg

SEQ ID NO: 1380852 - DNA, 23 bp, Homo sapiens
tgcaccctcaacctcctgggttc

SEQ ID NO: 1380853 - DNA, 19 bp, Homo sapiens
tgccctggtggcctgcccc

SEQ ID NO: 1380854 - DNA, 16 bp, Homo sapiens
tgcctcccatgcctgg

SEQ ID NO: 1380855 - DNA, 20 bp, Homo sapiens
tgctcaggctggtcttgaac

SEQ ID NO: 1380856 - DNA, 13 bp, Homo sapiens
tgctctcaggctg

SEQ ID NO: 1380857 - DNA, 21 bp, Homo sapiens
tgctttagatgtgtatacaga

SEQ ID NO: 1380858 - DNA, 23 bp, Homo sapiens
tggatgctctcaggctgagggag

SEQ ID NO: 1380859 - DNA, 18 bp, Homo sapiens
tggcccaagccctccaca

SEQ ID NO: 1380860 - DNA, 23 bp, Homo sapiens
tggccgcttggtgagtgtctggt

SEQ ID NO: 1380861 - DNA, 22 bp, Homo sapiens
tgggctcaagtgatcttcccac

SEQ ID NO: 1380862 - DNA, 22 bp, Homo sapiens
tggggccagaatggctgtcctt

SEQ ID NO: 1380863 - DNA, 19 bp, Homo sapiens
tggttcctccagccacctc

SEQ ID NO: 1380864 - DNA, 16 bp, Homo sapiens
tgtacctattccttca

SEQ ID NO: 1380865 - DNA, 23 bp, Homo sapiens
tgtccccaatgctgtacctggct

SEQ ID NO: 1380866 - DNA, 15 bp, Homo sapiens
tgtgcaggagccagt

SEQ ID NO: 1380867 - DNA, 20 bp, Homo sapiens
tgtgcctatgagcacaaact

SEQ ID NO: 1380868 - DNA, 19 bp, Homo sapiens
tgtgggaattagtgagaca

SEQ ID NO: 1380869 - DNA, 23 bp, Homo sapiens
tgttaatattttacttttacagt

SEQ ID NO: 1380870 - DNA, 15 bp, Homo sapiens
ttagagacagggtct

SEQ ID NO: 1380871 - DNA, 22 bp, Homo sapiens
ttatgctttaacttcagagtga

SEQ ID NO: 1380872 - DNA, 20 bp, Homo sapiens
ttcaagcaatcctcctgcct

SEQ ID NO: 1380873 - DNA, 15 bp, Homo sapiens
ttcccctctggaggg

SEQ ID NO: 1380874 - DNA, 16 bp, Homo sapiens
ttctctgtgcaggagc

SEQ ID NO: 1380875 - DNA, 22 bp, Homo sapiens
ttcttaactaaatttgtctttc

SEQ ID NO: 1380876 - DNA, 16 bp, Homo sapiens
ttgctcaggctggtct

SEQ ID NO: 1380877 - DNA, 22 bp, Homo sapiens
tttagatgtgtatacagaaaat

SEQ ID NO: 1380878 - DNA, 21 bp, Homo sapiens
caagctaatttctaatggcct

SEQ ID NO: 1380879 - DNA, 15 bp, Homo sapiens
caagggcagagaact

SEQ ID NO: 1380880 - DNA, 22 bp, Homo sapiens
caagggcagagaactgtctttc

SEQ ID NO: 1380881 - DNA, 22 bp, Homo sapiens
caataaagcagcctcattctga

SEQ ID NO: 1380882 - DNA, 23 bp, Homo sapiens
caataaagcagcctcattctgag

SEQ ID NO: 1380883 - DNA, 15 bp, Homo sapiens
caatcccagcaggag

SEQ ID NO: 1380884 - DNA, 20 bp, Homo sapiens
caatgcaagaatctcagaca

SEQ ID NO: 1380885 - DNA, 21 bp, Homo sapiens
aaagcagcctcattctgaggc

SEQ ID NO: 1380886 - DNA, 11 bp, Homo sapiens
aactgtctttc

SEQ ID NO: 1380887 - DNA, 13 bp, Homo sapiens
aactgtctttcat

SEQ ID NO: 1380888 - DNA, 17 bp, Homo sapiens
aagaagattcccacccc

SEQ ID NO: 1380889 - DNA, 18 bp, Homo sapiens
aagcagcctcattctgag

SEQ ID NO: 1380890 - DNA, 14 bp, Homo sapiens
aagccctccacatt

SEQ ID NO: 1380891 - DNA, 21 bp, Homo sapiens
aagctaatttctaatggcctt

SEQ ID NO: 1380892 - DNA, 14 bp, Homo sapiens
aagggcagagaact

SEQ ID NO: 1380893 - DNA, 20 bp, Homo sapiens
aagggcagagaactgtcttt

SEQ ID NO: 1380894 - DNA, 23 bp, Homo sapiens
aagtgtgagccaccgcgcctggc

SEQ ID NO: 1380895 - DNA, 17 bp, Homo sapiens
aatattttacttttaca

SEQ ID NO: 1380896 - DNA, 18 bp, Homo sapiens
aatccaagctaatttcta

SEQ ID NO: 1380897 - DNA, 13 bp, Homo sapiens
aatgaaagaaact

SEQ ID NO: 1380898 - DNA, 15 bp, Homo sapiens
aatgctgtacctggc

SEQ ID NO: 1380899 - DNA, 16 bp, Homo sapiens
aatgtcaagtggcagc

SEQ ID NO: 1380900 - DNA, 17 bp, Homo sapiens
acagcacatccacccag

SEQ ID NO: 1380901 - DNA, 22 bp, Homo sapiens
acagtgagacagtctggaaagt

SEQ ID NO: 1380902 - DNA, 20 bp, Homo sapiens
acatccacccaggtcccgag

SEQ ID NO: 1380903 - DNA, 19 bp, Homo sapiens
acccagactggagtgcagt

SEQ ID NO: 1380904 - DNA, 15 bp, Homo sapiens
acccaggtcccgagc

SEQ ID NO: 1380905 - DNA, 15 bp, Homo sapiens
acccctgcctcccat

SEQ ID NO: 1380906 - DNA, 21 bp, Homo sapiens
acccctgcctcccatgcctgg

SEQ ID NO: 1380907 - DNA, 21 bp, Homo sapiens
accctcggtgtacacagaggc

SEQ ID NO: 1380908 - DNA, 13 bp, Homo sapiens
acttctgtggcaa

SEQ ID NO: 1380909 - DNA, 17 bp, Homo sapiens
agaagattcccacccct

SEQ ID NO: 1380910 - DNA, 18 bp, Homo sapiens
agaatctcagacacacat

SEQ ID NO: 1380911 - DNA, 16 bp, Homo sapiens
tgaactcctcaagggc

SEQ ID NO: 1380912 - DNA, 18 bp, Homo sapiens
tgaactcctcaagggcag

SEQ ID NO: 1380913 - DNA, 24 bp, Homo sapiens
tgacactttgaactcctcaagggc

SEQ ID NO: 1380914 - DNA, 14 bp, Homo sapiens
tgagacatcaggga

SEQ ID NO: 1380915 - DNA, 20 bp, Homo sapiens
tgagccaccgcgcctggccc

SEQ ID NO: 1380916 - DNA, 21 bp, Homo sapiens
tgagccaccgcgcctggccca

SEQ ID NO: 1380917 - DNA, 13 bp, Homo sapiens
tgagggaggcaga

SEQ ID NO: 1380918 - DNA, 20 bp, Homo sapiens
tgatcatagctcactgcacc

SEQ ID NO: 1380919 - DNA, 13 bp, Homo sapiens
tgatttatgcttt

SEQ ID NO: 1380920 - DNA, 16 bp, Homo sapiens
tgcacgccaccacacc

SEQ ID NO: 1380921 - DNA, 14 bp, Homo sapiens
tgcagaggcggctc

SEQ ID NO: 1380922 - DNA, 20 bp, Homo sapiens
tgccccagctctcttctggc

SEQ ID NO: 1380923 - DNA, 16 bp, Homo sapiens
tgccctggtggcctgc

SEQ ID NO: 1380924 - DNA, 13 bp, Homo sapiens
tgcctcccatgcc

SEQ ID NO: 1380925 - DNA, 20 bp, Homo sapiens
tgcctcccatgcctggtccc

SEQ ID NO: 1380926 - DNA, 14 bp, Homo sapiens
tgcctggtcccaag

SEQ ID NO: 1380927 - DNA, 15 bp, Homo sapiens
tgctcaggctggtct

SEQ ID NO: 1380928 - DNA, 14 bp, Homo sapiens
tgctctcctgacag

SEQ ID NO: 1380929 - DNA, 20 bp, Homo sapiens
tggagggctatggcctccct

SEQ ID NO: 1380930 - DNA, 14 bp, Homo sapiens
tggagtgcagtggt

SEQ ID NO: 1380931 - DNA, 18 bp, Homo sapiens
tggatgctctcaggctga

SEQ ID NO: 1380932 - DNA, 23 bp, Homo sapiens
tggcccaagccctccacattttc

SEQ ID NO: 1380933 - DNA, 18 bp, Homo sapiens
tggcctgccccagctctc

SEQ ID NO: 1380934 - DNA, 23 bp, Homo sapiens
tgggttcaagcaatcctcctgcc

SEQ ID NO: 1380935 - DNA, 16 bp, Homo sapiens
tggtcttgaactcctg

SEQ ID NO: 1380936 - DNA, 18 bp, Homo sapiens
tggtcttgaactcctggg

SEQ ID NO: 1380937 - DNA, 22 bp, Homo sapiens
tggtcttgaactcctgggctca

SEQ ID NO: 1380938 - DNA, 18 bp, Homo sapiens
tggttcctccagccacct

SEQ ID NO: 1380939 - DNA, 12 bp, Homo sapiens
tgtacctggctg

SEQ ID NO: 1380940 - DNA, 17 bp, Homo sapiens
tgtcaagtggcagctca

SEQ ID NO: 1380941 - DNA, 21 bp, Homo sapiens
tgtcaagtggcagctcagcca

SEQ ID NO: 1380942 - DNA, 22 bp, Homo sapiens
tgtcacccagactggagtgcag

SEQ ID NO: 1380943 - DNA, 20 bp, Homo sapiens
tgtccccaatgctgtacctg

SEQ ID NO: 1380944 - DNA, 17 bp, Homo sapiens
tgttgatttatgcttta

SEQ ID NO: 1380945 - DNA, 23 bp, Homo sapiens
tgttgtttttagagacagggtct

SEQ ID NO: 1380946 - DNA, 14 bp, Homo sapiens
tgttttttctttaa

SEQ ID NO: 1380947 - DNA, 16 bp, Homo sapiens
ttacgctgctctcctg

SEQ ID NO: 1380948 - DNA, 18 bp, Homo sapiens
ttagcatgagctttccag

SEQ ID NO: 1380949 - DNA, 16 bp, Homo sapiens
ttcaagcaatcctcct

SEQ ID NO: 1380950 - DNA, 17 bp, Homo sapiens
ttcaagtgaaaccagct

SEQ ID NO: 1380951 - DNA, 14 bp, Homo sapiens
ttcctccagccacc

SEQ ID NO: 1380952 - DNA, 17 bp, Homo sapiens
ttcctctgtcctctcat

SEQ ID NO: 1380953 - DNA, 18 bp, Homo sapiens
ttctctgtgcaggagcca

SEQ ID NO: 1380954 - DNA, 15 bp, Homo sapiens
ttctttaaagaagaa

SEQ ID NO: 1380955 - DNA, 17 bp, Homo sapiens
ttgaaaagaacagaagg

SEQ ID NO: 1380956 - DNA, 14 bp, Homo sapiens
ttgagacagggtct

SEQ ID NO: 1380957 - DNA, 23 bp, Homo sapiens
ttgagtctgtgttgtgtcctgac

SEQ ID NO: 1380958 - DNA, 15 bp, Homo sapiens
ttgatttatgcttta

SEQ ID NO: 1380959 - DNA, 23 bp, Homo sapiens
tttaataatgtacctattccttc

SEQ ID NO: 1380960 - DNA, 18 bp, Homo sapiens
tttagatgtgtatacaga

SEQ ID NO: 1380961 - DNA, 14 bp, Homo sapiens
tttcaatccaggag

SEQ ID NO: 1380962 - DNA, 23 bp, Homo sapiens
tttcttgagctagaccaaggtca

SEQ ID NO: 1380963 - DNA, 15 bp, Homo sapiens
tttgagacagggtct

SEQ ID NO: 1380964 - DNA, 12 bp, Homo sapiens
tttgtctttcaa

SEQ ID NO: 1380965 - DNA, 15 bp, Homo sapiens
ttttacttttacagt

SEQ ID NO: 1380966 - DNA, 21 bp, Homo sapiens
gaactcctcaagggcagagaa

SEQ ID NO: 1380967 - DNA, 15 bp, Homo sapiens
gaactcctgggctca

SEQ ID NO: 1380968 - DNA, 18 bp, Homo sapiens
gaagcgagcagaggctcc

SEQ ID NO: 1380969 - DNA, 13 bp, Homo sapiens
gaatccaagctaa

SEQ ID NO: 1380970 - DNA, 23 bp, Homo sapiens
gacactttgaactcctcaagggc

SEQ ID NO: 1380971 - DNA, 13 bp, Homo sapiens
gacagtctggaaa

SEQ ID NO: 1380972 - DNA, 19 bp, Homo sapiens
gacagtgagacagtctgga

SEQ ID NO: 1380973 - DNA, 12 bp, Homo sapiens
gagacagggtct

SEQ ID NO: 1380974 - DNA, 19 bp, Homo sapiens
gagctagaccaaggtcaga

SEQ ID NO: 1380975 - DNA, 17 bp, Homo sapiens
gaggcgggtctataaca

SEQ ID NO: 1380976 - DNA, 23 bp, Homo sapiens
gagggaggcagaaagggaaagta

SEQ ID NO: 1380977 - DNA, 20 bp, Homo sapiens
gagtctgtgttgtgtcctga

SEQ ID NO: 1380978 - DNA, 20 bp, Homo sapiens
gagtgtccttcctctgtcct

SEQ ID NO: 1380979 - DNA, 12 bp, Homo sapiens
gatagggaaagg

SEQ ID NO: 1380980 - DNA, 17 bp, Homo sapiens
gatcatagctcactgca

SEQ ID NO: 1380981 - DNA, 19 bp, Homo sapiens
gatcatagctcactgcacc

SEQ ID NO: 1380982 - DNA, 14 bp, Homo sapiens
gatgctctcaggct

SEQ ID NO: 1380983 - DNA, 17 bp, Homo sapiens
gcacgccaccacacctg

SEQ ID NO: 1380984 - DNA, 19 bp, Homo sapiens
gcagaggcggctctggttc

SEQ ID NO: 1380985 - DNA, 16 bp, Homo sapiens
gcagagtgcagaggcg

SEQ ID NO: 1380986 - DNA, 20 bp, Homo sapiens
gcaggaagcgagcagaggct

SEQ ID NO: 1380987 - DNA, 21 bp, Homo sapiens
gcatgagctttccagttaggg

SEQ ID NO: 1380988 - DNA, 12 bp, Homo sapiens
gcattccagagc

SEQ ID NO: 1380989 - DNA, 16 bp, Homo sapiens
gccaccacacctggct

SEQ ID NO: 1380990 - DNA, 17 bp, Homo sapiens
gccaccacacctggctt

SEQ ID NO: 1380991 - DNA, 16 bp, Homo sapiens
gcccaagccctccaca

SEQ ID NO: 1380992 - DNA, 21 bp, Homo sapiens
gccccagctctcttctggctt

SEQ ID NO: 1380993 - DNA, 11 bp, Homo sapiens
agacagggtct

SEQ ID NO: 1380994 - DNA, 20 bp, Homo sapiens
agacagtgagacagtctgga

SEQ ID NO: 1380995 - DNA, 15 bp, Homo sapiens
agagaactgtctttc

SEQ ID NO: 1380996 - DNA, 13 bp, Homo sapiens
agagacagggtct

SEQ ID NO: 1380997 - DNA, 21 bp, Homo sapiens
agagcaggaggcagggctctg

SEQ ID NO: 1380998 - DNA, 13 bp, Homo sapiens
agagccctccaca

SEQ ID NO: 1380999 - DNA, 21 bp, Homo sapiens
agaggcgggtctataacaggc

SEQ ID NO: 1381000 - DNA, 22 bp, Homo sapiens
agatttgaaaagaacagaagga

SEQ ID NO: 1381001 - DNA, 16 bp, Homo sapiens
agcacatccacccagg

SEQ ID NO: 1381002 - DNA, 20 bp, Homo sapiens
agcaggaggcagggctctgg

SEQ ID NO: 1381003 - DNA, 14 bp, Homo sapiens
agcaggagggattg

SEQ ID NO: 1381004 - DNA, 18 bp, Homo sapiens
agcatgagctttccagtt

SEQ ID NO: 1381005 - DNA, 12 bp, Homo sapiens
agccaccaccca

SEQ ID NO: 1381006 - DNA, 15 bp, Homo sapiens
agccaccactcagtg

SEQ ID NO: 1381007 - DNA, 19 bp, Homo sapiens
agccctcacaccctggacg

SEQ ID NO: 1381008 - DNA, 14 bp, Homo sapiens
agccctgggcctgg

SEQ ID NO: 1381009 - DNA, 19 bp, Homo sapiens
agcctcattctgaggcctg

SEQ ID NO: 1381010 - DNA, 20 bp, Homo sapiens
agcctcattctgaggcctga

SEQ ID NO: 1381011 - DNA, 16 bp, Homo sapiens
aggcttacgctgctct

SEQ ID NO: 1381012 - DNA, 20 bp, Homo sapiens
aggcttacgctgctctcctg

SEQ ID NO: 1381013 - DNA, 17 bp, Homo sapiens
agggtccatatgaggga

SEQ ID NO: 1381014 - DNA, 16 bp, Homo sapiens
agggtggatgctctca

SEQ ID NO: 1381015 - DNA, 21 bp, Homo sapiens
aggtgcacgccaccacacctg

SEQ ID NO: 1381016 - DNA, 18 bp, Homo sapiens
agtaagtgacactttgaa

SEQ ID NO: 1381017 - DNA, 14 bp, Homo sapiens
agtgagacatcagg

SEQ ID NO: 1381018 - DNA, 12 bp, Homo sapiens
agttagggctgt

SEQ ID NO: 1381019 - DNA, 21 bp, Homo sapiens
ataatgtacctattccttcag

SEQ ID NO: 1381020 - DNA, 18 bp, Homo sapiens
atgacgcaccagttacag

SEQ ID NO: 1381021 - DNA, 22 bp, Homo sapiens
atgagctttccagttagggctg

SEQ ID NO: 1381022 - DNA, 16 bp, Homo sapiens
atgctgtacctggctg

SEQ ID NO: 1381023 - DNA, 20 bp, Homo sapiens
atgctttaacttcagagtga

SEQ ID NO: 1381024 - DNA, 14 bp, Homo sapiens
atgtacctattcct

SEQ ID NO: 1381025 - DNA, 15 bp, Homo sapiens
atgtgtatacagaaa

SEQ ID NO: 1381026 - DNA, 18 bp, Homo sapiens
attaatatgtgggaatta

SEQ ID NO: 1381027 - DNA, 15 bp, Homo sapiens
attgctcaggctggt

SEQ ID NO: 1381028 - DNA, 14 bp, Homo sapiens
attgtttttcaaag

SEQ ID NO: 1381029 - DNA, 18 bp, Homo sapiens
attgttttttctttaaag

SEQ ID NO: 1381030 - DNA, 13 bp, Homo sapiens
caagccctccaca

SEQ ID NO: 1381031 - DNA, 23 bp, Homo sapiens
caagtgtgagccaccgcgcctgg

SEQ ID NO: 1381032 - DNA, 16 bp, Homo sapiens
caatccaggagccttg

SEQ ID NO: 1381033 - DNA, 19 bp, Homo sapiens
cacaggcttacgctgctct

SEQ ID NO: 1381034 - DNA, 14 bp, Homo sapiens
caccactccactcc

SEQ ID NO: 1381035 - DNA, 19 bp, Homo sapiens
caccgatattagtcctaca

SEQ ID NO: 1381036 - DNA, 23 bp, Homo sapiens
caccgatattagtcctacaccaa

SEQ ID NO: 1381037 - DNA, 16 bp, Homo sapiens
caccttcaactgtctg

SEQ ID NO: 1381038 - DNA, 19 bp, Homo sapiens
cactgcaccctcaacctcc

SEQ ID NO: 1381039 - DNA, 20 bp, Homo sapiens
cactttgaactcctcaaggg

SEQ ID NO: 1381040 - DNA, 15 bp, Homo sapiens
cagacacacatgacg

SEQ ID NO: 1381041 - DNA, 16 bp, Homo sapiens
cagagaactgtctttc

SEQ ID NO: 1381042 - DNA, 13 bp, Homo sapiens
cagccctgggcct

SEQ ID NO: 1381043 - DNA, 21 bp, Homo sapiens
cagcctcattctgaggcctga

SEQ ID NO: 1381044 - DNA, 22 bp, Homo sapiens
cagctcagccaccactcagtgc

SEQ ID NO: 1381045 - DNA, 23 bp, Homo sapiens
cagctcagccaccactcagtgct

SEQ ID NO: 1381046 - DNA, 17 bp, Homo sapiens
caggcaatcaacaaacg

SEQ ID NO: 1381047 - DNA, 18 bp, Homo sapiens
caggctgagggaggcaga

SEQ ID NO: 1381048 - DNA, 11 bp, Homo sapiens
cagggctctgg

SEQ ID NO: 1381049 - DNA, 14 bp, Homo sapiens
cagggtcttgctct

SEQ ID NO: 1381050 - DNA, 22 bp, Homo sapiens
caggtgcacgccaccacacctg

SEQ ID NO: 1381051 - DNA, 23 bp, Homo sapiens
caggtgcacgccaccacacctgg

SEQ ID NO: 1381052 - DNA, 15 bp, Homo sapiens
cagttacaggggttg

SEQ ID NO: 1381053 - DNA, 22 bp, Homo sapiens
catcccagtcctgatggccgct

SEQ ID NO: 1381054 - DNA, 20 bp, Homo sapiens
catcgccagccctgggcctg

SEQ ID NO: 1381055 - DNA, 21 bp, Homo sapiens
cattgtttttcaaaggcctca

SEQ ID NO: 1381056 - DNA, 20 bp, Homo sapiens
catttttgaaccctcggtgt

SEQ ID NO: 1381057 - DNA, 16 bp, Homo sapiens
ccaatgtcaagtggca

SEQ ID NO: 1381058 - DNA, 13 bp, Homo sapiens
ccacacctggctt

SEQ ID NO: 1381059 - DNA, 17 bp, Homo sapiens
ccacattttcaatccag

SEQ ID NO: 1381060 - DNA, 15 bp, Homo sapiens
ccaccacacctggct

SEQ ID NO: 1381061 - DNA, 19 bp, Homo sapiens
ccacctcagtccctctttg

SEQ ID NO: 1381062 - DNA, 12 bp, Homo sapiens
ccagcaggaggg

SEQ ID NO: 1381063 - DNA, 13 bp, Homo sapiens
ccaggtcccgagc

SEQ ID NO: 1381064 - DNA, 18 bp, Homo sapiens
ccagtcctgatggccgct

SEQ ID NO: 1381065 - DNA, 19 bp, Homo sapiens
ccataataattctgcttta

SEQ ID NO: 1381066 - DNA, 23 bp, Homo sapiens
ccattgtttttcaaaggcctcac

SEQ ID NO: 1381067 - DNA, 23 bp, Homo sapiens
cccagatacagcacatccaccca

SEQ ID NO: 1381068 - DNA, 12 bp, Homo sapiens
cccagcaggagg

SEQ ID NO: 1381069 - DNA, 19 bp, Homo sapiens
cccagctctcttctggctt

SEQ ID NO: 1381070 - DNA, 14 bp, Homo sapiens
cccaggtcccgagc

SEQ ID NO: 1381071 - DNA, 23 bp, Homo sapiens
cccatgcctggtcccaagacagt

SEQ ID NO: 1381072 - DNA, 20 bp, Homo sapiens
ccccaatgctgtacctggct

SEQ ID NO: 1381073 - DNA, 19 bp, Homo sapiens
ccccagctctcttctggct

SEQ ID NO: 1381074 - DNA, 23 bp, Homo sapiens
ccgcctcccaccactccactcct

SEQ ID NO: 1381075 - DNA, 22 bp, Homo sapiens
cctatgctttcacttcccacct

SEQ ID NO: 1381076 - DNA, 18 bp, Homo sapiens
cctcaacctcctgggttc

SEQ ID NO: 1381077 - DNA, 18 bp, Homo sapiens
cctcacaccctggacggg

SEQ ID NO: 1381078 - DNA, 17 bp, Homo sapiens
cctcattctgaggcctg

SEQ ID NO: 1381079 - DNA, 22 bp, Homo sapiens
cctctggagggctatggcctcc

SEQ ID NO: 1381080 - DNA, 14 bp, Homo sapiens
cctgacagccacac

SEQ ID NO: 1381081 - DNA, 16 bp, Homo sapiens
cctgccccagctctct

SEQ ID NO: 1381082 - DNA, 20 bp, Homo sapiens
cctgcctcagcctcctgaac

SEQ ID NO: 1381083 - DNA, 23 bp, Homo sapiens
cctggacgggaagggacagctgc

SEQ ID NO: 1381084 - DNA, 13 bp, Homo sapiens
cctggctgacccc

SEQ ID NO: 1381085 - DNA, 13 bp, Homo sapiens
cctggtggcctgc

SEQ ID NO: 1381086 - DNA, 19 bp, Homo sapiens
cctggtggcctgccccagc

SEQ ID NO: 1381087 - DNA, 23 bp, Homo sapiens
ccttgtcgtagagccctccacat

SEQ ID NO: 1381088 - DNA, 15 bp, Homo sapiens
cgctgctctcctgac

SEQ ID NO: 1381089 - DNA, 14 bp, Homo sapiens
cggaatccaagcta

SEQ ID NO: 1381090 - DNA, 20 bp, Homo sapiens
cggaatccaagctaatttct

SEQ ID NO: 1381091 - DNA, 21 bp, Homo sapiens
cggaatccaagctaatttcta

SEQ ID NO: 1381092 - DNA, 20 bp, Homo sapiens
cggctctggttcctccagcc

SEQ ID NO: 1381093 - DNA, 20 bp, Homo sapiens
cgggagggtttggggacaga

SEQ ID NO: 1381094 - DNA, 19 bp, Homo sapiens
cggtgcagagtgcagaggc

SEQ ID NO: 1381095 - DNA, 14 bp, Homo sapiens
ctaaatttgtcttt

SEQ ID NO: 1381096 - DNA, 17 bp, Homo sapiens
ctaaggatagggaaagg

SEQ ID NO: 1381097 - DNA, 23 bp, Homo sapiens
ctcaagggcagagaactgtcttt

SEQ ID NO: 1381098 - DNA, 15 bp, Homo sapiens
ctcacaccctggacg

SEQ ID NO: 1381099 - DNA, 15 bp, Homo sapiens
ctcatcccagtcctg

SEQ ID NO: 1381100 - DNA, 15 bp, Homo sapiens
ctcccaaaacgctgg

SEQ ID NO: 1381101 - DNA, 21 bp, Homo sapiens
ctcccatgcctggtcccaaga

SEQ ID NO: 1381102 - DNA, 16 bp, Homo sapiens
ctcctcaagggcagag

SEQ ID NO: 1381103 - DNA, 15 bp, Homo sapiens
ctcctgacagccaca

SEQ ID NO: 1381104 - DNA, 14 bp, Homo sapiens
ctctcctgacagcc

SEQ ID NO: 1381105 - DNA, 20 bp, Homo sapiens
ctctggagggctatggcctc

SEQ ID NO: 1381106 - DNA, 23 bp, Homo sapiens
ctctggagggctatggcctccct

SEQ ID NO: 1381107 - DNA, 14 bp, Homo sapiens
ctctgtgcaggagc

SEQ ID NO: 1381108 - DNA, 13 bp, Homo sapiens
ctgaacagctggg

SEQ ID NO: 1381109 - DNA, 14 bp, Homo sapiens
ctgacacctccaag

SEQ ID NO: 1381110 - DNA, 15 bp, Homo sapiens
ctgacacctccaagt

SEQ ID NO: 1381111 - DNA, 22 bp, Homo sapiens
ctgagggaggcagaaagggaaa

SEQ ID NO: 1381112 - DNA, 19 bp, Homo sapiens
ctgcaccctcaacctcctg

SEQ ID NO: 1381113 - DNA, 20 bp, Homo sapiens
ctgcaccctcaacctcctgg

SEQ ID NO: 1381114 - DNA, 20 bp, Homo sapiens
ctggagggctatggcctccc

SEQ ID NO: 1381115 - DNA, 14 bp, Homo sapiens
ctggctgaccccgg

SEQ ID NO: 1381116 - DNA, 18 bp, Homo sapiens
ctggtcttgaactcctgg

SEQ ID NO: 1381117 - DNA, 19 bp, Homo sapiens
ctggtgccctggtggcctg

SEQ ID NO: 1381118 - DNA, 19 bp, Homo sapiens
aaaatcccatttatgcaat

SEQ ID NO: 1381119 - DNA, 11 bp, Homo sapiens
aaacagggcct

SEQ ID NO: 1381120 - DNA, 23 bp, Homo sapiens
aaagagtagaactttaaaagaag

SEQ ID NO: 1381121 - DNA, 15 bp, Homo sapiens
aaagcacctcttgaa

SEQ ID NO: 1381122 - DNA, 17 bp, Homo sapiens
aaataaaaccagaaaga

SEQ ID NO: 1381123 - DNA, 13 bp, Homo sapiens
aaataaccctgaa

SEQ ID NO: 1381124 - DNA, 18 bp, Homo sapiens
aaataaccctgaatcaga

SEQ ID NO: 1381125 - DNA, 19 bp, Homo sapiens
aaataaccctgaatcagag

SEQ ID NO: 1381126 - DNA, 18 bp, Homo sapiens
aaataatcatacacagaa

SEQ ID NO: 1381127 - DNA, 21 bp, Homo sapiens
aaatctcaaaagatctcctgt

SEQ ID NO: 1381128 - DNA, 21 bp, Homo sapiens
aaatggaaaggagaggaaaga

SEQ ID NO: 1381129 - DNA, 19 bp, Homo sapiens
aaatgtgaatgggaaaaga

SEQ ID NO: 1381130 - DNA, 17 bp, Homo sapiens
aacataaataaaatgac

SEQ ID NO: 1381131 - DNA, 16 bp, Homo sapiens
aaccaatttgttctgt

SEQ ID NO: 1381132 - DNA, 13 bp, Homo sapiens
aaccagaaagagg

SEQ ID NO: 1381133 - DNA, 19 bp, Homo sapiens
aacccctgacaccttttca

SEQ ID NO: 1381134 - DNA, 13 bp, Homo sapiens
aactgaagcagag

SEQ ID NO: 1381135 - DNA, 16 bp, Homo sapiens
aagaaagatgctgatg

SEQ ID NO: 1381136 - DNA, 22 bp, Homo sapiens
aagactcccatgagggagatgc

SEQ ID NO: 1381137 - DNA, 21 bp, Homo sapiens
aagaggaaaatgaataataca

SEQ ID NO: 1381138 - DNA, 22 bp, Homo sapiens
aagatgctgctgagcacatctc

SEQ ID NO: 1381139 - DNA, 18 bp, Homo sapiens
aagcacctcttgaagaac

SEQ ID NO: 1381140 - DNA, 21 bp, Homo sapiens
aagcacctcttgaagaactga

SEQ ID NO: 1381141 - DNA, 23 bp, Homo sapiens
aagcagaccattggggctcccag

SEQ ID NO: 1381142 - DNA, 22 bp, Homo sapiens
aagcagagtcaagctgatgaag

SEQ ID NO: 1381143 - DNA, 21 bp, Homo sapiens
aagccctccctgtctgtctgt

SEQ ID NO: 1381144 - DNA, 13 bp, Homo sapiens
aaggagggagaaa

SEQ ID NO: 1381145 - DNA, 18 bp, Homo sapiens
aagggactccagaagcag

SEQ ID NO: 1381146 - DNA, 20 bp, Homo sapiens
aataatacattgaattagaa

SEQ ID NO: 1381147 - DNA, 20 bp, Homo sapiens
aatatttttcaattttgaaa

SEQ ID NO: 1381148 - DNA, 14 bp, Homo sapiens
aatgcttaaatgat

SEQ ID NO: 1381149 - DNA, 18 bp, Homo sapiens
aatgcttctttcctctta

SEQ ID NO: 1381150 - DNA, 18 bp, Homo sapiens
aatggactttgcacactt

SEQ ID NO: 1381151 - DNA, 23 bp, Homo sapiens
aatggactttgcacactttggcc

SEQ ID NO: 1381152 - DNA, 15 bp, Homo sapiens
aatgtctcaaaataa

SEQ ID NO: 1381153 - DNA, 19 bp, Homo sapiens
aattctgtcactcaccact

SEQ ID NO: 1381154 - DNA, 18 bp, Homo sapiens
aattttgaaaactctaat

SEQ ID NO: 1381155 - DNA, 15 bp, Homo sapiens
acaaccatgttcttg

SEQ ID NO: 1381156 - DNA, 23 bp, Homo sapiens
acaaccatgttcttgagcagctg

SEQ ID NO: 1381157 - DNA, 19 bp, Homo sapiens
acaagtgccctccaggctt

SEQ ID NO: 1381158 - DNA, 19 bp, Homo sapiens
acaccataagctactgcca

SEQ ID NO: 1381159 - DNA, 20 bp, Homo sapiens
acaccataagctactgccat

SEQ ID NO: 1381160 - DNA, 21 bp, Homo sapiens
acaccataagctactgccatc

SEQ ID NO: 1381161 - DNA, 22 bp, Homo sapiens
acaccataagctactgccatcc

SEQ ID NO: 1381162 - DNA, 21 bp, Homo sapiens
acagatcacatgcccctctta

SEQ ID NO: 1381163 - DNA, 20 bp, Homo sapiens
acagcaggctgccagtgcct

SEQ ID NO: 1381164 - DNA, 13 bp, Homo sapiens
acagggcctctgc

SEQ ID NO: 1381165 - DNA, 12 bp, Homo sapiens
acatctcttcat

SEQ ID NO: 1381166 - DNA, 18 bp, Homo sapiens
acattgaattagaaacat

SEQ ID NO: 1381167 - DNA, 15 bp, Homo sapiens
accaatttgttctgt

SEQ ID NO: 1381168 - DNA, 17 bp, Homo sapiens
accaatttgttctgtgc

SEQ ID NO: 1381169 - DNA, 13 bp, Homo sapiens
accagaaagagga

SEQ ID NO: 1381170 - DNA, 18 bp, Homo sapiens
accagtaattgtgaaaat

SEQ ID NO: 1381171 - DNA, 21 bp, Homo sapiens
accagtgcctctccctgctgc

SEQ ID NO: 1381172 - DNA, 21 bp, Homo sapiens
accagttccctcagccctcat

SEQ ID NO: 1381173 - DNA, 18 bp, Homo sapiens
accataagctactgccat

SEQ ID NO: 1381174 - DNA, 16 bp, Homo sapiens
acccagtcctgcccgc

SEQ ID NO: 1381175 - DNA, 18 bp, Homo sapiens
accccaagactcccatga

SEQ ID NO: 1381176 - DNA, 17 bp, Homo sapiens
accccctcacccctcca

SEQ ID NO: 1381177 - DNA, 13 bp, Homo sapiens
accctgaatcaga

SEQ ID NO: 1381178 - DNA, 21 bp, Homo sapiens
acctgggcatactaataaagt

SEQ ID NO: 1381179 - DNA, 16 bp, Homo sapiens
acctgtaggtctatga

SEQ ID NO: 1381180 - DNA, 13 bp, Homo sapiens
actatcagcagcg

SEQ ID NO: 1381181 - DNA, 14 bp, Homo sapiens
atgctccctcatgc

SEQ ID NO: 1381182 - DNA, 14 bp, Homo sapiens
atgctgctgagcac

SEQ ID NO: 1381183 - DNA, 22 bp, Homo sapiens
atgctgctgagcacatctcttc

SEQ ID NO: 1381184 - DNA, 21 bp, Homo sapiens
atgctgctgcccctgcacagc

SEQ ID NO: 1381185 - DNA, 22 bp, Homo sapiens
atgctgctgcccctgcacagca

SEQ ID NO: 1381186 - DNA, 19 bp, Homo sapiens
atggaaaggagaggaaaga

SEQ ID NO: 1381187 - DNA, 15 bp, Homo sapiens
atggagtagagtcag

SEQ ID NO: 1381188 - DNA, 22 bp, Homo sapiens
atgggccaccgccttgcccagc

SEQ ID NO: 1381189 - DNA, 23 bp, Homo sapiens
atgtgattcctttgaagaggaaa

SEQ ID NO: 1381190 - DNA, 14 bp, Homo sapiens
atgtgccccttccc

SEQ ID NO: 1381191 - DNA, 14 bp, Homo sapiens
atgttctgaaatgg

SEQ ID NO: 1381192 - DNA, 18 bp, Homo sapiens
atgttcttgagcagctga

SEQ ID NO: 1381193 - DNA, 14 bp, Homo sapiens
attaagtatatata

SEQ ID NO: 1381194 - DNA, 22 bp, Homo sapiens
attaagtttgaaaatagttacc

SEQ ID NO: 1381195 - DNA, 22 bp, Homo sapiens
attcaaataaccctgaatcaga

SEQ ID NO: 1381196 - DNA, 23 bp, Homo sapiens
attcaaataaccctgaatcagag

SEQ ID NO: 1381197 - DNA, 22 bp, Homo sapiens
attggctgccaagagtccaagc

SEQ ID NO: 1381198 - DNA, 20 bp, Homo sapiens
attggggctcccagccaggc

SEQ ID NO: 1381199 - DNA, 23 bp, Homo sapiens
attggggctcccagccaggccct

SEQ ID NO: 1381200 - DNA, 23 bp, Homo sapiens
attgttcagaaaagcacctcttg

SEQ ID NO: 1381201 - DNA, 12 bp, Homo sapiens
atttatcctctg

SEQ ID NO: 1381202 - DNA, 16 bp, Homo sapiens
atttatcctctgttga

SEQ ID NO: 1381203 - DNA, 18 bp, Homo sapiens
atttgtcccaagtgccaa

SEQ ID NO: 1381204 - DNA, 15 bp, Homo sapiens
caaacagggcctctg

SEQ ID NO: 1381205 - DNA, 18 bp, Homo sapiens
caaaccaatttgttctgt

SEQ ID NO: 1381206 - DNA, 13 bp, Homo sapiens
caaagagtagaac

SEQ ID NO: 1381207 - DNA, 19 bp, Homo sapiens
tgaatggactttgcacact

SEQ ID NO: 1381208 - DNA, 18 bp, Homo sapiens
tgaatgggaaaagagatg

SEQ ID NO: 1381209 - DNA, 23 bp, Homo sapiens
tgaattagaaacataaataaaat

SEQ ID NO: 1381210 - DNA, 14 bp, Homo sapiens
tgagagcagcctct

SEQ ID NO: 1381211 - DNA, 13 bp, Homo sapiens
tgagcagctgaat

SEQ ID NO: 1381212 - DNA, 15 bp, Homo sapiens
tgagcatgctccctc

SEQ ID NO: 1381213 - DNA, 15 bp, Homo sapiens
tgagccgcccaaggc

SEQ ID NO: 1381214 - DNA, 15 bp, Homo sapiens
tgaggccaaatgagt

SEQ ID NO: 1381215 - DNA, 16 bp, Homo sapiens
tgagggagatgccatg

SEQ ID NO: 1381216 - DNA, 23 bp, Homo sapiens
tgatcaaggagggagaaaggcaa

SEQ ID NO: 1381217 - DNA, 20 bp, Homo sapiens
tgatctgtccttccaacctg

SEQ ID NO: 1381218 - DNA, 14 bp, Homo sapiens
tgatgatgttctga

SEQ ID NO: 1381219 - DNA, 14 bp, Homo sapiens
tgatgtccaaactt

SEQ ID NO: 1381220 - DNA, 16 bp, Homo sapiens
tgatgtccaaacttaa

SEQ ID NO: 1381221 - DNA, 13 bp, Homo sapiens
tgatgttctgaaa

SEQ ID NO: 1381222 - DNA, 21 bp, Homo sapiens
tgattcctttgaagaggaaaa

SEQ ID NO: 1381223 - DNA, 16 bp, Homo sapiens
tgcacactttggccca

SEQ ID NO: 1381224 - DNA, 20 bp, Homo sapiens
tgcacactttggcccagggt

SEQ ID NO: 1381225 - DNA, 18 bp, Homo sapiens
tgcacagcaggctgccag

SEQ ID NO: 1381226 - DNA, 22 bp, Homo sapiens
tgcacagcaggctgccagtgcc

SEQ ID NO: 1381227 - DNA, 23 bp, Homo sapiens
tgcacagcaggctgccagtgcct

SEQ ID NO: 1381228 - DNA, 15 bp, Homo sapiens
tgccacctcccccca

SEQ ID NO: 1381229 - DNA, 12 bp, Homo sapiens
tgccatccaagt

SEQ ID NO: 1381230 - DNA, 13 bp, Homo sapiens
tgccatcctggcc

SEQ ID NO: 1381231 - DNA, 19 bp, Homo sapiens
tgccatgagccgcccaagg

SEQ ID NO: 1381232 - DNA, 19 bp, Homo sapiens
tgccccttccccatgctca

SEQ ID NO: 1381233 - DNA, 17 bp, Homo sapiens
tgcctaactccttacag

SEQ ID NO: 1381234 - DNA, 13 bp, Homo sapiens
tgcggagcacact

SEQ ID NO: 1381235 - DNA, 16 bp, Homo sapiens
tgctcccacctggctc

SEQ ID NO: 1381236 - DNA, 15 bp, Homo sapiens
tgctctctcattccc

SEQ ID NO: 1381237 - DNA, 18 bp, Homo sapiens
tgctgagatcctggactg

SEQ ID NO: 1381238 - DNA, 22 bp, Homo sapiens
tgctgcccctgcacagcaggct

SEQ ID NO: 1381239 - DNA, 15 bp, Homo sapiens
tgcttctactccatg

SEQ ID NO: 1381240 - DNA, 17 bp, Homo sapiens
tgcttctttcctcttaa

SEQ ID NO: 1381241 - DNA, 18 bp, Homo sapiens
tgcttgaggccaaatgag

SEQ ID NO: 1381242 - DNA, 16 bp, Homo sapiens
gtatcataaaaataaa

SEQ ID NO: 1381243 - DNA, 19 bp, Homo sapiens
gtatctgatgatgttctga

SEQ ID NO: 1381244 - DNA, 22 bp, Homo sapiens
gtcagtgtactctgagtcctca

SEQ ID NO: 1381245 - DNA, 19 bp, Homo sapiens
gtcatgttggtaccctgga

SEQ ID NO: 1381246 - DNA, 21 bp, Homo sapiens
gtccaggagatgaggctggat

SEQ ID NO: 1381247 - DNA, 15 bp, Homo sapiens
gtcggccccaccagt

SEQ ID NO: 1381248 - DNA, 13 bp, Homo sapiens
gtctccagctgct

SEQ ID NO: 1381249 - DNA, 14 bp, Homo sapiens
gtctccagctgctg

SEQ ID NO: 1381250 - DNA, 24 bp, Homo sapiens
gtctgtctctcttttgctctctca

SEQ ID NO: 1381251 - DNA, 23 bp, Homo sapiens
gtgaataccccaagactcccatg

SEQ ID NO: 1381252 - DNA, 23 bp, Homo sapiens
gtgcctctccctgctgctcctag

SEQ ID NO: 1381253 - DNA, 23 bp, Homo sapiens
gtggccacacctctatcccggct

SEQ ID NO: 1381254 - DNA, 15 bp, Homo sapiens
gttattttgtgtcct

SEQ ID NO: 1381255 - DNA, 20 bp, Homo sapiens
gttcacgtgactcctcaatt

SEQ ID NO: 1381256 - DNA, 17 bp, Homo sapiens
gttcagaaaagcacctc

SEQ ID NO: 1381257 - DNA, 13 bp, Homo sapiens
gttctgaaatgga

SEQ ID NO: 1381258 - DNA, 13 bp, Homo sapiens
gttctttgtacct

SEQ ID NO: 1381259 - DNA, 19 bp, Homo sapiens
gtttccatcaaagccctcc

SEQ ID NO: 1381260 - DNA, 22 bp, Homo sapiens
gtttgcctccgtcccctgccca

SEQ ID NO: 1381261 - DNA, 21 bp, Homo sapiens
taaaaaaatcccatttatgca

SEQ ID NO: 1381262 - DNA, 16 bp, Homo sapiens
taaaaccagaaagagg

SEQ ID NO: 1381263 - DNA, 19 bp, Homo sapiens
taaagtatggtattgaaac

SEQ ID NO: 1381264 - DNA, 15 bp, Homo sapiens
taaataaaatgacca

SEQ ID NO: 1381265 - DNA, 15 bp, Homo sapiens
taaataatcatacac

SEQ ID NO: 1381266 - DNA, 23 bp, Homo sapiens
taagtgcttgaggccaaatgagt

SEQ ID NO: 1381267 - DNA, 18 bp, Homo sapiens
taatgattatataaaata

SEQ ID NO: 1381268 - DNA, 23 bp, Homo sapiens
taatgattatataaaatacataa

SEQ ID NO: 1381269 - DNA, 15 bp, Homo sapiens
taatgtctcaaaata

SEQ ID NO: 1381270 - DNA, 16 bp, Homo sapiens
tacatcacttgagaca

SEQ ID NO: 1381271 - DNA, 19 bp, Homo sapiens
taccccaagactcccatga

SEQ ID NO: 1381272 - DNA, 15 bp, Homo sapiens
tactgccatcctggc

SEQ ID NO: 1381273 - DNA, 19 bp, Homo sapiens
tactgccatcctggcccag

SEQ ID NO: 1381274 - DNA, 21 bp, Homo sapiens
tacttctggcataactaaaat

SEQ ID NO: 1381275 - DNA, 15 bp, Homo sapiens
gcagctagaaagaga

SEQ ID NO: 1381276 - DNA, 17 bp, Homo sapiens
gcaggctgccagtgcct

SEQ ID NO: 1381277 - DNA, 14 bp, Homo sapiens
gcagtgctcaccca

SEQ ID NO: 1381278 - DNA, 20 bp, Homo sapiens
gccaaatgagttcccttgat

SEQ ID NO: 1381279 - DNA, 13 bp, Homo sapiens
gccaccgccttgc

SEQ ID NO: 1381280 - DNA, 20 bp, Homo sapiens
gccaccgccttgcccagcct

SEQ ID NO: 1381281 - DNA, 21 bp, Homo sapiens
gccaggcccttgtcggcccca

SEQ ID NO: 1381282 - DNA, 14 bp, Homo sapiens
gccagtgcctgggt

SEQ ID NO: 1381283 - DNA, 20 bp, Homo sapiens
gccatcctggcccagggcat

SEQ ID NO: 1381284 - DNA, 19 bp, Homo sapiens
gccatgagccgcccaaggc

SEQ ID NO: 1381285 - DNA, 14 bp, Homo sapiens
gcccagggcatctg

SEQ ID NO: 1381286 - DNA, 18 bp, Homo sapiens
gcccagggcatctgggag

SEQ ID NO: 1381287 - DNA, 13 bp, Homo sapiens
gccccaccagtgc

SEQ ID NO: 1381288 - DNA, 17 bp, Homo sapiens
gccccaccagtgcctct

SEQ ID NO: 1381289 - DNA, 15 bp, Homo sapiens
gccccatctgcgggg

SEQ ID NO: 1381290 - DNA, 14 bp, Homo sapiens
gcccctgcacagca

SEQ ID NO: 1381291 - DNA, 14 bp, Homo sapiens
gccctccagagccc

SEQ ID NO: 1381292 - DNA, 21 bp, Homo sapiens
gcccttgtcggccccaccagt

SEQ ID NO: 1381293 - DNA, 19 bp, Homo sapiens
gcctctccctgctgctcct

SEQ ID NO: 1381294 - DNA, 21 bp, Homo sapiens
gcctctgcggagcacactggc

SEQ ID NO: 1381295 - DNA, 24 bp, Homo sapiens
gcctctgcggagcacactggctca

SEQ ID NO: 1381296 - DNA, 23 bp, Homo sapiens
gcctcttgaatgcttaaatgatc

SEQ ID NO: 1381297 - DNA, 20 bp, Homo sapiens
gccttcccctggcactggca

SEQ ID NO: 1381298 - DNA, 13 bp, Homo sapiens
gccttgcccagcc

SEQ ID NO: 1381299 - DNA, 14 bp, Homo sapiens
gccttgcccagcct

SEQ ID NO: 1381300 - DNA, 22 bp, Homo sapiens
gcgatgtgttctttgtacctgt

SEQ ID NO: 1381301 - DNA, 21 bp, Homo sapiens
gctagaaagagaaaaagccct

SEQ ID NO: 1381302 - DNA, 23 bp, Homo sapiens
gctagaaagagaaaaagccctct

SEQ ID NO: 1381303 - DNA, 23 bp, Homo sapiens
gctatacctgggcatactaataa

SEQ ID NO: 1381304 - DNA, 14 bp, Homo sapiens
gctcaaataaaatt

SEQ ID NO: 1381305 - DNA, 15 bp, Homo sapiens
gctcacccagtcctg

SEQ ID NO: 1381306 - DNA, 15 bp, Homo sapiens
gctcagcattgtgta

SEQ ID NO: 1381307 - DNA, 18 bp, Homo sapiens
catcctggcccagggcat

SEQ ID NO: 1381308 - DNA, 19 bp, Homo sapiens
catccttggactgagaaat

SEQ ID NO: 1381309 - DNA, 19 bp, Homo sapiens
catctgcgggggcagtgct

SEQ ID NO: 1381310 - DNA, 20 bp, Homo sapiens
catctgcgggggcagtgctc

SEQ ID NO: 1381311 - DNA, 21 bp, Homo sapiens
catctgcgggggcagtgctca

SEQ ID NO: 1381312 - DNA, 16 bp, Homo sapiens
catgagccgcccaagg

SEQ ID NO: 1381313 - DNA, 21 bp, Homo sapiens
catgcagatagtatacacatc

SEQ ID NO: 1381314 - DNA, 17 bp, Homo sapiens
catgcccctcttagaag

SEQ ID NO: 1381315 - DNA, 17 bp, Homo sapiens
catggtgaactgaagca

SEQ ID NO: 1381316 - DNA, 23 bp, Homo sapiens
catggtgaactgaagcagagtca

SEQ ID NO: 1381317 - DNA, 16 bp, Homo sapiens
catggtttggagctga

SEQ ID NO: 1381318 - DNA, 18 bp, Homo sapiens
catggtttggagctgatc

SEQ ID NO: 1381319 - DNA, 17 bp, Homo sapiens
catgttggtaccctgga

SEQ ID NO: 1381320 - DNA, 16 bp, Homo sapiens
cattggggctcccagc

SEQ ID NO: 1381321 - DNA, 21 bp, Homo sapiens
cattggggctcccagccaggc

SEQ ID NO: 1381322 - DNA, 22 bp, Homo sapiens
cattggggctcccagccaggcc

SEQ ID NO: 1381323 - DNA, 13 bp, Homo sapiens
catttgtcccaag

SEQ ID NO: 1381324 - DNA, 14 bp, Homo sapiens
catttgtcccaagt

SEQ ID NO: 1381325 - DNA, 15 bp, Homo sapiens
ccaagactcccatga

SEQ ID NO: 1381326 - DNA, 16 bp, Homo sapiens
ccaagagtccaagcca

SEQ ID NO: 1381327 - DNA, 11 bp, Homo sapiens
ccaagcccagc

SEQ ID NO: 1381328 - DNA, 22 bp, Homo sapiens
ccaagcccagcctatctctctt

SEQ ID NO: 1381329 - DNA, 19 bp, Homo sapiens
ccaaggccttcccctggca

SEQ ID NO: 1381330 - DNA, 23 bp, Homo sapiens
ccaagtgccaaagaagcagacca

SEQ ID NO: 1381331 - DNA, 20 bp, Homo sapiens
ccacaagtgccctccaggct

SEQ ID NO: 1381332 - DNA, 20 bp, Homo sapiens
ccacaccataagctactgcc

SEQ ID NO: 1381333 - DNA, 21 bp, Homo sapiens
ccacaccataagctactgcca

SEQ ID NO: 1381334 - DNA, 15 bp, Homo sapiens
ccaccagtgcctctc

SEQ ID NO: 1381335 - DNA, 19 bp, Homo sapiens
ttgcatggtttggagctga

SEQ ID NO: 1381336 - DNA, 19 bp, Homo sapiens
ttgctctctcattcccagg

SEQ ID NO: 1381337 - DNA, 15 bp, Homo sapiens
ttgcttgactctact

SEQ ID NO: 1381338 - DNA, 20 bp, Homo sapiens
ttggctcagacacctagact

SEQ ID NO: 1381339 - DNA, 16 bp, Homo sapiens
ttggctgccaagagtc

SEQ ID NO: 1381340 - DNA, 16 bp, Homo sapiens
ttggtttgtgggtcca

SEQ ID NO: 1381341 - DNA, 21 bp, Homo sapiens
ttgtcggccccaccagtgcct

SEQ ID NO: 1381342 - DNA, 24 bp, Homo sapiens
tttcctcttaatgtctcaaaataa

SEQ ID NO: 1381343 - DNA, 15 bp, Homo sapiens
tttcctgctcctcca

SEQ ID NO: 1381344 - DNA, 20 bp, Homo sapiens
tttgaagcatgctctgtaag

SEQ ID NO: 1381345 - DNA, 22 bp, Homo sapiens
tttgcacactttggcccagggt

SEQ ID NO: 1381346 - DNA, 12 bp, Homo sapiens
tttggcccaggg

SEQ ID NO: 1381347 - DNA, 24 bp, Homo sapiens
ataaccctgaatcagaggcagaga

SEQ ID NO: 1381348 - DNA, 21 bp, Homo sapiens
ataatgcttctttcctcttaa

SEQ ID NO: 1381349 - DNA, 13 bp, Homo sapiens
atactgaagatgc

SEQ ID NO: 1381350 - DNA, 15 bp, Homo sapiens
atagtatacacatca

SEQ ID NO: 1381351 - DNA, 21 bp, Homo sapiens
atattttggctcaaataaaat

SEQ ID NO: 1381352 - DNA, 19 bp, Homo sapiens
atatttttcaattttgaaa

SEQ ID NO: 1381353 - DNA, 12 bp, Homo sapiens
atcaaagccctc

SEQ ID NO: 1381354 - DNA, 21 bp, Homo sapiens
atcacatgcccctcttagaag

SEQ ID NO: 1381355 - DNA, 19 bp, Homo sapiens
atcacttgagacaaatcta

SEQ ID NO: 1381356 - DNA, 22 bp, Homo sapiens
atcataaaaataaaatctgtaa

SEQ ID NO: 1381357 - DNA, 18 bp, Homo sapiens
atccccataatgcttctt

SEQ ID NO: 1381358 - DNA, 16 bp, Homo sapiens
atcctggactgagggg

SEQ ID NO: 1381359 - DNA, 21 bp, Homo sapiens
atctcctgtgcacctgacttt

SEQ ID NO: 1381360 - DNA, 17 bp, Homo sapiens
atctgatgatgttctga

SEQ ID NO: 1381361 - DNA, 19 bp, Homo sapiens
atctgatgatgttctgaaa

SEQ ID NO: 1381362 - DNA, 18 bp, Homo sapiens
atctgcgggggcagtgct

SEQ ID NO: 1381363 - DNA, 21 bp, Homo sapiens
atctgcgggggcagtgctcac

SEQ ID NO: 1381364 - DNA, 23 bp, Homo sapiens
atctgcgggggcagtgctcaccc

SEQ ID NO: 1381365 - DNA, 16 bp, Homo sapiens
atgagggagatgccat

SEQ ID NO: 1381366 - DNA, 12 bp, Homo sapiens
atgatgttctga

SEQ ID NO: 1381367 - DNA, 14 bp, Homo sapiens
atgattgagagcag

SEQ ID NO: 1381368 - DNA, 19 bp, Homo sapiens
atgcaatttacttggaatt

SEQ ID NO: 1381369 - DNA, 16 bp, Homo sapiens
atgcagcaaaatgtga

SEQ ID NO: 1381370 - DNA, 15 bp, Homo sapiens
atgctgctgagcaca

SEQ ID NO: 1381371 - DNA, 15 bp, Homo sapiens
atgctgctgcccctg

SEQ ID NO: 1381372 - DNA, 22 bp, Homo sapiens
atggactttgcacactttggcc

SEQ ID NO: 1381373 - DNA, 14 bp, Homo sapiens
atggtttggagctg

SEQ ID NO: 1381374 - DNA, 21 bp, Homo sapiens
atgtccaaacttaacagatca

SEQ ID NO: 1381375 - DNA, 14 bp, Homo sapiens
atgtctcaaaataa

SEQ ID NO: 1381376 - DNA, 22 bp, Homo sapiens
atgtctcaaaataaaaccagaa

SEQ ID NO: 1381377 - DNA, 16 bp, Homo sapiens
atgtgaatgggaaaag

SEQ ID NO: 1381378 - DNA, 15 bp, Homo sapiens
attaaactgatgggt

SEQ ID NO: 1381379 - DNA, 22 bp, Homo sapiens
attaatggtttttgttagttca

SEQ ID NO: 1381380 - DNA, 17 bp, Homo sapiens
attagaaacataaataa

SEQ ID NO: 1381381 - DNA, 17 bp, Homo sapiens
attcattcatcctctta

SEQ ID NO: 1381382 - DNA, 17 bp, Homo sapiens
attccagggaaccagag

SEQ ID NO: 1381383 - DNA, 17 bp, Homo sapiens
attcccaaatctcaaaa

SEQ ID NO: 1381384 - DNA, 16 bp, Homo sapiens
attcctttgaagagga

SEQ ID NO: 1381385 - DNA, 17 bp, Homo sapiens
attgagagcagcctctt

SEQ ID NO: 1381386 - DNA, 23 bp, Homo sapiens
attgccttatattggatcaggaa

SEQ ID NO: 1381387 - DNA, 16 bp, Homo sapiens
attgttcagaaaagca

SEQ ID NO: 1381388 - DNA, 19 bp, Homo sapiens
atttctctggggtctgtga

SEQ ID NO: 1381389 - DNA, 23 bp, Homo sapiens
atttgaagcatgctctgtaagtt

SEQ ID NO: 1381390 - DNA, 16 bp, Homo sapiens
caaaataaaaccagaa

SEQ ID NO: 1381391 - DNA, 20 bp, Homo sapiens
caaaataaaaccagaaagag

SEQ ID NO: 1381392 - DNA, 19 bp, Homo sapiens
caaacagggcctctgcgga

SEQ ID NO: 1381393 - DNA, 20 bp, Homo sapiens
caaaccaatttgttctgtgc

SEQ ID NO: 1381394 - DNA, 18 bp, Homo sapiens
caaagagtagaactttaa

SEQ ID NO: 1381395 - DNA, 16 bp, Homo sapiens
caaagccctccctgtc

SEQ ID NO: 1381396 - DNA, 23 bp, Homo sapiens
caacctgttcacgtgactcctca

SEQ ID NO: 1381397 - DNA, 21 bp, Homo sapiens
caagctcactccccaaccccc

SEQ ID NO: 1381398 - DNA, 15 bp, Homo sapiens
caaggagggagaaag

SEQ ID NO: 1381399 - DNA, 20 bp, Homo sapiens
caatccccataatgcttctt

SEQ ID NO: 1381400 - DNA, 17 bp, Homo sapiens
cacaaccatgttcttga

SEQ ID NO: 1381401 - DNA, 21 bp, Homo sapiens
cacaccataagctactgccat

SEQ ID NO: 1381402 - DNA, 12 bp, Homo sapiens
cacactggctca

SEQ ID NO: 1381403 - DNA, 22 bp, Homo sapiens
cacatgcccctcttagaagaaa

SEQ ID NO: 1381404 - DNA, 12 bp, Homo sapiens
caccagtgcctc

SEQ ID NO: 1381405 - DNA, 18 bp, Homo sapiens
caccccctcacccctcca

SEQ ID NO: 1381406 - DNA, 22 bp, Homo sapiens
cacctctatcccggctttggtg

SEQ ID NO: 1381407 - DNA, 23 bp, Homo sapiens
cacctggctctgtggcgagccat

SEQ ID NO: 1381408 - DNA, 18 bp, Homo sapiens
cactccggccctccagag

SEQ ID NO: 1381409 - DNA, 18 bp, Homo sapiens
cactggctcacccagtcc

SEQ ID NO: 1381410 - DNA, 13 bp, Homo sapiens
cagaaagaggaat

SEQ ID NO: 1381411 - DNA, 21 bp, Homo sapiens
cagaagcagcagctagaaaga

SEQ ID NO: 1381412 - DNA, 22 bp, Homo sapiens
cagaccattggggctcccagcc

SEQ ID NO: 1381413 - DNA, 16 bp, Homo sapiens
cagagacctcctgatg

SEQ ID NO: 1381414 - DNA, 17 bp, Homo sapiens
cagagcgatgtgttctt

SEQ ID NO: 1381415 - DNA, 16 bp, Homo sapiens
cagagtcaagctgatg

SEQ ID NO: 1381416 - DNA, 17 bp, Homo sapiens
cagatcacatgcccctc

SEQ ID NO: 1381417 - DNA, 21 bp, Homo sapiens
cagatcacatgcccctcttag

SEQ ID NO: 1381418 - DNA, 19 bp, Homo sapiens
cagcagcagtttgtgatct

SEQ ID NO: 1381419 - DNA, 12 bp, Homo sapiens
cagccaggccct

SEQ ID NO: 1381420 - DNA, 15 bp, Homo sapiens
cagcctggatgccat

SEQ ID NO: 1381421 - DNA, 15 bp, Homo sapiens
cagcggcagcagcag

SEQ ID NO: 1381422 - DNA, 15 bp, Homo sapiens
cagctagaaagagaa

SEQ ID NO: 1381423 - DNA, 21 bp, Homo sapiens
caggctgccagtgcctgggtg

SEQ ID NO: 1381424 - DNA, 14 bp, Homo sapiens
cagggcatctggga

SEQ ID NO: 1381425 - DNA, 13 bp, Homo sapiens
cagggcctctgcg

SEQ ID NO: 1381426 - DNA, 14 bp, Homo sapiens
cagggcctctgcgg

SEQ ID NO: 1381427 - DNA, 17 bp, Homo sapiens
cagggcctctgcggagc

SEQ ID NO: 1381428 - DNA, 14 bp, Homo sapiens
cagggtggccacac

SEQ ID NO: 1381429 - DNA, 14 bp, Homo sapiens
cagtaattgtgaaa

SEQ ID NO: 1381430 - DNA, 22 bp, Homo sapiens
cagtacaataaataaaagaaag

SEQ ID NO: 1381431 - DNA, 15 bp, Homo sapiens
cagtcctgcccgcca

SEQ ID NO: 1381432 - DNA, 20 bp, Homo sapiens
cagtgcctctccctgctgct

SEQ ID NO: 1381433 - DNA, 17 bp, Homo sapiens
cagttccctcagccctc

SEQ ID NO: 1381434 - DNA, 18 bp, Homo sapiens
cagttccctcagccctca

SEQ ID NO: 1381435 - DNA, 20 bp, Homo sapiens
ctttgcacactttggcccag

SEQ ID NO: 1381436 - DNA, 16 bp, Homo sapiens
ctttggcccagggtgg

SEQ ID NO: 1381437 - DNA, 22 bp, Homo sapiens
cttttggtttgtgggtccagga

SEQ ID NO: 1381438 - DNA, 18 bp, Homo sapiens
gaaacataaataaaatga

SEQ ID NO: 1381439 - DNA, 17 bp, Homo sapiens
gaaacccctgacacctt

SEQ ID NO: 1381440 - DNA, 22 bp, Homo sapiens
gaaagaggaataaaatgattaa

SEQ ID NO: 1381441 - DNA, 21 bp, Homo sapiens
gaaatgattgagagcagcctc

SEQ ID NO: 1381442 - DNA, 17 bp, Homo sapiens
gaactgaagcagagtca

SEQ ID NO: 1381443 - DNA, 14 bp, Homo sapiens
gaactttaaaagaa

SEQ ID NO: 1381444 - DNA, 18 bp, Homo sapiens
gaagaggaaaatgaataa

SEQ ID NO: 1381445 - DNA, 15 bp, Homo sapiens
gaatgcttaaatgat

SEQ ID NO: 1381446 - DNA, 16 bp, Homo sapiens
gaattctatttgaagc

SEQ ID NO: 1381447 - DNA, 18 bp, Homo sapiens
gaattggctgccaagagt

SEQ ID NO: 1381448 - DNA, 22 bp, Homo sapiens
gaccccactccggccctccaga

SEQ ID NO: 1381449 - DNA, 18 bp, Homo sapiens
gacccgtctccagctgct

SEQ ID NO: 1381450 - DNA, 14 bp, Homo sapiens
gacctcctgatgtc

SEQ ID NO: 1381451 - DNA, 15 bp, Homo sapiens
gactgagggggcctg

SEQ ID NO: 1381452 - DNA, 13 bp, Homo sapiens
gagaaaaagccct

SEQ ID NO: 1381453 - DNA, 17 bp, Homo sapiens
gagatcaaatggaaagg

SEQ ID NO: 1381454 - DNA, 14 bp, Homo sapiens
gagatgaggctgga

SEQ ID NO: 1381455 - DNA, 15 bp, Homo sapiens
gagatgaggctggat

SEQ ID NO: 1381456 - DNA, 22 bp, Homo sapiens
gagcatgctccctcatgcagat

SEQ ID NO: 1381457 - DNA, 20 bp, Homo sapiens
gagccccacagccccatctg

SEQ ID NO: 1381458 - DNA, 16 bp, Homo sapiens
gagcgatgtgttcttt

SEQ ID NO: 1381459 - DNA, 21 bp, Homo sapiens
gagctgatcgcttctccccca

SEQ ID NO: 1381460 - DNA, 16 bp, Homo sapiens
gaggaaaaggcttgag

SEQ ID NO: 1381461 - DNA, 14 bp, Homo sapiens
gaggccaaatgagt

SEQ ID NO: 1381462 - DNA, 18 bp, Homo sapiens
gagtcaagctgatgaagt

SEQ ID NO: 1381463 - DNA, 13 bp, Homo sapiens
gataggagaggaa

SEQ ID NO: 1381464 - DNA, 23 bp, Homo sapiens
gatatgtatcataaaaataaaat

SEQ ID NO: 1381465 - DNA, 21 bp, Homo sapiens
gatcacatgcccctcttagaa

SEQ ID NO: 1381466 - DNA, 22 bp, Homo sapiens
gatctgtccttccaacctgttc

SEQ ID NO: 1381467 - DNA, 16 bp, Homo sapiens
gatgataaacgacttt

SEQ ID NO: 1381468 - DNA, 17 bp, Homo sapiens
gatgcagcaaaatgtga

SEQ ID NO: 1381469 - DNA, 15 bp, Homo sapiens
gcaaaccaatttgtt

SEQ ID NO: 1381470 - DNA, 18 bp, Homo sapiens
gcacaaccatgttcttga

SEQ ID NO: 1381471 - DNA, 22 bp, Homo sapiens
gcacactggctcacccagtcct

SEQ ID NO: 1381472 - DNA, 16 bp, Homo sapiens
gcacactttggcccag

SEQ ID NO: 1381473 - DNA, 18 bp, Homo sapiens
gcacagcaggctgccagt

SEQ ID NO: 1381474 - DNA, 23 bp, Homo sapiens
gcacagcaggctgccagtgcctg

SEQ ID NO: 1381475 - DNA, 12 bp, Homo sapiens
gcacctcttgaa

SEQ ID NO: 1381476 - DNA, 17 bp, Homo sapiens
gcactggcaaacagggc

SEQ ID NO: 1381477 - DNA, 19 bp, Homo sapiens
gcactggcaaacagggcct

SEQ ID NO: 1381478 - DNA, 20 bp, Homo sapiens
gcagaccattggggctccca

SEQ ID NO: 1381479 - DNA, 21 bp, Homo sapiens
gcagaccattggggctcccag

SEQ ID NO: 1381480 - DNA, 16 bp, Homo sapiens
gcagagtcaagctgat

SEQ ID NO: 1381481 - DNA, 14 bp, Homo sapiens
gcagcctcttgaat

SEQ ID NO: 1381482 - DNA, 17 bp, Homo sapiens
gcagcggcagcagcagc

SEQ ID NO: 1381483 - DNA, 16 bp, Homo sapiens
gcataactaaaattaa

SEQ ID NO: 1381484 - DNA, 16 bp, Homo sapiens
gcatactaataaagta

SEQ ID NO: 1381485 - DNA, 16 bp, Homo sapiens
gcatggtttggagctg

SEQ ID NO: 1381486 - DNA, 16 bp, Homo sapiens
gccaaagaagcagacc

SEQ ID NO: 1381487 - DNA, 16 bp, Homo sapiens
gccaccgccttgccca

SEQ ID NO: 1381488 - DNA, 13 bp, Homo sapiens
gccagtgcctggg

SEQ ID NO: 1381489 - DNA, 18 bp, Homo sapiens
gccatcctggcccagggc

SEQ ID NO: 1381490 - DNA, 23 bp, Homo sapiens
gccatcctggcccagggcatctg

SEQ ID NO: 1381491 - DNA, 13 bp, Homo sapiens
gccatttgtccca

SEQ ID NO: 1381492 - DNA, 16 bp, Homo sapiens
gccatttgtcccaagt

SEQ ID NO: 1381493 - DNA, 20 bp, Homo sapiens
gccatttgtcccaagtgcca

SEQ ID NO: 1381494 - DNA, 16 bp, Homo sapiens
gcccaaggccttcccc

SEQ ID NO: 1381495 - DNA, 21 bp, Homo sapiens
gcccagcctatctctcttctg

SEQ ID NO: 1381496 - DNA, 18 bp, Homo sapiens
gccccacagccccatctg

SEQ ID NO: 1381497 - DNA, 14 bp, Homo sapiens
gccccaccagtgcc

SEQ ID NO: 1381498 - DNA, 22 bp, Homo sapiens
gccccaccagtgcctctccctg

SEQ ID NO: 1381499 - DNA, 17 bp, Homo sapiens
gcccctgcacagcaggc

SEQ ID NO: 1381500 - DNA, 23 bp, Homo sapiens
gcccctgcacagcaggctgccag

SEQ ID NO: 1381501 - DNA, 12 bp, Homo sapiens
gccctccagagc

SEQ ID NO: 1381502 - DNA, 11 bp, Homo sapiens
gccctcttcaa

SEQ ID NO: 1381503 - DNA, 18 bp, Homo sapiens
gcctccgtcccctgccca

SEQ ID NO: 1381504 - DNA, 19 bp, Homo sapiens
gccttgcccagcctggatg

SEQ ID NO: 1381505 - DNA, 17 bp, Homo sapiens
gcggagcacactggctc

SEQ ID NO: 1381506 - DNA, 11 bp, Homo sapiens
gctactgccat

SEQ ID NO: 1381507 - DNA, 18 bp, Homo sapiens
gctactgccatcctggcc

SEQ ID NO: 1381508 - DNA, 21 bp, Homo sapiens
gctactgccatcctggcccag

SEQ ID NO: 1381509 - DNA, 18 bp, Homo sapiens
gctcccacctggctctgt

SEQ ID NO: 1381510 - DNA, 18 bp, Homo sapiens
gctcccagccaggccctt

SEQ ID NO: 1381511 - DNA, 14 bp, Homo sapiens
gctgagatcctgga

SEQ ID NO: 1381512 - DNA, 16 bp, Homo sapiens
gctgagatcctggact

SEQ ID NO: 1381513 - DNA, 15 bp, Homo sapiens
gctgatcgcttctcc

SEQ ID NO: 1381514 - DNA, 14 bp, Homo sapiens
gctgccagtgcctg

SEQ ID NO: 1381515 - DNA, 16 bp, Homo sapiens
gctgcccctgcacagc

SEQ ID NO: 1381516 - DNA, 20 bp, Homo sapiens
gctgctcccacctggctctg

SEQ ID NO: 1381517 - DNA, 14 bp, Homo sapiens
gctgctgcccctgc

SEQ ID NO: 1381518 - DNA, 15 bp, Homo sapiens
gctgctgcccctgca

SEQ ID NO: 1381519 - DNA, 19 bp, Homo sapiens
gcttgtgtaatttcctgct

SEQ ID NO: 1381520 - DNA, 22 bp, Homo sapiens
gcttgtgtaatttcctgctcct

SEQ ID NO: 1381521 - DNA, 21 bp, Homo sapiens
ggaaaaggcttgagtctggat

SEQ ID NO: 1381522 - DNA, 16 bp, Homo sapiens
ggactccagaagcagc

SEQ ID NO: 1381523 - DNA, 12 bp, Homo sapiens
ggagaggaaaga

SEQ ID NO: 1381524 - DNA, 20 bp, Homo sapiens
tggatcaggaacccttacag

SEQ ID NO: 1381525 - DNA, 16 bp, Homo sapiens
tggcaaacagggcctc

SEQ ID NO: 1381526 - DNA, 13 bp, Homo sapiens
tggcactggcaaa

SEQ ID NO: 1381527 - DNA, 22 bp, Homo sapiens
tggcactggcaaacagggcctc

SEQ ID NO: 1381528 - DNA, 23 bp, Homo sapiens
tggcataactaaaattaagtata

SEQ ID NO: 1381529 - DNA, 14 bp, Homo sapiens
tggcccagggcatc

SEQ ID NO: 1381530 - DNA, 17 bp, Homo sapiens
tggcccagggtggccac

SEQ ID NO: 1381531 - DNA, 14 bp, Homo sapiens
tggcgagccatttg

SEQ ID NO: 1381532 - DNA, 23 bp, Homo sapiens
tggcgagccatttgtcccaagtg

SEQ ID NO: 1381533 - DNA, 16 bp, Homo sapiens
tggctcacccagtcct

SEQ ID NO: 1381534 - DNA, 12 bp, Homo sapiens
tggggctcccag

SEQ ID NO: 1381535 - DNA, 14 bp, Homo sapiens
tgggtccaggagat

SEQ ID NO: 1381536 - DNA, 18 bp, Homo sapiens
tggtaagcaacatggctt

SEQ ID NO: 1381537 - DNA, 18 bp, Homo sapiens
tggtgaactgaagcagag

SEQ ID NO: 1381538 - DNA, 21 bp, Homo sapiens
tggtttccatcaaagccctcc

SEQ ID NO: 1381539 - DNA, 18 bp, Homo sapiens
tgtacaaaatatccaagc

SEQ ID NO: 1381540 - DNA, 14 bp, Homo sapiens
tgtaccactactta

SEQ ID NO: 1381541 - DNA, 15 bp, Homo sapiens
tgtcccaagtgccaa

SEQ ID NO: 1381542 - DNA, 20 bp, Homo sapiens
tgtcggccccaccagtgcct

SEQ ID NO: 1381543 - DNA, 19 bp, Homo sapiens
tgtctcaaaataaaaccag

SEQ ID NO: 1381544 - DNA, 21 bp, Homo sapiens
tgtctcaaaataaaaccagaa

SEQ ID NO: 1381545 - DNA, 16 bp, Homo sapiens
tgtgaatgggaaaaga

SEQ ID NO: 1381546 - DNA, 15 bp, Homo sapiens
tgtgccccttcccca

SEQ ID NO: 1381547 - DNA, 21 bp, Homo sapiens
tgtgccccttccccatgctca

SEQ ID NO: 1381548 - DNA, 16 bp, Homo sapiens
tgtgtcctttaaaaaa

SEQ ID NO: 1381549 - DNA, 14 bp, Homo sapiens
tgttcagaaaagca

SEQ ID NO: 1381550 - DNA, 23 bp, Homo sapiens
ttaaaaaaatcccatttatgcaa

SEQ ID NO: 1381551 - DNA, 13 bp, Homo sapiens
ttagaaacataaa

SEQ ID NO: 1381552 - DNA, 16 bp, Homo sapiens
ttagaaacataaataa

SEQ ID NO: 1381553 - DNA, 20 bp, Homo sapiens
ttagagttattttgtgtcct

SEQ ID NO: 1381554 - DNA, 20 bp, Homo sapiens
ttatattcccaaatctcaaa

SEQ ID NO: 1381555 - DNA, 22 bp, Homo sapiens
ttcaatccccataatgcttctt

SEQ ID NO: 1381556 - DNA, 12 bp, Homo sapiens
ttcatcctctta

SEQ ID NO: 1381557 - DNA, 16 bp, Homo sapiens
ttccagggaaccagag

SEQ ID NO: 1381558 - DNA, 18 bp, Homo sapiens
ttccctcagccctcatta

SEQ ID NO: 1381559 - DNA, 17 bp, Homo sapiens
ttcccttgattcaaata

SEQ ID NO: 1381560 - DNA, 15 bp, Homo sapiens
ttcctgaactcccag

SEQ ID NO: 1381561 - DNA, 22 bp, Homo sapiens
ttcctgctcctccagtacaata

SEQ ID NO: 1381562 - DNA, 14 bp, Homo sapiens
ttcctttgaagagg

SEQ ID NO: 1381563 - DNA, 13 bp, Homo sapiens
ttctttcctctta

SEQ ID NO: 1381564 - DNA, 22 bp, Homo sapiens
ttgaagaggaaaatgaataata

SEQ ID NO: 1381565 - DNA, 16 bp, Homo sapiens
ttgaatgcttaaatga

SEQ ID NO: 1381566 - DNA, 15 bp, Homo sapiens
ttgagagcagcctct

SEQ ID NO: 1381567 - DNA, 13 bp, Homo sapiens
ttggggctcccag

SEQ ID NO: 1381568 - DNA, 15 bp, Homo sapiens
ttggggctcccagcc

SEQ ID NO: 1381569 - DNA, 15 bp, Homo sapiens
ttgtcccaagtgcca

SEQ ID NO: 1381570 - DNA, 14 bp, Homo sapiens
ttgtgatctgtcct

SEQ ID NO: 1381571 - DNA, 20 bp, Homo sapiens
tttaaaagaaggtaaataat

SEQ ID NO: 1381572 - DNA, 23 bp, Homo sapiens
tttcctcttaatgtctcaaaata

SEQ ID NO: 1381573 - DNA, 22 bp, Homo sapiens
tttcctgctcctccagtacaat

SEQ ID NO: 1381574 - DNA, 23 bp, Homo sapiens
tttgctttatgggtttggcttgt

SEQ ID NO: 1381575 - DNA, 16 bp, Homo sapiens
ttttcttgcatggttt

SEQ ID NO: 1381576 - DNA, 20 bp, Homo sapiens
aaaaagcttaaacattgcct

SEQ ID NO: 1381577 - DNA, 21 bp, Homo sapiens
aaaatatccaagcccagccta

SEQ ID NO: 1381578 - DNA, 13 bp, Homo sapiens
caaatggaaagga

SEQ ID NO: 1381579 - DNA, 12 bp, Homo sapiens
caacatggcttt

SEQ ID NO: 1381580 - DNA, 13 bp, Homo sapiens
caacatggctttg

SEQ ID NO: 1381581 - DNA, 13 bp, Homo sapiens
caaccatgttctt

SEQ ID NO: 1381582 - DNA, 18 bp, Homo sapiens
caagactcccatgaggga

SEQ ID NO: 1381583 - DNA, 23 bp, Homo sapiens
caagctgatgaagttaagcacaa

SEQ ID NO: 1381584 - DNA, 14 bp, Homo sapiens
caataggcttagtg

SEQ ID NO: 1381585 - DNA, 19 bp, Homo sapiens
caattccagggaaccagag

SEQ ID NO: 1381586 - DNA, 12 bp, Homo sapiens
caatttgttctg

SEQ ID NO: 1381587 - DNA, 12 bp, Homo sapiens
caattttgaaaa

SEQ ID NO: 1381588 - DNA, 21 bp, Homo sapiens
cacaagtgccctccaggcttt

SEQ ID NO: 1381589 - DNA, 16 bp, Homo sapiens
cacagcaggctgccag

SEQ ID NO: 1381590 - DNA, 17 bp, Homo sapiens
cacagcaggctgccagt

SEQ ID NO: 1381591 - DNA, 14 bp, Homo sapiens
cacagccccatctg

SEQ ID NO: 1381592 - DNA, 19 bp, Homo sapiens
cacatgcccctcttagaag

SEQ ID NO: 1381593 - DNA, 11 bp, Homo sapiens
caccagtgcct

SEQ ID NO: 1381594 - DNA, 18 bp, Homo sapiens
caccataagctactgcca

SEQ ID NO: 1381595 - DNA, 19 bp, Homo sapiens
cacccagtcctgcccgcca

SEQ ID NO: 1381596 - DNA, 17 bp, Homo sapiens
caccgccttgcccagcc

SEQ ID NO: 1381597 - DNA, 21 bp, Homo sapiens
cactccggccctccagagccc

SEQ ID NO: 1381598 - DNA, 21 bp, Homo sapiens
cactggcaaacagggcctctg

SEQ ID NO: 1381599 - DNA, 14 bp, Homo sapiens
cactggctcaccca

SEQ ID NO: 1381600 - DNA, 13 bp, Homo sapiens
cactttggcccag

SEQ ID NO: 1381601 - DNA, 16 bp, Homo sapiens
cactttggcccagggt

SEQ ID NO: 1381602 - DNA, 16 bp, Homo sapiens
cagaaaagcacctctt

SEQ ID NO: 1381603 - DNA, 21 bp, Homo sapiens
cagaaagaggaataaaatgat

SEQ ID NO: 1381604 - DNA, 22 bp, Homo sapiens
cagaaagaggaataaaatgatt

SEQ ID NO: 1381605 - DNA, 14 bp, Homo sapiens
cagacacctagact

SEQ ID NO: 1381606 - DNA, 19 bp, Homo sapiens
cagaccattggggctccca

SEQ ID NO: 1381607 - DNA, 23 bp, Homo sapiens
cagaccattggggctcccagcca

SEQ ID NO: 1381608 - DNA, 16 bp, Homo sapiens
cagagccccacagccc

SEQ ID NO: 1381609 - DNA, 16 bp, Homo sapiens
cagagcgatgtgttct

SEQ ID NO: 1381610 - DNA, 21 bp, Homo sapiens
cagagcgatgtgttctttgta

SEQ ID NO: 1381611 - DNA, 22 bp, Homo sapiens
cagagcgatgtgttctttgtac

SEQ ID NO: 1381612 - DNA, 22 bp, Homo sapiens
cagatagtatacacatcataaa

SEQ ID NO: 1381613 - DNA, 22 bp, Homo sapiens
cagcaaaatgtgaatgggaaaa

SEQ ID NO: 1381614 - DNA, 12 bp, Homo sapiens
cagcagcagcag

SEQ ID NO: 1381615 - DNA, 18 bp, Homo sapiens
cagcagctagaaagagaa

SEQ ID NO: 1381616 - DNA, 14 bp, Homo sapiens
cagcaggctgccag

SEQ ID NO: 1381617 - DNA, 19 bp, Homo sapiens
cagccctcattaaactaat

SEQ ID NO: 1381618 - DNA, 11 bp, Homo sapiens
cagcctggatg

SEQ ID NO: 1381619 - DNA, 17 bp, Homo sapiens
cagctcagcattgtgta

SEQ ID NO: 1381620 - DNA, 16 bp, Homo sapiens
cagcttaataagtatt

SEQ ID NO: 1381621 - DNA, 14 bp, Homo sapiens
caggctgccagtgc

SEQ ID NO: 1381622 - DNA, 16 bp, Homo sapiens
caggctgccagtgcct

SEQ ID NO: 1381623 - DNA, 19 bp, Homo sapiens
caggctgccagtgcctggg

SEQ ID NO: 1381624 - DNA, 14 bp, Homo sapiens
cagggaaccagagc

SEQ ID NO: 1381625 - DNA, 12 bp, Homo sapiens
cagggcctctgc

SEQ ID NO: 1381626 - DNA, 15 bp, Homo sapiens
cagggcctctgcgga

SEQ ID NO: 1381627 - DNA, 21 bp, Homo sapiens
cagggcctctgcggagcacac

SEQ ID NO: 1381628 - DNA, 24 bp, Homo sapiens
cagtagagggtccagtcttctagt

SEQ ID NO: 1381629 - DNA, 12 bp, Homo sapiens
cagtgcctctcc

SEQ ID NO: 1381630 - DNA, 18 bp, Homo sapiens
cagtgctcacccacacca

SEQ ID NO: 1381631 - DNA, 19 bp, Homo sapiens
cagtgctcacccacaccat

SEQ ID NO: 1381632 - DNA, 21 bp, Homo sapiens
cagtgtactctgagtcctcat

SEQ ID NO: 1381633 - DNA, 21 bp, Homo sapiens
cagttccctcagccctcatta

SEQ ID NO: 1381634 - DNA, 12 bp, Homo sapiens
cagtttgtgatc

SEQ ID NO: 1381635 - DNA, 15 bp, Homo sapiens
cataaacaaagagta

SEQ ID NO: 1381636 - DNA, 15 bp, Homo sapiens
catacgcactgggca

SEQ ID NO: 1381637 - DNA, 21 bp, Homo sapiens
catcctcttatatgtgcccct

SEQ ID NO: 1381638 - DNA, 16 bp, Homo sapiens
tagaactttaaaagaa

SEQ ID NO: 1381639 - DNA, 19 bp, Homo sapiens
taggtctatgatgtccaaa

SEQ ID NO: 1381640 - DNA, 13 bp, Homo sapiens
tatcatgcttcta

SEQ ID NO: 1381641 - DNA, 18 bp, Homo sapiens
tatgatgtccaaacttaa

SEQ ID NO: 1381642 - DNA, 19 bp, Homo sapiens
tatgtgccccttccccatg

SEQ ID NO: 1381643 - DNA, 22 bp, Homo sapiens
tatttgaagcatgctctgtaag

SEQ ID NO: 1381644 - DNA, 17 bp, Homo sapiens
tatttttcaattttgaa

SEQ ID NO: 1381645 - DNA, 17 bp, Homo sapiens
tcaaaatgtggaccagt

SEQ ID NO: 1381646 - DNA, 21 bp, Homo sapiens
tcaaataaccctgaatcagag

SEQ ID NO: 1381647 - DNA, 20 bp, Homo sapiens
tcaacctactttcatactga

SEQ ID NO: 1381648 - DNA, 20 bp, Homo sapiens
tcactccccaacccccaact

SEQ ID NO: 1381649 - DNA, 21 bp, Homo sapiens
tcagaaaagcacctcttgaag

SEQ ID NO: 1381650 - DNA, 17 bp, Homo sapiens
tcagcagcggcagcagc

SEQ ID NO: 1381651 - DNA, 11 bp, Homo sapiens
tcatacacaga

SEQ ID NO: 1381652 - DNA, 18 bp, Homo sapiens
tcatgttggtaccctgga

SEQ ID NO: 1381653 - DNA, 17 bp, Homo sapiens
tccaagctcactcccca

SEQ ID NO: 1381654 - DNA, 22 bp, Homo sapiens
tccaagctcactccccaacccc

SEQ ID NO: 1381655 - DNA, 15 bp, Homo sapiens
tccagaagcagcagc

SEQ ID NO: 1381656 - DNA, 22 bp, Homo sapiens
tccagctgctgagatcctggac

SEQ ID NO: 1381657 - DNA, 16 bp, Homo sapiens
tccaggagatgaggct

SEQ ID NO: 1381658 - DNA, 16 bp, Homo sapiens
tccagggaaccagagc

SEQ ID NO: 1381659 - DNA, 16 bp, Homo sapiens
tccatcaaagccctcc

SEQ ID NO: 1381660 - DNA, 17 bp, Homo sapiens
tccatggtgaactgaag

SEQ ID NO: 1381661 - DNA, 23 bp, Homo sapiens
tccatggtgaactgaagcagagt

SEQ ID NO: 1381662 - DNA, 12 bp, Homo sapiens
tcccaagtgcca

SEQ ID NO: 1381663 - DNA, 15 bp, Homo sapiens
tcccaagtgccaaag

SEQ ID NO: 1381664 - DNA, 23 bp, Homo sapiens
tcccaagtgccaaagaagcagac

SEQ ID NO: 1381665 - DNA, 15 bp, Homo sapiens
tcccctgcccatgct

SEQ ID NO: 1381666 - DNA, 18 bp, Homo sapiens
tccctgctgctcctagga

SEQ ID NO: 1381667 - DNA, 16 bp, Homo sapiens
tcccttgattcaaata

SEQ ID NO: 1381668 - DNA, 20 bp, Homo sapiens
tcctaggacccgtctccagc

SEQ ID NO: 1381669 - DNA, 17 bp, Homo sapiens
tcctcaattccagggaa

SEQ ID NO: 1381670 - DNA, 18 bp, Homo sapiens
tcctcttaatgtctcaaa

SEQ ID NO: 1381671 - DNA, 22 bp, Homo sapiens
tcctggcccagggcatctggga

SEQ ID NO: 1381672 - DNA, 23 bp, Homo sapiens
tctatgatgtccaaacttaacag

SEQ ID NO: 1381673 - DNA, 11 bp, Homo sapiens
tctcattccca

SEQ ID NO: 1381674 - DNA, 18 bp, Homo sapiens
tctccctgctgctcctag

SEQ ID NO: 1381675 - DNA, 21 bp, Homo sapiens
tctgatgatgttctgaaatgg

SEQ ID NO: 1381676 - DNA, 14 bp, Homo sapiens
tctgcggagcacac

SEQ ID NO: 1381677 - DNA, 21 bp, Homo sapiens
tctgcggagcacactggctca

SEQ ID NO: 1381678 - DNA, 20 bp, Homo sapiens
tctgcgggggcagtgctcac

SEQ ID NO: 1381679 - DNA, 22 bp, Homo sapiens
tctgtccttccaacctgttcac

SEQ ID NO: 1381680 - DNA, 18 bp, Homo sapiens
tcttgaatgcttaaatga

SEQ ID NO: 1381681 - DNA, 15 bp, Homo sapiens
tcttgagcagctgaa

SEQ ID NO: 1381682 - DNA, 15 bp, Homo sapiens
tcttgcatggtttgg

SEQ ID NO: 1381683 - DNA, 14 bp, Homo sapiens
tgaactgaagcaga

SEQ ID NO: 1381684 - DNA, 16 bp, Homo sapiens
tgaagaggaaaatgaa

SEQ ID NO: 1381685 - DNA, 19 bp, Homo sapiens
tgaagaggaaaatgaataa

SEQ ID NO: 1381686 - DNA, 12 bp, Homo sapiens
tgaagcagagtc

SEQ ID NO: 1381687 - DNA, 16 bp, Homo sapiens
tgaagcagagtcaagc

SEQ ID NO: 1381688 - DNA, 20 bp, Homo sapiens
tgaagcagagtcaagctgat

SEQ ID NO: 1381689 - DNA, 23 bp, Homo sapiens
tgaagcagagtcaagctgatgaa

SEQ ID NO: 1381690 - DNA, 19 bp, Homo sapiens
tgaatcagaggcagagacc

SEQ ID NO: 1381691 - DNA, 14 bp, Homo sapiens
gctcccacctggct

SEQ ID NO: 1381692 - DNA, 16 bp, Homo sapiens
gctcccacctggctct

SEQ ID NO: 1381693 - DNA, 17 bp, Homo sapiens
gctcccagccaggccct

SEQ ID NO: 1381694 - DNA, 17 bp, Homo sapiens
gctccctcatgcagata

SEQ ID NO: 1381695 - DNA, 14 bp, Homo sapiens
gctgagcacatctc

SEQ ID NO: 1381696 - DNA, 22 bp, Homo sapiens
gctgctcctaggacccgtctcc

SEQ ID NO: 1381697 - DNA, 18 bp, Homo sapiens
gctgctgagatcctggac

SEQ ID NO: 1381698 - DNA, 23 bp, Homo sapiens
gctgctgcccctgcacagcaggc

SEQ ID NO: 1381699 - DNA, 21 bp, Homo sapiens
ggaaaagagatggcctgagaa

SEQ ID NO: 1381700 - DNA, 21 bp, Homo sapiens
ggagatgccatgagccgccca

SEQ ID NO: 1381701 - DNA, 20 bp, Homo sapiens
ggagcccacgctcaccccct

SEQ ID NO: 1381702 - DNA, 22 bp, Homo sapiens
ggagctgatcgcttctccccca

SEQ ID NO: 1381703 - DNA, 17 bp, Homo sapiens
ggcaaacagggcctctg

SEQ ID NO: 1381704 - DNA, 18 bp, Homo sapiens
ggcaaacagggcctctgc

SEQ ID NO: 1381705 - DNA, 21 bp, Homo sapiens
ggcaaaccaatttgttctgtg

SEQ ID NO: 1381706 - DNA, 16 bp, Homo sapiens
ggcagagacctcctga

SEQ ID NO: 1381707 - DNA, 14 bp, Homo sapiens
ggcagcagcagcag

SEQ ID NO: 1381708 - DNA, 19 bp, Homo sapiens
ggcagtgctcacccacacc

SEQ ID NO: 1381709 - DNA, 16 bp, Homo sapiens
ggccaccgccttgccc

SEQ ID NO: 1381710 - DNA, 12 bp, Homo sapiens
ggcccagggcat

SEQ ID NO: 1381711 - DNA, 16 bp, Homo sapiens
ggccccaccagtgcct

SEQ ID NO: 1381712 - DNA, 14 bp, Homo sapiens
ggccctccagagcc

SEQ ID NO: 1381713 - DNA, 14 bp, Homo sapiens
ggccttcccctggc

SEQ ID NO: 1381714 - DNA, 20 bp, Homo sapiens
ggccttcccctggcactggc

SEQ ID NO: 1381715 - DNA, 21 bp, Homo sapiens
ggcgagccatttgtcccaagt

SEQ ID NO: 1381716 - DNA, 15 bp, Homo sapiens
ggctcccagccaggc

SEQ ID NO: 1381717 - DNA, 22 bp, Homo sapiens
ggctgccaagagtccaagccat

SEQ ID NO: 1381718 - DNA, 14 bp, Homo sapiens
ggctgccagtgcct

SEQ ID NO: 1381719 - DNA, 17 bp, Homo sapiens
ggctgccagtgcctggg

SEQ ID NO: 1381720 - DNA, 11 bp, Homo sapiens
ggctgctccca

SEQ ID NO: 1381721 - DNA, 12 bp, Homo sapiens
ggctgctcccac

SEQ ID NO: 1381722 - DNA, 15 bp, Homo sapiens
ggctgctcccacctg

SEQ ID NO: 1381723 - DNA, 19 bp, Homo sapiens
ggctgctcccacctggctc

SEQ ID NO: 1381724 - DNA, 22 bp, Homo sapiens
ggctgctcccacctggctctgt

SEQ ID NO: 1381725 - DNA, 22 bp, Homo sapiens
gggactccagaagcagcagcta

SEQ ID NO: 1381726 - DNA, 20 bp, Homo sapiens
gggcagtgctcacccacacc

SEQ ID NO: 1381727 - DNA, 15 bp, Homo sapiens
gggctcccagccagg

SEQ ID NO: 1381728 - DNA, 17 bp, Homo sapiens
gggctcccagccaggcc

SEQ ID NO: 1381729 - DNA, 20 bp, Homo sapiens
ggggcagtgctcacccacac

SEQ ID NO: 1381730 - DNA, 12 bp, Homo sapiens
ggggcctggatg

SEQ ID NO: 1381731 - DNA, 13 bp, Homo sapiens
ggggctcccagcc

SEQ ID NO: 1381732 - DNA, 18 bp, Homo sapiens
ggggctgctcccacctgg

SEQ ID NO: 1381733 - DNA, 22 bp, Homo sapiens
gggtaagggactccagaagcag

SEQ ID NO: 1381734 - DNA, 16 bp, Homo sapiens
ggtaagcaacatggct

SEQ ID NO: 1381735 - DNA, 16 bp, Homo sapiens
ggtaagggactccaga

SEQ ID NO: 1381736 - DNA, 21 bp, Homo sapiens
ggtccaggagatgaggctgga

SEQ ID NO: 1381737 - DNA, 17 bp, Homo sapiens
ggtgaactgaagcagag

SEQ ID NO: 1381738 - DNA, 20 bp, Homo sapiens
ggtgaactgaagcagagtca

SEQ ID NO: 1381739 - DNA, 19 bp, Homo sapiens
ggtttccatcaaagccctc

SEQ ID NO: 1381740 - DNA, 21 bp, Homo sapiens
gtaagggactccagaagcagc

SEQ ID NO: 1381741 - DNA, 17 bp, Homo sapiens
gtacaataaataaaaga

SEQ ID NO: 1381742 - DNA, 19 bp, Homo sapiens
gtactctgagtcctcattg

SEQ ID NO: 1381743 - DNA, 17 bp, Homo sapiens
gtagaactttaaaagaa

SEQ ID NO: 1381744 - DNA, 16 bp, Homo sapiens
gtagagtcaggagaaa

SEQ ID NO: 1381745 - DNA, 16 bp, Homo sapiens
gtaggtctatgatgtc

SEQ ID NO: 1381746 - DNA, 13 bp, Homo sapiens
ctttgaagaggaa

SEQ ID NO: 1381747 - DNA, 20 bp, Homo sapiens
ctttgaagaggaaaatgaat

SEQ ID NO: 1381748 - DNA, 22 bp, Homo sapiens
ctttgcacactttggcccaggg

SEQ ID NO: 1381749 - DNA, 13 bp, Homo sapiens
ctttggcccaggg

SEQ ID NO: 1381750 - DNA, 20 bp, Homo sapiens
cttttcatggagtagagtca

SEQ ID NO: 1381751 - DNA, 14 bp, Homo sapiens
cttttgctctctca

SEQ ID NO: 1381752 - DNA, 19 bp, Homo sapiens
gaaaaggcttgagtctgga

SEQ ID NO: 1381753 - DNA, 20 bp, Homo sapiens
gaaaaggcttgagtctggat

SEQ ID NO: 1381754 - DNA, 13 bp, Homo sapiens
gaaaatgaataat

SEQ ID NO: 1381755 - DNA, 17 bp, Homo sapiens
gaaacataaataaaatg

SEQ ID NO: 1381756 - DNA, 22 bp, Homo sapiens
gaaacataaataaaatgaccag

SEQ ID NO: 1381757 - DNA, 11 bp, Homo sapiens
gaaagaggaat

SEQ ID NO: 1381758 - DNA, 14 bp, Homo sapiens
gaaaggagaggaaa

SEQ ID NO: 1381759 - DNA, 18 bp, Homo sapiens
gaaatggatagattgttt

SEQ ID NO: 1381760 - DNA, 22 bp, Homo sapiens
gaaccagagcgatgtgttcttt

SEQ ID NO: 1381761 - DNA, 22 bp, Homo sapiens
gaaccgagggggctgctcccac

SEQ ID NO: 1381762 - DNA, 16 bp, Homo sapiens
gaactgaagcagagtc

SEQ ID NO: 1381763 - DNA, 19 bp, Homo sapiens
gaagagagatcaaatggaa

SEQ ID NO: 1381764 - DNA, 14 bp, Homo sapiens
gaagaggaaaatga

SEQ ID NO: 1381765 - DNA, 21 bp, Homo sapiens
gaataccccaagactcccatg

SEQ ID NO: 1381766 - DNA, 19 bp, Homo sapiens
gaccattggggctcccagc

SEQ ID NO: 1381767 - DNA, 15 bp, Homo sapiens
gaccccactccggcc

SEQ ID NO: 1381768 - DNA, 14 bp, Homo sapiens
gacccgtctccagc

SEQ ID NO: 1381769 - DNA, 20 bp, Homo sapiens
gactcctcaattccagggaa

SEQ ID NO: 1381770 - DNA, 21 bp, Homo sapiens
gactctaaaactatcagcagc

SEQ ID NO: 1381771 - DNA, 16 bp, Homo sapiens
gactgaatggactttg

SEQ ID NO: 1381772 - DNA, 15 bp, Homo sapiens
gagaaaaagccctct

SEQ ID NO: 1381773 - DNA, 23 bp, Homo sapiens
gagatcaaatggaaaggagagga

SEQ ID NO: 1381774 - DNA, 15 bp, Homo sapiens
gagccatttgtccca

SEQ ID NO: 1381775 - DNA, 16 bp, Homo sapiens
gagccatttgtcccaa

SEQ ID NO: 1381776 - DNA, 14 bp, Homo sapiens
gagccccacagccc

SEQ ID NO: 1381777 - DNA, 16 bp, Homo sapiens
gagccgcccaaggcct

SEQ ID NO: 1381778 - DNA, 16 bp, Homo sapiens
gagctgatcgcttctc

SEQ ID NO: 1381779 - DNA, 21 bp, Homo sapiens
gaggaaaaggcttgagtctgg

SEQ ID NO: 1381780 - DNA, 20 bp, Homo sapiens
gaggctggataggagaggaa

SEQ ID NO: 1381781 - DNA, 15 bp, Homo sapiens
gagggggcctggatg

SEQ ID NO: 1381782 - DNA, 15 bp, Homo sapiens
gagggggctgctccc

SEQ ID NO: 1381783 - DNA, 21 bp, Homo sapiens
gagtcctcattgttcagaaaa

SEQ ID NO: 1381784 - DNA, 22 bp, Homo sapiens
gagtcctcattgttcagaaaag

SEQ ID NO: 1381785 - DNA, 23 bp, Homo sapiens
gagttgtgtgaataccccaagac

SEQ ID NO: 1381786 - DNA, 17 bp, Homo sapiens
gataggagaggaaaagg

SEQ ID NO: 1381787 - DNA, 14 bp, Homo sapiens
gatctcctgtgcac

SEQ ID NO: 1381788 - DNA, 12 bp, Homo sapiens
gatctgtccttc

SEQ ID NO: 1381789 - DNA, 14 bp, Homo sapiens
gatctgtccttcca

SEQ ID NO: 1381790 - DNA, 15 bp, Homo sapiens
gatgatgttctgaaa

SEQ ID NO: 1381791 - DNA, 22 bp, Homo sapiens
gatgccatgagccgcccaaggc

SEQ ID NO: 1381792 - DNA, 12 bp, Homo sapiens
gatgtgttcttt

SEQ ID NO: 1381793 - DNA, 13 bp, Homo sapiens
gcaaacagggcct

SEQ ID NO: 1381794 - DNA, 19 bp, Homo sapiens
gcaaaccaatttgttctgt

SEQ ID NO: 1381795 - DNA, 18 bp, Homo sapiens
gcacactttggcccaggg

SEQ ID NO: 1381796 - DNA, 13 bp, Homo sapiens
gcacctcttgaag

SEQ ID NO: 1381797 - DNA, 20 bp, Homo sapiens
gcactggcaaacagggcctc

SEQ ID NO: 1381798 - DNA, 23 bp, Homo sapiens
gcactggcaaacagggcctctgc

SEQ ID NO: 1381799 - DNA, 22 bp, Homo sapiens
gcagagtcaagctgatgaagtt

SEQ ID NO: 1381800 - DNA, 15 bp, Homo sapiens
gcagcagcagcagca

SEQ ID NO: 1381801 - DNA, 13 bp, Homo sapiens
gcagcctcttgaa

SEQ ID NO: 1381802 - DNA, 20 bp, Homo sapiens
ccaccagtgcctctccctgc

SEQ ID NO: 1381803 - DNA, 16 bp, Homo sapiens
ccaccgccttgcccag

SEQ ID NO: 1381804 - DNA, 14 bp, Homo sapiens
ccacctggctctgt

SEQ ID NO: 1381805 - DNA, 20 bp, Homo sapiens
ccactccggccctccagagc

SEQ ID NO: 1381806 - DNA, 22 bp, Homo sapiens
ccactccggccctccagagccc

SEQ ID NO: 1381807 - DNA, 13 bp, Homo sapiens
ccagaaagaggaa

SEQ ID NO: 1381808 - DNA, 14 bp, Homo sapiens
ccagaaagaggaat

SEQ ID NO: 1381809 - DNA, 22 bp, Homo sapiens
ccagaaagaggaataaaatgat

SEQ ID NO: 1381810 - DNA, 16 bp, Homo sapiens
ccagagccccacagcc

SEQ ID NO: 1381811 - DNA, 21 bp, Homo sapiens
ccagagcgatgtgttctttgt

SEQ ID NO: 1381812 - DNA, 20 bp, Homo sapiens
ccagctgctgagatcctgga

SEQ ID NO: 1381813 - DNA, 23 bp, Homo sapiens
ccagctgctgagatcctggactg

SEQ ID NO: 1381814 - DNA, 15 bp, Homo sapiens
ccagggcatctggga

SEQ ID NO: 1381815 - DNA, 22 bp, Homo sapiens
ccaggtatctgatgatgttctg

SEQ ID NO: 1381816 - DNA, 17 bp, Homo sapiens
ccagtacaataaataaa

SEQ ID NO: 1381817 - DNA, 21 bp, Homo sapiens
ccagtgcctctccctgctgct

SEQ ID NO: 1381818 - DNA, 23 bp, Homo sapiens
ccagttccctcagccctcattaa

SEQ ID NO: 1381819 - DNA, 17 bp, Homo sapiens
ccataagctactgccat

SEQ ID NO: 1381820 - DNA, 18 bp, Homo sapiens
ccataagctactgccatc

SEQ ID NO: 1381821 - DNA, 21 bp, Homo sapiens
ccataagctactgccatcctg

SEQ ID NO: 1381822 - DNA, 20 bp, Homo sapiens
ccatcctggcccagggcatc

SEQ ID NO: 1381823 - DNA, 22 bp, Homo sapiens
ccatctgcgggggcagtgctca

SEQ ID NO: 1381824 - DNA, 21 bp, Homo sapiens
ccatgagggagatgccatgag

SEQ ID NO: 1381825 - DNA, 16 bp, Homo sapiens
ccatgctcagctcagc

SEQ ID NO: 1381826 - DNA, 15 bp, Homo sapiens
ccattggggctccca

SEQ ID NO: 1381827 - DNA, 16 bp, Homo sapiens
ccattggggctcccag

SEQ ID NO: 1381828 - DNA, 15 bp, Homo sapiens
cccaagtgccaaaga

SEQ ID NO: 1381829 - DNA, 21 bp, Homo sapiens
cccacaagtgccctccaggct

SEQ ID NO: 1381830 - DNA, 21 bp, Homo sapiens
cccacaccataagctactgcc

SEQ ID NO: 1381831 - DNA, 15 bp, Homo sapiens
cccaccagtgcctct

SEQ ID NO: 1381832 - DNA, 14 bp, Homo sapiens
cccacctggctctg

SEQ ID NO: 1381833 - DNA, 19 bp, Homo sapiens
cccactccggccctccaga

SEQ ID NO: 1381834 - DNA, 17 bp, Homo sapiens
cccagggcatctgggag

SEQ ID NO: 1381835 - DNA, 13 bp, Homo sapiens
cccagggtggcca

SEQ ID NO: 1381836 - DNA, 21 bp, Homo sapiens
cccatctgcgggggcagtgct

SEQ ID NO: 1381837 - DNA, 20 bp, Homo sapiens
cccatgagggagatgccatg

SEQ ID NO: 1381838 - DNA, 12 bp, Homo sapiens
ccccacagcccc

SEQ ID NO: 1381839 - DNA, 15 bp, Homo sapiens
ccccaccagtgcctc

SEQ ID NO: 1381840 - DNA, 24 bp, Homo sapiens
ccccatctgcgggggcagtgctca

SEQ ID NO: 1381841 - DNA, 20 bp, Homo sapiens
ccccctgtggatgctgctgc

SEQ ID NO: 1381842 - DNA, 21 bp, Homo sapiens
cccctgcacagcaggctgcca

SEQ ID NO: 1381843 - DNA, 23 bp, Homo sapiens
cccctgcacagcaggctgccagt

SEQ ID NO: 1381844 - DNA, 16 bp, Homo sapiens
cccctggcactggcaa

SEQ ID NO: 1381845 - DNA, 20 bp, Homo sapiens
cccctgtggatgctgctgcc

SEQ ID NO: 1381846 - DNA, 18 bp, Homo sapiens
cccggctttggtgcgggg

SEQ ID NO: 1381847 - DNA, 13 bp, Homo sapiens
cccgtctccagct

SEQ ID NO: 1381848 - DNA, 17 bp, Homo sapiens
ccctcagccctcattaa

SEQ ID NO: 1381849 - DNA, 21 bp, Homo sapiens
ccctccagagccccacagccc

SEQ ID NO: 1381850 - DNA, 14 bp, Homo sapiens
ccctgcacagcagg

SEQ ID NO: 1381851 - DNA, 21 bp, Homo sapiens
ccctgcacagcaggctgccag

SEQ ID NO: 1381852 - DNA, 12 bp, Homo sapiens
ccctgctgctcc

SEQ ID NO: 1381853 - DNA, 20 bp, Homo sapiens
ccctggcactggcaaacagg

SEQ ID NO: 1381854 - DNA, 19 bp, Homo sapiens
ccctgtctgtctgtctctc

SEQ ID NO: 1381855 - DNA, 21 bp, Homo sapiens
ccctgtctgtctgtctctctt

SEQ ID NO: 1381856 - DNA, 22 bp, Homo sapiens
cccttgtcggccccaccagtgc

SEQ ID NO: 1381857 - DNA, 18 bp, Homo sapiens
ccgagggggctgctccca

SEQ ID NO: 1381858 - DNA, 13 bp, Homo sapiens
ccgcccaaggcct

SEQ ID NO: 1381859 - DNA, 15 bp, Homo sapiens
ccgccttgcccagcc

SEQ ID NO: 1381860 - DNA, 17 bp, Homo sapiens
tggaaaggagaggaaag

SEQ ID NO: 1381861 - DNA, 19 bp, Homo sapiens
tggaaaggagaggaaagaa

SEQ ID NO: 1381862 - DNA, 16 bp, Homo sapiens
tggacagtgcctaact

SEQ ID NO: 1381863 - DNA, 22 bp, Homo sapiens
tggacagtgcctaactccttac

SEQ ID NO: 1381864 - DNA, 22 bp, Homo sapiens
tggaccagttccctcagccctc

SEQ ID NO: 1381865 - DNA, 18 bp, Homo sapiens
tggactgagaaattatac

SEQ ID NO: 1381866 - DNA, 22 bp, Homo sapiens
tggactgagggggcctggatgc

SEQ ID NO: 1381867 - DNA, 14 bp, Homo sapiens
tggagtagagtcag

SEQ ID NO: 1381868 - DNA, 14 bp, Homo sapiens
tggatgtcccttcc

SEQ ID NO: 1381869 - DNA, 15 bp, Homo sapiens
tggcaaacagggcct

SEQ ID NO: 1381870 - DNA, 18 bp, Homo sapiens
tggcaaacagggcctctg

SEQ ID NO: 1381871 - DNA, 13 bp, Homo sapiens
tggcccagggcat

SEQ ID NO: 1381872 - DNA, 19 bp, Homo sapiens
tggcgagccatttgtccca

SEQ ID NO: 1381873 - DNA, 22 bp, Homo sapiens
tggcgagccatttgtcccaagt

SEQ ID NO: 1381874 - DNA, 20 bp, Homo sapiens
tggggctcccagccaggccc

SEQ ID NO: 1381875 - DNA, 21 bp, Homo sapiens
tggggctcccagccaggccct

SEQ ID NO: 1381876 - DNA, 13 bp, Homo sapiens
tgggtccaggaga

SEQ ID NO: 1381877 - DNA, 19 bp, Homo sapiens
tggtaagcaacatggcttt

SEQ ID NO: 1381878 - DNA, 21 bp, Homo sapiens
tggtgaactgaagcagagtca

SEQ ID NO: 1381879 - DNA, 22 bp, Homo sapiens
tgtataagatgctgctgagcac

SEQ ID NO: 1381880 - DNA, 14 bp, Homo sapiens
tgtcccaagtgcca

SEQ ID NO: 1381881 - DNA, 23 bp, Homo sapiens
tgtcggccccaccagtgcctctc

SEQ ID NO: 1381882 - DNA, 13 bp, Homo sapiens
tgtctcaaaataa

SEQ ID NO: 1381883 - DNA, 16 bp, Homo sapiens
tgtgatctgtccttcc

SEQ ID NO: 1381884 - DNA, 19 bp, Homo sapiens
tgtgattcctttgaagagg

SEQ ID NO: 1381885 - DNA, 20 bp, Homo sapiens
tgtgattcctttgaagagga

SEQ ID NO: 1381886 - DNA, 13 bp, Homo sapiens
tgtgccccttccc

SEQ ID NO: 1381887 - DNA, 14 bp, Homo sapiens
tgtgccccttcccc

SEQ ID NO: 1381888 - DNA, 18 bp, Homo sapiens
tgtgccccttccccatgc

SEQ ID NO: 1381889 - DNA, 12 bp, Homo sapiens
tgtggcgagcca

SEQ ID NO: 1381890 - DNA, 21 bp, Homo sapiens
tgtgtaatttcctgctcctcc

SEQ ID NO: 1381891 - DNA, 14 bp, Homo sapiens
tgttagttcacttc

SEQ ID NO: 1381892 - DNA, 15 bp, Homo sapiens
tgttcacgtgactcc

SEQ ID NO: 1381893 - DNA, 12 bp, Homo sapiens
tgttctgtgcaa

SEQ ID NO: 1381894 - DNA, 16 bp, Homo sapiens
tgttcttgagcagctg

SEQ ID NO: 1381895 - DNA, 21 bp, Homo sapiens
tgttcttgagcagctgaattg

SEQ ID NO: 1381896 - DNA, 19 bp, Homo sapiens
tgtttagtcagtgtactct

SEQ ID NO: 1381897 - DNA, 22 bp, Homo sapiens
tgtttagtcagtgtactctgag

SEQ ID NO: 1381898 - DNA, 17 bp, Homo sapiens
ttaataggcttgtgtaa

SEQ ID NO: 1381899 - DNA, 18 bp, Homo sapiens
ttaatgtttagtcagtgt

SEQ ID NO: 1381900 - DNA, 21 bp, Homo sapiens
ttaatgtttagtcagtgtact

SEQ ID NO: 1381901 - DNA, 17 bp, Homo sapiens
ttagaagaaatatgagc

SEQ ID NO: 1381902 - DNA, 11 bp, Homo sapiens
ttatcctctgt

SEQ ID NO: 1381903 - DNA, 15 bp, Homo sapiens
ttcaaataaccctga

SEQ ID NO: 1381904 - DNA, 22 bp, Homo sapiens
ttcaaataaccctgaatcagag

SEQ ID NO: 1381905 - DNA, 15 bp, Homo sapiens
ttcacttcagcttaa

SEQ ID NO: 1381906 - DNA, 19 bp, Homo sapiens
ttcctcttaatgtctcaaa

SEQ ID NO: 1381907 - DNA, 15 bp, Homo sapiens
ttcctttgaagagga

SEQ ID NO: 1381908 - DNA, 21 bp, Homo sapiens
ttgaagaggaaaatgaataat

SEQ ID NO: 1381909 - DNA, 19 bp, Homo sapiens
ttgaagcatgctctgtaag

SEQ ID NO: 1381910 - DNA, 15 bp, Homo sapiens
ttgaggccaaatgag

SEQ ID NO: 1381911 - DNA, 21 bp, Homo sapiens
ttgcacactttggcccagggt

SEQ ID NO: 1381912 - DNA, 12 bp, Homo sapiens
aaaaagccctct

SEQ ID NO: 1381913 - DNA, 16 bp, Homo sapiens
aaaagcacctcttgaa

SEQ ID NO: 1381914 - DNA, 17 bp, Homo sapiens
aaacataaataaaatga

SEQ ID NO: 1381915 - DNA, 17 bp, Homo sapiens
aaaccaatttgttctgt

SEQ ID NO: 1381916 - DNA, 12 bp, Homo sapiens
aaaccagaaaga

SEQ ID NO: 1381917 - DNA, 20 bp, Homo sapiens
aaacctctttcggaaatgat

SEQ ID NO: 1381918 - DNA, 13 bp, Homo sapiens
aaagaagcagacc

SEQ ID NO: 1381919 - DNA, 18 bp, Homo sapiens
aaagagatggcctgagaa

SEQ ID NO: 1381920 - DNA, 18 bp, Homo sapiens
aaagatctcctgtgcacc

SEQ ID NO: 1381921 - DNA, 15 bp, Homo sapiens
aaagccctccctgtc

SEQ ID NO: 1381922 - DNA, 19 bp, Homo sapiens
aaaggcaaaccaatttgtt

SEQ ID NO: 1381923 - DNA, 22 bp, Homo sapiens
aaataaaaccagaaagaggaat

SEQ ID NO: 1381924 - DNA, 11 bp, Homo sapiens
aaataaaagaa

SEQ ID NO: 1381925 - DNA, 14 bp, Homo sapiens
aaataaaatgacca

SEQ ID NO: 1381926 - DNA, 19 bp, Homo sapiens
aaatgaccagtaattgtga

SEQ ID NO: 1381927 - DNA, 21 bp, Homo sapiens
aaatgaccagtaattgtgaaa

SEQ ID NO: 1381928 - DNA, 20 bp, Homo sapiens
aaatgagttcccttgattca

SEQ ID NO: 1381929 - DNA, 21 bp, Homo sapiens
aaatgatcaaggagggagaaa

SEQ ID NO: 1381930 - DNA, 23 bp, Homo sapiens
aacagatcacatgcccctcttag

SEQ ID NO: 1381931 - DNA, 13 bp, Homo sapiens
aacatggctttga

SEQ ID NO: 1381932 - DNA, 15 bp, Homo sapiens
aaccaatttgttctg

SEQ ID NO: 1381933 - DNA, 12 bp, Homo sapiens
aactaaaattaa

SEQ ID NO: 1381934 - DNA, 16 bp, Homo sapiens
aactaattaaactgat

SEQ ID NO: 1381935 - DNA, 12 bp, Homo sapiens
aactccttacag

SEQ ID NO: 1381936 - DNA, 15 bp, Homo sapiens
aactgaagcagagtc

SEQ ID NO: 1381937 - DNA, 17 bp, Homo sapiens
aagagaaaaagccctct

SEQ ID NO: 1381938 - DNA, 16 bp, Homo sapiens
aagatctcctgtgcac

SEQ ID NO: 1381939 - DNA, 18 bp, Homo sapiens
aagatgctgctgagcaca

SEQ ID NO: 1381940 - DNA, 14 bp, Homo sapiens
aagcaacatggctt

SEQ ID NO: 1381941 - DNA, 15 bp, Homo sapiens
aagcaacatggcttt

SEQ ID NO: 1381942 - DNA, 17 bp, Homo sapiens
aagccctccctgtctgt

SEQ ID NO: 1381943 - DNA, 17 bp, Homo sapiens
aaggagaggaaagaact

SEQ ID NO: 1381944 - DNA, 16 bp, Homo sapiens
aagggagtgaaaacct

SEQ ID NO: 1381945 - DNA, 13 bp, Homo sapiens
aataaaaccagaa

SEQ ID NO: 1381946 - DNA, 18 bp, Homo sapiens
aataaccctgaatcagag

SEQ ID NO: 1381947 - DNA, 19 bp, Homo sapiens
aatgaccagtaattgtgaa

SEQ ID NO: 1381948 - DNA, 15 bp, Homo sapiens
aatggaaaggagagg

SEQ ID NO: 1381949 - DNA, 17 bp, Homo sapiens
aatgtgaatgggaaaag

SEQ ID NO: 1381950 - DNA, 21 bp, Homo sapiens
aatgtgattcctttgaagagg

SEQ ID NO: 1381951 - DNA, 12 bp, Homo sapiens
aattaaactgat

SEQ ID NO: 1381952 - DNA, 16 bp, Homo sapiens
aattaagtatatatat

SEQ ID NO: 1381953 - DNA, 12 bp, Homo sapiens
aatttgttctgt

SEQ ID NO: 1381954 - DNA, 16 bp, Homo sapiens
aatttgttctgtgcaa

SEQ ID NO: 1381955 - DNA, 15 bp, Homo sapiens
acaaatctatgccac

SEQ ID NO: 1381956 - DNA, 20 bp, Homo sapiens
acacatcataaacaaagagt

SEQ ID NO: 1381957 - DNA, 23 bp, Homo sapiens
acaccataagctactgccatcct

SEQ ID NO: 1381958 - DNA, 21 bp, Homo sapiens
acacctagactctaaaactat

SEQ ID NO: 1381959 - DNA, 20 bp, Homo sapiens
acactggctcacccagtcct

SEQ ID NO: 1381960 - DNA, 18 bp, Homo sapiens
acactttggcccagggtg

SEQ ID NO: 1381961 - DNA, 19 bp, Homo sapiens
acagatcacatgcccctct

SEQ ID NO: 1381962 - DNA, 15 bp, Homo sapiens
cctggcccagggcat

SEQ ID NO: 1381963 - DNA, 20 bp, Homo sapiens
cgagccatttgtcccaagtg

SEQ ID NO: 1381964 - DNA, 15 bp, Homo sapiens
cgagggggctgctcc

SEQ ID NO: 1381965 - DNA, 15 bp, Homo sapiens
cgccttgcccagcct

SEQ ID NO: 1381966 - DNA, 13 bp, Homo sapiens
cggccccaccagt

SEQ ID NO: 1381967 - DNA, 16 bp, Homo sapiens
cggccccaccagtgcc

SEQ ID NO: 1381968 - DNA, 16 bp, Homo sapiens
cggccctccagagccc

SEQ ID NO: 1381969 - DNA, 22 bp, Homo sapiens
ctaacatccttggactgagaaa

SEQ ID NO: 1381970 - DNA, 23 bp, Homo sapiens
ctaacatccttggactgagaaat

SEQ ID NO: 1381971 - DNA, 17 bp, Homo sapiens
ctaactccttacagaag

SEQ ID NO: 1381972 - DNA, 13 bp, Homo sapiens
ctaattaaactga

SEQ ID NO: 1381973 - DNA, 17 bp, Homo sapiens
ctactgccatcctggcc

SEQ ID NO: 1381974 - DNA, 20 bp, Homo sapiens
ctaggacccgtctccagctg

SEQ ID NO: 1381975 - DNA, 23 bp, Homo sapiens
ctaggacccgtctccagctgctg

SEQ ID NO: 1381976 - DNA, 23 bp, Homo sapiens
ctcaaaataaaaccagaaagagg

SEQ ID NO: 1381977 - DNA, 15 bp, Homo sapiens
ctcaattccagggaa

SEQ ID NO: 1381978 - DNA, 20 bp, Homo sapiens
ctcaattccagggaaccaga

SEQ ID NO: 1381979 - DNA, 13 bp, Homo sapiens
ctcacccacacca

SEQ ID NO: 1381980 - DNA, 15 bp, Homo sapiens
ctcacccagtcctgc

SEQ ID NO: 1381981 - DNA, 14 bp, Homo sapiens
ctcaccccctcacc

SEQ ID NO: 1381982 - DNA, 16 bp, Homo sapiens
ctcagacacctagact

SEQ ID NO: 1381983 - DNA, 22 bp, Homo sapiens
ctcattgttcagaaaagcacct

SEQ ID NO: 1381984 - DNA, 14 bp, Homo sapiens
ctccagaagcagca

SEQ ID NO: 1381985 - DNA, 16 bp, Homo sapiens
ctccagagccccacag

SEQ ID NO: 1381986 - DNA, 21 bp, Homo sapiens
ctccatggtgaactgaagcag

SEQ ID NO: 1381987 - DNA, 13 bp, Homo sapiens
ctcccacctggct

SEQ ID NO: 1381988 - DNA, 22 bp, Homo sapiens
ctcccacctggctctgtggcga

SEQ ID NO: 1381989 - DNA, 13 bp, Homo sapiens
ctcccagccaggc

SEQ ID NO: 1381990 - DNA, 18 bp, Homo sapiens
ctcccatgagggagatgc

SEQ ID NO: 1381991 - DNA, 12 bp, Homo sapiens
ctccttacagaa

SEQ ID NO: 1381992 - DNA, 22 bp, Homo sapiens
ctccttacagaagggagtgaaa

SEQ ID NO: 1381993 - DNA, 19 bp, Homo sapiens
ctcggaccccactccggcc

SEQ ID NO: 1381994 - DNA, 20 bp, Homo sapiens
ctctaaaactatcagcagcg

SEQ ID NO: 1381995 - DNA, 16 bp, Homo sapiens
ctctcattcccaggca

SEQ ID NO: 1381996 - DNA, 14 bp, Homo sapiens
ctctctcattccca

SEQ ID NO: 1381997 - DNA, 16 bp, Homo sapiens
ctcttgaatgcttaaa

SEQ ID NO: 1381998 - DNA, 17 bp, Homo sapiens
ctctttcggaaatgatt

SEQ ID NO: 1381999 - DNA, 22 bp, Homo sapiens
ctgaagatgcagcaaaatgtga

SEQ ID NO: 1382000 - DNA, 17 bp, Homo sapiens
ctgaatcagaggcagag

SEQ ID NO: 1382001 - DNA, 15 bp, Homo sapiens
ctgacaccttttcag

SEQ ID NO: 1382002 - DNA, 17 bp, Homo sapiens
ctgagatcctggactga

SEQ ID NO: 1382003 - DNA, 14 bp, Homo sapiens
ctgatcgcttctcc

SEQ ID NO: 1382004 - DNA, 19 bp, Homo sapiens
ctgatgaagttaagcacaa

SEQ ID NO: 1382005 - DNA, 18 bp, Homo sapiens
ctgatgggtatcatgctt

SEQ ID NO: 1382006 - DNA, 20 bp, Homo sapiens
ctgcacagcaggctgccagt

SEQ ID NO: 1382007 - DNA, 21 bp, Homo sapiens
ctgcacagcaggctgccagtg

SEQ ID NO: 1382008 - DNA, 16 bp, Homo sapiens
ctgccagtgcctgggt

SEQ ID NO: 1382009 - DNA, 17 bp, Homo sapiens
ctgccatcctggcccag

SEQ ID NO: 1382010 - DNA, 23 bp, Homo sapiens
ctgccatcctggcccagggcatc

SEQ ID NO: 1382011 - DNA, 21 bp, Homo sapiens
ctgcgggggcagtgctcaccc

SEQ ID NO: 1382012 - DNA, 16 bp, Homo sapiens
ctgctcccacctggct

SEQ ID NO: 1382013 - DNA, 17 bp, Homo sapiens
ctgctcccacctggctc

SEQ ID NO: 1382014 - DNA, 18 bp, Homo sapiens
ctgctcccacctggctct

SEQ ID NO: 1382015 - DNA, 14 bp, Homo sapiens
ctgctgcccctgca

SEQ ID NO: 1382016 - DNA, 15 bp, Homo sapiens
ctggacagtgcctaa

SEQ ID NO: 1382017 - DNA, 20 bp, Homo sapiens
ctggactgagggggcctgga

SEQ ID NO: 1382018 - DNA, 19 bp, Homo sapiens
ctggatgccccctgtggat

SEQ ID NO: 1382019 - DNA, 19 bp, Homo sapiens
ctggcaaacagggcctctg

SEQ ID NO: 1382020 - DNA, 20 bp, Homo sapiens
ctggcaaacagggcctctgc

SEQ ID NO: 1382021 - DNA, 23 bp, Homo sapiens
ctggcaaacagggcctctgcgga

SEQ ID NO: 1382022 - DNA, 13 bp, Homo sapiens
ctggcccagggca

SEQ ID NO: 1382023 - DNA, 18 bp, Homo sapiens
ctggcccagggcatctgg

SEQ ID NO: 1382024 - DNA, 13 bp, Homo sapiens
ctggctcacccag

SEQ ID NO: 1382025 - DNA, 12 bp, Homo sapiens
ctgggaggaacc

SEQ ID NO: 1382026 - DNA, 13 bp, Homo sapiens
ctggggtctgtga

SEQ ID NO: 1382027 - DNA, 16 bp, Homo sapiens
ctgtctgtctctcttt

SEQ ID NO: 1382028 - DNA, 15 bp, Homo sapiens
ctgttcacgtgactc

SEQ ID NO: 1382029 - DNA, 18 bp, Homo sapiens
ctgttcacgtgactcctc

SEQ ID NO: 1382030 - DNA, 20 bp, Homo sapiens
ctgttcacgtgactcctcaa

SEQ ID NO: 1382031 - DNA, 21 bp, Homo sapiens
ctgttcacgtgactcctcaat

SEQ ID NO: 1382032 - DNA, 16 bp, Homo sapiens
cttaaacattgcctta

SEQ ID NO: 1382033 - DNA, 16 bp, Homo sapiens
cttatatgtgcccctt

SEQ ID NO: 1382034 - DNA, 13 bp, Homo sapiens
cttccccatgctc

SEQ ID NO: 1382035 - DNA, 17 bp, Homo sapiens
cttcccctggcactggc

SEQ ID NO: 1382036 - DNA, 16 bp, Homo sapiens
cttgagcagctgaatt

SEQ ID NO: 1382037 - DNA, 18 bp, Homo sapiens
cttgcatggtttggagct

SEQ ID NO: 1382038 - DNA, 22 bp, Homo sapiens
cttgcatggtttggagctgatc

SEQ ID NO: 1382039 - DNA, 18 bp, Homo sapiens
cttgcccagcctggatgc

SEQ ID NO: 1382040 - DNA, 22 bp, Homo sapiens
cttggtttccatcaaagccctc

SEQ ID NO: 1382041 - DNA, 23 bp, Homo sapiens
cttggtttccatcaaagccctcc

SEQ ID NO: 1382042 - DNA, 15 bp, Homo sapiens
cttgtcggccccacc

SEQ ID NO: 1382043 - DNA, 21 bp, Homo sapiens
cttgtcggccccaccagtgcc

SEQ ID NO: 1382044 - DNA, 18 bp, Homo sapiens
cttgtgtaatttcctgct

SEQ ID NO: 1382045 - DNA, 16 bp, Homo sapiens
ctttaaaaaaatccca

SEQ ID NO: 1382046 - DNA, 19 bp, Homo sapiens
ctttaggtaaaaagcttaa

SEQ ID NO: 1382047 - DNA, 18 bp, Homo sapiens
ctttgaagaggaaaatga

SEQ ID NO: 1382048 - DNA, 15 bp, Homo sapiens
ctttgcacactttgg

SEQ ID NO: 1382049 - DNA, 19 bp, Homo sapiens
ctttgcacactttggccca

SEQ ID NO: 1382050 - DNA, 16 bp, Homo sapiens
aaaactatcagcagcg

SEQ ID NO: 1382051 - DNA, 19 bp, Homo sapiens
aaaagagatggcctgagaa

SEQ ID NO: 1382052 - DNA, 19 bp, Homo sapiens
aaaataaaaccagaaagag

SEQ ID NO: 1382053 - DNA, 19 bp, Homo sapiens
aaaatgaccagtaattgtg

SEQ ID NO: 1382054 - DNA, 13 bp, Homo sapiens
aaacataaataaa

SEQ ID NO: 1382055 - DNA, 14 bp, Homo sapiens
aaacataaataaaa

SEQ ID NO: 1382056 - DNA, 20 bp, Homo sapiens
aaaccagaaagaggaataaa

SEQ ID NO: 1382057 - DNA, 12 bp, Homo sapiens
aaacccctgaca

SEQ ID NO: 1382058 - DNA, 13 bp, Homo sapiens
aaactaattaaac

SEQ ID NO: 1382059 - DNA, 17 bp, Homo sapiens
aaactatcagcagcggc

SEQ ID NO: 1382060 - DNA, 15 bp, Homo sapiens
aaacttaacagatca

SEQ ID NO: 1382061 - DNA, 16 bp, Homo sapiens
aaagaagcagaccatt

SEQ ID NO: 1382062 - DNA, 22 bp, Homo sapiens
aaagagtagaactttaaaagaa

SEQ ID NO: 1382063 - DNA, 14 bp, Homo sapiens
aaagatctcctgtg

SEQ ID NO: 1382064 - DNA, 17 bp, Homo sapiens
aaagccctccctgtctg

SEQ ID NO: 1382065 - DNA, 18 bp, Homo sapiens
aaagccctccctgtctgt

SEQ ID NO: 1382066 - DNA, 14 bp, Homo sapiens
aaataaaagaaaga

SEQ ID NO: 1382067 - DNA, 14 bp, Homo sapiens
aaatctatgccact

SEQ ID NO: 1382068 - DNA, 20 bp, Homo sapiens
aaatctatgccactcagaat

SEQ ID NO: 1382069 - DNA, 17 bp, Homo sapiens
aaatggatagattgttt

SEQ ID NO: 1382070 - DNA, 15 bp, Homo sapiens
aacaaactcaaaatg

SEQ ID NO: 1382071 - DNA, 21 bp, Homo sapiens
aacagatcacatgcccctctt

SEQ ID NO: 1382072 - DNA, 14 bp, Homo sapiens
aacataaataaaat

SEQ ID NO: 1382073 - DNA, 18 bp, Homo sapiens
aacataaataaaatgacc

SEQ ID NO: 1382074 - DNA, 18 bp, Homo sapiens
aacattgccttatattgg

SEQ ID NO: 1382075 - DNA, 14 bp, Homo sapiens
aaccatgttcttga

SEQ ID NO: 1382076 - DNA, 22 bp, Homo sapiens
aaccatgttcttgagcagctga

SEQ ID NO: 1382077 - DNA, 20 bp, Homo sapiens
aaccgagggggctgctccca

SEQ ID NO: 1382078 - DNA, 21 bp, Homo sapiens
aaccgagggggctgctcccac

SEQ ID NO: 1382079 - DNA, 20 bp, Homo sapiens
aacctactttcatactgaag

SEQ ID NO: 1382080 - DNA, 22 bp, Homo sapiens
aacctactttcatactgaagat

SEQ ID NO: 1382081 - DNA, 14 bp, Homo sapiens
aagaaagatgctga

SEQ ID NO: 1382082 - DNA, 18 bp, Homo sapiens
aagagaaaaagccctctt

SEQ ID NO: 1382083 - DNA, 14 bp, Homo sapiens
aagaggaaaatgaa

SEQ ID NO: 1382084 - DNA, 20 bp, Homo sapiens
aagatgctgctgagcacatc

SEQ ID NO: 1382085 - DNA, 23 bp, Homo sapiens
aagatgctgctgagcacatctct

SEQ ID NO: 1382086 - DNA, 19 bp, Homo sapiens
aagcacctcttgaagaact

SEQ ID NO: 1382087 - DNA, 19 bp, Homo sapiens
aagcagagtcaagctgatg

SEQ ID NO: 1382088 - DNA, 13 bp, Homo sapiens
aagcagcagctag

SEQ ID NO: 1382089 - DNA, 22 bp, Homo sapiens
aagcagcagctagaaagagaaa

SEQ ID NO: 1382090 - DNA, 20 bp, Homo sapiens
aagcccagcctatctctctt

SEQ ID NO: 1382091 - DNA, 22 bp, Homo sapiens
aagctactgccatcctggccca

SEQ ID NO: 1382092 - DNA, 17 bp, Homo sapiens
aagggactccagaagca

SEQ ID NO: 1382093 - DNA, 18 bp, Homo sapiens
aagtgccctccaggcttt

SEQ ID NO: 1382094 - DNA, 17 bp, Homo sapiens
aagtttgaaaatagtta

SEQ ID NO: 1382095 - DNA, 15 bp, Homo sapiens
aataaccctgaatca

SEQ ID NO: 1382096 - DNA, 17 bp, Homo sapiens
aatacattgaattagaa

SEQ ID NO: 1382097 - DNA, 18 bp, Homo sapiens
aatacattgaattagaaa

SEQ ID NO: 1382098 - DNA, 15 bp, Homo sapiens
aatcagaggcagaga

SEQ ID NO: 1382099 - DNA, 14 bp, Homo sapiens
aatcatacacagaa

SEQ ID NO: 1382100 - DNA, 19 bp, Homo sapiens
aatccccataatgcttctt

SEQ ID NO: 1382101 - DNA, 23 bp, Homo sapiens
aatctcaaaagatctcctgtgca

SEQ ID NO: 1382102 - DNA, 21 bp, Homo sapiens
aatgaccagtaattgtgaaaa

SEQ ID NO: 1382103 - DNA, 14 bp, Homo sapiens
aatgagttcccttg

SEQ ID NO: 1382104 - DNA, 19 bp, Homo sapiens
aatgcttctttcctcttaa

SEQ ID NO: 1382105 - DNA, 14 bp, Homo sapiens
aatgggaaaagaga

SEQ ID NO: 1382106 - DNA, 17 bp, Homo sapiens
aatggtttttgttagtt

SEQ ID NO: 1382107 - DNA, 22 bp, Homo sapiens
aatgtgattcctttgaagagga

SEQ ID NO: 1382108 - DNA, 15 bp, Homo sapiens
aattaaactgatggg

SEQ ID NO: 1382109 - DNA, 16 bp, Homo sapiens
acaaccatgttcttga

SEQ ID NO: 1382110 - DNA, 14 bp, Homo sapiens
acaagtgccctcca

SEQ ID NO: 1382111 - DNA, 21 bp, Homo sapiens
acactggctcacccagtcctg

SEQ ID NO: 1382112 - DNA, 17 bp, Homo sapiens
acactttggcccagggt

SEQ ID NO: 1382113 - DNA, 23 bp, Homo sapiens
acagaagggagtgaaaacctctt

SEQ ID NO: 1382114 - DNA, 14 bp, Homo sapiens
acagcaggctgcca

SEQ ID NO: 1382115 - DNA, 15 bp, Homo sapiens
acagcaggctgccag

SEQ ID NO: 1382116 - DNA, 18 bp, Homo sapiens
acagcaggctgccagtgc

SEQ ID NO: 1382117 - DNA, 12 bp, Homo sapiens
acagggcctctg

SEQ ID NO: 1382118 - DNA, 19 bp, Homo sapiens
acataaataaaatgaccag

SEQ ID NO: 1382119 - DNA, 14 bp, Homo sapiens
acattgaattagaa

SEQ ID NO: 1382120 - DNA, 14 bp, Homo sapiens
acattgccttatat

SEQ ID NO: 1382121 - DNA, 10 bp, Homo sapiens
accagtgcct

SEQ ID NO: 1382122 - DNA, 13 bp, Homo sapiens
accagtgcctctc

SEQ ID NO: 1382123 - DNA, 13 bp, Homo sapiens
ctgccaagagtcc

SEQ ID NO: 1382124 - DNA, 15 bp, Homo sapiens
ctgccaagagtccaa

SEQ ID NO: 1382125 - DNA, 17 bp, Homo sapiens
ctgccagtgcctgggtg

SEQ ID NO: 1382126 - DNA, 18 bp, Homo sapiens
ctgccatcctggcccagg

SEQ ID NO: 1382127 - DNA, 14 bp, Homo sapiens
ctgcccctgcacag

SEQ ID NO: 1382128 - DNA, 19 bp, Homo sapiens
ctgcccctgcacagcaggc

SEQ ID NO: 1382129 - DNA, 15 bp, Homo sapiens
ggtgaactgaagcag

SEQ ID NO: 1382130 - DNA, 20 bp, Homo sapiens
ggtttccatcaaagccctcc

SEQ ID NO: 1382131 - DNA, 13 bp, Homo sapiens
ggtttggagctga

SEQ ID NO: 1382132 - DNA, 18 bp, Homo sapiens
gtacaataaataaaagaa

SEQ ID NO: 1382133 - DNA, 16 bp, Homo sapiens
gtaccactacttagag

SEQ ID NO: 1382134 - DNA, 15 bp, Homo sapiens
gtactctgagtcctc

SEQ ID NO: 1382135 - DNA, 21 bp, Homo sapiens
gtataagatgctgctgagcac

SEQ ID NO: 1382136 - DNA, 16 bp, Homo sapiens
gtcagtgtactctgag

SEQ ID NO: 1382137 - DNA, 18 bp, Homo sapiens
gtcatgttggtaccctgg

SEQ ID NO: 1382138 - DNA, 20 bp, Homo sapiens
tctactattaagtttgaaaa

SEQ ID NO: 1382139 - DNA, 13 bp, Homo sapiens
tctccagctgctg

SEQ ID NO: 1382140 - DNA, 15 bp, Homo sapiens
tctccagctgctgag

SEQ ID NO: 1382141 - DNA, 15 bp, Homo sapiens
tctccccccgcctgc

SEQ ID NO: 1382142 - DNA, 12 bp, Homo sapiens
tctgagtcctca

SEQ ID NO: 1382143 - DNA, 16 bp, Homo sapiens
tctgatgatgttctga

SEQ ID NO: 1382144 - DNA, 18 bp, Homo sapiens
tctgtctctcttttgctc

SEQ ID NO: 1382145 - DNA, 20 bp, Homo sapiens
tcttgcatggtttggagctg

SEQ ID NO: 1382146 - DNA, 17 bp, Homo sapiens
tgaactgaagcagagtc

SEQ ID NO: 1382147 - DNA, 20 bp, Homo sapiens
tgaagaggaaaatgaataat

SEQ ID NO: 1382148 - DNA, 22 bp, Homo sapiens
tgaataccccaagactcccatg

SEQ ID NO: 1382149 - DNA, 15 bp, Homo sapiens
tgaatcagaggcaga

SEQ ID NO: 1382150 - DNA, 19 bp, Homo sapiens
tgaattagaaacataaata

SEQ ID NO: 1382151 - DNA, 23 bp, Homo sapiens
tgagcatgctccctcatgcagat

SEQ ID NO: 1382152 - DNA, 14 bp, Homo sapiens
tgagccgcccaagg

SEQ ID NO: 1382153 - DNA, 17 bp, Homo sapiens
tgagccgcccaaggcct

SEQ ID NO: 1382154 - DNA, 18 bp, Homo sapiens
tgagccgcccaaggcctt

SEQ ID NO: 1382155 - DNA, 19 bp, Homo sapiens
tgagccgcccaaggccttc

SEQ ID NO: 1382156 - DNA, 20 bp, Homo sapiens
tgaggccaaatgagttccct

SEQ ID NO: 1382157 - DNA, 22 bp, Homo sapiens
tgaggccaaatgagttcccttg

SEQ ID NO: 1382158 - DNA, 22 bp, Homo sapiens
tgaggctggataggagaggaaa

SEQ ID NO: 1382159 - DNA, 13 bp, Homo sapiens
tgatctgtccttc

SEQ ID NO: 1382160 - DNA, 15 bp, Homo sapiens
tgatctgtccttcca

SEQ ID NO: 1382161 - DNA, 16 bp, Homo sapiens
tgatgttctgaaatgg

SEQ ID NO: 1382162 - DNA, 13 bp, Homo sapiens
tgattcaaataac

SEQ ID NO: 1382163 - DNA, 22 bp, Homo sapiens
tgattcaaataaccctgaatca

SEQ ID NO: 1382164 - DNA, 21 bp, Homo sapiens
tgattgagagcagcctcttga

SEQ ID NO: 1382165 - DNA, 23 bp, Homo sapiens
tgattgagagcagcctcttgaat

SEQ ID NO: 1382166 - DNA, 17 bp, Homo sapiens
tgcaatttacttggaat

SEQ ID NO: 1382167 - DNA, 19 bp, Homo sapiens
tgcacactttggcccaggg

SEQ ID NO: 1382168 - DNA, 20 bp, Homo sapiens
tgcattcattcatcctctta

SEQ ID NO: 1382169 - DNA, 17 bp, Homo sapiens
tgccacctccccccaca

SEQ ID NO: 1382170 - DNA, 15 bp, Homo sapiens
tgccatcctggccca

SEQ ID NO: 1382171 - DNA, 16 bp, Homo sapiens
tgccatcctggcccag

SEQ ID NO: 1382172 - DNA, 18 bp, Homo sapiens
tgccatcctggcccaggg

SEQ ID NO: 1382173 - DNA, 21 bp, Homo sapiens
tgccatcctggcccagggcat

SEQ ID NO: 1382174 - DNA, 21 bp, Homo sapiens
tgccatgagccgcccaaggcc

SEQ ID NO: 1382175 - DNA, 16 bp, Homo sapiens
tgcccagcctggatgc

SEQ ID NO: 1382176 - DNA, 18 bp, Homo sapiens
tgcccagcctggatgcca

SEQ ID NO: 1382177 - DNA, 20 bp, Homo sapiens
tgcccagcctggatgccatc

SEQ ID NO: 1382178 - DNA, 21 bp, Homo sapiens
tgcccagcctggatgccatcc

SEQ ID NO: 1382179 - DNA, 23 bp, Homo sapiens
tgcctccgtcccctgcccatgct

SEQ ID NO: 1382180 - DNA, 17 bp, Homo sapiens
tgcctctccctgctgct

SEQ ID NO: 1382181 - DNA, 20 bp, Homo sapiens
tgcctctccctgctgctcct

SEQ ID NO: 1382182 - DNA, 15 bp, Homo sapiens
tgcggagcacactgg

SEQ ID NO: 1382183 - DNA, 22 bp, Homo sapiens
tgctcctaggacccgtctccag

SEQ ID NO: 1382184 - DNA, 21 bp, Homo sapiens
tgctcctccagtacaataaat

SEQ ID NO: 1382185 - DNA, 22 bp, Homo sapiens
tgctgctgagcacatctcttca

SEQ ID NO: 1382186 - DNA, 16 bp, Homo sapiens
tgcttctactccatgg

SEQ ID NO: 1382187 - DNA, 14 bp, Homo sapiens
tggaccagttccct

SEQ ID NO: 1382188 - DNA, 19 bp, Homo sapiens
tggactgagggggcctgga

SEQ ID NO: 1382189 - DNA, 20 bp, Homo sapiens
tggactgagggggcctggat

SEQ ID NO: 1382190 - DNA, 14 bp, Homo sapiens
tggataggagagga

SEQ ID NO: 1382191 - DNA, 22 bp, Homo sapiens
tggatcaggaacccttacagta

SEQ ID NO: 1382192 - DNA, 19 bp, Homo sapiens
tggcaaacagggcctctgc

SEQ ID NO: 1382193 - DNA, 24 bp, Homo sapiens
tggcaaacagggcctctgcggagc

SEQ ID NO: 1382194 - DNA, 21 bp, Homo sapiens
tggcactggcaaacagggcct

SEQ ID NO: 1382195 - DNA, 14 bp, Homo sapiens
tggcctgagaagag

SEQ ID NO: 1382196 - DNA, 13 bp, Homo sapiens
tggctcacccagt

SEQ ID NO: 1382197 - DNA, 13 bp, Homo sapiens
tggctgccaagag

SEQ ID NO: 1382198 - DNA, 16 bp, Homo sapiens
tgggcatactaataaa

SEQ ID NO: 1382199 - DNA, 16 bp, Homo sapiens
tgggccaccgccttgc

SEQ ID NO: 1382200 - DNA, 17 bp, Homo sapiens
tgggccaccgccttgcc

SEQ ID NO: 1382201 - DNA, 15 bp, Homo sapiens
tggggctcccagcca

SEQ ID NO: 1382202 - DNA, 18 bp, Homo sapiens
tggggctcccagccaggc

SEQ ID NO: 1382203 - DNA, 23 bp, Homo sapiens
tggggctcccagccaggcccttg

SEQ ID NO: 1382204 - DNA, 20 bp, Homo sapiens
tgggtaagggactccagaag

SEQ ID NO: 1382205 - DNA, 20 bp, Homo sapiens
tggtaagcaacatggctttg

SEQ ID NO: 1382206 - DNA, 16 bp, Homo sapiens
tggtgaactgaagcag

SEQ ID NO: 1382207 - DNA, 17 bp, Homo sapiens
tgtaatttcctgctcct

SEQ ID NO: 1382208 - DNA, 19 bp, Homo sapiens
tgtacaaaatatccaagcc

SEQ ID NO: 1382209 - DNA, 12 bp, Homo sapiens
tgtcccaagtgc

SEQ ID NO: 1382210 - DNA, 15 bp, Homo sapiens
accccaagactccca

SEQ ID NO: 1382211 - DNA, 16 bp, Homo sapiens
accccaagactcccat

SEQ ID NO: 1382212 - DNA, 17 bp, Homo sapiens
accccaagactcccatg

SEQ ID NO: 1382213 - DNA, 14 bp, Homo sapiens
acccgtctccagct

SEQ ID NO: 1382214 - DNA, 16 bp, Homo sapiens
acccgtctccagctgc

SEQ ID NO: 1382215 - DNA, 17 bp, Homo sapiens
acccgtctccagctgct

SEQ ID NO: 1382216 - DNA, 14 bp, Homo sapiens
accctgaatcagag

SEQ ID NO: 1382217 - DNA, 18 bp, Homo sapiens
accctgaatcagaggcag

SEQ ID NO: 1382218 - DNA, 15 bp, Homo sapiens
accgccttgcccagc

SEQ ID NO: 1382219 - DNA, 22 bp, Homo sapiens
accgccttgcccagcctggatg

SEQ ID NO: 1382220 - DNA, 14 bp, Homo sapiens
actccagaagcagc

SEQ ID NO: 1382221 - DNA, 19 bp, Homo sapiens
actccatggtgaactgaag

SEQ ID NO: 1382222 - DNA, 19 bp, Homo sapiens
actcctcaattccagggaa

SEQ ID NO: 1382223 - DNA, 18 bp, Homo sapiens
actctactattaagtttg

SEQ ID NO: 1382224 - DNA, 15 bp, Homo sapiens
actgaagcagagtca

SEQ ID NO: 1382225 - DNA, 16 bp, Homo sapiens
actgaagcagagtcaa

SEQ ID NO: 1382226 - DNA, 17 bp, Homo sapiens
actgagggggcctggat

SEQ ID NO: 1382227 - DNA, 19 bp, Homo sapiens
actgagggggcctggatgc

SEQ ID NO: 1382228 - DNA, 21 bp, Homo sapiens
actggcaaacagggcctctgc

SEQ ID NO: 1382229 - DNA, 20 bp, Homo sapiens
acttctggcataactaaaat

SEQ ID NO: 1382230 - DNA, 17 bp, Homo sapiens
agaaacataaataaaat

SEQ ID NO: 1382231 - DNA, 23 bp, Homo sapiens
agaaacataaataaaatgaccag

SEQ ID NO: 1382232 - DNA, 18 bp, Homo sapiens
agaccattggggctccca

SEQ ID NO: 1382233 - DNA, 20 bp, Homo sapiens
agaccattggggctcccagc

SEQ ID NO: 1382234 - DNA, 16 bp, Homo sapiens
agagaaaaagccctct

SEQ ID NO: 1382235 - DNA, 17 bp, Homo sapiens
agagaaaaagccctctt

SEQ ID NO: 1382236 - DNA, 19 bp, Homo sapiens
agagatcaaatggaaagga

SEQ ID NO: 1382237 - DNA, 13 bp, Homo sapiens
agagcagcctctt

SEQ ID NO: 1382238 - DNA, 15 bp, Homo sapiens
agatgaggctggata

SEQ ID NO: 1382239 - DNA, 21 bp, Homo sapiens
agatgcagcaaaatgtgaatg

SEQ ID NO: 1382240 - DNA, 14 bp, Homo sapiens
agcaacatggcttt

SEQ ID NO: 1382241 - DNA, 13 bp, Homo sapiens
agcacctcttgaa

SEQ ID NO: 1382242 - DNA, 22 bp, Homo sapiens
agcacctcttgaagaactgact

SEQ ID NO: 1382243 - DNA, 15 bp, Homo sapiens
agcagcagtttgtga

SEQ ID NO: 1382244 - DNA, 21 bp, Homo sapiens
agcagctagaaagagaaaaag

SEQ ID NO: 1382245 - DNA, 22 bp, Homo sapiens
agcaggctgccagtgcctgggt

SEQ ID NO: 1382246 - DNA, 21 bp, Homo sapiens
agcatgctccctcatgcagat

SEQ ID NO: 1382247 - DNA, 18 bp, Homo sapiens
agccatttgtcccaagtg

SEQ ID NO: 1382248 - DNA, 19 bp, Homo sapiens
agccatttgtcccaagtgc

SEQ ID NO: 1382249 - DNA, 18 bp, Homo sapiens
agcccacgctcaccccct

SEQ ID NO: 1382250 - DNA, 22 bp, Homo sapiens
agcccagcctatctctcttctg

SEQ ID NO: 1382251 - DNA, 18 bp, Homo sapiens
agcctatctctcttctgc

SEQ ID NO: 1382252 - DNA, 22 bp, Homo sapiens
agcctcttgaatgcttaaatga

SEQ ID NO: 1382253 - DNA, 15 bp, Homo sapiens
agcctggatgccatc

SEQ ID NO: 1382254 - DNA, 12 bp, Homo sapiens
agctactgccat

SEQ ID NO: 1382255 - DNA, 13 bp, Homo sapiens
agctactgccatc

SEQ ID NO: 1382256 - DNA, 22 bp, Homo sapiens
agctactgccatcctggcccag

SEQ ID NO: 1382257 - DNA, 19 bp, Homo sapiens
agctgctgagatcctggac

SEQ ID NO: 1382258 - DNA, 21 bp, Homo sapiens
agctgctgagatcctggactg

SEQ ID NO: 1382259 - DNA, 14 bp, Homo sapiens
aggaaaaggcttga

SEQ ID NO: 1382260 - DNA, 22 bp, Homo sapiens
aggcccttgtcggccccaccag

SEQ ID NO: 1382261 - DNA, 17 bp, Homo sapiens
aggccttcccctggcac

SEQ ID NO: 1382262 - DNA, 15 bp, Homo sapiens
aggctgccagtgcct

SEQ ID NO: 1382263 - DNA, 16 bp, Homo sapiens
aggctgccagtgcctg

SEQ ID NO: 1382264 - DNA, 16 bp, Homo sapiens
aggctggataggagag

SEQ ID NO: 1382265 - DNA, 17 bp, Homo sapiens
aggctggataggagagg

SEQ ID NO: 1382266 - DNA, 23 bp, Homo sapiens
aggcttgtgtaatttcctgctcc

SEQ ID NO: 1382267 - DNA, 15 bp, Homo sapiens
agggggctgctccca

SEQ ID NO: 1382268 - DNA, 22 bp, Homo sapiens
agggggctgctcccacctggct

SEQ ID NO: 1382269 - DNA, 16 bp, Homo sapiens
aggtaaataatcatac

SEQ ID NO: 1382270 - DNA, 14 bp, Homo sapiens
agtacaataaataa

SEQ ID NO: 1382271 - DNA, 15 bp, Homo sapiens
agtacaataaataaa

SEQ ID NO: 1382272 - DNA, 17 bp, Homo sapiens
agtcctcattgttcaga

SEQ ID NO: 1382273 - DNA, 18 bp, Homo sapiens
agtctggataatttgtat

SEQ ID NO: 1382274 - DNA, 21 bp, Homo sapiens
agtgccaaagaagcagaccat

SEQ ID NO: 1382275 - DNA, 19 bp, Homo sapiens
agtgcctctccctgctgct

SEQ ID NO: 1382276 - DNA, 23 bp, Homo sapiens
agtgcctctccctgctgctccta

SEQ ID NO: 1382277 - DNA, 17 bp, Homo sapiens
agtgctcacccacacca

SEQ ID NO: 1382278 - DNA, 21 bp, Homo sapiens
agtgcttgaggccaaatgagt

SEQ ID NO: 1382279 - DNA, 24 bp, Homo sapiens
agttaagcacaaccatgttcttga

SEQ ID NO: 1382280 - DNA, 16 bp, Homo sapiens
agttattttgtgtcct

SEQ ID NO: 1382281 - DNA, 16 bp, Homo sapiens
agttccctcagccctc

SEQ ID NO: 1382282 - DNA, 20 bp, Homo sapiens
agttcccttgattcaaataa

SEQ ID NO: 1382283 - DNA, 20 bp, Homo sapiens
ataaccctgaatcagaggca

SEQ ID NO: 1382284 - DNA, 19 bp, Homo sapiens
atacacagaaatcctaaca

SEQ ID NO: 1382285 - DNA, 15 bp, Homo sapiens
atacattgaattaga

SEQ ID NO: 1382286 - DNA, 17 bp, Homo sapiens
atacattgaattagaaa

SEQ ID NO: 1382287 - DNA, 19 bp, Homo sapiens
atacattgaattagaaaca

SEQ ID NO: 1382288 - DNA, 11 bp, Homo sapiens
atactgaagat

SEQ ID NO: 1382289 - DNA, 14 bp, Homo sapiens
ataggagaggaaaa

SEQ ID NO: 1382290 - DNA, 13 bp, Homo sapiens
atataaaatacat

SEQ ID NO: 1382291 - DNA, 17 bp, Homo sapiens
atatgagcatgctccct

SEQ ID NO: 1382292 - DNA, 22 bp, Homo sapiens
atcaaagccctccctgtctgtc

SEQ ID NO: 1382293 - DNA, 20 bp, Homo sapiens
caggcccttgtcggccccac

SEQ ID NO: 1382294 - DNA, 12 bp, Homo sapiens
caggctgccagt

SEQ ID NO: 1382295 - DNA, 20 bp, Homo sapiens
caggctgccagtgcctgggt

SEQ ID NO: 1382296 - DNA, 16 bp, Homo sapiens
cagtaattgtgaaaat

SEQ ID NO: 1382297 - DNA, 20 bp, Homo sapiens
cagtacaataaataaaagaa

SEQ ID NO: 1382298 - DNA, 14 bp, Homo sapiens
cagtcctgcccgcc

SEQ ID NO: 1382299 - DNA, 19 bp, Homo sapiens
cagtgcctaactccttaca

SEQ ID NO: 1382300 - DNA, 21 bp, Homo sapiens
cataaaaataaaatctgtaaa

SEQ ID NO: 1382301 - DNA, 14 bp, Homo sapiens
cataaacaaagagt

SEQ ID NO: 1382302 - DNA, 14 bp, Homo sapiens
cataaataaaatga

SEQ ID NO: 1382303 - DNA, 18 bp, Homo sapiens
cataactaaaattaagta

SEQ ID NO: 1382304 - DNA, 20 bp, Homo sapiens
cataactaaaattaagtata

SEQ ID NO: 1382305 - DNA, 17 bp, Homo sapiens
cataagctactgccatc

SEQ ID NO: 1382306 - DNA, 23 bp, Homo sapiens
cataatatttttcaattttgaaa

SEQ ID NO: 1382307 - DNA, 14 bp, Homo sapiens
catcaaagccctcc

SEQ ID NO: 1382308 - DNA, 21 bp, Homo sapiens
catcataaacaaagagtagaa

SEQ ID NO: 1382309 - DNA, 17 bp, Homo sapiens
catcctcttatatgtgc

SEQ ID NO: 1382310 - DNA, 15 bp, Homo sapiens
catcctggcccaggg

SEQ ID NO: 1382311 - DNA, 17 bp, Homo sapiens
catgagccgcccaaggc

SEQ ID NO: 1382312 - DNA, 21 bp, Homo sapiens
catgagccgcccaaggccttc

SEQ ID NO: 1382313 - DNA, 18 bp, Homo sapiens
catgagggagatgccatg

SEQ ID NO: 1382314 - DNA, 19 bp, Homo sapiens
catgcccctcttagaagaa

SEQ ID NO: 1382315 - DNA, 21 bp, Homo sapiens
catggagtagagtcaggagaa

SEQ ID NO: 1382316 - DNA, 19 bp, Homo sapiens
catggtgaactgaagcaga

SEQ ID NO: 1382317 - DNA, 13 bp, Homo sapiens
cattaaactaatt

SEQ ID NO: 1382318 - DNA, 17 bp, Homo sapiens
cattcattcatcctctt

SEQ ID NO: 1382319 - DNA, 18 bp, Homo sapiens
cattggggctcccagcca

SEQ ID NO: 1382320 - DNA, 19 bp, Homo sapiens
cattggggctcccagccag

SEQ ID NO: 1382321 - DNA, 15 bp, Homo sapiens
cattgttcagaaaag

SEQ ID NO: 1382322 - DNA, 21 bp, Homo sapiens
cattgttcagaaaagcacctc

SEQ ID NO: 1382323 - DNA, 18 bp, Homo sapiens
catttgtcccaagtgcca

SEQ ID NO: 1382324 - DNA, 22 bp, Homo sapiens
ccaactccgtgtggtaagcaac

SEQ ID NO: 1382325 - DNA, 12 bp, Homo sapiens
ccaagactccca

SEQ ID NO: 1382326 - DNA, 19 bp, Homo sapiens
ccaagactcccatgaggga

SEQ ID NO: 1382327 - DNA, 16 bp, Homo sapiens
ccacaagtgccctcca

SEQ ID NO: 1382328 - DNA, 17 bp, Homo sapiens
ccaccagtgcctctccc

SEQ ID NO: 1382329 - DNA, 19 bp, Homo sapiens
ccaccagtgcctctccctg

SEQ ID NO: 1382330 - DNA, 19 bp, Homo sapiens
ccaccgccttgcccagcct

SEQ ID NO: 1382331 - DNA, 12 bp, Homo sapiens
ccacctggctct

SEQ ID NO: 1382332 - DNA, 16 bp, Homo sapiens
ccacctggctctgtgg

SEQ ID NO: 1382333 - DNA, 15 bp, Homo sapiens
ccacgctcaccccct

SEQ ID NO: 1382334 - DNA, 13 bp, Homo sapiens
ccagaagcagcag

SEQ ID NO: 1382335 - DNA, 17 bp, Homo sapiens
ccagagccccacagccc

SEQ ID NO: 1382336 - DNA, 20 bp, Homo sapiens
ccagcctatctctcttctgc

SEQ ID NO: 1382337 - DNA, 13 bp, Homo sapiens
ccagcctggatgc

SEQ ID NO: 1382338 - DNA, 19 bp, Homo sapiens
ccaggagatgaggctggat

SEQ ID NO: 1382339 - DNA, 18 bp, Homo sapiens
ccagggtggccacacctc

SEQ ID NO: 1382340 - DNA, 12 bp, Homo sapiens
ccagtcctgccc

SEQ ID NO: 1382341 - DNA, 14 bp, Homo sapiens
ccagtgcctctccc

SEQ ID NO: 1382342 - DNA, 16 bp, Homo sapiens
ccataagctactgcca

SEQ ID NO: 1382343 - DNA, 17 bp, Homo sapiens
ccatcctggcccagggc

SEQ ID NO: 1382344 - DNA, 20 bp, Homo sapiens
ccatctgcgggggcagtgct

SEQ ID NO: 1382345 - DNA, 17 bp, Homo sapiens
ccatgagggagatgcca

SEQ ID NO: 1382346 - DNA, 18 bp, Homo sapiens
ccatgagggagatgccat

SEQ ID NO: 1382347 - DNA, 17 bp, Homo sapiens
ccattggggctcccagc

SEQ ID NO: 1382348 - DNA, 21 bp, Homo sapiens
ccattggggctcccagccagg

SEQ ID NO: 1382349 - DNA, 17 bp, Homo sapiens
ccatttgtcccaagtgc

SEQ ID NO: 1382350 - DNA, 16 bp, Homo sapiens
cccacagccccatctg

SEQ ID NO: 1382351 - DNA, 13 bp, Homo sapiens
cccaccagtgcct

SEQ ID NO: 1382352 - DNA, 15 bp, Homo sapiens
cccacgctcaccccc

SEQ ID NO: 1382353 - DNA, 16 bp, Homo sapiens
cccacgctcaccccct

SEQ ID NO: 1382354 - DNA, 14 bp, Homo sapiens
cccactccggccct

SEQ ID NO: 1382355 - DNA, 21 bp, Homo sapiens
cccactccggccctccagagc

SEQ ID NO: 1382356 - DNA, 19 bp, Homo sapiens
cccagggtggccacacctc

SEQ ID NO: 1382357 - DNA, 15 bp, Homo sapiens
cccagtcctgcccgc

SEQ ID NO: 1382358 - DNA, 13 bp, Homo sapiens
ccccaccagtgcc

SEQ ID NO: 1382359 - DNA, 14 bp, Homo sapiens
ccccaccagtgcct

SEQ ID NO: 1382360 - DNA, 18 bp, Homo sapiens
ccccaccagtgcctctcc

SEQ ID NO: 1382361 - DNA, 22 bp, Homo sapiens
ccccaccagtgcctctccctgc

SEQ ID NO: 1382362 - DNA, 16 bp, Homo sapiens
ccccactccggccctc

SEQ ID NO: 1382363 - DNA, 23 bp, Homo sapiens
ccccataatgcttctttcctctt

SEQ ID NO: 1382364 - DNA, 14 bp, Homo sapiens
ccccatctgcgggg

SEQ ID NO: 1382365 - DNA, 16 bp, Homo sapiens
cccctgcacagcaggc

SEQ ID NO: 1382366 - DNA, 19 bp, Homo sapiens
cccctgtggatgctgctgc

SEQ ID NO: 1382367 - DNA, 20 bp, Homo sapiens
ccctcattaaactaattaaa

SEQ ID NO: 1382368 - DNA, 18 bp, Homo sapiens
ccctccagagccccacag

SEQ ID NO: 1382369 - DNA, 22 bp, Homo sapiens
ccctcttagaagaaatatgagc

SEQ ID NO: 1382370 - DNA, 17 bp, Homo sapiens
ccctgaatcagaggcag

SEQ ID NO: 1382371 - DNA, 15 bp, Homo sapiens
ccctgcacagcaggc

SEQ ID NO: 1382372 - DNA, 22 bp, Homo sapiens
ccctgcacagcaggctgccagt

SEQ ID NO: 1382373 - DNA, 13 bp, Homo sapiens
ccctgcccatgct

SEQ ID NO: 1382374 - DNA, 14 bp, Homo sapiens
ccctgctgctccta

SEQ ID NO: 1382375 - DNA, 16 bp, Homo sapiens
ccctggcactggcaaa

SEQ ID NO: 1382376 - DNA, 19 bp, Homo sapiens
ccctgtggatgctgctgcc

SEQ ID NO: 1382377 - DNA, 12 bp, Homo sapiens
ccgcccaaggcc

SEQ ID NO: 1382378 - DNA, 14 bp, Homo sapiens
ccgcccaaggcctt

SEQ ID NO: 1382379 - DNA, 17 bp, Homo sapiens
ccgccttgcccagcctg

SEQ ID NO: 1382380 - DNA, 18 bp, Homo sapiens
cctaggacccgtctccag

SEQ ID NO: 1382381 - DNA, 22 bp, Homo sapiens
cctaggacccgtctccagctgc

SEQ ID NO: 1382382 - DNA, 12 bp, Homo sapiens
cctccagagccc

SEQ ID NO: 1382383 - DNA, 19 bp, Homo sapiens
cctccagagccccacagcc

SEQ ID NO: 1382384 - DNA, 15 bp, Homo sapiens
cctcctgatgtcttg

SEQ ID NO: 1382385 - DNA, 15 bp, Homo sapiens
ttagtgcttggctca

SEQ ID NO: 1382386 - DNA, 11 bp, Homo sapiens
ttatacttact

SEQ ID NO: 1382387 - DNA, 19 bp, Homo sapiens
ttccaacctgttcacgtga

SEQ ID NO: 1382388 - DNA, 15 bp, Homo sapiens
ttccagggaaccaga

SEQ ID NO: 1382389 - DNA, 16 bp, Homo sapiens
ttcccttgattcaaat

SEQ ID NO: 1382390 - DNA, 18 bp, Homo sapiens
ttcccttgattcaaataa

SEQ ID NO: 1382391 - DNA, 21 bp, Homo sapiens
ttctagtgggtttaatgttta

SEQ ID NO: 1382392 - DNA, 23 bp, Homo sapiens
ttgaattagaaacataaataaaa

SEQ ID NO: 1382393 - DNA, 13 bp, Homo sapiens
ttgattcaaataa

SEQ ID NO: 1382394 - DNA, 19 bp, Homo sapiens
ttggctgccaagagtccaa

SEQ ID NO: 1382395 - DNA, 14 bp, Homo sapiens
ttggggctcccagc

SEQ ID NO: 1382396 - DNA, 18 bp, Homo sapiens
ttggggctcccagccagg

SEQ ID NO: 1382397 - DNA, 22 bp, Homo sapiens
ttggggctcccagccaggccct

SEQ ID NO: 1382398 - DNA, 19 bp, Homo sapiens
ttgggtaagggactccaga

SEQ ID NO: 1382399 - DNA, 20 bp, Homo sapiens
ttgtgtaatttcctgctcct

SEQ ID NO: 1382400 - DNA, 15 bp, Homo sapiens
ttgttctgtgcaaca

SEQ ID NO: 1382401 - DNA, 15 bp, Homo sapiens
tttgaagaggaaaat

SEQ ID NO: 1382402 - DNA, 12 bp, Homo sapiens
tttgatgataaa

SEQ ID NO: 1382403 - DNA, 16 bp, Homo sapiens
tttgtcccaagtgcca

SEQ ID NO: 1382404 - DNA, 20 bp, Homo sapiens
tttgtgatctgtccttccaa

SEQ ID NO: 1382405 - DNA, 15 bp, Homo sapiens
tttgtgtcctttaaa

SEQ ID NO: 1382406 - DNA, 19 bp, Homo sapiens
ttttggctcaaataaaatt

SEQ ID NO: 1382407 - DNA, 23 bp, Homo sapiens
agaggaaaaggcttgagtctgga

SEQ ID NO: 1382408 - DNA, 17 bp, Homo sapiens
agaggaaaatgaataat

SEQ ID NO: 1382409 - DNA, 20 bp, Homo sapiens
agaggaaaatgaataataca

SEQ ID NO: 1382410 - DNA, 16 bp, Homo sapiens
agaggaataaaatgat

SEQ ID NO: 1382411 - DNA, 13 bp, Homo sapiens
agatgaggctgga

SEQ ID NO: 1382412 - DNA, 14 bp, Homo sapiens
agatgcagcaaaat

SEQ ID NO: 1382413 - DNA, 19 bp, Homo sapiens
agatgctgctgagcacatc

SEQ ID NO: 1382414 - DNA, 13 bp, Homo sapiens
agcaacatggctt

SEQ ID NO: 1382415 - DNA, 15 bp, Homo sapiens
agcacatctcttcat

SEQ ID NO: 1382416 - DNA, 13 bp, Homo sapiens
agcaggctgccag

SEQ ID NO: 1382417 - DNA, 14 bp, Homo sapiens
agccatttgtccca

SEQ ID NO: 1382418 - DNA, 17 bp, Homo sapiens
agccatttgtcccaagt

SEQ ID NO: 1382419 - DNA, 13 bp, Homo sapiens
agccgcccaaggc

SEQ ID NO: 1382420 - DNA, 15 bp, Homo sapiens
agcctatctctcttc

SEQ ID NO: 1382421 - DNA, 11 bp, Homo sapiens
agcctggatgc

SEQ ID NO: 1382422 - DNA, 13 bp, Homo sapiens
agcctggatgcca

SEQ ID NO: 1382423 - DNA, 16 bp, Homo sapiens
agctactgccatcctg

SEQ ID NO: 1382424 - DNA, 18 bp, Homo sapiens
agctactgccatcctggc

SEQ ID NO: 1382425 - DNA, 13 bp, Homo sapiens
agctagaaagaga

SEQ ID NO: 1382426 - DNA, 21 bp, Homo sapiens
agctagaaagagaaaaagccc

SEQ ID NO: 1382427 - DNA, 20 bp, Homo sapiens
agctgatcgcttctccccca

SEQ ID NO: 1382428 - DNA, 16 bp, Homo sapiens
aggagatgaggctgga

SEQ ID NO: 1382429 - DNA, 17 bp, Homo sapiens
aggagatgaggctggat

SEQ ID NO: 1382430 - DNA, 23 bp, Homo sapiens
aggagatgaggctggataggaga

SEQ ID NO: 1382431 - DNA, 20 bp, Homo sapiens
aggcaaaccaatttgttctg

SEQ ID NO: 1382432 - DNA, 19 bp, Homo sapiens
aggccaaatgagttccctt

SEQ ID NO: 1382433 - DNA, 19 bp, Homo sapiens
aggctgccagtgcctgggt

SEQ ID NO: 1382434 - DNA, 20 bp, Homo sapiens
aggctgccagtgcctgggtg

SEQ ID NO: 1382435 - DNA, 19 bp, Homo sapiens
agggactccagaagcagca

SEQ ID NO: 1382436 - DNA, 21 bp, Homo sapiens
agggactccagaagcagcagc

SEQ ID NO: 1382437 - DNA, 16 bp, Homo sapiens
agggggctgctcccac

SEQ ID NO: 1382438 - DNA, 17 bp, Homo sapiens
aggtatctgatgatgtt

SEQ ID NO: 1382439 - DNA, 15 bp, Homo sapiens
agtagttaattctgt

SEQ ID NO: 1382440 - DNA, 21 bp, Homo sapiens
agtatacacatcataaacaaa

SEQ ID NO: 1382441 - DNA, 21 bp, Homo sapiens
agtcagtgtactctgagtcct

SEQ ID NO: 1382442 - DNA, 19 bp, Homo sapiens
agtgaaaacctctttcgga

SEQ ID NO: 1382443 - DNA, 14 bp, Homo sapiens
agttaccttcaaag

SEQ ID NO: 1382444 - DNA, 17 bp, Homo sapiens
agttccctcagccctca

SEQ ID NO: 1382445 - DNA, 13 bp, Homo sapiens
ataaaatgaccag

SEQ ID NO: 1382446 - DNA, 19 bp, Homo sapiens
ataaagtatggtattgaaa

SEQ ID NO: 1382447 - DNA, 17 bp, Homo sapiens
ataccccaagactccca

SEQ ID NO: 1382448 - DNA, 13 bp, Homo sapiens
ataggagaggaaa

SEQ ID NO: 1382449 - DNA, 17 bp, Homo sapiens
ataggcttgtgtaattt

SEQ ID NO: 1382450 - DNA, 23 bp, Homo sapiens
ataggcttgtgtaatttcctgct

SEQ ID NO: 1382451 - DNA, 12 bp, Homo sapiens
atatgtgcccct

SEQ ID NO: 1382452 - DNA, 11 bp, Homo sapiens
atcaaagccct

SEQ ID NO: 1382453 - DNA, 15 bp, Homo sapiens
atcaaggagggagaa

SEQ ID NO: 1382454 - DNA, 16 bp, Homo sapiens
atcacatgcccctctt

SEQ ID NO: 1382455 - DNA, 13 bp, Homo sapiens
atcagaggcagag

SEQ ID NO: 1382456 - DNA, 20 bp, Homo sapiens
atcctcttatatgtgcccct

SEQ ID NO: 1382457 - DNA, 23 bp, Homo sapiens
atcctggactgagggggcctgga

SEQ ID NO: 1382458 - DNA, 21 bp, Homo sapiens
atcctggcccagggcatctgg

SEQ ID NO: 1382459 - DNA, 19 bp, Homo sapiens
atccttggactgagaaatt

SEQ ID NO: 1382460 - DNA, 17 bp, Homo sapiens
atgagcatgctccctca

SEQ ID NO: 1382461 - DNA, 18 bp, Homo sapiens
atgagcatgctccctcat

SEQ ID NO: 1382462 - DNA, 21 bp, Homo sapiens
atgagccgcccaaggccttcc

SEQ ID NO: 1382463 - DNA, 20 bp, Homo sapiens
atgaggctggataggagagg

SEQ ID NO: 1382464 - DNA, 17 bp, Homo sapiens
atgagggagatgccatg

SEQ ID NO: 1382465 - DNA, 18 bp, Homo sapiens
atgatcaaggagggagaa

SEQ ID NO: 1382466 - DNA, 17 bp, Homo sapiens
atgatgttctgaaatgg

SEQ ID NO: 1382467 - DNA, 22 bp, Homo sapiens
atgattaagtgcttgaggccaa

SEQ ID NO: 1382468 - DNA, 15 bp, Homo sapiens
atgattgagagcagc

SEQ ID NO: 1382469 - DNA, 17 bp, Homo sapiens
ccggccctccagagccc

SEQ ID NO: 1382470 - DNA, 20 bp, Homo sapiens
cctaggacccgtctccagct

SEQ ID NO: 1382471 - DNA, 13 bp, Homo sapiens
cctccagagcccc

SEQ ID NO: 1382472 - DNA, 18 bp, Homo sapiens
cctccagagccccacagc

SEQ ID NO: 1382473 - DNA, 20 bp, Homo sapiens
cctccagagccccacagccc

SEQ ID NO: 1382474 - DNA, 15 bp, Homo sapiens
cctccgtcccctgcc

SEQ ID NO: 1382475 - DNA, 15 bp, Homo sapiens
cctcttcaatcccca

SEQ ID NO: 1382476 - DNA, 21 bp, Homo sapiens
cctcttgaatgcttaaatgat

SEQ ID NO: 1382477 - DNA, 15 bp, Homo sapiens
cctgaactcccagtc

SEQ ID NO: 1382478 - DNA, 20 bp, Homo sapiens
cctgaactcccagtcatgtt

SEQ ID NO: 1382479 - DNA, 16 bp, Homo sapiens
cctgaatcagaggcag

SEQ ID NO: 1382480 - DNA, 17 bp, Homo sapiens
cctgcacagcaggctgc

SEQ ID NO: 1382481 - DNA, 20 bp, Homo sapiens
cctgcacagcaggctgccag

SEQ ID NO: 1382482 - DNA, 13 bp, Homo sapiens
cctgctcctccag

SEQ ID NO: 1382483 - DNA, 13 bp, Homo sapiens
cctgctgctccta

SEQ ID NO: 1382484 - DNA, 15 bp, Homo sapiens
cctgctgctcctagg

SEQ ID NO: 1382485 - DNA, 22 bp, Homo sapiens
cctggactgagggggcctggat

SEQ ID NO: 1382486 - DNA, 14 bp, Homo sapiens
cctggatgccccct

SEQ ID NO: 1382487 - DNA, 14 bp, Homo sapiens
cctggcccagggca

SEQ ID NO: 1382488 - DNA, 21 bp, Homo sapiens
cctggcccagggcatctggga

SEQ ID NO: 1382489 - DNA, 18 bp, Homo sapiens
cctggctctgtggcgagc

SEQ ID NO: 1382490 - DNA, 20 bp, Homo sapiens
cctgtctgtctgtctctctt

SEQ ID NO: 1382491 - DNA, 20 bp, Homo sapiens
cctgttcacgtgactcctca

SEQ ID NO: 1382492 - DNA, 12 bp, Homo sapiens
cctttgaagagg

SEQ ID NO: 1382493 - DNA, 13 bp, Homo sapiens
cctttgaagagga

SEQ ID NO: 1382494 - DNA, 23 bp, Homo sapiens
cctttgaagaggaaaatgaataa

SEQ ID NO: 1382495 - DNA, 19 bp, Homo sapiens
cgagccatttgtcccaagt

SEQ ID NO: 1382496 - DNA, 23 bp, Homo sapiens
cgagccatttgtcccaagtgcca

SEQ ID NO: 1382497 - DNA, 17 bp, Homo sapiens
cgagggggctgctccca

SEQ ID NO: 1382498 - DNA, 15 bp, Homo sapiens
aaaaccagaaagagg

SEQ ID NO: 1382499 - DNA, 14 bp, Homo sapiens
aaaagcacctcttg

SEQ ID NO: 1382500 - DNA, 14 bp, Homo sapiens
aaaagccctcttca

SEQ ID NO: 1382501 - DNA, 14 bp, Homo sapiens
aaaataaaaccaga

SEQ ID NO: 1382502 - DNA, 12 bp, Homo sapiens
aaaatagttacc

SEQ ID NO: 1382503 - DNA, 20 bp, Homo sapiens
aaaatgaccagtaattgtga

SEQ ID NO: 1382504 - DNA, 16 bp, Homo sapiens
aaaccaatttgttctg

SEQ ID NO: 1382505 - DNA, 17 bp, Homo sapiens
aaaccagaaagaggaat

SEQ ID NO: 1382506 - DNA, 12 bp, Homo sapiens
aaagccctccct

SEQ ID NO: 1382507 - DNA, 18 bp, Homo sapiens
aaaggcttgagtctggat

SEQ ID NO: 1382508 - DNA, 19 bp, Homo sapiens
aaaggcttgagtctggata

SEQ ID NO: 1382509 - DNA, 19 bp, Homo sapiens
aaagtatggtattgaaact

SEQ ID NO: 1382510 - DNA, 14 bp, Homo sapiens
aaataaaaccagaa

SEQ ID NO: 1382511 - DNA, 15 bp, Homo sapiens
aaataaaatgaccag

SEQ ID NO: 1382512 - DNA, 16 bp, Homo sapiens
aaataaaatgaccagt

SEQ ID NO: 1382513 - DNA, 13 bp, Homo sapiens
aaatctatgccac

SEQ ID NO: 1382514 - DNA, 14 bp, Homo sapiens
aacagggcctctgc

SEQ ID NO: 1382515 - DNA, 18 bp, Homo sapiens
aaccataggtaatgatta

SEQ ID NO: 1382516 - DNA, 15 bp, Homo sapiens
aaccctgaatcagag

SEQ ID NO: 1382517 - DNA, 11 bp, Homo sapiens
aacccttacag

SEQ ID NO: 1382518 - DNA, 19 bp, Homo sapiens
aaccgagggggctgctccc

SEQ ID NO: 1382519 - DNA, 13 bp, Homo sapiens
aactctaattcta

SEQ ID NO: 1382520 - DNA, 23 bp, Homo sapiens
aactgatgggtatcatgcttcta

SEQ ID NO: 1382521 - DNA, 15 bp, Homo sapiens
aagagaaaaagccct

SEQ ID NO: 1382522 - DNA, 16 bp, Homo sapiens
aagagaaaaagccctc

SEQ ID NO: 1382523 - DNA, 14 bp, Homo sapiens
aagagaattctatt

SEQ ID NO: 1382524 - DNA, 17 bp, Homo sapiens
aagagatggcctgagaa

SEQ ID NO: 1382525 - DNA, 13 bp, Homo sapiens
aagaggaaaatga

SEQ ID NO: 1382526 - DNA, 14 bp, Homo sapiens
aagatgctgctgag

SEQ ID NO: 1382527 - DNA, 13 bp, Homo sapiens
aagcaacatggct

SEQ ID NO: 1382528 - DNA, 22 bp, Homo sapiens
aagcagaccattggggctccca

SEQ ID NO: 1382529 - DNA, 18 bp, Homo sapiens
aagcagcagctagaaaga

SEQ ID NO: 1382530 - DNA, 19 bp, Homo sapiens
aagcagcagctagaaagag

SEQ ID NO: 1382531 - DNA, 22 bp, Homo sapiens
aagcccagcctatctctcttct

SEQ ID NO: 1382532 - DNA, 17 bp, Homo sapiens
aagctactgccatcctg

SEQ ID NO: 1382533 - DNA, 18 bp, Homo sapiens
aagctgatgaagttaagc

SEQ ID NO: 1382534 - DNA, 23 bp, Homo sapiens
aagctgatgaagttaagcacaac

SEQ ID NO: 1382535 - DNA, 22 bp, Homo sapiens
aagggactccagaagcagcagc

SEQ ID NO: 1382536 - DNA, 12 bp, Homo sapiens
aagtgccctcca

SEQ ID NO: 1382537 - DNA, 19 bp, Homo sapiens
aataaaaccagaaagagga

SEQ ID NO: 1382538 - DNA, 20 bp, Homo sapiens
aataccccaagactcccatg

SEQ ID NO: 1382539 - DNA, 13 bp, Homo sapiens
aataggcttgtgt

SEQ ID NO: 1382540 - DNA, 16 bp, Homo sapiens
aatatccaagcccagc

SEQ ID NO: 1382541 - DNA, 18 bp, Homo sapiens
aatgaccagtaattgtga

SEQ ID NO: 1382542 - DNA, 13 bp, Homo sapiens
aatggaaaggaga

SEQ ID NO: 1382543 - DNA, 15 bp, Homo sapiens
aattaagtatatata

SEQ ID NO: 1382544 - DNA, 18 bp, Homo sapiens
aattccagggaaccagag

SEQ ID NO: 1382545 - DNA, 12 bp, Homo sapiens
aatttcctgctc

SEQ ID NO: 1382546 - DNA, 14 bp, Homo sapiens
acaaatctatgcca

SEQ ID NO: 1382547 - DNA, 21 bp, Homo sapiens
acaaatctatgccactcagaa

SEQ ID NO: 1382548 - DNA, 16 bp, Homo sapiens
acagcaggctgccagt

SEQ ID NO: 1382549 - DNA, 17 bp, Homo sapiens
acagggcctctgcggag

SEQ ID NO: 1382550 - DNA, 15 bp, Homo sapiens
acataaataaaatga

SEQ ID NO: 1382551 - DNA, 15 bp, Homo sapiens
acatgcccctcttag

SEQ ID NO: 1382552 - DNA, 21 bp, Homo sapiens
acatgcccctcttagaagaaa

SEQ ID NO: 1382553 - DNA, 22 bp, Homo sapiens
acattgaattagaaacataaat

SEQ ID NO: 1382554 - DNA, 21 bp, Homo sapiens
accagaaagaggaataaaatg

SEQ ID NO: 1382555 - DNA, 18 bp, Homo sapiens
accagtgcctctccctgc

SEQ ID NO: 1382556 - DNA, 20 bp, Homo sapiens
accagttccctcagccctca

SEQ ID NO: 1382557 - DNA, 15 bp, Homo sapiens
accctgaatcagagg

SEQ ID NO: 1382558 - DNA, 19 bp, Homo sapiens
accgagggggctgctccca

SEQ ID NO: 1382559 - DNA, 16 bp, Homo sapiens
accgccttgcccagcc

SEQ ID NO: 1382560 - DNA, 23 bp, Homo sapiens
acctggctctgtggcgagccatt

SEQ ID NO: 1382561 - DNA, 14 bp, Homo sapiens
actaaaattaagta

SEQ ID NO: 1382562 - DNA, 16 bp, Homo sapiens
actatcagcagcggca

SEQ ID NO: 1382563 - DNA, 23 bp, Homo sapiens
actatcagcagcggcagcagcag

SEQ ID NO: 1382564 - DNA, 17 bp, Homo sapiens
actccatggtgaactga

SEQ ID NO: 1382565 - DNA, 22 bp, Homo sapiens
actcccatgagggagatgccat

SEQ ID NO: 1382566 - DNA, 13 bp, Homo sapiens
actctgagtcctc

SEQ ID NO: 1382567 - DNA, 13 bp, Homo sapiens
actgaagcagagt

SEQ ID NO: 1382568 - DNA, 16 bp, Homo sapiens
actgagggggcctgga

SEQ ID NO: 1382569 - DNA, 22 bp, Homo sapiens
actgatgggtatcatgcttcta

SEQ ID NO: 1382570 - DNA, 18 bp, Homo sapiens
actggctcacccagtcct

SEQ ID NO: 1382571 - DNA, 14 bp, Homo sapiens
acttaacagatcac

SEQ ID NO: 1382572 - DNA, 21 bp, Homo sapiens
actttgcacactttggcccag

SEQ ID NO: 1382573 - DNA, 15 bp, Homo sapiens
agaaaaagccctctt

SEQ ID NO: 1382574 - DNA, 16 bp, Homo sapiens
agaaacataaataaaa

SEQ ID NO: 1382575 - DNA, 22 bp, Homo sapiens
agaaacataaataaaatgacca

SEQ ID NO: 1382576 - DNA, 14 bp, Homo sapiens
agaaacccctgaca

SEQ ID NO: 1382577 - DNA, 18 bp, Homo sapiens
agaactgacttcctgaac

SEQ ID NO: 1382578 - DNA, 23 bp, Homo sapiens
agaagcagcagctagaaagagaa

SEQ ID NO: 1382579 - DNA, 14 bp, Homo sapiens
agaaggtaaataat

SEQ ID NO: 1382580 - DNA, 14 bp, Homo sapiens
agacctcctgatgt

SEQ ID NO: 1382581 - DNA, 22 bp, Homo sapiens
agactctaaaactatcagcagc

SEQ ID NO: 1382582 - DNA, 23 bp, Homo sapiens
agactctaaaactatcagcagcg

SEQ ID NO: 1382583 - DNA, 15 bp, Homo sapiens
agagccccacagccc

SEQ ID NO: 1382584 - DNA, 16 bp, Homo sapiens
agaggaaaatgaataa

SEQ ID NO: 1382585 - DNA, 21 bp, Homo sapiens
agaggaataaaatgattaagt

SEQ ID NO: 1382586 - DNA, 13 bp, Homo sapiens
agaggcagagacc

SEQ ID NO: 1382587 - DNA, 21 bp, Homo sapiens
agaggcagagacctcctgatg

SEQ ID NO: 1382588 - DNA, 20 bp, Homo sapiens
agagtagaactttaaaagaa

SEQ ID NO: 1382589 - DNA, 14 bp, Homo sapiens
agagtcaggagaaa

SEQ ID NO: 1382590 - DNA, 16 bp, Homo sapiens
agatcaaatggaaagg

SEQ ID NO: 1382591 - DNA, 15 bp, Homo sapiens
agatcacatgcccct

SEQ ID NO: 1382592 - DNA, 22 bp, Homo sapiens
agatgaggctggataggagagg

SEQ ID NO: 1382593 - DNA, 19 bp, Homo sapiens
agatgcagcaaaatgtgaa

SEQ ID NO: 1382594 - DNA, 19 bp, Homo sapiens
agatggcctgagaagagag

SEQ ID NO: 1382595 - DNA, 14 bp, Homo sapiens
agcaaaatgtgaat

SEQ ID NO: 1382596 - DNA, 15 bp, Homo sapiens
agcaaaatgtgaatg

SEQ ID NO: 1382597 - DNA, 23 bp, Homo sapiens
agcaaaatgtgaatgggaaaaga

SEQ ID NO: 1382598 - DNA, 12 bp, Homo sapiens
agcacactggct

SEQ ID NO: 1382599 - DNA, 19 bp, Homo sapiens
agcacactggctcacccag

SEQ ID NO: 1382600 - DNA, 20 bp, Homo sapiens
agcacactggctcacccagt

SEQ ID NO: 1382601 - DNA, 22 bp, Homo sapiens
agcagaccattggggctcccag

SEQ ID NO: 1382602 - DNA, 15 bp, Homo sapiens
agcagcagcagcagc

SEQ ID NO: 1382603 - DNA, 20 bp, Homo sapiens
agcagcagtttgtgatctgt

SEQ ID NO: 1382604 - DNA, 18 bp, Homo sapiens
agcagctagaaagagaaa

SEQ ID NO: 1382605 - DNA, 17 bp, Homo sapiens
agcaggctgccagtgcc

SEQ ID NO: 1382606 - DNA, 18 bp, Homo sapiens
agcaggctgccagtgcct

SEQ ID NO: 1382607 - DNA, 22 bp, Homo sapiens
agccaggcccttgtcggcccca

SEQ ID NO: 1382608 - DNA, 13 bp, Homo sapiens
agccccacagccc

SEQ ID NO: 1382609 - DNA, 15 bp, Homo sapiens
agccgcccaaggcct

SEQ ID NO: 1382610 - DNA, 16 bp, Homo sapiens
agccgcccaaggcctt

SEQ ID NO: 1382611 - DNA, 15 bp, Homo sapiens
agcctttaataggct

SEQ ID NO: 1382612 - DNA, 14 bp, Homo sapiens
agctactgccatcc

SEQ ID NO: 1382613 - DNA, 20 bp, Homo sapiens
agctgctgagatcctggact

SEQ ID NO: 1382614 - DNA, 21 bp, Homo sapiens
aggaaaaggcttgagtctgga

SEQ ID NO: 1382615 - DNA, 14 bp, Homo sapiens
aggaaaatgaataa

SEQ ID NO: 1382616 - DNA, 23 bp, Homo sapiens
aggaaccgagggggctgctccca

SEQ ID NO: 1382617 - DNA, 12 bp, Homo sapiens
aggagaggaaag

SEQ ID NO: 1382618 - DNA, 19 bp, Homo sapiens
aggccttcccctggcactg

SEQ ID NO: 1382619 - DNA, 14 bp, Homo sapiens
aggctgccagtgcc

SEQ ID NO: 1382620 - DNA, 21 bp, Homo sapiens
aggcttgtgtaatttcctgct

SEQ ID NO: 1382621 - DNA, 14 bp, Homo sapiens
agggagaaaggcaa

SEQ ID NO: 1382622 - DNA, 15 bp, Homo sapiens
agggggcctggatgc

SEQ ID NO: 1382623 - DNA, 22 bp, Homo sapiens
agggtggccacacctctatccc

SEQ ID NO: 1382624 - DNA, 16 bp, Homo sapiens
agtagagtcaggagaa

SEQ ID NO: 1382625 - DNA, 17 bp, Homo sapiens
agtagagtcaggagaaa

SEQ ID NO: 1382626 - DNA, 14 bp, Homo sapiens
agtagttaattctg

SEQ ID NO: 1382627 - DNA, 22 bp, Homo sapiens
agtatacacatcataaacaaag

SEQ ID NO: 1382628 - DNA, 15 bp, Homo sapiens
agtcagtgtactctg

SEQ ID NO: 1382629 - DNA, 18 bp, Homo sapiens
agtcctcattgttcagaa

SEQ ID NO: 1382630 - DNA, 21 bp, Homo sapiens
agtgaaaacctctttcggaaa

SEQ ID NO: 1382631 - DNA, 20 bp, Homo sapiens
agtgcattcattcatcctct

SEQ ID NO: 1382632 - DNA, 20 bp, Homo sapiens
agtgcctctccctgctgctc

SEQ ID NO: 1382633 - DNA, 22 bp, Homo sapiens
agtgcctctccctgctgctcct

SEQ ID NO: 1382634 - DNA, 14 bp, Homo sapiens
agtgcttgaggcca

SEQ ID NO: 1382635 - DNA, 22 bp, Homo sapiens
agttaagcacaaccatgttctt

SEQ ID NO: 1382636 - DNA, 18 bp, Homo sapiens
agttcccttgattcaaat

SEQ ID NO: 1382637 - DNA, 19 bp, Homo sapiens
agttcccttgattcaaata

SEQ ID NO: 1382638 - DNA, 21 bp, Homo sapiens
agttgtgtgaataccccaaga

SEQ ID NO: 1382639 - DNA, 18 bp, Homo sapiens
ataaaaccagaaagagga

SEQ ID NO: 1382640 - DNA, 14 bp, Homo sapiens
ataaataaaatgac

SEQ ID NO: 1382641 - DNA, 14 bp, Homo sapiens
ataagctactgcca

SEQ ID NO: 1382642 - DNA, 16 bp, Homo sapiens
ataagctactgccatc

SEQ ID NO: 1382643 - DNA, 19 bp, Homo sapiens
ataccccaagactcccatg

SEQ ID NO: 1382644 - DNA, 18 bp, Homo sapiens
atacctgggcatactaat

SEQ ID NO: 1382645 - DNA, 12 bp, Homo sapiens
atatgtatcata

SEQ ID NO: 1382646 - DNA, 22 bp, Homo sapiens
atcaaatggaaaggagaggaaa

SEQ ID NO: 1382647 - DNA, 19 bp, Homo sapiens
atcagcagcggcagcagca

SEQ ID NO: 1382648 - DNA, 12 bp, Homo sapiens
atcatgcttcta

SEQ ID NO: 1382649 - DNA, 15 bp, Homo sapiens
atccaagcccagcct

SEQ ID NO: 1382650 - DNA, 21 bp, Homo sapiens
atctcaaaagatctcctgtgc

SEQ ID NO: 1382651 - DNA, 20 bp, Homo sapiens
atctgcgggggcagtgctca

SEQ ID NO: 1382652 - DNA, 19 bp, Homo sapiens
atgaccagtaattgtgaaa

SEQ ID NO: 1382653 - DNA, 15 bp, Homo sapiens
atgagccgcccaagg

SEQ ID NO: 1382654 - DNA, 16 bp, Homo sapiens
atgagccgcccaaggc

SEQ ID NO: 1382655 - DNA, 22 bp, Homo sapiens
atgagccgcccaaggccttccc

SEQ ID NO: 1382656 - DNA, 14 bp, Homo sapiens
atgaggctggatag

SEQ ID NO: 1382657 - DNA, 15 bp, Homo sapiens
atgatcaaggaggga

SEQ ID NO: 1382658 - DNA, 23 bp, Homo sapiens
atgatcaaggagggagaaaggca

SEQ ID NO: 1382659 - DNA, 21 bp, Homo sapiens
atgattgagagcagcctcttg

SEQ ID NO: 1382660 - DNA, 16 bp, Homo sapiens
atgctcagctcagcat

SEQ ID NO: 1382661 - DNA, 22 bp, Homo sapiens
atggaaaggagaggaaagaact

SEQ ID NO: 1382662 - DNA, 14 bp, Homo sapiens
atggatagattgtt

SEQ ID NO: 1382663 - DNA, 18 bp, Homo sapiens
atgggtatcatgcttcta

SEQ ID NO: 1382664 - DNA, 15 bp, Homo sapiens
atggtttggagctga

SEQ ID NO: 1382665 - DNA, 16 bp, Homo sapiens
atgtcttggtttccat

SEQ ID NO: 1382666 - DNA, 20 bp, Homo sapiens
atgtgattcctttgaagagg

SEQ ID NO: 1382667 - DNA, 13 bp, Homo sapiens
attaagtttgaaa

SEQ ID NO: 1382668 - DNA, 18 bp, Homo sapiens
attatataaaatacataa

SEQ ID NO: 1382669 - DNA, 23 bp, Homo sapiens
attatattcccaaatctcaaaag

SEQ ID NO: 1382670 - DNA, 16 bp, Homo sapiens
attcccaggcactctc

SEQ ID NO: 1382671 - DNA, 18 bp, Homo sapiens
attcctttgaagaggaaa

SEQ ID NO: 1382672 - DNA, 20 bp, Homo sapiens
attcctttgaagaggaaaat

SEQ ID NO: 1382673 - DNA, 14 bp, Homo sapiens
attggatcaggaac

SEQ ID NO: 1382674 - DNA, 15 bp, Homo sapiens
attggggctcccagc

SEQ ID NO: 1382675 - DNA, 22 bp, Homo sapiens
attggggctcccagccaggccc

SEQ ID NO: 1382676 - DNA, 14 bp, Homo sapiens
atttcctgctcctc

SEQ ID NO: 1382677 - DNA, 15 bp, Homo sapiens
atttcctgctcctcc

SEQ ID NO: 1382678 - DNA, 15 bp, Homo sapiens
caaaataaaaccaga

SEQ ID NO: 1382679 - DNA, 12 bp, Homo sapiens
caaacagggcct

SEQ ID NO: 1382680 - DNA, 15 bp, Homo sapiens
caaaccaatttgttc

SEQ ID NO: 1382681 - DNA, 14 bp, Homo sapiens
caaacttaacagat

SEQ ID NO: 1382682 - DNA, 11 bp, Homo sapiens
caaagccctcc

SEQ ID NO: 1382683 - DNA, 22 bp, Homo sapiens
caaatctcaaaagatctcctgt

SEQ ID NO: 1382684 - DNA, 14 bp, Homo sapiens
caaatggaaaggag

SEQ ID NO: 1382685 - DNA, 19 bp, Homo sapiens
caacaaactcaaaatgtgg

SEQ ID NO: 1382686 - DNA, 21 bp, Homo sapiens
caacctgttcacgtgactcct

SEQ ID NO: 1382687 - DNA, 14 bp, Homo sapiens
caagactcccatga

SEQ ID NO: 1382688 - DNA, 19 bp, Homo sapiens
caatccccataatgcttct

SEQ ID NO: 1382689 - DNA, 15 bp, Homo sapiens
cacaccataagctac

SEQ ID NO: 1382690 - DNA, 23 bp, Homo sapiens
cacaccataagctactgccatcc

SEQ ID NO: 1382691 - DNA, 15 bp, Homo sapiens
cacactggctcaccc

SEQ ID NO: 1382692 - DNA, 15 bp, Homo sapiens
cacactttggcccag

SEQ ID NO: 1382693 - DNA, 19 bp, Homo sapiens
cacactttggcccagggtg

SEQ ID NO: 1382694 - DNA, 19 bp, Homo sapiens
cacagcaggctgccagtgc

SEQ ID NO: 1382695 - DNA, 20 bp, Homo sapiens
cacagcaggctgccagtgcc

SEQ ID NO: 1382696 - DNA, 21 bp, Homo sapiens
cacagcaggctgccagtgcct

SEQ ID NO: 1382697 - DNA, 19 bp, Homo sapiens
cacatcataaacaaagagt

SEQ ID NO: 1382698 - DNA, 13 bp, Homo sapiens
caccagtgcctct

SEQ ID NO: 1382699 - DNA, 14 bp, Homo sapiens
caccagtgcctctc

SEQ ID NO: 1382700 - DNA, 20 bp, Homo sapiens
caccataagctactgccatc

SEQ ID NO: 1382701 - DNA, 15 bp, Homo sapiens
cacccacaccataag

SEQ ID NO: 1382702 - DNA, 15 bp, Homo sapiens
caccgccttgcccag

SEQ ID NO: 1382703 - DNA, 18 bp, Homo sapiens
caccgccttgcccagcct

SEQ ID NO: 1382704 - DNA, 12 bp, Homo sapiens
cacctggctctg

SEQ ID NO: 1382705 - DNA, 19 bp, Homo sapiens
cacgtgactcctcaattcc

SEQ ID NO: 1382706 - DNA, 15 bp, Homo sapiens
cactccccaaccccc

SEQ ID NO: 1382707 - DNA, 17 bp, Homo sapiens
cactccggccctccaga

SEQ ID NO: 1382708 - DNA, 17 bp, Homo sapiens
cactggcaaacagggcc

SEQ ID NO: 1382709 - DNA, 22 bp, Homo sapiens
cactggcaaacagggcctctgc

SEQ ID NO: 1382710 - DNA, 15 bp, Homo sapiens
cactggctcacccag

SEQ ID NO: 1382711 - DNA, 17 bp, Homo sapiens
cactggctcacccagtc

SEQ ID NO: 1382712 - DNA, 20 bp, Homo sapiens
cagaccattggggctcccag

SEQ ID NO: 1382713 - DNA, 15 bp, Homo sapiens
cagagccccacagcc

SEQ ID NO: 1382714 - DNA, 22 bp, Homo sapiens
cagagccccacagccccatctg

SEQ ID NO: 1382715 - DNA, 23 bp, Homo sapiens
cagatcacatgcccctcttagaa

SEQ ID NO: 1382716 - DNA, 18 bp, Homo sapiens
cagcagcggcagcagcag

SEQ ID NO: 1382717 - DNA, 13 bp, Homo sapiens
cagcaggctgcca

SEQ ID NO: 1382718 - DNA, 18 bp, Homo sapiens
cagcaggctgccagtgcc

SEQ ID NO: 1382719 - DNA, 21 bp, Homo sapiens
cagcctggatgccatccaagt

SEQ ID NO: 1382720 - DNA, 16 bp, Homo sapiens
cagctagaaagagaaa

SEQ ID NO: 1382721 - DNA, 18 bp, Homo sapiens
cagctcagcattgtgtac

SEQ ID NO: 1382722 - DNA, 19 bp, Homo sapiens
cagctgctgagatcctgga

SEQ ID NO: 1382723 - DNA, 21 bp, Homo sapiens
cagctgctgagatcctggact

SEQ ID NO: 1382724 - DNA, 14 bp, Homo sapiens
cagcttaataagta

SEQ ID NO: 1382725 - DNA, 16 bp, Homo sapiens
caggagatgaggctgg

SEQ ID NO: 1382726 - DNA, 17 bp, Homo sapiens
caggagatgaggctgga

SEQ ID NO: 1382727 - DNA, 11 bp, Homo sapiens
caggcactctc

SEQ ID NO: 1382728 - DNA, 17 bp, Homo sapiens
caggctgccagtgcctg

SEQ ID NO: 1382729 - DNA, 22 bp, Homo sapiens
cagggtggccacacctctatcc

SEQ ID NO: 1382730 - DNA, 21 bp, Homo sapiens
caggtatctgatgatgttctg

SEQ ID NO: 1382731 - DNA, 22 bp, Homo sapiens
caggtatctgatgatgttctga

SEQ ID NO: 1382732 - DNA, 21 bp, Homo sapiens
cagtgcctctccctgctgctc

SEQ ID NO: 1382733 - DNA, 22 bp, Homo sapiens
cagtgcctctccctgctgctcc

SEQ ID NO: 1382734 - DNA, 22 bp, Homo sapiens
cagtgcctgggtggatgggcca

SEQ ID NO: 1382735 - DNA, 12 bp, Homo sapiens
cagtgctcaccc

SEQ ID NO: 1382736 - DNA, 13 bp, Homo sapiens
cagtgctcaccca

SEQ ID NO: 1382737 - DNA, 17 bp, Homo sapiens
cagtgctcacccacacc

SEQ ID NO: 1382738 - DNA, 23 bp, Homo sapiens
cagtgtactctgagtcctcattg

SEQ ID NO: 1382739 - DNA, 14 bp, Homo sapiens
cagttccctcagcc

SEQ ID NO: 1382740 - DNA, 14 bp, Homo sapiens
cataagctactgcc

SEQ ID NO: 1382741 - DNA, 13 bp, Homo sapiens
cataatgcttctt

SEQ ID NO: 1382742 - DNA, 20 bp, Homo sapiens
catacacagaaatcctaaca

SEQ ID NO: 1382743 - DNA, 21 bp, Homo sapiens
catacacagaaatcctaacat

SEQ ID NO: 1382744 - DNA, 12 bp, Homo sapiens
catcaaagccct

SEQ ID NO: 1382745 - DNA, 11 bp, Homo sapiens
catcctcttat

SEQ ID NO: 1382746 - DNA, 19 bp, Homo sapiens
catcctggcccagggcatc

SEQ ID NO: 1382747 - DNA, 15 bp, Homo sapiens
catctcttcatgcgc

SEQ ID NO: 1382748 - DNA, 19 bp, Homo sapiens
catgagccgcccaaggcct

SEQ ID NO: 1382749 - DNA, 15 bp, Homo sapiens
catgctcagctcagc

SEQ ID NO: 1382750 - DNA, 19 bp, Homo sapiens
catgctccctcatgcagat

SEQ ID NO: 1382751 - DNA, 22 bp, Homo sapiens
catgctctgtaagttgcttcct

SEQ ID NO: 1382752 - DNA, 14 bp, Homo sapiens
catggtttggagct

SEQ ID NO: 1382753 - DNA, 15 bp, Homo sapiens
catggtttggagctg

SEQ ID NO: 1382754 - DNA, 14 bp, Homo sapiens
cattcatcctctta

SEQ ID NO: 1382755 - DNA, 15 bp, Homo sapiens
cattcatcctcttat

SEQ ID NO: 1382756 - DNA, 15 bp, Homo sapiens
cattggggctcccag

SEQ ID NO: 1382757 - DNA, 17 bp, Homo sapiens
cattggggctcccagcc

SEQ ID NO: 1382758 - DNA, 21 bp, Homo sapiens
catttatgcaatttacttgga

SEQ ID NO: 1382759 - DNA, 12 bp, Homo sapiens
catttgtcccaa

SEQ ID NO: 1382760 - DNA, 19 bp, Homo sapiens
catttgtcccaagtgccaa

SEQ ID NO: 1382761 - DNA, 14 bp, Homo sapiens
ccaagactcccatg

SEQ ID NO: 1382762 - DNA, 18 bp, Homo sapiens
ccaatttgttctgtgcaa

SEQ ID NO: 1382763 - DNA, 12 bp, Homo sapiens
ccacaataggct

SEQ ID NO: 1382764 - DNA, 23 bp, Homo sapiens
ccacaccataagctactgccatc

SEQ ID NO: 1382765 - DNA, 12 bp, Homo sapiens
ccaccagtgcct

SEQ ID NO: 1382766 - DNA, 13 bp, Homo sapiens
ccaccagtgcctc

SEQ ID NO: 1382767 - DNA, 14 bp, Homo sapiens
ccaccagtgcctct

SEQ ID NO: 1382768 - DNA, 12 bp, Homo sapiens
ccaccccctagg

SEQ ID NO: 1382769 - DNA, 17 bp, Homo sapiens
ccaccgccttgcccagc

SEQ ID NO: 1382770 - DNA, 18 bp, Homo sapiens
ccagaaagaggaataaaa

SEQ ID NO: 1382771 - DNA, 13 bp, Homo sapiens
ccagagccccaca

SEQ ID NO: 1382772 - DNA, 23 bp, Homo sapiens
ccagagccccacagccccatctg

SEQ ID NO: 1382773 - DNA, 14 bp, Homo sapiens
ccagggaaccagag

SEQ ID NO: 1382774 - DNA, 16 bp, Homo sapiens
ccagggaaccagagcg

SEQ ID NO: 1382775 - DNA, 17 bp, Homo sapiens
ccagggaaccagagcga

SEQ ID NO: 1382776 - DNA, 24 bp, Homo sapiens
ccagggtggccacacctctatccc

SEQ ID NO: 1382777 - DNA, 23 bp, Homo sapiens
ccaggtatctgatgatgttctga

SEQ ID NO: 1382778 - DNA, 13 bp, Homo sapiens
ccagtcctgcccg

SEQ ID NO: 1382779 - DNA, 15 bp, Homo sapiens
ccagtcctgcccgcc

SEQ ID NO: 1382780 - DNA, 16 bp, Homo sapiens
ccagtgcctctccctg

SEQ ID NO: 1382781 - DNA, 17 bp, Homo sapiens
ccagttccctcagccct

SEQ ID NO: 1382782 - DNA, 18 bp, Homo sapiens
ccatcctggcccagggca

SEQ ID NO: 1382783 - DNA, 19 bp, Homo sapiens
ccatcctggcccagggcat

SEQ ID NO: 1382784 - DNA, 22 bp, Homo sapiens
ccatcctggcccagggcatctg

SEQ ID NO: 1382785 - DNA, 21 bp, Homo sapiens
ccatctgcgggggcagtgctc

SEQ ID NO: 1382786 - DNA, 19 bp, Homo sapiens
ccatgagggagatgccatg

SEQ ID NO: 1382787 - DNA, 23 bp, Homo sapiens
ccatgagggagatgccatgagcc

SEQ ID NO: 1382788 - DNA, 16 bp, Homo sapiens
ccatggtgaactgaag

SEQ ID NO: 1382789 - DNA, 21 bp, Homo sapiens
ccatggtgaactgaagcagag

SEQ ID NO: 1382790 - DNA, 22 bp, Homo sapiens
ccatggtgaactgaagcagagt

SEQ ID NO: 1382791 - DNA, 22 bp, Homo sapiens
ccattggggctcccagccaggc

SEQ ID NO: 1382792 - DNA, 15 bp, Homo sapiens
ccatttgtcccaagt

SEQ ID NO: 1382793 - DNA, 16 bp, Homo sapiens
cccaagactcccatga

SEQ ID NO: 1382794 - DNA, 17 bp, Homo sapiens
cccacaccataagctac

SEQ ID NO: 1382795 - DNA, 14 bp, Homo sapiens
cccaccagtgcctc

SEQ ID NO: 1382796 - DNA, 16 bp, Homo sapiens
cccaccagtgcctctc

SEQ ID NO: 1382797 - DNA, 23 bp, Homo sapiens
cccaccagtgcctctccctgctg

SEQ ID NO: 1382798 - DNA, 17 bp, Homo sapiens
cccagcctatctctctt

SEQ ID NO: 1382799 - DNA, 14 bp, Homo sapiens
cccagcctggatgc

SEQ ID NO: 1382800 - DNA, 18 bp, Homo sapiens
cccagcctggatgccatc

SEQ ID NO: 1382801 - DNA, 13 bp, Homo sapiens
cccaggcactctc

SEQ ID NO: 1382802 - DNA, 16 bp, Homo sapiens
cccagggcatctggga

SEQ ID NO: 1382803 - DNA, 21 bp, Homo sapiens
cccataatgcttctttcctct

SEQ ID NO: 1382804 - DNA, 16 bp, Homo sapiens
ccccaccagtgcctct

SEQ ID NO: 1382805 - DNA, 20 bp, Homo sapiens
ccccactccggccctccaga

SEQ ID NO: 1382806 - DNA, 13 bp, Homo sapiens
cccctcacccctc

SEQ ID NO: 1382807 - DNA, 16 bp, Homo sapiens
cccctcttagaagaaa

SEQ ID NO: 1382808 - DNA, 15 bp, Homo sapiens
cccctgcacagcagg

SEQ ID NO: 1382809 - DNA, 22 bp, Homo sapiens
cccctgcacagcaggctgccag

SEQ ID NO: 1382810 - DNA, 14 bp, Homo sapiens
cccctggcactggc

SEQ ID NO: 1382811 - DNA, 22 bp, Homo sapiens
cccctgtggatgctgctgcccc

SEQ ID NO: 1382812 - DNA, 17 bp, Homo sapiens
cccgtctccagctgctg

SEQ ID NO: 1382813 - DNA, 13 bp, Homo sapiens
ccctcagccctca

SEQ ID NO: 1382814 - DNA, 19 bp, Homo sapiens
ccctccagagccccacagc

SEQ ID NO: 1382815 - DNA, 23 bp, Homo sapiens
ccctccctgtctgtctgtctctc

SEQ ID NO: 1382816 - DNA, 11 bp, Homo sapiens
ccctcttcaat

SEQ ID NO: 1382817 - DNA, 13 bp, Homo sapiens
ccctggcactggc

SEQ ID NO: 1382818 - DNA, 17 bp, Homo sapiens
ccgcccaaggccttccc

SEQ ID NO: 1382819 - DNA, 16 bp, Homo sapiens
ccggccctccagagcc

SEQ ID NO: 1382820 - DNA, 15 bp, Homo sapiens
ccgtctccagctgct

SEQ ID NO: 1382821 - DNA, 19 bp, Homo sapiens
cctaggacccgtctccagc

SEQ ID NO: 1382822 - DNA, 21 bp, Homo sapiens
cctaggacccgtctccagctg

SEQ ID NO: 1382823 - DNA, 12 bp, Homo sapiens
cctcagccctca

SEQ ID NO: 1382824 - DNA, 22 bp, Homo sapiens
cctcggaccccactccggccct

SEQ ID NO: 1382825 - DNA, 15 bp, Homo sapiens
cctctccctgctgct

SEQ ID NO: 1382826 - DNA, 19 bp, Homo sapiens
cctctccctgctgctccta

SEQ ID NO: 1382827 - DNA, 23 bp, Homo sapiens
cctctccctgctgctcctaggac

SEQ ID NO: 1382828 - DNA, 14 bp, Homo sapiens
cctcttagaagaaa

SEQ ID NO: 1382829 - DNA, 17 bp, Homo sapiens
cctctttcggaaatgat

SEQ ID NO: 1382830 - DNA, 12 bp, Homo sapiens
cctgagaagaga

SEQ ID NO: 1382831 - DNA, 13 bp, Homo sapiens
cctgagaagagag

SEQ ID NO: 1382832 - DNA, 14 bp, Homo sapiens
cctgcacagcaggc

SEQ ID NO: 1382833 - DNA, 19 bp, Homo sapiens
cctgcacagcaggctgcca

SEQ ID NO: 1382834 - DNA, 21 bp, Homo sapiens
cctgcacagcaggctgccagt

SEQ ID NO: 1382835 - DNA, 21 bp, Homo sapiens
cctggactgagggggcctgga

SEQ ID NO: 1382836 - DNA, 23 bp, Homo sapiens
cctggactgagggggcctggatg

SEQ ID NO: 1382837 - DNA, 14 bp, Homo sapiens
cctggatgccatcc

SEQ ID NO: 1382838 - DNA, 18 bp, Homo sapiens
cctggatgccatccaagt

SEQ ID NO: 1382839 - DNA, 13 bp, Homo sapiens
cctggcactggca

SEQ ID NO: 1382840 - DNA, 22 bp, Homo sapiens
cctggcactggcaaacagggcc

SEQ ID NO: 1382841 - DNA, 12 bp, Homo sapiens
cctggcccaggg

SEQ ID NO: 1382842 - DNA, 13 bp, Homo sapiens
cctggcccagggc

SEQ ID NO: 1382843 - DNA, 12 bp, Homo sapiens
cctggctctgtg

SEQ ID NO: 1382844 - DNA, 21 bp, Homo sapiens
cctgtaggtctatgatgtcca

SEQ ID NO: 1382845 - DNA, 15 bp, Homo sapiens
cctgtgcacctgact

SEQ ID NO: 1382846 - DNA, 17 bp, Homo sapiens
cctgtggatgctgctgc

SEQ ID NO: 1382847 - DNA, 14 bp, Homo sapiens
ccttgcccagcctg

SEQ ID NO: 1382848 - DNA, 23 bp, Homo sapiens
ccttgtcggccccaccagtgcct

SEQ ID NO: 1382849 - DNA, 21 bp, Homo sapiens
cgagccatttgtcccaagtgc

SEQ ID NO: 1382850 - DNA, 23 bp, Homo sapiens
cgagggggctgctcccacctggc

SEQ ID NO: 1382851 - DNA, 12 bp, Homo sapiens
cgcccaaggcct

SEQ ID NO: 1382852 - DNA, 17 bp, Homo sapiens
cggaccccactccggcc

SEQ ID NO: 1382853 - DNA, 15 bp, Homo sapiens
cggccccaccagtgc

SEQ ID NO: 1382854 - DNA, 13 bp, Homo sapiens
cggccctccagag

SEQ ID NO: 1382855 - DNA, 22 bp, Homo sapiens
cgggggcagtgctcacccacac

SEQ ID NO: 1382856 - DNA, 22 bp, Homo sapiens
ctactgccatcctggcccaggg

SEQ ID NO: 1382857 - DNA, 20 bp, Homo sapiens
ctatacctgggcatactaat

SEQ ID NO: 1382858 - DNA, 14 bp, Homo sapiens
ctatctctcttctg

SEQ ID NO: 1382859 - DNA, 16 bp, Homo sapiens
ctatgatgtccaaact

SEQ ID NO: 1382860 - DNA, 16 bp, Homo sapiens
ctattaagtttgaaaa

SEQ ID NO: 1382861 - DNA, 22 bp, Homo sapiens
ctatttgaagcatgctctgtaa

SEQ ID NO: 1382862 - DNA, 14 bp, Homo sapiens
ctcaaaagatctcc

SEQ ID NO: 1382863 - DNA, 17 bp, Homo sapiens
ctcaaaataaaaccaga

SEQ ID NO: 1382864 - DNA, 21 bp, Homo sapiens
ctcaaaatgtggaccagttcc

SEQ ID NO: 1382865 - DNA, 20 bp, Homo sapiens
ctcaccactacatcacttga

SEQ ID NO: 1382866 - DNA, 15 bp, Homo sapiens
ctcattgttcagaaa

SEQ ID NO: 1382867 - DNA, 22 bp, Homo sapiens
ctccagaagcagcagctagaaa

SEQ ID NO: 1382868 - DNA, 18 bp, Homo sapiens
ctccagagccccacagcc

SEQ ID NO: 1382869 - DNA, 14 bp, Homo sapiens
ctcccacctggctc

SEQ ID NO: 1382870 - DNA, 15 bp, Homo sapiens
ctcccacctggctct

SEQ ID NO: 1382871 - DNA, 19 bp, Homo sapiens
ctccggccctccagagccc

SEQ ID NO: 1382872 - DNA, 22 bp, Homo sapiens
ctcctaggacccgtctccagct

SEQ ID NO: 1382873 - DNA, 17 bp, Homo sapiens
ctcctccagtacaataa

SEQ ID NO: 1382874 - DNA, 12 bp, Homo sapiens
ctctcattccca

SEQ ID NO: 1382875 - DNA, 14 bp, Homo sapiens
ctctcattcccagg

SEQ ID NO: 1382876 - DNA, 16 bp, Homo sapiens
ctctccctgctgctcc

SEQ ID NO: 1382877 - DNA, 19 bp, Homo sapiens
ctctccctgctgctcctag

SEQ ID NO: 1382878 - DNA, 14 bp, Homo sapiens
ctctgagtcctcat

SEQ ID NO: 1382879 - DNA, 19 bp, Homo sapiens
ctctgcggagcacactggc

SEQ ID NO: 1382880 - DNA, 21 bp, Homo sapiens
ctcttaatgtctcaaaataaa

SEQ ID NO: 1382881 - DNA, 23 bp, Homo sapiens
ctcttatatgtgccccttcccca

SEQ ID NO: 1382882 - DNA, 20 bp, Homo sapiens
ctcttcatgcgcagtcccca

SEQ ID NO: 1382883 - DNA, 22 bp, Homo sapiens
ctcttcatgcgcagtccccagg

SEQ ID NO: 1382884 - DNA, 14 bp, Homo sapiens
ctcttttgctctct

SEQ ID NO: 1382885 - DNA, 16 bp, Homo sapiens
ctcttttgctctctca

SEQ ID NO: 1382886 - DNA, 14 bp, Homo sapiens
ctgaagcagagtca

SEQ ID NO: 1382887 - DNA, 16 bp, Homo sapiens
ctgaagcagagtcaag

SEQ ID NO: 1382888 - DNA, 15 bp, Homo sapiens
ctgaatcagaggcag

SEQ ID NO: 1382889 - DNA, 21 bp, Homo sapiens
ctgactttggagacgatgctt

SEQ ID NO: 1382890 - DNA, 22 bp, Homo sapiens
ctgagaagagagatcaaatgga

SEQ ID NO: 1382891 - DNA, 13 bp, Homo sapiens
ctgagatcctgga

SEQ ID NO: 1382892 - DNA, 15 bp, Homo sapiens
ctgagatcctggact

SEQ ID NO: 1382893 - DNA, 21 bp, Homo sapiens
ctgagatcctggactgagggg

SEQ ID NO: 1382894 - DNA, 22 bp, Homo sapiens
ctgagtcctcattgttcagaaa

SEQ ID NO: 1382895 - DNA, 15 bp, Homo sapiens
ctgatgatgttctga

SEQ ID NO: 1382896 - DNA, 21 bp, Homo sapiens
ctgatgatgttctgaaatgga

SEQ ID NO: 1382897 - DNA, 19 bp, Homo sapiens
ctgcacagcaggctgccag

SEQ ID NO: 1382898 - DNA, 13 bp, Homo sapiens
ctgccagtgcctg

SEQ ID NO: 1382899 - DNA, 20 bp, Homo sapiens
ctgccatcctggcccagggc

SEQ ID NO: 1382900 - DNA, 21 bp, Homo sapiens
ctgccatcctggcccagggca

SEQ ID NO: 1382901 - DNA, 20 bp, Homo sapiens
ctgcggagcacactggctca

SEQ ID NO: 1382902 - DNA, 15 bp, Homo sapiens
ctgctcccacctggc

SEQ ID NO: 1382903 - DNA, 17 bp, Homo sapiens
ctgctgagatcctggac

SEQ ID NO: 1382904 - DNA, 18 bp, Homo sapiens
ctgctgagatcctggact

SEQ ID NO: 1382905 - DNA, 19 bp, Homo sapiens
ctgctgagatcctggactg

SEQ ID NO: 1382906 - DNA, 16 bp, Homo sapiens
ctgctgcccctgcaca

SEQ ID NO: 1382907 - DNA, 22 bp, Homo sapiens
ctgctgcccctgcacagcaggc

SEQ ID NO: 1382908 - DNA, 23 bp, Homo sapiens
ctgctgcccctgcacagcaggct

SEQ ID NO: 1382909 - DNA, 18 bp, Homo sapiens
ctgctgctcctaggaccc

SEQ ID NO: 1382910 - DNA, 14 bp, Homo sapiens
ctggataatttgta

SEQ ID NO: 1382911 - DNA, 17 bp, Homo sapiens
ctggatgccccctgtgg

SEQ ID NO: 1382912 - DNA, 18 bp, Homo sapiens
ctggatgccccctgtgga

SEQ ID NO: 1382913 - DNA, 16 bp, Homo sapiens
ctggcaaacagggcct

SEQ ID NO: 1382914 - DNA, 17 bp, Homo sapiens
ctggcaaacagggcctc

SEQ ID NO: 1382915 - DNA, 15 bp, Homo sapiens
ctggcataactaaaa

SEQ ID NO: 1382916 - DNA, 17 bp, Homo sapiens
ctggcccagggcatctg

SEQ ID NO: 1382917 - DNA, 17 bp, Homo sapiens
ctggctcacccagtcct

SEQ ID NO: 1382918 - DNA, 13 bp, Homo sapiens
ctggctctgtggc

SEQ ID NO: 1382919 - DNA, 18 bp, Homo sapiens
ctgggaggaaccgagggg

SEQ ID NO: 1382920 - DNA, 17 bp, Homo sapiens
ctgggcctcggacccca

SEQ ID NO: 1382921 - DNA, 16 bp, Homo sapiens
ctgtccttccaacctg

SEQ ID NO: 1382922 - DNA, 18 bp, Homo sapiens
ctgtggatgctgctgccc

SEQ ID NO: 1382923 - DNA, 16 bp, Homo sapiens
cttaacagatcacatg

SEQ ID NO: 1382924 - DNA, 18 bp, Homo sapiens
cttacagaagggagtgaa

SEQ ID NO: 1382925 - DNA, 14 bp, Homo sapiens
cttagagatatgta

SEQ ID NO: 1382926 - DNA, 19 bp, Homo sapiens
cttagcctttaataggctt

SEQ ID NO: 1382927 - DNA, 17 bp, Homo sapiens
cttcatgcgcagtcccc

SEQ ID NO: 1382928 - DNA, 14 bp, Homo sapiens
cttctactccatgg

SEQ ID NO: 1382929 - DNA, 23 bp, Homo sapiens
cttctactccatggtgaactgaa

SEQ ID NO: 1382930 - DNA, 14 bp, Homo sapiens
cttctttcctctta

SEQ ID NO: 1382931 - DNA, 22 bp, Homo sapiens
cttgaagaactgacttcctgaa

SEQ ID NO: 1382932 - DNA, 13 bp, Homo sapiens
cttgaatgcttaa

SEQ ID NO: 1382933 - DNA, 17 bp, Homo sapiens
cttgaggccaaatgagt

SEQ ID NO: 1382934 - DNA, 14 bp, Homo sapiens
cttgattcaaataa

SEQ ID NO: 1382935 - DNA, 19 bp, Homo sapiens
cttgcatggtttggagctg

SEQ ID NO: 1382936 - DNA, 13 bp, Homo sapiens
cttgcccagcctg

SEQ ID NO: 1382937 - DNA, 17 bp, Homo sapiens
cttgcccagcctggatg

SEQ ID NO: 1382938 - DNA, 21 bp, Homo sapiens
ctttaaaagaaggtaaataat

SEQ ID NO: 1382939 - DNA, 17 bp, Homo sapiens
ctttcatactgaagatg

SEQ ID NO: 1382940 - DNA, 14 bp, Homo sapiens
ctttcggaaatgat

SEQ ID NO: 1382941 - DNA, 22 bp, Homo sapiens
ctttgaagaggaaaatgaataa

SEQ ID NO: 1382942 - DNA, 14 bp, Homo sapiens
ctttggcccagggt

SEQ ID NO: 1382943 - DNA, 15 bp, Homo sapiens
ctttggcccagggtg

SEQ ID NO: 1382944 - DNA, 20 bp, Homo sapiens
cttttgctctctcattccca

SEQ ID NO: 1382945 - DNA, 14 bp, Homo sapiens
gaaaagagatggcc

SEQ ID NO: 1382946 - DNA, 13 bp, Homo sapiens
gaaacataaataa

SEQ ID NO: 1382947 - DNA, 13 bp, Homo sapiens
gaaagagaaaaag

SEQ ID NO: 1382948 - DNA, 19 bp, Homo sapiens
gaaagaggaataaaatgat

SEQ ID NO: 1382949 - DNA, 17 bp, Homo sapiens
gaaatgattgagagcag

SEQ ID NO: 1382950 - DNA, 20 bp, Homo sapiens
gaaatggatagattgtttta

SEQ ID NO: 1382951 - DNA, 21 bp, Homo sapiens
gaaccgagggggctgctccca

SEQ ID NO: 1382952 - DNA, 14 bp, Homo sapiens
gaactgaagcagag

SEQ ID NO: 1382953 - DNA, 16 bp, Homo sapiens
gaagagagatcaaatg

SEQ ID NO: 1382954 - DNA, 17 bp, Homo sapiens
gaagggagtgaaaacct

SEQ ID NO: 1382955 - DNA, 14 bp, Homo sapiens
gaagggtggatgtc

SEQ ID NO: 1382956 - DNA, 16 bp, Homo sapiens
gaataatacattgaat

SEQ ID NO: 1382957 - DNA, 18 bp, Homo sapiens
gaattagaaacataaata

SEQ ID NO: 1382958 - DNA, 15 bp, Homo sapiens
gaccagtaattgtga

SEQ ID NO: 1382959 - DNA, 17 bp, Homo sapiens
gaccattggggctccca

SEQ ID NO: 1382960 - DNA, 20 bp, Homo sapiens
gaccattggggctcccagcc

SEQ ID NO: 1382961 - DNA, 15 bp, Homo sapiens
gacccgtctccagct

SEQ ID NO: 1382962 - DNA, 17 bp, Homo sapiens
gactccagaagcagcag

SEQ ID NO: 1382963 - DNA, 18 bp, Homo sapiens
gactccagaagcagcagc

SEQ ID NO: 1382964 - DNA, 22 bp, Homo sapiens
gactctaaaactatcagcagcg

SEQ ID NO: 1382965 - DNA, 17 bp, Homo sapiens
gactgagggggcctgga

SEQ ID NO: 1382966 - DNA, 18 bp, Homo sapiens
gactgagggggcctggat

SEQ ID NO: 1382967 - DNA, 18 bp, Homo sapiens
gagacaaatctatgccac

SEQ ID NO: 1382968 - DNA, 18 bp, Homo sapiens
gagatcaaatggaaagga

SEQ ID NO: 1382969 - DNA, 13 bp, Homo sapiens
gagatcctggact

SEQ ID NO: 1382970 - DNA, 15 bp, Homo sapiens
gagcacactggctca

SEQ ID NO: 1382971 - DNA, 20 bp, Homo sapiens
gagccatttgtcccaagtgc

SEQ ID NO: 1382972 - DNA, 12 bp, Homo sapiens
gagccccacagc

SEQ ID NO: 1382973 - DNA, 13 bp, Homo sapiens
gagccccacagcc

SEQ ID NO: 1382974 - DNA, 14 bp, Homo sapiens
gataggagaggaaa

SEQ ID NO: 1382975 - DNA, 15 bp, Homo sapiens
gatcacatgcccctc

SEQ ID NO: 1382976 - DNA, 21 bp, Homo sapiens
gatgaggctggataggagagg

SEQ ID NO: 1382977 - DNA, 13 bp, Homo sapiens
gatggcctgagaa

SEQ ID NO: 1382978 - DNA, 14 bp, Homo sapiens
gattatataaaata

SEQ ID NO: 1382979 - DNA, 17 bp, Homo sapiens
gattcaaataaccctga

SEQ ID NO: 1382980 - DNA, 18 bp, Homo sapiens
gattcaaataaccctgaa

SEQ ID NO: 1382981 - DNA, 21 bp, Homo sapiens
gattcaaataaccctgaatca

SEQ ID NO: 1382982 - DNA, 16 bp, Homo sapiens
gcaaacagggcctctg

SEQ ID NO: 1382983 - DNA, 18 bp, Homo sapiens
gcaaacagggcctctgcg

SEQ ID NO: 1382984 - DNA, 18 bp, Homo sapiens
gcaaaccaatttgttctg

SEQ ID NO: 1382985 - DNA, 13 bp, Homo sapiens
gcaacatggcttt

SEQ ID NO: 1382986 - DNA, 19 bp, Homo sapiens
gcacactggctcacccagt

SEQ ID NO: 1382987 - DNA, 22 bp, Homo sapiens
gcacagcaggctgccagtgcct

SEQ ID NO: 1382988 - DNA, 22 bp, Homo sapiens
gcactggcaaacagggcctctg

SEQ ID NO: 1382989 - DNA, 22 bp, Homo sapiens
gcagaccattggggctcccagc

SEQ ID NO: 1382990 - DNA, 23 bp, Homo sapiens
gcagaccattggggctcccagcc

SEQ ID NO: 1382991 - DNA, 19 bp, Homo sapiens
gcagagacctcctgatgtc

SEQ ID NO: 1382992 - DNA, 15 bp, Homo sapiens
gcagagtcaagctga

SEQ ID NO: 1382993 - DNA, 17 bp, Homo sapiens
gcagcagcagcagcagt

SEQ ID NO: 1382994 - DNA, 16 bp, Homo sapiens
gcatatttgctatgtc

SEQ ID NO: 1382995 - DNA, 20 bp, Homo sapiens
gcatgctccctcatgcagat

SEQ ID NO: 1382996 - DNA, 11 bp, Homo sapiens
gccaaatgagt

SEQ ID NO: 1382997 - DNA, 19 bp, Homo sapiens
gccatcctggcccagggca

SEQ ID NO: 1382998 - DNA, 18 bp, Homo sapiens
gccatgagccgcccaagg

SEQ ID NO: 1382999 - DNA, 21 bp, Homo sapiens
gccatgagccgcccaaggcct

SEQ ID NO: 1383000 - DNA, 14 bp, Homo sapiens
gccatttgtcccaa

SEQ ID NO: 1383001 - DNA, 18 bp, Homo sapiens
gccatttgtcccaagtgc

SEQ ID NO: 1383002 - DNA, 14 bp, Homo sapiens
gcccagcctggatg

SEQ ID NO: 1383003 - DNA, 16 bp, Homo sapiens
gcccagcctggatgcc

SEQ ID NO: 1383004 - DNA, 15 bp, Homo sapiens
gcccagggcatctgg

SEQ ID NO: 1383005 - DNA, 15 bp, Homo sapiens
gccccaccagtgcct

SEQ ID NO: 1383006 - DNA, 18 bp, Homo sapiens
gccccaccagtgcctctc

SEQ ID NO: 1383007 - DNA, 14 bp, Homo sapiens
gccccttccccatg

SEQ ID NO: 1383008 - DNA, 16 bp, Homo sapiens
gccctccagagcccca

SEQ ID NO: 1383009 - DNA, 18 bp, Homo sapiens
gccctccagagccccaca

SEQ ID NO: 1383010 - DNA, 14 bp, Homo sapiens
gccctccaggcttt

SEQ ID NO: 1383011 - DNA, 13 bp, Homo sapiens
gccgcccaaggcc

SEQ ID NO: 1383012 - DNA, 23 bp, Homo sapiens
gccgcccaaggccttcccctggc

SEQ ID NO: 1383013 - DNA, 22 bp, Homo sapiens
gcctattagtagttaattctgt

SEQ ID NO: 1383014 - DNA, 17 bp, Homo sapiens
gcctctccctgctgctc

SEQ ID NO: 1383015 - DNA, 18 bp, Homo sapiens
gcctctccctgctgctcc

SEQ ID NO: 1383016 - DNA, 21 bp, Homo sapiens
gcctctccctgctgctcctag

SEQ ID NO: 1383017 - DNA, 22 bp, Homo sapiens
gcctgagaagagagatcaaatg

SEQ ID NO: 1383018 - DNA, 13 bp, Homo sapiens
gcctgccacctcc

SEQ ID NO: 1383019 - DNA, 21 bp, Homo sapiens
gcctgccacctccccccacaa

SEQ ID NO: 1383020 - DNA, 19 bp, Homo sapiens
gccttcccctggcactggc

SEQ ID NO: 1383021 - DNA, 15 bp, Homo sapiens
gccttgcccagcctg

SEQ ID NO: 1383022 - DNA, 17 bp, Homo sapiens
gccttgcccagcctgga

SEQ ID NO: 1383023 - DNA, 13 bp, Homo sapiens
gcgcagtccccag

SEQ ID NO: 1383024 - DNA, 13 bp, Homo sapiens
gctactgccatcc

SEQ ID NO: 1383025 - DNA, 14 bp, Homo sapiens
gctcccagccaggc

SEQ ID NO: 1383026 - DNA, 16 bp, Homo sapiens
gctcccagccaggccc

SEQ ID NO: 1383027 - DNA, 22 bp, Homo sapiens
gctcctaggacccgtctccagc

SEQ ID NO: 1383028 - DNA, 20 bp, Homo sapiens
gctctctcattcccaggcac

SEQ ID NO: 1383029 - DNA, 20 bp, Homo sapiens
gctgcccctgcacagcaggc

SEQ ID NO: 1383030 - DNA, 10 bp, Homo sapiens
gctgctccca

SEQ ID NO: 1383031 - DNA, 22 bp, Homo sapiens
gctgctcccacctggctctgtg

SEQ ID NO: 1383032 - DNA, 24 bp, Homo sapiens
gctgctcccacctggctctgtggc

SEQ ID NO: 1383033 - DNA, 20 bp, Homo sapiens
gctgctgagatcctggactg

SEQ ID NO: 1383034 - DNA, 22 bp, Homo sapiens
gctgctgagcacatctcttcat

SEQ ID NO: 1383035 - DNA, 23 bp, Homo sapiens
gctgctgagcacatctcttcatg

SEQ ID NO: 1383036 - DNA, 13 bp, Homo sapiens
gctgctgcccctg

SEQ ID NO: 1383037 - DNA, 14 bp, Homo sapiens
gctggataggagag

SEQ ID NO: 1383038 - DNA, 18 bp, Homo sapiens
gctggataggagaggaaa

SEQ ID NO: 1383039 - DNA, 19 bp, Homo sapiens
gcttgaggccaaatgagtt

SEQ ID NO: 1383040 - DNA, 20 bp, Homo sapiens
ggaaaaggcttgagtctgga

SEQ ID NO: 1383041 - DNA, 14 bp, Homo sapiens
ggaaaatgaataat

SEQ ID NO: 1383042 - DNA, 15 bp, Homo sapiens
ggaaaggagaggaaa

SEQ ID NO: 1383043 - DNA, 14 bp, Homo sapiens
ggactttgcacact

SEQ ID NO: 1383044 - DNA, 23 bp, Homo sapiens
ggactttgcacactttggcccag

SEQ ID NO: 1383045 - DNA, 18 bp, Homo sapiens
ggagaaaggcaaaccaat

SEQ ID NO: 1383046 - DNA, 14 bp, Homo sapiens
ggagatgaggctgg

SEQ ID NO: 1383047 - DNA, 16 bp, Homo sapiens
ggagatgaggctggat

SEQ ID NO: 1383048 - DNA, 20 bp, Homo sapiens
ggaggaaccgagggggctgc

SEQ ID NO: 1383049 - DNA, 15 bp, Homo sapiens
ggagtagagtcagga

SEQ ID NO: 1383050 - DNA, 14 bp, Homo sapiens
ggcaaacagggcct

SEQ ID NO: 1383051 - DNA, 22 bp, Homo sapiens
ggcactggcaaacagggcctct

SEQ ID NO: 1383052 - DNA, 23 bp, Homo sapiens
ggcactggcaaacagggcctctg

SEQ ID NO: 1383053 - DNA, 17 bp, Homo sapiens
ggcataactaaaattaa

SEQ ID NO: 1383054 - DNA, 18 bp, Homo sapiens
ggccccaccagtgcctct

SEQ ID NO: 1383055 - DNA, 17 bp, Homo sapiens
ggccctccagagcccca

SEQ ID NO: 1383056 - DNA, 12 bp, Homo sapiens
ggctcaaataaa

SEQ ID NO: 1383057 - DNA, 16 bp, Homo sapiens
ggctcagacacctaga

SEQ ID NO: 1383058 - DNA, 16 bp, Homo sapiens
ggctcccagccaggcc

SEQ ID NO: 1383059 - DNA, 14 bp, Homo sapiens
ggctggataggaga

SEQ ID NO: 1383060 - DNA, 19 bp, Homo sapiens
ggctggataggagaggaaa

SEQ ID NO: 1383061 - DNA, 19 bp, Homo sapiens
gggccaccgccttgcccag

SEQ ID NO: 1383062 - DNA, 23 bp, Homo sapiens
gggcctctgcggagcacactggc

SEQ ID NO: 1383063 - DNA, 12 bp, Homo sapiens
gggcctggatgc

SEQ ID NO: 1383064 - DNA, 22 bp, Homo sapiens
gggctgctcccacctggctctg

SEQ ID NO: 1383065 - DNA, 14 bp, Homo sapiens
ggggctgctcccac

SEQ ID NO: 1383066 - DNA, 15 bp, Homo sapiens
gggggcctggatgcc

SEQ ID NO: 1383067 - DNA, 10 bp, Homo sapiens
gggtctgtga

SEQ ID NO: 1383068 - DNA, 19 bp, Homo sapiens
ggtaagcaacatggctttg

SEQ ID NO: 1383069 - DNA, 20 bp, Homo sapiens
ggtaagggactccagaagca

SEQ ID NO: 1383070 - DNA, 18 bp, Homo sapiens
ggtttccatcaaagccct

SEQ ID NO: 1383071 - DNA, 15 bp, Homo sapiens
ggtttggagctgatc

SEQ ID NO: 1383072 - DNA, 19 bp, Homo sapiens
ggtttgtgggtccaggaga

SEQ ID NO: 1383073 - DNA, 24 bp, Homo sapiens
gtaagggactccagaagcagcagc

SEQ ID NO: 1383074 - DNA, 18 bp, Homo sapiens
gtactctgagtcctcatt

SEQ ID NO: 1383075 - DNA, 15 bp, Homo sapiens
gtagagtcaggagaa

SEQ ID NO: 1383076 - DNA, 23 bp, Homo sapiens
gtatctgatgatgttctgaaatg

SEQ ID NO: 1383077 - DNA, 17 bp, Homo sapiens
gtcctcattgttcagaa

SEQ ID NO: 1383078 - DNA, 19 bp, Homo sapiens
gtcctcattgttcagaaaa

SEQ ID NO: 1383079 - DNA, 18 bp, Homo sapiens
gtccttccaacctgttca

SEQ ID NO: 1383080 - DNA, 19 bp, Homo sapiens
gtcggccccaccagtgcct

SEQ ID NO: 1383081 - DNA, 14 bp, Homo sapiens
gtgatctgtccttc

SEQ ID NO: 1383082 - DNA, 21 bp, Homo sapiens
gtgcctgggtggatgggccac

SEQ ID NO: 1383083 - DNA, 22 bp, Homo sapiens
gtggccacacctctatcccggc

SEQ ID NO: 1383084 - DNA, 20 bp, Homo sapiens
gtggcgagccatttgtccca

SEQ ID NO: 1383085 - DNA, 16 bp, Homo sapiens
gttcacgtgactcctc

SEQ ID NO: 1383086 - DNA, 22 bp, Homo sapiens
gttcagaaaagcacctcttgaa

SEQ ID NO: 1383087 - DNA, 18 bp, Homo sapiens
taaaagaaagatgctgat

SEQ ID NO: 1383088 - DNA, 21 bp, Homo sapiens
taaaatgaccagtaattgtga

SEQ ID NO: 1383089 - DNA, 18 bp, Homo sapiens
taaaattaagtatatata

SEQ ID NO: 1383090 - DNA, 19 bp, Homo sapiens
taaaattaagtatatatat

SEQ ID NO: 1383091 - DNA, 19 bp, Homo sapiens
taaataatcatacacagaa

SEQ ID NO: 1383092 - DNA, 18 bp, Homo sapiens
taacattatattcccaaa

SEQ ID NO: 1383093 - DNA, 14 bp, Homo sapiens
taactaaaattaag

SEQ ID NO: 1383094 - DNA, 19 bp, Homo sapiens
taactaaaattaagtatat

SEQ ID NO: 1383095 - DNA, 14 bp, Homo sapiens
taagcaacatggct

SEQ ID NO: 1383096 - DNA, 16 bp, Homo sapiens
taagcaacatggcttt

SEQ ID NO: 1383097 - DNA, 21 bp, Homo sapiens
taagcacaaccatgttcttga

SEQ ID NO: 1383098 - DNA, 20 bp, Homo sapiens
taagggactccagaagcagc

SEQ ID NO: 1383099 - DNA, 22 bp, Homo sapiens
taagggactccagaagcagcag

SEQ ID NO: 1383100 - DNA, 17 bp, Homo sapiens
taagtgcttgaggccaa

SEQ ID NO: 1383101 - DNA, 19 bp, Homo sapiens
taatgattatataaaatac

SEQ ID NO: 1383102 - DNA, 17 bp, Homo sapiens
taatgtctcaaaataaa

SEQ ID NO: 1383103 - DNA, 16 bp, Homo sapiens
taatgtttagtcagtg

SEQ ID NO: 1383104 - DNA, 21 bp, Homo sapiens
taatttgtataagatgctgct

SEQ ID NO: 1383105 - DNA, 17 bp, Homo sapiens
tacacagaaatcctaac

SEQ ID NO: 1383106 - DNA, 22 bp, Homo sapiens
taccactacttagagatatgta

SEQ ID NO: 1383107 - DNA, 22 bp, Homo sapiens
tactgccatcctggcccagggc

SEQ ID NO: 1383108 - DNA, 18 bp, Homo sapiens
tagaaacataaataaaat

SEQ ID NO: 1383109 - DNA, 19 bp, Homo sapiens
taggacccgtctccagctg

SEQ ID NO: 1383110 - DNA, 14 bp, Homo sapiens
taggtaatgattat

SEQ ID NO: 1383111 - DNA, 13 bp, Homo sapiens
tagttaattctgt

SEQ ID NO: 1383112 - DNA, 19 bp, Homo sapiens
tatcatgcttctactccat

SEQ ID NO: 1383113 - DNA, 18 bp, Homo sapiens
tatctgatgatgttctga

SEQ ID NO: 1383114 - DNA, 16 bp, Homo sapiens
tatgagcatgctccct

SEQ ID NO: 1383115 - DNA, 14 bp, Homo sapiens
tattaagtttgaaa

SEQ ID NO: 1383116 - DNA, 15 bp, Homo sapiens
tattttgtgtccttt

SEQ ID NO: 1383117 - DNA, 14 bp, Homo sapiens
tcaaaataaaacca

SEQ ID NO: 1383118 - DNA, 15 bp, Homo sapiens
tcaaataaccctgaa

SEQ ID NO: 1383119 - DNA, 12 bp, Homo sapiens
tcaatccccata

SEQ ID NO: 1383120 - DNA, 18 bp, Homo sapiens
tcacatgcccctcttaga

SEQ ID NO: 1383121 - DNA, 20 bp, Homo sapiens
tcacatgcccctcttagaag

SEQ ID NO: 1383122 - DNA, 12 bp, Homo sapiens
tcagaaaagcac

SEQ ID NO: 1383123 - DNA, 18 bp, Homo sapiens
tcagaggcagagacctcc

SEQ ID NO: 1383124 - DNA, 22 bp, Homo sapiens
tcagctcagcattgtgtacaaa

SEQ ID NO: 1383125 - DNA, 15 bp, Homo sapiens
tcaggagaaacccct

SEQ ID NO: 1383126 - DNA, 20 bp, Homo sapiens
tcagtgtactctgagtcctc

SEQ ID NO: 1383127 - DNA, 13 bp, Homo sapiens
tcataaaaataaa

SEQ ID NO: 1383128 - DNA, 22 bp, Homo sapiens
tcataaaaataaaatctgtaaa

SEQ ID NO: 1383129 - DNA, 20 bp, Homo sapiens
tcatacacagaaatcctaac

SEQ ID NO: 1383130 - DNA, 22 bp, Homo sapiens
tcatacacagaaatcctaacat

SEQ ID NO: 1383131 - DNA, 23 bp, Homo sapiens
tcattaaactaattaaactgatg

SEQ ID NO: 1383132 - DNA, 12 bp, Homo sapiens
tccagaagcagc

SEQ ID NO: 1383133 - DNA, 14 bp, Homo sapiens
tccagaagcagcag

SEQ ID NO: 1383134 - DNA, 14 bp, Homo sapiens
tccagctgctgaga

SEQ ID NO: 1383135 - DNA, 14 bp, Homo sapiens
tccatcaaagccct

SEQ ID NO: 1383136 - DNA, 16 bp, Homo sapiens
tccatggtgaactgaa

SEQ ID NO: 1383137 - DNA, 22 bp, Homo sapiens
tccatggtgaactgaagcagag

SEQ ID NO: 1383138 - DNA, 14 bp, Homo sapiens
tcccaaatctcaaa

SEQ ID NO: 1383139 - DNA, 19 bp, Homo sapiens
tcccacctggctctgtggc

SEQ ID NO: 1383140 - DNA, 20 bp, Homo sapiens
tcccacctggctctgtggcg

SEQ ID NO: 1383141 - DNA, 13 bp, Homo sapiens
tcccagccaggcc

SEQ ID NO: 1383142 - DNA, 16 bp, Homo sapiens
tcccaggcactctctt

SEQ ID NO: 1383143 - DNA, 23 bp, Homo sapiens
tcccatgagggagatgccatgag

SEQ ID NO: 1383144 - DNA, 17 bp, Homo sapiens
tccccccacaagtgccc

SEQ ID NO: 1383145 - DNA, 22 bp, Homo sapiens
tccccccacaagtgccctccag

SEQ ID NO: 1383146 - DNA, 14 bp, Homo sapiens
tcccctgcccatgc

SEQ ID NO: 1383147 - DNA, 21 bp, Homo sapiens
tcccctgcccatgctgggagc

SEQ ID NO: 1383148 - DNA, 16 bp, Homo sapiens
tcccggctttggtgcg

SEQ ID NO: 1383149 - DNA, 14 bp, Homo sapiens
tccctcagccctca

SEQ ID NO: 1383150 - DNA, 14 bp, Homo sapiens
tccgtcccctgccc

SEQ ID NO: 1383151 - DNA, 15 bp, Homo sapiens
tcctccagtacaata

SEQ ID NO: 1383152 - DNA, 13 bp, Homo sapiens
tcctggcccaggg

SEQ ID NO: 1383153 - DNA, 20 bp, Homo sapiens
tccttacagaagggagtgaa

SEQ ID NO: 1383154 - DNA, 15 bp, Homo sapiens
tcctttgaagaggaa

SEQ ID NO: 1383155 - DNA, 18 bp, Homo sapiens
tcggccccaccagtgcct

SEQ ID NO: 1383156 - DNA, 19 bp, Homo sapiens
tcggccccaccagtgcctc

SEQ ID NO: 1383157 - DNA, 20 bp, Homo sapiens
tctactccatggtgaactga

SEQ ID NO: 1383158 - DNA, 18 bp, Homo sapiens
tctcaaaataaaaccaga

SEQ ID NO: 1383159 - DNA, 20 bp, Homo sapiens
tctccctgctgctcctagga

SEQ ID NO: 1383160 - DNA, 22 bp, Homo sapiens
tctgcggagcacactggctcac

SEQ ID NO: 1383161 - DNA, 21 bp, Homo sapiens
tctgtccttccaacctgttca

SEQ ID NO: 1383162 - DNA, 15 bp, Homo sapiens
tcttaatgtctcaaa

SEQ ID NO: 1383163 - DNA, 23 bp, Homo sapiens
tcttgagcagctgaattggctgc

SEQ ID NO: 1383164 - DNA, 19 bp, Homo sapiens
tcttgcatggtttggagct

SEQ ID NO: 1383165 - DNA, 12 bp, Homo sapiens
tctttcctctta

SEQ ID NO: 1383166 - DNA, 21 bp, Homo sapiens
tgaaatggatagattgtttta

SEQ ID NO: 1383167 - DNA, 22 bp, Homo sapiens
tgaagaggaaaatgaataatac

SEQ ID NO: 1383168 - DNA, 21 bp, Homo sapiens
tgaagcagagtcaagctgatg

SEQ ID NO: 1383169 - DNA, 16 bp, Homo sapiens
tgaatcagaggcagag

SEQ ID NO: 1383170 - DNA, 19 bp, Homo sapiens
tgaatgcttaaatgatcaa

SEQ ID NO: 1383171 - DNA, 21 bp, Homo sapiens
tgaattagaaacataaataaa

SEQ ID NO: 1383172 - DNA, 16 bp, Homo sapiens
tgaattggctgccaag

SEQ ID NO: 1383173 - DNA, 22 bp, Homo sapiens
tgaattggctgccaagagtcca

SEQ ID NO: 1383174 - DNA, 16 bp, Homo sapiens
tgacaccttttcaggt

SEQ ID NO: 1383175 - DNA, 18 bp, Homo sapiens
tgagaagagagatcaaat

SEQ ID NO: 1383176 - DNA, 17 bp, Homo sapiens
tgagcacatctcttcat

SEQ ID NO: 1383177 - DNA, 20 bp, Homo sapiens
tgagcacatctcttcatgcg

SEQ ID NO: 1383178 - DNA, 18 bp, Homo sapiens
tgaggctggataggagag

SEQ ID NO: 1383179 - DNA, 20 bp, Homo sapiens
tgagtcctcattgttcagaa

SEQ ID NO: 1383180 - DNA, 16 bp, Homo sapiens
tgatcaaggagggaga

SEQ ID NO: 1383181 - DNA, 15 bp, Homo sapiens
tgatgatgttctgaa

SEQ ID NO: 1383182 - DNA, 23 bp, Homo sapiens
tgatggggaagggtggatgtccc

SEQ ID NO: 1383183 - DNA, 13 bp, Homo sapiens
tgcacactttggc

SEQ ID NO: 1383184 - DNA, 17 bp, Homo sapiens
tgcacactttggcccag

SEQ ID NO: 1383185 - DNA, 21 bp, Homo sapiens
tgcacactttggcccagggtg

SEQ ID NO: 1383186 - DNA, 22 bp, Homo sapiens
tgcattcattcatcctcttata

SEQ ID NO: 1383187 - DNA, 17 bp, Homo sapiens
tgccaaagaagcagacc

SEQ ID NO: 1383188 - DNA, 16 bp, Homo sapiens
tgccaagagtccaagc

SEQ ID NO: 1383189 - DNA, 16 bp, Homo sapiens
tgccagtgcctgggtg

SEQ ID NO: 1383190 - DNA, 20 bp, Homo sapiens
tgccatgagccgcccaaggc

SEQ ID NO: 1383191 - DNA, 20 bp, Homo sapiens
tgcccatgctgggagcccac

SEQ ID NO: 1383192 - DNA, 19 bp, Homo sapiens
tgcctgggtggatgggcca

SEQ ID NO: 1383193 - DNA, 17 bp, Homo sapiens
tgctcccacctggctct

SEQ ID NO: 1383194 - DNA, 13 bp, Homo sapiens
tgctccctcatgc

SEQ ID NO: 1383195 - DNA, 20 bp, Homo sapiens
tgctcctccagtacaataaa

SEQ ID NO: 1383196 - DNA, 20 bp, Homo sapiens
tgctgcccctgcacagcagg

SEQ ID NO: 1383197 - DNA, 18 bp, Homo sapiens
tgcttaaatgatcaagga

SEQ ID NO: 1383198 - DNA, 23 bp, Homo sapiens
tgcttctactccatggtgaactg

SEQ ID NO: 1383199 - DNA, 14 bp, Homo sapiens
tggaaaggagagga

SEQ ID NO: 1383200 - DNA, 15 bp, Homo sapiens
tggaaaggagaggaa

SEQ ID NO: 1383201 - DNA, 24 bp, Homo sapiens
tggaccagttccctcagccctcat

SEQ ID NO: 1383202 - DNA, 19 bp, Homo sapiens
tggactgagaaattatact

SEQ ID NO: 1383203 - DNA, 13 bp, Homo sapiens
tggagtagagtca

SEQ ID NO: 1383204 - DNA, 18 bp, Homo sapiens
tggagtagagtcaggaga

SEQ ID NO: 1383205 - DNA, 16 bp, Homo sapiens
tggatagattgtttta

SEQ ID NO: 1383206 - DNA, 20 bp, Homo sapiens
tggcccaacatacgcactgg

SEQ ID NO: 1383207 - DNA, 19 bp, Homo sapiens
tggcccagggcatctggga

SEQ ID NO: 1383208 - DNA, 16 bp, Homo sapiens
tggcccagggtggcca

SEQ ID NO: 1383209 - DNA, 18 bp, Homo sapiens
tggcccagggtggccaca

SEQ ID NO: 1383210 - DNA, 16 bp, Homo sapiens
tggctttgatgataaa

SEQ ID NO: 1383211 - DNA, 21 bp, Homo sapiens
tgggcatactaataaagtatg

SEQ ID NO: 1383212 - DNA, 23 bp, Homo sapiens
tgggccaccgccttgcccagcct

SEQ ID NO: 1383213 - DNA, 13 bp, Homo sapiens
tggggctcccagc

SEQ ID NO: 1383214 - DNA, 19 bp, Homo sapiens
tggggctcccagccaggcc

SEQ ID NO: 1383215 - DNA, 12 bp, Homo sapiens
tgggtccaggag

SEQ ID NO: 1383216 - DNA, 22 bp, Homo sapiens
tgtaaaccataggtaatgatta

SEQ ID NO: 1383217 - DNA, 18 bp, Homo sapiens
tgtccaaacttaacagat

SEQ ID NO: 1383218 - DNA, 13 bp, Homo sapiens
tgtcccaagtgcc

SEQ ID NO: 1383219 - DNA, 12 bp, Homo sapiens
tgtcccttcccc

SEQ ID NO: 1383220 - DNA, 13 bp, Homo sapiens
tgtcccttcccca

SEQ ID NO: 1383221 - DNA, 22 bp, Homo sapiens
tgtcggccccaccagtgcctct

SEQ ID NO: 1383222 - DNA, 18 bp, Homo sapiens
tgtctctcttttgctctc

SEQ ID NO: 1383223 - DNA, 16 bp, Homo sapiens
tgtgaataccccaaga

SEQ ID NO: 1383224 - DNA, 13 bp, Homo sapiens
tgtgcacctgact

SEQ ID NO: 1383225 - DNA, 21 bp, Homo sapiens
tgtggtaagcaacatggcttt

SEQ ID NO: 1383226 - DNA, 13 bp, Homo sapiens
tgtgtacaaaata

SEQ ID NO: 1383227 - DNA, 19 bp, Homo sapiens
tgttcacgtgactcctcaa

SEQ ID NO: 1383228 - DNA, 14 bp, Homo sapiens
tgttcttgagcagc

SEQ ID NO: 1383229 - DNA, 18 bp, Homo sapiens
ttaaactaattaaactga

SEQ ID NO: 1383230 - DNA, 14 bp, Homo sapiens
ttaagtatatatat

SEQ ID NO: 1383231 - DNA, 21 bp, Homo sapiens
ttaagtgcttgaggccaaatg

SEQ ID NO: 1383232 - DNA, 13 bp, Homo sapiens
ttaatgtctcaaa

SEQ ID NO: 1383233 - DNA, 18 bp, Homo sapiens
ttatattcccaaatctca

SEQ ID NO: 1383234 - DNA, 19 bp, Homo sapiens
ttcaaataaccctgaatca

SEQ ID NO: 1383235 - DNA, 13 bp, Homo sapiens
ttcaatccccata

SEQ ID NO: 1383236 - DNA, 19 bp, Homo sapiens
ttcatgcgcagtccccagg

SEQ ID NO: 1383237 - DNA, 17 bp, Homo sapiens
ttccaacctgttcacgt

SEQ ID NO: 1383238 - DNA, 21 bp, Homo sapiens
ttccatcaaagccctccctgt

SEQ ID NO: 1383239 - DNA, 15 bp, Homo sapiens
ttcccaaatctcaaa

SEQ ID NO: 1383240 - DNA, 20 bp, Homo sapiens
ttcctcttaatgtctcaaaa

SEQ ID NO: 1383241 - DNA, 16 bp, Homo sapiens
ttcctgctcctccagt

SEQ ID NO: 1383242 - DNA, 20 bp, Homo sapiens
ttctggcataactaaaatta

SEQ ID NO: 1383243 - DNA, 13 bp, Homo sapiens
ttgaagaggaaaa

SEQ ID NO: 1383244 - DNA, 18 bp, Homo sapiens
ttgaatgcttaaatgatc

SEQ ID NO: 1383245 - DNA, 14 bp, Homo sapiens
ttgaattagaaaca

SEQ ID NO: 1383246 - DNA, 12 bp, Homo sapiens
ttgagcagctga

SEQ ID NO: 1383247 - DNA, 15 bp, Homo sapiens
ttgcccagcctggat

SEQ ID NO: 1383248 - DNA, 11 bp, Homo sapiens
ttgctctctca

SEQ ID NO: 1383249 - DNA, 18 bp, Homo sapiens
ttgctctctcattcccag

SEQ ID NO: 1383250 - DNA, 14 bp, Homo sapiens
ttggaatttgctta

SEQ ID NO: 1383251 - DNA, 21 bp, Homo sapiens
ttggtaccctggacagtgcct

SEQ ID NO: 1383252 - DNA, 16 bp, Homo sapiens
ttggtgcggggtacac

SEQ ID NO: 1383253 - DNA, 18 bp, Homo sapiens
ttgtataagatgctgctg

SEQ ID NO: 1383254 - DNA, 12 bp, Homo sapiens
ttgttctgtgca

SEQ ID NO: 1383255 - DNA, 18 bp, Homo sapiens
tttcatggagtagagtca

SEQ ID NO: 1383256 - DNA, 18 bp, Homo sapiens
tttggctcaaataaaatt

SEQ ID NO: 1383257 - DNA, 10 bp, Homo sapiens
tttgttctgt

SEQ ID NO: 1383258 - DNA, 22 bp, Homo sapiens
ttttcttttgctttatgggttt

SEQ ID NO: 1383259 - DNA, 22 bp, Homo sapiens
accagtgcctctccctgctgct

SEQ ID NO: 1383260 - DNA, 23 bp, Homo sapiens
accagtgcctctccctgctgctc

SEQ ID NO: 1383261 - DNA, 17 bp, Homo sapiens
accataagctactgcca

SEQ ID NO: 1383262 - DNA, 18 bp, Homo sapiens
accattggggctcccagc

SEQ ID NO: 1383263 - DNA, 13 bp, Homo sapiens
gtcccaagtgcca

SEQ ID NO: 1383264 - DNA, 14 bp, Homo sapiens
gtcccaagtgccaa

SEQ ID NO: 1383265 - DNA, 21 bp, Homo sapiens
gtcctcattgttcagaaaagc

SEQ ID NO: 1383266 - DNA, 23 bp, Homo sapiens
gtcctcattgttcagaaaagcac

SEQ ID NO: 1383267 - DNA, 22 bp, Homo sapiens
gtcggccccaccagtgcctctc

SEQ ID NO: 1383268 - DNA, 21 bp, Homo sapiens
gtctatgatgtccaaacttaa

SEQ ID NO: 1383269 - DNA, 20 bp, Homo sapiens
gtctcaaaataaaaccagaa

SEQ ID NO: 1383270 - DNA, 17 bp, Homo sapiens
gtctctcttttgctctc

SEQ ID NO: 1383271 - DNA, 11 bp, Homo sapiens
gtctgtctctc

SEQ ID NO: 1383272 - DNA, 22 bp, Homo sapiens
gtctgtctctcttttgctctct

SEQ ID NO: 1383273 - DNA, 23 bp, Homo sapiens
gtcttggtttccatcaaagccct

SEQ ID NO: 1383274 - DNA, 15 bp, Homo sapiens
gtgaactgaagcaga

SEQ ID NO: 1383275 - DNA, 14 bp, Homo sapiens
gtgaataccccaag

SEQ ID NO: 1383276 - DNA, 15 bp, Homo sapiens
gtgaatgggaaaaga

SEQ ID NO: 1383277 - DNA, 13 bp, Homo sapiens
gtgatctgtcctt

SEQ ID NO: 1383278 - DNA, 19 bp, Homo sapiens
gtgattcctttgaagagga

SEQ ID NO: 1383279 - DNA, 21 bp, Homo sapiens
gtgattcctttgaagaggaaa

SEQ ID NO: 1383280 - DNA, 20 bp, Homo sapiens
gtgcctaactccttacagaa

SEQ ID NO: 1383281 - DNA, 12 bp, Homo sapiens
gtgcctctccct

SEQ ID NO: 1383282 - DNA, 14 bp, Homo sapiens
gtgcctctccctgc

SEQ ID NO: 1383283 - DNA, 16 bp, Homo sapiens
gtgcctctccctgctg

SEQ ID NO: 1383284 - DNA, 13 bp, Homo sapiens
gtgcggggtacac

SEQ ID NO: 1383285 - DNA, 19 bp, Homo sapiens
gtggatgtcccttccccac

SEQ ID NO: 1383286 - DNA, 15 bp, Homo sapiens
gtgtactctgagtcc

SEQ ID NO: 1383287 - DNA, 17 bp, Homo sapiens
gtgtgaataccccaaga

SEQ ID NO: 1383288 - DNA, 15 bp, Homo sapiens
gttccctcagccctc

SEQ ID NO: 1383289 - DNA, 16 bp, Homo sapiens
gttccctcagccctca

SEQ ID NO: 1383290 - DNA, 19 bp, Homo sapiens
gttcccttgattcaaataa

SEQ ID NO: 1383291 - DNA, 18 bp, Homo sapiens
gtttccatcaaagccctc

SEQ ID NO: 1383292 - DNA, 17 bp, Homo sapiens
taaaagaaggtaaataa

SEQ ID NO: 1383293 - DNA, 18 bp, Homo sapiens
taaaatctgtaaaccata

SEQ ID NO: 1383294 - DNA, 22 bp, Homo sapiens
taaaatctgtaaaccataggta

SEQ ID NO: 1383295 - DNA, 22 bp, Homo sapiens
taaacaaagagtagaactttaa

SEQ ID NO: 1383296 - DNA, 13 bp, Homo sapiens
taaataaaatgac

SEQ ID NO: 1383297 - DNA, 15 bp, Homo sapiens
taactccttacagaa

SEQ ID NO: 1383298 - DNA, 17 bp, Homo sapiens
taagcaacatggctttg

SEQ ID NO: 1383299 - DNA, 19 bp, Homo sapiens
taagcacaaccatgttctt

SEQ ID NO: 1383300 - DNA, 14 bp, Homo sapiens
taagctactgccat

SEQ ID NO: 1383301 - DNA, 16 bp, Homo sapiens
taagctactgccatcc

SEQ ID NO: 1383302 - DNA, 18 bp, Homo sapiens
taagtttgaaaatagtta

SEQ ID NO: 1383303 - DNA, 20 bp, Homo sapiens
taatggtttttgttagttca

SEQ ID NO: 1383304 - DNA, 20 bp, Homo sapiens
taccctggacagtgcctaac

SEQ ID NO: 1383305 - DNA, 20 bp, Homo sapiens
tacctgggcatactaataaa

SEQ ID NO: 1383306 - DNA, 17 bp, Homo sapiens
tactctgagtcctcatt

SEQ ID NO: 1383307 - DNA, 18 bp, Homo sapiens
tactgccatcctggccca

SEQ ID NO: 1383308 - DNA, 15 bp, Homo sapiens
tacttagagatatgt

SEQ ID NO: 1383309 - DNA, 17 bp, Homo sapiens
tacttagagatatgtat

SEQ ID NO: 1383310 - DNA, 14 bp, Homo sapiens
tagaaacataaata

SEQ ID NO: 1383311 - DNA, 18 bp, Homo sapiens
tagactctaaaactatca

SEQ ID NO: 1383312 - DNA, 17 bp, Homo sapiens
tagagggtccagtcttc

SEQ ID NO: 1383313 - DNA, 12 bp, Homo sapiens
taggagaggaaa

SEQ ID NO: 1383314 - DNA, 15 bp, Homo sapiens
tatataaaatacata

SEQ ID NO: 1383315 - DNA, 13 bp, Homo sapiens
tatcataaaaata

SEQ ID NO: 1383316 - DNA, 14 bp, Homo sapiens
tatcctctgttgat

SEQ ID NO: 1383317 - DNA, 18 bp, Homo sapiens
tatgagcatgctccctca

SEQ ID NO: 1383318 - DNA, 17 bp, Homo sapiens
tattcccaaatctcaaa

SEQ ID NO: 1383319 - DNA, 17 bp, Homo sapiens
tcaaaataaaaccagaa

SEQ ID NO: 1383320 - DNA, 20 bp, Homo sapiens
tcaaagccctccctgtctgt

SEQ ID NO: 1383321 - DNA, 23 bp, Homo sapiens
tcaaatggaaaggagaggaaaga

SEQ ID NO: 1383322 - DNA, 20 bp, Homo sapiens
tcaaggagggagaaaggcaa

SEQ ID NO: 1383323 - DNA, 13 bp, Homo sapiens
tcacccagtcctg

SEQ ID NO: 1383324 - DNA, 19 bp, Homo sapiens
tcacccagtcctgcccgcc

SEQ ID NO: 1383325 - DNA, 14 bp, Homo sapiens
tcacttgagacaaa

SEQ ID NO: 1383326 - DNA, 17 bp, Homo sapiens
tcagacacctagactct

SEQ ID NO: 1383327 - DNA, 17 bp, Homo sapiens
tcagcttaataagtatt

SEQ ID NO: 1383328 - DNA, 15 bp, Homo sapiens
tcatactgaagatgc

SEQ ID NO: 1383329 - DNA, 17 bp, Homo sapiens
tcatgcttctactccat

SEQ ID NO: 1383330 - DNA, 17 bp, Homo sapiens
tcatgttggtaccctgg

SEQ ID NO: 1383331 - DNA, 16 bp, Homo sapiens
tccagaagcagcagct

SEQ ID NO: 1383332 - DNA, 18 bp, Homo sapiens
tccagctgctgagatcct

SEQ ID NO: 1383333 - DNA, 19 bp, Homo sapiens
tccatcaaagccctccctg

SEQ ID NO: 1383334 - DNA, 21 bp, Homo sapiens
tccatggtgaactgaagcaga

SEQ ID NO: 1383335 - DNA, 14 bp, Homo sapiens
tcccacctggctct

SEQ ID NO: 1383336 - DNA, 15 bp, Homo sapiens
tcccacctggctctg

SEQ ID NO: 1383337 - DNA, 15 bp, Homo sapiens
tcccagccaggccct

SEQ ID NO: 1383338 - DNA, 16 bp, Homo sapiens
tccccaacccccaact

SEQ ID NO: 1383339 - DNA, 15 bp, Homo sapiens
tccctcatgcagata

SEQ ID NO: 1383340 - DNA, 18 bp, Homo sapiens
tccggccctccagagccc

SEQ ID NO: 1383341 - DNA, 19 bp, Homo sapiens
tcctaacattatattccca

SEQ ID NO: 1383342 - DNA, 23 bp, Homo sapiens
tcctcagtgtaccactacttaga

SEQ ID NO: 1383343 - DNA, 21 bp, Homo sapiens
tcctcttaatgtctcaaaata

SEQ ID NO: 1383344 - DNA, 19 bp, Homo sapiens
tcctcttatatgtgcccct

SEQ ID NO: 1383345 - DNA, 20 bp, Homo sapiens
tcctcttatatgtgcccctt

SEQ ID NO: 1383346 - DNA, 13 bp, Homo sapiens
tcctgatgtcttg

SEQ ID NO: 1383347 - DNA, 14 bp, Homo sapiens
tcctggactgaggg

SEQ ID NO: 1383348 - DNA, 15 bp, Homo sapiens
tcctggcccagggca

SEQ ID NO: 1383349 - DNA, 16 bp, Homo sapiens
tcctggcccagggcat

SEQ ID NO: 1383350 - DNA, 15 bp, Homo sapiens
tcggccccaccagtg

SEQ ID NO: 1383351 - DNA, 13 bp, Homo sapiens
atcctctgttgat

SEQ ID NO: 1383352 - DNA, 17 bp, Homo sapiens
atcctggcccagggcat

SEQ ID NO: 1383353 - DNA, 18 bp, Homo sapiens
atcctggcccagggcatc

SEQ ID NO: 1383354 - DNA, 23 bp, Homo sapiens
atctcaaaagatctcctgtgcac

SEQ ID NO: 1383355 - DNA, 16 bp, Homo sapiens
atctgatgatgttctg

SEQ ID NO: 1383356 - DNA, 19 bp, Homo sapiens
atctgcgggggcagtgctc

SEQ ID NO: 1383357 - DNA, 19 bp, Homo sapiens
atgaagttaagcacaacca

SEQ ID NO: 1383358 - DNA, 18 bp, Homo sapiens
atgagccgcccaaggcct

SEQ ID NO: 1383359 - DNA, 19 bp, Homo sapiens
atgagccgcccaaggcctt

SEQ ID NO: 1383360 - DNA, 19 bp, Homo sapiens
atgaggctggataggagag

SEQ ID NO: 1383361 - DNA, 16 bp, Homo sapiens
atgatcaaggagggag

SEQ ID NO: 1383362 - DNA, 13 bp, Homo sapiens
atgatgttctgaa

SEQ ID NO: 1383363 - DNA, 17 bp, Homo sapiens
atgcaatttacttggaa

SEQ ID NO: 1383364 - DNA, 15 bp, Homo sapiens
atgccccctgtggat

SEQ ID NO: 1383365 - DNA, 19 bp, Homo sapiens
atgccccctgtggatgctg

SEQ ID NO: 1383366 - DNA, 13 bp, Homo sapiens
atgctgctgcccc

SEQ ID NO: 1383367 - DNA, 23 bp, Homo sapiens
atgctgctgcccctgcacagcag

SEQ ID NO: 1383368 - DNA, 15 bp, Homo sapiens
atggaaaggagagga

SEQ ID NO: 1383369 - DNA, 20 bp, Homo sapiens
atggagtagagtcaggagaa

SEQ ID NO: 1383370 - DNA, 17 bp, Homo sapiens
atggcctgagaagagag

SEQ ID NO: 1383371 - DNA, 14 bp, Homo sapiens
atgggaaaagagat

SEQ ID NO: 1383372 - DNA, 17 bp, Homo sapiens
atgggccaccgccttgc

SEQ ID NO: 1383373 - DNA, 18 bp, Homo sapiens
atgggccaccgccttgcc

SEQ ID NO: 1383374 - DNA, 20 bp, Homo sapiens
atggtgaactgaagcagagt

SEQ ID NO: 1383375 - DNA, 19 bp, Homo sapiens
atgtccaaacttaacagat

SEQ ID NO: 1383376 - DNA, 14 bp, Homo sapiens
atgtgttctttgta

SEQ ID NO: 1383377 - DNA, 14 bp, Homo sapiens
atgttatttctctg

SEQ ID NO: 1383378 - DNA, 11 bp, Homo sapiens
attaaactaat

SEQ ID NO: 1383379 - DNA, 14 bp, Homo sapiens
attatacttacttc

SEQ ID NO: 1383380 - DNA, 12 bp, Homo sapiens
attctatttgaa

SEQ ID NO: 1383381 - DNA, 14 bp, Homo sapiens
attggggctcccag

SEQ ID NO: 1383382 - DNA, 21 bp, Homo sapiens
attggggctcccagccaggcc

SEQ ID NO: 1383383 - DNA, 23 bp, Homo sapiens
attgggtaagggactccagaagc

SEQ ID NO: 1383384 - DNA, 13 bp, Homo sapiens
atttgtcccaagt

SEQ ID NO: 1383385 - DNA, 14 bp, Homo sapiens
atttgtcccaagtg

SEQ ID NO: 1383386 - DNA, 15 bp, Homo sapiens
caaaagatctcctgt

SEQ ID NO: 1383387 - DNA, 14 bp, Homo sapiens
caaacagggcctct

SEQ ID NO: 1383388 - DNA, 23 bp, Homo sapiens
caaagccctccctgtctgtctgt

SEQ ID NO: 1383389 - DNA, 13 bp, Homo sapiens
caaataaccctga

SEQ ID NO: 1383390 - DNA, 20 bp, Homo sapiens
caaataaccctgaatcagag

SEQ ID NO: 1383391 - DNA, 21 bp, Homo sapiens
caaatggaaaggagaggaaag

SEQ ID NO: 1383392 - DNA, 19 bp, Homo sapiens
caagagtccaagccatctg

SEQ ID NO: 1383393 - DNA, 21 bp, Homo sapiens
caagcccagcctatctctctt

SEQ ID NO: 1383394 - DNA, 18 bp, Homo sapiens
caaggccttcccctggca

SEQ ID NO: 1383395 - DNA, 21 bp, Homo sapiens
caaggccttcccctggcactg

SEQ ID NO: 1383396 - DNA, 16 bp, Homo sapiens
cacactggctcaccca

SEQ ID NO: 1383397 - DNA, 19 bp, Homo sapiens
cacactggctcacccagtc

SEQ ID NO: 1383398 - DNA, 18 bp, Homo sapiens
cacactttggcccagggt

SEQ ID NO: 1383399 - DNA, 13 bp, Homo sapiens
cacagcaggctgc

SEQ ID NO: 1383400 - DNA, 15 bp, Homo sapiens
cacagcaggctgcca

SEQ ID NO: 1383401 - DNA, 22 bp, Homo sapiens
cacagcaggctgccagtgcctg

SEQ ID NO: 1383402 - DNA, 14 bp, Homo sapiens
cacatctcttcatg

SEQ ID NO: 1383403 - DNA, 14 bp, Homo sapiens
cacatgcccctctt

SEQ ID NO: 1383404 - DNA, 17 bp, Homo sapiens
caccagtgcctctccct

SEQ ID NO: 1383405 - DNA, 16 bp, Homo sapiens
caccataagctactgc

SEQ ID NO: 1383406 - DNA, 19 bp, Homo sapiens
caccataagctactgccat

SEQ ID NO: 1383407 - DNA, 21 bp, Homo sapiens
caccataagctactgccatcc

SEQ ID NO: 1383408 - DNA, 23 bp, Homo sapiens
caccgccttgcccagcctggatg

SEQ ID NO: 1383409 - DNA, 16 bp, Homo sapiens
caccgttatcggtgtc

SEQ ID NO: 1383410 - DNA, 23 bp, Homo sapiens
cacctccccccacaagtgccctc

SEQ ID NO: 1383411 - DNA, 13 bp, Homo sapiens
cacctggctctgt

SEQ ID NO: 1383412 - DNA, 14 bp, Homo sapiens
cacctggctctgtg

SEQ ID NO: 1383413 - DNA, 15 bp, Homo sapiens
cacctggctctgtgg

SEQ ID NO: 1383414 - DNA, 20 bp, Homo sapiens
cactccggccctccagagcc

SEQ ID NO: 1383415 - DNA, 18 bp, Homo sapiens
cactggcaaacagggcct

SEQ ID NO: 1383416 - DNA, 19 bp, Homo sapiens
cactggcaaacagggcctc

SEQ ID NO: 1383417 - DNA, 20 bp, Homo sapiens
cactggcaaacagggcctct

SEQ ID NO: 1383418 - DNA, 13 bp, Homo sapiens
cactggctcaccc

SEQ ID NO: 1383419 - DNA, 11 bp, Homo sapiens
cagaaaagcac

SEQ ID NO: 1383420 - DNA, 14 bp, Homo sapiens
cagaagcagcagct

SEQ ID NO: 1383421 - DNA, 22 bp, Homo sapiens
cagaagcagcagctagaaagag

SEQ ID NO: 1383422 - DNA, 21 bp, Homo sapiens
cagaccattggggctcccagc

SEQ ID NO: 1383423 - DNA, 13 bp, Homo sapiens
cagagccccacag

SEQ ID NO: 1383424 - DNA, 23 bp, Homo sapiens
cagagcgatgtgttctttgtacc

SEQ ID NO: 1383425 - DNA, 14 bp, Homo sapiens
cagcagcagcagca

SEQ ID NO: 1383426 - DNA, 19 bp, Homo sapiens
cagcagcggcagcagcagc

SEQ ID NO: 1383427 - DNA, 19 bp, Homo sapiens
cagcagctagaaagagaaa

SEQ ID NO: 1383428 - DNA, 15 bp, Homo sapiens
cagcaggctgccagt

SEQ ID NO: 1383429 - DNA, 19 bp, Homo sapiens
cagcaggctgccagtgcct

SEQ ID NO: 1383430 - DNA, 20 bp, Homo sapiens
cagcaggctgccagtgcctg

SEQ ID NO: 1383431 - DNA, 20 bp, Homo sapiens
cagcagtttgtgatctgtcc

SEQ ID NO: 1383432 - DNA, 12 bp, Homo sapiens
cagcctcttgaa

SEQ ID NO: 1383433 - DNA, 12 bp, Homo sapiens
cagcctggatgc

SEQ ID NO: 1383434 - DNA, 16 bp, Homo sapiens
cagcctggatgccatc

SEQ ID NO: 1383435 - DNA, 17 bp, Homo sapiens
cagcctggatgccatcc

SEQ ID NO: 1383436 - DNA, 14 bp, Homo sapiens
cagctagaaagaga

SEQ ID NO: 1383437 - DNA, 23 bp, Homo sapiens
cagctagaaagagaaaaagccct

SEQ ID NO: 1383438 - DNA, 12 bp, Homo sapiens
cagctgctgaga

SEQ ID NO: 1383439 - DNA, 19 bp, Homo sapiens
caggaacccttacagtaga

SEQ ID NO: 1383440 - DNA, 20 bp, Homo sapiens
cctcggaccccactccggcc

SEQ ID NO: 1383441 - DNA, 18 bp, Homo sapiens
cctctatcccggctttgg

SEQ ID NO: 1383442 - DNA, 14 bp, Homo sapiens
cctctccctgctgc

SEQ ID NO: 1383443 - DNA, 17 bp, Homo sapiens
cctctccctgctgctcc

SEQ ID NO: 1383444 - DNA, 14 bp, Homo sapiens
cctcttcaatcccc

SEQ ID NO: 1383445 - DNA, 11 bp, Homo sapiens
cctgctcctcc

SEQ ID NO: 1383446 - DNA, 16 bp, Homo sapiens
cctgctgctcctagga

SEQ ID NO: 1383447 - DNA, 17 bp, Homo sapiens
cctgctgctcctaggac

SEQ ID NO: 1383448 - DNA, 13 bp, Homo sapiens
cctggactgaggg

SEQ ID NO: 1383449 - DNA, 13 bp, Homo sapiens
cctggatgccatc

SEQ ID NO: 1383450 - DNA, 16 bp, Homo sapiens
cctggatgccccctgt

SEQ ID NO: 1383451 - DNA, 19 bp, Homo sapiens
cctggatgccccctgtgga

SEQ ID NO: 1383452 - DNA, 16 bp, Homo sapiens
cctggcccagggcatc

SEQ ID NO: 1383453 - DNA, 17 bp, Homo sapiens
cctgggcatactaataa

SEQ ID NO: 1383454 - DNA, 19 bp, Homo sapiens
cctgtggatgctgctgccc

SEQ ID NO: 1383455 - DNA, 16 bp, Homo sapiens
ccttccaacctgttca

SEQ ID NO: 1383456 - DNA, 13 bp, Homo sapiens
ccttcccctggca

SEQ ID NO: 1383457 - DNA, 21 bp, Homo sapiens
ccttgattcaaataaccctga

SEQ ID NO: 1383458 - DNA, 13 bp, Homo sapiens
ccttgcccagcct

SEQ ID NO: 1383459 - DNA, 16 bp, Homo sapiens
ccttgcccagcctgga

SEQ ID NO: 1383460 - DNA, 17 bp, Homo sapiens
ccttgcccagcctggat

SEQ ID NO: 1383461 - DNA, 15 bp, Homo sapiens
ccttgtcggccccac

SEQ ID NO: 1383462 - DNA, 21 bp, Homo sapiens
ccttgtcggccccaccagtgc

SEQ ID NO: 1383463 - DNA, 14 bp, Homo sapiens
cctttgaagaggaa

SEQ ID NO: 1383464 - DNA, 16 bp, Homo sapiens
cgagccatttgtccca

SEQ ID NO: 1383465 - DNA, 22 bp, Homo sapiens
cgagccatttgtcccaagtgcc

SEQ ID NO: 1383466 - DNA, 18 bp, Homo sapiens
cgagggggctgctcccac

SEQ ID NO: 1383467 - DNA, 21 bp, Homo sapiens
cggaccccactccggccctcc

SEQ ID NO: 1383468 - DNA, 17 bp, Homo sapiens
cggccccaccagtgcct

SEQ ID NO: 1383469 - DNA, 18 bp, Homo sapiens
cggccccaccagtgcctc

SEQ ID NO: 1383470 - DNA, 20 bp, Homo sapiens
cggccctccagagccccaca

SEQ ID NO: 1383471 - DNA, 14 bp, Homo sapiens
cgtctccagctgct

SEQ ID NO: 1383472 - DNA, 23 bp, Homo sapiens
cgtgggagtatgttatttctctg

SEQ ID NO: 1383473 - DNA, 16 bp, Homo sapiens
ctaaaattaagtatat

SEQ ID NO: 1383474 - DNA, 15 bp, Homo sapiens
ctactgccatcctgg

SEQ ID NO: 1383475 - DNA, 16 bp, Homo sapiens
ctactgccatcctggc

SEQ ID NO: 1383476 - DNA, 18 bp, Homo sapiens
ctactgccatcctggccc

SEQ ID NO: 1383477 - DNA, 20 bp, Homo sapiens
ctactgccatcctggcccag

SEQ ID NO: 1383478 - DNA, 20 bp, Homo sapiens
ctagaaagagaaaaagccct

SEQ ID NO: 1383479 - DNA, 21 bp, Homo sapiens
ctagaaagagaaaaagccctc

SEQ ID NO: 1383480 - DNA, 22 bp, Homo sapiens
ctagaaagagaaaaagccctct

SEQ ID NO: 1383481 - DNA, 21 bp, Homo sapiens
ctaggacccgtctccagctgc

SEQ ID NO: 1383482 - DNA, 21 bp, Homo sapiens
ctatacctgggcatactaata

SEQ ID NO: 1383483 - DNA, 22 bp, Homo sapiens
ctatcagcagcggcagcagcag

SEQ ID NO: 1383484 - DNA, 19 bp, Homo sapiens
ctatgatgtccaaacttaa

SEQ ID NO: 1383485 - DNA, 22 bp, Homo sapiens
ctattaagtttgaaaatagtta

SEQ ID NO: 1383486 - DNA, 12 bp, Homo sapiens
ctcacccagtcc

SEQ ID NO: 1383487 - DNA, 16 bp, Homo sapiens
ctcagccctcattaaa

SEQ ID NO: 1383488 - DNA, 13 bp, Homo sapiens
ctccagaagcagc

SEQ ID NO: 1383489 - DNA, 15 bp, Homo sapiens
ctccagaagcagcag

SEQ ID NO: 1383490 - DNA, 16 bp, Homo sapiens
ctccagaagcagcagc

SEQ ID NO: 1383491 - DNA, 14 bp, Homo sapiens
ctccagctgctgag

SEQ ID NO: 1383492 - DNA, 21 bp, Homo sapiens
ctccagctgctgagatcctgg

SEQ ID NO: 1383493 - DNA, 15 bp, Homo sapiens
ctccagtacaataaa

SEQ ID NO: 1383494 - DNA, 18 bp, Homo sapiens
ctccatggtgaactgaag

SEQ ID NO: 1383495 - DNA, 22 bp, Homo sapiens
ctccatggtgaactgaagcaga

SEQ ID NO: 1383496 - DNA, 11 bp, Homo sapiens
ctcccagccag

SEQ ID NO: 1383497 - DNA, 14 bp, Homo sapiens
ctcccagccaggcc

SEQ ID NO: 1383498 - DNA, 16 bp, Homo sapiens
ctcccagccaggccct

SEQ ID NO: 1383499 - DNA, 20 bp, Homo sapiens
ctcccatgagggagatgcca

SEQ ID NO: 1383500 - DNA, 22 bp, Homo sapiens
ctcccatgagggagatgccatg

SEQ ID NO: 1383501 - DNA, 15 bp, Homo sapiens
ctccccaacccccaa

SEQ ID NO: 1383502 - DNA, 17 bp, Homo sapiens
ctccccccgcctgccac

SEQ ID NO: 1383503 - DNA, 14 bp, Homo sapiens
ctccctgctgctcc

SEQ ID NO: 1383504 - DNA, 17 bp, Homo sapiens
ctccctgctgctcctag

SEQ ID NO: 1383505 - DNA, 23 bp, Homo sapiens
ctcctcaattccagggaaccaga

SEQ ID NO: 1383506 - DNA, 23 bp, Homo sapiens
ctcctccagtacaataaataaaa

SEQ ID NO: 1383507 - DNA, 21 bp, Homo sapiens
ctcggaccccactccggccct

SEQ ID NO: 1383508 - DNA, 23 bp, Homo sapiens
ctctgcggagcacactggctcac

SEQ ID NO: 1383509 - DNA, 16 bp, Homo sapiens
ctctgtggcgagccat

SEQ ID NO: 1383510 - DNA, 19 bp, Homo sapiens
ctcttgaatgcttaaatga

SEQ ID NO: 1383511 - DNA, 17 bp, Homo sapiens
ctcttttgctctctcat

SEQ ID NO: 1383512 - DNA, 12 bp, Homo sapiens
ctgaagcagagt

SEQ ID NO: 1383513 - DNA, 20 bp, Homo sapiens
ctgaagcagagtcaagctga

SEQ ID NO: 1383514 - DNA, 16 bp, Homo sapiens
ctgaatcagaggcaga

SEQ ID NO: 1383515 - DNA, 15 bp, Homo sapiens
ctgaattggctgcca

SEQ ID NO: 1383516 - DNA, 23 bp, Homo sapiens
ctgagaagagagatcaaatggaa

SEQ ID NO: 1383517 - DNA, 18 bp, Homo sapiens
ctgagcacatctcttcat

SEQ ID NO: 1383518 - DNA, 18 bp, Homo sapiens
ctgagggggcctggatgc

SEQ ID NO: 1383519 - DNA, 20 bp, Homo sapiens
ctgagtcctcattgttcaga

SEQ ID NO: 1383520 - DNA, 18 bp, Homo sapiens
ctgcacagcaggctgcca

SEQ ID NO: 1383521 - DNA, 22 bp, Homo sapiens
ctgcacagcaggctgccagtgc

SEQ ID NO: 1383522 - DNA, 17 bp, Homo sapiens
gcaaacagggcctctgc

SEQ ID NO: 1383523 - DNA, 16 bp, Homo sapiens
gcaatttacttggaat

SEQ ID NO: 1383524 - DNA, 17 bp, Homo sapiens
gcacaaccatgttcttg

SEQ ID NO: 1383525 - DNA, 13 bp, Homo sapiens
gcacactggctca

SEQ ID NO: 1383526 - DNA, 12 bp, Homo sapiens
gcacagcaggct

SEQ ID NO: 1383527 - DNA, 17 bp, Homo sapiens
gcacagcaggctgccag

SEQ ID NO: 1383528 - DNA, 20 bp, Homo sapiens
gcagcagctagaaagagaaa

SEQ ID NO: 1383529 - DNA, 18 bp, Homo sapiens
gcaggctgccagtgcctg

SEQ ID NO: 1383530 - DNA, 15 bp, Homo sapiens
gcatgctccctcatg

SEQ ID NO: 1383531 - DNA, 19 bp, Homo sapiens
gcatgctccctcatgcaga

SEQ ID NO: 1383532 - DNA, 19 bp, Homo sapiens
gccacacctctatcccggc

SEQ ID NO: 1383533 - DNA, 12 bp, Homo sapiens
gccagtgcctgg

SEQ ID NO: 1383534 - DNA, 14 bp, Homo sapiens
gccatcctggccca

SEQ ID NO: 1383535 - DNA, 13 bp, Homo sapiens
gcccaaggccttc

SEQ ID NO: 1383536 - DNA, 17 bp, Homo sapiens
gcccacgctcaccccct

SEQ ID NO: 1383537 - DNA, 15 bp, Homo sapiens
gcccagggtggccac

SEQ ID NO: 1383538 - DNA, 20 bp, Homo sapiens
gcccagggtggccacacctc

SEQ ID NO: 1383539 - DNA, 16 bp, Homo sapiens
gccccaccagtgcctc

SEQ ID NO: 1383540 - DNA, 13 bp, Homo sapiens
gccccctgtggat

SEQ ID NO: 1383541 - DNA, 17 bp, Homo sapiens
gccccctgtggatgctg

SEQ ID NO: 1383542 - DNA, 22 bp, Homo sapiens
gcccctgcacagcaggctgcca

SEQ ID NO: 1383543 - DNA, 20 bp, Homo sapiens
gccctccagagccccacagc

SEQ ID NO: 1383544 - DNA, 22 bp, Homo sapiens
gccctccagagccccacagccc

SEQ ID NO: 1383545 - DNA, 15 bp, Homo sapiens
gccctcttcaatccc

SEQ ID NO: 1383546 - DNA, 16 bp, Homo sapiens
gcccttgtcggcccca

SEQ ID NO: 1383547 - DNA, 14 bp, Homo sapiens
gccgcccaaggcct

SEQ ID NO: 1383548 - DNA, 20 bp, Homo sapiens
gcctctccctgctgctccta

SEQ ID NO: 1383549 - DNA, 22 bp, Homo sapiens
gcctctccctgctgctcctagg

SEQ ID NO: 1383550 - DNA, 19 bp, Homo sapiens
gcctctgcggagcacactg

SEQ ID NO: 1383551 - DNA, 18 bp, Homo sapiens
gccttgcccagcctggat

SEQ ID NO: 1383552 - DNA, 20 bp, Homo sapiens
gcgagccatttgtcccaagt

SEQ ID NO: 1383553 - DNA, 24 bp, Homo sapiens
gcgagccatttgtcccaagtgcca

SEQ ID NO: 1383554 - DNA, 17 bp, Homo sapiens
gctactgccatcctggc

SEQ ID NO: 1383555 - DNA, 20 bp, Homo sapiens
gctactgccatcctggccca

SEQ ID NO: 1383556 - DNA, 15 bp, Homo sapiens
gctagaaagagaaaa

SEQ ID NO: 1383557 - DNA, 15 bp, Homo sapiens
gctcccagccaggcc

SEQ ID NO: 1383558 - DNA, 21 bp, Homo sapiens
gctcctaggacccgtctccag

SEQ ID NO: 1383559 - DNA, 17 bp, Homo sapiens
gctcctccagtacaata

SEQ ID NO: 1383560 - DNA, 20 bp, Homo sapiens
gctctgtggcgagccatttg

SEQ ID NO: 1383561 - DNA, 22 bp, Homo sapiens
gctgagatcctggactgagggg

SEQ ID NO: 1383562 - DNA, 13 bp, Homo sapiens
gctgccagtgcct

SEQ ID NO: 1383563 - DNA, 11 bp, Homo sapiens
gctgctcccac

SEQ ID NO: 1383564 - DNA, 15 bp, Homo sapiens
gctgctcccacctgg

SEQ ID NO: 1383565 - DNA, 22 bp, Homo sapiens
gcttctcccccaccccctaggg

SEQ ID NO: 1383566 - DNA, 13 bp, Homo sapiens
ggaaaaggcttga

SEQ ID NO: 1383567 - DNA, 23 bp, Homo sapiens
ggaaccagagcgatgtgttcttt

SEQ ID NO: 1383568 - DNA, 23 bp, Homo sapiens
ggaaccgagggggctgctcccac

SEQ ID NO: 1383569 - DNA, 23 bp, Homo sapiens
ggaccccactccggccctccaga

SEQ ID NO: 1383570 - DNA, 20 bp, Homo sapiens
ggactgagggggcctggatg

SEQ ID NO: 1383571 - DNA, 15 bp, Homo sapiens
ggagatgaggctgga

SEQ ID NO: 1383572 - DNA, 17 bp, Homo sapiens
ggatgctgctgcccctg

SEQ ID NO: 1383573 - DNA, 12 bp, Homo sapiens
ggatgtcccttc

SEQ ID NO: 1383574 - DNA, 20 bp, Homo sapiens
ggcaaaccaatttgttctgt

SEQ ID NO: 1383575 - DNA, 15 bp, Homo sapiens
ggcagcagcagcagc

SEQ ID NO: 1383576 - DNA, 14 bp, Homo sapiens
ggcatactaataaa

SEQ ID NO: 1383577 - DNA, 18 bp, Homo sapiens
ggccaccgccttgcccag

SEQ ID NO: 1383578 - DNA, 15 bp, Homo sapiens
ggcccagggcatctg

SEQ ID NO: 1383579 - DNA, 16 bp, Homo sapiens
ggcccagggcatctgg

SEQ ID NO: 1383580 - DNA, 17 bp, Homo sapiens
ggccccaccagtgcctc

SEQ ID NO: 1383581 - DNA, 19 bp, Homo sapiens
ggcctctgcggagcacact

SEQ ID NO: 1383582 - DNA, 20 bp, Homo sapiens
ggcctctgcggagcacactg

SEQ ID NO: 1383583 - DNA, 16 bp, Homo sapiens
ggctcacccagtcctg

SEQ ID NO: 1383584 - DNA, 14 bp, Homo sapiens
ggctcccagccagg

SEQ ID NO: 1383585 - DNA, 17 bp, Homo sapiens
ggctcccagccaggccc

SEQ ID NO: 1383586 - DNA, 15 bp, Homo sapiens
ggctgccagtgcctg

SEQ ID NO: 1383587 - DNA, 13 bp, Homo sapiens
ggctgctcccacc

SEQ ID NO: 1383588 - DNA, 21 bp, Homo sapiens
ggctgctcccacctggctctg

SEQ ID NO: 1383589 - DNA, 16 bp, Homo sapiens
gggactccagaagcag

SEQ ID NO: 1383590 - DNA, 23 bp, Homo sapiens
gggcctcggaccccactccggcc

SEQ ID NO: 1383591 - DNA, 19 bp, Homo sapiens
gggctcccagccaggccct

SEQ ID NO: 1383592 - DNA, 13 bp, Homo sapiens
gggctgctcccac

SEQ ID NO: 1383593 - DNA, 21 bp, Homo sapiens
gggctgctcccacctggctct

SEQ ID NO: 1383594 - DNA, 22 bp, Homo sapiens
gggctgggcctcggaccccact

SEQ ID NO: 1383595 - DNA, 13 bp, Homo sapiens
ggggaagggtgga

SEQ ID NO: 1383596 - DNA, 16 bp, Homo sapiens
ggggctcccagccagg

SEQ ID NO: 1383597 - DNA, 20 bp, Homo sapiens
ggggctcccagccaggccct

SEQ ID NO: 1383598 - DNA, 21 bp, Homo sapiens
gggggcagtgctcacccacac

SEQ ID NO: 1383599 - DNA, 23 bp, Homo sapiens
gggtaagggactccagaagcagc

SEQ ID NO: 1383600 - DNA, 20 bp, Homo sapiens
ggtatctgatgatgttctga

SEQ ID NO: 1383601 - DNA, 19 bp, Homo sapiens
ctgcggagcacactggctc

SEQ ID NO: 1383602 - DNA, 18 bp, Homo sapiens
ctgcgggggcagtgctca

SEQ ID NO: 1383603 - DNA, 19 bp, Homo sapiens
ctgctcccacctggctctg

SEQ ID NO: 1383604 - DNA, 23 bp, Homo sapiens
ctgctcctccagtacaataaata

SEQ ID NO: 1383605 - DNA, 23 bp, Homo sapiens
ctgctgagatcctggactgaggg

SEQ ID NO: 1383606 - DNA, 13 bp, Homo sapiens
ctgctgagcacat

SEQ ID NO: 1383607 - DNA, 15 bp, Homo sapiens
ctgctgctcctagga

SEQ ID NO: 1383608 - DNA, 18 bp, Homo sapiens
ctggactgagggggcctg

SEQ ID NO: 1383609 - DNA, 21 bp, Homo sapiens
ctggactgagggggcctggat

SEQ ID NO: 1383610 - DNA, 12 bp, Homo sapiens
ctggatgccatc

SEQ ID NO: 1383611 - DNA, 20 bp, Homo sapiens
ctggcataactaaaattaag

SEQ ID NO: 1383612 - DNA, 14 bp, Homo sapiens
ctggcccagggcat

SEQ ID NO: 1383613 - DNA, 14 bp, Homo sapiens
ctggctctgtggcg

SEQ ID NO: 1383614 - DNA, 23 bp, Homo sapiens
ctggctctgtggcgagccatttg

SEQ ID NO: 1383615 - DNA, 21 bp, Homo sapiens
ctgtccttccaacctgttcac

SEQ ID NO: 1383616 - DNA, 16 bp, Homo sapiens
ctgtggatgctgctgc

SEQ ID NO: 1383617 - DNA, 21 bp, Homo sapiens
ctgtggatgctgctgcccctg

SEQ ID NO: 1383618 - DNA, 22 bp, Homo sapiens
ctgtggatgctgctgcccctgc

SEQ ID NO: 1383619 - DNA, 23 bp, Homo sapiens
ctgtggatgctgctgcccctgca

SEQ ID NO: 1383620 - DNA, 23 bp, Homo sapiens
ctgtggcgagccatttgtcccaa

SEQ ID NO: 1383621 - DNA, 16 bp, Homo sapiens
cttagaagaaatatga

SEQ ID NO: 1383622 - DNA, 13 bp, Homo sapiens
cttagagatatgt

SEQ ID NO: 1383623 - DNA, 20 bp, Homo sapiens
cttcaaaggccaagagaatt

SEQ ID NO: 1383624 - DNA, 13 bp, Homo sapiens
cttccccacaata

SEQ ID NO: 1383625 - DNA, 18 bp, Homo sapiens
cttccccacaataggctt

SEQ ID NO: 1383626 - DNA, 18 bp, Homo sapiens
cttcctgaactcccagtc

SEQ ID NO: 1383627 - DNA, 22 bp, Homo sapiens
cttctactccatggtgaactga

SEQ ID NO: 1383628 - DNA, 21 bp, Homo sapiens
cttctcccccaccccctaggg

SEQ ID NO: 1383629 - DNA, 21 bp, Homo sapiens
cttctggcataactaaaatta

SEQ ID NO: 1383630 - DNA, 13 bp, Homo sapiens
cttctttcctctt

SEQ ID NO: 1383631 - DNA, 18 bp, Homo sapiens
cttgaatgcttaaatgat

SEQ ID NO: 1383632 - DNA, 19 bp, Homo sapiens
cttgaatgcttaaatgatc

SEQ ID NO: 1383633 - DNA, 14 bp, Homo sapiens
cttgagcagctgaa

SEQ ID NO: 1383634 - DNA, 16 bp, Homo sapiens
cttgaggccaaatgag

SEQ ID NO: 1383635 - DNA, 20 bp, Homo sapiens
cttgaggccaaatgagttcc

SEQ ID NO: 1383636 - DNA, 20 bp, Homo sapiens
cttgcatggtttggagctga

SEQ ID NO: 1383637 - DNA, 15 bp, Homo sapiens
cttgcccagcctgga

SEQ ID NO: 1383638 - DNA, 19 bp, Homo sapiens
cttggactgagaaattata

SEQ ID NO: 1383639 - DNA, 20 bp, Homo sapiens
cttggctcagacacctagac

SEQ ID NO: 1383640 - DNA, 16 bp, Homo sapiens
cttggtttccatcaaa

SEQ ID NO: 1383641 - DNA, 17 bp, Homo sapiens
cttgtgtaatttcctgc

SEQ ID NO: 1383642 - DNA, 21 bp, Homo sapiens
cttgtgtaatttcctgctcct

SEQ ID NO: 1383643 - DNA, 14 bp, Homo sapiens
ctttgaagaggaaa

SEQ ID NO: 1383644 - DNA, 16 bp, Homo sapiens
gaaaaagccctcttca

SEQ ID NO: 1383645 - DNA, 21 bp, Homo sapiens
gaaaagagatggcctgagaag

SEQ ID NO: 1383646 - DNA, 17 bp, Homo sapiens
gaaaagcacctcttgaa

SEQ ID NO: 1383647 - DNA, 12 bp, Homo sapiens
gaaaatgaataa

SEQ ID NO: 1383648 - DNA, 15 bp, Homo sapiens
gaaacataaataaaa

SEQ ID NO: 1383649 - DNA, 17 bp, Homo sapiens
gaaaggagaggaaagaa

SEQ ID NO: 1383650 - DNA, 20 bp, Homo sapiens
gaaccgagggggctgctccc

SEQ ID NO: 1383651 - DNA, 15 bp, Homo sapiens
gaactgaagcagagt

SEQ ID NO: 1383652 - DNA, 14 bp, Homo sapiens
gaagaaatatgagc

SEQ ID NO: 1383653 - DNA, 16 bp, Homo sapiens
gaagaactgacttcct

SEQ ID NO: 1383654 - DNA, 15 bp, Homo sapiens
gaagaggaaaatgaa

SEQ ID NO: 1383655 - DNA, 21 bp, Homo sapiens
gaagatgcagcaaaatgtgaa

SEQ ID NO: 1383656 - DNA, 23 bp, Homo sapiens
gaagcagaccattggggctccca

SEQ ID NO: 1383657 - DNA, 15 bp, Homo sapiens
gaatcagaggcagag

SEQ ID NO: 1383658 - DNA, 16 bp, Homo sapiens
gaatcagaggcagaga

SEQ ID NO: 1383659 - DNA, 13 bp, Homo sapiens
gaatgggaaaaga

SEQ ID NO: 1383660 - DNA, 22 bp, Homo sapiens
gacacctagactctaaaactat

SEQ ID NO: 1383661 - DNA, 10 bp, Homo sapiens
gacagtgcct

SEQ ID NO: 1383662 - DNA, 20 bp, Homo sapiens
gaccagttccctcagccctc

SEQ ID NO: 1383663 - DNA, 21 bp, Homo sapiens
gaccattggggctcccagcca

SEQ ID NO: 1383664 - DNA, 17 bp, Homo sapiens
gaccccactccggccct

SEQ ID NO: 1383665 - DNA, 17 bp, Homo sapiens
gacctcctgatgtcttg

SEQ ID NO: 1383666 - DNA, 18 bp, Homo sapiens
gactcccatgagggagat

SEQ ID NO: 1383667 - DNA, 16 bp, Homo sapiens
gactgagggggcctgg

SEQ ID NO: 1383668 - DNA, 19 bp, Homo sapiens
gactgagggggcctggatg

SEQ ID NO: 1383669 - DNA, 17 bp, Homo sapiens
gagccatttgtcccaag

SEQ ID NO: 1383670 - DNA, 18 bp, Homo sapiens
gagccatttgtcccaagt

SEQ ID NO: 1383671 - DNA, 19 bp, Homo sapiens
gagccatttgtcccaagtg

SEQ ID NO: 1383672 - DNA, 22 bp, Homo sapiens
gagccatttgtcccaagtgcca

SEQ ID NO: 1383673 - DNA, 23 bp, Homo sapiens
gagccatttgtcccaagtgccaa

SEQ ID NO: 1383674 - DNA, 13 bp, Homo sapiens
gagccgcccaagg

SEQ ID NO: 1383675 - DNA, 17 bp, Homo sapiens
gagcgatgtgttctttg

SEQ ID NO: 1383676 - DNA, 12 bp, Homo sapiens
gagtcaggagaa

SEQ ID NO: 1383677 - DNA, 21 bp, Homo sapiens
gagttcccttgattcaaataa

SEQ ID NO: 1383678 - DNA, 15 bp, Homo sapiens
gatcaaggagggaga

SEQ ID NO: 1383679 - DNA, 19 bp, Homo sapiens
gatcaaggagggagaaagg

SEQ ID NO: 1383680 - DNA, 12 bp, Homo sapiens
gatctcctgtgc

SEQ ID NO: 1383681 - DNA, 16 bp, Homo sapiens
gatctcctgtgcacct

SEQ ID NO: 1383682 - DNA, 13 bp, Homo sapiens
gatgatgttctga

SEQ ID NO: 1383683 - DNA, 18 bp, Homo sapiens
gatgggccaccgccttgc

SEQ ID NO: 1383684 - DNA, 22 bp, Homo sapiens
gatgtccaaacttaacagatca

SEQ ID NO: 1383685 - DNA, 13 bp, Homo sapiens
gatgtcccttccc

SEQ ID NO: 1383686 - DNA, 17 bp, Homo sapiens
gattcctttgaagagga

SEQ ID NO: 1383687 - DNA, 21 bp, Homo sapiens
gattcctttgaagaggaaaat

SEQ ID NO: 1383688 - DNA, 13 bp, Homo sapiens
gcaaaatgtgaat

SEQ ID NO: 1383689 - DNA, 21 bp, Homo sapiens
tgtcggccccaccagtgcctc

SEQ ID NO: 1383690 - DNA, 14 bp, Homo sapiens
tgtctcaaaataaa

SEQ ID NO: 1383691 - DNA, 15 bp, Homo sapiens
tgtctcaaaataaaa

SEQ ID NO: 1383692 - DNA, 21 bp, Homo sapiens
tgtgattcctttgaagaggaa

SEQ ID NO: 1383693 - DNA, 18 bp, Homo sapiens
tgtgcacctgactttgga

SEQ ID NO: 1383694 - DNA, 22 bp, Homo sapiens
tgtggcgagccatttgtcccaa

SEQ ID NO: 1383695 - DNA, 20 bp, Homo sapiens
tgtggtaagcaacatggctt

SEQ ID NO: 1383696 - DNA, 10 bp, Homo sapiens
tgtgtccttt

SEQ ID NO: 1383697 - DNA, 18 bp, Homo sapiens
tgtgtgaataccccaaga

SEQ ID NO: 1383698 - DNA, 18 bp, Homo sapiens
tgttcacgtgactcctca

SEQ ID NO: 1383699 - DNA, 15 bp, Homo sapiens
tgttcagaaaagcac

SEQ ID NO: 1383700 - DNA, 13 bp, Homo sapiens
tgttctgtgcaac

SEQ ID NO: 1383701 - DNA, 22 bp, Homo sapiens
ttaagcacaaccatgttcttga

SEQ ID NO: 1383702 - DNA, 16 bp, Homo sapiens
ttaatttatcctctgt

SEQ ID NO: 1383703 - DNA, 23 bp, Homo sapiens
ttagtcagtgtactctgagtcct

SEQ ID NO: 1383704 - DNA, 13 bp, Homo sapiens
actccagaagcag

SEQ ID NO: 1383705 - DNA, 16 bp, Homo sapiens
actccagaagcagcag

SEQ ID NO: 1383706 - DNA, 23 bp, Homo sapiens
actcccatgagggagatgccatg

SEQ ID NO: 1383707 - DNA, 15 bp, Homo sapiens
actccccaaccccca

SEQ ID NO: 1383708 - DNA, 16 bp, Homo sapiens
actccccaacccccaa

SEQ ID NO: 1383709 - DNA, 21 bp, Homo sapiens
actctactattaagtttgaaa

SEQ ID NO: 1383710 - DNA, 14 bp, Homo sapiens
actctgagtcctca

SEQ ID NO: 1383711 - DNA, 17 bp, Homo sapiens
actctgagtcctcattg

SEQ ID NO: 1383712 - DNA, 12 bp, Homo sapiens
actgaagcagag

SEQ ID NO: 1383713 - DNA, 22 bp, Homo sapiens
actgaatggactttgcacactt

SEQ ID NO: 1383714 - DNA, 18 bp, Homo sapiens
actgagggggcctggatg

SEQ ID NO: 1383715 - DNA, 14 bp, Homo sapiens
actgccatcctggc

SEQ ID NO: 1383716 - DNA, 17 bp, Homo sapiens
actggcaaacagggcct

SEQ ID NO: 1383717 - DNA, 19 bp, Homo sapiens
actggcaaacagggcctct

SEQ ID NO: 1383718 - DNA, 20 bp, Homo sapiens
actggcaaacagggcctctg

SEQ ID NO: 1383719 - DNA, 12 bp, Homo sapiens
actggctcaccc

SEQ ID NO: 1383720 - DNA, 23 bp, Homo sapiens
acttggaatttgcttagccttta

SEQ ID NO: 1383721 - DNA, 15 bp, Homo sapiens
agaaacataaataaa

SEQ ID NO: 1383722 - DNA, 14 bp, Homo sapiens
agaagcagcagcta

SEQ ID NO: 1383723 - DNA, 22 bp, Homo sapiens
agaagcagcagctagaaagaga

SEQ ID NO: 1383724 - DNA, 13 bp, Homo sapiens
agaagggagtgaa

SEQ ID NO: 1383725 - DNA, 19 bp, Homo sapiens
agaccattggggctcccag

SEQ ID NO: 1383726 - DNA, 18 bp, Homo sapiens
agacctcctgatgtcttg

SEQ ID NO: 1383727 - DNA, 20 bp, Homo sapiens
agagatggcctgagaagaga

SEQ ID NO: 1383728 - DNA, 17 bp, Homo sapiens
agagcgatgtgttcttt

SEQ ID NO: 1383729 - DNA, 13 bp, Homo sapiens
cgatgtgttcttt

SEQ ID NO: 1383730 - DNA, 17 bp, Homo sapiens
cgcccaaggccttcccc

SEQ ID NO: 1383731 - DNA, 16 bp, Homo sapiens
cgccttgcccagcctg

SEQ ID NO: 1383732 - DNA, 19 bp, Homo sapiens
cgccttgcccagcctggat

SEQ ID NO: 1383733 - DNA, 17 bp, Homo sapiens
cggagcacactggctca

SEQ ID NO: 1383734 - DNA, 20 bp, Homo sapiens
cggccccaccagtgcctctc

SEQ ID NO: 1383735 - DNA, 21 bp, Homo sapiens
cggccccaccagtgcctctcc

SEQ ID NO: 1383736 - DNA, 14 bp, Homo sapiens
cgggggcagtgctc

SEQ ID NO: 1383737 - DNA, 15 bp, Homo sapiens
ctaattaaactgatg

SEQ ID NO: 1383738 - DNA, 14 bp, Homo sapiens
ctactgccatcctg

SEQ ID NO: 1383739 - DNA, 23 bp, Homo sapiens
ctactgccatcctggcccagggc

SEQ ID NO: 1383740 - DNA, 14 bp, Homo sapiens
ctagaaagagaaaa

SEQ ID NO: 1383741 - DNA, 23 bp, Homo sapiens
ctagaaagagaaaaagccctctt

SEQ ID NO: 1383742 - DNA, 22 bp, Homo sapiens
ctaggacccgtctccagctgct

SEQ ID NO: 1383743 - DNA, 21 bp, Homo sapiens
ctatcagcagcggcagcagca

SEQ ID NO: 1383744 - DNA, 22 bp, Homo sapiens
ctcaattccagggaaccagagc

SEQ ID NO: 1383745 - DNA, 20 bp, Homo sapiens
ctcagccctcattaaactaa

SEQ ID NO: 1383746 - DNA, 12 bp, Homo sapiens
ctccagaagcag

SEQ ID NO: 1383747 - DNA, 17 bp, Homo sapiens
ctccagaagcagcagct

SEQ ID NO: 1383748 - DNA, 21 bp, Homo sapiens
ctccagagccccacagcccca

SEQ ID NO: 1383749 - DNA, 20 bp, Homo sapiens
ctccagctgctgagatcctg

SEQ ID NO: 1383750 - DNA, 23 bp, Homo sapiens
ctccagctgctgagatcctggac

SEQ ID NO: 1383751 - DNA, 19 bp, Homo sapiens
ctccagtacaataaataaa

SEQ ID NO: 1383752 - DNA, 23 bp, Homo sapiens
ctccatggtgaactgaagcagag

SEQ ID NO: 1383753 - DNA, 14 bp, Homo sapiens
ctcccagtcatgtt

SEQ ID NO: 1383754 - DNA, 24 bp, Homo sapiens
ctcccatgagggagatgccatgag

SEQ ID NO: 1383755 - DNA, 16 bp, Homo sapiens
ctccctgctgctccta

SEQ ID NO: 1383756 - DNA, 14 bp, Homo sapiens
ctccctgtctgtct

SEQ ID NO: 1383757 - DNA, 20 bp, Homo sapiens
ctcctaggacccgtctccag

SEQ ID NO: 1383758 - DNA, 21 bp, Homo sapiens
ctcctaggacccgtctccagc

SEQ ID NO: 1383759 - DNA, 13 bp, Homo sapiens
ctctaaaactatc

SEQ ID NO: 1383760 - DNA, 19 bp, Homo sapiens
ctctccccccgcctgccac

SEQ ID NO: 1383761 - DNA, 13 bp, Homo sapiens
ctctccctgctgc

SEQ ID NO: 1383762 - DNA, 14 bp, Homo sapiens
ctctccctgctgct

SEQ ID NO: 1383763 - DNA, 20 bp, Homo sapiens
ctctccctgctgctcctagg

SEQ ID NO: 1383764 - DNA, 13 bp, Homo sapiens
ctctgagtcctca

SEQ ID NO: 1383765 - DNA, 17 bp, Homo sapiens
ctctgcggagcacactg

SEQ ID NO: 1383766 - DNA, 18 bp, Homo sapiens
ctctgcggagcacactgg

SEQ ID NO: 1383767 - DNA, 21 bp, Homo sapiens
ctctgcggagcacactggctc

SEQ ID NO: 1383768 - DNA, 17 bp, Homo sapiens
ctcttatatgtgcccct

SEQ ID NO: 1383769 - DNA, 15 bp, Homo sapiens
ctcttcaatccccat

SEQ ID NO: 1383770 - DNA, 15 bp, Homo sapiens
ctctttcggaaatga

SEQ ID NO: 1383771 - DNA, 22 bp, Homo sapiens
ctcttttgctctctcattccca

SEQ ID NO: 1383772 - DNA, 18 bp, Homo sapiens
ctgaatggactttgcaca

SEQ ID NO: 1383773 - DNA, 21 bp, Homo sapiens
ctgatgggtatcatgcttcta

SEQ ID NO: 1383774 - DNA, 18 bp, Homo sapiens
ctgccaagagtccaagcc

SEQ ID NO: 1383775 - DNA, 17 bp, Homo sapiens
ctgccacctccccccac

SEQ ID NO: 1383776 - DNA, 21 bp, Homo sapiens
ctgccacctccccccacaagt

SEQ ID NO: 1383777 - DNA, 12 bp, Homo sapiens
ctgccagtgcct

SEQ ID NO: 1383778 - DNA, 13 bp, Homo sapiens
ctgccatcctggc

SEQ ID NO: 1383779 - DNA, 16 bp, Homo sapiens
ctgccatcctggccca

SEQ ID NO: 1383780 - DNA, 19 bp, Homo sapiens
ctgccatcctggcccaggg

SEQ ID NO: 1383781 - DNA, 22 bp, Homo sapiens
ctgccatcctggcccagggcat

SEQ ID NO: 1383782 - DNA, 15 bp, Homo sapiens
ctgcccctgcacagc

SEQ ID NO: 1383783 - DNA, 10 bp, Homo sapiens
ctgctcccac

SEQ ID NO: 1383784 - DNA, 20 bp, Homo sapiens
ctgctcccacctggctctgt

SEQ ID NO: 1383785 - DNA, 16 bp, Homo sapiens
ctgctgagatcctgga

SEQ ID NO: 1383786 - DNA, 22 bp, Homo sapiens
ctggactgagggggcctggatg

SEQ ID NO: 1383787 - DNA, 23 bp, Homo sapiens
ctggactgagggggcctggatgc

SEQ ID NO: 1383788 - DNA, 15 bp, Homo sapiens
ctggataatttgtat

SEQ ID NO: 1383789 - DNA, 17 bp, Homo sapiens
ctggataggagaggaaa

SEQ ID NO: 1383790 - DNA, 22 bp, Homo sapiens
ctggatgccccctgtggatgct

SEQ ID NO: 1383791 - DNA, 21 bp, Homo sapiens
ctggcaaacagggcctctgcg

SEQ ID NO: 1383792 - DNA, 22 bp, Homo sapiens
ctggcactggcaaacagggcct

SEQ ID NO: 1383793 - DNA, 20 bp, Homo sapiens
ctggcccagggcatctggga

SEQ ID NO: 1383794 - DNA, 14 bp, Homo sapiens
ctggctcacccagt

SEQ ID NO: 1383795 - DNA, 12 bp, Homo sapiens
ctggctctgtgg

SEQ ID NO: 1383796 - DNA, 19 bp, Homo sapiens
ctgggcctcggaccccact

SEQ ID NO: 1383797 - DNA, 16 bp, Homo sapiens
ctgggtggatgggcca

SEQ ID NO: 1383798 - DNA, 15 bp, Homo sapiens
ctgtccttccaacct

SEQ ID NO: 1383799 - DNA, 11 bp, Homo sapiens
ctgtctctctt

SEQ ID NO: 1383800 - DNA, 19 bp, Homo sapiens
ctgtctctcttttgctctc

SEQ ID NO: 1383801 - DNA, 13 bp, Homo sapiens
ctgtctgtctctc

SEQ ID NO: 1383802 - DNA, 14 bp, Homo sapiens
ctgtggatgctgct

SEQ ID NO: 1383803 - DNA, 19 bp, Homo sapiens
ctgtggatgctgctgcccc

SEQ ID NO: 1383804 - DNA, 13 bp, Homo sapiens
cttaataagtatt

SEQ ID NO: 1383805 - DNA, 23 bp, Homo sapiens
cttcaatccccataatgcttctt

SEQ ID NO: 1383806 - DNA, 22 bp, Homo sapiens
cttcatgcgcagtccccaggta

SEQ ID NO: 1383807 - DNA, 13 bp, Homo sapiens
cttgaagaactga

SEQ ID NO: 1383808 - DNA, 14 bp, Homo sapiens
cttgaagaactgac

SEQ ID NO: 1383809 - DNA, 16 bp, Homo sapiens
cttgcccagcctggat

SEQ ID NO: 1383810 - DNA, 16 bp, Homo sapiens
cttggctcagacacct

SEQ ID NO: 1383811 - DNA, 19 bp, Homo sapiens
cttggctcagacacctaga

SEQ ID NO: 1383812 - DNA, 21 bp, Homo sapiens
cttggtttccatcaaagccct

SEQ ID NO: 1383813 - DNA, 20 bp, Homo sapiens
cttgtcggccccaccagtgc

SEQ ID NO: 1383814 - DNA, 22 bp, Homo sapiens
cttgtcggccccaccagtgcct

SEQ ID NO: 1383815 - DNA, 23 bp, Homo sapiens
cttgtcggccccaccagtgcctc

SEQ ID NO: 1383816 - DNA, 19 bp, Homo sapiens
cttgtgtaatttcctgctc

SEQ ID NO: 1383817 - DNA, 18 bp, Homo sapiens
acatccttggactgagaa

SEQ ID NO: 1383818 - DNA, 15 bp, Homo sapiens
accagaaagaggaat

SEQ ID NO: 1383819 - DNA, 18 bp, Homo sapiens
accagagcgatgtgttct

SEQ ID NO: 1383820 - DNA, 17 bp, Homo sapiens
accagttccctcagccc

SEQ ID NO: 1383821 - DNA, 16 bp, Homo sapiens
accataagctactgcc

SEQ ID NO: 1383822 - DNA, 22 bp, Homo sapiens
accataagctactgccatcctg

SEQ ID NO: 1383823 - DNA, 23 bp, Homo sapiens
accatgttcttgagcagctgaat

SEQ ID NO: 1383824 - DNA, 16 bp, Homo sapiens
accattggggctccca

SEQ ID NO: 1383825 - DNA, 17 bp, Homo sapiens
accattggggctcccag

SEQ ID NO: 1383826 - DNA, 13 bp, Homo sapiens
accccctcacccc

SEQ ID NO: 1383827 - DNA, 20 bp, Homo sapiens
accctgaatcagaggcagag

SEQ ID NO: 1383828 - DNA, 17 bp, Homo sapiens
accctggacagtgccta

SEQ ID NO: 1383829 - DNA, 20 bp, Homo sapiens
accgagggggctgctcccac

SEQ ID NO: 1383830 - DNA, 17 bp, Homo sapiens
accgccttgcccagcct

SEQ ID NO: 1383831 - DNA, 17 bp, Homo sapiens
acctctttcggaaatga

SEQ ID NO: 1383832 - DNA, 14 bp, Homo sapiens
acctggctctgtgg

SEQ ID NO: 1383833 - DNA, 15 bp, Homo sapiens
actaattaaactgat

SEQ ID NO: 1383834 - DNA, 23 bp, Homo sapiens
actccatggtgaactgaagcaga

SEQ ID NO: 1383835 - DNA, 17 bp, Homo sapiens
actcccatgagggagat

SEQ ID NO: 1383836 - DNA, 16 bp, Homo sapiens
actccggccctccaga

SEQ ID NO: 1383837 - DNA, 19 bp, Homo sapiens
actccggccctccagagcc

SEQ ID NO: 1383838 - DNA, 17 bp, Homo sapiens
actgaatggactttgca

SEQ ID NO: 1383839 - DNA, 15 bp, Homo sapiens
actggctcacccagt

SEQ ID NO: 1383840 - DNA, 20 bp, Homo sapiens
acttcagcttaataagtatt

SEQ ID NO: 1383841 - DNA, 19 bp, Homo sapiens
acttctggcataactaaaa

SEQ ID NO: 1383842 - DNA, 15 bp, Homo sapiens
acttggaatttgctt

SEQ ID NO: 1383843 - DNA, 13 bp, Homo sapiens
agaaaaagccctc

SEQ ID NO: 1383844 - DNA, 13 bp, Homo sapiens
agaaaagcacctc

SEQ ID NO: 1383845 - DNA, 22 bp, Homo sapiens
agaaacccctgacaccttttca

SEQ ID NO: 1383846 - DNA, 15 bp, Homo sapiens
agaaagaggaataaa

SEQ ID NO: 1383847 - DNA, 21 bp, Homo sapiens
agaaatcctaacattatattc

SEQ ID NO: 1383848 - DNA, 15 bp, Homo sapiens
agaagagagatcaaa

SEQ ID NO: 1383849 - DNA, 20 bp, Homo sapiens
agaagcagcagctagaaaga

SEQ ID NO: 1383850 - DNA, 23 bp, Homo sapiens
agacaaatctatgccactcagaa

SEQ ID NO: 1383851 - DNA, 22 bp, Homo sapiens
agaccattggggctcccagcca

SEQ ID NO: 1383852 - DNA, 23 bp, Homo sapiens
agaccattggggctcccagccag

SEQ ID NO: 1383853 - DNA, 16 bp, Homo sapiens
agactcccatgaggga

SEQ ID NO: 1383854 - DNA, 14 bp, Homo sapiens
agagaaaaagccct

SEQ ID NO: 1383855 - DNA, 21 bp, Homo sapiens
agagagatcaaatggaaagga

SEQ ID NO: 1383856 - DNA, 15 bp, Homo sapiens
agagatcaaatggaa

SEQ ID NO: 1383857 - DNA, 16 bp, Homo sapiens
agagcagcctcttgaa

SEQ ID NO: 1383858 - DNA, 13 bp, Homo sapiens
agagccccacagc

SEQ ID NO: 1383859 - DNA, 15 bp, Homo sapiens
agagtcaagctgatg

SEQ ID NO: 1383860 - DNA, 19 bp, Homo sapiens
agagtcaggagaaacccct

SEQ ID NO: 1383861 - DNA, 21 bp, Homo sapiens
agatatgtatcataaaaataa

SEQ ID NO: 1383862 - DNA, 17 bp, Homo sapiens
agatctcctgtgcacct

SEQ ID NO: 1383863 - DNA, 12 bp, Homo sapiens
agcaacatggct

SEQ ID NO: 1383864 - DNA, 19 bp, Homo sapiens
agcacaaccatgttcttga

SEQ ID NO: 1383865 - DNA, 23 bp, Homo sapiens
agcagaccattggggctcccagc

SEQ ID NO: 1383866 - DNA, 22 bp, Homo sapiens
agcagagtcaagctgatgaagt

SEQ ID NO: 1383867 - DNA, 15 bp, Homo sapiens
agcagctagaaagag

SEQ ID NO: 1383868 - DNA, 17 bp, Homo sapiens
agcagctagaaagagaa

SEQ ID NO: 1383869 - DNA, 14 bp, Homo sapiens
agcaggctgccagt

SEQ ID NO: 1383870 - DNA, 20 bp, Homo sapiens
agcaggctgccagtgcctgg

SEQ ID NO: 1383871 - DNA, 17 bp, Homo sapiens
agcagtttgtgatctgt

SEQ ID NO: 1383872 - DNA, 15 bp, Homo sapiens
agcatgctccctcat

SEQ ID NO: 1383873 - DNA, 12 bp, Homo sapiens
agccgcccaagg

SEQ ID NO: 1383874 - DNA, 10 bp, Homo sapiens
agcctggatg

SEQ ID NO: 1383875 - DNA, 16 bp, Homo sapiens
agcctggatgccatcc

SEQ ID NO: 1383876 - DNA, 14 bp, Homo sapiens
agcgatgtgttctt

SEQ ID NO: 1383877 - DNA, 19 bp, Homo sapiens
agctcactccccaaccccc

SEQ ID NO: 1383878 - DNA, 16 bp, Homo sapiens
aggacccgtctccagc

SEQ ID NO: 1383879 - DNA, 21 bp, Homo sapiens
aggcaaaccaatttgttctgt

SEQ ID NO: 1383880 - DNA, 11 bp, Homo sapiens
aggctgccagt

SEQ ID NO: 1383881 - DNA, 13 bp, Homo sapiens
aggctgccagtgc

SEQ ID NO: 1383882 - DNA, 18 bp, Homo sapiens
aggctggataggagagga

SEQ ID NO: 1383883 - DNA, 20 bp, Homo sapiens
aggctggataggagaggaaa

SEQ ID NO: 1383884 - DNA, 13 bp, Homo sapiens
agggaaccagagc

SEQ ID NO: 1383885 - DNA, 15 bp, Homo sapiens
agggaaccagagcga

SEQ ID NO: 1383886 - DNA, 17 bp, Homo sapiens
agggggcctggatgccc

SEQ ID NO: 1383887 - DNA, 14 bp, Homo sapiens
agggggctgctccc

SEQ ID NO: 1383888 - DNA, 19 bp, Homo sapiens
agggggctgctcccacctg

SEQ ID NO: 1383889 - DNA, 21 bp, Homo sapiens
aggtatctgatgatgttctga

SEQ ID NO: 1383890 - DNA, 17 bp, Homo sapiens
aggttggagtgcattca

SEQ ID NO: 1383891 - DNA, 13 bp, Homo sapiens
agtaattgtgaaa

SEQ ID NO: 1383892 - DNA, 20 bp, Homo sapiens
agtatacacatcataaacaa

SEQ ID NO: 1383893 - DNA, 16 bp, Homo sapiens
agtcaagctgatgaag

SEQ ID NO: 1383894 - DNA, 13 bp, Homo sapiens
agtcctgcccgcc

SEQ ID NO: 1383895 - DNA, 11 bp, Homo sapiens
agtctggataa

SEQ ID NO: 1383896 - DNA, 22 bp, Homo sapiens
agtgcattcattcatcctctta

SEQ ID NO: 1383897 - DNA, 23 bp, Homo sapiens
agtgcattcattcatcctcttat

SEQ ID NO: 1383898 - DNA, 18 bp, Homo sapiens
agtgctcacccacaccat

SEQ ID NO: 1383899 - DNA, 16 bp, Homo sapiens
agtgtactctgagtcc

SEQ ID NO: 1383900 - DNA, 17 bp, Homo sapiens
agttattttgtgtcctt

SEQ ID NO: 1383901 - DNA, 12 bp, Homo sapiens
ataaaaccagaa

SEQ ID NO: 1383902 - DNA, 15 bp, Homo sapiens
ataaaaccagaaaga

SEQ ID NO: 1383903 - DNA, 12 bp, Homo sapiens
ataaaagaaaga

SEQ ID NO: 1383904 - DNA, 15 bp, Homo sapiens
ataaaatgaccagta

SEQ ID NO: 1383905 - DNA, 16 bp, Homo sapiens
ataaataaaagaaaga

SEQ ID NO: 1383906 - DNA, 19 bp, Homo sapiens
cagttccctcagccctcat

SEQ ID NO: 1383907 - DNA, 18 bp, Homo sapiens
cataaataaaatgaccag

SEQ ID NO: 1383908 - DNA, 16 bp, Homo sapiens
cataactaaaattaag

SEQ ID NO: 1383909 - DNA, 16 bp, Homo sapiens
cataagctactgccat

SEQ ID NO: 1383910 - DNA, 20 bp, Homo sapiens
cataagctactgccatcctg

SEQ ID NO: 1383911 - DNA, 16 bp, Homo sapiens
catcctggcccagggc

SEQ ID NO: 1383912 - DNA, 17 bp, Homo sapiens
catctgcgggggcagtg

SEQ ID NO: 1383913 - DNA, 22 bp, Homo sapiens
catgagccgcccaaggccttcc

SEQ ID NO: 1383914 - DNA, 20 bp, Homo sapiens
catggagtagagtcaggaga

SEQ ID NO: 1383915 - DNA, 15 bp, Homo sapiens
catggtgaactgaag

SEQ ID NO: 1383916 - DNA, 20 bp, Homo sapiens
catggtgaactgaagcagag

SEQ ID NO: 1383917 - DNA, 14 bp, Homo sapiens
cattgaattagaaa

SEQ ID NO: 1383918 - DNA, 20 bp, Homo sapiens
cattgttcagaaaagcacct

SEQ ID NO: 1383919 - DNA, 22 bp, Homo sapiens
cattgttcagaaaagcacctct

SEQ ID NO: 1383920 - DNA, 16 bp, Homo sapiens
catttgtcccaagtgc

SEQ ID NO: 1383921 - DNA, 13 bp, Homo sapiens
ccaaggccttccc

SEQ ID NO: 1383922 - DNA, 14 bp, Homo sapiens
ccaatttgttctgt

SEQ ID NO: 1383923 - DNA, 22 bp, Homo sapiens
ccacaccataagctactgccat

SEQ ID NO: 1383924 - DNA, 24 bp, Homo sapiens
ccaccagtgcctctccctgctgct

SEQ ID NO: 1383925 - DNA, 16 bp, Homo sapiens
ccacctccccccacaa

SEQ ID NO: 1383926 - DNA, 21 bp, Homo sapiens
ccactccggccctccagagcc

SEQ ID NO: 1383927 - DNA, 11 bp, Homo sapiens
ccagaaagagg

SEQ ID NO: 1383928 - DNA, 21 bp, Homo sapiens
ccagaaagaggaataaaatga

SEQ ID NO: 1383929 - DNA, 14 bp, Homo sapiens
ccagaagcagcagc

SEQ ID NO: 1383930 - DNA, 15 bp, Homo sapiens
ccagaagcagcagct

SEQ ID NO: 1383931 - DNA, 18 bp, Homo sapiens
ccagagcgatgtgttctt

SEQ ID NO: 1383932 - DNA, 13 bp, Homo sapiens
ccagccaggccct

SEQ ID NO: 1383933 - DNA, 19 bp, Homo sapiens
ccagcctatctctcttctg

SEQ ID NO: 1383934 - DNA, 15 bp, Homo sapiens
ccagcctggatgcca

SEQ ID NO: 1383935 - DNA, 17 bp, Homo sapiens
ccagcctggatgccatc

SEQ ID NO: 1383936 - DNA, 21 bp, Homo sapiens
ccagctgctgagatcctggac

SEQ ID NO: 1383937 - DNA, 22 bp, Homo sapiens
ccagctgctgagatcctggact

SEQ ID NO: 1383938 - DNA, 16 bp, Homo sapiens
ccagggcatctgggag

SEQ ID NO: 1383939 - DNA, 14 bp, Homo sapiens
ccagtcttctagtg

SEQ ID NO: 1383940 - DNA, 11 bp, Homo sapiens
ccagtgcctct

SEQ ID NO: 1383941 - DNA, 19 bp, Homo sapiens
ccagtgcctctccctgctg

SEQ ID NO: 1383942 - DNA, 13 bp, Homo sapiens
ccagtgcctgggt

SEQ ID NO: 1383943 - DNA, 14 bp, Homo sapiens
ccagtgcctgggtg

SEQ ID NO: 1383944 - DNA, 13 bp, Homo sapiens
ccataatgcttct

SEQ ID NO: 1383945 - DNA, 23 bp, Homo sapiens
ccataatgcttctttcctcttaa

SEQ ID NO: 1383946 - DNA, 22 bp, Homo sapiens
ccatcaaagccctccctgtctg

SEQ ID NO: 1383947 - DNA, 20 bp, Homo sapiens
ccatgagggagatgccatga

SEQ ID NO: 1383948 - DNA, 14 bp, Homo sapiens
ccatggtgaactga

SEQ ID NO: 1383949 - DNA, 16 bp, Homo sapiens
ccattcttgcttgact

SEQ ID NO: 1383950 - DNA, 19 bp, Homo sapiens
ccattggggctcccagcca

SEQ ID NO: 1383951 - DNA, 20 bp, Homo sapiens
ccattggggctcccagccag

SEQ ID NO: 1383952 - DNA, 13 bp, Homo sapiens
ccatttgtcccaa

SEQ ID NO: 1383953 - DNA, 20 bp, Homo sapiens
cccaagactcccatgaggga

SEQ ID NO: 1383954 - DNA, 23 bp, Homo sapiens
cccaaggccttcccctggcactg

SEQ ID NO: 1383955 - DNA, 13 bp, Homo sapiens
cccaagtgccaaa

SEQ ID NO: 1383956 - DNA, 12 bp, Homo sapiens
cccagccaggcc

SEQ ID NO: 1383957 - DNA, 14 bp, Homo sapiens
cccagccaggccct

SEQ ID NO: 1383958 - DNA, 16 bp, Homo sapiens
cccagcctatctctct

SEQ ID NO: 1383959 - DNA, 19 bp, Homo sapiens
cccagcctggatgccatcc

SEQ ID NO: 1383960 - DNA, 15 bp, Homo sapiens
cccaggcactctctt

SEQ ID NO: 1383961 - DNA, 14 bp, Homo sapiens
cccagggtggccac

SEQ ID NO: 1383962 - DNA, 15 bp, Homo sapiens
cccagggtggccaca

SEQ ID NO: 1383963 - DNA, 22 bp, Homo sapiens
cccatctgcgggggcagtgctc

SEQ ID NO: 1383964 - DNA, 21 bp, Homo sapiens
cccatgagggagatgccatga

SEQ ID NO: 1383965 - DNA, 17 bp, Homo sapiens
ccccaagactcccatga

SEQ ID NO: 1383966 - DNA, 18 bp, Homo sapiens
ccccacaagtgccctcca

SEQ ID NO: 1383967 - DNA, 17 bp, Homo sapiens
ccccaccagtgcctctc

SEQ ID NO: 1383968 - DNA, 15 bp, Homo sapiens
ccccataatgcttct

SEQ ID NO: 1383969 - DNA, 16 bp, Homo sapiens
cccgtctccagctgct

SEQ ID NO: 1383970 - DNA, 13 bp, Homo sapiens
ccctccagagccc

SEQ ID NO: 1383971 - DNA, 15 bp, Homo sapiens
ccctcttagaagaaa

SEQ ID NO: 1383972 - DNA, 13 bp, Homo sapiens
ccctgcacagcag

SEQ ID NO: 1383973 - DNA, 20 bp, Homo sapiens
ccctgcacagcaggctgcca

SEQ ID NO: 1383974 - DNA, 19 bp, Homo sapiens
cccttgtcggccccaccag

SEQ ID NO: 1383975 - DNA, 16 bp, Homo sapiens
ccgagggggctgctcc

SEQ ID NO: 1383976 - DNA, 19 bp, Homo sapiens
ccgagggggctgctcccac

SEQ ID NO: 1383977 - DNA, 16 bp, Homo sapiens
ccgccttgcccagcct

SEQ ID NO: 1383978 - DNA, 22 bp, Homo sapiens
ccgccttgcccagcctggatgc

SEQ ID NO: 1383979 - DNA, 13 bp, Homo sapiens
ccggccctccaga

SEQ ID NO: 1383980 - DNA, 21 bp, Homo sapiens
ccgtgtggtaagcaacatggc

SEQ ID NO: 1383981 - DNA, 22 bp, Homo sapiens
ccgtgtggtaagcaacatggct

SEQ ID NO: 1383982 - DNA, 23 bp, Homo sapiens
ccgtgtggtaagcaacatggctt

SEQ ID NO: 1383983 - DNA, 15 bp, Homo sapiens
cctccagagccccac

SEQ ID NO: 1383984 - DNA, 16 bp, Homo sapiens
cctccctgtctgtctg

SEQ ID NO: 1383985 - DNA, 12 bp, Homo sapiens
cctgaatcagag

SEQ ID NO: 1383986 - DNA, 15 bp, Homo sapiens
cctgaatcagaggca

SEQ ID NO: 1383987 - DNA, 19 bp, Homo sapiens
cctgatgtcttggtttcca

SEQ ID NO: 1383988 - DNA, 23 bp, Homo sapiens
cctgcacagcaggctgccagtgc

SEQ ID NO: 1383989 - DNA, 13 bp, Homo sapiens
cctgccacctccc

SEQ ID NO: 1383990 - DNA, 18 bp, Homo sapiens
cctgccacctccccccac

SEQ ID NO: 1383991 - DNA, 18 bp, Homo sapiens
cctggacagtgcctaact

SEQ ID NO: 1383992 - DNA, 14 bp, Homo sapiens
cctggactgagggg

SEQ ID NO: 1383993 - DNA, 18 bp, Homo sapiens
cctggatgccccctgtgg

SEQ ID NO: 1383994 - DNA, 23 bp, Homo sapiens
cctggcactggcaaacagggcct

SEQ ID NO: 1383995 - DNA, 16 bp, Homo sapiens
ggagcacactggctca

SEQ ID NO: 1383996 - DNA, 15 bp, Homo sapiens
ggatgccatccaagt

SEQ ID NO: 1383997 - DNA, 20 bp, Homo sapiens
ggccaccgccttgcccagcc

SEQ ID NO: 1383998 - DNA, 19 bp, Homo sapiens
ggcccagggtggccacacc

SEQ ID NO: 1383999 - DNA, 15 bp, Homo sapiens
ggccccaccagtgcc

SEQ ID NO: 1384000 - DNA, 15 bp, Homo sapiens
ggccctccagagccc

SEQ ID NO: 1384001 - DNA, 21 bp, Homo sapiens
ggccctccagagccccacagc

SEQ ID NO: 1384002 - DNA, 23 bp, Homo sapiens
ggccctccagagccccacagccc

SEQ ID NO: 1384003 - DNA, 17 bp, Homo sapiens
ggcccttgtcggcccca

SEQ ID NO: 1384004 - DNA, 11 bp, Homo sapiens
ggcctggatgc

SEQ ID NO: 1384005 - DNA, 20 bp, Homo sapiens
ggcctggatgccccctgtgg

SEQ ID NO: 1384006 - DNA, 13 bp, Homo sapiens
ggctcacccagtc

SEQ ID NO: 1384007 - DNA, 18 bp, Homo sapiens
ggctcccagccaggccct

SEQ ID NO: 1384008 - DNA, 18 bp, Homo sapiens
ggctgccagtgcctgggt

SEQ ID NO: 1384009 - DNA, 18 bp, Homo sapiens
ggctgctcccacctggct

SEQ ID NO: 1384010 - DNA, 15 bp, Homo sapiens
ggcttgagtctggat

SEQ ID NO: 1384011 - DNA, 15 bp, Homo sapiens
gggcatactaataaa

SEQ ID NO: 1384012 - DNA, 21 bp, Homo sapiens
gggcctctgcggagcacactg

SEQ ID NO: 1384013 - DNA, 18 bp, Homo sapiens
gggctgctcccacctggc

SEQ ID NO: 1384014 - DNA, 23 bp, Homo sapiens
gggctgctcccacctggctctgt

SEQ ID NO: 1384015 - DNA, 13 bp, Homo sapiens
ggggcagtgctca

SEQ ID NO: 1384016 - DNA, 17 bp, Homo sapiens
ggggcagtgctcaccca

SEQ ID NO: 1384017 - DNA, 12 bp, Homo sapiens
ggggctcccagc

SEQ ID NO: 1384018 - DNA, 14 bp, Homo sapiens
gggggctgctccca

SEQ ID NO: 1384019 - DNA, 16 bp, Homo sapiens
gggtatcatgcttcta

SEQ ID NO: 1384020 - DNA, 17 bp, Homo sapiens
ggtaagcaacatggctt

SEQ ID NO: 1384021 - DNA, 12 bp, Homo sapiens
ggtccaggagat

SEQ ID NO: 1384022 - DNA, 20 bp, Homo sapiens
gtaagggactccagaagcag

SEQ ID NO: 1384023 - DNA, 18 bp, Homo sapiens
gtaatttcctgctcctcc

SEQ ID NO: 1384024 - DNA, 23 bp, Homo sapiens
gtaccactacttagagatatgta

SEQ ID NO: 1384025 - DNA, 17 bp, Homo sapiens
gtataagatgctgctga

SEQ ID NO: 1384026 - DNA, 19 bp, Homo sapiens
gtatcataaaaataaaatc

SEQ ID NO: 1384027 - DNA, 14 bp, Homo sapiens
gtatcatgcttcta

SEQ ID NO: 1384028 - DNA, 19 bp, Homo sapiens
gtcagtgtactctgagtcc

SEQ ID NO: 1384029 - DNA, 16 bp, Homo sapiens
gtcctcattgttcaga

SEQ ID NO: 1384030 - DNA, 17 bp, Homo sapiens
gtcggccccaccagtgc

SEQ ID NO: 1384031 - DNA, 15 bp, Homo sapiens
gtctcaaaataaaac

SEQ ID NO: 1384032 - DNA, 16 bp, Homo sapiens
gtctggataatttgta

SEQ ID NO: 1384033 - DNA, 21 bp, Homo sapiens
gtctgtctctcttttgctctc

SEQ ID NO: 1384034 - DNA, 18 bp, Homo sapiens
gtgatctgtccttccaac

SEQ ID NO: 1384035 - DNA, 22 bp, Homo sapiens
gtgcctctccctgctgctccta

SEQ ID NO: 1384036 - DNA, 20 bp, Homo sapiens
gtgcttgaggccaaatgagt

SEQ ID NO: 1384037 - DNA, 21 bp, Homo sapiens
gtggaccagttccctcagccc

SEQ ID NO: 1384038 - DNA, 20 bp, Homo sapiens
gtggatgctgctgcccctgc

SEQ ID NO: 1384039 - DNA, 14 bp, Homo sapiens
gtggatgtcccttc

SEQ ID NO: 1384040 - DNA, 23 bp, Homo sapiens
gtggcgagccatttgtcccaagt

SEQ ID NO: 1384041 - DNA, 17 bp, Homo sapiens
gtgggtccaggagatga

SEQ ID NO: 1384042 - DNA, 21 bp, Homo sapiens
gtggtaagcaacatggctttg

SEQ ID NO: 1384043 - DNA, 22 bp, Homo sapiens
gttaagcacaaccatgttcttg

SEQ ID NO: 1384044 - DNA, 18 bp, Homo sapiens
gttcacgtgactcctcaa

SEQ ID NO: 1384045 - DNA, 19 bp, Homo sapiens
gttccctcagccctcatta

SEQ ID NO: 1384046 - DNA, 15 bp, Homo sapiens
gttcttgagcagctg

SEQ ID NO: 1384047 - DNA, 16 bp, Homo sapiens
gttcttgagcagctga

SEQ ID NO: 1384048 - DNA, 15 bp, Homo sapiens
gtttttcttgcatgg

SEQ ID NO: 1384049 - DNA, 19 bp, Homo sapiens
taaaaataaaatctgtaaa

SEQ ID NO: 1384050 - DNA, 23 bp, Homo sapiens
taacattatattcccaaatctca

SEQ ID NO: 1384051 - DNA, 19 bp, Homo sapiens
taaccctgaatcagaggca

SEQ ID NO: 1384052 - DNA, 20 bp, Homo sapiens
taaccctgaatcagaggcag

SEQ ID NO: 1384053 - DNA, 13 bp, Homo sapiens
taactaaaattaa

SEQ ID NO: 1384054 - DNA, 20 bp, Homo sapiens
taagcacaaccatgttcttg

SEQ ID NO: 1384055 - DNA, 15 bp, Homo sapiens
taagctactgccatc

SEQ ID NO: 1384056 - DNA, 18 bp, Homo sapiens
taagctactgccatcctg

SEQ ID NO: 1384057 - DNA, 19 bp, Homo sapiens
taagggactccagaagcag

SEQ ID NO: 1384058 - DNA, 13 bp, Homo sapiens
taattaaactgat

SEQ ID NO: 1384059 - DNA, 17 bp, Homo sapiens
tacattgaattagaaac

SEQ ID NO: 1384060 - DNA, 14 bp, Homo sapiens
tacctgtaggtcta

SEQ ID NO: 1384061 - DNA, 22 bp, Homo sapiens
tactgaagatgcagcaaaatgt

SEQ ID NO: 1384062 - DNA, 22 bp, Homo sapiens
tacttctggcataactaaaatt

SEQ ID NO: 1384063 - DNA, 23 bp, Homo sapiens
tagagatatgtatcataaaaata

SEQ ID NO: 1384064 - DNA, 18 bp, Homo sapiens
tagattgttttagagtta

SEQ ID NO: 1384065 - DNA, 13 bp, Homo sapiens
taggtaatgatta

SEQ ID NO: 1384066 - DNA, 17 bp, Homo sapiens
tataaaatacataatat

SEQ ID NO: 1384067 - DNA, 16 bp, Homo sapiens
tatacacatcataaac

SEQ ID NO: 1384068 - DNA, 22 bp, Homo sapiens
tatacctgggcatactaataaa

SEQ ID NO: 1384069 - DNA, 20 bp, Homo sapiens
tatgagcatgctccctcatg

SEQ ID NO: 1384070 - DNA, 13 bp, Homo sapiens
tatgggtttggct

SEQ ID NO: 1384071 - DNA, 21 bp, Homo sapiens
tattttggctcaaataaaatt

SEQ ID NO: 1384072 - DNA, 15 bp, Homo sapiens
tcaaaataaaaccag

SEQ ID NO: 1384073 - DNA, 15 bp, Homo sapiens
tcaaatggaaaggag

SEQ ID NO: 1384074 - DNA, 14 bp, Homo sapiens
tcaattttgaaaac

SEQ ID NO: 1384075 - DNA, 14 bp, Homo sapiens
tcagaaaagcacct

SEQ ID NO: 1384076 - DNA, 16 bp, Homo sapiens
tcagaaaagcacctct

SEQ ID NO: 1384077 - DNA, 15 bp, Homo sapiens
tcagacacctagact

SEQ ID NO: 1384078 - DNA, 19 bp, Homo sapiens
tcagacacctagactctaa

SEQ ID NO: 1384079 - DNA, 20 bp, Homo sapiens
tcagacacctagactctaaa

SEQ ID NO: 1384080 - DNA, 19 bp, Homo sapiens
tcagcagcggcagcagcag

SEQ ID NO: 1384081 - DNA, 14 bp, Homo sapiens
tcatacacagaaat

SEQ ID NO: 1384082 - DNA, 13 bp, Homo sapiens
tcatactgaagat

SEQ ID NO: 1384083 - DNA, 17 bp, Homo sapiens
tcatgcgcagtccccag

SEQ ID NO: 1384084 - DNA, 16 bp, Homo sapiens
tccaaacttaacagat

SEQ ID NO: 1384085 - DNA, 18 bp, Homo sapiens
tccaaacttaacagatca

SEQ ID NO: 1384086 - DNA, 17 bp, Homo sapiens
tccagagccccacagcc

SEQ ID NO: 1384087 - DNA, 21 bp, Homo sapiens
tccagctgctgagatcctgga

SEQ ID NO: 1384088 - DNA, 10 bp, Homo sapiens
tccaggagat

SEQ ID NO: 1384089 - DNA, 15 bp, Homo sapiens
tcccaaatctcaaaa

SEQ ID NO: 1384090 - DNA, 13 bp, Homo sapiens
tcccaagtgccaa

SEQ ID NO: 1384091 - DNA, 16 bp, Homo sapiens
tcccacctggctctgt

SEQ ID NO: 1384092 - DNA, 14 bp, Homo sapiens
tcccagccaggccc

SEQ ID NO: 1384093 - DNA, 19 bp, Homo sapiens
tcccatgagggagatgcca

SEQ ID NO: 1384094 - DNA, 17 bp, Homo sapiens
tccccataatgcttctt

SEQ ID NO: 1384095 - DNA, 17 bp, Homo sapiens
tccccatgctcagctca

SEQ ID NO: 1384096 - DNA, 15 bp, Homo sapiens
tcccctggcactggc

SEQ ID NO: 1384097 - DNA, 16 bp, Homo sapiens
tccctcagccctcatt

SEQ ID NO: 1384098 - DNA, 17 bp, Homo sapiens
tccctcagccctcatta

SEQ ID NO: 1384099 - DNA, 18 bp, Homo sapiens
tccctcagccctcattaa

SEQ ID NO: 1384100 - DNA, 14 bp, Homo sapiens
tccctcatgcagat

SEQ ID NO: 1384101 - DNA, 20 bp, Homo sapiens
tccctgtctgtctgtctctc

SEQ ID NO: 1384102 - DNA, 22 bp, Homo sapiens
tccctgtctgtctgtctctctt

SEQ ID NO: 1384103 - DNA, 14 bp, Homo sapiens
tccggccctccaga

SEQ ID NO: 1384104 - DNA, 18 bp, Homo sapiens
tccgtcccctgcccatgc

SEQ ID NO: 1384105 - DNA, 17 bp, Homo sapiens
tcctcattgttcagaaa

SEQ ID NO: 1384106 - DNA, 20 bp, Homo sapiens
tcctggactgagggggcctg

SEQ ID NO: 1384107 - DNA, 22 bp, Homo sapiens
tcctggactgagggggcctgga

SEQ ID NO: 1384108 - DNA, 19 bp, Homo sapiens
tcctggcccagggcatctg

SEQ ID NO: 1384109 - DNA, 14 bp, Homo sapiens
tcctttgaagagga

SEQ ID NO: 1384110 - DNA, 20 bp, Homo sapiens
tcctttgaagaggaaaatga

SEQ ID NO: 1384111 - DNA, 12 bp, Homo sapiens
tctcctgtgcac

SEQ ID NO: 1384112 - DNA, 17 bp, Homo sapiens
tctctggggtctgtgat

SEQ ID NO: 1384113 - DNA, 19 bp, Homo sapiens
tctcttcatgcgcagtccc

SEQ ID NO: 1384114 - DNA, 18 bp, Homo sapiens
tctgatgatgttctgaaa

SEQ ID NO: 1384115 - DNA, 18 bp, Homo sapiens
tctgcgggggcagtgctc

SEQ ID NO: 1384116 - DNA, 22 bp, Homo sapiens
tctggataatttgtataagatg

SEQ ID NO: 1384117 - DNA, 21 bp, Homo sapiens
tctgtctctcttttgctctct

SEQ ID NO: 1384118 - DNA, 18 bp, Homo sapiens
tcttaatgtctcaaaata

SEQ ID NO: 1384119 - DNA, 13 bp, Homo sapiens
tcttggggaagat

SEQ ID NO: 1384120 - DNA, 21 bp, Homo sapiens
tcttttcatggagtagagtca

SEQ ID NO: 1384121 - DNA, 17 bp, Homo sapiens
tgaaaacctctttcgga

SEQ ID NO: 1384122 - DNA, 15 bp, Homo sapiens
tgaactgaagcagag

SEQ ID NO: 1384123 - DNA, 12 bp, Homo sapiens
tgaagaggaaaa

SEQ ID NO: 1384124 - DNA, 21 bp, Homo sapiens
tgaagatgcagcaaaatgtga

SEQ ID NO: 1384125 - DNA, 13 bp, Homo sapiens
tgaagcagagtca

SEQ ID NO: 1384126 - DNA, 18 bp, Homo sapiens
tgaagcatgctctgtaag

SEQ ID NO: 1384127 - DNA, 15 bp, Homo sapiens
tgaagttaagcacaa

SEQ ID NO: 1384128 - DNA, 22 bp, Homo sapiens
tgaagttaagcacaaccatgtt

SEQ ID NO: 1384129 - DNA, 14 bp, Homo sapiens
tgaataccccaaga

SEQ ID NO: 1384130 - DNA, 17 bp, Homo sapiens
tgaatgcttaaatgatc

SEQ ID NO: 1384131 - DNA, 14 bp, Homo sapiens
tgaatgggaaaaga

SEQ ID NO: 1384132 - DNA, 15 bp, Homo sapiens
tgactcctcaattcc

SEQ ID NO: 1384133 - DNA, 15 bp, Homo sapiens
tgacttcctgaactc

SEQ ID NO: 1384134 - DNA, 20 bp, Homo sapiens
tgactttggagacgatgctt

SEQ ID NO: 1384135 - DNA, 13 bp, Homo sapiens
tgagagcagcctc

SEQ ID NO: 1384136 - DNA, 12 bp, Homo sapiens
tgagcagctgaa

SEQ ID NO: 1384137 - DNA, 14 bp, Homo sapiens
tgagcatgctccct

SEQ ID NO: 1384138 - DNA, 15 bp, Homo sapiens
tgatgtccaaactta

SEQ ID NO: 1384139 - DNA, 19 bp, Homo sapiens
tgattcaaataaccctgaa

SEQ ID NO: 1384140 - DNA, 17 bp, Homo sapiens
tgattcctttgaagagg

SEQ ID NO: 1384141 - DNA, 20 bp, Homo sapiens
tgattcctttgaagaggaaa

SEQ ID NO: 1384142 - DNA, 16 bp, Homo sapiens
tgcaacaaactcaaaa

SEQ ID NO: 1384143 - DNA, 18 bp, Homo sapiens
tgcacactttggcccagg

SEQ ID NO: 1384144 - DNA, 21 bp, Homo sapiens
tgcacagcaggctgccagtgc

SEQ ID NO: 1384145 - DNA, 17 bp, Homo sapiens
tgcatggtttggagctg

SEQ ID NO: 1384146 - DNA, 18 bp, Homo sapiens
tgcattcattcatcctct

SEQ ID NO: 1384147 - DNA, 12 bp, Homo sapiens
tgccagtgcctg

SEQ ID NO: 1384148 - DNA, 15 bp, Homo sapiens
tgccagtgcctgggt

SEQ ID NO: 1384149 - DNA, 18 bp, Homo sapiens
tgccatgagccgcccaag

SEQ ID NO: 1384150 - DNA, 23 bp, Homo sapiens
tgccatgagccgcccaaggcctt

SEQ ID NO: 1384151 - DNA, 14 bp, Homo sapiens
tgcccagcctggat

SEQ ID NO: 1384152 - DNA, 17 bp, Homo sapiens
tgcccagcctggatgcc

SEQ ID NO: 1384153 - DNA, 13 bp, Homo sapiens
tgccccctgtgga

SEQ ID NO: 1384154 - DNA, 19 bp, Homo sapiens
tgccccctgtggatgctgc

SEQ ID NO: 1384155 - DNA, 21 bp, Homo sapiens
tgccccctgtggatgctgctg

SEQ ID NO: 1384156 - DNA, 14 bp, Homo sapiens
tgcccctcttagaa

SEQ ID NO: 1384157 - DNA, 18 bp, Homo sapiens
tgccccttccccatgctc

SEQ ID NO: 1384158 - DNA, 19 bp, Homo sapiens
tgcctccgtcccctgccca

SEQ ID NO: 1384159 - DNA, 15 bp, Homo sapiens
tgctcccacctggct

SEQ ID NO: 1384160 - DNA, 18 bp, Homo sapiens
tgctcccacctggctctg

SEQ ID NO: 1384161 - DNA, 16 bp, Homo sapiens
tgctctctcattccca

SEQ ID NO: 1384162 - DNA, 20 bp, Homo sapiens
tgctctctcattcccaggca

SEQ ID NO: 1384163 - DNA, 14 bp, Homo sapiens
tgctgagatcctgg

SEQ ID NO: 1384164 - DNA, 21 bp, Homo sapiens
tgctgcccctgcacagcaggc

SEQ ID NO: 1384165 - DNA, 12 bp, Homo sapiens
tgctgctgcccc

SEQ ID NO: 1384166 - DNA, 19 bp, Homo sapiens
tgctgctgcccctgcacag

SEQ ID NO: 1384167 - DNA, 16 bp, Homo sapiens
tggaaaggagaggaaa

SEQ ID NO: 1384168 - DNA, 23 bp, Homo sapiens
tggaaaggagaggaaagaactca

SEQ ID NO: 1384169 - DNA, 19 bp, Homo sapiens
tggaccagttccctcagcc

SEQ ID NO: 1384170 - DNA, 23 bp, Homo sapiens
tggactgagggggcctggatgcc

SEQ ID NO: 1384171 - DNA, 17 bp, Homo sapiens
tggactttgcacacttt

SEQ ID NO: 1384172 - DNA, 19 bp, Homo sapiens
gtgagcatgtttggaaggg

SEQ ID NO: 1384173 - DNA, 18 bp, Homo sapiens
gtgaggagcttgaaaccc

SEQ ID NO: 1384174 - DNA, 21 bp, Homo sapiens
gtgattcaatctgtaaactgt

SEQ ID NO: 1384175 - DNA, 17 bp, Homo sapiens
gtgatttttatgccacc

SEQ ID NO: 1384176 - DNA, 16 bp, Homo sapiens
gtgcagcaaccagagc

SEQ ID NO: 1384177 - DNA, 11 bp, Homo sapiens
gtgcatcaggc

SEQ ID NO: 1384178 - DNA, 14 bp, Homo sapiens
gtgcattctccagc

SEQ ID NO: 1384179 - DNA, 21 bp, Homo sapiens
gtgccaatttcaagttccaag

SEQ ID NO: 1384180 - DNA, 14 bp, Homo sapiens
gtgccttcatttgg

SEQ ID NO: 1384181 - DNA, 13 bp, Homo sapiens
gtgcgtgaatatt

SEQ ID NO: 1384182 - DNA, 13 bp, Homo sapiens
gtgcgtggtgcga

SEQ ID NO: 1384183 - DNA, 21 bp, Homo sapiens
gtgctatactgcatacttttt

SEQ ID NO: 1384184 - DNA, 16 bp, Homo sapiens
gtgctcaggagccctg

SEQ ID NO: 1384185 - DNA, 19 bp, Homo sapiens
gtgctcaggagccctggga

SEQ ID NO: 1384186 - DNA, 20 bp, Homo sapiens
gtgctgggattacaggtgta

SEQ ID NO: 1384187 - DNA, 22 bp, Homo sapiens
gtgcttctagttctgccaggag

SEQ ID NO: 1384188 - DNA, 15 bp, Homo sapiens
gtgcttttaaatgca

SEQ ID NO: 1384189 - DNA, 18 bp, Homo sapiens
gtggcactggggcagggg

SEQ ID NO: 1384190 - DNA, 13 bp, Homo sapiens
gtggccaggaggt

SEQ ID NO: 1384191 - DNA, 20 bp, Homo sapiens
gtggcccttatgactgccaa

SEQ ID NO: 1384192 - DNA, 21 bp, Homo sapiens
gtggcctaacctgccgagagt

SEQ ID NO: 1384193 - DNA, 22 bp, Homo sapiens
gtgggagaccggcctgccagga

SEQ ID NO: 1384194 - DNA, 15 bp, Homo sapiens
gtgggagggtaccag

SEQ ID NO: 1384195 - DNA, 13 bp, Homo sapiens
tttcatataaagt

SEQ ID NO: 1384196 - DNA, 21 bp, Homo sapiens
tttcccactgtttaaggagtt

SEQ ID NO: 1384197 - DNA, 23 bp, Homo sapiens
tttccctactgaagcccttgtga

SEQ ID NO: 1384198 - DNA, 23 bp, Homo sapiens
tttcctagccctctcacatttat

SEQ ID NO: 1384199 - DNA, 22 bp, Homo sapiens
tttcctccgtcacctcagagac

SEQ ID NO: 1384200 - DNA, 22 bp, Homo sapiens
tttcctcttctattttgtaaac

SEQ ID NO: 1384201 - DNA, 17 bp, Homo sapiens
tttccttttttgttatt

SEQ ID NO: 1384202 - DNA, 18 bp, Homo sapiens
tttcggacagtttatttg

SEQ ID NO: 1384203 - DNA, 17 bp, Homo sapiens
tttctaagaaacattta

SEQ ID NO: 1384204 - DNA, 13 bp, Homo sapiens
tttctatttttat

SEQ ID NO: 1384205 - DNA, 15 bp, Homo sapiens
tttctatttttatct

SEQ ID NO: 1384206 - DNA, 15 bp, Homo sapiens
tttctccaagagcta

SEQ ID NO: 1384207 - DNA, 15 bp, Homo sapiens
tttctctgaacacat

SEQ ID NO: 1384208 - DNA, 16 bp, Homo sapiens
tttctgagttcctgca

SEQ ID NO: 1384209 - DNA, 23 bp, Homo sapiens
tttctggattccccatctcaggc

SEQ ID NO: 1384210 - DNA, 22 bp, Homo sapiens
tttctgtaagaaacctactgcc

SEQ ID NO: 1384211 - DNA, 18 bp, Homo sapiens
tttcttaaaccttcagtt

SEQ ID NO: 1384212 - DNA, 13 bp, Homo sapiens
tttcttaaataag

SEQ ID NO: 1384213 - DNA, 18 bp, Homo sapiens
tttctttgtttctttctt

SEQ ID NO: 1384214 - DNA, 23 bp, Homo sapiens
tttgaagttagctttaacttaaa

SEQ ID NO: 1384215 - DNA, 19 bp, Homo sapiens
tttgaatcctctctctgtg

SEQ ID NO: 1384216 - DNA, 15 bp, Homo sapiens
tttgataaagtaaaa

SEQ ID NO: 1384217 - DNA, 12 bp, Homo sapiens
tttgcacagctc

SEQ ID NO: 1384218 - DNA, 16 bp, Homo sapiens
tttgcacagctctccg

SEQ ID NO: 1384219 - DNA, 21 bp, Homo sapiens
tttgcatttaaaacagacact

SEQ ID NO: 1384220 - DNA, 23 bp, Homo sapiens
tttgcatttaaaacagacactgg

SEQ ID NO: 1384221 - DNA, 12 bp, Homo sapiens
tttgcctgtaac

SEQ ID NO: 1384222 - DNA, 21 bp, Homo sapiens
tttgcctgtaacaagccagat

SEQ ID NO: 1384223 - DNA, 11 bp, Homo sapiens
tttggaatgtg

SEQ ID NO: 1384224 - DNA, 14 bp, Homo sapiens
tttggagtgcttaa

SEQ ID NO: 1384225 - DNA, 23 bp, Homo sapiens
tttggcatccctgggccttgggc

SEQ ID NO: 1384226 - DNA, 13 bp, Homo sapiens
tttggctttcagg

SEQ ID NO: 1384227 - DNA, 17 bp, Homo sapiens
tttgtaaactcaaaata

SEQ ID NO: 1384228 - DNA, 18 bp, Homo sapiens
tttgtaaggtttttgtag

SEQ ID NO: 1384229 - DNA, 15 bp, Homo sapiens
tttgtactgaaaaat

SEQ ID NO: 1384230 - DNA, 15 bp, Homo sapiens
tttgtttcctttgtt

SEQ ID NO: 1384231 - DNA, 13 bp, Homo sapiens
ttttaaacacatt

SEQ ID NO: 1384232 - DNA, 19 bp, Homo sapiens
ttttaaacagtgagcctga

SEQ ID NO: 1384233 - DNA, 12 bp, Homo sapiens
ttttaaagaatt

SEQ ID NO: 1384234 - DNA, 13 bp, Homo sapiens
ttttaaagaattg

SEQ ID NO: 1384235 - DNA, 19 bp, Homo sapiens
ttttaaatgcataaatgca

SEQ ID NO: 1384236 - DNA, 14 bp, Homo sapiens
ttttaataaatttc

SEQ ID NO: 1384237 - DNA, 12 bp, Homo sapiens
ttttacaaagcc

SEQ ID NO: 1384238 - DNA, 20 bp, Homo sapiens
ttttacttttaaactgtgta

SEQ ID NO: 1384239 - DNA, 23 bp, Homo sapiens
ttttagcaaagatatctcatctc

SEQ ID NO: 1384240 - DNA, 21 bp, Homo sapiens
ttttatctgaaatcaattaaa

SEQ ID NO: 1384241 - DNA, 15 bp, Homo sapiens
ttttatttgcatgtg

SEQ ID NO: 1384242 - DNA, 12 bp, Homo sapiens
ttttcacatttt

SEQ ID NO: 1384243 - DNA, 19 bp, Homo sapiens
ttttcaccagatttgctaa

SEQ ID NO: 1384244 - DNA, 11 bp, Homo sapiens
ttttcagatgt

SEQ ID NO: 1384245 - DNA, 17 bp, Homo sapiens
ttttcagatgtgaacca

SEQ ID NO: 1384246 - DNA, 19 bp, Homo sapiens
ttttcagcaaactcttttc

SEQ ID NO: 1384247 - DNA, 16 bp, Homo sapiens
ttttcatacattttct

SEQ ID NO: 1384248 - DNA, 21 bp, Homo sapiens
ttttccatggcaggaaggctt

SEQ ID NO: 1384249 - DNA, 18 bp, Homo sapiens
ttttccattacatgatct

SEQ ID NO: 1384250 - DNA, 12 bp, Homo sapiens
ttttctaactgg

SEQ ID NO: 1384251 - DNA, 16 bp, Homo sapiens
ttttctaagaaacatt

SEQ ID NO: 1384252 - DNA, 13 bp, Homo sapiens
ttttctatgaatt

SEQ ID NO: 1384253 - DNA, 14 bp, Homo sapiens
ttttctcctcccag

SEQ ID NO: 1384254 - DNA, 17 bp, Homo sapiens
ttttctctgaacacatt

SEQ ID NO: 1384255 - DNA, 21 bp, Homo sapiens
ttttctggaatacatgaaata

SEQ ID NO: 1384256 - DNA, 19 bp, Homo sapiens
ttttctttgtgtagctttg

SEQ ID NO: 1384257 - DNA, 19 bp, Homo sapiens
ttttgacagtgttgaaaat

SEQ ID NO: 1384258 - DNA, 15 bp, Homo sapiens
ttttgacataaagtt

SEQ ID NO: 1384259 - DNA, 13 bp, Homo sapiens
ttttgctgagact

SEQ ID NO: 1384260 - DNA, 13 bp, Homo sapiens
ttttgctggaata

SEQ ID NO: 1384261 - DNA, 21 bp, Homo sapiens
ttttggagtgcttaaaaatgc

SEQ ID NO: 1384262 - DNA, 23 bp, Homo sapiens
ttttggagtgcttaaaaatgcca

SEQ ID NO: 1384263 - DNA, 19 bp, Homo sapiens
ttttgttgtttcttaaata

SEQ ID NO: 1384264 - DNA, 21 bp, Homo sapiens
ttttgttgtttcttaaataag

SEQ ID NO: 1384265 - DNA, 15 bp, Homo sapiens
tttttaaaaaagctt

SEQ ID NO: 1384266 - DNA, 23 bp, Homo sapiens
tttttaaaaaagcttaaaacttt

SEQ ID NO: 1384267 - DNA, 15 bp, Homo sapiens
tttttacaaagccct

SEQ ID NO: 1384268 - DNA, 13 bp, Homo sapiens
tttttatttaaaa

SEQ ID NO: 1384269 - DNA, 13 bp, Homo sapiens
tttttcacatttt

SEQ ID NO: 1384270 - DNA, 11 bp, Homo sapiens
tttttccaaca

SEQ ID NO: 1384271 - DNA, 14 bp, Homo sapiens
tttttccgtaaaaa

SEQ ID NO: 1384272 - DNA, 15 bp, Homo sapiens
tttttccgtaaaaat

SEQ ID NO: 1384273 - DNA, 16 bp, Homo sapiens
tttttccgtaaaaatg

SEQ ID NO: 1384274 - DNA, 22 bp, Homo sapiens
tttttccttcaaagtttaataa

SEQ ID NO: 1384275 - DNA, 17 bp, Homo sapiens
tttttgaaaaagcgaaa

SEQ ID NO: 1384276 - DNA, 17 bp, Homo sapiens
tttttgcatttaaaaca

SEQ ID NO: 1384277 - DNA, 13 bp, Homo sapiens
ttttttaaaaaag

SEQ ID NO: 1384278 - DNA, 12 bp, Homo sapiens
tgtttgctttct

SEQ ID NO: 1384279 - DNA, 14 bp, Homo sapiens
tgtttggctttcag

SEQ ID NO: 1384280 - DNA, 19 bp, Homo sapiens
tgttttatgagaaagcctt

SEQ ID NO: 1384281 - DNA, 13 bp, Homo sapiens
tgtttttcacatt

SEQ ID NO: 1384282 - DNA, 15 bp, Homo sapiens
tgtttttttctaata

SEQ ID NO: 1384283 - DNA, 13 bp, Homo sapiens
ttaaaaaactaaa

SEQ ID NO: 1384284 - DNA, 20 bp, Homo sapiens
ttaaaaagtaataaaattca

SEQ ID NO: 1384285 - DNA, 21 bp, Homo sapiens
ttaaaaatgccaaaaacaaaa

SEQ ID NO: 1384286 - DNA, 15 bp, Homo sapiens
ttaaaactatccaat

SEQ ID NO: 1384287 - DNA, 15 bp, Homo sapiens
ttaaaactttgaagt

SEQ ID NO: 1384288 - DNA, 18 bp, Homo sapiens
ttaaaagtgtatttgtta

SEQ ID NO: 1384289 - DNA, 22 bp, Homo sapiens
ttaaaatagcaaaagaagaagt

SEQ ID NO: 1384290 - DNA, 13 bp, Homo sapiens
ttaaaatataaat

SEQ ID NO: 1384291 - DNA, 18 bp, Homo sapiens
ttaaaatataaattaaga

SEQ ID NO: 1384292 - DNA, 18 bp, Homo sapiens
ttaaacagtgagcctgaa

SEQ ID NO: 1384293 - DNA, 20 bp, Homo sapiens
ttaaagtgactaatggcatg

SEQ ID NO: 1384294 - DNA, 17 bp, Homo sapiens
ttaaataagaaactttt

SEQ ID NO: 1384295 - DNA, 18 bp, Homo sapiens
ttaaatctgtttttctaa

SEQ ID NO: 1384296 - DNA, 13 bp, Homo sapiens
ttaaatgtaaaga

SEQ ID NO: 1384297 - DNA, 23 bp, Homo sapiens
ttaaatgtgtgtaaaaaagtgtt

SEQ ID NO: 1384298 - DNA, 21 bp, Homo sapiens
ttaacaagatatttatatgtt

SEQ ID NO: 1384299 - DNA, 16 bp, Homo sapiens
ttaacagaagttgtga

SEQ ID NO: 1384300 - DNA, 14 bp, Homo sapiens
ttaacagagtctga

SEQ ID NO: 1384301 - DNA, 12 bp, Homo sapiens
ttaacataccta

SEQ ID NO: 1384302 - DNA, 17 bp, Homo sapiens
ttaacatacctaagaag

SEQ ID NO: 1384303 - DNA, 22 bp, Homo sapiens
ttaacatacctaagaagtacat

SEQ ID NO: 1384304 - DNA, 16 bp, Homo sapiens
ttaactcattagactg

SEQ ID NO: 1384305 - DNA, 20 bp, Homo sapiens
ttaactggtagttcattgta

SEQ ID NO: 1384306 - DNA, 13 bp, Homo sapiens
ttaagacttgaca

SEQ ID NO: 1384307 - DNA, 16 bp, Homo sapiens
ttaagatacactcctg

SEQ ID NO: 1384308 - DNA, 13 bp, Homo sapiens
ttaagattaaatt

SEQ ID NO: 1384309 - DNA, 17 bp, Homo sapiens
ttaaggtgtagccacac

SEQ ID NO: 1384310 - DNA, 17 bp, Homo sapiens
ttaatataatttaacag

SEQ ID NO: 1384311 - DNA, 19 bp, Homo sapiens
ttaatatcctaaacatcat

SEQ ID NO: 1384312 - DNA, 16 bp, Homo sapiens
ttaatatttatgtgtt

SEQ ID NO: 1384313 - DNA, 19 bp, Homo sapiens
ttaatatttatgtgtttta

SEQ ID NO: 1384314 - DNA, 17 bp, Homo sapiens
ttaatcagatagatatt

SEQ ID NO: 1384315 - DNA, 20 bp, Homo sapiens
ttaatcaggtcctcagagaa

SEQ ID NO: 1384316 - DNA, 19 bp, Homo sapiens
ttaatgtatagtaaatcac

SEQ ID NO: 1384317 - DNA, 16 bp, Homo sapiens
ttaattaccaacctgt

SEQ ID NO: 1384318 - DNA, 19 bp, Homo sapiens
ttaattagccagtgaaaaa

SEQ ID NO: 1384319 - DNA, 13 bp, Homo sapiens
ttaatttttgata

SEQ ID NO: 1384320 - DNA, 18 bp, Homo sapiens
ttacaaagcccttttata

SEQ ID NO: 1384321 - DNA, 20 bp, Homo sapiens
ttacaagtaacaaaaataaa

SEQ ID NO: 1384322 - DNA, 20 bp, Homo sapiens
ttacaattttttatcatgca

SEQ ID NO: 1384323 - DNA, 24 bp, Homo sapiens
ttaccagatttttacacatgtatc

SEQ ID NO: 1384324 - DNA, 14 bp, Homo sapiens
ttacccctctacca

SEQ ID NO: 1384325 - DNA, 18 bp, Homo sapiens
ttacctttttatttgcat

SEQ ID NO: 1384326 - DNA, 20 bp, Homo sapiens
ttactataagaactttgagc

SEQ ID NO: 1384327 - DNA, 13 bp, Homo sapiens
ttactgaattttt

SEQ ID NO: 1384328 - DNA, 14 bp, Homo sapiens
ttactggtccaaaa

SEQ ID NO: 1384329 - DNA, 15 bp, Homo sapiens
ttactgtaactgatt

SEQ ID NO: 1384330 - DNA, 16 bp, Homo sapiens
ttactttatgttacta

SEQ ID NO: 1384331 - DNA, 17 bp, Homo sapiens
ttacttttaaacagtga

SEQ ID NO: 1384332 - DNA, 14 bp, Homo sapiens
ttacttttaaactg

SEQ ID NO: 1384333 - DNA, 21 bp, Homo sapiens
ttagaaaacataatcttctgc

SEQ ID NO: 1384334 - DNA, 15 bp, Homo sapiens
ttagactggacagct

SEQ ID NO: 1384335 - DNA, 23 bp, Homo sapiens
ttagatgtgagagaaagagaaat

SEQ ID NO: 1384336 - DNA, 19 bp, Homo sapiens
ttagctctgtactcctaat

SEQ ID NO: 1384337 - DNA, 19 bp, Homo sapiens
ttataaaaaggtgttttga

SEQ ID NO: 1384338 - DNA, 16 bp, Homo sapiens
ttataactggaaagaa

SEQ ID NO: 1384339 - DNA, 17 bp, Homo sapiens
ttataactggaaagaag

SEQ ID NO: 1384340 - DNA, 18 bp, Homo sapiens
ttataggatttatttaaa

SEQ ID NO: 1384341 - DNA, 19 bp, Homo sapiens
ttatatgcttactgatata

SEQ ID NO: 1384342 - DNA, 15 bp, Homo sapiens
ttatcaacttcctaa

SEQ ID NO: 1384343 - DNA, 23 bp, Homo sapiens
ttatcccaaatcctgtctgaaaa

SEQ ID NO: 1384344 - DNA, 17 bp, Homo sapiens
ttatcctgaaatttcag

SEQ ID NO: 1384345 - DNA, 21 bp, Homo sapiens
ttatctaagttaatttaaagt

SEQ ID NO: 1384346 - DNA, 20 bp, Homo sapiens
ttatctacttccaaactaat

SEQ ID NO: 1384347 - DNA, 16 bp, Homo sapiens
ttatctttacttttaa

SEQ ID NO: 1384348 - DNA, 12 bp, Homo sapiens
ttatctttatat

SEQ ID NO: 1384349 - DNA, 16 bp, Homo sapiens
ttatgacatcacttgt

SEQ ID NO: 1384350 - DNA, 18 bp, Homo sapiens
ttatgacatcacttgtac

SEQ ID NO: 1384351 - DNA, 15 bp, Homo sapiens
ttatgagaaagcctt

SEQ ID NO: 1384352 - DNA, 18 bp, Homo sapiens
ttatgatttttttttcat

SEQ ID NO: 1384353 - DNA, 15 bp, Homo sapiens
ttatgtctcttctga

SEQ ID NO: 1384354 - DNA, 16 bp, Homo sapiens
ttattaacaattaggc

SEQ ID NO: 1384355 - DNA, 19 bp, Homo sapiens
ttattaatatatattatct

SEQ ID NO: 1384356 - DNA, 15 bp, Homo sapiens
ttattggctgagata

SEQ ID NO: 1384357 - DNA, 17 bp, Homo sapiens
ttatttaaaaaactaaa

SEQ ID NO: 1384358 - DNA, 22 bp, Homo sapiens
ttatttaaaatagcaaaagaag

SEQ ID NO: 1384359 - DNA, 22 bp, Homo sapiens
ttatttaaacaaatgtgtaatt

SEQ ID NO: 1384360 - DNA, 12 bp, Homo sapiens
ttatttataatg

SEQ ID NO: 1384361 - DNA, 12 bp, Homo sapiens
ttatttgtaata

SEQ ID NO: 1384362 - DNA, 16 bp, Homo sapiens
ttatttgtaatagatg

SEQ ID NO: 1384363 - DNA, 12 bp, Homo sapiens
ttatttgttgag

SEQ ID NO: 1384364 - DNA, 14 bp, Homo sapiens
ttatttgttgagag

SEQ ID NO: 1384365 - DNA, 15 bp, Homo sapiens
ttattttgacataaa

SEQ ID NO: 1384366 - DNA, 22 bp, Homo sapiens
ttattttgccaagggcataaat

SEQ ID NO: 1384367 - DNA, 12 bp, Homo sapiens
ttcaacaaacat

SEQ ID NO: 1384368 - DNA, 20 bp, Homo sapiens
ttcaacagttacctccaaaa

SEQ ID NO: 1384369 - DNA, 12 bp, Homo sapiens
ttcaacttttcc

SEQ ID NO: 1384370 - DNA, 20 bp, Homo sapiens
ttcaagaaactgaggaattt

SEQ ID NO: 1384371 - DNA, 14 bp, Homo sapiens
ttcaaggaaaataa

SEQ ID NO: 1384372 - DNA, 14 bp, Homo sapiens
ttcaatctgtaaac

SEQ ID NO: 1384373 - DNA, 21 bp, Homo sapiens
ttcacatcgcagattctccct

SEQ ID NO: 1384374 - DNA, 19 bp, Homo sapiens
ttcacattttccttttcaa

SEQ ID NO: 1384375 - DNA, 21 bp, Homo sapiens
ttcacctggaagcatttgttt

SEQ ID NO: 1384376 - DNA, 17 bp, Homo sapiens
ttcacctgtaaacctga

SEQ ID NO: 1384377 - DNA, 18 bp, Homo sapiens
tttaaaatgtaaagccat

SEQ ID NO: 1384378 - DNA, 17 bp, Homo sapiens
tttaaaatttatattgt

SEQ ID NO: 1384379 - DNA, 13 bp, Homo sapiens
tttaaacaaatgt

SEQ ID NO: 1384380 - DNA, 17 bp, Homo sapiens
tttaaaccgctaaaaga

SEQ ID NO: 1384381 - DNA, 20 bp, Homo sapiens
tttaaaccgctaaaagaaac

SEQ ID NO: 1384382 - DNA, 21 bp, Homo sapiens
tttaaaccgctaaaagaaact

SEQ ID NO: 1384383 - DNA, 15 bp, Homo sapiens
tttaaactgtgtaca

SEQ ID NO: 1384384 - DNA, 17 bp, Homo sapiens
tttaaagttgtttgtgc

SEQ ID NO: 1384385 - DNA, 20 bp, Homo sapiens
tttaaatctgtttttctaac

SEQ ID NO: 1384386 - DNA, 16 bp, Homo sapiens
tttaacctatgatatt

SEQ ID NO: 1384387 - DNA, 21 bp, Homo sapiens
tttaactgcctaaaatgttct

SEQ ID NO: 1384388 - DNA, 13 bp, Homo sapiens
tttaacttaaata

SEQ ID NO: 1384389 - DNA, 13 bp, Homo sapiens
tttaagtatttag

SEQ ID NO: 1384390 - DNA, 20 bp, Homo sapiens
tttaatgtatagtaaatcac

SEQ ID NO: 1384391 - DNA, 19 bp, Homo sapiens
tttacaattttttatcatg

SEQ ID NO: 1384392 - DNA, 18 bp, Homo sapiens
tttacacaatagaattat

SEQ ID NO: 1384393 - DNA, 19 bp, Homo sapiens
tttacacaatagaattata

SEQ ID NO: 1384394 - DNA, 13 bp, Homo sapiens
tttaccagaaagc

SEQ ID NO: 1384395 - DNA, 14 bp, Homo sapiens
tttacttccacaga

SEQ ID NO: 1384396 - DNA, 18 bp, Homo sapiens
tttacttttaaacagtga

SEQ ID NO: 1384397 - DNA, 16 bp, Homo sapiens
tttacttttaaactgt

SEQ ID NO: 1384398 - DNA, 15 bp, Homo sapiens
tttagacttcaagca

SEQ ID NO: 1384399 - DNA, 22 bp, Homo sapiens
tttagtagcagtgattgtctta

SEQ ID NO: 1384400 - DNA, 16 bp, Homo sapiens
tttagtgaacttgaaa

SEQ ID NO: 1384401 - DNA, 21 bp, Homo sapiens
tttatatgaagaaaatcactt

SEQ ID NO: 1384402 - DNA, 12 bp, Homo sapiens
tttatatgttat

SEQ ID NO: 1384403 - DNA, 15 bp, Homo sapiens
tttatatgttattaa

SEQ ID NO: 1384404 - DNA, 19 bp, Homo sapiens
tttatatgttattaaacag

SEQ ID NO: 1384405 - DNA, 14 bp, Homo sapiens
tttatattgtaaat

SEQ ID NO: 1384406 - DNA, 19 bp, Homo sapiens
tttatattgtaaatattgt

SEQ ID NO: 1384407 - DNA, 18 bp, Homo sapiens
tttatcctgaaatttcag

SEQ ID NO: 1384408 - DNA, 16 bp, Homo sapiens
tttatctgaattttta

SEQ ID NO: 1384409 - DNA, 20 bp, Homo sapiens
tttatgttactacatgcact

SEQ ID NO: 1384410 - DNA, 14 bp, Homo sapiens
tttatttgttgaga

SEQ ID NO: 1384411 - DNA, 22 bp, Homo sapiens
tttcaagttccaagttgctaat

SEQ ID NO: 1384412 - DNA, 23 bp, Homo sapiens
tttcacaacagcctgacaacatt

SEQ ID NO: 1384413 - DNA, 17 bp, Homo sapiens
tttcacattagaagaca

SEQ ID NO: 1384414 - DNA, 13 bp, Homo sapiens
tttcacattttcc

SEQ ID NO: 1384415 - DNA, 17 bp, Homo sapiens
tttcaccagatttgcta

SEQ ID NO: 1384416 - DNA, 18 bp, Homo sapiens
tttcacctgtaaacctga

SEQ ID NO: 1384417 - DNA, 23 bp, Homo sapiens
tttcagggggcctttaaagactt

SEQ ID NO: 1384418 - DNA, 14 bp, Homo sapiens
tttcatacacttat

SEQ ID NO: 1384419 - DNA, 16 bp, Homo sapiens
tcttcctgacacttta

SEQ ID NO: 1384420 - DNA, 13 bp, Homo sapiens
tcttctattttgt

SEQ ID NO: 1384421 - DNA, 13 bp, Homo sapiens
tcttcttgaaatt

SEQ ID NO: 1384422 - DNA, 21 bp, Homo sapiens
tcttcttttaaaccattttct

SEQ ID NO: 1384423 - DNA, 15 bp, Homo sapiens
tcttgaggggaccag

SEQ ID NO: 1384424 - DNA, 18 bp, Homo sapiens
tcttgaggggaccaggag

SEQ ID NO: 1384425 - DNA, 22 bp, Homo sapiens
tcttggggagtttagggtgggg

SEQ ID NO: 1384426 - DNA, 12 bp, Homo sapiens
tctttattttga

SEQ ID NO: 1384427 - DNA, 17 bp, Homo sapiens
tctttctcactaaatct

SEQ ID NO: 1384428 - DNA, 18 bp, Homo sapiens
tctttctcactaaatctt

SEQ ID NO: 1384429 - DNA, 21 bp, Homo sapiens
tctttgagaaaggattaagat

SEQ ID NO: 1384430 - DNA, 13 bp, Homo sapiens
tctttgtgtagct

SEQ ID NO: 1384431 - DNA, 15 bp, Homo sapiens
tctttgtttctttct

SEQ ID NO: 1384432 - DNA, 13 bp, Homo sapiens
tcttttcatacat

SEQ ID NO: 1384433 - DNA, 23 bp, Homo sapiens
tcttttcatacattttctaagaa

SEQ ID NO: 1384434 - DNA, 13 bp, Homo sapiens
tgaaaaagcgaaa

SEQ ID NO: 1384435 - DNA, 14 bp, Homo sapiens
tgaaaaatggtccc

SEQ ID NO: 1384436 - DNA, 19 bp, Homo sapiens
tgaaaaggtttatgaaaaa

SEQ ID NO: 1384437 - DNA, 20 bp, Homo sapiens
tgaaaataaaaagatcactt

SEQ ID NO: 1384438 - DNA, 21 bp, Homo sapiens
tgaaaataaaaagatcacttt

SEQ ID NO: 1384439 - DNA, 14 bp, Homo sapiens
tgaaaataaagaat

SEQ ID NO: 1384440 - DNA, 15 bp, Homo sapiens
tgaaaataaagaatg

SEQ ID NO: 1384441 - DNA, 16 bp, Homo sapiens
tgaaaataaagaatgg

SEQ ID NO: 1384442 - DNA, 17 bp, Homo sapiens
tgaaaataaagtgtata

SEQ ID NO: 1384443 - DNA, 19 bp, Homo sapiens
tgaaaatgtgctatactgc

SEQ ID NO: 1384444 - DNA, 20 bp, Homo sapiens
tgaaaatgtgctatactgca

SEQ ID NO: 1384445 - DNA, 21 bp, Homo sapiens
tgaaaatgtgctatactgcat

SEQ ID NO: 1384446 - DNA, 23 bp, Homo sapiens
tgaaacaaagagttcaagaaata

SEQ ID NO: 1384447 - DNA, 13 bp, Homo sapiens
tgaaacagaaaca

SEQ ID NO: 1384448 - DNA, 16 bp, Homo sapiens
tgaaacagaaacaaaa

SEQ ID NO: 1384449 - DNA, 15 bp, Homo sapiens
tgaaaccttgaagtt

SEQ ID NO: 1384450 - DNA, 22 bp, Homo sapiens
tgaaaccttgaagttctgaaat

SEQ ID NO: 1384451 - DNA, 13 bp, Homo sapiens
tgaaagccatgga

SEQ ID NO: 1384452 - DNA, 11 bp, Homo sapiens
tgaaagtgact

SEQ ID NO: 1384453 - DNA, 21 bp, Homo sapiens
tgaaataccaacctgaagaca

SEQ ID NO: 1384454 - DNA, 15 bp, Homo sapiens
tgaaatatcctgctt

SEQ ID NO: 1384455 - DNA, 23 bp, Homo sapiens
tgaaatttaactgcctaaaatgt

SEQ ID NO: 1384456 - DNA, 14 bp, Homo sapiens
tgaaattttaacct

SEQ ID NO: 1384457 - DNA, 22 bp, Homo sapiens
tgaaattttatatgcttactga

SEQ ID NO: 1384458 - DNA, 15 bp, Homo sapiens
tgaacaaatggcctt

SEQ ID NO: 1384459 - DNA, 18 bp, Homo sapiens
tgaacaagaattggaagc

SEQ ID NO: 1384460 - DNA, 17 bp, Homo sapiens
tgaacaccattgaaggc

SEQ ID NO: 1384461 - DNA, 15 bp, Homo sapiens
tgaacataatgaaca

SEQ ID NO: 1384462 - DNA, 21 bp, Homo sapiens
tgaacataatgaacagaattt

SEQ ID NO: 1384463 - DNA, 17 bp, Homo sapiens
tgaacatattgttgaaa

SEQ ID NO: 1384464 - DNA, 17 bp, Homo sapiens
tgaaccattaaccagat

SEQ ID NO: 1384465 - DNA, 14 bp, Homo sapiens
tgaactcaaactga

SEQ ID NO: 1384466 - DNA, 21 bp, Homo sapiens
tgaactgattcacatctcatt

SEQ ID NO: 1384467 - DNA, 17 bp, Homo sapiens
tgaactttttattgatt

SEQ ID NO: 1384468 - DNA, 19 bp, Homo sapiens
tgaagaactgaggaggaaa

SEQ ID NO: 1384469 - DNA, 16 bp, Homo sapiens
tgaagaatacttctca

SEQ ID NO: 1384470 - DNA, 20 bp, Homo sapiens
tgaagaatacttctcatttt

SEQ ID NO: 1384471 - DNA, 14 bp, Homo sapiens
tgaaggctgtacac

SEQ ID NO: 1384472 - DNA, 20 bp, Homo sapiens
tgaagttctgaaatttaact

SEQ ID NO: 1384473 - DNA, 21 bp, Homo sapiens
tgaatatttgttatgtagata

SEQ ID NO: 1384474 - DNA, 16 bp, Homo sapiens
tgaatcctctctctgt

SEQ ID NO: 1384475 - DNA, 22 bp, Homo sapiens
tgaatgaggtcagcatgtctat

SEQ ID NO: 1384476 - DNA, 21 bp, Homo sapiens
tgaatggctatgtttttaatg

SEQ ID NO: 1384477 - DNA, 17 bp, Homo sapiens
tgaattaaataaaccct

SEQ ID NO: 1384478 - DNA, 21 bp, Homo sapiens
tgaattatcttggttgaaaat

SEQ ID NO: 1384479 - DNA, 19 bp, Homo sapiens
tgaattgggaacattatca

SEQ ID NO: 1384480 - DNA, 16 bp, Homo sapiens
tgaattttgttgctgt

SEQ ID NO: 1384481 - DNA, 17 bp, Homo sapiens
tgaatttttaaacaagt

SEQ ID NO: 1384482 - DNA, 21 bp, Homo sapiens
tgaatttttaaacaagtattt

SEQ ID NO: 1384483 - DNA, 23 bp, Homo sapiens
tgaatttttaaacaagtatttgt

SEQ ID NO: 1384484 - DNA, 16 bp, Homo sapiens
tgaatttttttttcct

SEQ ID NO: 1384485 - DNA, 16 bp, Homo sapiens
tgacaacatttctata

SEQ ID NO: 1384486 - DNA, 17 bp, Homo sapiens
tgacaactggcaggcag

SEQ ID NO: 1384487 - DNA, 13 bp, Homo sapiens
tgacacaaacaca

SEQ ID NO: 1384488 - DNA, 22 bp, Homo sapiens
tgacacatggcccctccccctg

SEQ ID NO: 1384489 - DNA, 23 bp, Homo sapiens
tgacactagcccaatgaaatgaa

SEQ ID NO: 1384490 - DNA, 20 bp, Homo sapiens
tgacagctaggatgtgcatt

SEQ ID NO: 1384491 - DNA, 18 bp, Homo sapiens
tgacagtccgtcaaaaca

SEQ ID NO: 1384492 - DNA, 22 bp, Homo sapiens
tgacagtccgtcaaaacagatt

SEQ ID NO: 1384493 - DNA, 19 bp, Homo sapiens
tgacagtgttgaaaatgtt

SEQ ID NO: 1384494 - DNA, 14 bp, Homo sapiens
tgacataaagttga

SEQ ID NO: 1384495 - DNA, 16 bp, Homo sapiens
tgacataaagttgata

SEQ ID NO: 1384496 - DNA, 17 bp, Homo sapiens
tgacatcacttgtacaa

SEQ ID NO: 1384497 - DNA, 18 bp, Homo sapiens
tgacatcacttgtacaaa

SEQ ID NO: 1384498 - DNA, 19 bp, Homo sapiens
tgacatcacttgtacaaaa

SEQ ID NO: 1384499 - DNA, 20 bp, Homo sapiens
tgacatcacttgtacaaaat

SEQ ID NO: 1384500 - DNA, 23 bp, Homo sapiens
tgacatcacttgtacaaaataaa

SEQ ID NO: 1384501 - DNA, 17 bp, Homo sapiens
tgaccagccgtgagcat

SEQ ID NO: 1384502 - DNA, 13 bp, Homo sapiens
tgacccctgctca

SEQ ID NO: 1384503 - DNA, 21 bp, Homo sapiens
tgaccctcatctttcttccaa

SEQ ID NO: 1384504 - DNA, 13 bp, Homo sapiens
tgacctccccacc

SEQ ID NO: 1384505 - DNA, 18 bp, Homo sapiens
tgacctcgtgatccaccc

SEQ ID NO: 1384506 - DNA, 14 bp, Homo sapiens
tgactaatggcatg

SEQ ID NO: 1384507 - DNA, 17 bp, Homo sapiens
tgactagggagccatgt

SEQ ID NO: 1384508 - DNA, 20 bp, Homo sapiens
tgactagggagccatgtttc

SEQ ID NO: 1384509 - DNA, 17 bp, Homo sapiens
tgactttttgcatttaa

SEQ ID NO: 1384510 - DNA, 14 bp, Homo sapiens
tgagaaagccttct

SEQ ID NO: 1384511 - DNA, 13 bp, Homo sapiens
tgagaaatttaaa

SEQ ID NO: 1384512 - DNA, 15 bp, Homo sapiens
tgagaaatttaaact

SEQ ID NO: 1384513 - DNA, 22 bp, Homo sapiens
tgagaacctgggttgcagacag

SEQ ID NO: 1384514 - DNA, 23 bp, Homo sapiens
tgagaatctatatttaacaagat

SEQ ID NO: 1384515 - DNA, 18 bp, Homo sapiens
tgagaatttgtgtggata

SEQ ID NO: 1384516 - DNA, 23 bp, Homo sapiens
tgagacaagaaaataagagctca

SEQ ID NO: 1384517 - DNA, 22 bp, Homo sapiens
tgagactaatcttattcatttt

SEQ ID NO: 1384518 - DNA, 13 bp, Homo sapiens
tgagagaggccat

SEQ ID NO: 1384519 - DNA, 21 bp, Homo sapiens
tgagatacatacagaattact

SEQ ID NO: 1384520 - DNA, 12 bp, Homo sapiens
tgagatgctggc

SEQ ID NO: 1384521 - DNA, 15 bp, Homo sapiens
tgagatgctggcttg

SEQ ID NO: 1384522 - DNA, 14 bp, Homo sapiens
tgagcatcacagaa

SEQ ID NO: 1384523 - DNA, 19 bp, Homo sapiens
tgagctccttaaggctctt

SEQ ID NO: 1384524 - DNA, 21 bp, Homo sapiens
tgagctccttaaggctctttt

SEQ ID NO: 1384525 - DNA, 14 bp, Homo sapiens
tgaggaattttctt

SEQ ID NO: 1384526 - DNA, 19 bp, Homo sapiens
tgaggacaaccattccaga

SEQ ID NO: 1384527 - DNA, 20 bp, Homo sapiens
tgaggacaaccattccagac

SEQ ID NO: 1384528 - DNA, 20 bp, Homo sapiens
tgaggatacgacagtacact

SEQ ID NO: 1384529 - DNA, 14 bp, Homo sapiens
tgaggctcagccct

SEQ ID NO: 1384530 - DNA, 14 bp, Homo sapiens
tgaggctttccatg

SEQ ID NO: 1384531 - DNA, 13 bp, Homo sapiens
tgaggggaccagg

SEQ ID NO: 1384532 - DNA, 16 bp, Homo sapiens
tgaggggaccaggagt

SEQ ID NO: 1384533 - DNA, 15 bp, Homo sapiens
tgaggttaaaatata

SEQ ID NO: 1384534 - DNA, 16 bp, Homo sapiens
tgaggttaaaatataa

SEQ ID NO: 1384535 - DNA, 15 bp, Homo sapiens
tgagtacagaattca

SEQ ID NO: 1384536 - DNA, 18 bp, Homo sapiens
tgagtcaagttgttcctt

SEQ ID NO: 1384537 - DNA, 20 bp, Homo sapiens
tgagtcaccctacctgtgcc

SEQ ID NO: 1384538 - DNA, 22 bp, Homo sapiens
tgagtcaccctacctgtgcctg

SEQ ID NO: 1384539 - DNA, 19 bp, Homo sapiens
tgagtcgtacagaaagctg

SEQ ID NO: 1384540 - DNA, 21 bp, Homo sapiens
tgagtctgtccagataagtta

SEQ ID NO: 1384541 - DNA, 20 bp, Homo sapiens
tgagttggacacactgtaaa

SEQ ID NO: 1384542 - DNA, 19 bp, Homo sapiens
tgataaagattttttaata

SEQ ID NO: 1384543 - DNA, 20 bp, Homo sapiens
tgataaagattttttaataa

SEQ ID NO: 1384544 - DNA, 16 bp, Homo sapiens
tgataagtacttcctc

SEQ ID NO: 1384545 - DNA, 16 bp, Homo sapiens
tgataatgaacagaac

SEQ ID NO: 1384546 - DNA, 13 bp, Homo sapiens
tgataattttaaa

SEQ ID NO: 1384547 - DNA, 14 bp, Homo sapiens
tgatactaagcatt

SEQ ID NO: 1384548 - DNA, 16 bp, Homo sapiens
tgatactaagcattga

SEQ ID NO: 1384549 - DNA, 19 bp, Homo sapiens
tgatagaaatgccaagcac

SEQ ID NO: 1384550 - DNA, 19 bp, Homo sapiens
tgatagggtttgtgacagg

SEQ ID NO: 1384551 - DNA, 13 bp, Homo sapiens
tgatatattttac

SEQ ID NO: 1384552 - DNA, 13 bp, Homo sapiens
tgatccaactaat

SEQ ID NO: 1384553 - DNA, 21 bp, Homo sapiens
tcttaacaagatatttatatg

SEQ ID NO: 1384554 - DNA, 22 bp, Homo sapiens
tcttaacaagatatttatatgt

SEQ ID NO: 1384555 - DNA, 21 bp, Homo sapiens
tcttacctgtatgtctccagt

SEQ ID NO: 1384556 - DNA, 14 bp, Homo sapiens
tcttcaaatgcctg

SEQ ID NO: 1384557 - DNA, 21 bp, Homo sapiens
tcttcagctgattgtttattt

SEQ ID NO: 1384558 - DNA, 16 bp, Homo sapiens
tcttcatgtttcagga

SEQ ID NO: 1384559 - DNA, 21 bp, Homo sapiens
tcttccagtcttcctgacact

SEQ ID NO: 1384560 - DNA, 16 bp, Homo sapiens
taaatgaacataatga

SEQ ID NO: 1384561 - DNA, 16 bp, Homo sapiens
taaatgcataaatgca

SEQ ID NO: 1384562 - DNA, 14 bp, Homo sapiens
taaatgcattatag

SEQ ID NO: 1384563 - DNA, 16 bp, Homo sapiens
taaatgtaaagatatt

SEQ ID NO: 1384564 - DNA, 13 bp, Homo sapiens
taaatgtgtgtaa

SEQ ID NO: 1384565 - DNA, 15 bp, Homo sapiens
taaatgtgtgtaaaa

SEQ ID NO: 1384566 - DNA, 20 bp, Homo sapiens
taaatgtttttattaacaat

SEQ ID NO: 1384567 - DNA, 13 bp, Homo sapiens
taaattaagactt

SEQ ID NO: 1384568 - DNA, 17 bp, Homo sapiens
taaattaagactttaaa

SEQ ID NO: 1384569 - DNA, 13 bp, Homo sapiens
taacaaaaataaa

SEQ ID NO: 1384570 - DNA, 21 bp, Homo sapiens
taacaagatatttatatgtta

SEQ ID NO: 1384571 - DNA, 13 bp, Homo sapiens
taacagaagttgt

SEQ ID NO: 1384572 - DNA, 20 bp, Homo sapiens
taaccagacacatactcatt

SEQ ID NO: 1384573 - DNA, 20 bp, Homo sapiens
taacctatgatattttctgt

SEQ ID NO: 1384574 - DNA, 16 bp, Homo sapiens
taaccttaatttatta

SEQ ID NO: 1384575 - DNA, 20 bp, Homo sapiens
taacgtttaagccaaaacaa

SEQ ID NO: 1384576 - DNA, 19 bp, Homo sapiens
tagatgcatttgggtccag

SEQ ID NO: 1384577 - DNA, 20 bp, Homo sapiens
tagatgcatttgggtccagg

SEQ ID NO: 1384578 - DNA, 23 bp, Homo sapiens
tagatgcatttgggtccaggagg

SEQ ID NO: 1384579 - DNA, 14 bp, Homo sapiens
tagcaaaagaagaa

SEQ ID NO: 1384580 - DNA, 12 bp, Homo sapiens
tagcaaagaatt

SEQ ID NO: 1384581 - DNA, 17 bp, Homo sapiens
tagcaaagatatctcat

SEQ ID NO: 1384582 - DNA, 19 bp, Homo sapiens
tagcaagacctgttggtta

SEQ ID NO: 1384583 - DNA, 13 bp, Homo sapiens
tagcacaagttat

SEQ ID NO: 1384584 - DNA, 14 bp, Homo sapiens
tagcccctgaaagc

SEQ ID NO: 1384585 - DNA, 14 bp, Homo sapiens
tagccctcagccca

SEQ ID NO: 1384586 - DNA, 20 bp, Homo sapiens
tagccctcctttttccaaca

SEQ ID NO: 1384587 - DNA, 19 bp, Homo sapiens
tagcctcaatttctgaaca

SEQ ID NO: 1384588 - DNA, 18 bp, Homo sapiens
tagcctcacttttaatga

SEQ ID NO: 1384589 - DNA, 20 bp, Homo sapiens
tagccttctctgttcatttc

SEQ ID NO: 1384590 - DNA, 21 bp, Homo sapiens
tagcgctatctccctgcctcc

SEQ ID NO: 1384591 - DNA, 14 bp, Homo sapiens
tagctgggactaca

SEQ ID NO: 1384592 - DNA, 22 bp, Homo sapiens
tagcttatctacttccaaacta

SEQ ID NO: 1384593 - DNA, 16 bp, Homo sapiens
tagctttaacttaaat

SEQ ID NO: 1384594 - DNA, 22 bp, Homo sapiens
tagctttaacttaaatagtatt

SEQ ID NO: 1384595 - DNA, 15 bp, Homo sapiens
tagctttgctctttg

SEQ ID NO: 1384596 - DNA, 21 bp, Homo sapiens
taggatttatttaaaatagca

SEQ ID NO: 1384597 - DNA, 22 bp, Homo sapiens
taggatttatttaaaatagcaa

SEQ ID NO: 1384598 - DNA, 21 bp, Homo sapiens
taggattttttttaatgttta

SEQ ID NO: 1384599 - DNA, 23 bp, Homo sapiens
taggccttgcggctcctcaggga

SEQ ID NO: 1384600 - DNA, 24 bp, Homo sapiens
taggccttgcggctcctcagggac

SEQ ID NO: 1384601 - DNA, 16 bp, Homo sapiens
taggctagggtgggga

SEQ ID NO: 1384602 - DNA, 12 bp, Homo sapiens
tagggagccatg

SEQ ID NO: 1384603 - DNA, 14 bp, Homo sapiens
taggtacacagctc

SEQ ID NO: 1384604 - DNA, 14 bp, Homo sapiens
taggtaggaaatgt

SEQ ID NO: 1384605 - DNA, 20 bp, Homo sapiens
taggtgggttgaaagccaag

SEQ ID NO: 1384606 - DNA, 15 bp, Homo sapiens
taggtttttgtttgt

SEQ ID NO: 1384607 - DNA, 21 bp, Homo sapiens
tagtaaatcacgctttttgaa

SEQ ID NO: 1384608 - DNA, 20 bp, Homo sapiens
tagtagcagtgattgtctta

SEQ ID NO: 1384609 - DNA, 18 bp, Homo sapiens
tagtcaatcaagtctgtt

SEQ ID NO: 1384610 - DNA, 18 bp, Homo sapiens
tagtccctcatgcaaatc

SEQ ID NO: 1384611 - DNA, 14 bp, Homo sapiens
tagtgaacttgaaa

SEQ ID NO: 1384612 - DNA, 16 bp, Homo sapiens
tagttcattgtaaatg

SEQ ID NO: 1384613 - DNA, 22 bp, Homo sapiens
tagttcattgtaaatgaacata

SEQ ID NO: 1384614 - DNA, 13 bp, Homo sapiens
tagttctgccagg

SEQ ID NO: 1384615 - DNA, 11 bp, Homo sapiens
tagtttggata

SEQ ID NO: 1384616 - DNA, 21 bp, Homo sapiens
tataaaatgcaaaataaatgt

SEQ ID NO: 1384617 - DNA, 18 bp, Homo sapiens
tataaattaagactttaa

SEQ ID NO: 1384618 - DNA, 16 bp, Homo sapiens
tataaccagacacata

SEQ ID NO: 1384619 - DNA, 20 bp, Homo sapiens
tataaccttaatttattatt

SEQ ID NO: 1384620 - DNA, 14 bp, Homo sapiens
tataagcttttctt

SEQ ID NO: 1384621 - DNA, 18 bp, Homo sapiens
tatagccaaaaatagcta

SEQ ID NO: 1384622 - DNA, 19 bp, Homo sapiens
tatagccaaaaatagctaa

SEQ ID NO: 1384623 - DNA, 22 bp, Homo sapiens
tatagccaaaaatagctaaata

SEQ ID NO: 1384624 - DNA, 15 bp, Homo sapiens
tataggatcatttgt

SEQ ID NO: 1384625 - DNA, 21 bp, Homo sapiens
tataggatttatttaaaatag

SEQ ID NO: 1384626 - DNA, 22 bp, Homo sapiens
tatagttattaagttctttaaa

SEQ ID NO: 1384627 - DNA, 21 bp, Homo sapiens
tatagttcatgtctgctatca

SEQ ID NO: 1384628 - DNA, 16 bp, Homo sapiens
tatataccaaagcaca

SEQ ID NO: 1384629 - DNA, 18 bp, Homo sapiens
tatatattatcttttcat

SEQ ID NO: 1384630 - DNA, 22 bp, Homo sapiens
tatatggaataagtgtacatat

SEQ ID NO: 1384631 - DNA, 12 bp, Homo sapiens
tatatgtacagt

SEQ ID NO: 1384632 - DNA, 15 bp, Homo sapiens
tatatgttattaaac

SEQ ID NO: 1384633 - DNA, 15 bp, Homo sapiens
tatatttaacaagat

SEQ ID NO: 1384634 - DNA, 23 bp, Homo sapiens
tatcaaacaccaacataaaaatg

SEQ ID NO: 1384635 - DNA, 18 bp, Homo sapiens
tatcaaccccagacactg

SEQ ID NO: 1384636 - DNA, 13 bp, Homo sapiens
tatccaaaagctt

SEQ ID NO: 1384637 - DNA, 22 bp, Homo sapiens
tatcccacctgacatgtccttc

SEQ ID NO: 1384638 - DNA, 19 bp, Homo sapiens
tatccctcctgttgggaga

SEQ ID NO: 1384639 - DNA, 20 bp, Homo sapiens
tatccctcctgttgggagag

SEQ ID NO: 1384640 - DNA, 14 bp, Homo sapiens
tatcctgaaatttc

SEQ ID NO: 1384641 - DNA, 17 bp, Homo sapiens
tatcctgaaatttcaga

SEQ ID NO: 1384642 - DNA, 16 bp, Homo sapiens
tatctccctgcctcct

SEQ ID NO: 1384643 - DNA, 17 bp, Homo sapiens
tatctgaggcactgata

SEQ ID NO: 1384644 - DNA, 23 bp, Homo sapiens
tatctgggaagctatttttttca

SEQ ID NO: 1384645 - DNA, 17 bp, Homo sapiens
tatgaagaactgaggag

SEQ ID NO: 1384646 - DNA, 21 bp, Homo sapiens
tatgaaggctgtacactgcac

SEQ ID NO: 1384647 - DNA, 16 bp, Homo sapiens
tatgagctcttcatgt

SEQ ID NO: 1384648 - DNA, 23 bp, Homo sapiens
tatgaggacttgtgtctctgtgc

SEQ ID NO: 1384649 - DNA, 17 bp, Homo sapiens
tatggaaataaatgtat

SEQ ID NO: 1384650 - DNA, 13 bp, Homo sapiens
tatggaataagtg

SEQ ID NO: 1384651 - DNA, 16 bp, Homo sapiens
tatggtaccagatgca

SEQ ID NO: 1384652 - DNA, 17 bp, Homo sapiens
tatggtaccagatgcag

SEQ ID NO: 1384653 - DNA, 13 bp, Homo sapiens
tatgtaaaacatt

SEQ ID NO: 1384654 - DNA, 19 bp, Homo sapiens
tatgtaaaatattgttact

SEQ ID NO: 1384655 - DNA, 12 bp, Homo sapiens
tatgtacagtta

SEQ ID NO: 1384656 - DNA, 10 bp, Homo sapiens
tatgtaccaa

SEQ ID NO: 1384657 - DNA, 14 bp, Homo sapiens
tatgtctcttctga

SEQ ID NO: 1384658 - DNA, 15 bp, Homo sapiens
tatgttattaaacag

SEQ ID NO: 1384659 - DNA, 13 bp, Homo sapiens
tatgtttttaatg

SEQ ID NO: 1384660 - DNA, 13 bp, Homo sapiens
tattaacatacct

SEQ ID NO: 1384661 - DNA, 23 bp, Homo sapiens
tattaatatatattatcttttca

SEQ ID NO: 1384662 - DNA, 14 bp, Homo sapiens
tattatgagatgct

SEQ ID NO: 1384663 - DNA, 17 bp, Homo sapiens
tattatgtctcttctga

SEQ ID NO: 1384664 - DNA, 21 bp, Homo sapiens
tattatgtctcttctgagcta

SEQ ID NO: 1384665 - DNA, 17 bp, Homo sapiens
tattattaacataccta

SEQ ID NO: 1384666 - DNA, 19 bp, Homo sapiens
tattccaagacatgtctgt

SEQ ID NO: 1384667 - DNA, 16 bp, Homo sapiens
tattcctcaaaaaatt

SEQ ID NO: 1384668 - DNA, 13 bp, Homo sapiens
tattgcctcactt

SEQ ID NO: 1384669 - DNA, 21 bp, Homo sapiens
tattggagagaaaaaattaac

SEQ ID NO: 1384670 - DNA, 20 bp, Homo sapiens
tattgtaaccctgtctggat

SEQ ID NO: 1384671 - DNA, 14 bp, Homo sapiens
tattgtgcacattt

SEQ ID NO: 1384672 - DNA, 21 bp, Homo sapiens
tatttaaaatagcaaaagaag

SEQ ID NO: 1384673 - DNA, 21 bp, Homo sapiens
tatttaaacaaatgtgtaatt

SEQ ID NO: 1384674 - DNA, 19 bp, Homo sapiens
tatttaaaccgctaaaaga

SEQ ID NO: 1384675 - DNA, 15 bp, Homo sapiens
tatttaacaagatct

SEQ ID NO: 1384676 - DNA, 16 bp, Homo sapiens
tatttaactctcttta

SEQ ID NO: 1384677 - DNA, 23 bp, Homo sapiens
tatttaactctctttatgtctgt

SEQ ID NO: 1384678 - DNA, 13 bp, Homo sapiens
tatttatatgtta

SEQ ID NO: 1384679 - DNA, 15 bp, Homo sapiens
tatttcacaacagcc

SEQ ID NO: 1384680 - DNA, 17 bp, Homo sapiens
tatttggtgattacatt

SEQ ID NO: 1384681 - DNA, 23 bp, Homo sapiens
tattttacaattttttatcatgc

SEQ ID NO: 1384682 - DNA, 13 bp, Homo sapiens
tattttcaagaaa

SEQ ID NO: 1384683 - DNA, 21 bp, Homo sapiens
tattttctgtgcctgaatatt

SEQ ID NO: 1384684 - DNA, 17 bp, Homo sapiens
tattttgacataaagtt

SEQ ID NO: 1384685 - DNA, 18 bp, Homo sapiens
tattttgacataaagttg

SEQ ID NO: 1384686 - DNA, 13 bp, Homo sapiens
tattttgtaaact

SEQ ID NO: 1384687 - DNA, 21 bp, Homo sapiens
tattttgtaaactcaaaatat

SEQ ID NO: 1384688 - DNA, 12 bp, Homo sapiens
tatttttatctt

SEQ ID NO: 1384689 - DNA, 14 bp, Homo sapiens
tatttttattattg

SEQ ID NO: 1384690 - DNA, 19 bp, Homo sapiens
tatttttctatgaattcct

SEQ ID NO: 1384691 - DNA, 17 bp, Homo sapiens
tattttttttaagtatt

SEQ ID NO: 1384692 - DNA, 13 bp, Homo sapiens
tcaaaaaattgca

SEQ ID NO: 1384693 - DNA, 16 bp, Homo sapiens
tcaaaacagattgttt

SEQ ID NO: 1384694 - DNA, 12 bp, Homo sapiens
tcaaaacattgt

SEQ ID NO: 1384695 - DNA, 18 bp, Homo sapiens
tcaaactcctgacctcag

SEQ ID NO: 1384696 - DNA, 19 bp, Homo sapiens
tcaaagcaagcattcagaa

SEQ ID NO: 1384697 - DNA, 19 bp, Homo sapiens
tcaaagtgttttctctgaa

SEQ ID NO: 1384698 - DNA, 16 bp, Homo sapiens
tcaaataactaaggaa

SEQ ID NO: 1384699 - DNA, 14 bp, Homo sapiens
tcaaattcttctga

SEQ ID NO: 1384700 - DNA, 15 bp, Homo sapiens
tcaaattcttctgaa

SEQ ID NO: 1384701 - DNA, 14 bp, Homo sapiens
tcaacagttttcct

SEQ ID NO: 1384702 - DNA, 16 bp, Homo sapiens
tcaaccatcgctttat

SEQ ID NO: 1384703 - DNA, 18 bp, Homo sapiens
tcaaccccagacactggt

SEQ ID NO: 1384704 - DNA, 20 bp, Homo sapiens
tcaactctcttattgcctca

SEQ ID NO: 1384705 - DNA, 19 bp, Homo sapiens
tcaacttattaacaattag

SEQ ID NO: 1384706 - DNA, 16 bp, Homo sapiens
gggagggtaggcagga

SEQ ID NO: 1384707 - DNA, 23 bp, Homo sapiens
gggaggtgcttctagttctgcca

SEQ ID NO: 1384708 - DNA, 20 bp, Homo sapiens
gggatgactaaaatatttat

SEQ ID NO: 1384709 - DNA, 20 bp, Homo sapiens
gggattacaggcgtgagcca

SEQ ID NO: 1384710 - DNA, 17 bp, Homo sapiens
gggcagtctgagagagg

SEQ ID NO: 1384711 - DNA, 18 bp, Homo sapiens
gggcagtctgagagaggc

SEQ ID NO: 1384712 - DNA, 19 bp, Homo sapiens
gggcagtctgagagaggcc

SEQ ID NO: 1384713 - DNA, 15 bp, Homo sapiens
gggccaggctgggtc

SEQ ID NO: 1384714 - DNA, 11 bp, Homo sapiens
gggcccggacg

SEQ ID NO: 1384715 - DNA, 22 bp, Homo sapiens
gggccctggtggtggctcggga

SEQ ID NO: 1384716 - DNA, 12 bp, Homo sapiens
gggcctgggcag

SEQ ID NO: 1384717 - DNA, 15 bp, Homo sapiens
gggcctgggcaggag

SEQ ID NO: 1384718 - DNA, 16 bp, Homo sapiens
gggcctgggcaggagg

SEQ ID NO: 1384719 - DNA, 12 bp, Homo sapiens
gggcgcaggccg

SEQ ID NO: 1384720 - DNA, 14 bp, Homo sapiens
gggcgggggtggcg

SEQ ID NO: 1384721 - DNA, 18 bp, Homo sapiens
gggctccgtgtgggagac

SEQ ID NO: 1384722 - DNA, 17 bp, Homo sapiens
gggcttcaggtccaggc

SEQ ID NO: 1384723 - DNA, 13 bp, Homo sapiens
ggggaccaggagt

SEQ ID NO: 1384724 - DNA, 18 bp, Homo sapiens
ggggagtttagggtgggg

SEQ ID NO: 1384725 - DNA, 17 bp, Homo sapiens
ggggccgggggcagtct

SEQ ID NO: 1384726 - DNA, 15 bp, Homo sapiens
ggggcctgggcagga

SEQ ID NO: 1384727 - DNA, 15 bp, Homo sapiens
gggggagagggctgc

SEQ ID NO: 1384728 - DNA, 13 bp, Homo sapiens
ggggtggccaggc

SEQ ID NO: 1384729 - DNA, 16 bp, Homo sapiens
gggtagcgggggaggg

SEQ ID NO: 1384730 - DNA, 13 bp, Homo sapiens
gggtaggcaggat

SEQ ID NO: 1384731 - DNA, 12 bp, Homo sapiens
gggtccaggagg

SEQ ID NO: 1384732 - DNA, 15 bp, Homo sapiens
gggtcgccctggact

SEQ ID NO: 1384733 - DNA, 18 bp, Homo sapiens
gggtgctgggcccctgcc

SEQ ID NO: 1384734 - DNA, 19 bp, Homo sapiens
gggtgctgggcccctgcct

SEQ ID NO: 1384735 - DNA, 13 bp, Homo sapiens
gggtggggagaga

SEQ ID NO: 1384736 - DNA, 16 bp, Homo sapiens
ggaaattctgctcaga

SEQ ID NO: 1384737 - DNA, 17 bp, Homo sapiens
ggaactcgtgtctggca

SEQ ID NO: 1384738 - DNA, 18 bp, Homo sapiens
ggaagacgcaagggcctg

SEQ ID NO: 1384739 - DNA, 21 bp, Homo sapiens
ggaagagagcctgcaggatct

SEQ ID NO: 1384740 - DNA, 16 bp, Homo sapiens
ggaagccagctttccc

SEQ ID NO: 1384741 - DNA, 21 bp, Homo sapiens
ggaagctttggtgagaacctg

SEQ ID NO: 1384742 - DNA, 11 bp, Homo sapiens
ggaataagtgt

SEQ ID NO: 1384743 - DNA, 14 bp, Homo sapiens
ggaatatatatgga

SEQ ID NO: 1384744 - DNA, 17 bp, Homo sapiens
ggaattgattcaagatt

SEQ ID NO: 1384745 - DNA, 19 bp, Homo sapiens
ggaattttcatctaggatt

SEQ ID NO: 1384746 - DNA, 11 bp, Homo sapiens
ggacacactgt

SEQ ID NO: 1384747 - DNA, 16 bp, Homo sapiens
ggacacctaggctagg

SEQ ID NO: 1384748 - DNA, 20 bp, Homo sapiens
ggacaggatgtgtttgcttt

SEQ ID NO: 1384749 - DNA, 20 bp, Homo sapiens
ggacaggtcctcagtgtcct

SEQ ID NO: 1384750 - DNA, 17 bp, Homo sapiens
ggacgcccaggacccca

SEQ ID NO: 1384751 - DNA, 18 bp, Homo sapiens
ggactcaagccccggact

SEQ ID NO: 1384752 - DNA, 20 bp, Homo sapiens
ggactcaggtggccctactg

SEQ ID NO: 1384753 - DNA, 18 bp, Homo sapiens
ggactctgccccttctgt

SEQ ID NO: 1384754 - DNA, 21 bp, Homo sapiens
ggactctgccccttctgtttc

SEQ ID NO: 1384755 - DNA, 16 bp, Homo sapiens
ggacttgtgtctctgt

SEQ ID NO: 1384756 - DNA, 19 bp, Homo sapiens
ggagacaggttagctgctc

SEQ ID NO: 1384757 - DNA, 13 bp, Homo sapiens
ggagagggcgcag

SEQ ID NO: 1384758 - DNA, 21 bp, Homo sapiens
ggagcaggaggccaataaaaa

SEQ ID NO: 1384759 - DNA, 13 bp, Homo sapiens
ggagccctgggag

SEQ ID NO: 1384760 - DNA, 16 bp, Homo sapiens
ggagccctgggaggct

SEQ ID NO: 1384761 - DNA, 16 bp, Homo sapiens
ggagccgggagcctga

SEQ ID NO: 1384762 - DNA, 15 bp, Homo sapiens
ggaggacccagggct

SEQ ID NO: 1384763 - DNA, 18 bp, Homo sapiens
ggaggacccagggctctg

SEQ ID NO: 1384764 - DNA, 13 bp, Homo sapiens
ggaggagaatgag

SEQ ID NO: 1384765 - DNA, 16 bp, Homo sapiens
ggaggcatcagtgtcc

SEQ ID NO: 1384766 - DNA, 19 bp, Homo sapiens
ggaggccaataaaaagttc

SEQ ID NO: 1384767 - DNA, 15 bp, Homo sapiens
ggaggctctggagcc

SEQ ID NO: 1384768 - DNA, 17 bp, Homo sapiens
ggaggctctggagccca

SEQ ID NO: 1384769 - DNA, 13 bp, Homo sapiens
ggagggcaggcat

SEQ ID NO: 1384770 - DNA, 14 bp, Homo sapiens
ggagggcaggcatc

SEQ ID NO: 1384771 - DNA, 14 bp, Homo sapiens
ggagggggagaggg

SEQ ID NO: 1384772 - DNA, 13 bp, Homo sapiens
ggagggtaggcag

SEQ ID NO: 1384773 - DNA, 15 bp, Homo sapiens
ggagtcactgagacc

SEQ ID NO: 1384774 - DNA, 19 bp, Homo sapiens
ggagtgttctgtttcccat

SEQ ID NO: 1384775 - DNA, 18 bp, Homo sapiens
ggatacttatatggaaat

SEQ ID NO: 1384776 - DNA, 15 bp, Homo sapiens
ggatctcaccaggca

SEQ ID NO: 1384777 - DNA, 17 bp, Homo sapiens
ggatctcaccaggcagc

SEQ ID NO: 1384778 - DNA, 18 bp, Homo sapiens
ggattccccatctcaggc

SEQ ID NO: 1384779 - DNA, 14 bp, Homo sapiens
ggcaacatctttat

SEQ ID NO: 1384780 - DNA, 16 bp, Homo sapiens
ggcaacgcacaaaaca

SEQ ID NO: 1384781 - DNA, 15 bp, Homo sapiens
ggcaatgatggcaat

SEQ ID NO: 1384782 - DNA, 14 bp, Homo sapiens
ggcaattttgtaac

SEQ ID NO: 1384783 - DNA, 22 bp, Homo sapiens
ggcagactctttatgcttgcaa

SEQ ID NO: 1384784 - DNA, 17 bp, Homo sapiens
ggcagcccctcccagcc

SEQ ID NO: 1384785 - DNA, 19 bp, Homo sapiens
ggcagcctctggggggtgg

SEQ ID NO: 1384786 - DNA, 22 bp, Homo sapiens
ggcaggattggggaagagagcc

SEQ ID NO: 1384787 - DNA, 14 bp, Homo sapiens
ggcagtaataaaaa

SEQ ID NO: 1384788 - DNA, 19 bp, Homo sapiens
ggcagtctgaatttttaaa

SEQ ID NO: 1384789 - DNA, 16 bp, Homo sapiens
ggcagtgcagcaacca

SEQ ID NO: 1384790 - DNA, 13 bp, Homo sapiens
ggcagtgggaaaa

SEQ ID NO: 1384791 - DNA, 22 bp, Homo sapiens
ggcatccagagtccctgcctgg

SEQ ID NO: 1384792 - DNA, 17 bp, Homo sapiens
ggcatcctctttttcca

SEQ ID NO: 1384793 - DNA, 22 bp, Homo sapiens
ggcatcggggagccgggagcct

SEQ ID NO: 1384794 - DNA, 17 bp, Homo sapiens
ggccaaagaaccaaaga

SEQ ID NO: 1384795 - DNA, 14 bp, Homo sapiens
ggccaataaaaagt

SEQ ID NO: 1384796 - DNA, 16 bp, Homo sapiens
ggccaataaaaagttc

SEQ ID NO: 1384797 - DNA, 14 bp, Homo sapiens
ggccagagccaagg

SEQ ID NO: 1384798 - DNA, 23 bp, Homo sapiens
ggccagatgcacatccctggaag

SEQ ID NO: 1384799 - DNA, 18 bp, Homo sapiens
ggccaggctgggtcgccc

SEQ ID NO: 1384800 - DNA, 13 bp, Homo sapiens
ggccccctccctg

SEQ ID NO: 1384801 - DNA, 17 bp, Homo sapiens
ggccccctccctggatg

SEQ ID NO: 1384802 - DNA, 13 bp, Homo sapiens
ggcccctgcctct

SEQ ID NO: 1384803 - DNA, 17 bp, Homo sapiens
ggcccctgcctctctgc

SEQ ID NO: 1384804 - DNA, 20 bp, Homo sapiens
ggcccttatgactgccaaga

SEQ ID NO: 1384805 - DNA, 16 bp, Homo sapiens
ggccgtgacgtctggg

SEQ ID NO: 1384806 - DNA, 20 bp, Homo sapiens
ggccgtgacgtctgggtggc

SEQ ID NO: 1384807 - DNA, 23 bp, Homo sapiens
ggcctcaaagcaagcattcagaa

SEQ ID NO: 1384808 - DNA, 19 bp, Homo sapiens
ggcctcttccgtgacgtca

SEQ ID NO: 1384809 - DNA, 19 bp, Homo sapiens
ggcctgatggggtggaagg

SEQ ID NO: 1384810 - DNA, 17 bp, Homo sapiens
ggcctgcccagtgcact

SEQ ID NO: 1384811 - DNA, 18 bp, Homo sapiens
ggccttgcggctcctcag

SEQ ID NO: 1384812 - DNA, 16 bp, Homo sapiens
ggcctttgagctcaga

SEQ ID NO: 1384813 - DNA, 16 bp, Homo sapiens
ggctagggtggggaga

SEQ ID NO: 1384814 - DNA, 20 bp, Homo sapiens
ggctcagagggtgtcctgca

SEQ ID NO: 1384815 - DNA, 17 bp, Homo sapiens
ggctcccagggacacct

SEQ ID NO: 1384816 - DNA, 14 bp, Homo sapiens
ggctccgtgtggga

SEQ ID NO: 1384817 - DNA, 17 bp, Homo sapiens
ggctccgtgtgggagac

SEQ ID NO: 1384818 - DNA, 15 bp, Homo sapiens
ggctgagatatgaac

SEQ ID NO: 1384819 - DNA, 14 bp, Homo sapiens
ggctgggtcgccct

SEQ ID NO: 1384820 - DNA, 17 bp, Homo sapiens
ggctgggtcgccctgga

SEQ ID NO: 1384821 - DNA, 20 bp, Homo sapiens
ggctgggtcgccctggactg

SEQ ID NO: 1384822 - DNA, 18 bp, Homo sapiens
ggcttctggccaggaagc

SEQ ID NO: 1384823 - DNA, 22 bp, Homo sapiens
gggaatatgagtgcgtggtgcg

SEQ ID NO: 1384824 - DNA, 22 bp, Homo sapiens
gggacacctaggctagggtggg

SEQ ID NO: 1384825 - DNA, 16 bp, Homo sapiens
gggacatgtatgtggc

SEQ ID NO: 1384826 - DNA, 23 bp, Homo sapiens
gggaccaggagtgggtggggagt

SEQ ID NO: 1384827 - DNA, 21 bp, Homo sapiens
gggagaccggcctgccaggag

SEQ ID NO: 1384828 - DNA, 22 bp, Homo sapiens
gggagaccggcctgccaggagg

SEQ ID NO: 1384829 - DNA, 20 bp, Homo sapiens
gggagagggcgcaggccgtg

SEQ ID NO: 1384830 - DNA, 12 bp, Homo sapiens
gggagctcagga

SEQ ID NO: 1384831 - DNA, 22 bp, Homo sapiens
gggagctcaggaaccgaggcag

SEQ ID NO: 1384832 - DNA, 15 bp, Homo sapiens
gggagggtaccagca

SEQ ID NO: 1384833 - DNA, 15 bp, Homo sapiens
gccatttgctttttc

SEQ ID NO: 1384834 - DNA, 14 bp, Homo sapiens
gcccaatgaaatga

SEQ ID NO: 1384835 - DNA, 20 bp, Homo sapiens
gcccactgtacttgctcttg

SEQ ID NO: 1384836 - DNA, 22 bp, Homo sapiens
gcccactgtacttgctcttgat

SEQ ID NO: 1384837 - DNA, 13 bp, Homo sapiens
gcccaggacccca

SEQ ID NO: 1384838 - DNA, 23 bp, Homo sapiens
gcccatcatacgcatggtcctgg

SEQ ID NO: 1384839 - DNA, 22 bp, Homo sapiens
gcccccaaccatttcctcagac

SEQ ID NO: 1384840 - DNA, 14 bp, Homo sapiens
gccccctccctgga

SEQ ID NO: 1384841 - DNA, 15 bp, Homo sapiens
gccccctccctggat

SEQ ID NO: 1384842 - DNA, 21 bp, Homo sapiens
gcccctagcgctatctccctg

SEQ ID NO: 1384843 - DNA, 16 bp, Homo sapiens
gcccctgcctctctgc

SEQ ID NO: 1384844 - DNA, 16 bp, Homo sapiens
gccctagccctcagcc

SEQ ID NO: 1384845 - DNA, 22 bp, Homo sapiens
gccctggactgtgtgctcagga

SEQ ID NO: 1384846 - DNA, 16 bp, Homo sapiens
gccctgggaggctctg

SEQ ID NO: 1384847 - DNA, 15 bp, Homo sapiens
gccctggtttgaaat

SEQ ID NO: 1384848 - DNA, 13 bp, Homo sapiens
gccggctccttgg

SEQ ID NO: 1384849 - DNA, 14 bp, Homo sapiens
gccgggagcctgac

SEQ ID NO: 1384850 - DNA, 19 bp, Homo sapiens
gccgggagcctgaccctca

SEQ ID NO: 1384851 - DNA, 18 bp, Homo sapiens
gccgtgacgtctgggtgg

SEQ ID NO: 1384852 - DNA, 22 bp, Homo sapiens
gcctcaaagcaagcattcagaa

SEQ ID NO: 1384853 - DNA, 12 bp, Homo sapiens
gcctcccatgcc

SEQ ID NO: 1384854 - DNA, 14 bp, Homo sapiens
gcctccctcctcgt

SEQ ID NO: 1384855 - DNA, 14 bp, Homo sapiens
gcctcctcaccccc

SEQ ID NO: 1384856 - DNA, 16 bp, Homo sapiens
gcctcctcacccccag

SEQ ID NO: 1384857 - DNA, 21 bp, Homo sapiens
gcctcctcacccccagctttg

SEQ ID NO: 1384858 - DNA, 19 bp, Homo sapiens
gcctctcatcaactgaatg

SEQ ID NO: 1384859 - DNA, 24 bp, Homo sapiens
gcctctccactcatgtgactcttt

SEQ ID NO: 1384860 - DNA, 10 bp, Homo sapiens
gcctctctgc

SEQ ID NO: 1384861 - DNA, 23 bp, Homo sapiens
gcctctctgcaggtccctaataa

SEQ ID NO: 1384862 - DNA, 17 bp, Homo sapiens
gcctctggggggtggcc

SEQ ID NO: 1384863 - DNA, 20 bp, Homo sapiens
gcctctggggggtggccagg

SEQ ID NO: 1384864 - DNA, 23 bp, Homo sapiens
gcctctggggggtggccaggccg

SEQ ID NO: 1384865 - DNA, 18 bp, Homo sapiens
gcctctgtcttctggact

SEQ ID NO: 1384866 - DNA, 19 bp, Homo sapiens
gcctctgtcttctggactg

SEQ ID NO: 1384867 - DNA, 21 bp, Homo sapiens
gcctcttccagtcttcctgac

SEQ ID NO: 1384868 - DNA, 19 bp, Homo sapiens
gcctgactagggagccatg

SEQ ID NO: 1384869 - DNA, 11 bp, Homo sapiens
gcctgccagga

SEQ ID NO: 1384870 - DNA, 18 bp, Homo sapiens
gcctgccaggaggaccca

SEQ ID NO: 1384871 - DNA, 20 bp, Homo sapiens
gcctgccaggaggacccagg

SEQ ID NO: 1384872 - DNA, 21 bp, Homo sapiens
gcctgccaggaggacccaggg

SEQ ID NO: 1384873 - DNA, 16 bp, Homo sapiens
gcctggaccagcctct

SEQ ID NO: 1384874 - DNA, 17 bp, Homo sapiens
gcctggaccagcctctc

SEQ ID NO: 1384875 - DNA, 16 bp, Homo sapiens
gcctggctccgtccag

SEQ ID NO: 1384876 - DNA, 21 bp, Homo sapiens
gcctgtagccccagtgacagc

SEQ ID NO: 1384877 - DNA, 19 bp, Homo sapiens
gccttcctgtttttcacat

SEQ ID NO: 1384878 - DNA, 18 bp, Homo sapiens
gccttgcggctcctcagg

SEQ ID NO: 1384879 - DNA, 15 bp, Homo sapiens
gccttgtcacgccag

SEQ ID NO: 1384880 - DNA, 17 bp, Homo sapiens
gccttgtcacgccagac

SEQ ID NO: 1384881 - DNA, 14 bp, Homo sapiens
gcctttgagctcag

SEQ ID NO: 1384882 - DNA, 12 bp, Homo sapiens
gcgcggctggga

SEQ ID NO: 1384883 - DNA, 14 bp, Homo sapiens
gcggctcctcaggg

SEQ ID NO: 1384884 - DNA, 14 bp, Homo sapiens
gcggctgggaggag

SEQ ID NO: 1384885 - DNA, 13 bp, Homo sapiens
gcgtggtgcgagt

SEQ ID NO: 1384886 - DNA, 17 bp, Homo sapiens
gcgtggtggtccctggg

SEQ ID NO: 1384887 - DNA, 18 bp, Homo sapiens
gcgtggtggtccctgggt

SEQ ID NO: 1384888 - DNA, 12 bp, Homo sapiens
gctaaaagaaac

SEQ ID NO: 1384889 - DNA, 15 bp, Homo sapiens
gctaaaagaaacttt

SEQ ID NO: 1384890 - DNA, 16 bp, Homo sapiens
gctaaaagaaactttc

SEQ ID NO: 1384891 - DNA, 13 bp, Homo sapiens
gctaagagaagta

SEQ ID NO: 1384892 - DNA, 19 bp, Homo sapiens
gctaagctaggaatgaaat

SEQ ID NO: 1384893 - DNA, 20 bp, Homo sapiens
gctactctagtattccagac

SEQ ID NO: 1384894 - DNA, 13 bp, Homo sapiens
gctaggaatgaaa

SEQ ID NO: 1384895 - DNA, 18 bp, Homo sapiens
gctaggaatgaaatcctg

SEQ ID NO: 1384896 - DNA, 17 bp, Homo sapiens
gctagggtggggagaga

SEQ ID NO: 1384897 - DNA, 16 bp, Homo sapiens
gctatctctgtgtgca

SEQ ID NO: 1384898 - DNA, 23 bp, Homo sapiens
gctcaactctcttattgcctcac

SEQ ID NO: 1384899 - DNA, 17 bp, Homo sapiens
gctcagaaaatatccct

SEQ ID NO: 1384900 - DNA, 18 bp, Homo sapiens
gctcagaagtttcttctt

SEQ ID NO: 1384901 - DNA, 19 bp, Homo sapiens
gctcagagggtgtcctgca

SEQ ID NO: 1384902 - DNA, 19 bp, Homo sapiens
gctcagatagaatgacagt

SEQ ID NO: 1384903 - DNA, 11 bp, Homo sapiens
gctcagcccta

SEQ ID NO: 1384904 - DNA, 21 bp, Homo sapiens
gctcaggagccctgggaggct

SEQ ID NO: 1384905 - DNA, 22 bp, Homo sapiens
gctcaggagccctgggaggctc

SEQ ID NO: 1384906 - DNA, 13 bp, Homo sapiens
gctcccacagaac

SEQ ID NO: 1384907 - DNA, 19 bp, Homo sapiens
gctcccacagaacacagca

SEQ ID NO: 1384908 - DNA, 22 bp, Homo sapiens
gctcctcaacccctcccctcca

SEQ ID NO: 1384909 - DNA, 19 bp, Homo sapiens
gctcctcagggactcaggt

SEQ ID NO: 1384910 - DNA, 13 bp, Homo sapiens
gctcctgtttcca

SEQ ID NO: 1384911 - DNA, 12 bp, Homo sapiens
gctctaatacat

SEQ ID NO: 1384912 - DNA, 17 bp, Homo sapiens
gctctgaaagagaaaca

SEQ ID NO: 1384913 - DNA, 17 bp, Homo sapiens
gctctggagcccactgt

SEQ ID NO: 1384914 - DNA, 23 bp, Homo sapiens
gctctgtaagtagatgcatttgg

SEQ ID NO: 1384915 - DNA, 14 bp, Homo sapiens
gctcttgatgcctg

SEQ ID NO: 1384916 - DNA, 15 bp, Homo sapiens
gctgaaattttatat

SEQ ID NO: 1384917 - DNA, 17 bp, Homo sapiens
gctgaaattttatatgc

SEQ ID NO: 1384918 - DNA, 12 bp, Homo sapiens
gctgaccagaca

SEQ ID NO: 1384919 - DNA, 14 bp, Homo sapiens
gctgagctctctgt

SEQ ID NO: 1384920 - DNA, 17 bp, Homo sapiens
gctgcaggaatctttaa

SEQ ID NO: 1384921 - DNA, 23 bp, Homo sapiens
gctgcggcagcccctcccagcct

SEQ ID NO: 1384922 - DNA, 15 bp, Homo sapiens
gagttggaatcactg

SEQ ID NO: 1384923 - DNA, 16 bp, Homo sapiens
gagttggacacactgt

SEQ ID NO: 1384924 - DNA, 14 bp, Homo sapiens
gagtttagggtggg

SEQ ID NO: 1384925 - DNA, 16 bp, Homo sapiens
gagttttttgtaccaa

SEQ ID NO: 1384926 - DNA, 14 bp, Homo sapiens
gataagatctttta

SEQ ID NO: 1384927 - DNA, 20 bp, Homo sapiens
gataagatcttttattttgc

SEQ ID NO: 1384928 - DNA, 13 bp, Homo sapiens
gataaggaaatca

SEQ ID NO: 1384929 - DNA, 17 bp, Homo sapiens
gataaggtaaaatgcca

SEQ ID NO: 1384930 - DNA, 13 bp, Homo sapiens
gataagttattta

SEQ ID NO: 1384931 - DNA, 20 bp, Homo sapiens
gataatatgtttgaggttaa

SEQ ID NO: 1384932 - DNA, 15 bp, Homo sapiens
gataatctaaatata

SEQ ID NO: 1384933 - DNA, 18 bp, Homo sapiens
gataattttaaattctct

SEQ ID NO: 1384934 - DNA, 13 bp, Homo sapiens
gatacccagtccc

SEQ ID NO: 1384935 - DNA, 17 bp, Homo sapiens
gatacgacagtacactg

SEQ ID NO: 1384936 - DNA, 19 bp, Homo sapiens
gatagaaatgccaagcact

SEQ ID NO: 1384937 - DNA, 23 bp, Homo sapiens
gatagagactggaacactagaca

SEQ ID NO: 1384938 - DNA, 22 bp, Homo sapiens
gatagattttctgctactttgc

SEQ ID NO: 1384939 - DNA, 21 bp, Homo sapiens
gatatagttttacttttaaac

SEQ ID NO: 1384940 - DNA, 14 bp, Homo sapiens
gatatattttacaa

SEQ ID NO: 1384941 - DNA, 18 bp, Homo sapiens
gatatgtaaaacatttat

SEQ ID NO: 1384942 - DNA, 22 bp, Homo sapiens
gatatgtgccaaagtccattta

SEQ ID NO: 1384943 - DNA, 15 bp, Homo sapiens
gatatttatatgtta

SEQ ID NO: 1384944 - DNA, 20 bp, Homo sapiens
gatatttatatgttattaaa

SEQ ID NO: 1384945 - DNA, 14 bp, Homo sapiens
gatattttctctag

SEQ ID NO: 1384946 - DNA, 23 bp, Homo sapiens
gatcagtgggcctccaaggaggg

SEQ ID NO: 1384947 - DNA, 19 bp, Homo sapiens
gatccaactaatgccttac

SEQ ID NO: 1384948 - DNA, 20 bp, Homo sapiens
gatccaactaatgccttact

SEQ ID NO: 1384949 - DNA, 12 bp, Homo sapiens
gatcccaacact

SEQ ID NO: 1384950 - DNA, 21 bp, Homo sapiens
gatcccaagtagaatctcagt

SEQ ID NO: 1384951 - DNA, 17 bp, Homo sapiens
gatcccatgagctcctt

SEQ ID NO: 1384952 - DNA, 15 bp, Homo sapiens
gatccctagctgtga

SEQ ID NO: 1384953 - DNA, 18 bp, Homo sapiens
gatcctatcctcctacct

SEQ ID NO: 1384954 - DNA, 16 bp, Homo sapiens
gatcgttcaaagcatg

SEQ ID NO: 1384955 - DNA, 15 bp, Homo sapiens
gatctcaccaggcag

SEQ ID NO: 1384956 - DNA, 15 bp, Homo sapiens
gatcttttattttgc

SEQ ID NO: 1384957 - DNA, 15 bp, Homo sapiens
gatgaaaataaagaa

SEQ ID NO: 1384958 - DNA, 16 bp, Homo sapiens
gatgaaaataaagaat

SEQ ID NO: 1384959 - DNA, 14 bp, Homo sapiens
gatgcagctcaaga

SEQ ID NO: 1384960 - DNA, 22 bp, Homo sapiens
gatgcatttgggtccaggagga

SEQ ID NO: 1384961 - DNA, 21 bp, Homo sapiens
gatgcctggcggggtggggtg

SEQ ID NO: 1384962 - DNA, 14 bp, Homo sapiens
gatgcttttaacag

SEQ ID NO: 1384963 - DNA, 13 bp, Homo sapiens
gatgggattctgg

SEQ ID NO: 1384964 - DNA, 14 bp, Homo sapiens
gatgtgtttgcttt

SEQ ID NO: 1384965 - DNA, 16 bp, Homo sapiens
gatgtgtttgctttct

SEQ ID NO: 1384966 - DNA, 20 bp, Homo sapiens
gattaagatacactcctgct

SEQ ID NO: 1384967 - DNA, 15 bp, Homo sapiens
gattcacatctcatt

SEQ ID NO: 1384968 - DNA, 16 bp, Homo sapiens
gattcacatctcattt

SEQ ID NO: 1384969 - DNA, 19 bp, Homo sapiens
gattcattttaacatctga

SEQ ID NO: 1384970 - DNA, 19 bp, Homo sapiens
gattcccagagcaaaataa

SEQ ID NO: 1384971 - DNA, 17 bp, Homo sapiens
gattccccatctcaggc

SEQ ID NO: 1384972 - DNA, 16 bp, Homo sapiens
gattcgaatgacactg

SEQ ID NO: 1384973 - DNA, 17 bp, Homo sapiens
gattcgaatgacactgt

SEQ ID NO: 1384974 - DNA, 14 bp, Homo sapiens
gattctcttgcctc

SEQ ID NO: 1384975 - DNA, 15 bp, Homo sapiens
gattctcttgcctca

SEQ ID NO: 1384976 - DNA, 21 bp, Homo sapiens
gattgaagtattttgctggaa

SEQ ID NO: 1384977 - DNA, 21 bp, Homo sapiens
gatttattaatatatattatc

SEQ ID NO: 1384978 - DNA, 12 bp, Homo sapiens
gatttatttaaa

SEQ ID NO: 1384979 - DNA, 20 bp, Homo sapiens
gatttcatgctatctctgtg

SEQ ID NO: 1384980 - DNA, 18 bp, Homo sapiens
gatttctaggtaggaaat

SEQ ID NO: 1384981 - DNA, 18 bp, Homo sapiens
gattttcaaagctttttc

SEQ ID NO: 1384982 - DNA, 20 bp, Homo sapiens
gattttctgctactttgctg

SEQ ID NO: 1384983 - DNA, 23 bp, Homo sapiens
gattttgaacctgatgaaaataa

SEQ ID NO: 1384984 - DNA, 19 bp, Homo sapiens
gcaaaagaatggcagaaaa

SEQ ID NO: 1384985 - DNA, 15 bp, Homo sapiens
gcaaaataattttaa

SEQ ID NO: 1384986 - DNA, 15 bp, Homo sapiens
gcaaccagagcactg

SEQ ID NO: 1384987 - DNA, 17 bp, Homo sapiens
gcaaccagagcactgta

SEQ ID NO: 1384988 - DNA, 16 bp, Homo sapiens
gcaagaaggcaaaaat

SEQ ID NO: 1384989 - DNA, 23 bp, Homo sapiens
gcaagaaggcaaaaatagtttgg

SEQ ID NO: 1384990 - DNA, 17 bp, Homo sapiens
gcaagcattcagaagaa

SEQ ID NO: 1384991 - DNA, 13 bp, Homo sapiens
gcaatgtaaatat

SEQ ID NO: 1384992 - DNA, 23 bp, Homo sapiens
gcaatgtaaatattttaaagaat

SEQ ID NO: 1384993 - DNA, 18 bp, Homo sapiens
gcaatttccttttttgtt

SEQ ID NO: 1384994 - DNA, 14 bp, Homo sapiens
gcaattttgtaacg

SEQ ID NO: 1384995 - DNA, 15 bp, Homo sapiens
gcaatttttttatac

SEQ ID NO: 1384996 - DNA, 17 bp, Homo sapiens
gcacaagttatttaaat

SEQ ID NO: 1384997 - DNA, 17 bp, Homo sapiens
gcacaataaaaatgttt

SEQ ID NO: 1384998 - DNA, 18 bp, Homo sapiens
gcacacaaacacctccta

SEQ ID NO: 1384999 - DNA, 16 bp, Homo sapiens
gcacaggctaattttt

SEQ ID NO: 1385000 - DNA, 13 bp, Homo sapiens
gcacatccctgga

SEQ ID NO: 1385001 - DNA, 15 bp, Homo sapiens
gcaccaaaagaagta

SEQ ID NO: 1385002 - DNA, 19 bp, Homo sapiens
gcaccaccatgccaggcta

SEQ ID NO: 1385003 - DNA, 20 bp, Homo sapiens
gcaccatctctgattttcaa

SEQ ID NO: 1385004 - DNA, 13 bp, Homo sapiens
gcacctttctagt

SEQ ID NO: 1385005 - DNA, 20 bp, Homo sapiens
atctgcagggggtgtgtctg

SEQ ID NO: 1385006 - DNA, 16 bp, Homo sapiens
atctggcaacatcttt

SEQ ID NO: 1385007 - DNA, 12 bp, Homo sapiens
atctggcttctg

SEQ ID NO: 1385008 - DNA, 20 bp, Homo sapiens
atctggcttctggccaggaa

SEQ ID NO: 1385009 - DNA, 15 bp, Homo sapiens
atctgggaagctatt

SEQ ID NO: 1385010 - DNA, 22 bp, Homo sapiens
atctgtaaactgtgtattccaa

SEQ ID NO: 1385011 - DNA, 14 bp, Homo sapiens
atcttctgccttct

SEQ ID NO: 1385012 - DNA, 18 bp, Homo sapiens
atcttctgccttctcatg

SEQ ID NO: 1385013 - DNA, 17 bp, Homo sapiens
atcttcttatgcaattt

SEQ ID NO: 1385014 - DNA, 16 bp, Homo sapiens
atcttgactcactgca

SEQ ID NO: 1385015 - DNA, 20 bp, Homo sapiens
atcttggttgatgccaaaaa

SEQ ID NO: 1385016 - DNA, 14 bp, Homo sapiens
atgaaaaagaagaa

SEQ ID NO: 1385017 - DNA, 16 bp, Homo sapiens
atgaaaaagaagaatc

SEQ ID NO: 1385018 - DNA, 18 bp, Homo sapiens
atgaaaagctagaattga

SEQ ID NO: 1385019 - DNA, 16 bp, Homo sapiens
atgaattaaataaacc

SEQ ID NO: 1385020 - DNA, 18 bp, Homo sapiens
atgaattgggaacattat

SEQ ID NO: 1385021 - DNA, 20 bp, Homo sapiens
atgacagtccgtcaaaacag

SEQ ID NO: 1385022 - DNA, 14 bp, Homo sapiens
atgacatcacttgt

SEQ ID NO: 1385023 - DNA, 21 bp, Homo sapiens
atgactgccaagactgctgtg

SEQ ID NO: 1385024 - DNA, 19 bp, Homo sapiens
atgagaaagccttcttttg

SEQ ID NO: 1385025 - DNA, 11 bp, Homo sapiens
atgagaatcta

SEQ ID NO: 1385026 - DNA, 19 bp, Homo sapiens
atgagctccttaaggctct

SEQ ID NO: 1385027 - DNA, 15 bp, Homo sapiens
atgagggaaaagaaa

SEQ ID NO: 1385028 - DNA, 19 bp, Homo sapiens
atgagtgcgtggtgcgagt

SEQ ID NO: 1385029 - DNA, 15 bp, Homo sapiens
atgataatgaacaga

SEQ ID NO: 1385030 - DNA, 22 bp, Homo sapiens
atgatgcctctgtcttctggac

SEQ ID NO: 1385031 - DNA, 15 bp, Homo sapiens
atgatggagacttca

SEQ ID NO: 1385032 - DNA, 17 bp, Homo sapiens
atgatttttttttcata

SEQ ID NO: 1385033 - DNA, 18 bp, Homo sapiens
atgcaaatcaattactgg

SEQ ID NO: 1385034 - DNA, 19 bp, Homo sapiens
atgcacacaaacacctcct

SEQ ID NO: 1385035 - DNA, 20 bp, Homo sapiens
atgcacacaaacacctccta

SEQ ID NO: 1385036 - DNA, 14 bp, Homo sapiens
atgcacatccctgg

SEQ ID NO: 1385037 - DNA, 20 bp, Homo sapiens
atgcaccctcatacacagaa

SEQ ID NO: 1385038 - DNA, 16 bp, Homo sapiens
atgcacctaaagaaaa

SEQ ID NO: 1385039 - DNA, 19 bp, Homo sapiens
atgcagaatgttgattaca

SEQ ID NO: 1385040 - DNA, 20 bp, Homo sapiens
atgcatctgtttattctata

SEQ ID NO: 1385041 - DNA, 22 bp, Homo sapiens
atgcattataggatcatttgtt

SEQ ID NO: 1385042 - DNA, 15 bp, Homo sapiens
atgccaaaaacaaaa

SEQ ID NO: 1385043 - DNA, 17 bp, Homo sapiens
atgcccggctaattttt

SEQ ID NO: 1385044 - DNA, 16 bp, Homo sapiens
atgcccttctccttat

SEQ ID NO: 1385045 - DNA, 17 bp, Homo sapiens
atgcctccagctacaaa

SEQ ID NO: 1385046 - DNA, 15 bp, Homo sapiens
atgcctggtcccaag

SEQ ID NO: 1385047 - DNA, 15 bp, Homo sapiens
atgctaagagaagta

SEQ ID NO: 1385048 - DNA, 16 bp, Homo sapiens
atgctaagagaagtag

SEQ ID NO: 1385049 - DNA, 13 bp, Homo sapiens
atgctatctctgt

SEQ ID NO: 1385050 - DNA, 19 bp, Homo sapiens
atgcttgcaaaaactacaa

SEQ ID NO: 1385051 - DNA, 15 bp, Homo sapiens
atttatatgttatta

SEQ ID NO: 1385052 - DNA, 19 bp, Homo sapiens
atttatatgttattaaaca

SEQ ID NO: 1385053 - DNA, 22 bp, Homo sapiens
atttatattgataagatctttt

SEQ ID NO: 1385054 - DNA, 15 bp, Homo sapiens
atttatattgtaaat

SEQ ID NO: 1385055 - DNA, 21 bp, Homo sapiens
atttatattgtaaatattgtg

SEQ ID NO: 1385056 - DNA, 18 bp, Homo sapiens
atttatcctgaaatttca

SEQ ID NO: 1385057 - DNA, 22 bp, Homo sapiens
atttatctttacttttaaacag

SEQ ID NO: 1385058 - DNA, 17 bp, Homo sapiens
atttatgagctcttcat

SEQ ID NO: 1385059 - DNA, 18 bp, Homo sapiens
atttatgtgttttaataa

SEQ ID NO: 1385060 - DNA, 20 bp, Homo sapiens
atttattaatatatattatc

SEQ ID NO: 1385061 - DNA, 14 bp, Homo sapiens
atttatttaaacaa

SEQ ID NO: 1385062 - DNA, 12 bp, Homo sapiens
atttattttgac

SEQ ID NO: 1385063 - DNA, 14 bp, Homo sapiens
atttattttgacat

SEQ ID NO: 1385064 - DNA, 16 bp, Homo sapiens
atttcaagttccaagt

SEQ ID NO: 1385065 - DNA, 22 bp, Homo sapiens
atttcaagttccaagttgctaa

SEQ ID NO: 1385066 - DNA, 16 bp, Homo sapiens
atttcacctgtaaacc

SEQ ID NO: 1385067 - DNA, 14 bp, Homo sapiens
atttcaggattctc

SEQ ID NO: 1385068 - DNA, 19 bp, Homo sapiens
atttcctatttttggaaga

SEQ ID NO: 1385069 - DNA, 20 bp, Homo sapiens
atttcctccgtcacctcaga

SEQ ID NO: 1385070 - DNA, 17 bp, Homo sapiens
atttctaccatttcaga

SEQ ID NO: 1385071 - DNA, 14 bp, Homo sapiens
atttctactttgat

SEQ ID NO: 1385072 - DNA, 20 bp, Homo sapiens
atttctactttgataaagta

SEQ ID NO: 1385073 - DNA, 11 bp, Homo sapiens
atttctaggta

SEQ ID NO: 1385074 - DNA, 19 bp, Homo sapiens
atttctaggtaggaaatgt

SEQ ID NO: 1385075 - DNA, 20 bp, Homo sapiens
atttctaggtaggaaatgtg

SEQ ID NO: 1385076 - DNA, 18 bp, Homo sapiens
atttcttttttaaatgaa

SEQ ID NO: 1385077 - DNA, 20 bp, Homo sapiens
atttgaactttttattgatt

SEQ ID NO: 1385078 - DNA, 22 bp, Homo sapiens
atttgaggacaaccattccaga

SEQ ID NO: 1385079 - DNA, 16 bp, Homo sapiens
atttgcctaaatactt

SEQ ID NO: 1385080 - DNA, 11 bp, Homo sapiens
atttgcctgta

SEQ ID NO: 1385081 - DNA, 16 bp, Homo sapiens
atttgcctgtaacaag

SEQ ID NO: 1385082 - DNA, 18 bp, Homo sapiens
atttgctttttcaccaga

SEQ ID NO: 1385083 - DNA, 14 bp, Homo sapiens
atttggcatccctg

SEQ ID NO: 1385084 - DNA, 16 bp, Homo sapiens
atttggcatccctggg

SEQ ID NO: 1385085 - DNA, 14 bp, Homo sapiens
atttgggtccagga

SEQ ID NO: 1385086 - DNA, 17 bp, Homo sapiens
atttgtaatagatgttt

SEQ ID NO: 1385087 - DNA, 23 bp, Homo sapiens
atttgtactgaaaaatggtaatt

SEQ ID NO: 1385088 - DNA, 22 bp, Homo sapiens
atttgttgagagtgtgaccaaa

SEQ ID NO: 1385089 - DNA, 16 bp, Homo sapiens
atttgtttaaaaagta

SEQ ID NO: 1385090 - DNA, 14 bp, Homo sapiens
attttaaacacatt

SEQ ID NO: 1385091 - DNA, 13 bp, Homo sapiens
attttaaagaatt

SEQ ID NO: 1385092 - DNA, 16 bp, Homo sapiens
attttaaccagttatt

SEQ ID NO: 1385093 - DNA, 22 bp, Homo sapiens
attttaacctatgatattttct

SEQ ID NO: 1385094 - DNA, 17 bp, Homo sapiens
attttagccttctctgt

SEQ ID NO: 1385095 - DNA, 21 bp, Homo sapiens
attttagccttctctgttcat

SEQ ID NO: 1385096 - DNA, 16 bp, Homo sapiens
attttatggtgcatta

SEQ ID NO: 1385097 - DNA, 22 bp, Homo sapiens
attttcaagaaactgaggaatt

SEQ ID NO: 1385098 - DNA, 24 bp, Homo sapiens
attttcaagaataatcacgctttc

SEQ ID NO: 1385099 - DNA, 16 bp, Homo sapiens
attttctaagaaacat

SEQ ID NO: 1385100 - DNA, 17 bp, Homo sapiens
attttctaagaaacatt

SEQ ID NO: 1385101 - DNA, 16 bp, Homo sapiens
attttctttctgtaac

SEQ ID NO: 1385102 - DNA, 23 bp, Homo sapiens
attttctttgtgtagctttgctc

SEQ ID NO: 1385103 - DNA, 17 bp, Homo sapiens
attttgacataaagttg

SEQ ID NO: 1385104 - DNA, 19 bp, Homo sapiens
attttgccaagggcataaa

SEQ ID NO: 1385105 - DNA, 20 bp, Homo sapiens
attttgccaagggcataaat

SEQ ID NO: 1385106 - DNA, 17 bp, Homo sapiens
attttgtaaactcaaaa

SEQ ID NO: 1385107 - DNA, 19 bp, Homo sapiens
attttgtaacgaagacaca

SEQ ID NO: 1385108 - DNA, 16 bp, Homo sapiens
atttttaaaacccatt

SEQ ID NO: 1385109 - DNA, 14 bp, Homo sapiens
atttttaaacaagt

SEQ ID NO: 1385110 - DNA, 17 bp, Homo sapiens
atttttatgccacctga

SEQ ID NO: 1385111 - DNA, 21 bp, Homo sapiens
atttttatttttgctgagact

SEQ ID NO: 1385112 - DNA, 19 bp, Homo sapiens
atttttgatactaagcatt

SEQ ID NO: 1385113 - DNA, 23 bp, Homo sapiens
atttttggaagaggactccttaa

SEQ ID NO: 1385114 - DNA, 21 bp, Homo sapiens
atttttggggggagtaaagaa

SEQ ID NO: 1385115 - DNA, 19 bp, Homo sapiens
attttttaaaaaagcttaa

SEQ ID NO: 1385116 - DNA, 16 bp, Homo sapiens
attttttatcatgcat

SEQ ID NO: 1385117 - DNA, 17 bp, Homo sapiens
attttttttttaaaact

SEQ ID NO: 1385118 - DNA, 14 bp, Homo sapiens
caaaaaagaaaacc

SEQ ID NO: 1385119 - DNA, 18 bp, Homo sapiens
caaaaaattaaagcattt

SEQ ID NO: 1385120 - DNA, 14 bp, Homo sapiens
caaaacaatgttta

SEQ ID NO: 1385121 - DNA, 14 bp, Homo sapiens
caaaagaagaagtt

SEQ ID NO: 1385122 - DNA, 22 bp, Homo sapiens
caaaagattgctgaaattttat

SEQ ID NO: 1385123 - DNA, 16 bp, Homo sapiens
caaaagttacatgttt

SEQ ID NO: 1385124 - DNA, 21 bp, Homo sapiens
caaaataaaacctcagctagc

SEQ ID NO: 1385125 - DNA, 17 bp, Homo sapiens
caaaatatttgtacata

SEQ ID NO: 1385126 - DNA, 20 bp, Homo sapiens
caaaatccttgcttatgaca

SEQ ID NO: 1385127 - DNA, 17 bp, Homo sapiens
caaaatgttggtcattt

SEQ ID NO: 1385128 - DNA, 14 bp, Homo sapiens
caaacacctcccag

SEQ ID NO: 1385129 - DNA, 15 bp, Homo sapiens
caaacacctcccagg

SEQ ID NO: 1385130 - DNA, 14 bp, Homo sapiens
caaacaggctcaga

SEQ ID NO: 1385131 - DNA, 21 bp, Homo sapiens
caaacatatatatactattaa

SEQ ID NO: 1385132 - DNA, 13 bp, Homo sapiens
caaaccaggactc

SEQ ID NO: 1385133 - DNA, 20 bp, Homo sapiens
caaacctgacccctgctcag

SEQ ID NO: 1385134 - DNA, 13 bp, Homo sapiens
caaactcctgcct

SEQ ID NO: 1385135 - DNA, 17 bp, Homo sapiens
caaactgaggaatttca

SEQ ID NO: 1385136 - DNA, 17 bp, Homo sapiens
caaagaaccaaagaaga

SEQ ID NO: 1385137 - DNA, 18 bp, Homo sapiens
caaagagaatgcccttct

SEQ ID NO: 1385138 - DNA, 23 bp, Homo sapiens
caaagagaatgcccttctcctta

SEQ ID NO: 1385139 - DNA, 16 bp, Homo sapiens
caaagaggtatttatc

SEQ ID NO: 1385140 - DNA, 15 bp, Homo sapiens
caaagagttcaagaa

SEQ ID NO: 1385141 - DNA, 16 bp, Homo sapiens
caaagagttcaagaaa

SEQ ID NO: 1385142 - DNA, 18 bp, Homo sapiens
ataaagctgtgtggcagt

SEQ ID NO: 1385143 - DNA, 15 bp, Homo sapiens
ataaagtatcatcag

SEQ ID NO: 1385144 - DNA, 16 bp, Homo sapiens
ataaagttgataaaga

SEQ ID NO: 1385145 - DNA, 21 bp, Homo sapiens
ataaatatcctttaattgatc

SEQ ID NO: 1385146 - DNA, 14 bp, Homo sapiens
ataacaacttcata

SEQ ID NO: 1385147 - DNA, 16 bp, Homo sapiens
ataacaatgtgctctc

SEQ ID NO: 1385148 - DNA, 18 bp, Homo sapiens
ataacgtttaagccaaaa

SEQ ID NO: 1385149 - DNA, 20 bp, Homo sapiens
ataacgtttaagccaaaaca

SEQ ID NO: 1385150 - DNA, 17 bp, Homo sapiens
ataactaaggaatatat

SEQ ID NO: 1385151 - DNA, 21 bp, Homo sapiens
ataactgaaaattatttaaac

SEQ ID NO: 1385152 - DNA, 16 bp, Homo sapiens
ataagaactttgagct

SEQ ID NO: 1385153 - DNA, 15 bp, Homo sapiens
ataagaagaatgctt

SEQ ID NO: 1385154 - DNA, 16 bp, Homo sapiens
ataagcaagaaggcaa

SEQ ID NO: 1385155 - DNA, 20 bp, Homo sapiens
ataaggaaatcaacttgctt

SEQ ID NO: 1385156 - DNA, 18 bp, Homo sapiens
ataaggtaaaatgccatg

SEQ ID NO: 1385157 - DNA, 15 bp, Homo sapiens
ataatcttctgcctt

SEQ ID NO: 1385158 - DNA, 17 bp, Homo sapiens
ataatttaacagaagtt

SEQ ID NO: 1385159 - DNA, 17 bp, Homo sapiens
ataatttagtttcatat

SEQ ID NO: 1385160 - DNA, 15 bp, Homo sapiens
ataattttaaacaaa

SEQ ID NO: 1385161 - DNA, 14 bp, Homo sapiens
ataattttaaattc

SEQ ID NO: 1385162 - DNA, 12 bp, Homo sapiens
atacactcctgc

SEQ ID NO: 1385163 - DNA, 15 bp, Homo sapiens
atacactcctgctgt

SEQ ID NO: 1385164 - DNA, 16 bp, Homo sapiens
atacagcaacaattta

SEQ ID NO: 1385165 - DNA, 18 bp, Homo sapiens
ataccaaagcacatttta

SEQ ID NO: 1385166 - DNA, 21 bp, Homo sapiens
atactattaaaaaggtttaca

SEQ ID NO: 1385167 - DNA, 17 bp, Homo sapiens
atactcatttttcatga

SEQ ID NO: 1385168 - DNA, 18 bp, Homo sapiens
atactgctgagatacata

SEQ ID NO: 1385169 - DNA, 21 bp, Homo sapiens
atactgctgagatacatacag

SEQ ID NO: 1385170 - DNA, 19 bp, Homo sapiens
atacttatatggaaattct

SEQ ID NO: 1385171 - DNA, 16 bp, Homo sapiens
atacttctcatttttt

SEQ ID NO: 1385172 - DNA, 19 bp, Homo sapiens
atactttttaaatgtaaag

SEQ ID NO: 1385173 - DNA, 13 bp, Homo sapiens
atagaatgacagt

SEQ ID NO: 1385174 - DNA, 13 bp, Homo sapiens
atagacagaagaa

SEQ ID NO: 1385175 - DNA, 15 bp, Homo sapiens
atagcaaaagaagaa

SEQ ID NO: 1385176 - DNA, 14 bp, Homo sapiens
atagcaaagaattg

SEQ ID NO: 1385177 - DNA, 15 bp, Homo sapiens
atagcaaagaattga

SEQ ID NO: 1385178 - DNA, 14 bp, Homo sapiens
atagcacaggctaa

SEQ ID NO: 1385179 - DNA, 17 bp, Homo sapiens
atagcacaggctaattt

SEQ ID NO: 1385180 - DNA, 13 bp, Homo sapiens
atagcatgcatct

SEQ ID NO: 1385181 - DNA, 14 bp, Homo sapiens
atagccaaaaatag

SEQ ID NO: 1385182 - DNA, 20 bp, Homo sapiens
ataggtagaatgtaaagctt

SEQ ID NO: 1385183 - DNA, 13 bp, Homo sapiens
atagtaaatcacg

SEQ ID NO: 1385184 - DNA, 19 bp, Homo sapiens
atagtaaatcacgcttttt

SEQ ID NO: 1385185 - DNA, 15 bp, Homo sapiens
atagtaagcctccct

SEQ ID NO: 1385186 - DNA, 21 bp, Homo sapiens
atagtcagctgtaccaagccc

SEQ ID NO: 1385187 - DNA, 19 bp, Homo sapiens
atagtttggatatgtaaaa

SEQ ID NO: 1385188 - DNA, 23 bp, Homo sapiens
atagtttggatatgtaaaacatt

SEQ ID NO: 1385189 - DNA, 21 bp, Homo sapiens
atagttttacttttaaactgt

SEQ ID NO: 1385190 - DNA, 23 bp, Homo sapiens
atagttttacttttaaactgtgt

SEQ ID NO: 1385191 - DNA, 24 bp, Homo sapiens
atataaagtatcatcagtgtagaa

SEQ ID NO: 1385192 - DNA, 12 bp, Homo sapiens
atataaattaag

SEQ ID NO: 1385193 - DNA, 14 bp, Homo sapiens
atataatcattatt

SEQ ID NO: 1385194 - DNA, 17 bp, Homo sapiens
caagaataatcacgctt

SEQ ID NO: 1385195 - DNA, 20 bp, Homo sapiens
caagaataatcacgctttcc

SEQ ID NO: 1385196 - DNA, 23 bp, Homo sapiens
caagaataatcacgctttcctga

SEQ ID NO: 1385197 - DNA, 21 bp, Homo sapiens
caagacagtgagacagtctgg

SEQ ID NO: 1385198 - DNA, 22 bp, Homo sapiens
caagacagtgagacagtctgga

SEQ ID NO: 1385199 - DNA, 14 bp, Homo sapiens
caagacatgtctgt

SEQ ID NO: 1385200 - DNA, 22 bp, Homo sapiens
caagacctgttggttagctgga

SEQ ID NO: 1385201 - DNA, 19 bp, Homo sapiens
caagactgctgtggccagg

SEQ ID NO: 1385202 - DNA, 12 bp, Homo sapiens
caagagactgag

SEQ ID NO: 1385203 - DNA, 13 bp, Homo sapiens
caagagactgagt

SEQ ID NO: 1385204 - DNA, 14 bp, Homo sapiens
caagaggagatcca

SEQ ID NO: 1385205 - DNA, 22 bp, Homo sapiens
caagattgttcctgcttttccc

SEQ ID NO: 1385206 - DNA, 21 bp, Homo sapiens
caagcatggctattttatatt

SEQ ID NO: 1385207 - DNA, 14 bp, Homo sapiens
caagcattctgtct

SEQ ID NO: 1385208 - DNA, 15 bp, Homo sapiens
caagccagatttttt

SEQ ID NO: 1385209 - DNA, 14 bp, Homo sapiens
caagctgttttctt

SEQ ID NO: 1385210 - DNA, 20 bp, Homo sapiens
caagcttaatggctgataat

SEQ ID NO: 1385211 - DNA, 18 bp, Homo sapiens
caaggagtcactgagacc

SEQ ID NO: 1385212 - DNA, 17 bp, Homo sapiens
caaggatagaagtatac

SEQ ID NO: 1385213 - DNA, 16 bp, Homo sapiens
caaggcggtgcttgat

SEQ ID NO: 1385214 - DNA, 18 bp, Homo sapiens
caagggcataaattattg

SEQ ID NO: 1385215 - DNA, 18 bp, Homo sapiens
caagggtcaggcctttga

SEQ ID NO: 1385216 - DNA, 22 bp, Homo sapiens
caagtatttgttaatttagaaa

SEQ ID NO: 1385217 - DNA, 22 bp, Homo sapiens
caagtcatgatggagacttcag

SEQ ID NO: 1385218 - DNA, 22 bp, Homo sapiens
caagttgttccttaagtcagaa

SEQ ID NO: 1385219 - DNA, 17 bp, Homo sapiens
caataaaaatgtttaac

SEQ ID NO: 1385220 - DNA, 22 bp, Homo sapiens
caataaagcagcctcattctga

SEQ ID NO: 1385221 - DNA, 23 bp, Homo sapiens
caataacgtttaagccaaaacaa

SEQ ID NO: 1385222 - DNA, 15 bp, Homo sapiens
caatctgtaaactgt

SEQ ID NO: 1385223 - DNA, 17 bp, Homo sapiens
caatctgtaaactgtgt

SEQ ID NO: 1385224 - DNA, 18 bp, Homo sapiens
caatctgtaaactgtgta

SEQ ID NO: 1385225 - DNA, 21 bp, Homo sapiens
caatgatggcaattttgtaac

SEQ ID NO: 1385226 - DNA, 17 bp, Homo sapiens
caatgcacctaaagaaa

SEQ ID NO: 1385227 - DNA, 23 bp, Homo sapiens
caatgcacctaaagaaaaacaaa

SEQ ID NO: 1385228 - DNA, 19 bp, Homo sapiens
caatgtaaatattttaaag

SEQ ID NO: 1385229 - DNA, 13 bp, Homo sapiens
caatgtgctctcg

SEQ ID NO: 1385230 - DNA, 21 bp, Homo sapiens
caattagcaattgactgtcac

SEQ ID NO: 1385231 - DNA, 16 bp, Homo sapiens
caattagggcctagcc

SEQ ID NO: 1385232 - DNA, 21 bp, Homo sapiens
caattataagaggatatgaac

SEQ ID NO: 1385233 - DNA, 14 bp, Homo sapiens
caattgacaacagt

SEQ ID NO: 1385234 - DNA, 23 bp, Homo sapiens
caattgcacgcggagtgagtttt

SEQ ID NO: 1385235 - DNA, 14 bp, Homo sapiens
caatttatgaattg

SEQ ID NO: 1385236 - DNA, 20 bp, Homo sapiens
caattttctggaatacatga

SEQ ID NO: 1385237 - DNA, 21 bp, Homo sapiens
caattttttatcatgcatgtc

SEQ ID NO: 1385238 - DNA, 14 bp, Homo sapiens
caatttttttatac

SEQ ID NO: 1385239 - DNA, 15 bp, Homo sapiens
cacaaaccatgcaaa

SEQ ID NO: 1385240 - DNA, 21 bp, Homo sapiens
cacaaatatttattttctttc

SEQ ID NO: 1385241 - DNA, 23 bp, Homo sapiens
cacaacagcctgacaacatttct

SEQ ID NO: 1385242 - DNA, 16 bp, Homo sapiens
cacaagttatttaaat

SEQ ID NO: 1385243 - DNA, 15 bp, Homo sapiens
cacacaaacacctcc

SEQ ID NO: 1385244 - DNA, 10 bp, Homo sapiens
cacactgtaa

SEQ ID NO: 1385245 - DNA, 16 bp, Homo sapiens
cacagaaaccaatttt

SEQ ID NO: 1385246 - DNA, 19 bp, Homo sapiens
cacagacagggtcaaagtg

SEQ ID NO: 1385247 - DNA, 16 bp, Homo sapiens
cacagcaccagaatgt

SEQ ID NO: 1385248 - DNA, 19 bp, Homo sapiens
cacagcaccagaatgtata

SEQ ID NO: 1385249 - DNA, 19 bp, Homo sapiens
cacatcgcagattctccct

SEQ ID NO: 1385250 - DNA, 17 bp, Homo sapiens
cacatgtatctatgcat

SEQ ID NO: 1385251 - DNA, 21 bp, Homo sapiens
cacattagaagacaattgaca

SEQ ID NO: 1385252 - DNA, 13 bp, Homo sapiens
caccaggcagcct

SEQ ID NO: 1385253 - DNA, 14 bp, Homo sapiens
caccaggcagcctc

SEQ ID NO: 1385254 - DNA, 15 bp, Homo sapiens
caccaggcagcctct

SEQ ID NO: 1385255 - DNA, 18 bp, Homo sapiens
caccaggcagcctctggg

SEQ ID NO: 1385256 - DNA, 21 bp, Homo sapiens
caccatttggcatccctgggc

SEQ ID NO: 1385257 - DNA, 23 bp, Homo sapiens
caccatttggcatccctgggcct

SEQ ID NO: 1385258 - DNA, 24 bp, Homo sapiens
caccatttggcatccctgggcctt

SEQ ID NO: 1385259 - DNA, 22 bp, Homo sapiens
cacccaaagaggtatttatctt

SEQ ID NO: 1385260 - DNA, 14 bp, Homo sapiens
caccccccaagctg

SEQ ID NO: 1385261 - DNA, 14 bp, Homo sapiens
caccggggcctggg

SEQ ID NO: 1385262 - DNA, 14 bp, Homo sapiens
caccgttcattcag

SEQ ID NO: 1385263 - DNA, 12 bp, Homo sapiens
cacctaaagaaa

SEQ ID NO: 1385264 - DNA, 19 bp, Homo sapiens
cacctaggctagggtgggg

SEQ ID NO: 1385265 - DNA, 19 bp, Homo sapiens
cacctatgtcatttcattt

SEQ ID NO: 1385266 - DNA, 12 bp, Homo sapiens
cacctcccagga

SEQ ID NO: 1385267 - DNA, 21 bp, Homo sapiens
cacctccctatactgcttgga

SEQ ID NO: 1385268 - DNA, 19 bp, Homo sapiens
cacctgaactgaacaccat

SEQ ID NO: 1385269 - DNA, 14 bp, Homo sapiens
cacctgaggctcag

SEQ ID NO: 1385270 - DNA, 15 bp, Homo sapiens
cacctgaggctcagc

SEQ ID NO: 1385271 - DNA, 19 bp, Homo sapiens
cacctgaggctcagcccta

SEQ ID NO: 1385272 - DNA, 16 bp, Homo sapiens
cacctgggagaaatct

SEQ ID NO: 1385273 - DNA, 14 bp, Homo sapiens
cacctgtaaacctg

SEQ ID NO: 1385274 - DNA, 15 bp, Homo sapiens
cacctgtcccagaaa

SEQ ID NO: 1385275 - DNA, 15 bp, Homo sapiens
cacctgttgcacctc

SEQ ID NO: 1385276 - DNA, 19 bp, Homo sapiens
cacgctctctccaggcagg

SEQ ID NO: 1385277 - DNA, 14 bp, Homo sapiens
cacgctttcctgaa

SEQ ID NO: 1385278 - DNA, 12 bp, Homo sapiens
cacggcctttct

SEQ ID NO: 1385279 - DNA, 22 bp, Homo sapiens
cacggctcctcgagatcccaac

SEQ ID NO: 1385280 - DNA, 19 bp, Homo sapiens
cactagacaagccagaact

SEQ ID NO: 1385281 - DNA, 22 bp, Homo sapiens
cactcatgtgactctttccaac

SEQ ID NO: 1385282 - DNA, 10 bp, Homo sapiens
cactcctgct

SEQ ID NO: 1385283 - DNA, 14 bp, Homo sapiens
cactctgtaattga

SEQ ID NO: 1385284 - DNA, 17 bp, Homo sapiens
cactgagaccaaggctt

SEQ ID NO: 1385285 - DNA, 17 bp, Homo sapiens
cactgataatatgtttg

SEQ ID NO: 1385286 - DNA, 14 bp, Homo sapiens
cactgcaacctcca

SEQ ID NO: 1385287 - DNA, 19 bp, Homo sapiens
cactggggcaggggccggg

SEQ ID NO: 1385288 - DNA, 22 bp, Homo sapiens
cactgtcagcagggactgtaaa

SEQ ID NO: 1385289 - DNA, 20 bp, Homo sapiens
cactgttgagttggacacac

SEQ ID NO: 1385290 - DNA, 20 bp, Homo sapiens
cactgtttagaacacacaca

SEQ ID NO: 1385291 - DNA, 15 bp, Homo sapiens
catagacagaagaaa

SEQ ID NO: 1385292 - DNA, 19 bp, Homo sapiens
catagacagaagaaacaag

SEQ ID NO: 1385293 - DNA, 18 bp, Homo sapiens
catagtattcatgactat

SEQ ID NO: 1385294 - DNA, 12 bp, Homo sapiens
catataaagtat

SEQ ID NO: 1385295 - DNA, 17 bp, Homo sapiens
catatatgaggacttgt

SEQ ID NO: 1385296 - DNA, 17 bp, Homo sapiens
catatgtaaaatattgt

SEQ ID NO: 1385297 - DNA, 10 bp, Homo sapiens
catcaactga

SEQ ID NO: 1385298 - DNA, 17 bp, Homo sapiens
catcaagagactgagtc

SEQ ID NO: 1385299 - DNA, 16 bp, Homo sapiens
catcaattaaaggcaa

SEQ ID NO: 1385300 - DNA, 17 bp, Homo sapiens
catcactgagttttcca

SEQ ID NO: 1385301 - DNA, 11 bp, Homo sapiens
catcaggcttt

SEQ ID NO: 1385302 - DNA, 15 bp, Homo sapiens
catcatggctatctg

SEQ ID NO: 1385303 - DNA, 13 bp, Homo sapiens
catccagagtccc

SEQ ID NO: 1385304 - DNA, 16 bp, Homo sapiens
cagatgaggctttcca

SEQ ID NO: 1385305 - DNA, 16 bp, Homo sapiens
cagatgcagctcaaga

SEQ ID NO: 1385306 - DNA, 14 bp, Homo sapiens
cagatgtgaaccat

SEQ ID NO: 1385307 - DNA, 14 bp, Homo sapiens
cagattcccagagc

SEQ ID NO: 1385308 - DNA, 21 bp, Homo sapiens
cagattcccagagcaaaataa

SEQ ID NO: 1385309 - DNA, 20 bp, Homo sapiens
cagatttgctaatttatcct

SEQ ID NO: 1385310 - DNA, 13 bp, Homo sapiens
cagattttcagca

SEQ ID NO: 1385311 - DNA, 19 bp, Homo sapiens
cagattttcagcaaactct

SEQ ID NO: 1385312 - DNA, 14 bp, Homo sapiens
cagcaaccagagca

SEQ ID NO: 1385313 - DNA, 20 bp, Homo sapiens
cagcaaccagagcactgtat

SEQ ID NO: 1385314 - DNA, 18 bp, Homo sapiens
cagcagactcagctctga

SEQ ID NO: 1385315 - DNA, 18 bp, Homo sapiens
cagcatgtctattcagct

SEQ ID NO: 1385316 - DNA, 17 bp, Homo sapiens
cagcccctcccagccta

SEQ ID NO: 1385317 - DNA, 16 bp, Homo sapiens
cagccctaaacatcat

SEQ ID NO: 1385318 - DNA, 17 bp, Homo sapiens
cagccctagccctcagc

SEQ ID NO: 1385319 - DNA, 23 bp, Homo sapiens
cagccctagccctcagcccacct

SEQ ID NO: 1385320 - DNA, 14 bp, Homo sapiens
cagccgtgagcatg

SEQ ID NO: 1385321 - DNA, 18 bp, Homo sapiens
cagcctacccctcctgcg

SEQ ID NO: 1385322 - DNA, 17 bp, Homo sapiens
cagcctcattctgaggc

SEQ ID NO: 1385323 - DNA, 20 bp, Homo sapiens
cagcctcattctgaggcctg

SEQ ID NO: 1385324 - DNA, 22 bp, Homo sapiens
cagcctctggggggtggccagg

SEQ ID NO: 1385325 - DNA, 23 bp, Homo sapiens
cagcctggctgtggcctaacctg

SEQ ID NO: 1385326 - DNA, 14 bp, Homo sapiens
cagcggcatcaggc

SEQ ID NO: 1385327 - DNA, 15 bp, Homo sapiens
cagctaagctaggaa

SEQ ID NO: 1385328 - DNA, 15 bp, Homo sapiens
cagctcaagagatcc

SEQ ID NO: 1385329 - DNA, 21 bp, Homo sapiens
cagctcagaagtttcttcttt

SEQ ID NO: 1385330 - DNA, 21 bp, Homo sapiens
cagctcccttcccctgcctgg

SEQ ID NO: 1385331 - DNA, 12 bp, Homo sapiens
cagctctgaaag

SEQ ID NO: 1385332 - DNA, 14 bp, Homo sapiens
cagctctgacattc

SEQ ID NO: 1385333 - DNA, 20 bp, Homo sapiens
cagctctgacattctgattc

SEQ ID NO: 1385334 - DNA, 21 bp, Homo sapiens
cagctctgacattctgattcg

SEQ ID NO: 1385335 - DNA, 21 bp, Homo sapiens
cagctgcggcagcccctccca

SEQ ID NO: 1385336 - DNA, 18 bp, Homo sapiens
cagctggggccaggctgg

SEQ ID NO: 1385337 - DNA, 21 bp, Homo sapiens
cagctggggccaggctgggtc

SEQ ID NO: 1385338 - DNA, 20 bp, Homo sapiens
cagcttgtggcaagtgaatt

SEQ ID NO: 1385339 - DNA, 11 bp, Homo sapiens
cagctttgcta

SEQ ID NO: 1385340 - DNA, 21 bp, Homo sapiens
caggaagctttggtgagaacc

SEQ ID NO: 1385341 - DNA, 22 bp, Homo sapiens
caggaaggcttgttgtgctttt

SEQ ID NO: 1385342 - DNA, 15 bp, Homo sapiens
caggaatcttaaggt

SEQ ID NO: 1385343 - DNA, 20 bp, Homo sapiens
caggactctgccccttctgt

SEQ ID NO: 1385344 - DNA, 23 bp, Homo sapiens
caggagacaggttagctgctccc

SEQ ID NO: 1385345 - DNA, 19 bp, Homo sapiens
caggagagagttgaaccta

SEQ ID NO: 1385346 - DNA, 16 bp, Homo sapiens
caggagccctgggagg

SEQ ID NO: 1385347 - DNA, 18 bp, Homo sapiens
caggagccctgggaggct

SEQ ID NO: 1385348 - DNA, 19 bp, Homo sapiens
caggagccctgggaggctc

SEQ ID NO: 1385349 - DNA, 19 bp, Homo sapiens
caggaggacccagggctct

SEQ ID NO: 1385350 - DNA, 16 bp, Homo sapiens
caggaggccaataaaa

SEQ ID NO: 1385351 - DNA, 19 bp, Homo sapiens
caggaggccaataaaaagt

SEQ ID NO: 1385352 - DNA, 23 bp, Homo sapiens
caggaggccaataaaaagttcag

SEQ ID NO: 1385353 - DNA, 17 bp, Homo sapiens
caggaggtgccactgga

SEQ ID NO: 1385354 - DNA, 19 bp, Homo sapiens
caggaggtgccactggagt

SEQ ID NO: 1385355 - DNA, 22 bp, Homo sapiens
caggcaacgcacaaaacagaaa

SEQ ID NO: 1385356 - DNA, 15 bp, Homo sapiens
caggcaccaaaagaa

SEQ ID NO: 1385357 - DNA, 16 bp, Homo sapiens
caggcaccaaaagaag

SEQ ID NO: 1385358 - DNA, 19 bp, Homo sapiens
caggcaccaaaagaagtaa

SEQ ID NO: 1385359 - DNA, 15 bp, Homo sapiens
caggcagcctctggg

SEQ ID NO: 1385360 - DNA, 20 bp, Homo sapiens
caggcatcggggagccggga

SEQ ID NO: 1385361 - DNA, 21 bp, Homo sapiens
caggcatcggggagccgggag

SEQ ID NO: 1385362 - DNA, 17 bp, Homo sapiens
caggccgtgacgtctgg

SEQ ID NO: 1385363 - DNA, 17 bp, Homo sapiens
caggcctttgagctcag

SEQ ID NO: 1385364 - DNA, 15 bp, Homo sapiens
caggctcagagggtg

SEQ ID NO: 1385365 - DNA, 19 bp, Homo sapiens
caggctcccagggacacct

SEQ ID NO: 1385366 - DNA, 22 bp, Homo sapiens
caggctgtgtttggctttcagg

SEQ ID NO: 1385367 - DNA, 22 bp, Homo sapiens
cagggacacctgggagaaatct

SEQ ID NO: 1385368 - DNA, 16 bp, Homo sapiens
caggggcctgcccagt

SEQ ID NO: 1385369 - DNA, 16 bp, Homo sapiens
cagggggtgtgtctgc

SEQ ID NO: 1385370 - DNA, 21 bp, Homo sapiens
cagggtaccctttggggagca

SEQ ID NO: 1385371 - DNA, 23 bp, Homo sapiens
cagggtcaaagtgttttctctga

SEQ ID NO: 1385372 - DNA, 21 bp, Homo sapiens
caggtacttgtaaattattaa

SEQ ID NO: 1385373 - DNA, 20 bp, Homo sapiens
caggtagaattatctaattt

SEQ ID NO: 1385374 - DNA, 23 bp, Homo sapiens
caggtaggaggcaaatatcttga

SEQ ID NO: 1385375 - DNA, 15 bp, Homo sapiens
caggtatacctcact

SEQ ID NO: 1385376 - DNA, 21 bp, Homo sapiens
caggtccctaataaagctgtg

SEQ ID NO: 1385377 - DNA, 15 bp, Homo sapiens
caggtcctcagagaa

SEQ ID NO: 1385378 - DNA, 21 bp, Homo sapiens
caggtctgaagctcaactctc

SEQ ID NO: 1385379 - DNA, 15 bp, Homo sapiens
caggttgttctgtat

SEQ ID NO: 1385380 - DNA, 14 bp, Homo sapiens
cagtaactcatctg

SEQ ID NO: 1385381 - DNA, 16 bp, Homo sapiens
cagtaactcatctgtc

SEQ ID NO: 1385382 - DNA, 20 bp, Homo sapiens
cagtaggttatttagcttgg

SEQ ID NO: 1385383 - DNA, 22 bp, Homo sapiens
cagtcctggaagccagctttcc

SEQ ID NO: 1385384 - DNA, 13 bp, Homo sapiens
cagtcttcctgac

SEQ ID NO: 1385385 - DNA, 17 bp, Homo sapiens
cagtcttcctgacactt

SEQ ID NO: 1385386 - DNA, 18 bp, Homo sapiens
cagtcttcctgacacttt

SEQ ID NO: 1385387 - DNA, 14 bp, Homo sapiens
cagtgaagacagaa

SEQ ID NO: 1385388 - DNA, 19 bp, Homo sapiens
cagtgagacagtctggaaa

SEQ ID NO: 1385389 - DNA, 20 bp, Homo sapiens
cagtgagacagtctggaaag

SEQ ID NO: 1385390 - DNA, 12 bp, Homo sapiens
cagtgagcctga

SEQ ID NO: 1385391 - DNA, 19 bp, Homo sapiens
cagtgccctcattttatgt

SEQ ID NO: 1385392 - DNA, 23 bp, Homo sapiens
cagtgctgaccagacagcctccc

SEQ ID NO: 1385393 - DNA, 16 bp, Homo sapiens
cagtgctgtgctgtgc

SEQ ID NO: 1385394 - DNA, 22 bp, Homo sapiens
cagttacataattcactctgag

SEQ ID NO: 1385395 - DNA, 21 bp, Homo sapiens
cagttataagtagcaggccaa

SEQ ID NO: 1385396 - DNA, 22 bp, Homo sapiens
cagttatgatttttttttcata

SEQ ID NO: 1385397 - DNA, 14 bp, Homo sapiens
cagttcaagaaagc

SEQ ID NO: 1385398 - DNA, 19 bp, Homo sapiens
cagtttatatttaactctc

SEQ ID NO: 1385399 - DNA, 14 bp, Homo sapiens
cagtttatttgttg

SEQ ID NO: 1385400 - DNA, 19 bp, Homo sapiens
cagttttttcacctggaag

SEQ ID NO: 1385401 - DNA, 15 bp, Homo sapiens
cataaaaatgatcta

SEQ ID NO: 1385402 - DNA, 12 bp, Homo sapiens
cataaattattg

SEQ ID NO: 1385403 - DNA, 21 bp, Homo sapiens
cataattcactctgagtgttt

SEQ ID NO: 1385404 - DNA, 23 bp, Homo sapiens
cataattcactctgagtgtttta

SEQ ID NO: 1385405 - DNA, 22 bp, Homo sapiens
cataatttagtttcatataaag

SEQ ID NO: 1385406 - DNA, 18 bp, Homo sapiens
catacattttctaagaaa

SEQ ID NO: 1385407 - DNA, 13 bp, Homo sapiens
ccagagcactgta

SEQ ID NO: 1385408 - DNA, 16 bp, Homo sapiens
ccagagcactgtatac

SEQ ID NO: 1385409 - DNA, 21 bp, Homo sapiens
ccagatttgctaatttatcct

SEQ ID NO: 1385410 - DNA, 16 bp, Homo sapiens
ccagatttttacacat

SEQ ID NO: 1385411 - DNA, 19 bp, Homo sapiens
ccagcaaaccaggactctg

SEQ ID NO: 1385412 - DNA, 14 bp, Homo sapiens
ctaaaataaagaaa

SEQ ID NO: 1385413 - DNA, 14 bp, Homo sapiens
ctaaaatatttatt

SEQ ID NO: 1385414 - DNA, 15 bp, Homo sapiens
ctaaaatatttattt

SEQ ID NO: 1385415 - DNA, 23 bp, Homo sapiens
ctaaaatgttctccttagatgtg

SEQ ID NO: 1385416 - DNA, 17 bp, Homo sapiens
ctaaacacgtgacacaa

SEQ ID NO: 1385417 - DNA, 19 bp, Homo sapiens
ctctgagtgttttatgaga

SEQ ID NO: 1385418 - DNA, 19 bp, Homo sapiens
ctctgattttcaaagcttt

SEQ ID NO: 1385419 - DNA, 22 bp, Homo sapiens
ctctgattttcaaagctttttc

SEQ ID NO: 1385420 - DNA, 13 bp, Homo sapiens
ctctgcaggtccc

SEQ ID NO: 1385421 - DNA, 20 bp, Homo sapiens
ctctgcaggtccctaataaa

SEQ ID NO: 1385422 - DNA, 22 bp, Homo sapiens
ctctgcaggtccctaataaagc

SEQ ID NO: 1385423 - DNA, 23 bp, Homo sapiens
ctctgcaggtccctaataaagct

SEQ ID NO: 1385424 - DNA, 18 bp, Homo sapiens
ctctgtcgcccatgctgg

SEQ ID NO: 1385425 - DNA, 15 bp, Homo sapiens
ctctgtgtgcacaaa

SEQ ID NO: 1385426 - DNA, 18 bp, Homo sapiens
ctgtaaacccctgggtaa

SEQ ID NO: 1385427 - DNA, 13 bp, Homo sapiens
ctgtaaactgtgt

SEQ ID NO: 1385428 - DNA, 21 bp, Homo sapiens
ctgtaagaaacctactgccca

SEQ ID NO: 1385429 - DNA, 20 bp, Homo sapiens
ctgtaatcccagcatgctga

SEQ ID NO: 1385430 - DNA, 17 bp, Homo sapiens
ctgtaatgttaatattg

SEQ ID NO: 1385431 - DNA, 18 bp, Homo sapiens
ctgtaatgttaatattga

SEQ ID NO: 1385432 - DNA, 22 bp, Homo sapiens
ctgtaccaagccccttggccct

SEQ ID NO: 1385433 - DNA, 20 bp, Homo sapiens
ctgtacttgctcttgatgcc

SEQ ID NO: 1385434 - DNA, 18 bp, Homo sapiens
ctgtagtaggcattttta

SEQ ID NO: 1385435 - DNA, 22 bp, Homo sapiens
ctgtagtaggcatttttaccat

SEQ ID NO: 1385436 - DNA, 14 bp, Homo sapiens
ctgtcatagaaatt

SEQ ID NO: 1385437 - DNA, 17 bp, Homo sapiens
ctgtcgattagactgga

SEQ ID NO: 1385438 - DNA, 19 bp, Homo sapiens
ctgtcgattagactggaca

SEQ ID NO: 1385439 - DNA, 18 bp, Homo sapiens
ctgtctacttgctcaggt

SEQ ID NO: 1385440 - DNA, 15 bp, Homo sapiens
ctgtgccatgtgttt

SEQ ID NO: 1385441 - DNA, 15 bp, Homo sapiens
tggccaggccgggaa

SEQ ID NO: 1385442 - DNA, 14 bp, Homo sapiens
tggcccctgaacaa

SEQ ID NO: 1385443 - DNA, 16 bp, Homo sapiens
tggcctaacctgccga

SEQ ID NO: 1385444 - DNA, 15 bp, Homo sapiens
tggctagtccttgtt

SEQ ID NO: 1385445 - DNA, 13 bp, Homo sapiens
tggctatgttttt

SEQ ID NO: 1385446 - DNA, 17 bp, Homo sapiens
tggctatgtttttaatg

SEQ ID NO: 1385447 - DNA, 15 bp, Homo sapiens
tggctcctgtttcca

SEQ ID NO: 1385448 - DNA, 17 bp, Homo sapiens
tggctcctgtttccatg

SEQ ID NO: 1385449 - DNA, 19 bp, Homo sapiens
tggctgataattttaaatt

SEQ ID NO: 1385450 - DNA, 16 bp, Homo sapiens
tggctgcaggaatctt

SEQ ID NO: 1385451 - DNA, 15 bp, Homo sapiens
tggcttctggccagg

SEQ ID NO: 1385452 - DNA, 17 bp, Homo sapiens
tggcttctggccaggaa

SEQ ID NO: 1385453 - DNA, 19 bp, Homo sapiens
tggcttctggccaggaagc

SEQ ID NO: 1385454 - DNA, 20 bp, Homo sapiens
tggctttgtgattcaatctg

SEQ ID NO: 1385455 - DNA, 16 bp, Homo sapiens
tgggaaaaatgtagga

SEQ ID NO: 1385456 - DNA, 17 bp, Homo sapiens
tgggaccacaactattt

SEQ ID NO: 1385457 - DNA, 20 bp, Homo sapiens
tgggagaccggcctgccagg

SEQ ID NO: 1385458 - DNA, 14 bp, Homo sapiens
tgggagagggcgca

SEQ ID NO: 1385459 - DNA, 20 bp, Homo sapiens
tgggagagggcgcaggccgt

SEQ ID NO: 1385460 - DNA, 19 bp, Homo sapiens
tgggagctggttagaaatg

SEQ ID NO: 1385461 - DNA, 16 bp, Homo sapiens
tgggagcttgggaatg

SEQ ID NO: 1385462 - DNA, 14 bp, Homo sapiens
tgggaggagggcag

SEQ ID NO: 1385463 - DNA, 21 bp, Homo sapiens
tgggattctggacaggatgtg

SEQ ID NO: 1385464 - DNA, 15 bp, Homo sapiens
tgggcaggagggagg

SEQ ID NO: 1385465 - DNA, 18 bp, Homo sapiens
tgggcaggagggaggtgc

SEQ ID NO: 1385466 - DNA, 20 bp, Homo sapiens
tgggcccctgcctctctgca

SEQ ID NO: 1385467 - DNA, 15 bp, Homo sapiens
tgggccttgggctcc

SEQ ID NO: 1385468 - DNA, 17 bp, Homo sapiens
tggggagtgggggtggg

SEQ ID NO: 1385469 - DNA, 18 bp, Homo sapiens
tggggcaggggccggggg

SEQ ID NO: 1385470 - DNA, 21 bp, Homo sapiens
tggggccaggctgggtcgccc

SEQ ID NO: 1385471 - DNA, 21 bp, Homo sapiens
tgggggacttacatgattcat

SEQ ID NO: 1385472 - DNA, 16 bp, Homo sapiens
tgggggtgggggtagg

SEQ ID NO: 1385473 - DNA, 20 bp, Homo sapiens
tgggtatagttcatgtctgc

SEQ ID NO: 1385474 - DNA, 13 bp, Homo sapiens
tgggtccaggagg

SEQ ID NO: 1385475 - DNA, 16 bp, Homo sapiens
tgggtcgccctggact

SEQ ID NO: 1385476 - DNA, 18 bp, Homo sapiens
tgggtcgccctggactgt

SEQ ID NO: 1385477 - DNA, 15 bp, Homo sapiens
tgggtgaaagtgact

SEQ ID NO: 1385478 - DNA, 21 bp, Homo sapiens
tgggttgcagacaggaatctt

SEQ ID NO: 1385479 - DNA, 14 bp, Homo sapiens
tggtaattgtacta

SEQ ID NO: 1385480 - DNA, 13 bp, Homo sapiens
tggtaattgttgc

SEQ ID NO: 1385481 - DNA, 17 bp, Homo sapiens
tggtagaccaaaataaa

SEQ ID NO: 1385482 - DNA, 23 bp, Homo sapiens
tggtccaaaagattgctgaaatt

SEQ ID NO: 1385483 - DNA, 18 bp, Homo sapiens
tggtctcaaactcctgac

SEQ ID NO: 1385484 - DNA, 23 bp, Homo sapiens
tggtctcaaactcctgacctcag

SEQ ID NO: 1385485 - DNA, 15 bp, Homo sapiens
tggtgccaatttcaa

SEQ ID NO: 1385486 - DNA, 14 bp, Homo sapiens
tggtgccttcattt

SEQ ID NO: 1385487 - DNA, 14 bp, Homo sapiens
tggttagaaatgca

SEQ ID NO: 1385488 - DNA, 18 bp, Homo sapiens
tggttctttttattttaa

SEQ ID NO: 1385489 - DNA, 13 bp, Homo sapiens
tggtttcccaaga

SEQ ID NO: 1385490 - DNA, 16 bp, Homo sapiens
tggtttgccttccaga

SEQ ID NO: 1385491 - DNA, 19 bp, Homo sapiens
tggttttctccaagagcta

SEQ ID NO: 1385492 - DNA, 13 bp, Homo sapiens
tgtaaaaaagtgt

SEQ ID NO: 1385493 - DNA, 13 bp, Homo sapiens
tgtaaaacaggta

SEQ ID NO: 1385494 - DNA, 22 bp, Homo sapiens
tgtaaaacaggtagaattatct

SEQ ID NO: 1385495 - DNA, 15 bp, Homo sapiens
tgtaaactcaaaata

SEQ ID NO: 1385496 - DNA, 20 bp, Homo sapiens
tgtaaactcaaaatatttgt

SEQ ID NO: 1385497 - DNA, 14 bp, Homo sapiens
tgtaaactgtgtat

SEQ ID NO: 1385498 - DNA, 19 bp, Homo sapiens
tgtaaactgtgtattccaa

SEQ ID NO: 1385499 - DNA, 16 bp, Homo sapiens
tgtaaagctaaaataa

SEQ ID NO: 1385500 - DNA, 17 bp, Homo sapiens
tgtaaagctaaaataaa

SEQ ID NO: 1385501 - DNA, 20 bp, Homo sapiens
tgtaaagctaaaataaagaa

SEQ ID NO: 1385502 - DNA, 14 bp, Homo sapiens
tgtaaatattgtgt

SEQ ID NO: 1385503 - DNA, 14 bp, Homo sapiens
tgtaaatattttaa

SEQ ID NO: 1385504 - DNA, 15 bp, Homo sapiens
tgtaaatgaacataa

SEQ ID NO: 1385505 - DNA, 14 bp, Homo sapiens
tgtaacaagccaga

SEQ ID NO: 1385506 - DNA, 15 bp, Homo sapiens
tgtaacttttgtaag

SEQ ID NO: 1385507 - DNA, 16 bp, Homo sapiens
tgtaacttttgtaaga

SEQ ID NO: 1385508 - DNA, 12 bp, Homo sapiens
tgtaagaaacct

SEQ ID NO: 1385509 - DNA, 18 bp, Homo sapiens
tgtaatagatgtttgata

SEQ ID NO: 1385510 - DNA, 14 bp, Homo sapiens
tgtaatgttaatat

SEQ ID NO: 1385511 - DNA, 18 bp, Homo sapiens
tgtaatgttaatattgat

SEQ ID NO: 1385512 - DNA, 19 bp, Homo sapiens
tgtaattgaatattattcc

SEQ ID NO: 1385513 - DNA, 18 bp, Homo sapiens
tgtacagttatctaagtt

SEQ ID NO: 1385514 - DNA, 17 bp, Homo sapiens
tgtacataactgaaaat

SEQ ID NO: 1385515 - DNA, 15 bp, Homo sapiens
tgtaccaagaatctt

SEQ ID NO: 1385516 - DNA, 20 bp, Homo sapiens
tgtacgataggtagaattgt

SEQ ID NO: 1385517 - DNA, 20 bp, Homo sapiens
tgtactaaagccaaacatat

SEQ ID NO: 1385518 - DNA, 12 bp, Homo sapiens
tgtactgaaaaa

SEQ ID NO: 1385519 - DNA, 20 bp, Homo sapiens
tgtactgaaaaatggtaatt

SEQ ID NO: 1385520 - DNA, 15 bp, Homo sapiens
tgtacttgctcttga

SEQ ID NO: 1385521 - DNA, 22 bp, Homo sapiens
tgtacttgctcttgatgcctgg

SEQ ID NO: 1385522 - DNA, 23 bp, Homo sapiens
tgtacttgctcttgatgcctggc

SEQ ID NO: 1385523 - DNA, 18 bp, Homo sapiens
tgtagaatgatttcatgc

SEQ ID NO: 1385524 - DNA, 16 bp, Homo sapiens
tgtagccacaccagga

SEQ ID NO: 1385525 - DNA, 15 bp, Homo sapiens
tgtagctttgctctt

SEQ ID NO: 1385526 - DNA, 20 bp, Homo sapiens
tgtataaaatgcaaaataaa

SEQ ID NO: 1385527 - DNA, 23 bp, Homo sapiens
tgtataccccgtgaagcatccag

SEQ ID NO: 1385528 - DNA, 16 bp, Homo sapiens
tgtatattaaggtgtg

SEQ ID NO: 1385529 - DNA, 22 bp, Homo sapiens
tgaatttttaaaacccatttaa

SEQ ID NO: 1385530 - DNA, 19 bp, Homo sapiens
tgaatttttttttcctagc

SEQ ID NO: 1385531 - DNA, 19 bp, Homo sapiens
tgacaaaaaattaaagcat

SEQ ID NO: 1385532 - DNA, 23 bp, Homo sapiens
tgacaacatttctatagccaaaa

SEQ ID NO: 1385533 - DNA, 13 bp, Homo sapiens
tgacaactggcag

SEQ ID NO: 1385534 - DNA, 18 bp, Homo sapiens
tgacaactggcaggcagg

SEQ ID NO: 1385535 - DNA, 16 bp, Homo sapiens
tgacacatggcccctc

SEQ ID NO: 1385536 - DNA, 21 bp, Homo sapiens
tgacactagcccaatgaaatg

SEQ ID NO: 1385537 - DNA, 22 bp, Homo sapiens
tgacagctaggatgtgcattct

SEQ ID NO: 1385538 - DNA, 16 bp, Homo sapiens
tgacagtggaactaca

SEQ ID NO: 1385539 - DNA, 16 bp, Homo sapiens
tgacagtgttgaaaat

SEQ ID NO: 1385540 - DNA, 16 bp, Homo sapiens
tgacatcacttgtaca

SEQ ID NO: 1385541 - DNA, 21 bp, Homo sapiens
tgacatcacttgtacaaaata

SEQ ID NO: 1385542 - DNA, 22 bp, Homo sapiens
tgacatcacttgtacaaaataa

SEQ ID NO: 1385543 - DNA, 14 bp, Homo sapiens
tgacatgtccttct

SEQ ID NO: 1385544 - DNA, 15 bp, Homo sapiens
tgaccaaaagttaca

SEQ ID NO: 1385545 - DNA, 16 bp, Homo sapiens
tgaccaaaagttacat

SEQ ID NO: 1385546 - DNA, 12 bp, Homo sapiens
tgaccaggacta

SEQ ID NO: 1385547 - DNA, 19 bp, Homo sapiens
tgaccctcaattcatattt

SEQ ID NO: 1385548 - DNA, 14 bp, Homo sapiens
tgactcacacctga

SEQ ID NO: 1385549 - DNA, 14 bp, Homo sapiens
tgactctttccaac

SEQ ID NO: 1385550 - DNA, 21 bp, Homo sapiens
tgactgccaagactgctgtgg

SEQ ID NO: 1385551 - DNA, 22 bp, Homo sapiens
tgactgccaagactgctgtggc

SEQ ID NO: 1385552 - DNA, 19 bp, Homo sapiens
tgagaaaagctttgaaccc

SEQ ID NO: 1385553 - DNA, 17 bp, Homo sapiens
tgagaaatttaaactat

SEQ ID NO: 1385554 - DNA, 18 bp, Homo sapiens
tgagaaatttaaactata

SEQ ID NO: 1385555 - DNA, 12 bp, Homo sapiens
tgagaacctggg

SEQ ID NO: 1385556 - DNA, 21 bp, Homo sapiens
tgagaacctgggttgcagaca

SEQ ID NO: 1385557 - DNA, 23 bp, Homo sapiens
tgagacagtctggaaagtgatgt

SEQ ID NO: 1385558 - DNA, 22 bp, Homo sapiens
tgagagaaagagaaatcagaaa

SEQ ID NO: 1385559 - DNA, 21 bp, Homo sapiens
tgagagatgcagaaatatttg

SEQ ID NO: 1385560 - DNA, 13 bp, Homo sapiens
tgagagtgtgacc

SEQ ID NO: 1385561 - DNA, 14 bp, Homo sapiens
tgagatacatacag

SEQ ID NO: 1385562 - DNA, 17 bp, Homo sapiens
tgagatgctggcttggg

SEQ ID NO: 1385563 - DNA, 17 bp, Homo sapiens
tgagatggagtcttgct

SEQ ID NO: 1385564 - DNA, 18 bp, Homo sapiens
tgagatggagtcttgctc

SEQ ID NO: 1385565 - DNA, 16 bp, Homo sapiens
tgagcaaatcaccaca

SEQ ID NO: 1385566 - DNA, 24 bp, Homo sapiens
tgagctactgccgtcagtgctgtg

SEQ ID NO: 1385567 - DNA, 23 bp, Homo sapiens
tgagctcagaaaatatccctcct

SEQ ID NO: 1385568 - DNA, 12 bp, Homo sapiens
tgagctctctgt

SEQ ID NO: 1385569 - DNA, 12 bp, Homo sapiens
tgagctcttcat

SEQ ID NO: 1385570 - DNA, 18 bp, Homo sapiens
tgagctcttcatgtttca

SEQ ID NO: 1385571 - DNA, 24 bp, Homo sapiens
tgagctgaccagccgtgagcatgt

SEQ ID NO: 1385572 - DNA, 22 bp, Homo sapiens
tgaggaatttcacctgtaaacc

SEQ ID NO: 1385573 - DNA, 15 bp, Homo sapiens
tgaggagacacacct

SEQ ID NO: 1385574 - DNA, 19 bp, Homo sapiens
tgaggctttccatgggacc

SEQ ID NO: 1385575 - DNA, 21 bp, Homo sapiens
tgagggcattaaaaatagtaa

SEQ ID NO: 1385576 - DNA, 22 bp, Homo sapiens
tgaggggaccaggagtgggtgg

SEQ ID NO: 1385577 - DNA, 18 bp, Homo sapiens
tgagtctgtccagataag

SEQ ID NO: 1385578 - DNA, 21 bp, Homo sapiens
tgagtgttttatgagaaagcc

SEQ ID NO: 1385579 - DNA, 13 bp, Homo sapiens
tgagttttccatg

SEQ ID NO: 1385580 - DNA, 12 bp, Homo sapiens
tgataagatctt

SEQ ID NO: 1385581 - DNA, 15 bp, Homo sapiens
tgataagatctttta

SEQ ID NO: 1385582 - DNA, 15 bp, Homo sapiens
tgataatgaacagaa

SEQ ID NO: 1385583 - DNA, 14 bp, Homo sapiens
tgataattttaaat

SEQ ID NO: 1385584 - DNA, 17 bp, Homo sapiens
tgatatttctagcttat

SEQ ID NO: 1385585 - DNA, 20 bp, Homo sapiens
tgatattttctgtgcctgaa

SEQ ID NO: 1385586 - DNA, 11 bp, Homo sapiens
tgatcaaggcc

SEQ ID NO: 1385587 - DNA, 21 bp, Homo sapiens
tgatcagttttttcacctgga

SEQ ID NO: 1385588 - DNA, 14 bp, Homo sapiens
tgatccaactaatg

SEQ ID NO: 1385589 - DNA, 22 bp, Homo sapiens
tgatctgatagggtttgtgaca

SEQ ID NO: 1385590 - DNA, 12 bp, Homo sapiens
tgatgaaaataa

SEQ ID NO: 1385591 - DNA, 13 bp, Homo sapiens
tgatgaaaataaa

SEQ ID NO: 1385592 - DNA, 19 bp, Homo sapiens
tgatgaaaataaagaatgg

SEQ ID NO: 1385593 - DNA, 24 bp, Homo sapiens
tgatgaaaccttgaagttctgaaa

SEQ ID NO: 1385594 - DNA, 14 bp, Homo sapiens
tgatgcctctgtct

SEQ ID NO: 1385595 - DNA, 16 bp, Homo sapiens
tgattacagtgcagtg

SEQ ID NO: 1385596 - DNA, 16 bp, Homo sapiens
tgattcacatctcatt

SEQ ID NO: 1385597 - DNA, 19 bp, Homo sapiens
tgattcatgccaattagca

SEQ ID NO: 1385598 - DNA, 20 bp, Homo sapiens
tgattcattttaacatctga

SEQ ID NO: 1385599 - DNA, 12 bp, Homo sapiens
tgattctgcctt

SEQ ID NO: 1385600 - DNA, 13 bp, Homo sapiens
tgattctgccttt

SEQ ID NO: 1385601 - DNA, 18 bp, Homo sapiens
tgattgtcttaatattgt

SEQ ID NO: 1385602 - DNA, 21 bp, Homo sapiens
tgattgtttatttttctatga

SEQ ID NO: 1385603 - DNA, 15 bp, Homo sapiens
tgatttgtactgaaa

SEQ ID NO: 1385604 - DNA, 20 bp, Homo sapiens
tgattttcaaagctttttcc

SEQ ID NO: 1385605 - DNA, 13 bp, Homo sapiens
tgattttctggat

SEQ ID NO: 1385606 - DNA, 18 bp, Homo sapiens
tgatttttatgccacctg

SEQ ID NO: 1385607 - DNA, 15 bp, Homo sapiens
tgcaaaataaatgtt

SEQ ID NO: 1385608 - DNA, 23 bp, Homo sapiens
tgcaaataaatatcctttaattg

SEQ ID NO: 1385609 - DNA, 21 bp, Homo sapiens
tgcaaatgctatgagatgcat

SEQ ID NO: 1385610 - DNA, 21 bp, Homo sapiens
tgcacaataaaaatgtttaac

SEQ ID NO: 1385611 - DNA, 15 bp, Homo sapiens
tgcactatctttcag

SEQ ID NO: 1385612 - DNA, 14 bp, Homo sapiens
tgcacttcttacaa

SEQ ID NO: 1385613 - DNA, 18 bp, Homo sapiens
tgcagatggtgagagata

SEQ ID NO: 1385614 - DNA, 16 bp, Homo sapiens
tgcagcaaccagagca

SEQ ID NO: 1385615 - DNA, 17 bp, Homo sapiens
tgcagcaaccagagcac

SEQ ID NO: 1385616 - DNA, 20 bp, Homo sapiens
tgcagcaaccagagcactgt

SEQ ID NO: 1385617 - DNA, 17 bp, Homo sapiens
tgcaggatctcaccagg

SEQ ID NO: 1385618 - DNA, 21 bp, Homo sapiens
tgcaggatctcaccaggcagc

SEQ ID NO: 1385619 - DNA, 22 bp, Homo sapiens
tgcaggatctcaccaggcagcc

SEQ ID NO: 1385620 - DNA, 11 bp, Homo sapiens
tgcaggtccct

SEQ ID NO: 1385621 - DNA, 17 bp, Homo sapiens
tgcaggtccctaataaa

SEQ ID NO: 1385622 - DNA, 20 bp, Homo sapiens
tgcaggtccctaataaagct

SEQ ID NO: 1385623 - DNA, 22 bp, Homo sapiens
tgcatactttttaaatgtaaag

SEQ ID NO: 1385624 - DNA, 19 bp, Homo sapiens
tgcatccattctcctgagg

SEQ ID NO: 1385625 - DNA, 16 bp, Homo sapiens
tgcatgtcctgtaaag

SEQ ID NO: 1385626 - DNA, 15 bp, Homo sapiens
tgcatttaaaacaga

SEQ ID NO: 1385627 - DNA, 19 bp, Homo sapiens
tgcatttaaaacagacact

SEQ ID NO: 1385628 - DNA, 20 bp, Homo sapiens
tgcatttaaaacagacactg

SEQ ID NO: 1385629 - DNA, 20 bp, Homo sapiens
tgcatttatgagctcttcat

SEQ ID NO: 1385630 - DNA, 23 bp, Homo sapiens
tgccaagactgctgtggccagga

SEQ ID NO: 1385631 - DNA, 21 bp, Homo sapiens
tgccaagggcataaattattg

SEQ ID NO: 1385632 - DNA, 13 bp, Homo sapiens
tgccaatttcaag

SEQ ID NO: 1385633 - DNA, 13 bp, Homo sapiens
tgccaggaggacc

SEQ ID NO: 1385634 - DNA, 23 bp, Homo sapiens
tgccaggaggacccagggctctg

SEQ ID NO: 1385635 - DNA, 17 bp, Homo sapiens
tgccatgatgcctctgt

SEQ ID NO: 1385636 - DNA, 21 bp, Homo sapiens
tgccatgatgcctctgtcttc

SEQ ID NO: 1385637 - DNA, 18 bp, Homo sapiens
tgccatgtcaaacaaata

SEQ ID NO: 1385638 - DNA, 21 bp, Homo sapiens
tgccccttgacaactggcagg

SEQ ID NO: 1385639 - DNA, 20 bp, Homo sapiens
tgcccgcctgggtctcctaa

SEQ ID NO: 1385640 - DNA, 17 bp, Homo sapiens
tgcccgggagctcagga

SEQ ID NO: 1385641 - DNA, 14 bp, Homo sapiens
tgcctcacttcagg

SEQ ID NO: 1385642 - DNA, 12 bp, Homo sapiens
tgcctcctcacc

SEQ ID NO: 1385643 - DNA, 24 bp, Homo sapiens
tgcctcctcacccccagctttgct

SEQ ID NO: 1385644 - DNA, 21 bp, Homo sapiens
tgcctctcatcaactgaatga

SEQ ID NO: 1385645 - DNA, 18 bp, Homo sapiens
tgcctctctgcaggtccc

SEQ ID NO: 1385646 - DNA, 19 bp, Homo sapiens
tgcctctctgcaggtccct

SEQ ID NO: 1385647 - DNA, 16 bp, Homo sapiens
tgcctctgtcttctgg

SEQ ID NO: 1385648 - DNA, 23 bp, Homo sapiens
tgcctgaccctacttcttttgct

SEQ ID NO: 1385649 - DNA, 15 bp, Homo sapiens
tgcctggcggggtgg

SEQ ID NO: 1385650 - DNA, 20 bp, Homo sapiens
tgcctgtagccccagtgaca

SEQ ID NO: 1385651 - DNA, 22 bp, Homo sapiens
tgcctgtagccccagtgacagc

SEQ ID NO: 1385652 - DNA, 22 bp, Homo sapiens
tgcctgtgtttgtgtggatacc

SEQ ID NO: 1385653 - DNA, 18 bp, Homo sapiens
tgccttactcttcttgaa

SEQ ID NO: 1385654 - DNA, 12 bp, Homo sapiens
tgccttcatttg

SEQ ID NO: 1385655 - DNA, 22 bp, Homo sapiens
tgcctttttatttttgttttta

SEQ ID NO: 1385656 - DNA, 13 bp, Homo sapiens
tgctaagagaagt

SEQ ID NO: 1385657 - DNA, 13 bp, Homo sapiens
tgctaatcttctt

SEQ ID NO: 1385658 - DNA, 21 bp, Homo sapiens
tgctatctctgtgtgcacaaa

SEQ ID NO: 1385659 - DNA, 15 bp, Homo sapiens
tgctcaggagccctg

SEQ ID NO: 1385660 - DNA, 18 bp, Homo sapiens
tgctcaggagccctggga

SEQ ID NO: 1385661 - DNA, 22 bp, Homo sapiens
tgctcatattgtgattctgcct

SEQ ID NO: 1385662 - DNA, 20 bp, Homo sapiens
tcagaagccccatttgcaca

SEQ ID NO: 1385663 - DNA, 17 bp, Homo sapiens
tcagactctaagaaaga

SEQ ID NO: 1385664 - DNA, 18 bp, Homo sapiens
tcagactctaagaaagaa

SEQ ID NO: 1385665 - DNA, 12 bp, Homo sapiens
tcagagaatttc

SEQ ID NO: 1385666 - DNA, 15 bp, Homo sapiens
tcagagtcttgtccc

SEQ ID NO: 1385667 - DNA, 21 bp, Homo sapiens
tcagagttgctgcaaacctga

SEQ ID NO: 1385668 - DNA, 22 bp, Homo sapiens
tcagataaggtaaaatgccatg

SEQ ID NO: 1385669 - DNA, 15 bp, Homo sapiens
tcagatcctcctcat

SEQ ID NO: 1385670 - DNA, 14 bp, Homo sapiens
tcagattcccagag

SEQ ID NO: 1385671 - DNA, 16 bp, Homo sapiens
tcagcaactcgcttta

SEQ ID NO: 1385672 - DNA, 17 bp, Homo sapiens
tcagcagcctccctgaa

SEQ ID NO: 1385673 - DNA, 18 bp, Homo sapiens
tcagcagggactgtaaac

SEQ ID NO: 1385674 - DNA, 22 bp, Homo sapiens
tcagcagggactgtaaacacag

SEQ ID NO: 1385675 - DNA, 18 bp, Homo sapiens
tcagccctagccctcagc

SEQ ID NO: 1385676 - DNA, 22 bp, Homo sapiens
tcagctcccttcccctgcctgg

SEQ ID NO: 1385677 - DNA, 14 bp, Homo sapiens
tcagctctgaaaga

SEQ ID NO: 1385678 - DNA, 16 bp, Homo sapiens
tcagctctgaaagaga

SEQ ID NO: 1385679 - DNA, 21 bp, Homo sapiens
tcagctctgaaagagaaacac

SEQ ID NO: 1385680 - DNA, 12 bp, Homo sapiens
tcaggaaaattg

SEQ ID NO: 1385681 - DNA, 17 bp, Homo sapiens
tcaggaaccgaggcagg

SEQ ID NO: 1385682 - DNA, 19 bp, Homo sapiens
tcaggaatcggaatcctgt

SEQ ID NO: 1385683 - DNA, 11 bp, Homo sapiens
tcaggagccct

SEQ ID NO: 1385684 - DNA, 19 bp, Homo sapiens
tcaggcagaggatgttctg

SEQ ID NO: 1385685 - DNA, 23 bp, Homo sapiens
tcaggcagaggatgttctggacc

SEQ ID NO: 1385686 - DNA, 24 bp, Homo sapiens
tcaggcagaggatgttctggacct

SEQ ID NO: 1385687 - DNA, 20 bp, Homo sapiens
tcaggcccccacctggctca

SEQ ID NO: 1385688 - DNA, 15 bp, Homo sapiens
tcagggaggccctgt

SEQ ID NO: 1385689 - DNA, 22 bp, Homo sapiens
tcagggaggccctgtgcccctt

SEQ ID NO: 1385690 - DNA, 14 bp, Homo sapiens
tcaggtacttgtaa

SEQ ID NO: 1385691 - DNA, 17 bp, Homo sapiens
tcaggtatacctcactt

SEQ ID NO: 1385692 - DNA, 17 bp, Homo sapiens
tcaggttgttctgtata

SEQ ID NO: 1385693 - DNA, 17 bp, Homo sapiens
tcagtaatttgaggaca

SEQ ID NO: 1385694 - DNA, 18 bp, Homo sapiens
tcagtaatttgtttaaaa

SEQ ID NO: 1385695 - DNA, 13 bp, Homo sapiens
tcagtgctgtgct

SEQ ID NO: 1385696 - DNA, 22 bp, Homo sapiens
tcagtgctgtgctgtgctatgg

SEQ ID NO: 1385697 - DNA, 18 bp, Homo sapiens
tcagttgattttctggat

SEQ ID NO: 1385698 - DNA, 20 bp, Homo sapiens
tcataagtattatgtctctt

SEQ ID NO: 1385699 - DNA, 13 bp, Homo sapiens
tcatagaaatgta

SEQ ID NO: 1385700 - DNA, 13 bp, Homo sapiens
tcatataaagtat

SEQ ID NO: 1385701 - DNA, 21 bp, Homo sapiens
tcatattgtgattctgccttt

SEQ ID NO: 1385702 - DNA, 13 bp, Homo sapiens
tcatcaactgaat

SEQ ID NO: 1385703 - DNA, 14 bp, Homo sapiens
tcatctcttctttt

SEQ ID NO: 1385704 - DNA, 19 bp, Homo sapiens
tcatctggcaacatcttta

SEQ ID NO: 1385705 - DNA, 17 bp, Homo sapiens
tcatgataatgaacaga

SEQ ID NO: 1385706 - DNA, 13 bp, Homo sapiens
tcatgatccaact

SEQ ID NO: 1385707 - DNA, 16 bp, Homo sapiens
tcatgatggagacttc

SEQ ID NO: 1385708 - DNA, 14 bp, Homo sapiens
tcatgtaaaataag

SEQ ID NO: 1385709 - DNA, 16 bp, Homo sapiens
tcatgtaaaataagaa

SEQ ID NO: 1385710 - DNA, 19 bp, Homo sapiens
tcatgtgactctttccaac

SEQ ID NO: 1385711 - DNA, 22 bp, Homo sapiens
tcattcacatcgcagattctcc

SEQ ID NO: 1385712 - DNA, 14 bp, Homo sapiens
tcattcatttttgt

SEQ ID NO: 1385713 - DNA, 16 bp, Homo sapiens
tcattgtaaatgaaca

SEQ ID NO: 1385714 - DNA, 14 bp, Homo sapiens
tcattgtagaaaag

SEQ ID NO: 1385715 - DNA, 15 bp, Homo sapiens
tcatttcatttccta

SEQ ID NO: 1385716 - DNA, 15 bp, Homo sapiens
tcatttgttggaatg

SEQ ID NO: 1385717 - DNA, 20 bp, Homo sapiens
tcattttaacatctgagaaa

SEQ ID NO: 1385718 - DNA, 15 bp, Homo sapiens
tcattttatgttaag

SEQ ID NO: 1385719 - DNA, 12 bp, Homo sapiens
tcattttctcta

SEQ ID NO: 1385720 - DNA, 16 bp, Homo sapiens
tcattttttaaaaaag

SEQ ID NO: 1385721 - DNA, 16 bp, Homo sapiens
tccaaaagattgctga

SEQ ID NO: 1385722 - DNA, 20 bp, Homo sapiens
tccaaaagattgctgaaatt

SEQ ID NO: 1385723 - DNA, 13 bp, Homo sapiens
tccaaaagctttt

SEQ ID NO: 1385724 - DNA, 19 bp, Homo sapiens
tccaaaataaaacctcagc

SEQ ID NO: 1385725 - DNA, 19 bp, Homo sapiens
tccaactaatgccttactc

SEQ ID NO: 1385726 - DNA, 22 bp, Homo sapiens
tccaactaatgccttactcttc

SEQ ID NO: 1385727 - DNA, 14 bp, Homo sapiens
tccaattttctgga

SEQ ID NO: 1385728 - DNA, 12 bp, Homo sapiens
tccactcctcca

SEQ ID NO: 1385729 - DNA, 22 bp, Homo sapiens
tccagactgcttccaattttct

SEQ ID NO: 1385730 - DNA, 23 bp, Homo sapiens
tcctgtctccctcctctgcccgg

SEQ ID NO: 1385731 - DNA, 20 bp, Homo sapiens
tccttacctttttatttgca

SEQ ID NO: 1385732 - DNA, 17 bp, Homo sapiens
tccttagatctggcatg

SEQ ID NO: 1385733 - DNA, 21 bp, Homo sapiens
tccttcaaagtttaataaatt

SEQ ID NO: 1385734 - DNA, 15 bp, Homo sapiens
tccttccaccaagtt

SEQ ID NO: 1385735 - DNA, 24 bp, Homo sapiens
tccttctgagcccggtaagagcaa

SEQ ID NO: 1385736 - DNA, 19 bp, Homo sapiens
tcctttctagagcactgcc

SEQ ID NO: 1385737 - DNA, 16 bp, Homo sapiens
tcctttgttcttacct

SEQ ID NO: 1385738 - DNA, 17 bp, Homo sapiens
tccttttaattttcctg

SEQ ID NO: 1385739 - DNA, 12 bp, Homo sapiens
tcgaatgaaatt

SEQ ID NO: 1385740 - DNA, 15 bp, Homo sapiens
tcgaatgacactgtt

SEQ ID NO: 1385741 - DNA, 22 bp, Homo sapiens
tcgagatcccaacactgccagc

SEQ ID NO: 1385742 - DNA, 21 bp, Homo sapiens
tcgatgggaagggtagaaaac

SEQ ID NO: 1385743 - DNA, 19 bp, Homo sapiens
tcgcccatgctggagtgca

SEQ ID NO: 1385744 - DNA, 20 bp, Homo sapiens
tcgtaagatttccttctttt

SEQ ID NO: 1385745 - DNA, 18 bp, Homo sapiens
tcgtctcatgtaaaataa

SEQ ID NO: 1385746 - DNA, 19 bp, Homo sapiens
tcgtttattttcaagaata

SEQ ID NO: 1385747 - DNA, 19 bp, Homo sapiens
tctaaagctggtttaatgt

SEQ ID NO: 1385748 - DNA, 21 bp, Homo sapiens
tctaaagctggtttaatgttt

SEQ ID NO: 1385749 - DNA, 15 bp, Homo sapiens
tctaagaaacattta

SEQ ID NO: 1385750 - DNA, 12 bp, Homo sapiens
tctaagaaagaa

SEQ ID NO: 1385751 - DNA, 16 bp, Homo sapiens
tctaagttaatttaaa

SEQ ID NO: 1385752 - DNA, 21 bp, Homo sapiens
tctaagttaatttaaagttgt

SEQ ID NO: 1385753 - DNA, 15 bp, Homo sapiens
tctaccatttcagag

SEQ ID NO: 1385754 - DNA, 16 bp, Homo sapiens
tctagaacacaggcaa

SEQ ID NO: 1385755 - DNA, 17 bp, Homo sapiens
tctagaacacaggcaaa

SEQ ID NO: 1385756 - DNA, 14 bp, Homo sapiens
tctagacactgcca

SEQ ID NO: 1385757 - DNA, 14 bp, Homo sapiens
tctagagcactgcc

SEQ ID NO: 1385758 - DNA, 23 bp, Homo sapiens
tctagagtgagaatctggctcct

SEQ ID NO: 1385759 - DNA, 14 bp, Homo sapiens
tctagcttatctac

SEQ ID NO: 1385760 - DNA, 16 bp, Homo sapiens
tctagttctgccagga

SEQ ID NO: 1385761 - DNA, 19 bp, Homo sapiens
tctatagccaaaaatagct

SEQ ID NO: 1385762 - DNA, 20 bp, Homo sapiens
tctatagccaaaaatagcta

SEQ ID NO: 1385763 - DNA, 20 bp, Homo sapiens
tctatcaaccccagacactg

SEQ ID NO: 1385764 - DNA, 20 bp, Homo sapiens
tctatgaattcctacacatg

SEQ ID NO: 1385765 - DNA, 14 bp, Homo sapiens
tctatgcattttct

SEQ ID NO: 1385766 - DNA, 13 bp, Homo sapiens
tctcaccaggcag

SEQ ID NO: 1385767 - DNA, 18 bp, Homo sapiens
tctcaccaggcagcctct

SEQ ID NO: 1385768 - DNA, 16 bp, Homo sapiens
tctcagtgaagaatac

SEQ ID NO: 1385769 - DNA, 15 bp, Homo sapiens
tctcagttttcataa

SEQ ID NO: 1385770 - DNA, 13 bp, Homo sapiens
tctcatgaacctc

SEQ ID NO: 1385771 - DNA, 18 bp, Homo sapiens
tctccctcctctgcccgg

SEQ ID NO: 1385772 - DNA, 15 bp, Homo sapiens
tctccctgcctcctg

SEQ ID NO: 1385773 - DNA, 12 bp, Homo sapiens
tctcctcccagg

SEQ ID NO: 1385774 - DNA, 13 bp, Homo sapiens
tctccttgttctg

SEQ ID NO: 1385775 - DNA, 18 bp, Homo sapiens
tctccttgttctgataat

SEQ ID NO: 1385776 - DNA, 22 bp, Homo sapiens
tctctcatgaacctcaagctgc

SEQ ID NO: 1385777 - DNA, 11 bp, Homo sapiens
tctctgcaggt

SEQ ID NO: 1385778 - DNA, 13 bp, Homo sapiens
tctctgcaggtcc

SEQ ID NO: 1385779 - DNA, 14 bp, Homo sapiens
tctctgcaggtccc

SEQ ID NO: 1385780 - DNA, 19 bp, Homo sapiens
tctctgcaggtccctaata

SEQ ID NO: 1385781 - DNA, 20 bp, Homo sapiens
tctctgcaggtccctaataa

SEQ ID NO: 1385782 - DNA, 16 bp, Homo sapiens
tctcttattgcctcac

SEQ ID NO: 1385783 - DNA, 21 bp, Homo sapiens
tctcttctgagctatttcatc

SEQ ID NO: 1385784 - DNA, 22 bp, Homo sapiens
tctcttctgagctatttcatct

SEQ ID NO: 1385785 - DNA, 19 bp, Homo sapiens
tctctttatgtctgtggat

SEQ ID NO: 1385786 - DNA, 16 bp, Homo sapiens
tctgaactcaaactga

SEQ ID NO: 1385787 - DNA, 21 bp, Homo sapiens
tctgaagctcaactctcttat

SEQ ID NO: 1385788 - DNA, 19 bp, Homo sapiens
tctgaatttttaaacaagt

SEQ ID NO: 1385789 - DNA, 17 bp, Homo sapiens
tctgacattctgattcg

SEQ ID NO: 1385790 - DNA, 14 bp, Homo sapiens
tctgactctgagct

SEQ ID NO: 1385791 - DNA, 20 bp, Homo sapiens
tctgagagaggccattcttt

SEQ ID NO: 1385792 - DNA, 16 bp, Homo sapiens
tatatgttattaaaca

SEQ ID NO: 1385793 - DNA, 13 bp, Homo sapiens
tatattatctttt

SEQ ID NO: 1385794 - DNA, 16 bp, Homo sapiens
tatattttacaatttt

SEQ ID NO: 1385795 - DNA, 23 bp, Homo sapiens
tatcaaataactaaggaatatat

SEQ ID NO: 1385796 - DNA, 22 bp, Homo sapiens
tatcaacatctttttcctccct

SEQ ID NO: 1385797 - DNA, 14 bp, Homo sapiens
tatcaacttcctaa

SEQ ID NO: 1385798 - DNA, 19 bp, Homo sapiens
tatcaacttcctaaatatt

SEQ ID NO: 1385799 - DNA, 23 bp, Homo sapiens
tatcatcagtgtagaacctaatt

SEQ ID NO: 1385800 - DNA, 17 bp, Homo sapiens
tatcatgcatgtcctgt

SEQ ID NO: 1385801 - DNA, 19 bp, Homo sapiens
tatcatgcatgtcctgtaa

SEQ ID NO: 1385802 - DNA, 18 bp, Homo sapiens
tatccaattaaaattaag

SEQ ID NO: 1385803 - DNA, 14 bp, Homo sapiens
tatccctcctgttg

SEQ ID NO: 1385804 - DNA, 16 bp, Homo sapiens
tatcctgaaatttcag

SEQ ID NO: 1385805 - DNA, 17 bp, Homo sapiens
tatctacttccaaacta

SEQ ID NO: 1385806 - DNA, 22 bp, Homo sapiens
tatctacttccaaactaatttt

SEQ ID NO: 1385807 - DNA, 17 bp, Homo sapiens
tatctaggcaacatagt

SEQ ID NO: 1385808 - DNA, 16 bp, Homo sapiens
tatctctgtgtgcaca

SEQ ID NO: 1385809 - DNA, 23 bp, Homo sapiens
tatctctgtgtgcacaaatattt

SEQ ID NO: 1385810 - DNA, 20 bp, Homo sapiens
tatctgaatttttaaacaag

SEQ ID NO: 1385811 - DNA, 23 bp, Homo sapiens
tatctgaggcactgataatatgt

SEQ ID NO: 1385812 - DNA, 17 bp, Homo sapiens
tatcttactatttcaca

SEQ ID NO: 1385813 - DNA, 23 bp, Homo sapiens
tatcttggtgaatttttttttcc

SEQ ID NO: 1385814 - DNA, 14 bp, Homo sapiens
tatgaaaaagaaga

SEQ ID NO: 1385815 - DNA, 19 bp, Homo sapiens
tatgaacatattgttgaaa

SEQ ID NO: 1385816 - DNA, 14 bp, Homo sapiens
tatgaagaactgag

SEQ ID NO: 1385817 - DNA, 16 bp, Homo sapiens
tatgaagaactgagga

SEQ ID NO: 1385818 - DNA, 20 bp, Homo sapiens
tatgacatcacttgtacaaa

SEQ ID NO: 1385819 - DNA, 23 bp, Homo sapiens
tatgactccactgtggaaaatgc

SEQ ID NO: 1385820 - DNA, 14 bp, Homo sapiens
tatgagctcttcat

SEQ ID NO: 1385821 - DNA, 15 bp, Homo sapiens
tatgagctcttcatg

SEQ ID NO: 1385822 - DNA, 17 bp, Homo sapiens
tatgaggacttgtgtct

SEQ ID NO: 1385823 - DNA, 22 bp, Homo sapiens
tatgatattttctgtgcctgaa

SEQ ID NO: 1385824 - DNA, 21 bp, Homo sapiens
tatgatgggtgtttttagcag

SEQ ID NO: 1385825 - DNA, 18 bp, Homo sapiens
tatgatgttaaaaaaata

SEQ ID NO: 1385826 - DNA, 17 bp, Homo sapiens
tatgatttttttttcat

SEQ ID NO: 1385827 - DNA, 18 bp, Homo sapiens
tatgcctgctatttgaag

SEQ ID NO: 1385828 - DNA, 15 bp, Homo sapiens
tatgcttactgatat

SEQ ID NO: 1385829 - DNA, 15 bp, Homo sapiens
tatgctttgaaacag

SEQ ID NO: 1385830 - DNA, 23 bp, Homo sapiens
tatggtgctctgtctacttgctc

SEQ ID NO: 1385831 - DNA, 15 bp, Homo sapiens
tatgtaaaacattta

SEQ ID NO: 1385832 - DNA, 23 bp, Homo sapiens
tatgtagaaaaaagtaaatgtga

SEQ ID NO: 1385833 - DNA, 14 bp, Homo sapiens
tatgtagataacaa

SEQ ID NO: 1385834 - DNA, 16 bp, Homo sapiens
tatgtcatttcatttc

SEQ ID NO: 1385835 - DNA, 23 bp, Homo sapiens
tatgtgggcagattttcagcaaa

SEQ ID NO: 1385836 - DNA, 12 bp, Homo sapiens
tatgtgttttaa

SEQ ID NO: 1385837 - DNA, 16 bp, Homo sapiens
tatgtgttttaataaa

SEQ ID NO: 1385838 - DNA, 17 bp, Homo sapiens
tatgtgttttaataaac

SEQ ID NO: 1385839 - DNA, 18 bp, Homo sapiens
tatgtgttttaataaacg

SEQ ID NO: 1385840 - DNA, 20 bp, Homo sapiens
tatgtgttttaataaacgtt

SEQ ID NO: 1385841 - DNA, 18 bp, Homo sapiens
tatgttactacatgcact

SEQ ID NO: 1385842 - DNA, 20 bp, Homo sapiens
tattaaaaaggtttacagaa

SEQ ID NO: 1385843 - DNA, 19 bp, Homo sapiens
tattaaacaggtggttctt

SEQ ID NO: 1385844 - DNA, 18 bp, Homo sapiens
tattaatatatattatct

SEQ ID NO: 1385845 - DNA, 16 bp, Homo sapiens
tattaatatttatgtg

SEQ ID NO: 1385846 - DNA, 17 bp, Homo sapiens
tattaatttatgcagaa

SEQ ID NO: 1385847 - DNA, 16 bp, Homo sapiens
tattatccccatttct

SEQ ID NO: 1385848 - DNA, 17 bp, Homo sapiens
tattatgagatgctggc

SEQ ID NO: 1385849 - DNA, 15 bp, Homo sapiens
tattcattttctcta

SEQ ID NO: 1385850 - DNA, 17 bp, Homo sapiens
tattccccattcttcct

SEQ ID NO: 1385851 - DNA, 18 bp, Homo sapiens
tattgataagatctttta

SEQ ID NO: 1385852 - DNA, 16 bp, Homo sapiens
tattggaatataattg

SEQ ID NO: 1385853 - DNA, 17 bp, Homo sapiens
tattggacaaagaacct

SEQ ID NO: 1385854 - DNA, 19 bp, Homo sapiens
tattgtgcaatgtaaatat

SEQ ID NO: 1385855 - DNA, 21 bp, Homo sapiens
tattgtgcacatttaataatc

SEQ ID NO: 1385856 - DNA, 14 bp, Homo sapiens
tatttaaaatagca

SEQ ID NO: 1385857 - DNA, 15 bp, Homo sapiens
tatttaaaatagcaa

SEQ ID NO: 1385858 - DNA, 17 bp, Homo sapiens
tatttaaacaaatgtgt

SEQ ID NO: 1385859 - DNA, 21 bp, Homo sapiens
tatttaaaccgctaaaagaaa

SEQ ID NO: 1385860 - DNA, 13 bp, Homo sapiens
tatttaatagcaa

SEQ ID NO: 1385861 - DNA, 18 bp, Homo sapiens
tatttaatagcaaagaat

SEQ ID NO: 1385862 - DNA, 22 bp, Homo sapiens
tatttaatagcaaagaattgac

SEQ ID NO: 1385863 - DNA, 17 bp, Homo sapiens
tatttatatgttattaa

SEQ ID NO: 1385864 - DNA, 18 bp, Homo sapiens
cttttcccaaaatgttga

SEQ ID NO: 1385865 - DNA, 16 bp, Homo sapiens
cttttcttaaaccttc

SEQ ID NO: 1385866 - DNA, 23 bp, Homo sapiens
cttttgcggttcaggaaaattga

SEQ ID NO: 1385867 - DNA, 10 bp, Homo sapiens
cttttgtaag

SEQ ID NO: 1385868 - DNA, 14 bp, Homo sapiens
ctttttatttgcat

SEQ ID NO: 1385869 - DNA, 15 bp, Homo sapiens
ctttttatttgcatg

SEQ ID NO: 1385870 - DNA, 23 bp, Homo sapiens
ctttttccaacttggctgcagga

SEQ ID NO: 1385871 - DNA, 14 bp, Homo sapiens
gaaaaatgtaggag

SEQ ID NO: 1385872 - DNA, 13 bp, Homo sapiens
gaaaataaagaat

SEQ ID NO: 1385873 - DNA, 19 bp, Homo sapiens
gaaaataagagctcaggat

SEQ ID NO: 1385874 - DNA, 19 bp, Homo sapiens
gaaaatgctatcaaataac

SEQ ID NO: 1385875 - DNA, 23 bp, Homo sapiens
gaaacaaaaacactaaaaataaa

SEQ ID NO: 1385876 - DNA, 22 bp, Homo sapiens
gaaacattgttaatataattta

SEQ ID NO: 1385877 - DNA, 23 bp, Homo sapiens
gaaacattgttaatataatttaa

SEQ ID NO: 1385878 - DNA, 14 bp, Homo sapiens
gaaaccttgaagtt

SEQ ID NO: 1385879 - DNA, 16 bp, Homo sapiens
gaaactttctttctca

SEQ ID NO: 1385880 - DNA, 18 bp, Homo sapiens
gaaacttttttatttaaa

SEQ ID NO: 1385881 - DNA, 16 bp, Homo sapiens
gaaagagatacagagg

SEQ ID NO: 1385882 - DNA, 23 bp, Homo sapiens
gaaagccaaggagtcactgagac

SEQ ID NO: 1385883 - DNA, 15 bp, Homo sapiens
gaaagccctaaaata

SEQ ID NO: 1385884 - DNA, 17 bp, Homo sapiens
gaaagccctaaaatact

SEQ ID NO: 1385885 - DNA, 21 bp, Homo sapiens
taaagattttttaataattta

SEQ ID NO: 1385886 - DNA, 21 bp, Homo sapiens
taaagcgtttgcacagatcaa

SEQ ID NO: 1385887 - DNA, 15 bp, Homo sapiens
taaagctaaaataaa

SEQ ID NO: 1385888 - DNA, 22 bp, Homo sapiens
taaagctaaaataaagaaatag

SEQ ID NO: 1385889 - DNA, 19 bp, Homo sapiens
taaagctggtttaatgttt

SEQ ID NO: 1385890 - DNA, 16 bp, Homo sapiens
taaaggcaaaggcaat

SEQ ID NO: 1385891 - DNA, 16 bp, Homo sapiens
taaagtaaaaaagtta

SEQ ID NO: 1385892 - DNA, 21 bp, Homo sapiens
taaagtaaaaaagttaaatgt

SEQ ID NO: 1385893 - DNA, 22 bp, Homo sapiens
taaagtaaaaaagttaaatgtg

SEQ ID NO: 1385894 - DNA, 15 bp, Homo sapiens
taaagttcaacatgt

SEQ ID NO: 1385895 - DNA, 18 bp, Homo sapiens
taaatacttttttctatt

SEQ ID NO: 1385896 - DNA, 17 bp, Homo sapiens
taaatattttaaagaat

SEQ ID NO: 1385897 - DNA, 18 bp, Homo sapiens
taaatattttaaagaatt

SEQ ID NO: 1385898 - DNA, 13 bp, Homo sapiens
taaatgtaaagat

SEQ ID NO: 1385899 - DNA, 16 bp, Homo sapiens
taaatgtgtgtaaaaa

SEQ ID NO: 1385900 - DNA, 14 bp, Homo sapiens
taaattaagacttt

SEQ ID NO: 1385901 - DNA, 16 bp, Homo sapiens
taaattatatctgagg

SEQ ID NO: 1385902 - DNA, 16 bp, Homo sapiens
taaattgatgttgctg

SEQ ID NO: 1385903 - DNA, 20 bp, Homo sapiens
taacaagatatttatatgtt

SEQ ID NO: 1385904 - DNA, 23 bp, Homo sapiens
taacaagatatttatatgttatt

SEQ ID NO: 1385905 - DNA, 16 bp, Homo sapiens
taacaattaggcagac

SEQ ID NO: 1385906 - DNA, 18 bp, Homo sapiens
taacagaagttgtgaaac

SEQ ID NO: 1385907 - DNA, 22 bp, Homo sapiens
taacatacctaagaagtacatt

SEQ ID NO: 1385908 - DNA, 13 bp, Homo sapiens
taaccagttattt

SEQ ID NO: 1385909 - DNA, 21 bp, Homo sapiens
taaccttaccagatttttaca

SEQ ID NO: 1385910 - DNA, 17 bp, Homo sapiens
taacgtttaagccaaaa

SEQ ID NO: 1385911 - DNA, 21 bp, Homo sapiens
taactaaggaatatatatgga

SEQ ID NO: 1385912 - DNA, 14 bp, Homo sapiens
taactgaaaatgtg

SEQ ID NO: 1385913 - DNA, 20 bp, Homo sapiens
taactgaaaattatttaaac

SEQ ID NO: 1385914 - DNA, 20 bp, Homo sapiens
taactgggtaatgaaacaaa

SEQ ID NO: 1385915 - DNA, 14 bp, Homo sapiens
taacttaaatagta

SEQ ID NO: 1385916 - DNA, 13 bp, Homo sapiens
taacttttgtaag

SEQ ID NO: 1385917 - DNA, 21 bp, Homo sapiens
taagaagaatgcttaatcaga

SEQ ID NO: 1385918 - DNA, 12 bp, Homo sapiens
taagagaagtag

SEQ ID NO: 1385919 - DNA, 14 bp, Homo sapiens
taagagaagtagaa

SEQ ID NO: 1385920 - DNA, 22 bp, Homo sapiens
taagattaaattatatctgagg

SEQ ID NO: 1385921 - DNA, 16 bp, Homo sapiens
taagcttttcttttct

SEQ ID NO: 1385922 - DNA, 20 bp, Homo sapiens
taaggaaatcaacttgctta

SEQ ID NO: 1385923 - DNA, 12 bp, Homo sapiens
taagtgtacata

SEQ ID NO: 1385924 - DNA, 20 bp, Homo sapiens
taagtgtacatatgtaaaat

SEQ ID NO: 1385925 - DNA, 14 bp, Homo sapiens
taagttaatttaaa

SEQ ID NO: 1385926 - DNA, 14 bp, Homo sapiens
taagttttttactt

SEQ ID NO: 1385927 - DNA, 16 bp, Homo sapiens
taataaaaagattgaa

SEQ ID NO: 1385928 - DNA, 12 bp, Homo sapiens
taataaagctgt

SEQ ID NO: 1385929 - DNA, 21 bp, Homo sapiens
taatacagcaacaatttatga

SEQ ID NO: 1385930 - DNA, 20 bp, Homo sapiens
taatacattccaactcgtat

SEQ ID NO: 1385931 - DNA, 22 bp, Homo sapiens
taatagatgtttgatagatttt

SEQ ID NO: 1385932 - DNA, 21 bp, Homo sapiens
taatataatttaacagaagtt

SEQ ID NO: 1385933 - DNA, 17 bp, Homo sapiens
taatatcctaaacatca

SEQ ID NO: 1385934 - DNA, 17 bp, Homo sapiens
taatatgtttgaggtta

SEQ ID NO: 1385935 - DNA, 18 bp, Homo sapiens
taatatttatgtgtttta

SEQ ID NO: 1385936 - DNA, 18 bp, Homo sapiens
taatcacgctttcctgaa

SEQ ID NO: 1385937 - DNA, 15 bp, Homo sapiens
taatcagacaccaga

SEQ ID NO: 1385938 - DNA, 15 bp, Homo sapiens
taatctgcctccctc

SEQ ID NO: 1385939 - DNA, 14 bp, Homo sapiens
taatcttctgcctt

SEQ ID NO: 1385940 - DNA, 19 bp, Homo sapiens
taatgcatgtggtatgagt

SEQ ID NO: 1385941 - DNA, 21 bp, Homo sapiens
taatggctgataattttaaat

SEQ ID NO: 1385942 - DNA, 16 bp, Homo sapiens
taatggtgccttcatt

SEQ ID NO: 1385943 - DNA, 13 bp, Homo sapiens
taatgttaatatt

SEQ ID NO: 1385944 - DNA, 19 bp, Homo sapiens
taattaagggacatgtatg

SEQ ID NO: 1385945 - DNA, 17 bp, Homo sapiens
taattaccaacctgtta

SEQ ID NO: 1385946 - DNA, 14 bp, Homo sapiens
taattatccaggaa

SEQ ID NO: 1385947 - DNA, 19 bp, Homo sapiens
taattcaattcaaagctgt

SEQ ID NO: 1385948 - DNA, 21 bp, Homo sapiens
taatttaacagaagttgtgaa

SEQ ID NO: 1385949 - DNA, 15 bp, Homo sapiens
taatttagaaatcat

SEQ ID NO: 1385950 - DNA, 15 bp, Homo sapiens
taatttgagagaaat

SEQ ID NO: 1385951 - DNA, 23 bp, Homo sapiens
taatttttgatactaagcattga

SEQ ID NO: 1385952 - DNA, 17 bp, Homo sapiens
tacaaagcccttttata

SEQ ID NO: 1385953 - DNA, 21 bp, Homo sapiens
tacaagcattctgtcttgaag

SEQ ID NO: 1385954 - DNA, 22 bp, Homo sapiens
tacaagccactaccttctgacc

SEQ ID NO: 1385955 - DNA, 16 bp, Homo sapiens
tacaagcctgcacaat

SEQ ID NO: 1385956 - DNA, 15 bp, Homo sapiens
tacaagtaacaaaaa

SEQ ID NO: 1385957 - DNA, 16 bp, Homo sapiens
tacaataattctatga

SEQ ID NO: 1385958 - DNA, 17 bp, Homo sapiens
tacacagcaccagaatg

SEQ ID NO: 1385959 - DNA, 21 bp, Homo sapiens
tacacatgtatctatgcattt

SEQ ID NO: 1385960 - DNA, 14 bp, Homo sapiens
tacactcctgctgt

SEQ ID NO: 1385961 - DNA, 15 bp, Homo sapiens
tacactcctgctgtg

SEQ ID NO: 1385962 - DNA, 14 bp, Homo sapiens
tacagaaagctgcc

SEQ ID NO: 1385963 - DNA, 14 bp, Homo sapiens
tacagaattcaaca

SEQ ID NO: 1385964 - DNA, 13 bp, Homo sapiens
tacataactgaaa

SEQ ID NO: 1385965 - DNA, 15 bp, Homo sapiens
tacataactgaaaat

SEQ ID NO: 1385966 - DNA, 17 bp, Homo sapiens
tacataactgaaaatgt

SEQ ID NO: 1385967 - DNA, 21 bp, Homo sapiens
tacataactgaaaatgtgcta

SEQ ID NO: 1385968 - DNA, 20 bp, Homo sapiens
tacatacagaattactgtaa

SEQ ID NO: 1385969 - DNA, 14 bp, Homo sapiens
tacatagatgctta

SEQ ID NO: 1385970 - DNA, 15 bp, Homo sapiens
tacatatgtaaaata

SEQ ID NO: 1385971 - DNA, 20 bp, Homo sapiens
tacatatgtaaaatattgtt

SEQ ID NO: 1385972 - DNA, 21 bp, Homo sapiens
tacatatgtaaaatattgtta

SEQ ID NO: 1385973 - DNA, 13 bp, Homo sapiens
tacatgaaacaga

SEQ ID NO: 1385974 - DNA, 15 bp, Homo sapiens
tacatgattcatttt

SEQ ID NO: 1385975 - DNA, 20 bp, Homo sapiens
tacatgcattactgcatgca

SEQ ID NO: 1385976 - DNA, 19 bp, Homo sapiens
tacatgctaagagaagtag

SEQ ID NO: 1385977 - DNA, 22 bp, Homo sapiens
tacatgtttgcacctttctagt

SEQ ID NO: 1385978 - DNA, 17 bp, Homo sapiens
tacattgttacctctat

SEQ ID NO: 1385979 - DNA, 15 bp, Homo sapiens
tacattttctaagaa

SEQ ID NO: 1385980 - DNA, 12 bp, Homo sapiens
taccaaagcaca

SEQ ID NO: 1385981 - DNA, 21 bp, Homo sapiens
taccactgctgatattttctc

SEQ ID NO: 1385982 - DNA, 22 bp, Homo sapiens
taccactgctgatattttctct

SEQ ID NO: 1385983 - DNA, 16 bp, Homo sapiens
taccatatacagctca

SEQ ID NO: 1385984 - DNA, 17 bp, Homo sapiens
taccatcactgagtttt

SEQ ID NO: 1385985 - DNA, 20 bp, Homo sapiens
taccatcactgagttttcca

SEQ ID NO: 1385986 - DNA, 22 bp, Homo sapiens
tacccagtaactcatctgtcac

SEQ ID NO: 1385987 - DNA, 17 bp, Homo sapiens
tacctaagaagtacatt

SEQ ID NO: 1385988 - DNA, 14 bp, Homo sapiens
tacctccaaaaaag

SEQ ID NO: 1385989 - DNA, 14 bp, Homo sapiens
tacctgttgagcat

SEQ ID NO: 1385990 - DNA, 21 bp, Homo sapiens
tacctgttgagcatcacagaa

SEQ ID NO: 1385991 - DNA, 23 bp, Homo sapiens
tacgacagtacactgtcagcagg

SEQ ID NO: 1385992 - DNA, 18 bp, Homo sapiens
tacgataggtagaattgt

SEQ ID NO: 1385993 - DNA, 13 bp, Homo sapiens
tactacatgcact

SEQ ID NO: 1385994 - DNA, 14 bp, Homo sapiens
tactactgtgtaag

SEQ ID NO: 1385995 - DNA, 22 bp, Homo sapiens
tactattggagagaaaaaatta

SEQ ID NO: 1385996 - DNA, 17 bp, Homo sapiens
tactcttcttgaaattt

SEQ ID NO: 1385997 - DNA, 14 bp, Homo sapiens
tactgatatatttt

SEQ ID NO: 1385998 - DNA, 16 bp, Homo sapiens
tactgatatattttac

SEQ ID NO: 1385999 - DNA, 21 bp, Homo sapiens
tactgcaaggttcaacttatt

SEQ ID NO: 1386000 - DNA, 15 bp, Homo sapiens
tactgcatacttttt

SEQ ID NO: 1386001 - DNA, 18 bp, Homo sapiens
tactgcatactttttaaa

SEQ ID NO: 1386002 - DNA, 13 bp, Homo sapiens
tactggtccaaaa

SEQ ID NO: 1386003 - DNA, 23 bp, Homo sapiens
tactggtccaaaagattgctgaa

SEQ ID NO: 1386004 - DNA, 18 bp, Homo sapiens
tactggtcttgtggaatt

SEQ ID NO: 1386005 - DNA, 17 bp, Homo sapiens
tacttatttttgacagt

SEQ ID NO: 1386006 - DNA, 19 bp, Homo sapiens
tacttatttttgacagtgt

SEQ ID NO: 1386007 - DNA, 20 bp, Homo sapiens
tacttcctctaggaaatgta

SEQ ID NO: 1386008 - DNA, 14 bp, Homo sapiens
tacttgagataatc

SEQ ID NO: 1386009 - DNA, 17 bp, Homo sapiens
tacttgctcaggtactt

SEQ ID NO: 1386010 - DNA, 13 bp, Homo sapiens
tacttgctcttga

SEQ ID NO: 1386011 - DNA, 14 bp, Homo sapiens
tacttgctcttgat

SEQ ID NO: 1386012 - DNA, 18 bp, Homo sapiens
tacttgctcttgatgcct

SEQ ID NO: 1386013 - DNA, 14 bp, Homo sapiens
tacttttaaactgt

SEQ ID NO: 1386014 - DNA, 19 bp, Homo sapiens
tagaaattacacccaaaga

SEQ ID NO: 1386015 - DNA, 16 bp, Homo sapiens
tgtatcatagaaatgt

SEQ ID NO: 1386016 - DNA, 18 bp, Homo sapiens
tgtatggaaataaatgta

SEQ ID NO: 1386017 - DNA, 14 bp, Homo sapiens
tgtattcagacaga

SEQ ID NO: 1386018 - DNA, 15 bp, Homo sapiens
tgtattccaagacat

SEQ ID NO: 1386019 - DNA, 20 bp, Homo sapiens
tgtattccaagacatgtctg

SEQ ID NO: 1386020 - DNA, 16 bp, Homo sapiens
tgtattttagcagaga

SEQ ID NO: 1386021 - DNA, 13 bp, Homo sapiens
tgtcaaacaaata

SEQ ID NO: 1386022 - DNA, 21 bp, Homo sapiens
tgtcaagggttcaagattgtt

SEQ ID NO: 1386023 - DNA, 14 bp, Homo sapiens
tgtcacgccagact

SEQ ID NO: 1386024 - DNA, 12 bp, Homo sapiens
tgtcattgttat

SEQ ID NO: 1386025 - DNA, 15 bp, Homo sapiens
tgtccagataagtta

SEQ ID NO: 1386026 - DNA, 16 bp, Homo sapiens
tgtcccaggtcctcac

SEQ ID NO: 1386027 - DNA, 15 bp, Homo sapiens
tgtccgactcttctg

SEQ ID NO: 1386028 - DNA, 22 bp, Homo sapiens
tgtcctgtaaaggttacaagcc

SEQ ID NO: 1386029 - DNA, 21 bp, Homo sapiens
tgtctggtggtggcaccatct

SEQ ID NO: 1386030 - DNA, 15 bp, Homo sapiens
tgtctgtggattttt

SEQ ID NO: 1386031 - DNA, 16 bp, Homo sapiens
tgtgaatcaagggtca

SEQ ID NO: 1386032 - DNA, 22 bp, Homo sapiens
tgtgaatcaagggtcaggcctt

SEQ ID NO: 1386033 - DNA, 16 bp, Homo sapiens
tgtgacaaaaaattaa

SEQ ID NO: 1386034 - DNA, 17 bp, Homo sapiens
tgtgaccctcaattcat

SEQ ID NO: 1386035 - DNA, 17 bp, Homo sapiens
tgtgactctttccaacc

SEQ ID NO: 1386036 - DNA, 20 bp, Homo sapiens
tgtgattcaatctgtaaact

SEQ ID NO: 1386037 - DNA, 18 bp, Homo sapiens
tgtgcaaggtattacact

SEQ ID NO: 1386038 - DNA, 18 bp, Homo sapiens
tgtgcacatttaataatc

SEQ ID NO: 1386039 - DNA, 16 bp, Homo sapiens
tgtgccccttgacaac

SEQ ID NO: 1386040 - DNA, 23 bp, Homo sapiens
tgtgccccttgacaactggcagg

SEQ ID NO: 1386041 - DNA, 15 bp, Homo sapiens
tgtgcctgaccctac

SEQ ID NO: 1386042 - DNA, 19 bp, Homo sapiens
tgtgccttgtcacgccaga

SEQ ID NO: 1386043 - DNA, 16 bp, Homo sapiens
tgtgcgtggtggtccc

SEQ ID NO: 1386044 - DNA, 22 bp, Homo sapiens
tgtgcgtggtggtccctgggta

SEQ ID NO: 1386045 - DNA, 21 bp, Homo sapiens
tgtgctatactgcatactttt

SEQ ID NO: 1386046 - DNA, 18 bp, Homo sapiens
tgtgctatggtgctctgt

SEQ ID NO: 1386047 - DNA, 21 bp, Homo sapiens
tgtgctcaggagccctgggag

SEQ ID NO: 1386048 - DNA, 16 bp, Homo sapiens
tgtggatatttattta

SEQ ID NO: 1386049 - DNA, 19 bp, Homo sapiens
tgtggatatttatttaaac

SEQ ID NO: 1386050 - DNA, 21 bp, Homo sapiens
tgtggatatttatttaaacaa

SEQ ID NO: 1386051 - DNA, 19 bp, Homo sapiens
tgtggatcaaccatcgctt

SEQ ID NO: 1386052 - DNA, 20 bp, Homo sapiens
tgtggatcaaccatcgcttt

SEQ ID NO: 1386053 - DNA, 16 bp, Homo sapiens
tgtggcatccagagtc

SEQ ID NO: 1386054 - DNA, 14 bp, Homo sapiens
agactctttatgct

SEQ ID NO: 1386055 - DNA, 11 bp, Homo sapiens
agactggacag

SEQ ID NO: 1386056 - DNA, 22 bp, Homo sapiens
agacttcaagcatggctatttt

SEQ ID NO: 1386057 - DNA, 24 bp, Homo sapiens
agacttcaggttgttctgtataaa

SEQ ID NO: 1386058 - DNA, 18 bp, Homo sapiens
agactttaaaagatgaaa

SEQ ID NO: 1386059 - DNA, 17 bp, Homo sapiens
agactttctacacctgt

SEQ ID NO: 1386060 - DNA, 16 bp, Homo sapiens
agagaaagagaaatca

SEQ ID NO: 1386061 - DNA, 20 bp, Homo sapiens
agagacaaacacctcccagg

SEQ ID NO: 1386062 - DNA, 18 bp, Homo sapiens
agagacattaactcatta

SEQ ID NO: 1386063 - DNA, 14 bp, Homo sapiens
agagaggccttttg

SEQ ID NO: 1386064 - DNA, 15 bp, Homo sapiens
agagagttgaaccta

SEQ ID NO: 1386065 - DNA, 13 bp, Homo sapiens
agagatacagagg

SEQ ID NO: 1386066 - DNA, 18 bp, Homo sapiens
agagcaaaataattttaa

SEQ ID NO: 1386067 - DNA, 14 bp, Homo sapiens
agagcactgccacc

SEQ ID NO: 1386068 - DNA, 17 bp, Homo sapiens
agagcactgtatacccc

SEQ ID NO: 1386069 - DNA, 21 bp, Homo sapiens
agagcctgggaaggaggccgc

SEQ ID NO: 1386070 - DNA, 11 bp, Homo sapiens
agagctacata

SEQ ID NO: 1386071 - DNA, 16 bp, Homo sapiens
agagctacataattta

SEQ ID NO: 1386072 - DNA, 10 bp, Homo sapiens
agagctcagg

SEQ ID NO: 1386073 - DNA, 12 bp, Homo sapiens
agagctcaggat

SEQ ID NO: 1386074 - DNA, 13 bp, Homo sapiens
agagctcaggatg

SEQ ID NO: 1386075 - DNA, 13 bp, Homo sapiens
agaggatgttctg

SEQ ID NO: 1386076 - DNA, 19 bp, Homo sapiens
agaggccttttggaatgtg

SEQ ID NO: 1386077 - DNA, 20 bp, Homo sapiens
agaggcttccttcatttcct

SEQ ID NO: 1386078 - DNA, 15 bp, Homo sapiens
agagtgagaatctgg

SEQ ID NO: 1386079 - DNA, 22 bp, Homo sapiens
agagtgagaatctggctcctgt

SEQ ID NO: 1386080 - DNA, 15 bp, Homo sapiens
agagttcaagaaata

SEQ ID NO: 1386081 - DNA, 18 bp, Homo sapiens
agagttcaagaaataagt

SEQ ID NO: 1386082 - DNA, 13 bp, Homo sapiens
agagttgaaccta

SEQ ID NO: 1386083 - DNA, 15 bp, Homo sapiens
agataagttatttat

SEQ ID NO: 1386084 - DNA, 17 bp, Homo sapiens
agataatctaaatataa

SEQ ID NO: 1386085 - DNA, 16 bp, Homo sapiens
agataatctagaacac

SEQ ID NO: 1386086 - DNA, 23 bp, Homo sapiens
agataatctagaacacaggcaaa

SEQ ID NO: 1386087 - DNA, 15 bp, Homo sapiens
agatacactcctgct

SEQ ID NO: 1386088 - DNA, 16 bp, Homo sapiens
agatagaatgacagtc

SEQ ID NO: 1386089 - DNA, 18 bp, Homo sapiens
agatattcctattgtgca

SEQ ID NO: 1386090 - DNA, 17 bp, Homo sapiens
agatattggacaaagaa

SEQ ID NO: 1386091 - DNA, 19 bp, Homo sapiens
agatatttttatctttata

SEQ ID NO: 1386092 - DNA, 19 bp, Homo sapiens
agatcactttctcagtttt

SEQ ID NO: 1386093 - DNA, 19 bp, Homo sapiens
agatcccaacactgccagc

SEQ ID NO: 1386094 - DNA, 20 bp, Homo sapiens
agatcccaacactgccagca

SEQ ID NO: 1386095 - DNA, 13 bp, Homo sapiens
agatctggcatgt

SEQ ID NO: 1386096 - DNA, 16 bp, Homo sapiens
agatcttttattttgc

SEQ ID NO: 1386097 - DNA, 21 bp, Homo sapiens
agatgcatttgggtccaggag

SEQ ID NO: 1386098 - DNA, 22 bp, Homo sapiens
agatgcatttgggtccaggagg

SEQ ID NO: 1386099 - DNA, 23 bp, Homo sapiens
agatgcatttgggtccaggagga

SEQ ID NO: 1386100 - DNA, 19 bp, Homo sapiens
agatgctggcttgggcagc

SEQ ID NO: 1386101 - DNA, 11 bp, Homo sapiens
agatgctttta

SEQ ID NO: 1386102 - DNA, 17 bp, Homo sapiens
agatgtaaaaggtatta

SEQ ID NO: 1386103 - DNA, 13 bp, Homo sapiens
agattaactggta

SEQ ID NO: 1386104 - DNA, 19 bp, Homo sapiens
agattaactggtagttcat

SEQ ID NO: 1386105 - DNA, 13 bp, Homo sapiens
agattcccagagc

SEQ ID NO: 1386106 - DNA, 19 bp, Homo sapiens
agattgagagaagagacaa

SEQ ID NO: 1386107 - DNA, 14 bp, Homo sapiens
agattgctgaaatt

SEQ ID NO: 1386108 - DNA, 12 bp, Homo sapiens
agattgtttgca

SEQ ID NO: 1386109 - DNA, 19 bp, Homo sapiens
agattttcagcaaactctt

SEQ ID NO: 1386110 - DNA, 16 bp, Homo sapiens
agattttctgctactt

SEQ ID NO: 1386111 - DNA, 13 bp, Homo sapiens
agattttgccttt

SEQ ID NO: 1386112 - DNA, 17 bp, Homo sapiens
agcaaaagaatggcaga

SEQ ID NO: 1386113 - DNA, 21 bp, Homo sapiens
agcaaaagaatggcagaaaag

SEQ ID NO: 1386114 - DNA, 11 bp, Homo sapiens
agcaaatcacc

SEQ ID NO: 1386115 - DNA, 21 bp, Homo sapiens
agcaaatcaccacaaactgta

SEQ ID NO: 1386116 - DNA, 17 bp, Homo sapiens
agcaaatcgaatgaaat

SEQ ID NO: 1386117 - DNA, 22 bp, Homo sapiens
agcaaatcgaatgaaattaact

SEQ ID NO: 1386118 - DNA, 15 bp, Homo sapiens
agcaacctcagtaat

SEQ ID NO: 1386119 - DNA, 19 bp, Homo sapiens
agcaagaaggcaaaaatag

SEQ ID NO: 1386120 - DNA, 12 bp, Homo sapiens
agcactgtatac

SEQ ID NO: 1386121 - DNA, 15 bp, Homo sapiens
agcacttctttttct

SEQ ID NO: 1386122 - DNA, 18 bp, Homo sapiens
agcagaagcagggtaccc

SEQ ID NO: 1386123 - DNA, 16 bp, Homo sapiens
agcagactcagctctg

SEQ ID NO: 1386124 - DNA, 20 bp, Homo sapiens
agcagactcagctctgacat

SEQ ID NO: 1386125 - DNA, 16 bp, Homo sapiens
agcagcctcattctga

SEQ ID NO: 1386126 - DNA, 16 bp, Homo sapiens
agcaggaggccaataa

SEQ ID NO: 1386127 - DNA, 20 bp, Homo sapiens
agcaggaggccaataaaaag

SEQ ID NO: 1386128 - DNA, 16 bp, Homo sapiens
aactgggggaaaagat

SEQ ID NO: 1386129 - DNA, 14 bp, Homo sapiens
aactggtagttcat

SEQ ID NO: 1386130 - DNA, 17 bp, Homo sapiens
aacttcaaggaaaataa

SEQ ID NO: 1386131 - DNA, 21 bp, Homo sapiens
aacttcaaggaaaataagtga

SEQ ID NO: 1386132 - DNA, 22 bp, Homo sapiens
aacttcaaggaaaataagtgaa

SEQ ID NO: 1386133 - DNA, 20 bp, Homo sapiens
aacttcatatatgaggactt

SEQ ID NO: 1386134 - DNA, 18 bp, Homo sapiens
aacttgcttatcaacttc

SEQ ID NO: 1386135 - DNA, 16 bp, Homo sapiens
aacttggttttgctac

SEQ ID NO: 1386136 - DNA, 21 bp, Homo sapiens
aacttggttttgctacataat

SEQ ID NO: 1386137 - DNA, 11 bp, Homo sapiens
aacttttgtaa

SEQ ID NO: 1386138 - DNA, 20 bp, Homo sapiens
aactttttattgatttttgg

SEQ ID NO: 1386139 - DNA, 15 bp, Homo sapiens
aagaaacctactgcc

SEQ ID NO: 1386140 - DNA, 20 bp, Homo sapiens
aagaaactgaggaattttct

SEQ ID NO: 1386141 - DNA, 21 bp, Homo sapiens
aagaaactgaggaattttctt

SEQ ID NO: 1386142 - DNA, 11 bp, Homo sapiens
aagaaactttc

SEQ ID NO: 1386143 - DNA, 22 bp, Homo sapiens
aagaaagccctaaaatactatt

SEQ ID NO: 1386144 - DNA, 15 bp, Homo sapiens
aagaaataagttttt

SEQ ID NO: 1386145 - DNA, 20 bp, Homo sapiens
aagaaatagaacaaggctga

SEQ ID NO: 1386146 - DNA, 13 bp, Homo sapiens
aagaaatatacct

SEQ ID NO: 1386147 - DNA, 16 bp, Homo sapiens
aagaaattgcctcctt

SEQ ID NO: 1386148 - DNA, 18 bp, Homo sapiens
aagaactttgagctactg

SEQ ID NO: 1386149 - DNA, 21 bp, Homo sapiens
aagaagcaacctcagtaattt

SEQ ID NO: 1386150 - DNA, 16 bp, Homo sapiens
aagaagggactgagag

SEQ ID NO: 1386151 - DNA, 22 bp, Homo sapiens
aagaagtaaaagcaaaaaagaa

SEQ ID NO: 1386152 - DNA, 12 bp, Homo sapiens
aagaatctcatc

SEQ ID NO: 1386153 - DNA, 20 bp, Homo sapiens
aagaatcttggtttgccttc

SEQ ID NO: 1386154 - DNA, 17 bp, Homo sapiens
aagaatgcttaatcaga

SEQ ID NO: 1386155 - DNA, 11 bp, Homo sapiens
aagaattattt

SEQ ID NO: 1386156 - DNA, 14 bp, Homo sapiens
aagaattattttgt

SEQ ID NO: 1386157 - DNA, 17 bp, Homo sapiens
aagacaaaggttttcct

SEQ ID NO: 1386158 - DNA, 16 bp, Homo sapiens
aagacaagtacataaa

SEQ ID NO: 1386159 - DNA, 18 bp, Homo sapiens
aagacaccgttcattcag

SEQ ID NO: 1386160 - DNA, 18 bp, Homo sapiens
aagacagaagtttgcact

SEQ ID NO: 1386161 - DNA, 12 bp, Homo sapiens
aagacatgtctg

SEQ ID NO: 1386162 - DNA, 19 bp, Homo sapiens
aagacatgtctgttctaca

SEQ ID NO: 1386163 - DNA, 13 bp, Homo sapiens
aagaccctccccg

SEQ ID NO: 1386164 - DNA, 18 bp, Homo sapiens
aagactgctgtggccagg

SEQ ID NO: 1386165 - DNA, 13 bp, Homo sapiens
aagacttgacagt

SEQ ID NO: 1386166 - DNA, 14 bp, Homo sapiens
aagacttgacagtg

SEQ ID NO: 1386167 - DNA, 22 bp, Homo sapiens
aagagaatgcccttctccttat

SEQ ID NO: 1386168 - DNA, 23 bp, Homo sapiens
aagagaatgcccttctccttatt

SEQ ID NO: 1386169 - DNA, 15 bp, Homo sapiens
aagagcaaaagaatg

SEQ ID NO: 1386170 - DNA, 20 bp, Homo sapiens
aagagctacgtatttaatag

SEQ ID NO: 1386171 - DNA, 17 bp, Homo sapiens
aagaggtgttttttcta

SEQ ID NO: 1386172 - DNA, 15 bp, Homo sapiens
aagatatttatatgt

SEQ ID NO: 1386173 - DNA, 15 bp, Homo sapiens
aagatcactttctca

SEQ ID NO: 1386174 - DNA, 17 bp, Homo sapiens
aagatcactttctcagt

SEQ ID NO: 1386175 - DNA, 17 bp, Homo sapiens
aagatcttttattttgc

SEQ ID NO: 1386176 - DNA, 18 bp, Homo sapiens
aagatcttttattttgcc

SEQ ID NO: 1386177 - DNA, 12 bp, Homo sapiens
aagatgctttta

SEQ ID NO: 1386178 - DNA, 21 bp, Homo sapiens
aagattaaattatatctgagg

SEQ ID NO: 1386179 - DNA, 20 bp, Homo sapiens
aagattaactggtagttcat

SEQ ID NO: 1386180 - DNA, 20 bp, Homo sapiens
aagattactcagtaatttgt

SEQ ID NO: 1386181 - DNA, 12 bp, Homo sapiens
aagattgctgaa

SEQ ID NO: 1386182 - DNA, 15 bp, Homo sapiens
aagattgctgaaatt

SEQ ID NO: 1386183 - DNA, 15 bp, Homo sapiens
aagattgttcctgct

SEQ ID NO: 1386184 - DNA, 16 bp, Homo sapiens
aagattttttaataat

SEQ ID NO: 1386185 - DNA, 17 bp, Homo sapiens
aagattttttaataatt

SEQ ID NO: 1386186 - DNA, 19 bp, Homo sapiens
aagcaacctcagtaattta

SEQ ID NO: 1386187 - DNA, 14 bp, Homo sapiens
aagcagggtaccct

SEQ ID NO: 1386188 - DNA, 12 bp, Homo sapiens
aagcatgaaatg

SEQ ID NO: 1386189 - DNA, 13 bp, Homo sapiens
aagcattgaatgg

SEQ ID NO: 1386190 - DNA, 16 bp, Homo sapiens
aagcattgaatggcta

SEQ ID NO: 1386191 - DNA, 18 bp, Homo sapiens
aagccaaaacaatgttta

SEQ ID NO: 1386192 - DNA, 17 bp, Homo sapiens
aagccagctttccctgc

SEQ ID NO: 1386193 - DNA, 19 bp, Homo sapiens
aagcgattctcttgcctca

SEQ ID NO: 1386194 - DNA, 19 bp, Homo sapiens
aagctagaattgagtgttt

SEQ ID NO: 1386195 - DNA, 14 bp, Homo sapiens
aagctcacttctgg

SEQ ID NO: 1386196 - DNA, 20 bp, Homo sapiens
aagctgcctggtatatccaa

SEQ ID NO: 1386197 - DNA, 21 bp, Homo sapiens
aagctttactttagaatttag

SEQ ID NO: 1386198 - DNA, 19 bp, Homo sapiens
aagctttggtgagaacctg

SEQ ID NO: 1386199 - DNA, 21 bp, Homo sapiens
aaggactatgaaaagctagaa

SEQ ID NO: 1386200 - DNA, 15 bp, Homo sapiens
aaggaggggtacatt

SEQ ID NO: 1386201 - DNA, 18 bp, Homo sapiens
aaggattaagatacactc

SEQ ID NO: 1386202 - DNA, 13 bp, Homo sapiens
aaggcaaaaatag

SEQ ID NO: 1386203 - DNA, 17 bp, Homo sapiens
aaggcatggcggccccc

SEQ ID NO: 1386204 - DNA, 14 bp, Homo sapiens
aaggctcttttgta

SEQ ID NO: 1386205 - DNA, 14 bp, Homo sapiens
aaggctttctctac

SEQ ID NO: 1386206 - DNA, 21 bp, Homo sapiens
aagggactgagagatgcagaa

SEQ ID NO: 1386207 - DNA, 12 bp, Homo sapiens
aagggccaaaga

SEQ ID NO: 1386208 - DNA, 22 bp, Homo sapiens
aagggccaaagaaccaaagaag

SEQ ID NO: 1386209 - DNA, 17 bp, Homo sapiens
aagggtagaaaacttca

SEQ ID NO: 1386210 - DNA, 11 bp, Homo sapiens
aagggtcaggc

SEQ ID NO: 1386211 - DNA, 16 bp, Homo sapiens
aagggtcaggcctttg

SEQ ID NO: 1386212 - DNA, 14 bp, Homo sapiens
aaggtaaaatgcca

SEQ ID NO: 1386213 - DNA, 18 bp, Homo sapiens
aaggtaaaatgccatgat

SEQ ID NO: 1386214 - DNA, 18 bp, Homo sapiens
aaggtattaaattgatgt

SEQ ID NO: 1386215 - DNA, 13 bp, Homo sapiens
aaggtctttggtt

SEQ ID NO: 1386216 - DNA, 15 bp, Homo sapiens
aaggtggtgtttctg

SEQ ID NO: 1386217 - DNA, 20 bp, Homo sapiens
aaggttttcctcttctattt

SEQ ID NO: 1386218 - DNA, 21 bp, Homo sapiens
aagtaaaaaagttaaatgtgt

SEQ ID NO: 1386219 - DNA, 12 bp, Homo sapiens
aagtaacaaaaa

SEQ ID NO: 1386220 - DNA, 13 bp, Homo sapiens
aagtagaaatcat

SEQ ID NO: 1386221 - DNA, 21 bp, Homo sapiens
aagtatttgttaatttagaaa

SEQ ID NO: 1386222 - DNA, 21 bp, Homo sapiens
aagtcaggcccttattttcaa

SEQ ID NO: 1386223 - DNA, 13 bp, Homo sapiens
aagtctgtttact

SEQ ID NO: 1386224 - DNA, 18 bp, Homo sapiens
aagtgaaattttaaaagt

SEQ ID NO: 1386225 - DNA, 16 bp, Homo sapiens
aagtgaatttgcctgt

SEQ ID NO: 1386226 - DNA, 13 bp, Homo sapiens
aagtgactaccag

SEQ ID NO: 1386227 - DNA, 20 bp, Homo sapiens
aagtgactaccagaaagtga

SEQ ID NO: 1386228 - DNA, 13 bp, Homo sapiens
aagtgatgtcaga

SEQ ID NO: 1386229 - DNA, 14 bp, Homo sapiens
aagtgtaattgaga

SEQ ID NO: 1386230 - DNA, 20 bp, Homo sapiens
aagttacatgtttgcacctt

SEQ ID NO: 1386231 - DNA, 16 bp, Homo sapiens
aagttagctttaactt

SEQ ID NO: 1386232 - DNA, 16 bp, Homo sapiens
aagttatttaaatctg

SEQ ID NO: 1386233 - DNA, 23 bp, Homo sapiens
aagttcaaattcttctgaactca

SEQ ID NO: 1386234 - DNA, 20 bp, Homo sapiens
aagttgttccttaagtcaga

SEQ ID NO: 1386235 - DNA, 16 bp, Homo sapiens
aagtttaccagaaagc

SEQ ID NO: 1386236 - DNA, 21 bp, Homo sapiens
aagtttagcccctgaaagcca

SEQ ID NO: 1386237 - DNA, 15 bp, Homo sapiens
aagtttcatcatttt

SEQ ID NO: 1386238 - DNA, 21 bp, Homo sapiens
aagtttgcactatctttcagc

SEQ ID NO: 1386239 - DNA, 12 bp, Homo sapiens
aataaaaagttc

SEQ ID NO: 1386240 - DNA, 15 bp, Homo sapiens
aataaaaagttcaga

SEQ ID NO: 1386241 - DNA, 12 bp, Homo sapiens
aataaagaatgg

SEQ ID NO: 1386242 - DNA, 20 bp, Homo sapiens
aataaatttattttcttgga

SEQ ID NO: 1386243 - DNA, 13 bp, Homo sapiens
aataacaatgtgc

SEQ ID NO: 1386244 - DNA, 19 bp, Homo sapiens
aataacaatgtgctctcgg

SEQ ID NO: 1386245 - DNA, 15 bp, Homo sapiens
aataaggtacaagaa

SEQ ID NO: 1386246 - DNA, 14 bp, Homo sapiens
aataagtgaaattt

SEQ ID NO: 1386247 - DNA, 21 bp, Homo sapiens
aataagtgaaattttaaaagt

SEQ ID NO: 1386248 - DNA, 16 bp, Homo sapiens
aataattttaaacaaa

SEQ ID NO: 1386249 - DNA, 21 bp, Homo sapiens
aatacatgctaagagaagtag

SEQ ID NO: 1386250 - DNA, 16 bp, Homo sapiens
aatactcacctcctcc

SEQ ID NO: 1386251 - DNA, 11 bp, Homo sapiens
aatagatgttt

SEQ ID NO: 1386252 - DNA, 18 bp, Homo sapiens
aatagcaaagaattgact

SEQ ID NO: 1386253 - DNA, 21 bp, Homo sapiens
aatagctaaatacctcaatca

SEQ ID NO: 1386254 - DNA, 18 bp, Homo sapiens
aatagcttccaataaagc

SEQ ID NO: 1386255 - DNA, 21 bp, Homo sapiens
aatagggctgagctctctgtg

SEQ ID NO: 1386256 - DNA, 21 bp, Homo sapiens
aatagtaagcctccctcctcg

SEQ ID NO: 1386257 - DNA, 15 bp, Homo sapiens
aatagtatttcccat

SEQ ID NO: 1386258 - DNA, 14 bp, Homo sapiens
aatagtttggatat

SEQ ID NO: 1386259 - DNA, 21 bp, Homo sapiens
actagacaagccagaacttga

SEQ ID NO: 1386260 - DNA, 16 bp, Homo sapiens
actagagcaagcagga

SEQ ID NO: 1386261 - DNA, 17 bp, Homo sapiens
actagcccaatgaaatg

SEQ ID NO: 1386262 - DNA, 18 bp, Homo sapiens
actagccctcctttttcc

SEQ ID NO: 1386263 - DNA, 15 bp, Homo sapiens
actagggagccatgt

SEQ ID NO: 1386264 - DNA, 20 bp, Homo sapiens
actagttgtgtctggcagtt

SEQ ID NO: 1386265 - DNA, 19 bp, Homo sapiens
actatgaaaagctagaatt

SEQ ID NO: 1386266 - DNA, 20 bp, Homo sapiens
actatgaaaagctagaattg

SEQ ID NO: 1386267 - DNA, 22 bp, Homo sapiens
actattaaaaaggtttacagaa

SEQ ID NO: 1386268 - DNA, 15 bp, Homo sapiens
actcaaaatatttgt

SEQ ID NO: 1386269 - DNA, 19 bp, Homo sapiens
actcaaaatatttgtacat

SEQ ID NO: 1386270 - DNA, 20 bp, Homo sapiens
actcaaaatatttgtacata

SEQ ID NO: 1386271 - DNA, 21 bp, Homo sapiens
actcacacctgaactgaacac

SEQ ID NO: 1386272 - DNA, 15 bp, Homo sapiens
actcaggtggcccta

SEQ ID NO: 1386273 - DNA, 15 bp, Homo sapiens
actcatgtgactctt

SEQ ID NO: 1386274 - DNA, 18 bp, Homo sapiens
actcatgtgactctttcc

SEQ ID NO: 1386275 - DNA, 23 bp, Homo sapiens
actcatttttcatgataatgaac

SEQ ID NO: 1386276 - DNA, 10 bp, Homo sapiens
actcctgcct

SEQ ID NO: 1386277 - DNA, 12 bp, Homo sapiens
actcctgcctgt

SEQ ID NO: 1386278 - DNA, 18 bp, Homo sapiens
actcctgcctgtgtttgt

SEQ ID NO: 1386279 - DNA, 23 bp, Homo sapiens
actccttgattttagccttctct

SEQ ID NO: 1386280 - DNA, 19 bp, Homo sapiens
actcgtatagcatgcatct

SEQ ID NO: 1386281 - DNA, 14 bp, Homo sapiens
actcgttttttaca

SEQ ID NO: 1386282 - DNA, 14 bp, Homo sapiens
actctaagaaagaa

SEQ ID NO: 1386283 - DNA, 22 bp, Homo sapiens
actctatatagctgatcagttt

SEQ ID NO: 1386284 - DNA, 14 bp, Homo sapiens
actctgagtgtttt

SEQ ID NO: 1386285 - DNA, 16 bp, Homo sapiens
actctgcttgattttt

SEQ ID NO: 1386286 - DNA, 16 bp, Homo sapiens
actcttcactcttcaa

SEQ ID NO: 1386287 - DNA, 15 bp, Homo sapiens
actcttcttgaaatt

SEQ ID NO: 1386288 - DNA, 19 bp, Homo sapiens
actcttcttgaaattttaa

SEQ ID NO: 1386289 - DNA, 17 bp, Homo sapiens
actctttatgcttgcaa

SEQ ID NO: 1386290 - DNA, 18 bp, Homo sapiens
actgaatttttaaaatgc

SEQ ID NO: 1386291 - DNA, 16 bp, Homo sapiens
actgagaccaaggctt

SEQ ID NO: 1386292 - DNA, 17 bp, Homo sapiens
actgatatattttacaa

SEQ ID NO: 1386293 - DNA, 18 bp, Homo sapiens
actgcaacctccacctcc

SEQ ID NO: 1386294 - DNA, 13 bp, Homo sapiens
actgcatactttt

SEQ ID NO: 1386295 - DNA, 18 bp, Homo sapiens
actgcatgcacttcttac

SEQ ID NO: 1386296 - DNA, 20 bp, Homo sapiens
actgccaagactgctgtggc

SEQ ID NO: 1386297 - DNA, 18 bp, Homo sapiens
actgctgagatacataca

SEQ ID NO: 1386298 - DNA, 19 bp, Homo sapiens
actgctgagatacatacag

SEQ ID NO: 1386299 - DNA, 20 bp, Homo sapiens
actgctgagatacatacaga

SEQ ID NO: 1386300 - DNA, 18 bp, Homo sapiens
actgcttggagctgagca

SEQ ID NO: 1386301 - DNA, 16 bp, Homo sapiens
actggaacactagaca

SEQ ID NO: 1386302 - DNA, 18 bp, Homo sapiens
actggaacttgaactgat

SEQ ID NO: 1386303 - DNA, 16 bp, Homo sapiens
actggaccactgggca

SEQ ID NO: 1386304 - DNA, 20 bp, Homo sapiens
actggaccactgggcaatga

SEQ ID NO: 1386305 - DNA, 22 bp, Homo sapiens
actggagtgtgcgtggtggtcc

SEQ ID NO: 1386306 - DNA, 21 bp, Homo sapiens
actggcaggcaggctcccagg

SEQ ID NO: 1386307 - DNA, 21 bp, Homo sapiens
actggcatggatatagtttta

SEQ ID NO: 1386308 - DNA, 14 bp, Homo sapiens
actggggcaggggc

SEQ ID NO: 1386309 - DNA, 14 bp, Homo sapiens
actgggtaatgaaa

SEQ ID NO: 1386310 - DNA, 22 bp, Homo sapiens
actggtccaaaagattgctgaa

SEQ ID NO: 1386311 - DNA, 14 bp, Homo sapiens
actgtaaacacaga

SEQ ID NO: 1386312 - DNA, 14 bp, Homo sapiens
actgtaaacccctg

SEQ ID NO: 1386313 - DNA, 15 bp, Homo sapiens
actgtacttgctctt

SEQ ID NO: 1386314 - DNA, 19 bp, Homo sapiens
actgtagaatgatttcatg

SEQ ID NO: 1386315 - DNA, 20 bp, Homo sapiens
actgtagaatgatttcatgc

SEQ ID NO: 1386316 - DNA, 15 bp, Homo sapiens
actgtcactgttcct

SEQ ID NO: 1386317 - DNA, 18 bp, Homo sapiens
actgtctctcatgaacct

SEQ ID NO: 1386318 - DNA, 16 bp, Homo sapiens
actgtgccatgtgttt

SEQ ID NO: 1386319 - DNA, 12 bp, Homo sapiens
actgtgtgctca

SEQ ID NO: 1386320 - DNA, 15 bp, Homo sapiens
actgtgtgctcagga

SEQ ID NO: 1386321 - DNA, 20 bp, Homo sapiens
actgtgtgctcaggagccct

SEQ ID NO: 1386322 - DNA, 21 bp, Homo sapiens
actgtgtgctcaggagccctg

SEQ ID NO: 1386323 - DNA, 18 bp, Homo sapiens
actgtttttcggacagtt

SEQ ID NO: 1386324 - DNA, 13 bp, Homo sapiens
acttaagattaaa

SEQ ID NO: 1386325 - DNA, 17 bp, Homo sapiens
acttacatgattcattt

SEQ ID NO: 1386326 - DNA, 21 bp, Homo sapiens
acttaccaggcaccaaaagaa

SEQ ID NO: 1386327 - DNA, 22 bp, Homo sapiens
acttaccaggcaccaaaagaag

SEQ ID NO: 1386328 - DNA, 13 bp, Homo sapiens
acttactttttct

SEQ ID NO: 1386329 - DNA, 20 bp, Homo sapiens
acttattggaactctgcttg

SEQ ID NO: 1386330 - DNA, 20 bp, Homo sapiens
acttcaaggaaaataagtga

SEQ ID NO: 1386331 - DNA, 22 bp, Homo sapiens
acttcaaggaaaataagtgaaa

SEQ ID NO: 1386332 - DNA, 22 bp, Homo sapiens
acttcaggttgttctgtataaa

SEQ ID NO: 1386333 - DNA, 18 bp, Homo sapiens
acttcatatatgaggact

SEQ ID NO: 1386334 - DNA, 18 bp, Homo sapiens
acttccaaactaattttt

SEQ ID NO: 1386335 - DNA, 17 bp, Homo sapiens
acttgatgtaactgaga

SEQ ID NO: 1386336 - DNA, 20 bp, Homo sapiens
acttgatgtaactgagaatt

SEQ ID NO: 1386337 - DNA, 21 bp, Homo sapiens
acttgcaaccgtctgttatgc

SEQ ID NO: 1386338 - DNA, 22 bp, Homo sapiens
acttgctcaggtacttgtaaat

SEQ ID NO: 1386339 - DNA, 19 bp, Homo sapiens
acttgcttatcaacttcct

SEQ ID NO: 1386340 - DNA, 18 bp, Homo sapiens
acttgtacaaaataaaca

SEQ ID NO: 1386341 - DNA, 13 bp, Homo sapiens
acttgtcatgtga

SEQ ID NO: 1386342 - DNA, 24 bp, Homo sapiens
acttgtcattgttatataatcatt

SEQ ID NO: 1386343 - DNA, 16 bp, Homo sapiens
acttgtgtctctgtgc

SEQ ID NO: 1386344 - DNA, 21 bp, Homo sapiens
acttgtgtctctgtgctttta

SEQ ID NO: 1386345 - DNA, 18 bp, Homo sapiens
actttacacaatagaatt

SEQ ID NO: 1386346 - DNA, 20 bp, Homo sapiens
actttacacaatagaattat

SEQ ID NO: 1386347 - DNA, 14 bp, Homo sapiens
actttctcagtttt

SEQ ID NO: 1386348 - DNA, 18 bp, Homo sapiens
actttctcagttttcata

SEQ ID NO: 1386349 - DNA, 13 bp, Homo sapiens
actttctttctca

SEQ ID NO: 1386350 - DNA, 20 bp, Homo sapiens
actttgactttttgcattta

SEQ ID NO: 1386351 - DNA, 14 bp, Homo sapiens
actttgataaagta

SEQ ID NO: 1386352 - DNA, 21 bp, Homo sapiens
acttttacaagtaacaaaaat

SEQ ID NO: 1386353 - DNA, 18 bp, Homo sapiens
acttttcctttgaatcct

SEQ ID NO: 1386354 - DNA, 17 bp, Homo sapiens
acttttgtaagacaaag

SEQ ID NO: 1386355 - DNA, 22 bp, Homo sapiens
actttttttttttaagagtaaa

SEQ ID NO: 1386356 - DNA, 19 bp, Homo sapiens
agaaaaattaattctcttg

SEQ ID NO: 1386357 - DNA, 13 bp, Homo sapiens
agaaaacaaaact

SEQ ID NO: 1386358 - DNA, 23 bp, Homo sapiens
agaaaacataatcttctgccttc

SEQ ID NO: 1386359 - DNA, 18 bp, Homo sapiens
agaaacaaggttttcagt

SEQ ID NO: 1386360 - DNA, 19 bp, Homo sapiens
agaaacatttatattgata

SEQ ID NO: 1386361 - DNA, 15 bp, Homo sapiens
agaaacctactgccc

SEQ ID NO: 1386362 - DNA, 15 bp, Homo sapiens
agaaacttttttatt

SEQ ID NO: 1386363 - DNA, 19 bp, Homo sapiens
agaaacttttttatttaaa

SEQ ID NO: 1386364 - DNA, 16 bp, Homo sapiens
agaaagagaaatcaga

SEQ ID NO: 1386365 - DNA, 15 bp, Homo sapiens
agaaagccttctttt

SEQ ID NO: 1386366 - DNA, 13 bp, Homo sapiens
agaaataagtttt

SEQ ID NO: 1386367 - DNA, 14 bp, Homo sapiens
agaaataagttttt

SEQ ID NO: 1386368 - DNA, 16 bp, Homo sapiens
agaaataagtttttgt

SEQ ID NO: 1386369 - DNA, 23 bp, Homo sapiens
agaaatacaaaaatactcagata

SEQ ID NO: 1386370 - DNA, 14 bp, Homo sapiens
agaaatcatagctg

SEQ ID NO: 1386371 - DNA, 22 bp, Homo sapiens
agaaatcattttgcaatccctt

SEQ ID NO: 1386372 - DNA, 11 bp, Homo sapiens
agaaatgccaa

SEQ ID NO: 1386373 - DNA, 14 bp, Homo sapiens
agaaatgccaagca

SEQ ID NO: 1386374 - DNA, 21 bp, Homo sapiens
agaaatgccaagcacttcttt

SEQ ID NO: 1386375 - DNA, 16 bp, Homo sapiens
agaaattgcctcctta

SEQ ID NO: 1386376 - DNA, 16 bp, Homo sapiens
agaaatttaaactata

SEQ ID NO: 1386377 - DNA, 18 bp, Homo sapiens
agaacagcagactcagct

SEQ ID NO: 1386378 - DNA, 11 bp, Homo sapiens
agaaccaaaga

SEQ ID NO: 1386379 - DNA, 16 bp, Homo sapiens
agaaccaaagaagaaa

SEQ ID NO: 1386380 - DNA, 19 bp, Homo sapiens
agaaccaaagaagaaagtc

SEQ ID NO: 1386381 - DNA, 13 bp, Homo sapiens
agaaccacactgt

SEQ ID NO: 1386382 - DNA, 14 bp, Homo sapiens
agaacctaattcaa

SEQ ID NO: 1386383 - DNA, 19 bp, Homo sapiens
agaacctaattcaattcaa

SEQ ID NO: 1386384 - DNA, 14 bp, Homo sapiens
agaaccttctctat

SEQ ID NO: 1386385 - DNA, 19 bp, Homo sapiens
agaactccggaatgaccag

SEQ ID NO: 1386386 - DNA, 23 bp, Homo sapiens
agaagcaacctcagtaatttaga

SEQ ID NO: 1386387 - DNA, 15 bp, Homo sapiens
agaagcagggtaccc

SEQ ID NO: 1386388 - DNA, 16 bp, Homo sapiens
agaaggcaaaaatagt

SEQ ID NO: 1386389 - DNA, 14 bp, Homo sapiens
agtcagaacagcag

SEQ ID NO: 1386390 - DNA, 22 bp, Homo sapiens
agtcagaacagcagactcagct

SEQ ID NO: 1386391 - DNA, 20 bp, Homo sapiens
agtcattgggttttatcagt

SEQ ID NO: 1386392 - DNA, 18 bp, Homo sapiens
agtccacccttggttcct

SEQ ID NO: 1386393 - DNA, 16 bp, Homo sapiens
agtccatcagcctcca

SEQ ID NO: 1386394 - DNA, 19 bp, Homo sapiens
agtcccagaaccacactgt

SEQ ID NO: 1386395 - DNA, 13 bp, Homo sapiens
agtccctgcctgg

SEQ ID NO: 1386396 - DNA, 14 bp, Homo sapiens
agtccctgcctgga

SEQ ID NO: 1386397 - DNA, 14 bp, Homo sapiens
agtccgtcaaaaca

SEQ ID NO: 1386398 - DNA, 21 bp, Homo sapiens
agtctaaagctggtttaatgt

SEQ ID NO: 1386399 - DNA, 16 bp, Homo sapiens
agtctgaatttttaaa

SEQ ID NO: 1386400 - DNA, 15 bp, Homo sapiens
agtctggtgaagctc

SEQ ID NO: 1386401 - DNA, 16 bp, Homo sapiens
agtcttcctgacactt

SEQ ID NO: 1386402 - DNA, 16 bp, Homo sapiens
agtgaaattttaaaag

SEQ ID NO: 1386403 - DNA, 18 bp, Homo sapiens
agtgaaattttaaaagtc

SEQ ID NO: 1386404 - DNA, 14 bp, Homo sapiens
agtgaatttgcctg

SEQ ID NO: 1386405 - DNA, 12 bp, Homo sapiens
agtgacagctag

SEQ ID NO: 1386406 - DNA, 20 bp, Homo sapiens
agtgacagctaggatgtgca

SEQ ID NO: 1386407 - DNA, 11 bp, Homo sapiens
agtgagcctga

SEQ ID NO: 1386408 - DNA, 14 bp, Homo sapiens
agtgcaaggaccta

SEQ ID NO: 1386409 - DNA, 16 bp, Homo sapiens
agtgcaccaaagagaa

SEQ ID NO: 1386410 - DNA, 20 bp, Homo sapiens
agtgcaccaaagagaatgcc

SEQ ID NO: 1386411 - DNA, 18 bp, Homo sapiens
agtgcagcaaccagagca

SEQ ID NO: 1386412 - DNA, 22 bp, Homo sapiens
agtgcatttatgagctcttcat

SEQ ID NO: 1386413 - DNA, 16 bp, Homo sapiens
agtgccattaacaaat

SEQ ID NO: 1386414 - DNA, 19 bp, Homo sapiens
agtgggaaaaatgtaggag

SEQ ID NO: 1386415 - DNA, 19 bp, Homo sapiens
agtgggggtgggggtaggg

SEQ ID NO: 1386416 - DNA, 18 bp, Homo sapiens
agtgtacatatgtaaaat

SEQ ID NO: 1386417 - DNA, 20 bp, Homo sapiens
agtgtagaacctaattcaat

SEQ ID NO: 1386418 - DNA, 16 bp, Homo sapiens
agtgtatggaaataaa

SEQ ID NO: 1386419 - DNA, 20 bp, Homo sapiens
agtgtatggaaataaatgta

SEQ ID NO: 1386420 - DNA, 14 bp, Homo sapiens
agtgtcctcagggg

SEQ ID NO: 1386421 - DNA, 22 bp, Homo sapiens
agtgtccttggcaggctgattt

SEQ ID NO: 1386422 - DNA, 22 bp, Homo sapiens
agtgtgaccaaaagttacatgt

SEQ ID NO: 1386423 - DNA, 22 bp, Homo sapiens
agtgtgcttctgttatcaaaca

SEQ ID NO: 1386424 - DNA, 12 bp, Homo sapiens
agttaaatgtgt

SEQ ID NO: 1386425 - DNA, 14 bp, Homo sapiens
agttaaatgtgtgt

SEQ ID NO: 1386426 - DNA, 17 bp, Homo sapiens
agttaaatgtgtgtaaa

SEQ ID NO: 1386427 - DNA, 23 bp, Homo sapiens
agttaaatgtgtgtaaaaaagtg

SEQ ID NO: 1386428 - DNA, 14 bp, Homo sapiens
agttaatttaaagt

SEQ ID NO: 1386429 - DNA, 15 bp, Homo sapiens
agttacatgtttgca

SEQ ID NO: 1386430 - DNA, 22 bp, Homo sapiens
agttagctttaacttaaatagt

SEQ ID NO: 1386431 - DNA, 12 bp, Homo sapiens
agttatttaaat

SEQ ID NO: 1386432 - DNA, 15 bp, Homo sapiens
agttatttttattat

SEQ ID NO: 1386433 - DNA, 13 bp, Homo sapiens
agttcaacatgtt

SEQ ID NO: 1386434 - DNA, 17 bp, Homo sapiens
agttcatgtctgctatc

SEQ ID NO: 1386435 - DNA, 18 bp, Homo sapiens
agttcattgtaaatgaac

SEQ ID NO: 1386436 - DNA, 23 bp, Homo sapiens
agttcattgtaaatgaacataat

SEQ ID NO: 1386437 - DNA, 17 bp, Homo sapiens
agttctttaaaatgtaa

SEQ ID NO: 1386438 - DNA, 16 bp, Homo sapiens
agttgattttctggat

SEQ ID NO: 1386439 - DNA, 17 bp, Homo sapiens
agttgcacagctatgaa

SEQ ID NO: 1386440 - DNA, 17 bp, Homo sapiens
agttgctgcaaacctga

SEQ ID NO: 1386441 - DNA, 17 bp, Homo sapiens
agttggacacactgtaa

SEQ ID NO: 1386442 - DNA, 16 bp, Homo sapiens
agttggggacacatgt

SEQ ID NO: 1386443 - DNA, 17 bp, Homo sapiens
agtttaataaatttatt

SEQ ID NO: 1386444 - DNA, 20 bp, Homo sapiens
agtttaatggtgccttcatt

SEQ ID NO: 1386445 - DNA, 18 bp, Homo sapiens
agtttatatttaactctc

SEQ ID NO: 1386446 - DNA, 23 bp, Homo sapiens
agtttatttgttgagagtgtgac

SEQ ID NO: 1386447 - DNA, 14 bp, Homo sapiens
agtttggatatgta

SEQ ID NO: 1386448 - DNA, 18 bp, Homo sapiens
agttttcctatgctttga

SEQ ID NO: 1386449 - DNA, 14 bp, Homo sapiens
ataaaaagatcact

SEQ ID NO: 1386450 - DNA, 18 bp, Homo sapiens
ataaaaagatcactttct

SEQ ID NO: 1386451 - DNA, 12 bp, Homo sapiens
ataaaaaggtgt

SEQ ID NO: 1386452 - DNA, 11 bp, Homo sapiens
ataaaaagttc

SEQ ID NO: 1386453 - DNA, 12 bp, Homo sapiens
ataaaaatgaat

SEQ ID NO: 1386454 - DNA, 14 bp, Homo sapiens
ataaaacctcagct

SEQ ID NO: 1386455 - DNA, 19 bp, Homo sapiens
ataaaacctcagctagctc

SEQ ID NO: 1386456 - DNA, 15 bp, Homo sapiens
ataaacgtttgaaat

SEQ ID NO: 1386457 - DNA, 18 bp, Homo sapiens
ataaagaaatagaacaag

SEQ ID NO: 1386458 - DNA, 13 bp, Homo sapiens
ataaagatttttt

SEQ ID NO: 1386459 - DNA, 17 bp, Homo sapiens
ataaagattttttaata

SEQ ID NO: 1386460 - DNA, 22 bp, Homo sapiens
ataaagcagcctcattctgagg

SEQ ID NO: 1386461 - DNA, 20 bp, Homo sapiens
ataaagttgataaagatttt

SEQ ID NO: 1386462 - DNA, 21 bp, Homo sapiens
ataaagttgataaagattttt

SEQ ID NO: 1386463 - DNA, 14 bp, Homo sapiens
ataaatatccttta

SEQ ID NO: 1386464 - DNA, 17 bp, Homo sapiens
ataaatgtatcatagaa

SEQ ID NO: 1386465 - DNA, 21 bp, Homo sapiens
ataaatgtatcatagaaatgt

SEQ ID NO: 1386466 - DNA, 13 bp, Homo sapiens
ataaattaagact

SEQ ID NO: 1386467 - DNA, 13 bp, Homo sapiens
ataaattattgtt

SEQ ID NO: 1386468 - DNA, 22 bp, Homo sapiens
ataacgtttaagccaaaacaat

SEQ ID NO: 1386469 - DNA, 12 bp, Homo sapiens
ataactaaggaa

SEQ ID NO: 1386470 - DNA, 14 bp, Homo sapiens
ataactgaaaatta

SEQ ID NO: 1386471 - DNA, 15 bp, Homo sapiens
ataactggaaagaag

SEQ ID NO: 1386472 - DNA, 19 bp, Homo sapiens
ataacttgagacctaatct

SEQ ID NO: 1386473 - DNA, 21 bp, Homo sapiens
ataacttgagacctaatctct

SEQ ID NO: 1386474 - DNA, 13 bp, Homo sapiens
ataagaaactttt

SEQ ID NO: 1386475 - DNA, 14 bp, Homo sapiens
ataagaaacttttt

SEQ ID NO: 1386476 - DNA, 15 bp, Homo sapiens
ataagatcttttatt

SEQ ID NO: 1386477 - DNA, 17 bp, Homo sapiens
ataagatcttttatttt

SEQ ID NO: 1386478 - DNA, 23 bp, Homo sapiens
ataagcaagaaggcaaaaatagt

SEQ ID NO: 1386479 - DNA, 16 bp, Homo sapiens
ataaggtaaaatgcca

SEQ ID NO: 1386480 - DNA, 16 bp, Homo sapiens
ataagtgtacatatgt

SEQ ID NO: 1386481 - DNA, 24 bp, Homo sapiens
ataagttcaaattcttctgaactc

SEQ ID NO: 1386482 - DNA, 12 bp, Homo sapiens
ataatctagaac

SEQ ID NO: 1386483 - DNA, 17 bp, Homo sapiens
ataatcttctgccttct

SEQ ID NO: 1386484 - DNA, 22 bp, Homo sapiens
ataatgaacagaatttatgact

SEQ ID NO: 1386485 - DNA, 15 bp, Homo sapiens
ataatttaacagaag

SEQ ID NO: 1386486 - DNA, 18 bp, Homo sapiens
atacaaaaatactcagat

SEQ ID NO: 1386487 - DNA, 13 bp, Homo sapiens
atacactcctgct

SEQ ID NO: 1386488 - DNA, 17 bp, Homo sapiens
atacatacagaattact

SEQ ID NO: 1386489 - DNA, 22 bp, Homo sapiens
atacatgctaagagaagtagaa

SEQ ID NO: 1386490 - DNA, 16 bp, Homo sapiens
atacattttctaagaa

SEQ ID NO: 1386491 - DNA, 17 bp, Homo sapiens
ataccaaagcacatttt

SEQ ID NO: 1386492 - DNA, 12 bp, Homo sapiens
atacctcacttt

SEQ ID NO: 1386493 - DNA, 20 bp, Homo sapiens
atacctgattttttttcctt

SEQ ID NO: 1386494 - DNA, 17 bp, Homo sapiens
atactaagcattgaatg

SEQ ID NO: 1386495 - DNA, 22 bp, Homo sapiens
atactcacctcctcccagactt

SEQ ID NO: 1386496 - DNA, 21 bp, Homo sapiens
atactgcttggagctgagcaa

SEQ ID NO: 1386497 - DNA, 20 bp, Homo sapiens
atacttttacaagtaacaaa

SEQ ID NO: 1386498 - DNA, 19 bp, Homo sapiens
atagaaatgccaagcactt

SEQ ID NO: 1386499 - DNA, 14 bp, Homo sapiens
atagaacaaggctg

SEQ ID NO: 1386500 - DNA, 14 bp, Homo sapiens
atagacagaagaaa

SEQ ID NO: 1386501 - DNA, 16 bp, Homo sapiens
atagacagaagaaaca

SEQ ID NO: 1386502 - DNA, 17 bp, Homo sapiens
atagacagaagaaacaa

SEQ ID NO: 1386503 - DNA, 18 bp, Homo sapiens
atagccaaaaatagctaa

SEQ ID NO: 1386504 - DNA, 13 bp, Homo sapiens
atagctaaatacc

SEQ ID NO: 1386505 - DNA, 18 bp, Homo sapiens
atagtaagcctccctcct

SEQ ID NO: 1386506 - DNA, 18 bp, Homo sapiens
atataattgttttatctg

SEQ ID NO: 1386507 - DNA, 23 bp, Homo sapiens
atataatttaacagaagttgtga

SEQ ID NO: 1386508 - DNA, 12 bp, Homo sapiens
atataccaaagc

SEQ ID NO: 1386509 - DNA, 17 bp, Homo sapiens
atataccaaagcacatt

SEQ ID NO: 1386510 - DNA, 18 bp, Homo sapiens
atatacttttacaagtaa

SEQ ID NO: 1386511 - DNA, 23 bp, Homo sapiens
atatagatcagttataagtagca

SEQ ID NO: 1386512 - DNA, 17 bp, Homo sapiens
atatagctgatcagttt

SEQ ID NO: 1386513 - DNA, 14 bp, Homo sapiens
atatatactattaa

SEQ ID NO: 1386514 - DNA, 16 bp, Homo sapiens
atatatatatatatgt

SEQ ID NO: 1386515 - DNA, 15 bp, Homo sapiens
atatatatggaataa

SEQ ID NO: 1386516 - DNA, 15 bp, Homo sapiens
atatatatgtacagt

SEQ ID NO: 1386517 - DNA, 20 bp, Homo sapiens
atatatatgtacagttatct

SEQ ID NO: 1386518 - DNA, 20 bp, Homo sapiens
atatatattatcttttcata

SEQ ID NO: 1386519 - DNA, 13 bp, Homo sapiens
atatatgaggact

SEQ ID NO: 1386520 - DNA, 14 bp, Homo sapiens
atttaaacaaatgt

SEQ ID NO: 1386521 - DNA, 18 bp, Homo sapiens
atttaaacaaatgtgtaa

SEQ ID NO: 1386522 - DNA, 14 bp, Homo sapiens
atttaaagttgttt

SEQ ID NO: 1386523 - DNA, 13 bp, Homo sapiens
atttaacaagatc

SEQ ID NO: 1386524 - DNA, 13 bp, Homo sapiens
atttaacagaagt

SEQ ID NO: 1386525 - DNA, 19 bp, Homo sapiens
atttaacagaagttgtgaa

SEQ ID NO: 1386526 - DNA, 20 bp, Homo sapiens
atttaacagaagttgtgaaa

SEQ ID NO: 1386527 - DNA, 21 bp, Homo sapiens
atttaactgcctaaaatgttc

SEQ ID NO: 1386528 - DNA, 20 bp, Homo sapiens
atttaatagcaaagaattga

SEQ ID NO: 1386529 - DNA, 18 bp, Homo sapiens
atttagaaaactttaaag

SEQ ID NO: 1386530 - DNA, 22 bp, Homo sapiens
atttagccctggtttgaaattt

SEQ ID NO: 1386531 - DNA, 23 bp, Homo sapiens
atttagccctggtttgaaatttt

SEQ ID NO: 1386532 - DNA, 17 bp, Homo sapiens
atttaggtttctgagtt

SEQ ID NO: 1386533 - DNA, 21 bp, Homo sapiens
atttaggtttctgagttcctg

SEQ ID NO: 1386534 - DNA, 16 bp, Homo sapiens
atttataaaaaggtgt

SEQ ID NO: 1386535 - DNA, 12 bp, Homo sapiens
atttatatgtta

SEQ ID NO: 1386536 - DNA, 14 bp, Homo sapiens
atttatatgttatt

SEQ ID NO: 1386537 - DNA, 13 bp, Homo sapiens
atttatattgata

SEQ ID NO: 1386538 - DNA, 18 bp, Homo sapiens
atttatattgtaaatatt

SEQ ID NO: 1386539 - DNA, 20 bp, Homo sapiens
atttatcctgaaatttcaga

SEQ ID NO: 1386540 - DNA, 21 bp, Homo sapiens
atttatcctgaaatttcagat

SEQ ID NO: 1386541 - DNA, 12 bp, Homo sapiens
atttattaatat

SEQ ID NO: 1386542 - DNA, 16 bp, Homo sapiens
atttatttaaaatagc

SEQ ID NO: 1386543 - DNA, 17 bp, Homo sapiens
atttatttaaacaaatg

SEQ ID NO: 1386544 - DNA, 16 bp, Homo sapiens
atttcagagaggcctt

SEQ ID NO: 1386545 - DNA, 14 bp, Homo sapiens
atttcatctatttt

SEQ ID NO: 1386546 - DNA, 20 bp, Homo sapiens
atttcccttccttcctctcc

SEQ ID NO: 1386547 - DNA, 17 bp, Homo sapiens
atttctatagccaaaaa

SEQ ID NO: 1386548 - DNA, 14 bp, Homo sapiens
atttcttaaacact

SEQ ID NO: 1386549 - DNA, 21 bp, Homo sapiens
atttcttttttaaatgaagaa

SEQ ID NO: 1386550 - DNA, 17 bp, Homo sapiens
atttgcacaggttttca

SEQ ID NO: 1386551 - DNA, 17 bp, Homo sapiens
atttggcatccctgggc

SEQ ID NO: 1386552 - DNA, 16 bp, Homo sapiens
atttgggtccaggagg

SEQ ID NO: 1386553 - DNA, 22 bp, Homo sapiens
atttgtaatagatgtttgatag

SEQ ID NO: 1386554 - DNA, 15 bp, Homo sapiens
atttgtgacaaaaaa

SEQ ID NO: 1386555 - DNA, 23 bp, Homo sapiens
atttgttaatttagaaaacttta

SEQ ID NO: 1386556 - DNA, 13 bp, Homo sapiens
atttgttggaatg

SEQ ID NO: 1386557 - DNA, 13 bp, Homo sapiens
atttgtttctact

SEQ ID NO: 1386558 - DNA, 13 bp, Homo sapiens
attttaaacaaag

SEQ ID NO: 1386559 - DNA, 13 bp, Homo sapiens
attttaaacacat

SEQ ID NO: 1386560 - DNA, 12 bp, Homo sapiens
attttaaagaat

SEQ ID NO: 1386561 - DNA, 12 bp, Homo sapiens
attttacaattt

SEQ ID NO: 1386562 - DNA, 13 bp, Homo sapiens
attttagcagaga

SEQ ID NO: 1386563 - DNA, 18 bp, Homo sapiens
attttagccttctctgtt

SEQ ID NO: 1386564 - DNA, 18 bp, Homo sapiens
attttagcgtgctcactg

SEQ ID NO: 1386565 - DNA, 15 bp, Homo sapiens
attttatatgcttac

SEQ ID NO: 1386566 - DNA, 16 bp, Homo sapiens
attttatatgcttact

SEQ ID NO: 1386567 - DNA, 18 bp, Homo sapiens
attttatattacactaca

SEQ ID NO: 1386568 - DNA, 14 bp, Homo sapiens
attttatggtgcat

SEQ ID NO: 1386569 - DNA, 14 bp, Homo sapiens
attttcaagaaact

SEQ ID NO: 1386570 - DNA, 16 bp, Homo sapiens
attttcaagaaactga

SEQ ID NO: 1386571 - DNA, 13 bp, Homo sapiens
attttcactgtag

SEQ ID NO: 1386572 - DNA, 18 bp, Homo sapiens
attttcagcaaactcttt

SEQ ID NO: 1386573 - DNA, 19 bp, Homo sapiens
attttcagcaaactctttt

SEQ ID NO: 1386574 - DNA, 18 bp, Homo sapiens
attttcctggtgccaatt

SEQ ID NO: 1386575 - DNA, 22 bp, Homo sapiens
attttctaagaaacatttatat

SEQ ID NO: 1386576 - DNA, 15 bp, Homo sapiens
attttctgctacttt

SEQ ID NO: 1386577 - DNA, 18 bp, Homo sapiens
attttctggaatacatga

SEQ ID NO: 1386578 - DNA, 19 bp, Homo sapiens
attttctggaatacatgaa

SEQ ID NO: 1386579 - DNA, 22 bp, Homo sapiens
attttctggattccccatctca

SEQ ID NO: 1386580 - DNA, 20 bp, Homo sapiens
attttgaacctgatgaaaat

SEQ ID NO: 1386581 - DNA, 24 bp, Homo sapiens
attttgacataaagttgataaaga

SEQ ID NO: 1386582 - DNA, 21 bp, Homo sapiens
attttgcaatcccttaatatc

SEQ ID NO: 1386583 - DNA, 12 bp, Homo sapiens
attttgtaagtt

SEQ ID NO: 1386584 - DNA, 18 bp, Homo sapiens
attttgtgatgcaaataa

SEQ ID NO: 1386585 - DNA, 19 bp, Homo sapiens
attttgttgctgttttgat

SEQ ID NO: 1386586 - DNA, 23 bp, Homo sapiens
attttgttgctgttttgatttgt

SEQ ID NO: 1386587 - DNA, 17 bp, Homo sapiens
atttttaaaacccattt

SEQ ID NO: 1386588 - DNA, 18 bp, Homo sapiens
atttttatttttgctgag

SEQ ID NO: 1386589 - DNA, 18 bp, Homo sapiens
atttttcatgataatgaa

SEQ ID NO: 1386590 - DNA, 21 bp, Homo sapiens
atttttgatactaagcattga

SEQ ID NO: 1386591 - DNA, 18 bp, Homo sapiens
atttttgcctcttccagt

SEQ ID NO: 1386592 - DNA, 15 bp, Homo sapiens
atttttgctgagact

SEQ ID NO: 1386593 - DNA, 14 bp, Homo sapiens
attttttaataatt

SEQ ID NO: 1386594 - DNA, 21 bp, Homo sapiens
attttttatcatgcatgtcct

SEQ ID NO: 1386595 - DNA, 21 bp, Homo sapiens
attttttccttcaaagtttaa

SEQ ID NO: 1386596 - DNA, 20 bp, Homo sapiens
atttttttttcatacactta

SEQ ID NO: 1386597 - DNA, 12 bp, Homo sapiens
caaaaaagaaaa

SEQ ID NO: 1386598 - DNA, 14 bp, Homo sapiens
caaaaatagctaaa

SEQ ID NO: 1386599 - DNA, 18 bp, Homo sapiens
caaaagaagtaaaagcaa

SEQ ID NO: 1386600 - DNA, 16 bp, Homo sapiens
caaaagattgctgaaa

SEQ ID NO: 1386601 - DNA, 19 bp, Homo sapiens
caaaagttacatgtttgca

SEQ ID NO: 1386602 - DNA, 18 bp, Homo sapiens
caaaataaaacctcagct

SEQ ID NO: 1386603 - DNA, 14 bp, Homo sapiens
caaaatggtaattt

SEQ ID NO: 1386604 - DNA, 17 bp, Homo sapiens
caaaatggtaatttcta

SEQ ID NO: 1386605 - DNA, 22 bp, Homo sapiens
caaaatgttgaaatatgatgtt

SEQ ID NO: 1386606 - DNA, 21 bp, Homo sapiens
caaaatgttggtcattttatg

SEQ ID NO: 1386607 - DNA, 16 bp, Homo sapiens
caaacacacacaaaag

SEQ ID NO: 1386608 - DNA, 17 bp, Homo sapiens
caaaccaggactctgcc

SEQ ID NO: 1386609 - DNA, 12 bp, Homo sapiens
caaactcctgcc

SEQ ID NO: 1386610 - DNA, 18 bp, Homo sapiens
caaactcctgcctgtgtt

SEQ ID NO: 1386611 - DNA, 22 bp, Homo sapiens
caaactgaggaatttcacctgt

SEQ ID NO: 1386612 - DNA, 19 bp, Homo sapiens
caaagaaccaaagaagaaa

SEQ ID NO: 1386613 - DNA, 18 bp, Homo sapiens
caaagaaccttctctatg

SEQ ID NO: 1386614 - DNA, 17 bp, Homo sapiens
caaagatatctcatctc

SEQ ID NO: 1386615 - DNA, 20 bp, Homo sapiens
caaagtttaataaatttatt

SEQ ID NO: 1386616 - DNA, 19 bp, Homo sapiens
caaagtttaccagaaagca

SEQ ID NO: 1386617 - DNA, 20 bp, Homo sapiens
caaataactaaggaatatat

SEQ ID NO: 1386618 - DNA, 21 bp, Homo sapiens
caaataactaaggaatatata

SEQ ID NO: 1386619 - DNA, 16 bp, Homo sapiens
caaatcaattactggt

SEQ ID NO: 1386620 - DNA, 13 bp, Homo sapiens
caaatgtgtaatt

SEQ ID NO: 1386621 - DNA, 19 bp, Homo sapiens
caacaacctcaactgccta

SEQ ID NO: 1386622 - DNA, 21 bp, Homo sapiens
caacaagaagggactgagaga

SEQ ID NO: 1386623 - DNA, 23 bp, Homo sapiens
caacatctttttcctccctttcc

SEQ ID NO: 1386624 - DNA, 22 bp, Homo sapiens
caacatttctatagccaaaaat

SEQ ID NO: 1386625 - DNA, 16 bp, Homo sapiens
caaccagagcactgta

SEQ ID NO: 1386626 - DNA, 18 bp, Homo sapiens
caaccattataaccttaa

SEQ ID NO: 1386627 - DNA, 13 bp, Homo sapiens
caaccattccaga

SEQ ID NO: 1386628 - DNA, 22 bp, Homo sapiens
caaccattccagactgcttcca

SEQ ID NO: 1386629 - DNA, 16 bp, Homo sapiens
caaccatttcctcaga

SEQ ID NO: 1386630 - DNA, 16 bp, Homo sapiens
caaccccagacactgg

SEQ ID NO: 1386631 - DNA, 13 bp, Homo sapiens
caaccggctttgt

SEQ ID NO: 1386632 - DNA, 18 bp, Homo sapiens
caacctcagtaatttaga

SEQ ID NO: 1386633 - DNA, 20 bp, Homo sapiens
caacctccacctcctgggtt

SEQ ID NO: 1386634 - DNA, 19 bp, Homo sapiens
caactacccccagctgtgc

SEQ ID NO: 1386635 - DNA, 14 bp, Homo sapiens
caactattttcaga

SEQ ID NO: 1386636 - DNA, 19 bp, Homo sapiens
caactcgtatagcatgcat

SEQ ID NO: 1386637 - DNA, 18 bp, Homo sapiens
caagaaaataagagctca

SEQ ID NO: 1386638 - DNA, 20 bp, Homo sapiens
caagaaaataagagctcagg

SEQ ID NO: 1386639 - DNA, 18 bp, Homo sapiens
caagaaactgaggaattt

SEQ ID NO: 1386640 - DNA, 19 bp, Homo sapiens
caagaaactgaggaatttt

SEQ ID NO: 1386641 - DNA, 23 bp, Homo sapiens
caagaagcattttgtaagttgaa

SEQ ID NO: 1386642 - DNA, 17 bp, Homo sapiens
caagacatgtctgttct

SEQ ID NO: 1386643 - DNA, 17 bp, Homo sapiens
caagatatttatatgtt

SEQ ID NO: 1386644 - DNA, 16 bp, Homo sapiens
caagcattcagaagaa

SEQ ID NO: 1386645 - DNA, 23 bp, Homo sapiens
caagcctgcacaataaaaatgtt

SEQ ID NO: 1386646 - DNA, 21 bp, Homo sapiens
caagcgattctcttgcctcaa

SEQ ID NO: 1386647 - DNA, 15 bp, Homo sapiens
caaggaaaataagtg

SEQ ID NO: 1386648 - DNA, 20 bp, Homo sapiens
caaggaaaataagtgaaatt

SEQ ID NO: 1386649 - DNA, 16 bp, Homo sapiens
caaggagtcactgaga

SEQ ID NO: 1386650 - DNA, 18 bp, Homo sapiens
catttaaaacagacactg

SEQ ID NO: 1386651 - DNA, 23 bp, Homo sapiens
catttaaaacagacactggcatg

SEQ ID NO: 1386652 - DNA, 23 bp, Homo sapiens
catttatcccaaatcctgtctga

SEQ ID NO: 1386653 - DNA, 16 bp, Homo sapiens
catttatgaagcaagc

SEQ ID NO: 1386654 - DNA, 14 bp, Homo sapiens
catttcctcagact

SEQ ID NO: 1386655 - DNA, 22 bp, Homo sapiens
catttcctcagactctaagaaa

SEQ ID NO: 1386656 - DNA, 19 bp, Homo sapiens
catttgcacaggttttcag

SEQ ID NO: 1386657 - DNA, 20 bp, Homo sapiens
catttgctgaatagctacta

SEQ ID NO: 1386658 - DNA, 20 bp, Homo sapiens
catttggcatccctgggcct

SEQ ID NO: 1386659 - DNA, 15 bp, Homo sapiens
catttgggtccagga

SEQ ID NO: 1386660 - DNA, 16 bp, Homo sapiens
catttgggtccaggag

SEQ ID NO: 1386661 - DNA, 15 bp, Homo sapiens
catttgtttctactt

SEQ ID NO: 1386662 - DNA, 14 bp, Homo sapiens
ccaaactcctgcct

SEQ ID NO: 1386663 - DNA, 15 bp, Homo sapiens
ccaacactgccagca

SEQ ID NO: 1386664 - DNA, 14 bp, Homo sapiens
ccaaccatttcctc

SEQ ID NO: 1386665 - DNA, 17 bp, Homo sapiens
ccaacttggctgcagga

SEQ ID NO: 1386666 - DNA, 16 bp, Homo sapiens
ccaagacagtgagaca

SEQ ID NO: 1386667 - DNA, 18 bp, Homo sapiens
ccaagactgctgtggcca

SEQ ID NO: 1386668 - DNA, 23 bp, Homo sapiens
ccaagactgctgtggccaggagg

SEQ ID NO: 1386669 - DNA, 18 bp, Homo sapiens
ccaagatacttaagtgct

SEQ ID NO: 1386670 - DNA, 18 bp, Homo sapiens
ccaagcacttctttttct

SEQ ID NO: 1386671 - DNA, 22 bp, Homo sapiens
ccaaggagtcactgagaccaag

SEQ ID NO: 1386672 - DNA, 19 bp, Homo sapiens
ccaagggcataaattattg

SEQ ID NO: 1386673 - DNA, 16 bp, Homo sapiens
ccaaggggcttcaggt

SEQ ID NO: 1386674 - DNA, 10 bp, Homo sapiens
ccaataaaaa

SEQ ID NO: 1386675 - DNA, 14 bp, Homo sapiens
ccaataaaaagttc

SEQ ID NO: 1386676 - DNA, 16 bp, Homo sapiens
ccaataaaaagttcag

SEQ ID NO: 1386677 - DNA, 12 bp, Homo sapiens
ccaatgaaatga

SEQ ID NO: 1386678 - DNA, 21 bp, Homo sapiens
ccaattaaaattaaggtctgg

SEQ ID NO: 1386679 - DNA, 18 bp, Homo sapiens
ccacactcagatcctcct

SEQ ID NO: 1386680 - DNA, 21 bp, Homo sapiens
ccacactcagatcctcctcat

SEQ ID NO: 1386681 - DNA, 16 bp, Homo sapiens
ccacagataactgaaa

SEQ ID NO: 1386682 - DNA, 21 bp, Homo sapiens
ccaccatttggcatccctggg

SEQ ID NO: 1386683 - DNA, 20 bp, Homo sapiens
ccacctgaataaagaatgaa

SEQ ID NO: 1386684 - DNA, 12 bp, Homo sapiens
ccacctggctca

SEQ ID NO: 1386685 - DNA, 13 bp, Homo sapiens
ccactaccttctg

SEQ ID NO: 1386686 - DNA, 20 bp, Homo sapiens
ccactaccttctgacctccc

SEQ ID NO: 1386687 - DNA, 19 bp, Homo sapiens
ccactcatgtgactctttc

SEQ ID NO: 1386688 - DNA, 20 bp, Homo sapiens
ccactgctgatattttctct

SEQ ID NO: 1386689 - DNA, 13 bp, Homo sapiens
ccagaaccacact

SEQ ID NO: 1386690 - DNA, 11 bp, Homo sapiens
ccagacactgg

SEQ ID NO: 1386691 - DNA, 12 bp, Homo sapiens
ccagacactggt

SEQ ID NO: 1386692 - DNA, 23 bp, Homo sapiens
ccagacttcccacggctcctcga

SEQ ID NO: 1386693 - DNA, 18 bp, Homo sapiens
ccagagtccctgcctgga

SEQ ID NO: 1386694 - DNA, 22 bp, Homo sapiens
ccagagtccctgcctggaccag

SEQ ID NO: 1386695 - DNA, 16 bp, Homo sapiens
ccagatgcagctcaag

SEQ ID NO: 1386696 - DNA, 18 bp, Homo sapiens
ccagcaaaccaggactct

SEQ ID NO: 1386697 - DNA, 16 bp, Homo sapiens
ccagcatttcccttcc

SEQ ID NO: 1386698 - DNA, 18 bp, Homo sapiens
ccagccatcaagagactg

SEQ ID NO: 1386699 - DNA, 21 bp, Homo sapiens
ccagcctacccctcctgcgct

SEQ ID NO: 1386700 - DNA, 17 bp, Homo sapiens
ccagctggggccaggct

SEQ ID NO: 1386701 - DNA, 18 bp, Homo sapiens
ccagctggggccaggctg

SEQ ID NO: 1386702 - DNA, 19 bp, Homo sapiens
ccagctggggccaggctgg

SEQ ID NO: 1386703 - DNA, 20 bp, Homo sapiens
ccagctggggccaggctggg

SEQ ID NO: 1386704 - DNA, 21 bp, Homo sapiens
ccagctggggccaggctgggt

SEQ ID NO: 1386705 - DNA, 14 bp, Homo sapiens
ccaggaactgggcc

SEQ ID NO: 1386706 - DNA, 15 bp, Homo sapiens
ccaggaagctttggt

SEQ ID NO: 1386707 - DNA, 20 bp, Homo sapiens
ccaggactaatgcatgtggt

SEQ ID NO: 1386708 - DNA, 18 bp, Homo sapiens
ccaggaggacccagggct

SEQ ID NO: 1386709 - DNA, 20 bp, Homo sapiens
ccaggaggacccagggctct

SEQ ID NO: 1386710 - DNA, 19 bp, Homo sapiens
ccaggaggtgccactggag

SEQ ID NO: 1386711 - DNA, 19 bp, Homo sapiens
ccaggagtgggtggggagt

SEQ ID NO: 1386712 - DNA, 18 bp, Homo sapiens
ccaggatagagactggaa

SEQ ID NO: 1386713 - DNA, 16 bp, Homo sapiens
ccaggcacccaaaccc

SEQ ID NO: 1386714 - DNA, 17 bp, Homo sapiens
ccaggcagcctctgggg

SEQ ID NO: 1386715 - DNA, 17 bp, Homo sapiens
ccaggcaggtctgaagc

SEQ ID NO: 1386716 - DNA, 21 bp, Homo sapiens
ccaggccgggaaaaagcccac

SEQ ID NO: 1386717 - DNA, 15 bp, Homo sapiens
ccagggactctgccg

SEQ ID NO: 1386718 - DNA, 15 bp, Homo sapiens
ccagtaactcatctg

SEQ ID NO: 1386719 - DNA, 17 bp, Homo sapiens
ccagtcttcctgacact

SEQ ID NO: 1386720 - DNA, 14 bp, Homo sapiens
ccagtgacagctag

SEQ ID NO: 1386721 - DNA, 14 bp, Homo sapiens
ccatattgtaaaac

SEQ ID NO: 1386722 - DNA, 12 bp, Homo sapiens
ccatgagctcct

SEQ ID NO: 1386723 - DNA, 21 bp, Homo sapiens
ccatgagctccttaaggctct

SEQ ID NO: 1386724 - DNA, 20 bp, Homo sapiens
ccatgatgcctctgtcttct

SEQ ID NO: 1386725 - DNA, 21 bp, Homo sapiens
ccatgcccggctaatttttgt

SEQ ID NO: 1386726 - DNA, 14 bp, Homo sapiens
ccatgcctggtccc

SEQ ID NO: 1386727 - DNA, 19 bp, Homo sapiens
ccatgcctggtcccaagac

SEQ ID NO: 1386728 - DNA, 15 bp, Homo sapiens
ccatgggaccacaac

SEQ ID NO: 1386729 - DNA, 22 bp, Homo sapiens
ccatgggagctggttagaaatg

SEQ ID NO: 1386730 - DNA, 19 bp, Homo sapiens
ccattcttcctagttttct

SEQ ID NO: 1386731 - DNA, 20 bp, Homo sapiens
ccattctttcccaacacctc

SEQ ID NO: 1386732 - DNA, 12 bp, Homo sapiens
ccattgaaggct

SEQ ID NO: 1386733 - DNA, 21 bp, Homo sapiens
ccatttgcacaggttttcagc

SEQ ID NO: 1386734 - DNA, 13 bp, Homo sapiens
cccaacacctctt

SEQ ID NO: 1386735 - DNA, 16 bp, Homo sapiens
cccaacactgccagca

SEQ ID NO: 1386736 - DNA, 19 bp, Homo sapiens
cccaagctgttttcttcta

SEQ ID NO: 1386737 - DNA, 20 bp, Homo sapiens
cccaccatttggcatccctg

SEQ ID NO: 1386738 - DNA, 23 bp, Homo sapiens
cccaccatttggcatccctgggc

SEQ ID NO: 1386739 - DNA, 15 bp, Homo sapiens
cccacgtcagctggg

SEQ ID NO: 1386740 - DNA, 19 bp, Homo sapiens
cccagactttctacacctg

SEQ ID NO: 1386741 - DNA, 22 bp, Homo sapiens
cccagcctacccctcctgcgct

SEQ ID NO: 1386742 - DNA, 16 bp, Homo sapiens
cccagcggcatcaggc

SEQ ID NO: 1386743 - DNA, 12 bp, Homo sapiens
cccaggacccca

SEQ ID NO: 1386744 - DNA, 17 bp, Homo sapiens
cccaggagacagttcaa

SEQ ID NO: 1386745 - DNA, 19 bp, Homo sapiens
cccagggacacctgggaga

SEQ ID NO: 1386746 - DNA, 15 bp, Homo sapiens
cccagtaactcatct

SEQ ID NO: 1386747 - DNA, 21 bp, Homo sapiens
cccagtcccagaaccacactg

SEQ ID NO: 1386748 - DNA, 21 bp, Homo sapiens
cccatccagttcatgagaatc

SEQ ID NO: 1386749 - DNA, 22 bp, Homo sapiens
cccatggcagtgggaaaaatgt

SEQ ID NO: 1386750 - DNA, 20 bp, Homo sapiens
ccccaactacccccagctgt

SEQ ID NO: 1386751 - DNA, 16 bp, Homo sapiens
ccccaagctgttttct

SEQ ID NO: 1386752 - DNA, 23 bp, Homo sapiens
ccccagctgtcatcaattaaagg

SEQ ID NO: 1386753 - DNA, 15 bp, Homo sapiens
cccccacctggctca

SEQ ID NO: 1386754 - DNA, 20 bp, Homo sapiens
cccccacctggctcaccttg

SEQ ID NO: 1386755 - DNA, 23 bp, Homo sapiens
cccccagctttgctaccaaagca

SEQ ID NO: 1386756 - DNA, 13 bp, Homo sapiens
ccccctccctgga

SEQ ID NO: 1386757 - DNA, 22 bp, Homo sapiens
ccccctgtgccttgtcacgcca

SEQ ID NO: 1386758 - DNA, 22 bp, Homo sapiens
cccccttgcccatgcctccagc

SEQ ID NO: 1386759 - DNA, 23 bp, Homo sapiens
cccccttgcccatgcctccagct

SEQ ID NO: 1386760 - DNA, 14 bp, Homo sapiens
ccccgacttttgtt

SEQ ID NO: 1386761 - DNA, 21 bp, Homo sapiens
ccccgcgtggaactcgtgtct

SEQ ID NO: 1386762 - DNA, 17 bp, Homo sapiens
cccctgcctcccatgcc

SEQ ID NO: 1386763 - DNA, 15 bp, Homo sapiens
cccctgcctctctgc

SEQ ID NO: 1386764 - DNA, 16 bp, Homo sapiens
cccctgcctctctgca

SEQ ID NO: 1386765 - DNA, 19 bp, Homo sapiens
cccgcaccccccaagctgt

SEQ ID NO: 1386766 - DNA, 20 bp, Homo sapiens
cccggacgcccaggacccca

SEQ ID NO: 1386767 - DNA, 14 bp, Homo sapiens
cccgggagctcagg

SEQ ID NO: 1386768 - DNA, 15 bp, Homo sapiens
ccctaataaagctgt

SEQ ID NO: 1386769 - DNA, 18 bp, Homo sapiens
ccctacttcttttgctct

SEQ ID NO: 1386770 - DNA, 14 bp, Homo sapiens
ccctacttgagata

SEQ ID NO: 1386771 - DNA, 19 bp, Homo sapiens
ccctagcgctatctccctg

SEQ ID NO: 1386772 - DNA, 17 bp, Homo sapiens
ccctccatccctggccc

SEQ ID NO: 1386773 - DNA, 14 bp, Homo sapiens
ccctccccctgcca

SEQ ID NO: 1386774 - DNA, 16 bp, Homo sapiens
ccctccccgcaccccc

SEQ ID NO: 1386775 - DNA, 20 bp, Homo sapiens
ccctcctgttgggagagggc

SEQ ID NO: 1386776 - DNA, 22 bp, Homo sapiens
ccctgccaggagctttggacct

SEQ ID NO: 1386777 - DNA, 11 bp, Homo sapiens
ccctgcctctc

SEQ ID NO: 1386778 - DNA, 16 bp, Homo sapiens
ccctgcctctctgcag

SEQ ID NO: 1386779 - DNA, 15 bp, Homo sapiens
ctggaagccagcttt

SEQ ID NO: 1386780 - DNA, 17 bp, Homo sapiens
ctggaagccagctttcc

SEQ ID NO: 1386781 - DNA, 18 bp, Homo sapiens
ctggaatacatgaaatat

SEQ ID NO: 1386782 - DNA, 20 bp, Homo sapiens
ctggaatcagctcaggactg

SEQ ID NO: 1386783 - DNA, 14 bp, Homo sapiens
ctggacagcttgtg

SEQ ID NO: 1386784 - DNA, 14 bp, Homo sapiens
ctggaccagcctct

SEQ ID NO: 1386785 - DNA, 20 bp, Homo sapiens
ctggactgtcatagaaatta

SEQ ID NO: 1386786 - DNA, 19 bp, Homo sapiens
ctggactgtgtgctcagga

SEQ ID NO: 1386787 - DNA, 19 bp, Homo sapiens
ctggagaagaccctccccg

SEQ ID NO: 1386788 - DNA, 15 bp, Homo sapiens
ctggagcccactgta

SEQ ID NO: 1386789 - DNA, 15 bp, Homo sapiens
ctggatgacattaaa

SEQ ID NO: 1386790 - DNA, 20 bp, Homo sapiens
ctggattccccatctcaggc

SEQ ID NO: 1386791 - DNA, 14 bp, Homo sapiens
ctggcaacatcttt

SEQ ID NO: 1386792 - DNA, 14 bp, Homo sapiens
ctggcacagcctgg

SEQ ID NO: 1386793 - DNA, 21 bp, Homo sapiens
ctggcacagcctggctgtggc

SEQ ID NO: 1386794 - DNA, 20 bp, Homo sapiens
ctggccccctccctggatga

SEQ ID NO: 1386795 - DNA, 16 bp, Homo sapiens
ctggcctcaaagcaag

SEQ ID NO: 1386796 - DNA, 19 bp, Homo sapiens
ctggcttctggccaggaag

SEQ ID NO: 1386797 - DNA, 16 bp, Homo sapiens
ctggcttgggcagcat

SEQ ID NO: 1386798 - DNA, 18 bp, Homo sapiens
ctgggaacaggagaccca

SEQ ID NO: 1386799 - DNA, 13 bp, Homo sapiens
ctgggagaaatct

SEQ ID NO: 1386800 - DNA, 18 bp, Homo sapiens
ctgggaggctctggagcc

SEQ ID NO: 1386801 - DNA, 20 bp, Homo sapiens
ctgggaggctctggagccca

SEQ ID NO: 1386802 - DNA, 16 bp, Homo sapiens
ctgggcccctgcctct

SEQ ID NO: 1386803 - DNA, 17 bp, Homo sapiens
ctgggcccctgcctctc

SEQ ID NO: 1386804 - DNA, 19 bp, Homo sapiens
ctgggcccctgcctctctg

SEQ ID NO: 1386805 - DNA, 19 bp, Homo sapiens
ctggggacaggtcctcagt

SEQ ID NO: 1386806 - DNA, 16 bp, Homo sapiens
ctgggggcctcttctg

SEQ ID NO: 1386807 - DNA, 13 bp, Homo sapiens
ctggggggtggcc

SEQ ID NO: 1386808 - DNA, 19 bp, Homo sapiens
ctggggggtggccaggccg

SEQ ID NO: 1386809 - DNA, 22 bp, Homo sapiens
ctgggtaactgtcaagtcatga

SEQ ID NO: 1386810 - DNA, 15 bp, Homo sapiens
ctgggtcgccctgga

SEQ ID NO: 1386811 - DNA, 16 bp, Homo sapiens
ctgggtcgccctggac

SEQ ID NO: 1386812 - DNA, 17 bp, Homo sapiens
ctgggtcgccctggact

SEQ ID NO: 1386813 - DNA, 22 bp, Homo sapiens
ctggtagttcattgtaaatgaa

SEQ ID NO: 1386814 - DNA, 20 bp, Homo sapiens
ctggtatatccaaaagcttt

SEQ ID NO: 1386815 - DNA, 15 bp, Homo sapiens
ctggtgaagctcact

SEQ ID NO: 1386816 - DNA, 17 bp, Homo sapiens
ctggttttcacattaga

SEQ ID NO: 1386817 - DNA, 15 bp, Homo sapiens
ctgtaaacacagaca

SEQ ID NO: 1386818 - DNA, 23 bp, Homo sapiens
ctgtaaagctaaaataaagaaat

SEQ ID NO: 1386819 - DNA, 20 bp, Homo sapiens
ctgtaagtagatgcatttgg

SEQ ID NO: 1386820 - DNA, 14 bp, Homo sapiens
ctgtaatgttaata

SEQ ID NO: 1386821 - DNA, 15 bp, Homo sapiens
ctgtaatgttaatat

SEQ ID NO: 1386822 - DNA, 18 bp, Homo sapiens
ctgtaattgaatattatt

SEQ ID NO: 1386823 - DNA, 20 bp, Homo sapiens
ctgtaccaagccccttggcc

SEQ ID NO: 1386824 - DNA, 21 bp, Homo sapiens
ctgtacttgctcttgatgcct

SEQ ID NO: 1386825 - DNA, 23 bp, Homo sapiens
ctgtacttgctcttgatgcctgg

SEQ ID NO: 1386826 - DNA, 18 bp, Homo sapiens
ctgtagccccagtgacag

SEQ ID NO: 1386827 - DNA, 13 bp, Homo sapiens
ctgtagtcacttt

SEQ ID NO: 1386828 - DNA, 18 bp, Homo sapiens
ctgtcaagtcatgatgga

SEQ ID NO: 1386829 - DNA, 16 bp, Homo sapiens
ctgtcatagaaattac

SEQ ID NO: 1386830 - DNA, 19 bp, Homo sapiens
ctgtccagataagttattt

SEQ ID NO: 1386831 - DNA, 23 bp, Homo sapiens
ctgtcctttctagagcactgcca

SEQ ID NO: 1386832 - DNA, 17 bp, Homo sapiens
ctgtctctcatgaacct

SEQ ID NO: 1386833 - DNA, 20 bp, Homo sapiens
ctgtgcaaggtattacactc

SEQ ID NO: 1386834 - DNA, 20 bp, Homo sapiens
ctgtgccccttgacaactgg

SEQ ID NO: 1386835 - DNA, 13 bp, Homo sapiens
ctgtgcctcctca

SEQ ID NO: 1386836 - DNA, 19 bp, Homo sapiens
ctgtgctatggtgctctgt

SEQ ID NO: 1386837 - DNA, 21 bp, Homo sapiens
ctgtggaaaatgctatcaaat

SEQ ID NO: 1386838 - DNA, 18 bp, Homo sapiens
ctgtggcctaacctgccg

SEQ ID NO: 1386839 - DNA, 23 bp, Homo sapiens
ctgtgtaagggccagaaatatct

SEQ ID NO: 1386840 - DNA, 19 bp, Homo sapiens
ctgtgtgctcaggagccct

SEQ ID NO: 1386841 - DNA, 20 bp, Homo sapiens
ctgtgtgctcaggagccctg

SEQ ID NO: 1386842 - DNA, 21 bp, Homo sapiens
ctgtgtgctcaggagccctgg

SEQ ID NO: 1386843 - DNA, 14 bp, Homo sapiens
ctgttcatttcctc

SEQ ID NO: 1386844 - DNA, 17 bp, Homo sapiens
ctgttgagcatcacaga

SEQ ID NO: 1386845 - DNA, 22 bp, Homo sapiens
ctgttgggagagggcgcaggcc

SEQ ID NO: 1386846 - DNA, 19 bp, Homo sapiens
ctgttggttagctggacat

SEQ ID NO: 1386847 - DNA, 21 bp, Homo sapiens
ctgtttccataggaatcatgt

SEQ ID NO: 1386848 - DNA, 18 bp, Homo sapiens
ctgttttcttctattcca

SEQ ID NO: 1386849 - DNA, 15 bp, Homo sapiens
ctgtttttcacattt

SEQ ID NO: 1386850 - DNA, 17 bp, Homo sapiens
ctgtttttcggacagtt

SEQ ID NO: 1386851 - DNA, 22 bp, Homo sapiens
ctgtttttcggacagtttattt

SEQ ID NO: 1386852 - DNA, 20 bp, Homo sapiens
cttaaaaatgccaaaaacaa

SEQ ID NO: 1386853 - DNA, 12 bp, Homo sapiens
cttaaaactttg

SEQ ID NO: 1386854 - DNA, 16 bp, Homo sapiens
cttaagattaaattat

SEQ ID NO: 1386855 - DNA, 15 bp, Homo sapiens
cttaaggctcttttg

SEQ ID NO: 1386856 - DNA, 14 bp, Homo sapiens
cttaaggtgtagcc

SEQ ID NO: 1386857 - DNA, 21 bp, Homo sapiens
cttaaggtgtagccacaccag

SEQ ID NO: 1386858 - DNA, 18 bp, Homo sapiens
cttaagtcagaacagcag

SEQ ID NO: 1386859 - DNA, 16 bp, Homo sapiens
cttaagtgctgcaatt

SEQ ID NO: 1386860 - DNA, 19 bp, Homo sapiens
cttaatatatatatccaga

SEQ ID NO: 1386861 - DNA, 16 bp, Homo sapiens
cttaatttattattaa

SEQ ID NO: 1386862 - DNA, 19 bp, Homo sapiens
cttacatgcattactgcat

SEQ ID NO: 1386863 - DNA, 19 bp, Homo sapiens
cttacctttttatttgcat

SEQ ID NO: 1386864 - DNA, 19 bp, Homo sapiens
cttactgatatattttaca

SEQ ID NO: 1386865 - DNA, 16 bp, Homo sapiens
cttagatctggcatgt

SEQ ID NO: 1386866 - DNA, 17 bp, Homo sapiens
cttagctgtctgctcag

SEQ ID NO: 1386867 - DNA, 21 bp, Homo sapiens
cttatgacatcacttgtacaa

SEQ ID NO: 1386868 - DNA, 13 bp, Homo sapiens
cttatggtaccag

SEQ ID NO: 1386869 - DNA, 19 bp, Homo sapiens
cttatggtaccagatgcag

SEQ ID NO: 1386870 - DNA, 14 bp, Homo sapiens
cttattgcctcact

SEQ ID NO: 1386871 - DNA, 19 bp, Homo sapiens
cttattgcctcacttcagg

SEQ ID NO: 1386872 - DNA, 17 bp, Homo sapiens
cttattggaactctgct

SEQ ID NO: 1386873 - DNA, 14 bp, Homo sapiens
cttattttcaagaa

SEQ ID NO: 1386874 - DNA, 15 bp, Homo sapiens
cttattttcaagaaa

SEQ ID NO: 1386875 - DNA, 13 bp, Homo sapiens
cttcaaggaaaat

SEQ ID NO: 1386876 - DNA, 15 bp, Homo sapiens
cttcaaggaaaataa

SEQ ID NO: 1386877 - DNA, 18 bp, Homo sapiens
cttcaaggaaaataagtg

SEQ ID NO: 1386878 - DNA, 19 bp, Homo sapiens
cttcaaggaaaataagtga

SEQ ID NO: 1386879 - DNA, 19 bp, Homo sapiens
cttcactcttcaaatgcct

SEQ ID NO: 1386880 - DNA, 14 bp, Homo sapiens
cttcagctctgaaa

SEQ ID NO: 1386881 - DNA, 17 bp, Homo sapiens
cttcaggtccaggctgt

SEQ ID NO: 1386882 - DNA, 16 bp, Homo sapiens
cttcaggttgttctgt

SEQ ID NO: 1386883 - DNA, 18 bp, Homo sapiens
cttcaggttgttctgtat

SEQ ID NO: 1386884 - DNA, 20 bp, Homo sapiens
cttcaggttgttctgtataa

SEQ ID NO: 1386885 - DNA, 12 bp, Homo sapiens
cttcataatcca

SEQ ID NO: 1386886 - DNA, 19 bp, Homo sapiens
cttcatctggcaacatctt

SEQ ID NO: 1386887 - DNA, 24 bp, Homo sapiens
cttcatttgggatgctactctagt

SEQ ID NO: 1386888 - DNA, 22 bp, Homo sapiens
cttccagtcttcctgacacttt

SEQ ID NO: 1386889 - DNA, 14 bp, Homo sapiens
cttcccctgcctgg

SEQ ID NO: 1386890 - DNA, 17 bp, Homo sapiens
cttcctagttttctcct

SEQ ID NO: 1386891 - DNA, 23 bp, Homo sapiens
cttcctagttttctcctcccagg

SEQ ID NO: 1386892 - DNA, 15 bp, Homo sapiens
cttcctctcctgtct

SEQ ID NO: 1386893 - DNA, 19 bp, Homo sapiens
cttcctctcctgtctccct

SEQ ID NO: 1386894 - DNA, 15 bp, Homo sapiens
cttcctgacacttta

SEQ ID NO: 1386895 - DNA, 17 bp, Homo sapiens
cttcctgacactttaat

SEQ ID NO: 1386896 - DNA, 23 bp, Homo sapiens
cttcctggggcatctggcgaatc

SEQ ID NO: 1386897 - DNA, 16 bp, Homo sapiens
cttcctgtttttcaca

SEQ ID NO: 1386898 - DNA, 16 bp, Homo sapiens
cttccttcatttcctc

SEQ ID NO: 1386899 - DNA, 15 bp, Homo sapiens
cttcgtttattttca

SEQ ID NO: 1386900 - DNA, 18 bp, Homo sapiens
cttcgtttattttcaaga

SEQ ID NO: 1386901 - DNA, 19 bp, Homo sapiens
cttctagttctgccaggag

SEQ ID NO: 1386902 - DNA, 14 bp, Homo sapiens
cttctattttgtaa

SEQ ID NO: 1386903 - DNA, 20 bp, Homo sapiens
cttctcattttttaaaaaag

SEQ ID NO: 1386904 - DNA, 17 bp, Homo sapiens
cttctctgttcatttcc

SEQ ID NO: 1386905 - DNA, 18 bp, Homo sapiens
cttctgagctatttcatc

SEQ ID NO: 1386906 - DNA, 15 bp, Homo sapiens
cttctggccaggaag

SEQ ID NO: 1386907 - DNA, 15 bp, Homo sapiens
cttgaaattttaacc

SEQ ID NO: 1386908 - DNA, 17 bp, Homo sapiens
cttgaaattttaaccta

SEQ ID NO: 1386909 - DNA, 14 bp, Homo sapiens
gatgaaaataaaga

SEQ ID NO: 1386910 - DNA, 12 bp, Homo sapiens
gatgactaaaat

SEQ ID NO: 1386911 - DNA, 15 bp, Homo sapiens
gatgcatttgggtcc

SEQ ID NO: 1386912 - DNA, 18 bp, Homo sapiens
gatgcatttgggtccagg

SEQ ID NO: 1386913 - DNA, 23 bp, Homo sapiens
gatggagacttcaggttgttctg

SEQ ID NO: 1386914 - DNA, 11 bp, Homo sapiens
gatgtgcattc

SEQ ID NO: 1386915 - DNA, 18 bp, Homo sapiens
gatgtgtttgctttctga

SEQ ID NO: 1386916 - DNA, 18 bp, Homo sapiens
gatgttctggacctcccc

SEQ ID NO: 1386917 - DNA, 14 bp, Homo sapiens
gattacattttaaa

SEQ ID NO: 1386918 - DNA, 20 bp, Homo sapiens
gattagactggacagcttgt

SEQ ID NO: 1386919 - DNA, 14 bp, Homo sapiens
gattataaaaatga

SEQ ID NO: 1386920 - DNA, 19 bp, Homo sapiens
gattcaatctgtaaactgt

SEQ ID NO: 1386921 - DNA, 20 bp, Homo sapiens
gattcaatctgtaaactgtg

SEQ ID NO: 1386922 - DNA, 21 bp, Homo sapiens
gattcaatctgtaaactgtgt

SEQ ID NO: 1386923 - DNA, 22 bp, Homo sapiens
gattcaatctgtaaactgtgta

SEQ ID NO: 1386924 - DNA, 18 bp, Homo sapiens
gattcattcttaacaaga

SEQ ID NO: 1386925 - DNA, 13 bp, Homo sapiens
gattcccagagca

SEQ ID NO: 1386926 - DNA, 20 bp, Homo sapiens
gattccccatctcaggccag

SEQ ID NO: 1386927 - DNA, 13 bp, Homo sapiens
gattctcataact

SEQ ID NO: 1386928 - DNA, 14 bp, Homo sapiens
gatttgtcccaggt

SEQ ID NO: 1386929 - DNA, 14 bp, Homo sapiens
gatttttacacatg

SEQ ID NO: 1386930 - DNA, 13 bp, Homo sapiens
gatttttgcctct

SEQ ID NO: 1386931 - DNA, 16 bp, Homo sapiens
gattttttaataattt

SEQ ID NO: 1386932 - DNA, 19 bp, Homo sapiens
gattttttaataatttaga

SEQ ID NO: 1386933 - DNA, 15 bp, Homo sapiens
gcaaaaaagaaaacc

SEQ ID NO: 1386934 - DNA, 11 bp, Homo sapiens
gcaaaagaaga

SEQ ID NO: 1386935 - DNA, 13 bp, Homo sapiens
gcaaaataatttt

SEQ ID NO: 1386936 - DNA, 14 bp, Homo sapiens
gcaaaccaggactc

SEQ ID NO: 1386937 - DNA, 21 bp, Homo sapiens
gcaaacctgacccctgctcag

SEQ ID NO: 1386938 - DNA, 14 bp, Homo sapiens
gcaaagaattgact

SEQ ID NO: 1386939 - DNA, 16 bp, Homo sapiens
gcaaagatatctcatc

SEQ ID NO: 1386940 - DNA, 14 bp, Homo sapiens
gcaacaatttatga

SEQ ID NO: 1386941 - DNA, 16 bp, Homo sapiens
gcaaccagagcactgt

SEQ ID NO: 1386942 - DNA, 18 bp, Homo sapiens
gcaaccagagcactgtat

SEQ ID NO: 1386943 - DNA, 19 bp, Homo sapiens
gcaacctacctgttgagca

SEQ ID NO: 1386944 - DNA, 19 bp, Homo sapiens
gcaacctcagtaatttaga

SEQ ID NO: 1386945 - DNA, 18 bp, Homo sapiens
gcaactcagaatgctcta

SEQ ID NO: 1386946 - DNA, 20 bp, Homo sapiens
gcaagaaggcaaaaatagtt

SEQ ID NO: 1386947 - DNA, 13 bp, Homo sapiens
gcaagtgaatttg

SEQ ID NO: 1386948 - DNA, 15 bp, Homo sapiens
gcaatgtaaatattt

SEQ ID NO: 1386949 - DNA, 15 bp, Homo sapiens
gcacaaatatttatt

SEQ ID NO: 1386950 - DNA, 17 bp, Homo sapiens
gcacacaaacacctcct

SEQ ID NO: 1386951 - DNA, 12 bp, Homo sapiens
gcacagcctggc

SEQ ID NO: 1386952 - DNA, 13 bp, Homo sapiens
gcacagctatgaa

SEQ ID NO: 1386953 - DNA, 16 bp, Homo sapiens
gcacagctatgaaggc

SEQ ID NO: 1386954 - DNA, 16 bp, Homo sapiens
gcacaggttttcagca

SEQ ID NO: 1386955 - DNA, 17 bp, Homo sapiens
gcacatagtagaacgct

SEQ ID NO: 1386956 - DNA, 16 bp, Homo sapiens
gcaccaaaagaagtaa

SEQ ID NO: 1386957 - DNA, 18 bp, Homo sapiens
gcaccaaaagaagtaaaa

SEQ ID NO: 1386958 - DNA, 14 bp, Homo sapiens
gcaccccccaagct

SEQ ID NO: 1386959 - DNA, 16 bp, Homo sapiens
gcaccggggcctgggc

SEQ ID NO: 1386960 - DNA, 14 bp, Homo sapiens
gcacctaaagaaaa

SEQ ID NO: 1386961 - DNA, 17 bp, Homo sapiens
gcacctaaagaaaaaca

SEQ ID NO: 1386962 - DNA, 18 bp, Homo sapiens
gcacctttctagttgaaa

SEQ ID NO: 1386963 - DNA, 15 bp, Homo sapiens
gcactggggcagggg

SEQ ID NO: 1386964 - DNA, 15 bp, Homo sapiens
gcacttgctggaaga

SEQ ID NO: 1386965 - DNA, 18 bp, Homo sapiens
gcagaagcagggtaccct

SEQ ID NO: 1386966 - DNA, 19 bp, Homo sapiens
gcagacatgtgcacttgaa

SEQ ID NO: 1386967 - DNA, 17 bp, Homo sapiens
gcagaccttttttagga

SEQ ID NO: 1386968 - DNA, 15 bp, Homo sapiens
gcagactcagctctg

SEQ ID NO: 1386969 - DNA, 20 bp, Homo sapiens
gcagactctttatgcttgca

SEQ ID NO: 1386970 - DNA, 23 bp, Homo sapiens
gcagaggatgttctggacctccc

SEQ ID NO: 1386971 - DNA, 21 bp, Homo sapiens
gcagattctcccttgctctgc

SEQ ID NO: 1386972 - DNA, 17 bp, Homo sapiens
gcagcccctcccagcct

SEQ ID NO: 1386973 - DNA, 21 bp, Homo sapiens
gcagcctcattctgaggcctg

SEQ ID NO: 1386974 - DNA, 14 bp, Homo sapiens
gcagcctctggggg

SEQ ID NO: 1386975 - DNA, 15 bp, Homo sapiens
gcagcctctgggggg

SEQ ID NO: 1386976 - DNA, 22 bp, Homo sapiens
gcagcctctggggggtggccag

SEQ ID NO: 1386977 - DNA, 18 bp, Homo sapiens
gcagctcaagagatccca

SEQ ID NO: 1386978 - DNA, 23 bp, Homo sapiens
gcaggaaggactatgaaaagcta

SEQ ID NO: 1386979 - DNA, 22 bp, Homo sapiens
gcaggaggccaataaaaagttc

SEQ ID NO: 1386980 - DNA, 15 bp, Homo sapiens
gcaggagggaggtgc

SEQ ID NO: 1386981 - DNA, 17 bp, Homo sapiens
gcaggatctcaccaggc

SEQ ID NO: 1386982 - DNA, 18 bp, Homo sapiens
gcaggatctcaccaggca

SEQ ID NO: 1386983 - DNA, 19 bp, Homo sapiens
gcaggatctcaccaggcag

SEQ ID NO: 1386984 - DNA, 17 bp, Homo sapiens
gcaggcaggctcccagg

SEQ ID NO: 1386985 - DNA, 21 bp, Homo sapiens
gcaggcatcggggagccggga

SEQ ID NO: 1386986 - DNA, 23 bp, Homo sapiens
gcaggctcccagggacacctggg

SEQ ID NO: 1386987 - DNA, 12 bp, Homo sapiens
gcaggctgattt

SEQ ID NO: 1386988 - DNA, 16 bp, Homo sapiens
gcagggtaccctttgg

SEQ ID NO: 1386989 - DNA, 11 bp, Homo sapiens
gcaggtcccta

SEQ ID NO: 1386990 - DNA, 14 bp, Homo sapiens
gcaggtccctaata

SEQ ID NO: 1386991 - DNA, 17 bp, Homo sapiens
gcaggtccctaataaag

SEQ ID NO: 1386992 - DNA, 18 bp, Homo sapiens
gcaggtccctaataaagc

SEQ ID NO: 1386993 - DNA, 20 bp, Homo sapiens
gcaggtccctaataaagctg

SEQ ID NO: 1386994 - DNA, 18 bp, Homo sapiens
gcagtcctggaagccagc

SEQ ID NO: 1386995 - DNA, 17 bp, Homo sapiens
gcagtgggaaaaatgta

SEQ ID NO: 1386996 - DNA, 19 bp, Homo sapiens
gcagtgggaaaaatgtagg

SEQ ID NO: 1386997 - DNA, 18 bp, Homo sapiens
gcagtgggagggtaccag

SEQ ID NO: 1386998 - DNA, 17 bp, Homo sapiens
gcagttgagacaagaaa

SEQ ID NO: 1386999 - DNA, 13 bp, Homo sapiens
gcatactttttaa

SEQ ID NO: 1387000 - DNA, 21 bp, Homo sapiens
gcatccagagtccctgcctgg

SEQ ID NO: 1387001 - DNA, 22 bp, Homo sapiens
gcatctagaggcttccttcatt

SEQ ID NO: 1387002 - DNA, 13 bp, Homo sapiens
gcatctgtttatt

SEQ ID NO: 1387003 - DNA, 16 bp, Homo sapiens
gcatgatattttcaga

SEQ ID NO: 1387004 - DNA, 19 bp, Homo sapiens
gcatgtcctgtaaaggtta

SEQ ID NO: 1387005 - DNA, 22 bp, Homo sapiens
gcattattggaatataattgtt

SEQ ID NO: 1387006 - DNA, 15 bp, Homo sapiens
gcatttgggtccagg

SEQ ID NO: 1387007 - DNA, 18 bp, Homo sapiens
gcatttgggtccaggagg

SEQ ID NO: 1387008 - DNA, 16 bp, Homo sapiens
gccaaaaaaaaataca

SEQ ID NO: 1387009 - DNA, 23 bp, Homo sapiens
gccaaaacaatgtttaaaccttt

SEQ ID NO: 1387010 - DNA, 21 bp, Homo sapiens
gccaaagaaccaaagaagaaa

SEQ ID NO: 1387011 - DNA, 14 bp, Homo sapiens
gccaagactgctgt

SEQ ID NO: 1387012 - DNA, 23 bp, Homo sapiens
gccaagactgctgtggccaggag

SEQ ID NO: 1387013 - DNA, 13 bp, Homo sapiens
gccaataaaaagt

SEQ ID NO: 1387014 - DNA, 15 bp, Homo sapiens
gccaataaaaagttc

SEQ ID NO: 1387015 - DNA, 20 bp, Homo sapiens
gccaatttcaagttccaagt

SEQ ID NO: 1387016 - DNA, 13 bp, Homo sapiens
gccaccatgcccg

SEQ ID NO: 1387017 - DNA, 16 bp, Homo sapiens
gccacctgaataaaga

SEQ ID NO: 1387018 - DNA, 15 bp, Homo sapiens
gccaggaggacccag

SEQ ID NO: 1387019 - DNA, 16 bp, Homo sapiens
gccaggaggacccagg

SEQ ID NO: 1387020 - DNA, 17 bp, Homo sapiens
gccaggaggtgccactg

SEQ ID NO: 1387021 - DNA, 13 bp, Homo sapiens
gccaggctgggtc

SEQ ID NO: 1387022 - DNA, 15 bp, Homo sapiens
gccatgatgcctctg

SEQ ID NO: 1387023 - DNA, 17 bp, Homo sapiens
gccatgtgtttatccta

SEQ ID NO: 1387024 - DNA, 14 bp, Homo sapiens
gccattaacaaatg

SEQ ID NO: 1387025 - DNA, 15 bp, Homo sapiens
gcccactgtacttgc

SEQ ID NO: 1387026 - DNA, 16 bp, Homo sapiens
gcccagccctaaacat

SEQ ID NO: 1387027 - DNA, 15 bp, Homo sapiens
gcccaggcactgcaa

SEQ ID NO: 1387028 - DNA, 22 bp, Homo sapiens
gcccagtcattgggttttatca

SEQ ID NO: 1387029 - DNA, 22 bp, Homo sapiens
gcccatctgggggcctcttctg

SEQ ID NO: 1387030 - DNA, 16 bp, Homo sapiens
gcccatgcctccagct

SEQ ID NO: 1387031 - DNA, 20 bp, Homo sapiens
gcccatgggagctggttaga

SEQ ID NO: 1387032 - DNA, 21 bp, Homo sapiens
gcccccaaccatttcctcaga

SEQ ID NO: 1387033 - DNA, 16 bp, Homo sapiens
gcccccacctggctca

SEQ ID NO: 1387034 - DNA, 14 bp, Homo sapiens
gcccctcccagcct

SEQ ID NO: 1387035 - DNA, 16 bp, Homo sapiens
gcccctccccctgcca

SEQ ID NO: 1387036 - DNA, 16 bp, Homo sapiens
gcccctgaacaagaat

SEQ ID NO: 1387037 - DNA, 17 bp, Homo sapiens
gcccgggagctcaggaa

SEQ ID NO: 1387038 - DNA, 19 bp, Homo sapiens
gcccgggagctcaggaacc

SEQ ID NO: 1387039 - DNA, 12 bp, Homo sapiens
gccctactggga

SEQ ID NO: 1387040 - DNA, 16 bp, Homo sapiens
gtaacaagccagattt

SEQ ID NO: 1387041 - DNA, 23 bp, Homo sapiens
gtaacaagccagattttttaaaa

SEQ ID NO: 1387042 - DNA, 18 bp, Homo sapiens
gtaactgtcaagtcatga

SEQ ID NO: 1387043 - DNA, 20 bp, Homo sapiens
gtaagaaacctactgcccag

SEQ ID NO: 1387044 - DNA, 23 bp, Homo sapiens
gtaatttctactttgataaagta

SEQ ID NO: 1387045 - DNA, 17 bp, Homo sapiens
gtacaatgtttcagaag

SEQ ID NO: 1387046 - DNA, 14 bp, Homo sapiens
gtacataaaggtga

SEQ ID NO: 1387047 - DNA, 14 bp, Homo sapiens
gtacataactgaaa

SEQ ID NO: 1387048 - DNA, 21 bp, Homo sapiens
gtaccaagaatcttggtttgc

SEQ ID NO: 1387049 - DNA, 17 bp, Homo sapiens
gtaccagatgcagctca

SEQ ID NO: 1387050 - DNA, 14 bp, Homo sapiens
gtacttgctcttga

SEQ ID NO: 1387051 - DNA, 22 bp, Homo sapiens
gtagatattggacaaagaacct

SEQ ID NO: 1387052 - DNA, 15 bp, Homo sapiens
gtagatgcatttggg

SEQ ID NO: 1387053 - DNA, 20 bp, Homo sapiens
gtaggagactgtttggaaat

SEQ ID NO: 1387054 - DNA, 18 bp, Homo sapiens
gtaggcaggattggggaa

SEQ ID NO: 1387055 - DNA, 18 bp, Homo sapiens
gtataaaatgcaaaataa

SEQ ID NO: 1387056 - DNA, 14 bp, Homo sapiens
gtatccactttgca

SEQ ID NO: 1387057 - DNA, 19 bp, Homo sapiens
gtatccactttgcacagct

SEQ ID NO: 1387058 - DNA, 18 bp, Homo sapiens
gtatctaggcaacatagt

SEQ ID NO: 1387059 - DNA, 16 bp, Homo sapiens
gtattacactctgtaa

SEQ ID NO: 1387060 - DNA, 19 bp, Homo sapiens
gtattccagacctgaagaa

SEQ ID NO: 1387061 - DNA, 13 bp, Homo sapiens
gtcaaaacagatt

SEQ ID NO: 1387062 - DNA, 14 bp, Homo sapiens
gtcaacagttttcc

SEQ ID NO: 1387063 - DNA, 14 bp, Homo sapiens
gtcacgccagactt

SEQ ID NO: 1387064 - DNA, 13 bp, Homo sapiens
gtcactcaaggcg

SEQ ID NO: 1387065 - DNA, 22 bp, Homo sapiens
gtcagctgggacaccccgactt

SEQ ID NO: 1387066 - DNA, 21 bp, Homo sapiens
gtcaggcccttattttcaaga

SEQ ID NO: 1387067 - DNA, 22 bp, Homo sapiens
gtcaggcccttattttcaagaa

SEQ ID NO: 1387068 - DNA, 13 bp, Homo sapiens
gtcatagaaatta

SEQ ID NO: 1387069 - DNA, 21 bp, Homo sapiens
gtcattgttatataatcatta

SEQ ID NO: 1387070 - DNA, 13 bp, Homo sapiens
gtccaggagcctg

SEQ ID NO: 1387071 - DNA, 12 bp, Homo sapiens
gtccctaataaa

SEQ ID NO: 1387072 - DNA, 16 bp, Homo sapiens
gtccctaataaagctg

SEQ ID NO: 1387073 - DNA, 17 bp, Homo sapiens
gtccctaataaagctgt

SEQ ID NO: 1387074 - DNA, 13 bp, Homo sapiens
gtccctgcctgga

SEQ ID NO: 1387075 - DNA, 21 bp, Homo sapiens
gtccctgcctggaccagcctc

SEQ ID NO: 1387076 - DNA, 22 bp, Homo sapiens
gtcccttcttccctaatcagct

SEQ ID NO: 1387077 - DNA, 20 bp, Homo sapiens
gtcctaataatatcccactg

SEQ ID NO: 1387078 - DNA, 13 bp, Homo sapiens
gtccttcaaaggc

SEQ ID NO: 1387079 - DNA, 13 bp, Homo sapiens
gtcgccaggctag

SEQ ID NO: 1387080 - DNA, 21 bp, Homo sapiens
gtctatcaaccccagacactg

SEQ ID NO: 1387081 - DNA, 22 bp, Homo sapiens
gtctcaaactcctgacctcagg

SEQ ID NO: 1387082 - DNA, 16 bp, Homo sapiens
gtctcatgtaaaataa

SEQ ID NO: 1387083 - DNA, 18 bp, Homo sapiens
gtctcatgtaaaataaga

SEQ ID NO: 1387084 - DNA, 21 bp, Homo sapiens
gtctccagtatccactttgca

SEQ ID NO: 1387085 - DNA, 15 bp, Homo sapiens
gtctctcatgaacct

SEQ ID NO: 1387086 - DNA, 15 bp, Homo sapiens
gtctctctctctcta

SEQ ID NO: 1387087 - DNA, 19 bp, Homo sapiens
gtctctctctctctacaaa

SEQ ID NO: 1387088 - DNA, 22 bp, Homo sapiens
gtctcttctgagctatttcatc

SEQ ID NO: 1387089 - DNA, 18 bp, Homo sapiens
gtctgagagaggccattc

SEQ ID NO: 1387090 - DNA, 23 bp, Homo sapiens
gtctgctcagacagaacccctac

SEQ ID NO: 1387091 - DNA, 17 bp, Homo sapiens
gtctggcacagcctggc

SEQ ID NO: 1387092 - DNA, 19 bp, Homo sapiens
gtctggcagtttatattta

SEQ ID NO: 1387093 - DNA, 18 bp, Homo sapiens
gtctgtccagataagtta

SEQ ID NO: 1387094 - DNA, 13 bp, Homo sapiens
gtctgtggatttt

SEQ ID NO: 1387095 - DNA, 17 bp, Homo sapiens
gtctgttcacttttcct

SEQ ID NO: 1387096 - DNA, 13 bp, Homo sapiens
gtctgtttactgc

SEQ ID NO: 1387097 - DNA, 18 bp, Homo sapiens
gtcttcctgacactttaa

SEQ ID NO: 1387098 - DNA, 19 bp, Homo sapiens
gtcttcctgacactttaat

SEQ ID NO: 1387099 - DNA, 15 bp, Homo sapiens
gtctttggttcagct

SEQ ID NO: 1387100 - DNA, 16 bp, Homo sapiens
gtctttttagatgccc

SEQ ID NO: 1387101 - DNA, 20 bp, Homo sapiens
gtgaactaagttttttactt

SEQ ID NO: 1387102 - DNA, 15 bp, Homo sapiens
gtgaagcatccaggc

SEQ ID NO: 1387103 - DNA, 13 bp, Homo sapiens
gtgacaaaaaatt

SEQ ID NO: 1387104 - DNA, 13 bp, Homo sapiens
gtgacacaaacac

SEQ ID NO: 1387105 - DNA, 19 bp, Homo sapiens
gtgacagggcgggggtggc

SEQ ID NO: 1387106 - DNA, 17 bp, Homo sapiens
gtgaccaaaagttacat

SEQ ID NO: 1387107 - DNA, 19 bp, Homo sapiens
gtgacgtctgggtggccct

SEQ ID NO: 1387108 - DNA, 12 bp, Homo sapiens
gtgactggcacc

SEQ ID NO: 1387109 - DNA, 20 bp, Homo sapiens
gtgagaacctgggttgcaga

SEQ ID NO: 1387110 - DNA, 15 bp, Homo sapiens
gtgatgtgagttgca

SEQ ID NO: 1387111 - DNA, 16 bp, Homo sapiens
gtgattcaatctgtaa

SEQ ID NO: 1387112 - DNA, 13 bp, Homo sapiens
gtgattctgcctt

SEQ ID NO: 1387113 - DNA, 21 bp, Homo sapiens
gtgatttttatgccacctgaa

SEQ ID NO: 1387114 - DNA, 15 bp, Homo sapiens
gtgcaaggacctaaa

SEQ ID NO: 1387115 - DNA, 20 bp, Homo sapiens
gtgcaatgtaaatattttaa

SEQ ID NO: 1387116 - DNA, 18 bp, Homo sapiens
gtgcagcaaccagagcac

SEQ ID NO: 1387117 - DNA, 17 bp, Homo sapiens
gtgcatttatgagctct

SEQ ID NO: 1387118 - DNA, 12 bp, Homo sapiens
gtgccttcattt

SEQ ID NO: 1387119 - DNA, 19 bp, Homo sapiens
gtgccttgtcacgccagac

SEQ ID NO: 1387120 - DNA, 15 bp, Homo sapiens
gtgcgtggtggtccc

SEQ ID NO: 1387121 - DNA, 23 bp, Homo sapiens
gtgcttaaaaatgccaaaaacaa

SEQ ID NO: 1387122 - DNA, 16 bp, Homo sapiens
gtgcttatggtaccag

SEQ ID NO: 1387123 - DNA, 21 bp, Homo sapiens
gtgcttctagttctgccagga

SEQ ID NO: 1387124 - DNA, 18 bp, Homo sapiens
gtgcttgatagaaatgcc

SEQ ID NO: 1387125 - DNA, 17 bp, Homo sapiens
gtggcactggggcaggg

SEQ ID NO: 1387126 - DNA, 17 bp, Homo sapiens
gtggcagtgcagcaacc

SEQ ID NO: 1387127 - DNA, 22 bp, Homo sapiens
gtggcagtgcagcaaccagagc

SEQ ID NO: 1387128 - DNA, 14 bp, Homo sapiens
gtggcatccagagt

SEQ ID NO: 1387129 - DNA, 23 bp, Homo sapiens
gtggccaggccgggaaaaagccc

SEQ ID NO: 1387130 - DNA, 18 bp, Homo sapiens
gtggctcgggaggcgaag

SEQ ID NO: 1387131 - DNA, 21 bp, Homo sapiens
gtgggagaccggcctgccagg

SEQ ID NO: 1387132 - DNA, 23 bp, Homo sapiens
gtgggagaccggcctgccaggag

SEQ ID NO: 1387133 - DNA, 12 bp, Homo sapiens
gtggggagtggg

SEQ ID NO: 1387134 - DNA, 12 bp, Homo sapiens
gtggtaaaaagg

SEQ ID NO: 1387135 - DNA, 16 bp, Homo sapiens
gtgtacataactgaaa

SEQ ID NO: 1387136 - DNA, 14 bp, Homo sapiens
gtgtagctttgctc

SEQ ID NO: 1387137 - DNA, 12 bp, Homo sapiens
gtgtatatatat

SEQ ID NO: 1387138 - DNA, 21 bp, Homo sapiens
gtgtcactcaaggcggtgctt

SEQ ID NO: 1387139 - DNA, 15 bp, Homo sapiens
gtgtctgctcagtaa

SEQ ID NO: 1387140 - DNA, 15 bp, Homo sapiens
gtgtgtctgctcagt

SEQ ID NO: 1387141 - DNA, 16 bp, Homo sapiens
gtgtgtctgctcagta

SEQ ID NO: 1387142 - DNA, 12 bp, Homo sapiens
gtgttaattttt

SEQ ID NO: 1387143 - DNA, 23 bp, Homo sapiens
gtgttacccagtaactcatctgt

SEQ ID NO: 1387144 - DNA, 16 bp, Homo sapiens
gtgttgaaaatgttca

SEQ ID NO: 1387145 - DNA, 21 bp, Homo sapiens
gtgtttaaagttcaacatgtt

SEQ ID NO: 1387146 - DNA, 17 bp, Homo sapiens
gttaaaatataaattaa

SEQ ID NO: 1387147 - DNA, 18 bp, Homo sapiens
gttaaaatataaattaag

SEQ ID NO: 1387148 - DNA, 14 bp, Homo sapiens
gttaaatgtgtgta

SEQ ID NO: 1387149 - DNA, 17 bp, Homo sapiens
gttaagacttgacagtg

SEQ ID NO: 1387150 - DNA, 14 bp, Homo sapiens
gttaatttttgata

SEQ ID NO: 1387151 - DNA, 20 bp, Homo sapiens
gttacccagtaactcatctg

SEQ ID NO: 1387152 - DNA, 13 bp, Homo sapiens
gttacctactttg

SEQ ID NO: 1387153 - DNA, 15 bp, Homo sapiens
gttactacatgcact

SEQ ID NO: 1387154 - DNA, 19 bp, Homo sapiens
gttagatatgtgccaaagt

SEQ ID NO: 1387155 - DNA, 15 bp, Homo sapiens
gttatctaagttaat

SEQ ID NO: 1387156 - DNA, 11 bp, Homo sapiens
gttatttaaat

SEQ ID NO: 1387157 - DNA, 13 bp, Homo sapiens
gttatttataatg

SEQ ID NO: 1387158 - DNA, 14 bp, Homo sapiens
gttatttttattat

SEQ ID NO: 1387159 - DNA, 17 bp, Homo sapiens
gttcaagcgattctctt

SEQ ID NO: 1387160 - DNA, 19 bp, Homo sapiens
gttcagctaagctaggaat

SEQ ID NO: 1387161 - DNA, 20 bp, Homo sapiens
gttccccactgtatctaggc

SEQ ID NO: 1387162 - DNA, 14 bp, Homo sapiens
gttctgaaatttaa

SEQ ID NO: 1387163 - DNA, 13 bp, Homo sapiens
gttctgccaggag

SEQ ID NO: 1387164 - DNA, 16 bp, Homo sapiens
gttctgtataaaatgc

SEQ ID NO: 1387165 - DNA, 17 bp, Homo sapiens
gttctttttattttaac

SEQ ID NO: 1387166 - DNA, 18 bp, Homo sapiens
gttgaagcaaatcgaatg

SEQ ID NO: 1387167 - DNA, 23 bp, Homo sapiens
gttgaagcaaatcgaatgaaatt

SEQ ID NO: 1387168 - DNA, 15 bp, Homo sapiens
gttgagagtgtgacc

SEQ ID NO: 1387169 - DNA, 16 bp, Homo sapiens
gttgagttggacacac

SEQ ID NO: 1387170 - DNA, 23 bp, Homo sapiens
gttgcacctcaggcagaggatgt

SEQ ID NO: 1387171 - DNA, 16 bp, Homo sapiens
tatcctaaacatcatt

SEQ ID NO: 1387172 - DNA, 23 bp, Homo sapiens
tatctaagttaatttaaagttgt

SEQ ID NO: 1387173 - DNA, 18 bp, Homo sapiens
tatctctgtgtgcacaaa

SEQ ID NO: 1387174 - DNA, 19 bp, Homo sapiens
tatctgaatttttaaacaa

SEQ ID NO: 1387175 - DNA, 23 bp, Homo sapiens
tatctgagttacagaaatgatta

SEQ ID NO: 1387176 - DNA, 14 bp, Homo sapiens
tatcttcacttgtc

SEQ ID NO: 1387177 - DNA, 14 bp, Homo sapiens
tatgaaaagctaga

SEQ ID NO: 1387178 - DNA, 19 bp, Homo sapiens
tatgaaaagctagaattga

SEQ ID NO: 1387179 - DNA, 17 bp, Homo sapiens
tatgaacatattgttga

SEQ ID NO: 1387180 - DNA, 21 bp, Homo sapiens
tatgaatctctacgcaaaaaa

SEQ ID NO: 1387181 - DNA, 19 bp, Homo sapiens
tatgacatcacttgtacaa

SEQ ID NO: 1387182 - DNA, 24 bp, Homo sapiens
tatgacatcacttgtacaaaataa

SEQ ID NO: 1387183 - DNA, 23 bp, Homo sapiens
tatgagtaggtttggccccctca

SEQ ID NO: 1387184 - DNA, 20 bp, Homo sapiens
tatgccacctgaataaagaa

SEQ ID NO: 1387185 - DNA, 21 bp, Homo sapiens
tatgcttactgatatatttta

SEQ ID NO: 1387186 - DNA, 16 bp, Homo sapiens
tatgcttgcaaaaact

SEQ ID NO: 1387187 - DNA, 14 bp, Homo sapiens
tatggaataagtgt

SEQ ID NO: 1387188 - DNA, 13 bp, Homo sapiens
tatggattctaaa

SEQ ID NO: 1387189 - DNA, 16 bp, Homo sapiens
tatggattctaaaatg

SEQ ID NO: 1387190 - DNA, 15 bp, Homo sapiens
tatggtgctctgtct

SEQ ID NO: 1387191 - DNA, 14 bp, Homo sapiens
tatgtaccaagaat

SEQ ID NO: 1387192 - DNA, 19 bp, Homo sapiens
tatgtctcttctgagctat

SEQ ID NO: 1387193 - DNA, 19 bp, Homo sapiens
tatgtgccaaagtccattt

SEQ ID NO: 1387194 - DNA, 16 bp, Homo sapiens
tattaaggtgtggctt

SEQ ID NO: 1387195 - DNA, 16 bp, Homo sapiens
tattacactctgtaat

SEQ ID NO: 1387196 - DNA, 19 bp, Homo sapiens
tattacactctgtaattga

SEQ ID NO: 1387197 - DNA, 12 bp, Homo sapiens
tattatcttttc

SEQ ID NO: 1387198 - DNA, 14 bp, Homo sapiens
tattatcttttcat

SEQ ID NO: 1387199 - DNA, 19 bp, Homo sapiens
tattatcttttcatacatt

SEQ ID NO: 1387200 - DNA, 19 bp, Homo sapiens
tattattacttatttttga

SEQ ID NO: 1387201 - DNA, 14 bp, Homo sapiens
tattcattttctct

SEQ ID NO: 1387202 - DNA, 16 bp, Homo sapiens
tattcattttctctaa

SEQ ID NO: 1387203 - DNA, 14 bp, Homo sapiens
tattcctattgtgc

SEQ ID NO: 1387204 - DNA, 18 bp, Homo sapiens
tattcctcctgctcatat

SEQ ID NO: 1387205 - DNA, 17 bp, Homo sapiens
tattgataagatctttt

SEQ ID NO: 1387206 - DNA, 19 bp, Homo sapiens
tattgataagatcttttat

SEQ ID NO: 1387207 - DNA, 14 bp, Homo sapiens
tatttaaaaaacta

SEQ ID NO: 1387208 - DNA, 23 bp, Homo sapiens
tatttaaaatagcaaaagaagaa

SEQ ID NO: 1387209 - DNA, 16 bp, Homo sapiens
tatttaaacaaatgtg

SEQ ID NO: 1387210 - DNA, 20 bp, Homo sapiens
tatttaatagcaaagaattg

SEQ ID NO: 1387211 - DNA, 16 bp, Homo sapiens
tatttatatgttatta

SEQ ID NO: 1387212 - DNA, 12 bp, Homo sapiens
tatttatcttta

SEQ ID NO: 1387213 - DNA, 12 bp, Homo sapiens
tatttatttaaa

SEQ ID NO: 1387214 - DNA, 14 bp, Homo sapiens
tatttatttaaaca

SEQ ID NO: 1387215 - DNA, 15 bp, Homo sapiens
tatttatttaaacaa

SEQ ID NO: 1387216 - DNA, 14 bp, Homo sapiens
tatttgaacttttt

SEQ ID NO: 1387217 - DNA, 16 bp, Homo sapiens
tatttgcctaaatact

SEQ ID NO: 1387218 - DNA, 13 bp, Homo sapiens
tattttaaagaat

SEQ ID NO: 1387219 - DNA, 16 bp, Homo sapiens
tattttcaagaaactg

SEQ ID NO: 1387220 - DNA, 14 bp, Homo sapiens
tattttcagatgtg

SEQ ID NO: 1387221 - DNA, 23 bp, Homo sapiens
tattttgccaagggcataaatta

SEQ ID NO: 1387222 - DNA, 14 bp, Homo sapiens
tcaaaagggccaaa

SEQ ID NO: 1387223 - DNA, 16 bp, Homo sapiens
tcaaaatatttgtaca

SEQ ID NO: 1387224 - DNA, 17 bp, Homo sapiens
tcaaaatatttgtacat

SEQ ID NO: 1387225 - DNA, 19 bp, Homo sapiens
tcaaaatatttgtacatag

SEQ ID NO: 1387226 - DNA, 19 bp, Homo sapiens
tcaaactgaggaatttcac

SEQ ID NO: 1387227 - DNA, 21 bp, Homo sapiens
tcaaagcaagcattcagaaga

SEQ ID NO: 1387228 - DNA, 18 bp, Homo sapiens
tcaaagccggttgcagag

SEQ ID NO: 1387229 - DNA, 16 bp, Homo sapiens
tcaaattcttctgaac

SEQ ID NO: 1387230 - DNA, 21 bp, Homo sapiens
tcaaattcttctgaactcaaa

SEQ ID NO: 1387231 - DNA, 14 bp, Homo sapiens
tcaacaattctaaa

SEQ ID NO: 1387232 - DNA, 15 bp, Homo sapiens
tcaacagtgaagaca

SEQ ID NO: 1387233 - DNA, 22 bp, Homo sapiens
tcaacagttttcctatgctttg

SEQ ID NO: 1387234 - DNA, 20 bp, Homo sapiens
tcaacatctttttcctccct

SEQ ID NO: 1387235 - DNA, 17 bp, Homo sapiens
tcaaccccagacactgg

SEQ ID NO: 1387236 - DNA, 15 bp, Homo sapiens
tcaacccctcccctc

SEQ ID NO: 1387237 - DNA, 21 bp, Homo sapiens
tcaacccctcccctccatccc

SEQ ID NO: 1387238 - DNA, 21 bp, Homo sapiens
tcaactctcttattgcctcac

SEQ ID NO: 1387239 - DNA, 18 bp, Homo sapiens
tcaagaaactgaggaatt

SEQ ID NO: 1387240 - DNA, 22 bp, Homo sapiens
tcaagaaactgaggaattttct

SEQ ID NO: 1387241 - DNA, 14 bp, Homo sapiens
tcaagaaataagtt

SEQ ID NO: 1387242 - DNA, 17 bp, Homo sapiens
tcaagaaataagttttt

SEQ ID NO: 1387243 - DNA, 14 bp, Homo sapiens
tcaaggaaaataag

SEQ ID NO: 1387244 - DNA, 20 bp, Homo sapiens
tcaaggaaaataagtgaaat

SEQ ID NO: 1387245 - DNA, 15 bp, Homo sapiens
tcaagggtcaggcct

SEQ ID NO: 1387246 - DNA, 15 bp, Homo sapiens
tcaagtcatgatgga

SEQ ID NO: 1387247 - DNA, 16 bp, Homo sapiens
tcaatctgtaaactgt

SEQ ID NO: 1387248 - DNA, 16 bp, Homo sapiens
tcaattactggtccaa

SEQ ID NO: 1387249 - DNA, 15 bp, Homo sapiens
tcaattcaaagctgt

SEQ ID NO: 1387250 - DNA, 17 bp, Homo sapiens
tcaattcaaagctgtgt

SEQ ID NO: 1387251 - DNA, 22 bp, Homo sapiens
tcacaacagcctgacaacattt

SEQ ID NO: 1387252 - DNA, 22 bp, Homo sapiens
tcacacccaacttggttttgct

SEQ ID NO: 1387253 - DNA, 14 bp, Homo sapiens
tcacattagaagac

SEQ ID NO: 1387254 - DNA, 14 bp, Homo sapiens
tcacattttccttt

SEQ ID NO: 1387255 - DNA, 18 bp, Homo sapiens
tcacattttccttttcaa

SEQ ID NO: 1387256 - DNA, 12 bp, Homo sapiens
tcaccacaaact

SEQ ID NO: 1387257 - DNA, 15 bp, Homo sapiens
tcaccagatttgcta

SEQ ID NO: 1387258 - DNA, 21 bp, Homo sapiens
tcaccatgttagccaggctgg

SEQ ID NO: 1387259 - DNA, 18 bp, Homo sapiens
tcaccggggtggtttagt

SEQ ID NO: 1387260 - DNA, 19 bp, Homo sapiens
tcacctgagtcaccctacc

SEQ ID NO: 1387261 - DNA, 19 bp, Homo sapiens
tcacctggaagcatttgtt

SEQ ID NO: 1387262 - DNA, 17 bp, Homo sapiens
tcacctgtaaacctgag

SEQ ID NO: 1387263 - DNA, 14 bp, Homo sapiens
tcacgctttcctga

SEQ ID NO: 1387264 - DNA, 16 bp, Homo sapiens
tcacgctttttgaaaa

SEQ ID NO: 1387265 - DNA, 14 bp, Homo sapiens
tcactaattcatta

SEQ ID NO: 1387266 - DNA, 15 bp, Homo sapiens
tcactaattcattaa

SEQ ID NO: 1387267 - DNA, 12 bp, Homo sapiens
tcactcaaggcg

SEQ ID NO: 1387268 - DNA, 20 bp, Homo sapiens
tcactcaaggcggtgcttga

SEQ ID NO: 1387269 - DNA, 23 bp, Homo sapiens
tcactgagttttccatggcagga

SEQ ID NO: 1387270 - DNA, 16 bp, Homo sapiens
tcacttgtacaaaata

SEQ ID NO: 1387271 - DNA, 17 bp, Homo sapiens
tcacttgtacaaaataa

SEQ ID NO: 1387272 - DNA, 19 bp, Homo sapiens
tcacttttaatgaacaaat

SEQ ID NO: 1387273 - DNA, 12 bp, Homo sapiens
tcacttttcctc

SEQ ID NO: 1387274 - DNA, 18 bp, Homo sapiens
tcacttttcctccctcag

SEQ ID NO: 1387275 - DNA, 20 bp, Homo sapiens
tcagaaaatatccctcctgt

SEQ ID NO: 1387276 - DNA, 22 bp, Homo sapiens
tcagaatagcttccaataaagc

SEQ ID NO: 1387277 - DNA, 14 bp, Homo sapiens
tcagactgtttagt

SEQ ID NO: 1387278 - DNA, 19 bp, Homo sapiens
tcagagggtgtcctgcacc

SEQ ID NO: 1387279 - DNA, 13 bp, Homo sapiens
tcagatcctcctc

SEQ ID NO: 1387280 - DNA, 14 bp, Homo sapiens
tcagatcctcctca

SEQ ID NO: 1387281 - DNA, 19 bp, Homo sapiens
tcagattcccagagcaaaa

SEQ ID NO: 1387282 - DNA, 22 bp, Homo sapiens
tcagattcccagagcaaaataa

SEQ ID NO: 1387283 - DNA, 15 bp, Homo sapiens
tcagcaaactctttt

SEQ ID NO: 1387284 - DNA, 16 bp, Homo sapiens
tcagcatgtctattca

SEQ ID NO: 1387285 - DNA, 21 bp, Homo sapiens
tcagcatgtctattcagcttc

SEQ ID NO: 1387286 - DNA, 17 bp, Homo sapiens
tcagcattttcttagac

SEQ ID NO: 1387287 - DNA, 23 bp, Homo sapiens
tcagcctccatcctaccccctgt

SEQ ID NO: 1387288 - DNA, 16 bp, Homo sapiens
tcagctagctctgcca

SEQ ID NO: 1387289 - DNA, 20 bp, Homo sapiens
tcagctcccttcccctgcct

SEQ ID NO: 1387290 - DNA, 16 bp, Homo sapiens
tcagctctgacattct

SEQ ID NO: 1387291 - DNA, 22 bp, Homo sapiens
tcagctctgacattctgattcg

SEQ ID NO: 1387292 - DNA, 18 bp, Homo sapiens
tcagctgattgtttattt

SEQ ID NO: 1387293 - DNA, 21 bp, Homo sapiens
tcagcttcgtttattttcaag

SEQ ID NO: 1387294 - DNA, 18 bp, Homo sapiens
tcaggaaaattgaatgca

SEQ ID NO: 1387295 - DNA, 12 bp, Homo sapiens
tcaggagccctg

SEQ ID NO: 1387296 - DNA, 14 bp, Homo sapiens
tcaggagccctggg

SEQ ID NO: 1387297 - DNA, 18 bp, Homo sapiens
tcaggagccctgggaggc

SEQ ID NO: 1387298 - DNA, 20 bp, Homo sapiens
tcaggagccctgggaggctc

SEQ ID NO: 1387299 - DNA, 22 bp, Homo sapiens
tcaggcagaggatgttctggac

SEQ ID NO: 1387300 - DNA, 21 bp, Homo sapiens
tcaggcccccacctggctcac

SEQ ID NO: 1387301 - DNA, 16 bp, Homo sapiens
tgactctttccaaccg

SEQ ID NO: 1387302 - DNA, 14 bp, Homo sapiens
tgactgccaagact

SEQ ID NO: 1387303 - DNA, 13 bp, Homo sapiens
tgactgtcactgt

SEQ ID NO: 1387304 - DNA, 16 bp, Homo sapiens
tgactgtcactgttcc

SEQ ID NO: 1387305 - DNA, 14 bp, Homo sapiens
tgactttttgcatt

SEQ ID NO: 1387306 - DNA, 23 bp, Homo sapiens
tgagaacctgggttgcagacagg

SEQ ID NO: 1387307 - DNA, 18 bp, Homo sapiens
tgagaatctatatttaac

SEQ ID NO: 1387308 - DNA, 21 bp, Homo sapiens
tgagacaagaaaataagagct

SEQ ID NO: 1387309 - DNA, 16 bp, Homo sapiens
tgagacaatgccttgt

SEQ ID NO: 1387310 - DNA, 21 bp, Homo sapiens
tgagactaatcttattcattt

SEQ ID NO: 1387311 - DNA, 18 bp, Homo sapiens
tgagagacattaactcat

SEQ ID NO: 1387312 - DNA, 14 bp, Homo sapiens
tgagagtgtgacca

SEQ ID NO: 1387313 - DNA, 21 bp, Homo sapiens
tgagataatctaaatataaac

SEQ ID NO: 1387314 - DNA, 15 bp, Homo sapiens
tgagatacatacaga

SEQ ID NO: 1387315 - DNA, 15 bp, Homo sapiens
tgagcatcacagaat

SEQ ID NO: 1387316 - DNA, 15 bp, Homo sapiens
tgagctgaccagccg

SEQ ID NO: 1387317 - DNA, 18 bp, Homo sapiens
tgaggaagcctaaataaa

SEQ ID NO: 1387318 - DNA, 21 bp, Homo sapiens
tgaggaatttcacctgtaaac

SEQ ID NO: 1387319 - DNA, 13 bp, Homo sapiens
tgaggaattttct

SEQ ID NO: 1387320 - DNA, 18 bp, Homo sapiens
tgaggaattttctttgtg

SEQ ID NO: 1387321 - DNA, 19 bp, Homo sapiens
tgaggagacacacctgagg

SEQ ID NO: 1387322 - DNA, 16 bp, Homo sapiens
tgaggagcttgaaacc

SEQ ID NO: 1387323 - DNA, 16 bp, Homo sapiens
tgaggcactgataata

SEQ ID NO: 1387324 - DNA, 15 bp, Homo sapiens
tgaggctcagcccta

SEQ ID NO: 1387325 - DNA, 17 bp, Homo sapiens
tgagggaaaagaaaaag

SEQ ID NO: 1387326 - DNA, 14 bp, Homo sapiens
tgaggggaccagga

SEQ ID NO: 1387327 - DNA, 15 bp, Homo sapiens
tgaggggaccaggag

SEQ ID NO: 1387328 - DNA, 21 bp, Homo sapiens
tgaggttaaaatataaattaa

SEQ ID NO: 1387329 - DNA, 17 bp, Homo sapiens
tgagtcgtacagaaagc

SEQ ID NO: 1387330 - DNA, 19 bp, Homo sapiens
tgagtgttttatgagaaag

SEQ ID NO: 1387331 - DNA, 14 bp, Homo sapiens
tgagttacagaaat

SEQ ID NO: 1387332 - DNA, 13 bp, Homo sapiens
tgagttggacaca

SEQ ID NO: 1387333 - DNA, 18 bp, Homo sapiens
tgataaagattttttaat

SEQ ID NO: 1387334 - DNA, 16 bp, Homo sapiens
tgataaagtaaaaaag

SEQ ID NO: 1387335 - DNA, 20 bp, Homo sapiens
tgataaagtaaaaaagttaa

SEQ ID NO: 1387336 - DNA, 22 bp, Homo sapiens
tgataagatcttttattttgcc

SEQ ID NO: 1387337 - DNA, 15 bp, Homo sapiens
tgatatattttacaa

SEQ ID NO: 1387338 - DNA, 15 bp, Homo sapiens
tgatattttctctag

SEQ ID NO: 1387339 - DNA, 17 bp, Homo sapiens
tgatattttctgtgcct

SEQ ID NO: 1387340 - DNA, 12 bp, Homo sapiens
tgatcaaggcct

SEQ ID NO: 1387341 - DNA, 15 bp, Homo sapiens
tgatccttacaagtt

SEQ ID NO: 1387342 - DNA, 16 bp, Homo sapiens
tgatgaaaataaagaa

SEQ ID NO: 1387343 - DNA, 17 bp, Homo sapiens
tgatgaaaataaagaat

SEQ ID NO: 1387344 - DNA, 15 bp, Homo sapiens
tgatgaaaccttgaa

SEQ ID NO: 1387345 - DNA, 21 bp, Homo sapiens
tgatgccaaaaaaaaatacat

SEQ ID NO: 1387346 - DNA, 21 bp, Homo sapiens
tgatgcctctgtcttctggac

SEQ ID NO: 1387347 - DNA, 11 bp, Homo sapiens
tgatgcctggc

SEQ ID NO: 1387348 - DNA, 15 bp, Homo sapiens
tgatggcaattttgt

SEQ ID NO: 1387349 - DNA, 17 bp, Homo sapiens
tgatggcaattttgtaa

SEQ ID NO: 1387350 - DNA, 22 bp, Homo sapiens
tgatgtaactgagaatttgtgt

SEQ ID NO: 1387351 - DNA, 12 bp, Homo sapiens
tgatgttaaaaa

SEQ ID NO: 1387352 - DNA, 14 bp, Homo sapiens
tgattacagtgcag

SEQ ID NO: 1387353 - DNA, 11 bp, Homo sapiens
tgattatcagg

SEQ ID NO: 1387354 - DNA, 16 bp, Homo sapiens
tgattcaatctgtaaa

SEQ ID NO: 1387355 - DNA, 17 bp, Homo sapiens
tgattcaatctgtaaac

SEQ ID NO: 1387356 - DNA, 21 bp, Homo sapiens
tgattcaatctgtaaactgtg

SEQ ID NO: 1387357 - DNA, 23 bp, Homo sapiens
tgattcaatctgtaaactgtgta

SEQ ID NO: 1387358 - DNA, 14 bp, Homo sapiens
tgattgtcttaata

SEQ ID NO: 1387359 - DNA, 13 bp, Homo sapiens
tgattgtttattt

SEQ ID NO: 1387360 - DNA, 23 bp, Homo sapiens
tgatttattaatatatattatct

SEQ ID NO: 1387361 - DNA, 11 bp, Homo sapiens
tgatttctagg

SEQ ID NO: 1387362 - DNA, 19 bp, Homo sapiens
tgattttagccttctctgt

SEQ ID NO: 1387363 - DNA, 22 bp, Homo sapiens
tgcaaacctgacccctgctcag

SEQ ID NO: 1387364 - DNA, 16 bp, Homo sapiens
tgcaaggtctttggtt

SEQ ID NO: 1387365 - DNA, 20 bp, Homo sapiens
tgcacaataaaaatgtttaa

SEQ ID NO: 1387366 - DNA, 18 bp, Homo sapiens
tgcacacaaacacctcct

SEQ ID NO: 1387367 - DNA, 16 bp, Homo sapiens
tgcaccaaagagaatg

SEQ ID NO: 1387368 - DNA, 22 bp, Homo sapiens
tgcaccggggcctgggcaggag

SEQ ID NO: 1387369 - DNA, 13 bp, Homo sapiens
tgcacctaaagaa

SEQ ID NO: 1387370 - DNA, 15 bp, Homo sapiens
tgcacctaaagaaaa

SEQ ID NO: 1387371 - DNA, 19 bp, Homo sapiens
tgcacctaaagaaaaacaa

SEQ ID NO: 1387372 - DNA, 18 bp, Homo sapiens
tgcacctttctagttgaa

SEQ ID NO: 1387373 - DNA, 16 bp, Homo sapiens
tgcacttggctgcata

SEQ ID NO: 1387374 - DNA, 18 bp, Homo sapiens
tgcagacaggaatcttaa

SEQ ID NO: 1387375 - DNA, 20 bp, Homo sapiens
tgcagacaggaatcttaagg

SEQ ID NO: 1387376 - DNA, 14 bp, Homo sapiens
tgcagactcactgt

SEQ ID NO: 1387377 - DNA, 14 bp, Homo sapiens
tgcagcaaccagag

SEQ ID NO: 1387378 - DNA, 22 bp, Homo sapiens
tgcagcaaccagagcactgtat

SEQ ID NO: 1387379 - DNA, 19 bp, Homo sapiens
tgcaggaatctttaaaaga

SEQ ID NO: 1387380 - DNA, 22 bp, Homo sapiens
tgcagggggtgtgtctgctcag

SEQ ID NO: 1387381 - DNA, 12 bp, Homo sapiens
tgcaggtcccta

SEQ ID NO: 1387382 - DNA, 15 bp, Homo sapiens
tgcaggtccctaata

SEQ ID NO: 1387383 - DNA, 18 bp, Homo sapiens
tgcaggtccctaataaag

SEQ ID NO: 1387384 - DNA, 18 bp, Homo sapiens
tgcatccattctcctgag

SEQ ID NO: 1387385 - DNA, 15 bp, Homo sapiens
tgcattactgcatgc

SEQ ID NO: 1387386 - DNA, 18 bp, Homo sapiens
tgcattactgcatgcact

SEQ ID NO: 1387387 - DNA, 17 bp, Homo sapiens
tgcatttaaaacagaca

SEQ ID NO: 1387388 - DNA, 16 bp, Homo sapiens
tgccaaaaaaaaatac

SEQ ID NO: 1387389 - DNA, 14 bp, Homo sapiens
tgccaagactgctg

SEQ ID NO: 1387390 - DNA, 17 bp, Homo sapiens
tgccaagactgctgtgg

SEQ ID NO: 1387391 - DNA, 21 bp, Homo sapiens
tgccaagactgctgtggccag

SEQ ID NO: 1387392 - DNA, 22 bp, Homo sapiens
tgccaagactgctgtggccagg

SEQ ID NO: 1387393 - DNA, 15 bp, Homo sapiens
tgccaattagcaatt

SEQ ID NO: 1387394 - DNA, 21 bp, Homo sapiens
tgccaggaggacccagggctc

SEQ ID NO: 1387395 - DNA, 19 bp, Homo sapiens
tgccatgatgcctctgtct

SEQ ID NO: 1387396 - DNA, 20 bp, Homo sapiens
tgccatgatgcctctgtctt

SEQ ID NO: 1387397 - DNA, 17 bp, Homo sapiens
tgccatgtcaaacaaat

SEQ ID NO: 1387398 - DNA, 20 bp, Homo sapiens
tgcccaaatccttagatctg

SEQ ID NO: 1387399 - DNA, 16 bp, Homo sapiens
tgcccatgcctccagc

SEQ ID NO: 1387400 - DNA, 21 bp, Homo sapiens
tgcccccaaccatttcctcag

SEQ ID NO: 1387401 - DNA, 16 bp, Homo sapiens
tgcccccatctttcct

SEQ ID NO: 1387402 - DNA, 18 bp, Homo sapiens
tgccctcattttatgtca

SEQ ID NO: 1387403 - DNA, 14 bp, Homo sapiens
tgcccttctcctta

SEQ ID NO: 1387404 - DNA, 13 bp, Homo sapiens
tgcctaaaatgtt

SEQ ID NO: 1387405 - DNA, 15 bp, Homo sapiens
tgcctaaaatgttct

SEQ ID NO: 1387406 - DNA, 13 bp, Homo sapiens
tgcctcccatgcc

SEQ ID NO: 1387407 - DNA, 16 bp, Homo sapiens
tgcctcccatgcctgg

SEQ ID NO: 1387408 - DNA, 23 bp, Homo sapiens
tgcctccctctcgtaagatttcc

SEQ ID NO: 1387409 - DNA, 19 bp, Homo sapiens
tgcctcctcacccccagct

SEQ ID NO: 1387410 - DNA, 14 bp, Homo sapiens
tgcctcctgccggc

SEQ ID NO: 1387411 - DNA, 21 bp, Homo sapiens
tgcctcctgccggctccttgg

SEQ ID NO: 1387412 - DNA, 11 bp, Homo sapiens
tgcctctctgc

SEQ ID NO: 1387413 - DNA, 20 bp, Homo sapiens
tgcctctctgcaggtcccta

SEQ ID NO: 1387414 - DNA, 21 bp, Homo sapiens
tgcctctctgcaggtccctaa

SEQ ID NO: 1387415 - DNA, 20 bp, Homo sapiens
tgcctggtatatccaaaagc

SEQ ID NO: 1387416 - DNA, 23 bp, Homo sapiens
tgcctggtatatccaaaagcttt

SEQ ID NO: 1387417 - DNA, 15 bp, Homo sapiens
tgccttcctgttttt

SEQ ID NO: 1387418 - DNA, 19 bp, Homo sapiens
tgccttcctgtttttcaca

SEQ ID NO: 1387419 - DNA, 23 bp, Homo sapiens
tgcggttcaggaaaattgaatgc

SEQ ID NO: 1387420 - DNA, 22 bp, Homo sapiens
tgctaagagaagtagaaatcat

SEQ ID NO: 1387421 - DNA, 13 bp, Homo sapiens
tgctaccaaagca

SEQ ID NO: 1387422 - DNA, 15 bp, Homo sapiens
tgctactttatttgc

SEQ ID NO: 1387423 - DNA, 17 bp, Homo sapiens
tgctatcaaataactaa

SEQ ID NO: 1387424 - DNA, 16 bp, Homo sapiens
tgctatctctgtgtgc

SEQ ID NO: 1387425 - DNA, 15 bp, Homo sapiens
tgctatggtgctctg

SEQ ID NO: 1387426 - DNA, 17 bp, Homo sapiens
tgctatggttttctcca

SEQ ID NO: 1387427 - DNA, 14 bp, Homo sapiens
tgctcaggagccct

SEQ ID NO: 1387428 - DNA, 20 bp, Homo sapiens
tgctcaggagccctgggagg

SEQ ID NO: 1387429 - DNA, 13 bp, Homo sapiens
tgctcaggtactt

SEQ ID NO: 1387430 - DNA, 17 bp, Homo sapiens
tgctcaggtacttgtaa

SEQ ID NO: 1387431 - DNA, 17 bp, Homo sapiens
tgctcagtaatttgagg

SEQ ID NO: 1387432 - DNA, 20 bp, Homo sapiens
tgtaacttttgtaagacaaa

SEQ ID NO: 1387433 - DNA, 20 bp, Homo sapiens
tgtaagacaaaggttttcct

SEQ ID NO: 1387434 - DNA, 11 bp, Homo sapiens
tgtaatacaat

SEQ ID NO: 1387435 - DNA, 19 bp, Homo sapiens
tgtaattttgagtacagaa

SEQ ID NO: 1387436 - DNA, 21 bp, Homo sapiens
tgtacagttatctaagttaat

SEQ ID NO: 1387437 - DNA, 14 bp, Homo sapiens
tgtacataactgaa

SEQ ID NO: 1387438 - DNA, 18 bp, Homo sapiens
tgtacataactgaaaatg

SEQ ID NO: 1387439 - DNA, 13 bp, Homo sapiens
tgtacatatgtaa

SEQ ID NO: 1387440 - DNA, 19 bp, Homo sapiens
tgtacatatgtaaaatatt

SEQ ID NO: 1387441 - DNA, 14 bp, Homo sapiens
tgtaccaagcccct

SEQ ID NO: 1387442 - DNA, 18 bp, Homo sapiens
tgtactaaagccaaacat

SEQ ID NO: 1387443 - DNA, 19 bp, Homo sapiens
tgtacttgctcttgatgcc

SEQ ID NO: 1387444 - DNA, 16 bp, Homo sapiens
tgtagaatgatttcat

SEQ ID NO: 1387445 - DNA, 17 bp, Homo sapiens
tgtagaatgatttcatg

SEQ ID NO: 1387446 - DNA, 16 bp, Homo sapiens
tgtagccccagtgaca

SEQ ID NO: 1387447 - DNA, 20 bp, Homo sapiens
tgtagtgatttttatgccac

SEQ ID NO: 1387448 - DNA, 21 bp, Homo sapiens
tgtagtgatttttatgccacc

SEQ ID NO: 1387449 - DNA, 15 bp, Homo sapiens
tgtatcatagaaatg

SEQ ID NO: 1387450 - DNA, 15 bp, Homo sapiens
tgtcatagaaattac

SEQ ID NO: 1387451 - DNA, 16 bp, Homo sapiens
tgtcatagaaattaca

SEQ ID NO: 1387452 - DNA, 14 bp, Homo sapiens
tgtcccaggtcctc

SEQ ID NO: 1387453 - DNA, 22 bp, Homo sapiens
tgtccccggggtattagcacct

SEQ ID NO: 1387454 - DNA, 21 bp, Homo sapiens
tgtcctcagccccgcgtggaa

SEQ ID NO: 1387455 - DNA, 15 bp, Homo sapiens
tgtcctgtaaaggtt

SEQ ID NO: 1387456 - DNA, 13 bp, Homo sapiens
tgtccttctactc

SEQ ID NO: 1387457 - DNA, 18 bp, Homo sapiens
tgtcgattagactggaca

SEQ ID NO: 1387458 - DNA, 20 bp, Homo sapiens
tgtcgattagactggacagc

SEQ ID NO: 1387459 - DNA, 23 bp, Homo sapiens
tgtcgattagactggacagcttg

SEQ ID NO: 1387460 - DNA, 18 bp, Homo sapiens
tgtctattacctgttagt

SEQ ID NO: 1387461 - DNA, 14 bp, Homo sapiens
tgtctattcagctt

SEQ ID NO: 1387462 - DNA, 16 bp, Homo sapiens
tgtctcttctgagcta

SEQ ID NO: 1387463 - DNA, 23 bp, Homo sapiens
tgtctgaaaaggaggggtacatt

SEQ ID NO: 1387464 - DNA, 17 bp, Homo sapiens
tgtctggcacagcctgg

SEQ ID NO: 1387465 - DNA, 13 bp, Homo sapiens
tgtctgttctaca

SEQ ID NO: 1387466 - DNA, 13 bp, Homo sapiens
tgtgaaactaaaa

SEQ ID NO: 1387467 - DNA, 21 bp, Homo sapiens
tgtgaaactaaaattttctaa

SEQ ID NO: 1387468 - DNA, 17 bp, Homo sapiens
tgtgaatcaagggtcag

SEQ ID NO: 1387469 - DNA, 21 bp, Homo sapiens
tgtgaatcaagggtcaggcct

SEQ ID NO: 1387470 - DNA, 18 bp, Homo sapiens
tgtgaccaaaagttacat

SEQ ID NO: 1387471 - DNA, 14 bp, Homo sapiens
tgtgactctttcca

SEQ ID NO: 1387472 - DNA, 15 bp, Homo sapiens
tgtgactctttccaa

SEQ ID NO: 1387473 - DNA, 12 bp, Homo sapiens
tgtgactggcac

SEQ ID NO: 1387474 - DNA, 15 bp, Homo sapiens
tgtgattcaatctgt

SEQ ID NO: 1387475 - DNA, 17 bp, Homo sapiens
tgtgcaatgtaaatatt

SEQ ID NO: 1387476 - DNA, 18 bp, Homo sapiens
tgtgcccccaaccatttc

SEQ ID NO: 1387477 - DNA, 15 bp, Homo sapiens
tgtgcctcctcaccc

SEQ ID NO: 1387478 - DNA, 16 bp, Homo sapiens
tgtgcctcctcacccc

SEQ ID NO: 1387479 - DNA, 18 bp, Homo sapiens
tgtgctatactgcatact

SEQ ID NO: 1387480 - DNA, 16 bp, Homo sapiens
tgtgctcaggagccct

SEQ ID NO: 1387481 - DNA, 14 bp, Homo sapiens
tgtggatatttatt

SEQ ID NO: 1387482 - DNA, 15 bp, Homo sapiens
tgtggatatttattt

SEQ ID NO: 1387483 - DNA, 22 bp, Homo sapiens
tgtggattttttccttcaaagt

SEQ ID NO: 1387484 - DNA, 14 bp, Homo sapiens
tgtggcaagtgaat

SEQ ID NO: 1387485 - DNA, 19 bp, Homo sapiens
tgtggcatccagagtccct

SEQ ID NO: 1387486 - DNA, 14 bp, Homo sapiens
tgtggccaggaggt

SEQ ID NO: 1387487 - DNA, 15 bp, Homo sapiens
tgtggcctaacctgc

SEQ ID NO: 1387488 - DNA, 23 bp, Homo sapiens
tgtgggagaccggcctgccagga

SEQ ID NO: 1387489 - DNA, 18 bp, Homo sapiens
tgtggttccctaaagaca

SEQ ID NO: 1387490 - DNA, 15 bp, Homo sapiens
tgtgtacataactga

SEQ ID NO: 1387491 - DNA, 17 bp, Homo sapiens
tgtgtacataactgaaa

SEQ ID NO: 1387492 - DNA, 14 bp, Homo sapiens
tgtgtattccaaga

SEQ ID NO: 1387493 - DNA, 13 bp, Homo sapiens
tgtgtgtttggaa

SEQ ID NO: 1387494 - DNA, 14 bp, Homo sapiens
tgtgtttgctttct

SEQ ID NO: 1387495 - DNA, 16 bp, Homo sapiens
tgtgtttggctttcag

SEQ ID NO: 1387496 - DNA, 17 bp, Homo sapiens
tgtgtttggctttcagg

SEQ ID NO: 1387497 - DNA, 19 bp, Homo sapiens
tgttaaaaaaataagaaga

SEQ ID NO: 1387498 - DNA, 15 bp, Homo sapiens
tgttaagacttgaca

SEQ ID NO: 1387499 - DNA, 17 bp, Homo sapiens
tgttaagacttgacagt

SEQ ID NO: 1387500 - DNA, 20 bp, Homo sapiens
tgttaagacttgacagtgga

SEQ ID NO: 1387501 - DNA, 19 bp, Homo sapiens
tgttaatattgatttatta

SEQ ID NO: 1387502 - DNA, 15 bp, Homo sapiens
tgttaatttagaaaa

SEQ ID NO: 1387503 - DNA, 18 bp, Homo sapiens
tgttaatttagaaaactt

SEQ ID NO: 1387504 - DNA, 16 bp, Homo sapiens
tgttacctactttgac

SEQ ID NO: 1387505 - DNA, 17 bp, Homo sapiens
tgttatttgtaatagat

SEQ ID NO: 1387506 - DNA, 16 bp, Homo sapiens
tgttcacttttcctcc

SEQ ID NO: 1387507 - DNA, 16 bp, Homo sapiens
tgttcccatttcagct

SEQ ID NO: 1387508 - DNA, 12 bp, Homo sapiens
tgttctggacct

SEQ ID NO: 1387509 - DNA, 13 bp, Homo sapiens
tgttctgtttccc

SEQ ID NO: 1387510 - DNA, 20 bp, Homo sapiens
tgttgagcatcacagaatgt

SEQ ID NO: 1387511 - DNA, 14 bp, Homo sapiens
tgttgggagagggc

SEQ ID NO: 1387512 - DNA, 19 bp, Homo sapiens
tgttgggagagggcgcagg

SEQ ID NO: 1387513 - DNA, 20 bp, Homo sapiens
tgttgggagagggcgcaggc

SEQ ID NO: 1387514 - DNA, 15 bp, Homo sapiens
tgttgtttcttaaat

SEQ ID NO: 1387515 - DNA, 12 bp, Homo sapiens
tgtttaaaacat

SEQ ID NO: 1387516 - DNA, 13 bp, Homo sapiens
tgtttaaagttca

SEQ ID NO: 1387517 - DNA, 17 bp, Homo sapiens
tgtttatttttctatga

SEQ ID NO: 1387518 - DNA, 11 bp, Homo sapiens
tgtttctgtaa

SEQ ID NO: 1387519 - DNA, 18 bp, Homo sapiens
tgtttgcacctttctagt

SEQ ID NO: 1387520 - DNA, 17 bp, Homo sapiens
tgtttgtttcctttgtt

SEQ ID NO: 1387521 - DNA, 20 bp, Homo sapiens
tgttttaataaacgtttgaa

SEQ ID NO: 1387522 - DNA, 16 bp, Homo sapiens
tgttttatgagaaagc

SEQ ID NO: 1387523 - DNA, 11 bp, Homo sapiens
tgttttcttct

SEQ ID NO: 1387524 - DNA, 12 bp, Homo sapiens
tgttttttctaa

SEQ ID NO: 1387525 - DNA, 21 bp, Homo sapiens
ttaaaaaagcttaaaactttg

SEQ ID NO: 1387526 - DNA, 20 bp, Homo sapiens
ttaaaagatgcttttaacag

SEQ ID NO: 1387527 - DNA, 23 bp, Homo sapiens
ttaaaatagcaaaagaagaagtt

SEQ ID NO: 1387528 - DNA, 17 bp, Homo sapiens
ttaaaatataaattaag

SEQ ID NO: 1387529 - DNA, 17 bp, Homo sapiens
ttaaaatgtaaagccat

SEQ ID NO: 1387530 - DNA, 14 bp, Homo sapiens
ttaaacaaaggttg

SEQ ID NO: 1387531 - DNA, 23 bp, Homo sapiens
ttaaacagtgagcctgaattttg

SEQ ID NO: 1387532 - DNA, 19 bp, Homo sapiens
ttaaaccgctaaaagaaac

SEQ ID NO: 1387533 - DNA, 14 bp, Homo sapiens
ttaaagctgttatt

SEQ ID NO: 1387534 - DNA, 10 bp, Homo sapiens
ttaaatgtgt

SEQ ID NO: 1387535 - DNA, 11 bp, Homo sapiens
ttaaatgtgtg

SEQ ID NO: 1387536 - DNA, 15 bp, Homo sapiens
ttaaatgtgtgtaaa

SEQ ID NO: 1387537 - DNA, 14 bp, Homo sapiens
ttaacaacttgtct

SEQ ID NO: 1387538 - DNA, 12 bp, Homo sapiens
ttaacagaagtt

SEQ ID NO: 1387539 - DNA, 13 bp, Homo sapiens
ttaaccagatcta

SEQ ID NO: 1387540 - DNA, 15 bp, Homo sapiens
ttaactcattagact

SEQ ID NO: 1387541 - DNA, 17 bp, Homo sapiens
ttaactcattagactgg

SEQ ID NO: 1387542 - DNA, 17 bp, Homo sapiens
ttaactgggtaatgaaa

SEQ ID NO: 1387543 - DNA, 15 bp, Homo sapiens
ttaacttaaatagta

SEQ ID NO: 1387544 - DNA, 18 bp, Homo sapiens
ttaagatacactcctgct

SEQ ID NO: 1387545 - DNA, 21 bp, Homo sapiens
ttaagatacactcctgctgtg

SEQ ID NO: 1387546 - DNA, 15 bp, Homo sapiens
ttaagggacatgtat

SEQ ID NO: 1387547 - DNA, 22 bp, Homo sapiens
ttaaggtctgggagtgttctgt

SEQ ID NO: 1387548 - DNA, 13 bp, Homo sapiens
ttaagtcagaaca

SEQ ID NO: 1387549 - DNA, 19 bp, Homo sapiens
ttaataaacgtttgaaatt

SEQ ID NO: 1387550 - DNA, 15 bp, Homo sapiens
ttaatactcacctcc

SEQ ID NO: 1387551 - DNA, 15 bp, Homo sapiens
ttaatagcaaagaat

SEQ ID NO: 1387552 - DNA, 18 bp, Homo sapiens
ttaatagcaaagaattga

SEQ ID NO: 1387553 - DNA, 15 bp, Homo sapiens
ttaatataatttaac

SEQ ID NO: 1387554 - DNA, 14 bp, Homo sapiens
ttaatatcctaaac

SEQ ID NO: 1387555 - DNA, 20 bp, Homo sapiens
ttaatggtgccttcatttgg

SEQ ID NO: 1387556 - DNA, 13 bp, Homo sapiens
ttaattttcctgg

SEQ ID NO: 1387557 - DNA, 12 bp, Homo sapiens
ttaatttttgat

SEQ ID NO: 1387558 - DNA, 17 bp, Homo sapiens
ttacacccaaatattgt

SEQ ID NO: 1387559 - DNA, 22 bp, Homo sapiens
ttacactacacactgtgtactg

SEQ ID NO: 1387560 - DNA, 20 bp, Homo sapiens
ttacataattcactctgagt

SEQ ID NO: 1387561 - DNA, 16 bp, Homo sapiens
ttacatgattcatttt

SEQ ID NO: 1387562 - DNA, 13 bp, Homo sapiens
ttacatgtttgca

SEQ ID NO: 1387563 - DNA, 12 bp, Homo sapiens
ttaccaacctgt

SEQ ID NO: 1387564 - DNA, 23 bp, Homo sapiens
ttgaagttagctttaacttaaat

SEQ ID NO: 1387565 - DNA, 16 bp, Homo sapiens
ttgaatggctatgttt

SEQ ID NO: 1387566 - DNA, 22 bp, Homo sapiens
ttgaattatcttggttgaaaat

SEQ ID NO: 1387567 - DNA, 11 bp, Homo sapiens
ttgaattgaag

SEQ ID NO: 1387568 - DNA, 18 bp, Homo sapiens
ttgacaactggcaggcag

SEQ ID NO: 1387569 - DNA, 23 bp, Homo sapiens
ttgacactagcccaatgaaatga

SEQ ID NO: 1387570 - DNA, 16 bp, Homo sapiens
ttgagagaatttgtgc

SEQ ID NO: 1387571 - DNA, 15 bp, Homo sapiens
ttgagagtgtgacca

SEQ ID NO: 1387572 - DNA, 21 bp, Homo sapiens
ttgagataatctaaatataaa

SEQ ID NO: 1387573 - DNA, 18 bp, Homo sapiens
ttgaggttaaaatataaa

SEQ ID NO: 1387574 - DNA, 20 bp, Homo sapiens
ttgagtacagaattcaacag

SEQ ID NO: 1387575 - DNA, 17 bp, Homo sapiens
ttgataaagatttttta

SEQ ID NO: 1387576 - DNA, 19 bp, Homo sapiens
ttgataaagtaaaaaagtt

SEQ ID NO: 1387577 - DNA, 16 bp, Homo sapiens
ttgataagatctttta

SEQ ID NO: 1387578 - DNA, 14 bp, Homo sapiens
ttgattacagtgca

SEQ ID NO: 1387579 - DNA, 15 bp, Homo sapiens
ttgcacctttctagt

SEQ ID NO: 1387580 - DNA, 15 bp, Homo sapiens
ttgcactatctttca

SEQ ID NO: 1387581 - DNA, 20 bp, Homo sapiens
ttgcatttaaaacagacact

SEQ ID NO: 1387582 - DNA, 21 bp, Homo sapiens
ttgcatttaaaacagacactg

SEQ ID NO: 1387583 - DNA, 19 bp, Homo sapiens
ttgcctcttccagtcttcc

SEQ ID NO: 1387584 - DNA, 14 bp, Homo sapiens
ttgcctgtaacaag

SEQ ID NO: 1387585 - DNA, 14 bp, Homo sapiens
ttgctcttgatgcc

SEQ ID NO: 1387586 - DNA, 15 bp, Homo sapiens
ttgctgcaaacctga

SEQ ID NO: 1387587 - DNA, 21 bp, Homo sapiens
ttgctggaataagttcaaatt

SEQ ID NO: 1387588 - DNA, 13 bp, Homo sapiens
ttggacacactgt

SEQ ID NO: 1387589 - DNA, 17 bp, Homo sapiens
ttggacacactgtaaac

SEQ ID NO: 1387590 - DNA, 17 bp, Homo sapiens
ttggacctaatccaagc

SEQ ID NO: 1387591 - DNA, 19 bp, Homo sapiens
ttggatatgtaaaacattt

SEQ ID NO: 1387592 - DNA, 20 bp, Homo sapiens
ttggatatgtaaaacattta

SEQ ID NO: 1387593 - DNA, 17 bp, Homo sapiens
ttggcatccctgggcct

SEQ ID NO: 1387594 - DNA, 22 bp, Homo sapiens
ttggccaatgcacctaaagaaa

SEQ ID NO: 1387595 - DNA, 22 bp, Homo sapiens
ttggccctctcccatgcacaca

SEQ ID NO: 1387596 - DNA, 23 bp, Homo sapiens
ttggctgagatatgaacatattg

SEQ ID NO: 1387597 - DNA, 17 bp, Homo sapiens
ttgggagcttgggaatg

SEQ ID NO: 1387598 - DNA, 19 bp, Homo sapiens
ttgggagcttgggaatgga

SEQ ID NO: 1387599 - DNA, 14 bp, Homo sapiens
ttggggacacatgt

SEQ ID NO: 1387600 - DNA, 23 bp, Homo sapiens
ttggggggagtaaagaattattt

SEQ ID NO: 1387601 - DNA, 12 bp, Homo sapiens
ttgggtccagga

SEQ ID NO: 1387602 - DNA, 14 bp, Homo sapiens
ttggtggccacata

SEQ ID NO: 1387603 - DNA, 22 bp, Homo sapiens
ttggttcttgaggggaccagga

SEQ ID NO: 1387604 - DNA, 20 bp, Homo sapiens
ttggttgaaaataaaaagat

SEQ ID NO: 1387605 - DNA, 13 bp, Homo sapiens
ttgtaaatattgt

SEQ ID NO: 1387606 - DNA, 23 bp, Homo sapiens
ttgtaaattattaatttatgcag

SEQ ID NO: 1387607 - DNA, 22 bp, Homo sapiens
ttgtaagacaaaggttttcctc

SEQ ID NO: 1387608 - DNA, 21 bp, Homo sapiens
ttgtaatagatgtttgataga

SEQ ID NO: 1387609 - DNA, 23 bp, Homo sapiens
ttgtacaaaataaacaaataaca

SEQ ID NO: 1387610 - DNA, 15 bp, Homo sapiens
ttgtaccaactttta

SEQ ID NO: 1387611 - DNA, 16 bp, Homo sapiens
ttgtactaaagccaaa

SEQ ID NO: 1387612 - DNA, 23 bp, Homo sapiens
ttgtactaaagccaaacatatat

SEQ ID NO: 1387613 - DNA, 20 bp, Homo sapiens
ttgtcacgccagacttccca

SEQ ID NO: 1387614 - DNA, 18 bp, Homo sapiens
ttgtctattacctgttag

SEQ ID NO: 1387615 - DNA, 12 bp, Homo sapiens
ttgtcttaatat

SEQ ID NO: 1387616 - DNA, 17 bp, Homo sapiens
ttgtcttaatattgtgg

SEQ ID NO: 1387617 - DNA, 13 bp, Homo sapiens
ttgtctttttaga

SEQ ID NO: 1387618 - DNA, 20 bp, Homo sapiens
ttgtgaaactaaaattttct

SEQ ID NO: 1387619 - DNA, 16 bp, Homo sapiens
ttgtgacaaaaaatta

SEQ ID NO: 1387620 - DNA, 21 bp, Homo sapiens
ttgtgacagggcgggggtggc

SEQ ID NO: 1387621 - DNA, 19 bp, Homo sapiens
ttgtgattcaatctgtaaa

SEQ ID NO: 1387622 - DNA, 23 bp, Homo sapiens
ttgtgattcaatctgtaaactgt

SEQ ID NO: 1387623 - DNA, 17 bp, Homo sapiens
ttgtgcaatgtaaatat

SEQ ID NO: 1387624 - DNA, 18 bp, Homo sapiens
ttgtgcaatgtaaatatt

SEQ ID NO: 1387625 - DNA, 11 bp, Homo sapiens
ttgtgcagaga

SEQ ID NO: 1387626 - DNA, 21 bp, Homo sapiens
ttgtggaattgggagcttggg

SEQ ID NO: 1387627 - DNA, 16 bp, Homo sapiens
ttgtggcaagtgaatt

SEQ ID NO: 1387628 - DNA, 18 bp, Homo sapiens
ttgtggcaagtgaatttg

SEQ ID NO: 1387629 - DNA, 16 bp, Homo sapiens
ttgtgtggatatttat

SEQ ID NO: 1387630 - DNA, 20 bp, Homo sapiens
ttgtgttcccatttcagctg

SEQ ID NO: 1387631 - DNA, 14 bp, Homo sapiens
ttgttgtgctttta

SEQ ID NO: 1387632 - DNA, 15 bp, Homo sapiens
ttgtttaaaaagtaa

SEQ ID NO: 1387633 - DNA, 15 bp, Homo sapiens
ttgtttatttttcta

SEQ ID NO: 1387634 - DNA, 14 bp, Homo sapiens
ttgtttcttaaata

SEQ ID NO: 1387635 - DNA, 15 bp, Homo sapiens
tttaaaaaactaaaa

SEQ ID NO: 1387636 - DNA, 21 bp, Homo sapiens
tttaaaaaactaaaaactaga

SEQ ID NO: 1387637 - DNA, 15 bp, Homo sapiens
tttaaaacagacact

SEQ ID NO: 1387638 - DNA, 13 bp, Homo sapiens
tttaaaagatgct

SEQ ID NO: 1387639 - DNA, 17 bp, Homo sapiens
tttaaaagatgctttta

SEQ ID NO: 1387640 - DNA, 23 bp, Homo sapiens
tttaaaagtgccattaacaaatg

SEQ ID NO: 1387641 - DNA, 20 bp, Homo sapiens
tttaaaatttatattgtaaa

SEQ ID NO: 1387642 - DNA, 16 bp, Homo sapiens
tttaaacaaatgtgta

SEQ ID NO: 1387643 - DNA, 15 bp, Homo sapiens
tttaaacaagtattt

SEQ ID NO: 1387644 - DNA, 23 bp, Homo sapiens
tttaaaccgctaaaagaaacttt

SEQ ID NO: 1387645 - DNA, 12 bp, Homo sapiens
tttaaagaattg

SEQ ID NO: 1387646 - DNA, 13 bp, Homo sapiens
tttaaagacttaa

SEQ ID NO: 1387647 - DNA, 14 bp, Homo sapiens
tttaaatgaagaaa

SEQ ID NO: 1387648 - DNA, 18 bp, Homo sapiens
tttaaatgcataaatgca

SEQ ID NO: 1387649 - DNA, 15 bp, Homo sapiens
tttaaccagttattt

SEQ ID NO: 1387650 - DNA, 12 bp, Homo sapiens
tttaagccaaaa

SEQ ID NO: 1387651 - DNA, 18 bp, Homo sapiens
tttaagccaaaacaatgt

SEQ ID NO: 1387652 - DNA, 14 bp, Homo sapiens
tttaataaatttat

SEQ ID NO: 1387653 - DNA, 11 bp, Homo sapiens
tttaataattt

SEQ ID NO: 1387654 - DNA, 17 bp, Homo sapiens
tttaatagcaaagaatt

SEQ ID NO: 1387655 - DNA, 18 bp, Homo sapiens
tttaatagcaaagaattg

SEQ ID NO: 1387656 - DNA, 16 bp, Homo sapiens
tttaatgaacaaatgg

SEQ ID NO: 1387657 - DNA, 16 bp, Homo sapiens
tttaatgtttaaaaca

SEQ ID NO: 1387658 - DNA, 21 bp, Homo sapiens
tttaatgtttaaaacatcatt

SEQ ID NO: 1387659 - DNA, 13 bp, Homo sapiens
tttacagaatttt

SEQ ID NO: 1387660 - DNA, 15 bp, Homo sapiens
tttacttttaaactg

SEQ ID NO: 1387661 - DNA, 13 bp, Homo sapiens
tttagaaaacttt

SEQ ID NO: 1387662 - DNA, 13 bp, Homo sapiens
tttagaaatcatt

SEQ ID NO: 1387663 - DNA, 18 bp, Homo sapiens
tttagaaatcattttgca

SEQ ID NO: 1387664 - DNA, 16 bp, Homo sapiens
tttagccttctctgtt

SEQ ID NO: 1387665 - DNA, 18 bp, Homo sapiens
tttaggaagcaagcttaa

SEQ ID NO: 1387666 - DNA, 20 bp, Homo sapiens
tttatatgcttactgatata

SEQ ID NO: 1387667 - DNA, 13 bp, Homo sapiens
tttatatgttatt

SEQ ID NO: 1387668 - DNA, 22 bp, Homo sapiens
tttatattgataagatctttta

SEQ ID NO: 1387669 - DNA, 21 bp, Homo sapiens
tttatcagtgcttaatgtgaa

SEQ ID NO: 1387670 - DNA, 19 bp, Homo sapiens
tttatcctgaaatttcaga

SEQ ID NO: 1387671 - DNA, 16 bp, Homo sapiens
tttatcgcagaccttt

SEQ ID NO: 1387672 - DNA, 13 bp, Homo sapiens
tttatgcttgcaa

SEQ ID NO: 1387673 - DNA, 12 bp, Homo sapiens
tttatttgttga

SEQ ID NO: 1387674 - DNA, 13 bp, Homo sapiens
tttatttgttgag

SEQ ID NO: 1387675 - DNA, 20 bp, Homo sapiens
tttcaaatagggtctaactc

SEQ ID NO: 1387676 - DNA, 19 bp, Homo sapiens
tttcaagaaactgaggaat

SEQ ID NO: 1387677 - DNA, 14 bp, Homo sapiens
tttcacaaggtctt

SEQ ID NO: 1387678 - DNA, 17 bp, Homo sapiens
tttcacaaggtctttaa

SEQ ID NO: 1387679 - DNA, 18 bp, Homo sapiens
tttcacattagaagacaa

SEQ ID NO: 1387680 - DNA, 22 bp, Homo sapiens
tttcacctggaagcatttgttt

SEQ ID NO: 1387681 - DNA, 13 bp, Homo sapiens
tttcacctgtaaa

SEQ ID NO: 1387682 - DNA, 14 bp, Homo sapiens
tttcacctgtaaac

SEQ ID NO: 1387683 - DNA, 17 bp, Homo sapiens
tttcacctgtaaacctg

SEQ ID NO: 1387684 - DNA, 20 bp, Homo sapiens
tttcagattcccagagcaaa

SEQ ID NO: 1387685 - DNA, 22 bp, Homo sapiens
tttcaggagagagttgaaccta

SEQ ID NO: 1387686 - DNA, 18 bp, Homo sapiens
tttcagtccccacagata

SEQ ID NO: 1387687 - DNA, 16 bp, Homo sapiens
tttcatacattttcta

SEQ ID NO: 1387688 - DNA, 13 bp, Homo sapiens
tttcatcattttt

SEQ ID NO: 1387689 - DNA, 19 bp, Homo sapiens
tttccaaccggctttgtgg

SEQ ID NO: 1387690 - DNA, 19 bp, Homo sapiens
tttccagaggctattattt

SEQ ID NO: 1387691 - DNA, 23 bp, Homo sapiens
tttccatgcaccctcatacacag

SEQ ID NO: 1387692 - DNA, 21 bp, Homo sapiens
tttccatggcaggaaggcttg

SEQ ID NO: 1387693 - DNA, 17 bp, Homo sapiens
tttccctactgaagccc

SEQ ID NO: 1387694 - DNA, 18 bp, Homo sapiens
ttctaccatttcagagag

SEQ ID NO: 1387695 - DNA, 22 bp, Homo sapiens
ttctagcttatctacttccaaa

SEQ ID NO: 1387696 - DNA, 15 bp, Homo sapiens
ttctagttctgccag

SEQ ID NO: 1387697 - DNA, 21 bp, Homo sapiens
ttctatagccaaaaatagcta

SEQ ID NO: 1387698 - DNA, 23 bp, Homo sapiens
ttctatagccaaaaatagctaaa

SEQ ID NO: 1387699 - DNA, 16 bp, Homo sapiens
ttctatagttattaag

SEQ ID NO: 1387700 - DNA, 16 bp, Homo sapiens
ttctattaatatttat

SEQ ID NO: 1387701 - DNA, 13 bp, Homo sapiens
ttctattttgtaa

SEQ ID NO: 1387702 - DNA, 18 bp, Homo sapiens
ttctgaactcaaactgag

SEQ ID NO: 1387703 - DNA, 22 bp, Homo sapiens
ttctgagcccggtaagagcaaa

SEQ ID NO: 1387704 - DNA, 23 bp, Homo sapiens
ttctgagctatttcatctatttt

SEQ ID NO: 1387705 - DNA, 15 bp, Homo sapiens
ttctgatcaaggcct

SEQ ID NO: 1387706 - DNA, 22 bp, Homo sapiens
ttctgatcaaggccttattgga

SEQ ID NO: 1387707 - DNA, 14 bp, Homo sapiens
ttctgccttctcat

SEQ ID NO: 1387708 - DNA, 19 bp, Homo sapiens
ttctggaatacatgaaata

SEQ ID NO: 1387709 - DNA, 17 bp, Homo sapiens
ttctggattataaaaat

SEQ ID NO: 1387710 - DNA, 16 bp, Homo sapiens
ttctgggcttcatctg

SEQ ID NO: 1387711 - DNA, 15 bp, Homo sapiens
ttctgtaagaaacct

SEQ ID NO: 1387712 - DNA, 13 bp, Homo sapiens
ttctgtgcctgaa

SEQ ID NO: 1387713 - DNA, 17 bp, Homo sapiens
ttctgtgcctgaatatt

SEQ ID NO: 1387714 - DNA, 16 bp, Homo sapiens
ttcttcaccaaatctt

SEQ ID NO: 1387715 - DNA, 18 bp, Homo sapiens
ttctttttattttaacca

SEQ ID NO: 1387716 - DNA, 13 bp, Homo sapiens
ttgaaaaagcgaa

SEQ ID NO: 1387717 - DNA, 15 bp, Homo sapiens
ttgaagaatgttaag

SEQ ID NO: 1387718 - DNA, 21 bp, Homo sapiens
ttgaagaatgttaagacttga

SEQ ID NO: 1387719 - DNA, 20 bp, Homo sapiens
ttgaagttctgaaatttaac

SEQ ID NO: 1387720 - DNA, 15 bp, Homo sapiens
ttgaatgcaaaccat

SEQ ID NO: 1387721 - DNA, 20 bp, Homo sapiens
ttgaatggctatgtttttaa

SEQ ID NO: 1387722 - DNA, 19 bp, Homo sapiens
ttgacagtgttgaaaatgt

SEQ ID NO: 1387723 - DNA, 16 bp, Homo sapiens
ttgactttttgcattt

SEQ ID NO: 1387724 - DNA, 19 bp, Homo sapiens
ttgagaaggaaaattttag

SEQ ID NO: 1387725 - DNA, 23 bp, Homo sapiens
ttgagagaaatatgaagaactga

SEQ ID NO: 1387726 - DNA, 17 bp, Homo sapiens
ttgagagaagagacaaa

SEQ ID NO: 1387727 - DNA, 21 bp, Homo sapiens
ttgagatggagtcttgctctg

SEQ ID NO: 1387728 - DNA, 15 bp, Homo sapiens
ttgagcatcacagaa

SEQ ID NO: 1387729 - DNA, 14 bp, Homo sapiens
ttgaggggaccagg

SEQ ID NO: 1387730 - DNA, 18 bp, Homo sapiens
ttgagtacagaattcaac

SEQ ID NO: 1387731 - DNA, 14 bp, Homo sapiens
ttgagttggacaca

SEQ ID NO: 1387732 - DNA, 17 bp, Homo sapiens
ttgagttggacacactg

SEQ ID NO: 1387733 - DNA, 15 bp, Homo sapiens
ttgatatgactgttt

SEQ ID NO: 1387734 - DNA, 15 bp, Homo sapiens
ttgatatttctagct

SEQ ID NO: 1387735 - DNA, 14 bp, Homo sapiens
ttgatgccaaaaaa

SEQ ID NO: 1387736 - DNA, 17 bp, Homo sapiens
ttgattacagtgcagtg

SEQ ID NO: 1387737 - DNA, 15 bp, Homo sapiens
ttgcaaaaactacaa

SEQ ID NO: 1387738 - DNA, 19 bp, Homo sapiens
ttgcaaaaactacaaccaa

SEQ ID NO: 1387739 - DNA, 18 bp, Homo sapiens
ttgcaatcccttaatatc

SEQ ID NO: 1387740 - DNA, 16 bp, Homo sapiens
ttgcacagctatgaag

SEQ ID NO: 1387741 - DNA, 16 bp, Homo sapiens
ttgcagacaggaatct

SEQ ID NO: 1387742 - DNA, 21 bp, Homo sapiens
ttgccaagggcataaattatt

SEQ ID NO: 1387743 - DNA, 21 bp, Homo sapiens
ttgcctaaatacttttttcta

SEQ ID NO: 1387744 - DNA, 19 bp, Homo sapiens
ttgcctgtaacaagccaga

SEQ ID NO: 1387745 - DNA, 22 bp, Homo sapiens
ttgccttccagaaaacaaaact

SEQ ID NO: 1387746 - DNA, 16 bp, Homo sapiens
ttgctacataattatc

SEQ ID NO: 1387747 - DNA, 21 bp, Homo sapiens
ttgctactttatttgcctaaa

SEQ ID NO: 1387748 - DNA, 18 bp, Homo sapiens
ttgctcttgatgcctggc

SEQ ID NO: 1387749 - DNA, 13 bp, Homo sapiens
ttgctgttttgat

SEQ ID NO: 1387750 - DNA, 15 bp, Homo sapiens
ttggaatataattgt

SEQ ID NO: 1387751 - DNA, 11 bp, Homo sapiens
ttggagagaaa

SEQ ID NO: 1387752 - DNA, 20 bp, Homo sapiens
ttggagataatctagaacac

SEQ ID NO: 1387753 - DNA, 17 bp, Homo sapiens
ttggatagtcagctgta

SEQ ID NO: 1387754 - DNA, 16 bp, Homo sapiens
ttgggagagggcgcag

SEQ ID NO: 1387755 - DNA, 20 bp, Homo sapiens
ttggggacacatgtatttgg

SEQ ID NO: 1387756 - DNA, 13 bp, Homo sapiens
ttgggtccaggag

SEQ ID NO: 1387757 - DNA, 14 bp, Homo sapiens
ttgggttttatcag

SEQ ID NO: 1387758 - DNA, 15 bp, Homo sapiens
ttggttcttgagggg

SEQ ID NO: 1387759 - DNA, 16 bp, Homo sapiens
ttggttttgctacata

SEQ ID NO: 1387760 - DNA, 14 bp, Homo sapiens
ttgtaaaacaggta

SEQ ID NO: 1387761 - DNA, 22 bp, Homo sapiens
ttgtaaactcaaaatatttgta

SEQ ID NO: 1387762 - DNA, 14 bp, Homo sapiens
ttgtaaatattgtg

SEQ ID NO: 1387763 - DNA, 12 bp, Homo sapiens
ttgtacaaaata

SEQ ID NO: 1387764 - DNA, 13 bp, Homo sapiens
ttgtcacgccaga

SEQ ID NO: 1387765 - DNA, 22 bp, Homo sapiens
ttgtgaaactaaaattttctaa

SEQ ID NO: 1387766 - DNA, 23 bp, Homo sapiens
ttgtgaatcaagggtcaggcctt

SEQ ID NO: 1387767 - DNA, 15 bp, Homo sapiens
ttgtgactggcaccc

SEQ ID NO: 1387768 - DNA, 23 bp, Homo sapiens
ttgtgcaatgtaaatattttaaa

SEQ ID NO: 1387769 - DNA, 18 bp, Homo sapiens
ttgtgcacatttaataat

SEQ ID NO: 1387770 - DNA, 22 bp, Homo sapiens
ttgtgcccccaaccatttcctc

SEQ ID NO: 1387771 - DNA, 22 bp, Homo sapiens
ttgtggcaagtgaatttgcctg

SEQ ID NO: 1387772 - DNA, 19 bp, Homo sapiens
ttgtgtctggcagtttata

SEQ ID NO: 1387773 - DNA, 18 bp, Homo sapiens
ttgttaatataatttaac

SEQ ID NO: 1387774 - DNA, 20 bp, Homo sapiens
ttgttaatttagaaaacttt

SEQ ID NO: 1387775 - DNA, 22 bp, Homo sapiens
ttgttaatttagaaaactttaa

SEQ ID NO: 1387776 - DNA, 16 bp, Homo sapiens
ttgttatataatcatt

SEQ ID NO: 1387777 - DNA, 13 bp, Homo sapiens
ttgttggaatgaa

SEQ ID NO: 1387778 - DNA, 12 bp, Homo sapiens
ttgtttcttaaa

SEQ ID NO: 1387779 - DNA, 23 bp, Homo sapiens
ttgtttcttaaataagaaacttt

SEQ ID NO: 1387780 - DNA, 14 bp, Homo sapiens
tttaaaaaactaaa

SEQ ID NO: 1387781 - DNA, 14 bp, Homo sapiens
tttaaaaaagctta

SEQ ID NO: 1387782 - DNA, 17 bp, Homo sapiens
tttaaaaaagcttaaaa

SEQ ID NO: 1387783 - DNA, 12 bp, Homo sapiens
tttaaaaagtaa

SEQ ID NO: 1387784 - DNA, 14 bp, Homo sapiens
tttaaaacccattt

SEQ ID NO: 1387785 - DNA, 17 bp, Homo sapiens
tttaaaatgtaaagcca

SEQ ID NO: 1387786 - DNA, 18 bp, Homo sapiens
tccctactgaagcccttg

SEQ ID NO: 1387787 - DNA, 21 bp, Homo sapiens
tccctactgaagcccttgtga

SEQ ID NO: 1387788 - DNA, 16 bp, Homo sapiens
tccctcctctgcccgg

SEQ ID NO: 1387789 - DNA, 14 bp, Homo sapiens
tccctcctgttggg

SEQ ID NO: 1387790 - DNA, 16 bp, Homo sapiens
tccctgcctcctgccg

SEQ ID NO: 1387791 - DNA, 18 bp, Homo sapiens
tccctggatgacattaaa

SEQ ID NO: 1387792 - DNA, 20 bp, Homo sapiens
tccctggatgacattaaaga

SEQ ID NO: 1387793 - DNA, 13 bp, Homo sapiens
tccctgggccttg

SEQ ID NO: 1387794 - DNA, 20 bp, Homo sapiens
tccctgggtagcgggggagg

SEQ ID NO: 1387795 - DNA, 16 bp, Homo sapiens
tccgtcaaaacagatt

SEQ ID NO: 1387796 - DNA, 21 bp, Homo sapiens
tcctaaacatcattcattttt

SEQ ID NO: 1387797 - DNA, 14 bp, Homo sapiens
tcctaaatattatg

SEQ ID NO: 1387798 - DNA, 21 bp, Homo sapiens
tcctaaatattatgagatgct

SEQ ID NO: 1387799 - DNA, 19 bp, Homo sapiens
tcctaataatatcccactg

SEQ ID NO: 1387800 - DNA, 22 bp, Homo sapiens
tcctaataatatcccactggga

SEQ ID NO: 1387801 - DNA, 16 bp, Homo sapiens
tcctaccccctgtgcc

SEQ ID NO: 1387802 - DNA, 13 bp, Homo sapiens
tcctatcctccta

SEQ ID NO: 1387803 - DNA, 20 bp, Homo sapiens
tcctcacccccagctttgct

SEQ ID NO: 1387804 - DNA, 17 bp, Homo sapiens
tcctcagactctaagaa

SEQ ID NO: 1387805 - DNA, 15 bp, Homo sapiens
tcctccctcagtgcc

SEQ ID NO: 1387806 - DNA, 15 bp, Homo sapiens
tcctcgtcccctgcc

SEQ ID NO: 1387807 - DNA, 13 bp, Homo sapiens
tcctctcctgtct

SEQ ID NO: 1387808 - DNA, 16 bp, Homo sapiens
tcctctgcccgggagc

SEQ ID NO: 1387809 - DNA, 22 bp, Homo sapiens
tcctctgcccgggagctcagga

SEQ ID NO: 1387810 - DNA, 14 bp, Homo sapiens
tcctgaaatttcag

SEQ ID NO: 1387811 - DNA, 15 bp, Homo sapiens
tcctgaaatttcaga

SEQ ID NO: 1387812 - DNA, 13 bp, Homo sapiens
tcctgacacttta

SEQ ID NO: 1387813 - DNA, 18 bp, Homo sapiens
tcctgcaccggggcctgg

SEQ ID NO: 1387814 - DNA, 19 bp, Homo sapiens
tcctgcaccggggcctggg

SEQ ID NO: 1387815 - DNA, 21 bp, Homo sapiens
tcctgcgctgccccagagcct

SEQ ID NO: 1387816 - DNA, 18 bp, Homo sapiens
tcctgctaagttaatgtt

SEQ ID NO: 1387817 - DNA, 14 bp, Homo sapiens
tcctggaagccagc

SEQ ID NO: 1387818 - DNA, 20 bp, Homo sapiens
tcctggtgccaatttcaagt

SEQ ID NO: 1387819 - DNA, 21 bp, Homo sapiens
tcctgttgggagagggcgcag

SEQ ID NO: 1387820 - DNA, 14 bp, Homo sapiens
tcctgtttttcaca

SEQ ID NO: 1387821 - DNA, 17 bp, Homo sapiens
tccttaagtcagaacag

SEQ ID NO: 1387822 - DNA, 21 bp, Homo sapiens
tccttacaagttagaaaacat

SEQ ID NO: 1387823 - DNA, 22 bp, Homo sapiens
tccttacaagttagaaaacata

SEQ ID NO: 1387824 - DNA, 18 bp, Homo sapiens
tccttagatctggcatgt

SEQ ID NO: 1387825 - DNA, 14 bp, Homo sapiens
tccttatttatcaa

SEQ ID NO: 1387826 - DNA, 20 bp, Homo sapiens
tccttcaacaattctaaaat

SEQ ID NO: 1387827 - DNA, 22 bp, Homo sapiens
tccttgattttagccttctctg

SEQ ID NO: 1387828 - DNA, 22 bp, Homo sapiens
tccttgcttatgacatcacttg

SEQ ID NO: 1387829 - DNA, 21 bp, Homo sapiens
tccttggcaggctgatttcta

SEQ ID NO: 1387830 - DNA, 13 bp, Homo sapiens
tccttgtcactgg

SEQ ID NO: 1387831 - DNA, 20 bp, Homo sapiens
tcctttctagagcactgcca

SEQ ID NO: 1387832 - DNA, 20 bp, Homo sapiens
tcctttgaatcctctctctg

SEQ ID NO: 1387833 - DNA, 15 bp, Homo sapiens
tcctttttccaacaa

SEQ ID NO: 1387834 - DNA, 17 bp, Homo sapiens
tcctttttccaacaaga

SEQ ID NO: 1387835 - DNA, 14 bp, Homo sapiens
tcgaatgacactgt

SEQ ID NO: 1387836 - DNA, 18 bp, Homo sapiens
tcgagatcccaacactgc

SEQ ID NO: 1387837 - DNA, 21 bp, Homo sapiens
tcgagatcccaacactgccag

SEQ ID NO: 1387838 - DNA, 18 bp, Homo sapiens
tcgattagactggacagc

SEQ ID NO: 1387839 - DNA, 22 bp, Homo sapiens
tcgattagactggacagcttgt

SEQ ID NO: 1387840 - DNA, 18 bp, Homo sapiens
tcgccctggactgtgtgc

SEQ ID NO: 1387841 - DNA, 16 bp, Homo sapiens
tcgctcctcaacccct

SEQ ID NO: 1387842 - DNA, 11 bp, Homo sapiens
tcgctgtcctt

SEQ ID NO: 1387843 - DNA, 16 bp, Homo sapiens
tcgtacagaaagctgc

SEQ ID NO: 1387844 - DNA, 14 bp, Homo sapiens
tcgtcccctgcctc

SEQ ID NO: 1387845 - DNA, 15 bp, Homo sapiens
tcgttcaaagcatga

SEQ ID NO: 1387846 - DNA, 13 bp, Homo sapiens
tctaacagattag

SEQ ID NO: 1387847 - DNA, 18 bp, Homo sapiens
tctaagaaacatttatat

SEQ ID NO: 1387848 - DNA, 14 bp, Homo sapiens
tctaatttataaaa

SEQ ID NO: 1387849 - DNA, 18 bp, Homo sapiens
tctaccatttcagagagg

SEQ ID NO: 1387850 - DNA, 16 bp, Homo sapiens
tctactggtcttgtgg

SEQ ID NO: 1387851 - DNA, 22 bp, Homo sapiens
tctacttccaaactaattttta

SEQ ID NO: 1387852 - DNA, 15 bp, Homo sapiens
tctagagcactgcca

SEQ ID NO: 1387853 - DNA, 15 bp, Homo sapiens
tctagattgagagaa

SEQ ID NO: 1387854 - DNA, 13 bp, Homo sapiens
tctagcctggcta

SEQ ID NO: 1387855 - DNA, 15 bp, Homo sapiens
tctaggaaatatact

SEQ ID NO: 1387856 - DNA, 22 bp, Homo sapiens
tctaggaaatatacttttacaa

SEQ ID NO: 1387857 - DNA, 13 bp, Homo sapiens
tctaggaaatgta

SEQ ID NO: 1387858 - DNA, 19 bp, Homo sapiens
tctagttgaaaataaagtg

SEQ ID NO: 1387859 - DNA, 15 bp, Homo sapiens
tctatttttatctga

SEQ ID NO: 1387860 - DNA, 21 bp, Homo sapiens
tctcaaactcctgacctcagg

SEQ ID NO: 1387861 - DNA, 23 bp, Homo sapiens
tctcaaactcctgacctcaggca

SEQ ID NO: 1387862 - DNA, 21 bp, Homo sapiens
tctcaccaggcagcctctggg

SEQ ID NO: 1387863 - DNA, 22 bp, Homo sapiens
tctcaccaggcagcctctgggg

SEQ ID NO: 1387864 - DNA, 16 bp, Homo sapiens
tctcagttttcataag

SEQ ID NO: 1387865 - DNA, 15 bp, Homo sapiens
tctcatcaactgaat

SEQ ID NO: 1387866 - DNA, 18 bp, Homo sapiens
tctcatctcttcttttaa

SEQ ID NO: 1387867 - DNA, 19 bp, Homo sapiens
tctcatgtaaaataagaaa

SEQ ID NO: 1387868 - DNA, 20 bp, Homo sapiens
tctcattttttaaaaaagct

SEQ ID NO: 1387869 - DNA, 14 bp, Homo sapiens
tctccttgttctga

SEQ ID NO: 1387870 - DNA, 20 bp, Homo sapiens
tctctaccactgctgatatt

SEQ ID NO: 1387871 - DNA, 12 bp, Homo sapiens
tctctcatgaac

SEQ ID NO: 1387872 - DNA, 19 bp, Homo sapiens
tctctgattttcaaagctt

SEQ ID NO: 1387873 - DNA, 14 bp, Homo sapiens
tctctgtaaagcta

SEQ ID NO: 1387874 - DNA, 15 bp, Homo sapiens
tctcttattgcctca

SEQ ID NO: 1387875 - DNA, 12 bp, Homo sapiens
tctgaaagagaa

SEQ ID NO: 1387876 - DNA, 12 bp, Homo sapiens
tctgaactcaaa

SEQ ID NO: 1387877 - DNA, 14 bp, Homo sapiens
tctgaactcaaact

SEQ ID NO: 1387878 - DNA, 17 bp, Homo sapiens
tctgaactcaaactgag

SEQ ID NO: 1387879 - DNA, 17 bp, Homo sapiens
tctgaagctcaactctc

SEQ ID NO: 1387880 - DNA, 16 bp, Homo sapiens
tctgaatttttaaaca

SEQ ID NO: 1387881 - DNA, 12 bp, Homo sapiens
tctgacctcccc

SEQ ID NO: 1387882 - DNA, 21 bp, Homo sapiens
tctgagcccggtaagagcaaa

SEQ ID NO: 1387883 - DNA, 22 bp, Homo sapiens
tctgagctatttcatctatttt

SEQ ID NO: 1387884 - DNA, 23 bp, Homo sapiens
tctgagtgttttatgagaaagcc

SEQ ID NO: 1387885 - DNA, 15 bp, Homo sapiens
tctgatcaaggcctt

SEQ ID NO: 1387886 - DNA, 20 bp, Homo sapiens
tctgattcgaatgacactgt

SEQ ID NO: 1387887 - DNA, 16 bp, Homo sapiens
tctgattgtgatgtga

SEQ ID NO: 1387888 - DNA, 19 bp, Homo sapiens
tctgcagggggtgtgtctg

SEQ ID NO: 1387889 - DNA, 21 bp, Homo sapiens
tctgcaggtccctaataaagc

SEQ ID NO: 1387890 - DNA, 18 bp, Homo sapiens
tctgcttgatttttgcct

SEQ ID NO: 1387891 - DNA, 21 bp, Homo sapiens
tctggaaagtgatgtcagaat

SEQ ID NO: 1387892 - DNA, 12 bp, Homo sapiens
tctggagcccac

SEQ ID NO: 1387893 - DNA, 22 bp, Homo sapiens
tctggagcccactgtacttgct

SEQ ID NO: 1387894 - DNA, 23 bp, Homo sapiens
tctggagcccactgtacttgctc

SEQ ID NO: 1387895 - DNA, 16 bp, Homo sapiens
tctggcaacatcttta

SEQ ID NO: 1387896 - DNA, 12 bp, Homo sapiens
tctggctcctgt

SEQ ID NO: 1387897 - DNA, 14 bp, Homo sapiens
tctggctcctgttt

SEQ ID NO: 1387898 - DNA, 13 bp, Homo sapiens
tctggctctgtct

SEQ ID NO: 1387899 - DNA, 20 bp, Homo sapiens
tctggcttctggccaggaag

SEQ ID NO: 1387900 - DNA, 20 bp, Homo sapiens
tctggggggtggccaggccg

SEQ ID NO: 1387901 - DNA, 13 bp, Homo sapiens
tctgggtggccct

SEQ ID NO: 1387902 - DNA, 14 bp, Homo sapiens
tctgtaaactgtgt

SEQ ID NO: 1387903 - DNA, 16 bp, Homo sapiens
tctgtccagataagtt

SEQ ID NO: 1387904 - DNA, 19 bp, Homo sapiens
tctgtccagataagttatt

SEQ ID NO: 1387905 - DNA, 20 bp, Homo sapiens
tctgtccagataagttattt

SEQ ID NO: 1387906 - DNA, 14 bp, Homo sapiens
tctgtcttctggac

SEQ ID NO: 1387907 - DNA, 12 bp, Homo sapiens
tctgtcttgaag

SEQ ID NO: 1387908 - DNA, 17 bp, Homo sapiens
tctgtgcctgaatattt

SEQ ID NO: 1387909 - DNA, 19 bp, Homo sapiens
tctgttcacttttcctccc

SEQ ID NO: 1387910 - DNA, 21 bp, Homo sapiens
tctgttcacttttcctccctc

SEQ ID NO: 1387911 - DNA, 22 bp, Homo sapiens
tctgttcacttttcctccctca

SEQ ID NO: 1387912 - DNA, 12 bp, Homo sapiens
tctgtttccata

SEQ ID NO: 1387913 - DNA, 14 bp, Homo sapiens
taactcatctgtca

SEQ ID NO: 1387914 - DNA, 20 bp, Homo sapiens
taactgaaaatgtgctatac

SEQ ID NO: 1387915 - DNA, 16 bp, Homo sapiens
taactgcctaaaatgt

SEQ ID NO: 1387916 - DNA, 13 bp, Homo sapiens
taactggaaagaa

SEQ ID NO: 1387917 - DNA, 14 bp, Homo sapiens
taactggaaagaag

SEQ ID NO: 1387918 - DNA, 17 bp, Homo sapiens
taacttaaatagtattt

SEQ ID NO: 1387919 - DNA, 21 bp, Homo sapiens
taagaaacttttttatttaaa

SEQ ID NO: 1387920 - DNA, 14 bp, Homo sapiens
taagacttgacagt

SEQ ID NO: 1387921 - DNA, 20 bp, Homo sapiens
taagagcaaaagaatggcag

SEQ ID NO: 1387922 - DNA, 15 bp, Homo sapiens
taagagctcaggatg

SEQ ID NO: 1387923 - DNA, 16 bp, Homo sapiens
taagatacactcctgc

SEQ ID NO: 1387924 - DNA, 19 bp, Homo sapiens
taagatacactcctgctgt

SEQ ID NO: 1387925 - DNA, 17 bp, Homo sapiens
taagatctatagcctct

SEQ ID NO: 1387926 - DNA, 20 bp, Homo sapiens
taagattaaattatatctga

SEQ ID NO: 1387927 - DNA, 15 bp, Homo sapiens
taagatttccttctt

SEQ ID NO: 1387928 - DNA, 16 bp, Homo sapiens
taagcctccctcctcg

SEQ ID NO: 1387929 - DNA, 19 bp, Homo sapiens
taaggaaatcaacttgctt

SEQ ID NO: 1387930 - DNA, 19 bp, Homo sapiens
taagggccagaaatatctt

SEQ ID NO: 1387931 - DNA, 19 bp, Homo sapiens
taaggtacaagaagcattt

SEQ ID NO: 1387932 - DNA, 21 bp, Homo sapiens
taaggtctgggagtgttctgt

SEQ ID NO: 1387933 - DNA, 19 bp, Homo sapiens
taaggtgtagccacaccag

SEQ ID NO: 1387934 - DNA, 12 bp, Homo sapiens
taagtatttagg

SEQ ID NO: 1387935 - DNA, 11 bp, Homo sapiens
taagtgaaatt

SEQ ID NO: 1387936 - DNA, 12 bp, Homo sapiens
taagtgaaattt

SEQ ID NO: 1387937 - DNA, 20 bp, Homo sapiens
taagtgaaattttaaaagtc

SEQ ID NO: 1387938 - DNA, 15 bp, Homo sapiens
taagtgtacatatgt

SEQ ID NO: 1387939 - DNA, 13 bp, Homo sapiens
taataaaaagatt

SEQ ID NO: 1387940 - DNA, 15 bp, Homo sapiens
taataaacgtttgaa

SEQ ID NO: 1387941 - DNA, 22 bp, Homo sapiens
taataatttagacttcaagcat

SEQ ID NO: 1387942 - DNA, 18 bp, Homo sapiens
taatacagcaacaattta

SEQ ID NO: 1387943 - DNA, 14 bp, Homo sapiens
taatactgctgaga

SEQ ID NO: 1387944 - DNA, 14 bp, Homo sapiens
taatagatgtttga

SEQ ID NO: 1387945 - DNA, 21 bp, Homo sapiens
taatagatgtttgatagattt

SEQ ID NO: 1387946 - DNA, 13 bp, Homo sapiens
taatagcaaagaa

SEQ ID NO: 1387947 - DNA, 15 bp, Homo sapiens
taatatcctaaacat

SEQ ID NO: 1387948 - DNA, 15 bp, Homo sapiens
taatatttatgtgtt

SEQ ID NO: 1387949 - DNA, 13 bp, Homo sapiens
taatctaaatata

SEQ ID NO: 1387950 - DNA, 14 bp, Homo sapiens
taatctagaacaca

SEQ ID NO: 1387951 - DNA, 21 bp, Homo sapiens
taatcttattcattttctcta

SEQ ID NO: 1387952 - DNA, 15 bp, Homo sapiens
taatcttctgccttc

SEQ ID NO: 1387953 - DNA, 21 bp, Homo sapiens
taatgccttactcttcttgaa

SEQ ID NO: 1387954 - DNA, 22 bp, Homo sapiens
taatggctgataattttaaatt

SEQ ID NO: 1387955 - DNA, 17 bp, Homo sapiens
taatgggcattactgaa

SEQ ID NO: 1387956 - DNA, 17 bp, Homo sapiens
taatgttaatattgatt

SEQ ID NO: 1387957 - DNA, 15 bp, Homo sapiens
taatgtttaaaacat

SEQ ID NO: 1387958 - DNA, 21 bp, Homo sapiens
taattaccaacctgttaccta

SEQ ID NO: 1387959 - DNA, 16 bp, Homo sapiens
taattgttgctaatct

SEQ ID NO: 1387960 - DNA, 22 bp, Homo sapiens
taatttaacagaagttgtgaaa

SEQ ID NO: 1387961 - DNA, 23 bp, Homo sapiens
taatttaacagaagttgtgaaac

SEQ ID NO: 1387962 - DNA, 16 bp, Homo sapiens
taatttagaaaacttt

SEQ ID NO: 1387963 - DNA, 16 bp, Homo sapiens
taatttagtttcatat

SEQ ID NO: 1387964 - DNA, 16 bp, Homo sapiens
taatttataaaaaggt

SEQ ID NO: 1387965 - DNA, 14 bp, Homo sapiens
taatttattattaa

SEQ ID NO: 1387966 - DNA, 12 bp, Homo sapiens
taatttctactt

SEQ ID NO: 1387967 - DNA, 18 bp, Homo sapiens
taatttgaggacaaccat

SEQ ID NO: 1387968 - DNA, 23 bp, Homo sapiens
taatttttatttttgctgagact

SEQ ID NO: 1387969 - DNA, 16 bp, Homo sapiens
tacaaccaatggaatg

SEQ ID NO: 1387970 - DNA, 14 bp, Homo sapiens
tacaagaagcattt

SEQ ID NO: 1387971 - DNA, 15 bp, Homo sapiens
tacaagaagcatttt

SEQ ID NO: 1387972 - DNA, 21 bp, Homo sapiens
tacaagaagcattttgtaagt

SEQ ID NO: 1387973 - DNA, 17 bp, Homo sapiens
tacaattttttatcatg

SEQ ID NO: 1387974 - DNA, 18 bp, Homo sapiens
tacacaatagaattataa

SEQ ID NO: 1387975 - DNA, 23 bp, Homo sapiens
tacagaattactgtaactgatta

SEQ ID NO: 1387976 - DNA, 18 bp, Homo sapiens
tacagaattcaacagtta

SEQ ID NO: 1387977 - DNA, 19 bp, Homo sapiens
tacagcaacaatttatgaa

SEQ ID NO: 1387978 - DNA, 22 bp, Homo sapiens
tacagcaacaatttatgaattg

SEQ ID NO: 1387979 - DNA, 21 bp, Homo sapiens
tacagctcagaagtttcttct

SEQ ID NO: 1387980 - DNA, 15 bp, Homo sapiens
tacagtctaaagctg

SEQ ID NO: 1387981 - DNA, 14 bp, Homo sapiens
tacatgaaacagaa

SEQ ID NO: 1387982 - DNA, 14 bp, Homo sapiens
tacatgattcattt

SEQ ID NO: 1387983 - DNA, 17 bp, Homo sapiens
tacatgctaagagaagt

SEQ ID NO: 1387984 - DNA, 18 bp, Homo sapiens
tacatgctaagagaagta

SEQ ID NO: 1387985 - DNA, 14 bp, Homo sapiens
tacattccaactcg

SEQ ID NO: 1387986 - DNA, 18 bp, Homo sapiens
tacattggtaaacatttt

SEQ ID NO: 1387987 - DNA, 19 bp, Homo sapiens
taccagagaaaaagggagg

SEQ ID NO: 1387988 - DNA, 12 bp, Homo sapiens
taccagatgcag

SEQ ID NO: 1387989 - DNA, 21 bp, Homo sapiens
taccaggcaccaaaagaagta

SEQ ID NO: 1387990 - DNA, 15 bp, Homo sapiens
taccatttcagagag

SEQ ID NO: 1387991 - DNA, 16 bp, Homo sapiens
taccctttggggagca

SEQ ID NO: 1387992 - DNA, 14 bp, Homo sapiens
tacctactttgact

SEQ ID NO: 1387993 - DNA, 21 bp, Homo sapiens
tacctactttgactttttgca

SEQ ID NO: 1387994 - DNA, 15 bp, Homo sapiens
tacctccaaaaaaga

SEQ ID NO: 1387995 - DNA, 17 bp, Homo sapiens
tacctccaaaaaagaaa

SEQ ID NO: 1387996 - DNA, 15 bp, Homo sapiens
tacctctatatacca

SEQ ID NO: 1387997 - DNA, 16 bp, Homo sapiens
tacctctatataccaa

SEQ ID NO: 1387998 - DNA, 13 bp, Homo sapiens
tacctgttgagca

SEQ ID NO: 1387999 - DNA, 18 bp, Homo sapiens
tactaaagccaaacatat

SEQ ID NO: 1388000 - DNA, 20 bp, Homo sapiens
tactaagcattgaatggcta

SEQ ID NO: 1388001 - DNA, 15 bp, Homo sapiens
tactagagttagata

SEQ ID NO: 1388002 - DNA, 19 bp, Homo sapiens
tactagagttagatatgtg

SEQ ID NO: 1388003 - DNA, 17 bp, Homo sapiens
tactataagaactttga

SEQ ID NO: 1388004 - DNA, 12 bp, Homo sapiens
tactatttcaca

SEQ ID NO: 1388005 - DNA, 22 bp, Homo sapiens
tactgcatactttttaaatgta

SEQ ID NO: 1388006 - DNA, 13 bp, Homo sapiens
tactgcatgcact

SEQ ID NO: 1388007 - DNA, 24 bp, Homo sapiens
tactgcttggagctgagcaaatca

SEQ ID NO: 1388008 - DNA, 23 bp, Homo sapiens
tacttacatgcattactgcatgc

SEQ ID NO: 1388009 - DNA, 16 bp, Homo sapiens
tacttatatggaaatt

SEQ ID NO: 1388010 - DNA, 14 bp, Homo sapiens
tacttccaaactaa

SEQ ID NO: 1388011 - DNA, 19 bp, Homo sapiens
tacttcctctaggaaatgt

SEQ ID NO: 1388012 - DNA, 21 bp, Homo sapiens
tacttgctcttgatgcctggc

SEQ ID NO: 1388013 - DNA, 20 bp, Homo sapiens
tactttgataaagtaaaaaa

SEQ ID NO: 1388014 - DNA, 22 bp, Homo sapiens
tactttggtggccacataagcc

SEQ ID NO: 1388015 - DNA, 21 bp, Homo sapiens
tacttttaaacagtgagcctg

SEQ ID NO: 1388016 - DNA, 15 bp, Homo sapiens
tacttttaaactgtg

SEQ ID NO: 1388017 - DNA, 23 bp, Homo sapiens
tacttttacaagtaacaaaaata

SEQ ID NO: 1388018 - DNA, 13 bp, Homo sapiens
tacttttgtttca

SEQ ID NO: 1388019 - DNA, 15 bp, Homo sapiens
tagaaaactttaaag

SEQ ID NO: 1388020 - DNA, 11 bp, Homo sapiens
tagaaatcata

SEQ ID NO: 1388021 - DNA, 16 bp, Homo sapiens
tagaaatcattttgca

SEQ ID NO: 1388022 - DNA, 17 bp, Homo sapiens
tagaaatcattttgcaa

SEQ ID NO: 1388023 - DNA, 19 bp, Homo sapiens
tagaaatgtaacttttgta

SEQ ID NO: 1388024 - DNA, 12 bp, Homo sapiens
tagaacacacac

SEQ ID NO: 1388025 - DNA, 12 bp, Homo sapiens
tagaatgacagt

SEQ ID NO: 1388026 - DNA, 17 bp, Homo sapiens
tagaatgtaaagcttgt

SEQ ID NO: 1388027 - DNA, 16 bp, Homo sapiens
tagaattatctaattt

SEQ ID NO: 1388028 - DNA, 19 bp, Homo sapiens
tagaattatctaatttata

SEQ ID NO: 1388029 - DNA, 17 bp, Homo sapiens
tagaattgagtgtttaa

SEQ ID NO: 1388030 - DNA, 22 bp, Homo sapiens
tagaattgtggttccctaaaga

SEQ ID NO: 1388031 - DNA, 23 bp, Homo sapiens
tagaattgtggttccctaaagac

SEQ ID NO: 1388032 - DNA, 13 bp, Homo sapiens
tagacaagccaga

SEQ ID NO: 1388033 - DNA, 14 bp, Homo sapiens
tagactggacagct

SEQ ID NO: 1388034 - DNA, 18 bp, Homo sapiens
tagactggacagcttgtg

SEQ ID NO: 1388035 - DNA, 18 bp, Homo sapiens
tagagactggaacactag

SEQ ID NO: 1388036 - DNA, 16 bp, Homo sapiens
tagagcactgccacca

SEQ ID NO: 1388037 - DNA, 14 bp, Homo sapiens
tagagttagatatg

SEQ ID NO: 1388038 - DNA, 23 bp, Homo sapiens
tagataacaagacctcagtgcct

SEQ ID NO: 1388039 - DNA, 16 bp, Homo sapiens
tagatctggcatgtta

SEQ ID NO: 1388040 - DNA, 14 bp, Homo sapiens
tcaacttgcttatc

SEQ ID NO: 1388041 - DNA, 20 bp, Homo sapiens
tcaagaaactgaggaatttt

SEQ ID NO: 1388042 - DNA, 21 bp, Homo sapiens
tcaagaataatcacgctttcc

SEQ ID NO: 1388043 - DNA, 15 bp, Homo sapiens
tcaagagactgagtc

SEQ ID NO: 1388044 - DNA, 13 bp, Homo sapiens
tcaaggaaaataa

SEQ ID NO: 1388045 - DNA, 19 bp, Homo sapiens
tcaagtctgtttactgcaa

SEQ ID NO: 1388046 - DNA, 18 bp, Homo sapiens
tcaatataagcttttctt

SEQ ID NO: 1388047 - DNA, 13 bp, Homo sapiens
tcaatctgtaaac

SEQ ID NO: 1388048 - DNA, 13 bp, Homo sapiens
tcaattactggtc

SEQ ID NO: 1388049 - DNA, 16 bp, Homo sapiens
tcaattcatatttatg

SEQ ID NO: 1388050 - DNA, 15 bp, Homo sapiens
tcaatttctgaacac

SEQ ID NO: 1388051 - DNA, 13 bp, Homo sapiens
tcacaagaagatt

SEQ ID NO: 1388052 - DNA, 22 bp, Homo sapiens
tcacaattccagactttctatt

SEQ ID NO: 1388053 - DNA, 20 bp, Homo sapiens
tcacacctgaactgaacacc

SEQ ID NO: 1388054 - DNA, 15 bp, Homo sapiens
tcacattagaagaca

SEQ ID NO: 1388055 - DNA, 11 bp, Homo sapiens
tcacattttcc

SEQ ID NO: 1388056 - DNA, 17 bp, Homo sapiens
tcacattttccttttca

SEQ ID NO: 1388057 - DNA, 19 bp, Homo sapiens
tcaccaggcagcctctggg

SEQ ID NO: 1388058 - DNA, 18 bp, Homo sapiens
tcacccccagctttgcta

SEQ ID NO: 1388059 - DNA, 15 bp, Homo sapiens
tcaccctacctgtgc

SEQ ID NO: 1388060 - DNA, 13 bp, Homo sapiens
tcacctggaagca

SEQ ID NO: 1388061 - DNA, 16 bp, Homo sapiens
tcacctgtaaacctga

SEQ ID NO: 1388062 - DNA, 15 bp, Homo sapiens
tcacgctttcctgaa

SEQ ID NO: 1388063 - DNA, 16 bp, Homo sapiens
tcacgctttcctgaat

SEQ ID NO: 1388064 - DNA, 17 bp, Homo sapiens
tcactctgagtgtttta

SEQ ID NO: 1388065 - DNA, 20 bp, Homo sapiens
tcactctgagtgttttatga

SEQ ID NO: 1388066 - DNA, 17 bp, Homo sapiens
tcactgagttttccatg

SEQ ID NO: 1388067 - DNA, 20 bp, Homo sapiens
tcactggtagaccaaaataa

SEQ ID NO: 1388068 - DNA, 20 bp, Homo sapiens
tcactgtagaatgatttcat

SEQ ID NO: 1388069 - DNA, 17 bp, Homo sapiens
tcactgtttagaacaca

SEQ ID NO: 1388070 - DNA, 21 bp, Homo sapiens
tcacttaggaaatggctttgt

SEQ ID NO: 1388071 - DNA, 21 bp, Homo sapiens
tcacttcaggtatacctcact

SEQ ID NO: 1388072 - DNA, 14 bp, Homo sapiens
tcacttgtacaaaa

SEQ ID NO: 1388073 - DNA, 21 bp, Homo sapiens
tcacttttaatgaacaaatgg

SEQ ID NO: 1388074 - DNA, 13 bp, Homo sapiens
tcacttttcctcc

SEQ ID NO: 1388075 - DNA, 15 bp, Homo sapiens
tcagaaaaattaatt

SEQ ID NO: 1388076 - DNA, 14 bp, Homo sapiens
tcagaacagcagac

SEQ ID NO: 1388077 - DNA, 13 bp, Homo sapiens
tcagaagaaaaag

SEQ ID NO: 1388078 - DNA, 16 bp, Homo sapiens
tcagaagaaaaagaag

SEQ ID NO: 1388079 - DNA, 18 bp, Homo sapiens
tcagaagaaaaagaagca

SEQ ID NO: 1388080 - DNA, 17 bp, Homo sapiens
tcagaatgctctacttc

SEQ ID NO: 1388081 - DNA, 14 bp, Homo sapiens
tcagaatgtcattt

SEQ ID NO: 1388082 - DNA, 18 bp, Homo sapiens
tcagacagaacccctaca

SEQ ID NO: 1388083 - DNA, 19 bp, Homo sapiens
tcagactctaagaaagaac

SEQ ID NO: 1388084 - DNA, 23 bp, Homo sapiens
tcagagaatttctaccatttcag

SEQ ID NO: 1388085 - DNA, 22 bp, Homo sapiens
tcagagaggccttttggaatgt

SEQ ID NO: 1388086 - DNA, 20 bp, Homo sapiens
tcagataaggtaaaatgcca

SEQ ID NO: 1388087 - DNA, 23 bp, Homo sapiens
tcagataaggtaaaatgccatga

SEQ ID NO: 1388088 - DNA, 17 bp, Homo sapiens
tcagatagaatgacagt

SEQ ID NO: 1388089 - DNA, 17 bp, Homo sapiens
tcagcagggactgtaaa

SEQ ID NO: 1388090 - DNA, 19 bp, Homo sapiens
tcagcatgtctattcagct

SEQ ID NO: 1388091 - DNA, 16 bp, Homo sapiens
tcagcattttcttaga

SEQ ID NO: 1388092 - DNA, 20 bp, Homo sapiens
tcagcctcctgagtagctgg

SEQ ID NO: 1388093 - DNA, 19 bp, Homo sapiens
tcagctcccttcccctgcc

SEQ ID NO: 1388094 - DNA, 21 bp, Homo sapiens
tcagctcccttcccctgcctg

SEQ ID NO: 1388095 - DNA, 20 bp, Homo sapiens
tcaggcagaggatgttctgg

SEQ ID NO: 1388096 - DNA, 15 bp, Homo sapiens
tcaggtatacctcac

SEQ ID NO: 1388097 - DNA, 19 bp, Homo sapiens
tcagtaatttagaaatcat

SEQ ID NO: 1388098 - DNA, 14 bp, Homo sapiens
tcagtaatttgagg

SEQ ID NO: 1388099 - DNA, 18 bp, Homo sapiens
tcagtccccacagataac

SEQ ID NO: 1388100 - DNA, 13 bp, Homo sapiens
tcatacacagaaa

SEQ ID NO: 1388101 - DNA, 14 bp, Homo sapiens
tcatacattttcta

SEQ ID NO: 1388102 - DNA, 18 bp, Homo sapiens
tcatataaagtatcatca

SEQ ID NO: 1388103 - DNA, 22 bp, Homo sapiens
tcatcaactgaatgaggtcagc

SEQ ID NO: 1388104 - DNA, 13 bp, Homo sapiens
tcatcaattaaag

SEQ ID NO: 1388105 - DNA, 13 bp, Homo sapiens
tcatctaggattt

SEQ ID NO: 1388106 - DNA, 14 bp, Homo sapiens
tcatctaggatttt

SEQ ID NO: 1388107 - DNA, 22 bp, Homo sapiens
tcatctcagtgaagaatacttc

SEQ ID NO: 1388108 - DNA, 17 bp, Homo sapiens
tcatctttcttccaaac

SEQ ID NO: 1388109 - DNA, 18 bp, Homo sapiens
tcatgtgactctttccaa

SEQ ID NO: 1388110 - DNA, 17 bp, Homo sapiens
tcattaatctgcctccc

SEQ ID NO: 1388111 - DNA, 18 bp, Homo sapiens
tcattaatctgcctccct

SEQ ID NO: 1388112 - DNA, 20 bp, Homo sapiens
tcattagactggaacttgaa

SEQ ID NO: 1388113 - DNA, 18 bp, Homo sapiens
tcattgggttttatcagt

SEQ ID NO: 1388114 - DNA, 13 bp, Homo sapiens
tcatttcctcaaa

SEQ ID NO: 1388115 - DNA, 22 bp, Homo sapiens
tcattttaacatctgagaaaag

SEQ ID NO: 1388116 - DNA, 13 bp, Homo sapiens
tcattttctctaa

SEQ ID NO: 1388117 - DNA, 14 bp, Homo sapiens
tcattttggtactt

SEQ ID NO: 1388118 - DNA, 15 bp, Homo sapiens
tcatttttccgtaaa

SEQ ID NO: 1388119 - DNA, 19 bp, Homo sapiens
tccaaaaaagaaacattgt

SEQ ID NO: 1388120 - DNA, 19 bp, Homo sapiens
tccaaaagattgctgaaat

SEQ ID NO: 1388121 - DNA, 22 bp, Homo sapiens
tccaaaagattgctgaaatttt

SEQ ID NO: 1388122 - DNA, 12 bp, Homo sapiens
tccaaactcctg

SEQ ID NO: 1388123 - DNA, 16 bp, Homo sapiens
tccaaactcctgcctg

SEQ ID NO: 1388124 - DNA, 17 bp, Homo sapiens
tccaaactcctgcctgt

SEQ ID NO: 1388125 - DNA, 23 bp, Homo sapiens
tccaacaagaagggactgagaga

SEQ ID NO: 1388126 - DNA, 15 bp, Homo sapiens
tccaactaatgcctt

SEQ ID NO: 1388127 - DNA, 15 bp, Homo sapiens
tccaacttggctgca

SEQ ID NO: 1388128 - DNA, 21 bp, Homo sapiens
tccaagagctacataatttag

SEQ ID NO: 1388129 - DNA, 17 bp, Homo sapiens
tccaataaagcagcctc

SEQ ID NO: 1388130 - DNA, 18 bp, Homo sapiens
tccaattttctggaatac

SEQ ID NO: 1388131 - DNA, 22 bp, Homo sapiens
tccaattttctggaatacatga

SEQ ID NO: 1388132 - DNA, 14 bp, Homo sapiens
tccactcatgtgac

SEQ ID NO: 1388133 - DNA, 15 bp, Homo sapiens
tccagacctgaagaa

SEQ ID NO: 1388134 - DNA, 16 bp, Homo sapiens
tccagacctgaagaat

SEQ ID NO: 1388135 - DNA, 15 bp, Homo sapiens
tccagagtccctgcc

SEQ ID NO: 1388136 - DNA, 19 bp, Homo sapiens
tccagagtccctgcctgga

SEQ ID NO: 1388137 - DNA, 20 bp, Homo sapiens
tccagagtccctgcctggac

SEQ ID NO: 1388138 - DNA, 24 bp, Homo sapiens
tccagcatcgtctcatgtaaaata

SEQ ID NO: 1388139 - DNA, 20 bp, Homo sapiens
tccagccatcaagagactga

SEQ ID NO: 1388140 - DNA, 14 bp, Homo sapiens
tccaggagcctggc

SEQ ID NO: 1388141 - DNA, 23 bp, Homo sapiens
tccaggagcctggctccgtccag

SEQ ID NO: 1388142 - DNA, 18 bp, Homo sapiens
tccaggagcctgtgcctc

SEQ ID NO: 1388143 - DNA, 19 bp, Homo sapiens
tccagtcttcctgacactt

SEQ ID NO: 1388144 - DNA, 21 bp, Homo sapiens
tccagtcttcctgacacttta

SEQ ID NO: 1388145 - DNA, 23 bp, Homo sapiens
tccagttggagttttttgtacca

SEQ ID NO: 1388146 - DNA, 14 bp, Homo sapiens
tccatccctggccc

SEQ ID NO: 1388147 - DNA, 15 bp, Homo sapiens
tccatccctggcccc

SEQ ID NO: 1388148 - DNA, 20 bp, Homo sapiens
tccatgacctagttttccat

SEQ ID NO: 1388149 - DNA, 19 bp, Homo sapiens
tccatgcgtgtttctgact

SEQ ID NO: 1388150 - DNA, 20 bp, Homo sapiens
tccatgcgtgtttctgactc

SEQ ID NO: 1388151 - DNA, 21 bp, Homo sapiens
tccatgcgtgtttctgactct

SEQ ID NO: 1388152 - DNA, 22 bp, Homo sapiens
tccatgcgtgtttctgactctg

SEQ ID NO: 1388153 - DNA, 15 bp, Homo sapiens
tcccaacactgccag

SEQ ID NO: 1388154 - DNA, 12 bp, Homo sapiens
tcccaagacagt

SEQ ID NO: 1388155 - DNA, 19 bp, Homo sapiens
tcccacccctgcctcccat

SEQ ID NO: 1388156 - DNA, 15 bp, Homo sapiens
tcccacggcctttct

SEQ ID NO: 1388157 - DNA, 16 bp, Homo sapiens
tcccagaaccacactg

SEQ ID NO: 1388158 - DNA, 16 bp, Homo sapiens
tcccagagcaaaataa

SEQ ID NO: 1388159 - DNA, 19 bp, Homo sapiens
tcccatgcctggtcccaag

SEQ ID NO: 1388160 - DNA, 22 bp, Homo sapiens
tccccaagtacaaccacaccca

SEQ ID NO: 1388161 - DNA, 14 bp, Homo sapiens
tccccatctcaggc

SEQ ID NO: 1388162 - DNA, 19 bp, Homo sapiens
tccccatttaggtttctga

SEQ ID NO: 1388163 - DNA, 14 bp, Homo sapiens
tccccgcacccccc

SEQ ID NO: 1388164 - DNA, 18 bp, Homo sapiens
tcccctccatccctggcc

SEQ ID NO: 1388165 - DNA, 20 bp, Homo sapiens
tcccctccatccctggcccc

SEQ ID NO: 1388166 - DNA, 19 bp, Homo sapiens
tccccttcgcgtatttcag

SEQ ID NO: 1388167 - DNA, 18 bp, Homo sapiens
tccccttgaactcttcac

SEQ ID NO: 1388168 - DNA, 21 bp, Homo sapiens
tcccgggacacctaggctagg

SEQ ID NO: 1388169 - DNA, 14 bp, Homo sapiens
tccctaaagacaag

SEQ ID NO: 1388170 - DNA, 23 bp, Homo sapiens
gtggggggggggcgcggctggga

SEQ ID NO: 1388171 - DNA, 16 bp, Homo sapiens
gtggtggtccctgggt

SEQ ID NO: 1388172 - DNA, 18 bp, Homo sapiens
gtgtaattgagaaggaaa

SEQ ID NO: 1388173 - DNA, 17 bp, Homo sapiens
gtgtacatatgtaaaat

SEQ ID NO: 1388174 - DNA, 16 bp, Homo sapiens
gtgtagcaactacagt

SEQ ID NO: 1388175 - DNA, 13 bp, Homo sapiens
gtgtattccaaga

SEQ ID NO: 1388176 - DNA, 21 bp, Homo sapiens
gtgtcctgcaccggggcctgg

SEQ ID NO: 1388177 - DNA, 17 bp, Homo sapiens
gtgtctggcacagcctg

SEQ ID NO: 1388178 - DNA, 19 bp, Homo sapiens
gtgtggatatttatttaaa

SEQ ID NO: 1388179 - DNA, 15 bp, Homo sapiens
gtgtgtctgttcact

SEQ ID NO: 1388180 - DNA, 15 bp, Homo sapiens
gtgtgtgtatatata

SEQ ID NO: 1388181 - DNA, 21 bp, Homo sapiens
gtgttcccatttcagctgatc

SEQ ID NO: 1388182 - DNA, 12 bp, Homo sapiens
gtgttctgtttc

SEQ ID NO: 1388183 - DNA, 11 bp, Homo sapiens
gttaaatgtgt

SEQ ID NO: 1388184 - DNA, 23 bp, Homo sapiens
gttaaatgtgtgtaaaaaagtgt

SEQ ID NO: 1388185 - DNA, 19 bp, Homo sapiens
gttaagacttgacagtgga

SEQ ID NO: 1388186 - DNA, 14 bp, Homo sapiens
gttaatataattta

SEQ ID NO: 1388187 - DNA, 18 bp, Homo sapiens
gttaatattgatttatta

SEQ ID NO: 1388188 - DNA, 12 bp, Homo sapiens
gttaatttaaag

SEQ ID NO: 1388189 - DNA, 23 bp, Homo sapiens
gttaatttaaagttgtttgtgcc

SEQ ID NO: 1388190 - DNA, 16 bp, Homo sapiens
gttacctactttgact

SEQ ID NO: 1388191 - DNA, 20 bp, Homo sapiens
gttagctggacatgctttgg

SEQ ID NO: 1388192 - DNA, 18 bp, Homo sapiens
gttatctaagttaattta

SEQ ID NO: 1388193 - DNA, 21 bp, Homo sapiens
gttatctaagttaatttaaag

SEQ ID NO: 1388194 - DNA, 13 bp, Homo sapiens
gttatgctgtgac

SEQ ID NO: 1388195 - DNA, 19 bp, Homo sapiens
gttcaacttttcctttgaa

SEQ ID NO: 1388196 - DNA, 16 bp, Homo sapiens
gttcaagaaataagtt

SEQ ID NO: 1388197 - DNA, 19 bp, Homo sapiens
gttcatgagaatctatatt

SEQ ID NO: 1388198 - DNA, 12 bp, Homo sapiens
gttcctgcatgc

SEQ ID NO: 1388199 - DNA, 14 bp, Homo sapiens
gttctccttagatg

SEQ ID NO: 1388200 - DNA, 12 bp, Homo sapiens
gttctgccagga

SEQ ID NO: 1388201 - DNA, 14 bp, Homo sapiens
gttctgccaggaga

SEQ ID NO: 1388202 - DNA, 23 bp, Homo sapiens
gttctgtttcccattactttaat

SEQ ID NO: 1388203 - DNA, 21 bp, Homo sapiens
gttcttgaggggaccaggagt

SEQ ID NO: 1388204 - DNA, 23 bp, Homo sapiens
gttcttgaggggaccaggagtgg

SEQ ID NO: 1388205 - DNA, 23 bp, Homo sapiens
gttctttaaaatgtaaagccatg

SEQ ID NO: 1388206 - DNA, 22 bp, Homo sapiens
gttgaaaataaagtgtatattt

SEQ ID NO: 1388207 - DNA, 15 bp, Homo sapiens
gttgagacaagaaaa

SEQ ID NO: 1388208 - DNA, 12 bp, Homo sapiens
gttgagacagag

SEQ ID NO: 1388209 - DNA, 16 bp, Homo sapiens
gttgcacagctatgaa

SEQ ID NO: 1388210 - DNA, 16 bp, Homo sapiens
gttgcagacaggaatc

SEQ ID NO: 1388211 - DNA, 17 bp, Homo sapiens
gttggacacactgtaaa

SEQ ID NO: 1388212 - DNA, 20 bp, Homo sapiens
gtttaagccaaaacaatgtt

SEQ ID NO: 1388213 - DNA, 18 bp, Homo sapiens
gtttagtggctcaacatt

SEQ ID NO: 1388214 - DNA, 19 bp, Homo sapiens
gtttattttcaagaataat

SEQ ID NO: 1388215 - DNA, 23 bp, Homo sapiens
gtttcacagcctataaccagaca

SEQ ID NO: 1388216 - DNA, 23 bp, Homo sapiens
gtttcaggagagagttgaaccta

SEQ ID NO: 1388217 - DNA, 23 bp, Homo sapiens
gtttcagggggcctttaaagact

SEQ ID NO: 1388218 - DNA, 13 bp, Homo sapiens
gtttctgactctg

SEQ ID NO: 1388219 - DNA, 21 bp, Homo sapiens
gtttcttaaataagaaacttt

SEQ ID NO: 1388220 - DNA, 19 bp, Homo sapiens
gtttgaggttaaaatataa

SEQ ID NO: 1388221 - DNA, 21 bp, Homo sapiens
gtttgctttctgatcaaggcc

SEQ ID NO: 1388222 - DNA, 21 bp, Homo sapiens
gtttggaaattgattttgaac

SEQ ID NO: 1388223 - DNA, 18 bp, Homo sapiens
gtttggctttcagggagg

SEQ ID NO: 1388224 - DNA, 15 bp, Homo sapiens
gtttgtgtggatacc

SEQ ID NO: 1388225 - DNA, 18 bp, Homo sapiens
gttttacttttaaactgt

SEQ ID NO: 1388226 - DNA, 16 bp, Homo sapiens
gttttctcctcccagg

SEQ ID NO: 1388227 - DNA, 21 bp, Homo sapiens
gttttctcctcccaggaactg

SEQ ID NO: 1388228 - DNA, 17 bp, Homo sapiens
gttttgctacataatta

SEQ ID NO: 1388229 - DNA, 16 bp, Homo sapiens
gtttttcacattttcc

SEQ ID NO: 1388230 - DNA, 16 bp, Homo sapiens
gtttttcggacagttt

SEQ ID NO: 1388231 - DNA, 14 bp, Homo sapiens
gttttttgtaccaa

SEQ ID NO: 1388232 - DNA, 15 bp, Homo sapiens
taaaaaaataagaag

SEQ ID NO: 1388233 - DNA, 19 bp, Homo sapiens
taaaaaactaaaaactaga

SEQ ID NO: 1388234 - DNA, 18 bp, Homo sapiens
taaaaaagcttaaaactt

SEQ ID NO: 1388235 - DNA, 19 bp, Homo sapiens
taaaaaagcttaaaacttt

SEQ ID NO: 1388236 - DNA, 20 bp, Homo sapiens
taaaaactagaggtgagaaa

SEQ ID NO: 1388237 - DNA, 18 bp, Homo sapiens
taaaaagattgaagtatt

SEQ ID NO: 1388238 - DNA, 20 bp, Homo sapiens
taaaaagattgaagtatttt

SEQ ID NO: 1388239 - DNA, 18 bp, Homo sapiens
taaaaatgaattgggaac

SEQ ID NO: 1388240 - DNA, 15 bp, Homo sapiens
taaaaatgatctaaa

SEQ ID NO: 1388241 - DNA, 16 bp, Homo sapiens
taaaaatgatttcagt

SEQ ID NO: 1388242 - DNA, 17 bp, Homo sapiens
taaaacagacactggca

SEQ ID NO: 1388243 - DNA, 18 bp, Homo sapiens
taaaacagacactggcat

SEQ ID NO: 1388244 - DNA, 14 bp, Homo sapiens
taaaacatttattt

SEQ ID NO: 1388245 - DNA, 21 bp, Homo sapiens
taaaactttgaagttagcttt

SEQ ID NO: 1388246 - DNA, 17 bp, Homo sapiens
taaaagaaactttcttt

SEQ ID NO: 1388247 - DNA, 17 bp, Homo sapiens
taaaagcaaaaaagaaa

SEQ ID NO: 1388248 - DNA, 22 bp, Homo sapiens
taaaagcaaaaaagaaaacctt

SEQ ID NO: 1388249 - DNA, 23 bp, Homo sapiens
taaaagcaaaaaagaaaaccttt

SEQ ID NO: 1388250 - DNA, 19 bp, Homo sapiens
taaaagtcagcattttctt

SEQ ID NO: 1388251 - DNA, 13 bp, Homo sapiens
taaaataaagaaa

SEQ ID NO: 1388252 - DNA, 17 bp, Homo sapiens
taaaatactattggaga

SEQ ID NO: 1388253 - DNA, 21 bp, Homo sapiens
taaaatagcaaaagaagaagt

SEQ ID NO: 1388254 - DNA, 22 bp, Homo sapiens
taaaatagcaaaagaagaagtt

SEQ ID NO: 1388255 - DNA, 19 bp, Homo sapiens
taaaatgcaaaataaatgt

SEQ ID NO: 1388256 - DNA, 15 bp, Homo sapiens
taaaatgtaaagcca

SEQ ID NO: 1388257 - DNA, 16 bp, Homo sapiens
taaacaaatgtgtaat

SEQ ID NO: 1388258 - DNA, 20 bp, Homo sapiens
taaacaggtggttcttttta

SEQ ID NO: 1388259 - DNA, 23 bp, Homo sapiens
taaacagtgagcctgaattttgt

SEQ ID NO: 1388260 - DNA, 15 bp, Homo sapiens
taaacatcattcatt

SEQ ID NO: 1388261 - DNA, 21 bp, Homo sapiens
taaaccagctacttgatgtaa

SEQ ID NO: 1388262 - DNA, 17 bp, Homo sapiens
taaacccctgggtaact

SEQ ID NO: 1388263 - DNA, 17 bp, Homo sapiens
taaactataagcaagaa

SEQ ID NO: 1388264 - DNA, 20 bp, Homo sapiens
taaactatcttggtgaattt

SEQ ID NO: 1388265 - DNA, 16 bp, Homo sapiens
taaactcaaaatattt

SEQ ID NO: 1388266 - DNA, 21 bp, Homo sapiens
taaactcaaaatatttgtaca

SEQ ID NO: 1388267 - DNA, 13 bp, Homo sapiens
taaagaattattt

SEQ ID NO: 1388268 - DNA, 16 bp, Homo sapiens
taaagaattattttgt

SEQ ID NO: 1388269 - DNA, 15 bp, Homo sapiens
taaagacttaagatt

SEQ ID NO: 1388270 - DNA, 16 bp, Homo sapiens
taaagattttttaata

SEQ ID NO: 1388271 - DNA, 13 bp, Homo sapiens
taaagcatttaga

SEQ ID NO: 1388272 - DNA, 22 bp, Homo sapiens
taaaggtgaccctgatgaaacc

SEQ ID NO: 1388273 - DNA, 22 bp, Homo sapiens
taaaggttacaagcctgcacaa

SEQ ID NO: 1388274 - DNA, 18 bp, Homo sapiens
taaagttcaacatgttat

SEQ ID NO: 1388275 - DNA, 20 bp, Homo sapiens
taaagttgataaagattttt

SEQ ID NO: 1388276 - DNA, 18 bp, Homo sapiens
taaagttgtttgtgcctt

SEQ ID NO: 1388277 - DNA, 15 bp, Homo sapiens
taaatattttaaaga

SEQ ID NO: 1388278 - DNA, 18 bp, Homo sapiens
taaatcacgctttttgaa

SEQ ID NO: 1388279 - DNA, 13 bp, Homo sapiens
taaatgaacataa

SEQ ID NO: 1388280 - DNA, 20 bp, Homo sapiens
gctgctagagtgactcacta

SEQ ID NO: 1388281 - DNA, 17 bp, Homo sapiens
gctggaaaataatactg

SEQ ID NO: 1388282 - DNA, 17 bp, Homo sapiens
gctggacatgctttggc

SEQ ID NO: 1388283 - DNA, 17 bp, Homo sapiens
gctggcagtcctggaag

SEQ ID NO: 1388284 - DNA, 15 bp, Homo sapiens
gctggcttgggcagc

SEQ ID NO: 1388285 - DNA, 14 bp, Homo sapiens
gctgggactacagg

SEQ ID NO: 1388286 - DNA, 18 bp, Homo sapiens
gctgggcccctgcctctc

SEQ ID NO: 1388287 - DNA, 21 bp, Homo sapiens
gctgggcccctgcctctctgc

SEQ ID NO: 1388288 - DNA, 18 bp, Homo sapiens
gctggggacaggtcctca

SEQ ID NO: 1388289 - DNA, 16 bp, Homo sapiens
gctggggccaggctgg

SEQ ID NO: 1388290 - DNA, 15 bp, Homo sapiens
gctggtttaatgttt

SEQ ID NO: 1388291 - DNA, 12 bp, Homo sapiens
gctgtacactgc

SEQ ID NO: 1388292 - DNA, 19 bp, Homo sapiens
gctgtgaccctcaattcat

SEQ ID NO: 1388293 - DNA, 17 bp, Homo sapiens
gctgtgcttatggtacc

SEQ ID NO: 1388294 - DNA, 12 bp, Homo sapiens
gctgtggccagg

SEQ ID NO: 1388295 - DNA, 15 bp, Homo sapiens
gctgtggccaggagg

SEQ ID NO: 1388296 - DNA, 16 bp, Homo sapiens
gctgtggccaggaggt

SEQ ID NO: 1388297 - DNA, 12 bp, Homo sapiens
gcttaaaaatgc

SEQ ID NO: 1388298 - DNA, 22 bp, Homo sapiens
gcttatgacatcacttgtacaa

SEQ ID NO: 1388299 - DNA, 15 bp, Homo sapiens
gcttcaggtccaggc

SEQ ID NO: 1388300 - DNA, 16 bp, Homo sapiens
gcttcgtttattttca

SEQ ID NO: 1388301 - DNA, 16 bp, Homo sapiens
gcttctggccaggaag

SEQ ID NO: 1388302 - DNA, 20 bp, Homo sapiens
gcttgatagaaatgccaagc

SEQ ID NO: 1388303 - DNA, 19 bp, Homo sapiens
gcttgatgggattctggac

SEQ ID NO: 1388304 - DNA, 22 bp, Homo sapiens
gcttgatgggattctggacagg

SEQ ID NO: 1388305 - DNA, 16 bp, Homo sapiens
gcttgttgtgctttta

SEQ ID NO: 1388306 - DNA, 15 bp, Homo sapiens
gctttactttagaat

SEQ ID NO: 1388307 - DNA, 18 bp, Homo sapiens
gctttcagggaggccctg

SEQ ID NO: 1388308 - DNA, 22 bp, Homo sapiens
gctttcctgaatccaaactaat

SEQ ID NO: 1388309 - DNA, 15 bp, Homo sapiens
gctttgaaacagaaa

SEQ ID NO: 1388310 - DNA, 17 bp, Homo sapiens
gctttggacctaatcca

SEQ ID NO: 1388311 - DNA, 14 bp, Homo sapiens
gctttgtggcactg

SEQ ID NO: 1388312 - DNA, 23 bp, Homo sapiens
gcttttgcggttcaggaaaattg

SEQ ID NO: 1388313 - DNA, 19 bp, Homo sapiens
gctttttattcctcctgct

SEQ ID NO: 1388314 - DNA, 12 bp, Homo sapiens
ggaaaataagtg

SEQ ID NO: 1388315 - DNA, 13 bp, Homo sapiens
ggaaaataagtga

SEQ ID NO: 1388316 - DNA, 21 bp, Homo sapiens
ggaaaatgctatcaaataact

SEQ ID NO: 1388317 - DNA, 16 bp, Homo sapiens
ggaaaggtggtgtttc

SEQ ID NO: 1388318 - DNA, 20 bp, Homo sapiens
gggtttcaccatgttggcca

SEQ ID NO: 1388319 - DNA, 17 bp, Homo sapiens
gggtttgtgacagggcg

SEQ ID NO: 1388320 - DNA, 19 bp, Homo sapiens
ggtacattggtaaacattt

SEQ ID NO: 1388321 - DNA, 22 bp, Homo sapiens
ggtagcgggggagggtaggcag

SEQ ID NO: 1388322 - DNA, 23 bp, Homo sapiens
ggtatagttcatgtctgctatca

SEQ ID NO: 1388323 - DNA, 15 bp, Homo sapiens
ggtattagcacctct

SEQ ID NO: 1388324 - DNA, 16 bp, Homo sapiens
ggtcaacagttttcct

SEQ ID NO: 1388325 - DNA, 11 bp, Homo sapiens
ggtcaggcctt

SEQ ID NO: 1388326 - DNA, 13 bp, Homo sapiens
ggtcaggcctttg

SEQ ID NO: 1388327 - DNA, 12 bp, Homo sapiens
ggtccctaataa

SEQ ID NO: 1388328 - DNA, 14 bp, Homo sapiens
ggtcgccctggact

SEQ ID NO: 1388329 - DNA, 20 bp, Homo sapiens
ggtcgccctggactgtgtgc

SEQ ID NO: 1388330 - DNA, 17 bp, Homo sapiens
ggtctcaaactcctgac

SEQ ID NO: 1388331 - DNA, 15 bp, Homo sapiens
ggtgagaaatttaaa

SEQ ID NO: 1388332 - DNA, 18 bp, Homo sapiens
ggtgcgagtgcgtgaata

SEQ ID NO: 1388333 - DNA, 19 bp, Homo sapiens
ggtgctgggcccctgcctc

SEQ ID NO: 1388334 - DNA, 21 bp, Homo sapiens
ggtgcttctagttctgccagg

SEQ ID NO: 1388335 - DNA, 21 bp, Homo sapiens
ggtggcagtgcagcaaccaga

SEQ ID NO: 1388336 - DNA, 11 bp, Homo sapiens
ggtggccaggc

SEQ ID NO: 1388337 - DNA, 14 bp, Homo sapiens
ggtggcttttgcgg

SEQ ID NO: 1388338 - DNA, 22 bp, Homo sapiens
ggtggggggggggcgcggctgg

SEQ ID NO: 1388339 - DNA, 17 bp, Homo sapiens
ggtggggggggtgctgg

SEQ ID NO: 1388340 - DNA, 21 bp, Homo sapiens
ggtgtcctgcaccggggcctg

SEQ ID NO: 1388341 - DNA, 18 bp, Homo sapiens
ggttaaaatataaattaa

SEQ ID NO: 1388342 - DNA, 19 bp, Homo sapiens
ggttaaaatataaattaag

SEQ ID NO: 1388343 - DNA, 14 bp, Homo sapiens
ggttcaacttatta

SEQ ID NO: 1388344 - DNA, 15 bp, Homo sapiens
ggttccctaaagaca

SEQ ID NO: 1388345 - DNA, 19 bp, Homo sapiens
ggttcttgaggggaccagg

SEQ ID NO: 1388346 - DNA, 19 bp, Homo sapiens
ggtttaatgttttggccaa

SEQ ID NO: 1388347 - DNA, 19 bp, Homo sapiens
gtaaaaaagttaaatgtgt

SEQ ID NO: 1388348 - DNA, 18 bp, Homo sapiens
gtaaaacatttattttga

SEQ ID NO: 1388349 - DNA, 19 bp, Homo sapiens
gtaaaagcaaaaaagaaaa

SEQ ID NO: 1388350 - DNA, 17 bp, Homo sapiens
gtaaaaggtattaaatt

SEQ ID NO: 1388351 - DNA, 17 bp, Homo sapiens
gtaaaatattgttacta

SEQ ID NO: 1388352 - DNA, 23 bp, Homo sapiens
gtaaactcaaaatatttgtacat

SEQ ID NO: 1388353 - DNA, 14 bp, Homo sapiens
gtaaagaattattt

SEQ ID NO: 1388354 - DNA, 15 bp, Homo sapiens
gtaaagctaaaataa

SEQ ID NO: 1388355 - DNA, 14 bp, Homo sapiens
gtaaatattttaaa

SEQ ID NO: 1388356 - DNA, 21 bp, Homo sapiens
gtaaatcacgctttttgaaaa

SEQ ID NO: 1388357 - DNA, 18 bp, Homo sapiens
gtaaatgaacataatgaa

SEQ ID NO: 1388358 - DNA, 14 bp, Homo sapiens
gtaacaagccagat

SEQ ID NO: 1388359 - DNA, 15 bp, Homo sapiens
gtaactgagaatttg

SEQ ID NO: 1388360 - DNA, 14 bp, Homo sapiens
gtaacttttgtaag

SEQ ID NO: 1388361 - DNA, 22 bp, Homo sapiens
gtaatgttaatattgatttatt

SEQ ID NO: 1388362 - DNA, 18 bp, Homo sapiens
gtaatttagaaatcattt

SEQ ID NO: 1388363 - DNA, 23 bp, Homo sapiens
gtaatttgagagaaatatgaaga

SEQ ID NO: 1388364 - DNA, 16 bp, Homo sapiens
gtaatttgaggacaac

SEQ ID NO: 1388365 - DNA, 14 bp, Homo sapiens
gtacaaaataaaca

SEQ ID NO: 1388366 - DNA, 15 bp, Homo sapiens
gtacaagaagcattt

SEQ ID NO: 1388367 - DNA, 16 bp, Homo sapiens
gtacacagcaccagaa

SEQ ID NO: 1388368 - DNA, 18 bp, Homo sapiens
gtacatagttatttattt

SEQ ID NO: 1388369 - DNA, 13 bp, Homo sapiens
gtactaaagccaa

SEQ ID NO: 1388370 - DNA, 20 bp, Homo sapiens
gtactgggattacaggcgtg

SEQ ID NO: 1388371 - DNA, 15 bp, Homo sapiens
gtacttgctcttgat

SEQ ID NO: 1388372 - DNA, 16 bp, Homo sapiens
gtacttgctcttgatg

SEQ ID NO: 1388373 - DNA, 19 bp, Homo sapiens
gtacttgctcttgatgcct

SEQ ID NO: 1388374 - DNA, 23 bp, Homo sapiens
gtagaaaacttcaaggaaaataa

SEQ ID NO: 1388375 - DNA, 16 bp, Homo sapiens
gtagaatgtaaagctt

SEQ ID NO: 1388376 - DNA, 16 bp, Homo sapiens
gtagaccaaaataaaa

SEQ ID NO: 1388377 - DNA, 23 bp, Homo sapiens
gtagcacaagttatttaaatctg

SEQ ID NO: 1388378 - DNA, 13 bp, Homo sapiens
gtagccacaccag

SEQ ID NO: 1388379 - DNA, 15 bp, Homo sapiens
gtagccacaccagga

SEQ ID NO: 1388380 - DNA, 16 bp, Homo sapiens
gtagccacaccaggat

SEQ ID NO: 1388381 - DNA, 16 bp, Homo sapiens
gtagccccagtgacag

SEQ ID NO: 1388382 - DNA, 15 bp, Homo sapiens
gtatacctgattttt

SEQ ID NO: 1388383 - DNA, 10 bp, Homo sapiens
gtatatatat

SEQ ID NO: 1388384 - DNA, 12 bp, Homo sapiens
gtatcatagaaa

SEQ ID NO: 1388385 - DNA, 15 bp, Homo sapiens
gtatcatagaaatgt

SEQ ID NO: 1388386 - DNA, 18 bp, Homo sapiens
gtattacactctgtaatt

SEQ ID NO: 1388387 - DNA, 23 bp, Homo sapiens
gtattagcacctctttttgaaca

SEQ ID NO: 1388388 - DNA, 20 bp, Homo sapiens
gtcaaaacagattgtttgca

SEQ ID NO: 1388389 - DNA, 21 bp, Homo sapiens
gtcaacagttttcctatgctt

SEQ ID NO: 1388390 - DNA, 22 bp, Homo sapiens
gtcatagaaattacacccaaag

SEQ ID NO: 1388391 - DNA, 15 bp, Homo sapiens
gtcatgatggagact

SEQ ID NO: 1388392 - DNA, 18 bp, Homo sapiens
gtcattttggtactttgg

SEQ ID NO: 1388393 - DNA, 18 bp, Homo sapiens
gtccaaaagattgctgaa

SEQ ID NO: 1388394 - DNA, 21 bp, Homo sapiens
gtccaaaataaaacctcagct

SEQ ID NO: 1388395 - DNA, 22 bp, Homo sapiens
gtccaaaataaaacctcagcta

SEQ ID NO: 1388396 - DNA, 18 bp, Homo sapiens
gtcccagaaccacactgt

SEQ ID NO: 1388397 - DNA, 12 bp, Homo sapiens
gtcccctgcctc

SEQ ID NO: 1388398 - DNA, 15 bp, Homo sapiens
gtccctaataaagct

SEQ ID NO: 1388399 - DNA, 18 bp, Homo sapiens
gtccctaataaagctgtg

SEQ ID NO: 1388400 - DNA, 14 bp, Homo sapiens
gtccctgcctggac

SEQ ID NO: 1388401 - DNA, 20 bp, Homo sapiens
gtccctgcctggaccagcct

SEQ ID NO: 1388402 - DNA, 22 bp, Homo sapiens
gtccctgcctggaccagcctct

SEQ ID NO: 1388403 - DNA, 15 bp, Homo sapiens
gtcctgcaccggggc

SEQ ID NO: 1388404 - DNA, 23 bp, Homo sapiens
gtctatcaaccccagacactggt

SEQ ID NO: 1388405 - DNA, 13 bp, Homo sapiens
gtctattcagctt

SEQ ID NO: 1388406 - DNA, 20 bp, Homo sapiens
gtctcctctgattatcaggt

SEQ ID NO: 1388407 - DNA, 14 bp, Homo sapiens
gtctcttctgagct

SEQ ID NO: 1388408 - DNA, 15 bp, Homo sapiens
gtctgagagaggcca

SEQ ID NO: 1388409 - DNA, 19 bp, Homo sapiens
gtctggcacagcctggctg

SEQ ID NO: 1388410 - DNA, 16 bp, Homo sapiens
gtctgttatgctgtga

SEQ ID NO: 1388411 - DNA, 12 bp, Homo sapiens
gtctgtttactg

SEQ ID NO: 1388412 - DNA, 22 bp, Homo sapiens
gtgaaataccaacctgaagaca

SEQ ID NO: 1388413 - DNA, 14 bp, Homo sapiens
gtgaagaatacttc

SEQ ID NO: 1388414 - DNA, 16 bp, Homo sapiens
gtgaagcatccaggca

SEQ ID NO: 1388415 - DNA, 13 bp, Homo sapiens
gtgaatcaagggt

SEQ ID NO: 1388416 - DNA, 21 bp, Homo sapiens
gtgaatcaagggtcaggcctt

SEQ ID NO: 1388417 - DNA, 22 bp, Homo sapiens
gtgacagggcgggggtggcggc

SEQ ID NO: 1388418 - DNA, 15 bp, Homo sapiens
gtgacgtctgggtgg

SEQ ID NO: 1388419 - DNA, 15 bp, Homo sapiens
gtgagaaatttaaac

SEQ ID NO: 1388420 - DNA, 15 bp, Homo sapiens
gtgagacagtctgga

SEQ ID NO: 1388421 - DNA, 19 bp, Homo sapiens
gtgagacagtctggaaagt

SEQ ID NO: 1388422 - DNA, 22 bp, Homo sapiens
gtgagagaaagagaaatcagaa

SEQ ID NO: 1388423 - DNA, 17 bp, Homo sapiens
gcacctttctagttgaa

SEQ ID NO: 1388424 - DNA, 15 bp, Homo sapiens
gcacttggctgcata

SEQ ID NO: 1388425 - DNA, 17 bp, Homo sapiens
gcagcaaccagagcact

SEQ ID NO: 1388426 - DNA, 19 bp, Homo sapiens
gcagcaaccagagcactgt

SEQ ID NO: 1388427 - DNA, 14 bp, Homo sapiens
gcagcccctcccag

SEQ ID NO: 1388428 - DNA, 15 bp, Homo sapiens
gcaggaggccaataa

SEQ ID NO: 1388429 - DNA, 16 bp, Homo sapiens
gcaggaggccaataaa

SEQ ID NO: 1388430 - DNA, 17 bp, Homo sapiens
gcaggaggccaataaaa

SEQ ID NO: 1388431 - DNA, 21 bp, Homo sapiens
gcaggatctcaccaggcagcc

SEQ ID NO: 1388432 - DNA, 22 bp, Homo sapiens
gcaggcatcggggagccgggag

SEQ ID NO: 1388433 - DNA, 20 bp, Homo sapiens
gcaggccgtgacgtctgggt

SEQ ID NO: 1388434 - DNA, 14 bp, Homo sapiens
gcaggctcccaggg

SEQ ID NO: 1388435 - DNA, 19 bp, Homo sapiens
gcaggggccgggggcagtc

SEQ ID NO: 1388436 - DNA, 20 bp, Homo sapiens
gcaggggccgggggcagtct

SEQ ID NO: 1388437 - DNA, 12 bp, Homo sapiens
gcaggtccctaa

SEQ ID NO: 1388438 - DNA, 21 bp, Homo sapiens
gcaggtccctaataaagctgt

SEQ ID NO: 1388439 - DNA, 23 bp, Homo sapiens
gcaggtccctaataaagctgtgt

SEQ ID NO: 1388440 - DNA, 13 bp, Homo sapiens
gcagtaataaaaa

SEQ ID NO: 1388441 - DNA, 20 bp, Homo sapiens
gcagtcctggaagccagctt

SEQ ID NO: 1388442 - DNA, 16 bp, Homo sapiens
gcagtgcagcaaccag

SEQ ID NO: 1388443 - DNA, 14 bp, Homo sapiens
gcagtgggaaaaat

SEQ ID NO: 1388444 - DNA, 15 bp, Homo sapiens
gcagtttatatttaa

SEQ ID NO: 1388445 - DNA, 19 bp, Homo sapiens
gcatccattctcctgagga

SEQ ID NO: 1388446 - DNA, 12 bp, Homo sapiens
gcatccctgggc

SEQ ID NO: 1388447 - DNA, 15 bp, Homo sapiens
gcatccctgggcctt

SEQ ID NO: 1388448 - DNA, 20 bp, Homo sapiens
gcatccctgggccttgggct

SEQ ID NO: 1388449 - DNA, 14 bp, Homo sapiens
gcatgagaaataca

SEQ ID NO: 1388450 - DNA, 17 bp, Homo sapiens
gcatgagaaatacaaaa

SEQ ID NO: 1388451 - DNA, 14 bp, Homo sapiens
gcattactgaattt

SEQ ID NO: 1388452 - DNA, 23 bp, Homo sapiens
gcattattggaatataattgttt

SEQ ID NO: 1388453 - DNA, 22 bp, Homo sapiens
gcattttgtaagttgaagcaaa

SEQ ID NO: 1388454 - DNA, 13 bp, Homo sapiens
gccaaaaatagct

SEQ ID NO: 1388455 - DNA, 19 bp, Homo sapiens
gccaagggcataaattatt

SEQ ID NO: 1388456 - DNA, 10 bp, Homo sapiens
gccaataaaa

SEQ ID NO: 1388457 - DNA, 21 bp, Homo sapiens
gccaatgcacctaaagaaaaa

SEQ ID NO: 1388458 - DNA, 22 bp, Homo sapiens
gccactggagtgtgcgtggtgg

SEQ ID NO: 1388459 - DNA, 13 bp, Homo sapiens
gccagatttttta

SEQ ID NO: 1388460 - DNA, 15 bp, Homo sapiens
gccagctttccctgc

SEQ ID NO: 1388461 - DNA, 22 bp, Homo sapiens
gccaggaagctttggtgagaac

SEQ ID NO: 1388462 - DNA, 17 bp, Homo sapiens
gccaggaggacccaggg

SEQ ID NO: 1388463 - DNA, 15 bp, Homo sapiens
gccaggctaattttt

SEQ ID NO: 1388464 - DNA, 17 bp, Homo sapiens
gccaggctgggtcgccc

SEQ ID NO: 1388465 - DNA, 23 bp, Homo sapiens
gccaggctgggtcgccctggact

SEQ ID NO: 1388466 - DNA, 18 bp, Homo sapiens
gccatgatgcctctgtct

SEQ ID NO: 1388467 - DNA, 17 bp, Homo sapiens
gccatgtcaaacaaata

SEQ ID NO: 1388468 - DNA, 18 bp, Homo sapiens
attaactgggtaatgaaa

SEQ ID NO: 1388469 - DNA, 19 bp, Homo sapiens
attaagactttaaaagatg

SEQ ID NO: 1388470 - DNA, 16 bp, Homo sapiens
attaagatacactcct

SEQ ID NO: 1388471 - DNA, 13 bp, Homo sapiens
attaagttcttta

SEQ ID NO: 1388472 - DNA, 17 bp, Homo sapiens
attaatttatgcagaat

SEQ ID NO: 1388473 - DNA, 15 bp, Homo sapiens
attacagctggagaa

SEQ ID NO: 1388474 - DNA, 14 bp, Homo sapiens
attaccaacctgtt

SEQ ID NO: 1388475 - DNA, 14 bp, Homo sapiens
attactgcatgcac

SEQ ID NO: 1388476 - DNA, 17 bp, Homo sapiens
attactgcatgcacttc

SEQ ID NO: 1388477 - DNA, 14 bp, Homo sapiens
gagagcctgcagga

SEQ ID NO: 1388478 - DNA, 15 bp, Homo sapiens
gagaggccttttgga

SEQ ID NO: 1388479 - DNA, 18 bp, Homo sapiens
gagaggccttttggaatg

SEQ ID NO: 1388480 - DNA, 23 bp, Homo sapiens
gagataatctaaatataaaccag

SEQ ID NO: 1388481 - DNA, 18 bp, Homo sapiens
gagatggagtcttgctct

SEQ ID NO: 1388482 - DNA, 12 bp, Homo sapiens
gagcaaaataat

SEQ ID NO: 1388483 - DNA, 15 bp, Homo sapiens
gagcactgtataccc

SEQ ID NO: 1388484 - DNA, 18 bp, Homo sapiens
gagcaggaggccaataaa

SEQ ID NO: 1388485 - DNA, 13 bp, Homo sapiens
gagcatcacagaa

SEQ ID NO: 1388486 - DNA, 18 bp, Homo sapiens
gagccaaggggcttcagg

SEQ ID NO: 1388487 - DNA, 23 bp, Homo sapiens
gagcccactgtacttgctcttga

SEQ ID NO: 1388488 - DNA, 19 bp, Homo sapiens
gagccctgggaggctctgg

SEQ ID NO: 1388489 - DNA, 13 bp, Homo sapiens
gagcctgcaggat

SEQ ID NO: 1388490 - DNA, 23 bp, Homo sapiens
gagcctggctccgtccaggagcc

SEQ ID NO: 1388491 - DNA, 19 bp, Homo sapiens
gagcctgtgcctcctcacc

SEQ ID NO: 1388492 - DNA, 15 bp, Homo sapiens
gagctacataattta

SEQ ID NO: 1388493 - DNA, 15 bp, Homo sapiens
gagctacgtatttaa

SEQ ID NO: 1388494 - DNA, 20 bp, Homo sapiens
gagctacgtatttaatagca

SEQ ID NO: 1388495 - DNA, 11 bp, Homo sapiens
gagctactgcc

SEQ ID NO: 1388496 - DNA, 20 bp, Homo sapiens
gagctcaggaaccgaggcag

SEQ ID NO: 1388497 - DNA, 21 bp, Homo sapiens
gagctcaggaaccgaggcagg

SEQ ID NO: 1388498 - DNA, 23 bp, Homo sapiens
gagctcaggaaccgaggcaggga

SEQ ID NO: 1388499 - DNA, 13 bp, Homo sapiens
gagctcaggatga

SEQ ID NO: 1388500 - DNA, 20 bp, Homo sapiens
gagctccttaaggctctttt

SEQ ID NO: 1388501 - DNA, 17 bp, Homo sapiens
gagctcttcatgtttca

SEQ ID NO: 1388502 - DNA, 14 bp, Homo sapiens
gaggacccagggct

SEQ ID NO: 1388503 - DNA, 18 bp, Homo sapiens
gaggacttgtgtctctgt

SEQ ID NO: 1388504 - DNA, 13 bp, Homo sapiens
gaggatacgacag

SEQ ID NO: 1388505 - DNA, 12 bp, Homo sapiens
gaggatgttctg

SEQ ID NO: 1388506 - DNA, 13 bp, Homo sapiens
gaggatgttctgg

SEQ ID NO: 1388507 - DNA, 14 bp, Homo sapiens
gaggcagggaagga

SEQ ID NO: 1388508 - DNA, 17 bp, Homo sapiens
gaggccaataaaaagtt

SEQ ID NO: 1388509 - DNA, 17 bp, Homo sapiens
gaggccgctatgcaggg

SEQ ID NO: 1388510 - DNA, 21 bp, Homo sapiens
gaggcgaagcgttgtcctcag

SEQ ID NO: 1388511 - DNA, 20 bp, Homo sapiens
gaggctattattttcactgt

SEQ ID NO: 1388512 - DNA, 13 bp, Homo sapiens
gaggctcagccct

SEQ ID NO: 1388513 - DNA, 20 bp, Homo sapiens
gaggctctggagcccactgt

SEQ ID NO: 1388514 - DNA, 15 bp, Homo sapiens
gagggcgcaggccgt

SEQ ID NO: 1388515 - DNA, 16 bp, Homo sapiens
gagggctgcctttgga

SEQ ID NO: 1388516 - DNA, 23 bp, Homo sapiens
gaggggtacattggtaaacattt

SEQ ID NO: 1388517 - DNA, 18 bp, Homo sapiens
gagggtaggcaggattgg

SEQ ID NO: 1388518 - DNA, 21 bp, Homo sapiens
gaggttaaaatataaattaag

SEQ ID NO: 1388519 - DNA, 15 bp, Homo sapiens
gagtcactgagacca

SEQ ID NO: 1388520 - DNA, 13 bp, Homo sapiens
gagtccatcagcc

SEQ ID NO: 1388521 - DNA, 15 bp, Homo sapiens
gagtccctgcctgga

SEQ ID NO: 1388522 - DNA, 21 bp, Homo sapiens
gagtccctgcctggaccagcc

SEQ ID NO: 1388523 - DNA, 20 bp, Homo sapiens
gagtctgtccagataagtta

SEQ ID NO: 1388524 - DNA, 20 bp, Homo sapiens
gagtcttgctctgtcgccca

SEQ ID NO: 1388525 - DNA, 15 bp, Homo sapiens
gagtgggtggggagt

SEQ ID NO: 1388526 - DNA, 20 bp, Homo sapiens
gagtgtgaccaaaagttaca

SEQ ID NO: 1388527 - DNA, 12 bp, Homo sapiens
gagttcctgcat

SEQ ID NO: 1388528 - DNA, 18 bp, Homo sapiens
gagttgctgcaaacctga

SEQ ID NO: 1388529 - DNA, 19 bp, Homo sapiens
gaaattttatatgcttact

SEQ ID NO: 1388530 - DNA, 19 bp, Homo sapiens
gaaattttccattacatga

SEQ ID NO: 1388531 - DNA, 15 bp, Homo sapiens
gaacaaatggccttt

SEQ ID NO: 1388532 - DNA, 17 bp, Homo sapiens
gaacacaggcaaaatcc

SEQ ID NO: 1388533 - DNA, 17 bp, Homo sapiens
gaacactagacaagcca

SEQ ID NO: 1388534 - DNA, 19 bp, Homo sapiens
gaacactagacaagccaga

SEQ ID NO: 1388535 - DNA, 15 bp, Homo sapiens
gaacagaatttatga

SEQ ID NO: 1388536 - DNA, 21 bp, Homo sapiens
gaacataatgaacagaattta

SEQ ID NO: 1388537 - DNA, 23 bp, Homo sapiens
gaacataatgaacagaatttatg

SEQ ID NO: 1388538 - DNA, 12 bp, Homo sapiens
gaaccgaggcag

SEQ ID NO: 1388539 - DNA, 18 bp, Homo sapiens
gaactaagttttttactt

SEQ ID NO: 1388540 - DNA, 12 bp, Homo sapiens
gaactgaacacc

SEQ ID NO: 1388541 - DNA, 21 bp, Homo sapiens
gaactgaacaccattgaaggc

SEQ ID NO: 1388542 - DNA, 23 bp, Homo sapiens
gaactgaacaccattgaaggctt

SEQ ID NO: 1388543 - DNA, 17 bp, Homo sapiens
gaactgtctctcatgaa

SEQ ID NO: 1388544 - DNA, 15 bp, Homo sapiens
gaacttgaccctgag

SEQ ID NO: 1388545 - DNA, 13 bp, Homo sapiens
gaagaaaaagaag

SEQ ID NO: 1388546 - DNA, 20 bp, Homo sapiens
gaagaaacaaggttttcagt

SEQ ID NO: 1388547 - DNA, 19 bp, Homo sapiens
gaagaagtttcatcatttt

SEQ ID NO: 1388548 - DNA, 12 bp, Homo sapiens
gaagaattccag

SEQ ID NO: 1388549 - DNA, 12 bp, Homo sapiens
gaagacacagac

SEQ ID NO: 1388550 - DNA, 21 bp, Homo sapiens
gaagacacagactgcgatttg

SEQ ID NO: 1388551 - DNA, 14 bp, Homo sapiens
gaagaccctccccg

SEQ ID NO: 1388552 - DNA, 23 bp, Homo sapiens
gaagactatcttactatttcaca

SEQ ID NO: 1388553 - DNA, 17 bp, Homo sapiens
gaagcaaatcgaatgaa

SEQ ID NO: 1388554 - DNA, 22 bp, Homo sapiens
gaagcaacctcagtaatttaga

SEQ ID NO: 1388555 - DNA, 13 bp, Homo sapiens
gaagcatttgttt

SEQ ID NO: 1388556 - DNA, 19 bp, Homo sapiens
gaagcatttgtttctactt

SEQ ID NO: 1388557 - DNA, 13 bp, Homo sapiens
gaagcgttgtcct

SEQ ID NO: 1388558 - DNA, 20 bp, Homo sapiens
gaagcgttgtcctcagcccc

SEQ ID NO: 1388559 - DNA, 20 bp, Homo sapiens
gaagctatttttttcagttt

SEQ ID NO: 1388560 - DNA, 21 bp, Homo sapiens
gaaggactatgaaaagctaga

SEQ ID NO: 1388561 - DNA, 19 bp, Homo sapiens
gaaggatcccatgagctcc

SEQ ID NO: 1388562 - DNA, 19 bp, Homo sapiens
gaaggcttgttgtgctttt

SEQ ID NO: 1388563 - DNA, 20 bp, Homo sapiens
gaaggcttgttgtgctttta

SEQ ID NO: 1388564 - DNA, 14 bp, Homo sapiens
gaagggactgagag

SEQ ID NO: 1388565 - DNA, 19 bp, Homo sapiens
gaagggcttgaattgaagc

SEQ ID NO: 1388566 - DNA, 19 bp, Homo sapiens
gaagttagctttaacttaa

SEQ ID NO: 1388567 - DNA, 12 bp, Homo sapiens
gaagttctgaaa

SEQ ID NO: 1388568 - DNA, 19 bp, Homo sapiens
gaagttgtgaaactaaaat

SEQ ID NO: 1388569 - DNA, 23 bp, Homo sapiens
gaataaggtacaagaagcatttt

SEQ ID NO: 1388570 - DNA, 23 bp, Homo sapiens
gaataagtgtacatatgtaaaat

SEQ ID NO: 1388571 - DNA, 20 bp, Homo sapiens
gaataatcacgctttcctga

SEQ ID NO: 1388572 - DNA, 20 bp, Homo sapiens
gaatataattgttttatctg

SEQ ID NO: 1388573 - DNA, 14 bp, Homo sapiens
gaatatatatggaa

SEQ ID NO: 1388574 - DNA, 19 bp, Homo sapiens
gaatatatatggaataagt

SEQ ID NO: 1388575 - DNA, 16 bp, Homo sapiens
gaatcaagggtcaggc

SEQ ID NO: 1388576 - DNA, 17 bp, Homo sapiens
gaatcaagggtcaggcc

SEQ ID NO: 1388577 - DNA, 14 bp, Homo sapiens
gaatcctgtcgatt

SEQ ID NO: 1388578 - DNA, 22 bp, Homo sapiens
gaatcctgtcgattagactgga

SEQ ID NO: 1388579 - DNA, 20 bp, Homo sapiens
gaatcttggtttgccttcca

SEQ ID NO: 1388580 - DNA, 19 bp, Homo sapiens
gaatctttaaaagatgctt

SEQ ID NO: 1388581 - DNA, 14 bp, Homo sapiens
gaatgaattaaata

SEQ ID NO: 1388582 - DNA, 15 bp, Homo sapiens
gaatggaaagcttca

SEQ ID NO: 1388583 - DNA, 17 bp, Homo sapiens
gaatggctatgttttta

SEQ ID NO: 1388584 - DNA, 20 bp, Homo sapiens
gaatgtaaagcttgtctgat

SEQ ID NO: 1388585 - DNA, 19 bp, Homo sapiens
gaatgtgataaggaaatca

SEQ ID NO: 1388586 - DNA, 14 bp, Homo sapiens
gaattatctaattt

SEQ ID NO: 1388587 - DNA, 17 bp, Homo sapiens
gaattcctacacatggt

SEQ ID NO: 1388588 - DNA, 20 bp, Homo sapiens
gaatttagccctggtttgaa

SEQ ID NO: 1388589 - DNA, 21 bp, Homo sapiens
gaatttagccctggtttgaaa

SEQ ID NO: 1388590 - DNA, 12 bp, Homo sapiens
gaatttcacctg

SEQ ID NO: 1388591 - DNA, 23 bp, Homo sapiens
gaattttctttgtgtagctttgc

SEQ ID NO: 1388592 - DNA, 18 bp, Homo sapiens
gaatttttaaacaagtat

SEQ ID NO: 1388593 - DNA, 22 bp, Homo sapiens
gaatttttttttcctagccctc

SEQ ID NO: 1388594 - DNA, 12 bp, Homo sapiens
gacaactggcag

SEQ ID NO: 1388595 - DNA, 15 bp, Homo sapiens
gacaactggcaggca

SEQ ID NO: 1388596 - DNA, 18 bp, Homo sapiens
gacaactggcaggcaggc

SEQ ID NO: 1388597 - DNA, 15 bp, Homo sapiens
gacacaaacacacac

SEQ ID NO: 1388598 - DNA, 22 bp, Homo sapiens
gacacactgtaaacccctgggt

SEQ ID NO: 1388599 - DNA, 12 bp, Homo sapiens
gacacctgggag

SEQ ID NO: 1388600 - DNA, 19 bp, Homo sapiens
gacaccttttttcaacagt

SEQ ID NO: 1388601 - DNA, 16 bp, Homo sapiens
gacactgccacacagg

SEQ ID NO: 1388602 - DNA, 20 bp, Homo sapiens
gacagaacccctacatgaaa

SEQ ID NO: 1388603 - DNA, 18 bp, Homo sapiens
gacagcctccccctgtcc

SEQ ID NO: 1388604 - DNA, 20 bp, Homo sapiens
gacagcctccccctgtcccc

SEQ ID NO: 1388605 - DNA, 21 bp, Homo sapiens
gacagcttgtggcaagtgaat

SEQ ID NO: 1388606 - DNA, 20 bp, Homo sapiens
gacaggatgtgtttgctttc

SEQ ID NO: 1388607 - DNA, 17 bp, Homo sapiens
gacagggtttcaccatg

SEQ ID NO: 1388608 - DNA, 13 bp, Homo sapiens
gacagtctggaaa

SEQ ID NO: 1388609 - DNA, 19 bp, Homo sapiens
gacagtgagacagtctgga

SEQ ID NO: 1388610 - DNA, 14 bp, Homo sapiens
gacagttcaagaaa

SEQ ID NO: 1388611 - DNA, 17 bp, Homo sapiens
gacataaagttgataaa

SEQ ID NO: 1388612 - DNA, 20 bp, Homo sapiens
gacataaagttgataaagat

SEQ ID NO: 1388613 - DNA, 22 bp, Homo sapiens
gacataaagttgataaagattt

SEQ ID NO: 1388614 - DNA, 14 bp, Homo sapiens
gacattaactcatt

SEQ ID NO: 1388615 - DNA, 22 bp, Homo sapiens
gaccagccgtgagcatgtttgg

SEQ ID NO: 1388616 - DNA, 18 bp, Homo sapiens
gaccaggagtgggtgggg

SEQ ID NO: 1388617 - DNA, 16 bp, Homo sapiens
gacccacctgaggctc

SEQ ID NO: 1388618 - DNA, 22 bp, Homo sapiens
gacccacctgaggctcagccct

SEQ ID NO: 1388619 - DNA, 13 bp, Homo sapiens
gaccccccttgcc

SEQ ID NO: 1388620 - DNA, 20 bp, Homo sapiens
gaccctcatctttcttccaa

SEQ ID NO: 1388621 - DNA, 15 bp, Homo sapiens
gaccctccccgcacc

SEQ ID NO: 1388622 - DNA, 16 bp, Homo sapiens
gaccctgagctgacca

SEQ ID NO: 1388623 - DNA, 20 bp, Homo sapiens
gaccctgagctgaccagccg

SEQ ID NO: 1388624 - DNA, 17 bp, Homo sapiens
gaccggcctgccaggag

SEQ ID NO: 1388625 - DNA, 19 bp, Homo sapiens
gacgcaagggcctgatggg

SEQ ID NO: 1388626 - DNA, 15 bp, Homo sapiens
gactaatcttattca

SEQ ID NO: 1388627 - DNA, 22 bp, Homo sapiens
gactaatcttattcattttctc

SEQ ID NO: 1388628 - DNA, 14 bp, Homo sapiens
gactacaggcgtga

SEQ ID NO: 1388629 - DNA, 20 bp, Homo sapiens
gactacttgggagcaccgcc

SEQ ID NO: 1388630 - DNA, 15 bp, Homo sapiens
gactatgaaaagcta

SEQ ID NO: 1388631 - DNA, 14 bp, Homo sapiens
gactcaagccccgg

SEQ ID NO: 1388632 - DNA, 22 bp, Homo sapiens
gactcagctctgacattctgat

SEQ ID NO: 1388633 - DNA, 23 bp, Homo sapiens
gactcagctctgacattctgatt

SEQ ID NO: 1388634 - DNA, 22 bp, Homo sapiens
gactcaggcccccacctggctc

SEQ ID NO: 1388635 - DNA, 19 bp, Homo sapiens
gactcaggtggccctactg

SEQ ID NO: 1388636 - DNA, 16 bp, Homo sapiens
gactccactgtggaaa

SEQ ID NO: 1388637 - DNA, 14 bp, Homo sapiens
gactctaagaaaga

SEQ ID NO: 1388638 - DNA, 15 bp, Homo sapiens
gactctaagaaagaa

SEQ ID NO: 1388639 - DNA, 16 bp, Homo sapiens
gactctaagaaagaac

SEQ ID NO: 1388640 - DNA, 23 bp, Homo sapiens
gactctgccccttctgtttccat

SEQ ID NO: 1388641 - DNA, 17 bp, Homo sapiens
gactcttctgagcacct

SEQ ID NO: 1388642 - DNA, 16 bp, Homo sapiens
gactctttatgcttgc

SEQ ID NO: 1388643 - DNA, 19 bp, Homo sapiens
gactgctgtggccaggagg

SEQ ID NO: 1388644 - DNA, 21 bp, Homo sapiens
gactggacagcttgtggcaag

SEQ ID NO: 1388645 - DNA, 18 bp, Homo sapiens
gactgtaaacacagacag

SEQ ID NO: 1388646 - DNA, 15 bp, Homo sapiens
gactgtcatagaaat

SEQ ID NO: 1388647 - DNA, 16 bp, Homo sapiens
gactgtgtgctcagga

SEQ ID NO: 1388648 - DNA, 17 bp, Homo sapiens
gactgtgtgctcaggag

SEQ ID NO: 1388649 - DNA, 13 bp, Homo sapiens
gactgtttggaaa

SEQ ID NO: 1388650 - DNA, 16 bp, Homo sapiens
gacttacatgattcat

SEQ ID NO: 1388651 - DNA, 21 bp, Homo sapiens
gacttcaagcatggctatttt

SEQ ID NO: 1388652 - DNA, 18 bp, Homo sapiens
gacttcaggttgttctgt

SEQ ID NO: 1388653 - DNA, 17 bp, Homo sapiens
gagaaaggattaagata

SEQ ID NO: 1388654 - DNA, 15 bp, Homo sapiens
gagaaatacaaaaat

SEQ ID NO: 1388655 - DNA, 21 bp, Homo sapiens
gagaatttgtgtggatattta

SEQ ID NO: 1388656 - DNA, 18 bp, Homo sapiens
gagacagttcaagaaagc

SEQ ID NO: 1388657 - DNA, 13 bp, Homo sapiens
gagacccacctga

SEQ ID NO: 1388658 - DNA, 20 bp, Homo sapiens
gagaccggcctgccaggagg

SEQ ID NO: 1388659 - DNA, 16 bp, Homo sapiens
gagactgtttggaaat

SEQ ID NO: 1388660 - DNA, 13 bp, Homo sapiens
gagagacgggccc

SEQ ID NO: 1388661 - DNA, 21 bp, Homo sapiens
gagagaggccattctttccca

SEQ ID NO: 1388662 - DNA, 22 bp, Homo sapiens
cttaatggctgataattttaaa

SEQ ID NO: 1388663 - DNA, 12 bp, Homo sapiens
cttacatgattc

SEQ ID NO: 1388664 - DNA, 15 bp, Homo sapiens
cttactcttcttgaa

SEQ ID NO: 1388665 - DNA, 15 bp, Homo sapiens
cttactgatatattt

SEQ ID NO: 1388666 - DNA, 15 bp, Homo sapiens
cttagatctggcatg

SEQ ID NO: 1388667 - DNA, 17 bp, Homo sapiens
cttagatgtgagagaaa

SEQ ID NO: 1388668 - DNA, 18 bp, Homo sapiens
cttatctacttccaaact

SEQ ID NO: 1388669 - DNA, 22 bp, Homo sapiens
cttatgacatcacttgtacaaa

SEQ ID NO: 1388670 - DNA, 16 bp, Homo sapiens
cttattcattttctct

SEQ ID NO: 1388671 - DNA, 17 bp, Homo sapiens
cttattcattttctcta

SEQ ID NO: 1388672 - DNA, 18 bp, Homo sapiens
cttattcattttctctaa

SEQ ID NO: 1388673 - DNA, 19 bp, Homo sapiens
cttattcattttctctaat

SEQ ID NO: 1388674 - DNA, 18 bp, Homo sapiens
cttattggaactctgctt

SEQ ID NO: 1388675 - DNA, 18 bp, Homo sapiens
cttattttcaagaaactg

SEQ ID NO: 1388676 - DNA, 19 bp, Homo sapiens
cttattttcaagaaactga

SEQ ID NO: 1388677 - DNA, 17 bp, Homo sapiens
cttatttttgacagtgt

SEQ ID NO: 1388678 - DNA, 16 bp, Homo sapiens
cttcaaagtttaataa

SEQ ID NO: 1388679 - DNA, 16 bp, Homo sapiens
cttcaaggaaaataag

SEQ ID NO: 1388680 - DNA, 17 bp, Homo sapiens
cttcaaggaaaataagt

SEQ ID NO: 1388681 - DNA, 13 bp, Homo sapiens
cttcagctctgaa

SEQ ID NO: 1388682 - DNA, 18 bp, Homo sapiens
cttcaggtccaggctgtg

SEQ ID NO: 1388683 - DNA, 17 bp, Homo sapiens
cttcagtgtatggaaat

SEQ ID NO: 1388684 - DNA, 13 bp, Homo sapiens
cttcatctggcaa

SEQ ID NO: 1388685 - DNA, 19 bp, Homo sapiens
cttccaataaagcagcctc

SEQ ID NO: 1388686 - DNA, 20 bp, Homo sapiens
cttccagtcttcctgacact

SEQ ID NO: 1388687 - DNA, 21 bp, Homo sapiens
cttccagtcttcctgacactt

SEQ ID NO: 1388688 - DNA, 19 bp, Homo sapiens
cttcctaaatattatgaga

SEQ ID NO: 1388689 - DNA, 22 bp, Homo sapiens
cttcctagttttctcctcccag

SEQ ID NO: 1388690 - DNA, 17 bp, Homo sapiens
cttcctgtttttcacat

SEQ ID NO: 1388691 - DNA, 18 bp, Homo sapiens
cttcctgtttttcacatt

SEQ ID NO: 1388692 - DNA, 23 bp, Homo sapiens
cttcctgtttttcacattttcct

SEQ ID NO: 1388693 - DNA, 13 bp, Homo sapiens
cttccttcatttc

SEQ ID NO: 1388694 - DNA, 15 bp, Homo sapiens
cttccttcatttcct

SEQ ID NO: 1388695 - DNA, 14 bp, Homo sapiens
cttccttcctctcc

SEQ ID NO: 1388696 - DNA, 19 bp, Homo sapiens
cttcgcgtatttcaggatt

SEQ ID NO: 1388697 - DNA, 16 bp, Homo sapiens
cttcgtttattttcaa

SEQ ID NO: 1388698 - DNA, 17 bp, Homo sapiens
cttctagttctgccagg

SEQ ID NO: 1388699 - DNA, 15 bp, Homo sapiens
cttctattttgtaaa

SEQ ID NO: 1388700 - DNA, 16 bp, Homo sapiens
cttctattttgtaaac

SEQ ID NO: 1388701 - DNA, 17 bp, Homo sapiens
cttctgaactcaaactg

SEQ ID NO: 1388702 - DNA, 22 bp, Homo sapiens
cttctgaactcaaactgaggaa

SEQ ID NO: 1388703 - DNA, 13 bp, Homo sapiens
cttctgacctccc

SEQ ID NO: 1388704 - DNA, 16 bp, Homo sapiens
cttctgagctatttca

SEQ ID NO: 1388705 - DNA, 20 bp, Homo sapiens
cttctgagctatttcatcta

SEQ ID NO: 1388706 - DNA, 16 bp, Homo sapiens
cttctgccttctcatg

SEQ ID NO: 1388707 - DNA, 17 bp, Homo sapiens
cttctggccaggaagct

SEQ ID NO: 1388708 - DNA, 21 bp, Homo sapiens
cttctgggcttcatctggcaa

SEQ ID NO: 1388709 - DNA, 22 bp, Homo sapiens
cttctgggcttcatctggcaac

SEQ ID NO: 1388710 - DNA, 21 bp, Homo sapiens
cttcttacaataattctatga

SEQ ID NO: 1388711 - DNA, 19 bp, Homo sapiens
cttcttttaaaccattttc

SEQ ID NO: 1388712 - DNA, 14 bp, Homo sapiens
cttcttttgctctt

SEQ ID NO: 1388713 - DNA, 13 bp, Homo sapiens
cttgaaattttaa

SEQ ID NO: 1388714 - DNA, 14 bp, Homo sapiens
cttgaaattttaac

SEQ ID NO: 1388715 - DNA, 16 bp, Homo sapiens
cttgaaattttaacct

SEQ ID NO: 1388716 - DNA, 20 bp, Homo sapiens
cttgacaactggcaggcagg

SEQ ID NO: 1388717 - DNA, 17 bp, Homo sapiens
cttgaggggaccaggag

SEQ ID NO: 1388718 - DNA, 19 bp, Homo sapiens
cttgaggggaccaggagtg

SEQ ID NO: 1388719 - DNA, 12 bp, Homo sapiens
cttgatagaaat

SEQ ID NO: 1388720 - DNA, 12 bp, Homo sapiens
cttgatgcctgg

SEQ ID NO: 1388721 - DNA, 18 bp, Homo sapiens
cttgatgggattctggac

SEQ ID NO: 1388722 - DNA, 20 bp, Homo sapiens
cttgattttagccttctctg

SEQ ID NO: 1388723 - DNA, 12 bp, Homo sapiens
cttgatttttgc

SEQ ID NO: 1388724 - DNA, 18 bp, Homo sapiens
cttgcctcaacctcccaa

SEQ ID NO: 1388725 - DNA, 15 bp, Homo sapiens
cttgcggctcctcag

SEQ ID NO: 1388726 - DNA, 17 bp, Homo sapiens
cttgctcttgatgcctg

SEQ ID NO: 1388727 - DNA, 13 bp, Homo sapiens
cttgctggaagac

SEQ ID NO: 1388728 - DNA, 17 bp, Homo sapiens
cttggagctgagcaaat

SEQ ID NO: 1388729 - DNA, 13 bp, Homo sapiens
cttggctgcagga

SEQ ID NO: 1388730 - DNA, 10 bp, Homo sapiens
cttgggaatg

SEQ ID NO: 1388731 - DNA, 14 bp, Homo sapiens
cttgggcagcatcc

SEQ ID NO: 1388732 - DNA, 21 bp, Homo sapiens
cttggggagtttagggtgggg

SEQ ID NO: 1388733 - DNA, 19 bp, Homo sapiens
cttggggattcttccatct

SEQ ID NO: 1388734 - DNA, 15 bp, Homo sapiens
cttggtttgccttcc

SEQ ID NO: 1388735 - DNA, 13 bp, Homo sapiens
cttgtcacgccag

SEQ ID NO: 1388736 - DNA, 14 bp, Homo sapiens
cttgtcatgtgaca

SEQ ID NO: 1388737 - DNA, 22 bp, Homo sapiens
cttgtgaatcaagggtcaggcc

SEQ ID NO: 1388738 - DNA, 18 bp, Homo sapiens
cttgtggaattgggagct

SEQ ID NO: 1388739 - DNA, 17 bp, Homo sapiens
cttgttgtgcttttagt

SEQ ID NO: 1388740 - DNA, 15 bp, Homo sapiens
ctttaaaagatgaaa

SEQ ID NO: 1388741 - DNA, 18 bp, Homo sapiens
ctttaaaagatgctttta

SEQ ID NO: 1388742 - DNA, 17 bp, Homo sapiens
ctttaaagacttaagat

SEQ ID NO: 1388743 - DNA, 23 bp, Homo sapiens
ctttaaagtgactaatggcatga

SEQ ID NO: 1388744 - DNA, 15 bp, Homo sapiens
ctttaacttaaatag

SEQ ID NO: 1388745 - DNA, 18 bp, Homo sapiens
ctttaattaccaacctgt

SEQ ID NO: 1388746 - DNA, 18 bp, Homo sapiens
ctttactttagaatttag

SEQ ID NO: 1388747 - DNA, 12 bp, Homo sapiens
ctttagaattta

SEQ ID NO: 1388748 - DNA, 16 bp, Homo sapiens
ctttagcttctctgcc

SEQ ID NO: 1388749 - DNA, 15 bp, Homo sapiens
ctttaggcattaaat

SEQ ID NO: 1388750 - DNA, 13 bp, Homo sapiens
ctttatatgaaga

SEQ ID NO: 1388751 - DNA, 22 bp, Homo sapiens
ctttatatgaagaaaatcactt

SEQ ID NO: 1388752 - DNA, 13 bp, Homo sapiens
ctttatgcttgca

SEQ ID NO: 1388753 - DNA, 16 bp, Homo sapiens
ctttattggctgagat

SEQ ID NO: 1388754 - DNA, 18 bp, Homo sapiens
ctttattggctgagatat

SEQ ID NO: 1388755 - DNA, 13 bp, Homo sapiens
ctttattttgaga

SEQ ID NO: 1388756 - DNA, 16 bp, Homo sapiens
ctttctagcctggcta

SEQ ID NO: 1388757 - DNA, 16 bp, Homo sapiens
ctttctagttgaaaat

SEQ ID NO: 1388758 - DNA, 19 bp, Homo sapiens
ctttctattaatatttatg

SEQ ID NO: 1388759 - DNA, 20 bp, Homo sapiens
ctttctcagttttcataagt

SEQ ID NO: 1388760 - DNA, 17 bp, Homo sapiens
ctttctgatcaaggcct

SEQ ID NO: 1388761 - DNA, 14 bp, Homo sapiens
ctttgactttttgc

SEQ ID NO: 1388762 - DNA, 22 bp, Homo sapiens
ctttgagctactgccgtcagtg

SEQ ID NO: 1388763 - DNA, 15 bp, Homo sapiens
ctttgataaagtaaa

SEQ ID NO: 1388764 - DNA, 16 bp, Homo sapiens
ctttggacctaatcca

SEQ ID NO: 1388765 - DNA, 14 bp, Homo sapiens
ctttggttcagcta

SEQ ID NO: 1388766 - DNA, 16 bp, Homo sapiens
ctttgtgtagctttgc

SEQ ID NO: 1388767 - DNA, 17 bp, Homo sapiens
ctttgtgtagctttgct

SEQ ID NO: 1388768 - DNA, 18 bp, Homo sapiens
ctttgtgtagctttgctc

SEQ ID NO: 1388769 - DNA, 23 bp, Homo sapiens
cttttacaagtaacaaaaataaa

SEQ ID NO: 1388770 - DNA, 13 bp, Homo sapiens
cttttgtttcagg

SEQ ID NO: 1388771 - DNA, 16 bp, Homo sapiens
gaaaaatatgtaccaa

SEQ ID NO: 1388772 - DNA, 12 bp, Homo sapiens
gaaaaatgtagg

SEQ ID NO: 1388773 - DNA, 12 bp, Homo sapiens
gaaaagaaaaag

SEQ ID NO: 1388774 - DNA, 15 bp, Homo sapiens
gaaaataaagaatgg

SEQ ID NO: 1388775 - DNA, 16 bp, Homo sapiens
gaaaataaagaatgga

SEQ ID NO: 1388776 - DNA, 13 bp, Homo sapiens
gaaaataagtgaa

SEQ ID NO: 1388777 - DNA, 18 bp, Homo sapiens
gaaaatgctatcaaataa

SEQ ID NO: 1388778 - DNA, 23 bp, Homo sapiens
gaaacaaagagttcaagaaataa

SEQ ID NO: 1388779 - DNA, 22 bp, Homo sapiens
gaaacagaaaaatatgtaccaa

SEQ ID NO: 1388780 - DNA, 22 bp, Homo sapiens
gaaacagaaacaaaaacactaa

SEQ ID NO: 1388781 - DNA, 20 bp, Homo sapiens
gaaaccttgaagttctgaaa

SEQ ID NO: 1388782 - DNA, 23 bp, Homo sapiens
gaaaccttgaagttctgaaattt

SEQ ID NO: 1388783 - DNA, 17 bp, Homo sapiens
gaaacttttttatttaa

SEQ ID NO: 1388784 - DNA, 13 bp, Homo sapiens
gaaagagaaacac

SEQ ID NO: 1388785 - DNA, 14 bp, Homo sapiens
gaaagccttctttt

SEQ ID NO: 1388786 - DNA, 16 bp, Homo sapiens
gaaagcttcagtgctg

SEQ ID NO: 1388787 - DNA, 18 bp, Homo sapiens
gaaagcttcagtgctgcc

SEQ ID NO: 1388788 - DNA, 14 bp, Homo sapiens
gaaaggattaagat

SEQ ID NO: 1388789 - DNA, 16 bp, Homo sapiens
gaaaggtggtgtttct

SEQ ID NO: 1388790 - DNA, 22 bp, Homo sapiens
gaaaggtggtgtttctgtaaga

SEQ ID NO: 1388791 - DNA, 14 bp, Homo sapiens
gaaatacaaaaata

SEQ ID NO: 1388792 - DNA, 23 bp, Homo sapiens
gaaatatacttttacaagtaaca

SEQ ID NO: 1388793 - DNA, 15 bp, Homo sapiens
gaaatatcctgcttg

SEQ ID NO: 1388794 - DNA, 22 bp, Homo sapiens
gaaatctggcttctggccagga

SEQ ID NO: 1388795 - DNA, 13 bp, Homo sapiens
gaaatttaaacta

SEQ ID NO: 1388796 - DNA, 23 bp, Homo sapiens
gaaatttaaactataagcaagaa

SEQ ID NO: 1388797 - DNA, 23 bp, Homo sapiens
ctgatggggtggaaggcatggcg

SEQ ID NO: 1388798 - DNA, 21 bp, Homo sapiens
ctgattcacatctcatttttc

SEQ ID NO: 1388799 - DNA, 18 bp, Homo sapiens
ctgattttcaaagctttt

SEQ ID NO: 1388800 - DNA, 15 bp, Homo sapiens
ctgattttttttcct

SEQ ID NO: 1388801 - DNA, 19 bp, Homo sapiens
ctgattttttttcctttta

SEQ ID NO: 1388802 - DNA, 13 bp, Homo sapiens
ctgcaacctccac

SEQ ID NO: 1388803 - DNA, 14 bp, Homo sapiens
ctgcaccggggcct

SEQ ID NO: 1388804 - DNA, 18 bp, Homo sapiens
ctgcaccggggcctgggc

SEQ ID NO: 1388805 - DNA, 19 bp, Homo sapiens
ctgcaccggggcctgggca

SEQ ID NO: 1388806 - DNA, 15 bp, Homo sapiens
ctgcagactcactgt

SEQ ID NO: 1388807 - DNA, 20 bp, Homo sapiens
ctgcaggatctcaccaggca

SEQ ID NO: 1388808 - DNA, 21 bp, Homo sapiens
ctgcaggatctcaccaggcag

SEQ ID NO: 1388809 - DNA, 17 bp, Homo sapiens
ctgcagggggtgtgtct

SEQ ID NO: 1388810 - DNA, 15 bp, Homo sapiens
ctgcaggtccctaat

SEQ ID NO: 1388811 - DNA, 20 bp, Homo sapiens
ctgcaggtccctaataaagc

SEQ ID NO: 1388812 - DNA, 20 bp, Homo sapiens
ctgcatactttttaaatgta

SEQ ID NO: 1388813 - DNA, 21 bp, Homo sapiens
ctgcatccattctcctgagga

SEQ ID NO: 1388814 - DNA, 21 bp, Homo sapiens
ctgccaagactgctgtggcca

SEQ ID NO: 1388815 - DNA, 12 bp, Homo sapiens
ctgccacacagg

SEQ ID NO: 1388816 - DNA, 19 bp, Homo sapiens
ctgccaggaggacccaggg

SEQ ID NO: 1388817 - DNA, 17 bp, Homo sapiens
ctgccattcacttcata

SEQ ID NO: 1388818 - DNA, 16 bp, Homo sapiens
ctgcccaggcactgca

SEQ ID NO: 1388819 - DNA, 13 bp, Homo sapiens
ctgccctgtaccc

SEQ ID NO: 1388820 - DNA, 21 bp, Homo sapiens
ctgccctgtaccccagcactt

SEQ ID NO: 1388821 - DNA, 16 bp, Homo sapiens
ctgccggctccttggt

SEQ ID NO: 1388822 - DNA, 23 bp, Homo sapiens
ctgccggttcttaaatccatcct

SEQ ID NO: 1388823 - DNA, 20 bp, Homo sapiens
ctgccgtcagtgctgtgctg

SEQ ID NO: 1388824 - DNA, 21 bp, Homo sapiens
ctgcctaaaatgttctcctta

SEQ ID NO: 1388825 - DNA, 17 bp, Homo sapiens
ctgcctcccatgcctgg

SEQ ID NO: 1388826 - DNA, 23 bp, Homo sapiens
ctgcctcctgccggctccttggt

SEQ ID NO: 1388827 - DNA, 22 bp, Homo sapiens
ctgcctctcatcaactgaatga

SEQ ID NO: 1388828 - DNA, 21 bp, Homo sapiens
ctgcctctcgctcctcaaccc

SEQ ID NO: 1388829 - DNA, 13 bp, Homo sapiens
ctgcctctctgca

SEQ ID NO: 1388830 - DNA, 16 bp, Homo sapiens
ctgcctctctgcaggt

SEQ ID NO: 1388831 - DNA, 20 bp, Homo sapiens
ctgcctctctgcaggtccct

SEQ ID NO: 1388832 - DNA, 21 bp, Homo sapiens
ctgcctctctgcaggtcccta

SEQ ID NO: 1388833 - DNA, 20 bp, Homo sapiens
ctgcctggtatatccaaaag

SEQ ID NO: 1388834 - DNA, 21 bp, Homo sapiens
ctgctatggttttctccaaga

SEQ ID NO: 1388835 - DNA, 13 bp, Homo sapiens
ctgctcagacaga

SEQ ID NO: 1388836 - DNA, 19 bp, Homo sapiens
ctgctgagatacatacaga

SEQ ID NO: 1388837 - DNA, 18 bp, Homo sapiens
ctgctgatattttctcta

SEQ ID NO: 1388838 - DNA, 15 bp, Homo sapiens
ctgctgtggccagga

SEQ ID NO: 1388839 - DNA, 18 bp, Homo sapiens
ctgctgtggccaggaggt

SEQ ID NO: 1388840 - DNA, 17 bp, Homo sapiens
ctgcttggagctgagca

SEQ ID NO: 1388841 - DNA, 23 bp, Homo sapiens
ctggaacactagacaagccagaa

SEQ ID NO: 1388842 - DNA, 19 bp, Homo sapiens
ctggaactgtctctcatga

SEQ ID NO: 1388843 - DNA, 16 bp, Homo sapiens
ctggaagccagctttc

SEQ ID NO: 1388844 - DNA, 15 bp, Homo sapiens
ctggaatacatgaaa

SEQ ID NO: 1388845 - DNA, 14 bp, Homo sapiens
ctggaccactgggc

SEQ ID NO: 1388846 - DNA, 18 bp, Homo sapiens
ctggactgtcatagaaat

SEQ ID NO: 1388847 - DNA, 22 bp, Homo sapiens
ctggactgtgtgctcaggagcc

SEQ ID NO: 1388848 - DNA, 16 bp, Homo sapiens
ctggagcccactgtac

SEQ ID NO: 1388849 - DNA, 17 bp, Homo sapiens
ctggagcccactgtact

SEQ ID NO: 1388850 - DNA, 15 bp, Homo sapiens
ctggaggatgaccag

SEQ ID NO: 1388851 - DNA, 17 bp, Homo sapiens
ctggcaacatctttatc

SEQ ID NO: 1388852 - DNA, 15 bp, Homo sapiens
ctggcacagcctggc

SEQ ID NO: 1388853 - DNA, 18 bp, Homo sapiens
ctggcaggcaggctccca

SEQ ID NO: 1388854 - DNA, 20 bp, Homo sapiens
ctggcagtttatatttaact

SEQ ID NO: 1388855 - DNA, 22 bp, Homo sapiens
ctggcagtttatatttaactct

SEQ ID NO: 1388856 - DNA, 16 bp, Homo sapiens
ctggccccctccctgg

SEQ ID NO: 1388857 - DNA, 20 bp, Homo sapiens
ctggctccgtccaggagcct

SEQ ID NO: 1388858 - DNA, 12 bp, Homo sapiens
ctggcttctggc

SEQ ID NO: 1388859 - DNA, 17 bp, Homo sapiens
ctggcttctggccagga

SEQ ID NO: 1388860 - DNA, 21 bp, Homo sapiens
ctgggagaaatctggcttctg

SEQ ID NO: 1388861 - DNA, 17 bp, Homo sapiens
ctgggaggctctggagc

SEQ ID NO: 1388862 - DNA, 15 bp, Homo sapiens
ctgggagtgttctgt

SEQ ID NO: 1388863 - DNA, 18 bp, Homo sapiens
ctgggagtgttctgtttc

SEQ ID NO: 1388864 - DNA, 13 bp, Homo sapiens
ctgggcagacctt

SEQ ID NO: 1388865 - DNA, 19 bp, Homo sapiens
ctgggccaactcacctgag

SEQ ID NO: 1388866 - DNA, 23 bp, Homo sapiens
ctgggcccctgcctctctgcagg

SEQ ID NO: 1388867 - DNA, 17 bp, Homo sapiens
ctgggccttgggctccg

SEQ ID NO: 1388868 - DNA, 19 bp, Homo sapiens
ctgggcttcatctggcaac

SEQ ID NO: 1388869 - DNA, 13 bp, Homo sapiens
ctagccctctcac

SEQ ID NO: 1388870 - DNA, 16 bp, Homo sapiens
ctaggaatgaaatcct

SEQ ID NO: 1388871 - DNA, 14 bp, Homo sapiens
ctagggagccatgt

SEQ ID NO: 1388872 - DNA, 23 bp, Homo sapiens
ctagtattccagacctgaagaat

SEQ ID NO: 1388873 - DNA, 13 bp, Homo sapiens
ctagtcataacct

SEQ ID NO: 1388874 - DNA, 12 bp, Homo sapiens
ctagtccttgtt

SEQ ID NO: 1388875 - DNA, 14 bp, Homo sapiens
ctagttctgccagg

SEQ ID NO: 1388876 - DNA, 16 bp, Homo sapiens
ctagttctgccaggag

SEQ ID NO: 1388877 - DNA, 19 bp, Homo sapiens
ctagttttctcctcccagg

SEQ ID NO: 1388878 - DNA, 20 bp, Homo sapiens
ctagttttctcctcccagga

SEQ ID NO: 1388879 - DNA, 16 bp, Homo sapiens
ctataaccagacacat

SEQ ID NO: 1388880 - DNA, 12 bp, Homo sapiens
ctatactgcttg

SEQ ID NO: 1388881 - DNA, 23 bp, Homo sapiens
ctatactgcttggagctgagcaa

SEQ ID NO: 1388882 - DNA, 13 bp, Homo sapiens
ctatagccaaaaa

SEQ ID NO: 1388883 - DNA, 14 bp, Homo sapiens
ctatagccaaaaat

SEQ ID NO: 1388884 - DNA, 20 bp, Homo sapiens
ctatcaaccccagacactgg

SEQ ID NO: 1388885 - DNA, 19 bp, Homo sapiens
ctatccaattaaaattaag

SEQ ID NO: 1388886 - DNA, 15 bp, Homo sapiens
ctatctccctgcctc

SEQ ID NO: 1388887 - DNA, 18 bp, Homo sapiens
ctatctccctgcctcctg

SEQ ID NO: 1388888 - DNA, 23 bp, Homo sapiens
ctatgatattttctgtgcctgaa

SEQ ID NO: 1388889 - DNA, 19 bp, Homo sapiens
ctatgctttgaaacagaaa

SEQ ID NO: 1388890 - DNA, 17 bp, Homo sapiens
ctatggtgctctgtcta

SEQ ID NO: 1388891 - DNA, 23 bp, Homo sapiens
ctatggtgctctgtctacttgct

SEQ ID NO: 1388892 - DNA, 16 bp, Homo sapiens
ctatgtcctaataata

SEQ ID NO: 1388893 - DNA, 20 bp, Homo sapiens
ctattattttcactgtagaa

SEQ ID NO: 1388894 - DNA, 17 bp, Homo sapiens
ctattggagagaaaaaa

SEQ ID NO: 1388895 - DNA, 22 bp, Homo sapiens
ctattgtgcaatgtaaatattt

SEQ ID NO: 1388896 - DNA, 12 bp, Homo sapiens
ctattttcagat

SEQ ID NO: 1388897 - DNA, 18 bp, Homo sapiens
ctatttttggcagtctga

SEQ ID NO: 1388898 - DNA, 21 bp, Homo sapiens
ctatttttggcagtctgaatt

SEQ ID NO: 1388899 - DNA, 18 bp, Homo sapiens
ctcaaaatatttgtacat

SEQ ID NO: 1388900 - DNA, 19 bp, Homo sapiens
ctcaaactgaggaatttca

SEQ ID NO: 1388901 - DNA, 18 bp, Homo sapiens
ctcaaagagggagtgcat

SEQ ID NO: 1388902 - DNA, 19 bp, Homo sapiens
ctcaacagatctgtgggcc

SEQ ID NO: 1388903 - DNA, 21 bp, Homo sapiens
ctcaacccctcccctccatcc

SEQ ID NO: 1388904 - DNA, 13 bp, Homo sapiens
ctcaactgcctac

SEQ ID NO: 1388905 - DNA, 12 bp, Homo sapiens
ctcacatttatg

SEQ ID NO: 1388906 - DNA, 19 bp, Homo sapiens
ctcaccaggcagcctctgg

SEQ ID NO: 1388907 - DNA, 18 bp, Homo sapiens
ctcacccccagctttgct

SEQ ID NO: 1388908 - DNA, 21 bp, Homo sapiens
ctcaccttgtgctggggacag

SEQ ID NO: 1388909 - DNA, 15 bp, Homo sapiens
ctcactaattcatta

SEQ ID NO: 1388910 - DNA, 14 bp, Homo sapiens
ctcactatctctag

SEQ ID NO: 1388911 - DNA, 21 bp, Homo sapiens
ctcacttttaatgaacaaatg

SEQ ID NO: 1388912 - DNA, 16 bp, Homo sapiens
ctcagaagtttcttct

SEQ ID NO: 1388913 - DNA, 19 bp, Homo sapiens
ctcagactctaagaaagaa

SEQ ID NO: 1388914 - DNA, 23 bp, Homo sapiens
ctcagagaatttctaccatttca

SEQ ID NO: 1388915 - DNA, 16 bp, Homo sapiens
ctcagagggtgtcctg

SEQ ID NO: 1388916 - DNA, 22 bp, Homo sapiens
cagaattactgtaactgattac

SEQ ID NO: 1388917 - DNA, 22 bp, Homo sapiens
cagacactggtttgaagaatgt

SEQ ID NO: 1388918 - DNA, 19 bp, Homo sapiens
cagactctttatgcttgca

SEQ ID NO: 1388919 - DNA, 19 bp, Homo sapiens
cagactttctacacctgtt

SEQ ID NO: 1388920 - DNA, 21 bp, Homo sapiens
cagactttctacacctgttgc

SEQ ID NO: 1388921 - DNA, 21 bp, Homo sapiens
cagactttctattaatattta

SEQ ID NO: 1388922 - DNA, 18 bp, Homo sapiens
cagagaaaaagggagggg

SEQ ID NO: 1388923 - DNA, 13 bp, Homo sapiens
cagagaatttcta

SEQ ID NO: 1388924 - DNA, 16 bp, Homo sapiens
cagagaatttctacca

SEQ ID NO: 1388925 - DNA, 16 bp, Homo sapiens
cagagcactgtatacc

SEQ ID NO: 1388926 - DNA, 20 bp, Homo sapiens
cagagccaaggggcttcagg

SEQ ID NO: 1388927 - DNA, 22 bp, Homo sapiens
cagaggatgttctggacctccc

SEQ ID NO: 1388928 - DNA, 20 bp, Homo sapiens
cagaggctattattttcact

SEQ ID NO: 1388929 - DNA, 17 bp, Homo sapiens
cagagggtgtcctgcac

SEQ ID NO: 1388930 - DNA, 22 bp, Homo sapiens
cagataactgaaaattatttaa

SEQ ID NO: 1388931 - DNA, 14 bp, Homo sapiens
cagataagttattt

SEQ ID NO: 1388932 - DNA, 13 bp, Homo sapiens
cagatcctcctca

SEQ ID NO: 1388933 - DNA, 14 bp, Homo sapiens
cagatcctcctcat

SEQ ID NO: 1388934 - DNA, 16 bp, Homo sapiens
cagatggcatgtgttt

SEQ ID NO: 1388935 - DNA, 18 bp, Homo sapiens
cagattcccagagcaaaa

SEQ ID NO: 1388936 - DNA, 19 bp, Homo sapiens
cagattcccagagcaaaat

SEQ ID NO: 1388937 - DNA, 13 bp, Homo sapiens
cagattgtttgca

SEQ ID NO: 1388938 - DNA, 16 bp, Homo sapiens
cagatttttacacatg

SEQ ID NO: 1388939 - DNA, 16 bp, Homo sapiens
cagcaaaccaggactc

SEQ ID NO: 1388940 - DNA, 20 bp, Homo sapiens
cagcaaactcttttcccact

SEQ ID NO: 1388941 - DNA, 16 bp, Homo sapiens
cagcaaccagagcact

SEQ ID NO: 1388942 - DNA, 14 bp, Homo sapiens
cagcaccagaatgt

SEQ ID NO: 1388943 - DNA, 21 bp, Homo sapiens
cagcagactcagctctgacat

SEQ ID NO: 1388944 - DNA, 23 bp, Homo sapiens
cagcagactcagctctgacattc

SEQ ID NO: 1388945 - DNA, 19 bp, Homo sapiens
cagcatccccttgaactct

SEQ ID NO: 1388946 - DNA, 15 bp, Homo sapiens
cagcattttcttaga

SEQ ID NO: 1388947 - DNA, 21 bp, Homo sapiens
cagccatcaagagactgagtc

SEQ ID NO: 1388948 - DNA, 14 bp, Homo sapiens
cagccctaaacatc

SEQ ID NO: 1388949 - DNA, 21 bp, Homo sapiens
cagcctcattctgaggcctga

SEQ ID NO: 1388950 - DNA, 23 bp, Homo sapiens
cagcctctccactcatgtgactc

SEQ ID NO: 1388951 - DNA, 24 bp, Homo sapiens
cagcctctccactcatgtgactct

SEQ ID NO: 1388952 - DNA, 13 bp, Homo sapiens
cagcctctggggg

SEQ ID NO: 1388953 - DNA, 15 bp, Homo sapiens
cagctctactggtct

SEQ ID NO: 1388954 - DNA, 16 bp, Homo sapiens
cagctggagaagaccc

SEQ ID NO: 1388955 - DNA, 19 bp, Homo sapiens
cagctggggccaggctggg

SEQ ID NO: 1388956 - DNA, 18 bp, Homo sapiens
cagctgtcatcaattaaa

SEQ ID NO: 1388957 - DNA, 17 bp, Homo sapiens
caggaaaattgaatgca

SEQ ID NO: 1388958 - DNA, 15 bp, Homo sapiens
caggaaccgaggcag

SEQ ID NO: 1388959 - DNA, 23 bp, Homo sapiens
caggaagctttggtgagaacctg

SEQ ID NO: 1388960 - DNA, 16 bp, Homo sapiens
caggaaggactatgaa

SEQ ID NO: 1388961 - DNA, 19 bp, Homo sapiens
caggaaggactatgaaaag

SEQ ID NO: 1388962 - DNA, 21 bp, Homo sapiens
caggactctgccccttctgtt

SEQ ID NO: 1388963 - DNA, 16 bp, Homo sapiens
caggagacccacctga

SEQ ID NO: 1388964 - DNA, 19 bp, Homo sapiens
caggagacccacctgaggc

SEQ ID NO: 1388965 - DNA, 11 bp, Homo sapiens
caggagccctg

SEQ ID NO: 1388966 - DNA, 11 bp, Homo sapiens
caggagcctgg

SEQ ID NO: 1388967 - DNA, 15 bp, Homo sapiens
caggagcctgtgcct

SEQ ID NO: 1388968 - DNA, 17 bp, Homo sapiens
caggagctttggaccta

SEQ ID NO: 1388969 - DNA, 16 bp, Homo sapiens
caggaggacccagggc

SEQ ID NO: 1388970 - DNA, 18 bp, Homo sapiens
caggaggacccagggctc

SEQ ID NO: 1388971 - DNA, 14 bp, Homo sapiens
caggaggccaataa

SEQ ID NO: 1388972 - DNA, 20 bp, Homo sapiens
caggaggtgccactggagtg

SEQ ID NO: 1388973 - DNA, 14 bp, Homo sapiens
caggagtgggtggg

SEQ ID NO: 1388974 - DNA, 17 bp, Homo sapiens
caggagtgggtggggag

SEQ ID NO: 1388975 - DNA, 14 bp, Homo sapiens
caggatagagactg

SEQ ID NO: 1388976 - DNA, 16 bp, Homo sapiens
caggatagagactgga

SEQ ID NO: 1388977 - DNA, 22 bp, Homo sapiens
caggatgagggaaaagaaaaag

SEQ ID NO: 1388978 - DNA, 23 bp, Homo sapiens
caggatggggtatggattctaaa

SEQ ID NO: 1388979 - DNA, 14 bp, Homo sapiens
caggattctccttt

SEQ ID NO: 1388980 - DNA, 18 bp, Homo sapiens
caggcaaaatccttgctt

SEQ ID NO: 1388981 - DNA, 14 bp, Homo sapiens
caggcactgcaaac

SEQ ID NO: 1388982 - DNA, 14 bp, Homo sapiens
caggcagaggatgt

SEQ ID NO: 1388983 - DNA, 19 bp, Homo sapiens
caggcagcctctggggggt

SEQ ID NO: 1388984 - DNA, 20 bp, Homo sapiens
caggcaggtctgaagctcaa

SEQ ID NO: 1388985 - DNA, 17 bp, Homo sapiens
caggcccccacctggct

SEQ ID NO: 1388986 - DNA, 19 bp, Homo sapiens
caggcccccacctggctca

SEQ ID NO: 1388987 - DNA, 13 bp, Homo sapiens
caggccgggaaaa

SEQ ID NO: 1388988 - DNA, 18 bp, Homo sapiens
caggccgtgacgtctggg

SEQ ID NO: 1388989 - DNA, 18 bp, Homo sapiens
caggcgtgagccacctcg

SEQ ID NO: 1388990 - DNA, 22 bp, Homo sapiens
caggctcccagggacacctggg

SEQ ID NO: 1388991 - DNA, 23 bp, Homo sapiens
caggctcccagggacacctggga

SEQ ID NO: 1388992 - DNA, 17 bp, Homo sapiens
caggctgatttctaggt

SEQ ID NO: 1388993 - DNA, 23 bp, Homo sapiens
caggctgggtcgccctggactgt

SEQ ID NO: 1388994 - DNA, 22 bp, Homo sapiens
cagggggcctttaaagacttaa

SEQ ID NO: 1388995 - DNA, 22 bp, Homo sapiens
cagggtaccctttggggagcag

SEQ ID NO: 1388996 - DNA, 21 bp, Homo sapiens
cagggtcaaagtgttttctct

SEQ ID NO: 1388997 - DNA, 22 bp, Homo sapiens
caggtagaattatctaatttat

SEQ ID NO: 1388998 - DNA, 14 bp, Homo sapiens
caggtaggaggcaa

SEQ ID NO: 1388999 - DNA, 14 bp, Homo sapiens
caggtatacctcac

SEQ ID NO: 1389000 - DNA, 12 bp, Homo sapiens
caggtccctaat

SEQ ID NO: 1389001 - DNA, 19 bp, Homo sapiens
caggtccctaataaagctg

SEQ ID NO: 1389002 - DNA, 20 bp, Homo sapiens
caggtcctcagagaatttct

SEQ ID NO: 1389003 - DNA, 20 bp, Homo sapiens
caggtcctcagtgtcctcag

SEQ ID NO: 1389004 - DNA, 23 bp, Homo sapiens
cagtagcacaagttatttaaatc

SEQ ID NO: 1389005 - DNA, 22 bp, Homo sapiens
cagtaggttatttagcttggga

SEQ ID NO: 1389006 - DNA, 16 bp, Homo sapiens
cagtatccactttgca

SEQ ID NO: 1389007 - DNA, 17 bp, Homo sapiens
cagtctgagagaggcca

SEQ ID NO: 1389008 - DNA, 18 bp, Homo sapiens
cagtctgagagaggccat

SEQ ID NO: 1389009 - DNA, 16 bp, Homo sapiens
cagtcttcctgacact

SEQ ID NO: 1389010 - DNA, 17 bp, Homo sapiens
cagtgaaaaactattaa

SEQ ID NO: 1389011 - DNA, 16 bp, Homo sapiens
cagtgaagacagaagt

SEQ ID NO: 1389012 - DNA, 12 bp, Homo sapiens
cagtgacagcta

SEQ ID NO: 1389013 - DNA, 17 bp, Homo sapiens
cagtgagacagtctgga

SEQ ID NO: 1389014 - DNA, 16 bp, Homo sapiens
cagtgattgtcttaat

SEQ ID NO: 1389015 - DNA, 20 bp, Homo sapiens
cagtgattgtcttaatattg

SEQ ID NO: 1389016 - DNA, 17 bp, Homo sapiens
cagtgccctcattttat

SEQ ID NO: 1389017 - DNA, 12 bp, Homo sapiens
cagtgctgtgct

SEQ ID NO: 1389018 - DNA, 18 bp, Homo sapiens
cagtgggaaaaatgtagg

SEQ ID NO: 1389019 - DNA, 22 bp, Homo sapiens
cagtgggagggtaccagcagaa

SEQ ID NO: 1389020 - DNA, 16 bp, Homo sapiens
ccagactacttgggag

SEQ ID NO: 1389021 - DNA, 16 bp, Homo sapiens
ccagagtccctgcctg

SEQ ID NO: 1389022 - DNA, 13 bp, Homo sapiens
ccagataagttat

SEQ ID NO: 1389023 - DNA, 16 bp, Homo sapiens
ccagataagttattta

SEQ ID NO: 1389024 - DNA, 21 bp, Homo sapiens
ccagcatttcccttccttcct

SEQ ID NO: 1389025 - DNA, 23 bp, Homo sapiens
ccagctggggccaggctgggtcg

SEQ ID NO: 1389026 - DNA, 12 bp, Homo sapiens
ccagctttccct

SEQ ID NO: 1389027 - DNA, 14 bp, Homo sapiens
ccagctttccctgc

SEQ ID NO: 1389028 - DNA, 20 bp, Homo sapiens
ccagctttgctaccaaagca

SEQ ID NO: 1389029 - DNA, 11 bp, Homo sapiens
ccaggacccca

SEQ ID NO: 1389030 - DNA, 18 bp, Homo sapiens
ccaggaggtgccactgga

SEQ ID NO: 1389031 - DNA, 21 bp, Homo sapiens
ccaggaggtgccactggagtg

SEQ ID NO: 1389032 - DNA, 13 bp, Homo sapiens
ccaggcactgcaa

SEQ ID NO: 1389033 - DNA, 12 bp, Homo sapiens
ccaggcagcctc

SEQ ID NO: 1389034 - DNA, 24 bp, Homo sapiens
ccaggctaatttttttgtatttta

SEQ ID NO: 1389035 - DNA, 23 bp, Homo sapiens
ccaggctgggtcgccctggactg

SEQ ID NO: 1389036 - DNA, 23 bp, Homo sapiens
ccaggctgtgtttggctttcagg

SEQ ID NO: 1389037 - DNA, 23 bp, Homo sapiens
ccaggtgaacaaagtttaccaga

SEQ ID NO: 1389038 - DNA, 22 bp, Homo sapiens
ccagtcccagaaccacactgtt

SEQ ID NO: 1389039 - DNA, 16 bp, Homo sapiens
ccagttatttttatta

SEQ ID NO: 1389040 - DNA, 15 bp, Homo sapiens
ccataggtagaatgt

SEQ ID NO: 1389041 - DNA, 13 bp, Homo sapiens
ccatcagcctcca

SEQ ID NO: 1389042 - DNA, 13 bp, Homo sapiens
ccatccctggccc

SEQ ID NO: 1389043 - DNA, 16 bp, Homo sapiens
ccatccctggccccct

SEQ ID NO: 1389044 - DNA, 18 bp, Homo sapiens
ccatcctaccccctgtgc

SEQ ID NO: 1389045 - DNA, 21 bp, Homo sapiens
ccatgcacacaaacacctcct

SEQ ID NO: 1389046 - DNA, 14 bp, Homo sapiens
ccatgcctccagct

SEQ ID NO: 1389047 - DNA, 23 bp, Homo sapiens
ccatgcctggtcccaagacagtg

SEQ ID NO: 1389048 - DNA, 20 bp, Homo sapiens
ccatgcgtgtttctgactct

SEQ ID NO: 1389049 - DNA, 11 bp, Homo sapiens
ccatgggacca

SEQ ID NO: 1389050 - DNA, 20 bp, Homo sapiens
ccatgttggccaggatggtc

SEQ ID NO: 1389051 - DNA, 13 bp, Homo sapiens
ccattacatgatc

SEQ ID NO: 1389052 - DNA, 20 bp, Homo sapiens
ccattcacttcataatccag

SEQ ID NO: 1389053 - DNA, 14 bp, Homo sapiens
ccattctttcccaa

SEQ ID NO: 1389054 - DNA, 19 bp, Homo sapiens
ccatttaaatttttttcct

SEQ ID NO: 1389055 - DNA, 14 bp, Homo sapiens
cccaacactgccag

SEQ ID NO: 1389056 - DNA, 23 bp, Homo sapiens
cccaactacccccagctgtgctt

SEQ ID NO: 1389057 - DNA, 23 bp, Homo sapiens
cccaagagctacgtatttaatag

SEQ ID NO: 1389058 - DNA, 20 bp, Homo sapiens
cccacaatcacaagaagatt

SEQ ID NO: 1389059 - DNA, 21 bp, Homo sapiens
cccacactcagatcctcctca

SEQ ID NO: 1389060 - DNA, 18 bp, Homo sapiens
cccaccatttggcatccc

SEQ ID NO: 1389061 - DNA, 21 bp, Homo sapiens
cccacccctgcctcccatgcc

SEQ ID NO: 1389062 - DNA, 15 bp, Homo sapiens
cccacggctcctcga

SEQ ID NO: 1389063 - DNA, 19 bp, Homo sapiens
cccactgtacttgctcttg

SEQ ID NO: 1389064 - DNA, 23 bp, Homo sapiens
cccagctggggccaggctgggtc

SEQ ID NO: 1389065 - DNA, 20 bp, Homo sapiens
cccaggaccccatggcagtg

SEQ ID NO: 1389066 - DNA, 14 bp, Homo sapiens
cccagtgacagcta

SEQ ID NO: 1389067 - DNA, 16 bp, Homo sapiens
cccagtgcacttgctg

SEQ ID NO: 1389068 - DNA, 22 bp, Homo sapiens
cccatgagctccttaaggctct

SEQ ID NO: 1389069 - DNA, 14 bp, Homo sapiens
cccatgcctccagc

SEQ ID NO: 1389070 - DNA, 23 bp, Homo sapiens
cccatgcctggtcccaagacagt

SEQ ID NO: 1389071 - DNA, 13 bp, Homo sapiens
cccatttcagctg

SEQ ID NO: 1389072 - DNA, 23 bp, Homo sapiens
ccccaaccatttcctcagactct

SEQ ID NO: 1389073 - DNA, 17 bp, Homo sapiens
ccccaagctgttttctt

SEQ ID NO: 1389074 - DNA, 22 bp, Homo sapiens
ccccagctggggccaggctggg

SEQ ID NO: 1389075 - DNA, 13 bp, Homo sapiens
ccccatctcaggc

SEQ ID NO: 1389076 - DNA, 16 bp, Homo sapiens
ccccattcttcctagt

SEQ ID NO: 1389077 - DNA, 20 bp, Homo sapiens
cccccaaccatttcctcaga

SEQ ID NO: 1389078 - DNA, 19 bp, Homo sapiens
cccccaagctgttttcttc

SEQ ID NO: 1389079 - DNA, 14 bp, Homo sapiens
ccccctccctggat

SEQ ID NO: 1389080 - DNA, 13 bp, Homo sapiens
cccctcccctcca

SEQ ID NO: 1389081 - DNA, 14 bp, Homo sapiens
cccctccctggatg

SEQ ID NO: 1389082 - DNA, 12 bp, Homo sapiens
cccctcctgcgc

SEQ ID NO: 1389083 - DNA, 13 bp, Homo sapiens
cccctcctgcgct

SEQ ID NO: 1389084 - DNA, 17 bp, Homo sapiens
cccctgcctctctgcag

SEQ ID NO: 1389085 - DNA, 14 bp, Homo sapiens
cccctgtgccttgt

SEQ ID NO: 1389086 - DNA, 13 bp, Homo sapiens
ccctaaaatacta

SEQ ID NO: 1389087 - DNA, 12 bp, Homo sapiens
ccctaataaagc

SEQ ID NO: 1389088 - DNA, 14 bp, Homo sapiens
ccctaataaagctg

SEQ ID NO: 1389089 - DNA, 14 bp, Homo sapiens
ccctacctgtgcct

SEQ ID NO: 1389090 - DNA, 14 bp, Homo sapiens
ccctccatccctgg

SEQ ID NO: 1389091 - DNA, 18 bp, Homo sapiens
ccctcccctccatccctg

SEQ ID NO: 1389092 - DNA, 11 bp, Homo sapiens
ccctgagctga

SEQ ID NO: 1389093 - DNA, 14 bp, Homo sapiens
ccctgcctctctgc

SEQ ID NO: 1389094 - DNA, 13 bp, Homo sapiens
ccctggccccctc

SEQ ID NO: 1389095 - DNA, 16 bp, Homo sapiens
ccctggtttgaaattt

SEQ ID NO: 1389096 - DNA, 12 bp, Homo sapiens
cccttattttca

SEQ ID NO: 1389097 - DNA, 17 bp, Homo sapiens
cccttcgcgtatttcag

SEQ ID NO: 1389098 - DNA, 15 bp, Homo sapiens
ccgaggcagggaagg

SEQ ID NO: 1389099 - DNA, 16 bp, Homo sapiens
ccggaatgaccagcat

SEQ ID NO: 1389100 - DNA, 20 bp, Homo sapiens
ccggactcaagccccggact

SEQ ID NO: 1389101 - DNA, 19 bp, Homo sapiens
ccgggacacctaggctagg

SEQ ID NO: 1389102 - DNA, 20 bp, Homo sapiens
ccgggacacctaggctaggg

SEQ ID NO: 1389103 - DNA, 13 bp, Homo sapiens
ccgggagctcagg

SEQ ID NO: 1389104 - DNA, 15 bp, Homo sapiens
ccgggagctcaggaa

SEQ ID NO: 1389105 - DNA, 19 bp, Homo sapiens
ccggtaagagcaaaagaat

SEQ ID NO: 1389106 - DNA, 22 bp, Homo sapiens
ccgtcaaaacagattgtttgca

SEQ ID NO: 1389107 - DNA, 23 bp, Homo sapiens
ccgtggctgtggcatccagagtc

SEQ ID NO: 1389108 - DNA, 19 bp, Homo sapiens
cctaaatacttttttctat

SEQ ID NO: 1389109 - DNA, 16 bp, Homo sapiens
cctaattcaattcaaa

SEQ ID NO: 1389110 - DNA, 13 bp, Homo sapiens
cctacctccaaag

SEQ ID NO: 1389111 - DNA, 20 bp, Homo sapiens
cctactgcccaggcactgca

SEQ ID NO: 1389112 - DNA, 15 bp, Homo sapiens
cctactttgactttt

SEQ ID NO: 1389113 - DNA, 18 bp, Homo sapiens
cctaggctccaccccatc

SEQ ID NO: 1389114 - DNA, 13 bp, Homo sapiens
cctatactgcttg

SEQ ID NO: 1389115 - DNA, 12 bp, Homo sapiens
cctatgctttga

SEQ ID NO: 1389116 - DNA, 15 bp, Homo sapiens
cctcaactgcctact

SEQ ID NO: 1389117 - DNA, 17 bp, Homo sapiens
cctcacccccagctttg

SEQ ID NO: 1389118 - DNA, 22 bp, Homo sapiens
cctcacttttaatgaacaaatg

SEQ ID NO: 1389119 - DNA, 15 bp, Homo sapiens
cctcagactctaaga

SEQ ID NO: 1389120 - DNA, 21 bp, Homo sapiens
cctcaggcagaggatgttctg

SEQ ID NO: 1389121 - DNA, 16 bp, Homo sapiens
cctcagggactcaggt

SEQ ID NO: 1389122 - DNA, 14 bp, Homo sapiens
cctccaaactcctg

SEQ ID NO: 1389123 - DNA, 21 bp, Homo sapiens
cctccaaggaggggctgtaaa

SEQ ID NO: 1389124 - DNA, 17 bp, Homo sapiens
cctccccctcttggtcc

SEQ ID NO: 1389125 - DNA, 21 bp, Homo sapiens
cctccccgcaccccccaagct

SEQ ID NO: 1389126 - DNA, 20 bp, Homo sapiens
cctcccctccatccctggcc

SEQ ID NO: 1389127 - DNA, 12 bp, Homo sapiens
cctccctcctcg

SEQ ID NO: 1389128 - DNA, 12 bp, Homo sapiens
cctccctggatg

SEQ ID NO: 1389129 - DNA, 18 bp, Homo sapiens
cctccgtccaggagcctg

SEQ ID NO: 1389130 - DNA, 14 bp, Homo sapiens
cctcctctgcccgg

SEQ ID NO: 1389131 - DNA, 15 bp, Homo sapiens
cctcctctgcccggg

SEQ ID NO: 1389132 - DNA, 16 bp, Homo sapiens
cctcctgcgctgcccc

SEQ ID NO: 1389133 - DNA, 22 bp, Homo sapiens
cctctcaacagatctgtgggcc

SEQ ID NO: 1389134 - DNA, 20 bp, Homo sapiens
cctctcgctcctcaacccct

SEQ ID NO: 1389135 - DNA, 22 bp, Homo sapiens
cctctcgtaagatttccttctt

SEQ ID NO: 1389136 - DNA, 19 bp, Homo sapiens
cctctctgcaggtccctaa

SEQ ID NO: 1389137 - DNA, 23 bp, Homo sapiens
cctctctgcaggtccctaataaa

SEQ ID NO: 1389138 - DNA, 16 bp, Homo sapiens
cctctgattatcaggt

SEQ ID NO: 1389139 - DNA, 18 bp, Homo sapiens
cctcttccgtgacgtcac

SEQ ID NO: 1389140 - DNA, 22 bp, Homo sapiens
cctcttggggagtttagggtgg

SEQ ID NO: 1389141 - DNA, 17 bp, Homo sapiens
cctgaacaagaattgga

SEQ ID NO: 1389142 - DNA, 21 bp, Homo sapiens
cctgaacaagaattggaagct

SEQ ID NO: 1389143 - DNA, 18 bp, Homo sapiens
cctgaccctcatctttct

SEQ ID NO: 1389144 - DNA, 22 bp, Homo sapiens
cctgaccctcatctttcttcca

SEQ ID NO: 1389145 - DNA, 13 bp, Homo sapiens
cctgacctcaggc

SEQ ID NO: 1389146 - DNA, 16 bp, Homo sapiens
cctgagagctcacagt

SEQ ID NO: 1389147 - DNA, 15 bp, Homo sapiens
cctgcaccggggcct

SEQ ID NO: 1389148 - DNA, 17 bp, Homo sapiens
cctgcaccggggcctgg

SEQ ID NO: 1389149 - DNA, 22 bp, Homo sapiens
cctgcatccattctcctgagga

SEQ ID NO: 1389150 - DNA, 19 bp, Homo sapiens
cctgccaggaggacccagg

SEQ ID NO: 1389151 - DNA, 23 bp, Homo sapiens
cctgccaggaggacccagggctc

SEQ ID NO: 1389152 - DNA, 18 bp, Homo sapiens
cctgcccagtgcacttgc

SEQ ID NO: 1389153 - DNA, 13 bp, Homo sapiens
cctgccggctcct

SEQ ID NO: 1389154 - DNA, 23 bp, Homo sapiens
cctgcctcctgccggctccttgg

SEQ ID NO: 1389155 - DNA, 19 bp, Homo sapiens
cctgcctggaccagcctct

SEQ ID NO: 1389156 - DNA, 21 bp, Homo sapiens
cctgcgctgccccagagcctg

SEQ ID NO: 1389157 - DNA, 23 bp, Homo sapiens
cctggaagcatttgtttctactt

SEQ ID NO: 1389158 - DNA, 20 bp, Homo sapiens
cctggaaggacatccatgtt

SEQ ID NO: 1389159 - DNA, 22 bp, Homo sapiens
cctggaaggacatccatgttcc

SEQ ID NO: 1389160 - DNA, 20 bp, Homo sapiens
cctggactgtgtgctcagga

SEQ ID NO: 1389161 - DNA, 12 bp, Homo sapiens
cctggcggggtg

SEQ ID NO: 1389162 - DNA, 21 bp, Homo sapiens
cctggctccgtccaggagcct

SEQ ID NO: 1389163 - DNA, 21 bp, Homo sapiens
cctgggaaggaggccgctatg

SEQ ID NO: 1389164 - DNA, 18 bp, Homo sapiens
cctgggtagcgggggagg

SEQ ID NO: 1389165 - DNA, 12 bp, Homo sapiens
cctgtaaacctg

SEQ ID NO: 1389166 - DNA, 13 bp, Homo sapiens
cctgtaaacctga

SEQ ID NO: 1389167 - DNA, 16 bp, Homo sapiens
cctgtaacaagccaga

SEQ ID NO: 1389168 - DNA, 17 bp, Homo sapiens
cctgtatgtctccagta

SEQ ID NO: 1389169 - DNA, 15 bp, Homo sapiens
cctgtattcagacag

SEQ ID NO: 1389170 - DNA, 22 bp, Homo sapiens
cctgtcgattagactggacagc

SEQ ID NO: 1389171 - DNA, 15 bp, Homo sapiens
cctgtgcctcctcac

SEQ ID NO: 1389172 - DNA, 18 bp, Homo sapiens
cctgttacctactttgac

SEQ ID NO: 1389173 - DNA, 18 bp, Homo sapiens
ccttaaggctcttttgta

SEQ ID NO: 1389174 - DNA, 21 bp, Homo sapiens
ccttaccctgccccagctggg

SEQ ID NO: 1389175 - DNA, 14 bp, Homo sapiens
ccttacctttttat

SEQ ID NO: 1389176 - DNA, 17 bp, Homo sapiens
ccttcctgtttttcaca

SEQ ID NO: 1389177 - DNA, 19 bp, Homo sapiens
ccttcctgtttttcacatt

SEQ ID NO: 1389178 - DNA, 13 bp, Homo sapiens
ccttctctgttca

SEQ ID NO: 1389179 - DNA, 18 bp, Homo sapiens
ccttctctgttcatttcc

SEQ ID NO: 1389180 - DNA, 16 bp, Homo sapiens
ccttgacaactggcag

SEQ ID NO: 1389181 - DNA, 21 bp, Homo sapiens
ccttgattttagccttctctg

SEQ ID NO: 1389182 - DNA, 19 bp, Homo sapiens
ccttgcccatgcctccagc

SEQ ID NO: 1389183 - DNA, 15 bp, Homo sapiens
ccttgcggctcctca

SEQ ID NO: 1389184 - DNA, 19 bp, Homo sapiens
ccttgcggctcctcaggga

SEQ ID NO: 1389185 - DNA, 22 bp, Homo sapiens
ccttggggattcttccatctga

SEQ ID NO: 1389186 - DNA, 21 bp, Homo sapiens
ccttgttctgataatgaaaat

SEQ ID NO: 1389187 - DNA, 14 bp, Homo sapiens
cctttctagagcac

SEQ ID NO: 1389188 - DNA, 14 bp, Homo sapiens
cctttgaatcctct

SEQ ID NO: 1389189 - DNA, 14 bp, Homo sapiens
caaagaaccaaaga

SEQ ID NO: 1389190 - DNA, 21 bp, Homo sapiens
caaagagttcaagaaataagt

SEQ ID NO: 1389191 - DNA, 22 bp, Homo sapiens
caaagcaagcattcagaagaaa

SEQ ID NO: 1389192 - DNA, 19 bp, Homo sapiens
caaaggttttcctcttcta

SEQ ID NO: 1389193 - DNA, 12 bp, Homo sapiens
caaagtgcaagg

SEQ ID NO: 1389194 - DNA, 15 bp, Homo sapiens
caaagtgttttctct

SEQ ID NO: 1389195 - DNA, 17 bp, Homo sapiens
caaatattgtgcacatt

SEQ ID NO: 1389196 - DNA, 19 bp, Homo sapiens
caaatcaccacaaactgta

SEQ ID NO: 1389197 - DNA, 21 bp, Homo sapiens
caaatccttagatctggcatg

SEQ ID NO: 1389198 - DNA, 22 bp, Homo sapiens
caaatcttggttgatgccaaaa

SEQ ID NO: 1389199 - DNA, 14 bp, Homo sapiens
caaatgtgtaattt

SEQ ID NO: 1389200 - DNA, 13 bp, Homo sapiens
caacaattctaaa

SEQ ID NO: 1389201 - DNA, 12 bp, Homo sapiens
caacactgccag

SEQ ID NO: 1389202 - DNA, 13 bp, Homo sapiens
caacactgccagc

SEQ ID NO: 1389203 - DNA, 16 bp, Homo sapiens
caacagtgaagacaga

SEQ ID NO: 1389204 - DNA, 16 bp, Homo sapiens
caacagttacataatt

SEQ ID NO: 1389205 - DNA, 20 bp, Homo sapiens
caacagttttcctatgcttt

SEQ ID NO: 1389206 - DNA, 14 bp, Homo sapiens
caaccaatggaatg

SEQ ID NO: 1389207 - DNA, 14 bp, Homo sapiens
caaccacacccaca

SEQ ID NO: 1389208 - DNA, 13 bp, Homo sapiens
caaccatttcctc

SEQ ID NO: 1389209 - DNA, 21 bp, Homo sapiens
caacccctcccctccatccct

SEQ ID NO: 1389210 - DNA, 22 bp, Homo sapiens
caaccggctttgtggcactggg

SEQ ID NO: 1389211 - DNA, 18 bp, Homo sapiens
caacctcaactgcctact

SEQ ID NO: 1389212 - DNA, 23 bp, Homo sapiens
caacctgttacctactttgactt

SEQ ID NO: 1389213 - DNA, 17 bp, Homo sapiens
caactacccccagctgt

SEQ ID NO: 1389214 - DNA, 20 bp, Homo sapiens
caactacccccagctgtgct

SEQ ID NO: 1389215 - DNA, 22 bp, Homo sapiens
caactctcttattgcctcactt

SEQ ID NO: 1389216 - DNA, 18 bp, Homo sapiens
caactgaatgaggtcagc

SEQ ID NO: 1389217 - DNA, 14 bp, Homo sapiens
caactgcctactcc

SEQ ID NO: 1389218 - DNA, 15 bp, Homo sapiens
caactgcctactcca

SEQ ID NO: 1389219 - DNA, 14 bp, Homo sapiens
caactggcaggcag

SEQ ID NO: 1389220 - DNA, 11 bp, Homo sapiens
caacttattaa

SEQ ID NO: 1389221 - DNA, 16 bp, Homo sapiens
caagaaggcaaaaata

SEQ ID NO: 1389222 - DNA, 18 bp, Homo sapiens
caagaataatcacgcttt

SEQ ID NO: 1389223 - DNA, 21 bp, Homo sapiens
caagaataatcacgctttcct

SEQ ID NO: 1389224 - DNA, 22 bp, Homo sapiens
caagaataatcacgctttcctg

SEQ ID NO: 1389225 - DNA, 21 bp, Homo sapiens
caagaattggaagctgccctg

SEQ ID NO: 1389226 - DNA, 20 bp, Homo sapiens
caagactgctgtggccagga

SEQ ID NO: 1389227 - DNA, 21 bp, Homo sapiens
caagactgctgtggccaggag

SEQ ID NO: 1389228 - DNA, 15 bp, Homo sapiens
caagagactgagtca

SEQ ID NO: 1389229 - DNA, 22 bp, Homo sapiens
caagagctacgtatttaatagc

SEQ ID NO: 1389230 - DNA, 22 bp, Homo sapiens
caagcagttgggactacaggcg

SEQ ID NO: 1389231 - DNA, 18 bp, Homo sapiens
caagcatggctattttat

SEQ ID NO: 1389232 - DNA, 17 bp, Homo sapiens
caagcattcagaagaaa

SEQ ID NO: 1389233 - DNA, 22 bp, Homo sapiens
caagcattcagaagaaaaagaa

SEQ ID NO: 1389234 - DNA, 13 bp, Homo sapiens
caagccagaactt

SEQ ID NO: 1389235 - DNA, 15 bp, Homo sapiens
caagcgattctcttg

SEQ ID NO: 1389236 - DNA, 14 bp, Homo sapiens
caagctgcatctag

SEQ ID NO: 1389237 - DNA, 16 bp, Homo sapiens
caaggaaaataagtga

SEQ ID NO: 1389238 - DNA, 17 bp, Homo sapiens
caaggaaaataagtgaa

SEQ ID NO: 1389239 - DNA, 18 bp, Homo sapiens
caaggaggggctgtaaaa

SEQ ID NO: 1389240 - DNA, 17 bp, Homo sapiens
caaggagtcactgagac

SEQ ID NO: 1389241 - DNA, 16 bp, Homo sapiens
caagggtcaggccttt

SEQ ID NO: 1389242 - DNA, 13 bp, Homo sapiens
caaggtctttaaa

SEQ ID NO: 1389243 - DNA, 14 bp, Homo sapiens
caaggtctttggtt

SEQ ID NO: 1389244 - DNA, 19 bp, Homo sapiens
caagtacaaccacacccac

SEQ ID NO: 1389245 - DNA, 16 bp, Homo sapiens
caagtagaatctcagt

SEQ ID NO: 1389246 - DNA, 23 bp, Homo sapiens
caagtagaatctcagttgatttt

SEQ ID NO: 1389247 - DNA, 16 bp, Homo sapiens
caagtatttgttaatt

SEQ ID NO: 1389248 - DNA, 14 bp, Homo sapiens
caagtgctgtgcaa

SEQ ID NO: 1389249 - DNA, 16 bp, Homo sapiens
caagttagaaaacata

SEQ ID NO: 1389250 - DNA, 19 bp, Homo sapiens
caataaaaagttcagagtt

SEQ ID NO: 1389251 - DNA, 13 bp, Homo sapiens
caataattttcta

SEQ ID NO: 1389252 - DNA, 16 bp, Homo sapiens
caatataagcttttct

SEQ ID NO: 1389253 - DNA, 11 bp, Homo sapiens
caatgaaatga

SEQ ID NO: 1389254 - DNA, 13 bp, Homo sapiens
caatgaaatgaat

SEQ ID NO: 1389255 - DNA, 19 bp, Homo sapiens
caatgatcctgtattcaga

SEQ ID NO: 1389256 - DNA, 13 bp, Homo sapiens
caatgatggcaat

SEQ ID NO: 1389257 - DNA, 24 bp, Homo sapiens
caatgatggcaattttgtaacgaa

SEQ ID NO: 1389258 - DNA, 21 bp, Homo sapiens
caattgcacgcggagtgagtt

SEQ ID NO: 1389259 - DNA, 13 bp, Homo sapiens
cacaaacacctcc

SEQ ID NO: 1389260 - DNA, 15 bp, Homo sapiens
cacaaacacctccta

SEQ ID NO: 1389261 - DNA, 17 bp, Homo sapiens
cacaaactgtaatacaa

SEQ ID NO: 1389262 - DNA, 23 bp, Homo sapiens
cacacaaaagggaacccagctct

SEQ ID NO: 1389263 - DNA, 20 bp, Homo sapiens
cacacaaacacctcctagca

SEQ ID NO: 1389264 - DNA, 19 bp, Homo sapiens
cacacacaaaagggaaccc

SEQ ID NO: 1389265 - DNA, 14 bp, Homo sapiens
cacacttacttttt

SEQ ID NO: 1389266 - DNA, 16 bp, Homo sapiens
cacacttactttttct

SEQ ID NO: 1389267 - DNA, 18 bp, Homo sapiens
cacagcaattcctcaggc

SEQ ID NO: 1389268 - DNA, 18 bp, Homo sapiens
cacatactcatttttcat

SEQ ID NO: 1389269 - DNA, 15 bp, Homo sapiens
caccaaaagaagtaa

SEQ ID NO: 1389270 - DNA, 14 bp, Homo sapiens
caccactccactcc

SEQ ID NO: 1389271 - DNA, 22 bp, Homo sapiens
caccaggatagagactggaaca

SEQ ID NO: 1389272 - DNA, 17 bp, Homo sapiens
caccataggtagaatgt

SEQ ID NO: 1389273 - DNA, 14 bp, Homo sapiens
caccattgaaggct

SEQ ID NO: 1389274 - DNA, 16 bp, Homo sapiens
caccattgaaggctta

SEQ ID NO: 1389275 - DNA, 20 bp, Homo sapiens
caccatttggcatccctggg

SEQ ID NO: 1389276 - DNA, 22 bp, Homo sapiens
cacccctgcctcccatgcctgg

SEQ ID NO: 1389277 - DNA, 18 bp, Homo sapiens
cacccttggttcctaact

SEQ ID NO: 1389278 - DNA, 24 bp, Homo sapiens
caccgtgcccagccctaaacatca

SEQ ID NO: 1389279 - DNA, 17 bp, Homo sapiens
cacctaaagaaaaacaa

SEQ ID NO: 1389280 - DNA, 17 bp, Homo sapiens
cacctaggctagggtgg

SEQ ID NO: 1389281 - DNA, 20 bp, Homo sapiens
cacctcagagacatacacct

SEQ ID NO: 1389282 - DNA, 20 bp, Homo sapiens
cacctccctatactgcttgg

SEQ ID NO: 1389283 - DNA, 17 bp, Homo sapiens
cacctgaactgaacacc

SEQ ID NO: 1389284 - DNA, 22 bp, Homo sapiens
cacctggaagcatttgtttcta

SEQ ID NO: 1389285 - DNA, 17 bp, Homo sapiens
cacctgggagaaatctg

SEQ ID NO: 1389286 - DNA, 15 bp, Homo sapiens
cacctgtaaacctga

SEQ ID NO: 1389287 - DNA, 23 bp, Homo sapiens
caccttgtgctggggacaggtcc

SEQ ID NO: 1389288 - DNA, 17 bp, Homo sapiens
caccttttttcaacagt

SEQ ID NO: 1389289 - DNA, 20 bp, Homo sapiens
cacggcctttctagcctggc

SEQ ID NO: 1389290 - DNA, 14 bp, Homo sapiens
cacgtgacacaaac

SEQ ID NO: 1389291 - DNA, 17 bp, Homo sapiens
cacgtgacacaaacaca

SEQ ID NO: 1389292 - DNA, 19 bp, Homo sapiens
cactaccttctgacctccc

SEQ ID NO: 1389293 - DNA, 16 bp, Homo sapiens
cactagcccaatgaaa

SEQ ID NO: 1389294 - DNA, 19 bp, Homo sapiens
cactagcccaatgaaatga

SEQ ID NO: 1389295 - DNA, 11 bp, Homo sapiens
cactcaaggcg

SEQ ID NO: 1389296 - DNA, 19 bp, Homo sapiens
cactcaaggcggtgcttga

SEQ ID NO: 1389297 - DNA, 13 bp, Homo sapiens
cactcctgctgtg

SEQ ID NO: 1389298 - DNA, 16 bp, Homo sapiens
cactcctgctgtgccc

SEQ ID NO: 1389299 - DNA, 21 bp, Homo sapiens
cactgagttttccatggcagg

SEQ ID NO: 1389300 - DNA, 21 bp, Homo sapiens
cactgcaaaccgccacctccc

SEQ ID NO: 1389301 - DNA, 19 bp, Homo sapiens
caaaaaattaaagcattta

SEQ ID NO: 1389302 - DNA, 18 bp, Homo sapiens
caaaacaatgtttaaacc

SEQ ID NO: 1389303 - DNA, 13 bp, Homo sapiens
caaaacagattgt

SEQ ID NO: 1389304 - DNA, 18 bp, Homo sapiens
caaaacagattgtttgca

SEQ ID NO: 1389305 - DNA, 15 bp, Homo sapiens
caaaactgcatttca

SEQ ID NO: 1389306 - DNA, 15 bp, Homo sapiens
caaaagaagaagttt

SEQ ID NO: 1389307 - DNA, 20 bp, Homo sapiens
caaaagaagaagtttcatca

SEQ ID NO: 1389308 - DNA, 12 bp, Homo sapiens
caaaagaagtaa

SEQ ID NO: 1389309 - DNA, 19 bp, Homo sapiens
caaaagaatggcagaaaag

SEQ ID NO: 1389310 - DNA, 20 bp, Homo sapiens
caaaagggccaaagaaccaa

SEQ ID NO: 1389311 - DNA, 16 bp, Homo sapiens
caaacaccaacataaa

SEQ ID NO: 1389312 - DNA, 18 bp, Homo sapiens
caaaccaggactctgccc

SEQ ID NO: 1389313 - DNA, 19 bp, Homo sapiens
caaacctgacccctgctca

SEQ ID NO: 1389314 - DNA, 18 bp, Homo sapiens
caaactcctgacctcagg

SEQ ID NO: 1389315 - DNA, 14 bp, Homo sapiens
caaactcctgcctg

SEQ ID NO: 1389316 - DNA, 15 bp, Homo sapiens
caaactcctgcctgt

SEQ ID NO: 1389317 - DNA, 14 bp, Homo sapiens
aaaaagaaacattg

SEQ ID NO: 1389318 - DNA, 18 bp, Homo sapiens
aaaaagcgaaaaaatcag

SEQ ID NO: 1389319 - DNA, 12 bp, Homo sapiens
aaaaagcttaaa

SEQ ID NO: 1389320 - DNA, 15 bp, Homo sapiens
aaaaagcttaaaact

SEQ ID NO: 1389321 - DNA, 17 bp, Homo sapiens
aaaaagcttaaaacttt

SEQ ID NO: 1389322 - DNA, 19 bp, Homo sapiens
aaaaagcttaaaactttga

SEQ ID NO: 1389323 - DNA, 23 bp, Homo sapiens
aaaaagtgttctgtgtccttcta

SEQ ID NO: 1389324 - DNA, 14 bp, Homo sapiens
aaaaagttaaatgt

SEQ ID NO: 1389325 - DNA, 15 bp, Homo sapiens
aaaaagttaaatgtg

SEQ ID NO: 1389326 - DNA, 16 bp, Homo sapiens
aaaaagttaaatgtgt

SEQ ID NO: 1389327 - DNA, 22 bp, Homo sapiens
aaaaataagaagaatgcttaat

SEQ ID NO: 1389328 - DNA, 21 bp, Homo sapiens
aaaaatagctaaatacctcaa

SEQ ID NO: 1389329 - DNA, 16 bp, Homo sapiens
aaaaatgatttcagta

SEQ ID NO: 1389330 - DNA, 18 bp, Homo sapiens
aaaacataatcttctgcc

SEQ ID NO: 1389331 - DNA, 12 bp, Homo sapiens
aaaacatttatt

SEQ ID NO: 1389332 - DNA, 22 bp, Homo sapiens
aaaacatttattttgacataaa

SEQ ID NO: 1389333 - DNA, 13 bp, Homo sapiens
aaaacctcagcta

SEQ ID NO: 1389334 - DNA, 16 bp, Homo sapiens
aaaactaaaaactaga

SEQ ID NO: 1389335 - DNA, 22 bp, Homo sapiens
aaaactacaaccaatggaatgt

SEQ ID NO: 1389336 - DNA, 21 bp, Homo sapiens
aaaacttcaaggaaaataagt

SEQ ID NO: 1389337 - DNA, 19 bp, Homo sapiens
aaaagatgcttttaacaga

SEQ ID NO: 1389338 - DNA, 14 bp, Homo sapiens
aaaagattgctgaa

SEQ ID NO: 1389339 - DNA, 18 bp, Homo sapiens
aaaagattgctgaaattt

SEQ ID NO: 1389340 - DNA, 21 bp, Homo sapiens
aaaagctttgaaccctgggac

SEQ ID NO: 1389341 - DNA, 20 bp, Homo sapiens
aaaaggctaggtacacagct

SEQ ID NO: 1389342 - DNA, 14 bp, Homo sapiens
aaaagggaggggga

SEQ ID NO: 1389343 - DNA, 13 bp, Homo sapiens
aaaaggtttacag

SEQ ID NO: 1389344 - DNA, 18 bp, Homo sapiens
aaaaggtttacagaattt

SEQ ID NO: 1389345 - DNA, 14 bp, Homo sapiens
aaaaggtttatgaa

SEQ ID NO: 1389346 - DNA, 20 bp, Homo sapiens
aaaaggtttatgaaaaagaa

SEQ ID NO: 1389347 - DNA, 18 bp, Homo sapiens
aaaagttacatgtttgca

SEQ ID NO: 1389348 - DNA, 22 bp, Homo sapiens
aaaagttgctatttgaactttt

SEQ ID NO: 1389349 - DNA, 13 bp, Homo sapiens
aaaataaaaatgg

SEQ ID NO: 1389350 - DNA, 20 bp, Homo sapiens
aaaataattttaaacaaagg

SEQ ID NO: 1389351 - DNA, 17 bp, Homo sapiens
aaaatagcaaaagaaga

SEQ ID NO: 1389352 - DNA, 18 bp, Homo sapiens
aaaatagtaagcctccct

SEQ ID NO: 1389353 - DNA, 16 bp, Homo sapiens
aaaatagtttggatat

SEQ ID NO: 1389354 - DNA, 13 bp, Homo sapiens
aaaatataaatta

SEQ ID NO: 1389355 - DNA, 18 bp, Homo sapiens
aaaatataaattaagact

SEQ ID NO: 1389356 - DNA, 13 bp, Homo sapiens
aaaatccttgctt

SEQ ID NO: 1389357 - DNA, 20 bp, Homo sapiens
aaaatccttgcttatgacat

SEQ ID NO: 1389358 - DNA, 23 bp, Homo sapiens
aaaatgccatgatgcctctgtct

SEQ ID NO: 1389359 - DNA, 19 bp, Homo sapiens
aaaatggccatttgctttt

SEQ ID NO: 1389360 - DNA, 23 bp, Homo sapiens
aaaatggccatttgctttttcac

SEQ ID NO: 1389361 - DNA, 12 bp, Homo sapiens
aaaatgtaggag

SEQ ID NO: 1389362 - DNA, 13 bp, Homo sapiens
aaaatgttgaaat

SEQ ID NO: 1389363 - DNA, 21 bp, Homo sapiens
aaaattgaatgcaaaccatag

SEQ ID NO: 1389364 - DNA, 18 bp, Homo sapiens
aaacaaagagttcaagaa

SEQ ID NO: 1389365 - DNA, 17 bp, Homo sapiens
aaacaaaggttgagatg

SEQ ID NO: 1389366 - DNA, 16 bp, Homo sapiens
aaacaaggttttcagt

SEQ ID NO: 1389367 - DNA, 19 bp, Homo sapiens
aaacaccaacataaaaatg

SEQ ID NO: 1389368 - DNA, 21 bp, Homo sapiens
aaacagaaacaaaaacactaa

SEQ ID NO: 1389369 - DNA, 14 bp, Homo sapiens
aaacaggtggttct

SEQ ID NO: 1389370 - DNA, 19 bp, Homo sapiens
aaacatcattcatttttgt

SEQ ID NO: 1389371 - DNA, 18 bp, Homo sapiens
aaacatttattttgacat

SEQ ID NO: 1389372 - DNA, 14 bp, Homo sapiens
aaacatttgctgaa

SEQ ID NO: 1389373 - DNA, 15 bp, Homo sapiens
aaaccatgcaaatgc

SEQ ID NO: 1389374 - DNA, 18 bp, Homo sapiens
aaaccgctaaaagaaact

SEQ ID NO: 1389375 - DNA, 21 bp, Homo sapiens
aaaccgctaaaagaaactttc

SEQ ID NO: 1389376 - DNA, 18 bp, Homo sapiens
aaacctgacccctgctca

SEQ ID NO: 1389377 - DNA, 17 bp, Homo sapiens
aaacctttcttcaccaa

SEQ ID NO: 1389378 - DNA, 14 bp, Homo sapiens
aaactaaaaactag

SEQ ID NO: 1389379 - DNA, 16 bp, Homo sapiens
aaactatcttggtgaa

SEQ ID NO: 1389380 - DNA, 11 bp, Homo sapiens
aaactcctgcc

SEQ ID NO: 1389381 - DNA, 12 bp, Homo sapiens
aaactcctgcct

SEQ ID NO: 1389382 - DNA, 13 bp, Homo sapiens
aaactcttttccc

SEQ ID NO: 1389383 - DNA, 19 bp, Homo sapiens
aaactgaggaatttcacct

SEQ ID NO: 1389384 - DNA, 13 bp, Homo sapiens
aaactgagtgact

SEQ ID NO: 1389385 - DNA, 17 bp, Homo sapiens
aaactgtaatacaatga

SEQ ID NO: 1389386 - DNA, 18 bp, Homo sapiens
aaactgtgtattccaaga

SEQ ID NO: 1389387 - DNA, 22 bp, Homo sapiens
aaacttcaaggaaaataagtga

SEQ ID NO: 1389388 - DNA, 15 bp, Homo sapiens
aaagaaacattgtta

SEQ ID NO: 1389389 - DNA, 17 bp, Homo sapiens
aaagaaatatacctaaa

SEQ ID NO: 1389390 - DNA, 15 bp, Homo sapiens
aaagaagtaaaagca

SEQ ID NO: 1389391 - DNA, 16 bp, Homo sapiens
aaagagttcaagaaat

SEQ ID NO: 1389392 - DNA, 20 bp, Homo sapiens
aaagagttcaagaaataagt

SEQ ID NO: 1389393 - DNA, 13 bp, Homo sapiens
aaagatgctttta

SEQ ID NO: 1389394 - DNA, 19 bp, Homo sapiens
aaagattgctgaaatttta

SEQ ID NO: 1389395 - DNA, 21 bp, Homo sapiens
aaagattttttaataatttag

SEQ ID NO: 1389396 - DNA, 14 bp, Homo sapiens
aaagcaaaaaagaa

SEQ ID NO: 1389397 - DNA, 15 bp, Homo sapiens
aaagcaaaaaagaaa

SEQ ID NO: 1389398 - DNA, 21 bp, Homo sapiens
aaagcaaaaaagaaaaccttt

SEQ ID NO: 1389399 - DNA, 22 bp, Homo sapiens
aaagcaagcattcagaagaaaa

SEQ ID NO: 1389400 - DNA, 20 bp, Homo sapiens
aaagcatcatggctatctgt

SEQ ID NO: 1389401 - DNA, 23 bp, Homo sapiens
aaagccaaggagtcactgagacc

SEQ ID NO: 1389402 - DNA, 15 bp, Homo sapiens
aaagccctaaaatac

SEQ ID NO: 1389403 - DNA, 14 bp, Homo sapiens
aaagcgtttgcaca

SEQ ID NO: 1389404 - DNA, 14 bp, Homo sapiens
aaagcttaaaactt

SEQ ID NO: 1389405 - DNA, 15 bp, Homo sapiens
aaagcttaaaacttt

SEQ ID NO: 1389406 - DNA, 20 bp, Homo sapiens
aaagcttcagtgctgccgat

SEQ ID NO: 1389407 - DNA, 13 bp, Homo sapiens
aaaggattaagat

SEQ ID NO: 1389408 - DNA, 21 bp, Homo sapiens
aaaggattaagatacactcct

SEQ ID NO: 1389409 - DNA, 15 bp, Homo sapiens
aaaggtttacagaat

SEQ ID NO: 1389410 - DNA, 18 bp, Homo sapiens
aaagttcaacatgttatt

SEQ ID NO: 1389411 - DNA, 23 bp, Homo sapiens
aaagttgataaagattttttaat

SEQ ID NO: 1389412 - DNA, 12 bp, Homo sapiens
aaagtttaataa

SEQ ID NO: 1389413 - DNA, 16 bp, Homo sapiens
aaataaaacctcagct

SEQ ID NO: 1389414 - DNA, 19 bp, Homo sapiens
aaataaaacctcagctagc

SEQ ID NO: 1389415 - DNA, 13 bp, Homo sapiens
aaataaagaaata

SEQ ID NO: 1389416 - DNA, 14 bp, Homo sapiens
aaataaagaatgga

SEQ ID NO: 1389417 - DNA, 16 bp, Homo sapiens
aaataaagaatggaaa

SEQ ID NO: 1389418 - DNA, 15 bp, Homo sapiens
aattgaatattattc

SEQ ID NO: 1389419 - DNA, 17 bp, Homo sapiens
aattgatcgacttgcca

SEQ ID NO: 1389420 - DNA, 22 bp, Homo sapiens
aattgcacgcggagtgagtttt

SEQ ID NO: 1389421 - DNA, 22 bp, Homo sapiens
aatttaaactataagcaagaag

SEQ ID NO: 1389422 - DNA, 15 bp, Homo sapiens
aatttagaaaacttt

SEQ ID NO: 1389423 - DNA, 14 bp, Homo sapiens
aatttagtttcata

SEQ ID NO: 1389424 - DNA, 21 bp, Homo sapiens
aatttagtttcatataaagta

SEQ ID NO: 1389425 - DNA, 19 bp, Homo sapiens
aatttatcctgaaatttca

SEQ ID NO: 1389426 - DNA, 20 bp, Homo sapiens
aatttcacctgtaaacctga

SEQ ID NO: 1389427 - DNA, 16 bp, Homo sapiens
aatttctaccatttca

SEQ ID NO: 1389428 - DNA, 13 bp, Homo sapiens
aatttgaggacaa

SEQ ID NO: 1389429 - DNA, 22 bp, Homo sapiens
aatttgcctgtaacaagccaga

SEQ ID NO: 1389430 - DNA, 18 bp, Homo sapiens
aatttgggggacttacat

SEQ ID NO: 1389431 - DNA, 14 bp, Homo sapiens
aattttaaaagtca

SEQ ID NO: 1389432 - DNA, 18 bp, Homo sapiens
aattttcatctaggattt

SEQ ID NO: 1389433 - DNA, 18 bp, Homo sapiens
aattttccattacatgat

SEQ ID NO: 1389434 - DNA, 15 bp, Homo sapiens
aatttttaaacaagt

SEQ ID NO: 1389435 - DNA, 13 bp, Homo sapiens
aatttttgatact

SEQ ID NO: 1389436 - DNA, 20 bp, Homo sapiens
aattttttatcatgcatgtc

SEQ ID NO: 1389437 - DNA, 19 bp, Homo sapiens
aatttttttatactaccaa

SEQ ID NO: 1389438 - DNA, 16 bp, Homo sapiens
acaaaactgcatttca

SEQ ID NO: 1389439 - DNA, 21 bp, Homo sapiens
acaaactcgttttttacaaag

SEQ ID NO: 1389440 - DNA, 16 bp, Homo sapiens
acaaactgtaatacaa

SEQ ID NO: 1389441 - DNA, 12 bp, Homo sapiens
acaaagaacctt

SEQ ID NO: 1389442 - DNA, 16 bp, Homo sapiens
acaaataacaatgtgc

SEQ ID NO: 1389443 - DNA, 18 bp, Homo sapiens
acaaatatttattttctt

SEQ ID NO: 1389444 - DNA, 22 bp, Homo sapiens
acaaatatttattttctttctg

SEQ ID NO: 1389445 - DNA, 16 bp, Homo sapiens
acaaccaatggaatgt

SEQ ID NO: 1389446 - DNA, 20 bp, Homo sapiens
acaactattttcagatgtga

SEQ ID NO: 1389447 - DNA, 19 bp, Homo sapiens
acaactggcaggcaggctc

SEQ ID NO: 1389448 - DNA, 17 bp, Homo sapiens
acaagaagcattttgta

SEQ ID NO: 1389449 - DNA, 18 bp, Homo sapiens
acaagaagcattttgtaa

SEQ ID NO: 1389450 - DNA, 13 bp, Homo sapiens
acaagatatttat

SEQ ID NO: 1389451 - DNA, 21 bp, Homo sapiens
acaagatatttatatgttatt

SEQ ID NO: 1389452 - DNA, 14 bp, Homo sapiens
acaagccagaactt

SEQ ID NO: 1389453 - DNA, 17 bp, Homo sapiens
acaagtatttgttaatt

SEQ ID NO: 1389454 - DNA, 22 bp, Homo sapiens
acaagtatttgttaatttagaa

SEQ ID NO: 1389455 - DNA, 17 bp, Homo sapiens
acaagttatttaaatct

SEQ ID NO: 1389456 - DNA, 22 bp, Homo sapiens
acaatgatcctgtattcagaca

SEQ ID NO: 1389457 - DNA, 17 bp, Homo sapiens
acaatgtttaaaccttt

SEQ ID NO: 1389458 - DNA, 17 bp, Homo sapiens
acaattctaaaatgatt

SEQ ID NO: 1389459 - DNA, 22 bp, Homo sapiens
acaattttttatcatgcatgtc

SEQ ID NO: 1389460 - DNA, 16 bp, Homo sapiens
acacaaacacctccta

SEQ ID NO: 1389461 - DNA, 21 bp, Homo sapiens
acacactgtaaacccctgggt

SEQ ID NO: 1389462 - DNA, 22 bp, Homo sapiens
acacatactcatttttcatgat

SEQ ID NO: 1389463 - DNA, 15 bp, Homo sapiens
acacatgtatttggt

SEQ ID NO: 1389464 - DNA, 16 bp, Homo sapiens
acacattaggaaaagt

SEQ ID NO: 1389465 - DNA, 17 bp, Homo sapiens
acaccataggtagaatg

SEQ ID NO: 1389466 - DNA, 21 bp, Homo sapiens
acaccataggtagaatgtaaa

SEQ ID NO: 1389467 - DNA, 17 bp, Homo sapiens
acaccattgaaggctta

SEQ ID NO: 1389468 - DNA, 13 bp, Homo sapiens
acacctcccagga

SEQ ID NO: 1389469 - DNA, 17 bp, Homo sapiens
acacgtgacacaaacac

SEQ ID NO: 1389470 - DNA, 20 bp, Homo sapiens
acactagcccaatgaaatga

SEQ ID NO: 1389471 - DNA, 16 bp, Homo sapiens
acactgtaaacccctg

SEQ ID NO: 1389472 - DNA, 18 bp, Homo sapiens
acactgtgtactgcagtt

SEQ ID NO: 1389473 - DNA, 13 bp, Homo sapiens
acacttgcaacct

SEQ ID NO: 1389474 - DNA, 14 bp, Homo sapiens
acacttggtaattg

SEQ ID NO: 1389475 - DNA, 19 bp, Homo sapiens
acagaaaaatatgtaccaa

SEQ ID NO: 1389476 - DNA, 13 bp, Homo sapiens
acagaaagctgcc

SEQ ID NO: 1389477 - DNA, 17 bp, Homo sapiens
acagaacccctacatga

SEQ ID NO: 1389478 - DNA, 14 bp, Homo sapiens
acagaagaaacaag

SEQ ID NO: 1389479 - DNA, 16 bp, Homo sapiens
acagaagttgtgaaac

SEQ ID NO: 1389480 - DNA, 15 bp, Homo sapiens
acagaattcaacagt

SEQ ID NO: 1389481 - DNA, 14 bp, Homo sapiens
acagacactggcat

SEQ ID NO: 1389482 - DNA, 19 bp, Homo sapiens
acagcaattcctcaggcta

SEQ ID NO: 1389483 - DNA, 21 bp, Homo sapiens
acagcctgacaacatttctat

SEQ ID NO: 1389484 - DNA, 13 bp, Homo sapiens
acagctctagaca

SEQ ID NO: 1389485 - DNA, 23 bp, Homo sapiens
acagctgcggcagcccctcccag

SEQ ID NO: 1389486 - DNA, 18 bp, Homo sapiens
acaggatgtgtttgcttt

SEQ ID NO: 1389487 - DNA, 22 bp, Homo sapiens
acaggatgtgtttgctttctga

SEQ ID NO: 1389488 - DNA, 19 bp, Homo sapiens
acaggcgtgagccacctcg

SEQ ID NO: 1389489 - DNA, 20 bp, Homo sapiens
acaggcgtgagccacctcgc

SEQ ID NO: 1389490 - DNA, 16 bp, Homo sapiens
acagggcgggggtggc

SEQ ID NO: 1389491 - DNA, 13 bp, Homo sapiens
acaggttttcagc

SEQ ID NO: 1389492 - DNA, 17 bp, Homo sapiens
acagtccgtcaaaacag

SEQ ID NO: 1389493 - DNA, 14 bp, Homo sapiens
acagtctaaagctg

SEQ ID NO: 1389494 - DNA, 17 bp, Homo sapiens
acagtgagcctgaattt

SEQ ID NO: 1389495 - DNA, 16 bp, Homo sapiens
acagtggaactacatt

SEQ ID NO: 1389496 - DNA, 19 bp, Homo sapiens
acataaaaatgatctaaac

SEQ ID NO: 1389497 - DNA, 12 bp, Homo sapiens
acataaagttga

SEQ ID NO: 1389498 - DNA, 22 bp, Homo sapiens
acttatttttgacagtgttgaa

SEQ ID NO: 1389499 - DNA, 23 bp, Homo sapiens
acttcaagcatggctattttata

SEQ ID NO: 1389500 - DNA, 19 bp, Homo sapiens
acttcaaggaaaataagtg

SEQ ID NO: 1389501 - DNA, 17 bp, Homo sapiens
acttcaggttgttctgt

SEQ ID NO: 1389502 - DNA, 20 bp, Homo sapiens
acttcaggttgttctgtata

SEQ ID NO: 1389503 - DNA, 16 bp, Homo sapiens
acttccaaactaattt

SEQ ID NO: 1389504 - DNA, 21 bp, Homo sapiens
acttccacagaatacaagcca

SEQ ID NO: 1389505 - DNA, 22 bp, Homo sapiens
acttctgggcttcatctggcaa

SEQ ID NO: 1389506 - DNA, 20 bp, Homo sapiens
acttgaaatatcctgcttga

SEQ ID NO: 1389507 - DNA, 13 bp, Homo sapiens
acttgaactgatt

SEQ ID NO: 1389508 - DNA, 21 bp, Homo sapiens
acttgaactgattcacatctc

SEQ ID NO: 1389509 - DNA, 13 bp, Homo sapiens
acttgacagtgga

SEQ ID NO: 1389510 - DNA, 13 bp, Homo sapiens
acttgatgtaact

SEQ ID NO: 1389511 - DNA, 14 bp, Homo sapiens
acttgccaaattta

SEQ ID NO: 1389512 - DNA, 20 bp, Homo sapiens
acttgctcaggtacttgtaa

SEQ ID NO: 1389513 - DNA, 14 bp, Homo sapiens
acttgctcttgatg

SEQ ID NO: 1389514 - DNA, 20 bp, Homo sapiens
acttgctcttgatgcctggc

SEQ ID NO: 1389515 - DNA, 21 bp, Homo sapiens
acttgcttatcaacttcctaa

SEQ ID NO: 1389516 - DNA, 20 bp, Homo sapiens
acttgtacaaaataaacaaa

SEQ ID NO: 1389517 - DNA, 19 bp, Homo sapiens
actttaattaccaacctgt

SEQ ID NO: 1389518 - DNA, 22 bp, Homo sapiens
actttaattaccaacctgttac

SEQ ID NO: 1389519 - DNA, 17 bp, Homo sapiens
actttctacacctgttg

SEQ ID NO: 1389520 - DNA, 19 bp, Homo sapiens
actttctattaatatttat

SEQ ID NO: 1389521 - DNA, 20 bp, Homo sapiens
actttctattaatatttatg

SEQ ID NO: 1389522 - DNA, 22 bp, Homo sapiens
actttctttctcactaaatctt

SEQ ID NO: 1389523 - DNA, 17 bp, Homo sapiens
actttgaagttagcttt

SEQ ID NO: 1389524 - DNA, 15 bp, Homo sapiens
actttgactttttgc

SEQ ID NO: 1389525 - DNA, 15 bp, Homo sapiens
acttttaaacagtga

SEQ ID NO: 1389526 - DNA, 17 bp, Homo sapiens
acttttaaactgtgtac

SEQ ID NO: 1389527 - DNA, 13 bp, Homo sapiens
acttttacaagta

SEQ ID NO: 1389528 - DNA, 19 bp, Homo sapiens
acttttcctttgaatcctc

SEQ ID NO: 1389529 - DNA, 16 bp, Homo sapiens
acttttcttaaacctt

SEQ ID NO: 1389530 - DNA, 12 bp, Homo sapiens
acttttgtaaga

SEQ ID NO: 1389531 - DNA, 13 bp, Homo sapiens
acttttgtttcag

SEQ ID NO: 1389532 - DNA, 15 bp, Homo sapiens
actttttattgattt

SEQ ID NO: 1389533 - DNA, 12 bp, Homo sapiens
agaaaaaattaa

SEQ ID NO: 1389534 - DNA, 23 bp, Homo sapiens
agaaaaacaaactcgttttttac

SEQ ID NO: 1389535 - DNA, 15 bp, Homo sapiens
agaaaacttcaagga

SEQ ID NO: 1389536 - DNA, 14 bp, Homo sapiens
agaaacattgttaa

SEQ ID NO: 1389537 - DNA, 23 bp, Homo sapiens
agaaacctactgcccaggcactg

SEQ ID NO: 1389538 - DNA, 18 bp, Homo sapiens
agaaagccctaaaatact

SEQ ID NO: 1389539 - DNA, 16 bp, Homo sapiens
agaaaggttagtatca

SEQ ID NO: 1389540 - DNA, 14 bp, Homo sapiens
agaaatacaaaaat

SEQ ID NO: 1389541 - DNA, 23 bp, Homo sapiens
agaaatactactgtgtaagggcc

SEQ ID NO: 1389542 - DNA, 13 bp, Homo sapiens
agaaatagaacaa

SEQ ID NO: 1389543 - DNA, 13 bp, Homo sapiens
agaaatatcttca

SEQ ID NO: 1389544 - DNA, 20 bp, Homo sapiens
agaaatatcttcacttgtca

SEQ ID NO: 1389545 - DNA, 17 bp, Homo sapiens
agaaatcattttgcaat

SEQ ID NO: 1389546 - DNA, 17 bp, Homo sapiens
agaaatctggcttctgg

SEQ ID NO: 1389547 - DNA, 20 bp, Homo sapiens
agaaatttaaactataagca

SEQ ID NO: 1389548 - DNA, 24 bp, Homo sapiens
agaaatttaaactataagcaagaa

SEQ ID NO: 1389549 - DNA, 19 bp, Homo sapiens
agaacccctacatgaaaca

SEQ ID NO: 1389550 - DNA, 15 bp, Homo sapiens
agaagaaaaagaagc

SEQ ID NO: 1389551 - DNA, 13 bp, Homo sapiens
agaagaaacaagg

SEQ ID NO: 1389552 - DNA, 21 bp, Homo sapiens
agaagaaacaaggttttcagt

SEQ ID NO: 1389553 - DNA, 21 bp, Homo sapiens
agaagcaacctcagtaattta

SEQ ID NO: 1389554 - DNA, 22 bp, Homo sapiens
agaagttggggacacatgtatt

SEQ ID NO: 1389555 - DNA, 14 bp, Homo sapiens
agaagttgtgaaac

SEQ ID NO: 1389556 - DNA, 17 bp, Homo sapiens
agaagttgtgaaactaa

SEQ ID NO: 1389557 - DNA, 15 bp, Homo sapiens
agaatagcttccaat

SEQ ID NO: 1389558 - DNA, 17 bp, Homo sapiens
agaatatccatgaccta

SEQ ID NO: 1389559 - DNA, 20 bp, Homo sapiens
agaatcttggtttgccttcc

SEQ ID NO: 1389560 - DNA, 16 bp, Homo sapiens
agaatgtaaagcttgt

SEQ ID NO: 1389561 - DNA, 14 bp, Homo sapiens
agaattactgtaac

SEQ ID NO: 1389562 - DNA, 15 bp, Homo sapiens
agaattatctaattt

SEQ ID NO: 1389563 - DNA, 18 bp, Homo sapiens
agaattatctaatttata

SEQ ID NO: 1389564 - DNA, 21 bp, Homo sapiens
agaattatctaatttataaaa

SEQ ID NO: 1389565 - DNA, 10 bp, Homo sapiens
aggttttcag

SEQ ID NO: 1389566 - DNA, 13 bp, Homo sapiens
agtaaaaaagtta

SEQ ID NO: 1389567 - DNA, 12 bp, Homo sapiens
agtaaaagcaaa

SEQ ID NO: 1389568 - DNA, 14 bp, Homo sapiens
agtaactcatctgt

SEQ ID NO: 1389569 - DNA, 18 bp, Homo sapiens
agtaagcctccctcctcg

SEQ ID NO: 1389570 - DNA, 23 bp, Homo sapiens
agtaatctgcattattggaatat

SEQ ID NO: 1389571 - DNA, 23 bp, Homo sapiens
agtaatttagaaatcattttgca

SEQ ID NO: 1389572 - DNA, 20 bp, Homo sapiens
agtacacagcaccagaatgt

SEQ ID NO: 1389573 - DNA, 16 bp, Homo sapiens
agtacagaattcaaca

SEQ ID NO: 1389574 - DNA, 14 bp, Homo sapiens
agtacattgttacc

SEQ ID NO: 1389575 - DNA, 19 bp, Homo sapiens
agtacattgttacctctat

SEQ ID NO: 1389576 - DNA, 13 bp, Homo sapiens
agtagagacaggg

SEQ ID NO: 1389577 - DNA, 22 bp, Homo sapiens
agtagatgcatttgggtccagg

SEQ ID NO: 1389578 - DNA, 17 bp, Homo sapiens
agtatacttttgtttca

SEQ ID NO: 1389579 - DNA, 14 bp, Homo sapiens
agtatccactttgc

SEQ ID NO: 1389580 - DNA, 18 bp, Homo sapiens
agtatttgttaatttaga

SEQ ID NO: 1389581 - DNA, 18 bp, Homo sapiens
agtattttagtgaacttg

SEQ ID NO: 1389582 - DNA, 20 bp, Homo sapiens
agtattttagtgaacttgaa

SEQ ID NO: 1389583 - DNA, 24 bp, Homo sapiens
agtcaatcaagtctgtttactgca

SEQ ID NO: 1389584 - DNA, 19 bp, Homo sapiens
agtcaccctacctgtgcct

SEQ ID NO: 1389585 - DNA, 15 bp, Homo sapiens
agtcagaacagcaga

SEQ ID NO: 1389586 - DNA, 17 bp, Homo sapiens
agtcagaacagcagact

SEQ ID NO: 1389587 - DNA, 17 bp, Homo sapiens
agtcagcattttcttag

SEQ ID NO: 1389588 - DNA, 19 bp, Homo sapiens
agtcattgggttttatcag

SEQ ID NO: 1389589 - DNA, 13 bp, Homo sapiens
agtccatcagcct

SEQ ID NO: 1389590 - DNA, 23 bp, Homo sapiens
agtccctgcctggaccagcctct

SEQ ID NO: 1389591 - DNA, 22 bp, Homo sapiens
agtcctggaagccagctttccc

SEQ ID NO: 1389592 - DNA, 19 bp, Homo sapiens
agtctcagaatgtcatttt

SEQ ID NO: 1389593 - DNA, 23 bp, Homo sapiens
agtctgagagaggccattctttc

SEQ ID NO: 1389594 - DNA, 20 bp, Homo sapiens
agtctggaaagtgatgtcag

SEQ ID NO: 1389595 - DNA, 21 bp, Homo sapiens
agtctgtccagataagttatt

SEQ ID NO: 1389596 - DNA, 18 bp, Homo sapiens
agtcttcctgacacttta

SEQ ID NO: 1389597 - DNA, 22 bp, Homo sapiens
agtgaagaatacttctcatttt

SEQ ID NO: 1389598 - DNA, 15 bp, Homo sapiens
agtgaagacagaagt

SEQ ID NO: 1389599 - DNA, 20 bp, Homo sapiens
agtgagaatctggctcctgt

SEQ ID NO: 1389600 - DNA, 16 bp, Homo sapiens
agtgagacagtctgga

SEQ ID NO: 1389601 - DNA, 22 bp, Homo sapiens
agtgagagacattaactcatta

SEQ ID NO: 1389602 - DNA, 15 bp, Homo sapiens
agtgattgtcttaat

SEQ ID NO: 1389603 - DNA, 17 bp, Homo sapiens
agtgattgtcttaatat

SEQ ID NO: 1389604 - DNA, 13 bp, Homo sapiens
agtgcaccaaaga

SEQ ID NO: 1389605 - DNA, 20 bp, Homo sapiens
agtgcagcaaccagagcact

SEQ ID NO: 1389606 - DNA, 22 bp, Homo sapiens
agtgcagcaaccagagcactgt

SEQ ID NO: 1389607 - DNA, 17 bp, Homo sapiens
agtgggaaaaatgtagg

SEQ ID NO: 1389608 - DNA, 14 bp, Homo sapiens
agtgggtggggagt

SEQ ID NO: 1389609 - DNA, 14 bp, Homo sapiens
agtgtacatatgta

SEQ ID NO: 1389610 - DNA, 19 bp, Homo sapiens
agtgtacatatgtaaaata

SEQ ID NO: 1389611 - DNA, 21 bp, Homo sapiens
agtgtacatatgtaaaatatt

SEQ ID NO: 1389612 - DNA, 15 bp, Homo sapiens
agtgtagaacctaat

SEQ ID NO: 1389613 - DNA, 16 bp, Homo sapiens
agtgtcactcaaggcg

SEQ ID NO: 1389614 - DNA, 17 bp, Homo sapiens
agtgtgaccaaaagtta

SEQ ID NO: 1389615 - DNA, 19 bp, Homo sapiens
agtgtgaccaaaagttaca

SEQ ID NO: 1389616 - DNA, 23 bp, Homo sapiens
agtgtgcgtggtggtccctgggt

SEQ ID NO: 1389617 - DNA, 14 bp, Homo sapiens
agtgttttctctga

SEQ ID NO: 1389618 - DNA, 18 bp, Homo sapiens
agttacctccaaaaaaga

SEQ ID NO: 1389619 - DNA, 15 bp, Homo sapiens
agttagctttaactt

SEQ ID NO: 1389620 - DNA, 20 bp, Homo sapiens
agttagtggattactgccat

SEQ ID NO: 1389621 - DNA, 16 bp, Homo sapiens
agttatttttattatt

SEQ ID NO: 1389622 - DNA, 13 bp, Homo sapiens
agttcaagaaata

SEQ ID NO: 1389623 - DNA, 13 bp, Homo sapiens
agttcatgagaat

SEQ ID NO: 1389624 - DNA, 12 bp, Homo sapiens
agttctgccagg

SEQ ID NO: 1389625 - DNA, 17 bp, Homo sapiens
agttgagacaagaaaat

SEQ ID NO: 1389626 - DNA, 17 bp, Homo sapiens
agttgataaagattttt

SEQ ID NO: 1389627 - DNA, 23 bp, Homo sapiens
agttgataaagattttttaataa

SEQ ID NO: 1389628 - DNA, 15 bp, Homo sapiens
agttgctatttgaac

SEQ ID NO: 1389629 - DNA, 16 bp, Homo sapiens
agttgctgcaaacctg

SEQ ID NO: 1389630 - DNA, 15 bp, Homo sapiens
agttggacacactgt

SEQ ID NO: 1389631 - DNA, 18 bp, Homo sapiens
agttgggactacaggcgt

SEQ ID NO: 1389632 - DNA, 16 bp, Homo sapiens
agtttatttgttgaga

SEQ ID NO: 1389633 - DNA, 18 bp, Homo sapiens
agtttatttgttgagagt

SEQ ID NO: 1389634 - DNA, 20 bp, Homo sapiens
agtttggatatgtaaaacat

SEQ ID NO: 1389635 - DNA, 16 bp, Homo sapiens
agttttcctatgcttt

SEQ ID NO: 1389636 - DNA, 18 bp, Homo sapiens
agttttgatatttctagc

SEQ ID NO: 1389637 - DNA, 17 bp, Homo sapiens
ataaaaatgatctaaac

SEQ ID NO: 1389638 - DNA, 12 bp, Homo sapiens
ataaaaatgttt

SEQ ID NO: 1389639 - DNA, 14 bp, Homo sapiens
ataaacgtttgaaa

SEQ ID NO: 1389640 - DNA, 18 bp, Homo sapiens
ataaagattttttaataa

SEQ ID NO: 1389641 - DNA, 14 bp, Homo sapiens
acccaaatattgtg

SEQ ID NO: 1389642 - DNA, 21 bp, Homo sapiens
acccacctgaggctcagccct

SEQ ID NO: 1389643 - DNA, 15 bp, Homo sapiens
acccagggctctgta

SEQ ID NO: 1389644 - DNA, 20 bp, Homo sapiens
acccatttaaatttttttcc

SEQ ID NO: 1389645 - DNA, 12 bp, Homo sapiens
acccctcccctc

SEQ ID NO: 1389646 - DNA, 13 bp, Homo sapiens
acccgttcaactt

SEQ ID NO: 1389647 - DNA, 21 bp, Homo sapiens
acccgttcaacttttcctttg

SEQ ID NO: 1389648 - DNA, 13 bp, Homo sapiens
accctacctgtgc

SEQ ID NO: 1389649 - DNA, 14 bp, Homo sapiens
accctcatctttct

SEQ ID NO: 1389650 - DNA, 19 bp, Homo sapiens
accctcatctttcttccaa

SEQ ID NO: 1389651 - DNA, 23 bp, Homo sapiens
accctccccgcaccccccaagct

SEQ ID NO: 1389652 - DNA, 13 bp, Homo sapiens
accgctaaaagaa

SEQ ID NO: 1389653 - DNA, 15 bp, Homo sapiens
accgctaaaagaaac

SEQ ID NO: 1389654 - DNA, 15 bp, Homo sapiens
acctacctgttgagc

SEQ ID NO: 1389655 - DNA, 14 bp, Homo sapiens
acctagttttccat

SEQ ID NO: 1389656 - DNA, 12 bp, Homo sapiens
acctatgtcatt

SEQ ID NO: 1389657 - DNA, 16 bp, Homo sapiens
acctatgtcatttcat

SEQ ID NO: 1389658 - DNA, 22 bp, Homo sapiens
acctatgtcatttcatttccta

SEQ ID NO: 1389659 - DNA, 18 bp, Homo sapiens
acctatttcttaaacact

SEQ ID NO: 1389660 - DNA, 16 bp, Homo sapiens
acctcaactgcctact

SEQ ID NO: 1389661 - DNA, 14 bp, Homo sapiens
acctcaagctgcat

SEQ ID NO: 1389662 - DNA, 19 bp, Homo sapiens
acctccaaagcttcccacg

SEQ ID NO: 1389663 - DNA, 16 bp, Homo sapiens
acctccccctcttggt

SEQ ID NO: 1389664 - DNA, 23 bp, Homo sapiens
acctcgcccagcggcatcaggct

SEQ ID NO: 1389665 - DNA, 21 bp, Homo sapiens
acctctcccctggaactgtct

SEQ ID NO: 1389666 - DNA, 14 bp, Homo sapiens
acctgaggctggtt

SEQ ID NO: 1389667 - DNA, 21 bp, Homo sapiens
acctgagtcgtacagaaagct

SEQ ID NO: 1389668 - DNA, 18 bp, Homo sapiens
acctgatgaaaataaaga

SEQ ID NO: 1389669 - DNA, 23 bp, Homo sapiens
acctgccgagagtccatcagcct

SEQ ID NO: 1389670 - DNA, 23 bp, Homo sapiens
acctggaagcatttgtttctact

SEQ ID NO: 1389671 - DNA, 18 bp, Homo sapiens
acctgggttgcagacagg

SEQ ID NO: 1389672 - DNA, 17 bp, Homo sapiens
acctgttacctactttg

SEQ ID NO: 1389673 - DNA, 14 bp, Homo sapiens
acctgttgagcatc

SEQ ID NO: 1389674 - DNA, 20 bp, Homo sapiens
acctgttggttagctggaca

SEQ ID NO: 1389675 - DNA, 14 bp, Homo sapiens
accttaatttatta

SEQ ID NO: 1389676 - DNA, 22 bp, Homo sapiens
accttagctggcattacagctg

SEQ ID NO: 1389677 - DNA, 20 bp, Homo sapiens
accttgaagttctgaaattt

SEQ ID NO: 1389678 - DNA, 19 bp, Homo sapiens
acctttttatttgcatgtg

SEQ ID NO: 1389679 - DNA, 18 bp, Homo sapiens
accttttttcaacagtga

SEQ ID NO: 1389680 - DNA, 23 bp, Homo sapiens
accttttttcaacagtgaagaca

SEQ ID NO: 1389681 - DNA, 16 bp, Homo sapiens
acgccagacttcccac

SEQ ID NO: 1389682 - DNA, 22 bp, Homo sapiens
acgccagacttcccacggctcc

SEQ ID NO: 1389683 - DNA, 17 bp, Homo sapiens
acgctttttgaaaaagc

SEQ ID NO: 1389684 - DNA, 21 bp, Homo sapiens
acggcctttctagcctggcta

SEQ ID NO: 1389685 - DNA, 13 bp, Homo sapiens
acgtatttaatag

SEQ ID NO: 1389686 - DNA, 15 bp, Homo sapiens
acgtatttaatagca

SEQ ID NO: 1389687 - DNA, 21 bp, Homo sapiens
acgtgacacaaacacacacaa

SEQ ID NO: 1389688 - DNA, 13 bp, Homo sapiens
actaaaattttct

SEQ ID NO: 1389689 - DNA, 14 bp, Homo sapiens
actaaaattttcta

SEQ ID NO: 1389690 - DNA, 15 bp, Homo sapiens
actaaatcttttata

SEQ ID NO: 1389691 - DNA, 17 bp, Homo sapiens
actaaggaatatatatg

SEQ ID NO: 1389692 - DNA, 23 bp, Homo sapiens
actaatgccttactcttcttgaa

SEQ ID NO: 1389693 - DNA, 16 bp, Homo sapiens
actacaaccaatggaa

SEQ ID NO: 1389694 - DNA, 17 bp, Homo sapiens
actacagtctaaagctg

SEQ ID NO: 1389695 - DNA, 14 bp, Homo sapiens
actacatgcacttg

SEQ ID NO: 1389696 - DNA, 12 bp, Homo sapiens
actagacaagcc

SEQ ID NO: 1389697 - DNA, 17 bp, Homo sapiens
actagacaagccagaac

SEQ ID NO: 1389698 - DNA, 19 bp, Homo sapiens
actagagttagatatgtgc

SEQ ID NO: 1389699 - DNA, 13 bp, Homo sapiens
actataagaactt

SEQ ID NO: 1389700 - DNA, 14 bp, Homo sapiens
actataagaacttt

SEQ ID NO: 1389701 - DNA, 19 bp, Homo sapiens
actataagaactttgagct

SEQ ID NO: 1389702 - DNA, 20 bp, Homo sapiens
actataagcaagaaggcaaa

SEQ ID NO: 1389703 - DNA, 20 bp, Homo sapiens
actatccaattaaaattaag

SEQ ID NO: 1389704 - DNA, 23 bp, Homo sapiens
actatctctagagtgagaatctg

SEQ ID NO: 1389705 - DNA, 18 bp, Homo sapiens
actatctttcagctccag

SEQ ID NO: 1389706 - DNA, 16 bp, Homo sapiens
actatgaaaagctaga

SEQ ID NO: 1389707 - DNA, 20 bp, Homo sapiens
actatggagtgcaccaaaga

SEQ ID NO: 1389708 - DNA, 23 bp, Homo sapiens
actatggagtgcaccaaagagaa

SEQ ID NO: 1389709 - DNA, 22 bp, Homo sapiens
actattggagagaaaaaattaa

SEQ ID NO: 1389710 - DNA, 17 bp, Homo sapiens
actcaaaatatttgtac

SEQ ID NO: 1389711 - DNA, 14 bp, Homo sapiens
actcaaactgagga

SEQ ID NO: 1389712 - DNA, 21 bp, Homo sapiens
actcaaactgaggaatttcac

SEQ ID NO: 1389713 - DNA, 18 bp, Homo sapiens
actcaaggcggtgcttga

SEQ ID NO: 1389714 - DNA, 12 bp, Homo sapiens
actcacctcctc

SEQ ID NO: 1389715 - DNA, 13 bp, Homo sapiens
actcacctcctcc

SEQ ID NO: 1389716 - DNA, 13 bp, Homo sapiens
atataatttaaca

SEQ ID NO: 1389717 - DNA, 15 bp, Homo sapiens
atataatttaacaga

SEQ ID NO: 1389718 - DNA, 19 bp, Homo sapiens
atataatttaacagaagtt

SEQ ID NO: 1389719 - DNA, 15 bp, Homo sapiens
atatacagctcagaa

SEQ ID NO: 1389720 - DNA, 19 bp, Homo sapiens
atatatatggaataagtgt

SEQ ID NO: 1389721 - DNA, 21 bp, Homo sapiens
atatatatggaataagtgtac

SEQ ID NO: 1389722 - DNA, 16 bp, Homo sapiens
atatatattatctttt

SEQ ID NO: 1389723 - DNA, 18 bp, Homo sapiens
atatatggaataagtgta

SEQ ID NO: 1389724 - DNA, 13 bp, Homo sapiens
atatatgtacagt

SEQ ID NO: 1389725 - DNA, 14 bp, Homo sapiens
atatatgtacagtt

SEQ ID NO: 1389726 - DNA, 20 bp, Homo sapiens
atatccctcctgttgggaga

SEQ ID NO: 1389727 - DNA, 15 bp, Homo sapiens
atatcctaaacatca

SEQ ID NO: 1389728 - DNA, 13 bp, Homo sapiens
atatcctgcttga

SEQ ID NO: 1389729 - DNA, 13 bp, Homo sapiens
atatctcctgaaa

SEQ ID NO: 1389730 - DNA, 23 bp, Homo sapiens
atatctcctgaaaaggtttatga

SEQ ID NO: 1389731 - DNA, 21 bp, Homo sapiens
atatgactgtttttcggacag

SEQ ID NO: 1389732 - DNA, 21 bp, Homo sapiens
atatgatgttaaaaaaataag

SEQ ID NO: 1389733 - DNA, 15 bp, Homo sapiens
atatggaataagtgt

SEQ ID NO: 1389734 - DNA, 24 bp, Homo sapiens
atatgtaaaacatttattttgaca

SEQ ID NO: 1389735 - DNA, 19 bp, Homo sapiens
atattattcctcaaaaaat

SEQ ID NO: 1389736 - DNA, 23 bp, Homo sapiens
atattcctattgtgcaatgtaaa

SEQ ID NO: 1389737 - DNA, 21 bp, Homo sapiens
atattctggattataaaaatg

SEQ ID NO: 1389738 - DNA, 22 bp, Homo sapiens
atattctggattataaaaatga

SEQ ID NO: 1389739 - DNA, 13 bp, Homo sapiens
atattgatttatt

SEQ ID NO: 1389740 - DNA, 21 bp, Homo sapiens
atattgtgggtgttaattttt

SEQ ID NO: 1389741 - DNA, 12 bp, Homo sapiens
atatttatatgt

SEQ ID NO: 1389742 - DNA, 17 bp, Homo sapiens
atatttatatgttatta

SEQ ID NO: 1389743 - DNA, 23 bp, Homo sapiens
atatttatatgttattaaacagg

SEQ ID NO: 1389744 - DNA, 20 bp, Homo sapiens
atatttatgtgttttaataa

SEQ ID NO: 1389745 - DNA, 18 bp, Homo sapiens
atatttatttaaacaaat

SEQ ID NO: 1389746 - DNA, 22 bp, Homo sapiens
atatttatttaaacaaatgtgt

SEQ ID NO: 1389747 - DNA, 14 bp, Homo sapiens
atatttttatcttt

SEQ ID NO: 1389748 - DNA, 18 bp, Homo sapiens
atcaaaagggccaaagaa

SEQ ID NO: 1389749 - DNA, 22 bp, Homo sapiens
atcaaacaccaacataaaaatg

SEQ ID NO: 1389750 - DNA, 23 bp, Homo sapiens
atcaaacaccaacataaaaatga

SEQ ID NO: 1389751 - DNA, 19 bp, Homo sapiens
atcaaccccagacactggt

SEQ ID NO: 1389752 - DNA, 11 bp, Homo sapiens
atcaactgaat

SEQ ID NO: 1389753 - DNA, 16 bp, Homo sapiens
atcaagggtcaggcct

SEQ ID NO: 1389754 - DNA, 14 bp, Homo sapiens
atcacgctttcctg

SEQ ID NO: 1389755 - DNA, 15 bp, Homo sapiens
atcactgagttttcc

SEQ ID NO: 1389756 - DNA, 17 bp, Homo sapiens
atcactgagttttccat

SEQ ID NO: 1389757 - DNA, 15 bp, Homo sapiens
atcagatagcatctt

SEQ ID NO: 1389758 - DNA, 22 bp, Homo sapiens
atcaggctttcttaaagtgaga

SEQ ID NO: 1389759 - DNA, 16 bp, Homo sapiens
atcagtgcttaatgtg

SEQ ID NO: 1389760 - DNA, 12 bp, Homo sapiens
atcatagaaatg

SEQ ID NO: 1389761 - DNA, 20 bp, Homo sapiens
atccaactaatgccttactc

SEQ ID NO: 1389762 - DNA, 16 bp, Homo sapiens
atccagtgatccttac

SEQ ID NO: 1389763 - DNA, 16 bp, Homo sapiens
atccagttcatgagaa

SEQ ID NO: 1389764 - DNA, 11 bp, Homo sapiens
atcccaacact

SEQ ID NO: 1389765 - DNA, 20 bp, Homo sapiens
atcccaagtagaatctcagt

SEQ ID NO: 1389766 - DNA, 15 bp, Homo sapiens
atccctcctgttggg

SEQ ID NO: 1389767 - DNA, 11 bp, Homo sapiens
atccctggccc

SEQ ID NO: 1389768 - DNA, 16 bp, Homo sapiens
atccctggccccctcc

SEQ ID NO: 1389769 - DNA, 15 bp, Homo sapiens
atccctgggccttgg

SEQ ID NO: 1389770 - DNA, 20 bp, Homo sapiens
atcccttaatatcctaaaca

SEQ ID NO: 1389771 - DNA, 16 bp, Homo sapiens
atcctaccccctgtgc

SEQ ID NO: 1389772 - DNA, 14 bp, Homo sapiens
atcctgcttcagtg

SEQ ID NO: 1389773 - DNA, 12 bp, Homo sapiens
atcctgcttgat

SEQ ID NO: 1389774 - DNA, 20 bp, Homo sapiens
atcctgtattcagacagatg

SEQ ID NO: 1389775 - DNA, 21 bp, Homo sapiens
atcctgtattcagacagatga

SEQ ID NO: 1389776 - DNA, 19 bp, Homo sapiens
atcctgtcgattagactgg

SEQ ID NO: 1389777 - DNA, 14 bp, Homo sapiens
atcctgtctgaaaa

SEQ ID NO: 1389778 - DNA, 13 bp, Homo sapiens
atccttacaagtt

SEQ ID NO: 1389779 - DNA, 18 bp, Homo sapiens
atccttagatctggcatg

SEQ ID NO: 1389780 - DNA, 14 bp, Homo sapiens
atcgaatgaaatta

SEQ ID NO: 1389781 - DNA, 18 bp, Homo sapiens
atcgtctcatgtaaaata

SEQ ID NO: 1389782 - DNA, 14 bp, Homo sapiens
atctaatttataaa

SEQ ID NO: 1389783 - DNA, 15 bp, Homo sapiens
atctaatttataaaa

SEQ ID NO: 1389784 - DNA, 15 bp, Homo sapiens
atctacttccaaact

SEQ ID NO: 1389785 - DNA, 23 bp, Homo sapiens
atctagaggcttccttcatttcc

SEQ ID NO: 1389786 - DNA, 22 bp, Homo sapiens
atctcaccaggcagcctctggg

SEQ ID NO: 1389787 - DNA, 17 bp, Homo sapiens
atctcaggccagagcca

SEQ ID NO: 1389788 - DNA, 15 bp, Homo sapiens
atctcagtgaagaat

SEQ ID NO: 1389789 - DNA, 20 bp, Homo sapiens
atctcagtgaagaatacttc

SEQ ID NO: 1389790 - DNA, 14 bp, Homo sapiens
atctccctgcctcc

SEQ ID NO: 1389791 - DNA, 16 bp, Homo sapiens
atctccctgcctcctg

SEQ ID NO: 1389792 - DNA, 12 bp, Homo sapiens
atctcctgaaaa

SEQ ID NO: 1389793 - DNA, 13 bp, Homo sapiens
atctctgtaaagc

SEQ ID NO: 1389794 - DNA, 18 bp, Homo sapiens
atctctgtaaagctaaaa

SEQ ID NO: 1389795 - DNA, 12 bp, Homo sapiens
atctgaattttt

SEQ ID NO: 1389796 - DNA, 19 bp, Homo sapiens
atctgaatttttaaacaag

SEQ ID NO: 1389797 - DNA, 20 bp, Homo sapiens
atctgaatttttaaacaagt

SEQ ID NO: 1389798 - DNA, 22 bp, Homo sapiens
atctgagaaaagctttgaaccc

SEQ ID NO: 1389799 - DNA, 17 bp, Homo sapiens
aagcaaatcgaatgaaa

SEQ ID NO: 1389800 - DNA, 18 bp, Homo sapiens
aagcaacctcagtaattt

SEQ ID NO: 1389801 - DNA, 21 bp, Homo sapiens
aagcaacctcagtaatttaga

SEQ ID NO: 1389802 - DNA, 22 bp, Homo sapiens
aagcaacctcagtaatttagaa

SEQ ID NO: 1389803 - DNA, 15 bp, Homo sapiens
aagcaagcattcaga

SEQ ID NO: 1389804 - DNA, 18 bp, Homo sapiens
aagcacattttaaaagtg

SEQ ID NO: 1389805 - DNA, 19 bp, Homo sapiens
aagcaccttagctggcatt

SEQ ID NO: 1389806 - DNA, 18 bp, Homo sapiens
aagcagcctcattctgag

SEQ ID NO: 1389807 - DNA, 23 bp, Homo sapiens
aagcagggtaccctttggggagc

SEQ ID NO: 1389808 - DNA, 13 bp, Homo sapiens
aagcattttgtaa

SEQ ID NO: 1389809 - DNA, 19 bp, Homo sapiens
aagcattttgtaagttgaa

SEQ ID NO: 1389810 - DNA, 23 bp, Homo sapiens
aagcattttgtaagttgaagcaa

SEQ ID NO: 1389811 - DNA, 12 bp, Homo sapiens
aagccaaaacaa

SEQ ID NO: 1389812 - DNA, 23 bp, Homo sapiens
aagccagattttttaaaatttat

SEQ ID NO: 1389813 - DNA, 14 bp, Homo sapiens
aagccagctttccc

SEQ ID NO: 1389814 - DNA, 15 bp, Homo sapiens
aagccagctttccct

SEQ ID NO: 1389815 - DNA, 23 bp, Homo sapiens
aagccagctttccctgcctctca

SEQ ID NO: 1389816 - DNA, 20 bp, Homo sapiens
aagccatggagattctcata

SEQ ID NO: 1389817 - DNA, 14 bp, Homo sapiens
aagcctccctcctc

SEQ ID NO: 1389818 - DNA, 21 bp, Homo sapiens
aagcctgcacaataaaaatgt

SEQ ID NO: 1389819 - DNA, 15 bp, Homo sapiens
aagcgaaaaaatcag

SEQ ID NO: 1389820 - DNA, 16 bp, Homo sapiens
aagctaaaataaagaa

SEQ ID NO: 1389821 - DNA, 18 bp, Homo sapiens
aagctgcatctagaggct

SEQ ID NO: 1389822 - DNA, 15 bp, Homo sapiens
aagctgcctggtata

SEQ ID NO: 1389823 - DNA, 13 bp, Homo sapiens
aagcttaaaactt

SEQ ID NO: 1389824 - DNA, 14 bp, Homo sapiens
aagcttaaaacttt

SEQ ID NO: 1389825 - DNA, 15 bp, Homo sapiens
aagcttaaaactttg

SEQ ID NO: 1389826 - DNA, 21 bp, Homo sapiens
aagcttaatggctgataattt

SEQ ID NO: 1389827 - DNA, 23 bp, Homo sapiens
aagcttcccacggcctttctagc

SEQ ID NO: 1389828 - DNA, 16 bp, Homo sapiens
aaggaatatatatgga

SEQ ID NO: 1389829 - DNA, 12 bp, Homo sapiens
aaggacctaaaa

SEQ ID NO: 1389830 - DNA, 17 bp, Homo sapiens
aaggaggggctgtaaaa

SEQ ID NO: 1389831 - DNA, 17 bp, Homo sapiens
aaggagtcactgagacc

SEQ ID NO: 1389832 - DNA, 20 bp, Homo sapiens
aaggattaagatacactcct

SEQ ID NO: 1389833 - DNA, 21 bp, Homo sapiens
aaggcaaaaatagtttggata

SEQ ID NO: 1389834 - DNA, 20 bp, Homo sapiens
aagggccaaagaaccaaaga

SEQ ID NO: 1389835 - DNA, 17 bp, Homo sapiens
aagggcttgaattgaag

SEQ ID NO: 1389836 - DNA, 13 bp, Homo sapiens
aaggggcttcagg

SEQ ID NO: 1389837 - DNA, 13 bp, Homo sapiens
aagggtcaggcct

SEQ ID NO: 1389838 - DNA, 14 bp, Homo sapiens
aagggtcaggcctt

SEQ ID NO: 1389839 - DNA, 19 bp, Homo sapiens
aaggtctttggttcagcta

SEQ ID NO: 1389840 - DNA, 14 bp, Homo sapiens
aagtaaaaaagtta

SEQ ID NO: 1389841 - DNA, 20 bp, Homo sapiens
aagtaataaaattcaacaaa

SEQ ID NO: 1389842 - DNA, 15 bp, Homo sapiens
aagtattatgtctct

SEQ ID NO: 1389843 - DNA, 11 bp, Homo sapiens
aagtatttagg

SEQ ID NO: 1389844 - DNA, 19 bp, Homo sapiens
aagtgactaatggcatgag

SEQ ID NO: 1389845 - DNA, 16 bp, Homo sapiens
aagtgccattaacaaa

SEQ ID NO: 1389846 - DNA, 19 bp, Homo sapiens
aagtgtacatatgtaaaat

SEQ ID NO: 1389847 - DNA, 22 bp, Homo sapiens
aagtgttttctctgaacacatt

SEQ ID NO: 1389848 - DNA, 13 bp, Homo sapiens
aagttaaatgtgt

SEQ ID NO: 1389849 - DNA, 12 bp, Homo sapiens
aagttaatttaa

SEQ ID NO: 1389850 - DNA, 16 bp, Homo sapiens
aagttaatttaaagtt

SEQ ID NO: 1389851 - DNA, 19 bp, Homo sapiens
aagttccaagttgctaata

SEQ ID NO: 1389852 - DNA, 16 bp, Homo sapiens
aagttctgaaatttaa

SEQ ID NO: 1389853 - DNA, 21 bp, Homo sapiens
aagttggggacacatgtattt

SEQ ID NO: 1389854 - DNA, 23 bp, Homo sapiens
aagttgtgaaactaaaattttct

SEQ ID NO: 1389855 - DNA, 20 bp, Homo sapiens
aagtttaatggtgccttcat

SEQ ID NO: 1389856 - DNA, 19 bp, Homo sapiens
aagtttgcactatctttca

SEQ ID NO: 1389857 - DNA, 15 bp, Homo sapiens
aataaaaatgtttaa

SEQ ID NO: 1389858 - DNA, 19 bp, Homo sapiens
aataaaattcaacaaacat

SEQ ID NO: 1389859 - DNA, 13 bp, Homo sapiens
aataaacaaataa

SEQ ID NO: 1389860 - DNA, 17 bp, Homo sapiens
aataaagcagcctcatt

SEQ ID NO: 1389861 - DNA, 11 bp, Homo sapiens
aataaagctgt

SEQ ID NO: 1389862 - DNA, 12 bp, Homo sapiens
aataaagtgtat

SEQ ID NO: 1389863 - DNA, 20 bp, Homo sapiens
aataagaaagccctaaaata

SEQ ID NO: 1389864 - DNA, 19 bp, Homo sapiens
aataaggtacaagaagcat

SEQ ID NO: 1389865 - DNA, 15 bp, Homo sapiens
aataagtgaaatttt

SEQ ID NO: 1389866 - DNA, 13 bp, Homo sapiens
aataagtgtacat

SEQ ID NO: 1389867 - DNA, 21 bp, Homo sapiens
aataatcacgctttcctgaat

SEQ ID NO: 1389868 - DNA, 22 bp, Homo sapiens
aatacatgctaagagaagtaga

SEQ ID NO: 1389869 - DNA, 23 bp, Homo sapiens
aatacatgctaagagaagtagaa

SEQ ID NO: 1389870 - DNA, 18 bp, Homo sapiens
aatactgctgagatacat

SEQ ID NO: 1389871 - DNA, 21 bp, Homo sapiens
aatactgctgagatacataca

SEQ ID NO: 1389872 - DNA, 16 bp, Homo sapiens
aatacttctcattttt

SEQ ID NO: 1389873 - DNA, 17 bp, Homo sapiens
aatagaacaaggctgag

SEQ ID NO: 1389874 - DNA, 19 bp, Homo sapiens
aatagatgtttgatagatt

SEQ ID NO: 1389875 - DNA, 13 bp, Homo sapiens
aatagcaaaagaa

SEQ ID NO: 1389876 - DNA, 15 bp, Homo sapiens
aatagcaaagaattg

SEQ ID NO: 1389877 - DNA, 16 bp, Homo sapiens
aatagtatttcccatt

SEQ ID NO: 1389878 - DNA, 20 bp, Homo sapiens
aatataatttaacagaagtt

SEQ ID NO: 1389879 - DNA, 18 bp, Homo sapiens
aatatacttttacaagta

SEQ ID NO: 1389880 - DNA, 19 bp, Homo sapiens
aatatatattatcttttca

SEQ ID NO: 1389881 - DNA, 12 bp, Homo sapiens
aatatccctcct

SEQ ID NO: 1389882 - DNA, 12 bp, Homo sapiens
aatatgctgtgg

SEQ ID NO: 1389883 - DNA, 15 bp, Homo sapiens
aatatgtaccaagaa

SEQ ID NO: 1389884 - DNA, 14 bp, Homo sapiens
aatattatgagatg

SEQ ID NO: 1389885 - DNA, 14 bp, Homo sapiens
aaataacaatgtgc

SEQ ID NO: 1389886 - DNA, 20 bp, Homo sapiens
aaataagtgaaattttaaaa

SEQ ID NO: 1389887 - DNA, 16 bp, Homo sapiens
aaataagtttttgttt

SEQ ID NO: 1389888 - DNA, 17 bp, Homo sapiens
aaataatactgctgaga

SEQ ID NO: 1389889 - DNA, 18 bp, Homo sapiens
aaatacatgctaagagaa

SEQ ID NO: 1389890 - DNA, 16 bp, Homo sapiens
aaatacttttttctat

SEQ ID NO: 1389891 - DNA, 12 bp, Homo sapiens
aaatataaatta

SEQ ID NO: 1389892 - DNA, 20 bp, Homo sapiens
aaatataaattaagacttta

SEQ ID NO: 1389893 - DNA, 16 bp, Homo sapiens
aaatattatgagatgc

SEQ ID NO: 1389894 - DNA, 19 bp, Homo sapiens
aaatattgtgcacatttaa

SEQ ID NO: 1389895 - DNA, 15 bp, Homo sapiens
aaatatttgtacata

SEQ ID NO: 1389896 - DNA, 17 bp, Homo sapiens
aaatattttaaagaatt

SEQ ID NO: 1389897 - DNA, 23 bp, Homo sapiens
aaatattttaaagaattgtgtca

SEQ ID NO: 1389898 - DNA, 22 bp, Homo sapiens
aaatcaaaagggccaaagaacc

SEQ ID NO: 1389899 - DNA, 14 bp, Homo sapiens
aaatctggcttctg

SEQ ID NO: 1389900 - DNA, 21 bp, Homo sapiens
aaatctggcttctggccagga

SEQ ID NO: 1389901 - DNA, 15 bp, Homo sapiens
aaatgaacataatga

SEQ ID NO: 1389902 - DNA, 13 bp, Homo sapiens
aaatgatctaaac

SEQ ID NO: 1389903 - DNA, 14 bp, Homo sapiens
aaatgattgtagta

SEQ ID NO: 1389904 - DNA, 19 bp, Homo sapiens
aaatggccatttgcttttt

SEQ ID NO: 1389905 - DNA, 20 bp, Homo sapiens
aaatggtaatttctactttg

SEQ ID NO: 1389906 - DNA, 13 bp, Homo sapiens
aaatgtaaagcca

SEQ ID NO: 1389907 - DNA, 23 bp, Homo sapiens
aaatgtgtaattttgagtacaga

SEQ ID NO: 1389908 - DNA, 15 bp, Homo sapiens
aaatgttcagaaggt

SEQ ID NO: 1389909 - DNA, 21 bp, Homo sapiens
aaatgttcagaaggttgctct

SEQ ID NO: 1389910 - DNA, 13 bp, Homo sapiens
aaattaaagcatt

SEQ ID NO: 1389911 - DNA, 20 bp, Homo sapiens
aaattaactgggtaatgaaa

SEQ ID NO: 1389912 - DNA, 21 bp, Homo sapiens
aaattaactgggtaatgaaac

SEQ ID NO: 1389913 - DNA, 14 bp, Homo sapiens
aaattaaggtctgg

SEQ ID NO: 1389914 - DNA, 22 bp, Homo sapiens
aaattacacccaaagaggtatt

SEQ ID NO: 1389915 - DNA, 12 bp, Homo sapiens
aaattatttaaa

SEQ ID NO: 1389916 - DNA, 13 bp, Homo sapiens
aaattatttaaac

SEQ ID NO: 1389917 - DNA, 14 bp, Homo sapiens
aaattgattttgaa

SEQ ID NO: 1389918 - DNA, 17 bp, Homo sapiens
aacaaaactgcatttca

SEQ ID NO: 1389919 - DNA, 17 bp, Homo sapiens
aacaaagagttcaagaa

SEQ ID NO: 1389920 - DNA, 16 bp, Homo sapiens
aacaaatagtctatca

SEQ ID NO: 1389921 - DNA, 14 bp, Homo sapiens
aacaacctcaactg

SEQ ID NO: 1389922 - DNA, 18 bp, Homo sapiens
aacaacctcaactgccta

SEQ ID NO: 1389923 - DNA, 22 bp, Homo sapiens
aacaagacctcagtgccttcct

SEQ ID NO: 1389924 - DNA, 14 bp, Homo sapiens
aacaattctaaaat

SEQ ID NO: 1389925 - DNA, 22 bp, Homo sapiens
aacaattctaaaatgattgtag

SEQ ID NO: 1389926 - DNA, 15 bp, Homo sapiens
aacacaggcaaaatc

SEQ ID NO: 1389927 - DNA, 19 bp, Homo sapiens
aacaccattgaaggcttaa

SEQ ID NO: 1389928 - DNA, 23 bp, Homo sapiens
aacacctcccaggagacagttca

SEQ ID NO: 1389929 - DNA, 15 bp, Homo sapiens
aacactaaaaataaa

SEQ ID NO: 1389930 - DNA, 12 bp, Homo sapiens
aacactgccagc

SEQ ID NO: 1389931 - DNA, 22 bp, Homo sapiens
aacactgccagcatttcccttc

SEQ ID NO: 1389932 - DNA, 13 bp, Homo sapiens
aacagaaacaaaa

SEQ ID NO: 1389933 - DNA, 15 bp, Homo sapiens
aacagaagttgtgaa

SEQ ID NO: 1389934 - DNA, 17 bp, Homo sapiens
aacagaagttgtgaaac

SEQ ID NO: 1389935 - DNA, 15 bp, Homo sapiens
aacagattgtttgca

SEQ ID NO: 1389936 - DNA, 16 bp, Homo sapiens
aacagattgtttgcaa

SEQ ID NO: 1389937 - DNA, 19 bp, Homo sapiens
aacagcagactcagctctg

SEQ ID NO: 1389938 - DNA, 21 bp, Homo sapiens
aacatagacagaagaaacaag

SEQ ID NO: 1389939 - DNA, 14 bp, Homo sapiens
aacatattgttgaa

SEQ ID NO: 1389940 - DNA, 20 bp, Homo sapiens
aacatgttatttgtaataga

SEQ ID NO: 1389941 - DNA, 20 bp, Homo sapiens
aacattgttaatataattta

SEQ ID NO: 1389942 - DNA, 17 bp, Homo sapiens
aacatttattttgacat

SEQ ID NO: 1389943 - DNA, 19 bp, Homo sapiens
aacatttattttgacataa

SEQ ID NO: 1389944 - DNA, 22 bp, Homo sapiens
aacatttctatagccaaaaata

SEQ ID NO: 1389945 - DNA, 16 bp, Homo sapiens
aaccaaagaagaaagt

SEQ ID NO: 1389946 - DNA, 17 bp, Homo sapiens
aaccacacccacactca

SEQ ID NO: 1389947 - DNA, 17 bp, Homo sapiens
aaccacactgttgagtt

SEQ ID NO: 1389948 - DNA, 14 bp, Homo sapiens
aaccagagcactgt

SEQ ID NO: 1389949 - DNA, 17 bp, Homo sapiens
aaccattaaccagatct

SEQ ID NO: 1389950 - DNA, 21 bp, Homo sapiens
aacccctcccctccatccctg

SEQ ID NO: 1389951 - DNA, 16 bp, Homo sapiens
aacctcaactgcctac

SEQ ID NO: 1389952 - DNA, 17 bp, Homo sapiens
aacctcaactgcctact

SEQ ID NO: 1389953 - DNA, 13 bp, Homo sapiens
aacctccacctcc

SEQ ID NO: 1389954 - DNA, 17 bp, Homo sapiens
aacctgacccctgctca

SEQ ID NO: 1389955 - DNA, 17 bp, Homo sapiens
aacctgatgaaaataaa

SEQ ID NO: 1389956 - DNA, 21 bp, Homo sapiens
aacctgatgaaaataaagaat

SEQ ID NO: 1389957 - DNA, 23 bp, Homo sapiens
aacctgatgaaaataaagaatgg

SEQ ID NO: 1389958 - DNA, 17 bp, Homo sapiens
aacctgggttgcagaca

SEQ ID NO: 1389959 - DNA, 21 bp, Homo sapiens
aacctgttacctactttgact

SEQ ID NO: 1389960 - DNA, 13 bp, Homo sapiens
aaccttctctatg

SEQ ID NO: 1389961 - DNA, 18 bp, Homo sapiens
aacctttcttcaccaaat

SEQ ID NO: 1389962 - DNA, 21 bp, Homo sapiens
aactagaggtgagaaatttaa

SEQ ID NO: 1389963 - DNA, 22 bp, Homo sapiens
aactagaggtgagaaatttaaa

SEQ ID NO: 1389964 - DNA, 14 bp, Homo sapiens
aactattttcagat

SEQ ID NO: 1389965 - DNA, 15 bp, Homo sapiens
aactcaaaatatttg

SEQ ID NO: 1389966 - DNA, 16 bp, Homo sapiens
aactcaaaatatttgt

SEQ ID NO: 1389967 - DNA, 20 bp, Homo sapiens
aactcaagaatttctaaact

SEQ ID NO: 1389968 - DNA, 17 bp, Homo sapiens
aactcctgacctcaggc

SEQ ID NO: 1389969 - DNA, 10 bp, Homo sapiens
aactcctgcc

SEQ ID NO: 1389970 - DNA, 15 bp, Homo sapiens
aactcgtatagcatg

SEQ ID NO: 1389971 - DNA, 15 bp, Homo sapiens
aactcttcactcttc

SEQ ID NO: 1389972 - DNA, 12 bp, Homo sapiens
aactgaaaatta

SEQ ID NO: 1389973 - DNA, 21 bp, Homo sapiens
aactgaacaccattgaaggct

SEQ ID NO: 1389974 - DNA, 17 bp, Homo sapiens
aactgattcacatctca

SEQ ID NO: 1389975 - DNA, 19 bp, Homo sapiens
aactgattcacatctcatt

SEQ ID NO: 1389976 - DNA, 18 bp, Homo sapiens
aactgcctaaaatgttct

SEQ ID NO: 1389977 - DNA, 16 bp, Homo sapiens
aactgcctactccaaa

SEQ ID NO: 1389978 - DNA, 20 bp, Homo sapiens
aactgcctactccaaaatgt

SEQ ID NO: 1389979 - DNA, 19 bp, Homo sapiens
aactggtagttcattgtaa

SEQ ID NO: 1389980 - DNA, 20 bp, Homo sapiens
aactggtagttcattgtaaa

SEQ ID NO: 1389981 - DNA, 17 bp, Homo sapiens
aactgtcaagtcatgat

SEQ ID NO: 1389982 - DNA, 19 bp, Homo sapiens
aactgtctctcatgaacct

SEQ ID NO: 1389983 - DNA, 20 bp, Homo sapiens
aactgtgtacataactgaaa

SEQ ID NO: 1389984 - DNA, 21 bp, Homo sapiens
aactgtgtacataactgaaaa

SEQ ID NO: 1389985 - DNA, 18 bp, Homo sapiens
aacttgaccctgagctga

SEQ ID NO: 1389986 - DNA, 18 bp, Homo sapiens
aacttggctgcaggaatc

SEQ ID NO: 1389987 - DNA, 19 bp, Homo sapiens
aacttggctgcaggaatct

SEQ ID NO: 1389988 - DNA, 22 bp, Homo sapiens
aacttggttttgctacataatt

SEQ ID NO: 1389989 - DNA, 20 bp, Homo sapiens
aagaaaaacaaactcgtttt

SEQ ID NO: 1389990 - DNA, 13 bp, Homo sapiens
aagaaaatcactt

SEQ ID NO: 1389991 - DNA, 21 bp, Homo sapiens
aagaaacctactgcccaggca

SEQ ID NO: 1389992 - DNA, 16 bp, Homo sapiens
aagaaactgaggaatt

SEQ ID NO: 1389993 - DNA, 19 bp, Homo sapiens
aagaaactgaggaattttc

SEQ ID NO: 1389994 - DNA, 13 bp, Homo sapiens
aagaaagtccacc

SEQ ID NO: 1389995 - DNA, 14 bp, Homo sapiens
aagaaatagaacaa

SEQ ID NO: 1389996 - DNA, 16 bp, Homo sapiens
aagaaccaaagaagaa

SEQ ID NO: 1389997 - DNA, 20 bp, Homo sapiens
aagaactttgagctactgcc

SEQ ID NO: 1389998 - DNA, 22 bp, Homo sapiens
aagaagcattttgtaagttgaa

SEQ ID NO: 1389999 - DNA, 22 bp, Homo sapiens
aagaataatcacgctttcctga

SEQ ID NO: 1390000 - DNA, 21 bp, Homo sapiens
aagaatcacaataattttcta

SEQ ID NO: 1390001 - DNA, 13 bp, Homo sapiens
aagaatttctaaa

SEQ ID NO: 1390002 - DNA, 17 bp, Homo sapiens
aagacatgtctgttcta

SEQ ID NO: 1390003 - DNA, 21 bp, Homo sapiens
aagactgctgtggccaggagg

SEQ ID NO: 1390004 - DNA, 13 bp, Homo sapiens
aagacttaagatt

SEQ ID NO: 1390005 - DNA, 14 bp, Homo sapiens
aagacttaagatta

SEQ ID NO: 1390006 - DNA, 18 bp, Homo sapiens
aagagaaatcagaaaaat

SEQ ID NO: 1390007 - DNA, 16 bp, Homo sapiens
aagagctacataattt

SEQ ID NO: 1390008 - DNA, 12 bp, Homo sapiens
aagagctcagga

SEQ ID NO: 1390009 - DNA, 14 bp, Homo sapiens
aagagttcaagaaa

SEQ ID NO: 1390010 - DNA, 17 bp, Homo sapiens
aagatacactcctgctg

SEQ ID NO: 1390011 - DNA, 18 bp, Homo sapiens
aagatacactcctgctgt

SEQ ID NO: 1390012 - DNA, 17 bp, Homo sapiens
aagatacttaagtgctg

SEQ ID NO: 1390013 - DNA, 13 bp, Homo sapiens
aagatatttatat

SEQ ID NO: 1390014 - DNA, 16 bp, Homo sapiens
aagatatttatatgtt

SEQ ID NO: 1390015 - DNA, 18 bp, Homo sapiens
aagatatttatatgttat

SEQ ID NO: 1390016 - DNA, 15 bp, Homo sapiens
aagatcttttatttt

SEQ ID NO: 1390017 - DNA, 22 bp, Homo sapiens
aagatgcttttaacagagtctg

SEQ ID NO: 1390018 - DNA, 16 bp, Homo sapiens
aagattgctgaaattt

SEQ ID NO: 1390019 - DNA, 18 bp, Homo sapiens
atgctttgaaacagaaaa

SEQ ID NO: 1390020 - DNA, 16 bp, Homo sapiens
atggaataagtgtaca

SEQ ID NO: 1390021 - DNA, 18 bp, Homo sapiens
atggagtgcaccaaagag

SEQ ID NO: 1390022 - DNA, 15 bp, Homo sapiens
atggcatgagaaata

SEQ ID NO: 1390023 - DNA, 17 bp, Homo sapiens
atggcatgagaaataca

SEQ ID NO: 1390024 - DNA, 19 bp, Homo sapiens
atggcatgagaaatacaaa

SEQ ID NO: 1390025 - DNA, 20 bp, Homo sapiens
atggctgataattttaaatt

SEQ ID NO: 1390026 - DNA, 21 bp, Homo sapiens
atgggagctggttagaaatgc

SEQ ID NO: 1390027 - DNA, 17 bp, Homo sapiens
atgggattctggacagg

SEQ ID NO: 1390028 - DNA, 21 bp, Homo sapiens
atggggcatcctctttttcca

SEQ ID NO: 1390029 - DNA, 16 bp, Homo sapiens
atggtaccagatgcag

SEQ ID NO: 1390030 - DNA, 17 bp, Homo sapiens
atggtcccttcttccct

SEQ ID NO: 1390031 - DNA, 19 bp, Homo sapiens
atggtgcattacgtgggca

SEQ ID NO: 1390032 - DNA, 22 bp, Homo sapiens
atggttattcccccctacttga

SEQ ID NO: 1390033 - DNA, 14 bp, Homo sapiens
atggttttctccaa

SEQ ID NO: 1390034 - DNA, 14 bp, Homo sapiens
atgtaaaacattta

SEQ ID NO: 1390035 - DNA, 13 bp, Homo sapiens
atgtaaaataaga

SEQ ID NO: 1390036 - DNA, 16 bp, Homo sapiens
atgtaaaatattgtta

SEQ ID NO: 1390037 - DNA, 13 bp, Homo sapiens
atgtaaatatttt

SEQ ID NO: 1390038 - DNA, 19 bp, Homo sapiens
atgtaaatattttaaagaa

SEQ ID NO: 1390039 - DNA, 16 bp, Homo sapiens
atgtaactgagaattt

SEQ ID NO: 1390040 - DNA, 16 bp, Homo sapiens
atgtacgataggtaga

SEQ ID NO: 1390041 - DNA, 17 bp, Homo sapiens
atgtatcatagaaatgt

SEQ ID NO: 1390042 - DNA, 13 bp, Homo sapiens
atgtcaaacaaat

SEQ ID NO: 1390043 - DNA, 15 bp, Homo sapiens
atgtcatttcatttc

SEQ ID NO: 1390044 - DNA, 16 bp, Homo sapiens
atgtctattcagcttc

SEQ ID NO: 1390045 - DNA, 13 bp, Homo sapiens
atgtctcttctga

SEQ ID NO: 1390046 - DNA, 14 bp, Homo sapiens
atgtctgttctaca

SEQ ID NO: 1390047 - DNA, 22 bp, Homo sapiens
atgtgaaccattaaccagatct

SEQ ID NO: 1390048 - DNA, 16 bp, Homo sapiens
atgtgacaggtaaact

SEQ ID NO: 1390049 - DNA, 16 bp, Homo sapiens
atgtgactctttccaa

SEQ ID NO: 1390050 - DNA, 21 bp, Homo sapiens
atgtgactctttccaaccggc

SEQ ID NO: 1390051 - DNA, 20 bp, Homo sapiens
atgtgataaggaaatcaact

SEQ ID NO: 1390052 - DNA, 22 bp, Homo sapiens
atgtggcccctgaacaagaatt

SEQ ID NO: 1390053 - DNA, 15 bp, Homo sapiens
atgtgtttgctttct

SEQ ID NO: 1390054 - DNA, 17 bp, Homo sapiens
atgtgtttgctttctga

SEQ ID NO: 1390055 - DNA, 22 bp, Homo sapiens
atgttaaaaaaataagaagaat

SEQ ID NO: 1390056 - DNA, 16 bp, Homo sapiens
atgttaagacttgaca

SEQ ID NO: 1390057 - DNA, 18 bp, Homo sapiens
atgttaagacttgacagt

SEQ ID NO: 1390058 - DNA, 20 bp, Homo sapiens
atgttaagggaagaattcca

SEQ ID NO: 1390059 - DNA, 15 bp, Homo sapiens
atgttaatattgatt

SEQ ID NO: 1390060 - DNA, 19 bp, Homo sapiens
atgttgctggactgtcata

SEQ ID NO: 1390061 - DNA, 19 bp, Homo sapiens
atgttggatagtcagctgt

SEQ ID NO: 1390062 - DNA, 12 bp, Homo sapiens
atgtttttaatg

SEQ ID NO: 1390063 - DNA, 14 bp, Homo sapiens
atgtttttaatgta

SEQ ID NO: 1390064 - DNA, 16 bp, Homo sapiens
atgtttttaatgtata

SEQ ID NO: 1390065 - DNA, 18 bp, Homo sapiens
attaaaaaggtttacaga

SEQ ID NO: 1390066 - DNA, 12 bp, Homo sapiens
attaaaattaag

SEQ ID NO: 1390067 - DNA, 22 bp, Homo sapiens
attaaacaggtggttcttttta

SEQ ID NO: 1390068 - DNA, 21 bp, Homo sapiens
attaaagaagggttgagctgg

SEQ ID NO: 1390069 - DNA, 24 bp, Homo sapiens
attaacatacctaagaagtacatt

SEQ ID NO: 1390070 - DNA, 19 bp, Homo sapiens
attaactgggtaatgaaac

SEQ ID NO: 1390071 - DNA, 21 bp, Homo sapiens
attaactggtagttcattgta

SEQ ID NO: 1390072 - DNA, 16 bp, Homo sapiens
attaagggacatgtat

SEQ ID NO: 1390073 - DNA, 17 bp, Homo sapiens
attaatatatattatct

SEQ ID NO: 1390074 - DNA, 14 bp, Homo sapiens
attaatatttatgt

SEQ ID NO: 1390075 - DNA, 17 bp, Homo sapiens
attaatatttatgtgtt

SEQ ID NO: 1390076 - DNA, 16 bp, Homo sapiens
attaatctgcctccct

SEQ ID NO: 1390077 - DNA, 18 bp, Homo sapiens
attacacccaaatattgt

SEQ ID NO: 1390078 - DNA, 19 bp, Homo sapiens
attacacttggtaattgta

SEQ ID NO: 1390079 - DNA, 13 bp, Homo sapiens
attacatgatctt

SEQ ID NO: 1390080 - DNA, 17 bp, Homo sapiens
attactcagtaatttgt

SEQ ID NO: 1390081 - DNA, 15 bp, Homo sapiens
attactggtccaaaa

SEQ ID NO: 1390082 - DNA, 19 bp, Homo sapiens
attacttatttttgacagt

SEQ ID NO: 1390083 - DNA, 21 bp, Homo sapiens
attagaagacaattgacaaca

SEQ ID NO: 1390084 - DNA, 17 bp, Homo sapiens
attataactggaaagaa

SEQ ID NO: 1390085 - DNA, 14 bp, Homo sapiens
attatctaatttat

SEQ ID NO: 1390086 - DNA, 22 bp, Homo sapiens
attatcttttcatacattttct

SEQ ID NO: 1390087 - DNA, 15 bp, Homo sapiens
attattacttttgct

SEQ ID NO: 1390088 - DNA, 16 bp, Homo sapiens
attattcctcaaaaaa

SEQ ID NO: 1390089 - DNA, 16 bp, Homo sapiens
attcaatctgtaaact

SEQ ID NO: 1390090 - DNA, 14 bp, Homo sapiens
attcagaagaaaaa

SEQ ID NO: 1390091 - DNA, 17 bp, Homo sapiens
attcagaagaaaaagaa

SEQ ID NO: 1390092 - DNA, 18 bp, Homo sapiens
attcatatttatgaatct

SEQ ID NO: 1390093 - DNA, 18 bp, Homo sapiens
attcattttaacatctga

SEQ ID NO: 1390094 - DNA, 15 bp, Homo sapiens
attcattttctctaa

SEQ ID NO: 1390095 - DNA, 22 bp, Homo sapiens
attccaagacatgtctgttcta

SEQ ID NO: 1390096 - DNA, 17 bp, Homo sapiens
attccagactttctatt

SEQ ID NO: 1390097 - DNA, 18 bp, Homo sapiens
attccagactttctatta

SEQ ID NO: 1390098 - DNA, 22 bp, Homo sapiens
attcccacccaattcaaaacat

SEQ ID NO: 1390099 - DNA, 17 bp, Homo sapiens
attcccagagcaaaata

SEQ ID NO: 1390100 - DNA, 17 bp, Homo sapiens
attcccccctacttgag

SEQ ID NO: 1390101 - DNA, 22 bp, Homo sapiens
attcccccctacttgagataat

SEQ ID NO: 1390102 - DNA, 14 bp, Homo sapiens
attcctcctgctca

SEQ ID NO: 1390103 - DNA, 15 bp, Homo sapiens
attcctcctgctcat

SEQ ID NO: 1390104 - DNA, 20 bp, Homo sapiens
attcctcctgctcatattgt

SEQ ID NO: 1390105 - DNA, 14 bp, Homo sapiens
attctaaaatgatt

SEQ ID NO: 1390106 - DNA, 20 bp, Homo sapiens
attctaaaatgattgtagta

SEQ ID NO: 1390107 - DNA, 14 bp, Homo sapiens
attctaaaatgcct

SEQ ID NO: 1390108 - DNA, 22 bp, Homo sapiens
attctgattcgaatgacactgt

SEQ ID NO: 1390109 - DNA, 15 bp, Homo sapiens
attctggacaggatg

SEQ ID NO: 1390110 - DNA, 22 bp, Homo sapiens
attctggattataaaaatgaat

SEQ ID NO: 1390111 - DNA, 17 bp, Homo sapiens
attcttcctagttttct

SEQ ID NO: 1390112 - DNA, 19 bp, Homo sapiens
attcttcctagttttctcc

SEQ ID NO: 1390113 - DNA, 13 bp, Homo sapiens
attctttcccaac

SEQ ID NO: 1390114 - DNA, 22 bp, Homo sapiens
attgaagctttactttagaatt

SEQ ID NO: 1390115 - DNA, 15 bp, Homo sapiens
attgaaggcttaaac

SEQ ID NO: 1390116 - DNA, 21 bp, Homo sapiens
attgagtctgtccagataagt

SEQ ID NO: 1390117 - DNA, 22 bp, Homo sapiens
attgagtctgtccagataagtt

SEQ ID NO: 1390118 - DNA, 12 bp, Homo sapiens
attgctgaaatt

SEQ ID NO: 1390119 - DNA, 13 bp, Homo sapiens
attgctgaaattt

SEQ ID NO: 1390120 - DNA, 20 bp, Homo sapiens
attggagagaaaaaattaac

SEQ ID NO: 1390121 - DNA, 14 bp, Homo sapiens
attggtaaacattt

SEQ ID NO: 1390122 - DNA, 19 bp, Homo sapiens
attgtaaatgaacataatg

SEQ ID NO: 1390123 - DNA, 15 bp, Homo sapiens
attgtactaaagcca

SEQ ID NO: 1390124 - DNA, 18 bp, Homo sapiens
attgtgattctgcctttg

SEQ ID NO: 1390125 - DNA, 17 bp, Homo sapiens
attgtgcaatgtaaata

SEQ ID NO: 1390126 - DNA, 20 bp, Homo sapiens
attgtgcacatttaataatc

SEQ ID NO: 1390127 - DNA, 23 bp, Homo sapiens
attgtggttccctaaagacaagt

SEQ ID NO: 1390128 - DNA, 17 bp, Homo sapiens
attgtgtcagactgttt

SEQ ID NO: 1390129 - DNA, 20 bp, Homo sapiens
attgtgttcccatttcagct

SEQ ID NO: 1390130 - DNA, 19 bp, Homo sapiens
attgttaatataatttaac

SEQ ID NO: 1390131 - DNA, 16 bp, Homo sapiens
atttaaaacagacact

SEQ ID NO: 1390132 - DNA, 13 bp, Homo sapiens
atttaaaatagca

SEQ ID NO: 1390133 - DNA, 18 bp, Homo sapiens
atttaaaccgctaaaaga

SEQ ID NO: 1390134 - DNA, 22 bp, Homo sapiens
atttaaaccgctaaaagaaact

SEQ ID NO: 1390135 - DNA, 24 bp, Homo sapiens
atttaaaccgctaaaagaaacttt

SEQ ID NO: 1390136 - DNA, 12 bp, Homo sapiens
atttaaactata

SEQ ID NO: 1390137 - DNA, 20 bp, Homo sapiens
atttaaactataagcaagaa

SEQ ID NO: 1390138 - DNA, 22 bp, Homo sapiens
atttaaagttgtttgtgccttt

SEQ ID NO: 1390139 - DNA, 13 bp, Homo sapiens
atttaaatctgtt

SEQ ID NO: 1390140 - DNA, 17 bp, Homo sapiens
atttaaatttttttcct

SEQ ID NO: 1390141 - DNA, 14 bp, Homo sapiens
atttaacagaagtt

SEQ ID NO: 1390142 - DNA, 16 bp, Homo sapiens
atttaacagaagttgt

SEQ ID NO: 1390143 - DNA, 13 bp, Homo sapiens
atttaactctctt

SEQ ID NO: 1390144 - DNA, 19 bp, Homo sapiens
atttaactgcctaaaatgt

SEQ ID NO: 1390145 - DNA, 23 bp, Homo sapiens
atttaactgcctaaaatgttctc

SEQ ID NO: 1390146 - DNA, 17 bp, Homo sapiens
atttaatagcaaagaat

SEQ ID NO: 1390147 - DNA, 18 bp, Homo sapiens
atttaatagcaaagaatt

SEQ ID NO: 1390148 - DNA, 14 bp, Homo sapiens
atttagaaaacttt

SEQ ID NO: 1390149 - DNA, 20 bp, Homo sapiens
catccagagtccctgcctgg

SEQ ID NO: 1390150 - DNA, 13 bp, Homo sapiens
catccagttcatg

SEQ ID NO: 1390151 - DNA, 18 bp, Homo sapiens
catccatgttccgagaag

SEQ ID NO: 1390152 - DNA, 19 bp, Homo sapiens
catccatgttccgagaaga

SEQ ID NO: 1390153 - DNA, 13 bp, Homo sapiens
catccctggcccc

SEQ ID NO: 1390154 - DNA, 20 bp, Homo sapiens
catccctggccccctccctg

SEQ ID NO: 1390155 - DNA, 22 bp, Homo sapiens
catccctggccccctccctgga

SEQ ID NO: 1390156 - DNA, 13 bp, Homo sapiens
catccctgggcct

SEQ ID NO: 1390157 - DNA, 17 bp, Homo sapiens
catccctgggccttggg

SEQ ID NO: 1390158 - DNA, 18 bp, Homo sapiens
catcctaccccctgtgcc

SEQ ID NO: 1390159 - DNA, 17 bp, Homo sapiens
catctcaggccagagcc

SEQ ID NO: 1390160 - DNA, 21 bp, Homo sapiens
catctcagtgaagaatacttc

SEQ ID NO: 1390161 - DNA, 20 bp, Homo sapiens
catcttttaatatgctgtgg

SEQ ID NO: 1390162 - DNA, 14 bp, Homo sapiens
catgactatggata

SEQ ID NO: 1390163 - DNA, 22 bp, Homo sapiens
catgagaaatacaaaaatactc

SEQ ID NO: 1390164 - DNA, 19 bp, Homo sapiens
catgagaatctatatttaa

SEQ ID NO: 1390165 - DNA, 23 bp, Homo sapiens
catgagctccttaaggctctttt

SEQ ID NO: 1390166 - DNA, 18 bp, Homo sapiens
catgataatgaacagaac

SEQ ID NO: 1390167 - DNA, 17 bp, Homo sapiens
catgatgcctctgtctt

SEQ ID NO: 1390168 - DNA, 16 bp, Homo sapiens
catgattcatgccaat

SEQ ID NO: 1390169 - DNA, 21 bp, Homo sapiens
catgattcatgccaattagca

SEQ ID NO: 1390170 - DNA, 15 bp, Homo sapiens
catgcatctgtttat

SEQ ID NO: 1390171 - DNA, 22 bp, Homo sapiens
catgcatctgtttattctatag

SEQ ID NO: 1390172 - DNA, 16 bp, Homo sapiens
catgcatgtcctgtaa

SEQ ID NO: 1390173 - DNA, 18 bp, Homo sapiens
catgccaggctaattttt

SEQ ID NO: 1390174 - DNA, 17 bp, Homo sapiens
catgcgtgtttctgact

SEQ ID NO: 1390175 - DNA, 13 bp, Homo sapiens
catgctaagagaa

SEQ ID NO: 1390176 - DNA, 19 bp, Homo sapiens
catgctaagagaagtagaa

SEQ ID NO: 1390177 - DNA, 17 bp, Homo sapiens
catgctggaaaataata

SEQ ID NO: 1390178 - DNA, 23 bp, Homo sapiens
catgctggaaaataatactgctg

SEQ ID NO: 1390179 - DNA, 16 bp, Homo sapiens
catggctaactggcga

SEQ ID NO: 1390180 - DNA, 14 bp, Homo sapiens
catggctattttat

SEQ ID NO: 1390181 - DNA, 17 bp, Homo sapiens
catgggaccacaactat

SEQ ID NO: 1390182 - DNA, 20 bp, Homo sapiens
catgtatctatgcattttct

SEQ ID NO: 1390183 - DNA, 23 bp, Homo sapiens
catgtatctatgcattttctgga

SEQ ID NO: 1390184 - DNA, 15 bp, Homo sapiens
catgtcaaacaaata

SEQ ID NO: 1390185 - DNA, 20 bp, Homo sapiens
catgtcaagggttcaagatt

SEQ ID NO: 1390186 - DNA, 17 bp, Homo sapiens
catgtccttctgagccc

SEQ ID NO: 1390187 - DNA, 14 bp, Homo sapiens
catgtgtttatcct

SEQ ID NO: 1390188 - DNA, 13 bp, Homo sapiens
catgttagccagg

SEQ ID NO: 1390189 - DNA, 16 bp, Homo sapiens
catgttagcccttcct

SEQ ID NO: 1390190 - DNA, 23 bp, Homo sapiens
catgttatttgtaatagatgttt

SEQ ID NO: 1390191 - DNA, 20 bp, Homo sapiens
catgtttgcacctttctagt

SEQ ID NO: 1390192 - DNA, 22 bp, Homo sapiens
catgtttggaaggggtctgtag

SEQ ID NO: 1390193 - DNA, 15 bp, Homo sapiens
cattaactcattaga

SEQ ID NO: 1390194 - DNA, 23 bp, Homo sapiens
cattactataagaactttgagct

SEQ ID NO: 1390195 - DNA, 16 bp, Homo sapiens
cattactgcatgcact

SEQ ID NO: 1390196 - DNA, 23 bp, Homo sapiens
cattactttaatactcacctcct

SEQ ID NO: 1390197 - DNA, 21 bp, Homo sapiens
cattagtacacagcaccagaa

SEQ ID NO: 1390198 - DNA, 12 bp, Homo sapiens
cattattacttt

SEQ ID NO: 1390199 - DNA, 16 bp, Homo sapiens
cattattacttttgct

SEQ ID NO: 1390200 - DNA, 18 bp, Homo sapiens
cattattacttttgctgt

SEQ ID NO: 1390201 - DNA, 13 bp, Homo sapiens
cattcagaagaaa

SEQ ID NO: 1390202 - DNA, 21 bp, Homo sapiens
cattccaactcgtatagcatg

SEQ ID NO: 1390203 - DNA, 22 bp, Homo sapiens
cattctgattcgaatgacactg

SEQ ID NO: 1390204 - DNA, 13 bp, Homo sapiens
cattcttcctagt

SEQ ID NO: 1390205 - DNA, 14 bp, Homo sapiens
cattctttcccaac

SEQ ID NO: 1390206 - DNA, 14 bp, Homo sapiens
cattgaaggcttaa

SEQ ID NO: 1390207 - DNA, 22 bp, Homo sapiens
cattgaatggctatgtttttaa

SEQ ID NO: 1390208 - DNA, 19 bp, Homo sapiens
cattgggttttatcagtgc

SEQ ID NO: 1390209 - DNA, 23 bp, Homo sapiens
cattgtaaatgaacataatgaac

SEQ ID NO: 1390210 - DNA, 22 bp, Homo sapiens
cattgtgccatgtcaaacaaat

SEQ ID NO: 1390211 - DNA, 18 bp, Homo sapiens
cattgttacctctatata

SEQ ID NO: 1390212 - DNA, 17 bp, Homo sapiens
cattgttatataatcat

SEQ ID NO: 1390213 - DNA, 12 bp, Homo sapiens
catttaataatc

SEQ ID NO: 1390214 - DNA, 15 bp, Homo sapiens
catttaggtttctga

SEQ ID NO: 1390215 - DNA, 13 bp, Homo sapiens
catttatattgat

SEQ ID NO: 1390216 - DNA, 20 bp, Homo sapiens
catttatattgataagatct

SEQ ID NO: 1390217 - DNA, 17 bp, Homo sapiens
catttatgagctcttca

SEQ ID NO: 1390218 - DNA, 23 bp, Homo sapiens
catttatgagctcttcatgtttc

SEQ ID NO: 1390219 - DNA, 23 bp, Homo sapiens
catttctatagccaaaaatagct

SEQ ID NO: 1390220 - DNA, 16 bp, Homo sapiens
catttggcatccctgg

SEQ ID NO: 1390221 - DNA, 14 bp, Homo sapiens
catttgggtccagg

SEQ ID NO: 1390222 - DNA, 17 bp, Homo sapiens
catttgggtccaggagg

SEQ ID NO: 1390223 - DNA, 18 bp, Homo sapiens
catttgggtccaggagga

SEQ ID NO: 1390224 - DNA, 20 bp, Homo sapiens
catttgttgtgactggcacc

SEQ ID NO: 1390225 - DNA, 16 bp, Homo sapiens
cattttaacatctgag

SEQ ID NO: 1390226 - DNA, 14 bp, Homo sapiens
cattttctaagaaa

SEQ ID NO: 1390227 - DNA, 12 bp, Homo sapiens
cattttctctaa

SEQ ID NO: 1390228 - DNA, 16 bp, Homo sapiens
cattttggtactttgg

SEQ ID NO: 1390229 - DNA, 18 bp, Homo sapiens
catttttaccatcactga

SEQ ID NO: 1390230 - DNA, 12 bp, Homo sapiens
ccaaaaatagct

SEQ ID NO: 1390231 - DNA, 14 bp, Homo sapiens
ccaaaacaatgttt

SEQ ID NO: 1390232 - DNA, 22 bp, Homo sapiens
ccaaaagattgctgaaatttta

SEQ ID NO: 1390233 - DNA, 20 bp, Homo sapiens
ccaaaagttacatgtttgca

SEQ ID NO: 1390234 - DNA, 19 bp, Homo sapiens
ccaaaataaaacctcagct

SEQ ID NO: 1390235 - DNA, 16 bp, Homo sapiens
ccaaactcctgcctgt

SEQ ID NO: 1390236 - DNA, 13 bp, Homo sapiens
ccaaagcacattt

SEQ ID NO: 1390237 - DNA, 19 bp, Homo sapiens
ccaaatcctgtctgaaaag

SEQ ID NO: 1390238 - DNA, 21 bp, Homo sapiens
ccaacaagaagggactgagag

SEQ ID NO: 1390239 - DNA, 15 bp, Homo sapiens
ccaacataaaaatga

SEQ ID NO: 1390240 - DNA, 19 bp, Homo sapiens
ccaactaatgccttactct

SEQ ID NO: 1390241 - DNA, 20 bp, Homo sapiens
ccaactaatgccttactctt

SEQ ID NO: 1390242 - DNA, 14 bp, Homo sapiens
ccaactcacctgag

SEQ ID NO: 1390243 - DNA, 17 bp, Homo sapiens
ccaagactgctgtggcc

SEQ ID NO: 1390244 - DNA, 21 bp, Homo sapiens
ccaagccccttggccctctcc

SEQ ID NO: 1390245 - DNA, 22 bp, Homo sapiens
ccaagccccttggccctctccc

SEQ ID NO: 1390246 - DNA, 22 bp, Homo sapiens
ccaagccttggggattcttcca

SEQ ID NO: 1390247 - DNA, 20 bp, Homo sapiens
ccaagctgtgaccctcaatt

SEQ ID NO: 1390248 - DNA, 14 bp, Homo sapiens
ccaagctgttttct

SEQ ID NO: 1390249 - DNA, 17 bp, Homo sapiens
ccaagctgttttcttct

SEQ ID NO: 1390250 - DNA, 17 bp, Homo sapiens
ccaaggagtcactgaga

SEQ ID NO: 1390251 - DNA, 22 bp, Homo sapiens
ccaatggaatgtgatgttcatg

SEQ ID NO: 1390252 - DNA, 14 bp, Homo sapiens
ccacaaactgtaat

SEQ ID NO: 1390253 - DNA, 21 bp, Homo sapiens
ccacagaatacaagccactac

SEQ ID NO: 1390254 - DNA, 18 bp, Homo sapiens
ccacagataactgaaaat

SEQ ID NO: 1390255 - DNA, 16 bp, Homo sapiens
ccaccatttggcatcc

SEQ ID NO: 1390256 - DNA, 18 bp, Homo sapiens
ccaccatttggcatccct

SEQ ID NO: 1390257 - DNA, 17 bp, Homo sapiens
ccacctgaggctcagcc

SEQ ID NO: 1390258 - DNA, 18 bp, Homo sapiens
ccactgctgatattttct

SEQ ID NO: 1390259 - DNA, 17 bp, Homo sapiens
ccactgtacttgctctt

SEQ ID NO: 1390260 - DNA, 18 bp, Homo sapiens
ccactgtacttgctcttg

SEQ ID NO: 1390261 - DNA, 22 bp, Homo sapiens
ccacttattccccattcttcct

SEQ ID NO: 1390262 - DNA, 21 bp, Homo sapiens
ccagaaagcagttgagacaag

SEQ ID NO: 1390263 - DNA, 13 bp, Homo sapiens
ccagacactggtt

SEQ ID NO: 1390264 - DNA, 22 bp, Homo sapiens
ccagactgcttccaattttctg

SEQ ID NO: 1390265 - DNA, 16 bp, Homo sapiens
ccagactttctacacc

SEQ ID NO: 1390266 - DNA, 15 bp, Homo sapiens
ccagactttctatta

SEQ ID NO: 1390267 - DNA, 21 bp, Homo sapiens
ccagactttctattaatattt

SEQ ID NO: 1390268 - DNA, 13 bp, Homo sapiens
ccagagcaaaata

SEQ ID NO: 1390269 - DNA, 11 bp, Homo sapiens
ccagagcactg

SEQ ID NO: 1390270 - DNA, 20 bp, Homo sapiens
ccagccatcaagagactgag

SEQ ID NO: 1390271 - DNA, 20 bp, Homo sapiens
ccagcctacccctcctgcgc

SEQ ID NO: 1390272 - DNA, 22 bp, Homo sapiens
ccagctggggccaggctgggtc

SEQ ID NO: 1390273 - DNA, 14 bp, Homo sapiens
ccagctgtgcttat

SEQ ID NO: 1390274 - DNA, 15 bp, Homo sapiens
ccagctgtgcttatg

SEQ ID NO: 1390275 - DNA, 18 bp, Homo sapiens
ccagctttccctgcctct

SEQ ID NO: 1390276 - DNA, 13 bp, Homo sapiens
ccaggagacaggt

SEQ ID NO: 1390277 - DNA, 16 bp, Homo sapiens
ccaggagcctgtgcct

SEQ ID NO: 1390278 - DNA, 17 bp, Homo sapiens
ccaggagcctgtgcctc

SEQ ID NO: 1390279 - DNA, 14 bp, Homo sapiens
ccaggaggacccag

SEQ ID NO: 1390280 - DNA, 16 bp, Homo sapiens
ccaggatagagactgg

SEQ ID NO: 1390281 - DNA, 14 bp, Homo sapiens
ccaggcagcctctg

SEQ ID NO: 1390282 - DNA, 16 bp, Homo sapiens
ccaggcagcctctggg

SEQ ID NO: 1390283 - DNA, 12 bp, Homo sapiens
ccaggctgggtc

SEQ ID NO: 1390284 - DNA, 20 bp, Homo sapiens
ccagggacacctgggagaaa

SEQ ID NO: 1390285 - DNA, 22 bp, Homo sapiens
ccagtcttcctgacactttaat

SEQ ID NO: 1390286 - DNA, 12 bp, Homo sapiens
ccagtgacagct

SEQ ID NO: 1390287 - DNA, 15 bp, Homo sapiens
ccagttggagttttt

SEQ ID NO: 1390288 - DNA, 23 bp, Homo sapiens
ccagttggagttttttgtaccaa

SEQ ID NO: 1390289 - DNA, 15 bp, Homo sapiens
ccataggaatcatgt

SEQ ID NO: 1390290 - DNA, 18 bp, Homo sapiens
ccatattgtaaaacaggt

SEQ ID NO: 1390291 - DNA, 18 bp, Homo sapiens
ccatcactgagttttcca

SEQ ID NO: 1390292 - DNA, 21 bp, Homo sapiens
ccatcatacgcatggtcctgg

SEQ ID NO: 1390293 - DNA, 22 bp, Homo sapiens
ccatccctggccccctccctgg

SEQ ID NO: 1390294 - DNA, 17 bp, Homo sapiens
ccatcctaccccctgtg

SEQ ID NO: 1390295 - DNA, 20 bp, Homo sapiens
ccatcttttaatatgctgtg

SEQ ID NO: 1390296 - DNA, 16 bp, Homo sapiens
ccatgtcaaacaaata

SEQ ID NO: 1390297 - DNA, 18 bp, Homo sapiens
ccatgttagccaggctgg

SEQ ID NO: 1390298 - DNA, 20 bp, Homo sapiens
ccattataaccttaatttat

SEQ ID NO: 1390299 - DNA, 13 bp, Homo sapiens
ccattctcctgag

SEQ ID NO: 1390300 - DNA, 14 bp, Homo sapiens
ccattcttcctagt

SEQ ID NO: 1390301 - DNA, 16 bp, Homo sapiens
ccatttaggtttctga

SEQ ID NO: 1390302 - DNA, 21 bp, Homo sapiens
ccatttaggtttctgagttcc

SEQ ID NO: 1390303 - DNA, 16 bp, Homo sapiens
ccatttgctttttcac

SEQ ID NO: 1390304 - DNA, 19 bp, Homo sapiens
ccatttggcatccctgggc

SEQ ID NO: 1390305 - DNA, 17 bp, Homo sapiens
cccaaccatttcctcag

SEQ ID NO: 1390306 - DNA, 18 bp, Homo sapiens
cccaaccatttcctcaga

SEQ ID NO: 1390307 - DNA, 19 bp, Homo sapiens
cccactgtatctaggcaac

SEQ ID NO: 1390308 - DNA, 16 bp, Homo sapiens
cccagacactggtttg

SEQ ID NO: 1390309 - DNA, 18 bp, Homo sapiens
cccagcacttgtgttgtc

SEQ ID NO: 1390310 - DNA, 21 bp, Homo sapiens
cccagcctacccctcctgcgc

SEQ ID NO: 1390311 - DNA, 20 bp, Homo sapiens
cccagctggggccaggctgg

SEQ ID NO: 1390312 - DNA, 22 bp, Homo sapiens
cccagctggggccaggctgggt

SEQ ID NO: 1390313 - DNA, 15 bp, Homo sapiens
cccaggaactgggcc

SEQ ID NO: 1390314 - DNA, 18 bp, Homo sapiens
cccagggacacctgggag

SEQ ID NO: 1390315 - DNA, 13 bp, Homo sapiens
cccagggctctgt

SEQ ID NO: 1390316 - DNA, 13 bp, Homo sapiens
cccaggtcctcac

SEQ ID NO: 1390317 - DNA, 15 bp, Homo sapiens
cccagtgacagctag

SEQ ID NO: 1390318 - DNA, 15 bp, Homo sapiens
cccatattgtaaaac

SEQ ID NO: 1390319 - DNA, 23 bp, Homo sapiens
cccatctcaggccagagccaagg

SEQ ID NO: 1390320 - DNA, 15 bp, Homo sapiens
cccatgagctcctta

SEQ ID NO: 1390321 - DNA, 21 bp, Homo sapiens
cccattcttcctagttttctc

SEQ ID NO: 1390322 - DNA, 20 bp, Homo sapiens
cccatttaaatttttttcct

SEQ ID NO: 1390323 - DNA, 14 bp, Homo sapiens
ccccacctggctca

SEQ ID NO: 1390324 - DNA, 14 bp, Homo sapiens
ccccactgtatcta

SEQ ID NO: 1390325 - DNA, 13 bp, Homo sapiens
ccccagacactgg

SEQ ID NO: 1390326 - DNA, 21 bp, Homo sapiens
ccccagctggggccaggctgg

SEQ ID NO: 1390327 - DNA, 22 bp, Homo sapiens
ccccagctgtcatcaattaaag

SEQ ID NO: 1390328 - DNA, 14 bp, Homo sapiens
ccccatctcaggcc

SEQ ID NO: 1390329 - DNA, 17 bp, Homo sapiens
ccccatctcaggccaga

SEQ ID NO: 1390330 - DNA, 18 bp, Homo sapiens
ccccatttaggtttctga

SEQ ID NO: 1390331 - DNA, 21 bp, Homo sapiens
ccccggggtattagcacctct

SEQ ID NO: 1390332 - DNA, 14 bp, Homo sapiens
cccctcccagccta

SEQ ID NO: 1390333 - DNA, 19 bp, Homo sapiens
cccctgcctctctgcaggt

SEQ ID NO: 1390334 - DNA, 18 bp, Homo sapiens
ccccttgacaactggcag

SEQ ID NO: 1390335 - DNA, 23 bp, Homo sapiens
ccccttgacaactggcaggcagg

SEQ ID NO: 1390336 - DNA, 18 bp, Homo sapiens
ccccttgcccatgcctcc

SEQ ID NO: 1390337 - DNA, 22 bp, Homo sapiens
ccccttgcccatgcctccagct

SEQ ID NO: 1390338 - DNA, 18 bp, Homo sapiens
ccctaataaagctgtgtg

SEQ ID NO: 1390339 - DNA, 19 bp, Homo sapiens
ccctacttcttttgctctt

SEQ ID NO: 1390340 - DNA, 13 bp, Homo sapiens
ccctccatccctg

SEQ ID NO: 1390341 - DNA, 13 bp, Homo sapiens
ccctcccagccta

SEQ ID NO: 1390342 - DNA, 17 bp, Homo sapiens
ccctccccgcacccccc

SEQ ID NO: 1390343 - DNA, 14 bp, Homo sapiens
ccctgaacaagaat

SEQ ID NO: 1390344 - DNA, 14 bp, Homo sapiens
ccctgagctgacca

SEQ ID NO: 1390345 - DNA, 21 bp, Homo sapiens
ccctgcctctctgcaggtccc

SEQ ID NO: 1390346 - DNA, 12 bp, Homo sapiens
ccctgcctggac

SEQ ID NO: 1390347 - DNA, 13 bp, Homo sapiens
ccctgcctggacc

SEQ ID NO: 1390348 - DNA, 18 bp, Homo sapiens
ccctgcctggaccagcct

SEQ ID NO: 1390349 - DNA, 18 bp, Homo sapiens
ccctggaactgtctctca

SEQ ID NO: 1390350 - DNA, 21 bp, Homo sapiens
ccctggaaggacatccatgtt

SEQ ID NO: 1390351 - DNA, 21 bp, Homo sapiens
ccctggactgtgtgctcagga

SEQ ID NO: 1390352 - DNA, 21 bp, Homo sapiens
ccctggccccctccctggatg

SEQ ID NO: 1390353 - DNA, 16 bp, Homo sapiens
ccctgggaggctctgg

SEQ ID NO: 1390354 - DNA, 18 bp, Homo sapiens
ccctgggaggctctggag

SEQ ID NO: 1390355 - DNA, 15 bp, Homo sapiens
ccctgggtaactgtc

SEQ ID NO: 1390356 - DNA, 22 bp, Homo sapiens
ccctgtgccttgtcacgccaga

SEQ ID NO: 1390357 - DNA, 17 bp, Homo sapiens
ccctttgcccagaaaga

SEQ ID NO: 1390358 - DNA, 23 bp, Homo sapiens
ccgaaggtgaggagcttgaaacc

SEQ ID NO: 1390359 - DNA, 22 bp, Homo sapiens
ccgacttttgtttaccagagaa

SEQ ID NO: 1390360 - DNA, 13 bp, Homo sapiens
ccgagaagaacag

SEQ ID NO: 1390361 - DNA, 20 bp, Homo sapiens
ccgagagtccatcagcctcc

SEQ ID NO: 1390362 - DNA, 21 bp, Homo sapiens
ccgagagtccatcagcctcca

SEQ ID NO: 1390363 - DNA, 23 bp, Homo sapiens
ccgcctcccaccactccactcct

SEQ ID NO: 1390364 - DNA, 14 bp, Homo sapiens
ccgctaaaagaaac

SEQ ID NO: 1390365 - DNA, 18 bp, Homo sapiens
ccgctaaaagaaactttc

SEQ ID NO: 1390366 - DNA, 14 bp, Homo sapiens
ccggcctgccagga

SEQ ID NO: 1390367 - DNA, 12 bp, Homo sapiens
ccgtcagtgctg

SEQ ID NO: 1390368 - DNA, 18 bp, Homo sapiens
ccgtccaggagcctgtgc

SEQ ID NO: 1390369 - DNA, 14 bp, Homo sapiens
ccgtgacgtctggg

SEQ ID NO: 1390370 - DNA, 16 bp, Homo sapiens
ccgtgacgtctgggtg

SEQ ID NO: 1390371 - DNA, 13 bp, Homo sapiens
cctaacctgccga

SEQ ID NO: 1390372 - DNA, 12 bp, Homo sapiens
cctaataaagct

SEQ ID NO: 1390373 - DNA, 19 bp, Homo sapiens
cctaataatatcccactgg

SEQ ID NO: 1390374 - DNA, 20 bp, Homo sapiens
cctaataatatcccactggg

SEQ ID NO: 1390375 - DNA, 20 bp, Homo sapiens
cctaattcaattcaaagctg

SEQ ID NO: 1390376 - DNA, 19 bp, Homo sapiens
cctacatgaaacagaaaca

SEQ ID NO: 1390377 - DNA, 13 bp, Homo sapiens
cctactgcccagg

SEQ ID NO: 1390378 - DNA, 16 bp, Homo sapiens
cctacttcttttgctc

SEQ ID NO: 1390379 - DNA, 21 bp, Homo sapiens
cctactttgactttttgcatt

SEQ ID NO: 1390380 - DNA, 13 bp, Homo sapiens
cctagccctctca

SEQ ID NO: 1390381 - DNA, 20 bp, Homo sapiens
cctagccctctcacatttat

SEQ ID NO: 1390382 - DNA, 21 bp, Homo sapiens
cctagcgctatctccctgcct

SEQ ID NO: 1390383 - DNA, 17 bp, Homo sapiens
cctaggctccaccccat

SEQ ID NO: 1390384 - DNA, 15 bp, Homo sapiens
cctagttttctcctc

SEQ ID NO: 1390385 - DNA, 19 bp, Homo sapiens
cctagttttctcctcccag

SEQ ID NO: 1390386 - DNA, 22 bp, Homo sapiens
cctatactgcttggagctgagc

SEQ ID NO: 1390387 - DNA, 23 bp, Homo sapiens
cctatactgcttggagctgagca

SEQ ID NO: 1390388 - DNA, 17 bp, Homo sapiens
cctatgatattttctgt

SEQ ID NO: 1390389 - DNA, 19 bp, Homo sapiens
cctattgtgcaatgtaaat

SEQ ID NO: 1390390 - DNA, 20 bp, Homo sapiens
cctcaaaaagatttccccat

SEQ ID NO: 1390391 - DNA, 16 bp, Homo sapiens
cctcaatttctgaaca

SEQ ID NO: 1390392 - DNA, 19 bp, Homo sapiens
cctcacccccagctttgct

SEQ ID NO: 1390393 - DNA, 21 bp, Homo sapiens
cctcagactctaagaaagaac

SEQ ID NO: 1390394 - DNA, 18 bp, Homo sapiens
cctcagctagctctgcca

SEQ ID NO: 1390395 - DNA, 15 bp, Homo sapiens
cctcagggactcagg

SEQ ID NO: 1390396 - DNA, 17 bp, Homo sapiens
cctcattctgaggcctg

SEQ ID NO: 1390397 - DNA, 16 bp, Homo sapiens
cctccaaactcctgcc

SEQ ID NO: 1390398 - DNA, 20 bp, Homo sapiens
cctccaaggaggggctgtaa

SEQ ID NO: 1390399 - DNA, 13 bp, Homo sapiens
cctccacctcctg

SEQ ID NO: 1390400 - DNA, 12 bp, Homo sapiens
cctccatccctg

SEQ ID NO: 1390401 - DNA, 16 bp, Homo sapiens
cctccatccctggccc

SEQ ID NO: 1390402 - DNA, 17 bp, Homo sapiens
cctccatcctaccccct

SEQ ID NO: 1390403 - DNA, 22 bp, Homo sapiens
cctccatcctaccccctgtgcc

SEQ ID NO: 1390404 - DNA, 14 bp, Homo sapiens
cctcccaagcagtt

SEQ ID NO: 1390405 - DNA, 12 bp, Homo sapiens
cctcccagccta

SEQ ID NO: 1390406 - DNA, 13 bp, Homo sapiens
cctccctcctcgt

SEQ ID NO: 1390407 - DNA, 17 bp, Homo sapiens
cctcctagcaagacctg

SEQ ID NO: 1390408 - DNA, 14 bp, Homo sapiens
cctcctcaccccca

SEQ ID NO: 1390409 - DNA, 16 bp, Homo sapiens
cctcctcacccccagc

SEQ ID NO: 1390410 - DNA, 20 bp, Homo sapiens
cctcgcccagcggcatcagg

SEQ ID NO: 1390411 - DNA, 21 bp, Homo sapiens
cctcgcccagcggcatcaggc

SEQ ID NO: 1390412 - DNA, 16 bp, Homo sapiens
cctcgtcccctgcctc

SEQ ID NO: 1390413 - DNA, 14 bp, Homo sapiens
cctctaccaagctg

SEQ ID NO: 1390414 - DNA, 15 bp, Homo sapiens
cctctaggaaatgta

SEQ ID NO: 1390415 - DNA, 13 bp, Homo sapiens
cctctctgcaggt

SEQ ID NO: 1390416 - DNA, 15 bp, Homo sapiens
cctctctgcaggtcc

SEQ ID NO: 1390417 - DNA, 18 bp, Homo sapiens
cctctctgcaggtcccta

SEQ ID NO: 1390418 - DNA, 22 bp, Homo sapiens
cctctctgcaggtccctaataa

SEQ ID NO: 1390419 - DNA, 20 bp, Homo sapiens
cctctggggggtggccaggc

SEQ ID NO: 1390420 - DNA, 17 bp, Homo sapiens
cctcttctattttgtaa

SEQ ID NO: 1390421 - DNA, 18 bp, Homo sapiens
cctcttctattttgtaaa

SEQ ID NO: 1390422 - DNA, 15 bp, Homo sapiens
cctgaaatttcagat

SEQ ID NO: 1390423 - DNA, 13 bp, Homo sapiens
cctgaacaagaat

SEQ ID NO: 1390424 - DNA, 15 bp, Homo sapiens
cctgaacaagaattg

SEQ ID NO: 1390425 - DNA, 21 bp, Homo sapiens
cctgaatccaaactaatccat

SEQ ID NO: 1390426 - DNA, 21 bp, Homo sapiens
cctgaattttgttgctgtttt

SEQ ID NO: 1390427 - DNA, 15 bp, Homo sapiens
cctgacactttaatt

SEQ ID NO: 1390428 - DNA, 15 bp, Homo sapiens
cctgacccctgctca

SEQ ID NO: 1390429 - DNA, 16 bp, Homo sapiens
cctgacccctgctcag

SEQ ID NO: 1390430 - DNA, 17 bp, Homo sapiens
cctgagctgaccagccg

SEQ ID NO: 1390431 - DNA, 17 bp, Homo sapiens
cctgaggctcagcccta

SEQ ID NO: 1390432 - DNA, 23 bp, Homo sapiens
cctgagtcaccctacctgtgcct

SEQ ID NO: 1390433 - DNA, 22 bp, Homo sapiens
cctgagtcgtacagaaagctgc

SEQ ID NO: 1390434 - DNA, 13 bp, Homo sapiens
cctgatgaaaata

SEQ ID NO: 1390435 - DNA, 14 bp, Homo sapiens
cctgatgaaaataa

SEQ ID NO: 1390436 - DNA, 19 bp, Homo sapiens
cctgatgaaaataaagaat

SEQ ID NO: 1390437 - DNA, 16 bp, Homo sapiens
cctgattttttttcct

SEQ ID NO: 1390438 - DNA, 15 bp, Homo sapiens
cctgcagactcactg

SEQ ID NO: 1390439 - DNA, 16 bp, Homo sapiens
cctgcagactcactgt

SEQ ID NO: 1390440 - DNA, 22 bp, Homo sapiens
cctgcaggatctcaccaggcag

SEQ ID NO: 1390441 - DNA, 23 bp, Homo sapiens
cctgcatccattctcctgaggat

SEQ ID NO: 1390442 - DNA, 21 bp, Homo sapiens
cctgccaggagctttggacct

SEQ ID NO: 1390443 - DNA, 13 bp, Homo sapiens
cctgccaggagga

SEQ ID NO: 1390444 - DNA, 15 bp, Homo sapiens
cctgccaggaggacc

SEQ ID NO: 1390445 - DNA, 22 bp, Homo sapiens
cctgcccagtgcacttgctgga

SEQ ID NO: 1390446 - DNA, 16 bp, Homo sapiens
cctgcccatgggagct

SEQ ID NO: 1390447 - DNA, 14 bp, Homo sapiens
cctgccgagagtcc

SEQ ID NO: 1390448 - DNA, 18 bp, Homo sapiens
cctgcctcccatgcctgg

SEQ ID NO: 1390449 - DNA, 22 bp, Homo sapiens
cctgcctcccatgcctggtccc

SEQ ID NO: 1390450 - DNA, 13 bp, Homo sapiens
cctgcctctctgc

SEQ ID NO: 1390451 - DNA, 14 bp, Homo sapiens
cctgcctctctgca

SEQ ID NO: 1390452 - DNA, 17 bp, Homo sapiens
cctgcctctctgcaggt

SEQ ID NO: 1390453 - DNA, 20 bp, Homo sapiens
cctgcctctctgcaggtccc

SEQ ID NO: 1390454 - DNA, 12 bp, Homo sapiens
cctgcctggacc

SEQ ID NO: 1390455 - DNA, 15 bp, Homo sapiens
cctgctatttgaagt

SEQ ID NO: 1390456 - DNA, 20 bp, Homo sapiens
cctggaactgtctctcatga

SEQ ID NO: 1390457 - DNA, 14 bp, Homo sapiens
cctggaccagcctc

SEQ ID NO: 1390458 - DNA, 15 bp, Homo sapiens
cctggaccagcctct

SEQ ID NO: 1390459 - DNA, 16 bp, Homo sapiens
cctggaccagcctctc

SEQ ID NO: 1390460 - DNA, 20 bp, Homo sapiens
cctggccccctccctggatg

SEQ ID NO: 1390461 - DNA, 16 bp, Homo sapiens
cctggctatgtcctaa

SEQ ID NO: 1390462 - DNA, 16 bp, Homo sapiens
cctggctgtctgaggc

SEQ ID NO: 1390463 - DNA, 13 bp, Homo sapiens
cctgggaggctct

SEQ ID NO: 1390464 - DNA, 12 bp, Homo sapiens
cctgggcaggag

SEQ ID NO: 1390465 - DNA, 13 bp, Homo sapiens
cctgggccttggg

SEQ ID NO: 1390466 - DNA, 18 bp, Homo sapiens
cctgggccttgggctccg

SEQ ID NO: 1390467 - DNA, 14 bp, Homo sapiens
cctggtttgaaatt

SEQ ID NO: 1390468 - DNA, 16 bp, Homo sapiens
cctgtatgtctccagt

SEQ ID NO: 1390469 - DNA, 21 bp, Homo sapiens
cctgtctccctcctctgcccg

SEQ ID NO: 1390470 - DNA, 21 bp, Homo sapiens
cctgtgcctcctcacccccag

SEQ ID NO: 1390471 - DNA, 13 bp, Homo sapiens
ccttaaggctctt

SEQ ID NO: 1390472 - DNA, 12 bp, Homo sapiens
ccttaagtcaga

SEQ ID NO: 1390473 - DNA, 22 bp, Homo sapiens
ccttacaagttagaaaacataa

SEQ ID NO: 1390474 - DNA, 17 bp, Homo sapiens
ccttactcttcttgaaa

SEQ ID NO: 1390475 - DNA, 22 bp, Homo sapiens
ccttactcttcttgaaatttta

SEQ ID NO: 1390476 - DNA, 22 bp, Homo sapiens
ccttagctggcattacagctgg

SEQ ID NO: 1390477 - DNA, 13 bp, Homo sapiens
ccttatttatcaa

SEQ ID NO: 1390478 - DNA, 22 bp, Homo sapiens
ccttatttatcaacatcttttt

SEQ ID NO: 1390479 - DNA, 14 bp, Homo sapiens
ccttattttcaaga

SEQ ID NO: 1390480 - DNA, 18 bp, Homo sapiens
ccttattttcaagaaact

SEQ ID NO: 1390481 - DNA, 12 bp, Homo sapiens
ccttcatttcct

SEQ ID NO: 1390482 - DNA, 15 bp, Homo sapiens
ccttcatttcctccg

SEQ ID NO: 1390483 - DNA, 22 bp, Homo sapiens
ccttcctgtttttcacattttc

SEQ ID NO: 1390484 - DNA, 19 bp, Homo sapiens
ccttctctgttcatttcct

SEQ ID NO: 1390485 - DNA, 21 bp, Homo sapiens
ccttgaagttctgaaatttaa

SEQ ID NO: 1390486 - DNA, 20 bp, Homo sapiens
ccttgagtagtttttatctg

SEQ ID NO: 1390487 - DNA, 18 bp, Homo sapiens
ccttggggattcttccat

SEQ ID NO: 1390488 - DNA, 18 bp, Homo sapiens
ccttgtcacgccagactt

SEQ ID NO: 1390489 - DNA, 13 bp, Homo sapiens
ccttgtgctgggg

SEQ ID NO: 1390490 - DNA, 14 bp, Homo sapiens
cctttctagttgaa

SEQ ID NO: 1390491 - DNA, 17 bp, Homo sapiens
cctttttatttgcatgt

SEQ ID NO: 1390492 - DNA, 17 bp, Homo sapiens
cgaagcgttgtcctcag

SEQ ID NO: 1390493 - DNA, 13 bp, Homo sapiens
cgaatgacactgt

SEQ ID NO: 1390494 - DNA, 16 bp, Homo sapiens
cgacttgccaaattta

SEQ ID NO: 1390495 - DNA, 22 bp, Homo sapiens
cgagatcccaacactgccagca

SEQ ID NO: 1390496 - DNA, 11 bp, Homo sapiens
cgcggctggga

SEQ ID NO: 1390497 - DNA, 18 bp, Homo sapiens
cgctatctgggaagctat

SEQ ID NO: 1390498 - DNA, 17 bp, Homo sapiens
cgctgtcctttctagag

SEQ ID NO: 1390499 - DNA, 21 bp, Homo sapiens
cggaatcctgtcgattagact

SEQ ID NO: 1390500 - DNA, 16 bp, Homo sapiens
cggacgcccaggaccc

SEQ ID NO: 1390501 - DNA, 18 bp, Homo sapiens
cggagtgagttttttagt

SEQ ID NO: 1390502 - DNA, 22 bp, Homo sapiens
cggcctgccaggaggacccagg

SEQ ID NO: 1390503 - DNA, 15 bp, Homo sapiens
cggcctttctagcct

SEQ ID NO: 1390504 - DNA, 14 bp, Homo sapiens
cggctcctcaggga

SEQ ID NO: 1390505 - DNA, 23 bp, Homo sapiens
cggctcctcgagatcccaacact

SEQ ID NO: 1390506 - DNA, 18 bp, Homo sapiens
cggctgggaggagggcag

SEQ ID NO: 1390507 - DNA, 15 bp, Homo sapiens
cgggaaaaagcccac

SEQ ID NO: 1390508 - DNA, 16 bp, Homo sapiens
cgggagctcaggaacc

SEQ ID NO: 1390509 - DNA, 16 bp, Homo sapiens
cgggttgtgtgtctgt

SEQ ID NO: 1390510 - DNA, 22 bp, Homo sapiens
cgtagatattggacaaagaacc

SEQ ID NO: 1390511 - DNA, 15 bp, Homo sapiens
cgtatttaatagcaa

SEQ ID NO: 1390512 - DNA, 22 bp, Homo sapiens
cgtcaaaacagattgtttgcaa

SEQ ID NO: 1390513 - DNA, 19 bp, Homo sapiens
cgtcagctgggacaccccg

SEQ ID NO: 1390514 - DNA, 19 bp, Homo sapiens
cgtccaggagcctgtgcct

SEQ ID NO: 1390515 - DNA, 14 bp, Homo sapiens
cgtcccctgcctca

SEQ ID NO: 1390516 - DNA, 12 bp, Homo sapiens
cgtctgggtggc

SEQ ID NO: 1390517 - DNA, 13 bp, Homo sapiens
cgtgaagcatcca

SEQ ID NO: 1390518 - DNA, 13 bp, Homo sapiens
cgtgacacaaaca

SEQ ID NO: 1390519 - DNA, 15 bp, Homo sapiens
cgtgacgtctgggtg

SEQ ID NO: 1390520 - DNA, 20 bp, Homo sapiens
cgtgacgtctgggtggccct

SEQ ID NO: 1390521 - DNA, 20 bp, Homo sapiens
cgtgagcatgtttggaaggg

SEQ ID NO: 1390522 - DNA, 23 bp, Homo sapiens
cgtggctgtggcatccagagtcc

SEQ ID NO: 1390523 - DNA, 17 bp, Homo sapiens
cgtggtggtccctgggt

SEQ ID NO: 1390524 - DNA, 14 bp, Homo sapiens
cgtgtttctgactc

SEQ ID NO: 1390525 - DNA, 19 bp, Homo sapiens
cgttcaacttttcctttga

SEQ ID NO: 1390526 - DNA, 16 bp, Homo sapiens
cgttgtcctcagcccc

SEQ ID NO: 1390527 - DNA, 18 bp, Homo sapiens
cgtttaagccaaaacaat

SEQ ID NO: 1390528 - DNA, 14 bp, Homo sapiens
cgtttattttcaag

SEQ ID NO: 1390529 - DNA, 18 bp, Homo sapiens
ctaaacacgtgacacaaa

SEQ ID NO: 1390530 - DNA, 13 bp, Homo sapiens
ctaaacatcattc

SEQ ID NO: 1390531 - DNA, 17 bp, Homo sapiens
ctaaagaaaaacaaact

SEQ ID NO: 1390532 - DNA, 20 bp, Homo sapiens
ctaaagaaaaacaaactcgt

SEQ ID NO: 1390533 - DNA, 20 bp, Homo sapiens
ctaaatcttttataggattt

SEQ ID NO: 1390534 - DNA, 12 bp, Homo sapiens
ctaacctgccga

SEQ ID NO: 1390535 - DNA, 19 bp, Homo sapiens
ctaagaaacatttatattg

SEQ ID NO: 1390536 - DNA, 21 bp, Homo sapiens
ctaagaaacatttatattgat

SEQ ID NO: 1390537 - DNA, 15 bp, Homo sapiens
ctaagaaagaacacg

SEQ ID NO: 1390538 - DNA, 22 bp, Homo sapiens
ctaagaagtacattgttacctc

SEQ ID NO: 1390539 - DNA, 19 bp, Homo sapiens
ctaagagaagtagaaatca

SEQ ID NO: 1390540 - DNA, 17 bp, Homo sapiens
ctaaggaatatatatgg

SEQ ID NO: 1390541 - DNA, 13 bp, Homo sapiens
ctaataaagctgt

SEQ ID NO: 1390542 - DNA, 14 bp, Homo sapiens
ctaataaagctgtg

SEQ ID NO: 1390543 - DNA, 13 bp, Homo sapiens
ctaatttataaaa

SEQ ID NO: 1390544 - DNA, 21 bp, Homo sapiens
ctaatttttatttttgctgag

SEQ ID NO: 1390545 - DNA, 16 bp, Homo sapiens
ctaattttttgttgtt

SEQ ID NO: 1390546 - DNA, 19 bp, Homo sapiens
ctacacctgttgcacctca

SEQ ID NO: 1390547 - DNA, 21 bp, Homo sapiens
ctacaggcgtgagccaccatg

SEQ ID NO: 1390548 - DNA, 13 bp, Homo sapiens
ctacatgaaacag

SEQ ID NO: 1390549 - DNA, 15 bp, Homo sapiens
ctacatgaaacagaa

SEQ ID NO: 1390550 - DNA, 15 bp, Homo sapiens
ctaccaaagcacctt

SEQ ID NO: 1390551 - DNA, 17 bp, Homo sapiens
ctacccccagctgtgct

SEQ ID NO: 1390552 - DNA, 18 bp, Homo sapiens
ctacccccagctgtgctt

SEQ ID NO: 1390553 - DNA, 15 bp, Homo sapiens
ctacccctcctgcgc

SEQ ID NO: 1390554 - DNA, 23 bp, Homo sapiens
ctacctggggaccccccttgccc

SEQ ID NO: 1390555 - DNA, 16 bp, Homo sapiens
ctacctggtctctcct

SEQ ID NO: 1390556 - DNA, 21 bp, Homo sapiens
ctacctgttgagcatcacaga

SEQ ID NO: 1390557 - DNA, 22 bp, Homo sapiens
ctacctgttgagcatcacagaa

SEQ ID NO: 1390558 - DNA, 14 bp, Homo sapiens
ctacgtatttaata

SEQ ID NO: 1390559 - DNA, 14 bp, Homo sapiens
ctactgattccgca

SEQ ID NO: 1390560 - DNA, 22 bp, Homo sapiens
ctacttacatgcattactgcat

SEQ ID NO: 1390561 - DNA, 14 bp, Homo sapiens
ctacttgagataat

SEQ ID NO: 1390562 - DNA, 22 bp, Homo sapiens
ctacttgatgtaactgagaatt

SEQ ID NO: 1390563 - DNA, 23 bp, Homo sapiens
ctactttatttgcctaaatactt

SEQ ID NO: 1390564 - DNA, 18 bp, Homo sapiens
ctactttgactttttgca

SEQ ID NO: 1390565 - DNA, 16 bp, Homo sapiens
ctactttgataaagta

SEQ ID NO: 1390566 - DNA, 21 bp, Homo sapiens
ctactttgatatgactgtttt

SEQ ID NO: 1390567 - DNA, 19 bp, Homo sapiens
ctagaattgagtgtttaaa

SEQ ID NO: 1390568 - DNA, 21 bp, Homo sapiens
ctagaattgagtgtttaaagt

SEQ ID NO: 1390569 - DNA, 18 bp, Homo sapiens
ctagcaagacctgttggt

SEQ ID NO: 1390570 - DNA, 19 bp, Homo sapiens
ctaggtgggttgaaagcca

SEQ ID NO: 1390571 - DNA, 19 bp, Homo sapiens
ctatactgcatacttttta

SEQ ID NO: 1390572 - DNA, 20 bp, Homo sapiens
ctatagttattaagttcttt

SEQ ID NO: 1390573 - DNA, 19 bp, Homo sapiens
ctatatagctgatcagttt

SEQ ID NO: 1390574 - DNA, 21 bp, Homo sapiens
ctatcaaccccagacactggt

SEQ ID NO: 1390575 - DNA, 19 bp, Homo sapiens
ctatcagagttgctgcaaa

SEQ ID NO: 1390576 - DNA, 18 bp, Homo sapiens
ctatcttactatttcaca

SEQ ID NO: 1390577 - DNA, 21 bp, Homo sapiens
ctatgaaaagctagaattgag

SEQ ID NO: 1390578 - DNA, 13 bp, Homo sapiens
ctatgaaggctgt

SEQ ID NO: 1390579 - DNA, 16 bp, Homo sapiens
ctatgtcatttcattt

SEQ ID NO: 1390580 - DNA, 14 bp, Homo sapiens
ctatgtttttaatg

SEQ ID NO: 1390581 - DNA, 15 bp, Homo sapiens
ctatgtttttaatgt

SEQ ID NO: 1390582 - DNA, 16 bp, Homo sapiens
ctattatccccatttc

SEQ ID NO: 1390583 - DNA, 14 bp, Homo sapiens
ctattggagagaaa

SEQ ID NO: 1390584 - DNA, 22 bp, Homo sapiens
ctattttcagatgtgaaccatt

SEQ ID NO: 1390585 - DNA, 12 bp, Homo sapiens
ctattttgtaaa

SEQ ID NO: 1390586 - DNA, 22 bp, Homo sapiens
ctatttttggcagtctgaattt

SEQ ID NO: 1390587 - DNA, 19 bp, Homo sapiens
ctcaaactcctgacctcag

SEQ ID NO: 1390588 - DNA, 22 bp, Homo sapiens
ctcaaactgaggaatttcacct

SEQ ID NO: 1390589 - DNA, 13 bp, Homo sapiens
ctcaacagatctg

SEQ ID NO: 1390590 - DNA, 14 bp, Homo sapiens
ctcaacagatctgt

SEQ ID NO: 1390591 - DNA, 23 bp, Homo sapiens
ctcaacccctcccctccatccct

SEQ ID NO: 1390592 - DNA, 19 bp, Homo sapiens
ctcaagagatcccaagtag

SEQ ID NO: 1390593 - DNA, 23 bp, Homo sapiens
ctcaaggcggtgcttgatagaaa

SEQ ID NO: 1390594 - DNA, 21 bp, Homo sapiens
ctcaccaggcagcctctgggg

SEQ ID NO: 1390595 - DNA, 14 bp, Homo sapiens
ctcacccccagctt

SEQ ID NO: 1390596 - DNA, 12 bp, Homo sapiens
ctcacctcctcc

SEQ ID NO: 1390597 - DNA, 22 bp, Homo sapiens
ctcacttttaatgaacaaatgg

SEQ ID NO: 1390598 - DNA, 20 bp, Homo sapiens
ctcagaaaatatccctcctg

SEQ ID NO: 1390599 - DNA, 18 bp, Homo sapiens
ctcagactctaagaaaga

SEQ ID NO: 1390600 - DNA, 18 bp, Homo sapiens
ctcagatagaatgacagt

SEQ ID NO: 1390601 - DNA, 16 bp, Homo sapiens
ctcagctagctctgcc

SEQ ID NO: 1390602 - DNA, 17 bp, Homo sapiens
ctcaggagccctgggag

SEQ ID NO: 1390603 - DNA, 16 bp, Homo sapiens
ctcaggatgagggaaa

SEQ ID NO: 1390604 - DNA, 13 bp, Homo sapiens
ctcaggccagagc

SEQ ID NO: 1390605 - DNA, 19 bp, Homo sapiens
ctcagtaatttagaaatca

SEQ ID NO: 1390606 - DNA, 18 bp, Homo sapiens
ctcagtgaagaatacttc

SEQ ID NO: 1390607 - DNA, 20 bp, Homo sapiens
ctcagtgtcctcaggggcct

SEQ ID NO: 1390608 - DNA, 20 bp, Homo sapiens
ctcagttgattttctggatt

SEQ ID NO: 1390609 - DNA, 17 bp, Homo sapiens
ctcataacttgagacct

SEQ ID NO: 1390610 - DNA, 20 bp, Homo sapiens
ctcataacttgagacctaat

SEQ ID NO: 1390611 - DNA, 21 bp, Homo sapiens
ctcatattgtgattctgcctt

SEQ ID NO: 1390612 - DNA, 13 bp, Homo sapiens
ctcatcaactgaa

SEQ ID NO: 1390613 - DNA, 14 bp, Homo sapiens
ctcatctgtcacca

SEQ ID NO: 1390614 - DNA, 13 bp, Homo sapiens
ctccaaaaaagaa

SEQ ID NO: 1390615 - DNA, 22 bp, Homo sapiens
ctccaaaatgttggtcatttta

SEQ ID NO: 1390616 - DNA, 15 bp, Homo sapiens
ctccaaactcctgcc

SEQ ID NO: 1390617 - DNA, 20 bp, Homo sapiens
ctccaagagctacataattt

SEQ ID NO: 1390618 - DNA, 14 bp, Homo sapiens
ctccacctcctggg

SEQ ID NO: 1390619 - DNA, 17 bp, Homo sapiens
ctccactcctccagcca

SEQ ID NO: 1390620 - DNA, 20 bp, Homo sapiens
ctccagccatcaagagactg

SEQ ID NO: 1390621 - DNA, 15 bp, Homo sapiens
ctccatccctggccc

SEQ ID NO: 1390622 - DNA, 23 bp, Homo sapiens
ctccatcctaccccctgtgcctt

SEQ ID NO: 1390623 - DNA, 23 bp, Homo sapiens
ctccccttcgcgtatttcaggat

SEQ ID NO: 1390624 - DNA, 14 bp, Homo sapiens
ctccctcagtgccc

SEQ ID NO: 1390625 - DNA, 14 bp, Homo sapiens
ctccctgcctcctg

SEQ ID NO: 1390626 - DNA, 18 bp, Homo sapiens
ctcccttcccctgcctgg

SEQ ID NO: 1390627 - DNA, 14 bp, Homo sapiens
ctccgtgtgggaga

SEQ ID NO: 1390628 - DNA, 15 bp, Homo sapiens
ctcctcacccccagc

SEQ ID NO: 1390629 - DNA, 20 bp, Homo sapiens
ctcctcacccccagctttgc

SEQ ID NO: 1390630 - DNA, 17 bp, Homo sapiens
ctcctcagggactcagg

SEQ ID NO: 1390631 - DNA, 18 bp, Homo sapiens
ctcctcattcacatcgca

SEQ ID NO: 1390632 - DNA, 22 bp, Homo sapiens
ctcctctgcccgggagctcagg

SEQ ID NO: 1390633 - DNA, 14 bp, Homo sapiens
ctcctgacctcagg

SEQ ID NO: 1390634 - DNA, 15 bp, Homo sapiens
ctcctgacctcaggc

SEQ ID NO: 1390635 - DNA, 11 bp, Homo sapiens
ctcctgcctgt

SEQ ID NO: 1390636 - DNA, 18 bp, Homo sapiens
ctcctggctgtctgaggc

SEQ ID NO: 1390637 - DNA, 24 bp, Homo sapiens
ctcctgttgggagagggcgcaggc

SEQ ID NO: 1390638 - DNA, 12 bp, Homo sapiens
ctcctgtttcca

SEQ ID NO: 1390639 - DNA, 21 bp, Homo sapiens
ctccttatttatcaacatctt

SEQ ID NO: 1390640 - DNA, 19 bp, Homo sapiens
ctctaatatggcaaccatt

SEQ ID NO: 1390641 - DNA, 17 bp, Homo sapiens
ctctacaaactcccact

SEQ ID NO: 1390642 - DNA, 21 bp, Homo sapiens
ctctagacactgccacacagg

SEQ ID NO: 1390643 - DNA, 21 bp, Homo sapiens
ctctatataccaaagcacatt

SEQ ID NO: 1390644 - DNA, 19 bp, Homo sapiens
ctctatggggcatcctctt

SEQ ID NO: 1390645 - DNA, 13 bp, Homo sapiens
ctctcatgaacct

SEQ ID NO: 1390646 - DNA, 14 bp, Homo sapiens
ctctcatgaacctc

SEQ ID NO: 1390647 - DNA, 22 bp, Homo sapiens
ctctccactcatgtgactcttt

SEQ ID NO: 1390648 - DNA, 17 bp, Homo sapiens
ctctcctgtctccctcc

SEQ ID NO: 1390649 - DNA, 13 bp, Homo sapiens
ctctctgcaggtc

SEQ ID NO: 1390650 - DNA, 14 bp, Homo sapiens
ctctctgcaggtcc

SEQ ID NO: 1390651 - DNA, 19 bp, Homo sapiens
ctctctgcaggtccctaat

SEQ ID NO: 1390652 - DNA, 17 bp, Homo sapiens
ctctgaaagagaaacac

SEQ ID NO: 1390653 - DNA, 15 bp, Homo sapiens
ctgtgcctgaatatt

SEQ ID NO: 1390654 - DNA, 15 bp, Homo sapiens
ctgtggccaggaggt

SEQ ID NO: 1390655 - DNA, 15 bp, Homo sapiens
ctgtgggtagtatga

SEQ ID NO: 1390656 - DNA, 19 bp, Homo sapiens
ctgtgtacataactgaaaa

SEQ ID NO: 1390657 - DNA, 20 bp, Homo sapiens
ctgtgtacataactgaaaat

SEQ ID NO: 1390658 - DNA, 14 bp, Homo sapiens
ctgttatgctgtga

SEQ ID NO: 1390659 - DNA, 16 bp, Homo sapiens
ctgttcacttttcctc

SEQ ID NO: 1390660 - DNA, 17 bp, Homo sapiens
ctgttcatttcctcaaa

SEQ ID NO: 1390661 - DNA, 19 bp, Homo sapiens
ctgttctacatagatgctt

SEQ ID NO: 1390662 - DNA, 17 bp, Homo sapiens
ctgttgaatttcccaca

SEQ ID NO: 1390663 - DNA, 20 bp, Homo sapiens
ctgttgggagagggcgcagg

SEQ ID NO: 1390664 - DNA, 18 bp, Homo sapiens
ctgttggttagctggaca

SEQ ID NO: 1390665 - DNA, 15 bp, Homo sapiens
ctgtttactgcaagg

SEQ ID NO: 1390666 - DNA, 14 bp, Homo sapiens
ctgtttagaacaca

SEQ ID NO: 1390667 - DNA, 20 bp, Homo sapiens
ctgtttagtagcagtgattg

SEQ ID NO: 1390668 - DNA, 20 bp, Homo sapiens
ctgtttttcggacagtttat

SEQ ID NO: 1390669 - DNA, 23 bp, Homo sapiens
cttaaaccttcagttatgatttt

SEQ ID NO: 1390670 - DNA, 16 bp, Homo sapiens
cttaaataagaaactt

SEQ ID NO: 1390671 - DNA, 21 bp, Homo sapiens
cttaatcagatagatattcct

SEQ ID NO: 1390672 - DNA, 20 bp, Homo sapiens
cttaatcaggtcctcagaga

SEQ ID NO: 1390673 - DNA, 20 bp, Homo sapiens
cttaatggctgataatttta

SEQ ID NO: 1390674 - DNA, 18 bp, Homo sapiens
cttacatgcattactgca

SEQ ID NO: 1390675 - DNA, 20 bp, Homo sapiens
cttacctgtatgtctccagt

SEQ ID NO: 1390676 - DNA, 13 bp, Homo sapiens
cttacctttttat

SEQ ID NO: 1390677 - DNA, 20 bp, Homo sapiens
cttacctttttatttgcatg

SEQ ID NO: 1390678 - DNA, 19 bp, Homo sapiens
cttactcttcttgaaattt

SEQ ID NO: 1390679 - DNA, 12 bp, Homo sapiens
cttactgatata

SEQ ID NO: 1390680 - DNA, 21 bp, Homo sapiens
cttactgatatattttacaat

SEQ ID NO: 1390681 - DNA, 21 bp, Homo sapiens
cttagatctggcatgttagcc

SEQ ID NO: 1390682 - DNA, 14 bp, Homo sapiens
cttagctgtctgct

SEQ ID NO: 1390683 - DNA, 13 bp, Homo sapiens
cttattgcctcac

SEQ ID NO: 1390684 - DNA, 12 bp, Homo sapiens
cttattttcaag

SEQ ID NO: 1390685 - DNA, 15 bp, Homo sapiens
cttcaaagtttaata

SEQ ID NO: 1390686 - DNA, 14 bp, Homo sapiens
cttcatctggcaac

SEQ ID NO: 1390687 - DNA, 23 bp, Homo sapiens
cttcatctggcaacatctttatc

SEQ ID NO: 1390688 - DNA, 14 bp, Homo sapiens
cttcatttcctccg

SEQ ID NO: 1390689 - DNA, 18 bp, Homo sapiens
cttcatttgggatgctac

SEQ ID NO: 1390690 - DNA, 23 bp, Homo sapiens
cttccaccaagttggaacatcct

SEQ ID NO: 1390691 - DNA, 16 bp, Homo sapiens
cttccagaaaacaaaa

SEQ ID NO: 1390692 - DNA, 13 bp, Homo sapiens
cttccagaaatac

SEQ ID NO: 1390693 - DNA, 15 bp, Homo sapiens
cttcccctgcctggt

SEQ ID NO: 1390694 - DNA, 22 bp, Homo sapiens
cttcctaaatattatgagatgc

SEQ ID NO: 1390695 - DNA, 15 bp, Homo sapiens
cttcctagttttctc

SEQ ID NO: 1390696 - DNA, 20 bp, Homo sapiens
cttcctggggcatctggcga

SEQ ID NO: 1390697 - DNA, 18 bp, Homo sapiens
cttctctgccaagccctc

SEQ ID NO: 1390698 - DNA, 13 bp, Homo sapiens
cttctctgttcat

SEQ ID NO: 1390699 - DNA, 14 bp, Homo sapiens
cttctgacctcccc

SEQ ID NO: 1390700 - DNA, 22 bp, Homo sapiens
cttctgagcccggtaagagcaa

SEQ ID NO: 1390701 - DNA, 15 bp, Homo sapiens
cttctggactggttt

SEQ ID NO: 1390702 - DNA, 13 bp, Homo sapiens
cttctggccagga

SEQ ID NO: 1390703 - DNA, 21 bp, Homo sapiens
cttcttccctaatcagctccc

SEQ ID NO: 1390704 - DNA, 22 bp, Homo sapiens
cttcttgaaattttaacctatg

SEQ ID NO: 1390705 - DNA, 13 bp, Homo sapiens
cttcttttgctct

SEQ ID NO: 1390706 - DNA, 18 bp, Homo sapiens
cttctttttctttgagaa

SEQ ID NO: 1390707 - DNA, 18 bp, Homo sapiens
cttgaaatatcctgcttg

SEQ ID NO: 1390708 - DNA, 19 bp, Homo sapiens
cttgaaatatcctgcttga

SEQ ID NO: 1390709 - DNA, 17 bp, Homo sapiens
cttgaagttctgaaatt

SEQ ID NO: 1390710 - DNA, 18 bp, Homo sapiens
cttgaagttctgaaattt

SEQ ID NO: 1390711 - DNA, 20 bp, Homo sapiens
cttgaagttctgaaatttaa

SEQ ID NO: 1390712 - DNA, 20 bp, Homo sapiens
cttgacagtggaactacatt

SEQ ID NO: 1390713 - DNA, 13 bp, Homo sapiens
cttgaccctgagc

SEQ ID NO: 1390714 - DNA, 15 bp, Homo sapiens
cttgaccctgagctg

SEQ ID NO: 1390715 - DNA, 15 bp, Homo sapiens
cttgaggggaccagg

SEQ ID NO: 1390716 - DNA, 16 bp, Homo sapiens
cttgaggggaccagga

SEQ ID NO: 1390717 - DNA, 17 bp, Homo sapiens
cttgatagaaatgccaa

SEQ ID NO: 1390718 - DNA, 21 bp, Homo sapiens
cttgattttagccttctctgt

SEQ ID NO: 1390719 - DNA, 13 bp, Homo sapiens
cttgccaaattta

SEQ ID NO: 1390720 - DNA, 17 bp, Homo sapiens
cttgcctcaacctccca

SEQ ID NO: 1390721 - DNA, 18 bp, Homo sapiens
cttgctcttgatgcctgg

SEQ ID NO: 1390722 - DNA, 20 bp, Homo sapiens
cttggggagtttagggtggg

SEQ ID NO: 1390723 - DNA, 21 bp, Homo sapiens
cttggggattcttccatctga

SEQ ID NO: 1390724 - DNA, 21 bp, Homo sapiens
cttgggggaagggcttgaatt

SEQ ID NO: 1390725 - DNA, 20 bp, Homo sapiens
cttggtgaatttttttttcc

SEQ ID NO: 1390726 - DNA, 19 bp, Homo sapiens
cttggttcttgaggggacc

SEQ ID NO: 1390727 - DNA, 21 bp, Homo sapiens
cttggttttgctacataatta

SEQ ID NO: 1390728 - DNA, 13 bp, Homo sapiens
cttgtacaaaata

SEQ ID NO: 1390729 - DNA, 18 bp, Homo sapiens
cttgtcacgccagacttc

SEQ ID NO: 1390730 - DNA, 22 bp, Homo sapiens
cttgtcactggtagaccaaaat

SEQ ID NO: 1390731 - DNA, 19 bp, Homo sapiens
cttgtgaatcaagggtcag

SEQ ID NO: 1390732 - DNA, 15 bp, Homo sapiens
cttgtgtctctgtgc

SEQ ID NO: 1390733 - DNA, 15 bp, Homo sapiens
cttgttgtgctttta

SEQ ID NO: 1390734 - DNA, 19 bp, Homo sapiens
ctttaaaatgtaaagccat

SEQ ID NO: 1390735 - DNA, 13 bp, Homo sapiens
ctttaaagactta

SEQ ID NO: 1390736 - DNA, 18 bp, Homo sapiens
ctttaaagacttaagatt

SEQ ID NO: 1390737 - DNA, 20 bp, Homo sapiens
ctttaaagacttaagattaa

SEQ ID NO: 1390738 - DNA, 14 bp, Homo sapiens
ctttacttttaaac

SEQ ID NO: 1390739 - DNA, 15 bp, Homo sapiens
ctttaggagcagtgg

SEQ ID NO: 1390740 - DNA, 21 bp, Homo sapiens
ctttatgtctgtggatttttt

SEQ ID NO: 1390741 - DNA, 20 bp, Homo sapiens
ctttatgttactacatgcac

SEQ ID NO: 1390742 - DNA, 17 bp, Homo sapiens
ctttattaaaaactgag

SEQ ID NO: 1390743 - DNA, 17 bp, Homo sapiens
ctttcccaacacctctt

SEQ ID NO: 1390744 - DNA, 23 bp, Homo sapiens
ctttcctccaaactcctgcctgt

SEQ ID NO: 1390745 - DNA, 15 bp, Homo sapiens
ctttcctgaatccaa

SEQ ID NO: 1390746 - DNA, 22 bp, Homo sapiens
ctttcctgaatccaaactaatc

SEQ ID NO: 1390747 - DNA, 14 bp, Homo sapiens
ctttctagttgaaa

SEQ ID NO: 1390748 - DNA, 18 bp, Homo sapiens
ctttctagttgaaaataa

SEQ ID NO: 1390749 - DNA, 21 bp, Homo sapiens
ctttctagttgaaaataaagt

SEQ ID NO: 1390750 - DNA, 17 bp, Homo sapiens
ctttctcactaaatctt

SEQ ID NO: 1390751 - DNA, 22 bp, Homo sapiens
ctttctcactaaatcttttata

SEQ ID NO: 1390752 - DNA, 20 bp, Homo sapiens
ctttctcttttcctctacca

SEQ ID NO: 1390753 - DNA, 18 bp, Homo sapiens
ctttctgatcaaggcctt

SEQ ID NO: 1390754 - DNA, 16 bp, Homo sapiens
ctttctgtaaccataa

SEQ ID NO: 1390755 - DNA, 13 bp, Homo sapiens
ctttcttccaaac

SEQ ID NO: 1390756 - DNA, 22 bp, Homo sapiens
ctttcttccaaacaggctcaga

SEQ ID NO: 1390757 - DNA, 13 bp, Homo sapiens
ctttctttcttta

SEQ ID NO: 1390758 - DNA, 17 bp, Homo sapiens
ctttgactttttgcatt

SEQ ID NO: 1390759 - DNA, 18 bp, Homo sapiens
ctttgagaaaggattaag

SEQ ID NO: 1390760 - DNA, 19 bp, Homo sapiens
ctttgagaaaggattaaga

SEQ ID NO: 1390761 - DNA, 21 bp, Homo sapiens
ctttgagaaaggattaagata

SEQ ID NO: 1390762 - DNA, 15 bp, Homo sapiens
ctttgatatttcaat

SEQ ID NO: 1390763 - DNA, 13 bp, Homo sapiens
cttttaaactgtg

SEQ ID NO: 1390764 - DNA, 16 bp, Homo sapiens
cttttaatgaacaaat

SEQ ID NO: 1390765 - DNA, 14 bp, Homo sapiens
cttttaattttcct

SEQ ID NO: 1390766 - DNA, 17 bp, Homo sapiens
gaaagctgcctggtata

SEQ ID NO: 1390767 - DNA, 17 bp, Homo sapiens
gaaagcttcaaactgca

SEQ ID NO: 1390768 - DNA, 19 bp, Homo sapiens
gaaatatttgtgacaaaaa

SEQ ID NO: 1390769 - DNA, 14 bp, Homo sapiens
gaaatcagaaaaat

SEQ ID NO: 1390770 - DNA, 17 bp, Homo sapiens
gaaatcagaaaaattaa

SEQ ID NO: 1390771 - DNA, 18 bp, Homo sapiens
gaaatcagaaaaattaat

SEQ ID NO: 1390772 - DNA, 20 bp, Homo sapiens
gaaatctggcttctggccag

SEQ ID NO: 1390773 - DNA, 22 bp, Homo sapiens
gaaattgcctccttatttatca

SEQ ID NO: 1390774 - DNA, 20 bp, Homo sapiens
gaaatttaaactataagcaa

SEQ ID NO: 1390775 - DNA, 11 bp, Homo sapiens
gaaatttcaga

SEQ ID NO: 1390776 - DNA, 14 bp, Homo sapiens
gaaattttccatta

SEQ ID NO: 1390777 - DNA, 23 bp, Homo sapiens
gaaattttccattacatgatctt

SEQ ID NO: 1390778 - DNA, 20 bp, Homo sapiens
gaacaccattgaaggcttaa

SEQ ID NO: 1390779 - DNA, 15 bp, Homo sapiens
gaacactagacaagc

SEQ ID NO: 1390780 - DNA, 17 bp, Homo sapiens
gaacagataatccctgt

SEQ ID NO: 1390781 - DNA, 20 bp, Homo sapiens
gaacagcagactcagctctg

SEQ ID NO: 1390782 - DNA, 19 bp, Homo sapiens
gaacaggagacccacctga

SEQ ID NO: 1390783 - DNA, 12 bp, Homo sapiens
gaacataatgaa

SEQ ID NO: 1390784 - DNA, 12 bp, Homo sapiens
gaacatattgtt

SEQ ID NO: 1390785 - DNA, 24 bp, Homo sapiens
gaaccaacaacctcaactgcctac

SEQ ID NO: 1390786 - DNA, 21 bp, Homo sapiens
gaacccctacatgaaacagaa

SEQ ID NO: 1390787 - DNA, 15 bp, Homo sapiens
gaacctgatgaaaat

SEQ ID NO: 1390788 - DNA, 15 bp, Homo sapiens
gaactccttgatttt

SEQ ID NO: 1390789 - DNA, 22 bp, Homo sapiens
gaactccttgattttagccttc

SEQ ID NO: 1390790 - DNA, 22 bp, Homo sapiens
gaactgaacaccattgaaggct

SEQ ID NO: 1390791 - DNA, 23 bp, Homo sapiens
gaactgattcacatctcattttt

SEQ ID NO: 1390792 - DNA, 21 bp, Homo sapiens
gaactgtctctcatgaacctc

SEQ ID NO: 1390793 - DNA, 22 bp, Homo sapiens
gaacttgaaatatcctgcttga

SEQ ID NO: 1390794 - DNA, 14 bp, Homo sapiens
gaagaaaaagaagc

SEQ ID NO: 1390795 - DNA, 22 bp, Homo sapiens
gaagaatgttaagacttgacag

SEQ ID NO: 1390796 - DNA, 14 bp, Homo sapiens
gaagacaattgaca

SEQ ID NO: 1390797 - DNA, 18 bp, Homo sapiens
gaagacaattgacaacag

SEQ ID NO: 1390798 - DNA, 17 bp, Homo sapiens
gaagacagaagtttgca

SEQ ID NO: 1390799 - DNA, 14 bp, Homo sapiens
gaagcatccaggca

SEQ ID NO: 1390800 - DNA, 22 bp, Homo sapiens
gaagccagctttccctgcctct

SEQ ID NO: 1390801 - DNA, 14 bp, Homo sapiens
gaagctttggtgag

SEQ ID NO: 1390802 - DNA, 17 bp, Homo sapiens
gaaggcttgttgtgctt

SEQ ID NO: 1390803 - DNA, 22 bp, Homo sapiens
gaagggaataaggtacaagaag

SEQ ID NO: 1390804 - DNA, 21 bp, Homo sapiens
gaaggtgaggagcttgaaacc

SEQ ID NO: 1390805 - DNA, 19 bp, Homo sapiens
gaagtaaaagcaaaaaaga

SEQ ID NO: 1390806 - DNA, 17 bp, Homo sapiens
gaataaagaatgaatgg

SEQ ID NO: 1390807 - DNA, 19 bp, Homo sapiens
gaataaggtacaagaagca

SEQ ID NO: 1390808 - DNA, 20 bp, Homo sapiens
gaataaggtacaagaagcat

SEQ ID NO: 1390809 - DNA, 15 bp, Homo sapiens
gaataagtgtacata

SEQ ID NO: 1390810 - DNA, 19 bp, Homo sapiens
gaatataattgttttatct

SEQ ID NO: 1390811 - DNA, 21 bp, Homo sapiens
gaatatatatggaataagtgt

SEQ ID NO: 1390812 - DNA, 20 bp, Homo sapiens
gaatcctaggctccacccca

SEQ ID NO: 1390813 - DNA, 12 bp, Homo sapiens
gaatgacactgt

SEQ ID NO: 1390814 - DNA, 16 bp, Homo sapiens
gaatgaccagcatgat

SEQ ID NO: 1390815 - DNA, 11 bp, Homo sapiens
gaatgagcctc

SEQ ID NO: 1390816 - DNA, 20 bp, Homo sapiens
gaatgttgattacagtgcag

SEQ ID NO: 1390817 - DNA, 13 bp, Homo sapiens
gaattcaacagtt

SEQ ID NO: 1390818 - DNA, 23 bp, Homo sapiens
gaatttagccctggtttgaaatt

SEQ ID NO: 1390819 - DNA, 17 bp, Homo sapiens
gaatttcccacataccc

SEQ ID NO: 1390820 - DNA, 18 bp, Homo sapiens
gaatttgtgtggatattt

SEQ ID NO: 1390821 - DNA, 17 bp, Homo sapiens
gaatttttaaacaagta

SEQ ID NO: 1390822 - DNA, 18 bp, Homo sapiens
gacaaaaaattaaagcat

SEQ ID NO: 1390823 - DNA, 16 bp, Homo sapiens
gacaaacacctcccag

SEQ ID NO: 1390824 - DNA, 19 bp, Homo sapiens
gacaaacacctcccaggag

SEQ ID NO: 1390825 - DNA, 13 bp, Homo sapiens
gacaaagaacctt

SEQ ID NO: 1390826 - DNA, 18 bp, Homo sapiens
gacaaaggttttcctctt

SEQ ID NO: 1390827 - DNA, 22 bp, Homo sapiens
gacaacatttctatagccaaaa

SEQ ID NO: 1390828 - DNA, 13 bp, Homo sapiens
gacaactggcagg

SEQ ID NO: 1390829 - DNA, 16 bp, Homo sapiens
gacaagtacataaagg

SEQ ID NO: 1390830 - DNA, 19 bp, Homo sapiens
gacacaaacacacacaaaa

SEQ ID NO: 1390831 - DNA, 19 bp, Homo sapiens
gacacatactcatttttca

SEQ ID NO: 1390832 - DNA, 15 bp, Homo sapiens
gacacctaggctagg

SEQ ID NO: 1390833 - DNA, 15 bp, Homo sapiens
gacagatgaggcttt

SEQ ID NO: 1390834 - DNA, 16 bp, Homo sapiens
gacagatgaggctttc

SEQ ID NO: 1390835 - DNA, 19 bp, Homo sapiens
gacagggcgggggtggcgg

SEQ ID NO: 1390836 - DNA, 16 bp, Homo sapiens
gacatcacttgtacaa

SEQ ID NO: 1390837 - DNA, 17 bp, Homo sapiens
gacatgtctgttctaca

SEQ ID NO: 1390838 - DNA, 21 bp, Homo sapiens
gacattaactcattagactgg

SEQ ID NO: 1390839 - DNA, 13 bp, Homo sapiens
gacattctgattc

SEQ ID NO: 1390840 - DNA, 22 bp, Homo sapiens
gacattctgattcgaatgacac

SEQ ID NO: 1390841 - DNA, 15 bp, Homo sapiens
gacccacctgaggct

SEQ ID NO: 1390842 - DNA, 22 bp, Homo sapiens
gacccgttcaacttttcctttg

SEQ ID NO: 1390843 - DNA, 19 bp, Homo sapiens
gaccctcatctttcttcca

SEQ ID NO: 1390844 - DNA, 15 bp, Homo sapiens
gaccggcctgccagg

SEQ ID NO: 1390845 - DNA, 18 bp, Homo sapiens
gaccggcctgccaggagg

SEQ ID NO: 1390846 - DNA, 19 bp, Homo sapiens
gaccggcctgccaggagga

SEQ ID NO: 1390847 - DNA, 18 bp, Homo sapiens
gacctcaggcaatctgcc

SEQ ID NO: 1390848 - DNA, 12 bp, Homo sapiens
gacctgaagaat

SEQ ID NO: 1390849 - DNA, 12 bp, Homo sapiens
gacctgcctgta

SEQ ID NO: 1390850 - DNA, 17 bp, Homo sapiens
gacggggtttcaccatg

SEQ ID NO: 1390851 - DNA, 20 bp, Homo sapiens
gactaatggcatgagaaata

SEQ ID NO: 1390852 - DNA, 18 bp, Homo sapiens
gactacttgggagcaccg

SEQ ID NO: 1390853 - DNA, 23 bp, Homo sapiens
gactaggccttgcggctcctcag

SEQ ID NO: 1390854 - DNA, 12 bp, Homo sapiens
gactcagctctg

SEQ ID NO: 1390855 - DNA, 23 bp, Homo sapiens
gactcaggcccccacctggctca

SEQ ID NO: 1390856 - DNA, 16 bp, Homo sapiens
gactctgccccttctg

SEQ ID NO: 1390857 - DNA, 12 bp, Homo sapiens
gactgctgtggc

SEQ ID NO: 1390858 - DNA, 14 bp, Homo sapiens
gacttaagattaaa

SEQ ID NO: 1390859 - DNA, 14 bp, Homo sapiens
gacttacatgattc

SEQ ID NO: 1390860 - DNA, 18 bp, Homo sapiens
gacttgtcccgggacacc

SEQ ID NO: 1390861 - DNA, 16 bp, Homo sapiens
gactttctattaatat

SEQ ID NO: 1390862 - DNA, 13 bp, Homo sapiens
gagaaaaaattaa

SEQ ID NO: 1390863 - DNA, 15 bp, Homo sapiens
gagaaaggattaaga

SEQ ID NO: 1390864 - DNA, 23 bp, Homo sapiens
gagaacctgggttgcagacagga

SEQ ID NO: 1390865 - DNA, 18 bp, Homo sapiens
gagaaggaaaattttagc

SEQ ID NO: 1390866 - DNA, 20 bp, Homo sapiens
gagaatgcccttctccttat

SEQ ID NO: 1390867 - DNA, 19 bp, Homo sapiens
gagacaaacacctcccagg

SEQ ID NO: 1390868 - DNA, 22 bp, Homo sapiens
gagacattaactcattagactg

SEQ ID NO: 1390869 - DNA, 23 bp, Homo sapiens
gagacccacctgaggctcagccc

SEQ ID NO: 1390870 - DNA, 17 bp, Homo sapiens
gagaccggcctgccagg

SEQ ID NO: 1390871 - DNA, 20 bp, Homo sapiens
gagactgggtgaaagtgact

SEQ ID NO: 1390872 - DNA, 19 bp, Homo sapiens
gccattctttcccaacacc

SEQ ID NO: 1390873 - DNA, 21 bp, Homo sapiens
gcccaccatttggcatccctg

SEQ ID NO: 1390874 - DNA, 16 bp, Homo sapiens
gcccaggcactgcaaa

SEQ ID NO: 1390875 - DNA, 16 bp, Homo sapiens
gcccagtcattgggtt

SEQ ID NO: 1390876 - DNA, 22 bp, Homo sapiens
gcccagtgcacttgctggaaga

SEQ ID NO: 1390877 - DNA, 13 bp, Homo sapiens
gccccgcgtggaa

SEQ ID NO: 1390878 - DNA, 15 bp, Homo sapiens
gcccctcccagccta

SEQ ID NO: 1390879 - DNA, 17 bp, Homo sapiens
gcccctgcctctctgca

SEQ ID NO: 1390880 - DNA, 23 bp, Homo sapiens
gcccctgcctctctgcaggtccc

SEQ ID NO: 1390881 - DNA, 18 bp, Homo sapiens
gccccttctgtttccata

SEQ ID NO: 1390882 - DNA, 14 bp, Homo sapiens
gccccttggccctc

SEQ ID NO: 1390883 - DNA, 19 bp, Homo sapiens
gcccggacgcccaggaccc

SEQ ID NO: 1390884 - DNA, 21 bp, Homo sapiens
gcccggacgcccaggacccca

SEQ ID NO: 1390885 - DNA, 15 bp, Homo sapiens
gcccgggagctcagg

SEQ ID NO: 1390886 - DNA, 15 bp, Homo sapiens
gccctgggaggctct

SEQ ID NO: 1390887 - DNA, 17 bp, Homo sapiens
gccctgggaggctctgg

SEQ ID NO: 1390888 - DNA, 19 bp, Homo sapiens
gccctgggaggctctggag

SEQ ID NO: 1390889 - DNA, 21 bp, Homo sapiens
gccctgggaggctctggagcc

SEQ ID NO: 1390890 - DNA, 23 bp, Homo sapiens
gccctgggaggctctggagccca

SEQ ID NO: 1390891 - DNA, 20 bp, Homo sapiens
gccctgtgccccttgacaac

SEQ ID NO: 1390892 - DNA, 22 bp, Homo sapiens
gccctgtgccccttgacaactg

SEQ ID NO: 1390893 - DNA, 19 bp, Homo sapiens
gcccttatgactgccaaga

SEQ ID NO: 1390894 - DNA, 23 bp, Homo sapiens
gcccttgtgaatcaagggtcagg

SEQ ID NO: 1390895 - DNA, 20 bp, Homo sapiens
gccggttgcagagaatctgt

SEQ ID NO: 1390896 - DNA, 13 bp, Homo sapiens
gcctaaaatgttc

SEQ ID NO: 1390897 - DNA, 17 bp, Homo sapiens
gcctaacctgccgagag

SEQ ID NO: 1390898 - DNA, 17 bp, Homo sapiens
gcctacccctcctgcgc

SEQ ID NO: 1390899 - DNA, 22 bp, Homo sapiens
gcctcacttttaatgaacaaat

SEQ ID NO: 1390900 - DNA, 16 bp, Homo sapiens
gcctcccatgcctggt

SEQ ID NO: 1390901 - DNA, 23 bp, Homo sapiens
gcctcccatgcctggtcccaaga

SEQ ID NO: 1390902 - DNA, 21 bp, Homo sapiens
gcctcctggctgtctgaggct

SEQ ID NO: 1390903 - DNA, 16 bp, Homo sapiens
gcctccttatttatca

SEQ ID NO: 1390904 - DNA, 17 bp, Homo sapiens
gcctccttatttatcaa

SEQ ID NO: 1390905 - DNA, 18 bp, Homo sapiens
gcctctcatcaactgaat

SEQ ID NO: 1390906 - DNA, 21 bp, Homo sapiens
gcctctccactcatgtgactc

SEQ ID NO: 1390907 - DNA, 17 bp, Homo sapiens
gcctctctgcaggtccc

SEQ ID NO: 1390908 - DNA, 21 bp, Homo sapiens
gcctctctgcaggtccctaat

SEQ ID NO: 1390909 - DNA, 23 bp, Homo sapiens
gcctgaccctacttcttttgctc

SEQ ID NO: 1390910 - DNA, 17 bp, Homo sapiens
gcctgaccctcatcttt

SEQ ID NO: 1390911 - DNA, 13 bp, Homo sapiens
gcctgcaggatct

SEQ ID NO: 1390912 - DNA, 23 bp, Homo sapiens
gcctgcaggatctcaccaggcag

SEQ ID NO: 1390913 - DNA, 24 bp, Homo sapiens
gcctgcaggatctcaccaggcagc

SEQ ID NO: 1390914 - DNA, 15 bp, Homo sapiens
gcctgggtctcctaa

SEQ ID NO: 1390915 - DNA, 19 bp, Homo sapiens
gcctgtgcctcctcacccc

SEQ ID NO: 1390916 - DNA, 17 bp, Homo sapiens
gccttctcatgatccaa

SEQ ID NO: 1390917 - DNA, 23 bp, Homo sapiens
gccttcttttgggggtcaacagt

SEQ ID NO: 1390918 - DNA, 16 bp, Homo sapiens
gccttgcggctcctca

SEQ ID NO: 1390919 - DNA, 21 bp, Homo sapiens
gccttgggctccgtgtgggag

SEQ ID NO: 1390920 - DNA, 16 bp, Homo sapiens
gccttgtcacgccaga

SEQ ID NO: 1390921 - DNA, 16 bp, Homo sapiens
gccttgtttttttcta

SEQ ID NO: 1390922 - DNA, 21 bp, Homo sapiens
gcctttattaaaaactgagtg

SEQ ID NO: 1390923 - DNA, 18 bp, Homo sapiens
gcctttggacttgtcccg

SEQ ID NO: 1390924 - DNA, 17 bp, Homo sapiens
gcgaagcgttgtcctca

SEQ ID NO: 1390925 - DNA, 18 bp, Homo sapiens
gcgattctcttgcctcaa

SEQ ID NO: 1390926 - DNA, 19 bp, Homo sapiens
gcgcaggccgtgacgtctg

SEQ ID NO: 1390927 - DNA, 13 bp, Homo sapiens
gcggcatcaggct

SEQ ID NO: 1390928 - DNA, 17 bp, Homo sapiens
gcggctgggaggagggc

SEQ ID NO: 1390929 - DNA, 18 bp, Homo sapiens
gcggctgggaggagggca

SEQ ID NO: 1390930 - DNA, 22 bp, Homo sapiens
gcggctgggaggagggcaggca

SEQ ID NO: 1390931 - DNA, 17 bp, Homo sapiens
gcggtgcttgatagaaa

SEQ ID NO: 1390932 - DNA, 20 bp, Homo sapiens
gctaatttttgtatttttag

SEQ ID NO: 1390933 - DNA, 20 bp, Homo sapiens
gctaattttttgttgtttct

SEQ ID NO: 1390934 - DNA, 14 bp, Homo sapiens
gctacgtatttaat

SEQ ID NO: 1390935 - DNA, 19 bp, Homo sapiens
gctactctagtattccaga

SEQ ID NO: 1390936 - DNA, 18 bp, Homo sapiens
gctactgccgtcagtgct

SEQ ID NO: 1390937 - DNA, 24 bp, Homo sapiens
gctacttgatgtaactgagaattt

SEQ ID NO: 1390938 - DNA, 18 bp, Homo sapiens
gctatggtgctctgtcta

SEQ ID NO: 1390939 - DNA, 13 bp, Homo sapiens
gctatggttttct

SEQ ID NO: 1390940 - DNA, 18 bp, Homo sapiens
gctatgtttttaatgtat

SEQ ID NO: 1390941 - DNA, 17 bp, Homo sapiens
gctattattttcactgt

SEQ ID NO: 1390942 - DNA, 14 bp, Homo sapiens
gctatttcatctat

SEQ ID NO: 1390943 - DNA, 14 bp, Homo sapiens
gctatttgaagtgt

SEQ ID NO: 1390944 - DNA, 23 bp, Homo sapiens
gctattttatattacactacaca

SEQ ID NO: 1390945 - DNA, 22 bp, Homo sapiens
gctcacagtacaatgtttcaga

SEQ ID NO: 1390946 - DNA, 15 bp, Homo sapiens
gctcacttctgggct

SEQ ID NO: 1390947 - DNA, 23 bp, Homo sapiens
gctcacttctgggcttcatctgg

SEQ ID NO: 1390948 - DNA, 18 bp, Homo sapiens
gctcagagggtgtcctgc

SEQ ID NO: 1390949 - DNA, 16 bp, Homo sapiens
gctcaggaaccgaggc

SEQ ID NO: 1390950 - DNA, 19 bp, Homo sapiens
gctcaggaaccgaggcagg

SEQ ID NO: 1390951 - DNA, 21 bp, Homo sapiens
gctcaggaaccgaggcaggga

SEQ ID NO: 1390952 - DNA, 14 bp, Homo sapiens
gctcaggagccctg

SEQ ID NO: 1390953 - DNA, 18 bp, Homo sapiens
gctcaggagccctgggag

SEQ ID NO: 1390954 - DNA, 21 bp, Homo sapiens
gctcagtaatttgaggacaac

SEQ ID NO: 1390955 - DNA, 22 bp, Homo sapiens
gctcccagggacacctgggaga

SEQ ID NO: 1390956 - DNA, 18 bp, Homo sapiens
gctcctcgagatcccaac

SEQ ID NO: 1390957 - DNA, 21 bp, Homo sapiens
gctccttaaggctcttttgta

SEQ ID NO: 1390958 - DNA, 20 bp, Homo sapiens
gctctctccaggcaggtctg

SEQ ID NO: 1390959 - DNA, 19 bp, Homo sapiens
gctctctgtgggctggcag

SEQ ID NO: 1390960 - DNA, 13 bp, Homo sapiens
gctctgtctactt

SEQ ID NO: 1390961 - DNA, 16 bp, Homo sapiens
gctcttgatgcctggc

SEQ ID NO: 1390962 - DNA, 18 bp, Homo sapiens
gctctttggtagaaaagg

SEQ ID NO: 1390963 - DNA, 18 bp, Homo sapiens
gctgagcaaatcaccaca

SEQ ID NO: 1390964 - DNA, 12 bp, Homo sapiens
gctgataatttt

SEQ ID NO: 1390965 - DNA, 14 bp, Homo sapiens
gctgataattttaa

SEQ ID NO: 1390966 - DNA, 21 bp, Homo sapiens
tgtggcatccagagtccctgc

SEQ ID NO: 1390967 - DNA, 13 bp, Homo sapiens
tgtggccaggagg

SEQ ID NO: 1390968 - DNA, 22 bp, Homo sapiens
tgtggcccctgaacaagaattg

SEQ ID NO: 1390969 - DNA, 17 bp, Homo sapiens
tgtgggagaccggcctg

SEQ ID NO: 1390970 - DNA, 14 bp, Homo sapiens
tgtgggtgttaatt

SEQ ID NO: 1390971 - DNA, 17 bp, Homo sapiens
tgtgtagctttgctctt

SEQ ID NO: 1390972 - DNA, 21 bp, Homo sapiens
tgtgtatatatatatatatgt

SEQ ID NO: 1390973 - DNA, 15 bp, Homo sapiens
tgtgtgtaaaaaagt

SEQ ID NO: 1390974 - DNA, 13 bp, Homo sapiens
tgttaatattgat

SEQ ID NO: 1390975 - DNA, 21 bp, Homo sapiens
tgttactagagttagatatgt

SEQ ID NO: 1390976 - DNA, 23 bp, Homo sapiens
tgttactagagttagatatgtgc

SEQ ID NO: 1390977 - DNA, 16 bp, Homo sapiens
tgttatataatcatta

SEQ ID NO: 1390978 - DNA, 15 bp, Homo sapiens
tgttatgctgtgaca

SEQ ID NO: 1390979 - DNA, 12 bp, Homo sapiens
tgttattaaaca

SEQ ID NO: 1390980 - DNA, 19 bp, Homo sapiens
tgttccttaagtcagaaca

SEQ ID NO: 1390981 - DNA, 15 bp, Homo sapiens
tgttctgataatgaa

SEQ ID NO: 1390982 - DNA, 16 bp, Homo sapiens
tgttctggacctcccc

SEQ ID NO: 1390983 - DNA, 20 bp, Homo sapiens
tgttctggacctccccctct

SEQ ID NO: 1390984 - DNA, 17 bp, Homo sapiens
tgttcttacctgtatgt

SEQ ID NO: 1390985 - DNA, 20 bp, Homo sapiens
tgttctttggaaatacacag

SEQ ID NO: 1390986 - DNA, 14 bp, Homo sapiens
tgttgaaaatgttc

SEQ ID NO: 1390987 - DNA, 17 bp, Homo sapiens
tgttgaaaatgttcaga

SEQ ID NO: 1390988 - DNA, 15 bp, Homo sapiens
tgttgagagtgtgac

SEQ ID NO: 1390989 - DNA, 17 bp, Homo sapiens
tgttgagcatcacagaa

SEQ ID NO: 1390990 - DNA, 17 bp, Homo sapiens
tgttgggagagggcgca

SEQ ID NO: 1390991 - DNA, 17 bp, Homo sapiens
tgttgtgactggcaccc

SEQ ID NO: 1390992 - DNA, 16 bp, Homo sapiens
tgttgtttcttaaata

SEQ ID NO: 1390993 - DNA, 21 bp, Homo sapiens
tgttgtttcttaaataagaaa

SEQ ID NO: 1390994 - DNA, 16 bp, Homo sapiens
tgtttaaaacatcatt

SEQ ID NO: 1390995 - DNA, 15 bp, Homo sapiens
tgtttactgcaaggt

SEQ ID NO: 1390996 - DNA, 16 bp, Homo sapiens
tgtttagtagcagtga

SEQ ID NO: 1390997 - DNA, 24 bp, Homo sapiens
tgtttatttttctatgaattccta

SEQ ID NO: 1390998 - DNA, 17 bp, Homo sapiens
tgtttctactttgatat

SEQ ID NO: 1390999 - DNA, 16 bp, Homo sapiens
tgtttctgtaagaaac

SEQ ID NO: 1391000 - DNA, 13 bp, Homo sapiens
tgtttgctttctg

SEQ ID NO: 1391001 - DNA, 22 bp, Homo sapiens
tgtttgctttctgatcaaggcc

SEQ ID NO: 1391002 - DNA, 13 bp, Homo sapiens
tgtttggctttca

SEQ ID NO: 1391003 - DNA, 14 bp, Homo sapiens
tgttttatgagaaa

SEQ ID NO: 1391004 - DNA, 15 bp, Homo sapiens
tgttttatgagaaag

SEQ ID NO: 1391005 - DNA, 12 bp, Homo sapiens
tgttttctctga

SEQ ID NO: 1391006 - DNA, 17 bp, Homo sapiens
tgttttctctgaacaca

SEQ ID NO: 1391007 - DNA, 20 bp, Homo sapiens
tgtttttaatgctttgatat

SEQ ID NO: 1391008 - DNA, 12 bp, Homo sapiens
ttaaaaaaataa

SEQ ID NO: 1391009 - DNA, 12 bp, Homo sapiens
ttaaaaaagctt

SEQ ID NO: 1391010 - DNA, 19 bp, Homo sapiens
ttaaaaaagcttaaaactt

SEQ ID NO: 1391011 - DNA, 16 bp, Homo sapiens
ttaaaaaggtttacag

SEQ ID NO: 1391012 - DNA, 14 bp, Homo sapiens
ttaaaacagacact

SEQ ID NO: 1391013 - DNA, 22 bp, Homo sapiens
ttaaaagatgcttttaacagag

SEQ ID NO: 1391014 - DNA, 19 bp, Homo sapiens
ttaaaatagcaaaagaaga

SEQ ID NO: 1391015 - DNA, 21 bp, Homo sapiens
ttaaaatagcaaaagaagaag

SEQ ID NO: 1391016 - DNA, 16 bp, Homo sapiens
ttaaaatataaattaa

SEQ ID NO: 1391017 - DNA, 13 bp, Homo sapiens
ttaaacaaatgtg

SEQ ID NO: 1391018 - DNA, 12 bp, Homo sapiens
ttaaactgtgta

SEQ ID NO: 1391019 - DNA, 19 bp, Homo sapiens
ttaaactgtgtacataact

SEQ ID NO: 1391020 - DNA, 16 bp, Homo sapiens
ttaaagacttaagatt

SEQ ID NO: 1391021 - DNA, 18 bp, Homo sapiens
ttaaagacttaagattaa

SEQ ID NO: 1391022 - DNA, 15 bp, Homo sapiens
ttaaagttgtttgtg

SEQ ID NO: 1391023 - DNA, 15 bp, Homo sapiens
ttaaataagaaactt

SEQ ID NO: 1391024 - DNA, 17 bp, Homo sapiens
ttaaatgtaaagatatt

SEQ ID NO: 1391025 - DNA, 18 bp, Homo sapiens
ttaacaaatgtatcacta

SEQ ID NO: 1391026 - DNA, 22 bp, Homo sapiens
ttaacagaagttgtgaaactaa

SEQ ID NO: 1391027 - DNA, 15 bp, Homo sapiens
ttaactctctttatg

SEQ ID NO: 1391028 - DNA, 17 bp, Homo sapiens
ttaactctctttatgtc

SEQ ID NO: 1391029 - DNA, 19 bp, Homo sapiens
ttaactctctttatgtctg

SEQ ID NO: 1391030 - DNA, 13 bp, Homo sapiens
ttaacttaaatag

SEQ ID NO: 1391031 - DNA, 10 bp, Homo sapiens
ttaagacttt

SEQ ID NO: 1391032 - DNA, 12 bp, Homo sapiens
ttaagagtaaaa

SEQ ID NO: 1391033 - DNA, 17 bp, Homo sapiens
ttaagatacactcctgc

SEQ ID NO: 1391034 - DNA, 23 bp, Homo sapiens
ttaagattaaattatatctgagg

SEQ ID NO: 1391035 - DNA, 16 bp, Homo sapiens
ttaagccaaaacaatg

SEQ ID NO: 1391036 - DNA, 18 bp, Homo sapiens
ttaagggaagaattccag

SEQ ID NO: 1391037 - DNA, 17 bp, Homo sapiens
ttaataaacgtttgaaa

SEQ ID NO: 1391038 - DNA, 16 bp, Homo sapiens
ttaatactcacctcct

SEQ ID NO: 1391039 - DNA, 20 bp, Homo sapiens
ttaatagcaaagaattgact

SEQ ID NO: 1391040 - DNA, 20 bp, Homo sapiens
ttaatatatattatcttttc

SEQ ID NO: 1391041 - DNA, 16 bp, Homo sapiens
ttaatattgatttatt

SEQ ID NO: 1391042 - DNA, 14 bp, Homo sapiens
ttaatgaacaaatg

SEQ ID NO: 1391043 - DNA, 18 bp, Homo sapiens
ttaatggctgataatttt

SEQ ID NO: 1391044 - DNA, 19 bp, Homo sapiens
ttaatggtgccttcatttg

SEQ ID NO: 1391045 - DNA, 15 bp, Homo sapiens
ttaatgtttaaaaca

SEQ ID NO: 1391046 - DNA, 15 bp, Homo sapiens
ttaatttagaaaact

SEQ ID NO: 1391047 - DNA, 16 bp, Homo sapiens
ttaatttagaaaactt

SEQ ID NO: 1391048 - DNA, 18 bp, Homo sapiens
ttacaattttttatcatg

SEQ ID NO: 1391049 - DNA, 13 bp, Homo sapiens
ttacacccaaata

SEQ ID NO: 1391050 - DNA, 22 bp, Homo sapiens
ttacatgatcttggtttatcat

SEQ ID NO: 1391051 - DNA, 17 bp, Homo sapiens
ttacatgattcatttta

SEQ ID NO: 1391052 - DNA, 22 bp, Homo sapiens
ttacatgcattactgcatgcac

SEQ ID NO: 1391053 - DNA, 12 bp, Homo sapiens
ttacatgtttgc

SEQ ID NO: 1391054 - DNA, 21 bp, Homo sapiens
ttaccagatttttacacatgt

SEQ ID NO: 1391055 - DNA, 21 bp, Homo sapiens
ttaccaggcaccaaaagaagt

SEQ ID NO: 1391056 - DNA, 13 bp, Homo sapiens
ttacctactttga

SEQ ID NO: 1391057 - DNA, 20 bp, Homo sapiens
ttactaaggaagattactca

SEQ ID NO: 1391058 - DNA, 13 bp, Homo sapiens
ttactacatgcac

SEQ ID NO: 1391059 - DNA, 15 bp, Homo sapiens
ttactataagaactt

SEQ ID NO: 1391060 - DNA, 18 bp, Homo sapiens
ttactgaatttttaaaat

SEQ ID NO: 1391061 - DNA, 14 bp, Homo sapiens
ttactgatatattt

SEQ ID NO: 1391062 - DNA, 23 bp, Homo sapiens
ttactgatatattttacaatttt

SEQ ID NO: 1391063 - DNA, 18 bp, Homo sapiens
ttactggtccaaaagatt

SEQ ID NO: 1391064 - DNA, 15 bp, Homo sapiens
ttacttttaaactgt

SEQ ID NO: 1391065 - DNA, 19 bp, Homo sapiens
ttacttttaaactgtgtac

SEQ ID NO: 1391066 - DNA, 17 bp, Homo sapiens
ttagaacacacacactt

SEQ ID NO: 1391067 - DNA, 16 bp, Homo sapiens
ttagactggaacttga

SEQ ID NO: 1391068 - DNA, 17 bp, Homo sapiens
ttagactggaacttgaa

SEQ ID NO: 1391069 - DNA, 19 bp, Homo sapiens
ttagactggacagcttgtg

SEQ ID NO: 1391070 - DNA, 16 bp, Homo sapiens
ttagatgtgagagaaa

SEQ ID NO: 1391071 - DNA, 22 bp, Homo sapiens
ttagcaaagatatctcatctct

SEQ ID NO: 1391072 - DNA, 15 bp, Homo sapiens
ttagcccctgaaagc

SEQ ID NO: 1391073 - DNA, 20 bp, Homo sapiens
ttagcctcaatttctgaaca

SEQ ID NO: 1391074 - DNA, 12 bp, Homo sapiens
ttagccttctct

SEQ ID NO: 1391075 - DNA, 14 bp, Homo sapiens
ttagccttctctgt

SEQ ID NO: 1391076 - DNA, 15 bp, Homo sapiens
ttagccttctctgtt

SEQ ID NO: 1391077 - DNA, 21 bp, Homo sapiens
ttagccttctctgttcatttc

SEQ ID NO: 1391078 - DNA, 15 bp, Homo sapiens
ttagctggacatgct

SEQ ID NO: 1391079 - DNA, 16 bp, Homo sapiens
ttagctggcattacag

SEQ ID NO: 1391080 - DNA, 15 bp, Homo sapiens
ttagctgtctgctca

SEQ ID NO: 1391081 - DNA, 15 bp, Homo sapiens
ttagcttctctgcca

SEQ ID NO: 1391082 - DNA, 13 bp, Homo sapiens
ttagctttaactt

SEQ ID NO: 1391083 - DNA, 18 bp, Homo sapiens
ttaggaagcaagcttaat

SEQ ID NO: 1391084 - DNA, 15 bp, Homo sapiens
ttaggcagactcttt

SEQ ID NO: 1391085 - DNA, 20 bp, Homo sapiens
ttagtggctcaacattgtgt

SEQ ID NO: 1391086 - DNA, 23 bp, Homo sapiens
ttagtggctcaacattgtgttcc

SEQ ID NO: 1391087 - DNA, 19 bp, Homo sapiens
ttataaccttaatttatta

SEQ ID NO: 1391088 - DNA, 21 bp, Homo sapiens
ttataatgggcattactgaat

SEQ ID NO: 1391089 - DNA, 20 bp, Homo sapiens
ttatacgagtaatatgcctg

SEQ ID NO: 1391090 - DNA, 16 bp, Homo sapiens
ttatataatcattatt

SEQ ID NO: 1391091 - DNA, 17 bp, Homo sapiens
ttatattgataagatct

SEQ ID NO: 1391092 - DNA, 13 bp, Homo sapiens
ttatatttaactc

SEQ ID NO: 1391093 - DNA, 21 bp, Homo sapiens
ttatcaacttcctaaatatta

SEQ ID NO: 1391094 - DNA, 16 bp, Homo sapiens
ttatcctgaaatttca

SEQ ID NO: 1391095 - DNA, 11 bp, Homo sapiens
ttatctaattt

SEQ ID NO: 1391096 - DNA, 17 bp, Homo sapiens
ttatctgaatttttaaa

SEQ ID NO: 1391097 - DNA, 18 bp, Homo sapiens
ttatctgaatttttaaac

SEQ ID NO: 1391098 - DNA, 20 bp, Homo sapiens
ttatctgaatttttaaacaa

SEQ ID NO: 1391099 - DNA, 19 bp, Homo sapiens
ttatgaaaaagaagaatct

SEQ ID NO: 1391100 - DNA, 15 bp, Homo sapiens
ttatgactgccaaga

SEQ ID NO: 1391101 - DNA, 19 bp, Homo sapiens
ttatgatttttttttcata

SEQ ID NO: 1391102 - DNA, 16 bp, Homo sapiens
ttatgccacctgaata

SEQ ID NO: 1391103 - DNA, 17 bp, Homo sapiens
ttatgctgtgacacatg

SEQ ID NO: 1391104 - DNA, 19 bp, Homo sapiens
ttattaacaattaggcaga

SEQ ID NO: 1391105 - DNA, 14 bp, Homo sapiens
ttattacttttgct

SEQ ID NO: 1391106 - DNA, 20 bp, Homo sapiens
ttattcctcctgctcatatt

SEQ ID NO: 1391107 - DNA, 19 bp, Homo sapiens
ttattcgtagatattggac

SEQ ID NO: 1391108 - DNA, 23 bp, Homo sapiens
ttattgagtctgtccagataagt

SEQ ID NO: 1391109 - DNA, 15 bp, Homo sapiens
ttatttattggagat

SEQ ID NO: 1391110 - DNA, 19 bp, Homo sapiens
ttattttaaccagttattt

SEQ ID NO: 1391111 - DNA, 16 bp, Homo sapiens
ttatttttctatgaat

SEQ ID NO: 1391112 - DNA, 18 bp, Homo sapiens
ttcaaaacattgtgccat

SEQ ID NO: 1391113 - DNA, 23 bp, Homo sapiens
ttcaaagctgtgtgtttggaaga

SEQ ID NO: 1391114 - DNA, 19 bp, Homo sapiens
ttcaaagtttaataaattt

SEQ ID NO: 1391115 - DNA, 18 bp, Homo sapiens
ttcaaatagggtctaact

SEQ ID NO: 1391116 - DNA, 19 bp, Homo sapiens
ttcaaatagggtctaactc

SEQ ID NO: 1391117 - DNA, 15 bp, Homo sapiens
ttcaacaattctaaa

SEQ ID NO: 1391118 - DNA, 18 bp, Homo sapiens
ttcaacaattctaaaatg

SEQ ID NO: 1391119 - DNA, 18 bp, Homo sapiens
ttcaacagtgaagacaga

SEQ ID NO: 1391120 - DNA, 17 bp, Homo sapiens
ttcaacatgttatttgt

SEQ ID NO: 1391121 - DNA, 22 bp, Homo sapiens
ttcaagaaagcttcaaactgca

SEQ ID NO: 1391122 - DNA, 15 bp, Homo sapiens
ttcaaggaaaataag

SEQ ID NO: 1391123 - DNA, 18 bp, Homo sapiens
ttcaatctgtaaactgtg

SEQ ID NO: 1391124 - DNA, 20 bp, Homo sapiens
ttcaatctgtaaactgtgta

SEQ ID NO: 1391125 - DNA, 15 bp, Homo sapiens
ttcacattagaagac

SEQ ID NO: 1391126 - DNA, 16 bp, Homo sapiens
ttcacattagaagaca

SEQ ID NO: 1391127 - DNA, 18 bp, Homo sapiens
ttcaccagatttgctaat

SEQ ID NO: 1391128 - DNA, 22 bp, Homo sapiens
ttcactgtagaatgatttcatg

SEQ ID NO: 1391129 - DNA, 12 bp, Homo sapiens
ttcagaagaaaa

SEQ ID NO: 1391130 - DNA, 16 bp, Homo sapiens
ttcagatgtgaaccat

SEQ ID NO: 1391131 - DNA, 22 bp, Homo sapiens
ttcagattcccagagcaaaata

SEQ ID NO: 1391132 - DNA, 20 bp, Homo sapiens
ttcagctaagctaggaatga

SEQ ID NO: 1391133 - DNA, 20 bp, Homo sapiens
ttcaggagagagttgaacct

SEQ ID NO: 1391134 - DNA, 22 bp, Homo sapiens
ttcagggggcctttaaagactt

SEQ ID NO: 1391135 - DNA, 14 bp, Homo sapiens
ttcaggttgttctg

SEQ ID NO: 1391136 - DNA, 16 bp, Homo sapiens
ttcagttttgatattt

SEQ ID NO: 1391137 - DNA, 14 bp, Homo sapiens
ttcatataaagtat

SEQ ID NO: 1391138 - DNA, 16 bp, Homo sapiens
ttcatataaagtatca

SEQ ID NO: 1391139 - DNA, 14 bp, Homo sapiens
ttcatcatttttta

SEQ ID NO: 1391140 - DNA, 15 bp, Homo sapiens
ttcatctaggatttt

SEQ ID NO: 1391141 - DNA, 19 bp, Homo sapiens
ttcatctggcaacatcttt

SEQ ID NO: 1391142 - DNA, 15 bp, Homo sapiens
ttcatgataatgaac

SEQ ID NO: 1391143 - DNA, 23 bp, Homo sapiens
ttcattcttaacaagatatttat

SEQ ID NO: 1391144 - DNA, 16 bp, Homo sapiens
ttcatttcctcaaaaa

SEQ ID NO: 1391145 - DNA, 13 bp, Homo sapiens
ttcattttctcta

SEQ ID NO: 1391146 - DNA, 14 bp, Homo sapiens
ttccaaactaattt

SEQ ID NO: 1391147 - DNA, 17 bp, Homo sapiens
ttccaacttggctgcag

SEQ ID NO: 1391148 - DNA, 22 bp, Homo sapiens
ttccaacttggctgcaggaatc

SEQ ID NO: 1391149 - DNA, 16 bp, Homo sapiens
ttccaagttgctaata

SEQ ID NO: 1391150 - DNA, 20 bp, Homo sapiens
ttccagaggctattattttc

SEQ ID NO: 1391151 - DNA, 17 bp, Homo sapiens
ttccagtcttcctgaca

SEQ ID NO: 1391152 - DNA, 20 bp, Homo sapiens
ttccagtcttcctgacactt

SEQ ID NO: 1391153 - DNA, 21 bp, Homo sapiens
ttccatgcgtgtttctgactc

SEQ ID NO: 1391154 - DNA, 22 bp, Homo sapiens
ttccatgggaccacaactattt

SEQ ID NO: 1391155 - DNA, 13 bp, Homo sapiens
ttccattacatga

SEQ ID NO: 1391156 - DNA, 21 bp, Homo sapiens
ttcccacccaattcaaaacat

SEQ ID NO: 1391157 - DNA, 23 bp, Homo sapiens
ttcccagagcaaaataattttaa

SEQ ID NO: 1391158 - DNA, 17 bp, Homo sapiens
ttccctactgaagccct

SEQ ID NO: 1391159 - DNA, 14 bp, Homo sapiens
ttcctagccctctc

SEQ ID NO: 1391160 - DNA, 15 bp, Homo sapiens
ttcctagttttctcc

SEQ ID NO: 1391161 - DNA, 14 bp, Homo sapiens
ttcctatgctttga

SEQ ID NO: 1391162 - DNA, 18 bp, Homo sapiens
ttcctctaggaaatgtac

SEQ ID NO: 1391163 - DNA, 19 bp, Homo sapiens
ttccttaagtcagaacagc

SEQ ID NO: 1391164 - DNA, 20 bp, Homo sapiens
ttccttaagtcagaacagca

SEQ ID NO: 1391165 - DNA, 13 bp, Homo sapiens
ttccttacctttt

SEQ ID NO: 1391166 - DNA, 12 bp, Homo sapiens
ttccttttaatt

SEQ ID NO: 1391167 - DNA, 19 bp, Homo sapiens
ttcggacagtttatttgtt

SEQ ID NO: 1391168 - DNA, 15 bp, Homo sapiens
ttctaaaatgattgt

SEQ ID NO: 1391169 - DNA, 17 bp, Homo sapiens
ttctaattggcatgaag

SEQ ID NO: 1391170 - DNA, 17 bp, Homo sapiens
ttctagttctgccagga

SEQ ID NO: 1391171 - DNA, 14 bp, Homo sapiens
ttctagttgaaaat

SEQ ID NO: 1391172 - DNA, 14 bp, Homo sapiens
ttctatagccaaaa

SEQ ID NO: 1391173 - DNA, 16 bp, Homo sapiens
ttctattttgtaaact

SEQ ID NO: 1391174 - DNA, 22 bp, Homo sapiens
ttctcattttttaaaaaagctt

SEQ ID NO: 1391175 - DNA, 16 bp, Homo sapiens
ttctccaagagctaca

SEQ ID NO: 1391176 - DNA, 16 bp, Homo sapiens
ttctcctttttacccc

SEQ ID NO: 1391177 - DNA, 16 bp, Homo sapiens
ttctgaactcaaactg

SEQ ID NO: 1391178 - DNA, 16 bp, Homo sapiens
ttctgagctatttcat

SEQ ID NO: 1391179 - DNA, 16 bp, Homo sapiens
ttctgataatgaaaat

SEQ ID NO: 1391180 - DNA, 21 bp, Homo sapiens
ttctgattcgaatgacactgt

SEQ ID NO: 1391181 - DNA, 12 bp, Homo sapiens
ttctgccaggag

SEQ ID NO: 1391182 - DNA, 16 bp, Homo sapiens
ttctgccttctcatga

SEQ ID NO: 1391183 - DNA, 21 bp, Homo sapiens
ttctgctactttgctgctatg

SEQ ID NO: 1391184 - DNA, 19 bp, Homo sapiens
ttctggattataaaaatga

SEQ ID NO: 1391185 - DNA, 15 bp, Homo sapiens
ttctggccaggaagc

SEQ ID NO: 1391186 - DNA, 16 bp, Homo sapiens
ttcttaaacacttgca

SEQ ID NO: 1391187 - DNA, 19 bp, Homo sapiens
ttcttaacaagatatttat

SEQ ID NO: 1391188 - DNA, 13 bp, Homo sapiens
ttcttccatctga

SEQ ID NO: 1391189 - DNA, 14 bp, Homo sapiens
ttcttccatctgat

SEQ ID NO: 1391190 - DNA, 19 bp, Homo sapiens
ttcttgaggggaccaggag

SEQ ID NO: 1391191 - DNA, 20 bp, Homo sapiens
ttcttgaggggaccaggagt

SEQ ID NO: 1391192 - DNA, 15 bp, Homo sapiens
ttctttctcactaaa

SEQ ID NO: 1391193 - DNA, 19 bp, Homo sapiens
ttctttgtgtagctttgct

SEQ ID NO: 1391194 - DNA, 16 bp, Homo sapiens
ttctttttttagagaa

SEQ ID NO: 1391195 - DNA, 20 bp, Homo sapiens
ttgaaattttccattacatg

SEQ ID NO: 1391196 - DNA, 13 bp, Homo sapiens
tgctccccacgtc

SEQ ID NO: 1391197 - DNA, 19 bp, Homo sapiens
tgctgagatacatacagaa

SEQ ID NO: 1391198 - DNA, 15 bp, Homo sapiens
tgctgatattttctc

SEQ ID NO: 1391199 - DNA, 14 bp, Homo sapiens
tgctgcaaacctga

SEQ ID NO: 1391200 - DNA, 18 bp, Homo sapiens
tgctggaaaataatactg

SEQ ID NO: 1391201 - DNA, 21 bp, Homo sapiens
tgctgggcccctgcctctctg

SEQ ID NO: 1391202 - DNA, 24 bp, Homo sapiens
tgctgggcccctgcctctctgcag

SEQ ID NO: 1391203 - DNA, 13 bp, Homo sapiens
tgctgtggccagg

SEQ ID NO: 1391204 - DNA, 14 bp, Homo sapiens
tgctgtggccagga

SEQ ID NO: 1391205 - DNA, 17 bp, Homo sapiens
tgctgtggccaggaggt

SEQ ID NO: 1391206 - DNA, 13 bp, Homo sapiens
tgcttaaaaatgc

SEQ ID NO: 1391207 - DNA, 13 bp, Homo sapiens
tgcttgatagaaa

SEQ ID NO: 1391208 - DNA, 19 bp, Homo sapiens
tgcttgatgggattctgga

SEQ ID NO: 1391209 - DNA, 17 bp, Homo sapiens
tgcttggagctgagcaa

SEQ ID NO: 1391210 - DNA, 13 bp, Homo sapiens
tgctttgatattt

SEQ ID NO: 1391211 - DNA, 13 bp, Homo sapiens
tggaaataaatgt

SEQ ID NO: 1391212 - DNA, 14 bp, Homo sapiens
tggaaatacacagt

SEQ ID NO: 1391213 - DNA, 16 bp, Homo sapiens
tggaaattggaagagc

SEQ ID NO: 1391214 - DNA, 17 bp, Homo sapiens
tggaagctgccctgccc

SEQ ID NO: 1391215 - DNA, 11 bp, Homo sapiens
tggaataagtg

SEQ ID NO: 1391216 - DNA, 12 bp, Homo sapiens
tggaataagtgt

SEQ ID NO: 1391217 - DNA, 22 bp, Homo sapiens
tggaatcactgtttagaacaca

SEQ ID NO: 1391218 - DNA, 16 bp, Homo sapiens
tggaatcagctcagga

SEQ ID NO: 1391219 - DNA, 23 bp, Homo sapiens
tggaatgtggcccctgaacaaga

SEQ ID NO: 1391220 - DNA, 22 bp, Homo sapiens
tggacctaatccaagcatccct

SEQ ID NO: 1391221 - DNA, 15 bp, Homo sapiens
tggactgtgtgctca

SEQ ID NO: 1391222 - DNA, 16 bp, Homo sapiens
tggagcccactgtact

SEQ ID NO: 1391223 - DNA, 22 bp, Homo sapiens
tggagctttagcttctctgcca

SEQ ID NO: 1391224 - DNA, 22 bp, Homo sapiens
tggaggccattgtgtgagccta

SEQ ID NO: 1391225 - DNA, 15 bp, Homo sapiens
tggagtgcttaaaaa

SEQ ID NO: 1391226 - DNA, 17 bp, Homo sapiens
tggagttttttgtacca

SEQ ID NO: 1391227 - DNA, 17 bp, Homo sapiens
tggatatgtaaaacatt

SEQ ID NO: 1391228 - DNA, 18 bp, Homo sapiens
tggattccccatctcagg

SEQ ID NO: 1391229 - DNA, 19 bp, Homo sapiens
tggattccccatctcaggc

SEQ ID NO: 1391230 - DNA, 13 bp, Homo sapiens
tggattctaaaat

SEQ ID NO: 1391231 - DNA, 23 bp, Homo sapiens
tggattttttccttcaaagttta

SEQ ID NO: 1391232 - DNA, 15 bp, Homo sapiens
tggcaattttgtaac

SEQ ID NO: 1391233 - DNA, 22 bp, Homo sapiens
tggcacagcctggctgtggcct

SEQ ID NO: 1391234 - DNA, 12 bp, Homo sapiens
tggcaggaaggc

SEQ ID NO: 1391235 - DNA, 15 bp, Homo sapiens
tggcaggaaggcttg

SEQ ID NO: 1391236 - DNA, 21 bp, Homo sapiens
tggcatccagagtccctgcct

SEQ ID NO: 1391237 - DNA, 18 bp, Homo sapiens
tggcatgagaaatacaaa

SEQ ID NO: 1391238 - DNA, 12 bp, Homo sapiens
tggcatgtgttt

SEQ ID NO: 1391239 - DNA, 20 bp, Homo sapiens
tggcatgttagcccttcctc

SEQ ID NO: 1391240 - DNA, 13 bp, Homo sapiens
tggccaggaagct

SEQ ID NO: 1391241 - DNA, 11 bp, Homo sapiens
tggccaggagg

SEQ ID NO: 1391242 - DNA, 12 bp, Homo sapiens
tggccaggaggt

SEQ ID NO: 1391243 - DNA, 17 bp, Homo sapiens
gctttggtgagaacctg

SEQ ID NO: 1391244 - DNA, 13 bp, Homo sapiens
gctttttccagag

SEQ ID NO: 1391245 - DNA, 15 bp, Homo sapiens
ggaaaaatgtaggag

SEQ ID NO: 1391246 - DNA, 16 bp, Homo sapiens
ggaaaataatactgct

SEQ ID NO: 1391247 - DNA, 22 bp, Homo sapiens
ggaaatcaaaagggccaaagaa

SEQ ID NO: 1391248 - DNA, 16 bp, Homo sapiens
ggaaattgattttgaa

SEQ ID NO: 1391249 - DNA, 20 bp, Homo sapiens
ggaaccgaggcagggaagga

SEQ ID NO: 1391250 - DNA, 19 bp, Homo sapiens
ggaagcatttgtttctact

SEQ ID NO: 1391251 - DNA, 17 bp, Homo sapiens
ggaagctgccctgccca

SEQ ID NO: 1391252 - DNA, 17 bp, Homo sapiens
ggaaggatcccatgagc

SEQ ID NO: 1391253 - DNA, 22 bp, Homo sapiens
ggaaggatcccatgagctcctt

SEQ ID NO: 1391254 - DNA, 21 bp, Homo sapiens
ggaaggcttgttgtgctttta

SEQ ID NO: 1391255 - DNA, 16 bp, Homo sapiens
ggaagggtagaaaact

SEQ ID NO: 1391256 - DNA, 19 bp, Homo sapiens
ggaataaggtacaagaagc

SEQ ID NO: 1391257 - DNA, 15 bp, Homo sapiens
ggaataagtgtacat

SEQ ID NO: 1391258 - DNA, 15 bp, Homo sapiens
ggaatataattgttt

SEQ ID NO: 1391259 - DNA, 12 bp, Homo sapiens
ggacacactgta

SEQ ID NO: 1391260 - DNA, 23 bp, Homo sapiens
ggacacactgtaaacccctgggt

SEQ ID NO: 1391261 - DNA, 21 bp, Homo sapiens
ggaccaggagtgggtggggag

SEQ ID NO: 1391262 - DNA, 15 bp, Homo sapiens
ggacctccccctctt

SEQ ID NO: 1391263 - DNA, 19 bp, Homo sapiens
ggactatgaaaagctagaa

SEQ ID NO: 1391264 - DNA, 22 bp, Homo sapiens
ggactgtgtgctcaggagccct

SEQ ID NO: 1391265 - DNA, 19 bp, Homo sapiens
ggagaccggcctgccagga

SEQ ID NO: 1391266 - DNA, 23 bp, Homo sapiens
ggagattctcataacttgagacc

SEQ ID NO: 1391267 - DNA, 19 bp, Homo sapiens
ggagcaggaggccaataaa

SEQ ID NO: 1391268 - DNA, 18 bp, Homo sapiens
ggagcccactgtacttgc

SEQ ID NO: 1391269 - DNA, 22 bp, Homo sapiens
ggagcccactgtacttgctctt

SEQ ID NO: 1391270 - DNA, 12 bp, Homo sapiens
ggagccctggga

SEQ ID NO: 1391271 - DNA, 19 bp, Homo sapiens
ggaggacccagggctctgt

SEQ ID NO: 1391272 - DNA, 14 bp, Homo sapiens
ggaggagggcaggc

SEQ ID NO: 1391273 - DNA, 20 bp, Homo sapiens
ggaggagggcaggcatcggg

SEQ ID NO: 1391274 - DNA, 16 bp, Homo sapiens
ggaggccaataaaaag

SEQ ID NO: 1391275 - DNA, 23 bp, Homo sapiens
ggaggccctgtgccccttgacaa

SEQ ID NO: 1391276 - DNA, 15 bp, Homo sapiens
ggagggtaggcagga

SEQ ID NO: 1391277 - DNA, 16 bp, Homo sapiens
ggaggtgccactggag

SEQ ID NO: 1391278 - DNA, 14 bp, Homo sapiens
ggagtcactgagac

SEQ ID NO: 1391279 - DNA, 14 bp, Homo sapiens
ggagtgggtgggga

SEQ ID NO: 1391280 - DNA, 17 bp, Homo sapiens
ggagtgttctgtttccc

SEQ ID NO: 1391281 - DNA, 16 bp, Homo sapiens
ggagttttttgtacca

SEQ ID NO: 1391282 - DNA, 20 bp, Homo sapiens
ggatatagttttacttttaa

SEQ ID NO: 1391283 - DNA, 16 bp, Homo sapiens
ggatatgtaaaacatt

SEQ ID NO: 1391284 - DNA, 19 bp, Homo sapiens
ggattaagatacactcctg

SEQ ID NO: 1391285 - DNA, 16 bp, Homo sapiens
ggattcttccatctga

SEQ ID NO: 1391286 - DNA, 19 bp, Homo sapiens
ggatttatttaaaatagca

SEQ ID NO: 1391287 - DNA, 15 bp, Homo sapiens
ggcactggggcaggg

SEQ ID NO: 1391288 - DNA, 13 bp, Homo sapiens
ggcagcctctggg

SEQ ID NO: 1391289 - DNA, 20 bp, Homo sapiens
ggcagcctctggggggtggc

SEQ ID NO: 1391290 - DNA, 15 bp, Homo sapiens
ggcaggattggggaa

SEQ ID NO: 1391291 - DNA, 20 bp, Homo sapiens
ggcagtctgagagaggccat

SEQ ID NO: 1391292 - DNA, 22 bp, Homo sapiens
ggcagtgcagcaaccagagcac

SEQ ID NO: 1391293 - DNA, 20 bp, Homo sapiens
ggcatcagtgtccttggcag

SEQ ID NO: 1391294 - DNA, 18 bp, Homo sapiens
ggcatccagagtccctgc

SEQ ID NO: 1391295 - DNA, 12 bp, Homo sapiens
ggcatccctggg

SEQ ID NO: 1391296 - DNA, 23 bp, Homo sapiens
ggcatcggggagccgggagcctg

SEQ ID NO: 1391297 - DNA, 11 bp, Homo sapiens
ggccaaagaac

SEQ ID NO: 1391298 - DNA, 15 bp, Homo sapiens
ggccaataaaaagtt

SEQ ID NO: 1391299 - DNA, 13 bp, Homo sapiens
ggccaggaggtgc

SEQ ID NO: 1391300 - DNA, 22 bp, Homo sapiens
ggccaggctgggtcgccctgga

SEQ ID NO: 1391301 - DNA, 16 bp, Homo sapiens
ggcccccacctggctc

SEQ ID NO: 1391302 - DNA, 16 bp, Homo sapiens
ggccgctatgcagggt

SEQ ID NO: 1391303 - DNA, 22 bp, Homo sapiens
ggcctaacctgccgagagtcca

SEQ ID NO: 1391304 - DNA, 21 bp, Homo sapiens
ggcctccgtccaggagcctgg

SEQ ID NO: 1391305 - DNA, 12 bp, Homo sapiens
ggcctgccagga

SEQ ID NO: 1391306 - DNA, 13 bp, Homo sapiens
ggcctgccaggag

SEQ ID NO: 1391307 - DNA, 13 bp, Homo sapiens
ggcctgggcagga

SEQ ID NO: 1391308 - DNA, 15 bp, Homo sapiens
ggcctgggcaggagg

SEQ ID NO: 1391309 - DNA, 19 bp, Homo sapiens
ggcctgggcaggagggagg

SEQ ID NO: 1391310 - DNA, 12 bp, Homo sapiens
ggcgggggtggc

SEQ ID NO: 1391311 - DNA, 14 bp, Homo sapiens
ggcgggggtggcgg

SEQ ID NO: 1391312 - DNA, 17 bp, Homo sapiens
ggcgtgagccacctcgc

SEQ ID NO: 1391313 - DNA, 19 bp, Homo sapiens
ggctaggtgggttgaaagc

SEQ ID NO: 1391314 - DNA, 18 bp, Homo sapiens
ggctcaccttgtgctggg

SEQ ID NO: 1391315 - DNA, 23 bp, Homo sapiens
ggctcactgcaacctccacctcc

SEQ ID NO: 1391316 - DNA, 22 bp, Homo sapiens
ggctcagccctagccctcagcc

SEQ ID NO: 1391317 - DNA, 20 bp, Homo sapiens
ggctcctcgagatcccaaca

SEQ ID NO: 1391318 - DNA, 23 bp, Homo sapiens
ggctctggagcccactgtacttg

SEQ ID NO: 1391319 - DNA, 14 bp, Homo sapiens
ggctgatttctagg

SEQ ID NO: 1391320 - DNA, 13 bp, Homo sapiens
ggctgggaggagg

SEQ ID NO: 1391321 - DNA, 21 bp, Homo sapiens
ggctgggaggagggcaggcat

SEQ ID NO: 1391322 - DNA, 13 bp, Homo sapiens
ggctggtctcaaa

SEQ ID NO: 1391323 - DNA, 16 bp, Homo sapiens
ggcttcaggtccaggc

SEQ ID NO: 1391324 - DNA, 16 bp, Homo sapiens
gggaacaggagaccca

SEQ ID NO: 1391325 - DNA, 22 bp, Homo sapiens
gggaagagagcctgcaggatct

SEQ ID NO: 1391326 - DNA, 18 bp, Homo sapiens
gggaccaggagtgggtgg

SEQ ID NO: 1391327 - DNA, 20 bp, Homo sapiens
gggactacaggcgtgagcca

SEQ ID NO: 1391328 - DNA, 11 bp, Homo sapiens
gggactgagag

SEQ ID NO: 1391329 - DNA, 20 bp, Homo sapiens
gggagaccggcctgccagga

SEQ ID NO: 1391330 - DNA, 20 bp, Homo sapiens
gggagcaggaggccaataaa

SEQ ID NO: 1391331 - DNA, 13 bp, Homo sapiens
gggagccgggagc

SEQ ID NO: 1391332 - DNA, 12 bp, Homo sapiens
gggaggagggca

SEQ ID NO: 1391333 - DNA, 22 bp, Homo sapiens
gggaggctctggagcccactgt

SEQ ID NO: 1391334 - DNA, 20 bp, Homo sapiens
gggcagtctgagagaggcca

SEQ ID NO: 1391335 - DNA, 13 bp, Homo sapiens
gggccaggctggg

SEQ ID NO: 1391336 - DNA, 21 bp, Homo sapiens
gggccaggctgggtcgccctg

SEQ ID NO: 1391337 - DNA, 17 bp, Homo sapiens
gggcccctgcctctctg

SEQ ID NO: 1391338 - DNA, 14 bp, Homo sapiens
gggcctgcccagtg

SEQ ID NO: 1391339 - DNA, 17 bp, Homo sapiens
gggcctgggcaggaggg

SEQ ID NO: 1391340 - DNA, 14 bp, Homo sapiens
gggccttgggctcc

SEQ ID NO: 1391341 - DNA, 14 bp, Homo sapiens
gggcgcggctggga

SEQ ID NO: 1391342 - DNA, 17 bp, Homo sapiens
gggctccgtgtgggaga

SEQ ID NO: 1391343 - DNA, 19 bp, Homo sapiens
ggggaagagagcctgcagg

SEQ ID NO: 1391344 - DNA, 20 bp, Homo sapiens
ggggaagagagcctgcagga

SEQ ID NO: 1391345 - DNA, 19 bp, Homo sapiens
ggggacacatgtatttggt

SEQ ID NO: 1391346 - DNA, 21 bp, Homo sapiens
ggggaccaggagtgggtgggg

SEQ ID NO: 1391347 - DNA, 22 bp, Homo sapiens
ggggagtaaagaattattttgt

SEQ ID NO: 1391348 - DNA, 16 bp, Homo sapiens
ggggccaggctgggtc

SEQ ID NO: 1391349 - DNA, 21 bp, Homo sapiens
gggggacttacatgattcatt

SEQ ID NO: 1391350 - DNA, 18 bp, Homo sapiens
gggggcgcggctgggagg

SEQ ID NO: 1391351 - DNA, 17 bp, Homo sapiens
gggtattagcacctctt

SEQ ID NO: 1391352 - DNA, 12 bp, Homo sapiens
gggtcaggcctt

SEQ ID NO: 1391353 - DNA, 11 bp, Homo sapiens
gggtccaggag

SEQ ID NO: 1391354 - DNA, 17 bp, Homo sapiens
gggtgctgggcccctgc

SEQ ID NO: 1391355 - DNA, 12 bp, Homo sapiens
gggtggccaggc

SEQ ID NO: 1391356 - DNA, 13 bp, Homo sapiens
gggtggccaggcc

SEQ ID NO: 1391357 - DNA, 14 bp, Homo sapiens
gggtggccaggccg

SEQ ID NO: 1391358 - DNA, 20 bp, Homo sapiens
gggtggccaggccgggaaaa

SEQ ID NO: 1391359 - DNA, 14 bp, Homo sapiens
gggtggggagagac

SEQ ID NO: 1391360 - DNA, 15 bp, Homo sapiens
gggtggggggggtgc

SEQ ID NO: 1391361 - DNA, 18 bp, Homo sapiens
gggtggggggggtgctgg

SEQ ID NO: 1391362 - DNA, 17 bp, Homo sapiens
gggtgtcctgcaccggg

SEQ ID NO: 1391363 - DNA, 15 bp, Homo sapiens
gggttgtgtgtctgt

SEQ ID NO: 1391364 - DNA, 20 bp, Homo sapiens
gggtttcaccatgttagcca

SEQ ID NO: 1391365 - DNA, 22 bp, Homo sapiens
ggtaattgttgctaatcttctt

SEQ ID NO: 1391366 - DNA, 22 bp, Homo sapiens
ggtaccagatgcagctcaagag

SEQ ID NO: 1391367 - DNA, 20 bp, Homo sapiens
ggtaccctttggggagcagg

SEQ ID NO: 1391368 - DNA, 18 bp, Homo sapiens
ggtactggggctgagggc

SEQ ID NO: 1391369 - DNA, 12 bp, Homo sapiens
ggtaggaaatgt

SEQ ID NO: 1391370 - DNA, 22 bp, Homo sapiens
ggtcaacagttttcctatgctt

SEQ ID NO: 1391371 - DNA, 20 bp, Homo sapiens
ggtcaggcctttgagctcag

SEQ ID NO: 1391372 - DNA, 14 bp, Homo sapiens
ggtcccaagacagt

SEQ ID NO: 1391373 - DNA, 23 bp, Homo sapiens
ggtcccaagacagtgagacagtc

SEQ ID NO: 1391374 - DNA, 16 bp, Homo sapiens
ggtccctaataaagct

SEQ ID NO: 1391375 - DNA, 18 bp, Homo sapiens
ggtccctaataaagctgt

SEQ ID NO: 1391376 - DNA, 21 bp, Homo sapiens
ggtcctcagagaatttctacc

SEQ ID NO: 1391377 - DNA, 19 bp, Homo sapiens
ttgcttatcaacttcctaa

SEQ ID NO: 1391378 - DNA, 16 bp, Homo sapiens
ttggaactctgcttga

SEQ ID NO: 1391379 - DNA, 14 bp, Homo sapiens
ttggacacactgta

SEQ ID NO: 1391380 - DNA, 12 bp, Homo sapiens
ttggactatgga

SEQ ID NO: 1391381 - DNA, 17 bp, Homo sapiens
ttggagtgcttaaaaat

SEQ ID NO: 1391382 - DNA, 19 bp, Homo sapiens
ttggagtgcttaaaaatgc

SEQ ID NO: 1391383 - DNA, 15 bp, Homo sapiens
ttggcatccctgggc

SEQ ID NO: 1391384 - DNA, 23 bp, Homo sapiens
ttggccaatgcacctaaagaaaa

SEQ ID NO: 1391385 - DNA, 15 bp, Homo sapiens
ttgggagagggcgca

SEQ ID NO: 1391386 - DNA, 15 bp, Homo sapiens
ttgggatatctcctg

SEQ ID NO: 1391387 - DNA, 11 bp, Homo sapiens
ttggggaagag

SEQ ID NO: 1391388 - DNA, 15 bp, Homo sapiens
ttgggttttatcagt

SEQ ID NO: 1391389 - DNA, 13 bp, Homo sapiens
ttggttagctgga

SEQ ID NO: 1391390 - DNA, 23 bp, Homo sapiens
ttggttcttgaggggaccaggag

SEQ ID NO: 1391391 - DNA, 21 bp, Homo sapiens
ttggttttgctacataattat

SEQ ID NO: 1391392 - DNA, 13 bp, Homo sapiens
ttgtaaaacaggt

SEQ ID NO: 1391393 - DNA, 15 bp, Homo sapiens
ttgtaaaacaggtag

SEQ ID NO: 1391394 - DNA, 16 bp, Homo sapiens
ttgtaaattattaatt

SEQ ID NO: 1391395 - DNA, 22 bp, Homo sapiens
ttgtcctcagccccgcgtggaa

SEQ ID NO: 1391396 - DNA, 11 bp, Homo sapiens
ttgtgaagagg

SEQ ID NO: 1391397 - DNA, 20 bp, Homo sapiens
ttgtgaatcaagggtcaggc

SEQ ID NO: 1391398 - DNA, 21 bp, Homo sapiens
ttgtgaatcaagggtcaggcc

SEQ ID NO: 1391399 - DNA, 13 bp, Homo sapiens
ttgtgacaaaaaa

SEQ ID NO: 1391400 - DNA, 14 bp, Homo sapiens
ttgtgacaaaaaat

SEQ ID NO: 1391401 - DNA, 18 bp, Homo sapiens
ttgtgatgtgagttgcac

SEQ ID NO: 1391402 - DNA, 22 bp, Homo sapiens
ttgtgcaatgtaaatattttaa

SEQ ID NO: 1391403 - DNA, 14 bp, Homo sapiens
ttgtgcacatttaa

SEQ ID NO: 1391404 - DNA, 17 bp, Homo sapiens
ttgtgtggatatttatt

SEQ ID NO: 1391405 - DNA, 19 bp, Homo sapiens
ttgttaatttagaaaactt

SEQ ID NO: 1391406 - DNA, 21 bp, Homo sapiens
ttgttaatttagaaaacttta

SEQ ID NO: 1391407 - DNA, 21 bp, Homo sapiens
ttgttactagagttagatatg

SEQ ID NO: 1391408 - DNA, 13 bp, Homo sapiens
ttgttatataatc

SEQ ID NO: 1391409 - DNA, 18 bp, Homo sapiens
ttgttatgtagataacaa

SEQ ID NO: 1391410 - DNA, 13 bp, Homo sapiens
ttgttgtgctttt

SEQ ID NO: 1391411 - DNA, 23 bp, Homo sapiens
ttgtttctactttgatatgactg

SEQ ID NO: 1391412 - DNA, 15 bp, Homo sapiens
ttgtttcttaaataa

SEQ ID NO: 1391413 - DNA, 21 bp, Homo sapiens
tttaaaaaagcttaaaacttt

SEQ ID NO: 1391414 - DNA, 21 bp, Homo sapiens
tttaaaacccatttaaatttt

SEQ ID NO: 1391415 - DNA, 20 bp, Homo sapiens
tttaaaagtcagcattttct

SEQ ID NO: 1391416 - DNA, 12 bp, Homo sapiens
tttaaaatagca

SEQ ID NO: 1391417 - DNA, 20 bp, Homo sapiens
tttaaaatgtaaagccatgc

SEQ ID NO: 1391418 - DNA, 22 bp, Homo sapiens
tttaaaccgctaaaagaaactt

SEQ ID NO: 1391419 - DNA, 15 bp, Homo sapiens
tttaaactataagca

SEQ ID NO: 1391420 - DNA, 14 bp, Homo sapiens
tttaaactgtgtac

SEQ ID NO: 1391421 - DNA, 21 bp, Homo sapiens
tttaaactgtgtacataactg

SEQ ID NO: 1391422 - DNA, 22 bp, Homo sapiens
tttaaactgtgtacataactga

SEQ ID NO: 1391423 - DNA, 12 bp, Homo sapiens
tttaaagactta

SEQ ID NO: 1391424 - DNA, 17 bp, Homo sapiens
tttaaagcgtttgcaca

SEQ ID NO: 1391425 - DNA, 22 bp, Homo sapiens
tttaaagtgactaatggcatga

SEQ ID NO: 1391426 - DNA, 12 bp, Homo sapiens
tttaaatctgtt

SEQ ID NO: 1391427 - DNA, 15 bp, Homo sapiens
tttaaatgtaaagat

SEQ ID NO: 1391428 - DNA, 18 bp, Homo sapiens
tttaaatgtaaagatatt

SEQ ID NO: 1391429 - DNA, 18 bp, Homo sapiens
tttaaatttttttcctta

SEQ ID NO: 1391430 - DNA, 14 bp, Homo sapiens
tttaacttaaatag

SEQ ID NO: 1391431 - DNA, 19 bp, Homo sapiens
tttaatactcacctcctcc

SEQ ID NO: 1391432 - DNA, 18 bp, Homo sapiens
tttaatgtatagtaaatc

SEQ ID NO: 1391433 - DNA, 16 bp, Homo sapiens
tttacaagtaacaaaa

SEQ ID NO: 1391434 - DNA, 15 bp, Homo sapiens
tttacttttaaacag

SEQ ID NO: 1391435 - DNA, 14 bp, Homo sapiens
tttagaaaacttta

SEQ ID NO: 1391436 - DNA, 16 bp, Homo sapiens
tttagaaaactttaaa

SEQ ID NO: 1391437 - DNA, 16 bp, Homo sapiens
tttagaaatcattttg

SEQ ID NO: 1391438 - DNA, 21 bp, Homo sapiens
tttagccctggtttgaaattt

SEQ ID NO: 1391439 - DNA, 14 bp, Homo sapiens
tttatatgaagaaa

SEQ ID NO: 1391440 - DNA, 16 bp, Homo sapiens
tttatattgtaaatat

SEQ ID NO: 1391441 - DNA, 22 bp, Homo sapiens
tttatcatgcatgtcctgtaaa

SEQ ID NO: 1391442 - DNA, 18 bp, Homo sapiens
tttatctttatatgaaga

SEQ ID NO: 1391443 - DNA, 19 bp, Homo sapiens
tttatgaaaaagaagaatc

SEQ ID NO: 1391444 - DNA, 20 bp, Homo sapiens
tttatgttaagggaagaatt

SEQ ID NO: 1391445 - DNA, 22 bp, Homo sapiens
tttatttaaaaaactaaaaact

SEQ ID NO: 1391446 - DNA, 16 bp, Homo sapiens
tttattttaaccagtt

SEQ ID NO: 1391447 - DNA, 19 bp, Homo sapiens
tttcaaatagggtctaact

SEQ ID NO: 1391448 - DNA, 17 bp, Homo sapiens
tttcaagaaactgagga

SEQ ID NO: 1391449 - DNA, 19 bp, Homo sapiens
tttcacattagaagacaat

SEQ ID NO: 1391450 - DNA, 14 bp, Homo sapiens
tttcacattttcct

SEQ ID NO: 1391451 - DNA, 11 bp, Homo sapiens
tttcagatgtg

SEQ ID NO: 1391452 - DNA, 20 bp, Homo sapiens
tttcatacattttctaagaa

SEQ ID NO: 1391453 - DNA, 19 bp, Homo sapiens
tttccatgcgtgtttctga

SEQ ID NO: 1391454 - DNA, 22 bp, Homo sapiens
tttccatgggaccacaactatt

SEQ ID NO: 1391455 - DNA, 13 bp, Homo sapiens
tttccctgagagc

SEQ ID NO: 1391456 - DNA, 16 bp, Homo sapiens
tttccctgcctctcat

SEQ ID NO: 1391457 - DNA, 14 bp, Homo sapiens
tttctaagaaacat

SEQ ID NO: 1391458 - DNA, 16 bp, Homo sapiens
tttctaccatttcaga

SEQ ID NO: 1391459 - DNA, 17 bp, Homo sapiens
tttctaggtaggaaatg

SEQ ID NO: 1391460 - DNA, 16 bp, Homo sapiens
tttctcagttttcata

SEQ ID NO: 1391461 - DNA, 17 bp, Homo sapiens
tttctgatcaaggcctt

SEQ ID NO: 1391462 - DNA, 20 bp, Homo sapiens
tttctggaatacatgaaata

SEQ ID NO: 1391463 - DNA, 18 bp, Homo sapiens
tttcttaaataagaaact

SEQ ID NO: 1391464 - DNA, 18 bp, Homo sapiens
tttcttcaccaaatcttg

SEQ ID NO: 1391465 - DNA, 15 bp, Homo sapiens
tttctttgtgtagct

SEQ ID NO: 1391466 - DNA, 15 bp, Homo sapiens
tttgaaaaagcgaaa

SEQ ID NO: 1391467 - DNA, 18 bp, Homo sapiens
tttgacagtgttgaaaat

SEQ ID NO: 1391468 - DNA, 19 bp, Homo sapiens
tttgacagtgttgaaaatg

SEQ ID NO: 1391469 - DNA, 19 bp, Homo sapiens
tttgataaagtaaaaaagt

SEQ ID NO: 1391470 - DNA, 16 bp, Homo sapiens
tttgatactaagcatt

SEQ ID NO: 1391471 - DNA, 18 bp, Homo sapiens
tttgatactaagcattga

SEQ ID NO: 1391472 - DNA, 21 bp, Homo sapiens
tttgatactaagcattgaatg

SEQ ID NO: 1391473 - DNA, 16 bp, Homo sapiens
tttgcatttaaaacag

SEQ ID NO: 1391474 - DNA, 19 bp, Homo sapiens
tttgcatttaaaacagaca

SEQ ID NO: 1391475 - DNA, 22 bp, Homo sapiens
tttgccaagggcataaattatt

SEQ ID NO: 1391476 - DNA, 23 bp, Homo sapiens
tttgccaagggcataaattattg

SEQ ID NO: 1391477 - DNA, 12 bp, Homo sapiens
tttgctgagact

SEQ ID NO: 1391478 - DNA, 16 bp, Homo sapiens
tttggacctaatccaa

SEQ ID NO: 1391479 - DNA, 19 bp, Homo sapiens
tttggatatgtaaaacatt

SEQ ID NO: 1391480 - DNA, 15 bp, Homo sapiens
tttgggtccaggagg

SEQ ID NO: 1391481 - DNA, 17 bp, Homo sapiens
agcagggtaccctttgg

SEQ ID NO: 1391482 - DNA, 22 bp, Homo sapiens
agcagttgagacaagaaaataa

SEQ ID NO: 1391483 - DNA, 17 bp, Homo sapiens
agcatccccttgaactc

SEQ ID NO: 1391484 - DNA, 18 bp, Homo sapiens
agcatccccttgaactct

SEQ ID NO: 1391485 - DNA, 17 bp, Homo sapiens
agcatggctattttata

SEQ ID NO: 1391486 - DNA, 18 bp, Homo sapiens
agcatggctattttatat

SEQ ID NO: 1391487 - DNA, 19 bp, Homo sapiens
agcatgtctattcagcttc

SEQ ID NO: 1391488 - DNA, 14 bp, Homo sapiens
agcattcagaagaa

SEQ ID NO: 1391489 - DNA, 17 bp, Homo sapiens
agcattcagaagaaaaa

SEQ ID NO: 1391490 - DNA, 15 bp, Homo sapiens
agcatttagaaaact

SEQ ID NO: 1391491 - DNA, 17 bp, Homo sapiens
agcatttcccttccttc

SEQ ID NO: 1391492 - DNA, 17 bp, Homo sapiens
agcattttgtaagttga

SEQ ID NO: 1391493 - DNA, 14 bp, Homo sapiens
agccaaaaatagct

SEQ ID NO: 1391494 - DNA, 22 bp, Homo sapiens
agccagattttttaaaatttat

SEQ ID NO: 1391495 - DNA, 14 bp, Homo sapiens
agccagctttccct

SEQ ID NO: 1391496 - DNA, 16 bp, Homo sapiens
agccagctttccctgc

SEQ ID NO: 1391497 - DNA, 15 bp, Homo sapiens
agccatgtttcacaa

SEQ ID NO: 1391498 - DNA, 16 bp, Homo sapiens
agcccaatgaaatgaa

SEQ ID NO: 1391499 - DNA, 16 bp, Homo sapiens
agcccctcccagccta

SEQ ID NO: 1391500 - DNA, 17 bp, Homo sapiens
agccctagccctcagcc

SEQ ID NO: 1391501 - DNA, 17 bp, Homo sapiens
agccctgggaggctctg

SEQ ID NO: 1391502 - DNA, 18 bp, Homo sapiens
agccctgggaggctctgg

SEQ ID NO: 1391503 - DNA, 20 bp, Homo sapiens
agccctgggaggctctggag

SEQ ID NO: 1391504 - DNA, 16 bp, Homo sapiens
agccctggtttgaaat

SEQ ID NO: 1391505 - DNA, 21 bp, Homo sapiens
agcccttgtgaatcaagggtc

SEQ ID NO: 1391506 - DNA, 19 bp, Homo sapiens
agccctttggtgataagta

SEQ ID NO: 1391507 - DNA, 14 bp, Homo sapiens
agccgggagcctga

SEQ ID NO: 1391508 - DNA, 19 bp, Homo sapiens
agcctcattctgaggcctg

SEQ ID NO: 1391509 - DNA, 14 bp, Homo sapiens
agcctccctcctcg

SEQ ID NO: 1391510 - DNA, 20 bp, Homo sapiens
agcctctggggggtggccag

SEQ ID NO: 1391511 - DNA, 21 bp, Homo sapiens
agcctctggggggtggccagg

SEQ ID NO: 1391512 - DNA, 14 bp, Homo sapiens
agcctgcaggatct

SEQ ID NO: 1391513 - DNA, 23 bp, Homo sapiens
agcctgcaggatctcaccaggca

SEQ ID NO: 1391514 - DNA, 14 bp, Homo sapiens
agccttctctgttc

SEQ ID NO: 1391515 - DNA, 15 bp, Homo sapiens
agccttctctgttca

SEQ ID NO: 1391516 - DNA, 20 bp, Homo sapiens
agccttctctgttcatttcc

SEQ ID NO: 1391517 - DNA, 21 bp, Homo sapiens
agccttctctgttcatttcct

SEQ ID NO: 1391518 - DNA, 22 bp, Homo sapiens
agccttctctgttcatttcctc

SEQ ID NO: 1391519 - DNA, 23 bp, Homo sapiens
agccttctctgttcatttcctca

SEQ ID NO: 1391520 - DNA, 23 bp, Homo sapiens
agccttggggattcttccatctg

SEQ ID NO: 1391521 - DNA, 18 bp, Homo sapiens
agcgctatctccctgcct

SEQ ID NO: 1391522 - DNA, 13 bp, Homo sapiens
agcggcatcaggc

SEQ ID NO: 1391523 - DNA, 21 bp, Homo sapiens
agcgggggagggtaggcagga

SEQ ID NO: 1391524 - DNA, 16 bp, Homo sapiens
agctacgtatttaata

SEQ ID NO: 1391525 - DNA, 18 bp, Homo sapiens
agctataaaatgaataca

SEQ ID NO: 1391526 - DNA, 13 bp, Homo sapiens
agctatttcatct

SEQ ID NO: 1391527 - DNA, 23 bp, Homo sapiens
agctcaactctcttattgcctca

SEQ ID NO: 1391528 - DNA, 23 bp, Homo sapiens
agctcacttctgggcttcatctg

SEQ ID NO: 1391529 - DNA, 21 bp, Homo sapiens
agctcagaaaatatccctcct

SEQ ID NO: 1391530 - DNA, 12 bp, Homo sapiens
agctcccttccc

SEQ ID NO: 1391531 - DNA, 17 bp, Homo sapiens
agctccttaaggctctt

SEQ ID NO: 1391532 - DNA, 18 bp, Homo sapiens
agctccttaaggctcttt

SEQ ID NO: 1391533 - DNA, 22 bp, Homo sapiens
agctctgaaagagaaacacgta

SEQ ID NO: 1391534 - DNA, 14 bp, Homo sapiens
aaaaactaaaaact

SEQ ID NO: 1391535 - DNA, 15 bp, Homo sapiens
aaaaactgagtgact

SEQ ID NO: 1391536 - DNA, 18 bp, Homo sapiens
aaaaaggtttacagaatt

SEQ ID NO: 1391537 - DNA, 22 bp, Homo sapiens
aaaaagtgttctgtgtccttct

SEQ ID NO: 1391538 - DNA, 20 bp, Homo sapiens
aaaaagttaaatgtgtgtaa

SEQ ID NO: 1391539 - DNA, 13 bp, Homo sapiens
aaaaagttcagag

SEQ ID NO: 1391540 - DNA, 14 bp, Homo sapiens
aaaaataagaagaa

SEQ ID NO: 1391541 - DNA, 16 bp, Homo sapiens
aaaaataagaagaatg

SEQ ID NO: 1391542 - DNA, 22 bp, Homo sapiens
aaaaatagtaagcctccctcct

SEQ ID NO: 1391543 - DNA, 23 bp, Homo sapiens
aaaaatagtttggatatgtaaaa

SEQ ID NO: 1391544 - DNA, 13 bp, Homo sapiens
aaaaatggtaatt

SEQ ID NO: 1391545 - DNA, 16 bp, Homo sapiens
aaaaattaattctctt

SEQ ID NO: 1391546 - DNA, 21 bp, Homo sapiens
aaaacactaaaaataaaaatg

SEQ ID NO: 1391547 - DNA, 22 bp, Homo sapiens
aaaacaggtagaattatctaat

SEQ ID NO: 1391548 - DNA, 17 bp, Homo sapiens
aaaacataatcttctgc

SEQ ID NO: 1391549 - DNA, 13 bp, Homo sapiens
aaaactaaaaact

SEQ ID NO: 1391550 - DNA, 22 bp, Homo sapiens
aaaactagaggtgagaaattta

SEQ ID NO: 1391551 - DNA, 13 bp, Homo sapiens
aaaactttaaagc

SEQ ID NO: 1391552 - DNA, 13 bp, Homo sapiens
aaaagaaaaagat

SEQ ID NO: 1391553 - DNA, 14 bp, Homo sapiens
aaaagaagaagttt

SEQ ID NO: 1391554 - DNA, 11 bp, Homo sapiens
aaaagaagtaa

SEQ ID NO: 1391555 - DNA, 13 bp, Homo sapiens
aaaagatgctttt

SEQ ID NO: 1391556 - DNA, 16 bp, Homo sapiens
aaaagcaaaaaagaaa

SEQ ID NO: 1391557 - DNA, 15 bp, Homo sapiens
aaaaggtattaaatt

SEQ ID NO: 1391558 - DNA, 23 bp, Homo sapiens
aaaaggtttatgaaaaagaagaa

SEQ ID NO: 1391559 - DNA, 16 bp, Homo sapiens
aaaataaaacctcagc

SEQ ID NO: 1391560 - DNA, 12 bp, Homo sapiens
aaaataaacaaa

SEQ ID NO: 1391561 - DNA, 14 bp, Homo sapiens
aaaataaagaaata

SEQ ID NO: 1391562 - DNA, 12 bp, Homo sapiens
aaaataaagaat

SEQ ID NO: 1391563 - DNA, 15 bp, Homo sapiens
aaaataaagaatgga

SEQ ID NO: 1391564 - DNA, 14 bp, Homo sapiens
aaaataaatgtttt

SEQ ID NO: 1391565 - DNA, 23 bp, Homo sapiens
aaaataagtgaaattttaaaagt

SEQ ID NO: 1391566 - DNA, 23 bp, Homo sapiens
aaaataatactgctgagatacat

SEQ ID NO: 1391567 - DNA, 19 bp, Homo sapiens
aaaataattttaaacaaag

SEQ ID NO: 1391568 - DNA, 20 bp, Homo sapiens
aaaatagctaaatacctcaa

SEQ ID NO: 1391569 - DNA, 13 bp, Homo sapiens
aaaatagtttgga

SEQ ID NO: 1391570 - DNA, 19 bp, Homo sapiens
aaaatagtttggatatgta

SEQ ID NO: 1391571 - DNA, 10 bp, Homo sapiens
aaaatataaa

SEQ ID NO: 1391572 - DNA, 15 bp, Homo sapiens
aaaatgcaaaataaa

SEQ ID NO: 1391573 - DNA, 11 bp, Homo sapiens
aaaatgctatc

SEQ ID NO: 1391574 - DNA, 16 bp, Homo sapiens
aaaatgttcagaaggt

SEQ ID NO: 1391575 - DNA, 11 bp, Homo sapiens
aaaatgttctc

SEQ ID NO: 1391576 - DNA, 12 bp, Homo sapiens
aaaattgaatgc

SEQ ID NO: 1391577 - DNA, 14 bp, Homo sapiens
aaaattgaatgcaa

SEQ ID NO: 1391578 - DNA, 20 bp, Homo sapiens
aaaatttatattgtaaatat

SEQ ID NO: 1391579 - DNA, 13 bp, Homo sapiens
aaacaaaaacact

SEQ ID NO: 1391580 - DNA, 14 bp, Homo sapiens
aaacaatgtttaaa

SEQ ID NO: 1391581 - DNA, 17 bp, Homo sapiens
aaacacattaggaaaag

SEQ ID NO: 1391582 - DNA, 15 bp, Homo sapiens
aaacaccaacataaa

SEQ ID NO: 1391583 - DNA, 11 bp, Homo sapiens
aaacacctcct

SEQ ID NO: 1391584 - DNA, 13 bp, Homo sapiens
aaacagaaacaaa

SEQ ID NO: 1391585 - DNA, 16 bp, Homo sapiens
aaacagattgtttgca

SEQ ID NO: 1391586 - DNA, 20 bp, Homo sapiens
aaacataatcttctgccttc

SEQ ID NO: 1391587 - DNA, 14 bp, Homo sapiens
aaacatttattttg

SEQ ID NO: 1391588 - DNA, 22 bp, Homo sapiens
aaaccagctacttgatgtaact

SEQ ID NO: 1391589 - DNA, 15 bp, Homo sapiens
aaaccgctaaaagaa

SEQ ID NO: 1391590 - DNA, 16 bp, Homo sapiens
aaaccgctaaaagaaa

SEQ ID NO: 1391591 - DNA, 12 bp, Homo sapiens
aaacctcagcta

SEQ ID NO: 1391592 - DNA, 21 bp, Homo sapiens
aaacctcagctagctctgcca

SEQ ID NO: 1391593 - DNA, 13 bp, Homo sapiens
aaacgtttgaaat

SEQ ID NO: 1391594 - DNA, 16 bp, Homo sapiens
aaactaaaattttcta

SEQ ID NO: 1391595 - DNA, 21 bp, Homo sapiens
aaactacaaccaatggaatgt

SEQ ID NO: 1391596 - DNA, 19 bp, Homo sapiens
aaactatccaattaaaatt

SEQ ID NO: 1391597 - DNA, 23 bp, Homo sapiens
aaactatccaattaaaattaagg

SEQ ID NO: 1391598 - DNA, 13 bp, Homo sapiens
aaactcaaaatat

SEQ ID NO: 1391599 - DNA, 16 bp, Homo sapiens
aaactcgttttttaca

SEQ ID NO: 1391600 - DNA, 19 bp, Homo sapiens
aaactgaggaattttcttt

SEQ ID NO: 1391601 - DNA, 10 bp, Homo sapiens
aaactgtgta

SEQ ID NO: 1391602 - DNA, 19 bp, Homo sapiens
aaactgtgtattccaagac

SEQ ID NO: 1391603 - DNA, 18 bp, Homo sapiens
aaacttcaaggaaaataa

SEQ ID NO: 1391604 - DNA, 19 bp, Homo sapiens
aaacttcaaggaaaataag

SEQ ID NO: 1391605 - DNA, 12 bp, Homo sapiens
aaacttttttat

SEQ ID NO: 1391606 - DNA, 17 bp, Homo sapiens
aaacttttttatttaaa

SEQ ID NO: 1391607 - DNA, 23 bp, Homo sapiens
aaagaaccaacaacctcaactgc

SEQ ID NO: 1391608 - DNA, 14 bp, Homo sapiens
aaagacaagtacat

SEQ ID NO: 1391609 - DNA, 19 bp, Homo sapiens
aaagacttaagattaaatt

SEQ ID NO: 1391610 - DNA, 14 bp, Homo sapiens
aaagagttcaagaa

SEQ ID NO: 1391611 - DNA, 20 bp, Homo sapiens
aaagatatctcatctcttct

SEQ ID NO: 1391612 - DNA, 23 bp, Homo sapiens
aaagattgaagtattttgctgga

SEQ ID NO: 1391613 - DNA, 14 bp, Homo sapiens
aaagattttttaat

SEQ ID NO: 1391614 - DNA, 20 bp, Homo sapiens
aaagattttttaataattta

SEQ ID NO: 1391615 - DNA, 16 bp, Homo sapiens
aaagcaaaaaagaaaa

SEQ ID NO: 1391616 - DNA, 21 bp, Homo sapiens
aaagcagcctcattctgaggc

SEQ ID NO: 1391617 - DNA, 12 bp, Homo sapiens
aaagcgaaaaaa

SEQ ID NO: 1391618 - DNA, 16 bp, Homo sapiens
aaagcgaaaaaatcag

SEQ ID NO: 1391619 - DNA, 21 bp, Homo sapiens
aaagctaaaataaagaaatag

SEQ ID NO: 1391620 - DNA, 13 bp, Homo sapiens
aaagctagaattg

SEQ ID NO: 1391621 - DNA, 18 bp, Homo sapiens
aaagctggtttaatgttt

SEQ ID NO: 1391622 - DNA, 18 bp, Homo sapiens
aaagctgtgtgtttggaa

SEQ ID NO: 1391623 - DNA, 16 bp, Homo sapiens
aaagcttaaaactttg

SEQ ID NO: 1391624 - DNA, 12 bp, Homo sapiens
aaaggcaaaggc

SEQ ID NO: 1391625 - DNA, 19 bp, Homo sapiens
aaaggctaggtacacagct

SEQ ID NO: 1391626 - DNA, 18 bp, Homo sapiens
aaaggtttatgaaaaaga

SEQ ID NO: 1391627 - DNA, 16 bp, Homo sapiens
aaagtatacttttgtt

SEQ ID NO: 1391628 - DNA, 14 bp, Homo sapiens
aaagtgagagcacg

SEQ ID NO: 1391629 - DNA, 15 bp, Homo sapiens
aaagttaaatgtgtg

SEQ ID NO: 1391630 - DNA, 12 bp, Homo sapiens
aaataaaaagta

SEQ ID NO: 1391631 - DNA, 15 bp, Homo sapiens
aaataaatgtatcat

SEQ ID NO: 1391632 - DNA, 16 bp, Homo sapiens
aaataaatgtatcata

SEQ ID NO: 1391633 - DNA, 21 bp, Homo sapiens
aaataaatgtatcatagaaat

SEQ ID NO: 1391634 - DNA, 17 bp, Homo sapiens
aaataaatgtttttatt

SEQ ID NO: 1391635 - DNA, 17 bp, Homo sapiens
aaataacaatgtgctct

SEQ ID NO: 1391636 - DNA, 13 bp, Homo sapiens
aaataactaagga

SEQ ID NO: 1391637 - DNA, 12 bp, Homo sapiens
aaataagaaact

SEQ ID NO: 1391638 - DNA, 14 bp, Homo sapiens
aaataagaaacttt

SEQ ID NO: 1391639 - DNA, 14 bp, Homo sapiens
aaataattttaaac

SEQ ID NO: 1391640 - DNA, 18 bp, Homo sapiens
aaataattttaaacaaag

SEQ ID NO: 1391641 - DNA, 11 bp, Homo sapiens
aaatacaaaaa

SEQ ID NO: 1391642 - DNA, 13 bp, Homo sapiens
aaatacatgctaa

SEQ ID NO: 1391643 - DNA, 16 bp, Homo sapiens
aaatagggtctaactc

SEQ ID NO: 1391644 - DNA, 21 bp, Homo sapiens
aaatagtttggatatgtaaaa

SEQ ID NO: 1391645 - DNA, 14 bp, Homo sapiens
aaatataaattaag

SEQ ID NO: 1391646 - DNA, 22 bp, Homo sapiens
aaatatacttttacaagtaaca

SEQ ID NO: 1391647 - DNA, 18 bp, Homo sapiens
aaatatagatcagttata

SEQ ID NO: 1391648 - DNA, 23 bp, Homo sapiens
aaatatccctcctgttgggagag

SEQ ID NO: 1391649 - DNA, 15 bp, Homo sapiens
aaatatcttgaaagg

SEQ ID NO: 1391650 - DNA, 17 bp, Homo sapiens
aaatattatgagatgct

SEQ ID NO: 1391651 - DNA, 22 bp, Homo sapiens
aaatatttgtacatagttattt

SEQ ID NO: 1391652 - DNA, 14 bp, Homo sapiens
aaatattttaaaga

SEQ ID NO: 1391653 - DNA, 13 bp, Homo sapiens
aaatcgaatgaaa

SEQ ID NO: 1391654 - DNA, 18 bp, Homo sapiens
aaatctggcttctggcca

SEQ ID NO: 1391655 - DNA, 20 bp, Homo sapiens
aaatcttggttgatgccaaa

SEQ ID NO: 1391656 - DNA, 18 bp, Homo sapiens
aaatcttttataggattt

SEQ ID NO: 1391657 - DNA, 22 bp, Homo sapiens
aaatgccatgatgcctctgtct

SEQ ID NO: 1391658 - DNA, 23 bp, Homo sapiens
aaatgccgattacacccaaatat

SEQ ID NO: 1391659 - DNA, 18 bp, Homo sapiens
aaatgctatcaaataact

SEQ ID NO: 1391660 - DNA, 22 bp, Homo sapiens
aaatggccatttgctttttcac

SEQ ID NO: 1391661 - DNA, 18 bp, Homo sapiens
aaatgtgtgtaaaaaagt

SEQ ID NO: 1391662 - DNA, 19 bp, Homo sapiens
aaatgttggtcattttatg

SEQ ID NO: 1391663 - DNA, 18 bp, Homo sapiens
aaatgtttttattaacaa

SEQ ID NO: 1391664 - DNA, 13 bp, Homo sapiens
aaattaagacttt

SEQ ID NO: 1391665 - DNA, 22 bp, Homo sapiens
aaattaagactttaaaagatga

SEQ ID NO: 1391666 - DNA, 16 bp, Homo sapiens
aaattcaacaaacatt

SEQ ID NO: 1391667 - DNA, 14 bp, Homo sapiens
aaattgaatgcaaa

SEQ ID NO: 1391668 - DNA, 23 bp, Homo sapiens
aaattttagcgtgctcactgacc

SEQ ID NO: 1391669 - DNA, 12 bp, Homo sapiens
aaattttatatg

SEQ ID NO: 1391670 - DNA, 22 bp, Homo sapiens
aaattttccattacatgatctt

SEQ ID NO: 1391671 - DNA, 19 bp, Homo sapiens
aacaaaaacactaaaaata

SEQ ID NO: 1391672 - DNA, 18 bp, Homo sapiens
aacaaacatttgctgaat

SEQ ID NO: 1391673 - DNA, 16 bp, Homo sapiens
aacaaactcgtttttt

SEQ ID NO: 1391674 - DNA, 16 bp, Homo sapiens
aacaaaggttgagatg

SEQ ID NO: 1391675 - DNA, 13 bp, Homo sapiens
aacaaatgtgtaa

SEQ ID NO: 1391676 - DNA, 17 bp, Homo sapiens
aacaagatatttatatg

SEQ ID NO: 1391677 - DNA, 20 bp, Homo sapiens
aacaagatatttatatgtta

SEQ ID NO: 1391678 - DNA, 20 bp, Homo sapiens
aacaagtatttgttaattta

SEQ ID NO: 1391679 - DNA, 19 bp, Homo sapiens
aacaattctaaaatgattg

SEQ ID NO: 1391680 - DNA, 13 bp, Homo sapiens
aacaatttatgaa

SEQ ID NO: 1391681 - DNA, 18 bp, Homo sapiens
aacactagacaagccaga

SEQ ID NO: 1391682 - DNA, 20 bp, Homo sapiens
aacagcagactcagctctga

SEQ ID NO: 1391683 - DNA, 18 bp, Homo sapiens
aacagcctgacaacattt

SEQ ID NO: 1391684 - DNA, 14 bp, Homo sapiens
aacaggctcagagg

SEQ ID NO: 1391685 - DNA, 17 bp, Homo sapiens
aacagtgaagacagaag

SEQ ID NO: 1391686 - DNA, 13 bp, Homo sapiens
aacagtgagcctg

SEQ ID NO: 1391687 - DNA, 22 bp, Homo sapiens
aacataatcttctgccttctca

SEQ ID NO: 1391688 - DNA, 16 bp, Homo sapiens
aacatagacagaagaa

SEQ ID NO: 1391689 - DNA, 19 bp, Homo sapiens
aacatcattactataagaa

SEQ ID NO: 1391690 - DNA, 21 bp, Homo sapiens
aacatctgagaaaagctttga

SEQ ID NO: 1391691 - DNA, 21 bp, Homo sapiens
aacattgttaatataatttaa

SEQ ID NO: 1391692 - DNA, 23 bp, Homo sapiens
aaccagatctagtcaatcaagtc

SEQ ID NO: 1391693 - DNA, 12 bp, Homo sapiens
aaccagttattt

SEQ ID NO: 1391694 - DNA, 14 bp, Homo sapiens
aaccagttattttt

SEQ ID NO: 1391695 - DNA, 22 bp, Homo sapiens
aaccatagcacaggctaatttt

SEQ ID NO: 1391696 - DNA, 19 bp, Homo sapiens
aaccattataaccttaatt

SEQ ID NO: 1391697 - DNA, 21 bp, Homo sapiens
aacccatattgtaaaacaggt

SEQ ID NO: 1391698 - DNA, 15 bp, Homo sapiens
aaccccagacactgg

SEQ ID NO: 1391699 - DNA, 13 bp, Homo sapiens
aacccccatcttt

SEQ ID NO: 1391700 - DNA, 21 bp, Homo sapiens
aacccctacatgaaacagaaa

SEQ ID NO: 1391701 - DNA, 23 bp, Homo sapiens
aacccctcccctccatccctggc

SEQ ID NO: 1391702 - DNA, 16 bp, Homo sapiens
aaccgctaaaagaaac

SEQ ID NO: 1391703 - DNA, 22 bp, Homo sapiens
aacctatgatattttctgtgcc

SEQ ID NO: 1391704 - DNA, 19 bp, Homo sapiens
aacctgacccctgctcagt

SEQ ID NO: 1391705 - DNA, 22 bp, Homo sapiens
aacctgatgaaaataaagaatg

SEQ ID NO: 1391706 - DNA, 19 bp, Homo sapiens
aacctgggttgcagacagg

SEQ ID NO: 1391707 - DNA, 23 bp, Homo sapiens
aaccttgaagttctgaaatttaa

SEQ ID NO: 1391708 - DNA, 16 bp, Homo sapiens
aacgctatctgggaag

SEQ ID NO: 1391709 - DNA, 23 bp, Homo sapiens
aactaatttttatttttgctgag

SEQ ID NO: 1391710 - DNA, 20 bp, Homo sapiens
aactagaggtgagaaattta

SEQ ID NO: 1391711 - DNA, 17 bp, Homo sapiens
aactcatctgtcaccaa

SEQ ID NO: 1391712 - DNA, 23 bp, Homo sapiens
aactcattagactggaacttgaa

SEQ ID NO: 1391713 - DNA, 18 bp, Homo sapiens
aactcctgacctcaggca

SEQ ID NO: 1391714 - DNA, 19 bp, Homo sapiens
aactcgtatagcatgcatc

SEQ ID NO: 1391715 - DNA, 18 bp, Homo sapiens
aactctcttattgcctca

SEQ ID NO: 1391716 - DNA, 15 bp, Homo sapiens
aactcttataaattt

SEQ ID NO: 1391717 - DNA, 12 bp, Homo sapiens
aactgaaaatgt

SEQ ID NO: 1391718 - DNA, 22 bp, Homo sapiens
aactgaacaccattgaaggctt

SEQ ID NO: 1391719 - DNA, 23 bp, Homo sapiens
aactgaacaccattgaaggctta

SEQ ID NO: 1391720 - DNA, 18 bp, Homo sapiens
aactgaggaatttcacct

SEQ ID NO: 1391721 - DNA, 20 bp, Homo sapiens
aactgaggaattttctttgt

SEQ ID NO: 1391722 - DNA, 14 bp, Homo sapiens
aactggcaggcagg

SEQ ID NO: 1391723 - DNA, 21 bp, Homo sapiens
aactggtagttcattgtaaat

SEQ ID NO: 1391724 - DNA, 13 bp, Homo sapiens
aactgtaatacaa

SEQ ID NO: 1391725 - DNA, 15 bp, Homo sapiens
aacttcaaggaaaat

SEQ ID NO: 1391726 - DNA, 14 bp, Homo sapiens
aacttgaactgatt

SEQ ID NO: 1391727 - DNA, 21 bp, Homo sapiens
aacttgaactgattcacatct

SEQ ID NO: 1391728 - DNA, 15 bp, Homo sapiens
aacttgaccctgagc

SEQ ID NO: 1391729 - DNA, 15 bp, Homo sapiens
aactttgaagttagc

SEQ ID NO: 1391730 - DNA, 23 bp, Homo sapiens
aacttttttatttaaaaaactaa

SEQ ID NO: 1391731 - DNA, 15 bp, Homo sapiens
aagaaaaagaagcaa

SEQ ID NO: 1391732 - DNA, 16 bp, Homo sapiens
aagaaacaaggttttc

SEQ ID NO: 1391733 - DNA, 14 bp, Homo sapiens
aagaaacatttata

SEQ ID NO: 1391734 - DNA, 16 bp, Homo sapiens
aagaaacctactgccc

SEQ ID NO: 1391735 - DNA, 13 bp, Homo sapiens
aagaactttgagc

SEQ ID NO: 1391736 - DNA, 15 bp, Homo sapiens
aagaaggcaaaaata

SEQ ID NO: 1391737 - DNA, 12 bp, Homo sapiens
aagaatacttct

SEQ ID NO: 1391738 - DNA, 16 bp, Homo sapiens
aagaatacttctcatt

SEQ ID NO: 1391739 - DNA, 17 bp, Homo sapiens
aagaatacttctcattt

SEQ ID NO: 1391740 - DNA, 22 bp, Homo sapiens
aagaatacttctcattttttaa

SEQ ID NO: 1391741 - DNA, 17 bp, Homo sapiens
aagaatggcagaaaagt

SEQ ID NO: 1391742 - DNA, 12 bp, Homo sapiens
aagaatgttaag

SEQ ID NO: 1391743 - DNA, 13 bp, Homo sapiens
aagacatgtctgt

SEQ ID NO: 1391744 - DNA, 22 bp, Homo sapiens
aagactatcttactatttcaca

SEQ ID NO: 1391745 - DNA, 19 bp, Homo sapiens
aagactgctgtggccagga

SEQ ID NO: 1391746 - DNA, 13 bp, Homo sapiens
aagagaagtagaa

SEQ ID NO: 1391747 - DNA, 18 bp, Homo sapiens
aagagctacgtatttaat

SEQ ID NO: 1391748 - DNA, 18 bp, Homo sapiens
aagaggcacctgtcccag

SEQ ID NO: 1391749 - DNA, 21 bp, Homo sapiens
aagaggtatttatctttactt

SEQ ID NO: 1391750 - DNA, 15 bp, Homo sapiens
aagatacactcctgc

SEQ ID NO: 1391751 - DNA, 14 bp, Homo sapiens
aagatacttaagtg

SEQ ID NO: 1391752 - DNA, 19 bp, Homo sapiens
aagatatttatatgttatt

SEQ ID NO: 1391753 - DNA, 17 bp, Homo sapiens
aagatatttttatcttt

SEQ ID NO: 1391754 - DNA, 19 bp, Homo sapiens
aagatatttttatctttat

SEQ ID NO: 1391755 - DNA, 23 bp, Homo sapiens
aagatcactttctcagttttcat

SEQ ID NO: 1391756 - DNA, 23 bp, Homo sapiens
aagatctgcagggggtgtgtctg

SEQ ID NO: 1391757 - DNA, 11 bp, Homo sapiens
aagatctttta

SEQ ID NO: 1391758 - DNA, 20 bp, Homo sapiens
aagatgaaaaatggtccctt

SEQ ID NO: 1391759 - DNA, 23 bp, Homo sapiens
aagatgaaaaatggtcccttctt

SEQ ID NO: 1391760 - DNA, 20 bp, Homo sapiens
aagattaaattatatctgag

SEQ ID NO: 1391761 - DNA, 20 bp, Homo sapiens
aagattggacatggtctcct

SEQ ID NO: 1391762 - DNA, 22 bp, Homo sapiens
aagattggacatggtctcctct

SEQ ID NO: 1391763 - DNA, 22 bp, Homo sapiens
aagatttccttctttttttctt

SEQ ID NO: 1391764 - DNA, 14 bp, Homo sapiens
aagattttttaata

SEQ ID NO: 1391765 - DNA, 18 bp, Homo sapiens
aagcaaatcgaatgaaat

SEQ ID NO: 1391766 - DNA, 19 bp, Homo sapiens
aagcaagcattcagaagaa

SEQ ID NO: 1391767 - DNA, 21 bp, Homo sapiens
aagcaagcattcagaagaaaa

SEQ ID NO: 1391768 - DNA, 13 bp, Homo sapiens
aagcaagcttaat

SEQ ID NO: 1391769 - DNA, 16 bp, Homo sapiens
aagcaccttagctggc

SEQ ID NO: 1391770 - DNA, 15 bp, Homo sapiens
aagcatggctatttt

SEQ ID NO: 1391771 - DNA, 15 bp, Homo sapiens
aagcattcagaagaa

SEQ ID NO: 1391772 - DNA, 13 bp, Homo sapiens
aagcattctgtct

SEQ ID NO: 1391773 - DNA, 23 bp, Homo sapiens
aagcatttgtttctactttgata

SEQ ID NO: 1391774 - DNA, 12 bp, Homo sapiens
aagccagctttc

SEQ ID NO: 1391775 - DNA, 22 bp, Homo sapiens
aagccggttgcagagaatctgt

SEQ ID NO: 1391776 - DNA, 22 bp, Homo sapiens
aagcctgcacaataaaaatgtt

SEQ ID NO: 1391777 - DNA, 13 bp, Homo sapiens
aagctaaaataaa

SEQ ID NO: 1391778 - DNA, 15 bp, Homo sapiens
aagctaaaataaaga

SEQ ID NO: 1391779 - DNA, 14 bp, Homo sapiens
aagctaggaatgaa

SEQ ID NO: 1391780 - DNA, 17 bp, Homo sapiens
aagctgtgaccctcaat

SEQ ID NO: 1391781 - DNA, 18 bp, Homo sapiens
aagctgtgtggcagtctg

SEQ ID NO: 1391782 - DNA, 17 bp, Homo sapiens
aagcttaaaactttgaa

SEQ ID NO: 1391783 - DNA, 22 bp, Homo sapiens
aagctttggtgagaacctgggt

SEQ ID NO: 1391784 - DNA, 23 bp, Homo sapiens
aagctttttattcctcctgctca

SEQ ID NO: 1391785 - DNA, 15 bp, Homo sapiens
aaggaaaataagtga

SEQ ID NO: 1391786 - DNA, 16 bp, Homo sapiens
aaggaaaataagtgaa

SEQ ID NO: 1391787 - DNA, 16 bp, Homo sapiens
aaggaggggtacattg

SEQ ID NO: 1391788 - DNA, 19 bp, Homo sapiens
aaggagtgtagcaactaca

SEQ ID NO: 1391789 - DNA, 12 bp, Homo sapiens
aagggtcaggcc

SEQ ID NO: 1391790 - DNA, 14 bp, Homo sapiens
aagggttgagctgg

SEQ ID NO: 1391791 - DNA, 22 bp, Homo sapiens
aaggtaaaatgccatgatgcct

SEQ ID NO: 1391792 - DNA, 18 bp, Homo sapiens
aaggtacaagaagcattt

SEQ ID NO: 1391793 - DNA, 22 bp, Homo sapiens
aaggtattaaattgatgttgct

SEQ ID NO: 1391794 - DNA, 20 bp, Homo sapiens
aaggtgaggagcttgaaacc

SEQ ID NO: 1391795 - DNA, 21 bp, Homo sapiens
aagtaaaagcaaaaaagaaaa

SEQ ID NO: 1391796 - DNA, 15 bp, Homo sapiens
aagtagaaatcatag

SEQ ID NO: 1391797 - DNA, 19 bp, Homo sapiens
aagtatcatcagtgtagaa

SEQ ID NO: 1391798 - DNA, 10 bp, Homo sapiens
aagtatttag

SEQ ID NO: 1391799 - DNA, 19 bp, Homo sapiens
aagtatttgttaatttaga

SEQ ID NO: 1391800 - DNA, 20 bp, Homo sapiens
aagtatttgttaatttagaa

SEQ ID NO: 1391801 - DNA, 18 bp, Homo sapiens
aagtcagaacagcagact

SEQ ID NO: 1391802 - DNA, 14 bp, Homo sapiens
aagtctgtttactg

SEQ ID NO: 1391803 - DNA, 15 bp, Homo sapiens
aagtgaatttgcctg

SEQ ID NO: 1391804 - DNA, 22 bp, Homo sapiens
aagtgactaccagaaagtgagg

SEQ ID NO: 1391805 - DNA, 21 bp, Homo sapiens
aagtgaggaagcctaaataaa

SEQ ID NO: 1391806 - DNA, 17 bp, Homo sapiens
aagtgccattaacaaat

SEQ ID NO: 1391807 - DNA, 11 bp, Homo sapiens
aagtgtacata

SEQ ID NO: 1391808 - DNA, 13 bp, Homo sapiens
aagtgttttctct

SEQ ID NO: 1391809 - DNA, 16 bp, Homo sapiens
aagttacatgtttgca

SEQ ID NO: 1391810 - DNA, 19 bp, Homo sapiens
aagttacatgtttgcacct

SEQ ID NO: 1391811 - DNA, 22 bp, Homo sapiens
aagttcaatataagcttttctt

SEQ ID NO: 1391812 - DNA, 13 bp, Homo sapiens
aagttctgaaatt

SEQ ID NO: 1391813 - DNA, 17 bp, Homo sapiens
aagttctgaaatttaac

SEQ ID NO: 1391814 - DNA, 14 bp, Homo sapiens
aagtttaataaatt

SEQ ID NO: 1391815 - DNA, 17 bp, Homo sapiens
aagtttaataaatttat

SEQ ID NO: 1391816 - DNA, 23 bp, Homo sapiens
aagtttagcccctgaaagccatg

SEQ ID NO: 1391817 - DNA, 20 bp, Homo sapiens
aagtttgcactatctttcag

SEQ ID NO: 1391818 - DNA, 17 bp, Homo sapiens
aataaaaagatcacttt

SEQ ID NO: 1391819 - DNA, 19 bp, Homo sapiens
aataaaaagatcactttct

SEQ ID NO: 1391820 - DNA, 23 bp, Homo sapiens
aataaaaagatcactttctcagt

SEQ ID NO: 1391821 - DNA, 13 bp, Homo sapiens
aataaaaccagct

SEQ ID NO: 1391822 - DNA, 15 bp, Homo sapiens
aataaaacctcagct

SEQ ID NO: 1391823 - DNA, 22 bp, Homo sapiens
aataaaacctcagctagctctg

SEQ ID NO: 1391824 - DNA, 22 bp, Homo sapiens
aataaaattcaacaaacatttg

SEQ ID NO: 1391825 - DNA, 15 bp, Homo sapiens
aataaacgtttgaaa

SEQ ID NO: 1391826 - DNA, 13 bp, Homo sapiens
aataagaaacttt

SEQ ID NO: 1391827 - DNA, 19 bp, Homo sapiens
aataagtgtacatatgtaa

SEQ ID NO: 1391828 - DNA, 22 bp, Homo sapiens
aataagtgtacatatgtaaaat

SEQ ID NO: 1391829 - DNA, 22 bp, Homo sapiens
aataagttcaaattcttctgaa

SEQ ID NO: 1391830 - DNA, 20 bp, Homo sapiens
aataagtttttgtttcacag

SEQ ID NO: 1391831 - DNA, 18 bp, Homo sapiens
aatacagcaacaatttat

SEQ ID NO: 1391832 - DNA, 15 bp, Homo sapiens
aatactgctgagata

SEQ ID NO: 1391833 - DNA, 14 bp, Homo sapiens
aatacttctcattt

SEQ ID NO: 1391834 - DNA, 16 bp, Homo sapiens
aatagcaaaagaagaa

SEQ ID NO: 1391835 - DNA, 19 bp, Homo sapiens
aatagcaaaagaagaagtt

SEQ ID NO: 1391836 - DNA, 20 bp, Homo sapiens
aatagcaaaagaagaagttt

SEQ ID NO: 1391837 - DNA, 20 bp, Homo sapiens
aatagtaagcctccctcctc

SEQ ID NO: 1391838 - DNA, 15 bp, Homo sapiens
aatataaattaagac

SEQ ID NO: 1391839 - DNA, 18 bp, Homo sapiens
aatataaattaagacttt

SEQ ID NO: 1391840 - DNA, 13 bp, Homo sapiens
aatataatttaac

SEQ ID NO: 1391841 - DNA, 18 bp, Homo sapiens
aatatatatggaataagt

SEQ ID NO: 1391842 - DNA, 15 bp, Homo sapiens
aatatatattatctt

SEQ ID NO: 1391843 - DNA, 18 bp, Homo sapiens
aatatatattatcttttc

SEQ ID NO: 1391844 - DNA, 22 bp, Homo sapiens
aatatccctcctgttgggagag

SEQ ID NO: 1391845 - DNA, 14 bp, Homo sapiens
aatatcctaaacat

SEQ ID NO: 1391846 - DNA, 18 bp, Homo sapiens
aatatcctaaacatcatt

SEQ ID NO: 1391847 - DNA, 17 bp, Homo sapiens
aatatcttcacttgtca

SEQ ID NO: 1391848 - DNA, 16 bp, Homo sapiens
aatatgatgttaaaaa

SEQ ID NO: 1391849 - DNA, 21 bp, Homo sapiens
aatatgcctgctatttgaagt

SEQ ID NO: 1391850 - DNA, 12 bp, Homo sapiens
aatatgtaccaa

SEQ ID NO: 1391851 - DNA, 24 bp, Homo sapiens
aatatgtttgaggttaaaatataa

SEQ ID NO: 1391852 - DNA, 18 bp, Homo sapiens
aatattatgagatgctgg

SEQ ID NO: 1391853 - DNA, 22 bp, Homo sapiens
aatattatgagatgctggcttg

SEQ ID NO: 1391854 - DNA, 12 bp, Homo sapiens
aatatttatgtg

SEQ ID NO: 1391855 - DNA, 17 bp, Homo sapiens
aatatttgtgacaaaaa

SEQ ID NO: 1391856 - DNA, 13 bp, Homo sapiens
aatattttaaaga

SEQ ID NO: 1391857 - DNA, 18 bp, Homo sapiens
aatcaaaagggccaaaga

SEQ ID NO: 1391858 - DNA, 19 bp, Homo sapiens
aatcaaaagggccaaagaa

SEQ ID NO: 1391859 - DNA, 14 bp, Homo sapiens
aatcaattaaaagt

SEQ ID NO: 1391860 - DNA, 20 bp, Homo sapiens
aatcaattactggtccaaaa

SEQ ID NO: 1391861 - DNA, 19 bp, Homo sapiens
aatcactgtttagaacaca

SEQ ID NO: 1391862 - DNA, 16 bp, Homo sapiens
aatcaggtggcttttg

SEQ ID NO: 1391863 - DNA, 13 bp, Homo sapiens
aatcattttgcaa

SEQ ID NO: 1391864 - DNA, 19 bp, Homo sapiens
aatcctgtcgattagactg

SEQ ID NO: 1391865 - DNA, 19 bp, Homo sapiens
aatccttagatctggcatg

SEQ ID NO: 1391866 - DNA, 17 bp, Homo sapiens
aatccttgcttatgaca

SEQ ID NO: 1391867 - DNA, 13 bp, Homo sapiens
aatctaaatataa

SEQ ID NO: 1391868 - DNA, 22 bp, Homo sapiens
aatctcagttgattttctggat

SEQ ID NO: 1391869 - DNA, 16 bp, Homo sapiens
aatctgcattattgga

SEQ ID NO: 1391870 - DNA, 14 bp, Homo sapiens
aatctggctcctgt

SEQ ID NO: 1391871 - DNA, 21 bp, Homo sapiens
aatctggcttctggccaggaa

SEQ ID NO: 1391872 - DNA, 23 bp, Homo sapiens
aatctggcttctggccaggaagc

SEQ ID NO: 1391873 - DNA, 12 bp, Homo sapiens
aatctgtaaact

SEQ ID NO: 1391874 - DNA, 16 bp, Homo sapiens
aatctgtaaactgtgt

SEQ ID NO: 1391875 - DNA, 23 bp, Homo sapiens
aatctgtaaactgtgtattccaa

SEQ ID NO: 1391876 - DNA, 16 bp, Homo sapiens
aatcttttataggatt

SEQ ID NO: 1391877 - DNA, 12 bp, Homo sapiens
aatgaacaaatg

SEQ ID NO: 1391878 - DNA, 15 bp, Homo sapiens
aatgaacagaacata

SEQ ID NO: 1391879 - DNA, 22 bp, Homo sapiens
aatgaacagaacatagacagaa

SEQ ID NO: 1391880 - DNA, 17 bp, Homo sapiens
aatgaattaaataaacc

SEQ ID NO: 1391881 - DNA, 19 bp, Homo sapiens
aatgatggcaattttgtaa

SEQ ID NO: 1391882 - DNA, 11 bp, Homo sapiens
aatgatttcag

SEQ ID NO: 1391883 - DNA, 22 bp, Homo sapiens
aatgatttcatgctatctctgt

SEQ ID NO: 1391884 - DNA, 22 bp, Homo sapiens
aatgccatgatgcctctgtctt

SEQ ID NO: 1391885 - DNA, 15 bp, Homo sapiens
aatgccttttcccaa

SEQ ID NO: 1391886 - DNA, 19 bp, Homo sapiens
aatgctatcaaataactaa

SEQ ID NO: 1391887 - DNA, 17 bp, Homo sapiens
aatggaggccattgtgt

SEQ ID NO: 1391888 - DNA, 23 bp, Homo sapiens
aatggcatgagaaatacaaaaat

SEQ ID NO: 1391889 - DNA, 14 bp, Homo sapiens
aatggctatgtttt

SEQ ID NO: 1391890 - DNA, 20 bp, Homo sapiens
aatggctatgtttttaatgt

SEQ ID NO: 1391891 - DNA, 14 bp, Homo sapiens
aatggtcccttctt

SEQ ID NO: 1391892 - DNA, 19 bp, Homo sapiens
aatgtaaatattttaaaga

SEQ ID NO: 1391893 - DNA, 22 bp, Homo sapiens
aatgtaaatattttaaagaatt

SEQ ID NO: 1391894 - DNA, 23 bp, Homo sapiens
aatgtgaactaagttttttactt

SEQ ID NO: 1391895 - DNA, 20 bp, Homo sapiens
aatgtgtgtaaaaaagtgtt

SEQ ID NO: 1391896 - DNA, 17 bp, Homo sapiens
aatgttagcctcaattt

SEQ ID NO: 1391897 - DNA, 15 bp, Homo sapiens
aatgttgaaatatga

SEQ ID NO: 1391898 - DNA, 22 bp, Homo sapiens
aatgttgaaatatgatgttaaa

SEQ ID NO: 1391899 - DNA, 23 bp, Homo sapiens
aatgttggtcattttatgttaag

SEQ ID NO: 1391900 - DNA, 13 bp, Homo sapiens
aatgtttaaaaca

SEQ ID NO: 1391901 - DNA, 16 bp, Homo sapiens
aatgtttttattaaca

SEQ ID NO: 1391902 - DNA, 22 bp, Homo sapiens
aattaactaggttgctacttta

SEQ ID NO: 1391903 - DNA, 13 bp, Homo sapiens
aattatccaggaa

SEQ ID NO: 1391904 - DNA, 22 bp, Homo sapiens
aattcaaagctgtgtgtttgga

SEQ ID NO: 1391905 - DNA, 12 bp, Homo sapiens
aattcactctga

SEQ ID NO: 1391906 - DNA, 18 bp, Homo sapiens
aattgaagctttacttta

SEQ ID NO: 1391907 - DNA, 14 bp, Homo sapiens
aattgaatattatt

SEQ ID NO: 1391908 - DNA, 18 bp, Homo sapiens
aattgaatgcaaaccata

SEQ ID NO: 1391909 - DNA, 15 bp, Homo sapiens
aattgagaaggaaaa

SEQ ID NO: 1391910 - DNA, 18 bp, Homo sapiens
aattgagtgtttaaagtt

SEQ ID NO: 1391911 - DNA, 13 bp, Homo sapiens
aattgattttgaa

SEQ ID NO: 1391912 - DNA, 21 bp, Homo sapiens
aattgcctccttatttatcaa

SEQ ID NO: 1391913 - DNA, 23 bp, Homo sapiens
aattgcctgacgaactccttgat

SEQ ID NO: 1391914 - DNA, 21 bp, Homo sapiens
aattgggagcttgggaatgga

SEQ ID NO: 1391915 - DNA, 23 bp, Homo sapiens
aattgttgctaatcttcttatgc

SEQ ID NO: 1391916 - DNA, 17 bp, Homo sapiens
aatttaacagaagttgt

SEQ ID NO: 1391917 - DNA, 14 bp, Homo sapiens
aatttagaaatcat

SEQ ID NO: 1391918 - DNA, 17 bp, Homo sapiens
aatttagaaatcatttt

SEQ ID NO: 1391919 - DNA, 20 bp, Homo sapiens
aatttagaaatcattttgca

SEQ ID NO: 1391920 - DNA, 21 bp, Homo sapiens
aatttatgaattgaattatct

SEQ ID NO: 1391921 - DNA, 23 bp, Homo sapiens
aatttatgaattgaattatcttg

SEQ ID NO: 1391922 - DNA, 16 bp, Homo sapiens
aatttcacctgtaaac

SEQ ID NO: 1391923 - DNA, 18 bp, Homo sapiens
aatttgagagaaatatga

SEQ ID NO: 1391924 - DNA, 14 bp, Homo sapiens
aatttgaggacaac

SEQ ID NO: 1391925 - DNA, 16 bp, Homo sapiens
aattttccattacatg

SEQ ID NO: 1391926 - DNA, 23 bp, Homo sapiens
aattttgagtacagaattcaaca

SEQ ID NO: 1391927 - DNA, 13 bp, Homo sapiens
aattttgttgctg

SEQ ID NO: 1391928 - DNA, 13 bp, Homo sapiens
aatttttaaacaa

SEQ ID NO: 1391929 - DNA, 19 bp, Homo sapiens
aatttttaaacaagtattt

SEQ ID NO: 1391930 - DNA, 22 bp, Homo sapiens
aatttttatttttgctgagact

SEQ ID NO: 1391931 - DNA, 18 bp, Homo sapiens
aattttttatcatgcatg

SEQ ID NO: 1391932 - DNA, 19 bp, Homo sapiens
aatttttttttcctagccc

SEQ ID NO: 1391933 - DNA, 14 bp, Homo sapiens
acaaaactgcattt

SEQ ID NO: 1391934 - DNA, 15 bp, Homo sapiens
acaaacacctcccag

SEQ ID NO: 1391935 - DNA, 14 bp, Homo sapiens
acaaacacctccta

SEQ ID NO: 1391936 - DNA, 19 bp, Homo sapiens
acaaactgtaatacaatga

SEQ ID NO: 1391937 - DNA, 18 bp, Homo sapiens
acaaagagttcaagaaat

SEQ ID NO: 1391938 - DNA, 19 bp, Homo sapiens
acaaagagttcaagaaata

SEQ ID NO: 1391939 - DNA, 15 bp, Homo sapiens
acaaagcccttttat

SEQ ID NO: 1391940 - DNA, 12 bp, Homo sapiens
acaaatatttat

SEQ ID NO: 1391941 - DNA, 14 bp, Homo sapiens
acaaatgtgtaatt

SEQ ID NO: 1391942 - DNA, 23 bp, Homo sapiens
acaacagttacataattcactct

SEQ ID NO: 1391943 - DNA, 14 bp, Homo sapiens
acaacatttctata

SEQ ID NO: 1391944 - DNA, 22 bp, Homo sapiens
acaacatttctatagccaaaaa

SEQ ID NO: 1391945 - DNA, 15 bp, Homo sapiens
acaactattttcaga

SEQ ID NO: 1391946 - DNA, 16 bp, Homo sapiens
acaactattttcagat

SEQ ID NO: 1391947 - DNA, 16 bp, Homo sapiens
acaactggcaggcagg

SEQ ID NO: 1391948 - DNA, 15 bp, Homo sapiens
acaagatatttatat

SEQ ID NO: 1391949 - DNA, 17 bp, Homo sapiens
acaagatatttatatgt

SEQ ID NO: 1391950 - DNA, 20 bp, Homo sapiens
acaagatatttatatgttat

SEQ ID NO: 1391951 - DNA, 21 bp, Homo sapiens
acaagcattctgtcttgaagg

SEQ ID NO: 1391952 - DNA, 22 bp, Homo sapiens
acaagccagaacttgaccctga

SEQ ID NO: 1391953 - DNA, 14 bp, Homo sapiens
acaagtaacaaaaa

SEQ ID NO: 1391954 - DNA, 16 bp, Homo sapiens
acaagttatttaaatc

SEQ ID NO: 1391955 - DNA, 16 bp, Homo sapiens
acaataaaaatgttta

SEQ ID NO: 1391956 - DNA, 20 bp, Homo sapiens
acaatgatcctgtattcaga

SEQ ID NO: 1391957 - DNA, 19 bp, Homo sapiens
acaattaaagctgttattt

SEQ ID NO: 1391958 - DNA, 18 bp, Homo sapiens
acaattccagactttcta

SEQ ID NO: 1391959 - DNA, 14 bp, Homo sapiens
acaattctaaaatg

SEQ ID NO: 1391960 - DNA, 24 bp, Homo sapiens
acaattctaaaatgattgtagtaa

SEQ ID NO: 1391961 - DNA, 10 bp, Homo sapiens
acacactgta

SEQ ID NO: 1391962 - DNA, 14 bp, Homo sapiens
acacacttactttt

SEQ ID NO: 1391963 - DNA, 14 bp, Homo sapiens
acacagaaaccaat

SEQ ID NO: 1391964 - DNA, 23 bp, Homo sapiens
acacagactgcgatttgtcccag

SEQ ID NO: 1391965 - DNA, 17 bp, Homo sapiens
acaccaacataaaaatg

SEQ ID NO: 1391966 - DNA, 18 bp, Homo sapiens
acaccaacataaaaatga

SEQ ID NO: 1391967 - DNA, 19 bp, Homo sapiens
acacccaaagaggtattta

SEQ ID NO: 1391968 - DNA, 15 bp, Homo sapiens
acacccacactcaga

SEQ ID NO: 1391969 - DNA, 17 bp, Homo sapiens
acaccccgacttttgtt

SEQ ID NO: 1391970 - DNA, 18 bp, Homo sapiens
acaccgttcattcaggca

SEQ ID NO: 1391971 - DNA, 20 bp, Homo sapiens
acacctaggctagggtgggg

SEQ ID NO: 1391972 - DNA, 23 bp, Homo sapiens
acacctaggctagggtggggaga

SEQ ID NO: 1391973 - DNA, 17 bp, Homo sapiens
acacctatgtcatttca

SEQ ID NO: 1391974 - DNA, 15 bp, Homo sapiens
acacctcctagcaag

SEQ ID NO: 1391975 - DNA, 14 bp, Homo sapiens
acactaaaaataaa

SEQ ID NO: 1391976 - DNA, 16 bp, Homo sapiens
acactagacaagccag

SEQ ID NO: 1391977 - DNA, 17 bp, Homo sapiens
acactagcccaatgaaa

SEQ ID NO: 1391978 - DNA, 17 bp, Homo sapiens
acacttactttttctgg

SEQ ID NO: 1391979 - DNA, 22 bp, Homo sapiens
acactttaattaccaacctgtt

SEQ ID NO: 1391980 - DNA, 24 bp, Homo sapiens
acagaaatgattactaaggaagat

SEQ ID NO: 1391981 - DNA, 12 bp, Homo sapiens
acagaagaaaca

SEQ ID NO: 1391982 - DNA, 22 bp, Homo sapiens
acagaagttgtgaaactaaaat

SEQ ID NO: 1391983 - DNA, 15 bp, Homo sapiens
acagaagtttgcact

SEQ ID NO: 1391984 - DNA, 17 bp, Homo sapiens
acagaagtttgcactat

SEQ ID NO: 1391985 - DNA, 22 bp, Homo sapiens
acagaattactgtaactgatta

SEQ ID NO: 1391986 - DNA, 18 bp, Homo sapiens
acagaattttatggtgca

SEQ ID NO: 1391987 - DNA, 18 bp, Homo sapiens
acagataactgaaaatta

SEQ ID NO: 1391988 - DNA, 14 bp, Homo sapiens
acagattgtttgca

SEQ ID NO: 1391989 - DNA, 23 bp, Homo sapiens
acagcagactcagctctgacatt

SEQ ID NO: 1391990 - DNA, 20 bp, Homo sapiens
acaggatgtgtttgctttct

SEQ ID NO: 1391991 - DNA, 18 bp, Homo sapiens
acaggtaaactatcttgg

SEQ ID NO: 1391992 - DNA, 14 bp, Homo sapiens
acagtacactgtca

SEQ ID NO: 1391993 - DNA, 12 bp, Homo sapiens
acagtctaaagc

SEQ ID NO: 1391994 - DNA, 14 bp, Homo sapiens
acagtgaagacaga

SEQ ID NO: 1391995 - DNA, 18 bp, Homo sapiens
acagtgaagacagaagtt

SEQ ID NO: 1391996 - DNA, 21 bp, Homo sapiens
acagtgagacagtctggaaag

SEQ ID NO: 1391997 - DNA, 14 bp, Homo sapiens
acagtgagcctgaa

SEQ ID NO: 1391998 - DNA, 20 bp, Homo sapiens
acagtgctgaccagacagcc

SEQ ID NO: 1391999 - DNA, 18 bp, Homo sapiens
acagtggaactacattag

SEQ ID NO: 1392000 - DNA, 13 bp, Homo sapiens
acagttacataat

SEQ ID NO: 1392001 - DNA, 16 bp, Homo sapiens
acagttatctaagtta

SEQ ID NO: 1392002 - DNA, 15 bp, Homo sapiens
acataagccattatt

SEQ ID NO: 1392003 - DNA, 18 bp, Homo sapiens
acataagccattattcac

SEQ ID NO: 1392004 - DNA, 20 bp, Homo sapiens
acataatgaacagaatttat

SEQ ID NO: 1392005 - DNA, 14 bp, Homo sapiens
acatacctaagaag

SEQ ID NO: 1392006 - DNA, 16 bp, Homo sapiens
acatactcatttttca

SEQ ID NO: 1392007 - DNA, 21 bp, Homo sapiens
acatagaaattgcctgacgaa

SEQ ID NO: 1392008 - DNA, 15 bp, Homo sapiens
acatagttatttatt

SEQ ID NO: 1392009 - DNA, 12 bp, Homo sapiens
acatatgtaaaa

SEQ ID NO: 1392010 - DNA, 22 bp, Homo sapiens
acatatgtaaaatattgttact

SEQ ID NO: 1392011 - DNA, 18 bp, Homo sapiens
acatcattactataagaa

SEQ ID NO: 1392012 - DNA, 16 bp, Homo sapiens
acatctttttcctccc

SEQ ID NO: 1392013 - DNA, 18 bp, Homo sapiens
acatctttttcctccctt

SEQ ID NO: 1392014 - DNA, 20 bp, Homo sapiens
acatctttttcctccctttc

SEQ ID NO: 1392015 - DNA, 13 bp, Homo sapiens
acatgattcattt

SEQ ID NO: 1392016 - DNA, 18 bp, Homo sapiens
acatgcacttggctgcat

SEQ ID NO: 1392017 - DNA, 18 bp, Homo sapiens
acatgctaagagaagtag

SEQ ID NO: 1392018 - DNA, 18 bp, Homo sapiens
acatgtctgttctacata

SEQ ID NO: 1392019 - DNA, 13 bp, Homo sapiens
acattaactcatt

SEQ ID NO: 1392020 - DNA, 15 bp, Homo sapiens
acattaactcattag

SEQ ID NO: 1392021 - DNA, 21 bp, Homo sapiens
acattagaagacaattgacaa

SEQ ID NO: 1392022 - DNA, 15 bp, Homo sapiens
acattggtaaacatt

SEQ ID NO: 1392023 - DNA, 12 bp, Homo sapiens
acattgttaata

SEQ ID NO: 1392024 - DNA, 14 bp, Homo sapiens
acatttaataatca

SEQ ID NO: 1392025 - DNA, 16 bp, Homo sapiens
acatttaataatcaga

SEQ ID NO: 1392026 - DNA, 16 bp, Homo sapiens
acatttattttgacat

SEQ ID NO: 1392027 - DNA, 20 bp, Homo sapiens
acatttctatagccaaaaat

SEQ ID NO: 1392028 - DNA, 18 bp, Homo sapiens
acattttctaagaaacat

SEQ ID NO: 1392029 - DNA, 20 bp, Homo sapiens
accaaagcaccttagctggc

SEQ ID NO: 1392030 - DNA, 14 bp, Homo sapiens
accaacataaaaat

SEQ ID NO: 1392031 - DNA, 15 bp, Homo sapiens
accaacataaaaatg

SEQ ID NO: 1392032 - DNA, 21 bp, Homo sapiens
accaagatacttaagtgctgc

SEQ ID NO: 1392033 - DNA, 17 bp, Homo sapiens
accaaggctttctctac

SEQ ID NO: 1392034 - DNA, 23 bp, Homo sapiens
accaaggctttctctactgattc

SEQ ID NO: 1392035 - DNA, 23 bp, Homo sapiens
accaagttggaacatccttggaa

SEQ ID NO: 1392036 - DNA, 14 bp, Homo sapiens
accacaaactgtaa

SEQ ID NO: 1392037 - DNA, 13 bp, Homo sapiens
accacccacaatc

SEQ ID NO: 1392038 - DNA, 20 bp, Homo sapiens
accagagaaaaagggagggg

SEQ ID NO: 1392039 - DNA, 14 bp, Homo sapiens
accaggatagagac

SEQ ID NO: 1392040 - DNA, 19 bp, Homo sapiens
accaggatagagactggaa

SEQ ID NO: 1392041 - DNA, 17 bp, Homo sapiens
accaggcaccaaaagaa

SEQ ID NO: 1392042 - DNA, 20 bp, Homo sapiens
accaggcaccaaaagaagta

SEQ ID NO: 1392043 - DNA, 21 bp, Homo sapiens
accaggcagcctctggggggt

SEQ ID NO: 1392044 - DNA, 15 bp, Homo sapiens
accatcgctttattg

SEQ ID NO: 1392045 - DNA, 19 bp, Homo sapiens
accatgccaggctaatttt

SEQ ID NO: 1392046 - DNA, 21 bp, Homo sapiens
accattataaccttaatttat

SEQ ID NO: 1392047 - DNA, 11 bp, Homo sapiens
accatttcaga

SEQ ID NO: 1392048 - DNA, 13 bp, Homo sapiens
accatttcctcag

SEQ ID NO: 1392049 - DNA, 19 bp, Homo sapiens
accatttcctcagactcta

SEQ ID NO: 1392050 - DNA, 20 bp, Homo sapiens
accatttggcatccctgggc

SEQ ID NO: 1392051 - DNA, 22 bp, Homo sapiens
accatttggcatccctgggcct

SEQ ID NO: 1392052 - DNA, 22 bp, Homo sapiens
acccacactcagatcctcctca

SEQ ID NO: 1392053 - DNA, 19 bp, Homo sapiens
accccagctggggccaggc

SEQ ID NO: 1392054 - DNA, 22 bp, Homo sapiens
accccagctggggccaggctgg

SEQ ID NO: 1392055 - DNA, 23 bp, Homo sapiens
accccagctggggccaggctggg

SEQ ID NO: 1392056 - DNA, 17 bp, Homo sapiens
accccatccagttcatg

SEQ ID NO: 1392057 - DNA, 12 bp, Homo sapiens
accccgactttt

SEQ ID NO: 1392058 - DNA, 17 bp, Homo sapiens
accccgtgaagcatcca

SEQ ID NO: 1392059 - DNA, 16 bp, Homo sapiens
acccctacatgaaaca

SEQ ID NO: 1392060 - DNA, 19 bp, Homo sapiens
acccctcccctccatccct

SEQ ID NO: 1392061 - DNA, 20 bp, Homo sapiens
acccctcccctccatccctg

SEQ ID NO: 1392062 - DNA, 18 bp, Homo sapiens
acccctctaccaagctgt

SEQ ID NO: 1392063 - DNA, 22 bp, Homo sapiens
acccctgcctcccatgcctggt

SEQ ID NO: 1392064 - DNA, 16 bp, Homo sapiens
accctcatctttcttc

SEQ ID NO: 1392065 - DNA, 17 bp, Homo sapiens
accctgccccagctggg

SEQ ID NO: 1392066 - DNA, 13 bp, Homo sapiens
accgaggcaggga

SEQ ID NO: 1392067 - DNA, 19 bp, Homo sapiens
accggggcctgggcaggag

SEQ ID NO: 1392068 - DNA, 12 bp, Homo sapiens
acctaaagaaaa

SEQ ID NO: 1392069 - DNA, 11 bp, Homo sapiens
acctaatccaa

SEQ ID NO: 1392070 - DNA, 17 bp, Homo sapiens
acctacctgttgagcat

SEQ ID NO: 1392071 - DNA, 21 bp, Homo sapiens
acctactttgactttttgcat

SEQ ID NO: 1392072 - DNA, 15 bp, Homo sapiens
acctatgtcatttca

SEQ ID NO: 1392073 - DNA, 18 bp, Homo sapiens
acctatgtcatttcattt

SEQ ID NO: 1392074 - DNA, 19 bp, Homo sapiens
acctatgtcatttcatttc

SEQ ID NO: 1392075 - DNA, 23 bp, Homo sapiens
acctatttcttaaacacttgcaa

SEQ ID NO: 1392076 - DNA, 18 bp, Homo sapiens
acctcagctagctctgcc

SEQ ID NO: 1392077 - DNA, 21 bp, Homo sapiens
acctccaaagcttcccacggc

SEQ ID NO: 1392078 - DNA, 17 bp, Homo sapiens
acctccacctcctgggt

SEQ ID NO: 1392079 - DNA, 16 bp, Homo sapiens
acctgaactgaacacc

SEQ ID NO: 1392080 - DNA, 11 bp, Homo sapiens
acctgaagaat

SEQ ID NO: 1392081 - DNA, 15 bp, Homo sapiens
acctgacccctgctc

SEQ ID NO: 1392082 - DNA, 16 bp, Homo sapiens
acctgacccctgctca

SEQ ID NO: 1392083 - DNA, 17 bp, Homo sapiens
acctgacccctgctcag

SEQ ID NO: 1392084 - DNA, 17 bp, Homo sapiens
acctgaggctcagccct

SEQ ID NO: 1392085 - DNA, 22 bp, Homo sapiens
acctgagtcaccctacctgtgc

SEQ ID NO: 1392086 - DNA, 13 bp, Homo sapiens
acctgatgaaaat

SEQ ID NO: 1392087 - DNA, 15 bp, Homo sapiens
acctgatgaaaataa

SEQ ID NO: 1392088 - DNA, 19 bp, Homo sapiens
acctgatgaaaataaagaa

SEQ ID NO: 1392089 - DNA, 22 bp, Homo sapiens
acctgatgaaaataaagaatgg

SEQ ID NO: 1392090 - DNA, 11 bp, Homo sapiens
acctgattttt

SEQ ID NO: 1392091 - DNA, 16 bp, Homo sapiens
acctgattttttttcc

SEQ ID NO: 1392092 - DNA, 17 bp, Homo sapiens
acctgattttttttcct

SEQ ID NO: 1392093 - DNA, 16 bp, Homo sapiens
acctgccgagagtcca

SEQ ID NO: 1392094 - DNA, 17 bp, Homo sapiens
acctgtatgtctccagt

SEQ ID NO: 1392095 - DNA, 19 bp, Homo sapiens
acctgttgagcatcacaga

SEQ ID NO: 1392096 - DNA, 15 bp, Homo sapiens
acctgttgcacctca

SEQ ID NO: 1392097 - DNA, 23 bp, Homo sapiens
accttctctatggggcatcctct

SEQ ID NO: 1392098 - DNA, 21 bp, Homo sapiens
accttctgacctccccacccc

SEQ ID NO: 1392099 - DNA, 15 bp, Homo sapiens
acctttctagttgaa

SEQ ID NO: 1392100 - DNA, 22 bp, Homo sapiens
acgcaccaccatgccaggctaa

SEQ ID NO: 1392101 - DNA, 15 bp, Homo sapiens
acgcccaggacccca

SEQ ID NO: 1392102 - DNA, 21 bp, Homo sapiens
acgtatttaatagcaaagaat

SEQ ID NO: 1392103 - DNA, 17 bp, Homo sapiens
acgtctgggtggccctt

SEQ ID NO: 1392104 - DNA, 14 bp, Homo sapiens
actaaaatatttat

SEQ ID NO: 1392105 - DNA, 16 bp, Homo sapiens
actaaagccaaacata

SEQ ID NO: 1392106 - DNA, 23 bp, Homo sapiens
actaaagccaaacatatatatac

SEQ ID NO: 1392107 - DNA, 13 bp, Homo sapiens
actaaatctttta

SEQ ID NO: 1392108 - DNA, 20 bp, Homo sapiens
actaaggaatatatatggaa

SEQ ID NO: 1392109 - DNA, 19 bp, Homo sapiens
actaatgccttactcttct

SEQ ID NO: 1392110 - DNA, 24 bp, Homo sapiens
actaatgccttactcttcttgaaa

SEQ ID NO: 1392111 - DNA, 12 bp, Homo sapiens
actaatggcatg

SEQ ID NO: 1392112 - DNA, 22 bp, Homo sapiens
actaatggcatgagaaatacaa

SEQ ID NO: 1392113 - DNA, 15 bp, Homo sapiens
actaatttttatttt

SEQ ID NO: 1392114 - DNA, 22 bp, Homo sapiens
actacacactgtgtactgcagt

SEQ ID NO: 1392115 - DNA, 17 bp, Homo sapiens
actacaggcgtgagcca

SEQ ID NO: 1392116 - DNA, 12 bp, Homo sapiens
actacatgcact

SEQ ID NO: 1392117 - DNA, 14 bp, Homo sapiens
actaccaagtgacc

SEQ ID NO: 1392118 - DNA, 19 bp, Homo sapiens
actagagacctctcaacag

SEQ ID NO: 1392119 - DNA, 14 bp, Homo sapiens
actagaggtgagaa

SEQ ID NO: 1392120 - DNA, 16 bp, Homo sapiens
actagagttagatatg

SEQ ID NO: 1392121 - DNA, 15 bp, Homo sapiens
actagcccaatgaaa

SEQ ID NO: 1392122 - DNA, 22 bp, Homo sapiens
actaggccttgcggctcctcag

SEQ ID NO: 1392123 - DNA, 14 bp, Homo sapiens
actagggagccatg

SEQ ID NO: 1392124 - DNA, 18 bp, Homo sapiens
actagggagccatgtttc

SEQ ID NO: 1392125 - DNA, 16 bp, Homo sapiens
actatcttggtgaatt

SEQ ID NO: 1392126 - DNA, 18 bp, Homo sapiens
actattatccccatttct

SEQ ID NO: 1392127 - DNA, 23 bp, Homo sapiens
actcaaactgaggaatttcacct

SEQ ID NO: 1392128 - DNA, 15 bp, Homo sapiens
actcacctcctccca

SEQ ID NO: 1392129 - DNA, 15 bp, Homo sapiens
actcagaatgctcta

SEQ ID NO: 1392130 - DNA, 22 bp, Homo sapiens
actcagataaggtaaaatgcca

SEQ ID NO: 1392131 - DNA, 19 bp, Homo sapiens
actcagctctgacattctg

SEQ ID NO: 1392132 - DNA, 22 bp, Homo sapiens
actcaggcccccacctggctca

SEQ ID NO: 1392133 - DNA, 13 bp, Homo sapiens
actcattagactg

SEQ ID NO: 1392134 - DNA, 21 bp, Homo sapiens
actcattagactggaacttga

SEQ ID NO: 1392135 - DNA, 19 bp, Homo sapiens
actccactgtggaaaatgc

SEQ ID NO: 1392136 - DNA, 18 bp, Homo sapiens
actccggaatgaccagca

SEQ ID NO: 1392137 - DNA, 18 bp, Homo sapiens
actcctaattaagggaca

SEQ ID NO: 1392138 - DNA, 23 bp, Homo sapiens
actcctaattaagggacatgtat

SEQ ID NO: 1392139 - DNA, 16 bp, Homo sapiens
actcctgacctcaggc

SEQ ID NO: 1392140 - DNA, 17 bp, Homo sapiens
actcctgacctcaggca

SEQ ID NO: 1392141 - DNA, 21 bp, Homo sapiens
actcggcctcccaaagtgctg

SEQ ID NO: 1392142 - DNA, 23 bp, Homo sapiens
actcgtgtctggcacagcctggc

SEQ ID NO: 1392143 - DNA, 21 bp, Homo sapiens
actctcttattgcctcacttc

SEQ ID NO: 1392144 - DNA, 23 bp, Homo sapiens
actctcttattgcctcacttcag

SEQ ID NO: 1392145 - DNA, 20 bp, Homo sapiens
actctgagtgttttatgaga

SEQ ID NO: 1392146 - DNA, 15 bp, Homo sapiens
actctgccccttctg

SEQ ID NO: 1392147 - DNA, 21 bp, Homo sapiens
actctgccccttctgtttcca

SEQ ID NO: 1392148 - DNA, 23 bp, Homo sapiens
actcttctgagcacctacttaca

SEQ ID NO: 1392149 - DNA, 14 bp, Homo sapiens
actctttatgcttg

SEQ ID NO: 1392150 - DNA, 15 bp, Homo sapiens
actctttatgcttgc

SEQ ID NO: 1392151 - DNA, 19 bp, Homo sapiens
actgaaaatgtgctatact

SEQ ID NO: 1392152 - DNA, 20 bp, Homo sapiens
actgaacaccattgaaggct

SEQ ID NO: 1392153 - DNA, 20 bp, Homo sapiens
actgagagatgcagaaatat

SEQ ID NO: 1392154 - DNA, 12 bp, Homo sapiens
actgagtgactc

SEQ ID NO: 1392155 - DNA, 13 bp, Homo sapiens
actgagttttcca

SEQ ID NO: 1392156 - DNA, 14 bp, Homo sapiens
actgcaacctccac

SEQ ID NO: 1392157 - DNA, 17 bp, Homo sapiens
actgcatactttttaaa

SEQ ID NO: 1392158 - DNA, 18 bp, Homo sapiens
actgcatactttttaaat

SEQ ID NO: 1392159 - DNA, 23 bp, Homo sapiens
actgcatactttttaaatgtaaa

SEQ ID NO: 1392160 - DNA, 19 bp, Homo sapiens
actgccaagactgctgtgg

SEQ ID NO: 1392161 - DNA, 18 bp, Homo sapiens
actgccgtcagtgctgtg

SEQ ID NO: 1392162 - DNA, 20 bp, Homo sapiens
actgccgtcagtgctgtgct

SEQ ID NO: 1392163 - DNA, 22 bp, Homo sapiens
actgctgagatacatacagaat

SEQ ID NO: 1392164 - DNA, 15 bp, Homo sapiens
actgctgtggccagg

SEQ ID NO: 1392165 - DNA, 17 bp, Homo sapiens
actgctgtggccaggag

SEQ ID NO: 1392166 - DNA, 18 bp, Homo sapiens
actgctgtggccaggagg

SEQ ID NO: 1392167 - DNA, 20 bp, Homo sapiens
actgctgtggccaggaggtg

SEQ ID NO: 1392168 - DNA, 13 bp, Homo sapiens
actgcttggagct

SEQ ID NO: 1392169 - DNA, 17 bp, Homo sapiens
actggaacttgaactga

SEQ ID NO: 1392170 - DNA, 14 bp, Homo sapiens
actggacagcttgt

SEQ ID NO: 1392171 - DNA, 21 bp, Homo sapiens
actggaccactgggcaatgat

SEQ ID NO: 1392172 - DNA, 16 bp, Homo sapiens
actggagtgtgcgtgg

SEQ ID NO: 1392173 - DNA, 17 bp, Homo sapiens
actggagtgtgcgtggt

SEQ ID NO: 1392174 - DNA, 15 bp, Homo sapiens
actggcctcaaagca

SEQ ID NO: 1392175 - DNA, 17 bp, Homo sapiens
actggcctcaaagcaag

SEQ ID NO: 1392176 - DNA, 15 bp, Homo sapiens
actgggggaaaagat

SEQ ID NO: 1392177 - DNA, 20 bp, Homo sapiens
actgggtaatgaaacaaaga

SEQ ID NO: 1392178 - DNA, 17 bp, Homo sapiens
actggtttgaagaatgt

SEQ ID NO: 1392179 - DNA, 14 bp, Homo sapiens
actggttttcacat

SEQ ID NO: 1392180 - DNA, 18 bp, Homo sapiens
actgtagaatgatttcat

SEQ ID NO: 1392181 - DNA, 15 bp, Homo sapiens
actgtatctaggcaa

SEQ ID NO: 1392182 - DNA, 19 bp, Homo sapiens
actgtcagcagggactgta

SEQ ID NO: 1392183 - DNA, 22 bp, Homo sapiens
actgtcagcagggactgtaaac

SEQ ID NO: 1392184 - DNA, 13 bp, Homo sapiens
actgtcatagaaa

SEQ ID NO: 1392185 - DNA, 15 bp, Homo sapiens
actgtctctcatgaa

SEQ ID NO: 1392186 - DNA, 15 bp, Homo sapiens
actgtggaaaatgct

SEQ ID NO: 1392187 - DNA, 19 bp, Homo sapiens
actgtgtaagggccagaaa

SEQ ID NO: 1392188 - DNA, 21 bp, Homo sapiens
actgtgtattccaagacatgt

SEQ ID NO: 1392189 - DNA, 18 bp, Homo sapiens
actgttgagttggacaca

SEQ ID NO: 1392190 - DNA, 22 bp, Homo sapiens
actgttgagttggacacactgt

SEQ ID NO: 1392191 - DNA, 19 bp, Homo sapiens
actgtttttcggacagttt

SEQ ID NO: 1392192 - DNA, 18 bp, Homo sapiens
acttaccaggcaccaaaa

SEQ ID NO: 1392193 - DNA, 21 bp, Homo sapiens
acttattggaactctgcttga

SEQ ID NO: 1392194 - DNA, 19 bp, Homo sapiens
acttcaagcatggctattt

SEQ ID NO: 1392195 - DNA, 16 bp, Homo sapiens
acttcaaggaaaataa

SEQ ID NO: 1392196 - DNA, 14 bp, Homo sapiens
acttccaaactaat

SEQ ID NO: 1392197 - DNA, 20 bp, Homo sapiens
acttcctaaatattatgaga

SEQ ID NO: 1392198 - DNA, 24 bp, Homo sapiens
acttcctctaggaaatgtacgata

SEQ ID NO: 1392199 - DNA, 20 bp, Homo sapiens
acttctcattttttaaaaaa

SEQ ID NO: 1392200 - DNA, 17 bp, Homo sapiens
acttctgggcttcatct

SEQ ID NO: 1392201 - DNA, 20 bp, Homo sapiens
acttcttttgctcttagctg

SEQ ID NO: 1392202 - DNA, 14 bp, Homo sapiens
acttgacagtggaa

SEQ ID NO: 1392203 - DNA, 14 bp, Homo sapiens
acttgaccctgagc

SEQ ID NO: 1392204 - DNA, 15 bp, Homo sapiens
acttgaccctgagct

SEQ ID NO: 1392205 - DNA, 18 bp, Homo sapiens
acttgaccctgagctgac

SEQ ID NO: 1392206 - DNA, 20 bp, Homo sapiens
acttgagataatctaaatat

SEQ ID NO: 1392207 - DNA, 16 bp, Homo sapiens
acttggctgcaggaat

SEQ ID NO: 1392208 - DNA, 16 bp, Homo sapiens
acttggtaattgtact

SEQ ID NO: 1392209 - DNA, 14 bp, Homo sapiens
acttggttttgcta

SEQ ID NO: 1392210 - DNA, 14 bp, Homo sapiens
acttgtacaaaata

SEQ ID NO: 1392211 - DNA, 23 bp, Homo sapiens
acttgtcccgggacacctaggct

SEQ ID NO: 1392212 - DNA, 16 bp, Homo sapiens
acttgtctattacctg

SEQ ID NO: 1392213 - DNA, 22 bp, Homo sapiens
acttgtgtctctgtgcttttaa

SEQ ID NO: 1392214 - DNA, 12 bp, Homo sapiens
actttaaagcgt

SEQ ID NO: 1392215 - DNA, 19 bp, Homo sapiens
actttaatactcacctcct

SEQ ID NO: 1392216 - DNA, 14 bp, Homo sapiens
actttctattaata

SEQ ID NO: 1392217 - DNA, 13 bp, Homo sapiens
actttctcagttt

SEQ ID NO: 1392218 - DNA, 14 bp, Homo sapiens
actttgaagttagc

SEQ ID NO: 1392219 - DNA, 21 bp, Homo sapiens
actttgactttttgcatttaa

SEQ ID NO: 1392220 - DNA, 22 bp, Homo sapiens
actttgataaagtaaaaaagtt

SEQ ID NO: 1392221 - DNA, 12 bp, Homo sapiens
acttttaaacag

SEQ ID NO: 1392222 - DNA, 13 bp, Homo sapiens
acttttaaactgt

SEQ ID NO: 1392223 - DNA, 14 bp, Homo sapiens
acttttaaactgtg

SEQ ID NO: 1392224 - DNA, 15 bp, Homo sapiens
acttttaaactgtgt

SEQ ID NO: 1392225 - DNA, 17 bp, Homo sapiens
acttttcctccctcagt

SEQ ID NO: 1392226 - DNA, 22 bp, Homo sapiens
acttttgctgtaatgttaatat

SEQ ID NO: 1392227 - DNA, 18 bp, Homo sapiens
actttttaaatgtaaaga

SEQ ID NO: 1392228 - DNA, 13 bp, Homo sapiens
actttttgcattt

SEQ ID NO: 1392229 - DNA, 15 bp, Homo sapiens
acttttttatttaaa

SEQ ID NO: 1392230 - DNA, 23 bp, Homo sapiens
acttttttatttaaaaaactaaa

SEQ ID NO: 1392231 - DNA, 17 bp, Homo sapiens
acttttttctattttgt

SEQ ID NO: 1392232 - DNA, 19 bp, Homo sapiens
agaaaacttcaaggaaaat

SEQ ID NO: 1392233 - DNA, 16 bp, Homo sapiens
aggtcagcatgtctat

SEQ ID NO: 1392234 - DNA, 12 bp, Homo sapiens
aggtccctaata

SEQ ID NO: 1392235 - DNA, 13 bp, Homo sapiens
aggtccctaataa

SEQ ID NO: 1392236 - DNA, 17 bp, Homo sapiens
aggtccctaataaagct

SEQ ID NO: 1392237 - DNA, 18 bp, Homo sapiens
aggtccctaataaagctg

SEQ ID NO: 1392238 - DNA, 23 bp, Homo sapiens
aggtccctaataaagctgtgtgg

SEQ ID NO: 1392239 - DNA, 15 bp, Homo sapiens
aggtcctcagagaat

SEQ ID NO: 1392240 - DNA, 21 bp, Homo sapiens
aggtctgggagtgttctgttt

SEQ ID NO: 1392241 - DNA, 18 bp, Homo sapiens
aggtctttggttcagcta

SEQ ID NO: 1392242 - DNA, 21 bp, Homo sapiens
aggtgcttcaggataccatat

SEQ ID NO: 1392243 - DNA, 14 bp, Homo sapiens
aggtggccctactg

SEQ ID NO: 1392244 - DNA, 19 bp, Homo sapiens
aggtgtagccacaccagga

SEQ ID NO: 1392245 - DNA, 23 bp, Homo sapiens
aggttaaaatataaattaagact

SEQ ID NO: 1392246 - DNA, 15 bp, Homo sapiens
aggttacaagcctgc

SEQ ID NO: 1392247 - DNA, 21 bp, Homo sapiens
aggttacaagcctgcacaata

SEQ ID NO: 1392248 - DNA, 19 bp, Homo sapiens
aggtttttgtttgtttcct

SEQ ID NO: 1392249 - DNA, 14 bp, Homo sapiens
agtacaatgtttca

SEQ ID NO: 1392250 - DNA, 16 bp, Homo sapiens
agtacaatgtttcaga

SEQ ID NO: 1392251 - DNA, 12 bp, Homo sapiens
agtagaaatcat

SEQ ID NO: 1392252 - DNA, 22 bp, Homo sapiens
agtaggcatttttaccatcact

SEQ ID NO: 1392253 - DNA, 20 bp, Homo sapiens
agtatcatcagatagcatct

SEQ ID NO: 1392254 - DNA, 13 bp, Homo sapiens
agtatttgttaat

SEQ ID NO: 1392255 - DNA, 17 bp, Homo sapiens
agtattttgctggaata

SEQ ID NO: 1392256 - DNA, 18 bp, Homo sapiens
agtcaatcaagtctgttt

SEQ ID NO: 1392257 - DNA, 12 bp, Homo sapiens
agtcagaacagc

SEQ ID NO: 1392258 - DNA, 14 bp, Homo sapiens
agtccatcagcctc

SEQ ID NO: 1392259 - DNA, 20 bp, Homo sapiens
agtcctggaagccagctttc

SEQ ID NO: 1392260 - DNA, 18 bp, Homo sapiens
agtcgtacagaaagctgc

SEQ ID NO: 1392261 - DNA, 22 bp, Homo sapiens
agtctatcaaccccagacactg

SEQ ID NO: 1392262 - DNA, 20 bp, Homo sapiens
agtctgaacctatttcttaa

SEQ ID NO: 1392263 - DNA, 16 bp, Homo sapiens
agtctgagagaggcca

SEQ ID NO: 1392264 - DNA, 17 bp, Homo sapiens
agtctgtttactgcaag

SEQ ID NO: 1392265 - DNA, 22 bp, Homo sapiens
agtcttaatatatatatccaga

SEQ ID NO: 1392266 - DNA, 15 bp, Homo sapiens
agtcttcctgacact

SEQ ID NO: 1392267 - DNA, 17 bp, Homo sapiens
agtcttcctgacacttt

SEQ ID NO: 1392268 - DNA, 12 bp, Homo sapiens
agtgaagaatac

SEQ ID NO: 1392269 - DNA, 11 bp, Homo sapiens
agtgacagcta

SEQ ID NO: 1392270 - DNA, 21 bp, Homo sapiens
agtgaccataaaggcatggca

SEQ ID NO: 1392271 - DNA, 17 bp, Homo sapiens
agtgactaatggcatga

SEQ ID NO: 1392272 - DNA, 21 bp, Homo sapiens
agtgagagacattaactcatt

SEQ ID NO: 1392273 - DNA, 21 bp, Homo sapiens
agtgagcctgaattttgttgc

SEQ ID NO: 1392274 - DNA, 16 bp, Homo sapiens
agtgcacttgctggaa

SEQ ID NO: 1392275 - DNA, 18 bp, Homo sapiens
agtgcacttgctggaaga

SEQ ID NO: 1392276 - DNA, 15 bp, Homo sapiens
agtgcagcaaccaga

SEQ ID NO: 1392277 - DNA, 21 bp, Homo sapiens
agtgcagcaaccagagcactg

SEQ ID NO: 1392278 - DNA, 19 bp, Homo sapiens
agtgccttcctgtttttca

SEQ ID NO: 1392279 - DNA, 18 bp, Homo sapiens
agtgctgtgcaaggtatt

SEQ ID NO: 1392280 - DNA, 17 bp, Homo sapiens
agtgctgtgctgtgcta

SEQ ID NO: 1392281 - DNA, 14 bp, Homo sapiens
agtgcttaaaaatg

SEQ ID NO: 1392282 - DNA, 22 bp, Homo sapiens
agtggactggcctcaaagcaag

SEQ ID NO: 1392283 - DNA, 22 bp, Homo sapiens
agtgggagggtaccagcagaaa

SEQ ID NO: 1392284 - DNA, 12 bp, Homo sapiens
agtgggggtggg

SEQ ID NO: 1392285 - DNA, 22 bp, Homo sapiens
agtggtggcagtgcagcaacca

SEQ ID NO: 1392286 - DNA, 22 bp, Homo sapiens
agtgtgcgtggtggtccctggg

SEQ ID NO: 1392287 - DNA, 16 bp, Homo sapiens
agtgttgaaaatgttc

SEQ ID NO: 1392288 - DNA, 21 bp, Homo sapiens
agtgttttatgagaaagcctt

SEQ ID NO: 1392289 - DNA, 15 bp, Homo sapiens
agtgttttctctgaa

SEQ ID NO: 1392290 - DNA, 16 bp, Homo sapiens
agttaaatgtgtgtaa

SEQ ID NO: 1392291 - DNA, 19 bp, Homo sapiens
agttacagaaatgattact

SEQ ID NO: 1392292 - DNA, 22 bp, Homo sapiens
agttacataattcactctgagt

SEQ ID NO: 1392293 - DNA, 20 bp, Homo sapiens
agttagctttaacttaaata

SEQ ID NO: 1392294 - DNA, 21 bp, Homo sapiens
agttagctttaacttaaatag

SEQ ID NO: 1392295 - DNA, 21 bp, Homo sapiens
agttataagtagcaggccaag

SEQ ID NO: 1392296 - DNA, 21 bp, Homo sapiens
agttatttatttattggagat

SEQ ID NO: 1392297 - DNA, 18 bp, Homo sapiens
agttcaaattcttctgaa

SEQ ID NO: 1392298 - DNA, 19 bp, Homo sapiens
agttcaagaaataagtttt

SEQ ID NO: 1392299 - DNA, 22 bp, Homo sapiens
agttcattgtaaatgaacataa

SEQ ID NO: 1392300 - DNA, 13 bp, Homo sapiens
agttctgaaattt

SEQ ID NO: 1392301 - DNA, 14 bp, Homo sapiens
agttctgaaattta

SEQ ID NO: 1392302 - DNA, 20 bp, Homo sapiens
agttctgccaggagacaggt

SEQ ID NO: 1392303 - DNA, 16 bp, Homo sapiens
agttgaaaataaagtg

SEQ ID NO: 1392304 - DNA, 18 bp, Homo sapiens
agttgaaaataaagtgta

SEQ ID NO: 1392305 - DNA, 14 bp, Homo sapiens
agttgaagcaaatc

SEQ ID NO: 1392306 - DNA, 14 bp, Homo sapiens
agttgagacaagaa

SEQ ID NO: 1392307 - DNA, 21 bp, Homo sapiens
agttgataaagattttttaat

SEQ ID NO: 1392308 - DNA, 16 bp, Homo sapiens
agttgcacagctatga

SEQ ID NO: 1392309 - DNA, 19 bp, Homo sapiens
agttggagttttttgtacc

SEQ ID NO: 1392310 - DNA, 20 bp, Homo sapiens
agttggagttttttgtacca

SEQ ID NO: 1392311 - DNA, 21 bp, Homo sapiens
agttgtgtctggcagtttata

SEQ ID NO: 1392312 - DNA, 19 bp, Homo sapiens
agttgttccttaagtcaga

SEQ ID NO: 1392313 - DNA, 12 bp, Homo sapiens
agtttagggtgg

SEQ ID NO: 1392314 - DNA, 16 bp, Homo sapiens
agtttatatttaactc

SEQ ID NO: 1392315 - DNA, 19 bp, Homo sapiens
agtttatttgttgagagtg

SEQ ID NO: 1392316 - DNA, 16 bp, Homo sapiens
agtttcatataaagta

SEQ ID NO: 1392317 - DNA, 20 bp, Homo sapiens
agttttccatggcaggaagg

SEQ ID NO: 1392318 - DNA, 15 bp, Homo sapiens
agttttttgtaccaa

SEQ ID NO: 1392319 - DNA, 15 bp, Homo sapiens
ataaaacctcagcta

SEQ ID NO: 1392320 - DNA, 20 bp, Homo sapiens
ataaaccagctacttgatgt

SEQ ID NO: 1392321 - DNA, 22 bp, Homo sapiens
ataaaccagctacttgatgtaa

SEQ ID NO: 1392322 - DNA, 16 bp, Homo sapiens
ataaagattttttaat

SEQ ID NO: 1392323 - DNA, 21 bp, Homo sapiens
ataaagattttttaataattt

SEQ ID NO: 1392324 - DNA, 17 bp, Homo sapiens
ataaagtaaaaaagtta

SEQ ID NO: 1392325 - DNA, 22 bp, Homo sapiens
ataaagtaaaaaagttaaatgt

SEQ ID NO: 1392326 - DNA, 14 bp, Homo sapiens
ataaattaagactt

SEQ ID NO: 1392327 - DNA, 15 bp, Homo sapiens
ataaattaagacttt

SEQ ID NO: 1392328 - DNA, 14 bp, Homo sapiens
ataaccttaattta

SEQ ID NO: 1392329 - DNA, 17 bp, Homo sapiens
ataacgtttaagccaaa

SEQ ID NO: 1392330 - DNA, 13 bp, Homo sapiens
ataactgaaaatg

SEQ ID NO: 1392331 - DNA, 15 bp, Homo sapiens
ataactgaaaatgtg

SEQ ID NO: 1392332 - DNA, 17 bp, Homo sapiens
ataactgaaaattattt

SEQ ID NO: 1392333 - DNA, 21 bp, Homo sapiens
ataagaaacttttttatttaa

SEQ ID NO: 1392334 - DNA, 19 bp, Homo sapiens
ataagaaagccctaaaata

SEQ ID NO: 1392335 - DNA, 20 bp, Homo sapiens
ataagaagaatgcttaatca

SEQ ID NO: 1392336 - DNA, 15 bp, Homo sapiens
ataagagctcaggat

SEQ ID NO: 1392337 - DNA, 13 bp, Homo sapiens
ataagatctttta

SEQ ID NO: 1392338 - DNA, 20 bp, Homo sapiens
ataagatcttttattttgcc

SEQ ID NO: 1392339 - DNA, 14 bp, Homo sapiens
ataagcttttcttt

SEQ ID NO: 1392340 - DNA, 24 bp, Homo sapiens
ataaggaaatcaacttgcttatca

SEQ ID NO: 1392341 - DNA, 13 bp, Homo sapiens
ataagtgaaattt

SEQ ID NO: 1392342 - DNA, 20 bp, Homo sapiens
ataagtgaaattttaaaagt

SEQ ID NO: 1392343 - DNA, 22 bp, Homo sapiens
ataagtgaaattttaaaagtca

SEQ ID NO: 1392344 - DNA, 20 bp, Homo sapiens
ataagttcaaattcttctga

SEQ ID NO: 1392345 - DNA, 22 bp, Homo sapiens
ataatactgctgagatacatac

SEQ ID NO: 1392346 - DNA, 14 bp, Homo sapiens
ataatatgtttgag

SEQ ID NO: 1392347 - DNA, 22 bp, Homo sapiens
ataatatgtttgaggttaaaat

SEQ ID NO: 1392348 - DNA, 16 bp, Homo sapiens
ataatcacgctttcct

SEQ ID NO: 1392349 - DNA, 18 bp, Homo sapiens
ataatcacgctttcctga

SEQ ID NO: 1392350 - DNA, 21 bp, Homo sapiens
ataatcattattacttttgct

SEQ ID NO: 1392351 - DNA, 22 bp, Homo sapiens
ataatcattattacttttgctg

SEQ ID NO: 1392352 - DNA, 14 bp, Homo sapiens
ataatcttctgcct

SEQ ID NO: 1392353 - DNA, 20 bp, Homo sapiens
ataatcttctgccttctcat

SEQ ID NO: 1392354 - DNA, 17 bp, Homo sapiens
ataatgaacagaacata

SEQ ID NO: 1392355 - DNA, 16 bp, Homo sapiens
ataatgaacagaattt

SEQ ID NO: 1392356 - DNA, 18 bp, Homo sapiens
ataatgaacagaatttat

SEQ ID NO: 1392357 - DNA, 19 bp, Homo sapiens
ataatgaacagaatttatg

SEQ ID NO: 1392358 - DNA, 20 bp, Homo sapiens
ataatgaacagaatttatga

SEQ ID NO: 1392359 - DNA, 20 bp, Homo sapiens
ataatttagtttcatataaa

SEQ ID NO: 1392360 - DNA, 14 bp, Homo sapiens
atacactcctgctg

SEQ ID NO: 1392361 - DNA, 22 bp, Homo sapiens
atacacttattggaactctgct

SEQ ID NO: 1392362 - DNA, 20 bp, Homo sapiens
atacagaattactgtaactg

SEQ ID NO: 1392363 - DNA, 18 bp, Homo sapiens
atacatgctaagagaagt

SEQ ID NO: 1392364 - DNA, 16 bp, Homo sapiens
ataccccgtgaagcat

SEQ ID NO: 1392365 - DNA, 21 bp, Homo sapiens
atacctaagaagtacattgtt

SEQ ID NO: 1392366 - DNA, 15 bp, Homo sapiens
atgactgccaagact

SEQ ID NO: 1392367 - DNA, 19 bp, Homo sapiens
atgactgtttttcggacag

SEQ ID NO: 1392368 - DNA, 21 bp, Homo sapiens
atgactgtttttcggacagtt

SEQ ID NO: 1392369 - DNA, 14 bp, Homo sapiens
atgagaaagccttc

SEQ ID NO: 1392370 - DNA, 15 bp, Homo sapiens
atgagaaatacaaaa

SEQ ID NO: 1392371 - DNA, 14 bp, Homo sapiens
atgagatgctggct

SEQ ID NO: 1392372 - DNA, 19 bp, Homo sapiens
atgagatgctggcttgggc

SEQ ID NO: 1392373 - DNA, 13 bp, Homo sapiens
atgagggaaaaga

SEQ ID NO: 1392374 - DNA, 12 bp, Homo sapiens
atgataatgaac

SEQ ID NO: 1392375 - DNA, 21 bp, Homo sapiens
atgatccaactaatgccttac

SEQ ID NO: 1392376 - DNA, 20 bp, Homo sapiens
atgatcctgtattcagacag

SEQ ID NO: 1392377 - DNA, 19 bp, Homo sapiens
atgatggcaattttgtaac

SEQ ID NO: 1392378 - DNA, 22 bp, Homo sapiens
atgatgttaaaaaaataagaag

SEQ ID NO: 1392379 - DNA, 14 bp, Homo sapiens
atgatttcagtagc

SEQ ID NO: 1392380 - DNA, 21 bp, Homo sapiens
atgatttcatgctatctctgt

SEQ ID NO: 1392381 - DNA, 14 bp, Homo sapiens
atgcaaaccatagc

SEQ ID NO: 1392382 - DNA, 14 bp, Homo sapiens
atgcacctaaagaa

SEQ ID NO: 1392383 - DNA, 18 bp, Homo sapiens
atgcacctaaagaaaaac

SEQ ID NO: 1392384 - DNA, 14 bp, Homo sapiens
atgcataaatgcat

SEQ ID NO: 1392385 - DNA, 12 bp, Homo sapiens
atgcatctgttt

SEQ ID NO: 1392386 - DNA, 19 bp, Homo sapiens
atgcatttgggtccaggag

SEQ ID NO: 1392387 - DNA, 22 bp, Homo sapiens
atgcatttgggtccaggaggaa

SEQ ID NO: 1392388 - DNA, 16 bp, Homo sapiens
atgccaaaaacaaaat

SEQ ID NO: 1392389 - DNA, 14 bp, Homo sapiens
atgccatgatgcct

SEQ ID NO: 1392390 - DNA, 21 bp, Homo sapiens
atgccttttcccaaaatgttg

SEQ ID NO: 1392391 - DNA, 17 bp, Homo sapiens
atgcgtgtttctgactc

SEQ ID NO: 1392392 - DNA, 15 bp, Homo sapiens
atgctatcaaataac

SEQ ID NO: 1392393 - DNA, 16 bp, Homo sapiens
atgctctacttctttt

SEQ ID NO: 1392394 - DNA, 13 bp, Homo sapiens
atgcttactgata

SEQ ID NO: 1392395 - DNA, 22 bp, Homo sapiens
atgcttactgatatattttaca

SEQ ID NO: 1392396 - DNA, 16 bp, Homo sapiens
atgcttgcaaaaacta

SEQ ID NO: 1392397 - DNA, 17 bp, Homo sapiens
atgctttgaaacagaaa

SEQ ID NO: 1392398 - DNA, 19 bp, Homo sapiens
atggaaagcttcagtgctg

SEQ ID NO: 1392399 - DNA, 18 bp, Homo sapiens
atggaaattctgctcaga

SEQ ID NO: 1392400 - DNA, 23 bp, Homo sapiens
atggagacttcaggttgttctgt

SEQ ID NO: 1392401 - DNA, 15 bp, Homo sapiens
atggagtcttgctct

SEQ ID NO: 1392402 - DNA, 16 bp, Homo sapiens
atggagtgtacaagta

SEQ ID NO: 1392403 - DNA, 12 bp, Homo sapiens
atggattctaaa

SEQ ID NO: 1392404 - DNA, 15 bp, Homo sapiens
atggattctaaaatg

SEQ ID NO: 1392405 - DNA, 16 bp, Homo sapiens
atggcaaccattataa

SEQ ID NO: 1392406 - DNA, 15 bp, Homo sapiens
atggcaattttgtaa

SEQ ID NO: 1392407 - DNA, 16 bp, Homo sapiens
atggcaattttgtaac

SEQ ID NO: 1392408 - DNA, 13 bp, Homo sapiens
atggcagaaaagt

SEQ ID NO: 1392409 - DNA, 18 bp, Homo sapiens
atggcatgagaaatacaa

SEQ ID NO: 1392410 - DNA, 13 bp, Homo sapiens
atggctattttat

SEQ ID NO: 1392411 - DNA, 17 bp, Homo sapiens
atggctttgtgattcaa

SEQ ID NO: 1392412 - DNA, 20 bp, Homo sapiens
atgggagctggttagaaatg

SEQ ID NO: 1392413 - DNA, 22 bp, Homo sapiens
atgggagctggttagaaatgca

SEQ ID NO: 1392414 - DNA, 16 bp, Homo sapiens
atggtgccttcatttg

SEQ ID NO: 1392415 - DNA, 14 bp, Homo sapiens
atgtaaagccatgc

SEQ ID NO: 1392416 - DNA, 15 bp, Homo sapiens
atgtaaatattttaa

SEQ ID NO: 1392417 - DNA, 20 bp, Homo sapiens
atgtaaatattttaaagaat

SEQ ID NO: 1392418 - DNA, 23 bp, Homo sapiens
atgtaaatattttaaagaattgt

SEQ ID NO: 1392419 - DNA, 20 bp, Homo sapiens
atgtaactgagaatttgtgt

SEQ ID NO: 1392420 - DNA, 16 bp, Homo sapiens
atgtatagtaaatcac

SEQ ID NO: 1392421 - DNA, 11 bp, Homo sapiens
atgtatcacta

SEQ ID NO: 1392422 - DNA, 22 bp, Homo sapiens
atgtcaagggttcaagattgtt

SEQ ID NO: 1392423 - DNA, 13 bp, Homo sapiens
atgtcctgtaaag

SEQ ID NO: 1392424 - DNA, 14 bp, Homo sapiens
atgtcctgtaaagg

SEQ ID NO: 1392425 - DNA, 14 bp, Homo sapiens
atgtctattcagct

SEQ ID NO: 1392426 - DNA, 17 bp, Homo sapiens
atgtgcattctccagcc

SEQ ID NO: 1392427 - DNA, 18 bp, Homo sapiens
atgtgctatactgcatac

SEQ ID NO: 1392428 - DNA, 18 bp, Homo sapiens
atgtggcccctgaacaag

SEQ ID NO: 1392429 - DNA, 17 bp, Homo sapiens
atgtgtttactttatgt

SEQ ID NO: 1392430 - DNA, 19 bp, Homo sapiens
atgtgttttaataaacgtt

SEQ ID NO: 1392431 - DNA, 20 bp, Homo sapiens
atgttaagacttgacagtgg

SEQ ID NO: 1392432 - DNA, 17 bp, Homo sapiens
atgttactacatgcact

SEQ ID NO: 1392433 - DNA, 15 bp, Homo sapiens
atgttatttgtaata

SEQ ID NO: 1392434 - DNA, 23 bp, Homo sapiens
atgttcagaaggttgctctagat

SEQ ID NO: 1392435 - DNA, 21 bp, Homo sapiens
atgttctccttagatgtgaga

SEQ ID NO: 1392436 - DNA, 22 bp, Homo sapiens
atgttgaaatatgatgttaaaa

SEQ ID NO: 1392437 - DNA, 21 bp, Homo sapiens
atgtttgcacctttctagttg

SEQ ID NO: 1392438 - DNA, 22 bp, Homo sapiens
atgtttgcacctttctagttga

SEQ ID NO: 1392439 - DNA, 23 bp, Homo sapiens
atgttttggccaatgcacctaaa

SEQ ID NO: 1392440 - DNA, 13 bp, Homo sapiens
atgtttttaatgt

SEQ ID NO: 1392441 - DNA, 19 bp, Homo sapiens
atgtttttaatgtatagta

SEQ ID NO: 1392442 - DNA, 16 bp, Homo sapiens
attaaaattaaggtct

SEQ ID NO: 1392443 - DNA, 19 bp, Homo sapiens
attaaacaggtggttcttt

SEQ ID NO: 1392444 - DNA, 20 bp, Homo sapiens
attaaagaagggttgagctg

SEQ ID NO: 1392445 - DNA, 15 bp, Homo sapiens
attaaagcatttaga

SEQ ID NO: 1392446 - DNA, 19 bp, Homo sapiens
attaacaattaggcagact

SEQ ID NO: 1392447 - DNA, 12 bp, Homo sapiens
attaacatacct

SEQ ID NO: 1392448 - DNA, 23 bp, Homo sapiens
attaacatacctaagaagtacat

SEQ ID NO: 1392449 - DNA, 14 bp, Homo sapiens
attaagatacactc

SEQ ID NO: 1392450 - DNA, 18 bp, Homo sapiens
attaagatacactcctgc

SEQ ID NO: 1392451 - DNA, 12 bp, Homo sapiens
attaagggacat

SEQ ID NO: 1392452 - DNA, 16 bp, Homo sapiens
attaatttatgcagaa

SEQ ID NO: 1392453 - DNA, 14 bp, Homo sapiens
attacacccaaaga

SEQ ID NO: 1392454 - DNA, 17 bp, Homo sapiens
attacacccaaatattg

SEQ ID NO: 1392455 - DNA, 22 bp, Homo sapiens
attacaggcgtgagccacctcg

SEQ ID NO: 1392456 - DNA, 20 bp, Homo sapiens
attactgccattcacttcat

SEQ ID NO: 1392457 - DNA, 15 bp, Homo sapiens
attacttatttttga

SEQ ID NO: 1392458 - DNA, 14 bp, Homo sapiens
attacttttgctgt

SEQ ID NO: 1392459 - DNA, 15 bp, Homo sapiens
attagactggacagc

SEQ ID NO: 1392460 - DNA, 21 bp, Homo sapiens
attagagggaggagaatgagc

SEQ ID NO: 1392461 - DNA, 22 bp, Homo sapiens
attagcaattgactgtcactgt

SEQ ID NO: 1392462 - DNA, 15 bp, Homo sapiens
attagcacctctttt

SEQ ID NO: 1392463 - DNA, 19 bp, Homo sapiens
attagtacacagcaccaga

SEQ ID NO: 1392464 - DNA, 17 bp, Homo sapiens
attataggatcatttgt

SEQ ID NO: 1392465 - DNA, 23 bp, Homo sapiens
attatcttttcatacattttcta

SEQ ID NO: 1392466 - DNA, 14 bp, Homo sapiens
attattacttttgc

SEQ ID NO: 1392467 - DNA, 18 bp, Homo sapiens
attattgttgcattaaaa

SEQ ID NO: 1392468 - DNA, 11 bp, Homo sapiens
attcaaaacat

SEQ ID NO: 1392469 - DNA, 13 bp, Homo sapiens
attcaacaaacat

SEQ ID NO: 1392470 - DNA, 14 bp, Homo sapiens
attcaatctgtaaa

SEQ ID NO: 1392471 - DNA, 18 bp, Homo sapiens
attcacatcgcagattct

SEQ ID NO: 1392472 - DNA, 16 bp, Homo sapiens
attcacatctcatttt

SEQ ID NO: 1392473 - DNA, 13 bp, Homo sapiens
attcagacagatg

SEQ ID NO: 1392474 - DNA, 20 bp, Homo sapiens
attcagacagatgaggcttt

SEQ ID NO: 1392475 - DNA, 21 bp, Homo sapiens
attcattcttaacaagatatt

SEQ ID NO: 1392476 - DNA, 19 bp, Homo sapiens
attccaactcgtatagcat

SEQ ID NO: 1392477 - DNA, 23 bp, Homo sapiens
attccaactcgtatagcatgcat

SEQ ID NO: 1392478 - DNA, 16 bp, Homo sapiens
attccccatctcaggc

SEQ ID NO: 1392479 - DNA, 14 bp, Homo sapiens
attccccattcttc

SEQ ID NO: 1392480 - DNA, 16 bp, Homo sapiens
attcgaatgacactgt

SEQ ID NO: 1392481 - DNA, 15 bp, Homo sapiens
attctcccttgctct

SEQ ID NO: 1392482 - DNA, 14 bp, Homo sapiens
attctgtcttgaag

SEQ ID NO: 1392483 - DNA, 15 bp, Homo sapiens
attcttccatctgat

SEQ ID NO: 1392484 - DNA, 12 bp, Homo sapiens
attcttcctagt

SEQ ID NO: 1392485 - DNA, 13 bp, Homo sapiens
attcttctgaact

SEQ ID NO: 1392486 - DNA, 21 bp, Homo sapiens
attcttctgaactcaaactga

SEQ ID NO: 1392487 - DNA, 19 bp, Homo sapiens
attctttcccaacacctct

SEQ ID NO: 1392488 - DNA, 21 bp, Homo sapiens
attgaatggctatgtttttaa

SEQ ID NO: 1392489 - DNA, 23 bp, Homo sapiens
attgaatggctatgtttttaatg

SEQ ID NO: 1392490 - DNA, 17 bp, Homo sapiens
attgataagatctttta

SEQ ID NO: 1392491 - DNA, 13 bp, Homo sapiens
attgattttgaac

SEQ ID NO: 1392492 - DNA, 12 bp, Homo sapiens
attgatttttgg

SEQ ID NO: 1392493 - DNA, 17 bp, Homo sapiens
attggacaaagaacctt

SEQ ID NO: 1392494 - DNA, 16 bp, Homo sapiens
attggggaagagagcc

SEQ ID NO: 1392495 - DNA, 22 bp, Homo sapiens
attggggaagagagcctgcagg

SEQ ID NO: 1392496 - DNA, 13 bp, Homo sapiens
attgtaaatgaac

SEQ ID NO: 1392497 - DNA, 18 bp, Homo sapiens
attgtaaccctgtctgga

SEQ ID NO: 1392498 - DNA, 21 bp, Homo sapiens
attgtactaaagccaaacata

SEQ ID NO: 1392499 - DNA, 20 bp, Homo sapiens
attgtgcaatgtaaatattt

SEQ ID NO: 1392500 - DNA, 12 bp, Homo sapiens
attgttgcatta

SEQ ID NO: 1392501 - DNA, 15 bp, Homo sapiens
atttaaaacagacac

SEQ ID NO: 1392502 - DNA, 15 bp, Homo sapiens
atttaaaatagcaaa

SEQ ID NO: 1392503 - DNA, 18 bp, Homo sapiens
atttaaaatagcaaaaga

SEQ ID NO: 1392504 - DNA, 20 bp, Homo sapiens
atttaaaatagcaaaagaag

SEQ ID NO: 1392505 - DNA, 21 bp, Homo sapiens
atttaaaatagcaaaagaaga

SEQ ID NO: 1392506 - DNA, 22 bp, Homo sapiens
atttaaaatagcaaaagaagaa

SEQ ID NO: 1392507 - DNA, 23 bp, Homo sapiens
atttaaaatagcaaaagaagaag

SEQ ID NO: 1392508 - DNA, 16 bp, Homo sapiens
atttaaacaaatgtgt

SEQ ID NO: 1392509 - DNA, 19 bp, Homo sapiens
atttaaaccgctaaaagaa

SEQ ID NO: 1392510 - DNA, 20 bp, Homo sapiens
atttaaaccgctaaaagaaa

SEQ ID NO: 1392511 - DNA, 21 bp, Homo sapiens
atttaaaccgctaaaagaaac

SEQ ID NO: 1392512 - DNA, 23 bp, Homo sapiens
atttaaaccgctaaaagaaactt

SEQ ID NO: 1392513 - DNA, 19 bp, Homo sapiens
atttaaactataagcaaga

SEQ ID NO: 1392514 - DNA, 21 bp, Homo sapiens
atttaacagaagttgtgaaac

SEQ ID NO: 1392515 - DNA, 20 bp, Homo sapiens
atttagccctggtttgaaat

SEQ ID NO: 1392516 - DNA, 14 bp, Homo sapiens
atttaggtttctga

SEQ ID NO: 1392517 - DNA, 23 bp, Homo sapiens
atttaggtttctgagttcctgca

SEQ ID NO: 1392518 - DNA, 23 bp, Homo sapiens
atttaggtttttgtttgtttcct

SEQ ID NO: 1392519 - DNA, 20 bp, Homo sapiens
atttatatgttattaaacag

SEQ ID NO: 1392520 - DNA, 23 bp, Homo sapiens
atttatatgttattaaacaggtg

SEQ ID NO: 1392521 - DNA, 21 bp, Homo sapiens
atttatattgataagatcttt

SEQ ID NO: 1392522 - DNA, 12 bp, Homo sapiens
atttatgtgttt

SEQ ID NO: 1392523 - DNA, 19 bp, Homo sapiens
atttatgtgttttaataaa

SEQ ID NO: 1392524 - DNA, 13 bp, Homo sapiens
atttattttgaca

SEQ ID NO: 1392525 - DNA, 23 bp, Homo sapiens
atttcaagttccaagttgctaat

SEQ ID NO: 1392526 - DNA, 22 bp, Homo sapiens
atttcagagaggccttttggaa

SEQ ID NO: 1392527 - DNA, 18 bp, Homo sapiens
atttcagattcccagagc

SEQ ID NO: 1392528 - DNA, 13 bp, Homo sapiens
atttcatctattt

SEQ ID NO: 1392529 - DNA, 18 bp, Homo sapiens
atttcatgctatctctgt

SEQ ID NO: 1392530 - DNA, 16 bp, Homo sapiens
atttcccttccttcct

SEQ ID NO: 1392531 - DNA, 18 bp, Homo sapiens
atttctaccatttcagag

SEQ ID NO: 1392532 - DNA, 16 bp, Homo sapiens
atttctagcttatcta

SEQ ID NO: 1392533 - DNA, 18 bp, Homo sapiens
atttctagcttatctact

SEQ ID NO: 1392534 - DNA, 21 bp, Homo sapiens
atttctagcttatctacttcc

SEQ ID NO: 1392535 - DNA, 23 bp, Homo sapiens
atttctatagccaaaaatagcta

SEQ ID NO: 1392536 - DNA, 22 bp, Homo sapiens
atttcttttttaaatgaagaaa

SEQ ID NO: 1392537 - DNA, 13 bp, Homo sapiens
atttgaagtgtaa

SEQ ID NO: 1392538 - DNA, 18 bp, Homo sapiens
atttgagagaaatatgaa

SEQ ID NO: 1392539 - DNA, 15 bp, Homo sapiens
atttgcctgtaacaa

SEQ ID NO: 1392540 - DNA, 22 bp, Homo sapiens
atttgcctgtaacaagccagat

SEQ ID NO: 1392541 - DNA, 15 bp, Homo sapiens
atttgggtccaggag

SEQ ID NO: 1392542 - DNA, 17 bp, Homo sapiens
atttgggtccaggagga

SEQ ID NO: 1392543 - DNA, 14 bp, Homo sapiens
atttgtgacaaaaa

SEQ ID NO: 1392544 - DNA, 18 bp, Homo sapiens
atttgtgtggatatttat

SEQ ID NO: 1392545 - DNA, 19 bp, Homo sapiens
atttgttaatttagaaaac

SEQ ID NO: 1392546 - DNA, 13 bp, Homo sapiens
atttgttgagagt

SEQ ID NO: 1392547 - DNA, 15 bp, Homo sapiens
atttgttggaatgaa

SEQ ID NO: 1392548 - DNA, 17 bp, Homo sapiens
attttaaagaattgtgt

SEQ ID NO: 1392549 - DNA, 23 bp, Homo sapiens
attttaaccagttatttttatta

SEQ ID NO: 1392550 - DNA, 23 bp, Homo sapiens
attttatatgcttactgatatat

SEQ ID NO: 1392551 - DNA, 22 bp, Homo sapiens
attttatgttaagggaagaatt

SEQ ID NO: 1392552 - DNA, 22 bp, Homo sapiens
attttcaaagctttttccagag

SEQ ID NO: 1392553 - DNA, 13 bp, Homo sapiens
attttcaagaaac

SEQ ID NO: 1392554 - DNA, 17 bp, Homo sapiens
attttcagcaaactctt

SEQ ID NO: 1392555 - DNA, 16 bp, Homo sapiens
attttccattacatga

SEQ ID NO: 1392556 - DNA, 14 bp, Homo sapiens
attttccttttcaa

SEQ ID NO: 1392557 - DNA, 18 bp, Homo sapiens
attttctgtgcctgaata

SEQ ID NO: 1392558 - DNA, 20 bp, Homo sapiens
attttctgtgcctgaatatt

SEQ ID NO: 1392559 - DNA, 22 bp, Homo sapiens
attttgaacctgatgaaaataa

SEQ ID NO: 1392560 - DNA, 14 bp, Homo sapiens
attttgctggaata

SEQ ID NO: 1392561 - DNA, 20 bp, Homo sapiens
attttgtaaactcaaaatat

SEQ ID NO: 1392562 - DNA, 18 bp, Homo sapiens
attttgtaacgaagacac

SEQ ID NO: 1392563 - DNA, 17 bp, Homo sapiens
attttgttagattttgc

SEQ ID NO: 1392564 - DNA, 13 bp, Homo sapiens
atttttaaacaag

SEQ ID NO: 1392565 - DNA, 14 bp, Homo sapiens
atttttattattga

SEQ ID NO: 1392566 - DNA, 21 bp, Homo sapiens
atttttgcctcttccagtctt

SEQ ID NO: 1392567 - DNA, 14 bp, Homo sapiens
attttttaaaaaag

SEQ ID NO: 1392568 - DNA, 17 bp, Homo sapiens
attttttaaaaaagctt

SEQ ID NO: 1392569 - DNA, 18 bp, Homo sapiens
attttttaaaaaagctta

SEQ ID NO: 1392570 - DNA, 20 bp, Homo sapiens
attttttaaaaaagcttaaa

SEQ ID NO: 1392571 - DNA, 14 bp, Homo sapiens
atttttttatacta

SEQ ID NO: 1392572 - DNA, 18 bp, Homo sapiens
attttttttaagtattta

SEQ ID NO: 1392573 - DNA, 14 bp, Homo sapiens
atttttttttcata

SEQ ID NO: 1392574 - DNA, 16 bp, Homo sapiens
atttttttttcataca

SEQ ID NO: 1392575 - DNA, 19 bp, Homo sapiens
atttttttttcatacactt

SEQ ID NO: 1392576 - DNA, 17 bp, Homo sapiens
atttttttttcctagcc

SEQ ID NO: 1392577 - DNA, 14 bp, Homo sapiens
caaaaaaaaataca

SEQ ID NO: 1392578 - DNA, 16 bp, Homo sapiens
caaaacaatgtttaaa

SEQ ID NO: 1392579 - DNA, 17 bp, Homo sapiens
caaaagaagtaaaagca

SEQ ID NO: 1392580 - DNA, 19 bp, Homo sapiens
caaaagaagtaaaagcaaa

SEQ ID NO: 1392581 - DNA, 20 bp, Homo sapiens
caaaagaatggcagaaaagt

SEQ ID NO: 1392582 - DNA, 19 bp, Homo sapiens
caaaagattgctgaaattt

SEQ ID NO: 1392583 - DNA, 20 bp, Homo sapiens
caaaagattgctgaaatttt

SEQ ID NO: 1392584 - DNA, 13 bp, Homo sapiens
caaaagcttttta

SEQ ID NO: 1392585 - DNA, 19 bp, Homo sapiens
caaaagggccaaagaacca

SEQ ID NO: 1392586 - DNA, 18 bp, Homo sapiens
caaaagttacatgtttgc

SEQ ID NO: 1392587 - DNA, 16 bp, Homo sapiens
caaaatatttgtacat

SEQ ID NO: 1392588 - DNA, 16 bp, Homo sapiens
caaaatccttgcttat

SEQ ID NO: 1392589 - DNA, 18 bp, Homo sapiens
caaaatgttggtcatttt

SEQ ID NO: 1392590 - DNA, 18 bp, Homo sapiens
caaacaccaacataaaaa

SEQ ID NO: 1392591 - DNA, 15 bp, Homo sapiens
caaacaggctcagag

SEQ ID NO: 1392592 - DNA, 19 bp, Homo sapiens
caaactcctgacctcaggc

SEQ ID NO: 1392593 - DNA, 16 bp, Homo sapiens
caaactcctgcctgtg

SEQ ID NO: 1392594 - DNA, 14 bp, Homo sapiens
caaactgtaataca

SEQ ID NO: 1392595 - DNA, 13 bp, Homo sapiens
caaagaggtattt

SEQ ID NO: 1392596 - DNA, 17 bp, Homo sapiens
caaagagttcaagaaat

SEQ ID NO: 1392597 - DNA, 15 bp, Homo sapiens
caaagcccttttata

SEQ ID NO: 1392598 - DNA, 15 bp, Homo sapiens
caaaggttgagatgt

SEQ ID NO: 1392599 - DNA, 11 bp, Homo sapiens
caaaggttttc

SEQ ID NO: 1392600 - DNA, 18 bp, Homo sapiens
caaagtgttttctctgaa

SEQ ID NO: 1392601 - DNA, 13 bp, Homo sapiens
caaagtttaataa

SEQ ID NO: 1392602 - DNA, 23 bp, Homo sapiens
caaatattgtgcacatttaataa

SEQ ID NO: 1392603 - DNA, 15 bp, Homo sapiens
caaatatttattttc

SEQ ID NO: 1392604 - DNA, 16 bp, Homo sapiens
caaatatttattttct

SEQ ID NO: 1392605 - DNA, 20 bp, Homo sapiens
caaatcaccacaaactgtaa

SEQ ID NO: 1392606 - DNA, 17 bp, Homo sapiens
caaatccttagatctgg

SEQ ID NO: 1392607 - DNA, 18 bp, Homo sapiens
caacaacctcaactgcct

SEQ ID NO: 1392608 - DNA, 20 bp, Homo sapiens
caacaagaagggactgagag

SEQ ID NO: 1392609 - DNA, 16 bp, Homo sapiens
caacaatttatgaatt

SEQ ID NO: 1392610 - DNA, 17 bp, Homo sapiens
caacaatttatgaattg

SEQ ID NO: 1392611 - DNA, 18 bp, Homo sapiens
caacacctcttggggagt

SEQ ID NO: 1392612 - DNA, 12 bp, Homo sapiens
caacagttttcc

SEQ ID NO: 1392613 - DNA, 19 bp, Homo sapiens
caacatctttttcctccct

SEQ ID NO: 1392614 - DNA, 15 bp, Homo sapiens
caacatgttatttgt

SEQ ID NO: 1392615 - DNA, 22 bp, Homo sapiens
caacatgttatttgtaatagat

SEQ ID NO: 1392616 - DNA, 23 bp, Homo sapiens
caacatgttatttgtaatagatg

SEQ ID NO: 1392617 - DNA, 13 bp, Homo sapiens
caaccagagcact

SEQ ID NO: 1392618 - DNA, 15 bp, Homo sapiens
caaccagagcactgt

SEQ ID NO: 1392619 - DNA, 13 bp, Homo sapiens
caaccatcgcttt

SEQ ID NO: 1392620 - DNA, 16 bp, Homo sapiens
caaccattccagactg

SEQ ID NO: 1392621 - DNA, 17 bp, Homo sapiens
caaccatttcctcagac

SEQ ID NO: 1392622 - DNA, 15 bp, Homo sapiens
caacctcagtaattt

SEQ ID NO: 1392623 - DNA, 20 bp, Homo sapiens
caacctgttacctactttga

SEQ ID NO: 1392624 - DNA, 22 bp, Homo sapiens
caacctgttacctactttgact

SEQ ID NO: 1392625 - DNA, 15 bp, Homo sapiens
caactacagtctaaa

SEQ ID NO: 1392626 - DNA, 19 bp, Homo sapiens
caactacagtctaaagctg

SEQ ID NO: 1392627 - DNA, 14 bp, Homo sapiens
caactcgctttagg

SEQ ID NO: 1392628 - DNA, 13 bp, Homo sapiens
caactctcttatt

SEQ ID NO: 1392629 - DNA, 16 bp, Homo sapiens
caactctcttattgcc

SEQ ID NO: 1392630 - DNA, 21 bp, Homo sapiens
caactctcttattgcctcact

SEQ ID NO: 1392631 - DNA, 22 bp, Homo sapiens
caactgcctactccaaaatgtt

SEQ ID NO: 1392632 - DNA, 12 bp, Homo sapiens
caactggcaggc

SEQ ID NO: 1392633 - DNA, 20 bp, Homo sapiens
caacttttcctttgaatcct

SEQ ID NO: 1392634 - DNA, 22 bp, Homo sapiens
atactattaaaaaggtttacag

SEQ ID NO: 1392635 - DNA, 13 bp, Homo sapiens
atactcacctcct

SEQ ID NO: 1392636 - DNA, 15 bp, Homo sapiens
atactcacctcctcc

SEQ ID NO: 1392637 - DNA, 21 bp, Homo sapiens
atactgcatactttttaaatg

SEQ ID NO: 1392638 - DNA, 19 bp, Homo sapiens
atactgctgagatacatac

SEQ ID NO: 1392639 - DNA, 10 bp, Homo sapiens
atactgcttg

SEQ ID NO: 1392640 - DNA, 15 bp, Homo sapiens
atactgcttggagct

SEQ ID NO: 1392641 - DNA, 20 bp, Homo sapiens
atactgcttggagctgagca

SEQ ID NO: 1392642 - DNA, 21 bp, Homo sapiens
atacttttacaagtaacaaaa

SEQ ID NO: 1392643 - DNA, 19 bp, Homo sapiens
atacttttttctattttgt

SEQ ID NO: 1392644 - DNA, 12 bp, Homo sapiens
atagaaatgcca

SEQ ID NO: 1392645 - DNA, 16 bp, Homo sapiens
atagaaatgccaagca

SEQ ID NO: 1392646 - DNA, 18 bp, Homo sapiens
atagacagaagaaacaag

SEQ ID NO: 1392647 - DNA, 12 bp, Homo sapiens
atagatgtttga

SEQ ID NO: 1392648 - DNA, 17 bp, Homo sapiens
atagcaaaagaagaagt

SEQ ID NO: 1392649 - DNA, 18 bp, Homo sapiens
atagcaaaagaagaagtt

SEQ ID NO: 1392650 - DNA, 19 bp, Homo sapiens
atagcaaaagaagaagttt

SEQ ID NO: 1392651 - DNA, 15 bp, Homo sapiens
atagccaaaaatagc

SEQ ID NO: 1392652 - DNA, 16 bp, Homo sapiens
atagccaaaaatagct

SEQ ID NO: 1392653 - DNA, 14 bp, Homo sapiens
atagctgatcagtt

SEQ ID NO: 1392654 - DNA, 23 bp, Homo sapiens
ataggatcatttgttggaatgaa

SEQ ID NO: 1392655 - DNA, 22 bp, Homo sapiens
ataggatttatttaaaatagca

SEQ ID NO: 1392656 - DNA, 23 bp, Homo sapiens
ataggatttatttaaaatagcaa

SEQ ID NO: 1392657 - DNA, 14 bp, Homo sapiens
atagggctgagctc

SEQ ID NO: 1392658 - DNA, 20 bp, Homo sapiens
atagggtttgtgacagggcg

SEQ ID NO: 1392659 - DNA, 18 bp, Homo sapiens
ataggtagaatgtaaagc

SEQ ID NO: 1392660 - DNA, 20 bp, Homo sapiens
atagtaagcctccctcctcg

SEQ ID NO: 1392661 - DNA, 18 bp, Homo sapiens
atagtttggatatgtaaa

SEQ ID NO: 1392662 - DNA, 22 bp, Homo sapiens
atagttttacttttaaactgtg

SEQ ID NO: 1392663 - DNA, 17 bp, Homo sapiens
atataaattaagacttt

SEQ ID NO: 1392664 - DNA, 12 bp, Homo sapiens
atataagctttt

SEQ ID NO: 1392665 - DNA, 18 bp, Homo sapiens
atatagctgatcagtttt

SEQ ID NO: 1392666 - DNA, 16 bp, Homo sapiens
atatagttttactttt

SEQ ID NO: 1392667 - DNA, 18 bp, Homo sapiens
atatagttttacttttaa

SEQ ID NO: 1392668 - DNA, 16 bp, Homo sapiens
atatatatgtacagtt

SEQ ID NO: 1392669 - DNA, 21 bp, Homo sapiens
atatatggaataagtgtacat

SEQ ID NO: 1392670 - DNA, 15 bp, Homo sapiens
atatattatcttttc

SEQ ID NO: 1392671 - DNA, 16 bp, Homo sapiens
atatattttacaattt

SEQ ID NO: 1392672 - DNA, 15 bp, Homo sapiens
atatctcctgaaaag

SEQ ID NO: 1392673 - DNA, 19 bp, Homo sapiens
atatgaacatattgttgaa

SEQ ID NO: 1392674 - DNA, 22 bp, Homo sapiens
atatgactgtttttcggacagt

SEQ ID NO: 1392675 - DNA, 15 bp, Homo sapiens
atatgatgttaaaaa

SEQ ID NO: 1392676 - DNA, 14 bp, Homo sapiens
atatgcttactgat

SEQ ID NO: 1392677 - DNA, 20 bp, Homo sapiens
atatggaataagtgtacata

SEQ ID NO: 1392678 - DNA, 14 bp, Homo sapiens
atatgtaaaacatt

SEQ ID NO: 1392679 - DNA, 15 bp, Homo sapiens
atatgtaaaacattt

SEQ ID NO: 1392680 - DNA, 11 bp, Homo sapiens
atatgtaccaa

SEQ ID NO: 1392681 - DNA, 22 bp, Homo sapiens
atatgtcaagtgctgtgcaagg

SEQ ID NO: 1392682 - DNA, 13 bp, Homo sapiens
atatgttattaaa

SEQ ID NO: 1392683 - DNA, 15 bp, Homo sapiens
atattatgagatgct

SEQ ID NO: 1392684 - DNA, 17 bp, Homo sapiens
atattcctattgtgcaa

SEQ ID NO: 1392685 - DNA, 15 bp, Homo sapiens
atattgatttattaa

SEQ ID NO: 1392686 - DNA, 17 bp, Homo sapiens
atattgtaaaacaggta

SEQ ID NO: 1392687 - DNA, 19 bp, Homo sapiens
atattgtgggtgttaattt

SEQ ID NO: 1392688 - DNA, 19 bp, Homo sapiens
atatttattttttttaagt

SEQ ID NO: 1392689 - DNA, 12 bp, Homo sapiens
atatttgtacat

SEQ ID NO: 1392690 - DNA, 15 bp, Homo sapiens
atattttaaagaatt

SEQ ID NO: 1392691 - DNA, 20 bp, Homo sapiens
atattttaaagaattgtgtc

SEQ ID NO: 1392692 - DNA, 20 bp, Homo sapiens
atatttttatctttatatga

SEQ ID NO: 1392693 - DNA, 22 bp, Homo sapiens
atatttttatctttatatgaag

SEQ ID NO: 1392694 - DNA, 22 bp, Homo sapiens
atcaaaagggccaaagaaccaa

SEQ ID NO: 1392695 - DNA, 18 bp, Homo sapiens
atcaaccccagacactgg

SEQ ID NO: 1392696 - DNA, 14 bp, Homo sapiens
atcaactgaatgag

SEQ ID NO: 1392697 - DNA, 13 bp, Homo sapiens
atcaagagactga

SEQ ID NO: 1392698 - DNA, 15 bp, Homo sapiens
atcaagggtcaggcc

SEQ ID NO: 1392699 - DNA, 17 bp, Homo sapiens
atcaagggtcaggcctt

SEQ ID NO: 1392700 - DNA, 13 bp, Homo sapiens
atcaagtctgttt

SEQ ID NO: 1392701 - DNA, 23 bp, Homo sapiens
atcaagtctgtttactgcaaggt

SEQ ID NO: 1392702 - DNA, 17 bp, Homo sapiens
atcactagccctccttt

SEQ ID NO: 1392703 - DNA, 18 bp, Homo sapiens
atcactgagttttccatg

SEQ ID NO: 1392704 - DNA, 21 bp, Homo sapiens
atcacttgtacaaaataaaca

SEQ ID NO: 1392705 - DNA, 16 bp, Homo sapiens
atcactttctcagttt

SEQ ID NO: 1392706 - DNA, 21 bp, Homo sapiens
atcactttctcagttttcata

SEQ ID NO: 1392707 - DNA, 17 bp, Homo sapiens
atcagacaccagatttt

SEQ ID NO: 1392708 - DNA, 19 bp, Homo sapiens
atcagctcccttcccctgc

SEQ ID NO: 1392709 - DNA, 14 bp, Homo sapiens
atcaggctttcttt

SEQ ID NO: 1392710 - DNA, 15 bp, Homo sapiens
atcatagaaatgtaa

SEQ ID NO: 1392711 - DNA, 15 bp, Homo sapiens
atcatcagtgtagaa

SEQ ID NO: 1392712 - DNA, 21 bp, Homo sapiens
atcatgcatgtcctgtaaagg

SEQ ID NO: 1392713 - DNA, 15 bp, Homo sapiens
atcatggctatctgt

SEQ ID NO: 1392714 - DNA, 15 bp, Homo sapiens
atcattcatttttgt

SEQ ID NO: 1392715 - DNA, 18 bp, Homo sapiens
atcatttgttggaatgaa

SEQ ID NO: 1392716 - DNA, 22 bp, Homo sapiens
atcattttgcaatcccttaata

SEQ ID NO: 1392717 - DNA, 21 bp, Homo sapiens
atccagtgatccttacaagtt

SEQ ID NO: 1392718 - DNA, 22 bp, Homo sapiens
atccatgacctagttttccatg

SEQ ID NO: 1392719 - DNA, 14 bp, Homo sapiens
atccctagctgtga

SEQ ID NO: 1392720 - DNA, 13 bp, Homo sapiens
atccctcctgttg

SEQ ID NO: 1392721 - DNA, 21 bp, Homo sapiens
atcccttaatatcctaaacat

SEQ ID NO: 1392722 - DNA, 11 bp, Homo sapiens
atcctcctcat

SEQ ID NO: 1392723 - DNA, 14 bp, Homo sapiens
atcctgaaatttca

SEQ ID NO: 1392724 - DNA, 16 bp, Homo sapiens
atcctgaaatttcaga

SEQ ID NO: 1392725 - DNA, 14 bp, Homo sapiens
atccttagatctgg

SEQ ID NO: 1392726 - DNA, 13 bp, Homo sapiens
atcgaatgaaatt

SEQ ID NO: 1392727 - DNA, 18 bp, Homo sapiens
atcggggagccgggagcc

SEQ ID NO: 1392728 - DNA, 20 bp, Homo sapiens
atcgtctcatgtaaaataag

SEQ ID NO: 1392729 - DNA, 16 bp, Homo sapiens
atctaagttaatttaa

SEQ ID NO: 1392730 - DNA, 13 bp, Homo sapiens
atctaatttataa

SEQ ID NO: 1392731 - DNA, 17 bp, Homo sapiens
atctagaggcttccttc

SEQ ID NO: 1392732 - DNA, 19 bp, Homo sapiens
atctagaggcttccttcat

SEQ ID NO: 1392733 - DNA, 11 bp, Homo sapiens
atctaggattt

SEQ ID NO: 1392734 - DNA, 15 bp, Homo sapiens
atctatatttaacaa

SEQ ID NO: 1392735 - DNA, 18 bp, Homo sapiens
atctcaccaggcagcctc

SEQ ID NO: 1392736 - DNA, 19 bp, Homo sapiens
atctcagttgattttctgg

SEQ ID NO: 1392737 - DNA, 19 bp, Homo sapiens
atctcatctcagtgaagaa

SEQ ID NO: 1392738 - DNA, 20 bp, Homo sapiens
atctcatctcagtgaagaat

SEQ ID NO: 1392739 - DNA, 21 bp, Homo sapiens
atctcatttttccgtaaaaat

SEQ ID NO: 1392740 - DNA, 23 bp, Homo sapiens
atctcatttttccgtaaaaatga

SEQ ID NO: 1392741 - DNA, 13 bp, Homo sapiens
atctccctgcctc

SEQ ID NO: 1392742 - DNA, 17 bp, Homo sapiens
atctctgtaaagctaaa

SEQ ID NO: 1392743 - DNA, 19 bp, Homo sapiens
atctctgtgtgcacaaata

SEQ ID NO: 1392744 - DNA, 14 bp, Homo sapiens
atctcttcttttaa

SEQ ID NO: 1392745 - DNA, 18 bp, Homo sapiens
atctgaatttttaaacaa

SEQ ID NO: 1392746 - DNA, 18 bp, Homo sapiens
atctgagaaaagctttga

SEQ ID NO: 1392747 - DNA, 12 bp, Homo sapiens
atctgatagggt

SEQ ID NO: 1392748 - DNA, 13 bp, Homo sapiens
atctggctcctgt

SEQ ID NO: 1392749 - DNA, 18 bp, Homo sapiens
atctgggggcctcttctg

SEQ ID NO: 1392750 - DNA, 17 bp, Homo sapiens
atctgtaaactgtgtat

SEQ ID NO: 1392751 - DNA, 13 bp, Homo sapiens
atctgtgggccca

SEQ ID NO: 1392752 - DNA, 16 bp, Homo sapiens
atcttctgccttctca

SEQ ID NO: 1392753 - DNA, 21 bp, Homo sapiens
atcttggttgatgccaaaaaa

SEQ ID NO: 1392754 - DNA, 22 bp, Homo sapiens
atctttcctccaaactcctgcc

SEQ ID NO: 1392755 - DNA, 15 bp, Homo sapiens
atgaaaaagaagaat

SEQ ID NO: 1392756 - DNA, 13 bp, Homo sapiens
atgaaaagctaga

SEQ ID NO: 1392757 - DNA, 17 bp, Homo sapiens
atgaaaataaagaatgg

SEQ ID NO: 1392758 - DNA, 13 bp, Homo sapiens
atgaacagaattt

SEQ ID NO: 1392759 - DNA, 14 bp, Homo sapiens
atgaacagaattta

SEQ ID NO: 1392760 - DNA, 19 bp, Homo sapiens
atgaacagaatttatgact

SEQ ID NO: 1392761 - DNA, 14 bp, Homo sapiens
atgaacataatgaa

SEQ ID NO: 1392762 - DNA, 16 bp, Homo sapiens
atgaacataatgaaca

SEQ ID NO: 1392763 - DNA, 21 bp, Homo sapiens
atgaacatattgttgaaaggt

SEQ ID NO: 1392764 - DNA, 15 bp, Homo sapiens
atgaagaactgagga

SEQ ID NO: 1392765 - DNA, 14 bp, Homo sapiens
atgaattaaagtgg

SEQ ID NO: 1392766 - DNA, 14 bp, Homo sapiens
atgaattaaataaa

SEQ ID NO: 1392767 - DNA, 22 bp, Homo sapiens
atgaattcctacacatggttat

SEQ ID NO: 1392768 - DNA, 22 bp, Homo sapiens
atgacattaaagaagggttgag

SEQ ID NO: 1392769 - DNA, 18 bp, Homo sapiens
caagaaataagtttttgt

SEQ ID NO: 1392770 - DNA, 17 bp, Homo sapiens
caagaaattgcctcctt

SEQ ID NO: 1392771 - DNA, 16 bp, Homo sapiens
caagaagggactgaga

SEQ ID NO: 1392772 - DNA, 15 bp, Homo sapiens
caagacatgtctgtt

SEQ ID NO: 1392773 - DNA, 17 bp, Homo sapiens
caagacctcagtgcctt

SEQ ID NO: 1392774 - DNA, 14 bp, Homo sapiens
caagacctgttggt

SEQ ID NO: 1392775 - DNA, 12 bp, Homo sapiens
caagactgctgt

SEQ ID NO: 1392776 - DNA, 22 bp, Homo sapiens
caagactgctgtggccaggagg

SEQ ID NO: 1392777 - DNA, 23 bp, Homo sapiens
caagactgctgtggccaggaggt

SEQ ID NO: 1392778 - DNA, 19 bp, Homo sapiens
caagagctacataatttag

SEQ ID NO: 1392779 - DNA, 14 bp, Homo sapiens
caagcacttctttt

SEQ ID NO: 1392780 - DNA, 16 bp, Homo sapiens
caagctgttttcttct

SEQ ID NO: 1392781 - DNA, 21 bp, Homo sapiens
caaggaaaataagtgaaattt

SEQ ID NO: 1392782 - DNA, 13 bp, Homo sapiens
caaggcggtgctt

SEQ ID NO: 1392783 - DNA, 14 bp, Homo sapiens
caagggcctgatgg

SEQ ID NO: 1392784 - DNA, 18 bp, Homo sapiens
caaggttcaacttattaa

SEQ ID NO: 1392785 - DNA, 24 bp, Homo sapiens
caagtacaaccacacccacactca

SEQ ID NO: 1392786 - DNA, 19 bp, Homo sapiens
caagtatttgttaatttag

SEQ ID NO: 1392787 - DNA, 19 bp, Homo sapiens
caagtcaggcccttatttt

SEQ ID NO: 1392788 - DNA, 14 bp, Homo sapiens
caagtctgtttact

SEQ ID NO: 1392789 - DNA, 20 bp, Homo sapiens
caagtctgtttactgcaagg

SEQ ID NO: 1392790 - DNA, 18 bp, Homo sapiens
caagttccaagttgctaa

SEQ ID NO: 1392791 - DNA, 15 bp, Homo sapiens
caagttgctaataca

SEQ ID NO: 1392792 - DNA, 13 bp, Homo sapiens
caataaaaagttc

SEQ ID NO: 1392793 - DNA, 20 bp, Homo sapiens
caataaaaagttcagagttc

SEQ ID NO: 1392794 - DNA, 23 bp, Homo sapiens
caataaagcagcctcattctgag

SEQ ID NO: 1392795 - DNA, 15 bp, Homo sapiens
caatcaagtctgttt

SEQ ID NO: 1392796 - DNA, 12 bp, Homo sapiens
caatctgtaaac

SEQ ID NO: 1392797 - DNA, 16 bp, Homo sapiens
caatctgtaaactgtg

SEQ ID NO: 1392798 - DNA, 21 bp, Homo sapiens
caatgaaatgaattaaagtgg

SEQ ID NO: 1392799 - DNA, 23 bp, Homo sapiens
caatgaaatgaattaaagtggac

SEQ ID NO: 1392800 - DNA, 16 bp, Homo sapiens
caatgatggcaatttt

SEQ ID NO: 1392801 - DNA, 18 bp, Homo sapiens
caatgcacctaaagaaaa

SEQ ID NO: 1392802 - DNA, 17 bp, Homo sapiens
caatgtaaatattttaa

SEQ ID NO: 1392803 - DNA, 22 bp, Homo sapiens
caatgttagcctcaatttctga

SEQ ID NO: 1392804 - DNA, 14 bp, Homo sapiens
caattaaaggcaaa

SEQ ID NO: 1392805 - DNA, 17 bp, Homo sapiens
caattactggtccaaaa

SEQ ID NO: 1392806 - DNA, 12 bp, Homo sapiens
caattcaaaaca

SEQ ID NO: 1392807 - DNA, 13 bp, Homo sapiens
caattcaaagctg

SEQ ID NO: 1392808 - DNA, 20 bp, Homo sapiens
caattccagactttctatta

SEQ ID NO: 1392809 - DNA, 11 bp, Homo sapiens
caatttcaagt

SEQ ID NO: 1392810 - DNA, 13 bp, Homo sapiens
caatttctgaaca

SEQ ID NO: 1392811 - DNA, 19 bp, Homo sapiens
caattttctggaatacatg

SEQ ID NO: 1392812 - DNA, 14 bp, Homo sapiens
cacaaacacctcct

SEQ ID NO: 1392813 - DNA, 18 bp, Homo sapiens
cacaataaaaatgtttaa

SEQ ID NO: 1392814 - DNA, 14 bp, Homo sapiens
cacaatagaattat

SEQ ID NO: 1392815 - DNA, 15 bp, Homo sapiens
cacaatagaattata

SEQ ID NO: 1392816 - DNA, 18 bp, Homo sapiens
cacacaaacacctcctag

SEQ ID NO: 1392817 - DNA, 23 bp, Homo sapiens
cacacagggtctgcaaggtcttt

SEQ ID NO: 1392818 - DNA, 14 bp, Homo sapiens
cacaccaggataga

SEQ ID NO: 1392819 - DNA, 16 bp, Homo sapiens
cacactgtaaacccct

SEQ ID NO: 1392820 - DNA, 12 bp, Homo sapiens
cacagctatgaa

SEQ ID NO: 1392821 - DNA, 22 bp, Homo sapiens
cacagctatgaaggctgtacac

SEQ ID NO: 1392822 - DNA, 20 bp, Homo sapiens
cacagctctccggtctctct

SEQ ID NO: 1392823 - DNA, 16 bp, Homo sapiens
cacaggcaaaatcctt

SEQ ID NO: 1392824 - DNA, 20 bp, Homo sapiens
cacaggcaaaatccttgctt

SEQ ID NO: 1392825 - DNA, 18 bp, Homo sapiens
cacagtacaatgtttcag

SEQ ID NO: 1392826 - DNA, 23 bp, Homo sapiens
cacatggcccctccccctgccag

SEQ ID NO: 1392827 - DNA, 21 bp, Homo sapiens
cacattaggaaaagttgctat

SEQ ID NO: 1392828 - DNA, 15 bp, Homo sapiens
cacattttaaaagtg

SEQ ID NO: 1392829 - DNA, 18 bp, Homo sapiens
cacattttccttttcaaa

SEQ ID NO: 1392830 - DNA, 17 bp, Homo sapiens
caccaaagagaatgccc

SEQ ID NO: 1392831 - DNA, 19 bp, Homo sapiens
caccatttggcatccctgg

SEQ ID NO: 1392832 - DNA, 17 bp, Homo sapiens
cacccaattcaaaacat

SEQ ID NO: 1392833 - DNA, 12 bp, Homo sapiens
cacccccagctt

SEQ ID NO: 1392834 - DNA, 15 bp, Homo sapiens
caccccccaagctgt

SEQ ID NO: 1392835 - DNA, 16 bp, Homo sapiens
caccctacctgtgcct

SEQ ID NO: 1392836 - DNA, 22 bp, Homo sapiens
caccggggcctgggcaggaggg

SEQ ID NO: 1392837 - DNA, 13 bp, Homo sapiens
cacctaaagaaaa

SEQ ID NO: 1392838 - DNA, 18 bp, Homo sapiens
cacctaggctagggtggg

SEQ ID NO: 1392839 - DNA, 10 bp, Homo sapiens
cacctcccag

SEQ ID NO: 1392840 - DNA, 11 bp, Homo sapiens
cacctcccagg

SEQ ID NO: 1392841 - DNA, 20 bp, Homo sapiens
cacctcctgggttcaagcga

SEQ ID NO: 1392842 - DNA, 16 bp, Homo sapiens
cacctgaggctcagcc

SEQ ID NO: 1392843 - DNA, 18 bp, Homo sapiens
cacctgaggctcagccct

SEQ ID NO: 1392844 - DNA, 19 bp, Homo sapiens
cacctgagtcaccctacct

SEQ ID NO: 1392845 - DNA, 23 bp, Homo sapiens
cacctgagtcaccctacctgtgc

SEQ ID NO: 1392846 - DNA, 12 bp, Homo sapiens
cacctttctagt

SEQ ID NO: 1392847 - DNA, 22 bp, Homo sapiens
cactaattcattaatctgcctc

SEQ ID NO: 1392848 - DNA, 20 bp, Homo sapiens
cactaccttctgacctcccc

SEQ ID NO: 1392849 - DNA, 14 bp, Homo sapiens
cactagacaagcca

SEQ ID NO: 1392850 - DNA, 17 bp, Homo sapiens
cactagacaagccagaa

SEQ ID NO: 1392851 - DNA, 21 bp, Homo sapiens
cactagacaagccagaacttg

SEQ ID NO: 1392852 - DNA, 23 bp, Homo sapiens
cactagcccaatgaaatgaatta

SEQ ID NO: 1392853 - DNA, 17 bp, Homo sapiens
cactcaaggcggtgctt

SEQ ID NO: 1392854 - DNA, 18 bp, Homo sapiens
cactcagatcctcctcat

SEQ ID NO: 1392855 - DNA, 23 bp, Homo sapiens
cactctgtaattgaatattattc

SEQ ID NO: 1392856 - DNA, 19 bp, Homo sapiens
cactgcaacctccacctcc

SEQ ID NO: 1392857 - DNA, 20 bp, Homo sapiens
cactgcaatctccacctccc

SEQ ID NO: 1392858 - DNA, 18 bp, Homo sapiens
cactgccagcatttccct

SEQ ID NO: 1392859 - DNA, 19 bp, Homo sapiens
cactgggaacaggagaccc

SEQ ID NO: 1392860 - DNA, 19 bp, Homo sapiens
cactgtaaacccctgggta

SEQ ID NO: 1392861 - DNA, 15 bp, Homo sapiens
cactgtacttgctct

SEQ ID NO: 1392862 - DNA, 19 bp, Homo sapiens
cactgtacttgctcttgat

SEQ ID NO: 1392863 - DNA, 18 bp, Homo sapiens
cactgtagaatgatttca

SEQ ID NO: 1392864 - DNA, 22 bp, Homo sapiens
cactgttgagttggacacactg

SEQ ID NO: 1392865 - DNA, 11 bp, Homo sapiens
cactgtttaag

SEQ ID NO: 1392866 - DNA, 20 bp, Homo sapiens
cacttattccccattcttcc

SEQ ID NO: 1392867 - DNA, 20 bp, Homo sapiens
cacttatttatgaacctgcc

SEQ ID NO: 1392868 - DNA, 19 bp, Homo sapiens
cacttcaggtatacctcac

SEQ ID NO: 1392869 - DNA, 20 bp, Homo sapiens
cacttctgggcttcatctgg

SEQ ID NO: 1392870 - DNA, 12 bp, Homo sapiens
cacttgtacaaa

SEQ ID NO: 1392871 - DNA, 22 bp, Homo sapiens
cactttacacaatagaattata

SEQ ID NO: 1392872 - DNA, 22 bp, Homo sapiens
cagaaaaatatgtaccaagaat

SEQ ID NO: 1392873 - DNA, 19 bp, Homo sapiens
cagaaaatatccctcctgt

SEQ ID NO: 1392874 - DNA, 20 bp, Homo sapiens
cagaaagtgaggaagcctaa

SEQ ID NO: 1392875 - DNA, 14 bp, Homo sapiens
cagaaatactactg

SEQ ID NO: 1392876 - DNA, 21 bp, Homo sapiens
cagaaatatttgtgacaaaaa

SEQ ID NO: 1392877 - DNA, 22 bp, Homo sapiens
cagaaatatttgtgacaaaaaa

SEQ ID NO: 1392878 - DNA, 16 bp, Homo sapiens
cagaacatagacagaa

SEQ ID NO: 1392879 - DNA, 14 bp, Homo sapiens
cagaagaaacaagg

SEQ ID NO: 1392880 - DNA, 20 bp, Homo sapiens
cagaagcagggtaccctttg

SEQ ID NO: 1392881 - DNA, 11 bp, Homo sapiens
cagaagcccca

SEQ ID NO: 1392882 - DNA, 16 bp, Homo sapiens
cagaagttgtgaaact

SEQ ID NO: 1392883 - DNA, 16 bp, Homo sapiens
cagaagtttgcactat

SEQ ID NO: 1392884 - DNA, 21 bp, Homo sapiens
cagaatagcttccaataaagc

SEQ ID NO: 1392885 - DNA, 21 bp, Homo sapiens
cagaatgtcattttggtactt

SEQ ID NO: 1392886 - DNA, 16 bp, Homo sapiens
cagaatgttgattaca

SEQ ID NO: 1392887 - DNA, 23 bp, Homo sapiens
cagaattactgtaactgattaca

SEQ ID NO: 1392888 - DNA, 18 bp, Homo sapiens
cagactctaagaaagaac

SEQ ID NO: 1392889 - DNA, 18 bp, Homo sapiens
cagactctttatgcttgc

SEQ ID NO: 1392890 - DNA, 18 bp, Homo sapiens
cagactgcgatttgtccc

SEQ ID NO: 1392891 - DNA, 12 bp, Homo sapiens
cagacttcccac

SEQ ID NO: 1392892 - DNA, 22 bp, Homo sapiens
cagacttcccacggctcctcga

SEQ ID NO: 1392893 - DNA, 20 bp, Homo sapiens
cagactttctacacctgttg

SEQ ID NO: 1392894 - DNA, 23 bp, Homo sapiens
cagagaatttctaccatttcaga

SEQ ID NO: 1392895 - DNA, 16 bp, Homo sapiens
cagagcaaaataattt

SEQ ID NO: 1392896 - DNA, 13 bp, Homo sapiens
cagagcactgtat

SEQ ID NO: 1392897 - DNA, 21 bp, Homo sapiens
cagagccaaggggcttcaggt

SEQ ID NO: 1392898 - DNA, 20 bp, Homo sapiens
cagagtctggtgaagctcac

SEQ ID NO: 1392899 - DNA, 20 bp, Homo sapiens
cagagttgctgcaaacctga

SEQ ID NO: 1392900 - DNA, 22 bp, Homo sapiens
cagataaggtaaaatgccatga

SEQ ID NO: 1392901 - DNA, 15 bp, Homo sapiens
cagataatccctgta

SEQ ID NO: 1392902 - DNA, 16 bp, Homo sapiens
cagatcctcctcattc

SEQ ID NO: 1392903 - DNA, 21 bp, Homo sapiens
cagatctagtcaatcaagtct

SEQ ID NO: 1392904 - DNA, 17 bp, Homo sapiens
cagatgtgaaccattaa

SEQ ID NO: 1392905 - DNA, 15 bp, Homo sapiens
cagattttcagcaaa

SEQ ID NO: 1392906 - DNA, 22 bp, Homo sapiens
cagattttcagcaaactctttt

SEQ ID NO: 1392907 - DNA, 15 bp, Homo sapiens
cagcaaccagagcac

SEQ ID NO: 1392908 - DNA, 17 bp, Homo sapiens
cagcaaccagagcactg

SEQ ID NO: 1392909 - DNA, 19 bp, Homo sapiens
cagcaaccagagcactgta

SEQ ID NO: 1392910 - DNA, 21 bp, Homo sapiens
cagcaaccagagcactgtata

SEQ ID NO: 1392911 - DNA, 15 bp, Homo sapiens
cagcagactcagctc

SEQ ID NO: 1392912 - DNA, 20 bp, Homo sapiens
cagcatccccttgaactctt

SEQ ID NO: 1392913 - DNA, 15 bp, Homo sapiens
cagcatttcccttcc

SEQ ID NO: 1392914 - DNA, 24 bp, Homo sapiens
cagccccgcgtggaactcgtgtct

SEQ ID NO: 1392915 - DNA, 17 bp, Homo sapiens
cagcctacccctcctgc

SEQ ID NO: 1392916 - DNA, 19 bp, Homo sapiens
cagcctacccctcctgcgc

SEQ ID NO: 1392917 - DNA, 20 bp, Homo sapiens
cagcctacccctcctgcgct

SEQ ID NO: 1392918 - DNA, 18 bp, Homo sapiens
cagcctccatcctacccc

SEQ ID NO: 1392919 - DNA, 23 bp, Homo sapiens
cagcctccccctgtcccctctat

SEQ ID NO: 1392920 - DNA, 23 bp, Homo sapiens
cagcctctggggggtggccaggc

SEQ ID NO: 1392921 - DNA, 18 bp, Homo sapiens
cagctaagctaggaatga

SEQ ID NO: 1392922 - DNA, 16 bp, Homo sapiens
cagctccagttggagt

SEQ ID NO: 1392923 - DNA, 22 bp, Homo sapiens
cagctggggccaggctgggtcg

SEQ ID NO: 1392924 - DNA, 11 bp, Homo sapiens
cagctgtgctt

SEQ ID NO: 1392925 - DNA, 22 bp, Homo sapiens
cagcttcgtttattttcaagaa

SEQ ID NO: 1392926 - DNA, 17 bp, Homo sapiens
cagctttccctgcctct

SEQ ID NO: 1392927 - DNA, 19 bp, Homo sapiens
cagctttccctgcctctca

SEQ ID NO: 1392928 - DNA, 13 bp, Homo sapiens
caggaaaattgaa

SEQ ID NO: 1392929 - DNA, 17 bp, Homo sapiens
caggaaccgaggcaggg

SEQ ID NO: 1392930 - DNA, 12 bp, Homo sapiens
caggaactgggc

SEQ ID NO: 1392931 - DNA, 14 bp, Homo sapiens
caggaatcttaagg

SEQ ID NO: 1392932 - DNA, 14 bp, Homo sapiens
caggagccctggga

SEQ ID NO: 1392933 - DNA, 16 bp, Homo sapiens
caggagcctgtgcctc

SEQ ID NO: 1392934 - DNA, 15 bp, Homo sapiens
caggaggacccaggg

SEQ ID NO: 1392935 - DNA, 17 bp, Homo sapiens
caggaggacccagggct

SEQ ID NO: 1392936 - DNA, 20 bp, Homo sapiens
caggaggacccagggctctg

SEQ ID NO: 1392937 - DNA, 15 bp, Homo sapiens
caggaggccaataaa

SEQ ID NO: 1392938 - DNA, 22 bp, Homo sapiens
caggaggccaataaaaagttca

SEQ ID NO: 1392939 - DNA, 18 bp, Homo sapiens
caggagtgggtggggagt

SEQ ID NO: 1392940 - DNA, 19 bp, Homo sapiens
caggatagagactggaaca

SEQ ID NO: 1392941 - DNA, 18 bp, Homo sapiens
caggatctcaccaggcag

SEQ ID NO: 1392942 - DNA, 18 bp, Homo sapiens
caggatgtgtttgctttc

SEQ ID NO: 1392943 - DNA, 15 bp, Homo sapiens
caggattggggaaga

SEQ ID NO: 1392944 - DNA, 21 bp, Homo sapiens
caggcactgcaaaccgccacc

SEQ ID NO: 1392945 - DNA, 22 bp, Homo sapiens
caggcagaggatgttctggacc

SEQ ID NO: 1392946 - DNA, 13 bp, Homo sapiens
caggcagcctctg

SEQ ID NO: 1392947 - DNA, 16 bp, Homo sapiens
caggcagcctctgggg

SEQ ID NO: 1392948 - DNA, 18 bp, Homo sapiens
caggcaggctcccaggga

SEQ ID NO: 1392949 - DNA, 13 bp, Homo sapiens
caggccagagcca

SEQ ID NO: 1392950 - DNA, 18 bp, Homo sapiens
caggcccccacctggctc

SEQ ID NO: 1392951 - DNA, 19 bp, Homo sapiens
caggccgtgacgtctgggt

SEQ ID NO: 1392952 - DNA, 11 bp, Homo sapiens
caggctcagag

SEQ ID NO: 1392953 - DNA, 16 bp, Homo sapiens
caggctcccagggaca

SEQ ID NO: 1392954 - DNA, 16 bp, Homo sapiens
caggctgatttctagg

SEQ ID NO: 1392955 - DNA, 13 bp, Homo sapiens
cagggaaggatcc

SEQ ID NO: 1392956 - DNA, 18 bp, Homo sapiens
cagggaaggatcccatga

SEQ ID NO: 1392957 - DNA, 17 bp, Homo sapiens
cagggacacctgggaga

SEQ ID NO: 1392958 - DNA, 15 bp, Homo sapiens
cagggcaaggccatt

SEQ ID NO: 1392959 - DNA, 15 bp, Homo sapiens
cagggcgggggtggc

SEQ ID NO: 1392960 - DNA, 21 bp, Homo sapiens
cagggggcctttaaagactta

SEQ ID NO: 1392961 - DNA, 16 bp, Homo sapiens
caggtccaggctgtgt

SEQ ID NO: 1392962 - DNA, 11 bp, Homo sapiens
caggtccctaa

SEQ ID NO: 1392963 - DNA, 13 bp, Homo sapiens
caggtccctaata

SEQ ID NO: 1392964 - DNA, 14 bp, Homo sapiens
caggtccctaataa

SEQ ID NO: 1392965 - DNA, 15 bp, Homo sapiens
caggtccctaataaa

SEQ ID NO: 1392966 - DNA, 20 bp, Homo sapiens
caggtccctaataaagctgt

SEQ ID NO: 1392967 - DNA, 15 bp, Homo sapiens
caggtggccctactg

SEQ ID NO: 1392968 - DNA, 19 bp, Homo sapiens
caggttgttctgtataaaa

SEQ ID NO: 1392969 - DNA, 15 bp, Homo sapiens
cagtaaagcacttgc

SEQ ID NO: 1392970 - DNA, 17 bp, Homo sapiens
cagtaatttgaggacaa

SEQ ID NO: 1392971 - DNA, 23 bp, Homo sapiens
cagtacactgtcagcagggactg

SEQ ID NO: 1392972 - DNA, 21 bp, Homo sapiens
cagtagcacaagttatttaaa

SEQ ID NO: 1392973 - DNA, 22 bp, Homo sapiens
cagtctaaagctggtttaatgt

SEQ ID NO: 1392974 - DNA, 19 bp, Homo sapiens
cagtctcagaatgtcattt

SEQ ID NO: 1392975 - DNA, 13 bp, Homo sapiens
cagtgaagacaga

SEQ ID NO: 1392976 - DNA, 15 bp, Homo sapiens
cagtgaagacagaag

SEQ ID NO: 1392977 - DNA, 18 bp, Homo sapiens
cagtgagacagtctggaa

SEQ ID NO: 1392978 - DNA, 21 bp, Homo sapiens
cagtgagacagtctggaaagt

SEQ ID NO: 1392979 - DNA, 20 bp, Homo sapiens
cagtgcagcaaccagagcac

SEQ ID NO: 1392980 - DNA, 22 bp, Homo sapiens
cagtgcagcaaccagagcactg

SEQ ID NO: 1392981 - DNA, 22 bp, Homo sapiens
cagtgccttcctgtttttcaca

SEQ ID NO: 1392982 - DNA, 18 bp, Homo sapiens
cagtgcttaatgtgaact

SEQ ID NO: 1392983 - DNA, 19 bp, Homo sapiens
cagtgggaaaaatgtagga

SEQ ID NO: 1392984 - DNA, 15 bp, Homo sapiens
cagtggtaaaaaggc

SEQ ID NO: 1392985 - DNA, 20 bp, Homo sapiens
cagtgtccttggcaggctga

SEQ ID NO: 1392986 - DNA, 16 bp, Homo sapiens
cagttatctaagttaa

SEQ ID NO: 1392987 - DNA, 22 bp, Homo sapiens
cagttatctaagttaatttaaa

SEQ ID NO: 1392988 - DNA, 16 bp, Homo sapiens
cagttgattttctgga

SEQ ID NO: 1392989 - DNA, 17 bp, Homo sapiens
cagttgattttctggat

SEQ ID NO: 1392990 - DNA, 14 bp, Homo sapiens
cagtttatatttaa

SEQ ID NO: 1392991 - DNA, 12 bp, Homo sapiens
cagttttcataa

SEQ ID NO: 1392992 - DNA, 18 bp, Homo sapiens
cataaccttaccagattt

SEQ ID NO: 1392993 - DNA, 14 bp, Homo sapiens
cataactgaaaatg

SEQ ID NO: 1392994 - DNA, 19 bp, Homo sapiens
cataagtattatgtctctt

SEQ ID NO: 1392995 - DNA, 21 bp, Homo sapiens
cataatcttctgccttctcat

SEQ ID NO: 1392996 - DNA, 22 bp, Homo sapiens
cataatcttctgccttctcatg

SEQ ID NO: 1392997 - DNA, 17 bp, Homo sapiens
cataattcactctgagt

SEQ ID NO: 1392998 - DNA, 20 bp, Homo sapiens
catacacctatgtcatttca

SEQ ID NO: 1392999 - DNA, 14 bp, Homo sapiens
catacattttctaa

SEQ ID NO: 1393000 - DNA, 20 bp, Homo sapiens
catactttttaaatgtaaag

SEQ ID NO: 1393001 - DNA, 22 bp, Homo sapiens
catactttttaaatgtaaagat

SEQ ID NO: 1393002 - DNA, 23 bp, Homo sapiens
catagaaatgtaacttttgtaag

SEQ ID NO: 1393003 - DNA, 20 bp, Homo sapiens
catagacagaagaaacaagg

SEQ ID NO: 1393004 - DNA, 17 bp, Homo sapiens
cataggtagaatgtaaa

SEQ ID NO: 1393005 - DNA, 23 bp, Homo sapiens
cataggtagaatgtaaagcttgt

SEQ ID NO: 1393006 - DNA, 17 bp, Homo sapiens
catatacagctcagaag

SEQ ID NO: 1393007 - DNA, 17 bp, Homo sapiens
catatatatactattaa

SEQ ID NO: 1393008 - DNA, 17 bp, Homo sapiens
catattgtaaaacaggt

SEQ ID NO: 1393009 - DNA, 19 bp, Homo sapiens
catattgtaaaacaggtag

SEQ ID NO: 1393010 - DNA, 20 bp, Homo sapiens
catattgtgattctgccttt

SEQ ID NO: 1393011 - DNA, 12 bp, Homo sapiens
catcaactgaat

SEQ ID NO: 1393012 - DNA, 23 bp, Homo sapiens
catcactgagttttccatggcag

SEQ ID NO: 1393013 - DNA, 15 bp, Homo sapiens
catcacttgtacaaa

SEQ ID NO: 1393014 - DNA, 15 bp, Homo sapiens
catcaggctttctta

SEQ ID NO: 1393015 - DNA, 14 bp, Homo sapiens
catcattttttact

SEQ ID NO: 1393016 - DNA, 16 bp, Homo sapiens
catccattctcctgag

SEQ ID NO: 1393017 - DNA, 21 bp, Homo sapiens
catccctgggccttgggctcc

SEQ ID NO: 1393018 - DNA, 15 bp, Homo sapiens
catcctaccccctgt

SEQ ID NO: 1393019 - DNA, 22 bp, Homo sapiens
catctagaggcttccttcattt

SEQ ID NO: 1393020 - DNA, 14 bp, Homo sapiens
catctcaggccaga

SEQ ID NO: 1393021 - DNA, 18 bp, Homo sapiens
catctcaggccagagcca

SEQ ID NO: 1393022 - DNA, 22 bp, Homo sapiens
catctcagtgaagaatacttct

SEQ ID NO: 1393023 - DNA, 20 bp, Homo sapiens
catctttcctccaaactcct

SEQ ID NO: 1393024 - DNA, 21 bp, Homo sapiens
catctttttcctccctttccc

SEQ ID NO: 1393025 - DNA, 13 bp, Homo sapiens
catgaaacagaaa

SEQ ID NO: 1393026 - DNA, 19 bp, Homo sapiens
catgaaacagaaacaaaaa

SEQ ID NO: 1393027 - DNA, 19 bp, Homo sapiens
catgaacctcaagctgcat

SEQ ID NO: 1393028 - DNA, 16 bp, Homo sapiens
catgaaggtgtcatac

SEQ ID NO: 1393029 - DNA, 14 bp, Homo sapiens
catgatattttcag

SEQ ID NO: 1393030 - DNA, 15 bp, Homo sapiens
catgatattttcaga

SEQ ID NO: 1393031 - DNA, 16 bp, Homo sapiens
catgatgcctctgtct

SEQ ID NO: 1393032 - DNA, 20 bp, Homo sapiens
catgatgcctctgtcttctg

SEQ ID NO: 1393033 - DNA, 18 bp, Homo sapiens
catgattcattttaacat

SEQ ID NO: 1393034 - DNA, 21 bp, Homo sapiens
catgcacacaaacacctccta

SEQ ID NO: 1393035 - DNA, 16 bp, Homo sapiens
cccagggctctgtaag

SEQ ID NO: 1393036 - DNA, 18 bp, Homo sapiens
cccatattgtaaaacagg

SEQ ID NO: 1393037 - DNA, 19 bp, Homo sapiens
cccatattgtaaaacaggt

SEQ ID NO: 1393038 - DNA, 14 bp, Homo sapiens
cccatccagttcat

SEQ ID NO: 1393039 - DNA, 11 bp, Homo sapiens
cccatctcagg

SEQ ID NO: 1393040 - DNA, 16 bp, Homo sapiens
cccatctcaggccaga

SEQ ID NO: 1393041 - DNA, 13 bp, Homo sapiens
cccatgagctcct

SEQ ID NO: 1393042 - DNA, 14 bp, Homo sapiens
cccatgagctcctt

SEQ ID NO: 1393043 - DNA, 22 bp, Homo sapiens
cccatgcacacaaacacctcct

SEQ ID NO: 1393044 - DNA, 15 bp, Homo sapiens
cccatgcctccagct

SEQ ID NO: 1393045 - DNA, 12 bp, Homo sapiens
cccattcttcct

SEQ ID NO: 1393046 - DNA, 20 bp, Homo sapiens
cccattcttcctagttttct

SEQ ID NO: 1393047 - DNA, 12 bp, Homo sapiens
cccatttcagct

SEQ ID NO: 1393048 - DNA, 14 bp, Homo sapiens
ccccaagctgtttt

SEQ ID NO: 1393049 - DNA, 15 bp, Homo sapiens
ccccagtgacagcta

SEQ ID NO: 1393050 - DNA, 21 bp, Homo sapiens
ccccattcttcctagttttct

SEQ ID NO: 1393051 - DNA, 23 bp, Homo sapiens
ccccattcttcctagttttctcc

SEQ ID NO: 1393052 - DNA, 16 bp, Homo sapiens
ccccctccctggatga

SEQ ID NO: 1393053 - DNA, 20 bp, Homo sapiens
cccctagcgctatctccctg

SEQ ID NO: 1393054 - DNA, 14 bp, Homo sapiens
cccctgcctctctg

SEQ ID NO: 1393055 - DNA, 18 bp, Homo sapiens
ccctaaaatactattgga

SEQ ID NO: 1393056 - DNA, 13 bp, Homo sapiens
ccctaataaagct

SEQ ID NO: 1393057 - DNA, 19 bp, Homo sapiens
ccctactagagacctctca

SEQ ID NO: 1393058 - DNA, 21 bp, Homo sapiens
ccctacttgagataatctaaa

SEQ ID NO: 1393059 - DNA, 14 bp, Homo sapiens
ccctagccctcagc

SEQ ID NO: 1393060 - DNA, 15 bp, Homo sapiens
ccctagccctcagcc

SEQ ID NO: 1393061 - DNA, 23 bp, Homo sapiens
ccctatactgcttggagctgagc

SEQ ID NO: 1393062 - DNA, 14 bp, Homo sapiens
ccctcatctttctt

SEQ ID NO: 1393063 - DNA, 12 bp, Homo sapiens
ccctccatccct

SEQ ID NO: 1393064 - DNA, 19 bp, Homo sapiens
ccctgcctcccatgcctgg

SEQ ID NO: 1393065 - DNA, 20 bp, Homo sapiens
ccctgcctcccatgcctggt

SEQ ID NO: 1393066 - DNA, 17 bp, Homo sapiens
ccctgcctcctgccggc

SEQ ID NO: 1393067 - DNA, 12 bp, Homo sapiens
ccctgcctctca

SEQ ID NO: 1393068 - DNA, 22 bp, Homo sapiens
ccctgcctctcatcaactgaat

SEQ ID NO: 1393069 - DNA, 13 bp, Homo sapiens
ccctgcctctctg

SEQ ID NO: 1393070 - DNA, 15 bp, Homo sapiens
ccctgcctctctgca

SEQ ID NO: 1393071 - DNA, 18 bp, Homo sapiens
ccctgcctctctgcaggt

SEQ ID NO: 1393072 - DNA, 22 bp, Homo sapiens
ccctgcctctctgcaggtccct

SEQ ID NO: 1393073 - DNA, 16 bp, Homo sapiens
ccctgctcagtaaagc

SEQ ID NO: 1393074 - DNA, 17 bp, Homo sapiens
ccctgctcccacagaac

SEQ ID NO: 1393075 - DNA, 15 bp, Homo sapiens
ccctgggaggctctg

SEQ ID NO: 1393076 - DNA, 17 bp, Homo sapiens
ccctgggaggctctgga

SEQ ID NO: 1393077 - DNA, 13 bp, Homo sapiens
ccctgggccttgg

SEQ ID NO: 1393078 - DNA, 14 bp, Homo sapiens
ccctgggccttggg

SEQ ID NO: 1393079 - DNA, 17 bp, Homo sapiens
cccttatgactgccaag

SEQ ID NO: 1393080 - DNA, 12 bp, Homo sapiens
cccttgaactct

SEQ ID NO: 1393081 - DNA, 17 bp, Homo sapiens
cccttgacaactggcag

SEQ ID NO: 1393082 - DNA, 18 bp, Homo sapiens
cccttgacaactggcagg

SEQ ID NO: 1393083 - DNA, 19 bp, Homo sapiens
cccttgacaactggcaggc

SEQ ID NO: 1393084 - DNA, 21 bp, Homo sapiens
cccttgacaactggcaggcag

SEQ ID NO: 1393085 - DNA, 18 bp, Homo sapiens
cccttgcccatgcctcca

SEQ ID NO: 1393086 - DNA, 17 bp, Homo sapiens
ccgcctgggtctcctaa

SEQ ID NO: 1393087 - DNA, 16 bp, Homo sapiens
ccggcctgccaggagg

SEQ ID NO: 1393088 - DNA, 15 bp, Homo sapiens
ccggctaatttttgt

SEQ ID NO: 1393089 - DNA, 19 bp, Homo sapiens
ccggctaatttttgtattt

SEQ ID NO: 1393090 - DNA, 15 bp, Homo sapiens
ccggggcctgggcag

SEQ ID NO: 1393091 - DNA, 19 bp, Homo sapiens
ccggggcctgggcaggagg

SEQ ID NO: 1393092 - DNA, 20 bp, Homo sapiens
ccggggcctgggcaggaggg

SEQ ID NO: 1393093 - DNA, 16 bp, Homo sapiens
ccgtccaggagcctgg

SEQ ID NO: 1393094 - DNA, 16 bp, Homo sapiens
cctaaagaaaaacaaa

SEQ ID NO: 1393095 - DNA, 12 bp, Homo sapiens
cctaacctgccg

SEQ ID NO: 1393096 - DNA, 14 bp, Homo sapiens
cctaataaagctgt

SEQ ID NO: 1393097 - DNA, 23 bp, Homo sapiens
cctaataaagctgtgtggcagtc

SEQ ID NO: 1393098 - DNA, 15 bp, Homo sapiens
cctacctgtgcctga

SEQ ID NO: 1393099 - DNA, 16 bp, Homo sapiens
cctacctgtgcctgac

SEQ ID NO: 1393100 - DNA, 16 bp, Homo sapiens
cctactccaaaatgtt

SEQ ID NO: 1393101 - DNA, 16 bp, Homo sapiens
cctactgcccaggcac

SEQ ID NO: 1393102 - DNA, 19 bp, Homo sapiens
cctacttgagataatctaa

SEQ ID NO: 1393103 - DNA, 14 bp, Homo sapiens
cctagccctcagcc

SEQ ID NO: 1393104 - DNA, 21 bp, Homo sapiens
cctagctgtgacctctcccct

SEQ ID NO: 1393105 - DNA, 15 bp, Homo sapiens
cctaggctccacccc

SEQ ID NO: 1393106 - DNA, 15 bp, Homo sapiens
cctagttttccatgc

SEQ ID NO: 1393107 - DNA, 16 bp, Homo sapiens
cctagttttctcctcc

SEQ ID NO: 1393108 - DNA, 18 bp, Homo sapiens
cctagttttctcctccca

SEQ ID NO: 1393109 - DNA, 18 bp, Homo sapiens
cctatgtcatttcatttc

SEQ ID NO: 1393110 - DNA, 21 bp, Homo sapiens
cctcaaagcaagcattcagaa

SEQ ID NO: 1393111 - DNA, 14 bp, Homo sapiens
cctcaacctcccaa

SEQ ID NO: 1393112 - DNA, 15 bp, Homo sapiens
cctcaagctgcatct

SEQ ID NO: 1393113 - DNA, 18 bp, Homo sapiens
cctcacttttaatgaaca

SEQ ID NO: 1393114 - DNA, 19 bp, Homo sapiens
cctcagactctaagaaaga

SEQ ID NO: 1393115 - DNA, 20 bp, Homo sapiens
cctcagactctaagaaagaa

SEQ ID NO: 1393116 - DNA, 16 bp, Homo sapiens
cctcagctagctctgc

SEQ ID NO: 1393117 - DNA, 15 bp, Homo sapiens
cctccaaactcctgc

SEQ ID NO: 1393118 - DNA, 18 bp, Homo sapiens
cctccaaactcctgcctg

SEQ ID NO: 1393119 - DNA, 19 bp, Homo sapiens
cctccaaactcctgcctgt

SEQ ID NO: 1393120 - DNA, 20 bp, Homo sapiens
cctccaaactcctgcctgtg

SEQ ID NO: 1393121 - DNA, 19 bp, Homo sapiens
cctccaaagcttcccacgg

SEQ ID NO: 1393122 - DNA, 14 bp, Homo sapiens
cctccatccctggc

SEQ ID NO: 1393123 - DNA, 23 bp, Homo sapiens
cctccatcctaccccctgtgcct

SEQ ID NO: 1393124 - DNA, 13 bp, Homo sapiens
cctccccctgcca

SEQ ID NO: 1393125 - DNA, 14 bp, Homo sapiens
cctccccctgccag

SEQ ID NO: 1393126 - DNA, 16 bp, Homo sapiens
cctcccctccatccct

SEQ ID NO: 1393127 - DNA, 22 bp, Homo sapiens
cctccctctcgtaagatttcct

SEQ ID NO: 1393128 - DNA, 13 bp, Homo sapiens
cctcctcaccccc

SEQ ID NO: 1393129 - DNA, 19 bp, Homo sapiens
cctcctgccggctccttgg

SEQ ID NO: 1393130 - DNA, 11 bp, Homo sapiens
cctcctgctca

SEQ ID NO: 1393131 - DNA, 23 bp, Homo sapiens
cctctccactcatgtgactcttt

SEQ ID NO: 1393132 - DNA, 13 bp, Homo sapiens
cctctcccatgca

SEQ ID NO: 1393133 - DNA, 19 bp, Homo sapiens
cctctcgtaagatttcctt

SEQ ID NO: 1393134 - DNA, 23 bp, Homo sapiens
cctctcgtaagatttccttcttt

SEQ ID NO: 1393135 - DNA, 16 bp, Homo sapiens
cctctctgcaggtccc

SEQ ID NO: 1393136 - DNA, 17 bp, Homo sapiens
cctctctgcaggtccct

SEQ ID NO: 1393137 - DNA, 22 bp, Homo sapiens
cctctgcccgggagctcaggaa

SEQ ID NO: 1393138 - DNA, 19 bp, Homo sapiens
cctctggggggtggccagg

SEQ ID NO: 1393139 - DNA, 15 bp, Homo sapiens
cctctgtcttctgga

SEQ ID NO: 1393140 - DNA, 16 bp, Homo sapiens
cctctgtcttctggac

SEQ ID NO: 1393141 - DNA, 12 bp, Homo sapiens
cctcttccagtc

SEQ ID NO: 1393142 - DNA, 14 bp, Homo sapiens
cctcttccagtctt

SEQ ID NO: 1393143 - DNA, 14 bp, Homo sapiens
cctgaaatttcaga

SEQ ID NO: 1393144 - DNA, 16 bp, Homo sapiens
cctgaacaagaattgg

SEQ ID NO: 1393145 - DNA, 17 bp, Homo sapiens
cctgaactgaacaccat

SEQ ID NO: 1393146 - DNA, 17 bp, Homo sapiens
cctgaatccaaactaat

SEQ ID NO: 1393147 - DNA, 13 bp, Homo sapiens
cctgacactttaa

SEQ ID NO: 1393148 - DNA, 17 bp, Homo sapiens
cctgacatgtccttctg

SEQ ID NO: 1393149 - DNA, 14 bp, Homo sapiens
cctgacccctgctc

SEQ ID NO: 1393150 - DNA, 19 bp, Homo sapiens
cctgactagggagccatgt

SEQ ID NO: 1393151 - DNA, 21 bp, Homo sapiens
cctgagtcgtacagaaagctg

SEQ ID NO: 1393152 - DNA, 21 bp, Homo sapiens
cctgatggggtggaaggcatg

SEQ ID NO: 1393153 - DNA, 20 bp, Homo sapiens
cctgcacaataaaaatgttt

SEQ ID NO: 1393154 - DNA, 23 bp, Homo sapiens
cctgcaggatctcaccaggcagc

SEQ ID NO: 1393155 - DNA, 11 bp, Homo sapiens
cctgccaggag

SEQ ID NO: 1393156 - DNA, 22 bp, Homo sapiens
cctgccaggaggacccagggct

SEQ ID NO: 1393157 - DNA, 20 bp, Homo sapiens
cctgcctctcatcaactgaa

SEQ ID NO: 1393158 - DNA, 12 bp, Homo sapiens
cctgcctgtgtt

SEQ ID NO: 1393159 - DNA, 21 bp, Homo sapiens
cctgcttgatgggattctgga

SEQ ID NO: 1393160 - DNA, 22 bp, Homo sapiens
cctgcttgatgggattctggac

SEQ ID NO: 1393161 - DNA, 17 bp, Homo sapiens
cctggaagccagctttc

SEQ ID NO: 1393162 - DNA, 13 bp, Homo sapiens
cctggccccctcc

SEQ ID NO: 1393163 - DNA, 17 bp, Homo sapiens
cctggctcaccttgtgc

SEQ ID NO: 1393164 - DNA, 17 bp, Homo sapiens
cctgggccttgggctcc

SEQ ID NO: 1393165 - DNA, 16 bp, Homo sapiens
cctgggttgcagacag

SEQ ID NO: 1393166 - DNA, 18 bp, Homo sapiens
cctggtatatccaaaagc

SEQ ID NO: 1393167 - DNA, 18 bp, Homo sapiens
cctggtggtggctcggga

SEQ ID NO: 1393168 - DNA, 15 bp, Homo sapiens
cctggtttgaaattt

SEQ ID NO: 1393169 - DNA, 17 bp, Homo sapiens
cctgtaccccagcactt

SEQ ID NO: 1393170 - DNA, 20 bp, Homo sapiens
catgcaccctcatacacaga

SEQ ID NO: 1393171 - DNA, 17 bp, Homo sapiens
catgcacttggctgcat

SEQ ID NO: 1393172 - DNA, 13 bp, Homo sapiens
catgcatctgttt

SEQ ID NO: 1393173 - DNA, 17 bp, Homo sapiens
catgcatgtcctgtaaa

SEQ ID NO: 1393174 - DNA, 17 bp, Homo sapiens
catgctaagagaagtag

SEQ ID NO: 1393175 - DNA, 21 bp, Homo sapiens
catgctaagagaagtagaaat

SEQ ID NO: 1393176 - DNA, 23 bp, Homo sapiens
catgctatctctgtgtgcacaaa

SEQ ID NO: 1393177 - DNA, 22 bp, Homo sapiens
catgctggaaaataatactgct

SEQ ID NO: 1393178 - DNA, 12 bp, Homo sapiens
catgctttggca

SEQ ID NO: 1393179 - DNA, 12 bp, Homo sapiens
catggctatctg

SEQ ID NO: 1393180 - DNA, 21 bp, Homo sapiens
catgggagctggttagaaatg

SEQ ID NO: 1393181 - DNA, 13 bp, Homo sapiens
catgtaaaataag

SEQ ID NO: 1393182 - DNA, 20 bp, Homo sapiens
catgtatttggtgattacat

SEQ ID NO: 1393183 - DNA, 18 bp, Homo sapiens
catgtcaagggttcaaga

SEQ ID NO: 1393184 - DNA, 14 bp, Homo sapiens
catgtcctgtaaag

SEQ ID NO: 1393185 - DNA, 16 bp, Homo sapiens
catgtctattcagctt

SEQ ID NO: 1393186 - DNA, 17 bp, Homo sapiens
catgtctattcagcttc

SEQ ID NO: 1393187 - DNA, 14 bp, Homo sapiens
catgtggtatgagt

SEQ ID NO: 1393188 - DNA, 22 bp, Homo sapiens
catgtttgcacctttctagttg

SEQ ID NO: 1393189 - DNA, 18 bp, Homo sapiens
cattaactcattagactg

SEQ ID NO: 1393190 - DNA, 18 bp, Homo sapiens
cattaatctgcctccctc

SEQ ID NO: 1393191 - DNA, 17 bp, Homo sapiens
cattactataagaactt

SEQ ID NO: 1393192 - DNA, 16 bp, Homo sapiens
cattagactggaactt

SEQ ID NO: 1393193 - DNA, 18 bp, Homo sapiens
cattataaccttaattta

SEQ ID NO: 1393194 - DNA, 15 bp, Homo sapiens
cattcacttcataat

SEQ ID NO: 1393195 - DNA, 17 bp, Homo sapiens
cattcagaagaaaaaga

SEQ ID NO: 1393196 - DNA, 18 bp, Homo sapiens
cattcttcctagttttct

SEQ ID NO: 1393197 - DNA, 12 bp, Homo sapiens
cattctttccca

SEQ ID NO: 1393198 - DNA, 13 bp, Homo sapiens
cattgaaggctta

SEQ ID NO: 1393199 - DNA, 16 bp, Homo sapiens
cattgggttttatcag

SEQ ID NO: 1393200 - DNA, 17 bp, Homo sapiens
cattgtaaatgaacata

SEQ ID NO: 1393201 - DNA, 21 bp, Homo sapiens
cattgtaaatgaacataatga

SEQ ID NO: 1393202 - DNA, 14 bp, Homo sapiens
cattgtagaaaagc

SEQ ID NO: 1393203 - DNA, 20 bp, Homo sapiens
cattgtctttttagatgccc

SEQ ID NO: 1393204 - DNA, 21 bp, Homo sapiens
cattgttatataatcattatt

SEQ ID NO: 1393205 - DNA, 18 bp, Homo sapiens
catttaaatttttttcct

SEQ ID NO: 1393206 - DNA, 20 bp, Homo sapiens
catttatgagctcttcatgt

SEQ ID NO: 1393207 - DNA, 14 bp, Homo sapiens
catttcatttccta

SEQ ID NO: 1393208 - DNA, 20 bp, Homo sapiens
catttctagcgcatggcctg

SEQ ID NO: 1393209 - DNA, 11 bp, Homo sapiens
catttgctgaa

SEQ ID NO: 1393210 - DNA, 17 bp, Homo sapiens
cattttctaagaaacat

SEQ ID NO: 1393211 - DNA, 16 bp, Homo sapiens
catttttcatgataat

SEQ ID NO: 1393212 - DNA, 16 bp, Homo sapiens
ccaaaagattgctgaa

SEQ ID NO: 1393213 - DNA, 19 bp, Homo sapiens
ccaaaagattgctgaaatt

SEQ ID NO: 1393214 - DNA, 20 bp, Homo sapiens
ccaaaataaaacctcagcta

SEQ ID NO: 1393215 - DNA, 17 bp, Homo sapiens
ccaaaatgttgaaatat

SEQ ID NO: 1393216 - DNA, 21 bp, Homo sapiens
ccaaaatgttggtcattttat

SEQ ID NO: 1393217 - DNA, 13 bp, Homo sapiens
ccaaactcctgcc

SEQ ID NO: 1393218 - DNA, 15 bp, Homo sapiens
ccaaagaaccaaaga

SEQ ID NO: 1393219 - DNA, 19 bp, Homo sapiens
ccaaagaaccaaagaagaa

SEQ ID NO: 1393220 - DNA, 17 bp, Homo sapiens
ccaaagcttcccacggc

SEQ ID NO: 1393221 - DNA, 12 bp, Homo sapiens
ccaaatattgtg

SEQ ID NO: 1393222 - DNA, 21 bp, Homo sapiens
ccaaatccttagatctggcat

SEQ ID NO: 1393223 - DNA, 13 bp, Homo sapiens
ccaaccatttcct

SEQ ID NO: 1393224 - DNA, 22 bp, Homo sapiens
ccaagacagtgagacagtctgg

SEQ ID NO: 1393225 - DNA, 21 bp, Homo sapiens
ccaagacatgtctgttctaca

SEQ ID NO: 1393226 - DNA, 21 bp, Homo sapiens
ccaagcagttgggactacagg

SEQ ID NO: 1393227 - DNA, 22 bp, Homo sapiens
ccaagcagttgggactacaggc

SEQ ID NO: 1393228 - DNA, 16 bp, Homo sapiens
ccaaggctttctctac

SEQ ID NO: 1393229 - DNA, 13 bp, Homo sapiens
ccaataaaaagtt

SEQ ID NO: 1393230 - DNA, 21 bp, Homo sapiens
ccaataaaaagttcagagttc

SEQ ID NO: 1393231 - DNA, 18 bp, Homo sapiens
ccaatagggctgagctct

SEQ ID NO: 1393232 - DNA, 18 bp, Homo sapiens
ccaatgcacctaaagaaa

SEQ ID NO: 1393233 - DNA, 20 bp, Homo sapiens
ccaatggaatgtgatgttca

SEQ ID NO: 1393234 - DNA, 22 bp, Homo sapiens
ccacaaatgggaaaaccagact

SEQ ID NO: 1393235 - DNA, 17 bp, Homo sapiens
ccacaactattttcaga

SEQ ID NO: 1393236 - DNA, 16 bp, Homo sapiens
ccacacccacactcag

SEQ ID NO: 1393237 - DNA, 19 bp, Homo sapiens
ccacactcagatcctcctc

SEQ ID NO: 1393238 - DNA, 15 bp, Homo sapiens
ccaccactccactcc

SEQ ID NO: 1393239 - DNA, 22 bp, Homo sapiens
ccaccatttggcatccctgggc

SEQ ID NO: 1393240 - DNA, 22 bp, Homo sapiens
ccacccaattcaaaacattgtg

SEQ ID NO: 1393241 - DNA, 20 bp, Homo sapiens
ccacctgaggctcagcccta

SEQ ID NO: 1393242 - DNA, 21 bp, Homo sapiens
ccacgtcagctgggacacccc

SEQ ID NO: 1393243 - DNA, 22 bp, Homo sapiens
ccactgctgatattttctctag

SEQ ID NO: 1393244 - DNA, 19 bp, Homo sapiens
ccactgtacttgctcttga

SEQ ID NO: 1393245 - DNA, 21 bp, Homo sapiens
ccagaaagtgaggaagcctaa

SEQ ID NO: 1393246 - DNA, 18 bp, Homo sapiens
ccagactttctacacctg

SEQ ID NO: 1393247 - DNA, 20 bp, Homo sapiens
ccagactttctacacctgtt

SEQ ID NO: 1393248 - DNA, 18 bp, Homo sapiens
ccagagaaaaagggaggg

SEQ ID NO: 1393249 - DNA, 12 bp, Homo sapiens
ccagagcactgt

SEQ ID NO: 1393250 - DNA, 14 bp, Homo sapiens
ccagagcactgtat

SEQ ID NO: 1393251 - DNA, 13 bp, Homo sapiens
ccagagccaaggg

SEQ ID NO: 1393252 - DNA, 19 bp, Homo sapiens
ccagaggctattattttca

SEQ ID NO: 1393253 - DNA, 17 bp, Homo sapiens
ccagagtccctgcctgg

SEQ ID NO: 1393254 - DNA, 19 bp, Homo sapiens
ccagagtccctgcctggac

SEQ ID NO: 1393255 - DNA, 18 bp, Homo sapiens
ccagatgcacatccctgg

SEQ ID NO: 1393256 - DNA, 22 bp, Homo sapiens
ccagattttttaaaatttatat

SEQ ID NO: 1393257 - DNA, 21 bp, Homo sapiens
ccagctgtgcttatggtacca

SEQ ID NO: 1393258 - DNA, 14 bp, Homo sapiens
ccaggactctgccc

SEQ ID NO: 1393259 - DNA, 15 bp, Homo sapiens
ccaggaggacccagg

SEQ ID NO: 1393260 - DNA, 19 bp, Homo sapiens
ccaggaggacccagggctc

SEQ ID NO: 1393261 - DNA, 21 bp, Homo sapiens
ccaggaggacccagggctctg

SEQ ID NO: 1393262 - DNA, 17 bp, Homo sapiens
ccaggcaccaaaagaag

SEQ ID NO: 1393263 - DNA, 12 bp, Homo sapiens
ccaggcactgca

SEQ ID NO: 1393264 - DNA, 16 bp, Homo sapiens
ccaggctgggtcgccc

SEQ ID NO: 1393265 - DNA, 21 bp, Homo sapiens
ccaggctgggtcgccctggac

SEQ ID NO: 1393266 - DNA, 22 bp, Homo sapiens
ccaggctgggtcgccctggact

SEQ ID NO: 1393267 - DNA, 24 bp, Homo sapiens
ccaggctgggtcgccctggactgt

SEQ ID NO: 1393268 - DNA, 18 bp, Homo sapiens
ccagggacacctgggaga

SEQ ID NO: 1393269 - DNA, 16 bp, Homo sapiens
ccagtaactcatctgt

SEQ ID NO: 1393270 - DNA, 16 bp, Homo sapiens
ccagtgcacttgctgg

SEQ ID NO: 1393271 - DNA, 20 bp, Homo sapiens
ccagtgcacttgctggaaga

SEQ ID NO: 1393272 - DNA, 11 bp, Homo sapiens
ccagttatttt

SEQ ID NO: 1393273 - DNA, 23 bp, Homo sapiens
ccatccctggccccctccctgga

SEQ ID NO: 1393274 - DNA, 11 bp, Homo sapiens
ccatctcaggc

SEQ ID NO: 1393275 - DNA, 14 bp, Homo sapiens
ccatctcaggccag

SEQ ID NO: 1393276 - DNA, 18 bp, Homo sapiens
ccatctcaggccagagcc

SEQ ID NO: 1393277 - DNA, 18 bp, Homo sapiens
ccatctctgattttcaaa

SEQ ID NO: 1393278 - DNA, 23 bp, Homo sapiens
ccatctctgattttcaaagcttt

SEQ ID NO: 1393279 - DNA, 14 bp, Homo sapiens
ccatgatgcctctg

SEQ ID NO: 1393280 - DNA, 22 bp, Homo sapiens
ccatgcacacaaacacctccta

SEQ ID NO: 1393281 - DNA, 21 bp, Homo sapiens
ccatgcaccctcatacacaga

SEQ ID NO: 1393282 - DNA, 14 bp, Homo sapiens
ccatggcaggaagg

SEQ ID NO: 1393283 - DNA, 22 bp, Homo sapiens
ccattaaccagatctagtcaat

SEQ ID NO: 1393284 - DNA, 20 bp, Homo sapiens
ccattcttcctagttttctc

SEQ ID NO: 1393285 - DNA, 12 bp, Homo sapiens
ccattctttccc

SEQ ID NO: 1393286 - DNA, 11 bp, Homo sapiens
ccattgaaggc

SEQ ID NO: 1393287 - DNA, 17 bp, Homo sapiens
ccattgaaggcttaaac

SEQ ID NO: 1393288 - DNA, 21 bp, Homo sapiens
ccattgaaggcttaaacccat

SEQ ID NO: 1393289 - DNA, 13 bp, Homo sapiens
ccatttcagagag

SEQ ID NO: 1393290 - DNA, 16 bp, Homo sapiens
ccatttggcatccctg

SEQ ID NO: 1393291 - DNA, 18 bp, Homo sapiens
ccatttggcatccctggg

SEQ ID NO: 1393292 - DNA, 15 bp, Homo sapiens
cccaacactgccagc

SEQ ID NO: 1393293 - DNA, 12 bp, Homo sapiens
cccacactcaga

SEQ ID NO: 1393294 - DNA, 22 bp, Homo sapiens
cccacactcagatcctcctcat

SEQ ID NO: 1393295 - DNA, 20 bp, Homo sapiens
cccacctgaggctcagccct

SEQ ID NO: 1393296 - DNA, 21 bp, Homo sapiens
cccacctgaggctcagcccta

SEQ ID NO: 1393297 - DNA, 20 bp, Homo sapiens
cccacctggggagtttacta

SEQ ID NO: 1393298 - DNA, 15 bp, Homo sapiens
cccacggcctttcta

SEQ ID NO: 1393299 - DNA, 18 bp, Homo sapiens
cccactgtacttgctctt

SEQ ID NO: 1393300 - DNA, 23 bp, Homo sapiens
cccactgtacttgctcttgatgc

SEQ ID NO: 1393301 - DNA, 22 bp, Homo sapiens
cccagctgtgcttatggtacca

SEQ ID NO: 1393302 - DNA, 15 bp, Homo sapiens
cccaggagacagttc

SEQ ID NO: 1393303 - DNA, 20 bp, Homo sapiens
cctgtagccccagtgacagc

SEQ ID NO: 1393304 - DNA, 16 bp, Homo sapiens
cctgtcgattagactg

SEQ ID NO: 1393305 - DNA, 20 bp, Homo sapiens
cctgtgcctcctcaccccca

SEQ ID NO: 1393306 - DNA, 15 bp, Homo sapiens
cctgtgcctgaccct

SEQ ID NO: 1393307 - DNA, 17 bp, Homo sapiens
cctgttacctactttga

SEQ ID NO: 1393308 - DNA, 14 bp, Homo sapiens
cctgttgcacctca

SEQ ID NO: 1393309 - DNA, 13 bp, Homo sapiens
cctgtttttcaca

SEQ ID NO: 1393310 - DNA, 20 bp, Homo sapiens
cctgtttttcacattttcct

SEQ ID NO: 1393311 - DNA, 23 bp, Homo sapiens
ccttaatcaggtcctcagagaat

SEQ ID NO: 1393312 - DNA, 16 bp, Homo sapiens
ccttactcttcttgaa

SEQ ID NO: 1393313 - DNA, 14 bp, Homo sapiens
ccttagatctggca

SEQ ID NO: 1393314 - DNA, 17 bp, Homo sapiens
ccttatgactgccaaga

SEQ ID NO: 1393315 - DNA, 14 bp, Homo sapiens
ccttcccctgcctg

SEQ ID NO: 1393316 - DNA, 19 bp, Homo sapiens
ccttcctggggcatctggc

SEQ ID NO: 1393317 - DNA, 21 bp, Homo sapiens
ccttctctgttcatttcctca

SEQ ID NO: 1393318 - DNA, 20 bp, Homo sapiens
ccttctgggcagaccttgac

SEQ ID NO: 1393319 - DNA, 18 bp, Homo sapiens
ccttctgtttccatagga

SEQ ID NO: 1393320 - DNA, 15 bp, Homo sapiens
ccttgacaactggca

SEQ ID NO: 1393321 - DNA, 19 bp, Homo sapiens
ccttgagtagtttttatct

SEQ ID NO: 1393322 - DNA, 22 bp, Homo sapiens
ccttgattttagccttctctgt

SEQ ID NO: 1393323 - DNA, 20 bp, Homo sapiens
ccttgcccatgcctccagct

SEQ ID NO: 1393324 - DNA, 16 bp, Homo sapiens
ccttgcggctcctcag

SEQ ID NO: 1393325 - DNA, 17 bp, Homo sapiens
ccttgcggctcctcagg

SEQ ID NO: 1393326 - DNA, 18 bp, Homo sapiens
ccttgcggctcctcaggg

SEQ ID NO: 1393327 - DNA, 20 bp, Homo sapiens
ccttgcggctcctcagggac

SEQ ID NO: 1393328 - DNA, 13 bp, Homo sapiens
ccttggttcctaa

SEQ ID NO: 1393329 - DNA, 22 bp, Homo sapiens
ccttggttcttgaggggaccag

SEQ ID NO: 1393330 - DNA, 15 bp, Homo sapiens
ccttgtcacgccaga

SEQ ID NO: 1393331 - DNA, 14 bp, Homo sapiens
ccttgtttttttct

SEQ ID NO: 1393332 - DNA, 15 bp, Homo sapiens
cctttaaagacttaa

SEQ ID NO: 1393333 - DNA, 20 bp, Homo sapiens
cctttaaagacttaagatta

SEQ ID NO: 1393334 - DNA, 15 bp, Homo sapiens
cctttctagcctggc

SEQ ID NO: 1393335 - DNA, 23 bp, Homo sapiens
ccttttcccaaaatgttgaaata

SEQ ID NO: 1393336 - DNA, 18 bp, Homo sapiens
cctttttatttgcatgtg

SEQ ID NO: 1393337 - DNA, 15 bp, Homo sapiens
cgagatcccaacact

SEQ ID NO: 1393338 - DNA, 21 bp, Homo sapiens
cgagatcccaacactgccagc

SEQ ID NO: 1393339 - DNA, 16 bp, Homo sapiens
cgattctcttgcctca

SEQ ID NO: 1393340 - DNA, 17 bp, Homo sapiens
cgcaccccccaagctgt

SEQ ID NO: 1393341 - DNA, 15 bp, Homo sapiens
cgctaaaagaaactt

SEQ ID NO: 1393342 - DNA, 13 bp, Homo sapiens
cggcctgccagga

SEQ ID NO: 1393343 - DNA, 13 bp, Homo sapiens
cggctcctcaggg

SEQ ID NO: 1393344 - DNA, 23 bp, Homo sapiens
cggctgggaggagggcaggcatc

SEQ ID NO: 1393345 - DNA, 18 bp, Homo sapiens
cgggaattttcatctagg

SEQ ID NO: 1393346 - DNA, 18 bp, Homo sapiens
cgggacacctaggctagg

SEQ ID NO: 1393347 - DNA, 19 bp, Homo sapiens
cgggacacctaggctaggg

SEQ ID NO: 1393348 - DNA, 17 bp, Homo sapiens
cgggagcctgaccctca

SEQ ID NO: 1393349 - DNA, 19 bp, Homo sapiens
cggggctccccttcgcgta

SEQ ID NO: 1393350 - DNA, 18 bp, Homo sapiens
cgggggcagtctgagaga

SEQ ID NO: 1393351 - DNA, 14 bp, Homo sapiens
cgtaagatttcctt

SEQ ID NO: 1393352 - DNA, 23 bp, Homo sapiens
cgtatttaatagcaaagaattga

SEQ ID NO: 1393353 - DNA, 14 bp, Homo sapiens
cgtcagtgctgtgc

SEQ ID NO: 1393354 - DNA, 14 bp, Homo sapiens
cgtgagccacctcg

SEQ ID NO: 1393355 - DNA, 14 bp, Homo sapiens
cgtgggcattgtct

SEQ ID NO: 1393356 - DNA, 15 bp, Homo sapiens
cgtggtggtccctgg

SEQ ID NO: 1393357 - DNA, 21 bp, Homo sapiens
cgtgtctggcacagcctggct

SEQ ID NO: 1393358 - DNA, 23 bp, Homo sapiens
cgtgtgggagaccggcctgccag

SEQ ID NO: 1393359 - DNA, 20 bp, Homo sapiens
cgtgtttctgactctgagct

SEQ ID NO: 1393360 - DNA, 13 bp, Homo sapiens
ctaaaagaaactt

SEQ ID NO: 1393361 - DNA, 18 bp, Homo sapiens
ctaaagccaaacatatat

SEQ ID NO: 1393362 - DNA, 17 bp, Homo sapiens
ctaaagctggtttaatg

SEQ ID NO: 1393363 - DNA, 19 bp, Homo sapiens
ctaacctgccgagagtcca

SEQ ID NO: 1393364 - DNA, 20 bp, Homo sapiens
ctaagaaacatttatattga

SEQ ID NO: 1393365 - DNA, 15 bp, Homo sapiens
ctaagagaagtagaa

SEQ ID NO: 1393366 - DNA, 17 bp, Homo sapiens
ctaagctaggaatgaaa

SEQ ID NO: 1393367 - DNA, 23 bp, Homo sapiens
ctaaggagtgtagcaactacagt

SEQ ID NO: 1393368 - DNA, 19 bp, Homo sapiens
ctaatacagcaacaattta

SEQ ID NO: 1393369 - DNA, 14 bp, Homo sapiens
ctaatctctgtaaa

SEQ ID NO: 1393370 - DNA, 17 bp, Homo sapiens
ctaatcttattcatttt

SEQ ID NO: 1393371 - DNA, 15 bp, Homo sapiens
ctaattcaattcaaa

SEQ ID NO: 1393372 - DNA, 14 bp, Homo sapiens
ctaatttataaaaa

SEQ ID NO: 1393373 - DNA, 23 bp, Homo sapiens
ctaatttttgtatttttagtaga

SEQ ID NO: 1393374 - DNA, 16 bp, Homo sapiens
ctaatttttttgtatt

SEQ ID NO: 1393375 - DNA, 20 bp, Homo sapiens
ctaatttttttgtattttag

SEQ ID NO: 1393376 - DNA, 15 bp, Homo sapiens
ctacataatttagtt

SEQ ID NO: 1393377 - DNA, 14 bp, Homo sapiens
ctacatgaaacaga

SEQ ID NO: 1393378 - DNA, 18 bp, Homo sapiens
ctacatgaaacagaaaca

SEQ ID NO: 1393379 - DNA, 12 bp, Homo sapiens
ctaccatttcag

SEQ ID NO: 1393380 - DNA, 13 bp, Homo sapiens
ctaccccctgtgc

SEQ ID NO: 1393381 - DNA, 14 bp, Homo sapiens
ctacccctcctgcg

SEQ ID NO: 1393382 - DNA, 16 bp, Homo sapiens
ctacccctcctgcgct

SEQ ID NO: 1393383 - DNA, 14 bp, Homo sapiens
ctaccttctgacct

SEQ ID NO: 1393384 - DNA, 13 bp, Homo sapiens
ctactgaagccct

SEQ ID NO: 1393385 - DNA, 21 bp, Homo sapiens
ctactgcccaggcactgcaaa

SEQ ID NO: 1393386 - DNA, 17 bp, Homo sapiens
ctactggtcttgtggaa

SEQ ID NO: 1393387 - DNA, 16 bp, Homo sapiens
ctacttccaaactaat

SEQ ID NO: 1393388 - DNA, 21 bp, Homo sapiens
ctacttgagataatctaaata

SEQ ID NO: 1393389 - DNA, 20 bp, Homo sapiens
ctactttgactttttgcatt

SEQ ID NO: 1393390 - DNA, 17 bp, Homo sapiens
ctactttgatatgactg

SEQ ID NO: 1393391 - DNA, 14 bp, Homo sapiens
ctagaacacaggca

SEQ ID NO: 1393392 - DNA, 19 bp, Homo sapiens
ctagaacacaggcaaaatc

SEQ ID NO: 1393393 - DNA, 21 bp, Homo sapiens
ctagaacacaggcaaaatcct

SEQ ID NO: 1393394 - DNA, 22 bp, Homo sapiens
ctagaacacaggcaaaatcctt

SEQ ID NO: 1393395 - DNA, 13 bp, Homo sapiens
ctagacaagccag

SEQ ID NO: 1393396 - DNA, 17 bp, Homo sapiens
ctagacaagccagaact

SEQ ID NO: 1393397 - DNA, 13 bp, Homo sapiens
ctagacactgcca

SEQ ID NO: 1393398 - DNA, 18 bp, Homo sapiens
ctagagacctctcaacag

SEQ ID NO: 1393399 - DNA, 15 bp, Homo sapiens
ctagagcactgccac

SEQ ID NO: 1393400 - DNA, 18 bp, Homo sapiens
ctagagcactgccaccag

SEQ ID NO: 1393401 - DNA, 18 bp, Homo sapiens
ctagaggcttccttcatt

SEQ ID NO: 1393402 - DNA, 23 bp, Homo sapiens
ctagaggcttccttcatttcctc

SEQ ID NO: 1393403 - DNA, 15 bp, Homo sapiens
ctagaggtgagaaat

SEQ ID NO: 1393404 - DNA, 18 bp, Homo sapiens
ctagcccaatgaaatgaa

SEQ ID NO: 1393405 - DNA, 13 bp, Homo sapiens
ctagccctcagcc

SEQ ID NO: 1393406 - DNA, 18 bp, Homo sapiens
ctagccctctcacattta

SEQ ID NO: 1393407 - DNA, 22 bp, Homo sapiens
ctagccttaatcaggtcctcag

SEQ ID NO: 1393408 - DNA, 20 bp, Homo sapiens
ctagcgctatctccctgcct

SEQ ID NO: 1393409 - DNA, 16 bp, Homo sapiens
ctaggaaatgtacgat

SEQ ID NO: 1393410 - DNA, 17 bp, Homo sapiens
ctaggaatgaaatcctg

SEQ ID NO: 1393411 - DNA, 21 bp, Homo sapiens
ctaggccttgcggctcctcag

SEQ ID NO: 1393412 - DNA, 15 bp, Homo sapiens
ctagggtggggagag

SEQ ID NO: 1393413 - DNA, 15 bp, Homo sapiens
ctagttctgccagga

SEQ ID NO: 1393414 - DNA, 16 bp, Homo sapiens
ctagttttctcctccc

SEQ ID NO: 1393415 - DNA, 17 bp, Homo sapiens
ctagttttctcctccca

SEQ ID NO: 1393416 - DNA, 18 bp, Homo sapiens
ctagttttctcctcccag

SEQ ID NO: 1393417 - DNA, 17 bp, Homo sapiens
ctataagaactttgagc

SEQ ID NO: 1393418 - DNA, 17 bp, Homo sapiens
ctatactgcatactttt

SEQ ID NO: 1393419 - DNA, 19 bp, Homo sapiens
ctatagccaaaaatagcta

SEQ ID NO: 1393420 - DNA, 19 bp, Homo sapiens
ctatataccaaagcacatt

SEQ ID NO: 1393421 - DNA, 16 bp, Homo sapiens
ctatatttaacaagat

SEQ ID NO: 1393422 - DNA, 19 bp, Homo sapiens
ctatcaaataactaaggaa

SEQ ID NO: 1393423 - DNA, 17 bp, Homo sapiens
ctatcaaccccagacac

SEQ ID NO: 1393424 - DNA, 19 bp, Homo sapiens
ctatcaaccccagacactg

SEQ ID NO: 1393425 - DNA, 17 bp, Homo sapiens
ctatctccctgcctcct

SEQ ID NO: 1393426 - DNA, 18 bp, Homo sapiens
ctatctctagagtgagaa

SEQ ID NO: 1393427 - DNA, 17 bp, Homo sapiens
ctatctctgtgtgcaca

SEQ ID NO: 1393428 - DNA, 16 bp, Homo sapiens
ctatctgggaagctat

SEQ ID NO: 1393429 - DNA, 21 bp, Homo sapiens
ctatgacctcgccctccacaa

SEQ ID NO: 1393430 - DNA, 11 bp, Homo sapiens
ctatgctttga

SEQ ID NO: 1393431 - DNA, 15 bp, Homo sapiens
ctatgctttgaaaca

SEQ ID NO: 1393432 - DNA, 17 bp, Homo sapiens
ctatgctttgaaacaga

SEQ ID NO: 1393433 - DNA, 19 bp, Homo sapiens
ctatggagtgcaccaaaga

SEQ ID NO: 1393434 - DNA, 16 bp, Homo sapiens
ctatggtgctctgtct

SEQ ID NO: 1393435 - DNA, 16 bp, Homo sapiens
ctatgtttttaatgta

SEQ ID NO: 1393436 - DNA, 20 bp, Homo sapiens
ctattaatatttatgtgttt

SEQ ID NO: 1393437 - DNA, 17 bp, Homo sapiens
ctattatccccatttct

SEQ ID NO: 1393438 - DNA, 18 bp, Homo sapiens
ctatttcttaaacacttg

SEQ ID NO: 1393439 - DNA, 18 bp, Homo sapiens
ctattttcagatgtgaac

SEQ ID NO: 1393440 - DNA, 14 bp, Homo sapiens
ctcaaactcctgac

SEQ ID NO: 1393441 - DNA, 15 bp, Homo sapiens
ctcaactgcctactc

SEQ ID NO: 1393442 - DNA, 15 bp, Homo sapiens
ctcaagagatcccaa

SEQ ID NO: 1393443 - DNA, 16 bp, Homo sapiens
ctcaatttctgaacac

SEQ ID NO: 1393444 - DNA, 22 bp, Homo sapiens
ctcacaaaccatgcaaatgcta

SEQ ID NO: 1393445 - DNA, 20 bp, Homo sapiens
ctcaccaggcagcctctggg

SEQ ID NO: 1393446 - DNA, 11 bp, Homo sapiens
ctcacctcctc

SEQ ID NO: 1393447 - DNA, 19 bp, Homo sapiens
ctcacctgagtcaccctac

SEQ ID NO: 1393448 - DNA, 22 bp, Homo sapiens
ctcacgcctgtaatcccagcat

SEQ ID NO: 1393449 - DNA, 12 bp, Homo sapiens
ctcacttcaggt

SEQ ID NO: 1393450 - DNA, 20 bp, Homo sapiens
ctcacttctgggcttcatct

SEQ ID NO: 1393451 - DNA, 14 bp, Homo sapiens
ctcagaccctttct

SEQ ID NO: 1393452 - DNA, 15 bp, Homo sapiens
ctcagaccctttctt

SEQ ID NO: 1393453 - DNA, 14 bp, Homo sapiens
ctcagactctaaga

SEQ ID NO: 1393454 - DNA, 14 bp, Homo sapiens
ctcagatcctcctc

SEQ ID NO: 1393455 - DNA, 17 bp, Homo sapiens
ctcaggaaccgaggcag

SEQ ID NO: 1393456 - DNA, 18 bp, Homo sapiens
ctcaggaaccgaggcagg

SEQ ID NO: 1393457 - DNA, 12 bp, Homo sapiens
ctcaggagccct

SEQ ID NO: 1393458 - DNA, 13 bp, Homo sapiens
ctcaggagccctg

SEQ ID NO: 1393459 - DNA, 22 bp, Homo sapiens
ctcaggagccctgggaggctct

SEQ ID NO: 1393460 - DNA, 17 bp, Homo sapiens
ctcaggccagagccaag

SEQ ID NO: 1393461 - DNA, 22 bp, Homo sapiens
ctcaggcccccacctggctcac

SEQ ID NO: 1393462 - DNA, 16 bp, Homo sapiens
ctcagtaaagcacttg

SEQ ID NO: 1393463 - DNA, 13 bp, Homo sapiens
ctcagtaatttag

SEQ ID NO: 1393464 - DNA, 18 bp, Homo sapiens
ctcagtaatttagaaatc

SEQ ID NO: 1393465 - DNA, 13 bp, Homo sapiens
ctcagtaatttgt

SEQ ID NO: 1393466 - DNA, 15 bp, Homo sapiens
ctcagttgattttct

SEQ ID NO: 1393467 - DNA, 18 bp, Homo sapiens
ctcagttgattttctgga

SEQ ID NO: 1393468 - DNA, 14 bp, Homo sapiens
ctcatcaactgaat

SEQ ID NO: 1393469 - DNA, 16 bp, Homo sapiens
ctcatctttcttccaa

SEQ ID NO: 1393470 - DNA, 20 bp, Homo sapiens
ctcatgcaaatcaattactg

SEQ ID NO: 1393471 - DNA, 13 bp, Homo sapiens
ctcatgtaaaata

SEQ ID NO: 1393472 - DNA, 17 bp, Homo sapiens
ctcatgtaaaataagaa

SEQ ID NO: 1393473 - DNA, 14 bp, Homo sapiens
ctcatgtgactctt

SEQ ID NO: 1393474 - DNA, 16 bp, Homo sapiens
ctccaaaaaagaaaca

SEQ ID NO: 1393475 - DNA, 14 bp, Homo sapiens
ctccaagagctaca

SEQ ID NO: 1393476 - DNA, 22 bp, Homo sapiens
ctccaaggaggggctgtaaaat

SEQ ID NO: 1393477 - DNA, 23 bp, Homo sapiens
ctccagccatcaagagactgagt

SEQ ID NO: 1393478 - DNA, 12 bp, Homo sapiens
ctccatccctgg

SEQ ID NO: 1393479 - DNA, 16 bp, Homo sapiens
ctccatccctggcccc

SEQ ID NO: 1393480 - DNA, 19 bp, Homo sapiens
ctccatccctggccccctc

SEQ ID NO: 1393481 - DNA, 17 bp, Homo sapiens
ctcccaccactccactc

SEQ ID NO: 1393482 - DNA, 22 bp, Homo sapiens
ctcccagcctacccctcctgcg

SEQ ID NO: 1393483 - DNA, 15 bp, Homo sapiens
ctcccatgcctggtc

SEQ ID NO: 1393484 - DNA, 14 bp, Homo sapiens
ctccccctcttggt

SEQ ID NO: 1393485 - DNA, 14 bp, Homo sapiens
ctcccctccatccc

SEQ ID NO: 1393486 - DNA, 23 bp, Homo sapiens
ctcccctccatccctggccccct

SEQ ID NO: 1393487 - DNA, 18 bp, Homo sapiens
ctccctatactgcttgga

SEQ ID NO: 1393488 - DNA, 23 bp, Homo sapiens
ctccctcagtgccctcattttat

SEQ ID NO: 1393489 - DNA, 11 bp, Homo sapiens
ctccctcctcg

SEQ ID NO: 1393490 - DNA, 16 bp, Homo sapiens
ctccggaatgaccagc

SEQ ID NO: 1393491 - DNA, 19 bp, Homo sapiens
ctccgtccaggagcctggc

SEQ ID NO: 1393492 - DNA, 18 bp, Homo sapiens
ctccgtgtgggagaccgg

SEQ ID NO: 1393493 - DNA, 17 bp, Homo sapiens
ctcctcacccccagctt

SEQ ID NO: 1393494 - DNA, 24 bp, Homo sapiens
ctcctctgcccgggagctcaggaa

SEQ ID NO: 1393495 - DNA, 19 bp, Homo sapiens
ctcctgaggatgtgtccca

SEQ ID NO: 1393496 - DNA, 15 bp, Homo sapiens
ctcctgccggctcct

SEQ ID NO: 1393497 - DNA, 14 bp, Homo sapiens
ctcctgcctgtgtt

SEQ ID NO: 1393498 - DNA, 16 bp, Homo sapiens
ctcctgtctccctcct

SEQ ID NO: 1393499 - DNA, 13 bp, Homo sapiens
ctccttaaggctc

SEQ ID NO: 1393500 - DNA, 22 bp, Homo sapiens
ctccttaaggctcttttgtaag

SEQ ID NO: 1393501 - DNA, 21 bp, Homo sapiens
ctccttgattttagccttctc

SEQ ID NO: 1393502 - DNA, 21 bp, Homo sapiens
ctccttggttcttgaggggac

SEQ ID NO: 1393503 - DNA, 13 bp, Homo sapiens
ctcgagatcccaa

SEQ ID NO: 1393504 - DNA, 22 bp, Homo sapiens
ctcgagatcccaacactgccag

SEQ ID NO: 1393505 - DNA, 14 bp, Homo sapiens
ctcggatctctcct

SEQ ID NO: 1393506 - DNA, 14 bp, Homo sapiens
ctcgtatagcatgc

SEQ ID NO: 1393507 - DNA, 14 bp, Homo sapiens
ctctaagaaagaac

SEQ ID NO: 1393508 - DNA, 15 bp, Homo sapiens
ctctaatacattcca

SEQ ID NO: 1393509 - DNA, 21 bp, Homo sapiens
ctctacttctttttctttgag

SEQ ID NO: 1393510 - DNA, 15 bp, Homo sapiens
ctctagtattccaga

SEQ ID NO: 1393511 - DNA, 16 bp, Homo sapiens
ctctcatcaactgaat

SEQ ID NO: 1393512 - DNA, 21 bp, Homo sapiens
ctctccactcatgtgactctt

SEQ ID NO: 1393513 - DNA, 15 bp, Homo sapiens
ctctccggtctctct

SEQ ID NO: 1393514 - DNA, 19 bp, Homo sapiens
ctctctacaaactcccact

SEQ ID NO: 1393515 - DNA, 12 bp, Homo sapiens
ctctctgcaggt

SEQ ID NO: 1393516 - DNA, 17 bp, Homo sapiens
ctctctgcaggtcccta

SEQ ID NO: 1393517 - DNA, 14 bp, Homo sapiens
ctctgaaagagaaa

SEQ ID NO: 1393518 - DNA, 16 bp, Homo sapiens
ctctgaaagagaaaca

SEQ ID NO: 1393519 - DNA, 14 bp, Homo sapiens
ctctgattatcagg

SEQ ID NO: 1393520 - DNA, 15 bp, Homo sapiens
ctctgattttcaaag

SEQ ID NO: 1393521 - DNA, 18 bp, Homo sapiens
ctctgattttcaaagctt

SEQ ID NO: 1393522 - DNA, 17 bp, Homo sapiens
ctctgcaggtccctaat

SEQ ID NO: 1393523 - DNA, 18 bp, Homo sapiens
ctctgcaggtccctaata

SEQ ID NO: 1393524 - DNA, 19 bp, Homo sapiens
ctctgcaggtccctaataa

SEQ ID NO: 1393525 - DNA, 16 bp, Homo sapiens
ctctgccccttctgtt

SEQ ID NO: 1393526 - DNA, 20 bp, Homo sapiens
ctctgccccttctgtttcca

SEQ ID NO: 1393527 - DNA, 12 bp, Homo sapiens
ctctggagccca

SEQ ID NO: 1393528 - DNA, 15 bp, Homo sapiens
ctctggagcccactg

SEQ ID NO: 1393529 - DNA, 20 bp, Homo sapiens
ctctgtcactcctcatgcct

SEQ ID NO: 1393530 - DNA, 17 bp, Homo sapiens
ctctgtcttctggactg

SEQ ID NO: 1393531 - DNA, 20 bp, Homo sapiens
ctctgtgcacttatttatga

SEQ ID NO: 1393532 - DNA, 22 bp, Homo sapiens
ctctgtgcttttaaatgcataa

SEQ ID NO: 1393533 - DNA, 17 bp, Homo sapiens
ctctgtgggctggcagt

SEQ ID NO: 1393534 - DNA, 13 bp, Homo sapiens
ctctgttcatttc

SEQ ID NO: 1393535 - DNA, 20 bp, Homo sapiens
ctcttattgcctcacttcag

SEQ ID NO: 1393536 - DNA, 20 bp, Homo sapiens
ctcttccgtgacgtcactgg

SEQ ID NO: 1393537 - DNA, 17 bp, Homo sapiens
ctcttctattttgtaaa

SEQ ID NO: 1393538 - DNA, 19 bp, Homo sapiens
ctcttctattttgtaaact

SEQ ID NO: 1393539 - DNA, 12 bp, Homo sapiens
ctcttctgagct

SEQ ID NO: 1393540 - DNA, 18 bp, Homo sapiens
ctcttctgagctatttca

SEQ ID NO: 1393541 - DNA, 21 bp, Homo sapiens
ctcttctgagctatttcatct

SEQ ID NO: 1393542 - DNA, 15 bp, Homo sapiens
ctcttcttgaaattt

SEQ ID NO: 1393543 - DNA, 16 bp, Homo sapiens
ctcttgatgcctggcg

SEQ ID NO: 1393544 - DNA, 13 bp, Homo sapiens
ctgaaaatgtgct

SEQ ID NO: 1393545 - DNA, 16 bp, Homo sapiens
ctgaaagccatggaga

SEQ ID NO: 1393546 - DNA, 16 bp, Homo sapiens
ctgaacaagaattgga

SEQ ID NO: 1393547 - DNA, 20 bp, Homo sapiens
ctgaacaccattgaaggctt

SEQ ID NO: 1393548 - DNA, 13 bp, Homo sapiens
ctgaagcccttgt

SEQ ID NO: 1393549 - DNA, 20 bp, Homo sapiens
ctgaatccaaactaatccat

SEQ ID NO: 1393550 - DNA, 12 bp, Homo sapiens
ctgaatttttaa

SEQ ID NO: 1393551 - DNA, 22 bp, Homo sapiens
ctgacaacatttctatagccaa

SEQ ID NO: 1393552 - DNA, 19 bp, Homo sapiens
ctgacactttaattaccaa

SEQ ID NO: 1393553 - DNA, 21 bp, Homo sapiens
ctgagaaaagctttgaaccct

SEQ ID NO: 1393554 - DNA, 14 bp, Homo sapiens
ctgagaatttgtgt

SEQ ID NO: 1393555 - DNA, 15 bp, Homo sapiens
ctgagacaatgcctt

SEQ ID NO: 1393556 - DNA, 22 bp, Homo sapiens
ctgagagaggccattctttccc

SEQ ID NO: 1393557 - DNA, 14 bp, Homo sapiens
ctgagagctcacag

SEQ ID NO: 1393558 - DNA, 19 bp, Homo sapiens
ctgagatacatacagaatt

SEQ ID NO: 1393559 - DNA, 12 bp, Homo sapiens
ctgagatatgaa

SEQ ID NO: 1393560 - DNA, 23 bp, Homo sapiens
ctgagcccggtaagagcaaaaga

SEQ ID NO: 1393561 - DNA, 16 bp, Homo sapiens
ctgaggaattttcttt

SEQ ID NO: 1393562 - DNA, 18 bp, Homo sapiens
ctgagtcgtacagaaagc

SEQ ID NO: 1393563 - DNA, 21 bp, Homo sapiens
ctgagtcgtacagaaagctgc

SEQ ID NO: 1393564 - DNA, 11 bp, Homo sapiens
ctgagtgactc

SEQ ID NO: 1393565 - DNA, 11 bp, Homo sapiens
ctgagttttcc

SEQ ID NO: 1393566 - DNA, 19 bp, Homo sapiens
ctgagttttccatggcagg

SEQ ID NO: 1393567 - DNA, 15 bp, Homo sapiens
ctgataattttaaat

SEQ ID NO: 1393568 - DNA, 17 bp, Homo sapiens
ctgataattttaaattc

SEQ ID NO: 1393569 - DNA, 20 bp, Homo sapiens
ctgatagggtttgtgacagg

SEQ ID NO: 1393570 - DNA, 23 bp, Homo sapiens
ctgatagggtttgtgacagggcg

SEQ ID NO: 1393571 - DNA, 12 bp, Homo sapiens
ctgatgaaaata

SEQ ID NO: 1393572 - DNA, 14 bp, Homo sapiens
ctgatgaaaataaa

SEQ ID NO: 1393573 - DNA, 16 bp, Homo sapiens
ctgatgaaaataaaga

SEQ ID NO: 1393574 - DNA, 21 bp, Homo sapiens
ctgatggggtggaaggcatgg

SEQ ID NO: 1393575 - DNA, 20 bp, Homo sapiens
ctgcaaacctgacccctgct

SEQ ID NO: 1393576 - DNA, 17 bp, Homo sapiens
ctgcaaggtctttggtt

SEQ ID NO: 1393577 - DNA, 18 bp, Homo sapiens
ctgcacaataaaaatgtt

SEQ ID NO: 1393578 - DNA, 17 bp, Homo sapiens
ctgcaggtccctaataa

SEQ ID NO: 1393579 - DNA, 18 bp, Homo sapiens
ctgcaggtccctaataaa

SEQ ID NO: 1393580 - DNA, 22 bp, Homo sapiens
ctgcaggtccctaataaagctg

SEQ ID NO: 1393581 - DNA, 14 bp, Homo sapiens
ctgcatacttttta

SEQ ID NO: 1393582 - DNA, 19 bp, Homo sapiens
ctgcatccattctcctgag

SEQ ID NO: 1393583 - DNA, 21 bp, Homo sapiens
ctgcatctagaggcttccttc

SEQ ID NO: 1393584 - DNA, 17 bp, Homo sapiens
ctgccaagactgctgtg

SEQ ID NO: 1393585 - DNA, 18 bp, Homo sapiens
ctgccaggaggacccagg

SEQ ID NO: 1393586 - DNA, 22 bp, Homo sapiens
ctgccaggaggacccagggctc

SEQ ID NO: 1393587 - DNA, 16 bp, Homo sapiens
ctgccccttctgtttc

SEQ ID NO: 1393588 - DNA, 18 bp, Homo sapiens
ctgcccgggagctcagga

SEQ ID NO: 1393589 - DNA, 23 bp, Homo sapiens
ctgccgagagtccatcagcctcc

SEQ ID NO: 1393590 - DNA, 16 bp, Homo sapiens
ctgcctcccatgcctg

SEQ ID NO: 1393591 - DNA, 22 bp, Homo sapiens
ctgcctcctgccggctccttgg

SEQ ID NO: 1393592 - DNA, 18 bp, Homo sapiens
ctgcctctctgcaggtcc

SEQ ID NO: 1393593 - DNA, 19 bp, Homo sapiens
ctgcctctctgcaggtccc

SEQ ID NO: 1393594 - DNA, 17 bp, Homo sapiens
ctgcctggaccagcctc

SEQ ID NO: 1393595 - DNA, 15 bp, Homo sapiens
ctgcctggtatgagt

SEQ ID NO: 1393596 - DNA, 19 bp, Homo sapiens
ctgctcagtaaagcacttg

SEQ ID NO: 1393597 - DNA, 17 bp, Homo sapiens
ctgctgatattttctct

SEQ ID NO: 1393598 - DNA, 12 bp, Homo sapiens
ctgctgtggcca

SEQ ID NO: 1393599 - DNA, 17 bp, Homo sapiens
ctgctgtggccaggagg

SEQ ID NO: 1393600 - DNA, 21 bp, Homo sapiens
ctgctgtggccaggaggtgcc

SEQ ID NO: 1393601 - DNA, 24 bp, Homo sapiens
ctgcttccaattttctggaataca

SEQ ID NO: 1393602 - DNA, 13 bp, Homo sapiens
ctgcttgattttt

SEQ ID NO: 1393603 - DNA, 23 bp, Homo sapiens
ctggaaaataatactgctgagat

SEQ ID NO: 1393604 - DNA, 20 bp, Homo sapiens
ctggaacactagacaagcca

SEQ ID NO: 1393605 - DNA, 21 bp, Homo sapiens
ctggaacactagacaagccag

SEQ ID NO: 1393606 - DNA, 22 bp, Homo sapiens
ctggaacactagacaagccaga

SEQ ID NO: 1393607 - DNA, 16 bp, Homo sapiens
ctggaacttgaactga

SEQ ID NO: 1393608 - DNA, 20 bp, Homo sapiens
ctggaacttgaactgattca

SEQ ID NO: 1393609 - DNA, 21 bp, Homo sapiens
ctggaagacgcaagggcctga

SEQ ID NO: 1393610 - DNA, 15 bp, Homo sapiens
ctggaccactgggca

SEQ ID NO: 1393611 - DNA, 12 bp, Homo sapiens
ctggaccagcct

SEQ ID NO: 1393612 - DNA, 19 bp, Homo sapiens
ctggactgtcatagaaatt

SEQ ID NO: 1393613 - DNA, 21 bp, Homo sapiens
ctggagcccactgtacttgct

SEQ ID NO: 1393614 - DNA, 21 bp, Homo sapiens
ctggattccccatctcaggcc

SEQ ID NO: 1393615 - DNA, 16 bp, Homo sapiens
ctggcacagcctggct

SEQ ID NO: 1393616 - DNA, 23 bp, Homo sapiens
ctggcacagcctggctgtggcct

SEQ ID NO: 1393617 - DNA, 24 bp, Homo sapiens
ctggcaggcaggctcccagggaca

SEQ ID NO: 1393618 - DNA, 22 bp, Homo sapiens
ctggcagtcctggaagccagct

SEQ ID NO: 1393619 - DNA, 15 bp, Homo sapiens
ctggcattacagctg

SEQ ID NO: 1393620 - DNA, 16 bp, Homo sapiens
ctggcattacagctgg

SEQ ID NO: 1393621 - DNA, 13 bp, Homo sapiens
ctggccccctccc

SEQ ID NO: 1393622 - DNA, 17 bp, Homo sapiens
ctggccccctccctgga

SEQ ID NO: 1393623 - DNA, 18 bp, Homo sapiens
ctggccccctccctggat

SEQ ID NO: 1393624 - DNA, 19 bp, Homo sapiens
ctggccccctccctggatg

SEQ ID NO: 1393625 - DNA, 18 bp, Homo sapiens
ctgggagaaatctggctt

SEQ ID NO: 1393626 - DNA, 19 bp, Homo sapiens
ctgggaggagggcaggcat

SEQ ID NO: 1393627 - DNA, 15 bp, Homo sapiens
ctgggaggctctgga

SEQ ID NO: 1393628 - DNA, 16 bp, Homo sapiens
ctgggaggctctggag

SEQ ID NO: 1393629 - DNA, 22 bp, Homo sapiens
ctgggaggctctggagcccact

SEQ ID NO: 1393630 - DNA, 19 bp, Homo sapiens
ctgggcaatgatggcaatt

SEQ ID NO: 1393631 - DNA, 13 bp, Homo sapiens
ctgggcaggaggg

SEQ ID NO: 1393632 - DNA, 10 bp, Homo sapiens
ctgggcccct

SEQ ID NO: 1393633 - DNA, 12 bp, Homo sapiens
ctgggcccctgc

SEQ ID NO: 1393634 - DNA, 15 bp, Homo sapiens
ctgggcttcatctgg

SEQ ID NO: 1393635 - DNA, 23 bp, Homo sapiens
ctggggagtttactacctgggga

SEQ ID NO: 1393636 - DNA, 15 bp, Homo sapiens
ctggggccaggctgg

SEQ ID NO: 1393637 - DNA, 17 bp, Homo sapiens
ctggggggtggccaggc

SEQ ID NO: 1393638 - DNA, 13 bp, Homo sapiens
ctgggtcgccctg

SEQ ID NO: 1393639 - DNA, 18 bp, Homo sapiens
ctggtatatccaaaagct

SEQ ID NO: 1393640 - DNA, 19 bp, Homo sapiens
ctggtctcaaactcctgac

SEQ ID NO: 1393641 - DNA, 20 bp, Homo sapiens
ctggtcttgtggaattggga

SEQ ID NO: 1393642 - DNA, 20 bp, Homo sapiens
ctggtgaagctcacttctgg

SEQ ID NO: 1393643 - DNA, 15 bp, Homo sapiens
ctggtgccaatttca

SEQ ID NO: 1393644 - DNA, 22 bp, Homo sapiens
ctggtggtggctcgggaggcga

SEQ ID NO: 1393645 - DNA, 14 bp, Homo sapiens
ctggttagaaatgc

SEQ ID NO: 1393646 - DNA, 23 bp, Homo sapiens
ctggttagaaatgcagaatccta

SEQ ID NO: 1393647 - DNA, 14 bp, Homo sapiens
ctggtttaatgttt

SEQ ID NO: 1393648 - DNA, 17 bp, Homo sapiens
ctgtaaacccctgggta

SEQ ID NO: 1393649 - DNA, 22 bp, Homo sapiens
ctgtaaacccctgggtaactgt

SEQ ID NO: 1393650 - DNA, 12 bp, Homo sapiens
ctgtaaactgtg

SEQ ID NO: 1393651 - DNA, 14 bp, Homo sapiens
ctgtaaactgtgta

SEQ ID NO: 1393652 - DNA, 20 bp, Homo sapiens
ctgtaaactgtgtattccaa

SEQ ID NO: 1393653 - DNA, 13 bp, Homo sapiens
ctgtaagaaacct

SEQ ID NO: 1393654 - DNA, 19 bp, Homo sapiens
ctgtaattgaatattattc

SEQ ID NO: 1393655 - DNA, 13 bp, Homo sapiens
ctgtacactgcac

SEQ ID NO: 1393656 - DNA, 15 bp, Homo sapiens
ctgtaccaagcccct

SEQ ID NO: 1393657 - DNA, 17 bp, Homo sapiens
ctgtactcctaattaag

SEQ ID NO: 1393658 - DNA, 22 bp, Homo sapiens
ctgtacttgctcttgatgcctg

SEQ ID NO: 1393659 - DNA, 17 bp, Homo sapiens
ctgtagccccagtgaca

SEQ ID NO: 1393660 - DNA, 20 bp, Homo sapiens
ctgtagtgtcactcaaggcg

SEQ ID NO: 1393661 - DNA, 21 bp, Homo sapiens
ctgtataccccgtgaagcatc

SEQ ID NO: 1393662 - DNA, 15 bp, Homo sapiens
ctgtattcagacaga

SEQ ID NO: 1393663 - DNA, 16 bp, Homo sapiens
ctgtattcagacagat

SEQ ID NO: 1393664 - DNA, 16 bp, Homo sapiens
ctgtcatcaattaaag

SEQ ID NO: 1393665 - DNA, 23 bp, Homo sapiens
ctgtcatcaattaaaggcaaagg

SEQ ID NO: 1393666 - DNA, 13 bp, Homo sapiens
ctgtcctttctag

SEQ ID NO: 1393667 - DNA, 21 bp, Homo sapiens
ctgtcctttctagagcactgc

SEQ ID NO: 1393668 - DNA, 20 bp, Homo sapiens
ctgtctacttgctcaggtac

SEQ ID NO: 1393669 - DNA, 15 bp, Homo sapiens
ctgtctgctcagaca

SEQ ID NO: 1393670 - DNA, 14 bp, Homo sapiens
ctgtcttctggact

SEQ ID NO: 1393671 - DNA, 15 bp, Homo sapiens
ctgtcttctggactg

SEQ ID NO: 1393672 - DNA, 21 bp, Homo sapiens
ctgtgaccctcaattcatatt

SEQ ID NO: 1393673 - DNA, 16 bp, Homo sapiens
ctgtgcctcctcaccc

SEQ ID NO: 1393674 - DNA, 17 bp, Homo sapiens
ctgtgcttttaaatgca

SEQ ID NO: 1393675 - DNA, 23 bp, Homo sapiens
ctgtggattttttccttcaaagt

SEQ ID NO: 1393676 - DNA, 12 bp, Homo sapiens
ctgtggccagga

SEQ ID NO: 1393677 - DNA, 15 bp, Homo sapiens
ctgtgggctggcagt

SEQ ID NO: 1393678 - DNA, 17 bp, Homo sapiens
ctgtgtacataactgaa

SEQ ID NO: 1393679 - DNA, 15 bp, Homo sapiens
ctgtgtactgcagtt

SEQ ID NO: 1393680 - DNA, 15 bp, Homo sapiens
ctgtgtattccaaga

SEQ ID NO: 1393681 - DNA, 19 bp, Homo sapiens
ctgtgtattccaagacatg

SEQ ID NO: 1393682 - DNA, 16 bp, Homo sapiens
ctgtgtgctcaggagc

SEQ ID NO: 1393683 - DNA, 15 bp, Homo sapiens
ctgtgtggcagtctg

SEQ ID NO: 1393684 - DNA, 18 bp, Homo sapiens
ctgtgtttggctttcagg

SEQ ID NO: 1393685 - DNA, 22 bp, Homo sapiens
ctgtgtttggctttcagggagg

SEQ ID NO: 1393686 - DNA, 17 bp, Homo sapiens
ctgttcacttttcctcc

SEQ ID NO: 1393687 - DNA, 16 bp, Homo sapiens
ctgttgagttggacac

SEQ ID NO: 1393688 - DNA, 18 bp, Homo sapiens
ctgttgcacctcaggcag

SEQ ID NO: 1393689 - DNA, 23 bp, Homo sapiens
ctgtttggaaattgattttgaac

SEQ ID NO: 1393690 - DNA, 12 bp, Homo sapiens
ctgttttcttct

SEQ ID NO: 1393691 - DNA, 15 bp, Homo sapiens
ctgtttttcggacag

SEQ ID NO: 1393692 - DNA, 17 bp, Homo sapiens
ctgtttttctaactggg

SEQ ID NO: 1393693 - DNA, 17 bp, Homo sapiens
cttaaataagaaacttt

SEQ ID NO: 1393694 - DNA, 17 bp, Homo sapiens
cttaaggtgtagccaca

SEQ ID NO: 1393695 - DNA, 17 bp, Homo sapiens
cttaagtcagaacagca

SEQ ID NO: 1393696 - DNA, 22 bp, Homo sapiens
cttaatcaggtcctcagagaat

SEQ ID NO: 1393697 - DNA, 15 bp, Homo sapiens
cttaatttattatta

SEQ ID NO: 1393698 - DNA, 19 bp, Homo sapiens
cttaccaggcaccaaaaga

SEQ ID NO: 1393699 - DNA, 20 bp, Homo sapiens
cttaccaggcaccaaaagaa

SEQ ID NO: 1393700 - DNA, 16 bp, Homo sapiens
cttatacgagtaatat

SEQ ID NO: 1393701 - DNA, 21 bp, Homo sapiens
cttattaacaattaggcagac

SEQ ID NO: 1393702 - DNA, 14 bp, Homo sapiens
cttattcattttct

SEQ ID NO: 1393703 - DNA, 15 bp, Homo sapiens
cttattggaactctg

SEQ ID NO: 1393704 - DNA, 13 bp, Homo sapiens
cttcaaatgcctg

SEQ ID NO: 1393705 - DNA, 16 bp, Homo sapiens
cttcaaatgcctgact

SEQ ID NO: 1393706 - DNA, 20 bp, Homo sapiens
cttcaacaattctaaaatga

SEQ ID NO: 1393707 - DNA, 22 bp, Homo sapiens
cttcaagcatggctattttata

SEQ ID NO: 1393708 - DNA, 20 bp, Homo sapiens
cttcaaggaaaataagtgaa

SEQ ID NO: 1393709 - DNA, 22 bp, Homo sapiens
cttcaaggaaaataagtgaaat

SEQ ID NO: 1393710 - DNA, 10 bp, Homo sapiens
cttcaggtcc

SEQ ID NO: 1393711 - DNA, 20 bp, Homo sapiens
cttcagtgtatggaaataaa

SEQ ID NO: 1393712 - DNA, 17 bp, Homo sapiens
cttcagttatgattttt

SEQ ID NO: 1393713 - DNA, 19 bp, Homo sapiens
cttccaaacaggctcagag

SEQ ID NO: 1393714 - DNA, 16 bp, Homo sapiens
cttccaaactaatttt

SEQ ID NO: 1393715 - DNA, 15 bp, Homo sapiens
cttcctctaggaaat

SEQ ID NO: 1393716 - DNA, 16 bp, Homo sapiens
cttcctgacactttaa

SEQ ID NO: 1393717 - DNA, 18 bp, Homo sapiens
cttcctgacactttaatt

SEQ ID NO: 1393718 - DNA, 16 bp, Homo sapiens
cttctagttctgccag

SEQ ID NO: 1393719 - DNA, 18 bp, Homo sapiens
cttctagttctgccagga

SEQ ID NO: 1393720 - DNA, 17 bp, Homo sapiens
cttctattttgtaaact

SEQ ID NO: 1393721 - DNA, 14 bp, Homo sapiens
cttctcatgatcca

SEQ ID NO: 1393722 - DNA, 14 bp, Homo sapiens
cttctctgttcatt

SEQ ID NO: 1393723 - DNA, 18 bp, Homo sapiens
cttctgaactcaaactga

SEQ ID NO: 1393724 - DNA, 17 bp, Homo sapiens
cttctgagctatttcat

SEQ ID NO: 1393725 - DNA, 14 bp, Homo sapiens
cttctgccttctca

SEQ ID NO: 1393726 - DNA, 12 bp, Homo sapiens
cttctggccagg

SEQ ID NO: 1393727 - DNA, 22 bp, Homo sapiens
cttctggccaggaagctttggt

SEQ ID NO: 1393728 - DNA, 14 bp, Homo sapiens
cttgaactgattca

SEQ ID NO: 1393729 - DNA, 21 bp, Homo sapiens
cttgaagttctgaaatttaac

SEQ ID NO: 1393730 - DNA, 14 bp, Homo sapiens
cttgacaactggca

SEQ ID NO: 1393731 - DNA, 21 bp, Homo sapiens
cttgagataatctaaatataa

SEQ ID NO: 1393732 - DNA, 22 bp, Homo sapiens
cttgagataatctaaatataaa

SEQ ID NO: 1393733 - DNA, 21 bp, Homo sapiens
cttgaggggaccaggagtggg

SEQ ID NO: 1393734 - DNA, 17 bp, Homo sapiens
cttgatgggattctgga

SEQ ID NO: 1393735 - DNA, 19 bp, Homo sapiens
cttgattttagccttctct

SEQ ID NO: 1393736 - DNA, 23 bp, Homo sapiens
cttgcaggaaggactatgaaaag

SEQ ID NO: 1393737 - DNA, 19 bp, Homo sapiens
cttgctcttgatgcctggc

SEQ ID NO: 1393738 - DNA, 14 bp, Homo sapiens
cttggagctgagca

SEQ ID NO: 1393739 - DNA, 21 bp, Homo sapiens
cttgggctccgtgtgggagac

SEQ ID NO: 1393740 - DNA, 22 bp, Homo sapiens
cttggtgaatttttttttccta

SEQ ID NO: 1393741 - DNA, 22 bp, Homo sapiens
cttggttcttgaggggaccagg

SEQ ID NO: 1393742 - DNA, 23 bp, Homo sapiens
cttggttcttgaggggaccagga

SEQ ID NO: 1393743 - DNA, 12 bp, Homo sapiens
cttgtacaaaat

SEQ ID NO: 1393744 - DNA, 23 bp, Homo sapiens
cttgtcacgccagacttcccacg

SEQ ID NO: 1393745 - DNA, 23 bp, Homo sapiens
cttgtcactggtagaccaaaata

SEQ ID NO: 1393746 - DNA, 17 bp, Homo sapiens
cttgtgtctctgtgctt

SEQ ID NO: 1393747 - DNA, 21 bp, Homo sapiens
ctttaaaatgtaaagccatgc

SEQ ID NO: 1393748 - DNA, 20 bp, Homo sapiens
ctttacacaatagaattata

SEQ ID NO: 1393749 - DNA, 23 bp, Homo sapiens
ctttaggcattaaattttagcaa

SEQ ID NO: 1393750 - DNA, 11 bp, Homo sapiens
ctttattttga

SEQ ID NO: 1393751 - DNA, 13 bp, Homo sapiens
ctttccctgcctc

SEQ ID NO: 1393752 - DNA, 22 bp, Homo sapiens
ctttcctccaaactcctgcctg

SEQ ID NO: 1393753 - DNA, 17 bp, Homo sapiens
ctttccttgagtagttt

SEQ ID NO: 1393754 - DNA, 22 bp, Homo sapiens
ctttctattaatatttatgtgt

SEQ ID NO: 1393755 - DNA, 15 bp, Homo sapiens
ctttctcagttttca

SEQ ID NO: 1393756 - DNA, 16 bp, Homo sapiens
ctttctcagttttcat

SEQ ID NO: 1393757 - DNA, 15 bp, Homo sapiens
ctttctgatcaaggc

SEQ ID NO: 1393758 - DNA, 15 bp, Homo sapiens
ctttctttattttga

SEQ ID NO: 1393759 - DNA, 21 bp, Homo sapiens
ctttgaagttagctttaactt

SEQ ID NO: 1393760 - DNA, 19 bp, Homo sapiens
ctttgaatcctctctctgt

SEQ ID NO: 1393761 - DNA, 23 bp, Homo sapiens
ctttgaatcctctctctgtgtta

SEQ ID NO: 1393762 - DNA, 15 bp, Homo sapiens
ctttgactttttgca

SEQ ID NO: 1393763 - DNA, 15 bp, Homo sapiens
ctttgcccagaaaga

SEQ ID NO: 1393764 - DNA, 12 bp, Homo sapiens
ctttggacttgt

SEQ ID NO: 1393765 - DNA, 13 bp, Homo sapiens
ctttggggagcag

SEQ ID NO: 1393766 - DNA, 14 bp, Homo sapiens
ctttggtagaaaag

SEQ ID NO: 1393767 - DNA, 19 bp, Homo sapiens
ctttggtgagaacctgggt

SEQ ID NO: 1393768 - DNA, 22 bp, Homo sapiens
ctttgtgattcaatctgtaaac

SEQ ID NO: 1393769 - DNA, 14 bp, Homo sapiens
ctttgtggcactgg

SEQ ID NO: 1393770 - DNA, 17 bp, Homo sapiens
cttttaaaccattttct

SEQ ID NO: 1393771 - DNA, 12 bp, Homo sapiens
cttttaaactgt

SEQ ID NO: 1393772 - DNA, 15 bp, Homo sapiens
cttttaaactgtgta

SEQ ID NO: 1393773 - DNA, 18 bp, Homo sapiens
cttttcatacattttcta

SEQ ID NO: 1393774 - DNA, 15 bp, Homo sapiens
cttttcttaaacctt

SEQ ID NO: 1393775 - DNA, 22 bp, Homo sapiens
cttttgctcttagctgtctgct

SEQ ID NO: 1393776 - DNA, 13 bp, Homo sapiens
cttttgtaagaca

SEQ ID NO: 1393777 - DNA, 20 bp, Homo sapiens
ctttttaaatgtaaagatat

SEQ ID NO: 1393778 - DNA, 21 bp, Homo sapiens
ctttttaaatgtaaagatatt

SEQ ID NO: 1393779 - DNA, 17 bp, Homo sapiens
ctttttccaacaagaag

SEQ ID NO: 1393780 - DNA, 13 bp, Homo sapiens
ctttttccagagg

SEQ ID NO: 1393781 - DNA, 13 bp, Homo sapiens
cttttttctattt

SEQ ID NO: 1393782 - DNA, 21 bp, Homo sapiens
ctttttttttttttaataaat

SEQ ID NO: 1393783 - DNA, 21 bp, Homo sapiens
gaaaaacaaactcgtttttta

SEQ ID NO: 1393784 - DNA, 23 bp, Homo sapiens
gaaaaacaaactcgttttttaca

SEQ ID NO: 1393785 - DNA, 12 bp, Homo sapiens
gaaaaagaagca

SEQ ID NO: 1393786 - DNA, 13 bp, Homo sapiens
gaaaaagcgaaaa

SEQ ID NO: 1393787 - DNA, 17 bp, Homo sapiens
gaaaaatgtaggagact

SEQ ID NO: 1393788 - DNA, 15 bp, Homo sapiens
gaaaacctttcttca

SEQ ID NO: 1393789 - DNA, 16 bp, Homo sapiens
gaaaactttaaagcgt

SEQ ID NO: 1393790 - DNA, 17 bp, Homo sapiens
gaaaaggtttatgaaaa

SEQ ID NO: 1393791 - DNA, 23 bp, Homo sapiens
gaaaaggtttatgaaaaagaaga

SEQ ID NO: 1393792 - DNA, 23 bp, Homo sapiens
gaaaagtttagcccctgaaagcc

SEQ ID NO: 1393793 - DNA, 12 bp, Homo sapiens
gaaaataaagaa

SEQ ID NO: 1393794 - DNA, 17 bp, Homo sapiens
gaaaataagtgaaattt

SEQ ID NO: 1393795 - DNA, 13 bp, Homo sapiens
gaaaattatttaa

SEQ ID NO: 1393796 - DNA, 23 bp, Homo sapiens
gaaaattatttaaaccgctaaaa

SEQ ID NO: 1393797 - DNA, 19 bp, Homo sapiens
gaaacaaaaacactaaaaa

SEQ ID NO: 1393798 - DNA, 11 bp, Homo sapiens
gaaacagaaaa

SEQ ID NO: 1393799 - DNA, 13 bp, Homo sapiens
gaaacctactgcc

SEQ ID NO: 1393800 - DNA, 19 bp, Homo sapiens
gaaaggattaagatacact

SEQ ID NO: 1393801 - DNA, 22 bp, Homo sapiens
gaaaggattaagatacactcct

SEQ ID NO: 1393802 - DNA, 17 bp, Homo sapiens
gaaaggtggtgtttctg

SEQ ID NO: 1393803 - DNA, 21 bp, Homo sapiens
gaaataaatgtatcatagaaa

SEQ ID NO: 1393804 - DNA, 13 bp, Homo sapiens
gaaatacaaaaat

SEQ ID NO: 1393805 - DNA, 23 bp, Homo sapiens
gaaatctggcttctggccaggaa

SEQ ID NO: 1393806 - DNA, 16 bp, Homo sapiens
gaaatggctttgtgat

SEQ ID NO: 1393807 - DNA, 23 bp, Homo sapiens
gaaatgtggtagcctcactttta

SEQ ID NO: 1393808 - DNA, 15 bp, Homo sapiens
gaaattgattttgaa

SEQ ID NO: 1393809 - DNA, 23 bp, Homo sapiens
gaaattgcctccttatttatcaa

SEQ ID NO: 1393810 - DNA, 15 bp, Homo sapiens
gaaattttatatgct

SEQ ID NO: 1393811 - DNA, 22 bp, Homo sapiens
gaaattttatatgcttactgat

SEQ ID NO: 1393812 - DNA, 17 bp, Homo sapiens
gaaattttccattacat

SEQ ID NO: 1393813 - DNA, 20 bp, Homo sapiens
gaaattttccattacatgat

SEQ ID NO: 1393814 - DNA, 16 bp, Homo sapiens
gaacaccattgaaggc

SEQ ID NO: 1393815 - DNA, 18 bp, Homo sapiens
gaacactagacaagccag

SEQ ID NO: 1393816 - DNA, 20 bp, Homo sapiens
gaacactagacaagccagaa

SEQ ID NO: 1393817 - DNA, 23 bp, Homo sapiens
gaacaggagacccacctgaggct

SEQ ID NO: 1393818 - DNA, 18 bp, Homo sapiens
gaacatattgttgaaagg

SEQ ID NO: 1393819 - DNA, 21 bp, Homo sapiens
gaacattatcacaattccaga

SEQ ID NO: 1393820 - DNA, 16 bp, Homo sapiens
gaaccattaaccagat

SEQ ID NO: 1393821 - DNA, 19 bp, Homo sapiens
gaacctaattcaattcaaa

SEQ ID NO: 1393822 - DNA, 20 bp, Homo sapiens
gaacctgatgaaaataaaga

SEQ ID NO: 1393823 - DNA, 21 bp, Homo sapiens
gaacctgggttgcagacagga

SEQ ID NO: 1393824 - DNA, 21 bp, Homo sapiens
gaactgattcacatctcattt

SEQ ID NO: 1393825 - DNA, 15 bp, Homo sapiens
gaacttgaactgatt

SEQ ID NO: 1393826 - DNA, 16 bp, Homo sapiens
gaactttttattgatt

SEQ ID NO: 1393827 - DNA, 20 bp, Homo sapiens
gaagagagcctgcaggatct

SEQ ID NO: 1393828 - DNA, 16 bp, Homo sapiens
gaagattcccacccct

SEQ ID NO: 1393829 - DNA, 20 bp, Homo sapiens
gaagcaacctcagtaattta

SEQ ID NO: 1393830 - DNA, 16 bp, Homo sapiens
gaagcaagcttaatgg

SEQ ID NO: 1393831 - DNA, 19 bp, Homo sapiens
gaagccccatttgcacagg

SEQ ID NO: 1393832 - DNA, 14 bp, Homo sapiens
gaagcctaaataaa

SEQ ID NO: 1393833 - DNA, 15 bp, Homo sapiens
gaagcctaaataaaa

SEQ ID NO: 1393834 - DNA, 19 bp, Homo sapiens
gaagcgttgtcctcagccc

SEQ ID NO: 1393835 - DNA, 16 bp, Homo sapiens
gaagctgccctgccca

SEQ ID NO: 1393836 - DNA, 13 bp, Homo sapiens
gaaggcatggcgg

SEQ ID NO: 1393837 - DNA, 17 bp, Homo sapiens
gaagggaataaggtaca

SEQ ID NO: 1393838 - DNA, 14 bp, Homo sapiens
gaagtatacctgat

SEQ ID NO: 1393839 - DNA, 19 bp, Homo sapiens
gaagtattttgctggaata

SEQ ID NO: 1393840 - DNA, 17 bp, Homo sapiens
gaagttagctttaactt

SEQ ID NO: 1393841 - DNA, 13 bp, Homo sapiens
gaagttgtgaaac

SEQ ID NO: 1393842 - DNA, 22 bp, Homo sapiens
gaagttgtgaaactaaaatttt

SEQ ID NO: 1393843 - DNA, 11 bp, Homo sapiens
gaagtttcatc

SEQ ID NO: 1393844 - DNA, 17 bp, Homo sapiens
gaataaggtacaagaag

SEQ ID NO: 1393845 - DNA, 21 bp, Homo sapiens
gaataatcacgctttcctgaa

SEQ ID NO: 1393846 - DNA, 12 bp, Homo sapiens
gaatatatatgg

SEQ ID NO: 1393847 - DNA, 16 bp, Homo sapiens
gaatatccatgaccta

SEQ ID NO: 1393848 - DNA, 22 bp, Homo sapiens
gaatatttgttatgtagataac

SEQ ID NO: 1393849 - DNA, 19 bp, Homo sapiens
gaatcaagggtcaggcctt

SEQ ID NO: 1393850 - DNA, 20 bp, Homo sapiens
gaatcactgtttagaacaca

SEQ ID NO: 1393851 - DNA, 23 bp, Homo sapiens
gaatcagagaccttccagaaata

SEQ ID NO: 1393852 - DNA, 22 bp, Homo sapiens
gaatcatgttggatagtcagct

SEQ ID NO: 1393853 - DNA, 17 bp, Homo sapiens
gaatctatatttaacaa

SEQ ID NO: 1393854 - DNA, 15 bp, Homo sapiens
gaatcttggtttgcc

SEQ ID NO: 1393855 - DNA, 23 bp, Homo sapiens
gaatgaaatcctgcttcagtgta

SEQ ID NO: 1393856 - DNA, 16 bp, Homo sapiens
gaatgaattaaataaa

SEQ ID NO: 1393857 - DNA, 13 bp, Homo sapiens
gaatgagcctcgg

SEQ ID NO: 1393858 - DNA, 14 bp, Homo sapiens
gaatgatttcatgc

SEQ ID NO: 1393859 - DNA, 15 bp, Homo sapiens
gaatgtaaagcttgt

SEQ ID NO: 1393860 - DNA, 22 bp, Homo sapiens
gaatgtggcccctgaacaagaa

SEQ ID NO: 1393861 - DNA, 20 bp, Homo sapiens
gaatgttaagacttgacagt

SEQ ID NO: 1393862 - DNA, 19 bp, Homo sapiens
gaattataactggaaagaa

SEQ ID NO: 1393863 - DNA, 20 bp, Homo sapiens
gaattatcttggttgaaaat

SEQ ID NO: 1393864 - DNA, 12 bp, Homo sapiens
gaattattttgt

SEQ ID NO: 1393865 - DNA, 21 bp, Homo sapiens
gaattgaagctttactttaga

SEQ ID NO: 1393866 - DNA, 19 bp, Homo sapiens
gaattgagtgtttaaagtt

SEQ ID NO: 1393867 - DNA, 16 bp, Homo sapiens
gaattgggagcttggg

SEQ ID NO: 1393868 - DNA, 17 bp, Homo sapiens
gaatttcacctgtaaac

SEQ ID NO: 1393869 - DNA, 21 bp, Homo sapiens
gaatttcacctgtaaacctga

SEQ ID NO: 1393870 - DNA, 21 bp, Homo sapiens
gaattttctttgtgtagcttt

SEQ ID NO: 1393871 - DNA, 16 bp, Homo sapiens
gacaactggcaggcag

SEQ ID NO: 1393872 - DNA, 17 bp, Homo sapiens
gacaactggcaggcagg

SEQ ID NO: 1393873 - DNA, 16 bp, Homo sapiens
gacaagccagaacttg

SEQ ID NO: 1393874 - DNA, 13 bp, Homo sapiens
gacaagtacataa

SEQ ID NO: 1393875 - DNA, 18 bp, Homo sapiens
gacaagtacataaaggtg

SEQ ID NO: 1393876 - DNA, 10 bp, Homo sapiens
gacacactgt

SEQ ID NO: 1393877 - DNA, 16 bp, Homo sapiens
gacacctaggctaggg

SEQ ID NO: 1393878 - DNA, 20 bp, Homo sapiens
gacacctaggctagggtggg

SEQ ID NO: 1393879 - DNA, 23 bp, Homo sapiens
gacactttaattaccaacctgtt

SEQ ID NO: 1393880 - DNA, 20 bp, Homo sapiens
gacagaagtttgcactatct

SEQ ID NO: 1393881 - DNA, 22 bp, Homo sapiens
gacagaagtttgcactatcttt

SEQ ID NO: 1393882 - DNA, 20 bp, Homo sapiens
gacagatgaggctttccatg

SEQ ID NO: 1393883 - DNA, 14 bp, Homo sapiens
gacaggatgtgttt

SEQ ID NO: 1393884 - DNA, 16 bp, Homo sapiens
gacagggcgggggtgg

SEQ ID NO: 1393885 - DNA, 18 bp, Homo sapiens
gacagggcgggggtggcg

SEQ ID NO: 1393886 - DNA, 16 bp, Homo sapiens
gacaggttagctgctc

SEQ ID NO: 1393887 - DNA, 18 bp, Homo sapiens
gacagtgagacagtctgg

SEQ ID NO: 1393888 - DNA, 16 bp, Homo sapiens
gacagtttatttgttg

SEQ ID NO: 1393889 - DNA, 15 bp, Homo sapiens
gacatgtctgttcta

SEQ ID NO: 1393890 - DNA, 22 bp, Homo sapiens
gacattaactcattagactgga

SEQ ID NO: 1393891 - DNA, 23 bp, Homo sapiens
gacattctgattcgaatgacact

SEQ ID NO: 1393892 - DNA, 14 bp, Homo sapiens
gaccagcctctcca

SEQ ID NO: 1393893 - DNA, 11 bp, Homo sapiens
gaccaggagtg

SEQ ID NO: 1393894 - DNA, 23 bp, Homo sapiens
gacccctgctcagtaaagcactt

SEQ ID NO: 1393895 - DNA, 17 bp, Homo sapiens
gaccctccccgcacccc

SEQ ID NO: 1393896 - DNA, 16 bp, Homo sapiens
gaccggcctgccagga

SEQ ID NO: 1393897 - DNA, 16 bp, Homo sapiens
gactaatggcatgaga

SEQ ID NO: 1393898 - DNA, 16 bp, Homo sapiens
gactagggagccatgt

SEQ ID NO: 1393899 - DNA, 17 bp, Homo sapiens
gactatcttactatttc

SEQ ID NO: 1393900 - DNA, 15 bp, Homo sapiens
gactcaagccccgga

SEQ ID NO: 1393901 - DNA, 20 bp, Homo sapiens
gactgccaagactgctgtgg

SEQ ID NO: 1393902 - DNA, 15 bp, Homo sapiens
gactgctgtggccag

SEQ ID NO: 1393903 - DNA, 18 bp, Homo sapiens
gactgctgtggccaggag

SEQ ID NO: 1393904 - DNA, 20 bp, Homo sapiens
gactgctgtggccaggaggt

SEQ ID NO: 1393905 - DNA, 15 bp, Homo sapiens
gactggaacactaga

SEQ ID NO: 1393906 - DNA, 13 bp, Homo sapiens
gactggacagctt

SEQ ID NO: 1393907 - DNA, 14 bp, Homo sapiens
gactggacagcttg

SEQ ID NO: 1393908 - DNA, 14 bp, Homo sapiens
gactgtgtgctcag

SEQ ID NO: 1393909 - DNA, 22 bp, Homo sapiens
gactgtgtgctcaggagccctg

SEQ ID NO: 1393910 - DNA, 15 bp, Homo sapiens
gacttacatgattca

SEQ ID NO: 1393911 - DNA, 19 bp, Homo sapiens
gacttacatgattcatttt

SEQ ID NO: 1393912 - DNA, 18 bp, Homo sapiens
gacttcccacggctcctc

SEQ ID NO: 1393913 - DNA, 16 bp, Homo sapiens
gacttgacagtggaac

SEQ ID NO: 1393914 - DNA, 13 bp, Homo sapiens
gacttgtgtctct

SEQ ID NO: 1393915 - DNA, 16 bp, Homo sapiens
gacttgtgtctctgtg

SEQ ID NO: 1393916 - DNA, 20 bp, Homo sapiens
gagaaaggattaagatacac

SEQ ID NO: 1393917 - DNA, 14 bp, Homo sapiens
gagaaatacaaaaa

SEQ ID NO: 1393918 - DNA, 19 bp, Homo sapiens
gagaaatcagaaaaattaa

SEQ ID NO: 1393919 - DNA, 15 bp, Homo sapiens
gagaatctatattta

SEQ ID NO: 1393920 - DNA, 22 bp, Homo sapiens
gagaatctatatttaacaagat

SEQ ID NO: 1393921 - DNA, 17 bp, Homo sapiens
gagaatctggctcctgt

SEQ ID NO: 1393922 - DNA, 18 bp, Homo sapiens
gagaatctggctcctgtt

SEQ ID NO: 1393923 - DNA, 13 bp, Homo sapiens
gagaatgagcctc

SEQ ID NO: 1393924 - DNA, 21 bp, Homo sapiens
gagaatttctaccatttcaga

SEQ ID NO: 1393925 - DNA, 22 bp, Homo sapiens
gagacaaacacctcccaggaga

SEQ ID NO: 1393926 - DNA, 9 bp, Homo sapiens
gagacagag

SEQ ID NO: 1393927 - DNA, 16 bp, Homo sapiens
gagacagttcaagaaa

SEQ ID NO: 1393928 - DNA, 16 bp, Homo sapiens
gagacccacctgaggc

SEQ ID NO: 1393929 - DNA, 22 bp, Homo sapiens
gagacccacctgaggctcagcc

SEQ ID NO: 1393930 - DNA, 18 bp, Homo sapiens
gagaccggcctgccagga

SEQ ID NO: 1393931 - DNA, 19 bp, Homo sapiens
gagaccggcctgccaggag

SEQ ID NO: 1393932 - DNA, 16 bp, Homo sapiens
gagacgggccctggtg

SEQ ID NO: 1393933 - DNA, 23 bp, Homo sapiens
gagacttcaggttgttctgtata

SEQ ID NO: 1393934 - DNA, 13 bp, Homo sapiens
gagagaggccatt

SEQ ID NO: 1393935 - DNA, 16 bp, Homo sapiens
gagagggcgcaggccg

SEQ ID NO: 1393936 - DNA, 18 bp, Homo sapiens
gagatcccaacactgcca

SEQ ID NO: 1393937 - DNA, 17 bp, Homo sapiens
gagatgtaaaaggtatt

SEQ ID NO: 1393938 - DNA, 22 bp, Homo sapiens
gagcacaagaggagatccaggg

SEQ ID NO: 1393939 - DNA, 16 bp, Homo sapiens
gagcactgtatacccc

SEQ ID NO: 1393940 - DNA, 15 bp, Homo sapiens
gagcaggaggccaat

SEQ ID NO: 1393941 - DNA, 14 bp, Homo sapiens
gagcatcacagaat

SEQ ID NO: 1393942 - DNA, 12 bp, Homo sapiens
gagccctgggag

SEQ ID NO: 1393943 - DNA, 16 bp, Homo sapiens
gagccctgggaggctc

SEQ ID NO: 1393944 - DNA, 20 bp, Homo sapiens
gagccctgggaggctctgga

SEQ ID NO: 1393945 - DNA, 19 bp, Homo sapiens
gagcctgaattttgttgct

SEQ ID NO: 1393946 - DNA, 23 bp, Homo sapiens
gagctcagaaaatatccctcctg

SEQ ID NO: 1393947 - DNA, 22 bp, Homo sapiens
gagctcaggaaccgaggcaggg

SEQ ID NO: 1393948 - DNA, 11 bp, Homo sapiens
gagctcaggat

SEQ ID NO: 1393949 - DNA, 13 bp, Homo sapiens
gagcttgggaatg

SEQ ID NO: 1393950 - DNA, 16 bp, Homo sapiens
gaggacccagggctct

SEQ ID NO: 1393951 - DNA, 14 bp, Homo sapiens
gaggacttgtgtct

SEQ ID NO: 1393952 - DNA, 17 bp, Homo sapiens
gaggacttgtgtctctg

SEQ ID NO: 1393953 - DNA, 13 bp, Homo sapiens
gaggagggcaggc

SEQ ID NO: 1393954 - DNA, 14 bp, Homo sapiens
gaggagggcaggca

SEQ ID NO: 1393955 - DNA, 22 bp, Homo sapiens
gaggatgttctggacctccccc

SEQ ID NO: 1393956 - DNA, 15 bp, Homo sapiens
gaggccaataaaaag

SEQ ID NO: 1393957 - DNA, 20 bp, Homo sapiens
gaggccaataaaaagttcag

SEQ ID NO: 1393958 - DNA, 19 bp, Homo sapiens
gaggccattgtgtgagcct

SEQ ID NO: 1393959 - DNA, 14 bp, Homo sapiens
gaggctctggagcc

SEQ ID NO: 1393960 - DNA, 14 bp, Homo sapiens
gaggctttccatgg

SEQ ID NO: 1393961 - DNA, 9 bp, Homo sapiens
gagggctgc

SEQ ID NO: 1393962 - DNA, 13 bp, Homo sapiens
gaggggaccagga

SEQ ID NO: 1393963 - DNA, 16 bp, Homo sapiens
gaggggaccaggagtg

SEQ ID NO: 1393964 - DNA, 22 bp, Homo sapiens
gagggtaggcaggattggggaa

SEQ ID NO: 1393965 - DNA, 13 bp, Homo sapiens
gagggtgtcctgc

SEQ ID NO: 1393966 - DNA, 23 bp, Homo sapiens
gaggtgcttctagttctgccagg

SEQ ID NO: 1393967 - DNA, 13 bp, Homo sapiens
gaggttaaaatat

SEQ ID NO: 1393968 - DNA, 18 bp, Homo sapiens
gagtaaagaattattttg

SEQ ID NO: 1393969 - DNA, 14 bp, Homo sapiens
gagtcaagttgttc

SEQ ID NO: 1393970 - DNA, 14 bp, Homo sapiens
gagtcactgagacc

SEQ ID NO: 1393971 - DNA, 14 bp, Homo sapiens
gagtccatcagcct

SEQ ID NO: 1393972 - DNA, 23 bp, Homo sapiens
gagtctggtgaagctcacttctg

SEQ ID NO: 1393973 - DNA, 14 bp, Homo sapiens
gagtgcaccaaaga

SEQ ID NO: 1393974 - DNA, 14 bp, Homo sapiens
gagttcctgcatgc

SEQ ID NO: 1393975 - DNA, 21 bp, Homo sapiens
gataactgaaaattatttaaa

SEQ ID NO: 1393976 - DNA, 17 bp, Homo sapiens
gataatctaaatataaa

SEQ ID NO: 1393977 - DNA, 20 bp, Homo sapiens
gataatctaaatataaacca

SEQ ID NO: 1393978 - DNA, 12 bp, Homo sapiens
gataattttaaa

SEQ ID NO: 1393979 - DNA, 14 bp, Homo sapiens
gatacactcctgct

SEQ ID NO: 1393980 - DNA, 14 bp, Homo sapiens
gatacatacagaat

SEQ ID NO: 1393981 - DNA, 18 bp, Homo sapiens
gataccatatacagctca

SEQ ID NO: 1393982 - DNA, 14 bp, Homo sapiens
gatagaatgacagt

SEQ ID NO: 1393983 - DNA, 19 bp, Homo sapiens
gatatagttttacttttaa

SEQ ID NO: 1393984 - DNA, 24 bp, Homo sapiens
gatatagttttacttttaaactgt

SEQ ID NO: 1393985 - DNA, 13 bp, Homo sapiens
gatatctcatctc

SEQ ID NO: 1393986 - DNA, 19 bp, Homo sapiens
gatatgtaaaacatttatt

SEQ ID NO: 1393987 - DNA, 20 bp, Homo sapiens
gatattctggattataaaaa

SEQ ID NO: 1393988 - DNA, 18 bp, Homo sapiens
gatatttatttaaacaaa

SEQ ID NO: 1393989 - DNA, 15 bp, Homo sapiens
gatatttctagctta

SEQ ID NO: 1393990 - DNA, 15 bp, Homo sapiens
gatattttctgtgcc

SEQ ID NO: 1393991 - DNA, 17 bp, Homo sapiens
gatatttttatctttat

SEQ ID NO: 1393992 - DNA, 18 bp, Homo sapiens
gatcagttataagtagca

SEQ ID NO: 1393993 - DNA, 19 bp, Homo sapiens
gatccctagctgtgacctc

SEQ ID NO: 1393994 - DNA, 21 bp, Homo sapiens
gatccctagctgtgacctctc

SEQ ID NO: 1393995 - DNA, 20 bp, Homo sapiens
gatcctgtattcagacagat

SEQ ID NO: 1393996 - DNA, 19 bp, Homo sapiens
gatctcaccaggcagcctc

SEQ ID NO: 1393997 - DNA, 23 bp, Homo sapiens
gatctcaccaggcagcctctggg

SEQ ID NO: 1393998 - DNA, 19 bp, Homo sapiens
gatctgatagggtttgtga

SEQ ID NO: 1393999 - DNA, 14 bp, Homo sapiens
gatgaccaggacta

SEQ ID NO: 1394000 - DNA, 21 bp, Homo sapiens
gatgagggaaaagaaaaagat

SEQ ID NO: 1394001 - DNA, 15 bp, Homo sapiens
gatgcacatccctgg

SEQ ID NO: 1394002 - DNA, 16 bp, Homo sapiens
gatgcacatccctgga

SEQ ID NO: 1394003 - DNA, 16 bp, Homo sapiens
gatgcatttgggtcca

SEQ ID NO: 1394004 - DNA, 20 bp, Homo sapiens
gattaaattatatctgaggc

SEQ ID NO: 1394005 - DNA, 20 bp, Homo sapiens
gattaactggtagttcattg

SEQ ID NO: 1394006 - DNA, 14 bp, Homo sapiens
gattacaggcgtga

SEQ ID NO: 1394007 - DNA, 18 bp, Homo sapiens
gattagactggacagctt

SEQ ID NO: 1394008 - DNA, 19 bp, Homo sapiens
gattagactggacagcttg

SEQ ID NO: 1394009 - DNA, 10 bp, Homo sapiens
gattatcagg

SEQ ID NO: 1394010 - DNA, 14 bp, Homo sapiens
gattcaatctgtaa

SEQ ID NO: 1394011 - DNA, 16 bp, Homo sapiens
gattcaatctgtaaac

SEQ ID NO: 1394012 - DNA, 18 bp, Homo sapiens
gattcaatctgtaaactg

SEQ ID NO: 1394013 - DNA, 21 bp, Homo sapiens
gattcatgccaattagcaatt

SEQ ID NO: 1394014 - DNA, 14 bp, Homo sapiens
gattcattcttaac

SEQ ID NO: 1394015 - DNA, 16 bp, Homo sapiens
gattctcttgcctcaa

SEQ ID NO: 1394016 - DNA, 14 bp, Homo sapiens
gattcttccatctg

SEQ ID NO: 1394017 - DNA, 22 bp, Homo sapiens
gattggggaagagagcctgcag

SEQ ID NO: 1394018 - DNA, 15 bp, Homo sapiens
gattgtcttaatatt

SEQ ID NO: 1394019 - DNA, 16 bp, Homo sapiens
gatttcatgctatctc

SEQ ID NO: 1394020 - DNA, 18 bp, Homo sapiens
gatttcatgctatctctg

SEQ ID NO: 1394021 - DNA, 19 bp, Homo sapiens
gattttcaaagctttttcc

SEQ ID NO: 1394022 - DNA, 15 bp, Homo sapiens
gatttttttttcata

SEQ ID NO: 1394023 - DNA, 14 bp, Homo sapiens
gcaaaaaagaaaac

SEQ ID NO: 1394024 - DNA, 17 bp, Homo sapiens
gcaaaaaagaaaacctt

SEQ ID NO: 1394025 - DNA, 18 bp, Homo sapiens
gcaaaaaagaaaaccttt

SEQ ID NO: 1394026 - DNA, 15 bp, Homo sapiens
gcaaaagaagaagtt

SEQ ID NO: 1394027 - DNA, 20 bp, Homo sapiens
gcaaaataattttaaacaaa

SEQ ID NO: 1394028 - DNA, 19 bp, Homo sapiens
gcaaacctgacccctgctc

SEQ ID NO: 1394029 - DNA, 19 bp, Homo sapiens
gcaaccagagcactgtata

SEQ ID NO: 1394030 - DNA, 16 bp, Homo sapiens
gcaacctccacctcct

SEQ ID NO: 1394031 - DNA, 12 bp, Homo sapiens
gcaactcagaat

SEQ ID NO: 1394032 - DNA, 23 bp, Homo sapiens
gcaagcttaatggctgataattt

SEQ ID NO: 1394033 - DNA, 21 bp, Homo sapiens
gcaataacgtttaagccaaaa

SEQ ID NO: 1394034 - DNA, 18 bp, Homo sapiens
gcaatgtaaatattttaa

SEQ ID NO: 1394035 - DNA, 19 bp, Homo sapiens
gcaatgtaaatattttaaa

SEQ ID NO: 1394036 - DNA, 17 bp, Homo sapiens
gcaatttttttatacta

SEQ ID NO: 1394037 - DNA, 13 bp, Homo sapiens
gcacaaatattta

SEQ ID NO: 1394038 - DNA, 14 bp, Homo sapiens
gcacaaatatttat

SEQ ID NO: 1394039 - DNA, 16 bp, Homo sapiens
gcacaaatatttattt

SEQ ID NO: 1394040 - DNA, 16 bp, Homo sapiens
gcacaataaaaatgtt

SEQ ID NO: 1394041 - DNA, 15 bp, Homo sapiens
gcacaggctaatttt

SEQ ID NO: 1394042 - DNA, 17 bp, Homo sapiens
gcacatttaataatcag

SEQ ID NO: 1394043 - DNA, 19 bp, Homo sapiens
gcacatttaataatcagac

SEQ ID NO: 1394044 - DNA, 16 bp, Homo sapiens
gcaccagaatgtatat

SEQ ID NO: 1394045 - DNA, 22 bp, Homo sapiens
gcaccccagctggggccaggct

SEQ ID NO: 1394046 - DNA, 17 bp, Homo sapiens
gcaccctcatacacaga

SEQ ID NO: 1394047 - DNA, 20 bp, Homo sapiens
gcaccctcatacacagaaac

SEQ ID NO: 1394048 - DNA, 14 bp, Homo sapiens
gcaccggggcctgg

SEQ ID NO: 1394049 - DNA, 20 bp, Homo sapiens
gcaccggggcctgggcagga

SEQ ID NO: 1394050 - DNA, 15 bp, Homo sapiens
gcacctgtcccagaa

SEQ ID NO: 1394051 - DNA, 22 bp, Homo sapiens
gcacctgtcccagaaaaagcat

SEQ ID NO: 1394052 - DNA, 18 bp, Homo sapiens
gcactatctttcagctcc

SEQ ID NO: 1394053 - DNA, 18 bp, Homo sapiens
gcactggggcaggggccg

SEQ ID NO: 1394054 - DNA, 23 bp, Homo sapiens
gcagaatcctaggctccacccca

SEQ ID NO: 1394055 - DNA, 13 bp, Homo sapiens
gcagactcactgt

SEQ ID NO: 1394056 - DNA, 16 bp, Homo sapiens
gcagactcagctctga

SEQ ID NO: 1394057 - DNA, 19 bp, Homo sapiens
gcagattctcccttgctct

SEQ ID NO: 1394058 - DNA, 18 bp, Homo sapiens
gcagcccctcccagccta

SEQ ID NO: 1394059 - DNA, 11 bp, Homo sapiens
gcaggaaggct

SEQ ID NO: 1394060 - DNA, 21 bp, Homo sapiens
gcaggaggccaataaaaagtt

SEQ ID NO: 1394061 - DNA, 20 bp, Homo sapiens
gcaggatctcaccaggcagc

SEQ ID NO: 1394062 - DNA, 21 bp, Homo sapiens
gcaggattggggaagagagcc

SEQ ID NO: 1394063 - DNA, 15 bp, Homo sapiens
gcaggcaggctccca

SEQ ID NO: 1394064 - DNA, 23 bp, Homo sapiens
gcaggcatcggggagccgggagc

SEQ ID NO: 1394065 - DNA, 19 bp, Homo sapiens
gcaggccgtgacgtctggg

SEQ ID NO: 1394066 - DNA, 20 bp, Homo sapiens
gcagggactgtaaacacaga

SEQ ID NO: 1394067 - DNA, 10 bp, Homo sapiens
gcaggtccct

SEQ ID NO: 1394068 - DNA, 15 bp, Homo sapiens
gcaggtccctaataa

SEQ ID NO: 1394069 - DNA, 19 bp, Homo sapiens
gcaggtccctaataaagct

SEQ ID NO: 1394070 - DNA, 21 bp, Homo sapiens
gcagtgcagcaaccagagcac

SEQ ID NO: 1394071 - DNA, 22 bp, Homo sapiens
gcagtgcagcaaccagagcact

SEQ ID NO: 1394072 - DNA, 23 bp, Homo sapiens
gcagtgcagcaaccagagcactg

SEQ ID NO: 1394073 - DNA, 18 bp, Homo sapiens
gcagtttatatttaactc

SEQ ID NO: 1394074 - DNA, 23 bp, Homo sapiens
gcatccagagtccctgcctggac

SEQ ID NO: 1394075 - DNA, 12 bp, Homo sapiens
gcatccaggcac

SEQ ID NO: 1394076 - DNA, 17 bp, Homo sapiens
gcatccattctcctgag

SEQ ID NO: 1394077 - DNA, 17 bp, Homo sapiens
gcatccctgggccttgg

SEQ ID NO: 1394078 - DNA, 17 bp, Homo sapiens
gcatcggggagccggga

SEQ ID NO: 1394079 - DNA, 23 bp, Homo sapiens
gcatctagaggcttccttcattt

SEQ ID NO: 1394080 - DNA, 20 bp, Homo sapiens
gcatggatatagttttactt

SEQ ID NO: 1394081 - DNA, 15 bp, Homo sapiens
gcatggctattttat

SEQ ID NO: 1394082 - DNA, 23 bp, Homo sapiens
gcattaaattttagcaaagatat

SEQ ID NO: 1394083 - DNA, 17 bp, Homo sapiens
gcattactgcatgcact

SEQ ID NO: 1394084 - DNA, 18 bp, Homo sapiens
gcattcagaagaaaaaga

SEQ ID NO: 1394085 - DNA, 19 bp, Homo sapiens
gcattgaatggctatgttt

SEQ ID NO: 1394086 - DNA, 22 bp, Homo sapiens
gcatttcactttcccggtgttc

SEQ ID NO: 1394087 - DNA, 18 bp, Homo sapiens
gcatttcccttccttcct

SEQ ID NO: 1394088 - DNA, 16 bp, Homo sapiens
gcatttgggtccagga

SEQ ID NO: 1394089 - DNA, 17 bp, Homo sapiens
gcatttgggtccaggag

SEQ ID NO: 1394090 - DNA, 15 bp, Homo sapiens
gccaagactgctgtg

SEQ ID NO: 1394091 - DNA, 22 bp, Homo sapiens
gccaagactgctgtggccagga

SEQ ID NO: 1394092 - DNA, 19 bp, Homo sapiens
gccaatgcacctaaagaaa

SEQ ID NO: 1394093 - DNA, 16 bp, Homo sapiens
gccacaccaggataga

SEQ ID NO: 1394094 - DNA, 21 bp, Homo sapiens
gccacaccaggatagagactg

SEQ ID NO: 1394095 - DNA, 21 bp, Homo sapiens
gccagacttcccacggctcct

SEQ ID NO: 1394096 - DNA, 22 bp, Homo sapiens
gccagagccaaggggcttcagg

SEQ ID NO: 1394097 - DNA, 21 bp, Homo sapiens
gccagatgcacatccctggaa

SEQ ID NO: 1394098 - DNA, 22 bp, Homo sapiens
gccagatgcacatccctggaag

SEQ ID NO: 1394099 - DNA, 12 bp, Homo sapiens
gccagatttttt

SEQ ID NO: 1394100 - DNA, 16 bp, Homo sapiens
gccagattttttaaaa

SEQ ID NO: 1394101 - DNA, 23 bp, Homo sapiens
gccagattttttaaaatttatat

SEQ ID NO: 1394102 - DNA, 18 bp, Homo sapiens
gccagcaaaccaggactc

SEQ ID NO: 1394103 - DNA, 19 bp, Homo sapiens
gccaggaggacccagggct

SEQ ID NO: 1394104 - DNA, 22 bp, Homo sapiens
gccaggaggacccagggctctg

SEQ ID NO: 1394105 - DNA, 18 bp, Homo sapiens
gccaggaggtgccactgg

SEQ ID NO: 1394106 - DNA, 13 bp, Homo sapiens
gccaggccgggaa

SEQ ID NO: 1394107 - DNA, 15 bp, Homo sapiens
gccatcaagagactg

SEQ ID NO: 1394108 - DNA, 13 bp, Homo sapiens
gccatgatgcctc

SEQ ID NO: 1394109 - DNA, 19 bp, Homo sapiens
gccatgatgcctctgtctt

SEQ ID NO: 1394110 - DNA, 21 bp, Homo sapiens
gccattcacttcataatccag

SEQ ID NO: 1394111 - DNA, 21 bp, Homo sapiens
gcccaggaccccatggcagtg

SEQ ID NO: 1394112 - DNA, 19 bp, Homo sapiens
gcccagtgcacttgctgga

SEQ ID NO: 1394113 - DNA, 14 bp, Homo sapiens
gccccagtgacagc

SEQ ID NO: 1394114 - DNA, 16 bp, Homo sapiens
gccccctccctggatg

SEQ ID NO: 1394115 - DNA, 15 bp, Homo sapiens
gcccctgcctctctg

SEQ ID NO: 1394116 - DNA, 18 bp, Homo sapiens
gcccctgcctctctgcag

SEQ ID NO: 1394117 - DNA, 20 bp, Homo sapiens
gcccctgcctctctgcaggt

SEQ ID NO: 1394118 - DNA, 19 bp, Homo sapiens
gccccttgacaactggcag

SEQ ID NO: 1394119 - DNA, 17 bp, Homo sapiens
gcccggtaagagcaaaa

SEQ ID NO: 1394120 - DNA, 15 bp, Homo sapiens
gccctagccctcagc

SEQ ID NO: 1394121 - DNA, 18 bp, Homo sapiens
gccctcaataagccagca

SEQ ID NO: 1394122 - DNA, 19 bp, Homo sapiens
gccctctcccatgcacaca

SEQ ID NO: 1394123 - DNA, 14 bp, Homo sapiens
gccctgggaggctc

SEQ ID NO: 1394124 - DNA, 18 bp, Homo sapiens
gccctgggaggctctgga

SEQ ID NO: 1394125 - DNA, 17 bp, Homo sapiens
gcccttattttcaagaa

SEQ ID NO: 1394126 - DNA, 20 bp, Homo sapiens
gcccttattttcaagaaact

SEQ ID NO: 1394127 - DNA, 15 bp, Homo sapiens
gccgctatgcagggt

SEQ ID NO: 1394128 - DNA, 13 bp, Homo sapiens
gccgggagcctga

SEQ ID NO: 1394129 - DNA, 16 bp, Homo sapiens
gcctacccctcctgcg

SEQ ID NO: 1394130 - DNA, 17 bp, Homo sapiens
gcctactccaaaatgtt

SEQ ID NO: 1394131 - DNA, 20 bp, Homo sapiens
gcctatcagagttgctgcaa

SEQ ID NO: 1394132 - DNA, 15 bp, Homo sapiens
gcctcaacctcccaa

SEQ ID NO: 1394133 - DNA, 23 bp, Homo sapiens
gcctccaaggaggggctgtaaaa

SEQ ID NO: 1394134 - DNA, 23 bp, Homo sapiens
gcctccatcctaccccctgtgcc

SEQ ID NO: 1394135 - DNA, 13 bp, Homo sapiens
gcctccctcctcg

SEQ ID NO: 1394136 - DNA, 19 bp, Homo sapiens
gcctcctcacccccagctt

SEQ ID NO: 1394137 - DNA, 20 bp, Homo sapiens
gcctcctgccggctccttgg

SEQ ID NO: 1394138 - DNA, 19 bp, Homo sapiens
gcctctcgctcctcaaccc

SEQ ID NO: 1394139 - DNA, 22 bp, Homo sapiens
gcctctcgctcctcaacccctc

SEQ ID NO: 1394140 - DNA, 16 bp, Homo sapiens
gcctctctgcaggtcc

SEQ ID NO: 1394141 - DNA, 19 bp, Homo sapiens
gcctctctgcaggtcccta

SEQ ID NO: 1394142 - DNA, 21 bp, Homo sapiens
gcctctggggggtggccaggc

SEQ ID NO: 1394143 - DNA, 16 bp, Homo sapiens
gcctgcagactcactg

SEQ ID NO: 1394144 - DNA, 21 bp, Homo sapiens
gcctgcatccattctcctgag

SEQ ID NO: 1394145 - DNA, 22 bp, Homo sapiens
gcctgcatccattctcctgagg

SEQ ID NO: 1394146 - DNA, 13 bp, Homo sapiens
gcctgccaggagg

SEQ ID NO: 1394147 - DNA, 16 bp, Homo sapiens
gcctgggcaggaggga

SEQ ID NO: 1394148 - DNA, 20 bp, Homo sapiens
gcctggtatatccaaaagct

SEQ ID NO: 1394149 - DNA, 19 bp, Homo sapiens
gcctgtaacaagccagatt

SEQ ID NO: 1394150 - DNA, 20 bp, Homo sapiens
gcctgtagccccagtgacag

SEQ ID NO: 1394151 - DNA, 22 bp, Homo sapiens
gccttattggaaagcagtcccc

SEQ ID NO: 1394152 - DNA, 18 bp, Homo sapiens
gccttgggctccgtgtgg

SEQ ID NO: 1394153 - DNA, 20 bp, Homo sapiens
gccttgggctccgtgtggga

SEQ ID NO: 1394154 - DNA, 22 bp, Homo sapiens
gccttgggctccgtgtgggaga

SEQ ID NO: 1394155 - DNA, 15 bp, Homo sapiens
gccttgtttttttct

SEQ ID NO: 1394156 - DNA, 22 bp, Homo sapiens
gcgaaaaaatcaggtggctttt

SEQ ID NO: 1394157 - DNA, 17 bp, Homo sapiens
gcgatctcggctcactg

SEQ ID NO: 1394158 - DNA, 12 bp, Homo sapiens
gcggctcctcag

SEQ ID NO: 1394159 - DNA, 13 bp, Homo sapiens
gcggctgggagga

SEQ ID NO: 1394160 - DNA, 12 bp, Homo sapiens
gcggttcaggaa

SEQ ID NO: 1394161 - DNA, 11 bp, Homo sapiens
gcgtgcagatg

SEQ ID NO: 1394162 - DNA, 22 bp, Homo sapiens
gcgttattggtcggcagccttc

SEQ ID NO: 1394163 - DNA, 14 bp, Homo sapiens
gctaagagaagtag

SEQ ID NO: 1394164 - DNA, 15 bp, Homo sapiens
gctaagctaggaatg

SEQ ID NO: 1394165 - DNA, 20 bp, Homo sapiens
gctaccaaagcaccttagct

SEQ ID NO: 1394166 - DNA, 21 bp, Homo sapiens
gctactctagtattccagacc

SEQ ID NO: 1394167 - DNA, 22 bp, Homo sapiens
gctactgccgtcagtgctgtgc

SEQ ID NO: 1394168 - DNA, 23 bp, Homo sapiens
gctactttgctgctatggttttc

SEQ ID NO: 1394169 - DNA, 21 bp, Homo sapiens
gctagaattgagtgtttaaag

SEQ ID NO: 1394170 - DNA, 21 bp, Homo sapiens
gctatactgcatactttttaa

SEQ ID NO: 1394171 - DNA, 14 bp, Homo sapiens
gctatcaaataact

SEQ ID NO: 1394172 - DNA, 13 bp, Homo sapiens
gctatctctgtgt

SEQ ID NO: 1394173 - DNA, 20 bp, Homo sapiens
gctatctctgtgtgcacaaa

SEQ ID NO: 1394174 - DNA, 21 bp, Homo sapiens
gctattattttcactgtagaa

SEQ ID NO: 1394175 - DNA, 14 bp, Homo sapiens
gctcacaaaccatg

SEQ ID NO: 1394176 - DNA, 18 bp, Homo sapiens
gctcaccttgtgctgggg

SEQ ID NO: 1394177 - DNA, 19 bp, Homo sapiens
gctcactgacctgcctgta

SEQ ID NO: 1394178 - DNA, 21 bp, Homo sapiens
gctcagagggtgtcctgcacc

SEQ ID NO: 1394179 - DNA, 20 bp, Homo sapiens
gctcaggaaccgaggcaggg

SEQ ID NO: 1394180 - DNA, 15 bp, Homo sapiens
gctcaggagccctgg

SEQ ID NO: 1394181 - DNA, 23 bp, Homo sapiens
gctcaggagccctgggaggctct

SEQ ID NO: 1394182 - DNA, 20 bp, Homo sapiens
gctcaggatgagggaaaaga

SEQ ID NO: 1394183 - DNA, 16 bp, Homo sapiens
gctcaggtacttgtaa

SEQ ID NO: 1394184 - DNA, 16 bp, Homo sapiens
gctcagtaatttgagg

SEQ ID NO: 1394185 - DNA, 22 bp, Homo sapiens
gctccgtgtgggagaccggcct

SEQ ID NO: 1394186 - DNA, 18 bp, Homo sapiens
gctcctcagggactcagg

SEQ ID NO: 1394187 - DNA, 20 bp, Homo sapiens
gctcctcagggactcaggtg

SEQ ID NO: 1394188 - DNA, 20 bp, Homo sapiens
gctctctgtgggctggcagt

SEQ ID NO: 1394189 - DNA, 23 bp, Homo sapiens
gctctggagcccactgtacttgc

SEQ ID NO: 1394190 - DNA, 15 bp, Homo sapiens
gctcttgatgcctgg

SEQ ID NO: 1394191 - DNA, 17 bp, Homo sapiens
gctcttgatgcctggcg

SEQ ID NO: 1394192 - DNA, 19 bp, Homo sapiens
gctcttgatgcctggcggg

SEQ ID NO: 1394193 - DNA, 13 bp, Homo sapiens
gctctttggtaga

SEQ ID NO: 1394194 - DNA, 17 bp, Homo sapiens
gctgatattttctctag

SEQ ID NO: 1394195 - DNA, 15 bp, Homo sapiens
gctgattgtttattt

SEQ ID NO: 1394196 - DNA, 18 bp, Homo sapiens
gctgattgtttatttttc

SEQ ID NO: 1394197 - DNA, 23 bp, Homo sapiens
gctgattgtttatttttctatga

SEQ ID NO: 1394198 - DNA, 23 bp, Homo sapiens
gctgatttctaggtaggaaatgt

SEQ ID NO: 1394199 - DNA, 22 bp, Homo sapiens
gctgcaggaatctttaaaagat

SEQ ID NO: 1394200 - DNA, 18 bp, Homo sapiens
gctgccctgtaccccagc

SEQ ID NO: 1394201 - DNA, 20 bp, Homo sapiens
gctgcctttggacttgtccc

SEQ ID NO: 1394202 - DNA, 13 bp, Homo sapiens
gctgctagagtga

SEQ ID NO: 1394203 - DNA, 23 bp, Homo sapiens
gctgggacaccccgacttttgtt

SEQ ID NO: 1394204 - DNA, 12 bp, Homo sapiens
gctgggcccctg

SEQ ID NO: 1394205 - DNA, 13 bp, Homo sapiens
gctgggcccctgc

SEQ ID NO: 1394206 - DNA, 20 bp, Homo sapiens
gctgggcccctgcctctctg

SEQ ID NO: 1394207 - DNA, 23 bp, Homo sapiens
gctgggcccctgcctctctgcag

SEQ ID NO: 1394208 - DNA, 12 bp, Homo sapiens
gctgggtcgccc

SEQ ID NO: 1394209 - DNA, 16 bp, Homo sapiens
gctgggtcgccctgga

SEQ ID NO: 1394210 - DNA, 17 bp, Homo sapiens
gctgggtcgccctggac

SEQ ID NO: 1394211 - DNA, 18 bp, Homo sapiens
gctgggtcgccctggact

SEQ ID NO: 1394212 - DNA, 20 bp, Homo sapiens
gctggtctcaaactcctgac

SEQ ID NO: 1394213 - DNA, 19 bp, Homo sapiens
gctgtaatgttaatattga

SEQ ID NO: 1394214 - DNA, 16 bp, Homo sapiens
gctgtacactgcacga

SEQ ID NO: 1394215 - DNA, 20 bp, Homo sapiens
gctgtggccaggaggtgcca

SEQ ID NO: 1394216 - DNA, 20 bp, Homo sapiens
gctgtggcctaacctgccga

SEQ ID NO: 1394217 - DNA, 12 bp, Homo sapiens
gcttaaaacttt

SEQ ID NO: 1394218 - DNA, 13 bp, Homo sapiens
gcttaaaactttg

SEQ ID NO: 1394219 - DNA, 22 bp, Homo sapiens
gcttaaacccatattgtaaaac

SEQ ID NO: 1394220 - DNA, 20 bp, Homo sapiens
gcttaatggctgataatttt

SEQ ID NO: 1394221 - DNA, 17 bp, Homo sapiens
gcttactgatatatttt

SEQ ID NO: 1394222 - DNA, 18 bp, Homo sapiens
gcttatgacatcacttgt

SEQ ID NO: 1394223 - DNA, 23 bp, Homo sapiens
gcttatgacatcacttgtacaaa

SEQ ID NO: 1394224 - DNA, 15 bp, Homo sapiens
gcttatggtaccaga

SEQ ID NO: 1394225 - DNA, 20 bp, Homo sapiens
gcttatggtaccagatgcag

SEQ ID NO: 1394226 - DNA, 21 bp, Homo sapiens
gcttcaggtccaggctgtgtt

SEQ ID NO: 1394227 - DNA, 14 bp, Homo sapiens
gcttcatctggcaa

SEQ ID NO: 1394228 - DNA, 17 bp, Homo sapiens
gcttccttcatttcctc

SEQ ID NO: 1394229 - DNA, 17 bp, Homo sapiens
gcttctagttctgccag

SEQ ID NO: 1394230 - DNA, 19 bp, Homo sapiens
gcttctagttctgccagga

SEQ ID NO: 1394231 - DNA, 21 bp, Homo sapiens
gcttctagttctgccaggaga

SEQ ID NO: 1394232 - DNA, 14 bp, Homo sapiens
gcttctggccagga

SEQ ID NO: 1394233 - DNA, 14 bp, Homo sapiens
gcttgatttttgcc

SEQ ID NO: 1394234 - DNA, 15 bp, Homo sapiens
gcttggagctgagca

SEQ ID NO: 1394235 - DNA, 15 bp, Homo sapiens
gctttccatgggacc

SEQ ID NO: 1394236 - DNA, 15 bp, Homo sapiens
gctttccctgcctct

SEQ ID NO: 1394237 - DNA, 11 bp, Homo sapiens
gctttcctgaa

SEQ ID NO: 1394238 - DNA, 21 bp, Homo sapiens
gcttttagtattttagtgaac

SEQ ID NO: 1394239 - DNA, 19 bp, Homo sapiens
ggtttccctactgaagccc

SEQ ID NO: 1394240 - DNA, 17 bp, Homo sapiens
ggtttctgagttcctgc

SEQ ID NO: 1394241 - DNA, 13 bp, Homo sapiens
gtaaaaaagtgtt

SEQ ID NO: 1394242 - DNA, 20 bp, Homo sapiens
gtaaaaaagttaaatgtgtg

SEQ ID NO: 1394243 - DNA, 18 bp, Homo sapiens
gtaaaagcaaaaaagaaa

SEQ ID NO: 1394244 - DNA, 19 bp, Homo sapiens
gtaaagatatttttatctt

SEQ ID NO: 1394245 - DNA, 22 bp, Homo sapiens
gtaaagatatttttatctttat

SEQ ID NO: 1394246 - DNA, 13 bp, Homo sapiens
gtaacaagccaga

SEQ ID NO: 1394247 - DNA, 15 bp, Homo sapiens
gtaacaagccagatt

SEQ ID NO: 1394248 - DNA, 13 bp, Homo sapiens
gtaactcatctgt

SEQ ID NO: 1394249 - DNA, 15 bp, Homo sapiens
gtaagacaaaggttt

SEQ ID NO: 1394250 - DNA, 17 bp, Homo sapiens
gtaagcctccctcctcg

SEQ ID NO: 1394251 - DNA, 20 bp, Homo sapiens
gtaataaaattcaacaaaca

SEQ ID NO: 1394252 - DNA, 17 bp, Homo sapiens
gtaatgttaatattgat

SEQ ID NO: 1394253 - DNA, 18 bp, Homo sapiens
gtaattgtactaaagcca

SEQ ID NO: 1394254 - DNA, 23 bp, Homo sapiens
gtaattgtactaaagccaaacat

SEQ ID NO: 1394255 - DNA, 12 bp, Homo sapiens
gtacaaaataaa

SEQ ID NO: 1394256 - DNA, 23 bp, Homo sapiens
gtacaaccacacccacactcaga

SEQ ID NO: 1394257 - DNA, 21 bp, Homo sapiens
gtacaagaagcattttgtaag

SEQ ID NO: 1394258 - DNA, 15 bp, Homo sapiens
gtacaatgtttcaga

SEQ ID NO: 1394259 - DNA, 13 bp, Homo sapiens
gtacagaaagctg

SEQ ID NO: 1394260 - DNA, 17 bp, Homo sapiens
gtacatagttatttatt

SEQ ID NO: 1394261 - DNA, 16 bp, Homo sapiens
gtacattggtaaacat

SEQ ID NO: 1394262 - DNA, 13 bp, Homo sapiens
gtaccaagcccct

SEQ ID NO: 1394263 - DNA, 19 bp, Homo sapiens
gtacttcctctaggaaatg

SEQ ID NO: 1394264 - DNA, 22 bp, Homo sapiens
gtacttcctctaggaaatgtac

SEQ ID NO: 1394265 - DNA, 18 bp, Homo sapiens
gtacttgctcttgatgcc

SEQ ID NO: 1394266 - DNA, 22 bp, Homo sapiens
gtacttgctcttgatgcctggc

SEQ ID NO: 1394267 - DNA, 21 bp, Homo sapiens
gtagaatgtaaagcttgtctg

SEQ ID NO: 1394268 - DNA, 17 bp, Homo sapiens
gtagaattatctaattt

SEQ ID NO: 1394269 - DNA, 14 bp, Homo sapiens
gtagaccaaaataa

SEQ ID NO: 1394270 - DNA, 22 bp, Homo sapiens
gtagatgcatttgggtccagga

SEQ ID NO: 1394271 - DNA, 15 bp, Homo sapiens
gtagccccagtgaca

SEQ ID NO: 1394272 - DNA, 19 bp, Homo sapiens
gtagccccagtgacagcta

SEQ ID NO: 1394273 - DNA, 23 bp, Homo sapiens
gtagcgggggagggtaggcagga

SEQ ID NO: 1394274 - DNA, 13 bp, Homo sapiens
gtaggaaatgtgg

SEQ ID NO: 1394275 - DNA, 19 bp, Homo sapiens
gtaggagactgtttggaaa

SEQ ID NO: 1394276 - DNA, 16 bp, Homo sapiens
gtagtaggcattttta

SEQ ID NO: 1394277 - DNA, 19 bp, Homo sapiens
gtagtgatttttatgccac

SEQ ID NO: 1394278 - DNA, 19 bp, Homo sapiens
gtataaaatgcaaaataaa

SEQ ID NO: 1394279 - DNA, 18 bp, Homo sapiens
gtatagcatgcatctgtt

SEQ ID NO: 1394280 - DNA, 20 bp, Homo sapiens
gtatagcatgcatctgttta

SEQ ID NO: 1394281 - DNA, 18 bp, Homo sapiens
gtatatatatatatatgt

SEQ ID NO: 1394282 - DNA, 13 bp, Homo sapiens
gtatcatcagtgt

SEQ ID NO: 1394283 - DNA, 16 bp, Homo sapiens
gtatgagtaggtttgg

SEQ ID NO: 1394284 - DNA, 15 bp, Homo sapiens
gtatggttgacacta

SEQ ID NO: 1394285 - DNA, 13 bp, Homo sapiens
gtatgtctccagt

SEQ ID NO: 1394286 - DNA, 17 bp, Homo sapiens
gtatttgttaatttaga

SEQ ID NO: 1394287 - DNA, 18 bp, Homo sapiens
gtatttgttaatttagaa

SEQ ID NO: 1394288 - DNA, 22 bp, Homo sapiens
gtatttgttaatttagaaaact

SEQ ID NO: 1394289 - DNA, 23 bp, Homo sapiens
gtatttgttaatttagaaaactt

SEQ ID NO: 1394290 - DNA, 19 bp, Homo sapiens
gtattttagtgaacttgaa

SEQ ID NO: 1394291 - DNA, 20 bp, Homo sapiens
gtattttagtgaacttgaaa

SEQ ID NO: 1394292 - DNA, 15 bp, Homo sapiens
gtcaaaacagattgt

SEQ ID NO: 1394293 - DNA, 12 bp, Homo sapiens
gtcaaacaaata

SEQ ID NO: 1394294 - DNA, 22 bp, Homo sapiens
gtcaacagttttcctatgcttt

SEQ ID NO: 1394295 - DNA, 14 bp, Homo sapiens
gtcaagtcatgatg

SEQ ID NO: 1394296 - DNA, 21 bp, Homo sapiens
gtcacctcagagacatacacc

SEQ ID NO: 1394297 - DNA, 12 bp, Homo sapiens
gtcactgagacc

SEQ ID NO: 1394298 - DNA, 19 bp, Homo sapiens
gtcactggaccactgggca

SEQ ID NO: 1394299 - DNA, 21 bp, Homo sapiens
gtcactggtagaccaaaataa

SEQ ID NO: 1394300 - DNA, 17 bp, Homo sapiens
gtcactgttccttgtca

SEQ ID NO: 1394301 - DNA, 16 bp, Homo sapiens
gtcagaacagcagact

SEQ ID NO: 1394302 - DNA, 19 bp, Homo sapiens
gtcagaacagcagactcag

SEQ ID NO: 1394303 - DNA, 13 bp, Homo sapiens
gtcagcattttct

SEQ ID NO: 1394304 - DNA, 15 bp, Homo sapiens
gtcatgtgacaggta

SEQ ID NO: 1394305 - DNA, 11 bp, Homo sapiens
gtcattaaatg

SEQ ID NO: 1394306 - DNA, 15 bp, Homo sapiens
gtcatttcatttcct

SEQ ID NO: 1394307 - DNA, 22 bp, Homo sapiens
gtcccgggacacctaggctagg

SEQ ID NO: 1394308 - DNA, 23 bp, Homo sapiens
gtccctgcctggaccagcctctc

SEQ ID NO: 1394309 - DNA, 20 bp, Homo sapiens
gtccctgggtagcgggggag

SEQ ID NO: 1394310 - DNA, 20 bp, Homo sapiens
gtcctcagagaatttctacc

SEQ ID NO: 1394311 - DNA, 19 bp, Homo sapiens
gtcctgcaccggggcctgg

SEQ ID NO: 1394312 - DNA, 20 bp, Homo sapiens
gtcctgcaccggggcctggg

SEQ ID NO: 1394313 - DNA, 22 bp, Homo sapiens
gtcctttctagagcactgccac

SEQ ID NO: 1394314 - DNA, 14 bp, Homo sapiens
gtcgattagactgg

SEQ ID NO: 1394315 - DNA, 20 bp, Homo sapiens
gtcgcccatgctggagtgca

SEQ ID NO: 1394316 - DNA, 21 bp, Homo sapiens
gtctaaagctggtttaatgtt

SEQ ID NO: 1394317 - DNA, 15 bp, Homo sapiens
gtctacttgctcagg

SEQ ID NO: 1394318 - DNA, 22 bp, Homo sapiens
gtctatcaaccccagacactgg

SEQ ID NO: 1394319 - DNA, 19 bp, Homo sapiens
gtctcatgtaaaataagaa

SEQ ID NO: 1394320 - DNA, 12 bp, Homo sapiens
gtctccctcctc

SEQ ID NO: 1394321 - DNA, 16 bp, Homo sapiens
gtctccctcctctgcc

SEQ ID NO: 1394322 - DNA, 19 bp, Homo sapiens
gtctccctcctctgcccgg

SEQ ID NO: 1394323 - DNA, 19 bp, Homo sapiens
gtctcctctgattatcagg

SEQ ID NO: 1394324 - DNA, 16 bp, Homo sapiens
gtctctcatgaacctc

SEQ ID NO: 1394325 - DNA, 13 bp, Homo sapiens
gtctgagagaggc

SEQ ID NO: 1394326 - DNA, 14 bp, Homo sapiens
gtctgagagaggcc

SEQ ID NO: 1394327 - DNA, 16 bp, Homo sapiens
gtctgctatcattatt

SEQ ID NO: 1394328 - DNA, 10 bp, Homo sapiens
gtctggaaag

SEQ ID NO: 1394329 - DNA, 20 bp, Homo sapiens
gtctggaaagtgatgtcaga

SEQ ID NO: 1394330 - DNA, 21 bp, Homo sapiens
gtctgggagtgttctgtttcc

SEQ ID NO: 1394331 - DNA, 21 bp, Homo sapiens
gtctgtccagataagttattt

SEQ ID NO: 1394332 - DNA, 16 bp, Homo sapiens
gtctgtggattttttc

SEQ ID NO: 1394333 - DNA, 15 bp, Homo sapiens
gtgaatcaagggtca

SEQ ID NO: 1394334 - DNA, 17 bp, Homo sapiens
gtgaatcaagggtcagg

SEQ ID NO: 1394335 - DNA, 14 bp, Homo sapiens
gtgacacaaacaca

SEQ ID NO: 1394336 - DNA, 21 bp, Homo sapiens
gtgacacaaacacacacaaaa

SEQ ID NO: 1394337 - DNA, 16 bp, Homo sapiens
gtgacgtctgggtggc

SEQ ID NO: 1394338 - DNA, 19 bp, Homo sapiens
gtgagaatctggctcctgt

SEQ ID NO: 1394339 - DNA, 18 bp, Homo sapiens
gtgagacagtctggaaag

SEQ ID NO: 1394340 - DNA, 14 bp, Homo sapiens
gtgagagaaagaga

SEQ ID NO: 1394341 - DNA, 18 bp, Homo sapiens
gtgagagaaagagaaatc

SEQ ID NO: 1394342 - DNA, 21 bp, Homo sapiens
gtgatccctagctgtgacctc

SEQ ID NO: 1394343 - DNA, 18 bp, Homo sapiens
gtgatttacgctcattgt

SEQ ID NO: 1394344 - DNA, 16 bp, Homo sapiens
gtgatttttatgccac

SEQ ID NO: 1394345 - DNA, 20 bp, Homo sapiens
gtgatttttatgccacctga

SEQ ID NO: 1394346 - DNA, 19 bp, Homo sapiens
gtgcaaggacctaaaacat

SEQ ID NO: 1394347 - DNA, 17 bp, Homo sapiens
gtgcaatgtaaatattt

SEQ ID NO: 1394348 - DNA, 22 bp, Homo sapiens
gtgcaatgtaaatattttaaag

SEQ ID NO: 1394349 - DNA, 15 bp, Homo sapiens
gtgcacaaatattta

SEQ ID NO: 1394350 - DNA, 14 bp, Homo sapiens
gtgccaatttcaag

SEQ ID NO: 1394351 - DNA, 22 bp, Homo sapiens
gtgcccccaaccatttcctcag

SEQ ID NO: 1394352 - DNA, 11 bp, Homo sapiens
gtgccttcatt

SEQ ID NO: 1394353 - DNA, 23 bp, Homo sapiens
gtgccttcctgtttttcacattt

SEQ ID NO: 1394354 - DNA, 19 bp, Homo sapiens
gtgcgtggtggtccctggg

SEQ ID NO: 1394355 - DNA, 20 bp, Homo sapiens
gtgcgtggtggtccctgggt

SEQ ID NO: 1394356 - DNA, 16 bp, Homo sapiens
gtgctatggtgctctg

SEQ ID NO: 1394357 - DNA, 15 bp, Homo sapiens
gtgctcaggagccct

SEQ ID NO: 1394358 - DNA, 18 bp, Homo sapiens
gtgctcaggagccctggg

SEQ ID NO: 1394359 - DNA, 16 bp, Homo sapiens
gtgctgggcccctgcc

SEQ ID NO: 1394360 - DNA, 19 bp, Homo sapiens
gtgctgggcccctgcctct

SEQ ID NO: 1394361 - DNA, 20 bp, Homo sapiens
gtgcttctagttctgccagg

SEQ ID NO: 1394362 - DNA, 23 bp, Homo sapiens
gtggaactacattagtacacagc

SEQ ID NO: 1394363 - DNA, 20 bp, Homo sapiens
gtggatatttatttaaacaa

SEQ ID NO: 1394364 - DNA, 14 bp, Homo sapiens
gtggcactggggca

SEQ ID NO: 1394365 - DNA, 22 bp, Homo sapiens
gtggcctaacctgccgagagtc

SEQ ID NO: 1394366 - DNA, 16 bp, Homo sapiens
gtggctcgggaggcga

SEQ ID NO: 1394367 - DNA, 19 bp, Homo sapiens
gtggctttaggagcagtgg

SEQ ID NO: 1394368 - DNA, 16 bp, Homo sapiens
gtgggagggtaccagc

SEQ ID NO: 1394369 - DNA, 21 bp, Homo sapiens
gtggggagagacgggccctgg

SEQ ID NO: 1394370 - DNA, 18 bp, Homo sapiens
gtggggggggtgctgggc

SEQ ID NO: 1394371 - DNA, 14 bp, Homo sapiens
gtggtggctcggga

SEQ ID NO: 1394372 - DNA, 16 bp, Homo sapiens
ggaaatcaacttgctt

SEQ ID NO: 1394373 - DNA, 16 bp, Homo sapiens
ggaaccgaggcaggga

SEQ ID NO: 1394374 - DNA, 14 bp, Homo sapiens
ggaacttgaactga

SEQ ID NO: 1394375 - DNA, 18 bp, Homo sapiens
ggaacttgaactgattca

SEQ ID NO: 1394376 - DNA, 18 bp, Homo sapiens
ggaagagagcctgcagga

SEQ ID NO: 1394377 - DNA, 20 bp, Homo sapiens
ggaagctttggtgagaacct

SEQ ID NO: 1394378 - DNA, 19 bp, Homo sapiens
ggaaggcttgttgtgcttt

SEQ ID NO: 1394379 - DNA, 21 bp, Homo sapiens
ggaatatatatggaataagtg

SEQ ID NO: 1394380 - DNA, 13 bp, Homo sapiens
ggacaaagaacct

SEQ ID NO: 1394381 - DNA, 19 bp, Homo sapiens
ggacacactgtaaacccct

SEQ ID NO: 1394382 - DNA, 16 bp, Homo sapiens
ggacaccccgactttt

SEQ ID NO: 1394383 - DNA, 19 bp, Homo sapiens
ggacacctgggagaaatct

SEQ ID NO: 1394384 - DNA, 12 bp, Homo sapiens
ggacagcttgtg

SEQ ID NO: 1394385 - DNA, 22 bp, Homo sapiens
ggacagcttgtggcaagtgaat

SEQ ID NO: 1394386 - DNA, 18 bp, Homo sapiens
ggacaggatgtgtttgct

SEQ ID NO: 1394387 - DNA, 11 bp, Homo sapiens
ggaccaggagt

SEQ ID NO: 1394388 - DNA, 20 bp, Homo sapiens
ggaccaggagtgggtgggga

SEQ ID NO: 1394389 - DNA, 23 bp, Homo sapiens
ggaccaggagtgggtggggagtg

SEQ ID NO: 1394390 - DNA, 13 bp, Homo sapiens
ggacccagggctc

SEQ ID NO: 1394391 - DNA, 23 bp, Homo sapiens
ggactctgccccttctgtttcca

SEQ ID NO: 1394392 - DNA, 15 bp, Homo sapiens
ggactgtcatagaaa

SEQ ID NO: 1394393 - DNA, 17 bp, Homo sapiens
ggactgtgtgctcagga

SEQ ID NO: 1394394 - DNA, 23 bp, Homo sapiens
ggactgtgtgctcaggagccctg

SEQ ID NO: 1394395 - DNA, 22 bp, Homo sapiens
ggagaaatctggcttctggcca

SEQ ID NO: 1394396 - DNA, 17 bp, Homo sapiens
ggagaccggcctgccag

SEQ ID NO: 1394397 - DNA, 20 bp, Homo sapiens
ggagaccggcctgccaggag

SEQ ID NO: 1394398 - DNA, 21 bp, Homo sapiens
ggagaccggcctgccaggagg

SEQ ID NO: 1394399 - DNA, 22 bp, Homo sapiens
ggagaccggcctgccaggagga

SEQ ID NO: 1394400 - DNA, 21 bp, Homo sapiens
ggagactgggtgaaagtgact

SEQ ID NO: 1394401 - DNA, 15 bp, Homo sapiens
ggagagacgggccct

SEQ ID NO: 1394402 - DNA, 17 bp, Homo sapiens
ggagagacgggccctgg

SEQ ID NO: 1394403 - DNA, 18 bp, Homo sapiens
ggagcaggaggccaataa

SEQ ID NO: 1394404 - DNA, 20 bp, Homo sapiens
ggagcaggaggccaataaaa

SEQ ID NO: 1394405 - DNA, 15 bp, Homo sapiens
ggagcccactgtact

SEQ ID NO: 1394406 - DNA, 20 bp, Homo sapiens
ggagccctgggaggctctgg

SEQ ID NO: 1394407 - DNA, 15 bp, Homo sapiens
ggagcttgggaatgg

SEQ ID NO: 1394408 - DNA, 16 bp, Homo sapiens
ggaggacccagggctc

SEQ ID NO: 1394409 - DNA, 14 bp, Homo sapiens
ggaggccaataaaa

SEQ ID NO: 1394410 - DNA, 22 bp, Homo sapiens
ggaggccaataaaaagttcaga

SEQ ID NO: 1394411 - DNA, 20 bp, Homo sapiens
ggaggctctggagcccactg

SEQ ID NO: 1394412 - DNA, 12 bp, Homo sapiens
ggagtcttgctc

SEQ ID NO: 1394413 - DNA, 16 bp, Homo sapiens
ggagtgtgcgtggtgg

SEQ ID NO: 1394414 - DNA, 16 bp, Homo sapiens
ggatatagttttactt

SEQ ID NO: 1394415 - DNA, 17 bp, Homo sapiens
ggatcccatgagctcct

SEQ ID NO: 1394416 - DNA, 18 bp, Homo sapiens
ggattctcctttttaccc

SEQ ID NO: 1394417 - DNA, 16 bp, Homo sapiens
ggcaaaatccttgctt

SEQ ID NO: 1394418 - DNA, 16 bp, Homo sapiens
ggcaaatatcttgaaa

SEQ ID NO: 1394419 - DNA, 13 bp, Homo sapiens
ggcacagcctggc

SEQ ID NO: 1394420 - DNA, 18 bp, Homo sapiens
ggcagactctttatgctt

SEQ ID NO: 1394421 - DNA, 12 bp, Homo sapiens
ggcagcctctgg

SEQ ID NO: 1394422 - DNA, 16 bp, Homo sapiens
ggcagcctctgggggg

SEQ ID NO: 1394423 - DNA, 23 bp, Homo sapiens
ggcagcctctggggggtggccag

SEQ ID NO: 1394424 - DNA, 17 bp, Homo sapiens
ggcaggattggggaaga

SEQ ID NO: 1394425 - DNA, 18 bp, Homo sapiens
ggcaggcaggctcccagg

SEQ ID NO: 1394426 - DNA, 12 bp, Homo sapiens
ggcaggggccgg

SEQ ID NO: 1394427 - DNA, 15 bp, Homo sapiens
ggcagtgggaaaaat

SEQ ID NO: 1394428 - DNA, 16 bp, Homo sapiens
ggcatccagagtccct

SEQ ID NO: 1394429 - DNA, 13 bp, Homo sapiens
ggcatccctgggc

SEQ ID NO: 1394430 - DNA, 14 bp, Homo sapiens
ggcatccctgggcc

SEQ ID NO: 1394431 - DNA, 23 bp, Homo sapiens
ggcatgtgtttactttatgttac

SEQ ID NO: 1394432 - DNA, 21 bp, Homo sapiens
ggcatttttaccatcactgag

SEQ ID NO: 1394433 - DNA, 22 bp, Homo sapiens
ggccaaagaaccaaagaagaaa

SEQ ID NO: 1394434 - DNA, 12 bp, Homo sapiens
ggccaataaaaa

SEQ ID NO: 1394435 - DNA, 21 bp, Homo sapiens
ggccaataaaaagttcagagt

SEQ ID NO: 1394436 - DNA, 22 bp, Homo sapiens
ggccaatgcacctaaagaaaaa

SEQ ID NO: 1394437 - DNA, 21 bp, Homo sapiens
ggccagatgcacatccctgga

SEQ ID NO: 1394438 - DNA, 20 bp, Homo sapiens
ggccattctttcccaacacc

SEQ ID NO: 1394439 - DNA, 18 bp, Homo sapiens
ggcccctgcctctctgca

SEQ ID NO: 1394440 - DNA, 21 bp, Homo sapiens
ggccgtgacgtctgggtggcc

SEQ ID NO: 1394441 - DNA, 15 bp, Homo sapiens
ggcctaacctgccga

SEQ ID NO: 1394442 - DNA, 16 bp, Homo sapiens
ggcctaacctgccgag

SEQ ID NO: 1394443 - DNA, 21 bp, Homo sapiens
ggcctaacctgccgagagtcc

SEQ ID NO: 1394444 - DNA, 14 bp, Homo sapiens
ggcctgggcaggag

SEQ ID NO: 1394445 - DNA, 17 bp, Homo sapiens
ggccttgcggctcctca

SEQ ID NO: 1394446 - DNA, 13 bp, Homo sapiens
ggccttgggctcc

SEQ ID NO: 1394447 - DNA, 16 bp, Homo sapiens
ggcctttaaagactta

SEQ ID NO: 1394448 - DNA, 22 bp, Homo sapiens
ggcgaagcgttgtcctcagccc

SEQ ID NO: 1394449 - DNA, 14 bp, Homo sapiens
ggcgcaggccgtga

SEQ ID NO: 1394450 - DNA, 20 bp, Homo sapiens
ggctagagtgcggtggcgcg

SEQ ID NO: 1394451 - DNA, 21 bp, Homo sapiens
ggctcagccctagccctcagc

SEQ ID NO: 1394452 - DNA, 13 bp, Homo sapiens
ggctctggagccc

SEQ ID NO: 1394453 - DNA, 14 bp, Homo sapiens
ggctctggagccca

SEQ ID NO: 1394454 - DNA, 16 bp, Homo sapiens
ggctctggagcccact

SEQ ID NO: 1394455 - DNA, 13 bp, Homo sapiens
ggctgaaagacag

SEQ ID NO: 1394456 - DNA, 15 bp, Homo sapiens
ggctgataattttaa

SEQ ID NO: 1394457 - DNA, 14 bp, Homo sapiens
ggctgtctgaggct

SEQ ID NO: 1394458 - DNA, 17 bp, Homo sapiens
gggacaggtcctcagtg

SEQ ID NO: 1394459 - DNA, 12 bp, Homo sapiens
gggaccaggagt

SEQ ID NO: 1394460 - DNA, 17 bp, Homo sapiens
gggagaccggcctgcca

SEQ ID NO: 1394461 - DNA, 14 bp, Homo sapiens
gggaggagaatgag

SEQ ID NO: 1394462 - DNA, 16 bp, Homo sapiens
gggaggagggcaggca

SEQ ID NO: 1394463 - DNA, 14 bp, Homo sapiens
gggcataaattatt

SEQ ID NO: 1394464 - DNA, 15 bp, Homo sapiens
gggcattaaaaatag

SEQ ID NO: 1394465 - DNA, 13 bp, Homo sapiens
gggcccctgcctc

SEQ ID NO: 1394466 - DNA, 15 bp, Homo sapiens
gggcccctgcctctc

SEQ ID NO: 1394467 - DNA, 19 bp, Homo sapiens
gggcccctgcctctctgca

SEQ ID NO: 1394468 - DNA, 22 bp, Homo sapiens
gggcccctgcctctctgcaggt

SEQ ID NO: 1394469 - DNA, 12 bp, Homo sapiens
gggcccggacgc

SEQ ID NO: 1394470 - DNA, 13 bp, Homo sapiens
gggcctgggcagg

SEQ ID NO: 1394471 - DNA, 13 bp, Homo sapiens
gggccttgggctc

SEQ ID NO: 1394472 - DNA, 24 bp, Homo sapiens
gggccttgggctccgtgtgggaga

SEQ ID NO: 1394473 - DNA, 19 bp, Homo sapiens
gggcctttaaagacttaag

SEQ ID NO: 1394474 - DNA, 21 bp, Homo sapiens
gggctccccttcgcgtatttc

SEQ ID NO: 1394475 - DNA, 17 bp, Homo sapiens
ggggacacatgtatttg

SEQ ID NO: 1394476 - DNA, 15 bp, Homo sapiens
ggggacaggtcctca

SEQ ID NO: 1394477 - DNA, 17 bp, Homo sapiens
ggggagggtaggcagga

SEQ ID NO: 1394478 - DNA, 14 bp, Homo sapiens
ggggccaggctggg

SEQ ID NO: 1394479 - DNA, 23 bp, Homo sapiens
ggggcctgcccagtgcacttgct

SEQ ID NO: 1394480 - DNA, 12 bp, Homo sapiens
ggggcctgggca

SEQ ID NO: 1394481 - DNA, 15 bp, Homo sapiens
ggggcgcggctggga

SEQ ID NO: 1394482 - DNA, 19 bp, Homo sapiens
gggggcctttaaagactta

SEQ ID NO: 1394483 - DNA, 13 bp, Homo sapiens
gggggtggccagg

SEQ ID NO: 1394484 - DNA, 20 bp, Homo sapiens
gggtaggcaggattggggaa

SEQ ID NO: 1394485 - DNA, 19 bp, Homo sapiens
gggtcaggcctttgagctc

SEQ ID NO: 1394486 - DNA, 21 bp, Homo sapiens
gggtcaggcctttgagctcag

SEQ ID NO: 1394487 - DNA, 13 bp, Homo sapiens
gggtcgccctgga

SEQ ID NO: 1394488 - DNA, 18 bp, Homo sapiens
gggtggggagagacgggc

SEQ ID NO: 1394489 - DNA, 15 bp, Homo sapiens
ggtagaatgtaaagc

SEQ ID NO: 1394490 - DNA, 19 bp, Homo sapiens
ggtagaatgtaaagcttgt

SEQ ID NO: 1394491 - DNA, 21 bp, Homo sapiens
ggtcagcatgtctattcagct

SEQ ID NO: 1394492 - DNA, 22 bp, Homo sapiens
ggtccaaaataaaacctcagct

SEQ ID NO: 1394493 - DNA, 13 bp, Homo sapiens
ggtccctaataaa

SEQ ID NO: 1394494 - DNA, 17 bp, Homo sapiens
ggtccctaataaagctg

SEQ ID NO: 1394495 - DNA, 11 bp, Homo sapiens
ggtccctgggt

SEQ ID NO: 1394496 - DNA, 20 bp, Homo sapiens
ggtctcctctgattatcagg

SEQ ID NO: 1394497 - DNA, 21 bp, Homo sapiens
ggtgagaacctgggttgcaga

SEQ ID NO: 1394498 - DNA, 16 bp, Homo sapiens
ggtgctgggcccctgc

SEQ ID NO: 1394499 - DNA, 20 bp, Homo sapiens
ggtggcccttatgactgcca

SEQ ID NO: 1394500 - DNA, 23 bp, Homo sapiens
ggtggcccttatgactgccaaga

SEQ ID NO: 1394501 - DNA, 21 bp, Homo sapiens
ggtggggagagacgggccctg

SEQ ID NO: 1394502 - DNA, 14 bp, Homo sapiens
ggtggtccctgggt

SEQ ID NO: 1394503 - DNA, 15 bp, Homo sapiens
ggtggtggctcggga

SEQ ID NO: 1394504 - DNA, 21 bp, Homo sapiens
ggttcttgaggggaccaggag

SEQ ID NO: 1394505 - DNA, 20 bp, Homo sapiens
ggtttcaccatgttggccag

SEQ ID NO: 1394506 - DNA, 15 bp, Homo sapiens
gtggtggtccctggg

SEQ ID NO: 1394507 - DNA, 14 bp, Homo sapiens
gtgtaaaaaagtgt

SEQ ID NO: 1394508 - DNA, 19 bp, Homo sapiens
gtgtaagggccagaaatat

SEQ ID NO: 1394509 - DNA, 15 bp, Homo sapiens
gtgtcactcaaggcg

SEQ ID NO: 1394510 - DNA, 22 bp, Homo sapiens
gtgtcactcaaggcggtgcttg

SEQ ID NO: 1394511 - DNA, 20 bp, Homo sapiens
gtgtgcacaaatatttattt

SEQ ID NO: 1394512 - DNA, 16 bp, Homo sapiens
gtgtgctcaggagccc

SEQ ID NO: 1394513 - DNA, 13 bp, Homo sapiens
gtgtttctgactc

SEQ ID NO: 1394514 - DNA, 13 bp, Homo sapiens
gtgtttgctttct

SEQ ID NO: 1394515 - DNA, 14 bp, Homo sapiens
gtgtttggctttca

SEQ ID NO: 1394516 - DNA, 18 bp, Homo sapiens
gtgttttaataaacgttt

SEQ ID NO: 1394517 - DNA, 19 bp, Homo sapiens
gttaaaatataaattaaga

SEQ ID NO: 1394518 - DNA, 23 bp, Homo sapiens
gttaaaatataaattaagacttt

SEQ ID NO: 1394519 - DNA, 12 bp, Homo sapiens
gttaaatgtgtg

SEQ ID NO: 1394520 - DNA, 16 bp, Homo sapiens
gttaagacttgacagt

SEQ ID NO: 1394521 - DNA, 12 bp, Homo sapiens
gttaatttttga

SEQ ID NO: 1394522 - DNA, 14 bp, Homo sapiens
gttacatgtttgca

SEQ ID NO: 1394523 - DNA, 16 bp, Homo sapiens
gttacatgtttgcacc

SEQ ID NO: 1394524 - DNA, 21 bp, Homo sapiens
gttacctctatataccaaagc

SEQ ID NO: 1394525 - DNA, 19 bp, Homo sapiens
gttagaaatgcagaatcct

SEQ ID NO: 1394526 - DNA, 20 bp, Homo sapiens
gttatgatttttttttcata

SEQ ID NO: 1394527 - DNA, 12 bp, Homo sapiens
gttattaaacag

SEQ ID NO: 1394528 - DNA, 22 bp, Homo sapiens
gttattaaacaggtggttcttt

SEQ ID NO: 1394529 - DNA, 12 bp, Homo sapiens
gttatttataat

SEQ ID NO: 1394530 - DNA, 16 bp, Homo sapiens
gttatttgtaatagat

SEQ ID NO: 1394531 - DNA, 17 bp, Homo sapiens
gttatttgtaatagatg

SEQ ID NO: 1394532 - DNA, 16 bp, Homo sapiens
gttatttttattattg

SEQ ID NO: 1394533 - DNA, 21 bp, Homo sapiens
gttcaatataagcttttcttt

SEQ ID NO: 1394534 - DNA, 22 bp, Homo sapiens
gttcagctaagctaggaatgaa

SEQ ID NO: 1394535 - DNA, 12 bp, Homo sapiens
gttcatgagaat

SEQ ID NO: 1394536 - DNA, 13 bp, Homo sapiens
gttcattgtaaat

SEQ ID NO: 1394537 - DNA, 16 bp, Homo sapiens
gttcccatttcagctg

SEQ ID NO: 1394538 - DNA, 13 bp, Homo sapiens
gttctgaaattta

SEQ ID NO: 1394539 - DNA, 22 bp, Homo sapiens
gttcttacctgtatgtctccag

SEQ ID NO: 1394540 - DNA, 16 bp, Homo sapiens
gttgaaatatgatgtt

SEQ ID NO: 1394541 - DNA, 17 bp, Homo sapiens
gttgagagtgtgaccaa

SEQ ID NO: 1394542 - DNA, 16 bp, Homo sapiens
gttgattacagtgcag

SEQ ID NO: 1394543 - DNA, 20 bp, Homo sapiens
gttgcattaaaaatgcatat

SEQ ID NO: 1394544 - DNA, 20 bp, Homo sapiens
gttgggagagggcgcaggcc

SEQ ID NO: 1394545 - DNA, 21 bp, Homo sapiens
gttggggacacatgtatttgg

SEQ ID NO: 1394546 - DNA, 17 bp, Homo sapiens
gtttaagccaaaacaat

SEQ ID NO: 1394547 - DNA, 13 bp, Homo sapiens
gtttaatgttttg

SEQ ID NO: 1394548 - DNA, 15 bp, Homo sapiens
gtttaccagaaagca

SEQ ID NO: 1394549 - DNA, 15 bp, Homo sapiens
gtttcagaagcccca

SEQ ID NO: 1394550 - DNA, 22 bp, Homo sapiens
gtttcaggagagagttgaacct

SEQ ID NO: 1394551 - DNA, 17 bp, Homo sapiens
gtttctgactctgagct

SEQ ID NO: 1394552 - DNA, 23 bp, Homo sapiens
gtttctttctttctttattttga

SEQ ID NO: 1394553 - DNA, 16 bp, Homo sapiens
gtttgatagattttct

SEQ ID NO: 1394554 - DNA, 15 bp, Homo sapiens
gtttgccttccagaa

SEQ ID NO: 1394555 - DNA, 11 bp, Homo sapiens
gtttgctttct

SEQ ID NO: 1394556 - DNA, 20 bp, Homo sapiens
gtttggatatgtaaaacatt

SEQ ID NO: 1394557 - DNA, 13 bp, Homo sapiens
gtttggctttcag

SEQ ID NO: 1394558 - DNA, 21 bp, Homo sapiens
gttttacttttaaactgtgta

SEQ ID NO: 1394559 - DNA, 11 bp, Homo sapiens
gttttatcagt

SEQ ID NO: 1394560 - DNA, 14 bp, Homo sapiens
gttttctctgaaca

SEQ ID NO: 1394561 - DNA, 12 bp, Homo sapiens
gtttttaatgta

SEQ ID NO: 1394562 - DNA, 21 bp, Homo sapiens
gtttttatctgaaatcaatta

SEQ ID NO: 1394563 - DNA, 14 bp, Homo sapiens
gtttttcacatttt

SEQ ID NO: 1394564 - DNA, 17 bp, Homo sapiens
taaaaaagcttaaaact

SEQ ID NO: 1394565 - DNA, 14 bp, Homo sapiens
taaaaagatcactt

SEQ ID NO: 1394566 - DNA, 16 bp, Homo sapiens
taaaaaggcctcctgg

SEQ ID NO: 1394567 - DNA, 13 bp, Homo sapiens
taaaacagacact

SEQ ID NO: 1394568 - DNA, 18 bp, Homo sapiens
taaaacctcagctagctc

SEQ ID NO: 1394569 - DNA, 14 bp, Homo sapiens
taaaactttgaagt

SEQ ID NO: 1394570 - DNA, 13 bp, Homo sapiens
taaaagaaacttt

SEQ ID NO: 1394571 - DNA, 14 bp, Homo sapiens
taaaagaaactttc

SEQ ID NO: 1394572 - DNA, 12 bp, Homo sapiens
taaaagatgctt

SEQ ID NO: 1394573 - DNA, 14 bp, Homo sapiens
taaaagatgctttt

SEQ ID NO: 1394574 - DNA, 20 bp, Homo sapiens
taaaagcaaaaaagaaaacc

SEQ ID NO: 1394575 - DNA, 18 bp, Homo sapiens
taaaagtcagcattttct

SEQ ID NO: 1394576 - DNA, 17 bp, Homo sapiens
taaaagtgccattaaca

SEQ ID NO: 1394577 - DNA, 13 bp, Homo sapiens
taaaatatttatt

SEQ ID NO: 1394578 - DNA, 18 bp, Homo sapiens
taaaatgccgattacacc

SEQ ID NO: 1394579 - DNA, 21 bp, Homo sapiens
taaaatgttctccttagatgt

SEQ ID NO: 1394580 - DNA, 23 bp, Homo sapiens
taaaatgttctccttagatgtga

SEQ ID NO: 1394581 - DNA, 12 bp, Homo sapiens
taaaattttcta

SEQ ID NO: 1394582 - DNA, 15 bp, Homo sapiens
taaacaaatgtgtaa

SEQ ID NO: 1394583 - DNA, 18 bp, Homo sapiens
taaacaagtatttgttaa

SEQ ID NO: 1394584 - DNA, 22 bp, Homo sapiens
taaacaagtatttgttaattta

SEQ ID NO: 1394585 - DNA, 14 bp, Homo sapiens
taaacacagacagg

SEQ ID NO: 1394586 - DNA, 20 bp, Homo sapiens
taaacagtgagcctgaattt

SEQ ID NO: 1394587 - DNA, 13 bp, Homo sapiens
taaaccttttttg

SEQ ID NO: 1394588 - DNA, 15 bp, Homo sapiens
taaactataagcaag

SEQ ID NO: 1394589 - DNA, 15 bp, Homo sapiens
taaactgtgtacata

SEQ ID NO: 1394590 - DNA, 17 bp, Homo sapiens
taaactgtgtattccaa

SEQ ID NO: 1394591 - DNA, 16 bp, Homo sapiens
taaagaaatagaacaa

SEQ ID NO: 1394592 - DNA, 17 bp, Homo sapiens
taaagaaatagaacaag

SEQ ID NO: 1394593 - DNA, 15 bp, Homo sapiens
taaagaattattttg

SEQ ID NO: 1394594 - DNA, 22 bp, Homo sapiens
taaagatatttttatctttata

SEQ ID NO: 1394595 - DNA, 22 bp, Homo sapiens
taaagattttttaataatttag

SEQ ID NO: 1394596 - DNA, 19 bp, Homo sapiens
taaagcatttagaaaactt

SEQ ID NO: 1394597 - DNA, 15 bp, Homo sapiens
taaagccatgctgga

SEQ ID NO: 1394598 - DNA, 15 bp, Homo sapiens
taaagcgtttgcaca

SEQ ID NO: 1394599 - DNA, 23 bp, Homo sapiens
taaagctaaaataaagaaataga

SEQ ID NO: 1394600 - DNA, 15 bp, Homo sapiens
taaagctggtttaat

SEQ ID NO: 1394601 - DNA, 11 bp, Homo sapiens
taaagcttgtc

SEQ ID NO: 1394602 - DNA, 23 bp, Homo sapiens
taaagtaaaaaagttaaatgtgt

SEQ ID NO: 1394603 - DNA, 19 bp, Homo sapiens
taaagtgactaatggcatg

SEQ ID NO: 1394604 - DNA, 16 bp, Homo sapiens
taaagttgataaagat

SEQ ID NO: 1394605 - DNA, 13 bp, Homo sapiens
taaataaaccctt

SEQ ID NO: 1394606 - DNA, 13 bp, Homo sapiens
taaataagaaact

SEQ ID NO: 1394607 - DNA, 15 bp, Homo sapiens
taaataagaaacttt

SEQ ID NO: 1394608 - DNA, 21 bp, Homo sapiens
taaatcacgctttttgaaaaa

SEQ ID NO: 1394609 - DNA, 22 bp, Homo sapiens
taaatcacgctttttgaaaaag

SEQ ID NO: 1394610 - DNA, 19 bp, Homo sapiens
taaatcttttataggattt

SEQ ID NO: 1394611 - DNA, 23 bp, Homo sapiens
taaatcttttataggatttattt

SEQ ID NO: 1394612 - DNA, 17 bp, Homo sapiens
taaatggggctcacaaa

SEQ ID NO: 1394613 - DNA, 17 bp, Homo sapiens
taaatgtaaagatattt

SEQ ID NO: 1394614 - DNA, 18 bp, Homo sapiens
taaattattgtttttctt

SEQ ID NO: 1394615 - DNA, 22 bp, Homo sapiens
taaattctctctcttgcaggaa

SEQ ID NO: 1394616 - DNA, 20 bp, Homo sapiens
taaatttctatttttatctg

SEQ ID NO: 1394617 - DNA, 20 bp, Homo sapiens
taacaaaaataaaaactctt

SEQ ID NO: 1394618 - DNA, 15 bp, Homo sapiens
taacaagatatttat

SEQ ID NO: 1394619 - DNA, 15 bp, Homo sapiens
taacaagccagattt

SEQ ID NO: 1394620 - DNA, 20 bp, Homo sapiens
taacagaagttgtgaaacta

SEQ ID NO: 1394621 - DNA, 21 bp, Homo sapiens
taacagaagttgtgaaactaa

SEQ ID NO: 1394622 - DNA, 22 bp, Homo sapiens
taaccagacacatactcatttt

SEQ ID NO: 1394623 - DNA, 19 bp, Homo sapiens
taactaggttgctacttta

SEQ ID NO: 1394624 - DNA, 15 bp, Homo sapiens
taactcatctgtcac

SEQ ID NO: 1394625 - DNA, 12 bp, Homo sapiens
taactcattaga

SEQ ID NO: 1394626 - DNA, 14 bp, Homo sapiens
taactctctttatg

SEQ ID NO: 1394627 - DNA, 17 bp, Homo sapiens
taactgggggaaaagat

SEQ ID NO: 1394628 - DNA, 19 bp, Homo sapiens
taactgggtaatgaaacaa

SEQ ID NO: 1394629 - DNA, 18 bp, Homo sapiens
taacttttgtaagacaaa

SEQ ID NO: 1394630 - DNA, 19 bp, Homo sapiens
taagaaacttttttattta

SEQ ID NO: 1394631 - DNA, 20 bp, Homo sapiens
taagaaacttttttatttaa

SEQ ID NO: 1394632 - DNA, 17 bp, Homo sapiens
taagacttgacagtgga

SEQ ID NO: 1394633 - DNA, 18 bp, Homo sapiens
taagagaagtagaaatca

SEQ ID NO: 1394634 - DNA, 12 bp, Homo sapiens
taagagctcagg

SEQ ID NO: 1394635 - DNA, 22 bp, Homo sapiens
taagagctcaggatgagggaaa

SEQ ID NO: 1394636 - DNA, 21 bp, Homo sapiens
taagatacactcctgctgtgc

SEQ ID NO: 1394637 - DNA, 18 bp, Homo sapiens
taagatcttttattttgc

SEQ ID NO: 1394638 - DNA, 16 bp, Homo sapiens
taagatttccttcttt

SEQ ID NO: 1394639 - DNA, 14 bp, Homo sapiens
taagcaagaaggca

SEQ ID NO: 1394640 - DNA, 22 bp, Homo sapiens
taagcattgaatggctatgttt

SEQ ID NO: 1394641 - DNA, 13 bp, Homo sapiens
taagggaagaatt

SEQ ID NO: 1394642 - DNA, 18 bp, Homo sapiens
taaggtacaagaagcatt

SEQ ID NO: 1394643 - DNA, 13 bp, Homo sapiens
taaggtgtagcca

SEQ ID NO: 1394644 - DNA, 21 bp, Homo sapiens
taaggtgtagccacaccagga

SEQ ID NO: 1394645 - DNA, 21 bp, Homo sapiens
taagtattatgtctcttctga

SEQ ID NO: 1394646 - DNA, 13 bp, Homo sapiens
taagtcagaacag

SEQ ID NO: 1394647 - DNA, 14 bp, Homo sapiens
taagtcagaacagc

SEQ ID NO: 1394648 - DNA, 15 bp, Homo sapiens
taagtgaaattttaa

SEQ ID NO: 1394649 - DNA, 18 bp, Homo sapiens
taagtgaaattttaaaag

SEQ ID NO: 1394650 - DNA, 11 bp, Homo sapiens
taataaagctg

SEQ ID NO: 1394651 - DNA, 22 bp, Homo sapiens
taatacagcaacaatttatgaa

SEQ ID NO: 1394652 - DNA, 15 bp, Homo sapiens
taatactcacctcct

SEQ ID NO: 1394653 - DNA, 19 bp, Homo sapiens
taatactgctgagatacat

SEQ ID NO: 1394654 - DNA, 23 bp, Homo sapiens
taatactgctgagatacatacag

SEQ ID NO: 1394655 - DNA, 16 bp, Homo sapiens
taatagatgtttgata

SEQ ID NO: 1394656 - DNA, 15 bp, Homo sapiens
taatagcaaagaatt

SEQ ID NO: 1394657 - DNA, 13 bp, Homo sapiens
taatataatttaa

SEQ ID NO: 1394658 - DNA, 18 bp, Homo sapiens
taatatatattatctttt

SEQ ID NO: 1394659 - DNA, 23 bp, Homo sapiens
taatatcccactgggagaaagga

SEQ ID NO: 1394660 - DNA, 14 bp, Homo sapiens
taatatgtttgagg

SEQ ID NO: 1394661 - DNA, 15 bp, Homo sapiens
taatcacgctttcct

SEQ ID NO: 1394662 - DNA, 17 bp, Homo sapiens
taatcacgctttcctga

SEQ ID NO: 1394663 - DNA, 17 bp, Homo sapiens
taatcagacaccagatt

SEQ ID NO: 1394664 - DNA, 19 bp, Homo sapiens
taatcaggtcctcagagaa

SEQ ID NO: 1394665 - DNA, 14 bp, Homo sapiens
taatctaaatataa

SEQ ID NO: 1394666 - DNA, 17 bp, Homo sapiens
taatctaaatataaacc

SEQ ID NO: 1394667 - DNA, 17 bp, Homo sapiens
taatctctgtaaagcta

SEQ ID NO: 1394668 - DNA, 18 bp, Homo sapiens
taatctctgtaaagctaa

SEQ ID NO: 1394669 - DNA, 13 bp, Homo sapiens
taatctgcctccc

SEQ ID NO: 1394670 - DNA, 22 bp, Homo sapiens
taatcttattcattttctctaa

SEQ ID NO: 1394671 - DNA, 13 bp, Homo sapiens
taatgaaacaaag

SEQ ID NO: 1394672 - DNA, 16 bp, Homo sapiens
taatgaaacaaagagt

SEQ ID NO: 1394673 - DNA, 17 bp, Homo sapiens
taatgaaacaaagagtt

SEQ ID NO: 1394674 - DNA, 23 bp, Homo sapiens
taatgaaacaaagagttcaagaa

SEQ ID NO: 1394675 - DNA, 13 bp, Homo sapiens
taatgaacaaatg

SEQ ID NO: 1394676 - DNA, 14 bp, Homo sapiens
taatgaacaaatgg

SEQ ID NO: 1394677 - DNA, 15 bp, Homo sapiens
taatggcatgagaaa

SEQ ID NO: 1394678 - DNA, 17 bp, Homo sapiens
taatggcatgagaaata

SEQ ID NO: 1394679 - DNA, 16 bp, Homo sapiens
taatgttaatattgat

SEQ ID NO: 1394680 - DNA, 22 bp, Homo sapiens
taattgtactaaagccaaacat

SEQ ID NO: 1394681 - DNA, 14 bp, Homo sapiens
taatttatgcagaa

SEQ ID NO: 1394682 - DNA, 22 bp, Homo sapiens
taatttgaggacaaccattcca

SEQ ID NO: 1394683 - DNA, 13 bp, Homo sapiens
taattttaaattc

SEQ ID NO: 1394684 - DNA, 20 bp, Homo sapiens
taatttttgatactaagcat

SEQ ID NO: 1394685 - DNA, 19 bp, Homo sapiens
tacaaaataaacaaataac

SEQ ID NO: 1394686 - DNA, 20 bp, Homo sapiens
tacaaaataaacaaataaca

SEQ ID NO: 1394687 - DNA, 19 bp, Homo sapiens
tacaaactcccacttgtca

SEQ ID NO: 1394688 - DNA, 19 bp, Homo sapiens
tacaagaagcattttgtaa

SEQ ID NO: 1394689 - DNA, 13 bp, Homo sapiens
tacaagttagaaa

SEQ ID NO: 1394690 - DNA, 15 bp, Homo sapiens
tacaagttagaaaac

SEQ ID NO: 1394691 - DNA, 19 bp, Homo sapiens
tacaattaaagctgttatt

SEQ ID NO: 1394692 - DNA, 16 bp, Homo sapiens
tacacaatagaattat

SEQ ID NO: 1394693 - DNA, 15 bp, Homo sapiens
tacacagctctagac

SEQ ID NO: 1394694 - DNA, 16 bp, Homo sapiens
tacacccaaatattgt

SEQ ID NO: 1394695 - DNA, 14 bp, Homo sapiens
tacacctatgtcat

SEQ ID NO: 1394696 - DNA, 11 bp, Homo sapiens
tacactcctgc

SEQ ID NO: 1394697 - DNA, 13 bp, Homo sapiens
tacagaaagctgc

SEQ ID NO: 1394698 - DNA, 15 bp, Homo sapiens
tacagaattcaacag

SEQ ID NO: 1394699 - DNA, 20 bp, Homo sapiens
tacagcaacaatttatgaat

SEQ ID NO: 1394700 - DNA, 14 bp, Homo sapiens
tacagtctaaagct

SEQ ID NO: 1394701 - DNA, 15 bp, Homo sapiens
tacataattcactct

SEQ ID NO: 1394702 - DNA, 16 bp, Homo sapiens
tacataattcactctg

SEQ ID NO: 1394703 - DNA, 17 bp, Homo sapiens
tacataattcactctga

SEQ ID NO: 1394704 - DNA, 17 bp, Homo sapiens
tacatagatgcttagtc

SEQ ID NO: 1394705 - DNA, 19 bp, Homo sapiens
tacatatgtaaaatattgt

SEQ ID NO: 1394706 - DNA, 12 bp, Homo sapiens
tacatgaaacag

SEQ ID NO: 1394707 - DNA, 21 bp, Homo sapiens
tacatgaaacagaaacaaaaa

SEQ ID NO: 1394708 - DNA, 12 bp, Homo sapiens
tacatgtttgca

SEQ ID NO: 1394709 - DNA, 13 bp, Homo sapiens
tacatgtttgcac

SEQ ID NO: 1394710 - DNA, 19 bp, Homo sapiens
tacattttctaagaaacat

SEQ ID NO: 1394711 - DNA, 20 bp, Homo sapiens
tacattttctaagaaacatt

SEQ ID NO: 1394712 - DNA, 17 bp, Homo sapiens
taccactgctgatattt

SEQ ID NO: 1394713 - DNA, 20 bp, Homo sapiens
taccactgctgatattttct

SEQ ID NO: 1394714 - DNA, 13 bp, Homo sapiens
taccagaaagcag

SEQ ID NO: 1394715 - DNA, 15 bp, Homo sapiens
taccagaaagtgagg

SEQ ID NO: 1394716 - DNA, 18 bp, Homo sapiens
taccaggcaccaaaagaa

SEQ ID NO: 1394717 - DNA, 12 bp, Homo sapiens
taccatttcaga

SEQ ID NO: 1394718 - DNA, 19 bp, Homo sapiens
tacccagtaactcatctgt

SEQ ID NO: 1394719 - DNA, 18 bp, Homo sapiens
tacctgattttttttcct

SEQ ID NO: 1394720 - DNA, 12 bp, Homo sapiens
tacctgtgcctg

SEQ ID NO: 1394721 - DNA, 20 bp, Homo sapiens
tacctttttatttgcatgtg

SEQ ID NO: 1394722 - DNA, 13 bp, Homo sapiens
tactatttcacaa

SEQ ID NO: 1394723 - DNA, 12 bp, Homo sapiens
tactcacctcct

SEQ ID NO: 1394724 - DNA, 14 bp, Homo sapiens
tactcacctcctcc

SEQ ID NO: 1394725 - DNA, 15 bp, Homo sapiens
tactcacctcctccc

SEQ ID NO: 1394726 - DNA, 14 bp, Homo sapiens
tactcatttttcat

SEQ ID NO: 1394727 - DNA, 16 bp, Homo sapiens
tactcatttttcatga

SEQ ID NO: 1394728 - DNA, 17 bp, Homo sapiens
tactgaatttttaaaat

SEQ ID NO: 1394729 - DNA, 17 bp, Homo sapiens
tactgcatactttttaa

SEQ ID NO: 1394730 - DNA, 20 bp, Homo sapiens
tactgccattcacttcataa

SEQ ID NO: 1394731 - DNA, 22 bp, Homo sapiens
tactgccgtcagtgctgtgctg

SEQ ID NO: 1394732 - DNA, 20 bp, Homo sapiens
tactgctgagatacatacag

SEQ ID NO: 1394733 - DNA, 21 bp, Homo sapiens
tactgctgagatacatacaga

SEQ ID NO: 1394734 - DNA, 18 bp, Homo sapiens
tactggtccaaaagattg

SEQ ID NO: 1394735 - DNA, 20 bp, Homo sapiens
tacttatttttgacagtgtt

SEQ ID NO: 1394736 - DNA, 22 bp, Homo sapiens
tacttcgtgtccgactcttctg

SEQ ID NO: 1394737 - DNA, 17 bp, Homo sapiens
tacttgagataatctaa

SEQ ID NO: 1394738 - DNA, 18 bp, Homo sapiens
tacttgagataatctaaa

SEQ ID NO: 1394739 - DNA, 20 bp, Homo sapiens
tacttgagataatctaaata

SEQ ID NO: 1394740 - DNA, 14 bp, Homo sapiens
tacttgatgtaact

SEQ ID NO: 1394741 - DNA, 16 bp, Homo sapiens
tacttgctcaggtact

SEQ ID NO: 1394742 - DNA, 17 bp, Homo sapiens
tactttatgttactaca

SEQ ID NO: 1394743 - DNA, 20 bp, Homo sapiens
tactttatgttactacatgc

SEQ ID NO: 1394744 - DNA, 20 bp, Homo sapiens
tacttttacaagtaacaaaa

SEQ ID NO: 1394745 - DNA, 14 bp, Homo sapiens
tacttttgtttcag

SEQ ID NO: 1394746 - DNA, 11 bp, Homo sapiens
tagaaaacttt

SEQ ID NO: 1394747 - DNA, 16 bp, Homo sapiens
tagaaaactttaaagc

SEQ ID NO: 1394748 - DNA, 21 bp, Homo sapiens
tagaaaaggctaggtacacag

SEQ ID NO: 1394749 - DNA, 17 bp, Homo sapiens
tagaaagagatacagag

SEQ ID NO: 1394750 - DNA, 23 bp, Homo sapiens
tagaacctaattcaattcaaagc

SEQ ID NO: 1394751 - DNA, 20 bp, Homo sapiens
tagaagacaattgacaacag

SEQ ID NO: 1394752 - DNA, 21 bp, Homo sapiens
tagaatgatttcatgctatct

SEQ ID NO: 1394753 - DNA, 15 bp, Homo sapiens
tagaatgtaaagctt

SEQ ID NO: 1394754 - DNA, 21 bp, Homo sapiens
tagaattataactggaaagaa

SEQ ID NO: 1394755 - DNA, 21 bp, Homo sapiens
tagaattatctaatttataaa

SEQ ID NO: 1394756 - DNA, 23 bp, Homo sapiens
tagaattatctaatttataaaaa

SEQ ID NO: 1394757 - DNA, 14 bp, Homo sapiens
tagaccaaaataaa

SEQ ID NO: 1394758 - DNA, 18 bp, Homo sapiens
tagaggcttccttcattt

SEQ ID NO: 1394759 - DNA, 19 bp, Homo sapiens
tagaggcttccttcatttc

SEQ ID NO: 1394760 - DNA, 17 bp, Homo sapiens
tagaggtgagaaattta

SEQ ID NO: 1394761 - DNA, 17 bp, Homo sapiens
tagagttagatatgtgc

SEQ ID NO: 1394762 - DNA, 16 bp, Homo sapiens
tagatattggacaaag

SEQ ID NO: 1394763 - DNA, 15 bp, Homo sapiens
tagatctggcatgtt

SEQ ID NO: 1394764 - DNA, 15 bp, Homo sapiens
tagatgcatttgggt

SEQ ID NO: 1394765 - DNA, 22 bp, Homo sapiens
tagatgcatttgggtccaggag

SEQ ID NO: 1394766 - DNA, 19 bp, Homo sapiens
tagatttgtgtgcatcagg

SEQ ID NO: 1394767 - DNA, 22 bp, Homo sapiens
tagatttgtgtgcatcaggctt

SEQ ID NO: 1394768 - DNA, 13 bp, Homo sapiens
tagattttctgct

SEQ ID NO: 1394769 - DNA, 16 bp, Homo sapiens
tagcaaagatatctca

SEQ ID NO: 1394770 - DNA, 19 bp, Homo sapiens
tagcaaagatatctcatct

SEQ ID NO: 1394771 - DNA, 21 bp, Homo sapiens
tagccaaaaatagctaaatac

SEQ ID NO: 1394772 - DNA, 12 bp, Homo sapiens
tagccctcagcc

SEQ ID NO: 1394773 - DNA, 13 bp, Homo sapiens
tagccctcagccc

SEQ ID NO: 1394774 - DNA, 23 bp, Homo sapiens
tagcctcacttttaatgaacaaa

SEQ ID NO: 1394775 - DNA, 14 bp, Homo sapiens
tagccttctctgtt

SEQ ID NO: 1394776 - DNA, 22 bp, Homo sapiens
tagccttctctgttcatttcct

SEQ ID NO: 1394777 - DNA, 16 bp, Homo sapiens
tagcgtgctcactgac

SEQ ID NO: 1394778 - DNA, 17 bp, Homo sapiens
tagcgtgctcactgacc

SEQ ID NO: 1394779 - DNA, 21 bp, Homo sapiens
tagctgtctgctcagacagaa

SEQ ID NO: 1394780 - DNA, 15 bp, Homo sapiens
tagcttatctacttc

SEQ ID NO: 1394781 - DNA, 16 bp, Homo sapiens
tagcttccaataaagc

SEQ ID NO: 1394782 - DNA, 11 bp, Homo sapiens
tagctttgctc

SEQ ID NO: 1394783 - DNA, 11 bp, Homo sapiens
taggaaatgta

SEQ ID NO: 1394784 - DNA, 22 bp, Homo sapiens
taggattttttttaatgtttaa

SEQ ID NO: 1394785 - DNA, 21 bp, Homo sapiens
taggcatttttaccatcactg

SEQ ID NO: 1394786 - DNA, 18 bp, Homo sapiens
tagtaaatcacgcttttt

SEQ ID NO: 1394787 - DNA, 22 bp, Homo sapiens
tagtaaatcacgctttttgaaa

SEQ ID NO: 1394788 - DNA, 14 bp, Homo sapiens
tagtaatctgcatt

SEQ ID NO: 1394789 - DNA, 17 bp, Homo sapiens
tagtaatctgcattatt

SEQ ID NO: 1394790 - DNA, 16 bp, Homo sapiens
tagtaggcatttttac

SEQ ID NO: 1394791 - DNA, 18 bp, Homo sapiens
tagtatcatcagatagca

SEQ ID NO: 1394792 - DNA, 21 bp, Homo sapiens
tagtcaatcaagtctgtttac

SEQ ID NO: 1394793 - DNA, 17 bp, Homo sapiens
tagtggattactgccat

SEQ ID NO: 1394794 - DNA, 19 bp, Homo sapiens
tagtttcatataaagtatc

SEQ ID NO: 1394795 - DNA, 20 bp, Homo sapiens
tagtttcatataaagtatca

SEQ ID NO: 1394796 - DNA, 14 bp, Homo sapiens
tagttttactttta

SEQ ID NO: 1394797 - DNA, 23 bp, Homo sapiens
tataaaatgcaaaataaatgttt

SEQ ID NO: 1394798 - DNA, 11 bp, Homo sapiens
tataaattaag

SEQ ID NO: 1394799 - DNA, 15 bp, Homo sapiens
tataaattaagactt

SEQ ID NO: 1394800 - DNA, 16 bp, Homo sapiens
tataactggaaagaag

SEQ ID NO: 1394801 - DNA, 16 bp, Homo sapiens
tataatgggcattact

SEQ ID NO: 1394802 - DNA, 13 bp, Homo sapiens
tataatttaacag

SEQ ID NO: 1394803 - DNA, 15 bp, Homo sapiens
tataatttaacagaa

SEQ ID NO: 1394804 - DNA, 22 bp, Homo sapiens
tataccaaagcacattttaaaa

SEQ ID NO: 1394805 - DNA, 12 bp, Homo sapiens
tatacctcactt

SEQ ID NO: 1394806 - DNA, 20 bp, Homo sapiens
tatacctgattttttttcct

SEQ ID NO: 1394807 - DNA, 13 bp, Homo sapiens
tatacttttacaa

SEQ ID NO: 1394808 - DNA, 16 bp, Homo sapiens
tatagttttactttta

SEQ ID NO: 1394809 - DNA, 17 bp, Homo sapiens
tatagttttacttttaa

SEQ ID NO: 1394810 - DNA, 21 bp, Homo sapiens
tatataccaaagcacatttta

SEQ ID NO: 1394811 - DNA, 14 bp, Homo sapiens
tatatatatatatg

SEQ ID NO: 1394812 - DNA, 19 bp, Homo sapiens
tatatatggaataagtgta

SEQ ID NO: 1394813 - DNA, 22 bp, Homo sapiens
tatatatggaataagtgtacat

SEQ ID NO: 1394814 - DNA, 19 bp, Homo sapiens
tatatgaagaaaatcactt

SEQ ID NO: 1394815 - DNA, 14 bp, Homo sapiens
tatatgcttactga

SEQ ID NO: 1394816 - DNA, 16 bp, Homo sapiens
tatatgcttactgata

SEQ ID NO: 1394817 - DNA, 22 bp, Homo sapiens
tatattacactacacactgtgt

SEQ ID NO: 1394818 - DNA, 17 bp, Homo sapiens
tatcaaccccagacact

SEQ ID NO: 1394819 - DNA, 19 bp, Homo sapiens
tatcaaccccagacactgg

SEQ ID NO: 1394820 - DNA, 21 bp, Homo sapiens
tatcaaccccagacactggtt

SEQ ID NO: 1394821 - DNA, 18 bp, Homo sapiens
tatcatagaaatgtaact

SEQ ID NO: 1394822 - DNA, 18 bp, Homo sapiens
tatcatcagatagcatct

SEQ ID NO: 1394823 - DNA, 19 bp, Homo sapiens
tatctaagttaatttaaag

SEQ ID NO: 1394824 - DNA, 20 bp, Homo sapiens
tatctaagttaatttaaagt

SEQ ID NO: 1394825 - DNA, 22 bp, Homo sapiens
tatctaagttaatttaaagttg

SEQ ID NO: 1394826 - DNA, 13 bp, Homo sapiens
tatctaatttata

SEQ ID NO: 1394827 - DNA, 11 bp, Homo sapiens
tatctcatctc

SEQ ID NO: 1394828 - DNA, 22 bp, Homo sapiens
tatctccctgcctcctgccggc

SEQ ID NO: 1394829 - DNA, 17 bp, Homo sapiens
tatctctgtgtgcacaa

SEQ ID NO: 1394830 - DNA, 18 bp, Homo sapiens
tatcttactatttcacaa

SEQ ID NO: 1394831 - DNA, 21 bp, Homo sapiens
tatcttttcatacattttcta

SEQ ID NO: 1394832 - DNA, 23 bp, Homo sapiens
tatcttttcatacattttctaag

SEQ ID NO: 1394833 - DNA, 15 bp, Homo sapiens
tatgaaaaagaagaa

SEQ ID NO: 1394834 - DNA, 14 bp, Homo sapiens
tatgaacatattgt

SEQ ID NO: 1394835 - DNA, 18 bp, Homo sapiens
tatgaattgaattatctt

SEQ ID NO: 1394836 - DNA, 23 bp, Homo sapiens
tatgacatcacttgtacaaaata

SEQ ID NO: 1394837 - DNA, 15 bp, Homo sapiens
tatgatattttctgt

SEQ ID NO: 1394838 - DNA, 14 bp, Homo sapiens
tatgatgttaaaaa

SEQ ID NO: 1394839 - DNA, 19 bp, Homo sapiens
tatgatttttttttcatac

SEQ ID NO: 1394840 - DNA, 16 bp, Homo sapiens
tatgcaatttcctttt

SEQ ID NO: 1394841 - DNA, 14 bp, Homo sapiens
tatgcctgctattt

SEQ ID NO: 1394842 - DNA, 16 bp, Homo sapiens
tatgcttactgatata

SEQ ID NO: 1394843 - DNA, 14 bp, Homo sapiens
tatggattctaaaa

SEQ ID NO: 1394844 - DNA, 15 bp, Homo sapiens
tatggattctaaaat

SEQ ID NO: 1394845 - DNA, 20 bp, Homo sapiens
tatggcaaccattataacct

SEQ ID NO: 1394846 - DNA, 15 bp, Homo sapiens
tatgtaaaatattgt

SEQ ID NO: 1394847 - DNA, 21 bp, Homo sapiens
tatgtgccaaagtccatttat

SEQ ID NO: 1394848 - DNA, 17 bp, Homo sapiens
tatgtgggcagattttc

SEQ ID NO: 1394849 - DNA, 19 bp, Homo sapiens
tatgttaagggaagaattc

SEQ ID NO: 1394850 - DNA, 14 bp, Homo sapiens
tatgttattaaaca

SEQ ID NO: 1394851 - DNA, 22 bp, Homo sapiens
tattaatatatattatcttttc

SEQ ID NO: 1394852 - DNA, 23 bp, Homo sapiens
tattacttatttttgacagtgtt

SEQ ID NO: 1394853 - DNA, 15 bp, Homo sapiens
tattatgagatgctg

SEQ ID NO: 1394854 - DNA, 13 bp, Homo sapiens
tattcagacagat

SEQ ID NO: 1394855 - DNA, 17 bp, Homo sapiens
tattccaagacatgtct

SEQ ID NO: 1394856 - DNA, 23 bp, Homo sapiens
tattgataagatcttttattttg

SEQ ID NO: 1394857 - DNA, 16 bp, Homo sapiens
tattggagagaaaaaa

SEQ ID NO: 1394858 - DNA, 15 bp, Homo sapiens
tattgtaaaacaggt

SEQ ID NO: 1394859 - DNA, 15 bp, Homo sapiens
tattgtaaatattgt

SEQ ID NO: 1394860 - DNA, 17 bp, Homo sapiens
tattgtgcaatgtaaat

SEQ ID NO: 1394861 - DNA, 22 bp, Homo sapiens
tattgtgcacatttaataatca

SEQ ID NO: 1394862 - DNA, 16 bp, Homo sapiens
tattgttactagagtt

SEQ ID NO: 1394863 - DNA, 16 bp, Homo sapiens
tatttaaaaaactaaa

SEQ ID NO: 1394864 - DNA, 20 bp, Homo sapiens
tatttaaaaaactaaaaact

SEQ ID NO: 1394865 - DNA, 21 bp, Homo sapiens
tatttaaaaaactaaaaacta

SEQ ID NO: 1394866 - DNA, 18 bp, Homo sapiens
tatttaaacaaatgtgta

SEQ ID NO: 1394867 - DNA, 19 bp, Homo sapiens
tatttaatagcaaagaatt

SEQ ID NO: 1394868 - DNA, 19 bp, Homo sapiens
tatttagcttgggaaaggt

SEQ ID NO: 1394869 - DNA, 18 bp, Homo sapiens
tatttatatgttattaaa

SEQ ID NO: 1394870 - DNA, 19 bp, Homo sapiens
tatttatatgttattaaac

SEQ ID NO: 1394871 - DNA, 21 bp, Homo sapiens
tatttatatgttattaaacag

SEQ ID NO: 1394872 - DNA, 23 bp, Homo sapiens
tatttatatgttattaaacaggt

SEQ ID NO: 1394873 - DNA, 15 bp, Homo sapiens
tatttcaatgttagc

SEQ ID NO: 1394874 - DNA, 13 bp, Homo sapiens
tatttcttaaaca

SEQ ID NO: 1394875 - DNA, 16 bp, Homo sapiens
tatttcttaaacactt

SEQ ID NO: 1394876 - DNA, 22 bp, Homo sapiens
tatttggtgattacattttaaa

SEQ ID NO: 1394877 - DNA, 20 bp, Homo sapiens
tatttgtaatagatgtttga

SEQ ID NO: 1394878 - DNA, 16 bp, Homo sapiens
tattttaaagaattgt

SEQ ID NO: 1394879 - DNA, 21 bp, Homo sapiens
tattttagtgaacttgaaata

SEQ ID NO: 1394880 - DNA, 22 bp, Homo sapiens
tattttgccaagggcataaatt

SEQ ID NO: 1394881 - DNA, 14 bp, Homo sapiens
tattttgctggaat

SEQ ID NO: 1394882 - DNA, 20 bp, Homo sapiens
tattttgtaaactcaaaata

SEQ ID NO: 1394883 - DNA, 21 bp, Homo sapiens
tattttgttttgtgcagagat

SEQ ID NO: 1394884 - DNA, 19 bp, Homo sapiens
tatttttggcagtctgaat

SEQ ID NO: 1394885 - DNA, 21 bp, Homo sapiens
tcaaacaccaacataaaaatg

SEQ ID NO: 1394886 - DNA, 13 bp, Homo sapiens
tcaaagcaagcat

SEQ ID NO: 1394887 - DNA, 15 bp, Homo sapiens
tcaaagcaagcattc

SEQ ID NO: 1394888 - DNA, 22 bp, Homo sapiens
tcaaagcaagcattcagaagaa

SEQ ID NO: 1394889 - DNA, 19 bp, Homo sapiens
tcaaagctgtgtgtttgga

SEQ ID NO: 1394890 - DNA, 15 bp, Homo sapiens
tcaaagctttttcca

SEQ ID NO: 1394891 - DNA, 16 bp, Homo sapiens
tcaaagctttttccag

SEQ ID NO: 1394892 - DNA, 13 bp, Homo sapiens
tcaaagtttaata

SEQ ID NO: 1394893 - DNA, 12 bp, Homo sapiens
tcaaataactaa

SEQ ID NO: 1394894 - DNA, 15 bp, Homo sapiens
tcaacaattctaaaa

SEQ ID NO: 1394895 - DNA, 17 bp, Homo sapiens
tcaacaattctaaaatg

SEQ ID NO: 1394896 - DNA, 17 bp, Homo sapiens
tcaacagtgaagacaga

SEQ ID NO: 1394897 - DNA, 18 bp, Homo sapiens
tcaacagtgaagacagaa

SEQ ID NO: 1394898 - DNA, 15 bp, Homo sapiens
tcaacagttttccta

SEQ ID NO: 1394899 - DNA, 17 bp, Homo sapiens
tcaacagttttcctatg

SEQ ID NO: 1394900 - DNA, 20 bp, Homo sapiens
tcaacagttttcctatgctt

SEQ ID NO: 1394901 - DNA, 23 bp, Homo sapiens
tcaacagttttcctatgctttga

SEQ ID NO: 1394902 - DNA, 16 bp, Homo sapiens
tcaaccccagacactg

SEQ ID NO: 1394903 - DNA, 16 bp, Homo sapiens
tcaacccctcccctcc

SEQ ID NO: 1394904 - DNA, 12 bp, Homo sapiens
tcaacctcccaa

SEQ ID NO: 1394905 - DNA, 14 bp, Homo sapiens
tcaactgcctactc

SEQ ID NO: 1394906 - DNA, 18 bp, Homo sapiens
tcaactgcctactccaaa

SEQ ID NO: 1394907 - DNA, 20 bp, Homo sapiens
tcaactgcctactccaaaat

SEQ ID NO: 1394908 - DNA, 15 bp, Homo sapiens
tcaacttttcctttg

SEQ ID NO: 1394909 - DNA, 12 bp, Homo sapiens
tcaagaaactga

SEQ ID NO: 1394910 - DNA, 13 bp, Homo sapiens
tcaagaaactgag

SEQ ID NO: 1394911 - DNA, 17 bp, Homo sapiens
tcaagaaactgaggaat

SEQ ID NO: 1394912 - DNA, 23 bp, Homo sapiens
tcaagaaactgaggaattttctt

SEQ ID NO: 1394913 - DNA, 19 bp, Homo sapiens
tcaagattgttcctgcttt

SEQ ID NO: 1394914 - DNA, 15 bp, Homo sapiens
tcaaggaaaataagt

SEQ ID NO: 1394915 - DNA, 17 bp, Homo sapiens
tcaaggaaaataagtga

SEQ ID NO: 1394916 - DNA, 21 bp, Homo sapiens
tcaaggaaaataagtgaaatt

SEQ ID NO: 1394917 - DNA, 22 bp, Homo sapiens
tcaaggaaaataagtgaaattt

SEQ ID NO: 1394918 - DNA, 23 bp, Homo sapiens
tcaagtcatgatggagacttcag

SEQ ID NO: 1394919 - DNA, 21 bp, Homo sapiens
tcaatcagtctcagaatgtca

SEQ ID NO: 1394920 - DNA, 14 bp, Homo sapiens
tcaatctgtaaact

SEQ ID NO: 1394921 - DNA, 20 bp, Homo sapiens
tcaattactggtccaaaaga

SEQ ID NO: 1394922 - DNA, 18 bp, Homo sapiens
tcaattcatatttatgaa

SEQ ID NO: 1394923 - DNA, 14 bp, Homo sapiens
tcacaacagcctga

SEQ ID NO: 1394924 - DNA, 15 bp, Homo sapiens
tcacaataattttct

SEQ ID NO: 1394925 - DNA, 16 bp, Homo sapiens
tcacaataattttcta

SEQ ID NO: 1394926 - DNA, 17 bp, Homo sapiens
tcacagtacaatgtttc

SEQ ID NO: 1394927 - DNA, 22 bp, Homo sapiens
tcacattagaagacaattgaca

SEQ ID NO: 1394928 - DNA, 16 bp, Homo sapiens
tcacattttccttttc

SEQ ID NO: 1394929 - DNA, 22 bp, Homo sapiens
tcaccacaaactgtaatacaat

SEQ ID NO: 1394930 - DNA, 17 bp, Homo sapiens
tcaccaggcagcctctg

SEQ ID NO: 1394931 - DNA, 20 bp, Homo sapiens
tcaccaggcagcctctgggg

SEQ ID NO: 1394932 - DNA, 17 bp, Homo sapiens
tcaccatgttagccagg

SEQ ID NO: 1394933 - DNA, 13 bp, Homo sapiens
tcacccccagctt

SEQ ID NO: 1394934 - DNA, 11 bp, Homo sapiens
tcacctcctcc

SEQ ID NO: 1394935 - DNA, 19 bp, Homo sapiens
tcacctgtaaacctgagtc

SEQ ID NO: 1394936 - DNA, 18 bp, Homo sapiens
tcacgccagacttcccac

SEQ ID NO: 1394937 - DNA, 17 bp, Homo sapiens
tcacgctttcctgaatc

SEQ ID NO: 1394938 - DNA, 22 bp, Homo sapiens
tcacgctttcctgaatccaaac

SEQ ID NO: 1394939 - DNA, 12 bp, Homo sapiens
tcactaaatctt

SEQ ID NO: 1394940 - DNA, 17 bp, Homo sapiens
tcactaaatcttttata

SEQ ID NO: 1394941 - DNA, 18 bp, Homo sapiens
tcactaattcattaatct

SEQ ID NO: 1394942 - DNA, 18 bp, Homo sapiens
tcactagccctccttttt

SEQ ID NO: 1394943 - DNA, 18 bp, Homo sapiens
tcactgagaccaaggctt

SEQ ID NO: 1394944 - DNA, 14 bp, Homo sapiens
tcactgcaacctcc

SEQ ID NO: 1394945 - DNA, 21 bp, Homo sapiens
tcactttacacaatagaatta

SEQ ID NO: 1394946 - DNA, 14 bp, Homo sapiens
tcactttctcagtt

SEQ ID NO: 1394947 - DNA, 21 bp, Homo sapiens
tcagaagccccatttgcacag

SEQ ID NO: 1394948 - DNA, 14 bp, Homo sapiens
tcagaatgctctac

SEQ ID NO: 1394949 - DNA, 13 bp, Homo sapiens
tcagagaatttct

SEQ ID NO: 1394950 - DNA, 16 bp, Homo sapiens
tcagagaggccttttg

SEQ ID NO: 1394951 - DNA, 21 bp, Homo sapiens
tcagagaggccttttggaatg

SEQ ID NO: 1394952 - DNA, 21 bp, Homo sapiens
tcagattcccagagcaaaata

SEQ ID NO: 1394953 - DNA, 12 bp, Homo sapiens
tcagcatgtcta

SEQ ID NO: 1394954 - DNA, 16 bp, Homo sapiens
tcagccccgcgtggaa

SEQ ID NO: 1394955 - DNA, 19 bp, Homo sapiens
tcagccctagccctcagcc

SEQ ID NO: 1394956 - DNA, 18 bp, Homo sapiens
tcagctctgaaagagaaa

SEQ ID NO: 1394957 - DNA, 19 bp, Homo sapiens
tcagcttcgtttattttca

SEQ ID NO: 1394958 - DNA, 18 bp, Homo sapiens
tcaggaaccgaggcaggg

SEQ ID NO: 1394959 - DNA, 20 bp, Homo sapiens
tcaggagagagttgaaccta

SEQ ID NO: 1394960 - DNA, 15 bp, Homo sapiens
tcaggagccctggga

SEQ ID NO: 1394961 - DNA, 19 bp, Homo sapiens
tcaggagccctgggaggct

SEQ ID NO: 1394962 - DNA, 23 bp, Homo sapiens
tcaggagccctgggaggctctgg

SEQ ID NO: 1394963 - DNA, 18 bp, Homo sapiens
tcaggatgagggaaaaga

SEQ ID NO: 1394964 - DNA, 19 bp, Homo sapiens
tcaggatgagggaaaagaa

SEQ ID NO: 1394965 - DNA, 23 bp, Homo sapiens
tcaggattctcctttttacccct

SEQ ID NO: 1394966 - DNA, 14 bp, Homo sapiens
tcaggccagagcca

SEQ ID NO: 1394967 - DNA, 17 bp, Homo sapiens
tcaggccagagccaagg

SEQ ID NO: 1394968 - DNA, 19 bp, Homo sapiens
tcaggcccttattttcaag

SEQ ID NO: 1394969 - DNA, 18 bp, Homo sapiens
tcaggcctttgagctcag

SEQ ID NO: 1394970 - DNA, 19 bp, Homo sapiens
tcagggaggccctgtgccc

SEQ ID NO: 1394971 - DNA, 18 bp, Homo sapiens
tcaggttgttctgtataa

SEQ ID NO: 1394972 - DNA, 18 bp, Homo sapiens
tcagtaatttagaaatca

SEQ ID NO: 1394973 - DNA, 18 bp, Homo sapiens
tcagtctcagaatgtcat

SEQ ID NO: 1394974 - DNA, 19 bp, Homo sapiens
tcagtctcagaatgtcatt

SEQ ID NO: 1394975 - DNA, 22 bp, Homo sapiens
tcatagaaatgtaacttttgta

SEQ ID NO: 1394976 - DNA, 16 bp, Homo sapiens
tcatataaagtatcat

SEQ ID NO: 1394977 - DNA, 23 bp, Homo sapiens
tcatctggcaacatctttatccg

SEQ ID NO: 1394978 - DNA, 12 bp, Homo sapiens
tcatctttcttc

SEQ ID NO: 1394979 - DNA, 11 bp, Homo sapiens
tcatgaacctc

SEQ ID NO: 1394980 - DNA, 22 bp, Homo sapiens
tcatgaacctcaagctgcatct

SEQ ID NO: 1394981 - DNA, 21 bp, Homo sapiens
tcatgataatgaacagaacat

SEQ ID NO: 1394982 - DNA, 16 bp, Homo sapiens
tcatgatccaactaat

SEQ ID NO: 1394983 - DNA, 18 bp, Homo sapiens
tcatgcatgtcctgtaaa

SEQ ID NO: 1394984 - DNA, 15 bp, Homo sapiens
tcatgctatctctgt

SEQ ID NO: 1394985 - DNA, 15 bp, Homo sapiens
tcatgtaaaataaga

SEQ ID NO: 1394986 - DNA, 12 bp, Homo sapiens
tcattactataa

SEQ ID NO: 1394987 - DNA, 23 bp, Homo sapiens
tcattattcgtagatattggaca

SEQ ID NO: 1394988 - DNA, 18 bp, Homo sapiens
tcattcttaacaagatat

SEQ ID NO: 1394989 - DNA, 17 bp, Homo sapiens
tcattgggttttatcag

SEQ ID NO: 1394990 - DNA, 19 bp, Homo sapiens
tcattgggttttatcagtg

SEQ ID NO: 1394991 - DNA, 22 bp, Homo sapiens
tcattgtaaatgaacataatga

SEQ ID NO: 1394992 - DNA, 16 bp, Homo sapiens
tcattttctctaatat

SEQ ID NO: 1394993 - DNA, 20 bp, Homo sapiens
tccaaaataaaacctcagct

SEQ ID NO: 1394994 - DNA, 22 bp, Homo sapiens
tccaaaatgttggtcattttat

SEQ ID NO: 1394995 - DNA, 14 bp, Homo sapiens
tccaaacaggctca

SEQ ID NO: 1394996 - DNA, 21 bp, Homo sapiens
tccaaccggctttgtggcact

SEQ ID NO: 1394997 - DNA, 21 bp, Homo sapiens
tccactcatgtgactctttcc

SEQ ID NO: 1394998 - DNA, 18 bp, Homo sapiens
tccagagtccctgcctgg

SEQ ID NO: 1394999 - DNA, 13 bp, Homo sapiens
tccagataagtta

SEQ ID NO: 1395000 - DNA, 22 bp, Homo sapiens
tccagcatcgtctcatgtaaaa

SEQ ID NO: 1395001 - DNA, 15 bp, Homo sapiens
tccagccaccaccca

SEQ ID NO: 1395002 - DNA, 21 bp, Homo sapiens
tccagccatcaagagactgag

SEQ ID NO: 1395003 - DNA, 24 bp, Homo sapiens
tccagccatcaagagactgagtca

SEQ ID NO: 1395004 - DNA, 13 bp, Homo sapiens
tccaggagcctgg

SEQ ID NO: 1395005 - DNA, 15 bp, Homo sapiens
tccaggctgtgtttg

SEQ ID NO: 1395006 - DNA, 16 bp, Homo sapiens
tccagtaggatccagt

SEQ ID NO: 1395007 - DNA, 22 bp, Homo sapiens
tccagtcttcctgacactttaa

SEQ ID NO: 1395008 - DNA, 15 bp, Homo sapiens
tccataggaatcatg

SEQ ID NO: 1395009 - DNA, 13 bp, Homo sapiens
tccatccctggcc

SEQ ID NO: 1395010 - DNA, 20 bp, Homo sapiens
tccatccctggccccctccc

SEQ ID NO: 1395011 - DNA, 23 bp, Homo sapiens
tccatccctggccccctccctgg

SEQ ID NO: 1395012 - DNA, 18 bp, Homo sapiens
tccatggcaggaaggctt

SEQ ID NO: 1395013 - DNA, 21 bp, Homo sapiens
tcccaaatcctgtctgaaaag

SEQ ID NO: 1395014 - DNA, 22 bp, Homo sapiens
tcccaagacagtgagacagtct

SEQ ID NO: 1395015 - DNA, 17 bp, Homo sapiens
tcccaagtagaatctca

SEQ ID NO: 1395016 - DNA, 19 bp, Homo sapiens
tcccaagtagaatctcagt

SEQ ID NO: 1395017 - DNA, 12 bp, Homo sapiens
tcccacttgtca

SEQ ID NO: 1395018 - DNA, 17 bp, Homo sapiens
tcccagactttctacac

SEQ ID NO: 1395019 - DNA, 20 bp, Homo sapiens
tcccagcatgctgagattac

SEQ ID NO: 1395020 - DNA, 16 bp, Homo sapiens
tcccagggacacctgg

SEQ ID NO: 1395021 - DNA, 13 bp, Homo sapiens
tcccatctaggga

SEQ ID NO: 1395022 - DNA, 13 bp, Homo sapiens
tcccatgcctggt

SEQ ID NO: 1395023 - DNA, 15 bp, Homo sapiens
tcccatgcctggtcc

SEQ ID NO: 1395024 - DNA, 16 bp, Homo sapiens
tcccatttatcgcaga

SEQ ID NO: 1395025 - DNA, 19 bp, Homo sapiens
tccccactgtatctaggca

SEQ ID NO: 1395026 - DNA, 17 bp, Homo sapiens
tccccattcttcctagt

SEQ ID NO: 1395027 - DNA, 21 bp, Homo sapiens
tccccgcaccccccaagctgt

SEQ ID NO: 1395028 - DNA, 16 bp, Homo sapiens
tccccggactcaagcc

SEQ ID NO: 1395029 - DNA, 15 bp, Homo sapiens
tcccctccatccctg

SEQ ID NO: 1395030 - DNA, 12 bp, Homo sapiens
tccctaataaag

SEQ ID NO: 1395031 - DNA, 14 bp, Homo sapiens
tccctaataaagct

SEQ ID NO: 1395032 - DNA, 15 bp, Homo sapiens
tccctaataaagctg

SEQ ID NO: 1395033 - DNA, 17 bp, Homo sapiens
tccctactagagacctc

SEQ ID NO: 1395034 - DNA, 14 bp, Homo sapiens
tccctctcgtaaga

SEQ ID NO: 1395035 - DNA, 13 bp, Homo sapiens
tccctgcctcctg

SEQ ID NO: 1395036 - DNA, 18 bp, Homo sapiens
tccctgcctcctgccggc

SEQ ID NO: 1395037 - DNA, 17 bp, Homo sapiens
tccctgcctctcatcaa

SEQ ID NO: 1395038 - DNA, 13 bp, Homo sapiens
tccctgcctggac

SEQ ID NO: 1395039 - DNA, 20 bp, Homo sapiens
tccctggccccctccctgga

SEQ ID NO: 1395040 - DNA, 16 bp, Homo sapiens
tccctgggccttgggc

SEQ ID NO: 1395041 - DNA, 16 bp, Homo sapiens
tcccttcccctgcctg

SEQ ID NO: 1395042 - DNA, 17 bp, Homo sapiens
tcccttcccctgcctgg

SEQ ID NO: 1395043 - DNA, 16 bp, Homo sapiens
tcccttccttcctctc

SEQ ID NO: 1395044 - DNA, 14 bp, Homo sapiens
tccggaatgaccag

SEQ ID NO: 1395045 - DNA, 13 bp, Homo sapiens
tccgtaaaaatga

SEQ ID NO: 1395046 - DNA, 15 bp, Homo sapiens
tccgtaaaaatgatt

SEQ ID NO: 1395047 - DNA, 23 bp, Homo sapiens
tccgtcaaaacagattgtttgca

SEQ ID NO: 1395048 - DNA, 23 bp, Homo sapiens
tcctaaactgagacaatgccttg

SEQ ID NO: 1395049 - DNA, 20 bp, Homo sapiens
tcctagttttctcctcccag

SEQ ID NO: 1395050 - DNA, 20 bp, Homo sapiens
tcctatgctttgaaacagaa

SEQ ID NO: 1395051 - DNA, 21 bp, Homo sapiens
tcctattgtgcaatgtaaata

SEQ ID NO: 1395052 - DNA, 19 bp, Homo sapiens
tcctcaacccctcccctcc

SEQ ID NO: 1395053 - DNA, 13 bp, Homo sapiens
tcctcacccccag

SEQ ID NO: 1395054 - DNA, 16 bp, Homo sapiens
tcctcagactctaaga

SEQ ID NO: 1395055 - DNA, 17 bp, Homo sapiens
tcctccgtcacctcaga

SEQ ID NO: 1395056 - DNA, 16 bp, Homo sapiens
tcctcgagatcccaac

SEQ ID NO: 1395057 - DNA, 16 bp, Homo sapiens
tcctcgtcccctgcct

SEQ ID NO: 1395058 - DNA, 16 bp, Homo sapiens
tcctctgattatcagg

SEQ ID NO: 1395059 - DNA, 23 bp, Homo sapiens
tcctgaaaaggtttatgaaaaag

SEQ ID NO: 1395060 - DNA, 22 bp, Homo sapiens
tcctgaatccaaactaatccat

SEQ ID NO: 1395061 - DNA, 15 bp, Homo sapiens
tcctgacctcaggca

SEQ ID NO: 1395062 - DNA, 20 bp, Homo sapiens
tcctgcaccggggcctgggc

SEQ ID NO: 1395063 - DNA, 14 bp, Homo sapiens
tcctgcctcagcct

SEQ ID NO: 1395064 - DNA, 11 bp, Homo sapiens
tcctgctgtgc

SEQ ID NO: 1395065 - DNA, 18 bp, Homo sapiens
tcctggaggatgaccagg

SEQ ID NO: 1395066 - DNA, 22 bp, Homo sapiens
tcctggaggatgaccaggacta

SEQ ID NO: 1395067 - DNA, 19 bp, Homo sapiens
tcctgtaaaggttacaagc

SEQ ID NO: 1395068 - DNA, 22 bp, Homo sapiens
tcctgtcgattagactggacag

SEQ ID NO: 1395069 - DNA, 13 bp, Homo sapiens
tcctgtttccatg

SEQ ID NO: 1395070 - DNA, 11 bp, Homo sapiens
tccttcatttc

SEQ ID NO: 1395071 - DNA, 14 bp, Homo sapiens
tccttcatttcctc

SEQ ID NO: 1395072 - DNA, 15 bp, Homo sapiens
tccttcatttcctcc

SEQ ID NO: 1395073 - DNA, 10 bp, Homo sapiens
tcctttgttc

SEQ ID NO: 1395074 - DNA, 23 bp, Homo sapiens
tcgagatcccaacactgccagca

SEQ ID NO: 1395075 - DNA, 14 bp, Homo sapiens
tcgattagactgga

SEQ ID NO: 1395076 - DNA, 21 bp, Homo sapiens
tcgcccagcggcatcaggctt

SEQ ID NO: 1395077 - DNA, 18 bp, Homo sapiens
tcgctcctcaacccctcc

SEQ ID NO: 1395078 - DNA, 19 bp, Homo sapiens
tcgctttattggctgagat

SEQ ID NO: 1395079 - DNA, 14 bp, Homo sapiens
tcgtgtctggcaca

SEQ ID NO: 1395080 - DNA, 21 bp, Homo sapiens
tcgtgtctggcacagcctggc

SEQ ID NO: 1395081 - DNA, 13 bp, Homo sapiens
tctaactcagcaa

SEQ ID NO: 1395082 - DNA, 17 bp, Homo sapiens
tctaagaaacatttata

SEQ ID NO: 1395083 - DNA, 14 bp, Homo sapiens
tctaagttaattta

SEQ ID NO: 1395084 - DNA, 20 bp, Homo sapiens
tctaagttaatttaaagttg

SEQ ID NO: 1395085 - DNA, 14 bp, Homo sapiens
tctaccatttcaga

SEQ ID NO: 1395086 - DNA, 21 bp, Homo sapiens
tctacctggtctctccttgtt

SEQ ID NO: 1395087 - DNA, 23 bp, Homo sapiens
tctactggtcttgtggaattggg

SEQ ID NO: 1395088 - DNA, 20 bp, Homo sapiens
tctactttgataaagtaaaa

SEQ ID NO: 1395089 - DNA, 22 bp, Homo sapiens
tctactttgataaagtaaaaaa

SEQ ID NO: 1395090 - DNA, 24 bp, Homo sapiens
tctagtattccagacctgaagaat

SEQ ID NO: 1395091 - DNA, 15 bp, Homo sapiens
tctagttctgccagg

SEQ ID NO: 1395092 - DNA, 19 bp, Homo sapiens
tctatcaaccccagacact

SEQ ID NO: 1395093 - DNA, 22 bp, Homo sapiens
tctatcaaccccagacactggt

SEQ ID NO: 1395094 - DNA, 15 bp, Homo sapiens
tctatgcattttctg

SEQ ID NO: 1395095 - DNA, 19 bp, Homo sapiens
tctattaatatttatgtgt

SEQ ID NO: 1395096 - DNA, 12 bp, Homo sapiens
tctattcagctt

SEQ ID NO: 1395097 - DNA, 14 bp, Homo sapiens
tctcaccaggcagc

SEQ ID NO: 1395098 - DNA, 19 bp, Homo sapiens
tctcaccaggcagcctctg

SEQ ID NO: 1395099 - DNA, 14 bp, Homo sapiens
tctcactaaatctt

SEQ ID NO: 1395100 - DNA, 18 bp, Homo sapiens
tctcagaatgtcattttg

SEQ ID NO: 1395101 - DNA, 17 bp, Homo sapiens
tctcatcaactgaatga

SEQ ID NO: 1395102 - DNA, 19 bp, Homo sapiens
tctcatctcagtgaagaat

SEQ ID NO: 1395103 - DNA, 20 bp, Homo sapiens
tctcatctcagtgaagaata

SEQ ID NO: 1395104 - DNA, 22 bp, Homo sapiens
tctcatgaacctcaagctgcat

SEQ ID NO: 1395105 - DNA, 14 bp, Homo sapiens
tctcatgtaaaata

SEQ ID NO: 1395106 - DNA, 16 bp, Homo sapiens
tctcatgtaaaataag

SEQ ID NO: 1395107 - DNA, 19 bp, Homo sapiens
tctccagtatccactttgc

SEQ ID NO: 1395108 - DNA, 15 bp, Homo sapiens
tctccttagatgtga

SEQ ID NO: 1395109 - DNA, 13 bp, Homo sapiens
tctcgatctcctg

SEQ ID NO: 1395110 - DNA, 17 bp, Homo sapiens
tctctcatgaacctcaa

SEQ ID NO: 1395111 - DNA, 13 bp, Homo sapiens
tctctctctacaa

SEQ ID NO: 1395112 - DNA, 12 bp, Homo sapiens
tctctgaacaca

SEQ ID NO: 1395113 - DNA, 20 bp, Homo sapiens
tctctgattttcaaagcttt

SEQ ID NO: 1395114 - DNA, 15 bp, Homo sapiens
tctctgcaggtccct

SEQ ID NO: 1395115 - DNA, 18 bp, Homo sapiens
tctctgcaggtccctaat

SEQ ID NO: 1395116 - DNA, 21 bp, Homo sapiens
tctctgcaggtccctaataaa

SEQ ID NO: 1395117 - DNA, 12 bp, Homo sapiens
tctctgtaaagc

SEQ ID NO: 1395118 - DNA, 11 bp, Homo sapiens
tctctgtgctt

SEQ ID NO: 1395119 - DNA, 16 bp, Homo sapiens
tctctgttcatttcct

SEQ ID NO: 1395120 - DNA, 17 bp, Homo sapiens
tctctgttcatttcctc

SEQ ID NO: 1395121 - DNA, 18 bp, Homo sapiens
tctctgttcatttcctca

SEQ ID NO: 1395122 - DNA, 22 bp, Homo sapiens
tctcttattgcctcacttcagg

SEQ ID NO: 1395123 - DNA, 21 bp, Homo sapiens
tctcttgcctcaacctcccaa

SEQ ID NO: 1395124 - DNA, 21 bp, Homo sapiens
tctgaactcaaactgaggaat

SEQ ID NO: 1395125 - DNA, 15 bp, Homo sapiens
tctgaatttttaaac

SEQ ID NO: 1395126 - DNA, 17 bp, Homo sapiens
tctgaatttttaaacaa

SEQ ID NO: 1395127 - DNA, 22 bp, Homo sapiens
tctgagaaaagctttgaaccct

SEQ ID NO: 1395128 - DNA, 15 bp, Homo sapiens
tctgataatgaaaat

SEQ ID NO: 1395129 - DNA, 18 bp, Homo sapiens
tctgattatcaggtactg

SEQ ID NO: 1395130 - DNA, 19 bp, Homo sapiens
tctgattcgaatgacactg

SEQ ID NO: 1395131 - DNA, 17 bp, Homo sapiens
tctgcaaggtctttggt

SEQ ID NO: 1395132 - DNA, 12 bp, Homo sapiens
tctgcaggtccc

SEQ ID NO: 1395133 - DNA, 13 bp, Homo sapiens
tctgcaggtccct

SEQ ID NO: 1395134 - DNA, 15 bp, Homo sapiens
tctgcaggtccctaa

SEQ ID NO: 1395135 - DNA, 17 bp, Homo sapiens
tctgcaggtccctaata

SEQ ID NO: 1395136 - DNA, 19 bp, Homo sapiens
tctgcaggtccctaataaa

SEQ ID NO: 1395137 - DNA, 22 bp, Homo sapiens
tctgcaggtccctaataaagct

SEQ ID NO: 1395138 - DNA, 23 bp, Homo sapiens
tctgcaggtccctaataaagctg

SEQ ID NO: 1395139 - DNA, 15 bp, Homo sapiens
tctgccaggagacag

SEQ ID NO: 1395140 - DNA, 22 bp, Homo sapiens
tctgcctttggggacttttctt

SEQ ID NO: 1395141 - DNA, 14 bp, Homo sapiens
tctggaatacatga

SEQ ID NO: 1395142 - DNA, 22 bp, Homo sapiens
tctggaatacatgaaatataga

SEQ ID NO: 1395143 - DNA, 20 bp, Homo sapiens
tctggacctccccctcttgg

SEQ ID NO: 1395144 - DNA, 20 bp, Homo sapiens
tctggattccccatctcagg

SEQ ID NO: 1395145 - DNA, 17 bp, Homo sapiens
tctggggggtggccagg

SEQ ID NO: 1395146 - DNA, 13 bp, Homo sapiens
tctgtaaactgtg

SEQ ID NO: 1395147 - DNA, 15 bp, Homo sapiens
tctgtaaactgtgta

SEQ ID NO: 1395148 - DNA, 16 bp, Homo sapiens
tctgtaaactgtgtat

SEQ ID NO: 1395149 - DNA, 19 bp, Homo sapiens
tctgtaaactgtgtattcc

SEQ ID NO: 1395150 - DNA, 14 bp, Homo sapiens
tctgtaagaaacct

SEQ ID NO: 1395151 - DNA, 20 bp, Homo sapiens
tctgtaagaaacctactgcc

SEQ ID NO: 1395152 - DNA, 22 bp, Homo sapiens
tctgtccagataagttatttat

SEQ ID NO: 1395153 - DNA, 17 bp, Homo sapiens
tctgtcgcccatgctgg

SEQ ID NO: 1395154 - DNA, 18 bp, Homo sapiens
tctgtctacttgctcagg

SEQ ID NO: 1395155 - DNA, 23 bp, Homo sapiens
tctgtctacttgctcaggtactt

SEQ ID NO: 1395156 - DNA, 21 bp, Homo sapiens
tctgtgtgcacaaatatttat

SEQ ID NO: 1395157 - DNA, 17 bp, Homo sapiens
tctgttatgctgtgaca

SEQ ID NO: 1395158 - DNA, 20 bp, Homo sapiens
tctgttctacatagatgctt

SEQ ID NO: 1395159 - DNA, 16 bp, Homo sapiens
tcttaaaccttcagtt

SEQ ID NO: 1395160 - DNA, 19 bp, Homo sapiens
tcttaaataagaaactttt

SEQ ID NO: 1395161 - DNA, 23 bp, Homo sapiens
tcttagctgtctgctcagacaga

SEQ ID NO: 1395162 - DNA, 14 bp, Homo sapiens
tcttatgcaatttc

SEQ ID NO: 1395163 - DNA, 16 bp, Homo sapiens
tcttcaccaaatcttg

SEQ ID NO: 1395164 - DNA, 19 bp, Homo sapiens
tcttcctagttttctcctc

SEQ ID NO: 1395165 - DNA, 21 bp, Homo sapiens
tcttcctagttttctcctccc

SEQ ID NO: 1395166 - DNA, 24 bp, Homo sapiens
tcttctgaactcaaactgaggaat

SEQ ID NO: 1395167 - DNA, 21 bp, Homo sapiens
tcttctgagctatttcatcta

SEQ ID NO: 1395168 - DNA, 12 bp, Homo sapiens
tcttcttatgca

SEQ ID NO: 1395169 - DNA, 14 bp, Homo sapiens
tcttgatgcctggc

SEQ ID NO: 1395170 - DNA, 23 bp, Homo sapiens
tcttgcaggaaggactatgaaaa

SEQ ID NO: 1395171 - DNA, 16 bp, Homo sapiens
tcttgcctcaacctcc

SEQ ID NO: 1395172 - DNA, 23 bp, Homo sapiens
tcttggggagtttagggtggggg

SEQ ID NO: 1395173 - DNA, 19 bp, Homo sapiens
tcttggttgaaaataaaaa

SEQ ID NO: 1395174 - DNA, 23 bp, Homo sapiens
tcttggttgaaaataaaaagatc

SEQ ID NO: 1395175 - DNA, 19 bp, Homo sapiens
tctttaaaagatgctttta

SEQ ID NO: 1395176 - DNA, 20 bp, Homo sapiens
tctttaaaatgtaaagccat

SEQ ID NO: 1395177 - DNA, 15 bp, Homo sapiens
tctttatgcttgcaa

SEQ ID NO: 1395178 - DNA, 19 bp, Homo sapiens
tctttccaaccggctttgt

SEQ ID NO: 1395179 - DNA, 22 bp, Homo sapiens
tctttgagaaaggattaagata

SEQ ID NO: 1395180 - DNA, 14 bp, Homo sapiens
tcttttcatacatt

SEQ ID NO: 1395181 - DNA, 19 bp, Homo sapiens
tcttttcccactgtttaag

SEQ ID NO: 1395182 - DNA, 19 bp, Homo sapiens
tcttttttaaatgaagaaa

SEQ ID NO: 1395183 - DNA, 22 bp, Homo sapiens
tgaaaaggtttatgaaaaagaa

SEQ ID NO: 1395184 - DNA, 13 bp, Homo sapiens
tgaaaataaagaa

SEQ ID NO: 1395185 - DNA, 17 bp, Homo sapiens
tgaaaataaagaatgga

SEQ ID NO: 1395186 - DNA, 13 bp, Homo sapiens
tgaaaattattta

SEQ ID NO: 1395187 - DNA, 15 bp, Homo sapiens
tgaaacagaaaaata

SEQ ID NO: 1395188 - DNA, 14 bp, Homo sapiens
tgaaacagaaacaa

SEQ ID NO: 1395189 - DNA, 16 bp, Homo sapiens
tgaaagccatggagat

SEQ ID NO: 1395190 - DNA, 16 bp, Homo sapiens
tgaaatatgatgttaa

SEQ ID NO: 1395191 - DNA, 20 bp, Homo sapiens
tgaaatatgatgttaaaaaa

SEQ ID NO: 1395192 - DNA, 17 bp, Homo sapiens
tgaaatggatacttata

SEQ ID NO: 1395193 - DNA, 22 bp, Homo sapiens
tgaaattaactgggtaatgaaa

SEQ ID NO: 1395194 - DNA, 12 bp, Homo sapiens
tgaaatttcaga

SEQ ID NO: 1395195 - DNA, 22 bp, Homo sapiens
tgaaatttcagattcccagagc

SEQ ID NO: 1395196 - DNA, 15 bp, Homo sapiens
tgaaattttaaaagt

SEQ ID NO: 1395197 - DNA, 20 bp, Homo sapiens
tgaaattttaacctatgata

SEQ ID NO: 1395198 - DNA, 22 bp, Homo sapiens
tgaaattttaacctatgatatt

SEQ ID NO: 1395199 - DNA, 18 bp, Homo sapiens
tgaaattttatatgctta

SEQ ID NO: 1395200 - DNA, 23 bp, Homo sapiens
tgaaattttccattacatgatct

SEQ ID NO: 1395201 - DNA, 11 bp, Homo sapiens
tgaacaagaat

SEQ ID NO: 1395202 - DNA, 20 bp, Homo sapiens
tgaacaccattgaaggctta

SEQ ID NO: 1395203 - DNA, 18 bp, Homo sapiens
tgaacataatgaacagaa

SEQ ID NO: 1395204 - DNA, 16 bp, Homo sapiens
tgaactcaaactgagg

SEQ ID NO: 1395205 - DNA, 12 bp, Homo sapiens
tgaactgattca

SEQ ID NO: 1395206 - DNA, 20 bp, Homo sapiens
tgaactgattcacatctcat

SEQ ID NO: 1395207 - DNA, 13 bp, Homo sapiens
tgaagaactgagg

SEQ ID NO: 1395208 - DNA, 19 bp, Homo sapiens
tgaagaatacttctcattt

SEQ ID NO: 1395209 - DNA, 15 bp, Homo sapiens
tgaagggcaggtgct

SEQ ID NO: 1395210 - DNA, 19 bp, Homo sapiens
tgaagggcaggtgcttcag

SEQ ID NO: 1395211 - DNA, 23 bp, Homo sapiens
tgaagttagctttaacttaaata

SEQ ID NO: 1395212 - DNA, 13 bp, Homo sapiens
tgaatattattcc

SEQ ID NO: 1395213 - DNA, 15 bp, Homo sapiens
tgaatattattcctc

SEQ ID NO: 1395214 - DNA, 15 bp, Homo sapiens
tgaatccaaactaat

SEQ ID NO: 1395215 - DNA, 21 bp, Homo sapiens
tgaattgggaacattatcaca

SEQ ID NO: 1395216 - DNA, 14 bp, Homo sapiens
tgaattttgttgct

SEQ ID NO: 1395217 - DNA, 14 bp, Homo sapiens
tgacaactggcagg

SEQ ID NO: 1395218 - DNA, 15 bp, Homo sapiens
tgacaactggcaggc

SEQ ID NO: 1395219 - DNA, 12 bp, Homo sapiens
tgacacaaacac

SEQ ID NO: 1395220 - DNA, 18 bp, Homo sapiens
tgacactagcccaatgaa

SEQ ID NO: 1395221 - DNA, 19 bp, Homo sapiens
tgacactagcccaatgaaa

SEQ ID NO: 1395222 - DNA, 22 bp, Homo sapiens
tgacactagcccaatgaaatga

SEQ ID NO: 1395223 - DNA, 22 bp, Homo sapiens
tgacactttaattaccaacctg

SEQ ID NO: 1395224 - DNA, 21 bp, Homo sapiens
tgacagggcgggggtggcggc

SEQ ID NO: 1395225 - DNA, 13 bp, Homo sapiens
tgacatcacttgt

SEQ ID NO: 1395226 - DNA, 22 bp, Homo sapiens
tgaccaaaagttacatgtttgc

SEQ ID NO: 1395227 - DNA, 15 bp, Homo sapiens
tgaccaagatactta

SEQ ID NO: 1395228 - DNA, 17 bp, Homo sapiens
tgaccctgagctgacca

SEQ ID NO: 1395229 - DNA, 17 bp, Homo sapiens
tgacctagttttccatg

SEQ ID NO: 1395230 - DNA, 20 bp, Homo sapiens
tgacctcaggcaatctgccc

SEQ ID NO: 1395231 - DNA, 14 bp, Homo sapiens
tgacgtctgggtgg

SEQ ID NO: 1395232 - DNA, 16 bp, Homo sapiens
tgactaatggcatgag

SEQ ID NO: 1395233 - DNA, 18 bp, Homo sapiens
tgactagggagccatgtt

SEQ ID NO: 1395234 - DNA, 19 bp, Homo sapiens
tgactcacacctgaactga

SEQ ID NO: 1395235 - DNA, 20 bp, Homo sapiens
tgactccactgtggaaaatg

SEQ ID NO: 1395236 - DNA, 19 bp, Homo sapiens
tgactctttccaaccggct

SEQ ID NO: 1395237 - DNA, 17 bp, Homo sapiens
tgactgtcactgttcct

SEQ ID NO: 1395238 - DNA, 19 bp, Homo sapiens
tgactgtttttcggacagt

SEQ ID NO: 1395239 - DNA, 20 bp, Homo sapiens
tgactgtttttcggacagtt

SEQ ID NO: 1395240 - DNA, 23 bp, Homo sapiens
tgactttttgcatttaaaacaga

SEQ ID NO: 1395241 - DNA, 16 bp, Homo sapiens
tgagaaagccttcttt

SEQ ID NO: 1395242 - DNA, 14 bp, Homo sapiens
tgagaaatttaaac

SEQ ID NO: 1395243 - DNA, 15 bp, Homo sapiens
tgagacaatgccttg

SEQ ID NO: 1395244 - DNA, 14 bp, Homo sapiens
tgagacagtctgga

SEQ ID NO: 1395245 - DNA, 17 bp, Homo sapiens
tgagacagtctggaaag

SEQ ID NO: 1395246 - DNA, 18 bp, Homo sapiens
tgagacctaatctctgta

SEQ ID NO: 1395247 - DNA, 19 bp, Homo sapiens
tgagacctaatctctgtaa

SEQ ID NO: 1395248 - DNA, 20 bp, Homo sapiens
tgagacctaatctctgtaaa

SEQ ID NO: 1395249 - DNA, 17 bp, Homo sapiens
tgagagaaagagaaatc

SEQ ID NO: 1395250 - DNA, 19 bp, Homo sapiens
tgagagacattaactcatt

SEQ ID NO: 1395251 - DNA, 12 bp, Homo sapiens
tgagagtgtgac

SEQ ID NO: 1395252 - DNA, 22 bp, Homo sapiens
tgagataatctaaatataaacc

SEQ ID NO: 1395253 - DNA, 12 bp, Homo sapiens
tgagcatcacag

SEQ ID NO: 1395254 - DNA, 13 bp, Homo sapiens
tgagcatcacaga

SEQ ID NO: 1395255 - DNA, 18 bp, Homo sapiens
tgagcatcacagaatgtg

SEQ ID NO: 1395256 - DNA, 21 bp, Homo sapiens
tgagctactgccgtcagtgct

SEQ ID NO: 1395257 - DNA, 15 bp, Homo sapiens
tgagctatttcatct

SEQ ID NO: 1395258 - DNA, 15 bp, Homo sapiens
tgagctcttcatgtt

SEQ ID NO: 1395259 - DNA, 16 bp, Homo sapiens
tgagctcttcatgttt

SEQ ID NO: 1395260 - DNA, 15 bp, Homo sapiens
tgaggaatttcacct

SEQ ID NO: 1395261 - DNA, 17 bp, Homo sapiens
tgagggcattaaaaata

SEQ ID NO: 1395262 - DNA, 18 bp, Homo sapiens
tgaggggaccaggagtgg

SEQ ID NO: 1395263 - DNA, 22 bp, Homo sapiens
tgaggttaaaatataaattaag

SEQ ID NO: 1395264 - DNA, 22 bp, Homo sapiens
tgagtacagaattcaacagtta

SEQ ID NO: 1395265 - DNA, 17 bp, Homo sapiens
tgagtctgtccagataa

SEQ ID NO: 1395266 - DNA, 20 bp, Homo sapiens
tgagtctgtccagataagtt

SEQ ID NO: 1395267 - DNA, 16 bp, Homo sapiens
tgagttggacacactg

SEQ ID NO: 1395268 - DNA, 19 bp, Homo sapiens
tgagttttccatggcagga

SEQ ID NO: 1395269 - DNA, 15 bp, Homo sapiens
tgataaagtaaaaaa

SEQ ID NO: 1395270 - DNA, 18 bp, Homo sapiens
tgataaagtaaaaaagtt

SEQ ID NO: 1395271 - DNA, 19 bp, Homo sapiens
tgataaagtaaaaaagtta

SEQ ID NO: 1395272 - DNA, 18 bp, Homo sapiens
tgataatgaacagaacat

SEQ ID NO: 1395273 - DNA, 20 bp, Homo sapiens
tgataatgaacagaacatag

SEQ ID NO: 1395274 - DNA, 14 bp, Homo sapiens
tgatagattttctg

SEQ ID NO: 1395275 - DNA, 14 bp, Homo sapiens
tgatatattttaca

SEQ ID NO: 1395276 - DNA, 14 bp, Homo sapiens
tgatattttctcta

SEQ ID NO: 1395277 - DNA, 13 bp, Homo sapiens
tgatcaaggcctt

SEQ ID NO: 1395278 - DNA, 21 bp, Homo sapiens
tgatcctgtattcagacagat

SEQ ID NO: 1395279 - DNA, 20 bp, Homo sapiens
tgatctgatagggtttgtga

SEQ ID NO: 1395280 - DNA, 18 bp, Homo sapiens
tgatgccaaaaaaaaata

SEQ ID NO: 1395281 - DNA, 24 bp, Homo sapiens
tgatgggattctggacaggatgtg

SEQ ID NO: 1395282 - DNA, 13 bp, Homo sapiens
tgatgttaaaaaa

SEQ ID NO: 1395283 - DNA, 22 bp, Homo sapiens
tgattcaatctgtaaactgtgt

SEQ ID NO: 1395284 - DNA, 22 bp, Homo sapiens
tgattcattttaacatctgaga

SEQ ID NO: 1395285 - DNA, 20 bp, Homo sapiens
tgattgtagtaatctgcatt

SEQ ID NO: 1395286 - DNA, 18 bp, Homo sapiens
tgatttgtactgaaaaat

SEQ ID NO: 1395287 - DNA, 15 bp, Homo sapiens
tgattttagccttct

SEQ ID NO: 1395288 - DNA, 22 bp, Homo sapiens
tgatttttgcctcttccagtct

SEQ ID NO: 1395289 - DNA, 16 bp, Homo sapiens
tgattttttttccttt

SEQ ID NO: 1395290 - DNA, 22 bp, Homo sapiens
tgatttttttttcatacactta

SEQ ID NO: 1395291 - DNA, 19 bp, Homo sapiens
tgcaaaaactacaaccaat

SEQ ID NO: 1395292 - DNA, 20 bp, Homo sapiens
tgcaacctccacctcctggg

SEQ ID NO: 1395293 - DNA, 21 bp, Homo sapiens
tgcaacctccacctcctgggt

SEQ ID NO: 1395294 - DNA, 17 bp, Homo sapiens
tgcaaggacctaaaaca

SEQ ID NO: 1395295 - DNA, 21 bp, Homo sapiens
tgcacaaatatttattttctt

SEQ ID NO: 1395296 - DNA, 16 bp, Homo sapiens
tgcacaggttttcagc

SEQ ID NO: 1395297 - DNA, 12 bp, Homo sapiens
tgcacatccctg

SEQ ID NO: 1395298 - DNA, 16 bp, Homo sapiens
tgcaccggggcctggg

SEQ ID NO: 1395299 - DNA, 14 bp, Homo sapiens
tgcacctaaagaaa

SEQ ID NO: 1395300 - DNA, 16 bp, Homo sapiens
tgcacctaaagaaaaa

SEQ ID NO: 1395301 - DNA, 21 bp, Homo sapiens
tgcacctaaagaaaaacaaac

SEQ ID NO: 1395302 - DNA, 13 bp, Homo sapiens
tgcagacaggaat

SEQ ID NO: 1395303 - DNA, 15 bp, Homo sapiens
tgcagacaggaatct

SEQ ID NO: 1395304 - DNA, 16 bp, Homo sapiens
tgcagacaggaatctt

SEQ ID NO: 1395305 - DNA, 19 bp, Homo sapiens
tgcagcaaccagagcactg

SEQ ID NO: 1395306 - DNA, 19 bp, Homo sapiens
tgcaggatctcaccaggca

SEQ ID NO: 1395307 - DNA, 14 bp, Homo sapiens
tgcaggtccctaat

SEQ ID NO: 1395308 - DNA, 19 bp, Homo sapiens
tgcaggtccctaataaagc

SEQ ID NO: 1395309 - DNA, 21 bp, Homo sapiens
tgcaggtccctaataaagctg

SEQ ID NO: 1395310 - DNA, 18 bp, Homo sapiens
tgcatactttttaaatgt

SEQ ID NO: 1395311 - DNA, 19 bp, Homo sapiens
tgcatactttttaaatgta

SEQ ID NO: 1395312 - DNA, 23 bp, Homo sapiens
tgcatactttttaaatgtaaaga

SEQ ID NO: 1395313 - DNA, 21 bp, Homo sapiens
tgcatctagaggcttccttca

SEQ ID NO: 1395314 - DNA, 14 bp, Homo sapiens
tgcatttgggtcca

SEQ ID NO: 1395315 - DNA, 16 bp, Homo sapiens
tgcatttgggtccagg

SEQ ID NO: 1395316 - DNA, 18 bp, Homo sapiens
tgcatttgggtccaggag

SEQ ID NO: 1395317 - DNA, 20 bp, Homo sapiens
tgcatttgggtccaggagga

SEQ ID NO: 1395318 - DNA, 22 bp, Homo sapiens
tgccaaagtccatttatcccaa

SEQ ID NO: 1395319 - DNA, 13 bp, Homo sapiens
tgccactggagtg

SEQ ID NO: 1395320 - DNA, 17 bp, Homo sapiens
tgccaggaggacccagg

SEQ ID NO: 1395321 - DNA, 20 bp, Homo sapiens
tgccaggaggacccagggct

SEQ ID NO: 1395322 - DNA, 16 bp, Homo sapiens
tgccaggctaattttt

SEQ ID NO: 1395323 - DNA, 16 bp, Homo sapiens
tgccatgatgcctctg

SEQ ID NO: 1395324 - DNA, 14 bp, Homo sapiens
tgccattaacaaat

SEQ ID NO: 1395325 - DNA, 16 bp, Homo sapiens
tgccattcacttcata

SEQ ID NO: 1395326 - DNA, 15 bp, Homo sapiens
tgcccaggcactgca

SEQ ID NO: 1395327 - DNA, 20 bp, Homo sapiens
tgccccttgacaactggcag

SEQ ID NO: 1395328 - DNA, 18 bp, Homo sapiens
tgcccgggagctcaggaa

SEQ ID NO: 1395329 - DNA, 22 bp, Homo sapiens
tgccgagagtccatcagcctcc

SEQ ID NO: 1395330 - DNA, 19 bp, Homo sapiens
tgccgtcagtgctgtgctg

SEQ ID NO: 1395331 - DNA, 21 bp, Homo sapiens
tgcctaaatacttttttctat

SEQ ID NO: 1395332 - DNA, 14 bp, Homo sapiens
tgcctcaacctccc

SEQ ID NO: 1395333 - DNA, 17 bp, Homo sapiens
tgcctcccatgcctggt

SEQ ID NO: 1395334 - DNA, 20 bp, Homo sapiens
tgcctcctgccggctccttg

SEQ ID NO: 1395335 - DNA, 18 bp, Homo sapiens
tgcctctcatcaactgaa

SEQ ID NO: 1395336 - DNA, 20 bp, Homo sapiens
tgcctctcgctcctcaaccc

SEQ ID NO: 1395337 - DNA, 9 bp, Homo sapiens
tgcctctct

SEQ ID NO: 1395338 - DNA, 15 bp, Homo sapiens
tgcctctctgcaggt

SEQ ID NO: 1395339 - DNA, 23 bp, Homo sapiens
tgcctctctgcaggtccctaata

SEQ ID NO: 1395340 - DNA, 21 bp, Homo sapiens
tgcctcttccagtcttcctga

SEQ ID NO: 1395341 - DNA, 15 bp, Homo sapiens
tgcctgaatatttgt

SEQ ID NO: 1395342 - DNA, 21 bp, Homo sapiens
tgcctgactagggagccatgt

SEQ ID NO: 1395343 - DNA, 17 bp, Homo sapiens
tgcctgctatttgaagt

SEQ ID NO: 1395344 - DNA, 18 bp, Homo sapiens
tgccttccagaaaacaaa

SEQ ID NO: 1395345 - DNA, 15 bp, Homo sapiens
tgccttgtcacgcca

SEQ ID NO: 1395346 - DNA, 13 bp, Homo sapiens
tgcggctcctcag

SEQ ID NO: 1395347 - DNA, 15 bp, Homo sapiens
tgcggctcctcaggg

SEQ ID NO: 1395348 - DNA, 16 bp, Homo sapiens
tgctaagagaagtaga

SEQ ID NO: 1395349 - DNA, 22 bp, Homo sapiens
tgctaatcttcttatgcaattt

SEQ ID NO: 1395350 - DNA, 17 bp, Homo sapiens
tgctatcattattcgta

SEQ ID NO: 1395351 - DNA, 14 bp, Homo sapiens
tgctatggttttct

SEQ ID NO: 1395352 - DNA, 19 bp, Homo sapiens
tgctcaggagccctgggag

SEQ ID NO: 1395353 - DNA, 21 bp, Homo sapiens
tgctcatattgtgattctgcc

SEQ ID NO: 1395354 - DNA, 15 bp, Homo sapiens
tgctcttagctgtct

SEQ ID NO: 1395355 - DNA, 18 bp, Homo sapiens
tgctgatattttctctag

SEQ ID NO: 1395356 - DNA, 21 bp, Homo sapiens
tgctgatattttctctaggaa

SEQ ID NO: 1395357 - DNA, 22 bp, Homo sapiens
tgctggaagacgcaagggcctg

SEQ ID NO: 1395358 - DNA, 15 bp, Homo sapiens
tgctggactgtcata

SEQ ID NO: 1395359 - DNA, 19 bp, Homo sapiens
tgctggactgtcatagaaa

SEQ ID NO: 1395360 - DNA, 16 bp, Homo sapiens
tgctgggcccctgcct

SEQ ID NO: 1395361 - DNA, 18 bp, Homo sapiens
tgctgttttgatttgtac

SEQ ID NO: 1395362 - DNA, 23 bp, Homo sapiens
tgcttaaaaatgccaaaaacaaa

SEQ ID NO: 1395363 - DNA, 22 bp, Homo sapiens
tgcttactgatatattttacaa

SEQ ID NO: 1395364 - DNA, 14 bp, Homo sapiens
tgcttatggtacca

SEQ ID NO: 1395365 - DNA, 21 bp, Homo sapiens
tgcttatggtaccagatgcag

SEQ ID NO: 1395366 - DNA, 18 bp, Homo sapiens
tgcttctagttctgccag

SEQ ID NO: 1395367 - DNA, 14 bp, Homo sapiens
tgctttctgatcaa

SEQ ID NO: 1395368 - DNA, 16 bp, Homo sapiens
tgctttgaaacagaaa

SEQ ID NO: 1395369 - DNA, 21 bp, Homo sapiens
tgctttgaaacagaaaaatat

SEQ ID NO: 1395370 - DNA, 15 bp, Homo sapiens
tgctttttcaccaga

SEQ ID NO: 1395371 - DNA, 22 bp, Homo sapiens
tggaaaatgctatcaaataact

SEQ ID NO: 1395372 - DNA, 23 bp, Homo sapiens
tggaaataaatgtatcatagaaa

SEQ ID NO: 1395373 - DNA, 17 bp, Homo sapiens
tggaaattgattttgaa

SEQ ID NO: 1395374 - DNA, 13 bp, Homo sapiens
tggaactctgctt

SEQ ID NO: 1395375 - DNA, 16 bp, Homo sapiens
tggaacttgaactgat

SEQ ID NO: 1395376 - DNA, 15 bp, Homo sapiens
tggaagccagctttc

SEQ ID NO: 1395377 - DNA, 16 bp, Homo sapiens
tggaagccagctttcc

SEQ ID NO: 1395378 - DNA, 11 bp, Homo sapiens
tggaaggcatg

SEQ ID NO: 1395379 - DNA, 14 bp, Homo sapiens
tggaaggcatggcg

SEQ ID NO: 1395380 - DNA, 17 bp, Homo sapiens
tggaataagtgtacata

SEQ ID NO: 1395381 - DNA, 15 bp, Homo sapiens
tggaataagttcaaa

SEQ ID NO: 1395382 - DNA, 14 bp, Homo sapiens
tggaatacatgaaa

SEQ ID NO: 1395383 - DNA, 15 bp, Homo sapiens
tggacaaagaacctt

SEQ ID NO: 1395384 - DNA, 13 bp, Homo sapiens
tggacaggatgtg

SEQ ID NO: 1395385 - DNA, 17 bp, Homo sapiens
tggacatggtctcctct

SEQ ID NO: 1395386 - DNA, 20 bp, Homo sapiens
tggaccaatagggctgagct

SEQ ID NO: 1395387 - DNA, 21 bp, Homo sapiens
tggaccaatagggctgagctc

SEQ ID NO: 1395388 - DNA, 19 bp, Homo sapiens
tggaccactgggcaatgat

SEQ ID NO: 1395389 - DNA, 14 bp, Homo sapiens
tggactggttttca

SEQ ID NO: 1395390 - DNA, 17 bp, Homo sapiens
tggagaagaccctcccc

SEQ ID NO: 1395391 - DNA, 22 bp, Homo sapiens
tggagacttcaggttgttctgt

SEQ ID NO: 1395392 - DNA, 18 bp, Homo sapiens
tggagtgcaccaaagaga

SEQ ID NO: 1395393 - DNA, 16 bp, Homo sapiens
tggagtgcttaaaaat

SEQ ID NO: 1395394 - DNA, 21 bp, Homo sapiens
tggatatgtaaaacatttatt

SEQ ID NO: 1395395 - DNA, 18 bp, Homo sapiens
tggatatttatttaaaca

SEQ ID NO: 1395396 - DNA, 19 bp, Homo sapiens
tggatatttatttaaacaa

SEQ ID NO: 1395397 - DNA, 22 bp, Homo sapiens
tggatatttatttaaacaaatg

SEQ ID NO: 1395398 - DNA, 14 bp, Homo sapiens
tggcaattttgtaa

SEQ ID NO: 1395399 - DNA, 17 bp, Homo sapiens
tggcaggaaggcttgtt

SEQ ID NO: 1395400 - DNA, 19 bp, Homo sapiens
tggcagtgggaaaaatgta

SEQ ID NO: 1395401 - DNA, 13 bp, Homo sapiens
tggcatgagaaat

SEQ ID NO: 1395402 - DNA, 19 bp, Homo sapiens
tggcattacagctggagaa

SEQ ID NO: 1395403 - DNA, 21 bp, Homo sapiens
tggccaggaagctttggtgag

SEQ ID NO: 1395404 - DNA, 15 bp, Homo sapiens
tggccatttgctttt

SEQ ID NO: 1395405 - DNA, 20 bp, Homo sapiens
tggcccctgaacaagaattg

SEQ ID NO: 1395406 - DNA, 21 bp, Homo sapiens
tggcccttatgactgccaaga

SEQ ID NO: 1395407 - DNA, 22 bp, Homo sapiens
tggcctttattaaaaactgagt

SEQ ID NO: 1395408 - DNA, 15 bp, Homo sapiens
tggcggggtggggtg

SEQ ID NO: 1395409 - DNA, 18 bp, Homo sapiens
tggctatgtttttaatgt

SEQ ID NO: 1395410 - DNA, 12 bp, Homo sapiens
tggctattttat

SEQ ID NO: 1395411 - DNA, 17 bp, Homo sapiens
tggctgtggcatccaga

SEQ ID NO: 1395412 - DNA, 16 bp, Homo sapiens
tggcttctggccagga

SEQ ID NO: 1395413 - DNA, 18 bp, Homo sapiens
tggcttctggccaggaag

SEQ ID NO: 1395414 - DNA, 17 bp, Homo sapiens
tggctttaggagcagtg

SEQ ID NO: 1395415 - DNA, 11 bp, Homo sapiens
tggctttcagg

SEQ ID NO: 1395416 - DNA, 17 bp, Homo sapiens
tgggaaaaatgtaggag

SEQ ID NO: 1395417 - DNA, 17 bp, Homo sapiens
tgggaacattatcacaa

SEQ ID NO: 1395418 - DNA, 21 bp, Homo sapiens
tgggacaccccgacttttgtt

SEQ ID NO: 1395419 - DNA, 21 bp, Homo sapiens
tgggagaccggcctgccagga

SEQ ID NO: 1395420 - DNA, 18 bp, Homo sapiens
tgggagctggttagaaat

SEQ ID NO: 1395421 - DNA, 14 bp, Homo sapiens
tgggaggctctgga

SEQ ID NO: 1395422 - DNA, 14 bp, Homo sapiens
tgggagtgttctgt

SEQ ID NO: 1395423 - DNA, 17 bp, Homo sapiens
tgggcagattttcagca

SEQ ID NO: 1395424 - DNA, 14 bp, Homo sapiens
tgggccttgggctc

SEQ ID NO: 1395425 - DNA, 16 bp, Homo sapiens
tggggagcaggaggcc

SEQ ID NO: 1395426 - DNA, 23 bp, Homo sapiens
tggggagcaggaggccaataaaa

SEQ ID NO: 1395427 - DNA, 18 bp, Homo sapiens
tggggagtttagggtggg

SEQ ID NO: 1395428 - DNA, 20 bp, Homo sapiens
tggggccaggctgggtcgcc

SEQ ID NO: 1395429 - DNA, 22 bp, Homo sapiens
tggggccaggctgggtcgccct

SEQ ID NO: 1395430 - DNA, 20 bp, Homo sapiens
tgggggaagggcttgaattg

SEQ ID NO: 1395431 - DNA, 19 bp, Homo sapiens
tggggtatggattctaaaa

SEQ ID NO: 1395432 - DNA, 14 bp, Homo sapiens
tgggtaactgtcaa

SEQ ID NO: 1395433 - DNA, 15 bp, Homo sapiens
tgggtaactgtcaag

SEQ ID NO: 1395434 - DNA, 21 bp, Homo sapiens
tgggtagaaagagatacagag

SEQ ID NO: 1395435 - DNA, 14 bp, Homo sapiens
tgggtccaggagga

SEQ ID NO: 1395436 - DNA, 21 bp, Homo sapiens
tgggtcgccctggactgtgtg

SEQ ID NO: 1395437 - DNA, 16 bp, Homo sapiens
tgggttgcagacagga

SEQ ID NO: 1395438 - DNA, 15 bp, Homo sapiens
tggtaatttctactt

SEQ ID NO: 1395439 - DNA, 13 bp, Homo sapiens
tggtaccagatgc

SEQ ID NO: 1395440 - DNA, 21 bp, Homo sapiens
tggtccaaaagattgctgaaa

SEQ ID NO: 1395441 - DNA, 18 bp, Homo sapiens
tggtcccaagacagtgag

SEQ ID NO: 1395442 - DNA, 12 bp, Homo sapiens
tggtccctgggt

SEQ ID NO: 1395443 - DNA, 21 bp, Homo sapiens
tggtggcagtgcagcaaccag

SEQ ID NO: 1395444 - DNA, 16 bp, Homo sapiens
tggttcagctaagcta

SEQ ID NO: 1395445 - DNA, 18 bp, Homo sapiens
tggttgatgccaaaaaaa

SEQ ID NO: 1395446 - DNA, 18 bp, Homo sapiens
tggtttcccaagagctac

SEQ ID NO: 1395447 - DNA, 23 bp, Homo sapiens
tggtttgaagaatgttaagactt

SEQ ID NO: 1395448 - DNA, 14 bp, Homo sapiens
tgtaaaaaagtgtt

SEQ ID NO: 1395449 - DNA, 12 bp, Homo sapiens
tgtaaaacaggt

SEQ ID NO: 1395450 - DNA, 11 bp, Homo sapiens
tgtaaacacag

SEQ ID NO: 1395451 - DNA, 13 bp, Homo sapiens
tgtaaactgtgta

SEQ ID NO: 1395452 - DNA, 15 bp, Homo sapiens
tgtaaatattgtgtg

SEQ ID NO: 1395453 - DNA, 20 bp, Homo sapiens
tgtaaatattttaaagaatt

SEQ ID NO: 1395454 - DNA, 22 bp, Homo sapiens
tgtaaatattttaaagaattgt

SEQ ID NO: 1395455 - DNA, 18 bp, Homo sapiens
tgtaacaagccagatttt

SEQ ID NO: 1395456 - DNA, 18 bp, Homo sapiens
tgtaagggccagaaatat

SEQ ID NO: 1395457 - DNA, 21 bp, Homo sapiens
tgtaagggccagaaatatctt

SEQ ID NO: 1395458 - DNA, 15 bp, Homo sapiens
tgtaatgttaatatt

SEQ ID NO: 1395459 - DNA, 17 bp, Homo sapiens
tgtaattgaatattatt

SEQ ID NO: 1395460 - DNA, 13 bp, Homo sapiens
tgtacaaaataaa

SEQ ID NO: 1395461 - DNA, 17 bp, Homo sapiens
tgtacagttatctaagt

SEQ ID NO: 1395462 - DNA, 15 bp, Homo sapiens
tgtacataactgaaa

SEQ ID NO: 1395463 - DNA, 18 bp, Homo sapiens
tgtacatagttatttatt

SEQ ID NO: 1395464 - DNA, 18 bp, Homo sapiens
tgtacatatgtaaaatat

SEQ ID NO: 1395465 - DNA, 15 bp, Homo sapiens
tgtactaaagccaaa

SEQ ID NO: 1395466 - DNA, 16 bp, Homo sapiens
tgtactaaagccaaac

SEQ ID NO: 1395467 - DNA, 13 bp, Homo sapiens
tgtagccacacca

SEQ ID NO: 1395468 - DNA, 17 bp, Homo sapiens
tgtagccacaccaggat

SEQ ID NO: 1395469 - DNA, 21 bp, Homo sapiens
tgtagccccagtgacagctag

SEQ ID NO: 1395470 - DNA, 12 bp, Homo sapiens
tgtagctttgct

SEQ ID NO: 1395471 - DNA, 19 bp, Homo sapiens
tgtagtaatctgcattatt

SEQ ID NO: 1395472 - DNA, 20 bp, Homo sapiens
tgtagtaggcatttttacca

SEQ ID NO: 1395473 - DNA, 15 bp, Homo sapiens
tgtatatatatatat

SEQ ID NO: 1395474 - DNA, 23 bp, Homo sapiens
tgtatggaaataaatgtatcata

SEQ ID NO: 1395475 - DNA, 13 bp, Homo sapiens
tgtattccaagac

SEQ ID NO: 1395476 - DNA, 21 bp, Homo sapiens
tgtcaaacaaatagtctatca

SEQ ID NO: 1395477 - DNA, 17 bp, Homo sapiens
tgtcactcaaggcggtg

SEQ ID NO: 1395478 - DNA, 20 bp, Homo sapiens
tgtcactcaaggcggtgctt

SEQ ID NO: 1395479 - DNA, 21 bp, Homo sapiens
tgtcactggtagaccaaaata

SEQ ID NO: 1395480 - DNA, 14 bp, Homo sapiens
tgtcattgttatat

SEQ ID NO: 1395481 - DNA, 20 bp, Homo sapiens
tgtccagataagttatttat

SEQ ID NO: 1395482 - DNA, 22 bp, Homo sapiens
tgtcctaataatatcccactgg

SEQ ID NO: 1395483 - DNA, 13 bp, Homo sapiens
tgtcctcagcccc

SEQ ID NO: 1395484 - DNA, 18 bp, Homo sapiens
tgtcctgcaccggggcct

SEQ ID NO: 1395485 - DNA, 19 bp, Homo sapiens
tgtcctttctagagcactg

SEQ ID NO: 1395486 - DNA, 21 bp, Homo sapiens
tgtctgatcgttcaaagcatg

SEQ ID NO: 1395487 - DNA, 15 bp, Homo sapiens
tgtctgttctacata

SEQ ID NO: 1395488 - DNA, 21 bp, Homo sapiens
tgtctgttctacatagatgct

SEQ ID NO: 1395489 - DNA, 15 bp, Homo sapiens
tgtgacaaaaaatta

SEQ ID NO: 1395490 - DNA, 21 bp, Homo sapiens
tgtgacaaaaaattaaagcat

SEQ ID NO: 1395491 - DNA, 12 bp, Homo sapiens
tgtgacagggcg

SEQ ID NO: 1395492 - DNA, 14 bp, Homo sapiens
tgtgattcaatctg

SEQ ID NO: 1395493 - DNA, 18 bp, Homo sapiens
tgtgcaatgtaaatattt

SEQ ID NO: 1395494 - DNA, 17 bp, Homo sapiens
tgtgcacttatttatga

SEQ ID NO: 1395495 - DNA, 16 bp, Homo sapiens
tgtgccatgtcaaaca

SEQ ID NO: 1395496 - DNA, 23 bp, Homo sapiens
tgtgcccccaaccatttcctcag

SEQ ID NO: 1395497 - DNA, 17 bp, Homo sapiens
tgtgccttgtcacgcca

SEQ ID NO: 1395498 - DNA, 21 bp, Homo sapiens
tgtgcgtggtggtccctgggt

SEQ ID NO: 1395499 - DNA, 13 bp, Homo sapiens
tgtgctatactgc

SEQ ID NO: 1395500 - DNA, 20 bp, Homo sapiens
tgtgctatactgcatacttt

SEQ ID NO: 1395501 - DNA, 17 bp, Homo sapiens
tgtgctcaggagccctg

SEQ ID NO: 1395502 - DNA, 19 bp, Homo sapiens
tgtgctgtgctatggtgct

SEQ ID NO: 1395503 - DNA, 19 bp, Homo sapiens
tgtgcttatggtaccagat

SEQ ID NO: 1395504 - DNA, 15 bp, Homo sapiens
tgtggcaagtgaatt

SEQ ID NO: 1395505 - DNA, 19 bp, Homo sapiens
tgtggcactggggcagggg

SEQ ID NO: 1395506 - DNA, 17 bp, Homo sapiens
tgtggcccctgaacaag

SEQ ID NO: 1395507 - DNA, 22 bp, Homo sapiens
tgtgggtgttaatttttgatac

SEQ ID NO: 1395508 - DNA, 22 bp, Homo sapiens
tgtgtgcatcaggctttctttt

SEQ ID NO: 1395509 - DNA, 16 bp, Homo sapiens
tgtgttcccatttcag

SEQ ID NO: 1395510 - DNA, 17 bp, Homo sapiens
tgtgttcccatttcagc

SEQ ID NO: 1395511 - DNA, 19 bp, Homo sapiens
tgtgttcccatttcagctg

SEQ ID NO: 1395512 - DNA, 20 bp, Homo sapiens
tgtgtttactttatgttact

SEQ ID NO: 1395513 - DNA, 15 bp, Homo sapiens
tgtgtttgctttctg

SEQ ID NO: 1395514 - DNA, 17 bp, Homo sapiens
tgtgtttggaagactat

SEQ ID NO: 1395515 - DNA, 15 bp, Homo sapiens
tgtgtttggctttca

SEQ ID NO: 1395516 - DNA, 20 bp, Homo sapiens
tgttaaaaaaataagaagaa

SEQ ID NO: 1395517 - DNA, 22 bp, Homo sapiens
tgttaaaaaaataagaagaatg

SEQ ID NO: 1395518 - DNA, 20 bp, Homo sapiens
tgttaagggaagaattccag

SEQ ID NO: 1395519 - DNA, 19 bp, Homo sapiens
tgttaatataatttaacag

SEQ ID NO: 1395520 - DNA, 20 bp, Homo sapiens
tgttaatataatttaacaga

SEQ ID NO: 1395521 - DNA, 22 bp, Homo sapiens
tgttaatttagaaaactttaaa

SEQ ID NO: 1395522 - DNA, 16 bp, Homo sapiens
tgttaatttttgatac

SEQ ID NO: 1395523 - DNA, 21 bp, Homo sapiens
tgttacccagtaactcatctg

SEQ ID NO: 1395524 - DNA, 15 bp, Homo sapiens
tgttatataatcatt

SEQ ID NO: 1395525 - DNA, 22 bp, Homo sapiens
tgttatcaaacaccaacataaa

SEQ ID NO: 1395526 - DNA, 17 bp, Homo sapiens
tgttatgtagataacaa

SEQ ID NO: 1395527 - DNA, 13 bp, Homo sapiens
tgttattaaacag

SEQ ID NO: 1395528 - DNA, 22 bp, Homo sapiens
tgttattattacttatttttga

SEQ ID NO: 1395529 - DNA, 18 bp, Homo sapiens
tgttcagaaggttgctct

SEQ ID NO: 1395530 - DNA, 11 bp, Homo sapiens
tgttcatttcc

SEQ ID NO: 1395531 - DNA, 17 bp, Homo sapiens
tgttcccatttcagctg

SEQ ID NO: 1395532 - DNA, 22 bp, Homo sapiens
tgttcttacctgtatgtctcca

SEQ ID NO: 1395533 - DNA, 24 bp, Homo sapiens
tgttgaaaggtaatttgagagaaa

SEQ ID NO: 1395534 - DNA, 16 bp, Homo sapiens
tgttgagcatcacaga

SEQ ID NO: 1395535 - DNA, 19 bp, Homo sapiens
tgttgagttggacacactg

SEQ ID NO: 1395536 - DNA, 17 bp, Homo sapiens
tgttgtttcttaaataa

SEQ ID NO: 1395537 - DNA, 14 bp, Homo sapiens
tgtttaaacctttt

SEQ ID NO: 1395538 - DNA, 18 bp, Homo sapiens
tgtttagtagcagtgatt

SEQ ID NO: 1395539 - DNA, 13 bp, Homo sapiens
tgtttcacaaggt

SEQ ID NO: 1395540 - DNA, 20 bp, Homo sapiens
tgtttgcacctttctagttg

SEQ ID NO: 1395541 - DNA, 23 bp, Homo sapiens
tgtttgcacctttctagttgaaa

SEQ ID NO: 1395542 - DNA, 21 bp, Homo sapiens
tgttttaataaacgtttgaaa

SEQ ID NO: 1395543 - DNA, 14 bp, Homo sapiens
ttaaaaactgagtg

SEQ ID NO: 1395544 - DNA, 21 bp, Homo sapiens
ttaaaacagacactggcatgg

SEQ ID NO: 1395545 - DNA, 22 bp, Homo sapiens
ttaaaactatccaattaaaatt

SEQ ID NO: 1395546 - DNA, 16 bp, Homo sapiens
ttaaaatgtaaagcca

SEQ ID NO: 1395547 - DNA, 14 bp, Homo sapiens
ttaaacaaatgtgt

SEQ ID NO: 1395548 - DNA, 19 bp, Homo sapiens
ttaaacaggtggttctttt

SEQ ID NO: 1395549 - DNA, 16 bp, Homo sapiens
ttaaaccgctaaaaga

SEQ ID NO: 1395550 - DNA, 14 bp, Homo sapiens
ttaaaccttttttg

SEQ ID NO: 1395551 - DNA, 11 bp, Homo sapiens
ttaaagactta

SEQ ID NO: 1395552 - DNA, 19 bp, Homo sapiens
ttaaagacttaagattaaa

SEQ ID NO: 1395553 - DNA, 21 bp, Homo sapiens
ttaaagtgactaatggcatga

SEQ ID NO: 1395554 - DNA, 23 bp, Homo sapiens
ttaaattctctctcttgcaggaa

SEQ ID NO: 1395555 - DNA, 17 bp, Homo sapiens
ttaacaattaggcagac

SEQ ID NO: 1395556 - DNA, 18 bp, Homo sapiens
ttaacagaagttgtgaaa

SEQ ID NO: 1395557 - DNA, 13 bp, Homo sapiens
ttaacagagtctg

SEQ ID NO: 1395558 - DNA, 19 bp, Homo sapiens
ttaacagagtctgaaccta

SEQ ID NO: 1395559 - DNA, 22 bp, Homo sapiens
ttaaccagatctagtcaatcaa

SEQ ID NO: 1395560 - DNA, 18 bp, Homo sapiens
ttaaccagttatttttat

SEQ ID NO: 1395561 - DNA, 19 bp, Homo sapiens
ttaaccagttatttttatt

SEQ ID NO: 1395562 - DNA, 20 bp, Homo sapiens
ttaacctatgatattttctg

SEQ ID NO: 1395563 - DNA, 21 bp, Homo sapiens
ttaacctatgatattttctgt

SEQ ID NO: 1395564 - DNA, 21 bp, Homo sapiens
ttaactgggtaatgaaacaaa

SEQ ID NO: 1395565 - DNA, 17 bp, Homo sapiens
ttaagacttgacagtgg

SEQ ID NO: 1395566 - DNA, 15 bp, Homo sapiens
ttaagatacactcct

SEQ ID NO: 1395567 - DNA, 14 bp, Homo sapiens
ttaaggtgtagcca

SEQ ID NO: 1395568 - DNA, 16 bp, Homo sapiens
ttaataaacgtttgaa

SEQ ID NO: 1395569 - DNA, 19 bp, Homo sapiens
ttaataatttagacttcaa

SEQ ID NO: 1395570 - DNA, 18 bp, Homo sapiens
ttaatactcacctcctcc

SEQ ID NO: 1395571 - DNA, 16 bp, Homo sapiens
ttaatagcaaagaatt

SEQ ID NO: 1395572 - DNA, 17 bp, Homo sapiens
ttaatatcctaaacatc

SEQ ID NO: 1395573 - DNA, 13 bp, Homo sapiens
ttaatattgattt

SEQ ID NO: 1395574 - DNA, 16 bp, Homo sapiens
ttaatggctgataatt

SEQ ID NO: 1395575 - DNA, 17 bp, Homo sapiens
ttaatggtgccttcatt

SEQ ID NO: 1395576 - DNA, 14 bp, Homo sapiens
ttaatttatgcaga

SEQ ID NO: 1395577 - DNA, 14 bp, Homo sapiens
ttaatttattatta

SEQ ID NO: 1395578 - DNA, 17 bp, Homo sapiens
ttacaagtaacaaaaat

SEQ ID NO: 1395579 - DNA, 19 bp, Homo sapiens
ttacaagtaacaaaaataa

SEQ ID NO: 1395580 - DNA, 15 bp, Homo sapiens
ttacaattttttatc

SEQ ID NO: 1395581 - DNA, 17 bp, Homo sapiens
ttacaattttttatcat

SEQ ID NO: 1395582 - DNA, 14 bp, Homo sapiens
ttacacccaaatat

SEQ ID NO: 1395583 - DNA, 14 bp, Homo sapiens
ttacagtgcagtgc

SEQ ID NO: 1395584 - DNA, 14 bp, Homo sapiens
ttacatgtttgcac

SEQ ID NO: 1395585 - DNA, 18 bp, Homo sapiens
ttacattttaaacacatt

SEQ ID NO: 1395586 - DNA, 13 bp, Homo sapiens
ttaccaacctgtt

SEQ ID NO: 1395587 - DNA, 23 bp, Homo sapiens
ttaccaggcaccaaaagaagtaa

SEQ ID NO: 1395588 - DNA, 20 bp, Homo sapiens
ttacctttttatttgcatgt

SEQ ID NO: 1395589 - DNA, 14 bp, Homo sapiens
ttactacatgcact

SEQ ID NO: 1395590 - DNA, 23 bp, Homo sapiens
ttactataagaactttgagctac

SEQ ID NO: 1395591 - DNA, 16 bp, Homo sapiens
ttactcagtaatttgt

SEQ ID NO: 1395592 - DNA, 17 bp, Homo sapiens
ttactggtccaaaagat

SEQ ID NO: 1395593 - DNA, 22 bp, Homo sapiens
ttacttccacagaatacaagcc

SEQ ID NO: 1395594 - DNA, 22 bp, Homo sapiens
ttacttcgtgtccgactcttct

SEQ ID NO: 1395595 - DNA, 14 bp, Homo sapiens
ttacttttgctgta

SEQ ID NO: 1395596 - DNA, 14 bp, Homo sapiens
ttagaaaactttaa

SEQ ID NO: 1395597 - DNA, 16 bp, Homo sapiens
ttagaaaactttaaag

SEQ ID NO: 1395598 - DNA, 13 bp, Homo sapiens
ttagaaatcattt

SEQ ID NO: 1395599 - DNA, 17 bp, Homo sapiens
ttagaagacaattgaca

SEQ ID NO: 1395600 - DNA, 22 bp, Homo sapiens
ttagactggaacttgaactgat

SEQ ID NO: 1395601 - DNA, 16 bp, Homo sapiens
ttagactggacagctt

SEQ ID NO: 1395602 - DNA, 16 bp, Homo sapiens
ttagcccctgaaagcc

SEQ ID NO: 1395603 - DNA, 18 bp, Homo sapiens
ttagccctggtttgaaat

SEQ ID NO: 1395604 - DNA, 20 bp, Homo sapiens
ttagccctggtttgaaattt

SEQ ID NO: 1395605 - DNA, 16 bp, Homo sapiens
ttagtggctcaacatt

SEQ ID NO: 1395606 - DNA, 15 bp, Homo sapiens
ttataaaaatgaatt

SEQ ID NO: 1395607 - DNA, 17 bp, Homo sapiens
ttataaatttctatttt

SEQ ID NO: 1395608 - DNA, 16 bp, Homo sapiens
ttataaccttaattta

SEQ ID NO: 1395609 - DNA, 21 bp, Homo sapiens
ttataaccttaatttattatt

SEQ ID NO: 1395610 - DNA, 18 bp, Homo sapiens
ttatactaccaagtgacc

SEQ ID NO: 1395611 - DNA, 24 bp, Homo sapiens
ttataggatttatttaaaatagca

SEQ ID NO: 1395612 - DNA, 15 bp, Homo sapiens
ttatatgaagaaaat

SEQ ID NO: 1395613 - DNA, 13 bp, Homo sapiens
ttatatggaaatt

SEQ ID NO: 1395614 - DNA, 19 bp, Homo sapiens
ttatcagtgcttaatgtga

SEQ ID NO: 1395615 - DNA, 16 bp, Homo sapiens
ttatctaatttataaa

SEQ ID NO: 1395616 - DNA, 17 bp, Homo sapiens
ttatctaatttataaaa

SEQ ID NO: 1395617 - DNA, 19 bp, Homo sapiens
ttatctacttccaaactaa

SEQ ID NO: 1395618 - DNA, 17 bp, Homo sapiens
ttatcttggttgaaaat

SEQ ID NO: 1395619 - DNA, 17 bp, Homo sapiens
ttatgaaaaagaagaat

SEQ ID NO: 1395620 - DNA, 18 bp, Homo sapiens
ttatgaaaaagaagaatc

SEQ ID NO: 1395621 - DNA, 21 bp, Homo sapiens
ttatgacatcacttgtacaaa

SEQ ID NO: 1395622 - DNA, 20 bp, Homo sapiens
ttatgactccactgtggaaa

SEQ ID NO: 1395623 - DNA, 18 bp, Homo sapiens
ttatgagctcttcatgtt

SEQ ID NO: 1395624 - DNA, 17 bp, Homo sapiens
ttatgtctgtggatttt

SEQ ID NO: 1395625 - DNA, 17 bp, Homo sapiens
ttatgtgttttaataaa

SEQ ID NO: 1395626 - DNA, 20 bp, Homo sapiens
ttattgagtctgtccagata

SEQ ID NO: 1395627 - DNA, 14 bp, Homo sapiens
ttattggctgagat

SEQ ID NO: 1395628 - DNA, 16 bp, Homo sapiens
ttattggctgagatat

SEQ ID NO: 1395629 - DNA, 22 bp, Homo sapiens
ttattggctgagatatgaacat

SEQ ID NO: 1395630 - DNA, 16 bp, Homo sapiens
ttatttaaaatagcaa

SEQ ID NO: 1395631 - DNA, 21 bp, Homo sapiens
ttatttaaaatagcaaaagaa

SEQ ID NO: 1395632 - DNA, 20 bp, Homo sapiens
ttatttaaacaaatgtgtaa

SEQ ID NO: 1395633 - DNA, 14 bp, Homo sapiens
ttatttaaatctgt

SEQ ID NO: 1395634 - DNA, 13 bp, Homo sapiens
ttatttgcatgtg

SEQ ID NO: 1395635 - DNA, 19 bp, Homo sapiens
ttatttgttgagagtgtga

SEQ ID NO: 1395636 - DNA, 12 bp, Homo sapiens
ttattttcactg

SEQ ID NO: 1395637 - DNA, 17 bp, Homo sapiens
ttattttgacataaagt

SEQ ID NO: 1395638 - DNA, 22 bp, Homo sapiens
ttattttgtgatgcaaataaat

SEQ ID NO: 1395639 - DNA, 23 bp, Homo sapiens
ttatttttgacagtgttgaaaat

SEQ ID NO: 1395640 - DNA, 16 bp, Homo sapiens
ttcaaagcatgaaatg

SEQ ID NO: 1395641 - DNA, 20 bp, Homo sapiens
ttcaaagctgtgtgtttgga

SEQ ID NO: 1395642 - DNA, 16 bp, Homo sapiens
ttcaaattcttctgaa

SEQ ID NO: 1395643 - DNA, 13 bp, Homo sapiens
ttcaagaaactga

SEQ ID NO: 1395644 - DNA, 23 bp, Homo sapiens
ttcaagaaactgaggaattttct

SEQ ID NO: 1395645 - DNA, 23 bp, Homo sapiens
ttcaagaataatcacgctttcct

SEQ ID NO: 1395646 - DNA, 21 bp, Homo sapiens
ttcaagattggacatggtctc

SEQ ID NO: 1395647 - DNA, 23 bp, Homo sapiens
ttcaagttccaagttgctaatac

SEQ ID NO: 1395648 - DNA, 18 bp, Homo sapiens
ttcaatataagcttttct

SEQ ID NO: 1395649 - DNA, 16 bp, Homo sapiens
ttcaatctgtaaactg

SEQ ID NO: 1395650 - DNA, 17 bp, Homo sapiens
ttcaatctgtaaactgt

SEQ ID NO: 1395651 - DNA, 15 bp, Homo sapiens
ttcaatgttagcctc

SEQ ID NO: 1395652 - DNA, 15 bp, Homo sapiens
ttcaattcaaagctg

SEQ ID NO: 1395653 - DNA, 22 bp, Homo sapiens
ttcacaacagcctgacaacatt

SEQ ID NO: 1395654 - DNA, 19 bp, Homo sapiens
ttcacagcctataaccaga

SEQ ID NO: 1395655 - DNA, 13 bp, Homo sapiens
ttcacatctcatt

SEQ ID NO: 1395656 - DNA, 15 bp, Homo sapiens
ttcagagaggccttt

SEQ ID NO: 1395657 - DNA, 18 bp, Homo sapiens
ttcagatgtgaaccatta

SEQ ID NO: 1395658 - DNA, 14 bp, Homo sapiens
ttcagattcccaga

SEQ ID NO: 1395659 - DNA, 20 bp, Homo sapiens
ttcagcaaactcttttccca

SEQ ID NO: 1395660 - DNA, 13 bp, Homo sapiens
ttcagcaactcag

SEQ ID NO: 1395661 - DNA, 22 bp, Homo sapiens
ttcagcttcgtttattttcaag

SEQ ID NO: 1395662 - DNA, 14 bp, Homo sapiens
ttcaggtccaggct

SEQ ID NO: 1395663 - DNA, 12 bp, Homo sapiens
ttcataagtatt

SEQ ID NO: 1395664 - DNA, 20 bp, Homo sapiens
ttcataagtattatgtctct

SEQ ID NO: 1395665 - DNA, 21 bp, Homo sapiens
ttcatatatgaggacttgtgt

SEQ ID NO: 1395666 - DNA, 12 bp, Homo sapiens
ttcatgataatg

SEQ ID NO: 1395667 - DNA, 18 bp, Homo sapiens
ttcatgataatgaacaga

SEQ ID NO: 1395668 - DNA, 21 bp, Homo sapiens
ttcatgccaattagcaattga

SEQ ID NO: 1395669 - DNA, 16 bp, Homo sapiens
ttcatgtctgctatca

SEQ ID NO: 1395670 - DNA, 13 bp, Homo sapiens
ttcattcttaaca

SEQ ID NO: 1395671 - DNA, 17 bp, Homo sapiens
ttcattcttaacaagat

SEQ ID NO: 1395672 - DNA, 15 bp, Homo sapiens
ttcattgtaaatgaa

SEQ ID NO: 1395673 - DNA, 19 bp, Homo sapiens
ttcattgtaaatgaacata

SEQ ID NO: 1395674 - DNA, 21 bp, Homo sapiens
ttcattgtaaatgaacataat

SEQ ID NO: 1395675 - DNA, 18 bp, Homo sapiens
ttcattttaacatctgag

SEQ ID NO: 1395676 - DNA, 19 bp, Homo sapiens
ttccaactcgtatagcatg

SEQ ID NO: 1395677 - DNA, 16 bp, Homo sapiens
ttccaagacatgtctg

SEQ ID NO: 1395678 - DNA, 21 bp, Homo sapiens
ttccaagacatgtctgttcta

SEQ ID NO: 1395679 - DNA, 12 bp, Homo sapiens
ttccatctgatt

SEQ ID NO: 1395680 - DNA, 18 bp, Homo sapiens
ttccatgcgtgtttctga

SEQ ID NO: 1395681 - DNA, 15 bp, Homo sapiens
ttcccactgtttaag

SEQ ID NO: 1395682 - DNA, 14 bp, Homo sapiens
ttccctgcctctca

SEQ ID NO: 1395683 - DNA, 18 bp, Homo sapiens
ttccgtgacgtcactgga

SEQ ID NO: 1395684 - DNA, 18 bp, Homo sapiens
ttcctaaatattatgaga

SEQ ID NO: 1395685 - DNA, 14 bp, Homo sapiens
ttcctacacatggt

SEQ ID NO: 1395686 - DNA, 18 bp, Homo sapiens
ttcctagccctctcacat

SEQ ID NO: 1395687 - DNA, 14 bp, Homo sapiens
ttcctcagactcta

SEQ ID NO: 1395688 - DNA, 17 bp, Homo sapiens
ttcctccaaactcctgc

SEQ ID NO: 1395689 - DNA, 21 bp, Homo sapiens
ttcctccaaactcctgcctgt

SEQ ID NO: 1395690 - DNA, 13 bp, Homo sapiens
ttcctcctgctca

SEQ ID NO: 1395691 - DNA, 15 bp, Homo sapiens
ttcctcctgctcata

SEQ ID NO: 1395692 - DNA, 22 bp, Homo sapiens
ttcctctaggaaatgtacgata

SEQ ID NO: 1395693 - DNA, 19 bp, Homo sapiens
ttcctggtgccaatttcaa

SEQ ID NO: 1395694 - DNA, 16 bp, Homo sapiens
ttccttgtcactggta

SEQ ID NO: 1395695 - DNA, 15 bp, Homo sapiens
ttcgaatgacactgt

SEQ ID NO: 1395696 - DNA, 15 bp, Homo sapiens
ttcgtttattttcaa

SEQ ID NO: 1395697 - DNA, 14 bp, Homo sapiens
ttctaagaaacatt

SEQ ID NO: 1395698 - DNA, 16 bp, Homo sapiens
ttctaagaaacattta

SEQ ID NO: 1395699 - DNA, 16 bp, Homo sapiens
ttctagttctgccagg

SEQ ID NO: 1395700 - DNA, 15 bp, Homo sapiens
ttctatagccaaaaa

SEQ ID NO: 1395701 - DNA, 17 bp, Homo sapiens
ttctatagccaaaaata

SEQ ID NO: 1395702 - DNA, 16 bp, Homo sapiens
ttctatttttatctga

SEQ ID NO: 1395703 - DNA, 14 bp, Homo sapiens
ttctcatgatccaa

SEQ ID NO: 1395704 - DNA, 17 bp, Homo sapiens
ttctcattttttaaaaa

SEQ ID NO: 1395705 - DNA, 13 bp, Homo sapiens
ttctcctcccagg

SEQ ID NO: 1395706 - DNA, 19 bp, Homo sapiens
ttctcgctgtcctttctag

SEQ ID NO: 1395707 - DNA, 13 bp, Homo sapiens
ttctcttgcctca

SEQ ID NO: 1395708 - DNA, 15 bp, Homo sapiens
ttctcttttcctttg

SEQ ID NO: 1395709 - DNA, 17 bp, Homo sapiens
ttctgaactcaaactga

SEQ ID NO: 1395710 - DNA, 22 bp, Homo sapiens
ttctgaactcaaactgaggaat

SEQ ID NO: 1395711 - DNA, 15 bp, Homo sapiens
ttctgactctgagct

SEQ ID NO: 1395712 - DNA, 19 bp, Homo sapiens
ttctgagcccggtaagagc

SEQ ID NO: 1395713 - DNA, 15 bp, Homo sapiens
ttctgagttcctgca

SEQ ID NO: 1395714 - DNA, 13 bp, Homo sapiens
ttctgccaggaga

SEQ ID NO: 1395715 - DNA, 22 bp, Homo sapiens
ttctgcctttggggacttttct

SEQ ID NO: 1395716 - DNA, 19 bp, Homo sapiens
ttctggacccgttcaactt

SEQ ID NO: 1395717 - DNA, 20 bp, Homo sapiens
ttctggattataaaaatgaa

SEQ ID NO: 1395718 - DNA, 14 bp, Homo sapiens
ttctggccaggaag

SEQ ID NO: 1395719 - DNA, 19 bp, Homo sapiens
ttctgtaagaaacctactg

SEQ ID NO: 1395720 - DNA, 15 bp, Homo sapiens
ttctgtgcctgaata

SEQ ID NO: 1395721 - DNA, 16 bp, Homo sapiens
ttctgtgcctgaatat

SEQ ID NO: 1395722 - DNA, 18 bp, Homo sapiens
ttcttaaataagaaactt

SEQ ID NO: 1395723 - DNA, 19 bp, Homo sapiens
ttcttaaataagaaacttt

SEQ ID NO: 1395724 - DNA, 20 bp, Homo sapiens
ttcttctgaactcaaactga

SEQ ID NO: 1395725 - DNA, 23 bp, Homo sapiens
ttcttctgaactcaaactgagga

SEQ ID NO: 1395726 - DNA, 20 bp, Homo sapiens
ttctttaaaatgtaaagcca

SEQ ID NO: 1395727 - DNA, 15 bp, Homo sapiens
ttgaaacagaaaaat

SEQ ID NO: 1395728 - DNA, 18 bp, Homo sapiens
ttgaaatatcctgcttga

SEQ ID NO: 1395729 - DNA, 18 bp, Homo sapiens
ttgaacctgatgaaaata

SEQ ID NO: 1395730 - DNA, 20 bp, Homo sapiens
ttgaacctgatgaaaataaa

SEQ ID NO: 1395731 - DNA, 13 bp, Homo sapiens
ttgaactgattca

SEQ ID NO: 1395732 - DNA, 20 bp, Homo sapiens
ttgaagcaaatcgaatgaaa

SEQ ID NO: 1395733 - DNA, 11 bp, Homo sapiens
ttgaaggctta

SEQ ID NO: 1395734 - DNA, 12 bp, Homo sapiens
ttgaaggcttaa

SEQ ID NO: 1395735 - DNA, 19 bp, Homo sapiens
ttgaagttagctttaactt

SEQ ID NO: 1395736 - DNA, 15 bp, Homo sapiens
ttgaatcctctctct

SEQ ID NO: 1395737 - DNA, 13 bp, Homo sapiens
ttgaattatcttg

SEQ ID NO: 1395738 - DNA, 18 bp, Homo sapiens
ttgaattatcttggttga

SEQ ID NO: 1395739 - DNA, 20 bp, Homo sapiens
ttgaattatcttggttgaaa

SEQ ID NO: 1395740 - DNA, 15 bp, Homo sapiens
ttgacataaagttga

SEQ ID NO: 1395741 - DNA, 19 bp, Homo sapiens
ttgacataaagttgataaa

SEQ ID NO: 1395742 - DNA, 17 bp, Homo sapiens
ttgactttttgcattta

SEQ ID NO: 1395743 - DNA, 21 bp, Homo sapiens
ttgagaaaggattaagataca

SEQ ID NO: 1395744 - DNA, 20 bp, Homo sapiens
ttgagaaggaaaattttagc

SEQ ID NO: 1395745 - DNA, 13 bp, Homo sapiens
ttgagagtgtgac

SEQ ID NO: 1395746 - DNA, 22 bp, Homo sapiens
ttgagataatctaaatataaac

SEQ ID NO: 1395747 - DNA, 16 bp, Homo sapiens
ttgagcatcacagaat

SEQ ID NO: 1395748 - DNA, 17 bp, Homo sapiens
ttgaggggaccaggagt

SEQ ID NO: 1395749 - DNA, 18 bp, Homo sapiens
ttgataagatcttttatt

SEQ ID NO: 1395750 - DNA, 22 bp, Homo sapiens
ttgatgccaaaaaaaaatacat

SEQ ID NO: 1395751 - DNA, 12 bp, Homo sapiens
ttgatgcctggc

SEQ ID NO: 1395752 - DNA, 11 bp, Homo sapiens
ttgcagacagg

SEQ ID NO: 1395753 - DNA, 15 bp, Homo sapiens
ttgcagacaggaatc

SEQ ID NO: 1395754 - DNA, 18 bp, Homo sapiens
ttgcagacaggaatctta

SEQ ID NO: 1395755 - DNA, 22 bp, Homo sapiens
ttgcatttaaaacagacactgg

SEQ ID NO: 1395756 - DNA, 18 bp, Homo sapiens
ttgcccatgcctccagct

SEQ ID NO: 1395757 - DNA, 14 bp, Homo sapiens
ttgcggctcctcag

SEQ ID NO: 1395758 - DNA, 14 bp, Homo sapiens
ttgctactttattt

SEQ ID NO: 1395759 - DNA, 17 bp, Homo sapiens
ttgctcttgatgcctgg

SEQ ID NO: 1395760 - DNA, 11 bp, Homo sapiens
ttgctgaaatt

SEQ ID NO: 1395761 - DNA, 11 bp, Homo sapiens
ttgctgagact

SEQ ID NO: 1395762 - DNA, 13 bp, Homo sapiens
ttgctgcaaacct

SEQ ID NO: 1395763 - DNA, 21 bp, Homo sapiens
ttgctggaagacgcaagggcc

SEQ ID NO: 1395764 - DNA, 23 bp, Homo sapiens
ttgctggactgtcatagaaatta

SEQ ID NO: 1395765 - DNA, 16 bp, Homo sapiens
ttgctgtaatgttaat

SEQ ID NO: 1395766 - DNA, 13 bp, Homo sapiens
ttgcttatgacat

SEQ ID NO: 1395767 - DNA, 15 bp, Homo sapiens
ttgcttttcacaaat

SEQ ID NO: 1395768 - DNA, 15 bp, Homo sapiens
ttgctttttcaccag

SEQ ID NO: 1395769 - DNA, 16 bp, Homo sapiens
ttggacttgtcccggg

SEQ ID NO: 1395770 - DNA, 14 bp, Homo sapiens
ttggcagtctgaat

SEQ ID NO: 1395771 - DNA, 13 bp, Homo sapiens
ttggcatccctgg

SEQ ID NO: 1395772 - DNA, 18 bp, Homo sapiens
ttgggaatggatcctgga

SEQ ID NO: 1395773 - DNA, 22 bp, Homo sapiens
ttggggaagagagcctgcagga

SEQ ID NO: 1395774 - DNA, 23 bp, Homo sapiens
ttggggaagagagcctgcaggat

SEQ ID NO: 1395775 - DNA, 23 bp, Homo sapiens
ttggggagcaggaggccaataaa

SEQ ID NO: 1395776 - DNA, 23 bp, Homo sapiens
ttgggtagaaagagatacagagg

SEQ ID NO: 1395777 - DNA, 14 bp, Homo sapiens
ttgggtccaggagg

SEQ ID NO: 1395778 - DNA, 14 bp, Homo sapiens
ttggtgagaacctg

SEQ ID NO: 1395779 - DNA, 14 bp, Homo sapiens
ttggtttgccttcc

SEQ ID NO: 1395780 - DNA, 16 bp, Homo sapiens
ttgtaaactcaaaata

SEQ ID NO: 1395781 - DNA, 18 bp, Homo sapiens
ttgtaagacaaaggtttt

SEQ ID NO: 1395782 - DNA, 21 bp, Homo sapiens
ttgtaagacaaaggttttcct

SEQ ID NO: 1395783 - DNA, 14 bp, Homo sapiens
ttgtacaaaataaa

SEQ ID NO: 1395784 - DNA, 16 bp, Homo sapiens
ttgtacatagttattt

SEQ ID NO: 1395785 - DNA, 19 bp, Homo sapiens
ttgtctttttagatgccca

SEQ ID NO: 1395786 - DNA, 21 bp, Homo sapiens
ttgtgaaactaaaattttcta

SEQ ID NO: 1395787 - DNA, 22 bp, Homo sapiens
ttgtgacaaaaaattaaagcat

SEQ ID NO: 1395788 - DNA, 12 bp, Homo sapiens
ttgtgactggca

SEQ ID NO: 1395789 - DNA, 21 bp, Homo sapiens
ttgtgccatgtcaaacaaata

SEQ ID NO: 1395790 - DNA, 14 bp, Homo sapiens
ttgtttctactttg

SEQ ID NO: 1395791 - DNA, 16 bp, Homo sapiens
ttgttttgtgcagaga

SEQ ID NO: 1395792 - DNA, 13 bp, Homo sapiens
tttaaaaaagctt

SEQ ID NO: 1395793 - DNA, 20 bp, Homo sapiens
tttaaaaaagcttaaaactt

SEQ ID NO: 1395794 - DNA, 23 bp, Homo sapiens
tttaaaaaagcttaaaactttga

SEQ ID NO: 1395795 - DNA, 11 bp, Homo sapiens
tttaaaccttt

SEQ ID NO: 1395796 - DNA, 19 bp, Homo sapiens
tttaaactgtgtacataac

SEQ ID NO: 1395797 - DNA, 13 bp, Homo sapiens
tttaaagaattgt

SEQ ID NO: 1395798 - DNA, 15 bp, Homo sapiens
tttaaagacttaaga

SEQ ID NO: 1395799 - DNA, 14 bp, Homo sapiens
tttaactgcctaaa

SEQ ID NO: 1395800 - DNA, 20 bp, Homo sapiens
tttaagccaaaacaatgttt

SEQ ID NO: 1395801 - DNA, 18 bp, Homo sapiens
tttaagtatttaggtttt

SEQ ID NO: 1395802 - DNA, 15 bp, Homo sapiens
tttaatgaacaaatg

SEQ ID NO: 1395803 - DNA, 17 bp, Homo sapiens
tttaatgtttaaaacat

SEQ ID NO: 1395804 - DNA, 12 bp, Homo sapiens
tttagaaaactt

SEQ ID NO: 1395805 - DNA, 15 bp, Homo sapiens
tttagaaaactttaa

SEQ ID NO: 1395806 - DNA, 16 bp, Homo sapiens
tttagcttctctgcca

SEQ ID NO: 1395807 - DNA, 13 bp, Homo sapiens
tttaggagcagtg

SEQ ID NO: 1395808 - DNA, 22 bp, Homo sapiens
tttaggtttttgtttgtttcct

SEQ ID NO: 1395809 - DNA, 21 bp, Homo sapiens
tttagtagcagtgattgtctt

SEQ ID NO: 1395810 - DNA, 16 bp, Homo sapiens
tttatattacactaca

SEQ ID NO: 1395811 - DNA, 24 bp, Homo sapiens
tttatcagtgcttaatgtgaacta

SEQ ID NO: 1395812 - DNA, 16 bp, Homo sapiens
tttatcatgcatgtcc

SEQ ID NO: 1395813 - DNA, 23 bp, Homo sapiens
tttatcatgcatgtcctgtaaag

SEQ ID NO: 1395814 - DNA, 12 bp, Homo sapiens
tttatctttata

SEQ ID NO: 1395815 - DNA, 17 bp, Homo sapiens
tttatgagaaagccttc

SEQ ID NO: 1395816 - DNA, 14 bp, Homo sapiens
tttatgccacctga

SEQ ID NO: 1395817 - DNA, 19 bp, Homo sapiens
tttatgtctgtggattttt

SEQ ID NO: 1395818 - DNA, 13 bp, Homo sapiens
tttattaaaaact

SEQ ID NO: 1395819 - DNA, 18 bp, Homo sapiens
tttattaaaaactgagtg

SEQ ID NO: 1395820 - DNA, 17 bp, Homo sapiens
tttattaatatatatta

SEQ ID NO: 1395821 - DNA, 19 bp, Homo sapiens
tttattaatatatattatc

SEQ ID NO: 1395822 - DNA, 16 bp, Homo sapiens
tttattggctgagata

SEQ ID NO: 1395823 - DNA, 13 bp, Homo sapiens
tttatttaaacaa

SEQ ID NO: 1395824 - DNA, 18 bp, Homo sapiens
tttatttgttgagagtgt

SEQ ID NO: 1395825 - DNA, 14 bp, Homo sapiens
tttattttgacata

SEQ ID NO: 1395826 - DNA, 14 bp, Homo sapiens
tttatttttctatg

SEQ ID NO: 1395827 - DNA, 17 bp, Homo sapiens
tttcaaagctttttcca

SEQ ID NO: 1395828 - DNA, 17 bp, Homo sapiens
tttcaacagtgaagaca

SEQ ID NO: 1395829 - DNA, 19 bp, Homo sapiens
tttcaacagtgaagacaga

SEQ ID NO: 1395830 - DNA, 20 bp, Homo sapiens
tttcaacagtgaagacagaa

SEQ ID NO: 1395831 - DNA, 23 bp, Homo sapiens
tttcaagaataatcacgctttcc

SEQ ID NO: 1395832 - DNA, 18 bp, Homo sapiens
tttcacctggaagcattt

SEQ ID NO: 1395833 - DNA, 24 bp, Homo sapiens
tttcactgtagaatgatttcatgc

SEQ ID NO: 1395834 - DNA, 18 bp, Homo sapiens
tttcagatgtgaaccatt

SEQ ID NO: 1395835 - DNA, 19 bp, Homo sapiens
tttcatgataatgaacaga

SEQ ID NO: 1395836 - DNA, 22 bp, Homo sapiens
tttcatgataatgaacagaaca

SEQ ID NO: 1395837 - DNA, 16 bp, Homo sapiens
tttcatgctatctctg

SEQ ID NO: 1395838 - DNA, 19 bp, Homo sapiens
tttcatgctatctctgtgt

SEQ ID NO: 1395839 - DNA, 20 bp, Homo sapiens
tttccatggcaggaaggctt

SEQ ID NO: 1395840 - DNA, 19 bp, Homo sapiens
tttccatgggaccacaact

SEQ ID NO: 1395841 - DNA, 23 bp, Homo sapiens
tttccccatttaggtttctgagt

SEQ ID NO: 1395842 - DNA, 22 bp, Homo sapiens
tttccgtaaaaatgatttcagt

SEQ ID NO: 1395843 - DNA, 14 bp, Homo sapiens
tttcctggtgccaa

SEQ ID NO: 1395844 - DNA, 22 bp, Homo sapiens
tttcctggtgccaatttcaagt

SEQ ID NO: 1395845 - DNA, 18 bp, Homo sapiens
tttccttcaaagtttaat

SEQ ID NO: 1395846 - DNA, 16 bp, Homo sapiens
tttctagagcactgcc

SEQ ID NO: 1395847 - DNA, 21 bp, Homo sapiens
tttctaggtaggaaatgtggt

SEQ ID NO: 1395848 - DNA, 13 bp, Homo sapiens
tttctagttgaaa

SEQ ID NO: 1395849 - DNA, 18 bp, Homo sapiens
tttctatagccaaaaata

SEQ ID NO: 1395850 - DNA, 20 bp, Homo sapiens
tttctattaatatttatgtg

SEQ ID NO: 1395851 - DNA, 15 bp, Homo sapiens
tttctcctcccagga

SEQ ID NO: 1395852 - DNA, 22 bp, Homo sapiens
tttctcgctgtcctttctagag

SEQ ID NO: 1395853 - DNA, 15 bp, Homo sapiens
tttctgatcaaggcc

SEQ ID NO: 1395854 - DNA, 18 bp, Homo sapiens
tttctggaatacatgaaa

SEQ ID NO: 1395855 - DNA, 21 bp, Homo sapiens
tttctggaatacatgaaatat

SEQ ID NO: 1395856 - DNA, 12 bp, Homo sapiens
tttcttaaataa

SEQ ID NO: 1395857 - DNA, 19 bp, Homo sapiens
tttctttgtttctttcttt

SEQ ID NO: 1395858 - DNA, 13 bp, Homo sapiens
tttcttttctttg

SEQ ID NO: 1395859 - DNA, 20 bp, Homo sapiens
tttgaaaaagcgaaaaaatc

SEQ ID NO: 1395860 - DNA, 14 bp, Homo sapiens
tttgaactttttat

SEQ ID NO: 1395861 - DNA, 16 bp, Homo sapiens
tttgaagttagcttta

SEQ ID NO: 1395862 - DNA, 14 bp, Homo sapiens
tttgcaaagtgcaa

SEQ ID NO: 1395863 - DNA, 20 bp, Homo sapiens
tttgcacctttctagttgaa

SEQ ID NO: 1395864 - DNA, 21 bp, Homo sapiens
tttgcacctttctagttgaaa

SEQ ID NO: 1395865 - DNA, 17 bp, Homo sapiens
tttgcatttaaaacaga

SEQ ID NO: 1395866 - DNA, 18 bp, Homo sapiens
tttgcccagaaagaagat

SEQ ID NO: 1395867 - DNA, 15 bp, Homo sapiens
tttgctggaataagt

SEQ ID NO: 1395868 - DNA, 15 bp, Homo sapiens
tttggatatgtaaaa

SEQ ID NO: 1395869 - DNA, 23 bp, Homo sapiens
tttggccaatgcacctaaagaaa

SEQ ID NO: 1395870 - DNA, 16 bp, Homo sapiens
tttggctagtccttgt

SEQ ID NO: 1395871 - DNA, 16 bp, Homo sapiens
tttgtaagttgaagca

SEQ ID NO: 1395872 - DNA, 20 bp, Homo sapiens
tttgtaagttgaagcaaatc

SEQ ID NO: 1395873 - DNA, 19 bp, Homo sapiens
tttgtacatagttatttat

SEQ ID NO: 1395874 - DNA, 14 bp, Homo sapiens
tttgtactgaaaaa

SEQ ID NO: 1395875 - DNA, 15 bp, Homo sapiens
tttgtagtgattttt

SEQ ID NO: 1395876 - DNA, 12 bp, Homo sapiens
tttgtcccaggt

SEQ ID NO: 1395877 - DNA, 23 bp, Homo sapiens
tttgttaatttagaaaactttaa

SEQ ID NO: 1395878 - DNA, 13 bp, Homo sapiens
tttgttgtgactg

SEQ ID NO: 1395879 - DNA, 14 bp, Homo sapiens
ttttaaaaaagctt

SEQ ID NO: 1395880 - DNA, 15 bp, Homo sapiens
ttttaaaaaagctta

SEQ ID NO: 1395881 - DNA, 20 bp, Homo sapiens
ttttaaaaaagcttaaaact

SEQ ID NO: 1395882 - DNA, 23 bp, Homo sapiens
ttttaaaaaagcttaaaactttg

SEQ ID NO: 1395883 - DNA, 24 bp, Homo sapiens
ttttaaaatgccgattacacccaa

SEQ ID NO: 1395884 - DNA, 18 bp, Homo sapiens
ttttaaacacattaggaa

SEQ ID NO: 1395885 - DNA, 13 bp, Homo sapiens
ttttaaactgtgt

SEQ ID NO: 1395886 - DNA, 20 bp, Homo sapiens
ttttaaactgtgtacataac

SEQ ID NO: 1395887 - DNA, 15 bp, Homo sapiens
ttttaagtatttagg

SEQ ID NO: 1395888 - DNA, 16 bp, Homo sapiens
ttttaatgaacaaatg

SEQ ID NO: 1395889 - DNA, 18 bp, Homo sapiens
ttttacaagtaacaaaaa

SEQ ID NO: 1395890 - DNA, 17 bp, Homo sapiens
ttttacttttaaactgt

SEQ ID NO: 1395891 - DNA, 18 bp, Homo sapiens
ttttacttttaaactgtg

SEQ ID NO: 1395892 - DNA, 19 bp, Homo sapiens
ttttagtgaacttgaaata

SEQ ID NO: 1395893 - DNA, 20 bp, Homo sapiens
ttttatctgaaatcaattaa

SEQ ID NO: 1395894 - DNA, 23 bp, Homo sapiens
ttttatctgaatttttaaacaag

SEQ ID NO: 1395895 - DNA, 20 bp, Homo sapiens
ttttatctgagttacagaaa

SEQ ID NO: 1395896 - DNA, 19 bp, Homo sapiens
ttttatgagaaagccttct

SEQ ID NO: 1395897 - DNA, 18 bp, Homo sapiens
ttttcaacagtgaagaca

SEQ ID NO: 1395898 - DNA, 16 bp, Homo sapiens
ttttcaagaataatca

SEQ ID NO: 1395899 - DNA, 22 bp, Homo sapiens
ttttccatggcaggaaggcttg

SEQ ID NO: 1395900 - DNA, 19 bp, Homo sapiens
ttttctcctcccaggaact

SEQ ID NO: 1395901 - DNA, 17 bp, Homo sapiens
ttttctgtgcctgaata

SEQ ID NO: 1395902 - DNA, 24 bp, Homo sapiens
ttttgacagtgttgaaaatgttca

SEQ ID NO: 1395903 - DNA, 18 bp, Homo sapiens
ttttgatactaagcattg

SEQ ID NO: 1395904 - DNA, 20 bp, Homo sapiens
ttttgatttgtactgaaaaa

SEQ ID NO: 1395905 - DNA, 21 bp, Homo sapiens
ttttgcggttcaggaaaattg

SEQ ID NO: 1395906 - DNA, 22 bp, Homo sapiens
ttttgctgtaatgttaatattg

SEQ ID NO: 1395907 - DNA, 19 bp, Homo sapiens
ttttgtaagttgaagcaaa

SEQ ID NO: 1395908 - DNA, 11 bp, Homo sapiens
ttttgtaccaa

SEQ ID NO: 1395909 - DNA, 20 bp, Homo sapiens
tttttaaatgtaaagatatt

SEQ ID NO: 1395910 - DNA, 18 bp, Homo sapiens
tttttcctagccctctca

SEQ ID NO: 1395911 - DNA, 21 bp, Homo sapiens
tttttctcgctgtcctttcta

SEQ ID NO: 1395912 - DNA, 23 bp, Homo sapiens
tttttgaaaaagcgaaaaaatca

SEQ ID NO: 1395913 - DNA, 13 bp, Homo sapiens
tttttgatactaa

SEQ ID NO: 1395914 - DNA, 15 bp, Homo sapiens
tttttgatactaagc

SEQ ID NO: 1395915 - DNA, 12 bp, Homo sapiens
tttttgtaccaa

SEQ ID NO: 1395916 - DNA, 12 bp, Homo sapiens
ttttttctattt

SEQ ID NO: 1395917 - DNA, 21 bp, Homo sapiens
aacttgaaatatcctgcttga

SEQ ID NO: 1395918 - DNA, 19 bp, Homo sapiens
aacttgaccctgagctgac

SEQ ID NO: 1395919 - DNA, 19 bp, Homo sapiens
aactttaaagcgtttgcac

SEQ ID NO: 1395920 - DNA, 20 bp, Homo sapiens
aagaaaataagagctcagga

SEQ ID NO: 1395921 - DNA, 15 bp, Homo sapiens
aagaaacattgttaa

SEQ ID NO: 1395922 - DNA, 23 bp, Homo sapiens
aagaaactttctttctcactaaa

SEQ ID NO: 1395923 - DNA, 14 bp, Homo sapiens
aagaaactttttta

SEQ ID NO: 1395924 - DNA, 22 bp, Homo sapiens
aagaaagcttcaaactgcatga

SEQ ID NO: 1395925 - DNA, 15 bp, Homo sapiens
aagaaatagaacaag

SEQ ID NO: 1395926 - DNA, 16 bp, Homo sapiens
aagaagattcccaccc

SEQ ID NO: 1395927 - DNA, 17 bp, Homo sapiens
aagaagattcccacccc

SEQ ID NO: 1395928 - DNA, 19 bp, Homo sapiens
aagaaggcaaaaatagttt

SEQ ID NO: 1395929 - DNA, 17 bp, Homo sapiens
aagaagggactgagaga

SEQ ID NO: 1395930 - DNA, 14 bp, Homo sapiens
aagaagtaaaagca

SEQ ID NO: 1395931 - DNA, 15 bp, Homo sapiens
aagaagtttcatcat

SEQ ID NO: 1395932 - DNA, 18 bp, Homo sapiens
aagaagtttcatcatttt

SEQ ID NO: 1395933 - DNA, 16 bp, Homo sapiens
aagaataatcacgctt

SEQ ID NO: 1395934 - DNA, 23 bp, Homo sapiens
aagaataatcacgctttcctgaa

SEQ ID NO: 1395935 - DNA, 20 bp, Homo sapiens
aagaatctcatctcagtgaa

SEQ ID NO: 1395936 - DNA, 21 bp, Homo sapiens
aagaatcttggtttgccttcc

SEQ ID NO: 1395937 - DNA, 13 bp, Homo sapiens
aagaatgcttaat

SEQ ID NO: 1395938 - DNA, 20 bp, Homo sapiens
aagaatggcagaaaagttta

SEQ ID NO: 1395939 - DNA, 18 bp, Homo sapiens
aagaatgttaagacttga

SEQ ID NO: 1395940 - DNA, 19 bp, Homo sapiens
aagaatgttaagacttgac

SEQ ID NO: 1395941 - DNA, 19 bp, Homo sapiens
aagacaagtacataaaggt

SEQ ID NO: 1395942 - DNA, 16 bp, Homo sapiens
aagacagaagtttgca

SEQ ID NO: 1395943 - DNA, 16 bp, Homo sapiens
aagacatgtctgttct

SEQ ID NO: 1395944 - DNA, 20 bp, Homo sapiens
aagactgctgtggccaggag

SEQ ID NO: 1395945 - DNA, 22 bp, Homo sapiens
aagactgctgtggccaggaggt

SEQ ID NO: 1395946 - DNA, 15 bp, Homo sapiens
aagacttaagattaa

SEQ ID NO: 1395947 - DNA, 18 bp, Homo sapiens
aagactttaaaagatgaa

SEQ ID NO: 1395948 - DNA, 22 bp, Homo sapiens
aagagaaatcagaaaaattaat

SEQ ID NO: 1395949 - DNA, 19 bp, Homo sapiens
aagagacaaacacctccca

SEQ ID NO: 1395950 - DNA, 21 bp, Homo sapiens
aagagacaaacacctcccagg

SEQ ID NO: 1395951 - DNA, 18 bp, Homo sapiens
aagagagcctgcaggatc

SEQ ID NO: 1395952 - DNA, 14 bp, Homo sapiens
aagagatacagagg

SEQ ID NO: 1395953 - DNA, 20 bp, Homo sapiens
aagagcaaaagaatggcaga

SEQ ID NO: 1395954 - DNA, 14 bp, Homo sapiens
aagagctacataat

SEQ ID NO: 1395955 - DNA, 13 bp, Homo sapiens
aagagctcaggat

SEQ ID NO: 1395956 - DNA, 16 bp, Homo sapiens
aagagttcaagaaata

SEQ ID NO: 1395957 - DNA, 14 bp, Homo sapiens
aagatacactcctg

SEQ ID NO: 1395958 - DNA, 16 bp, Homo sapiens
aagatacactcctgct

SEQ ID NO: 1395959 - DNA, 19 bp, Homo sapiens
aagatacactcctgctgtg

SEQ ID NO: 1395960 - DNA, 13 bp, Homo sapiens
aagattttttaat

SEQ ID NO: 1395961 - DNA, 15 bp, Homo sapiens
aagcaaaaaagaaaa

SEQ ID NO: 1395962 - DNA, 15 bp, Homo sapiens
aagcaacctcagtaa

SEQ ID NO: 1395963 - DNA, 20 bp, Homo sapiens
aagcaacctcagtaatttag

SEQ ID NO: 1395964 - DNA, 13 bp, Homo sapiens
aagcagcctcatt

SEQ ID NO: 1395965 - DNA, 18 bp, Homo sapiens
aagcagggtaccctttgg

SEQ ID NO: 1395966 - DNA, 13 bp, Homo sapiens
aagcatccaggca

SEQ ID NO: 1395967 - DNA, 21 bp, Homo sapiens
aagcattcagaagaaaaagaa

SEQ ID NO: 1395968 - DNA, 16 bp, Homo sapiens
aagcatttagaaaact

SEQ ID NO: 1395969 - DNA, 19 bp, Homo sapiens
aagcatttgtttctacttt

SEQ ID NO: 1395970 - DNA, 13 bp, Homo sapiens
aagccatgctgga

SEQ ID NO: 1395971 - DNA, 15 bp, Homo sapiens
aagccatgctggaaa

SEQ ID NO: 1395972 - DNA, 21 bp, Homo sapiens
aagccatgctggaaaataata

SEQ ID NO: 1395973 - DNA, 16 bp, Homo sapiens
aagcccaccatttggc

SEQ ID NO: 1395974 - DNA, 13 bp, Homo sapiens
aagcctccctcct

SEQ ID NO: 1395975 - DNA, 20 bp, Homo sapiens
aagcgattctcttgcctcaa

SEQ ID NO: 1395976 - DNA, 23 bp, Homo sapiens
aagctcacttctgggcttcatct

SEQ ID NO: 1395977 - DNA, 15 bp, Homo sapiens
aagctgccctgccca

SEQ ID NO: 1395978 - DNA, 16 bp, Homo sapiens
aagctggtttaatgtt

SEQ ID NO: 1395979 - DNA, 19 bp, Homo sapiens
aagcttaatggctgataat

SEQ ID NO: 1395980 - DNA, 18 bp, Homo sapiens
aagcttcaaactgcatga

SEQ ID NO: 1395981 - DNA, 19 bp, Homo sapiens
aagcttcagtgctgccgat

SEQ ID NO: 1395982 - DNA, 23 bp, Homo sapiens
aaggaatatatatggaataagtg

SEQ ID NO: 1395983 - DNA, 12 bp, Homo sapiens
acttgacagtgg

SEQ ID NO: 1395984 - DNA, 14 bp, Homo sapiens
acttgagacctaat

SEQ ID NO: 1395985 - DNA, 21 bp, Homo sapiens
acttgagacctaatctctgta

SEQ ID NO: 1395986 - DNA, 19 bp, Homo sapiens
acttgagataatctaaata

SEQ ID NO: 1395987 - DNA, 19 bp, Homo sapiens
acttgccaaatttagattt

SEQ ID NO: 1395988 - DNA, 16 bp, Homo sapiens
acttgctcttgatgcc

SEQ ID NO: 1395989 - DNA, 17 bp, Homo sapiens
acttgctcttgatgcct

SEQ ID NO: 1395990 - DNA, 18 bp, Homo sapiens
acttgctcttgatgcctg

SEQ ID NO: 1395991 - DNA, 23 bp, Homo sapiens
acttgtcattgttatataatcat

SEQ ID NO: 1395992 - DNA, 14 bp, Homo sapiens
acttgtgtctctgt

SEQ ID NO: 1395993 - DNA, 15 bp, Homo sapiens
actttaaaagatgaa

SEQ ID NO: 1395994 - DNA, 20 bp, Homo sapiens
actttaatactcacctcctc

SEQ ID NO: 1395995 - DNA, 21 bp, Homo sapiens
actttaatactcacctcctcc

SEQ ID NO: 1395996 - DNA, 20 bp, Homo sapiens
actttaattaccaacctgtt

SEQ ID NO: 1395997 - DNA, 21 bp, Homo sapiens
actttctattaatatttatgt

SEQ ID NO: 1395998 - DNA, 17 bp, Homo sapiens
actttctcagttttcat

SEQ ID NO: 1395999 - DNA, 16 bp, Homo sapiens
actttctttctcacta

SEQ ID NO: 1396000 - DNA, 20 bp, Homo sapiens
acttttaaactgtgtacata

SEQ ID NO: 1396001 - DNA, 18 bp, Homo sapiens
acttttaatgaacaaatg

SEQ ID NO: 1396002 - DNA, 14 bp, Homo sapiens
acttttacaagtaa

SEQ ID NO: 1396003 - DNA, 24 bp, Homo sapiens
acttttcttaaaccttcagttatg

SEQ ID NO: 1396004 - DNA, 17 bp, Homo sapiens
agaaaaaattaactagg

SEQ ID NO: 1396005 - DNA, 14 bp, Homo sapiens
agaaaaagaagcaa

SEQ ID NO: 1396006 - DNA, 16 bp, Homo sapiens
agaaaaatatgtacca

SEQ ID NO: 1396007 - DNA, 21 bp, Homo sapiens
agaaaacaaaactgcatttca

SEQ ID NO: 1396008 - DNA, 16 bp, Homo sapiens
agaaaacctttcttca

SEQ ID NO: 1396009 - DNA, 13 bp, Homo sapiens
agaaaagctataa

SEQ ID NO: 1396010 - DNA, 21 bp, Homo sapiens
agaaaagctataaaatgaata

SEQ ID NO: 1396011 - DNA, 14 bp, Homo sapiens
agaaaagctttgaa

SEQ ID NO: 1396012 - DNA, 23 bp, Homo sapiens
agaaacacgtatcccacctgaca

SEQ ID NO: 1396013 - DNA, 12 bp, Homo sapiens
agaaacatttat

SEQ ID NO: 1396014 - DNA, 15 bp, Homo sapiens
agaaacatttatatt

SEQ ID NO: 1396015 - DNA, 14 bp, Homo sapiens
acccctcccctcca

SEQ ID NO: 1396016 - DNA, 15 bp, Homo sapiens
acccctgcctcccat

SEQ ID NO: 1396017 - DNA, 21 bp, Homo sapiens
acccctgcctcccatgcctgg

SEQ ID NO: 1396018 - DNA, 18 bp, Homo sapiens
accctacttcttttgctc

SEQ ID NO: 1396019 - DNA, 22 bp, Homo sapiens
accctgagctgaccagccgtga

SEQ ID NO: 1396020 - DNA, 14 bp, Homo sapiens
accctgatgaaacc

SEQ ID NO: 1396021 - DNA, 17 bp, Homo sapiens
accctttcttcagctct

SEQ ID NO: 1396022 - DNA, 13 bp, Homo sapiens
accggcctgccag

SEQ ID NO: 1396023 - DNA, 16 bp, Homo sapiens
accggcctgccaggag

SEQ ID NO: 1396024 - DNA, 17 bp, Homo sapiens
accggcctgccaggagg

SEQ ID NO: 1396025 - DNA, 13 bp, Homo sapiens
accggggcctggg

SEQ ID NO: 1396026 - DNA, 13 bp, Homo sapiens
acctaaagaaaaa

SEQ ID NO: 1396027 - DNA, 21 bp, Homo sapiens
acctaatctctgtaaagctaa

SEQ ID NO: 1396028 - DNA, 19 bp, Homo sapiens
acctactgcccaggcactg

SEQ ID NO: 1396029 - DNA, 23 bp, Homo sapiens
acctactgcccaggcactgcaaa

SEQ ID NO: 1396030 - DNA, 22 bp, Homo sapiens
acctcaactgcctactccaaaa

SEQ ID NO: 1396031 - DNA, 16 bp, Homo sapiens
acctcaagctgcatct

SEQ ID NO: 1396032 - DNA, 15 bp, Homo sapiens
acctcagtaatttag

SEQ ID NO: 1396033 - DNA, 13 bp, Homo sapiens
acctccccctctt

SEQ ID NO: 1396034 - DNA, 17 bp, Homo sapiens
acctccctatactgctt

SEQ ID NO: 1396035 - DNA, 21 bp, Homo sapiens
acctcctagcaagacctgttg

SEQ ID NO: 1396036 - DNA, 14 bp, Homo sapiens
acctgaagaatcac

SEQ ID NO: 1396037 - DNA, 16 bp, Homo sapiens
acctgaagaatcacaa

SEQ ID NO: 1396038 - DNA, 18 bp, Homo sapiens
acctgaataaagaatgaa

SEQ ID NO: 1396039 - DNA, 23 bp, Homo sapiens
acctgacccctgctcagtaaagc

SEQ ID NO: 1396040 - DNA, 16 bp, Homo sapiens
acctgaggctcagccc

SEQ ID NO: 1396041 - DNA, 14 bp, Homo sapiens
acctgatgaaaata

SEQ ID NO: 1396042 - DNA, 21 bp, Homo sapiens
acctgatgaaaataaagaatg

SEQ ID NO: 1396043 - DNA, 20 bp, Homo sapiens
acctgattttttttcctttt

SEQ ID NO: 1396044 - DNA, 16 bp, Homo sapiens
acctgggttgcagaca

SEQ ID NO: 1396045 - DNA, 20 bp, Homo sapiens
acctgggttgcagacaggaa

SEQ ID NO: 1396046 - DNA, 14 bp, Homo sapiens
acctggtctctcct

SEQ ID NO: 1396047 - DNA, 18 bp, Homo sapiens
acctgttacctactttga

SEQ ID NO: 1396048 - DNA, 20 bp, Homo sapiens
acctgttgagcatcacagaa

SEQ ID NO: 1396049 - DNA, 15 bp, Homo sapiens
accttaatttattat

SEQ ID NO: 1396050 - DNA, 21 bp, Homo sapiens
accttagctggcattacagct

SEQ ID NO: 1396051 - DNA, 19 bp, Homo sapiens
accttcagttatgattttt

SEQ ID NO: 1396052 - DNA, 22 bp, Homo sapiens
accttctctatggggcatcctc

SEQ ID NO: 1396053 - DNA, 16 bp, Homo sapiens
accttctgacctcccc

SEQ ID NO: 1396054 - DNA, 17 bp, Homo sapiens
accttgaagttctgaaa

SEQ ID NO: 1396055 - DNA, 11 bp, Homo sapiens
acctttctagt

SEQ ID NO: 1396056 - DNA, 20 bp, Homo sapiens
acctttcttcaccaaatctt

SEQ ID NO: 1396057 - DNA, 23 bp, Homo sapiens
acgataggtagaattgtggttcc

SEQ ID NO: 1396058 - DNA, 16 bp, Homo sapiens
acgtatttaatagcaa

SEQ ID NO: 1396059 - DNA, 13 bp, Homo sapiens
acgtgacacaaac

SEQ ID NO: 1396060 - DNA, 17 bp, Homo sapiens
acgtttaagccaaaaca

SEQ ID NO: 1396061 - DNA, 18 bp, Homo sapiens
actaaacacgtgacacaa

SEQ ID NO: 1396062 - DNA, 17 bp, Homo sapiens
actaaagccaaacatat

SEQ ID NO: 1396063 - DNA, 16 bp, Homo sapiens
actaatggcatgagaa

SEQ ID NO: 1396064 - DNA, 21 bp, Homo sapiens
actaatggcatgagaaataca

SEQ ID NO: 1396065 - DNA, 18 bp, Homo sapiens
actagaggtgagaaattt

SEQ ID NO: 1396066 - DNA, 21 bp, Homo sapiens
actagaggtgagaaatttaaa

SEQ ID NO: 1396067 - DNA, 23 bp, Homo sapiens
actaggccttgcggctcctcagg

SEQ ID NO: 1396068 - DNA, 19 bp, Homo sapiens
actagggagccatgtttca

SEQ ID NO: 1396069 - DNA, 22 bp, Homo sapiens
actagggagccatgtttcacaa

SEQ ID NO: 1396070 - DNA, 18 bp, Homo sapiens
actataagaactttgagc

SEQ ID NO: 1396071 - DNA, 20 bp, Homo sapiens
actatcttactatttcacaa

SEQ ID NO: 1396072 - DNA, 21 bp, Homo sapiens
actatgaaaagctagaattga

SEQ ID NO: 1396073 - DNA, 22 bp, Homo sapiens
actatggagtgcaccaaagaga

SEQ ID NO: 1396074 - DNA, 21 bp, Homo sapiens
actatggataaactaaacacg

SEQ ID NO: 1396075 - DNA, 24 bp, Homo sapiens
actatggataaactaaacacgtga

SEQ ID NO: 1396076 - DNA, 19 bp, Homo sapiens
actattggagagaaaaaat

SEQ ID NO: 1396077 - DNA, 12 bp, Homo sapiens
actattttcaga

SEQ ID NO: 1396078 - DNA, 22 bp, Homo sapiens
actattttcagatgtgaaccat

SEQ ID NO: 1396079 - DNA, 19 bp, Homo sapiens
actcaagaatttctaaact

SEQ ID NO: 1396080 - DNA, 11 bp, Homo sapiens
actcacctcct

SEQ ID NO: 1396081 - DNA, 18 bp, Homo sapiens
actcactaattcattaat

SEQ ID NO: 1396082 - DNA, 20 bp, Homo sapiens
actcactaattcattaatct

SEQ ID NO: 1396083 - DNA, 14 bp, Homo sapiens
actcattagactgg

SEQ ID NO: 1396084 - DNA, 13 bp, Homo sapiens
actccaaaatgtt

SEQ ID NO: 1396085 - DNA, 22 bp, Homo sapiens
actccaaaatgttggtcatttt

SEQ ID NO: 1396086 - DNA, 14 bp, Homo sapiens
actcctgacctcag

SEQ ID NO: 1396087 - DNA, 15 bp, Homo sapiens
actcctgacctcagg

SEQ ID NO: 1396088 - DNA, 20 bp, Homo sapiens
actccttcaacaattctaaa

SEQ ID NO: 1396089 - DNA, 22 bp, Homo sapiens
actcgtgtctggcacagcctgg

SEQ ID NO: 1396090 - DNA, 21 bp, Homo sapiens
actctgagtgttttatgagaa

SEQ ID NO: 1396091 - DNA, 18 bp, Homo sapiens
actctgcttgatttttgc

SEQ ID NO: 1396092 - DNA, 15 bp, Homo sapiens
actcttcaaatgcct

SEQ ID NO: 1396093 - DNA, 15 bp, Homo sapiens
actgaaaatgtgcta

SEQ ID NO: 1396094 - DNA, 21 bp, Homo sapiens
actgaacaccattgaaggctt

SEQ ID NO: 1396095 - DNA, 12 bp, Homo sapiens
actgaatgaggt

SEQ ID NO: 1396096 - DNA, 20 bp, Homo sapiens
actgaatgaggtcagcatgt

SEQ ID NO: 1396097 - DNA, 20 bp, Homo sapiens
actgaatttttaaaatgccg

SEQ ID NO: 1396098 - DNA, 21 bp, Homo sapiens
actgagaatttgtgtggatat

SEQ ID NO: 1396099 - DNA, 16 bp, Homo sapiens
actgagacaatgcctt

SEQ ID NO: 1396100 - DNA, 23 bp, Homo sapiens
actgagaccaaggctttctctac

SEQ ID NO: 1396101 - DNA, 20 bp, Homo sapiens
actgaggaattttctttgtg

SEQ ID NO: 1396102 - DNA, 23 bp, Homo sapiens
actgagtgactctatatagctga

SEQ ID NO: 1396103 - DNA, 18 bp, Homo sapiens
actgagttttccatggca

SEQ ID NO: 1396104 - DNA, 16 bp, Homo sapiens
actgatatattttaca

SEQ ID NO: 1396105 - DNA, 20 bp, Homo sapiens
actgattcacatctcatttt

SEQ ID NO: 1396106 - DNA, 20 bp, Homo sapiens
actgcatactttttaaatgt

SEQ ID NO: 1396107 - DNA, 14 bp, Homo sapiens
actgcatgcacttc

SEQ ID NO: 1396108 - DNA, 16 bp, Homo sapiens
actgccaagactgctg

SEQ ID NO: 1396109 - DNA, 18 bp, Homo sapiens
actgccaagactgctgtg

SEQ ID NO: 1396110 - DNA, 17 bp, Homo sapiens
actgcccaggcactgca

SEQ ID NO: 1396111 - DNA, 16 bp, Homo sapiens
actgcctaaaatgttc

SEQ ID NO: 1396112 - DNA, 14 bp, Homo sapiens
actgctgtggccag

SEQ ID NO: 1396113 - DNA, 16 bp, Homo sapiens
actgcttggagctgag

SEQ ID NO: 1396114 - DNA, 12 bp, Homo sapiens
actggaaagaag

SEQ ID NO: 1396115 - DNA, 22 bp, Homo sapiens
actggaacactagacaagccag

SEQ ID NO: 1396116 - DNA, 12 bp, Homo sapiens
actggacagctt

SEQ ID NO: 1396117 - DNA, 13 bp, Homo sapiens
actggacagcttg

SEQ ID NO: 1396118 - DNA, 15 bp, Homo sapiens
actggacagcttgtg

SEQ ID NO: 1396119 - DNA, 23 bp, Homo sapiens
actggcatggatatagttttact

SEQ ID NO: 1396120 - DNA, 22 bp, Homo sapiens
actggcctcaaagcaagcattc

SEQ ID NO: 1396121 - DNA, 13 bp, Homo sapiens
actgggcaatgat

SEQ ID NO: 1396122 - DNA, 20 bp, Homo sapiens
actggtttgaagaatgttaa

SEQ ID NO: 1396123 - DNA, 16 bp, Homo sapiens
actgtaaacacagaca

SEQ ID NO: 1396124 - DNA, 16 bp, Homo sapiens
actgtaactgattaca

SEQ ID NO: 1396125 - DNA, 23 bp, Homo sapiens
actgtacttgctcttgatgcctg

SEQ ID NO: 1396126 - DNA, 22 bp, Homo sapiens
actgtatctaggcaacatagta

SEQ ID NO: 1396127 - DNA, 23 bp, Homo sapiens
actgtatctaggcaacatagtat

SEQ ID NO: 1396128 - DNA, 23 bp, Homo sapiens
actgtcaagtcatgatggagact

SEQ ID NO: 1396129 - DNA, 17 bp, Homo sapiens
actgtctctcatgaacc

SEQ ID NO: 1396130 - DNA, 21 bp, Homo sapiens
actgtgtaagggccagaaata

SEQ ID NO: 1396131 - DNA, 16 bp, Homo sapiens
actgtgtacataactg

SEQ ID NO: 1396132 - DNA, 17 bp, Homo sapiens
actgtgtacataactga

SEQ ID NO: 1396133 - DNA, 15 bp, Homo sapiens
actgtgtattccaag

SEQ ID NO: 1396134 - DNA, 16 bp, Homo sapiens
actgtgtattccaaga

SEQ ID NO: 1396135 - DNA, 16 bp, Homo sapiens
acttaaatagtatttc

SEQ ID NO: 1396136 - DNA, 18 bp, Homo sapiens
acttacatgattcatttt

SEQ ID NO: 1396137 - DNA, 19 bp, Homo sapiens
acttacatgattcatttta

SEQ ID NO: 1396138 - DNA, 17 bp, Homo sapiens
acttatttatgaacctg

SEQ ID NO: 1396139 - DNA, 14 bp, Homo sapiens
acttcaaggaaaat

SEQ ID NO: 1396140 - DNA, 18 bp, Homo sapiens
acttcaggtatacctcac

SEQ ID NO: 1396141 - DNA, 20 bp, Homo sapiens
acttcaggtatacctcactt

SEQ ID NO: 1396142 - DNA, 17 bp, Homo sapiens
acttccaaactaatttt

SEQ ID NO: 1396143 - DNA, 19 bp, Homo sapiens
acttccaaactaattttta

SEQ ID NO: 1396144 - DNA, 20 bp, Homo sapiens
acttcctctaggaaatgtac

SEQ ID NO: 1396145 - DNA, 19 bp, Homo sapiens
acttctcattttttaaaaa

SEQ ID NO: 1396146 - DNA, 19 bp, Homo sapiens
acttctgggcttcatctgg

SEQ ID NO: 1396147 - DNA, 19 bp, Homo sapiens
acttcttttgctcttagct

SEQ ID NO: 1396148 - DNA, 16 bp, Homo sapiens
aattcatatttatgaa

SEQ ID NO: 1396149 - DNA, 24 bp, Homo sapiens
aattccagactttctattaatatt

SEQ ID NO: 1396150 - DNA, 16 bp, Homo sapiens
aattctgctcagatag

SEQ ID NO: 1396151 - DNA, 13 bp, Homo sapiens
aattcttctgaac

SEQ ID NO: 1396152 - DNA, 18 bp, Homo sapiens
aattcttctgaactcaaa

SEQ ID NO: 1396153 - DNA, 23 bp, Homo sapiens
aattcttctgaactcaaactgag

SEQ ID NO: 1396154 - DNA, 20 bp, Homo sapiens
aattgaagctttactttaga

SEQ ID NO: 1396155 - DNA, 22 bp, Homo sapiens
aattgaagctttactttagaat

SEQ ID NO: 1396156 - DNA, 14 bp, Homo sapiens
aattgactgtcact

SEQ ID NO: 1396157 - DNA, 14 bp, Homo sapiens
aattgattttgaac

SEQ ID NO: 1396158 - DNA, 20 bp, Homo sapiens
aattggaagctgccctgccc

SEQ ID NO: 1396159 - DNA, 22 bp, Homo sapiens
aatttaaagttgtttgtgcctt

SEQ ID NO: 1396160 - DNA, 15 bp, Homo sapiens
aatttagaaatcatt

SEQ ID NO: 1396161 - DNA, 21 bp, Homo sapiens
aatttagaaatcattttgcaa

SEQ ID NO: 1396162 - DNA, 12 bp, Homo sapiens
aatttagtttca

SEQ ID NO: 1396163 - DNA, 16 bp, Homo sapiens
aatttataaaaaggtg

SEQ ID NO: 1396164 - DNA, 23 bp, Homo sapiens
aatttatcctgaaatttcagatt

SEQ ID NO: 1396165 - DNA, 13 bp, Homo sapiens
aatttattattaa

SEQ ID NO: 1396166 - DNA, 19 bp, Homo sapiens
aatttcacctgtaaacctg

SEQ ID NO: 1396167 - DNA, 12 bp, Homo sapiens
aatttctaaact

SEQ ID NO: 1396168 - DNA, 16 bp, Homo sapiens
aatttgcctgtaacaa

SEQ ID NO: 1396169 - DNA, 17 bp, Homo sapiens
aattttgagtacagaat

SEQ ID NO: 1396170 - DNA, 18 bp, Homo sapiens
aatttttttgtattttag

SEQ ID NO: 1396171 - DNA, 16 bp, Homo sapiens
acaaaaatactcagat

SEQ ID NO: 1396172 - DNA, 16 bp, Homo sapiens
acaaaactagagactc

SEQ ID NO: 1396173 - DNA, 12 bp, Homo sapiens
acaaaataaaca

SEQ ID NO: 1396174 - DNA, 14 bp, Homo sapiens
acaaaataaacaaa

SEQ ID NO: 1396175 - DNA, 20 bp, Homo sapiens
acaaactcgttttttacaaa

SEQ ID NO: 1396176 - DNA, 21 bp, Homo sapiens
acaaagagttcaagaaataag

SEQ ID NO: 1396177 - DNA, 16 bp, Homo sapiens
acaaagcccttttata

SEQ ID NO: 1396178 - DNA, 19 bp, Homo sapiens
acaaagtttaccagaaagc

SEQ ID NO: 1396179 - DNA, 14 bp, Homo sapiens
acaaatggccttta

SEQ ID NO: 1396180 - DNA, 20 bp, Homo sapiens
acaacatttctatagccaaa

SEQ ID NO: 1396181 - DNA, 16 bp, Homo sapiens
acaacctcaactgcct

SEQ ID NO: 1396182 - DNA, 23 bp, Homo sapiens
acaagaaaataagagctcaggat

SEQ ID NO: 1396183 - DNA, 15 bp, Homo sapiens
acaagaagcattttg

SEQ ID NO: 1396184 - DNA, 12 bp, Homo sapiens
acaagatattta

SEQ ID NO: 1396185 - DNA, 16 bp, Homo sapiens
acaaggtctttaaagt

SEQ ID NO: 1396186 - DNA, 15 bp, Homo sapiens
acaagtaacaaaaat

SEQ ID NO: 1396187 - DNA, 14 bp, Homo sapiens
acaagtatttgtta

SEQ ID NO: 1396188 - DNA, 14 bp, Homo sapiens
acaataaaaatgtt

SEQ ID NO: 1396189 - DNA, 20 bp, Homo sapiens
acaatgtttcagaagcccca

SEQ ID NO: 1396190 - DNA, 21 bp, Homo sapiens
acaattaggcagactctttat

SEQ ID NO: 1396191 - DNA, 12 bp, Homo sapiens
acaattctaaaa

SEQ ID NO: 1396192 - DNA, 23 bp, Homo sapiens
acaattctaaaatgattgtagta

SEQ ID NO: 1396193 - DNA, 16 bp, Homo sapiens
acaattttttatcatg

SEQ ID NO: 1396194 - DNA, 14 bp, Homo sapiens
acacaaacacacac

SEQ ID NO: 1396195 - DNA, 22 bp, Homo sapiens
acacagtgctgaccagacagcc

SEQ ID NO: 1396196 - DNA, 19 bp, Homo sapiens
acacatactcatttttcat

SEQ ID NO: 1396197 - DNA, 22 bp, Homo sapiens
acacattgagttggaatcactg

SEQ ID NO: 1396198 - DNA, 15 bp, Homo sapiens
acaccagatttttag

SEQ ID NO: 1396199 - DNA, 22 bp, Homo sapiens
acaccaggatagagactggaac

SEQ ID NO: 1396200 - DNA, 19 bp, Homo sapiens
acacctcccaggagacagt

SEQ ID NO: 1396201 - DNA, 17 bp, Homo sapiens
acactacacactgtgta

SEQ ID NO: 1396202 - DNA, 19 bp, Homo sapiens
acactcagatcctcctcat

SEQ ID NO: 1396203 - DNA, 17 bp, Homo sapiens
acactgattcattctta

SEQ ID NO: 1396204 - DNA, 11 bp, Homo sapiens
acactgccagc

SEQ ID NO: 1396205 - DNA, 17 bp, Homo sapiens
acagaagttgtgaaact

SEQ ID NO: 1396206 - DNA, 18 bp, Homo sapiens
acagaagttgtgaaacta

SEQ ID NO: 1396207 - DNA, 20 bp, Homo sapiens
acagaagttgtgaaactaaa

SEQ ID NO: 1396208 - DNA, 18 bp, Homo sapiens
acagaatgtgataaggaa

SEQ ID NO: 1396209 - DNA, 15 bp, Homo sapiens
acagattgtttgcaa

SEQ ID NO: 1396210 - DNA, 20 bp, Homo sapiens
acagcaacaatttatgaatt

SEQ ID NO: 1396211 - DNA, 17 bp, Homo sapiens
acagcaattcctcaggc

SEQ ID NO: 1396212 - DNA, 20 bp, Homo sapiens
acagcctgacaacatttcta

SEQ ID NO: 1396213 - DNA, 12 bp, Homo sapiens
acagcctggctg

SEQ ID NO: 1396214 - DNA, 16 bp, Homo sapiens
acaggatgtgtttgct

SEQ ID NO: 1396215 - DNA, 19 bp, Homo sapiens
acaggcaaaatccttgctt

SEQ ID NO: 1396216 - DNA, 21 bp, Homo sapiens
acagtccgtcaaaacagattg

SEQ ID NO: 1396217 - DNA, 13 bp, Homo sapiens
acagtgaagacag

SEQ ID NO: 1396218 - DNA, 19 bp, Homo sapiens
acagtgaagacagaagttt

SEQ ID NO: 1396219 - DNA, 14 bp, Homo sapiens
acagtgcagtgcgc

SEQ ID NO: 1396220 - DNA, 19 bp, Homo sapiens
acagttacataattcactc

SEQ ID NO: 1396221 - DNA, 15 bp, Homo sapiens
acagttatctaagtt

SEQ ID NO: 1396222 - DNA, 17 bp, Homo sapiens
acagttatctaagttaa

SEQ ID NO: 1396223 - DNA, 23 bp, Homo sapiens
acagttatctaagttaatttaaa

SEQ ID NO: 1396224 - DNA, 16 bp, Homo sapiens
acagttcaagaaagct

SEQ ID NO: 1396225 - DNA, 20 bp, Homo sapiens
acagttcaagaaagcttcaa

SEQ ID NO: 1396226 - DNA, 20 bp, Homo sapiens
acagttttcctatgctttga

SEQ ID NO: 1396227 - DNA, 23 bp, Homo sapiens
acataaaggtgaccctgatgaaa

SEQ ID NO: 1396228 - DNA, 20 bp, Homo sapiens
acataactgaaaatgtgcta

SEQ ID NO: 1396229 - DNA, 17 bp, Homo sapiens
acataattcactctgag

SEQ ID NO: 1396230 - DNA, 18 bp, Homo sapiens
acatacagaattactgta

SEQ ID NO: 1396231 - DNA, 20 bp, Homo sapiens
acatacagaattactgtaac

SEQ ID NO: 1396232 - DNA, 12 bp, Homo sapiens
acatactcattt

SEQ ID NO: 1396233 - DNA, 14 bp, Homo sapiens
acatactcattttt

SEQ ID NO: 1396234 - DNA, 17 bp, Homo sapiens
acatagacagaagaaac

SEQ ID NO: 1396235 - DNA, 14 bp, Homo sapiens
acatatgtaaaata

SEQ ID NO: 1396236 - DNA, 15 bp, Homo sapiens
acatcacttgtacaa

SEQ ID NO: 1396237 - DNA, 19 bp, Homo sapiens
acatcacttgtacaaaata

SEQ ID NO: 1396238 - DNA, 21 bp, Homo sapiens
acatcattactataagaactt

SEQ ID NO: 1396239 - DNA, 12 bp, Homo sapiens
acatctcatttt

SEQ ID NO: 1396240 - DNA, 13 bp, Homo sapiens
acatctttatccg

SEQ ID NO: 1396241 - DNA, 17 bp, Homo sapiens
acatctttttcctccct

SEQ ID NO: 1396242 - DNA, 13 bp, Homo sapiens
acatgaaacagaa

SEQ ID NO: 1396243 - DNA, 15 bp, Homo sapiens
acatgaaacagaaac

SEQ ID NO: 1396244 - DNA, 17 bp, Homo sapiens
acatgctaagagaagta

SEQ ID NO: 1396245 - DNA, 14 bp, Homo sapiens
acatggtctcctct

SEQ ID NO: 1396246 - DNA, 22 bp, Homo sapiens
acattaactcattagactggaa

SEQ ID NO: 1396247 - DNA, 14 bp, Homo sapiens
acattagaagacaa

SEQ ID NO: 1396248 - DNA, 15 bp, Homo sapiens
acattagaagacaat

SEQ ID NO: 1396249 - DNA, 15 bp, Homo sapiens
acattccaactcgta

SEQ ID NO: 1396250 - DNA, 23 bp, Homo sapiens
acattctgattcgaatgacactg

SEQ ID NO: 1396251 - DNA, 12 bp, Homo sapiens
acattttccttt

SEQ ID NO: 1396252 - DNA, 19 bp, Homo sapiens
acattttccttttcaaata

SEQ ID NO: 1396253 - DNA, 13 bp, Homo sapiens
accaaaagaagta

SEQ ID NO: 1396254 - DNA, 14 bp, Homo sapiens
accaaaagttacat

SEQ ID NO: 1396255 - DNA, 21 bp, Homo sapiens
accaaaagttacatgtttgca

SEQ ID NO: 1396256 - DNA, 11 bp, Homo sapiens
accaaagcaca

SEQ ID NO: 1396257 - DNA, 23 bp, Homo sapiens
accaacataaaaatgatctaaac

SEQ ID NO: 1396258 - DNA, 22 bp, Homo sapiens
accacaaactgtaatacaatga

SEQ ID NO: 1396259 - DNA, 23 bp, Homo sapiens
accagaaagcagttgagacaaga

SEQ ID NO: 1396260 - DNA, 24 bp, Homo sapiens
accagaaagcagttgagacaagaa

SEQ ID NO: 1396261 - DNA, 21 bp, Homo sapiens
accagactacttgggagcacc

SEQ ID NO: 1396262 - DNA, 17 bp, Homo sapiens
accagagcactgtatac

SEQ ID NO: 1396263 - DNA, 14 bp, Homo sapiens
accagatgcagctc

SEQ ID NO: 1396264 - DNA, 19 bp, Homo sapiens
accagccgtgagcatgttt

SEQ ID NO: 1396265 - DNA, 16 bp, Homo sapiens
accaggagtgggtggg

SEQ ID NO: 1396266 - DNA, 16 bp, Homo sapiens
accaggatagagactg

SEQ ID NO: 1396267 - DNA, 17 bp, Homo sapiens
accaggatagagactgg

SEQ ID NO: 1396268 - DNA, 17 bp, Homo sapiens
accaggcagcctctggg

SEQ ID NO: 1396269 - DNA, 22 bp, Homo sapiens
accatagcacaggctaattttt

SEQ ID NO: 1396270 - DNA, 22 bp, Homo sapiens
accatgcccggctaatttttgt

SEQ ID NO: 1396271 - DNA, 14 bp, Homo sapiens
accatttcagagag

SEQ ID NO: 1396272 - DNA, 20 bp, Homo sapiens
accatttcagagaggccttt

SEQ ID NO: 1396273 - DNA, 23 bp, Homo sapiens
acccacactcagatcctcctcat

SEQ ID NO: 1396274 - DNA, 12 bp, Homo sapiens
acccagggctct

SEQ ID NO: 1396275 - DNA, 13 bp, Homo sapiens
acccagggctctg

SEQ ID NO: 1396276 - DNA, 18 bp, Homo sapiens
acccagtaactcatctgt

SEQ ID NO: 1396277 - DNA, 22 bp, Homo sapiens
acccagtcccagaaccacactg

SEQ ID NO: 1396278 - DNA, 22 bp, Homo sapiens
accccatggcagtgggaaaaat

SEQ ID NO: 1396279 - DNA, 14 bp, Homo sapiens
accccccaagctgt

SEQ ID NO: 1396280 - DNA, 22 bp, Homo sapiens
accccccttgcccatgcctcca

SEQ ID NO: 1396281 - DNA, 13 bp, Homo sapiens
acccctcccctcc

SEQ ID NO: 1396282 - DNA, 18 bp, Homo sapiens
aaggagtcactgagacca

SEQ ID NO: 1396283 - DNA, 15 bp, Homo sapiens
aaggcctcctggctg

SEQ ID NO: 1396284 - DNA, 15 bp, Homo sapiens
aaggcttaaacccat

SEQ ID NO: 1396285 - DNA, 17 bp, Homo sapiens
aaggcttgttgtgcttt

SEQ ID NO: 1396286 - DNA, 19 bp, Homo sapiens
aaggcttgttgtgctttta

SEQ ID NO: 1396287 - DNA, 20 bp, Homo sapiens
aaggcttgttgtgcttttag

SEQ ID NO: 1396288 - DNA, 13 bp, Homo sapiens
aagggagggggag

SEQ ID NO: 1396289 - DNA, 13 bp, Homo sapiens
aagggcttgaatt

SEQ ID NO: 1396290 - DNA, 22 bp, Homo sapiens
aaggggcttcaggtccaggctg

SEQ ID NO: 1396291 - DNA, 20 bp, Homo sapiens
aagggtcaggcctttgagct

SEQ ID NO: 1396292 - DNA, 19 bp, Homo sapiens
aaggtacaagaagcatttt

SEQ ID NO: 1396293 - DNA, 20 bp, Homo sapiens
aaggtctgggagtgttctgt

SEQ ID NO: 1396294 - DNA, 20 bp, Homo sapiens
aaggtgtagccacaccagga

SEQ ID NO: 1396295 - DNA, 17 bp, Homo sapiens
aaggtttatgaaaaaga

SEQ ID NO: 1396296 - DNA, 19 bp, Homo sapiens
aagtaaaaaagttaaatgt

SEQ ID NO: 1396297 - DNA, 13 bp, Homo sapiens
aagtaaaagcaaa

SEQ ID NO: 1396298 - DNA, 18 bp, Homo sapiens
aagtaaaagcaaaaaaga

SEQ ID NO: 1396299 - DNA, 13 bp, Homo sapiens
aagtaacaaaaat

SEQ ID NO: 1396300 - DNA, 16 bp, Homo sapiens
aagtaacaaaaataaa

SEQ ID NO: 1396301 - DNA, 14 bp, Homo sapiens
aagtaataaaattc

SEQ ID NO: 1396302 - DNA, 17 bp, Homo sapiens
aagtacttcctctagga

SEQ ID NO: 1396303 - DNA, 15 bp, Homo sapiens
aagtagatgcatttg

SEQ ID NO: 1396304 - DNA, 16 bp, Homo sapiens
aagtatttaggttttt

SEQ ID NO: 1396305 - DNA, 15 bp, Homo sapiens
aagtattttgctgga

SEQ ID NO: 1396306 - DNA, 19 bp, Homo sapiens
aagtcatgatggagacttc

SEQ ID NO: 1396307 - DNA, 16 bp, Homo sapiens
aagtctgtttactgca

SEQ ID NO: 1396308 - DNA, 15 bp, Homo sapiens
aagtgaaattttaaa

SEQ ID NO: 1396309 - DNA, 20 bp, Homo sapiens
aagtgaaattttaaaagtca

SEQ ID NO: 1396310 - DNA, 17 bp, Homo sapiens
aagtgaatttgcctgta

SEQ ID NO: 1396311 - DNA, 20 bp, Homo sapiens
aagtgaatttgcctgtaaca

SEQ ID NO: 1396312 - DNA, 15 bp, Homo sapiens
aagtgtacatatgta

SEQ ID NO: 1396313 - DNA, 14 bp, Homo sapiens
aagtgttttctctg

SEQ ID NO: 1396314 - DNA, 15 bp, Homo sapiens
aagttaatttaaagt

SEQ ID NO: 1396315 - DNA, 17 bp, Homo sapiens
aagttaatttaaagttg

SEQ ID NO: 1396316 - DNA, 13 bp, Homo sapiens
aagttatttataa

SEQ ID NO: 1396317 - DNA, 16 bp, Homo sapiens
aagttcaacatgttat

SEQ ID NO: 1396318 - DNA, 15 bp, Homo sapiens
aagttgtgaaactaa

SEQ ID NO: 1396319 - DNA, 13 bp, Homo sapiens
aataaaaagtata

SEQ ID NO: 1396320 - DNA, 14 bp, Homo sapiens
aataaaaatgttta

SEQ ID NO: 1396321 - DNA, 18 bp, Homo sapiens
aataaaattcaacaaaca

SEQ ID NO: 1396322 - DNA, 17 bp, Homo sapiens
aataaagaatggaaagc

SEQ ID NO: 1396323 - DNA, 19 bp, Homo sapiens
aataaagctgtgtggcagt

SEQ ID NO: 1396324 - DNA, 20 bp, Homo sapiens
aataaatatcctttaattga

SEQ ID NO: 1396325 - DNA, 22 bp, Homo sapiens
aataacgtttaagccaaaacaa

SEQ ID NO: 1396326 - DNA, 17 bp, Homo sapiens
aataagtgtacatatgt

SEQ ID NO: 1396327 - DNA, 18 bp, Homo sapiens
aataagtgtacatatgta

SEQ ID NO: 1396328 - DNA, 21 bp, Homo sapiens
aataagttcaaattcttctga

SEQ ID NO: 1396329 - DNA, 16 bp, Homo sapiens
aataatactgctgaga

SEQ ID NO: 1396330 - DNA, 20 bp, Homo sapiens
aataatcacgctttcctgaa

SEQ ID NO: 1396331 - DNA, 12 bp, Homo sapiens
aataatttagac

SEQ ID NO: 1396332 - DNA, 21 bp, Homo sapiens
aataatttagacttcaagcat

SEQ ID NO: 1396333 - DNA, 22 bp, Homo sapiens
aatacaagccactaccttctga

SEQ ID NO: 1396334 - DNA, 22 bp, Homo sapiens
aatactattggagagaaaaaat

SEQ ID NO: 1396335 - DNA, 14 bp, Homo sapiens
aatactcacctcct

SEQ ID NO: 1396336 - DNA, 13 bp, Homo sapiens
aatactgctgaga

SEQ ID NO: 1396337 - DNA, 22 bp, Homo sapiens
aatacttctcattttttaaaaa

SEQ ID NO: 1396338 - DNA, 22 bp, Homo sapiens
aatagatgtttgatagattttc

SEQ ID NO: 1396339 - DNA, 14 bp, Homo sapiens
aatagcaaagaatt

SEQ ID NO: 1396340 - DNA, 21 bp, Homo sapiens
aatatagatcagttataagta

SEQ ID NO: 1396341 - DNA, 20 bp, Homo sapiens
aatatatatggaataagtgt

SEQ ID NO: 1396342 - DNA, 13 bp, Homo sapiens
aatatatattatc

SEQ ID NO: 1396343 - DNA, 16 bp, Homo sapiens
aatatatattatcttt

SEQ ID NO: 1396344 - DNA, 19 bp, Homo sapiens
aatatccctcctgttggga

SEQ ID NO: 1396345 - DNA, 23 bp, Homo sapiens
aatatccctcctgttgggagagg

SEQ ID NO: 1396346 - DNA, 15 bp, Homo sapiens
aatatcctaaacatc

SEQ ID NO: 1396347 - DNA, 16 bp, Homo sapiens
aatatcctaaacatca

SEQ ID NO: 1396348 - DNA, 17 bp, Homo sapiens
aatatcctaaacatcat

SEQ ID NO: 1396349 - DNA, 19 bp, Homo sapiens
aatatgtaccaagaatctt

SEQ ID NO: 1396350 - DNA, 15 bp, Homo sapiens
aatatgtttgaggtt

SEQ ID NO: 1396351 - DNA, 12 bp, Homo sapiens
aatatttgtaca

SEQ ID NO: 1396352 - DNA, 23 bp, Homo sapiens
aatcaaaagggccaaagaaccaa

SEQ ID NO: 1396353 - DNA, 13 bp, Homo sapiens
aatcaacttgctt

SEQ ID NO: 1396354 - DNA, 14 bp, Homo sapiens
aatcaagggtcagg

SEQ ID NO: 1396355 - DNA, 18 bp, Homo sapiens
aatcaagggtcaggcctt

SEQ ID NO: 1396356 - DNA, 17 bp, Homo sapiens
aatcaagtctgtttact

SEQ ID NO: 1396357 - DNA, 16 bp, Homo sapiens
aatcacgctttcctga

SEQ ID NO: 1396358 - DNA, 14 bp, Homo sapiens
aatcacgctttttg

SEQ ID NO: 1396359 - DNA, 17 bp, Homo sapiens
aatcacgctttttgaaa

SEQ ID NO: 1396360 - DNA, 18 bp, Homo sapiens
aatcacgctttttgaaaa

SEQ ID NO: 1396361 - DNA, 20 bp, Homo sapiens
aatcacgctttttgaaaaag

SEQ ID NO: 1396362 - DNA, 12 bp, Homo sapiens
aatcagaaaaat

SEQ ID NO: 1396363 - DNA, 17 bp, Homo sapiens
aatcagaaaaattaatt

SEQ ID NO: 1396364 - DNA, 14 bp, Homo sapiens
aatcagatagatat

SEQ ID NO: 1396365 - DNA, 16 bp, Homo sapiens
aatcagatagatattc

SEQ ID NO: 1396366 - DNA, 11 bp, Homo sapiens
aatcagctccc

SEQ ID NO: 1396367 - DNA, 24 bp, Homo sapiens
aatcagtctcagaatgtcattttg

SEQ ID NO: 1396368 - DNA, 20 bp, Homo sapiens
aatcatagctggttcacact

SEQ ID NO: 1396369 - DNA, 18 bp, Homo sapiens
aatcctctctctgtgtta

SEQ ID NO: 1396370 - DNA, 20 bp, Homo sapiens
aatcctgtcgattagactgg

SEQ ID NO: 1396371 - DNA, 13 bp, Homo sapiens
aatccttgcttat

SEQ ID NO: 1396372 - DNA, 14 bp, Homo sapiens
aatctaaatataaa

SEQ ID NO: 1396373 - DNA, 17 bp, Homo sapiens
aatctcatctcagtgaa

SEQ ID NO: 1396374 - DNA, 13 bp, Homo sapiens
aatctctgtaaag

SEQ ID NO: 1396375 - DNA, 17 bp, Homo sapiens
aatctgcattattggaa

SEQ ID NO: 1396376 - DNA, 18 bp, Homo sapiens
aatctgcattattggaat

SEQ ID NO: 1396377 - DNA, 19 bp, Homo sapiens
aatctggctcctgtttcca

SEQ ID NO: 1396378 - DNA, 14 bp, Homo sapiens
aatctgtaaactgt

SEQ ID NO: 1396379 - DNA, 15 bp, Homo sapiens
aatctgtaaactgtg

SEQ ID NO: 1396380 - DNA, 15 bp, Homo sapiens
aatctgtttttctaa

SEQ ID NO: 1396381 - DNA, 16 bp, Homo sapiens
aatctgtttttctaac

SEQ ID NO: 1396382 - DNA, 20 bp, Homo sapiens
aatcttaaggtgtagccaca

SEQ ID NO: 1396383 - DNA, 13 bp, Homo sapiens
aatcttggtttgc

SEQ ID NO: 1396384 - DNA, 21 bp, Homo sapiens
aatgaaatcctgcttcagtgt

SEQ ID NO: 1396385 - DNA, 14 bp, Homo sapiens
aatgaacagaacat

SEQ ID NO: 1396386 - DNA, 13 bp, Homo sapiens
aatgaacagaatt

SEQ ID NO: 1396387 - DNA, 11 bp, Homo sapiens
aatgacactgt

SEQ ID NO: 1396388 - DNA, 14 bp, Homo sapiens
aatgaggagacaca

SEQ ID NO: 1396389 - DNA, 14 bp, Homo sapiens
aatgatggcaattt

SEQ ID NO: 1396390 - DNA, 18 bp, Homo sapiens
aatgatggcaattttgta

SEQ ID NO: 1396391 - DNA, 15 bp, Homo sapiens
aatgattgtagtaat

SEQ ID NO: 1396392 - DNA, 14 bp, Homo sapiens
aatgcataaatgca

SEQ ID NO: 1396393 - DNA, 18 bp, Homo sapiens
aatgccaaaaacaaaatg

SEQ ID NO: 1396394 - DNA, 22 bp, Homo sapiens
aatgccaaaaacaaaatggtaa

SEQ ID NO: 1396395 - DNA, 19 bp, Homo sapiens
aatgccaagcacttctttt

SEQ ID NO: 1396396 - DNA, 14 bp, Homo sapiens
aatgcttaatcaga

SEQ ID NO: 1396397 - DNA, 16 bp, Homo sapiens
aatggctatgttttta

SEQ ID NO: 1396398 - DNA, 15 bp, Homo sapiens
aatgtaaagccatgc

SEQ ID NO: 1396399 - DNA, 16 bp, Homo sapiens
aatgtaacttttgtaa

SEQ ID NO: 1396400 - DNA, 22 bp, Homo sapiens
aatgtaacttttgtaagacaaa

SEQ ID NO: 1396401 - DNA, 17 bp, Homo sapiens
aatgtacgataggtaga

SEQ ID NO: 1396402 - DNA, 18 bp, Homo sapiens
aatgtatcatagaaatgt

SEQ ID NO: 1396403 - DNA, 19 bp, Homo sapiens
aatgtatcatagaaatgta

SEQ ID NO: 1396404 - DNA, 22 bp, Homo sapiens
aatgtatcatagaaatgtaact

SEQ ID NO: 1396405 - DNA, 19 bp, Homo sapiens
aatgtcattttggtacttt

SEQ ID NO: 1396406 - DNA, 18 bp, Homo sapiens
aattaactgggtaatgaa

SEQ ID NO: 1396407 - DNA, 22 bp, Homo sapiens
aattaactgggtaatgaaacaa

SEQ ID NO: 1396408 - DNA, 17 bp, Homo sapiens
aattaagggacatgtat

SEQ ID NO: 1396409 - DNA, 15 bp, Homo sapiens
aattaccaacctgtt

SEQ ID NO: 1396410 - DNA, 14 bp, Homo sapiens
aattactggtccaa

SEQ ID NO: 1396411 - DNA, 19 bp, Homo sapiens
aattataactggaaagaag

SEQ ID NO: 1396412 - DNA, 15 bp, Homo sapiens
aattatctaatttat

SEQ ID NO: 1396413 - DNA, 18 bp, Homo sapiens
aattatctaatttataaa

SEQ ID NO: 1396414 - DNA, 22 bp, Homo sapiens
aattatttaaaccgctaaaaga

SEQ ID NO: 1396415 - DNA, 15 bp, Homo sapiens
aattcaacaaacatt

SEQ ID NO: 1396416 - DNA, 13 bp, Homo sapiens
aattcaattcaaa

SEQ ID NO: 1396417 - DNA, 15 bp, Homo sapiens
acataaagttgataa

SEQ ID NO: 1396418 - DNA, 21 bp, Homo sapiens
acataatgaacagaatttatg

SEQ ID NO: 1396419 - DNA, 17 bp, Homo sapiens
acataattatccaggaa

SEQ ID NO: 1396420 - DNA, 16 bp, Homo sapiens
acataattcactctga

SEQ ID NO: 1396421 - DNA, 21 bp, Homo sapiens
acataatttagtttcatataa

SEQ ID NO: 1396422 - DNA, 13 bp, Homo sapiens
acatactcatttt

SEQ ID NO: 1396423 - DNA, 17 bp, Homo sapiens
acatactcatttttcat

SEQ ID NO: 1396424 - DNA, 16 bp, Homo sapiens
acatagaaattgcctg

SEQ ID NO: 1396425 - DNA, 18 bp, Homo sapiens
acatagacagaagaaaca

SEQ ID NO: 1396426 - DNA, 14 bp, Homo sapiens
acatagtattcatg

SEQ ID NO: 1396427 - DNA, 21 bp, Homo sapiens
acatatgtaaaatattgttac

SEQ ID NO: 1396428 - DNA, 23 bp, Homo sapiens
acatatgtaaaatattgttacta

SEQ ID NO: 1396429 - DNA, 15 bp, Homo sapiens
acatcattcattttt

SEQ ID NO: 1396430 - DNA, 15 bp, Homo sapiens
acatcattcttgaga

SEQ ID NO: 1396431 - DNA, 22 bp, Homo sapiens
acatctttttcctccctttccc

SEQ ID NO: 1396432 - DNA, 21 bp, Homo sapiens
acatggcccctccccctgcca

SEQ ID NO: 1396433 - DNA, 22 bp, Homo sapiens
acatggcccctccccctgccag

SEQ ID NO: 1396434 - DNA, 17 bp, Homo sapiens
acatgtctgttctacat

SEQ ID NO: 1396435 - DNA, 14 bp, Homo sapiens
acatgttatttgta

SEQ ID NO: 1396436 - DNA, 21 bp, Homo sapiens
acatgtttgcacctttctagt

SEQ ID NO: 1396437 - DNA, 22 bp, Homo sapiens
acatgtttgcacctttctagtt

SEQ ID NO: 1396438 - DNA, 14 bp, Homo sapiens
acattaactcatta

SEQ ID NO: 1396439 - DNA, 20 bp, Homo sapiens
acattagaagacaattgaca

SEQ ID NO: 1396440 - DNA, 19 bp, Homo sapiens
acattaggaaaagttgcta

SEQ ID NO: 1396441 - DNA, 11 bp, Homo sapiens
acattgtgcca

SEQ ID NO: 1396442 - DNA, 14 bp, Homo sapiens
acattgttaatata

SEQ ID NO: 1396443 - DNA, 18 bp, Homo sapiens
acattgttaatataattt

SEQ ID NO: 1396444 - DNA, 19 bp, Homo sapiens
acattttaaaagtgccatt

SEQ ID NO: 1396445 - DNA, 14 bp, Homo sapiens
accaaaagaagtaa

SEQ ID NO: 1396446 - DNA, 21 bp, Homo sapiens
accaaaagaagtaaaagcaaa

SEQ ID NO: 1396447 - DNA, 23 bp, Homo sapiens
accaaaagttacatgtttgcacc

SEQ ID NO: 1396448 - DNA, 15 bp, Homo sapiens
accaagatacttaag

SEQ ID NO: 1396449 - DNA, 20 bp, Homo sapiens
accaagatacttaagtgctg

SEQ ID NO: 1396450 - DNA, 20 bp, Homo sapiens
accacaactattttcagatg

SEQ ID NO: 1396451 - DNA, 17 bp, Homo sapiens
accacacccacactcag

SEQ ID NO: 1396452 - DNA, 21 bp, Homo sapiens
accactgctgatattttctct

SEQ ID NO: 1396453 - DNA, 23 bp, Homo sapiens
accagactacttgggagcaccgc

SEQ ID NO: 1396454 - DNA, 18 bp, Homo sapiens
accagagaaaaagggagg

SEQ ID NO: 1396455 - DNA, 13 bp, Homo sapiens
accagagcactgt

SEQ ID NO: 1396456 - DNA, 14 bp, Homo sapiens
accagccgtgagca

SEQ ID NO: 1396457 - DNA, 22 bp, Homo sapiens
accagccgtgagcatgtttgga

SEQ ID NO: 1396458 - DNA, 14 bp, Homo sapiens
accagctacttgat

SEQ ID NO: 1396459 - DNA, 19 bp, Homo sapiens
accagctacttgatgtaac

SEQ ID NO: 1396460 - DNA, 20 bp, Homo sapiens
accaggagtgggtggggagt

SEQ ID NO: 1396461 - DNA, 19 bp, Homo sapiens
accaggcaccaaaagaagt

SEQ ID NO: 1396462 - DNA, 20 bp, Homo sapiens
accaggcagcctctgggggg

SEQ ID NO: 1396463 - DNA, 13 bp, Homo sapiens
accatcactgagt

SEQ ID NO: 1396464 - DNA, 20 bp, Homo sapiens
accatgccaggctaattttt

SEQ ID NO: 1396465 - DNA, 19 bp, Homo sapiens
accattataaccttaattt

SEQ ID NO: 1396466 - DNA, 16 bp, Homo sapiens
accattgaaggcttaa

SEQ ID NO: 1396467 - DNA, 15 bp, Homo sapiens
accatttcctcagac

SEQ ID NO: 1396468 - DNA, 19 bp, Homo sapiens
accatttggcatccctggg

SEQ ID NO: 1396469 - DNA, 18 bp, Homo sapiens
acccaaagaggtatttat

SEQ ID NO: 1396470 - DNA, 16 bp, Homo sapiens
aatattatgagatgct

SEQ ID NO: 1396471 - DNA, 16 bp, Homo sapiens
aatattattcctcaaa

SEQ ID NO: 1396472 - DNA, 11 bp, Homo sapiens
aatattttaaa

SEQ ID NO: 1396473 - DNA, 15 bp, Homo sapiens
aatattttaaagaat

SEQ ID NO: 1396474 - DNA, 20 bp, Homo sapiens
aatcaaaagggccaaagaac

SEQ ID NO: 1396475 - DNA, 17 bp, Homo sapiens
aatcaacttgcttatca

SEQ ID NO: 1396476 - DNA, 18 bp, Homo sapiens
aatcaacttgcttatcaa

SEQ ID NO: 1396477 - DNA, 15 bp, Homo sapiens
aatcaagggtcaggc

SEQ ID NO: 1396478 - DNA, 18 bp, Homo sapiens
aatcaccacaaactgtaa

SEQ ID NO: 1396479 - DNA, 21 bp, Homo sapiens
aatcactgtttagaacacaca

SEQ ID NO: 1396480 - DNA, 16 bp, Homo sapiens
aatcacttaggaaatg

SEQ ID NO: 1396481 - DNA, 17 bp, Homo sapiens
aatcagtctcagaatgt

SEQ ID NO: 1396482 - DNA, 14 bp, Homo sapiens
aatcctgtctgaaa

SEQ ID NO: 1396483 - DNA, 21 bp, Homo sapiens
aatctcagttgattttctgga

SEQ ID NO: 1396484 - DNA, 12 bp, Homo sapiens
aatctctgtaaa

SEQ ID NO: 1396485 - DNA, 11 bp, Homo sapiens
aatctgtaaac

SEQ ID NO: 1396486 - DNA, 19 bp, Homo sapiens
aatcttggttgatgccaaa

SEQ ID NO: 1396487 - DNA, 17 bp, Homo sapiens
aatctttaaaagatgct

SEQ ID NO: 1396488 - DNA, 16 bp, Homo sapiens
aatgaaacaaagagtt

SEQ ID NO: 1396489 - DNA, 14 bp, Homo sapiens
aatgaaattaactg

SEQ ID NO: 1396490 - DNA, 22 bp, Homo sapiens
aatgacagtccgtcaaaacaga

SEQ ID NO: 1396491 - DNA, 19 bp, Homo sapiens
aatgaggtcagcatgtcta

SEQ ID NO: 1396492 - DNA, 19 bp, Homo sapiens
aatgatcctgtattcagac

SEQ ID NO: 1396493 - DNA, 13 bp, Homo sapiens
aatgatttcatgc

SEQ ID NO: 1396494 - DNA, 15 bp, Homo sapiens
aatgcacctaaagaa

SEQ ID NO: 1396495 - DNA, 22 bp, Homo sapiens
aatgcattataggatcatttgt

SEQ ID NO: 1396496 - DNA, 22 bp, Homo sapiens
aatgcttaatcagatagatatt

SEQ ID NO: 1396497 - DNA, 17 bp, Homo sapiens
aatggccatttgctttt

SEQ ID NO: 1396498 - DNA, 15 bp, Homo sapiens
aatggctgataattt

SEQ ID NO: 1396499 - DNA, 17 bp, Homo sapiens
aatggctgataatttta

SEQ ID NO: 1396500 - DNA, 19 bp, Homo sapiens
aatggctgataattttaaa

SEQ ID NO: 1396501 - DNA, 16 bp, Homo sapiens
aatgtaaatattttaa

SEQ ID NO: 1396502 - DNA, 20 bp, Homo sapiens
aatgtaaatattttaaagaa

SEQ ID NO: 1396503 - DNA, 21 bp, Homo sapiens
aatgtaaatattttaaagaat

SEQ ID NO: 1396504 - DNA, 22 bp, Homo sapiens
aatgtaggagactgtttggaaa

SEQ ID NO: 1396505 - DNA, 18 bp, Homo sapiens
aatgtgctatactgcata

SEQ ID NO: 1396506 - DNA, 16 bp, Homo sapiens
aatgtggtagcctcac

SEQ ID NO: 1396507 - DNA, 19 bp, Homo sapiens
aatgttgattacagtgcag

SEQ ID NO: 1396508 - DNA, 15 bp, Homo sapiens
aattaaagctgttat

SEQ ID NO: 1396509 - DNA, 21 bp, Homo sapiens
aattaactgggtaatgaaaca

SEQ ID NO: 1396510 - DNA, 12 bp, Homo sapiens
aattaagacttt

SEQ ID NO: 1396511 - DNA, 14 bp, Homo sapiens
aattacacccaaag

SEQ ID NO: 1396512 - DNA, 18 bp, Homo sapiens
aattataactggaaagaa

SEQ ID NO: 1396513 - DNA, 15 bp, Homo sapiens
aattcaattcaaagc

SEQ ID NO: 1396514 - DNA, 23 bp, Homo sapiens
aattcactctgagtgttttatga

SEQ ID NO: 1396515 - DNA, 22 bp, Homo sapiens
aattccagactttctattaata

SEQ ID NO: 1396516 - DNA, 12 bp, Homo sapiens
aattctaaaatg

SEQ ID NO: 1396517 - DNA, 15 bp, Homo sapiens
aattcttctgaactc

SEQ ID NO: 1396518 - DNA, 15 bp, Homo sapiens
agaattcaacagtta

SEQ ID NO: 1396519 - DNA, 14 bp, Homo sapiens
agaattgagtgttt

SEQ ID NO: 1396520 - DNA, 20 bp, Homo sapiens
agaattgtgtcagactgttt

SEQ ID NO: 1396521 - DNA, 23 bp, Homo sapiens
agaattgtgtcagactgtttagt

SEQ ID NO: 1396522 - DNA, 15 bp, Homo sapiens
agacaagccagaact

SEQ ID NO: 1396523 - DNA, 16 bp, Homo sapiens
agacaattgacaacag

SEQ ID NO: 1396524 - DNA, 19 bp, Homo sapiens
agacaattgacaacagtta

SEQ ID NO: 1396525 - DNA, 13 bp, Homo sapiens
agacacacctgag

SEQ ID NO: 1396526 - DNA, 16 bp, Homo sapiens
agacacatactcattt

SEQ ID NO: 1396527 - DNA, 15 bp, Homo sapiens
agacagaagaaacaa

SEQ ID NO: 1396528 - DNA, 17 bp, Homo sapiens
agacagaagaaacaagg

SEQ ID NO: 1396529 - DNA, 19 bp, Homo sapiens
agacagtgagacagtctgg

SEQ ID NO: 1396530 - DNA, 14 bp, Homo sapiens
agacagttcaagaa

SEQ ID NO: 1396531 - DNA, 20 bp, Homo sapiens
agacatgtctgttctacata

SEQ ID NO: 1396532 - DNA, 19 bp, Homo sapiens
agacctaatctctgtaaag

SEQ ID NO: 1396533 - DNA, 18 bp, Homo sapiens
agacctcagtgccttcct

SEQ ID NO: 1396534 - DNA, 20 bp, Homo sapiens
agacctctcaacagatctgt

SEQ ID NO: 1396535 - DNA, 18 bp, Homo sapiens
agacctctgtgcacttat

SEQ ID NO: 1396536 - DNA, 13 bp, Homo sapiens
agacctgaagaat

SEQ ID NO: 1396537 - DNA, 16 bp, Homo sapiens
agaccttttttaggaa

SEQ ID NO: 1396538 - DNA, 14 bp, Homo sapiens
agacgggccctggt

SEQ ID NO: 1396539 - DNA, 18 bp, Homo sapiens
agactcagctctgacatt

SEQ ID NO: 1396540 - DNA, 17 bp, Homo sapiens
agactctaagaaagaac

SEQ ID NO: 1396541 - DNA, 23 bp, Homo sapiens
agactgcgatttgtcccaggtcc

SEQ ID NO: 1396542 - DNA, 17 bp, Homo sapiens
agactggaacttgaact

SEQ ID NO: 1396543 - DNA, 15 bp, Homo sapiens
agactggacagcttg

SEQ ID NO: 1396544 - DNA, 16 bp, Homo sapiens
agactggacagcttgt

SEQ ID NO: 1396545 - DNA, 17 bp, Homo sapiens
agactggacagcttgtg

SEQ ID NO: 1396546 - DNA, 19 bp, Homo sapiens
agacttaagattaaattat

SEQ ID NO: 1396547 - DNA, 19 bp, Homo sapiens
agacttcaggttgttctgt

SEQ ID NO: 1396548 - DNA, 13 bp, Homo sapiens
agacttgacagtg

SEQ ID NO: 1396549 - DNA, 10 bp, Homo sapiens
agactttaaa

SEQ ID NO: 1396550 - DNA, 17 bp, Homo sapiens
agactttctattaatat

SEQ ID NO: 1396551 - DNA, 21 bp, Homo sapiens
agagaatgcccttctccttat

SEQ ID NO: 1396552 - DNA, 21 bp, Homo sapiens
agagacaaacacctcccagga

SEQ ID NO: 1396553 - DNA, 14 bp, Homo sapiens
agagagcctgcagg

SEQ ID NO: 1396554 - DNA, 12 bp, Homo sapiens
agagaggccatt

SEQ ID NO: 1396555 - DNA, 22 bp, Homo sapiens
agagaggccattctttcccaac

SEQ ID NO: 1396556 - DNA, 23 bp, Homo sapiens
agagaggccattctttcccaaca

SEQ ID NO: 1396557 - DNA, 16 bp, Homo sapiens
agagatgcagaaatat

SEQ ID NO: 1396558 - DNA, 20 bp, Homo sapiens
agagcacgcctgtactagag

SEQ ID NO: 1396559 - DNA, 21 bp, Homo sapiens
agagcacgcctgtactagagc

SEQ ID NO: 1396560 - DNA, 12 bp, Homo sapiens
agagcactgcca

SEQ ID NO: 1396561 - DNA, 13 bp, Homo sapiens
agagcactgccac

SEQ ID NO: 1396562 - DNA, 16 bp, Homo sapiens
agagcctgcaggatct

SEQ ID NO: 1396563 - DNA, 17 bp, Homo sapiens
agagcctgcaggatctc

SEQ ID NO: 1396564 - DNA, 18 bp, Homo sapiens
agagctacataatttagt

SEQ ID NO: 1396565 - DNA, 17 bp, Homo sapiens
agagctacgtatttaat

SEQ ID NO: 1396566 - DNA, 18 bp, Homo sapiens
agaggcacctgtcccaga

SEQ ID NO: 1396567 - DNA, 21 bp, Homo sapiens
agaggccattctttcccaaca

SEQ ID NO: 1396568 - DNA, 16 bp, Homo sapiens
agagggtgtcctgcac

SEQ ID NO: 1396569 - DNA, 17 bp, Homo sapiens
agaggtgagaaatttaa

SEQ ID NO: 1396570 - DNA, 14 bp, Homo sapiens
agagtccctgcctg

SEQ ID NO: 1396571 - DNA, 18 bp, Homo sapiens
agagtctggtgaagctca

SEQ ID NO: 1396572 - DNA, 13 bp, Homo sapiens
agagtgagagaca

SEQ ID NO: 1396573 - DNA, 14 bp, Homo sapiens
agagtgtgaccaaa

SEQ ID NO: 1396574 - DNA, 21 bp, Homo sapiens
agagttcaagaaataagtttt

SEQ ID NO: 1396575 - DNA, 18 bp, Homo sapiens
agataactgaaaattatt

SEQ ID NO: 1396576 - DNA, 13 bp, Homo sapiens
agataatccctgt

SEQ ID NO: 1396577 - DNA, 15 bp, Homo sapiens
agatacatacagaat

SEQ ID NO: 1396578 - DNA, 16 bp, Homo sapiens
agatacttaagtgctg

SEQ ID NO: 1396579 - DNA, 14 bp, Homo sapiens
agatattggacaaa

SEQ ID NO: 1396580 - DNA, 21 bp, Homo sapiens
agatatttttatctttatatg

SEQ ID NO: 1396581 - DNA, 18 bp, Homo sapiens
agatcactttctcagttt

SEQ ID NO: 1396582 - DNA, 18 bp, Homo sapiens
agatcccaacactgccag

SEQ ID NO: 1396583 - DNA, 21 bp, Homo sapiens
agatctgcagggggtgtgtct

SEQ ID NO: 1396584 - DNA, 18 bp, Homo sapiens
agatgcatttgggtccag

SEQ ID NO: 1396585 - DNA, 19 bp, Homo sapiens
agatgcatttgggtccagg

SEQ ID NO: 1396586 - DNA, 17 bp, Homo sapiens
agatgctggcttgggca

SEQ ID NO: 1396587 - DNA, 18 bp, Homo sapiens
agatgctggcttgggcag

SEQ ID NO: 1396588 - DNA, 18 bp, Homo sapiens
agatgcttttaacagagt

SEQ ID NO: 1396589 - DNA, 16 bp, Homo sapiens
agatgtgagagaaaga

SEQ ID NO: 1396590 - DNA, 19 bp, Homo sapiens
agatgtttgatagattttc

SEQ ID NO: 1396591 - DNA, 16 bp, Homo sapiens
agattcccagagcaaa

SEQ ID NO: 1396592 - DNA, 17 bp, Homo sapiens
agattctcccttgctct

SEQ ID NO: 1396593 - DNA, 18 bp, Homo sapiens
agattgagagaagagaca

SEQ ID NO: 1396594 - DNA, 13 bp, Homo sapiens
agattgagagaat

SEQ ID NO: 1396595 - DNA, 15 bp, Homo sapiens
agattgagagaattt

SEQ ID NO: 1396596 - DNA, 22 bp, Homo sapiens
agattgctgaaattttatatgc

SEQ ID NO: 1396597 - DNA, 20 bp, Homo sapiens
agattggacatggtctcctc

SEQ ID NO: 1396598 - DNA, 21 bp, Homo sapiens
agatttccttctttttttctt

SEQ ID NO: 1396599 - DNA, 12 bp, Homo sapiens
agcaaaaaagaa

SEQ ID NO: 1396600 - DNA, 22 bp, Homo sapiens
agcaaatcaccacaaactgtaa

SEQ ID NO: 1396601 - DNA, 20 bp, Homo sapiens
agcaaatcgaatgaaattaa

SEQ ID NO: 1396602 - DNA, 15 bp, Homo sapiens
agcaacaatttatga

SEQ ID NO: 1396603 - DNA, 21 bp, Homo sapiens
agcaacaatttatgaattgaa

SEQ ID NO: 1396604 - DNA, 18 bp, Homo sapiens
agcaaccagagcactgta

SEQ ID NO: 1396605 - DNA, 18 bp, Homo sapiens
agcaagacctgttggtta

SEQ ID NO: 1396606 - DNA, 17 bp, Homo sapiens
agcaagcttaatggctg

SEQ ID NO: 1396607 - DNA, 17 bp, Homo sapiens
agcacaagttatttaaa

SEQ ID NO: 1396608 - DNA, 22 bp, Homo sapiens
agcacttgcaaccgtctgttat

SEQ ID NO: 1396609 - DNA, 19 bp, Homo sapiens
agcagactcagctctgaca

SEQ ID NO: 1396610 - DNA, 15 bp, Homo sapiens
agcaggaggccaata

SEQ ID NO: 1396611 - DNA, 21 bp, Homo sapiens
agcagggtaccctttggggag

SEQ ID NO: 1396612 - DNA, 19 bp, Homo sapiens
agcagttgagacaagaaaa

SEQ ID NO: 1396613 - DNA, 20 bp, Homo sapiens
agcagttgagacaagaaaat

SEQ ID NO: 1396614 - DNA, 14 bp, Homo sapiens
agcatcacagaatg

SEQ ID NO: 1396615 - DNA, 20 bp, Homo sapiens
agcatccccttgaactcttc

SEQ ID NO: 1396616 - DNA, 22 bp, Homo sapiens
agcatcgtctcatgtaaaataa

SEQ ID NO: 1396617 - DNA, 15 bp, Homo sapiens
agcatggctatttta

SEQ ID NO: 1396618 - DNA, 17 bp, Homo sapiens
agcatgtctattcagct

SEQ ID NO: 1396619 - DNA, 19 bp, Homo sapiens
agcattcagaagaaaaaga

SEQ ID NO: 1396620 - DNA, 21 bp, Homo sapiens
agcattcagaagaaaaagaag

SEQ ID NO: 1396621 - DNA, 12 bp, Homo sapiens
agcattctgtct

SEQ ID NO: 1396622 - DNA, 15 bp, Homo sapiens
agcattgaatggcta

SEQ ID NO: 1396623 - DNA, 14 bp, Homo sapiens
agcatttgtttcta

SEQ ID NO: 1396624 - DNA, 19 bp, Homo sapiens
agcatttgtttctactttg

SEQ ID NO: 1396625 - DNA, 21 bp, Homo sapiens
agccaaacatatatatactat

SEQ ID NO: 1396626 - DNA, 21 bp, Homo sapiens
agccaaggagtcactgagacc

SEQ ID NO: 1396627 - DNA, 13 bp, Homo sapiens
agccacaccagga

SEQ ID NO: 1396628 - DNA, 14 bp, Homo sapiens
agccacaccaggat

SEQ ID NO: 1396629 - DNA, 17 bp, Homo sapiens
agccacaccaggataga

SEQ ID NO: 1396630 - DNA, 12 bp, Homo sapiens
agccaccaccca

SEQ ID NO: 1396631 - DNA, 23 bp, Homo sapiens
agccagattttttaaaatttata

SEQ ID NO: 1396632 - DNA, 18 bp, Homo sapiens
agccatgctggaaaataa

SEQ ID NO: 1396633 - DNA, 20 bp, Homo sapiens
agccatggagattctcataa

SEQ ID NO: 1396634 - DNA, 21 bp, Homo sapiens
agcccaccatttggcatccct

SEQ ID NO: 1396635 - DNA, 22 bp, Homo sapiens
agcccaccatttggcatccctg

SEQ ID NO: 1396636 - DNA, 14 bp, Homo sapiens
agcccactgtactt

SEQ ID NO: 1396637 - DNA, 14 bp, Homo sapiens
agcccctgaaagcc

SEQ ID NO: 1396638 - DNA, 22 bp, Homo sapiens
agcccggtaagagcaaaagaat

SEQ ID NO: 1396639 - DNA, 15 bp, Homo sapiens
agccctaaacatcat

SEQ ID NO: 1396640 - DNA, 21 bp, Homo sapiens
agccctaaacatcattcttga

SEQ ID NO: 1396641 - DNA, 15 bp, Homo sapiens
agccctggtttgaaa

SEQ ID NO: 1396642 - DNA, 13 bp, Homo sapiens
agccgtgagcatg

SEQ ID NO: 1396643 - DNA, 19 bp, Homo sapiens
agcctaaataaaaagtata

SEQ ID NO: 1396644 - DNA, 21 bp, Homo sapiens
agcctccctcctcgtcccctg

SEQ ID NO: 1396645 - DNA, 24 bp, Homo sapiens
agcctccctcctcgtcccctgcct

SEQ ID NO: 1396646 - DNA, 22 bp, Homo sapiens
agcctctgcagcggaatctgtt

SEQ ID NO: 1396647 - DNA, 20 bp, Homo sapiens
agcctgaattttgttgctgt

SEQ ID NO: 1396648 - DNA, 21 bp, Homo sapiens
agcctgaattttgttgctgtt

SEQ ID NO: 1396649 - DNA, 18 bp, Homo sapiens
agcctgaccctcatcttt

SEQ ID NO: 1396650 - DNA, 22 bp, Homo sapiens
agcctgcaggatctcaccaggc

SEQ ID NO: 1396651 - DNA, 19 bp, Homo sapiens
agcctggctatgtcctaat

SEQ ID NO: 1396652 - DNA, 12 bp, Homo sapiens
agcctgtgcctc

SEQ ID NO: 1396653 - DNA, 17 bp, Homo sapiens
agctaagctaggaatga

SEQ ID NO: 1396654 - DNA, 18 bp, Homo sapiens
agctaagctaggaatgaa

SEQ ID NO: 1396655 - DNA, 14 bp, Homo sapiens
agctagaattgagt

SEQ ID NO: 1396656 - DNA, 20 bp, Homo sapiens
agctagaattgagtgtttaa

SEQ ID NO: 1396657 - DNA, 13 bp, Homo sapiens
agctaggaatgaa

SEQ ID NO: 1396658 - DNA, 14 bp, Homo sapiens
agctatttcatcta

SEQ ID NO: 1396659 - DNA, 17 bp, Homo sapiens
agctatttcatctattt

SEQ ID NO: 1396660 - DNA, 13 bp, Homo sapiens
agctcacttctgg

SEQ ID NO: 1396661 - DNA, 20 bp, Homo sapiens
agctcaggaaccgaggcagg

SEQ ID NO: 1396662 - DNA, 18 bp, Homo sapiens
agctcccttcccctgcct

SEQ ID NO: 1396663 - DNA, 19 bp, Homo sapiens
agctcccttcccctgcctg

SEQ ID NO: 1396664 - DNA, 20 bp, Homo sapiens
agctcccttcccctgcctgg

SEQ ID NO: 1396665 - DNA, 16 bp, Homo sapiens
agctccttaaggctct

SEQ ID NO: 1396666 - DNA, 22 bp, Homo sapiens
agctccttaaggctcttttgta

SEQ ID NO: 1396667 - DNA, 18 bp, Homo sapiens
agctctccggtctctctc

SEQ ID NO: 1396668 - DNA, 19 bp, Homo sapiens
agctgaccagccgtgagca

SEQ ID NO: 1396669 - DNA, 22 bp, Homo sapiens
agctgaccagccgtgagcatgt

SEQ ID NO: 1396670 - DNA, 22 bp, Homo sapiens
agctgattgtttatttttctat

SEQ ID NO: 1396671 - DNA, 14 bp, Homo sapiens
agctgctccccacg

SEQ ID NO: 1396672 - DNA, 15 bp, Homo sapiens
agctggagaagaccc

SEQ ID NO: 1396673 - DNA, 21 bp, Homo sapiens
agctgggacaccccgactttt

SEQ ID NO: 1396674 - DNA, 20 bp, Homo sapiens
agctggggccaggctgggtc

SEQ ID NO: 1396675 - DNA, 17 bp, Homo sapiens
agctgtgacctctcccc

SEQ ID NO: 1396676 - DNA, 22 bp, Homo sapiens
agctgtgtgtttggaagactat

SEQ ID NO: 1396677 - DNA, 12 bp, Homo sapiens
agcttaaaactt

SEQ ID NO: 1396678 - DNA, 14 bp, Homo sapiens
agcttaaaactttg

SEQ ID NO: 1396679 - DNA, 12 bp, Homo sapiens
agcttctctgcc

SEQ ID NO: 1396680 - DNA, 20 bp, Homo sapiens
agcttgggaaaggtggtgtt

SEQ ID NO: 1396681 - DNA, 12 bp, Homo sapiens
agcttgggaatg

SEQ ID NO: 1396682 - DNA, 18 bp, Homo sapiens
agctttgctctttggtag

SEQ ID NO: 1396683 - DNA, 23 bp, Homo sapiens
aggaaatgtggtagcctcacttt

SEQ ID NO: 1396684 - DNA, 16 bp, Homo sapiens
aggaaccgaggcaggg

SEQ ID NO: 1396685 - DNA, 17 bp, Homo sapiens
aggaagcaagcttaatg

SEQ ID NO: 1396686 - DNA, 23 bp, Homo sapiens
aggaagctttggtgagaacctgg

SEQ ID NO: 1396687 - DNA, 19 bp, Homo sapiens
aggaaggcttgttgtgctt

SEQ ID NO: 1396688 - DNA, 21 bp, Homo sapiens
aggaaggcttgttgtgctttt

SEQ ID NO: 1396689 - DNA, 22 bp, Homo sapiens
aggaatctttaaaagatgcttt

SEQ ID NO: 1396690 - DNA, 16 bp, Homo sapiens
aggaattttctttgtg

SEQ ID NO: 1396691 - DNA, 12 bp, Homo sapiens
aggacccagggc

SEQ ID NO: 1396692 - DNA, 18 bp, Homo sapiens
aggactctgccccttctg

SEQ ID NO: 1396693 - DNA, 16 bp, Homo sapiens
aggacttgtgtctctg

SEQ ID NO: 1396694 - DNA, 20 bp, Homo sapiens
aggagacaggttagctgctc

SEQ ID NO: 1396695 - DNA, 18 bp, Homo sapiens
aggagacagttcaagaaa

SEQ ID NO: 1396696 - DNA, 20 bp, Homo sapiens
aggagactgtttggaaattg

SEQ ID NO: 1396697 - DNA, 19 bp, Homo sapiens
aggagccctgggaggctct

SEQ ID NO: 1396698 - DNA, 23 bp, Homo sapiens
aggagccctgggaggctctggag

SEQ ID NO: 1396699 - DNA, 11 bp, Homo sapiens
aggagcctggc

SEQ ID NO: 1396700 - DNA, 22 bp, Homo sapiens
aggagctgactcacacctgaac

SEQ ID NO: 1396701 - DNA, 15 bp, Homo sapiens
aggaggccaataaaa

SEQ ID NO: 1396702 - DNA, 20 bp, Homo sapiens
aggaggccaataaaaagttc

SEQ ID NO: 1396703 - DNA, 16 bp, Homo sapiens
aggaggggctgtaaaa

SEQ ID NO: 1396704 - DNA, 14 bp, Homo sapiens
aggaggggtacatt

SEQ ID NO: 1396705 - DNA, 14 bp, Homo sapiens
aggaggtgccactg

SEQ ID NO: 1396706 - DNA, 15 bp, Homo sapiens
aggagttttgcaaag

SEQ ID NO: 1396707 - DNA, 13 bp, Homo sapiens
aggatgtgtttgc

SEQ ID NO: 1396708 - DNA, 17 bp, Homo sapiens
aggatgtgtttgctttc

SEQ ID NO: 1396709 - DNA, 19 bp, Homo sapiens
aggatgtgtttgctttctg

SEQ ID NO: 1396710 - DNA, 12 bp, Homo sapiens
aggatgttctgg

SEQ ID NO: 1396711 - DNA, 21 bp, Homo sapiens
aggattaagatacactcctgc

SEQ ID NO: 1396712 - DNA, 12 bp, Homo sapiens
aggattggggaa

SEQ ID NO: 1396713 - DNA, 17 bp, Homo sapiens
aggcaaaatccttgctt

SEQ ID NO: 1396714 - DNA, 17 bp, Homo sapiens
aggcagaggatgttctg

SEQ ID NO: 1396715 - DNA, 21 bp, Homo sapiens
aggcagcctctggggggtggc

SEQ ID NO: 1396716 - DNA, 20 bp, Homo sapiens
aggcaggattggggaagaga

SEQ ID NO: 1396717 - DNA, 16 bp, Homo sapiens
aggcaggctcccaggg

SEQ ID NO: 1396718 - DNA, 14 bp, Homo sapiens
actcacctcctccc

SEQ ID NO: 1396719 - DNA, 16 bp, Homo sapiens
actcagatcctcctca

SEQ ID NO: 1396720 - DNA, 17 bp, Homo sapiens
actcagatcctcctcat

SEQ ID NO: 1396721 - DNA, 11 bp, Homo sapiens
actcagctctg

SEQ ID NO: 1396722 - DNA, 23 bp, Homo sapiens
actcaggcccccacctggctcac

SEQ ID NO: 1396723 - DNA, 14 bp, Homo sapiens
actcagtaatttgt

SEQ ID NO: 1396724 - DNA, 16 bp, Homo sapiens
actcatgtgactcttt

SEQ ID NO: 1396725 - DNA, 17 bp, Homo sapiens
actcatgtgactctttc

SEQ ID NO: 1396726 - DNA, 19 bp, Homo sapiens
actcatgtgactctttcca

SEQ ID NO: 1396727 - DNA, 15 bp, Homo sapiens
actcattagactgga

SEQ ID NO: 1396728 - DNA, 19 bp, Homo sapiens
actcatttttcatgataat

SEQ ID NO: 1396729 - DNA, 20 bp, Homo sapiens
actcatttttcatgataatg

SEQ ID NO: 1396730 - DNA, 17 bp, Homo sapiens
actccactgtggaaaat

SEQ ID NO: 1396731 - DNA, 15 bp, Homo sapiens
actcctgcctgtgtt

SEQ ID NO: 1396732 - DNA, 17 bp, Homo sapiens
actcctgcctgtgtttg

SEQ ID NO: 1396733 - DNA, 22 bp, Homo sapiens
actccttcaacaattctaaaat

SEQ ID NO: 1396734 - DNA, 22 bp, Homo sapiens
actcggcctcccaaagtgctgg

SEQ ID NO: 1396735 - DNA, 13 bp, Homo sapiens
actctaagaaaga

SEQ ID NO: 1396736 - DNA, 15 bp, Homo sapiens
actctaagaaagaac

SEQ ID NO: 1396737 - DNA, 20 bp, Homo sapiens
actctcttattgcctcactt

SEQ ID NO: 1396738 - DNA, 15 bp, Homo sapiens
actctgcttgatttt

SEQ ID NO: 1396739 - DNA, 16 bp, Homo sapiens
actcttataaatttct

SEQ ID NO: 1396740 - DNA, 15 bp, Homo sapiens
actcttcactcttca

SEQ ID NO: 1396741 - DNA, 16 bp, Homo sapiens
actcttcttgaaattt

SEQ ID NO: 1396742 - DNA, 18 bp, Homo sapiens
actctttatgcttgcaaa

SEQ ID NO: 1396743 - DNA, 17 bp, Homo sapiens
actgaaaattatttaaa

SEQ ID NO: 1396744 - DNA, 19 bp, Homo sapiens
actgaacaccattgaaggc

SEQ ID NO: 1396745 - DNA, 22 bp, Homo sapiens
actgaacaccattgaaggctta

SEQ ID NO: 1396746 - DNA, 17 bp, Homo sapiens
actgaggaatttcacct

SEQ ID NO: 1396747 - DNA, 19 bp, Homo sapiens
actgaggaatttcacctgt

SEQ ID NO: 1396748 - DNA, 16 bp, Homo sapiens
actgaggaattttctt

SEQ ID NO: 1396749 - DNA, 19 bp, Homo sapiens
actgattcacatctcattt

SEQ ID NO: 1396750 - DNA, 13 bp, Homo sapiens
actgcaacctcca

SEQ ID NO: 1396751 - DNA, 16 bp, Homo sapiens
actgcatactttttaa

SEQ ID NO: 1396752 - DNA, 12 bp, Homo sapiens
actgcatgcact

SEQ ID NO: 1396753 - DNA, 12 bp, Homo sapiens
actgccagcatt

SEQ ID NO: 1396754 - DNA, 16 bp, Homo sapiens
actgctgtggccagga

SEQ ID NO: 1396755 - DNA, 19 bp, Homo sapiens
actgctgtggccaggaggt

SEQ ID NO: 1396756 - DNA, 21 bp, Homo sapiens
actggaatcagctcaggactg

SEQ ID NO: 1396757 - DNA, 18 bp, Homo sapiens
actgggcaatgatggcaa

SEQ ID NO: 1396758 - DNA, 16 bp, Homo sapiens
actggggcaggggccg

SEQ ID NO: 1396759 - DNA, 20 bp, Homo sapiens
actggtagttcattgtaaat

SEQ ID NO: 1396760 - DNA, 21 bp, Homo sapiens
actggtccaaaagattgctga

SEQ ID NO: 1396761 - DNA, 13 bp, Homo sapiens
actgtaaacacag

SEQ ID NO: 1396762 - DNA, 21 bp, Homo sapiens
actgtataccccgtgaagcat

SEQ ID NO: 1396763 - DNA, 15 bp, Homo sapiens
actgtcaagtcatga

SEQ ID NO: 1396764 - DNA, 12 bp, Homo sapiens
actgtgtacata

SEQ ID NO: 1396765 - DNA, 18 bp, Homo sapiens
actgtgtacataactgaa

SEQ ID NO: 1396766 - DNA, 19 bp, Homo sapiens
actgtgtgctcaggagccc

SEQ ID NO: 1396767 - DNA, 23 bp, Homo sapiens
actgtttggaaattgattttgaa

SEQ ID NO: 1396768 - DNA, 12 bp, Homo sapiens
acttacatgatt

SEQ ID NO: 1396769 - DNA, 14 bp, Homo sapiens
acttacatgattca

SEQ ID NO: 1396770 - DNA, 21 bp, Homo sapiens
acttactttttctggtctcta

SEQ ID NO: 1396771 - DNA, 18 bp, Homo sapiens
acttatatggaaattctg

SEQ ID NO: 1396772 - DNA, 12 bp, Homo sapiens
acttattaacaa

SEQ ID NO: 1396773 - DNA, 21 bp, Homo sapiens
acttattaacaattaggcaga

SEQ ID NO: 1396774 - DNA, 14 bp, Homo sapiens
acttatttttgaca

SEQ ID NO: 1396775 - DNA, 16 bp, Homo sapiens
acttatttttgacagt

SEQ ID NO: 1396776 - DNA, 19 bp, Homo sapiens
acttatttttgacagtgtt

SEQ ID NO: 1396777 - DNA, 23 bp, Homo sapiens
caaagcaagcattcagaagaaaa

SEQ ID NO: 1396778 - DNA, 16 bp, Homo sapiens
caaagcatgaaatgga

SEQ ID NO: 1396779 - DNA, 16 bp, Homo sapiens
caaagctttttccaga

SEQ ID NO: 1396780 - DNA, 22 bp, Homo sapiens
caaaggggaggcatcagtgtcc

SEQ ID NO: 1396781 - DNA, 16 bp, Homo sapiens
caaagtgcaaggacct

SEQ ID NO: 1396782 - DNA, 17 bp, Homo sapiens
caaataactaaggaata

SEQ ID NO: 1396783 - DNA, 12 bp, Homo sapiens
caaatatttatt

SEQ ID NO: 1396784 - DNA, 14 bp, Homo sapiens
caaatatttatttt

SEQ ID NO: 1396785 - DNA, 20 bp, Homo sapiens
caaatatttattttctttct

SEQ ID NO: 1396786 - DNA, 14 bp, Homo sapiens
caaatcaccacaaa

SEQ ID NO: 1396787 - DNA, 14 bp, Homo sapiens
caaatcgaatgaaa

SEQ ID NO: 1396788 - DNA, 12 bp, Homo sapiens
caaatgtgtaat

SEQ ID NO: 1396789 - DNA, 14 bp, Homo sapiens
caaattcttctgaa

SEQ ID NO: 1396790 - DNA, 15 bp, Homo sapiens
caaattcttctgaac

SEQ ID NO: 1396791 - DNA, 14 bp, Homo sapiens
caacaatttatgaa

SEQ ID NO: 1396792 - DNA, 18 bp, Homo sapiens
caacaatttatgaattga

SEQ ID NO: 1396793 - DNA, 14 bp, Homo sapiens
caacactgccagca

SEQ ID NO: 1396794 - DNA, 13 bp, Homo sapiens
caacagttttcct

SEQ ID NO: 1396795 - DNA, 22 bp, Homo sapiens
caacagttttcctatgctttga

SEQ ID NO: 1396796 - DNA, 21 bp, Homo sapiens
caacatagtattcatgactat

SEQ ID NO: 1396797 - DNA, 15 bp, Homo sapiens
caacatctttttcct

SEQ ID NO: 1396798 - DNA, 18 bp, Homo sapiens
caaccagagcactgtata

SEQ ID NO: 1396799 - DNA, 20 bp, Homo sapiens
caaccagagcactgtatacc

SEQ ID NO: 1396800 - DNA, 22 bp, Homo sapiens
caaccattataaccttaattta

SEQ ID NO: 1396801 - DNA, 14 bp, Homo sapiens
caaccattccagac

SEQ ID NO: 1396802 - DNA, 22 bp, Homo sapiens
caacccctcccctccatccctg

SEQ ID NO: 1396803 - DNA, 14 bp, Homo sapiens
caacctccacctcc

SEQ ID NO: 1396804 - DNA, 17 bp, Homo sapiens
caactattttcagatgt

SEQ ID NO: 1396805 - DNA, 21 bp, Homo sapiens
caactattttcagatgtgaac

SEQ ID NO: 1396806 - DNA, 19 bp, Homo sapiens
caactcgctttaggtcagc

SEQ ID NO: 1396807 - DNA, 16 bp, Homo sapiens
caactcgtatagcatg

SEQ ID NO: 1396808 - DNA, 18 bp, Homo sapiens
caactgcctactccaaaa

SEQ ID NO: 1396809 - DNA, 14 bp, Homo sapiens
caacttgcttatca

SEQ ID NO: 1396810 - DNA, 16 bp, Homo sapiens
caacttggctgcagga

SEQ ID NO: 1396811 - DNA, 17 bp, Homo sapiens
caagaagcattttgtaa

SEQ ID NO: 1396812 - DNA, 13 bp, Homo sapiens
caagaagggactg

SEQ ID NO: 1396813 - DNA, 18 bp, Homo sapiens
caagaagggactgagaga

SEQ ID NO: 1396814 - DNA, 14 bp, Homo sapiens
aggccagagccaag

SEQ ID NO: 1396815 - DNA, 14 bp, Homo sapiens
aggccattctttcc

SEQ ID NO: 1396816 - DNA, 15 bp, Homo sapiens
aggccattctttccc

SEQ ID NO: 1396817 - DNA, 16 bp, Homo sapiens
aggcccttattttcaa

SEQ ID NO: 1396818 - DNA, 20 bp, Homo sapiens
aggcccttattttcaagaaa

SEQ ID NO: 1396819 - DNA, 17 bp, Homo sapiens
aggccgctatgcagggt

SEQ ID NO: 1396820 - DNA, 14 bp, Homo sapiens
aggcctcctggctg

SEQ ID NO: 1396821 - DNA, 23 bp, Homo sapiens
aggccttgcggctcctcagggac

SEQ ID NO: 1396822 - DNA, 18 bp, Homo sapiens
aggcgtgagccacctcgc

SEQ ID NO: 1396823 - DNA, 23 bp, Homo sapiens
aggctaatttttttgtattttag

SEQ ID NO: 1396824 - DNA, 19 bp, Homo sapiens
aggctagggtggggagaga

SEQ ID NO: 1396825 - DNA, 21 bp, Homo sapiens
aggctaggtgggttgaaagcc

SEQ ID NO: 1396826 - DNA, 18 bp, Homo sapiens
aggctcagagggtgtcct

SEQ ID NO: 1396827 - DNA, 12 bp, Homo sapiens
aggctcagccct

SEQ ID NO: 1396828 - DNA, 14 bp, Homo sapiens
aggctcagccctag

SEQ ID NO: 1396829 - DNA, 18 bp, Homo sapiens
aggctctggagcccactg

SEQ ID NO: 1396830 - DNA, 10 bp, Homo sapiens
aggctgggtc

SEQ ID NO: 1396831 - DNA, 18 bp, Homo sapiens
aggctgggtcgccctgga

SEQ ID NO: 1396832 - DNA, 14 bp, Homo sapiens
aggcttccttcatt

SEQ ID NO: 1396833 - DNA, 16 bp, Homo sapiens
aggcttccttcatttc

SEQ ID NO: 1396834 - DNA, 21 bp, Homo sapiens
aggcttccttcatttcctccg

SEQ ID NO: 1396835 - DNA, 15 bp, Homo sapiens
aggcttgttgtgctt

SEQ ID NO: 1396836 - DNA, 16 bp, Homo sapiens
aggcttgttgtgcttt

SEQ ID NO: 1396837 - DNA, 13 bp, Homo sapiens
aggctttctctac

SEQ ID NO: 1396838 - DNA, 23 bp, Homo sapiens
agggaacccagctctaatacatt

SEQ ID NO: 1396839 - DNA, 23 bp, Homo sapiens
agggaaggatcccatgagctcct

SEQ ID NO: 1396840 - DNA, 19 bp, Homo sapiens
agggaattgattcaagatt

SEQ ID NO: 1396841 - DNA, 20 bp, Homo sapiens
agggactgagagatgcagaa

SEQ ID NO: 1396842 - DNA, 16 bp, Homo sapiens
agggcataaattattg

SEQ ID NO: 1396843 - DNA, 23 bp, Homo sapiens
agggccaaagaaccaaagaagaa

SEQ ID NO: 1396844 - DNA, 13 bp, Homo sapiens
agggcgcaggccg

SEQ ID NO: 1396845 - DNA, 17 bp, Homo sapiens
agggctgagctctctgt

SEQ ID NO: 1396846 - DNA, 17 bp, Homo sapiens
aggggaccaggagtggg

SEQ ID NO: 1396847 - DNA, 17 bp, Homo sapiens
aggggaggcatcagtgt

SEQ ID NO: 1396848 - DNA, 14 bp, Homo sapiens
aggggcctgcccag

SEQ ID NO: 1396849 - DNA, 12 bp, Homo sapiens
aggggcttcagg

SEQ ID NO: 1396850 - DNA, 15 bp, Homo sapiens
aggggcttcaggtcc

SEQ ID NO: 1396851 - DNA, 16 bp, Homo sapiens
agggggagagggctgc

SEQ ID NO: 1396852 - DNA, 15 bp, Homo sapiens
agggtaggcaggatt

SEQ ID NO: 1396853 - DNA, 13 bp, Homo sapiens
agggtcaggcctt

SEQ ID NO: 1396854 - DNA, 21 bp, Homo sapiens
agggtggggggggggcgcggc

SEQ ID NO: 1396855 - DNA, 21 bp, Homo sapiens
agggtttgtgacagggcgggg

SEQ ID NO: 1396856 - DNA, 13 bp, Homo sapiens
aggtaaaatgcca

SEQ ID NO: 1396857 - DNA, 14 bp, Homo sapiens
aggtaaaatgccat

SEQ ID NO: 1396858 - DNA, 16 bp, Homo sapiens
aggtaaaatgccatga

SEQ ID NO: 1396859 - DNA, 12 bp, Homo sapiens
aggtactattat

SEQ ID NO: 1396860 - DNA, 14 bp, Homo sapiens
aggtagaatgtaaa

SEQ ID NO: 1396861 - DNA, 14 bp, Homo sapiens
aggtattacactct

SEQ ID NO: 1396862 - DNA, 10 bp, Homo sapiens
aggtccctaa

SEQ ID NO: 1396863 - DNA, 20 bp, Homo sapiens
aggtccctaataaagctgtg

SEQ ID NO: 1396864 - DNA, 21 bp, Homo sapiens
aggtcctcagtgtcctcaggg

SEQ ID NO: 1396865 - DNA, 23 bp, Homo sapiens
aggtgcttctagttctgccagga

SEQ ID NO: 1396866 - DNA, 15 bp, Homo sapiens
aggtgtcatacagat

SEQ ID NO: 1396867 - DNA, 23 bp, Homo sapiens
aggtgtggctttaggagcagtgg

SEQ ID NO: 1396868 - DNA, 14 bp, Homo sapiens
aggttaaaatataa

SEQ ID NO: 1396869 - DNA, 14 bp, Homo sapiens
aggttcaacttatt

SEQ ID NO: 1396870 - DNA, 14 bp, Homo sapiens
aggttgttctgtat

SEQ ID NO: 1396871 - DNA, 14 bp, Homo sapiens
aggtttatgaaaaa

SEQ ID NO: 1396872 - DNA, 16 bp, Homo sapiens
aggtttatgaaaaaga

SEQ ID NO: 1396873 - DNA, 14 bp, Homo sapiens
tccagactttctat

SEQ ID NO: 1396874 - DNA, 17 bp, Homo sapiens
tccagactttctattaa

SEQ ID NO: 1396875 - DNA, 21 bp, Homo sapiens
tccagactttctattaatatt

SEQ ID NO: 1396876 - DNA, 20 bp, Homo sapiens
tccagaggctattattttca

SEQ ID NO: 1396877 - DNA, 21 bp, Homo sapiens
tccagagtccctgcctggacc

SEQ ID NO: 1396878 - DNA, 14 bp, Homo sapiens
tccagataagttat

SEQ ID NO: 1396879 - DNA, 21 bp, Homo sapiens
tccagataagttatttataat

SEQ ID NO: 1396880 - DNA, 21 bp, Homo sapiens
tccaggcaggtctgaagctca

SEQ ID NO: 1396881 - DNA, 16 bp, Homo sapiens
tccagttcatgagaat

SEQ ID NO: 1396882 - DNA, 17 bp, Homo sapiens
tccataggaatcatgtt

SEQ ID NO: 1396883 - DNA, 20 bp, Homo sapiens
tccataggaatcatgttgga

SEQ ID NO: 1396884 - DNA, 22 bp, Homo sapiens
tccatccctggccccctccctg

SEQ ID NO: 1396885 - DNA, 24 bp, Homo sapiens
tccatccctggccccctccctgga

SEQ ID NO: 1396886 - DNA, 21 bp, Homo sapiens
tccatgcaccctcatacacag

SEQ ID NO: 1396887 - DNA, 18 bp, Homo sapiens
tccatgcgtgtttctgac

SEQ ID NO: 1396888 - DNA, 14 bp, Homo sapiens
tccattctcctgag

SEQ ID NO: 1396889 - DNA, 20 bp, Homo sapiens
tcccaaaatgttgaaatatg

SEQ ID NO: 1396890 - DNA, 19 bp, Homo sapiens
tcccacccaattcaaaaca

SEQ ID NO: 1396891 - DNA, 17 bp, Homo sapiens
tcccagaaccacactgt

SEQ ID NO: 1396892 - DNA, 15 bp, Homo sapiens
tcccaggagacagtt

SEQ ID NO: 1396893 - DNA, 22 bp, Homo sapiens
tcccaggagacagttcaagaaa

SEQ ID NO: 1396894 - DNA, 23 bp, Homo sapiens
tcccatgagctccttaaggctct

SEQ ID NO: 1396895 - DNA, 23 bp, Homo sapiens
tcccatgcacacaaacacctcct

SEQ ID NO: 1396896 - DNA, 13 bp, Homo sapiens
tccccatctcagg

SEQ ID NO: 1396897 - DNA, 14 bp, Homo sapiens
tccccattcttcct

SEQ ID NO: 1396898 - DNA, 22 bp, Homo sapiens
tccccattcttcctagttttct

SEQ ID NO: 1396899 - DNA, 18 bp, Homo sapiens
tcccctggaactgtctct

SEQ ID NO: 1396900 - DNA, 20 bp, Homo sapiens
tcccctggaactgtctctca

SEQ ID NO: 1396901 - DNA, 13 bp, Homo sapiens
tccctaataaagc

SEQ ID NO: 1396902 - DNA, 16 bp, Homo sapiens
tccctaataaagctgt

SEQ ID NO: 1396903 - DNA, 15 bp, Homo sapiens
tccctactgaagccc

SEQ ID NO: 1396904 - DNA, 18 bp, Homo sapiens
tccctagctgtgacctct

SEQ ID NO: 1396905 - DNA, 14 bp, Homo sapiens
tccctatactgctt

SEQ ID NO: 1396906 - DNA, 23 bp, Homo sapiens
tccctgcctctcatcaactgaat

SEQ ID NO: 1396907 - DNA, 19 bp, Homo sapiens
tccctgggccttgggctcc

SEQ ID NO: 1396908 - DNA, 14 bp, Homo sapiens
tcccttaatatcct

SEQ ID NO: 1396909 - DNA, 15 bp, Homo sapiens
tcccttcccctgcct

SEQ ID NO: 1396910 - DNA, 19 bp, Homo sapiens
tcccttccttcctctcctg

SEQ ID NO: 1396911 - DNA, 17 bp, Homo sapiens
tccgactcttctgagca

SEQ ID NO: 1396912 - DNA, 16 bp, Homo sapiens
tccgtgtgggagaccg

SEQ ID NO: 1396913 - DNA, 13 bp, Homo sapiens
tcctaccccctgt

SEQ ID NO: 1396914 - DNA, 20 bp, Homo sapiens
tcctaggctccaccccatcc

SEQ ID NO: 1396915 - DNA, 22 bp, Homo sapiens
tcctaggctccaccccatccag

SEQ ID NO: 1396916 - DNA, 13 bp, Homo sapiens
tcctatgctttga

SEQ ID NO: 1396917 - DNA, 16 bp, Homo sapiens
tcctcacccccagctt

SEQ ID NO: 1396918 - DNA, 21 bp, Homo sapiens
tcctcagactctaagaaagaa

SEQ ID NO: 1396919 - DNA, 17 bp, Homo sapiens
tcctcagagaatttcta

SEQ ID NO: 1396920 - DNA, 17 bp, Homo sapiens
tcctccaaactcctgcc

SEQ ID NO: 1396921 - DNA, 19 bp, Homo sapiens
tcctccaaactcctgcctg

SEQ ID NO: 1396922 - DNA, 20 bp, Homo sapiens
tcctccaaactcctgcctgt

SEQ ID NO: 1396923 - DNA, 23 bp, Homo sapiens
tcctcgagatcccaacactgcca

SEQ ID NO: 1396924 - DNA, 16 bp, Homo sapiens
tcctctaggaaatgta

SEQ ID NO: 1396925 - DNA, 16 bp, Homo sapiens
tcctctctctgtgtta

SEQ ID NO: 1396926 - DNA, 15 bp, Homo sapiens
tcctctgattatcag

SEQ ID NO: 1396927 - DNA, 21 bp, Homo sapiens
tcctgaaaaggtttatgaaaa

SEQ ID NO: 1396928 - DNA, 13 bp, Homo sapiens
tcctgagtagctg

SEQ ID NO: 1396929 - DNA, 21 bp, Homo sapiens
tcctgcaccggggcctgggca

SEQ ID NO: 1396930 - DNA, 15 bp, Homo sapiens
tcctgctcatattgt

SEQ ID NO: 1396931 - DNA, 23 bp, Homo sapiens
tcctgcttgatgggattctggac

SEQ ID NO: 1396932 - DNA, 18 bp, Homo sapiens
tcctggaagccagctttc

SEQ ID NO: 1396933 - DNA, 20 bp, Homo sapiens
tcctggaagccagctttccc

SEQ ID NO: 1396934 - DNA, 16 bp, Homo sapiens
tcctgtattcagacag

SEQ ID NO: 1396935 - DNA, 17 bp, Homo sapiens
tcctgtattcagacaga

SEQ ID NO: 1396936 - DNA, 21 bp, Homo sapiens
tcctgtattcagacagatgag

SEQ ID NO: 1396937 - DNA, 21 bp, Homo sapiens
tcctgtcgattagactggaca

SEQ ID NO: 1396938 - DNA, 21 bp, Homo sapiens
gttaaaatataaattaagact

SEQ ID NO: 1396939 - DNA, 15 bp, Homo sapiens
gttaagacttgacag

SEQ ID NO: 1396940 - DNA, 21 bp, Homo sapiens
gttaatattgatttattaata

SEQ ID NO: 1396941 - DNA, 19 bp, Homo sapiens
gttaatttagaaaacttta

SEQ ID NO: 1396942 - DNA, 17 bp, Homo sapiens
gttacctctatatacca

SEQ ID NO: 1396943 - DNA, 19 bp, Homo sapiens
gttactgtgccatgtgttt

SEQ ID NO: 1396944 - DNA, 12 bp, Homo sapiens
gttagctggaca

SEQ ID NO: 1396945 - DNA, 13 bp, Homo sapiens
gttatataatcat

SEQ ID NO: 1396946 - DNA, 14 bp, Homo sapiens
gttcaacttattaa

SEQ ID NO: 1396947 - DNA, 18 bp, Homo sapiens
gttcaagcgattctcttg

SEQ ID NO: 1396948 - DNA, 14 bp, Homo sapiens
gttcatgagaatct

SEQ ID NO: 1396949 - DNA, 13 bp, Homo sapiens
gttcatttcctca

SEQ ID NO: 1396950 - DNA, 17 bp, Homo sapiens
gttctggacctccccct

SEQ ID NO: 1396951 - DNA, 16 bp, Homo sapiens
gttcttgaggggacca

SEQ ID NO: 1396952 - DNA, 20 bp, Homo sapiens
gttcttgaggggaccaggag

SEQ ID NO: 1396953 - DNA, 22 bp, Homo sapiens
gttcttgaggggaccaggagtg

SEQ ID NO: 1396954 - DNA, 14 bp, Homo sapiens
gttgcagacaggaa

SEQ ID NO: 1396955 - DNA, 22 bp, Homo sapiens
gttggaatgaattaaataaacc

SEQ ID NO: 1396956 - DNA, 14 bp, Homo sapiens
gttggacacactgt

SEQ ID NO: 1396957 - DNA, 17 bp, Homo sapiens
gttgtcctcagccccgc

SEQ ID NO: 1396958 - DNA, 17 bp, Homo sapiens
gttgtgaaactaaaatt

SEQ ID NO: 1396959 - DNA, 19 bp, Homo sapiens
gttgtgaaactaaaatttt

SEQ ID NO: 1396960 - DNA, 11 bp, Homo sapiens
gtttacagaat

SEQ ID NO: 1396961 - DNA, 18 bp, Homo sapiens
gtttatgaaaaagaagaa

SEQ ID NO: 1396962 - DNA, 19 bp, Homo sapiens
gtttcacaaggtctttaaa

SEQ ID NO: 1396963 - DNA, 16 bp, Homo sapiens
gtttcccaagagctac

SEQ ID NO: 1396964 - DNA, 20 bp, Homo sapiens
gtttctgagttcctgcatgc

SEQ ID NO: 1396965 - DNA, 13 bp, Homo sapiens
gtttgaaattttc

SEQ ID NO: 1396966 - DNA, 21 bp, Homo sapiens
gtttggatatgtaaaacattt

SEQ ID NO: 1396967 - DNA, 16 bp, Homo sapiens
gtttgtgacagggcgg

SEQ ID NO: 1396968 - DNA, 23 bp, Homo sapiens
gtttgtgcctttttatttttgtt

SEQ ID NO: 1396969 - DNA, 21 bp, Homo sapiens
gttttatgagaaagccttctt

SEQ ID NO: 1396970 - DNA, 16 bp, Homo sapiens
gttttcagcaactcag

SEQ ID NO: 1396971 - DNA, 17 bp, Homo sapiens
gttttcctatgctttga

SEQ ID NO: 1396972 - DNA, 19 bp, Homo sapiens
gttttgatttgtactgaaa

SEQ ID NO: 1396973 - DNA, 13 bp, Homo sapiens
gtttttaatgtat

SEQ ID NO: 1396974 - DNA, 14 bp, Homo sapiens
gtttttttctaata

SEQ ID NO: 1396975 - DNA, 20 bp, Homo sapiens
taaaaaaataagaagaatgc

SEQ ID NO: 1396976 - DNA, 22 bp, Homo sapiens
taaaaaaataagaagaatgctt

SEQ ID NO: 1396977 - DNA, 20 bp, Homo sapiens
taaaaaagcttaaaactttg

SEQ ID NO: 1396978 - DNA, 14 bp, Homo sapiens
taaaaaagtgttct

SEQ ID NO: 1396979 - DNA, 22 bp, Homo sapiens
taaaaaagttaaatgtgtgtaa

SEQ ID NO: 1396980 - DNA, 16 bp, Homo sapiens
taaaaactgagtgact

SEQ ID NO: 1396981 - DNA, 16 bp, Homo sapiens
taaaaatgaattggga

SEQ ID NO: 1396982 - DNA, 17 bp, Homo sapiens
taaaaatgaattgggaa

SEQ ID NO: 1396983 - DNA, 11 bp, Homo sapiens
taaaaatgcca

SEQ ID NO: 1396984 - DNA, 15 bp, Homo sapiens
taaaacagacactgg

SEQ ID NO: 1396985 - DNA, 19 bp, Homo sapiens
taaaacagacactggcatg

SEQ ID NO: 1396986 - DNA, 21 bp, Homo sapiens
taaaacaggtagaattatcta

SEQ ID NO: 1396987 - DNA, 22 bp, Homo sapiens
taaaacaggtagaattatctaa

SEQ ID NO: 1396988 - DNA, 17 bp, Homo sapiens
taaaacatcattactat

SEQ ID NO: 1396989 - DNA, 20 bp, Homo sapiens
taaaacatttattttgacat

SEQ ID NO: 1396990 - DNA, 13 bp, Homo sapiens
taaaacctcagct

SEQ ID NO: 1396991 - DNA, 15 bp, Homo sapiens
taaaagatgctttta

SEQ ID NO: 1396992 - DNA, 16 bp, Homo sapiens
taaaagcaaaaaagaa

SEQ ID NO: 1396993 - DNA, 22 bp, Homo sapiens
taaaaggtattaaattgatgtt

SEQ ID NO: 1396994 - DNA, 20 bp, Homo sapiens
taaaagtcagcattttctta

SEQ ID NO: 1396995 - DNA, 17 bp, Homo sapiens
taaaataaagaaataga

SEQ ID NO: 1396996 - DNA, 13 bp, Homo sapiens
taaaatagcaaaa

SEQ ID NO: 1396997 - DNA, 16 bp, Homo sapiens
taaaatataaattaag

SEQ ID NO: 1396998 - DNA, 19 bp, Homo sapiens
taaaatataaattaagact

SEQ ID NO: 1396999 - DNA, 15 bp, Homo sapiens
taaaatattgttact

SEQ ID NO: 1397000 - DNA, 16 bp, Homo sapiens
taaaatgattgtagta

SEQ ID NO: 1397001 - DNA, 12 bp, Homo sapiens
taaaatgttctc

SEQ ID NO: 1397002 - DNA, 14 bp, Homo sapiens
taaaatgttctcct

SEQ ID NO: 1397003 - DNA, 14 bp, Homo sapiens
taaaatttatattg

SEQ ID NO: 1397004 - DNA, 17 bp, Homo sapiens
taaaatttatattgtaa

SEQ ID NO: 1397005 - DNA, 14 bp, Homo sapiens
taaaattttctaag

SEQ ID NO: 1397006 - DNA, 20 bp, Homo sapiens
taaaattttctaagattaac

SEQ ID NO: 1397007 - DNA, 21 bp, Homo sapiens
taaaattttctaagattaact

SEQ ID NO: 1397008 - DNA, 13 bp, Homo sapiens
taaacaaatgtgt

SEQ ID NO: 1397009 - DNA, 16 bp, Homo sapiens
taaacacttgcaacct

SEQ ID NO: 1397010 - DNA, 17 bp, Homo sapiens
taaaccgctaaaagaaa

SEQ ID NO: 1397011 - DNA, 15 bp, Homo sapiens
taaacgtttgaaatt

SEQ ID NO: 1397012 - DNA, 21 bp, Homo sapiens
taaactatcttggtgaatttt

SEQ ID NO: 1397013 - DNA, 23 bp, Homo sapiens
taaactcaaaatatttgtacata

SEQ ID NO: 1397014 - DNA, 13 bp, Homo sapiens
taaagacttaaga

SEQ ID NO: 1397015 - DNA, 21 bp, Homo sapiens
taaagatatttttatctttat

SEQ ID NO: 1397016 - DNA, 17 bp, Homo sapiens
taaagattttttaataa

SEQ ID NO: 1397017 - DNA, 13 bp, Homo sapiens
tagaacaaggctg

SEQ ID NO: 1397018 - DNA, 17 bp, Homo sapiens
tagaacacacacactta

SEQ ID NO: 1397019 - DNA, 15 bp, Homo sapiens
tagaacacaggcaaa

SEQ ID NO: 1397020 - DNA, 22 bp, Homo sapiens
tagaattatctaatttataaaa

SEQ ID NO: 1397021 - DNA, 20 bp, Homo sapiens
tagaattgagtgtttaaagt

SEQ ID NO: 1397022 - DNA, 23 bp, Homo sapiens
tagaatttagccctggtttgaaa

SEQ ID NO: 1397023 - DNA, 15 bp, Homo sapiens
tagacaagccagaac

SEQ ID NO: 1397024 - DNA, 12 bp, Homo sapiens
tagacagaagaa

SEQ ID NO: 1397025 - DNA, 14 bp, Homo sapiens
tagacagaagaaac

SEQ ID NO: 1397026 - DNA, 15 bp, Homo sapiens
tagacagaagaaaca

SEQ ID NO: 1397027 - DNA, 13 bp, Homo sapiens
tagaccaaaataa

SEQ ID NO: 1397028 - DNA, 14 bp, Homo sapiens
tagagactggaaca

SEQ ID NO: 1397029 - DNA, 11 bp, Homo sapiens
tagagcactgc

SEQ ID NO: 1397030 - DNA, 16 bp, Homo sapiens
tagaggcttccttcat

SEQ ID NO: 1397031 - DNA, 16 bp, Homo sapiens
tagaggtgagaaattt

SEQ ID NO: 1397032 - DNA, 21 bp, Homo sapiens
tagatgcatttgggtccagga

SEQ ID NO: 1397033 - DNA, 16 bp, Homo sapiens
tagcaaaagaagaagt

SEQ ID NO: 1397034 - DNA, 14 bp, Homo sapiens
tagcaaagaattga

SEQ ID NO: 1397035 - DNA, 16 bp, Homo sapiens
tagcaagacctgttgg

SEQ ID NO: 1397036 - DNA, 19 bp, Homo sapiens
tagcacaagttatttaaat

SEQ ID NO: 1397037 - DNA, 16 bp, Homo sapiens
tagccaaaaatagcta

SEQ ID NO: 1397038 - DNA, 14 bp, Homo sapiens
tagccacaccagga

SEQ ID NO: 1397039 - DNA, 15 bp, Homo sapiens
tagccacaccaggat

SEQ ID NO: 1397040 - DNA, 18 bp, Homo sapiens
tagcccaatgaaatgaat

SEQ ID NO: 1397041 - DNA, 17 bp, Homo sapiens
tagccccagtgacagct

SEQ ID NO: 1397042 - DNA, 11 bp, Homo sapiens
tagcctggcta

SEQ ID NO: 1397043 - DNA, 13 bp, Homo sapiens
tagccttctctgt

SEQ ID NO: 1397044 - DNA, 15 bp, Homo sapiens
tagccttctctgttc

SEQ ID NO: 1397045 - DNA, 16 bp, Homo sapiens
tagctgtgacctctcc

SEQ ID NO: 1397046 - DNA, 22 bp, Homo sapiens
taggaaatggctttgtgattca

SEQ ID NO: 1397047 - DNA, 20 bp, Homo sapiens
taggatcatttgttggaatg

SEQ ID NO: 1397048 - DNA, 17 bp, Homo sapiens
taggatttatttaaaat

SEQ ID NO: 1397049 - DNA, 13 bp, Homo sapiens
taggctagggtgg

SEQ ID NO: 1397050 - DNA, 15 bp, Homo sapiens
taggctagggtgggg

SEQ ID NO: 1397051 - DNA, 19 bp, Homo sapiens
tagtcaatcaagtctgttt

SEQ ID NO: 1397052 - DNA, 21 bp, Homo sapiens
tagtgatttttatgccacctg

SEQ ID NO: 1397053 - DNA, 22 bp, Homo sapiens
tagtgatttttatgccacctga

SEQ ID NO: 1397054 - DNA, 20 bp, Homo sapiens
tagttcattgtaaatgaaca

SEQ ID NO: 1397055 - DNA, 14 bp, Homo sapiens
tagttctgccagga

SEQ ID NO: 1397056 - DNA, 12 bp, Homo sapiens
tagttgtgtctg

SEQ ID NO: 1397057 - DNA, 22 bp, Homo sapiens
tataagcaagaaggcaaaaata

SEQ ID NO: 1397058 - DNA, 23 bp, Homo sapiens
tataatcattattacttttgctg

SEQ ID NO: 1397059 - DNA, 22 bp, Homo sapiens
tataattgttttatctgaattt

SEQ ID NO: 1397060 - DNA, 17 bp, Homo sapiens
tataccaaagcacattt

SEQ ID NO: 1397061 - DNA, 20 bp, Homo sapiens
tataccccgtgaagcatcca

SEQ ID NO: 1397062 - DNA, 21 bp, Homo sapiens
tataccccgtgaagcatccag

SEQ ID NO: 1397063 - DNA, 12 bp, Homo sapiens
tatacctgattt

SEQ ID NO: 1397064 - DNA, 19 bp, Homo sapiens
tatactattaaaaaggttt

SEQ ID NO: 1397065 - DNA, 21 bp, Homo sapiens
tatactattaaaaaggtttac

SEQ ID NO: 1397066 - DNA, 17 bp, Homo sapiens
tatactgcatacttttt

SEQ ID NO: 1397067 - DNA, 22 bp, Homo sapiens
tatagttttacttttaaactgt

SEQ ID NO: 1397068 - DNA, 23 bp, Homo sapiens
tatagttttacttttaaactgtg

SEQ ID NO: 1397069 - DNA, 15 bp, Homo sapiens
tatatatatatgtac

SEQ ID NO: 1397070 - DNA, 14 bp, Homo sapiens
tatatatgtacagt

SEQ ID NO: 1397071 - DNA, 17 bp, Homo sapiens
tatatatgtacagttat

SEQ ID NO: 1397072 - DNA, 14 bp, Homo sapiens
tatatattatcttt

SEQ ID NO: 1397073 - DNA, 20 bp, Homo sapiens
tatatccaaaagctttttat

SEQ ID NO: 1397074 - DNA, 15 bp, Homo sapiens
tatatggaataagtg

SEQ ID NO: 1397075 - DNA, 17 bp, Homo sapiens
tatatggaataagtgta

SEQ ID NO: 1397076 - DNA, 15 bp, Homo sapiens
gctgataattttaaa

SEQ ID NO: 1397077 - DNA, 16 bp, Homo sapiens
gctgatcagtgggcct

SEQ ID NO: 1397078 - DNA, 15 bp, Homo sapiens
gctgcctttggactt

SEQ ID NO: 1397079 - DNA, 13 bp, Homo sapiens
gctgctccccacg

SEQ ID NO: 1397080 - DNA, 22 bp, Homo sapiens
gctgctccccacgtcagctggg

SEQ ID NO: 1397081 - DNA, 22 bp, Homo sapiens
gctggaaaataatactgctgag

SEQ ID NO: 1397082 - DNA, 20 bp, Homo sapiens
gctggagtgcagtggcgcga

SEQ ID NO: 1397083 - DNA, 17 bp, Homo sapiens
gctgggaggagggcagg

SEQ ID NO: 1397084 - DNA, 21 bp, Homo sapiens
gctgggaggagggcaggcatc

SEQ ID NO: 1397085 - DNA, 14 bp, Homo sapiens
gctgggcccctgcc

SEQ ID NO: 1397086 - DNA, 19 bp, Homo sapiens
gctgggtcgccctggactg

SEQ ID NO: 1397087 - DNA, 14 bp, Homo sapiens
gctggttagaaatg

SEQ ID NO: 1397088 - DNA, 23 bp, Homo sapiens
gctgtagtaggcatttttaccat

SEQ ID NO: 1397089 - DNA, 18 bp, Homo sapiens
gctgtcatcaattaaagg

SEQ ID NO: 1397090 - DNA, 14 bp, Homo sapiens
gctgtcctttctag

SEQ ID NO: 1397091 - DNA, 18 bp, Homo sapiens
gctgtctgaggctaggtg

SEQ ID NO: 1397092 - DNA, 13 bp, Homo sapiens
gctgtggccagga

SEQ ID NO: 1397093 - DNA, 18 bp, Homo sapiens
gctgtggggcatagaact

SEQ ID NO: 1397094 - DNA, 23 bp, Homo sapiens
gctgtgtttggctttcagggagg

SEQ ID NO: 1397095 - DNA, 17 bp, Homo sapiens
gcttaatcagatagata

SEQ ID NO: 1397096 - DNA, 21 bp, Homo sapiens
gcttactgatatattttacaa

SEQ ID NO: 1397097 - DNA, 16 bp, Homo sapiens
gcttatggtaccagat

SEQ ID NO: 1397098 - DNA, 13 bp, Homo sapiens
gcttccttcattt

SEQ ID NO: 1397099 - DNA, 14 bp, Homo sapiens
gcttcgtttatttt

SEQ ID NO: 1397100 - DNA, 18 bp, Homo sapiens
gcttctagttctgccagg

SEQ ID NO: 1397101 - DNA, 15 bp, Homo sapiens
gcttctggccaggaa

SEQ ID NO: 1397102 - DNA, 17 bp, Homo sapiens
gcttctggccaggaagc

SEQ ID NO: 1397103 - DNA, 18 bp, Homo sapiens
gcttctggccaggaagct

SEQ ID NO: 1397104 - DNA, 13 bp, Homo sapiens
gcttgaattgaag

SEQ ID NO: 1397105 - DNA, 14 bp, Homo sapiens
gcttggagctgagc

SEQ ID NO: 1397106 - DNA, 22 bp, Homo sapiens
gcttgggaaaggtggtgtttct

SEQ ID NO: 1397107 - DNA, 17 bp, Homo sapiens
gcttgggcagcatcccc

SEQ ID NO: 1397108 - DNA, 18 bp, Homo sapiens
gcttgtggcaagtgaatt

SEQ ID NO: 1397109 - DNA, 18 bp, Homo sapiens
gctttaacttaaatagta

SEQ ID NO: 1397110 - DNA, 18 bp, Homo sapiens
gctttactttagaattta

SEQ ID NO: 1397111 - DNA, 13 bp, Homo sapiens
gctttcagggagg

SEQ ID NO: 1397112 - DNA, 12 bp, Homo sapiens
gctttcctgaat

SEQ ID NO: 1397113 - DNA, 17 bp, Homo sapiens
gctttctgatcaaggcc

SEQ ID NO: 1397114 - DNA, 16 bp, Homo sapiens
gctttgctaccaaagc

SEQ ID NO: 1397115 - DNA, 13 bp, Homo sapiens
ggtgagaaattta

SEQ ID NO: 1397116 - DNA, 23 bp, Homo sapiens
ggtgccaatttcaagttccaagt

SEQ ID NO: 1397117 - DNA, 11 bp, Homo sapiens
ggtgctgggcc

SEQ ID NO: 1397118 - DNA, 13 bp, Homo sapiens
ggtgctgggcccc

SEQ ID NO: 1397119 - DNA, 20 bp, Homo sapiens
ggtgctgggcccctgcctct

SEQ ID NO: 1397120 - DNA, 22 bp, Homo sapiens
ggtgcttctagttctgccagga

SEQ ID NO: 1397121 - DNA, 15 bp, Homo sapiens
ggtggaacaagcaca

SEQ ID NO: 1397122 - DNA, 16 bp, Homo sapiens
ggtggccaggccggga

SEQ ID NO: 1397123 - DNA, 23 bp, Homo sapiens
ggtgggggtagggtttccctact

SEQ ID NO: 1397124 - DNA, 12 bp, Homo sapiens
ggtgtgtctgct

SEQ ID NO: 1397125 - DNA, 14 bp, Homo sapiens
ggtgttaatttttg

SEQ ID NO: 1397126 - DNA, 20 bp, Homo sapiens
ggttcttgaggggaccagga

SEQ ID NO: 1397127 - DNA, 22 bp, Homo sapiens
ggttcttgaggggaccaggagt

SEQ ID NO: 1397128 - DNA, 13 bp, Homo sapiens
ggtttaatgtttt

SEQ ID NO: 1397129 - DNA, 19 bp, Homo sapiens
ggtttcaccatgttggcca

SEQ ID NO: 1397130 - DNA, 13 bp, Homo sapiens
ggttttatcagtg

SEQ ID NO: 1397131 - DNA, 11 bp, Homo sapiens
gtaaaacattt

SEQ ID NO: 1397132 - DNA, 16 bp, Homo sapiens
gtaaactcaaaatatt

SEQ ID NO: 1397133 - DNA, 15 bp, Homo sapiens
gtaaagaattatttt

SEQ ID NO: 1397134 - DNA, 12 bp, Homo sapiens
gtaaagccatgc

SEQ ID NO: 1397135 - DNA, 20 bp, Homo sapiens
gtaaagctaaaataaagaaa

SEQ ID NO: 1397136 - DNA, 16 bp, Homo sapiens
gtaaagcttgtctgat

SEQ ID NO: 1397137 - DNA, 13 bp, Homo sapiens
gtaaatattttaa

SEQ ID NO: 1397138 - DNA, 22 bp, Homo sapiens
gtaaattattaatttatgcaga

SEQ ID NO: 1397139 - DNA, 13 bp, Homo sapiens
gtaacaaaaataa

SEQ ID NO: 1397140 - DNA, 15 bp, Homo sapiens
gtaactcatctgtca

SEQ ID NO: 1397141 - DNA, 15 bp, Homo sapiens
gtaacttttgtaaga

SEQ ID NO: 1397142 - DNA, 17 bp, Homo sapiens
gtaacttttgtaagaca

SEQ ID NO: 1397143 - DNA, 15 bp, Homo sapiens
gtaagagcaaaagaa

SEQ ID NO: 1397144 - DNA, 13 bp, Homo sapiens
gtaagatttcctt

SEQ ID NO: 1397145 - DNA, 18 bp, Homo sapiens
gtaagatttccttctttt

SEQ ID NO: 1397146 - DNA, 21 bp, Homo sapiens
gtaataaaattcaacaaacat

SEQ ID NO: 1397147 - DNA, 18 bp, Homo sapiens
gtaatgttaatattgatt

SEQ ID NO: 1397148 - DNA, 21 bp, Homo sapiens
gtaattgttgctaatcttctt

SEQ ID NO: 1397149 - DNA, 16 bp, Homo sapiens
gtacaaaataaacaaa

SEQ ID NO: 1397150 - DNA, 13 bp, Homo sapiens
gtacaatgtttca

SEQ ID NO: 1397151 - DNA, 14 bp, Homo sapiens
gtacaatgtttcag

SEQ ID NO: 1397152 - DNA, 18 bp, Homo sapiens
gtacacagcaccagaatg

SEQ ID NO: 1397153 - DNA, 20 bp, Homo sapiens
gtacacagctctagacactg

SEQ ID NO: 1397154 - DNA, 14 bp, Homo sapiens
gtacagaaagctgc

SEQ ID NO: 1397155 - DNA, 14 bp, Homo sapiens
gtacagttatctaa

SEQ ID NO: 1397156 - DNA, 20 bp, Homo sapiens
gtacagttatctaagttaat

SEQ ID NO: 1397157 - DNA, 16 bp, Homo sapiens
gtacatatgtaaaata

SEQ ID NO: 1397158 - DNA, 22 bp, Homo sapiens
gtaccaagccccttggccctct

SEQ ID NO: 1397159 - DNA, 18 bp, Homo sapiens
gtacgataggtagaattg

SEQ ID NO: 1397160 - DNA, 13 bp, Homo sapiens
gtagaaaagctat

SEQ ID NO: 1397161 - DNA, 19 bp, Homo sapiens
gtagaatgtaaagcttgtc

SEQ ID NO: 1397162 - DNA, 22 bp, Homo sapiens
gtagaattatctaatttataaa

SEQ ID NO: 1397163 - DNA, 15 bp, Homo sapiens
gtagaccaaaataaa

SEQ ID NO: 1397164 - DNA, 20 bp, Homo sapiens
gtagatgcatttgggtccag

SEQ ID NO: 1397165 - DNA, 17 bp, Homo sapiens
gtagctgggactacagg

SEQ ID NO: 1397166 - DNA, 12 bp, Homo sapiens
gtagctttgctc

SEQ ID NO: 1397167 - DNA, 13 bp, Homo sapiens
gtaggcaggattg

SEQ ID NO: 1397168 - DNA, 13 bp, Homo sapiens
gtagtatgatggg

SEQ ID NO: 1397169 - DNA, 22 bp, Homo sapiens
gtagttcattgtaaatgaacat

SEQ ID NO: 1397170 - DNA, 13 bp, Homo sapiens
gtatacctcactt

SEQ ID NO: 1397171 - DNA, 16 bp, Homo sapiens
gtatacttttgtttca

SEQ ID NO: 1397172 - DNA, 23 bp, Homo sapiens
gtatatatatatatatgtacagt

SEQ ID NO: 1397173 - DNA, 17 bp, Homo sapiens
gtatctatgcattttct

SEQ ID NO: 1397174 - DNA, 13 bp, Homo sapiens
gtatggaaataaa

SEQ ID NO: 1397175 - DNA, 16 bp, Homo sapiens
gtattatgtctcttct

SEQ ID NO: 1397176 - DNA, 13 bp, Homo sapiens
gtatttatcttta

SEQ ID NO: 1397177 - DNA, 18 bp, Homo sapiens
gtcaatcaagtctgttta

SEQ ID NO: 1397178 - DNA, 16 bp, Homo sapiens
gtcacctcagagacat

SEQ ID NO: 1397179 - DNA, 23 bp, Homo sapiens
gtcagtgctgtgctgtgctatgg

SEQ ID NO: 1397180 - DNA, 23 bp, Homo sapiens
gtcatcaattaaaggcaaaggca

SEQ ID NO: 1397181 - DNA, 20 bp, Homo sapiens
gtcattttggtactttggtg

SEQ ID NO: 1397182 - DNA, 20 bp, Homo sapiens
gtccaaaataaaacctcagc

SEQ ID NO: 1397183 - DNA, 15 bp, Homo sapiens
gtccatcagcctcca

SEQ ID NO: 1397184 - DNA, 22 bp, Homo sapiens
gtcccagaaaaagcatcatggc

SEQ ID NO: 1397185 - DNA, 19 bp, Homo sapiens
gtcccagaaccacactgtt

SEQ ID NO: 1397186 - DNA, 20 bp, Homo sapiens
gtcccagaaccacactgttg

SEQ ID NO: 1397187 - DNA, 20 bp, Homo sapiens
gtccctaataaagctgtgtg

SEQ ID NO: 1397188 - DNA, 12 bp, Homo sapiens
gtcctcagcccc

SEQ ID NO: 1397189 - DNA, 16 bp, Homo sapiens
gtccttctactccagc

SEQ ID NO: 1397190 - DNA, 20 bp, Homo sapiens
gtccttggcaggctgatttc

SEQ ID NO: 1397191 - DNA, 13 bp, Homo sapiens
gtcgattagactg

SEQ ID NO: 1397192 - DNA, 14 bp, Homo sapiens
gtcgccctggactg

SEQ ID NO: 1397193 - DNA, 18 bp, Homo sapiens
gtcgccctggactgtgtg

SEQ ID NO: 1397194 - DNA, 15 bp, Homo sapiens
gtctcaaactcctga

SEQ ID NO: 1397195 - DNA, 15 bp, Homo sapiens
gtctcatgtaaaata

SEQ ID NO: 1397196 - DNA, 16 bp, Homo sapiens
gtctgggagtgttctg

SEQ ID NO: 1397197 - DNA, 17 bp, Homo sapiens
gtctgggagtgttctgt

SEQ ID NO: 1397198 - DNA, 22 bp, Homo sapiens
gtctgtagtgtcactcaaggcg

SEQ ID NO: 1397199 - DNA, 14 bp, Homo sapiens
gtcttcctgacact

SEQ ID NO: 1397200 - DNA, 14 bp, Homo sapiens
gtgaaattttaaaa

SEQ ID NO: 1397201 - DNA, 14 bp, Homo sapiens
gtgaagacagaagt

SEQ ID NO: 1397202 - DNA, 17 bp, Homo sapiens
gtgaagcatccaggcac

SEQ ID NO: 1397203 - DNA, 17 bp, Homo sapiens
gtgaatttttttttcct

SEQ ID NO: 1397204 - DNA, 20 bp, Homo sapiens
gtgacaaaaaattaaagcat

SEQ ID NO: 1397205 - DNA, 18 bp, Homo sapiens
gtgacacaaacacacaca

SEQ ID NO: 1397206 - DNA, 21 bp, Homo sapiens
gtgacgtctgggtggccctta

SEQ ID NO: 1397207 - DNA, 17 bp, Homo sapiens
gtgactaatggcatgag

SEQ ID NO: 1397208 - DNA, 12 bp, Homo sapiens
gtgactctttcc

SEQ ID NO: 1397209 - DNA, 22 bp, Homo sapiens
gtgagaacctgggttgcagaca

SEQ ID NO: 1397210 - DNA, 19 bp, Homo sapiens
gtgagagacattaactcat

SEQ ID NO: 1397211 - DNA, 23 bp, Homo sapiens
gtgagagacattaactcattaga

SEQ ID NO: 1397212 - DNA, 13 bp, Homo sapiens
gtgagcatgtttg

SEQ ID NO: 1397213 - DNA, 14 bp, Homo sapiens
gtgaggaagcctaa

SEQ ID NO: 1397214 - DNA, 22 bp, Homo sapiens
gtgatccctagctgtgacctct

SEQ ID NO: 1397215 - DNA, 15 bp, Homo sapiens
gtgatgttcatgggt

SEQ ID NO: 1397216 - DNA, 22 bp, Homo sapiens
gtgattagagggaggagaatga

SEQ ID NO: 1397217 - DNA, 14 bp, Homo sapiens
gtgattcaatctgt

SEQ ID NO: 1397218 - DNA, 23 bp, Homo sapiens
gtgattcaatctgtaaactgtgt

SEQ ID NO: 1397219 - DNA, 19 bp, Homo sapiens
gtgatttttatgccacctg

SEQ ID NO: 1397220 - DNA, 13 bp, Homo sapiens
gtgcaatgtaaat

SEQ ID NO: 1397221 - DNA, 20 bp, Homo sapiens
gtgcacaaatatttattttc

SEQ ID NO: 1397222 - DNA, 20 bp, Homo sapiens
gtgcatcaggctttcttttt

SEQ ID NO: 1397223 - DNA, 19 bp, Homo sapiens
gtgccatgtcaaacaaata

SEQ ID NO: 1397224 - DNA, 14 bp, Homo sapiens
gtgcccccatcttt

SEQ ID NO: 1397225 - DNA, 14 bp, Homo sapiens
gtgctatggtgctc

SEQ ID NO: 1397226 - DNA, 16 bp, Homo sapiens
gtgcttaatgtgaact

SEQ ID NO: 1397227 - DNA, 19 bp, Homo sapiens
gtggcaagtgaatttgcct

SEQ ID NO: 1397228 - DNA, 11 bp, Homo sapiens
gtggcagtctg

SEQ ID NO: 1397229 - DNA, 12 bp, Homo sapiens
gtggccaggagg

SEQ ID NO: 1397230 - DNA, 10 bp, Homo sapiens
gtggccaggc

SEQ ID NO: 1397231 - DNA, 23 bp, Homo sapiens
gtggcccttatgactgccaagac

SEQ ID NO: 1397232 - DNA, 20 bp, Homo sapiens
gtgggagggtaccagcagaa

SEQ ID NO: 1397233 - DNA, 17 bp, Homo sapiens
gtggtgcgagtgcgtga

SEQ ID NO: 1397234 - DNA, 22 bp, Homo sapiens
gtggtggcagtgcagcaaccag

SEQ ID NO: 1397235 - DNA, 14 bp, Homo sapiens
gtgtacataactga

SEQ ID NO: 1397236 - DNA, 22 bp, Homo sapiens
gtgtacatatgtaaaatattgt

SEQ ID NO: 1397237 - DNA, 17 bp, Homo sapiens
gtgtagccacaccagga

SEQ ID NO: 1397238 - DNA, 19 bp, Homo sapiens
gtgtatggaaataaatgta

SEQ ID NO: 1397239 - DNA, 20 bp, Homo sapiens
gtgtattccaagacatgtct

SEQ ID NO: 1397240 - DNA, 17 bp, Homo sapiens
gtgtgctcaggagccct

SEQ ID NO: 1397241 - DNA, 18 bp, Homo sapiens
gtgtgctcaggagccctg

SEQ ID NO: 1397242 - DNA, 19 bp, Homo sapiens
gtgtgctcaggagccctgg

SEQ ID NO: 1397243 - DNA, 11 bp, Homo sapiens
gtgtgggagac

SEQ ID NO: 1397244 - DNA, 22 bp, Homo sapiens
gtgtgtctgttcacttttcctc

SEQ ID NO: 1397245 - DNA, 15 bp, Homo sapiens
gtgttaatttttgat

SEQ ID NO: 1397246 - DNA, 17 bp, Homo sapiens
gtgttcccatttcagct

SEQ ID NO: 1397247 - DNA, 14 bp, Homo sapiens
gtgttctgtttccc

SEQ ID NO: 1397248 - DNA, 17 bp, Homo sapiens
gtgttgaaaatgttcag

SEQ ID NO: 1397249 - DNA, 18 bp, Homo sapiens
gtgtttctgtaagaaacc

SEQ ID NO: 1397250 - DNA, 21 bp, Homo sapiens
cacttactttttctggtctct

SEQ ID NO: 1397251 - DNA, 21 bp, Homo sapiens
cacttattggaactctgcttg

SEQ ID NO: 1397252 - DNA, 18 bp, Homo sapiens
cacttctgggcttcatct

SEQ ID NO: 1397253 - DNA, 17 bp, Homo sapiens
cacttgtacaaaataaa

SEQ ID NO: 1397254 - DNA, 18 bp, Homo sapiens
cacttgtcattgttatat

SEQ ID NO: 1397255 - DNA, 17 bp, Homo sapiens
cactttgcacagctctc

SEQ ID NO: 1397256 - DNA, 18 bp, Homo sapiens
cactttggagctttagct

SEQ ID NO: 1397257 - DNA, 15 bp, Homo sapiens
cagaaaacaaaactg

SEQ ID NO: 1397258 - DNA, 22 bp, Homo sapiens
cagaaagcagttgagacaagaa

SEQ ID NO: 1397259 - DNA, 14 bp, Homo sapiens
cagaaagctgcctg

SEQ ID NO: 1397260 - DNA, 21 bp, Homo sapiens
cagaaccacactgttgagttg

SEQ ID NO: 1397261 - DNA, 21 bp, Homo sapiens
cagaacttgaccctgagctga

SEQ ID NO: 1397262 - DNA, 20 bp, Homo sapiens
cagaagccccatttgcacag

SEQ ID NO: 1397263 - DNA, 22 bp, Homo sapiens
cagaagtttgcactatctttca

SEQ ID NO: 1397264 - DNA, 19 bp, Homo sapiens
cagaattcaacagttacct

SEQ ID NO: 1397265 - DNA, 11 bp, Homo sapiens
cagacagatga

SEQ ID NO: 1397266 - DNA, 17 bp, Homo sapiens
cagacagatgaggcttt

SEQ ID NO: 1397267 - DNA, 18 bp, Homo sapiens
cagacagatgaggctttc

SEQ ID NO: 1397268 - DNA, 15 bp, Homo sapiens
cagactcagctctga

SEQ ID NO: 1397269 - DNA, 17 bp, Homo sapiens
cagactctaagaaagaa

SEQ ID NO: 1397270 - DNA, 14 bp, Homo sapiens
cagactgcttccaa

SEQ ID NO: 1397271 - DNA, 20 bp, Homo sapiens
cagactgcttccaattttct

SEQ ID NO: 1397272 - DNA, 17 bp, Homo sapiens
cagagaaaaagggaggg

SEQ ID NO: 1397273 - DNA, 15 bp, Homo sapiens
cagagaatttctacc

SEQ ID NO: 1397274 - DNA, 17 bp, Homo sapiens
cagagaccttccagaaa

SEQ ID NO: 1397275 - DNA, 16 bp, Homo sapiens
cagagataaagacctt

SEQ ID NO: 1397276 - DNA, 14 bp, Homo sapiens
cagagcaaaataat

SEQ ID NO: 1397277 - DNA, 14 bp, Homo sapiens
cagagtccctgcct

SEQ ID NO: 1397278 - DNA, 20 bp, Homo sapiens
cagataaggtaaaatgccat

SEQ ID NO: 1397279 - DNA, 17 bp, Homo sapiens
gaggggaccaggagtgg

SEQ ID NO: 1397280 - DNA, 21 bp, Homo sapiens
gaggggaccaggagtgggtgg

SEQ ID NO: 1397281 - DNA, 23 bp, Homo sapiens
gaggtcagcatgtctattcagct

SEQ ID NO: 1397282 - DNA, 13 bp, Homo sapiens
gaggtgccactgg

SEQ ID NO: 1397283 - DNA, 14 bp, Homo sapiens
gaggtgccactgga

SEQ ID NO: 1397284 - DNA, 15 bp, Homo sapiens
gaggttaaaatataa

SEQ ID NO: 1397285 - DNA, 19 bp, Homo sapiens
gagtagctgggactacagg

SEQ ID NO: 1397286 - DNA, 15 bp, Homo sapiens
gagtccatcagcctc

SEQ ID NO: 1397287 - DNA, 17 bp, Homo sapiens
gagtccatcagcctcca

SEQ ID NO: 1397288 - DNA, 14 bp, Homo sapiens
gagtccctgcctgg

SEQ ID NO: 1397289 - DNA, 19 bp, Homo sapiens
gagtccctgcctggaccag

SEQ ID NO: 1397290 - DNA, 14 bp, Homo sapiens
gagtgggtggggag

SEQ ID NO: 1397291 - DNA, 18 bp, Homo sapiens
gagtgtagcaactacagt

SEQ ID NO: 1397292 - DNA, 12 bp, Homo sapiens
gagtgtgaccaa

SEQ ID NO: 1397293 - DNA, 21 bp, Homo sapiens
gagtgtgaccaaaagttacat

SEQ ID NO: 1397294 - DNA, 23 bp, Homo sapiens
gagtgtgcgtggtggtccctggg

SEQ ID NO: 1397295 - DNA, 15 bp, Homo sapiens
gagttggacacactg

SEQ ID NO: 1397296 - DNA, 15 bp, Homo sapiens
gagtttagggtgggg

SEQ ID NO: 1397297 - DNA, 19 bp, Homo sapiens
gataaagattttttaataa

SEQ ID NO: 1397298 - DNA, 16 bp, Homo sapiens
gatacgacagtacact

SEQ ID NO: 1397299 - DNA, 14 bp, Homo sapiens
gatagaaatgccaa

SEQ ID NO: 1397300 - DNA, 12 bp, Homo sapiens
gatagaatgaca

SEQ ID NO: 1397301 - DNA, 17 bp, Homo sapiens
gatatgtaaaacattta

SEQ ID NO: 1397302 - DNA, 18 bp, Homo sapiens
gatattctggattataaa

SEQ ID NO: 1397303 - DNA, 19 bp, Homo sapiens
gatattctggattataaaa

SEQ ID NO: 1397304 - DNA, 17 bp, Homo sapiens
gatatttatatgttatt

SEQ ID NO: 1397305 - DNA, 23 bp, Homo sapiens
gatatttatttaaacaaatgtgt

SEQ ID NO: 1397306 - DNA, 22 bp, Homo sapiens
gatcactttctcagttttcata

SEQ ID NO: 1397307 - DNA, 18 bp, Homo sapiens
gatcatttgttggaatga

SEQ ID NO: 1397308 - DNA, 16 bp, Homo sapiens
gatcccaacactgcca

SEQ ID NO: 1397309 - DNA, 17 bp, Homo sapiens
gatcccaacactgccag

SEQ ID NO: 1397310 - DNA, 19 bp, Homo sapiens
gatcccaacactgccagca

SEQ ID NO: 1397311 - DNA, 15 bp, Homo sapiens
gatcccatgagctcc

SEQ ID NO: 1397312 - DNA, 12 bp, Homo sapiens
gatcctcctcat

SEQ ID NO: 1397313 - DNA, 14 bp, Homo sapiens
gatctcaccaggca

SEQ ID NO: 1397314 - DNA, 23 bp, Homo sapiens
gatctgatagggtttgtgacagg

SEQ ID NO: 1397315 - DNA, 20 bp, Homo sapiens
gatctgcagggggtgtgtct

SEQ ID NO: 1397316 - DNA, 12 bp, Homo sapiens
gatctggcatgt

SEQ ID NO: 1397317 - DNA, 14 bp, Homo sapiens
gatcttttattttg

SEQ ID NO: 1397318 - DNA, 11 bp, Homo sapiens
gatgaaaataa

SEQ ID NO: 1397319 - DNA, 18 bp, Homo sapiens
gatgaaaataaagaatgg

SEQ ID NO: 1397320 - DNA, 19 bp, Homo sapiens
gatgaaaataaagaatgga

SEQ ID NO: 1397321 - DNA, 20 bp, Homo sapiens
gatgaaaccttgaagttctg

SEQ ID NO: 1397322 - DNA, 15 bp, Homo sapiens
gatgactaaaatatt

SEQ ID NO: 1397323 - DNA, 18 bp, Homo sapiens
gatgactaaaatatttat

SEQ ID NO: 1397324 - DNA, 19 bp, Homo sapiens
gatgcatttgggtccagga

SEQ ID NO: 1397325 - DNA, 20 bp, Homo sapiens
gatgcatttgggtccaggag

SEQ ID NO: 1397326 - DNA, 21 bp, Homo sapiens
gatgcatttgggtccaggagg

SEQ ID NO: 1397327 - DNA, 19 bp, Homo sapiens
gatgccaaaaaaaaataca

SEQ ID NO: 1397328 - DNA, 17 bp, Homo sapiens
gatgcccaaatccttag

SEQ ID NO: 1397329 - DNA, 15 bp, Homo sapiens
gatgcttttaacaga

SEQ ID NO: 1397330 - DNA, 17 bp, Homo sapiens
gatgggattctggacag

SEQ ID NO: 1397331 - DNA, 19 bp, Homo sapiens
gatgtgagttgcacagcta

SEQ ID NO: 1397332 - DNA, 22 bp, Homo sapiens
gatgttaaaaaaataagaagaa

SEQ ID NO: 1397333 - DNA, 17 bp, Homo sapiens
gatgttctggacctccc

SEQ ID NO: 1397334 - DNA, 16 bp, Homo sapiens
gattataaaaatgaat

SEQ ID NO: 1397335 - DNA, 21 bp, Homo sapiens
gattcattcttaacaagatat

SEQ ID NO: 1397336 - DNA, 23 bp, Homo sapiens
gattgaagtattttgctggaata

SEQ ID NO: 1397337 - DNA, 16 bp, Homo sapiens
gattgggaatccgccc

SEQ ID NO: 1397338 - DNA, 15 bp, Homo sapiens
gattgttcctgcttt

SEQ ID NO: 1397339 - DNA, 11 bp, Homo sapiens
gattgtttgca

SEQ ID NO: 1397340 - DNA, 15 bp, Homo sapiens
gatttacgctcattg

SEQ ID NO: 1397341 - DNA, 18 bp, Homo sapiens
gatttatttaaaatagca

SEQ ID NO: 1397342 - DNA, 12 bp, Homo sapiens
gatttccttctt

SEQ ID NO: 1397343 - DNA, 14 bp, Homo sapiens
gatttgtactgaaa

SEQ ID NO: 1397344 - DNA, 17 bp, Homo sapiens
gattttttaataattta

SEQ ID NO: 1397345 - DNA, 18 bp, Homo sapiens
gattttttccttcaaagt

SEQ ID NO: 1397346 - DNA, 21 bp, Homo sapiens
gattttttccttcaaagttta

SEQ ID NO: 1397347 - DNA, 13 bp, Homo sapiens
gcaaaaaagaaaa

SEQ ID NO: 1397348 - DNA, 23 bp, Homo sapiens
gcaaaaatagtttggatatgtaa

SEQ ID NO: 1397349 - DNA, 18 bp, Homo sapiens
gcaaaataaatgttttta

SEQ ID NO: 1397350 - DNA, 22 bp, Homo sapiens
gcaaatcgaatgaaattaactg

SEQ ID NO: 1397351 - DNA, 23 bp, Homo sapiens
gcaaccgtctgttatgctgtgac

SEQ ID NO: 1397352 - DNA, 17 bp, Homo sapiens
gcaacctccacctcctg

SEQ ID NO: 1397353 - DNA, 21 bp, Homo sapiens
gcaagaaggcaaaaatagttt

SEQ ID NO: 1397354 - DNA, 15 bp, Homo sapiens
gcaagacctgttggt

SEQ ID NO: 1397355 - DNA, 18 bp, Homo sapiens
gcaagcattcagaagaaa

SEQ ID NO: 1397356 - DNA, 17 bp, Homo sapiens
gcaaggacctaaaacat

SEQ ID NO: 1397357 - DNA, 19 bp, Homo sapiens
gcacagcctggctgtggcc

SEQ ID NO: 1397358 - DNA, 14 bp, Homo sapiens
gcaccaaaagaagt

SEQ ID NO: 1397359 - DNA, 19 bp, Homo sapiens
gcaccggggcctgggcagg

SEQ ID NO: 1397360 - DNA, 14 bp, Homo sapiens
gcacctacttacat

SEQ ID NO: 1397361 - DNA, 19 bp, Homo sapiens
gcacctgtcccagaaaaag

SEQ ID NO: 1397362 - DNA, 20 bp, Homo sapiens
gcacgcggagtgagtttttt

SEQ ID NO: 1397363 - DNA, 19 bp, Homo sapiens
gcactatctttcagctcca

SEQ ID NO: 1397364 - DNA, 23 bp, Homo sapiens
gcactggggcaggggccgggggc

SEQ ID NO: 1397365 - DNA, 23 bp, Homo sapiens
gcacttctttttctcgctgtcct

SEQ ID NO: 1397366 - DNA, 16 bp, Homo sapiens
gcagaagcagggtacc

SEQ ID NO: 1397367 - DNA, 21 bp, Homo sapiens
gcagattttcagcaaactctt

SEQ ID NO: 1397368 - DNA, 15 bp, Homo sapiens
gcagcaaccagagca

SEQ ID NO: 1397369 - DNA, 16 bp, Homo sapiens
gcagcaaccagagcac

SEQ ID NO: 1397370 - DNA, 18 bp, Homo sapiens
gcagcaaccagagcactg

SEQ ID NO: 1397371 - DNA, 20 bp, Homo sapiens
gcagcaaccagagcactgta

SEQ ID NO: 1397372 - DNA, 23 bp, Homo sapiens
gcagcctctggggggtggccagg

SEQ ID NO: 1397373 - DNA, 16 bp, Homo sapiens
gcagctcaagagatcc

SEQ ID NO: 1397374 - DNA, 22 bp, Homo sapiens
gcaggatctcaccaggcagcct

SEQ ID NO: 1397375 - DNA, 20 bp, Homo sapiens
gcaggattggggaagagagc

SEQ ID NO: 1397376 - DNA, 18 bp, Homo sapiens
gcaggcaggctcccaggg

SEQ ID NO: 1397377 - DNA, 20 bp, Homo sapiens
gcaggccaagtcaggccctt

SEQ ID NO: 1397378 - DNA, 22 bp, Homo sapiens
gcaggctcccagggacacctgg

SEQ ID NO: 1397379 - DNA, 17 bp, Homo sapiens
gcaggctgatttctagg

SEQ ID NO: 1397380 - DNA, 13 bp, Homo sapiens
gcagggtaccctt

SEQ ID NO: 1397381 - DNA, 23 bp, Homo sapiens
gcagggtaccctttggggagcag

SEQ ID NO: 1397382 - DNA, 13 bp, Homo sapiens
gcaggtccctaat

SEQ ID NO: 1397383 - DNA, 16 bp, Homo sapiens
gcaggtccctaataaa

SEQ ID NO: 1397384 - DNA, 13 bp, Homo sapiens
gcataaattattg

SEQ ID NO: 1397385 - DNA, 13 bp, Homo sapiens
gcatcatggctat

SEQ ID NO: 1397386 - DNA, 22 bp, Homo sapiens
gcatccagagtccctgcctgga

SEQ ID NO: 1397387 - DNA, 16 bp, Homo sapiens
gcatccattctcctga

SEQ ID NO: 1397388 - DNA, 18 bp, Homo sapiens
gcatccctgggccttggg

SEQ ID NO: 1397389 - DNA, 19 bp, Homo sapiens
gcatccctgggccttgggc

SEQ ID NO: 1397390 - DNA, 19 bp, Homo sapiens
gcatcgtctcatgtaaaat

SEQ ID NO: 1397391 - DNA, 21 bp, Homo sapiens
gcatctagaggcttccttcat

SEQ ID NO: 1397392 - DNA, 20 bp, Homo sapiens
gcatggtcctggaggatgac

SEQ ID NO: 1397393 - DNA, 23 bp, Homo sapiens
gcatggtcctggaggatgaccag

SEQ ID NO: 1397394 - DNA, 14 bp, Homo sapiens
gcattactgcatgc

SEQ ID NO: 1397395 - DNA, 16 bp, Homo sapiens
gcattcagaagaaaaa

SEQ ID NO: 1397396 - DNA, 21 bp, Homo sapiens
gcattgaatggctatgttttt

SEQ ID NO: 1397397 - DNA, 18 bp, Homo sapiens
gcatttaaaacagacact

SEQ ID NO: 1397398 - DNA, 14 bp, Homo sapiens
gccaaaaacaaaat

SEQ ID NO: 1397399 - DNA, 20 bp, Homo sapiens
gccaagactgctgtggccag

SEQ ID NO: 1397400 - DNA, 21 bp, Homo sapiens
gccaagactgctgtggccagg

SEQ ID NO: 1397401 - DNA, 21 bp, Homo sapiens
gccaaggagtcactgagacca

SEQ ID NO: 1397402 - DNA, 18 bp, Homo sapiens
gccaaggggcttcaggtc

SEQ ID NO: 1397403 - DNA, 11 bp, Homo sapiens
gccaataaaaa

SEQ ID NO: 1397404 - DNA, 14 bp, Homo sapiens
gccaataaaaagtt

SEQ ID NO: 1397405 - DNA, 13 bp, Homo sapiens
gccacaccaggat

SEQ ID NO: 1397406 - DNA, 23 bp, Homo sapiens
gccactaccttctgacctcccca

SEQ ID NO: 1397407 - DNA, 17 bp, Homo sapiens
gccagcaaaccaggact

SEQ ID NO: 1397408 - DNA, 22 bp, Homo sapiens
gccagcagaagcagggtaccct

SEQ ID NO: 1397409 - DNA, 16 bp, Homo sapiens
gccatcaagagactga

SEQ ID NO: 1397410 - DNA, 22 bp, Homo sapiens
gccattcacttcataatccagt

SEQ ID NO: 1397411 - DNA, 12 bp, Homo sapiens
gccattctttcc

SEQ ID NO: 1397412 - DNA, 14 bp, Homo sapiens
ctctgttcatttcc

SEQ ID NO: 1397413 - DNA, 22 bp, Homo sapiens
ctcttattgcctcacttcaggt

SEQ ID NO: 1397414 - DNA, 18 bp, Homo sapiens
ctcttcactcttcaaatg

SEQ ID NO: 1397415 - DNA, 22 bp, Homo sapiens
ctcttccagtcttcctgacact

SEQ ID NO: 1397416 - DNA, 23 bp, Homo sapiens
ctcttccagtcttcctgacactt

SEQ ID NO: 1397417 - DNA, 15 bp, Homo sapiens
ctcttctgagctatt

SEQ ID NO: 1397418 - DNA, 22 bp, Homo sapiens
ctcttctgagctatttcatcta

SEQ ID NO: 1397419 - DNA, 23 bp, Homo sapiens
ctcttctgagctatttcatctat

SEQ ID NO: 1397420 - DNA, 13 bp, Homo sapiens
ctcttgatgcctg

SEQ ID NO: 1397421 - DNA, 21 bp, Homo sapiens
ctcttgatgcctggcggggtg

SEQ ID NO: 1397422 - DNA, 21 bp, Homo sapiens
ctctttttccaacttggctgc

SEQ ID NO: 1397423 - DNA, 17 bp, Homo sapiens
ctgaaaaggtttatgaa

SEQ ID NO: 1397424 - DNA, 17 bp, Homo sapiens
ctgaaaattatttaaac

SEQ ID NO: 1397425 - DNA, 14 bp, Homo sapiens
ctgaaatttcagat

SEQ ID NO: 1397426 - DNA, 22 bp, Homo sapiens
ctgaaattttatatgcttactg

SEQ ID NO: 1397427 - DNA, 14 bp, Homo sapiens
ctgaacaagaattg

SEQ ID NO: 1397428 - DNA, 23 bp, Homo sapiens
ctgaacctatttcttaaacactt

SEQ ID NO: 1397429 - DNA, 15 bp, Homo sapiens
ctgaactcaaactga

SEQ ID NO: 1397430 - DNA, 13 bp, Homo sapiens
ctgaactgaacac

SEQ ID NO: 1397431 - DNA, 11 bp, Homo sapiens
ctgaattttta

SEQ ID NO: 1397432 - DNA, 20 bp, Homo sapiens
ctgaccagccgtgagcatgt

SEQ ID NO: 1397433 - DNA, 23 bp, Homo sapiens
ctgaccagccgtgagcatgtttg

SEQ ID NO: 1397434 - DNA, 22 bp, Homo sapiens
ctgagaccaaggctttctctac

SEQ ID NO: 1397435 - DNA, 18 bp, Homo sapiens
ctgagactaatcttattc

SEQ ID NO: 1397436 - DNA, 23 bp, Homo sapiens
ctgagatatgaacatattgttga

SEQ ID NO: 1397437 - DNA, 20 bp, Homo sapiens
ctgagcccggtaagagcaaa

SEQ ID NO: 1397438 - DNA, 21 bp, Homo sapiens
ctgagctatttcatctatttt

SEQ ID NO: 1397439 - DNA, 15 bp, Homo sapiens
ctgagctgaccagcc

SEQ ID NO: 1397440 - DNA, 22 bp, Homo sapiens
ctgagtcaccctacctgtgcct

SEQ ID NO: 1397441 - DNA, 17 bp, Homo sapiens
ctgagtcgtacagaaag

SEQ ID NO: 1397442 - DNA, 20 bp, Homo sapiens
ctgagtcgtacagaaagctg

SEQ ID NO: 1397443 - DNA, 23 bp, Homo sapiens
ctgagtcgtacagaaagctgcct

SEQ ID NO: 1397444 - DNA, 21 bp, Homo sapiens
ctgagtgactctatatagctg

SEQ ID NO: 1397445 - DNA, 17 bp, Homo sapiens
ctgagttacagaaatga

SEQ ID NO: 1397446 - DNA, 16 bp, Homo sapiens
ctgagttcctgcatgc

SEQ ID NO: 1397447 - DNA, 20 bp, Homo sapiens
ctgagttttccatggcagga

SEQ ID NO: 1397448 - DNA, 22 bp, Homo sapiens
ctgagttttccatggcaggaag

SEQ ID NO: 1397449 - DNA, 18 bp, Homo sapiens
ctgataattttaaattct

SEQ ID NO: 1397450 - DNA, 18 bp, Homo sapiens
ctgatatattttacaatt

SEQ ID NO: 1397451 - DNA, 14 bp, Homo sapiens
ctgatattttctct

SEQ ID NO: 1397452 - DNA, 15 bp, Homo sapiens
ctgatcaaggcctta

SEQ ID NO: 1397453 - DNA, 12 bp, Homo sapiens
ctgattatcagg

SEQ ID NO: 1397454 - DNA, 20 bp, Homo sapiens
ctgattgtttatttttctat

SEQ ID NO: 1397455 - DNA, 12 bp, Homo sapiens
ctgatttctagg

SEQ ID NO: 1397456 - DNA, 21 bp, Homo sapiens
ctgattttcaaagctttttcc

SEQ ID NO: 1397457 - DNA, 20 bp, Homo sapiens
ctgattttttttccttttaa

SEQ ID NO: 1397458 - DNA, 22 bp, Homo sapiens
ctgcacaataaaaatgtttaac

SEQ ID NO: 1397459 - DNA, 22 bp, Homo sapiens
ctgcacgaatggaagaggcacc

SEQ ID NO: 1397460 - DNA, 23 bp, Homo sapiens
ctgcagggggtgtgtctgctcag

SEQ ID NO: 1397461 - DNA, 11 bp, Homo sapiens
ctgcaggtccc

SEQ ID NO: 1397462 - DNA, 19 bp, Homo sapiens
ctgcaggtccctaataaag

SEQ ID NO: 1397463 - DNA, 21 bp, Homo sapiens
ctgcaggtccctaataaagct

SEQ ID NO: 1397464 - DNA, 23 bp, Homo sapiens
ctgcaggtccctaataaagctgt

SEQ ID NO: 1397465 - DNA, 20 bp, Homo sapiens
ctgcatctagaggcttcctt

SEQ ID NO: 1397466 - DNA, 23 bp, Homo sapiens
ctgcattattggaatataattgt

SEQ ID NO: 1397467 - DNA, 15 bp, Homo sapiens
ctgccaggagctttg

SEQ ID NO: 1397468 - DNA, 11 bp, Homo sapiens
ctgccaggagg

SEQ ID NO: 1397469 - DNA, 16 bp, Homo sapiens
ctgccaggaggaccca

SEQ ID NO: 1397470 - DNA, 15 bp, Homo sapiens
ctgcccaggcactgc

SEQ ID NO: 1397471 - DNA, 16 bp, Homo sapiens
ctgcccagtgcacttg

SEQ ID NO: 1397472 - DNA, 13 bp, Homo sapiens
ctgccgtcagtgc

SEQ ID NO: 1397473 - DNA, 19 bp, Homo sapiens
ctgccgtcagtgctgtgct

SEQ ID NO: 1397474 - DNA, 15 bp, Homo sapiens
ctgcctcctgccggc

SEQ ID NO: 1397475 - DNA, 12 bp, Homo sapiens
ctgcctctctgc

SEQ ID NO: 1397476 - DNA, 14 bp, Homo sapiens
ctgcctctctgcag

SEQ ID NO: 1397477 - DNA, 15 bp, Homo sapiens
ctgcctctctgcagg

SEQ ID NO: 1397478 - DNA, 17 bp, Homo sapiens
ctgcctctctgcaggtc

SEQ ID NO: 1397479 - DNA, 22 bp, Homo sapiens
ctgcctctctgcaggtccctaa

SEQ ID NO: 1397480 - DNA, 20 bp, Homo sapiens
ctgcgctgccccagagcctg

SEQ ID NO: 1397481 - DNA, 14 bp, Homo sapiens
ctgctatttgaagt

SEQ ID NO: 1397482 - DNA, 18 bp, Homo sapiens
ctgctcagtaaagcactt

SEQ ID NO: 1397483 - DNA, 15 bp, Homo sapiens
ctgctcatattgtga

SEQ ID NO: 1397484 - DNA, 19 bp, Homo sapiens
ctgctcatattgtgattct

SEQ ID NO: 1397485 - DNA, 21 bp, Homo sapiens
ctgcttcagtgtatggaaata

SEQ ID NO: 1397486 - DNA, 23 bp, Homo sapiens
ctgcttgatgggattctggacag

SEQ ID NO: 1397487 - DNA, 20 bp, Homo sapiens
ctgcttgatttttgcctctt

SEQ ID NO: 1397488 - DNA, 17 bp, Homo sapiens
ctggaaaataatactgc

SEQ ID NO: 1397489 - DNA, 20 bp, Homo sapiens
ctggaaaataatactgctga

SEQ ID NO: 1397490 - DNA, 11 bp, Homo sapiens
ctggaaagaag

SEQ ID NO: 1397491 - DNA, 19 bp, Homo sapiens
ctggaacttgaactgattc

SEQ ID NO: 1397492 - DNA, 22 bp, Homo sapiens
ctggaagcatttgtttctactt

SEQ ID NO: 1397493 - DNA, 14 bp, Homo sapiens
ctggaataagttca

SEQ ID NO: 1397494 - DNA, 12 bp, Homo sapiens
ctggacagcttg

SEQ ID NO: 1397495 - DNA, 18 bp, Homo sapiens
ctggaccagcctctccac

SEQ ID NO: 1397496 - DNA, 19 bp, Homo sapiens
ctggacctccccctcttgg

SEQ ID NO: 1397497 - DNA, 20 bp, Homo sapiens
ctggacctccccctcttggt

SEQ ID NO: 1397498 - DNA, 22 bp, Homo sapiens
ctggacctccccctcttggtcc

SEQ ID NO: 1397499 - DNA, 13 bp, Homo sapiens
ctggactgtgtgc

SEQ ID NO: 1397500 - DNA, 16 bp, Homo sapiens
ctggactgtgtgctca

SEQ ID NO: 1397501 - DNA, 23 bp, Homo sapiens
ctggactgtgtgctcaggagccc

SEQ ID NO: 1397502 - DNA, 13 bp, Homo sapiens
ctggagcccactg

SEQ ID NO: 1397503 - DNA, 20 bp, Homo sapiens
ctggagcccactgtacttgc

SEQ ID NO: 1397504 - DNA, 16 bp, Homo sapiens
ctggattataaaaatg

SEQ ID NO: 1397505 - DNA, 15 bp, Homo sapiens
ctggccccctccctg

SEQ ID NO: 1397506 - DNA, 21 bp, Homo sapiens
ctggcctcaaagcaagcattc

SEQ ID NO: 1397507 - DNA, 18 bp, Homo sapiens
ctggctgtggcctaacct

SEQ ID NO: 1397508 - DNA, 13 bp, Homo sapiens
ctggcttctggcc

SEQ ID NO: 1397509 - DNA, 19 bp, Homo sapiens
ctgggagaaatctggcttc

SEQ ID NO: 1397510 - DNA, 20 bp, Homo sapiens
ctgggagaaatctggcttct

SEQ ID NO: 1397511 - DNA, 21 bp, Homo sapiens
ctgggaggctctggagcccac

SEQ ID NO: 1397512 - DNA, 14 bp, Homo sapiens
ctgggagtgttctg

SEQ ID NO: 1397513 - DNA, 21 bp, Homo sapiens
ctgggattacaggcgtgagcc

SEQ ID NO: 1397514 - DNA, 20 bp, Homo sapiens
ctgggcccctgcctctctgc

SEQ ID NO: 1397515 - DNA, 11 bp, Homo sapiens
ctgggccttgg

SEQ ID NO: 1397516 - DNA, 14 bp, Homo sapiens
ctgggccttgggct

SEQ ID NO: 1397517 - DNA, 15 bp, Homo sapiens
ctgggccttgggctc

SEQ ID NO: 1397518 - DNA, 12 bp, Homo sapiens
ctggggacaggt

SEQ ID NO: 1397519 - DNA, 18 bp, Homo sapiens
ctggggccaggctgggtc

SEQ ID NO: 1397520 - DNA, 13 bp, Homo sapiens
ctgggtaactgtc

SEQ ID NO: 1397521 - DNA, 18 bp, Homo sapiens
ctgggtcgccctggactg

SEQ ID NO: 1397522 - DNA, 22 bp, Homo sapiens
ctgggtcgccctggactgtgtg

SEQ ID NO: 1397523 - DNA, 19 bp, Homo sapiens
ctggtatatccaaaagctt

SEQ ID NO: 1397524 - DNA, 15 bp, Homo sapiens
ctggtccaaaagatt

SEQ ID NO: 1397525 - DNA, 16 bp, Homo sapiens
ctggtgccaatttcaa

SEQ ID NO: 1397526 - DNA, 20 bp, Homo sapiens
ctggtgccaatttcaagttc

SEQ ID NO: 1397527 - DNA, 14 bp, Homo sapiens
ctggtggtggctcg

SEQ ID NO: 1397528 - DNA, 17 bp, Homo sapiens
ctggtttgaagaatgtt

SEQ ID NO: 1397529 - DNA, 14 bp, Homo sapiens
ctgtaaacccctgg

SEQ ID NO: 1397530 - DNA, 15 bp, Homo sapiens
gagagaaaaaattaa

SEQ ID NO: 1397531 - DNA, 16 bp, Homo sapiens
gagagagttgaaccta

SEQ ID NO: 1397532 - DNA, 15 bp, Homo sapiens
gagagggcgcaggcc

SEQ ID NO: 1397533 - DNA, 17 bp, Homo sapiens
gagagggcgcaggccgt

SEQ ID NO: 1397534 - DNA, 13 bp, Homo sapiens
gagatacatacag

SEQ ID NO: 1397535 - DNA, 16 bp, Homo sapiens
gagatacatacagaat

SEQ ID NO: 1397536 - DNA, 20 bp, Homo sapiens
gagatcccaacactgccagc

SEQ ID NO: 1397537 - DNA, 20 bp, Homo sapiens
gagattctcataacttgaga

SEQ ID NO: 1397538 - DNA, 21 bp, Homo sapiens
gagcagtgggagggtaccagc

SEQ ID NO: 1397539 - DNA, 12 bp, Homo sapiens
gagcatcacaga

SEQ ID NO: 1397540 - DNA, 12 bp, Homo sapiens
gagccatgtttc

SEQ ID NO: 1397541 - DNA, 21 bp, Homo sapiens
gagcccactgtacttgctctt

SEQ ID NO: 1397542 - DNA, 18 bp, Homo sapiens
gagccctgggaggctctg

SEQ ID NO: 1397543 - DNA, 21 bp, Homo sapiens
gagcctgaccctcatctttct

SEQ ID NO: 1397544 - DNA, 20 bp, Homo sapiens
gagctcagaaaatatccctc

SEQ ID NO: 1397545 - DNA, 14 bp, Homo sapiens
gagctgaccagccg

SEQ ID NO: 1397546 - DNA, 14 bp, Homo sapiens
gaggaatttcacct

SEQ ID NO: 1397547 - DNA, 22 bp, Homo sapiens
gaggaattttctttgtgtagct

SEQ ID NO: 1397548 - DNA, 15 bp, Homo sapiens
gaggacaaccattcc

SEQ ID NO: 1397549 - DNA, 15 bp, Homo sapiens
gaggacccagggctc

SEQ ID NO: 1397550 - DNA, 16 bp, Homo sapiens
gaggacttgtgtctct

SEQ ID NO: 1397551 - DNA, 12 bp, Homo sapiens
gaggccaataaa

SEQ ID NO: 1397552 - DNA, 13 bp, Homo sapiens
gaggccaataaaa

SEQ ID NO: 1397553 - DNA, 19 bp, Homo sapiens
gaggccaataaaaagttca

SEQ ID NO: 1397554 - DNA, 19 bp, Homo sapiens
gaggctctggagcccactg

SEQ ID NO: 1397555 - DNA, 13 bp, Homo sapiens
gagggctgccctg

SEQ ID NO: 1397556 - DNA, 12 bp, Homo sapiens
gaggggaccagg

SEQ ID NO: 1397557 - DNA, 14 bp, Homo sapiens
gaggggaccaggag

SEQ ID NO: 1397558 - DNA, 23 bp, Homo sapiens
ttgaagaatgttaagacttgaca

SEQ ID NO: 1397559 - DNA, 18 bp, Homo sapiens
ttgaagtattttgctgga

SEQ ID NO: 1397560 - DNA, 14 bp, Homo sapiens
ttgaagttctgaaa

SEQ ID NO: 1397561 - DNA, 17 bp, Homo sapiens
ttgaagttctgaaattt

SEQ ID NO: 1397562 - DNA, 23 bp, Homo sapiens
ttgaatattattcctcaaaaaat

SEQ ID NO: 1397563 - DNA, 16 bp, Homo sapiens
ttgaatgcaaaccata

SEQ ID NO: 1397564 - DNA, 15 bp, Homo sapiens
ttgaggggaccagga

SEQ ID NO: 1397565 - DNA, 21 bp, Homo sapiens
ttgagtctgtccagataagtt

SEQ ID NO: 1397566 - DNA, 13 bp, Homo sapiens
ttgagtgtttaaa

SEQ ID NO: 1397567 - DNA, 18 bp, Homo sapiens
ttgagttggacacactgt

SEQ ID NO: 1397568 - DNA, 14 bp, Homo sapiens
ttgataaagatttt

SEQ ID NO: 1397569 - DNA, 20 bp, Homo sapiens
ttgataaagattttttaata

SEQ ID NO: 1397570 - DNA, 22 bp, Homo sapiens
ttgataaagattttttaataat

SEQ ID NO: 1397571 - DNA, 15 bp, Homo sapiens
ttgatactaagcatt

SEQ ID NO: 1397572 - DNA, 15 bp, Homo sapiens
ttgatagaaatgcca

SEQ ID NO: 1397573 - DNA, 17 bp, Homo sapiens
ttgatgggattctggac

SEQ ID NO: 1397574 - DNA, 20 bp, Homo sapiens
ttgattttagccttctctgt

SEQ ID NO: 1397575 - DNA, 14 bp, Homo sapiens
ttgattttctggat

SEQ ID NO: 1397576 - DNA, 20 bp, Homo sapiens
ttgatttttgcctcttccag

SEQ ID NO: 1397577 - DNA, 20 bp, Homo sapiens
ttgcaaaaactacaaccaat

SEQ ID NO: 1397578 - DNA, 14 bp, Homo sapiens
ttgcaaccgtctgt

SEQ ID NO: 1397579 - DNA, 20 bp, Homo sapiens
ttgcacaggttttcagcaac

SEQ ID NO: 1397580 - DNA, 15 bp, Homo sapiens
ttgcatgtggatcaa

SEQ ID NO: 1397581 - DNA, 15 bp, Homo sapiens
ttgcatttaaaacag

SEQ ID NO: 1397582 - DNA, 19 bp, Homo sapiens
ttgcctccttatttatcaa

SEQ ID NO: 1397583 - DNA, 17 bp, Homo sapiens
ttgcctcttccagtctt

SEQ ID NO: 1397584 - DNA, 14 bp, Homo sapiens
ttgcggttcaggaa

SEQ ID NO: 1397585 - DNA, 13 bp, Homo sapiens
ttgctacataatt

SEQ ID NO: 1397586 - DNA, 16 bp, Homo sapiens
ttgctgaaattttata

SEQ ID NO: 1397587 - DNA, 19 bp, Homo sapiens
ttgctgaaattttatatgc

SEQ ID NO: 1397588 - DNA, 21 bp, Homo sapiens
tttggtccttcaaaggcttgt

SEQ ID NO: 1397589 - DNA, 14 bp, Homo sapiens
tttggtgagaacct

SEQ ID NO: 1397590 - DNA, 14 bp, Homo sapiens
tttggtgataagta

SEQ ID NO: 1397591 - DNA, 19 bp, Homo sapiens
tttggtttcccaagagcta

SEQ ID NO: 1397592 - DNA, 16 bp, Homo sapiens
tttgtaaactcaaaat

SEQ ID NO: 1397593 - DNA, 22 bp, Homo sapiens
tttgtaaactcaaaatatttgt

SEQ ID NO: 1397594 - DNA, 22 bp, Homo sapiens
tttgtagtgatttttatgccac

SEQ ID NO: 1397595 - DNA, 20 bp, Homo sapiens
tttgtgattcaatctgtaaa

SEQ ID NO: 1397596 - DNA, 21 bp, Homo sapiens
tttgttaatttagaaaacttt

SEQ ID NO: 1397597 - DNA, 22 bp, Homo sapiens
tttgttaatttagaaaacttta

SEQ ID NO: 1397598 - DNA, 14 bp, Homo sapiens
tttgtttaaaaagt

SEQ ID NO: 1397599 - DNA, 20 bp, Homo sapiens
tttgtttaaaaagtaataaa

SEQ ID NO: 1397600 - DNA, 17 bp, Homo sapiens
ttttaaaaaagcttaaa

SEQ ID NO: 1397601 - DNA, 21 bp, Homo sapiens
ttttaaaaaagcttaaaactt

SEQ ID NO: 1397602 - DNA, 22 bp, Homo sapiens
ttttaaaaaagcttaaaacttt

SEQ ID NO: 1397603 - DNA, 13 bp, Homo sapiens
ttttaaacagtga

SEQ ID NO: 1397604 - DNA, 12 bp, Homo sapiens
ttttaataaatt

SEQ ID NO: 1397605 - DNA, 12 bp, Homo sapiens
ttttacaagtaa

SEQ ID NO: 1397606 - DNA, 17 bp, Homo sapiens
ttttacaagtaacaaaa

SEQ ID NO: 1397607 - DNA, 23 bp, Homo sapiens
ttttagccttctctgttcatttc

SEQ ID NO: 1397608 - DNA, 16 bp, Homo sapiens
ttttatcatgcatgtc

SEQ ID NO: 1397609 - DNA, 14 bp, Homo sapiens
ttttattttgccaa

SEQ ID NO: 1397610 - DNA, 22 bp, Homo sapiens
ttttcaacagtgaagacagaag

SEQ ID NO: 1397611 - DNA, 18 bp, Homo sapiens
ttttcacattagaagaca

SEQ ID NO: 1397612 - DNA, 23 bp, Homo sapiens
ttttcacctggaagcatttgttt

SEQ ID NO: 1397613 - DNA, 18 bp, Homo sapiens
ttttcagatgtgaaccat

SEQ ID NO: 1397614 - DNA, 16 bp, Homo sapiens
ttttcagcaactcaga

SEQ ID NO: 1397615 - DNA, 18 bp, Homo sapiens
ttttcatacattttctaa

SEQ ID NO: 1397616 - DNA, 21 bp, Homo sapiens
ttttccaacttggctgcagga

SEQ ID NO: 1397617 - DNA, 19 bp, Homo sapiens
ttttccattacatgatctt

SEQ ID NO: 1397618 - DNA, 18 bp, Homo sapiens
ttttcctcttctattttg

SEQ ID NO: 1397619 - DNA, 17 bp, Homo sapiens
ttttcctttgaatcctc

SEQ ID NO: 1397620 - DNA, 18 bp, Homo sapiens
ttttctaagaaacattta

SEQ ID NO: 1397621 - DNA, 20 bp, Homo sapiens
ttttctctaggaaatatact

SEQ ID NO: 1397622 - DNA, 16 bp, Homo sapiens
ttttctttgtgtagct

SEQ ID NO: 1397623 - DNA, 16 bp, Homo sapiens
ttttgatatttctagc

SEQ ID NO: 1397624 - DNA, 21 bp, Homo sapiens
ttttgatttgtactgaaaaat

SEQ ID NO: 1397625 - DNA, 18 bp, Homo sapiens
ttttgcaatcccttaata

SEQ ID NO: 1397626 - DNA, 18 bp, Homo sapiens
ttttgcatttaaaacaga

SEQ ID NO: 1397627 - DNA, 17 bp, Homo sapiens
tttttaaaaaagcttaa

SEQ ID NO: 1397628 - DNA, 22 bp, Homo sapiens
tttttaaaaaagcttaaaactt

SEQ ID NO: 1397629 - DNA, 16 bp, Homo sapiens
tttttaaacaagtatt

SEQ ID NO: 1397630 - DNA, 16 bp, Homo sapiens
tttttaataaatttca

SEQ ID NO: 1397631 - DNA, 17 bp, Homo sapiens
tttttatcatgcatgtc

SEQ ID NO: 1397632 - DNA, 16 bp, Homo sapiens
tttttcatgataatga

SEQ ID NO: 1397633 - DNA, 19 bp, Homo sapiens
tttttccttcaaagtttaa

SEQ ID NO: 1397634 - DNA, 15 bp, Homo sapiens
ttttttaataaattt

SEQ ID NO: 1397635 - DNA, 17 bp, Homo sapiens
tatttatttaaacaaat

SEQ ID NO: 1397636 - DNA, 20 bp, Homo sapiens
tatttattttttttaagtat

SEQ ID NO: 1397637 - DNA, 16 bp, Homo sapiens
tatttcaatgttagcc

SEQ ID NO: 1397638 - DNA, 14 bp, Homo sapiens
tatttcaggattct

SEQ ID NO: 1397639 - DNA, 14 bp, Homo sapiens
tatttgtaatagat

SEQ ID NO: 1397640 - DNA, 15 bp, Homo sapiens
tatttgtaatagatg

SEQ ID NO: 1397641 - DNA, 12 bp, Homo sapiens
tattttaaagaa

SEQ ID NO: 1397642 - DNA, 14 bp, Homo sapiens
tattttaaagaatt

SEQ ID NO: 1397643 - DNA, 14 bp, Homo sapiens
tattttacaatttt

SEQ ID NO: 1397644 - DNA, 13 bp, Homo sapiens
tattttcttggat

SEQ ID NO: 1397645 - DNA, 20 bp, Homo sapiens
tatttttggcagtctgaatt

SEQ ID NO: 1397646 - DNA, 14 bp, Homo sapiens
tcaaaacagattgt

SEQ ID NO: 1397647 - DNA, 19 bp, Homo sapiens
tcaaaacagattgtttgca

SEQ ID NO: 1397648 - DNA, 22 bp, Homo sapiens
tcaaaacattgtgccatgtcaa

SEQ ID NO: 1397649 - DNA, 20 bp, Homo sapiens
tcaaaagggccaaagaacca

SEQ ID NO: 1397650 - DNA, 21 bp, Homo sapiens
tcaaaagggccaaagaaccaa

SEQ ID NO: 1397651 - DNA, 18 bp, Homo sapiens
tcaaaatatttgtacata

SEQ ID NO: 1397652 - DNA, 20 bp, Homo sapiens
tcaaactcctgacctcaggc

SEQ ID NO: 1397653 - DNA, 21 bp, Homo sapiens
tcaaactcctgacctcaggca

SEQ ID NO: 1397654 - DNA, 15 bp, Homo sapiens
tcaaactgaggaatt

SEQ ID NO: 1397655 - DNA, 17 bp, Homo sapiens
tcaaagccggttgcaga

SEQ ID NO: 1397656 - DNA, 18 bp, Homo sapiens
tcaaagtgttttctctga

SEQ ID NO: 1397657 - DNA, 14 bp, Homo sapiens
tcaaagtttaataa

SEQ ID NO: 1397658 - DNA, 12 bp, Homo sapiens
tcaacaaacatt

SEQ ID NO: 1397659 - DNA, 22 bp, Homo sapiens
tcaacagtgaagacagaagttt

SEQ ID NO: 1397660 - DNA, 22 bp, Homo sapiens
tcaacagttacctccaaaaaag

SEQ ID NO: 1397661 - DNA, 19 bp, Homo sapiens
tcaacccctcccctccatc

SEQ ID NO: 1397662 - DNA, 23 bp, Homo sapiens
tcaacccctcccctccatccctg

SEQ ID NO: 1397663 - DNA, 23 bp, Homo sapiens
tcaactctcttattgcctcactt

SEQ ID NO: 1397664 - DNA, 24 bp, Homo sapiens
tcaactctcttattgcctcacttc

SEQ ID NO: 1397665 - DNA, 21 bp, Homo sapiens
tcaacttttcctttgaatcct

SEQ ID NO: 1397666 - DNA, 21 bp, Homo sapiens
tcaagaaagcttcaaactgca

SEQ ID NO: 1397667 - DNA, 16 bp, Homo sapiens
tcaagattgttcctgc

SEQ ID NO: 1397668 - DNA, 16 bp, Homo sapiens
tcaagccccggactca

SEQ ID NO: 1397669 - DNA, 16 bp, Homo sapiens
tcaaggcggtgcttga

SEQ ID NO: 1397670 - DNA, 13 bp, Homo sapiens
tcaagggtcaggc

SEQ ID NO: 1397671 - DNA, 16 bp, Homo sapiens
tcaagggtcaggcctt

SEQ ID NO: 1397672 - DNA, 23 bp, Homo sapiens
tcaagttgttccttaagtcagaa

SEQ ID NO: 1397673 - DNA, 19 bp, Homo sapiens
tcaatcagtctcagaatgt

SEQ ID NO: 1397674 - DNA, 22 bp, Homo sapiens
tcaatcagtctcagaatgtcat

SEQ ID NO: 1397675 - DNA, 17 bp, Homo sapiens
tcaatctgtaaactgtg

SEQ ID NO: 1397676 - DNA, 22 bp, Homo sapiens
tcaattcaaagctgtgtgtttg

SEQ ID NO: 1397677 - DNA, 12 bp, Homo sapiens
tcacattagaag

SEQ ID NO: 1397678 - DNA, 21 bp, Homo sapiens
tcaccagatttgctaatttat

SEQ ID NO: 1397679 - DNA, 22 bp, Homo sapiens
tcaccaggcagcctctgggggg

SEQ ID NO: 1397680 - DNA, 17 bp, Homo sapiens
tcaccctacctgtgcct

SEQ ID NO: 1397681 - DNA, 21 bp, Homo sapiens
tcactagccctcctttttcca

SEQ ID NO: 1397682 - DNA, 15 bp, Homo sapiens
tcactctgagtgttt

SEQ ID NO: 1397683 - DNA, 21 bp, Homo sapiens
tcactgagttttccatggcag

SEQ ID NO: 1397684 - DNA, 18 bp, Homo sapiens
tcactgcaagctccgcct

SEQ ID NO: 1397685 - DNA, 18 bp, Homo sapiens
tcactggaccactgggca

SEQ ID NO: 1397686 - DNA, 18 bp, Homo sapiens
tcactggtagaccaaaat

SEQ ID NO: 1397687 - DNA, 19 bp, Homo sapiens
tcactggtagaccaaaata

SEQ ID NO: 1397688 - DNA, 21 bp, Homo sapiens
tcactgtagaatgatttcatg

SEQ ID NO: 1397689 - DNA, 20 bp, Homo sapiens
tcactgtttagaacacacac

SEQ ID NO: 1397690 - DNA, 16 bp, Homo sapiens
tcacttcataatccag

SEQ ID NO: 1397691 - DNA, 13 bp, Homo sapiens
tcacttgtacaaa

SEQ ID NO: 1397692 - DNA, 15 bp, Homo sapiens
tcacttgtacaaaat

SEQ ID NO: 1397693 - DNA, 13 bp, Homo sapiens
tcagaaaaattaa

SEQ ID NO: 1397694 - DNA, 23 bp, Homo sapiens
tcagaacagcagactcagctctg

SEQ ID NO: 1397695 - DNA, 17 bp, Homo sapiens
tcagaagaaaaagaagc

SEQ ID NO: 1397696 - DNA, 20 bp, Homo sapiens
tctgagctatttcatctatt

SEQ ID NO: 1397697 - DNA, 17 bp, Homo sapiens
tctgagttcctgcatgc

SEQ ID NO: 1397698 - DNA, 21 bp, Homo sapiens
tctgatagggtttgtgacagg

SEQ ID NO: 1397699 - DNA, 22 bp, Homo sapiens
tctgatagggtttgtgacaggg

SEQ ID NO: 1397700 - DNA, 16 bp, Homo sapiens
tctgcaggtccctaat

SEQ ID NO: 1397701 - DNA, 18 bp, Homo sapiens
tctgcaggtccctaataa

SEQ ID NO: 1397702 - DNA, 13 bp, Homo sapiens
tctgccaagccct

SEQ ID NO: 1397703 - DNA, 22 bp, Homo sapiens
tctgctcagacagaacccctac

SEQ ID NO: 1397704 - DNA, 22 bp, Homo sapiens
tctgctcagtaatttgaggaca

SEQ ID NO: 1397705 - DNA, 13 bp, Homo sapiens
tctggacctcccc

SEQ ID NO: 1397706 - DNA, 16 bp, Homo sapiens
tctggagcccactgta

SEQ ID NO: 1397707 - DNA, 18 bp, Homo sapiens
tctggattataaaaatga

SEQ ID NO: 1397708 - DNA, 19 bp, Homo sapiens
tctggcttctggccaggaa

SEQ ID NO: 1397709 - DNA, 17 bp, Homo sapiens
tctgggagtgttctgtt

SEQ ID NO: 1397710 - DNA, 19 bp, Homo sapiens
tctgggagtgttctgtttc

SEQ ID NO: 1397711 - DNA, 20 bp, Homo sapiens
tctgggagtgttctgtttcc

SEQ ID NO: 1397712 - DNA, 13 bp, Homo sapiens
tctggggggtggc

SEQ ID NO: 1397713 - DNA, 18 bp, Homo sapiens
tctggggggtggccaggc

SEQ ID NO: 1397714 - DNA, 19 bp, Homo sapiens
tctggggggtggccaggcc

SEQ ID NO: 1397715 - DNA, 17 bp, Homo sapiens
tctggtgaagctcactt

SEQ ID NO: 1397716 - DNA, 12 bp, Homo sapiens
tctgtaaactgt

SEQ ID NO: 1397717 - DNA, 22 bp, Homo sapiens
tctgtaaactgtgtattccaag

SEQ ID NO: 1397718 - DNA, 19 bp, Homo sapiens
tctgtaaagctaaaataaa

SEQ ID NO: 1397719 - DNA, 22 bp, Homo sapiens
tctgtaagaaacctactgccca

SEQ ID NO: 1397720 - DNA, 22 bp, Homo sapiens
tctgtataaaatgcaaaataaa

SEQ ID NO: 1397721 - DNA, 23 bp, Homo sapiens
tctgtataaaatgcaaaataaat

SEQ ID NO: 1397722 - DNA, 15 bp, Homo sapiens
tctgtctacttgctc

SEQ ID NO: 1397723 - DNA, 15 bp, Homo sapiens
tctgtgcctgaatat

SEQ ID NO: 1397724 - DNA, 18 bp, Homo sapiens
tctgttcatttcctcaaa

SEQ ID NO: 1397725 - DNA, 16 bp, Homo sapiens
tcttaaataagaaact

SEQ ID NO: 1397726 - DNA, 19 bp, Homo sapiens
tcttacaataattctatga

SEQ ID NO: 1397727 - DNA, 23 bp, Homo sapiens
tcttacctgtatgtctccagtat

SEQ ID NO: 1397728 - DNA, 15 bp, Homo sapiens
tcttactatttcaca

SEQ ID NO: 1397729 - DNA, 16 bp, Homo sapiens
tcttattcattttctc

SEQ ID NO: 1397730 - DNA, 18 bp, Homo sapiens
tcttccagtcttcctgac

SEQ ID NO: 1397731 - DNA, 15 bp, Homo sapiens
tcttcctgacacttt

SEQ ID NO: 1397732 - DNA, 19 bp, Homo sapiens
tcttctgaactcaaactga

SEQ ID NO: 1397733 - DNA, 22 bp, Homo sapiens
tcttcttttaaaccattttctt

SEQ ID NO: 1397734 - DNA, 17 bp, Homo sapiens
tcttgaggggaccagga

SEQ ID NO: 1397735 - DNA, 20 bp, Homo sapiens
tcttgatgcctggcggggtg

SEQ ID NO: 1397736 - DNA, 12 bp, Homo sapiens
tctttactttta

SEQ ID NO: 1397737 - DNA, 11 bp, Homo sapiens
tctttatatga

SEQ ID NO: 1397738 - DNA, 15 bp, Homo sapiens
tctttatatgaagaa

SEQ ID NO: 1397739 - DNA, 14 bp, Homo sapiens
tctttatgcttgca

SEQ ID NO: 1397740 - DNA, 16 bp, Homo sapiens
tctttcctccaaactc

SEQ ID NO: 1397741 - DNA, 13 bp, Homo sapiens
tctttcttccaaa

SEQ ID NO: 1397742 - DNA, 13 bp, Homo sapiens
tctttctttattt

SEQ ID NO: 1397743 - DNA, 15 bp, Homo sapiens
tctttgtgtagcttt

SEQ ID NO: 1397744 - DNA, 18 bp, Homo sapiens
tctttgtgtagctttgct

SEQ ID NO: 1397745 - DNA, 14 bp, Homo sapiens
tcttttataggatt

SEQ ID NO: 1397746 - DNA, 22 bp, Homo sapiens
tgaaaatgtgctatactgcata

SEQ ID NO: 1397747 - DNA, 11 bp, Homo sapiens
tgaaactaaaa

SEQ ID NO: 1397748 - DNA, 14 bp, Homo sapiens
tgaaagagaaacac

SEQ ID NO: 1397749 - DNA, 17 bp, Homo sapiens
tgaaatatcctgcttga

SEQ ID NO: 1397750 - DNA, 23 bp, Homo sapiens
tgaacaaagtttaccagaaagca

SEQ ID NO: 1397751 - DNA, 14 bp, Homo sapiens
tgaacaagaattgg

SEQ ID NO: 1397752 - DNA, 14 bp, Homo sapiens
tgaacagaatttat

SEQ ID NO: 1397753 - DNA, 18 bp, Homo sapiens
tgaacctgatgaaaataa

SEQ ID NO: 1397754 - DNA, 23 bp, Homo sapiens
tgaacctgatgaaaataaagaat

SEQ ID NO: 1397755 - DNA, 12 bp, Homo sapiens
tgaacctgccct

SEQ ID NO: 1397756 - DNA, 12 bp, Homo sapiens
tgaactgaacac

SEQ ID NO: 1397757 - DNA, 13 bp, Homo sapiens
tgaactgaacacc

SEQ ID NO: 1397758 - DNA, 15 bp, Homo sapiens
tgaagaaaatcactt

SEQ ID NO: 1397759 - DNA, 21 bp, Homo sapiens
tgaagaaaatcacttaggaaa

SEQ ID NO: 1397760 - DNA, 13 bp, Homo sapiens
tgaagaatgttaa

SEQ ID NO: 1397761 - DNA, 15 bp, Homo sapiens
tgaagcatccaggca

SEQ ID NO: 1397762 - DNA, 20 bp, Homo sapiens
tgaagtattttgctggaata

SEQ ID NO: 1397763 - DNA, 17 bp, Homo sapiens
tgaagttctgaaattta

SEQ ID NO: 1397764 - DNA, 16 bp, Homo sapiens
tgaatccaaactaatc

SEQ ID NO: 1397765 - DNA, 19 bp, Homo sapiens
tgaatgcaaaccatagcac

SEQ ID NO: 1397766 - DNA, 20 bp, Homo sapiens
tgaatggctatgtttttaat

SEQ ID NO: 1397767 - DNA, 18 bp, Homo sapiens
tgaattcctacacatggt

SEQ ID NO: 1397768 - DNA, 13 bp, Homo sapiens
agattgctgaaat

SEQ ID NO: 1397769 - DNA, 19 bp, Homo sapiens
agattttctgctactttgc

SEQ ID NO: 1397770 - DNA, 13 bp, Homo sapiens
agattttttaata

SEQ ID NO: 1397771 - DNA, 16 bp, Homo sapiens
agattttttaataatt

SEQ ID NO: 1397772 - DNA, 14 bp, Homo sapiens
agcaaaaaagaaaa

SEQ ID NO: 1397773 - DNA, 14 bp, Homo sapiens
agcaaaagaagaag

SEQ ID NO: 1397774 - DNA, 13 bp, Homo sapiens
agcaaactctttt

SEQ ID NO: 1397775 - DNA, 17 bp, Homo sapiens
agcaaactcttttccca

SEQ ID NO: 1397776 - DNA, 20 bp, Homo sapiens
agcaaagatatctcatctct

SEQ ID NO: 1397777 - DNA, 18 bp, Homo sapiens
agcaaatcaccacaaact

SEQ ID NO: 1397778 - DNA, 23 bp, Homo sapiens
agcaaatcaccacaaactgtaat

SEQ ID NO: 1397779 - DNA, 17 bp, Homo sapiens
agcaaccagagcactgt

SEQ ID NO: 1397780 - DNA, 15 bp, Homo sapiens
agcaagcattcagaa

SEQ ID NO: 1397781 - DNA, 21 bp, Homo sapiens
agcaagcattcagaagaaaaa

SEQ ID NO: 1397782 - DNA, 18 bp, Homo sapiens
agcacaagttatttaaat

SEQ ID NO: 1397783 - DNA, 19 bp, Homo sapiens
agcacaagttatttaaatc

SEQ ID NO: 1397784 - DNA, 21 bp, Homo sapiens
agcacaagttatttaaatctg

SEQ ID NO: 1397785 - DNA, 16 bp, Homo sapiens
agcacaggctaatttt

SEQ ID NO: 1397786 - DNA, 15 bp, Homo sapiens
agcacctacttacat

SEQ ID NO: 1397787 - DNA, 14 bp, Homo sapiens
agcactgccaccag

SEQ ID NO: 1397788 - DNA, 14 bp, Homo sapiens
agcaggaggccaat

SEQ ID NO: 1397789 - DNA, 17 bp, Homo sapiens
agcaggaggccaataaa

SEQ ID NO: 1397790 - DNA, 22 bp, Homo sapiens
agcaggaggccaataaaaagtt

SEQ ID NO: 1397791 - DNA, 23 bp, Homo sapiens
agcaggaggccaataaaaagttc

SEQ ID NO: 1397792 - DNA, 16 bp, Homo sapiens
agcagggactgtaaac

SEQ ID NO: 1397793 - DNA, 13 bp, Homo sapiens
agctcttcatgtt

SEQ ID NO: 1397794 - DNA, 16 bp, Homo sapiens
agctcttcatgtttca

SEQ ID NO: 1397795 - DNA, 13 bp, Homo sapiens
agctgactcacac

SEQ ID NO: 1397796 - DNA, 16 bp, Homo sapiens
agctgagcaaatcacc

SEQ ID NO: 1397797 - DNA, 20 bp, Homo sapiens
agctgagcaaatcaccacaa

SEQ ID NO: 1397798 - DNA, 13 bp, Homo sapiens
agctgatcagttt

SEQ ID NO: 1397799 - DNA, 17 bp, Homo sapiens
agctgctccccacgtca

SEQ ID NO: 1397800 - DNA, 19 bp, Homo sapiens
agctggacatgctttggca

SEQ ID NO: 1397801 - DNA, 15 bp, Homo sapiens
agctggcattacagc

SEQ ID NO: 1397802 - DNA, 16 bp, Homo sapiens
agctgtgtggcagtct

SEQ ID NO: 1397803 - DNA, 13 bp, Homo sapiens
agcttaaaacttt

SEQ ID NO: 1397804 - DNA, 12 bp, Homo sapiens
agctttccctgc

SEQ ID NO: 1397805 - DNA, 16 bp, Homo sapiens
agctttgctaccaaag

SEQ ID NO: 1397806 - DNA, 13 bp, Homo sapiens
aggaaaataagtg

SEQ ID NO: 1397807 - DNA, 19 bp, Homo sapiens
aggaaaataagtgaaattt

SEQ ID NO: 1397808 - DNA, 14 bp, Homo sapiens
aggaaaattgaatg

SEQ ID NO: 1397809 - DNA, 16 bp, Homo sapiens
aggaaaattgaatgca

SEQ ID NO: 1397810 - DNA, 17 bp, Homo sapiens
aggaagattactcagta

SEQ ID NO: 1397811 - DNA, 22 bp, Homo sapiens
aggaatatatatggaataagtg

SEQ ID NO: 1397812 - DNA, 14 bp, Homo sapiens
aggacaaccattcc

SEQ ID NO: 1397813 - DNA, 13 bp, Homo sapiens
aggacccagggct

SEQ ID NO: 1397814 - DNA, 14 bp, Homo sapiens
aggacccagggctc

SEQ ID NO: 1397815 - DNA, 17 bp, Homo sapiens
aggactccttaaatttg

SEQ ID NO: 1397816 - DNA, 15 bp, Homo sapiens
aggagaatgagcctc

SEQ ID NO: 1397817 - DNA, 18 bp, Homo sapiens
aggagacacacctgaggc

SEQ ID NO: 1397818 - DNA, 15 bp, Homo sapiens
aggagacccacctga

SEQ ID NO: 1397819 - DNA, 14 bp, Homo sapiens
aggagagagttgaa

SEQ ID NO: 1397820 - DNA, 18 bp, Homo sapiens
aggaggacccagggctct

SEQ ID NO: 1397821 - DNA, 13 bp, Homo sapiens
aggaggccaataa

SEQ ID NO: 1397822 - DNA, 18 bp, Homo sapiens
aggaggccaataaaaagt

SEQ ID NO: 1397823 - DNA, 14 bp, Homo sapiens
aggagtcactgaga

SEQ ID NO: 1397824 - DNA, 16 bp, Homo sapiens
aggagtcactgagacc

SEQ ID NO: 1397825 - DNA, 14 bp, Homo sapiens
aggatagagactgg

SEQ ID NO: 1397826 - DNA, 19 bp, Homo sapiens
aggatcccatgagctcctt

SEQ ID NO: 1397827 - DNA, 18 bp, Homo sapiens
aggatctcaccaggcagc

SEQ ID NO: 1397828 - DNA, 23 bp, Homo sapiens
aggatctcaccaggcagcctctg

SEQ ID NO: 1397829 - DNA, 22 bp, Homo sapiens
aggatgagggaaaagaaaaaga

SEQ ID NO: 1397830 - DNA, 21 bp, Homo sapiens
aggatgtgtcccatctaggga

SEQ ID NO: 1397831 - DNA, 22 bp, Homo sapiens
aggatgttctggacctccccct

SEQ ID NO: 1397832 - DNA, 21 bp, Homo sapiens
aggattttttttaatgtttaa

SEQ ID NO: 1397833 - DNA, 19 bp, Homo sapiens
aggcaaaatccttgcttat

SEQ ID NO: 1397834 - DNA, 18 bp, Homo sapiens
aggcaccaaaagaagtaa

SEQ ID NO: 1397835 - DNA, 13 bp, Homo sapiens
aggcagcctctgg

SEQ ID NO: 1397836 - DNA, 22 bp, Homo sapiens
aggcagcctctggggggtggcc

SEQ ID NO: 1397837 - DNA, 19 bp, Homo sapiens
aggcaggattggggaagag

SEQ ID NO: 1397838 - DNA, 22 bp, Homo sapiens
aggcattaaattttagcaaaga

SEQ ID NO: 1397839 - DNA, 12 bp, Homo sapiens
aggccaataaaa

SEQ ID NO: 1397840 - DNA, 16 bp, Homo sapiens
aggccaataaaaagtt

SEQ ID NO: 1397841 - DNA, 17 bp, Homo sapiens
aggcccccacctggctc

SEQ ID NO: 1397842 - DNA, 14 bp, Homo sapiens
aggccgggaaaaag

SEQ ID NO: 1397843 - DNA, 18 bp, Homo sapiens
aggccgggaaaaagccca

SEQ ID NO: 1397844 - DNA, 20 bp, Homo sapiens
aggccgtgacgtctgggtgg

SEQ ID NO: 1397845 - DNA, 21 bp, Homo sapiens
aggccgtgacgtctgggtggc

SEQ ID NO: 1397846 - DNA, 23 bp, Homo sapiens
aggcctcctggctgtctgaggct

SEQ ID NO: 1397847 - DNA, 20 bp, Homo sapiens
aggccttgcggctcctcagg

SEQ ID NO: 1397848 - DNA, 16 bp, Homo sapiens
aggccttttggaatgt

SEQ ID NO: 1397849 - DNA, 18 bp, Homo sapiens
aggcgtgagccaccatgc

SEQ ID NO: 1397850 - DNA, 14 bp, Homo sapiens
aggctaagctgccg

SEQ ID NO: 1397851 - DNA, 12 bp, Homo sapiens
aggctaattttt

SEQ ID NO: 1397852 - DNA, 16 bp, Homo sapiens
aggctagggtggggag

SEQ ID NO: 1397853 - DNA, 20 bp, Homo sapiens
aggctcagagggtgtcctgc

SEQ ID NO: 1397854 - DNA, 13 bp, Homo sapiens
aggctcagcccta

SEQ ID NO: 1397855 - DNA, 22 bp, Homo sapiens
aggctcagccctagccctcagc

SEQ ID NO: 1397856 - DNA, 14 bp, Homo sapiens
aggctctggagccc

SEQ ID NO: 1397857 - DNA, 21 bp, Homo sapiens
aggctgggtcgccctggactg

SEQ ID NO: 1397858 - DNA, 18 bp, Homo sapiens
aggctgtgtttggctttc

SEQ ID NO: 1397859 - DNA, 20 bp, Homo sapiens
aggctgtgtttggctttcag

SEQ ID NO: 1397860 - DNA, 15 bp, Homo sapiens
agggaaggatcccat

SEQ ID NO: 1397861 - DNA, 22 bp, Homo sapiens
agggaaggatcccatgagctcc

SEQ ID NO: 1397862 - DNA, 13 bp, Homo sapiens
agggactgagaga

SEQ ID NO: 1397863 - DNA, 16 bp, Homo sapiens
agggagccatgtttca

SEQ ID NO: 1397864 - DNA, 22 bp, Homo sapiens
agggatgactaaaatatttatt

SEQ ID NO: 1397865 - DNA, 12 bp, Homo sapiens
aggggaccagga

SEQ ID NO: 1397866 - DNA, 13 bp, Homo sapiens
aggggcctgccca

SEQ ID NO: 1397867 - DNA, 20 bp, Homo sapiens
agggggcctttaaagactta

SEQ ID NO: 1397868 - DNA, 23 bp, Homo sapiens
agggggtgattagagggaggaga

SEQ ID NO: 1397869 - DNA, 14 bp, Homo sapiens
agggtaccagcaga

SEQ ID NO: 1397870 - DNA, 20 bp, Homo sapiens
agggtaccctttggggagca

SEQ ID NO: 1397871 - DNA, 18 bp, Homo sapiens
agggtaggcaggattggg

SEQ ID NO: 1397872 - DNA, 22 bp, Homo sapiens
agggtttccctactgaagccct

SEQ ID NO: 1397873 - DNA, 15 bp, Homo sapiens
aggtaaaatgccatg

SEQ ID NO: 1397874 - DNA, 14 bp, Homo sapiens
aaactcctgcctgt

SEQ ID NO: 1397875 - DNA, 14 bp, Homo sapiens
aaactgaggaattt

SEQ ID NO: 1397876 - DNA, 18 bp, Homo sapiens
aaactgaggaattttctt

SEQ ID NO: 1397877 - DNA, 20 bp, Homo sapiens
aaactgtgtacataactgaa

SEQ ID NO: 1397878 - DNA, 21 bp, Homo sapiens
aaactgtgtacataactgaaa

SEQ ID NO: 1397879 - DNA, 20 bp, Homo sapiens
aaacttcaaggaaaataagt

SEQ ID NO: 1397880 - DNA, 19 bp, Homo sapiens
aaacttttttatttaaaaa

SEQ ID NO: 1397881 - DNA, 17 bp, Homo sapiens
aaagaatggcagaaaag

SEQ ID NO: 1397882 - DNA, 13 bp, Homo sapiens
aaagacttaagat

SEQ ID NO: 1397883 - DNA, 12 bp, Homo sapiens
aaagagaaacac

SEQ ID NO: 1397884 - DNA, 13 bp, Homo sapiens
aaagagaaacacg

SEQ ID NO: 1397885 - DNA, 16 bp, Homo sapiens
aaagagaaatcagaaa

SEQ ID NO: 1397886 - DNA, 16 bp, Homo sapiens
aaagatatttttatct

SEQ ID NO: 1397887 - DNA, 19 bp, Homo sapiens
aaagatgcttttaacagag

SEQ ID NO: 1397888 - DNA, 22 bp, Homo sapiens
aaagattttttaataatttaga

SEQ ID NO: 1397889 - DNA, 20 bp, Homo sapiens
aaagcaagcattcagaagaa

SEQ ID NO: 1397890 - DNA, 19 bp, Homo sapiens
aaagcagcctcattctgag

SEQ ID NO: 1397891 - DNA, 15 bp, Homo sapiens
aaagccaaacatata

SEQ ID NO: 1397892 - DNA, 22 bp, Homo sapiens
aaagccaaggagtcactgagac

SEQ ID NO: 1397893 - DNA, 13 bp, Homo sapiens
aaagccatgctgg

SEQ ID NO: 1397894 - DNA, 11 bp, Homo sapiens
aaagccttctt

SEQ ID NO: 1397895 - DNA, 18 bp, Homo sapiens
aaagccttcttttggggg

SEQ ID NO: 1397896 - DNA, 14 bp, Homo sapiens
aaagctaaaataaa

SEQ ID NO: 1397897 - DNA, 14 bp, Homo sapiens
aaagctagaattga

SEQ ID NO: 1397898 - DNA, 20 bp, Homo sapiens
aaagctagaattgagtgttt

SEQ ID NO: 1397899 - DNA, 19 bp, Homo sapiens
aaagcttaaaactttgaag

SEQ ID NO: 1397900 - DNA, 19 bp, Homo sapiens
aaaggattaagatacactc

SEQ ID NO: 1397901 - DNA, 19 bp, Homo sapiens
aaaggtttatgaaaaagaa

SEQ ID NO: 1397902 - DNA, 22 bp, Homo sapiens
aaaggtttatgaaaaagaagaa

SEQ ID NO: 1397903 - DNA, 22 bp, Homo sapiens
aaagtatacttttgtttcaggg

SEQ ID NO: 1397904 - DNA, 20 bp, Homo sapiens
aaagtcagcattttcttaga

SEQ ID NO: 1397905 - DNA, 19 bp, Homo sapiens
aaagtgactaatggcatga

SEQ ID NO: 1397906 - DNA, 21 bp, Homo sapiens
aaagtgttctgtgtccttcta

SEQ ID NO: 1397907 - DNA, 17 bp, Homo sapiens
aaagtgttttctctgaa

SEQ ID NO: 1397908 - DNA, 14 bp, Homo sapiens
aaagttaaatgtgt

SEQ ID NO: 1397909 - DNA, 21 bp, Homo sapiens
aaagttaaatgtgtgtaaaaa

SEQ ID NO: 1397910 - DNA, 17 bp, Homo sapiens
aaagttgataaagattt

SEQ ID NO: 1397911 - DNA, 15 bp, Homo sapiens
aaagtttaataaatt

SEQ ID NO: 1397912 - DNA, 18 bp, Homo sapiens
aaataaacaaataacaat

SEQ ID NO: 1397913 - DNA, 13 bp, Homo sapiens
aaataagtttttg

SEQ ID NO: 1397914 - DNA, 14 bp, Homo sapiens
aaatagtttggata

SEQ ID NO: 1397915 - DNA, 23 bp, Homo sapiens
aaatatacttttacaagtaacaa

SEQ ID NO: 1397916 - DNA, 20 bp, Homo sapiens
aaatatccctcctgttggga

SEQ ID NO: 1397917 - DNA, 17 bp, Homo sapiens
aaatatgaagaactgag

SEQ ID NO: 1397918 - DNA, 15 bp, Homo sapiens
aaatatgatgttaaa

SEQ ID NO: 1397919 - DNA, 13 bp, Homo sapiens
aaatatgtaccaa

SEQ ID NO: 1397920 - DNA, 13 bp, Homo sapiens
aaatatttatttt

SEQ ID NO: 1397921 - DNA, 14 bp, Homo sapiens
aaatatttgtacat

SEQ ID NO: 1397922 - DNA, 19 bp, Homo sapiens
aaatattttaaagaattgt

SEQ ID NO: 1397923 - DNA, 23 bp, Homo sapiens
aaatcaattactggtccaaaaga

SEQ ID NO: 1397924 - DNA, 15 bp, Homo sapiens
aaatcagaaaaatta

SEQ ID NO: 1397925 - DNA, 19 bp, Homo sapiens
aaatccttagatctggcat

SEQ ID NO: 1397926 - DNA, 20 bp, Homo sapiens
aaatcgaatgaaattaactg

SEQ ID NO: 1397927 - DNA, 22 bp, Homo sapiens
aaatcttggttgatgccaaaaa

SEQ ID NO: 1397928 - DNA, 20 bp, Homo sapiens
aaatgaacataatgaacaga

SEQ ID NO: 1397929 - DNA, 17 bp, Homo sapiens
aaatgattactaaggaa

SEQ ID NO: 1397930 - DNA, 20 bp, Homo sapiens
aaatgcattataggatcatt

SEQ ID NO: 1397931 - DNA, 20 bp, Homo sapiens
aaatgccaaaaacaaaatgg

SEQ ID NO: 1397932 - DNA, 16 bp, Homo sapiens
aaatggccatttgctt

SEQ ID NO: 1397933 - DNA, 22 bp, Homo sapiens
aaatgtaaagatatttttatct

SEQ ID NO: 1397934 - DNA, 20 bp, Homo sapiens
aaatgtatcatagaaatgta

SEQ ID NO: 1397935 - DNA, 22 bp, Homo sapiens
aaattaactaggttgctacttt

SEQ ID NO: 1397936 - DNA, 15 bp, Homo sapiens
aaattaagactttaa

SEQ ID NO: 1397937 - DNA, 16 bp, Homo sapiens
aaattacacccaaaga

SEQ ID NO: 1397938 - DNA, 18 bp, Homo sapiens
aaattattaatttatgca

SEQ ID NO: 1397939 - DNA, 12 bp, Homo sapiens
aaattattgttt

SEQ ID NO: 1397940 - DNA, 20 bp, Homo sapiens
aaattattgtttttcttttt

SEQ ID NO: 1397941 - DNA, 14 bp, Homo sapiens
aaattcaacaaaca

SEQ ID NO: 1397942 - DNA, 15 bp, Homo sapiens
aaattctgctcagat

SEQ ID NO: 1397943 - DNA, 23 bp, Homo sapiens
aaattcttctgaactcaaactga

SEQ ID NO: 1397944 - DNA, 15 bp, Homo sapiens
aaattgaatgcaaac

SEQ ID NO: 1397945 - DNA, 22 bp, Homo sapiens
aaatttaactgcctaaaatgtt

SEQ ID NO: 1397946 - DNA, 19 bp, Homo sapiens
aacaaagagttcaagaaat

SEQ ID NO: 1397947 - DNA, 22 bp, Homo sapiens
aacaagatatttatatgttatt

SEQ ID NO: 1397948 - DNA, 23 bp, Homo sapiens
aacaagtatttgttaatttagaa

SEQ ID NO: 1397949 - DNA, 22 bp, Homo sapiens
aacacaggcaaaatccttgctt

SEQ ID NO: 1397950 - DNA, 15 bp, Homo sapiens
aacaccaacataaaa

SEQ ID NO: 1397951 - DNA, 15 bp, Homo sapiens
aacaccattgaaggc

SEQ ID NO: 1397952 - DNA, 13 bp, Homo sapiens
aacacctcccagg

SEQ ID NO: 1397953 - DNA, 14 bp, Homo sapiens
aacacctcctagca

SEQ ID NO: 1397954 - DNA, 21 bp, Homo sapiens
aacacgtatcccacctgacat

SEQ ID NO: 1397955 - DNA, 16 bp, Homo sapiens
aacagaaacaaaaaca

SEQ ID NO: 1397956 - DNA, 18 bp, Homo sapiens
aacagaacatagacagaa

SEQ ID NO: 1397957 - DNA, 17 bp, Homo sapiens
aacaggtggttcttttt

SEQ ID NO: 1397958 - DNA, 21 bp, Homo sapiens
aacagtgagcctgaattttgt

SEQ ID NO: 1397959 - DNA, 18 bp, Homo sapiens
aacagttttcctatgctt

SEQ ID NO: 1397960 - DNA, 20 bp, Homo sapiens
aacagttttcctatgctttg

SEQ ID NO: 1397961 - DNA, 13 bp, Homo sapiens
aacataaaaatga

SEQ ID NO: 1397962 - DNA, 14 bp, Homo sapiens
aacataaaaatgat

SEQ ID NO: 1397963 - DNA, 17 bp, Homo sapiens
aacataatgaacagaat

SEQ ID NO: 1397964 - DNA, 20 bp, Homo sapiens
aacataatgaacagaattta

SEQ ID NO: 1397965 - DNA, 18 bp, Homo sapiens
aacatctttttcctccct

SEQ ID NO: 1397966 - DNA, 12 bp, Homo sapiens
aacattatcaca

SEQ ID NO: 1397967 - DNA, 18 bp, Homo sapiens
aaccagagcactgtatac

SEQ ID NO: 1397968 - DNA, 19 bp, Homo sapiens
aaccagttatttttattat

SEQ ID NO: 1397969 - DNA, 23 bp, Homo sapiens
aaccagttatttttattattgag

SEQ ID NO: 1397970 - DNA, 12 bp, Homo sapiens
aaccatttcctc

SEQ ID NO: 1397971 - DNA, 15 bp, Homo sapiens
aaccatttcctcaga

SEQ ID NO: 1397972 - DNA, 12 bp, Homo sapiens
aacccctgggta

SEQ ID NO: 1397973 - DNA, 18 bp, Homo sapiens
aaccgtctgttatgctgt

SEQ ID NO: 1397974 - DNA, 22 bp, Homo sapiens
aaccgtctgttatgctgtgaca

SEQ ID NO: 1397975 - DNA, 18 bp, Homo sapiens
aacctcaactgcctactc

SEQ ID NO: 1397976 - DNA, 11 bp, Homo sapiens
aacctcagcta

SEQ ID NO: 1397977 - DNA, 17 bp, Homo sapiens
aacctcagctagctctg

SEQ ID NO: 1397978 - DNA, 18 bp, Homo sapiens
aacctcagtaatttagaa

SEQ ID NO: 1397979 - DNA, 16 bp, Homo sapiens
aacctgacccctgctc

SEQ ID NO: 1397980 - DNA, 19 bp, Homo sapiens
aacctgatgaaaataaaga

SEQ ID NO: 1397981 - DNA, 20 bp, Homo sapiens
aacctgatgaaaataaagaa

SEQ ID NO: 1397982 - DNA, 17 bp, Homo sapiens
aaccttaatttattatt

SEQ ID NO: 1397983 - DNA, 18 bp, Homo sapiens
aaccttaatttattatta

SEQ ID NO: 1397984 - DNA, 16 bp, Homo sapiens
aacctttcttcaccaa

SEQ ID NO: 1397985 - DNA, 22 bp, Homo sapiens
aactaaaattttctaagattaa

SEQ ID NO: 1397986 - DNA, 21 bp, Homo sapiens
aactaagttttttacttccac

SEQ ID NO: 1397987 - DNA, 12 bp, Homo sapiens
aactaatgcctt

SEQ ID NO: 1397988 - DNA, 20 bp, Homo sapiens
aactacaaccaatggaatgt

SEQ ID NO: 1397989 - DNA, 22 bp, Homo sapiens
aactatccaattaaaattaagg

SEQ ID NO: 1397990 - DNA, 11 bp, Homo sapiens
aactatcttgg

SEQ ID NO: 1397991 - DNA, 22 bp, Homo sapiens
aactcaaactgaggaatttcac

SEQ ID NO: 1397992 - DNA, 15 bp, Homo sapiens
aactcattagactgg

SEQ ID NO: 1397993 - DNA, 13 bp, Homo sapiens
aactcctgcctgt

SEQ ID NO: 1397994 - DNA, 21 bp, Homo sapiens
aactcgtatagcatgcatctg

SEQ ID NO: 1397995 - DNA, 15 bp, Homo sapiens
aactcgttttttaca

SEQ ID NO: 1397996 - DNA, 21 bp, Homo sapiens
aactctcttattgcctcactt

SEQ ID NO: 1397997 - DNA, 16 bp, Homo sapiens
aactctgcttgatttt

SEQ ID NO: 1397998 - DNA, 13 bp, Homo sapiens
aactgaaaattat

SEQ ID NO: 1397999 - DNA, 17 bp, Homo sapiens
aactgaaaattatttaa

SEQ ID NO: 1398000 - DNA, 13 bp, Homo sapiens
aactgaggaattt

SEQ ID NO: 1398001 - DNA, 18 bp, Homo sapiens
aactgaggaattttcttt

SEQ ID NO: 1398002 - DNA, 13 bp, Homo sapiens
aactgcctaaaat

SEQ ID NO: 1398003 - DNA, 12 bp, Homo sapiens
aactggaaagaa

SEQ ID NO: 1398004 - DNA, 13 bp, Homo sapiens
acactctgtaatt

SEQ ID NO: 1398005 - DNA, 20 bp, Homo sapiens
acacttattggaactctgct

SEQ ID NO: 1398006 - DNA, 12 bp, Homo sapiens
acagaaacaaaa

SEQ ID NO: 1398007 - DNA, 17 bp, Homo sapiens
acagaaacaaaaacact

SEQ ID NO: 1398008 - DNA, 16 bp, Homo sapiens
acagaacatagacaga

SEQ ID NO: 1398009 - DNA, 15 bp, Homo sapiens
acagaagttgtgaaa

SEQ ID NO: 1398010 - DNA, 21 bp, Homo sapiens
acagaatacaagccactacct

SEQ ID NO: 1398011 - DNA, 13 bp, Homo sapiens
acagaattcaaca

SEQ ID NO: 1398012 - DNA, 23 bp, Homo sapiens
acagactgcgatttgtcccaggt

SEQ ID NO: 1398013 - DNA, 14 bp, Homo sapiens
acagataactgaaa

SEQ ID NO: 1398014 - DNA, 17 bp, Homo sapiens
acagcaacaatttatga

SEQ ID NO: 1398015 - DNA, 15 bp, Homo sapiens
acagcaattcctcag

SEQ ID NO: 1398016 - DNA, 13 bp, Homo sapiens
acagcagactcag

SEQ ID NO: 1398017 - DNA, 18 bp, Homo sapiens
acagcagactcagctctg

SEQ ID NO: 1398018 - DNA, 19 bp, Homo sapiens
acagcagactcagctctga

SEQ ID NO: 1398019 - DNA, 17 bp, Homo sapiens
acagcctgacaacattt

SEQ ID NO: 1398020 - DNA, 18 bp, Homo sapiens
acagctcagaagtttctt

SEQ ID NO: 1398021 - DNA, 22 bp, Homo sapiens
acaggagacccacctgaggctc

SEQ ID NO: 1398022 - DNA, 19 bp, Homo sapiens
acaggatgtgtttgctttc

SEQ ID NO: 1398023 - DNA, 21 bp, Homo sapiens
acaggatgtgtttgctttctg

SEQ ID NO: 1398024 - DNA, 22 bp, Homo sapiens
acaggtagaattatctaattta

SEQ ID NO: 1398025 - DNA, 15 bp, Homo sapiens
acaggttagctgctc

SEQ ID NO: 1398026 - DNA, 15 bp, Homo sapiens
acagtctaaagctgg

SEQ ID NO: 1398027 - DNA, 21 bp, Homo sapiens
acagtgaagacagaagtttgc

SEQ ID NO: 1398028 - DNA, 22 bp, Homo sapiens
acagtgagacagtctggaaagt

SEQ ID NO: 1398029 - DNA, 12 bp, Homo sapiens
acagtgagcctg

SEQ ID NO: 1398030 - DNA, 18 bp, Homo sapiens
acagtgagcctgaatttt

SEQ ID NO: 1398031 - DNA, 21 bp, Homo sapiens
acagtgagcctgaattttgtt

SEQ ID NO: 1398032 - DNA, 19 bp, Homo sapiens
acagtgttgaaaatgttca

SEQ ID NO: 1398033 - DNA, 21 bp, Homo sapiens
acagtgttgaaaatgttcaga

SEQ ID NO: 1398034 - DNA, 12 bp, Homo sapiens
acagttcaagaa

SEQ ID NO: 1398035 - DNA, 15 bp, Homo sapiens
acagtttatttgttg

SEQ ID NO: 1398036 - DNA, 12 bp, Homo sapiens
acataactgaaa

SEQ ID NO: 1398037 - DNA, 23 bp, Homo sapiens
acataatcttctgccttctcatg

SEQ ID NO: 1398038 - DNA, 19 bp, Homo sapiens
acataatgaacagaattta

SEQ ID NO: 1398039 - DNA, 23 bp, Homo sapiens
acataattatccaggaagggaat

SEQ ID NO: 1398040 - DNA, 18 bp, Homo sapiens
acataattcactctgagt

SEQ ID NO: 1398041 - DNA, 20 bp, Homo sapiens
acataattcactctgagtgt

SEQ ID NO: 1398042 - DNA, 21 bp, Homo sapiens
acatacacctatgtcatttca

SEQ ID NO: 1398043 - DNA, 19 bp, Homo sapiens
acatacagaattactgtaa

SEQ ID NO: 1398044 - DNA, 16 bp, Homo sapiens
acatagacagaagaaa

SEQ ID NO: 1398045 - DNA, 19 bp, Homo sapiens
acatagtattcatgactat

SEQ ID NO: 1398046 - DNA, 13 bp, Homo sapiens
acatatgtaaaat

SEQ ID NO: 1398047 - DNA, 16 bp, Homo sapiens
acatcacttgtacaaa

SEQ ID NO: 1398048 - DNA, 15 bp, Homo sapiens
acatcattactataa

SEQ ID NO: 1398049 - DNA, 22 bp, Homo sapiens
acatgcacttggctgcataaat

SEQ ID NO: 1398050 - DNA, 16 bp, Homo sapiens
acatgcattactgcat

SEQ ID NO: 1398051 - DNA, 20 bp, Homo sapiens
acatgcattactgcatgcac

SEQ ID NO: 1398052 - DNA, 19 bp, Homo sapiens
acatgctaagagaagtaga

SEQ ID NO: 1398053 - DNA, 24 bp, Homo sapiens
acatgctaagagaagtagaaatca

SEQ ID NO: 1398054 - DNA, 18 bp, Homo sapiens
acatgtatctatgcattt

SEQ ID NO: 1398055 - DNA, 21 bp, Homo sapiens
acatgtatctatgcattttct

SEQ ID NO: 1398056 - DNA, 19 bp, Homo sapiens
acatgtccttctgagcccg

SEQ ID NO: 1398057 - DNA, 22 bp, Homo sapiens
acattaaagaagggttgagctg

SEQ ID NO: 1398058 - DNA, 22 bp, Homo sapiens
acattccaactcgtatagcatg

SEQ ID NO: 1398059 - DNA, 16 bp, Homo sapiens
acattttaaaagtgcc

SEQ ID NO: 1398060 - DNA, 16 bp, Homo sapiens
acattttaaacacatt

SEQ ID NO: 1398061 - DNA, 19 bp, Homo sapiens
acattttctaagaaacatt

SEQ ID NO: 1398062 - DNA, 15 bp, Homo sapiens
accaaagaagaaagt

SEQ ID NO: 1398063 - DNA, 19 bp, Homo sapiens
accaacctgaagacaccgt

SEQ ID NO: 1398064 - DNA, 21 bp, Homo sapiens
accaagccccttggccctctc

SEQ ID NO: 1398065 - DNA, 20 bp, Homo sapiens
accaagctgtgaccctcaat

SEQ ID NO: 1398066 - DNA, 23 bp, Homo sapiens
accaatagggctgagctctctgt

SEQ ID NO: 1398067 - DNA, 18 bp, Homo sapiens
accacaaactgtaataca

SEQ ID NO: 1398068 - DNA, 14 bp, Homo sapiens
accacactgttgag

SEQ ID NO: 1398069 - DNA, 17 bp, Homo sapiens
accacactgttgagttg

SEQ ID NO: 1398070 - DNA, 14 bp, Homo sapiens
accagagcactgta

SEQ ID NO: 1398071 - DNA, 15 bp, Homo sapiens
accagagcactgtat

SEQ ID NO: 1398072 - DNA, 16 bp, Homo sapiens
accagagcactgtata

SEQ ID NO: 1398073 - DNA, 20 bp, Homo sapiens
accagagcactgtatacccc

SEQ ID NO: 1398074 - DNA, 21 bp, Homo sapiens
accaggcaccaaaagaagtaa

SEQ ID NO: 1398075 - DNA, 16 bp, Homo sapiens
accatgcaaatgctat

SEQ ID NO: 1398076 - DNA, 22 bp, Homo sapiens
accatgtcaagggttcaagatt

SEQ ID NO: 1398077 - DNA, 13 bp, Homo sapiens
accattaaccaga

SEQ ID NO: 1398078 - DNA, 13 bp, Homo sapiens
accattgaaggct

SEQ ID NO: 1398079 - DNA, 17 bp, Homo sapiens
acccagtaactcatctg

SEQ ID NO: 1398080 - DNA, 16 bp, Homo sapiens
acccatattgtaaaac

SEQ ID NO: 1398081 - DNA, 20 bp, Homo sapiens
acccatattgtaaaacaggt

SEQ ID NO: 1398082 - DNA, 23 bp, Homo sapiens
acccatttaaatttttttcctta

SEQ ID NO: 1398083 - DNA, 14 bp, Homo sapiens
accccagacactgg

SEQ ID NO: 1398084 - DNA, 14 bp, Homo sapiens
acccccagctttgc

SEQ ID NO: 1398085 - DNA, 16 bp, Homo sapiens
acccccagctttgcta

SEQ ID NO: 1398086 - DNA, 13 bp, Homo sapiens
accccctgtgcct

SEQ ID NO: 1398087 - DNA, 15 bp, Homo sapiens
accccgacttttgtt

SEQ ID NO: 1398088 - DNA, 16 bp, Homo sapiens
acccctctaccaagct

SEQ ID NO: 1398089 - DNA, 16 bp, Homo sapiens
accctacctgtgcctg

SEQ ID NO: 1398090 - DNA, 17 bp, Homo sapiens
accctacctgtgcctga

SEQ ID NO: 1398091 - DNA, 14 bp, Homo sapiens
accctacttctttt

SEQ ID NO: 1398092 - DNA, 18 bp, Homo sapiens
accctcatacacagaaac

SEQ ID NO: 1398093 - DNA, 13 bp, Homo sapiens
accctcatctttc

SEQ ID NO: 1398094 - DNA, 17 bp, Homo sapiens
acccttggttcctaact

SEQ ID NO: 1398095 - DNA, 16 bp, Homo sapiens
accgctaaaagaaact

SEQ ID NO: 1398096 - DNA, 15 bp, Homo sapiens
accggcctgccagga

SEQ ID NO: 1398097 - DNA, 23 bp, Homo sapiens
acctaaacatagaaattgcctga

SEQ ID NO: 1398098 - DNA, 17 bp, Homo sapiens
acctaaagaaaaacaaa

SEQ ID NO: 1398099 - DNA, 17 bp, Homo sapiens
acctaatctctgtaaag

SEQ ID NO: 1398100 - DNA, 24 bp, Homo sapiens
acctacctgttgagcatcacagaa

SEQ ID NO: 1398101 - DNA, 20 bp, Homo sapiens
acctactttgactttttgca

SEQ ID NO: 1398102 - DNA, 12 bp, Homo sapiens
acctaggctagg

SEQ ID NO: 1398103 - DNA, 17 bp, Homo sapiens
acctaggctagggtggg

SEQ ID NO: 1398104 - DNA, 19 bp, Homo sapiens
acctatgatattttctgtg

SEQ ID NO: 1398105 - DNA, 19 bp, Homo sapiens
acctcaatcagtctcagaa

SEQ ID NO: 1398106 - DNA, 21 bp, Homo sapiens
acctcaatcagtctcagaatg

SEQ ID NO: 1398107 - DNA, 17 bp, Homo sapiens
acctcagtaatttagaa

SEQ ID NO: 1398108 - DNA, 21 bp, Homo sapiens
acctcagtaatttagaaatca

SEQ ID NO: 1398109 - DNA, 23 bp, Homo sapiens
acctcagtgccttcctgtttttc

SEQ ID NO: 1398110 - DNA, 21 bp, Homo sapiens
acctccaaaaaagaaacattg

SEQ ID NO: 1398111 - DNA, 15 bp, Homo sapiens
acctccacctcctgg

SEQ ID NO: 1398112 - DNA, 17 bp, Homo sapiens
acctctcccctggaact

SEQ ID NO: 1398113 - DNA, 18 bp, Homo sapiens
acctggaagcatttgttt

SEQ ID NO: 1398114 - DNA, 22 bp, Homo sapiens
acctgggagaaatctggcttct

SEQ ID NO: 1398115 - DNA, 21 bp, Homo sapiens
acctggggaccccccttgccc

SEQ ID NO: 1398116 - DNA, 21 bp, Homo sapiens
acctgttgagcatcacagaat

SEQ ID NO: 1398117 - DNA, 22 bp, Homo sapiens
acctgttgagcatcacagaatg

SEQ ID NO: 1398118 - DNA, 15 bp, Homo sapiens
accttccagaaatac

SEQ ID NO: 1398119 - DNA, 23 bp, Homo sapiens
accttccagaaatactactgtgt

SEQ ID NO: 1398120 - DNA, 18 bp, Homo sapiens
accttgaagttctgaaat

SEQ ID NO: 1398121 - DNA, 18 bp, Homo sapiens
acgctttcctgaatccaa

SEQ ID NO: 1398122 - DNA, 14 bp, Homo sapiens
acggcctttctagc

SEQ ID NO: 1398123 - DNA, 15 bp, Homo sapiens
acggggtttcaccat

SEQ ID NO: 1398124 - DNA, 21 bp, Homo sapiens
acgtcactggaccactgggca

SEQ ID NO: 1398125 - DNA, 19 bp, Homo sapiens
acgtgacacaaacacacac

SEQ ID NO: 1398126 - DNA, 20 bp, Homo sapiens
acgtgacacaaacacacaca

SEQ ID NO: 1398127 - DNA, 19 bp, Homo sapiens
acgtttaagccaaaacaat

SEQ ID NO: 1398128 - DNA, 23 bp, Homo sapiens
acgtttaagccaaaacaatgttt

SEQ ID NO: 1398129 - DNA, 13 bp, Homo sapiens
actaatggcatga

SEQ ID NO: 1398130 - DNA, 16 bp, Homo sapiens
actacagtctaaagct

SEQ ID NO: 1398131 - DNA, 17 bp, Homo sapiens
actacttgggagcaccg

SEQ ID NO: 1398132 - DNA, 15 bp, Homo sapiens
actagacaagccaga

SEQ ID NO: 1398133 - DNA, 14 bp, Homo sapiens
agctcaactctctt

SEQ ID NO: 1398134 - DNA, 22 bp, Homo sapiens
agctcaactctcttattgcctc

SEQ ID NO: 1398135 - DNA, 21 bp, Homo sapiens
agctcaggaaccgaggcaggg

SEQ ID NO: 1398136 - DNA, 22 bp, Homo sapiens
agctcaggaaccgaggcaggga

SEQ ID NO: 1398137 - DNA, 15 bp, Homo sapiens
agctctgaaagagaa

SEQ ID NO: 1398138 - DNA, 16 bp, Homo sapiens
agctctgaaagagaaa

SEQ ID NO: 1398139 - DNA, 20 bp, Homo sapiens
agctctgacattctgattcg

SEQ ID NO: 1398140 - DNA, 16 bp, Homo sapiens
agctgaccagccgtga

SEQ ID NO: 1398141 - DNA, 17 bp, Homo sapiens
agctgtctgctcagaca

SEQ ID NO: 1398142 - DNA, 22 bp, Homo sapiens
agctgtgcttatggtaccagat

SEQ ID NO: 1398143 - DNA, 22 bp, Homo sapiens
agcttaaaactttgaagttagc

SEQ ID NO: 1398144 - DNA, 19 bp, Homo sapiens
agcttaatggctgataatt

SEQ ID NO: 1398145 - DNA, 23 bp, Homo sapiens
agcttatctacttccaaactaat

SEQ ID NO: 1398146 - DNA, 17 bp, Homo sapiens
agcttcagtgctgccga

SEQ ID NO: 1398147 - DNA, 18 bp, Homo sapiens
agctttaacttaaatagt

SEQ ID NO: 1398148 - DNA, 21 bp, Homo sapiens
agctttgctaccaaagcacct

SEQ ID NO: 1398149 - DNA, 10 bp, Homo sapiens
agctttgctc

SEQ ID NO: 1398150 - DNA, 21 bp, Homo sapiens
agctttgctctttggtagaaa

SEQ ID NO: 1398151 - DNA, 22 bp, Homo sapiens
agctttttattcctcctgctca

SEQ ID NO: 1398152 - DNA, 12 bp, Homo sapiens
aggaaaataagt

SEQ ID NO: 1398153 - DNA, 14 bp, Homo sapiens
aggaaaataagtga

SEQ ID NO: 1398154 - DNA, 15 bp, Homo sapiens
aggaaatatactttt

SEQ ID NO: 1398155 - DNA, 22 bp, Homo sapiens
aggaagctttggtgagaacctg

SEQ ID NO: 1398156 - DNA, 16 bp, Homo sapiens
aggaaggactatgaaa

SEQ ID NO: 1398157 - DNA, 22 bp, Homo sapiens
aggaaggcttgttgtgctttta

SEQ ID NO: 1398158 - DNA, 21 bp, Homo sapiens
aggaatatatatggaataagt

SEQ ID NO: 1398159 - DNA, 16 bp, Homo sapiens
aggaatcatgttggat

SEQ ID NO: 1398160 - DNA, 16 bp, Homo sapiens
aggaatctttaaaaga

SEQ ID NO: 1398161 - DNA, 23 bp, Homo sapiens
aggaatgaaatcctgcttcagtg

SEQ ID NO: 1398162 - DNA, 18 bp, Homo sapiens
aggaatttcacctgtaaa

SEQ ID NO: 1398163 - DNA, 14 bp, Homo sapiens
aggaattttctttg

SEQ ID NO: 1398164 - DNA, 15 bp, Homo sapiens
aggacccagggctct

SEQ ID NO: 1398165 - DNA, 14 bp, Homo sapiens
aggacctaaaacat

SEQ ID NO: 1398166 - DNA, 16 bp, Homo sapiens
aggacctaaaacatct

SEQ ID NO: 1398167 - DNA, 20 bp, Homo sapiens
aggactctgccccttctgtt

SEQ ID NO: 1398168 - DNA, 21 bp, Homo sapiens
aggactctgccccttctgttt

SEQ ID NO: 1398169 - DNA, 22 bp, Homo sapiens
aggagatccagggcaaggccat

SEQ ID NO: 1398170 - DNA, 16 bp, Homo sapiens
aggaggacccagggct

SEQ ID NO: 1398171 - DNA, 13 bp, Homo sapiens
aggagggcaggca

SEQ ID NO: 1398172 - DNA, 15 bp, Homo sapiens
aggagggcaggcatc

SEQ ID NO: 1398173 - DNA, 15 bp, Homo sapiens
aggagtgggtgggga

SEQ ID NO: 1398174 - DNA, 18 bp, Homo sapiens
aggatacgacagtacact

SEQ ID NO: 1398175 - DNA, 23 bp, Homo sapiens
aggatagaagtatacctgatttt

SEQ ID NO: 1398176 - DNA, 21 bp, Homo sapiens
aggatcatttgttggaatgaa

SEQ ID NO: 1398177 - DNA, 17 bp, Homo sapiens
aggatctcaccaggcag

SEQ ID NO: 1398178 - DNA, 16 bp, Homo sapiens
aggatgaccaggacta

SEQ ID NO: 1398179 - DNA, 18 bp, Homo sapiens
aggatgtgtttgctttct

SEQ ID NO: 1398180 - DNA, 19 bp, Homo sapiens
aggcactgcaaaccgccac

SEQ ID NO: 1398181 - DNA, 20 bp, Homo sapiens
aggcagactctttatgcttg

SEQ ID NO: 1398182 - DNA, 21 bp, Homo sapiens
aggcagactctttatgcttgc

SEQ ID NO: 1398183 - DNA, 16 bp, Homo sapiens
aggcaggattggggaa

SEQ ID NO: 1398184 - DNA, 15 bp, Homo sapiens
aggcaggctcccagg

SEQ ID NO: 1398185 - DNA, 19 bp, Homo sapiens
aggcagtaataaaaagatt

SEQ ID NO: 1398186 - DNA, 19 bp, Homo sapiens
aggcatcggggagccggga

SEQ ID NO: 1398187 - DNA, 14 bp, Homo sapiens
aggcattaaatttt

SEQ ID NO: 1398188 - DNA, 15 bp, Homo sapiens
aggcatttttaccat

SEQ ID NO: 1398189 - DNA, 18 bp, Homo sapiens
aggccaagtcaggccctt

SEQ ID NO: 1398190 - DNA, 15 bp, Homo sapiens
aggccaataaaaagt

SEQ ID NO: 1398191 - DNA, 17 bp, Homo sapiens
aggccaataaaaagttc

SEQ ID NO: 1398192 - DNA, 18 bp, Homo sapiens
aggccattctttcccaac

SEQ ID NO: 1398193 - DNA, 19 bp, Homo sapiens
aggccattctttcccaaca

SEQ ID NO: 1398194 - DNA, 18 bp, Homo sapiens
aggcccccacctggctca

SEQ ID NO: 1398195 - DNA, 17 bp, Homo sapiens
aggccgtgacgtctggg

SEQ ID NO: 1398196 - DNA, 22 bp, Homo sapiens
aggccgtgacgtctgggtggcc

SEQ ID NO: 1398197 - DNA, 19 bp, Homo sapiens
aggccttgcggctcctcag

SEQ ID NO: 1398198 - DNA, 18 bp, Homo sapiens
aggcgaagcgttgtcctc

SEQ ID NO: 1398199 - DNA, 14 bp, Homo sapiens
aggctagggtgggg

SEQ ID NO: 1398200 - DNA, 15 bp, Homo sapiens
aggctagggtgggga

SEQ ID NO: 1398201 - DNA, 23 bp, Homo sapiens
aggctaggtgggttgaaagccaa

SEQ ID NO: 1398202 - DNA, 19 bp, Homo sapiens
aggctattattttcactgt

SEQ ID NO: 1398203 - DNA, 13 bp, Homo sapiens
aggctctggagcc

SEQ ID NO: 1398204 - DNA, 20 bp, Homo sapiens
aggctgggtcgccctggact

SEQ ID NO: 1398205 - DNA, 22 bp, Homo sapiens
aggctgtgtttggctttcaggg

SEQ ID NO: 1398206 - DNA, 19 bp, Homo sapiens
aggcttccttcatttcctc

SEQ ID NO: 1398207 - DNA, 19 bp, Homo sapiens
agggaataaggtacaagaa

SEQ ID NO: 1398208 - DNA, 21 bp, Homo sapiens
agggacacctgggagaaatct

SEQ ID NO: 1398209 - DNA, 20 bp, Homo sapiens
agggactgtaaacacagaca

SEQ ID NO: 1398210 - DNA, 15 bp, Homo sapiens
agggatgactaaaat

SEQ ID NO: 1398211 - DNA, 16 bp, Homo sapiens
agggcaggtgcttcag

SEQ ID NO: 1398212 - DNA, 14 bp, Homo sapiens
agggcctgatgggg

SEQ ID NO: 1398213 - DNA, 14 bp, Homo sapiens
agggcgcaggccgt

SEQ ID NO: 1398214 - DNA, 17 bp, Homo sapiens
agggcgggggtggcggc

SEQ ID NO: 1398215 - DNA, 14 bp, Homo sapiens
aggggaccaggagt

SEQ ID NO: 1398216 - DNA, 16 bp, Homo sapiens
aggggaccaggagtgg

SEQ ID NO: 1398217 - DNA, 17 bp, Homo sapiens
aggggccgggggcagtc

SEQ ID NO: 1398218 - DNA, 15 bp, Homo sapiens
agggggagagggctg

SEQ ID NO: 1398219 - DNA, 19 bp, Homo sapiens
agggggcctttaaagactt

SEQ ID NO: 1398220 - DNA, 18 bp, Homo sapiens
agggtaccctttggggag

SEQ ID NO: 1398221 - DNA, 21 bp, Homo sapiens
agggtaccctttggggagcag

SEQ ID NO: 1398222 - DNA, 13 bp, Homo sapiens
agggtaggcagga

SEQ ID NO: 1398223 - DNA, 14 bp, Homo sapiens
agggtcaggccttt

SEQ ID NO: 1398224 - DNA, 22 bp, Homo sapiens
agggtcaggcctttgagctcag

SEQ ID NO: 1398225 - DNA, 15 bp, Homo sapiens
agggtttcaccatgt

SEQ ID NO: 1398226 - DNA, 18 bp, Homo sapiens
agggtttgtgacagggcg

SEQ ID NO: 1398227 - DNA, 16 bp, Homo sapiens
aggtacacagctctag

SEQ ID NO: 1398228 - DNA, 21 bp, Homo sapiens
aggtagaatgtaaagcttgtc

SEQ ID NO: 1398229 - DNA, 15 bp, Homo sapiens
aggtatacctcactt

SEQ ID NO: 1398230 - DNA, 15 bp, Homo sapiens
aggtcagcatgtcta

SEQ ID NO: 1398231 - DNA, 11 bp, Homo sapiens
aggtccctaat

SEQ ID NO: 1398232 - DNA, 15 bp, Homo sapiens
aggtccctaataaag

SEQ ID NO: 1398233 - DNA, 13 bp, Homo sapiens
aggtgagaaattt

SEQ ID NO: 1398234 - DNA, 13 bp, Homo sapiens
aggtgccactgga

SEQ ID NO: 1398235 - DNA, 18 bp, Homo sapiens
aggtgccactggagtgtg

SEQ ID NO: 1398236 - DNA, 21 bp, Homo sapiens
aggtgcttctagttctgccag

SEQ ID NO: 1398237 - DNA, 22 bp, Homo sapiens
aggtgcttctagttctgccagg

SEQ ID NO: 1398238 - DNA, 20 bp, Homo sapiens
aggtggttctttttatttta

SEQ ID NO: 1398239 - DNA, 21 bp, Homo sapiens
aggtttatgaaaaagaagaat

SEQ ID NO: 1398240 - DNA, 19 bp, Homo sapiens
aggtttctgagttcctgca

SEQ ID NO: 1398241 - DNA, 21 bp, Homo sapiens
aggtttctgagttcctgcatg

SEQ ID NO: 1398242 - DNA, 22 bp, Homo sapiens
aggttttcctcttctattttgt

SEQ ID NO: 1398243 - DNA, 19 bp, Homo sapiens
aggtttttgtagtgatttt

SEQ ID NO: 1398244 - DNA, 18 bp, Homo sapiens
agtaaaaaagttaaatgt

SEQ ID NO: 1398245 - DNA, 16 bp, Homo sapiens
agtaaaagcaaaaaag

SEQ ID NO: 1398246 - DNA, 16 bp, Homo sapiens
agtaaagaattatttt

SEQ ID NO: 1398247 - DNA, 15 bp, Homo sapiens
agtaacaaaaataaa

SEQ ID NO: 1398248 - DNA, 22 bp, Homo sapiens
agtaataaaattcaacaaacat

SEQ ID NO: 1398249 - DNA, 23 bp, Homo sapiens
agtaataaaattcaacaaacatt

SEQ ID NO: 1398250 - DNA, 22 bp, Homo sapiens
agtaatatgcctgctatttgaa

SEQ ID NO: 1398251 - DNA, 12 bp, Homo sapiens
agtaatttagaa

SEQ ID NO: 1398252 - DNA, 14 bp, Homo sapiens
agtaatttagaaat

SEQ ID NO: 1398253 - DNA, 17 bp, Homo sapiens
agtaatttagaaatcat

SEQ ID NO: 1398254 - DNA, 21 bp, Homo sapiens
agtaatttgtttaaaaagtaa

SEQ ID NO: 1398255 - DNA, 15 bp, Homo sapiens
agtacataaaggtga

SEQ ID NO: 1398256 - DNA, 21 bp, Homo sapiens
agtagatgcatttgggtccag

SEQ ID NO: 1398257 - DNA, 23 bp, Homo sapiens
agtagcacaagttatttaaatct

SEQ ID NO: 1398258 - DNA, 22 bp, Homo sapiens
agtagcagtgattgtcttaata

SEQ ID NO: 1398259 - DNA, 20 bp, Homo sapiens
agtattccagacctgaagaa

SEQ ID NO: 1398260 - DNA, 15 bp, Homo sapiens
agtatttgttaattt

SEQ ID NO: 1398261 - DNA, 20 bp, Homo sapiens
agtcaccctacctgtgcctg

SEQ ID NO: 1398262 - DNA, 21 bp, Homo sapiens
atgcttagtccctcatgcaaa

SEQ ID NO: 1398263 - DNA, 13 bp, Homo sapiens
atggaataagtgt

SEQ ID NO: 1398264 - DNA, 14 bp, Homo sapiens
atggaataagtgta

SEQ ID NO: 1398265 - DNA, 15 bp, Homo sapiens
atggaataagtgtac

SEQ ID NO: 1398266 - DNA, 18 bp, Homo sapiens
atggaataagtgtacata

SEQ ID NO: 1398267 - DNA, 22 bp, Homo sapiens
atggaataagtgtacatatgta

SEQ ID NO: 1398268 - DNA, 17 bp, Homo sapiens
atggagtgcaccaaaga

SEQ ID NO: 1398269 - DNA, 16 bp, Homo sapiens
atggatcctggaggat

SEQ ID NO: 1398270 - DNA, 13 bp, Homo sapiens
atggattctaaaa

SEQ ID NO: 1398271 - DNA, 14 bp, Homo sapiens
atggattctaaaat

SEQ ID NO: 1398272 - DNA, 18 bp, Homo sapiens
atggattctaaaatgcct

SEQ ID NO: 1398273 - DNA, 18 bp, Homo sapiens
atggcaaccattataacc

SEQ ID NO: 1398274 - DNA, 17 bp, Homo sapiens
atggcaggaaggcttgt

SEQ ID NO: 1398275 - DNA, 22 bp, Homo sapiens
atggccatggagtgtacaagta

SEQ ID NO: 1398276 - DNA, 19 bp, Homo sapiens
atggctatgtttttaatgt

SEQ ID NO: 1398277 - DNA, 14 bp, Homo sapiens
atgggaagggtaga

SEQ ID NO: 1398278 - DNA, 12 bp, Homo sapiens
atgggaccacaa

SEQ ID NO: 1398279 - DNA, 14 bp, Homo sapiens
atggtaattgttgc

SEQ ID NO: 1398280 - DNA, 22 bp, Homo sapiens
atggtctcctctgattatcagg

SEQ ID NO: 1398281 - DNA, 14 bp, Homo sapiens
atggtgccttcatt

SEQ ID NO: 1398282 - DNA, 20 bp, Homo sapiens
atggttttctccaagagcta

SEQ ID NO: 1398283 - DNA, 13 bp, Homo sapiens
atgtaaaacattt

SEQ ID NO: 1398284 - DNA, 15 bp, Homo sapiens
atgtaaaacatttat

SEQ ID NO: 1398285 - DNA, 21 bp, Homo sapiens
atgtaaaacatttattttgac

SEQ ID NO: 1398286 - DNA, 21 bp, Homo sapiens
atgtaaaaggtattaaattga

SEQ ID NO: 1398287 - DNA, 21 bp, Homo sapiens
atgtaaagatatttttatctt

SEQ ID NO: 1398288 - DNA, 13 bp, Homo sapiens
atgtaaagccatg

SEQ ID NO: 1398289 - DNA, 14 bp, Homo sapiens
atgtaaagcttgtc

SEQ ID NO: 1398290 - DNA, 17 bp, Homo sapiens
atgtaactgagaatttg

SEQ ID NO: 1398291 - DNA, 14 bp, Homo sapiens
atgtaacttttgta

SEQ ID NO: 1398292 - DNA, 16 bp, Homo sapiens
atgtaacttttgtaag

SEQ ID NO: 1398293 - DNA, 18 bp, Homo sapiens
atgtaacttttgtaagac

SEQ ID NO: 1398294 - DNA, 19 bp, Homo sapiens
atgtacgataggtagaatt

SEQ ID NO: 1398295 - DNA, 12 bp, Homo sapiens
atgtatagtaaa

SEQ ID NO: 1398296 - DNA, 15 bp, Homo sapiens
atgtatagtaaatca

SEQ ID NO: 1398297 - DNA, 17 bp, Homo sapiens
atgtctcttctgagcta

SEQ ID NO: 1398298 - DNA, 18 bp, Homo sapiens
atgtgataaggaaatcaa

SEQ ID NO: 1398299 - DNA, 19 bp, Homo sapiens
atgtgctatactgcatact

SEQ ID NO: 1398300 - DNA, 20 bp, Homo sapiens
atgtggcccctgaacaagaa

SEQ ID NO: 1398301 - DNA, 18 bp, Homo sapiens
atgtgtgtaaaaaagtgt

SEQ ID NO: 1398302 - DNA, 16 bp, Homo sapiens
atgtgtttgctttctg

SEQ ID NO: 1398303 - DNA, 15 bp, Homo sapiens
atgtgttttaataaa

SEQ ID NO: 1398304 - DNA, 20 bp, Homo sapiens
atgtgttttaataaacgttt

SEQ ID NO: 1398305 - DNA, 15 bp, Homo sapiens
atgttaaaaaaataa

SEQ ID NO: 1398306 - DNA, 21 bp, Homo sapiens
atgttaaaaaaataagaagaa

SEQ ID NO: 1398307 - DNA, 12 bp, Homo sapiens
atgttagccagg

SEQ ID NO: 1398308 - DNA, 14 bp, Homo sapiens
atgttattaaacag

SEQ ID NO: 1398309 - DNA, 19 bp, Homo sapiens
atgttatttgtaatagatg

SEQ ID NO: 1398310 - DNA, 16 bp, Homo sapiens
atgttctggacctccc

SEQ ID NO: 1398311 - DNA, 18 bp, Homo sapiens
atgttgattacagtgcag

SEQ ID NO: 1398312 - DNA, 14 bp, Homo sapiens
atgtttaaaccttt

SEQ ID NO: 1398313 - DNA, 18 bp, Homo sapiens
atgtttgaggttaaaata

SEQ ID NO: 1398314 - DNA, 19 bp, Homo sapiens
atgtttgcacctttctagt

SEQ ID NO: 1398315 - DNA, 20 bp, Homo sapiens
attaaaaactgagtgactct

SEQ ID NO: 1398316 - DNA, 19 bp, Homo sapiens
attaaaaaggtttacagaa

SEQ ID NO: 1398317 - DNA, 24 bp, Homo sapiens
attaaattatatctgaggcactga

SEQ ID NO: 1398318 - DNA, 17 bp, Homo sapiens
attaactcattagactg

SEQ ID NO: 1398319 - DNA, 22 bp, Homo sapiens
attaactgggtaatgaaacaaa

SEQ ID NO: 1398320 - DNA, 22 bp, Homo sapiens
attaactggtagttcattgtaa

SEQ ID NO: 1398321 - DNA, 11 bp, Homo sapiens
attaagacttt

SEQ ID NO: 1398322 - DNA, 13 bp, Homo sapiens
attaagactttaa

SEQ ID NO: 1398323 - DNA, 19 bp, Homo sapiens
attaagatacactcctgct

SEQ ID NO: 1398324 - DNA, 17 bp, Homo sapiens
attaagggacatgtatg

SEQ ID NO: 1398325 - DNA, 23 bp, Homo sapiens
attaaggtctgggagtgttctgt

SEQ ID NO: 1398326 - DNA, 16 bp, Homo sapiens
attaatatttatgtgt

SEQ ID NO: 1398327 - DNA, 13 bp, Homo sapiens
attaattctcttg

SEQ ID NO: 1398328 - DNA, 14 bp, Homo sapiens
attacacttggtaa

SEQ ID NO: 1398329 - DNA, 17 bp, Homo sapiens
attacaggcgtgagcca

SEQ ID NO: 1398330 - DNA, 16 bp, Homo sapiens
attaccaacctgttac

SEQ ID NO: 1398331 - DNA, 16 bp, Homo sapiens
attacttatttttgac

SEQ ID NO: 1398332 - DNA, 17 bp, Homo sapiens
attacttatttttgaca

SEQ ID NO: 1398333 - DNA, 18 bp, Homo sapiens
attacttatttttgacag

SEQ ID NO: 1398334 - DNA, 15 bp, Homo sapiens
attactttaatactc

SEQ ID NO: 1398335 - DNA, 22 bp, Homo sapiens
attactttaatactcacctcct

SEQ ID NO: 1398336 - DNA, 16 bp, Homo sapiens
attagactggacagct

SEQ ID NO: 1398337 - DNA, 19 bp, Homo sapiens
attagactggacagcttgt

SEQ ID NO: 1398338 - DNA, 19 bp, Homo sapiens
attagagggaggagaatga

SEQ ID NO: 1398339 - DNA, 14 bp, Homo sapiens
attataaccttaat

SEQ ID NO: 1398340 - DNA, 22 bp, Homo sapiens
attataaccttaatttattatt

SEQ ID NO: 1398341 - DNA, 16 bp, Homo sapiens
attattaatttatgca

SEQ ID NO: 1398342 - DNA, 20 bp, Homo sapiens
attattacttatttttgaca

SEQ ID NO: 1398343 - DNA, 21 bp, Homo sapiens
attattacttatttttgacag

SEQ ID NO: 1398344 - DNA, 14 bp, Homo sapiens
attattcactagta

SEQ ID NO: 1398345 - DNA, 21 bp, Homo sapiens
attattgagtctgtccagata

SEQ ID NO: 1398346 - DNA, 20 bp, Homo sapiens
attattggaatataattgtt

SEQ ID NO: 1398347 - DNA, 22 bp, Homo sapiens
attatttaaaccgctaaaagaa

SEQ ID NO: 1398348 - DNA, 15 bp, Homo sapiens
attcaatctgtaaac

SEQ ID NO: 1398349 - DNA, 17 bp, Homo sapiens
attcaatctgtaaactg

SEQ ID NO: 1398350 - DNA, 15 bp, Homo sapiens
attcacatctcattt

SEQ ID NO: 1398351 - DNA, 21 bp, Homo sapiens
attcactctgagtgttttatg

SEQ ID NO: 1398352 - DNA, 18 bp, Homo sapiens
attcagaagaaaaagaag

SEQ ID NO: 1398353 - DNA, 21 bp, Homo sapiens
attcattttaacatctgagaa

SEQ ID NO: 1398354 - DNA, 14 bp, Homo sapiens
attcattttctcta

SEQ ID NO: 1398355 - DNA, 16 bp, Homo sapiens
attcattttctctaat

SEQ ID NO: 1398356 - DNA, 17 bp, Homo sapiens
attccagacctgaagaa

SEQ ID NO: 1398357 - DNA, 18 bp, Homo sapiens
attccagacctgaagaat

SEQ ID NO: 1398358 - DNA, 23 bp, Homo sapiens
attccagactgcttccaattttc

SEQ ID NO: 1398359 - DNA, 19 bp, Homo sapiens
attcccagagcaaaataat

SEQ ID NO: 1398360 - DNA, 18 bp, Homo sapiens
attccccatctcaggcca

SEQ ID NO: 1398361 - DNA, 22 bp, Homo sapiens
attcctattgtgcaatgtaaat

SEQ ID NO: 1398362 - DNA, 13 bp, Homo sapiens
attcctcctgctc

SEQ ID NO: 1398363 - DNA, 22 bp, Homo sapiens
attcgtagatattggacaaaga

SEQ ID NO: 1398364 - DNA, 21 bp, Homo sapiens
attctcctttttacccctcta

SEQ ID NO: 1398365 - DNA, 17 bp, Homo sapiens
attcttaacaagatatt

SEQ ID NO: 1398366 - DNA, 13 bp, Homo sapiens
attcttccatctg

SEQ ID NO: 1398367 - DNA, 20 bp, Homo sapiens
attgaagctttactttagaa

SEQ ID NO: 1398368 - DNA, 21 bp, Homo sapiens
attgaattatcttggttgaaa

SEQ ID NO: 1398369 - DNA, 11 bp, Homo sapiens
attgagagaat

SEQ ID NO: 1398370 - DNA, 13 bp, Homo sapiens
attgagttggaat

SEQ ID NO: 1398371 - DNA, 16 bp, Homo sapiens
attgctgaaattttat

SEQ ID NO: 1398372 - DNA, 15 bp, Homo sapiens
attggagagaaaaaa

SEQ ID NO: 1398373 - DNA, 18 bp, Homo sapiens
attgggagcttgggaatg

SEQ ID NO: 1398374 - DNA, 16 bp, Homo sapiens
attgggttttatcagt

SEQ ID NO: 1398375 - DNA, 16 bp, Homo sapiens
attgtaaatgaacata

SEQ ID NO: 1398376 - DNA, 22 bp, Homo sapiens
attgtactaaagccaaacatat

SEQ ID NO: 1398377 - DNA, 18 bp, Homo sapiens
attgtgcaatgtaaatat

SEQ ID NO: 1398378 - DNA, 15 bp, Homo sapiens
attgtgcacatttaa

SEQ ID NO: 1398379 - DNA, 17 bp, Homo sapiens
attgtgcacatttaata

SEQ ID NO: 1398380 - DNA, 18 bp, Homo sapiens
attgtgcacatttaataa

SEQ ID NO: 1398381 - DNA, 18 bp, Homo sapiens
attgtgccatgtcaaaca

SEQ ID NO: 1398382 - DNA, 16 bp, Homo sapiens
attgtgggtgttaatt

SEQ ID NO: 1398383 - DNA, 15 bp, Homo sapiens
attgttaatataatt

SEQ ID NO: 1398384 - DNA, 18 bp, Homo sapiens
attgttaatataatttaa

SEQ ID NO: 1398385 - DNA, 19 bp, Homo sapiens
attgtttatttttctatga

SEQ ID NO: 1398386 - DNA, 17 bp, Homo sapiens
atttaaaaaactaaaaa

SEQ ID NO: 1398387 - DNA, 22 bp, Homo sapiens
atttaaaaaactaaaaactaga

SEQ ID NO: 1398388 - DNA, 14 bp, Homo sapiens
atttaaaacagaca

SEQ ID NO: 1398389 - DNA, 18 bp, Homo sapiens
atttaaaacagacactgg

SEQ ID NO: 1398390 - DNA, 23 bp, Homo sapiens
atttaaaacagacactggcatgg

SEQ ID NO: 1398391 - DNA, 13 bp, Homo sapiens
atttaaacaaatg

SEQ ID NO: 1398392 - DNA, 16 bp, Homo sapiens
cagccctagccctcag

SEQ ID NO: 1398393 - DNA, 17 bp, Homo sapiens
cagccgtgagcatgttt

SEQ ID NO: 1398394 - DNA, 21 bp, Homo sapiens
cagcctccatcctaccccctg

SEQ ID NO: 1398395 - DNA, 18 bp, Homo sapiens
cagcctgcagactcactg

SEQ ID NO: 1398396 - DNA, 13 bp, Homo sapiens
cagctagctctgc

SEQ ID NO: 1398397 - DNA, 22 bp, Homo sapiens
cagctcaagagatcccaagtag

SEQ ID NO: 1398398 - DNA, 22 bp, Homo sapiens
cagctcagaagtttcttcttta

SEQ ID NO: 1398399 - DNA, 20 bp, Homo sapiens
cagctcccttcccctgcctg

SEQ ID NO: 1398400 - DNA, 22 bp, Homo sapiens
cagctcccttcccctgcctggt

SEQ ID NO: 1398401 - DNA, 20 bp, Homo sapiens
cagctctagacactgccaca

SEQ ID NO: 1398402 - DNA, 16 bp, Homo sapiens
cagctctgaaagagaa

SEQ ID NO: 1398403 - DNA, 20 bp, Homo sapiens
cagctggggccaggctgggt

SEQ ID NO: 1398404 - DNA, 20 bp, Homo sapiens
cagcttcgtttattttcaag

SEQ ID NO: 1398405 - DNA, 18 bp, Homo sapiens
cagcttgtggcaagtgaa

SEQ ID NO: 1398406 - DNA, 21 bp, Homo sapiens
cagcttgtggcaagtgaattt

SEQ ID NO: 1398407 - DNA, 22 bp, Homo sapiens
cagctttgctaccaaagcacct

SEQ ID NO: 1398408 - DNA, 18 bp, Homo sapiens
caggaaccgaggcaggga

SEQ ID NO: 1398409 - DNA, 13 bp, Homo sapiens
caggaactgggcc

SEQ ID NO: 1398410 - DNA, 22 bp, Homo sapiens
caggaagctttggtgagaacct

SEQ ID NO: 1398411 - DNA, 13 bp, Homo sapiens
caggaaggcttgt

SEQ ID NO: 1398412 - DNA, 15 bp, Homo sapiens
caggagacccacctg

SEQ ID NO: 1398413 - DNA, 21 bp, Homo sapiens
caggagccctgggaggctctg

SEQ ID NO: 1398414 - DNA, 12 bp, Homo sapiens
caggagcctggc

SEQ ID NO: 1398415 - DNA, 20 bp, Homo sapiens
caggaggccaataaaaagtt

SEQ ID NO: 1398416 - DNA, 21 bp, Homo sapiens
caggaggccaataaaaagttc

SEQ ID NO: 1398417 - DNA, 16 bp, Homo sapiens
caggagtgggtgggga

SEQ ID NO: 1398418 - DNA, 17 bp, Homo sapiens
caggatctcaccaggca

SEQ ID NO: 1398419 - DNA, 19 bp, Homo sapiens
caggatctcaccaggcagc

SEQ ID NO: 1398420 - DNA, 22 bp, Homo sapiens
caggatctcaccaggcagcctc

SEQ ID NO: 1398421 - DNA, 18 bp, Homo sapiens
caggatgagggaaaagaa

SEQ ID NO: 1398422 - DNA, 15 bp, Homo sapiens
caggatgtgtttgct

SEQ ID NO: 1398423 - DNA, 20 bp, Homo sapiens
caggatgtgtttgctttctg

SEQ ID NO: 1398424 - DNA, 14 bp, Homo sapiens
caggattggggaag

SEQ ID NO: 1398425 - DNA, 20 bp, Homo sapiens
caggattggggaagagagcc

SEQ ID NO: 1398426 - DNA, 24 bp, Homo sapiens
caggattggggaagagagcctgca

SEQ ID NO: 1398427 - DNA, 14 bp, Homo sapiens
caggcaaaatcctt

SEQ ID NO: 1398428 - DNA, 14 bp, Homo sapiens
caggcagcctctgg

SEQ ID NO: 1398429 - DNA, 16 bp, Homo sapiens
caggcaggctcccagg

SEQ ID NO: 1398430 - DNA, 21 bp, Homo sapiens
caggcccttattttcaagaaa

SEQ ID NO: 1398431 - DNA, 20 bp, Homo sapiens
caggccgtgacgtctgggtg

SEQ ID NO: 1398432 - DNA, 16 bp, Homo sapiens
caggcctttgagctca

SEQ ID NO: 1398433 - DNA, 13 bp, Homo sapiens
caggctaattttt

SEQ ID NO: 1398434 - DNA, 22 bp, Homo sapiens
caggctaatttttttgtatttt

SEQ ID NO: 1398435 - DNA, 14 bp, Homo sapiens
caggctcccaggga

SEQ ID NO: 1398436 - DNA, 21 bp, Homo sapiens
caggctgggtcgccctggact

SEQ ID NO: 1398437 - DNA, 12 bp, Homo sapiens
cagggactcagg

SEQ ID NO: 1398438 - DNA, 17 bp, Homo sapiens
cagggaggccctgtgcc

SEQ ID NO: 1398439 - DNA, 15 bp, Homo sapiens
cagggctctgtaagt

SEQ ID NO: 1398440 - DNA, 19 bp, Homo sapiens
cagggtaccctttggggag

SEQ ID NO: 1398441 - DNA, 23 bp, Homo sapiens
caggtagaattatctaatttata

SEQ ID NO: 1398442 - DNA, 16 bp, Homo sapiens
caggtatacctcactt

SEQ ID NO: 1398443 - DNA, 13 bp, Homo sapiens
caggtccaggctg

SEQ ID NO: 1398444 - DNA, 16 bp, Homo sapiens
caggtccctaataaag

SEQ ID NO: 1398445 - DNA, 17 bp, Homo sapiens
caggtccctaataaagc

SEQ ID NO: 1398446 - DNA, 18 bp, Homo sapiens
caggtccctaataaagct

SEQ ID NO: 1398447 - DNA, 22 bp, Homo sapiens
caggtccctaataaagctgtgt

SEQ ID NO: 1398448 - DNA, 14 bp, Homo sapiens
cagtaatttagaaa

SEQ ID NO: 1398449 - DNA, 18 bp, Homo sapiens
cagtagcacaagttattt

SEQ ID NO: 1398450 - DNA, 21 bp, Homo sapiens
cagtcattgggttttatcagt

SEQ ID NO: 1398451 - DNA, 21 bp, Homo sapiens
cagtcccagaaccacactgtt

SEQ ID NO: 1398452 - DNA, 19 bp, Homo sapiens
cagtccgtcaaaacagatt

SEQ ID NO: 1398453 - DNA, 17 bp, Homo sapiens
cagtcctggaagccagc

SEQ ID NO: 1398454 - DNA, 21 bp, Homo sapiens
cagtctcagaatgtcattttg

SEQ ID NO: 1398455 - DNA, 21 bp, Homo sapiens
cagtcttcctgacactttaat

SEQ ID NO: 1398456 - DNA, 14 bp, Homo sapiens
cagtgaaaaactat

SEQ ID NO: 1398457 - DNA, 15 bp, Homo sapiens
cagtgacagctagga

SEQ ID NO: 1398458 - DNA, 16 bp, Homo sapiens
cagtgagacagtctgg

SEQ ID NO: 1398459 - DNA, 23 bp, Homo sapiens
cagtgcagcaaccagagcactgt

SEQ ID NO: 1398460 - DNA, 19 bp, Homo sapiens
cagtgctgtgctgtgctat

SEQ ID NO: 1398461 - DNA, 22 bp, Homo sapiens
cagtgctgtgctgtgctatggt

SEQ ID NO: 1398462 - DNA, 21 bp, Homo sapiens
cagttacctccaaaaaagaaa

SEQ ID NO: 1398463 - DNA, 21 bp, Homo sapiens
cataaagttgataaagatttt

SEQ ID NO: 1398464 - DNA, 15 bp, Homo sapiens
cataacaacttcata

SEQ ID NO: 1398465 - DNA, 15 bp, Homo sapiens
cataatcttctgcct

SEQ ID NO: 1398466 - DNA, 19 bp, Homo sapiens
cataatgaacagaatttat

SEQ ID NO: 1398467 - DNA, 20 bp, Homo sapiens
cataatgaacagaatttatg

SEQ ID NO: 1398468 - DNA, 23 bp, Homo sapiens
cataatgaacagaatttatgact

SEQ ID NO: 1398469 - DNA, 21 bp, Homo sapiens
cataattatccaggaagggaa

SEQ ID NO: 1398470 - DNA, 23 bp, Homo sapiens
catacagaattactgtaactgat

SEQ ID NO: 1398471 - DNA, 16 bp, Homo sapiens
catacattttctaaga

SEQ ID NO: 1398472 - DNA, 22 bp, Homo sapiens
catactcatttttcatgataat

SEQ ID NO: 1398473 - DNA, 16 bp, Homo sapiens
catactttttaaatgt

SEQ ID NO: 1398474 - DNA, 16 bp, Homo sapiens
catagtagaacgctat

SEQ ID NO: 1398475 - DNA, 13 bp, Homo sapiens
catattgtaaaac

SEQ ID NO: 1398476 - DNA, 18 bp, Homo sapiens
catattgtgattctgcct

SEQ ID NO: 1398477 - DNA, 13 bp, Homo sapiens
catattgttgaaa

SEQ ID NO: 1398478 - DNA, 15 bp, Homo sapiens
catcaggctttcttt

SEQ ID NO: 1398479 - DNA, 21 bp, Homo sapiens
catcatacgcatggtcctgga

SEQ ID NO: 1398480 - DNA, 18 bp, Homo sapiens
catccagagtccctgcct

SEQ ID NO: 1398481 - DNA, 23 bp, Homo sapiens
catccctggccccctccctggat

SEQ ID NO: 1398482 - DNA, 11 bp, Homo sapiens
catccctgggc

SEQ ID NO: 1398483 - DNA, 16 bp, Homo sapiens
catccctttgcccaga

SEQ ID NO: 1398484 - DNA, 14 bp, Homo sapiens
catctgagaaaagc

SEQ ID NO: 1398485 - DNA, 21 bp, Homo sapiens
catctttcctccaaactcctg

SEQ ID NO: 1398486 - DNA, 14 bp, Homo sapiens
catcttttaatatg

SEQ ID NO: 1398487 - DNA, 15 bp, Homo sapiens
catgaaacagaaaca

SEQ ID NO: 1398488 - DNA, 22 bp, Homo sapiens
catgaaatatagatcagttata

SEQ ID NO: 1398489 - DNA, 18 bp, Homo sapiens
catgacctagttttccat

SEQ ID NO: 1398490 - DNA, 19 bp, Homo sapiens
catgacctagttttccatg

SEQ ID NO: 1398491 - DNA, 13 bp, Homo sapiens
catgagaaataca

SEQ ID NO: 1398492 - DNA, 18 bp, Homo sapiens
catgagaaatacaaaaat

SEQ ID NO: 1398493 - DNA, 19 bp, Homo sapiens
catgatcttggtttatcat

SEQ ID NO: 1398494 - DNA, 22 bp, Homo sapiens
catgatgcctctgtcttctgga

SEQ ID NO: 1398495 - DNA, 14 bp, Homo sapiens
catgattcatttta

SEQ ID NO: 1398496 - DNA, 17 bp, Homo sapiens
catgcacacaaacacct

SEQ ID NO: 1398497 - DNA, 21 bp, Homo sapiens
catgcatgtcctgtaaaggtt

SEQ ID NO: 1398498 - DNA, 16 bp, Homo sapiens
catgccaggctaattt

SEQ ID NO: 1398499 - DNA, 16 bp, Homo sapiens
catgctatctctgtgt

SEQ ID NO: 1398500 - DNA, 12 bp, Homo sapiens
catgctccttac

SEQ ID NO: 1398501 - DNA, 18 bp, Homo sapiens
catggatatagttttact

SEQ ID NO: 1398502 - DNA, 12 bp, Homo sapiens
catggcagtggg

SEQ ID NO: 1398503 - DNA, 23 bp, Homo sapiens
catggcagtgggaaaaatgtagg

SEQ ID NO: 1398504 - DNA, 16 bp, Homo sapiens
catgtgactctttcca

SEQ ID NO: 1398505 - DNA, 18 bp, Homo sapiens
catgtgtttactttatgt

SEQ ID NO: 1398506 - DNA, 14 bp, Homo sapiens
catgttatttgtaa

SEQ ID NO: 1398507 - DNA, 15 bp, Homo sapiens
cattactataagaac

SEQ ID NO: 1398508 - DNA, 21 bp, Homo sapiens
cattactgaatttttaaaatg

SEQ ID NO: 1398509 - DNA, 13 bp, Homo sapiens
cattactgcatgc

SEQ ID NO: 1398510 - DNA, 23 bp, Homo sapiens
cattactgcatgcacttcttaca

SEQ ID NO: 1398511 - DNA, 19 bp, Homo sapiens
cattagaagacaattgaca

SEQ ID NO: 1398512 - DNA, 19 bp, Homo sapiens
cattaggaaaagttgctat

SEQ ID NO: 1398513 - DNA, 16 bp, Homo sapiens
cattataaccttaatt

SEQ ID NO: 1398514 - DNA, 23 bp, Homo sapiens
cattattacttttgctgtaatgt

SEQ ID NO: 1398515 - DNA, 17 bp, Homo sapiens
cattcacatcgcagatt

SEQ ID NO: 1398516 - DNA, 17 bp, Homo sapiens
cattcatttttgttgtt

SEQ ID NO: 1398517 - DNA, 23 bp, Homo sapiens
cattctgattcgaatgacactgt

SEQ ID NO: 1398518 - DNA, 21 bp, Homo sapiens
cattcttcctagttttctcct

SEQ ID NO: 1398519 - DNA, 18 bp, Homo sapiens
cattgtaaatgaacataa

SEQ ID NO: 1398520 - DNA, 14 bp, Homo sapiens
cattgttacctcta

SEQ ID NO: 1398521 - DNA, 16 bp, Homo sapiens
cgctttttgaaaaagc

SEQ ID NO: 1398522 - DNA, 22 bp, Homo sapiens
cggaatcctgtcgattagactg

SEQ ID NO: 1398523 - DNA, 23 bp, Homo sapiens
cggcagcccctcccagcctaccc

SEQ ID NO: 1398524 - DNA, 12 bp, Homo sapiens
cggctgggagga

SEQ ID NO: 1398525 - DNA, 19 bp, Homo sapiens
cggggcctgggcaggaggg

SEQ ID NO: 1398526 - DNA, 19 bp, Homo sapiens
cgggggagggtaggcagga

SEQ ID NO: 1398527 - DNA, 21 bp, Homo sapiens
cgggggcagtctgagagaggc

SEQ ID NO: 1398528 - DNA, 17 bp, Homo sapiens
cgggggtggcggcggcc

SEQ ID NO: 1398529 - DNA, 21 bp, Homo sapiens
cgggggtggcggcggccccta

SEQ ID NO: 1398530 - DNA, 17 bp, Homo sapiens
cgggttgtgtgtctgtt

SEQ ID NO: 1398531 - DNA, 20 bp, Homo sapiens
cggtggctcacgcctgtaat

SEQ ID NO: 1398532 - DNA, 16 bp, Homo sapiens
cgtaaaaatgatttca

SEQ ID NO: 1398533 - DNA, 21 bp, Homo sapiens
cgtatttaatagcaaagaatt

SEQ ID NO: 1398534 - DNA, 12 bp, Homo sapiens
cgtcacctcaga

SEQ ID NO: 1398535 - DNA, 18 bp, Homo sapiens
cgtctcatgtaaaataag

SEQ ID NO: 1398536 - DNA, 17 bp, Homo sapiens
cgtgtccgactcttctg

SEQ ID NO: 1398537 - DNA, 13 bp, Homo sapiens
cgtgtctggcaca

SEQ ID NO: 1398538 - DNA, 15 bp, Homo sapiens
cgtgtttctgactct

SEQ ID NO: 1398539 - DNA, 15 bp, Homo sapiens
cgtttattttcaaga

SEQ ID NO: 1398540 - DNA, 22 bp, Homo sapiens
ctaaaataaagaaatagaacaa

SEQ ID NO: 1398541 - DNA, 22 bp, Homo sapiens
ctaaaatactattggagagaaa

SEQ ID NO: 1398542 - DNA, 23 bp, Homo sapiens
ctaaaatatttattttttttaag

SEQ ID NO: 1398543 - DNA, 13 bp, Homo sapiens
ctaaaattttcta

SEQ ID NO: 1398544 - DNA, 14 bp, Homo sapiens
ctaaaattttctaa

SEQ ID NO: 1398545 - DNA, 23 bp, Homo sapiens
ctaaacatcattcatttttgttg

SEQ ID NO: 1398546 - DNA, 13 bp, Homo sapiens
ctaaagaaaaaca

SEQ ID NO: 1398547 - DNA, 19 bp, Homo sapiens
ctaaatacctcaatcagtc

SEQ ID NO: 1398548 - DNA, 20 bp, Homo sapiens
ctaaatattatgagatgctg

SEQ ID NO: 1398549 - DNA, 22 bp, Homo sapiens
ctaagaaacatttatattgata

SEQ ID NO: 1398550 - DNA, 12 bp, Homo sapiens
ctaagaaagaac

SEQ ID NO: 1398551 - DNA, 20 bp, Homo sapiens
ctaaggaatatatatggaat

SEQ ID NO: 1398552 - DNA, 17 bp, Homo sapiens
ctaagttaatttaaagt

SEQ ID NO: 1398553 - DNA, 21 bp, Homo sapiens
ctaagttaatttaaagttgtt

SEQ ID NO: 1398554 - DNA, 23 bp, Homo sapiens
ctaatacagcaacaatttatgaa

SEQ ID NO: 1398555 - DNA, 17 bp, Homo sapiens
ctaatatggcaaccatt

SEQ ID NO: 1398556 - DNA, 18 bp, Homo sapiens
ctaatcagctcccttccc

SEQ ID NO: 1398557 - DNA, 19 bp, Homo sapiens
ctaatcttattcattttct

SEQ ID NO: 1398558 - DNA, 14 bp, Homo sapiens
ctaatggcatgaga

SEQ ID NO: 1398559 - DNA, 18 bp, Homo sapiens
ctaatggcatgagaaata

SEQ ID NO: 1398560 - DNA, 17 bp, Homo sapiens
ctaatttataaaaaggt

SEQ ID NO: 1398561 - DNA, 21 bp, Homo sapiens
ctaatttatcctgaaatttca

SEQ ID NO: 1398562 - DNA, 23 bp, Homo sapiens
ctaatttatcctgaaatttcaga

SEQ ID NO: 1398563 - DNA, 14 bp, Homo sapiens
ctaattttttgttg

SEQ ID NO: 1398564 - DNA, 10 bp, Homo sapiens
ctacatgaaa

SEQ ID NO: 1398565 - DNA, 16 bp, Homo sapiens
ctacatgaaacagaaa

SEQ ID NO: 1398566 - DNA, 14 bp, Homo sapiens
ctaccaaagcacct

SEQ ID NO: 1398567 - DNA, 19 bp, Homo sapiens
ctacccccagctgtgctta

SEQ ID NO: 1398568 - DNA, 13 bp, Homo sapiens
ctacctgtgcctg

SEQ ID NO: 1398569 - DNA, 21 bp, Homo sapiens
ctactgccgtcagtgctgtgc

SEQ ID NO: 1398570 - DNA, 19 bp, Homo sapiens
ctacttccaaactaatttt

SEQ ID NO: 1398571 - DNA, 14 bp, Homo sapiens
ctacttgctcaggt

SEQ ID NO: 1398572 - DNA, 19 bp, Homo sapiens
ctactttgactttttgcat

SEQ ID NO: 1398573 - DNA, 21 bp, Homo sapiens
ctactttgactttttgcattt

SEQ ID NO: 1398574 - DNA, 16 bp, Homo sapiens
ctagaattgagtgttt

SEQ ID NO: 1398575 - DNA, 14 bp, Homo sapiens
ctagacaagccaga

SEQ ID NO: 1398576 - DNA, 17 bp, Homo sapiens
ctagaggtgagaaattt

SEQ ID NO: 1398577 - DNA, 18 bp, Homo sapiens
ctagccctcctttttcca

SEQ ID NO: 1398578 - DNA, 19 bp, Homo sapiens
ctagccctctcacatttat

SEQ ID NO: 1398579 - DNA, 17 bp, Homo sapiens
ctagcgctatctccctg

SEQ ID NO: 1398580 - DNA, 22 bp, Homo sapiens
ctaggatgtgcattctccagcc

SEQ ID NO: 1398581 - DNA, 13 bp, Homo sapiens
ctaggcaacatag

SEQ ID NO: 1398582 - DNA, 15 bp, Homo sapiens
ctaggctagggtggg

SEQ ID NO: 1398583 - DNA, 13 bp, Homo sapiens
ctaggctccaccc

SEQ ID NO: 1398584 - DNA, 17 bp, Homo sapiens
ctaggtaggaaatgtgg

SEQ ID NO: 1398585 - DNA, 18 bp, Homo sapiens
ctaggtgggttgaaagcc

SEQ ID NO: 1398586 - DNA, 23 bp, Homo sapiens
ctaggtgggttgaaagccaagga

SEQ ID NO: 1398587 - DNA, 16 bp, Homo sapiens
ctagtcaatcaagtct

SEQ ID NO: 1398588 - DNA, 20 bp, Homo sapiens
ctagtcaatcaagtctgttt

SEQ ID NO: 1398589 - DNA, 21 bp, Homo sapiens
ctagtcaatcaagtctgttta

SEQ ID NO: 1398590 - DNA, 13 bp, Homo sapiens
ctagttctgccag

SEQ ID NO: 1398591 - DNA, 22 bp, Homo sapiens
ctataagcaagaaggcaaaaat

SEQ ID NO: 1398592 - DNA, 21 bp, Homo sapiens
ctatactgcatactttttaaa

SEQ ID NO: 1398593 - DNA, 21 bp, Homo sapiens
ctatctctgtgtgcacaaata

SEQ ID NO: 1398594 - DNA, 16 bp, Homo sapiens
ctatgaaaagctagaa

SEQ ID NO: 1398595 - DNA, 14 bp, Homo sapiens
ctatggtgctctgt

SEQ ID NO: 1398596 - DNA, 18 bp, Homo sapiens
ctatgtcatttcatttcc

SEQ ID NO: 1398597 - DNA, 19 bp, Homo sapiens
ctattaatatttatgtgtt

SEQ ID NO: 1398598 - DNA, 21 bp, Homo sapiens
ctattaatatttatgtgtttt

SEQ ID NO: 1398599 - DNA, 22 bp, Homo sapiens
ctattattttcactgtagaatg

SEQ ID NO: 1398600 - DNA, 23 bp, Homo sapiens
ctattcagcttcgtttattttca

SEQ ID NO: 1398601 - DNA, 16 bp, Homo sapiens
ctatttcttaaacact

SEQ ID NO: 1398602 - DNA, 19 bp, Homo sapiens
ctattttgtaaactcaaaa

SEQ ID NO: 1398603 - DNA, 14 bp, Homo sapiens
ctatttttatctga

SEQ ID NO: 1398604 - DNA, 13 bp, Homo sapiens
ctcaaaatatttg

SEQ ID NO: 1398605 - DNA, 19 bp, Homo sapiens
ctcaaagcaagcattcaga

SEQ ID NO: 1398606 - DNA, 19 bp, Homo sapiens
ctcaacccctcccctccat

SEQ ID NO: 1398607 - DNA, 23 bp, Homo sapiens
ctcaactgcctactccaaaatgt

SEQ ID NO: 1398608 - DNA, 17 bp, Homo sapiens
ctcaagctgcatctaga

SEQ ID NO: 1398609 - DNA, 17 bp, Homo sapiens
ctcaaggcggtgcttga

SEQ ID NO: 1398610 - DNA, 16 bp, Homo sapiens
ctcaatcagtctcaga

SEQ ID NO: 1398611 - DNA, 19 bp, Homo sapiens
ctcaattcatatttatgaa

SEQ ID NO: 1398612 - DNA, 15 bp, Homo sapiens
ctcacacctgaactg

SEQ ID NO: 1398613 - DNA, 18 bp, Homo sapiens
ctcaccaggcagcctctg

SEQ ID NO: 1398614 - DNA, 17 bp, Homo sapiens
ctcacccccagctttgc

SEQ ID NO: 1398615 - DNA, 19 bp, Homo sapiens
ctcacccccagctttgcta

SEQ ID NO: 1398616 - DNA, 22 bp, Homo sapiens
ctcaccttgtgctggggacagg

SEQ ID NO: 1398617 - DNA, 19 bp, Homo sapiens
ctcagaagtttcttcttta

SEQ ID NO: 1398618 - DNA, 14 bp, Homo sapiens
ctcagaatgctcta

SEQ ID NO: 1398619 - DNA, 15 bp, Homo sapiens
ctcagaatgctctac

SEQ ID NO: 1398620 - DNA, 21 bp, Homo sapiens
ctcagataaggtaaaatgcca

SEQ ID NO: 1398621 - DNA, 22 bp, Homo sapiens
ctcagataaggtaaaatgccat

SEQ ID NO: 1398622 - DNA, 16 bp, Homo sapiens
ctcagatagaatgaca

SEQ ID NO: 1398623 - DNA, 23 bp, Homo sapiens
ctcagctctgacattctgattcg

SEQ ID NO: 1398624 - DNA, 19 bp, Homo sapiens
ctcaggaaccgaggcaggg

SEQ ID NO: 1398625 - DNA, 15 bp, Homo sapiens
ctcaggagccctggg

SEQ ID NO: 1398626 - DNA, 16 bp, Homo sapiens
ctcaggagccctggga

SEQ ID NO: 1398627 - DNA, 21 bp, Homo sapiens
ctcaggagccctgggaggctc

SEQ ID NO: 1398628 - DNA, 22 bp, Homo sapiens
ctcaggatgagggaaaagaaaa

SEQ ID NO: 1398629 - DNA, 20 bp, Homo sapiens
ctcaggcagaggatgttctg

SEQ ID NO: 1398630 - DNA, 16 bp, Homo sapiens
ctcaggccagagccaa

SEQ ID NO: 1398631 - DNA, 18 bp, Homo sapiens
ctcaggccagagccaagg

SEQ ID NO: 1398632 - DNA, 17 bp, Homo sapiens
ctcaggggcctgcccag

SEQ ID NO: 1398633 - DNA, 15 bp, Homo sapiens
ctcaggtacttgtaa

SEQ ID NO: 1398634 - DNA, 22 bp, Homo sapiens
ctcagtaatttagaaatcattt

SEQ ID NO: 1398635 - DNA, 15 bp, Homo sapiens
ctcagtgaagaatac

SEQ ID NO: 1398636 - DNA, 13 bp, Homo sapiens
ctcagttttcata

SEQ ID NO: 1398637 - DNA, 13 bp, Homo sapiens
ctcatattgtgat

SEQ ID NO: 1398638 - DNA, 19 bp, Homo sapiens
ctcatattgtgattctgcc

SEQ ID NO: 1398639 - DNA, 16 bp, Homo sapiens
ctcatcaactgaatga

SEQ ID NO: 1398640 - DNA, 18 bp, Homo sapiens
ctcatctcagtgaagaat

SEQ ID NO: 1398641 - DNA, 15 bp, Homo sapiens
ctcatctcttctttt

SEQ ID NO: 1398642 - DNA, 16 bp, Homo sapiens
ctcatgcaaatcaatt

SEQ ID NO: 1398643 - DNA, 19 bp, Homo sapiens
ctcatgcaaatcaattact

SEQ ID NO: 1398644 - DNA, 12 bp, Homo sapiens
ctcatgtaaaat

SEQ ID NO: 1398645 - DNA, 12 bp, Homo sapiens
ctcattagactg

SEQ ID NO: 1398646 - DNA, 14 bp, Homo sapiens
ctcattagactgga

SEQ ID NO: 1398647 - DNA, 22 bp, Homo sapiens
ctcatttttccgtaaaaatgat

SEQ ID NO: 1398648 - DNA, 14 bp, Homo sapiens
ctccaaactcctgc

SEQ ID NO: 1398649 - DNA, 18 bp, Homo sapiens
ctccaaactcctgcctgt

SEQ ID NO: 1398650 - DNA, 17 bp, Homo sapiens
gaattgggagcttggga

SEQ ID NO: 1398651 - DNA, 22 bp, Homo sapiens
gaatttagccctggtttgaaat

SEQ ID NO: 1398652 - DNA, 15 bp, Homo sapiens
gaattttgttgctgt

SEQ ID NO: 1398653 - DNA, 15 bp, Homo sapiens
gaatttttaaaatgc

SEQ ID NO: 1398654 - DNA, 15 bp, Homo sapiens
gacaaaactagagac

SEQ ID NO: 1398655 - DNA, 17 bp, Homo sapiens
gacaaacacctcccagg

SEQ ID NO: 1398656 - DNA, 22 bp, Homo sapiens
gacaaacacctcccaggagaca

SEQ ID NO: 1398657 - DNA, 18 bp, Homo sapiens
gacacctgggagaaatct

SEQ ID NO: 1398658 - DNA, 18 bp, Homo sapiens
gacactagcccaatgaaa

SEQ ID NO: 1398659 - DNA, 12 bp, Homo sapiens
gacactggcatg

SEQ ID NO: 1398660 - DNA, 16 bp, Homo sapiens
gacactggtttgaaga

SEQ ID NO: 1398661 - DNA, 15 bp, Homo sapiens
gacagaagtttgcac

SEQ ID NO: 1398662 - DNA, 18 bp, Homo sapiens
gacaggatgtgtttgctt

SEQ ID NO: 1398663 - DNA, 19 bp, Homo sapiens
gacaggatgtgtttgcttt

SEQ ID NO: 1398664 - DNA, 17 bp, Homo sapiens
gacagggcgggggtggc

SEQ ID NO: 1398665 - DNA, 21 bp, Homo sapiens
gacagtccgtcaaaacagatt

SEQ ID NO: 1398666 - DNA, 23 bp, Homo sapiens
gacagtgttgaaaatgttcagaa

SEQ ID NO: 1398667 - DNA, 19 bp, Homo sapiens
gacataaagttgataaaga

SEQ ID NO: 1398668 - DNA, 15 bp, Homo sapiens
gacatcacttgtaca

SEQ ID NO: 1398669 - DNA, 22 bp, Homo sapiens
gacatcacttgtacaaaataaa

SEQ ID NO: 1398670 - DNA, 23 bp, Homo sapiens
gacatccatgttccgagaagaac

SEQ ID NO: 1398671 - DNA, 14 bp, Homo sapiens
gaccaaaagttaca

SEQ ID NO: 1398672 - DNA, 19 bp, Homo sapiens
gaccaaaagttacatgttt

SEQ ID NO: 1398673 - DNA, 18 bp, Homo sapiens
gaccagccgtgagcatgt

SEQ ID NO: 1398674 - DNA, 10 bp, Homo sapiens
gaccaggagt

SEQ ID NO: 1398675 - DNA, 18 bp, Homo sapiens
gacccacctgaggctcag

SEQ ID NO: 1398676 - DNA, 15 bp, Homo sapiens
gaccctcatctttct

SEQ ID NO: 1398677 - DNA, 17 bp, Homo sapiens
gacgtctgggtggccct

SEQ ID NO: 1398678 - DNA, 14 bp, Homo sapiens
gactaatggcatga

SEQ ID NO: 1398679 - DNA, 19 bp, Homo sapiens
gactatcttactatttcac

SEQ ID NO: 1398680 - DNA, 23 bp, Homo sapiens
gactcacacctgaactgaacacc

SEQ ID NO: 1398681 - DNA, 13 bp, Homo sapiens
gactctgcccctt

SEQ ID NO: 1398682 - DNA, 17 bp, Homo sapiens
gactctgccccttctgt

SEQ ID NO: 1398683 - DNA, 19 bp, Homo sapiens
gactgccaagactgctgtg

SEQ ID NO: 1398684 - DNA, 16 bp, Homo sapiens
gactgctgtggccagg

SEQ ID NO: 1398685 - DNA, 17 bp, Homo sapiens
gactgctgtggccagga

SEQ ID NO: 1398686 - DNA, 15 bp, Homo sapiens
gactggacagcttgt

SEQ ID NO: 1398687 - DNA, 17 bp, Homo sapiens
gactgtaaacacagaca

SEQ ID NO: 1398688 - DNA, 20 bp, Homo sapiens
gactgtgtgctcaggagccc

SEQ ID NO: 1398689 - DNA, 18 bp, Homo sapiens
gactgtttttcggacagt

SEQ ID NO: 1398690 - DNA, 19 bp, Homo sapiens
gactgtttttcggacagtt

SEQ ID NO: 1398691 - DNA, 18 bp, Homo sapiens
gacttacatgattcattt

SEQ ID NO: 1398692 - DNA, 17 bp, Homo sapiens
gacttcaggttgttctg

SEQ ID NO: 1398693 - DNA, 19 bp, Homo sapiens
gactttctacacctgttgc

SEQ ID NO: 1398694 - DNA, 16 bp, Homo sapiens
gactttttgcatttaa

SEQ ID NO: 1398695 - DNA, 16 bp, Homo sapiens
gagaaaggattaagat

SEQ ID NO: 1398696 - DNA, 23 bp, Homo sapiens
gagaaatctggcttctggccagg

SEQ ID NO: 1398697 - DNA, 21 bp, Homo sapiens
gagaacctgggttgcagacag

SEQ ID NO: 1398698 - DNA, 22 bp, Homo sapiens
gagaatctggctcctgtttcca

SEQ ID NO: 1398699 - DNA, 23 bp, Homo sapiens
gagaatctggctcctgtttccat

SEQ ID NO: 1398700 - DNA, 15 bp, Homo sapiens
gagacacacctgagg

SEQ ID NO: 1398701 - DNA, 16 bp, Homo sapiens
gagacattaactcatt

SEQ ID NO: 1398702 - DNA, 21 bp, Homo sapiens
gagacccacctgaggctcagc

SEQ ID NO: 1398703 - DNA, 15 bp, Homo sapiens
gagaccggcctgcca

SEQ ID NO: 1398704 - DNA, 21 bp, Homo sapiens
gagaccggcctgccaggagga

SEQ ID NO: 1398705 - DNA, 20 bp, Homo sapiens
gagacctctcaacagatctg

SEQ ID NO: 1398706 - DNA, 14 bp, Homo sapiens
gagactgtttggaa

SEQ ID NO: 1398707 - DNA, 17 bp, Homo sapiens
gagagcctgcaggatct

SEQ ID NO: 1398708 - DNA, 18 bp, Homo sapiens
gagagggcgcaggccgtg

SEQ ID NO: 1398709 - DNA, 11 bp, Homo sapiens
gagagtgtgac

SEQ ID NO: 1398710 - DNA, 18 bp, Homo sapiens
gagataatctaaatataa

SEQ ID NO: 1398711 - DNA, 18 bp, Homo sapiens
gagatccagggcaaggcc

SEQ ID NO: 1398712 - DNA, 19 bp, Homo sapiens
gagatcccaacactgccag

SEQ ID NO: 1398713 - DNA, 12 bp, Homo sapiens
gagatgctggct

SEQ ID NO: 1398714 - DNA, 19 bp, Homo sapiens
gagatgctggcttgggcag

SEQ ID NO: 1398715 - DNA, 23 bp, Homo sapiens
gagattctcataacttgagacct

SEQ ID NO: 1398716 - DNA, 18 bp, Homo sapiens
gagcaagcaggaatcaga

SEQ ID NO: 1398717 - DNA, 22 bp, Homo sapiens
gagcaccgcctgtgaaatacca

SEQ ID NO: 1398718 - DNA, 14 bp, Homo sapiens
gagcaggaggccaa

SEQ ID NO: 1398719 - DNA, 23 bp, Homo sapiens
gagcaggaggccaataaaaagtt

SEQ ID NO: 1398720 - DNA, 18 bp, Homo sapiens
gagcccactgtacttgct

SEQ ID NO: 1398721 - DNA, 15 bp, Homo sapiens
gagcctgcaggatct

SEQ ID NO: 1398722 - DNA, 18 bp, Homo sapiens
gagctcacagtacaatgt

SEQ ID NO: 1398723 - DNA, 19 bp, Homo sapiens
gagctcagaaaatatccct

SEQ ID NO: 1398724 - DNA, 12 bp, Homo sapiens
gagctcaggatg

SEQ ID NO: 1398725 - DNA, 23 bp, Homo sapiens
gagctcaggatgagggaaaagaa

SEQ ID NO: 1398726 - DNA, 22 bp, Homo sapiens
gagcttgaaacccgtggcgctt

SEQ ID NO: 1398727 - DNA, 16 bp, Homo sapiens
gagctttagcttctct

SEQ ID NO: 1398728 - DNA, 22 bp, Homo sapiens
gaggacttgtgtctctgtgctt

SEQ ID NO: 1398729 - DNA, 15 bp, Homo sapiens
gaggagggcaggcat

SEQ ID NO: 1398730 - DNA, 16 bp, Homo sapiens
gaggccaataaaaagt

SEQ ID NO: 1398731 - DNA, 22 bp, Homo sapiens
gaggccctgtgccccttgacaa

SEQ ID NO: 1398732 - DNA, 20 bp, Homo sapiens
gaggcgaagcgttgtcctca

SEQ ID NO: 1398733 - DNA, 22 bp, Homo sapiens
gaggctaggtgggttgaaagcc

SEQ ID NO: 1398734 - DNA, 14 bp, Homo sapiens
gaggctcagcccta

SEQ ID NO: 1398735 - DNA, 14 bp, Homo sapiens
gaggcttccttcat

SEQ ID NO: 1398736 - DNA, 15 bp, Homo sapiens
gaggggaccaggagt

SEQ ID NO: 1398737 - DNA, 14 bp, Homo sapiens
gagggggagagggc

SEQ ID NO: 1398738 - DNA, 13 bp, Homo sapiens
gagggtaggcagg

SEQ ID NO: 1398739 - DNA, 14 bp, Homo sapiens
gagggtaggcagga

SEQ ID NO: 1398740 - DNA, 15 bp, Homo sapiens
gagggtaggcaggat

SEQ ID NO: 1398741 - DNA, 19 bp, Homo sapiens
gaggtatttatctttactt

SEQ ID NO: 1398742 - DNA, 16 bp, Homo sapiens
gagtaatatgcctgct

SEQ ID NO: 1398743 - DNA, 16 bp, Homo sapiens
gagtccatcagcctcc

SEQ ID NO: 1398744 - DNA, 16 bp, Homo sapiens
gagtccctgcctggac

SEQ ID NO: 1398745 - DNA, 23 bp, Homo sapiens
gagtccctgcctggaccagcctc

SEQ ID NO: 1398746 - DNA, 17 bp, Homo sapiens
gagtcgtacagaaagct

SEQ ID NO: 1398747 - DNA, 22 bp, Homo sapiens
gagtcgtacagaaagctgcctg

SEQ ID NO: 1398748 - DNA, 14 bp, Homo sapiens
gagtgagaatctgg

SEQ ID NO: 1398749 - DNA, 15 bp, Homo sapiens
gagtgcaccaaagag

SEQ ID NO: 1398750 - DNA, 17 bp, Homo sapiens
gagtgcaccaaagagaa

SEQ ID NO: 1398751 - DNA, 15 bp, Homo sapiens
gagtgcgtggtgcga

SEQ ID NO: 1398752 - DNA, 16 bp, Homo sapiens
gagtgcttaaaaatgc

SEQ ID NO: 1398753 - DNA, 13 bp, Homo sapiens
gagtgggggtggg

SEQ ID NO: 1398754 - DNA, 13 bp, Homo sapiens
gagtgtacaagta

SEQ ID NO: 1398755 - DNA, 18 bp, Homo sapiens
gagttttccatggcagga

SEQ ID NO: 1398756 - DNA, 21 bp, Homo sapiens
gagttttccatggcaggaagg

SEQ ID NO: 1398757 - DNA, 17 bp, Homo sapiens
gataaagattttttaat

SEQ ID NO: 1398758 - DNA, 13 bp, Homo sapiens
gataaagtaaaaa

SEQ ID NO: 1398759 - DNA, 20 bp, Homo sapiens
gataactgaaaattatttaa

SEQ ID NO: 1398760 - DNA, 20 bp, Homo sapiens
gataaggtaaaatgccatga

SEQ ID NO: 1398761 - DNA, 13 bp, Homo sapiens
gataatatgtttg

SEQ ID NO: 1398762 - DNA, 13 bp, Homo sapiens
gataatgaacaga

SEQ ID NO: 1398763 - DNA, 14 bp, Homo sapiens
gataatgaacagaa

SEQ ID NO: 1398764 - DNA, 20 bp, Homo sapiens
gatacttaagtgctgcaatt

SEQ ID NO: 1398765 - DNA, 13 bp, Homo sapiens
gatagaaatgcca

SEQ ID NO: 1398766 - DNA, 23 bp, Homo sapiens
gatatattttacaattttttatc

SEQ ID NO: 1398767 - DNA, 14 bp, Homo sapiens
gatatctcatctct

SEQ ID NO: 1398768 - DNA, 16 bp, Homo sapiens
gatatgtaaaacattt

SEQ ID NO: 1398769 - DNA, 22 bp, Homo sapiens
gatattcctattgtgcaatgta

SEQ ID NO: 1398770 - DNA, 19 bp, Homo sapiens
gatatttatatgttattaa

SEQ ID NO: 1398771 - DNA, 23 bp, Homo sapiens
gatatttatatgttattaaacag

SEQ ID NO: 1398772 - DNA, 19 bp, Homo sapiens
gatatttatttaaacaaat

SEQ ID NO: 1398773 - DNA, 21 bp, Homo sapiens
gatattttctgtgcctgaata

SEQ ID NO: 1398774 - DNA, 13 bp, Homo sapiens
gatcaaggcctta

SEQ ID NO: 1398775 - DNA, 22 bp, Homo sapiens
gatcaaggccttattggaaagc

SEQ ID NO: 1398776 - DNA, 23 bp, Homo sapiens
gatcaaggccttattggaaagca

SEQ ID NO: 1398777 - DNA, 18 bp, Homo sapiens
gatcccaacactgccagc

SEQ ID NO: 1398778 - DNA, 16 bp, Homo sapiens
gatctcaccaggcagc

SEQ ID NO: 1398779 - DNA, 20 bp, Homo sapiens
gatctcaccaggcagcctct

SEQ ID NO: 1398780 - DNA, 15 bp, Homo sapiens
ggaggagggcaggca

SEQ ID NO: 1398781 - DNA, 17 bp, Homo sapiens
ggaggccaataaaaagt

SEQ ID NO: 1398782 - DNA, 17 bp, Homo sapiens
ggaggccattgtgtgag

SEQ ID NO: 1398783 - DNA, 15 bp, Homo sapiens
ggaggccctgtgccc

SEQ ID NO: 1398784 - DNA, 21 bp, Homo sapiens
ggaggctctggagcccactgt

SEQ ID NO: 1398785 - DNA, 15 bp, Homo sapiens
ggagtgggtggggag

SEQ ID NO: 1398786 - DNA, 15 bp, Homo sapiens
ggagttttgcaaagt

SEQ ID NO: 1398787 - DNA, 20 bp, Homo sapiens
ggatcccatgagctccttaa

SEQ ID NO: 1398788 - DNA, 16 bp, Homo sapiens
ggatctcaccaggcag

SEQ ID NO: 1398789 - DNA, 22 bp, Homo sapiens
ggatctcaccaggcagcctctg

SEQ ID NO: 1398790 - DNA, 20 bp, Homo sapiens
ggatgagggaaaagaaaaag

SEQ ID NO: 1398791 - DNA, 21 bp, Homo sapiens
ggatggggtatggattctaaa

SEQ ID NO: 1398792 - DNA, 18 bp, Homo sapiens
ggattaagatacactcct

SEQ ID NO: 1398793 - DNA, 14 bp, Homo sapiens
ggatttatttaaaa

SEQ ID NO: 1398794 - DNA, 12 bp, Homo sapiens
ggcacagcctgg

SEQ ID NO: 1398795 - DNA, 19 bp, Homo sapiens
ggcagactctttatgcttg

SEQ ID NO: 1398796 - DNA, 20 bp, Homo sapiens
ggcagactctttatgcttgc

SEQ ID NO: 1398797 - DNA, 16 bp, Homo sapiens
ggcagaggatgttctg

SEQ ID NO: 1398798 - DNA, 17 bp, Homo sapiens
ggcagcatccccttgaa

SEQ ID NO: 1398799 - DNA, 14 bp, Homo sapiens
ggcaggagggaggt

SEQ ID NO: 1398800 - DNA, 23 bp, Homo sapiens
ggcaggcatcggggagccgggag

SEQ ID NO: 1398801 - DNA, 21 bp, Homo sapiens
ggcagtgcagcaaccagagca

SEQ ID NO: 1398802 - DNA, 13 bp, Homo sapiens
ggcatgagaaata

SEQ ID NO: 1398803 - DNA, 23 bp, Homo sapiens
ggcatgttagcccttcctccaat

SEQ ID NO: 1398804 - DNA, 17 bp, Homo sapiens
ggccaataaaaagttca

SEQ ID NO: 1398805 - DNA, 20 bp, Homo sapiens
ggccagatgcacatccctgg

SEQ ID NO: 1398806 - DNA, 17 bp, Homo sapiens
ggcccccacctggctca

SEQ ID NO: 1398807 - DNA, 14 bp, Homo sapiens
ggcccccccagctg

SEQ ID NO: 1398808 - DNA, 16 bp, Homo sapiens
ggccccctccctggat

SEQ ID NO: 1398809 - DNA, 19 bp, Homo sapiens
ggcccctgcctctctgcag

SEQ ID NO: 1398810 - DNA, 21 bp, Homo sapiens
ggcccctgcctctctgcaggt

SEQ ID NO: 1398811 - DNA, 19 bp, Homo sapiens
ggcctcaaatgcaccatgt

SEQ ID NO: 1398812 - DNA, 14 bp, Homo sapiens
ggcctgccaggagg

SEQ ID NO: 1398813 - DNA, 17 bp, Homo sapiens
ggcctgggcaggaggga

SEQ ID NO: 1398814 - DNA, 19 bp, Homo sapiens
ggccttgcggctcctcagg

SEQ ID NO: 1398815 - DNA, 12 bp, Homo sapiens
ggccttgggctc

SEQ ID NO: 1398816 - DNA, 13 bp, Homo sapiens
ggcctttgagctc

SEQ ID NO: 1398817 - DNA, 11 bp, Homo sapiens
ggcgcaggagg

SEQ ID NO: 1398818 - DNA, 22 bp, Homo sapiens
ggcgcgatctcggctcactgca

SEQ ID NO: 1398819 - DNA, 16 bp, Homo sapiens
ggcgcggctgggagga

SEQ ID NO: 1398820 - DNA, 19 bp, Homo sapiens
ggcgggggtggcggcggcc

SEQ ID NO: 1398821 - DNA, 13 bp, Homo sapiens
ggctaggtacaca

SEQ ID NO: 1398822 - DNA, 15 bp, Homo sapiens
ggctccgtgtgggag

SEQ ID NO: 1398823 - DNA, 16 bp, Homo sapiens
ggctccgtgtgggaga

SEQ ID NO: 1398824 - DNA, 18 bp, Homo sapiens
ggctccgtgtgggagacc

SEQ ID NO: 1398825 - DNA, 17 bp, Homo sapiens
ggctccttggttcttga

SEQ ID NO: 1398826 - DNA, 17 bp, Homo sapiens
ggctctggagcccactg

SEQ ID NO: 1398827 - DNA, 19 bp, Homo sapiens
ggctctggagcccactgta

SEQ ID NO: 1398828 - DNA, 15 bp, Homo sapiens
ggctgagctctctgt

SEQ ID NO: 1398829 - DNA, 20 bp, Homo sapiens
ggctgagctctctgtgggct

SEQ ID NO: 1398830 - DNA, 20 bp, Homo sapiens
ggctgggaggagggcaggca

SEQ ID NO: 1398831 - DNA, 21 bp, Homo sapiens
ggctgtggcatccagagtccc

SEQ ID NO: 1398832 - DNA, 23 bp, Homo sapiens
ggctgtggcatccagagtccctg

SEQ ID NO: 1398833 - DNA, 23 bp, Homo sapiens
ggcttaaacccatattgtaaaac

SEQ ID NO: 1398834 - DNA, 13 bp, Homo sapiens
ggcttcaggtcca

SEQ ID NO: 1398835 - DNA, 22 bp, Homo sapiens
gggaaatcaaaagggccaaaga

SEQ ID NO: 1398836 - DNA, 15 bp, Homo sapiens
gggaaggatcccatg

SEQ ID NO: 1398837 - DNA, 14 bp, Homo sapiens
gggacacctaggct

SEQ ID NO: 1398838 - DNA, 19 bp, Homo sapiens
gggaccaggagtgggtggg

SEQ ID NO: 1398839 - DNA, 19 bp, Homo sapiens
gggactacaggcgtgagcc

SEQ ID NO: 1398840 - DNA, 12 bp, Homo sapiens
gggactgagaga

SEQ ID NO: 1398841 - DNA, 23 bp, Homo sapiens
gggactgagagatgcagaaatat

SEQ ID NO: 1398842 - DNA, 14 bp, Homo sapiens
gggagagggcgcag

SEQ ID NO: 1398843 - DNA, 17 bp, Homo sapiens
gggagaggggcctcaaa

SEQ ID NO: 1398844 - DNA, 15 bp, Homo sapiens
gggagcaggaggcca

SEQ ID NO: 1398845 - DNA, 23 bp, Homo sapiens
gggagctcaggaaccgaggcagg

SEQ ID NO: 1398846 - DNA, 19 bp, Homo sapiens
gggagctggttagaaatgc

SEQ ID NO: 1398847 - DNA, 14 bp, Homo sapiens
gggagggggagagg

SEQ ID NO: 1398848 - DNA, 16 bp, Homo sapiens
gggagtttagggtggg

SEQ ID NO: 1398849 - DNA, 19 bp, Homo sapiens
gggatgactaaaatattta

SEQ ID NO: 1398850 - DNA, 16 bp, Homo sapiens
gggcagattttcagca

SEQ ID NO: 1398851 - DNA, 21 bp, Homo sapiens
gggcagtctgagagaggccat

SEQ ID NO: 1398852 - DNA, 14 bp, Homo sapiens
gggccaggctgggt

SEQ ID NO: 1398853 - DNA, 18 bp, Homo sapiens
gggcccctgcctctctgc

SEQ ID NO: 1398854 - DNA, 21 bp, Homo sapiens
gggcccctgcctctctgcagg

SEQ ID NO: 1398855 - DNA, 12 bp, Homo sapiens
ggggaccaggag

SEQ ID NO: 1398856 - DNA, 19 bp, Homo sapiens
ggggacttacatgattcat

SEQ ID NO: 1398857 - DNA, 18 bp, Homo sapiens
ggggagcaggaggccaat

SEQ ID NO: 1398858 - DNA, 21 bp, Homo sapiens
ggggagcaggaggccaataaa

SEQ ID NO: 1398859 - DNA, 22 bp, Homo sapiens
ggggagcaggaggccaataaaa

SEQ ID NO: 1398860 - DNA, 13 bp, Homo sapiens
ggggagggtaggc

SEQ ID NO: 1398861 - DNA, 20 bp, Homo sapiens
ggggattcttccatctgatt

SEQ ID NO: 1398862 - DNA, 15 bp, Homo sapiens
ggggcagtctgagag

SEQ ID NO: 1398863 - DNA, 18 bp, Homo sapiens
ggggcagtctgagagagg

SEQ ID NO: 1398864 - DNA, 19 bp, Homo sapiens
ggggcagtctgagagaggc

SEQ ID NO: 1398865 - DNA, 13 bp, Homo sapiens
ggggccaggctgg

SEQ ID NO: 1398866 - DNA, 23 bp, Homo sapiens
ggggcccggacgcccaggacccc

SEQ ID NO: 1398867 - DNA, 16 bp, Homo sapiens
ggggcgcggctgggag

SEQ ID NO: 1398868 - DNA, 22 bp, Homo sapiens
gggggcagtctgagagaggcca

SEQ ID NO: 1398869 - DNA, 19 bp, Homo sapiens
gggggtgctgggcccctgc

SEQ ID NO: 1398870 - DNA, 20 bp, Homo sapiens
gggggtggccaggccgggaa

SEQ ID NO: 1398871 - DNA, 18 bp, Homo sapiens
ggggtgctgggcccctgc

SEQ ID NO: 1398872 - DNA, 20 bp, Homo sapiens
ggggtggggggggtgctggg

SEQ ID NO: 1398873 - DNA, 12 bp, Homo sapiens
gggtaggcagga

SEQ ID NO: 1398874 - DNA, 18 bp, Homo sapiens
gggtggccaggccgggaa

SEQ ID NO: 1398875 - DNA, 21 bp, Homo sapiens
gggtgtcctgcaccggggcct

SEQ ID NO: 1398876 - DNA, 23 bp, Homo sapiens
gggtgtcctgcaccggggcctgg

SEQ ID NO: 1398877 - DNA, 13 bp, Homo sapiens
gggttttatcagt

SEQ ID NO: 1398878 - DNA, 13 bp, Homo sapiens
ggtaaaatgccat

SEQ ID NO: 1398879 - DNA, 14 bp, Homo sapiens
ggtaccagatgcag

SEQ ID NO: 1398880 - DNA, 21 bp, Homo sapiens
ggtaccagcagaaaggttagt

SEQ ID NO: 1398881 - DNA, 20 bp, Homo sapiens
ggtagaaagagatacagagg

SEQ ID NO: 1398882 - DNA, 14 bp, Homo sapiens
ggtatacctcactt

SEQ ID NO: 1398883 - DNA, 16 bp, Homo sapiens
ggtatatccaaaagct

SEQ ID NO: 1398884 - DNA, 12 bp, Homo sapiens
ggtcaggccttt

SEQ ID NO: 1398885 - DNA, 21 bp, Homo sapiens
ggtccaaaataaaacctcagc

SEQ ID NO: 1398886 - DNA, 13 bp, Homo sapiens
ggtccaggctgtg

SEQ ID NO: 1398887 - DNA, 20 bp, Homo sapiens
ggtccctgggtagcggggga

SEQ ID NO: 1398888 - DNA, 14 bp, Homo sapiens
ggtcctcagagaat

SEQ ID NO: 1398889 - DNA, 10 bp, Homo sapiens
ggtccttcaa

SEQ ID NO: 1398890 - DNA, 19 bp, Homo sapiens
ggtctctctctctctacaa

SEQ ID NO: 1398891 - DNA, 21 bp, Homo sapiens
ggtgaagctcacttctgggct

SEQ ID NO: 1398892 - DNA, 12 bp, Homo sapiens
ggtgctctgtct

SEQ ID NO: 1398893 - DNA, 15 bp, Homo sapiens
ggtgctgggcccctg

SEQ ID NO: 1398894 - DNA, 12 bp, Homo sapiens
ggtggccaggcc

SEQ ID NO: 1398895 - DNA, 13 bp, Homo sapiens
ggtggccaggccg

SEQ ID NO: 1398896 - DNA, 23 bp, Homo sapiens
ggtggcttttgcggttcaggaaa

SEQ ID NO: 1398897 - DNA, 14 bp, Homo sapiens
ggttgcagacagga

SEQ ID NO: 1398898 - DNA, 13 bp, Homo sapiens
ggtttgaaatttt

SEQ ID NO: 1398899 - DNA, 23 bp, Homo sapiens
ggtttttgtttgtttcctttgtt

SEQ ID NO: 1398900 - DNA, 15 bp, Homo sapiens
gtaaaaatgatttca

SEQ ID NO: 1398901 - DNA, 20 bp, Homo sapiens
gtaaaacatttattttgaca

SEQ ID NO: 1398902 - DNA, 12 bp, Homo sapiens
gtaaaagcaaaa

SEQ ID NO: 1398903 - DNA, 12 bp, Homo sapiens
gtaaaataagaa

SEQ ID NO: 1398904 - DNA, 22 bp, Homo sapiens
gtaaactatcttggtgaatttt

SEQ ID NO: 1398905 - DNA, 20 bp, Homo sapiens
gtaaactgtgtattccaaga

SEQ ID NO: 1398906 - DNA, 13 bp, Homo sapiens
gtaaagaattatt

SEQ ID NO: 1398907 - DNA, 23 bp, Homo sapiens
gtaaatattttaaagaattgtgt

SEQ ID NO: 1398908 - DNA, 14 bp, Homo sapiens
gtaaatgaacataa

SEQ ID NO: 1398909 - DNA, 17 bp, Homo sapiens
gtaaatgaacataatga

SEQ ID NO: 1398910 - DNA, 19 bp, Homo sapiens
tacaagtaacaaaaataaa

SEQ ID NO: 1398911 - DNA, 14 bp, Homo sapiens
tacaatgtttcaga

SEQ ID NO: 1398912 - DNA, 23 bp, Homo sapiens
tacaattttttatcatgcatgtc

SEQ ID NO: 1398913 - DNA, 14 bp, Homo sapiens
tacacccaaagagg

SEQ ID NO: 1398914 - DNA, 17 bp, Homo sapiens
tacacctatgtcatttc

SEQ ID NO: 1398915 - DNA, 21 bp, Homo sapiens
tacacctatgtcatttcattt

SEQ ID NO: 1398916 - DNA, 12 bp, Homo sapiens
tacactcctgct

SEQ ID NO: 1398917 - DNA, 20 bp, Homo sapiens
tacactgtcagcagggactg

SEQ ID NO: 1398918 - DNA, 15 bp, Homo sapiens
tacagaattactgta

SEQ ID NO: 1398919 - DNA, 19 bp, Homo sapiens
tacagttatctaagttaat

SEQ ID NO: 1398920 - DNA, 12 bp, Homo sapiens
tacatacagaat

SEQ ID NO: 1398921 - DNA, 15 bp, Homo sapiens
tacatgaaacagaaa

SEQ ID NO: 1398922 - DNA, 21 bp, Homo sapiens
tacatgcacttggctgcataa

SEQ ID NO: 1398923 - DNA, 16 bp, Homo sapiens
tacattggtaaacatt

SEQ ID NO: 1398924 - DNA, 21 bp, Homo sapiens
tacattgttacctctatatac

SEQ ID NO: 1398925 - DNA, 12 bp, Homo sapiens
taccaacctgtt

SEQ ID NO: 1398926 - DNA, 17 bp, Homo sapiens
taccaggcaccaaaaga

SEQ ID NO: 1398927 - DNA, 16 bp, Homo sapiens
taccatttcagagagg

SEQ ID NO: 1398928 - DNA, 16 bp, Homo sapiens
tacccccagctgtgct

SEQ ID NO: 1398929 - DNA, 15 bp, Homo sapiens
taccccctgtgcctt

SEQ ID NO: 1398930 - DNA, 13 bp, Homo sapiens
tacctactttgac

SEQ ID NO: 1398931 - DNA, 16 bp, Homo sapiens
tacctccaaaaaagaa

SEQ ID NO: 1398932 - DNA, 12 bp, Homo sapiens
tacctgattttt

SEQ ID NO: 1398933 - DNA, 16 bp, Homo sapiens
tacgtatttaatagca

SEQ ID NO: 1398934 - DNA, 19 bp, Homo sapiens
tacgtgggcattgtctttt

SEQ ID NO: 1398935 - DNA, 14 bp, Homo sapiens
tactaaagccaaac

SEQ ID NO: 1398936 - DNA, 19 bp, Homo sapiens
tactaaggaagattactca

SEQ ID NO: 1398937 - DNA, 12 bp, Homo sapiens
tactattaaaaa

SEQ ID NO: 1398938 - DNA, 19 bp, Homo sapiens
tactattggagagaaaaaa

SEQ ID NO: 1398939 - DNA, 13 bp, Homo sapiens
tactcacctcctc

SEQ ID NO: 1398940 - DNA, 16 bp, Homo sapiens
tactcagataaggtaa

SEQ ID NO: 1398941 - DNA, 23 bp, Homo sapiens
tactcagataaggtaaaatgcca

SEQ ID NO: 1398942 - DNA, 11 bp, Homo sapiens
tactcattttt

SEQ ID NO: 1398943 - DNA, 14 bp, Homo sapiens
tactcttcttgaaa

SEQ ID NO: 1398944 - DNA, 18 bp, Homo sapiens
tactcttcttgaaatttt

SEQ ID NO: 1398945 - DNA, 19 bp, Homo sapiens
tactgaatttttaaaatgc

SEQ ID NO: 1398946 - DNA, 13 bp, Homo sapiens
tactgcatacttt

SEQ ID NO: 1398947 - DNA, 21 bp, Homo sapiens
tactgcatactttttaaatgt

SEQ ID NO: 1398948 - DNA, 19 bp, Homo sapiens
tacttacatgcattactgc

SEQ ID NO: 1398949 - DNA, 18 bp, Homo sapiens
tacttcctctaggaaatg

SEQ ID NO: 1398950 - DNA, 20 bp, Homo sapiens
tacttctcattttttaaaaa

SEQ ID NO: 1398951 - DNA, 19 bp, Homo sapiens
tacttgctcttgatgcctg

SEQ ID NO: 1398952 - DNA, 20 bp, Homo sapiens
tacttgctcttgatgcctgg

SEQ ID NO: 1398953 - DNA, 14 bp, Homo sapiens
tactttgacttttt

SEQ ID NO: 1398954 - DNA, 21 bp, Homo sapiens
tactttgataaagtaaaaaag

SEQ ID NO: 1398955 - DNA, 21 bp, Homo sapiens
tacttttaaactgtgtacata

SEQ ID NO: 1398956 - DNA, 14 bp, Homo sapiens
tactttttaaatgt

SEQ ID NO: 1398957 - DNA, 16 bp, Homo sapiens
tagaaaacataatctt

SEQ ID NO: 1398958 - DNA, 18 bp, Homo sapiens
tagaaagagatacagagg

SEQ ID NO: 1398959 - DNA, 13 bp, Homo sapiens
tagaaatcatttt

SEQ ID NO: 1398960 - DNA, 15 bp, Homo sapiens
tagaacctaattcaa

SEQ ID NO: 1398961 - DNA, 16 bp, Homo sapiens
tagaatgatttcatgc

SEQ ID NO: 1398962 - DNA, 18 bp, Homo sapiens
tagaatgtaaagcttgtc

SEQ ID NO: 1398963 - DNA, 15 bp, Homo sapiens
tagaattatctaatt

SEQ ID NO: 1398964 - DNA, 19 bp, Homo sapiens
tagaattgagtgtttaaag

SEQ ID NO: 1398965 - DNA, 22 bp, Homo sapiens
tagaatttagccctggtttgaa

SEQ ID NO: 1398966 - DNA, 14 bp, Homo sapiens
tagacaagccagaa

SEQ ID NO: 1398967 - DNA, 19 bp, Homo sapiens
tagacaagccagaacttga

SEQ ID NO: 1398968 - DNA, 19 bp, Homo sapiens
tagactggaacttgaactg

SEQ ID NO: 1398969 - DNA, 16 bp, Homo sapiens
tagactggacagcttg

SEQ ID NO: 1398970 - DNA, 22 bp, Homo sapiens
tagacttcaagcatggctattt

SEQ ID NO: 1398971 - DNA, 14 bp, Homo sapiens
tagagcactgccac

SEQ ID NO: 1398972 - DNA, 17 bp, Homo sapiens
tagagcactgccaccag

SEQ ID NO: 1398973 - DNA, 17 bp, Homo sapiens
tagaggcttccttcatt

SEQ ID NO: 1398974 - DNA, 23 bp, Homo sapiens
tagagggaggagaatgagcctcg

SEQ ID NO: 1398975 - DNA, 20 bp, Homo sapiens
tagatttgtgtgcatcaggc

SEQ ID NO: 1398976 - DNA, 21 bp, Homo sapiens
tagcaactacagtctaaagct

SEQ ID NO: 1398977 - DNA, 22 bp, Homo sapiens
tagcaactacagtctaaagctg

SEQ ID NO: 1398978 - DNA, 17 bp, Homo sapiens
tagccacaccaggatag

SEQ ID NO: 1398979 - DNA, 13 bp, Homo sapiens
tagccccagtgac

SEQ ID NO: 1398980 - DNA, 18 bp, Homo sapiens
tagccctcagcccacctg

SEQ ID NO: 1398981 - DNA, 18 bp, Homo sapiens
tagccctcctttttccaa

SEQ ID NO: 1398982 - DNA, 16 bp, Homo sapiens
tagccctggtttgaaa

SEQ ID NO: 1398983 - DNA, 16 bp, Homo sapiens
tagccttctctgttca

SEQ ID NO: 1398984 - DNA, 14 bp, Homo sapiens
tagctgatcagttt

SEQ ID NO: 1398985 - DNA, 19 bp, Homo sapiens
tagcttatctacttccaaa

SEQ ID NO: 1398986 - DNA, 23 bp, Homo sapiens
taggaaatggctttgtgattcaa

SEQ ID NO: 1398987 - DNA, 21 bp, Homo sapiens
taggatccagtgatccttaca

SEQ ID NO: 1398988 - DNA, 16 bp, Homo sapiens
taggatttatttaaaa

SEQ ID NO: 1398989 - DNA, 12 bp, Homo sapiens
taggcaacatag

SEQ ID NO: 1398990 - DNA, 22 bp, Homo sapiens
taggcagactctttatgcttgc

SEQ ID NO: 1398991 - DNA, 19 bp, Homo sapiens
taggcatttttaccatcac

SEQ ID NO: 1398992 - DNA, 20 bp, Homo sapiens
taggccttgcggctcctcag

SEQ ID NO: 1398993 - DNA, 21 bp, Homo sapiens
taggccttgcggctcctcagg

SEQ ID NO: 1398994 - DNA, 19 bp, Homo sapiens
tagggtttccctactgaag

SEQ ID NO: 1398995 - DNA, 19 bp, Homo sapiens
tagggtttgtgacagggcg

SEQ ID NO: 1398996 - DNA, 15 bp, Homo sapiens
taggtagaattgtgg

SEQ ID NO: 1398997 - DNA, 19 bp, Homo sapiens
tagtaagcctccctcctcg

SEQ ID NO: 1398998 - DNA, 15 bp, Homo sapiens
tagtcaatcaagtct

SEQ ID NO: 1398999 - DNA, 20 bp, Homo sapiens
tagtgatttttatgccacct

SEQ ID NO: 1399000 - DNA, 23 bp, Homo sapiens
tagtggattactgccattcactt

SEQ ID NO: 1399001 - DNA, 17 bp, Homo sapiens
tagttcatgtctgctat

SEQ ID NO: 1399002 - DNA, 17 bp, Homo sapiens
tagttgaaaataaagtg

SEQ ID NO: 1399003 - DNA, 20 bp, Homo sapiens
tagttttacttttaaactgt

SEQ ID NO: 1399004 - DNA, 22 bp, Homo sapiens
tagttttacttttaaactgtgt

SEQ ID NO: 1399005 - DNA, 19 bp, Homo sapiens
tataaaatgcaaaataaat

SEQ ID NO: 1399006 - DNA, 16 bp, Homo sapiens
tataaattaagacttt

SEQ ID NO: 1399007 - DNA, 15 bp, Homo sapiens
tataaccttaattta

SEQ ID NO: 1399008 - DNA, 16 bp, Homo sapiens
tataagtagcaggcca

SEQ ID NO: 1399009 - DNA, 17 bp, Homo sapiens
tataatcattattactt

SEQ ID NO: 1399010 - DNA, 18 bp, Homo sapiens
tataattgttttatctga

SEQ ID NO: 1399011 - DNA, 22 bp, Homo sapiens
tataccccgtgaagcatccagg

SEQ ID NO: 1399012 - DNA, 12 bp, Homo sapiens
tatactgcatac

SEQ ID NO: 1399013 - DNA, 16 bp, Homo sapiens
tatactgcatactttt

SEQ ID NO: 1399014 - DNA, 23 bp, Homo sapiens
tatactgcttggagctgagcaaa

SEQ ID NO: 1399015 - DNA, 19 bp, Homo sapiens
tataggatttatttaaaat

SEQ ID NO: 1399016 - DNA, 15 bp, Homo sapiens
tatagttttactttt

SEQ ID NO: 1399017 - DNA, 19 bp, Homo sapiens
tatatatgtacagttatct

SEQ ID NO: 1399018 - DNA, 18 bp, Homo sapiens
tatatgaagaaaatcact

SEQ ID NO: 1399019 - DNA, 19 bp, Homo sapiens
tatatgaggacttgtgtct

SEQ ID NO: 1399020 - DNA, 17 bp, Homo sapiens
tatatgcttactgatat

SEQ ID NO: 1399021 - DNA, 21 bp, Homo sapiens
tatatgcttactgatatattt

SEQ ID NO: 1399022 - DNA, 17 bp, Homo sapiens
tatatggaaattctgct

SEQ ID NO: 1399023 - DNA, 16 bp, Homo sapiens
tatatggaataagtgt

SEQ ID NO: 1399024 - DNA, 18 bp, Homo sapiens
tatatggaataagtgtac

SEQ ID NO: 1399025 - DNA, 20 bp, Homo sapiens
tatatggaataagtgtacat

SEQ ID NO: 1399026 - DNA, 21 bp, Homo sapiens
tatatggaataagtgtacata

SEQ ID NO: 1399027 - DNA, 13 bp, Homo sapiens
tatatgttattaa

SEQ ID NO: 1399028 - DNA, 16 bp, Homo sapiens
tatattgataagatct

SEQ ID NO: 1399029 - DNA, 19 bp, Homo sapiens
tatatttaactctctttat

SEQ ID NO: 1399030 - DNA, 19 bp, Homo sapiens
tatcaaacaccaacataaa

SEQ ID NO: 1399031 - DNA, 14 bp, Homo sapiens
tatcaaataactaa

SEQ ID NO: 1399032 - DNA, 21 bp, Homo sapiens
tatcaacatctttttcctccc

SEQ ID NO: 1399033 - DNA, 16 bp, Homo sapiens
tatcagtgcttaatgt

SEQ ID NO: 1399034 - DNA, 14 bp, Homo sapiens
tatcatagaaatgt

SEQ ID NO: 1399035 - DNA, 15 bp, Homo sapiens
tatcatagaaatgta

SEQ ID NO: 1399036 - DNA, 23 bp, Homo sapiens
tatcatagaaatgtaacttttgt

SEQ ID NO: 1399037 - DNA, 15 bp, Homo sapiens
tatccactttgcaca

SEQ ID NO: 1399038 - DNA, 18 bp, Homo sapiens
tatccactttgcacagct

SEQ ID NO: 1399039 - DNA, 16 bp, Homo sapiens
tatccccatttctttt

SEQ ID NO: 1399040 - DNA, 20 bp, Homo sapiens
tctactggtcttgtggaatt

SEQ ID NO: 1399041 - DNA, 19 bp, Homo sapiens
tctacttccaaactaattt

SEQ ID NO: 1399042 - DNA, 21 bp, Homo sapiens
tctacttctttttctttgaga

SEQ ID NO: 1399043 - DNA, 13 bp, Homo sapiens
tctagaacacagg

SEQ ID NO: 1399044 - DNA, 15 bp, Homo sapiens
tctagaacacaggca

SEQ ID NO: 1399045 - DNA, 16 bp, Homo sapiens
tctagaggcttccttc

SEQ ID NO: 1399046 - DNA, 21 bp, Homo sapiens
tctagaggcttccttcatttc

SEQ ID NO: 1399047 - DNA, 20 bp, Homo sapiens
tctagagtgagaatctggct

SEQ ID NO: 1399048 - DNA, 17 bp, Homo sapiens
tctaggtaggaaatgtg

SEQ ID NO: 1399049 - DNA, 14 bp, Homo sapiens
tctagttctgccag

SEQ ID NO: 1399050 - DNA, 17 bp, Homo sapiens
tctagttctgccaggag

SEQ ID NO: 1399051 - DNA, 17 bp, Homo sapiens
tctatagccaaaaatag

SEQ ID NO: 1399052 - DNA, 21 bp, Homo sapiens
tctatcaaccccagacactgg

SEQ ID NO: 1399053 - DNA, 17 bp, Homo sapiens
tctattaatatttatgt

SEQ ID NO: 1399054 - DNA, 17 bp, Homo sapiens
tctattttgtaaactca

SEQ ID NO: 1399055 - DNA, 16 bp, Homo sapiens
tctcaccaggcagcct

SEQ ID NO: 1399056 - DNA, 17 bp, Homo sapiens
tctcaccaggcagcctc

SEQ ID NO: 1399057 - DNA, 17 bp, Homo sapiens
tctcaggccagagccaa

SEQ ID NO: 1399058 - DNA, 14 bp, Homo sapiens
tctcatgaacctca

SEQ ID NO: 1399059 - DNA, 17 bp, Homo sapiens
tctcatttttccgtaaa

SEQ ID NO: 1399060 - DNA, 21 bp, Homo sapiens
tctcatttttccgtaaaaatg

SEQ ID NO: 1399061 - DNA, 15 bp, Homo sapiens
tctccaggcaggtct

SEQ ID NO: 1399062 - DNA, 16 bp, Homo sapiens
tctccttgttctgata

SEQ ID NO: 1399063 - DNA, 15 bp, Homo sapiens
tctctcatgaacctc

SEQ ID NO: 1399064 - DNA, 15 bp, Homo sapiens
tctctccttgttctg

SEQ ID NO: 1399065 - DNA, 19 bp, Homo sapiens
tctctccttgttctgataa

SEQ ID NO: 1399066 - DNA, 14 bp, Homo sapiens
tctctctctacaaa

SEQ ID NO: 1399067 - DNA, 16 bp, Homo sapiens
tctctgcaggtcccta

SEQ ID NO: 1399068 - DNA, 22 bp, Homo sapiens
tctctgcaggtccctaataaag

SEQ ID NO: 1399069 - DNA, 18 bp, Homo sapiens
tctctgtgtgcacaaata

SEQ ID NO: 1399070 - DNA, 13 bp, Homo sapiens
tctctgttcattt

SEQ ID NO: 1399071 - DNA, 14 bp, Homo sapiens
tctctgttcatttc

SEQ ID NO: 1399072 - DNA, 12 bp, Homo sapiens
tctcttgcctca

SEQ ID NO: 1399073 - DNA, 13 bp, Homo sapiens
tctcttgcctcaa

SEQ ID NO: 1399074 - DNA, 12 bp, Homo sapiens
tctgaacacatt

SEQ ID NO: 1399075 - DNA, 13 bp, Homo sapiens
tctgaacacattg

SEQ ID NO: 1399076 - DNA, 14 bp, Homo sapiens
tctgagagaggcca

SEQ ID NO: 1399077 - DNA, 23 bp, Homo sapiens
tctgagcccggtaagagcaaaag

SEQ ID NO: 1399078 - DNA, 17 bp, Homo sapiens
tctgagctatttcatct

SEQ ID NO: 1399079 - DNA, 13 bp, Homo sapiens
tctgattatcagg

SEQ ID NO: 1399080 - DNA, 22 bp, Homo sapiens
tctgattcgaatgacactgttc

SEQ ID NO: 1399081 - DNA, 11 bp, Homo sapiens
tctgcaggtcc

SEQ ID NO: 1399082 - DNA, 14 bp, Homo sapiens
tctgcaggtcccta

SEQ ID NO: 1399083 - DNA, 19 bp, Homo sapiens
tctgccccttctgtttcca

SEQ ID NO: 1399084 - DNA, 20 bp, Homo sapiens
tctgccttctcatgatccaa

SEQ ID NO: 1399085 - DNA, 16 bp, Homo sapiens
tctgctactttgctgc

SEQ ID NO: 1399086 - DNA, 18 bp, Homo sapiens
tctgctcagatagaatga

SEQ ID NO: 1399087 - DNA, 19 bp, Homo sapiens
tctggacaggatgtgtttg

SEQ ID NO: 1399088 - DNA, 17 bp, Homo sapiens
tctggacctccccctct

SEQ ID NO: 1399089 - DNA, 13 bp, Homo sapiens
tctggattataaa

SEQ ID NO: 1399090 - DNA, 15 bp, Homo sapiens
tctggcaacatcttt

SEQ ID NO: 1399091 - DNA, 22 bp, Homo sapiens
tctggcacagcctggctgtggc

SEQ ID NO: 1399092 - DNA, 16 bp, Homo sapiens
tctggccaggaagctt

SEQ ID NO: 1399093 - DNA, 17 bp, Homo sapiens
tctggccaggaagcttt

SEQ ID NO: 1399094 - DNA, 15 bp, Homo sapiens
tctggcttctggcca

SEQ ID NO: 1399095 - DNA, 18 bp, Homo sapiens
tctggcttctggccagga

SEQ ID NO: 1399096 - DNA, 21 bp, Homo sapiens
tctgggagtgttctgtttccc

SEQ ID NO: 1399097 - DNA, 13 bp, Homo sapiens
tctgtaaagctaa

SEQ ID NO: 1399098 - DNA, 14 bp, Homo sapiens
tctgtgtgcacaaa

SEQ ID NO: 1399099 - DNA, 18 bp, Homo sapiens
tctgtttttctaactggg

SEQ ID NO: 1399100 - DNA, 16 bp, Homo sapiens
tcttaaacacttgcaa

SEQ ID NO: 1399101 - DNA, 15 bp, Homo sapiens
tcttaaataagaaac

SEQ ID NO: 1399102 - DNA, 18 bp, Homo sapiens
tcttaaataagaaacttt

SEQ ID NO: 1399103 - DNA, 15 bp, Homo sapiens
tcttagctgtctgct

SEQ ID NO: 1399104 - DNA, 18 bp, Homo sapiens
tcttagctgtctgctcag

SEQ ID NO: 1399105 - DNA, 15 bp, Homo sapiens
tcttattcattttct

SEQ ID NO: 1399106 - DNA, 23 bp, Homo sapiens
tcttcctagttttctcctcccag

SEQ ID NO: 1399107 - DNA, 13 bp, Homo sapiens
tcttcctgacact

SEQ ID NO: 1399108 - DNA, 19 bp, Homo sapiens
tcttctgagctatttcatc

SEQ ID NO: 1399109 - DNA, 18 bp, Homo sapiens
tcttctggactggttttc

SEQ ID NO: 1399110 - DNA, 17 bp, Homo sapiens
tcttcttgaaattttaa

SEQ ID NO: 1399111 - DNA, 19 bp, Homo sapiens
tcttgaggggaccaggagt

SEQ ID NO: 1399112 - DNA, 21 bp, Homo sapiens
tcttgatgcctggcggggtgg

SEQ ID NO: 1399113 - DNA, 23 bp, Homo sapiens
tctttaaagtgactaatggcatg

SEQ ID NO: 1399114 - DNA, 19 bp, Homo sapiens
tcttttgtaaggtttttgt

SEQ ID NO: 1399115 - DNA, 15 bp, Homo sapiens
tctttttttcttgaa

SEQ ID NO: 1399116 - DNA, 22 bp, Homo sapiens
tctttttttttttttaataaat

SEQ ID NO: 1399117 - DNA, 23 bp, Homo sapiens
tctttttttttttttaataaatt

SEQ ID NO: 1399118 - DNA, 13 bp, Homo sapiens
tgaaaaagaagaa

SEQ ID NO: 1399119 - DNA, 17 bp, Homo sapiens
tgaaaagctagaattga

SEQ ID NO: 1399120 - DNA, 18 bp, Homo sapiens
tgaaaaggaggggtacat

SEQ ID NO: 1399121 - DNA, 21 bp, Homo sapiens
tgaaaaggtttatgaaaaaga

SEQ ID NO: 1399122 - DNA, 17 bp, Homo sapiens
tgaaaatgtgctatact

SEQ ID NO: 1399123 - DNA, 14 bp, Homo sapiens
tgaaaattatttaa

SEQ ID NO: 1399124 - DNA, 17 bp, Homo sapiens
tgaaaattatttaaacc

SEQ ID NO: 1399125 - DNA, 14 bp, Homo sapiens
tgaaacaaagagtt

SEQ ID NO: 1399126 - DNA, 12 bp, Homo sapiens
tgaaacagaaaa

SEQ ID NO: 1399127 - DNA, 23 bp, Homo sapiens
tgaaacagaaaaatatgtaccaa

SEQ ID NO: 1399128 - DNA, 23 bp, Homo sapiens
tgaaagccaaggagtcactgaga

SEQ ID NO: 1399129 - DNA, 16 bp, Homo sapiens
tgaaaggtaatttgag

SEQ ID NO: 1399130 - DNA, 14 bp, Homo sapiens
tgaaatcctgcttc

SEQ ID NO: 1399131 - DNA, 17 bp, Homo sapiens
tgaaatttaactgccta

SEQ ID NO: 1399132 - DNA, 16 bp, Homo sapiens
tgaaattttatatgct

SEQ ID NO: 1399133 - DNA, 12 bp, Homo sapiens
tgaacaagaatt

SEQ ID NO: 1399134 - DNA, 13 bp, Homo sapiens
tgaacagaacata

SEQ ID NO: 1399135 - DNA, 17 bp, Homo sapiens
tgaactcaaactgagga

SEQ ID NO: 1399136 - DNA, 18 bp, Homo sapiens
tgaactcaaactgaggaa

SEQ ID NO: 1399137 - DNA, 15 bp, Homo sapiens
tgaactcttcactct

SEQ ID NO: 1399138 - DNA, 22 bp, Homo sapiens
tgaactgaacaccattgaaggc

SEQ ID NO: 1399139 - DNA, 17 bp, Homo sapiens
tgaactgattcacatct

SEQ ID NO: 1399140 - DNA, 21 bp, Homo sapiens
tgaacttgaaatatcctgctt

SEQ ID NO: 1399141 - DNA, 21 bp, Homo sapiens
tgaagaatacttctcattttt

SEQ ID NO: 1399142 - DNA, 13 bp, Homo sapiens
tgaagacagaagt

SEQ ID NO: 1399143 - DNA, 20 bp, Homo sapiens
tgaagcaaatcgaatgaaat

SEQ ID NO: 1399144 - DNA, 16 bp, Homo sapiens
tgaagctcacttctgg

SEQ ID NO: 1399145 - DNA, 18 bp, Homo sapiens
tgaagttagctttaactt

SEQ ID NO: 1399146 - DNA, 15 bp, Homo sapiens
tgaagttctgaaatt

SEQ ID NO: 1399147 - DNA, 16 bp, Homo sapiens
tgaagttctgaaattt

SEQ ID NO: 1399148 - DNA, 18 bp, Homo sapiens
tgaatcaagggtcaggcc

SEQ ID NO: 1399149 - DNA, 20 bp, Homo sapiens
tgaatcaagggtcaggcctt

SEQ ID NO: 1399150 - DNA, 14 bp, Homo sapiens
tgaatcctctctct

SEQ ID NO: 1399151 - DNA, 21 bp, Homo sapiens
tgaatcctctctctgtgttac

SEQ ID NO: 1399152 - DNA, 15 bp, Homo sapiens
tgaatgcaaaccata

SEQ ID NO: 1399153 - DNA, 17 bp, Homo sapiens
tgaattgggaacattat

SEQ ID NO: 1399154 - DNA, 19 bp, Homo sapiens
tgaatttttaaacaagtat

SEQ ID NO: 1399155 - DNA, 20 bp, Homo sapiens
tgaatttttttttcctagcc

SEQ ID NO: 1399156 - DNA, 17 bp, Homo sapiens
tgacacaaacacacaca

SEQ ID NO: 1399157 - DNA, 15 bp, Homo sapiens
tgacaggtaaactat

SEQ ID NO: 1399158 - DNA, 18 bp, Homo sapiens
tgacagtggaactacatt

SEQ ID NO: 1399159 - DNA, 17 bp, Homo sapiens
tgacatgtccttctgag

SEQ ID NO: 1399160 - DNA, 23 bp, Homo sapiens
tgaccaaaagttacatgtttgca

SEQ ID NO: 1399161 - DNA, 14 bp, Homo sapiens
tgaccctgagctga

SEQ ID NO: 1399162 - DNA, 22 bp, Homo sapiens
tgacctagttttccatgcgtgt

SEQ ID NO: 1399163 - DNA, 21 bp, Homo sapiens
tgacctcaggcaatctgcccg

SEQ ID NO: 1399164 - DNA, 15 bp, Homo sapiens
tgacgtctgggtggc

SEQ ID NO: 1399165 - DNA, 18 bp, Homo sapiens
tgacgtctgggtggccct

SEQ ID NO: 1399166 - DNA, 14 bp, Homo sapiens
tgactaaaatattt

SEQ ID NO: 1399167 - DNA, 15 bp, Homo sapiens
tgactaatggcatga

SEQ ID NO: 1399168 - DNA, 13 bp, Homo sapiens
tgactagggagcc

SEQ ID NO: 1399169 - DNA, 21 bp, Homo sapiens
tgactagggagccatgtttca

SEQ ID NO: 1399170 - DNA, 13 bp, Homo sapiens
tgactctttccaa

SEQ ID NO: 1399171 - DNA, 23 bp, Homo sapiens
tgctcatattgtgattctgcctt

SEQ ID NO: 1399172 - DNA, 12 bp, Homo sapiens
tgctcttagctg

SEQ ID NO: 1399173 - DNA, 18 bp, Homo sapiens
tgctgagatacatacaga

SEQ ID NO: 1399174 - DNA, 20 bp, Homo sapiens
tgctgagatacatacagaat

SEQ ID NO: 1399175 - DNA, 20 bp, Homo sapiens
tgctgcaaacctgacccctg

SEQ ID NO: 1399176 - DNA, 17 bp, Homo sapiens
tgctggaataagttcaa

SEQ ID NO: 1399177 - DNA, 14 bp, Homo sapiens
tgctggactgtcat

SEQ ID NO: 1399178 - DNA, 14 bp, Homo sapiens
tgctgggcccctgc

SEQ ID NO: 1399179 - DNA, 17 bp, Homo sapiens
tgctgggcccctgcctc

SEQ ID NO: 1399180 - DNA, 18 bp, Homo sapiens
tgctgggcccctgcctct

SEQ ID NO: 1399181 - DNA, 19 bp, Homo sapiens
tgctgggcccctgcctctc

SEQ ID NO: 1399182 - DNA, 15 bp, Homo sapiens
tgctgtgctgtgcta

SEQ ID NO: 1399183 - DNA, 18 bp, Homo sapiens
tgctgtgctgtgctatgg

SEQ ID NO: 1399184 - DNA, 15 bp, Homo sapiens
tgctgtggccaggag

SEQ ID NO: 1399185 - DNA, 16 bp, Homo sapiens
tgctgtggccaggagg

SEQ ID NO: 1399186 - DNA, 14 bp, Homo sapiens
tgcttactgatata

SEQ ID NO: 1399187 - DNA, 21 bp, Homo sapiens
tgcttatgacatcacttgtac

SEQ ID NO: 1399188 - DNA, 15 bp, Homo sapiens
tgcttccaattttct

SEQ ID NO: 1399189 - DNA, 20 bp, Homo sapiens
tgcttctagttctgccagga

SEQ ID NO: 1399190 - DNA, 18 bp, Homo sapiens
tgcttgatagaaatgcca

SEQ ID NO: 1399191 - DNA, 20 bp, Homo sapiens
tgcttgatgggattctggac

SEQ ID NO: 1399192 - DNA, 12 bp, Homo sapiens
tgcttgattttt

SEQ ID NO: 1399193 - DNA, 15 bp, Homo sapiens
tgcttggagctgagc

SEQ ID NO: 1399194 - DNA, 24 bp, Homo sapiens
tgcttttagtattttagtgaactt

SEQ ID NO: 1399195 - DNA, 17 bp, Homo sapiens
tggaaattggaagagca

SEQ ID NO: 1399196 - DNA, 21 bp, Homo sapiens
tggaacactagacaagccaga

SEQ ID NO: 1399197 - DNA, 22 bp, Homo sapiens
tggaacactagacaagccagaa

SEQ ID NO: 1399198 - DNA, 14 bp, Homo sapiens
tggaacatccttgg

SEQ ID NO: 1399199 - DNA, 23 bp, Homo sapiens
tggaactacattagtacacagca

SEQ ID NO: 1399200 - DNA, 17 bp, Homo sapiens
tggaagacgcaagggcc

SEQ ID NO: 1399201 - DNA, 15 bp, Homo sapiens
tggaaggaaggaggc

SEQ ID NO: 1399202 - DNA, 15 bp, Homo sapiens
tggaataagtgtaca

SEQ ID NO: 1399203 - DNA, 14 bp, Homo sapiens
tggaatataattgt

SEQ ID NO: 1399204 - DNA, 22 bp, Homo sapiens
tggaatataattgttttatctg

SEQ ID NO: 1399205 - DNA, 17 bp, Homo sapiens
tggaatgaattaaataa

SEQ ID NO: 1399206 - DNA, 21 bp, Homo sapiens
tggaatgtggcccctgaacaa

SEQ ID NO: 1399207 - DNA, 12 bp, Homo sapiens
tggacacactgt

SEQ ID NO: 1399208 - DNA, 15 bp, Homo sapiens
tggacacactgtaaa

SEQ ID NO: 1399209 - DNA, 21 bp, Homo sapiens
tggacacactgtaaacccctg

SEQ ID NO: 1399210 - DNA, 16 bp, Homo sapiens
tggacatggtctcctc

SEQ ID NO: 1399211 - DNA, 15 bp, Homo sapiens
tggaccactgggcaa

SEQ ID NO: 1399212 - DNA, 14 bp, Homo sapiens
tggacctaatccaa

SEQ ID NO: 1399213 - DNA, 22 bp, Homo sapiens
tggactatggagtgcaccaaag

SEQ ID NO: 1399214 - DNA, 15 bp, Homo sapiens
tggactgtcatagaa

SEQ ID NO: 1399215 - DNA, 21 bp, Homo sapiens
tggactgtcatagaaattaca

SEQ ID NO: 1399216 - DNA, 15 bp, Homo sapiens
tggagagaaaaaatt

SEQ ID NO: 1399217 - DNA, 19 bp, Homo sapiens
tggagcccactgtacttgc

SEQ ID NO: 1399218 - DNA, 23 bp, Homo sapiens
tggagcccactgtacttgctctt

SEQ ID NO: 1399219 - DNA, 12 bp, Homo sapiens
tggagctgagca

SEQ ID NO: 1399220 - DNA, 16 bp, Homo sapiens
tggagtgcaccaaaga

SEQ ID NO: 1399221 - DNA, 16 bp, Homo sapiens
tggatatagttttact

SEQ ID NO: 1399222 - DNA, 17 bp, Homo sapiens
tggatatagttttactt

SEQ ID NO: 1399223 - DNA, 22 bp, Homo sapiens
tggattccccatctcaggccag

SEQ ID NO: 1399224 - DNA, 15 bp, Homo sapiens
tggattctaaaatgc

SEQ ID NO: 1399225 - DNA, 14 bp, Homo sapiens
tggcaagtgaattt

SEQ ID NO: 1399226 - DNA, 20 bp, Homo sapiens
tggcaggcaggctcccaggg

SEQ ID NO: 1399227 - DNA, 22 bp, Homo sapiens
tggcagtgcagcaaccagagca

SEQ ID NO: 1399228 - DNA, 22 bp, Homo sapiens
tggcagtgggaaaaatgtagga

SEQ ID NO: 1399229 - DNA, 23 bp, Homo sapiens
tggcagtgggaaaaatgtaggag

SEQ ID NO: 1399230 - DNA, 16 bp, Homo sapiens
tggcagtttatattta

SEQ ID NO: 1399231 - DNA, 20 bp, Homo sapiens
tggcagtttatatttaactc

SEQ ID NO: 1399232 - DNA, 14 bp, Homo sapiens
tggcatccctgggc

SEQ ID NO: 1399233 - DNA, 20 bp, Homo sapiens
tggcatccctgggccttggg

SEQ ID NO: 1399234 - DNA, 22 bp, Homo sapiens
tggccaatgcacctaaagaaaa

SEQ ID NO: 1399235 - DNA, 16 bp, Homo sapiens
tggccaggaggtgcca

SEQ ID NO: 1399236 - DNA, 13 bp, Homo sapiens
tggccaggccggg

SEQ ID NO: 1399237 - DNA, 22 bp, Homo sapiens
tggccaggccgggaaaaagccc

SEQ ID NO: 1399238 - DNA, 19 bp, Homo sapiens
tggcccctccccctgccag

SEQ ID NO: 1399239 - DNA, 15 bp, Homo sapiens
tggcctcaaagcaag

SEQ ID NO: 1399240 - DNA, 14 bp, Homo sapiens
tggctgcaggaatc

SEQ ID NO: 1399241 - DNA, 19 bp, Homo sapiens
tggctgcaggaatctttaa

SEQ ID NO: 1399242 - DNA, 19 bp, Homo sapiens
tggctgcataaatgtggta

SEQ ID NO: 1399243 - DNA, 21 bp, Homo sapiens
tggcttctggccaggaagctt

SEQ ID NO: 1399244 - DNA, 16 bp, Homo sapiens
tggcttgggcagcatc

SEQ ID NO: 1399245 - DNA, 20 bp, Homo sapiens
tggcttttgcggttcaggaa

SEQ ID NO: 1399246 - DNA, 19 bp, Homo sapiens
tgggagaaatctggcttct

SEQ ID NO: 1399247 - DNA, 23 bp, Homo sapiens
tgggagaccggcctgccaggagg

SEQ ID NO: 1399248 - DNA, 13 bp, Homo sapiens
tgggagagggcgc

SEQ ID NO: 1399249 - DNA, 15 bp, Homo sapiens
tgggagagggcgcag

SEQ ID NO: 1399250 - DNA, 23 bp, Homo sapiens
tgggaggctctggagcccactgt

SEQ ID NO: 1399251 - DNA, 15 bp, Homo sapiens
tgggcagattttcag

SEQ ID NO: 1399252 - DNA, 16 bp, Homo sapiens
tgggccaactcacctg

SEQ ID NO: 1399253 - DNA, 15 bp, Homo sapiens
tgggcccctgcctct

SEQ ID NO: 1399254 - DNA, 23 bp, Homo sapiens
tgggcccctgcctctctgcaggt

SEQ ID NO: 1399255 - DNA, 16 bp, Homo sapiens
tgggccttgggctccg

SEQ ID NO: 1399256 - DNA, 13 bp, Homo sapiens
tgggcttcatctg

SEQ ID NO: 1399257 - DNA, 15 bp, Homo sapiens
tggggaagagagcct

SEQ ID NO: 1399258 - DNA, 17 bp, Homo sapiens
tggggaagagagcctgc

SEQ ID NO: 1399259 - DNA, 22 bp, Homo sapiens
tggggaagagagcctgcaggat

SEQ ID NO: 1399260 - DNA, 13 bp, Homo sapiens
tggggagagacgg

SEQ ID NO: 1399261 - DNA, 18 bp, Homo sapiens
tggggagcaggaggccaa

SEQ ID NO: 1399262 - DNA, 21 bp, Homo sapiens
tggggagcaggaggccaataa

SEQ ID NO: 1399263 - DNA, 22 bp, Homo sapiens
tggggagcaggaggccaataaa

SEQ ID NO: 1399264 - DNA, 19 bp, Homo sapiens
tggggagtttagggtgggg

SEQ ID NO: 1399265 - DNA, 20 bp, Homo sapiens
tggggagtttagggtggggg

SEQ ID NO: 1399266 - DNA, 16 bp, Homo sapiens
tggggcaggggccggg

SEQ ID NO: 1399267 - DNA, 14 bp, Homo sapiens
tgggggacttacat

SEQ ID NO: 1399268 - DNA, 13 bp, Homo sapiens
tggggggggtgct

SEQ ID NO: 1399269 - DNA, 20 bp, Homo sapiens
tggggtatggattctaaaat

SEQ ID NO: 1399270 - DNA, 22 bp, Homo sapiens
tggggtggggggggtgctgggc

SEQ ID NO: 1399271 - DNA, 18 bp, Homo sapiens
tgggtaatgaaacaaaga

SEQ ID NO: 1399272 - DNA, 14 bp, Homo sapiens
tgggtgttaatttt

SEQ ID NO: 1399273 - DNA, 14 bp, Homo sapiens
tgggttttatcagt

SEQ ID NO: 1399274 - DNA, 19 bp, Homo sapiens
tggtaatttctactttgat

SEQ ID NO: 1399275 - DNA, 18 bp, Homo sapiens
tggtcattttatgttaag

SEQ ID NO: 1399276 - DNA, 17 bp, Homo sapiens
tggtccaaaataaaacc

SEQ ID NO: 1399277 - DNA, 21 bp, Homo sapiens
tggtccaaaataaaacctcag

SEQ ID NO: 1399278 - DNA, 23 bp, Homo sapiens
tggtccaaaataaaacctcagct

SEQ ID NO: 1399279 - DNA, 12 bp, Homo sapiens
tggtctcctctg

SEQ ID NO: 1399280 - DNA, 21 bp, Homo sapiens
tggtctcctctgattatcagg

SEQ ID NO: 1399281 - DNA, 12 bp, Homo sapiens
tggtgccttcat

SEQ ID NO: 1399282 - DNA, 14 bp, Homo sapiens
tggtggtccctggg

SEQ ID NO: 1399283 - DNA, 15 bp, Homo sapiens
tggtggtccctgggt

SEQ ID NO: 1399284 - DNA, 13 bp, Homo sapiens
tggttagaaatgc

SEQ ID NO: 1399285 - DNA, 15 bp, Homo sapiens
tggttcacactgacc

SEQ ID NO: 1399286 - DNA, 21 bp, Homo sapiens
tggttcttgaggggaccagga

SEQ ID NO: 1399287 - DNA, 22 bp, Homo sapiens
tggttcttgaggggaccaggag

SEQ ID NO: 1399288 - DNA, 17 bp, Homo sapiens
tggtttcccaagagcta

SEQ ID NO: 1399289 - DNA, 17 bp, Homo sapiens
tggtttgccttccagaa

SEQ ID NO: 1399290 - DNA, 20 bp, Homo sapiens
tggttttctccaagagctac

SEQ ID NO: 1399291 - DNA, 14 bp, Homo sapiens
tgtaaaacaggtag

SEQ ID NO: 1399292 - DNA, 14 bp, Homo sapiens
tgtaaaatattgtt

SEQ ID NO: 1399293 - DNA, 23 bp, Homo sapiens
tgtaaactcaaaatatttgtaca

SEQ ID NO: 1399294 - DNA, 18 bp, Homo sapiens
tgtaaactgtgtattcca

SEQ ID NO: 1399295 - DNA, 22 bp, Homo sapiens
tgtaaactgtgtattccaagac

SEQ ID NO: 1399296 - DNA, 18 bp, Homo sapiens
tgtaaagatatttttatc

SEQ ID NO: 1399297 - DNA, 12 bp, Homo sapiens
tgtaaagctaaa

SEQ ID NO: 1399298 - DNA, 13 bp, Homo sapiens
tgtaaagcttgtc

SEQ ID NO: 1399299 - DNA, 17 bp, Homo sapiens
tgtaaatattttaaaga

SEQ ID NO: 1399300 - DNA, 18 bp, Homo sapiens
tgtaaatattttaaagaa

SEQ ID NO: 1399301 - DNA, 17 bp, Homo sapiens
tttcctagccctctcac

SEQ ID NO: 1399302 - DNA, 15 bp, Homo sapiens
tttcctatgctttga

SEQ ID NO: 1399303 - DNA, 19 bp, Homo sapiens
tttcctcagactctaagaa

SEQ ID NO: 1399304 - DNA, 22 bp, Homo sapiens
tttcctccaaactcctgcctgt

SEQ ID NO: 1399305 - DNA, 13 bp, Homo sapiens
tttcctccctcag

SEQ ID NO: 1399306 - DNA, 21 bp, Homo sapiens
tttcctcttctattttgtaaa

SEQ ID NO: 1399307 - DNA, 16 bp, Homo sapiens
tttcctggtgccaatt

SEQ ID NO: 1399308 - DNA, 19 bp, Homo sapiens
tttcctggtgccaatttca

SEQ ID NO: 1399309 - DNA, 16 bp, Homo sapiens
tttccttttttgttat

SEQ ID NO: 1399310 - DNA, 22 bp, Homo sapiens
tttctatagccaaaaatagcta

SEQ ID NO: 1399311 - DNA, 17 bp, Homo sapiens
tttctattaatatttat

SEQ ID NO: 1399312 - DNA, 16 bp, Homo sapiens
tttctcactaaatctt

SEQ ID NO: 1399313 - DNA, 21 bp, Homo sapiens
tttctccaagagctacataat

SEQ ID NO: 1399314 - DNA, 17 bp, Homo sapiens
tttctgtgcctgaatat

SEQ ID NO: 1399315 - DNA, 16 bp, Homo sapiens
tttcttaaaccttcag

SEQ ID NO: 1399316 - DNA, 19 bp, Homo sapiens
tttcttaaataagaaactt

SEQ ID NO: 1399317 - DNA, 20 bp, Homo sapiens
tttcttaaataagaaacttt

SEQ ID NO: 1399318 - DNA, 21 bp, Homo sapiens
tttcttaaataagaaactttt

SEQ ID NO: 1399319 - DNA, 23 bp, Homo sapiens
tttgaaaaagcgaaaaaatcagg

SEQ ID NO: 1399320 - DNA, 18 bp, Homo sapiens
tttgaacctgatgaaaat

SEQ ID NO: 1399321 - DNA, 20 bp, Homo sapiens
tttgaacctgatgaaaataa

SEQ ID NO: 1399322 - DNA, 13 bp, Homo sapiens
tttgaagtgtaat

SEQ ID NO: 1399323 - DNA, 17 bp, Homo sapiens
tttgaagttagctttaa

SEQ ID NO: 1399324 - DNA, 21 bp, Homo sapiens
tttgagagaaatatgaagaac

SEQ ID NO: 1399325 - DNA, 17 bp, Homo sapiens
tttgagtacagaattca

SEQ ID NO: 1399326 - DNA, 17 bp, Homo sapiens
tttgatactaagcattg

SEQ ID NO: 1399327 - DNA, 16 bp, Homo sapiens
tttgcacctttctagt

SEQ ID NO: 1399328 - DNA, 17 bp, Homo sapiens
tttgcacctttctagtt

SEQ ID NO: 1399329 - DNA, 17 bp, Homo sapiens
tttgcctcttccagtct

SEQ ID NO: 1399330 - DNA, 13 bp, Homo sapiens
tttgcctgtaaca

SEQ ID NO: 1399331 - DNA, 14 bp, Homo sapiens
tttgcctgtaacaa

SEQ ID NO: 1399332 - DNA, 22 bp, Homo sapiens
tttgctgtaatgttaatattga

SEQ ID NO: 1399333 - DNA, 19 bp, Homo sapiens
tttggcaatttttttatac

SEQ ID NO: 1399334 - DNA, 16 bp, Homo sapiens
tttggcatccctgggc

SEQ ID NO: 1399335 - DNA, 18 bp, Homo sapiens
tttggcatccctgggcct

SEQ ID NO: 1399336 - DNA, 13 bp, Homo sapiens
tttgggtccagga

SEQ ID NO: 1399337 - DNA, 14 bp, Homo sapiens
tttgggtccaggag

SEQ ID NO: 1399338 - DNA, 18 bp, Homo sapiens
tttggtgattacatttta

SEQ ID NO: 1399339 - DNA, 21 bp, Homo sapiens
tttggtttcccaagagctacg

SEQ ID NO: 1399340 - DNA, 15 bp, Homo sapiens
tttgtgattcaatct

SEQ ID NO: 1399341 - DNA, 17 bp, Homo sapiens
tttgtgtggatatttat

SEQ ID NO: 1399342 - DNA, 12 bp, Homo sapiens
tttgttaattta

SEQ ID NO: 1399343 - DNA, 14 bp, Homo sapiens
tttgttgctgtttt

SEQ ID NO: 1399344 - DNA, 14 bp, Homo sapiens
tttgtttcctttgt

SEQ ID NO: 1399345 - DNA, 21 bp, Homo sapiens
ttttaaaatgccgattacacc

SEQ ID NO: 1399346 - DNA, 23 bp, Homo sapiens
ttttaaactgtgtacataactga

SEQ ID NO: 1399347 - DNA, 16 bp, Homo sapiens
ttttagccttctctgt

SEQ ID NO: 1399348 - DNA, 18 bp, Homo sapiens
ttttaggaagcaagctta

SEQ ID NO: 1399349 - DNA, 19 bp, Homo sapiens
ttttatctgaaatcaatta

SEQ ID NO: 1399350 - DNA, 13 bp, Homo sapiens
ttttatttaaaaa

SEQ ID NO: 1399351 - DNA, 14 bp, Homo sapiens
ttttcaagaaactg

SEQ ID NO: 1399352 - DNA, 15 bp, Homo sapiens
ttttcaagaaactga

SEQ ID NO: 1399353 - DNA, 16 bp, Homo sapiens
ttttcactgtagaatg

SEQ ID NO: 1399354 - DNA, 18 bp, Homo sapiens
ttttcagcaaactctttt

SEQ ID NO: 1399355 - DNA, 21 bp, Homo sapiens
ttttcatacattttctaagaa

SEQ ID NO: 1399356 - DNA, 20 bp, Homo sapiens
ttttccatgcgtgtttctga

SEQ ID NO: 1399357 - DNA, 18 bp, Homo sapiens
ttttcccaaaatgttgaa

SEQ ID NO: 1399358 - DNA, 17 bp, Homo sapiens
ttttcctagccctctca

SEQ ID NO: 1399359 - DNA, 13 bp, Homo sapiens
ttttcctccctca

SEQ ID NO: 1399360 - DNA, 16 bp, Homo sapiens
ttttccttcaaagttt

SEQ ID NO: 1399361 - DNA, 13 bp, Homo sapiens
ttttctattttgt

SEQ ID NO: 1399362 - DNA, 13 bp, Homo sapiens
ttttctcctccca

SEQ ID NO: 1399363 - DNA, 21 bp, Homo sapiens
ttttctcgctgtcctttctag

SEQ ID NO: 1399364 - DNA, 17 bp, Homo sapiens
ttttctggaatacatga

SEQ ID NO: 1399365 - DNA, 18 bp, Homo sapiens
ttttctgtgcctgaatat

SEQ ID NO: 1399366 - DNA, 12 bp, Homo sapiens
ttttctttgtgt

SEQ ID NO: 1399367 - DNA, 23 bp, Homo sapiens
ttttgacagtgttgaaaatgttc

SEQ ID NO: 1399368 - DNA, 19 bp, Homo sapiens
ttttgctgagactaatctt

SEQ ID NO: 1399369 - DNA, 18 bp, Homo sapiens
ttttgtaaactcaaaata

SEQ ID NO: 1399370 - DNA, 14 bp, Homo sapiens
ttttgtaagacaaa

SEQ ID NO: 1399371 - DNA, 20 bp, Homo sapiens
ttttgtgatgcaaataaata

SEQ ID NO: 1399372 - DNA, 16 bp, Homo sapiens
ttttgtttaccagaga

SEQ ID NO: 1399373 - DNA, 14 bp, Homo sapiens
tttttaataattta

SEQ ID NO: 1399374 - DNA, 18 bp, Homo sapiens
tttttaatgtatagtaaa

SEQ ID NO: 1399375 - DNA, 20 bp, Homo sapiens
tttttaggaagcaagcttaa

SEQ ID NO: 1399376 - DNA, 14 bp, Homo sapiens
tttttatctttata

SEQ ID NO: 1399377 - DNA, 18 bp, Homo sapiens
tttttccttcaaagttta

SEQ ID NO: 1399378 - DNA, 22 bp, Homo sapiens
tttttggaagaggactccttaa

SEQ ID NO: 1399379 - DNA, 13 bp, Homo sapiens
ttttttgtaccaa

SEQ ID NO: 1399380 - DNA, 17 bp, Homo sapiens
aaaaactaaaaactaga

SEQ ID NO: 1399381 - DNA, 19 bp, Homo sapiens
aaaaactacaaccaatgga

SEQ ID NO: 1399382 - DNA, 18 bp, Homo sapiens
aaaaagaagcaacctcag

SEQ ID NO: 1399383 - DNA, 17 bp, Homo sapiens
aaaaagcccaccatttg

SEQ ID NO: 1399384 - DNA, 20 bp, Homo sapiens
aaaaagcttaaaactttgaa

SEQ ID NO: 1399385 - DNA, 15 bp, Homo sapiens
aaaaagggaggggga

SEQ ID NO: 1399386 - DNA, 13 bp, Homo sapiens
aaaaaggtttaca

SEQ ID NO: 1399387 - DNA, 14 bp, Homo sapiens
aaaaatactcagat

SEQ ID NO: 1399388 - DNA, 19 bp, Homo sapiens
aaaaatagtaagcctccct

SEQ ID NO: 1399389 - DNA, 14 bp, Homo sapiens
aaaaatagtttgga

SEQ ID NO: 1399390 - DNA, 14 bp, Homo sapiens
aaaaatgatctaaa

SEQ ID NO: 1399391 - DNA, 20 bp, Homo sapiens
aaaaatgatttcagtagcac

SEQ ID NO: 1399392 - DNA, 11 bp, Homo sapiens
aaaaatgtagg

SEQ ID NO: 1399393 - DNA, 12 bp, Homo sapiens
aaaaatgtagga

SEQ ID NO: 1399394 - DNA, 17 bp, Homo sapiens
aaaacagacactggcat

SEQ ID NO: 1399395 - DNA, 12 bp, Homo sapiens
aaaacaggtaga

SEQ ID NO: 1399396 - DNA, 17 bp, Homo sapiens
aaaacaggtagaattat

SEQ ID NO: 1399397 - DNA, 13 bp, Homo sapiens
aaaacatttattt

SEQ ID NO: 1399398 - DNA, 16 bp, Homo sapiens
aaaacatttattttga

SEQ ID NO: 1399399 - DNA, 20 bp, Homo sapiens
aaaacctcagctagctctgc

SEQ ID NO: 1399400 - DNA, 14 bp, Homo sapiens
aaaactgcatttca

SEQ ID NO: 1399401 - DNA, 14 bp, Homo sapiens
aaaagaaacattgt

SEQ ID NO: 1399402 - DNA, 21 bp, Homo sapiens
aaaagattgaagtattttgct

SEQ ID NO: 1399403 - DNA, 21 bp, Homo sapiens
aaaagattgctgaaattttat

SEQ ID NO: 1399404 - DNA, 22 bp, Homo sapiens
aaaagggccaaagaaccaaaga

SEQ ID NO: 1399405 - DNA, 14 bp, Homo sapiens
aaaaggtttacaga

SEQ ID NO: 1399406 - DNA, 20 bp, Homo sapiens
aaaagtatacttttgtttca

SEQ ID NO: 1399407 - DNA, 15 bp, Homo sapiens
aaaagtcagcatttt

SEQ ID NO: 1399408 - DNA, 19 bp, Homo sapiens
aaaagtcagcattttctta

SEQ ID NO: 1399409 - DNA, 20 bp, Homo sapiens
aaaataaaaagatcactttc

SEQ ID NO: 1399410 - DNA, 14 bp, Homo sapiens
aaaataaacaaata

SEQ ID NO: 1399411 - DNA, 16 bp, Homo sapiens
aaaataaagaatggaa

SEQ ID NO: 1399412 - DNA, 20 bp, Homo sapiens
aaaatagtttggatatgtaa

SEQ ID NO: 1399413 - DNA, 22 bp, Homo sapiens
aaaatagtttggatatgtaaaa

SEQ ID NO: 1399414 - DNA, 22 bp, Homo sapiens
aaaatataaattaagactttaa

SEQ ID NO: 1399415 - DNA, 14 bp, Homo sapiens
aaaatatgtaccaa

SEQ ID NO: 1399416 - DNA, 20 bp, Homo sapiens
ttcactcttcaaatgcctga

SEQ ID NO: 1399417 - DNA, 15 bp, Homo sapiens
ttcagctctgaaaga

SEQ ID NO: 1399418 - DNA, 13 bp, Homo sapiens
ttcaggaaaattg

SEQ ID NO: 1399419 - DNA, 21 bp, Homo sapiens
ttcaggagagagttgaaccta

SEQ ID NO: 1399420 - DNA, 16 bp, Homo sapiens
ttcaggttgttctgta

SEQ ID NO: 1399421 - DNA, 18 bp, Homo sapiens
ttcatatatgaggacttg

SEQ ID NO: 1399422 - DNA, 23 bp, Homo sapiens
ttcatctatttttggcagtctga

SEQ ID NO: 1399423 - DNA, 17 bp, Homo sapiens
ttcatgctatctctgtg

SEQ ID NO: 1399424 - DNA, 13 bp, Homo sapiens
ttcatttcctcaa

SEQ ID NO: 1399425 - DNA, 16 bp, Homo sapiens
ttcatttcctccgtca

SEQ ID NO: 1399426 - DNA, 14 bp, Homo sapiens
ttccagacctgaag

SEQ ID NO: 1399427 - DNA, 23 bp, Homo sapiens
ttccagactgcttccaattttct

SEQ ID NO: 1399428 - DNA, 18 bp, Homo sapiens
ttccataggaatcatgtt

SEQ ID NO: 1399429 - DNA, 17 bp, Homo sapiens
ttccatggcaggaaggc

SEQ ID NO: 1399430 - DNA, 20 bp, Homo sapiens
ttcccacggcctttctagcc

SEQ ID NO: 1399431 - DNA, 23 bp, Homo sapiens
ttcccattactttaatactcacc

SEQ ID NO: 1399432 - DNA, 14 bp, Homo sapiens
ttcccatttcagct

SEQ ID NO: 1399433 - DNA, 15 bp, Homo sapiens
ttcccatttcagctg

SEQ ID NO: 1399434 - DNA, 19 bp, Homo sapiens
ttccccatctcaggccaga

SEQ ID NO: 1399435 - DNA, 23 bp, Homo sapiens
ttcccccctacttgagataatct

SEQ ID NO: 1399436 - DNA, 16 bp, Homo sapiens
ttcctaaatattatga

SEQ ID NO: 1399437 - DNA, 18 bp, Homo sapiens
ttcctagttttctcctcc

SEQ ID NO: 1399438 - DNA, 16 bp, Homo sapiens
ttcctatgctttgaaa

SEQ ID NO: 1399439 - DNA, 18 bp, Homo sapiens
ttcctcagactctaagaa

SEQ ID NO: 1399440 - DNA, 18 bp, Homo sapiens
ttcctccaaactcctgcc

SEQ ID NO: 1399441 - DNA, 20 bp, Homo sapiens
ttcctcttctattttgtaaa

SEQ ID NO: 1399442 - DNA, 13 bp, Homo sapiens
ttcctgaatccaa

SEQ ID NO: 1399443 - DNA, 13 bp, Homo sapiens
ttcctgacacttt

SEQ ID NO: 1399444 - DNA, 22 bp, Homo sapiens
ttcctgacactttaattaccaa

SEQ ID NO: 1399445 - DNA, 15 bp, Homo sapiens
ttcctgcttttcccc

SEQ ID NO: 1399446 - DNA, 19 bp, Homo sapiens
ttcctgtttttcacatttt

SEQ ID NO: 1399447 - DNA, 23 bp, Homo sapiens
ttcctgtttttcacattttcctt

SEQ ID NO: 1399448 - DNA, 22 bp, Homo sapiens
ttcctttgaatcctctctctgt

SEQ ID NO: 1399449 - DNA, 14 bp, Homo sapiens
ttctaaaatgcctt

SEQ ID NO: 1399450 - DNA, 23 bp, Homo sapiens
ttctaagaaacatttatattgat

SEQ ID NO: 1399451 - DNA, 20 bp, Homo sapiens
tgatcctgtattcagacaga

SEQ ID NO: 1399452 - DNA, 15 bp, Homo sapiens
tgatgaaaataaaga

SEQ ID NO: 1399453 - DNA, 19 bp, Homo sapiens
tgatgaaaccttgaagttc

SEQ ID NO: 1399454 - DNA, 23 bp, Homo sapiens
tgatgaaaccttgaagttctgaa

SEQ ID NO: 1399455 - DNA, 14 bp, Homo sapiens
tgatgccaaaaaaa

SEQ ID NO: 1399456 - DNA, 16 bp, Homo sapiens
tgatgggattctggac

SEQ ID NO: 1399457 - DNA, 17 bp, Homo sapiens
tgatgggattctggaca

SEQ ID NO: 1399458 - DNA, 14 bp, Homo sapiens
tgatgttaaaaaaa

SEQ ID NO: 1399459 - DNA, 23 bp, Homo sapiens
tgatgttaaaaaaataagaagaa

SEQ ID NO: 1399460 - DNA, 17 bp, Homo sapiens
tgattcattcttaacaa

SEQ ID NO: 1399461 - DNA, 17 bp, Homo sapiens
tgattcattttaacatc

SEQ ID NO: 1399462 - DNA, 18 bp, Homo sapiens
tgattcgaatgacactgt

SEQ ID NO: 1399463 - DNA, 13 bp, Homo sapiens
tgattgtcttaat

SEQ ID NO: 1399464 - DNA, 16 bp, Homo sapiens
tgatttacgctcattg

SEQ ID NO: 1399465 - DNA, 22 bp, Homo sapiens
tgatttcagtagcacaagttat

SEQ ID NO: 1399466 - DNA, 11 bp, Homo sapiens
tgattttgaac

SEQ ID NO: 1399467 - DNA, 23 bp, Homo sapiens
tgattttgaacctgatgaaaata

SEQ ID NO: 1399468 - DNA, 21 bp, Homo sapiens
tgatttttgcctcttccagtc

SEQ ID NO: 1399469 - DNA, 18 bp, Homo sapiens
tgatttttttttcataca

SEQ ID NO: 1399470 - DNA, 23 bp, Homo sapiens
tgcaaacctgacccctgctcagt

SEQ ID NO: 1399471 - DNA, 13 bp, Homo sapiens
tgcaaataaatat

SEQ ID NO: 1399472 - DNA, 16 bp, Homo sapiens
tgcaaccgtctgttat

SEQ ID NO: 1399473 - DNA, 18 bp, Homo sapiens
tgcaacctccacctcctg

SEQ ID NO: 1399474 - DNA, 19 bp, Homo sapiens
tgcaacctccacctcctgg

SEQ ID NO: 1399475 - DNA, 21 bp, Homo sapiens
tgcaaggtattacactctgta

SEQ ID NO: 1399476 - DNA, 22 bp, Homo sapiens
tgcaaggtattacactctgtaa

SEQ ID NO: 1399477 - DNA, 15 bp, Homo sapiens
tgcaatcccttaata

SEQ ID NO: 1399478 - DNA, 22 bp, Homo sapiens
tgcaatgtaaatattttaaaga

SEQ ID NO: 1399479 - DNA, 15 bp, Homo sapiens
tgcacaataaaaatg

SEQ ID NO: 1399480 - DNA, 15 bp, Homo sapiens
tgcacacaaacacct

SEQ ID NO: 1399481 - DNA, 21 bp, Homo sapiens
tgcacacaaacacctcctagc

SEQ ID NO: 1399482 - DNA, 12 bp, Homo sapiens
tgcaccggggcc

SEQ ID NO: 1399483 - DNA, 14 bp, Homo sapiens
tgcacctttctagt

SEQ ID NO: 1399484 - DNA, 16 bp, Homo sapiens
tgcactatctttcagc

SEQ ID NO: 1399485 - DNA, 22 bp, Homo sapiens
tgcacttatttatgaacctgcc

SEQ ID NO: 1399486 - DNA, 18 bp, Homo sapiens
tgcagcaaccagagcact

SEQ ID NO: 1399487 - DNA, 20 bp, Homo sapiens
tgcagctcaagagatcccaa

SEQ ID NO: 1399488 - DNA, 20 bp, Homo sapiens
tgcaggatctcaccaggcag

SEQ ID NO: 1399489 - DNA, 19 bp, Homo sapiens
tgcagggggtgtgtctgct

SEQ ID NO: 1399490 - DNA, 16 bp, Homo sapiens
tgcaggtccctaataa

SEQ ID NO: 1399491 - DNA, 22 bp, Homo sapiens
tgcaggtccctaataaagctgt

SEQ ID NO: 1399492 - DNA, 17 bp, Homo sapiens
tgcattactgcatgcac

SEQ ID NO: 1399493 - DNA, 22 bp, Homo sapiens
tgcatttaaaacagacactggc

SEQ ID NO: 1399494 - DNA, 19 bp, Homo sapiens
tgcatttatgagctcttca

SEQ ID NO: 1399495 - DNA, 17 bp, Homo sapiens
tgcatttgggtccagga

SEQ ID NO: 1399496 - DNA, 19 bp, Homo sapiens
tgcatttgggtccaggagg

SEQ ID NO: 1399497 - DNA, 15 bp, Homo sapiens
tgccaaaaacaaaat

SEQ ID NO: 1399498 - DNA, 17 bp, Homo sapiens
tgccaagggcataaatt

SEQ ID NO: 1399499 - DNA, 22 bp, Homo sapiens
tgccaggaggacccagggctct

SEQ ID NO: 1399500 - DNA, 17 bp, Homo sapiens
tgccaggctaatttttt

SEQ ID NO: 1399501 - DNA, 19 bp, Homo sapiens
tgcccagccctaaacatca

SEQ ID NO: 1399502 - DNA, 23 bp, Homo sapiens
tgcccatcatacgcatggtcctg

SEQ ID NO: 1399503 - DNA, 16 bp, Homo sapiens
tgcccatgggagctgg

SEQ ID NO: 1399504 - DNA, 16 bp, Homo sapiens
tgcccccaaccatttc

SEQ ID NO: 1399505 - DNA, 21 bp, Homo sapiens
tgccgattacacccaaatatt

SEQ ID NO: 1399506 - DNA, 22 bp, Homo sapiens
tgcctcaagaaattgcctcctt

SEQ ID NO: 1399507 - DNA, 15 bp, Homo sapiens
tgcctcccatgcctg

SEQ ID NO: 1399508 - DNA, 20 bp, Homo sapiens
tgcctcccatgcctggtccc

SEQ ID NO: 1399509 - DNA, 22 bp, Homo sapiens
tgcctccctctcgtaagatttc

SEQ ID NO: 1399510 - DNA, 18 bp, Homo sapiens
tgcctccttatttatcaa

SEQ ID NO: 1399511 - DNA, 12 bp, Homo sapiens
tgcctctctgca

SEQ ID NO: 1399512 - DNA, 16 bp, Homo sapiens
tgcctctctgcaggtc

SEQ ID NO: 1399513 - DNA, 18 bp, Homo sapiens
tgcctctgtcttctggac

SEQ ID NO: 1399514 - DNA, 23 bp, Homo sapiens
tgcctcttccagtcttcctgaca

SEQ ID NO: 1399515 - DNA, 14 bp, Homo sapiens
tgcctggtcccaag

SEQ ID NO: 1399516 - DNA, 21 bp, Homo sapiens
tgcctgtagccccagtgacag

SEQ ID NO: 1399517 - DNA, 15 bp, Homo sapiens
tgccttactcttctt

SEQ ID NO: 1399518 - DNA, 19 bp, Homo sapiens
tgccttactcttcttgaaa

SEQ ID NO: 1399519 - DNA, 15 bp, Homo sapiens
tgccttccagaaaac

SEQ ID NO: 1399520 - DNA, 17 bp, Homo sapiens
tgccttgtcacgccaga

SEQ ID NO: 1399521 - DNA, 18 bp, Homo sapiens
tgcgtggtggtccctggg

SEQ ID NO: 1399522 - DNA, 19 bp, Homo sapiens
tgcgtggtggtccctgggt

SEQ ID NO: 1399523 - DNA, 21 bp, Homo sapiens
tgcgtggtggtccctgggtag

SEQ ID NO: 1399524 - DNA, 20 bp, Homo sapiens
tgctaatcttcttatgcaat

SEQ ID NO: 1399525 - DNA, 18 bp, Homo sapiens
tgctaatttatcctgaaa

SEQ ID NO: 1399526 - DNA, 13 bp, Homo sapiens
tgctatactgcat

SEQ ID NO: 1399527 - DNA, 20 bp, Homo sapiens
tgctatctctgtgtgcacaa

SEQ ID NO: 1399528 - DNA, 13 bp, Homo sapiens
tgctatttgaagt

SEQ ID NO: 1399529 - DNA, 13 bp, Homo sapiens
tgctcagacagaa

SEQ ID NO: 1399530 - DNA, 18 bp, Homo sapiens
tgctcttagctgtctgct

SEQ ID NO: 1399531 - DNA, 17 bp, Homo sapiens
tgctcttgatgcctggc

SEQ ID NO: 1399532 - DNA, 17 bp, Homo sapiens
tgctgaaattttatatg

SEQ ID NO: 1399533 - DNA, 10 bp, Homo sapiens
tgctgagact

SEQ ID NO: 1399534 - DNA, 20 bp, Homo sapiens
tgctgagattacaggtgtga

SEQ ID NO: 1399535 - DNA, 13 bp, Homo sapiens
tgctgcaaacctg

SEQ ID NO: 1399536 - DNA, 22 bp, Homo sapiens
tgctgggcccctgcctctctgc

SEQ ID NO: 1399537 - DNA, 23 bp, Homo sapiens
tgctgggcccctgcctctctgca

SEQ ID NO: 1399538 - DNA, 19 bp, Homo sapiens
tgcttctagttctgccagg

SEQ ID NO: 1399539 - DNA, 22 bp, Homo sapiens
tgcttgatgggattctggacag

SEQ ID NO: 1399540 - DNA, 17 bp, Homo sapiens
tgctttgatatttcaat

SEQ ID NO: 1399541 - DNA, 15 bp, Homo sapiens
tggaaataaatgtat

SEQ ID NO: 1399542 - DNA, 15 bp, Homo sapiens
tggaaatacacagtg

SEQ ID NO: 1399543 - DNA, 20 bp, Homo sapiens
tggaacactagacaagccag

SEQ ID NO: 1399544 - DNA, 18 bp, Homo sapiens
tggaactcgtgtctggca

SEQ ID NO: 1399545 - DNA, 23 bp, Homo sapiens
tggaactgtctctcatgaacctc

SEQ ID NO: 1399546 - DNA, 13 bp, Homo sapiens
tggaacttgaact

SEQ ID NO: 1399547 - DNA, 15 bp, Homo sapiens
tggaacttgaactga

SEQ ID NO: 1399548 - DNA, 23 bp, Homo sapiens
tggaagacgcaagggcctgatgg

SEQ ID NO: 1399549 - DNA, 18 bp, Homo sapiens
tggaagccagctttccct

SEQ ID NO: 1399550 - DNA, 18 bp, Homo sapiens
tggaagctgccctgccca

SEQ ID NO: 1399551 - DNA, 14 bp, Homo sapiens
tggaataagtgtac

SEQ ID NO: 1399552 - DNA, 15 bp, Homo sapiens
tggaatacatgaaat

SEQ ID NO: 1399553 - DNA, 18 bp, Homo sapiens
tggaatgaattaaataaa

SEQ ID NO: 1399554 - DNA, 17 bp, Homo sapiens
tggaattgggagcttgg

SEQ ID NO: 1399555 - DNA, 20 bp, Homo sapiens
tggacacactgtaaacccct

SEQ ID NO: 1399556 - DNA, 22 bp, Homo sapiens
tggacacactgtaaacccctgg

SEQ ID NO: 1399557 - DNA, 12 bp, Homo sapiens
tggacagcttgt

SEQ ID NO: 1399558 - DNA, 13 bp, Homo sapiens
tggacagcttgtg

SEQ ID NO: 1399559 - DNA, 18 bp, Homo sapiens
tggacaggatgtgtttgc

SEQ ID NO: 1399560 - DNA, 16 bp, Homo sapiens
tggaccagcctctcca

SEQ ID NO: 1399561 - DNA, 22 bp, Homo sapiens
tggaccagcctctccactcatg

SEQ ID NO: 1399562 - DNA, 16 bp, Homo sapiens
tggagagaaaaaatta

SEQ ID NO: 1399563 - DNA, 17 bp, Homo sapiens
tggagagaaaaaattaa

SEQ ID NO: 1399564 - DNA, 18 bp, Homo sapiens
tggagagaaaaaattaac

SEQ ID NO: 1399565 - DNA, 18 bp, Homo sapiens
tggagttttttgtaccaa

SEQ ID NO: 1399566 - DNA, 16 bp, Homo sapiens
tggatatgtaaaacat

SEQ ID NO: 1399567 - DNA, 14 bp, Homo sapiens
tggatgacattaaa

SEQ ID NO: 1399568 - DNA, 20 bp, Homo sapiens
tggattactgccattcactt

SEQ ID NO: 1399569 - DNA, 13 bp, Homo sapiens
tggcaattttgta

SEQ ID NO: 1399570 - DNA, 12 bp, Homo sapiens
tggcagaaaagt

SEQ ID NO: 1399571 - DNA, 16 bp, Homo sapiens
tggcagtctgaatttt

SEQ ID NO: 1399572 - DNA, 22 bp, Homo sapiens
tggcagtctgaatttttaaaac

SEQ ID NO: 1399573 - DNA, 22 bp, Homo sapiens
tggcatccagagtccctgcctg

SEQ ID NO: 1399574 - DNA, 13 bp, Homo sapiens
tggcatccctggg

SEQ ID NO: 1399575 - DNA, 15 bp, Homo sapiens
tggcatccctgggcc

SEQ ID NO: 1399576 - DNA, 16 bp, Homo sapiens
tggcatccctgggcct

SEQ ID NO: 1399577 - DNA, 21 bp, Homo sapiens
tggcatgagaaatacaaaaat

SEQ ID NO: 1399578 - DNA, 14 bp, Homo sapiens
tggccatttgcttt

SEQ ID NO: 1399579 - DNA, 11 bp, Homo sapiens
tggccccctcc

SEQ ID NO: 1399580 - DNA, 23 bp, Homo sapiens
tggcctaacctgccgagagtcca

SEQ ID NO: 1399581 - DNA, 12 bp, Homo sapiens
tggcctttatta

SEQ ID NO: 1399582 - DNA, 21 bp, Homo sapiens
tggcgcgatctcggctcactg

SEQ ID NO: 1399583 - DNA, 19 bp, Homo sapiens
tggctgagatatgaacata

SEQ ID NO: 1399584 - DNA, 14 bp, Homo sapiens
tggctgataatttt

SEQ ID NO: 1399585 - DNA, 20 bp, Homo sapiens
tggctgtggcctaacctgcc

SEQ ID NO: 1399586 - DNA, 20 bp, Homo sapiens
tggctttaggagcagtggga

SEQ ID NO: 1399587 - DNA, 14 bp, Homo sapiens
tggctttcagggag

SEQ ID NO: 1399588 - DNA, 22 bp, Homo sapiens
tgggagaccggcctgccaggag

SEQ ID NO: 1399589 - DNA, 12 bp, Homo sapiens
tgggagagggcg

SEQ ID NO: 1399590 - DNA, 20 bp, Homo sapiens
tgggagctggttagaaatgc

SEQ ID NO: 1399591 - DNA, 17 bp, Homo sapiens
tgggaggagggcaggca

SEQ ID NO: 1399592 - DNA, 18 bp, Homo sapiens
tgggaggagggcaggcat

SEQ ID NO: 1399593 - DNA, 17 bp, Homo sapiens
tgggaggctctggagcc

SEQ ID NO: 1399594 - DNA, 19 bp, Homo sapiens
tgggcaatgatggcaattt

SEQ ID NO: 1399595 - DNA, 13 bp, Homo sapiens
tgggcaggaggga

SEQ ID NO: 1399596 - DNA, 16 bp, Homo sapiens
tgggcaggagggaggt

SEQ ID NO: 1399597 - DNA, 19 bp, Homo sapiens
tgggcccctgcctctctgc

SEQ ID NO: 1399598 - DNA, 21 bp, Homo sapiens
tgggcccctgcctctctgcag

SEQ ID NO: 1399599 - DNA, 18 bp, Homo sapiens
tgggctccgtgtgggaga

SEQ ID NO: 1399600 - DNA, 19 bp, Homo sapiens
tgggctggcagtcctggaa

SEQ ID NO: 1399601 - DNA, 20 bp, Homo sapiens
tggggagcaggaggccaata

SEQ ID NO: 1399602 - DNA, 18 bp, Homo sapiens
tggggcatagaactccgg

SEQ ID NO: 1399603 - DNA, 17 bp, Homo sapiens
tggggccaggctgggtc

SEQ ID NO: 1399604 - DNA, 16 bp, Homo sapiens
tggggggtggccaggc

SEQ ID NO: 1399605 - DNA, 10 bp, Homo sapiens
tgggggtggg

SEQ ID NO: 1399606 - DNA, 21 bp, Homo sapiens
tggggtggggggggtgctggg

SEQ ID NO: 1399607 - DNA, 12 bp, Homo sapiens
tgggtccaggag

SEQ ID NO: 1399608 - DNA, 19 bp, Homo sapiens
tggtagttcattgtaaatg

SEQ ID NO: 1399609 - DNA, 23 bp, Homo sapiens
tggtagttcattgtaaatgaaca

SEQ ID NO: 1399610 - DNA, 16 bp, Homo sapiens
tggtatatccaaaagc

SEQ ID NO: 1399611 - DNA, 19 bp, Homo sapiens
tggtatatccaaaagcttt

SEQ ID NO: 1399612 - DNA, 22 bp, Homo sapiens
tggtatatccaaaagcttttta

SEQ ID NO: 1399613 - DNA, 15 bp, Homo sapiens
tggtcccttcttccc

SEQ ID NO: 1399614 - DNA, 16 bp, Homo sapiens
tggtcttgtggaattg

SEQ ID NO: 1399615 - DNA, 12 bp, Homo sapiens
tggtgataagta

SEQ ID NO: 1399616 - DNA, 13 bp, Homo sapiens
tggttagaaaagt

SEQ ID NO: 1399617 - DNA, 15 bp, Homo sapiens
tggttcttgagggga

SEQ ID NO: 1399618 - DNA, 23 bp, Homo sapiens
tggttcttgaggggaccaggagt

SEQ ID NO: 1399619 - DNA, 16 bp, Homo sapiens
tggttgaaaataaaaa

SEQ ID NO: 1399620 - DNA, 14 bp, Homo sapiens
tggttgatgccaaa

SEQ ID NO: 1399621 - DNA, 12 bp, Homo sapiens
tggtttatcatc

SEQ ID NO: 1399622 - DNA, 13 bp, Homo sapiens
tggtttgaaattt

SEQ ID NO: 1399623 - DNA, 15 bp, Homo sapiens
tgtaaaaaagtgttc

SEQ ID NO: 1399624 - DNA, 19 bp, Homo sapiens
tgtaaaacatttattttga

SEQ ID NO: 1399625 - DNA, 12 bp, Homo sapiens
tgtaaaataaga

SEQ ID NO: 1399626 - DNA, 19 bp, Homo sapiens
tgtaaacctgagtcgtaca

SEQ ID NO: 1399627 - DNA, 13 bp, Homo sapiens
tgtaaagccatgc

SEQ ID NO: 1399628 - DNA, 21 bp, Homo sapiens
tgtaaagctaaaataaagaaa

SEQ ID NO: 1399629 - DNA, 19 bp, Homo sapiens
tgtaaatgaacataatgaa

SEQ ID NO: 1399630 - DNA, 21 bp, Homo sapiens
tgtaagacaaaggttttcctc

SEQ ID NO: 1399631 - DNA, 16 bp, Homo sapiens
tgtaagttgaagcaaa

SEQ ID NO: 1399632 - DNA, 17 bp, Homo sapiens
tgtaatgttaatattga

SEQ ID NO: 1399633 - DNA, 17 bp, Homo sapiens
tgtacaaaataaacaaa

SEQ ID NO: 1399634 - DNA, 22 bp, Homo sapiens
tgtacaaaataaacaaataaca

SEQ ID NO: 1399635 - DNA, 22 bp, Homo sapiens
tgtacagttatctaagttaatt

SEQ ID NO: 1399636 - DNA, 13 bp, Homo sapiens
tgtacataactga

SEQ ID NO: 1399637 - DNA, 19 bp, Homo sapiens
tgtacataactgaaaatgt

SEQ ID NO: 1399638 - DNA, 16 bp, Homo sapiens
tgtacatatgtaaaat

SEQ ID NO: 1399639 - DNA, 17 bp, Homo sapiens
tgtagaacctaattcaa

SEQ ID NO: 1399640 - DNA, 20 bp, Homo sapiens
tgtagcaactacagtctaaa

SEQ ID NO: 1399641 - DNA, 18 bp, Homo sapiens
tgtagccacaccaggata

SEQ ID NO: 1399642 - DNA, 13 bp, Homo sapiens
tgtagctttgctc

SEQ ID NO: 1399643 - DNA, 15 bp, Homo sapiens
tgtatagtaaatcac

SEQ ID NO: 1399644 - DNA, 19 bp, Homo sapiens
tgtatattaaggtgtggct

SEQ ID NO: 1399645 - DNA, 17 bp, Homo sapiens
tgtatcatagaaatgta

SEQ ID NO: 1399646 - DNA, 18 bp, Homo sapiens
tgtatctatgcattttct

SEQ ID NO: 1399647 - DNA, 19 bp, Homo sapiens
tgtatctatgcattttctg

SEQ ID NO: 1399648 - DNA, 18 bp, Homo sapiens
tgtattcagacagatgag

SEQ ID NO: 1399649 - DNA, 21 bp, Homo sapiens
tgtattccaagacatgtctgt

SEQ ID NO: 1399650 - DNA, 14 bp, Homo sapiens
tgtcactcaaggcg

SEQ ID NO: 1399651 - DNA, 22 bp, Homo sapiens
tgtcactcaaggcggtgcttga

SEQ ID NO: 1399652 - DNA, 23 bp, Homo sapiens
tgtcactggtagaccaaaataaa

SEQ ID NO: 1399653 - DNA, 16 bp, Homo sapiens
tgtcagcagggactgt

SEQ ID NO: 1399654 - DNA, 14 bp, Homo sapiens
tgtcatcaattaaa

SEQ ID NO: 1399655 - DNA, 15 bp, Homo sapiens
tgtcatcaattaaag

SEQ ID NO: 1399656 - DNA, 23 bp, Homo sapiens
tgtcattaaatggggctcacaaa

SEQ ID NO: 1399657 - DNA, 20 bp, Homo sapiens
tgtcattgttatataatcat

SEQ ID NO: 1399658 - DNA, 23 bp, Homo sapiens
tgtcattgttatataatcattat

SEQ ID NO: 1399659 - DNA, 14 bp, Homo sapiens
tgtcatttcatttc

SEQ ID NO: 1399660 - DNA, 16 bp, Homo sapiens
tgtcatttcatttcct

SEQ ID NO: 1399661 - DNA, 17 bp, Homo sapiens
tgtcatttcatttccta

SEQ ID NO: 1399662 - DNA, 13 bp, Homo sapiens
tgtcattttggta

SEQ ID NO: 1399663 - DNA, 17 bp, Homo sapiens
tgtcccaggtcctcact

SEQ ID NO: 1399664 - DNA, 13 bp, Homo sapiens
tgtcctttctaga

SEQ ID NO: 1399665 - DNA, 14 bp, Homo sapiens
tgtcctttctagag

SEQ ID NO: 1399666 - DNA, 18 bp, Homo sapiens
tgtcctttctagagcact

SEQ ID NO: 1399667 - DNA, 14 bp, Homo sapiens
tgtcgattagactg

SEQ ID NO: 1399668 - DNA, 13 bp, Homo sapiens
tgtctattcagct

SEQ ID NO: 1399669 - DNA, 12 bp, Homo sapiens
tgtctctcatga

SEQ ID NO: 1399670 - DNA, 13 bp, Homo sapiens
tgtctcttctgag

SEQ ID NO: 1399671 - DNA, 12 bp, Homo sapiens
tgtgacaaaaaa

SEQ ID NO: 1399672 - DNA, 17 bp, Homo sapiens
tgtgaccaaaagttaca

SEQ ID NO: 1399673 - DNA, 12 bp, Homo sapiens
tgtgactctttc

SEQ ID NO: 1399674 - DNA, 13 bp, Homo sapiens
tgtgataaggaaa

SEQ ID NO: 1399675 - DNA, 16 bp, Homo sapiens
tgtgattcaatctgta

SEQ ID NO: 1399676 - DNA, 22 bp, Homo sapiens
tgtgattcaatctgtaaactgt

SEQ ID NO: 1399677 - DNA, 19 bp, Homo sapiens
tgtgcacatttaataatca

SEQ ID NO: 1399678 - DNA, 13 bp, Homo sapiens
tgtgcatcaggct

SEQ ID NO: 1399679 - DNA, 21 bp, Homo sapiens
tgtgccatgtcaaacaaatag

SEQ ID NO: 1399680 - DNA, 14 bp, Homo sapiens
tgtgcctcctcacc

SEQ ID NO: 1399681 - DNA, 20 bp, Homo sapiens
tgtgccttgtcacgccagac

SEQ ID NO: 1399682 - DNA, 19 bp, Homo sapiens
tgtgcgtggtggtccctgg

SEQ ID NO: 1399683 - DNA, 15 bp, Homo sapiens
tgtgctcaggagccc

SEQ ID NO: 1399684 - DNA, 20 bp, Homo sapiens
tgtgctcaggagccctggga

SEQ ID NO: 1399685 - DNA, 11 bp, Homo sapiens
tgtggccagga

SEQ ID NO: 1399686 - DNA, 12 bp, Homo sapiens
tgtggccaggag

SEQ ID NO: 1399687 - DNA, 21 bp, Homo sapiens
tgtggtacaagcattctgtct

SEQ ID NO: 1399688 - DNA, 14 bp, Homo sapiens
tgtgtagctttgct

SEQ ID NO: 1399689 - DNA, 14 bp, Homo sapiens
tgtgtctgctcagt

SEQ ID NO: 1399690 - DNA, 15 bp, Homo sapiens
tgtgtgcatcaggct

SEQ ID NO: 1399691 - DNA, 17 bp, Homo sapiens
tgtgtgcatcaggcttt

SEQ ID NO: 1399692 - DNA, 15 bp, Homo sapiens
tgtgtggatatttat

SEQ ID NO: 1399693 - DNA, 23 bp, Homo sapiens
tgttaaaaaaataagaagaatgc

SEQ ID NO: 1399694 - DNA, 17 bp, Homo sapiens
tgttaatttagaaaact

SEQ ID NO: 1399695 - DNA, 20 bp, Homo sapiens
tgttaatttagaaaacttta

SEQ ID NO: 1399696 - DNA, 13 bp, Homo sapiens
tgttaatttttga

SEQ ID NO: 1399697 - DNA, 15 bp, Homo sapiens
tgttaatttttgata

SEQ ID NO: 1399698 - DNA, 22 bp, Homo sapiens
tgttactagagttagatatgtg

SEQ ID NO: 1399699 - DNA, 19 bp, Homo sapiens
tgttagcctcaatttctga

SEQ ID NO: 1399700 - DNA, 19 bp, Homo sapiens
tgttcacttttcctccctc

SEQ ID NO: 1399701 - DNA, 22 bp, Homo sapiens
tgttcagaaggttgctctagat

SEQ ID NO: 1399702 - DNA, 13 bp, Homo sapiens
tgttcatttcctc

SEQ ID NO: 1399703 - DNA, 14 bp, Homo sapiens
tgttcatttcctca

SEQ ID NO: 1399704 - DNA, 13 bp, Homo sapiens
tgttgagacagag

SEQ ID NO: 1399705 - DNA, 18 bp, Homo sapiens
tgttgagttggacacact

SEQ ID NO: 1399706 - DNA, 20 bp, Homo sapiens
tgttgagttggacacactgt

SEQ ID NO: 1399707 - DNA, 12 bp, Homo sapiens
tgttggaatgaa

SEQ ID NO: 1399708 - DNA, 14 bp, Homo sapiens
tgttggtcatttta

SEQ ID NO: 1399709 - DNA, 13 bp, Homo sapiens
tgttgtgctttta

SEQ ID NO: 1399710 - DNA, 15 bp, Homo sapiens
tgtttaaaacatcat

SEQ ID NO: 1399711 - DNA, 12 bp, Homo sapiens
tgtttaaagttc

SEQ ID NO: 1399712 - DNA, 23 bp, Homo sapiens
tgtttaaagttcaacatgttatt

SEQ ID NO: 1399713 - DNA, 16 bp, Homo sapiens
tgtttcacaaggtctt

SEQ ID NO: 1399714 - DNA, 12 bp, Homo sapiens
tgtttctgactc

SEQ ID NO: 1399715 - DNA, 19 bp, Homo sapiens
tgtttctgactctgagcta

SEQ ID NO: 1399716 - DNA, 14 bp, Homo sapiens
tgtttgaggttaaa

SEQ ID NO: 1399717 - DNA, 13 bp, Homo sapiens
tgtttgatagatt

SEQ ID NO: 1399718 - DNA, 22 bp, Homo sapiens
tgtttgcacctttctagttgaa

SEQ ID NO: 1399719 - DNA, 17 bp, Homo sapiens
aaaatgccaaaaacaaa

SEQ ID NO: 1399720 - DNA, 14 bp, Homo sapiens
aaaatgtaaagcca

SEQ ID NO: 1399721 - DNA, 17 bp, Homo sapiens
aaaatgtaggagactgt

SEQ ID NO: 1399722 - DNA, 20 bp, Homo sapiens
aaaatgtgctatactgcata

SEQ ID NO: 1399723 - DNA, 14 bp, Homo sapiens
aaaattttctaaga

SEQ ID NO: 1399724 - DNA, 13 bp, Homo sapiens
aaacaaatgtgta

SEQ ID NO: 1399725 - DNA, 12 bp, Homo sapiens
aaacaagtattt

SEQ ID NO: 1399726 - DNA, 15 bp, Homo sapiens
aaacacttgcaacct

SEQ ID NO: 1399727 - DNA, 19 bp, Homo sapiens
aaacagaaacaaaaacact

SEQ ID NO: 1399728 - DNA, 14 bp, Homo sapiens
aaacagtgagcctg

SEQ ID NO: 1399729 - DNA, 22 bp, Homo sapiens
aaacattgttaatataatttaa

SEQ ID NO: 1399730 - DNA, 17 bp, Homo sapiens
aaacatttattttgaca

SEQ ID NO: 1399731 - DNA, 20 bp, Homo sapiens
aaacatttattttgacataa

SEQ ID NO: 1399732 - DNA, 20 bp, Homo sapiens
aaaccagctacttgatgtaa

SEQ ID NO: 1399733 - DNA, 15 bp, Homo sapiens
aaaccccggggctcc

SEQ ID NO: 1399734 - DNA, 14 bp, Homo sapiens
aaaccgctaaaaga

SEQ ID NO: 1399735 - DNA, 23 bp, Homo sapiens
aaaccgctaaaagaaactttctt

SEQ ID NO: 1399736 - DNA, 16 bp, Homo sapiens
aaacctcagctagctc

SEQ ID NO: 1399737 - DNA, 19 bp, Homo sapiens
aaacctcagctagctctgc

SEQ ID NO: 1399738 - DNA, 19 bp, Homo sapiens
aaaccttgaagttctgaaa

SEQ ID NO: 1399739 - DNA, 22 bp, Homo sapiens
aaactagaggtgagaaatttaa

SEQ ID NO: 1399740 - DNA, 20 bp, Homo sapiens
aaactatccaattaaaatta

SEQ ID NO: 1399741 - DNA, 21 bp, Homo sapiens
aaactcaaaatatttgtacat

SEQ ID NO: 1399742 - DNA, 23 bp, Homo sapiens
aaactcccacttgtcatgtgaca

SEQ ID NO: 1399743 - DNA, 16 bp, Homo sapiens
aaactgtgtattccaa

SEQ ID NO: 1399744 - DNA, 14 bp, Homo sapiens
aaacttcaaggaaa

SEQ ID NO: 1399745 - DNA, 22 bp, Homo sapiens
aaactttaaagcgtttgcacag

SEQ ID NO: 1399746 - DNA, 16 bp, Homo sapiens
aaactttgaagttagc

SEQ ID NO: 1399747 - DNA, 13 bp, Homo sapiens
aaagaaaaacaaa

SEQ ID NO: 1399748 - DNA, 13 bp, Homo sapiens
aaagaaaaccttt

SEQ ID NO: 1399749 - DNA, 12 bp, Homo sapiens
aaagaaactttc

SEQ ID NO: 1399750 - DNA, 15 bp, Homo sapiens
aaagaaatataccta

SEQ ID NO: 1399751 - DNA, 15 bp, Homo sapiens
aaagaattattttgt

SEQ ID NO: 1399752 - DNA, 11 bp, Homo sapiens
aaagacttaag

SEQ ID NO: 1399753 - DNA, 15 bp, Homo sapiens
aaagacttaagatta

SEQ ID NO: 1399754 - DNA, 22 bp, Homo sapiens
aaagagaaatcagaaaaattaa

SEQ ID NO: 1399755 - DNA, 14 bp, Homo sapiens
aaagagatacagag

SEQ ID NO: 1399756 - DNA, 12 bp, Homo sapiens
aaagatgctttt

SEQ ID NO: 1399757 - DNA, 15 bp, Homo sapiens
aaagattgagagaat

SEQ ID NO: 1399758 - DNA, 21 bp, Homo sapiens
aaagattgctgaaattttata

SEQ ID NO: 1399759 - DNA, 13 bp, Homo sapiens
aaagattttttaa

SEQ ID NO: 1399760 - DNA, 19 bp, Homo sapiens
aaagattttttaataattt

SEQ ID NO: 1399761 - DNA, 16 bp, Homo sapiens
aaagctaaaataaaga

SEQ ID NO: 1399762 - DNA, 15 bp, Homo sapiens
aaagctggtttaatg

SEQ ID NO: 1399763 - DNA, 16 bp, Homo sapiens
aaagctggtttaatgt

SEQ ID NO: 1399764 - DNA, 14 bp, Homo sapiens
aaagctgtgtggca

SEQ ID NO: 1399765 - DNA, 17 bp, Homo sapiens
aaagcttcagtgctgcc

SEQ ID NO: 1399766 - DNA, 19 bp, Homo sapiens
aaagctttttattcctcct

SEQ ID NO: 1399767 - DNA, 16 bp, Homo sapiens
aaaggaggggtacatt

SEQ ID NO: 1399768 - DNA, 16 bp, Homo sapiens
aaaggtttacagaatt

SEQ ID NO: 1399769 - DNA, 16 bp, Homo sapiens
aaaggtttatgaaaaa

SEQ ID NO: 1399770 - DNA, 14 bp, Homo sapiens
aaaggttttcctct

SEQ ID NO: 1399771 - DNA, 16 bp, Homo sapiens
aaagtaaaaaagttaa

SEQ ID NO: 1399772 - DNA, 22 bp, Homo sapiens
aaagtgaggaagcctaaataaa

SEQ ID NO: 1399773 - DNA, 19 bp, Homo sapiens
aaagtgccattaacaaatg

SEQ ID NO: 1399774 - DNA, 15 bp, Homo sapiens
aaagtgtatttgtta

SEQ ID NO: 1399775 - DNA, 14 bp, Homo sapiens
aaagtgttttctct

SEQ ID NO: 1399776 - DNA, 21 bp, Homo sapiens
aaagtgttttctctgaacaca

SEQ ID NO: 1399777 - DNA, 23 bp, Homo sapiens
aaagtgttttctctgaacacatt

SEQ ID NO: 1399778 - DNA, 18 bp, Homo sapiens
aaagttgataaagatttt

SEQ ID NO: 1399779 - DNA, 20 bp, Homo sapiens
aaagttgataaagatttttt

SEQ ID NO: 1399780 - DNA, 22 bp, Homo sapiens
aaagttgctatttgaacttttt

SEQ ID NO: 1399781 - DNA, 19 bp, Homo sapiens
aaagtttagcccctgaaag

SEQ ID NO: 1399782 - DNA, 14 bp, Homo sapiens
aaataaaaccagct

SEQ ID NO: 1399783 - DNA, 13 bp, Homo sapiens
aaataaagaatgg

SEQ ID NO: 1399784 - DNA, 15 bp, Homo sapiens
aaataagaaactttt

SEQ ID NO: 1399785 - DNA, 21 bp, Homo sapiens
aaataagaaacttttttattt

SEQ ID NO: 1399786 - DNA, 20 bp, Homo sapiens
aaataagaaagccctaaaat

SEQ ID NO: 1399787 - DNA, 14 bp, Homo sapiens
aaataagaagaatg

SEQ ID NO: 1399788 - DNA, 15 bp, Homo sapiens
aaataagaagaatgc

SEQ ID NO: 1399789 - DNA, 20 bp, Homo sapiens
aaataagaagaatgcttaat

SEQ ID NO: 1399790 - DNA, 17 bp, Homo sapiens
aaataagagctcaggat

SEQ ID NO: 1399791 - DNA, 15 bp, Homo sapiens
aaataagtgaaattt

SEQ ID NO: 1399792 - DNA, 12 bp, Homo sapiens
aaataattttaa

SEQ ID NO: 1399793 - DNA, 20 bp, Homo sapiens
aaataattttaaacaaaggt

SEQ ID NO: 1399794 - DNA, 15 bp, Homo sapiens
aaatacaaaaatact

SEQ ID NO: 1399795 - DNA, 15 bp, Homo sapiens
aaatacttttttcta

SEQ ID NO: 1399796 - DNA, 16 bp, Homo sapiens
aaatagcaaaagaaga

SEQ ID NO: 1399797 - DNA, 17 bp, Homo sapiens
aaatagcaaaagaagaa

SEQ ID NO: 1399798 - DNA, 12 bp, Homo sapiens
aaatagtatttc

SEQ ID NO: 1399799 - DNA, 20 bp, Homo sapiens
aaatagtttggatatgtaaa

SEQ ID NO: 1399800 - DNA, 21 bp, Homo sapiens
aaatataaaccagctacttga

SEQ ID NO: 1399801 - DNA, 15 bp, Homo sapiens
aaatataaattaaga

SEQ ID NO: 1399802 - DNA, 18 bp, Homo sapiens
aaatataaattaagactt

SEQ ID NO: 1399803 - DNA, 13 bp, Homo sapiens
aaatatactttta

SEQ ID NO: 1399804 - DNA, 21 bp, Homo sapiens
aaatatgatgttaaaaaaata

SEQ ID NO: 1399805 - DNA, 15 bp, Homo sapiens
aaatattttaaagaa

SEQ ID NO: 1399806 - DNA, 16 bp, Homo sapiens
aaatattttaaagaat

SEQ ID NO: 1399807 - DNA, 18 bp, Homo sapiens
aaatattttaaagaattg

SEQ ID NO: 1399808 - DNA, 18 bp, Homo sapiens
aaatcaacttgcttatca

SEQ ID NO: 1399809 - DNA, 19 bp, Homo sapiens
aaatcaattactggtccaa

SEQ ID NO: 1399810 - DNA, 19 bp, Homo sapiens
aaatcaccacaaactgtaa

SEQ ID NO: 1399811 - DNA, 20 bp, Homo sapiens
aaatcaccacaaactgtaat

SEQ ID NO: 1399812 - DNA, 17 bp, Homo sapiens
aaatcacgctttttgaa

SEQ ID NO: 1399813 - DNA, 20 bp, Homo sapiens
aaatcacgctttttgaaaaa

SEQ ID NO: 1399814 - DNA, 16 bp, Homo sapiens
aaatcagaaaaattaa

SEQ ID NO: 1399815 - DNA, 14 bp, Homo sapiens
aaatcattttgcaa

SEQ ID NO: 1399816 - DNA, 21 bp, Homo sapiens
aaatccttagatctggcatgt

SEQ ID NO: 1399817 - DNA, 11 bp, Homo sapiens
aaatgaagaaa

SEQ ID NO: 1399818 - DNA, 15 bp, Homo sapiens
aaatgcataaatgca

SEQ ID NO: 1399819 - DNA, 16 bp, Homo sapiens
aaatgccttttcccaa

SEQ ID NO: 1399820 - DNA, 21 bp, Homo sapiens
aaatgccttttcccaaaatgt

SEQ ID NO: 1399821 - DNA, 13 bp, Homo sapiens
aaatggccatttg

SEQ ID NO: 1399822 - DNA, 23 bp, Homo sapiens
aaatggccatttgctttttcacc

SEQ ID NO: 1399823 - DNA, 17 bp, Homo sapiens
aaatgtaacttttgtaa

SEQ ID NO: 1399824 - DNA, 18 bp, Homo sapiens
aaatgtaacttttgtaag

SEQ ID NO: 1399825 - DNA, 20 bp, Homo sapiens
aaatgtacgataggtagaat

SEQ ID NO: 1399826 - DNA, 17 bp, Homo sapiens
aaatgtatcatagaaat

SEQ ID NO: 1399827 - DNA, 22 bp, Homo sapiens
aaatgtgtgtaaaaaagtgttc

SEQ ID NO: 1399828 - DNA, 23 bp, Homo sapiens
aaatgttgaaatatgatgttaaa

SEQ ID NO: 1399829 - DNA, 17 bp, Homo sapiens
aaatgttggtcatttta

SEQ ID NO: 1399830 - DNA, 13 bp, Homo sapiens
aaattgaatgcaa

SEQ ID NO: 1399831 - DNA, 15 bp, Homo sapiens
aaattgattttgaac

SEQ ID NO: 1399832 - DNA, 22 bp, Homo sapiens
aaattgcctccttatttatcaa

SEQ ID NO: 1399833 - DNA, 14 bp, Homo sapiens
aaatttaaactata

SEQ ID NO: 1399834 - DNA, 19 bp, Homo sapiens
aaatttaaactataagcaa

SEQ ID NO: 1399835 - DNA, 21 bp, Homo sapiens
aaatttaactgcctaaaatgt

SEQ ID NO: 1399836 - DNA, 23 bp, Homo sapiens
aaatttaactgcctaaaatgttc

SEQ ID NO: 1399837 - DNA, 16 bp, Homo sapiens
aaatttatattgtaaa

SEQ ID NO: 1399838 - DNA, 12 bp, Homo sapiens
aaatttcagatt

SEQ ID NO: 1399839 - DNA, 20 bp, Homo sapiens
aacaaactcgttttttacaa

SEQ ID NO: 1399840 - DNA, 23 bp, Homo sapiens
aacaaagagttcaagaaataagt

SEQ ID NO: 1399841 - DNA, 19 bp, Homo sapiens
aacaagaagggactgagag

SEQ ID NO: 1399842 - DNA, 12 bp, Homo sapiens
aacaagaattgg

SEQ ID NO: 1399843 - DNA, 23 bp, Homo sapiens
aacaagacctcagtgccttcctg

SEQ ID NO: 1399844 - DNA, 14 bp, Homo sapiens
aacaagatatttat

SEQ ID NO: 1399845 - DNA, 12 bp, Homo sapiens
aacaagtatttg

SEQ ID NO: 1399846 - DNA, 12 bp, Homo sapiens
aacaattctaaa

SEQ ID NO: 1399847 - DNA, 16 bp, Homo sapiens
aacaatttatgaattg

SEQ ID NO: 1399848 - DNA, 14 bp, Homo sapiens
aacacacacaaaag

SEQ ID NO: 1399849 - DNA, 18 bp, Homo sapiens
aacacagcaattcctcag

SEQ ID NO: 1399850 - DNA, 20 bp, Homo sapiens
aacaccataggtagaatgta

SEQ ID NO: 1399851 - DNA, 17 bp, Homo sapiens
aacaccattgaaggctt

SEQ ID NO: 1399852 - DNA, 14 bp, Homo sapiens
aacactaaaaataa

SEQ ID NO: 1399853 - DNA, 19 bp, Homo sapiens
aacactagacaagccagaa

SEQ ID NO: 1399854 - DNA, 22 bp, Homo sapiens
agcagggtaccctttggggagc

SEQ ID NO: 1399855 - DNA, 19 bp, Homo sapiens
agcagtgattgtcttaata

SEQ ID NO: 1399856 - DNA, 13 bp, Homo sapiens
agcatcacagaat

SEQ ID NO: 1399857 - DNA, 19 bp, Homo sapiens
agcatcgtctcatgtaaaa

SEQ ID NO: 1399858 - DNA, 20 bp, Homo sapiens
agcatcgtctcatgtaaaat

SEQ ID NO: 1399859 - DNA, 15 bp, Homo sapiens
agcatgcatctgttt

SEQ ID NO: 1399860 - DNA, 15 bp, Homo sapiens
agcattcagaagaaa

SEQ ID NO: 1399861 - DNA, 17 bp, Homo sapiens
agcatttgtttctactt

SEQ ID NO: 1399862 - DNA, 23 bp, Homo sapiens
agcattttcttagacctcttcag

SEQ ID NO: 1399863 - DNA, 15 bp, Homo sapiens
agccaaaaatagcta

SEQ ID NO: 1399864 - DNA, 18 bp, Homo sapiens
agccaaaaatagctaaat

SEQ ID NO: 1399865 - DNA, 22 bp, Homo sapiens
agccaaaaatagctaaatacct

SEQ ID NO: 1399866 - DNA, 20 bp, Homo sapiens
agccaaggagtcactgagac

SEQ ID NO: 1399867 - DNA, 24 bp, Homo sapiens
agccacaccaggatagagactgga

SEQ ID NO: 1399868 - DNA, 17 bp, Homo sapiens
agccactaccttctgac

SEQ ID NO: 1399869 - DNA, 22 bp, Homo sapiens
agccagaacttgaccctgagct

SEQ ID NO: 1399870 - DNA, 18 bp, Homo sapiens
agccagattttttaaaat

SEQ ID NO: 1399871 - DNA, 18 bp, Homo sapiens
agccagctttccctgcct

SEQ ID NO: 1399872 - DNA, 17 bp, Homo sapiens
agccatcaagagactga

SEQ ID NO: 1399873 - DNA, 17 bp, Homo sapiens
agccccagtgacagcta

SEQ ID NO: 1399874 - DNA, 23 bp, Homo sapiens
agccccgcgtggaactcgtgtct

SEQ ID NO: 1399875 - DNA, 15 bp, Homo sapiens
agcccggtaagagca

SEQ ID NO: 1399876 - DNA, 14 bp, Homo sapiens
agccctaaacatca

SEQ ID NO: 1399877 - DNA, 16 bp, Homo sapiens
agccctagccctcagc

SEQ ID NO: 1399878 - DNA, 15 bp, Homo sapiens
agcctcaatttctga

SEQ ID NO: 1399879 - DNA, 18 bp, Homo sapiens
agcctccctcctcgtccc

SEQ ID NO: 1399880 - DNA, 17 bp, Homo sapiens
agcctccctgaagacca

SEQ ID NO: 1399881 - DNA, 16 bp, Homo sapiens
agcctctccactcatg

SEQ ID NO: 1399882 - DNA, 13 bp, Homo sapiens
agcctctgggggg

SEQ ID NO: 1399883 - DNA, 22 bp, Homo sapiens
agcctctggggggtggccaggc

SEQ ID NO: 1399884 - DNA, 17 bp, Homo sapiens
agcctgacaacatttct

SEQ ID NO: 1399885 - DNA, 19 bp, Homo sapiens
agcctgaccctcatctttc

SEQ ID NO: 1399886 - DNA, 13 bp, Homo sapiens
agcgctatctccc

SEQ ID NO: 1399887 - DNA, 17 bp, Homo sapiens
agcgctatctccctgcc

SEQ ID NO: 1399888 - DNA, 15 bp, Homo sapiens
agcggcatcaggctt

SEQ ID NO: 1399889 - DNA, 12 bp, Homo sapiens
agcgggggaggg

SEQ ID NO: 1399890 - DNA, 12 bp, Homo sapiens
agctaaaataaa

SEQ ID NO: 1399891 - DNA, 20 bp, Homo sapiens
agctaaatacctcaatcagt

SEQ ID NO: 1399892 - DNA, 12 bp, Homo sapiens
agctaggaatga

SEQ ID NO: 1399893 - DNA, 18 bp, Homo sapiens
agctcagaaaatatccct

SEQ ID NO: 1399894 - DNA, 19 bp, Homo sapiens
agctcagaaaatatccctc

SEQ ID NO: 1399895 - DNA, 18 bp, Homo sapiens
agctcaggatgagggaaa

SEQ ID NO: 1399896 - DNA, 22 bp, Homo sapiens
agctcaggatgagggaaaagaa

SEQ ID NO: 1399897 - DNA, 21 bp, Homo sapiens
agctcccttcccctgcctggt

SEQ ID NO: 1399898 - DNA, 15 bp, Homo sapiens
agctgcctggtatat

SEQ ID NO: 1399899 - DNA, 16 bp, Homo sapiens
agctggacatgctttg

SEQ ID NO: 1399900 - DNA, 21 bp, Homo sapiens
agctggcattacagctggaga

SEQ ID NO: 1399901 - DNA, 17 bp, Homo sapiens
agctggggccaggctgg

SEQ ID NO: 1399902 - DNA, 15 bp, Homo sapiens
agctggttagaaatg

SEQ ID NO: 1399903 - DNA, 20 bp, Homo sapiens
agctggtttaatgttttggc

SEQ ID NO: 1399904 - DNA, 19 bp, Homo sapiens
agctgtcatcaattaaagg

SEQ ID NO: 1399905 - DNA, 11 bp, Homo sapiens
agctgtctgct

SEQ ID NO: 1399906 - DNA, 15 bp, Homo sapiens
agctgtgaccctcaa

SEQ ID NO: 1399907 - DNA, 19 bp, Homo sapiens
agctgtgcttatggtacca

SEQ ID NO: 1399908 - DNA, 14 bp, Homo sapiens
agctgtgtggcagt

SEQ ID NO: 1399909 - DNA, 14 bp, Homo sapiens
agctgttttcttct

SEQ ID NO: 1399910 - DNA, 16 bp, Homo sapiens
agcttaaaactttgaa

SEQ ID NO: 1399911 - DNA, 22 bp, Homo sapiens
agcttaatggctgataatttta

SEQ ID NO: 1399912 - DNA, 20 bp, Homo sapiens
agcttcgtttattttcaaga

SEQ ID NO: 1399913 - DNA, 18 bp, Homo sapiens
agcttctctgccaagccc

SEQ ID NO: 1399914 - DNA, 14 bp, Homo sapiens
agcttgggaatgga

SEQ ID NO: 1399915 - DNA, 17 bp, Homo sapiens
agcttgtggcaagtgaa

SEQ ID NO: 1399916 - DNA, 18 bp, Homo sapiens
agcttgtggcaagtgaat

SEQ ID NO: 1399917 - DNA, 16 bp, Homo sapiens
agctttagcttctctg

SEQ ID NO: 1399918 - DNA, 16 bp, Homo sapiens
agctttccctgcctct

SEQ ID NO: 1399919 - DNA, 10 bp, Homo sapiens
agctttgcta

SEQ ID NO: 1399920 - DNA, 23 bp, Homo sapiens
agctttgctctttggtagaaaag

SEQ ID NO: 1399921 - DNA, 18 bp, Homo sapiens
agctttggacctaatcca

SEQ ID NO: 1399922 - DNA, 19 bp, Homo sapiens
agctttggacctaatccaa

SEQ ID NO: 1399923 - DNA, 15 bp, Homo sapiens
aggaaaataagtgaa

SEQ ID NO: 1399924 - DNA, 21 bp, Homo sapiens
aggaaaattttagcgtgctca

SEQ ID NO: 1399925 - DNA, 21 bp, Homo sapiens
aggaaatcaacttgcttatca

SEQ ID NO: 1399926 - DNA, 15 bp, Homo sapiens
aggaagcaagcttaa

SEQ ID NO: 1399927 - DNA, 16 bp, Homo sapiens
aggaagcctaaataaa

SEQ ID NO: 1399928 - DNA, 22 bp, Homo sapiens
aggaatttcacctgtaaacctg

SEQ ID NO: 1399929 - DNA, 17 bp, Homo sapiens
aggacccagggctctgt

SEQ ID NO: 1399930 - DNA, 17 bp, Homo sapiens
aggactaatgcatgtgg

SEQ ID NO: 1399931 - DNA, 17 bp, Homo sapiens
aggactctgccccttct

SEQ ID NO: 1399932 - DNA, 13 bp, Homo sapiens
aggacttgtgtct

SEQ ID NO: 1399933 - DNA, 22 bp, Homo sapiens
aggagacccacctgaggctcag

SEQ ID NO: 1399934 - DNA, 18 bp, Homo sapiens
aggagccctgggaggctc

SEQ ID NO: 1399935 - DNA, 17 bp, Homo sapiens
aggaggacccagggctc

SEQ ID NO: 1399936 - DNA, 22 bp, Homo sapiens
aggaggccaataaaaagttcag

SEQ ID NO: 1399937 - DNA, 15 bp, Homo sapiens
aggagggaggtgctt

SEQ ID NO: 1399938 - DNA, 15 bp, Homo sapiens
aggagtcactgagac

SEQ ID NO: 1399939 - DNA, 17 bp, Homo sapiens
aggagtcactgagacca

SEQ ID NO: 1399940 - DNA, 22 bp, Homo sapiens
aggagtgggtggggagtggggg

SEQ ID NO: 1399941 - DNA, 15 bp, Homo sapiens
aggataccatataca

SEQ ID NO: 1399942 - DNA, 22 bp, Homo sapiens
aggataccatatacagctcaga

SEQ ID NO: 1399943 - DNA, 20 bp, Homo sapiens
aggatacgacagtacactgt

SEQ ID NO: 1399944 - DNA, 20 bp, Homo sapiens
aggatcatttgttggaatga

SEQ ID NO: 1399945 - DNA, 14 bp, Homo sapiens
aggattctcctttt

SEQ ID NO: 1399946 - DNA, 21 bp, Homo sapiens
aggattggggaagagagcctg

SEQ ID NO: 1399947 - DNA, 17 bp, Homo sapiens
aggatttatttaaaata

SEQ ID NO: 1399948 - DNA, 17 bp, Homo sapiens
aggcaccaaaagaagta

SEQ ID NO: 1399949 - DNA, 20 bp, Homo sapiens
aggcaccaaaagaagtaaaa

SEQ ID NO: 1399950 - DNA, 22 bp, Homo sapiens
aggcagactctttatgcttgca

SEQ ID NO: 1399951 - DNA, 14 bp, Homo sapiens
aggcagcctctggg

SEQ ID NO: 1399952 - DNA, 15 bp, Homo sapiens
aggcagcctctgggg

SEQ ID NO: 1399953 - DNA, 16 bp, Homo sapiens
aggcagcctctggggg

SEQ ID NO: 1399954 - DNA, 23 bp, Homo sapiens
aggcaggattggggaagagagcc

SEQ ID NO: 1399955 - DNA, 14 bp, Homo sapiens
aggccaataaaaag

SEQ ID NO: 1399956 - DNA, 23 bp, Homo sapiens
aggccaataaaaagttcagagtt

SEQ ID NO: 1399957 - DNA, 17 bp, Homo sapiens
aggccattctttcccaa

SEQ ID NO: 1399958 - DNA, 19 bp, Homo sapiens
aggcccccacctggctcac

SEQ ID NO: 1399959 - DNA, 13 bp, Homo sapiens
aggccctgtgccc

SEQ ID NO: 1399960 - DNA, 22 bp, Homo sapiens
aggcccttattttcaagaaact

SEQ ID NO: 1399961 - DNA, 22 bp, Homo sapiens
aggccttgcggctcctcaggga

SEQ ID NO: 1399962 - DNA, 13 bp, Homo sapiens
agtttagggtggg

SEQ ID NO: 1399963 - DNA, 14 bp, Homo sapiens
agtttagggtgggg

SEQ ID NO: 1399964 - DNA, 15 bp, Homo sapiens
agtttatatttaact

SEQ ID NO: 1399965 - DNA, 13 bp, Homo sapiens
agtttatttgttg

SEQ ID NO: 1399966 - DNA, 20 bp, Homo sapiens
agtttatttgttgagagtgt

SEQ ID NO: 1399967 - DNA, 16 bp, Homo sapiens
agtttggatatgtaaa

SEQ ID NO: 1399968 - DNA, 17 bp, Homo sapiens
agtttggatatgtaaaa

SEQ ID NO: 1399969 - DNA, 22 bp, Homo sapiens
agtttggatatgtaaaacattt

SEQ ID NO: 1399970 - DNA, 19 bp, Homo sapiens
agttttacttttaaactgt

SEQ ID NO: 1399971 - DNA, 20 bp, Homo sapiens
agttttacttttaaactgtg

SEQ ID NO: 1399972 - DNA, 22 bp, Homo sapiens
agttttccatggcaggaaggct

SEQ ID NO: 1399973 - DNA, 17 bp, Homo sapiens
agttttctcctcccagg

SEQ ID NO: 1399974 - DNA, 16 bp, Homo sapiens
agttttgcaaagtgca

SEQ ID NO: 1399975 - DNA, 22 bp, Homo sapiens
ataaaaagatcactttctcagt

SEQ ID NO: 1399976 - DNA, 13 bp, Homo sapiens
ataaaaatgaatt

SEQ ID NO: 1399977 - DNA, 16 bp, Homo sapiens
ataaaaatgatctaaa

SEQ ID NO: 1399978 - DNA, 17 bp, Homo sapiens
ataaagaaatagaacaa

SEQ ID NO: 1399979 - DNA, 11 bp, Homo sapiens
ataaagaatgg

SEQ ID NO: 1399980 - DNA, 21 bp, Homo sapiens
ataaagcagcctcattctgag

SEQ ID NO: 1399981 - DNA, 23 bp, Homo sapiens
ataaagcagcctcattctgaggc

SEQ ID NO: 1399982 - DNA, 16 bp, Homo sapiens
ataaagtaaaaaagtt

SEQ ID NO: 1399983 - DNA, 14 bp, Homo sapiens
ataaagtatcatca

SEQ ID NO: 1399984 - DNA, 17 bp, Homo sapiens
ataaagttgataaagat

SEQ ID NO: 1399985 - DNA, 13 bp, Homo sapiens
ataaatgtatcat

SEQ ID NO: 1399986 - DNA, 15 bp, Homo sapiens
ataaatgtttttatt

SEQ ID NO: 1399987 - DNA, 17 bp, Homo sapiens
ataaatgtttttattaa

SEQ ID NO: 1399988 - DNA, 19 bp, Homo sapiens
ataaattattgtttttctt

SEQ ID NO: 1399989 - DNA, 18 bp, Homo sapiens
ataaatttctatttttat

SEQ ID NO: 1399990 - DNA, 14 bp, Homo sapiens
ataactaaggaata

SEQ ID NO: 1399991 - DNA, 18 bp, Homo sapiens
ataactaaggaatatata

SEQ ID NO: 1399992 - DNA, 20 bp, Homo sapiens
ataactgaaaattatttaaa

SEQ ID NO: 1399993 - DNA, 22 bp, Homo sapiens
ataagaaacttttttatttaaa

SEQ ID NO: 1399994 - DNA, 18 bp, Homo sapiens
ataagaaagccctaaaat

SEQ ID NO: 1399995 - DNA, 11 bp, Homo sapiens
ataagaagaat

SEQ ID NO: 1399996 - DNA, 13 bp, Homo sapiens
ataagaagaatgc

SEQ ID NO: 1399997 - DNA, 19 bp, Homo sapiens
ataagaagaatgcttaatc

SEQ ID NO: 1399998 - DNA, 21 bp, Homo sapiens
ataagcaagaaggcaaaaata

SEQ ID NO: 1399999 - DNA, 13 bp, Homo sapiens
ataagcttttctt

SEQ ID NO: 1400000 - DNA, 22 bp, Homo sapiens
ataaggaaatcaacttgcttat

SEQ ID NO: 1400001 - DNA, 13 bp, Homo sapiens
ataagtgtacata

SEQ ID NO: 1400002 - DNA, 17 bp, Homo sapiens
ataagtgtacatatgta

SEQ ID NO: 1400003 - DNA, 18 bp, Homo sapiens
ataagttcaaattcttct

SEQ ID NO: 1400004 - DNA, 21 bp, Homo sapiens
ataagttcaaattcttctgaa

SEQ ID NO: 1400005 - DNA, 21 bp, Homo sapiens
ataatactgctgagatacata

SEQ ID NO: 1400006 - DNA, 15 bp, Homo sapiens
ataatctagaacaca

SEQ ID NO: 1400007 - DNA, 13 bp, Homo sapiens
ataatgaacagaa

SEQ ID NO: 1400008 - DNA, 21 bp, Homo sapiens
ataattgttttatctgaattt

SEQ ID NO: 1400009 - DNA, 13 bp, Homo sapiens
atacagctcagaa

SEQ ID NO: 1400010 - DNA, 12 bp, Homo sapiens
atacatacagaa

SEQ ID NO: 1400011 - DNA, 15 bp, Homo sapiens
atacctaagaagtac

SEQ ID NO: 1400012 - DNA, 16 bp, Homo sapiens
atacgacagtacactg

SEQ ID NO: 1400013 - DNA, 21 bp, Homo sapiens
atactaagcattgaatggcta

SEQ ID NO: 1400014 - DNA, 17 bp, Homo sapiens
atactcacctcctccca

SEQ ID NO: 1400015 - DNA, 15 bp, Homo sapiens
atactgcatactttt

SEQ ID NO: 1400016 - DNA, 12 bp, Homo sapiens
atactgctgaga

SEQ ID NO: 1400017 - DNA, 22 bp, Homo sapiens
atactgctgagatacatacaga

SEQ ID NO: 1400018 - DNA, 16 bp, Homo sapiens
atacttttacaagtaa

SEQ ID NO: 1400019 - DNA, 15 bp, Homo sapiens
atacttttttctatt

SEQ ID NO: 1400020 - DNA, 17 bp, Homo sapiens
atagaaatgccaagcac

SEQ ID NO: 1400021 - DNA, 22 bp, Homo sapiens
atagaattataactggaaagaa

SEQ ID NO: 1400022 - DNA, 19 bp, Homo sapiens
atagacagaagaaacaagg

SEQ ID NO: 1400023 - DNA, 16 bp, Homo sapiens
atagcaaaagaagaag

SEQ ID NO: 1400024 - DNA, 13 bp, Homo sapiens
atagcaaagaatt

SEQ ID NO: 1400025 - DNA, 13 bp, Homo sapiens
atagccaaaaata

SEQ ID NO: 1400026 - DNA, 16 bp, Homo sapiens
ataggatttatttaaa

SEQ ID NO: 1400027 - DNA, 21 bp, Homo sapiens
ataggatttatttaaaatagc

SEQ ID NO: 1400028 - DNA, 17 bp, Homo sapiens
atagggctgagctctct

SEQ ID NO: 1400029 - DNA, 14 bp, Homo sapiens
atagggtctaactc

SEQ ID NO: 1400030 - DNA, 23 bp, Homo sapiens
ataggtagaatgtaaagcttgtc

SEQ ID NO: 1400031 - DNA, 23 bp, Homo sapiens
atagtagaacgctatctgggaag

SEQ ID NO: 1400032 - DNA, 15 bp, Homo sapiens
atagttttactttta

SEQ ID NO: 1400033 - DNA, 16 bp, Homo sapiens
atataaattaagactt

SEQ ID NO: 1400034 - DNA, 14 bp, Homo sapiens
atataatttaacag

SEQ ID NO: 1400035 - DNA, 22 bp, Homo sapiens
atatactattaaaaaggtttac

SEQ ID NO: 1400036 - DNA, 12 bp, Homo sapiens
atatagttttac

SEQ ID NO: 1400037 - DNA, 13 bp, Homo sapiens
atatagttttact

SEQ ID NO: 1400038 - DNA, 23 bp, Homo sapiens
atatagttttacttttaaactgt

SEQ ID NO: 1400039 - DNA, 14 bp, Homo sapiens
atatatatatatgt

SEQ ID NO: 1400040 - DNA, 15 bp, Homo sapiens
atatatatatgtaca

SEQ ID NO: 1400041 - DNA, 13 bp, Homo sapiens
atatattatcttt

SEQ ID NO: 1400042 - DNA, 12 bp, Homo sapiens
atatccaaaagc

SEQ ID NO: 1400043 - DNA, 19 bp, Homo sapiens
atatccaaaagctttttat

SEQ ID NO: 1400044 - DNA, 13 bp, Homo sapiens
atatcccactggg

SEQ ID NO: 1400045 - DNA, 13 bp, Homo sapiens
atatcctaaacat

SEQ ID NO: 1400046 - DNA, 12 bp, Homo sapiens
atatctcatctc

SEQ ID NO: 1400047 - DNA, 22 bp, Homo sapiens
atatctcctgaaaaggtttatg

SEQ ID NO: 1400048 - DNA, 17 bp, Homo sapiens
atatggaataagtgtac

SEQ ID NO: 1400049 - DNA, 18 bp, Homo sapiens
atatgtaaaacatttatt

SEQ ID NO: 1400050 - DNA, 14 bp, Homo sapiens
atatgtacagttat

SEQ ID NO: 1400051 - DNA, 16 bp, Homo sapiens
atatgtacagttatct

SEQ ID NO: 1400052 - DNA, 14 bp, Homo sapiens
atattatgagatgc

SEQ ID NO: 1400053 - DNA, 16 bp, Homo sapiens
atattatgagatgctg

SEQ ID NO: 1400054 - DNA, 19 bp, Homo sapiens
atattgataagatctttta

SEQ ID NO: 1400055 - DNA, 19 bp, Homo sapiens
atattggacaaagaacctt

SEQ ID NO: 1400056 - DNA, 16 bp, Homo sapiens
atattgtaaaacaggt

SEQ ID NO: 1400057 - DNA, 12 bp, Homo sapiens
atattgtaaata

SEQ ID NO: 1400058 - DNA, 14 bp, Homo sapiens
atattgtgattctg

SEQ ID NO: 1400059 - DNA, 17 bp, Homo sapiens
atattgtgattctgcct

SEQ ID NO: 1400060 - DNA, 14 bp, Homo sapiens
atattgttactaga

SEQ ID NO: 1400061 - DNA, 21 bp, Homo sapiens
atatttattttctttctgtaa

SEQ ID NO: 1400062 - DNA, 18 bp, Homo sapiens
atatttgtgacaaaaaat

SEQ ID NO: 1400063 - DNA, 15 bp, Homo sapiens
atatttgttatgtag

SEQ ID NO: 1400064 - DNA, 14 bp, Homo sapiens
atattttaaagaat

SEQ ID NO: 1400065 - DNA, 16 bp, Homo sapiens
atattttaaagaattg

SEQ ID NO: 1400066 - DNA, 12 bp, Homo sapiens
atattttctcta

SEQ ID NO: 1400067 - DNA, 16 bp, Homo sapiens
atattttctctaggaa

SEQ ID NO: 1400068 - DNA, 19 bp, Homo sapiens
atattttctctaggaaata

SEQ ID NO: 1400069 - DNA, 21 bp, Homo sapiens
atcaacatctttttcctccct

SEQ ID NO: 1400070 - DNA, 13 bp, Homo sapiens
atcaactgaatga

SEQ ID NO: 1400071 - DNA, 21 bp, Homo sapiens
atcaacttaccaggcaccaaa

SEQ ID NO: 1400072 - DNA, 15 bp, Homo sapiens
atcaagtctgtttac

SEQ ID NO: 1400073 - DNA, 13 bp, Homo sapiens
atcacgctttcct

SEQ ID NO: 1400074 - DNA, 18 bp, Homo sapiens
atcacgctttttgaaaaa

SEQ ID NO: 1400075 - DNA, 18 bp, Homo sapiens
atcactgtttagaacaca

SEQ ID NO: 1400076 - DNA, 20 bp, Homo sapiens
atcacttaggaaatggcttt

SEQ ID NO: 1400077 - DNA, 20 bp, Homo sapiens
atcactttctcagttttcat

SEQ ID NO: 1400078 - DNA, 22 bp, Homo sapiens
atcagctcccttcccctgcctg

SEQ ID NO: 1400079 - DNA, 23 bp, Homo sapiens
atcagctcccttcccctgcctgg

SEQ ID NO: 1400080 - DNA, 14 bp, Homo sapiens
atcaggctttctta

SEQ ID NO: 1400081 - DNA, 16 bp, Homo sapiens
atcaggtcctcagaga

SEQ ID NO: 1400082 - DNA, 21 bp, Homo sapiens
atcagttttttcacctggaag

SEQ ID NO: 1400083 - DNA, 13 bp, Homo sapiens
atcattactataa

SEQ ID NO: 1400084 - DNA, 14 bp, Homo sapiens
atcattttttactt

SEQ ID NO: 1400085 - DNA, 13 bp, Homo sapiens
atccaaaagcttt

SEQ ID NO: 1400086 - DNA, 18 bp, Homo sapiens
atccaactaatgccttac

SEQ ID NO: 1400087 - DNA, 20 bp, Homo sapiens
atccagagtccctgcctgga

SEQ ID NO: 1400088 - DNA, 21 bp, Homo sapiens
atccagagtccctgcctggac

SEQ ID NO: 1400089 - DNA, 21 bp, Homo sapiens
atccaggcacccaaaccccgg

SEQ ID NO: 1400090 - DNA, 15 bp, Homo sapiens
atccattctcctgag

SEQ ID NO: 1400091 - DNA, 17 bp, Homo sapiens
atcccaagtagaatctc

SEQ ID NO: 1400092 - DNA, 12 bp, Homo sapiens
atccccttgaac

SEQ ID NO: 1400093 - DNA, 22 bp, Homo sapiens
atccctggccccctccctggat

SEQ ID NO: 1400094 - DNA, 14 bp, Homo sapiens
atcctaaacatcat

SEQ ID NO: 1400095 - DNA, 20 bp, Homo sapiens
atcctcctacctccaaagct

SEQ ID NO: 1400096 - DNA, 17 bp, Homo sapiens
atcctgaaatttcagat

SEQ ID NO: 1400097 - DNA, 17 bp, Homo sapiens
aggcgtgagccacctcg

SEQ ID NO: 1400098 - DNA, 22 bp, Homo sapiens
aggctaatttttttgtatttta

SEQ ID NO: 1400099 - DNA, 16 bp, Homo sapiens
aggctattattttcac

SEQ ID NO: 1400100 - DNA, 18 bp, Homo sapiens
aggctattattttcactg

SEQ ID NO: 1400101 - DNA, 19 bp, Homo sapiens
aggctcagagggtgtcctg

SEQ ID NO: 1400102 - DNA, 22 bp, Homo sapiens
aggctccaccccatccagttca

SEQ ID NO: 1400103 - DNA, 15 bp, Homo sapiens
aggctcccagggaca

SEQ ID NO: 1400104 - DNA, 15 bp, Homo sapiens
aggctctggagccca

SEQ ID NO: 1400105 - DNA, 19 bp, Homo sapiens
aggctctggagcccactgt

SEQ ID NO: 1400106 - DNA, 22 bp, Homo sapiens
aggctctggagcccactgtact

SEQ ID NO: 1400107 - DNA, 15 bp, Homo sapiens
aggctgatttctagg

SEQ ID NO: 1400108 - DNA, 15 bp, Homo sapiens
aggctgggtcgccct

SEQ ID NO: 1400109 - DNA, 22 bp, Homo sapiens
aggctggtctcaaactcctgac

SEQ ID NO: 1400110 - DNA, 21 bp, Homo sapiens
aggctgtgtttggctttcagg

SEQ ID NO: 1400111 - DNA, 14 bp, Homo sapiens
aggcttaaacccat

SEQ ID NO: 1400112 - DNA, 18 bp, Homo sapiens
aggcttccttcatttcct

SEQ ID NO: 1400113 - DNA, 14 bp, Homo sapiens
aggcttgttgtgct

SEQ ID NO: 1400114 - DNA, 22 bp, Homo sapiens
agggaacccagctctaatacat

SEQ ID NO: 1400115 - DNA, 19 bp, Homo sapiens
agggaaggctggactaggc

SEQ ID NO: 1400116 - DNA, 14 bp, Homo sapiens
agggacacctggga

SEQ ID NO: 1400117 - DNA, 13 bp, Homo sapiens
agggccaaagaac

SEQ ID NO: 1400118 - DNA, 16 bp, Homo sapiens
agggccaaagaaccaa

SEQ ID NO: 1400119 - DNA, 19 bp, Homo sapiens
agggcctgatggggtggaa

SEQ ID NO: 1400120 - DNA, 13 bp, Homo sapiens
aggggaccaggag

SEQ ID NO: 1400121 - DNA, 15 bp, Homo sapiens
aggggaccaggagtg

SEQ ID NO: 1400122 - DNA, 20 bp, Homo sapiens
aggggaccaggagtgggtgg

SEQ ID NO: 1400123 - DNA, 22 bp, Homo sapiens
aggggaccaggagtgggtgggg

SEQ ID NO: 1400124 - DNA, 16 bp, Homo sapiens
aggggcttcaggtcca

SEQ ID NO: 1400125 - DNA, 15 bp, Homo sapiens
agggtaccagcagaa

SEQ ID NO: 1400126 - DNA, 16 bp, Homo sapiens
agggtaggcaggattg

SEQ ID NO: 1400127 - DNA, 12 bp, Homo sapiens
agggtcaggcct

SEQ ID NO: 1400128 - DNA, 21 bp, Homo sapiens
agggtttccctactgaagccc

SEQ ID NO: 1400129 - DNA, 15 bp, Homo sapiens
agggtttgtgacagg

SEQ ID NO: 1400130 - DNA, 22 bp, Homo sapiens
aggtaaaatgccatgatgcctc

SEQ ID NO: 1400131 - DNA, 16 bp, Homo sapiens
aggtacaagaagcatt

SEQ ID NO: 1400132 - DNA, 19 bp, Homo sapiens
aggtagaatgtaaagcttg

SEQ ID NO: 1400133 - DNA, 22 bp, Homo sapiens
aggtagaattatctaatttata

SEQ ID NO: 1400134 - DNA, 13 bp, Homo sapiens
aggtatacctcac

SEQ ID NO: 1400135 - DNA, 14 bp, Homo sapiens
aggtatttatcttt

SEQ ID NO: 1400136 - DNA, 16 bp, Homo sapiens
aggtccctaataaagc

SEQ ID NO: 1400137 - DNA, 19 bp, Homo sapiens
aggtccctaataaagctgt

SEQ ID NO: 1400138 - DNA, 18 bp, Homo sapiens
aggtgggttgaaagccaa

SEQ ID NO: 1400139 - DNA, 13 bp, Homo sapiens
aggtggtgtttct

SEQ ID NO: 1400140 - DNA, 20 bp, Homo sapiens
aggtgtagccacaccaggat

SEQ ID NO: 1400141 - DNA, 21 bp, Homo sapiens
aggtgtcatacagatttgcaa

SEQ ID NO: 1400142 - DNA, 15 bp, Homo sapiens
aggttaaaatataaa

SEQ ID NO: 1400143 - DNA, 19 bp, Homo sapiens
aggttaaaatataaattaa

SEQ ID NO: 1400144 - DNA, 23 bp, Homo sapiens
aggttgttctgtataaaatgcaa

SEQ ID NO: 1400145 - DNA, 14 bp, Homo sapiens
aggtttacagaatt

SEQ ID NO: 1400146 - DNA, 15 bp, Homo sapiens
agtaaagaattattt

SEQ ID NO: 1400147 - DNA, 19 bp, Homo sapiens
agtaaatcacgctttttga

SEQ ID NO: 1400148 - DNA, 20 bp, Homo sapiens
agtaaatcacgctttttgaa

SEQ ID NO: 1400149 - DNA, 12 bp, Homo sapiens
agtaacaaaaat

SEQ ID NO: 1400150 - DNA, 13 bp, Homo sapiens
agtaacaaaaata

SEQ ID NO: 1400151 - DNA, 17 bp, Homo sapiens
agtaagcctccctcctc

SEQ ID NO: 1400152 - DNA, 19 bp, Homo sapiens
agtaagcctccctcctcgt

SEQ ID NO: 1400153 - DNA, 15 bp, Homo sapiens
agtaataaaattcaa

SEQ ID NO: 1400154 - DNA, 13 bp, Homo sapiens
agtaatctgcatt

SEQ ID NO: 1400155 - DNA, 15 bp, Homo sapiens
agtaatttgaggaca

SEQ ID NO: 1400156 - DNA, 16 bp, Homo sapiens
agtactgggattacag

SEQ ID NO: 1400157 - DNA, 20 bp, Homo sapiens
agtactgggattacaggcgt

SEQ ID NO: 1400158 - DNA, 14 bp, Homo sapiens
agtacttcctctag

SEQ ID NO: 1400159 - DNA, 23 bp, Homo sapiens
agtacttcctctaggaaatgtac

SEQ ID NO: 1400160 - DNA, 14 bp, Homo sapiens
agtagaatctcagt

SEQ ID NO: 1400161 - DNA, 21 bp, Homo sapiens
agtagaatctcagttgatttt

SEQ ID NO: 1400162 - DNA, 23 bp, Homo sapiens
agtagatgcatttgggtccagga

SEQ ID NO: 1400163 - DNA, 14 bp, Homo sapiens
agtagcagtgattg

SEQ ID NO: 1400164 - DNA, 17 bp, Homo sapiens
agtaggcatttttacca

SEQ ID NO: 1400165 - DNA, 15 bp, Homo sapiens
agtatacctgatttt

SEQ ID NO: 1400166 - DNA, 23 bp, Homo sapiens
agtatgtgggcagattttcagca

SEQ ID NO: 1400167 - DNA, 14 bp, Homo sapiens
agtatttgttaatt

SEQ ID NO: 1400168 - DNA, 12 bp, Homo sapiens
agtcaatcaagt

SEQ ID NO: 1400169 - DNA, 13 bp, Homo sapiens
agtcactgagacc

SEQ ID NO: 1400170 - DNA, 23 bp, Homo sapiens
agtcactgagaccaaggctttct

SEQ ID NO: 1400171 - DNA, 22 bp, Homo sapiens
agtccccacagataactgaaaa

SEQ ID NO: 1400172 - DNA, 15 bp, Homo sapiens
agtccctgcctggac

SEQ ID NO: 1400173 - DNA, 21 bp, Homo sapiens
agtccctgcctggaccagcct

SEQ ID NO: 1400174 - DNA, 22 bp, Homo sapiens
agtccctgcctggaccagcctc

SEQ ID NO: 1400175 - DNA, 15 bp, Homo sapiens
agtccgtcaaaacag

SEQ ID NO: 1400176 - DNA, 14 bp, Homo sapiens
agtcctggaagcca

SEQ ID NO: 1400177 - DNA, 23 bp, Homo sapiens
agtcctggaagccagctttccct

SEQ ID NO: 1400178 - DNA, 20 bp, Homo sapiens
agtctaaagctggtttaatg

SEQ ID NO: 1400179 - DNA, 23 bp, Homo sapiens
agtctatcaaccccagacactgg

SEQ ID NO: 1400180 - DNA, 13 bp, Homo sapiens
agtctggaaagtg

SEQ ID NO: 1400181 - DNA, 19 bp, Homo sapiens
agtctgtccagataagtta

SEQ ID NO: 1400182 - DNA, 12 bp, Homo sapiens
agtcttcctgac

SEQ ID NO: 1400183 - DNA, 19 bp, Homo sapiens
agtcttcctgacactttaa

SEQ ID NO: 1400184 - DNA, 14 bp, Homo sapiens
agtgaagaatactt

SEQ ID NO: 1400185 - DNA, 14 bp, Homo sapiens
agtgaagacagaag

SEQ ID NO: 1400186 - DNA, 19 bp, Homo sapiens
agtgaccataaaggcatgg

SEQ ID NO: 1400187 - DNA, 15 bp, Homo sapiens
agtgactaatggcat

SEQ ID NO: 1400188 - DNA, 16 bp, Homo sapiens
agtgactaatggcatg

SEQ ID NO: 1400189 - DNA, 18 bp, Homo sapiens
agtgactctatatagctg

SEQ ID NO: 1400190 - DNA, 19 bp, Homo sapiens
agtgagaatctggctcctg

SEQ ID NO: 1400191 - DNA, 13 bp, Homo sapiens
agtgagagacatt

SEQ ID NO: 1400192 - DNA, 15 bp, Homo sapiens
agtgagttttttagt

SEQ ID NO: 1400193 - DNA, 19 bp, Homo sapiens
agtgagttttttagtgcgt

SEQ ID NO: 1400194 - DNA, 16 bp, Homo sapiens
agtgatccttacaagt

SEQ ID NO: 1400195 - DNA, 16 bp, Homo sapiens
agtgatttttatgcca

SEQ ID NO: 1400196 - DNA, 20 bp, Homo sapiens
agtgatttttatgccacctg

SEQ ID NO: 1400197 - DNA, 21 bp, Homo sapiens
agtgatttttatgccacctga

SEQ ID NO: 1400198 - DNA, 18 bp, Homo sapiens
agtgcaccaaagagaatg

SEQ ID NO: 1400199 - DNA, 19 bp, Homo sapiens
agtgcagcaaccagagcac

SEQ ID NO: 1400200 - DNA, 20 bp, Homo sapiens
agtgctgggattacaggtgt

SEQ ID NO: 1400201 - DNA, 12 bp, Homo sapiens
agtgctgtgctg

SEQ ID NO: 1400202 - DNA, 14 bp, Homo sapiens
agtggctcaacatt

SEQ ID NO: 1400203 - DNA, 14 bp, Homo sapiens
agtgggaaaaatgt

SEQ ID NO: 1400204 - DNA, 18 bp, Homo sapiens
agtgggaaaaatgtagga

SEQ ID NO: 1400205 - DNA, 11 bp, Homo sapiens
agtgggtgggg

SEQ ID NO: 1400206 - DNA, 19 bp, Homo sapiens
agtggtaaaaaggcctcct

SEQ ID NO: 1400207 - DNA, 14 bp, Homo sapiens
agtgtaattgagaa

SEQ ID NO: 1400208 - DNA, 22 bp, Homo sapiens
agtgtacatatgtaaaatattg

SEQ ID NO: 1400209 - DNA, 21 bp, Homo sapiens
agtgtatggaaataaatgtat

SEQ ID NO: 1400210 - DNA, 22 bp, Homo sapiens
agtgtatggaaataaatgtatc

SEQ ID NO: 1400211 - DNA, 20 bp, Homo sapiens
agtgtgcgtggtggtccctg

SEQ ID NO: 1400212 - DNA, 17 bp, Homo sapiens
agtgttgaaaatgttca

SEQ ID NO: 1400213 - DNA, 18 bp, Homo sapiens
agtgttttatgagaaagc

SEQ ID NO: 1400214 - DNA, 22 bp, Homo sapiens
agttaaatgtgtgtaaaaaagt

SEQ ID NO: 1400215 - DNA, 14 bp, Homo sapiens
agttagatatgtgc

SEQ ID NO: 1400216 - DNA, 17 bp, Homo sapiens
agttagtggattactgc

SEQ ID NO: 1400217 - DNA, 15 bp, Homo sapiens
agttatctaagttaa

SEQ ID NO: 1400218 - DNA, 22 bp, Homo sapiens
agttatctaagttaatttaaag

SEQ ID NO: 1400219 - DNA, 20 bp, Homo sapiens
agttatgatttttttttcat

SEQ ID NO: 1400220 - DNA, 18 bp, Homo sapiens
agttattaagttctttaa

SEQ ID NO: 1400221 - DNA, 19 bp, Homo sapiens
agttattaagttctttaaa

SEQ ID NO: 1400222 - DNA, 21 bp, Homo sapiens
agttcatgagaatctatattt

SEQ ID NO: 1400223 - DNA, 16 bp, Homo sapiens
agttcatgtctgctat

SEQ ID NO: 1400224 - DNA, 14 bp, Homo sapiens
agttcattgtaaat

SEQ ID NO: 1400225 - DNA, 21 bp, Homo sapiens
agttcattgtaaatgaacata

SEQ ID NO: 1400226 - DNA, 13 bp, Homo sapiens
agttctgccagga

SEQ ID NO: 1400227 - DNA, 14 bp, Homo sapiens
agttctgccaggag

SEQ ID NO: 1400228 - DNA, 19 bp, Homo sapiens
agttgaaaataaagtgtat

SEQ ID NO: 1400229 - DNA, 15 bp, Homo sapiens
agttgtttgtgcctt

SEQ ID NO: 1400230 - DNA, 22 bp, Homo sapiens
agtttaatggtgccttcatttg

SEQ ID NO: 1400231 - DNA, 23 bp, Homo sapiens
aacagaaaaatatgtaccaagaa

SEQ ID NO: 1400232 - DNA, 20 bp, Homo sapiens
aacagaagttgtgaaactaa

SEQ ID NO: 1400233 - DNA, 13 bp, Homo sapiens
aacagaatttatg

SEQ ID NO: 1400234 - DNA, 18 bp, Homo sapiens
aacaggagacccacctga

SEQ ID NO: 1400235 - DNA, 16 bp, Homo sapiens
aacagtgaagacagaa

SEQ ID NO: 1400236 - DNA, 12 bp, Homo sapiens
aacagttttcct

SEQ ID NO: 1400237 - DNA, 21 bp, Homo sapiens
aacagttttcctatgctttga

SEQ ID NO: 1400238 - DNA, 20 bp, Homo sapiens
aacataatcttctgccttct

SEQ ID NO: 1400239 - DNA, 13 bp, Homo sapiens
aacataatgaaca

SEQ ID NO: 1400240 - DNA, 17 bp, Homo sapiens
aacatacctaagaagta

SEQ ID NO: 1400241 - DNA, 22 bp, Homo sapiens
aacatagaaattgcctgacgaa

SEQ ID NO: 1400242 - DNA, 15 bp, Homo sapiens
aacatagacagaaga

SEQ ID NO: 1400243 - DNA, 19 bp, Homo sapiens
aacatagacagaagaaaca

SEQ ID NO: 1400244 - DNA, 15 bp, Homo sapiens
aacatatatatacta

SEQ ID NO: 1400245 - DNA, 21 bp, Homo sapiens
aacatctttttcctccctttc

SEQ ID NO: 1400246 - DNA, 13 bp, Homo sapiens
aacattgtgttcc

SEQ ID NO: 1400247 - DNA, 23 bp, Homo sapiens
aacattgtgttcccatttcagct

SEQ ID NO: 1400248 - DNA, 23 bp, Homo sapiens
aacattgttaatataatttaaca

SEQ ID NO: 1400249 - DNA, 15 bp, Homo sapiens
aacatttattttgac

SEQ ID NO: 1400250 - DNA, 13 bp, Homo sapiens
aaccagagcactg

SEQ ID NO: 1400251 - DNA, 15 bp, Homo sapiens
aaccaggactctgcc

SEQ ID NO: 1400252 - DNA, 16 bp, Homo sapiens
aaccaggactctgccc

SEQ ID NO: 1400253 - DNA, 18 bp, Homo sapiens
aaccataacaacttcata

SEQ ID NO: 1400254 - DNA, 19 bp, Homo sapiens
aaccatgcaaatgctatga

SEQ ID NO: 1400255 - DNA, 16 bp, Homo sapiens
aaccatttcctcagac

SEQ ID NO: 1400256 - DNA, 17 bp, Homo sapiens
aacccatattgtaaaac

SEQ ID NO: 1400257 - DNA, 20 bp, Homo sapiens
aacccctcccctccatccct

SEQ ID NO: 1400258 - DNA, 22 bp, Homo sapiens
aaccctgtctggatcctatcct

SEQ ID NO: 1400259 - DNA, 16 bp, Homo sapiens
aaccgtctgttatgct

SEQ ID NO: 1400260 - DNA, 22 bp, Homo sapiens
aacctatttcttaaacacttgc

SEQ ID NO: 1400261 - DNA, 14 bp, Homo sapiens
aacctcagtaattt

SEQ ID NO: 1400262 - DNA, 20 bp, Homo sapiens
aacctgagtcgtacagaaag

SEQ ID NO: 1400263 - DNA, 20 bp, Homo sapiens
aacctgggttgcagacagga

SEQ ID NO: 1400264 - DNA, 24 bp, Homo sapiens
aacctgttacctactttgactttt

SEQ ID NO: 1400265 - DNA, 18 bp, Homo sapiens
aaccttgaagttctgaaa

SEQ ID NO: 1400266 - DNA, 19 bp, Homo sapiens
aaccttgaagttctgaaat

SEQ ID NO: 1400267 - DNA, 20 bp, Homo sapiens
aacgtttaagccaaaacaat

SEQ ID NO: 1400268 - DNA, 23 bp, Homo sapiens
aactaagttttttacttccacag

SEQ ID NO: 1400269 - DNA, 15 bp, Homo sapiens
aactaatgccttact

SEQ ID NO: 1400270 - DNA, 14 bp, Homo sapiens
aactacagtctaaa

SEQ ID NO: 1400271 - DNA, 22 bp, Homo sapiens
aactaggttgctactttatttg

SEQ ID NO: 1400272 - DNA, 15 bp, Homo sapiens
aactatccaattaaa

SEQ ID NO: 1400273 - DNA, 19 bp, Homo sapiens
aactatccaattaaaatta

SEQ ID NO: 1400274 - DNA, 21 bp, Homo sapiens
aactatccaattaaaattaag

SEQ ID NO: 1400275 - DNA, 18 bp, Homo sapiens
aactatcttggtgaattt

SEQ ID NO: 1400276 - DNA, 12 bp, Homo sapiens
aactattttcag

SEQ ID NO: 1400277 - DNA, 13 bp, Homo sapiens
aactattttcaga

SEQ ID NO: 1400278 - DNA, 16 bp, Homo sapiens
aactattttcagatgt

SEQ ID NO: 1400279 - DNA, 20 bp, Homo sapiens
aactattttcagatgtgaac

SEQ ID NO: 1400280 - DNA, 16 bp, Homo sapiens
aactcagaatgctcta

SEQ ID NO: 1400281 - DNA, 12 bp, Homo sapiens
aactcctgcctg

SEQ ID NO: 1400282 - DNA, 16 bp, Homo sapiens
aactcctgcctgtgtt

SEQ ID NO: 1400283 - DNA, 19 bp, Homo sapiens
aactcgtgtctggcacagc

SEQ ID NO: 1400284 - DNA, 19 bp, Homo sapiens
aactctcttattgcctcac

SEQ ID NO: 1400285 - DNA, 22 bp, Homo sapiens
aactcttataaatttctatttt

SEQ ID NO: 1400286 - DNA, 17 bp, Homo sapiens
aactcttcactcttcaa

SEQ ID NO: 1400287 - DNA, 23 bp, Homo sapiens
aactcttcactcttcaaatgcct

SEQ ID NO: 1400288 - DNA, 17 bp, Homo sapiens
aactgagaatttgtgtg

SEQ ID NO: 1400289 - DNA, 12 bp, Homo sapiens
aactgaggaatt

SEQ ID NO: 1400290 - DNA, 16 bp, Homo sapiens
aactgaggaattttct

SEQ ID NO: 1400291 - DNA, 13 bp, Homo sapiens
aactggaaagaag

SEQ ID NO: 1400292 - DNA, 16 bp, Homo sapiens
aactggaatcagctca

SEQ ID NO: 1400293 - DNA, 19 bp, Homo sapiens
aactggaatcagctcagga

SEQ ID NO: 1400294 - DNA, 22 bp, Homo sapiens
aactggcaggcaggctcccagg

SEQ ID NO: 1400295 - DNA, 18 bp, Homo sapiens
aactgggtaatgaaacaa

SEQ ID NO: 1400296 - DNA, 23 bp, Homo sapiens
aactgtgtacataactgaaaatg

SEQ ID NO: 1400297 - DNA, 21 bp, Homo sapiens
aacttaccaggcaccaaaaga

SEQ ID NO: 1400298 - DNA, 16 bp, Homo sapiens
agaaactgaggaattt

SEQ ID NO: 1400299 - DNA, 18 bp, Homo sapiens
agaaactgaggaattttc

SEQ ID NO: 1400300 - DNA, 13 bp, Homo sapiens
agaaagccttctt

SEQ ID NO: 1400301 - DNA, 16 bp, Homo sapiens
agaaaggattaagata

SEQ ID NO: 1400302 - DNA, 23 bp, Homo sapiens
agaaaggattaagatacactcct

SEQ ID NO: 1400303 - DNA, 15 bp, Homo sapiens
agaaatcagaaaaat

SEQ ID NO: 1400304 - DNA, 22 bp, Homo sapiens
agaaatgccaagcacttctttt

SEQ ID NO: 1400305 - DNA, 14 bp, Homo sapiens
agaaattgcctcct

SEQ ID NO: 1400306 - DNA, 15 bp, Homo sapiens
agaaattgcctcctt

SEQ ID NO: 1400307 - DNA, 13 bp, Homo sapiens
agaaatttaaact

SEQ ID NO: 1400308 - DNA, 10 bp, Homo sapiens
agaacaaggc

SEQ ID NO: 1400309 - DNA, 12 bp, Homo sapiens
agaacacacaca

SEQ ID NO: 1400310 - DNA, 15 bp, Homo sapiens
agaacacacacactt

SEQ ID NO: 1400311 - DNA, 19 bp, Homo sapiens
agaacatagacagaagaaa

SEQ ID NO: 1400312 - DNA, 17 bp, Homo sapiens
agaacccctacatgaaa

SEQ ID NO: 1400313 - DNA, 21 bp, Homo sapiens
agaacctgggttgcagacagg

SEQ ID NO: 1400314 - DNA, 13 bp, Homo sapiens
agaagaaaaagaa

SEQ ID NO: 1400315 - DNA, 22 bp, Homo sapiens
agaagaagtttcatcatttttt

SEQ ID NO: 1400316 - DNA, 22 bp, Homo sapiens
agaagaatctcatctcagtgaa

SEQ ID NO: 1400317 - DNA, 17 bp, Homo sapiens
agaagattcccacccct

SEQ ID NO: 1400318 - DNA, 21 bp, Homo sapiens
agaaggaaaattttagcgtgc

SEQ ID NO: 1400319 - DNA, 17 bp, Homo sapiens
agaagtagaaatcatag

SEQ ID NO: 1400320 - DNA, 13 bp, Homo sapiens
agaagtttgcact

SEQ ID NO: 1400321 - DNA, 21 bp, Homo sapiens
agaagtttgcactatctttca

SEQ ID NO: 1400322 - DNA, 15 bp, Homo sapiens
agaatacttctcatt

SEQ ID NO: 1400323 - DNA, 12 bp, Homo sapiens
agaatgagcctc

SEQ ID NO: 1400324 - DNA, 13 bp, Homo sapiens
agaatgatttcat

SEQ ID NO: 1400325 - DNA, 16 bp, Homo sapiens
agaatggcagaaaagt

SEQ ID NO: 1400326 - DNA, 17 bp, Homo sapiens
agaatgtaaagcttgtc

SEQ ID NO: 1400327 - DNA, 23 bp, Homo sapiens
agaatgtatattaaggtgtggct

SEQ ID NO: 1400328 - DNA, 21 bp, Homo sapiens
agaatgttaagacttgacagt

SEQ ID NO: 1400329 - DNA, 14 bp, Homo sapiens
agaattatctaatt

SEQ ID NO: 1400330 - DNA, 13 bp, Homo sapiens
agaattattttgt

SEQ ID NO: 1400331 - DNA, 15 bp, Homo sapiens
agaattattttgtga

SEQ ID NO: 1400332 - DNA, 19 bp, Homo sapiens
agaattgtgtcagactgtt

SEQ ID NO: 1400333 - DNA, 16 bp, Homo sapiens
agaatttctaccattt

SEQ ID NO: 1400334 - DNA, 20 bp, Homo sapiens
agaatttctaccatttcaga

SEQ ID NO: 1400335 - DNA, 14 bp, Homo sapiens
agacacacctgagg

SEQ ID NO: 1400336 - DNA, 12 bp, Homo sapiens
agacacagactg

SEQ ID NO: 1400337 - DNA, 17 bp, Homo sapiens
agacaccgttcattcag

SEQ ID NO: 1400338 - DNA, 12 bp, Homo sapiens
agacactggttt

SEQ ID NO: 1400339 - DNA, 17 bp, Homo sapiens
agacagaacccctacat

SEQ ID NO: 1400340 - DNA, 14 bp, Homo sapiens
agacagaagaaaca

SEQ ID NO: 1400341 - DNA, 14 bp, Homo sapiens
agacagtctggaaa

SEQ ID NO: 1400342 - DNA, 15 bp, Homo sapiens
agacagtctggaaag

SEQ ID NO: 1400343 - DNA, 20 bp, Homo sapiens
agacagtgagacagtctgga

SEQ ID NO: 1400344 - DNA, 15 bp, Homo sapiens
agacagttcaagaaa

SEQ ID NO: 1400345 - DNA, 18 bp, Homo sapiens
agacatgtctgttctaca

SEQ ID NO: 1400346 - DNA, 22 bp, Homo sapiens
agacattaactcattagactgg

SEQ ID NO: 1400347 - DNA, 19 bp, Homo sapiens
agaccaaggctttctctac

SEQ ID NO: 1400348 - DNA, 20 bp, Homo sapiens
agacccacctgaggctcagc

SEQ ID NO: 1400349 - DNA, 21 bp, Homo sapiens
agacccacctgaggctcagcc

SEQ ID NO: 1400350 - DNA, 22 bp, Homo sapiens
agaccctttcttcagctctgaa

SEQ ID NO: 1400351 - DNA, 18 bp, Homo sapiens
agaccggcctgccaggag

SEQ ID NO: 1400352 - DNA, 21 bp, Homo sapiens
agacctaatctctgtaaagct

SEQ ID NO: 1400353 - DNA, 22 bp, Homo sapiens
agacctctcaacagatctgtgg

SEQ ID NO: 1400354 - DNA, 20 bp, Homo sapiens
agactcagctctgacattct

SEQ ID NO: 1400355 - DNA, 17 bp, Homo sapiens
agactccttcaacaatt

SEQ ID NO: 1400356 - DNA, 17 bp, Homo sapiens
agactgctgtggccagg

SEQ ID NO: 1400357 - DNA, 20 bp, Homo sapiens
agactgctgtggccaggagg

SEQ ID NO: 1400358 - DNA, 15 bp, Homo sapiens
agactggaacactag

SEQ ID NO: 1400359 - DNA, 13 bp, Homo sapiens
agactggaacttg

SEQ ID NO: 1400360 - DNA, 18 bp, Homo sapiens
agactggaacttgaactg

SEQ ID NO: 1400361 - DNA, 13 bp, Homo sapiens
agactggacagct

SEQ ID NO: 1400362 - DNA, 14 bp, Homo sapiens
agacttaagattaa

SEQ ID NO: 1400363 - DNA, 19 bp, Homo sapiens
agacttcaagcatggctat

SEQ ID NO: 1400364 - DNA, 12 bp, Homo sapiens
agacttgacagt

SEQ ID NO: 1400365 - DNA, 20 bp, Homo sapiens
agactttctattaatattta

SEQ ID NO: 1400366 - DNA, 17 bp, Homo sapiens
agagaaatcagaaaaat

SEQ ID NO: 1400367 - DNA, 16 bp, Homo sapiens
agagaccttccagaaa

SEQ ID NO: 1400368 - DNA, 17 bp, Homo sapiens
agagacgggccctggtg

SEQ ID NO: 1400369 - DNA, 15 bp, Homo sapiens
agagagcctgcagga

SEQ ID NO: 1400370 - DNA, 20 bp, Homo sapiens
agagaggccttttggaatgt

SEQ ID NO: 1400371 - DNA, 13 bp, Homo sapiens
agagatgcagaaa

SEQ ID NO: 1400372 - DNA, 17 bp, Homo sapiens
agagatgcagaaatatt

SEQ ID NO: 1400373 - DNA, 18 bp, Homo sapiens
agagcactgccaccagta

SEQ ID NO: 1400374 - DNA, 14 bp, Homo sapiens
agagcctgcaggat

SEQ ID NO: 1400375 - DNA, 14 bp, Homo sapiens
agagctacataatt

SEQ ID NO: 1400376 - DNA, 16 bp, Homo sapiens
agagctacgtatttaa

SEQ ID NO: 1400377 - DNA, 14 bp, Homo sapiens
agagggcgcaggcc

SEQ ID NO: 1400378 - DNA, 17 bp, Homo sapiens
agagtccctgcctggac

SEQ ID NO: 1400379 - DNA, 16 bp, Homo sapiens
agagttagatatgtgc

SEQ ID NO: 1400380 - DNA, 14 bp, Homo sapiens
agagttcaagaaat

SEQ ID NO: 1400381 - DNA, 12 bp, Homo sapiens
agagttgaacct

SEQ ID NO: 1400382 - DNA, 15 bp, Homo sapiens
agataactgaaaatt

SEQ ID NO: 1400383 - DNA, 22 bp, Homo sapiens
agataactgaaaattatttaaa

SEQ ID NO: 1400384 - DNA, 18 bp, Homo sapiens
agataaggtaaaatgcca

SEQ ID NO: 1400385 - DNA, 14 bp, Homo sapiens
agatacactcctgc

SEQ ID NO: 1400386 - DNA, 14 bp, Homo sapiens
agatacatacagaa

SEQ ID NO: 1400387 - DNA, 12 bp, Homo sapiens
agatagaatgac

SEQ ID NO: 1400388 - DNA, 17 bp, Homo sapiens
agatatttatatgttat

SEQ ID NO: 1400389 - DNA, 17 bp, Homo sapiens
agatatttttatcttta

SEQ ID NO: 1400390 - DNA, 11 bp, Homo sapiens
agatcactttc

SEQ ID NO: 1400391 - DNA, 22 bp, Homo sapiens
agatcccaagtagaatctcagt

SEQ ID NO: 1400392 - DNA, 12 bp, Homo sapiens
agatcctcctca

SEQ ID NO: 1400393 - DNA, 15 bp, Homo sapiens
agatcctcctcattc

SEQ ID NO: 1400394 - DNA, 18 bp, Homo sapiens
agatcttttattttgcca

SEQ ID NO: 1400395 - DNA, 20 bp, Homo sapiens
agatgcatttgggtccagga

SEQ ID NO: 1400396 - DNA, 15 bp, Homo sapiens
agatgcccaaatcct

SEQ ID NO: 1400397 - DNA, 20 bp, Homo sapiens
agatgcttttaacagagtct

SEQ ID NO: 1400398 - DNA, 17 bp, Homo sapiens
agatgtttgatagattt

SEQ ID NO: 1400399 - DNA, 19 bp, Homo sapiens
agattctcataacttgaga

SEQ ID NO: 1400400 - DNA, 20 bp, Homo sapiens
agattctcataacttgagac

SEQ ID NO: 1400401 - DNA, 12 bp, Homo sapiens
ctggggggtggc

SEQ ID NO: 1400402 - DNA, 15 bp, Homo sapiens
ctggggggtggccag

SEQ ID NO: 1400403 - DNA, 16 bp, Homo sapiens
ctggggggtggccagg

SEQ ID NO: 1400404 - DNA, 18 bp, Homo sapiens
ctgggtaatgaaacaaag

SEQ ID NO: 1400405 - DNA, 17 bp, Homo sapiens
ctgggtagcgggggagg

SEQ ID NO: 1400406 - DNA, 15 bp, Homo sapiens
ctgggttgcagacag

SEQ ID NO: 1400407 - DNA, 18 bp, Homo sapiens
ctgggttgcagacaggaa

SEQ ID NO: 1400408 - DNA, 19 bp, Homo sapiens
ctggtagttcattgtaaat

SEQ ID NO: 1400409 - DNA, 23 bp, Homo sapiens
ctggtagttcattgtaaatgaac

SEQ ID NO: 1400410 - DNA, 22 bp, Homo sapiens
ctggtccaaaagattgctgaaa

SEQ ID NO: 1400411 - DNA, 14 bp, Homo sapiens
ctggtctctccttg

SEQ ID NO: 1400412 - DNA, 18 bp, Homo sapiens
ctggtcttgtggaattgg

SEQ ID NO: 1400413 - DNA, 18 bp, Homo sapiens
ctggtgccaatttcaagt

SEQ ID NO: 1400414 - DNA, 20 bp, Homo sapiens
ctggttcacactgaccaaga

SEQ ID NO: 1400415 - DNA, 14 bp, Homo sapiens
ctggtttgaaattt

SEQ ID NO: 1400416 - DNA, 18 bp, Homo sapiens
ctgtaaagctaaaataaa

SEQ ID NO: 1400417 - DNA, 16 bp, Homo sapiens
ctgtaacaagccagat

SEQ ID NO: 1400418 - DNA, 22 bp, Homo sapiens
ctgtaagaaacctactgcccag

SEQ ID NO: 1400419 - DNA, 19 bp, Homo sapiens
ctgtaatgttaatattgat

SEQ ID NO: 1400420 - DNA, 15 bp, Homo sapiens
ctgtacactgcacga

SEQ ID NO: 1400421 - DNA, 16 bp, Homo sapiens
ctgtacttgctcttga

SEQ ID NO: 1400422 - DNA, 19 bp, Homo sapiens
ctgtacttgctcttgatgc

SEQ ID NO: 1400423 - DNA, 20 bp, Homo sapiens
ctgtagccccagtgacagct

SEQ ID NO: 1400424 - DNA, 21 bp, Homo sapiens
ctgtagccccagtgacagcta

SEQ ID NO: 1400425 - DNA, 21 bp, Homo sapiens
ctgtataaaatgcaaaataaa

SEQ ID NO: 1400426 - DNA, 20 bp, Homo sapiens
ctgtcaagtcatgatggaga

SEQ ID NO: 1400427 - DNA, 20 bp, Homo sapiens
ctgtcctttctagagcactg

SEQ ID NO: 1400428 - DNA, 22 bp, Homo sapiens
ctgtcctttctagagcactgcc

SEQ ID NO: 1400429 - DNA, 15 bp, Homo sapiens
ctgtcgattagactg

SEQ ID NO: 1400430 - DNA, 20 bp, Homo sapiens
ctgtcgattagactggacag

SEQ ID NO: 1400431 - DNA, 23 bp, Homo sapiens
ctgtcgattagactggacagctt

SEQ ID NO: 1400432 - DNA, 21 bp, Homo sapiens
ctgtctccctcctctgcccgg

SEQ ID NO: 1400433 - DNA, 13 bp, Homo sapiens
ctgtctctcatga

SEQ ID NO: 1400434 - DNA, 13 bp, Homo sapiens
ctgtcttctggac

SEQ ID NO: 1400435 - DNA, 17 bp, Homo sapiens
ctgtgacctctcccctg

SEQ ID NO: 1400436 - DNA, 20 bp, Homo sapiens
ctgtgccttgtcacgccaga

SEQ ID NO: 1400437 - DNA, 21 bp, Homo sapiens
ctgtgctatggtgctctgtct

SEQ ID NO: 1400438 - DNA, 16 bp, Homo sapiens
ctgtgcttatggtacc

SEQ ID NO: 1400439 - DNA, 13 bp, Homo sapiens
ctgtggccaggag

SEQ ID NO: 1400440 - DNA, 14 bp, Homo sapiens
ctgtggccaggagg

SEQ ID NO: 1400441 - DNA, 22 bp, Homo sapiens
ctgtgtacataactgaaaatgt

SEQ ID NO: 1400442 - DNA, 16 bp, Homo sapiens
ctgtgtgcacaaatat

SEQ ID NO: 1400443 - DNA, 14 bp, Homo sapiens
ctgtgtgctcagga

SEQ ID NO: 1400444 - DNA, 23 bp, Homo sapiens
ctgtgtgctcaggagccctggga

SEQ ID NO: 1400445 - DNA, 16 bp, Homo sapiens
ctgtgtttggctttca

SEQ ID NO: 1400446 - DNA, 17 bp, Homo sapiens
ctgtgtttggctttcag

SEQ ID NO: 1400447 - DNA, 23 bp, Homo sapiens
ctgtgtttggctttcagggaggc

SEQ ID NO: 1400448 - DNA, 23 bp, Homo sapiens
ctgttatcaaacaccaacataaa

SEQ ID NO: 1400449 - DNA, 19 bp, Homo sapiens
ctgttatgctgtgacacat

SEQ ID NO: 1400450 - DNA, 20 bp, Homo sapiens
ctgttctacatagatgctta

SEQ ID NO: 1400451 - DNA, 12 bp, Homo sapiens
ctgttgggagag

SEQ ID NO: 1400452 - DNA, 17 bp, Homo sapiens
ctgtttactgcaaggtt

SEQ ID NO: 1400453 - DNA, 13 bp, Homo sapiens
ctgtttagaacac

SEQ ID NO: 1400454 - DNA, 17 bp, Homo sapiens
ctgtttagtagcagtga

SEQ ID NO: 1400455 - DNA, 13 bp, Homo sapiens
ctgtttccatggg

SEQ ID NO: 1400456 - DNA, 22 bp, Homo sapiens
ctgtttggaaattgattttgaa

SEQ ID NO: 1400457 - DNA, 12 bp, Homo sapiens
ctgtttttcaca

SEQ ID NO: 1400458 - DNA, 13 bp, Homo sapiens
ctgtttttcacat

SEQ ID NO: 1400459 - DNA, 15 bp, Homo sapiens
cttaaaccttcagtt

SEQ ID NO: 1400460 - DNA, 13 bp, Homo sapiens
cttaaataagaaa

SEQ ID NO: 1400461 - DNA, 22 bp, Homo sapiens
cttaacaagatatttatatgtt

SEQ ID NO: 1400462 - DNA, 23 bp, Homo sapiens
ctcagataaggtaaaatgccatg

SEQ ID NO: 1400463 - DNA, 16 bp, Homo sapiens
ctcagatcctcctcat

SEQ ID NO: 1400464 - DNA, 17 bp, Homo sapiens
ctcagccccgcgtggaa

SEQ ID NO: 1400465 - DNA, 19 bp, Homo sapiens
ctcagccctagccctcagc

SEQ ID NO: 1400466 - DNA, 14 bp, Homo sapiens
ctcagctagctctg

SEQ ID NO: 1400467 - DNA, 15 bp, Homo sapiens
ctcagctagctctgc

SEQ ID NO: 1400468 - DNA, 14 bp, Homo sapiens
ctcaggagccctgg

SEQ ID NO: 1400469 - DNA, 20 bp, Homo sapiens
ctcaggagccctgggaggct

SEQ ID NO: 1400470 - DNA, 23 bp, Homo sapiens
ctcaggagccctgggaggctctg

SEQ ID NO: 1400471 - DNA, 24 bp, Homo sapiens
ctcaggagccctgggaggctctgg

SEQ ID NO: 1400472 - DNA, 20 bp, Homo sapiens
ctcaggatgagggaaaagaa

SEQ ID NO: 1400473 - DNA, 21 bp, Homo sapiens
ctcaggatgagggaaaagaaa

SEQ ID NO: 1400474 - DNA, 21 bp, Homo sapiens
ctcaggcagaggatgttctgg

SEQ ID NO: 1400475 - DNA, 20 bp, Homo sapiens
ctcaggcccccacctggctc

SEQ ID NO: 1400476 - DNA, 21 bp, Homo sapiens
ctcaggcccccacctggctca

SEQ ID NO: 1400477 - DNA, 16 bp, Homo sapiens
ctcagttgattttctg

SEQ ID NO: 1400478 - DNA, 14 bp, Homo sapiens
ctcagttttcataa

SEQ ID NO: 1400479 - DNA, 14 bp, Homo sapiens
ctcataacttgaga

SEQ ID NO: 1400480 - DNA, 11 bp, Homo sapiens
ctcatctcagt

SEQ ID NO: 1400481 - DNA, 12 bp, Homo sapiens
ctcatctcttct

SEQ ID NO: 1400482 - DNA, 12 bp, Homo sapiens
ctcatctgtcac

SEQ ID NO: 1400483 - DNA, 12 bp, Homo sapiens
ctcatgaacctc

SEQ ID NO: 1400484 - DNA, 21 bp, Homo sapiens
ctcatgaacctcaagctgcat

SEQ ID NO: 1400485 - DNA, 18 bp, Homo sapiens
ctcatgtgactctttcca

SEQ ID NO: 1400486 - DNA, 13 bp, Homo sapiens
ctcattagactgg

SEQ ID NO: 1400487 - DNA, 13 bp, Homo sapiens
ctcattttttaaa

SEQ ID NO: 1400488 - DNA, 14 bp, Homo sapiens
ctccaaaaaagaaa

SEQ ID NO: 1400489 - DNA, 13 bp, Homo sapiens
ctccaaactcctg

SEQ ID NO: 1400490 - DNA, 20 bp, Homo sapiens
ctccaaggaggggctgtaaa

SEQ ID NO: 1400491 - DNA, 21 bp, Homo sapiens
ctccaaggaggggctgtaaaa

SEQ ID NO: 1400492 - DNA, 16 bp, Homo sapiens
ctccactcatgtgact

SEQ ID NO: 1400493 - DNA, 22 bp, Homo sapiens
ctccactcatgtgactctttcc

SEQ ID NO: 1400494 - DNA, 16 bp, Homo sapiens
ctccagccaccaccca

SEQ ID NO: 1400495 - DNA, 13 bp, Homo sapiens
ctccatccctggc

SEQ ID NO: 1400496 - DNA, 14 bp, Homo sapiens
ctccatccctggcc

SEQ ID NO: 1400497 - DNA, 18 bp, Homo sapiens
ctccatcctaccccctgt

SEQ ID NO: 1400498 - DNA, 22 bp, Homo sapiens
ctccatcctaccccctgtgcct

SEQ ID NO: 1400499 - DNA, 18 bp, Homo sapiens
ctcccaggaactgggcca

SEQ ID NO: 1400500 - DNA, 16 bp, Homo sapiens
ctcccaggagacagtt

SEQ ID NO: 1400501 - DNA, 19 bp, Homo sapiens
ctcccaggagacagttcaa

SEQ ID NO: 1400502 - DNA, 13 bp, Homo sapiens
ctccccacccccc

SEQ ID NO: 1400503 - DNA, 20 bp, Homo sapiens
ctccccacgtcagctgggac

SEQ ID NO: 1400504 - DNA, 16 bp, Homo sapiens
ctcccctccatccctg

SEQ ID NO: 1400505 - DNA, 22 bp, Homo sapiens
ctcccctggaactgtctctcat

SEQ ID NO: 1400506 - DNA, 21 bp, Homo sapiens
ctccctatactgcttggagct

SEQ ID NO: 1400507 - DNA, 14 bp, Homo sapiens
ctccctcctctgcc

SEQ ID NO: 1400508 - DNA, 15 bp, Homo sapiens
ctccctttccctgag

SEQ ID NO: 1400509 - DNA, 18 bp, Homo sapiens
ctccgtccaggagcctgg

SEQ ID NO: 1400510 - DNA, 20 bp, Homo sapiens
ctccgtccaggagcctgtgc

SEQ ID NO: 1400511 - DNA, 22 bp, Homo sapiens
ctccgtccaggagcctgtgcct

SEQ ID NO: 1400512 - DNA, 12 bp, Homo sapiens
ctccgtgtggga

SEQ ID NO: 1400513 - DNA, 20 bp, Homo sapiens
ctcctcaacccctcccctcc

SEQ ID NO: 1400514 - DNA, 14 bp, Homo sapiens
ctcctcacccccag

SEQ ID NO: 1400515 - DNA, 11 bp, Homo sapiens
ctcctcaggga

SEQ ID NO: 1400516 - DNA, 12 bp, Homo sapiens
ctcctcccagga

SEQ ID NO: 1400517 - DNA, 24 bp, Homo sapiens
ctcctcgagatcccaacactgcca

SEQ ID NO: 1400518 - DNA, 17 bp, Homo sapiens
ctcctctgattatcagg

SEQ ID NO: 1400519 - DNA, 22 bp, Homo sapiens
ctcctgaaaaggtttatgaaaa

SEQ ID NO: 1400520 - DNA, 16 bp, Homo sapiens
ctcctgacctcaggca

SEQ ID NO: 1400521 - DNA, 11 bp, Homo sapiens
ctcctgctgtg

SEQ ID NO: 1400522 - DNA, 19 bp, Homo sapiens
ctcctggctgtctgaggct

SEQ ID NO: 1400523 - DNA, 19 bp, Homo sapiens
ctcctgggttcaagcgatt

SEQ ID NO: 1400524 - DNA, 13 bp, Homo sapiens
ctcctgttgggag

SEQ ID NO: 1400525 - DNA, 14 bp, Homo sapiens
ctcctgttgggaga

SEQ ID NO: 1400526 - DNA, 16 bp, Homo sapiens
ctcctgttgggagagg

SEQ ID NO: 1400527 - DNA, 22 bp, Homo sapiens
ctcctgttgggagagggcgcag

SEQ ID NO: 1400528 - DNA, 16 bp, Homo sapiens
ctccttatttatcaac

SEQ ID NO: 1400529 - DNA, 23 bp, Homo sapiens
ctcgagatcccaacactgccagc

SEQ ID NO: 1400530 - DNA, 15 bp, Homo sapiens
ctcgtgtctggcaca

SEQ ID NO: 1400531 - DNA, 23 bp, Homo sapiens
ctctccaggcaggtctgaagctc

SEQ ID NO: 1400532 - DNA, 21 bp, Homo sapiens
ctctcccctggaactgtctct

SEQ ID NO: 1400533 - DNA, 15 bp, Homo sapiens
ctctcctgtctccct

SEQ ID NO: 1400534 - DNA, 19 bp, Homo sapiens
ctctcgggttgtgtgtctg

SEQ ID NO: 1400535 - DNA, 16 bp, Homo sapiens
ctctctgcaggtccct

SEQ ID NO: 1400536 - DNA, 23 bp, Homo sapiens
ctctcttattgcctcacttcagg

SEQ ID NO: 1400537 - DNA, 13 bp, Homo sapiens
ctctgaaagagaa

SEQ ID NO: 1400538 - DNA, 21 bp, Homo sapiens
ctctgaaagagaaacacgtat

SEQ ID NO: 1400539 - DNA, 12 bp, Homo sapiens
ctctgaacacat

SEQ ID NO: 1400540 - DNA, 17 bp, Homo sapiens
ctctgagtgttttatga

SEQ ID NO: 1400541 - DNA, 22 bp, Homo sapiens
ctctgagtgttttatgagaaag

SEQ ID NO: 1400542 - DNA, 14 bp, Homo sapiens
ctctgcaggtccct

SEQ ID NO: 1400543 - DNA, 15 bp, Homo sapiens
ctctgcaggtcccta

SEQ ID NO: 1400544 - DNA, 16 bp, Homo sapiens
ctctgcaggtccctaa

SEQ ID NO: 1400545 - DNA, 21 bp, Homo sapiens
ctctgcaggtccctaataaag

SEQ ID NO: 1400546 - DNA, 14 bp, Homo sapiens
ctctgcccgggagc

SEQ ID NO: 1400547 - DNA, 19 bp, Homo sapiens
ctctggggggtggccaggc

SEQ ID NO: 1400548 - DNA, 21 bp, Homo sapiens
ctctggggggtggccaggccg

SEQ ID NO: 1400549 - DNA, 15 bp, Homo sapiens
ctctgtaaagctaaa

SEQ ID NO: 1400550 - DNA, 23 bp, Homo sapiens
ctctgtaagtagatgcatttggg

SEQ ID NO: 1400551 - DNA, 18 bp, Homo sapiens
ctctgtaattgaatatta

SEQ ID NO: 1400552 - DNA, 20 bp, Homo sapiens
ctctgtcgcccatgctggag

SEQ ID NO: 1400553 - DNA, 19 bp, Homo sapiens
ctctgtctacttgctcagg

SEQ ID NO: 1400554 - DNA, 14 bp, Homo sapiens
ctctgtcttctgga

SEQ ID NO: 1400555 - DNA, 16 bp, Homo sapiens
ctctgttcatttcctc

SEQ ID NO: 1400556 - DNA, 17 bp, Homo sapiens
ctcttattgcctcactt

SEQ ID NO: 1400557 - DNA, 15 bp, Homo sapiens
ctcttcaaatgcctg

SEQ ID NO: 1400558 - DNA, 19 bp, Homo sapiens
ctcttccagtcttcctgac

SEQ ID NO: 1400559 - DNA, 20 bp, Homo sapiens
ctcttcttgaaattttaacc

SEQ ID NO: 1400560 - DNA, 23 bp, Homo sapiens
ctcttcttttaaaccattttctt

SEQ ID NO: 1400561 - DNA, 15 bp, Homo sapiens
ctcttgatgcctggc

SEQ ID NO: 1400562 - DNA, 21 bp, Homo sapiens
ctcttggggagtttagggtgg

SEQ ID NO: 1400563 - DNA, 23 bp, Homo sapiens
ctcttggggagtttagggtgggg

SEQ ID NO: 1400564 - DNA, 21 bp, Homo sapiens
ctctttatgcttgcaaaaact

SEQ ID NO: 1400565 - DNA, 21 bp, Homo sapiens
ctgaaaaatggtaattgttgc

SEQ ID NO: 1400566 - DNA, 13 bp, Homo sapiens
ctgaaattttata

SEQ ID NO: 1400567 - DNA, 19 bp, Homo sapiens
ctgaaattttatatgctta

SEQ ID NO: 1400568 - DNA, 12 bp, Homo sapiens
ctgaacaagaat

SEQ ID NO: 1400569 - DNA, 22 bp, Homo sapiens
ctgaacaccataggtagaatgt

SEQ ID NO: 1400570 - DNA, 19 bp, Homo sapiens
ctgaatccaaactaatcca

SEQ ID NO: 1400571 - DNA, 21 bp, Homo sapiens
ctgaatttttaaacaagtatt

SEQ ID NO: 1400572 - DNA, 22 bp, Homo sapiens
ctgaatttttaaacaagtattt

SEQ ID NO: 1400573 - DNA, 15 bp, Homo sapiens
ctgacattctgattc

SEQ ID NO: 1400574 - DNA, 13 bp, Homo sapiens
ctgacccctgctc

SEQ ID NO: 1400575 - DNA, 14 bp, Homo sapiens
ctgacccctgctca

SEQ ID NO: 1400576 - DNA, 16 bp, Homo sapiens
ctgacccctgctcagt

SEQ ID NO: 1400577 - DNA, 21 bp, Homo sapiens
ctgactagggagccatgtttc

SEQ ID NO: 1400578 - DNA, 14 bp, Homo sapiens
ctgagagaggccat

SEQ ID NO: 1400579 - DNA, 15 bp, Homo sapiens
ctgagatatgaacat

SEQ ID NO: 1400580 - DNA, 21 bp, Homo sapiens
ctgagatatgaacatattgtt

SEQ ID NO: 1400581 - DNA, 13 bp, Homo sapiens
ctgagctatttca

SEQ ID NO: 1400582 - DNA, 16 bp, Homo sapiens
ctgagctatttcatct

SEQ ID NO: 1400583 - DNA, 16 bp, Homo sapiens
ctgaggaatttcacct

SEQ ID NO: 1400584 - DNA, 15 bp, Homo sapiens
ctgagtcaagttgtt

SEQ ID NO: 1400585 - DNA, 23 bp, Homo sapiens
ctgagtcaccctacctgtgcctg

SEQ ID NO: 1400586 - DNA, 19 bp, Homo sapiens
ctgagtcgtacagaaagct

SEQ ID NO: 1400587 - DNA, 14 bp, Homo sapiens
ctgagttcctgcat

SEQ ID NO: 1400588 - DNA, 16 bp, Homo sapiens
ctgagttttccatggc

SEQ ID NO: 1400589 - DNA, 18 bp, Homo sapiens
ctgagttttccatggcag

SEQ ID NO: 1400590 - DNA, 21 bp, Homo sapiens
ctgataatatgtttgaggtta

SEQ ID NO: 1400591 - DNA, 22 bp, Homo sapiens
ctgatcagtgggcctccaagga

SEQ ID NO: 1400592 - DNA, 13 bp, Homo sapiens
ctgatgaaaataa

SEQ ID NO: 1400593 - DNA, 17 bp, Homo sapiens
ctgatgaaaataaagaa

SEQ ID NO: 1400594 - DNA, 19 bp, Homo sapiens
ctgatgaaaataaagaatg

SEQ ID NO: 1400595 - DNA, 19 bp, Homo sapiens
ctgatgaaaccttgaagtt

SEQ ID NO: 1400596 - DNA, 16 bp, Homo sapiens
cctttgaatcctctct

SEQ ID NO: 1400597 - DNA, 20 bp, Homo sapiens
cctttgaatcctctctctgt

SEQ ID NO: 1400598 - DNA, 12 bp, Homo sapiens
ccttttccatgc

SEQ ID NO: 1400599 - DNA, 22 bp, Homo sapiens
ccttttttaggaagcaagctta

SEQ ID NO: 1400600 - DNA, 13 bp, Homo sapiens
cgaagacacagac

SEQ ID NO: 1400601 - DNA, 21 bp, Homo sapiens
cgaagcgttgtcctcagcccc

SEQ ID NO: 1400602 - DNA, 13 bp, Homo sapiens
cgagatcccaaca

SEQ ID NO: 1400603 - DNA, 16 bp, Homo sapiens
cgattacacccaaata

SEQ ID NO: 1400604 - DNA, 18 bp, Homo sapiens
cgattagactggacagct

SEQ ID NO: 1400605 - DNA, 14 bp, Homo sapiens
cgatttgtcccagg

SEQ ID NO: 1400606 - DNA, 14 bp, Homo sapiens
cgcaagggcctgat

SEQ ID NO: 1400607 - DNA, 14 bp, Homo sapiens
cgcccaggacccca

SEQ ID NO: 1400608 - DNA, 16 bp, Homo sapiens
cgccctggactgtgtg

SEQ ID NO: 1400609 - DNA, 13 bp, Homo sapiens
cgctaaaagaaac

SEQ ID NO: 1400610 - DNA, 14 bp, Homo sapiens
cgctttcctgaatc

SEQ ID NO: 1400611 - DNA, 20 bp, Homo sapiens
cggcagcccctcccagccta

SEQ ID NO: 1400612 - DNA, 21 bp, Homo sapiens
cggcctccgtccaggagcctg

SEQ ID NO: 1400613 - DNA, 22 bp, Homo sapiens
cggcctccgtccaggagcctgg

SEQ ID NO: 1400614 - DNA, 14 bp, Homo sapiens
cggcctgccaggag

SEQ ID NO: 1400615 - DNA, 15 bp, Homo sapiens
cggcctgccaggagg

SEQ ID NO: 1400616 - DNA, 17 bp, Homo sapiens
cggcggcccctagcgct

SEQ ID NO: 1400617 - DNA, 20 bp, Homo sapiens
cggctcctcagggactcagg

SEQ ID NO: 1400618 - DNA, 22 bp, Homo sapiens
cggctgggaggagggcaggcat

SEQ ID NO: 1400619 - DNA, 20 bp, Homo sapiens
cgggaattttcatctaggat

SEQ ID NO: 1400620 - DNA, 17 bp, Homo sapiens
cggggcctgggcaggag

SEQ ID NO: 1400621 - DNA, 17 bp, Homo sapiens
cgggggcagtctgagag

SEQ ID NO: 1400622 - DNA, 20 bp, Homo sapiens
cggttcaggaaaattgaatg

SEQ ID NO: 1400623 - DNA, 23 bp, Homo sapiens
cgtagatattggacaaagaacct

SEQ ID NO: 1400624 - DNA, 21 bp, Homo sapiens
cgtcaaaacagattgtttgca

SEQ ID NO: 1400625 - DNA, 14 bp, Homo sapiens
cgtctcatgtaaaa

SEQ ID NO: 1400626 - DNA, 15 bp, Homo sapiens
cgtctcatgtaaaat

SEQ ID NO: 1400627 - DNA, 18 bp, Homo sapiens
cgtggtgcgagtgcgtga

SEQ ID NO: 1400628 - DNA, 13 bp, Homo sapiens
cgtggtggtccct

SEQ ID NO: 1400629 - DNA, 14 bp, Homo sapiens
cgtgtctggcacag

SEQ ID NO: 1400630 - DNA, 17 bp, Homo sapiens
cgtttaagccaaaacaa

SEQ ID NO: 1400631 - DNA, 22 bp, Homo sapiens
cgtttaagccaaaacaatgttt

SEQ ID NO: 1400632 - DNA, 11 bp, Homo sapiens
ctaaaaataaa

SEQ ID NO: 1400633 - DNA, 14 bp, Homo sapiens
ctaaaagaaacttt

SEQ ID NO: 1400634 - DNA, 16 bp, Homo sapiens
ctaaaataaagaaata

SEQ ID NO: 1400635 - DNA, 20 bp, Homo sapiens
ctaaactgagacaatgcctt

SEQ ID NO: 1400636 - DNA, 16 bp, Homo sapiens
ctaaagacaagtacat

SEQ ID NO: 1400637 - DNA, 18 bp, Homo sapiens
ctaaagacaagtacataa

SEQ ID NO: 1400638 - DNA, 11 bp, Homo sapiens
ctaaagccaaa

SEQ ID NO: 1400639 - DNA, 18 bp, Homo sapiens
ctaaagctggtttaatgt

SEQ ID NO: 1400640 - DNA, 17 bp, Homo sapiens
ctaaatacttttttcta

SEQ ID NO: 1400641 - DNA, 21 bp, Homo sapiens
ctaacctgccgagagtccatc

SEQ ID NO: 1400642 - DNA, 13 bp, Homo sapiens
ctaagagaagtag

SEQ ID NO: 1400643 - DNA, 17 bp, Homo sapiens
ctaagagaagtagaaat

SEQ ID NO: 1400644 - DNA, 14 bp, Homo sapiens
ctaagctaggaatg

SEQ ID NO: 1400645 - DNA, 22 bp, Homo sapiens
ctaagctaggaatgaaatcctg

SEQ ID NO: 1400646 - DNA, 16 bp, Homo sapiens
ctaaggaatatatatg

SEQ ID NO: 1400647 - DNA, 15 bp, Homo sapiens
ctaagttaatttaaa

SEQ ID NO: 1400648 - DNA, 12 bp, Homo sapiens
ctaataaagctg

SEQ ID NO: 1400649 - DNA, 20 bp, Homo sapiens
ctaatctctgtaaagctaaa

SEQ ID NO: 1400650 - DNA, 18 bp, Homo sapiens
ctaatcttattcattttc

SEQ ID NO: 1400651 - DNA, 21 bp, Homo sapiens
ctaatcttattcattttctct

SEQ ID NO: 1400652 - DNA, 16 bp, Homo sapiens
ctaatggcatgagaaa

SEQ ID NO: 1400653 - DNA, 22 bp, Homo sapiens
ctaattggcatgaaggtgtcat

SEQ ID NO: 1400654 - DNA, 12 bp, Homo sapiens
ctaatttataaa

SEQ ID NO: 1400655 - DNA, 18 bp, Homo sapiens
ctaatttttatttttgct

SEQ ID NO: 1400656 - DNA, 13 bp, Homo sapiens
ctaatttttgtat

SEQ ID NO: 1400657 - DNA, 21 bp, Homo sapiens
ctaatttttttgtattttagc

SEQ ID NO: 1400658 - DNA, 15 bp, Homo sapiens
ctacaaccaatggaa

SEQ ID NO: 1400659 - DNA, 13 bp, Homo sapiens
ctaccaagtgacc

SEQ ID NO: 1400660 - DNA, 13 bp, Homo sapiens
ctaccatttcaga

SEQ ID NO: 1400661 - DNA, 14 bp, Homo sapiens
ctaccccctgtgcc

SEQ ID NO: 1400662 - DNA, 22 bp, Homo sapiens
ctacctccaaagcttcccacgg

SEQ ID NO: 1400663 - DNA, 24 bp, Homo sapiens
ctacctggggaccccccttgccca

SEQ ID NO: 1400664 - DNA, 12 bp, Homo sapiens
ctacctgtgcct

SEQ ID NO: 1400665 - DNA, 15 bp, Homo sapiens
ctaccttctgacctc

SEQ ID NO: 1400666 - DNA, 16 bp, Homo sapiens
ctaccttctgacctcc

SEQ ID NO: 1400667 - DNA, 14 bp, Homo sapiens
ctactgaagccctt

SEQ ID NO: 1400668 - DNA, 15 bp, Homo sapiens
ctactgcccaggcac

SEQ ID NO: 1400669 - DNA, 22 bp, Homo sapiens
ctacttcttttgctcttagctg

SEQ ID NO: 1400670 - DNA, 14 bp, Homo sapiens
ctacttctttttct

SEQ ID NO: 1400671 - DNA, 20 bp, Homo sapiens
ctacttgatgtaactgagaa

SEQ ID NO: 1400672 - DNA, 19 bp, Homo sapiens
ctactttgataaagtaaaa

SEQ ID NO: 1400673 - DNA, 16 bp, Homo sapiens
ctagacaagccagaac

SEQ ID NO: 1400674 - DNA, 14 bp, Homo sapiens
ctagagcactgcca

SEQ ID NO: 1400675 - DNA, 19 bp, Homo sapiens
ctagaggcttccttcattt

SEQ ID NO: 1400676 - DNA, 21 bp, Homo sapiens
ctagaggcttccttcatttcc

SEQ ID NO: 1400677 - DNA, 19 bp, Homo sapiens
ctagaggtgagaaatttaa

SEQ ID NO: 1400678 - DNA, 24 bp, Homo sapiens
ctagagtgactcactaattcatta

SEQ ID NO: 1400679 - DNA, 17 bp, Homo sapiens
ctagagttagatatgtg

SEQ ID NO: 1400680 - DNA, 24 bp, Homo sapiens
ctagattgagagaagagacaaaca

SEQ ID NO: 1400681 - DNA, 17 bp, Homo sapiens
ctagccctcctttttcc

SEQ ID NO: 1400682 - DNA, 19 bp, Homo sapiens
ctagccctcctttttccaa

SEQ ID NO: 1400683 - DNA, 21 bp, Homo sapiens
catctagaggcttccttcatt

SEQ ID NO: 1400684 - DNA, 23 bp, Homo sapiens
catctagaggcttccttcatttc

SEQ ID NO: 1400685 - DNA, 12 bp, Homo sapiens
catctaggattt

SEQ ID NO: 1400686 - DNA, 23 bp, Homo sapiens
catctgagaaaagctttgaaccc

SEQ ID NO: 1400687 - DNA, 20 bp, Homo sapiens
catctggcaacatctttatc

SEQ ID NO: 1400688 - DNA, 20 bp, Homo sapiens
catgaacctcaagctgcatc

SEQ ID NO: 1400689 - DNA, 12 bp, Homo sapiens
catgagaatcta

SEQ ID NO: 1400690 - DNA, 14 bp, Homo sapiens
catgatcttggttt

SEQ ID NO: 1400691 - DNA, 23 bp, Homo sapiens
catgatgcctctgtcttctggac

SEQ ID NO: 1400692 - DNA, 13 bp, Homo sapiens
catgattcatttt

SEQ ID NO: 1400693 - DNA, 19 bp, Homo sapiens
catgcacacaaacacctcc

SEQ ID NO: 1400694 - DNA, 20 bp, Homo sapiens
catgcacacaaacacctcct

SEQ ID NO: 1400695 - DNA, 16 bp, Homo sapiens
catgcaccctcataca

SEQ ID NO: 1400696 - DNA, 18 bp, Homo sapiens
catgcatgtcctgtaaag

SEQ ID NO: 1400697 - DNA, 15 bp, Homo sapiens
catgcattactgcat

SEQ ID NO: 1400698 - DNA, 17 bp, Homo sapiens
catgcattactgcatgc

SEQ ID NO: 1400699 - DNA, 20 bp, Homo sapiens
catgcattactgcatgcact

SEQ ID NO: 1400700 - DNA, 16 bp, Homo sapiens
catgcgtgtttctgac

SEQ ID NO: 1400701 - DNA, 16 bp, Homo sapiens
catgctaagagaagta

SEQ ID NO: 1400702 - DNA, 19 bp, Homo sapiens
catgctgaaggctgaaaga

SEQ ID NO: 1400703 - DNA, 17 bp, Homo sapiens
catggagattctcataa

SEQ ID NO: 1400704 - DNA, 14 bp, Homo sapiens
catggctaactggc

SEQ ID NO: 1400705 - DNA, 15 bp, Homo sapiens
catggctattttata

SEQ ID NO: 1400706 - DNA, 17 bp, Homo sapiens
catggctattttatatt

SEQ ID NO: 1400707 - DNA, 20 bp, Homo sapiens
catgggtatagttcatgtct

SEQ ID NO: 1400708 - DNA, 15 bp, Homo sapiens
catgtatttggtgat

SEQ ID NO: 1400709 - DNA, 14 bp, Homo sapiens
catgtcaaacaaat

SEQ ID NO: 1400710 - DNA, 15 bp, Homo sapiens
catgtcctgtaaagg

SEQ ID NO: 1400711 - DNA, 14 bp, Homo sapiens
catgtgactctttc

SEQ ID NO: 1400712 - DNA, 17 bp, Homo sapiens
catgtgactctttccaa

SEQ ID NO: 1400713 - DNA, 21 bp, Homo sapiens
catgttggatagtcagctgta

SEQ ID NO: 1400714 - DNA, 21 bp, Homo sapiens
catgtttgcacctttctagtt

SEQ ID NO: 1400715 - DNA, 22 bp, Homo sapiens
cattaaaaatgcatatacttta

SEQ ID NO: 1400716 - DNA, 12 bp, Homo sapiens
cattaatctgcc

SEQ ID NO: 1400717 - DNA, 20 bp, Homo sapiens
cattagactggaacttgaac

SEQ ID NO: 1400718 - DNA, 22 bp, Homo sapiens
cattattcgtagatattggaca

SEQ ID NO: 1400719 - DNA, 18 bp, Homo sapiens
cattattggaatataatt

SEQ ID NO: 1400720 - DNA, 11 bp, Homo sapiens
cattcacttca

SEQ ID NO: 1400721 - DNA, 14 bp, Homo sapiens
cattcacttcataa

SEQ ID NO: 1400722 - DNA, 18 bp, Homo sapiens
cattcagaagaaaaagaa

SEQ ID NO: 1400723 - DNA, 15 bp, Homo sapiens
cattctgtcttgaag

SEQ ID NO: 1400724 - DNA, 14 bp, Homo sapiens
cattgtctttttag

SEQ ID NO: 1400725 - DNA, 14 bp, Homo sapiens
cattgttaatataa

SEQ ID NO: 1400726 - DNA, 22 bp, Homo sapiens
cattgttaatataatttaacag

SEQ ID NO: 1400727 - DNA, 13 bp, Homo sapiens
catttaaaacaga

SEQ ID NO: 1400728 - DNA, 17 bp, Homo sapiens
catttaaaacagacact

SEQ ID NO: 1400729 - DNA, 14 bp, Homo sapiens
catttatattgata

SEQ ID NO: 1400730 - DNA, 21 bp, Homo sapiens
catttatattgataagatctt

SEQ ID NO: 1400731 - DNA, 14 bp, Homo sapiens
catttattttgaca

SEQ ID NO: 1400732 - DNA, 16 bp, Homo sapiens
catttgctttttcacc

SEQ ID NO: 1400733 - DNA, 18 bp, Homo sapiens
catttggcatccctgggc

SEQ ID NO: 1400734 - DNA, 16 bp, Homo sapiens
catttgttggaatgaa

SEQ ID NO: 1400735 - DNA, 23 bp, Homo sapiens
cattttctaagaaacatttatat

SEQ ID NO: 1400736 - DNA, 14 bp, Homo sapiens
cattttggtacttt

SEQ ID NO: 1400737 - DNA, 16 bp, Homo sapiens
catttttccgtaaaaa

SEQ ID NO: 1400738 - DNA, 19 bp, Homo sapiens
ccaaaaaaaaatacatgct

SEQ ID NO: 1400739 - DNA, 13 bp, Homo sapiens
ccaaaaatagcta

SEQ ID NO: 1400740 - DNA, 23 bp, Homo sapiens
ccaaaagattgctgaaattttat

SEQ ID NO: 1400741 - DNA, 15 bp, Homo sapiens
ccaaaagctttttat

SEQ ID NO: 1400742 - DNA, 17 bp, Homo sapiens
ccaaaagttacatgttt

SEQ ID NO: 1400743 - DNA, 20 bp, Homo sapiens
ccaaaatgttggtcatttta

SEQ ID NO: 1400744 - DNA, 16 bp, Homo sapiens
ccaaacaggctcagag

SEQ ID NO: 1400745 - DNA, 15 bp, Homo sapiens
ccaaaccccggggct

SEQ ID NO: 1400746 - DNA, 14 bp, Homo sapiens
ccaaactaattttt

SEQ ID NO: 1400747 - DNA, 20 bp, Homo sapiens
ccaaatccttagatctggca

SEQ ID NO: 1400748 - DNA, 13 bp, Homo sapiens
ccaacactgccag

SEQ ID NO: 1400749 - DNA, 14 bp, Homo sapiens
ccaacactgccagc

SEQ ID NO: 1400750 - DNA, 16 bp, Homo sapiens
ccaacactgccagcat

SEQ ID NO: 1400751 - DNA, 17 bp, Homo sapiens
ccaaccatttcctcaga

SEQ ID NO: 1400752 - DNA, 11 bp, Homo sapiens
ccaagaatctt

SEQ ID NO: 1400753 - DNA, 21 bp, Homo sapiens
ccaagactgctgtggccagga

SEQ ID NO: 1400754 - DNA, 22 bp, Homo sapiens
ccaagactgctgtggccaggag

SEQ ID NO: 1400755 - DNA, 22 bp, Homo sapiens
ccaagagctacgtatttaatag

SEQ ID NO: 1400756 - DNA, 20 bp, Homo sapiens
ccaagcagttgggactacag

SEQ ID NO: 1400757 - DNA, 18 bp, Homo sapiens
ccaagctgttttcttcta

SEQ ID NO: 1400758 - DNA, 19 bp, Homo sapiens
ccaaggagtcactgagacc

SEQ ID NO: 1400759 - DNA, 22 bp, Homo sapiens
ccaagtagaatctcagttgatt

SEQ ID NO: 1400760 - DNA, 9 bp, Homo sapiens
ccaataaaa

SEQ ID NO: 1400761 - DNA, 17 bp, Homo sapiens
ccaataaaaagttcaga

SEQ ID NO: 1400762 - DNA, 22 bp, Homo sapiens
ccaatagggctgagctctctgt

SEQ ID NO: 1400763 - DNA, 15 bp, Homo sapiens
ccaattaaaattaag

SEQ ID NO: 1400764 - DNA, 19 bp, Homo sapiens
ccaatttcaagttccaagt

SEQ ID NO: 1400765 - DNA, 15 bp, Homo sapiens
ccacaactattttca

SEQ ID NO: 1400766 - DNA, 11 bp, Homo sapiens
ccacactcaga

SEQ ID NO: 1400767 - DNA, 17 bp, Homo sapiens
ccaccatttggcatccc

SEQ ID NO: 1400768 - DNA, 23 bp, Homo sapiens
ccacccacaatcacaagaagatt

SEQ ID NO: 1400769 - DNA, 18 bp, Homo sapiens
ccaccccatccagttcat

SEQ ID NO: 1400770 - DNA, 19 bp, Homo sapiens
ccacctgaggctcagccct

SEQ ID NO: 1400771 - DNA, 22 bp, Homo sapiens
ccactaccttctgacctcccca

SEQ ID NO: 1400772 - DNA, 22 bp, Homo sapiens
ccactcatgtgactctttccaa

SEQ ID NO: 1400773 - DNA, 19 bp, Homo sapiens
ccactgctgatattttctc

SEQ ID NO: 1400774 - DNA, 20 bp, Homo sapiens
ccactgtacttgctcttgat

SEQ ID NO: 1400775 - DNA, 16 bp, Homo sapiens
ccactgtggaaaatgc

SEQ ID NO: 1400776 - DNA, 20 bp, Homo sapiens
ccactttgcacagctctccg

SEQ ID NO: 1400777 - DNA, 13 bp, Homo sapiens
ccagaaaacaaaa

SEQ ID NO: 1400778 - DNA, 16 bp, Homo sapiens
ccagaaaacaaaactg

SEQ ID NO: 1400779 - DNA, 15 bp, Homo sapiens
ccagaaccacactgt

SEQ ID NO: 1400780 - DNA, 17 bp, Homo sapiens
ccagaaccacactgttg

SEQ ID NO: 1400781 - DNA, 20 bp, Homo sapiens
ccagaacttgaccctgagct

SEQ ID NO: 1400782 - DNA, 17 bp, Homo sapiens
cagtgtatggaaataaa

SEQ ID NO: 1400783 - DNA, 16 bp, Homo sapiens
cagttacctccaaaaa

SEQ ID NO: 1400784 - DNA, 16 bp, Homo sapiens
cagttgagacaagaaa

SEQ ID NO: 1400785 - DNA, 18 bp, Homo sapiens
cagttgagacaagaaaat

SEQ ID NO: 1400786 - DNA, 22 bp, Homo sapiens
cagttggagttttttgtaccaa

SEQ ID NO: 1400787 - DNA, 17 bp, Homo sapiens
cagtttatatttaactc

SEQ ID NO: 1400788 - DNA, 19 bp, Homo sapiens
cagttttcctatgctttga

SEQ ID NO: 1400789 - DNA, 11 bp, Homo sapiens
cataaattatt

SEQ ID NO: 1400790 - DNA, 11 bp, Homo sapiens
cataactgaaa

SEQ ID NO: 1400791 - DNA, 13 bp, Homo sapiens
cataatcttctgc

SEQ ID NO: 1400792 - DNA, 14 bp, Homo sapiens
cataattcactctg

SEQ ID NO: 1400793 - DNA, 23 bp, Homo sapiens
catacacttattggaactctgct

SEQ ID NO: 1400794 - DNA, 14 bp, Homo sapiens
catatatatactat

SEQ ID NO: 1400795 - DNA, 16 bp, Homo sapiens
catattgtaaaacagg

SEQ ID NO: 1400796 - DNA, 16 bp, Homo sapiens
catattgttgaaaggt

SEQ ID NO: 1400797 - DNA, 14 bp, Homo sapiens
catcaactgaatga

SEQ ID NO: 1400798 - DNA, 12 bp, Homo sapiens
catcacagaatg

SEQ ID NO: 1400799 - DNA, 16 bp, Homo sapiens
catcactgagttttcc

SEQ ID NO: 1400800 - DNA, 14 bp, Homo sapiens
catcacttgtacaa

SEQ ID NO: 1400801 - DNA, 19 bp, Homo sapiens
catcacttgtacaaaataa

SEQ ID NO: 1400802 - DNA, 17 bp, Homo sapiens
catccagagtccctgcc

SEQ ID NO: 1400803 - DNA, 21 bp, Homo sapiens
catccagagtccctgcctgga

SEQ ID NO: 1400804 - DNA, 19 bp, Homo sapiens
catccccttgaactcttca

SEQ ID NO: 1400805 - DNA, 12 bp, Homo sapiens
catccctggccc

SEQ ID NO: 1400806 - DNA, 21 bp, Homo sapiens
catccctggccccctccctgg

SEQ ID NO: 1400807 - DNA, 22 bp, Homo sapiens
catccctgggccttgggctccg

SEQ ID NO: 1400808 - DNA, 19 bp, Homo sapiens
catcctaccccctgtgcct

SEQ ID NO: 1400809 - DNA, 19 bp, Homo sapiens
catctagaggcttccttca

SEQ ID NO: 1400810 - DNA, 20 bp, Homo sapiens
catctagaggcttccttcat

SEQ ID NO: 1400811 - DNA, 13 bp, Homo sapiens
attactgccattc

SEQ ID NO: 1400812 - DNA, 15 bp, Homo sapiens
attagactggaactt

SEQ ID NO: 1400813 - DNA, 22 bp, Homo sapiens
attagactggaacttgaactga

SEQ ID NO: 1400814 - DNA, 14 bp, Homo sapiens
attagactggacag

SEQ ID NO: 1400815 - DNA, 20 bp, Homo sapiens
attagactggacagcttgtg

SEQ ID NO: 1400816 - DNA, 17 bp, Homo sapiens
attagccagtgaaaaac

SEQ ID NO: 1400817 - DNA, 14 bp, Homo sapiens
attaggcagactct

SEQ ID NO: 1400818 - DNA, 21 bp, Homo sapiens
attaggcagactctttatgct

SEQ ID NO: 1400819 - DNA, 14 bp, Homo sapiens
attataaaaatgaa

SEQ ID NO: 1400820 - DNA, 15 bp, Homo sapiens
attataaaaatgaat

SEQ ID NO: 1400821 - DNA, 13 bp, Homo sapiens
attatctaattta

SEQ ID NO: 1400822 - DNA, 23 bp, Homo sapiens
attattaacatacctaagaagta

SEQ ID NO: 1400823 - DNA, 19 bp, Homo sapiens
attattgagtctgtccaga

SEQ ID NO: 1400824 - DNA, 12 bp, Homo sapiens
attattttgtga

SEQ ID NO: 1400825 - DNA, 12 bp, Homo sapiens
attcaacaaaca

SEQ ID NO: 1400826 - DNA, 18 bp, Homo sapiens
attcaatctgtaaactgt

SEQ ID NO: 1400827 - DNA, 22 bp, Homo sapiens
attcaatctgtaaactgtgtat

SEQ ID NO: 1400828 - DNA, 16 bp, Homo sapiens
attcaattcaaagctg

SEQ ID NO: 1400829 - DNA, 16 bp, Homo sapiens
attcagaagaaaaaga

SEQ ID NO: 1400830 - DNA, 14 bp, Homo sapiens
attcagacagatga

SEQ ID NO: 1400831 - DNA, 13 bp, Homo sapiens
attcatgactatg

SEQ ID NO: 1400832 - DNA, 17 bp, Homo sapiens
attcattcttaacaaga

SEQ ID NO: 1400833 - DNA, 15 bp, Homo sapiens
attccccattcttcc

SEQ ID NO: 1400834 - DNA, 16 bp, Homo sapiens
attcctcctgctcata

SEQ ID NO: 1400835 - DNA, 16 bp, Homo sapiens
attctaaaatgattgt

SEQ ID NO: 1400836 - DNA, 15 bp, Homo sapiens
attctaaaatgcctt

SEQ ID NO: 1400837 - DNA, 23 bp, Homo sapiens
attctccagccatcaagagactg

SEQ ID NO: 1400838 - DNA, 13 bp, Homo sapiens
attctgaggcctg

SEQ ID NO: 1400839 - DNA, 20 bp, Homo sapiens
attctgattcgaatgacact

SEQ ID NO: 1400840 - DNA, 21 bp, Homo sapiens
attctgattcgaatgacactg

SEQ ID NO: 1400841 - DNA, 22 bp, Homo sapiens
attctggacaggatgtgtttgc

SEQ ID NO: 1400842 - DNA, 23 bp, Homo sapiens
attcttaacaagatatttatatg

SEQ ID NO: 1400843 - DNA, 14 bp, Homo sapiens
attcttccatctga

SEQ ID NO: 1400844 - DNA, 23 bp, Homo sapiens
attcttccatctgattgtgatgt

SEQ ID NO: 1400845 - DNA, 16 bp, Homo sapiens
attctttcccaacacc

SEQ ID NO: 1400846 - DNA, 21 bp, Homo sapiens
attgaagctttactttagaat

SEQ ID NO: 1400847 - DNA, 19 bp, Homo sapiens
attgaaggcttaaacccat

SEQ ID NO: 1400848 - DNA, 19 bp, Homo sapiens
attgaagtattttgctgga

SEQ ID NO: 1400849 - DNA, 22 bp, Homo sapiens
attgaatggctatgtttttaat

SEQ ID NO: 1400850 - DNA, 13 bp, Homo sapiens
attgaattatctt

SEQ ID NO: 1400851 - DNA, 17 bp, Homo sapiens
attgacaacagttacat

SEQ ID NO: 1400852 - DNA, 12 bp, Homo sapiens
attgattttgaa

SEQ ID NO: 1400853 - DNA, 15 bp, Homo sapiens
attgcctcacttcag

SEQ ID NO: 1400854 - DNA, 16 bp, Homo sapiens
attggacatggtctcc

SEQ ID NO: 1400855 - DNA, 19 bp, Homo sapiens
attggacatggtctcctct

SEQ ID NO: 1400856 - DNA, 19 bp, Homo sapiens
attggagagaaaaaattaa

SEQ ID NO: 1400857 - DNA, 21 bp, Homo sapiens
attgggagcttgggaatggat

SEQ ID NO: 1400858 - DNA, 23 bp, Homo sapiens
attggggaagagagcctgcagga

SEQ ID NO: 1400859 - DNA, 13 bp, Homo sapiens
attggtaaacatt

SEQ ID NO: 1400860 - DNA, 14 bp, Homo sapiens
attgtaaaacaggt

SEQ ID NO: 1400861 - DNA, 14 bp, Homo sapiens
attgtaaatattgt

SEQ ID NO: 1400862 - DNA, 18 bp, Homo sapiens
attgtaaatgaacataat

SEQ ID NO: 1400863 - DNA, 13 bp, Homo sapiens
attgtagtaatct

SEQ ID NO: 1400864 - DNA, 16 bp, Homo sapiens
attgtcttaatattgt

SEQ ID NO: 1400865 - DNA, 15 bp, Homo sapiens
attgtgcaatgtaaa

SEQ ID NO: 1400866 - DNA, 21 bp, Homo sapiens
attgtgccatgtcaaacaaat

SEQ ID NO: 1400867 - DNA, 22 bp, Homo sapiens
attgtgccatgtcaaacaaata

SEQ ID NO: 1400868 - DNA, 15 bp, Homo sapiens
attgtgttcccattt

SEQ ID NO: 1400869 - DNA, 19 bp, Homo sapiens
attgttttatctgaatttt

SEQ ID NO: 1400870 - DNA, 13 bp, Homo sapiens
atttaaaaaacta

SEQ ID NO: 1400871 - DNA, 17 bp, Homo sapiens
atttaaaacagacactg

SEQ ID NO: 1400872 - DNA, 19 bp, Homo sapiens
atttaaacaaatgtgtaat

SEQ ID NO: 1400873 - DNA, 17 bp, Homo sapiens
atttaacagaagttgtg

SEQ ID NO: 1400874 - DNA, 14 bp, Homo sapiens
atttaataatcaga

SEQ ID NO: 1400875 - DNA, 13 bp, Homo sapiens
atttagaaaactt

SEQ ID NO: 1400876 - DNA, 17 bp, Homo sapiens
atttagaaaactttaaa

SEQ ID NO: 1400877 - DNA, 14 bp, Homo sapiens
atttagatttgtgt

SEQ ID NO: 1400878 - DNA, 20 bp, Homo sapiens
atttatattgataagatctt

SEQ ID NO: 1400879 - DNA, 20 bp, Homo sapiens
atttatattgtaaatattgt

SEQ ID NO: 1400880 - DNA, 17 bp, Homo sapiens
atttatcccaaatcctg

SEQ ID NO: 1400881 - DNA, 19 bp, Homo sapiens
atttatcctgaaatttcag

SEQ ID NO: 1400882 - DNA, 17 bp, Homo sapiens
atttatcgcagaccttt

SEQ ID NO: 1400883 - DNA, 23 bp, Homo sapiens
atttatgaattgaattatcttgg

SEQ ID NO: 1400884 - DNA, 21 bp, Homo sapiens
atttatgactccactgtggaa

SEQ ID NO: 1400885 - DNA, 14 bp, Homo sapiens
atttatttaaaata

SEQ ID NO: 1400886 - DNA, 20 bp, Homo sapiens
atttatttaaacaaatgtgt

SEQ ID NO: 1400887 - DNA, 21 bp, Homo sapiens
atttatttaaacaaatgtgta

SEQ ID NO: 1400888 - DNA, 21 bp, Homo sapiens
atttattttgacataaagttg

SEQ ID NO: 1400889 - DNA, 11 bp, Homo sapiens
atttcaagttc

SEQ ID NO: 1400890 - DNA, 19 bp, Homo sapiens
atttcacaacagcctgaca

SEQ ID NO: 1400891 - DNA, 14 bp, Homo sapiens
atttcacctgtaaa

SEQ ID NO: 1400892 - DNA, 15 bp, Homo sapiens
atttcacctgtaaac

SEQ ID NO: 1400893 - DNA, 18 bp, Homo sapiens
atttcacctgtaaacctg

SEQ ID NO: 1400894 - DNA, 19 bp, Homo sapiens
atttcacctgtaaacctga

SEQ ID NO: 1400895 - DNA, 19 bp, Homo sapiens
atttccttttttgttatta

SEQ ID NO: 1400896 - DNA, 17 bp, Homo sapiens
atttgagagaaatatga

SEQ ID NO: 1400897 - DNA, 13 bp, Homo sapiens
atttgcctgtaac

SEQ ID NO: 1400898 - DNA, 20 bp, Homo sapiens
atttggcatccctgggcctt

SEQ ID NO: 1400899 - DNA, 21 bp, Homo sapiens
atttgtacatagttatttatt

SEQ ID NO: 1400900 - DNA, 17 bp, Homo sapiens
atttgtgacaaaaaatt

SEQ ID NO: 1400901 - DNA, 19 bp, Homo sapiens
atttgtgcccccaaccatt

SEQ ID NO: 1400902 - DNA, 14 bp, Homo sapiens
atttgttggaatga

SEQ ID NO: 1400903 - DNA, 21 bp, Homo sapiens
atttgttgtgactggcaccca

SEQ ID NO: 1400904 - DNA, 17 bp, Homo sapiens
atttgtttaaaaagtaa

SEQ ID NO: 1400905 - DNA, 22 bp, Homo sapiens
attttaaacaaaggttgagatg

SEQ ID NO: 1400906 - DNA, 23 bp, Homo sapiens
attttaaacacattaggaaaagt

SEQ ID NO: 1400907 - DNA, 18 bp, Homo sapiens
attttatatgcttactga

SEQ ID NO: 1400908 - DNA, 15 bp, Homo sapiens
attttatattacact

SEQ ID NO: 1400909 - DNA, 17 bp, Homo sapiens
attttcaagaaactgag

SEQ ID NO: 1400910 - DNA, 23 bp, Homo sapiens
attttcaagaaactgaggaattt

SEQ ID NO: 1400911 - DNA, 22 bp, Homo sapiens
attttcctggtgccaatttcaa

SEQ ID NO: 1400912 - DNA, 23 bp, Homo sapiens
attttcctggtgccaatttcaag

SEQ ID NO: 1400913 - DNA, 21 bp, Homo sapiens
attttctacctggtctctcct

SEQ ID NO: 1400914 - DNA, 22 bp, Homo sapiens
attttctggaatacatgaaata

SEQ ID NO: 1400915 - DNA, 16 bp, Homo sapiens
attttctgtgcctgaa

SEQ ID NO: 1400916 - DNA, 21 bp, Homo sapiens
attttctgtgcctgaatattt

SEQ ID NO: 1400917 - DNA, 10 bp, Homo sapiens
attttgtaaa

SEQ ID NO: 1400918 - DNA, 19 bp, Homo sapiens
attttgtaaactcaaaata

SEQ ID NO: 1400919 - DNA, 17 bp, Homo sapiens
attttgtgatgcaaata

SEQ ID NO: 1400920 - DNA, 15 bp, Homo sapiens
attttgttagatttt

SEQ ID NO: 1400921 - DNA, 15 bp, Homo sapiens
atttttaaacaagta

SEQ ID NO: 1400922 - DNA, 12 bp, Homo sapiens
atttttgcctct

SEQ ID NO: 1400923 - DNA, 19 bp, Homo sapiens
atttttggcagtctgaatt

SEQ ID NO: 1400924 - DNA, 20 bp, Homo sapiens
attttttccttcaaagttta

SEQ ID NO: 1400925 - DNA, 23 bp, Homo sapiens
attttttccttcaaagtttaata

SEQ ID NO: 1400926 - DNA, 21 bp, Homo sapiens
atttttttttcatacacttat

SEQ ID NO: 1400927 - DNA, 18 bp, Homo sapiens
attttttttttaaaacta

SEQ ID NO: 1400928 - DNA, 15 bp, Homo sapiens
caaaaaattaaagca

SEQ ID NO: 1400929 - DNA, 13 bp, Homo sapiens
cactggggcaggg

SEQ ID NO: 1400930 - DNA, 15 bp, Homo sapiens
cactggggcaggggc

SEQ ID NO: 1400931 - DNA, 15 bp, Homo sapiens
cactgtaaacccctg

SEQ ID NO: 1400932 - DNA, 18 bp, Homo sapiens
cactgtaaacccctgggt

SEQ ID NO: 1400933 - DNA, 18 bp, Homo sapiens
cactgtacttgctcttga

SEQ ID NO: 1400934 - DNA, 22 bp, Homo sapiens
cactgtataccccgtgaagcat

SEQ ID NO: 1400935 - DNA, 20 bp, Homo sapiens
cacttcaggtatacctcact

SEQ ID NO: 1400936 - DNA, 15 bp, Homo sapiens
cacttcataatccag

SEQ ID NO: 1400937 - DNA, 23 bp, Homo sapiens
cacttggctgcataaatgtggta

SEQ ID NO: 1400938 - DNA, 15 bp, Homo sapiens
cacttggtaattgta

SEQ ID NO: 1400939 - DNA, 19 bp, Homo sapiens
cactttctcagttttcata

SEQ ID NO: 1400940 - DNA, 18 bp, Homo sapiens
cagaaaaatatgtaccaa

SEQ ID NO: 1400941 - DNA, 18 bp, Homo sapiens
cagaaacaaaaacactaa

SEQ ID NO: 1400942 - DNA, 15 bp, Homo sapiens
cagaaagctgcctgg

SEQ ID NO: 1400943 - DNA, 19 bp, Homo sapiens
cagaacatagacagaagaa

SEQ ID NO: 1400944 - DNA, 23 bp, Homo sapiens
cagaacccctacatgaaacagaa

SEQ ID NO: 1400945 - DNA, 21 bp, Homo sapiens
cagaagcagggtaccctttgg

SEQ ID NO: 1400946 - DNA, 23 bp, Homo sapiens
cagaaggttgctctagattgaga

SEQ ID NO: 1400947 - DNA, 17 bp, Homo sapiens
cagaagttgtgaaacta

SEQ ID NO: 1400948 - DNA, 18 bp, Homo sapiens
cagaagttgtgaaactaa

SEQ ID NO: 1400949 - DNA, 18 bp, Homo sapiens
cagaagtttgcactatct

SEQ ID NO: 1400950 - DNA, 14 bp, Homo sapiens
cagaatgtatatta

SEQ ID NO: 1400951 - DNA, 16 bp, Homo sapiens
atcctgtattcagaca

SEQ ID NO: 1400952 - DNA, 17 bp, Homo sapiens
atcctgtctgaaaagga

SEQ ID NO: 1400953 - DNA, 22 bp, Homo sapiens
atcgatgggaagggtagaaaac

SEQ ID NO: 1400954 - DNA, 16 bp, Homo sapiens
atcggggagccgggag

SEQ ID NO: 1400955 - DNA, 21 bp, Homo sapiens
atcgtctcatgtaaaataaga

SEQ ID NO: 1400956 - DNA, 17 bp, Homo sapiens
atctaagttaatttaaa

SEQ ID NO: 1400957 - DNA, 18 bp, Homo sapiens
atctaagttaatttaaag

SEQ ID NO: 1400958 - DNA, 23 bp, Homo sapiens
atctaatttataaaaaggtgttt

SEQ ID NO: 1400959 - DNA, 13 bp, Homo sapiens
atctacttccaaa

SEQ ID NO: 1400960 - DNA, 19 bp, Homo sapiens
atctaggattttaagggaa

SEQ ID NO: 1400961 - DNA, 18 bp, Homo sapiens
atctaggcaacatagtat

SEQ ID NO: 1400962 - DNA, 16 bp, Homo sapiens
atctatgcattttctg

SEQ ID NO: 1400963 - DNA, 15 bp, Homo sapiens
atctcaccaggcagc

SEQ ID NO: 1400964 - DNA, 14 bp, Homo sapiens
atctcaggccagag

SEQ ID NO: 1400965 - DNA, 14 bp, Homo sapiens
atctcagtgaagaa

SEQ ID NO: 1400966 - DNA, 21 bp, Homo sapiens
atctcagttgattttctggat

SEQ ID NO: 1400967 - DNA, 19 bp, Homo sapiens
atctccctgcctcctgccg

SEQ ID NO: 1400968 - DNA, 15 bp, Homo sapiens
atctctgtgtgcaca

SEQ ID NO: 1400969 - DNA, 17 bp, Homo sapiens
atctctgtgtgcacaaa

SEQ ID NO: 1400970 - DNA, 14 bp, Homo sapiens
atctgaatttttaa

SEQ ID NO: 1400971 - DNA, 22 bp, Homo sapiens
atctgatagggtttgtgacagg

SEQ ID NO: 1400972 - DNA, 18 bp, Homo sapiens
atctggctcctgtttcca

SEQ ID NO: 1400973 - DNA, 22 bp, Homo sapiens
atctggcttctggccaggaagc

SEQ ID NO: 1400974 - DNA, 13 bp, Homo sapiens
atctgtaaactgt

SEQ ID NO: 1400975 - DNA, 14 bp, Homo sapiens
atctgtaaactgtg

SEQ ID NO: 1400976 - DNA, 14 bp, Homo sapiens
atctgtttttctaa

SEQ ID NO: 1400977 - DNA, 13 bp, Homo sapiens
atcttattcattt

SEQ ID NO: 1400978 - DNA, 20 bp, Homo sapiens
atcttcttatgcaatttcct

SEQ ID NO: 1400979 - DNA, 14 bp, Homo sapiens
atcttggtttgcct

SEQ ID NO: 1400980 - DNA, 20 bp, Homo sapiens
atcttggtttgccttccaga

SEQ ID NO: 1400981 - DNA, 21 bp, Homo sapiens
atctttaaaagatgcttttaa

SEQ ID NO: 1400982 - DNA, 11 bp, Homo sapiens
atctttcctcc

SEQ ID NO: 1400983 - DNA, 19 bp, Homo sapiens
atctttcctccaaactcct

SEQ ID NO: 1400984 - DNA, 21 bp, Homo sapiens
atctttcctccaaactcctgc

SEQ ID NO: 1400985 - DNA, 14 bp, Homo sapiens
atcttttaatatgc

SEQ ID NO: 1400986 - DNA, 13 bp, Homo sapiens
atctttttcctcc

SEQ ID NO: 1400987 - DNA, 13 bp, Homo sapiens
atgaaacagaaac

SEQ ID NO: 1400988 - DNA, 18 bp, Homo sapiens
atgaaacagaaacaaaaa

SEQ ID NO: 1400989 - DNA, 22 bp, Homo sapiens
atgaaacagaaacaaaaacact

SEQ ID NO: 1400990 - DNA, 16 bp, Homo sapiens
atgaacagaacataga

SEQ ID NO: 1400991 - DNA, 21 bp, Homo sapiens
atgaacagaacatagacagaa

SEQ ID NO: 1400992 - DNA, 13 bp, Homo sapiens
atgaacataatga

SEQ ID NO: 1400993 - DNA, 15 bp, Homo sapiens
atgaattgggaacat

SEQ ID NO: 1400994 - DNA, 16 bp, Homo sapiens
atgacactgttcagga

SEQ ID NO: 1400995 - DNA, 21 bp, Homo sapiens
atgacagtccgtcaaaacaga

SEQ ID NO: 1400996 - DNA, 18 bp, Homo sapiens
atgacatcacttgtacaa

SEQ ID NO: 1400997 - DNA, 20 bp, Homo sapiens
atgacatcacttgtacaaaa

SEQ ID NO: 1400998 - DNA, 13 bp, Homo sapiens
atgaccaggacta

SEQ ID NO: 1400999 - DNA, 18 bp, Homo sapiens
atgacctagttttccatg

SEQ ID NO: 1401000 - DNA, 22 bp, Homo sapiens
atgactgtttttcggacagttt

SEQ ID NO: 1401001 - DNA, 15 bp, Homo sapiens
atgagaaagccttct

SEQ ID NO: 1401002 - DNA, 22 bp, Homo sapiens
atgagaaatacaaaaatactca

SEQ ID NO: 1401003 - DNA, 14 bp, Homo sapiens
atgagggaaaagaa

SEQ ID NO: 1401004 - DNA, 22 bp, Homo sapiens
atgagtgcgtggtgcgagtgcg

SEQ ID NO: 1401005 - DNA, 16 bp, Homo sapiens
atgatgggtgttttta

SEQ ID NO: 1401006 - DNA, 21 bp, Homo sapiens
atgatgttaaaaaaataagaa

SEQ ID NO: 1401007 - DNA, 17 bp, Homo sapiens
atgcaatttcctttttt

SEQ ID NO: 1401008 - DNA, 22 bp, Homo sapiens
atgcacacaaacacctcctagc

SEQ ID NO: 1401009 - DNA, 15 bp, Homo sapiens
atgcacctaaagaaa

SEQ ID NO: 1401010 - DNA, 12 bp, Homo sapiens
atgcagaatgtt

SEQ ID NO: 1401011 - DNA, 21 bp, Homo sapiens
atgcagaatgttgattacagt

SEQ ID NO: 1401012 - DNA, 21 bp, Homo sapiens
atgcattataggatcatttgt

SEQ ID NO: 1401013 - DNA, 15 bp, Homo sapiens
atgcatttgggtcca

SEQ ID NO: 1401014 - DNA, 18 bp, Homo sapiens
atgcatttgggtccagga

SEQ ID NO: 1401015 - DNA, 20 bp, Homo sapiens
atgcatttgggtccaggagg

SEQ ID NO: 1401016 - DNA, 19 bp, Homo sapiens
atgccaaaaaaaaatacat

SEQ ID NO: 1401017 - DNA, 22 bp, Homo sapiens
atgccaattagcaattgactgt

SEQ ID NO: 1401018 - DNA, 19 bp, Homo sapiens
atgcctctgtcttctggac

SEQ ID NO: 1401019 - DNA, 16 bp, Homo sapiens
atgcgtgtttctgact

SEQ ID NO: 1401020 - DNA, 17 bp, Homo sapiens
atgctaagagaagtaga

SEQ ID NO: 1401021 - DNA, 18 bp, Homo sapiens
atgctaagagaagtagaa

SEQ ID NO: 1401022 - DNA, 22 bp, Homo sapiens
atgctatcaaataactaaggaa

SEQ ID NO: 1401023 - DNA, 21 bp, Homo sapiens
atgctgagattacaggtgtga

SEQ ID NO: 1401024 - DNA, 23 bp, Homo sapiens
atgctgtgacacatggcccctcc

SEQ ID NO: 1401025 - DNA, 15 bp, Homo sapiens
atgcttagtccctca

SEQ ID NO: 1401026 - DNA, 23 bp, Homo sapiens
atgcttagtccctcatgcaaatc

SEQ ID NO: 1401027 - DNA, 16 bp, Homo sapiens
atgctttgaaacagaa

SEQ ID NO: 1401028 - DNA, 17 bp, Homo sapiens
atggaataagtgtacat

SEQ ID NO: 1401029 - DNA, 19 bp, Homo sapiens
atggagtgcaccaaagaga

SEQ ID NO: 1401030 - DNA, 20 bp, Homo sapiens
atggagtgcaccaaagagaa

SEQ ID NO: 1401031 - DNA, 22 bp, Homo sapiens
atggatatagttttacttttaa

SEQ ID NO: 1401032 - DNA, 15 bp, Homo sapiens
atggcaaccattata

SEQ ID NO: 1401033 - DNA, 14 bp, Homo sapiens
atgggattctggac

SEQ ID NO: 1401034 - DNA, 15 bp, Homo sapiens
atggggtggaaggca

SEQ ID NO: 1401035 - DNA, 23 bp, Homo sapiens
atggtaatttctactttgataaa

SEQ ID NO: 1401036 - DNA, 21 bp, Homo sapiens
atggttttctccaagagctac

SEQ ID NO: 1401037 - DNA, 20 bp, Homo sapiens
atgtaaaacatttattttga

SEQ ID NO: 1401038 - DNA, 14 bp, Homo sapiens
atgtaaaatattgt

SEQ ID NO: 1401039 - DNA, 14 bp, Homo sapiens
atgtaaagatattt

SEQ ID NO: 1401040 - DNA, 16 bp, Homo sapiens
atgtaaagcttgtctg

SEQ ID NO: 1401041 - DNA, 21 bp, Homo sapiens
atgtaaatattttaaagaatt

SEQ ID NO: 1401042 - DNA, 14 bp, Homo sapiens
atgtaactgagaat

SEQ ID NO: 1401043 - DNA, 15 bp, Homo sapiens
atgtaactgagaatt

SEQ ID NO: 1401044 - DNA, 17 bp, Homo sapiens
atgtaacttttgtaaga

SEQ ID NO: 1401045 - DNA, 20 bp, Homo sapiens
atgtacgataggtagaattg

SEQ ID NO: 1401046 - DNA, 19 bp, Homo sapiens
atgtagataacaagacctc

SEQ ID NO: 1401047 - DNA, 16 bp, Homo sapiens
atgtatcatagaaatg

SEQ ID NO: 1401048 - DNA, 14 bp, Homo sapiens
atgtcaaacaaata

SEQ ID NO: 1401049 - DNA, 13 bp, Homo sapiens
atgtcattaaatg

SEQ ID NO: 1401050 - DNA, 18 bp, Homo sapiens
atgtcatttcatttccta

SEQ ID NO: 1401051 - DNA, 16 bp, Homo sapiens
atgtccttctgagccc

SEQ ID NO: 1401052 - DNA, 15 bp, Homo sapiens
atgtctattcagctt

SEQ ID NO: 1401053 - DNA, 16 bp, Homo sapiens
atgtctcttctgagct

SEQ ID NO: 1401054 - DNA, 14 bp, Homo sapiens
atgtctgtggattt

SEQ ID NO: 1401055 - DNA, 16 bp, Homo sapiens
atgtctgttctacata

SEQ ID NO: 1401056 - DNA, 12 bp, Homo sapiens
atgtgaaccatt

SEQ ID NO: 1401057 - DNA, 12 bp, Homo sapiens
atgtgactcttt

SEQ ID NO: 1401058 - DNA, 17 bp, Homo sapiens
atgtgataaggaaatca

SEQ ID NO: 1401059 - DNA, 21 bp, Homo sapiens
atgtgccaaagtccatttatc

SEQ ID NO: 1401060 - DNA, 15 bp, Homo sapiens
atgtgtgtaaaaaag

SEQ ID NO: 1401061 - DNA, 19 bp, Homo sapiens
atgtgtgtaaaaaagtgtt

SEQ ID NO: 1401062 - DNA, 12 bp, Homo sapiens
atgtgtttgctt

SEQ ID NO: 1401063 - DNA, 14 bp, Homo sapiens
atgtgttttaataa

SEQ ID NO: 1401064 - DNA, 19 bp, Homo sapiens
atgttaaaaaaataagaag

SEQ ID NO: 1401065 - DNA, 15 bp, Homo sapiens
atgttattaaacagg

SEQ ID NO: 1401066 - DNA, 16 bp, Homo sapiens
atgttattaaacaggt

SEQ ID NO: 1401067 - DNA, 15 bp, Homo sapiens
atgttgctggactgt

SEQ ID NO: 1401068 - DNA, 18 bp, Homo sapiens
atgttggtcattttatgt

SEQ ID NO: 1401069 - DNA, 14 bp, Homo sapiens
atgtttaaaacatc

SEQ ID NO: 1401070 - DNA, 17 bp, Homo sapiens
atgtttcacaaggtctt

SEQ ID NO: 1401071 - DNA, 15 bp, Homo sapiens
atgtttgaggttaaa

SEQ ID NO: 1401072 - DNA, 21 bp, Homo sapiens
atgtttgatagattttctgct

SEQ ID NO: 1401073 - DNA, 17 bp, Homo sapiens
atgtttgcacctttcta

SEQ ID NO: 1401074 - DNA, 13 bp, Homo sapiens
attaaaaactgag

SEQ ID NO: 1401075 - DNA, 14 bp, Homo sapiens
attaaaaactgagt

SEQ ID NO: 1401076 - DNA, 12 bp, Homo sapiens
attaactcatta

SEQ ID NO: 1401077 - DNA, 13 bp, Homo sapiens
agaaaatcactta

SEQ ID NO: 1401078 - DNA, 11 bp, Homo sapiens
agaaacattgt

SEQ ID NO: 1401079 - DNA, 17 bp, Homo sapiens
agaaacattgttaatat

SEQ ID NO: 1401080 - DNA, 16 bp, Homo sapiens
agaaacctactgccca

SEQ ID NO: 1401081 - DNA, 13 bp, Homo sapiens
agaaactgaggaa

SEQ ID NO: 1401082 - DNA, 15 bp, Homo sapiens
agaaactttctttct

SEQ ID NO: 1401083 - DNA, 19 bp, Homo sapiens
agaaagccctaaaatacta

SEQ ID NO: 1401084 - DNA, 13 bp, Homo sapiens
agaaagctgcctg

SEQ ID NO: 1401085 - DNA, 23 bp, Homo sapiens
agaaataagtttttgtttcacag

SEQ ID NO: 1401086 - DNA, 20 bp, Homo sapiens
agaaatatttgtgacaaaaa

SEQ ID NO: 1401087 - DNA, 14 bp, Homo sapiens
agaaatcagaaaaa

SEQ ID NO: 1401088 - DNA, 16 bp, Homo sapiens
agaaatcagaaaaatt

SEQ ID NO: 1401089 - DNA, 12 bp, Homo sapiens
agaaatgcagaa

SEQ ID NO: 1401090 - DNA, 14 bp, Homo sapiens
agaacacacacact

SEQ ID NO: 1401091 - DNA, 20 bp, Homo sapiens
agaacacagcaattcctcag

SEQ ID NO: 1401092 - DNA, 21 bp, Homo sapiens
agaacatagacagaagaaaca

SEQ ID NO: 1401093 - DNA, 15 bp, Homo sapiens
agaacctaattcaat

SEQ ID NO: 1401094 - DNA, 12 bp, Homo sapiens
agaaccttctct

SEQ ID NO: 1401095 - DNA, 18 bp, Homo sapiens
agaaccttctctatgggg

SEQ ID NO: 1401096 - DNA, 15 bp, Homo sapiens
agaacttgaccctga

SEQ ID NO: 1401097 - DNA, 15 bp, Homo sapiens
agaactttgagctac

SEQ ID NO: 1401098 - DNA, 20 bp, Homo sapiens
agaactttgagctactgccg

SEQ ID NO: 1401099 - DNA, 19 bp, Homo sapiens
agaagaatgcttaatcaga

SEQ ID NO: 1401100 - DNA, 15 bp, Homo sapiens
agaagacaattgaca

SEQ ID NO: 1401101 - DNA, 19 bp, Homo sapiens
agaagcattttgtaagttg

SEQ ID NO: 1401102 - DNA, 19 bp, Homo sapiens
agaaggcaaaaatagtttg

SEQ ID NO: 1401103 - DNA, 22 bp, Homo sapiens
agaagtaaaagcaaaaaagaaa

SEQ ID NO: 1401104 - DNA, 19 bp, Homo sapiens
agaagttcaatataagctt

SEQ ID NO: 1401105 - DNA, 19 bp, Homo sapiens
agaagtttcatcatttttt

SEQ ID NO: 1401106 - DNA, 16 bp, Homo sapiens
agaagtttgcactatc

SEQ ID NO: 1401107 - DNA, 17 bp, Homo sapiens
agaataatcacgctttc

SEQ ID NO: 1401108 - DNA, 20 bp, Homo sapiens
agaataatcacgctttcctg

SEQ ID NO: 1401109 - DNA, 21 bp, Homo sapiens
agaataatcacgctttcctga

SEQ ID NO: 1401110 - DNA, 19 bp, Homo sapiens
agaatacttctcatttttt

SEQ ID NO: 1401111 - DNA, 18 bp, Homo sapiens
agaatctatatttaacaa

SEQ ID NO: 1401112 - DNA, 17 bp, Homo sapiens
agaatctggctcctgtt

SEQ ID NO: 1401113 - DNA, 19 bp, Homo sapiens
agaatctggctcctgtttc

SEQ ID NO: 1401114 - DNA, 19 bp, Homo sapiens
agaatcttggtttgccttc

SEQ ID NO: 1401115 - DNA, 14 bp, Homo sapiens
agaatgcttaatca

SEQ ID NO: 1401116 - DNA, 20 bp, Homo sapiens
agaatgcttaatcagataga

SEQ ID NO: 1401117 - DNA, 12 bp, Homo sapiens
agaatgtaaagc

SEQ ID NO: 1401118 - DNA, 23 bp, Homo sapiens
agaatgtcattttggtactttgg

SEQ ID NO: 1401119 - DNA, 14 bp, Homo sapiens
agaatgttaagact

SEQ ID NO: 1401120 - DNA, 13 bp, Homo sapiens
agaattactgtaa

SEQ ID NO: 1401121 - DNA, 20 bp, Homo sapiens
agaattatctaatttataaa

SEQ ID NO: 1401122 - DNA, 13 bp, Homo sapiens
agaattgtggttc

SEQ ID NO: 1401123 - DNA, 20 bp, Homo sapiens
agaatttgtgtggatattta

SEQ ID NO: 1401124 - DNA, 19 bp, Homo sapiens
agacaccgttcattcaggc

SEQ ID NO: 1401125 - DNA, 20 bp, Homo sapiens
agacactgccacacagggtc

SEQ ID NO: 1401126 - DNA, 12 bp, Homo sapiens
agacagaagaaa

SEQ ID NO: 1401127 - DNA, 13 bp, Homo sapiens
agacagtctggaa

SEQ ID NO: 1401128 - DNA, 20 bp, Homo sapiens
agacattaactcattagact

SEQ ID NO: 1401129 - DNA, 13 bp, Homo sapiens
agaccaaaataaa

SEQ ID NO: 1401130 - DNA, 19 bp, Homo sapiens
agacccacctgaggctcag

SEQ ID NO: 1401131 - DNA, 23 bp, Homo sapiens
agacccacctgaggctcagccct

SEQ ID NO: 1401132 - DNA, 15 bp, Homo sapiens
agaccggcctgccag

SEQ ID NO: 1401133 - DNA, 17 bp, Homo sapiens
agaccggcctgccagga

SEQ ID NO: 1401134 - DNA, 20 bp, Homo sapiens
agaccggcctgccaggagga

SEQ ID NO: 1401135 - DNA, 20 bp, Homo sapiens
agactatcttactatttcac

SEQ ID NO: 1401136 - DNA, 21 bp, Homo sapiens
agactccttcaacaattctaa

SEQ ID NO: 1401137 - DNA, 16 bp, Homo sapiens
agactctaagaaagaa

SEQ ID NO: 1401138 - DNA, 12 bp, Homo sapiens
aaaaaaaataca

SEQ ID NO: 1401139 - DNA, 13 bp, Homo sapiens
aaaaaagaaacat

SEQ ID NO: 1401140 - DNA, 14 bp, Homo sapiens
aaaaagaagaatct

SEQ ID NO: 1401141 - DNA, 18 bp, Homo sapiens
aaaaagtatacttttgtt

SEQ ID NO: 1401142 - DNA, 13 bp, Homo sapiens
aaaaatactcaga

SEQ ID NO: 1401143 - DNA, 17 bp, Homo sapiens
aaaaatgccaaaaacaa

SEQ ID NO: 1401144 - DNA, 18 bp, Homo sapiens
aaaaatgtaggagactgt

SEQ ID NO: 1401145 - DNA, 15 bp, Homo sapiens
aaaacaaaactgcat

SEQ ID NO: 1401146 - DNA, 20 bp, Homo sapiens
aaaacataatcttctgcctt

SEQ ID NO: 1401147 - DNA, 24 bp, Homo sapiens
aaaacataatcttctgccttctca

SEQ ID NO: 1401148 - DNA, 17 bp, Homo sapiens
aaaactatccaattaaa

SEQ ID NO: 1401149 - DNA, 19 bp, Homo sapiens
aaaactcttataaatttct

SEQ ID NO: 1401150 - DNA, 12 bp, Homo sapiens
aaaagaaacttt

SEQ ID NO: 1401151 - DNA, 12 bp, Homo sapiens
aaaagaagaagt

SEQ ID NO: 1401152 - DNA, 16 bp, Homo sapiens
aaaagattgctgaaat

SEQ ID NO: 1401153 - DNA, 19 bp, Homo sapiens
aaaagcccaccatttggca

SEQ ID NO: 1401154 - DNA, 14 bp, Homo sapiens
aaaagctagaattg

SEQ ID NO: 1401155 - DNA, 14 bp, Homo sapiens
aaaagctttttatt

SEQ ID NO: 1401156 - DNA, 16 bp, Homo sapiens
aaaaggtttacagaat

SEQ ID NO: 1401157 - DNA, 19 bp, Homo sapiens
aaaaggtttatgaaaaaga

SEQ ID NO: 1401158 - DNA, 13 bp, Homo sapiens
aaaagtaataaaa

SEQ ID NO: 1401159 - DNA, 20 bp, Homo sapiens
aaaagtgccattaacaaatg

SEQ ID NO: 1401160 - DNA, 15 bp, Homo sapiens
aaaagttaaatgtgt

SEQ ID NO: 1401161 - DNA, 19 bp, Homo sapiens
aaaagttacatgtttgcac

SEQ ID NO: 1401162 - DNA, 13 bp, Homo sapiens
aaaagttcagagt

SEQ ID NO: 1401163 - DNA, 14 bp, Homo sapiens
aaaagttgctattt

SEQ ID NO: 1401164 - DNA, 13 bp, Homo sapiens
aaaataaagaatg

SEQ ID NO: 1401165 - DNA, 16 bp, Homo sapiens
aaaataatactgctga

SEQ ID NO: 1401166 - DNA, 10 bp, Homo sapiens
aaaatacatg

SEQ ID NO: 1401167 - DNA, 12 bp, Homo sapiens
aaaatattgtta

SEQ ID NO: 1401168 - DNA, 15 bp, Homo sapiens
aaaatatttgtacat

SEQ ID NO: 1401169 - DNA, 21 bp, Homo sapiens
aaaatcaggtggcttttgcgg

SEQ ID NO: 1401170 - DNA, 17 bp, Homo sapiens
aaaatgctatcaaataa

SEQ ID NO: 1401171 - DNA, 22 bp, Homo sapiens
aaaatggaggccattgtgtgag

SEQ ID NO: 1401172 - DNA, 19 bp, Homo sapiens
aaaatgtgctatactgcat

SEQ ID NO: 1401173 - DNA, 17 bp, Homo sapiens
aaaatgttgaaatatga

SEQ ID NO: 1401174 - DNA, 21 bp, Homo sapiens
aaaatgttggtcattttatgt

SEQ ID NO: 1401175 - DNA, 13 bp, Homo sapiens
aaaattatttaaa

SEQ ID NO: 1401176 - DNA, 18 bp, Homo sapiens
aaaattcaacaaacattt

SEQ ID NO: 1401177 - DNA, 20 bp, Homo sapiens
aaacaaactcgttttttaca

SEQ ID NO: 1401178 - DNA, 14 bp, Homo sapiens
aaacaaatgtgtaa

SEQ ID NO: 1401179 - DNA, 13 bp, Homo sapiens
aaacaagtatttg

SEQ ID NO: 1401180 - DNA, 22 bp, Homo sapiens
aaacaagtatttgttaatttag

SEQ ID NO: 1401181 - DNA, 23 bp, Homo sapiens
aaacaagtatttgttaatttaga

SEQ ID NO: 1401182 - DNA, 12 bp, Homo sapiens
aaacagacactg

SEQ ID NO: 1401183 - DNA, 19 bp, Homo sapiens
aaacaggtggttcttttta

SEQ ID NO: 1401184 - DNA, 21 bp, Homo sapiens
aaacatttattttgacataaa

SEQ ID NO: 1401185 - DNA, 22 bp, Homo sapiens
aaacccatattgtaaaacaggt

SEQ ID NO: 1401186 - DNA, 13 bp, Homo sapiens
aaacccctgggta

SEQ ID NO: 1401187 - DNA, 13 bp, Homo sapiens
aaaccttgaagtt

SEQ ID NO: 1401188 - DNA, 12 bp, Homo sapiens
aaacgtttgaaa

SEQ ID NO: 1401189 - DNA, 11 bp, Homo sapiens
aaactaatcca

SEQ ID NO: 1401190 - DNA, 22 bp, Homo sapiens
aaactataagcaagaaggcaaa

SEQ ID NO: 1401191 - DNA, 17 bp, Homo sapiens
aaactatccaattaaaa

SEQ ID NO: 1401192 - DNA, 15 bp, Homo sapiens
aatataattgtttta

SEQ ID NO: 1401193 - DNA, 14 bp, Homo sapiens
aatataatttaaca

SEQ ID NO: 1401194 - DNA, 19 bp, Homo sapiens
aatatacttttacaagtaa

SEQ ID NO: 1401195 - DNA, 15 bp, Homo sapiens
aatatatatggaata

SEQ ID NO: 1401196 - DNA, 13 bp, Homo sapiens
aatatcctgcttg

SEQ ID NO: 1401197 - DNA, 17 bp, Homo sapiens
aatatgctgtggggcat

SEQ ID NO: 1401198 - DNA, 9 bp, Homo sapiens
aatattgtg

SEQ ID NO: 1401199 - DNA, 13 bp, Homo sapiens
aatatttatgtgt

SEQ ID NO: 1401200 - DNA, 14 bp, Homo sapiens
aatatttgtacata

SEQ ID NO: 1401201 - DNA, 16 bp, Homo sapiens
aatattttaaagaatt

SEQ ID NO: 1401202 - DNA, 15 bp, Homo sapiens
aatcaacttgcttat

SEQ ID NO: 1401203 - DNA, 21 bp, Homo sapiens
aatcaacttgcttatcaactt

SEQ ID NO: 1401204 - DNA, 15 bp, Homo sapiens
aatcaagtctgttta

SEQ ID NO: 1401205 - DNA, 21 bp, Homo sapiens
aatcaagtctgtttactgcaa

SEQ ID NO: 1401206 - DNA, 15 bp, Homo sapiens
aatcacgctttttga

SEQ ID NO: 1401207 - DNA, 16 bp, Homo sapiens
aatcacgctttttgaa

SEQ ID NO: 1401208 - DNA, 15 bp, Homo sapiens
aatcagaaaaattaa

SEQ ID NO: 1401209 - DNA, 20 bp, Homo sapiens
aatcagagaccttccagaaa

SEQ ID NO: 1401210 - DNA, 21 bp, Homo sapiens
aatcagatagatattcctatt

SEQ ID NO: 1401211 - DNA, 21 bp, Homo sapiens
aatcccttaatatcctaaaca

SEQ ID NO: 1401212 - DNA, 12 bp, Homo sapiens
aatccgcccatc

SEQ ID NO: 1401213 - DNA, 21 bp, Homo sapiens
aatcctgtcgattagactgga

SEQ ID NO: 1401214 - DNA, 20 bp, Homo sapiens
aatccttagatctggcatgt

SEQ ID NO: 1401215 - DNA, 18 bp, Homo sapiens
aatccttgcttatgacat

SEQ ID NO: 1401216 - DNA, 16 bp, Homo sapiens
aatctcagttgatttt

SEQ ID NO: 1401217 - DNA, 21 bp, Homo sapiens
aatctggctcctgtttccatg

SEQ ID NO: 1401218 - DNA, 21 bp, Homo sapiens
aatctgtaaactgtgtattcc

SEQ ID NO: 1401219 - DNA, 19 bp, Homo sapiens
aatcttaaggtgtagccac

SEQ ID NO: 1401220 - DNA, 21 bp, Homo sapiens
aatctttaaaagatgctttta

SEQ ID NO: 1401221 - DNA, 23 bp, Homo sapiens
aatgaaacaaagagttcaagaaa

SEQ ID NO: 1401222 - DNA, 12 bp, Homo sapiens
aatgaacagaac

SEQ ID NO: 1401223 - DNA, 21 bp, Homo sapiens
aatgaacagaatttatgactc

SEQ ID NO: 1401224 - DNA, 16 bp, Homo sapiens
aatgaacataatgaac

SEQ ID NO: 1401225 - DNA, 15 bp, Homo sapiens
aatgaggtcagcatg

SEQ ID NO: 1401226 - DNA, 21 bp, Homo sapiens
aatgatcctgtattcagacag

SEQ ID NO: 1401227 - DNA, 23 bp, Homo sapiens
aatgatcctgtattcagacagat

SEQ ID NO: 1401228 - DNA, 17 bp, Homo sapiens
aatgatggcaattttgt

SEQ ID NO: 1401229 - DNA, 16 bp, Homo sapiens
aatgcacctaaagaaa

SEQ ID NO: 1401230 - DNA, 23 bp, Homo sapiens
aatgcattataggatcatttgtt

SEQ ID NO: 1401231 - DNA, 14 bp, Homo sapiens
aatgccaagcactt

SEQ ID NO: 1401232 - DNA, 22 bp, Homo sapiens
aatgcctgactagggagccatg

SEQ ID NO: 1401233 - DNA, 12 bp, Homo sapiens
aatgctttgata

SEQ ID NO: 1401234 - DNA, 18 bp, Homo sapiens
aatgctttgatatttcaa

SEQ ID NO: 1401235 - DNA, 21 bp, Homo sapiens
aatggaatgtgatgttcatgg

SEQ ID NO: 1401236 - DNA, 20 bp, Homo sapiens
aatggcatgagaaatacaaa

SEQ ID NO: 1401237 - DNA, 13 bp, Homo sapiens
aatggcctttatt

SEQ ID NO: 1401238 - DNA, 16 bp, Homo sapiens
aatggctgataatttt

SEQ ID NO: 1401239 - DNA, 18 bp, Homo sapiens
aatggctgataattttaa

SEQ ID NO: 1401240 - DNA, 16 bp, Homo sapiens
aatggtgccttcattt

SEQ ID NO: 1401241 - DNA, 14 bp, Homo sapiens
aatgtaaagccatg

SEQ ID NO: 1401242 - DNA, 19 bp, Homo sapiens
aatgtaaagcttgtctgat

SEQ ID NO: 1401243 - DNA, 17 bp, Homo sapiens
aatgtaaatattttaaa

SEQ ID NO: 1401244 - DNA, 15 bp, Homo sapiens
aatgtaacttttgta

SEQ ID NO: 1401245 - DNA, 20 bp, Homo sapiens
aatgtacgataggtagaatt

SEQ ID NO: 1401246 - DNA, 13 bp, Homo sapiens
aatgtatagtaaa

SEQ ID NO: 1401247 - DNA, 16 bp, Homo sapiens
aatgtatcatagaaat

SEQ ID NO: 1401248 - DNA, 14 bp, Homo sapiens
aatgtcattttggt

SEQ ID NO: 1401249 - DNA, 20 bp, Homo sapiens
aatgtgatttacgctcattg

SEQ ID NO: 1401250 - DNA, 21 bp, Homo sapiens
aatgtggcccctgaacaagaa

SEQ ID NO: 1401251 - DNA, 15 bp, Homo sapiens
aatgtgtaattttga

SEQ ID NO: 1401252 - DNA, 19 bp, Homo sapiens
aatgttaagacttgacagt

SEQ ID NO: 1401253 - DNA, 15 bp, Homo sapiens
aatgtttaaaccttt

SEQ ID NO: 1401254 - DNA, 15 bp, Homo sapiens
aattaagggacatgt

SEQ ID NO: 1401255 - DNA, 12 bp, Homo sapiens
aattagcaattg

SEQ ID NO: 1401256 - DNA, 14 bp, Homo sapiens
aattatctaattta

SEQ ID NO: 1401257 - DNA, 19 bp, Homo sapiens
aattatctaatttataaaa

SEQ ID NO: 1401258 - DNA, 16 bp, Homo sapiens
aattattgtttttctt

SEQ ID NO: 1401259 - DNA, 11 bp, Homo sapiens
aattattttgt

SEQ ID NO: 1401260 - DNA, 21 bp, Homo sapiens
aattcattaatctgcctccct

SEQ ID NO: 1401261 - DNA, 14 bp, Homo sapiens
aattctaaaatgat

SEQ ID NO: 1401262 - DNA, 21 bp, Homo sapiens
aattgattcaagattggacat

SEQ ID NO: 1401263 - DNA, 15 bp, Homo sapiens
aattgcctgacgaac

SEQ ID NO: 1401264 - DNA, 22 bp, Homo sapiens
aattgggaacattatcacaatt

SEQ ID NO: 1401265 - DNA, 16 bp, Homo sapiens
aattgtactaaagcca

SEQ ID NO: 1401266 - DNA, 17 bp, Homo sapiens
aattgtactaaagccaa

SEQ ID NO: 1401267 - DNA, 21 bp, Homo sapiens
aattgtggttccctaaagaca

SEQ ID NO: 1401268 - DNA, 19 bp, Homo sapiens
aattgttttatctgaattt

SEQ ID NO: 1401269 - DNA, 22 bp, Homo sapiens
aattgttttatctgaattttta

SEQ ID NO: 1401270 - DNA, 21 bp, Homo sapiens
aatttaacagaagttgtgaaa

SEQ ID NO: 1401271 - DNA, 16 bp, Homo sapiens
aatttagaaaacttta

SEQ ID NO: 1401272 - DNA, 17 bp, Homo sapiens
aatttagacttcaagca

SEQ ID NO: 1401273 - DNA, 20 bp, Homo sapiens
aatttagccctggtttgaaa

SEQ ID NO: 1401274 - DNA, 22 bp, Homo sapiens
aatttagccctggtttgaaatt

SEQ ID NO: 1401275 - DNA, 22 bp, Homo sapiens
aatttagtttcatataaagtat

SEQ ID NO: 1401276 - DNA, 22 bp, Homo sapiens
aatttataaaaaggtgttttga

SEQ ID NO: 1401277 - DNA, 16 bp, Homo sapiens
aatttatattgtaaat

SEQ ID NO: 1401278 - DNA, 18 bp, Homo sapiens
aatttatcctgaaatttc

SEQ ID NO: 1401279 - DNA, 13 bp, Homo sapiens
aatttattttctt

SEQ ID NO: 1401280 - DNA, 18 bp, Homo sapiens
aatttctaccatttcaga

SEQ ID NO: 1401281 - DNA, 20 bp, Homo sapiens
aatttgagagaaatatgaag

SEQ ID NO: 1401282 - DNA, 21 bp, Homo sapiens
aatttgggggacttacatgat

SEQ ID NO: 1401283 - DNA, 14 bp, Homo sapiens
aatttgtgtggata

SEQ ID NO: 1401284 - DNA, 14 bp, Homo sapiens
aattttaaacaaag

SEQ ID NO: 1401285 - DNA, 19 bp, Homo sapiens
aattttaacctatgatatt

SEQ ID NO: 1401286 - DNA, 22 bp, Homo sapiens
aattttctggaatacatgaaat

SEQ ID NO: 1401287 - DNA, 21 bp, Homo sapiens
aattttgagtacagaattcaa

SEQ ID NO: 1401288 - DNA, 22 bp, Homo sapiens
aattttgagtacagaattcaac

SEQ ID NO: 1401289 - DNA, 15 bp, Homo sapiens
aattttgtaacgaag

SEQ ID NO: 1401290 - DNA, 20 bp, Homo sapiens
aatttttttccttacctttt

SEQ ID NO: 1401291 - DNA, 12 bp, Homo sapiens
acaaaaataaaa

SEQ ID NO: 1401292 - DNA, 17 bp, Homo sapiens
acaaacacacacaaaag

SEQ ID NO: 1401293 - DNA, 13 bp, Homo sapiens
acaaacacctcct

SEQ ID NO: 1401294 - DNA, 14 bp, Homo sapiens
acaaaccatgcaaa

SEQ ID NO: 1401295 - DNA, 17 bp, Homo sapiens
acaaactgtaatacaat

SEQ ID NO: 1401296 - DNA, 16 bp, Homo sapiens
acaaagagttcaagaa

SEQ ID NO: 1401297 - DNA, 22 bp, Homo sapiens
acaaagagttcaagaaataagt

SEQ ID NO: 1401298 - DNA, 24 bp, Homo sapiens
acaaaggttgagatgtaaaaggta

SEQ ID NO: 1401299 - DNA, 21 bp, Homo sapiens
acaaaggttttcctcttctat

SEQ ID NO: 1401300 - DNA, 23 bp, Homo sapiens
acaaatatttattttctttctgt

SEQ ID NO: 1401301 - DNA, 13 bp, Homo sapiens
acaaatgtgtaat

SEQ ID NO: 1401302 - DNA, 14 bp, Homo sapiens
acaaccattccaga

SEQ ID NO: 1401303 - DNA, 15 bp, Homo sapiens
acaacctcaactgcc

SEQ ID NO: 1401304 - DNA, 22 bp, Homo sapiens
acaacttgtctattacctgtta

SEQ ID NO: 1401305 - DNA, 19 bp, Homo sapiens
acaagaaaataagagctca

SEQ ID NO: 1401306 - DNA, 18 bp, Homo sapiens
acaagatatttatatgtt

SEQ ID NO: 1401307 - DNA, 13 bp, Homo sapiens
acaagtaacaaaa

SEQ ID NO: 1401308 - DNA, 20 bp, Homo sapiens
acaagtatttgttaatttag

SEQ ID NO: 1401309 - DNA, 22 bp, Homo sapiens
acaagttatttaaatctgtttt

SEQ ID NO: 1401310 - DNA, 14 bp, Homo sapiens
acaataattttcta

SEQ ID NO: 1401311 - DNA, 16 bp, Homo sapiens
acaattaaagctgtta

SEQ ID NO: 1401312 - DNA, 18 bp, Homo sapiens
acaatttatgaattgaat

SEQ ID NO: 1401313 - DNA, 15 bp, Homo sapiens
acacaaacacctcct

SEQ ID NO: 1401314 - DNA, 18 bp, Homo sapiens
acacactgtaaacccctg

SEQ ID NO: 1401315 - DNA, 20 bp, Homo sapiens
acacccaaagaggtatttat

SEQ ID NO: 1401316 - DNA, 20 bp, Homo sapiens
acacctatgtcatttcattt

SEQ ID NO: 1401317 - DNA, 12 bp, Homo sapiens
acacctcccagg

SEQ ID NO: 1401318 - DNA, 22 bp, Homo sapiens
acacctcctagcaagacctgtt

SEQ ID NO: 1401319 - DNA, 16 bp, Homo sapiens
acacctcttggggagt

SEQ ID NO: 1401320 - DNA, 17 bp, Homo sapiens
acacctgttgcacctca

SEQ ID NO: 1401321 - DNA, 19 bp, Homo sapiens
acacgtatcccacctgaca

SEQ ID NO: 1401322 - DNA, 16 bp, Homo sapiens
agaaggttgctctaga

SEQ ID NO: 1401323 - DNA, 20 bp, Homo sapiens
agaaggttgctctagattga

SEQ ID NO: 1401324 - DNA, 15 bp, Homo sapiens
agaagtaaaagcaaa

SEQ ID NO: 1401325 - DNA, 21 bp, Homo sapiens
agaagtttcatcattttttac

SEQ ID NO: 1401326 - DNA, 23 bp, Homo sapiens
agaagtttcatcattttttactt

SEQ ID NO: 1401327 - DNA, 23 bp, Homo sapiens
agaagtttgcactatctttcagc

SEQ ID NO: 1401328 - DNA, 20 bp, Homo sapiens
agaatagcttccaataaagc

SEQ ID NO: 1401329 - DNA, 21 bp, Homo sapiens
agaatcctaggctccacccca

SEQ ID NO: 1401330 - DNA, 16 bp, Homo sapiens
agaatctggctcctgt

SEQ ID NO: 1401331 - DNA, 14 bp, Homo sapiens
agaatgatttcatg

SEQ ID NO: 1401332 - DNA, 23 bp, Homo sapiens
agaatgctctacttctttttctt

SEQ ID NO: 1401333 - DNA, 13 bp, Homo sapiens
agaatgtaaagct

SEQ ID NO: 1401334 - DNA, 16 bp, Homo sapiens
agaatgtcattttggt

SEQ ID NO: 1401335 - DNA, 20 bp, Homo sapiens
agaatgtcattttggtactt

SEQ ID NO: 1401336 - DNA, 19 bp, Homo sapiens
agaatgttaagacttgaca

SEQ ID NO: 1401337 - DNA, 20 bp, Homo sapiens
agaattactgtaactgatta

SEQ ID NO: 1401338 - DNA, 17 bp, Homo sapiens
agaattatctaatttat

SEQ ID NO: 1401339 - DNA, 17 bp, Homo sapiens
agaattgagtgtttaaa

SEQ ID NO: 1401340 - DNA, 21 bp, Homo sapiens
agaatttctaccatttcagag

SEQ ID NO: 1401341 - DNA, 19 bp, Homo sapiens
agacaaacacctcccagga

SEQ ID NO: 1401342 - DNA, 18 bp, Homo sapiens
agacaaaggttttcctct

SEQ ID NO: 1401343 - DNA, 17 bp, Homo sapiens
agacaagccagaacttg

SEQ ID NO: 1401344 - DNA, 16 bp, Homo sapiens
agacagaagaaacaag

SEQ ID NO: 1401345 - DNA, 19 bp, Homo sapiens
agacagggtcaaagtgttt

SEQ ID NO: 1401346 - DNA, 17 bp, Homo sapiens
agacagtctggaaagtg

SEQ ID NO: 1401347 - DNA, 19 bp, Homo sapiens
agaccggcctgccaggagg

SEQ ID NO: 1401348 - DNA, 20 bp, Homo sapiens
agacctcagtgccttcctgt

SEQ ID NO: 1401349 - DNA, 14 bp, Homo sapiens
agaccttttttagg

SEQ ID NO: 1401350 - DNA, 17 bp, Homo sapiens
agactatcttactattt

SEQ ID NO: 1401351 - DNA, 13 bp, Homo sapiens
agactcagctctg

SEQ ID NO: 1401352 - DNA, 12 bp, Homo sapiens
agactctaagaa

SEQ ID NO: 1401353 - DNA, 16 bp, Homo sapiens
agactgctgtggccag

SEQ ID NO: 1401354 - DNA, 18 bp, Homo sapiens
agactgctgtggccagga

SEQ ID NO: 1401355 - DNA, 19 bp, Homo sapiens
agactgctgtggccaggag

SEQ ID NO: 1401356 - DNA, 21 bp, Homo sapiens
agactgctgtggccaggaggt

SEQ ID NO: 1401357 - DNA, 19 bp, Homo sapiens
agactgcttccaattttct

SEQ ID NO: 1401358 - DNA, 18 bp, Homo sapiens
agactggaacactagaca

SEQ ID NO: 1401359 - DNA, 23 bp, Homo sapiens
agactggaacttgaactgattca

SEQ ID NO: 1401360 - DNA, 14 bp, Homo sapiens
agactggacagctt

SEQ ID NO: 1401361 - DNA, 17 bp, Homo sapiens
agactgggtgaaagtga

SEQ ID NO: 1401362 - DNA, 15 bp, Homo sapiens
agacttaagattaaa

SEQ ID NO: 1401363 - DNA, 14 bp, Homo sapiens
agacttcaggttgt

SEQ ID NO: 1401364 - DNA, 19 bp, Homo sapiens
agacttcccacggctcctc

SEQ ID NO: 1401365 - DNA, 14 bp, Homo sapiens
agacttgacagtgg

SEQ ID NO: 1401366 - DNA, 15 bp, Homo sapiens
agacttgacagtgga

SEQ ID NO: 1401367 - DNA, 16 bp, Homo sapiens
agactttctattaata

SEQ ID NO: 1401368 - DNA, 13 bp, Homo sapiens
agagaaaaaatta

SEQ ID NO: 1401369 - DNA, 14 bp, Homo sapiens
agagaaatatgaag

SEQ ID NO: 1401370 - DNA, 19 bp, Homo sapiens
agagaaatcagaaaaatta

SEQ ID NO: 1401371 - DNA, 16 bp, Homo sapiens
agagaagtagaaatca

SEQ ID NO: 1401372 - DNA, 22 bp, Homo sapiens
agagaatttctaccatttcaga

SEQ ID NO: 1401373 - DNA, 23 bp, Homo sapiens
agagaatttctaccatttcagag

SEQ ID NO: 1401374 - DNA, 19 bp, Homo sapiens
agagacaaacacctcccag

SEQ ID NO: 1401375 - DNA, 22 bp, Homo sapiens
agagacattaactcattagact

SEQ ID NO: 1401376 - DNA, 23 bp, Homo sapiens
agagacattaactcattagactg

SEQ ID NO: 1401377 - DNA, 18 bp, Homo sapiens
agagagcctgcaggatct

SEQ ID NO: 1401378 - DNA, 21 bp, Homo sapiens
agagatcccaagtagaatctc

SEQ ID NO: 1401379 - DNA, 15 bp, Homo sapiens
agagcactgccacca

SEQ ID NO: 1401380 - DNA, 14 bp, Homo sapiens
agagctacgtattt

SEQ ID NO: 1401381 - DNA, 14 bp, Homo sapiens
agaggatgttctgg

SEQ ID NO: 1401382 - DNA, 19 bp, Homo sapiens
agaggctattattttcact

SEQ ID NO: 1401383 - DNA, 24 bp, Homo sapiens
agagggaggagaatgagcctcggc

SEQ ID NO: 1401384 - DNA, 16 bp, Homo sapiens
agagggcgcaggccgt

SEQ ID NO: 1401385 - DNA, 10 bp, Homo sapiens
agagggctgc

SEQ ID NO: 1401386 - DNA, 17 bp, Homo sapiens
agaggtatttatcttta

SEQ ID NO: 1401387 - DNA, 16 bp, Homo sapiens
agaggtgagaaattta

SEQ ID NO: 1401388 - DNA, 23 bp, Homo sapiens
agagtccatcagcctccatccta

SEQ ID NO: 1401389 - DNA, 16 bp, Homo sapiens
agagtctgaacctatt

SEQ ID NO: 1401390 - DNA, 23 bp, Homo sapiens
agagtctggtgaagctcacttct

SEQ ID NO: 1401391 - DNA, 22 bp, Homo sapiens
agagtgagagacattaactcat

SEQ ID NO: 1401392 - DNA, 11 bp, Homo sapiens
agagtgtgacc

SEQ ID NO: 1401393 - DNA, 21 bp, Homo sapiens
agagtgtgaccaaaagttaca

SEQ ID NO: 1401394 - DNA, 18 bp, Homo sapiens
agataagttatttataat

SEQ ID NO: 1401395 - DNA, 13 bp, Homo sapiens
agatacactcctg

SEQ ID NO: 1401396 - DNA, 16 bp, Homo sapiens
agatacatacagaatt

SEQ ID NO: 1401397 - DNA, 15 bp, Homo sapiens
agatagaatgacagt

SEQ ID NO: 1401398 - DNA, 18 bp, Homo sapiens
agatatgaacatattgtt

SEQ ID NO: 1401399 - DNA, 16 bp, Homo sapiens
agatattggacaaaga

SEQ ID NO: 1401400 - DNA, 14 bp, Homo sapiens
agatatttatatgt

SEQ ID NO: 1401401 - DNA, 20 bp, Homo sapiens
agatatttttatctttatat

SEQ ID NO: 1401402 - DNA, 23 bp, Homo sapiens
agatcactttctcagttttcata

SEQ ID NO: 1401403 - DNA, 13 bp, Homo sapiens
agatcctcctcat

SEQ ID NO: 1401404 - DNA, 16 bp, Homo sapiens
agatttccttcttttt

SEQ ID NO: 1401405 - DNA, 19 bp, Homo sapiens
agatttgtgtgcatcaggc

SEQ ID NO: 1401406 - DNA, 23 bp, Homo sapiens
agattttgcctttcttttggaag

SEQ ID NO: 1401407 - DNA, 14 bp, Homo sapiens
agattttttaataa

SEQ ID NO: 1401408 - DNA, 21 bp, Homo sapiens
agcaaaataattttaaacaaa

SEQ ID NO: 1401409 - DNA, 15 bp, Homo sapiens
agcaaatcgaatgaa

SEQ ID NO: 1401410 - DNA, 16 bp, Homo sapiens
agcaaccagagcactg

SEQ ID NO: 1401411 - DNA, 21 bp, Homo sapiens
agcaactacagtctaaagctg

SEQ ID NO: 1401412 - DNA, 18 bp, Homo sapiens
agcaagcattcagaagaa

SEQ ID NO: 1401413 - DNA, 22 bp, Homo sapiens
agcaagcattcagaagaaaaag

SEQ ID NO: 1401414 - DNA, 12 bp, Homo sapiens
agcacaggctaa

SEQ ID NO: 1401415 - DNA, 17 bp, Homo sapiens
agcacaggctaattttt

SEQ ID NO: 1401416 - DNA, 14 bp, Homo sapiens
agcaccagaatgta

SEQ ID NO: 1401417 - DNA, 21 bp, Homo sapiens
agcactgggaacaggagaccc

SEQ ID NO: 1401418 - DNA, 18 bp, Homo sapiens
agcaggaggccaataaaa

SEQ ID NO: 1401419 - DNA, 21 bp, Homo sapiens
agcaggaggccaataaaaagt

SEQ ID NO: 1401420 - DNA, 19 bp, Homo sapiens
agccaaggagtcactgaga

SEQ ID NO: 1401421 - DNA, 16 bp, Homo sapiens
agccaaggggcttcag

SEQ ID NO: 1401422 - DNA, 15 bp, Homo sapiens
agccactaccttctg

SEQ ID NO: 1401423 - DNA, 13 bp, Homo sapiens
agccagctttccc

SEQ ID NO: 1401424 - DNA, 22 bp, Homo sapiens
agccagctttccctgcctctca

SEQ ID NO: 1401425 - DNA, 19 bp, Homo sapiens
agccatggagattctcata

SEQ ID NO: 1401426 - DNA, 22 bp, Homo sapiens
agccatggagattctcataact

SEQ ID NO: 1401427 - DNA, 16 bp, Homo sapiens
agcccactgtacttgc

SEQ ID NO: 1401428 - DNA, 16 bp, Homo sapiens
agcccctgaaagccat

SEQ ID NO: 1401429 - DNA, 16 bp, Homo sapiens
agcccggtaagagcaa

SEQ ID NO: 1401430 - DNA, 21 bp, Homo sapiens
agcccggtaagagcaaaagaa

SEQ ID NO: 1401431 - DNA, 13 bp, Homo sapiens
agccctaaacatc

SEQ ID NO: 1401432 - DNA, 13 bp, Homo sapiens
agccctcagccca

SEQ ID NO: 1401433 - DNA, 18 bp, Homo sapiens
agccctggtttgaaattt

SEQ ID NO: 1401434 - DNA, 21 bp, Homo sapiens
agccgacaccttttttcaaca

SEQ ID NO: 1401435 - DNA, 18 bp, Homo sapiens
agcctacccctcctgcgc

SEQ ID NO: 1401436 - DNA, 19 bp, Homo sapiens
agcctacccctcctgcgct

SEQ ID NO: 1401437 - DNA, 22 bp, Homo sapiens
agcctcacttttaatgaacaaa

SEQ ID NO: 1401438 - DNA, 23 bp, Homo sapiens
agcctcacttttaatgaacaaat

SEQ ID NO: 1401439 - DNA, 20 bp, Homo sapiens
agcctcattctgaggcctga

SEQ ID NO: 1401440 - DNA, 13 bp, Homo sapiens
agcctccctcctc

SEQ ID NO: 1401441 - DNA, 18 bp, Homo sapiens
agccttaatcaggtcctc

SEQ ID NO: 1401442 - DNA, 12 bp, Homo sapiens
agccttctctgt

SEQ ID NO: 1401443 - DNA, 19 bp, Homo sapiens
agccttctctgttcatttc

SEQ ID NO: 1401444 - DNA, 16 bp, Homo sapiens
agccttggggattctt

SEQ ID NO: 1401445 - DNA, 23 bp, Homo sapiens
agcgaaaaaatcaggtggctttt

SEQ ID NO: 1401446 - DNA, 19 bp, Homo sapiens
agctaaaataaagaaatag

SEQ ID NO: 1401447 - DNA, 15 bp, Homo sapiens
agctacataatttag

SEQ ID NO: 1401448 - DNA, 23 bp, Homo sapiens
agctactgccgtcagtgctgtgc

SEQ ID NO: 1401449 - DNA, 13 bp, Homo sapiens
agctacttgatgt

SEQ ID NO: 1401450 - DNA, 21 bp, Homo sapiens
agctatttcatctatttttgg

SEQ ID NO: 1401451 - DNA, 17 bp, Homo sapiens
atatatggaataagtgt

SEQ ID NO: 1401452 - DNA, 22 bp, Homo sapiens
atatatggaataagtgtacata

SEQ ID NO: 1401453 - DNA, 14 bp, Homo sapiens
atatattatctttt

SEQ ID NO: 1401454 - DNA, 16 bp, Homo sapiens
atatattatcttttca

SEQ ID NO: 1401455 - DNA, 18 bp, Homo sapiens
atatattttacaattttt

SEQ ID NO: 1401456 - DNA, 21 bp, Homo sapiens
atatccatgacctagttttcc

SEQ ID NO: 1401457 - DNA, 22 bp, Homo sapiens
atatcctaaacatcattcattt

SEQ ID NO: 1401458 - DNA, 15 bp, Homo sapiens
atatgaacatattgt

SEQ ID NO: 1401459 - DNA, 20 bp, Homo sapiens
atatgaacatattgttgaaa

SEQ ID NO: 1401460 - DNA, 14 bp, Homo sapiens
atatggaataagtg

SEQ ID NO: 1401461 - DNA, 12 bp, Homo sapiens
atatgtaaaaca

SEQ ID NO: 1401462 - DNA, 13 bp, Homo sapiens
atatgtaaaacat

SEQ ID NO: 1401463 - DNA, 16 bp, Homo sapiens
atatgtaaaacattta

SEQ ID NO: 1401464 - DNA, 12 bp, Homo sapiens
atatgtaaaata

SEQ ID NO: 1401465 - DNA, 15 bp, Homo sapiens
atatgttattaaaca

SEQ ID NO: 1401466 - DNA, 15 bp, Homo sapiens
atattacactacaca

SEQ ID NO: 1401467 - DNA, 13 bp, Homo sapiens
atattatcttttc

SEQ ID NO: 1401468 - DNA, 22 bp, Homo sapiens
atattcctattgtgcaatgtaa

SEQ ID NO: 1401469 - DNA, 18 bp, Homo sapiens
atattgataagatctttt

SEQ ID NO: 1401470 - DNA, 19 bp, Homo sapiens
atattgtgattctgccttt

SEQ ID NO: 1401471 - DNA, 19 bp, Homo sapiens
atattgtgcacatttaata

SEQ ID NO: 1401472 - DNA, 20 bp, Homo sapiens
atattgtgcacatttaataa

SEQ ID NO: 1401473 - DNA, 19 bp, Homo sapiens
atatttaactctctttatg

SEQ ID NO: 1401474 - DNA, 15 bp, Homo sapiens
atatttatatgttat

SEQ ID NO: 1401475 - DNA, 19 bp, Homo sapiens
atatttatgtgttttaata

SEQ ID NO: 1401476 - DNA, 19 bp, Homo sapiens
atatttatttaaacaaatg

SEQ ID NO: 1401477 - DNA, 13 bp, Homo sapiens
atatttgtacata

SEQ ID NO: 1401478 - DNA, 13 bp, Homo sapiens
atattttctctag

SEQ ID NO: 1401479 - DNA, 15 bp, Homo sapiens
atatttttatcttta

SEQ ID NO: 1401480 - DNA, 18 bp, Homo sapiens
atcaaggccttattggaa

SEQ ID NO: 1401481 - DNA, 22 bp, Homo sapiens
atcaaggccttattggaaagca

SEQ ID NO: 1401482 - DNA, 23 bp, Homo sapiens
atcaccacaaactgtaatacaat

SEQ ID NO: 1401483 - DNA, 18 bp, Homo sapiens
atcacgctttcctgaatc

SEQ ID NO: 1401484 - DNA, 22 bp, Homo sapiens
atcactagccctcctttttcca

SEQ ID NO: 1401485 - DNA, 16 bp, Homo sapiens
atcactgagttttcca

SEQ ID NO: 1401486 - DNA, 20 bp, Homo sapiens
atcactgtttagaacacaca

SEQ ID NO: 1401487 - DNA, 14 bp, Homo sapiens
atcacttgtacaaa

SEQ ID NO: 1401488 - DNA, 16 bp, Homo sapiens
atcacttgtacaaaat

SEQ ID NO: 1401489 - DNA, 17 bp, Homo sapiens
atcacttgtacaaaata

SEQ ID NO: 1401490 - DNA, 18 bp, Homo sapiens
atcacttgtacaaaataa

SEQ ID NO: 1401491 - DNA, 18 bp, Homo sapiens
atcactttctcagttttc

SEQ ID NO: 1401492 - DNA, 17 bp, Homo sapiens
atcagagttgctgcaaa

SEQ ID NO: 1401493 - DNA, 22 bp, Homo sapiens
atcaggctttcttttttttctt

SEQ ID NO: 1401494 - DNA, 20 bp, Homo sapiens
atcaggtcctcagagaattt

SEQ ID NO: 1401495 - DNA, 16 bp, Homo sapiens
atcagtctcagaatgt

SEQ ID NO: 1401496 - DNA, 16 bp, Homo sapiens
atcatcagtgtagaac

SEQ ID NO: 1401497 - DNA, 16 bp, Homo sapiens
atccaactaatgcctt

SEQ ID NO: 1401498 - DNA, 12 bp, Homo sapiens
atccactttgca

SEQ ID NO: 1401499 - DNA, 19 bp, Homo sapiens
atccagagtccctgcctgg

SEQ ID NO: 1401500 - DNA, 16 bp, Homo sapiens
atccagtaggatccag

SEQ ID NO: 1401501 - DNA, 18 bp, Homo sapiens
atccatgacctagttttc

SEQ ID NO: 1401502 - DNA, 20 bp, Homo sapiens
atccatgacctagttttcca

SEQ ID NO: 1401503 - DNA, 21 bp, Homo sapiens
atccatgacctagttttccat

SEQ ID NO: 1401504 - DNA, 16 bp, Homo sapiens
atcccaacactgccag

SEQ ID NO: 1401505 - DNA, 17 bp, Homo sapiens
atcccaacactgccagc

SEQ ID NO: 1401506 - DNA, 16 bp, Homo sapiens
atccccttgaactctt

SEQ ID NO: 1401507 - DNA, 12 bp, Homo sapiens
atccctcctgtt

SEQ ID NO: 1401508 - DNA, 10 bp, Homo sapiens
atccctggcc

SEQ ID NO: 1401509 - DNA, 12 bp, Homo sapiens
atccctggcccc

SEQ ID NO: 1401510 - DNA, 20 bp, Homo sapiens
atccctgggccttgggctcc

SEQ ID NO: 1401511 - DNA, 14 bp, Homo sapiens
atcctaccccctgt

SEQ ID NO: 1401512 - DNA, 14 bp, Homo sapiens
atcctctttttcca

SEQ ID NO: 1401513 - DNA, 15 bp, Homo sapiens
atcctctttttccaa

SEQ ID NO: 1401514 - DNA, 13 bp, Homo sapiens
atcctgctaagtt

SEQ ID NO: 1401515 - DNA, 18 bp, Homo sapiens
atcctgtattcagacaga

SEQ ID NO: 1401516 - DNA, 21 bp, Homo sapiens
atcctgtcgattagactggac

SEQ ID NO: 1401517 - DNA, 13 bp, Homo sapiens
atcctgtctgaaa

SEQ ID NO: 1401518 - DNA, 20 bp, Homo sapiens
atcgcagaccttttttagga

SEQ ID NO: 1401519 - DNA, 17 bp, Homo sapiens
atcgtctcatgtaaaat

SEQ ID NO: 1401520 - DNA, 19 bp, Homo sapiens
atctaatttataaaaaggt

SEQ ID NO: 1401521 - DNA, 19 bp, Homo sapiens
atctacttccaaactaatt

SEQ ID NO: 1401522 - DNA, 21 bp, Homo sapiens
atctagaacacaggcaaaatc

SEQ ID NO: 1401523 - DNA, 18 bp, Homo sapiens
atctatgcattttctgga

SEQ ID NO: 1401524 - DNA, 19 bp, Homo sapiens
atctatttttggcagtctg

SEQ ID NO: 1401525 - DNA, 23 bp, Homo sapiens
atctatttttggcagtctgaatt

SEQ ID NO: 1401526 - DNA, 18 bp, Homo sapiens
atctcaggccagagccaa

SEQ ID NO: 1401527 - DNA, 17 bp, Homo sapiens
atctcagtgaagaatac

SEQ ID NO: 1401528 - DNA, 17 bp, Homo sapiens
atctgattgtgatgtga

SEQ ID NO: 1401529 - DNA, 12 bp, Homo sapiens
atctgcctccct

SEQ ID NO: 1401530 - DNA, 14 bp, Homo sapiens
atctggctcctgtt

SEQ ID NO: 1401531 - DNA, 17 bp, Homo sapiens
atctggctcctgtttcc

SEQ ID NO: 1401532 - DNA, 16 bp, Homo sapiens
atcttactatttcaca

SEQ ID NO: 1401533 - DNA, 18 bp, Homo sapiens
atcttattcattttctct

SEQ ID NO: 1401534 - DNA, 20 bp, Homo sapiens
atcttattcattttctctaa

SEQ ID NO: 1401535 - DNA, 17 bp, Homo sapiens
atcttggtttgccttcc

SEQ ID NO: 1401536 - DNA, 21 bp, Homo sapiens
atcttggtttgccttccagaa

SEQ ID NO: 1401537 - DNA, 20 bp, Homo sapiens
atctttaaaagatgctttta

SEQ ID NO: 1401538 - DNA, 14 bp, Homo sapiens
atcttttattttgc

SEQ ID NO: 1401539 - DNA, 14 bp, Homo sapiens
atcttttcatacat

SEQ ID NO: 1401540 - DNA, 15 bp, Homo sapiens
atctttttcctccct

SEQ ID NO: 1401541 - DNA, 17 bp, Homo sapiens
atgaaaaagaagaatct

SEQ ID NO: 1401542 - DNA, 14 bp, Homo sapiens
atgaaaataaagaa

SEQ ID NO: 1401543 - DNA, 15 bp, Homo sapiens
atgaaaataaagaat

SEQ ID NO: 1401544 - DNA, 15 bp, Homo sapiens
atgaaaccttgaagt

SEQ ID NO: 1401545 - DNA, 12 bp, Homo sapiens
atgaacaaatgg

SEQ ID NO: 1401546 - DNA, 23 bp, Homo sapiens
atgaacctcaagctgcatctaga

SEQ ID NO: 1401547 - DNA, 19 bp, Homo sapiens
atgaagaaaatcacttagg

SEQ ID NO: 1401548 - DNA, 14 bp, Homo sapiens
atgaagaactgagg

SEQ ID NO: 1401549 - DNA, 18 bp, Homo sapiens
atgaaggtgtcatacaga

SEQ ID NO: 1401550 - DNA, 22 bp, Homo sapiens
atgaattgggaacattatcaca

SEQ ID NO: 1401551 - DNA, 19 bp, Homo sapiens
atgacagtccgtcaaaaca

SEQ ID NO: 1401552 - DNA, 22 bp, Homo sapiens
atgacagtccgtcaaaacagat

SEQ ID NO: 1401553 - DNA, 19 bp, Homo sapiens
atgacatcacttgtacaaa

SEQ ID NO: 1401554 - DNA, 16 bp, Homo sapiens
atgactgccaagactg

SEQ ID NO: 1401555 - DNA, 15 bp, Homo sapiens
atgagatgctggctt

SEQ ID NO: 1401556 - DNA, 22 bp, Homo sapiens
atgagatgctggcttgggcagc

SEQ ID NO: 1401557 - DNA, 16 bp, Homo sapiens
atgagctcttcatgtt

SEQ ID NO: 1401558 - DNA, 13 bp, Homo sapiens
atgaggctttcca

SEQ ID NO: 1401559 - DNA, 14 bp, Homo sapiens
atgatattttcaga

SEQ ID NO: 1401560 - DNA, 14 bp, Homo sapiens
atgatgttaaaaaa

SEQ ID NO: 1401561 - DNA, 13 bp, Homo sapiens
atgattcatttta

SEQ ID NO: 1401562 - DNA, 20 bp, Homo sapiens
atgatttcatgctatctctg

SEQ ID NO: 1401563 - DNA, 21 bp, Homo sapiens
atgatttttttttcatacact

SEQ ID NO: 1401564 - DNA, 18 bp, Homo sapiens
atgcaaaataaatgtttt

SEQ ID NO: 1401565 - DNA, 23 bp, Homo sapiens
atgcacctaaagaaaaacaaact

SEQ ID NO: 1401566 - DNA, 13 bp, Homo sapiens
atgcagctcaaga

SEQ ID NO: 1401567 - DNA, 11 bp, Homo sapiens
atgcatatact

SEQ ID NO: 1401568 - DNA, 23 bp, Homo sapiens
atgcatggagggctgccctgtac

SEQ ID NO: 1401569 - DNA, 16 bp, Homo sapiens
atgcatgtcctgtaaa

SEQ ID NO: 1401570 - DNA, 17 bp, Homo sapiens
atgcatgtcctgtaaag

SEQ ID NO: 1401571 - DNA, 17 bp, Homo sapiens
atgcatttgggtccagg

SEQ ID NO: 1401572 - DNA, 17 bp, Homo sapiens
atgccaaaaaaaaatac

SEQ ID NO: 1401573 - DNA, 18 bp, Homo sapiens
atgccaaaaaaaaataca

SEQ ID NO: 1401574 - DNA, 12 bp, Homo sapiens
atgcctccagct

SEQ ID NO: 1401575 - DNA, 16 bp, Homo sapiens
atgccttactcttctt

SEQ ID NO: 1401576 - DNA, 18 bp, Homo sapiens
atgccttactcttcttga

SEQ ID NO: 1401577 - DNA, 23 bp, Homo sapiens
atgccttttcccaaaatgttgaa

SEQ ID NO: 1401578 - DNA, 22 bp, Homo sapiens
atgctaagagaagtagaaatca

SEQ ID NO: 1401579 - DNA, 18 bp, Homo sapiens
atgctatcaaataactaa

SEQ ID NO: 1401580 - DNA, 15 bp, Homo sapiens
atgctctacttcttt

SEQ ID NO: 1401581 - DNA, 23 bp, Homo sapiens
atgcttactgatatattttacaa

SEQ ID NO: 1401582 - DNA, 22 bp, Homo sapiens
caaggccttattggaaagcagt

SEQ ID NO: 1401583 - DNA, 15 bp, Homo sapiens
caaggctttctctac

SEQ ID NO: 1401584 - DNA, 22 bp, Homo sapiens
caaggggcttcaggtccaggct

SEQ ID NO: 1401585 - DNA, 15 bp, Homo sapiens
caagggtcaggcctt

SEQ ID NO: 1401586 - DNA, 14 bp, Homo sapiens
caagtaacaaaaat

SEQ ID NO: 1401587 - DNA, 17 bp, Homo sapiens
caagtaacaaaaataaa

SEQ ID NO: 1401588 - DNA, 13 bp, Homo sapiens
caagtagaatctc

SEQ ID NO: 1401589 - DNA, 22 bp, Homo sapiens
caagtatgtgggcagattttca

SEQ ID NO: 1401590 - DNA, 20 bp, Homo sapiens
caagtatttgttaatttaga

SEQ ID NO: 1401591 - DNA, 21 bp, Homo sapiens
caagttgttccttaagtcaga

SEQ ID NO: 1401592 - DNA, 15 bp, Homo sapiens
caataaaaagttcag

SEQ ID NO: 1401593 - DNA, 16 bp, Homo sapiens
caataaaaagttcaga

SEQ ID NO: 1401594 - DNA, 13 bp, Homo sapiens
caataaaaatgtt

SEQ ID NO: 1401595 - DNA, 20 bp, Homo sapiens
caataaaaatgtttaacggt

SEQ ID NO: 1401596 - DNA, 15 bp, Homo sapiens
caataacgtttaagc

SEQ ID NO: 1401597 - DNA, 14 bp, Homo sapiens
caataattttctac

SEQ ID NO: 1401598 - DNA, 18 bp, Homo sapiens
caatcaagtctgtttact

SEQ ID NO: 1401599 - DNA, 22 bp, Homo sapiens
caatcccttaatatcctaaaca

SEQ ID NO: 1401600 - DNA, 19 bp, Homo sapiens
caatgaaatgaattaaagt

SEQ ID NO: 1401601 - DNA, 14 bp, Homo sapiens
caatgtaaatattt

SEQ ID NO: 1401602 - DNA, 15 bp, Homo sapiens
caatgttagcctcaa

SEQ ID NO: 1401603 - DNA, 14 bp, Homo sapiens
caattaaaattaag

SEQ ID NO: 1401604 - DNA, 20 bp, Homo sapiens
caattaaaattaaggtctgg

SEQ ID NO: 1401605 - DNA, 23 bp, Homo sapiens
caattaggcagactctttatgct

SEQ ID NO: 1401606 - DNA, 20 bp, Homo sapiens
caattcatatttatgaatct

SEQ ID NO: 1401607 - DNA, 21 bp, Homo sapiens
caattgacaacagttacataa

SEQ ID NO: 1401608 - DNA, 22 bp, Homo sapiens
caattgacaacagttacataat

SEQ ID NO: 1401609 - DNA, 19 bp, Homo sapiens
caattgactgtcactgttc

SEQ ID NO: 1401610 - DNA, 11 bp, Homo sapiens
caattttgtaa

SEQ ID NO: 1401611 - DNA, 12 bp, Homo sapiens
caattttgtaac

SEQ ID NO: 1401612 - DNA, 13 bp, Homo sapiens
cacaaatatttat

SEQ ID NO: 1401613 - DNA, 23 bp, Homo sapiens
cacaaatatttattttctttctg

SEQ ID NO: 1401614 - DNA, 15 bp, Homo sapiens
cacaataattttcta

SEQ ID NO: 1401615 - DNA, 20 bp, Homo sapiens
cacaattccagactttctat

SEQ ID NO: 1401616 - DNA, 16 bp, Homo sapiens
cacacaaacacctcct

SEQ ID NO: 1401617 - DNA, 20 bp, Homo sapiens
cacactcagatcctcctcat

SEQ ID NO: 1401618 - DNA, 17 bp, Homo sapiens
cacactgtaaacccctg

SEQ ID NO: 1401619 - DNA, 20 bp, Homo sapiens
cacactgtaaacccctgggt

SEQ ID NO: 1401620 - DNA, 19 bp, Homo sapiens
cacagataactgaaaatta

SEQ ID NO: 1401621 - DNA, 22 bp, Homo sapiens
cacagataactgaaaattattt

SEQ ID NO: 1401622 - DNA, 16 bp, Homo sapiens
cacagcaattcctcag

SEQ ID NO: 1401623 - DNA, 21 bp, Homo sapiens
cacagctctccggtctctctc

SEQ ID NO: 1401624 - DNA, 19 bp, Homo sapiens
cacatactcatttttcatg

SEQ ID NO: 1401625 - DNA, 13 bp, Homo sapiens
caccaaagagaat

SEQ ID NO: 1401626 - DNA, 22 bp, Homo sapiens
caccaagttggaacatccttgg

SEQ ID NO: 1401627 - DNA, 23 bp, Homo sapiens
caccaagttggaacatccttgga

SEQ ID NO: 1401628 - DNA, 20 bp, Homo sapiens
caccactccactcctccagc

SEQ ID NO: 1401629 - DNA, 13 bp, Homo sapiens
caccattgaaggc

SEQ ID NO: 1401630 - DNA, 15 bp, Homo sapiens
caccattgaaggctt

SEQ ID NO: 1401631 - DNA, 18 bp, Homo sapiens
caccatttggcatccctg

SEQ ID NO: 1401632 - DNA, 22 bp, Homo sapiens
caccatttggcatccctgggcc

SEQ ID NO: 1401633 - DNA, 15 bp, Homo sapiens
cacccaaaccccggg

SEQ ID NO: 1401634 - DNA, 16 bp, Homo sapiens
cacccaattcaaaaca

SEQ ID NO: 1401635 - DNA, 16 bp, Homo sapiens
caccccgacttttgtt

SEQ ID NO: 1401636 - DNA, 21 bp, Homo sapiens
caccggggcctgggcaggagg

SEQ ID NO: 1401637 - DNA, 20 bp, Homo sapiens
cacctatgtcatttcatttc

SEQ ID NO: 1401638 - DNA, 23 bp, Homo sapiens
cacctatgtcatttcatttccta

SEQ ID NO: 1401639 - DNA, 22 bp, Homo sapiens
cacctcctagcaagacctgttg

SEQ ID NO: 1401640 - DNA, 22 bp, Homo sapiens
cacctcctgggttcaagcgatt

SEQ ID NO: 1401641 - DNA, 13 bp, Homo sapiens
cacctgaactgaa

SEQ ID NO: 1401642 - DNA, 21 bp, Homo sapiens
cacctggaagcatttgtttct

SEQ ID NO: 1401643 - DNA, 16 bp, Homo sapiens
cacctgtaaacctgag

SEQ ID NO: 1401644 - DNA, 14 bp, Homo sapiens
cacctgtcccagaa

SEQ ID NO: 1401645 - DNA, 21 bp, Homo sapiens
cacctgttgcacctcaggcag

SEQ ID NO: 1401646 - DNA, 13 bp, Homo sapiens
caccttagctggc

SEQ ID NO: 1401647 - DNA, 13 bp, Homo sapiens
cacctttctagtt

SEQ ID NO: 1401648 - DNA, 17 bp, Homo sapiens
cacctttctagttgaaa

SEQ ID NO: 1401649 - DNA, 23 bp, Homo sapiens
cacgctctctccaggcaggtctg

SEQ ID NO: 1401650 - DNA, 20 bp, Homo sapiens
cacggctcctcgagatccca

SEQ ID NO: 1401651 - DNA, 17 bp, Homo sapiens
cactaccttctgacctc

SEQ ID NO: 1401652 - DNA, 16 bp, Homo sapiens
cactagacaagccaga

SEQ ID NO: 1401653 - DNA, 14 bp, Homo sapiens
cactatctttcagc

SEQ ID NO: 1401654 - DNA, 16 bp, Homo sapiens
cactcatgtgactctt

SEQ ID NO: 1401655 - DNA, 14 bp, Homo sapiens
cactcctccagcca

SEQ ID NO: 1401656 - DNA, 12 bp, Homo sapiens
cactcctgctgt

SEQ ID NO: 1401657 - DNA, 16 bp, Homo sapiens
cactctgagtgtttta

SEQ ID NO: 1401658 - DNA, 15 bp, Homo sapiens
cactgagaccaaggc

SEQ ID NO: 1401659 - DNA, 15 bp, Homo sapiens
cactgagttttccat

SEQ ID NO: 1401660 - DNA, 22 bp, Homo sapiens
cactgagttttccatggcagga

SEQ ID NO: 1401661 - DNA, 20 bp, Homo sapiens
cactgcaaaccgccacctcc

SEQ ID NO: 1401662 - DNA, 20 bp, Homo sapiens
cactgctgatattttctcta

SEQ ID NO: 1401663 - DNA, 16 bp, Homo sapiens
cactggaccactgggc

SEQ ID NO: 1401664 - DNA, 14 bp, Homo sapiens
cactgggaacagga

SEQ ID NO: 1401665 - DNA, 20 bp, Homo sapiens
cactggtagaccaaaataaa

SEQ ID NO: 1401666 - DNA, 14 bp, Homo sapiens
cactggtttgaaga

SEQ ID NO: 1401667 - DNA, 22 bp, Homo sapiens
cacttattggaactctgcttga

SEQ ID NO: 1401668 - DNA, 14 bp, Homo sapiens
cacttcataatcca

SEQ ID NO: 1401669 - DNA, 19 bp, Homo sapiens
cacttcttacaataattct

SEQ ID NO: 1401670 - DNA, 12 bp, Homo sapiens
cacttgcaacct

SEQ ID NO: 1401671 - DNA, 19 bp, Homo sapiens
cacttggtaattgtactaa

SEQ ID NO: 1401672 - DNA, 20 bp, Homo sapiens
cactttaattaccaacctgt

SEQ ID NO: 1401673 - DNA, 14 bp, Homo sapiens
cactttgcacagct

SEQ ID NO: 1401674 - DNA, 17 bp, Homo sapiens
cacttttaatgaacaaa

SEQ ID NO: 1401675 - DNA, 16 bp, Homo sapiens
cacttttcctccctca

SEQ ID NO: 1401676 - DNA, 13 bp, Homo sapiens
cagaaaaattaat

SEQ ID NO: 1401677 - DNA, 14 bp, Homo sapiens
cagaaaacaaaact

SEQ ID NO: 1401678 - DNA, 20 bp, Homo sapiens
cagaaacaaaaacactaaaa

SEQ ID NO: 1401679 - DNA, 23 bp, Homo sapiens
cagaaagcagttgagacaagaaa

SEQ ID NO: 1401680 - DNA, 21 bp, Homo sapiens
cagaaatgaggagacacacct

SEQ ID NO: 1401681 - DNA, 21 bp, Homo sapiens
cagaacatagacagaagaaac

SEQ ID NO: 1401682 - DNA, 14 bp, Homo sapiens
cagaaccacactgt

SEQ ID NO: 1401683 - DNA, 15 bp, Homo sapiens
cagaaccacactgtt

SEQ ID NO: 1401684 - DNA, 14 bp, Homo sapiens
cagaagttgtgaaa

SEQ ID NO: 1401685 - DNA, 15 bp, Homo sapiens
cagaagttgtgaaac

SEQ ID NO: 1401686 - DNA, 16 bp, Homo sapiens
cagaatacaagccact

SEQ ID NO: 1401687 - DNA, 21 bp, Homo sapiens
cagaatgtgataaggaaatca

SEQ ID NO: 1401688 - DNA, 22 bp, Homo sapiens
cagaatgttgattacagtgcag

SEQ ID NO: 1401689 - DNA, 15 bp, Homo sapiens
cagaccttttttagg

SEQ ID NO: 1401690 - DNA, 14 bp, Homo sapiens
cagactcagctctg

SEQ ID NO: 1401691 - DNA, 18 bp, Homo sapiens
cagactccttcaacaatt

SEQ ID NO: 1401692 - DNA, 23 bp, Homo sapiens
cagactccttcaacaattctaaa

SEQ ID NO: 1401693 - DNA, 14 bp, Homo sapiens
cagactctaagaaa

SEQ ID NO: 1401694 - DNA, 15 bp, Homo sapiens
cagactctttatgct

SEQ ID NO: 1401695 - DNA, 12 bp, Homo sapiens
cagagaaaaagg

SEQ ID NO: 1401696 - DNA, 22 bp, Homo sapiens
cagagaatttctaccatttcag

SEQ ID NO: 1401697 - DNA, 20 bp, Homo sapiens
cagagaggccttttggaatg

SEQ ID NO: 1401698 - DNA, 23 bp, Homo sapiens
cagagagtgagagacattaactc

SEQ ID NO: 1401699 - DNA, 18 bp, Homo sapiens
cagagtccctgcctggac

SEQ ID NO: 1401700 - DNA, 19 bp, Homo sapiens
cagataactgaaaattatt

SEQ ID NO: 1401701 - DNA, 22 bp, Homo sapiens
cagatggcatgtgtttacttta

SEQ ID NO: 1401702 - DNA, 17 bp, Homo sapiens
cagattcccagagcaaa

SEQ ID NO: 1401703 - DNA, 18 bp, Homo sapiens
cagcaaccagagcactgt

SEQ ID NO: 1401704 - DNA, 17 bp, Homo sapiens
cagcagactcagctctg

SEQ ID NO: 1401705 - DNA, 21 bp, Homo sapiens
cagcagggactgtaaacacag

SEQ ID NO: 1401706 - DNA, 22 bp, Homo sapiens
cagcagggactgtaaacacaga

SEQ ID NO: 1401707 - DNA, 18 bp, Homo sapiens
cagcatgatattttcaga

SEQ ID NO: 1401708 - DNA, 18 bp, Homo sapiens
cagccatcaagagactga

SEQ ID NO: 1401709 - DNA, 13 bp, Homo sapiens
cagcccctcccag

SEQ ID NO: 1401710 - DNA, 16 bp, Homo sapiens
cagcccctcccagcct

SEQ ID NO: 1401711 - DNA, 17 bp, Homo sapiens
ccctgcctggtatgagt

SEQ ID NO: 1401712 - DNA, 15 bp, Homo sapiens
ccctggaactgtctc

SEQ ID NO: 1401713 - DNA, 15 bp, Homo sapiens
ccctggactgtgtgc

SEQ ID NO: 1401714 - DNA, 9 bp, Homo sapiens
ccctggccc

SEQ ID NO: 1401715 - DNA, 20 bp, Homo sapiens
ccctggccccctccctggat

SEQ ID NO: 1401716 - DNA, 18 bp, Homo sapiens
ccctgggccttgggctcc

SEQ ID NO: 1401717 - DNA, 23 bp, Homo sapiens
ccctgggtagcgggggagggtag

SEQ ID NO: 1401718 - DNA, 15 bp, Homo sapiens
ccctgtgccttgtca

SEQ ID NO: 1401719 - DNA, 20 bp, Homo sapiens
cccttgcccatgcctccagc

SEQ ID NO: 1401720 - DNA, 21 bp, Homo sapiens
cccttgtgaatcaagggtcag

SEQ ID NO: 1401721 - DNA, 22 bp, Homo sapiens
ccctttggggagcaggaggcca

SEQ ID NO: 1401722 - DNA, 13 bp, Homo sapiens
ccgcaccccccaa

SEQ ID NO: 1401723 - DNA, 14 bp, Homo sapiens
ccgctatgcagggt

SEQ ID NO: 1401724 - DNA, 15 bp, Homo sapiens
ccggcctgccaggag

SEQ ID NO: 1401725 - DNA, 18 bp, Homo sapiens
ccggcctgccaggaggac

SEQ ID NO: 1401726 - DNA, 16 bp, Homo sapiens
ccggctttgtggcact

SEQ ID NO: 1401727 - DNA, 17 bp, Homo sapiens
ccggctttgtggcactg

SEQ ID NO: 1401728 - DNA, 19 bp, Homo sapiens
ccggctttgtggcactggg

SEQ ID NO: 1401729 - DNA, 21 bp, Homo sapiens
ccgggggcagtctgagagagg

SEQ ID NO: 1401730 - DNA, 15 bp, Homo sapiens
ccgtgagcatgtttg

SEQ ID NO: 1401731 - DNA, 20 bp, Homo sapiens
ccgtgtgggagaccggcctg

SEQ ID NO: 1401732 - DNA, 13 bp, Homo sapiens
cctaataaagctg

SEQ ID NO: 1401733 - DNA, 17 bp, Homo sapiens
cctacccctcctgcgct

SEQ ID NO: 1401734 - DNA, 14 bp, Homo sapiens
cctacctgtgcctg

SEQ ID NO: 1401735 - DNA, 22 bp, Homo sapiens
cctacttcttttgctcttagct

SEQ ID NO: 1401736 - DNA, 14 bp, Homo sapiens
cctactttgacttt

SEQ ID NO: 1401737 - DNA, 18 bp, Homo sapiens
cctagcaagacctgttgg

SEQ ID NO: 1401738 - DNA, 16 bp, Homo sapiens
cctaggctagggtggg

SEQ ID NO: 1401739 - DNA, 12 bp, Homo sapiens
cctagttttcca

SEQ ID NO: 1401740 - DNA, 13 bp, Homo sapiens
cctagttttccat

SEQ ID NO: 1401741 - DNA, 20 bp, Homo sapiens
cctagttttctcctcccagg

SEQ ID NO: 1401742 - DNA, 20 bp, Homo sapiens
cctatcagagttgctgcaaa

SEQ ID NO: 1401743 - DNA, 14 bp, Homo sapiens
cctcaacccctccc

SEQ ID NO: 1401744 - DNA, 23 bp, Homo sapiens
cctcaacccctcccctccatccc

SEQ ID NO: 1401745 - DNA, 12 bp, Homo sapiens
cctcaacctccc

SEQ ID NO: 1401746 - DNA, 14 bp, Homo sapiens
cctcaactgcctac

SEQ ID NO: 1401747 - DNA, 14 bp, Homo sapiens
cctcagcccacctg

SEQ ID NO: 1401748 - DNA, 18 bp, Homo sapiens
cctcagccccgcgtggaa

SEQ ID NO: 1401749 - DNA, 15 bp, Homo sapiens
cctcagctagctctg

SEQ ID NO: 1401750 - DNA, 22 bp, Homo sapiens
cctcaggcaatctgcccgcctg

SEQ ID NO: 1401751 - DNA, 22 bp, Homo sapiens
cctcaggcagaggatgttctgg

SEQ ID NO: 1401752 - DNA, 18 bp, Homo sapiens
cctcattctgaggcctga

SEQ ID NO: 1401753 - DNA, 17 bp, Homo sapiens
cctccatccctggcccc

SEQ ID NO: 1401754 - DNA, 16 bp, Homo sapiens
cctccccctgccagga

SEQ ID NO: 1401755 - DNA, 14 bp, Homo sapiens
cctccccctgtccc

SEQ ID NO: 1401756 - DNA, 15 bp, Homo sapiens
cctccccgcaccccc

SEQ ID NO: 1401757 - DNA, 14 bp, Homo sapiens
cctcccctccatcc

SEQ ID NO: 1401758 - DNA, 23 bp, Homo sapiens
cctcctgttgggagagggcgcag

SEQ ID NO: 1401759 - DNA, 16 bp, Homo sapiens
cctccttatttatcaa

SEQ ID NO: 1401760 - DNA, 17 bp, Homo sapiens
cctcgtcccctgcctca

SEQ ID NO: 1401761 - DNA, 18 bp, Homo sapiens
cctctccactcatgtgac

SEQ ID NO: 1401762 - DNA, 20 bp, Homo sapiens
cctctctgcaggtccctaat

SEQ ID NO: 1401763 - DNA, 21 bp, Homo sapiens
cctctctgcaggtccctaata

SEQ ID NO: 1401764 - DNA, 21 bp, Homo sapiens
cctctgcccgggagctcagga

SEQ ID NO: 1401765 - DNA, 15 bp, Homo sapiens
cctctggggggtggc

SEQ ID NO: 1401766 - DNA, 23 bp, Homo sapiens
cctcttggggagtttagggtggg

SEQ ID NO: 1401767 - DNA, 23 bp, Homo sapiens
cctctttttccaacttggctgca

SEQ ID NO: 1401768 - DNA, 22 bp, Homo sapiens
cctgaaaaggtttatgaaaaag

SEQ ID NO: 1401769 - DNA, 20 bp, Homo sapiens
cctgaatccaaactaatcca

SEQ ID NO: 1401770 - DNA, 14 bp, Homo sapiens
cctgacactttaat

SEQ ID NO: 1401771 - DNA, 19 bp, Homo sapiens
cctgaccctcatctttctt

SEQ ID NO: 1401772 - DNA, 13 bp, Homo sapiens
cctgaggctcagc

SEQ ID NO: 1401773 - DNA, 16 bp, Homo sapiens
cctgaggctcagccct

SEQ ID NO: 1401774 - DNA, 19 bp, Homo sapiens
cctgagtcgtacagaaagc

SEQ ID NO: 1401775 - DNA, 15 bp, Homo sapiens
cctgatgaaaataaa

SEQ ID NO: 1401776 - DNA, 17 bp, Homo sapiens
cctgatgaaaataaaga

SEQ ID NO: 1401777 - DNA, 18 bp, Homo sapiens
cctgatgaaaataaagaa

SEQ ID NO: 1401778 - DNA, 21 bp, Homo sapiens
cctgatgaaaataaagaatgg

SEQ ID NO: 1401779 - DNA, 22 bp, Homo sapiens
cctgattttttttccttttaat

SEQ ID NO: 1401780 - DNA, 19 bp, Homo sapiens
cctgcacaataaaaatgtt

SEQ ID NO: 1401781 - DNA, 12 bp, Homo sapiens
cctgccaggagg

SEQ ID NO: 1401782 - DNA, 22 bp, Homo sapiens
cctgccgagagtccatcagcct

SEQ ID NO: 1401783 - DNA, 23 bp, Homo sapiens
cctgccgagagtccatcagcctc

SEQ ID NO: 1401784 - DNA, 16 bp, Homo sapiens
cctgcctcccatgcct

SEQ ID NO: 1401785 - DNA, 17 bp, Homo sapiens
cctgcctcccatgcctg

SEQ ID NO: 1401786 - DNA, 11 bp, Homo sapiens
cctgcctcctg

SEQ ID NO: 1401787 - DNA, 23 bp, Homo sapiens
cctgcctctcatcaactgaatga

SEQ ID NO: 1401788 - DNA, 15 bp, Homo sapiens
cctgcctctctgcag

SEQ ID NO: 1401789 - DNA, 21 bp, Homo sapiens
cctgcctctctgcaggtccct

SEQ ID NO: 1401790 - DNA, 18 bp, Homo sapiens
cctggaactgtctctcat

SEQ ID NO: 1401791 - DNA, 15 bp, Homo sapiens
cctggaagccagctt

SEQ ID NO: 1401792 - DNA, 17 bp, Homo sapiens
cctggactgtgtgctca

SEQ ID NO: 1401793 - DNA, 12 bp, Homo sapiens
cctggaggatga

SEQ ID NO: 1401794 - DNA, 16 bp, Homo sapiens
cctggatgacattaaa

SEQ ID NO: 1401795 - DNA, 22 bp, Homo sapiens
cctgggagaaatctggcttctg

SEQ ID NO: 1401796 - DNA, 21 bp, Homo sapiens
cctgggaggctctggagccca

SEQ ID NO: 1401797 - DNA, 14 bp, Homo sapiens
cctgggcaggaggg

SEQ ID NO: 1401798 - DNA, 17 bp, Homo sapiens
cctgggttgcagacagg

SEQ ID NO: 1401799 - DNA, 20 bp, Homo sapiens
cctggtatatccaaaagctt

SEQ ID NO: 1401800 - DNA, 21 bp, Homo sapiens
cctggtggtggctcgggaggc

SEQ ID NO: 1401801 - DNA, 14 bp, Homo sapiens
cctgtaccccagca

SEQ ID NO: 1401802 - DNA, 22 bp, Homo sapiens
cctgtagccccagtgacagcta

SEQ ID NO: 1401803 - DNA, 16 bp, Homo sapiens
cctgtattcagacaga

SEQ ID NO: 1401804 - DNA, 19 bp, Homo sapiens
cctgttacctactttgact

SEQ ID NO: 1401805 - DNA, 17 bp, Homo sapiens
cctgttgagcatcacag

SEQ ID NO: 1401806 - DNA, 12 bp, Homo sapiens
cctgttgggaga

SEQ ID NO: 1401807 - DNA, 16 bp, Homo sapiens
cctgtttttcacattt

SEQ ID NO: 1401808 - DNA, 16 bp, Homo sapiens
ccttaaggctcttttg

SEQ ID NO: 1401809 - DNA, 16 bp, Homo sapiens
ccttaatttattatta

SEQ ID NO: 1401810 - DNA, 19 bp, Homo sapiens
ccttagctggcattacagc

SEQ ID NO: 1401811 - DNA, 22 bp, Homo sapiens
ccttcaacaattctaaaatgat

SEQ ID NO: 1401812 - DNA, 18 bp, Homo sapiens
ccttcagttatgattttt

SEQ ID NO: 1401813 - DNA, 13 bp, Homo sapiens
ccttcatttcctc

SEQ ID NO: 1401814 - DNA, 14 bp, Homo sapiens
ccttcatttcctcc

SEQ ID NO: 1401815 - DNA, 14 bp, Homo sapiens
ccttccagaaaaca

SEQ ID NO: 1401816 - DNA, 22 bp, Homo sapiens
ccttcgcgtatttcaggattct

SEQ ID NO: 1401817 - DNA, 17 bp, Homo sapiens
ccttctctgttcatttc

SEQ ID NO: 1401818 - DNA, 19 bp, Homo sapiens
ccttgaagttctgaaattt

SEQ ID NO: 1401819 - DNA, 21 bp, Homo sapiens
ccttgacaactggcaggcagg

SEQ ID NO: 1401820 - DNA, 20 bp, Homo sapiens
ccttgattttagccttctct

SEQ ID NO: 1401821 - DNA, 18 bp, Homo sapiens
ccttgcttatgacatcac

SEQ ID NO: 1401822 - DNA, 21 bp, Homo sapiens
ccttgggctccgtgtgggaga

SEQ ID NO: 1401823 - DNA, 16 bp, Homo sapiens
ccttgtcactggtaga

SEQ ID NO: 1401824 - DNA, 20 bp, Homo sapiens
ccttgtgaatcaagggtcag

SEQ ID NO: 1401825 - DNA, 19 bp, Homo sapiens
cctttctagagcactgcca

SEQ ID NO: 1401826 - DNA, 15 bp, Homo sapiens
cctttctagttgaaa

SEQ ID NO: 1401827 - DNA, 16 bp, Homo sapiens
cctttgcccagaaaga

SEQ ID NO: 1401828 - DNA, 15 bp, Homo sapiens
cgaactccttgattt

SEQ ID NO: 1401829 - DNA, 15 bp, Homo sapiens
cgaagcgttgtcctc

SEQ ID NO: 1401830 - DNA, 16 bp, Homo sapiens
cgaagcgttgtcctca

SEQ ID NO: 1401831 - DNA, 12 bp, Homo sapiens
cgaatgacactg

SEQ ID NO: 1401832 - DNA, 16 bp, Homo sapiens
cgaatgacactgttca

SEQ ID NO: 1401833 - DNA, 15 bp, Homo sapiens
cgagtaatatgcctg

SEQ ID NO: 1401834 - DNA, 11 bp, Homo sapiens
cgattagactg

SEQ ID NO: 1401835 - DNA, 12 bp, Homo sapiens
cgcggctgggag

SEQ ID NO: 1401836 - DNA, 16 bp, Homo sapiens
cgcggctgggaggagg

SEQ ID NO: 1401837 - DNA, 21 bp, Homo sapiens
cgctatctccctgcctcctgc

SEQ ID NO: 1401838 - DNA, 14 bp, Homo sapiens
cgctctctccaggc

SEQ ID NO: 1401839 - DNA, 16 bp, Homo sapiens
cgctgtcctttctaga

SEQ ID NO: 1401840 - DNA, 11 bp, Homo sapiens
cgctttttgaa

SEQ ID NO: 1401841 - DNA, 19 bp, Homo sapiens
ctccaaggaggggctgtaa

SEQ ID NO: 1401842 - DNA, 21 bp, Homo sapiens
ctccagccatcaagagactga

SEQ ID NO: 1401843 - DNA, 11 bp, Homo sapiens
ctccatccctg

SEQ ID NO: 1401844 - DNA, 24 bp, Homo sapiens
ctccatccctggccccctccctgg

SEQ ID NO: 1401845 - DNA, 20 bp, Homo sapiens
ctccatcctaccccctgtgc

SEQ ID NO: 1401846 - DNA, 22 bp, Homo sapiens
ctcccaccactccactcctcca

SEQ ID NO: 1401847 - DNA, 22 bp, Homo sapiens
ctcccatgcacacaaacacctc

SEQ ID NO: 1401848 - DNA, 16 bp, Homo sapiens
ctcccatgcctggtcc

SEQ ID NO: 1401849 - DNA, 21 bp, Homo sapiens
ctcccatgcctggtcccaaga

SEQ ID NO: 1401850 - DNA, 11 bp, Homo sapiens
ctccccctgcc

SEQ ID NO: 1401851 - DNA, 15 bp, Homo sapiens
ctcccctccatccct

SEQ ID NO: 1401852 - DNA, 19 bp, Homo sapiens
ctcccctccatccctggcc

SEQ ID NO: 1401853 - DNA, 13 bp, Homo sapiens
ctccctcctctgc

SEQ ID NO: 1401854 - DNA, 12 bp, Homo sapiens
ctccctggatga

SEQ ID NO: 1401855 - DNA, 17 bp, Homo sapiens
ctcctaaagtactggga

SEQ ID NO: 1401856 - DNA, 21 bp, Homo sapiens
ctcctaattaagggacatgta

SEQ ID NO: 1401857 - DNA, 15 bp, Homo sapiens
ctcctcaacccctcc

SEQ ID NO: 1401858 - DNA, 21 bp, Homo sapiens
ctcctcaacccctcccctcca

SEQ ID NO: 1401859 - DNA, 21 bp, Homo sapiens
ctcctcacccccagctttgct

SEQ ID NO: 1401860 - DNA, 17 bp, Homo sapiens
ctcctcgagatcccaac

SEQ ID NO: 1401861 - DNA, 21 bp, Homo sapiens
ctcctcgagatcccaacactg

SEQ ID NO: 1401862 - DNA, 12 bp, Homo sapiens
ctcctgcctgtg

SEQ ID NO: 1401863 - DNA, 15 bp, Homo sapiens
ctcctgcctgtgttt

SEQ ID NO: 1401864 - DNA, 21 bp, Homo sapiens
ctccttcaacaattctaaaat

SEQ ID NO: 1401865 - DNA, 18 bp, Homo sapiens
ctcgctgtcctttctaga

SEQ ID NO: 1401866 - DNA, 16 bp, Homo sapiens
ctcgtaagatttcctt

SEQ ID NO: 1401867 - DNA, 13 bp, Homo sapiens
ctcgtatagcatg

SEQ ID NO: 1401868 - DNA, 12 bp, Homo sapiens
ctctaagaaaga

SEQ ID NO: 1401869 - DNA, 16 bp, Homo sapiens
ctctacaaactcccac

SEQ ID NO: 1401870 - DNA, 16 bp, Homo sapiens
ctctagacactgccac

SEQ ID NO: 1401871 - DNA, 13 bp, Homo sapiens
ctctaggaaatgt

SEQ ID NO: 1401872 - DNA, 17 bp, Homo sapiens
ctctcatcaactgaatg

SEQ ID NO: 1401873 - DNA, 18 bp, Homo sapiens
ctctcatcaactgaatga

SEQ ID NO: 1401874 - DNA, 19 bp, Homo sapiens
ctctccactcatgtgactc

SEQ ID NO: 1401875 - DNA, 22 bp, Homo sapiens
ctctctgcaggtccctaataaa

SEQ ID NO: 1401876 - DNA, 19 bp, Homo sapiens
ctctctgtgggctggcagt

SEQ ID NO: 1401877 - DNA, 13 bp, Homo sapiens
ctctgaacacatt

SEQ ID NO: 1401878 - DNA, 20 bp, Homo sapiens
ctctgattatcaggtactgg

SEQ ID NO: 1401879 - DNA, 20 bp, Homo sapiens
ctctgattttcaaagctttt

SEQ ID NO: 1401880 - DNA, 19 bp, Homo sapiens
ctctgccccttctgtttcc

SEQ ID NO: 1401881 - DNA, 20 bp, Homo sapiens
ctctgcccgggagctcagga

SEQ ID NO: 1401882 - DNA, 19 bp, Homo sapiens
ctctggagcccactgtact

SEQ ID NO: 1401883 - DNA, 16 bp, Homo sapiens
ctctggggggtggcca

SEQ ID NO: 1401884 - DNA, 20 bp, Homo sapiens
ctctggggggtggccaggcc

SEQ ID NO: 1401885 - DNA, 21 bp, Homo sapiens
ctctgtaaagctaaaataaag

SEQ ID NO: 1401886 - DNA, 19 bp, Homo sapiens
ctctgtaattgaatattat

SEQ ID NO: 1401887 - DNA, 13 bp, Homo sapiens
ctctgtcttctgg

SEQ ID NO: 1401888 - DNA, 17 bp, Homo sapiens
ctctgtgtgcacaaata

SEQ ID NO: 1401889 - DNA, 17 bp, Homo sapiens
ctctgttcatttcctca

SEQ ID NO: 1401890 - DNA, 13 bp, Homo sapiens
ctcttagctgtct

SEQ ID NO: 1401891 - DNA, 14 bp, Homo sapiens
ctcttattgcctca

SEQ ID NO: 1401892 - DNA, 18 bp, Homo sapiens
ctcttgcctcaacctccc

SEQ ID NO: 1401893 - DNA, 20 bp, Homo sapiens
ctcttgcctcaacctcccaa

SEQ ID NO: 1401894 - DNA, 22 bp, Homo sapiens
ctcttttcctttggtccttcaa

SEQ ID NO: 1401895 - DNA, 12 bp, Homo sapiens
ctctttttccaa

SEQ ID NO: 1401896 - DNA, 12 bp, Homo sapiens
ctgaaaatgtgc

SEQ ID NO: 1401897 - DNA, 14 bp, Homo sapiens
ctgaaagagaaaca

SEQ ID NO: 1401898 - DNA, 18 bp, Homo sapiens
ctgaaatcaattaaaagt

SEQ ID NO: 1401899 - DNA, 13 bp, Homo sapiens
ctgaaatttcaga

SEQ ID NO: 1401900 - DNA, 13 bp, Homo sapiens
ctgaacaagaatt

SEQ ID NO: 1401901 - DNA, 11 bp, Homo sapiens
ctgaacaccat

SEQ ID NO: 1401902 - DNA, 18 bp, Homo sapiens
ctgaacaccattgaaggc

SEQ ID NO: 1401903 - DNA, 19 bp, Homo sapiens
ctgaacaccattgaaggct

SEQ ID NO: 1401904 - DNA, 18 bp, Homo sapiens
ctgaactcaaactgagga

SEQ ID NO: 1401905 - DNA, 23 bp, Homo sapiens
ctgaagacaccgttcattcaggc

SEQ ID NO: 1401906 - DNA, 20 bp, Homo sapiens
ctgaatgaggtcagcatgtc

SEQ ID NO: 1401907 - DNA, 14 bp, Homo sapiens
ctgaatttttaaaa

SEQ ID NO: 1401908 - DNA, 18 bp, Homo sapiens
ctgaatttttaaacaagt

SEQ ID NO: 1401909 - DNA, 18 bp, Homo sapiens
ctgaccctcatctttctt

SEQ ID NO: 1401910 - DNA, 18 bp, Homo sapiens
ctgactagggagccatgt

SEQ ID NO: 1401911 - DNA, 22 bp, Homo sapiens
ctgactcacacctgaactgaac

SEQ ID NO: 1401912 - DNA, 21 bp, Homo sapiens
ctgagaccaaggctttctcta

SEQ ID NO: 1401913 - DNA, 13 bp, Homo sapiens
ctgagagaggcca

SEQ ID NO: 1401914 - DNA, 21 bp, Homo sapiens
ctgagagaggccattctttcc

SEQ ID NO: 1401915 - DNA, 19 bp, Homo sapiens
ctgagagatgcagaaatat

SEQ ID NO: 1401916 - DNA, 17 bp, Homo sapiens
ctgagatacatacagaa

SEQ ID NO: 1401917 - DNA, 16 bp, Homo sapiens
ctgagatatgaacata

SEQ ID NO: 1401918 - DNA, 19 bp, Homo sapiens
ctgagcccggtaagagcaa

SEQ ID NO: 1401919 - DNA, 15 bp, Homo sapiens
ctgaggctcagccct

SEQ ID NO: 1401920 - DNA, 16 bp, Homo sapiens
ctgaggctcagcccta

SEQ ID NO: 1401921 - DNA, 21 bp, Homo sapiens
ctgagggcattaaaaatagta

SEQ ID NO: 1401922 - DNA, 16 bp, Homo sapiens
ctgagtcaagttgttc

SEQ ID NO: 1401923 - DNA, 19 bp, Homo sapiens
ctgatagggtttgtgacag

SEQ ID NO: 1401924 - DNA, 16 bp, Homo sapiens
ctgatatattttacaa

SEQ ID NO: 1401925 - DNA, 15 bp, Homo sapiens
ctgatattttctcta

SEQ ID NO: 1401926 - DNA, 16 bp, Homo sapiens
ctgatattttctctag

SEQ ID NO: 1401927 - DNA, 18 bp, Homo sapiens
ctgatattttctctagga

SEQ ID NO: 1401928 - DNA, 12 bp, Homo sapiens
ctgatcaaggcc

SEQ ID NO: 1401929 - DNA, 18 bp, Homo sapiens
ctgatgaaaataaagaat

SEQ ID NO: 1401930 - DNA, 20 bp, Homo sapiens
ctgatgaaaataaagaatgg

SEQ ID NO: 1401931 - DNA, 17 bp, Homo sapiens
ctgattcacatctcatt

SEQ ID NO: 1401932 - DNA, 18 bp, Homo sapiens
ctgattcattcttaacaa

SEQ ID NO: 1401933 - DNA, 17 bp, Homo sapiens
ctgattcgaatgacact

SEQ ID NO: 1401934 - DNA, 19 bp, Homo sapiens
ctgattcgaatgacactgt

SEQ ID NO: 1401935 - DNA, 18 bp, Homo sapiens
ctgcaaacctgacccctg

SEQ ID NO: 1401936 - DNA, 17 bp, Homo sapiens
ctgcaacctccacctcc

SEQ ID NO: 1401937 - DNA, 15 bp, Homo sapiens
ctgcacaataaaaat

SEQ ID NO: 1401938 - DNA, 16 bp, Homo sapiens
ctgcaccggggcctgg

SEQ ID NO: 1401939 - DNA, 14 bp, Homo sapiens
ctgcaggaatcttt

SEQ ID NO: 1401940 - DNA, 20 bp, Homo sapiens
ctgcagggggtgtgtctgct

SEQ ID NO: 1401941 - DNA, 12 bp, Homo sapiens
ctgcaggtccct

SEQ ID NO: 1401942 - DNA, 13 bp, Homo sapiens
ctgcaggtcccta

SEQ ID NO: 1401943 - DNA, 14 bp, Homo sapiens
ctgcaggtccctaa

SEQ ID NO: 1401944 - DNA, 16 bp, Homo sapiens
ctgcaggtccctaata

SEQ ID NO: 1401945 - DNA, 20 bp, Homo sapiens
ctgccaagactgctgtggcc

SEQ ID NO: 1401946 - DNA, 20 bp, Homo sapiens
ctgccagcatttcccttcct

SEQ ID NO: 1401947 - DNA, 11 bp, Homo sapiens
ctgccaggaga

SEQ ID NO: 1401948 - DNA, 16 bp, Homo sapiens
ctgccaggagacaggt

SEQ ID NO: 1401949 - DNA, 21 bp, Homo sapiens
ctgccaggaggacccagggct

SEQ ID NO: 1401950 - DNA, 23 bp, Homo sapiens
ctgccaggaggacccagggctct

SEQ ID NO: 1401951 - DNA, 14 bp, Homo sapiens
ctgcccaggcactg

SEQ ID NO: 1401952 - DNA, 19 bp, Homo sapiens
ctgcccagtgcacttgctg

SEQ ID NO: 1401953 - DNA, 21 bp, Homo sapiens
ctgcccagtgcacttgctgga

SEQ ID NO: 1401954 - DNA, 19 bp, Homo sapiens
ctgcccgggagctcaggaa

SEQ ID NO: 1401955 - DNA, 22 bp, Homo sapiens
ctgccgagagtccatcagcctc

SEQ ID NO: 1401956 - DNA, 11 bp, Homo sapiens
ctgcctcccat

SEQ ID NO: 1401957 - DNA, 19 bp, Homo sapiens
ctgcctgtgtttgtgtgga

SEQ ID NO: 1401958 - DNA, 19 bp, Homo sapiens
ctgcggcagcccctcccag

SEQ ID NO: 1401959 - DNA, 23 bp, Homo sapiens
ctgcggcagcccctcccagccta

SEQ ID NO: 1401960 - DNA, 15 bp, Homo sapiens
ctgctatcattattc

SEQ ID NO: 1401961 - DNA, 20 bp, Homo sapiens
ctgctgagatacatacagaa

SEQ ID NO: 1401962 - DNA, 14 bp, Homo sapiens
ctgctgatattttc

SEQ ID NO: 1401963 - DNA, 19 bp, Homo sapiens
ctgctgatattttctctag

SEQ ID NO: 1401964 - DNA, 14 bp, Homo sapiens
ctgctgtggccagg

SEQ ID NO: 1401965 - DNA, 16 bp, Homo sapiens
ctgctgtggccaggag

SEQ ID NO: 1401966 - DNA, 19 bp, Homo sapiens
ctgcttcagtgtatggaaa

SEQ ID NO: 1401967 - DNA, 21 bp, Homo sapiens
ctgcttgatgggattctggac

SEQ ID NO: 1401968 - DNA, 16 bp, Homo sapiens
ctgcttggagctgagc

SEQ ID NO: 1401969 - DNA, 16 bp, Homo sapiens
ctggaactgtctctca

SEQ ID NO: 1401970 - DNA, 18 bp, Homo sapiens
ctggaactgtctctcatg

SEQ ID NO: 1401971 - DNA, 19 bp, Homo sapiens
cttgaagttctgaaattta

SEQ ID NO: 1401972 - DNA, 16 bp, Homo sapiens
cttgacaactggcagg

SEQ ID NO: 1401973 - DNA, 14 bp, Homo sapiens
cttgaccctgagct

SEQ ID NO: 1401974 - DNA, 18 bp, Homo sapiens
cttgaggggaccaggagt

SEQ ID NO: 1401975 - DNA, 14 bp, Homo sapiens
cttgatagaaatgc

SEQ ID NO: 1401976 - DNA, 22 bp, Homo sapiens
cttgatagaaatgccaagcact

SEQ ID NO: 1401977 - DNA, 13 bp, Homo sapiens
cttgatgcctggc

SEQ ID NO: 1401978 - DNA, 19 bp, Homo sapiens
cttgatgggattctggaca

SEQ ID NO: 1401979 - DNA, 22 bp, Homo sapiens
cttgggaaaggtggtgtttctg

SEQ ID NO: 1401980 - DNA, 18 bp, Homo sapiens
cttgggaatggatcctgg

SEQ ID NO: 1401981 - DNA, 23 bp, Homo sapiens
cttgtaaattattaatttatgca

SEQ ID NO: 1401982 - DNA, 16 bp, Homo sapiens
cttgtcacgccagact

SEQ ID NO: 1401983 - DNA, 15 bp, Homo sapiens
cttgtcactggtaga

SEQ ID NO: 1401984 - DNA, 22 bp, Homo sapiens
cttgtcattgttatataatcat

SEQ ID NO: 1401985 - DNA, 20 bp, Homo sapiens
cttgtgaatcaagggtcagg

SEQ ID NO: 1401986 - DNA, 18 bp, Homo sapiens
cttgtgtctctgtgcttt

SEQ ID NO: 1401987 - DNA, 21 bp, Homo sapiens
cttgtgtctctgtgcttttaa

SEQ ID NO: 1401988 - DNA, 16 bp, Homo sapiens
ctttaaaatgtaaagc

SEQ ID NO: 1401989 - DNA, 14 bp, Homo sapiens
ctttaaagacttaa

SEQ ID NO: 1401990 - DNA, 16 bp, Homo sapiens
ctttaaagacttaaga

SEQ ID NO: 1401991 - DNA, 21 bp, Homo sapiens
ctttaaagacttaagattaaa

SEQ ID NO: 1401992 - DNA, 18 bp, Homo sapiens
ctttaatactcacctcct

SEQ ID NO: 1401993 - DNA, 20 bp, Homo sapiens
ctttaatactcacctcctcc

SEQ ID NO: 1401994 - DNA, 19 bp, Homo sapiens
ctttaattaccaacctgtt

SEQ ID NO: 1401995 - DNA, 14 bp, Homo sapiens
ctttattaaaaact

SEQ ID NO: 1401996 - DNA, 13 bp, Homo sapiens
ctttcccaacacc

SEQ ID NO: 1401997 - DNA, 21 bp, Homo sapiens
ctttctacacctgttgcacct

SEQ ID NO: 1401998 - DNA, 17 bp, Homo sapiens
ctttctcagttttcata

SEQ ID NO: 1401999 - DNA, 16 bp, Homo sapiens
ctttctgatcaaggcc

SEQ ID NO: 1402000 - DNA, 20 bp, Homo sapiens
ctttctgatcaaggccttat

SEQ ID NO: 1402001 - DNA, 19 bp, Homo sapiens
ctttcttccaaacaggctc

SEQ ID NO: 1402002 - DNA, 13 bp, Homo sapiens
ctttgaaacagaa

SEQ ID NO: 1402003 - DNA, 18 bp, Homo sapiens
ctttgaatcctctctctg

SEQ ID NO: 1402004 - DNA, 17 bp, Homo sapiens
ctttgataaagtaaaaa

SEQ ID NO: 1402005 - DNA, 20 bp, Homo sapiens
ctttgataaagtaaaaaagt

SEQ ID NO: 1402006 - DNA, 18 bp, Homo sapiens
ctttgcacagctctccgg

SEQ ID NO: 1402007 - DNA, 17 bp, Homo sapiens
ctttggacctaatccaa

SEQ ID NO: 1402008 - DNA, 20 bp, Homo sapiens
ctttggggagcaggaggcca

SEQ ID NO: 1402009 - DNA, 14 bp, Homo sapiens
ctttggtccttcaa

SEQ ID NO: 1402010 - DNA, 23 bp, Homo sapiens
ctttgtgattcaatctgtaaact

SEQ ID NO: 1402011 - DNA, 22 bp, Homo sapiens
cttttaacagagtctgaaccta

SEQ ID NO: 1402012 - DNA, 18 bp, Homo sapiens
cttttaatatgctgtggg

SEQ ID NO: 1402013 - DNA, 15 bp, Homo sapiens
cttttaatgaacaaa

SEQ ID NO: 1402014 - DNA, 18 bp, Homo sapiens
cttttaatgaacaaatgg

SEQ ID NO: 1402015 - DNA, 21 bp, Homo sapiens
cttttataggatttatttaaa

SEQ ID NO: 1402016 - DNA, 22 bp, Homo sapiens
cttttcaaatagggtctaactc

SEQ ID NO: 1402017 - DNA, 22 bp, Homo sapiens
cttttcccaaaatgttgaaata

SEQ ID NO: 1402018 - DNA, 18 bp, Homo sapiens
cttttcccactgtttaag

SEQ ID NO: 1402019 - DNA, 18 bp, Homo sapiens
cttttgggggtcaacagt

SEQ ID NO: 1402020 - DNA, 20 bp, Homo sapiens
cttttgtaagacaaaggttt

SEQ ID NO: 1402021 - DNA, 13 bp, Homo sapiens
ctttttatttgca

SEQ ID NO: 1402022 - DNA, 17 bp, Homo sapiens
ctttttattttaaccag

SEQ ID NO: 1402023 - DNA, 23 bp, Homo sapiens
ctttttattttaaccagttattt

SEQ ID NO: 1402024 - DNA, 18 bp, Homo sapiens
cttttttaaatgaagaaa

SEQ ID NO: 1402025 - DNA, 16 bp, Homo sapiens
ctttttttagagaagt

SEQ ID NO: 1402026 - DNA, 14 bp, Homo sapiens
gaaaaagaagaatc

SEQ ID NO: 1402027 - DNA, 13 bp, Homo sapiens
gaaaacaaaactg

SEQ ID NO: 1402028 - DNA, 11 bp, Homo sapiens
gaaaacctttc

SEQ ID NO: 1402029 - DNA, 22 bp, Homo sapiens
gaaaacttcaaggaaaataagt

SEQ ID NO: 1402030 - DNA, 12 bp, Homo sapiens
gaaaactttaaa

SEQ ID NO: 1402031 - DNA, 23 bp, Homo sapiens
gaaaagctagaattgagtgttta

SEQ ID NO: 1402032 - DNA, 22 bp, Homo sapiens
gaaaaggtttatgaaaaagaag

SEQ ID NO: 1402033 - DNA, 17 bp, Homo sapiens
gaaaataagagctcagg

SEQ ID NO: 1402034 - DNA, 12 bp, Homo sapiens
gaaaataagtga

SEQ ID NO: 1402035 - DNA, 16 bp, Homo sapiens
gaaaataagtgaaatt

SEQ ID NO: 1402036 - DNA, 14 bp, Homo sapiens
gaaacaaaaacact

SEQ ID NO: 1402037 - DNA, 14 bp, Homo sapiens
gaaacagaaacaaa

SEQ ID NO: 1402038 - DNA, 13 bp, Homo sapiens
gaaacatttatat

SEQ ID NO: 1402039 - DNA, 19 bp, Homo sapiens
gaaacctactgcccaggca

SEQ ID NO: 1402040 - DNA, 13 bp, Homo sapiens
gaaaccttgaagt

SEQ ID NO: 1402041 - DNA, 18 bp, Homo sapiens
gaaactgaggaattttct

SEQ ID NO: 1402042 - DNA, 22 bp, Homo sapiens
gaaactgaggaattttctttgt

SEQ ID NO: 1402043 - DNA, 18 bp, Homo sapiens
gaaagcagttgagacaag

SEQ ID NO: 1402044 - DNA, 14 bp, Homo sapiens
gaaaggtggtgttt

SEQ ID NO: 1402045 - DNA, 21 bp, Homo sapiens
gaaataagtttttgtttcaca

SEQ ID NO: 1402046 - DNA, 18 bp, Homo sapiens
gaaatacaaaaatactca

SEQ ID NO: 1402047 - DNA, 17 bp, Homo sapiens
gaaatactactgtgtaa

SEQ ID NO: 1402048 - DNA, 21 bp, Homo sapiens
gaaatatacttttacaagtaa

SEQ ID NO: 1402049 - DNA, 19 bp, Homo sapiens
gaaatatcttcacttgtca

SEQ ID NO: 1402050 - DNA, 15 bp, Homo sapiens
gaaatcaacttgctt

SEQ ID NO: 1402051 - DNA, 15 bp, Homo sapiens
gaaatgaattaaagt

SEQ ID NO: 1402052 - DNA, 17 bp, Homo sapiens
gaaattacacccaaaga

SEQ ID NO: 1402053 - DNA, 17 bp, Homo sapiens
gaaattgcctgacgaac

SEQ ID NO: 1402054 - DNA, 16 bp, Homo sapiens
gaaattggaagagcac

SEQ ID NO: 1402055 - DNA, 14 bp, Homo sapiens
gaaatttaaactat

SEQ ID NO: 1402056 - DNA, 22 bp, Homo sapiens
gaaatttaactgcctaaaatgt

SEQ ID NO: 1402057 - DNA, 21 bp, Homo sapiens
gaaatttcagattcccagagc

SEQ ID NO: 1402058 - DNA, 23 bp, Homo sapiens
gaaatttcagattcccagagcaa

SEQ ID NO: 1402059 - DNA, 14 bp, Homo sapiens
gaaattttaaaagt

SEQ ID NO: 1402060 - DNA, 22 bp, Homo sapiens
gaaattttaacctatgatattt

SEQ ID NO: 1402061 - DNA, 20 bp, Homo sapiens
gaacaccataggtagaatgt

SEQ ID NO: 1402062 - DNA, 19 bp, Homo sapiens
gaacaccattgaaggctta

SEQ ID NO: 1402063 - DNA, 23 bp, Homo sapiens
gaacagaacatagacagaagaaa

SEQ ID NO: 1402064 - DNA, 18 bp, Homo sapiens
gaacagataatccctgta

SEQ ID NO: 1402065 - DNA, 21 bp, Homo sapiens
gaacagcagactcagctctga

SEQ ID NO: 1402066 - DNA, 16 bp, Homo sapiens
gaacatagacagaaga

SEQ ID NO: 1402067 - DNA, 15 bp, Homo sapiens
gaaccgaggcaggga

SEQ ID NO: 1402068 - DNA, 16 bp, Homo sapiens
gaacctgatgaaaata

SEQ ID NO: 1402069 - DNA, 16 bp, Homo sapiens
gaacttgaactgattc

SEQ ID NO: 1402070 - DNA, 23 bp, Homo sapiens
gaagaatacttctcattttttaa

SEQ ID NO: 1402071 - DNA, 21 bp, Homo sapiens
gaagaatctcatctcagtgaa

SEQ ID NO: 1402072 - DNA, 24 bp, Homo sapiens
gaagaatgcttaatcagatagata

SEQ ID NO: 1402073 - DNA, 10 bp, Homo sapiens
gaagaggact

SEQ ID NO: 1402074 - DNA, 11 bp, Homo sapiens
gaagcatccag

SEQ ID NO: 1402075 - DNA, 18 bp, Homo sapiens
gaagcctaaataaaaagt

SEQ ID NO: 1402076 - DNA, 20 bp, Homo sapiens
gaagctttactttagaattt

SEQ ID NO: 1402077 - DNA, 20 bp, Homo sapiens
gaagctttggtgagaacctg

SEQ ID NO: 1402078 - DNA, 21 bp, Homo sapiens
gaaggatcccatgagctcctt

SEQ ID NO: 1402079 - DNA, 15 bp, Homo sapiens
gaagggcttgaattg

SEQ ID NO: 1402080 - DNA, 15 bp, Homo sapiens
gaagttctgaaattt

SEQ ID NO: 1402081 - DNA, 20 bp, Homo sapiens
gaagttgtgaaactaaaatt

SEQ ID NO: 1402082 - DNA, 14 bp, Homo sapiens
gaataagtgtacat

SEQ ID NO: 1402083 - DNA, 18 bp, Homo sapiens
gaataatcacgctttcct

SEQ ID NO: 1402084 - DNA, 19 bp, Homo sapiens
gaataatcacgctttcctg

SEQ ID NO: 1402085 - DNA, 22 bp, Homo sapiens
gaatatatatggaataagtgta

SEQ ID NO: 1402086 - DNA, 23 bp, Homo sapiens
gaatattttgttttgtgcagaga

SEQ ID NO: 1402087 - DNA, 14 bp, Homo sapiens
gaatcatgttggat

SEQ ID NO: 1402088 - DNA, 13 bp, Homo sapiens
gaatctatattta

SEQ ID NO: 1402089 - DNA, 23 bp, Homo sapiens
gaatctcagttgattttctggat

SEQ ID NO: 1402090 - DNA, 21 bp, Homo sapiens
gaatcttaaggtgtagccaca

SEQ ID NO: 1402091 - DNA, 22 bp, Homo sapiens
gaatcttaaggtgtagccacac

SEQ ID NO: 1402092 - DNA, 23 bp, Homo sapiens
gaatcttggtttgccttccagaa

SEQ ID NO: 1402093 - DNA, 19 bp, Homo sapiens
gaatggctatgtttttaat

SEQ ID NO: 1402094 - DNA, 18 bp, Homo sapiens
gaatgtgataaggaaatc

SEQ ID NO: 1402095 - DNA, 22 bp, Homo sapiens
gaattaaagtggaccaataggg

SEQ ID NO: 1402096 - DNA, 12 bp, Homo sapiens
gaattaaataaa

SEQ ID NO: 1402097 - DNA, 20 bp, Homo sapiens
gaattaaataaacccttcct

SEQ ID NO: 1402098 - DNA, 20 bp, Homo sapiens
gaattataactggaaagaag

SEQ ID NO: 1402099 - DNA, 15 bp, Homo sapiens
gaattgagtgtttaa

SEQ ID NO: 1402100 - DNA, 16 bp, Homo sapiens
gccctcagcccacctg

SEQ ID NO: 1402101 - DNA, 20 bp, Homo sapiens
gccctctcccatgcacacaa

SEQ ID NO: 1402102 - DNA, 12 bp, Homo sapiens
gccctggactgt

SEQ ID NO: 1402103 - DNA, 16 bp, Homo sapiens
gccctggactgtgtgc

SEQ ID NO: 1402104 - DNA, 13 bp, Homo sapiens
gccctgggaggct

SEQ ID NO: 1402105 - DNA, 23 bp, Homo sapiens
gccctggtggtggctcgggaggc

SEQ ID NO: 1402106 - DNA, 18 bp, Homo sapiens
gcccttattttcaagaaa

SEQ ID NO: 1402107 - DNA, 21 bp, Homo sapiens
gccgagagtccatcagcctcc

SEQ ID NO: 1402108 - DNA, 20 bp, Homo sapiens
gccgctatgcagggtagcac

SEQ ID NO: 1402109 - DNA, 17 bp, Homo sapiens
gccgtcagtgctgtgct

SEQ ID NO: 1402110 - DNA, 14 bp, Homo sapiens
gccgtgacgtctgg

SEQ ID NO: 1402111 - DNA, 22 bp, Homo sapiens
gccgtgacgtctgggtggccct

SEQ ID NO: 1402112 - DNA, 22 bp, Homo sapiens
gcctcaatttctgaacaccata

SEQ ID NO: 1402113 - DNA, 23 bp, Homo sapiens
gcctcacttttaatgaacaaatg

SEQ ID NO: 1402114 - DNA, 22 bp, Homo sapiens
gcctccaaggaggggctgtaaa

SEQ ID NO: 1402115 - DNA, 17 bp, Homo sapiens
gcctcctcacccccagc

SEQ ID NO: 1402116 - DNA, 18 bp, Homo sapiens
gcctcctcacccccagct

SEQ ID NO: 1402117 - DNA, 13 bp, Homo sapiens
gcctcctgccggc

SEQ ID NO: 1402118 - DNA, 17 bp, Homo sapiens
gcctcctgccggctcct

SEQ ID NO: 1402119 - DNA, 16 bp, Homo sapiens
gcctctcatcaactga

SEQ ID NO: 1402120 - DNA, 14 bp, Homo sapiens
gcctctctgcaggt

SEQ ID NO: 1402121 - DNA, 18 bp, Homo sapiens
gcctctctgcaggtccct

SEQ ID NO: 1402122 - DNA, 20 bp, Homo sapiens
gcctctctgcaggtccctaa

SEQ ID NO: 1402123 - DNA, 20 bp, Homo sapiens
gcctgactagggagccatgt

SEQ ID NO: 1402124 - DNA, 16 bp, Homo sapiens
gcctgcacaataaaaa

SEQ ID NO: 1402125 - DNA, 16 bp, Homo sapiens
gcctgcaggatctcac

SEQ ID NO: 1402126 - DNA, 12 bp, Homo sapiens
gcctgccaggag

SEQ ID NO: 1402127 - DNA, 14 bp, Homo sapiens
gcctgccaggagga

SEQ ID NO: 1402128 - DNA, 23 bp, Homo sapiens
gcctgccaggaggacccagggct

SEQ ID NO: 1402129 - DNA, 20 bp, Homo sapiens
gcctgctatttgaagtgtaa

SEQ ID NO: 1402130 - DNA, 14 bp, Homo sapiens
gcctggttagaggc

SEQ ID NO: 1402131 - DNA, 14 bp, Homo sapiens
gccttctctgttca

SEQ ID NO: 1402132 - DNA, 16 bp, Homo sapiens
gccttctctgttcatt

SEQ ID NO: 1402133 - DNA, 17 bp, Homo sapiens
gccttgcggctcctcag

SEQ ID NO: 1402134 - DNA, 20 bp, Homo sapiens
gccttgcggctcctcaggga

SEQ ID NO: 1402135 - DNA, 17 bp, Homo sapiens
gccttgggctccgtgtg

SEQ ID NO: 1402136 - DNA, 18 bp, Homo sapiens
gcgcggctgggaggaggg

SEQ ID NO: 1402137 - DNA, 15 bp, Homo sapiens
gcgctatctccctgc

SEQ ID NO: 1402138 - DNA, 20 bp, Homo sapiens
gcgctatctccctgcctcct

SEQ ID NO: 1402139 - DNA, 19 bp, Homo sapiens
gcggctgggaggagggcag

SEQ ID NO: 1402140 - DNA, 21 bp, Homo sapiens
gcgtggaactcgtgtctggca

SEQ ID NO: 1402141 - DNA, 16 bp, Homo sapiens
gcgtggtggtccctgg

SEQ ID NO: 1402142 - DNA, 17 bp, Homo sapiens
gctaaaataaagaaata

SEQ ID NO: 1402143 - DNA, 20 bp, Homo sapiens
gctaatttatcctgaaattt

SEQ ID NO: 1402144 - DNA, 19 bp, Homo sapiens
gctaatttttttgtatttt

SEQ ID NO: 1402145 - DNA, 21 bp, Homo sapiens
gctaatttttttgtattttag

SEQ ID NO: 1402146 - DNA, 13 bp, Homo sapiens
gctacataattta

SEQ ID NO: 1402147 - DNA, 16 bp, Homo sapiens
gctactttgctgctat

SEQ ID NO: 1402148 - DNA, 12 bp, Homo sapiens
gctaggaatgaa

SEQ ID NO: 1402149 - DNA, 18 bp, Homo sapiens
gctagggtggggagagac

SEQ ID NO: 1402150 - DNA, 12 bp, Homo sapiens
gctatctccctg

SEQ ID NO: 1402151 - DNA, 16 bp, Homo sapiens
gctatgtttttaatgt

SEQ ID NO: 1402152 - DNA, 18 bp, Homo sapiens
gctattattttcactgta

SEQ ID NO: 1402153 - DNA, 15 bp, Homo sapiens
gctatttcatctatt

SEQ ID NO: 1402154 - DNA, 18 bp, Homo sapiens
gctattttatattacact

SEQ ID NO: 1402155 - DNA, 20 bp, Homo sapiens
gctcacagtacaatgtttca

SEQ ID NO: 1402156 - DNA, 15 bp, Homo sapiens
gctcagatagaatga

SEQ ID NO: 1402157 - DNA, 16 bp, Homo sapiens
gctcagccctagccct

SEQ ID NO: 1402158 - DNA, 21 bp, Homo sapiens
gctcagccctagccctcagcc

SEQ ID NO: 1402159 - DNA, 23 bp, Homo sapiens
gctccgtccaggagcctgtgcct

SEQ ID NO: 1402160 - DNA, 23 bp, Homo sapiens
gctccgtgtgggagaccggcctg

SEQ ID NO: 1402161 - DNA, 21 bp, Homo sapiens
gctcctcaacccctcccctcc

SEQ ID NO: 1402162 - DNA, 15 bp, Homo sapiens
gctccttaaggctct

SEQ ID NO: 1402163 - DNA, 17 bp, Homo sapiens
gctccttaaggctcttt

SEQ ID NO: 1402164 - DNA, 21 bp, Homo sapiens
gctctactggtcttgtggaat

SEQ ID NO: 1402165 - DNA, 15 bp, Homo sapiens
gctctacttcttttt

SEQ ID NO: 1402166 - DNA, 23 bp, Homo sapiens
gctctagattgagagaagagaca

SEQ ID NO: 1402167 - DNA, 19 bp, Homo sapiens
gctctcgggttgtgtgtct

SEQ ID NO: 1402168 - DNA, 15 bp, Homo sapiens
gctctggagcccact

SEQ ID NO: 1402169 - DNA, 16 bp, Homo sapiens
gctctggagcccactg

SEQ ID NO: 1402170 - DNA, 19 bp, Homo sapiens
gctctgtctacttgctcag

SEQ ID NO: 1402171 - DNA, 21 bp, Homo sapiens
gctctgtctacttgctcaggt

SEQ ID NO: 1402172 - DNA, 14 bp, Homo sapiens
gctcttcatgtttc

SEQ ID NO: 1402173 - DNA, 21 bp, Homo sapiens
gctgaccagccgtgagcatgt

SEQ ID NO: 1402174 - DNA, 17 bp, Homo sapiens
gctgactcacacctgaa

SEQ ID NO: 1402175 - DNA, 9 bp, Homo sapiens
gctgagact

SEQ ID NO: 1402176 - DNA, 13 bp, Homo sapiens
gctgataatttta

SEQ ID NO: 1402177 - DNA, 19 bp, Homo sapiens
gctgataattttaaattct

SEQ ID NO: 1402178 - DNA, 20 bp, Homo sapiens
gctgattgtttatttttcta

SEQ ID NO: 1402179 - DNA, 21 bp, Homo sapiens
gctgattgtttatttttctat

SEQ ID NO: 1402180 - DNA, 13 bp, Homo sapiens
gctgatttctagg

SEQ ID NO: 1402181 - DNA, 19 bp, Homo sapiens
gctgctagagtgactcact

SEQ ID NO: 1402182 - DNA, 21 bp, Homo sapiens
gctggaagacgcaagggcctg

SEQ ID NO: 1402183 - DNA, 23 bp, Homo sapiens
gctggaagacgcaagggcctgat

SEQ ID NO: 1402184 - DNA, 19 bp, Homo sapiens
gctgggaggagggcaggca

SEQ ID NO: 1402185 - DNA, 22 bp, Homo sapiens
gctgggcccctgcctctctgca

SEQ ID NO: 1402186 - DNA, 23 bp, Homo sapiens
gctggggaaatcaaaagggccaa

SEQ ID NO: 1402187 - DNA, 19 bp, Homo sapiens
gctggggccaggctgggtc

SEQ ID NO: 1402188 - DNA, 16 bp, Homo sapiens
gctgtagtaggcattt

SEQ ID NO: 1402189 - DNA, 16 bp, Homo sapiens
gctgtgctatggtgct

SEQ ID NO: 1402190 - DNA, 17 bp, Homo sapiens
gctgtgctatggtgctc

SEQ ID NO: 1402191 - DNA, 14 bp, Homo sapiens
gctgtggccaggag

SEQ ID NO: 1402192 - DNA, 18 bp, Homo sapiens
gctgtggccaggaggtgc

SEQ ID NO: 1402193 - DNA, 19 bp, Homo sapiens
gctgtggcctaacctgccg

SEQ ID NO: 1402194 - DNA, 16 bp, Homo sapiens
gctgtgtggcagtctg

SEQ ID NO: 1402195 - DNA, 18 bp, Homo sapiens
gcttaaaactttgaagtt

SEQ ID NO: 1402196 - DNA, 12 bp, Homo sapiens
gcttccaatttt

SEQ ID NO: 1402197 - DNA, 14 bp, Homo sapiens
gcttccttcatttc

SEQ ID NO: 1402198 - DNA, 17 bp, Homo sapiens
gcttcgtttattttcaa

SEQ ID NO: 1402199 - DNA, 16 bp, Homo sapiens
gcttctagttctgcca

SEQ ID NO: 1402200 - DNA, 20 bp, Homo sapiens
gcttctagttctgccaggag

SEQ ID NO: 1402201 - DNA, 19 bp, Homo sapiens
gcttgaaacccgtggcgct

SEQ ID NO: 1402202 - DNA, 20 bp, Homo sapiens
gcttgatgggattctggaca

SEQ ID NO: 1402203 - DNA, 13 bp, Homo sapiens
gcttgttgtgctt

SEQ ID NO: 1402204 - DNA, 22 bp, Homo sapiens
gctttgtggcactggggcaggg

SEQ ID NO: 1402205 - DNA, 19 bp, Homo sapiens
gcttttaacagagtctgaa

SEQ ID NO: 1402206 - DNA, 12 bp, Homo sapiens
ggaaaaccagac

SEQ ID NO: 1402207 - DNA, 22 bp, Homo sapiens
ggaaaaccagactacttgggag

SEQ ID NO: 1402208 - DNA, 11 bp, Homo sapiens
ggaaaataagt

SEQ ID NO: 1402209 - DNA, 20 bp, Homo sapiens
ggaaaatgctatcaaataac

SEQ ID NO: 1402210 - DNA, 17 bp, Homo sapiens
ggaaattggaagagcac

SEQ ID NO: 1402211 - DNA, 20 bp, Homo sapiens
ggaacactagacaagccaga

SEQ ID NO: 1402212 - DNA, 21 bp, Homo sapiens
ggaacactagacaagccagaa

SEQ ID NO: 1402213 - DNA, 15 bp, Homo sapiens
ggaaccgaggcaggg

SEQ ID NO: 1402214 - DNA, 16 bp, Homo sapiens
ggaacttgaactgatt

SEQ ID NO: 1402215 - DNA, 14 bp, Homo sapiens
ggacaaagaacctt

SEQ ID NO: 1402216 - DNA, 21 bp, Homo sapiens
ggacacactgtaaacccctgg

SEQ ID NO: 1402217 - DNA, 17 bp, Homo sapiens
ggacaggatgtgtttgc

SEQ ID NO: 1402218 - DNA, 20 bp, Homo sapiens
ggaccacaactattttcaga

SEQ ID NO: 1402219 - DNA, 12 bp, Homo sapiens
ggaccagcctct

SEQ ID NO: 1402220 - DNA, 12 bp, Homo sapiens
ggagagaaaaaa

SEQ ID NO: 1402221 - DNA, 17 bp, Homo sapiens
ggagagagttgaaccta

SEQ ID NO: 1402222 - DNA, 20 bp, Homo sapiens
ggagagagttgaacctaaac

SEQ ID NO: 1402223 - DNA, 22 bp, Homo sapiens
ggagattctcataacttgagac

SEQ ID NO: 1402224 - DNA, 19 bp, Homo sapiens
ggagccctgggaggctctg

SEQ ID NO: 1402225 - DNA, 21 bp, Homo sapiens
ggagctcaggaaccgaggcag

SEQ ID NO: 1402226 - DNA, 18 bp, Homo sapiens
ggagctggttagaaatgc

SEQ ID NO: 1402227 - DNA, 23 bp, Homo sapiens
ggagctggttagaaatgcagaat

SEQ ID NO: 1402228 - DNA, 12 bp, Homo sapiens
ggaggacccagg

SEQ ID NO: 1402229 - DNA, 15 bp, Homo sapiens
gttgcagacaggaat

SEQ ID NO: 1402230 - DNA, 20 bp, Homo sapiens
gttgcagacaggaatcttaa

SEQ ID NO: 1402231 - DNA, 18 bp, Homo sapiens
gttgggactacaggcgtg

SEQ ID NO: 1402232 - DNA, 23 bp, Homo sapiens
gttgggagagggcgcaggccgtg

SEQ ID NO: 1402233 - DNA, 13 bp, Homo sapiens
gttgtttgtgcct

SEQ ID NO: 1402234 - DNA, 16 bp, Homo sapiens
gtttagaacacacaca

SEQ ID NO: 1402235 - DNA, 22 bp, Homo sapiens
gtttccatgggtcaaagccggt

SEQ ID NO: 1402236 - DNA, 18 bp, Homo sapiens
gtttccctactgaagccc

SEQ ID NO: 1402237 - DNA, 12 bp, Homo sapiens
gtttctgactct

SEQ ID NO: 1402238 - DNA, 22 bp, Homo sapiens
gtttcttaaataagaaactttt

SEQ ID NO: 1402239 - DNA, 12 bp, Homo sapiens
gtttctttcttt

SEQ ID NO: 1402240 - DNA, 16 bp, Homo sapiens
gtttgaggttaaaata

SEQ ID NO: 1402241 - DNA, 17 bp, Homo sapiens
gtttgcacctttctagt

SEQ ID NO: 1402242 - DNA, 17 bp, Homo sapiens
gtttgcactatctttca

SEQ ID NO: 1402243 - DNA, 17 bp, Homo sapiens
gtttgtgacagggcggg

SEQ ID NO: 1402244 - DNA, 13 bp, Homo sapiens
gttttacttttaa

SEQ ID NO: 1402245 - DNA, 21 bp, Homo sapiens
gttttcctatgctttgaaaca

SEQ ID NO: 1402246 - DNA, 18 bp, Homo sapiens
gttttctccaagagctac

SEQ ID NO: 1402247 - DNA, 18 bp, Homo sapiens
gttttctcctcccaggaa

SEQ ID NO: 1402248 - DNA, 18 bp, Homo sapiens
gtttttaatgtatagtaa

SEQ ID NO: 1402249 - DNA, 12 bp, Homo sapiens
gtttttcacatt

SEQ ID NO: 1402250 - DNA, 17 bp, Homo sapiens
taaaaaactaaaaacta

SEQ ID NO: 1402251 - DNA, 15 bp, Homo sapiens
taaaaaagtgttctg

SEQ ID NO: 1402252 - DNA, 18 bp, Homo sapiens
taaaaaagtgttctgtgt

SEQ ID NO: 1402253 - DNA, 17 bp, Homo sapiens
taaaaaagttaaatgtg

SEQ ID NO: 1402254 - DNA, 18 bp, Homo sapiens
taaaaaagttaaatgtgt

SEQ ID NO: 1402255 - DNA, 21 bp, Homo sapiens
taaaaactgagtgactctata

SEQ ID NO: 1402256 - DNA, 19 bp, Homo sapiens
taaaaagtaataaaattca

SEQ ID NO: 1402257 - DNA, 17 bp, Homo sapiens
taaaaagttcagagttc

SEQ ID NO: 1402258 - DNA, 19 bp, Homo sapiens
taaaaatgatttcagtagc

SEQ ID NO: 1402259 - DNA, 19 bp, Homo sapiens
taaaacccatttaaatttt

SEQ ID NO: 1402260 - DNA, 15 bp, Homo sapiens
taaaactttgaagtt

SEQ ID NO: 1402261 - DNA, 12 bp, Homo sapiens
taaaagcaaaaa

SEQ ID NO: 1402262 - DNA, 18 bp, Homo sapiens
taaaagcaaaaaagaaaa

SEQ ID NO: 1402263 - DNA, 19 bp, Homo sapiens
taaaagcaaaaaagaaaac

SEQ ID NO: 1402264 - DNA, 16 bp, Homo sapiens
taaaatagcaaaagaa

SEQ ID NO: 1402265 - DNA, 17 bp, Homo sapiens
taaaatagcaaaagaag

SEQ ID NO: 1402266 - DNA, 16 bp, Homo sapiens
taaaatattgttacta

SEQ ID NO: 1402267 - DNA, 17 bp, Homo sapiens
taaaatgccgattacac

SEQ ID NO: 1402268 - DNA, 18 bp, Homo sapiens
taaaatgtaaagccatgc

SEQ ID NO: 1402269 - DNA, 23 bp, Homo sapiens
taaaatgtaaagccatgctggaa

SEQ ID NO: 1402270 - DNA, 15 bp, Homo sapiens
taaaatgttctcctt

SEQ ID NO: 1402271 - DNA, 22 bp, Homo sapiens
taaaatgttctccttagatgtg

SEQ ID NO: 1402272 - DNA, 13 bp, Homo sapiens
taaacaaaggttg

SEQ ID NO: 1402273 - DNA, 13 bp, Homo sapiens
taaacaagtattt

SEQ ID NO: 1402274 - DNA, 23 bp, Homo sapiens
taaacaagtatttgttaatttag

SEQ ID NO: 1402275 - DNA, 17 bp, Homo sapiens
taaacatcattcatttt

SEQ ID NO: 1402276 - DNA, 23 bp, Homo sapiens
taaacccatattgtaaaacaggt

SEQ ID NO: 1402277 - DNA, 14 bp, Homo sapiens
taaacgtttgaaat

SEQ ID NO: 1402278 - DNA, 13 bp, Homo sapiens
taaactaaacacg

SEQ ID NO: 1402279 - DNA, 22 bp, Homo sapiens
taaactatcttggtgaattttt

SEQ ID NO: 1402280 - DNA, 14 bp, Homo sapiens
taaactcaaaatat

SEQ ID NO: 1402281 - DNA, 19 bp, Homo sapiens
taaactcaaaatatttgta

SEQ ID NO: 1402282 - DNA, 22 bp, Homo sapiens
taaactcaaaatatttgtacat

SEQ ID NO: 1402283 - DNA, 18 bp, Homo sapiens
taaactgtgtacataact

SEQ ID NO: 1402284 - DNA, 22 bp, Homo sapiens
taaactgtgtattccaagacat

SEQ ID NO: 1402285 - DNA, 14 bp, Homo sapiens
taaagaaaaacaaa

SEQ ID NO: 1402286 - DNA, 15 bp, Homo sapiens
taaagaaaaacaaac

SEQ ID NO: 1402287 - DNA, 20 bp, Homo sapiens
taaagacttaagattaaatt

SEQ ID NO: 1402288 - DNA, 18 bp, Homo sapiens
taaagatatttttatctt

SEQ ID NO: 1402289 - DNA, 12 bp, Homo sapiens
taaagatttttt

SEQ ID NO: 1402290 - DNA, 20 bp, Homo sapiens
taaagattttttaataattt

SEQ ID NO: 1402291 - DNA, 11 bp, Homo sapiens
taaataagaaa

SEQ ID NO: 1402292 - DNA, 16 bp, Homo sapiens
taaataagaaactttt

SEQ ID NO: 1402293 - DNA, 12 bp, Homo sapiens
taaatagtattt

SEQ ID NO: 1402294 - DNA, 13 bp, Homo sapiens
taaatagtatttc

SEQ ID NO: 1402295 - DNA, 23 bp, Homo sapiens
taaatataaaccagctacttgat

SEQ ID NO: 1402296 - DNA, 14 bp, Homo sapiens
taaatattttaaag

SEQ ID NO: 1402297 - DNA, 16 bp, Homo sapiens
taaatcacgctttttg

SEQ ID NO: 1402298 - DNA, 19 bp, Homo sapiens
taaatcacgctttttgaaa

SEQ ID NO: 1402299 - DNA, 13 bp, Homo sapiens
taaatcttttata

SEQ ID NO: 1402300 - DNA, 12 bp, Homo sapiens
taaatgaagaaa

SEQ ID NO: 1402301 - DNA, 15 bp, Homo sapiens
taaatttattttctt

SEQ ID NO: 1402302 - DNA, 14 bp, Homo sapiens
taaatttttttcct

SEQ ID NO: 1402303 - DNA, 16 bp, Homo sapiens
taaatttttttcctta

SEQ ID NO: 1402304 - DNA, 20 bp, Homo sapiens
taacaattaggcagactctt

SEQ ID NO: 1402305 - DNA, 13 bp, Homo sapiens
taacatctgagaa

SEQ ID NO: 1402306 - DNA, 22 bp, Homo sapiens
taaccagatctagtcaatcaag

SEQ ID NO: 1402307 - DNA, 22 bp, Homo sapiens
taactaggttgctactttattt

SEQ ID NO: 1402308 - DNA, 16 bp, Homo sapiens
taactcattagactgg

SEQ ID NO: 1402309 - DNA, 21 bp, Homo sapiens
taactgaaaatgtgctatact

SEQ ID NO: 1402310 - DNA, 20 bp, Homo sapiens
taactgcctaaaatgttctc

SEQ ID NO: 1402311 - DNA, 15 bp, Homo sapiens
taactggaaagaagt

SEQ ID NO: 1402312 - DNA, 17 bp, Homo sapiens
taactgggtaatgaaac

SEQ ID NO: 1402313 - DNA, 16 bp, Homo sapiens
taacttaaatagtatt

SEQ ID NO: 1402314 - DNA, 23 bp, Homo sapiens
taagaaacctactgcccaggcac

SEQ ID NO: 1402315 - DNA, 20 bp, Homo sapiens
taagagaagtagaaatcata

SEQ ID NO: 1402316 - DNA, 22 bp, Homo sapiens
taagagcaaaagaatggcagaa

SEQ ID NO: 1402317 - DNA, 14 bp, Homo sapiens
taagagctcaggat

SEQ ID NO: 1402318 - DNA, 17 bp, Homo sapiens
taagatacactcctgct

SEQ ID NO: 1402319 - DNA, 14 bp, Homo sapiens
taagattaaattat

SEQ ID NO: 1402320 - DNA, 23 bp, Homo sapiens
taagattaactggtagttcattg

SEQ ID NO: 1402321 - DNA, 16 bp, Homo sapiens
taagccaaaacaatgt

SEQ ID NO: 1402322 - DNA, 20 bp, Homo sapiens
taagcttttcttttctttgt

SEQ ID NO: 1402323 - DNA, 17 bp, Homo sapiens
taagtattatgtctctt

SEQ ID NO: 1402324 - DNA, 20 bp, Homo sapiens
taagtatttaggtttttgtt

SEQ ID NO: 1402325 - DNA, 16 bp, Homo sapiens
taagtgtacatatgta

SEQ ID NO: 1402326 - DNA, 22 bp, Homo sapiens
taagtgtacatatgtaaaatat

SEQ ID NO: 1402327 - DNA, 19 bp, Homo sapiens
taagttcaaattcttctga

SEQ ID NO: 1402328 - DNA, 20 bp, Homo sapiens
taagttcaaattcttctgaa

SEQ ID NO: 1402329 - DNA, 20 bp, Homo sapiens
taagttttttacttccacag

SEQ ID NO: 1402330 - DNA, 15 bp, Homo sapiens
taataaaattcaaca

SEQ ID NO: 1402331 - DNA, 16 bp, Homo sapiens
taatatatattatctt

SEQ ID NO: 1402332 - DNA, 19 bp, Homo sapiens
taatatatattatcttttc

SEQ ID NO: 1402333 - DNA, 12 bp, Homo sapiens
taatatcctaaa

SEQ ID NO: 1402334 - DNA, 14 bp, Homo sapiens
taatatcctaaaca

SEQ ID NO: 1402335 - DNA, 16 bp, Homo sapiens
taatattgatttatta

SEQ ID NO: 1402336 - DNA, 22 bp, Homo sapiens
taatcaggtcctcagagaattt

SEQ ID NO: 1402337 - DNA, 21 bp, Homo sapiens
taatcccagcatgctgagatt

SEQ ID NO: 1402338 - DNA, 22 bp, Homo sapiens
taatctagaacacaggcaaaat

SEQ ID NO: 1402339 - DNA, 20 bp, Homo sapiens
taatgcatgtggtatgagta

SEQ ID NO: 1402340 - DNA, 15 bp, Homo sapiens
taatgccttactctt

SEQ ID NO: 1402341 - DNA, 18 bp, Homo sapiens
taatggtgccttcatttg

SEQ ID NO: 1402342 - DNA, 21 bp, Homo sapiens
taatgttgggtagaaagagat

SEQ ID NO: 1402343 - DNA, 16 bp, Homo sapiens
taattaccaacctgtt

SEQ ID NO: 1402344 - DNA, 16 bp, Homo sapiens
taattcaattcaaagc

SEQ ID NO: 1402345 - DNA, 15 bp, Homo sapiens
taattctatgagata

SEQ ID NO: 1402346 - DNA, 18 bp, Homo sapiens
taattgtactaaagccaa

SEQ ID NO: 1402347 - DNA, 23 bp, Homo sapiens
taattgtactaaagccaaacata

SEQ ID NO: 1402348 - DNA, 14 bp, Homo sapiens
taatttagaaaact

SEQ ID NO: 1402349 - DNA, 15 bp, Homo sapiens
taatttagaaaactt

SEQ ID NO: 1402350 - DNA, 17 bp, Homo sapiens
taatttagaaaacttta

SEQ ID NO: 1402351 - DNA, 21 bp, Homo sapiens
taatttagaaaactttaaagc

SEQ ID NO: 1402352 - DNA, 14 bp, Homo sapiens
taatttagaaatca

SEQ ID NO: 1402353 - DNA, 21 bp, Homo sapiens
taatttagacttcaagcatgg

SEQ ID NO: 1402354 - DNA, 17 bp, Homo sapiens
taatttagtttcatata

SEQ ID NO: 1402355 - DNA, 13 bp, Homo sapiens
taatttataaaaa

SEQ ID NO: 1402356 - DNA, 14 bp, Homo sapiens
taattttaaacaaa

SEQ ID NO: 1402357 - DNA, 12 bp, Homo sapiens
taattttctacc

SEQ ID NO: 1402358 - DNA, 21 bp, Homo sapiens
taatttttgatactaagcatt

SEQ ID NO: 1402359 - DNA, 22 bp, Homo sapiens
tcagggggcctttaaagactta

SEQ ID NO: 1402360 - DNA, 16 bp, Homo sapiens
tcaggtcctcagagaa

SEQ ID NO: 1402361 - DNA, 14 bp, Homo sapiens
tcaggttgttctgt

SEQ ID NO: 1402362 - DNA, 15 bp, Homo sapiens
tcaggttgttctgta

SEQ ID NO: 1402363 - DNA, 20 bp, Homo sapiens
tcagtaatttagaaatcatt

SEQ ID NO: 1402364 - DNA, 15 bp, Homo sapiens
tcagtaatttgagga

SEQ ID NO: 1402365 - DNA, 18 bp, Homo sapiens
tcagtaatttgaggacaa

SEQ ID NO: 1402366 - DNA, 14 bp, Homo sapiens
tcagtgctgtgctg

SEQ ID NO: 1402367 - DNA, 16 bp, Homo sapiens
tcagtgctgtgctgtg

SEQ ID NO: 1402368 - DNA, 22 bp, Homo sapiens
tcagtgtagaacctaattcaat

SEQ ID NO: 1402369 - DNA, 21 bp, Homo sapiens
tcagtgtatggaaataaatgt

SEQ ID NO: 1402370 - DNA, 22 bp, Homo sapiens
tcagtgtatggaaataaatgta

SEQ ID NO: 1402371 - DNA, 17 bp, Homo sapiens
tcagttgattttctgga

SEQ ID NO: 1402372 - DNA, 21 bp, Homo sapiens
tcatacattttctaagaaaca

SEQ ID NO: 1402373 - DNA, 16 bp, Homo sapiens
tcatacgcatggtcct

SEQ ID NO: 1402374 - DNA, 23 bp, Homo sapiens
tcatagaaatgtaacttttgtaa

SEQ ID NO: 1402375 - DNA, 15 bp, Homo sapiens
tcatcaactgaatga

SEQ ID NO: 1402376 - DNA, 14 bp, Homo sapiens
tcatctttcttcca

SEQ ID NO: 1402377 - DNA, 12 bp, Homo sapiens
tcatgtaaaata

SEQ ID NO: 1402378 - DNA, 13 bp, Homo sapiens
tcatgtaaaataa

SEQ ID NO: 1402379 - DNA, 14 bp, Homo sapiens
tcatgtgactcttt

SEQ ID NO: 1402380 - DNA, 17 bp, Homo sapiens
tcatgtgactctttcca

SEQ ID NO: 1402381 - DNA, 15 bp, Homo sapiens
tcattaaatggggct

SEQ ID NO: 1402382 - DNA, 19 bp, Homo sapiens
tcattattacttttgctgt

SEQ ID NO: 1402383 - DNA, 20 bp, Homo sapiens
tcattcacatcgcagattct

SEQ ID NO: 1402384 - DNA, 15 bp, Homo sapiens
tcattctgaggcctg

SEQ ID NO: 1402385 - DNA, 15 bp, Homo sapiens
tcattttctctaata

SEQ ID NO: 1402386 - DNA, 16 bp, Homo sapiens
tccaaaagctttttat

SEQ ID NO: 1402387 - DNA, 21 bp, Homo sapiens
tccaaaataaaacctcagcta

SEQ ID NO: 1402388 - DNA, 12 bp, Homo sapiens
tccaaactaatt

SEQ ID NO: 1402389 - DNA, 16 bp, Homo sapiens
tccaaactaattttta

SEQ ID NO: 1402390 - DNA, 13 bp, Homo sapiens
tccaaactcctgc

SEQ ID NO: 1402391 - DNA, 14 bp, Homo sapiens
tccaaactcctgcc

SEQ ID NO: 1402392 - DNA, 15 bp, Homo sapiens
tccaaactcctgcct

SEQ ID NO: 1402393 - DNA, 16 bp, Homo sapiens
tccaaagcttcccacg

SEQ ID NO: 1402394 - DNA, 23 bp, Homo sapiens
tccaacttggctgcaggaatctt

SEQ ID NO: 1402395 - DNA, 17 bp, Homo sapiens
tccaagacatgtctgtt

SEQ ID NO: 1402396 - DNA, 20 bp, Homo sapiens
tccaagacatgtctgttcta

SEQ ID NO: 1402397 - DNA, 22 bp, Homo sapiens
tccaagacatgtctgttctaca

SEQ ID NO: 1402398 - DNA, 20 bp, Homo sapiens
tccaaggaggggctgtaaaa

SEQ ID NO: 1402399 - DNA, 16 bp, Homo sapiens
tccaattaaaattaag

SEQ ID NO: 1402400 - DNA, 22 bp, Homo sapiens
tccaattataagaggatatgaa

SEQ ID NO: 1402401 - DNA, 13 bp, Homo sapiens
tccagaaaacaaa

SEQ ID NO: 1402402 - DNA, 14 bp, Homo sapiens
tccagaaaacaaaa

SEQ ID NO: 1402403 - DNA, 23 bp, Homo sapiens
tccagactgcttccaattttctg

SEQ ID NO: 1402404 - DNA, 20 bp, Homo sapiens
tccagataagttatttataa

SEQ ID NO: 1402405 - DNA, 19 bp, Homo sapiens
tccagccatcaagagactg

SEQ ID NO: 1402406 - DNA, 15 bp, Homo sapiens
tccaggagcctgtgc

SEQ ID NO: 1402407 - DNA, 15 bp, Homo sapiens
tccagtcttcctgac

SEQ ID NO: 1402408 - DNA, 23 bp, Homo sapiens
tccagtcttcctgacactttaat

SEQ ID NO: 1402409 - DNA, 19 bp, Homo sapiens
tccagttcatgagaatcta

SEQ ID NO: 1402410 - DNA, 16 bp, Homo sapiens
tccatcctaccccctg

SEQ ID NO: 1402411 - DNA, 20 bp, Homo sapiens
tccatcctaccccctgtgcc

SEQ ID NO: 1402412 - DNA, 13 bp, Homo sapiens
tcccaaagtgctg

SEQ ID NO: 1402413 - DNA, 14 bp, Homo sapiens
tcccaacactgcca

SEQ ID NO: 1402414 - DNA, 16 bp, Homo sapiens
tcccaacactgccagc

SEQ ID NO: 1402415 - DNA, 13 bp, Homo sapiens
tcccaagagctac

SEQ ID NO: 1402416 - DNA, 16 bp, Homo sapiens
tcccaagtagaatctc

SEQ ID NO: 1402417 - DNA, 18 bp, Homo sapiens
tcccacaggttcaggcga

SEQ ID NO: 1402418 - DNA, 17 bp, Homo sapiens
tcccacggcctttctag

SEQ ID NO: 1402419 - DNA, 18 bp, Homo sapiens
tcccagaaccacactgtt

SEQ ID NO: 1402420 - DNA, 21 bp, Homo sapiens
tcccagcctacccctcctgcg

SEQ ID NO: 1402421 - DNA, 11 bp, Homo sapiens
tcccaggaact

SEQ ID NO: 1402422 - DNA, 16 bp, Homo sapiens
tcccaggaactgggcc

SEQ ID NO: 1402423 - DNA, 16 bp, Homo sapiens
tcccaggagacagttc

SEQ ID NO: 1402424 - DNA, 21 bp, Homo sapiens
tcccatgcacacaaacacctc

SEQ ID NO: 1402425 - DNA, 16 bp, Homo sapiens
tcccatgcctggtccc

SEQ ID NO: 1402426 - DNA, 13 bp, Homo sapiens
tcccatttcagct

SEQ ID NO: 1402427 - DNA, 15 bp, Homo sapiens
tccccactgtatcta

SEQ ID NO: 1402428 - DNA, 14 bp, Homo sapiens
tcccctccatccct

SEQ ID NO: 1402429 - DNA, 16 bp, Homo sapiens
tcccctccatccctgg

SEQ ID NO: 1402430 - DNA, 11 bp, Homo sapiens
tcccctgcctc

SEQ ID NO: 1402431 - DNA, 12 bp, Homo sapiens
tcccctgcctgg

SEQ ID NO: 1402432 - DNA, 22 bp, Homo sapiens
tccccttcgcgtatttcaggat

SEQ ID NO: 1402433 - DNA, 11 bp, Homo sapiens
tccctaataaa

SEQ ID NO: 1402434 - DNA, 15 bp, Homo sapiens
tccctatactgcttg

SEQ ID NO: 1402435 - DNA, 17 bp, Homo sapiens
tccctatactgcttgga

SEQ ID NO: 1402436 - DNA, 16 bp, Homo sapiens
tccctcagtgccctca

SEQ ID NO: 1402437 - DNA, 18 bp, Homo sapiens
tccctggaaggacatcca

SEQ ID NO: 1402438 - DNA, 18 bp, Homo sapiens
tccctggccccctccctg

SEQ ID NO: 1402439 - DNA, 14 bp, Homo sapiens
tccctgggccttgg

SEQ ID NO: 1402440 - DNA, 15 bp, Homo sapiens
tccctgggccttggg

SEQ ID NO: 1402441 - DNA, 17 bp, Homo sapiens
tcccttaatatcctaaa

SEQ ID NO: 1402442 - DNA, 21 bp, Homo sapiens
tcccttaatatcctaaacatc

SEQ ID NO: 1402443 - DNA, 17 bp, Homo sapiens
tccctttgcccagaaag

SEQ ID NO: 1402444 - DNA, 15 bp, Homo sapiens
tcctaccccctgtgc

SEQ ID NO: 1402445 - DNA, 17 bp, Homo sapiens
tcctaccccctgtgcct

SEQ ID NO: 1402446 - DNA, 13 bp, Homo sapiens
tcctagttttctc

SEQ ID NO: 1402447 - DNA, 14 bp, Homo sapiens
tcctatgctttgaa

SEQ ID NO: 1402448 - DNA, 22 bp, Homo sapiens
tcctcaacccctcccctccatc

SEQ ID NO: 1402449 - DNA, 20 bp, Homo sapiens
tcctcagagaatttctacca

SEQ ID NO: 1402450 - DNA, 11 bp, Homo sapiens
tcctcagcccc

SEQ ID NO: 1402451 - DNA, 16 bp, Homo sapiens
tcctccaaactcctgc

SEQ ID NO: 1402452 - DNA, 12 bp, Homo sapiens
tcctcctgctca

SEQ ID NO: 1402453 - DNA, 19 bp, Homo sapiens
tcctcttctattttgtaaa

SEQ ID NO: 1402454 - DNA, 14 bp, Homo sapiens
tcctgccggctcct

SEQ ID NO: 1402455 - DNA, 17 bp, Homo sapiens
tcctgccggctccttgg

SEQ ID NO: 1402456 - DNA, 16 bp, Homo sapiens
tcctgctcatattgtg

SEQ ID NO: 1402457 - DNA, 22 bp, Homo sapiens
tcctgcttgatgggattctgga

SEQ ID NO: 1402458 - DNA, 21 bp, Homo sapiens
tcctggtgccaatttcaagtt

SEQ ID NO: 1402459 - DNA, 20 bp, Homo sapiens
tcctgtattcagacagatga

SEQ ID NO: 1402460 - DNA, 17 bp, Homo sapiens
tcctgtcgattagactg

SEQ ID NO: 1402461 - DNA, 15 bp, Homo sapiens
tcctgtctccctcct

SEQ ID NO: 1402462 - DNA, 13 bp, Homo sapiens
tcctgttgggaga

SEQ ID NO: 1402463 - DNA, 14 bp, Homo sapiens
tcctgttgggagag

SEQ ID NO: 1402464 - DNA, 16 bp, Homo sapiens
tccttaaggctctttt

SEQ ID NO: 1402465 - DNA, 19 bp, Homo sapiens
tccttaaggctcttttgta

SEQ ID NO: 1402466 - DNA, 15 bp, Homo sapiens
tccttacctttttat

SEQ ID NO: 1402467 - DNA, 18 bp, Homo sapiens
tccttcaacaattctaaa

SEQ ID NO: 1402468 - DNA, 16 bp, Homo sapiens
tccttctactccagca

SEQ ID NO: 1402469 - DNA, 23 bp, Homo sapiens
tccttgattttagccttctctgt

SEQ ID NO: 1402470 - DNA, 23 bp, Homo sapiens
tccttggcaggctgatttctagg

SEQ ID NO: 1402471 - DNA, 21 bp, Homo sapiens
tcctttgaatcctctctctgt

SEQ ID NO: 1402472 - DNA, 24 bp, Homo sapiens
tcctttgttcttacctgtatgtct

SEQ ID NO: 1402473 - DNA, 17 bp, Homo sapiens
tcgaatgaaattaactg

SEQ ID NO: 1402474 - DNA, 17 bp, Homo sapiens
tcgagatcccaacactg

SEQ ID NO: 1402475 - DNA, 12 bp, Homo sapiens
tcgattagactg

SEQ ID NO: 1402476 - DNA, 13 bp, Homo sapiens
tcgattagactgg

SEQ ID NO: 1402477 - DNA, 21 bp, Homo sapiens
tcgattagactggacagcttg

SEQ ID NO: 1402478 - DNA, 19 bp, Homo sapiens
tcgctcctcaacccctccc

SEQ ID NO: 1402479 - DNA, 22 bp, Homo sapiens
tcgctcctcaacccctcccctc

SEQ ID NO: 1402480 - DNA, 17 bp, Homo sapiens
tcgctgtcctttctaga

SEQ ID NO: 1402481 - DNA, 19 bp, Homo sapiens
tcggcctcccaaagtgctg

SEQ ID NO: 1402482 - DNA, 20 bp, Homo sapiens
tcggggagccgggagcctga

SEQ ID NO: 1402483 - DNA, 15 bp, Homo sapiens
tcgtacagaaagctg

SEQ ID NO: 1402484 - DNA, 14 bp, Homo sapiens
tcgttttttacaaa

SEQ ID NO: 1402485 - DNA, 13 bp, Homo sapiens
tctaagaaacatt

SEQ ID NO: 1402486 - DNA, 22 bp, Homo sapiens
tctaagaaacatttatattgat

SEQ ID NO: 1402487 - DNA, 13 bp, Homo sapiens
tctaagaaagaac

SEQ ID NO: 1402488 - DNA, 18 bp, Homo sapiens
tctaagttaatttaaagt

SEQ ID NO: 1402489 - DNA, 13 bp, Homo sapiens
tctaatttataaa

SEQ ID NO: 1402490 - DNA, 20 bp, Homo sapiens
ttaccaacctgttacctact

SEQ ID NO: 1402491 - DNA, 23 bp, Homo sapiens
ttacctactttgactttttgcat

SEQ ID NO: 1402492 - DNA, 15 bp, Homo sapiens
ttacctttttatttg

SEQ ID NO: 1402493 - DNA, 15 bp, Homo sapiens
ttactggtccaaaag

SEQ ID NO: 1402494 - DNA, 21 bp, Homo sapiens
ttactttaatactcacctcct

SEQ ID NO: 1402495 - DNA, 16 bp, Homo sapiens
ttacttttaaactgtg

SEQ ID NO: 1402496 - DNA, 16 bp, Homo sapiens
ttagaaatgcagaatc

SEQ ID NO: 1402497 - DNA, 20 bp, Homo sapiens
ttagaacacacacacttact

SEQ ID NO: 1402498 - DNA, 15 bp, Homo sapiens
ttagactggaacttg

SEQ ID NO: 1402499 - DNA, 21 bp, Homo sapiens
ttagactggaacttgaactga

SEQ ID NO: 1402500 - DNA, 17 bp, Homo sapiens
ttagactggacagcttg

SEQ ID NO: 1402501 - DNA, 18 bp, Homo sapiens
ttagagggaggagaatga

SEQ ID NO: 1402502 - DNA, 15 bp, Homo sapiens
ttagatctggcatgt

SEQ ID NO: 1402503 - DNA, 13 bp, Homo sapiens
ttagatttgtgtg

SEQ ID NO: 1402504 - DNA, 17 bp, Homo sapiens
ttagccctggtttgaaa

SEQ ID NO: 1402505 - DNA, 17 bp, Homo sapiens
ttagccttctctgttca

SEQ ID NO: 1402506 - DNA, 17 bp, Homo sapiens
ttagctgtctgctcaga

SEQ ID NO: 1402507 - DNA, 16 bp, Homo sapiens
ttaggcagactcttta

SEQ ID NO: 1402508 - DNA, 17 bp, Homo sapiens
ttagtccctcatgcaaa

SEQ ID NO: 1402509 - DNA, 18 bp, Homo sapiens
ttataagtagcaggccaa

SEQ ID NO: 1402510 - DNA, 20 bp, Homo sapiens
ttataatgggcattactgaa

SEQ ID NO: 1402511 - DNA, 16 bp, Homo sapiens
ttataggatcatttgt

SEQ ID NO: 1402512 - DNA, 20 bp, Homo sapiens
ttatataatcattattactt

SEQ ID NO: 1402513 - DNA, 19 bp, Homo sapiens
ttatatgaagaaaatcact

SEQ ID NO: 1402514 - DNA, 13 bp, Homo sapiens
ttatatgcttact

SEQ ID NO: 1402515 - DNA, 14 bp, Homo sapiens
ttatatggaaattc

SEQ ID NO: 1402516 - DNA, 17 bp, Homo sapiens
ttatatgttattaaaca

SEQ ID NO: 1402517 - DNA, 21 bp, Homo sapiens
ttatctgaatttttaaacaag

SEQ ID NO: 1402518 - DNA, 14 bp, Homo sapiens
ttatgaaaaagaag

SEQ ID NO: 1402519 - DNA, 23 bp, Homo sapiens
ttatgacatcacttgtacaaaat

SEQ ID NO: 1402520 - DNA, 13 bp, Homo sapiens
ttatgccacctga

SEQ ID NO: 1402521 - DNA, 22 bp, Homo sapiens
ttatgttaagggaagaattcca

SEQ ID NO: 1402522 - DNA, 20 bp, Homo sapiens
ttattaatatatattatctt

SEQ ID NO: 1402523 - DNA, 20 bp, Homo sapiens
ttattccccattcttcctag

SEQ ID NO: 1402524 - DNA, 16 bp, Homo sapiens
ttattcctcctgctca

SEQ ID NO: 1402525 - DNA, 15 bp, Homo sapiens
ttatttaaaatagca

SEQ ID NO: 1402526 - DNA, 12 bp, Homo sapiens
ttatttaaacaa

SEQ ID NO: 1402527 - DNA, 23 bp, Homo sapiens
ttatttaaaccgctaaaagaaac

SEQ ID NO: 1402528 - DNA, 17 bp, Homo sapiens
ttatttgtaatagatgt

SEQ ID NO: 1402529 - DNA, 18 bp, Homo sapiens
ttatttgtaatagatgtt

SEQ ID NO: 1402530 - DNA, 13 bp, Homo sapiens
ttattttcaagaa

SEQ ID NO: 1402531 - DNA, 18 bp, Homo sapiens
ttattttcaagaaactga

SEQ ID NO: 1402532 - DNA, 22 bp, Homo sapiens
ttcaaagctttttccagaggct

SEQ ID NO: 1402533 - DNA, 14 bp, Homo sapiens
ttcaaagtttaata

SEQ ID NO: 1402534 - DNA, 19 bp, Homo sapiens
ttcaaattcttctgaactc

SEQ ID NO: 1402535 - DNA, 20 bp, Homo sapiens
ttcaacaaacatttgctgaa

SEQ ID NO: 1402536 - DNA, 14 bp, Homo sapiens
ttcaacaattctaa

SEQ ID NO: 1402537 - DNA, 19 bp, Homo sapiens
ttcaacaattctaaaatga

SEQ ID NO: 1402538 - DNA, 16 bp, Homo sapiens
ttcaacagtgaagaca

SEQ ID NO: 1402539 - DNA, 19 bp, Homo sapiens
ttcaacagtgaagacagaa

SEQ ID NO: 1402540 - DNA, 21 bp, Homo sapiens
ttcaacatgttatttgtaata

SEQ ID NO: 1402541 - DNA, 19 bp, Homo sapiens
ttcaacttattaacaatta

SEQ ID NO: 1402542 - DNA, 12 bp, Homo sapiens
ttcaagaaactg

SEQ ID NO: 1402543 - DNA, 17 bp, Homo sapiens
ttcaaggaaaataagtg

SEQ ID NO: 1402544 - DNA, 22 bp, Homo sapiens
ttcaaggaaaataagtgaaatt

SEQ ID NO: 1402545 - DNA, 23 bp, Homo sapiens
ttcaaggaaaataagtgaaattt

SEQ ID NO: 1402546 - DNA, 19 bp, Homo sapiens
ttcaatataagcttttctt

SEQ ID NO: 1402547 - DNA, 15 bp, Homo sapiens
ttcaatctgtaaact

SEQ ID NO: 1402548 - DNA, 14 bp, Homo sapiens
ttcaccaaatcttg

SEQ ID NO: 1402549 - DNA, 13 bp, Homo sapiens
ttcacctgtaaac

SEQ ID NO: 1402550 - DNA, 16 bp, Homo sapiens
ttcacctgtaaacctg

SEQ ID NO: 1402551 - DNA, 18 bp, Homo sapiens
ttcacctgtaaacctgag

SEQ ID NO: 1402552 - DNA, 15 bp, Homo sapiens
ttcactgtagaatga

SEQ ID NO: 1402553 - DNA, 14 bp, Homo sapiens
ttcagaagaaaaag

SEQ ID NO: 1402554 - DNA, 15 bp, Homo sapiens
ttcagatgtgaacca

SEQ ID NO: 1402555 - DNA, 21 bp, Homo sapiens
ttcagattcccagagcaaaat

SEQ ID NO: 1402556 - DNA, 14 bp, Homo sapiens
ttcagctaagctag

SEQ ID NO: 1402557 - DNA, 18 bp, Homo sapiens
ttcaggaaaattgaatgc

SEQ ID NO: 1402558 - DNA, 20 bp, Homo sapiens
ttcagtgtatggaaataaat

SEQ ID NO: 1402559 - DNA, 19 bp, Homo sapiens
ttcataagtattatgtctc

SEQ ID NO: 1402560 - DNA, 18 bp, Homo sapiens
ttcatgctatctctgtgt

SEQ ID NO: 1402561 - DNA, 21 bp, Homo sapiens
ttcattttaacatctgagaaa

SEQ ID NO: 1402562 - DNA, 20 bp, Homo sapiens
ttccaacaagaagggactga

SEQ ID NO: 1402563 - DNA, 22 bp, Homo sapiens
ttccaactcgtatagcatgcat

SEQ ID NO: 1402564 - DNA, 21 bp, Homo sapiens
ttccaattttctggaatacat

SEQ ID NO: 1402565 - DNA, 16 bp, Homo sapiens
ttccagacctgaagaa

SEQ ID NO: 1402566 - DNA, 17 bp, Homo sapiens
ttccagacctgaagaat

SEQ ID NO: 1402567 - DNA, 19 bp, Homo sapiens
ttccagaggctattatttt

SEQ ID NO: 1402568 - DNA, 19 bp, Homo sapiens
ttccatggcaggaaggctt

SEQ ID NO: 1402569 - DNA, 19 bp, Homo sapiens
ttcccaaaatgttgaaata

SEQ ID NO: 1402570 - DNA, 22 bp, Homo sapiens
ttcccaaaatgttgaaatatga

SEQ ID NO: 1402571 - DNA, 18 bp, Homo sapiens
ttcccagagcaaaataat

SEQ ID NO: 1402572 - DNA, 13 bp, Homo sapiens
ttccctaaagaca

SEQ ID NO: 1402573 - DNA, 23 bp, Homo sapiens
ttccctgcctctcatcaactgaa

SEQ ID NO: 1402574 - DNA, 16 bp, Homo sapiens
ttcctccaaactcctg

SEQ ID NO: 1402575 - DNA, 18 bp, Homo sapiens
ttcctgaatccaaactaa

SEQ ID NO: 1402576 - DNA, 20 bp, Homo sapiens
ttcctggtgccaatttcaag

SEQ ID NO: 1402577 - DNA, 17 bp, Homo sapiens
ttccttcatttcctccg

SEQ ID NO: 1402578 - DNA, 20 bp, Homo sapiens
ttcggacagtttatttgttg

SEQ ID NO: 1402579 - DNA, 15 bp, Homo sapiens
ttcgtagatattgga

SEQ ID NO: 1402580 - DNA, 20 bp, Homo sapiens
ttctaagaaacatttatatt

SEQ ID NO: 1402581 - DNA, 22 bp, Homo sapiens
ttctacacctgttgcacctcag

SEQ ID NO: 1402582 - DNA, 15 bp, Homo sapiens
ttctacatagatgct

SEQ ID NO: 1402583 - DNA, 14 bp, Homo sapiens
ttctaccatttcag

SEQ ID NO: 1402584 - DNA, 15 bp, Homo sapiens
ttctaccatttcaga

SEQ ID NO: 1402585 - DNA, 19 bp, Homo sapiens
ttctactttgatatgactg

SEQ ID NO: 1402586 - DNA, 16 bp, Homo sapiens
ttctagagcactgcca

SEQ ID NO: 1402587 - DNA, 14 bp, Homo sapiens
ttctaggtaggaaa

SEQ ID NO: 1402588 - DNA, 18 bp, Homo sapiens
ttctaggtaggaaatgtg

SEQ ID NO: 1402589 - DNA, 13 bp, Homo sapiens
ttctattaatatt

SEQ ID NO: 1402590 - DNA, 21 bp, Homo sapiens
ttctattaatatttatgtgtt

SEQ ID NO: 1402591 - DNA, 15 bp, Homo sapiens
ttctcactaaatctt

SEQ ID NO: 1402592 - DNA, 14 bp, Homo sapiens
ttctcagttttcat

SEQ ID NO: 1402593 - DNA, 15 bp, Homo sapiens
ttctcagttttcata

SEQ ID NO: 1402594 - DNA, 12 bp, Homo sapiens
ttctcataactt

SEQ ID NO: 1402595 - DNA, 23 bp, Homo sapiens
ttctcattttttaaaaaagctta

SEQ ID NO: 1402596 - DNA, 21 bp, Homo sapiens
ttctcctgaggatgtgtccca

SEQ ID NO: 1402597 - DNA, 12 bp, Homo sapiens
ttctctaatatg

SEQ ID NO: 1402598 - DNA, 21 bp, Homo sapiens
ttctctaatatggcaaccatt

SEQ ID NO: 1402599 - DNA, 16 bp, Homo sapiens
ttctgactctgagcta

SEQ ID NO: 1402600 - DNA, 12 bp, Homo sapiens
ttctgagttcct

SEQ ID NO: 1402601 - DNA, 14 bp, Homo sapiens
ttctgatcaaggcc

SEQ ID NO: 1402602 - DNA, 17 bp, Homo sapiens
ttctggaatacatgaaa

SEQ ID NO: 1402603 - DNA, 21 bp, Homo sapiens
ttctggattccccatctcagg

SEQ ID NO: 1402604 - DNA, 20 bp, Homo sapiens
ttctgtttccataggaatca

SEQ ID NO: 1402605 - DNA, 17 bp, Homo sapiens
ttcttaaacacttgcaa

SEQ ID NO: 1402606 - DNA, 11 bp, Homo sapiens
ttcttaaataa

SEQ ID NO: 1402607 - DNA, 14 bp, Homo sapiens
ttcttaacaagata

SEQ ID NO: 1402608 - DNA, 15 bp, Homo sapiens
ttcttaacaagatat

SEQ ID NO: 1402609 - DNA, 15 bp, Homo sapiens
ttcttacctgtatgt

SEQ ID NO: 1402610 - DNA, 13 bp, Homo sapiens
ttcttctgaactc

SEQ ID NO: 1402611 - DNA, 22 bp, Homo sapiens
ttctttggtttcccaagagcta

SEQ ID NO: 1402612 - DNA, 12 bp, Homo sapiens
ttctttgtgtag

SEQ ID NO: 1402613 - DNA, 17 bp, Homo sapiens
ttctttgtttctttctt

SEQ ID NO: 1402614 - DNA, 21 bp, Homo sapiens
ttgaaaggggttgtgaagagg

SEQ ID NO: 1402615 - DNA, 21 bp, Homo sapiens
ttgaaattttccattacatga

SEQ ID NO: 1402616 - DNA, 22 bp, Homo sapiens
ttgaaattttccattacatgat

SEQ ID NO: 1402617 - DNA, 19 bp, Homo sapiens
ttgaacctgatgaaaataa

SEQ ID NO: 1402618 - DNA, 20 bp, Homo sapiens
ttgaactcttcactcttcaa

SEQ ID NO: 1402619 - DNA, 19 bp, Homo sapiens
ttgaagaatgttaagactt

SEQ ID NO: 1402620 - DNA, 16 bp, Homo sapiens
atttgagcatatcagt

SEQ ID NO: 1402621 - DNA, 21 bp, Homo sapiens
atttgcaaggctgatttatgg

SEQ ID NO: 1402622 - DNA, 14 bp, Homo sapiens
atttgccaagtctc

SEQ ID NO: 1402623 - DNA, 13 bp, Homo sapiens
atttgctgccatt

SEQ ID NO: 1402624 - DNA, 15 bp, Homo sapiens
atttggcctcttgta

SEQ ID NO: 1402625 - DNA, 21 bp, Homo sapiens
atttgtattatgttccaaggc

SEQ ID NO: 1402626 - DNA, 22 bp, Homo sapiens
attttaaaatgaaatgcatttt

SEQ ID NO: 1402627 - DNA, 14 bp, Homo sapiens
attttcatgaaaat

SEQ ID NO: 1402628 - DNA, 20 bp, Homo sapiens
attttcatgaaaataccatt

SEQ ID NO: 1402629 - DNA, 21 bp, Homo sapiens
attttcatgaaaataccattt

SEQ ID NO: 1402630 - DNA, 23 bp, Homo sapiens
attttgcacctgcagccaagcaa

SEQ ID NO: 1402631 - DNA, 21 bp, Homo sapiens
attttgctagacagttaaact

SEQ ID NO: 1402632 - DNA, 10 bp, Homo sapiens
attttgtatg

SEQ ID NO: 1402633 - DNA, 21 bp, Homo sapiens
atttttataattgtacaaaat

SEQ ID NO: 1402634 - DNA, 17 bp, Homo sapiens
caaaaatagctcttgct

SEQ ID NO: 1402635 - DNA, 21 bp, Homo sapiens
caaactgcttcccttactttg

SEQ ID NO: 1402636 - DNA, 19 bp, Homo sapiens
caaaggtaggttgaaggga

SEQ ID NO: 1402637 - DNA, 22 bp, Homo sapiens
caaagttttgttgtacttaaat

SEQ ID NO: 1402638 - DNA, 14 bp, Homo sapiens
caaatacacatttg

SEQ ID NO: 1402639 - DNA, 20 bp, Homo sapiens
caaatgagctctgaaatctt

SEQ ID NO: 1402640 - DNA, 21 bp, Homo sapiens
caaatgagctctgaaatcttc

SEQ ID NO: 1402641 - DNA, 13 bp, Homo sapiens
caaattgcatttg

SEQ ID NO: 1402642 - DNA, 23 bp, Homo sapiens
caacaacaaaacatttgctctgg

SEQ ID NO: 1402643 - DNA, 22 bp, Homo sapiens
caactttgtaaaaatcttttga

SEQ ID NO: 1402644 - DNA, 13 bp, Homo sapiens
caagacttcagat

SEQ ID NO: 1402645 - DNA, 16 bp, Homo sapiens
caaggagataagaaag

SEQ ID NO: 1402646 - DNA, 13 bp, Homo sapiens
caaggctgattta

SEQ ID NO: 1402647 - DNA, 16 bp, Homo sapiens
caagttgaagaagctg

SEQ ID NO: 1402648 - DNA, 14 bp, Homo sapiens
caataaaatttaaa

SEQ ID NO: 1402649 - DNA, 20 bp, Homo sapiens
caataaaatttaaaaaataa

SEQ ID NO: 1402650 - DNA, 15 bp, Homo sapiens
caatacctggcctca

SEQ ID NO: 1402651 - DNA, 23 bp, Homo sapiens
caatactaggaagtaaagtgaag

SEQ ID NO: 1402652 - DNA, 19 bp, Homo sapiens
caatattccagatctttca

SEQ ID NO: 1402653 - DNA, 17 bp, Homo sapiens
caatattgattgggaaa

SEQ ID NO: 1402654 - DNA, 20 bp, Homo sapiens
caatattgattgggaaaaca

SEQ ID NO: 1402655 - DNA, 21 bp, Homo sapiens
caatattgattgggaaaacat

SEQ ID NO: 1402656 - DNA, 15 bp, Homo sapiens
caatgaaccataaat

SEQ ID NO: 1402657 - DNA, 19 bp, Homo sapiens
caatgaaccataaattcaa

SEQ ID NO: 1402658 - DNA, 23 bp, Homo sapiens
caatgtaatagaagcttaaaata

SEQ ID NO: 1402659 - DNA, 18 bp, Homo sapiens
caattttaaaatgaaatg

SEQ ID NO: 1402660 - DNA, 22 bp, Homo sapiens
caattttaaaatgaaatgcatt

SEQ ID NO: 1402661 - DNA, 13 bp, Homo sapiens
cacatatttcaaa

SEQ ID NO: 1402662 - DNA, 18 bp, Homo sapiens
cacatcaaataagaaata

SEQ ID NO: 1402663 - DNA, 19 bp, Homo sapiens
cacatcacccatgttgaga

SEQ ID NO: 1402664 - DNA, 16 bp, Homo sapiens
cacatttctaagcctt

SEQ ID NO: 1402665 - DNA, 16 bp, Homo sapiens
caccaggcaagaaaag

SEQ ID NO: 1402666 - DNA, 20 bp, Homo sapiens
caccagtccctgtccggaat

SEQ ID NO: 1402667 - DNA, 17 bp, Homo sapiens
caccgccagccgccttc

SEQ ID NO: 1402668 - DNA, 17 bp, Homo sapiens
cacctacaaggagataa

SEQ ID NO: 1402669 - DNA, 16 bp, Homo sapiens
cacctctttgctccct

SEQ ID NO: 1402670 - DNA, 14 bp, Homo sapiens
cacctgtgggccag

SEQ ID NO: 1402671 - DNA, 17 bp, Homo sapiens
cactctcgagttaaaga

SEQ ID NO: 1402672 - DNA, 11 bp, Homo sapiens
cactctgcccc

SEQ ID NO: 1402673 - DNA, 21 bp, Homo sapiens
cacttaaacgaagagttccct

SEQ ID NO: 1402674 - DNA, 14 bp, Homo sapiens
cacttgaaaccttt

SEQ ID NO: 1402675 - DNA, 14 bp, Homo sapiens
cagaaaaagatctt

SEQ ID NO: 1402676 - DNA, 17 bp, Homo sapiens
cagaaatggaaagcaga

SEQ ID NO: 1402677 - DNA, 16 bp, Homo sapiens
cagaaccacacttgaa

SEQ ID NO: 1402678 - DNA, 22 bp, Homo sapiens
cagaatgatgcaggttcaggtc

SEQ ID NO: 1402679 - DNA, 20 bp, Homo sapiens
cagagatataataagcccaa

SEQ ID NO: 1402680 - DNA, 12 bp, Homo sapiens
cagagctagagg

SEQ ID NO: 1402681 - DNA, 20 bp, Homo sapiens
cagagctggtggacccaggg

SEQ ID NO: 1402682 - DNA, 13 bp, Homo sapiens
cagaggatgctga

SEQ ID NO: 1402683 - DNA, 23 bp, Homo sapiens
cagaggtattaaaactaaatttc

SEQ ID NO: 1402684 - DNA, 17 bp, Homo sapiens
cagagttttcattaaat

SEQ ID NO: 1402685 - DNA, 14 bp, Homo sapiens
cagataactgagga

SEQ ID NO: 1402686 - DNA, 19 bp, Homo sapiens
cagataccttatcttacaa

SEQ ID NO: 1402687 - DNA, 14 bp, Homo sapiens
cagatcttggactc

SEQ ID NO: 1402688 - DNA, 15 bp, Homo sapiens
cagatcttggactca

SEQ ID NO: 1402689 - DNA, 15 bp, Homo sapiens
cagatctttcagaaa

SEQ ID NO: 1402690 - DNA, 20 bp, Homo sapiens
cagatctttcagaaatataa

SEQ ID NO: 1402691 - DNA, 17 bp, Homo sapiens
cagatgttcccccatct

SEQ ID NO: 1402692 - DNA, 17 bp, Homo sapiens
cagcatttgccaagtct

SEQ ID NO: 1402693 - DNA, 13 bp, Homo sapiens
cagccactgattc

SEQ ID NO: 1402694 - DNA, 21 bp, Homo sapiens
cagccactgattctctcttgt

SEQ ID NO: 1402695 - DNA, 19 bp, Homo sapiens
cagccccctaaaagcactc

SEQ ID NO: 1402696 - DNA, 21 bp, Homo sapiens
cagccgattcctccagccctg

SEQ ID NO: 1402697 - DNA, 16 bp, Homo sapiens
cagcctactctccttg

SEQ ID NO: 1402698 - DNA, 16 bp, Homo sapiens
cagcgtggctctaaaa

SEQ ID NO: 1402699 - DNA, 15 bp, Homo sapiens
caggacatgcaataa

SEQ ID NO: 1402700 - DNA, 18 bp, Homo sapiens
caggactgcagagggctc

SEQ ID NO: 1402701 - DNA, 14 bp, Homo sapiens
caggcaagaaaagc

SEQ ID NO: 1402702 - DNA, 14 bp, Homo sapiens
caggtcccctttca

SEQ ID NO: 1402703 - DNA, 22 bp, Homo sapiens
cagtactattcaggtaacacta

SEQ ID NO: 1402704 - DNA, 12 bp, Homo sapiens
cagtagactgtg

SEQ ID NO: 1402705 - DNA, 13 bp, Homo sapiens
cagtcatcattta

SEQ ID NO: 1402706 - DNA, 14 bp, Homo sapiens
cagtcatcatttat

SEQ ID NO: 1402707 - DNA, 14 bp, Homo sapiens
cagtgataagtata

SEQ ID NO: 1402708 - DNA, 13 bp, Homo sapiens
cagttgcttgtct

SEQ ID NO: 1402709 - DNA, 18 bp, Homo sapiens
cataaattcaactttgta

SEQ ID NO: 1402710 - DNA, 19 bp, Homo sapiens
cataaattcaactttgtaa

SEQ ID NO: 1402711 - DNA, 18 bp, Homo sapiens
cataagagtaacagtcat

SEQ ID NO: 1402712 - DNA, 22 bp, Homo sapiens
cataatttttatttttggcaaa

SEQ ID NO: 1402713 - DNA, 21 bp, Homo sapiens
catacaccccctcttctgagc

SEQ ID NO: 1402714 - DNA, 14 bp, Homo sapiens
catacttaacttta

SEQ ID NO: 1402715 - DNA, 17 bp, Homo sapiens
catagataatattgttt

SEQ ID NO: 1402716 - DNA, 19 bp, Homo sapiens
catagataatattgtttgg

SEQ ID NO: 1402717 - DNA, 17 bp, Homo sapiens
catagcttttccctgtc

SEQ ID NO: 1402718 - DNA, 14 bp, Homo sapiens
catattaacaaatt

SEQ ID NO: 1402719 - DNA, 13 bp, Homo sapiens
catcacaaatggc

SEQ ID NO: 1402720 - DNA, 16 bp, Homo sapiens
catcatacttaacttt

SEQ ID NO: 1402721 - DNA, 13 bp, Homo sapiens
catctaattctga

SEQ ID NO: 1402722 - DNA, 21 bp, Homo sapiens
catctcctttgcagaatgatg

SEQ ID NO: 1402723 - DNA, 17 bp, Homo sapiens
catctcgctccctccca

SEQ ID NO: 1402724 - DNA, 14 bp, Homo sapiens
catcttcgggacca

SEQ ID NO: 1402725 - DNA, 20 bp, Homo sapiens
catgcaaatgagctctgaaa

SEQ ID NO: 1402726 - DNA, 22 bp, Homo sapiens
catgcaaatgagctctgaaatc

SEQ ID NO: 1402727 - DNA, 14 bp, Homo sapiens
catgcatgcaaatg

SEQ ID NO: 1402728 - DNA, 20 bp, Homo sapiens
catggcagcctactctcctt

SEQ ID NO: 1402729 - DNA, 14 bp, Homo sapiens
catgtatttgagca

SEQ ID NO: 1402730 - DNA, 22 bp, Homo sapiens
catgtgatacattttttaagct

SEQ ID NO: 1402731 - DNA, 19 bp, Homo sapiens
cattaaggggaagaatgaa

SEQ ID NO: 1402732 - DNA, 20 bp, Homo sapiens
cattcagaaatgttgagtct

SEQ ID NO: 1402733 - DNA, 23 bp, Homo sapiens
cattcagaaatgttgagtctgta

SEQ ID NO: 1402734 - DNA, 13 bp, Homo sapiens
cattctcaggcac

SEQ ID NO: 1402735 - DNA, 16 bp, Homo sapiens
cattctcaggcaccag

SEQ ID NO: 1402736 - DNA, 18 bp, Homo sapiens
cattgagtattgtttaaa

SEQ ID NO: 1402737 - DNA, 15 bp, Homo sapiens
catttagtaagaata

SEQ ID NO: 1402738 - DNA, 15 bp, Homo sapiens
catttccattgctta

SEQ ID NO: 1402739 - DNA, 21 bp, Homo sapiens
catttctaagcctttgagact

SEQ ID NO: 1402740 - DNA, 18 bp, Homo sapiens
catttgctactgttgtaa

SEQ ID NO: 1402741 - DNA, 14 bp, Homo sapiens
cattttaattttaa

SEQ ID NO: 1402742 - DNA, 18 bp, Homo sapiens
cattttaattttaaagtg

SEQ ID NO: 1402743 - DNA, 22 bp, Homo sapiens
cattttatagaatgtgtcacac

SEQ ID NO: 1402744 - DNA, 17 bp, Homo sapiens
cattttgcacctgcagc

SEQ ID NO: 1402745 - DNA, 22 bp, Homo sapiens
cattttgctagacagttaaact

SEQ ID NO: 1402746 - DNA, 14 bp, Homo sapiens
ccaaagagtgctaa

SEQ ID NO: 1402747 - DNA, 21 bp, Homo sapiens
ccaattttaaaatgaaatgca

SEQ ID NO: 1402748 - DNA, 16 bp, Homo sapiens
ccacacttgaaacctt

SEQ ID NO: 1402749 - DNA, 18 bp, Homo sapiens
ccacatttctaagccttt

SEQ ID NO: 1402750 - DNA, 16 bp, Homo sapiens
ccacctacaaggagat

SEQ ID NO: 1402751 - DNA, 17 bp, Homo sapiens
ccactctctaccagata

SEQ ID NO: 1402752 - DNA, 23 bp, Homo sapiens
ccagagtggagatcccacatatt

SEQ ID NO: 1402753 - DNA, 17 bp, Homo sapiens
ccagccaggaagatgaa

SEQ ID NO: 1402754 - DNA, 18 bp, Homo sapiens
atgaaagctgttccttgg

SEQ ID NO: 1402755 - DNA, 14 bp, Homo sapiens
atgaaatgcatttt

SEQ ID NO: 1402756 - DNA, 15 bp, Homo sapiens
atgaaatgcattttg

SEQ ID NO: 1402757 - DNA, 17 bp, Homo sapiens
atgaaccctggcatttg

SEQ ID NO: 1402758 - DNA, 17 bp, Homo sapiens
atgagctctgaaatctt

SEQ ID NO: 1402759 - DNA, 15 bp, Homo sapiens
atgaggaaaattctt

SEQ ID NO: 1402760 - DNA, 19 bp, Homo sapiens
atgaggaaaattcttaaaa

SEQ ID NO: 1402761 - DNA, 14 bp, Homo sapiens
atgatgtacagatt

SEQ ID NO: 1402762 - DNA, 23 bp, Homo sapiens
atgcaaatgagctctgaaatctt

SEQ ID NO: 1402763 - DNA, 14 bp, Homo sapiens
atgcaataaaattt

SEQ ID NO: 1402764 - DNA, 23 bp, Homo sapiens
atgcaataaaatttaaaaaataa

SEQ ID NO: 1402765 - DNA, 20 bp, Homo sapiens
atgcagttagctgaagaatt

SEQ ID NO: 1402766 - DNA, 22 bp, Homo sapiens
atgcagttagctgaagaattga

SEQ ID NO: 1402767 - DNA, 23 bp, Homo sapiens
atggaaagcagagttttcattaa

SEQ ID NO: 1402768 - DNA, 17 bp, Homo sapiens
atggactcagccttgca

SEQ ID NO: 1402769 - DNA, 20 bp, Homo sapiens
atggcttgtctatactcctt

SEQ ID NO: 1402770 - DNA, 19 bp, Homo sapiens
atggggaaactgagggcag

SEQ ID NO: 1402771 - DNA, 12 bp, Homo sapiens
atgtaatttaaa

SEQ ID NO: 1402772 - DNA, 13 bp, Homo sapiens
atgtaatttaaat

SEQ ID NO: 1402773 - DNA, 20 bp, Homo sapiens
atgtaatttaaatgaaagaa

SEQ ID NO: 1402774 - DNA, 14 bp, Homo sapiens
atgtacagattctt

SEQ ID NO: 1402775 - DNA, 18 bp, Homo sapiens
atgtagaggcttgtttac

SEQ ID NO: 1402776 - DNA, 19 bp, Homo sapiens
atgtaggtaagactgtaga

SEQ ID NO: 1402777 - DNA, 21 bp, Homo sapiens
atgtagttttgtgatgcattt

SEQ ID NO: 1402778 - DNA, 14 bp, Homo sapiens
atgtatttgcaagg

SEQ ID NO: 1402779 - DNA, 14 bp, Homo sapiens
atgtcccctcccag

SEQ ID NO: 1402780 - DNA, 15 bp, Homo sapiens
atgtgagctcttcct

SEQ ID NO: 1402781 - DNA, 16 bp, Homo sapiens
attaaaactaaatttc

SEQ ID NO: 1402782 - DNA, 18 bp, Homo sapiens
attaacaaattgcatttg

SEQ ID NO: 1402783 - DNA, 15 bp, Homo sapiens
attaaggggaagaat

SEQ ID NO: 1402784 - DNA, 15 bp, Homo sapiens
attaatgttttcaaa

SEQ ID NO: 1402785 - DNA, 15 bp, Homo sapiens
attaattacaatgta

SEQ ID NO: 1402786 - DNA, 15 bp, Homo sapiens
attattattaattac

SEQ ID NO: 1402787 - DNA, 18 bp, Homo sapiens
attatttttataattgta

SEQ ID NO: 1402788 - DNA, 18 bp, Homo sapiens
attatttttttaaaattt

SEQ ID NO: 1402789 - DNA, 18 bp, Homo sapiens
attccccactcagccttt

SEQ ID NO: 1402790 - DNA, 18 bp, Homo sapiens
attcctccagccctggtg

SEQ ID NO: 1402791 - DNA, 16 bp, Homo sapiens
attctaacgcaaaaat

SEQ ID NO: 1402792 - DNA, 13 bp, Homo sapiens
attctataaaact

SEQ ID NO: 1402793 - DNA, 14 bp, Homo sapiens
attctataaaactc

SEQ ID NO: 1402794 - DNA, 14 bp, Homo sapiens
attctggctttaag

SEQ ID NO: 1402795 - DNA, 16 bp, Homo sapiens
attctggctttaagcc

SEQ ID NO: 1402796 - DNA, 19 bp, Homo sapiens
attctggctttaagccttc

SEQ ID NO: 1402797 - DNA, 15 bp, Homo sapiens
attctttcagttctt

SEQ ID NO: 1402798 - DNA, 15 bp, Homo sapiens
attgacttttataaa

SEQ ID NO: 1402799 - DNA, 18 bp, Homo sapiens
attgacttttataaagca

SEQ ID NO: 1402800 - DNA, 13 bp, Homo sapiens
attgagtattgtt

SEQ ID NO: 1402801 - DNA, 14 bp, Homo sapiens
attgagtattgttt

SEQ ID NO: 1402802 - DNA, 20 bp, Homo sapiens
attgagtattgtttaaaatg

SEQ ID NO: 1402803 - DNA, 14 bp, Homo sapiens
attgattgggaaaa

SEQ ID NO: 1402804 - DNA, 18 bp, Homo sapiens
attgattgggaaaacatt

SEQ ID NO: 1402805 - DNA, 22 bp, Homo sapiens
attgattgggaaaacatttgct

SEQ ID NO: 1402806 - DNA, 23 bp, Homo sapiens
attgattgggaaaacatttgctg

SEQ ID NO: 1402807 - DNA, 14 bp, Homo sapiens
attgatttgattgg

SEQ ID NO: 1402808 - DNA, 19 bp, Homo sapiens
attgcatcactgtatcatt

SEQ ID NO: 1402809 - DNA, 18 bp, Homo sapiens
attgcctctgaaaagtgt

SEQ ID NO: 1402810 - DNA, 19 bp, Homo sapiens
attgcttattatgtaggta

SEQ ID NO: 1402811 - DNA, 15 bp, Homo sapiens
attgggaaaacattt

SEQ ID NO: 1402812 - DNA, 15 bp, Homo sapiens
attggttttcctgtg

SEQ ID NO: 1402813 - DNA, 22 bp, Homo sapiens
attgtacaaaattaagcaaatg

SEQ ID NO: 1402814 - DNA, 18 bp, Homo sapiens
attgtttggtaaatgttt

SEQ ID NO: 1402815 - DNA, 19 bp, Homo sapiens
attgtttggtaaatgtttc

SEQ ID NO: 1402816 - DNA, 15 bp, Homo sapiens
atttagtaagaatac

SEQ ID NO: 1402817 - DNA, 18 bp, Homo sapiens
atttcaaaaacatgcttt

SEQ ID NO: 1402818 - DNA, 23 bp, Homo sapiens
atttccatgtcccctcccagagc

SEQ ID NO: 1402819 - DNA, 16 bp, Homo sapiens
atttctaagcctttga

SEQ ID NO: 1402820 - DNA, 15 bp, Homo sapiens
atttctcattgactt

SEQ ID NO: 1402821 - DNA, 14 bp, Homo sapiens
atttgaaaaatata

SEQ ID NO: 1402822 - DNA, 16 bp, Homo sapiens
agcttggcactcaggt

SEQ ID NO: 1402823 - DNA, 16 bp, Homo sapiens
agctttaattaagctc

SEQ ID NO: 1402824 - DNA, 16 bp, Homo sapiens
aggaagctgagatgaa

SEQ ID NO: 1402825 - DNA, 17 bp, Homo sapiens
aggaatcattcagaaat

SEQ ID NO: 1402826 - DNA, 13 bp, Homo sapiens
aggacatgcaata

SEQ ID NO: 1402827 - DNA, 16 bp, Homo sapiens
aggacatgcaataaaa

SEQ ID NO: 1402828 - DNA, 22 bp, Homo sapiens
aggactagagcacaacataatt

SEQ ID NO: 1402829 - DNA, 16 bp, Homo sapiens
aggactgcagagggct

SEQ ID NO: 1402830 - DNA, 23 bp, Homo sapiens
aggactgcagccactgattctct

SEQ ID NO: 1402831 - DNA, 13 bp, Homo sapiens
aggagataagaaa

SEQ ID NO: 1402832 - DNA, 14 bp, Homo sapiens
aggagataagaaag

SEQ ID NO: 1402833 - DNA, 17 bp, Homo sapiens
aggagataagaaagcag

SEQ ID NO: 1402834 - DNA, 19 bp, Homo sapiens
aggaggggcccccctgccc

SEQ ID NO: 1402835 - DNA, 21 bp, Homo sapiens
aggaggggcccccctgccctg

SEQ ID NO: 1402836 - DNA, 17 bp, Homo sapiens
aggagtggtgatttgaa

SEQ ID NO: 1402837 - DNA, 18 bp, Homo sapiens
aggatgctgacatcattt

SEQ ID NO: 1402838 - DNA, 22 bp, Homo sapiens
aggatgctgacatcatttgtat

SEQ ID NO: 1402839 - DNA, 15 bp, Homo sapiens
aggcaccagtccctg

SEQ ID NO: 1402840 - DNA, 14 bp, Homo sapiens
aggctactacagag

SEQ ID NO: 1402841 - DNA, 21 bp, Homo sapiens
aggctactacagagaaggctg

SEQ ID NO: 1402842 - DNA, 19 bp, Homo sapiens
aggctgcctgctatgtatt

SEQ ID NO: 1402843 - DNA, 21 bp, Homo sapiens
aggcttgtttacctttctctc

SEQ ID NO: 1402844 - DNA, 22 bp, Homo sapiens
aggcttgtttacctttctctct

SEQ ID NO: 1402845 - DNA, 13 bp, Homo sapiens
agggaaaacacag

SEQ ID NO: 1402846 - DNA, 15 bp, Homo sapiens
agggaaagttttttt

SEQ ID NO: 1402847 - DNA, 13 bp, Homo sapiens
agggctccagagt

SEQ ID NO: 1402848 - DNA, 15 bp, Homo sapiens
aggggaagaatgaaa

SEQ ID NO: 1402849 - DNA, 16 bp, Homo sapiens
aggggcccccctgccc

SEQ ID NO: 1402850 - DNA, 21 bp, Homo sapiens
aggggcccccctgccctgtgg

SEQ ID NO: 1402851 - DNA, 20 bp, Homo sapiens
aggtattaaaactaaatttc

SEQ ID NO: 1402852 - DNA, 13 bp, Homo sapiens
aggtattatacat

SEQ ID NO: 1402853 - DNA, 22 bp, Homo sapiens
aggtttacaataggagtggtga

SEQ ID NO: 1402854 - DNA, 15 bp, Homo sapiens
agtaaagtgaagaat

SEQ ID NO: 1402855 - DNA, 20 bp, Homo sapiens
agtaaagtgaagaatttatc

SEQ ID NO: 1402856 - DNA, 18 bp, Homo sapiens
agtaacagtcatcattta

SEQ ID NO: 1402857 - DNA, 21 bp, Homo sapiens
agtaacccccttaaatttaat

SEQ ID NO: 1402858 - DNA, 21 bp, Homo sapiens
agtaagaataccacatcaaat

SEQ ID NO: 1402859 - DNA, 14 bp, Homo sapiens
agtaagatatctca

SEQ ID NO: 1402860 - DNA, 12 bp, Homo sapiens
agtattgtttaa

SEQ ID NO: 1402861 - DNA, 13 bp, Homo sapiens
agtattgtttaaa

SEQ ID NO: 1402862 - DNA, 19 bp, Homo sapiens
agtattgtttaaaatgtaa

SEQ ID NO: 1402863 - DNA, 21 bp, Homo sapiens
agtctattgaataatgtagtt

SEQ ID NO: 1402864 - DNA, 22 bp, Homo sapiens
agtctattgaataatgtagttt

SEQ ID NO: 1402865 - DNA, 14 bp, Homo sapiens
agtctgatccctgc

SEQ ID NO: 1402866 - DNA, 16 bp, Homo sapiens
agtgattatatttcac

SEQ ID NO: 1402867 - DNA, 17 bp, Homo sapiens
agtgctaagcattagct

SEQ ID NO: 1402868 - DNA, 20 bp, Homo sapiens
agtgctaagcattagcttta

SEQ ID NO: 1402869 - DNA, 15 bp, Homo sapiens
agtggtgatttgaaa

SEQ ID NO: 1402870 - DNA, 18 bp, Homo sapiens
agttagtgattatatttc

SEQ ID NO: 1402871 - DNA, 16 bp, Homo sapiens
agttagtttttaatct

SEQ ID NO: 1402872 - DNA, 12 bp, Homo sapiens
agttcaaaaaca

SEQ ID NO: 1402873 - DNA, 22 bp, Homo sapiens
agttctttggattctaaataca

SEQ ID NO: 1402874 - DNA, 23 bp, Homo sapiens
agttgcacttattgaccattttt

SEQ ID NO: 1402875 - DNA, 16 bp, Homo sapiens
agttgggtgtctcctt

SEQ ID NO: 1402876 - DNA, 19 bp, Homo sapiens
agtttcagtttgttggaaa

SEQ ID NO: 1402877 - DNA, 23 bp, Homo sapiens
agttttactgtctattaatattc

SEQ ID NO: 1402878 - DNA, 15 bp, Homo sapiens
agttttatatgcttt

SEQ ID NO: 1402879 - DNA, 16 bp, Homo sapiens
agttttatatgcttta

SEQ ID NO: 1402880 - DNA, 17 bp, Homo sapiens
agttttgtgatgcattt

SEQ ID NO: 1402881 - DNA, 13 bp, Homo sapiens
agttttgttgtac

SEQ ID NO: 1402882 - DNA, 16 bp, Homo sapiens
agtttttggttgggaa

SEQ ID NO: 1402883 - DNA, 23 bp, Homo sapiens
ttgattattttttttttcttctt

SEQ ID NO: 1402884 - DNA, 16 bp, Homo sapiens
ttgcaaatagccagtg

SEQ ID NO: 1402885 - DNA, 17 bp, Homo sapiens
ttgcaaggctgatttat

SEQ ID NO: 1402886 - DNA, 17 bp, Homo sapiens
ttgcacctgcagccaag

SEQ ID NO: 1402887 - DNA, 20 bp, Homo sapiens
ttgcatcactgtatcatttt

SEQ ID NO: 1402888 - DNA, 16 bp, Homo sapiens
ttgcatgcatgcaaat

SEQ ID NO: 1402889 - DNA, 17 bp, Homo sapiens
ttgcatgcatgcaaatg

SEQ ID NO: 1402890 - DNA, 17 bp, Homo sapiens
ttgggaaaacatttgct

SEQ ID NO: 1402891 - DNA, 17 bp, Homo sapiens
ttggtaaatgtttcttt

SEQ ID NO: 1402892 - DNA, 23 bp, Homo sapiens
ttgtacttaaatggtaataagca

SEQ ID NO: 1402893 - DNA, 12 bp, Homo sapiens
ttgttgtactta

SEQ ID NO: 1402894 - DNA, 21 bp, Homo sapiens
ttgtttaaaatgtaatttaaa

SEQ ID NO: 1402895 - DNA, 19 bp, Homo sapiens
ttgtttggtaaatgtttct

SEQ ID NO: 1402896 - DNA, 22 bp, Homo sapiens
tttaaaaaataaataaaaacta

SEQ ID NO: 1402897 - DNA, 19 bp, Homo sapiens
tttaaaatgaaatgcattt

SEQ ID NO: 1402898 - DNA, 12 bp, Homo sapiens
tttaaaatgtaa

SEQ ID NO: 1402899 - DNA, 21 bp, Homo sapiens
tttaaaattttgtatgttaaa

SEQ ID NO: 1402900 - DNA, 13 bp, Homo sapiens
tttaaccctcaca

SEQ ID NO: 1402901 - DNA, 23 bp, Homo sapiens
tttaaccggtaagagtttcagtt

SEQ ID NO: 1402902 - DNA, 15 bp, Homo sapiens
tttacttgttttgga

SEQ ID NO: 1402903 - DNA, 22 bp, Homo sapiens
tttaggtcagtagactgtgatt

SEQ ID NO: 1402904 - DNA, 15 bp, Homo sapiens
tttataattgtacaa

SEQ ID NO: 1402905 - DNA, 20 bp, Homo sapiens
tttataattgtacaaaatta

SEQ ID NO: 1402906 - DNA, 12 bp, Homo sapiens
tttatatgcttt

SEQ ID NO: 1402907 - DNA, 20 bp, Homo sapiens
tttatctaaggtccccagca

SEQ ID NO: 1402908 - DNA, 12 bp, Homo sapiens
tttattaatgtt

SEQ ID NO: 1402909 - DNA, 18 bp, Homo sapiens
tttattaatgttttcaaa

SEQ ID NO: 1402910 - DNA, 15 bp, Homo sapiens
tttcaaaaacatgct

SEQ ID NO: 1402911 - DNA, 21 bp, Homo sapiens
tttcaaaaggtattatacatg

SEQ ID NO: 1402912 - DNA, 14 bp, Homo sapiens
tttcagaaatataa

SEQ ID NO: 1402913 - DNA, 22 bp, Homo sapiens
tttcagaaatataacacatttt

SEQ ID NO: 1402914 - DNA, 14 bp, Homo sapiens
tttcatgaaaatac

SEQ ID NO: 1402915 - DNA, 12 bp, Homo sapiens
tttctctctcta

SEQ ID NO: 1402916 - DNA, 12 bp, Homo sapiens
tttgaaaaatat

SEQ ID NO: 1402917 - DNA, 17 bp, Homo sapiens
tttgattgggatgaatg

SEQ ID NO: 1402918 - DNA, 20 bp, Homo sapiens
tttgcatgcatgcaaatgag

SEQ ID NO: 1402919 - DNA, 17 bp, Homo sapiens
tttgccaggacatgcaa

SEQ ID NO: 1402920 - DNA, 21 bp, Homo sapiens
tttgctcaatacctggcctca

SEQ ID NO: 1402921 - DNA, 14 bp, Homo sapiens
tttggcctcttgta

SEQ ID NO: 1402922 - DNA, 13 bp, Homo sapiens
tttggtaaatgtt

SEQ ID NO: 1402923 - DNA, 16 bp, Homo sapiens
tttggtaaatgtttct

SEQ ID NO: 1402924 - DNA, 22 bp, Homo sapiens
tttgtaaaaatcttttgaagca

SEQ ID NO: 1402925 - DNA, 16 bp, Homo sapiens
tttgtatgttaaagag

SEQ ID NO: 1402926 - DNA, 14 bp, Homo sapiens
tttgtattttcatg

SEQ ID NO: 1402927 - DNA, 13 bp, Homo sapiens
ttttaaagtgcaa

SEQ ID NO: 1402928 - DNA, 18 bp, Homo sapiens
ttttaatttacttgtttt

SEQ ID NO: 1402929 - DNA, 13 bp, Homo sapiens
ttttatatgcttt

SEQ ID NO: 1402930 - DNA, 17 bp, Homo sapiens
ttttcaaaaggtattat

SEQ ID NO: 1402931 - DNA, 19 bp, Homo sapiens
ttttctattatttttataa

SEQ ID NO: 1402932 - DNA, 13 bp, Homo sapiens
ttttgaagcatag

SEQ ID NO: 1402933 - DNA, 22 bp, Homo sapiens
ttttgattattttttttttctt

SEQ ID NO: 1402934 - DNA, 16 bp, Homo sapiens
ttttggggagccagaa

SEQ ID NO: 1402935 - DNA, 18 bp, Homo sapiens
ttttgtattttcatgaaa

SEQ ID NO: 1402936 - DNA, 18 bp, Homo sapiens
ttttgtttggagacgttt

SEQ ID NO: 1402937 - DNA, 16 bp, Homo sapiens
tttttatttttggcaa

SEQ ID NO: 1402938 - DNA, 19 bp, Homo sapiens
tttttatttttggcaaagc

SEQ ID NO: 1402939 - DNA, 23 bp, Homo sapiens
cctgtggggtcaacccttctgga

SEQ ID NO: 1402940 - DNA, 13 bp, Homo sapiens
ccttaaatttaat

SEQ ID NO: 1402941 - DNA, 21 bp, Homo sapiens
ccttcctcttgtctgatttct

SEQ ID NO: 1402942 - DNA, 17 bp, Homo sapiens
ccttctccctagctcct

SEQ ID NO: 1402943 - DNA, 19 bp, Homo sapiens
ccttctggaaactgtgaag

SEQ ID NO: 1402944 - DNA, 18 bp, Homo sapiens
ccttgaaactttgggaaa

SEQ ID NO: 1402945 - DNA, 19 bp, Homo sapiens
ccttgaaactttgggaaaa

SEQ ID NO: 1402946 - DNA, 15 bp, Homo sapiens
cgaagagttcccttg

SEQ ID NO: 1402947 - DNA, 13 bp, Homo sapiens
cgatgtaaattat

SEQ ID NO: 1402948 - DNA, 18 bp, Homo sapiens
cgattcctccagccctgg

SEQ ID NO: 1402949 - DNA, 11 bp, Homo sapiens
cgcagagaaat

SEQ ID NO: 1402950 - DNA, 12 bp, Homo sapiens
cgcccacctgtg

SEQ ID NO: 1402951 - DNA, 20 bp, Homo sapiens
cgctccctcccaggactctg

SEQ ID NO: 1402952 - DNA, 16 bp, Homo sapiens
ctaagcattagcttta

SEQ ID NO: 1402953 - DNA, 23 bp, Homo sapiens
ctaagtaatctcacagcatttgc

SEQ ID NO: 1402954 - DNA, 17 bp, Homo sapiens
ctacaaggagataagaa

SEQ ID NO: 1402955 - DNA, 18 bp, Homo sapiens
ctacatctccaaatatca

SEQ ID NO: 1402956 - DNA, 18 bp, Homo sapiens
ctaccagataactgagga

SEQ ID NO: 1402957 - DNA, 15 bp, Homo sapiens
ctactagattgacta

SEQ ID NO: 1402958 - DNA, 19 bp, Homo sapiens
ctagagcacaacataattt

SEQ ID NO: 1402959 - DNA, 13 bp, Homo sapiens
ctagaggccatgt

SEQ ID NO: 1402960 - DNA, 12 bp, Homo sapiens
ctagattgacta

SEQ ID NO: 1402961 - DNA, 13 bp, Homo sapiens
ctagccagccagg

SEQ ID NO: 1402962 - DNA, 14 bp, Homo sapiens
ctatatatataaat

SEQ ID NO: 1402963 - DNA, 18 bp, Homo sapiens
ctatatatataaatgtat

SEQ ID NO: 1402964 - DNA, 23 bp, Homo sapiens
ctatgtatttgcaaggctgattt

SEQ ID NO: 1402965 - DNA, 17 bp, Homo sapiens
ctattcggcaaggaagt

SEQ ID NO: 1402966 - DNA, 13 bp, Homo sapiens
ctattgaataatg

SEQ ID NO: 1402967 - DNA, 22 bp, Homo sapiens
ctcacagcatttgccaagtctc

SEQ ID NO: 1402968 - DNA, 12 bp, Homo sapiens
ctcagccttgca

SEQ ID NO: 1402969 - DNA, 20 bp, Homo sapiens
ctcagcttggcactcaggtg

SEQ ID NO: 1402970 - DNA, 22 bp, Homo sapiens
ctcagcttggcactcaggtgct

SEQ ID NO: 1402971 - DNA, 22 bp, Homo sapiens
ctcaggaatcatctcctttgca

SEQ ID NO: 1402972 - DNA, 19 bp, Homo sapiens
ctcagtgttggtatatttt

SEQ ID NO: 1402973 - DNA, 20 bp, Homo sapiens
ctcataagagtaacagtcat

SEQ ID NO: 1402974 - DNA, 12 bp, Homo sapiens
ctcattgacttt

SEQ ID NO: 1402975 - DNA, 14 bp, Homo sapiens
ctcattgactttta

SEQ ID NO: 1402976 - DNA, 21 bp, Homo sapiens
ctcattgacttttataaagca

SEQ ID NO: 1402977 - DNA, 14 bp, Homo sapiens
ctccactctctacc

SEQ ID NO: 1402978 - DNA, 18 bp, Homo sapiens
ctccagtttcacctcttt

SEQ ID NO: 1402979 - DNA, 17 bp, Homo sapiens
ctcccagagctggtgga

SEQ ID NO: 1402980 - DNA, 14 bp, Homo sapiens
ctccctagctcctc

SEQ ID NO: 1402981 - DNA, 16 bp, Homo sapiens
ctcctattctataaaa

SEQ ID NO: 1402982 - DNA, 18 bp, Homo sapiens
ctcgctccctcccaggac

SEQ ID NO: 1402983 - DNA, 21 bp, Homo sapiens
ctctaccagataactgaggag

SEQ ID NO: 1402984 - DNA, 17 bp, Homo sapiens
ctctatatatacatcat

SEQ ID NO: 1402985 - DNA, 17 bp, Homo sapiens
ctctccaccttccaaag

SEQ ID NO: 1402986 - DNA, 15 bp, Homo sapiens
ctctggggggcaggg

SEQ ID NO: 1402987 - DNA, 17 bp, Homo sapiens
ctcttgtagtcttggct

SEQ ID NO: 1402988 - DNA, 21 bp, Homo sapiens
ctgaagggtaatatggactca

SEQ ID NO: 1402989 - DNA, 22 bp, Homo sapiens
ctgagggcagagaggttaacag

SEQ ID NO: 1402990 - DNA, 14 bp, Homo sapiens
ctgattctggcttt

SEQ ID NO: 1402991 - DNA, 18 bp, Homo sapiens
ctgattctggctttaagc

SEQ ID NO: 1402992 - DNA, 23 bp, Homo sapiens
ctgccatggctaggtagaagtga

SEQ ID NO: 1402993 - DNA, 11 bp, Homo sapiens
ctgccctgtgg

SEQ ID NO: 1402994 - DNA, 19 bp, Homo sapiens
ctgctatgtatttgcaagg

SEQ ID NO: 1402995 - DNA, 19 bp, Homo sapiens
ctgctcggcaccgccagcc

SEQ ID NO: 1402996 - DNA, 23 bp, Homo sapiens
ctgcttaatcttcaaagccttct

SEQ ID NO: 1402997 - DNA, 21 bp, Homo sapiens
ctgcttcccttactttgctga

SEQ ID NO: 1402998 - DNA, 16 bp, Homo sapiens
ctggcttaacttagta

SEQ ID NO: 1402999 - DNA, 17 bp, Homo sapiens
ctggctttaagccttca

SEQ ID NO: 1403000 - DNA, 20 bp, Homo sapiens
ctgggggcaaaatcagaatg

SEQ ID NO: 1403001 - DNA, 23 bp, Homo sapiens
ctgtgagaacccagtttcccgtc

SEQ ID NO: 1403002 - DNA, 14 bp, Homo sapiens
ctgtggcataaatt

SEQ ID NO: 1403003 - DNA, 17 bp, Homo sapiens
ctgttgtaagaattctg

SEQ ID NO: 1403004 - DNA, 21 bp, Homo sapiens
ctgttgtaagaattctgattg

SEQ ID NO: 1403005 - DNA, 19 bp, Homo sapiens
cttaaaataaagttaaact

SEQ ID NO: 1403006 - DNA, 18 bp, Homo sapiens
cttaatggagttcttgtg

SEQ ID NO: 1403007 - DNA, 18 bp, Homo sapiens
cttactttaaccctttct

SEQ ID NO: 1403008 - DNA, 13 bp, Homo sapiens
cttactttgctga

SEQ ID NO: 1403009 - DNA, 15 bp, Homo sapiens
cttaggggaaggaga

SEQ ID NO: 1403010 - DNA, 15 bp, Homo sapiens
cttagtactcttcta

SEQ ID NO: 1403011 - DNA, 16 bp, Homo sapiens
cttatagtctaagact

SEQ ID NO: 1403012 - DNA, 20 bp, Homo sapiens
cttatcttacaatattgatt

SEQ ID NO: 1403013 - DNA, 13 bp, Homo sapiens
cttcaaagccttc

SEQ ID NO: 1403014 - DNA, 23 bp, Homo sapiens
cttcagattccccactcagcctt

SEQ ID NO: 1403015 - DNA, 13 bp, Homo sapiens
cttcccatgcatt

SEQ ID NO: 1403016 - DNA, 18 bp, Homo sapiens
cttcccatgcattctggt

SEQ ID NO: 1403017 - DNA, 12 bp, Homo sapiens
cttcgggaccag

SEQ ID NO: 1403018 - DNA, 15 bp, Homo sapiens
cttcgggaccaggat

SEQ ID NO: 1403019 - DNA, 18 bp, Homo sapiens
cttctagtgatgatggtt

SEQ ID NO: 1403020 - DNA, 19 bp, Homo sapiens
cttctccctagctcctccc

SEQ ID NO: 1403021 - DNA, 14 bp, Homo sapiens
aagaaaattgagtt

SEQ ID NO: 1403022 - DNA, 20 bp, Homo sapiens
aagaattctgattgatttga

SEQ ID NO: 1403023 - DNA, 20 bp, Homo sapiens
aagaattgaaaagtttttgt

SEQ ID NO: 1403024 - DNA, 21 bp, Homo sapiens
aagacccagacaggactgcag

SEQ ID NO: 1403025 - DNA, 14 bp, Homo sapiens
aagactatatatat

SEQ ID NO: 1403026 - DNA, 16 bp, Homo sapiens
aagactgtagatatgt

SEQ ID NO: 1403027 - DNA, 16 bp, Homo sapiens
aagagaatgagtcctt

SEQ ID NO: 1403028 - DNA, 15 bp, Homo sapiens
aagagataagtcttt

SEQ ID NO: 1403029 - DNA, 17 bp, Homo sapiens
aagagtgctaagcatta

SEQ ID NO: 1403030 - DNA, 23 bp, Homo sapiens
aagagtgctaagcattagcttta

SEQ ID NO: 1403031 - DNA, 22 bp, Homo sapiens
aagatctttcattttgcacctg

SEQ ID NO: 1403032 - DNA, 16 bp, Homo sapiens
aagcaaatgcctgcca

SEQ ID NO: 1403033 - DNA, 18 bp, Homo sapiens
aagcaggtgcaacactca

SEQ ID NO: 1403034 - DNA, 15 bp, Homo sapiens
aagcattagctttaa

SEQ ID NO: 1403035 - DNA, 22 bp, Homo sapiens
aagccttcaaaactatagcttg

SEQ ID NO: 1403036 - DNA, 17 bp, Homo sapiens
aagctctcatagctcat

SEQ ID NO: 1403037 - DNA, 24 bp, Homo sapiens
aagctgagatgaaccctggcattt

SEQ ID NO: 1403038 - DNA, 17 bp, Homo sapiens
aagctgcagagatttct

SEQ ID NO: 1403039 - DNA, 16 bp, Homo sapiens
aagcttcagttgcttg

SEQ ID NO: 1403040 - DNA, 15 bp, Homo sapiens
aaggatagtaagcat

SEQ ID NO: 1403041 - DNA, 21 bp, Homo sapiens
aaggctactacagagaaggct

SEQ ID NO: 1403042 - DNA, 21 bp, Homo sapiens
aaggctgcctgctatgtattt

SEQ ID NO: 1403043 - DNA, 16 bp, Homo sapiens
aaggtattatacatgt

SEQ ID NO: 1403044 - DNA, 16 bp, Homo sapiens
aaggtccccagcagaa

SEQ ID NO: 1403045 - DNA, 21 bp, Homo sapiens
aagtaatctcacagcatttgc

SEQ ID NO: 1403046 - DNA, 20 bp, Homo sapiens
aagtctattgaataatgtag

SEQ ID NO: 1403047 - DNA, 15 bp, Homo sapiens
aagtctgatccctgc

SEQ ID NO: 1403048 - DNA, 15 bp, Homo sapiens
aagtctttcatggct

SEQ ID NO: 1403049 - DNA, 13 bp, Homo sapiens
aagtggctggaag

SEQ ID NO: 1403050 - DNA, 16 bp, Homo sapiens
aagtgtgtatatattt

SEQ ID NO: 1403051 - DNA, 14 bp, Homo sapiens
aagttaaactgatt

SEQ ID NO: 1403052 - DNA, 17 bp, Homo sapiens
aagttagtttttaatct

SEQ ID NO: 1403053 - DNA, 21 bp, Homo sapiens
aagttcatgtccaaacgtcct

SEQ ID NO: 1403054 - DNA, 12 bp, Homo sapiens
aagttttgttgt

SEQ ID NO: 1403055 - DNA, 13 bp, Homo sapiens
aataaaatttaaa

SEQ ID NO: 1403056 - DNA, 19 bp, Homo sapiens
aataagcactgtaaacttc

SEQ ID NO: 1403057 - DNA, 22 bp, Homo sapiens
aataagcccaacaagttgaaga

SEQ ID NO: 1403058 - DNA, 17 bp, Homo sapiens
aataatagcacatgatt

SEQ ID NO: 1403059 - DNA, 19 bp, Homo sapiens
aataatgctacaattttaa

SEQ ID NO: 1403060 - DNA, 15 bp, Homo sapiens
aatacacatttgcta

SEQ ID NO: 1403061 - DNA, 14 bp, Homo sapiens
aatacctggcctca

SEQ ID NO: 1403062 - DNA, 19 bp, Homo sapiens
aatacctggcctcatttaa

SEQ ID NO: 1403063 - DNA, 11 bp, Homo sapiens
aatagctcttg

SEQ ID NO: 1403064 - DNA, 23 bp, Homo sapiens
aataggaatcattcagaaatgtt

SEQ ID NO: 1403065 - DNA, 12 bp, Homo sapiens
aatataaaatta

SEQ ID NO: 1403066 - DNA, 17 bp, Homo sapiens
aatatcccttactttaa

SEQ ID NO: 1403067 - DNA, 20 bp, Homo sapiens
aatattcagggtaaatagga

SEQ ID NO: 1403068 - DNA, 18 bp, Homo sapiens
aatattccagatctttca

SEQ ID NO: 1403069 - DNA, 16 bp, Homo sapiens
aatattgattgggaaa

SEQ ID NO: 1403070 - DNA, 22 bp, Homo sapiens
aatattgattgggaaaacattt

SEQ ID NO: 1403071 - DNA, 23 bp, Homo sapiens
aatattgattgggaaaacatttg

SEQ ID NO: 1403072 - DNA, 16 bp, Homo sapiens
aatattgtttggtaaa

SEQ ID NO: 1403073 - DNA, 21 bp, Homo sapiens
aatattgtttggtaaatgttt

SEQ ID NO: 1403074 - DNA, 20 bp, Homo sapiens
aatcatctcctttgcagaat

SEQ ID NO: 1403075 - DNA, 14 bp, Homo sapiens
aatcattcagaaat

SEQ ID NO: 1403076 - DNA, 15 bp, Homo sapiens
aatctcacagcattt

SEQ ID NO: 1403077 - DNA, 13 bp, Homo sapiens
aatcttttgaagc

SEQ ID NO: 1403078 - DNA, 12 bp, Homo sapiens
aatgacaatatt

SEQ ID NO: 1403079 - DNA, 14 bp, Homo sapiens
aatgagctctgaaa

SEQ ID NO: 1403080 - DNA, 19 bp, Homo sapiens
aatgaggaaaattcttaaa

SEQ ID NO: 1403081 - DNA, 17 bp, Homo sapiens
aatgccatctatctagt

SEQ ID NO: 1403082 - DNA, 19 bp, Homo sapiens
aatgcctgccaaattttag

SEQ ID NO: 1403083 - DNA, 16 bp, Homo sapiens
aatgctacaattttaa

SEQ ID NO: 1403084 - DNA, 18 bp, Homo sapiens
aatgtaatagaagcttaa

SEQ ID NO: 1403085 - DNA, 16 bp, Homo sapiens
aatgtaatttaaatga

SEQ ID NO: 1403086 - DNA, 22 bp, Homo sapiens
aatgtagttttgtgatgcattt

SEQ ID NO: 1403087 - DNA, 14 bp, Homo sapiens
aatgtataaatata

SEQ ID NO: 1403088 - DNA, 16 bp, Homo sapiens
aatgtataaatataca

SEQ ID NO: 1403089 - DNA, 13 bp, Homo sapiens
aattaagcaaatg

SEQ ID NO: 1403090 - DNA, 22 bp, Homo sapiens
aattaagcaaatgttaaaagtt

SEQ ID NO: 1403091 - DNA, 14 bp, Homo sapiens
aattcaactttgta

SEQ ID NO: 1403092 - DNA, 23 bp, Homo sapiens
aattctaacgcaaaaatagctct

SEQ ID NO: 1403093 - DNA, 18 bp, Homo sapiens
aattgagttgcacttatt

SEQ ID NO: 1403094 - DNA, 13 bp, Homo sapiens
aattgcatttgtg

SEQ ID NO: 1403095 - DNA, 19 bp, Homo sapiens
aattgtacaaaattaagca

SEQ ID NO: 1403096 - DNA, 16 bp, Homo sapiens
aatttccctctgatat

SEQ ID NO: 1403097 - DNA, 17 bp, Homo sapiens
aattttaaagtgcaaaa

SEQ ID NO: 1403098 - DNA, 16 bp, Homo sapiens
aattttgtatgttaaa

SEQ ID NO: 1403099 - DNA, 22 bp, Homo sapiens
acaaatggctacatctccaaat

SEQ ID NO: 1403100 - DNA, 14 bp, Homo sapiens
acaagttgaagaag

SEQ ID NO: 1403101 - DNA, 12 bp, Homo sapiens
acaattttaaga

SEQ ID NO: 1403102 - DNA, 16 bp, Homo sapiens
acacatttgctactgt

SEQ ID NO: 1403103 - DNA, 19 bp, Homo sapiens
acacatttgctactgttgt

SEQ ID NO: 1403104 - DNA, 13 bp, Homo sapiens
acacatttttttg

SEQ ID NO: 1403105 - DNA, 15 bp, Homo sapiens
acagagctagaggcc

SEQ ID NO: 1403106 - DNA, 19 bp, Homo sapiens
acagaggtattaaaactaa

SEQ ID NO: 1403107 - DNA, 17 bp, Homo sapiens
acagatgtgttgcaaag

SEQ ID NO: 1403108 - DNA, 20 bp, Homo sapiens
acagccactcccctccactc

SEQ ID NO: 1403109 - DNA, 16 bp, Homo sapiens
acagtatagatttttg

SEQ ID NO: 1403110 - DNA, 15 bp, Homo sapiens
acataagcttccatt

SEQ ID NO: 1403111 - DNA, 22 bp, Homo sapiens
acatatttcaaaaacatgcttt

SEQ ID NO: 1403112 - DNA, 16 bp, Homo sapiens
acatcatacttaactt

SEQ ID NO: 1403113 - DNA, 13 bp, Homo sapiens
acatcatttgtat

SEQ ID NO: 1403114 - DNA, 19 bp, Homo sapiens
acatcatttgtattatgtt

SEQ ID NO: 1403115 - DNA, 18 bp, Homo sapiens
acatgcaataaaatttaa

SEQ ID NO: 1403116 - DNA, 22 bp, Homo sapiens
acatgccacatcaaacctttga

SEQ ID NO: 1403117 - DNA, 13 bp, Homo sapiens
acatgcttttcca

SEQ ID NO: 1403118 - DNA, 15 bp, Homo sapiens
acatgcttttccaaa

SEQ ID NO: 1403119 - DNA, 14 bp, Homo sapiens
acatgtgatacatt

SEQ ID NO: 1403120 - DNA, 15 bp, Homo sapiens
acatgtgatacattt

SEQ ID NO: 1403121 - DNA, 23 bp, Homo sapiens
acatgtgatacattttttaagct

SEQ ID NO: 1403122 - DNA, 16 bp, Homo sapiens
acatgttaatgacaat

SEQ ID NO: 1403123 - DNA, 19 bp, Homo sapiens
acatttgctactgttgtaa

SEQ ID NO: 1403124 - DNA, 18 bp, Homo sapiens
accacatttctaagcctt

SEQ ID NO: 1403125 - DNA, 21 bp, Homo sapiens
accagggagatttgctcaata

SEQ ID NO: 1403126 - DNA, 12 bp, Homo sapiens
accagtccctgt

SEQ ID NO: 1403127 - DNA, 14 bp, Homo sapiens
accataaattcaac

SEQ ID NO: 1403128 - DNA, 18 bp, Homo sapiens
accatgtgagctcttcct

SEQ ID NO: 1403129 - DNA, 19 bp, Homo sapiens
accatgtgagctcttccta

SEQ ID NO: 1403130 - DNA, 22 bp, Homo sapiens
acccatgttgagacctcagctt

SEQ ID NO: 1403131 - DNA, 22 bp, Homo sapiens
acccccgacgtgctcccctgct

SEQ ID NO: 1403132 - DNA, 23 bp, Homo sapiens
acccccgacgtgctcccctgctc

SEQ ID NO: 1403133 - DNA, 22 bp, Homo sapiens
acccttactggcttacctcctc

SEQ ID NO: 1403134 - DNA, 14 bp, Homo sapiens
acctggcctcattt

SEQ ID NO: 1403135 - DNA, 16 bp, Homo sapiens
acctggcctcatttaa

SEQ ID NO: 1403136 - DNA, 15 bp, Homo sapiens
acgatgatgtacaga

SEQ ID NO: 1403137 - DNA, 13 bp, Homo sapiens
acgcaaaaatagc

SEQ ID NO: 1403138 - DNA, 14 bp, Homo sapiens
acgtttataaacag

SEQ ID NO: 1403139 - DNA, 15 bp, Homo sapiens
actaactcaaataca

SEQ ID NO: 1403140 - DNA, 22 bp, Homo sapiens
actaactcaaatacacatttgc

SEQ ID NO: 1403141 - DNA, 13 bp, Homo sapiens
actagccagccag

SEQ ID NO: 1403142 - DNA, 17 bp, Homo sapiens
actatatatataaatgt

SEQ ID NO: 1403143 - DNA, 16 bp, Homo sapiens
actcaaatacacattt

SEQ ID NO: 1403144 - DNA, 19 bp, Homo sapiens
actcagccttgcaaatagc

SEQ ID NO: 1403145 - DNA, 12 bp, Homo sapiens
actcagcctttt

SEQ ID NO: 1403146 - DNA, 22 bp, Homo sapiens
actcagccttttgggaataata

SEQ ID NO: 1403147 - DNA, 14 bp, Homo sapiens
actctgcatgtaga

SEQ ID NO: 1403148 - DNA, 13 bp, Homo sapiens
actgacatttctt

SEQ ID NO: 1403149 - DNA, 20 bp, Homo sapiens
actgcagccactgattctct

SEQ ID NO: 1403150 - DNA, 21 bp, Homo sapiens
actgcttcccttactttgctg

SEQ ID NO: 1403151 - DNA, 15 bp, Homo sapiens
atttgaaaaatataa

SEQ ID NO: 1403152 - DNA, 22 bp, Homo sapiens
attttatattactgacatttct

SEQ ID NO: 1403153 - DNA, 17 bp, Homo sapiens
atttttggcaaagccag

SEQ ID NO: 1403154 - DNA, 21 bp, Homo sapiens
attttttaagcttcagttgct

SEQ ID NO: 1403155 - DNA, 15 bp, Homo sapiens
atttttttaaaattt

SEQ ID NO: 1403156 - DNA, 22 bp, Homo sapiens
atttttttgcatgcatgcaaat

SEQ ID NO: 1403157 - DNA, 23 bp, Homo sapiens
atttttttgcatgcatgcaaatg

SEQ ID NO: 1403158 - DNA, 14 bp, Homo sapiens
caaaaatagctctt

SEQ ID NO: 1403159 - DNA, 16 bp, Homo sapiens
caaaaatagctcttgc

SEQ ID NO: 1403160 - DNA, 20 bp, Homo sapiens
caaaaatagctcttgctttg

SEQ ID NO: 1403161 - DNA, 14 bp, Homo sapiens
caaacctttgagta

SEQ ID NO: 1403162 - DNA, 16 bp, Homo sapiens
caaatacacatttgct

SEQ ID NO: 1403163 - DNA, 17 bp, Homo sapiens
caaatagccagtgctag

SEQ ID NO: 1403164 - DNA, 15 bp, Homo sapiens
caaatgcctgccaaa

SEQ ID NO: 1403165 - DNA, 16 bp, Homo sapiens
caaatgcctgccaaat

SEQ ID NO: 1403166 - DNA, 21 bp, Homo sapiens
caaatggctacatctccaaat

SEQ ID NO: 1403167 - DNA, 15 bp, Homo sapiens
caacaagttgaagaa

SEQ ID NO: 1403168 - DNA, 19 bp, Homo sapiens
caactttgtaaaaatcttt

SEQ ID NO: 1403169 - DNA, 19 bp, Homo sapiens
caagaaaagcgcagagaaa

SEQ ID NO: 1403170 - DNA, 20 bp, Homo sapiens
caagaaaagcgcagagaaat

SEQ ID NO: 1403171 - DNA, 17 bp, Homo sapiens
caagggctgtcattgca

SEQ ID NO: 1403172 - DNA, 11 bp, Homo sapiens
caataaaattt

SEQ ID NO: 1403173 - DNA, 17 bp, Homo sapiens
caatatccaattttaaa

SEQ ID NO: 1403174 - DNA, 16 bp, Homo sapiens
caatgaaccataaatt

SEQ ID NO: 1403175 - DNA, 18 bp, Homo sapiens
cacactgtggcctgatca

SEQ ID NO: 1403176 - DNA, 16 bp, Homo sapiens
cacacttgaaaccttt

SEQ ID NO: 1403177 - DNA, 16 bp, Homo sapiens
cacagaagcacatgca

SEQ ID NO: 1403178 - DNA, 23 bp, Homo sapiens
cacagagcaagagataagtcttt

SEQ ID NO: 1403179 - DNA, 19 bp, Homo sapiens
cacagatgttcccccatct

SEQ ID NO: 1403180 - DNA, 14 bp, Homo sapiens
cacatcaaaccttt

SEQ ID NO: 1403181 - DNA, 17 bp, Homo sapiens
cacatttctaagccttt

SEQ ID NO: 1403182 - DNA, 13 bp, Homo sapiens
caccaggcaagaa

SEQ ID NO: 1403183 - DNA, 17 bp, Homo sapiens
caccatgtgagctcttc

SEQ ID NO: 1403184 - DNA, 21 bp, Homo sapiens
cacctacaaggagataagaaa

SEQ ID NO: 1403185 - DNA, 21 bp, Homo sapiens
cacctgtgggccagccgattc

SEQ ID NO: 1403186 - DNA, 12 bp, Homo sapiens
caccttccaaag

SEQ ID NO: 1403187 - DNA, 20 bp, Homo sapiens
cacgttggggtgatttaatc

SEQ ID NO: 1403188 - DNA, 21 bp, Homo sapiens
cacgttggggtgatttaatcc

SEQ ID NO: 1403189 - DNA, 19 bp, Homo sapiens
cactcctgcttaatcttca

SEQ ID NO: 1403190 - DNA, 21 bp, Homo sapiens
cactcctgcttaatcttcaaa

SEQ ID NO: 1403191 - DNA, 23 bp, Homo sapiens
cactctccgaagtctgatccctg

SEQ ID NO: 1403192 - DNA, 23 bp, Homo sapiens
cactctgccccccccccccatct

SEQ ID NO: 1403193 - DNA, 21 bp, Homo sapiens
cacttgaaacctttttttatc

SEQ ID NO: 1403194 - DNA, 20 bp, Homo sapiens
cagaaatataacacattttt

SEQ ID NO: 1403195 - DNA, 21 bp, Homo sapiens
cagaaccacacttgaaacctt

SEQ ID NO: 1403196 - DNA, 16 bp, Homo sapiens
cagagaggttaacaga

SEQ ID NO: 1403197 - DNA, 20 bp, Homo sapiens
cagagatttctcattgactt

SEQ ID NO: 1403198 - DNA, 21 bp, Homo sapiens
cagagctggtggacccaggga

SEQ ID NO: 1403199 - DNA, 22 bp, Homo sapiens
cagaggatgctgacatcatttg

SEQ ID NO: 1403200 - DNA, 22 bp, Homo sapiens
cagagttttcattaaatccttt

SEQ ID NO: 1403201 - DNA, 23 bp, Homo sapiens
cagagttttcattaaatcctttt

SEQ ID NO: 1403202 - DNA, 20 bp, Homo sapiens
cagataactgaggaggggag

SEQ ID NO: 1403203 - DNA, 21 bp, Homo sapiens
cagattccccactcagccttt

SEQ ID NO: 1403204 - DNA, 15 bp, Homo sapiens
cagcatttgccaagt

SEQ ID NO: 1403205 - DNA, 22 bp, Homo sapiens
cagccaagcaaatgcctgccaa

SEQ ID NO: 1403206 - DNA, 21 bp, Homo sapiens
cagccactcccctccactctc

SEQ ID NO: 1403207 - DNA, 15 bp, Homo sapiens
cagccagttcaaaaa

SEQ ID NO: 1403208 - DNA, 20 bp, Homo sapiens
cagccgattcctccagccct

SEQ ID NO: 1403209 - DNA, 19 bp, Homo sapiens
caggacatgcaataaaatt

SEQ ID NO: 1403210 - DNA, 21 bp, Homo sapiens
caggacatgcaataaaattta

SEQ ID NO: 1403211 - DNA, 15 bp, Homo sapiens
caggactagagcaca

SEQ ID NO: 1403212 - DNA, 16 bp, Homo sapiens
caggactagagcacaa

SEQ ID NO: 1403213 - DNA, 14 bp, Homo sapiens
caggatttgcacag

SEQ ID NO: 1403214 - DNA, 18 bp, Homo sapiens
caggcaccagtccctgtc

SEQ ID NO: 1403215 - DNA, 13 bp, Homo sapiens
caggttcaggtcc

SEQ ID NO: 1403216 - DNA, 15 bp, Homo sapiens
cagtcatcatttatc

SEQ ID NO: 1403217 - DNA, 14 bp, Homo sapiens
cagtcccctttctc

SEQ ID NO: 1403218 - DNA, 14 bp, Homo sapiens
cagttgcttgtctt

SEQ ID NO: 1403219 - DNA, 15 bp, Homo sapiens
cagtttgttggaaag

SEQ ID NO: 1403220 - DNA, 20 bp, Homo sapiens
cataaattcaactttgtaaa

SEQ ID NO: 1403221 - DNA, 17 bp, Homo sapiens
catactttgtattttga

SEQ ID NO: 1403222 - DNA, 18 bp, Homo sapiens
catagaaaccactagaaa

SEQ ID NO: 1403223 - DNA, 23 bp, Homo sapiens
catagataatattgtttggtaaa

SEQ ID NO: 1403224 - DNA, 24 bp, Homo sapiens
catagataatattgtttggtaaat

SEQ ID NO: 1403225 - DNA, 15 bp, Homo sapiens
catcacaaatggcta

SEQ ID NO: 1403226 - DNA, 12 bp, Homo sapiens
catcactgtatc

SEQ ID NO: 1403227 - DNA, 14 bp, Homo sapiens
catcatacttaact

SEQ ID NO: 1403228 - DNA, 12 bp, Homo sapiens
catcatttatca

SEQ ID NO: 1403229 - DNA, 15 bp, Homo sapiens
catctaattctgatt

SEQ ID NO: 1403230 - DNA, 22 bp, Homo sapiens
catctccaaatatcagtgggct

SEQ ID NO: 1403231 - DNA, 15 bp, Homo sapiens
catctcctttgcaga

SEQ ID NO: 1403232 - DNA, 20 bp, Homo sapiens
catctcgctccctcccagga

SEQ ID NO: 1403233 - DNA, 15 bp, Homo sapiens
catcttcgggaccag

SEQ ID NO: 1403234 - DNA, 24 bp, Homo sapiens
catgaaaataccatttagtaagaa

SEQ ID NO: 1403235 - DNA, 13 bp, Homo sapiens
catgaggaggggc

SEQ ID NO: 1403236 - DNA, 18 bp, Homo sapiens
catgcaataaaatttaaa

SEQ ID NO: 1403237 - DNA, 14 bp, Homo sapiens
catgcttttccaaa

SEQ ID NO: 1403238 - DNA, 15 bp, Homo sapiens
catgcttttccaaac

SEQ ID NO: 1403239 - DNA, 16 bp, Homo sapiens
catgtgagaatatttt

SEQ ID NO: 1403240 - DNA, 16 bp, Homo sapiens
catgtgatacattttt

SEQ ID NO: 1403241 - DNA, 20 bp, Homo sapiens
catgttgagacctcagcttg

SEQ ID NO: 1403242 - DNA, 23 bp, Homo sapiens
cattaaggggaagaatgaaagct

SEQ ID NO: 1403243 - DNA, 14 bp, Homo sapiens
cattcagaaatgtt

SEQ ID NO: 1403244 - DNA, 14 bp, Homo sapiens
cattctcaggcacc

SEQ ID NO: 1403245 - DNA, 15 bp, Homo sapiens
cattctcaggcacca

SEQ ID NO: 1403246 - DNA, 17 bp, Homo sapiens
cattctcaggcaccagt

SEQ ID NO: 1403247 - DNA, 9 bp, Homo sapiens
cattgagta

SEQ ID NO: 1403248 - DNA, 10 bp, Homo sapiens
cattgagtat

SEQ ID NO: 1403249 - DNA, 14 bp, Homo sapiens
cattgagtattgtt

SEQ ID NO: 1403250 - DNA, 16 bp, Homo sapiens
cattgagtattgttta

SEQ ID NO: 1403251 - DNA, 21 bp, Homo sapiens
cattgcacataagcttccatt

SEQ ID NO: 1403252 - DNA, 15 bp, Homo sapiens
catttctaagccttt

SEQ ID NO: 1403253 - DNA, 15 bp, Homo sapiens
catttgctactgttg

SEQ ID NO: 1403254 - DNA, 15 bp, Homo sapiens
cattttatagaatgt

SEQ ID NO: 1403255 - DNA, 16 bp, Homo sapiens
ccaaagagtgctaagc

SEQ ID NO: 1403256 - DNA, 19 bp, Homo sapiens
ccaaatatcagtgggctct

SEQ ID NO: 1403257 - DNA, 21 bp, Homo sapiens
ccaaattttagatttaccttg

SEQ ID NO: 1403258 - DNA, 14 bp, Homo sapiens
ccaagcaaatgcct

SEQ ID NO: 1403259 - DNA, 19 bp, Homo sapiens
ccaagcaaatgcctgccaa

SEQ ID NO: 1403260 - DNA, 21 bp, Homo sapiens
ccaatatccaattttaaaatg

SEQ ID NO: 1403261 - DNA, 23 bp, Homo sapiens
ccaattttaaaatgaaatgcatt

SEQ ID NO: 1403262 - DNA, 23 bp, Homo sapiens
ccacagaggatgctgacatcatt

SEQ ID NO: 1403263 - DNA, 12 bp, Homo sapiens
ccacatatttca

SEQ ID NO: 1403264 - DNA, 16 bp, Homo sapiens
ccacatcaaataagaa

SEQ ID NO: 1403265 - DNA, 17 bp, Homo sapiens
ccacatttctaagcctt

SEQ ID NO: 1403266 - DNA, 13 bp, Homo sapiens
ccactcagccttt

SEQ ID NO: 1403267 - DNA, 22 bp, Homo sapiens
ccactcccctccactctctacc

SEQ ID NO: 1403268 - DNA, 22 bp, Homo sapiens
ccagaaccacacttgaaacctt

SEQ ID NO: 1403269 - DNA, 22 bp, Homo sapiens
ccagagctggtggacccaggga

SEQ ID NO: 1403270 - DNA, 20 bp, Homo sapiens
ccagcattctcaggcaccag

SEQ ID NO: 1403271 - DNA, 21 bp, Homo sapiens
ccagccgattcctccagccct

SEQ ID NO: 1403272 - DNA, 13 bp, Homo sapiens
ccaggaagatgaa

SEQ ID NO: 1403273 - DNA, 17 bp, Homo sapiens
ccaggaagatgaatcct

SEQ ID NO: 1403274 - DNA, 16 bp, Homo sapiens
ccaggactagagcaca

SEQ ID NO: 1403275 - DNA, 17 bp, Homo sapiens
ccaggtcgcccacctgt

SEQ ID NO: 1403276 - DNA, 15 bp, Homo sapiens
ccagtcccctttctc

SEQ ID NO: 1403277 - DNA, 13 bp, Homo sapiens
ccagtccctgtcc

SEQ ID NO: 1403278 - DNA, 18 bp, Homo sapiens
ccagtccctgtccggaat

SEQ ID NO: 1403279 - DNA, 14 bp, Homo sapiens
ccatacaccccctc

SEQ ID NO: 1403280 - DNA, 16 bp, Homo sapiens
ccatagacatgaaagg

SEQ ID NO: 1403281 - DNA, 11 bp, Homo sapiens
ggaagaatgaa

SEQ ID NO: 1403282 - DNA, 17 bp, Homo sapiens
ggaagggaaagtttttt

SEQ ID NO: 1403283 - DNA, 17 bp, Homo sapiens
ggaagtaaagtgaagaa

SEQ ID NO: 1403284 - DNA, 16 bp, Homo sapiens
ggacatgcaataaaat

SEQ ID NO: 1403285 - DNA, 14 bp, Homo sapiens
ggactcatgaggag

SEQ ID NO: 1403286 - DNA, 21 bp, Homo sapiens
ggactgcagagggctccagag

SEQ ID NO: 1403287 - DNA, 15 bp, Homo sapiens
ggagatcccacatat

SEQ ID NO: 1403288 - DNA, 18 bp, Homo sapiens
ggagatcccacatatttc

SEQ ID NO: 1403289 - DNA, 17 bp, Homo sapiens
ggatgctgacatcattt

SEQ ID NO: 1403290 - DNA, 14 bp, Homo sapiens
ggatggcttgtcta

SEQ ID NO: 1403291 - DNA, 14 bp, Homo sapiens
ggcaccagtccctg

SEQ ID NO: 1403292 - DNA, 16 bp, Homo sapiens
ggcactagccaaagcg

SEQ ID NO: 1403293 - DNA, 11 bp, Homo sapiens
ggcattgagta

SEQ ID NO: 1403294 - DNA, 21 bp, Homo sapiens
ggccagccgattcctccagcc

SEQ ID NO: 1403295 - DNA, 16 bp, Homo sapiens
ggccatgtctcctgca

SEQ ID NO: 1403296 - DNA, 18 bp, Homo sapiens
ggcccatagcagccagtt

SEQ ID NO: 1403297 - DNA, 14 bp, Homo sapiens
ggcccccctgccct

SEQ ID NO: 1403298 - DNA, 19 bp, Homo sapiens
ggcctcagctcaatgcagt

SEQ ID NO: 1403299 - DNA, 17 bp, Homo sapiens
ggctacatctccaaata

SEQ ID NO: 1403300 - DNA, 15 bp, Homo sapiens
ggcttaacttagtat

SEQ ID NO: 1403301 - DNA, 17 bp, Homo sapiens
gggaaactgagggcaga

SEQ ID NO: 1403302 - DNA, 21 bp, Homo sapiens
gggaaactgagggcagagagg

SEQ ID NO: 1403303 - DNA, 15 bp, Homo sapiens
gggatatttttttct

SEQ ID NO: 1403304 - DNA, 20 bp, Homo sapiens
gggccagccgattcctccag

SEQ ID NO: 1403305 - DNA, 21 bp, Homo sapiens
gggccagccgattcctccagc

SEQ ID NO: 1403306 - DNA, 13 bp, Homo sapiens
gggcccccctgcc

SEQ ID NO: 1403307 - DNA, 17 bp, Homo sapiens
gggcccccctgccctgt

SEQ ID NO: 1403308 - DNA, 22 bp, Homo sapiens
ggggaaactgagggcagagagg

SEQ ID NO: 1403309 - DNA, 15 bp, Homo sapiens
ggggcccccctgccc

SEQ ID NO: 1403310 - DNA, 12 bp, Homo sapiens
ggtaaatgtttc

SEQ ID NO: 1403311 - DNA, 13 bp, Homo sapiens
ggtaaatgtttct

SEQ ID NO: 1403312 - DNA, 15 bp, Homo sapiens
ggtgtctccttaagc

SEQ ID NO: 1403313 - DNA, 17 bp, Homo sapiens
gtaaataggaatcattc

SEQ ID NO: 1403314 - DNA, 16 bp, Homo sapiens
gtaacagtcatcattt

SEQ ID NO: 1403315 - DNA, 17 bp, Homo sapiens
gtaacagtcatcattta

SEQ ID NO: 1403316 - DNA, 18 bp, Homo sapiens
gtaacagtcatcatttat

SEQ ID NO: 1403317 - DNA, 16 bp, Homo sapiens
gtaagaagacaaactg

SEQ ID NO: 1403318 - DNA, 22 bp, Homo sapiens
gtaagatatctcaatgaaccat

SEQ ID NO: 1403319 - DNA, 12 bp, Homo sapiens
gtaataaactat

SEQ ID NO: 1403320 - DNA, 14 bp, Homo sapiens
gtaataaactattt

SEQ ID NO: 1403321 - DNA, 20 bp, Homo sapiens
gtaatcccctaaaataacag

SEQ ID NO: 1403322 - DNA, 19 bp, Homo sapiens
gtaatttaaatgaaagaaa

SEQ ID NO: 1403323 - DNA, 14 bp, Homo sapiens
gtagaggcttgttt

SEQ ID NO: 1403324 - DNA, 18 bp, Homo sapiens
gtagatatgtattctttt

SEQ ID NO: 1403325 - DNA, 20 bp, Homo sapiens
gtagtcttggctaaggaaat

SEQ ID NO: 1403326 - DNA, 20 bp, Homo sapiens
gtagttttgtgatgcatttt

SEQ ID NO: 1403327 - DNA, 20 bp, Homo sapiens
gtatgtgggatattgaatgt

SEQ ID NO: 1403328 - DNA, 18 bp, Homo sapiens
gtattaaaactaaatttc

SEQ ID NO: 1403329 - DNA, 20 bp, Homo sapiens
gtattaaaactaaatttcac

SEQ ID NO: 1403330 - DNA, 22 bp, Homo sapiens
gtattatacatgtgatacattt

SEQ ID NO: 1403331 - DNA, 19 bp, Homo sapiens
gtattatgttccaaggcta

SEQ ID NO: 1403332 - DNA, 15 bp, Homo sapiens
gtattttcatgaaaa

SEQ ID NO: 1403333 - DNA, 15 bp, Homo sapiens
gtcaacccttctgga

SEQ ID NO: 1403334 - DNA, 16 bp, Homo sapiens
gtccggaatgccaccc

SEQ ID NO: 1403335 - DNA, 14 bp, Homo sapiens
gtcctagtaagaag

SEQ ID NO: 1403336 - DNA, 23 bp, Homo sapiens
gtcctgacaccaggcaagaaaag

SEQ ID NO: 1403337 - DNA, 22 bp, Homo sapiens
gtctatataaccacatttctaa

SEQ ID NO: 1403338 - DNA, 13 bp, Homo sapiens
gtctttcatggct

SEQ ID NO: 1403339 - DNA, 16 bp, Homo sapiens
gtctttcatggctgct

SEQ ID NO: 1403340 - DNA, 19 bp, Homo sapiens
gtctttcatggctgctgtt

SEQ ID NO: 1403341 - DNA, 19 bp, Homo sapiens
gtgaagatctcactctgcc

SEQ ID NO: 1403342 - DNA, 17 bp, Homo sapiens
gtgagaacccagtttcc

SEQ ID NO: 1403343 - DNA, 18 bp, Homo sapiens
gtgagtgacgatgatgta

SEQ ID NO: 1403344 - DNA, 15 bp, Homo sapiens
gtgatgcattttata

SEQ ID NO: 1403345 - DNA, 17 bp, Homo sapiens
gtgattcttagcaaaaa

SEQ ID NO: 1403346 - DNA, 13 bp, Homo sapiens
gtgctcccctgct

SEQ ID NO: 1403347 - DNA, 21 bp, Homo sapiens
gtggagatcccacatatttca

SEQ ID NO: 1403348 - DNA, 20 bp, Homo sapiens
gtgggatttccagaaccaca

SEQ ID NO: 1403349 - DNA, 19 bp, Homo sapiens
gtgtcacactgtggcctga

SEQ ID NO: 1403350 - DNA, 23 bp, Homo sapiens
gtgtggattgcctctgaaaagtg

SEQ ID NO: 1403351 - DNA, 18 bp, Homo sapiens
gttaaactggcttaactt

SEQ ID NO: 1403352 - DNA, 21 bp, Homo sapiens
gttaaagggatatttttttct

SEQ ID NO: 1403353 - DNA, 19 bp, Homo sapiens
gttagaagaggtggcccca

SEQ ID NO: 1403354 - DNA, 19 bp, Homo sapiens
gttcaggtcccctttcaga

SEQ ID NO: 1403355 - DNA, 21 bp, Homo sapiens
gttcccttgaaactttgggaa

SEQ ID NO: 1403356 - DNA, 23 bp, Homo sapiens
gttgggaatgaggaaaattctta

SEQ ID NO: 1403357 - DNA, 14 bp, Homo sapiens
gtttataaacagaa

SEQ ID NO: 1403358 - DNA, 15 bp, Homo sapiens
gtttcagtttgttgg

SEQ ID NO: 1403359 - DNA, 14 bp, Homo sapiens
gtttcttttaaaga

SEQ ID NO: 1403360 - DNA, 14 bp, Homo sapiens
gtttcttttgtttg

SEQ ID NO: 1403361 - DNA, 18 bp, Homo sapiens
gtttcttttgtttggtaa

SEQ ID NO: 1403362 - DNA, 16 bp, Homo sapiens
gtttggtaaatgtttc

SEQ ID NO: 1403363 - DNA, 18 bp, Homo sapiens
taaaaatcttttgaagca

SEQ ID NO: 1403364 - DNA, 17 bp, Homo sapiens
taaaactaaatttcact

SEQ ID NO: 1403365 - DNA, 14 bp, Homo sapiens
taaaatgaaatgca

SEQ ID NO: 1403366 - DNA, 10 bp, Homo sapiens
taaaatgtaa

SEQ ID NO: 1403367 - DNA, 20 bp, Homo sapiens
taaaatgtaatttaaatgaa

SEQ ID NO: 1403368 - DNA, 22 bp, Homo sapiens
taaagatggggaaactgagggc

SEQ ID NO: 1403369 - DNA, 18 bp, Homo sapiens
taaagtgaagaatttatc

SEQ ID NO: 1403370 - DNA, 21 bp, Homo sapiens
taaataggaatcattcagaaa

SEQ ID NO: 1403371 - DNA, 19 bp, Homo sapiens
taaatggtaataagcactg

SEQ ID NO: 1403372 - DNA, 18 bp, Homo sapiens
taaattcaactttgtaaa

SEQ ID NO: 1403373 - DNA, 18 bp, Homo sapiens
taaattgcatcactgtat

SEQ ID NO: 1403374 - DNA, 14 bp, Homo sapiens
taaatttaatacca

SEQ ID NO: 1403375 - DNA, 21 bp, Homo sapiens
taacacatttttttgcatgca

SEQ ID NO: 1403376 - DNA, 14 bp, Homo sapiens
taacagtcatcatt

SEQ ID NO: 1403377 - DNA, 16 bp, Homo sapiens
taacagtcatcattta

SEQ ID NO: 1403378 - DNA, 17 bp, Homo sapiens
taacagtcatcatttat

SEQ ID NO: 1403379 - DNA, 19 bp, Homo sapiens
taacccccttaaatttaat

SEQ ID NO: 1403380 - DNA, 20 bp, Homo sapiens
taaccctttctgggatgcaa

SEQ ID NO: 1403381 - DNA, 20 bp, Homo sapiens
taacgcaaaaatagctcttg

SEQ ID NO: 1403382 - DNA, 15 bp, Homo sapiens
taactcaaatacaca

SEQ ID NO: 1403383 - DNA, 11 bp, Homo sapiens
taacttagtat

SEQ ID NO: 1403384 - DNA, 22 bp, Homo sapiens
taagaataccacatcaaataag

SEQ ID NO: 1403385 - DNA, 18 bp, Homo sapiens
taagaattctgattgatt

SEQ ID NO: 1403386 - DNA, 19 bp, Homo sapiens
taagagtaacagtcatcat

SEQ ID NO: 1403387 - DNA, 14 bp, Homo sapiens
taagcaaatgttaa

SEQ ID NO: 1403388 - DNA, 19 bp, Homo sapiens
taagcaaatgttaaaagtt

SEQ ID NO: 1403389 - DNA, 18 bp, Homo sapiens
taagcctttgagactgtt

SEQ ID NO: 1403390 - DNA, 20 bp, Homo sapiens
taagcctttgagactgttcc

SEQ ID NO: 1403391 - DNA, 17 bp, Homo sapiens
taagcttcagttgcttg

SEQ ID NO: 1403392 - DNA, 14 bp, Homo sapiens
taaggaaattctaa

SEQ ID NO: 1403393 - DNA, 16 bp, Homo sapiens
taaggggaagaatgaa

SEQ ID NO: 1403394 - DNA, 13 bp, Homo sapiens
taaggtccccagc

SEQ ID NO: 1403395 - DNA, 22 bp, Homo sapiens
taagtaatctcacagcatttgc

SEQ ID NO: 1403396 - DNA, 22 bp, Homo sapiens
taatatggactcagccttgcaa

SEQ ID NO: 1403397 - DNA, 23 bp, Homo sapiens
taatatggactcagccttgcaaa

SEQ ID NO: 1403398 - DNA, 21 bp, Homo sapiens
taatattcagggtaaatagga

SEQ ID NO: 1403399 - DNA, 23 bp, Homo sapiens
taatccagttataagaagaagtt

SEQ ID NO: 1403400 - DNA, 19 bp, Homo sapiens
taatcccctaaaataacag

SEQ ID NO: 1403401 - DNA, 13 bp, Homo sapiens
taatctctccacc

SEQ ID NO: 1403402 - DNA, 20 bp, Homo sapiens
taatctctccaccttccaaa

SEQ ID NO: 1403403 - DNA, 23 bp, Homo sapiens
taatgtgtggattgcctctgaaa

SEQ ID NO: 1403404 - DNA, 14 bp, Homo sapiens
taattaagctctca

SEQ ID NO: 1403405 - DNA, 22 bp, Homo sapiens
taattaagctctcatagctcat

SEQ ID NO: 1403406 - DNA, 17 bp, Homo sapiens
taattgtacaaaattaa

SEQ ID NO: 1403407 - DNA, 23 bp, Homo sapiens
taattgtacaaaattaagcaaat

SEQ ID NO: 1403408 - DNA, 16 bp, Homo sapiens
taatttacttgttttg

SEQ ID NO: 1403409 - DNA, 20 bp, Homo sapiens
taatttacttgttttggatg

SEQ ID NO: 1403410 - DNA, 12 bp, Homo sapiens
taattttaaagt

SEQ ID NO: 1403411 - DNA, 17 bp, Homo sapiens
ttttgtatgttaaagag

SEQ ID NO: 1403412 - DNA, 14 bp, Homo sapiens
ttttgtgtgaaatt

SEQ ID NO: 1403413 - DNA, 15 bp, Homo sapiens
ttttgtgtgaaattg

SEQ ID NO: 1403414 - DNA, 18 bp, Homo sapiens
tttttataattgtacaaa

SEQ ID NO: 1403415 - DNA, 19 bp, Homo sapiens
tttttgcatgcatgcaaat

SEQ ID NO: 1403416 - DNA, 14 bp, Homo sapiens
tttttggttgggaa

SEQ ID NO: 1403417 - DNA, 11 bp, Homo sapiens
tttttgtttgg

SEQ ID NO: 1403418 - DNA, 10 bp, Homo sapiens
aaaaaaaaga

SEQ ID NO: 1403419 - DNA, 15 bp, Homo sapiens
aaaagcactcctgct

SEQ ID NO: 1403420 - DNA, 19 bp, Homo sapiens
aaaagtgtgtatatatttt

SEQ ID NO: 1403421 - DNA, 13 bp, Homo sapiens
aaaatcagaatgg

SEQ ID NO: 1403422 - DNA, 16 bp, Homo sapiens
aaaatcttttgaagca

SEQ ID NO: 1403423 - DNA, 14 bp, Homo sapiens
aaaatgtaatttaa

SEQ ID NO: 1403424 - DNA, 18 bp, Homo sapiens
aaaatgtaatttaaatga

SEQ ID NO: 1403425 - DNA, 20 bp, Homo sapiens
aaacacccgacgtcatgtat

SEQ ID NO: 1403426 - DNA, 17 bp, Homo sapiens
aaacatgcttttccaaa

SEQ ID NO: 1403427 - DNA, 15 bp, Homo sapiens
aaaccactagaaagt

SEQ ID NO: 1403428 - DNA, 23 bp, Homo sapiens
aaacgtcctctttagtttttggt

SEQ ID NO: 1403429 - DNA, 19 bp, Homo sapiens
aaactggcttaacttagta

SEQ ID NO: 1403430 - DNA, 13 bp, Homo sapiens
aaactttgggaaa

SEQ ID NO: 1403431 - DNA, 17 bp, Homo sapiens
aaactttgggaaaacat

SEQ ID NO: 1403432 - DNA, 20 bp, Homo sapiens
aaactttgggaaaacatgtt

SEQ ID NO: 1403433 - DNA, 9 bp, Homo sapiens
aaagaaaag

SEQ ID NO: 1403434 - DNA, 15 bp, Homo sapiens
aaagaaaagagaaaa

SEQ ID NO: 1403435 - DNA, 12 bp, Homo sapiens
aaagaaaattga

SEQ ID NO: 1403436 - DNA, 22 bp, Homo sapiens
aaagaccctcctattctataaa

SEQ ID NO: 1403437 - DNA, 18 bp, Homo sapiens
aaagactagccagccagg

SEQ ID NO: 1403438 - DNA, 22 bp, Homo sapiens
aaagcatgttcacccttatagt

SEQ ID NO: 1403439 - DNA, 13 bp, Homo sapiens
aaagggatatttt

SEQ ID NO: 1403440 - DNA, 20 bp, Homo sapiens
aaaggtattatacatgtgat

SEQ ID NO: 1403441 - DNA, 18 bp, Homo sapiens
aaagtgaagaatttatct

SEQ ID NO: 1403442 - DNA, 12 bp, Homo sapiens
aaatacacattt

SEQ ID NO: 1403443 - DNA, 22 bp, Homo sapiens
aaatacacatttgctactgttg

SEQ ID NO: 1403444 - DNA, 23 bp, Homo sapiens
aaatacatgccacatcaaacctt

SEQ ID NO: 1403445 - DNA, 17 bp, Homo sapiens
aaatagccagtgctagt

SEQ ID NO: 1403446 - DNA, 12 bp, Homo sapiens
aaatagctcttg

SEQ ID NO: 1403447 - DNA, 15 bp, Homo sapiens
aaatagctcttgctt

SEQ ID NO: 1403448 - DNA, 19 bp, Homo sapiens
aaataggaatcattcagaa

SEQ ID NO: 1403449 - DNA, 20 bp, Homo sapiens
aaataggaatcattcagaaa

SEQ ID NO: 1403450 - DNA, 17 bp, Homo sapiens
aaatataacacattttt

SEQ ID NO: 1403451 - DNA, 17 bp, Homo sapiens
aaatccttttacctttt

SEQ ID NO: 1403452 - DNA, 14 bp, Homo sapiens
aaatgaaagaaaat

SEQ ID NO: 1403453 - DNA, 12 bp, Homo sapiens
aaatgaaatgca

SEQ ID NO: 1403454 - DNA, 19 bp, Homo sapiens
aaatgagctctgaaatctt

SEQ ID NO: 1403455 - DNA, 14 bp, Homo sapiens
aaatgcctgccaaa

SEQ ID NO: 1403456 - DNA, 21 bp, Homo sapiens
aaatggaaagcagagttttca

SEQ ID NO: 1403457 - DNA, 16 bp, Homo sapiens
aaatgtataaatatac

SEQ ID NO: 1403458 - DNA, 19 bp, Homo sapiens
aaatgtataaatatacagt

SEQ ID NO: 1403459 - DNA, 18 bp, Homo sapiens
aaatgttaaaagttttat

SEQ ID NO: 1403460 - DNA, 23 bp, Homo sapiens
aaatgttaaaagttttatatgct

SEQ ID NO: 1403461 - DNA, 17 bp, Homo sapiens
aaattaagcaaatgtta

SEQ ID NO: 1403462 - DNA, 17 bp, Homo sapiens
aaattgcatactttgta

SEQ ID NO: 1403463 - DNA, 13 bp, Homo sapiens
aaatttaaaaaat

SEQ ID NO: 1403464 - DNA, 16 bp, Homo sapiens
aaatttaaaaaataaa

SEQ ID NO: 1403465 - DNA, 14 bp, Homo sapiens
aaattttagattta

SEQ ID NO: 1403466 - DNA, 18 bp, Homo sapiens
aacaagacttcagattcc

SEQ ID NO: 1403467 - DNA, 15 bp, Homo sapiens
aacaagttgaagaag

SEQ ID NO: 1403468 - DNA, 20 bp, Homo sapiens
aacagtatgtgggatattga

SEQ ID NO: 1403469 - DNA, 21 bp, Homo sapiens
aacagtatgtgggatattgaa

SEQ ID NO: 1403470 - DNA, 20 bp, Homo sapiens
aacagtgaagttttactgtc

SEQ ID NO: 1403471 - DNA, 21 bp, Homo sapiens
aacagtgaagttttactgtct

SEQ ID NO: 1403472 - DNA, 16 bp, Homo sapiens
aacatgcttttccaaa

SEQ ID NO: 1403473 - DNA, 13 bp, Homo sapiens
aacatttgctgcc

SEQ ID NO: 1403474 - DNA, 23 bp, Homo sapiens
aacccattaaggggaagaatgaa

SEQ ID NO: 1403475 - DNA, 15 bp, Homo sapiens
aaccctggcatttgg

SEQ ID NO: 1403476 - DNA, 16 bp, Homo sapiens
aacgaagagttccctt

SEQ ID NO: 1403477 - DNA, 13 bp, Homo sapiens
aactaaatttcac

SEQ ID NO: 1403478 - DNA, 16 bp, Homo sapiens
aactgagggcagagag

SEQ ID NO: 1403479 - DNA, 22 bp, Homo sapiens
aactttgggaaaacatgttaat

SEQ ID NO: 1403480 - DNA, 21 bp, Homo sapiens
aactttgtaaaaatcttttga

SEQ ID NO: 1403481 - DNA, 14 bp, Homo sapiens
aagaaaagagaaaa

SEQ ID NO: 1403482 - DNA, 19 bp, Homo sapiens
aagaaataatgctacaatt

SEQ ID NO: 1403483 - DNA, 13 bp, Homo sapiens
aagaagaagttca

SEQ ID NO: 1403484 - DNA, 17 bp, Homo sapiens
aagaagttcatgtccaa

SEQ ID NO: 1403485 - DNA, 17 bp, Homo sapiens
aagaatgaaagctgttc

SEQ ID NO: 1403486 - DNA, 19 bp, Homo sapiens
aagaatgaaagctgttcct

SEQ ID NO: 1403487 - DNA, 19 bp, Homo sapiens
aagaattctgattgatttg

SEQ ID NO: 1403488 - DNA, 14 bp, Homo sapiens
aagacccagacagg

SEQ ID NO: 1403489 - DNA, 21 bp, Homo sapiens
aagactatatatataaatgta

SEQ ID NO: 1403490 - DNA, 22 bp, Homo sapiens
aagactatatatataaatgtat

SEQ ID NO: 1403491 - DNA, 17 bp, Homo sapiens
aagactgtagatatgta

SEQ ID NO: 1403492 - DNA, 14 bp, Homo sapiens
aagacttcagattc

SEQ ID NO: 1403493 - DNA, 15 bp, Homo sapiens
aagacttcagattcc

SEQ ID NO: 1403494 - DNA, 9 bp, Homo sapiens
aagagaaaa

SEQ ID NO: 1403495 - DNA, 20 bp, Homo sapiens
aagaggtggccccatattaa

SEQ ID NO: 1403496 - DNA, 14 bp, Homo sapiens
aagagtgctaagca

SEQ ID NO: 1403497 - DNA, 19 bp, Homo sapiens
aagagtttcagtttgttgg

SEQ ID NO: 1403498 - DNA, 20 bp, Homo sapiens
aagatggggaaactgagggc

SEQ ID NO: 1403499 - DNA, 14 bp, Homo sapiens
aagcagagttttca

SEQ ID NO: 1403500 - DNA, 21 bp, Homo sapiens
aagcatagataatattgtttg

SEQ ID NO: 1403501 - DNA, 19 bp, Homo sapiens
aagcctttgagactgttcc

SEQ ID NO: 1403502 - DNA, 15 bp, Homo sapiens
aagctgcagagattt

SEQ ID NO: 1403503 - DNA, 18 bp, Homo sapiens
aagcttcagttgcttgtc

SEQ ID NO: 1403504 - DNA, 14 bp, Homo sapiens
aaggaaattctaac

SEQ ID NO: 1403505 - DNA, 17 bp, Homo sapiens
aaggagataagaaagca

SEQ ID NO: 1403506 - DNA, 15 bp, Homo sapiens
aagggaaagtttttt

SEQ ID NO: 1403507 - DNA, 16 bp, Homo sapiens
aagtaaagtgaagaat

SEQ ID NO: 1403508 - DNA, 14 bp, Homo sapiens
aagtaactgtgaga

SEQ ID NO: 1403509 - DNA, 20 bp, Homo sapiens
aagtctcccaatatccaatt

SEQ ID NO: 1403510 - DNA, 18 bp, Homo sapiens
aagtggctggaagagtcc

SEQ ID NO: 1403511 - DNA, 18 bp, Homo sapiens
aagttagtttttaatctc

SEQ ID NO: 1403512 - DNA, 13 bp, Homo sapiens
aagttttgttgta

SEQ ID NO: 1403513 - DNA, 15 bp, Homo sapiens
aagtttttgtttgga

SEQ ID NO: 1403514 - DNA, 18 bp, Homo sapiens
aataaataaaaactaatt

SEQ ID NO: 1403515 - DNA, 23 bp, Homo sapiens
aataagcccaacaagttgaagaa

SEQ ID NO: 1403516 - DNA, 18 bp, Homo sapiens
aataatagcacatgattt

SEQ ID NO: 1403517 - DNA, 24 bp, Homo sapiens
aataatgtagttttgtgatgcatt

SEQ ID NO: 1403518 - DNA, 18 bp, Homo sapiens
aataccatttagtaagaa

SEQ ID NO: 1403519 - DNA, 19 bp, Homo sapiens
aataggaatcattcagaaa

SEQ ID NO: 1403520 - DNA, 15 bp, Homo sapiens
aatataaaattatga

SEQ ID NO: 1403521 - DNA, 22 bp, Homo sapiens
aatattgtttggtaaatgtttc

SEQ ID NO: 1403522 - DNA, 17 bp, Homo sapiens
agataatattgtttggt

SEQ ID NO: 1403523 - DNA, 17 bp, Homo sapiens
agatctttcagaaatat

SEQ ID NO: 1403524 - DNA, 19 bp, Homo sapiens
agatctttcagaaatataa

SEQ ID NO: 1403525 - DNA, 14 bp, Homo sapiens
agatctttcatttt

SEQ ID NO: 1403526 - DNA, 20 bp, Homo sapiens
agatgaaccctggcatttgg

SEQ ID NO: 1403527 - DNA, 16 bp, Homo sapiens
agatttctcattgact

SEQ ID NO: 1403528 - DNA, 14 bp, Homo sapiens
agcacaacataatt

SEQ ID NO: 1403529 - DNA, 20 bp, Homo sapiens
agcactaacctatgagggtg

SEQ ID NO: 1403530 - DNA, 23 bp, Homo sapiens
agcagaattgacagttgaacaga

SEQ ID NO: 1403531 - DNA, 23 bp, Homo sapiens
agcagagttttcattaaatcctt

SEQ ID NO: 1403532 - DNA, 15 bp, Homo sapiens
agcatagataatatt

SEQ ID NO: 1403533 - DNA, 17 bp, Homo sapiens
agcatgcagctttgcaa

SEQ ID NO: 1403534 - DNA, 15 bp, Homo sapiens
agcattagctttaat

SEQ ID NO: 1403535 - DNA, 15 bp, Homo sapiens
agcatttagatctac

SEQ ID NO: 1403536 - DNA, 13 bp, Homo sapiens
agccagaaaaaga

SEQ ID NO: 1403537 - DNA, 14 bp, Homo sapiens
agccgattcctcca

SEQ ID NO: 1403538 - DNA, 13 bp, Homo sapiens
agcctactctcct

SEQ ID NO: 1403539 - DNA, 20 bp, Homo sapiens
agccttcaaaactatagctt

SEQ ID NO: 1403540 - DNA, 21 bp, Homo sapiens
agccttcaaaactatagcttg

SEQ ID NO: 1403541 - DNA, 13 bp, Homo sapiens
agcgcagagaaat

SEQ ID NO: 1403542 - DNA, 13 bp, Homo sapiens
agctctgaaatct

SEQ ID NO: 1403543 - DNA, 21 bp, Homo sapiens
agcttaaaataaagttaaact

SEQ ID NO: 1403544 - DNA, 18 bp, Homo sapiens
agcttcttccattggaaa

SEQ ID NO: 1403545 - DNA, 18 bp, Homo sapiens
agctttaattaagctctc

SEQ ID NO: 1403546 - DNA, 21 bp, Homo sapiens
aggaagtaaagtgaagaattt

SEQ ID NO: 1403547 - DNA, 22 bp, Homo sapiens
aggaagttagtttttaatctct

SEQ ID NO: 1403548 - DNA, 23 bp, Homo sapiens
aggaatcattcagaaatgttgag

SEQ ID NO: 1403549 - DNA, 23 bp, Homo sapiens
aggactagagcacaacataattt

SEQ ID NO: 1403550 - DNA, 16 bp, Homo sapiens
aggagataagaaagca

SEQ ID NO: 1403551 - DNA, 23 bp, Homo sapiens
aggaggggcccccctgccctgtg

SEQ ID NO: 1403552 - DNA, 23 bp, Homo sapiens
aggatttgcacagaagcacatgc

SEQ ID NO: 1403553 - DNA, 12 bp, Homo sapiens
aggcaagaaaag

SEQ ID NO: 1403554 - DNA, 13 bp, Homo sapiens
aggcccatagcag

SEQ ID NO: 1403555 - DNA, 20 bp, Homo sapiens
aggctactacagagaaggct

SEQ ID NO: 1403556 - DNA, 22 bp, Homo sapiens
aggctgatttatggtcagaatt

SEQ ID NO: 1403557 - DNA, 14 bp, Homo sapiens
agggaaaacacaga

SEQ ID NO: 1403558 - DNA, 22 bp, Homo sapiens
agggactacccatagacatgaa

SEQ ID NO: 1403559 - DNA, 20 bp, Homo sapiens
agggcagagaggttaacaga

SEQ ID NO: 1403560 - DNA, 17 bp, Homo sapiens
aggggaaggagaagtaa

SEQ ID NO: 1403561 - DNA, 22 bp, Homo sapiens
aggggcccccctgccctgtggg

SEQ ID NO: 1403562 - DNA, 23 bp, Homo sapiens
aggtaacactagggccttggaaa

SEQ ID NO: 1403563 - DNA, 12 bp, Homo sapiens
aggtcgcccacc

SEQ ID NO: 1403564 - DNA, 23 bp, Homo sapiens
aggtggccccatattaacaaatt

SEQ ID NO: 1403565 - DNA, 18 bp, Homo sapiens
agtaaagtgaagaattta

SEQ ID NO: 1403566 - DNA, 16 bp, Homo sapiens
agtaacagtcatcatt

SEQ ID NO: 1403567 - DNA, 19 bp, Homo sapiens
agtaacccccttaaattta

SEQ ID NO: 1403568 - DNA, 23 bp, Homo sapiens
agtagatccatttccattgctta

SEQ ID NO: 1403569 - DNA, 16 bp, Homo sapiens
agtattgtttaaaatg

SEQ ID NO: 1403570 - DNA, 22 bp, Homo sapiens
agtattgtttaaaatgtaattt

SEQ ID NO: 1403571 - DNA, 13 bp, Homo sapiens
agtcatcatttat

SEQ ID NO: 1403572 - DNA, 12 bp, Homo sapiens
agtcccctttct

SEQ ID NO: 1403573 - DNA, 15 bp, Homo sapiens
agtctattgaataat

SEQ ID NO: 1403574 - DNA, 18 bp, Homo sapiens
agtctattgaataatgta

SEQ ID NO: 1403575 - DNA, 17 bp, Homo sapiens
agtctttcatggctgct

SEQ ID NO: 1403576 - DNA, 15 bp, Homo sapiens
agtgaagaatttatc

SEQ ID NO: 1403577 - DNA, 18 bp, Homo sapiens
agtgctaagcattagctt

SEQ ID NO: 1403578 - DNA, 19 bp, Homo sapiens
agtgctaagcattagcttt

SEQ ID NO: 1403579 - DNA, 18 bp, Homo sapiens
agtggagatcccacatat

SEQ ID NO: 1403580 - DNA, 18 bp, Homo sapiens
agtggctggaagagtccc

SEQ ID NO: 1403581 - DNA, 18 bp, Homo sapiens
agtgtgtatatattttgt

SEQ ID NO: 1403582 - DNA, 14 bp, Homo sapiens
agttaaactgatta

SEQ ID NO: 1403583 - DNA, 20 bp, Homo sapiens
agttaaactggcttaactta

SEQ ID NO: 1403584 - DNA, 23 bp, Homo sapiens
agttaaactggcttaacttagta

SEQ ID NO: 1403585 - DNA, 18 bp, Homo sapiens
agttagctgaagaattga

SEQ ID NO: 1403586 - DNA, 14 bp, Homo sapiens
agttataagaagaa

SEQ ID NO: 1403587 - DNA, 15 bp, Homo sapiens
agttcaacaacaaaa

SEQ ID NO: 1403588 - DNA, 22 bp, Homo sapiens
agttcccttgaaactttgggaa

SEQ ID NO: 1403589 - DNA, 21 bp, Homo sapiens
agttgaacagagctagaggcc

SEQ ID NO: 1403590 - DNA, 19 bp, Homo sapiens
agttgcttgtcttctggta

SEQ ID NO: 1403591 - DNA, 22 bp, Homo sapiens
agtttcacctctttgctccctg

SEQ ID NO: 1403592 - DNA, 18 bp, Homo sapiens
agttttgtgatgcatttt

SEQ ID NO: 1403593 - DNA, 23 bp, Homo sapiens
agttttgttgtacttaaatggta

SEQ ID NO: 1403594 - DNA, 12 bp, Homo sapiens
ataaaatttaaa

SEQ ID NO: 1403595 - DNA, 19 bp, Homo sapiens
ataaatgtataaatataca

SEQ ID NO: 1403596 - DNA, 23 bp, Homo sapiens
ataacacatttttttgcatgcat

SEQ ID NO: 1403597 - DNA, 22 bp, Homo sapiens
ataagagtaacagtcatcattt

SEQ ID NO: 1403598 - DNA, 17 bp, Homo sapiens
ataagcactgtaaactt

SEQ ID NO: 1403599 - DNA, 18 bp, Homo sapiens
ataatagcacatgatttg

SEQ ID NO: 1403600 - DNA, 14 bp, Homo sapiens
ataatattgtttgg

SEQ ID NO: 1403601 - DNA, 14 bp, Homo sapiens
ataatgctacaatt

SEQ ID NO: 1403602 - DNA, 13 bp, Homo sapiens
ataattgtacaaa

SEQ ID NO: 1403603 - DNA, 19 bp, Homo sapiens
ataattgtacaaaattaag

SEQ ID NO: 1403604 - DNA, 21 bp, Homo sapiens
ataattgtacaaaattaagca

SEQ ID NO: 1403605 - DNA, 24 bp, Homo sapiens
ataattgtacaaaattaagcaaat

SEQ ID NO: 1403606 - DNA, 21 bp, Homo sapiens
ataatttttatttttggcaaa

SEQ ID NO: 1403607 - DNA, 22 bp, Homo sapiens
atacaccccctcttctgagcac

SEQ ID NO: 1403608 - DNA, 19 bp, Homo sapiens
atactaggaagtaaagtga

SEQ ID NO: 1403609 - DNA, 13 bp, Homo sapiens
atacttaacttta

SEQ ID NO: 1403610 - DNA, 17 bp, Homo sapiens
atactttgtattttgat

SEQ ID NO: 1403611 - DNA, 16 bp, Homo sapiens
atagataatattgttt

SEQ ID NO: 1403612 - DNA, 21 bp, Homo sapiens
atagcacatgatttgggctct

SEQ ID NO: 1403613 - DNA, 12 bp, Homo sapiens
atagctcttgct

SEQ ID NO: 1403614 - DNA, 20 bp, Homo sapiens
ataggaatcattcagaaatg

SEQ ID NO: 1403615 - DNA, 13 bp, Homo sapiens
atagtaagcatag

SEQ ID NO: 1403616 - DNA, 15 bp, Homo sapiens
atagtgggatttcca

SEQ ID NO: 1403617 - DNA, 12 bp, Homo sapiens
atataacacatt

SEQ ID NO: 1403618 - DNA, 15 bp, Homo sapiens
atataacacattttt

SEQ ID NO: 1403619 - DNA, 12 bp, Homo sapiens
atatataaatgt

SEQ ID NO: 1403620 - DNA, 14 bp, Homo sapiens
atatataaatgtat

SEQ ID NO: 1403621 - DNA, 16 bp, Homo sapiens
atatatataaatgtat

SEQ ID NO: 1403622 - DNA, 17 bp, Homo sapiens
atatccaattttaaaat

SEQ ID NO: 1403623 - DNA, 18 bp, Homo sapiens
atatccaattttaaaatg

SEQ ID NO: 1403624 - DNA, 20 bp, Homo sapiens
atatccaattttaaaatgaa

SEQ ID NO: 1403625 - DNA, 14 bp, Homo sapiens
atatcccttacttt

SEQ ID NO: 1403626 - DNA, 20 bp, Homo sapiens
atatggactcagccttgcaa

SEQ ID NO: 1403627 - DNA, 20 bp, Homo sapiens
atatgtctagggtgtgattt

SEQ ID NO: 1403628 - DNA, 22 bp, Homo sapiens
atattaacaaattgcatttgtg

SEQ ID NO: 1403629 - DNA, 16 bp, Homo sapiens
atattactgacatttc

SEQ ID NO: 1403630 - DNA, 19 bp, Homo sapiens
atattcagggtaaatagga

SEQ ID NO: 1403631 - DNA, 15 bp, Homo sapiens
atattgattgggaaa

SEQ ID NO: 1403632 - DNA, 21 bp, Homo sapiens
atattgtttggtaaatgtttc

SEQ ID NO: 1403633 - DNA, 13 bp, Homo sapiens
atattttgtgtga

SEQ ID NO: 1403634 - DNA, 15 bp, Homo sapiens
atcaaacctttgagt

SEQ ID NO: 1403635 - DNA, 15 bp, Homo sapiens
atcaaataagaaata

SEQ ID NO: 1403636 - DNA, 19 bp, Homo sapiens
atcacgatgtaaattatta

SEQ ID NO: 1403637 - DNA, 15 bp, Homo sapiens
atcagtaaccccctt

SEQ ID NO: 1403638 - DNA, 22 bp, Homo sapiens
atcagtaacccccttaaattta

SEQ ID NO: 1403639 - DNA, 23 bp, Homo sapiens
atcagtaacccccttaaatttaa

SEQ ID NO: 1403640 - DNA, 13 bp, Homo sapiens
atcatcacaaatg

SEQ ID NO: 1403641 - DNA, 16 bp, Homo sapiens
atcattcagaaatgtt

SEQ ID NO: 1403642 - DNA, 20 bp, Homo sapiens
atccaattttaaaatgaaat

SEQ ID NO: 1403643 - DNA, 16 bp, Homo sapiens
atccatttccattgct

SEQ ID NO: 1403644 - DNA, 15 bp, Homo sapiens
atcccacatatttca

SEQ ID NO: 1403645 - DNA, 13 bp, Homo sapiens
atcccctaaaata

SEQ ID NO: 1403646 - DNA, 18 bp, Homo sapiens
atctaaggtccccagcag

SEQ ID NO: 1403647 - DNA, 15 bp, Homo sapiens
atctaattctgattc

SEQ ID NO: 1403648 - DNA, 23 bp, Homo sapiens
atctcaatgaaccataaattcaa

SEQ ID NO: 1403649 - DNA, 17 bp, Homo sapiens
atcttacaatattgatt

SEQ ID NO: 1403650 - DNA, 12 bp, Homo sapiens
atctttcagaaa

SEQ ID NO: 1403651 - DNA, 17 bp, Homo sapiens
atcttttgaagcataga

SEQ ID NO: 1403652 - DNA, 16 bp, Homo sapiens
atgaaagctgttcctt

SEQ ID NO: 1403653 - DNA, 15 bp, Homo sapiens
atgaaccataaattc

SEQ ID NO: 1403654 - DNA, 16 bp, Homo sapiens
atgaaccctggcattt

SEQ ID NO: 1403655 - DNA, 12 bp, Homo sapiens
gaaatgcatttt

SEQ ID NO: 1403656 - DNA, 23 bp, Homo sapiens
gaaatgcattttgctagacagtt

SEQ ID NO: 1403657 - DNA, 20 bp, Homo sapiens
gaagcacatgcacctaccca

SEQ ID NO: 1403658 - DNA, 14 bp, Homo sapiens
gaagcttaaaataa

SEQ ID NO: 1403659 - DNA, 20 bp, Homo sapiens
gaaggactgcagccactgat

SEQ ID NO: 1403660 - DNA, 15 bp, Homo sapiens
gaagtctgatccctg

SEQ ID NO: 1403661 - DNA, 19 bp, Homo sapiens
gaataatagcacatgattt

SEQ ID NO: 1403662 - DNA, 17 bp, Homo sapiens
gaatcatctcctttgca

SEQ ID NO: 1403663 - DNA, 15 bp, Homo sapiens
gaattctgattgatt

SEQ ID NO: 1403664 - DNA, 22 bp, Homo sapiens
gaattgaaaagtttttgtttgg

SEQ ID NO: 1403665 - DNA, 14 bp, Homo sapiens
gacaggactgcaga

SEQ ID NO: 1403666 - DNA, 19 bp, Homo sapiens
gacagttgaacagagctag

SEQ ID NO: 1403667 - DNA, 13 bp, Homo sapiens
gacatcatttgta

SEQ ID NO: 1403668 - DNA, 19 bp, Homo sapiens
gacatgcaataaaatttaa

SEQ ID NO: 1403669 - DNA, 23 bp, Homo sapiens
gacccaaccacagaggatgctga

SEQ ID NO: 1403670 - DNA, 22 bp, Homo sapiens
gacccagggaacagccactccc

SEQ ID NO: 1403671 - DNA, 19 bp, Homo sapiens
gacgtttataaacagaaat

SEQ ID NO: 1403672 - DNA, 23 bp, Homo sapiens
gacgtttataaacagaaatggaa

SEQ ID NO: 1403673 - DNA, 14 bp, Homo sapiens
gactagccagccag

SEQ ID NO: 1403674 - DNA, 18 bp, Homo sapiens
gactatatatataaatgt

SEQ ID NO: 1403675 - DNA, 20 bp, Homo sapiens
gactatatatataaatgtat

SEQ ID NO: 1403676 - DNA, 12 bp, Homo sapiens
gactcagccttg

SEQ ID NO: 1403677 - DNA, 14 bp, Homo sapiens
gactcagccttgca

SEQ ID NO: 1403678 - DNA, 13 bp, Homo sapiens
gactcatgaggag

SEQ ID NO: 1403679 - DNA, 13 bp, Homo sapiens
gactgcagagggc

SEQ ID NO: 1403680 - DNA, 22 bp, Homo sapiens
gacttcagattccccactcagc

SEQ ID NO: 1403681 - DNA, 14 bp, Homo sapiens
gagaatatttttcc

SEQ ID NO: 1403682 - DNA, 23 bp, Homo sapiens
gagacgtttataaacagaaatgg

SEQ ID NO: 1403683 - DNA, 19 bp, Homo sapiens
gagctctgaaatcttccca

SEQ ID NO: 1403684 - DNA, 22 bp, Homo sapiens
gagcttaatgctacatgtgagt

SEQ ID NO: 1403685 - DNA, 12 bp, Homo sapiens
gaggaaaattct

SEQ ID NO: 1403686 - DNA, 13 bp, Homo sapiens
gaggaaaattctt

SEQ ID NO: 1403687 - DNA, 19 bp, Homo sapiens
gaggaggggcccccctgcc

SEQ ID NO: 1403688 - DNA, 19 bp, Homo sapiens
gaggatgctgacatcattt

SEQ ID NO: 1403689 - DNA, 17 bp, Homo sapiens
gaggccatgtctcctgc

SEQ ID NO: 1403690 - DNA, 18 bp, Homo sapiens
gagtaacagtcatcattt

SEQ ID NO: 1403691 - DNA, 19 bp, Homo sapiens
gagtaacagtcatcattta

SEQ ID NO: 1403692 - DNA, 22 bp, Homo sapiens
gagttcccttgaaactttggga

SEQ ID NO: 1403693 - DNA, 15 bp, Homo sapiens
gataatattgtttgg

SEQ ID NO: 1403694 - DNA, 19 bp, Homo sapiens
gatagtgggatttccagaa

SEQ ID NO: 1403695 - DNA, 12 bp, Homo sapiens
gatctttcagaa

SEQ ID NO: 1403696 - DNA, 15 bp, Homo sapiens
gatctttcagaaata

SEQ ID NO: 1403697 - DNA, 18 bp, Homo sapiens
gatctttcagaaatataa

SEQ ID NO: 1403698 - DNA, 17 bp, Homo sapiens
gattccccactcagcct

SEQ ID NO: 1403699 - DNA, 13 bp, Homo sapiens
gattctaaataca

SEQ ID NO: 1403700 - DNA, 23 bp, Homo sapiens
gattgactaactcaaatacacat

SEQ ID NO: 1403701 - DNA, 16 bp, Homo sapiens
gatttctcattgactt

SEQ ID NO: 1403702 - DNA, 23 bp, Homo sapiens
gatttcttttgtaataaactatt

SEQ ID NO: 1403703 - DNA, 23 bp, Homo sapiens
gatttgctcaatacctggcctca

SEQ ID NO: 1403704 - DNA, 16 bp, Homo sapiens
gcaaaaatagctcttg

SEQ ID NO: 1403705 - DNA, 16 bp, Homo sapiens
gcaaacccattaaggg

SEQ ID NO: 1403706 - DNA, 12 bp, Homo sapiens
gcaaagccagaa

SEQ ID NO: 1403707 - DNA, 16 bp, Homo sapiens
gcaagaaaagcgcaga

SEQ ID NO: 1403708 - DNA, 17 bp, Homo sapiens
gcaagaaaagcgcagag

SEQ ID NO: 1403709 - DNA, 19 bp, Homo sapiens
gcaataaaatttaaaaaat

SEQ ID NO: 1403710 - DNA, 17 bp, Homo sapiens
gcacatgcacctaccca

SEQ ID NO: 1403711 - DNA, 15 bp, Homo sapiens
gcacctgcagccaag

SEQ ID NO: 1403712 - DNA, 22 bp, Homo sapiens
gcagaattgacagttgaacaga

SEQ ID NO: 1403713 - DNA, 10 bp, Homo sapiens
gcagagaaat

SEQ ID NO: 1403714 - DNA, 17 bp, Homo sapiens
gcagagaggttaacaga

SEQ ID NO: 1403715 - DNA, 12 bp, Homo sapiens
gcagagttttca

SEQ ID NO: 1403716 - DNA, 19 bp, Homo sapiens
gcagagttttcattaaatc

SEQ ID NO: 1403717 - DNA, 16 bp, Homo sapiens
gcagggaaaacacaga

SEQ ID NO: 1403718 - DNA, 17 bp, Homo sapiens
gcagttagctgaagaat

SEQ ID NO: 1403719 - DNA, 19 bp, Homo sapiens
gcatagataatattgtttg

SEQ ID NO: 1403720 - DNA, 18 bp, Homo sapiens
gcatgcaaatgagctctg

SEQ ID NO: 1403721 - DNA, 14 bp, Homo sapiens
gcatgcagctttgc

SEQ ID NO: 1403722 - DNA, 17 bp, Homo sapiens
gcatgcagctttgcaaa

SEQ ID NO: 1403723 - DNA, 13 bp, Homo sapiens
gcatttggcctct

SEQ ID NO: 1403724 - DNA, 22 bp, Homo sapiens
gccaaattttagatttaccttg

SEQ ID NO: 1403725 - DNA, 16 bp, Homo sapiens
gccactcccctccact

SEQ ID NO: 1403726 - DNA, 18 bp, Homo sapiens
gccagaaaaagatctttc

SEQ ID NO: 1403727 - DNA, 22 bp, Homo sapiens
gccaggacatgcaataaaattt

SEQ ID NO: 1403728 - DNA, 19 bp, Homo sapiens
gcccacctgtgggccagcc

SEQ ID NO: 1403729 - DNA, 15 bp, Homo sapiens
gcccccctgccctgt

SEQ ID NO: 1403730 - DNA, 18 bp, Homo sapiens
gccgattcctccagccct

SEQ ID NO: 1403731 - DNA, 19 bp, Homo sapiens
gccgattcctccagccctg

SEQ ID NO: 1403732 - DNA, 16 bp, Homo sapiens
gcctcttgtagtcttg

SEQ ID NO: 1403733 - DNA, 14 bp, Homo sapiens
gcctgatcagcagg

SEQ ID NO: 1403734 - DNA, 19 bp, Homo sapiens
gccttgcaaatagccagtg

SEQ ID NO: 1403735 - DNA, 23 bp, Homo sapiens
gcgtggctctaaaaggtaatgtg

SEQ ID NO: 1403736 - DNA, 19 bp, Homo sapiens
gctactgttgtaagaattc

SEQ ID NO: 1403737 - DNA, 22 bp, Homo sapiens
gctcaatacctggcctcattta

SEQ ID NO: 1403738 - DNA, 13 bp, Homo sapiens
gctcggcaccgcc

SEQ ID NO: 1403739 - DNA, 23 bp, Homo sapiens
gctctaaaaggtaatgtgtggat

SEQ ID NO: 1403740 - DNA, 13 bp, Homo sapiens
gctctcatagctc

SEQ ID NO: 1403741 - DNA, 14 bp, Homo sapiens
gctgacatcatttg

SEQ ID NO: 1403742 - DNA, 18 bp, Homo sapiens
gctgcagagatttctcat

SEQ ID NO: 1403743 - DNA, 13 bp, Homo sapiens
gcttacctcctca

SEQ ID NO: 1403744 - DNA, 19 bp, Homo sapiens
gcttccattttaattttaa

SEQ ID NO: 1403745 - DNA, 15 bp, Homo sapiens
gcttcccttactttg

SEQ ID NO: 1403746 - DNA, 20 bp, Homo sapiens
gcttgtctatactccttccc

SEQ ID NO: 1403747 - DNA, 16 bp, Homo sapiens
gcttgtttacctttct

SEQ ID NO: 1403748 - DNA, 14 bp, Homo sapiens
gctttaagccttca

SEQ ID NO: 1403749 - DNA, 20 bp, Homo sapiens
gcttttccaaacccaggcta

SEQ ID NO: 1403750 - DNA, 13 bp, Homo sapiens
ggaaaacatttgc

SEQ ID NO: 1403751 - DNA, 22 bp, Homo sapiens
ggaaacttaaccacctacaagg

SEQ ID NO: 1403752 - DNA, 15 bp, Homo sapiens
ggaaatgagaacaat

SEQ ID NO: 1403753 - DNA, 16 bp, Homo sapiens
ggaagaatgaaagctg

SEQ ID NO: 1403754 - DNA, 21 bp, Homo sapiens
ggaagttagtttttaatctct

SEQ ID NO: 1403755 - DNA, 21 bp, Homo sapiens
ggaatcatctcctttgcagaa

SEQ ID NO: 1403756 - DNA, 16 bp, Homo sapiens
ggaatgaggaaaattc

SEQ ID NO: 1403757 - DNA, 22 bp, Homo sapiens
ggacccagggaacagccactcc

SEQ ID NO: 1403758 - DNA, 16 bp, Homo sapiens
ggagataagaaagcag

SEQ ID NO: 1403759 - DNA, 18 bp, Homo sapiens
ggagtggtgatttgaaaa

SEQ ID NO: 1403760 - DNA, 18 bp, Homo sapiens
ggatattgaatgttaaag

SEQ ID NO: 1403761 - DNA, 15 bp, Homo sapiens
ggcaccagtccctgt

SEQ ID NO: 1403762 - DNA, 14 bp, Homo sapiens
ggcaccgccagccg

SEQ ID NO: 1403763 - DNA, 14 bp, Homo sapiens
ggcatttggcctct

SEQ ID NO: 1403764 - DNA, 16 bp, Homo sapiens
ggcccccctgccctgt

SEQ ID NO: 1403765 - DNA, 12 bp, Homo sapiens
ggccttggaaat

SEQ ID NO: 1403766 - DNA, 16 bp, Homo sapiens
ggctacatctccaaat

SEQ ID NO: 1403767 - DNA, 20 bp, Homo sapiens
gggactacccatagacatga

SEQ ID NO: 1403768 - DNA, 20 bp, Homo sapiens
gggcagatcttggactcatg

SEQ ID NO: 1403769 - DNA, 15 bp, Homo sapiens
gggctctagaattcc

SEQ ID NO: 1403770 - DNA, 19 bp, Homo sapiens
ggtattaaaactaaatttc

SEQ ID NO: 1403771 - DNA, 12 bp, Homo sapiens
ggtccccagcag

SEQ ID NO: 1403772 - DNA, 16 bp, Homo sapiens
gtaaacttctgcaaca

SEQ ID NO: 1403773 - DNA, 19 bp, Homo sapiens
gtaaagtgaagaatttatc

SEQ ID NO: 1403774 - DNA, 20 bp, Homo sapiens
gtaacactagggccttggaa

SEQ ID NO: 1403775 - DNA, 13 bp, Homo sapiens
gtaataagcactg

SEQ ID NO: 1403776 - DNA, 21 bp, Homo sapiens
gtaataagcactgtaaacttc

SEQ ID NO: 1403777 - DNA, 22 bp, Homo sapiens
gtaatagaagcttaaaataaag

SEQ ID NO: 1403778 - DNA, 17 bp, Homo sapiens
gtaatatggactcagcc

SEQ ID NO: 1403779 - DNA, 17 bp, Homo sapiens
gtaatcccctaaaataa

SEQ ID NO: 1403780 - DNA, 21 bp, Homo sapiens
gtaatttaaatgaaagaaaat

SEQ ID NO: 1403781 - DNA, 12 bp, Homo sapiens
gtacaaaattaa

SEQ ID NO: 1403782 - DNA, 21 bp, Homo sapiens
gtactttctgttatgggcttt

SEQ ID NO: 1403783 - DNA, 17 bp, Homo sapiens
gtagatatgtattcttt

SEQ ID NO: 1403784 - DNA, 15 bp, Homo sapiens
gttaaagagaatgag

SEQ ID NO: 1403785 - DNA, 22 bp, Homo sapiens
gttcccttgaaactttgggaaa

SEQ ID NO: 1403786 - DNA, 21 bp, Homo sapiens
gttccttggtcctagtaagaa

SEQ ID NO: 1403787 - DNA, 14 bp, Homo sapiens
gttctttggattct

SEQ ID NO: 1403788 - DNA, 15 bp, Homo sapiens
gttgagtctgtacta

SEQ ID NO: 1403789 - DNA, 21 bp, Homo sapiens
gttgggtgtctccttaagctg

SEQ ID NO: 1403790 - DNA, 16 bp, Homo sapiens
gttgtaagaattctga

SEQ ID NO: 1403791 - DNA, 13 bp, Homo sapiens
gtttaaaatgtaa

SEQ ID NO: 1403792 - DNA, 21 bp, Homo sapiens
gtttaaaatgtaatttaaatg

SEQ ID NO: 1403793 - DNA, 18 bp, Homo sapiens
gtttcagtttgttggaaa

SEQ ID NO: 1403794 - DNA, 21 bp, Homo sapiens
gtttcagtttgttggaaagta

SEQ ID NO: 1403795 - DNA, 17 bp, Homo sapiens
taaaagttttatatgct

SEQ ID NO: 1403796 - DNA, 17 bp, Homo sapiens
taaaatgtaatttaaat

SEQ ID NO: 1403797 - DNA, 21 bp, Homo sapiens
taaaatgtaatttaaatgaaa

SEQ ID NO: 1403798 - DNA, 15 bp, Homo sapiens
taaaattatgagatt

SEQ ID NO: 1403799 - DNA, 22 bp, Homo sapiens
taaaattatgagattggttttc

SEQ ID NO: 1403800 - DNA, 12 bp, Homo sapiens
taaacagaaatg

SEQ ID NO: 1403801 - DNA, 17 bp, Homo sapiens
taaacagtaagatatct

SEQ ID NO: 1403802 - DNA, 21 bp, Homo sapiens
taaacctaggacttccgagct

SEQ ID NO: 1403803 - DNA, 19 bp, Homo sapiens
taaagaccctcctattcta

SEQ ID NO: 1403804 - DNA, 12 bp, Homo sapiens
taaagagaatga

SEQ ID NO: 1403805 - DNA, 13 bp, Homo sapiens
taaagagaatgag

SEQ ID NO: 1403806 - DNA, 18 bp, Homo sapiens
taaagatggggaaactga

SEQ ID NO: 1403807 - DNA, 22 bp, Homo sapiens
taaagggatatttttttctatt

SEQ ID NO: 1403808 - DNA, 22 bp, Homo sapiens
taaagtgaagaatttatctctt

SEQ ID NO: 1403809 - DNA, 18 bp, Homo sapiens
taaagttaaactgattat

SEQ ID NO: 1403810 - DNA, 19 bp, Homo sapiens
taaataaaaactaattaag

SEQ ID NO: 1403811 - DNA, 23 bp, Homo sapiens
taaataggaatcattcagaaatg

SEQ ID NO: 1403812 - DNA, 18 bp, Homo sapiens
taaatggtaataagcact

SEQ ID NO: 1403813 - DNA, 15 bp, Homo sapiens
taaatgtataaatat

SEQ ID NO: 1403814 - DNA, 19 bp, Homo sapiens
taaatgtataaatatacag

SEQ ID NO: 1403815 - DNA, 22 bp, Homo sapiens
taaatgtataaatatacagtat

SEQ ID NO: 1403816 - DNA, 21 bp, Homo sapiens
taaatgtttcttttaaagacc

SEQ ID NO: 1403817 - DNA, 16 bp, Homo sapiens
taacaaattgcatttg

SEQ ID NO: 1403818 - DNA, 17 bp, Homo sapiens
taacaaattgcatttgt

SEQ ID NO: 1403819 - DNA, 12 bp, Homo sapiens
taacacattttt

SEQ ID NO: 1403820 - DNA, 19 bp, Homo sapiens
taacacatttttttgcatg

SEQ ID NO: 1403821 - DNA, 20 bp, Homo sapiens
taacacatttttttgcatgc

SEQ ID NO: 1403822 - DNA, 21 bp, Homo sapiens
taacagtatgtgggatattga

SEQ ID NO: 1403823 - DNA, 18 bp, Homo sapiens
taacagtcatcatttatc

SEQ ID NO: 1403824 - DNA, 15 bp, Homo sapiens
taaccacatttctaa

SEQ ID NO: 1403825 - DNA, 20 bp, Homo sapiens
taaccctcacactgctccag

SEQ ID NO: 1403826 - DNA, 22 bp, Homo sapiens
taaccctttctgggatgcaata

SEQ ID NO: 1403827 - DNA, 21 bp, Homo sapiens
taactttactaagtaatctca

SEQ ID NO: 1403828 - DNA, 22 bp, Homo sapiens
taagaagaagttcatgtccaaa

SEQ ID NO: 1403829 - DNA, 19 bp, Homo sapiens
taagactatatatataaat

SEQ ID NO: 1403830 - DNA, 23 bp, Homo sapiens
taagactatatatataaatgtat

SEQ ID NO: 1403831 - DNA, 17 bp, Homo sapiens
taagatatctcaatgaa

SEQ ID NO: 1403832 - DNA, 13 bp, Homo sapiens
taagcattagctt

SEQ ID NO: 1403833 - DNA, 16 bp, Homo sapiens
taagcttccattttaa

SEQ ID NO: 1403834 - DNA, 14 bp, Homo sapiens
taagtctttcatgg

SEQ ID NO: 1403835 - DNA, 15 bp, Homo sapiens
taataagcactgtaa

SEQ ID NO: 1403836 - DNA, 14 bp, Homo sapiens
taatctcacagcat

SEQ ID NO: 1403837 - DNA, 19 bp, Homo sapiens
taatctctccaccttccaa

SEQ ID NO: 1403838 - DNA, 22 bp, Homo sapiens
taattgtacaaaattaagcaaa

SEQ ID NO: 1403839 - DNA, 12 bp, Homo sapiens
taatttaaatga

SEQ ID NO: 1403840 - DNA, 16 bp, Homo sapiens
taatttaaatgaaaga

SEQ ID NO: 1403841 - DNA, 15 bp, Homo sapiens
tacaaaattaagcaa

SEQ ID NO: 1403842 - DNA, 15 bp, Homo sapiens
tacaatattgattgg

SEQ ID NO: 1403843 - DNA, 13 bp, Homo sapiens
tacatctccaaat

SEQ ID NO: 1403844 - DNA, 18 bp, Homo sapiens
tacatgtgatacattttt

SEQ ID NO: 1403845 - DNA, 19 bp, Homo sapiens
tacatgtgatacatttttt

SEQ ID NO: 1403846 - DNA, 17 bp, Homo sapiens
taccacatcaaataaga

SEQ ID NO: 1403847 - DNA, 15 bp, Homo sapiens
tacccatagacatga

SEQ ID NO: 1403848 - DNA, 22 bp, Homo sapiens
tacccccgacgtgctcccctgc

SEQ ID NO: 1403849 - DNA, 23 bp, Homo sapiens
taccttatcttacaatattgatt

SEQ ID NO: 1403850 - DNA, 18 bp, Homo sapiens
tacctttctctctctaag

SEQ ID NO: 1403851 - DNA, 23 bp, Homo sapiens
tactaggaagtaaagtgaagaat

SEQ ID NO: 1403852 - DNA, 18 bp, Homo sapiens
tactggcttacctcctca

SEQ ID NO: 1403853 - DNA, 19 bp, Homo sapiens
tactgtctattaatattca

SEQ ID NO: 1403854 - DNA, 19 bp, Homo sapiens
tactgtgtctcatggattt

SEQ ID NO: 1403855 - DNA, 21 bp, Homo sapiens
tagacagttaaactggcttaa

SEQ ID NO: 1403856 - DNA, 12 bp, Homo sapiens
tagacatgaaag

SEQ ID NO: 1403857 - DNA, 13 bp, Homo sapiens
tagataatattgt

SEQ ID NO: 1403858 - DNA, 21 bp, Homo sapiens
tagatccatttccattgctta

SEQ ID NO: 1403859 - DNA, 16 bp, Homo sapiens
tagcagccagttcaaa

SEQ ID NO: 1403860 - DNA, 19 bp, Homo sapiens
tagccagtgctagttctga

SEQ ID NO: 1403861 - DNA, 12 bp, Homo sapiens
tagctcttgctt

SEQ ID NO: 1403862 - DNA, 22 bp, Homo sapiens
taggaatcattcagaaatgttg

SEQ ID NO: 1403863 - DNA, 18 bp, Homo sapiens
taggggaaggagaagtaa

SEQ ID NO: 1403864 - DNA, 16 bp, Homo sapiens
tagtaagcatagaaac

SEQ ID NO: 1403865 - DNA, 18 bp, Homo sapiens
tagttttgtgatgcattt

SEQ ID NO: 1403866 - DNA, 12 bp, Homo sapiens
tataaaattatg

SEQ ID NO: 1403867 - DNA, 20 bp, Homo sapiens
tataaaattatgagattggt

SEQ ID NO: 1403868 - DNA, 18 bp, Homo sapiens
tataaacagaaatggaaa

SEQ ID NO: 1403869 - DNA, 21 bp, Homo sapiens
tataaacagaaatggaaagca

SEQ ID NO: 1403870 - DNA, 15 bp, Homo sapiens
tataaatatacagta

SEQ ID NO: 1403871 - DNA, 16 bp, Homo sapiens
tataaatgtataaata

SEQ ID NO: 1403872 - DNA, 22 bp, Homo sapiens
tataacacatttttttgcatgc

SEQ ID NO: 1403873 - DNA, 22 bp, Homo sapiens
tataaccacatttctaagcctt

SEQ ID NO: 1403874 - DNA, 14 bp, Homo sapiens
tataattgtacaaa

SEQ ID NO: 1403875 - DNA, 23 bp, Homo sapiens
tatactgggggcaaaatcagaat

SEQ ID NO: 1403876 - DNA, 13 bp, Homo sapiens
tatataaatgtat

SEQ ID NO: 1403877 - DNA, 18 bp, Homo sapiens
tatatattttgtgtgaaa

SEQ ID NO: 1403878 - DNA, 19 bp, Homo sapiens
tatattttgtgtgaaattg

SEQ ID NO: 1403879 - DNA, 21 bp, Homo sapiens
tatcagtaacccccttaaatt

SEQ ID NO: 1403880 - DNA, 20 bp, Homo sapiens
tatcatcacaaatggctaca

SEQ ID NO: 1403881 - DNA, 20 bp, Homo sapiens
tatcattttcttttttaacc

SEQ ID NO: 1403882 - DNA, 21 bp, Homo sapiens
tatccaattttaaaatgaaat

SEQ ID NO: 1403883 - DNA, 23 bp, Homo sapiens
tatcccttactttaaccctttct

SEQ ID NO: 1403884 - DNA, 20 bp, Homo sapiens
tatcgtttttgtattttcat

SEQ ID NO: 1403885 - DNA, 20 bp, Homo sapiens
tatgagattggttttcctgt

SEQ ID NO: 1403886 - DNA, 14 bp, Homo sapiens
tatggactcagcct

SEQ ID NO: 1403887 - DNA, 23 bp, Homo sapiens
tatgggcttttggggagccagaa

SEQ ID NO: 1403888 - DNA, 15 bp, Homo sapiens
tatgtcagtactatt

SEQ ID NO: 1403889 - DNA, 21 bp, Homo sapiens
tatgtctagggtgtgatttag

SEQ ID NO: 1403890 - DNA, 13 bp, Homo sapiens
tatgttaaagaga

SEQ ID NO: 1403891 - DNA, 14 bp, Homo sapiens
tattaaaactaaat

SEQ ID NO: 1403892 - DNA, 13 bp, Homo sapiens
tgcatttgtggga

SEQ ID NO: 1403893 - DNA, 19 bp, Homo sapiens
tgcattttgctagacagtt

SEQ ID NO: 1403894 - DNA, 22 bp, Homo sapiens
tgccacatcaaacctttgagta

SEQ ID NO: 1403895 - DNA, 19 bp, Homo sapiens
tgccagccccctaaaagca

SEQ ID NO: 1403896 - DNA, 20 bp, Homo sapiens
tgccaggacatgcaataaaa

SEQ ID NO: 1403897 - DNA, 16 bp, Homo sapiens
tgcctgctatgtattt

SEQ ID NO: 1403898 - DNA, 16 bp, Homo sapiens
tgctaagcattagctt

SEQ ID NO: 1403899 - DNA, 14 bp, Homo sapiens
tgctacaattttaa

SEQ ID NO: 1403900 - DNA, 13 bp, Homo sapiens
tgctactgttgta

SEQ ID NO: 1403901 - DNA, 21 bp, Homo sapiens
tgctactgttgtaagaattct

SEQ ID NO: 1403902 - DNA, 18 bp, Homo sapiens
tgctcggcaccgccagcc

SEQ ID NO: 1403903 - DNA, 14 bp, Homo sapiens
tgctgacatcattt

SEQ ID NO: 1403904 - DNA, 17 bp, Homo sapiens
tgctgagggtttgaata

SEQ ID NO: 1403905 - DNA, 19 bp, Homo sapiens
tgctgccattacagaggta

SEQ ID NO: 1403906 - DNA, 14 bp, Homo sapiens
tgcttaaaccactt

SEQ ID NO: 1403907 - DNA, 15 bp, Homo sapiens
tgcttaatcttcaaa

SEQ ID NO: 1403908 - DNA, 20 bp, Homo sapiens
tgcttaatcttcaaagcctt

SEQ ID NO: 1403909 - DNA, 21 bp, Homo sapiens
tgcttaatcttcaaagccttc

SEQ ID NO: 1403910 - DNA, 20 bp, Homo sapiens
tgcttgtcttctggtacttt

SEQ ID NO: 1403911 - DNA, 18 bp, Homo sapiens
tgctttattaatgttttc

SEQ ID NO: 1403912 - DNA, 19 bp, Homo sapiens
tggaaagcagagttttcat

SEQ ID NO: 1403913 - DNA, 13 bp, Homo sapiens
tggaaattcctgt

SEQ ID NO: 1403914 - DNA, 22 bp, Homo sapiens
tggaaattcctgtactgtgtct

SEQ ID NO: 1403915 - DNA, 16 bp, Homo sapiens
tggacccagggaacag

SEQ ID NO: 1403916 - DNA, 13 bp, Homo sapiens
tggactcagcctt

SEQ ID NO: 1403917 - DNA, 14 bp, Homo sapiens
tggactcagccttg

SEQ ID NO: 1403918 - DNA, 16 bp, Homo sapiens
tggagatcccacatat

SEQ ID NO: 1403919 - DNA, 18 bp, Homo sapiens
tggatttggcactagcca

SEQ ID NO: 1403920 - DNA, 13 bp, Homo sapiens
tggcaaagccaga

SEQ ID NO: 1403921 - DNA, 15 bp, Homo sapiens
tggcataaattgcat

SEQ ID NO: 1403922 - DNA, 15 bp, Homo sapiens
tggcatttggcctct

SEQ ID NO: 1403923 - DNA, 22 bp, Homo sapiens
tggcctgatcagcaggagccaa

SEQ ID NO: 1403924 - DNA, 13 bp, Homo sapiens
tggcttgtctata

SEQ ID NO: 1403925 - DNA, 23 bp, Homo sapiens
tggctttaagccttcaaaactat

SEQ ID NO: 1403926 - DNA, 18 bp, Homo sapiens
tgggatattgaatgttaa

SEQ ID NO: 1403927 - DNA, 22 bp, Homo sapiens
tgggcttttggggagccagaag

SEQ ID NO: 1403928 - DNA, 21 bp, Homo sapiens
tggtaatcccctaaaataaca

SEQ ID NO: 1403929 - DNA, 23 bp, Homo sapiens
tggtaatcccctaaaataacagt

SEQ ID NO: 1403930 - DNA, 23 bp, Homo sapiens
tggtcaagggctgtcattgcaca

SEQ ID NO: 1403931 - DNA, 22 bp, Homo sapiens
tggtgatttgaaaaatataaaa

SEQ ID NO: 1403932 - DNA, 17 bp, Homo sapiens
tgtaagaattctgattg

SEQ ID NO: 1403933 - DNA, 15 bp, Homo sapiens
tgtaatagaagctta

SEQ ID NO: 1403934 - DNA, 13 bp, Homo sapiens
tgtacaaaattaa

SEQ ID NO: 1403935 - DNA, 19 bp, Homo sapiens
tgtacaaaattaagcaaat

SEQ ID NO: 1403936 - DNA, 14 bp, Homo sapiens
tgtacagattcttt

SEQ ID NO: 1403937 - DNA, 20 bp, Homo sapiens
tgtactaaacagtaagatat

SEQ ID NO: 1403938 - DNA, 22 bp, Homo sapiens
tgtacttaaatggtaataagca

SEQ ID NO: 1403939 - DNA, 14 bp, Homo sapiens
tgtataaatataca

SEQ ID NO: 1403940 - DNA, 22 bp, Homo sapiens
tgtatgttaaagagaatgagtc

SEQ ID NO: 1403941 - DNA, 18 bp, Homo sapiens
tgtattcttttctcagtg

SEQ ID NO: 1403942 - DNA, 16 bp, Homo sapiens
tgtattttcatgaaaa

SEQ ID NO: 1403943 - DNA, 17 bp, Homo sapiens
tgtccggaatgccaccc

SEQ ID NO: 1403944 - DNA, 13 bp, Homo sapiens
tgtctgatttctt

SEQ ID NO: 1403945 - DNA, 18 bp, Homo sapiens
tgtgaaattgcatacttt

SEQ ID NO: 1403946 - DNA, 21 bp, Homo sapiens
tgtgatacattttttaagctt

SEQ ID NO: 1403947 - DNA, 13 bp, Homo sapiens
tgtgatgcatttt

SEQ ID NO: 1403948 - DNA, 17 bp, Homo sapiens
tgtgatgcattttatag

SEQ ID NO: 1403949 - DNA, 12 bp, Homo sapiens
tgtgttgcaaag

SEQ ID NO: 1403950 - DNA, 19 bp, Homo sapiens
tgttagaagaggtggcccc

SEQ ID NO: 1403951 - DNA, 20 bp, Homo sapiens
tgttagaagaggtggcccca

SEQ ID NO: 1403952 - DNA, 22 bp, Homo sapiens
tgttgagacctcagcttggcac

SEQ ID NO: 1403953 - DNA, 16 bp, Homo sapiens
tgttgtaagaattctg

SEQ ID NO: 1403954 - DNA, 15 bp, Homo sapiens
tgttgtacttaaatg

SEQ ID NO: 1403955 - DNA, 20 bp, Homo sapiens
tgtttaaaatgtaatttaaa

SEQ ID NO: 1403956 - DNA, 19 bp, Homo sapiens
tgtttggagacgtttataa

SEQ ID NO: 1403957 - DNA, 14 bp, Homo sapiens
ttaaaaaataaata

SEQ ID NO: 1403958 - DNA, 13 bp, Homo sapiens
ttaaaactaaatt

SEQ ID NO: 1403959 - DNA, 17 bp, Homo sapiens
ttaaactggcttaactt

SEQ ID NO: 1403960 - DNA, 20 bp, Homo sapiens
ttaaagaccctcctattcta

SEQ ID NO: 1403961 - DNA, 19 bp, Homo sapiens
ttaaatccttttacctttt

SEQ ID NO: 1403962 - DNA, 18 bp, Homo sapiens
ttaacaaattgcatttgt

SEQ ID NO: 1403963 - DNA, 16 bp, Homo sapiens
ttaagccttcaaaact

SEQ ID NO: 1403964 - DNA, 16 bp, Homo sapiens
ttaagctctcatagct

SEQ ID NO: 1403965 - DNA, 19 bp, Homo sapiens
ttaagctgcagagatttct

SEQ ID NO: 1403966 - DNA, 18 bp, Homo sapiens
ttaaggggtatcatgtat

SEQ ID NO: 1403967 - DNA, 18 bp, Homo sapiens
ttaatccagttataagaa

SEQ ID NO: 1403968 - DNA, 20 bp, Homo sapiens
ttaatctctccaccttccaa

SEQ ID NO: 1403969 - DNA, 14 bp, Homo sapiens
ttaatgctacatgt

SEQ ID NO: 1403970 - DNA, 18 bp, Homo sapiens
ttaattttaaagtgcaaa

SEQ ID NO: 1403971 - DNA, 21 bp, Homo sapiens
ttacaatattgattgggaaaa

SEQ ID NO: 1403972 - DNA, 18 bp, Homo sapiens
ttacaatgtaatagaagc

SEQ ID NO: 1403973 - DNA, 21 bp, Homo sapiens
ttacagaggtattaaaactaa

SEQ ID NO: 1403974 - DNA, 17 bp, Homo sapiens
ttactttaaccctttct

SEQ ID NO: 1403975 - DNA, 23 bp, Homo sapiens
ttagggactacccatagacatga

SEQ ID NO: 1403976 - DNA, 20 bp, Homo sapiens
ttagtactcttctagcattt

SEQ ID NO: 1403977 - DNA, 24 bp, Homo sapiens
ttagtatattattattaattacaa

SEQ ID NO: 1403978 - DNA, 13 bp, Homo sapiens
ttataaagcatgt

SEQ ID NO: 1403979 - DNA, 21 bp, Homo sapiens
ttataagaagaagttcatgtc

SEQ ID NO: 1403980 - DNA, 20 bp, Homo sapiens
ttatacatgtgatacatttt

SEQ ID NO: 1403981 - DNA, 15 bp, Homo sapiens
ttatcgtttttgtat

SEQ ID NO: 1403982 - DNA, 20 bp, Homo sapiens
ttatctaaggtccccagcag

SEQ ID NO: 1403983 - DNA, 22 bp, Homo sapiens
ttatctaaggtccccagcagaa

SEQ ID NO: 1403984 - DNA, 20 bp, Homo sapiens
ttatgagattggttttcctg

SEQ ID NO: 1403985 - DNA, 16 bp, Homo sapiens
ttattaatgttttcaa

SEQ ID NO: 1403986 - DNA, 16 bp, Homo sapiens
ttcaaagttttgttgt

SEQ ID NO: 1403987 - DNA, 21 bp, Homo sapiens
ttcaaagttttgttgtactta

SEQ ID NO: 1403988 - DNA, 22 bp, Homo sapiens
ttcacccttatagtctaagact

SEQ ID NO: 1403989 - DNA, 17 bp, Homo sapiens
ttccagtcccctttctc

SEQ ID NO: 1403990 - DNA, 18 bp, Homo sapiens
ttccattttaattttaaa

SEQ ID NO: 1403991 - DNA, 17 bp, Homo sapiens
ttccccactcagccttt

SEQ ID NO: 1403992 - DNA, 22 bp, Homo sapiens
ttcccttaaggggtatcatgta

SEQ ID NO: 1403993 - DNA, 21 bp, Homo sapiens
ttctaacgcaaaaatagctct

SEQ ID NO: 1403994 - DNA, 23 bp, Homo sapiens
ttctaacgcaaaaatagctcttg

SEQ ID NO: 1403995 - DNA, 19 bp, Homo sapiens
ttctttcagttctttggat

SEQ ID NO: 1403996 - DNA, 14 bp, Homo sapiens
ttcttttctcagtg

SEQ ID NO: 1403997 - DNA, 15 bp, Homo sapiens
ttcttttgtttggta

SEQ ID NO: 1403998 - DNA, 14 bp, Homo sapiens
ttgaatgttaaagg

SEQ ID NO: 1403999 - DNA, 22 bp, Homo sapiens
ttgaatgttaaagggatatttt

SEQ ID NO: 1404000 - DNA, 22 bp, Homo sapiens
ttgactaactcaaatacacatt

SEQ ID NO: 1404001 - DNA, 23 bp, Homo sapiens
ttgactaactcaaatacacattt

SEQ ID NO: 1404002 - DNA, 23 bp, Homo sapiens
ttgagacctcagcttggcactca

SEQ ID NO: 1404003 - DNA, 13 bp, Homo sapiens
ttgagtattgttt

SEQ ID NO: 1404004 - DNA, 14 bp, Homo sapiens
ttgagtattgttta

SEQ ID NO: 1404005 - DNA, 17 bp, Homo sapiens
ttgattgggaaaacatt

SEQ ID NO: 1404006 - DNA, 20 bp, Homo sapiens
ttgatttcaaagttttgttg

SEQ ID NO: 1404007 - DNA, 18 bp, Homo sapiens
ttgatttgattgggatga

SEQ ID NO: 1404008 - DNA, 16 bp, Homo sapiens
ttgcagaatgatgcag

SEQ ID NO: 1404009 - DNA, 21 bp, Homo sapiens
ttgcatactttgtattttgat

SEQ ID NO: 1404010 - DNA, 11 bp, Homo sapiens
ttgcatgcatg

SEQ ID NO: 1404011 - DNA, 15 bp, Homo sapiens
ttgcatgcatgcaaa

SEQ ID NO: 1404012 - DNA, 18 bp, Homo sapiens
ttggaaattcctgtactg

SEQ ID NO: 1404013 - DNA, 20 bp, Homo sapiens
ttggcctcttgtagtcttgg

SEQ ID NO: 1404014 - DNA, 16 bp, Homo sapiens
ttgggaaaacatgtta

SEQ ID NO: 1404015 - DNA, 23 bp, Homo sapiens
ttgggaatgaggaaaattcttaa

SEQ ID NO: 1404016 - DNA, 20 bp, Homo sapiens
ttggtaatcccctaaaataa

SEQ ID NO: 1404017 - DNA, 22 bp, Homo sapiens
ttgtaaaaatcttttgaagcat

SEQ ID NO: 1404018 - DNA, 17 bp, Homo sapiens
ttgtattttcatgaaaa

SEQ ID NO: 1404019 - DNA, 16 bp, Homo sapiens
ttgtctgatttcttag

SEQ ID NO: 1404020 - DNA, 15 bp, Homo sapiens
ttgtgtgaaattgca

SEQ ID NO: 1404021 - DNA, 15 bp, Homo sapiens
tttgtgatgcatttt

SEQ ID NO: 1404022 - DNA, 21 bp, Homo sapiens
ttttaaaatgaaatgcatttt

SEQ ID NO: 1404023 - DNA, 22 bp, Homo sapiens
ttttaaccggtaagagtttcag

SEQ ID NO: 1404024 - DNA, 16 bp, Homo sapiens
ttttcttcttgggata

SEQ ID NO: 1404025 - DNA, 21 bp, Homo sapiens
ttttgcatgcatgcaaatgag

SEQ ID NO: 1404026 - DNA, 14 bp, Homo sapiens
ttttgtatgttaaa

SEQ ID NO: 1404027 - DNA, 15 bp, Homo sapiens
ttttgtttgccagga

SEQ ID NO: 1404028 - DNA, 15 bp, Homo sapiens
ttttgtttggtaaat

SEQ ID NO: 1404029 - DNA, 12 bp, Homo sapiens
tttttaaaattt

SEQ ID NO: 1404030 - DNA, 17 bp, Homo sapiens
tttttggcaaagccaga

SEQ ID NO: 1404031 - DNA, 12 bp, Homo sapiens
ttttttaagctt

SEQ ID NO: 1404032 - DNA, 23 bp, Homo sapiens
ttttttaagcttcagttgcttgt

SEQ ID NO: 1404033 - DNA, 11 bp, Homo sapiens
ttttttattat

SEQ ID NO: 1404034 - DNA, 10 bp, Homo sapiens
aaaaaaagaa

SEQ ID NO: 1404035 - DNA, 11 bp, Homo sapiens
aaaaagaaaag

SEQ ID NO: 1404036 - DNA, 16 bp, Homo sapiens
aaaacatgcttttcca

SEQ ID NO: 1404037 - DNA, 13 bp, Homo sapiens
aaaacatttgctg

SEQ ID NO: 1404038 - DNA, 20 bp, Homo sapiens
aaaataaataaaaactaatt

SEQ ID NO: 1404039 - DNA, 17 bp, Homo sapiens
aaaatagctcttgcttt

SEQ ID NO: 1404040 - DNA, 13 bp, Homo sapiens
aaaatgaaatgca

SEQ ID NO: 1404041 - DNA, 20 bp, Homo sapiens
aaaattgagttgcacttatt

SEQ ID NO: 1404042 - DNA, 21 bp, Homo sapiens
aaaattttgtatgttaaagag

SEQ ID NO: 1404043 - DNA, 18 bp, Homo sapiens
aaacatgcttttccaaac

SEQ ID NO: 1404044 - DNA, 16 bp, Homo sapiens
aaacatgttaatgaca

SEQ ID NO: 1404045 - DNA, 21 bp, Homo sapiens
aaacatgttaatgacaatatt

SEQ ID NO: 1404046 - DNA, 12 bp, Homo sapiens
aaacatttgctg

SEQ ID NO: 1404047 - DNA, 22 bp, Homo sapiens
aaactgcttcccttactttgct

SEQ ID NO: 1404048 - DNA, 13 bp, Homo sapiens
aaagaaaattgag

SEQ ID NO: 1404049 - DNA, 10 bp, Homo sapiens
aaagagaaaa

SEQ ID NO: 1404050 - DNA, 12 bp, Homo sapiens
aaagagaaaaaa

SEQ ID NO: 1404051 - DNA, 14 bp, Homo sapiens
aaagctgttccttg

SEQ ID NO: 1404052 - DNA, 17 bp, Homo sapiens
aaagtgggcttaatgga

SEQ ID NO: 1404053 - DNA, 23 bp, Homo sapiens
aaagtgtgtatatattttgtgtg

SEQ ID NO: 1404054 - DNA, 17 bp, Homo sapiens
aaagttttatatgcttt

SEQ ID NO: 1404055 - DNA, 15 bp, Homo sapiens
aaataaaaactaatt

SEQ ID NO: 1404056 - DNA, 15 bp, Homo sapiens
aaatacacatttgct

SEQ ID NO: 1404057 - DNA, 22 bp, Homo sapiens
aaataccatttagtaagaatac

SEQ ID NO: 1404058 - DNA, 13 bp, Homo sapiens
aaatataaaatta

SEQ ID NO: 1404059 - DNA, 14 bp, Homo sapiens
aaatataacacatt

SEQ ID NO: 1404060 - DNA, 16 bp, Homo sapiens
aaatataacacatttt

SEQ ID NO: 1404061 - DNA, 16 bp, Homo sapiens
aaatgaaatgcatttt

SEQ ID NO: 1404062 - DNA, 13 bp, Homo sapiens
aaatgtaatttaa

SEQ ID NO: 1404063 - DNA, 14 bp, Homo sapiens
aaatgtaatttaaa

SEQ ID NO: 1404064 - DNA, 13 bp, Homo sapiens
aaatgtataaata

SEQ ID NO: 1404065 - DNA, 17 bp, Homo sapiens
aaatgtataaatataca

SEQ ID NO: 1404066 - DNA, 21 bp, Homo sapiens
aaatgtataaatatacagtat

SEQ ID NO: 1404067 - DNA, 14 bp, Homo sapiens
aaatgttaaaagtt

SEQ ID NO: 1404068 - DNA, 16 bp, Homo sapiens
aaatgttaaaagtttt

SEQ ID NO: 1404069 - DNA, 19 bp, Homo sapiens
aaatgttaaaagttttata

SEQ ID NO: 1404070 - DNA, 10 bp, Homo sapiens
aaatgtttct

SEQ ID NO: 1404071 - DNA, 13 bp, Homo sapiens
aaattgcatttgt

SEQ ID NO: 1404072 - DNA, 14 bp, Homo sapiens
aacaaattgcattt

SEQ ID NO: 1404073 - DNA, 17 bp, Homo sapiens
aacaaattgcatttgtg

SEQ ID NO: 1404074 - DNA, 20 bp, Homo sapiens
aacacatttttttgcatgca

SEQ ID NO: 1404075 - DNA, 15 bp, Homo sapiens
aacagccactcccct

SEQ ID NO: 1404076 - DNA, 18 bp, Homo sapiens
aacagccactcccctcca

SEQ ID NO: 1404077 - DNA, 15 bp, Homo sapiens
aacagtcatcattta

SEQ ID NO: 1404078 - DNA, 17 bp, Homo sapiens
aacatgcttttccaaac

SEQ ID NO: 1404079 - DNA, 20 bp, Homo sapiens
aacatgttaatgacaatatt

SEQ ID NO: 1404080 - DNA, 20 bp, Homo sapiens
aaccacatttctaagccttt

SEQ ID NO: 1404081 - DNA, 21 bp, Homo sapiens
aacctttgagtagatccattt

SEQ ID NO: 1404082 - DNA, 23 bp, Homo sapiens
aacgaagagttcccttgaaactt

SEQ ID NO: 1404083 - DNA, 22 bp, Homo sapiens
aactgcttcccttactttgctg

SEQ ID NO: 1404084 - DNA, 18 bp, Homo sapiens
aactggcttaacttagta

SEQ ID NO: 1404085 - DNA, 14 bp, Homo sapiens
aactttgtaaaaat

SEQ ID NO: 1404086 - DNA, 13 bp, Homo sapiens
atagacatgaaag

SEQ ID NO: 1404087 - DNA, 15 bp, Homo sapiens
atagataatattgtt

SEQ ID NO: 1404088 - DNA, 15 bp, Homo sapiens
atagcacatgatttg

SEQ ID NO: 1404089 - DNA, 13 bp, Homo sapiens
atagctcttgctt

SEQ ID NO: 1404090 - DNA, 21 bp, Homo sapiens
ataggaatcattcagaaatgt

SEQ ID NO: 1404091 - DNA, 23 bp, Homo sapiens
atagtctaagactatatatataa

SEQ ID NO: 1404092 - DNA, 12 bp, Homo sapiens
atataaaattat

SEQ ID NO: 1404093 - DNA, 18 bp, Homo sapiens
atataaccacatttctaa

SEQ ID NO: 1404094 - DNA, 20 bp, Homo sapiens
atataaccacatttctaagc

SEQ ID NO: 1404095 - DNA, 13 bp, Homo sapiens
atatacatcatac

SEQ ID NO: 1404096 - DNA, 19 bp, Homo sapiens
atatagaaggactgcagcc

SEQ ID NO: 1404097 - DNA, 20 bp, Homo sapiens
atatagaaggactgcagcca

SEQ ID NO: 1404098 - DNA, 13 bp, Homo sapiens
atatataaatgta

SEQ ID NO: 1404099 - DNA, 14 bp, Homo sapiens
atatatacatcata

SEQ ID NO: 1404100 - DNA, 16 bp, Homo sapiens
atatattttgtgtgaa

SEQ ID NO: 1404101 - DNA, 22 bp, Homo sapiens
atatccaattttaaaatgaaat

SEQ ID NO: 1404102 - DNA, 19 bp, Homo sapiens
atatgctttattaatgttt

SEQ ID NO: 1404103 - DNA, 14 bp, Homo sapiens
atatggactcagcc

SEQ ID NO: 1404104 - DNA, 20 bp, Homo sapiens
atatgtattcttttctcagt

SEQ ID NO: 1404105 - DNA, 16 bp, Homo sapiens
atattaacaaattgca

SEQ ID NO: 1404106 - DNA, 19 bp, Homo sapiens
atattaacaaattgcattt

SEQ ID NO: 1404107 - DNA, 14 bp, Homo sapiens
atattactgacatt

SEQ ID NO: 1404108 - DNA, 20 bp, Homo sapiens
atattcagggtaaataggaa

SEQ ID NO: 1404109 - DNA, 17 bp, Homo sapiens
atattccagatctttca

SEQ ID NO: 1404110 - DNA, 12 bp, Homo sapiens
atattgaatgtt

SEQ ID NO: 1404111 - DNA, 19 bp, Homo sapiens
atattgtttggtaaatgtt

SEQ ID NO: 1404112 - DNA, 18 bp, Homo sapiens
atattttgtgtgaaattg

SEQ ID NO: 1404113 - DNA, 22 bp, Homo sapiens
atattttgtgtgaaattgcata

SEQ ID NO: 1404114 - DNA, 15 bp, Homo sapiens
atatttttcccagga

SEQ ID NO: 1404115 - DNA, 18 bp, Homo sapiens
atcactgtatcattttct

SEQ ID NO: 1404116 - DNA, 19 bp, Homo sapiens
atcactgtatcattttctt

SEQ ID NO: 1404117 - DNA, 19 bp, Homo sapiens
atcatacttaactttacta

SEQ ID NO: 1404118 - DNA, 16 bp, Homo sapiens
atcatcacaaatggct

SEQ ID NO: 1404119 - DNA, 15 bp, Homo sapiens
atcatctcctttgca

SEQ ID NO: 1404120 - DNA, 18 bp, Homo sapiens
atcatctcctttgcagaa

SEQ ID NO: 1404121 - DNA, 14 bp, Homo sapiens
atcattcagaaatg

SEQ ID NO: 1404122 - DNA, 19 bp, Homo sapiens
atccagttataagaagaag

SEQ ID NO: 1404123 - DNA, 17 bp, Homo sapiens
atccatttccattgctt

SEQ ID NO: 1404124 - DNA, 20 bp, Homo sapiens
atcccttactttaacccttt

SEQ ID NO: 1404125 - DNA, 22 bp, Homo sapiens
atcccttactttaaccctttct

SEQ ID NO: 1404126 - DNA, 15 bp, Homo sapiens
atcgtttttgtattt

SEQ ID NO: 1404127 - DNA, 19 bp, Homo sapiens
atctaaggtccccagcaga

SEQ ID NO: 1404128 - DNA, 20 bp, Homo sapiens
atctaaggtccccagcagaa

SEQ ID NO: 1404129 - DNA, 14 bp, Homo sapiens
atctacaatctctt

SEQ ID NO: 1404130 - DNA, 23 bp, Homo sapiens
atctacaatctctttttgtttgc

SEQ ID NO: 1404131 - DNA, 22 bp, Homo sapiens
atctcacagcatttgccaagtc

SEQ ID NO: 1404132 - DNA, 17 bp, Homo sapiens
atctcgctccctcccag

SEQ ID NO: 1404133 - DNA, 19 bp, Homo sapiens
atctctcaggaatcatctc

SEQ ID NO: 1404134 - DNA, 15 bp, Homo sapiens
atctctttttgtttg

SEQ ID NO: 1404135 - DNA, 16 bp, Homo sapiens
atctctttttgtttgc

SEQ ID NO: 1404136 - DNA, 15 bp, Homo sapiens
atcttcgggaccagg

SEQ ID NO: 1404137 - DNA, 18 bp, Homo sapiens
atcttcgggaccaggatt

SEQ ID NO: 1404138 - DNA, 21 bp, Homo sapiens
atcttggactcatgaggaggg

SEQ ID NO: 1404139 - DNA, 17 bp, Homo sapiens
atctttcagaaatataa

SEQ ID NO: 1404140 - DNA, 22 bp, Homo sapiens
atctttcagaaatataacacat

SEQ ID NO: 1404141 - DNA, 22 bp, Homo sapiens
atctttcattttgcacctgcag

SEQ ID NO: 1404142 - DNA, 12 bp, Homo sapiens
atgaaagaaaat

SEQ ID NO: 1404143 - DNA, 12 bp, Homo sapiens
atgaaatgcatt

SEQ ID NO: 1404144 - DNA, 16 bp, Homo sapiens
atgaaatgcattttgc

SEQ ID NO: 1404145 - DNA, 19 bp, Homo sapiens
atgaaatgcattttgctag

SEQ ID NO: 1404146 - DNA, 22 bp, Homo sapiens
atgagctctgaaatcttcccat

SEQ ID NO: 1404147 - DNA, 21 bp, Homo sapiens
atgaggaaaattcttaaaagg

SEQ ID NO: 1404148 - DNA, 19 bp, Homo sapiens
atgagtccttgatttcaaa

SEQ ID NO: 1404149 - DNA, 21 bp, Homo sapiens
atgagtccttgatttcaaagt

SEQ ID NO: 1404150 - DNA, 22 bp, Homo sapiens
atgatttgggctctagaattcc

SEQ ID NO: 1404151 - DNA, 21 bp, Homo sapiens
atgcaaatgagctctgaaatc

SEQ ID NO: 1404152 - DNA, 18 bp, Homo sapiens
atgcaataaaatttaaaa

SEQ ID NO: 1404153 - DNA, 15 bp, Homo sapiens
atgcagctttgcaaa

SEQ ID NO: 1404154 - DNA, 19 bp, Homo sapiens
atgcagttagctgaagaat

SEQ ID NO: 1404155 - DNA, 18 bp, Homo sapiens
atgcattttgctagacag

SEQ ID NO: 1404156 - DNA, 15 bp, Homo sapiens
atgccacccacatct

SEQ ID NO: 1404157 - DNA, 15 bp, Homo sapiens
atgctgacatcattt

SEQ ID NO: 1404158 - DNA, 16 bp, Homo sapiens
atgctgacatcatttg

SEQ ID NO: 1404159 - DNA, 22 bp, Homo sapiens
atgctttattaatgttttcaaa

SEQ ID NO: 1404160 - DNA, 14 bp, Homo sapiens
atgcttttccaaac

SEQ ID NO: 1404161 - DNA, 22 bp, Homo sapiens
atggatttggcactagccaaag

SEQ ID NO: 1404162 - DNA, 13 bp, Homo sapiens
atggcttgtctat

SEQ ID NO: 1404163 - DNA, 22 bp, Homo sapiens
atggtcagaatttccctctgat

SEQ ID NO: 1404164 - DNA, 23 bp, Homo sapiens
atggtcagaatttccctctgata

SEQ ID NO: 1404165 - DNA, 17 bp, Homo sapiens
atgtaatttaaatgaaa

SEQ ID NO: 1404166 - DNA, 16 bp, Homo sapiens
atgtacagattctttc

SEQ ID NO: 1404167 - DNA, 18 bp, Homo sapiens
atgtaggtaagactgtag

SEQ ID NO: 1404168 - DNA, 14 bp, Homo sapiens
atgtataaatatac

SEQ ID NO: 1404169 - DNA, 12 bp, Homo sapiens
atgtatttgcaa

SEQ ID NO: 1404170 - DNA, 17 bp, Homo sapiens
atgtgggatattgaatg

SEQ ID NO: 1404171 - DNA, 19 bp, Homo sapiens
atgtgggatattgaatgtt

SEQ ID NO: 1404172 - DNA, 16 bp, Homo sapiens
atgttaaagagaatga

SEQ ID NO: 1404173 - DNA, 21 bp, Homo sapiens
atgtttcttttgtttggtaaa

SEQ ID NO: 1404174 - DNA, 13 bp, Homo sapiens
attaacaaattgc

SEQ ID NO: 1404175 - DNA, 14 bp, Homo sapiens
attaacaaattgca

SEQ ID NO: 1404176 - DNA, 15 bp, Homo sapiens
attaacaaattgcat

SEQ ID NO: 1404177 - DNA, 16 bp, Homo sapiens
attaacaaattgcatt

SEQ ID NO: 1404178 - DNA, 21 bp, Homo sapiens
attacagaggtattaaaacta

SEQ ID NO: 1404179 - DNA, 16 bp, Homo sapiens
attagctttaattaag

SEQ ID NO: 1404180 - DNA, 20 bp, Homo sapiens
attatacatgtgatacattt

SEQ ID NO: 1404181 - DNA, 21 bp, Homo sapiens
attatatttcacccatctctc

SEQ ID NO: 1404182 - DNA, 13 bp, Homo sapiens
attatgttccaag

SEQ ID NO: 1404183 - DNA, 22 bp, Homo sapiens
attatttttttaaaattttgta

SEQ ID NO: 1404184 - DNA, 18 bp, Homo sapiens
attcaactttgtaaaaat

SEQ ID NO: 1404185 - DNA, 14 bp, Homo sapiens
attctaaatacatg

SEQ ID NO: 1404186 - DNA, 15 bp, Homo sapiens
attctataaaactct

SEQ ID NO: 1404187 - DNA, 13 bp, Homo sapiens
attctcaggcacc

SEQ ID NO: 1404188 - DNA, 23 bp, Homo sapiens
attcttaaaaggcccatagcagc

SEQ ID NO: 1404189 - DNA, 14 bp, Homo sapiens
attcttagcaaaaa

SEQ ID NO: 1404190 - DNA, 22 bp, Homo sapiens
attcttagcaaaaaatgaacag

SEQ ID NO: 1404191 - DNA, 17 bp, Homo sapiens
attctttcagttctttg

SEQ ID NO: 1404192 - DNA, 13 bp, Homo sapiens
attcttttctcag

SEQ ID NO: 1404193 - DNA, 20 bp, Homo sapiens
attgaaaagtttttgtttgg

SEQ ID NO: 1404194 - DNA, 23 bp, Homo sapiens
attgaaaagtttttgtttggaga

SEQ ID NO: 1404195 - DNA, 16 bp, Homo sapiens
attgacagttgaacag

SEQ ID NO: 1404196 - DNA, 17 bp, Homo sapiens
attgacagttgaacaga

SEQ ID NO: 1404197 - DNA, 19 bp, Homo sapiens
attgactaactcaaataca

SEQ ID NO: 1404198 - DNA, 16 bp, Homo sapiens
attgagtattgtttaa

SEQ ID NO: 1404199 - DNA, 23 bp, Homo sapiens
attgagtattgtttaaaatgtaa

SEQ ID NO: 1404200 - DNA, 19 bp, Homo sapiens
attgattgggaaaacattt

SEQ ID NO: 1404201 - DNA, 18 bp, Homo sapiens
attgtacaaaattaagca

SEQ ID NO: 1404202 - DNA, 21 bp, Homo sapiens
attgtacaaaattaagcaaat

SEQ ID NO: 1404203 - DNA, 14 bp, Homo sapiens
attgtttaaaatgt

SEQ ID NO: 1404204 - DNA, 15 bp, Homo sapiens
attgtttaaaatgta

SEQ ID NO: 1404205 - DNA, 16 bp, Homo sapiens
attgtttaaaatgtaa

SEQ ID NO: 1404206 - DNA, 17 bp, Homo sapiens
attgtttggtaaatgtt

SEQ ID NO: 1404207 - DNA, 22 bp, Homo sapiens
atttaaaaaataaataaaaact

SEQ ID NO: 1404208 - DNA, 15 bp, Homo sapiens
atttacttgttttgg

SEQ ID NO: 1404209 - DNA, 23 bp, Homo sapiens
atttacttgttttggatggcttg

SEQ ID NO: 1404210 - DNA, 22 bp, Homo sapiens
atttatctaaggtccccagcag

SEQ ID NO: 1404211 - DNA, 23 bp, Homo sapiens
atttatctaaggtccccagcaga

SEQ ID NO: 1404212 - DNA, 19 bp, Homo sapiens
atttcaaagttttgttgta

SEQ ID NO: 1404213 - DNA, 22 bp, Homo sapiens
atttccagaaccacacttgaaa

SEQ ID NO: 1404214 - DNA, 22 bp, Homo sapiens
atttcttttgtaataaactatt

SEQ ID NO: 1404215 - DNA, 18 bp, Homo sapiens
cttctggaaactgtgaag

SEQ ID NO: 1404216 - DNA, 18 bp, Homo sapiens
cttcttccattggaaaat

SEQ ID NO: 1404217 - DNA, 18 bp, Homo sapiens
cttgaaactttgggaaaa

SEQ ID NO: 1404218 - DNA, 19 bp, Homo sapiens
cttggaaattcctgtactg

SEQ ID NO: 1404219 - DNA, 15 bp, Homo sapiens
cttggctaaggaaat

SEQ ID NO: 1404220 - DNA, 14 bp, Homo sapiens
cttgtctgatttct

SEQ ID NO: 1404221 - DNA, 22 bp, Homo sapiens
cttgttagaagaggtggcccca

SEQ ID NO: 1404222 - DNA, 19 bp, Homo sapiens
cttgtttacctttctctct

SEQ ID NO: 1404223 - DNA, 22 bp, Homo sapiens
ctttaaccctcacactgctcca

SEQ ID NO: 1404224 - DNA, 14 bp, Homo sapiens
ctttaaccctttct

SEQ ID NO: 1404225 - DNA, 16 bp, Homo sapiens
ctttactaagtaatct

SEQ ID NO: 1404226 - DNA, 23 bp, Homo sapiens
ctttagtttttggttgggaatga

SEQ ID NO: 1404227 - DNA, 14 bp, Homo sapiens
ctttattaatgttt

SEQ ID NO: 1404228 - DNA, 14 bp, Homo sapiens
ctttcattttgcac

SEQ ID NO: 1404229 - DNA, 21 bp, Homo sapiens
ctttgagtagatccatttcca

SEQ ID NO: 1404230 - DNA, 20 bp, Homo sapiens
ctttggattctaaatacatg

SEQ ID NO: 1404231 - DNA, 12 bp, Homo sapiens
cttttaaagacc

SEQ ID NO: 1404232 - DNA, 20 bp, Homo sapiens
cttttaccttttttttttct

SEQ ID NO: 1404233 - DNA, 16 bp, Homo sapiens
cttttataaagcatgt

SEQ ID NO: 1404234 - DNA, 17 bp, Homo sapiens
cttttctcagtgttggt

SEQ ID NO: 1404235 - DNA, 14 bp, Homo sapiens
cttttgtttggtaa

SEQ ID NO: 1404236 - DNA, 14 bp, Homo sapiens
gaaaacatgttaat

SEQ ID NO: 1404237 - DNA, 12 bp, Homo sapiens
gaaaagagaaaa

SEQ ID NO: 1404238 - DNA, 15 bp, Homo sapiens
gaaaagcgcagagaa

SEQ ID NO: 1404239 - DNA, 16 bp, Homo sapiens
gaaaattcttaaaagg

SEQ ID NO: 1404240 - DNA, 12 bp, Homo sapiens
gaaaattgagtt

SEQ ID NO: 1404241 - DNA, 16 bp, Homo sapiens
gaaactgagggcagag

SEQ ID NO: 1404242 - DNA, 17 bp, Homo sapiens
gaaactgagggcagaga

SEQ ID NO: 1404243 - DNA, 19 bp, Homo sapiens
gaaactgagggcagagagg

SEQ ID NO: 1404244 - DNA, 17 bp, Homo sapiens
gaaactttgggaaaaca

SEQ ID NO: 1404245 - DNA, 18 bp, Homo sapiens
gaaagtttttttttatta

SEQ ID NO: 1404246 - DNA, 15 bp, Homo sapiens
gaaatggaaagcaga

SEQ ID NO: 1404247 - DNA, 16 bp, Homo sapiens
gaaatggaaagcagag

SEQ ID NO: 1404248 - DNA, 12 bp, Homo sapiens
gaacagagctag

SEQ ID NO: 1404249 - DNA, 16 bp, Homo sapiens
gaagaatgaaagctgt

SEQ ID NO: 1404250 - DNA, 17 bp, Homo sapiens
gaagaattgaaaagttt

SEQ ID NO: 1404251 - DNA, 15 bp, Homo sapiens
gaagaggtggcccca

SEQ ID NO: 1404252 - DNA, 21 bp, Homo sapiens
gaagatctcactctgcccccc

SEQ ID NO: 1404253 - DNA, 15 bp, Homo sapiens
gaagtaaagtgaaga

SEQ ID NO: 1404254 - DNA, 18 bp, Homo sapiens
gaagtctgatccctgcca

SEQ ID NO: 1404255 - DNA, 18 bp, Homo sapiens
gaataatagcacatgatt

SEQ ID NO: 1404256 - DNA, 16 bp, Homo sapiens
gaataccacatcaaat

SEQ ID NO: 1404257 - DNA, 18 bp, Homo sapiens
gaatcattcagaaatgtt

SEQ ID NO: 1404258 - DNA, 16 bp, Homo sapiens
gaatgaggaaaattct

SEQ ID NO: 1404259 - DNA, 13 bp, Homo sapiens
gaattccagtccc

SEQ ID NO: 1404260 - DNA, 19 bp, Homo sapiens
gaattccagtcccctttct

SEQ ID NO: 1404261 - DNA, 18 bp, Homo sapiens
gacatcatttgtattatg

SEQ ID NO: 1404262 - DNA, 16 bp, Homo sapiens
gacccaaccacagagg

SEQ ID NO: 1404263 - DNA, 15 bp, Homo sapiens
gacccagggaacagc

SEQ ID NO: 1404264 - DNA, 20 bp, Homo sapiens
gacctggcatctaattctga

SEQ ID NO: 1404265 - DNA, 15 bp, Homo sapiens
gactagccagccagg

SEQ ID NO: 1404266 - DNA, 17 bp, Homo sapiens
gactagccagccaggaa

SEQ ID NO: 1404267 - DNA, 22 bp, Homo sapiens
gactcatgaggaggggcccccc

SEQ ID NO: 1404268 - DNA, 14 bp, Homo sapiens
gactgcagagggct

SEQ ID NO: 1404269 - DNA, 20 bp, Homo sapiens
gactgcagccactgattctc

SEQ ID NO: 1404270 - DNA, 13 bp, Homo sapiens
gacttcagattcc

SEQ ID NO: 1404271 - DNA, 12 bp, Homo sapiens
gagataagaaag

SEQ ID NO: 1404272 - DNA, 18 bp, Homo sapiens
gagatcccacatatttca

SEQ ID NO: 1404273 - DNA, 21 bp, Homo sapiens
gagatgaaccctggcatttgg

SEQ ID NO: 1404274 - DNA, 18 bp, Homo sapiens
gaggatgctgacatcatt

SEQ ID NO: 1404275 - DNA, 22 bp, Homo sapiens
gaggatgctgacatcatttgta

SEQ ID NO: 1404276 - DNA, 17 bp, Homo sapiens
gaggggcccccctgccc

SEQ ID NO: 1404277 - DNA, 14 bp, Homo sapiens
gaggtattaaaact

SEQ ID NO: 1404278 - DNA, 17 bp, Homo sapiens
gagtaacagtcatcatt

SEQ ID NO: 1404279 - DNA, 20 bp, Homo sapiens
gagtaacagtcatcatttat

SEQ ID NO: 1404280 - DNA, 19 bp, Homo sapiens
gagtgctaagcattagctt

SEQ ID NO: 1404281 - DNA, 13 bp, Homo sapiens
gagtgtatgagta

SEQ ID NO: 1404282 - DNA, 16 bp, Homo sapiens
gagttttcattaaatc

SEQ ID NO: 1404283 - DNA, 22 bp, Homo sapiens
gataatattgtttggtaaatgt

SEQ ID NO: 1404284 - DNA, 13 bp, Homo sapiens
gatattgaatgtt

SEQ ID NO: 1404285 - DNA, 17 bp, Homo sapiens
gatccatttccattgct

SEQ ID NO: 1404286 - DNA, 23 bp, Homo sapiens
gatccatttccattgcttattat

SEQ ID NO: 1404287 - DNA, 17 bp, Homo sapiens
gatgaaccctggcattt

SEQ ID NO: 1404288 - DNA, 21 bp, Homo sapiens
gatgaatcctagcttcttcca

SEQ ID NO: 1404289 - DNA, 16 bp, Homo sapiens
gatgtgttgcaaaggt

SEQ ID NO: 1404290 - DNA, 17 bp, Homo sapiens
gattattttttttttct

SEQ ID NO: 1404291 - DNA, 20 bp, Homo sapiens
gattctttcagttctttgga

SEQ ID NO: 1404292 - DNA, 14 bp, Homo sapiens
gattgcctctgaaa

SEQ ID NO: 1404293 - DNA, 21 bp, Homo sapiens
gatttatctaaggtccccagc

SEQ ID NO: 1404294 - DNA, 19 bp, Homo sapiens
gatttccagaaccacactt

SEQ ID NO: 1404295 - DNA, 22 bp, Homo sapiens
gatttccagaaccacacttgaa

SEQ ID NO: 1404296 - DNA, 15 bp, Homo sapiens
gatttctcattgact

SEQ ID NO: 1404297 - DNA, 22 bp, Homo sapiens
gatttctcattgacttttataa

SEQ ID NO: 1404298 - DNA, 23 bp, Homo sapiens
gcaaaatcagaatggaatgctct

SEQ ID NO: 1404299 - DNA, 12 bp, Homo sapiens
gcaaatgttaaa

SEQ ID NO: 1404300 - DNA, 13 bp, Homo sapiens
gcaataaaattta

SEQ ID NO: 1404301 - DNA, 21 bp, Homo sapiens
gcaataaaatttaaaaaataa

SEQ ID NO: 1404302 - DNA, 19 bp, Homo sapiens
gcaatactaggaagtaaag

SEQ ID NO: 1404303 - DNA, 14 bp, Homo sapiens
gcaccagtccctgt

SEQ ID NO: 1404304 - DNA, 14 bp, Homo sapiens
gcagaattgacagt

SEQ ID NO: 1404305 - DNA, 14 bp, Homo sapiens
gcagagttttcatt

SEQ ID NO: 1404306 - DNA, 14 bp, Homo sapiens
gcagccaagcaaat

SEQ ID NO: 1404307 - DNA, 13 bp, Homo sapiens
gcagccagttcaa

SEQ ID NO: 1404308 - DNA, 22 bp, Homo sapiens
gcagttagctgaagaattgaaa

SEQ ID NO: 1404309 - DNA, 15 bp, Homo sapiens
gcataaattgcatca

SEQ ID NO: 1404310 - DNA, 14 bp, Homo sapiens
gcatactttgtatt

SEQ ID NO: 1404311 - DNA, 18 bp, Homo sapiens
gcatactttgtattttga

SEQ ID NO: 1404312 - DNA, 14 bp, Homo sapiens
gcatgcatgcaaat

SEQ ID NO: 1404313 - DNA, 18 bp, Homo sapiens
gcatgtagaggcttgttt

SEQ ID NO: 1404314 - DNA, 21 bp, Homo sapiens
gcatgttcacccttatagtct

SEQ ID NO: 1404315 - DNA, 10 bp, Homo sapiens
gcattgagta

SEQ ID NO: 1404316 - DNA, 17 bp, Homo sapiens
gcattgagtattgttta

SEQ ID NO: 1404317 - DNA, 17 bp, Homo sapiens
gccaaattttagattta

SEQ ID NO: 1404318 - DNA, 20 bp, Homo sapiens
gccaatatcccttactttaa

SEQ ID NO: 1404319 - DNA, 16 bp, Homo sapiens
gccacatcaaaccttt

SEQ ID NO: 1404320 - DNA, 19 bp, Homo sapiens
gcccaacaagttgaagaag

SEQ ID NO: 1404321 - DNA, 15 bp, Homo sapiens
gccgattcctccagc

SEQ ID NO: 1404322 - DNA, 16 bp, Homo sapiens
gcctctgaaaagtgtg

SEQ ID NO: 1404323 - DNA, 14 bp, Homo sapiens
gcctcttgtagtct

SEQ ID NO: 1404324 - DNA, 19 bp, Homo sapiens
gccttcaaaactatagctt

SEQ ID NO: 1404325 - DNA, 13 bp, Homo sapiens
gccttggaaattc

SEQ ID NO: 1404326 - DNA, 15 bp, Homo sapiens
gcctttgagactgtt

SEQ ID NO: 1404327 - DNA, 22 bp, Homo sapiens
gccttttgggaataatagcaca

SEQ ID NO: 1404328 - DNA, 12 bp, Homo sapiens
gcgcagagaaat

SEQ ID NO: 1404329 - DNA, 16 bp, Homo sapiens
gctaaggaaattctaa

SEQ ID NO: 1404330 - DNA, 16 bp, Homo sapiens
gctacatctccaaata

SEQ ID NO: 1404331 - DNA, 21 bp, Homo sapiens
gctatgtatttgcaaggctga

SEQ ID NO: 1404332 - DNA, 15 bp, Homo sapiens
gctatgtcagtacta

SEQ ID NO: 1404333 - DNA, 14 bp, Homo sapiens
gctccctcccagga

SEQ ID NO: 1404334 - DNA, 15 bp, Homo sapiens
gctccctcccaggac

SEQ ID NO: 1404335 - DNA, 18 bp, Homo sapiens
gctccctcccaggactct

SEQ ID NO: 1404336 - DNA, 23 bp, Homo sapiens
gctcctccccttcctcttgtctg

SEQ ID NO: 1404337 - DNA, 14 bp, Homo sapiens
gctctaaaaggtaa

SEQ ID NO: 1404338 - DNA, 20 bp, Homo sapiens
gctctaaaaggtaatgtgtg

SEQ ID NO: 1404339 - DNA, 15 bp, Homo sapiens
gctctggggggcagg

SEQ ID NO: 1404340 - DNA, 16 bp, Homo sapiens
gctgacatcatttgta

SEQ ID NO: 1404341 - DNA, 21 bp, Homo sapiens
gctgtcattgcacataagctt

SEQ ID NO: 1404342 - DNA, 19 bp, Homo sapiens
gctttaattaagctctcat

SEQ ID NO: 1404343 - DNA, 15 bp, Homo sapiens
gcttttccctgtcct

SEQ ID NO: 1404344 - DNA, 18 bp, Homo sapiens
gcttttggggagccagaa

SEQ ID NO: 1404345 - DNA, 14 bp, Homo sapiens
ggaaaacatttgct

SEQ ID NO: 1404346 - DNA, 18 bp, Homo sapiens
tgtctagggtgtgattta

SEQ ID NO: 1404347 - DNA, 13 bp, Homo sapiens
tgtgaaattgcat

SEQ ID NO: 1404348 - DNA, 16 bp, Homo sapiens
tgtgatttaggtcagt

SEQ ID NO: 1404349 - DNA, 23 bp, Homo sapiens
tgtgggccagccgattcctccag

SEQ ID NO: 1404350 - DNA, 24 bp, Homo sapiens
tgtgggccagccgattcctccagc

SEQ ID NO: 1404351 - DNA, 19 bp, Homo sapiens
tgtgtatatattttgtgtg

SEQ ID NO: 1404352 - DNA, 20 bp, Homo sapiens
tgtgtcacactgtggcctga

SEQ ID NO: 1404353 - DNA, 14 bp, Homo sapiens
tgtgtgaaattgca

SEQ ID NO: 1404354 - DNA, 23 bp, Homo sapiens
tgtgtggattgcctctgaaaagt

SEQ ID NO: 1404355 - DNA, 16 bp, Homo sapiens
tgttgtacttaaatgg

SEQ ID NO: 1404356 - DNA, 13 bp, Homo sapiens
tgtttaaaatgta

SEQ ID NO: 1404357 - DNA, 14 bp, Homo sapiens
tgtttaaaatgtaa

SEQ ID NO: 1404358 - DNA, 22 bp, Homo sapiens
tgtttaaaatgtaatttaaatg

SEQ ID NO: 1404359 - DNA, 16 bp, Homo sapiens
tgtttacctttctctc

SEQ ID NO: 1404360 - DNA, 23 bp, Homo sapiens
tgtttacctttctctctctaagg

SEQ ID NO: 1404361 - DNA, 13 bp, Homo sapiens
tgtttgccaggac

SEQ ID NO: 1404362 - DNA, 16 bp, Homo sapiens
tgtttgccaggacatg

SEQ ID NO: 1404363 - DNA, 19 bp, Homo sapiens
tgtttgccaggacatgcaa

SEQ ID NO: 1404364 - DNA, 14 bp, Homo sapiens
tgtttggtaaatgt

SEQ ID NO: 1404365 - DNA, 15 bp, Homo sapiens
tgtttggtaaatgtt

SEQ ID NO: 1404366 - DNA, 22 bp, Homo sapiens
ttaaaataaagttaaactgatt

SEQ ID NO: 1404367 - DNA, 15 bp, Homo sapiens
ttaaaatgaaatgca

SEQ ID NO: 1404368 - DNA, 19 bp, Homo sapiens
ttaaaatgaaatgcatttt

SEQ ID NO: 1404369 - DNA, 13 bp, Homo sapiens
ttaaaatgtaatt

SEQ ID NO: 1404370 - DNA, 17 bp, Homo sapiens
ttaaaatgtaatttaaa

SEQ ID NO: 1404371 - DNA, 16 bp, Homo sapiens
ttaaaattttgtatgt

SEQ ID NO: 1404372 - DNA, 20 bp, Homo sapiens
ttaaaattttgtatgttaaa

SEQ ID NO: 1404373 - DNA, 14 bp, Homo sapiens
ttaaaccacttaaa

SEQ ID NO: 1404374 - DNA, 14 bp, Homo sapiens
ttaaagagaatgag

SEQ ID NO: 1404375 - DNA, 12 bp, Homo sapiens
ttaaatgaaaga

SEQ ID NO: 1404376 - DNA, 15 bp, Homo sapiens
ttaaatttaatacca

SEQ ID NO: 1404377 - DNA, 13 bp, Homo sapiens
ttaacagatttat

SEQ ID NO: 1404378 - DNA, 23 bp, Homo sapiens
ttaagctgcagagatttctcatt

SEQ ID NO: 1404379 - DNA, 18 bp, Homo sapiens
ttaaggggaagaatgaaa

SEQ ID NO: 1404380 - DNA, 22 bp, Homo sapiens
ttaatctctccaccttccaaag

SEQ ID NO: 1404381 - DNA, 14 bp, Homo sapiens
ttaatgacaatatt

SEQ ID NO: 1404382 - DNA, 15 bp, Homo sapiens
ttaatgttttcaaaa

SEQ ID NO: 1404383 - DNA, 16 bp, Homo sapiens
ttaatgttttcaaaag

SEQ ID NO: 1404384 - DNA, 13 bp, Homo sapiens
ttaattttaaagt

SEQ ID NO: 1404385 - DNA, 19 bp, Homo sapiens
ttaattttaaagtgcaaaa

SEQ ID NO: 1404386 - DNA, 14 bp, Homo sapiens
ttacctttctctct

SEQ ID NO: 1404387 - DNA, 16 bp, Homo sapiens
ttagctgaagaattga

SEQ ID NO: 1404388 - DNA, 19 bp, Homo sapiens
ttagctttaattaagctct

SEQ ID NO: 1404389 - DNA, 23 bp, Homo sapiens
ttagtttttggttgggaatgagg

SEQ ID NO: 1404390 - DNA, 13 bp, Homo sapiens
ttataaacagaaa

SEQ ID NO: 1404391 - DNA, 17 bp, Homo sapiens
ttataaacagaaatgga

SEQ ID NO: 1404392 - DNA, 20 bp, Homo sapiens
ttataattgtacaaaattaa

SEQ ID NO: 1404393 - DNA, 18 bp, Homo sapiens
ttatcatcacaaatggct

SEQ ID NO: 1404394 - DNA, 13 bp, Homo sapiens
ttattgaccattt

SEQ ID NO: 1404395 - DNA, 21 bp, Homo sapiens
ttatttttataattgtacaaa

SEQ ID NO: 1404396 - DNA, 20 bp, Homo sapiens
ttcagaaatataacacattt

SEQ ID NO: 1404397 - DNA, 22 bp, Homo sapiens
ttcagaaatataacacattttt

SEQ ID NO: 1404398 - DNA, 17 bp, Homo sapiens
ttcagttgcttgtcttc

SEQ ID NO: 1404399 - DNA, 19 bp, Homo sapiens
ttcagttgcttgtcttctg

SEQ ID NO: 1404400 - DNA, 15 bp, Homo sapiens
ttcatgaaaatacca

SEQ ID NO: 1404401 - DNA, 19 bp, Homo sapiens
ttcatggctgctgttgctt

SEQ ID NO: 1404402 - DNA, 21 bp, Homo sapiens
ttcatggctgctgttgcttaa

SEQ ID NO: 1404403 - DNA, 22 bp, Homo sapiens
ttcatggctgctgttgcttaaa

SEQ ID NO: 1404404 - DNA, 15 bp, Homo sapiens
ttccaaacccaggct

SEQ ID NO: 1404405 - DNA, 20 bp, Homo sapiens
ttccaaggctactacagaga

SEQ ID NO: 1404406 - DNA, 16 bp, Homo sapiens
ttccagtcccctttct

SEQ ID NO: 1404407 - DNA, 21 bp, Homo sapiens
ttctaccctccatgtgagaat

SEQ ID NO: 1404408 - DNA, 20 bp, Homo sapiens
ttctcattgacttttataaa

SEQ ID NO: 1404409 - DNA, 13 bp, Homo sapiens
ttctctctctaag

SEQ ID NO: 1404410 - DNA, 17 bp, Homo sapiens
ttctgcaacaagcatgc

SEQ ID NO: 1404411 - DNA, 13 bp, Homo sapiens
ttctgggatgcaa

SEQ ID NO: 1404412 - DNA, 15 bp, Homo sapiens
ttctggtactttctg

SEQ ID NO: 1404413 - DNA, 14 bp, Homo sapiens
ttcttttgtttggt

SEQ ID NO: 1404414 - DNA, 13 bp, Homo sapiens
ttgaaaaatataa

SEQ ID NO: 1404415 - DNA, 20 bp, Homo sapiens
ttgaaactttgggaaaacat

SEQ ID NO: 1404416 - DNA, 22 bp, Homo sapiens
ttgaaactttgggaaaacatgt

SEQ ID NO: 1404417 - DNA, 16 bp, Homo sapiens
ttgaacagagctagag

SEQ ID NO: 1404418 - DNA, 21 bp, Homo sapiens
ttgaacagagctagaggccat

SEQ ID NO: 1404419 - DNA, 20 bp, Homo sapiens
ttgactaactcaaatacaca

SEQ ID NO: 1404420 - DNA, 18 bp, Homo sapiens
ttgacttttataaagcat

SEQ ID NO: 1404421 - DNA, 21 bp, Homo sapiens
ttgacttttataaagcatgtt

SEQ ID NO: 1404422 - DNA, 14 bp, Homo sapiens
ttgagacctcagct

SEQ ID NO: 1404423 - DNA, 19 bp, Homo sapiens
ttgattgggaaaacatttg

SEQ ID NO: 1404424 - DNA, 22 bp, Homo sapiens
ttgattgggaaaacatttgctg

SEQ ID NO: 1404425 - DNA, 14 bp, Homo sapiens
ttgatttcaaagtt

SEQ ID NO: 1404426 - DNA, 18 bp, Homo sapiens
ttgcacctgcagccaagc

SEQ ID NO: 1404427 - DNA, 21 bp, Homo sapiens
ttgcacctgcagccaagcaaa

SEQ ID NO: 1404428 - DNA, 17 bp, Homo sapiens
ttgcatactttgtattt

SEQ ID NO: 1404429 - DNA, 13 bp, Homo sapiens
ttgcatgcatgca

SEQ ID NO: 1404430 - DNA, 16 bp, Homo sapiens
ttgccaggacatgcaa

SEQ ID NO: 1404431 - DNA, 19 bp, Homo sapiens
ttgctactgttgtaagaat

SEQ ID NO: 1404432 - DNA, 9 bp, Homo sapiens
ttgctctgg

SEQ ID NO: 1404433 - DNA, 18 bp, Homo sapiens
ttgcttaaaccacttaaa

SEQ ID NO: 1404434 - DNA, 11 bp, Homo sapiens
ttggaaattcc

SEQ ID NO: 1404435 - DNA, 16 bp, Homo sapiens
ttggatggcttgtcta

SEQ ID NO: 1404436 - DNA, 12 bp, Homo sapiens
ttgggaaaacat

SEQ ID NO: 1404437 - DNA, 20 bp, Homo sapiens
ttgggtgtctccttaagctg

SEQ ID NO: 1404438 - DNA, 12 bp, Homo sapiens
ttggtatatttt

SEQ ID NO: 1404439 - DNA, 22 bp, Homo sapiens
ttggttgggaatgaggaaaatt

SEQ ID NO: 1404440 - DNA, 14 bp, Homo sapiens
ttgtgatgcatttt

SEQ ID NO: 1404441 - DNA, 14 bp, Homo sapiens
ttgtgtgaaattgc

SEQ ID NO: 1404442 - DNA, 16 bp, Homo sapiens
ttgtgtgaaattgcat

SEQ ID NO: 1404443 - DNA, 13 bp, Homo sapiens
ttgtttgccagga

SEQ ID NO: 1404444 - DNA, 12 bp, Homo sapiens
ttgtttggagac

SEQ ID NO: 1404445 - DNA, 17 bp, Homo sapiens
ttgtttggtaaatgttt

SEQ ID NO: 1404446 - DNA, 17 bp, Homo sapiens
ttgttttggatggcttg

SEQ ID NO: 1404447 - DNA, 21 bp, Homo sapiens
tttaaaatgaaatgcattttg

SEQ ID NO: 1404448 - DNA, 23 bp, Homo sapiens
tttaaaatgtaatttaaatgaaa

SEQ ID NO: 1404449 - DNA, 14 bp, Homo sapiens
tttaaagtgcaaaa

SEQ ID NO: 1404450 - DNA, 18 bp, Homo sapiens
tttaagccttcaaaacta

SEQ ID NO: 1404451 - DNA, 14 bp, Homo sapiens
tttaagcttcagtt

SEQ ID NO: 1404452 - DNA, 16 bp, Homo sapiens
tttataaacagaaatg

SEQ ID NO: 1404453 - DNA, 18 bp, Homo sapiens
tttatattactgacattt

SEQ ID NO: 1404454 - DNA, 21 bp, Homo sapiens
tttatctaaggtccccagcag

SEQ ID NO: 1404455 - DNA, 16 bp, Homo sapiens
tttatttttggcaaag

SEQ ID NO: 1404456 - DNA, 20 bp, Homo sapiens
tttcaaaaggtattatacat

SEQ ID NO: 1404457 - DNA, 21 bp, Homo sapiens
tttcaaagttttgttgtactt

SEQ ID NO: 1404458 - DNA, 13 bp, Homo sapiens
tttcagaaatata

SEQ ID NO: 1404459 - DNA, 14 bp, Homo sapiens
tttcagtttgttgg

SEQ ID NO: 1404460 - DNA, 19 bp, Homo sapiens
tttcattttgcacctgcag

SEQ ID NO: 1404461 - DNA, 20 bp, Homo sapiens
tttgcagaatgatgcaggtt

SEQ ID NO: 1404462 - DNA, 14 bp, Homo sapiens
tttgtaaaaatctt

SEQ ID NO: 1404463 - DNA, 23 bp, Homo sapiens
tttgtaaaaatcttttgaagcat

SEQ ID NO: 1404464 - DNA, 13 bp, Homo sapiens
tttgtattttcat

SEQ ID NO: 1404465 - DNA, 21 bp, Homo sapiens
tttgtattttcatgaaaatac

SEQ ID NO: 1404466 - DNA, 18 bp, Homo sapiens
tttgttgtacttaaatgg

SEQ ID NO: 1404467 - DNA, 14 bp, Homo sapiens
ttttaaagtgcaaa

SEQ ID NO: 1404468 - DNA, 13 bp, Homo sapiens
ttttactgtctat

SEQ ID NO: 1404469 - DNA, 12 bp, Homo sapiens
ttttataaagca

SEQ ID NO: 1404470 - DNA, 15 bp, Homo sapiens
ttttataaagcatgt

SEQ ID NO: 1404471 - DNA, 19 bp, Homo sapiens
ttttatattactgacattt

SEQ ID NO: 1404472 - DNA, 23 bp, Homo sapiens
ttttatcgtttttgtattttcat

SEQ ID NO: 1404473 - DNA, 22 bp, Homo sapiens
ttttatttttggcaaagccaga

SEQ ID NO: 1404474 - DNA, 19 bp, Homo sapiens
ttttgcacctgcagccaag

SEQ ID NO: 1404475 - DNA, 19 bp, Homo sapiens
ttttgcatgcatgcaaatg

SEQ ID NO: 1404476 - DNA, 23 bp, Homo sapiens
aatattgtttggtaaatgtttct

SEQ ID NO: 1404477 - DNA, 14 bp, Homo sapiens
aatcagaatggaat

SEQ ID NO: 1404478 - DNA, 18 bp, Homo sapiens
aatcatctcctttgcaga

SEQ ID NO: 1404479 - DNA, 15 bp, Homo sapiens
aatcattcagaaatg

SEQ ID NO: 1404480 - DNA, 16 bp, Homo sapiens
aatcattcagaaatgt

SEQ ID NO: 1404481 - DNA, 14 bp, Homo sapiens
aatctcacagcatt

SEQ ID NO: 1404482 - DNA, 16 bp, Homo sapiens
aatctcacagcatttg

SEQ ID NO: 1404483 - DNA, 18 bp, Homo sapiens
aatctctttttgtttgcc

SEQ ID NO: 1404484 - DNA, 16 bp, Homo sapiens
aatcttcaaagccttc

SEQ ID NO: 1404485 - DNA, 16 bp, Homo sapiens
aatgaaagaaaattga

SEQ ID NO: 1404486 - DNA, 19 bp, Homo sapiens
aatgaaagaaaattgagtt

SEQ ID NO: 1404487 - DNA, 16 bp, Homo sapiens
aatgaaatgcattttg

SEQ ID NO: 1404488 - DNA, 13 bp, Homo sapiens
aatgtataaatat

SEQ ID NO: 1404489 - DNA, 16 bp, Homo sapiens
aatgttttcaaaaggt

SEQ ID NO: 1404490 - DNA, 18 bp, Homo sapiens
aattaagctctcatagct

SEQ ID NO: 1404491 - DNA, 17 bp, Homo sapiens
aattatgagattggttt

SEQ ID NO: 1404492 - DNA, 23 bp, Homo sapiens
aattatgagattggttttcctgt

SEQ ID NO: 1404493 - DNA, 15 bp, Homo sapiens
aattctgattgattt

SEQ ID NO: 1404494 - DNA, 16 bp, Homo sapiens
aattgcatactttgta

SEQ ID NO: 1404495 - DNA, 22 bp, Homo sapiens
aattgcatactttgtattttga

SEQ ID NO: 1404496 - DNA, 13 bp, Homo sapiens
aattgtacaaaat

SEQ ID NO: 1404497 - DNA, 18 bp, Homo sapiens
aattgtacaaaattaagc

SEQ ID NO: 1404498 - DNA, 12 bp, Homo sapiens
aatttaaatgaa

SEQ ID NO: 1404499 - DNA, 18 bp, Homo sapiens
aatttaaatgaaagaaaa

SEQ ID NO: 1404500 - DNA, 13 bp, Homo sapiens
aatttacttgttt

SEQ ID NO: 1404501 - DNA, 15 bp, Homo sapiens
aatttacttgttttg

SEQ ID NO: 1404502 - DNA, 16 bp, Homo sapiens
aattttaaagtgcaaa

SEQ ID NO: 1404503 - DNA, 20 bp, Homo sapiens
aattttgtatgttaaagaga

SEQ ID NO: 1404504 - DNA, 22 bp, Homo sapiens
acaaactgcttcccttactttg

SEQ ID NO: 1404505 - DNA, 12 bp, Homo sapiens
acaaattgcatt

SEQ ID NO: 1404506 - DNA, 17 bp, Homo sapiens
acaagacttcagattcc

SEQ ID NO: 1404507 - DNA, 16 bp, Homo sapiens
acaaggagataagaaa

SEQ ID NO: 1404508 - DNA, 18 bp, Homo sapiens
acaaggagataagaaagc

SEQ ID NO: 1404509 - DNA, 22 bp, Homo sapiens
acaataggagtggtgatttgaa

SEQ ID NO: 1404510 - DNA, 18 bp, Homo sapiens
acaatattgattgggaaa

SEQ ID NO: 1404511 - DNA, 19 bp, Homo sapiens
acaatctctttttgtttgc

SEQ ID NO: 1404512 - DNA, 17 bp, Homo sapiens
acacatttgctactgtt

SEQ ID NO: 1404513 - DNA, 18 bp, Homo sapiens
acagaagcacatgcacct

SEQ ID NO: 1404514 - DNA, 16 bp, Homo sapiens
acagagctagaggcca

SEQ ID NO: 1404515 - DNA, 14 bp, Homo sapiens
acagcatttgccaa

SEQ ID NO: 1404516 - DNA, 15 bp, Homo sapiens
acagtcatcatttat

SEQ ID NO: 1404517 - DNA, 23 bp, Homo sapiens
acagtgaagttttactgtctatt

SEQ ID NO: 1404518 - DNA, 17 bp, Homo sapiens
acataagcttccatttt

SEQ ID NO: 1404519 - DNA, 16 bp, Homo sapiens
acataatttttatttt

SEQ ID NO: 1404520 - DNA, 18 bp, Homo sapiens
acatcaaataagaaataa

SEQ ID NO: 1404521 - DNA, 12 bp, Homo sapiens
acatcatttgta

SEQ ID NO: 1404522 - DNA, 18 bp, Homo sapiens
acatctgacctggcatct

SEQ ID NO: 1404523 - DNA, 19 bp, Homo sapiens
acatgcaataaaatttaaa

SEQ ID NO: 1404524 - DNA, 23 bp, Homo sapiens
acatttttttgcatgcatgcaaa

SEQ ID NO: 1404525 - DNA, 13 bp, Homo sapiens
accacacttgaaa

SEQ ID NO: 1404526 - DNA, 16 bp, Homo sapiens
accatgtgagctcttc

SEQ ID NO: 1404527 - DNA, 16 bp, Homo sapiens
acccaaccacagagga

SEQ ID NO: 1404528 - DNA, 14 bp, Homo sapiens
acccatacaccccc

SEQ ID NO: 1404529 - DNA, 22 bp, Homo sapiens
acccattaaggggaagaatgaa

SEQ ID NO: 1404530 - DNA, 23 bp, Homo sapiens
accccagcattctcaggcaccag

SEQ ID NO: 1404531 - DNA, 21 bp, Homo sapiens
acccccgacgtgctcccctgc

SEQ ID NO: 1404532 - DNA, 14 bp, Homo sapiens
accctcacactgct

SEQ ID NO: 1404533 - DNA, 18 bp, Homo sapiens
acccttctggaaactgtg

SEQ ID NO: 1404534 - DNA, 21 bp, Homo sapiens
acctacaaggagataagaaag

SEQ ID NO: 1404535 - DNA, 21 bp, Homo sapiens
acctggcatctaattctgatt

SEQ ID NO: 1404536 - DNA, 11 bp, Homo sapiens
acctggcctca

SEQ ID NO: 1404537 - DNA, 13 bp, Homo sapiens
acctttctctctc

SEQ ID NO: 1404538 - DNA, 14 bp, Homo sapiens
acgattttggaaat

SEQ ID NO: 1404539 - DNA, 16 bp, Homo sapiens
acgtttataaacagaa

SEQ ID NO: 1404540 - DNA, 18 bp, Homo sapiens
actaactcaaatacacat

SEQ ID NO: 1404541 - DNA, 23 bp, Homo sapiens
actaagtaatctcacagcatttg

SEQ ID NO: 1404542 - DNA, 15 bp, Homo sapiens
actacagagaaggct

SEQ ID NO: 1404543 - DNA, 19 bp, Homo sapiens
actagagcacaacataatt

SEQ ID NO: 1404544 - DNA, 20 bp, Homo sapiens
actatatatataaatgtata

SEQ ID NO: 1404545 - DNA, 22 bp, Homo sapiens
actatatatataaatgtataaa

SEQ ID NO: 1404546 - DNA, 19 bp, Homo sapiens
actcaaatacacatttgct

SEQ ID NO: 1404547 - DNA, 22 bp, Homo sapiens
actcaagtctattgaataatgt

SEQ ID NO: 1404548 - DNA, 20 bp, Homo sapiens
actcagccttgcaaatagcc

SEQ ID NO: 1404549 - DNA, 14 bp, Homo sapiens
actcatgaggaggg

SEQ ID NO: 1404550 - DNA, 14 bp, Homo sapiens
actctctaccagat

SEQ ID NO: 1404551 - DNA, 12 bp, Homo sapiens
actgagggcaga

SEQ ID NO: 1404552 - DNA, 13 bp, Homo sapiens
actgcagagggct

SEQ ID NO: 1404553 - DNA, 22 bp, Homo sapiens
actgctccagtttcacctcttt

SEQ ID NO: 1404554 - DNA, 19 bp, Homo sapiens
actggcttaacttagtata

SEQ ID NO: 1404555 - DNA, 20 bp, Homo sapiens
actgtagatatgtattcttt

SEQ ID NO: 1404556 - DNA, 14 bp, Homo sapiens
actgtatcattttc

SEQ ID NO: 1404557 - DNA, 17 bp, Homo sapiens
actgttcctgagccttc

SEQ ID NO: 1404558 - DNA, 18 bp, Homo sapiens
actgttcctgagccttca

SEQ ID NO: 1404559 - DNA, 14 bp, Homo sapiens
actgttgtaagaat

SEQ ID NO: 1404560 - DNA, 15 bp, Homo sapiens
acttattgaccattt

SEQ ID NO: 1404561 - DNA, 17 bp, Homo sapiens
actttgtaaaaatcttt

SEQ ID NO: 1404562 - DNA, 16 bp, Homo sapiens
agaaaaagatctttca

SEQ ID NO: 1404563 - DNA, 22 bp, Homo sapiens
agaaagtgggcttaatggagtt

SEQ ID NO: 1404564 - DNA, 17 bp, Homo sapiens
agaaatataacacattt

SEQ ID NO: 1404565 - DNA, 16 bp, Homo sapiens
agaaatggaaagcaga

SEQ ID NO: 1404566 - DNA, 19 bp, Homo sapiens
agaaccacacttgaaacct

SEQ ID NO: 1404567 - DNA, 21 bp, Homo sapiens
agaagaggtggccccatatta

SEQ ID NO: 1404568 - DNA, 22 bp, Homo sapiens
agaagccaatctacaatctctt

SEQ ID NO: 1404569 - DNA, 14 bp, Homo sapiens
agaagcttaaaata

SEQ ID NO: 1404570 - DNA, 16 bp, Homo sapiens
agaagcttaaaataaa

SEQ ID NO: 1404571 - DNA, 16 bp, Homo sapiens
agaataccacatcaaa

SEQ ID NO: 1404572 - DNA, 21 bp, Homo sapiens
agaatgaaagctgttccttgg

SEQ ID NO: 1404573 - DNA, 20 bp, Homo sapiens
agaatgagtccttgatttca

SEQ ID NO: 1404574 - DNA, 21 bp, Homo sapiens
agaatgagtccttgatttcaa

SEQ ID NO: 1404575 - DNA, 22 bp, Homo sapiens
agaatgagtccttgatttcaaa

SEQ ID NO: 1404576 - DNA, 15 bp, Homo sapiens
agaattctgattgat

SEQ ID NO: 1404577 - DNA, 23 bp, Homo sapiens
agaattctgattgatttgattgg

SEQ ID NO: 1404578 - DNA, 17 bp, Homo sapiens
agacaggactgcagagg

SEQ ID NO: 1404579 - DNA, 18 bp, Homo sapiens
agacagttaaactggctt

SEQ ID NO: 1404580 - DNA, 13 bp, Homo sapiens
agacctcagcttg

SEQ ID NO: 1404581 - DNA, 13 bp, Homo sapiens
agacgtttataaa

SEQ ID NO: 1404582 - DNA, 17 bp, Homo sapiens
agactgtagatatgtat

SEQ ID NO: 1404583 - DNA, 20 bp, Homo sapiens
agactgtgattcttagcaaa

SEQ ID NO: 1404584 - DNA, 20 bp, Homo sapiens
agagaggttaacagatttat

SEQ ID NO: 1404585 - DNA, 12 bp, Homo sapiens
agagatttctca

SEQ ID NO: 1404586 - DNA, 14 bp, Homo sapiens
agagctagaggcca

SEQ ID NO: 1404587 - DNA, 20 bp, Homo sapiens
agaggatgctgacatcattt

SEQ ID NO: 1404588 - DNA, 16 bp, Homo sapiens
agaggtattaaaacta

SEQ ID NO: 1404589 - DNA, 17 bp, Homo sapiens
agaggtattaaaactaa

SEQ ID NO: 1404590 - DNA, 22 bp, Homo sapiens
agagtgctaagcattagcttta

SEQ ID NO: 1404591 - DNA, 20 bp, Homo sapiens
agagttcccttgaaactttg

SEQ ID NO: 1404592 - DNA, 19 bp, Homo sapiens
agagttgggtgtctcctta

SEQ ID NO: 1404593 - DNA, 15 bp, Homo sapiens
ttgtttaaaatgtaa

SEQ ID NO: 1404594 - DNA, 12 bp, Homo sapiens
tttaaaaaataa

SEQ ID NO: 1404595 - DNA, 17 bp, Homo sapiens
tttaaaatgaaatgcat

SEQ ID NO: 1404596 - DNA, 21 bp, Homo sapiens
tttaaaatgtaatttaaatga

SEQ ID NO: 1404597 - DNA, 22 bp, Homo sapiens
tttaaaatgtaatttaaatgaa

SEQ ID NO: 1404598 - DNA, 10 bp, Homo sapiens
tttaaaattt

SEQ ID NO: 1404599 - DNA, 14 bp, Homo sapiens
tttaaccctttctg

SEQ ID NO: 1404600 - DNA, 12 bp, Homo sapiens
tttaatccagtt

SEQ ID NO: 1404601 - DNA, 23 bp, Homo sapiens
tttaatctctccaccttccaaag

SEQ ID NO: 1404602 - DNA, 17 bp, Homo sapiens
tttactaagtaatctca

SEQ ID NO: 1404603 - DNA, 23 bp, Homo sapiens
tttactgtctattaatattcagg

SEQ ID NO: 1404604 - DNA, 15 bp, Homo sapiens
tttataaacagaaat

SEQ ID NO: 1404605 - DNA, 23 bp, Homo sapiens
tttataaacagaaatggaaagca

SEQ ID NO: 1404606 - DNA, 14 bp, Homo sapiens
tttatcgtttttgt

SEQ ID NO: 1404607 - DNA, 17 bp, Homo sapiens
tttatctaaggtcccca

SEQ ID NO: 1404608 - DNA, 24 bp, Homo sapiens
tttatctaaggtccccagcagaat

SEQ ID NO: 1404609 - DNA, 12 bp, Homo sapiens
tttcaaagtttt

SEQ ID NO: 1404610 - DNA, 17 bp, Homo sapiens
tttcacccatctctcag

SEQ ID NO: 1404611 - DNA, 20 bp, Homo sapiens
tttcacccatctctcaggaa

SEQ ID NO: 1404612 - DNA, 20 bp, Homo sapiens
tttcagaaatataacacatt

SEQ ID NO: 1404613 - DNA, 22 bp, Homo sapiens
tttcagttctttggattctaaa

SEQ ID NO: 1404614 - DNA, 19 bp, Homo sapiens
tttcatgaaaataccattt

SEQ ID NO: 1404615 - DNA, 20 bp, Homo sapiens
tttcatggctgctgttgctt

SEQ ID NO: 1404616 - DNA, 16 bp, Homo sapiens
tttcattaaatccttt

SEQ ID NO: 1404617 - DNA, 21 bp, Homo sapiens
tttccagaaccacacttgaaa

SEQ ID NO: 1404618 - DNA, 21 bp, Homo sapiens
tttcccaggactagagcacaa

SEQ ID NO: 1404619 - DNA, 17 bp, Homo sapiens
tttctcagtgttggtat

SEQ ID NO: 1404620 - DNA, 14 bp, Homo sapiens
tttcttttgtaata

SEQ ID NO: 1404621 - DNA, 13 bp, Homo sapiens
tttgcatgcatgc

SEQ ID NO: 1404622 - DNA, 18 bp, Homo sapiens
tttggattctaaatacat

SEQ ID NO: 1404623 - DNA, 19 bp, Homo sapiens
tttggattctaaatacatg

SEQ ID NO: 1404624 - DNA, 23 bp, Homo sapiens
tttgggtggggggcattgagtat

SEQ ID NO: 1404625 - DNA, 15 bp, Homo sapiens
tttgtattttcatga

SEQ ID NO: 1404626 - DNA, 19 bp, Homo sapiens
atgagctctgaaatcttcc

SEQ ID NO: 1404627 - DNA, 14 bp, Homo sapiens
atgatggttcacgt

SEQ ID NO: 1404628 - DNA, 21 bp, Homo sapiens
cagccaagcaaatgcctgcca

SEQ ID NO: 1404629 - DNA, 14 bp, Homo sapiens
cagccgccttccct

SEQ ID NO: 1404630 - DNA, 17 bp, Homo sapiens
tattaatgttttcaaaa

SEQ ID NO: 1404631 - DNA, 12 bp, Homo sapiens
tattaattacaa

SEQ ID NO: 1404632 - DNA, 16 bp, Homo sapiens
tattactgacatttct

SEQ ID NO: 1404633 - DNA, 14 bp, Homo sapiens
tattatacatgtga

SEQ ID NO: 1404634 - DNA, 21 bp, Homo sapiens
tattatacatgtgatacattt

SEQ ID NO: 1404635 - DNA, 15 bp, Homo sapiens
tattcagggtaaata

SEQ ID NO: 1404636 - DNA, 16 bp, Homo sapiens
tattcagggtaaatag

SEQ ID NO: 1404637 - DNA, 22 bp, Homo sapiens
tattccagatctttcagaaata

SEQ ID NO: 1404638 - DNA, 14 bp, Homo sapiens
tattcggcaaggaa

SEQ ID NO: 1404639 - DNA, 14 bp, Homo sapiens
tattgaatgttaaa

SEQ ID NO: 1404640 - DNA, 14 bp, Homo sapiens
tattgattgggaaa

SEQ ID NO: 1404641 - DNA, 19 bp, Homo sapiens
tattgattgggaaaacatt

SEQ ID NO: 1404642 - DNA, 22 bp, Homo sapiens
tattgattgggaaaacatttgc

SEQ ID NO: 1404643 - DNA, 18 bp, Homo sapiens
tatttgcaaggctgattt

SEQ ID NO: 1404644 - DNA, 20 bp, Homo sapiens
tatttttataattgtacaaa

SEQ ID NO: 1404645 - DNA, 16 bp, Homo sapiens
tatttttttaaaattt

SEQ ID NO: 1404646 - DNA, 21 bp, Homo sapiens
tattttttttttcttcttggg

SEQ ID NO: 1404647 - DNA, 16 bp, Homo sapiens
tcaatgaaccataaat

SEQ ID NO: 1404648 - DNA, 20 bp, Homo sapiens
tcacgttggggtgatttaat

SEQ ID NO: 1404649 - DNA, 13 bp, Homo sapiens
tcagaaatataac

SEQ ID NO: 1404650 - DNA, 20 bp, Homo sapiens
tcagaaatataacacatttt

SEQ ID NO: 1404651 - DNA, 14 bp, Homo sapiens
tcagattccccact

SEQ ID NO: 1404652 - DNA, 20 bp, Homo sapiens
tcagattccccactcagcct

SEQ ID NO: 1404653 - DNA, 13 bp, Homo sapiens
tcagccttgcaaa

SEQ ID NO: 1404654 - DNA, 18 bp, Homo sapiens
tcaggcaccagtccctgt

SEQ ID NO: 1404655 - DNA, 16 bp, Homo sapiens
aaaagatctttcattt

SEQ ID NO: 1404656 - DNA, 14 bp, Homo sapiens
aaaaggtattatac

SEQ ID NO: 1404657 - DNA, 20 bp, Homo sapiens
aaaagtgtgtatatattttg

SEQ ID NO: 1404658 - DNA, 16 bp, Homo sapiens
aaaagtttttgtttgg

SEQ ID NO: 1404659 - DNA, 13 bp, Homo sapiens
aaaataacagtat

SEQ ID NO: 1404660 - DNA, 16 bp, Homo sapiens
aaaatgaaatgcattt

SEQ ID NO: 1404661 - DNA, 19 bp, Homo sapiens
aaaatgtaatttaaatgaa

SEQ ID NO: 1404662 - DNA, 20 bp, Homo sapiens
aaaattaagcaaatgttaaa

SEQ ID NO: 1404663 - DNA, 22 bp, Homo sapiens
aaaattttgtatgttaaagaga

SEQ ID NO: 1404664 - DNA, 14 bp, Homo sapiens
aaacgtcctcttta

SEQ ID NO: 1404665 - DNA, 13 bp, Homo sapiens
aaactaaatttca

SEQ ID NO: 1404666 - DNA, 14 bp, Homo sapiens
aaagaaaagagaaa

SEQ ID NO: 1404667 - DNA, 12 bp, Homo sapiens
aaagagaatgag

SEQ ID NO: 1404668 - DNA, 14 bp, Homo sapiens
aaagagaatgagtc

SEQ ID NO: 1404669 - DNA, 20 bp, Homo sapiens
aaagagaatgagtccttgat

SEQ ID NO: 1404670 - DNA, 21 bp, Homo sapiens
aaagtgaagaatttatctctt

SEQ ID NO: 1404671 - DNA, 16 bp, Homo sapiens
aaagtgtgtatatatt

SEQ ID NO: 1404672 - DNA, 20 bp, Homo sapiens
aaagtgtgtatatattttgt

SEQ ID NO: 1404673 - DNA, 21 bp, Homo sapiens
aaagtgtgtatatattttgtg

SEQ ID NO: 1404674 - DNA, 12 bp, Homo sapiens
aaagttttgttg

SEQ ID NO: 1404675 - DNA, 14 bp, Homo sapiens
aaagttttgttgta

SEQ ID NO: 1404676 - DNA, 23 bp, Homo sapiens
aaagttttgttgtacttaaatgg

SEQ ID NO: 1404677 - DNA, 14 bp, Homo sapiens
aaagtttttgtttg

SEQ ID NO: 1404678 - DNA, 14 bp, Homo sapiens
aaataagaaataat

SEQ ID NO: 1404679 - DNA, 16 bp, Homo sapiens
aaataagaaataatgc

SEQ ID NO: 1404680 - DNA, 19 bp, Homo sapiens
aaataatgctacaatttta

SEQ ID NO: 1404681 - DNA, 13 bp, Homo sapiens
aaatacacatttg

SEQ ID NO: 1404682 - DNA, 14 bp, Homo sapiens
aaatacacatttgc

SEQ ID NO: 1404683 - DNA, 19 bp, Homo sapiens
aaatacatgccacatcaaa

SEQ ID NO: 1404684 - DNA, 15 bp, Homo sapiens
aaatgaaagaaaatt

SEQ ID NO: 1404685 - DNA, 20 bp, Homo sapiens
aaatgaaagaaaattgagtt

SEQ ID NO: 1404686 - DNA, 15 bp, Homo sapiens
aaatgagctctgaaa

SEQ ID NO: 1404687 - DNA, 18 bp, Homo sapiens
aaatgtaatttaaatgaa

SEQ ID NO: 1404688 - DNA, 19 bp, Homo sapiens
aaatgtaatttaaatgaaa

SEQ ID NO: 1404689 - DNA, 15 bp, Homo sapiens
aaatgtataaatata

SEQ ID NO: 1404690 - DNA, 15 bp, Homo sapiens
aaatgtttcttttaa

SEQ ID NO: 1404691 - DNA, 13 bp, Homo sapiens
aaattaagcaaat

SEQ ID NO: 1404692 - DNA, 16 bp, Homo sapiens
aaattcaactttgtaa

SEQ ID NO: 1404693 - DNA, 11 bp, Homo sapiens
aaattcctgta

SEQ ID NO: 1404694 - DNA, 14 bp, Homo sapiens
aaattgcatacttt

SEQ ID NO: 1404695 - DNA, 15 bp, Homo sapiens
aaattgcatactttg

SEQ ID NO: 1404696 - DNA, 12 bp, Homo sapiens
aaattgcatttg

SEQ ID NO: 1404697 - DNA, 14 bp, Homo sapiens
aaattgcatttgtg

SEQ ID NO: 1404698 - DNA, 21 bp, Homo sapiens
aaatttaataccagatacctt

SEQ ID NO: 1404699 - DNA, 18 bp, Homo sapiens
aaatttcactactagatt

SEQ ID NO: 1404700 - DNA, 18 bp, Homo sapiens
aacaaaacatttgctctg

SEQ ID NO: 1404701 - DNA, 14 bp, Homo sapiens
aacaagttgaagaa

SEQ ID NO: 1404702 - DNA, 21 bp, Homo sapiens
aacacagatgtgttgcaaagg

SEQ ID NO: 1404703 - DNA, 14 bp, Homo sapiens
aacagaaatggaaa

SEQ ID NO: 1404704 - DNA, 14 bp, Homo sapiens
aacagtcatcattt

SEQ ID NO: 1404705 - DNA, 23 bp, Homo sapiens
aattttaaaatgaaatgcatttt

SEQ ID NO: 1404706 - DNA, 13 bp, Homo sapiens
aattttaaagtgc

SEQ ID NO: 1404707 - DNA, 22 bp, Homo sapiens
aatttttatttttggcaaagcc

SEQ ID NO: 1404708 - DNA, 14 bp, Homo sapiens
acaaattgcatttg

SEQ ID NO: 1404709 - DNA, 19 bp, Homo sapiens
acaagcatgcagctttgca

SEQ ID NO: 1404710 - DNA, 15 bp, Homo sapiens
acaagttgaagaagc

SEQ ID NO: 1404711 - DNA, 16 bp, Homo sapiens
acaagttgaagaagct

SEQ ID NO: 1404712 - DNA, 23 bp, Homo sapiens
acaataggagtggtgatttgaaa

SEQ ID NO: 1404713 - DNA, 13 bp, Homo sapiens
acacttgaaacct

SEQ ID NO: 1404714 - DNA, 14 bp, Homo sapiens
acacttgaaacctt

SEQ ID NO: 1404715 - DNA, 17 bp, Homo sapiens
acagaaatggaaagcag

SEQ ID NO: 1404716 - DNA, 14 bp, Homo sapiens
acagaagcacatgc

SEQ ID NO: 1404717 - DNA, 22 bp, Homo sapiens
acagaggatgctgacatcattt

SEQ ID NO: 1404718 - DNA, 23 bp, Homo sapiens
acagaggatgctgacatcatttg

SEQ ID NO: 1404719 - DNA, 22 bp, Homo sapiens
acagaggtattaaaactaaatt

SEQ ID NO: 1404720 - DNA, 21 bp, Homo sapiens
acagattctttcagttctttg

SEQ ID NO: 1404721 - DNA, 15 bp, Homo sapiens
acagtaagatatctc

SEQ ID NO: 1404722 - DNA, 23 bp, Homo sapiens
acagtatgtgggatattgaatgt

SEQ ID NO: 1404723 - DNA, 16 bp, Homo sapiens
acagtgaagttttact

SEQ ID NO: 1404724 - DNA, 13 bp, Homo sapiens
acatcaaaccttt

SEQ ID NO: 1404725 - DNA, 13 bp, Homo sapiens
acatcaaataaga

SEQ ID NO: 1404726 - DNA, 23 bp, Homo sapiens
acatcatttgtattatgttccaa

SEQ ID NO: 1404727 - DNA, 24 bp, Homo sapiens
acatcttccatttccatgtcccct

SEQ ID NO: 1404728 - DNA, 15 bp, Homo sapiens
acatgcaataaaatt

SEQ ID NO: 1404729 - DNA, 19 bp, Homo sapiens
acatgccacatcaaacctt

SEQ ID NO: 1404730 - DNA, 17 bp, Homo sapiens
acatgtgatacattttt

SEQ ID NO: 1404731 - DNA, 20 bp, Homo sapiens
acatgttaatgacaatattc

SEQ ID NO: 1404732 - DNA, 17 bp, Homo sapiens
acatttgctactgttgt

SEQ ID NO: 1404733 - DNA, 15 bp, Homo sapiens
acatttgctgccatt

SEQ ID NO: 1404734 - DNA, 17 bp, Homo sapiens
acattttttaagcttca

SEQ ID NO: 1404735 - DNA, 18 bp, Homo sapiens
acatttttttgcatgcat

SEQ ID NO: 1404736 - DNA, 17 bp, Homo sapiens
accacacttgaaacctt

SEQ ID NO: 1404737 - DNA, 17 bp, Homo sapiens
accacatcaaataagaa

SEQ ID NO: 1404738 - DNA, 17 bp, Homo sapiens
accacctacaaggagat

SEQ ID NO: 1404739 - DNA, 19 bp, Homo sapiens
accagataactgaggaggg

SEQ ID NO: 1404740 - DNA, 22 bp, Homo sapiens
accagatatatagaaggactgc

SEQ ID NO: 1404741 - DNA, 22 bp, Homo sapiens
accaggcaagaaaagcgcagag

SEQ ID NO: 1404742 - DNA, 17 bp, Homo sapiens
accattttttaatttac

SEQ ID NO: 1404743 - DNA, 13 bp, Homo sapiens
acccagggaacag

SEQ ID NO: 1404744 - DNA, 20 bp, Homo sapiens
accccctcttctgagcacag

SEQ ID NO: 1404745 - DNA, 21 bp, Homo sapiens
accccctcttctgagcacaga

SEQ ID NO: 1404746 - DNA, 22 bp, Homo sapiens
accccctcttctgagcacagat

SEQ ID NO: 1404747 - DNA, 17 bp, Homo sapiens
acccccttaaatttaat

SEQ ID NO: 1404748 - DNA, 14 bp, Homo sapiens
accttccaaagagt

SEQ ID NO: 1404749 - DNA, 24 bp, Homo sapiens
acctttttttatcgtttttgtatt

SEQ ID NO: 1404750 - DNA, 19 bp, Homo sapiens
acgtttataaacagaaatg

SEQ ID NO: 1404751 - DNA, 20 bp, Homo sapiens
actaagtaatctcacagcat

SEQ ID NO: 1404752 - DNA, 14 bp, Homo sapiens
actactagattgac

SEQ ID NO: 1404753 - DNA, 15 bp, Homo sapiens
actagagcacaacat

SEQ ID NO: 1404754 - DNA, 13 bp, Homo sapiens
actagattgacta

SEQ ID NO: 1404755 - DNA, 21 bp, Homo sapiens
actagccagccaggaagatga

SEQ ID NO: 1404756 - DNA, 21 bp, Homo sapiens
actctccgaagtctgatccct

SEQ ID NO: 1404757 - DNA, 20 bp, Homo sapiens
actctgcatgtagaggcttg

SEQ ID NO: 1404758 - DNA, 13 bp, Homo sapiens
actctgccccccc

SEQ ID NO: 1404759 - DNA, 15 bp, Homo sapiens
tgactaactcaaata

SEQ ID NO: 1404760 - DNA, 18 bp, Homo sapiens
tgacttttataaagcatg

SEQ ID NO: 1404761 - DNA, 15 bp, Homo sapiens
tgagattggttttcc

SEQ ID NO: 1404762 - DNA, 22 bp, Homo sapiens
tgagattggttttcctgtggca

SEQ ID NO: 1404763 - DNA, 22 bp, Homo sapiens
tgaggaggggcccccctgccct

SEQ ID NO: 1404764 - DNA, 14 bp, Homo sapiens
tgagtgtatgagta

SEQ ID NO: 1404765 - DNA, 18 bp, Homo sapiens
tgatacattttttaagct

SEQ ID NO: 1404766 - DNA, 13 bp, Homo sapiens
tgattatatttca

SEQ ID NO: 1404767 - DNA, 14 bp, Homo sapiens
tgattctggcttta

SEQ ID NO: 1404768 - DNA, 17 bp, Homo sapiens
tgattctggctttaagc

SEQ ID NO: 1404769 - DNA, 21 bp, Homo sapiens
tgattcttagcaaaaaatgaa

SEQ ID NO: 1404770 - DNA, 22 bp, Homo sapiens
tgattcttagcaaaaaatgaac

SEQ ID NO: 1404771 - DNA, 18 bp, Homo sapiens
tgattgggaaaacatttg

SEQ ID NO: 1404772 - DNA, 19 bp, Homo sapiens
tgatttaggtcagtagact

SEQ ID NO: 1404773 - DNA, 13 bp, Homo sapiens
tgcaaatagccag

SEQ ID NO: 1404774 - DNA, 21 bp, Homo sapiens
tgcaaatgagctctgaaatct

SEQ ID NO: 1404775 - DNA, 15 bp, Homo sapiens
tgcaataaaatttaa

SEQ ID NO: 1404776 - DNA, 16 bp, Homo sapiens
tgcaataaaatttaaa

SEQ ID NO: 1404777 - DNA, 17 bp, Homo sapiens
tgcaataaaatttaaaa

SEQ ID NO: 1404778 - DNA, 14 bp, Homo sapiens
tgcacagaagcaca

SEQ ID NO: 1404779 - DNA, 17 bp, Homo sapiens
tgcacaggaagctgaga

SEQ ID NO: 1404780 - DNA, 23 bp, Homo sapiens
tgcacctacccatacaccccctc

SEQ ID NO: 1404781 - DNA, 14 bp, Homo sapiens
tgcacctgcagcca

SEQ ID NO: 1404782 - DNA, 17 bp, Homo sapiens
tgcacctgcagccaagc

SEQ ID NO: 1404783 - DNA, 14 bp, Homo sapiens
tgcagctttgcaaa

SEQ ID NO: 1404784 - DNA, 18 bp, Homo sapiens
tgcatgcatgcaaatgag

SEQ ID NO: 1404785 - DNA, 21 bp, Homo sapiens
tgccagccccctaaaagcact

SEQ ID NO: 1404786 - DNA, 22 bp, Homo sapiens
tgccagccccctaaaagcactc

SEQ ID NO: 1404787 - DNA, 23 bp, Homo sapiens
tgccaggacatgcaataaaattt

SEQ ID NO: 1404788 - DNA, 16 bp, Homo sapiens
tgccatctatctagtt

SEQ ID NO: 1404789 - DNA, 14 bp, Homo sapiens
tgcctgccaaattt

SEQ ID NO: 1404790 - DNA, 22 bp, Homo sapiens
tgctcaatacctggcctcattt

SEQ ID NO: 1404791 - DNA, 16 bp, Homo sapiens
tgctcccctgctcggc

SEQ ID NO: 1404792 - DNA, 21 bp, Homo sapiens
tgctccctgagttcactctcc

SEQ ID NO: 1404793 - DNA, 15 bp, Homo sapiens
tgcttcccttacttt

SEQ ID NO: 1404794 - DNA, 22 bp, Homo sapiens
tgcttgtcttctggtactttct

SEQ ID NO: 1404795 - DNA, 20 bp, Homo sapiens
tgctttattaatgttttcaa

SEQ ID NO: 1404796 - DNA, 23 bp, Homo sapiens
tgctttattaatgttttcaaaag

SEQ ID NO: 1404797 - DNA, 15 bp, Homo sapiens
tggaaagtaactgtg

SEQ ID NO: 1404798 - DNA, 12 bp, Homo sapiens
tggactcagcct

SEQ ID NO: 1404799 - DNA, 21 bp, Homo sapiens
tggagatcccacatatttcaa

SEQ ID NO: 1404800 - DNA, 23 bp, Homo sapiens
tggatggcttgtctatactcctt

SEQ ID NO: 1404801 - DNA, 14 bp, Homo sapiens
tggatttcttttgt

SEQ ID NO: 1404802 - DNA, 16 bp, Homo sapiens
tggatttcttttgtaa

SEQ ID NO: 1404803 - DNA, 17 bp, Homo sapiens
tggcactcaggtgctga

SEQ ID NO: 1404804 - DNA, 20 bp, Homo sapiens
tggcctcatttaaaacaaga

SEQ ID NO: 1404805 - DNA, 17 bp, Homo sapiens
tggctacatctccaaat

SEQ ID NO: 1404806 - DNA, 22 bp, Homo sapiens
tgggaataatagcacatgattt

SEQ ID NO: 1404807 - DNA, 22 bp, Homo sapiens
tgggatttccagaaccacactt

SEQ ID NO: 1404808 - DNA, 20 bp, Homo sapiens
tgggccagccgattcctcca

SEQ ID NO: 1404809 - DNA, 21 bp, Homo sapiens
tgggccagccgattcctccag

SEQ ID NO: 1404810 - DNA, 20 bp, Homo sapiens
tggggaaactgagggcagag

SEQ ID NO: 1404811 - DNA, 17 bp, Homo sapiens
tgggtgtctccttaagc

SEQ ID NO: 1404812 - DNA, 13 bp, Homo sapiens
tggttttcctgtg

SEQ ID NO: 1404813 - DNA, 12 bp, Homo sapiens
tgtaaaaatctt

SEQ ID NO: 1404814 - DNA, 16 bp, Homo sapiens
tgtaaaaatcttttga

SEQ ID NO: 1404815 - DNA, 16 bp, Homo sapiens
tgtaatttaaatgaaa

SEQ ID NO: 1404816 - DNA, 16 bp, Homo sapiens
tgtacaaaattaagca

SEQ ID NO: 1404817 - DNA, 24 bp, Homo sapiens
tgtacaaaattaagcaaatgttaa

SEQ ID NO: 1404818 - DNA, 15 bp, Homo sapiens
tgtacttaaatggta

SEQ ID NO: 1404819 - DNA, 14 bp, Homo sapiens
tgtaggtaagactg

SEQ ID NO: 1404820 - DNA, 21 bp, Homo sapiens
tgtagttttgtgatgcatttt

SEQ ID NO: 1404821 - DNA, 19 bp, Homo sapiens
tgtataaatatacagtata

SEQ ID NO: 1404822 - DNA, 15 bp, Homo sapiens
tgtatgttaaagaga

SEQ ID NO: 1404823 - DNA, 19 bp, Homo sapiens
tgtattcttttctcagtgt

SEQ ID NO: 1404824 - DNA, 15 bp, Homo sapiens
tgtatttgagcatat

SEQ ID NO: 1404825 - DNA, 17 bp, Homo sapiens
tgtctccttaagctgca

SEQ ID NO: 1404826 - DNA, 21 bp, Homo sapiens
tgtctccttaagctgcagaga

SEQ ID NO: 1404827 - DNA, 14 bp, Homo sapiens
tgtgatgcatttta

SEQ ID NO: 1404828 - DNA, 12 bp, Homo sapiens
tgtgattcttag

SEQ ID NO: 1404829 - DNA, 15 bp, Homo sapiens
tgttaaaagttttat

SEQ ID NO: 1404830 - DNA, 18 bp, Homo sapiens
tgttgtaagaattctgat

SEQ ID NO: 1404831 - DNA, 15 bp, Homo sapiens
tgtttcttttgtttg

SEQ ID NO: 1404832 - DNA, 21 bp, Homo sapiens
tgtttcttttgtttggtaaat

SEQ ID NO: 1404833 - DNA, 18 bp, Homo sapiens
tgtttgccaggacatgca

SEQ ID NO: 1404834 - DNA, 12 bp, Homo sapiens
tgtttggtaaat

SEQ ID NO: 1404835 - DNA, 17 bp, Homo sapiens
tgttttggatggcttgt

SEQ ID NO: 1404836 - DNA, 16 bp, Homo sapiens
ttaaaactaaatttca

SEQ ID NO: 1404837 - DNA, 17 bp, Homo sapiens
ttaaaatgaaatgcatt

SEQ ID NO: 1404838 - DNA, 20 bp, Homo sapiens
ttaaaatgaaatgcattttg

SEQ ID NO: 1404839 - DNA, 11 bp, Homo sapiens
ttaaaatgtaa

SEQ ID NO: 1404840 - DNA, 21 bp, Homo sapiens
ttaaaatgtaatttaaatgaa

SEQ ID NO: 1404841 - DNA, 19 bp, Homo sapiens
ttaaacgaagagttccctt

SEQ ID NO: 1404842 - DNA, 13 bp, Homo sapiens
ttaaatcctttta

SEQ ID NO: 1404843 - DNA, 16 bp, Homo sapiens
ttaaatgaaagaaaat

SEQ ID NO: 1404844 - DNA, 13 bp, Homo sapiens
ttaacaaattgca

SEQ ID NO: 1404845 - DNA, 17 bp, Homo sapiens
ttaacaaattgcatttg

SEQ ID NO: 1404846 - DNA, 19 bp, Homo sapiens
ttaacaaattgcatttgtg

SEQ ID NO: 1404847 - DNA, 17 bp, Homo sapiens
ttaaggggaagaatgaa

SEQ ID NO: 1404848 - DNA, 20 bp, Homo sapiens
ttaaggggaagaatgaaagc

SEQ ID NO: 1404849 - DNA, 19 bp, Homo sapiens
ttaatccagttataagaag

SEQ ID NO: 1404850 - DNA, 21 bp, Homo sapiens
ttaatccagttataagaagaa

SEQ ID NO: 1404851 - DNA, 18 bp, Homo sapiens
ttaatcttcaaagccttc

SEQ ID NO: 1404852 - DNA, 20 bp, Homo sapiens
ttaatcttcaaagccttctc

SEQ ID NO: 1404853 - DNA, 14 bp, Homo sapiens
ttaatgttttcaaa

SEQ ID NO: 1404854 - DNA, 17 bp, Homo sapiens
ttacaataggagtggtg

SEQ ID NO: 1404855 - DNA, 19 bp, Homo sapiens
ttaccttttttttttcttg

SEQ ID NO: 1404856 - DNA, 23 bp, Homo sapiens
ttactaagtaatctcacagcatt

SEQ ID NO: 1404857 - DNA, 14 bp, Homo sapiens
ttactgacatttct

SEQ ID NO: 1404858 - DNA, 15 bp, Homo sapiens
ttacttgttttggat

SEQ ID NO: 1404859 - DNA, 13 bp, Homo sapiens
ttactttgctgag

SEQ ID NO: 1404860 - DNA, 15 bp, Homo sapiens
ttagcaaaaaatgaa

SEQ ID NO: 1404861 - DNA, 19 bp, Homo sapiens
ttaggggaaggagaagtaa

SEQ ID NO: 1404862 - DNA, 18 bp, Homo sapiens
ttagtttttggttgggaa

SEQ ID NO: 1404863 - DNA, 19 bp, Homo sapiens
ttagtttttggttgggaat

SEQ ID NO: 1404864 - DNA, 18 bp, Homo sapiens
ttataagaagaagttcat

SEQ ID NO: 1404865 - DNA, 19 bp, Homo sapiens
ttatattactgacatttct

SEQ ID NO: 1404866 - DNA, 19 bp, Homo sapiens
ttatatttcacccatctct

SEQ ID NO: 1404867 - DNA, 22 bp, Homo sapiens
ttatcgtttttgtattttcatg

SEQ ID NO: 1404868 - DNA, 17 bp, Homo sapiens
ttattaatgttttcaaa

SEQ ID NO: 1404869 - DNA, 18 bp, Homo sapiens
ttatttttataattgtac

SEQ ID NO: 1404870 - DNA, 18 bp, Homo sapiens
ttatttttggcaaagcca

SEQ ID NO: 1404871 - DNA, 17 bp, Homo sapiens
ttatttttttaaaattt

SEQ ID NO: 1404872 - DNA, 22 bp, Homo sapiens
ttcaaaaacatgcttttccaaa

SEQ ID NO: 1404873 - DNA, 17 bp, Homo sapiens
ttcaaagccttctccct

SEQ ID NO: 1404874 - DNA, 18 bp, Homo sapiens
ttcaacaacaaaacattt

SEQ ID NO: 1404875 - DNA, 17 bp, Homo sapiens
ttcacctctttgctccc

SEQ ID NO: 1404876 - DNA, 15 bp, Homo sapiens
ttcagaaatataaca

SEQ ID NO: 1404877 - DNA, 21 bp, Homo sapiens
ttcagaaatataacacatttt

SEQ ID NO: 1404878 - DNA, 21 bp, Homo sapiens
ttcagattccccactcagcct

SEQ ID NO: 1404879 - DNA, 23 bp, Homo sapiens
ttcagggtaaataggaatcattc

SEQ ID NO: 1404880 - DNA, 14 bp, Homo sapiens
ttcagttctttgga

SEQ ID NO: 1404881 - DNA, 20 bp, Homo sapiens
ttcagttctttggattctaa

SEQ ID NO: 1404882 - DNA, 18 bp, Homo sapiens
ttcagttgcttgtcttct

SEQ ID NO: 1404883 - DNA, 17 bp, Homo sapiens
ttcatgaaaataccatt

SEQ ID NO: 1404884 - DNA, 18 bp, Homo sapiens
ttccaaacccaggctatt

SEQ ID NO: 1404885 - DNA, 16 bp, Homo sapiens
ttccagatctttcaga

SEQ ID NO: 1404886 - DNA, 13 bp, Homo sapiens
ttccattgcttat

SEQ ID NO: 1404887 - DNA, 19 bp, Homo sapiens
ttccattggaaaatttaag

SEQ ID NO: 1404888 - DNA, 13 bp, Homo sapiens
ttccattttaatt

SEQ ID NO: 1404889 - DNA, 14 bp, Homo sapiens
ttcccttgaaactt

SEQ ID NO: 1404890 - DNA, 22 bp, Homo sapiens
ttcccttgaaactttgggaaaa

SEQ ID NO: 1404891 - DNA, 23 bp, Homo sapiens
ttccctttaaccctcacactgct

SEQ ID NO: 1404892 - DNA, 17 bp, Homo sapiens
ccagccgattcctccag

SEQ ID NO: 1404893 - DNA, 22 bp, Homo sapiens
ccagccgattcctccagccctg

SEQ ID NO: 1404894 - DNA, 23 bp, Homo sapiens
ccaggacatgcaataaaatttaa

SEQ ID NO: 1404895 - DNA, 14 bp, Homo sapiens
ccaggactctgacc

SEQ ID NO: 1404896 - DNA, 22 bp, Homo sapiens
ccaggactctgaccccagcatt

SEQ ID NO: 1404897 - DNA, 17 bp, Homo sapiens
ccaggatttgcacagaa

SEQ ID NO: 1404898 - DNA, 20 bp, Homo sapiens
ccaggcaagaaaagcgcaga

SEQ ID NO: 1404899 - DNA, 22 bp, Homo sapiens
ccaggcaagaaaagcgcagaga

SEQ ID NO: 1404900 - DNA, 23 bp, Homo sapiens
ccaggcaagaaaagcgcagagaa

SEQ ID NO: 1404901 - DNA, 14 bp, Homo sapiens
ccagtcccctttct

SEQ ID NO: 1404902 - DNA, 14 bp, Homo sapiens
ccagtttcacctct

SEQ ID NO: 1404903 - DNA, 14 bp, Homo sapiens
ccatattaacaaat

SEQ ID NO: 1404904 - DNA, 18 bp, Homo sapiens
ccatctcgctccctccca

SEQ ID NO: 1404905 - DNA, 18 bp, Homo sapiens
ccatcttcgggaccagga

SEQ ID NO: 1404906 - DNA, 20 bp, Homo sapiens
ccatcttcgggaccaggatt

SEQ ID NO: 1404907 - DNA, 15 bp, Homo sapiens
ccatgtctcctgcat

SEQ ID NO: 1404908 - DNA, 18 bp, Homo sapiens
ccattgcttattatgtag

SEQ ID NO: 1404909 - DNA, 22 bp, Homo sapiens
ccatttccatgtcccctcccag

SEQ ID NO: 1404910 - DNA, 15 bp, Homo sapiens
ccatttccattgctt

SEQ ID NO: 1404911 - DNA, 19 bp, Homo sapiens
cccagagctggtggaccca

SEQ ID NO: 1404912 - DNA, 15 bp, Homo sapiens
cccagcattctcagg

SEQ ID NO: 1404913 - DNA, 19 bp, Homo sapiens
cccaggactctgaccccag

SEQ ID NO: 1404914 - DNA, 17 bp, Homo sapiens
cccaggtcgcccacctg

SEQ ID NO: 1404915 - DNA, 20 bp, Homo sapiens
cccatctcgctccctcccag

SEQ ID NO: 1404916 - DNA, 21 bp, Homo sapiens
cccatctcgctccctcccagg

SEQ ID NO: 1404917 - DNA, 23 bp, Homo sapiens
cccatctcgctccctcccaggac

SEQ ID NO: 1404918 - DNA, 15 bp, Homo sapiens
cccatcttcgggacc

SEQ ID NO: 1404919 - DNA, 17 bp, Homo sapiens
cccatcttcgggaccag

SEQ ID NO: 1404920 - DNA, 16 bp, Homo sapiens
cccccttaaatttaat

SEQ ID NO: 1404921 - DNA, 21 bp, Homo sapiens
cccctaaaagcactcctgctt

SEQ ID NO: 1404922 - DNA, 14 bp, Homo sapiens
cccctcttctgagc

SEQ ID NO: 1404923 - DNA, 15 bp, Homo sapiens
cccctgccctgtggg

SEQ ID NO: 1404924 - DNA, 19 bp, Homo sapiens
ccccttcctcttgtctgat

SEQ ID NO: 1404925 - DNA, 17 bp, Homo sapiens
cccgacgtgctcccctg

SEQ ID NO: 1404926 - DNA, 19 bp, Homo sapiens
cccgacgtgctcccctgct

SEQ ID NO: 1404927 - DNA, 20 bp, Homo sapiens
ccctaaaagcactcctgctt

SEQ ID NO: 1404928 - DNA, 16 bp, Homo sapiens
ccctccatgtgagaat

SEQ ID NO: 1404929 - DNA, 20 bp, Homo sapiens
ccctcccaggactctgaccc

SEQ ID NO: 1404930 - DNA, 20 bp, Homo sapiens
cccttcctcttgtctgattt

SEQ ID NO: 1404931 - DNA, 21 bp, Homo sapiens
cctaacatctgacctggcatc

SEQ ID NO: 1404932 - DNA, 20 bp, Homo sapiens
cctagctcctccccttcctc

SEQ ID NO: 1404933 - DNA, 14 bp, Homo sapiens
cctagcttcttcca

SEQ ID NO: 1404934 - DNA, 15 bp, Homo sapiens
cctagcttcttccat

SEQ ID NO: 1404935 - DNA, 13 bp, Homo sapiens
cctccagccctgg

SEQ ID NO: 1404936 - DNA, 21 bp, Homo sapiens
cctccatgtgagaatattttt

SEQ ID NO: 1404937 - DNA, 23 bp, Homo sapiens
cctcccagagctggtggacccag

SEQ ID NO: 1404938 - DNA, 19 bp, Homo sapiens
cctcctattctataaaact

SEQ ID NO: 1404939 - DNA, 16 bp, Homo sapiens
cctgacaccaggcaag

SEQ ID NO: 1404940 - DNA, 12 bp, Homo sapiens
cctgccaaattt

SEQ ID NO: 1404941 - DNA, 23 bp, Homo sapiens
cctgcttaatcttcaaagccttc

SEQ ID NO: 1404942 - DNA, 18 bp, Homo sapiens
cctgtggcataaattgca

SEQ ID NO: 1404943 - DNA, 19 bp, Homo sapiens
gacccagggaacagccact

SEQ ID NO: 1404944 - DNA, 20 bp, Homo sapiens
gacccagggaacagccactc

SEQ ID NO: 1404945 - DNA, 15 bp, Homo sapiens
gacgtgctcccctgc

SEQ ID NO: 1404946 - DNA, 19 bp, Homo sapiens
gactatatatataaatgta

SEQ ID NO: 1404947 - DNA, 23 bp, Homo sapiens
gactcagccttgcaaatagccag

SEQ ID NO: 1404948 - DNA, 18 bp, Homo sapiens
gactcatgaggaggggcc

SEQ ID NO: 1404949 - DNA, 20 bp, Homo sapiens
gactgtagatatgtattctt

SEQ ID NO: 1404950 - DNA, 19 bp, Homo sapiens
gactgtgattcttagcaaa

SEQ ID NO: 1404951 - DNA, 17 bp, Homo sapiens
gagcacaacataatttt

SEQ ID NO: 1404952 - DNA, 12 bp, Homo sapiens
gagctcttccta

SEQ ID NO: 1404953 - DNA, 21 bp, Homo sapiens
gagctcttcctatccctctcc

SEQ ID NO: 1404954 - DNA, 16 bp, Homo sapiens
gagctggtggacccag

SEQ ID NO: 1404955 - DNA, 23 bp, Homo sapiens
gagctggtggacccagggaacag

SEQ ID NO: 1404956 - DNA, 21 bp, Homo sapiens
gagcttaatgctacatgtgag

SEQ ID NO: 1404957 - DNA, 21 bp, Homo sapiens
gaggaggggcccccctgccct

SEQ ID NO: 1404958 - DNA, 19 bp, Homo sapiens
gaggcttgtttacctttct

SEQ ID NO: 1404959 - DNA, 23 bp, Homo sapiens
gaggcttgtttacctttctctct

SEQ ID NO: 1404960 - DNA, 13 bp, Homo sapiens
gataagaaagcag

SEQ ID NO: 1404961 - DNA, 14 bp, Homo sapiens
gatagtaagcatag

SEQ ID NO: 1404962 - DNA, 20 bp, Homo sapiens
gatatgtattcttttctcag

SEQ ID NO: 1404963 - DNA, 22 bp, Homo sapiens
gatatgtctagggtgtgattta

SEQ ID NO: 1404964 - DNA, 18 bp, Homo sapiens
gatcacgatgtaaattat

SEQ ID NO: 1404965 - DNA, 20 bp, Homo sapiens
gatgaaccctggcatttggc

SEQ ID NO: 1404966 - DNA, 18 bp, Homo sapiens
gatgcaatactaggaagt

SEQ ID NO: 1404967 - DNA, 10 bp, Homo sapiens
gatgcatttt

SEQ ID NO: 1404968 - DNA, 20 bp, Homo sapiens
gatgcattttatagaatgtg

SEQ ID NO: 1404969 - DNA, 15 bp, Homo sapiens
gatgctgacatcatt

SEQ ID NO: 1404970 - DNA, 13 bp, Homo sapiens
gatggcttgtcta

SEQ ID NO: 1404971 - DNA, 21 bp, Homo sapiens
gatggggaaactgagggcaga

SEQ ID NO: 1404972 - DNA, 16 bp, Homo sapiens
gattccccactcagcc

SEQ ID NO: 1404973 - DNA, 19 bp, Homo sapiens
gattccccactcagccttt

SEQ ID NO: 1404974 - DNA, 16 bp, Homo sapiens
gattctggctttaagc

SEQ ID NO: 1404975 - DNA, 20 bp, Homo sapiens
gattctggctttaagccttc

SEQ ID NO: 1404976 - DNA, 19 bp, Homo sapiens
gatttatctaaggtcccca

SEQ ID NO: 1404977 - DNA, 15 bp, Homo sapiens
gatttgaaaaatata

SEQ ID NO: 1404978 - DNA, 16 bp, Homo sapiens
gatttgaaaaatataa

SEQ ID NO: 1404979 - DNA, 19 bp, Homo sapiens
gatttggcactagccaaag

SEQ ID NO: 1404980 - DNA, 20 bp, Homo sapiens
gatttgggctctagaattcc

SEQ ID NO: 1404981 - DNA, 14 bp, Homo sapiens
gcaaaaatagctct

SEQ ID NO: 1404982 - DNA, 16 bp, Homo sapiens
gcaaagccagaaaaag

SEQ ID NO: 1404983 - DNA, 16 bp, Homo sapiens
gcaaatgagctctgaa

SEQ ID NO: 1404984 - DNA, 17 bp, Homo sapiens
gcaaatgcctgccaaat

SEQ ID NO: 1404985 - DNA, 14 bp, Homo sapiens
gcaataaaatttaa

SEQ ID NO: 1404986 - DNA, 15 bp, Homo sapiens
gcaataaaatttaaa

SEQ ID NO: 1404987 - DNA, 17 bp, Homo sapiens
gcacagaagcacatgca

SEQ ID NO: 1404988 - DNA, 14 bp, Homo sapiens
gcaccgccagccgc

SEQ ID NO: 1404989 - DNA, 13 bp, Homo sapiens
gcacctgcagcca

SEQ ID NO: 1404990 - DNA, 19 bp, Homo sapiens
gcacctgcagccaagcaaa

SEQ ID NO: 1404991 - DNA, 23 bp, Homo sapiens
gcagagatttctcattgactttt

SEQ ID NO: 1404992 - DNA, 16 bp, Homo sapiens
gcatgcaaatgagctc

SEQ ID NO: 1404993 - DNA, 20 bp, Homo sapiens
gcatgttcacccttatagtc

SEQ ID NO: 1404994 - DNA, 15 bp, Homo sapiens
gccacatcaaacctt

SEQ ID NO: 1404995 - DNA, 13 bp, Homo sapiens
gccactgattctc

SEQ ID NO: 1404996 - DNA, 19 bp, Homo sapiens
gccagccaggaagatgaat

SEQ ID NO: 1404997 - DNA, 17 bp, Homo sapiens
gccagccgattcctcca

SEQ ID NO: 1404998 - DNA, 14 bp, Homo sapiens
gccatgtctcctgc

SEQ ID NO: 1404999 - DNA, 19 bp, Homo sapiens
gccctggtgctgtaccccc

SEQ ID NO: 1405000 - DNA, 21 bp, Homo sapiens
gcctcaccatgtgagctcttc

SEQ ID NO: 1405001 - DNA, 19 bp, Homo sapiens
gcctcttgtagtcttggct

SEQ ID NO: 1405002 - DNA, 18 bp, Homo sapiens
gctactgttgtaagaatt

SEQ ID NO: 1405003 - DNA, 18 bp, Homo sapiens
gctcaatacctggcctca

SEQ ID NO: 1405004 - DNA, 15 bp, Homo sapiens
gctcctccccttcct

SEQ ID NO: 1405005 - DNA, 20 bp, Homo sapiens
gctcttcctatccctctcct

SEQ ID NO: 1405006 - DNA, 22 bp, Homo sapiens
gctgaagggtaatatggactca

SEQ ID NO: 1405007 - DNA, 13 bp, Homo sapiens
gctgacatcattt

SEQ ID NO: 1405008 - DNA, 14 bp, Homo sapiens
gctgagggtttgaa

SEQ ID NO: 1405009 - DNA, 14 bp, Homo sapiens
gctggaagagtccc

SEQ ID NO: 1405010 - DNA, 19 bp, Homo sapiens
gctgttgcttaaaccactt

SEQ ID NO: 1405011 - DNA, 18 bp, Homo sapiens
gcttaatgctacatgtga

SEQ ID NO: 1405012 - DNA, 11 bp, Homo sapiens
gcttgcagaac

SEQ ID NO: 1405013 - DNA, 16 bp, Homo sapiens
gctttattaatgtttt

SEQ ID NO: 1405014 - DNA, 12 bp, Homo sapiens
gcttttccaaac

SEQ ID NO: 1405015 - DNA, 20 bp, Homo sapiens
ggaaactgagggcagagagg

SEQ ID NO: 1405016 - DNA, 16 bp, Homo sapiens
ggaaattcctgtactg

SEQ ID NO: 1405017 - DNA, 13 bp, Homo sapiens
ggaagaatgaaag

SEQ ID NO: 1405018 - DNA, 16 bp, Homo sapiens
ggaaggagaagtaaga

SEQ ID NO: 1405019 - DNA, 18 bp, Homo sapiens
ggacatgcaataaaattt

SEQ ID NO: 1405020 - DNA, 19 bp, Homo sapiens
ggacatgcaataaaattta

SEQ ID NO: 1405021 - DNA, 16 bp, Homo sapiens
ggactcagccttgcaa

SEQ ID NO: 1405022 - DNA, 22 bp, Homo sapiens
ggagacgtttataaacagaaat

SEQ ID NO: 1405023 - DNA, 14 bp, Homo sapiens
ggattctaaataca

SEQ ID NO: 1405024 - DNA, 15 bp, Homo sapiens
ggattgcctctgaaa

SEQ ID NO: 1405025 - DNA, 13 bp, Homo sapiens
ggcaaagccagaa

SEQ ID NO: 1405026 - DNA, 12 bp, Homo sapiens
ggcaagaaaagc

SEQ ID NO: 1405027 - DNA, 11 bp, Homo sapiens
ggcaaggaagt

SEQ ID NO: 1405028 - DNA, 15 bp, Homo sapiens
ggcaccgccagccgc

SEQ ID NO: 1405029 - DNA, 19 bp, Homo sapiens
ggccagccgattcctccag

SEQ ID NO: 1405030 - DNA, 14 bp, Homo sapiens
ggccatgtctcctg

SEQ ID NO: 1405031 - DNA, 22 bp, Homo sapiens
ggccccatattaacaaattgca

SEQ ID NO: 1405032 - DNA, 16 bp, Homo sapiens
agtttttgtttggaga

SEQ ID NO: 1405033 - DNA, 15 bp, Homo sapiens
ataaattcaactttg

SEQ ID NO: 1405034 - DNA, 20 bp, Homo sapiens
ataaattcaactttgtaaaa

SEQ ID NO: 1405035 - DNA, 12 bp, Homo sapiens
ataactgaggag

SEQ ID NO: 1405036 - DNA, 23 bp, Homo sapiens
ataagcccaacaagttgaagaag

SEQ ID NO: 1405037 - DNA, 22 bp, Homo sapiens
ataagtatactgggggcaaaat

SEQ ID NO: 1405038 - DNA, 23 bp, Homo sapiens
ataataagcccaacaagttgaag

SEQ ID NO: 1405039 - DNA, 17 bp, Homo sapiens
ataatgctacaatttta

SEQ ID NO: 1405040 - DNA, 20 bp, Homo sapiens
ataatgctacaattttaaga

SEQ ID NO: 1405041 - DNA, 15 bp, Homo sapiens
ataattgtacaaaat

SEQ ID NO: 1405042 - DNA, 14 bp, Homo sapiens
atacacatttgcta

SEQ ID NO: 1405043 - DNA, 22 bp, Homo sapiens
atacacatttgctactgttgta

SEQ ID NO: 1405044 - DNA, 20 bp, Homo sapiens
atacatcatacttaacttta

SEQ ID NO: 1405045 - DNA, 19 bp, Homo sapiens
atacatgtgatacattttt

SEQ ID NO: 1405046 - DNA, 19 bp, Homo sapiens
atacctggcctcatttaaa

SEQ ID NO: 1405047 - DNA, 22 bp, Homo sapiens
atacctggcctcatttaaaaca

SEQ ID NO: 1405048 - DNA, 16 bp, Homo sapiens
atactgggggcaaaat

SEQ ID NO: 1405049 - DNA, 16 bp, Homo sapiens
atacttaactttacta

SEQ ID NO: 1405050 - DNA, 20 bp, Homo sapiens
atacttaactttactaagta

SEQ ID NO: 1405051 - DNA, 13 bp, Homo sapiens
atactttgtattt

SEQ ID NO: 1405052 - DNA, 19 bp, Homo sapiens
atagcagccagttcaaaaa

SEQ ID NO: 1405053 - DNA, 21 bp, Homo sapiens
ataggagtggtgatttgaaaa

SEQ ID NO: 1405054 - DNA, 18 bp, Homo sapiens
atagtctaagactatata

SEQ ID NO: 1405055 - DNA, 21 bp, Homo sapiens
atagtctaagactatatatat

SEQ ID NO: 1405056 - DNA, 15 bp, Homo sapiens
atatatataaatgta

SEQ ID NO: 1405057 - DNA, 19 bp, Homo sapiens
atatattttgtgtgaaatt

SEQ ID NO: 1405058 - DNA, 22 bp, Homo sapiens
atatcagtgggctctcttacca

SEQ ID NO: 1405059 - DNA, 15 bp, Homo sapiens
atatccaattttaaa

SEQ ID NO: 1405060 - DNA, 21 bp, Homo sapiens
atatccaattttaaaatgaaa

SEQ ID NO: 1405061 - DNA, 13 bp, Homo sapiens
atatgtattcttt

SEQ ID NO: 1405062 - DNA, 17 bp, Homo sapiens
atattactgacatttct

SEQ ID NO: 1405063 - DNA, 21 bp, Homo sapiens
atattccagatctttcagaaa

SEQ ID NO: 1405064 - DNA, 13 bp, Homo sapiens
atattgaatgtta

SEQ ID NO: 1405065 - DNA, 19 bp, Homo sapiens
atattgattgggaaaacat

SEQ ID NO: 1405066 - DNA, 21 bp, Homo sapiens
atattgattgggaaaacattt

SEQ ID NO: 1405067 - DNA, 16 bp, Homo sapiens
atattgtttggtaaat

SEQ ID NO: 1405068 - DNA, 18 bp, Homo sapiens
atattgtttggtaaatgt

SEQ ID NO: 1405069 - DNA, 14 bp, Homo sapiens
atattttatattac

SEQ ID NO: 1405070 - DNA, 18 bp, Homo sapiens
atcacgatgtaaattatt

SEQ ID NO: 1405071 - DNA, 21 bp, Homo sapiens
atcatctcctttgcagaatga

SEQ ID NO: 1405072 - DNA, 13 bp, Homo sapiens
atcattcagaaat

SEQ ID NO: 1405073 - DNA, 17 bp, Homo sapiens
atccaattttaaaatga

SEQ ID NO: 1405074 - DNA, 21 bp, Homo sapiens
atccaattttaaaatgaaatg

SEQ ID NO: 1405075 - DNA, 22 bp, Homo sapiens
atccaattttaaaatgaaatgc

SEQ ID NO: 1405076 - DNA, 17 bp, Homo sapiens
atcccacatatttcaaa

SEQ ID NO: 1405077 - DNA, 22 bp, Homo sapiens
atcccacatatttcaaaaacat

SEQ ID NO: 1405078 - DNA, 15 bp, Homo sapiens
atccctctcctaact

SEQ ID NO: 1405079 - DNA, 16 bp, Homo sapiens
atccctgccaaaaagt

SEQ ID NO: 1405080 - DNA, 16 bp, Homo sapiens
atcctagcttcttcca

SEQ ID NO: 1405081 - DNA, 13 bp, Homo sapiens
atctaattctgat

SEQ ID NO: 1405082 - DNA, 19 bp, Homo sapiens
atctacaatctctttttgt

SEQ ID NO: 1405083 - DNA, 14 bp, Homo sapiens
atctacactctcga

SEQ ID NO: 1405084 - DNA, 12 bp, Homo sapiens
atctcactctgc

SEQ ID NO: 1405085 - DNA, 14 bp, Homo sapiens
atctcactctgccc

SEQ ID NO: 1405086 - DNA, 14 bp, Homo sapiens
atctcctttgcaga

SEQ ID NO: 1405087 - DNA, 18 bp, Homo sapiens
atctcctttgcagaatga

SEQ ID NO: 1405088 - DNA, 19 bp, Homo sapiens
atctcgctccctcccagga

SEQ ID NO: 1405089 - DNA, 18 bp, Homo sapiens
atctctccaccttccaaa

SEQ ID NO: 1405090 - DNA, 19 bp, Homo sapiens
atctctccaccttccaaag

SEQ ID NO: 1405091 - DNA, 15 bp, Homo sapiens
atcttcaaagccttc

SEQ ID NO: 1405092 - DNA, 18 bp, Homo sapiens
atcttcaaagccttctcc

SEQ ID NO: 1405093 - DNA, 14 bp, Homo sapiens
atctttcagaaata

SEQ ID NO: 1405094 - DNA, 16 bp, Homo sapiens
atctttcagaaatata

SEQ ID NO: 1405095 - DNA, 16 bp, Homo sapiens
atcttttgaagcatag

SEQ ID NO: 1405096 - DNA, 14 bp, Homo sapiens
atgaaaataccatt

SEQ ID NO: 1405097 - DNA, 24 bp, Homo sapiens
atgaaaataccatttagtaagaat

SEQ ID NO: 1405098 - DNA, 23 bp, Homo sapiens
gtgctcccctgctcggcaccgcc

SEQ ID NO: 1405099 - DNA, 17 bp, Homo sapiens
gtggattgcctctgaaa

SEQ ID NO: 1405100 - DNA, 20 bp, Homo sapiens
gtgtctgacgattttggaaa

SEQ ID NO: 1405101 - DNA, 19 bp, Homo sapiens
gtgtggattgcctctgaaa

SEQ ID NO: 1405102 - DNA, 17 bp, Homo sapiens
gttagctgaagaattga

SEQ ID NO: 1405103 - DNA, 24 bp, Homo sapiens
gttgagacctcagcttggcactca

SEQ ID NO: 1405104 - DNA, 13 bp, Homo sapiens
gttgcttgtcttc

SEQ ID NO: 1405105 - DNA, 14 bp, Homo sapiens
gttgcttgtcttct

SEQ ID NO: 1405106 - DNA, 19 bp, Homo sapiens
gtttaaaatgtaatttaaa

SEQ ID NO: 1405107 - DNA, 20 bp, Homo sapiens
gtttaaaatgtaatttaaat

SEQ ID NO: 1405108 - DNA, 13 bp, Homo sapiens
gtttgttggaaag

SEQ ID NO: 1405109 - DNA, 15 bp, Homo sapiens
gttttactgtctatt

SEQ ID NO: 1405110 - DNA, 11 bp, Homo sapiens
taaaaatcttt

SEQ ID NO: 1405111 - DNA, 19 bp, Homo sapiens
taaaagttttatatgcttt

SEQ ID NO: 1405112 - DNA, 15 bp, Homo sapiens
taaaatgtaatttaa

SEQ ID NO: 1405113 - DNA, 19 bp, Homo sapiens
taaaatgtaatttaaatga

SEQ ID NO: 1405114 - DNA, 16 bp, Homo sapiens
taaaattttgtatgtt

SEQ ID NO: 1405115 - DNA, 19 bp, Homo sapiens
taaaattttgtatgttaaa

SEQ ID NO: 1405116 - DNA, 16 bp, Homo sapiens
taaactggcttaactt

SEQ ID NO: 1405117 - DNA, 22 bp, Homo sapiens
taaacttctgcaacaagcatgc

SEQ ID NO: 1405118 - DNA, 23 bp, Homo sapiens
taaagaccctcctattctataaa

SEQ ID NO: 1405119 - DNA, 13 bp, Homo sapiens
taaagtgaagaat

SEQ ID NO: 1405120 - DNA, 20 bp, Homo sapiens
taaatacatgccacatcaaa

SEQ ID NO: 1405121 - DNA, 14 bp, Homo sapiens
taaatgaaagaaaa

SEQ ID NO: 1405122 - DNA, 22 bp, Homo sapiens
taaatgaaagaaaattgagttg

SEQ ID NO: 1405123 - DNA, 19 bp, Homo sapiens
taaatgtttcttttgtttg

SEQ ID NO: 1405124 - DNA, 19 bp, Homo sapiens
taaattcaactttgtaaaa

SEQ ID NO: 1405125 - DNA, 12 bp, Homo sapiens
taaattgcatca

SEQ ID NO: 1405126 - DNA, 16 bp, Homo sapiens
taaattgcatcactgt

SEQ ID NO: 1405127 - DNA, 21 bp, Homo sapiens
taaatttcactactagattga

SEQ ID NO: 1405128 - DNA, 15 bp, Homo sapiens
taacaaattgcattt

SEQ ID NO: 1405129 - DNA, 15 bp, Homo sapiens
taacagtcatcattt

SEQ ID NO: 1405130 - DNA, 23 bp, Homo sapiens
taaccacctacaaggagataaga

SEQ ID NO: 1405131 - DNA, 18 bp, Homo sapiens
taaccctcacactgctcc

SEQ ID NO: 1405132 - DNA, 11 bp, Homo sapiens
taaccctttct

SEQ ID NO: 1405133 - DNA, 20 bp, Homo sapiens
taactcaaatacacatttgc

SEQ ID NO: 1405134 - DNA, 21 bp, Homo sapiens
taactcaaatacacatttgct

SEQ ID NO: 1405135 - DNA, 17 bp, Homo sapiens
taagaagaagttcatgt

SEQ ID NO: 1405136 - DNA, 23 bp, Homo sapiens
taagaataccacatcaaataaga

SEQ ID NO: 1405137 - DNA, 19 bp, Homo sapiens
taagaattctgattgattt

SEQ ID NO: 1405138 - DNA, 23 bp, Homo sapiens
taagacaagttcaacaacaaaac

SEQ ID NO: 1405139 - DNA, 18 bp, Homo sapiens
taagactatatatataaa

SEQ ID NO: 1405140 - DNA, 20 bp, Homo sapiens
taagactatatatataaatg

SEQ ID NO: 1405141 - DNA, 21 bp, Homo sapiens
taagcattagctttaattaag

SEQ ID NO: 1405142 - DNA, 15 bp, Homo sapiens
taaggggaagaatga

SEQ ID NO: 1405143 - DNA, 21 bp, Homo sapiens
taatagaagcttaaaataaag

SEQ ID NO: 1405144 - DNA, 20 bp, Homo sapiens
taatattgtttggtaaatgt

SEQ ID NO: 1405145 - DNA, 21 bp, Homo sapiens
taatattgtttggtaaatgtt

SEQ ID NO: 1405146 - DNA, 19 bp, Homo sapiens
taatccagttataagaaga

SEQ ID NO: 1405147 - DNA, 16 bp, Homo sapiens
taatctcacagcattt

SEQ ID NO: 1405148 - DNA, 21 bp, Homo sapiens
taatctcacagcatttgccaa

SEQ ID NO: 1405149 - DNA, 18 bp, Homo sapiens
taatctctccaccttcca

SEQ ID NO: 1405150 - DNA, 17 bp, Homo sapiens
taatcttcaaagccttc

SEQ ID NO: 1405151 - DNA, 14 bp, Homo sapiens
taatgctacaattt

SEQ ID NO: 1405152 - DNA, 15 bp, Homo sapiens
taatgctacaatttt

SEQ ID NO: 1405153 - DNA, 22 bp, Homo sapiens
taatgtagttttgtgatgcatt

SEQ ID NO: 1405154 - DNA, 15 bp, Homo sapiens
taatgtgtggattgc

SEQ ID NO: 1405155 - DNA, 13 bp, Homo sapiens
taatgttttcaaa

SEQ ID NO: 1405156 - DNA, 14 bp, Homo sapiens
taatgttttcaaaa

SEQ ID NO: 1405157 - DNA, 21 bp, Homo sapiens
taattacaatgtaatagaagc

SEQ ID NO: 1405158 - DNA, 15 bp, Homo sapiens
taattgtacaaaatt

SEQ ID NO: 1405159 - DNA, 13 bp, Homo sapiens
taatttaaatgaa

SEQ ID NO: 1405160 - DNA, 23 bp, Homo sapiens
tacaatattgattgggaaaacat

SEQ ID NO: 1405161 - DNA, 17 bp, Homo sapiens
tacaatctctttttgtt

SEQ ID NO: 1405162 - DNA, 13 bp, Homo sapiens
tacaattttaaga

SEQ ID NO: 1405163 - DNA, 13 bp, Homo sapiens
tacacatttgcta

SEQ ID NO: 1405164 - DNA, 21 bp, Homo sapiens
tacacatttgctactgttgta

SEQ ID NO: 1405165 - DNA, 22 bp, Homo sapiens
tacaccccctcttctgagcaca

SEQ ID NO: 1405166 - DNA, 15 bp, Homo sapiens
tacagtatagatttt

SEQ ID NO: 1405167 - DNA, 14 bp, Homo sapiens
tacatctccaaata

SEQ ID NO: 1405168 - DNA, 17 bp, Homo sapiens
tacatgtgatacatttt

SEQ ID NO: 1405169 - DNA, 15 bp, Homo sapiens
tacattttttaagct

SEQ ID NO: 1405170 - DNA, 21 bp, Homo sapiens
taccagggagatttgctcaat

SEQ ID NO: 1405171 - DNA, 23 bp, Homo sapiens
tacccatacaccccctcttctga

SEQ ID NO: 1405172 - DNA, 17 bp, Homo sapiens
tacccatagacatgaaa

SEQ ID NO: 1405173 - DNA, 18 bp, Homo sapiens
tacccatagacatgaaag

SEQ ID NO: 1405174 - DNA, 17 bp, Homo sapiens
tacctggcctcatttaa

SEQ ID NO: 1405175 - DNA, 14 bp, Homo sapiens
taccttatcttaca

SEQ ID NO: 1405176 - DNA, 18 bp, Homo sapiens
taccttttttttttcttg

SEQ ID NO: 1405177 - DNA, 19 bp, Homo sapiens
tactaaacagtaagatatc

SEQ ID NO: 1405178 - DNA, 14 bp, Homo sapiens
tactgacatttctt

SEQ ID NO: 1405179 - DNA, 16 bp, Homo sapiens
tactgttgtaagaatt

SEQ ID NO: 1405180 - DNA, 17 bp, Homo sapiens
tactgttgtaagaattc

SEQ ID NO: 1405181 - DNA, 22 bp, Homo sapiens
tactgttgtaagaattctgatt

SEQ ID NO: 1405182 - DNA, 14 bp, Homo sapiens
tacttaaatggtaa

SEQ ID NO: 1405183 - DNA, 16 bp, Homo sapiens
tagaagcttaaaataa

SEQ ID NO: 1405184 - DNA, 16 bp, Homo sapiens
tagaaggactgcagcc

SEQ ID NO: 1405185 - DNA, 15 bp, Homo sapiens
tagatccatttccat

SEQ ID NO: 1405186 - DNA, 18 bp, Homo sapiens
tagatctacactctcgag

SEQ ID NO: 1405187 - DNA, 16 bp, Homo sapiens
tagcaaaaaatgaaca

SEQ ID NO: 1405188 - DNA, 14 bp, Homo sapiens
tagcacatgatttg

SEQ ID NO: 1405189 - DNA, 21 bp, Homo sapiens
tagcatttagatctacactct

SEQ ID NO: 1405190 - DNA, 16 bp, Homo sapiens
tagctcctccccttcc

SEQ ID NO: 1405191 - DNA, 17 bp, Homo sapiens
tagctgaagaattgaaa

SEQ ID NO: 1405192 - DNA, 21 bp, Homo sapiens
tagctgaagaattgaaaagtt

SEQ ID NO: 1405193 - DNA, 15 bp, Homo sapiens
tagctttaattaagc

SEQ ID NO: 1405194 - DNA, 14 bp, Homo sapiens
aaaaaatgaacagt

SEQ ID NO: 1405195 - DNA, 16 bp, Homo sapiens
aaaaatagctcttgct

SEQ ID NO: 1405196 - DNA, 22 bp, Homo sapiens
aaaaatataaaattatgagatt

SEQ ID NO: 1405197 - DNA, 14 bp, Homo sapiens
aaaactaaatttca

SEQ ID NO: 1405198 - DNA, 17 bp, Homo sapiens
aaaagatctttcatttt

SEQ ID NO: 1405199 - DNA, 18 bp, Homo sapiens
aaaagatctttcattttg

SEQ ID NO: 1405200 - DNA, 18 bp, Homo sapiens
aaaagtggctggaagagt

SEQ ID NO: 1405201 - DNA, 21 bp, Homo sapiens
aaaagtggctggaagagtccc

SEQ ID NO: 1405202 - DNA, 21 bp, Homo sapiens
aaaagtgtgtatatattttgt

SEQ ID NO: 1405203 - DNA, 14 bp, Homo sapiens
aaaatataaaatta

SEQ ID NO: 1405204 - DNA, 21 bp, Homo sapiens
aaaatcagaatggaatgctct

SEQ ID NO: 1405205 - DNA, 17 bp, Homo sapiens
aaaatgaaatgcatttt

SEQ ID NO: 1405206 - DNA, 18 bp, Homo sapiens
aaaattttgtatgttaaa

SEQ ID NO: 1405207 - DNA, 14 bp, Homo sapiens
aaacagaaatggaa

SEQ ID NO: 1405208 - DNA, 16 bp, Homo sapiens
aaacatgcttttccaa

SEQ ID NO: 1405209 - DNA, 18 bp, Homo sapiens
aaacatttgctctggggg

SEQ ID NO: 1405210 - DNA, 22 bp, Homo sapiens
aaaccacttaaacgaagagttc

SEQ ID NO: 1405211 - DNA, 20 bp, Homo sapiens
aaagactagccagccaggaa

SEQ ID NO: 1405212 - DNA, 21 bp, Homo sapiens
aaagagttgggtgtctcctta

SEQ ID NO: 1405213 - DNA, 14 bp, Homo sapiens
aaagatctttcatt

SEQ ID NO: 1405214 - DNA, 20 bp, Homo sapiens
aaagatctttcattttgcac

SEQ ID NO: 1405215 - DNA, 22 bp, Homo sapiens
aaagatggggaaactgagggca

SEQ ID NO: 1405216 - DNA, 21 bp, Homo sapiens
aaaggatagtaagcatagaaa

SEQ ID NO: 1405217 - DNA, 16 bp, Homo sapiens
aaaggtaatgtgtgga

SEQ ID NO: 1405218 - DNA, 16 bp, Homo sapiens
aaagtaactgtgagaa

SEQ ID NO: 1405219 - DNA, 18 bp, Homo sapiens
aaagtgtgtatatatttt

SEQ ID NO: 1405220 - DNA, 19 bp, Homo sapiens
aaagtgtgtatatattttg

SEQ ID NO: 1405221 - DNA, 21 bp, Homo sapiens
aaataaagttaaactgattat

SEQ ID NO: 1405222 - DNA, 12 bp, Homo sapiens
aaataacagtat

SEQ ID NO: 1405223 - DNA, 13 bp, Homo sapiens
aaataatgctaca

SEQ ID NO: 1405224 - DNA, 20 bp, Homo sapiens
aaataatgctacaattttaa

SEQ ID NO: 1405225 - DNA, 12 bp, Homo sapiens
aaataccattta

SEQ ID NO: 1405226 - DNA, 21 bp, Homo sapiens
aaatagctcttgctttgactt

SEQ ID NO: 1405227 - DNA, 18 bp, Homo sapiens
aaatataaaattatgaga

SEQ ID NO: 1405228 - DNA, 13 bp, Homo sapiens
aaatcttcccatg

SEQ ID NO: 1405229 - DNA, 15 bp, Homo sapiens
aaatcttttgaagca

SEQ ID NO: 1405230 - DNA, 17 bp, Homo sapiens
aaatcttttgaagcata

SEQ ID NO: 1405231 - DNA, 14 bp, Homo sapiens
aaatgaaatgcatt

SEQ ID NO: 1405232 - DNA, 15 bp, Homo sapiens
aaatgaaatgcattt

SEQ ID NO: 1405233 - DNA, 17 bp, Homo sapiens
aaatgaaatgcattttg

SEQ ID NO: 1405234 - DNA, 17 bp, Homo sapiens
aaatgcattttgctaga

SEQ ID NO: 1405235 - DNA, 21 bp, Homo sapiens
aaatggctacatctccaaata

SEQ ID NO: 1405236 - DNA, 17 bp, Homo sapiens
aaatgtaatttaaatga

SEQ ID NO: 1405237 - DNA, 11 bp, Homo sapiens
aaatgtttctt

SEQ ID NO: 1405238 - DNA, 18 bp, Homo sapiens
aaatgtttcttttaaaga

SEQ ID NO: 1405239 - DNA, 14 bp, Homo sapiens
aaatgtttcttttg

SEQ ID NO: 1405240 - DNA, 19 bp, Homo sapiens
aaatgtttcttttgtttgg

SEQ ID NO: 1405241 - DNA, 16 bp, Homo sapiens
aaattaagcaaatgtt

SEQ ID NO: 1405242 - DNA, 15 bp, Homo sapiens
aaattcaactttgta

SEQ ID NO: 1405243 - DNA, 20 bp, Homo sapiens
aaattcaactttgtaaaaat

SEQ ID NO: 1405244 - DNA, 19 bp, Homo sapiens
aaattgagttgcacttatt

SEQ ID NO: 1405245 - DNA, 12 bp, Homo sapiens
aaattgcatact

SEQ ID NO: 1405246 - DNA, 23 bp, Homo sapiens
aaattgcatactttgtattttga

SEQ ID NO: 1405247 - DNA, 19 bp, Homo sapiens
aaatttaaaaaataaataa

SEQ ID NO: 1405248 - DNA, 15 bp, Homo sapiens
aacaaattgcatttg

SEQ ID NO: 1405249 - DNA, 14 bp, Homo sapiens
aacaagacttcaga

SEQ ID NO: 1405250 - DNA, 17 bp, Homo sapiens
aacaagacttcagattc

SEQ ID NO: 1405251 - DNA, 13 bp, Homo sapiens
aacaagcatgcag

SEQ ID NO: 1405252 - DNA, 23 bp, Homo sapiens
aacactagggccttggaaattcc

SEQ ID NO: 1405253 - DNA, 16 bp, Homo sapiens
aacagagctagaggcc

SEQ ID NO: 1405254 - DNA, 16 bp, Homo sapiens
aacagtcatcatttat

SEQ ID NO: 1405255 - DNA, 20 bp, Homo sapiens
aacataatttttatttttgg

SEQ ID NO: 1405256 - DNA, 22 bp, Homo sapiens
aacatgttaatgacaatattcc

SEQ ID NO: 1405257 - DNA, 12 bp, Homo sapiens
aacatttgctgc

SEQ ID NO: 1405258 - DNA, 16 bp, Homo sapiens
aacatttgctgccatt

SEQ ID NO: 1405259 - DNA, 14 bp, Homo sapiens
aaccataaattcaa

SEQ ID NO: 1405260 - DNA, 14 bp, Homo sapiens
aaccctggcatttg

SEQ ID NO: 1405261 - DNA, 18 bp, Homo sapiens
aacgcaaaaatagctctt

SEQ ID NO: 1405262 - DNA, 19 bp, Homo sapiens
aacgtcctctttagttttt

SEQ ID NO: 1405263 - DNA, 22 bp, Homo sapiens
aactaaatttcactactagatt

SEQ ID NO: 1405264 - DNA, 15 bp, Homo sapiens
aactctgcatgtaga

SEQ ID NO: 1405265 - DNA, 20 bp, Homo sapiens
aactgagggcagagaggtta

SEQ ID NO: 1405266 - DNA, 19 bp, Homo sapiens
aacttctgcaacaagcatg

SEQ ID NO: 1405267 - DNA, 20 bp, Homo sapiens
aacttctgcaacaagcatgc

SEQ ID NO: 1405268 - DNA, 22 bp, Homo sapiens
aacttctgcaacaagcatgcag

SEQ ID NO: 1405269 - DNA, 18 bp, Homo sapiens
aactttgtaaaaatcttt

SEQ ID NO: 1405270 - DNA, 13 bp, Homo sapiens
aagaatgaaagct

SEQ ID NO: 1405271 - DNA, 15 bp, Homo sapiens
aagaattgaaaagtt

SEQ ID NO: 1405272 - DNA, 19 bp, Homo sapiens
aagaattgaaaagtttttg

SEQ ID NO: 1405273 - DNA, 20 bp, Homo sapiens
aagactatatatataaatgt

SEQ ID NO: 1405274 - DNA, 11 bp, Homo sapiens
aagagaaaaaa

SEQ ID NO: 1405275 - DNA, 14 bp, Homo sapiens
aagaggtggcccca

SEQ ID NO: 1405276 - DNA, 17 bp, Homo sapiens
aagagtaacagtcatca

SEQ ID NO: 1405277 - DNA, 20 bp, Homo sapiens
aagagttcccttgaaacttt

SEQ ID NO: 1405278 - DNA, 21 bp, Homo sapiens
aagatctcactctgccccccc

SEQ ID NO: 1405279 - DNA, 17 bp, Homo sapiens
aagcaaatgttaaaagt

SEQ ID NO: 1405280 - DNA, 19 bp, Homo sapiens
aagcaaatgttaaaagttt

SEQ ID NO: 1405281 - DNA, 15 bp, Homo sapiens
aagcagagttttcat

SEQ ID NO: 1405282 - DNA, 22 bp, Homo sapiens
aagcatagataatattgtttgg

SEQ ID NO: 1405283 - DNA, 16 bp, Homo sapiens
aagcattagctttaat

SEQ ID NO: 1405284 - DNA, 13 bp, Homo sapiens
aagcgcagagaaa

SEQ ID NO: 1405285 - DNA, 14 bp, Homo sapiens
aagcgcagagaaat

SEQ ID NO: 1405286 - DNA, 14 bp, Homo sapiens
aagctctcatagct

SEQ ID NO: 1405287 - DNA, 18 bp, Homo sapiens
aagctctcatagctcata

SEQ ID NO: 1405288 - DNA, 14 bp, Homo sapiens
aaggatagtaagca

SEQ ID NO: 1405289 - DNA, 20 bp, Homo sapiens
aaggatagtaagcatagaaa

SEQ ID NO: 1405290 - DNA, 19 bp, Homo sapiens
aaggctactacagagaagg

SEQ ID NO: 1405291 - DNA, 14 bp, Homo sapiens
aaggctgatttatg

SEQ ID NO: 1405292 - DNA, 13 bp, Homo sapiens
aaggctgcctgct

SEQ ID NO: 1405293 - DNA, 12 bp, Homo sapiens
aagggatatttt

SEQ ID NO: 1405294 - DNA, 13 bp, Homo sapiens
aaggggtaaaagg

SEQ ID NO: 1405295 - DNA, 22 bp, Homo sapiens
aaggtattatacatgtgataca

SEQ ID NO: 1405296 - DNA, 17 bp, Homo sapiens
aaggtccccagcagaat

SEQ ID NO: 1405297 - DNA, 18 bp, Homo sapiens
aagtaatctcacagcatt

SEQ ID NO: 1405298 - DNA, 19 bp, Homo sapiens
aagtaatctcacagcattt

SEQ ID NO: 1405299 - DNA, 15 bp, Homo sapiens
aagtgtgtatatatt

SEQ ID NO: 1405300 - DNA, 17 bp, Homo sapiens
aagtgtgtatatatttt

SEQ ID NO: 1405301 - DNA, 21 bp, Homo sapiens
aagtgtgtatatattttgtgt

SEQ ID NO: 1405302 - DNA, 14 bp, Homo sapiens
aagttgaagaagct

SEQ ID NO: 1405303 - DNA, 13 bp, Homo sapiens
aagttttatatgc

SEQ ID NO: 1405304 - DNA, 12 bp, Homo sapiens
aataaaatttaa

SEQ ID NO: 1405305 - DNA, 19 bp, Homo sapiens
aataaagttaaactgatta

SEQ ID NO: 1405306 - DNA, 21 bp, Homo sapiens
aataatgctacaattttaaga

SEQ ID NO: 1405307 - DNA, 14 bp, Homo sapiens
aatacacatttgct

SEQ ID NO: 1405308 - DNA, 18 bp, Homo sapiens
aatacatgccacatcaaa

SEQ ID NO: 1405309 - DNA, 15 bp, Homo sapiens
aataccatttagtaa

SEQ ID NO: 1405310 - DNA, 17 bp, Homo sapiens
aatacctggcctcattt

SEQ ID NO: 1405311 - DNA, 20 bp, Homo sapiens
aatacctggcctcatttaaa

SEQ ID NO: 1405312 - DNA, 21 bp, Homo sapiens
aatagaagcttaaaataaagt

SEQ ID NO: 1405313 - DNA, 22 bp, Homo sapiens
aataggaatcattcagaaatgt

SEQ ID NO: 1405314 - DNA, 21 bp, Homo sapiens
aataggagtggtgatttgaaa

SEQ ID NO: 1405315 - DNA, 12 bp, Homo sapiens
aatatggactca

SEQ ID NO: 1405316 - DNA, 22 bp, Homo sapiens
aatattccagatctttcagaaa

SEQ ID NO: 1405317 - DNA, 23 bp, Homo sapiens
aatattccagatctttcagaaat

SEQ ID NO: 1405318 - DNA, 21 bp, Homo sapiens
aatattgattgggaaaacatt

SEQ ID NO: 1405319 - DNA, 19 bp, Homo sapiens
aatccagttataagaagaa

SEQ ID NO: 1405320 - DNA, 14 bp, Homo sapiens
aatcccctaaaata

SEQ ID NO: 1405321 - DNA, 17 bp, Homo sapiens
aatcccctaaaataaca

SEQ ID NO: 1405322 - DNA, 20 bp, Homo sapiens
aatctacaatctctttttgt

SEQ ID NO: 1405323 - DNA, 18 bp, Homo sapiens
aatctctccaccttccaa

SEQ ID NO: 1405324 - DNA, 17 bp, Homo sapiens
aatcttcccatgcattc

SEQ ID NO: 1405325 - DNA, 13 bp, Homo sapiens
aatgaaagaaaat

SEQ ID NO: 1405326 - DNA, 16 bp, Homo sapiens
aatgaaagctgttcct

SEQ ID NO: 1405327 - DNA, 15 bp, Homo sapiens
aatgaaatgcatttt

SEQ ID NO: 1405328 - DNA, 17 bp, Homo sapiens
aatgaaccataaattca

SEQ ID NO: 1405329 - DNA, 18 bp, Homo sapiens
aatgaaccataaattcaa

SEQ ID NO: 1405330 - DNA, 17 bp, Homo sapiens
aatgaggaaaattctta

SEQ ID NO: 1405331 - DNA, 23 bp, Homo sapiens
aatgcattttgctagacagttaa

SEQ ID NO: 1405332 - DNA, 12 bp, Homo sapiens
aatgcctgccaa

SEQ ID NO: 1405333 - DNA, 20 bp, Homo sapiens
aatgctacaattttaagagg

SEQ ID NO: 1405334 - DNA, 15 bp, Homo sapiens
aatgctacatgtgag

SEQ ID NO: 1405335 - DNA, 13 bp, Homo sapiens
aatgtaatttaaa

SEQ ID NO: 1405336 - DNA, 15 bp, Homo sapiens
aatgtataaatatac

SEQ ID NO: 1405337 - DNA, 23 bp, Homo sapiens
aatgtgtggattgcctctgaaaa

SEQ ID NO: 1405338 - DNA, 13 bp, Homo sapiens
aatgttaaaggga

SEQ ID NO: 1405339 - DNA, 18 bp, Homo sapiens
aatgttaaagggatattt

SEQ ID NO: 1405340 - DNA, 21 bp, Homo sapiens
aatgtttcttttgtttggtaa

SEQ ID NO: 1405341 - DNA, 18 bp, Homo sapiens
aattaagcaaatgttaaa

SEQ ID NO: 1405342 - DNA, 23 bp, Homo sapiens
aattaagcaaatgttaaaagttt

SEQ ID NO: 1405343 - DNA, 15 bp, Homo sapiens
aattcaactttgtaa

SEQ ID NO: 1405344 - DNA, 22 bp, Homo sapiens
aattcaactttgtaaaaatctt

SEQ ID NO: 1405345 - DNA, 11 bp, Homo sapiens
aattcttaaaa

SEQ ID NO: 1405346 - DNA, 23 bp, Homo sapiens
aattcttaaaaggcccatagcag

SEQ ID NO: 1405347 - DNA, 20 bp, Homo sapiens
aattgtacaaaattaagcaa

SEQ ID NO: 1405348 - DNA, 14 bp, Homo sapiens
aatttaaaaaataa

SEQ ID NO: 1405349 - DNA, 18 bp, Homo sapiens
aatttaaaaaataaataa

SEQ ID NO: 1405350 - DNA, 19 bp, Homo sapiens
aatttaaatgaaagaaaat

SEQ ID NO: 1405351 - DNA, 20 bp, Homo sapiens
aatttaataccagatacctt

SEQ ID NO: 1405352 - DNA, 24 bp, Homo sapiens
aatttatctctttagttagtgatt

SEQ ID NO: 1405353 - DNA, 22 bp, Homo sapiens
aatttcactactagattgacta

SEQ ID NO: 1405354 - DNA, 20 bp, Homo sapiens
acaaaattaagcaaatgtta

SEQ ID NO: 1405355 - DNA, 19 bp, Homo sapiens
acaaggagataagaaagca

SEQ ID NO: 1405356 - DNA, 17 bp, Homo sapiens
acaatattccagatctt

SEQ ID NO: 1405357 - DNA, 20 bp, Homo sapiens
acacatttgctactgttgta

SEQ ID NO: 1405358 - DNA, 19 bp, Homo sapiens
acagatgttcccccatctc

SEQ ID NO: 1405359 - DNA, 15 bp, Homo sapiens
acagattctttcagt

SEQ ID NO: 1405360 - DNA, 19 bp, Homo sapiens
acagattctttcagttctt

SEQ ID NO: 1405361 - DNA, 20 bp, Homo sapiens
acagattctttcagttcttt

SEQ ID NO: 1405362 - DNA, 21 bp, Homo sapiens
acagttaaactggcttaactt

SEQ ID NO: 1405363 - DNA, 18 bp, Homo sapiens
acataagcttccatttta

SEQ ID NO: 1405364 - DNA, 17 bp, Homo sapiens
acatcaaacctttgagt

SEQ ID NO: 1405365 - DNA, 14 bp, Homo sapiens
acatcaaataagaa

SEQ ID NO: 1405366 - DNA, 23 bp, Homo sapiens
acatctccaaatatcagtgggct

SEQ ID NO: 1405367 - DNA, 13 bp, Homo sapiens
acatgcaataaaa

SEQ ID NO: 1405368 - DNA, 14 bp, Homo sapiens
acatgcaataaaat

SEQ ID NO: 1405369 - DNA, 16 bp, Homo sapiens
acatgcaataaaattt

SEQ ID NO: 1405370 - DNA, 19 bp, Homo sapiens
acatttcttctagtgatga

SEQ ID NO: 1405371 - DNA, 14 bp, Homo sapiens
acattttttaagct

SEQ ID NO: 1405372 - DNA, 19 bp, Homo sapiens
accacatttctaagccttt

SEQ ID NO: 1405373 - DNA, 22 bp, Homo sapiens
accagataccttatcttacaat

SEQ ID NO: 1405374 - DNA, 13 bp, Homo sapiens
accagtccctgtc

SEQ ID NO: 1405375 - DNA, 22 bp, Homo sapiens
accataaattcaactttgtaaa

SEQ ID NO: 1405376 - DNA, 23 bp, Homo sapiens
accattttttaatttacttgttt

SEQ ID NO: 1405377 - DNA, 22 bp, Homo sapiens
acccagggaacagccactcccc

SEQ ID NO: 1405378 - DNA, 21 bp, Homo sapiens
acccattaaggggaagaatga

SEQ ID NO: 1405379 - DNA, 22 bp, Homo sapiens
accccagcattctcaggcacca

SEQ ID NO: 1405380 - DNA, 17 bp, Homo sapiens
acccccgacgtgctccc

SEQ ID NO: 1405381 - DNA, 19 bp, Homo sapiens
accctggcatttggcctct

SEQ ID NO: 1405382 - DNA, 15 bp, Homo sapiens
acctacccatacacc

SEQ ID NO: 1405383 - DNA, 15 bp, Homo sapiens
acctcctcatggcag

SEQ ID NO: 1405384 - DNA, 14 bp, Homo sapiens
acctctttgctccc

SEQ ID NO: 1405385 - DNA, 15 bp, Homo sapiens
acctctttgctccct

SEQ ID NO: 1405386 - DNA, 17 bp, Homo sapiens
acctctttgctccctga

SEQ ID NO: 1405387 - DNA, 20 bp, Homo sapiens
acctttgagtagatccattt

SEQ ID NO: 1405388 - DNA, 18 bp, Homo sapiens
acgcaaaaatagctcttg

SEQ ID NO: 1405389 - DNA, 12 bp, Homo sapiens
acgtcatgtatt

SEQ ID NO: 1405390 - DNA, 18 bp, Homo sapiens
acgtcatgtatttgagca

SEQ ID NO: 1405391 - DNA, 11 bp, Homo sapiens
acgtttataaa

SEQ ID NO: 1405392 - DNA, 21 bp, Homo sapiens
acgtttataaacagaaatgga

SEQ ID NO: 1405393 - DNA, 22 bp, Homo sapiens
actaagtaatctcacagcattt

SEQ ID NO: 1405394 - DNA, 15 bp, Homo sapiens
actacccatagacat

SEQ ID NO: 1405395 - DNA, 19 bp, Homo sapiens
actacccatagacatgaaa

SEQ ID NO: 1405396 - DNA, 22 bp, Homo sapiens
actaggaagtaaagtgaagaat

SEQ ID NO: 1405397 - DNA, 20 bp, Homo sapiens
actatagcttgcagaactgt

SEQ ID NO: 1405398 - DNA, 16 bp, Homo sapiens
actatatatataaatg

SEQ ID NO: 1405399 - DNA, 15 bp, Homo sapiens
actcaaatacacatt

SEQ ID NO: 1405400 - DNA, 20 bp, Homo sapiens
actcaagtctattgaataat

SEQ ID NO: 1405401 - DNA, 12 bp, Homo sapiens
actcagccttgc

SEQ ID NO: 1405402 - DNA, 13 bp, Homo sapiens
actcagccttgca

SEQ ID NO: 1405403 - DNA, 15 bp, Homo sapiens
actcagccttgcaaa

SEQ ID NO: 1405404 - DNA, 13 bp, Homo sapiens
actcctgcttaat

SEQ ID NO: 1405405 - DNA, 15 bp, Homo sapiens
actgacatttcttct

SEQ ID NO: 1405406 - DNA, 15 bp, Homo sapiens
actgagggcagagag

SEQ ID NO: 1405407 - DNA, 17 bp, Homo sapiens
actgcagccactgattc

SEQ ID NO: 1405408 - DNA, 16 bp, Homo sapiens
actggcttaacttagt

SEQ ID NO: 1405409 - DNA, 15 bp, Homo sapiens
actgtagatatgtat

SEQ ID NO: 1405410 - DNA, 15 bp, Homo sapiens
actgtatcattttct

SEQ ID NO: 1405411 - DNA, 16 bp, Homo sapiens
actgtatcattttctt

SEQ ID NO: 1405412 - DNA, 17 bp, Homo sapiens
actgtgagaacccagtt

SEQ ID NO: 1405413 - DNA, 15 bp, Homo sapiens
actgttgtaagaatt

SEQ ID NO: 1405414 - DNA, 21 bp, Homo sapiens
actgttgtaagaattctgatt

SEQ ID NO: 1405415 - DNA, 22 bp, Homo sapiens
actgttgtaagaattctgattg

SEQ ID NO: 1405416 - DNA, 19 bp, Homo sapiens
acttaaatggtaataagca

SEQ ID NO: 1405417 - DNA, 17 bp, Homo sapiens
acttaactttactaagt

SEQ ID NO: 1405418 - DNA, 16 bp, Homo sapiens
acttctgcaacaagca

SEQ ID NO: 1405419 - DNA, 20 bp, Homo sapiens
acttgttttggatggcttgt

SEQ ID NO: 1405420 - DNA, 16 bp, Homo sapiens
actttactaagtaatc

SEQ ID NO: 1405421 - DNA, 21 bp, Homo sapiens
actttgtaaaaatcttttgaa

SEQ ID NO: 1405422 - DNA, 14 bp, Homo sapiens
acttttataaagca

SEQ ID NO: 1405423 - DNA, 13 bp, Homo sapiens
agaaaagagaaaa

SEQ ID NO: 1405424 - DNA, 15 bp, Homo sapiens
agaaaagagaaaaaa

SEQ ID NO: 1405425 - DNA, 22 bp, Homo sapiens
agaaaattgagttgcacttatt

SEQ ID NO: 1405426 - DNA, 17 bp, Homo sapiens
agaaataatgctacaat

SEQ ID NO: 1405427 - DNA, 18 bp, Homo sapiens
agaaatataacacatttt

SEQ ID NO: 1405428 - DNA, 13 bp, Homo sapiens
agaacaatctcaa

SEQ ID NO: 1405429 - DNA, 21 bp, Homo sapiens
agaaccacacttgaaaccttt

SEQ ID NO: 1405430 - DNA, 16 bp, Homo sapiens
agaagaagttcatgtc

SEQ ID NO: 1405431 - DNA, 15 bp, Homo sapiens
agaagacaaactgct

SEQ ID NO: 1405432 - DNA, 21 bp, Homo sapiens
agaagcttaaaataaagttaa

SEQ ID NO: 1405433 - DNA, 22 bp, Homo sapiens
agaaggactgcagccactgatt

SEQ ID NO: 1405434 - DNA, 17 bp, Homo sapiens
agaagttcatgtccaaa

SEQ ID NO: 1405435 - DNA, 16 bp, Homo sapiens
agaatgaaagctgttc

SEQ ID NO: 1405436 - DNA, 21 bp, Homo sapiens
agaattccagtcccctttctc

SEQ ID NO: 1405437 - DNA, 19 bp, Homo sapiens
agaattgaaaagtttttgt

SEQ ID NO: 1405438 - DNA, 21 bp, Homo sapiens
agacgtttataaacagaaatg

SEQ ID NO: 1405439 - DNA, 15 bp, Homo sapiens
agactagccagccag

SEQ ID NO: 1405440 - DNA, 19 bp, Homo sapiens
agactatatatataaatgt

SEQ ID NO: 1405441 - DNA, 23 bp, Homo sapiens
agactgtagatatgtattctttt

SEQ ID NO: 1405442 - DNA, 16 bp, Homo sapiens
agactgttcctgagcc

SEQ ID NO: 1405443 - DNA, 16 bp, Homo sapiens
agacttcagattcccc

SEQ ID NO: 1405444 - DNA, 10 bp, Homo sapiens
agagaatgag

SEQ ID NO: 1405445 - DNA, 13 bp, Homo sapiens
agagatataataa

SEQ ID NO: 1405446 - DNA, 17 bp, Homo sapiens
agaggccatgtctcctg

SEQ ID NO: 1405447 - DNA, 20 bp, Homo sapiens
agagtttcagtttgttggaa

SEQ ID NO: 1405448 - DNA, 20 bp, Homo sapiens
agataatattgtttggtaaa

SEQ ID NO: 1405449 - DNA, 17 bp, Homo sapiens
agatcccacatatttca

SEQ ID NO: 1405450 - DNA, 14 bp, Homo sapiens
agatgttcccccat

SEQ ID NO: 1405451 - DNA, 16 bp, Homo sapiens
agattccccactcagc

SEQ ID NO: 1405452 - DNA, 20 bp, Homo sapiens
agattctttcagttctttgg

SEQ ID NO: 1405453 - DNA, 17 bp, Homo sapiens
agattgactaactcaaa

SEQ ID NO: 1405454 - DNA, 19 bp, Homo sapiens
agattgactaactcaaata

SEQ ID NO: 1405455 - DNA, 11 bp, Homo sapiens
agcacatgatt

SEQ ID NO: 1405456 - DNA, 19 bp, Homo sapiens
agcacatgatttgggctct

SEQ ID NO: 1405457 - DNA, 20 bp, Homo sapiens
agcactcctgcttaatcttc

SEQ ID NO: 1405458 - DNA, 19 bp, Homo sapiens
agcagagttttcattaaat

SEQ ID NO: 1405459 - DNA, 19 bp, Homo sapiens
agcatagataatattgttt

SEQ ID NO: 1405460 - DNA, 17 bp, Homo sapiens
agcattagctttaatta

SEQ ID NO: 1405461 - DNA, 21 bp, Homo sapiens
agccaagcaaatgcctgccaa

SEQ ID NO: 1405462 - DNA, 19 bp, Homo sapiens
agccaatctacaatctctt

SEQ ID NO: 1405463 - DNA, 22 bp, Homo sapiens
agccaatctacaatctcttttt

SEQ ID NO: 1405464 - DNA, 14 bp, Homo sapiens
agccactcccctcc

SEQ ID NO: 1405465 - DNA, 15 bp, Homo sapiens
agccactcccctcca

SEQ ID NO: 1405466 - DNA, 21 bp, Homo sapiens
agccagaaaaagatctttcat

SEQ ID NO: 1405467 - DNA, 14 bp, Homo sapiens
agccgccttccctt

SEQ ID NO: 1405468 - DNA, 23 bp, Homo sapiens
agcgaggcacccttactggctta

SEQ ID NO: 1405469 - DNA, 19 bp, Homo sapiens
agctcctccccttcctctt

SEQ ID NO: 1405470 - DNA, 14 bp, Homo sapiens
agctctcatagctc

SEQ ID NO: 1405471 - DNA, 22 bp, Homo sapiens
agctcttcctatccctctccta

SEQ ID NO: 1405472 - DNA, 18 bp, Homo sapiens
agctgaagaattgaaaag

SEQ ID NO: 1405473 - DNA, 20 bp, Homo sapiens
agctgagatgaaccctggca

SEQ ID NO: 1405474 - DNA, 19 bp, Homo sapiens
agctgcagagatttctcat

SEQ ID NO: 1405475 - DNA, 14 bp, Homo sapiens
agctgccatggcta

SEQ ID NO: 1405476 - DNA, 23 bp, Homo sapiens
agcttcagttgcttgtcttctgg

SEQ ID NO: 1405477 - DNA, 15 bp, Homo sapiens
agcttccattttaat

SEQ ID NO: 1405478 - DNA, 20 bp, Homo sapiens
agcttccattttaattttaa

SEQ ID NO: 1405479 - DNA, 21 bp, Homo sapiens
agctttgcaaacccattaagg

SEQ ID NO: 1405480 - DNA, 13 bp, Homo sapiens
agcttttccctgt

SEQ ID NO: 1405481 - DNA, 16 bp, Homo sapiens
aggaaaattcttaaaa

SEQ ID NO: 1405482 - DNA, 23 bp, Homo sapiens
aggaatcatctcctttgcagaat

SEQ ID NO: 1405483 - DNA, 22 bp, Homo sapiens
aggacatgcaataaaatttaaa

SEQ ID NO: 1405484 - DNA, 16 bp, Homo sapiens
aggatgctgacatcat

SEQ ID NO: 1405485 - DNA, 21 bp, Homo sapiens
aggcaagaaaagcgcagagaa

SEQ ID NO: 1405486 - DNA, 16 bp, Homo sapiens
aggcaccagtccctgt

SEQ ID NO: 1405487 - DNA, 12 bp, Homo sapiens
aggctgatttat

SEQ ID NO: 1405488 - DNA, 19 bp, Homo sapiens
agggactacccatagacat

SEQ ID NO: 1405489 - DNA, 15 bp, Homo sapiens
agggctgtcattgca

SEQ ID NO: 1405490 - DNA, 21 bp, Homo sapiens
aggggtatcatgtatggtgat

SEQ ID NO: 1405491 - DNA, 23 bp, Homo sapiens
agggtgtgatttaggtcagtaga

SEQ ID NO: 1405492 - DNA, 15 bp, Homo sapiens
aggtatctagagctt

SEQ ID NO: 1405493 - DNA, 19 bp, Homo sapiens
aggtattaaaactaaattt

SEQ ID NO: 1405494 - DNA, 20 bp, Homo sapiens
aggtcagtagactgtgattc

SEQ ID NO: 1405495 - DNA, 15 bp, Homo sapiens
aggtccccagcagaa

SEQ ID NO: 1405496 - DNA, 16 bp, Homo sapiens
aggtgcaacactcaag

SEQ ID NO: 1405497 - DNA, 16 bp, Homo sapiens
aggttaacagatttat

SEQ ID NO: 1405498 - DNA, 14 bp, Homo sapiens
agtaaagtgaagaa

SEQ ID NO: 1405499 - DNA, 19 bp, Homo sapiens
agtaacagtcatcatttat

SEQ ID NO: 1405500 - DNA, 23 bp, Homo sapiens
agtaagaataccacatcaaataa

SEQ ID NO: 1405501 - DNA, 20 bp, Homo sapiens
agtactcttctagcatttag

SEQ ID NO: 1405502 - DNA, 14 bp, Homo sapiens
agtagactgtgatt

SEQ ID NO: 1405503 - DNA, 16 bp, Homo sapiens
agtagatccatttcca

SEQ ID NO: 1405504 - DNA, 14 bp, Homo sapiens
agtcatcatttatc

SEQ ID NO: 1405505 - DNA, 23 bp, Homo sapiens
agtccttgatttcaaagttttgt

SEQ ID NO: 1405506 - DNA, 17 bp, Homo sapiens
agtctgtactaaacagt

SEQ ID NO: 1405507 - DNA, 22 bp, Homo sapiens
agtctgtactaaacagtaagat

SEQ ID NO: 1405508 - DNA, 15 bp, Homo sapiens
agtcttggctaagga

SEQ ID NO: 1405509 - DNA, 13 bp, Homo sapiens
agtgaagaattta

SEQ ID NO: 1405510 - DNA, 15 bp, Homo sapiens
agtgattatatttca

SEQ ID NO: 1405511 - DNA, 19 bp, Homo sapiens
agtggagatcccacatatt

SEQ ID NO: 1405512 - DNA, 12 bp, Homo sapiens
agttataagaag

SEQ ID NO: 1405513 - DNA, 19 bp, Homo sapiens
agttctaacagtgaagttt

SEQ ID NO: 1405514 - DNA, 23 bp, Homo sapiens
agttctaacagtgaagttttact

SEQ ID NO: 1405515 - DNA, 23 bp, Homo sapiens
agttgaacagagctagaggccat

SEQ ID NO: 1405516 - DNA, 17 bp, Homo sapiens
agttttatatgctttat

SEQ ID NO: 1405517 - DNA, 12 bp, Homo sapiens
agtttttgtttg

SEQ ID NO: 1405518 - DNA, 11 bp, Homo sapiens
ataaaactctg

SEQ ID NO: 1405519 - DNA, 20 bp, Homo sapiens
ataaaatttaaaaaataaat

SEQ ID NO: 1405520 - DNA, 13 bp, Homo sapiens
ataaacagaaatg

SEQ ID NO: 1405521 - DNA, 20 bp, Homo sapiens
ataaatgtataaatatacag

SEQ ID NO: 1405522 - DNA, 16 bp, Homo sapiens
ataaccacatttctaa

SEQ ID NO: 1405523 - DNA, 21 bp, Homo sapiens
ataagaaataatgctacaatt

SEQ ID NO: 1405524 - DNA, 23 bp, Homo sapiens
ataagaagaagttcatgtccaaa

SEQ ID NO: 1405525 - DNA, 13 bp, Homo sapiens
ataagcactgtaa

SEQ ID NO: 1405526 - DNA, 22 bp, Homo sapiens
ataagcttccattttaatttta

SEQ ID NO: 1405527 - DNA, 19 bp, Homo sapiens
ataatagcacatgatttgg

SEQ ID NO: 1405528 - DNA, 21 bp, Homo sapiens
ataatattgtttggtaaatgt

SEQ ID NO: 1405529 - DNA, 22 bp, Homo sapiens
ataatattgtttggtaaatgtt

SEQ ID NO: 1405530 - DNA, 17 bp, Homo sapiens
atacatgccacatcaaa

SEQ ID NO: 1405531 - DNA, 21 bp, Homo sapiens
atacatgccacatcaaacctt

SEQ ID NO: 1405532 - DNA, 16 bp, Homo sapiens
atacattttttaagct

SEQ ID NO: 1405533 - DNA, 20 bp, Homo sapiens
atacattttttaagcttcag

SEQ ID NO: 1405534 - DNA, 18 bp, Homo sapiens
ataccatttagtaagaat

SEQ ID NO: 1405535 - DNA, 22 bp, Homo sapiens
ataccatttagtaagaatacca

SEQ ID NO: 1405536 - DNA, 17 bp, Homo sapiens
atacctggcctcattta

SEQ ID NO: 1405537 - DNA, 12 bp, Homo sapiens
atactccttccc

SEQ ID NO: 1405538 - DNA, 15 bp, Homo sapiens
atagaagcttaaaat

SEQ ID NO: 1405539 - DNA, 19 bp, Homo sapiens
atagaagcttaaaataaag

SEQ ID NO: 1405540 - DNA, 17 bp, Homo sapiens
atagaaggactgcagcc

SEQ ID NO: 1405541 - DNA, 12 bp, Homo sapiens
atagacatgaaa

SEQ ID NO: 1405542 - DNA, 16 bp, Homo sapiens
atagcacatgatttgg

SEQ ID NO: 1405543 - DNA, 17 bp, Homo sapiens
atagcagccagttcaaa

SEQ ID NO: 1405544 - DNA, 12 bp, Homo sapiens
atagctcataag

SEQ ID NO: 1405545 - DNA, 17 bp, Homo sapiens
atagcttgcagaactgt

SEQ ID NO: 1405546 - DNA, 18 bp, Homo sapiens
ataggaatcattcagaaa

SEQ ID NO: 1405547 - DNA, 18 bp, Homo sapiens
atataaatgtataaatat

SEQ ID NO: 1405548 - DNA, 14 bp, Homo sapiens
atataacacatttt

SEQ ID NO: 1405549 - DNA, 16 bp, Homo sapiens
atataaccacatttct

SEQ ID NO: 1405550 - DNA, 17 bp, Homo sapiens
atataaccacatttcta

SEQ ID NO: 1405551 - DNA, 17 bp, Homo sapiens
atatacagtatagattt

SEQ ID NO: 1405552 - DNA, 20 bp, Homo sapiens
atatacatcatacttaactt

SEQ ID NO: 1405553 - DNA, 22 bp, Homo sapiens
atatacatcatacttaacttta

SEQ ID NO: 1405554 - DNA, 15 bp, Homo sapiens
atatataaatgtata

SEQ ID NO: 1405555 - DNA, 16 bp, Homo sapiens
atatataaatgtataa

SEQ ID NO: 1405556 - DNA, 20 bp, Homo sapiens
atatattttgtgtgaaattg

SEQ ID NO: 1405557 - DNA, 22 bp, Homo sapiens
atatattttgtgtgaaattgca

SEQ ID NO: 1405558 - DNA, 23 bp, Homo sapiens
atatcagtaacccccttaaattt

SEQ ID NO: 1405559 - DNA, 23 bp, Homo sapiens
atatctcaatgaaccataaattc

SEQ ID NO: 1405560 - DNA, 14 bp, Homo sapiens
atatgctttattaa

SEQ ID NO: 1405561 - DNA, 20 bp, Homo sapiens
atatgctttattaatgtttt

SEQ ID NO: 1405562 - DNA, 15 bp, Homo sapiens
atatggactcagcct

SEQ ID NO: 1405563 - DNA, 21 bp, Homo sapiens
atatggactcagccttgcaaa

SEQ ID NO: 1405564 - DNA, 14 bp, Homo sapiens
atatgtattctttt

SEQ ID NO: 1405565 - DNA, 18 bp, Homo sapiens
atatgtattcttttctca

SEQ ID NO: 1405566 - DNA, 15 bp, Homo sapiens
atattactgacattt

SEQ ID NO: 1405567 - DNA, 15 bp, Homo sapiens
atattccagatcttt

SEQ ID NO: 1405568 - DNA, 14 bp, Homo sapiens
atattgtttggtaa

SEQ ID NO: 1405569 - DNA, 14 bp, Homo sapiens
atcaaataagaaat

SEQ ID NO: 1405570 - DNA, 15 bp, Homo sapiens
atcacgatgtaaatt

SEQ ID NO: 1405571 - DNA, 19 bp, Homo sapiens
atcagtaacccccttaaat

SEQ ID NO: 1405572 - DNA, 13 bp, Homo sapiens
atcatacttaact

SEQ ID NO: 1405573 - DNA, 12 bp, Homo sapiens
atcattcagaaa

SEQ ID NO: 1405574 - DNA, 14 bp, Homo sapiens
atcgtttttgtatt

SEQ ID NO: 1405575 - DNA, 15 bp, Homo sapiens
atctagtgaccagat

SEQ ID NO: 1405576 - DNA, 16 bp, Homo sapiens
atctatctagttctaa

SEQ ID NO: 1405577 - DNA, 16 bp, Homo sapiens
atctcactctgccccc

SEQ ID NO: 1405578 - DNA, 16 bp, Homo sapiens
atctctccaccttcca

SEQ ID NO: 1405579 - DNA, 17 bp, Homo sapiens
atctctccaccttccaa

SEQ ID NO: 1405580 - DNA, 15 bp, Homo sapiens
atcttacaatattga

SEQ ID NO: 1405581 - DNA, 14 bp, Homo sapiens
atcttcccatgcat

SEQ ID NO: 1405582 - DNA, 17 bp, Homo sapiens
atgaaatgcattttgct

SEQ ID NO: 1405583 - DNA, 20 bp, Homo sapiens
atgagattggttttcctgtg

SEQ ID NO: 1405584 - DNA, 21 bp, Homo sapiens
atgaggaggggcccccctgcc

SEQ ID NO: 1405585 - DNA, 13 bp, Homo sapiens
atgagtagccagg

SEQ ID NO: 1405586 - DNA, 18 bp, Homo sapiens
atgatgtacagattcttt

SEQ ID NO: 1405587 - DNA, 21 bp, Homo sapiens
atgatgtacagattctttcag

SEQ ID NO: 1405588 - DNA, 14 bp, Homo sapiens
atgcaaatgagctc

SEQ ID NO: 1405589 - DNA, 19 bp, Homo sapiens
atgcaaatgagctctgaaa

SEQ ID NO: 1405590 - DNA, 14 bp, Homo sapiens
atgcagctttgcaa

SEQ ID NO: 1405591 - DNA, 13 bp, Homo sapiens
atgcatgcaaatg

SEQ ID NO: 1405592 - DNA, 19 bp, Homo sapiens
atgcattttatagaatgtg

SEQ ID NO: 1405593 - DNA, 18 bp, Homo sapiens
atgccacatcaaaccttt

SEQ ID NO: 1405594 - DNA, 17 bp, Homo sapiens
atgctacaattttaaga

SEQ ID NO: 1405595 - DNA, 18 bp, Homo sapiens
atgctttattaatgtttt

SEQ ID NO: 1405596 - DNA, 19 bp, Homo sapiens
atgctttattaatgttttc

SEQ ID NO: 1405597 - DNA, 19 bp, Homo sapiens
atggcagcctactctcctt

SEQ ID NO: 1405598 - DNA, 15 bp, Homo sapiens
atggctgctgttgct

SEQ ID NO: 1405599 - DNA, 22 bp, Homo sapiens
atggggaaactgagggcagaga

SEQ ID NO: 1405600 - DNA, 20 bp, Homo sapiens
atggtaataagcactgtaaa

SEQ ID NO: 1405601 - DNA, 17 bp, Homo sapiens
atgtaatagaagcttaa

SEQ ID NO: 1405602 - DNA, 15 bp, Homo sapiens
atgtacagattcttt

SEQ ID NO: 1405603 - DNA, 18 bp, Homo sapiens
atgtacagattctttcag

SEQ ID NO: 1405604 - DNA, 16 bp, Homo sapiens
atgtaggtaagactgt

SEQ ID NO: 1405605 - DNA, 16 bp, Homo sapiens
atgtataaatatacag

SEQ ID NO: 1405606 - DNA, 17 bp, Homo sapiens
atgtataaatatacagt

SEQ ID NO: 1405607 - DNA, 17 bp, Homo sapiens
atgtattcttttctcag

SEQ ID NO: 1405608 - DNA, 17 bp, Homo sapiens
atgtctcctgcatagct

SEQ ID NO: 1405609 - DNA, 20 bp, Homo sapiens
atgtgagtgacgatgatgta

SEQ ID NO: 1405610 - DNA, 15 bp, Homo sapiens
atgtgatacattttt

SEQ ID NO: 1405611 - DNA, 21 bp, Homo sapiens
atgtgatacattttttaagct

SEQ ID NO: 1405612 - DNA, 17 bp, Homo sapiens
atgttaaagagaatgag

SEQ ID NO: 1405613 - DNA, 18 bp, Homo sapiens
atgttaaagagaatgagt

SEQ ID NO: 1405614 - DNA, 18 bp, Homo sapiens
atgttgagacctcagctt

SEQ ID NO: 1405615 - DNA, 16 bp, Homo sapiens
atgtttcttttaaaga

SEQ ID NO: 1405616 - DNA, 14 bp, Homo sapiens
attaagcaaatgtt

SEQ ID NO: 1405617 - DNA, 17 bp, Homo sapiens
attaagcaaatgttaaa

SEQ ID NO: 1405618 - DNA, 19 bp, Homo sapiens
attaagctctcatagctca

SEQ ID NO: 1405619 - DNA, 18 bp, Homo sapiens
attaaggggaagaatgaa

SEQ ID NO: 1405620 - DNA, 19 bp, Homo sapiens
attaaggggaagaatgaaa

SEQ ID NO: 1405621 - DNA, 23 bp, Homo sapiens
attaatattcagggtaaatagga

SEQ ID NO: 1405622 - DNA, 17 bp, Homo sapiens
attaatgttttcaaaag

SEQ ID NO: 1405623 - DNA, 21 bp, Homo sapiens
attactgacatttcttctagt

SEQ ID NO: 1405624 - DNA, 21 bp, Homo sapiens
attatacatgtgatacatttt

SEQ ID NO: 1405625 - DNA, 22 bp, Homo sapiens
attatacatgtgatacattttt

SEQ ID NO: 1405626 - DNA, 23 bp, Homo sapiens
attatgagattggttttcctgtg

SEQ ID NO: 1405627 - DNA, 19 bp, Homo sapiens
attatttttataattgtac

SEQ ID NO: 1405628 - DNA, 17 bp, Homo sapiens
attatttttttaaaatt

SEQ ID NO: 1405629 - DNA, 20 bp, Homo sapiens
attatttttttaaaattttg

SEQ ID NO: 1405630 - DNA, 14 bp, Homo sapiens
attcaactttgtaa

SEQ ID NO: 1405631 - DNA, 15 bp, Homo sapiens
attcaactttgtaaa

SEQ ID NO: 1405632 - DNA, 13 bp, Homo sapiens
attcagaaatgtt

SEQ ID NO: 1405633 - DNA, 19 bp, Homo sapiens
attccagatctttcagaaa

SEQ ID NO: 1405634 - DNA, 20 bp, Homo sapiens
attccagatctttcagaaat

SEQ ID NO: 1405635 - DNA, 17 bp, Homo sapiens
attccagtcccctttct

SEQ ID NO: 1405636 - DNA, 17 bp, Homo sapiens
attccccactcagcctt

SEQ ID NO: 1405637 - DNA, 15 bp, Homo sapiens
attcctccagccctg

SEQ ID NO: 1405638 - DNA, 20 bp, Homo sapiens
attctaacgcaaaaatagct

SEQ ID NO: 1405639 - DNA, 18 bp, Homo sapiens
attctctcttgtccttca

SEQ ID NO: 1405640 - DNA, 21 bp, Homo sapiens
attctgattctggctttaagc

SEQ ID NO: 1405641 - DNA, 15 bp, Homo sapiens
attgagtattgttta

SEQ ID NO: 1405642 - DNA, 15 bp, Homo sapiens
attgcatactttgta

SEQ ID NO: 1405643 - DNA, 15 bp, Homo sapiens
attgcatcactgtat

SEQ ID NO: 1405644 - DNA, 16 bp, Homo sapiens
attgcatcactgtatc

SEQ ID NO: 1405645 - DNA, 13 bp, Homo sapiens
attgcctctgaaa

SEQ ID NO: 1405646 - DNA, 17 bp, Homo sapiens
atttaaaaaataaataa

SEQ ID NO: 1405647 - DNA, 13 bp, Homo sapiens
atttaaatgaaag

SEQ ID NO: 1405648 - DNA, 20 bp, Homo sapiens
atttaagacaagttcaacaa

SEQ ID NO: 1405649 - DNA, 20 bp, Homo sapiens
atttaatccagttataagaa

SEQ ID NO: 1405650 - DNA, 23 bp, Homo sapiens
atttaggtcagtagactgtgatt

SEQ ID NO: 1405651 - DNA, 16 bp, Homo sapiens
atttcaaaaacatgct

SEQ ID NO: 1405652 - DNA, 18 bp, Homo sapiens
atttcactactagattga

SEQ ID NO: 1405653 - DNA, 15 bp, Homo sapiens
atttccctctgatat

SEQ ID NO: 1405654 - DNA, 14 bp, Homo sapiens
atttctaagccttt

SEQ ID NO: 1405655 - DNA, 17 bp, Homo sapiens
atttctcattgactttt

SEQ ID NO: 1405656 - DNA, 21 bp, Homo sapiens
atttcttttgtaataaactat

SEQ ID NO: 1405657 - DNA, 18 bp, Homo sapiens
atttgattgggatgaatg

SEQ ID NO: 1405658 - DNA, 21 bp, Homo sapiens
atttgccaagtctcccaatat

SEQ ID NO: 1405659 - DNA, 11 bp, Homo sapiens
atttgctctgg

SEQ ID NO: 1405660 - DNA, 21 bp, Homo sapiens
attttaaaatgaaatgcattt

SEQ ID NO: 1405661 - DNA, 20 bp, Homo sapiens
attttagatttaccttgtta

SEQ ID NO: 1405662 - DNA, 12 bp, Homo sapiens
atttttataatt

SEQ ID NO: 1405663 - DNA, 17 bp, Homo sapiens
atttttttaaaattttg

SEQ ID NO: 1405664 - DNA, 13 bp, Homo sapiens
atttttttctatt

SEQ ID NO: 1405665 - DNA, 16 bp, Homo sapiens
caaaattaagcaaatg

SEQ ID NO: 1405666 - DNA, 22 bp, Homo sapiens
caaaattaagcaaatgttaaaa

SEQ ID NO: 1405667 - DNA, 15 bp, Homo sapiens
caaacctttgagtag

SEQ ID NO: 1405668 - DNA, 16 bp, Homo sapiens
caaagccttctcccta

SEQ ID NO: 1405669 - DNA, 14 bp, Homo sapiens
caaataagaaataa

SEQ ID NO: 1405670 - DNA, 17 bp, Homo sapiens
caaatacacatttgcta

SEQ ID NO: 1405671 - DNA, 23 bp, Homo sapiens
caaatatcagtgggctctcttac

SEQ ID NO: 1405672 - DNA, 16 bp, Homo sapiens
caaatgagctctgaaa

SEQ ID NO: 1405673 - DNA, 14 bp, Homo sapiens
caaatgcctgccaa

SEQ ID NO: 1405674 - DNA, 18 bp, Homo sapiens
caaatgcctgccaaattt

SEQ ID NO: 1405675 - DNA, 22 bp, Homo sapiens
caaatggctacatctccaaata

SEQ ID NO: 1405676 - DNA, 14 bp, Homo sapiens
caaattgcatttgt

SEQ ID NO: 1405677 - DNA, 18 bp, Homo sapiens
caacaagttgaagaagct

SEQ ID NO: 1405678 - DNA, 16 bp, Homo sapiens
caagagataagtcttt

SEQ ID NO: 1405679 - DNA, 19 bp, Homo sapiens
caagcaaatgcctgccaaa

SEQ ID NO: 1405680 - DNA, 12 bp, Homo sapiens
caaggagataag

SEQ ID NO: 1405681 - DNA, 17 bp, Homo sapiens
caaggctactacagaga

SEQ ID NO: 1405682 - DNA, 21 bp, Homo sapiens
caatacctggcctcatttaaa

SEQ ID NO: 1405683 - DNA, 22 bp, Homo sapiens
caataggagtggtgatttgaaa

SEQ ID NO: 1405684 - DNA, 20 bp, Homo sapiens
caatatccaattttaaaatg

SEQ ID NO: 1405685 - DNA, 17 bp, Homo sapiens
caatatcccttacttta

SEQ ID NO: 1405686 - DNA, 23 bp, Homo sapiens
caatattgattgggaaaacattt

SEQ ID NO: 1405687 - DNA, 17 bp, Homo sapiens
caatctctttttgtttg

SEQ ID NO: 1405688 - DNA, 17 bp, Homo sapiens
caatgaaccataaattc

SEQ ID NO: 1405689 - DNA, 17 bp, Homo sapiens
caattttaaaatgaaat

SEQ ID NO: 1405690 - DNA, 24 bp, Homo sapiens
caattttaaaatgaaatgcatttt

SEQ ID NO: 1405691 - DNA, 15 bp, Homo sapiens
cacaaatggctacat

SEQ ID NO: 1405692 - DNA, 15 bp, Homo sapiens
cacactgtggcctga

SEQ ID NO: 1405693 - DNA, 14 bp, Homo sapiens
cacatcaaataaga

SEQ ID NO: 1405694 - DNA, 17 bp, Homo sapiens
cacatgatttgggctct

SEQ ID NO: 1405695 - DNA, 15 bp, Homo sapiens
cacatttctaagcct

SEQ ID NO: 1405696 - DNA, 21 bp, Homo sapiens
cacatttgctactgttgtaag

SEQ ID NO: 1405697 - DNA, 17 bp, Homo sapiens
caccaggcaagaaaagc

SEQ ID NO: 1405698 - DNA, 22 bp, Homo sapiens
cacccatgttgagacctcagct

SEQ ID NO: 1405699 - DNA, 13 bp, Homo sapiens
caccgccagccgc

SEQ ID NO: 1405700 - DNA, 17 bp, Homo sapiens
cacctctttgctccctg

SEQ ID NO: 1405701 - DNA, 14 bp, Homo sapiens
cacctgcagccaag

SEQ ID NO: 1405702 - DNA, 23 bp, Homo sapiens
cacctgcagccaagcaaatgcct

SEQ ID NO: 1405703 - DNA, 17 bp, Homo sapiens
cacctgtgggccagccg

SEQ ID NO: 1405704 - DNA, 13 bp, Homo sapiens
caccttccaaaga

SEQ ID NO: 1405705 - DNA, 19 bp, Homo sapiens
cacggatcacgatgtaaat

SEQ ID NO: 1405706 - DNA, 15 bp, Homo sapiens
cactctctaccagat

SEQ ID NO: 1405707 - DNA, 21 bp, Homo sapiens
cagaaatataacacatttttt

SEQ ID NO: 1405708 - DNA, 23 bp, Homo sapiens
cagaagccaatctacaatctctt

SEQ ID NO: 1405709 - DNA, 20 bp, Homo sapiens
cagaatggaatgctctggtc

SEQ ID NO: 1405710 - DNA, 17 bp, Homo sapiens
cagaatttccctctgat

SEQ ID NO: 1405711 - DNA, 15 bp, Homo sapiens
cagagctagaggcca

SEQ ID NO: 1405712 - DNA, 18 bp, Homo sapiens
cagagctggtggacccag

SEQ ID NO: 1405713 - DNA, 14 bp, Homo sapiens
cagagttttcatta

SEQ ID NO: 1405714 - DNA, 18 bp, Homo sapiens
cagataccttatcttaca

SEQ ID NO: 1405715 - DNA, 22 bp, Homo sapiens
cagatcttggactcatgaggag

SEQ ID NO: 1405716 - DNA, 17 bp, Homo sapiens
cagatctttcagaaata

SEQ ID NO: 1405717 - DNA, 19 bp, Homo sapiens
cagcattctcaggcaccag

SEQ ID NO: 1405718 - DNA, 20 bp, Homo sapiens
cagcattctcaggcaccagt

SEQ ID NO: 1405719 - DNA, 15 bp, Homo sapiens
cagcctactctcctt

SEQ ID NO: 1405720 - DNA, 21 bp, Homo sapiens
cagccttgcaaatagccagtg

SEQ ID NO: 1405721 - DNA, 12 bp, Homo sapiens
caggactctgac

SEQ ID NO: 1405722 - DNA, 14 bp, Homo sapiens
caggactctgaccc

SEQ ID NO: 1405723 - DNA, 15 bp, Homo sapiens
caggatttgcacaga

SEQ ID NO: 1405724 - DNA, 13 bp, Homo sapiens
caggcaagaaaag

SEQ ID NO: 1405725 - DNA, 20 bp, Homo sapiens
caggcaagaaaagcgcagag

SEQ ID NO: 1405726 - DNA, 18 bp, Homo sapiens
cagggaaaacacagatgt

SEQ ID NO: 1405727 - DNA, 22 bp, Homo sapiens
cagggagatttgctcaatacct

SEQ ID NO: 1405728 - DNA, 16 bp, Homo sapiens
caggtcccctttcaga

SEQ ID NO: 1405729 - DNA, 13 bp, Homo sapiens
caggtcgcccacc

SEQ ID NO: 1405730 - DNA, 16 bp, Homo sapiens
caggtcgcccacctgt

SEQ ID NO: 1405731 - DNA, 18 bp, Homo sapiens
cagtaacccccttaaatt

SEQ ID NO: 1405732 - DNA, 20 bp, Homo sapiens
cagtaacccccttaaattta

SEQ ID NO: 1405733 - DNA, 14 bp, Homo sapiens
cagtttgttggaaa

SEQ ID NO: 1405734 - DNA, 16 bp, Homo sapiens
cataaattcaactttg

SEQ ID NO: 1405735 - DNA, 17 bp, Homo sapiens
cataagcttccatttta

SEQ ID NO: 1405736 - DNA, 19 bp, Homo sapiens
cataagcttccattttaat

SEQ ID NO: 1405737 - DNA, 22 bp, Homo sapiens
catacaccccctcttctgagca

SEQ ID NO: 1405738 - DNA, 23 bp, Homo sapiens
catacaccccctcttctgagcac

SEQ ID NO: 1405739 - DNA, 16 bp, Homo sapiens
catactttgtattttg

SEQ ID NO: 1405740 - DNA, 14 bp, Homo sapiens
catagacatgaaag

SEQ ID NO: 1405741 - DNA, 16 bp, Homo sapiens
catagacatgaaaggt

SEQ ID NO: 1405742 - DNA, 16 bp, Homo sapiens
catagataatattgtt

SEQ ID NO: 1405743 - DNA, 22 bp, Homo sapiens
catagataatattgtttggtaa

SEQ ID NO: 1405744 - DNA, 20 bp, Homo sapiens
catattaacaaattgcattt

SEQ ID NO: 1405745 - DNA, 21 bp, Homo sapiens
catattaacaaattgcatttg

SEQ ID NO: 1405746 - DNA, 17 bp, Homo sapiens
catcaaacctttgagta

SEQ ID NO: 1405747 - DNA, 21 bp, Homo sapiens
catcatttatcatcacaaatg

SEQ ID NO: 1405748 - DNA, 16 bp, Homo sapiens
catcatttgtattatg

SEQ ID NO: 1405749 - DNA, 13 bp, Homo sapiens
catctatctagtt

SEQ ID NO: 1405750 - DNA, 21 bp, Homo sapiens
catctccaaatatcagtgggc

SEQ ID NO: 1405751 - DNA, 19 bp, Homo sapiens
catctcgctccctcccagg

SEQ ID NO: 1405752 - DNA, 21 bp, Homo sapiens
catctcgctccctcccaggac

SEQ ID NO: 1405753 - DNA, 21 bp, Homo sapiens
catgaggaggggcccccctgc

SEQ ID NO: 1405754 - DNA, 22 bp, Homo sapiens
catgaggaggggcccccctgcc

SEQ ID NO: 1405755 - DNA, 16 bp, Homo sapiens
catgcaaatgagctct

SEQ ID NO: 1405756 - DNA, 14 bp, Homo sapiens
catgcaataaaatt

SEQ ID NO: 1405757 - DNA, 19 bp, Homo sapiens
catgcatgcaaatgagctc

SEQ ID NO: 1405758 - DNA, 18 bp, Homo sapiens
catggctgctgttgctta

SEQ ID NO: 1405759 - DNA, 15 bp, Homo sapiens
catgtatttgagcat

SEQ ID NO: 1405760 - DNA, 19 bp, Homo sapiens
catgtgagaatatttttcc

SEQ ID NO: 1405761 - DNA, 18 bp, Homo sapiens
catgtgagctcttcctat

SEQ ID NO: 1405762 - DNA, 18 bp, Homo sapiens
cattaaggggaagaatga

SEQ ID NO: 1405763 - DNA, 17 bp, Homo sapiens
cattagctttaattaag

SEQ ID NO: 1405764 - DNA, 15 bp, Homo sapiens
cattcagaaatgttg

SEQ ID NO: 1405765 - DNA, 21 bp, Homo sapiens
cattctggtcaagggctgtca

SEQ ID NO: 1405766 - DNA, 23 bp, Homo sapiens
cattctggtcaagggctgtcatt

SEQ ID NO: 1405767 - DNA, 16 bp, Homo sapiens
cattgacttttataaa

SEQ ID NO: 1405768 - DNA, 22 bp, Homo sapiens
cattgagtattgtttaaaatgt

SEQ ID NO: 1405769 - DNA, 19 bp, Homo sapiens
cattgcacataagcttcca

SEQ ID NO: 1405770 - DNA, 21 bp, Homo sapiens
cattggaaaatttaagacaag

SEQ ID NO: 1405771 - DNA, 14 bp, Homo sapiens
catttagtaagaat

SEQ ID NO: 1405772 - DNA, 14 bp, Homo sapiens
catttccattgctt

SEQ ID NO: 1405773 - DNA, 16 bp, Homo sapiens
catttccattgcttat

SEQ ID NO: 1405774 - DNA, 20 bp, Homo sapiens
catttggcctcttgtagtct

SEQ ID NO: 1405775 - DNA, 13 bp, Homo sapiens
cattttttaagct

SEQ ID NO: 1405776 - DNA, 17 bp, Homo sapiens
ccaacaagttgaagaag

SEQ ID NO: 1405777 - DNA, 15 bp, Homo sapiens
ccaaccacagaggat

SEQ ID NO: 1405778 - DNA, 18 bp, Homo sapiens
ccaatatcccttacttta

SEQ ID NO: 1405779 - DNA, 17 bp, Homo sapiens
ccaattttaaaatgaaa

SEQ ID NO: 1405780 - DNA, 17 bp, Homo sapiens
ccacacttgaaaccttt

SEQ ID NO: 1405781 - DNA, 23 bp, Homo sapiens
ccacatatttcaaaaacatgctt

SEQ ID NO: 1405782 - DNA, 18 bp, Homo sapiens
ccacatcttccatttcca

SEQ ID NO: 1405783 - DNA, 14 bp, Homo sapiens
ccagagctggtgga

SEQ ID NO: 1405784 - DNA, 18 bp, Homo sapiens
ccagagctggtggaccca

SEQ ID NO: 1405785 - DNA, 16 bp, Homo sapiens
ccagatctttcagaaa

SEQ ID NO: 1405786 - DNA, 16 bp, Homo sapiens
ccagcattctcaggca

SEQ ID NO: 1405787 - DNA, 16 bp, Homo sapiens
ccagccgattcctcca

SEQ ID NO: 1405788 - DNA, 13 bp, Homo sapiens
ccaggactctgac

SEQ ID NO: 1405789 - DNA, 18 bp, Homo sapiens
ccaggactctgaccccag

SEQ ID NO: 1405790 - DNA, 13 bp, Homo sapiens
ccaggcaagaaaa

SEQ ID NO: 1405791 - DNA, 15 bp, Homo sapiens
ccaggcaagaaaagc

SEQ ID NO: 1405792 - DNA, 21 bp, Homo sapiens
ccaggcaagaaaagcgcagag

SEQ ID NO: 1405793 - DNA, 22 bp, Homo sapiens
ccaggctattcggcaaggaagt

SEQ ID NO: 1405794 - DNA, 21 bp, Homo sapiens
ccagtgctagttctgacccaa

SEQ ID NO: 1405795 - DNA, 12 bp, Homo sapiens
ccagttcaaaaa

SEQ ID NO: 1405796 - DNA, 19 bp, Homo sapiens
ccatacaccccctcttctg

SEQ ID NO: 1405797 - DNA, 20 bp, Homo sapiens
ccatattaacaaattgcatt

SEQ ID NO: 1405798 - DNA, 13 bp, Homo sapiens
ccatgtcccctcc

SEQ ID NO: 1405799 - DNA, 15 bp, Homo sapiens
ccatgtcccctccca

SEQ ID NO: 1405800 - DNA, 22 bp, Homo sapiens
ccattacagaggtattaaaact

SEQ ID NO: 1405801 - DNA, 17 bp, Homo sapiens
ccattgcttattatgta

SEQ ID NO: 1405802 - DNA, 22 bp, Homo sapiens
ccattggaaaatttaagacaag

SEQ ID NO: 1405803 - DNA, 14 bp, Homo sapiens
ccattttaatttta

SEQ ID NO: 1405804 - DNA, 21 bp, Homo sapiens
ccattttaattttaaagtgca

SEQ ID NO: 1405805 - DNA, 15 bp, Homo sapiens
cccaggactctgacc

SEQ ID NO: 1405806 - DNA, 23 bp, Homo sapiens
cccaggactctgaccccagcatt

SEQ ID NO: 1405807 - DNA, 18 bp, Homo sapiens
cccatattaacaaattgc

SEQ ID NO: 1405808 - DNA, 21 bp, Homo sapiens
cccatattaacaaattgcatt

SEQ ID NO: 1405809 - DNA, 18 bp, Homo sapiens
cccatcttcgggaccagg

SEQ ID NO: 1405810 - DNA, 19 bp, Homo sapiens
ccccagcattctcaggcac

SEQ ID NO: 1405811 - DNA, 22 bp, Homo sapiens
ccccagcattctcaggcaccag

SEQ ID NO: 1405812 - DNA, 16 bp, Homo sapiens
ccccatcttcgggacc

SEQ ID NO: 1405813 - DNA, 18 bp, Homo sapiens
cccccatcttcgggacca

SEQ ID NO: 1405814 - DNA, 21 bp, Homo sapiens
cccccgacgtgctcccctgct

SEQ ID NO: 1405815 - DNA, 12 bp, Homo sapiens
cccctgccctgt

SEQ ID NO: 1405816 - DNA, 12 bp, Homo sapiens
ccctccactctc

SEQ ID NO: 1405817 - DNA, 15 bp, Homo sapiens
ccctcttctgagcac

SEQ ID NO: 1405818 - DNA, 13 bp, Homo sapiens
ccctgccctgtgg

SEQ ID NO: 1405819 - DNA, 15 bp, Homo sapiens
ccctgccctgtgggg

SEQ ID NO: 1405820 - DNA, 19 bp, Homo sapiens
ccctttaaccctcacactg

SEQ ID NO: 1405821 - DNA, 18 bp, Homo sapiens
ccgaagtctgatccctgc

SEQ ID NO: 1405822 - DNA, 14 bp, Homo sapiens
ccgacgtcatgtat

SEQ ID NO: 1405823 - DNA, 20 bp, Homo sapiens
ccggaatgccacccacatct

SEQ ID NO: 1405824 - DNA, 23 bp, Homo sapiens
cctaaaataacagtatgtgggat

SEQ ID NO: 1405825 - DNA, 15 bp, Homo sapiens
cctatccctctccta

SEQ ID NO: 1405826 - DNA, 15 bp, Homo sapiens
cctccatgtgagaat

SEQ ID NO: 1405827 - DNA, 17 bp, Homo sapiens
cctcccaggactctgac

SEQ ID NO: 1405828 - DNA, 19 bp, Homo sapiens
cctcttgtagtcttggcta

SEQ ID NO: 1405829 - DNA, 22 bp, Homo sapiens
cctgacaccaggcaagaaaagc

SEQ ID NO: 1405830 - DNA, 14 bp, Homo sapiens
cctgcatagctttt

SEQ ID NO: 1405831 - DNA, 22 bp, Homo sapiens
cctgctcggcaccgccagccgc

SEQ ID NO: 1405832 - DNA, 22 bp, Homo sapiens
cctgcttaatcttcaaagcctt

SEQ ID NO: 1405833 - DNA, 17 bp, Homo sapiens
cctggcatttggcctct

SEQ ID NO: 1405834 - DNA, 15 bp, Homo sapiens
cctgtggcataaatt

SEQ ID NO: 1405835 - DNA, 13 bp, Homo sapiens
cctgtgggccagc

SEQ ID NO: 1405836 - DNA, 20 bp, Homo sapiens
ccttactttaaccctttctg

SEQ ID NO: 1405837 - DNA, 17 bp, Homo sapiens
ccttatagtctaagact

SEQ ID NO: 1405838 - DNA, 15 bp, Homo sapiens
cctttctctctctaa

SEQ ID NO: 1405839 - DNA, 16 bp, Homo sapiens
ccttttttttttcttg

SEQ ID NO: 1405840 - DNA, 16 bp, Homo sapiens
cgacgtgctcccctgc

SEQ ID NO: 1405841 - DNA, 10 bp, Homo sapiens
cgcagagaaa

SEQ ID NO: 1405842 - DNA, 21 bp, Homo sapiens
cgcagagaaatcggtgtctga

SEQ ID NO: 1405843 - DNA, 15 bp, Homo sapiens
cggcaccgccagccg

SEQ ID NO: 1405844 - DNA, 14 bp, Homo sapiens
cggggtcaggttct

SEQ ID NO: 1405845 - DNA, 13 bp, Homo sapiens
cgtccatctccct

SEQ ID NO: 1405846 - DNA, 18 bp, Homo sapiens
ctaacgcaaaaatagctc

SEQ ID NO: 1405847 - DNA, 22 bp, Homo sapiens
ctaacgcaaaaatagctcttgc

SEQ ID NO: 1405848 - DNA, 23 bp, Homo sapiens
ctaacgcaaaaatagctcttgct

SEQ ID NO: 1405849 - DNA, 18 bp, Homo sapiens
ctaaggtccccagcagaa

SEQ ID NO: 1405850 - DNA, 20 bp, Homo sapiens
ctaagtaatctcacagcatt

SEQ ID NO: 1405851 - DNA, 20 bp, Homo sapiens
ctacagagaaggctgcctgc

SEQ ID NO: 1405852 - DNA, 13 bp, Homo sapiens
ctacatgtgagtg

SEQ ID NO: 1405853 - DNA, 17 bp, Homo sapiens
ctaccctccatgtgaga

SEQ ID NO: 1405854 - DNA, 22 bp, Homo sapiens
ctactgttgtaagaattctgat

SEQ ID NO: 1405855 - DNA, 14 bp, Homo sapiens
ctagagcacaacat

SEQ ID NO: 1405856 - DNA, 18 bp, Homo sapiens
ctagagcacaacataatt

SEQ ID NO: 1405857 - DNA, 12 bp, Homo sapiens
ctagccagccag

SEQ ID NO: 1405858 - DNA, 14 bp, Homo sapiens
ctagcttcttccat

SEQ ID NO: 1405859 - DNA, 16 bp, Homo sapiens
ctagttctaacagtga

SEQ ID NO: 1405860 - DNA, 15 bp, Homo sapiens
ctatagcttgcagaa

SEQ ID NO: 1405861 - DNA, 20 bp, Homo sapiens
ctatataaccacatttctaa

SEQ ID NO: 1405862 - DNA, 19 bp, Homo sapiens
ctattatttttataattgt

SEQ ID NO: 1405863 - DNA, 15 bp, Homo sapiens
ctcaaatacacattt

SEQ ID NO: 1405864 - DNA, 17 bp, Homo sapiens
ctcaatacctggcctca

SEQ ID NO: 1405865 - DNA, 20 bp, Homo sapiens
ctcaatgaaccataaattca

SEQ ID NO: 1405866 - DNA, 22 bp, Homo sapiens
ctcaatgcagttagctgaagaa

SEQ ID NO: 1405867 - DNA, 13 bp, Homo sapiens
ctcacagcatttg

SEQ ID NO: 1405868 - DNA, 15 bp, Homo sapiens
ctcagccttttggga

SEQ ID NO: 1405869 - DNA, 14 bp, Homo sapiens
ctcaggcaccagtc

SEQ ID NO: 1405870 - DNA, 16 bp, Homo sapiens
ctccaccttccaaaga

SEQ ID NO: 1405871 - DNA, 17 bp, Homo sapiens
ctcccaatatccaattt

SEQ ID NO: 1405872 - DNA, 22 bp, Homo sapiens
ctcccagagctggtggacccag

SEQ ID NO: 1405873 - DNA, 21 bp, Homo sapiens
ctcccaggactctgaccccag

SEQ ID NO: 1405874 - DNA, 13 bp, Homo sapiens
ctccctcccagga

SEQ ID NO: 1405875 - DNA, 15 bp, Homo sapiens
ctcctccccttcctc

SEQ ID NO: 1405876 - DNA, 17 bp, Homo sapiens
ctcctgcatagcttttc

SEQ ID NO: 1405877 - DNA, 19 bp, Homo sapiens
ctccttgagtgtatgagta

SEQ ID NO: 1405878 - DNA, 22 bp, Homo sapiens
ctctaaaaggtaatgtgtggat

SEQ ID NO: 1405879 - DNA, 22 bp, Homo sapiens
ctctccgaagtctgatccctgc

SEQ ID NO: 1405880 - DNA, 23 bp, Homo sapiens
ctctgaaatcttcccatgcattc

SEQ ID NO: 1405881 - DNA, 20 bp, Homo sapiens
ctctgatatgtctagggtgt

SEQ ID NO: 1405882 - DNA, 20 bp, Homo sapiens
ctcttcctatccctctccta

SEQ ID NO: 1405883 - DNA, 21 bp, Homo sapiens
ctgaaatcttcccatgcattc

SEQ ID NO: 1405884 - DNA, 18 bp, Homo sapiens
ctgaagaattgaaaagtt

SEQ ID NO: 1405885 - DNA, 12 bp, Homo sapiens
ctgacatcattt

SEQ ID NO: 1405886 - DNA, 13 bp, Homo sapiens
ctgacatcatttg

SEQ ID NO: 1405887 - DNA, 16 bp, Homo sapiens
ctgacatcatttgtat

SEQ ID NO: 1405888 - DNA, 14 bp, Homo sapiens
ctgacatttcttct

SEQ ID NO: 1405889 - DNA, 23 bp, Homo sapiens
ctgatatgtctagggtgtgattt

SEQ ID NO: 1405890 - DNA, 18 bp, Homo sapiens
ctgatcagcaggagccaa

SEQ ID NO: 1405891 - DNA, 15 bp, Homo sapiens
ctgattctggcttta

SEQ ID NO: 1405892 - DNA, 19 bp, Homo sapiens
ctgattctggctttaagcc

SEQ ID NO: 1405893 - DNA, 23 bp, Homo sapiens
ctgcagagatttctcattgactt

SEQ ID NO: 1405894 - DNA, 13 bp, Homo sapiens
ctgcatagctttt

SEQ ID NO: 1405895 - DNA, 21 bp, Homo sapiens
ctgccaaaaagtggctggaag

SEQ ID NO: 1405896 - DNA, 23 bp, Homo sapiens
ctgccattacagaggtattaaaa

SEQ ID NO: 1405897 - DNA, 19 bp, Homo sapiens
ctgccccccccccccatct

SEQ ID NO: 1405898 - DNA, 22 bp, Homo sapiens
ctgctccagtttcacctctttg

SEQ ID NO: 1405899 - DNA, 17 bp, Homo sapiens
ctgctcggcaccgccag

SEQ ID NO: 1405900 - DNA, 21 bp, Homo sapiens
ctgctcggcaccgccagccgc

SEQ ID NO: 1405901 - DNA, 20 bp, Homo sapiens
ctgtagatatgtattctttt

SEQ ID NO: 1405902 - DNA, 20 bp, Homo sapiens
ctgtccggaatgccacccac

SEQ ID NO: 1405903 - DNA, 20 bp, Homo sapiens
ctgtgaagatctcactctgc

SEQ ID NO: 1405904 - DNA, 13 bp, Homo sapiens
ctgttatgggctt

SEQ ID NO: 1405905 - DNA, 21 bp, Homo sapiens
cttaaaataaagttaaactga

SEQ ID NO: 1405906 - DNA, 16 bp, Homo sapiens
cttaaatttaatacca

SEQ ID NO: 1405907 - DNA, 15 bp, Homo sapiens
cttacctaacatctg

SEQ ID NO: 1405908 - DNA, 17 bp, Homo sapiens
cttagcaaaaaatgaac

SEQ ID NO: 1405909 - DNA, 23 bp, Homo sapiens
cttagggactacccatagacatg

SEQ ID NO: 1405910 - DNA, 23 bp, Homo sapiens
cttagtatattattattaattac

SEQ ID NO: 1405911 - DNA, 21 bp, Homo sapiens
cttatagtctaagactatata

SEQ ID NO: 1405912 - DNA, 16 bp, Homo sapiens
cttattgaccattttt

SEQ ID NO: 1405913 - DNA, 14 bp, Homo sapiens
cttcagttgcttgt

SEQ ID NO: 1405914 - DNA, 23 bp, Homo sapiens
cttcagttgcttgtcttctggta

SEQ ID NO: 1405915 - DNA, 24 bp, Homo sapiens
cttccctttaaccctcacactgct

SEQ ID NO: 1405916 - DNA, 16 bp, Homo sapiens
cttcctcttgtctgat

SEQ ID NO: 1405917 - DNA, 18 bp, Homo sapiens
cttcctcttgtctgattt

SEQ ID NO: 1405918 - DNA, 14 bp, Homo sapiens
cttcgggaccagga

SEQ ID NO: 1405919 - DNA, 16 bp, Homo sapiens
cttctccctagctcct

SEQ ID NO: 1405920 - DNA, 14 bp, Homo sapiens
cttctggaaactgt

SEQ ID NO: 1405921 - DNA, 15 bp, Homo sapiens
cttctggtactttct

SEQ ID NO: 1405922 - DNA, 19 bp, Homo sapiens
cttgatttcaaagttttgt

SEQ ID NO: 1405923 - DNA, 14 bp, Homo sapiens
cttgcagaactgta

SEQ ID NO: 1405924 - DNA, 16 bp, Homo sapiens
cttgtagtcttggcta

SEQ ID NO: 1405925 - DNA, 18 bp, Homo sapiens
cttgtcttctggtacttt

SEQ ID NO: 1405926 - DNA, 21 bp, Homo sapiens
cttgtcttctggtactttctg

SEQ ID NO: 1405927 - DNA, 15 bp, Homo sapiens
ctttaaccctttctg

SEQ ID NO: 1405928 - DNA, 21 bp, Homo sapiens
ctttagtttttggttgggaat

SEQ ID NO: 1405929 - DNA, 15 bp, Homo sapiens
ctttattaatgtttt

SEQ ID NO: 1405930 - DNA, 19 bp, Homo sapiens
ctttattaatgttttcaaa

SEQ ID NO: 1405931 - DNA, 22 bp, Homo sapiens
ctttcagaaatataacacattt

SEQ ID NO: 1405932 - DNA, 17 bp, Homo sapiens
ctttcattttgcacctg

SEQ ID NO: 1405933 - DNA, 22 bp, Homo sapiens
ctttcattttgcacctgcagcc

SEQ ID NO: 1405934 - DNA, 15 bp, Homo sapiens
ctttgagactgttcc

SEQ ID NO: 1405935 - DNA, 14 bp, Homo sapiens
ctttggattctaaa

SEQ ID NO: 1405936 - DNA, 21 bp, Homo sapiens
ctttggattctaaatacatgc

SEQ ID NO: 1405937 - DNA, 16 bp, Homo sapiens
ctttgtaaaaatcttt

SEQ ID NO: 1405938 - DNA, 18 bp, Homo sapiens
cttttaaagaccctccta

SEQ ID NO: 1405939 - DNA, 12 bp, Homo sapiens
cttttgtaataa

SEQ ID NO: 1405940 - DNA, 14 bp, Homo sapiens
cttttgtaataaac

SEQ ID NO: 1405941 - DNA, 18 bp, Homo sapiens
cttttgtttggtaaatgt

SEQ ID NO: 1405942 - DNA, 14 bp, Homo sapiens
gaaaaagatctttc

SEQ ID NO: 1405943 - DNA, 16 bp, Homo sapiens
gaaaacatgttaatga

SEQ ID NO: 1405944 - DNA, 20 bp, Homo sapiens
gaaaacatgttaatgacaat

SEQ ID NO: 1405945 - DNA, 10 bp, Homo sapiens
gaaaagagaa

SEQ ID NO: 1405946 - DNA, 15 bp, Homo sapiens
gaaactgagggcaga

SEQ ID NO: 1405947 - DNA, 22 bp, Homo sapiens
gaaagcagagttttcattaaat

SEQ ID NO: 1405948 - DNA, 11 bp, Homo sapiens
gaaagtttttt

SEQ ID NO: 1405949 - DNA, 23 bp, Homo sapiens
gaaataatgctacaattttaaga

SEQ ID NO: 1405950 - DNA, 16 bp, Homo sapiens
gaaattgcatactttg

SEQ ID NO: 1405951 - DNA, 13 bp, Homo sapiens
gaaccataaattc

SEQ ID NO: 1405952 - DNA, 15 bp, Homo sapiens
gaaccataaattcaa

SEQ ID NO: 1405953 - DNA, 12 bp, Homo sapiens
gaagaatgaaag

SEQ ID NO: 1405954 - DNA, 18 bp, Homo sapiens
gaagaattgaaaagtttt

SEQ ID NO: 1405955 - DNA, 22 bp, Homo sapiens
gaagaattgaaaagtttttgtt

SEQ ID NO: 1405956 - DNA, 20 bp, Homo sapiens
gaagagttcccttgaaactt

SEQ ID NO: 1405957 - DNA, 22 bp, Homo sapiens
gaagctgagatgaaccctggca

SEQ ID NO: 1405958 - DNA, 17 bp, Homo sapiens
gaaggagaagtaagagg

SEQ ID NO: 1405959 - DNA, 14 bp, Homo sapiens
gaagggaaagtttt

SEQ ID NO: 1405960 - DNA, 17 bp, Homo sapiens
gaagtaaagtgaagaat

SEQ ID NO: 1405961 - DNA, 21 bp, Homo sapiens
gaagtctgatccctgccaaaa

SEQ ID NO: 1405962 - DNA, 22 bp, Homo sapiens
gaataccacatcaaataagaaa

SEQ ID NO: 1405963 - DNA, 17 bp, Homo sapiens
gaatgccacccacatct

SEQ ID NO: 1405964 - DNA, 17 bp, Homo sapiens
gaattgaaaagtttttg

SEQ ID NO: 1405965 - DNA, 24 bp, Homo sapiens
gaattgacagttgaacagagctag

SEQ ID NO: 1405966 - DNA, 14 bp, Homo sapiens
gaatttatctcttt

SEQ ID NO: 1405967 - DNA, 18 bp, Homo sapiens
gacaccaggcaagaaaag

SEQ ID NO: 1405968 - DNA, 15 bp, Homo sapiens
gacatgcaataaaat

SEQ ID NO: 1405969 - DNA, 19 bp, Homo sapiens
gaccattttttaatttact

SEQ ID NO: 1405970 - DNA, 20 bp, Homo sapiens
gaccattttttaatttactt

SEQ ID NO: 1405971 - DNA, 14 bp, Homo sapiens
gacgtgctcccctg

SEQ ID NO: 1405972 - DNA, 16 bp, Homo sapiens
gactaactcaaataca

SEQ ID NO: 1405973 - DNA, 20 bp, Homo sapiens
gactagagcacaacataatt

SEQ ID NO: 1405974 - DNA, 22 bp, Homo sapiens
gactagccagccaggaagatga

SEQ ID NO: 1405975 - DNA, 15 bp, Homo sapiens
gactcatgaggaggg

SEQ ID NO: 1405976 - DNA, 17 bp, Homo sapiens
gacttaggtgtgaagac

SEQ ID NO: 1405977 - DNA, 16 bp, Homo sapiens
gagaacccagtttccc

SEQ ID NO: 1405978 - DNA, 23 bp, Homo sapiens
gagaatgagtccttgatttcaaa

SEQ ID NO: 1405979 - DNA, 20 bp, Homo sapiens
gagacgtttataaacagaaa

SEQ ID NO: 1405980 - DNA, 17 bp, Homo sapiens
gagattggttttcctgt

SEQ ID NO: 1405981 - DNA, 12 bp, Homo sapiens
gagccttcagca

SEQ ID NO: 1405982 - DNA, 15 bp, Homo sapiens
gagctctgaaatctt

SEQ ID NO: 1405983 - DNA, 16 bp, Homo sapiens
gagctctgaaatcttc

SEQ ID NO: 1405984 - DNA, 22 bp, Homo sapiens
gaggaggggcccccctgccctg

SEQ ID NO: 1405985 - DNA, 18 bp, Homo sapiens
gaggccatgtctcctgca

SEQ ID NO: 1405986 - DNA, 20 bp, Homo sapiens
gagtattgtttaaaatgtaa

SEQ ID NO: 1405987 - DNA, 21 bp, Homo sapiens
gagtattgtttaaaatgtaat

SEQ ID NO: 1405988 - DNA, 23 bp, Homo sapiens
gagtcccttagtactcttctagc

SEQ ID NO: 1405989 - DNA, 14 bp, Homo sapiens
gataagaaagcagg

SEQ ID NO: 1405990 - DNA, 13 bp, Homo sapiens
gatagtaagcata

SEQ ID NO: 1405991 - DNA, 17 bp, Homo sapiens
gatagtgggatttccag

SEQ ID NO: 1405992 - DNA, 21 bp, Homo sapiens
gatatatagaaggactgcagc

SEQ ID NO: 1405993 - DNA, 16 bp, Homo sapiens
gatattgaatgttaaa

SEQ ID NO: 1405994 - DNA, 13 bp, Homo sapiens
gatctcactctgc

SEQ ID NO: 1405995 - DNA, 15 bp, Homo sapiens
gatctcactctgccc

SEQ ID NO: 1405996 - DNA, 16 bp, Homo sapiens
gatctttcagaaatat

SEQ ID NO: 1405997 - DNA, 16 bp, Homo sapiens
gatgctgacatcattt

SEQ ID NO: 1405998 - DNA, 15 bp, Homo sapiens
gatggcttgtctata

SEQ ID NO: 1405999 - DNA, 14 bp, Homo sapiens
gattctaaatacat

SEQ ID NO: 1406000 - DNA, 13 bp, Homo sapiens
gattgcctctgaa

SEQ ID NO: 1406001 - DNA, 22 bp, Homo sapiens
gatttcttttgtaataaactat

SEQ ID NO: 1406002 - DNA, 21 bp, Homo sapiens
gatttgaaaaatataaaatta

SEQ ID NO: 1406003 - DNA, 10 bp, Homo sapiens
gcaaagccag

SEQ ID NO: 1406004 - DNA, 15 bp, Homo sapiens
gcaaatgcctgccaa

SEQ ID NO: 1406005 - DNA, 23 bp, Homo sapiens
gcaaatgttaaaagttttatatg

SEQ ID NO: 1406006 - DNA, 20 bp, Homo sapiens
gcaagaaaagcgcagagaaa

SEQ ID NO: 1406007 - DNA, 14 bp, Homo sapiens
gcaaggctgattta

SEQ ID NO: 1406008 - DNA, 12 bp, Homo sapiens
gcaataaaattt

SEQ ID NO: 1406009 - DNA, 18 bp, Homo sapiens
gcacttattgaccatttt

SEQ ID NO: 1406010 - DNA, 19 bp, Homo sapiens
gcacttattgaccattttt

SEQ ID NO: 1406011 - DNA, 23 bp, Homo sapiens
gcacttattgaccattttttaat

SEQ ID NO: 1406012 - DNA, 16 bp, Homo sapiens
gcagagatttctcatt

SEQ ID NO: 1406013 - DNA, 16 bp, Homo sapiens
gcagatcttggactca

SEQ ID NO: 1406014 - DNA, 23 bp, Homo sapiens
gcatagataatattgtttggtaa

SEQ ID NO: 1406015 - DNA, 21 bp, Homo sapiens
gcatgcaaatgagctctgaaa

SEQ ID NO: 1406016 - DNA, 20 bp, Homo sapiens
gcatgtagaggcttgtttac

SEQ ID NO: 1406017 - DNA, 17 bp, Homo sapiens
gcattagctttaattaa

SEQ ID NO: 1406018 - DNA, 15 bp, Homo sapiens
gcattgagtattgtt

SEQ ID NO: 1406019 - DNA, 14 bp, Homo sapiens
gcatttgccaagtc

SEQ ID NO: 1406020 - DNA, 15 bp, Homo sapiens
gccatgtctcctgca

SEQ ID NO: 1406021 - DNA, 14 bp, Homo sapiens
gcccccctgccctg

SEQ ID NO: 1406022 - DNA, 16 bp, Homo sapiens
gccgattcctccagcc

SEQ ID NO: 1406023 - DNA, 20 bp, Homo sapiens
gcctgctatgtatttgcaag

SEQ ID NO: 1406024 - DNA, 22 bp, Homo sapiens
gccttcaaaactatagcttgca

SEQ ID NO: 1406025 - DNA, 14 bp, Homo sapiens
gccttggaaattcc

SEQ ID NO: 1406026 - DNA, 17 bp, Homo sapiens
gctaagcattagcttta

SEQ ID NO: 1406027 - DNA, 13 bp, Homo sapiens
gctacaattttaa

SEQ ID NO: 1406028 - DNA, 13 bp, Homo sapiens
gctagaggccatg

SEQ ID NO: 1406029 - DNA, 20 bp, Homo sapiens
gctccagtttcacctctttg

SEQ ID NO: 1406030 - DNA, 15 bp, Homo sapiens
gctcccctgctcggc

SEQ ID NO: 1406031 - DNA, 21 bp, Homo sapiens
gctcccctgctcggcaccgcc

SEQ ID NO: 1406032 - DNA, 19 bp, Homo sapiens
gctccctcccaggactctg

SEQ ID NO: 1406033 - DNA, 21 bp, Homo sapiens
gctccctcccaggactctgac

SEQ ID NO: 1406034 - DNA, 18 bp, Homo sapiens
gctcggcaccgccagccg

SEQ ID NO: 1406035 - DNA, 15 bp, Homo sapiens
gctctcatagctcat

SEQ ID NO: 1406036 - DNA, 19 bp, Homo sapiens
gctcttcctatccctctcc

SEQ ID NO: 1406037 - DNA, 16 bp, Homo sapiens
gctgaagaattgaaaa

SEQ ID NO: 1406038 - DNA, 16 bp, Homo sapiens
gctggtggacccaggg

SEQ ID NO: 1406039 - DNA, 21 bp, Homo sapiens
gctggtggacccagggaacag

SEQ ID NO: 1406040 - DNA, 22 bp, Homo sapiens
gcttaatcttcaaagccttctc

SEQ ID NO: 1406041 - DNA, 16 bp, Homo sapiens
gcttaatgctacatgt

SEQ ID NO: 1406042 - DNA, 18 bp, Homo sapiens
gcttaatggagttcttgt

SEQ ID NO: 1406043 - DNA, 15 bp, Homo sapiens
gcttcagttgcttgt

SEQ ID NO: 1406044 - DNA, 18 bp, Homo sapiens
gcttgtttacctttctct

SEQ ID NO: 1406045 - DNA, 13 bp, Homo sapiens
gctttaagccttc

SEQ ID NO: 1406046 - DNA, 12 bp, Homo sapiens
ggaaaacatttg

SEQ ID NO: 1406047 - DNA, 18 bp, Homo sapiens
ggaaactgagggcagaga

SEQ ID NO: 1406048 - DNA, 15 bp, Homo sapiens
ggaagggaaagtttt

SEQ ID NO: 1406049 - DNA, 17 bp, Homo sapiens
ggaatgaggaaaattct

SEQ ID NO: 1406050 - DNA, 22 bp, Homo sapiens
ggacatgcaataaaatttaaaa

SEQ ID NO: 1406051 - DNA, 16 bp, Homo sapiens
ggacccagggaacagc

SEQ ID NO: 1406052 - DNA, 12 bp, Homo sapiens
ggactgcagcca

SEQ ID NO: 1406053 - DNA, 19 bp, Homo sapiens
ggagatttgctcaatacct

SEQ ID NO: 1406054 - DNA, 15 bp, Homo sapiens
ggattctaaatacat

SEQ ID NO: 1406055 - DNA, 22 bp, Homo sapiens
ggatttgcacagaagcacatgc

SEQ ID NO: 1406056 - DNA, 19 bp, Homo sapiens
ggcaagaaaagcgcagaga

SEQ ID NO: 1406057 - DNA, 22 bp, Homo sapiens
ggcaagaaaagcgcagagaaat

SEQ ID NO: 1406058 - DNA, 17 bp, Homo sapiens
ggcaccagtccctgtcc

SEQ ID NO: 1406059 - DNA, 18 bp, Homo sapiens
ggcaccagtccctgtccg

SEQ ID NO: 1406060 - DNA, 19 bp, Homo sapiens
ggcagggaaaacacagatg

SEQ ID NO: 1406061 - DNA, 19 bp, Homo sapiens
ggcattgagtattgtttaa

SEQ ID NO: 1406062 - DNA, 13 bp, Homo sapiens
ggccagcgtggct

SEQ ID NO: 1406063 - DNA, 22 bp, Homo sapiens
ggcttgtctatactccttccct

SEQ ID NO: 1406064 - DNA, 22 bp, Homo sapiens
gggaacagccactcccctccac

SEQ ID NO: 1406065 - DNA, 18 bp, Homo sapiens
gggcagatcttggactca

SEQ ID NO: 1406066 - DNA, 22 bp, Homo sapiens
gggcagatcttggactcatgag

SEQ ID NO: 1406067 - DNA, 20 bp, Homo sapiens
gggcttaatggagttcttgt

SEQ ID NO: 1406068 - DNA, 22 bp, Homo sapiens
gggggcagatcttggactcatg

SEQ ID NO: 1406069 - DNA, 21 bp, Homo sapiens
ggtaaatgtttcttttaaaga

SEQ ID NO: 1406070 - DNA, 19 bp, Homo sapiens
ggtcaggttctaccctcca

SEQ ID NO: 1406071 - DNA, 13 bp, Homo sapiens
ggtccccagcaga

SEQ ID NO: 1406072 - DNA, 14 bp, Homo sapiens
gtaaagtgaagaat

SEQ ID NO: 1406073 - DNA, 14 bp, Homo sapiens
gtaaatgtttcttt

SEQ ID NO: 1406074 - DNA, 19 bp, Homo sapiens
gtaacagtcatcatttatc

SEQ ID NO: 1406075 - DNA, 23 bp, Homo sapiens
gtaatttaaatgaaagaaaattg

SEQ ID NO: 1406076 - DNA, 14 bp, Homo sapiens
gtacaaaattaagc

SEQ ID NO: 1406077 - DNA, 22 bp, Homo sapiens
gtagatccatttccattgctta

SEQ ID NO: 1406078 - DNA, 19 bp, Homo sapiens
gtagttttgtgatgcattt

SEQ ID NO: 1406079 - DNA, 13 bp, Homo sapiens
gtatatattttgt

SEQ ID NO: 1406080 - DNA, 22 bp, Homo sapiens
gtatatattttgtgtgaaattg

SEQ ID NO: 1406081 - DNA, 22 bp, Homo sapiens
gtatctagagcttaatgctaca

SEQ ID NO: 1406082 - DNA, 15 bp, Homo sapiens
gtatgtgggatattg

SEQ ID NO: 1406083 - DNA, 18 bp, Homo sapiens
gtatgttaaagagaatga

SEQ ID NO: 1406084 - DNA, 20 bp, Homo sapiens
gtattatacatgtgatacat

SEQ ID NO: 1406085 - DNA, 19 bp, Homo sapiens
gtcaacccttctggaaact

SEQ ID NO: 1406086 - DNA, 14 bp, Homo sapiens
gtcagtagactgtg

SEQ ID NO: 1406087 - DNA, 22 bp, Homo sapiens
gtcccctcccagagctggtgga

SEQ ID NO: 1406088 - DNA, 17 bp, Homo sapiens
gtcctagtaagaagaca

SEQ ID NO: 1406089 - DNA, 17 bp, Homo sapiens
gtcctctttagtttttg

SEQ ID NO: 1406090 - DNA, 16 bp, Homo sapiens
gtcctgacaccaggca

SEQ ID NO: 1406091 - DNA, 20 bp, Homo sapiens
gtcctgacaccaggcaagaa

SEQ ID NO: 1406092 - DNA, 19 bp, Homo sapiens
gtccttgatttcaaagttt

SEQ ID NO: 1406093 - DNA, 18 bp, Homo sapiens
gtctatataaccacattt

SEQ ID NO: 1406094 - DNA, 21 bp, Homo sapiens
gtctatataaccacatttcta

SEQ ID NO: 1406095 - DNA, 14 bp, Homo sapiens
gtctgatccctgcc

SEQ ID NO: 1406096 - DNA, 15 bp, Homo sapiens
gtgatacatttttta

SEQ ID NO: 1406097 - DNA, 14 bp, Homo sapiens
gtgatgcattttat

SEQ ID NO: 1406098 - DNA, 23 bp, Homo sapiens
gtgatttgaaaaatataaaatta

SEQ ID NO: 1406099 - DNA, 20 bp, Homo sapiens
gtggccccatattaacaaat

SEQ ID NO: 1406100 - DNA, 22 bp, Homo sapiens
gtgggccagccgattcctccag

SEQ ID NO: 1406101 - DNA, 22 bp, Homo sapiens
gtgtctccttaagctgcagaga

SEQ ID NO: 1406102 - DNA, 19 bp, Homo sapiens
gttaacagatttatctaag

SEQ ID NO: 1406103 - DNA, 13 bp, Homo sapiens
gttataagaagaa

SEQ ID NO: 1406104 - DNA, 12 bp, Homo sapiens
gttcccccatct

SEQ ID NO: 1406105 - DNA, 22 bp, Homo sapiens
gttctaacagtgaagttttact

SEQ ID NO: 1406106 - DNA, 20 bp, Homo sapiens
gttgcaaaggtaggttgaag

SEQ ID NO: 1406107 - DNA, 23 bp, Homo sapiens
gttgcaaaggtaggttgaaggga

SEQ ID NO: 1406108 - DNA, 18 bp, Homo sapiens
gttggtatattttatatt

SEQ ID NO: 1406109 - DNA, 15 bp, Homo sapiens
gttgtacttaaatgg

SEQ ID NO: 1406110 - DNA, 13 bp, Homo sapiens
gtttacctttctc

SEQ ID NO: 1406111 - DNA, 19 bp, Homo sapiens
gtttggtaaatgtttcttt

SEQ ID NO: 1406112 - DNA, 13 bp, Homo sapiens
gttttactgtcta

SEQ ID NO: 1406113 - DNA, 20 bp, Homo sapiens
gttttgtgatgcattttata

SEQ ID NO: 1406114 - DNA, 15 bp, Homo sapiens
gtttttgtttggaga

SEQ ID NO: 1406115 - DNA, 22 bp, Homo sapiens
taaaaggcccatagcagccagt

SEQ ID NO: 1406116 - DNA, 15 bp, Homo sapiens
taaaaggtaatgtgt

SEQ ID NO: 1406117 - DNA, 16 bp, Homo sapiens
taaaatgaaatgcatt

SEQ ID NO: 1406118 - DNA, 17 bp, Homo sapiens
taaaatgaaatgcattt

SEQ ID NO: 1406119 - DNA, 18 bp, Homo sapiens
taaaatgaaatgcatttt

SEQ ID NO: 1406120 - DNA, 16 bp, Homo sapiens
taaaatgtaatttaaa

SEQ ID NO: 1406121 - DNA, 23 bp, Homo sapiens
taaaattttgtatgttaaagaga

SEQ ID NO: 1406122 - DNA, 14 bp, Homo sapiens
taaacagaaatgga

SEQ ID NO: 1406123 - DNA, 22 bp, Homo sapiens
taaaccacttaaacgaagagtt

SEQ ID NO: 1406124 - DNA, 12 bp, Homo sapiens
taaactggctta

SEQ ID NO: 1406125 - DNA, 18 bp, Homo sapiens
taaactggcttaacttag

SEQ ID NO: 1406126 - DNA, 23 bp, Homo sapiens
taaacttctgcaacaagcatgca

SEQ ID NO: 1406127 - DNA, 14 bp, Homo sapiens
taaataaaaactaa

SEQ ID NO: 1406128 - DNA, 15 bp, Homo sapiens
taaattcaactttgt

SEQ ID NO: 1406129 - DNA, 16 bp, Homo sapiens
taaattcaactttgta

SEQ ID NO: 1406130 - DNA, 19 bp, Homo sapiens
taaattgcatcactgtatc

SEQ ID NO: 1406131 - DNA, 17 bp, Homo sapiens
taaatttaataccagat

SEQ ID NO: 1406132 - DNA, 14 bp, Homo sapiens
taacaaattgcatt

SEQ ID NO: 1406133 - DNA, 22 bp, Homo sapiens
taaccacatttctaagcctttg

SEQ ID NO: 1406134 - DNA, 15 bp, Homo sapiens
taaccacctacaagg

SEQ ID NO: 1406135 - DNA, 19 bp, Homo sapiens
taacgcaaaaatagctctt

SEQ ID NO: 1406136 - DNA, 21 bp, Homo sapiens
taacgcaaaaatagctcttgc

SEQ ID NO: 1406137 - DNA, 18 bp, Homo sapiens
taactcaaatacacattt

SEQ ID NO: 1406138 - DNA, 18 bp, Homo sapiens
taagaataccacatcaaa

SEQ ID NO: 1406139 - DNA, 13 bp, Homo sapiens
taagaattctgat

SEQ ID NO: 1406140 - DNA, 20 bp, Homo sapiens
taagaattctgattgatttg

SEQ ID NO: 1406141 - DNA, 17 bp, Homo sapiens
taagactgtagatatgt

SEQ ID NO: 1406142 - DNA, 20 bp, Homo sapiens
taagagtaacagtcatcatt

SEQ ID NO: 1406143 - DNA, 18 bp, Homo sapiens
taagcaaatgttaaaagt

SEQ ID NO: 1406144 - DNA, 15 bp, Homo sapiens
taagcattagcttta

SEQ ID NO: 1406145 - DNA, 22 bp, Homo sapiens
taagcccaacaagttgaagaag

SEQ ID NO: 1406146 - DNA, 14 bp, Homo sapiens
taagccttcaaaac

SEQ ID NO: 1406147 - DNA, 23 bp, Homo sapiens
taagcttccattttaattttaaa

SEQ ID NO: 1406148 - DNA, 20 bp, Homo sapiens
taaggggaagaatgaaagct

SEQ ID NO: 1406149 - DNA, 18 bp, Homo sapiens
taaggtccccagcagaat

SEQ ID NO: 1406150 - DNA, 12 bp, Homo sapiens
taagtaatctca

SEQ ID NO: 1406151 - DNA, 16 bp, Homo sapiens
taataagcactgtaaa

SEQ ID NO: 1406152 - DNA, 19 bp, Homo sapiens
taatatggactcagccttg

SEQ ID NO: 1406153 - DNA, 20 bp, Homo sapiens
taatattcagggtaaatagg

SEQ ID NO: 1406154 - DNA, 16 bp, Homo sapiens
taatcttcaaagcctt

SEQ ID NO: 1406155 - DNA, 23 bp, Homo sapiens
taatttttatttttggcaaagcc

SEQ ID NO: 1406156 - DNA, 23 bp, Homo sapiens
tacaaaattaagcaaatgttaaa

SEQ ID NO: 1406157 - DNA, 17 bp, Homo sapiens
tacatgccacatcaaac

SEQ ID NO: 1406158 - DNA, 16 bp, Homo sapiens
tacatgtgatacattt

SEQ ID NO: 1406159 - DNA, 19 bp, Homo sapiens
taccatttagtaagaatac

SEQ ID NO: 1406160 - DNA, 20 bp, Homo sapiens
taccttttttttttcttggt

SEQ ID NO: 1406161 - DNA, 21 bp, Homo sapiens
tactaagtaatctcacagcat

SEQ ID NO: 1406162 - DNA, 22 bp, Homo sapiens
tactaagtaatctcacagcatt

SEQ ID NO: 1406163 - DNA, 17 bp, Homo sapiens
tactgtctattaatatt

SEQ ID NO: 1406164 - DNA, 21 bp, Homo sapiens
tacttaaatggtaataagcac

SEQ ID NO: 1406165 - DNA, 15 bp, Homo sapiens
tactttaaccctttc

SEQ ID NO: 1406166 - DNA, 17 bp, Homo sapiens
tactttaaccctttctg

SEQ ID NO: 1406167 - DNA, 21 bp, Homo sapiens
tactttgtattttgattattt

SEQ ID NO: 1406168 - DNA, 20 bp, Homo sapiens
tagaagaggtggccccatat

SEQ ID NO: 1406169 - DNA, 22 bp, Homo sapiens
tagattgactaactcaaataca

SEQ ID NO: 1406170 - DNA, 13 bp, Homo sapiens
tagcacatgattt

SEQ ID NO: 1406171 - DNA, 18 bp, Homo sapiens
tagcagccagttcaaaaa

SEQ ID NO: 1406172 - DNA, 18 bp, Homo sapiens
tagctcataagagtaaca

SEQ ID NO: 1406173 - DNA, 22 bp, Homo sapiens
tagctgaagaattgaaaagttt

SEQ ID NO: 1406174 - DNA, 14 bp, Homo sapiens
tagcttttccctgt

SEQ ID NO: 1406175 - DNA, 17 bp, Homo sapiens
taggaatcattcagaaa

SEQ ID NO: 1406176 - DNA, 19 bp, Homo sapiens
tagggactacccatagaca

SEQ ID NO: 1406177 - DNA, 11 bp, Homo sapiens
tagtaagaata

SEQ ID NO: 1406178 - DNA, 11 bp, Homo sapiens
tagtaagcata

SEQ ID NO: 1406179 - DNA, 15 bp, Homo sapiens
tagtaagcatagaaa

SEQ ID NO: 1406180 - DNA, 17 bp, Homo sapiens
tagtcttggctaaggaa

SEQ ID NO: 1406181 - DNA, 19 bp, Homo sapiens
tagtgatgatggttcacgt

SEQ ID NO: 1406182 - DNA, 23 bp, Homo sapiens
tagttagtgattatatttcaccc

SEQ ID NO: 1406183 - DNA, 14 bp, Homo sapiens
tataaatatacagt

SEQ ID NO: 1406184 - DNA, 12 bp, Homo sapiens
tataaatgtata

SEQ ID NO: 1406185 - DNA, 23 bp, Homo sapiens
tataacacatttttttgcatgca

SEQ ID NO: 1406186 - DNA, 18 bp, Homo sapiens
tataaccacatttctaag

SEQ ID NO: 1406187 - DNA, 13 bp, Homo sapiens
tataattgtacaa

SEQ ID NO: 1406188 - DNA, 16 bp, Homo sapiens
tataattgtacaaaat

SEQ ID NO: 1406189 - DNA, 22 bp, Homo sapiens
tatacagtatagatttttgggt

SEQ ID NO: 1406190 - DNA, 18 bp, Homo sapiens
tatataaccacatttcta

SEQ ID NO: 1406191 - DNA, 21 bp, Homo sapiens
tatatacatcatacttaactt

SEQ ID NO: 1406192 - DNA, 13 bp, Homo sapiens
tatatataaatgt

SEQ ID NO: 1406193 - DNA, 14 bp, Homo sapiens
tatatatacatcat

SEQ ID NO: 1406194 - DNA, 18 bp, Homo sapiens
tatatgctttattaatgt

SEQ ID NO: 1406195 - DNA, 16 bp, Homo sapiens
tatattactgacattt

SEQ ID NO: 1406196 - DNA, 18 bp, Homo sapiens
tatattttgtgtgaaatt

SEQ ID NO: 1406197 - DNA, 22 bp, Homo sapiens
tatattttgtgtgaaattgcat

SEQ ID NO: 1406198 - DNA, 18 bp, Homo sapiens
tatctagttctaacagtg

SEQ ID NO: 1406199 - DNA, 16 bp, Homo sapiens
tatctcaatgaaccat

SEQ ID NO: 1406200 - DNA, 21 bp, Homo sapiens
tatgagattggttttcctgtg

SEQ ID NO: 1406201 - DNA, 19 bp, Homo sapiens
tatggactcagccttgcaa

SEQ ID NO: 1406202 - DNA, 21 bp, Homo sapiens
tatgtaggtaagactgtagat

SEQ ID NO: 1406203 - DNA, 18 bp, Homo sapiens
tatgtgggatattgaatg

SEQ ID NO: 1406204 - DNA, 19 bp, Homo sapiens
tatgtgggatattgaatgt

SEQ ID NO: 1406205 - DNA, 16 bp, Homo sapiens
tattaacaaattgcat

SEQ ID NO: 1406206 - DNA, 19 bp, Homo sapiens
tattaacaaattgcatttg

SEQ ID NO: 1406207 - DNA, 18 bp, Homo sapiens
tattaatgttttcaaaag

SEQ ID NO: 1406208 - DNA, 18 bp, Homo sapiens
tattactgacatttcttc

SEQ ID NO: 1406209 - DNA, 19 bp, Homo sapiens
tattatacatgtgatacat

SEQ ID NO: 1406210 - DNA, 18 bp, Homo sapiens
tattatgtaggtaagact

SEQ ID NO: 1406211 - DNA, 20 bp, Homo sapiens
tattatttttataattgtac

SEQ ID NO: 1406212 - DNA, 20 bp, Homo sapiens
tattatttttttaaaatttt

SEQ ID NO: 1406213 - DNA, 15 bp, Homo sapiens
tattgattgggaaaa

SEQ ID NO: 1406214 - DNA, 20 bp, Homo sapiens
tattgattgggaaaacattt

SEQ ID NO: 1406215 - DNA, 19 bp, Homo sapiens
tatttcaaaaacatgcttt

SEQ ID NO: 1406216 - DNA, 13 bp, Homo sapiens
tatttgcaaggct

SEQ ID NO: 1406217 - DNA, 19 bp, Homo sapiens
tatttgcaaggctgattta

SEQ ID NO: 1406218 - DNA, 14 bp, Homo sapiens
tattttcatgaaaa

SEQ ID NO: 1406219 - DNA, 20 bp, Homo sapiens
tattttcatgaaaataccat

SEQ ID NO: 1406220 - DNA, 16 bp, Homo sapiens
tatttttggcaaagcc

SEQ ID NO: 1406221 - DNA, 21 bp, Homo sapiens
tcaaaaacatgcttttccaaa

SEQ ID NO: 1406222 - DNA, 11 bp, Homo sapiens
tcaaagccttc

SEQ ID NO: 1406223 - DNA, 13 bp, Homo sapiens
tcaaagttttgtt

SEQ ID NO: 1406224 - DNA, 12 bp, Homo sapiens
tcaaataagaaa

SEQ ID NO: 1406225 - DNA, 23 bp, Homo sapiens
tcaacaacaaaacatttgctctg

SEQ ID NO: 1406226 - DNA, 16 bp, Homo sapiens
tcaactttgtaaaaat

SEQ ID NO: 1406227 - DNA, 15 bp, Homo sapiens
tcaagggctgtcatt

SEQ ID NO: 1406228 - DNA, 20 bp, Homo sapiens
tcaatacctggcctcattta

SEQ ID NO: 1406229 - DNA, 17 bp, Homo sapiens
tcaatgaaccataaatt

SEQ ID NO: 1406230 - DNA, 16 bp, Homo sapiens
tcacctctttgctccc

SEQ ID NO: 1406231 - DNA, 23 bp, Homo sapiens
tcactctccgaagtctgatccct

SEQ ID NO: 1406232 - DNA, 19 bp, Homo sapiens
tcagaaatataacacattt

SEQ ID NO: 1406233 - DNA, 18 bp, Homo sapiens
tcagaatggaatgctctg

SEQ ID NO: 1406234 - DNA, 15 bp, Homo sapiens
tcagaatttccctct

SEQ ID NO: 1406235 - DNA, 15 bp, Homo sapiens
tcagagatataataa

SEQ ID NO: 1406236 - DNA, 17 bp, Homo sapiens
tcagagatataataagc

SEQ ID NO: 1406237 - DNA, 21 bp, Homo sapiens
tcagattccccactcagcctt

SEQ ID NO: 1406238 - DNA, 19 bp, Homo sapiens
tcaggcaccagtccctgtc

SEQ ID NO: 1406239 - DNA, 17 bp, Homo sapiens
tcagggtaaataggaat

SEQ ID NO: 1406240 - DNA, 15 bp, Homo sapiens
tcagttgcttgtctt

SEQ ID NO: 1406241 - DNA, 15 bp, Homo sapiens
tcatcacaaatggct

SEQ ID NO: 1406242 - DNA, 18 bp, Homo sapiens
tcatgtatttgagcatat

SEQ ID NO: 1406243 - DNA, 11 bp, Homo sapiens
tcattgacttt

SEQ ID NO: 1406244 - DNA, 16 bp, Homo sapiens
tcattgacttttataa

SEQ ID NO: 1406245 - DNA, 17 bp, Homo sapiens
tcattgcacataagctt

SEQ ID NO: 1406246 - DNA, 16 bp, Homo sapiens
tcattttcttttttaa

SEQ ID NO: 1406247 - DNA, 22 bp, Homo sapiens
tcattttgcacctgcagccaag

SEQ ID NO: 1406248 - DNA, 23 bp, Homo sapiens
tccaaagagtgctaagcattagc

SEQ ID NO: 1406249 - DNA, 21 bp, Homo sapiens
tccaattttaaaatgaaatgc

SEQ ID NO: 1406250 - DNA, 15 bp, Homo sapiens
tccagttataagaag

SEQ ID NO: 1406251 - DNA, 17 bp, Homo sapiens
tccatgtcccctcccag

SEQ ID NO: 1406252 - DNA, 19 bp, Homo sapiens
tccatttccattgcttatt

SEQ ID NO: 1406253 - DNA, 19 bp, Homo sapiens
tccctgagttcactctccg

SEQ ID NO: 1406254 - DNA, 15 bp, Homo sapiens
tcccttactttgctg

SEQ ID NO: 1406255 - DNA, 15 bp, Homo sapiens
tcctattctataaaa

SEQ ID NO: 1406256 - DNA, 19 bp, Homo sapiens
tcctctttagtttttggtt

SEQ ID NO: 1406257 - DNA, 22 bp, Homo sapiens
tcctgcatagcttttccctgtc

SEQ ID NO: 1406258 - DNA, 16 bp, Homo sapiens
tccttgagtgtatgag

SEQ ID NO: 1406259 - DNA, 14 bp, Homo sapiens
tccttgatttcaaa

SEQ ID NO: 1406260 - DNA, 15 bp, Homo sapiens
tcgctccctcccagg

SEQ ID NO: 1406261 - DNA, 13 bp, Homo sapiens
tcggcaaggaagt

SEQ ID NO: 1406262 - DNA, 20 bp, Homo sapiens
tcgtttttgtattttcatga

SEQ ID NO: 1406263 - DNA, 21 bp, Homo sapiens
tctaacgcaaaaatagctctt

SEQ ID NO: 1406264 - DNA, 16 bp, Homo sapiens
tctaagactatatata

SEQ ID NO: 1406265 - DNA, 17 bp, Homo sapiens
tctaagcctttgagact

SEQ ID NO: 1406266 - DNA, 14 bp, Homo sapiens
tctacaatctcttt

SEQ ID NO: 1406267 - DNA, 22 bp, Homo sapiens
tctacaatctctttttgtttgc

SEQ ID NO: 1406268 - DNA, 21 bp, Homo sapiens
tctatataaccacatttctaa

SEQ ID NO: 1406269 - DNA, 20 bp, Homo sapiens
tctatatatacatcatactt

SEQ ID NO: 1406270 - DNA, 16 bp, Homo sapiens
tctattatttttataa

SEQ ID NO: 1406271 - DNA, 19 bp, Homo sapiens
tctcaatgaaccataaatt

SEQ ID NO: 1406272 - DNA, 23 bp, Homo sapiens
tctcactctgcccccccccccca

SEQ ID NO: 1406273 - DNA, 14 bp, Homo sapiens
tctcatagctcata

SEQ ID NO: 1406274 - DNA, 15 bp, Homo sapiens
tctccctagctcctc

SEQ ID NO: 1406275 - DNA, 20 bp, Homo sapiens
tctccctagctcctcccctt

SEQ ID NO: 1406276 - DNA, 13 bp, Homo sapiens
tctctaccagata

SEQ ID NO: 1406277 - DNA, 23 bp, Homo sapiens
tctctcaggaatcatctcctttg

SEQ ID NO: 1406278 - DNA, 13 bp, Homo sapiens
tctctcttgtcct

SEQ ID NO: 1406279 - DNA, 14 bp, Homo sapiens
tctctttttgtttg

SEQ ID NO: 1406280 - DNA, 23 bp, Homo sapiens
tctgaaaagtgtgtatatatttt

SEQ ID NO: 1406281 - DNA, 23 bp, Homo sapiens
tctgacctggcatctaattctga

SEQ ID NO: 1406282 - DNA, 20 bp, Homo sapiens
tctggtcaagggctgtcatt

SEQ ID NO: 1406283 - DNA, 21 bp, Homo sapiens
tctgttatgggcttttgggga

SEQ ID NO: 1406284 - DNA, 18 bp, Homo sapiens
tcttagcaaaaaatgaac

SEQ ID NO: 1406285 - DNA, 17 bp, Homo sapiens
tcttcccatgcattctg

SEQ ID NO: 1406286 - DNA, 14 bp, Homo sapiens
tcttcgggaccagg

SEQ ID NO: 1406287 - DNA, 12 bp, Homo sapiens
tctttagttttt

SEQ ID NO: 1406288 - DNA, 10 bp, Homo sapiens
tctttcatgg

SEQ ID NO: 1406289 - DNA, 19 bp, Homo sapiens
tcttttgtaataaactatt

SEQ ID NO: 1406290 - DNA, 21 bp, Homo sapiens
tcttttttaaccggtaagagt

SEQ ID NO: 1406291 - DNA, 17 bp, Homo sapiens
tgaaaaatataaaatta

SEQ ID NO: 1406292 - DNA, 20 bp, Homo sapiens
tgaaaaatataaaattatga

SEQ ID NO: 1406293 - DNA, 22 bp, Homo sapiens
tgaaaaatataaaattatgaga

SEQ ID NO: 1406294 - DNA, 19 bp, Homo sapiens
tgaaaagtgtgtatatatt

SEQ ID NO: 1406295 - DNA, 16 bp, Homo sapiens
tgaaactttgggaaaa

SEQ ID NO: 1406296 - DNA, 13 bp, Homo sapiens
tgaaagaaaattg

SEQ ID NO: 1406297 - DNA, 15 bp, Homo sapiens
tgaaagaaaattgag

SEQ ID NO: 1406298 - DNA, 12 bp, Homo sapiens
tgaaatgcattt

SEQ ID NO: 1406299 - DNA, 13 bp, Homo sapiens
tgaaatgcatttt

SEQ ID NO: 1406300 - DNA, 13 bp, Homo sapiens
tgaagaattgaaa

SEQ ID NO: 1406301 - DNA, 22 bp, Homo sapiens
tgaagcatagataatattgttt

SEQ ID NO: 1406302 - DNA, 19 bp, Homo sapiens
tgaatcctagcttcttcca

SEQ ID NO: 1406303 - DNA, 21 bp, Homo sapiens
tgaatgttaaagggatatttt

SEQ ID NO: 1406304 - DNA, 16 bp, Homo sapiens
tgacaatattccagat

SEQ ID NO: 1406305 - DNA, 16 bp, Homo sapiens
tgacaccaggcaagaa

SEQ ID NO: 1406306 - DNA, 12 bp, Homo sapiens
tgaccatttttt

SEQ ID NO: 1406307 - DNA, 22 bp, Homo sapiens
tgacctggcatctaattctgat

SEQ ID NO: 1406308 - DNA, 16 bp, Homo sapiens
tgacgattttggaaat

SEQ ID NO: 1406309 - DNA, 21 bp, Homo sapiens
tgactaactcaaatacacatt

SEQ ID NO: 1406310 - DNA, 16 bp, Homo sapiens
tgacttttataaagca

SEQ ID NO: 1406311 - DNA, 14 bp, Homo sapiens
tgagacctcagctt

SEQ ID NO: 1406312 - DNA, 22 bp, Homo sapiens
tgagacctcagcttggcactca

SEQ ID NO: 1406313 - DNA, 19 bp, Homo sapiens
tgagtattgtttaaaatgt

SEQ ID NO: 1406314 - DNA, 21 bp, Homo sapiens
tgatatgtctagggtgtgatt

SEQ ID NO: 1406315 - DNA, 15 bp, Homo sapiens
tgatccctgccaaaa

SEQ ID NO: 1406316 - DNA, 14 bp, Homo sapiens
tgatgcattttata

SEQ ID NO: 1406317 - DNA, 17 bp, Homo sapiens
tgatgtacagattcttt

SEQ ID NO: 1406318 - DNA, 21 bp, Homo sapiens
tgattctggctttaagccttc

SEQ ID NO: 1406319 - DNA, 15 bp, Homo sapiens
tgattgggaaaacat

SEQ ID NO: 1406320 - DNA, 20 bp, Homo sapiens
tgatttcaaagttttgttgt

SEQ ID NO: 1406321 - DNA, 15 bp, Homo sapiens
tgcaacaagcatgca

SEQ ID NO: 1406322 - DNA, 12 bp, Homo sapiens
tgcaacactcaa

SEQ ID NO: 1406323 - DNA, 17 bp, Homo sapiens
tgcaacactcaagtcta

SEQ ID NO: 1406324 - DNA, 14 bp, Homo sapiens
tgcaataaaattta

SEQ ID NO: 1406325 - DNA, 13 bp, Homo sapiens
tgcacctgcagcc

SEQ ID NO: 1406326 - DNA, 15 bp, Homo sapiens
tgcagaactgtagct

SEQ ID NO: 1406327 - DNA, 15 bp, Homo sapiens
tgcagagatttctca

SEQ ID NO: 1406328 - DNA, 23 bp, Homo sapiens
tgcagagggctccagagtggaga

SEQ ID NO: 1406329 - DNA, 20 bp, Homo sapiens
tgcatactttgtattttgat

SEQ ID NO: 1406330 - DNA, 22 bp, Homo sapiens
tgcatactttgtattttgatta

SEQ ID NO: 1406331 - DNA, 20 bp, Homo sapiens
tgcatagcttttccctgtcc

SEQ ID NO: 1406332 - DNA, 21 bp, Homo sapiens
tgcatcactgtatcattttct

SEQ ID NO: 1406333 - DNA, 20 bp, Homo sapiens
tgcattttgctagacagtta

SEQ ID NO: 1406334 - DNA, 22 bp, Homo sapiens
tgccatggctaggtagaagtga

SEQ ID NO: 1406335 - DNA, 20 bp, Homo sapiens
tgctactgttgtaagaattc

SEQ ID NO: 1406336 - DNA, 16 bp, Homo sapiens
tgctatgtatttgcaa

SEQ ID NO: 1406337 - DNA, 18 bp, Homo sapiens
tgctcaatacctggcctc

SEQ ID NO: 1406338 - DNA, 19 bp, Homo sapiens
tgctcaatacctggcctca

SEQ ID NO: 1406339 - DNA, 18 bp, Homo sapiens
tgctccagtttcacctct

SEQ ID NO: 1406340 - DNA, 15 bp, Homo sapiens
tgctgacatcatttg

SEQ ID NO: 1406341 - DNA, 17 bp, Homo sapiens
tgctgacatcatttgta

SEQ ID NO: 1406342 - DNA, 16 bp, Homo sapiens
tgcttaatcttcaaag

SEQ ID NO: 1406343 - DNA, 17 bp, Homo sapiens
tgcttattatgtaggta

SEQ ID NO: 1406344 - DNA, 15 bp, Homo sapiens
tgcttgtcttctggt

SEQ ID NO: 1406345 - DNA, 15 bp, Homo sapiens
tgctttattaatgtt

SEQ ID NO: 1406346 - DNA, 17 bp, Homo sapiens
tgctttattaatgtttt

SEQ ID NO: 1406347 - DNA, 14 bp, Homo sapiens
tggaaattcctgta

SEQ ID NO: 1406348 - DNA, 22 bp, Homo sapiens
tggagacgtttataaacagaaa

SEQ ID NO: 1406349 - DNA, 15 bp, Homo sapiens
tggattctaaataca

SEQ ID NO: 1406350 - DNA, 16 bp, Homo sapiens
tggattgcctctgaaa

SEQ ID NO: 1406351 - DNA, 12 bp, Homo sapiens
tggcaaagccag

SEQ ID NO: 1406352 - DNA, 18 bp, Homo sapiens
tggcactcaggtgctgaa

SEQ ID NO: 1406353 - DNA, 17 bp, Homo sapiens
tggcatttggcctcttg

SEQ ID NO: 1406354 - DNA, 18 bp, Homo sapiens
tggccccatattaacaaa

SEQ ID NO: 1406355 - DNA, 14 bp, Homo sapiens
tggctgctgttgct

SEQ ID NO: 1406356 - DNA, 14 bp, Homo sapiens
tgggaaaacatttg

SEQ ID NO: 1406357 - DNA, 15 bp, Homo sapiens
tggggggcattgagt

SEQ ID NO: 1406358 - DNA, 13 bp, Homo sapiens
tggtaaatgtttc

SEQ ID NO: 1406359 - DNA, 17 bp, Homo sapiens
tggtctatataaccaca

SEQ ID NO: 1406360 - DNA, 20 bp, Homo sapiens
tggtgatttgaaaaatataa

SEQ ID NO: 1406361 - DNA, 16 bp, Homo sapiens
tggttgggaatgagga

SEQ ID NO: 1406362 - DNA, 18 bp, Homo sapiens
tgtagatatgtattcttt

SEQ ID NO: 1406363 - DNA, 20 bp, Homo sapiens
tgtagttttgtgatgcattt

SEQ ID NO: 1406364 - DNA, 13 bp, Homo sapiens
tgtataaatatac

SEQ ID NO: 1406365 - DNA, 20 bp, Homo sapiens
tgtatatattttgtgtgaaa

SEQ ID NO: 1406366 - DNA, 19 bp, Homo sapiens
tgtattatgttccaaggct

SEQ ID NO: 1406367 - DNA, 12 bp, Homo sapiens
tgtattttcatg

SEQ ID NO: 1406368 - DNA, 14 bp, Homo sapiens
tgtattttgattat

SEQ ID NO: 1406369 - DNA, 18 bp, Homo sapiens
tgtcacactgtggcctga

SEQ ID NO: 1406370 - DNA, 17 bp, Homo sapiens
tgtcagtactattcagg

SEQ ID NO: 1406371 - DNA, 17 bp, Homo sapiens
tgtcattgcacataagc

SEQ ID NO: 1406372 - DNA, 21 bp, Homo sapiens
tgtcattgcacataagcttcc

SEQ ID NO: 1406373 - DNA, 12 bp, Homo sapiens
tgtcccctccca

SEQ ID NO: 1406374 - DNA, 16 bp, Homo sapiens
tgtcccctcccagagc

SEQ ID NO: 1406375 - DNA, 15 bp, Homo sapiens
tgtgagctcttccta

SEQ ID NO: 1406376 - DNA, 22 bp, Homo sapiens
tgtgatacattttttaagcttc

SEQ ID NO: 1406377 - DNA, 23 bp, Homo sapiens
tgtggcataaattgcatcactgt

SEQ ID NO: 1406378 - DNA, 17 bp, Homo sapiens
tgtgggatattgaatgt

SEQ ID NO: 1406379 - DNA, 22 bp, Homo sapiens
tgtgtatatattttgtgtgaaa

SEQ ID NO: 1406380 - DNA, 20 bp, Homo sapiens
tgttaaaagttttatatgct

SEQ ID NO: 1406381 - DNA, 12 bp, Homo sapiens
tgttaaagagaa

SEQ ID NO: 1406382 - DNA, 16 bp, Homo sapiens
tgttaaagagaatgag

SEQ ID NO: 1406383 - DNA, 17 bp, Homo sapiens
tgttgagacctcagctt

SEQ ID NO: 1406384 - DNA, 13 bp, Homo sapiens
tgttggaaagtaa

SEQ ID NO: 1406385 - DNA, 15 bp, Homo sapiens
tgttgtaagaattct

SEQ ID NO: 1406386 - DNA, 15 bp, Homo sapiens
tgtttacctttctct

SEQ ID NO: 1406387 - DNA, 18 bp, Homo sapiens
tgtttcttttgtttggta

SEQ ID NO: 1406388 - DNA, 15 bp, Homo sapiens
ttaaagagaatgagt

SEQ ID NO: 1406389 - DNA, 22 bp, Homo sapiens
ttaaatggtaataagcactgta

SEQ ID NO: 1406390 - DNA, 21 bp, Homo sapiens
ttaaccggtaagagtttcagt

SEQ ID NO: 1406391 - DNA, 19 bp, Homo sapiens
ttaagcaaatgttaaaagt

SEQ ID NO: 1406392 - DNA, 23 bp, Homo sapiens
ttaataccagataccttatctta

SEQ ID NO: 1406393 - DNA, 20 bp, Homo sapiens
ttaatccagttataagaaga

SEQ ID NO: 1406394 - DNA, 22 bp, Homo sapiens
ttaattaagctctcatagctca

SEQ ID NO: 1406395 - DNA, 16 bp, Homo sapiens
ttaattttaaagtgca

SEQ ID NO: 1406396 - DNA, 19 bp, Homo sapiens
ttactgtctattaatattc

SEQ ID NO: 1406397 - DNA, 14 bp, Homo sapiens
ttagctttaattaa

SEQ ID NO: 1406398 - DNA, 13 bp, Homo sapiens
ttaggtgtgaaga

SEQ ID NO: 1406399 - DNA, 20 bp, Homo sapiens
ttatagtctaagactatata

SEQ ID NO: 1406400 - DNA, 20 bp, Homo sapiens
ttatatgctttattaatgtt

SEQ ID NO: 1406401 - DNA, 23 bp, Homo sapiens
ttatctaaggtccccagcagaat

SEQ ID NO: 1406402 - DNA, 15 bp, Homo sapiens
ttatcttacaatatt

SEQ ID NO: 1406403 - DNA, 20 bp, Homo sapiens
ttatcttacaatattgattg

SEQ ID NO: 1406404 - DNA, 12 bp, Homo sapiens
ttattaatgttt

SEQ ID NO: 1406405 - DNA, 13 bp, Homo sapiens
ttattaatgtttt

SEQ ID NO: 1406406 - DNA, 15 bp, Homo sapiens
ttattattaattaca

SEQ ID NO: 1406407 - DNA, 22 bp, Homo sapiens
ttattgaccattttttaattta

SEQ ID NO: 1406408 - DNA, 14 bp, Homo sapiens
ttatttttataatt

SEQ ID NO: 1406409 - DNA, 16 bp, Homo sapiens
ttatttttataattgt

SEQ ID NO: 1406410 - DNA, 16 bp, Homo sapiens
ttatttttttaaaatt

SEQ ID NO: 1406411 - DNA, 15 bp, Homo sapiens
ttcaaaaacatgctt

SEQ ID NO: 1406412 - DNA, 23 bp, Homo sapiens
ttcaaaaacatgcttttccaaac

SEQ ID NO: 1406413 - DNA, 20 bp, Homo sapiens
ttcaaaaggtattatacatg

SEQ ID NO: 1406414 - DNA, 21 bp, Homo sapiens
ttcaaaaggtattatacatgt

SEQ ID NO: 1406415 - DNA, 12 bp, Homo sapiens
ttcaaagccttc

SEQ ID NO: 1406416 - DNA, 20 bp, Homo sapiens
ttcaaagttttgttgtactt

SEQ ID NO: 1406417 - DNA, 12 bp, Homo sapiens
ttcagaaatgtt

SEQ ID NO: 1406418 - DNA, 14 bp, Homo sapiens
ttcagggtaaatag

SEQ ID NO: 1406419 - DNA, 18 bp, Homo sapiens
ttcatggctgctgttgct

SEQ ID NO: 1406420 - DNA, 21 bp, Homo sapiens
ttcattttgcacctgcagcca

SEQ ID NO: 1406421 - DNA, 21 bp, Homo sapiens
ttccaaagagtgctaagcatt

SEQ ID NO: 1406422 - DNA, 21 bp, Homo sapiens
ttccagaaccacacttgaaac

SEQ ID NO: 1406423 - DNA, 20 bp, Homo sapiens
ttccagatctttcagaaata

SEQ ID NO: 1406424 - DNA, 20 bp, Homo sapiens
ttccatgtcccctcccagag

SEQ ID NO: 1406425 - DNA, 23 bp, Homo sapiens
ttctaaatacatgccacatcaaa

SEQ ID NO: 1406426 - DNA, 19 bp, Homo sapiens
ttctattatttttataatt

SEQ ID NO: 1406427 - DNA, 23 bp, Homo sapiens
ttctgattctggctttaagcctt

SEQ ID NO: 1406428 - DNA, 18 bp, Homo sapiens
ttctggctttaagccttc

SEQ ID NO: 1406429 - DNA, 22 bp, Homo sapiens
ttctggtcaagggctgtcattg

SEQ ID NO: 1406430 - DNA, 21 bp, Homo sapiens
ttcttaaaaggcccatagcag

SEQ ID NO: 1406431 - DNA, 21 bp, Homo sapiens
ttctttggattctaaatacat

SEQ ID NO: 1406432 - DNA, 14 bp, Homo sapiens
ttcttttaaagacc

SEQ ID NO: 1406433 - DNA, 20 bp, Homo sapiens
ttgaaaaatataaaattatg

SEQ ID NO: 1406434 - DNA, 19 bp, Homo sapiens
ttgaagcatagataatatt

SEQ ID NO: 1406435 - DNA, 20 bp, Homo sapiens
ttgacttaggtgtgaagacc

SEQ ID NO: 1406436 - DNA, 22 bp, Homo sapiens
ttgagacctcagcttggcactc

SEQ ID NO: 1406437 - DNA, 20 bp, Homo sapiens
ttgagtattgtttaaaatgt

SEQ ID NO: 1406438 - DNA, 17 bp, Homo sapiens
ttgagtctgtactaaac

SEQ ID NO: 1406439 - DNA, 20 bp, Homo sapiens
ttgcaaatagccagtgctag

SEQ ID NO: 1406440 - DNA, 14 bp, Homo sapiens
ttgcacctgcagcc

SEQ ID NO: 1406441 - DNA, 15 bp, Homo sapiens
ttgcacctgcagcca

SEQ ID NO: 1406442 - DNA, 22 bp, Homo sapiens
ttgcacctgcagccaagcaaat

SEQ ID NO: 1406443 - DNA, 16 bp, Homo sapiens
ttgcagaactgtagct

SEQ ID NO: 1406444 - DNA, 14 bp, Homo sapiens
ttgcagaatgatgc

SEQ ID NO: 1406445 - DNA, 16 bp, Homo sapiens
ttgcatactttgtatt

SEQ ID NO: 1406446 - DNA, 11 bp, Homo sapiens
ttgcatttgtg

SEQ ID NO: 1406447 - DNA, 15 bp, Homo sapiens
ttgccaggacatgca

SEQ ID NO: 1406448 - DNA, 17 bp, Homo sapiens
ttgccaggacatgcaat

SEQ ID NO: 1406449 - DNA, 18 bp, Homo sapiens
ttgctcaatacctggcct

SEQ ID NO: 1406450 - DNA, 20 bp, Homo sapiens
ttgctgccattacagaggta

SEQ ID NO: 1406451 - DNA, 14 bp, Homo sapiens
ttgcttgtcttctg

SEQ ID NO: 1406452 - DNA, 23 bp, Homo sapiens
ttgctttgacttaggtgtgaaga

SEQ ID NO: 1406453 - DNA, 13 bp, Homo sapiens
ttggaaatgagaa

SEQ ID NO: 1406454 - DNA, 17 bp, Homo sapiens
ttggattctaaatacat

SEQ ID NO: 1406455 - DNA, 14 bp, Homo sapiens
ttggcaaagccaga

SEQ ID NO: 1406456 - DNA, 13 bp, Homo sapiens
ttgggaaaacatg

SEQ ID NO: 1406457 - DNA, 15 bp, Homo sapiens
ttgggaaaacatttg

SEQ ID NO: 1406458 - DNA, 16 bp, Homo sapiens
ttgggaaaacatttgc

SEQ ID NO: 1406459 - DNA, 19 bp, Homo sapiens
ttgggctctagaattccag

SEQ ID NO: 1406460 - DNA, 21 bp, Homo sapiens
ttgggtggggggcattgagta

SEQ ID NO: 1406461 - DNA, 14 bp, Homo sapiens
ttggtaaatgtttc

SEQ ID NO: 1406462 - DNA, 17 bp, Homo sapiens
ttggttttcctgtggca

SEQ ID NO: 1406463 - DNA, 18 bp, Homo sapiens
ttgtacaaaattaagcaa

SEQ ID NO: 1406464 - DNA, 20 bp, Homo sapiens
ttgtacaaaattaagcaaat

SEQ ID NO: 1406465 - DNA, 15 bp, Homo sapiens
ttgtacttaaatggt

SEQ ID NO: 1406466 - DNA, 16 bp, Homo sapiens
ttgtattttcatgaaa

SEQ ID NO: 1406467 - DNA, 18 bp, Homo sapiens
ttgtattttcatgaaaat

SEQ ID NO: 1406468 - DNA, 18 bp, Homo sapiens
ttgtattttgattatttt

SEQ ID NO: 1406469 - DNA, 12 bp, Homo sapiens
ttgtgtgaaatt

SEQ ID NO: 1406470 - DNA, 14 bp, Homo sapiens
ttgttgtacttaaa

SEQ ID NO: 1406471 - DNA, 21 bp, Homo sapiens
ttgtttggagacgtttataaa

SEQ ID NO: 1406472 - DNA, 20 bp, Homo sapiens
tttaaaatgaaatgcatttt

SEQ ID NO: 1406473 - DNA, 18 bp, Homo sapiens
tttaaaatgtaatttaaa

SEQ ID NO: 1406474 - DNA, 17 bp, Homo sapiens
tttaaaattttgtatgt

SEQ ID NO: 1406475 - DNA, 17 bp, Homo sapiens
tttaaagaccctcctat

SEQ ID NO: 1406476 - DNA, 21 bp, Homo sapiens
tttaagcttcagttgcttgtc

SEQ ID NO: 1406477 - DNA, 12 bp, Homo sapiens
tttataaagcat

SEQ ID NO: 1406478 - DNA, 17 bp, Homo sapiens
tttataattgtacaaaa

SEQ ID NO: 1406479 - DNA, 20 bp, Homo sapiens
tttcaaagttttgttgtact

SEQ ID NO: 1406480 - DNA, 17 bp, Homo sapiens
tttcacctctttgctcc

SEQ ID NO: 1406481 - DNA, 21 bp, Homo sapiens
tttcagaaatataacacattt

SEQ ID NO: 1406482 - DNA, 17 bp, Homo sapiens
tttcatgaaaataccat

SEQ ID NO: 1406483 - DNA, 22 bp, Homo sapiens
tttcctgtggcataaattgcat

SEQ ID NO: 1406484 - DNA, 20 bp, Homo sapiens
tttctcagtgttggtatatt

SEQ ID NO: 1406485 - DNA, 23 bp, Homo sapiens
tttctgggatgcaatactaggaa

SEQ ID NO: 1406486 - DNA, 19 bp, Homo sapiens
tttcttttgtaataaacta

SEQ ID NO: 1406487 - DNA, 13 bp, Homo sapiens
tttgaaaaatata

SEQ ID NO: 1406488 - DNA, 21 bp, Homo sapiens
tttgaaaaatataaaattatg

SEQ ID NO: 1406489 - DNA, 16 bp, Homo sapiens
tttgccaagtctccca

SEQ ID NO: 1406490 - DNA, 21 bp, Homo sapiens
tttgctactgttgtaagaatt

SEQ ID NO: 1406491 - DNA, 15 bp, Homo sapiens
tttggattctaaata

SEQ ID NO: 1406492 - DNA, 14 bp, Homo sapiens
tttgtgatgcattt

SEQ ID NO: 1406493 - DNA, 16 bp, Homo sapiens
tttgtgatgcatttta

SEQ ID NO: 1406494 - DNA, 13 bp, Homo sapiens
ttttaaaatgaaa

SEQ ID NO: 1406495 - DNA, 19 bp, Homo sapiens
ttttaaaatgaaatgcatt

SEQ ID NO: 1406496 - DNA, 23 bp, Homo sapiens
ttttaaagaccctcctattctat

SEQ ID NO: 1406497 - DNA, 16 bp, Homo sapiens
ttttataattgtacaa

SEQ ID NO: 1406498 - DNA, 13 bp, Homo sapiens
ttttcatgaaaat

SEQ ID NO: 1406499 - DNA, 20 bp, Homo sapiens
ttttgcacctgcagccaagc

SEQ ID NO: 1406500 - DNA, 17 bp, Homo sapiens
ttttggcaaagccagaa

SEQ ID NO: 1406501 - DNA, 15 bp, Homo sapiens
ttttggggagccaga

SEQ ID NO: 1406502 - DNA, 19 bp, Homo sapiens
ttttgttgtacttaaatgg

SEQ ID NO: 1406503 - DNA, 16 bp, Homo sapiens
ttttgtttggtaaatg

SEQ ID NO: 1406504 - DNA, 16 bp, Homo sapiens
tttttaagcttcagtt

SEQ ID NO: 1406505 - DNA, 16 bp, Homo sapiens
tttttaatttacttgt

SEQ ID NO: 1406506 - DNA, 13 bp, Homo sapiens
tttttataattgt

SEQ ID NO: 1406507 - DNA, 23 bp, Homo sapiens
tttttataattgtacaaaattaa

SEQ ID NO: 1406508 - DNA, 12 bp, Homo sapiens
tttttgtttgcc

SEQ ID NO: 1406509 - DNA, 14 bp, Homo sapiens
tttttgtttggaga

SEQ ID NO: 1406510 - DNA, 15 bp, Homo sapiens
ttttttaagcttcag

SEQ ID NO: 1406511 - DNA, 12 bp, Homo sapiens
tttttttctatt

SEQ ID NO: 1406512 - DNA, 20 bp, Homo sapiens
atgcaaatgagctctgaaat

SEQ ID NO: 1406513 - DNA, 23 bp, Homo sapiens
atgcaggttcaggtcccctttca

SEQ ID NO: 1406514 - DNA, 16 bp, Homo sapiens
atgcatgcaaatgagc

SEQ ID NO: 1406515 - DNA, 15 bp, Homo sapiens
atggactcagccttg

SEQ ID NO: 1406516 - DNA, 19 bp, Homo sapiens
atggactcagccttgcaaa

SEQ ID NO: 1406517 - DNA, 16 bp, Homo sapiens
atggctacatctccaa

SEQ ID NO: 1406518 - DNA, 22 bp, Homo sapiens
atgggcttttggggagccagaa

SEQ ID NO: 1406519 - DNA, 13 bp, Homo sapiens
atggtaataagca

SEQ ID NO: 1406520 - DNA, 15 bp, Homo sapiens
atgtaatttaaatga

SEQ ID NO: 1406521 - DNA, 16 bp, Homo sapiens
atgtaatttaaatgaa

SEQ ID NO: 1406522 - DNA, 20 bp, Homo sapiens
atgtaggtaagactgtagat

SEQ ID NO: 1406523 - DNA, 22 bp, Homo sapiens
atgtagttttgtgatgcatttt

SEQ ID NO: 1406524 - DNA, 12 bp, Homo sapiens
atgtataaatat

SEQ ID NO: 1406525 - DNA, 22 bp, Homo sapiens
atgtatttgcaaggctgattta

SEQ ID NO: 1406526 - DNA, 22 bp, Homo sapiens
atgtgatacattttttaagctt

SEQ ID NO: 1406527 - DNA, 22 bp, Homo sapiens
atgttaaagagaatgagtcctt

SEQ ID NO: 1406528 - DNA, 16 bp, Homo sapiens
atgtttcttttgtttg

SEQ ID NO: 1406529 - DNA, 16 bp, Homo sapiens
atgttttcaaaaggta

SEQ ID NO: 1406530 - DNA, 22 bp, Homo sapiens
atgttttcaaaaggtattatac

SEQ ID NO: 1406531 - DNA, 17 bp, Homo sapiens
attaaaactaaatttca

SEQ ID NO: 1406532 - DNA, 17 bp, Homo sapiens
attaacaaattgcattt

SEQ ID NO: 1406533 - DNA, 22 bp, Homo sapiens
attaagctctcatagctcataa

SEQ ID NO: 1406534 - DNA, 13 bp, Homo sapiens
attactgacattt

SEQ ID NO: 1406535 - DNA, 15 bp, Homo sapiens
attactgacatttct

SEQ ID NO: 1406536 - DNA, 16 bp, Homo sapiens
attactgacatttctt

SEQ ID NO: 1406537 - DNA, 15 bp, Homo sapiens
attatacatgtgata

SEQ ID NO: 1406538 - DNA, 14 bp, Homo sapiens
attatttttataat

SEQ ID NO: 1406539 - DNA, 19 bp, Homo sapiens
attatttttttaaaatttt

SEQ ID NO: 1406540 - DNA, 21 bp, Homo sapiens
attatttttttaaaattttgt

SEQ ID NO: 1406541 - DNA, 13 bp, Homo sapiens
attcaactttgta

SEQ ID NO: 1406542 - DNA, 18 bp, Homo sapiens
attcagggtaaataggaa

SEQ ID NO: 1406543 - DNA, 14 bp, Homo sapiens
attcaggtaacact

SEQ ID NO: 1406544 - DNA, 16 bp, Homo sapiens
attccagatctttcag

SEQ ID NO: 1406545 - DNA, 21 bp, Homo sapiens
attccagatctttcagaaata

SEQ ID NO: 1406546 - DNA, 18 bp, Homo sapiens
attccagtcccctttctc

SEQ ID NO: 1406547 - DNA, 21 bp, Homo sapiens
attcctgtactgtgtctcatg

SEQ ID NO: 1406548 - DNA, 24 bp, Homo sapiens
attctataaaactctgcatgtaga

SEQ ID NO: 1406549 - DNA, 22 bp, Homo sapiens
attctgattctggctttaagcc

SEQ ID NO: 1406550 - DNA, 15 bp, Homo sapiens
attcttagcaaaaaa

SEQ ID NO: 1406551 - DNA, 16 bp, Homo sapiens
attcttagcaaaaaat

SEQ ID NO: 1406552 - DNA, 19 bp, Homo sapiens
attcttttctcagtgttgg

SEQ ID NO: 1406553 - DNA, 16 bp, Homo sapiens
attgaaaagtttttgt

SEQ ID NO: 1406554 - DNA, 19 bp, Homo sapiens
attgaaaagtttttgtttg

SEQ ID NO: 1406555 - DNA, 23 bp, Homo sapiens
attgacagttgaacagagctaga

SEQ ID NO: 1406556 - DNA, 13 bp, Homo sapiens
attgaccattttt

SEQ ID NO: 1406557 - DNA, 22 bp, Homo sapiens
attgaccattttttaatttact

SEQ ID NO: 1406558 - DNA, 23 bp, Homo sapiens
attgactaactcaaatacacatt

SEQ ID NO: 1406559 - DNA, 21 bp, Homo sapiens
attgagtattgtttaaaatgt

SEQ ID NO: 1406560 - DNA, 13 bp, Homo sapiens
attgattgggaaa

SEQ ID NO: 1406561 - DNA, 20 bp, Homo sapiens
attgattgggaaaacatttg

SEQ ID NO: 1406562 - DNA, 21 bp, Homo sapiens
attgattgggaaaacatttgc

SEQ ID NO: 1406563 - DNA, 21 bp, Homo sapiens
attgcatactttgtattttga

SEQ ID NO: 1406564 - DNA, 14 bp, Homo sapiens
attgcatcactgta

SEQ ID NO: 1406565 - DNA, 14 bp, Homo sapiens
attggaaaatttaa

SEQ ID NO: 1406566 - DNA, 15 bp, Homo sapiens
attgtacaaaattaa

SEQ ID NO: 1406567 - DNA, 17 bp, Homo sapiens
attgtttaaaatgtaat

SEQ ID NO: 1406568 - DNA, 18 bp, Homo sapiens
atttaaaacaagacttca

SEQ ID NO: 1406569 - DNA, 17 bp, Homo sapiens
atttaaatgaaagaaaa

SEQ ID NO: 1406570 - DNA, 19 bp, Homo sapiens
atttaataccagatacctt

SEQ ID NO: 1406571 - DNA, 23 bp, Homo sapiens
atttaatccagttataagaagaa

SEQ ID NO: 1406572 - DNA, 12 bp, Homo sapiens
atttacttgttt

SEQ ID NO: 1406573 - DNA, 16 bp, Homo sapiens
atttacttgttttgga

SEQ ID NO: 1406574 - DNA, 14 bp, Homo sapiens
atttagtaagaata

SEQ ID NO: 1406575 - DNA, 22 bp, Homo sapiens
atttcaaaaacatgcttttcca

SEQ ID NO: 1406576 - DNA, 23 bp, Homo sapiens
atttcaaaaacatgcttttccaa

SEQ ID NO: 1406577 - DNA, 18 bp, Homo sapiens
atttcaaagttttgttgt

SEQ ID NO: 1406578 - DNA, 20 bp, Homo sapiens
atttccatgtcccctcccag

SEQ ID NO: 1406579 - DNA, 13 bp, Homo sapiens
atttccattgctt

SEQ ID NO: 1406580 - DNA, 22 bp, Homo sapiens
atttctcattgacttttataaa

SEQ ID NO: 1406581 - DNA, 20 bp, Homo sapiens
atttgaaaaatataaaatta

SEQ ID NO: 1406582 - DNA, 16 bp, Homo sapiens
atttgcaaggctgatt

SEQ ID NO: 1406583 - DNA, 17 bp, Homo sapiens
atttgcaaggctgattt

SEQ ID NO: 1406584 - DNA, 23 bp, Homo sapiens
atttgcacagaagcacatgcacc

SEQ ID NO: 1406585 - DNA, 16 bp, Homo sapiens
atttgctactgttgta

SEQ ID NO: 1406586 - DNA, 17 bp, Homo sapiens
atttgctactgttgtaa

SEQ ID NO: 1406587 - DNA, 17 bp, Homo sapiens
attttaaagtgcaaaag

SEQ ID NO: 1406588 - DNA, 17 bp, Homo sapiens
attttcatgaaaatacc

SEQ ID NO: 1406589 - DNA, 22 bp, Homo sapiens
attttgcacctgcagccaagca

SEQ ID NO: 1406590 - DNA, 15 bp, Homo sapiens
attttgtatgttaaa

SEQ ID NO: 1406591 - DNA, 15 bp, Homo sapiens
atttttggcaaagcc

SEQ ID NO: 1406592 - DNA, 19 bp, Homo sapiens
atttttggcaaagccagaa

SEQ ID NO: 1406593 - DNA, 12 bp, Homo sapiens
attttttaagct

SEQ ID NO: 1406594 - DNA, 21 bp, Homo sapiens
caaaaacatgcttttccaaac

SEQ ID NO: 1406595 - DNA, 17 bp, Homo sapiens
caaaatcagaatggaat

SEQ ID NO: 1406596 - DNA, 13 bp, Homo sapiens
caaatacacattt

SEQ ID NO: 1406597 - DNA, 17 bp, Homo sapiens
caaatgcctgccaaatt

SEQ ID NO: 1406598 - DNA, 12 bp, Homo sapiens
caacaacaaaac

SEQ ID NO: 1406599 - DNA, 14 bp, Homo sapiens
caacactcaagtct

SEQ ID NO: 1406600 - DNA, 19 bp, Homo sapiens
caacataatttttattttt

SEQ ID NO: 1406601 - DNA, 20 bp, Homo sapiens
caagcaaatgcctgccaaat

SEQ ID NO: 1406602 - DNA, 17 bp, Homo sapiens
caagcatgcagctttgc

SEQ ID NO: 1406603 - DNA, 13 bp, Homo sapiens
caagttgaagaag

SEQ ID NO: 1406604 - DNA, 13 bp, Homo sapiens
caataaaatttaa

SEQ ID NO: 1406605 - DNA, 19 bp, Homo sapiens
caatacctggcctcattta

SEQ ID NO: 1406606 - DNA, 14 bp, Homo sapiens
caatactaggaagt

SEQ ID NO: 1406607 - DNA, 15 bp, Homo sapiens
caatatcccttactt

SEQ ID NO: 1406608 - DNA, 16 bp, Homo sapiens
caatattgattgggaa

SEQ ID NO: 1406609 - DNA, 14 bp, Homo sapiens
caatctctttttgt

SEQ ID NO: 1406610 - DNA, 20 bp, Homo sapiens
caattttaaaatgaaatgca

SEQ ID NO: 1406611 - DNA, 14 bp, Homo sapiens
cacactgctccagt

SEQ ID NO: 1406612 - DNA, 22 bp, Homo sapiens
cacagaggatgctgacatcatt

SEQ ID NO: 1406613 - DNA, 14 bp, Homo sapiens
cacatgatttgggc

SEQ ID NO: 1406614 - DNA, 14 bp, Homo sapiens
caccagtccctgtc

SEQ ID NO: 1406615 - DNA, 15 bp, Homo sapiens
cacctgtgggccagc

SEQ ID NO: 1406616 - DNA, 10 bp, Homo sapiens
caccttccaa

SEQ ID NO: 1406617 - DNA, 22 bp, Homo sapiens
caccttccaaagagtgctaagc

SEQ ID NO: 1406618 - DNA, 17 bp, Homo sapiens
cacgttggggtgattta

SEQ ID NO: 1406619 - DNA, 17 bp, Homo sapiens
cactagggccttggaaa

SEQ ID NO: 1406620 - DNA, 18 bp, Homo sapiens
cactagggccttggaaat

SEQ ID NO: 1406621 - DNA, 16 bp, Homo sapiens
cactcccctccactct

SEQ ID NO: 1406622 - DNA, 22 bp, Homo sapiens
cactctccgaagtctgatccct

SEQ ID NO: 1406623 - DNA, 20 bp, Homo sapiens
cactgtggcctgatcagcag

SEQ ID NO: 1406624 - DNA, 15 bp, Homo sapiens
cagaaatggaaagca

SEQ ID NO: 1406625 - DNA, 22 bp, Homo sapiens
cagaaatgttgagtctgtacta

SEQ ID NO: 1406626 - DNA, 22 bp, Homo sapiens
cagaaccacacttgaaaccttt

SEQ ID NO: 1406627 - DNA, 16 bp, Homo sapiens
cagaatggaatgctct

SEQ ID NO: 1406628 - DNA, 22 bp, Homo sapiens
cagaattgacagttgaacagag

SEQ ID NO: 1406629 - DNA, 16 bp, Homo sapiens
cagagatttctcattg

SEQ ID NO: 1406630 - DNA, 19 bp, Homo sapiens
cagagatttctcattgact

SEQ ID NO: 1406631 - DNA, 21 bp, Homo sapiens
cagagatttctcattgacttt

SEQ ID NO: 1406632 - DNA, 17 bp, Homo sapiens
cagagctggtggaccca

SEQ ID NO: 1406633 - DNA, 22 bp, Homo sapiens
cagaggtattaaaactaaattt

SEQ ID NO: 1406634 - DNA, 13 bp, Homo sapiens
cagataactgagg

SEQ ID NO: 1406635 - DNA, 22 bp, Homo sapiens
cagataccttatcttacaatat

SEQ ID NO: 1406636 - DNA, 23 bp, Homo sapiens
cagataccttatcttacaatatt

SEQ ID NO: 1406637 - DNA, 18 bp, Homo sapiens
cagatcttggactcatga

SEQ ID NO: 1406638 - DNA, 19 bp, Homo sapiens
cagatcttggactcatgag

SEQ ID NO: 1406639 - DNA, 20 bp, Homo sapiens
cagatcttggactcatgagg

SEQ ID NO: 1406640 - DNA, 18 bp, Homo sapiens
cagcattctcaggcacca

SEQ ID NO: 1406641 - DNA, 12 bp, Homo sapiens
cagctttgcaaa

SEQ ID NO: 1406642 - DNA, 16 bp, Homo sapiens
caggatttgcacagaa

SEQ ID NO: 1406643 - DNA, 22 bp, Homo sapiens
caggatttgcacagaagcacat

SEQ ID NO: 1406644 - DNA, 21 bp, Homo sapiens
caggcaagaaaagcgcagaga

SEQ ID NO: 1406645 - DNA, 22 bp, Homo sapiens
caggcaagaaaagcgcagagaa

SEQ ID NO: 1406646 - DNA, 16 bp, Homo sapiens
caggcaccagtccctg

SEQ ID NO: 1406647 - DNA, 14 bp, Homo sapiens
cagggaaaacacag

SEQ ID NO: 1406648 - DNA, 15 bp, Homo sapiens
cagggaaaacacaga

SEQ ID NO: 1406649 - DNA, 18 bp, Homo sapiens
caggtcccctttcagaga

SEQ ID NO: 1406650 - DNA, 24 bp, Homo sapiens
caggtgcaacactcaagtctattg

SEQ ID NO: 1406651 - DNA, 21 bp, Homo sapiens
cagtaacccccttaaatttaa

SEQ ID NO: 1406652 - DNA, 20 bp, Homo sapiens
cagtaagatatctcaatgaa

SEQ ID NO: 1406653 - DNA, 15 bp, Homo sapiens
cagtatgtgggatat

SEQ ID NO: 1406654 - DNA, 19 bp, Homo sapiens
cagtatgtgggatattgaa

SEQ ID NO: 1406655 - DNA, 12 bp, Homo sapiens
cagtcatcattt

SEQ ID NO: 1406656 - DNA, 13 bp, Homo sapiens
cagtcccctttct

SEQ ID NO: 1406657 - DNA, 16 bp, Homo sapiens
cagtgttggtatattt

SEQ ID NO: 1406658 - DNA, 15 bp, Homo sapiens
cagttaaactggctt

SEQ ID NO: 1406659 - DNA, 21 bp, Homo sapiens
cagttaaactggcttaactta

SEQ ID NO: 1406660 - DNA, 15 bp, Homo sapiens
cagttataagaagaa

SEQ ID NO: 1406661 - DNA, 17 bp, Homo sapiens
cagttgaacagagctag

SEQ ID NO: 1406662 - DNA, 22 bp, Homo sapiens
cataagagtaacagtcatcatt

SEQ ID NO: 1406663 - DNA, 13 bp, Homo sapiens
cataagcttccat

SEQ ID NO: 1406664 - DNA, 13 bp, Homo sapiens
catacttaacttt

SEQ ID NO: 1406665 - DNA, 18 bp, Homo sapiens
catactttgtattttgat

SEQ ID NO: 1406666 - DNA, 13 bp, Homo sapiens
catagacatgaaa

SEQ ID NO: 1406667 - DNA, 17 bp, Homo sapiens
catattaacaaattgca

SEQ ID NO: 1406668 - DNA, 18 bp, Homo sapiens
catattaacaaattgcat

SEQ ID NO: 1406669 - DNA, 19 bp, Homo sapiens
catattaacaaattgcatt

SEQ ID NO: 1406670 - DNA, 21 bp, Homo sapiens
catatttcaaaaacatgcttt

SEQ ID NO: 1406671 - DNA, 18 bp, Homo sapiens
catcaaacctttgagtag

SEQ ID NO: 1406672 - DNA, 13 bp, Homo sapiens
catcaaataagaa

SEQ ID NO: 1406673 - DNA, 17 bp, Homo sapiens
catcacaaatggctaca

SEQ ID NO: 1406674 - DNA, 14 bp, Homo sapiens
catctaattctgat

SEQ ID NO: 1406675 - DNA, 16 bp, Homo sapiens
catctaattctgattc

SEQ ID NO: 1406676 - DNA, 17 bp, Homo sapiens
catctatctagttctaa

SEQ ID NO: 1406677 - DNA, 13 bp, Homo sapiens
catctcctttgca

SEQ ID NO: 1406678 - DNA, 14 bp, Homo sapiens
catctcgctccctc

SEQ ID NO: 1406679 - DNA, 22 bp, Homo sapiens
catctcgctccctcccaggact

SEQ ID NO: 1406680 - DNA, 19 bp, Homo sapiens
catctctcaggaatcatct

SEQ ID NO: 1406681 - DNA, 18 bp, Homo sapiens
catcttcgggaccaggat

SEQ ID NO: 1406682 - DNA, 23 bp, Homo sapiens
catgaggaggggcccccctgccc

SEQ ID NO: 1406683 - DNA, 15 bp, Homo sapiens
catgcaataaaattt

SEQ ID NO: 1406684 - DNA, 15 bp, Homo sapiens
catggctgctgttgc

SEQ ID NO: 1406685 - DNA, 19 bp, Homo sapiens
catgtccaaacgtcctctt

SEQ ID NO: 1406686 - DNA, 15 bp, Homo sapiens
catgtcccctcccag

SEQ ID NO: 1406687 - DNA, 16 bp, Homo sapiens
catgtcccctcccaga

SEQ ID NO: 1406688 - DNA, 18 bp, Homo sapiens
catgtcccctcccagagc

SEQ ID NO: 1406689 - DNA, 14 bp, Homo sapiens
catgtgagctcttc

SEQ ID NO: 1406690 - DNA, 21 bp, Homo sapiens
catgtgagtgacgatgatgta

SEQ ID NO: 1406691 - DNA, 15 bp, Homo sapiens
catgtgatacatttt

SEQ ID NO: 1406692 - DNA, 18 bp, Homo sapiens
catgttgagacctcagct

SEQ ID NO: 1406693 - DNA, 21 bp, Homo sapiens
cattaaggggaagaatgaaag

SEQ ID NO: 1406694 - DNA, 21 bp, Homo sapiens
cattacagaggtattaaaact

SEQ ID NO: 1406695 - DNA, 15 bp, Homo sapiens
cattagctttaatta

SEQ ID NO: 1406696 - DNA, 12 bp, Homo sapiens
cattcagaaatg

SEQ ID NO: 1406697 - DNA, 18 bp, Homo sapiens
cattgacttttataaagc

SEQ ID NO: 1406698 - DNA, 15 bp, Homo sapiens
cattgagtattgttt

SEQ ID NO: 1406699 - DNA, 21 bp, Homo sapiens
catttccatgtcccctcccag

SEQ ID NO: 1406700 - DNA, 16 bp, Homo sapiens
catttctaagcctttg

SEQ ID NO: 1406701 - DNA, 22 bp, Homo sapiens
catttgctactgttgtaagaat

SEQ ID NO: 1406702 - DNA, 16 bp, Homo sapiens
catttggcctcttgta

SEQ ID NO: 1406703 - DNA, 15 bp, Homo sapiens
cattttaattttaaa

SEQ ID NO: 1406704 - DNA, 17 bp, Homo sapiens
cattttcttttttaacc

SEQ ID NO: 1406705 - DNA, 16 bp, Homo sapiens
cattttgcacctgcag

SEQ ID NO: 1406706 - DNA, 16 bp, Homo sapiens
cattttttaatttact

SEQ ID NO: 1406707 - DNA, 21 bp, Homo sapiens
cattttttaatttacttgttt

SEQ ID NO: 1406708 - DNA, 23 bp, Homo sapiens
cattttttaatttacttgttttg

SEQ ID NO: 1406709 - DNA, 14 bp, Homo sapiens
catttttttgcatg

SEQ ID NO: 1406710 - DNA, 15 bp, Homo sapiens
ccaaacccaggctat

SEQ ID NO: 1406711 - DNA, 15 bp, Homo sapiens
ccaagcaaatgcctg

SEQ ID NO: 1406712 - DNA, 18 bp, Homo sapiens
ccaattttaaaatgaaat

SEQ ID NO: 1406713 - DNA, 14 bp, Homo sapiens
ccacatcaaacctt

SEQ ID NO: 1406714 - DNA, 16 bp, Homo sapiens
ccagataactgaggag

SEQ ID NO: 1406715 - DNA, 21 bp, Homo sapiens
ccagatctttcagaaatataa

SEQ ID NO: 1406716 - DNA, 14 bp, Homo sapiens
ccagcattctcagg

SEQ ID NO: 1406717 - DNA, 13 bp, Homo sapiens
ccagccgattcct

SEQ ID NO: 1406718 - DNA, 15 bp, Homo sapiens
ccagccgattcctcc

SEQ ID NO: 1406719 - DNA, 18 bp, Homo sapiens
ccagccgattcctccagc

SEQ ID NO: 1406720 - DNA, 20 bp, Homo sapiens
ccaggacatgcaataaaatt

SEQ ID NO: 1406721 - DNA, 11 bp, Homo sapiens
ccaggactctg

SEQ ID NO: 1406722 - DNA, 14 bp, Homo sapiens
ccaggcaagaaaag

SEQ ID NO: 1406723 - DNA, 15 bp, Homo sapiens
ccatattaacaaatt

SEQ ID NO: 1406724 - DNA, 22 bp, Homo sapiens
ccatattaacaaattgcatttg

SEQ ID NO: 1406725 - DNA, 16 bp, Homo sapiens
ccatgtcccctcccag

SEQ ID NO: 1406726 - DNA, 15 bp, Homo sapiens
ccattaaggggaaga

SEQ ID NO: 1406727 - DNA, 23 bp, Homo sapiens
ccattacagaggtattaaaacta

SEQ ID NO: 1406728 - DNA, 19 bp, Homo sapiens
cccaaccacagaggatgct

SEQ ID NO: 1406729 - DNA, 23 bp, Homo sapiens
cccagagctggtggacccaggga

SEQ ID NO: 1406730 - DNA, 20 bp, Homo sapiens
cccatagcagccagttcaaa

SEQ ID NO: 1406731 - DNA, 21 bp, Homo sapiens
cccatcttcgggaccaggatt

SEQ ID NO: 1406732 - DNA, 15 bp, Homo sapiens
ccccactcagccttt

SEQ ID NO: 1406733 - DNA, 20 bp, Homo sapiens
ccccagcattctcaggcacc

SEQ ID NO: 1406734 - DNA, 18 bp, Homo sapiens
ccccatcttcgggaccag

SEQ ID NO: 1406735 - DNA, 12 bp, Homo sapiens
cccctcccagag

SEQ ID NO: 1406736 - DNA, 13 bp, Homo sapiens
cccgacgtgctcc

SEQ ID NO: 1406737 - DNA, 14 bp, Homo sapiens
ccctcccaggactc

SEQ ID NO: 1406738 - DNA, 12 bp, Homo sapiens
ccctgccctgtg

SEQ ID NO: 1406739 - DNA, 21 bp, Homo sapiens
ccctgtccggaatgccaccca

SEQ ID NO: 1406740 - DNA, 20 bp, Homo sapiens
cccttactttaaccctttct

SEQ ID NO: 1406741 - DNA, 21 bp, Homo sapiens
ccctttaaccctcacactgct

SEQ ID NO: 1406742 - DNA, 19 bp, Homo sapiens
ccgattcctccagccctgg

SEQ ID NO: 1406743 - DNA, 13 bp, Homo sapiens
cctaaaagcactc

SEQ ID NO: 1406744 - DNA, 14 bp, Homo sapiens
cctatccctctcct

SEQ ID NO: 1406745 - DNA, 22 bp, Homo sapiens
cctatgagggtgagctggtccc

SEQ ID NO: 1406746 - DNA, 14 bp, Homo sapiens
cctcagcttggcac

SEQ ID NO: 1406747 - DNA, 18 bp, Homo sapiens
cctctgaaaagtgtgtat

SEQ ID NO: 1406748 - DNA, 18 bp, Homo sapiens
cctcttgtagtcttggct

SEQ ID NO: 1406749 - DNA, 23 bp, Homo sapiens
cctctttagtttttggttgggaa

SEQ ID NO: 1406750 - DNA, 21 bp, Homo sapiens
cctgacaccaggcaagaaaag

SEQ ID NO: 1406751 - DNA, 16 bp, Homo sapiens
cctgagccttcagcac

SEQ ID NO: 1406752 - DNA, 12 bp, Homo sapiens
cctggcatttgg

SEQ ID NO: 1406753 - DNA, 15 bp, Homo sapiens
cctgtgggccagccg

SEQ ID NO: 1406754 - DNA, 21 bp, Homo sapiens
cctgtggggtcaacccttctg

SEQ ID NO: 1406755 - DNA, 13 bp, Homo sapiens
ccttactggctta

SEQ ID NO: 1406756 - DNA, 18 bp, Homo sapiens
ccttactggcttacctcc

SEQ ID NO: 1406757 - DNA, 20 bp, Homo sapiens
ccttcaaaactatagcttgc

SEQ ID NO: 1406758 - DNA, 22 bp, Homo sapiens
ccttctccctagctcctcccct

SEQ ID NO: 1406759 - DNA, 20 bp, Homo sapiens
cctttctcggggtcaggttc

SEQ ID NO: 1406760 - DNA, 21 bp, Homo sapiens
cctttctcggggtcaggttct

SEQ ID NO: 1406761 - DNA, 16 bp, Homo sapiens
cgaagtctgatccctg

SEQ ID NO: 1406762 - DNA, 17 bp, Homo sapiens
cgaagtctgatccctgc

SEQ ID NO: 1406763 - DNA, 19 bp, Homo sapiens
cgcaaaaatagctcttgct

SEQ ID NO: 1406764 - DNA, 13 bp, Homo sapiens
cgctccctcccag

SEQ ID NO: 1406765 - DNA, 15 bp, Homo sapiens
cgctccctcccagga

SEQ ID NO: 1406766 - DNA, 14 bp, Homo sapiens
cggcaccgccagcc

SEQ ID NO: 1406767 - DNA, 13 bp, Homo sapiens
cgtgctcccctgc

SEQ ID NO: 1406768 - DNA, 21 bp, Homo sapiens
cgtttttgtattttcatgaaa

SEQ ID NO: 1406769 - DNA, 13 bp, Homo sapiens
ctaaatttcacta

SEQ ID NO: 1406770 - DNA, 20 bp, Homo sapiens
ctaacagtgaagttttactg

SEQ ID NO: 1406771 - DNA, 14 bp, Homo sapiens
ctaactcaaataca

SEQ ID NO: 1406772 - DNA, 20 bp, Homo sapiens
ctaactcaaatacacatttg

SEQ ID NO: 1406773 - DNA, 22 bp, Homo sapiens
ctaagactatatatataaatgt

SEQ ID NO: 1406774 - DNA, 23 bp, Homo sapiens
ctaagcattagctttaattaagc

SEQ ID NO: 1406775 - DNA, 10 bp, Homo sapiens
ctaaggaaat

SEQ ID NO: 1406776 - DNA, 14 bp, Homo sapiens
ctaaggtccccagc

SEQ ID NO: 1406777 - DNA, 13 bp, Homo sapiens
ctacaatctcttt

SEQ ID NO: 1406778 - DNA, 15 bp, Homo sapiens
ctagccagccaggaa

SEQ ID NO: 1406779 - DNA, 15 bp, Homo sapiens
ctagctcctcccctt

SEQ ID NO: 1406780 - DNA, 20 bp, Homo sapiens
ctaggaagtaaagtgaagaa

SEQ ID NO: 1406781 - DNA, 22 bp, Homo sapiens
ctagtaagaagacaaactgctt

SEQ ID NO: 1406782 - DNA, 13 bp, Homo sapiens
ctataaaactctg

SEQ ID NO: 1406783 - DNA, 15 bp, Homo sapiens
ctataaaactctgca

SEQ ID NO: 1406784 - DNA, 16 bp, Homo sapiens
ctatatatacatcata

SEQ ID NO: 1406785 - DNA, 16 bp, Homo sapiens
ctatatatataaatgt

SEQ ID NO: 1406786 - DNA, 17 bp, Homo sapiens
ctatatatataaatgta

SEQ ID NO: 1406787 - DNA, 18 bp, Homo sapiens
ctatctagttctaacagt

SEQ ID NO: 1406788 - DNA, 18 bp, Homo sapiens
ctattatttttataattg

SEQ ID NO: 1406789 - DNA, 22 bp, Homo sapiens
ctattctataaaactctgcatg

SEQ ID NO: 1406790 - DNA, 17 bp, Homo sapiens
ctattgaataatgtagt

SEQ ID NO: 1406791 - DNA, 12 bp, Homo sapiens
ctatttttgtac

SEQ ID NO: 1406792 - DNA, 16 bp, Homo sapiens
ctcaaatacacatttg

SEQ ID NO: 1406793 - DNA, 17 bp, Homo sapiens
ctcaaatacacatttgc

SEQ ID NO: 1406794 - DNA, 20 bp, Homo sapiens
ctcagccttgcaaatagcca

SEQ ID NO: 1406795 - DNA, 16 bp, Homo sapiens
ctcagcttggcactca

SEQ ID NO: 1406796 - DNA, 23 bp, Homo sapiens
ctcagcttggcactcaggtgctg

SEQ ID NO: 1406797 - DNA, 21 bp, Homo sapiens
ctcagtgttggtatattttat

SEQ ID NO: 1406798 - DNA, 22 bp, Homo sapiens
ctcagtgttggtatattttata

SEQ ID NO: 1406799 - DNA, 17 bp, Homo sapiens
ctcatgaggaggggccc

SEQ ID NO: 1406800 - DNA, 19 bp, Homo sapiens
ctccactctctaccagata

SEQ ID NO: 1406801 - DNA, 17 bp, Homo sapiens
ctccctcccaggactct

SEQ ID NO: 1406802 - DNA, 19 bp, Homo sapiens
ctccgaagtctgatccctg

SEQ ID NO: 1406803 - DNA, 20 bp, Homo sapiens
ctcctaactgccagccccct

SEQ ID NO: 1406804 - DNA, 20 bp, Homo sapiens
ctcctcatggcagcctactc

SEQ ID NO: 1406805 - DNA, 17 bp, Homo sapiens
ctcctccccttcctctt

SEQ ID NO: 1406806 - DNA, 19 bp, Homo sapiens
ctcctgcttaatcttcaaa

SEQ ID NO: 1406807 - DNA, 23 bp, Homo sapiens
ctccttaagctgcagagatttct

SEQ ID NO: 1406808 - DNA, 20 bp, Homo sapiens
ctcctttgcagaatgatgca

SEQ ID NO: 1406809 - DNA, 15 bp, Homo sapiens
ctcgctccctcccag

SEQ ID NO: 1406810 - DNA, 23 bp, Homo sapiens
ctctaccagataactgaggaggg

SEQ ID NO: 1406811 - DNA, 21 bp, Homo sapiens
ctctatatatacatcatactt

SEQ ID NO: 1406812 - DNA, 22 bp, Homo sapiens
ctctcctaactgccagccccct

SEQ ID NO: 1406813 - DNA, 14 bp, Homo sapiens
ctctccttgagtgt

SEQ ID NO: 1406814 - DNA, 20 bp, Homo sapiens
ctctgaccccagcattctca

SEQ ID NO: 1406815 - DNA, 21 bp, Homo sapiens
ctcttgtagtcttggctaagg

SEQ ID NO: 1406816 - DNA, 23 bp, Homo sapiens
ctgagatgaaccctggcatttgg

SEQ ID NO: 1406817 - DNA, 11 bp, Homo sapiens
ctgagcacaga

SEQ ID NO: 1406818 - DNA, 13 bp, Homo sapiens
ctgagcacagatg

SEQ ID NO: 1406819 - DNA, 14 bp, Homo sapiens
ctgagggcagagag

SEQ ID NO: 1406820 - DNA, 20 bp, Homo sapiens
ctgcagagggctccagagtg

SEQ ID NO: 1406821 - DNA, 15 bp, Homo sapiens
ctgcagccaagcaaa

SEQ ID NO: 1406822 - DNA, 19 bp, Homo sapiens
ctgcagccaagcaaatgcc

SEQ ID NO: 1406823 - DNA, 20 bp, Homo sapiens
ctgcagccaagcaaatgcct

SEQ ID NO: 1406824 - DNA, 19 bp, Homo sapiens
ctgcatagcttttccctgt

SEQ ID NO: 1406825 - DNA, 20 bp, Homo sapiens
ctgcatgtagaggcttgttt

SEQ ID NO: 1406826 - DNA, 17 bp, Homo sapiens
ctgctatgtatttgcaa

SEQ ID NO: 1406827 - DNA, 20 bp, Homo sapiens
ctgctatgtatttgcaaggc

SEQ ID NO: 1406828 - DNA, 22 bp, Homo sapiens
ctgcttaatcttcaaagccttc

SEQ ID NO: 1406829 - DNA, 20 bp, Homo sapiens
ctgcttcccttactttgctg

SEQ ID NO: 1406830 - DNA, 16 bp, Homo sapiens
ctggcatttggcctct

SEQ ID NO: 1406831 - DNA, 12 bp, Homo sapiens
ctggggggcagg

SEQ ID NO: 1406832 - DNA, 21 bp, Homo sapiens
ctggtctatataaccacattt

SEQ ID NO: 1406833 - DNA, 15 bp, Homo sapiens
ctggtggacccaggg

SEQ ID NO: 1406834 - DNA, 17 bp, Homo sapiens
ctgtactgtgtctcatg

SEQ ID NO: 1406835 - DNA, 14 bp, Homo sapiens
ctgtagatatgtat

SEQ ID NO: 1406836 - DNA, 14 bp, Homo sapiens
ctgtagctgccatg

SEQ ID NO: 1406837 - DNA, 15 bp, Homo sapiens
ctgtcattgcacata

SEQ ID NO: 1406838 - DNA, 21 bp, Homo sapiens
ctgtgaagatctcactctgcc

SEQ ID NO: 1406839 - DNA, 17 bp, Homo sapiens
ctgtggcataaattgca

SEQ ID NO: 1406840 - DNA, 19 bp, Homo sapiens
ctgtggcctgatcagcagg

SEQ ID NO: 1406841 - DNA, 12 bp, Homo sapiens
ctgtgggccagc

SEQ ID NO: 1406842 - DNA, 13 bp, Homo sapiens
ctgtgggccagcc

SEQ ID NO: 1406843 - DNA, 14 bp, Homo sapiens
ctgtgggccagccg

SEQ ID NO: 1406844 - DNA, 22 bp, Homo sapiens
ctgtggggtcaacccttctgga

SEQ ID NO: 1406845 - DNA, 19 bp, Homo sapiens
ctgttgtaagaattctgat

SEQ ID NO: 1406846 - DNA, 13 bp, Homo sapiens
cttaaaataaagt

SEQ ID NO: 1406847 - DNA, 19 bp, Homo sapiens
cttaaacgaagagttccct

SEQ ID NO: 1406848 - DNA, 12 bp, Homo sapiens
cttaaatttaat

SEQ ID NO: 1406849 - DNA, 17 bp, Homo sapiens
cttaactttactaagta

SEQ ID NO: 1406850 - DNA, 17 bp, Homo sapiens
cttaatggagttcttgt

SEQ ID NO: 1406851 - DNA, 20 bp, Homo sapiens
cttaccagggagatttgctc

SEQ ID NO: 1406852 - DNA, 20 bp, Homo sapiens
cttattatgtaggtaagact

SEQ ID NO: 1406853 - DNA, 16 bp, Homo sapiens
cttccattttaatttt

SEQ ID NO: 1406854 - DNA, 16 bp, Homo sapiens
cttgaaactttgggaa

SEQ ID NO: 1406855 - DNA, 23 bp, Homo sapiens
cttgatttcaaagttttgttgta

SEQ ID NO: 1406856 - DNA, 16 bp, Homo sapiens
cttggaaattcctgta

SEQ ID NO: 1406857 - DNA, 11 bp, Homo sapiens
cttggactcat

SEQ ID NO: 1406858 - DNA, 15 bp, Homo sapiens
cttgtttacctttct

SEQ ID NO: 1406859 - DNA, 22 bp, Homo sapiens
cttgtttacctttctctctcta

SEQ ID NO: 1406860 - DNA, 17 bp, Homo sapiens
ctttaagccttcaaaac

SEQ ID NO: 1406861 - DNA, 18 bp, Homo sapiens
ctttaagccttcaaaact

SEQ ID NO: 1406862 - DNA, 20 bp, Homo sapiens
ctttaagccttcaaaactat

SEQ ID NO: 1406863 - DNA, 19 bp, Homo sapiens
ctttaattaagctctcata

SEQ ID NO: 1406864 - DNA, 23 bp, Homo sapiens
ctttagttagtgattatatttca

SEQ ID NO: 1406865 - DNA, 13 bp, Homo sapiens
ctttagtttttgg

SEQ ID NO: 1406866 - DNA, 15 bp, Homo sapiens
ctttcagaaatataa

SEQ ID NO: 1406867 - DNA, 21 bp, Homo sapiens
ctttcagaaatataacacatt

SEQ ID NO: 1406868 - DNA, 23 bp, Homo sapiens
ctttcagaaatataacacatttt

SEQ ID NO: 1406869 - DNA, 21 bp, Homo sapiens
ctttgacttaggtgtgaagac

SEQ ID NO: 1406870 - DNA, 13 bp, Homo sapiens
ctttgagactgtt

SEQ ID NO: 1406871 - DNA, 23 bp, Homo sapiens
ctttgagtagatccatttccatt

SEQ ID NO: 1406872 - DNA, 18 bp, Homo sapiens
ctttggattctaaataca

SEQ ID NO: 1406873 - DNA, 14 bp, Homo sapiens
ctttgggaaaacat

SEQ ID NO: 1406874 - DNA, 21 bp, Homo sapiens
ctttgggaaaacatgttaatg

SEQ ID NO: 1406875 - DNA, 13 bp, Homo sapiens
ctttgtaaaaatc

SEQ ID NO: 1406876 - DNA, 17 bp, Homo sapiens
ctttgtattttgattat

SEQ ID NO: 1406877 - DNA, 18 bp, Homo sapiens
ctttgtattttgattatt

SEQ ID NO: 1406878 - DNA, 13 bp, Homo sapiens
cttttataaagca

SEQ ID NO: 1406879 - DNA, 14 bp, Homo sapiens
cttttataaagcat

SEQ ID NO: 1406880 - DNA, 21 bp, Homo sapiens
cttttgaagcatagataatat

SEQ ID NO: 1406881 - DNA, 12 bp, Homo sapiens
cttttgtttggt

SEQ ID NO: 1406882 - DNA, 15 bp, Homo sapiens
cttttgtttggtaaa

SEQ ID NO: 1406883 - DNA, 16 bp, Homo sapiens
cttttttttttcttgg

SEQ ID NO: 1406884 - DNA, 12 bp, Homo sapiens
gaaaaatataaa

SEQ ID NO: 1406885 - DNA, 16 bp, Homo sapiens
gaaaaatataaaatta

SEQ ID NO: 1406886 - DNA, 12 bp, Homo sapiens
gaaaacacagat

SEQ ID NO: 1406887 - DNA, 13 bp, Homo sapiens
gaaaagagaaaaa

SEQ ID NO: 1406888 - DNA, 14 bp, Homo sapiens
gaaaagagaaaaaa

SEQ ID NO: 1406889 - DNA, 13 bp, Homo sapiens
gaaaagcgcagag

SEQ ID NO: 1406890 - DNA, 14 bp, Homo sapiens
gaaaagcgcagaga

SEQ ID NO: 1406891 - DNA, 18 bp, Homo sapiens
gaaactgagggcagagag

SEQ ID NO: 1406892 - DNA, 19 bp, Homo sapiens
gaaagtttttttttattat

SEQ ID NO: 1406893 - DNA, 17 bp, Homo sapiens
gaaatataacacatttt

SEQ ID NO: 1406894 - DNA, 18 bp, Homo sapiens
gaaatataacacattttt

SEQ ID NO: 1406895 - DNA, 15 bp, Homo sapiens
gtagatccatttcca

SEQ ID NO: 1406896 - DNA, 12 bp, Homo sapiens
gtataaatatac

SEQ ID NO: 1406897 - DNA, 18 bp, Homo sapiens
gtatactgggggcaaaat

SEQ ID NO: 1406898 - DNA, 18 bp, Homo sapiens
gtattgtttaaaatgtaa

SEQ ID NO: 1406899 - DNA, 17 bp, Homo sapiens
gtcaacccttctggaaa

SEQ ID NO: 1406900 - DNA, 13 bp, Homo sapiens
gtccccagcagaa

SEQ ID NO: 1406901 - DNA, 14 bp, Homo sapiens
gtccttgatttcaa

SEQ ID NO: 1406902 - DNA, 13 bp, Homo sapiens
gtctgatttctta

SEQ ID NO: 1406903 - DNA, 20 bp, Homo sapiens
gtgaaattgcatactttgta

SEQ ID NO: 1406904 - DNA, 18 bp, Homo sapiens
gtgaagttttactgtcta

SEQ ID NO: 1406905 - DNA, 23 bp, Homo sapiens
gtgagctcttcctatccctctcc

SEQ ID NO: 1406906 - DNA, 12 bp, Homo sapiens
gtgatgcatttt

SEQ ID NO: 1406907 - DNA, 16 bp, Homo sapiens
gtgatttaatccagtt

SEQ ID NO: 1406908 - DNA, 14 bp, Homo sapiens
gtgatttgaaaaat

SEQ ID NO: 1406909 - DNA, 17 bp, Homo sapiens
gtgatttgaaaaatata

SEQ ID NO: 1406910 - DNA, 22 bp, Homo sapiens
gtgatttgaaaaatataaaatt

SEQ ID NO: 1406911 - DNA, 22 bp, Homo sapiens
gtggcctcagctcaatgcagtt

SEQ ID NO: 1406912 - DNA, 18 bp, Homo sapiens
gtggtgatttgaaaaata

SEQ ID NO: 1406913 - DNA, 21 bp, Homo sapiens
gtggtgatttgaaaaatataa

SEQ ID NO: 1406914 - DNA, 22 bp, Homo sapiens
tcaggtgctgaagggtaatatg

SEQ ID NO: 1406915 - DNA, 22 bp, Homo sapiens
tcagtaacccccttaaatttaa

SEQ ID NO: 1406916 - DNA, 23 bp, Homo sapiens
tcagtaacccccttaaatttaat

SEQ ID NO: 1406917 - DNA, 16 bp, Homo sapiens
tcagtagactgtgatt

SEQ ID NO: 1406918 - DNA, 15 bp, Homo sapiens
tcagtttgttggaaa

SEQ ID NO: 1406919 - DNA, 19 bp, Homo sapiens
tcagtttgttggaaagtaa

SEQ ID NO: 1406920 - DNA, 18 bp, Homo sapiens
tcatctcctttgcagaat

SEQ ID NO: 1406921 - DNA, 14 bp, Homo sapiens
tcatgaaaatacca

SEQ ID NO: 1406922 - DNA, 16 bp, Homo sapiens
tcatgaaaataccatt

SEQ ID NO: 1406923 - DNA, 14 bp, Homo sapiens
tcattgacttttat

SEQ ID NO: 1406924 - DNA, 22 bp, Homo sapiens
tcatttatcatcacaaatggct

SEQ ID NO: 1406925 - DNA, 24 bp, Homo sapiens
tcattttgcacctgcagccaagca

SEQ ID NO: 1406926 - DNA, 20 bp, Homo sapiens
tccaaggctactacagagaa

SEQ ID NO: 1406927 - DNA, 17 bp, Homo sapiens
tccaattttaaaatgaa

SEQ ID NO: 1406928 - DNA, 22 bp, Homo sapiens
tccaattttaaaatgaaatgca

SEQ ID NO: 1406929 - DNA, 13 bp, Homo sapiens
tccagttataaga

SEQ ID NO: 1406930 - DNA, 16 bp, Homo sapiens
tccatgtcccctccca

SEQ ID NO: 1406931 - DNA, 21 bp, Homo sapiens
tcccagagctggtggacccag

SEQ ID NO: 1406932 - DNA, 19 bp, Homo sapiens
tcccaggtcgcccacctgt

SEQ ID NO: 1406933 - DNA, 13 bp, Homo sapiens
tcccctcccagag

SEQ ID NO: 1406934 - DNA, 15 bp, Homo sapiens
tcccctttcagagat

SEQ ID NO: 1406935 - DNA, 14 bp, Homo sapiens
tccctcccaggact

SEQ ID NO: 1406936 - DNA, 16 bp, Homo sapiens
tcccttagtactcttc

SEQ ID NO: 1406937 - DNA, 18 bp, Homo sapiens
tcccttagtactcttcta

SEQ ID NO: 1406938 - DNA, 14 bp, Homo sapiens
tcctagtaagaaga

SEQ ID NO: 1406939 - DNA, 22 bp, Homo sapiens
tcctcatggcagcctactctcc

SEQ ID NO: 1406940 - DNA, 22 bp, Homo sapiens
tcctgacaccaggcaagaaaag

SEQ ID NO: 1406941 - DNA, 23 bp, Homo sapiens
tcctgacaccaggcaagaaaagc

SEQ ID NO: 1406942 - DNA, 16 bp, Homo sapiens
tcctgtggcataaatt

SEQ ID NO: 1406943 - DNA, 17 bp, Homo sapiens
tccttaagctgcagaga

SEQ ID NO: 1406944 - DNA, 20 bp, Homo sapiens
tccttaagctgcagagattt

SEQ ID NO: 1406945 - DNA, 13 bp, Homo sapiens
tcgctccctccca

SEQ ID NO: 1406946 - DNA, 11 bp, Homo sapiens
tcgggaccagg

SEQ ID NO: 1406947 - DNA, 17 bp, Homo sapiens
tctaaaaggtaatgtgt

SEQ ID NO: 1406948 - DNA, 21 bp, Homo sapiens
tctaagactatatatataaat

SEQ ID NO: 1406949 - DNA, 13 bp, Homo sapiens
tctagaattccag

SEQ ID NO: 1406950 - DNA, 12 bp, Homo sapiens
tctagtgatgat

SEQ ID NO: 1406951 - DNA, 12 bp, Homo sapiens
tctataaaactc

SEQ ID NO: 1406952 - DNA, 16 bp, Homo sapiens
tctattaatattcagg

SEQ ID NO: 1406953 - DNA, 13 bp, Homo sapiens
tctattgaataat

SEQ ID NO: 1406954 - DNA, 23 bp, Homo sapiens
tctcaggaatcatctcctttgca

SEQ ID NO: 1406955 - DNA, 20 bp, Homo sapiens
tctcaggcaccagtccctgt

SEQ ID NO: 1406956 - DNA, 14 bp, Homo sapiens
tctccaccttccaa

SEQ ID NO: 1406957 - DNA, 16 bp, Homo sapiens
tctccctagctcctcc

SEQ ID NO: 1406958 - DNA, 12 bp, Homo sapiens
tctccttaagct

SEQ ID NO: 1406959 - DNA, 22 bp, Homo sapiens
tctccttaagctgcagagattt

SEQ ID NO: 1406960 - DNA, 16 bp, Homo sapiens
tctccttgagtgtatg

SEQ ID NO: 1406961 - DNA, 17 bp, Homo sapiens
tctcggggtcaggttct

SEQ ID NO: 1406962 - DNA, 17 bp, Homo sapiens
tctctaaggtttacaat

SEQ ID NO: 1406963 - DNA, 12 bp, Homo sapiens
tctctttttgtt

SEQ ID NO: 1406964 - DNA, 22 bp, Homo sapiens
tctgaaatcttcccatgcattc

SEQ ID NO: 1406965 - DNA, 23 bp, Homo sapiens
tctgacgattttggaaatgagaa

SEQ ID NO: 1406966 - DNA, 12 bp, Homo sapiens
tctgagcacaga

SEQ ID NO: 1406967 - DNA, 20 bp, Homo sapiens
tctgccccccccccccatct

SEQ ID NO: 1406968 - DNA, 20 bp, Homo sapiens
tcttaccagggagatttgct

SEQ ID NO: 1406969 - DNA, 19 bp, Homo sapiens
tcttcctatccctctccta

SEQ ID NO: 1406970 - DNA, 22 bp, Homo sapiens
tcttcctatccctctcctaact

SEQ ID NO: 1406971 - DNA, 17 bp, Homo sapiens
tcttcgggaccaggatt

SEQ ID NO: 1406972 - DNA, 22 bp, Homo sapiens
tcttctggtactttctgttatg

SEQ ID NO: 1406973 - DNA, 14 bp, Homo sapiens
tcttgtagtcttgg

SEQ ID NO: 1406974 - DNA, 15 bp, Homo sapiens
tctttggattctaaa

SEQ ID NO: 1406975 - DNA, 12 bp, Homo sapiens
tcttttgaagca

SEQ ID NO: 1406976 - DNA, 12 bp, Homo sapiens
tcttttgtttgg

SEQ ID NO: 1406977 - DNA, 12 bp, Homo sapiens
tcttttttaacc

SEQ ID NO: 1406978 - DNA, 23 bp, Homo sapiens
tcttttttaaccggtaagagttt

SEQ ID NO: 1406979 - DNA, 12 bp, Homo sapiens
tgaaaaatataa

SEQ ID NO: 1406980 - DNA, 13 bp, Homo sapiens
tgaaaataccatt

SEQ ID NO: 1406981 - DNA, 17 bp, Homo sapiens
tgaaacctttttttatc

SEQ ID NO: 1406982 - DNA, 15 bp, Homo sapiens
tgaaactttgggaaa

SEQ ID NO: 1406983 - DNA, 17 bp, Homo sapiens
tgaaagaaaattgagtt

SEQ ID NO: 1406984 - DNA, 15 bp, Homo sapiens
tgaaatgcattttgc

SEQ ID NO: 1406985 - DNA, 16 bp, Homo sapiens
tgaaattgcatacttt

SEQ ID NO: 1406986 - DNA, 17 bp, Homo sapiens
tgaaattgcatactttg

SEQ ID NO: 1406987 - DNA, 13 bp, Homo sapiens
tgaaccctggcat

SEQ ID NO: 1406988 - DNA, 22 bp, Homo sapiens
tgaaccctggcatttggcctct

SEQ ID NO: 1406989 - DNA, 13 bp, Homo sapiens
tgacatttcttct

SEQ ID NO: 1406990 - DNA, 18 bp, Homo sapiens
tgaccagatatatagaag

SEQ ID NO: 1406991 - DNA, 14 bp, Homo sapiens
tgacgatgatgtac

SEQ ID NO: 1406992 - DNA, 20 bp, Homo sapiens
tgactaactcaaatacacat

SEQ ID NO: 1406993 - DNA, 23 bp, Homo sapiens
tgactaactcaaatacacatttg

SEQ ID NO: 1406994 - DNA, 13 bp, Homo sapiens
tgagattggtttt

SEQ ID NO: 1406995 - DNA, 19 bp, Homo sapiens
tgagattggttttcctgtg

SEQ ID NO: 1406996 - DNA, 15 bp, Homo sapiens
tgagctctgaaatct

SEQ ID NO: 1406997 - DNA, 17 bp, Homo sapiens
tgagctctgaaatcttc

SEQ ID NO: 1406998 - DNA, 16 bp, Homo sapiens
tgagctggtcccctct

SEQ ID NO: 1406999 - DNA, 15 bp, Homo sapiens
tgaggaaaattctta

SEQ ID NO: 1407000 - DNA, 19 bp, Homo sapiens
tgagtagatccatttccat

SEQ ID NO: 1407001 - DNA, 21 bp, Homo sapiens
tgagtagatccatttccattg

SEQ ID NO: 1407002 - DNA, 11 bp, Homo sapiens
tgatgcatttt

SEQ ID NO: 1407003 - DNA, 21 bp, Homo sapiens
tgattattttttttttcttct

SEQ ID NO: 1407004 - DNA, 16 bp, Homo sapiens
tgattgggaaaacatt

SEQ ID NO: 1407005 - DNA, 17 bp, Homo sapiens
tgattgggaaaacattt

SEQ ID NO: 1407006 - DNA, 20 bp, Homo sapiens
tgattgggaaaacatttgct

SEQ ID NO: 1407007 - DNA, 21 bp, Homo sapiens
tgattgggaaaacatttgctg

SEQ ID NO: 1407008 - DNA, 22 bp, Homo sapiens
tgatttcttaggggaaggagaa

SEQ ID NO: 1407009 - DNA, 18 bp, Homo sapiens
tgatttgggctctagaat

SEQ ID NO: 1407010 - DNA, 20 bp, Homo sapiens
tgcaaatgagctctgaaatc

SEQ ID NO: 1407011 - DNA, 19 bp, Homo sapiens
tgcaacactcaagtctatt

SEQ ID NO: 1407012 - DNA, 22 bp, Homo sapiens
tgcacataagcttccattttaa

SEQ ID NO: 1407013 - DNA, 16 bp, Homo sapiens
tgcacctgcagccaag

SEQ ID NO: 1407014 - DNA, 19 bp, Homo sapiens
tgcacttattgaccatttt

SEQ ID NO: 1407015 - DNA, 20 bp, Homo sapiens
tgcagagatttctcattgac

SEQ ID NO: 1407016 - DNA, 13 bp, Homo sapiens
tgcatactttgta

SEQ ID NO: 1407017 - DNA, 18 bp, Homo sapiens
tgcatgtagaggcttgtt

SEQ ID NO: 1407018 - DNA, 9 bp, Homo sapiens
aaaaaaaga

SEQ ID NO: 1407019 - DNA, 12 bp, Homo sapiens
aaaacatttgct

SEQ ID NO: 1407020 - DNA, 14 bp, Homo sapiens
aaaagatctttcat

SEQ ID NO: 1407021 - DNA, 23 bp, Homo sapiens
aacatttgctctggggggcaggg

SEQ ID NO: 1407022 - DNA, 19 bp, Homo sapiens
aaccacacttgaaaccttt

SEQ ID NO: 1407023 - DNA, 12 bp, Homo sapiens
aaccactagaaa

SEQ ID NO: 1407024 - DNA, 16 bp, Homo sapiens
aacccagtttcccgtc

SEQ ID NO: 1407025 - DNA, 23 bp, Homo sapiens
aactatagcttgcagaactgtag

SEQ ID NO: 1407026 - DNA, 13 bp, Homo sapiens
aactcaaatacac

SEQ ID NO: 1407027 - DNA, 23 bp, Homo sapiens
aactgcttcccttactttgctga

SEQ ID NO: 1407028 - DNA, 12 bp, Homo sapiens
aactttgggaaa

SEQ ID NO: 1407029 - DNA, 16 bp, Homo sapiens
aactttgggaaaacat

SEQ ID NO: 1407030 - DNA, 9 bp, Homo sapiens
aagaaaaga

SEQ ID NO: 1407031 - DNA, 13 bp, Homo sapiens
aagaaaagagaaa

SEQ ID NO: 1407032 - DNA, 18 bp, Homo sapiens
aagaattgaaaagttttt

SEQ ID NO: 1407033 - DNA, 15 bp, Homo sapiens
aagaatttatctctt

SEQ ID NO: 1407034 - DNA, 15 bp, Homo sapiens
aagactagccagcca

SEQ ID NO: 1407035 - DNA, 20 bp, Homo sapiens
aagactagccagccaggaag

SEQ ID NO: 1407036 - DNA, 11 bp, Homo sapiens
aagagaatgag

SEQ ID NO: 1407037 - DNA, 20 bp, Homo sapiens
aagagtaacagtcatcattt

SEQ ID NO: 1407038 - DNA, 16 bp, Homo sapiens
aagagttcccttgaaa

SEQ ID NO: 1407039 - DNA, 18 bp, Homo sapiens
aagagtttcagtttgttg

SEQ ID NO: 1407040 - DNA, 21 bp, Homo sapiens
aagagtttcagtttgttggaa

SEQ ID NO: 1407041 - DNA, 19 bp, Homo sapiens
aagatggggaaactgaggg

SEQ ID NO: 1407042 - DNA, 18 bp, Homo sapiens
aagcaaatgcctgccaaa

SEQ ID NO: 1407043 - DNA, 21 bp, Homo sapiens
aagcaaatgcctgccaaattt

SEQ ID NO: 1407044 - DNA, 23 bp, Homo sapiens
aagcactcctgcttaatcttcaa

SEQ ID NO: 1407045 - DNA, 20 bp, Homo sapiens
aagcatagataatattgttt

SEQ ID NO: 1407046 - DNA, 19 bp, Homo sapiens
aagccaatctacaatctct

SEQ ID NO: 1407047 - DNA, 13 bp, Homo sapiens
aagccttcaaaac

SEQ ID NO: 1407048 - DNA, 17 bp, Homo sapiens
aagcctttgagactgtt

SEQ ID NO: 1407049 - DNA, 16 bp, Homo sapiens
aagctctcatagctca

SEQ ID NO: 1407050 - DNA, 23 bp, Homo sapiens
aagctgcagagatttctcattga

SEQ ID NO: 1407051 - DNA, 15 bp, Homo sapiens
aagcttcagttgctt

SEQ ID NO: 1407052 - DNA, 19 bp, Homo sapiens
aaggagataagaaagcagg

SEQ ID NO: 1407053 - DNA, 21 bp, Homo sapiens
aagggccagcgtggctctaaa

SEQ ID NO: 1407054 - DNA, 13 bp, Homo sapiens
aaggtaatgtgtg

SEQ ID NO: 1407055 - DNA, 15 bp, Homo sapiens
aaggtccccagcaga

SEQ ID NO: 1407056 - DNA, 21 bp, Homo sapiens
aagtgaagaatttatctcttt

SEQ ID NO: 1407057 - DNA, 19 bp, Homo sapiens
aagtgtgtatatattttgt

SEQ ID NO: 1407058 - DNA, 22 bp, Homo sapiens
aagttttgttgtacttaaatgg

SEQ ID NO: 1407059 - DNA, 18 bp, Homo sapiens
aataaagttaaactgatt

SEQ ID NO: 1407060 - DNA, 19 bp, Homo sapiens
aataccacatcaaataaga

SEQ ID NO: 1407061 - DNA, 21 bp, Homo sapiens
aataccacatcaaataagaaa

SEQ ID NO: 1407062 - DNA, 20 bp, Homo sapiens
aataggaatcattcagaaat

SEQ ID NO: 1407063 - DNA, 14 bp, Homo sapiens
aatataacacattt

SEQ ID NO: 1407064 - DNA, 15 bp, Homo sapiens
aatataacacatttt

SEQ ID NO: 1407065 - DNA, 16 bp, Homo sapiens
aatatcccttacttta

SEQ ID NO: 1407066 - DNA, 17 bp, Homo sapiens
aatatggactcagcctt

SEQ ID NO: 1407067 - DNA, 21 bp, Homo sapiens
aatatggactcagccttgcaa

SEQ ID NO: 1407068 - DNA, 16 bp, Homo sapiens
aatattccagatcttt

SEQ ID NO: 1407069 - DNA, 20 bp, Homo sapiens
aatattgattgggaaaacat

SEQ ID NO: 1407070 - DNA, 20 bp, Homo sapiens
aatattgtttggtaaatgtt

SEQ ID NO: 1407071 - DNA, 13 bp, Homo sapiens
aatcattcagaaa

SEQ ID NO: 1407072 - DNA, 19 bp, Homo sapiens
aatcattcagaaatgttga

SEQ ID NO: 1407073 - DNA, 23 bp, Homo sapiens
aatcattcagaaatgttgagtct

SEQ ID NO: 1407074 - DNA, 13 bp, Homo sapiens
aatccagttataa

SEQ ID NO: 1407075 - DNA, 16 bp, Homo sapiens
aatccagttataagaa

SEQ ID NO: 1407076 - DNA, 15 bp, Homo sapiens
aatctctccaccttc

SEQ ID NO: 1407077 - DNA, 19 bp, Homo sapiens
aatctctccaccttccaaa

SEQ ID NO: 1407078 - DNA, 20 bp, Homo sapiens
aatctctccaccttccaaag

SEQ ID NO: 1407079 - DNA, 21 bp, Homo sapiens
aatctctccaccttccaaaga

SEQ ID NO: 1407080 - DNA, 17 bp, Homo sapiens
aatctctttttgtttgc

SEQ ID NO: 1407081 - DNA, 17 bp, Homo sapiens
aatcttcaaagccttct

SEQ ID NO: 1407082 - DNA, 12 bp, Homo sapiens
aatgaaatgcat

SEQ ID NO: 1407083 - DNA, 14 bp, Homo sapiens
aatgaaatgcattt

SEQ ID NO: 1407084 - DNA, 12 bp, Homo sapiens
aatgagaacaat

SEQ ID NO: 1407085 - DNA, 18 bp, Homo sapiens
aatggctacatctccaaa

SEQ ID NO: 1407086 - DNA, 20 bp, Homo sapiens
aatggctacatctccaaata

SEQ ID NO: 1407087 - DNA, 14 bp, Homo sapiens
aatggtaataagca

SEQ ID NO: 1407088 - DNA, 17 bp, Homo sapiens
aatgtaatttaaatgaa

SEQ ID NO: 1407089 - DNA, 23 bp, Homo sapiens
aatgtagttttgtgatgcatttt

SEQ ID NO: 1407090 - DNA, 17 bp, Homo sapiens
aatgtttcttttgtttg

SEQ ID NO: 1407091 - DNA, 15 bp, Homo sapiens
aattaagcaaatgtt

SEQ ID NO: 1407092 - DNA, 16 bp, Homo sapiens
aattcaactttgtaaa

SEQ ID NO: 1407093 - DNA, 21 bp, Homo sapiens
aattctaacgcaaaaatagct

SEQ ID NO: 1407094 - DNA, 23 bp, Homo sapiens
aattctgattctggctttaagcc

SEQ ID NO: 1407095 - DNA, 12 bp, Homo sapiens
aattgcatttgt

SEQ ID NO: 1407096 - DNA, 12 bp, Homo sapiens
aattgtacaaaa

SEQ ID NO: 1407097 - DNA, 16 bp, Homo sapiens
aatttaaatgaaagaa

SEQ ID NO: 1407098 - DNA, 22 bp, Homo sapiens
aatttaaatgaaagaaaattga

SEQ ID NO: 1407099 - DNA, 16 bp, Homo sapiens
aatttacttgttttgg

SEQ ID NO: 1407100 - DNA, 13 bp, Homo sapiens
ttcctccagccct

SEQ ID NO: 1407101 - DNA, 15 bp, Homo sapiens
ttcctcttgtctgat

SEQ ID NO: 1407102 - DNA, 12 bp, Homo sapiens
ttcctgtactgt

SEQ ID NO: 1407103 - DNA, 16 bp, Homo sapiens
ttcctgtactgtgtct

SEQ ID NO: 1407104 - DNA, 23 bp, Homo sapiens
ttccttggtcctagtaagaagac

SEQ ID NO: 1407105 - DNA, 23 bp, Homo sapiens
ttctagtgatgatggttcacgtt

SEQ ID NO: 1407106 - DNA, 21 bp, Homo sapiens
ttctataaaactctgcatgta

SEQ ID NO: 1407107 - DNA, 19 bp, Homo sapiens
ttctgggatgcaatactag

SEQ ID NO: 1407108 - DNA, 17 bp, Homo sapiens
ttctggtactttctgtt

SEQ ID NO: 1407109 - DNA, 18 bp, Homo sapiens
ttcttaggggaaggagaa

SEQ ID NO: 1407110 - DNA, 13 bp, Homo sapiens
ttcttttgtttgg

SEQ ID NO: 1407111 - DNA, 17 bp, Homo sapiens
ttgaaaaatataaaatt

SEQ ID NO: 1407112 - DNA, 19 bp, Homo sapiens
ttgaaaaatataaaattat

SEQ ID NO: 1407113 - DNA, 11 bp, Homo sapiens
ttgaagcatag

SEQ ID NO: 1407114 - DNA, 23 bp, Homo sapiens
ttgaagcatagataatattgttt

SEQ ID NO: 1407115 - DNA, 20 bp, Homo sapiens
ttgacttttataaagcatgt

SEQ ID NO: 1407116 - DNA, 15 bp, Homo sapiens
ttgagtattgtttaa

SEQ ID NO: 1407117 - DNA, 22 bp, Homo sapiens
ttgagtattgtttaaaatgtaa

SEQ ID NO: 1407118 - DNA, 15 bp, Homo sapiens
ttgagtgtatgagta

SEQ ID NO: 1407119 - DNA, 17 bp, Homo sapiens
tagcttttccctgtcct

SEQ ID NO: 1407120 - DNA, 19 bp, Homo sapiens
taggagtggtgatttgaaa

SEQ ID NO: 1407121 - DNA, 20 bp, Homo sapiens
taggtagaagtgagcaaaaa

SEQ ID NO: 1407122 - DNA, 18 bp, Homo sapiens
tagtaagaagacaaactg

SEQ ID NO: 1407123 - DNA, 22 bp, Homo sapiens
tagtaagaataccacatcaaat

SEQ ID NO: 1407124 - DNA, 21 bp, Homo sapiens
tagtactcttctagcatttag

SEQ ID NO: 1407125 - DNA, 17 bp, Homo sapiens
tagtctaagactatata

SEQ ID NO: 1407126 - DNA, 12 bp, Homo sapiens
tagtcttggcta

SEQ ID NO: 1407127 - DNA, 19 bp, Homo sapiens
tagttttgtgatgcatttt

SEQ ID NO: 1407128 - DNA, 20 bp, Homo sapiens
tataaatgtataaatataca

SEQ ID NO: 1407129 - DNA, 14 bp, Homo sapiens
tataacacattttt

SEQ ID NO: 1407130 - DNA, 14 bp, Homo sapiens
tataaccacatttc

SEQ ID NO: 1407131 - DNA, 15 bp, Homo sapiens
tatacatgtgataca

SEQ ID NO: 1407132 - DNA, 18 bp, Homo sapiens
tatacatgtgatacattt

SEQ ID NO: 1407133 - DNA, 15 bp, Homo sapiens
tatagcttgcagaac

SEQ ID NO: 1407134 - DNA, 19 bp, Homo sapiens
tatagtctaagactatata

SEQ ID NO: 1407135 - DNA, 20 bp, Homo sapiens
tatataaccacatttctaag

SEQ ID NO: 1407136 - DNA, 14 bp, Homo sapiens
tatatatataaatg

SEQ ID NO: 1407137 - DNA, 23 bp, Homo sapiens
tatatattttgtgtgaaattgca

SEQ ID NO: 1407138 - DNA, 15 bp, Homo sapiens
tatattttatattac

SEQ ID NO: 1407139 - DNA, 16 bp, Homo sapiens
tatattttgtgtgaaa

SEQ ID NO: 1407140 - DNA, 22 bp, Homo sapiens
tatctcaatgaaccataaattc

SEQ ID NO: 1407141 - DNA, 14 bp, Homo sapiens
tatcttacaatatt

SEQ ID NO: 1407142 - DNA, 14 bp, Homo sapiens
tatgagattggttt

SEQ ID NO: 1407143 - DNA, 14 bp, Homo sapiens
tatgagtagccagg

SEQ ID NO: 1407144 - DNA, 13 bp, Homo sapiens
tatgctttattaa

SEQ ID NO: 1407145 - DNA, 15 bp, Homo sapiens
tatggactcagcctt

SEQ ID NO: 1407146 - DNA, 21 bp, Homo sapiens
tatggactcagccttgcaaat

SEQ ID NO: 1407147 - DNA, 21 bp, Homo sapiens
tatgtgggatattgaatgtta

SEQ ID NO: 1407148 - DNA, 14 bp, Homo sapiens
tatgttaaagagaa

SEQ ID NO: 1407149 - DNA, 12 bp, Homo sapiens
tattaaaactaa

SEQ ID NO: 1407150 - DNA, 18 bp, Homo sapiens
tattaacaaattgcattt

SEQ ID NO: 1407151 - DNA, 20 bp, Homo sapiens
tattaacaaattgcatttgt

SEQ ID NO: 1407152 - DNA, 17 bp, Homo sapiens
tattactgacatttctt

SEQ ID NO: 1407153 - DNA, 13 bp, Homo sapiens
tattcttttctca

SEQ ID NO: 1407154 - DNA, 14 bp, Homo sapiens
tattgaccattttt

SEQ ID NO: 1407155 - DNA, 18 bp, Homo sapiens
tattgattgggaaaacat

SEQ ID NO: 1407156 - DNA, 17 bp, Homo sapiens
tattgtttaaaatgtaa

SEQ ID NO: 1407157 - DNA, 16 bp, Homo sapiens
tattgtttggtaaatg

SEQ ID NO: 1407158 - DNA, 21 bp, Homo sapiens
tatttgcaaggctgatttatg

SEQ ID NO: 1407159 - DNA, 16 bp, Homo sapiens
tattttttttttcttc

SEQ ID NO: 1407160 - DNA, 20 bp, Homo sapiens
tcaaaaacatgcttttccaa

SEQ ID NO: 1407161 - DNA, 20 bp, Homo sapiens
tcaaaaggtattatacatgt

SEQ ID NO: 1407162 - DNA, 13 bp, Homo sapiens
tcaaataagaaat

SEQ ID NO: 1407163 - DNA, 16 bp, Homo sapiens
tcaaatacacatttgc

SEQ ID NO: 1407164 - DNA, 17 bp, Homo sapiens
tcaaatacacatttgct

SEQ ID NO: 1407165 - DNA, 19 bp, Homo sapiens
tcaactttgtaaaaatctt

SEQ ID NO: 1407166 - DNA, 16 bp, Homo sapiens
tcaatacctggcctca

SEQ ID NO: 1407167 - DNA, 23 bp, Homo sapiens
tcacactgtggcctgatcagcag

SEQ ID NO: 1407168 - DNA, 13 bp, Homo sapiens
tcacagcatttgc

SEQ ID NO: 1407169 - DNA, 18 bp, Homo sapiens
tcaccatgtgagctcttc

SEQ ID NO: 1407170 - DNA, 22 bp, Homo sapiens
tcacccttatagtctaagacta

SEQ ID NO: 1407171 - DNA, 18 bp, Homo sapiens
tcactgtatcattttctt

SEQ ID NO: 1407172 - DNA, 20 bp, Homo sapiens
tcagagatataataagccca

SEQ ID NO: 1407173 - DNA, 17 bp, Homo sapiens
tcagcaggagccaatat

SEQ ID NO: 1407174 - DNA, 14 bp, Homo sapiens
tcagccttgcaaat

SEQ ID NO: 1407175 - DNA, 15 bp, Homo sapiens
tcagccttttgggaa

SEQ ID NO: 1407176 - DNA, 15 bp, Homo sapiens
tcagcttggcactca

SEQ ID NO: 1407177 - DNA, 23 bp, Homo sapiens
tcagcttggcactcaggtgctga

SEQ ID NO: 1407178 - DNA, 15 bp, Homo sapiens
tcaggtcccctttca

SEQ ID NO: 1407179 - DNA, 12 bp, Homo sapiens
tcaggtgctgaa

SEQ ID NO: 1407180 - DNA, 21 bp, Homo sapiens
tcagtaacccccttaaattta

SEQ ID NO: 1407181 - DNA, 15 bp, Homo sapiens
tcagtgttggtatat

SEQ ID NO: 1407182 - DNA, 14 bp, Homo sapiens
tcagtttgttggaa

SEQ ID NO: 1407183 - DNA, 16 bp, Homo sapiens
tcagtttgttggaaag

SEQ ID NO: 1407184 - DNA, 21 bp, Homo sapiens
tcatgtccaaacgtcctcttt

SEQ ID NO: 1407185 - DNA, 13 bp, Homo sapiens
tcattcagaaatg

SEQ ID NO: 1407186 - DNA, 14 bp, Homo sapiens
tcattcagaaatgt

SEQ ID NO: 1407187 - DNA, 12 bp, Homo sapiens
tcattgactttt

SEQ ID NO: 1407188 - DNA, 24 bp, Homo sapiens
tcattgacttttataaagcatgtt

SEQ ID NO: 1407189 - DNA, 23 bp, Homo sapiens
tcattgcacataagcttccattt

SEQ ID NO: 1407190 - DNA, 20 bp, Homo sapiens
tccaaagagtgctaagcatt

SEQ ID NO: 1407191 - DNA, 15 bp, Homo sapiens
tccaccttccaaaga

SEQ ID NO: 1407192 - DNA, 18 bp, Homo sapiens
tccagagtggagatccca

SEQ ID NO: 1407193 - DNA, 17 bp, Homo sapiens
tccagatctttcagaaa

SEQ ID NO: 1407194 - DNA, 16 bp, Homo sapiens
tccagttataagaaga

SEQ ID NO: 1407195 - DNA, 18 bp, Homo sapiens
tccatgtgagaatatttt

SEQ ID NO: 1407196 - DNA, 17 bp, Homo sapiens
tccattttaattttaaa

SEQ ID NO: 1407197 - DNA, 19 bp, Homo sapiens
tcccagagctggtggaccc

SEQ ID NO: 1407198 - DNA, 22 bp, Homo sapiens
tcccaggactagagcacaacat

SEQ ID NO: 1407199 - DNA, 14 bp, Homo sapiens
tccccagcagaatt

SEQ ID NO: 1407200 - DNA, 13 bp, Homo sapiens
tccctcccaggac

SEQ ID NO: 1407201 - DNA, 14 bp, Homo sapiens
tccctctcctaact

SEQ ID NO: 1407202 - DNA, 20 bp, Homo sapiens
tcccttaaggggtatcatgt

SEQ ID NO: 1407203 - DNA, 17 bp, Homo sapiens
tccggaatgccacccac

SEQ ID NO: 1407204 - DNA, 16 bp, Homo sapiens
tcctccccttcctctt

SEQ ID NO: 1407205 - DNA, 23 bp, Homo sapiens
tcctgcatagcttttccctgtcc

SEQ ID NO: 1407206 - DNA, 19 bp, Homo sapiens
tcctgtggcataaattgca

SEQ ID NO: 1407207 - DNA, 20 bp, Homo sapiens
tcctgtggcataaattgcat

SEQ ID NO: 1407208 - DNA, 15 bp, Homo sapiens
tccttcacatcaccc

SEQ ID NO: 1407209 - DNA, 22 bp, Homo sapiens
tccttgatttcaaagttttgtt

SEQ ID NO: 1407210 - DNA, 14 bp, Homo sapiens
tcgctccctcccag

SEQ ID NO: 1407211 - DNA, 11 bp, Homo sapiens
tcgtttttgta

SEQ ID NO: 1407212 - DNA, 12 bp, Homo sapiens
tctaattctgat

SEQ ID NO: 1407213 - DNA, 14 bp, Homo sapiens
tctaattctgattc

SEQ ID NO: 1407214 - DNA, 19 bp, Homo sapiens
tctacaatctctttttgtt

SEQ ID NO: 1407215 - DNA, 15 bp, Homo sapiens
tctccaccttccaaa

SEQ ID NO: 1407216 - DNA, 20 bp, Homo sapiens
tctccttaagctgcagagat

SEQ ID NO: 1407217 - DNA, 15 bp, Homo sapiens
tctcgctccctccca

SEQ ID NO: 1407218 - DNA, 19 bp, Homo sapiens
tctctccaccttccaaaga

SEQ ID NO: 1407219 - DNA, 15 bp, Homo sapiens
tctgaaaagtgtgta

SEQ ID NO: 1407220 - DNA, 23 bp, Homo sapiens
tctgattctggctttaagccttc

SEQ ID NO: 1407221 - DNA, 22 bp, Homo sapiens
tctgattgatttgattgggatg

SEQ ID NO: 1407222 - DNA, 14 bp, Homo sapiens
tctggctttaagcc

SEQ ID NO: 1407223 - DNA, 15 bp, Homo sapiens
tctggtactttctgt

SEQ ID NO: 1407224 - DNA, 22 bp, Homo sapiens
tctgtactaaacagtaagatat

SEQ ID NO: 1407225 - DNA, 21 bp, Homo sapiens
tcttacaatattgattgggaa

SEQ ID NO: 1407226 - DNA, 14 bp, Homo sapiens
tcttcaaagccttc

SEQ ID NO: 1407227 - DNA, 17 bp, Homo sapiens
tcttcaaagccttctcc

SEQ ID NO: 1407228 - DNA, 17 bp, Homo sapiens
tcttgtagtcttggcta

SEQ ID NO: 1407229 - DNA, 21 bp, Homo sapiens
tctttagttagtgattatatt

SEQ ID NO: 1407230 - DNA, 22 bp, Homo sapiens
tctttagtttttggttgggaat

SEQ ID NO: 1407231 - DNA, 23 bp, Homo sapiens
tctttcagaaatataacacattt

SEQ ID NO: 1407232 - DNA, 16 bp, Homo sapiens
tctttggattctaaat

SEQ ID NO: 1407233 - DNA, 13 bp, Homo sapiens
tgaaaaatataaa

SEQ ID NO: 1407234 - DNA, 19 bp, Homo sapiens
tgaaaaatataaaattatg

SEQ ID NO: 1407235 - DNA, 18 bp, Homo sapiens
tgaaaagtgtgtatatat

SEQ ID NO: 1407236 - DNA, 15 bp, Homo sapiens
tgaaaagtttttgtt

SEQ ID NO: 1407237 - DNA, 21 bp, Homo sapiens
tgaaactttgggaaaacatgt

SEQ ID NO: 1407238 - DNA, 22 bp, Homo sapiens
tgaaactttgggaaaacatgtt

SEQ ID NO: 1407239 - DNA, 22 bp, Homo sapiens
tgaaagaaaattgagttgcact

SEQ ID NO: 1407240 - DNA, 18 bp, Homo sapiens
tgaaatcttcccatgcat

SEQ ID NO: 1407241 - DNA, 19 bp, Homo sapiens
tgaaatcttcccatgcatt

SEQ ID NO: 1407242 - DNA, 22 bp, Homo sapiens
tgaaatcttcccatgcattctg

SEQ ID NO: 1407243 - DNA, 14 bp, Homo sapiens
tgaaatgcattttg

SEQ ID NO: 1407244 - DNA, 16 bp, Homo sapiens
tgaaccataaattcaa

SEQ ID NO: 1407245 - DNA, 21 bp, Homo sapiens
tgaaccataaattcaactttg

SEQ ID NO: 1407246 - DNA, 22 bp, Homo sapiens
tgaaccataaattcaactttgt

SEQ ID NO: 1407247 - DNA, 14 bp, Homo sapiens
tgaagacccagaca

SEQ ID NO: 1407248 - DNA, 17 bp, Homo sapiens
tgaagcatagataatat

SEQ ID NO: 1407249 - DNA, 16 bp, Homo sapiens
tgaagttttactgtct

SEQ ID NO: 1407250 - DNA, 22 bp, Homo sapiens
tgacatttcttctagtgatgat

SEQ ID NO: 1407251 - DNA, 22 bp, Homo sapiens
tgaccccagcattctcaggcac

SEQ ID NO: 1407252 - DNA, 18 bp, Homo sapiens
tgacgattttggaaatga

SEQ ID NO: 1407253 - DNA, 15 bp, Homo sapiens
cttctgagcacagat

SEQ ID NO: 1407254 - DNA, 18 bp, Homo sapiens
cttctgcaacaagcatgc

SEQ ID NO: 1407255 - DNA, 11 bp, Homo sapiens
cttcttgggat

SEQ ID NO: 1407256 - DNA, 23 bp, Homo sapiens
cttgaaactttgggaaaacatgt

SEQ ID NO: 1407257 - DNA, 20 bp, Homo sapiens
cttggaaattcctgtactgt

SEQ ID NO: 1407258 - DNA, 12 bp, Homo sapiens
cttgtagtcttg

SEQ ID NO: 1407259 - DNA, 23 bp, Homo sapiens
cttgtcttctggtactttctgtt

SEQ ID NO: 1407260 - DNA, 17 bp, Homo sapiens
cttgttttggatggctt

SEQ ID NO: 1407261 - DNA, 21 bp, Homo sapiens
cttgttttggatggcttgtct

SEQ ID NO: 1407262 - DNA, 16 bp, Homo sapiens
ctttaattaagctctc

SEQ ID NO: 1407263 - DNA, 14 bp, Homo sapiens
ctttagtttttggt

SEQ ID NO: 1407264 - DNA, 22 bp, Homo sapiens
ctttcatggctgctgttgctta

SEQ ID NO: 1407265 - DNA, 19 bp, Homo sapiens
ctttcattttgcacctgca

SEQ ID NO: 1407266 - DNA, 13 bp, Homo sapiens
ctttgtattttga

SEQ ID NO: 1407267 - DNA, 21 bp, Homo sapiens
cttttaccttttttttttctt

SEQ ID NO: 1407268 - DNA, 16 bp, Homo sapiens
cttttgtttggtaaat

SEQ ID NO: 1407269 - DNA, 20 bp, Homo sapiens
gaaaaagatctttcattttg

SEQ ID NO: 1407270 - DNA, 17 bp, Homo sapiens
gaaaaatataaaattat

SEQ ID NO: 1407271 - DNA, 14 bp, Homo sapiens
gaaaacacagatgt

SEQ ID NO: 1407272 - DNA, 21 bp, Homo sapiens
gaaactttgggaaaacatgtt

SEQ ID NO: 1407273 - DNA, 22 bp, Homo sapiens
gaaagtgggcttaatggagttc

SEQ ID NO: 1407274 - DNA, 14 bp, Homo sapiens
gaaataatgctaca

SEQ ID NO: 1407275 - DNA, 19 bp, Homo sapiens
gaaataatgctacaatttt

SEQ ID NO: 1407276 - DNA, 21 bp, Homo sapiens
gaaataatgctacaattttaa

SEQ ID NO: 1407277 - DNA, 13 bp, Homo sapiens
gaaattgcatact

SEQ ID NO: 1407278 - DNA, 20 bp, Homo sapiens
gaactgtagctgccatggct

SEQ ID NO: 1407279 - DNA, 21 bp, Homo sapiens
gaagaattgaaaagtttttgt

SEQ ID NO: 1407280 - DNA, 20 bp, Homo sapiens
gaagaggtggccccatatta

SEQ ID NO: 1407281 - DNA, 21 bp, Homo sapiens
gaagagttcccttgaaacttt

SEQ ID NO: 1407282 - DNA, 18 bp, Homo sapiens
gaagcttaaaataaagtt

SEQ ID NO: 1407283 - DNA, 15 bp, Homo sapiens
gaaggactgcagcca

SEQ ID NO: 1407284 - DNA, 22 bp, Homo sapiens
gaaggctgcctgctatgtattt

SEQ ID NO: 1407285 - DNA, 16 bp, Homo sapiens
gaagtctgatccctgc

SEQ ID NO: 1407286 - DNA, 19 bp, Homo sapiens
gaataccacatcaaataag

SEQ ID NO: 1407287 - DNA, 21 bp, Homo sapiens
gaatcatctcctttgcagaat

SEQ ID NO: 1407288 - DNA, 15 bp, Homo sapiens
gaatgaaagctgttc

SEQ ID NO: 1407289 - DNA, 14 bp, Homo sapiens
gaatgaggaaaatt

SEQ ID NO: 1407290 - DNA, 23 bp, Homo sapiens
gaatgaggaaaattcttaaaagg

SEQ ID NO: 1407291 - DNA, 19 bp, Homo sapiens
gaatgccatctatctagtt

SEQ ID NO: 1407292 - DNA, 13 bp, Homo sapiens
gaatgttaaaggg

SEQ ID NO: 1407293 - DNA, 14 bp, Homo sapiens
gaattgaaaagttt

SEQ ID NO: 1407294 - DNA, 17 bp, Homo sapiens
gacatgcaataaaattt

SEQ ID NO: 1407295 - DNA, 20 bp, Homo sapiens
gacatgcaataaaatttaaa

SEQ ID NO: 1407296 - DNA, 23 bp, Homo sapiens
gaccattttttaatttacttgtt

SEQ ID NO: 1407297 - DNA, 17 bp, Homo sapiens
gacccagggaacagcca

SEQ ID NO: 1407298 - DNA, 20 bp, Homo sapiens
actctgccccccccccccat

SEQ ID NO: 1407299 - DNA, 18 bp, Homo sapiens
actggcttacctcctcat

SEQ ID NO: 1407300 - DNA, 18 bp, Homo sapiens
acttagtatattattatt

SEQ ID NO: 1407301 - DNA, 24 bp, Homo sapiens
acttctgcaacaagcatgcagctt

SEQ ID NO: 1407302 - DNA, 18 bp, Homo sapiens
acttgttttggatggctt

SEQ ID NO: 1407303 - DNA, 19 bp, Homo sapiens
acttgttttggatggcttg

SEQ ID NO: 1407304 - DNA, 14 bp, Homo sapiens
actttctgttatgg

SEQ ID NO: 1407305 - DNA, 18 bp, Homo sapiens
actttctgttatgggctt

SEQ ID NO: 1407306 - DNA, 19 bp, Homo sapiens
actttgggaaaacatgtta

SEQ ID NO: 1407307 - DNA, 17 bp, Homo sapiens
acttttataaagcatgt

SEQ ID NO: 1407308 - DNA, 13 bp, Homo sapiens
agaaaattgagtt

SEQ ID NO: 1407309 - DNA, 20 bp, Homo sapiens
agaaataatgctacaatttt

SEQ ID NO: 1407310 - DNA, 22 bp, Homo sapiens
agaaataatgctacaattttaa

SEQ ID NO: 1407311 - DNA, 16 bp, Homo sapiens
agaaatataacacatt

SEQ ID NO: 1407312 - DNA, 19 bp, Homo sapiens
agaaatataacacattttt

SEQ ID NO: 1407313 - DNA, 16 bp, Homo sapiens
agaaccacacttgaaa

SEQ ID NO: 1407314 - DNA, 23 bp, Homo sapiens
agaagaggtggccccatattaac

SEQ ID NO: 1407315 - DNA, 20 bp, Homo sapiens
agaagtaagaggctacctct

SEQ ID NO: 1407316 - DNA, 21 bp, Homo sapiens
agaagtaagaggctacctctt

SEQ ID NO: 1407317 - DNA, 18 bp, Homo sapiens
agaagtgagcaaaaaaga

SEQ ID NO: 1407318 - DNA, 14 bp, Homo sapiens
agaatatttttccc

SEQ ID NO: 1407319 - DNA, 20 bp, Homo sapiens
agaattccagtcccctttct

SEQ ID NO: 1407320 - DNA, 17 bp, Homo sapiens
agaattgaaaagttttt

SEQ ID NO: 1407321 - DNA, 20 bp, Homo sapiens
agaattgacagttgaacaga

SEQ ID NO: 1407322 - DNA, 17 bp, Homo sapiens
agacagttaaactggct

SEQ ID NO: 1407323 - DNA, 16 bp, Homo sapiens
agacgtttataaacag

SEQ ID NO: 1407324 - DNA, 16 bp, Homo sapiens
agactagccagccagg

SEQ ID NO: 1407325 - DNA, 14 bp, Homo sapiens
agactgtgattctt

SEQ ID NO: 1407326 - DNA, 18 bp, Homo sapiens
agactgtgattcttagca

SEQ ID NO: 1407327 - DNA, 19 bp, Homo sapiens
agactgttcctgagccttc

SEQ ID NO: 1407328 - DNA, 13 bp, Homo sapiens
agagaaaaaaaag

SEQ ID NO: 1407329 - DNA, 13 bp, Homo sapiens
agagatttctcat

SEQ ID NO: 1407330 - DNA, 18 bp, Homo sapiens
agaggtggccccatatta

SEQ ID NO: 1407331 - DNA, 19 bp, Homo sapiens
agagtaacagtcatcattt

SEQ ID NO: 1407332 - DNA, 22 bp, Homo sapiens
agagttgggtgtctccttaagc

SEQ ID NO: 1407333 - DNA, 13 bp, Homo sapiens
agataagaaagca

SEQ ID NO: 1407334 - DNA, 19 bp, Homo sapiens
agataccttatcttacaat

SEQ ID NO: 1407335 - DNA, 22 bp, Homo sapiens
agataccttatcttacaatatt

SEQ ID NO: 1407336 - DNA, 14 bp, Homo sapiens
agatatgtattctt

SEQ ID NO: 1407337 - DNA, 16 bp, Homo sapiens
agatctcactctgccc

SEQ ID NO: 1407338 - DNA, 12 bp, Homo sapiens
agatctttcaga

SEQ ID NO: 1407339 - DNA, 21 bp, Homo sapiens
agatctttcagaaatataaca

SEQ ID NO: 1407340 - DNA, 18 bp, Homo sapiens
agatgaaccctggcattt

SEQ ID NO: 1407341 - DNA, 20 bp, Homo sapiens
agattccccactcagccttt

SEQ ID NO: 1407342 - DNA, 18 bp, Homo sapiens
agatttctcattgacttt

SEQ ID NO: 1407343 - DNA, 14 bp, Homo sapiens
agcaaaaaatgaac

SEQ ID NO: 1407344 - DNA, 18 bp, Homo sapiens
agcaaatgcctgccaaat

SEQ ID NO: 1407345 - DNA, 19 bp, Homo sapiens
agcacaacataatttttat

SEQ ID NO: 1407346 - DNA, 16 bp, Homo sapiens
agcactcctgcttaat

SEQ ID NO: 1407347 - DNA, 15 bp, Homo sapiens
agcagaattgacagt

SEQ ID NO: 1407348 - DNA, 16 bp, Homo sapiens
agcatagaaaccacta

SEQ ID NO: 1407349 - DNA, 20 bp, Homo sapiens
agcatagaaaccactagaaa

SEQ ID NO: 1407350 - DNA, 19 bp, Homo sapiens
agcattctcaggcaccagt

SEQ ID NO: 1407351 - DNA, 14 bp, Homo sapiens
agccaagcaaatgc

SEQ ID NO: 1407352 - DNA, 20 bp, Homo sapiens
agccaatatcccttacttta

SEQ ID NO: 1407353 - DNA, 22 bp, Homo sapiens
agccaatatcccttactttaac

SEQ ID NO: 1407354 - DNA, 19 bp, Homo sapiens
agccactcccctccactct

SEQ ID NO: 1407355 - DNA, 14 bp, Homo sapiens
agccagccaggaag

SEQ ID NO: 1407356 - DNA, 15 bp, Homo sapiens
agccgattcctccag

SEQ ID NO: 1407357 - DNA, 19 bp, Homo sapiens
agccgattcctccagccct

SEQ ID NO: 1407358 - DNA, 21 bp, Homo sapiens
agccgattcctccagccctgg

SEQ ID NO: 1407359 - DNA, 14 bp, Homo sapiens
agcctactctcctt

SEQ ID NO: 1407360 - DNA, 12 bp, Homo sapiens
agccttctccct

SEQ ID NO: 1407361 - DNA, 20 bp, Homo sapiens
agccttctccctagctcctc

SEQ ID NO: 1407362 - DNA, 14 bp, Homo sapiens
agcctttgagactg

SEQ ID NO: 1407363 - DNA, 13 bp, Homo sapiens
agctcaatgcagt

SEQ ID NO: 1407364 - DNA, 19 bp, Homo sapiens
agctcttcctatccctctc

SEQ ID NO: 1407365 - DNA, 23 bp, Homo sapiens
agctgagatgaaccctggcattt

SEQ ID NO: 1407366 - DNA, 16 bp, Homo sapiens
agctgcagagatttct

SEQ ID NO: 1407367 - DNA, 15 bp, Homo sapiens
agctgccatggctag

SEQ ID NO: 1407368 - DNA, 19 bp, Homo sapiens
agctggtcccctctatata

SEQ ID NO: 1407369 - DNA, 15 bp, Homo sapiens
agcttcagttgcttg

SEQ ID NO: 1407370 - DNA, 16 bp, Homo sapiens
agcttcagttgcttgt

SEQ ID NO: 1407371 - DNA, 16 bp, Homo sapiens
ggctctagaattccag

SEQ ID NO: 1407372 - DNA, 22 bp, Homo sapiens
ggcttaacttagtatattatta

SEQ ID NO: 1407373 - DNA, 17 bp, Homo sapiens
ggcttgtttacctttct

SEQ ID NO: 1407374 - DNA, 15 bp, Homo sapiens
gggaaaacacagatg

SEQ ID NO: 1407375 - DNA, 20 bp, Homo sapiens
gggaaactgagggcagagag

SEQ ID NO: 1407376 - DNA, 13 bp, Homo sapiens
gggaacagccact

SEQ ID NO: 1407377 - DNA, 15 bp, Homo sapiens
gggcccccctgccct

SEQ ID NO: 1407378 - DNA, 20 bp, Homo sapiens
ggggcagatcttggactcat

SEQ ID NO: 1407379 - DNA, 19 bp, Homo sapiens
ggggcattgagtattgttt

SEQ ID NO: 1407380 - DNA, 16 bp, Homo sapiens
ggtaaatgtttctttt

SEQ ID NO: 1407381 - DNA, 14 bp, Homo sapiens
ggtccccagcagaa

SEQ ID NO: 1407382 - DNA, 15 bp, Homo sapiens
ggtcctagtaagaag

SEQ ID NO: 1407383 - DNA, 13 bp, Homo sapiens
ggtggacccaggg

SEQ ID NO: 1407384 - DNA, 18 bp, Homo sapiens
ggtggacccagggaacag

SEQ ID NO: 1407385 - DNA, 21 bp, Homo sapiens
gtaaataggaatcattcagaa

SEQ ID NO: 1407386 - DNA, 11 bp, Homo sapiens
gtaaatgtttc

SEQ ID NO: 1407387 - DNA, 13 bp, Homo sapiens
gtaaatgtttctt

SEQ ID NO: 1407388 - DNA, 13 bp, Homo sapiens
gtaagaattctga

SEQ ID NO: 1407389 - DNA, 20 bp, Homo sapiens
gtaataagcactgtaaactt

SEQ ID NO: 1407390 - DNA, 19 bp, Homo sapiens
gtaatctcacagcatttgc

SEQ ID NO: 1407391 - DNA, 10 bp, Homo sapiens
gtaatttaaa

SEQ ID NO: 1407392 - DNA, 23 bp, Homo sapiens
gtacttaaatggtaataagcact

SEQ ID NO: 1407393 - DNA, 15 bp, Homo sapiens
gtagaggcttgttta

SEQ ID NO: 1407394 - DNA, 13 bp, Homo sapiens
gtaggtaagactg

SEQ ID NO: 1407395 - DNA, 16 bp, Homo sapiens
gtattttcatgaaaat

SEQ ID NO: 1407396 - DNA, 19 bp, Homo sapiens
gtattttcatgaaaatacc

SEQ ID NO: 1407397 - DNA, 22 bp, Homo sapiens
gtcaagggctgtcattgcacat

SEQ ID NO: 1407398 - DNA, 19 bp, Homo sapiens
gtcattgcacataagcttc

SEQ ID NO: 1407399 - DNA, 17 bp, Homo sapiens
gtccaaacgtcctcttt

SEQ ID NO: 1407400 - DNA, 12 bp, Homo sapiens
gtccccagcaga

SEQ ID NO: 1407401 - DNA, 14 bp, Homo sapiens
gtccccagcagaat

SEQ ID NO: 1407402 - DNA, 14 bp, Homo sapiens
gtcctgacaccagg

SEQ ID NO: 1407403 - DNA, 16 bp, Homo sapiens
gtccttgatttcaaag

SEQ ID NO: 1407404 - DNA, 22 bp, Homo sapiens
gtcgcccacctgtgggccagcc

SEQ ID NO: 1407405 - DNA, 23 bp, Homo sapiens
gtctaagactatatatataaatg

SEQ ID NO: 1407406 - DNA, 17 bp, Homo sapiens
gtctagggtgtgattta

SEQ ID NO: 1407407 - DNA, 23 bp, Homo sapiens
gtctttcatggctgctgttgctt

SEQ ID NO: 1407408 - DNA, 14 bp, Homo sapiens
gtgattatatttca

SEQ ID NO: 1407409 - DNA, 17 bp, Homo sapiens
actgtaaacttctgcaa

SEQ ID NO: 1407410 - DNA, 17 bp, Homo sapiens
actgtctattaatattc

SEQ ID NO: 1407411 - DNA, 18 bp, Homo sapiens
actgtgattcttagcaaa

SEQ ID NO: 1407412 - DNA, 18 bp, Homo sapiens
acttctgcaacaagcatg

SEQ ID NO: 1407413 - DNA, 19 bp, Homo sapiens
acttctgcaacaagcatgc

SEQ ID NO: 1407414 - DNA, 15 bp, Homo sapiens
actttaaccctttct

SEQ ID NO: 1407415 - DNA, 14 bp, Homo sapiens
actttgtattttga

SEQ ID NO: 1407416 - DNA, 16 bp, Homo sapiens
acttttataaagcatg

SEQ ID NO: 1407417 - DNA, 11 bp, Homo sapiens
agaaaagagaa

SEQ ID NO: 1407418 - DNA, 19 bp, Homo sapiens
agaaataatgctacaattt

SEQ ID NO: 1407419 - DNA, 22 bp, Homo sapiens
agaaatgttgagtctgtactaa

SEQ ID NO: 1407420 - DNA, 20 bp, Homo sapiens
agaaccacacttgaaacctt

SEQ ID NO: 1407421 - DNA, 13 bp, Homo sapiens
agaaggactgcag

SEQ ID NO: 1407422 - DNA, 14 bp, Homo sapiens
agaagtgagcaaaa

SEQ ID NO: 1407423 - DNA, 17 bp, Homo sapiens
agaataccacatcaaat

SEQ ID NO: 1407424 - DNA, 18 bp, Homo sapiens
agaataccacatcaaata

SEQ ID NO: 1407425 - DNA, 18 bp, Homo sapiens
agaattctgattgatttg

SEQ ID NO: 1407426 - DNA, 16 bp, Homo sapiens
agaattgaaaagtttt

SEQ ID NO: 1407427 - DNA, 18 bp, Homo sapiens
agacccagacaggactgc

SEQ ID NO: 1407428 - DNA, 16 bp, Homo sapiens
agacctcagcttggca

SEQ ID NO: 1407429 - DNA, 13 bp, Homo sapiens
agactagccagcc

SEQ ID NO: 1407430 - DNA, 21 bp, Homo sapiens
agactatatatataaatgtat

SEQ ID NO: 1407431 - DNA, 14 bp, Homo sapiens
agacttcagattcc

SEQ ID NO: 1407432 - DNA, 18 bp, Homo sapiens
agagaatgagtccttgat

SEQ ID NO: 1407433 - DNA, 15 bp, Homo sapiens
agagaggttaacaga

SEQ ID NO: 1407434 - DNA, 12 bp, Homo sapiens
agagatataata

SEQ ID NO: 1407435 - DNA, 20 bp, Homo sapiens
agagcaagagataagtcttt

SEQ ID NO: 1407436 - DNA, 14 bp, Homo sapiens
agaggcttgtttac

SEQ ID NO: 1407437 - DNA, 19 bp, Homo sapiens
agaggcttgtttacctttc

SEQ ID NO: 1407438 - DNA, 21 bp, Homo sapiens
agagtgctaagcattagcttt

SEQ ID NO: 1407439 - DNA, 21 bp, Homo sapiens
agagtttcagtttgttggaaa

SEQ ID NO: 1407440 - DNA, 14 bp, Homo sapiens
agataatattgttt

SEQ ID NO: 1407441 - DNA, 15 bp, Homo sapiens
agatatctcaatgaa

SEQ ID NO: 1407442 - DNA, 15 bp, Homo sapiens
agatatgtattcttt

SEQ ID NO: 1407443 - DNA, 18 bp, Homo sapiens
agatccatttccattgct

SEQ ID NO: 1407444 - DNA, 19 bp, Homo sapiens
agatccatttccattgctt

SEQ ID NO: 1407445 - DNA, 19 bp, Homo sapiens
agatcccacatatttcaaa

SEQ ID NO: 1407446 - DNA, 14 bp, Homo sapiens
agatctttcagaaa

SEQ ID NO: 1407447 - DNA, 16 bp, Homo sapiens
agatctttcagaaata

SEQ ID NO: 1407448 - DNA, 20 bp, Homo sapiens
agatctttcagaaatataac

SEQ ID NO: 1407449 - DNA, 21 bp, Homo sapiens
agattctttcagttctttgga

SEQ ID NO: 1407450 - DNA, 21 bp, Homo sapiens
agattgactaactcaaataca

SEQ ID NO: 1407451 - DNA, 15 bp, Homo sapiens
agattggttttcctg

SEQ ID NO: 1407452 - DNA, 14 bp, Homo sapiens
agcaaaaaagagtt

SEQ ID NO: 1407453 - DNA, 17 bp, Homo sapiens
agcaaatgcctgccaaa

SEQ ID NO: 1407454 - DNA, 15 bp, Homo sapiens
agcacatgatttggg

SEQ ID NO: 1407455 - DNA, 15 bp, Homo sapiens
agcactgtaaacttc

SEQ ID NO: 1407456 - DNA, 13 bp, Homo sapiens
agcagagttttca

SEQ ID NO: 1407457 - DNA, 15 bp, Homo sapiens
agcagagttttcatt

SEQ ID NO: 1407458 - DNA, 18 bp, Homo sapiens
agcattagctttaattaa

SEQ ID NO: 1407459 - DNA, 23 bp, Homo sapiens
agcattagctttaattaagctct

SEQ ID NO: 1407460 - DNA, 22 bp, Homo sapiens
agccttcaaaactatagcttgc

SEQ ID NO: 1407461 - DNA, 16 bp, Homo sapiens
agccttcagcactaac

SEQ ID NO: 1407462 - DNA, 16 bp, Homo sapiens
agccttctccctagct

SEQ ID NO: 1407463 - DNA, 18 bp, Homo sapiens
agccttgcaaatagccag

SEQ ID NO: 1407464 - DNA, 15 bp, Homo sapiens
agcctttgagactgt

SEQ ID NO: 1407465 - DNA, 12 bp, Homo sapiens
agcgcagagaaa

SEQ ID NO: 1407466 - DNA, 14 bp, Homo sapiens
agctcataagagta

SEQ ID NO: 1407467 - DNA, 13 bp, Homo sapiens
agctcctcccctt

SEQ ID NO: 1407468 - DNA, 13 bp, Homo sapiens
agctctcatagct

SEQ ID NO: 1407469 - DNA, 16 bp, Homo sapiens
agctctgaaatcttcc

SEQ ID NO: 1407470 - DNA, 13 bp, Homo sapiens
agctcttgctttg

SEQ ID NO: 1407471 - DNA, 15 bp, Homo sapiens
agctggtggacccag

SEQ ID NO: 1407472 - DNA, 20 bp, Homo sapiens
agctgttccttggtcctagt

SEQ ID NO: 1407473 - DNA, 14 bp, Homo sapiens
agcttaatgctaca

SEQ ID NO: 1407474 - DNA, 19 bp, Homo sapiens
agcttcagttgcttgtctt

SEQ ID NO: 1407475 - DNA, 14 bp, Homo sapiens
agcttttccctgtc

SEQ ID NO: 1407476 - DNA, 22 bp, Homo sapiens
aggaatcattcagaaatgttga

SEQ ID NO: 1407477 - DNA, 20 bp, Homo sapiens
aggacatgcaataaaattta

SEQ ID NO: 1407478 - DNA, 21 bp, Homo sapiens
aggacatgcaataaaatttaa

SEQ ID NO: 1407479 - DNA, 17 bp, Homo sapiens
aggactgcagagggctc

SEQ ID NO: 1407480 - DNA, 23 bp, Homo sapiens
aggactgcagagggctccagagt

SEQ ID NO: 1407481 - DNA, 18 bp, Homo sapiens
aggcaagaaaagcgcaga

SEQ ID NO: 1407482 - DNA, 20 bp, Homo sapiens
aggcaagaaaagcgcagaga

SEQ ID NO: 1407483 - DNA, 22 bp, Homo sapiens
aggcaagaaaagcgcagagaaa

SEQ ID NO: 1407484 - DNA, 23 bp, Homo sapiens
aggcaagaaaagcgcagagaaat

SEQ ID NO: 1407485 - DNA, 23 bp, Homo sapiens
aggctgatttatggtcagaattt

SEQ ID NO: 1407486 - DNA, 21 bp, Homo sapiens
agggccttggaaattcctgta

SEQ ID NO: 1407487 - DNA, 17 bp, Homo sapiens
agggctccagagtggag

SEQ ID NO: 1407488 - DNA, 13 bp, Homo sapiens
aggggaagaatga

SEQ ID NO: 1407489 - DNA, 18 bp, Homo sapiens
aggggcccccctgccctg

SEQ ID NO: 1407490 - DNA, 20 bp, Homo sapiens
aggggcccccctgccctgtg

SEQ ID NO: 1407491 - DNA, 19 bp, Homo sapiens
aggtcagtagactgtgatt

SEQ ID NO: 1407492 - DNA, 14 bp, Homo sapiens
aggtccccagcaga

SEQ ID NO: 1407493 - DNA, 13 bp, Homo sapiens
aggtcccctttca

SEQ ID NO: 1407494 - DNA, 19 bp, Homo sapiens
aggtcccctttcagagata

SEQ ID NO: 1407495 - DNA, 21 bp, Homo sapiens
aggttcaggtcccctttcaga

SEQ ID NO: 1407496 - DNA, 17 bp, Homo sapiens
agtaacagtcatcattt

SEQ ID NO: 1407497 - DNA, 20 bp, Homo sapiens
agtaacagtcatcatttatc

SEQ ID NO: 1407498 - DNA, 18 bp, Homo sapiens
agtaatctcacagcattt

SEQ ID NO: 1407499 - DNA, 15 bp, Homo sapiens
agtatattattatta

SEQ ID NO: 1407500 - DNA, 14 bp, Homo sapiens
agtattgtttaaaa

SEQ ID NO: 1407501 - DNA, 20 bp, Homo sapiens
agtcccttagtactcttcta

SEQ ID NO: 1407502 - DNA, 23 bp, Homo sapiens
agtctcccaatatccaattttaa

SEQ ID NO: 1407503 - DNA, 16 bp, Homo sapiens
agtctgatccctgcca

SEQ ID NO: 1407504 - DNA, 15 bp, Homo sapiens
agtctttcatggctg

SEQ ID NO: 1407505 - DNA, 19 bp, Homo sapiens
agtgaagaatttatctctt

SEQ ID NO: 1407506 - DNA, 22 bp, Homo sapiens
agtggtgatttgaaaaatataa

SEQ ID NO: 1407507 - DNA, 23 bp, Homo sapiens
agtgtgtatatattttgtgtgaa

SEQ ID NO: 1407508 - DNA, 21 bp, Homo sapiens
agtgttggtatattttatatt

SEQ ID NO: 1407509 - DNA, 14 bp, Homo sapiens
agttcaacaacaaa

SEQ ID NO: 1407510 - DNA, 17 bp, Homo sapiens
agttcccttgaaacttt

SEQ ID NO: 1407511 - DNA, 21 bp, Homo sapiens
agttctgacccaaccacagag

SEQ ID NO: 1407512 - DNA, 15 bp, Homo sapiens
agttctttggattct

SEQ ID NO: 1407513 - DNA, 16 bp, Homo sapiens
agttgaacagagctag

SEQ ID NO: 1407514 - DNA, 15 bp, Homo sapiens
agttgggtgtctcct

SEQ ID NO: 1407515 - DNA, 18 bp, Homo sapiens
agtttcagtttgttggaa

SEQ ID NO: 1407516 - DNA, 13 bp, Homo sapiens
agtttgttggaaa

SEQ ID NO: 1407517 - DNA, 14 bp, Homo sapiens
agttttatatgctt

SEQ ID NO: 1407518 - DNA, 15 bp, Homo sapiens
agttttcattaaatc

SEQ ID NO: 1407519 - DNA, 18 bp, Homo sapiens
agttttgttgtacttaaa

SEQ ID NO: 1407520 - DNA, 17 bp, Homo sapiens
agtttttggttgggaat

SEQ ID NO: 1407521 - DNA, 15 bp, Homo sapiens
ataaagttaaactga

SEQ ID NO: 1407522 - DNA, 17 bp, Homo sapiens
ataaatgtataaatata

SEQ ID NO: 1407523 - DNA, 12 bp, Homo sapiens
ataacacatttt

SEQ ID NO: 1407524 - DNA, 13 bp, Homo sapiens
ataacacattttt

SEQ ID NO: 1407525 - DNA, 15 bp, Homo sapiens
ataaccacatttcta

SEQ ID NO: 1407526 - DNA, 22 bp, Homo sapiens
ataagaaataatgctacaattt

SEQ ID NO: 1407527 - DNA, 17 bp, Homo sapiens
ataagagtaacagtcat

SEQ ID NO: 1407528 - DNA, 23 bp, Homo sapiens
ataagagtaacagtcatcattta

SEQ ID NO: 1407529 - DNA, 22 bp, Homo sapiens
ataagcccaacaagttgaagaa

SEQ ID NO: 1407530 - DNA, 16 bp, Homo sapiens
ataatattgtttggta

SEQ ID NO: 1407531 - DNA, 15 bp, Homo sapiens
ataatgctacaattt

SEQ ID NO: 1407532 - DNA, 16 bp, Homo sapiens
ataatgtagttttgtg

SEQ ID NO: 1407533 - DNA, 23 bp, Homo sapiens
atacaccccctcttctgagcaca

SEQ ID NO: 1407534 - DNA, 16 bp, Homo sapiens
atacatgtgatacatt

SEQ ID NO: 1407535 - DNA, 18 bp, Homo sapiens
atacatgtgatacatttt

SEQ ID NO: 1407536 - DNA, 13 bp, Homo sapiens
ataccacatcaaa

SEQ ID NO: 1407537 - DNA, 15 bp, Homo sapiens
ataccacatcaaata

SEQ ID NO: 1407538 - DNA, 13 bp, Homo sapiens
atacctggcctca

SEQ ID NO: 1407539 - DNA, 21 bp, Homo sapiens
atacttaactttactaagtaa

SEQ ID NO: 1407540 - DNA, 22 bp, Homo sapiens
ccatctcgctccctcccaggac

SEQ ID NO: 1407541 - DNA, 20 bp, Homo sapiens
ccattaaggggaagaatgaa

SEQ ID NO: 1407542 - DNA, 18 bp, Homo sapiens
ccattttttaatttactt

SEQ ID NO: 1407543 - DNA, 19 bp, Homo sapiens
cccacctgtgggccagccg

SEQ ID NO: 1407544 - DNA, 14 bp, Homo sapiens
cccactcagccttt

SEQ ID NO: 1407545 - DNA, 20 bp, Homo sapiens
cccagagctggtggacccag

SEQ ID NO: 1407546 - DNA, 13 bp, Homo sapiens
cccagcattctca

SEQ ID NO: 1407547 - DNA, 16 bp, Homo sapiens
cccagcattctcaggc

SEQ ID NO: 1407548 - DNA, 17 bp, Homo sapiens
cccagcattctcaggca

SEQ ID NO: 1407549 - DNA, 19 bp, Homo sapiens
cccagcattctcaggcacc

SEQ ID NO: 1407550 - DNA, 18 bp, Homo sapiens
cccaggtcgcccacctgt

SEQ ID NO: 1407551 - DNA, 23 bp, Homo sapiens
cccatattaacaaattgcatttg

SEQ ID NO: 1407552 - DNA, 22 bp, Homo sapiens
cccatctcgctccctcccagga

SEQ ID NO: 1407553 - DNA, 17 bp, Homo sapiens
cccatgttgagacctca

SEQ ID NO: 1407554 - DNA, 21 bp, Homo sapiens
cccattaaggggaagaatgaa

SEQ ID NO: 1407555 - DNA, 18 bp, Homo sapiens
ccccagcattctcaggca

SEQ ID NO: 1407556 - DNA, 21 bp, Homo sapiens
ccccagcattctcaggcacca

SEQ ID NO: 1407557 - DNA, 22 bp, Homo sapiens
ccccatctcgctccctcccagg

SEQ ID NO: 1407558 - DNA, 19 bp, Homo sapiens
ccccatcttcgggaccagg

SEQ ID NO: 1407559 - DNA, 16 bp, Homo sapiens
cccccatcttcgggac

SEQ ID NO: 1407560 - DNA, 21 bp, Homo sapiens
cccccatcttcgggaccagga

SEQ ID NO: 1407561 - DNA, 15 bp, Homo sapiens
ccccgacgtgctccc

SEQ ID NO: 1407562 - DNA, 18 bp, Homo sapiens
ccccgacgtgctcccctg

SEQ ID NO: 1407563 - DNA, 14 bp, Homo sapiens
cccctgccctgtgg

SEQ ID NO: 1407564 - DNA, 15 bp, Homo sapiens
ccctcacactgctcc

SEQ ID NO: 1407565 - DNA, 14 bp, Homo sapiens
ccctcttctgagca

SEQ ID NO: 1407566 - DNA, 14 bp, Homo sapiens
ccctgccctgtggg

SEQ ID NO: 1407567 - DNA, 18 bp, Homo sapiens
ccctggcatttggcctct

SEQ ID NO: 1407568 - DNA, 22 bp, Homo sapiens
ccctgtccggaatgccacccac

SEQ ID NO: 1407569 - DNA, 21 bp, Homo sapiens
cccttactggcttacctcctc

SEQ ID NO: 1407570 - DNA, 18 bp, Homo sapiens
cccttactttaacccttt

SEQ ID NO: 1407571 - DNA, 18 bp, Homo sapiens
cccttgaaactttgggaa

SEQ ID NO: 1407572 - DNA, 18 bp, Homo sapiens
ccgacgtgctcccctgct

SEQ ID NO: 1407573 - DNA, 18 bp, Homo sapiens
ccgattcctccagccctg

SEQ ID NO: 1407574 - DNA, 16 bp, Homo sapiens
ccggaatgccacccac

SEQ ID NO: 1407575 - DNA, 19 bp, Homo sapiens
cctaaaataacagtatgtg

SEQ ID NO: 1407576 - DNA, 18 bp, Homo sapiens
cctacaaggagataagaa

SEQ ID NO: 1407577 - DNA, 21 bp, Homo sapiens
cctactctccttgagtgtatg

SEQ ID NO: 1407578 - DNA, 14 bp, Homo sapiens
cctagtaagaagac

SEQ ID NO: 1407579 - DNA, 16 bp, Homo sapiens
cctattctataaaact

SEQ ID NO: 1407580 - DNA, 11 bp, Homo sapiens
cctcacactgc

SEQ ID NO: 1407581 - DNA, 23 bp, Homo sapiens
cctcatttaaaacaagacttcag

SEQ ID NO: 1407582 - DNA, 22 bp, Homo sapiens
cctcccaggactctgaccccag

SEQ ID NO: 1407583 - DNA, 16 bp, Homo sapiens
cctcttgtagtcttgg

SEQ ID NO: 1407584 - DNA, 14 bp, Homo sapiens
cctcttgtctgatt

SEQ ID NO: 1407585 - DNA, 17 bp, Homo sapiens
cctgcagccaagcaaat

SEQ ID NO: 1407586 - DNA, 20 bp, Homo sapiens
cctgcagccaagcaaatgcc

SEQ ID NO: 1407587 - DNA, 21 bp, Homo sapiens
cctgcatagcttttccctgtc

SEQ ID NO: 1407588 - DNA, 21 bp, Homo sapiens
cctgctcggcaccgccagccg

SEQ ID NO: 1407589 - DNA, 21 bp, Homo sapiens
cctggcatttggcctcttgta

SEQ ID NO: 1407590 - DNA, 19 bp, Homo sapiens
ccttactttaaccctttct

SEQ ID NO: 1407591 - DNA, 16 bp, Homo sapiens
ccttctggaaactgtg

SEQ ID NO: 1407592 - DNA, 13 bp, Homo sapiens
ccttgatttcaaa

SEQ ID NO: 1407593 - DNA, 17 bp, Homo sapiens
cgattcctccagccctg

SEQ ID NO: 1407594 - DNA, 13 bp, Homo sapiens
cgcaaaaatagct

SEQ ID NO: 1407595 - DNA, 21 bp, Homo sapiens
cgctccctcccaggactctga

SEQ ID NO: 1407596 - DNA, 18 bp, Homo sapiens
cgtttataaacagaaatg

SEQ ID NO: 1407597 - DNA, 15 bp, Homo sapiens
cgtttttgtattttc

SEQ ID NO: 1407598 - DNA, 21 bp, Homo sapiens
ctaacgcaaaaatagctcttg

SEQ ID NO: 1407599 - DNA, 16 bp, Homo sapiens
ctaactcaaatacaca

SEQ ID NO: 1407600 - DNA, 13 bp, Homo sapiens
ctaagactatata

SEQ ID NO: 1407601 - DNA, 17 bp, Homo sapiens
ctaaggtccccagcaga

SEQ ID NO: 1407602 - DNA, 19 bp, Homo sapiens
ctaagtaatctcacagcat

SEQ ID NO: 1407603 - DNA, 22 bp, Homo sapiens
ctaagtaatctcacagcatttg

SEQ ID NO: 1407604 - DNA, 21 bp, Homo sapiens
ctacaatctctttttgtttgc

SEQ ID NO: 1407605 - DNA, 21 bp, Homo sapiens
ctaggaagtaaagtgaagaat

SEQ ID NO: 1407606 - DNA, 16 bp, Homo sapiens
ctagggccttggaaat

SEQ ID NO: 1407607 - DNA, 13 bp, Homo sapiens
ctagtaagaagac

SEQ ID NO: 1407608 - DNA, 21 bp, Homo sapiens
ctatagcttgcagaactgtag

SEQ ID NO: 1407609 - DNA, 19 bp, Homo sapiens
ctatataaccacatttcta

SEQ ID NO: 1407610 - DNA, 16 bp, Homo sapiens
ctattatttttataat

SEQ ID NO: 1407611 - DNA, 18 bp, Homo sapiens
ctcaaatacacatttgct

SEQ ID NO: 1407612 - DNA, 19 bp, Homo sapiens
ctcaagtctattgaataat

SEQ ID NO: 1407613 - DNA, 22 bp, Homo sapiens
ctcaatacctggcctcatttaa

SEQ ID NO: 1407614 - DNA, 19 bp, Homo sapiens
ctcaatgaaccataaattc

SEQ ID NO: 1407615 - DNA, 14 bp, Homo sapiens
ctcacagcatttgc

SEQ ID NO: 1407616 - DNA, 14 bp, Homo sapiens
ctcagctcaatgca

SEQ ID NO: 1407617 - DNA, 21 bp, Homo sapiens
ctcagcttggcactcaggtgc

SEQ ID NO: 1407618 - DNA, 23 bp, Homo sapiens
ctcatgaggaggggcccccctgc

SEQ ID NO: 1407619 - DNA, 22 bp, Homo sapiens
ctcattgacttttataaagcat

SEQ ID NO: 1407620 - DNA, 14 bp, Homo sapiens
ctccaccttccaaa

SEQ ID NO: 1407621 - DNA, 16 bp, Homo sapiens
ctccagtttcacctct

SEQ ID NO: 1407622 - DNA, 21 bp, Homo sapiens
ctccatgtgagaatatttttc

SEQ ID NO: 1407623 - DNA, 14 bp, Homo sapiens
ctccctcccaggac

SEQ ID NO: 1407624 - DNA, 15 bp, Homo sapiens
ctcctattctataaa

SEQ ID NO: 1407625 - DNA, 20 bp, Homo sapiens
ctcctattctataaaactct

SEQ ID NO: 1407626 - DNA, 18 bp, Homo sapiens
ctcggcaccgccagccgc

SEQ ID NO: 1407627 - DNA, 20 bp, Homo sapiens
ctctaccagataactgagga

SEQ ID NO: 1407628 - DNA, 21 bp, Homo sapiens
ctctccgaagtctgatccctg

SEQ ID NO: 1407629 - DNA, 15 bp, Homo sapiens
ctctgaaatcttccc

SEQ ID NO: 1407630 - DNA, 13 bp, Homo sapiens
ctctttttgtttg

SEQ ID NO: 1407631 - DNA, 22 bp, Homo sapiens
ctgaaaagtgtgtatatatttt

SEQ ID NO: 1407632 - DNA, 23 bp, Homo sapiens
ctgaaatcttcccatgcattctg

SEQ ID NO: 1407633 - DNA, 13 bp, Homo sapiens
ctgaagaattgaa

SEQ ID NO: 1407634 - DNA, 11 bp, Homo sapiens
ctgacaccagg

SEQ ID NO: 1407635 - DNA, 18 bp, Homo sapiens
ctgacatttcttctagtg

SEQ ID NO: 1407636 - DNA, 23 bp, Homo sapiens
ctgacctggcatctaattctgat

SEQ ID NO: 1407637 - DNA, 18 bp, Homo sapiens
ctgagatgaaccctggca

SEQ ID NO: 1407638 - DNA, 13 bp, Homo sapiens
ctgaggaggggag

SEQ ID NO: 1407639 - DNA, 13 bp, Homo sapiens
ctgagggcagaga

SEQ ID NO: 1407640 - DNA, 16 bp, Homo sapiens
ctgagggcagagaggt

SEQ ID NO: 1407641 - DNA, 22 bp, Homo sapiens
ctgattctggctttaagccttc

SEQ ID NO: 1407642 - DNA, 16 bp, Homo sapiens
ctgatttatggtcaga

SEQ ID NO: 1407643 - DNA, 14 bp, Homo sapiens
ctgcagagatttct

SEQ ID NO: 1407644 - DNA, 20 bp, Homo sapiens
ctgcatagcttttccctgtc

SEQ ID NO: 1407645 - DNA, 22 bp, Homo sapiens
ctgccattacagaggtattaaa

SEQ ID NO: 1407646 - DNA, 15 bp, Homo sapiens
ctgcttcccttactt

SEQ ID NO: 1407647 - DNA, 21 bp, Homo sapiens
ctggcatctaattctgattct

SEQ ID NO: 1407648 - DNA, 20 bp, Homo sapiens
ctggcatttggcctcttgta

SEQ ID NO: 1407649 - DNA, 16 bp, Homo sapiens
ctggctttaagccttc

SEQ ID NO: 1407650 - DNA, 20 bp, Homo sapiens
ctggtctatataaccacatt

SEQ ID NO: 1407651 - DNA, 18 bp, Homo sapiens
ctgtagatatgtattctt

SEQ ID NO: 1407652 - DNA, 16 bp, Homo sapiens
ctgtatcattttcttt

SEQ ID NO: 1407653 - DNA, 21 bp, Homo sapiens
ctgtccggaatgccacccaca

SEQ ID NO: 1407654 - DNA, 18 bp, Homo sapiens
ctgtcctgacaccaggca

SEQ ID NO: 1407655 - DNA, 20 bp, Homo sapiens
ctgtcctgacaccaggcaag

SEQ ID NO: 1407656 - DNA, 14 bp, Homo sapiens
ctgtgaagatctca

SEQ ID NO: 1407657 - DNA, 15 bp, Homo sapiens
ctgtggcataaattg

SEQ ID NO: 1407658 - DNA, 18 bp, Homo sapiens
ctgtggcataaattgcat

SEQ ID NO: 1407659 - DNA, 12 bp, Homo sapiens
cttaacttagta

SEQ ID NO: 1407660 - DNA, 20 bp, Homo sapiens
cttaaggggtatcatgtatg

SEQ ID NO: 1407661 - DNA, 15 bp, Homo sapiens
cttacaatattgatt

SEQ ID NO: 1407662 - DNA, 20 bp, Homo sapiens
cttacaatattgattgggaa

SEQ ID NO: 1407663 - DNA, 21 bp, Homo sapiens
cttacaatattgattgggaaa

SEQ ID NO: 1407664 - DNA, 14 bp, Homo sapiens
cttattgaccattt

SEQ ID NO: 1407665 - DNA, 15 bp, Homo sapiens
cttcaaagccttctc

SEQ ID NO: 1407666 - DNA, 11 bp, Homo sapiens
cttcagattcc

SEQ ID NO: 1407667 - DNA, 15 bp, Homo sapiens
cttcagttgcttgtc

SEQ ID NO: 1407668 - DNA, 14 bp, Homo sapiens
cttcctcttgtctg

SEQ ID NO: 1407669 - DNA, 14 bp, Homo sapiens
taattttaaagtgc

SEQ ID NO: 1407670 - DNA, 14 bp, Homo sapiens
tacaaaattaagca

SEQ ID NO: 1407671 - DNA, 14 bp, Homo sapiens
tacaatattgattg

SEQ ID NO: 1407672 - DNA, 19 bp, Homo sapiens
tacaatattgattgggaaa

SEQ ID NO: 1407673 - DNA, 17 bp, Homo sapiens
tacacatttgctactgt

SEQ ID NO: 1407674 - DNA, 20 bp, Homo sapiens
tacaccccctcttctgagca

SEQ ID NO: 1407675 - DNA, 16 bp, Homo sapiens
tacagaggtattaaaa

SEQ ID NO: 1407676 - DNA, 15 bp, Homo sapiens
tacatgtgatacatt

SEQ ID NO: 1407677 - DNA, 18 bp, Homo sapiens
taccatttagtaagaata

SEQ ID NO: 1407678 - DNA, 16 bp, Homo sapiens
tacccatacaccccct

SEQ ID NO: 1407679 - DNA, 16 bp, Homo sapiens
tacccatagacatgaa

SEQ ID NO: 1407680 - DNA, 20 bp, Homo sapiens
tacccccgacgtgctcccct

SEQ ID NO: 1407681 - DNA, 13 bp, Homo sapiens
tacctaacatctg

SEQ ID NO: 1407682 - DNA, 16 bp, Homo sapiens
taccttttttttttct

SEQ ID NO: 1407683 - DNA, 13 bp, Homo sapiens
tactacagagaag

SEQ ID NO: 1407684 - DNA, 19 bp, Homo sapiens
tactattcaggtaacacta

SEQ ID NO: 1407685 - DNA, 21 bp, Homo sapiens
tactctccttgagtgtatgag

SEQ ID NO: 1407686 - DNA, 16 bp, Homo sapiens
tactgacatttcttct

SEQ ID NO: 1407687 - DNA, 21 bp, Homo sapiens
tactgggggcaaaatcagaat

SEQ ID NO: 1407688 - DNA, 18 bp, Homo sapiens
tactgtctattaatattc

SEQ ID NO: 1407689 - DNA, 23 bp, Homo sapiens
tacttaaatggtaataagcactg

SEQ ID NO: 1407690 - DNA, 24 bp, Homo sapiens
tacttaaatggtaataagcactgt

SEQ ID NO: 1407691 - DNA, 13 bp, Homo sapiens
tacttgttttgga

SEQ ID NO: 1407692 - DNA, 16 bp, Homo sapiens
tactttgtattttgat

SEQ ID NO: 1407693 - DNA, 20 bp, Homo sapiens
tagaagtgagcaaaaaagag

SEQ ID NO: 1407694 - DNA, 11 bp, Homo sapiens
tagacatgaaa

SEQ ID NO: 1407695 - DNA, 18 bp, Homo sapiens
tagaggccatgtctcctg

SEQ ID NO: 1407696 - DNA, 15 bp, Homo sapiens
tagataatattgttt

SEQ ID NO: 1407697 - DNA, 22 bp, Homo sapiens
tagatatgtattcttttctcag

SEQ ID NO: 1407698 - DNA, 18 bp, Homo sapiens
tagatccatttccattgc

SEQ ID NO: 1407699 - DNA, 20 bp, Homo sapiens
tagcacatgatttgggctct

SEQ ID NO: 1407700 - DNA, 11 bp, Homo sapiens
tagccagccag

SEQ ID NO: 1407701 - DNA, 19 bp, Homo sapiens
tagctcctccccttcctct

SEQ ID NO: 1407702 - DNA, 11 bp, Homo sapiens
tagctcttgct

SEQ ID NO: 1407703 - DNA, 15 bp, Homo sapiens
tagctgaagaattga

SEQ ID NO: 1407704 - DNA, 17 bp, Homo sapiens
tagcttgcagaactgta

SEQ ID NO: 1407705 - DNA, 20 bp, Homo sapiens
taggaagtaaagtgaagaat

SEQ ID NO: 1407706 - DNA, 20 bp, Homo sapiens
taggaatcattcagaaatgt

SEQ ID NO: 1407707 - DNA, 20 bp, Homo sapiens
tagggactacccatagacat

SEQ ID NO: 1407708 - DNA, 17 bp, Homo sapiens
taggtcagtagactgtg

SEQ ID NO: 1407709 - DNA, 12 bp, Homo sapiens
tagtaagcatag

SEQ ID NO: 1407710 - DNA, 13 bp, Homo sapiens
tagtctaagacta

SEQ ID NO: 1407711 - DNA, 13 bp, Homo sapiens
tagtcttggctaa

SEQ ID NO: 1407712 - DNA, 16 bp, Homo sapiens
tagttagtgattatat

SEQ ID NO: 1407713 - DNA, 20 bp, Homo sapiens
tagttttgtgatgcatttta

SEQ ID NO: 1407714 - DNA, 16 bp, Homo sapiens
tataaacagaaatgga

SEQ ID NO: 1407715 - DNA, 17 bp, Homo sapiens
tataaacagaaatggaa

SEQ ID NO: 1407716 - DNA, 14 bp, Homo sapiens
tataaatgtataaa

SEQ ID NO: 1407717 - DNA, 13 bp, Homo sapiens
tataacacatttt

SEQ ID NO: 1407718 - DNA, 23 bp, Homo sapiens
tataattgtacaaaattaagcaa

SEQ ID NO: 1407719 - DNA, 20 bp, Homo sapiens
tatacatgtgatacattttt

SEQ ID NO: 1407720 - DNA, 16 bp, Homo sapiens
tatagtctaagactat

SEQ ID NO: 1407721 - DNA, 18 bp, Homo sapiens
tatagtctaagactatat

SEQ ID NO: 1407722 - DNA, 20 bp, Homo sapiens
tatagtctaagactatatat

SEQ ID NO: 1407723 - DNA, 12 bp, Homo sapiens
tatataaatgta

SEQ ID NO: 1407724 - DNA, 15 bp, Homo sapiens
tatatataaatgtat

SEQ ID NO: 1407725 - DNA, 16 bp, Homo sapiens
tatatatataaatgta

SEQ ID NO: 1407726 - DNA, 16 bp, Homo sapiens
tatatattttgtgtga

SEQ ID NO: 1407727 - DNA, 23 bp, Homo sapiens
tatattactgacatttcttctag

SEQ ID NO: 1407728 - DNA, 12 bp, Homo sapiens
tatcatgtatgg

SEQ ID NO: 1407729 - DNA, 12 bp, Homo sapiens
tatcgtttttgt

SEQ ID NO: 1407730 - DNA, 18 bp, Homo sapiens
tatcgtttttgtattttc

SEQ ID NO: 1407731 - DNA, 23 bp, Homo sapiens
tatctctttagttagtgattata

SEQ ID NO: 1407732 - DNA, 18 bp, Homo sapiens
tatggactcagccttgca

SEQ ID NO: 1407733 - DNA, 17 bp, Homo sapiens
tatgtaggtaagactgt

SEQ ID NO: 1407734 - DNA, 14 bp, Homo sapiens
tatgtattcttttc

SEQ ID NO: 1407735 - DNA, 14 bp, Homo sapiens
tatgttccaaggct

SEQ ID NO: 1407736 - DNA, 17 bp, Homo sapiens
tattaaaactaaatttc

SEQ ID NO: 1407737 - DNA, 19 bp, Homo sapiens
tattaaaactaaatttcac

SEQ ID NO: 1407738 - DNA, 22 bp, Homo sapiens
tattaatattcagggtaaatag

SEQ ID NO: 1407739 - DNA, 12 bp, Homo sapiens
tattattaatta

SEQ ID NO: 1407740 - DNA, 19 bp, Homo sapiens
tattctataaaactctgca

SEQ ID NO: 1407741 - DNA, 16 bp, Homo sapiens
tattgtttaaaatgta

SEQ ID NO: 1407742 - DNA, 15 bp, Homo sapiens
tattgtttggtaaat

SEQ ID NO: 1407743 - DNA, 17 bp, Homo sapiens
tattgtttggtaaatgt

SEQ ID NO: 1407744 - DNA, 18 bp, Homo sapiens
tatttcacccatctctca

SEQ ID NO: 1407745 - DNA, 14 bp, Homo sapiens
tattttgtgtgaaa

SEQ ID NO: 1407746 - DNA, 15 bp, Homo sapiens
tattttgtgtgaaat

SEQ ID NO: 1407747 - DNA, 17 bp, Homo sapiens
tattttgtgtgaaattg

SEQ ID NO: 1407748 - DNA, 15 bp, Homo sapiens
tatttttttaaaatt

SEQ ID NO: 1407749 - DNA, 17 bp, Homo sapiens
tattttttttttcttct

SEQ ID NO: 1407750 - DNA, 19 bp, Homo sapiens
tattttttttttcttcttg

SEQ ID NO: 1407751 - DNA, 21 bp, Homo sapiens
tcaaaaggtattatacatgtg

SEQ ID NO: 1407752 - DNA, 14 bp, Homo sapiens
tcaaatacacattt

SEQ ID NO: 1407753 - DNA, 16 bp, Homo sapiens
tcaacccttctggaaa

SEQ ID NO: 1407754 - DNA, 13 bp, Homo sapiens
tcaactttgtaaa

SEQ ID NO: 1407755 - DNA, 14 bp, Homo sapiens
tcaactttgtaaaa

SEQ ID NO: 1407756 - DNA, 21 bp, Homo sapiens
tcaatacctggcctcatttaa

SEQ ID NO: 1407757 - DNA, 22 bp, Homo sapiens
tcaatacctggcctcatttaaa

SEQ ID NO: 1407758 - DNA, 20 bp, Homo sapiens
tcacatcacccatgttgaga

SEQ ID NO: 1407759 - DNA, 17 bp, Homo sapiens
tcacctctttgctccct

SEQ ID NO: 1407760 - DNA, 18 bp, Homo sapiens
tcacctctttgctccctg

SEQ ID NO: 1407761 - DNA, 22 bp, Homo sapiens
tcagattccccactcagccttt

SEQ ID NO: 1407762 - DNA, 16 bp, Homo sapiens
tcagctcaatgcagtt

SEQ ID NO: 1407763 - DNA, 14 bp, Homo sapiens
tcaggaatcatctc

SEQ ID NO: 1407764 - DNA, 12 bp, Homo sapiens
tcaggcaccagt

SEQ ID NO: 1407765 - DNA, 19 bp, Homo sapiens
tcagtagactgtgattctt

SEQ ID NO: 1407766 - DNA, 13 bp, Homo sapiens
tcagttgcttgtc

SEQ ID NO: 1407767 - DNA, 19 bp, Homo sapiens
tcataagagtaacagtcat

SEQ ID NO: 1407768 - DNA, 19 bp, Homo sapiens
tcatacttaactttactaa

SEQ ID NO: 1407769 - DNA, 17 bp, Homo sapiens
tcatagctcataagagt

SEQ ID NO: 1407770 - DNA, 19 bp, Homo sapiens
tcatctcctttgcagaatg

SEQ ID NO: 1407771 - DNA, 12 bp, Homo sapiens
tcatgaaaatac

SEQ ID NO: 1407772 - DNA, 20 bp, Homo sapiens
tcatgaggaggggcccccct

SEQ ID NO: 1407773 - DNA, 16 bp, Homo sapiens
tcatggctgctgttgc

SEQ ID NO: 1407774 - DNA, 15 bp, Homo sapiens
tcatgtatttgagca

SEQ ID NO: 1407775 - DNA, 21 bp, Homo sapiens
tcattgacttttataaagcat

SEQ ID NO: 1407776 - DNA, 23 bp, Homo sapiens
tcatttatcatcacaaatggcta

SEQ ID NO: 1407777 - DNA, 13 bp, Homo sapiens
tccaaagagtgct

SEQ ID NO: 1407778 - DNA, 14 bp, Homo sapiens
tccaccttccaaag

SEQ ID NO: 1407779 - DNA, 20 bp, Homo sapiens
tccaccttccaaagagtgct

SEQ ID NO: 1407780 - DNA, 19 bp, Homo sapiens
tccagaaccacacttgaaa

SEQ ID NO: 1407781 - DNA, 14 bp, Homo sapiens
tccagccctggtgc

SEQ ID NO: 1407782 - DNA, 18 bp, Homo sapiens
tccatgtcccctcccaga

SEQ ID NO: 1407783 - DNA, 15 bp, Homo sapiens
tccatttccattgct

SEQ ID NO: 1407784 - DNA, 22 bp, Homo sapiens
tcccagagctggtggacccagg

SEQ ID NO: 1407785 - DNA, 18 bp, Homo sapiens
tccccactcagccttttg

SEQ ID NO: 1407786 - DNA, 23 bp, Homo sapiens
tcccccatctcgctccctcccag

SEQ ID NO: 1407787 - DNA, 21 bp, Homo sapiens
tcccctgctcggcaccgccag

SEQ ID NO: 1407788 - DNA, 18 bp, Homo sapiens
tccccttcctcttgtctg

SEQ ID NO: 1407789 - DNA, 17 bp, Homo sapiens
tccctgagttcactctc

SEQ ID NO: 1407790 - DNA, 20 bp, Homo sapiens
tcccttgaaactttgggaaa

SEQ ID NO: 1407791 - DNA, 16 bp, Homo sapiens
tccggaatgccaccca

SEQ ID NO: 1407792 - DNA, 18 bp, Homo sapiens
tccggaatgccacccaca

SEQ ID NO: 1407793 - DNA, 13 bp, Homo sapiens
tcctagtaagaag

SEQ ID NO: 1407794 - DNA, 18 bp, Homo sapiens
tcctattctataaaactc

SEQ ID NO: 1407795 - DNA, 19 bp, Homo sapiens
tcctcatggcagcctactc

SEQ ID NO: 1407796 - DNA, 20 bp, Homo sapiens
tcctcttgtctgatttctta

SEQ ID NO: 1407797 - DNA, 18 bp, Homo sapiens
tcctctttagtttttggt

SEQ ID NO: 1407798 - DNA, 19 bp, Homo sapiens
tccttggtcctagtaagaa

SEQ ID NO: 1407799 - DNA, 19 bp, Homo sapiens
tcgcccacctgtgggccag

SEQ ID NO: 1407800 - DNA, 17 bp, Homo sapiens
tcgctccctcccaggac

SEQ ID NO: 1407801 - DNA, 10 bp, Homo sapiens
tcgggaccag

SEQ ID NO: 1407802 - DNA, 18 bp, Homo sapiens
tctaaaaggtaatgtgtg

SEQ ID NO: 1407803 - DNA, 22 bp, Homo sapiens
tctaacagtgaagttttactgt

SEQ ID NO: 1407804 - DNA, 22 bp, Homo sapiens
tctaacgcaaaaatagctcttg

SEQ ID NO: 1407805 - DNA, 23 bp, Homo sapiens
tctaacgcaaaaatagctcttgc

SEQ ID NO: 1407806 - DNA, 23 bp, Homo sapiens
tctaagactatatatataaatgt

SEQ ID NO: 1407807 - DNA, 21 bp, Homo sapiens
tctagagcttaatgctacatg

SEQ ID NO: 1407808 - DNA, 16 bp, Homo sapiens
tctataaaactctgca

SEQ ID NO: 1407809 - DNA, 13 bp, Homo sapiens
tctcaaaaaaaaa

SEQ ID NO: 1407810 - DNA, 21 bp, Homo sapiens
tctcaatgaaccataaattca

SEQ ID NO: 1407811 - DNA, 13 bp, Homo sapiens
tctcaggcaccag

SEQ ID NO: 1407812 - DNA, 13 bp, Homo sapiens
tctcagtgttggt

SEQ ID NO: 1407813 - DNA, 14 bp, Homo sapiens
tctcagtgttggta

SEQ ID NO: 1407814 - DNA, 22 bp, Homo sapiens
tctcattgacttttataaagca

SEQ ID NO: 1407815 - DNA, 22 bp, Homo sapiens
tctccaaatatcagtgggctct

SEQ ID NO: 1407816 - DNA, 13 bp, Homo sapiens
tctccaccttcca

SEQ ID NO: 1407817 - DNA, 16 bp, Homo sapiens
tctccaccttccaaag

SEQ ID NO: 1407818 - DNA, 18 bp, Homo sapiens
tctcctgcatagcttttc

SEQ ID NO: 1407819 - DNA, 16 bp, Homo sapiens
tctcgctccctcccag

SEQ ID NO: 1407820 - DNA, 18 bp, Homo sapiens
tctcgctccctcccagga

SEQ ID NO: 1407821 - DNA, 12 bp, Homo sapiens
tctctcaggaat

SEQ ID NO: 1407822 - DNA, 14 bp, Homo sapiens
tctctctctaaggt

SEQ ID NO: 1407823 - DNA, 15 bp, Homo sapiens
tctgattctggcttt

SEQ ID NO: 1407824 - DNA, 19 bp, Homo sapiens
tctgattctggctttaagc

SEQ ID NO: 1407825 - DNA, 14 bp, Homo sapiens
tctgcaacaagcat

SEQ ID NO: 1407826 - DNA, 16 bp, Homo sapiens
tctgcaacaagcatgc

SEQ ID NO: 1407827 - DNA, 17 bp, Homo sapiens
tctgcaacaagcatgca

SEQ ID NO: 1407828 - DNA, 17 bp, Homo sapiens
tctggctttaagccttc

SEQ ID NO: 1407829 - DNA, 13 bp, Homo sapiens
tctggtctatata

SEQ ID NO: 1407830 - DNA, 15 bp, Homo sapiens
tctgttatgggcttt

SEQ ID NO: 1407831 - DNA, 13 bp, Homo sapiens
tcttcccatgcat

SEQ ID NO: 1407832 - DNA, 17 bp, Homo sapiens
tcttcctatccctctcc

SEQ ID NO: 1407833 - DNA, 19 bp, Homo sapiens
tcttctagtgatgatggtt

SEQ ID NO: 1407834 - DNA, 16 bp, Homo sapiens
tcttgtctgatttctt

SEQ ID NO: 1407835 - DNA, 23 bp, Homo sapiens
tctttagtttttggttgggaatg

SEQ ID NO: 1407836 - DNA, 18 bp, Homo sapiens
tctttcagaaatataaca

SEQ ID NO: 1407837 - DNA, 13 bp, Homo sapiens
tcttttaaagacc

SEQ ID NO: 1407838 - DNA, 18 bp, Homo sapiens
tcttttaaagaccctcct

SEQ ID NO: 1407839 - DNA, 14 bp, Homo sapiens
tcttttgaagcata

SEQ ID NO: 1407840 - DNA, 16 bp, Homo sapiens
tcttttgtttggtaaa

SEQ ID NO: 1407841 - DNA, 12 bp, Homo sapiens
tctttttgtttg

SEQ ID NO: 1407842 - DNA, 14 bp, Homo sapiens
tgaaaagtgtgtat

SEQ ID NO: 1407843 - DNA, 19 bp, Homo sapiens
tgaaactttgggaaaacat

SEQ ID NO: 1407844 - DNA, 23 bp, Homo sapiens
tgaaactttgggaaaacatgtta

SEQ ID NO: 1407845 - DNA, 14 bp, Homo sapiens
tgaaagaaaattga

SEQ ID NO: 1407846 - DNA, 21 bp, Homo sapiens
tgaaatgcattttgctagaca

SEQ ID NO: 1407847 - DNA, 20 bp, Homo sapiens
tgaagggtaatatggactca

SEQ ID NO: 1407848 - DNA, 17 bp, Homo sapiens
tgaagttttactgtcta

SEQ ID NO: 1407849 - DNA, 24 bp, Homo sapiens
tgacaatattccagatctttcaga

SEQ ID NO: 1407850 - DNA, 19 bp, Homo sapiens
tgacaccaggcaagaaaag

SEQ ID NO: 1407851 - DNA, 22 bp, Homo sapiens
tgaccattttttaatttacttg

SEQ ID NO: 1407852 - DNA, 21 bp, Homo sapiens
tgacgatgatgtacagattct

SEQ ID NO: 1407853 - DNA, 22 bp, Homo sapiens
tgactaactcaaatacacattt

SEQ ID NO: 1407854 - DNA, 17 bp, Homo sapiens
tgacttttataaagcat

SEQ ID NO: 1407855 - DNA, 22 bp, Homo sapiens
tgagatgaaccctggcatttgg

SEQ ID NO: 1407856 - DNA, 12 bp, Homo sapiens
tgagctctgaaa

SEQ ID NO: 1407857 - DNA, 16 bp, Homo sapiens
tgagctctgaaatctt

SEQ ID NO: 1407858 - DNA, 21 bp, Homo sapiens
tgagctcttcctatccctctc

SEQ ID NO: 1407859 - DNA, 12 bp, Homo sapiens
tgagtattgttt

SEQ ID NO: 1407860 - DNA, 15 bp, Homo sapiens
tgagtattgtttaaa

SEQ ID NO: 1407861 - DNA, 21 bp, Homo sapiens
tgagtattgtttaaaatgtaa

SEQ ID NO: 1407862 - DNA, 23 bp, Homo sapiens
tgagtattgtttaaaatgtaatt

SEQ ID NO: 1407863 - DNA, 18 bp, Homo sapiens
tgagtccttgatttcaaa

SEQ ID NO: 1407864 - DNA, 21 bp, Homo sapiens
tgagtctgtactaaacagtaa

SEQ ID NO: 1407865 - DNA, 18 bp, Homo sapiens
tgagtgtatgagtagcca

SEQ ID NO: 1407866 - DNA, 12 bp, Homo sapiens
tgatgcatttta

SEQ ID NO: 1407867 - DNA, 14 bp, Homo sapiens
tgattatatttcac

SEQ ID NO: 1407868 - DNA, 18 bp, Homo sapiens
tgattattttttttttct

SEQ ID NO: 1407869 - DNA, 18 bp, Homo sapiens
tgattctggctttaagcc

SEQ ID NO: 1407870 - DNA, 21 bp, Homo sapiens
tgatttcaaagttttgttgta

SEQ ID NO: 1407871 - DNA, 16 bp, Homo sapiens
tgatttgaaaaatata

SEQ ID NO: 1407872 - DNA, 18 bp, Homo sapiens
tgcaaatgagctctgaaa

SEQ ID NO: 1407873 - DNA, 21 bp, Homo sapiens
tgcacataagcttccatttta

SEQ ID NO: 1407874 - DNA, 23 bp, Homo sapiens
tgcacttattgaccattttttaa

SEQ ID NO: 1407875 - DNA, 13 bp, Homo sapiens
tgcagagatttct

SEQ ID NO: 1407876 - DNA, 15 bp, Homo sapiens
tgcagccactgattc

SEQ ID NO: 1407877 - DNA, 16 bp, Homo sapiens
tgcagccactgattct

SEQ ID NO: 1407878 - DNA, 15 bp, Homo sapiens
tgcagctttgcaaac

SEQ ID NO: 1407879 - DNA, 15 bp, Homo sapiens
tgcatgcaaatgagc

SEQ ID NO: 1407880 - DNA, 22 bp, Homo sapiens
tgcatgcaaatgagctctgaaa

SEQ ID NO: 1407881 - DNA, 21 bp, Homo sapiens
tgcatgtagaggcttgtttac

SEQ ID NO: 1407882 - DNA, 15 bp, Homo sapiens
tgcattttatagaat

SEQ ID NO: 1407883 - DNA, 23 bp, Homo sapiens
tgccagccccctaaaagcactcc

SEQ ID NO: 1407884 - DNA, 22 bp, Homo sapiens
tgccattacagaggtattaaaa

SEQ ID NO: 1407885 - DNA, 23 bp, Homo sapiens
tgctactgttgtaagaattctga

SEQ ID NO: 1407886 - DNA, 12 bp, Homo sapiens
tgctgttgctta

SEQ ID NO: 1407887 - DNA, 21 bp, Homo sapiens
tgcttaaaccacttaaacgaa

SEQ ID NO: 1407888 - DNA, 14 bp, Homo sapiens
tgcttaatcttcaa

SEQ ID NO: 1407889 - DNA, 21 bp, Homo sapiens
tgctttattaatgttttcaaa

SEQ ID NO: 1407890 - DNA, 15 bp, Homo sapiens
tggaaatgagaacaa

SEQ ID NO: 1407891 - DNA, 19 bp, Homo sapiens
tggaaattcctgtactgtg

SEQ ID NO: 1407892 - DNA, 19 bp, Homo sapiens
tggactcagccttgcaaat

SEQ ID NO: 1407893 - DNA, 21 bp, Homo sapiens
tggatttggcactagccaaag

SEQ ID NO: 1407894 - DNA, 14 bp, Homo sapiens
tggcaaagccagaa

SEQ ID NO: 1407895 - DNA, 17 bp, Homo sapiens
tggcctcttgtagtctt

SEQ ID NO: 1407896 - DNA, 18 bp, Homo sapiens
tggcctcttgtagtcttg

SEQ ID NO: 1407897 - DNA, 13 bp, Homo sapiens
tggctacatctcc

SEQ ID NO: 1407898 - DNA, 15 bp, Homo sapiens
tggctttaagccttc

SEQ ID NO: 1407899 - DNA, 21 bp, Homo sapiens
tgggaaaacatgttaatgaca

SEQ ID NO: 1407900 - DNA, 16 bp, Homo sapiens
tgggaatgaggaaaat

SEQ ID NO: 1407901 - DNA, 14 bp, Homo sapiens
tgggatgaatgcca

SEQ ID NO: 1407902 - DNA, 20 bp, Homo sapiens
tgggcttttggggagccaga

SEQ ID NO: 1407903 - DNA, 21 bp, Homo sapiens
tgggcttttggggagccagaa

SEQ ID NO: 1407904 - DNA, 19 bp, Homo sapiens
tgggggcaaaatcagaatg

SEQ ID NO: 1407905 - DNA, 20 bp, Homo sapiens
tgggtggggggcattgagta

SEQ ID NO: 1407906 - DNA, 14 bp, Homo sapiens
tggtaaatgtttct

SEQ ID NO: 1407907 - DNA, 15 bp, Homo sapiens
tggtaaatgtttctt

SEQ ID NO: 1407908 - DNA, 16 bp, Homo sapiens
tggtaataagcactgt

SEQ ID NO: 1407909 - DNA, 17 bp, Homo sapiens
tggtcctagtaagaaga

SEQ ID NO: 1407910 - DNA, 14 bp, Homo sapiens
tggtgatttgaaaa

SEQ ID NO: 1407911 - DNA, 19 bp, Homo sapiens
tggtgatttgaaaaatata

SEQ ID NO: 1407912 - DNA, 21 bp, Homo sapiens
tggtgatttgaaaaatataaa

SEQ ID NO: 1407913 - DNA, 23 bp, Homo sapiens
tggttgggaatgaggaaaattct

SEQ ID NO: 1407914 - DNA, 23 bp, Homo sapiens
tgtaaaaatcttttgaagcatag

SEQ ID NO: 1407915 - DNA, 15 bp, Homo sapiens
tgtaatttaaatgaa

SEQ ID NO: 1407916 - DNA, 17 bp, Homo sapiens
tgtaatttaaatgaaag

SEQ ID NO: 1407917 - DNA, 18 bp, Homo sapiens
tgtacagattctttcagt

SEQ ID NO: 1407918 - DNA, 19 bp, Homo sapiens
tgtacagattctttcagtt

SEQ ID NO: 1407919 - DNA, 14 bp, Homo sapiens
tgtactaaacagta

SEQ ID NO: 1407920 - DNA, 15 bp, Homo sapiens
tgtaggtaagactgt

SEQ ID NO: 1407921 - DNA, 21 bp, Homo sapiens
tgtagtcttggctaaggaaat

SEQ ID NO: 1407922 - DNA, 12 bp, Homo sapiens
tgtataaatata

SEQ ID NO: 1407923 - DNA, 22 bp, Homo sapiens
tgtatatattttgtgtgaaatt

SEQ ID NO: 1407924 - DNA, 16 bp, Homo sapiens
tgtatgagtagccagg

SEQ ID NO: 1407925 - DNA, 17 bp, Homo sapiens
tgtatgagtagccaggg

SEQ ID NO: 1407926 - DNA, 16 bp, Homo sapiens
tgtattcttttctcag

SEQ ID NO: 1407927 - DNA, 17 bp, Homo sapiens
tgtccaaacgtcctctt

SEQ ID NO: 1407928 - DNA, 21 bp, Homo sapiens
tgtccaaacgtcctctttagt

SEQ ID NO: 1407929 - DNA, 13 bp, Homo sapiens
tgtcccctcccag

SEQ ID NO: 1407930 - DNA, 17 bp, Homo sapiens
tgggattttcaattata

SEQ ID NO: 1407931 - DNA, 20 bp, Homo sapiens
tggggaaactgagggcagag

SEQ ID NO: 1407932 - DNA, 16 bp, Homo sapiens
tggggcagaggagaac

SEQ ID NO: 1407933 - DNA, 22 bp, Homo sapiens
tggggtctcctcaggaccaggg

SEQ ID NO: 1407934 - DNA, 19 bp, Homo sapiens
tgtaaacaaatattttctt

SEQ ID NO: 1407935 - DNA, 12 bp, Homo sapiens
tgtacacacaca

SEQ ID NO: 1407936 - DNA, 13 bp, Homo sapiens
tgtacacacacag

SEQ ID NO: 1407937 - DNA, 20 bp, Homo sapiens
tgtacttgatttttcaaaga

SEQ ID NO: 1407938 - DNA, 19 bp, Homo sapiens
tgtagaagaaaatttaatt

SEQ ID NO: 1407939 - DNA, 23 bp, Homo sapiens
tgtagcctaaagaccatttaatc

SEQ ID NO: 1407940 - DNA, 20 bp, Homo sapiens
tgtagttttgtgatgcattt

SEQ ID NO: 1407941 - DNA, 18 bp, Homo sapiens
tgtatatgaggatgtatg

SEQ ID NO: 1407942 - DNA, 19 bp, Homo sapiens
tgtatatgaggatgtatgt

SEQ ID NO: 1407943 - DNA, 17 bp, Homo sapiens
tgtatctgacatatttc

SEQ ID NO: 1407944 - DNA, 13 bp, Homo sapiens
tgtatgtgtatat

SEQ ID NO: 1407945 - DNA, 12 bp, Homo sapiens
tgtatgttaata

SEQ ID NO: 1407946 - DNA, 20 bp, Homo sapiens
tgtcaagtttttatacctgt

SEQ ID NO: 1407947 - DNA, 18 bp, Homo sapiens
tgtcacactgtggcctga

SEQ ID NO: 1407948 - DNA, 18 bp, Homo sapiens
tgtcatgtgcgaacacag

SEQ ID NO: 1407949 - DNA, 12 bp, Homo sapiens
tgtccccaccat

SEQ ID NO: 1407950 - DNA, 16 bp, Homo sapiens
tgtccccaccatctgc

SEQ ID NO: 1407951 - DNA, 17 bp, Homo sapiens
tgtctttcttgctccct

SEQ ID NO: 1407952 - DNA, 19 bp, Homo sapiens
tgtcttttctttgccatct

SEQ ID NO: 1407953 - DNA, 19 bp, Homo sapiens
tgtgaactttctcagcata

SEQ ID NO: 1407954 - DNA, 13 bp, Homo sapiens
tgtgatgcatttt

SEQ ID NO: 1407955 - DNA, 12 bp, Homo sapiens
tgtgattcttag

SEQ ID NO: 1407956 - DNA, 14 bp, Homo sapiens
tgtgcgaacacagt

SEQ ID NO: 1407957 - DNA, 23 bp, Homo sapiens
tgtgcgaacacagtgacacgttt

SEQ ID NO: 1407958 - DNA, 23 bp, Homo sapiens
tgtgggccagccgattcctccag

SEQ ID NO: 1407959 - DNA, 12 bp, Homo sapiens
tgtgtatatgtt

SEQ ID NO: 1407960 - DNA, 21 bp, Homo sapiens
tgtgtatatgtttatacacac

SEQ ID NO: 1407961 - DNA, 23 bp, Homo sapiens
tgtgtatatgtttatacacacag

SEQ ID NO: 1407962 - DNA, 21 bp, Homo sapiens
tgtgtatggaagacaaataca

SEQ ID NO: 1407963 - DNA, 23 bp, Homo sapiens
tgtgtatggaagacaaatacaca

SEQ ID NO: 1407964 - DNA, 19 bp, Homo sapiens
tgtgtcttgtattatcata

SEQ ID NO: 1407965 - DNA, 20 bp, Homo sapiens
tgttatcattcttataacat

SEQ ID NO: 1407966 - DNA, 15 bp, Homo sapiens
tgtttatacacacag

SEQ ID NO: 1407967 - DNA, 22 bp, Homo sapiens
ttaaaataaagttaaactgatt

SEQ ID NO: 1407968 - DNA, 17 bp, Homo sapiens
ttaaactggcttaactt

SEQ ID NO: 1407969 - DNA, 13 bp, Homo sapiens
ttaaagatttaaa

SEQ ID NO: 1407970 - DNA, 18 bp, Homo sapiens
ttaacaaattgcatttgt

SEQ ID NO: 1407971 - DNA, 16 bp, Homo sapiens
ttaacactgagtgaaa

SEQ ID NO: 1407972 - DNA, 19 bp, Homo sapiens
ttaacactgagtgaaatat

SEQ ID NO: 1407973 - DNA, 14 bp, Homo sapiens
ttaatagaaaatat

SEQ ID NO: 1407974 - DNA, 22 bp, Homo sapiens
ttaatctctccaccttccaaag

SEQ ID NO: 1407975 - DNA, 22 bp, Homo sapiens
ttaattaagctctcatagctca

SEQ ID NO: 1407976 - DNA, 20 bp, Homo sapiens
ttaattgaaagggacaagta

SEQ ID NO: 1407977 - DNA, 21 bp, Homo sapiens
ttaattgaaagggacaagtat

SEQ ID NO: 1407978 - DNA, 18 bp, Homo sapiens
ttaccacaggatgcatat

SEQ ID NO: 1407979 - DNA, 23 bp, Homo sapiens
ttactaagtaatctcacagcatt

SEQ ID NO: 1407980 - DNA, 20 bp, Homo sapiens
ttactctaaggtaaaaccat

SEQ ID NO: 1407981 - DNA, 15 bp, Homo sapiens
ttagcaaaaaatgaa

SEQ ID NO: 1407982 - DNA, 13 bp, Homo sapiens
ttaggtgtgaaga

SEQ ID NO: 1407983 - DNA, 16 bp, Homo sapiens
ttataatgtcaaatga

SEQ ID NO: 1407984 - DNA, 11 bp, Homo sapiens
ttatacacaca

SEQ ID NO: 1407985 - DNA, 15 bp, Homo sapiens
ttatacctgtacaca

SEQ ID NO: 1407986 - DNA, 16 bp, Homo sapiens
ttatactgaagctagt

SEQ ID NO: 1407987 - DNA, 20 bp, Homo sapiens
ttatactttgctgttgaaga

SEQ ID NO: 1407988 - DNA, 15 bp, Homo sapiens
ttatcaaataatatt

SEQ ID NO: 1407989 - DNA, 19 bp, Homo sapiens
ttatcaaataatattcatg

SEQ ID NO: 1407990 - DNA, 22 bp, Homo sapiens
ttatctaaggtccccagcagaa

SEQ ID NO: 1407991 - DNA, 23 bp, Homo sapiens
ttatctaaggtccccagcagaat

SEQ ID NO: 1407992 - DNA, 21 bp, Homo sapiens
ttatctagaaattaagattga

SEQ ID NO: 1407993 - DNA, 23 bp, Homo sapiens
ttatctagaaattaagattgaag

SEQ ID NO: 1407994 - DNA, 22 bp, Homo sapiens
ttatctagtagttgtagaagaa

SEQ ID NO: 1407995 - DNA, 15 bp, Homo sapiens
ttattattaattaca

SEQ ID NO: 1407996 - DNA, 22 bp, Homo sapiens
ttcaaaaacatgcttttccaaa

SEQ ID NO: 1407997 - DNA, 20 bp, Homo sapiens
ttcaaagacttcatttaaca

SEQ ID NO: 1407998 - DNA, 17 bp, Homo sapiens
ttcaagtattatatttt

SEQ ID NO: 1407999 - DNA, 20 bp, Homo sapiens
ttcagttttaaaaatgaaga

SEQ ID NO: 1408000 - DNA, 21 bp, Homo sapiens
ttccaaagagtgctaagcatt

SEQ ID NO: 1408001 - DNA, 20 bp, Homo sapiens
ttccatgtcccctcccagag

SEQ ID NO: 1408002 - DNA, 14 bp, Homo sapiens
ttccccctccccca

SEQ ID NO: 1408003 - DNA, 19 bp, Homo sapiens
ttcctgggcacacgctgct

SEQ ID NO: 1408004 - DNA, 14 bp, Homo sapiens
ttcctttatgtgat

SEQ ID NO: 1408005 - DNA, 15 bp, Homo sapiens
ttcggtacccaccac

SEQ ID NO: 1408006 - DNA, 21 bp, Homo sapiens
ttctaacgcaaaaatagctct

SEQ ID NO: 1408007 - DNA, 23 bp, Homo sapiens
ttctaacgcaaaaatagctcttg

SEQ ID NO: 1408008 - DNA, 16 bp, Homo sapiens
ttctactgttcaattt

SEQ ID NO: 1408009 - DNA, 16 bp, Homo sapiens
ttctcagcatatatat

SEQ ID NO: 1408010 - DNA, 24 bp, Homo sapiens
ttctcatgaaagcagtgaagcaat

SEQ ID NO: 1408011 - DNA, 18 bp, Homo sapiens
ttctttgccatctctgct

SEQ ID NO: 1408012 - DNA, 17 bp, Homo sapiens
ttgaaagggacaagtat

SEQ ID NO: 1408013 - DNA, 21 bp, Homo sapiens
ttgaacagagctagaggccat

SEQ ID NO: 1408014 - DNA, 20 bp, Homo sapiens
ttgcaaatagccagtgctag

SEQ ID NO: 1408015 - DNA, 17 bp, Homo sapiens
ttgcacctgcagccaag

SEQ ID NO: 1408016 - DNA, 11 bp, Homo sapiens
ttgcatttgtg

SEQ ID NO: 1408017 - DNA, 21 bp, Homo sapiens
ttgccaaaacccagctgcacc

SEQ ID NO: 1408018 - DNA, 12 bp, Homo sapiens
ttgccagcccat

SEQ ID NO: 1408019 - DNA, 17 bp, Homo sapiens
ttgccatctctgctcca

SEQ ID NO: 1408020 - DNA, 14 bp, Homo sapiens
ttggcaaagccaga

SEQ ID NO: 1408021 - DNA, 15 bp, Homo sapiens
ttgggcagagaggct

SEQ ID NO: 1408022 - DNA, 18 bp, Homo sapiens
ttgtatatatatgtgaac

SEQ ID NO: 1408023 - DNA, 19 bp, Homo sapiens
ttgtatatatatgtgaact

SEQ ID NO: 1408024 - DNA, 15 bp, Homo sapiens
ttgtctgaaacatag

SEQ ID NO: 1408025 - DNA, 15 bp, Homo sapiens
tttaaaaatgaagat

SEQ ID NO: 1408026 - DNA, 21 bp, Homo sapiens
tttaaaatgaaatgcattttg

SEQ ID NO: 1408027 - DNA, 14 bp, Homo sapiens
tttaaccctttctg

SEQ ID NO: 1408028 - DNA, 13 bp, Homo sapiens
tttaagatacaaa

SEQ ID NO: 1408029 - DNA, 17 bp, Homo sapiens
tttactaagtaatctca

SEQ ID NO: 1408030 - DNA, 22 bp, Homo sapiens
tttaggtcagtagactgtgatt

SEQ ID NO: 1408031 - DNA, 13 bp, Homo sapiens
tttatacacacag

SEQ ID NO: 1408032 - DNA, 22 bp, Homo sapiens
tttattgccaaaacccagctgc

SEQ ID NO: 1408033 - DNA, 16 bp, Homo sapiens
tttatttttggcaaag

SEQ ID NO: 1408034 - DNA, 23 bp, Homo sapiens
tttcaaagacttcatttaacact

SEQ ID NO: 1408035 - DNA, 17 bp, Homo sapiens
tttcacctctttgctcc

SEQ ID NO: 1408036 - DNA, 15 bp, Homo sapiens
tttcagttttaaaaa

SEQ ID NO: 1408037 - DNA, 19 bp, Homo sapiens
tttcagttttaaaaatgaa

SEQ ID NO: 1408038 - DNA, 16 bp, Homo sapiens
tttcatgtaattatct

SEQ ID NO: 1408039 - DNA, 21 bp, Homo sapiens
tttcccaggactagagcacaa

SEQ ID NO: 1408040 - DNA, 23 bp, Homo sapiens
tttctagaacaattacatgtaaa

SEQ ID NO: 1408041 - DNA, 20 bp, Homo sapiens
tttctgttgttcacttggag

SEQ ID NO: 1408042 - DNA, 14 bp, Homo sapiens
tttcttttgtaata

SEQ ID NO: 1408043 - DNA, 19 bp, Homo sapiens
tttcttttgtaataaacta

SEQ ID NO: 1408044 - DNA, 17 bp, Homo sapiens
tttcttttttaattgaa

SEQ ID NO: 1408045 - DNA, 20 bp, Homo sapiens
tttgcagctatggacaattt

SEQ ID NO: 1408046 - DNA, 21 bp, Homo sapiens
tttgcagctatggacaattta

SEQ ID NO: 1408047 - DNA, 14 bp, Homo sapiens
tttggcctcttgta

SEQ ID NO: 1408048 - DNA, 15 bp, Homo sapiens
tttgtgatgcatttt

SEQ ID NO: 1408049 - DNA, 13 bp, Homo sapiens
tttgttatacatt

SEQ ID NO: 1408050 - DNA, 16 bp, Homo sapiens
ttttaaaaatgaagat

SEQ ID NO: 1408051 - DNA, 13 bp, Homo sapiens
ttttaaaatgaaa

SEQ ID NO: 1408052 - DNA, 12 bp, Homo sapiens
ttttaattgaaa

SEQ ID NO: 1408053 - DNA, 23 bp, Homo sapiens
ttttaattgaaagggacaagtat

SEQ ID NO: 1408054 - DNA, 19 bp, Homo sapiens
ttttacacattgacaatga

SEQ ID NO: 1408055 - DNA, 20 bp, Homo sapiens
ttttgcacctgcagccaagc

SEQ ID NO: 1408056 - DNA, 20 bp, Homo sapiens
tcagattccccactcagcct

SEQ ID NO: 1408057 - DNA, 20 bp, Homo sapiens
tcagcatatatataaaatac

SEQ ID NO: 1408058 - DNA, 14 bp, Homo sapiens
tcagccttgcaaat

SEQ ID NO: 1408059 - DNA, 15 bp, Homo sapiens
tcagcttggcactca

SEQ ID NO: 1408060 - DNA, 23 bp, Homo sapiens
tcagcttggcactcaggtgctga

SEQ ID NO: 1408061 - DNA, 18 bp, Homo sapiens
tcaggagctccatacaca

SEQ ID NO: 1408062 - DNA, 12 bp, Homo sapiens
tcaggcaccagt

SEQ ID NO: 1408063 - DNA, 19 bp, Homo sapiens
tcaggcaccagtccctgtc

SEQ ID NO: 1408064 - DNA, 16 bp, Homo sapiens
tcagtagactgtgatt

SEQ ID NO: 1408065 - DNA, 16 bp, Homo sapiens
tcagtgcccatgtgta

SEQ ID NO: 1408066 - DNA, 22 bp, Homo sapiens
tcatattttcctttatgtgatg

SEQ ID NO: 1408067 - DNA, 24 bp, Homo sapiens
tcatattttcctttatgtgatgta

SEQ ID NO: 1408068 - DNA, 22 bp, Homo sapiens
tcatgaaagcagtgaagcaatt

SEQ ID NO: 1408069 - DNA, 21 bp, Homo sapiens
tcatgaagagttgtttataat

SEQ ID NO: 1408070 - DNA, 20 bp, Homo sapiens
tcatgaggaggggcccccct

SEQ ID NO: 1408071 - DNA, 21 bp, Homo sapiens
tcatttaacactgagtgaaat

SEQ ID NO: 1408072 - DNA, 20 bp, Homo sapiens
tccaaagagtgctaagcatt

SEQ ID NO: 1408073 - DNA, 23 bp, Homo sapiens
tccaaagagtgctaagcattagc

SEQ ID NO: 1408074 - DNA, 21 bp, Homo sapiens
tccaattttaaaatgaaatgc

SEQ ID NO: 1408075 - DNA, 14 bp, Homo sapiens
tccaccttccaaag

SEQ ID NO: 1408076 - DNA, 20 bp, Homo sapiens
tccaccttccaaagagtgct

SEQ ID NO: 1408077 - DNA, 18 bp, Homo sapiens
tccagagtggagatccca

SEQ ID NO: 1408078 - DNA, 14 bp, Homo sapiens
tccagccctggtgc

SEQ ID NO: 1408079 - DNA, 18 bp, Homo sapiens
tccaggacaggagatgct

SEQ ID NO: 1408080 - DNA, 19 bp, Homo sapiens
tccaggacaggagatgctg

SEQ ID NO: 1408081 - DNA, 18 bp, Homo sapiens
tccatacacacgctgcct

SEQ ID NO: 1408082 - DNA, 17 bp, Homo sapiens
tccatgtcccctcccag

SEQ ID NO: 1408083 - DNA, 23 bp, Homo sapiens
tccccaccatctgctgtcttttc

SEQ ID NO: 1408084 - DNA, 14 bp, Homo sapiens
tccccagccagcct

SEQ ID NO: 1408085 - DNA, 16 bp, Homo sapiens
tccccagccagcctgg

SEQ ID NO: 1408086 - DNA, 19 bp, Homo sapiens
tccccagccagcctggctg

SEQ ID NO: 1408087 - DNA, 21 bp, Homo sapiens
tccccagccagcctggctggg

SEQ ID NO: 1408088 - DNA, 19 bp, Homo sapiens
tccctgagttcactctccg

SEQ ID NO: 1408089 - DNA, 16 bp, Homo sapiens
tccggaatgccaccca

SEQ ID NO: 1408090 - DNA, 17 bp, Homo sapiens
tccggaatgccacccac

SEQ ID NO: 1408091 - DNA, 12 bp, Homo sapiens
tcctcaggacca

SEQ ID NO: 1408092 - DNA, 18 bp, Homo sapiens
tcctgggcacacgctgct

SEQ ID NO: 1408093 - DNA, 21 bp, Homo sapiens
tcctgggcacacgctgctctg

SEQ ID NO: 1408094 - DNA, 10 bp, Homo sapiens
tcgggaccag

SEQ ID NO: 1408095 - DNA, 11 bp, Homo sapiens
tcgggaccagg

SEQ ID NO: 1408096 - DNA, 21 bp, Homo sapiens
tcggtgtccccaccatctgct

SEQ ID NO: 1408097 - DNA, 19 bp, Homo sapiens
tctaaataaatttgctttt

SEQ ID NO: 1408098 - DNA, 12 bp, Homo sapiens
tctaaatattat

SEQ ID NO: 1408099 - DNA, 13 bp, Homo sapiens
tctaaatattatg

SEQ ID NO: 1408100 - DNA, 13 bp, Homo sapiens
tctcaaaaaaaaa

SEQ ID NO: 1408101 - DNA, 12 bp, Homo sapiens
tctcaatttaag

SEQ ID NO: 1408102 - DNA, 13 bp, Homo sapiens
tctcaggcaccag

SEQ ID NO: 1408103 - DNA, 22 bp, Homo sapiens
tctccaaatatcagtgggctct

SEQ ID NO: 1408104 - DNA, 20 bp, Homo sapiens
tctccgaaatgctgtctttc

SEQ ID NO: 1408105 - DNA, 15 bp, Homo sapiens
tctcgctccctccca

SEQ ID NO: 1408106 - DNA, 12 bp, Homo sapiens
tctctcaggaat

SEQ ID NO: 1408107 - DNA, 14 bp, Homo sapiens
tctgccccagcttg

SEQ ID NO: 1408108 - DNA, 13 bp, Homo sapiens
tctgttgttcact

SEQ ID NO: 1408109 - DNA, 22 bp, Homo sapiens
tcttagttaatctttgaaaact

SEQ ID NO: 1408110 - DNA, 16 bp, Homo sapiens
tcttataacattgtat

SEQ ID NO: 1408111 - DNA, 17 bp, Homo sapiens
tcttcgggaccaggatt

SEQ ID NO: 1408112 - DNA, 14 bp, Homo sapiens
tctttcttgctccc

SEQ ID NO: 1408113 - DNA, 18 bp, Homo sapiens
tctttcttgctccctgac

SEQ ID NO: 1408114 - DNA, 20 bp, Homo sapiens
tctttcttgctccctgactg

SEQ ID NO: 1408115 - DNA, 18 bp, Homo sapiens
tctttgccatctctgctc

SEQ ID NO: 1408116 - DNA, 15 bp, Homo sapiens
tgaaaactcatacag

SEQ ID NO: 1408117 - DNA, 17 bp, Homo sapiens
tgaaacacaatatcatc

SEQ ID NO: 1408118 - DNA, 23 bp, Homo sapiens
tgaaacctacaggaatctctgat

SEQ ID NO: 1408119 - DNA, 13 bp, Homo sapiens
tgaaagggacaag

SEQ ID NO: 1408120 - DNA, 15 bp, Homo sapiens
tgaaatgcattttgc

SEQ ID NO: 1408121 - DNA, 21 bp, Homo sapiens
tgaaatgcattttgctagaca

SEQ ID NO: 1408122 - DNA, 13 bp, Homo sapiens
tgaactttctcag

SEQ ID NO: 1408123 - DNA, 14 bp, Homo sapiens
tgaagacccagaca

SEQ ID NO: 1408124 - DNA, 23 bp, Homo sapiens
tgaagatcggctttcatgtaatt

SEQ ID NO: 1408125 - DNA, 20 bp, Homo sapiens
tgaagggtaatatggactca

SEQ ID NO: 1408126 - DNA, 19 bp, Homo sapiens
tgaatcctagcttcttcca

SEQ ID NO: 1408127 - DNA, 14 bp, Homo sapiens
tgacagcaaacaca

SEQ ID NO: 1408128 - DNA, 16 bp, Homo sapiens
tgacagcaaacacagt

SEQ ID NO: 1408129 - DNA, 19 bp, Homo sapiens
tgacagcaaacacagtcac

SEQ ID NO: 1408130 - DNA, 14 bp, Homo sapiens
tgacatatttcata

SEQ ID NO: 1408131 - DNA, 16 bp, Homo sapiens
tgacatttcaatcact

SEQ ID NO: 1408132 - DNA, 22 bp, Homo sapiens
tgaccccagcattctcaggcac

SEQ ID NO: 1408133 - DNA, 18 bp, Homo sapiens
tgacgattttggaaatga

SEQ ID NO: 1408134 - DNA, 14 bp, Homo sapiens
tgactgggggcaga

SEQ ID NO: 1408135 - DNA, 23 bp, Homo sapiens
tgagatatgcaataaatattatt

SEQ ID NO: 1408136 - DNA, 14 bp, Homo sapiens
tgagatctttctaa

SEQ ID NO: 1408137 - DNA, 16 bp, Homo sapiens
tgaggatgtatgtgta

SEQ ID NO: 1408138 - DNA, 19 bp, Homo sapiens
tgatactccaccagtgaaa

SEQ ID NO: 1408139 - DNA, 22 bp, Homo sapiens
tgatactccaccagtgaaaatt

SEQ ID NO: 1408140 - DNA, 14 bp, Homo sapiens
tgatgcattttata

SEQ ID NO: 1408141 - DNA, 22 bp, Homo sapiens
tgattcttagcaaaaaatgaac

SEQ ID NO: 1408142 - DNA, 12 bp, Homo sapiens
tgcaacactcaa

SEQ ID NO: 1408143 - DNA, 15 bp, Homo sapiens
tgcaataaatattat

SEQ ID NO: 1408144 - DNA, 13 bp, Homo sapiens
tgcaccccttcct

SEQ ID NO: 1408145 - DNA, 18 bp, Homo sapiens
tgcaccccttcctgggca

SEQ ID NO: 1408146 - DNA, 15 bp, Homo sapiens
tgcagccactgattc

SEQ ID NO: 1408147 - DNA, 17 bp, Homo sapiens
tgcagctatggacaatt

SEQ ID NO: 1408148 - DNA, 19 bp, Homo sapiens
tgcagctatggacaattta

SEQ ID NO: 1408149 - DNA, 17 bp, Homo sapiens
tgcataatatgcatata

SEQ ID NO: 1408150 - DNA, 14 bp, Homo sapiens
tgcatattaaagaa

SEQ ID NO: 1408151 - DNA, 16 bp, Homo sapiens
tgcattttacacattg

SEQ ID NO: 1408152 - DNA, 16 bp, Homo sapiens
tgccaaaacccagctg

SEQ ID NO: 1408153 - DNA, 19 bp, Homo sapiens
tgccaaaacccagctgcac

SEQ ID NO: 1408154 - DNA, 20 bp, Homo sapiens
tgccaaaacccagctgcacc

SEQ ID NO: 1408155 - DNA, 22 bp, Homo sapiens
tgccaaaacccagctgcacccc

SEQ ID NO: 1408156 - DNA, 14 bp, Homo sapiens
tgcccctggccttg

SEQ ID NO: 1408157 - DNA, 16 bp, Homo sapiens
tgcctcggatcccctt

SEQ ID NO: 1408158 - DNA, 18 bp, Homo sapiens
tgcctcggatccccttcc

SEQ ID NO: 1408159 - DNA, 14 bp, Homo sapiens
tgccttatcaaata

SEQ ID NO: 1408160 - DNA, 18 bp, Homo sapiens
tgccttcggtacccacca

SEQ ID NO: 1408161 - DNA, 18 bp, Homo sapiens
tgcctttatttctgtatc

SEQ ID NO: 1408162 - DNA, 14 bp, Homo sapiens
tgcggggcgggcac

SEQ ID NO: 1408163 - DNA, 19 bp, Homo sapiens
tgctcaatacctggcctca

SEQ ID NO: 1408164 - DNA, 21 bp, Homo sapiens
tgctccctgagttcactctcc

SEQ ID NO: 1408165 - DNA, 18 bp, Homo sapiens
tgctcggcaccgccagcc

SEQ ID NO: 1408166 - DNA, 14 bp, Homo sapiens
tgctctgccccagc

SEQ ID NO: 1408167 - DNA, 17 bp, Homo sapiens
tgctctgccccagcttg

SEQ ID NO: 1408168 - DNA, 15 bp, Homo sapiens
tgctgacatcatttg

SEQ ID NO: 1408169 - DNA, 13 bp, Homo sapiens
tgctgtctttctt

SEQ ID NO: 1408170 - DNA, 15 bp, Homo sapiens
tgctgtgcccctggc

SEQ ID NO: 1408171 - DNA, 15 bp, Homo sapiens
tggaagacaaataca

SEQ ID NO: 1408172 - DNA, 18 bp, Homo sapiens
tggaagacaaatacacat

SEQ ID NO: 1408173 - DNA, 16 bp, Homo sapiens
tggacaatttaccaca

SEQ ID NO: 1408174 - DNA, 14 bp, Homo sapiens
tggactcagccttg

SEQ ID NO: 1408175 - DNA, 12 bp, Homo sapiens
tggatgtaattc

SEQ ID NO: 1408176 - DNA, 18 bp, Homo sapiens
tggcactcaggtgctgaa

SEQ ID NO: 1408177 - DNA, 20 bp, Homo sapiens
tggcagcaccgcctcttccc

SEQ ID NO: 1408178 - DNA, 23 bp, Homo sapiens
tggcagcaccgcctcttcccgcc

SEQ ID NO: 1408179 - DNA, 17 bp, Homo sapiens
tggctgggactgggaac

SEQ ID NO: 1408180 - DNA, 23 bp, Homo sapiens
tgggagccgggcaaactggccgc

SEQ ID NO: 1408181 - DNA, 20 bp, Homo sapiens
tgggatccaggcccctccct

SEQ ID NO: 1408182 - DNA, 16 bp, Homo sapiens
tgggattttcaattat

SEQ ID NO: 1408183 - DNA, 22 bp, Homo sapiens
gtgtccccaccatctgctgtct

SEQ ID NO: 1408184 - DNA, 18 bp, Homo sapiens
gttaaactggcttaactt

SEQ ID NO: 1408185 - DNA, 19 bp, Homo sapiens
gttaacagatttatctaag

SEQ ID NO: 1408186 - DNA, 16 bp, Homo sapiens
gttaactgcattttac

SEQ ID NO: 1408187 - DNA, 15 bp, Homo sapiens
gttatctagaaatta

SEQ ID NO: 1408188 - DNA, 18 bp, Homo sapiens
gttattcgttactctaag

SEQ ID NO: 1408189 - DNA, 16 bp, Homo sapiens
gttcaatttcagaaac

SEQ ID NO: 1408190 - DNA, 18 bp, Homo sapiens
gttcaatttcagaaacta

SEQ ID NO: 1408191 - DNA, 19 bp, Homo sapiens
gttcaggtcccctttcaga

SEQ ID NO: 1408192 - DNA, 12 bp, Homo sapiens
gttcccccatct

SEQ ID NO: 1408193 - DNA, 14 bp, Homo sapiens
gttgtctgaaacat

SEQ ID NO: 1408194 - DNA, 16 bp, Homo sapiens
gtttaaaaatcagaaa

SEQ ID NO: 1408195 - DNA, 19 bp, Homo sapiens
taaaaagcatcattacaat

SEQ ID NO: 1408196 - DNA, 20 bp, Homo sapiens
taaaaagcatcattacaata

SEQ ID NO: 1408197 - DNA, 12 bp, Homo sapiens
taaaaatgaaga

SEQ ID NO: 1408198 - DNA, 16 bp, Homo sapiens
taaaatacacgtgtat

SEQ ID NO: 1408199 - DNA, 14 bp, Homo sapiens
taaaatgaaatgca

SEQ ID NO: 1408200 - DNA, 18 bp, Homo sapiens
taaactggcttaacttag

SEQ ID NO: 1408201 - DNA, 22 bp, Homo sapiens
taaatattatgccttgagaatg

SEQ ID NO: 1408202 - DNA, 15 bp, Homo sapiens
taacaaattgcattt

SEQ ID NO: 1408203 - DNA, 16 bp, Homo sapiens
taacaaattgcatttg

SEQ ID NO: 1408204 - DNA, 14 bp, Homo sapiens
taacagtcatcatt

SEQ ID NO: 1408205 - DNA, 14 bp, Homo sapiens
taacattgtatgtt

SEQ ID NO: 1408206 - DNA, 18 bp, Homo sapiens
taaccctcacactgctcc

SEQ ID NO: 1408207 - DNA, 20 bp, Homo sapiens
taaccctcacactgctccag

SEQ ID NO: 1408208 - DNA, 17 bp, Homo sapiens
taactactttctgttat

SEQ ID NO: 1408209 - DNA, 11 bp, Homo sapiens
taacttagtat

SEQ ID NO: 1408210 - DNA, 20 bp, Homo sapiens
taagagtaacagtcatcatt

SEQ ID NO: 1408211 - DNA, 15 bp, Homo sapiens
taagcattagcttta

SEQ ID NO: 1408212 - DNA, 18 bp, Homo sapiens
taagcctttgagactgtt

SEQ ID NO: 1408213 - DNA, 13 bp, Homo sapiens
taaggtccccagc

SEQ ID NO: 1408214 - DNA, 22 bp, Homo sapiens
taagtaatctcacagcatttgc

SEQ ID NO: 1408215 - DNA, 13 bp, Homo sapiens
taatatgcatata

SEQ ID NO: 1408216 - DNA, 19 bp, Homo sapiens
taatatgcatatatatgta

SEQ ID NO: 1408217 - DNA, 20 bp, Homo sapiens
taatatgcatatatatgtat

SEQ ID NO: 1408218 - DNA, 19 bp, Homo sapiens
taatatggactcagccttg

SEQ ID NO: 1408219 - DNA, 23 bp, Homo sapiens
taatatggactcagccttgcaaa

SEQ ID NO: 1408220 - DNA, 15 bp, Homo sapiens
taatctcaatttaag

SEQ ID NO: 1408221 - DNA, 21 bp, Homo sapiens
taatctcacagcatttgccaa

SEQ ID NO: 1408222 - DNA, 13 bp, Homo sapiens
taatctctccacc

SEQ ID NO: 1408223 - DNA, 18 bp, Homo sapiens
taatctctccaccttcca

SEQ ID NO: 1408224 - DNA, 23 bp, Homo sapiens
taatcttgaaggaacacaaagat

SEQ ID NO: 1408225 - DNA, 19 bp, Homo sapiens
taatctttgaaaactcata

SEQ ID NO: 1408226 - DNA, 21 bp, Homo sapiens
taattacaatgtaatagaagc

SEQ ID NO: 1408227 - DNA, 13 bp, Homo sapiens
taattatctagta

SEQ ID NO: 1408228 - DNA, 11 bp, Homo sapiens
taattgaaagg

SEQ ID NO: 1408229 - DNA, 20 bp, Homo sapiens
taattgaaagggacaagtat

SEQ ID NO: 1408230 - DNA, 12 bp, Homo sapiens
tacacacacaga

SEQ ID NO: 1408231 - DNA, 15 bp, Homo sapiens
tacacacgctgcctt

SEQ ID NO: 1408232 - DNA, 16 bp, Homo sapiens
tacacacgctgccttc

SEQ ID NO: 1408233 - DNA, 23 bp, Homo sapiens
tacacacgctgccttcggtaccc

SEQ ID NO: 1408234 - DNA, 15 bp, Homo sapiens
tacacatacatatat

SEQ ID NO: 1408235 - DNA, 13 bp, Homo sapiens
tacacgtgtatat

SEQ ID NO: 1408236 - DNA, 16 bp, Homo sapiens
tacacgtgtatatgag

SEQ ID NO: 1408237 - DNA, 19 bp, Homo sapiens
tacatacgcaattgtatat

SEQ ID NO: 1408238 - DNA, 20 bp, Homo sapiens
tacatacgcaattgtatata

SEQ ID NO: 1408239 - DNA, 14 bp, Homo sapiens
tacatgtaaacaaa

SEQ ID NO: 1408240 - DNA, 19 bp, Homo sapiens
tacatttaaagatttaaag

SEQ ID NO: 1408241 - DNA, 21 bp, Homo sapiens
taccagggagatttgctcaat

SEQ ID NO: 1408242 - DNA, 20 bp, Homo sapiens
tacccccgacgtgctcccct

SEQ ID NO: 1408243 - DNA, 22 bp, Homo sapiens
tacccccgacgtgctcccctgc

SEQ ID NO: 1408244 - DNA, 17 bp, Homo sapiens
tacctggcctcatttaa

SEQ ID NO: 1408245 - DNA, 21 bp, Homo sapiens
tactaagtaatctcacagcat

SEQ ID NO: 1408246 - DNA, 23 bp, Homo sapiens
tactaggaagtaaagtgaagaat

SEQ ID NO: 1408247 - DNA, 14 bp, Homo sapiens
tactctaatataca

SEQ ID NO: 1408248 - DNA, 15 bp, Homo sapiens
tacttgatttttcaa

SEQ ID NO: 1408249 - DNA, 22 bp, Homo sapiens
tagaagaaaatttaattatttg

SEQ ID NO: 1408250 - DNA, 16 bp, Homo sapiens
tagaagcttaaaataa

SEQ ID NO: 1408251 - DNA, 21 bp, Homo sapiens
tagacagttaaactggcttaa

SEQ ID NO: 1408252 - DNA, 19 bp, Homo sapiens
tagcatttctagaacaatt

SEQ ID NO: 1408253 - DNA, 16 bp, Homo sapiens
tagccaaagaaatttc

SEQ ID NO: 1408254 - DNA, 20 bp, Homo sapiens
tagcctaaagaccatttaat

SEQ ID NO: 1408255 - DNA, 18 bp, Homo sapiens
tagctcataagagtaaca

SEQ ID NO: 1408256 - DNA, 12 bp, Homo sapiens
tagctcttgctt

SEQ ID NO: 1408257 - DNA, 17 bp, Homo sapiens
tagcttttccctgtcct

SEQ ID NO: 1408258 - DNA, 14 bp, Homo sapiens
tagtagttgtagaa

SEQ ID NO: 1408259 - DNA, 14 bp, Homo sapiens
acgctgctctgccc

SEQ ID NO: 1408260 - DNA, 15 bp, Homo sapiens
acgctgctctgcccc

SEQ ID NO: 1408261 - DNA, 17 bp, Homo sapiens
acgctgctctgccccag

SEQ ID NO: 1408262 - DNA, 19 bp, Homo sapiens
acgctgctctgccccagct

SEQ ID NO: 1408263 - DNA, 14 bp, Homo sapiens
acgttttctgcaat

SEQ ID NO: 1408264 - DNA, 20 bp, Homo sapiens
actaagtaatctcacagcat

SEQ ID NO: 1408265 - DNA, 12 bp, Homo sapiens
actacctggctg

SEQ ID NO: 1408266 - DNA, 13 bp, Homo sapiens
actagccagccag

SEQ ID NO: 1408267 - DNA, 21 bp, Homo sapiens
actagccagccaggaagatga

SEQ ID NO: 1408268 - DNA, 12 bp, Homo sapiens
actcagccttgc

SEQ ID NO: 1408269 - DNA, 12 bp, Homo sapiens
actcagcctttt

SEQ ID NO: 1408270 - DNA, 17 bp, Homo sapiens
actcatacagtggtatt

SEQ ID NO: 1408271 - DNA, 14 bp, Homo sapiens
actcatgaggaggg

SEQ ID NO: 1408272 - DNA, 17 bp, Homo sapiens
actccccagccagcctg

SEQ ID NO: 1408273 - DNA, 21 bp, Homo sapiens
actccccagccagcctggctg

SEQ ID NO: 1408274 - DNA, 16 bp, Homo sapiens
actctaaataaatttg

SEQ ID NO: 1408275 - DNA, 18 bp, Homo sapiens
actctaaataaatttgct

SEQ ID NO: 1408276 - DNA, 20 bp, Homo sapiens
actctgccccccccccccat

SEQ ID NO: 1408277 - DNA, 18 bp, Homo sapiens
actgactaggattctgca

SEQ ID NO: 1408278 - DNA, 14 bp, Homo sapiens
actgagtgaaatat

SEQ ID NO: 1408279 - DNA, 17 bp, Homo sapiens
actgagtgaaatattac

SEQ ID NO: 1408280 - DNA, 16 bp, Homo sapiens
actgcattttacacat

SEQ ID NO: 1408281 - DNA, 19 bp, Homo sapiens
actgtacttgatttttcaa

SEQ ID NO: 1408282 - DNA, 22 bp, Homo sapiens
actgtacttgatttttcaaaga

SEQ ID NO: 1408283 - DNA, 18 bp, Homo sapiens
actgtgattcttagcaaa

SEQ ID NO: 1408284 - DNA, 17 bp, Homo sapiens
actgttcctgagccttc

SEQ ID NO: 1408285 - DNA, 16 bp, Homo sapiens
actttactaagtaatc

SEQ ID NO: 1408286 - DNA, 17 bp, Homo sapiens
actttcaagtattatat

SEQ ID NO: 1408287 - DNA, 18 bp, Homo sapiens
actttctcagcatatata

SEQ ID NO: 1408288 - DNA, 12 bp, Homo sapiens
agaaacaagaca

SEQ ID NO: 1408289 - DNA, 16 bp, Homo sapiens
agaacaattacatgta

SEQ ID NO: 1408290 - DNA, 17 bp, Homo sapiens
agaacaattacatgtaa

SEQ ID NO: 1408291 - DNA, 14 bp, Homo sapiens
agaagaaaatttaa

SEQ ID NO: 1408292 - DNA, 20 bp, Homo sapiens
agaatgagggcgtgaaacac

SEQ ID NO: 1408293 - DNA, 21 bp, Homo sapiens
agaatgagggcgtgaaacaca

SEQ ID NO: 1408294 - DNA, 20 bp, Homo sapiens
agaattccagtcccctttct

SEQ ID NO: 1408295 - DNA, 21 bp, Homo sapiens
agaattccagtcccctttctc

SEQ ID NO: 1408296 - DNA, 15 bp, Homo sapiens
agacaaatacacata

SEQ ID NO: 1408297 - DNA, 21 bp, Homo sapiens
agacacacaagcagacacaca

SEQ ID NO: 1408298 - DNA, 12 bp, Homo sapiens
agacacacacat

SEQ ID NO: 1408299 - DNA, 19 bp, Homo sapiens
agacacacacatatataca

SEQ ID NO: 1408300 - DNA, 21 bp, Homo sapiens
agacacacacatatatacata

SEQ ID NO: 1408301 - DNA, 18 bp, Homo sapiens
agacccagacaggactgc

SEQ ID NO: 1408302 - DNA, 16 bp, Homo sapiens
agacctcagcttggca

SEQ ID NO: 1408303 - DNA, 16 bp, Homo sapiens
agactgttcctgagcc

SEQ ID NO: 1408304 - DNA, 13 bp, Homo sapiens
agagaaaaaaaag

SEQ ID NO: 1408305 - DNA, 19 bp, Homo sapiens
agaggagaacttgctgcct

SEQ ID NO: 1408306 - DNA, 18 bp, Homo sapiens
agaggtggccccatatta

SEQ ID NO: 1408307 - DNA, 19 bp, Homo sapiens
agagtaacagtcatcattt

SEQ ID NO: 1408308 - DNA, 20 bp, Homo sapiens
agatacaaataaggacacaa

SEQ ID NO: 1408309 - DNA, 16 bp, Homo sapiens
agatatgcaataaata

SEQ ID NO: 1408310 - DNA, 19 bp, Homo sapiens
agatatgcaataaatatta

SEQ ID NO: 1408311 - DNA, 20 bp, Homo sapiens
agatatgcaataaatattat

SEQ ID NO: 1408312 - DNA, 13 bp, Homo sapiens
agatcaaatgaaa

SEQ ID NO: 1408313 - DNA, 19 bp, Homo sapiens
agatcccacatatttcaaa

SEQ ID NO: 1408314 - DNA, 18 bp, Homo sapiens
agatgaaccctggcattt

SEQ ID NO: 1408315 - DNA, 20 bp, Homo sapiens
agatgaaccctggcatttgg

SEQ ID NO: 1408316 - DNA, 14 bp, Homo sapiens
agatggatgtaatt

SEQ ID NO: 1408317 - DNA, 16 bp, Homo sapiens
agattccccactcagc

SEQ ID NO: 1408318 - DNA, 15 bp, Homo sapiens
agcacatgatttggg

SEQ ID NO: 1408319 - DNA, 16 bp, Homo sapiens
agcaccgcctcttccc

SEQ ID NO: 1408320 - DNA, 18 bp, Homo sapiens
agcaccgcctcttcccgc

SEQ ID NO: 1408321 - DNA, 20 bp, Homo sapiens
agcactaacctatgagggtg

SEQ ID NO: 1408322 - DNA, 19 bp, Homo sapiens
agcagacacacacatatat

SEQ ID NO: 1408323 - DNA, 14 bp, Homo sapiens
agcatatatataaa

SEQ ID NO: 1408324 - DNA, 17 bp, Homo sapiens
agcatatatataaaata

SEQ ID NO: 1408325 - DNA, 16 bp, Homo sapiens
agcatcattacaatac

SEQ ID NO: 1408326 - DNA, 19 bp, Homo sapiens
agcatcgcactctggcagc

SEQ ID NO: 1408327 - DNA, 15 bp, Homo sapiens
agcattagctttaat

SEQ ID NO: 1408328 - DNA, 23 bp, Homo sapiens
agcattagctttaattaagctct

SEQ ID NO: 1408329 - DNA, 19 bp, Homo sapiens
agcattctcaggcaccagt

SEQ ID NO: 1408330 - DNA, 17 bp, Homo sapiens
agccaaagaaatttcaa

SEQ ID NO: 1408331 - DNA, 19 bp, Homo sapiens
agccactcccctccactct

SEQ ID NO: 1408332 - DNA, 22 bp, Homo sapiens
agccagcctggctgggactggg

SEQ ID NO: 1408333 - DNA, 22 bp, Homo sapiens
agcccatttgggcagagaggct

SEQ ID NO: 1408334 - DNA, 14 bp, Homo sapiens
agccgattcctcca

SEQ ID NO: 1408335 - DNA, 19 bp, Homo sapiens
agctcgtagaaacaagaca

SEQ ID NO: 1408336 - DNA, 13 bp, Homo sapiens
agctcttgctttg

SEQ ID NO: 1408337 - DNA, 20 bp, Homo sapiens
agctgagatgaaccctggca

SEQ ID NO: 1408338 - DNA, 23 bp, Homo sapiens
agctgagatgaaccctggcattt

SEQ ID NO: 1408339 - DNA, 19 bp, Homo sapiens
agctggtcccctctatata

SEQ ID NO: 1408340 - DNA, 21 bp, Homo sapiens
aggaagtaaagtgaagaattt

SEQ ID NO: 1408341 - DNA, 22 bp, Homo sapiens
aggaccagggttggcaccttcc

SEQ ID NO: 1408342 - DNA, 23 bp, Homo sapiens
aggactgcagccactgattctct

SEQ ID NO: 1408343 - DNA, 15 bp, Homo sapiens
aggagaacttgctgc

SEQ ID NO: 1408344 - DNA, 19 bp, Homo sapiens
aggaggggcccccctgccc

SEQ ID NO: 1408345 - DNA, 12 bp, Homo sapiens
aggatgcatatt

SEQ ID NO: 1408346 - DNA, 13 bp, Homo sapiens
aggatgcatatta

SEQ ID NO: 1408347 - DNA, 19 bp, Homo sapiens
aggatgcatattaaagaaa

SEQ ID NO: 1408348 - DNA, 16 bp, Homo sapiens
aggatgctgacatcat

SEQ ID NO: 1408349 - DNA, 14 bp, Homo sapiens
aggatgtatgtgta

SEQ ID NO: 1408350 - DNA, 16 bp, Homo sapiens
aggatgtatgtgtata

SEQ ID NO: 1408351 - DNA, 23 bp, Homo sapiens
aggatttgcacagaagcacatgc

SEQ ID NO: 1408352 - DNA, 23 bp, Homo sapiens
aggcaagaaaagcgcagagaaat

SEQ ID NO: 1408353 - DNA, 16 bp, Homo sapiens
aggcccatgggaggct

SEQ ID NO: 1408354 - DNA, 21 bp, Homo sapiens
aggcccatgggaggctggagt

SEQ ID NO: 1408355 - DNA, 17 bp, Homo sapiens
aggctggagttggggca

SEQ ID NO: 1408356 - DNA, 13 bp, Homo sapiens
agggaaaacacag

SEQ ID NO: 1408357 - DNA, 23 bp, Homo sapiens
agggcaacctgacagcaaacaca

SEQ ID NO: 1408358 - DNA, 15 bp, Homo sapiens
aggggaggccatctg

SEQ ID NO: 1408359 - DNA, 18 bp, Homo sapiens
aggggcccccctgccctg

SEQ ID NO: 1408360 - DNA, 12 bp, Homo sapiens
aggggcgcggga

SEQ ID NO: 1408361 - DNA, 17 bp, Homo sapiens
agggttggcaccttccc

SEQ ID NO: 1408362 - DNA, 20 bp, Homo sapiens
aggtcagtagactgtgattc

SEQ ID NO: 1408363 - DNA, 14 bp, Homo sapiens
aggtccccagcaga

SEQ ID NO: 1408364 - DNA, 16 bp, Homo sapiens
agtactctaatataca

SEQ ID NO: 1408365 - DNA, 15 bp, Homo sapiens
agtatattattatta

SEQ ID NO: 1408366 - DNA, 20 bp, Homo sapiens
agtatcatctaaatattatg

SEQ ID NO: 1408367 - DNA, 21 bp, Homo sapiens
agtatcatctaaatattatgc

SEQ ID NO: 1408368 - DNA, 13 bp, Homo sapiens
agtatttctttgt

SEQ ID NO: 1408369 - DNA, 14 bp, Homo sapiens
agtccccccactcc

SEQ ID NO: 1408370 - DNA, 21 bp, Homo sapiens
agtctattgaataatgtagtt

SEQ ID NO: 1408371 - DNA, 23 bp, Homo sapiens
agtctcccaatatccaattttaa

SEQ ID NO: 1408372 - DNA, 19 bp, Homo sapiens
agtgaagaatttatctctt

SEQ ID NO: 1408373 - DNA, 15 bp, Homo sapiens
agtgattatatttca

SEQ ID NO: 1408374 - DNA, 17 bp, Homo sapiens
agtgctaagcattagct

SEQ ID NO: 1408375 - DNA, 19 bp, Homo sapiens
agtgctaagcattagcttt

SEQ ID NO: 1408376 - DNA, 20 bp, Homo sapiens
agtgctaagcattagcttta

SEQ ID NO: 1408377 - DNA, 22 bp, Homo sapiens
agtggcctccgtcactacctgg

SEQ ID NO: 1408378 - DNA, 23 bp, Homo sapiens
agttaaactggcttaacttagta

SEQ ID NO: 1408379 - DNA, 16 bp, Homo sapiens
agttagtttttaatct

SEQ ID NO: 1408380 - DNA, 14 bp, Homo sapiens
agttcaacaacaaa

SEQ ID NO: 1408381 - DNA, 18 bp, Homo sapiens
agttgtagaagaaaattt

SEQ ID NO: 1408382 - DNA, 20 bp, Homo sapiens
agttgtagaagaaaatttaa

SEQ ID NO: 1408383 - DNA, 22 bp, Homo sapiens
agttgtagaagaaaatttaatt

SEQ ID NO: 1408384 - DNA, 23 bp, Homo sapiens
agtttaaaaatcagaaagacatt

SEQ ID NO: 1408385 - DNA, 13 bp, Homo sapiens
cagtcatcattta

SEQ ID NO: 1408386 - DNA, 14 bp, Homo sapiens
cagtcatcatttat

SEQ ID NO: 1408387 - DNA, 19 bp, Homo sapiens
cagtgaaaattgatgctaa

SEQ ID NO: 1408388 - DNA, 14 bp, Homo sapiens
cagtgataagtata

SEQ ID NO: 1408389 - DNA, 18 bp, Homo sapiens
cataagagtaacagtcat

SEQ ID NO: 1408390 - DNA, 14 bp, Homo sapiens
cataagttagatgt

SEQ ID NO: 1408391 - DNA, 14 bp, Homo sapiens
cataatatgcatat

SEQ ID NO: 1408392 - DNA, 19 bp, Homo sapiens
catacacacgctgccttcg

SEQ ID NO: 1408393 - DNA, 23 bp, Homo sapiens
catacaccccctcttctgagcac

SEQ ID NO: 1408394 - DNA, 16 bp, Homo sapiens
catacatatatacatt

SEQ ID NO: 1408395 - DNA, 14 bp, Homo sapiens
catatatataaaat

SEQ ID NO: 1408396 - DNA, 16 bp, Homo sapiens
catatatataaaatac

SEQ ID NO: 1408397 - DNA, 13 bp, Homo sapiens
catatatatgtat

SEQ ID NO: 1408398 - DNA, 16 bp, Homo sapiens
catatatatgtatatt

SEQ ID NO: 1408399 - DNA, 19 bp, Homo sapiens
catattaaagaaagtcata

SEQ ID NO: 1408400 - DNA, 19 bp, Homo sapiens
catattaacaaattgcatt

SEQ ID NO: 1408401 - DNA, 21 bp, Homo sapiens
catatttcaaaaacatgcttt

SEQ ID NO: 1408402 - DNA, 14 bp, Homo sapiens
catatttcataagc

SEQ ID NO: 1408403 - DNA, 15 bp, Homo sapiens
catcacaaatggcta

SEQ ID NO: 1408404 - DNA, 16 bp, Homo sapiens
catcatttgtattatg

SEQ ID NO: 1408405 - DNA, 13 bp, Homo sapiens
catctaaatatta

SEQ ID NO: 1408406 - DNA, 15 bp, Homo sapiens
catctaggatgattt

SEQ ID NO: 1408407 - DNA, 21 bp, Homo sapiens
catctccaaatatcagtgggc

SEQ ID NO: 1408408 - DNA, 14 bp, Homo sapiens
catctcgctccctc

SEQ ID NO: 1408409 - DNA, 16 bp, Homo sapiens
catctcgtatggattt

SEQ ID NO: 1408410 - DNA, 14 bp, Homo sapiens
catctgctgtcttt

SEQ ID NO: 1408411 - DNA, 21 bp, Homo sapiens
catctgctgtcttttctttgc

SEQ ID NO: 1408412 - DNA, 21 bp, Homo sapiens
catgaggaggggcccccctgc

SEQ ID NO: 1408413 - DNA, 23 bp, Homo sapiens
catgaggaggggcccccctgccc

SEQ ID NO: 1408414 - DNA, 14 bp, Homo sapiens
catgccaggggcct

SEQ ID NO: 1408415 - DNA, 14 bp, Homo sapiens
catgcttttccaaa

SEQ ID NO: 1408416 - DNA, 15 bp, Homo sapiens
catgcttttccaaac

SEQ ID NO: 1408417 - DNA, 16 bp, Homo sapiens
catggccggctttcag

SEQ ID NO: 1408418 - DNA, 17 bp, Homo sapiens
catggccggctttcagg

SEQ ID NO: 1408419 - DNA, 15 bp, Homo sapiens
catgtaaacaaatat

SEQ ID NO: 1408420 - DNA, 16 bp, Homo sapiens
catgtaattatctagt

SEQ ID NO: 1408421 - DNA, 15 bp, Homo sapiens
catgtcccctcccag

SEQ ID NO: 1408422 - DNA, 16 bp, Homo sapiens
catgtgcgaacacagt

SEQ ID NO: 1408423 - DNA, 16 bp, Homo sapiens
cattacaatacagtat

SEQ ID NO: 1408424 - DNA, 20 bp, Homo sapiens
cattacaatacagtatttct

SEQ ID NO: 1408425 - DNA, 15 bp, Homo sapiens
cattagctttaatta

SEQ ID NO: 1408426 - DNA, 13 bp, Homo sapiens
cattctcaggcac

SEQ ID NO: 1408427 - DNA, 22 bp, Homo sapiens
cattcttataacattgtatgtt

SEQ ID NO: 1408428 - DNA, 17 bp, Homo sapiens
catttaacactgagtga

SEQ ID NO: 1408429 - DNA, 21 bp, Homo sapiens
catttctagaacaattacatg

SEQ ID NO: 1408430 - DNA, 24 bp, Homo sapiens
catttctagaacaattacatgtaa

SEQ ID NO: 1408431 - DNA, 17 bp, Homo sapiens
cattttgcacctgcagc

SEQ ID NO: 1408432 - DNA, 15 bp, Homo sapiens
cttcgggaccaggat

SEQ ID NO: 1408433 - DNA, 13 bp, Homo sapiens
cttgatttttcaa

SEQ ID NO: 1408434 - DNA, 16 bp, Homo sapiens
cttgatttttcaaaga

SEQ ID NO: 1408435 - DNA, 17 bp, Homo sapiens
cttgcagttatgttatc

SEQ ID NO: 1408436 - DNA, 15 bp, Homo sapiens
cttggctaaggaaat

SEQ ID NO: 1408437 - DNA, 19 bp, Homo sapiens
cttgggcagatctcccaca

SEQ ID NO: 1408438 - DNA, 22 bp, Homo sapiens
ctttcaagtattatattttatt

SEQ ID NO: 1408439 - DNA, 17 bp, Homo sapiens
ctttcattttgcacctg

SEQ ID NO: 1408440 - DNA, 19 bp, Homo sapiens
ctttcattttgcacctgca

SEQ ID NO: 1408441 - DNA, 17 bp, Homo sapiens
ctttctgttatctagaa

SEQ ID NO: 1408442 - DNA, 19 bp, Homo sapiens
ctttgaaaactcatacagt

SEQ ID NO: 1408443 - DNA, 21 bp, Homo sapiens
ctttgacttaggtgtgaagac

SEQ ID NO: 1408444 - DNA, 14 bp, Homo sapiens
ctttgggtgctgtt

SEQ ID NO: 1408445 - DNA, 17 bp, Homo sapiens
cttttctttgccatctc

SEQ ID NO: 1408446 - DNA, 21 bp, Homo sapiens
gaaaactcatcgggagtgaat

SEQ ID NO: 1408447 - DNA, 12 bp, Homo sapiens
gaaaagagaaaa

SEQ ID NO: 1408448 - DNA, 14 bp, Homo sapiens
gaaaagagaaaaaa

SEQ ID NO: 1408449 - DNA, 17 bp, Homo sapiens
gaaaagtaaaacactct

SEQ ID NO: 1408450 - DNA, 15 bp, Homo sapiens
gaaaatatatttgca

SEQ ID NO: 1408451 - DNA, 16 bp, Homo sapiens
gaaactgagggcagag

SEQ ID NO: 1408452 - DNA, 22 bp, Homo sapiens
gaacagaactcggtgtccccac

SEQ ID NO: 1408453 - DNA, 20 bp, Homo sapiens
gaacatgacccgtacacacc

SEQ ID NO: 1408454 - DNA, 21 bp, Homo sapiens
gaacatgacccgtacacacca

SEQ ID NO: 1408455 - DNA, 20 bp, Homo sapiens
gaactcggtgtccccaccat

SEQ ID NO: 1408456 - DNA, 15 bp, Homo sapiens
gaagaggtggcccca

SEQ ID NO: 1408457 - DNA, 19 bp, Homo sapiens
gaagagttgtttataatgt

SEQ ID NO: 1408458 - DNA, 20 bp, Homo sapiens
gaagatcggctttcatgtaa

SEQ ID NO: 1408459 - DNA, 22 bp, Homo sapiens
gaaggctgcctgctatgtattt

SEQ ID NO: 1408460 - DNA, 21 bp, Homo sapiens
gaatcatctcctttgcagaat

SEQ ID NO: 1408461 - DNA, 18 bp, Homo sapiens
gaatgagggcgtgaaaca

SEQ ID NO: 1408462 - DNA, 21 bp, Homo sapiens
gaatgagggcgtgaaacacaa

SEQ ID NO: 1408463 - DNA, 23 bp, Homo sapiens
gaatgagggcgtgaaacacaata

SEQ ID NO: 1408464 - DNA, 19 bp, Homo sapiens
gaattccagtcccctttct

SEQ ID NO: 1408465 - DNA, 14 bp, Homo sapiens
gacaaatacacata

SEQ ID NO: 1408466 - DNA, 20 bp, Homo sapiens
gacacacacatatatacata

SEQ ID NO: 1408467 - DNA, 17 bp, Homo sapiens
gacaggagatgctgtgc

SEQ ID NO: 1408468 - DNA, 13 bp, Homo sapiens
gacatcatttgta

SEQ ID NO: 1408469 - DNA, 18 bp, Homo sapiens
gacatcatttgtattatg

SEQ ID NO: 1408470 - DNA, 15 bp, Homo sapiens
gacccagggaacagc

SEQ ID NO: 1408471 - DNA, 12 bp, Homo sapiens
gactcagccttg

SEQ ID NO: 1408472 - DNA, 14 bp, Homo sapiens
gactcagccttgca

SEQ ID NO: 1408473 - DNA, 13 bp, Homo sapiens
gactcatgaggag

SEQ ID NO: 1408474 - DNA, 15 bp, Homo sapiens
gactcatgaggaggg

SEQ ID NO: 1408475 - DNA, 13 bp, Homo sapiens
gactgcagagggc

SEQ ID NO: 1408476 - DNA, 23 bp, Homo sapiens
gactgggggcagacatggtgggg

SEQ ID NO: 1408477 - DNA, 13 bp, Homo sapiens
gacttcagattcc

SEQ ID NO: 1408478 - DNA, 22 bp, Homo sapiens
gacttcagattccccactcagc

SEQ ID NO: 1408479 - DNA, 16 bp, Homo sapiens
gagaacttgctgcctc

SEQ ID NO: 1408480 - DNA, 18 bp, Homo sapiens
gagatatgcaataaatat

SEQ ID NO: 1408481 - DNA, 19 bp, Homo sapiens
gagatatgcaataaatatt

SEQ ID NO: 1408482 - DNA, 17 bp, Homo sapiens
gagatgctgtgcccctg

SEQ ID NO: 1408483 - DNA, 16 bp, Homo sapiens
gaggagaacttgctgc

SEQ ID NO: 1408484 - DNA, 18 bp, Homo sapiens
gaggagaacttgctgcct

SEQ ID NO: 1408485 - DNA, 16 bp, Homo sapiens
gaggatgtatgtgtat

SEQ ID NO: 1408486 - DNA, 22 bp, Homo sapiens
gaggccatctggagagcccaga

SEQ ID NO: 1408487 - DNA, 19 bp, Homo sapiens
ccctttaaccctcacactg

SEQ ID NO: 1408488 - DNA, 21 bp, Homo sapiens
ccctttaaccctcacactgct

SEQ ID NO: 1408489 - DNA, 19 bp, Homo sapiens
ccgattcctccagccctgg

SEQ ID NO: 1408490 - DNA, 14 bp, Homo sapiens
ccgcccagcccacc

SEQ ID NO: 1408491 - DNA, 12 bp, Homo sapiens
ccgcctcttccc

SEQ ID NO: 1408492 - DNA, 16 bp, Homo sapiens
ccggaatgccacccac

SEQ ID NO: 1408493 - DNA, 16 bp, Homo sapiens
ccgggggaggggcgcg

SEQ ID NO: 1408494 - DNA, 14 bp, Homo sapiens
cctcagcttggcac

SEQ ID NO: 1408495 - DNA, 13 bp, Homo sapiens
cctcaggaccagg

SEQ ID NO: 1408496 - DNA, 13 bp, Homo sapiens
cctccagccctgg

SEQ ID NO: 1408497 - DNA, 23 bp, Homo sapiens
cctcccagagctggtggacccag

SEQ ID NO: 1408498 - DNA, 13 bp, Homo sapiens
cctccctctccag

SEQ ID NO: 1408499 - DNA, 16 bp, Homo sapiens
cctccgtcactacctg

SEQ ID NO: 1408500 - DNA, 16 bp, Homo sapiens
cctcggatccccttcc

SEQ ID NO: 1408501 - DNA, 22 bp, Homo sapiens
cctctccagcaggcccatggga

SEQ ID NO: 1408502 - DNA, 21 bp, Homo sapiens
cctgacaccaggcaagaaaag

SEQ ID NO: 1408503 - DNA, 15 bp, Homo sapiens
cctgacagcaaacac

SEQ ID NO: 1408504 - DNA, 16 bp, Homo sapiens
cctgagccttcagcac

SEQ ID NO: 1408505 - DNA, 14 bp, Homo sapiens
cctgcatagctttt

SEQ ID NO: 1408506 - DNA, 12 bp, Homo sapiens
cctgccaaattt

SEQ ID NO: 1408507 - DNA, 21 bp, Homo sapiens
cctgctcggcaccgccagccg

SEQ ID NO: 1408508 - DNA, 22 bp, Homo sapiens
cctggccttgggatccaggccc

SEQ ID NO: 1408509 - DNA, 17 bp, Homo sapiens
cctgggcacacgctgct

SEQ ID NO: 1408510 - DNA, 13 bp, Homo sapiens
cctgtacacacac

SEQ ID NO: 1408511 - DNA, 15 bp, Homo sapiens
cctgtgggccagccg

SEQ ID NO: 1408512 - DNA, 23 bp, Homo sapiens
cctgtggggtcaacccttctgga

SEQ ID NO: 1408513 - DNA, 20 bp, Homo sapiens
ccttaacttactatttagat

SEQ ID NO: 1408514 - DNA, 20 bp, Homo sapiens
ccttactttaaccctttctg

SEQ ID NO: 1408515 - DNA, 15 bp, Homo sapiens
ccttctgatccacag

SEQ ID NO: 1408516 - DNA, 14 bp, Homo sapiens
ccttgggatccagg

SEQ ID NO: 1408517 - DNA, 20 bp, Homo sapiens
cgctccctcccaggactctg

SEQ ID NO: 1408518 - DNA, 15 bp, Homo sapiens
cgctgctctgcccca

SEQ ID NO: 1408519 - DNA, 14 bp, Homo sapiens
cggatccccttcct

SEQ ID NO: 1408520 - DNA, 20 bp, Homo sapiens
cggtccccactttattgcca

SEQ ID NO: 1408521 - DNA, 15 bp, Homo sapiens
cggtgtccccaccat

SEQ ID NO: 1408522 - DNA, 16 bp, Homo sapiens
cgtcactacctggctg

SEQ ID NO: 1408523 - DNA, 13 bp, Homo sapiens
cgtcttttgaaaa

SEQ ID NO: 1408524 - DNA, 12 bp, Homo sapiens
cgtgaaacacaa

SEQ ID NO: 1408525 - DNA, 23 bp, Homo sapiens
cgtgtatatgaggatgtatgtgt

SEQ ID NO: 1408526 - DNA, 11 bp, Homo sapiens
ctaaataaatt

SEQ ID NO: 1408527 - DNA, 18 bp, Homo sapiens
ctaacgcaaaaatagctc

SEQ ID NO: 1408528 - DNA, 16 bp, Homo sapiens
ctaagcattagcttta

SEQ ID NO: 1408529 - DNA, 23 bp, Homo sapiens
ctaagcattagctttaattaagc

SEQ ID NO: 1408530 - DNA, 14 bp, Homo sapiens
ctaaggtccccagc

SEQ ID NO: 1408531 - DNA, 17 bp, Homo sapiens
ctaaggtccccagcaga

SEQ ID NO: 1408532 - DNA, 19 bp, Homo sapiens
ctaagtaatctcacagcat

SEQ ID NO: 1408533 - DNA, 15 bp, Homo sapiens
ctaatctcaatttaa

SEQ ID NO: 1408534 - DNA, 21 bp, Homo sapiens
ctacaggaatctctgattaca

SEQ ID NO: 1408535 - DNA, 19 bp, Homo sapiens
ctactaatctcaatttaag

SEQ ID NO: 1408536 - DNA, 15 bp, Homo sapiens
ctagccagccaggaa

SEQ ID NO: 1408537 - DNA, 21 bp, Homo sapiens
aatttcagaaactaagaatca

SEQ ID NO: 1408538 - DNA, 22 bp, Homo sapiens
aatttttatttttggcaaagcc

SEQ ID NO: 1408539 - DNA, 17 bp, Homo sapiens
acaaactttcaagtatt

SEQ ID NO: 1408540 - DNA, 21 bp, Homo sapiens
acaaatattttctttatttgt

SEQ ID NO: 1408541 - DNA, 16 bp, Homo sapiens
acaacatccaagtggc

SEQ ID NO: 1408542 - DNA, 17 bp, Homo sapiens
acaagacttcagattcc

SEQ ID NO: 1408543 - DNA, 20 bp, Homo sapiens
acaagcagacacacacatat

SEQ ID NO: 1408544 - DNA, 16 bp, Homo sapiens
acaaggagataagaaa

SEQ ID NO: 1408545 - DNA, 18 bp, Homo sapiens
acaaggagataagaaagc

SEQ ID NO: 1408546 - DNA, 19 bp, Homo sapiens
acaaggagataagaaagca

SEQ ID NO: 1408547 - DNA, 14 bp, Homo sapiens
acaagttgaagaag

SEQ ID NO: 1408548 - DNA, 14 bp, Homo sapiens
acaattacatgtaa

SEQ ID NO: 1408549 - DNA, 17 bp, Homo sapiens
acacaagcagacacaca

SEQ ID NO: 1408550 - DNA, 22 bp, Homo sapiens
acacaagcagacacacacatat

SEQ ID NO: 1408551 - DNA, 13 bp, Homo sapiens
acacacgctgcct

SEQ ID NO: 1408552 - DNA, 16 bp, Homo sapiens
acacatatatacatac

SEQ ID NO: 1408553 - DNA, 18 bp, Homo sapiens
acacgctgctctgcccca

SEQ ID NO: 1408554 - DNA, 14 bp, Homo sapiens
acacgtgtatatga

SEQ ID NO: 1408555 - DNA, 13 bp, Homo sapiens
acactgagtgaaa

SEQ ID NO: 1408556 - DNA, 20 bp, Homo sapiens
acagaactcggtgtccccac

SEQ ID NO: 1408557 - DNA, 16 bp, Homo sapiens
acagagctagaggcca

SEQ ID NO: 1408558 - DNA, 19 bp, Homo sapiens
acagatgttcccccatctc

SEQ ID NO: 1408559 - DNA, 12 bp, Homo sapiens
acagcaaacaca

SEQ ID NO: 1408560 - DNA, 14 bp, Homo sapiens
acagcaaacacagt

SEQ ID NO: 1408561 - DNA, 14 bp, Homo sapiens
acaggagatgctgt

SEQ ID NO: 1408562 - DNA, 19 bp, Homo sapiens
acaggatgcatattaaaga

SEQ ID NO: 1408563 - DNA, 22 bp, Homo sapiens
acaggatgcatattaaagaaag

SEQ ID NO: 1408564 - DNA, 15 bp, Homo sapiens
acagtcatcatttat

SEQ ID NO: 1408565 - DNA, 16 bp, Homo sapiens
acataatttttatttt

SEQ ID NO: 1408566 - DNA, 14 bp, Homo sapiens
acatacatatatac

SEQ ID NO: 1408567 - DNA, 23 bp, Homo sapiens
acatacgcaattgtatatatatg

SEQ ID NO: 1408568 - DNA, 13 bp, Homo sapiens
acatatatacata

SEQ ID NO: 1408569 - DNA, 14 bp, Homo sapiens
acatatatacatac

SEQ ID NO: 1408570 - DNA, 22 bp, Homo sapiens
acatatttcaaaaacatgcttt

SEQ ID NO: 1408571 - DNA, 15 bp, Homo sapiens
acatgcttttccaaa

SEQ ID NO: 1408572 - DNA, 19 bp, Homo sapiens
acatggtggggtctcctca

SEQ ID NO: 1408573 - DNA, 21 bp, Homo sapiens
acattgacaatgacaaaaaga

SEQ ID NO: 1408574 - DNA, 23 bp, Homo sapiens
accacacaacatccaagtggcct

SEQ ID NO: 1408575 - DNA, 17 bp, Homo sapiens
accacccggtccccact

SEQ ID NO: 1408576 - DNA, 21 bp, Homo sapiens
accagggagatttgctcaata

SEQ ID NO: 1408577 - DNA, 21 bp, Homo sapiens
accagggttggcaccttcccc

SEQ ID NO: 1408578 - DNA, 12 bp, Homo sapiens
accagtccctgt

SEQ ID NO: 1408579 - DNA, 13 bp, Homo sapiens
accagtccctgtc

SEQ ID NO: 1408580 - DNA, 13 bp, Homo sapiens
accatctgctgtc

SEQ ID NO: 1408581 - DNA, 22 bp, Homo sapiens
accccctcttctgagcacagat

SEQ ID NO: 1408582 - DNA, 23 bp, Homo sapiens
accccttcctgggcacacgctgc

SEQ ID NO: 1408583 - DNA, 14 bp, Homo sapiens
acccggtccccact

SEQ ID NO: 1408584 - DNA, 13 bp, Homo sapiens
accgcctcttccc

SEQ ID NO: 1408585 - DNA, 18 bp, Homo sapiens
acctcctcccactgccca

SEQ ID NO: 1408586 - DNA, 19 bp, Homo sapiens
acctcctcccactgcccac

SEQ ID NO: 1408587 - DNA, 15 bp, Homo sapiens
acctctttgctccct

SEQ ID NO: 1408588 - DNA, 18 bp, Homo sapiens
acctgacagcaaacacag

SEQ ID NO: 1408589 - DNA, 16 bp, Homo sapiens
acctggcctcatttaa

SEQ ID NO: 1408590 - DNA, 20 bp, Homo sapiens
acctgtacacacacagacac

SEQ ID NO: 1408591 - DNA, 16 bp, Homo sapiens
acctgttgtctgaaac

SEQ ID NO: 1408592 - DNA, 13 bp, Homo sapiens
acgcaaaaatagc

SEQ ID NO: 1408593 - DNA, 23 bp, Homo sapiens
acgcaattgtatatatatgtgaa

SEQ ID NO: 1408594 - DNA, 20 bp, Homo sapiens
acgctgctctgccccagctt

SEQ ID NO: 1408595 - DNA, 18 bp, Homo sapiens
acgtctcaggttattcgt

SEQ ID NO: 1408596 - DNA, 13 bp, Homo sapiens
acgtgtatatgag

SEQ ID NO: 1408597 - DNA, 23 bp, Homo sapiens
acgtgtatatgaggatgtatgtg

SEQ ID NO: 1408598 - DNA, 16 bp, Homo sapiens
acgttgatgtctgaac

SEQ ID NO: 1408599 - DNA, 15 bp, Homo sapiens
actagagcacaacat

SEQ ID NO: 1408600 - DNA, 22 bp, Homo sapiens
actcaagtctattgaataatgt

SEQ ID NO: 1408601 - DNA, 13 bp, Homo sapiens
actcagccttgca

SEQ ID NO: 1408602 - DNA, 15 bp, Homo sapiens
actcagccttgcaaa

SEQ ID NO: 1408603 - DNA, 21 bp, Homo sapiens
actcatacagtggtattgcta

SEQ ID NO: 1408604 - DNA, 21 bp, Homo sapiens
actctccgaagtctgatccct

SEQ ID NO: 1408605 - DNA, 23 bp, Homo sapiens
actctgcctgtcaagtttttata

SEQ ID NO: 1408606 - DNA, 20 bp, Homo sapiens
actctggcagcaccgcctct

SEQ ID NO: 1408607 - DNA, 13 bp, Homo sapiens
actgcagagggct

SEQ ID NO: 1408608 - DNA, 20 bp, Homo sapiens
actgcagccactgattctct

SEQ ID NO: 1408609 - DNA, 17 bp, Homo sapiens
actggccgcgggggcag

SEQ ID NO: 1408610 - DNA, 19 bp, Homo sapiens
actggcttaacttagtata

SEQ ID NO: 1408611 - DNA, 23 bp, Homo sapiens
actgtacttgatttttcaaagac

SEQ ID NO: 1408612 - DNA, 20 bp, Homo sapiens
actgtcatgtgcgaacacag

SEQ ID NO: 1408613 - DNA, 17 bp, Homo sapiens
acttaactttactaagt

SEQ ID NO: 1408614 - DNA, 13 bp, Homo sapiens
acttcatttaaca

SEQ ID NO: 1408615 - DNA, 18 bp, Homo sapiens
acttctactgttcaattt

SEQ ID NO: 1408616 - DNA, 19 bp, Homo sapiens
acttgatttttcaaagact

SEQ ID NO: 1408617 - DNA, 11 bp, Homo sapiens
acttgctgcct

SEQ ID NO: 1408618 - DNA, 17 bp, Homo sapiens
actttattgccaaaacc

SEQ ID NO: 1408619 - DNA, 21 bp, Homo sapiens
actttcaagtattatatttta

SEQ ID NO: 1408620 - DNA, 16 bp, Homo sapiens
agaaaaagatctttca

SEQ ID NO: 1408621 - DNA, 11 bp, Homo sapiens
agaaaagagaa

SEQ ID NO: 1408622 - DNA, 13 bp, Homo sapiens
agaaaagagaaaa

SEQ ID NO: 1408623 - DNA, 13 bp, Homo sapiens
agaaaatttaatt

SEQ ID NO: 1408624 - DNA, 15 bp, Homo sapiens
agaaaatttaattat

SEQ ID NO: 1408625 - DNA, 16 bp, Homo sapiens
agaaaatttaattatt

SEQ ID NO: 1408626 - DNA, 13 bp, Homo sapiens
agaacaatctcaa

SEQ ID NO: 1408627 - DNA, 19 bp, Homo sapiens
agaactcggtgtccccacc

SEQ ID NO: 1408628 - DNA, 20 bp, Homo sapiens
agaactcggtgtccccacca

SEQ ID NO: 1408629 - DNA, 14 bp, Homo sapiens
agaacttgctgcct

SEQ ID NO: 1408630 - DNA, 21 bp, Homo sapiens
agaagcttaaaataaagttaa

SEQ ID NO: 1408631 - DNA, 20 bp, Homo sapiens
agaatcatcctcatgccttt

SEQ ID NO: 1408632 - DNA, 14 bp, Homo sapiens
agacaaatacacat

SEQ ID NO: 1408633 - DNA, 11 bp, Homo sapiens
agacacacaca

SEQ ID NO: 1408634 - DNA, 14 bp, Homo sapiens
agacacacacatat

SEQ ID NO: 1408635 - DNA, 17 bp, Homo sapiens
agacaggactgcagagg

SEQ ID NO: 1408636 - DNA, 18 bp, Homo sapiens
agacatggtggggtctcc

SEQ ID NO: 1408637 - DNA, 13 bp, Homo sapiens
agaccatttaatc

SEQ ID NO: 1408638 - DNA, 13 bp, Homo sapiens
agactagccagcc

SEQ ID NO: 1408639 - DNA, 16 bp, Homo sapiens
agactagccagccagg

SEQ ID NO: 1408640 - DNA, 14 bp, Homo sapiens
agactgtgattctt

SEQ ID NO: 1408641 - DNA, 18 bp, Homo sapiens
agactgtgattcttagca

SEQ ID NO: 1408642 - DNA, 16 bp, Homo sapiens
agacttcagattcccc

SEQ ID NO: 1408643 - DNA, 14 bp, Homo sapiens
agacttcatttaac

SEQ ID NO: 1408644 - DNA, 15 bp, Homo sapiens
agagaggttaacaga

SEQ ID NO: 1408645 - DNA, 20 bp, Homo sapiens
agagaggttaacagatttat

SEQ ID NO: 1408646 - DNA, 18 bp, Homo sapiens
agagcccagagtcccccc

SEQ ID NO: 1408647 - DNA, 20 bp, Homo sapiens
agaggagaacttgctgcctc

SEQ ID NO: 1408648 - DNA, 15 bp, Homo sapiens
agagtccccccactc

SEQ ID NO: 1408649 - DNA, 13 bp, Homo sapiens
agataagaaagca

SEQ ID NO: 1408650 - DNA, 22 bp, Homo sapiens
agatcggctttcatgtaattat

SEQ ID NO: 1408651 - DNA, 16 bp, Homo sapiens
agatctcactctgccc

SEQ ID NO: 1408652 - DNA, 14 bp, Homo sapiens
agatctttcatttt

SEQ ID NO: 1408653 - DNA, 20 bp, Homo sapiens
agattccccactcagccttt

SEQ ID NO: 1408654 - DNA, 17 bp, Homo sapiens
agcaatttcagttttaa

SEQ ID NO: 1408655 - DNA, 14 bp, Homo sapiens
agcacaacataatt

SEQ ID NO: 1408656 - DNA, 11 bp, Homo sapiens
agcacatgatt

SEQ ID NO: 1408657 - DNA, 23 bp, Homo sapiens
agcagaattgacagttgaacaga

SEQ ID NO: 1408658 - DNA, 13 bp, Homo sapiens
agcatatatataa

SEQ ID NO: 1408659 - DNA, 19 bp, Homo sapiens
agcatatatataaaataca

SEQ ID NO: 1408660 - DNA, 14 bp, Homo sapiens
agcatcgcactctg

SEQ ID NO: 1408661 - DNA, 17 bp, Homo sapiens
agcattagctttaatta

SEQ ID NO: 1408662 - DNA, 15 bp, Homo sapiens
agcatttagatctac

SEQ ID NO: 1408663 - DNA, 18 bp, Homo sapiens
agcatttctagaacaatt

SEQ ID NO: 1408664 - DNA, 20 bp, Homo sapiens
agccaaagaaatttcaacag

SEQ ID NO: 1408665 - DNA, 21 bp, Homo sapiens
agccaagcaaatgcctgccaa

SEQ ID NO: 1408666 - DNA, 20 bp, Homo sapiens
agccaatatcccttacttta

SEQ ID NO: 1408667 - DNA, 11 bp, Homo sapiens
agccactcccc

SEQ ID NO: 1408668 - DNA, 14 bp, Homo sapiens
agccactccccagc

SEQ ID NO: 1408669 - DNA, 13 bp, Homo sapiens
agccagaaaaaga

SEQ ID NO: 1408670 - DNA, 21 bp, Homo sapiens
agccagaaaaagatctttcat

SEQ ID NO: 1408671 - DNA, 14 bp, Homo sapiens
agccagccaggaag

SEQ ID NO: 1408672 - DNA, 23 bp, Homo sapiens
agcccatttgggcagagaggctg

SEQ ID NO: 1408673 - DNA, 20 bp, Homo sapiens
agccggggggccgggggagg

SEQ ID NO: 1408674 - DNA, 14 bp, Homo sapiens
agcctaaagaccat

SEQ ID NO: 1408675 - DNA, 16 bp, Homo sapiens
agcctaaagaccattt

SEQ ID NO: 1408676 - DNA, 14 bp, Homo sapiens
agcctttgagactg

SEQ ID NO: 1408677 - DNA, 15 bp, Homo sapiens
agctaaaacacttct

SEQ ID NO: 1408678 - DNA, 14 bp, Homo sapiens
agctcataagagta

SEQ ID NO: 1408679 - DNA, 18 bp, Homo sapiens
agctccatacacacgctg

SEQ ID NO: 1408680 - DNA, 20 bp, Homo sapiens
agctccatacacacgctgcc

SEQ ID NO: 1408681 - DNA, 22 bp, Homo sapiens
agctccatacacacgctgcctt

SEQ ID NO: 1408682 - DNA, 14 bp, Homo sapiens
agctctcatagctc

SEQ ID NO: 1408683 - DNA, 15 bp, Homo sapiens
agctgcaccccttcc

SEQ ID NO: 1408684 - DNA, 17 bp, Homo sapiens
agctgcaccccttcctg

SEQ ID NO: 1408685 - DNA, 21 bp, Homo sapiens
agctgcaccccttcctgggca

SEQ ID NO: 1408686 - DNA, 15 bp, Homo sapiens
agctggtggacccag

SEQ ID NO: 1408687 - DNA, 21 bp, Homo sapiens
agcttaaaataaagttaaact

SEQ ID NO: 1408688 - DNA, 16 bp, Homo sapiens
agcttggcactcaggt

SEQ ID NO: 1408689 - DNA, 11 bp, Homo sapiens
agcttgggcag

SEQ ID NO: 1408690 - DNA, 21 bp, Homo sapiens
agcttgggcagatctcccaca

SEQ ID NO: 1408691 - DNA, 18 bp, Homo sapiens
agctttaattaagctctc

SEQ ID NO: 1408692 - DNA, 14 bp, Homo sapiens
aggagataagaaag

SEQ ID NO: 1408693 - DNA, 16 bp, Homo sapiens
aggagataagaaagca

SEQ ID NO: 1408694 - DNA, 23 bp, Homo sapiens
aggaggggcccccctgccctgtg

SEQ ID NO: 1408695 - DNA, 17 bp, Homo sapiens
aggatgcatattaaaga

SEQ ID NO: 1408696 - DNA, 12 bp, Homo sapiens
aggatgtatgtg

SEQ ID NO: 1408697 - DNA, 18 bp, Homo sapiens
aggcaagaaaagcgcaga

SEQ ID NO: 1408698 - DNA, 20 bp, Homo sapiens
aggcaagaaaagcgcagaga

SEQ ID NO: 1408699 - DNA, 16 bp, Homo sapiens
aggcaccagtccctgt

SEQ ID NO: 1408700 - DNA, 11 bp, Homo sapiens
aggccatctgg

SEQ ID NO: 1408701 - DNA, 14 bp, Homo sapiens
aggccatctggaga

SEQ ID NO: 1408702 - DNA, 14 bp, Homo sapiens
aggctactacagag

SEQ ID NO: 1408703 - DNA, 20 bp, Homo sapiens
aggctactacagagaaggct

SEQ ID NO: 1408704 - DNA, 22 bp, Homo sapiens
aggctgatttatggtcagaatt

SEQ ID NO: 1408705 - DNA, 20 bp, Homo sapiens
agggcagagaggttaacaga

SEQ ID NO: 1408706 - DNA, 13 bp, Homo sapiens
agggctccagagt

SEQ ID NO: 1408707 - DNA, 16 bp, Homo sapiens
aggggaggccatctgg

SEQ ID NO: 1408708 - DNA, 16 bp, Homo sapiens
aggggcccccctgccc

SEQ ID NO: 1408709 - DNA, 22 bp, Homo sapiens
aggggcccccctgccctgtggg

SEQ ID NO: 1408710 - DNA, 19 bp, Homo sapiens
aggtcagtagactgtgatt

SEQ ID NO: 1408711 - DNA, 15 bp, Homo sapiens
aggtccccagcagaa

SEQ ID NO: 1408712 - DNA, 13 bp, Homo sapiens
aggtcccctttca

SEQ ID NO: 1408713 - DNA, 12 bp, Homo sapiens
aggtcgcccacc

SEQ ID NO: 1408714 - DNA, 16 bp, Homo sapiens
aggtgcaacactcaag

SEQ ID NO: 1408715 - DNA, 21 bp, Homo sapiens
aggttcaggtcccctttcaga

SEQ ID NO: 1408716 - DNA, 18 bp, Homo sapiens
agtaaagtgaagaattta

SEQ ID NO: 1408717 - DNA, 20 bp, Homo sapiens
agtaaagtgaagaatttatc

SEQ ID NO: 1408718 - DNA, 17 bp, Homo sapiens
agtaacagtcatcattt

SEQ ID NO: 1408719 - DNA, 18 bp, Homo sapiens
agtaacagtcatcattta

SEQ ID NO: 1408720 - DNA, 19 bp, Homo sapiens
agtaacagtcatcatttat

SEQ ID NO: 1408721 - DNA, 20 bp, Homo sapiens
agtaacagtcatcatttatc

SEQ ID NO: 1408722 - DNA, 14 bp, Homo sapiens
agtagactgtgatt

SEQ ID NO: 1408723 - DNA, 21 bp, Homo sapiens
agtcagtgcccatgtgtatgg

SEQ ID NO: 1408724 - DNA, 13 bp, Homo sapiens
agtcatcatttat

SEQ ID NO: 1408725 - DNA, 14 bp, Homo sapiens
agtcatcatttatc

SEQ ID NO: 1408726 - DNA, 23 bp, Homo sapiens
agtccaggacaggagatgctgtg

SEQ ID NO: 1408727 - DNA, 18 bp, Homo sapiens
agtctattgaataatgta

SEQ ID NO: 1408728 - DNA, 13 bp, Homo sapiens
agtgaaatattac

SEQ ID NO: 1408729 - DNA, 13 bp, Homo sapiens
agtgaagaattta

SEQ ID NO: 1408730 - DNA, 16 bp, Homo sapiens
agtgcccatgtgtatg

SEQ ID NO: 1408731 - DNA, 20 bp, Homo sapiens
agtgccttatcaaataatat

SEQ ID NO: 1408732 - DNA, 20 bp, Homo sapiens
agtggatccagcttcactgt

SEQ ID NO: 1408733 - DNA, 14 bp, Homo sapiens
agttaaactgatta

SEQ ID NO: 1408734 - DNA, 18 bp, Homo sapiens
agttagtgattatatttc

SEQ ID NO: 1408735 - DNA, 15 bp, Homo sapiens
agttcaacaacaaaa

SEQ ID NO: 1408736 - DNA, 16 bp, Homo sapiens
agttgaacagagctag

SEQ ID NO: 1408737 - DNA, 23 bp, Homo sapiens
agttgaacagagctagaggccat

SEQ ID NO: 1408738 - DNA, 19 bp, Homo sapiens
agttgtagaagaaaattta

SEQ ID NO: 1408739 - DNA, 11 bp, Homo sapiens
ataaaatacac

SEQ ID NO: 1408740 - DNA, 13 bp, Homo sapiens
ataaaatacacgt

SEQ ID NO: 1408741 - DNA, 20 bp, Homo sapiens
ataaaatacacgtgtatatg

SEQ ID NO: 1408742 - DNA, 21 bp, Homo sapiens
ataaaatacacgtgtatatga

SEQ ID NO: 1408743 - DNA, 15 bp, Homo sapiens
ataaccacatttcta

SEQ ID NO: 1408744 - DNA, 17 bp, Homo sapiens
ataagagtaacagtcat

SEQ ID NO: 1408745 - DNA, 22 bp, Homo sapiens
ataagagtaacagtcatcattt

SEQ ID NO: 1408746 - DNA, 19 bp, Homo sapiens
ataatagcacatgatttgg

SEQ ID NO: 1408747 - DNA, 13 bp, Homo sapiens
ataatatgcatat

SEQ ID NO: 1408748 - DNA, 14 bp, Homo sapiens
ataatatgcatata

SEQ ID NO: 1408749 - DNA, 14 bp, Homo sapiens
ataatgtcaaatga

SEQ ID NO: 1408750 - DNA, 12 bp, Homo sapiens
atacacacagga

SEQ ID NO: 1408751 - DNA, 15 bp, Homo sapiens
atacatatatacatt

SEQ ID NO: 1408752 - DNA, 20 bp, Homo sapiens
atttcagaaactaagaatca

SEQ ID NO: 1408753 - DNA, 15 bp, Homo sapiens
atttcataagcacat

SEQ ID NO: 1408754 - DNA, 19 bp, Homo sapiens
atttcataagcacatccaa

SEQ ID NO: 1408755 - DNA, 15 bp, Homo sapiens
atttctagaacaatt

SEQ ID NO: 1408756 - DNA, 21 bp, Homo sapiens
atttctagaacaattacatgt

SEQ ID NO: 1408757 - DNA, 22 bp, Homo sapiens
atttctagaacaattacatgta

SEQ ID NO: 1408758 - DNA, 23 bp, Homo sapiens
atttctagaacaattacatgtaa

SEQ ID NO: 1408759 - DNA, 16 bp, Homo sapiens
atttctgtatctgaca

SEQ ID NO: 1408760 - DNA, 21 bp, Homo sapiens
atttcttttgtaataaactat

SEQ ID NO: 1408761 - DNA, 22 bp, Homo sapiens
atttcttttgtaataaactatt

SEQ ID NO: 1408762 - DNA, 21 bp, Homo sapiens
atttgcataatatgcatatat

SEQ ID NO: 1408763 - DNA, 20 bp, Homo sapiens
atttgtagccaaagaaattt

SEQ ID NO: 1408764 - DNA, 14 bp, Homo sapiens
attttcaattatac

SEQ ID NO: 1408765 - DNA, 15 bp, Homo sapiens
attttcaattatact

SEQ ID NO: 1408766 - DNA, 18 bp, Homo sapiens
attttcctttatgtgatg

SEQ ID NO: 1408767 - DNA, 15 bp, Homo sapiens
attttctttatttgt

SEQ ID NO: 1408768 - DNA, 16 bp, Homo sapiens
attttctttatttgta

SEQ ID NO: 1408769 - DNA, 23 bp, Homo sapiens
attttgcacctgcagccaagcaa

SEQ ID NO: 1408770 - DNA, 14 bp, Homo sapiens
caaaaatagctctt

SEQ ID NO: 1408771 - DNA, 16 bp, Homo sapiens
caaaaatagctcttgc

SEQ ID NO: 1408772 - DNA, 18 bp, Homo sapiens
caaaacccagctgcaccc

SEQ ID NO: 1408773 - DNA, 20 bp, Homo sapiens
caaagaaatttcaacagtta

SEQ ID NO: 1408774 - DNA, 13 bp, Homo sapiens
caaagatcaaatg

SEQ ID NO: 1408775 - DNA, 14 bp, Homo sapiens
caaatacacataca

SEQ ID NO: 1408776 - DNA, 15 bp, Homo sapiens
caaatacacatacat

SEQ ID NO: 1408777 - DNA, 16 bp, Homo sapiens
caaatacacatacata

SEQ ID NO: 1408778 - DNA, 18 bp, Homo sapiens
caaatgcctgccaaattt

SEQ ID NO: 1408779 - DNA, 21 bp, Homo sapiens
caaatggctacatctccaaat

SEQ ID NO: 1408780 - DNA, 13 bp, Homo sapiens
caaattgcatttg

SEQ ID NO: 1408781 - DNA, 22 bp, Homo sapiens
caacagttattgggcttaaaaa

SEQ ID NO: 1408782 - DNA, 20 bp, Homo sapiens
caagaaaagcgcagagaaat

SEQ ID NO: 1408783 - DNA, 13 bp, Homo sapiens
caagacttcagat

SEQ ID NO: 1408784 - DNA, 12 bp, Homo sapiens
caagattttgtt

SEQ ID NO: 1408785 - DNA, 23 bp, Homo sapiens
caagcagacacacacatatatac

SEQ ID NO: 1408786 - DNA, 17 bp, Homo sapiens
caaggctactacagaga

SEQ ID NO: 1408787 - DNA, 19 bp, Homo sapiens
caagtatcatctaaatatt

SEQ ID NO: 1408788 - DNA, 14 bp, Homo sapiens
caatacagtatttc

SEQ ID NO: 1408789 - DNA, 15 bp, Homo sapiens
caatacctggcctca

SEQ ID NO: 1408790 - DNA, 19 bp, Homo sapiens
caatacctggcctcattta

SEQ ID NO: 1408791 - DNA, 14 bp, Homo sapiens
caatactaggaagt

SEQ ID NO: 1408792 - DNA, 17 bp, Homo sapiens
caatatccaattttaaa

SEQ ID NO: 1408793 - DNA, 15 bp, Homo sapiens
caatgacaaaaagaa

SEQ ID NO: 1408794 - DNA, 14 bp, Homo sapiens
attgtatatatatg

SEQ ID NO: 1408795 - DNA, 15 bp, Homo sapiens
attgtatatatatgt

SEQ ID NO: 1408796 - DNA, 13 bp, Homo sapiens
aatttaattattt

SEQ ID NO: 1408797 - DNA, 18 bp, Homo sapiens
aatttaccacaggatgca

SEQ ID NO: 1408798 - DNA, 19 bp, Homo sapiens
aatttcagaaactaagaat

SEQ ID NO: 1408799 - DNA, 23 bp, Homo sapiens
aattttaaaatgaaatgcatttt

SEQ ID NO: 1408800 - DNA, 22 bp, Homo sapiens
acaaactttcaagtattatatt

SEQ ID NO: 1408801 - DNA, 11 bp, Homo sapiens
acaaatacaca

SEQ ID NO: 1408802 - DNA, 16 bp, Homo sapiens
acaaatacacatacat

SEQ ID NO: 1408803 - DNA, 20 bp, Homo sapiens
acaaatacacatacatatat

SEQ ID NO: 1408804 - DNA, 22 bp, Homo sapiens
acaaatggctacatctccaaat

SEQ ID NO: 1408805 - DNA, 12 bp, Homo sapiens
acaaattgcatt

SEQ ID NO: 1408806 - DNA, 23 bp, Homo sapiens
acaacatccaagtggcctccgtc

SEQ ID NO: 1408807 - DNA, 13 bp, Homo sapiens
acaagcagacaca

SEQ ID NO: 1408808 - DNA, 22 bp, Homo sapiens
acaagcagacacacacatatat

SEQ ID NO: 1408809 - DNA, 23 bp, Homo sapiens
acaagtatcatctaaatattatg

SEQ ID NO: 1408810 - DNA, 16 bp, Homo sapiens
acaattacatgtaaac

SEQ ID NO: 1408811 - DNA, 19 bp, Homo sapiens
acaattacatgtaaacaaa

SEQ ID NO: 1408812 - DNA, 15 bp, Homo sapiens
acacaaagatcaaat

SEQ ID NO: 1408813 - DNA, 20 bp, Homo sapiens
acacacaagcagacacacac

SEQ ID NO: 1408814 - DNA, 18 bp, Homo sapiens
acacacagacacacaagc

SEQ ID NO: 1408815 - DNA, 15 bp, Homo sapiens
acacacatatataca

SEQ ID NO: 1408816 - DNA, 14 bp, Homo sapiens
acacacgctgcctt

SEQ ID NO: 1408817 - DNA, 17 bp, Homo sapiens
acacagacacacaagca

SEQ ID NO: 1408818 - DNA, 14 bp, Homo sapiens
acacatacatatat

SEQ ID NO: 1408819 - DNA, 21 bp, Homo sapiens
acacatacatatatacatttt

SEQ ID NO: 1408820 - DNA, 12 bp, Homo sapiens
acacatatatac

SEQ ID NO: 1408821 - DNA, 13 bp, Homo sapiens
acacattgacaat

SEQ ID NO: 1408822 - DNA, 14 bp, Homo sapiens
acacctcctcccac

SEQ ID NO: 1408823 - DNA, 12 bp, Homo sapiens
acacgctgcctt

SEQ ID NO: 1408824 - DNA, 22 bp, Homo sapiens
acacgctgctctgccccagctt

SEQ ID NO: 1408825 - DNA, 23 bp, Homo sapiens
acacgctgctctgccccagcttg

SEQ ID NO: 1408826 - DNA, 15 bp, Homo sapiens
acactctaaataaat

SEQ ID NO: 1408827 - DNA, 17 bp, Homo sapiens
acagatgtgttgcaaag

SEQ ID NO: 1408828 - DNA, 15 bp, Homo sapiens
acagcaaacacagtc

SEQ ID NO: 1408829 - DNA, 13 bp, Homo sapiens
acaggatgcatat

SEQ ID NO: 1408830 - DNA, 15 bp, Homo sapiens
acaggatgcatatta

SEQ ID NO: 1408831 - DNA, 21 bp, Homo sapiens
acagtatttctttgttataca

SEQ ID NO: 1408832 - DNA, 23 bp, Homo sapiens
acagtggccttgagcttcaaaat

SEQ ID NO: 1408833 - DNA, 13 bp, Homo sapiens
acagtgtgtagtt

SEQ ID NO: 1408834 - DNA, 19 bp, Homo sapiens
acatacgcaattgtatata

SEQ ID NO: 1408835 - DNA, 13 bp, Homo sapiens
acatatatacatt

SEQ ID NO: 1408836 - DNA, 19 bp, Homo sapiens
acatatttcataagcacat

SEQ ID NO: 1408837 - DNA, 12 bp, Homo sapiens
acatcatttgta

SEQ ID NO: 1408838 - DNA, 19 bp, Homo sapiens
acatcatttgtattatgtt

SEQ ID NO: 1408839 - DNA, 14 bp, Homo sapiens
acatgtaaacaaat

SEQ ID NO: 1408840 - DNA, 16 bp, Homo sapiens
acatgtaaacaaatat

SEQ ID NO: 1408841 - DNA, 12 bp, Homo sapiens
acattgtatgtt

SEQ ID NO: 1408842 - DNA, 16 bp, Homo sapiens
acatttcaatcactga

SEQ ID NO: 1408843 - DNA, 20 bp, Homo sapiens
acattttgcagctatggaca

SEQ ID NO: 1408844 - DNA, 16 bp, Homo sapiens
accacaggatgcatat

SEQ ID NO: 1408845 - DNA, 17 bp, Homo sapiens
accacaggatgcatatt

SEQ ID NO: 1408846 - DNA, 19 bp, Homo sapiens
accacatttctaagccttt

SEQ ID NO: 1408847 - DNA, 16 bp, Homo sapiens
accacccggtccccac

SEQ ID NO: 1408848 - DNA, 19 bp, Homo sapiens
accagataactgaggaggg

SEQ ID NO: 1408849 - DNA, 19 bp, Homo sapiens
accagggttggcaccttcc

SEQ ID NO: 1408850 - DNA, 15 bp, Homo sapiens
accagtgaaaattga

SEQ ID NO: 1408851 - DNA, 17 bp, Homo sapiens
accatctaggatgattt

SEQ ID NO: 1408852 - DNA, 14 bp, Homo sapiens
acccagctgcaccc

SEQ ID NO: 1408853 - DNA, 14 bp, Homo sapiens
accccatggccggc

SEQ ID NO: 1408854 - DNA, 21 bp, Homo sapiens
acccccgacgtgctcccctgc

SEQ ID NO: 1408855 - DNA, 22 bp, Homo sapiens
acccccgacgtgctcccctgct

SEQ ID NO: 1408856 - DNA, 23 bp, Homo sapiens
acccccgacgtgctcccctgctc

SEQ ID NO: 1408857 - DNA, 14 bp, Homo sapiens
acccgtacacacca

SEQ ID NO: 1408858 - DNA, 18 bp, Homo sapiens
acccttctggaaactgtg

SEQ ID NO: 1408859 - DNA, 21 bp, Homo sapiens
acctacaaggagataagaaag

SEQ ID NO: 1408860 - DNA, 14 bp, Homo sapiens
acctcctcccactg

SEQ ID NO: 1408861 - DNA, 14 bp, Homo sapiens
acctctttgctccc

SEQ ID NO: 1408862 - DNA, 17 bp, Homo sapiens
acctctttgctccctga

SEQ ID NO: 1408863 - DNA, 15 bp, Homo sapiens
acctgtacacacaca

SEQ ID NO: 1408864 - DNA, 14 bp, Homo sapiens
accttccaaagagt

SEQ ID NO: 1408865 - DNA, 20 bp, Homo sapiens
accttccccctcccccagcc

SEQ ID NO: 1408866 - DNA, 22 bp, Homo sapiens
acgaccgtcttttgaaaactca

SEQ ID NO: 1408867 - DNA, 14 bp, Homo sapiens
acgattttggaaat

SEQ ID NO: 1408868 - DNA, 14 bp, Homo sapiens
acgcaattgtatat

SEQ ID NO: 1408869 - DNA, 15 bp, Homo sapiens
acgcaattgtatata

SEQ ID NO: 1408870 - DNA, 21 bp, Homo sapiens
acgcaattgtatatatatgtg

SEQ ID NO: 1408871 - DNA, 18 bp, Homo sapiens
acgctgccttcggtaccc

SEQ ID NO: 1408872 - DNA, 13 bp, Homo sapiens
acgctgctctgcc

SEQ ID NO: 1408873 - DNA, 22 bp, Homo sapiens
actaagtaatctcacagcattt

SEQ ID NO: 1408874 - DNA, 23 bp, Homo sapiens
actaagtaatctcacagcatttg

SEQ ID NO: 1408875 - DNA, 16 bp, Homo sapiens
actaatctcaatttaa

SEQ ID NO: 1408876 - DNA, 15 bp, Homo sapiens
actacagagaaggct

SEQ ID NO: 1408877 - DNA, 16 bp, Homo sapiens
actactcctagactga

SEQ ID NO: 1408878 - DNA, 19 bp, Homo sapiens
actagagcacaacataatt

SEQ ID NO: 1408879 - DNA, 20 bp, Homo sapiens
actcaagtctattgaataat

SEQ ID NO: 1408880 - DNA, 20 bp, Homo sapiens
actcagccttgcaaatagcc

SEQ ID NO: 1408881 - DNA, 20 bp, Homo sapiens
actcccagcatcgcactctg

SEQ ID NO: 1408882 - DNA, 14 bp, Homo sapiens
actcggtgtcccca

SEQ ID NO: 1408883 - DNA, 18 bp, Homo sapiens
actcggtgtccccaccat

SEQ ID NO: 1408884 - DNA, 23 bp, Homo sapiens
actctaaataaatttgcttttat

SEQ ID NO: 1408885 - DNA, 14 bp, Homo sapiens
actctctaccagat

SEQ ID NO: 1408886 - DNA, 15 bp, Homo sapiens
actctggcagcaccg

SEQ ID NO: 1408887 - DNA, 22 bp, Homo sapiens
actctggcagcaccgcctcttc

SEQ ID NO: 1408888 - DNA, 23 bp, Homo sapiens
actgaaaatgtgctctacatctc

SEQ ID NO: 1408889 - DNA, 18 bp, Homo sapiens
actgagtgaaatattact

SEQ ID NO: 1408890 - DNA, 17 bp, Homo sapiens
actgcagccactgattc

SEQ ID NO: 1408891 - DNA, 20 bp, Homo sapiens
actgcattttacacattgac

SEQ ID NO: 1408892 - DNA, 16 bp, Homo sapiens
actggcttaacttagt

SEQ ID NO: 1408893 - DNA, 15 bp, Homo sapiens
actgggggcagacat

SEQ ID NO: 1408894 - DNA, 21 bp, Homo sapiens
actgtcatgtgcgaacacagt

SEQ ID NO: 1408895 - DNA, 18 bp, Homo sapiens
acttagtatattattatt

SEQ ID NO: 1408896 - DNA, 18 bp, Homo sapiens
acttgatttttcaaagac

SEQ ID NO: 1408897 - DNA, 12 bp, Homo sapiens
acttgctgcctc

SEQ ID NO: 1408898 - DNA, 15 bp, Homo sapiens
actttaaccctttct

SEQ ID NO: 1408899 - DNA, 19 bp, Homo sapiens
actttctcagcatatatat

SEQ ID NO: 1408900 - DNA, 20 bp, Homo sapiens
actttctcagcatatatata

SEQ ID NO: 1408901 - DNA, 15 bp, Homo sapiens
agaaaagagaaaaaa

SEQ ID NO: 1408902 - DNA, 12 bp, Homo sapiens
agaaaatttaat

SEQ ID NO: 1408903 - DNA, 19 bp, Homo sapiens
agaaatttcaacagttatt

SEQ ID NO: 1408904 - DNA, 18 bp, Homo sapiens
agaactcggtgtccccac

SEQ ID NO: 1408905 - DNA, 15 bp, Homo sapiens
agaacttgctgcctc

SEQ ID NO: 1408906 - DNA, 23 bp, Homo sapiens
agaagaggtggccccatattaac

SEQ ID NO: 1408907 - DNA, 17 bp, Homo sapiens
agaatgagggcgtgaaa

SEQ ID NO: 1408908 - DNA, 23 bp, Homo sapiens
agaatgagggcgtgaaacacaat

SEQ ID NO: 1408909 - DNA, 12 bp, Homo sapiens
agacaaatacac

SEQ ID NO: 1408910 - DNA, 13 bp, Homo sapiens
agacaaatacaca

SEQ ID NO: 1408911 - DNA, 22 bp, Homo sapiens
agacacacaagcagacacacac

SEQ ID NO: 1408912 - DNA, 17 bp, Homo sapiens
agacagttaaactggct

SEQ ID NO: 1408913 - DNA, 18 bp, Homo sapiens
agacagttaaactggctt

SEQ ID NO: 1408914 - DNA, 15 bp, Homo sapiens
agacattcttagtta

SEQ ID NO: 1408915 - DNA, 13 bp, Homo sapiens
agacctcagcttg

SEQ ID NO: 1408916 - DNA, 20 bp, Homo sapiens
agactgtgattcttagcaaa

SEQ ID NO: 1408917 - DNA, 12 bp, Homo sapiens
agagatataata

SEQ ID NO: 1408918 - DNA, 13 bp, Homo sapiens
agagatataataa

SEQ ID NO: 1408919 - DNA, 20 bp, Homo sapiens
agaggatgctgacatcattt

SEQ ID NO: 1408920 - DNA, 20 bp, Homo sapiens
caagtatcatctaaatatta

SEQ ID NO: 1408921 - DNA, 17 bp, Homo sapiens
caagtattatattttat

SEQ ID NO: 1408922 - DNA, 13 bp, Homo sapiens
caagttgaagaag

SEQ ID NO: 1408923 - DNA, 16 bp, Homo sapiens
caagttgaagaagctg

SEQ ID NO: 1408924 - DNA, 23 bp, Homo sapiens
caagtttttatacctgtacacac

SEQ ID NO: 1408925 - DNA, 15 bp, Homo sapiens
caataaatattattt

SEQ ID NO: 1408926 - DNA, 13 bp, Homo sapiens
caatacagtattt

SEQ ID NO: 1408927 - DNA, 23 bp, Homo sapiens
caatatcatccccaaatgtgtct

SEQ ID NO: 1408928 - DNA, 20 bp, Homo sapiens
caatatccaattttaaaatg

SEQ ID NO: 1408929 - DNA, 12 bp, Homo sapiens
caattgtatata

SEQ ID NO: 1408930 - DNA, 13 bp, Homo sapiens
caattgtatatat

SEQ ID NO: 1408931 - DNA, 16 bp, Homo sapiens
caattgtatatatatg

SEQ ID NO: 1408932 - DNA, 15 bp, Homo sapiens
caatttcagaaacta

SEQ ID NO: 1408933 - DNA, 20 bp, Homo sapiens
caattttaaaatgaaatgca

SEQ ID NO: 1408934 - DNA, 18 bp, Homo sapiens
cacaagcagacacacaca

SEQ ID NO: 1408935 - DNA, 14 bp, Homo sapiens
cacacacatatata

SEQ ID NO: 1408936 - DNA, 12 bp, Homo sapiens
cacacatatata

SEQ ID NO: 1408937 - DNA, 12 bp, Homo sapiens
cacacgctgcct

SEQ ID NO: 1408938 - DNA, 14 bp, Homo sapiens
cacactgctccagt

SEQ ID NO: 1408939 - DNA, 18 bp, Homo sapiens
cacactgtggcctgatca

SEQ ID NO: 1408940 - DNA, 16 bp, Homo sapiens
cacagaagcacatgca

SEQ ID NO: 1408941 - DNA, 17 bp, Homo sapiens
cacagcctcatcagtat

SEQ ID NO: 1408942 - DNA, 19 bp, Homo sapiens
cacaggatgcatattaaag

SEQ ID NO: 1408943 - DNA, 20 bp, Homo sapiens
cacaggatgcatattaaaga

SEQ ID NO: 1408944 - DNA, 14 bp, Homo sapiens
cacatacatatata

SEQ ID NO: 1408945 - DNA, 15 bp, Homo sapiens
cacatacatatatac

SEQ ID NO: 1408946 - DNA, 14 bp, Homo sapiens
cacatatatacata

SEQ ID NO: 1408947 - DNA, 15 bp, Homo sapiens
cacatatatacatac

SEQ ID NO: 1408948 - DNA, 19 bp, Homo sapiens
cacatcacccatgttgaga

SEQ ID NO: 1408949 - DNA, 14 bp, Homo sapiens
cacatgccaggggc

SEQ ID NO: 1408950 - DNA, 16 bp, Homo sapiens
cacatttctaagcctt

SEQ ID NO: 1408951 - DNA, 13 bp, Homo sapiens
caccaggcaagaa

SEQ ID NO: 1408952 - DNA, 15 bp, Homo sapiens
caccccatggccggc

SEQ ID NO: 1408953 - DNA, 21 bp, Homo sapiens
cacctacaaggagataagaaa

SEQ ID NO: 1408954 - DNA, 15 bp, Homo sapiens
cacctgtgggccagc

SEQ ID NO: 1408955 - DNA, 12 bp, Homo sapiens
caccttccaaag

SEQ ID NO: 1408956 - DNA, 19 bp, Homo sapiens
caccttccccctcccccag

SEQ ID NO: 1408957 - DNA, 17 bp, Homo sapiens
cacgctgctctgcccca

SEQ ID NO: 1408958 - DNA, 13 bp, Homo sapiens
cactacctggctg

SEQ ID NO: 1408959 - DNA, 16 bp, Homo sapiens
cactccccagccagcc

SEQ ID NO: 1408960 - DNA, 22 bp, Homo sapiens
cactccccagccagcctggctg

SEQ ID NO: 1408961 - DNA, 17 bp, Homo sapiens
cactctcgagttaaaga

SEQ ID NO: 1408962 - DNA, 16 bp, Homo sapiens
cactctggcagcaccg

SEQ ID NO: 1408963 - DNA, 13 bp, Homo sapiens
cactgagtgaaat

SEQ ID NO: 1408964 - DNA, 15 bp, Homo sapiens
cactgagtgaaatat

SEQ ID NO: 1408965 - DNA, 22 bp, Homo sapiens
cactgtcatgtgcgaacacagt

SEQ ID NO: 1408966 - DNA, 23 bp, Homo sapiens
cactgtcatgtgcgaacacagtg

SEQ ID NO: 1408967 - DNA, 20 bp, Homo sapiens
cactttattgccaaaaccca

SEQ ID NO: 1408968 - DNA, 11 bp, Homo sapiens
cagaaagacat

SEQ ID NO: 1408969 - DNA, 22 bp, Homo sapiens
cagaatgatgcaggttcaggtc

SEQ ID NO: 1408970 - DNA, 20 bp, Homo sapiens
cagaatggaatgctctggtc

SEQ ID NO: 1408971 - DNA, 12 bp, Homo sapiens
cagacacacaca

SEQ ID NO: 1408972 - DNA, 19 bp, Homo sapiens
cagacacacacatatatac

SEQ ID NO: 1408973 - DNA, 15 bp, Homo sapiens
cagagaggctgtggt

SEQ ID NO: 1408974 - DNA, 16 bp, Homo sapiens
cagagaggctgtggtt

SEQ ID NO: 1408975 - DNA, 15 bp, Homo sapiens
cagagctagaggcca

SEQ ID NO: 1408976 - DNA, 18 bp, Homo sapiens
cagagctggtggacccag

SEQ ID NO: 1408977 - DNA, 13 bp, Homo sapiens
cagagtcccccca

SEQ ID NO: 1408978 - DNA, 14 bp, Homo sapiens
cagataactgagga

SEQ ID NO: 1408979 - DNA, 23 bp, Homo sapiens
cagatctcccacatgccaggggc

SEQ ID NO: 1408980 - DNA, 14 bp, Homo sapiens
cagatcttggactc

SEQ ID NO: 1408981 - DNA, 15 bp, Homo sapiens
cagatcttggactca

SEQ ID NO: 1408982 - DNA, 17 bp, Homo sapiens
cagatgttcccccatct

SEQ ID NO: 1408983 - DNA, 13 bp, Homo sapiens
cagcaaacacagt

SEQ ID NO: 1408984 - DNA, 14 bp, Homo sapiens
cagcaccgcctctt

SEQ ID NO: 1408985 - DNA, 11 bp, Homo sapiens
cagcaggccca

SEQ ID NO: 1408986 - DNA, 18 bp, Homo sapiens
cagcattctcaggcacca

SEQ ID NO: 1408987 - DNA, 14 bp, Homo sapiens
cagccactccccag

SEQ ID NO: 1408988 - DNA, 13 bp, Homo sapiens
cagccactgattc

SEQ ID NO: 1408989 - DNA, 17 bp, Homo sapiens
cagcccaccccatggcc

SEQ ID NO: 1408990 - DNA, 14 bp, Homo sapiens
cagctgcacccctt

SEQ ID NO: 1408991 - DNA, 17 bp, Homo sapiens
cagctgcaccccttcct

SEQ ID NO: 1408992 - DNA, 18 bp, Homo sapiens
caggaatctctgattaca

SEQ ID NO: 1408993 - DNA, 17 bp, Homo sapiens
caggacaggagatgctg

SEQ ID NO: 1408994 - DNA, 21 bp, Homo sapiens
caggacaggagatgctgtgcc

SEQ ID NO: 1408995 - DNA, 22 bp, Homo sapiens
caggagtcagtgcccatgtgta

SEQ ID NO: 1408996 - DNA, 16 bp, Homo sapiens
caggatgcatattaaa

SEQ ID NO: 1408997 - DNA, 17 bp, Homo sapiens
caggatgcatattaaag

SEQ ID NO: 1408998 - DNA, 14 bp, Homo sapiens
caggatttgcacag

SEQ ID NO: 1408999 - DNA, 18 bp, Homo sapiens
caggcaccagtccctgtc

SEQ ID NO: 1409000 - DNA, 14 bp, Homo sapiens
caggcccctccctc

SEQ ID NO: 1409001 - DNA, 17 bp, Homo sapiens
caggcccctccctctcc

SEQ ID NO: 1409002 - DNA, 15 bp, Homo sapiens
cagggaaaacacaga

SEQ ID NO: 1409003 - DNA, 13 bp, Homo sapiens
cagggttggcacc

SEQ ID NO: 1409004 - DNA, 20 bp, Homo sapiens
cagggttggcaccttccccc

SEQ ID NO: 1409005 - DNA, 24 bp, Homo sapiens
caggtgcaacactcaagtctattg

SEQ ID NO: 1409006 - DNA, 16 bp, Homo sapiens
cagtgcccatgtgtat

SEQ ID NO: 1409007 - DNA, 15 bp, Homo sapiens
cagttaaactggctt

SEQ ID NO: 1409008 - DNA, 22 bp, Homo sapiens
cataagagtaacagtcatcatt

SEQ ID NO: 1409009 - DNA, 18 bp, Homo sapiens
cataagttagatgtttta

SEQ ID NO: 1409010 - DNA, 20 bp, Homo sapiens
cataatatgcatatatatgt

SEQ ID NO: 1409011 - DNA, 21 bp, Homo sapiens
cataatatgcatatatatgta

SEQ ID NO: 1409012 - DNA, 22 bp, Homo sapiens
cataatttttatttttggcaaa

SEQ ID NO: 1409013 - DNA, 13 bp, Homo sapiens
catacacacgctg

SEQ ID NO: 1409014 - DNA, 22 bp, Homo sapiens
catacaccccctcttctgagca

SEQ ID NO: 1409015 - DNA, 19 bp, Homo sapiens
catacgcaattgtatatat

SEQ ID NO: 1409016 - DNA, 23 bp, Homo sapiens
catacgcaattgtatatatatgt

SEQ ID NO: 1409017 - DNA, 16 bp, Homo sapiens
catacgttttctgcaa

SEQ ID NO: 1409018 - DNA, 13 bp, Homo sapiens
catatatacatac

SEQ ID NO: 1409019 - DNA, 20 bp, Homo sapiens
catatatataaaatacacgt

SEQ ID NO: 1409020 - DNA, 23 bp, Homo sapiens
catattttcctttatgtgatgta

SEQ ID NO: 1409021 - DNA, 13 bp, Homo sapiens
catcacaaatggc

SEQ ID NO: 1409022 - DNA, 12 bp, Homo sapiens
catcatttatca

SEQ ID NO: 1409023 - DNA, 15 bp, Homo sapiens
catctaaatattatg

SEQ ID NO: 1409024 - DNA, 21 bp, Homo sapiens
catctcctttgcagaatgatg

SEQ ID NO: 1409025 - DNA, 19 bp, Homo sapiens
catctcgctccctcccagg

SEQ ID NO: 1409026 - DNA, 19 bp, Homo sapiens
catctctcaggaatcatct

SEQ ID NO: 1409027 - DNA, 12 bp, Homo sapiens
catctgctgtct

SEQ ID NO: 1409028 - DNA, 20 bp, Homo sapiens
catctggagagcccagagtc

SEQ ID NO: 1409029 - DNA, 18 bp, Homo sapiens
catcttcgggaccaggat

SEQ ID NO: 1409030 - DNA, 18 bp, Homo sapiens
catgacccgtacacacca

SEQ ID NO: 1409031 - DNA, 13 bp, Homo sapiens
catgccaggggcc

SEQ ID NO: 1409032 - DNA, 15 bp, Homo sapiens
catgcctttatactt

SEQ ID NO: 1409033 - DNA, 18 bp, Homo sapiens
catggcagcatgcgatgt

SEQ ID NO: 1409034 - DNA, 18 bp, Homo sapiens
catggccggctttcagga

SEQ ID NO: 1409035 - DNA, 19 bp, Homo sapiens
catggccggctttcaggag

SEQ ID NO: 1409036 - DNA, 20 bp, Homo sapiens
catggtggggtctcctcagg

SEQ ID NO: 1409037 - DNA, 23 bp, Homo sapiens
catggtggggtctcctcaggacc

SEQ ID NO: 1409038 - DNA, 16 bp, Homo sapiens
catgtcccctcccaga

SEQ ID NO: 1409039 - DNA, 19 bp, Homo sapiens
catgtgagaatatttttcc

SEQ ID NO: 1409040 - DNA, 18 bp, Homo sapiens
catgttgagacctcagct

SEQ ID NO: 1409041 - DNA, 18 bp, Homo sapiens
cattacaatacagtattt

SEQ ID NO: 1409042 - DNA, 14 bp, Homo sapiens
cattctcaggcacc

SEQ ID NO: 1409043 - DNA, 15 bp, Homo sapiens
cattctcaggcacca

SEQ ID NO: 1409044 - DNA, 21 bp, Homo sapiens
cattggaaaatttaagacaag

SEQ ID NO: 1409045 - DNA, 13 bp, Homo sapiens
cattgtatgttaa

SEQ ID NO: 1409046 - DNA, 21 bp, Homo sapiens
cattgtatgttaatagaaaat

SEQ ID NO: 1409047 - DNA, 21 bp, Homo sapiens
catttccatgtcccctcccag

SEQ ID NO: 1409048 - DNA, 16 bp, Homo sapiens
catttggcctcttgta

SEQ ID NO: 1409049 - DNA, 20 bp, Homo sapiens
catttggcctcttgtagtct

SEQ ID NO: 1409050 - DNA, 12 bp, Homo sapiens
catttgggcaga

SEQ ID NO: 1409051 - DNA, 15 bp, Homo sapiens
cattttatagaatgt

SEQ ID NO: 1409052 - DNA, 21 bp, Homo sapiens
ccaaatgtgtcttgtattatc

SEQ ID NO: 1409053 - DNA, 21 bp, Homo sapiens
ccaaattttagatttaccttg

SEQ ID NO: 1409054 - DNA, 15 bp, Homo sapiens
ccaaccacagaggat

SEQ ID NO: 1409055 - DNA, 14 bp, Homo sapiens
ccaagcaaatgcct

SEQ ID NO: 1409056 - DNA, 21 bp, Homo sapiens
ccaatatccaattttaaaatg

SEQ ID NO: 1409057 - DNA, 21 bp, Homo sapiens
ccaattttaaaatgaaatgca

SEQ ID NO: 1409058 - DNA, 21 bp, Homo sapiens
ccacacaacatccaagtggcc

SEQ ID NO: 1409059 - DNA, 18 bp, Homo sapiens
ccacatttctaagccttt

SEQ ID NO: 1409060 - DNA, 11 bp, Homo sapiens
ccaccatctgc

SEQ ID NO: 1409061 - DNA, 13 bp, Homo sapiens
ccaccccatggcc

SEQ ID NO: 1409062 - DNA, 16 bp, Homo sapiens
ccacctacaaggagat

SEQ ID NO: 1409063 - DNA, 19 bp, Homo sapiens
ccactccccagccagcctg

SEQ ID NO: 1409064 - DNA, 15 bp, Homo sapiens
ccactgcccactggc

SEQ ID NO: 1409065 - DNA, 16 bp, Homo sapiens
ccactgcccactggcc

SEQ ID NO: 1409066 - DNA, 16 bp, Homo sapiens
ccagataactgaggag

SEQ ID NO: 1409067 - DNA, 18 bp, Homo sapiens
ccagcatcgcactctggc

SEQ ID NO: 1409068 - DNA, 14 bp, Homo sapiens
ccagccagcctggc

SEQ ID NO: 1409069 - DNA, 17 bp, Homo sapiens
ccagcccatttgggcag

SEQ ID NO: 1409070 - DNA, 13 bp, Homo sapiens
ccagccgattcct

SEQ ID NO: 1409071 - DNA, 18 bp, Homo sapiens
ccagccgattcctccagc

SEQ ID NO: 1409072 - DNA, 22 bp, Homo sapiens
ccagccgattcctccagccctg

SEQ ID NO: 1409073 - DNA, 20 bp, Homo sapiens
ccagcctggctgggactggg

SEQ ID NO: 1409074 - DNA, 21 bp, Homo sapiens
ccagctgcaccccttcctggg

SEQ ID NO: 1409075 - DNA, 13 bp, Homo sapiens
ccagcttgggcag

SEQ ID NO: 1409076 - DNA, 14 bp, Homo sapiens
ccagcttgggcaga

SEQ ID NO: 1409077 - DNA, 20 bp, Homo sapiens
ccaggacaggagatgctgtg

SEQ ID NO: 1409078 - DNA, 13 bp, Homo sapiens
ccaggactctgac

SEQ ID NO: 1409079 - DNA, 21 bp, Homo sapiens
ccaggcaagaaaagcgcagag

SEQ ID NO: 1409080 - DNA, 23 bp, Homo sapiens
ccaggcaagaaaagcgcagagaa

SEQ ID NO: 1409081 - DNA, 16 bp, Homo sapiens
ccaggcccctccctct

SEQ ID NO: 1409082 - DNA, 22 bp, Homo sapiens
ccaggctattcggcaaggaagt

SEQ ID NO: 1409083 - DNA, 21 bp, Homo sapiens
ccagggttggcaccttccccc

SEQ ID NO: 1409084 - DNA, 17 bp, Homo sapiens
ccaggtcgcccacctgt

SEQ ID NO: 1409085 - DNA, 14 bp, Homo sapiens
ccatacacacgctg

SEQ ID NO: 1409086 - DNA, 20 bp, Homo sapiens
ccatacacacgctgccttcg

SEQ ID NO: 1409087 - DNA, 19 bp, Homo sapiens
ccatacaccccctcttctg

SEQ ID NO: 1409088 - DNA, 14 bp, Homo sapiens
ccatattaacaaat

SEQ ID NO: 1409089 - DNA, 18 bp, Homo sapiens
ccatctcgctccctccca

SEQ ID NO: 1409090 - DNA, 22 bp, Homo sapiens
ccatctcgctccctcccaggac

SEQ ID NO: 1409091 - DNA, 22 bp, Homo sapiens
ccatctggagagcccagagtcc

SEQ ID NO: 1409092 - DNA, 22 bp, Homo sapiens
ccattggaaaatttaagacaag

SEQ ID NO: 1409093 - DNA, 17 bp, Homo sapiens
ccatttgggcagagagg

SEQ ID NO: 1409094 - DNA, 19 bp, Homo sapiens
cccaaccacagaggatgct

SEQ ID NO: 1409095 - DNA, 12 bp, Homo sapiens
cccacatgccag

SEQ ID NO: 1409096 - DNA, 17 bp, Homo sapiens
cccaccatctgctgtct

SEQ ID NO: 1409097 - DNA, 13 bp, Homo sapiens
cccactggccggc

SEQ ID NO: 1409098 - DNA, 19 bp, Homo sapiens
cccagagctggtggaccca

SEQ ID NO: 1409099 - DNA, 20 bp, Homo sapiens
cccagagtccccccactccc

SEQ ID NO: 1409100 - DNA, 21 bp, Homo sapiens
cccagcatcgcactctggcag

SEQ ID NO: 1409101 - DNA, 13 bp, Homo sapiens
cccagcattctca

SEQ ID NO: 1409102 - DNA, 19 bp, Homo sapiens
cccagcattctcaggcacc

SEQ ID NO: 1409103 - DNA, 16 bp, Homo sapiens
cccagccactccccag

SEQ ID NO: 1409104 - DNA, 22 bp, Homo sapiens
cccagcttgggcagatctccca

SEQ ID NO: 1409105 - DNA, 19 bp, Homo sapiens
cccaggactctgaccccag

SEQ ID NO: 1409106 - DNA, 17 bp, Homo sapiens
cccaggtcgcccacctg

SEQ ID NO: 1409107 - DNA, 18 bp, Homo sapiens
cccatcttcgggaccagg

SEQ ID NO: 1409108 - DNA, 17 bp, Homo sapiens
cccatgttgagacctca

SEQ ID NO: 1409109 - DNA, 20 bp, Homo sapiens
cccatttgggcagagaggct

SEQ ID NO: 1409110 - DNA, 14 bp, Homo sapiens
ccccaccatctgct

SEQ ID NO: 1409111 - DNA, 15 bp, Homo sapiens
ccccactcagccttt

SEQ ID NO: 1409112 - DNA, 22 bp, Homo sapiens
ccccagccagcctggctgggac

SEQ ID NO: 1409113 - DNA, 16 bp, Homo sapiens
cccccatcttcgggac

SEQ ID NO: 1409114 - DNA, 18 bp, Homo sapiens
cccccatcttcgggacca

SEQ ID NO: 1409115 - DNA, 21 bp, Homo sapiens
cccccgacgtgctcccctgct

SEQ ID NO: 1409116 - DNA, 18 bp, Homo sapiens
ccccctcccccagccact

SEQ ID NO: 1409117 - DNA, 18 bp, Homo sapiens
ccccgacgtgctcccctg

SEQ ID NO: 1409118 - DNA, 14 bp, Homo sapiens
cccctcttctgagc

SEQ ID NO: 1409119 - DNA, 14 bp, Homo sapiens
ccccttcctgggca

SEQ ID NO: 1409120 - DNA, 15 bp, Homo sapiens
ccctcacactgctcc

SEQ ID NO: 1409121 - DNA, 16 bp, Homo sapiens
ccctccatgtgagaat

SEQ ID NO: 1409122 - DNA, 14 bp, Homo sapiens
ccctcccaggactc

SEQ ID NO: 1409123 - DNA, 13 bp, Homo sapiens
ccctctccagcag

SEQ ID NO: 1409124 - DNA, 15 bp, Homo sapiens
ccctcttctgagcac

SEQ ID NO: 1409125 - DNA, 20 bp, Homo sapiens
ccctgactgggggcagacat

SEQ ID NO: 1409126 - DNA, 13 bp, Homo sapiens
ccctgccctgtgg

SEQ ID NO: 1409127 - DNA, 14 bp, Homo sapiens
cccttcctgggcac

SEQ ID NO: 1409128 - DNA, 18 bp, Homo sapiens
cccttcctgggcacacgc

SEQ ID NO: 1409129 - DNA, 23 bp, Homo sapiens
cccttcctgggcacacgctgctc

SEQ ID NO: 1409130 - DNA, 19 bp, Homo sapiens
cccttgcagttatgttatc

SEQ ID NO: 1409131 - DNA, 18 bp, Homo sapiens
ccgaagtctgatccctgc

SEQ ID NO: 1409132 - DNA, 18 bp, Homo sapiens
ccgattcctccagccctg

SEQ ID NO: 1409133 - DNA, 20 bp, Homo sapiens
ccggaatgccacccacatct

SEQ ID NO: 1409134 - DNA, 16 bp, Homo sapiens
ccgggatgggagccgg

SEQ ID NO: 1409135 - DNA, 17 bp, Homo sapiens
ccgggcaaactggccgc

SEQ ID NO: 1409136 - DNA, 18 bp, Homo sapiens
cctaaagaccatttaatc

SEQ ID NO: 1409137 - DNA, 18 bp, Homo sapiens
cctacaaggagataagaa

SEQ ID NO: 1409138 - DNA, 23 bp, Homo sapiens
cctcatcagtatttggacttttt

SEQ ID NO: 1409139 - DNA, 23 bp, Homo sapiens
cctcatgcctttatttctgtatc

SEQ ID NO: 1409140 - DNA, 23 bp, Homo sapiens
cctcatttaaaacaagacttcag

SEQ ID NO: 1409141 - DNA, 15 bp, Homo sapiens
cctccatgtgagaat

SEQ ID NO: 1409142 - DNA, 18 bp, Homo sapiens
cctcccccagccactccc

SEQ ID NO: 1409143 - DNA, 14 bp, Homo sapiens
cctccgtcactacc

SEQ ID NO: 1409144 - DNA, 22 bp, Homo sapiens
cctcctcccactgcccactggc

SEQ ID NO: 1409145 - DNA, 16 bp, Homo sapiens
cctcttgtagtcttgg

SEQ ID NO: 1409146 - DNA, 18 bp, Homo sapiens
cctcttgtagtcttggct

SEQ ID NO: 1409147 - DNA, 16 bp, Homo sapiens
cctgacaccaggcaag

SEQ ID NO: 1409148 - DNA, 17 bp, Homo sapiens
cctgactgggggcagac

SEQ ID NO: 1409149 - DNA, 21 bp, Homo sapiens
cctgcatagcttttccctgtc

SEQ ID NO: 1409150 - DNA, 20 bp, Homo sapiens
cctggccttgggatccaggc

SEQ ID NO: 1409151 - DNA, 21 bp, Homo sapiens
cctgtacacacacagacacac

SEQ ID NO: 1409152 - DNA, 17 bp, Homo sapiens
cctgttgtctgaaacat

SEQ ID NO: 1409153 - DNA, 19 bp, Homo sapiens
ccttactttaaccctttct

SEQ ID NO: 1409154 - DNA, 15 bp, Homo sapiens
ccttatcaaataata

SEQ ID NO: 1409155 - DNA, 13 bp, Homo sapiens
ccttcctgggcac

SEQ ID NO: 1409156 - DNA, 23 bp, Homo sapiens
ccttcctgggcacacgctgctct

SEQ ID NO: 1409157 - DNA, 21 bp, Homo sapiens
ccttgagaatgagggcgtgaa

SEQ ID NO: 1409158 - DNA, 12 bp, Homo sapiens
cctttatgtgat

SEQ ID NO: 1409159 - DNA, 19 bp, Homo sapiens
cctttgggtgctgttttgc

SEQ ID NO: 1409160 - DNA, 18 bp, Homo sapiens
cgaaatgctgtctttctt

SEQ ID NO: 1409161 - DNA, 16 bp, Homo sapiens
cgaagtctgatccctg

SEQ ID NO: 1409162 - DNA, 17 bp, Homo sapiens
cgattcctccagccctg

SEQ ID NO: 1409163 - DNA, 13 bp, Homo sapiens
cgcaaaaatagct

SEQ ID NO: 1409164 - DNA, 16 bp, Homo sapiens
cgcaattgtatatata

SEQ ID NO: 1409165 - DNA, 13 bp, Homo sapiens
cgcactctggcag

SEQ ID NO: 1409166 - DNA, 10 bp, Homo sapiens
cgcagagaaa

SEQ ID NO: 1409167 - DNA, 11 bp, Homo sapiens
cgcagagaaat

SEQ ID NO: 1409168 - DNA, 13 bp, Homo sapiens
cgctccctcccag

SEQ ID NO: 1409169 - DNA, 14 bp, Homo sapiens
ggactcatgaggag

SEQ ID NO: 1409170 - DNA, 12 bp, Homo sapiens
ggactgcagcca

SEQ ID NO: 1409171 - DNA, 23 bp, Homo sapiens
ggagatgctgtgcccctggcctt

SEQ ID NO: 1409172 - DNA, 24 bp, Homo sapiens
ggagatgctgtgcccctggccttg

SEQ ID NO: 1409173 - DNA, 12 bp, Homo sapiens
ggaggccatctg

SEQ ID NO: 1409174 - DNA, 13 bp, Homo sapiens
ggatccaggcccc

SEQ ID NO: 1409175 - DNA, 19 bp, Homo sapiens
ggcaagaaaagcgcagaga

SEQ ID NO: 1409176 - DNA, 17 bp, Homo sapiens
ggcacacctcctcccac

SEQ ID NO: 1409177 - DNA, 21 bp, Homo sapiens
ggcacacctcctcccactgcc

SEQ ID NO: 1409178 - DNA, 20 bp, Homo sapiens
ggcacacgctgctctgcccc

SEQ ID NO: 1409179 - DNA, 21 bp, Homo sapiens
ggcacacgctgctctgcccca

SEQ ID NO: 1409180 - DNA, 22 bp, Homo sapiens
ggcacacgctgctctgccccag

SEQ ID NO: 1409181 - DNA, 14 bp, Homo sapiens
ggcaccagtccctg

SEQ ID NO: 1409182 - DNA, 18 bp, Homo sapiens
ggcaccagtccctgtccg

SEQ ID NO: 1409183 - DNA, 21 bp, Homo sapiens
ggcagacatggtggggtctcc

SEQ ID NO: 1409184 - DNA, 19 bp, Homo sapiens
ggcagcaccgcctcttccc

SEQ ID NO: 1409185 - DNA, 16 bp, Homo sapiens
ggcaggggaggccatc

SEQ ID NO: 1409186 - DNA, 20 bp, Homo sapiens
ggcaggggaggccatctgga

SEQ ID NO: 1409187 - DNA, 15 bp, Homo sapiens
ggcccctccctctcc

SEQ ID NO: 1409188 - DNA, 23 bp, Homo sapiens
ggcccctccctctccagcaggcc

SEQ ID NO: 1409189 - DNA, 15 bp, Homo sapiens
ggccgggggaggggc

SEQ ID NO: 1409190 - DNA, 17 bp, Homo sapiens
ggctacatctccaaata

SEQ ID NO: 1409191 - DNA, 17 bp, Homo sapiens
ggctggagttggggcag

SEQ ID NO: 1409192 - DNA, 22 bp, Homo sapiens
ggcttaacttagtatattatta

SEQ ID NO: 1409193 - DNA, 17 bp, Homo sapiens
gggaaactgagggcaga

SEQ ID NO: 1409194 - DNA, 17 bp, Homo sapiens
gggcacacctcctccca

SEQ ID NO: 1409195 - DNA, 16 bp, Homo sapiens
gggcacacgctgctct

SEQ ID NO: 1409196 - DNA, 15 bp, Homo sapiens
gggcagaggagaact

SEQ ID NO: 1409197 - DNA, 21 bp, Homo sapiens
gggcagaggagaacttgctgc

SEQ ID NO: 1409198 - DNA, 23 bp, Homo sapiens
gggcagaggagaacttgctgcct

SEQ ID NO: 1409199 - DNA, 16 bp, Homo sapiens
gggcagatctcccaca

SEQ ID NO: 1409200 - DNA, 22 bp, Homo sapiens
gggcagatcttggactcatgag

SEQ ID NO: 1409201 - DNA, 20 bp, Homo sapiens
gggcaggggaggccatctgg

SEQ ID NO: 1409202 - DNA, 13 bp, Homo sapiens
gggcccccctgcc

SEQ ID NO: 1409203 - DNA, 15 bp, Homo sapiens
gggcccccctgccct

SEQ ID NO: 1409204 - DNA, 15 bp, Homo sapiens
gggctctagaattcc

SEQ ID NO: 1409205 - DNA, 15 bp, Homo sapiens
ggggaggccatctgg

SEQ ID NO: 1409206 - DNA, 20 bp, Homo sapiens
ggggcctttgggtgctgttt

SEQ ID NO: 1409207 - DNA, 15 bp, Homo sapiens
gggggccgggggagg

SEQ ID NO: 1409208 - DNA, 18 bp, Homo sapiens
ggtggacccagggaacag

SEQ ID NO: 1409209 - DNA, 13 bp, Homo sapiens
ggtgtccccacca

SEQ ID NO: 1409210 - DNA, 18 bp, Homo sapiens
ggtgtccccaccatctgc

SEQ ID NO: 1409211 - DNA, 21 bp, Homo sapiens
ggtgtccccaccatctgctgt

SEQ ID NO: 1409212 - DNA, 14 bp, Homo sapiens
gtaaacaaatattt

SEQ ID NO: 1409213 - DNA, 19 bp, Homo sapiens
gtaaagtgaagaatttatc

SEQ ID NO: 1409214 - DNA, 14 bp, Homo sapiens
gtaataaactattt

SEQ ID NO: 1409215 - DNA, 17 bp, Homo sapiens
gtaatatggactcagcc

SEQ ID NO: 1409216 - DNA, 14 bp, Homo sapiens
gtactctaatatac

SEQ ID NO: 1409217 - DNA, 20 bp, Homo sapiens
gtactctaatatacagtgtg

SEQ ID NO: 1409218 - DNA, 17 bp, Homo sapiens
gtagaagaaaatttaat

SEQ ID NO: 1409219 - DNA, 19 bp, Homo sapiens
gtagttttgtgatgcattt

SEQ ID NO: 1409220 - DNA, 14 bp, Homo sapiens
gtatatgtttatac

SEQ ID NO: 1409221 - DNA, 22 bp, Homo sapiens
gtatatgtttatacacacagga

SEQ ID NO: 1409222 - DNA, 17 bp, Homo sapiens
gtatcatctaaatatta

SEQ ID NO: 1409223 - DNA, 19 bp, Homo sapiens
gtatcatctaaatattatg

SEQ ID NO: 1409224 - DNA, 13 bp, Homo sapiens
gtatgtgtatatg

SEQ ID NO: 1409225 - DNA, 14 bp, Homo sapiens
gtatgttaatagaa

SEQ ID NO: 1409226 - DNA, 14 bp, Homo sapiens
gtattatattttat

SEQ ID NO: 1409227 - DNA, 12 bp, Homo sapiens
gtattatcataa

SEQ ID NO: 1409228 - DNA, 19 bp, Homo sapiens
gtattatgttccaaggcta

SEQ ID NO: 1409229 - DNA, 16 bp, Homo sapiens
gtattgctagtttaaa

SEQ ID NO: 1409230 - DNA, 15 bp, Homo sapiens
gtcaagtttttatac

SEQ ID NO: 1409231 - DNA, 16 bp, Homo sapiens
gtcaagtttttatacc

SEQ ID NO: 1409232 - DNA, 14 bp, Homo sapiens
gtcactacctggct

SEQ ID NO: 1409233 - DNA, 17 bp, Homo sapiens
gtcatattttcctttat

SEQ ID NO: 1409234 - DNA, 22 bp, Homo sapiens
gtccaggacaggagatgctgtg

SEQ ID NO: 1409235 - DNA, 17 bp, Homo sapiens
gtccccaccatctgctg

SEQ ID NO: 1409236 - DNA, 18 bp, Homo sapiens
gtccccaccatctgctgt

SEQ ID NO: 1409237 - DNA, 12 bp, Homo sapiens
gtccccagcaga

SEQ ID NO: 1409238 - DNA, 17 bp, Homo sapiens
gtccccccactcccagc

SEQ ID NO: 1409239 - DNA, 16 bp, Homo sapiens
gtcctgacaccaggca

SEQ ID NO: 1409240 - DNA, 21 bp, Homo sapiens
gtctatataaccacatttcta

SEQ ID NO: 1409241 - DNA, 20 bp, Homo sapiens
gtctccgaaatgctgtcttt

SEQ ID NO: 1409242 - DNA, 20 bp, Homo sapiens
gtctgaacgaccgtcttttg

SEQ ID NO: 1409243 - DNA, 14 bp, Homo sapiens
gtctgatccctgcc

SEQ ID NO: 1409244 - DNA, 20 bp, Homo sapiens
gtcttttctttgccatctct

SEQ ID NO: 1409245 - DNA, 13 bp, Homo sapiens
gtgaaacacaata

SEQ ID NO: 1409246 - DNA, 19 bp, Homo sapiens
gtgaactttctcagcatat

SEQ ID NO: 1409247 - DNA, 23 bp, Homo sapiens
gtgaactttctcagcatatatat

SEQ ID NO: 1409248 - DNA, 23 bp, Homo sapiens
gtgctcccctgctcggcaccgcc

SEQ ID NO: 1409249 - DNA, 18 bp, Homo sapiens
gtgtatggaagacaaata

SEQ ID NO: 1409250 - DNA, 23 bp, Homo sapiens
gtgtatggaagacaaatacacat

SEQ ID NO: 1409251 - DNA, 19 bp, Homo sapiens
gtgtcacactgtggcctga

SEQ ID NO: 1409252 - DNA, 13 bp, Homo sapiens
gtgtccccaccat

SEQ ID NO: 1409253 - DNA, 18 bp, Homo sapiens
gtgtccccaccatctgct

SEQ ID NO: 1409254 - DNA, 20 bp, Homo sapiens
gtgtctgacgattttggaaa

SEQ ID NO: 1409255 - DNA, 18 bp, Homo sapiens
gtgtgcttacctgttgtc

SEQ ID NO: 1409256 - DNA, 19 bp, Homo sapiens
gttaactgcattttacaca

SEQ ID NO: 1409257 - DNA, 13 bp, Homo sapiens
gttatacatttaa

SEQ ID NO: 1409258 - DNA, 14 bp, Homo sapiens
gttatacatttaaa

SEQ ID NO: 1409259 - DNA, 24 bp, Homo sapiens
gttgagacctcagcttggcactca

SEQ ID NO: 1409260 - DNA, 20 bp, Homo sapiens
gttgcaaaggtaggttgaag

SEQ ID NO: 1409261 - DNA, 13 bp, Homo sapiens
gttggcaccttcc

SEQ ID NO: 1409262 - DNA, 18 bp, Homo sapiens
gttggcaccttccccctc

SEQ ID NO: 1409263 - DNA, 22 bp, Homo sapiens
gttgtaagtactctaatataca

SEQ ID NO: 1409264 - DNA, 20 bp, Homo sapiens
gttgtagaagaaaatttaat

SEQ ID NO: 1409265 - DNA, 14 bp, Homo sapiens
gtttatacacacag

SEQ ID NO: 1409266 - DNA, 22 bp, Homo sapiens
gtttttatacctgtacacacac

SEQ ID NO: 1409267 - DNA, 22 bp, Homo sapiens
taaaaatcagaaagacattctt

SEQ ID NO: 1409268 - DNA, 15 bp, Homo sapiens
taaaatacacgtgta

SEQ ID NO: 1409269 - DNA, 18 bp, Homo sapiens
taaaatacacgtgtatat

SEQ ID NO: 1409270 - DNA, 17 bp, Homo sapiens
taaaatgaaatgcattt

SEQ ID NO: 1409271 - DNA, 23 bp, Homo sapiens
taaaatgagtcacttacttcata

SEQ ID NO: 1409272 - DNA, 13 bp, Homo sapiens
taaacaaatattt

SEQ ID NO: 1409273 - DNA, 20 bp, Homo sapiens
taaacaaatattttctttat

SEQ ID NO: 1409274 - DNA, 14 bp, Homo sapiens
taaagaaagtcata

SEQ ID NO: 1409275 - DNA, 18 bp, Homo sapiens
taaagtgaagaatttatc

SEQ ID NO: 1409276 - DNA, 22 bp, Homo sapiens
taaagtgaagaatttatctctt

SEQ ID NO: 1409277 - DNA, 16 bp, Homo sapiens
taaataaatttgcttt

SEQ ID NO: 1409278 - DNA, 15 bp, Homo sapiens
taaatattatttgat

SEQ ID NO: 1409279 - DNA, 14 bp, Homo sapiens
taacaaattgcatt

SEQ ID NO: 1409280 - DNA, 15 bp, Homo sapiens
taacactgagtgaaa

SEQ ID NO: 1409281 - DNA, 21 bp, Homo sapiens
taacactgagtgaaatattac

SEQ ID NO: 1409282 - DNA, 15 bp, Homo sapiens
taacagtcatcattt

SEQ ID NO: 1409283 - DNA, 17 bp, Homo sapiens
taacagtcatcatttat

SEQ ID NO: 1409284 - DNA, 18 bp, Homo sapiens
taacagtcatcatttatc

SEQ ID NO: 1409285 - DNA, 20 bp, Homo sapiens
taaccctttctgggatgcaa

SEQ ID NO: 1409286 - DNA, 21 bp, Homo sapiens
taacgcaaaaatagctcttgc

SEQ ID NO: 1409287 - DNA, 22 bp, Homo sapiens
taactactttctgttatctaga

SEQ ID NO: 1409288 - DNA, 18 bp, Homo sapiens
taactgcattttacacat

SEQ ID NO: 1409289 - DNA, 20 bp, Homo sapiens
taagcctttgagactgttcc

SEQ ID NO: 1409290 - DNA, 21 bp, Homo sapiens
taatagaagcttaaaataaag

SEQ ID NO: 1409291 - DNA, 18 bp, Homo sapiens
taatatacagtgtgtagt

SEQ ID NO: 1409292 - DNA, 20 bp, Homo sapiens
ttccaaggctactacagaga

SEQ ID NO: 1409293 - DNA, 21 bp, Homo sapiens
ttcctaccacccggtccccac

SEQ ID NO: 1409294 - DNA, 13 bp, Homo sapiens
ttcctccagccct

SEQ ID NO: 1409295 - DNA, 16 bp, Homo sapiens
ttcctgggcacacgct

SEQ ID NO: 1409296 - DNA, 20 bp, Homo sapiens
ttcctgggcacacgctgctc

SEQ ID NO: 1409297 - DNA, 21 bp, Homo sapiens
ttctaccctccatgtgagaat

SEQ ID NO: 1409298 - DNA, 22 bp, Homo sapiens
ttcttagttaatctttgaaaac

SEQ ID NO: 1409299 - DNA, 18 bp, Homo sapiens
ttgaaagggacaagtatc

SEQ ID NO: 1409300 - DNA, 23 bp, Homo sapiens
ttgagaatgagggcgtgaaacac

SEQ ID NO: 1409301 - DNA, 14 bp, Homo sapiens
ttgagacctcagct

SEQ ID NO: 1409302 - DNA, 22 bp, Homo sapiens
ttgagacctcagcttggcactc

SEQ ID NO: 1409303 - DNA, 23 bp, Homo sapiens
ttgagacctcagcttggcactca

SEQ ID NO: 1409304 - DNA, 16 bp, Homo sapiens
ttgcaaatagccagtg

SEQ ID NO: 1409305 - DNA, 17 bp, Homo sapiens
ttgcaaggctgatttat

SEQ ID NO: 1409306 - DNA, 18 bp, Homo sapiens
ttgcacctgcagccaagc

SEQ ID NO: 1409307 - DNA, 21 bp, Homo sapiens
ttgcacctgcagccaagcaaa

SEQ ID NO: 1409308 - DNA, 14 bp, Homo sapiens
ttgcagaatgatgc

SEQ ID NO: 1409309 - DNA, 16 bp, Homo sapiens
ttgcagaatgatgcag

SEQ ID NO: 1409310 - DNA, 20 bp, Homo sapiens
ttgcagctatggacaattta

SEQ ID NO: 1409311 - DNA, 17 bp, Homo sapiens
ttgccaaaacccagctg

SEQ ID NO: 1409312 - DNA, 22 bp, Homo sapiens
ttgccaaaacccagctgcaccc

SEQ ID NO: 1409313 - DNA, 20 bp, Homo sapiens
ttgccagcccatttgggcag

SEQ ID NO: 1409314 - DNA, 15 bp, Homo sapiens
ttgccatctctgctc

SEQ ID NO: 1409315 - DNA, 23 bp, Homo sapiens
ttgctgcctcggatccccttcct

SEQ ID NO: 1409316 - DNA, 23 bp, Homo sapiens
ttgctttgacttaggtgtgaaga

SEQ ID NO: 1409317 - DNA, 16 bp, Homo sapiens
ttggcaccttccccct

SEQ ID NO: 1409318 - DNA, 19 bp, Homo sapiens
ttgggatccaggcccctcc

SEQ ID NO: 1409319 - DNA, 21 bp, Homo sapiens
ttgggatccaggcccctccct

SEQ ID NO: 1409320 - DNA, 17 bp, Homo sapiens
ttgtagccaaagaaatt

SEQ ID NO: 1409321 - DNA, 16 bp, Homo sapiens
ttgtatatatatgtga

SEQ ID NO: 1409322 - DNA, 17 bp, Homo sapiens
ttgtatatatatgtgaa

SEQ ID NO: 1409323 - DNA, 20 bp, Homo sapiens
ttgtatgttaatagaaaata

SEQ ID NO: 1409324 - DNA, 14 bp, Homo sapiens
ttgtgatgcatttt

SEQ ID NO: 1409325 - DNA, 14 bp, Homo sapiens
ttgttatacattta

SEQ ID NO: 1409326 - DNA, 20 bp, Homo sapiens
tttaaaaatcagaaagacat

SEQ ID NO: 1409327 - DNA, 12 bp, Homo sapiens
tttaacactgag

SEQ ID NO: 1409328 - DNA, 21 bp, Homo sapiens
tttaattgaaagggacaagta

SEQ ID NO: 1409329 - DNA, 16 bp, Homo sapiens
tttacacattgacaat

SEQ ID NO: 1409330 - DNA, 14 bp, Homo sapiens
tttataatgtcaaa

SEQ ID NO: 1409331 - DNA, 18 bp, Homo sapiens
tttatacctgtacacaca

SEQ ID NO: 1409332 - DNA, 22 bp, Homo sapiens
tttatactttgctgttgaagaa

SEQ ID NO: 1409333 - DNA, 20 bp, Homo sapiens
tttatctaaggtccccagca

SEQ ID NO: 1409334 - DNA, 24 bp, Homo sapiens
tttatctaaggtccccagcagaat

SEQ ID NO: 1409335 - DNA, 16 bp, Homo sapiens
tttatttctgtatctg

SEQ ID NO: 1409336 - DNA, 15 bp, Homo sapiens
tttcaaaaacatgct

SEQ ID NO: 1409337 - DNA, 12 bp, Homo sapiens
tttcaattatac

SEQ ID NO: 1409338 - DNA, 22 bp, Homo sapiens
tttcagttttaaaaatgaagat

SEQ ID NO: 1409339 - DNA, 23 bp, Homo sapiens
tttctgggatgcaatactaggaa

SEQ ID NO: 1409340 - DNA, 13 bp, Homo sapiens
tttcttgctccct

SEQ ID NO: 1409341 - DNA, 18 bp, Homo sapiens
tttcttgctccctgactg

SEQ ID NO: 1409342 - DNA, 19 bp, Homo sapiens
tttctttgccatctctgct

SEQ ID NO: 1409343 - DNA, 15 bp, Homo sapiens
tttgccatctctgct

SEQ ID NO: 1409344 - DNA, 21 bp, Homo sapiens
tttgctcaatacctggcctca

SEQ ID NO: 1409345 - DNA, 21 bp, Homo sapiens
tttggccagtgacatttcaat

SEQ ID NO: 1409346 - DNA, 17 bp, Homo sapiens
tttgtagcctaaagacc

SEQ ID NO: 1409347 - DNA, 16 bp, Homo sapiens
tttgtgatgcatttta

SEQ ID NO: 1409348 - DNA, 14 bp, Homo sapiens
ttttaaaaatgaag

SEQ ID NO: 1409349 - DNA, 17 bp, Homo sapiens
ttttgcagctatggaca

SEQ ID NO: 1409350 - DNA, 13 bp, Homo sapiens
ttttgccagccca

SEQ ID NO: 1409351 - DNA, 17 bp, Homo sapiens
ttttggcaaagccagaa

SEQ ID NO: 1409352 - DNA, 15 bp, Homo sapiens
tttttatacctgtac

SEQ ID NO: 1409353 - DNA, 23 bp, Homo sapiens
tttttatacctgtacacacacag

SEQ ID NO: 1409354 - DNA, 15 bp, Homo sapiens
tttttcaaagacttc

SEQ ID NO: 1409355 - DNA, 23 bp, Homo sapiens
cttcccgccgcccagcccacccc

SEQ ID NO: 1409356 - DNA, 22 bp, Homo sapiens
cttcctaccacccggtccccac

SEQ ID NO: 1409357 - DNA, 18 bp, Homo sapiens
cttcctgggcacacgctg

SEQ ID NO: 1409358 - DNA, 14 bp, Homo sapiens
cttcgggaccagga

SEQ ID NO: 1409359 - DNA, 19 bp, Homo sapiens
cttcggtacccaccacaca

SEQ ID NO: 1409360 - DNA, 14 bp, Homo sapiens
cttctggaaactgt

SEQ ID NO: 1409361 - DNA, 18 bp, Homo sapiens
cttgatttttcaaagact

SEQ ID NO: 1409362 - DNA, 13 bp, Homo sapiens
cttgctgcctcgg

SEQ ID NO: 1409363 - DNA, 11 bp, Homo sapiens
cttggactcat

SEQ ID NO: 1409364 - DNA, 17 bp, Homo sapiens
cttgggatccaggcccc

SEQ ID NO: 1409365 - DNA, 23 bp, Homo sapiens
cttgggcagatctcccacatgcc

SEQ ID NO: 1409366 - DNA, 16 bp, Homo sapiens
cttgtagtcttggcta

SEQ ID NO: 1409367 - DNA, 22 bp, Homo sapiens
cttgttagaagaggtggcccca

SEQ ID NO: 1409368 - DNA, 19 bp, Homo sapiens
ctttattgccaaaacccag

SEQ ID NO: 1409369 - DNA, 21 bp, Homo sapiens
ctttattgccaaaacccagct

SEQ ID NO: 1409370 - DNA, 14 bp, Homo sapiens
ctttctcagcatat

SEQ ID NO: 1409371 - DNA, 19 bp, Homo sapiens
ctttctcagcatatatata

SEQ ID NO: 1409372 - DNA, 15 bp, Homo sapiens
ctttctgttatctag

SEQ ID NO: 1409373 - DNA, 14 bp, Homo sapiens
ctttcttgctccct

SEQ ID NO: 1409374 - DNA, 19 bp, Homo sapiens
ctttcttgctccctgactg

SEQ ID NO: 1409375 - DNA, 15 bp, Homo sapiens
ctttgagactgttcc

SEQ ID NO: 1409376 - DNA, 12 bp, Homo sapiens
ctttgccatctc

SEQ ID NO: 1409377 - DNA, 19 bp, Homo sapiens
ctttgccatctctgctcca

SEQ ID NO: 1409378 - DNA, 22 bp, Homo sapiens
cttttttaattgaaagggacaa

SEQ ID NO: 1409379 - DNA, 12 bp, Homo sapiens
gaaaacacagat

SEQ ID NO: 1409380 - DNA, 14 bp, Homo sapiens
gaaaacacagatgt

SEQ ID NO: 1409381 - DNA, 10 bp, Homo sapiens
gaaaagagaa

SEQ ID NO: 1409382 - DNA, 13 bp, Homo sapiens
gaaaagcgcagag

SEQ ID NO: 1409383 - DNA, 14 bp, Homo sapiens
gaaactactaatct

SEQ ID NO: 1409384 - DNA, 11 bp, Homo sapiens
gaaagggacaa

SEQ ID NO: 1409385 - DNA, 12 bp, Homo sapiens
gaacagagctag

SEQ ID NO: 1409386 - DNA, 17 bp, Homo sapiens
gaactcggtgtccccac

SEQ ID NO: 1409387 - DNA, 14 bp, Homo sapiens
gaagacaaatacac

SEQ ID NO: 1409388 - DNA, 16 bp, Homo sapiens
gaagatggatgtaatt

SEQ ID NO: 1409389 - DNA, 20 bp, Homo sapiens
gaagcacatgcacctaccca

SEQ ID NO: 1409390 - DNA, 14 bp, Homo sapiens
gaagctaaaacact

SEQ ID NO: 1409391 - DNA, 18 bp, Homo sapiens
gaagcttaaaataaagtt

SEQ ID NO: 1409392 - DNA, 20 bp, Homo sapiens
gaaggactgcagccactgat

SEQ ID NO: 1409393 - DNA, 18 bp, Homo sapiens
gaagtaggggtggcccga

SEQ ID NO: 1409394 - DNA, 17 bp, Homo sapiens
gaatcatctcctttgca

SEQ ID NO: 1409395 - DNA, 20 bp, Homo sapiens
gaatgagggcgtgaaacaca

SEQ ID NO: 1409396 - DNA, 13 bp, Homo sapiens
gaattccagtccc

SEQ ID NO: 1409397 - DNA, 15 bp, Homo sapiens
gacaaatacacatac

SEQ ID NO: 1409398 - DNA, 21 bp, Homo sapiens
gacacacaagcagacacacac

SEQ ID NO: 1409399 - DNA, 22 bp, Homo sapiens
gacaggagatgctgtgcccctg

SEQ ID NO: 1409400 - DNA, 19 bp, Homo sapiens
gacagttgaacagagctag

SEQ ID NO: 1409401 - DNA, 12 bp, Homo sapiens
gacatggtgggg

SEQ ID NO: 1409402 - DNA, 21 bp, Homo sapiens
gacatttcaatcactgaaaat

SEQ ID NO: 1409403 - DNA, 16 bp, Homo sapiens
gacccaaccacagagg

SEQ ID NO: 1409404 - DNA, 20 bp, Homo sapiens
gacccagggaacagccactc

SEQ ID NO: 1409405 - DNA, 17 bp, Homo sapiens
gactagccagccaggaa

SEQ ID NO: 1409406 - DNA, 23 bp, Homo sapiens
gactcagccttgcaaatagccag

SEQ ID NO: 1409407 - DNA, 22 bp, Homo sapiens
gactcatgaggaggggcccccc

SEQ ID NO: 1409408 - DNA, 14 bp, Homo sapiens
gactgcagagggct

SEQ ID NO: 1409409 - DNA, 20 bp, Homo sapiens
gactgcagccactgattctc

SEQ ID NO: 1409410 - DNA, 16 bp, Homo sapiens
gactgggaacagaact

SEQ ID NO: 1409411 - DNA, 19 bp, Homo sapiens
gactgtgattcttagcaaa

SEQ ID NO: 1409412 - DNA, 17 bp, Homo sapiens
gacttaggtgtgaagac

SEQ ID NO: 1409413 - DNA, 19 bp, Homo sapiens
gacttcatttaacactgag

SEQ ID NO: 1409414 - DNA, 22 bp, Homo sapiens
gacttcatttaacactgagtga

SEQ ID NO: 1409415 - DNA, 14 bp, Homo sapiens
gagaacttgctgcc

SEQ ID NO: 1409416 - DNA, 14 bp, Homo sapiens
gagaatatttttcc

SEQ ID NO: 1409417 - DNA, 23 bp, Homo sapiens
gagaatgagggcgtgaaacacaa

SEQ ID NO: 1409418 - DNA, 20 bp, Homo sapiens
gagagcccagagtcccccca

SEQ ID NO: 1409419 - DNA, 14 bp, Homo sapiens
gagatgctgtgccc

SEQ ID NO: 1409420 - DNA, 15 bp, Homo sapiens
gagatgctgtgcccc

SEQ ID NO: 1409421 - DNA, 17 bp, Homo sapiens
gagcacaacataatttt

SEQ ID NO: 1409422 - DNA, 18 bp, Homo sapiens
gagctccatacacacgct

SEQ ID NO: 1409423 - DNA, 20 bp, Homo sapiens
gagctccatacacacgctgc

SEQ ID NO: 1409424 - DNA, 22 bp, Homo sapiens
gagctccatacacacgctgcct

SEQ ID NO: 1409425 - DNA, 16 bp, Homo sapiens
gagctggtggacccag

SEQ ID NO: 1409426 - DNA, 23 bp, Homo sapiens
gagctggtggacccagggaacag

SEQ ID NO: 1409427 - DNA, 22 bp, Homo sapiens
gaggaggggcccccctgccctg

SEQ ID NO: 1409428 - DNA, 18 bp, Homo sapiens
gaggatgctgacatcatt

SEQ ID NO: 1409429 - DNA, 19 bp, Homo sapiens
gaggatgctgacatcattt

SEQ ID NO: 1409430 - DNA, 22 bp, Homo sapiens
gaggatgctgacatcatttgta

SEQ ID NO: 1409431 - DNA, 18 bp, Homo sapiens
gaggatgtatgtgtatat

SEQ ID NO: 1409432 - DNA, 12 bp, Homo sapiens
gaggccatctgg

SEQ ID NO: 1409433 - DNA, 14 bp, Homo sapiens
gaggccatctggag

SEQ ID NO: 1409434 - DNA, 16 bp, Homo sapiens
gaggggcgcgggaggg

SEQ ID NO: 1409435 - DNA, 20 bp, Homo sapiens
gagtaacagtcatcatttat

SEQ ID NO: 1409436 - DNA, 22 bp, Homo sapiens
gagtcagtgcccatgtgtatgg

SEQ ID NO: 1409437 - DNA, 22 bp, Homo sapiens
gagtccccccactcccagcatc

SEQ ID NO: 1409438 - DNA, 13 bp, Homo sapiens
gataagaaagcag

SEQ ID NO: 1409439 - DNA, 22 bp, Homo sapiens
gatatgtctagggtgtgattta

SEQ ID NO: 1409440 - DNA, 18 bp, Homo sapiens
gatcggctttcatgtaat

SEQ ID NO: 1409441 - DNA, 18 bp, Homo sapiens
gatgcaatactaggaagt

SEQ ID NO: 1409442 - DNA, 20 bp, Homo sapiens
gatgcatattaaagaaagtc

SEQ ID NO: 1409443 - DNA, 14 bp, Homo sapiens
gatgtatgtgtata

SEQ ID NO: 1409444 - DNA, 19 bp, Homo sapiens
gattccccactcagccttt

SEQ ID NO: 1409445 - DNA, 23 bp, Homo sapiens
gatttaaagtgccttatcaaata

SEQ ID NO: 1409446 - DNA, 20 bp, Homo sapiens
gatttgggctctagaattcc

SEQ ID NO: 1409447 - DNA, 17 bp, Homo sapiens
gatttttcaaagacttc

SEQ ID NO: 1409448 - DNA, 16 bp, Homo sapiens
gcaaagccagaaaaag

SEQ ID NO: 1409449 - DNA, 14 bp, Homo sapiens
gcaaaggagggcaa

SEQ ID NO: 1409450 - DNA, 17 bp, Homo sapiens
gcaaatgcctgccaaat

SEQ ID NO: 1409451 - DNA, 22 bp, Homo sapiens
gcaacctgacagcaaacacagt

SEQ ID NO: 1409452 - DNA, 13 bp, Homo sapiens
gcaataaatatta

SEQ ID NO: 1409453 - DNA, 16 bp, Homo sapiens
gcaattgtatatatat

SEQ ID NO: 1409454 - DNA, 22 bp, Homo sapiens
gcaattgtatatatatgtgaac

SEQ ID NO: 1409455 - DNA, 19 bp, Homo sapiens
gcacacctcctcccactgc

SEQ ID NO: 1409456 - DNA, 13 bp, Homo sapiens
gcacacgctgctc

SEQ ID NO: 1409457 - DNA, 21 bp, Homo sapiens
gcacacgctgctctgccccag

SEQ ID NO: 1409458 - DNA, 14 bp, Homo sapiens
gcacatccaactac

SEQ ID NO: 1409459 - DNA, 15 bp, Homo sapiens
gcaccccttcctggg

SEQ ID NO: 1409460 - DNA, 22 bp, Homo sapiens
gccagcccatttgggcagagag

SEQ ID NO: 1409461 - DNA, 17 bp, Homo sapiens
gccagcctggctgggac

SEQ ID NO: 1409462 - DNA, 14 bp, Homo sapiens
gccatctctgctcc

SEQ ID NO: 1409463 - DNA, 20 bp, Homo sapiens
gccatctggagagcccagag

SEQ ID NO: 1409464 - DNA, 16 bp, Homo sapiens
gcccaccccatggccg

SEQ ID NO: 1409465 - DNA, 19 bp, Homo sapiens
gcccacctgtgggccagcc

SEQ ID NO: 1409466 - DNA, 15 bp, Homo sapiens
gcccatttgggcaga

SEQ ID NO: 1409467 - DNA, 14 bp, Homo sapiens
gcccccctgccctg

SEQ ID NO: 1409468 - DNA, 15 bp, Homo sapiens
gcccccctgccctgt

SEQ ID NO: 1409469 - DNA, 20 bp, Homo sapiens
gcccctccctctccagcagg

SEQ ID NO: 1409470 - DNA, 19 bp, Homo sapiens
gccctggtgctgtaccccc

SEQ ID NO: 1409471 - DNA, 15 bp, Homo sapiens
gccgattcctccagc

SEQ ID NO: 1409472 - DNA, 13 bp, Homo sapiens
gccgggggagggg

SEQ ID NO: 1409473 - DNA, 23 bp, Homo sapiens
gccgggggaggggcgcgggaggg

SEQ ID NO: 1409474 - DNA, 19 bp, Homo sapiens
gcctccgtcactacctggc

SEQ ID NO: 1409475 - DNA, 18 bp, Homo sapiens
gccttcggtacccaccac

SEQ ID NO: 1409476 - DNA, 19 bp, Homo sapiens
gccttcggtacccaccaca

SEQ ID NO: 1409477 - DNA, 19 bp, Homo sapiens
gccttgcaaatagccagtg

SEQ ID NO: 1409478 - DNA, 11 bp, Homo sapiens
gcgaacacagt

SEQ ID NO: 1409479 - DNA, 12 bp, Homo sapiens
gcgaacacagtg

SEQ ID NO: 1409480 - DNA, 15 bp, Homo sapiens
gcgcgggagggggcg

SEQ ID NO: 1409481 - DNA, 19 bp, Homo sapiens
gcgggcacacctcctccca

SEQ ID NO: 1409482 - DNA, 13 bp, Homo sapiens
gctagaggccatg

SEQ ID NO: 1409483 - DNA, 19 bp, Homo sapiens
gctatggacaatttaccac

SEQ ID NO: 1409484 - DNA, 21 bp, Homo sapiens
gctatgtatttgcaaggctga

SEQ ID NO: 1409485 - DNA, 17 bp, Homo sapiens
gctccatacacacgctg

SEQ ID NO: 1409486 - DNA, 15 bp, Homo sapiens
gctcccctgctcggc

SEQ ID NO: 1409487 - DNA, 13 bp, Homo sapiens
gctgacatcattt

SEQ ID NO: 1409488 - DNA, 14 bp, Homo sapiens
gctgacatcatttg

SEQ ID NO: 1409489 - DNA, 16 bp, Homo sapiens
gctgcaccccttcctg

SEQ ID NO: 1409490 - DNA, 19 bp, Homo sapiens
gctgcctcggatccccttc

SEQ ID NO: 1409491 - DNA, 13 bp, Homo sapiens
gctgctctgcccc

SEQ ID NO: 1409492 - DNA, 14 bp, Homo sapiens
gctgctctgcccca

SEQ ID NO: 1409493 - DNA, 17 bp, Homo sapiens
gctgctctgccccagct

SEQ ID NO: 1409494 - DNA, 14 bp, Homo sapiens
gctggaagagtccc

SEQ ID NO: 1409495 - DNA, 16 bp, Homo sapiens
gctggtggacccaggg

SEQ ID NO: 1409496 - DNA, 15 bp, Homo sapiens
gctttcaggagctcc

SEQ ID NO: 1409497 - DNA, 20 bp, Homo sapiens
gcttttccaaacccaggcta

SEQ ID NO: 1409498 - DNA, 15 bp, Homo sapiens
gcttttccctgtcct

SEQ ID NO: 1409499 - DNA, 15 bp, Homo sapiens
ggaaatgagaacaat

SEQ ID NO: 1409500 - DNA, 17 bp, Homo sapiens
ggaagacaaatacacat

SEQ ID NO: 1409501 - DNA, 23 bp, Homo sapiens
ggaagacaaatacacatacatat

SEQ ID NO: 1409502 - DNA, 17 bp, Homo sapiens
ggacaatttaccacagg

SEQ ID NO: 1409503 - DNA, 15 bp, Homo sapiens
ggagatcccacatat

SEQ ID NO: 1409504 - DNA, 18 bp, Homo sapiens
ggagatcccacatatttc

SEQ ID NO: 1409505 - DNA, 15 bp, Homo sapiens
ggagatgctgtgccc

SEQ ID NO: 1409506 - DNA, 19 bp, Homo sapiens
ggagatttgctcaatacct

SEQ ID NO: 1409507 - DNA, 21 bp, Homo sapiens
ggagccgggcaaactggccgc

SEQ ID NO: 1409508 - DNA, 17 bp, Homo sapiens
ggaggccatctggagag

SEQ ID NO: 1409509 - DNA, 12 bp, Homo sapiens
ggatccaggccc

SEQ ID NO: 1409510 - DNA, 19 bp, Homo sapiens
ggatccaggcccctccctc

SEQ ID NO: 1409511 - DNA, 13 bp, Homo sapiens
ggatccccttcct

SEQ ID NO: 1409512 - DNA, 22 bp, Homo sapiens
ggcaacctgacagcaaacacag

SEQ ID NO: 1409513 - DNA, 20 bp, Homo sapiens
ggcacacctcctcccactgc

SEQ ID NO: 1409514 - DNA, 22 bp, Homo sapiens
ggcacacctcctcccactgccc

SEQ ID NO: 1409515 - DNA, 17 bp, Homo sapiens
ggcaccagtccctgtcc

SEQ ID NO: 1409516 - DNA, 14 bp, Homo sapiens
ggcaccgccagccg

SEQ ID NO: 1409517 - DNA, 16 bp, Homo sapiens
ggcagagaggctgtgg

SEQ ID NO: 1409518 - DNA, 19 bp, Homo sapiens
ggcagggaaaacacagatg

SEQ ID NO: 1409519 - DNA, 19 bp, Homo sapiens
ggccagccgattcctccag

SEQ ID NO: 1409520 - DNA, 21 bp, Homo sapiens
ggccagccgattcctccagcc

SEQ ID NO: 1409521 - DNA, 14 bp, Homo sapiens
ggccatctggagag

SEQ ID NO: 1409522 - DNA, 16 bp, Homo sapiens
ggccatgtctcctgca

SEQ ID NO: 1409523 - DNA, 19 bp, Homo sapiens
ggccggctttcaggagctc

SEQ ID NO: 1409524 - DNA, 21 bp, Homo sapiens
ggcctccgtcactacctggct

SEQ ID NO: 1409525 - DNA, 20 bp, Homo sapiens
ggcgggcacacctcctccca

SEQ ID NO: 1409526 - DNA, 16 bp, Homo sapiens
ggctacatctccaaat

SEQ ID NO: 1409527 - DNA, 17 bp, Homo sapiens
ggctgcggggcgggcac

SEQ ID NO: 1409528 - DNA, 16 bp, Homo sapiens
ggctggagttggggca

SEQ ID NO: 1409529 - DNA, 22 bp, Homo sapiens
ggctggagttggggcagaggag

SEQ ID NO: 1409530 - DNA, 15 bp, Homo sapiens
ggcttaacttagtat

SEQ ID NO: 1409531 - DNA, 21 bp, Homo sapiens
gggaaactgagggcagagagg

SEQ ID NO: 1409532 - DNA, 13 bp, Homo sapiens
gggaacagccact

SEQ ID NO: 1409533 - DNA, 19 bp, Homo sapiens
gggaggccatctggagagc

SEQ ID NO: 1409534 - DNA, 19 bp, Homo sapiens
gggcacacgctgctctgcc

SEQ ID NO: 1409535 - DNA, 23 bp, Homo sapiens
gggcacacgctgctctgccccag

SEQ ID NO: 1409536 - DNA, 20 bp, Homo sapiens
gggcagatcttggactcatg

SEQ ID NO: 1409537 - DNA, 20 bp, Homo sapiens
gggccagccgattcctccag

SEQ ID NO: 1409538 - DNA, 21 bp, Homo sapiens
gggccagccgattcctccagc

SEQ ID NO: 1409539 - DNA, 15 bp, Homo sapiens
ggggcccccctgccc

SEQ ID NO: 1409540 - DNA, 19 bp, Homo sapiens
gggggccgggggaggggcg

SEQ ID NO: 1409541 - DNA, 22 bp, Homo sapiens
ggggtggcccgaaagggtctcc

SEQ ID NO: 1409542 - DNA, 16 bp, Homo sapiens
gggtgctgttttgcca

SEQ ID NO: 1409543 - DNA, 19 bp, Homo sapiens
ggtcaggttctaccctcca

SEQ ID NO: 1409544 - DNA, 14 bp, Homo sapiens
ggtccccagcagaa

SEQ ID NO: 1409545 - DNA, 17 bp, Homo sapiens
ggtctccgaaatgctgt

SEQ ID NO: 1409546 - DNA, 19 bp, Homo sapiens
ggtctccgaaatgctgtct

SEQ ID NO: 1409547 - DNA, 12 bp, Homo sapiens
ggtctcctcagg

SEQ ID NO: 1409548 - DNA, 15 bp, Homo sapiens
ggtctcctcaggacc

SEQ ID NO: 1409549 - DNA, 14 bp, Homo sapiens
gtaaagtgaagaat

SEQ ID NO: 1409550 - DNA, 17 bp, Homo sapiens
gtaacagtcatcattta

SEQ ID NO: 1409551 - DNA, 19 bp, Homo sapiens
gtaatctcacagcatttgc

SEQ ID NO: 1409552 - DNA, 14 bp, Homo sapiens
gtacacacacagac

SEQ ID NO: 1409553 - DNA, 15 bp, Homo sapiens
gtacacacacagaca

SEQ ID NO: 1409554 - DNA, 20 bp, Homo sapiens
gtacacacacagacacacaa

SEQ ID NO: 1409555 - DNA, 13 bp, Homo sapiens
gtatatatatgtg

SEQ ID NO: 1409556 - DNA, 20 bp, Homo sapiens
gtatatgaggatgtatgtgt

SEQ ID NO: 1409557 - DNA, 23 bp, Homo sapiens
gtatatgaggatgtatgtgtata

SEQ ID NO: 1409558 - DNA, 15 bp, Homo sapiens
gtatatgtttataca

SEQ ID NO: 1409559 - DNA, 16 bp, Homo sapiens
gtatatgtttatacac

SEQ ID NO: 1409560 - DNA, 22 bp, Homo sapiens
gtatctgacatatttcataagc

SEQ ID NO: 1409561 - DNA, 11 bp, Homo sapiens
gtatgtgtata

SEQ ID NO: 1409562 - DNA, 23 bp, Homo sapiens
gtatgtgtatatgtttatacaca

SEQ ID NO: 1409563 - DNA, 14 bp, Homo sapiens
gtattatcataagt

SEQ ID NO: 1409564 - DNA, 19 bp, Homo sapiens
gtcaacccttctggaaact

SEQ ID NO: 1409565 - DNA, 17 bp, Homo sapiens
gtcactacctggctgcg

SEQ ID NO: 1409566 - DNA, 19 bp, Homo sapiens
gtcagtgcccatgtgtatg

SEQ ID NO: 1409567 - DNA, 17 bp, Homo sapiens
gtcatgtgcgaacacag

SEQ ID NO: 1409568 - DNA, 13 bp, Homo sapiens
gtccccaccatct

SEQ ID NO: 1409569 - DNA, 15 bp, Homo sapiens
gtccccaccatctgc

SEQ ID NO: 1409570 - DNA, 20 bp, Homo sapiens
gtccccaccatctgctgtct

SEQ ID NO: 1409571 - DNA, 20 bp, Homo sapiens
gtcctgacaccaggcaagaa

SEQ ID NO: 1409572 - DNA, 18 bp, Homo sapiens
gtctatataaccacattt

SEQ ID NO: 1409573 - DNA, 14 bp, Homo sapiens
gtctcctcaggacc

SEQ ID NO: 1409574 - DNA, 13 bp, Homo sapiens
gtcttgtattatc

SEQ ID NO: 1409575 - DNA, 18 bp, Homo sapiens
gtcttgtattatcataag

SEQ ID NO: 1409576 - DNA, 15 bp, Homo sapiens
gtcttttctttgcca

SEQ ID NO: 1409577 - DNA, 19 bp, Homo sapiens
gtcttttctttgccatctc

SEQ ID NO: 1409578 - DNA, 15 bp, Homo sapiens
gtgaaacacaatatc

SEQ ID NO: 1409579 - DNA, 14 bp, Homo sapiens
gtgatgcattttat

SEQ ID NO: 1409580 - DNA, 14 bp, Homo sapiens
gtgattatatttca

SEQ ID NO: 1409581 - DNA, 17 bp, Homo sapiens
gtgcccatgtgtatgga

SEQ ID NO: 1409582 - DNA, 20 bp, Homo sapiens
gtggccccatattaacaaat

SEQ ID NO: 1409583 - DNA, 22 bp, Homo sapiens
gtgggccagccgattcctccag

SEQ ID NO: 1409584 - DNA, 22 bp, Homo sapiens
gtgtatatgaggatgtatgtgt

SEQ ID NO: 1409585 - DNA, 18 bp, Homo sapiens
gtgtatatgtttatacac

SEQ ID NO: 1409586 - DNA, 20 bp, Homo sapiens
gtgtccccaccatctgctgt

SEQ ID NO: 1409587 - DNA, 13 bp, Homo sapiens
aagaaaagagaaa

SEQ ID NO: 1409588 - DNA, 14 bp, Homo sapiens
aagaaaatttaatt

SEQ ID NO: 1409589 - DNA, 22 bp, Homo sapiens
aagaatcatcctcatgccttta

SEQ ID NO: 1409590 - DNA, 13 bp, Homo sapiens
aagacaaatacac

SEQ ID NO: 1409591 - DNA, 15 bp, Homo sapiens
aagacaaatacacat

SEQ ID NO: 1409592 - DNA, 13 bp, Homo sapiens
aagaccatttaat

SEQ ID NO: 1409593 - DNA, 19 bp, Homo sapiens
aagacttcatttaacactg

SEQ ID NO: 1409594 - DNA, 20 bp, Homo sapiens
aagacttcatttaacactga

SEQ ID NO: 1409595 - DNA, 14 bp, Homo sapiens
aagagtgctaagca

SEQ ID NO: 1409596 - DNA, 12 bp, Homo sapiens
aagatacaaata

SEQ ID NO: 1409597 - DNA, 21 bp, Homo sapiens
aagatcggctttcatgtaatt

SEQ ID NO: 1409598 - DNA, 20 bp, Homo sapiens
aagattgaagctaaaacact

SEQ ID NO: 1409599 - DNA, 23 bp, Homo sapiens
aagatttaaagtgccttatcaaa

SEQ ID NO: 1409600 - DNA, 17 bp, Homo sapiens
agttttgtgatgcattt

SEQ ID NO: 1409601 - DNA, 18 bp, Homo sapiens
agttttgtgatgcatttt

SEQ ID NO: 1409602 - DNA, 19 bp, Homo sapiens
ataaaatacacgtgtatat

SEQ ID NO: 1409603 - DNA, 16 bp, Homo sapiens
ataaatttgcttttat

SEQ ID NO: 1409604 - DNA, 13 bp, Homo sapiens
ataacattgtatg

SEQ ID NO: 1409605 - DNA, 18 bp, Homo sapiens
ataacattgtatgttaat

SEQ ID NO: 1409606 - DNA, 16 bp, Homo sapiens
ataaccacatttctaa

SEQ ID NO: 1409607 - DNA, 12 bp, Homo sapiens
ataactgaggag

SEQ ID NO: 1409608 - DNA, 22 bp, Homo sapiens
ataagtatactgggggcaaaat

SEQ ID NO: 1409609 - DNA, 18 bp, Homo sapiens
ataatagcacatgatttg

SEQ ID NO: 1409610 - DNA, 15 bp, Homo sapiens
ataatatgcatatat

SEQ ID NO: 1409611 - DNA, 16 bp, Homo sapiens
ataatattcatgaaga

SEQ ID NO: 1409612 - DNA, 16 bp, Homo sapiens
ataatgtagttttgtg

SEQ ID NO: 1409613 - DNA, 16 bp, Homo sapiens
ataatgtcaaatgaaa

SEQ ID NO: 1409614 - DNA, 11 bp, Homo sapiens
atacacacgct

SEQ ID NO: 1409615 - DNA, 14 bp, Homo sapiens
atacacacgctgcc

SEQ ID NO: 1409616 - DNA, 15 bp, Homo sapiens
atacacacgctgcct

SEQ ID NO: 1409617 - DNA, 22 bp, Homo sapiens
atacaccccctcttctgagcac

SEQ ID NO: 1409618 - DNA, 23 bp, Homo sapiens
atacaccccctcttctgagcaca

SEQ ID NO: 1409619 - DNA, 16 bp, Homo sapiens
atacatatatacattt

SEQ ID NO: 1409620 - DNA, 11 bp, Homo sapiens
atacatttaaa

SEQ ID NO: 1409621 - DNA, 14 bp, Homo sapiens
atacatttaaagat

SEQ ID NO: 1409622 - DNA, 15 bp, Homo sapiens
atacatttaaagatt

SEQ ID NO: 1409623 - DNA, 17 bp, Homo sapiens
atacctggcctcattta

SEQ ID NO: 1409624 - DNA, 16 bp, Homo sapiens
atacctgtacacacac

SEQ ID NO: 1409625 - DNA, 17 bp, Homo sapiens
atacctgtacacacaca

SEQ ID NO: 1409626 - DNA, 19 bp, Homo sapiens
atacctgtacacacacaga

SEQ ID NO: 1409627 - DNA, 15 bp, Homo sapiens
atacgcaattgtata

SEQ ID NO: 1409628 - DNA, 14 bp, Homo sapiens
atacgttttctgca

SEQ ID NO: 1409629 - DNA, 16 bp, Homo sapiens
atactgggggcaaaat

SEQ ID NO: 1409630 - DNA, 20 bp, Homo sapiens
atacttaactttactaagta

SEQ ID NO: 1409631 - DNA, 15 bp, Homo sapiens
atagaagcttaaaat

SEQ ID NO: 1409632 - DNA, 21 bp, Homo sapiens
atagatcccacgttgatgtct

SEQ ID NO: 1409633 - DNA, 15 bp, Homo sapiens
atagcacatgatttg

SEQ ID NO: 1409634 - DNA, 16 bp, Homo sapiens
atagcacatgatttgg

SEQ ID NO: 1409635 - DNA, 21 bp, Homo sapiens
atagcacatgatttgggctct

SEQ ID NO: 1409636 - DNA, 12 bp, Homo sapiens
atagctcttgct

SEQ ID NO: 1409637 - DNA, 13 bp, Homo sapiens
atagctcttgctt

SEQ ID NO: 1409638 - DNA, 15 bp, Homo sapiens
atataaaatacacgt

SEQ ID NO: 1409639 - DNA, 19 bp, Homo sapiens
atataaaatacacgtgtat

SEQ ID NO: 1409640 - DNA, 20 bp, Homo sapiens
atatacatacgcaattgtat

SEQ ID NO: 1409641 - DNA, 14 bp, Homo sapiens
atatatacatacgc

SEQ ID NO: 1409642 - DNA, 16 bp, Homo sapiens
atatatacattttgca

SEQ ID NO: 1409643 - DNA, 16 bp, Homo sapiens
atatatataaaataca

SEQ ID NO: 1409644 - DNA, 14 bp, Homo sapiens
atatatatgtatat

SEQ ID NO: 1409645 - DNA, 14 bp, Homo sapiens
atatatatgtgaac

SEQ ID NO: 1409646 - DNA, 15 bp, Homo sapiens
atatatatgtgaact

SEQ ID NO: 1409647 - DNA, 20 bp, Homo sapiens
atatccaattttaaaatgaa

SEQ ID NO: 1409648 - DNA, 22 bp, Homo sapiens
atatccaattttaaaatgaaat

SEQ ID NO: 1409649 - DNA, 13 bp, Homo sapiens
atatgcatatata

SEQ ID NO: 1409650 - DNA, 14 bp, Homo sapiens
atatggactcagcc

SEQ ID NO: 1409651 - DNA, 21 bp, Homo sapiens
atatggactcagccttgcaaa

SEQ ID NO: 1409652 - DNA, 16 bp, Homo sapiens
atattaaagaaagtca

SEQ ID NO: 1409653 - DNA, 21 bp, Homo sapiens
atattactctgcctgtcaagt

SEQ ID NO: 1409654 - DNA, 17 bp, Homo sapiens
atattcatgaagagttg

SEQ ID NO: 1409655 - DNA, 21 bp, Homo sapiens
atatttgcataatatgcatat

SEQ ID NO: 1409656 - DNA, 20 bp, Homo sapiens
atcagaaagacattcttagt

SEQ ID NO: 1409657 - DNA, 17 bp, Homo sapiens
atcataagttagatgtt

SEQ ID NO: 1409658 - DNA, 15 bp, Homo sapiens
atcatctcctttgca

SEQ ID NO: 1409659 - DNA, 21 bp, Homo sapiens
atcatctcctttgcagaatga

SEQ ID NO: 1409660 - DNA, 18 bp, Homo sapiens
atcattacaatacagtat

SEQ ID NO: 1409661 - DNA, 20 bp, Homo sapiens
atcattacaatacagtattt

SEQ ID NO: 1409662 - DNA, 13 bp, Homo sapiens
atccaagtggcct

SEQ ID NO: 1409663 - DNA, 22 bp, Homo sapiens
atccaattttaaaatgaaatgc

SEQ ID NO: 1409664 - DNA, 20 bp, Homo sapiens
atccaggcccctccctctcc

SEQ ID NO: 1409665 - DNA, 20 bp, Homo sapiens
atctaaggtccccagcagaa

SEQ ID NO: 1409666 - DNA, 14 bp, Homo sapiens
atctacactctcga

SEQ ID NO: 1409667 - DNA, 15 bp, Homo sapiens
atctagtgaccagat

SEQ ID NO: 1409668 - DNA, 23 bp, Homo sapiens
atctcaatttaagatacaaataa

SEQ ID NO: 1409669 - DNA, 22 bp, Homo sapiens
atctcacagcatttgccaagtc

SEQ ID NO: 1409670 - DNA, 14 bp, Homo sapiens
atctcctttgcaga

SEQ ID NO: 1409671 - DNA, 18 bp, Homo sapiens
atctcgtatggatttcta

SEQ ID NO: 1409672 - DNA, 16 bp, Homo sapiens
atctctccaccttcca

SEQ ID NO: 1409673 - DNA, 19 bp, Homo sapiens
atctctccaccttccaaag

SEQ ID NO: 1409674 - DNA, 21 bp, Homo sapiens
atctgctgtcttttctttgcc

SEQ ID NO: 1409675 - DNA, 19 bp, Homo sapiens
atctggagagcccagagtc

SEQ ID NO: 1409676 - DNA, 15 bp, Homo sapiens
atcttcgggaccagg

SEQ ID NO: 1409677 - DNA, 18 bp, Homo sapiens
atcttcgggaccaggatt

SEQ ID NO: 1409678 - DNA, 17 bp, Homo sapiens
atctttgaaaactcata

SEQ ID NO: 1409679 - DNA, 14 bp, Homo sapiens
atgaaatgcatttt

SEQ ID NO: 1409680 - DNA, 17 bp, Homo sapiens
atgaaatgcattttgct

SEQ ID NO: 1409681 - DNA, 19 bp, Homo sapiens
atgaaatgcattttgctag

SEQ ID NO: 1409682 - DNA, 14 bp, Homo sapiens
atgaagagttgttt

SEQ ID NO: 1409683 - DNA, 22 bp, Homo sapiens
atgaagatcggctttcatgtaa

SEQ ID NO: 1409684 - DNA, 16 bp, Homo sapiens
atgagatctttctaaa

SEQ ID NO: 1409685 - DNA, 21 bp, Homo sapiens
atgaggaggggcccccctgcc

SEQ ID NO: 1409686 - DNA, 16 bp, Homo sapiens
atgaggatgtatgtgt

SEQ ID NO: 1409687 - DNA, 17 bp, Homo sapiens
atgagggcgtgaaacac

SEQ ID NO: 1409688 - DNA, 19 bp, Homo sapiens
atgagggcgtgaaacacaa

SEQ ID NO: 1409689 - DNA, 17 bp, Homo sapiens
atgcaataaatattatt

SEQ ID NO: 1409690 - DNA, 21 bp, Homo sapiens
atgcaataaatattatttgat

SEQ ID NO: 1409691 - DNA, 16 bp, Homo sapiens
atgcatatatatgtat

SEQ ID NO: 1409692 - DNA, 16 bp, Homo sapiens
atgcctttatactttg

SEQ ID NO: 1409693 - DNA, 16 bp, Homo sapiens
atgcgatgtcatattt

SEQ ID NO: 1409694 - DNA, 21 bp, Homo sapiens
atgctgtctttcttgctccct

SEQ ID NO: 1409695 - DNA, 14 bp, Homo sapiens
atgcttttccaaac

SEQ ID NO: 1409696 - DNA, 17 bp, Homo sapiens
atggaagacaaatacac

SEQ ID NO: 1409697 - DNA, 19 bp, Homo sapiens
atggaagacaaatacacat

SEQ ID NO: 1409698 - DNA, 17 bp, Homo sapiens
atggactcagccttgca

SEQ ID NO: 1409699 - DNA, 12 bp, Homo sapiens
atgggagccggg

SEQ ID NO: 1409700 - DNA, 23 bp, Homo sapiens
atggtcagaatttccctctgata

SEQ ID NO: 1409701 - DNA, 13 bp, Homo sapiens
atgtaattatcta

SEQ ID NO: 1409702 - DNA, 22 bp, Homo sapiens
atgtagttttgtgatgcatttt

SEQ ID NO: 1409703 - DNA, 18 bp, Homo sapiens
atgtatgtgtatatgttt

SEQ ID NO: 1409704 - DNA, 19 bp, Homo sapiens
atgtgaactttctcagcat

SEQ ID NO: 1409705 - DNA, 20 bp, Homo sapiens
atgtgaactttctcagcata

SEQ ID NO: 1409706 - DNA, 20 bp, Homo sapiens
atgtgtatatgtttatacac

SEQ ID NO: 1409707 - DNA, 18 bp, Homo sapiens
atgttgagacctcagctt

SEQ ID NO: 1409708 - DNA, 13 bp, Homo sapiens
attaacaaattgc

SEQ ID NO: 1409709 - DNA, 14 bp, Homo sapiens
attaacaaattgca

SEQ ID NO: 1409710 - DNA, 22 bp, Homo sapiens
attaagctctcatagctcataa

SEQ ID NO: 1409711 - DNA, 16 bp, Homo sapiens
attagctttaattaag

SEQ ID NO: 1409712 - DNA, 17 bp, Homo sapiens
attatactgaagctagt

SEQ ID NO: 1409713 - DNA, 16 bp, Homo sapiens
attatttgatgatact

SEQ ID NO: 1409714 - DNA, 15 bp, Homo sapiens
attcctccagccctg

SEQ ID NO: 1409715 - DNA, 18 bp, Homo sapiens
attcctccagccctggtg

SEQ ID NO: 1409716 - DNA, 16 bp, Homo sapiens
attctaacgcaaaaat

SEQ ID NO: 1409717 - DNA, 18 bp, Homo sapiens
attctctcttgtccttca

SEQ ID NO: 1409718 - DNA, 17 bp, Homo sapiens
attcttataacattgta

SEQ ID NO: 1409719 - DNA, 21 bp, Homo sapiens
attcttataacattgtatgtt

SEQ ID NO: 1409720 - DNA, 16 bp, Homo sapiens
attgacaatgacaaaa

SEQ ID NO: 1409721 - DNA, 16 bp, Homo sapiens
attgccaaaacccagc

SEQ ID NO: 1409722 - DNA, 17 bp, Homo sapiens
attgccaaaacccagct

SEQ ID NO: 1409723 - DNA, 14 bp, Homo sapiens
attggaaaatttaa

SEQ ID NO: 1409724 - DNA, 20 bp, Homo sapiens
cagcctggctgggactggga

SEQ ID NO: 1409725 - DNA, 21 bp, Homo sapiens
cagccttgcaaatagccagtg

SEQ ID NO: 1409726 - DNA, 20 bp, Homo sapiens
cagctgcaccccttcctggg

SEQ ID NO: 1409727 - DNA, 23 bp, Homo sapiens
cagctgcaccccttcctgggcac

SEQ ID NO: 1409728 - DNA, 19 bp, Homo sapiens
caggaccagggttggcacc

SEQ ID NO: 1409729 - DNA, 16 bp, Homo sapiens
caggagatgctgtgcc

SEQ ID NO: 1409730 - DNA, 13 bp, Homo sapiens
caggcaagaaaag

SEQ ID NO: 1409731 - DNA, 22 bp, Homo sapiens
caggcaagaaaagcgcagagaa

SEQ ID NO: 1409732 - DNA, 16 bp, Homo sapiens
caggcaccagtccctg

SEQ ID NO: 1409733 - DNA, 22 bp, Homo sapiens
caggcccatgggaggctggagt

SEQ ID NO: 1409734 - DNA, 17 bp, Homo sapiens
caggggaggccatctgg

SEQ ID NO: 1409735 - DNA, 14 bp, Homo sapiens
caggtcccctttca

SEQ ID NO: 1409736 - DNA, 12 bp, Homo sapiens
cagtagactgtg

SEQ ID NO: 1409737 - DNA, 20 bp, Homo sapiens
cagtatttctttgttataca

SEQ ID NO: 1409738 - DNA, 13 bp, Homo sapiens
cagtcccctttct

SEQ ID NO: 1409739 - DNA, 14 bp, Homo sapiens
cagtcccctttctc

SEQ ID NO: 1409740 - DNA, 23 bp, Homo sapiens
cagtggccttgagcttcaaaatg

SEQ ID NO: 1409741 - DNA, 15 bp, Homo sapiens
cagtgtgtagtttgt

SEQ ID NO: 1409742 - DNA, 21 bp, Homo sapiens
cagttaaactggcttaactta

SEQ ID NO: 1409743 - DNA, 18 bp, Homo sapiens
cagttattgggcttaaaa

SEQ ID NO: 1409744 - DNA, 15 bp, Homo sapiens
cagttttaaaaatga

SEQ ID NO: 1409745 - DNA, 18 bp, Homo sapiens
cataatatgcatatatat

SEQ ID NO: 1409746 - DNA, 19 bp, Homo sapiens
cataatatgcatatatatg

SEQ ID NO: 1409747 - DNA, 18 bp, Homo sapiens
catacgcaattgtatata

SEQ ID NO: 1409748 - DNA, 13 bp, Homo sapiens
catacttaacttt

SEQ ID NO: 1409749 - DNA, 20 bp, Homo sapiens
catagatagatcccacgttg

SEQ ID NO: 1409750 - DNA, 17 bp, Homo sapiens
catagcttttccctgtc

SEQ ID NO: 1409751 - DNA, 13 bp, Homo sapiens
catatatacattt

SEQ ID NO: 1409752 - DNA, 21 bp, Homo sapiens
catatatataaaatacacgtg

SEQ ID NO: 1409753 - DNA, 18 bp, Homo sapiens
catattaaagaaagtcat

SEQ ID NO: 1409754 - DNA, 18 bp, Homo sapiens
catattaacaaattgcat

SEQ ID NO: 1409755 - DNA, 21 bp, Homo sapiens
catattaacaaattgcatttg

SEQ ID NO: 1409756 - DNA, 14 bp, Homo sapiens
catcatacttaact

SEQ ID NO: 1409757 - DNA, 18 bp, Homo sapiens
catcattacaatacagta

SEQ ID NO: 1409758 - DNA, 21 bp, Homo sapiens
catcatttatcatcacaaatg

SEQ ID NO: 1409759 - DNA, 14 bp, Homo sapiens
catccaagtggcct

SEQ ID NO: 1409760 - DNA, 16 bp, Homo sapiens
catctaaatattatgc

SEQ ID NO: 1409761 - DNA, 21 bp, Homo sapiens
catctcgctccctcccaggac

SEQ ID NO: 1409762 - DNA, 12 bp, Homo sapiens
catctctgctcc

SEQ ID NO: 1409763 - DNA, 13 bp, Homo sapiens
catctctgctcca

SEQ ID NO: 1409764 - DNA, 14 bp, Homo sapiens
catcttcgggacca

SEQ ID NO: 1409765 - DNA, 16 bp, Homo sapiens
catgacccgtacacac

SEQ ID NO: 1409766 - DNA, 22 bp, Homo sapiens
catgaggaggggcccccctgcc

SEQ ID NO: 1409767 - DNA, 20 bp, Homo sapiens
catggccggctttcaggagc

SEQ ID NO: 1409768 - DNA, 22 bp, Homo sapiens
catggccggctttcaggagctc

SEQ ID NO: 1409769 - DNA, 15 bp, Homo sapiens
catggtggggtctcc

SEQ ID NO: 1409770 - DNA, 18 bp, Homo sapiens
catggtggggtctcctca

SEQ ID NO: 1409771 - DNA, 20 bp, Homo sapiens
catgtaattatctagtagtt

SEQ ID NO: 1409772 - DNA, 23 bp, Homo sapiens
catgtgtatggaagacaaataca

SEQ ID NO: 1409773 - DNA, 16 bp, Homo sapiens
cattctcaggcaccag

SEQ ID NO: 1409774 - DNA, 13 bp, Homo sapiens
catttaaagattt

SEQ ID NO: 1409775 - DNA, 16 bp, Homo sapiens
catttaaagatttaaa

SEQ ID NO: 1409776 - DNA, 20 bp, Homo sapiens
catttaacactgagtgaaat

SEQ ID NO: 1409777 - DNA, 15 bp, Homo sapiens
catttctaagccttt

SEQ ID NO: 1409778 - DNA, 16 bp, Homo sapiens
catttctaagcctttg

SEQ ID NO: 1409779 - DNA, 21 bp, Homo sapiens
catttctaagcctttgagact

SEQ ID NO: 1409780 - DNA, 19 bp, Homo sapiens
catttctagaacaattaca

SEQ ID NO: 1409781 - DNA, 20 bp, Homo sapiens
cattttgcagctatggacaa

SEQ ID NO: 1409782 - DNA, 22 bp, Homo sapiens
cattttgctagacagttaaact

SEQ ID NO: 1409783 - DNA, 16 bp, Homo sapiens
ccaaagagtgctaagc

SEQ ID NO: 1409784 - DNA, 22 bp, Homo sapiens
ccaaatgtgtcttgtattatca

SEQ ID NO: 1409785 - DNA, 23 bp, Homo sapiens
ccaattttaaaatgaaatgcatt

SEQ ID NO: 1409786 - DNA, 18 bp, Homo sapiens
ccacatcttccatttcca

SEQ ID NO: 1409787 - DNA, 13 bp, Homo sapiens
ccaccatctgctg

SEQ ID NO: 1409788 - DNA, 18 bp, Homo sapiens
ccaccatctgctgtcttt

SEQ ID NO: 1409789 - DNA, 13 bp, Homo sapiens
ccactcagccttt

SEQ ID NO: 1409790 - DNA, 22 bp, Homo sapiens
ccactcccctccactctctacc

SEQ ID NO: 1409791 - DNA, 14 bp, Homo sapiens
ccactttattgcca

SEQ ID NO: 1409792 - DNA, 18 bp, Homo sapiens
ccagagctggtggaccca

SEQ ID NO: 1409793 - DNA, 19 bp, Homo sapiens
ccagagtccccccactccc

SEQ ID NO: 1409794 - DNA, 23 bp, Homo sapiens
ccagagtccccccactcccagca

SEQ ID NO: 1409795 - DNA, 17 bp, Homo sapiens
ccagcaggcccatggga

SEQ ID NO: 1409796 - DNA, 16 bp, Homo sapiens
ccagccactccccagc

SEQ ID NO: 1409797 - DNA, 15 bp, Homo sapiens
ccagcccaccccatg

SEQ ID NO: 1409798 - DNA, 22 bp, Homo sapiens
ccagcccatttgggcagagagg

SEQ ID NO: 1409799 - DNA, 16 bp, Homo sapiens
ccagccgattcctcca

SEQ ID NO: 1409800 - DNA, 21 bp, Homo sapiens
ccagccgattcctccagccct

SEQ ID NO: 1409801 - DNA, 19 bp, Homo sapiens
ccagctgcaccccttcctg

SEQ ID NO: 1409802 - DNA, 22 bp, Homo sapiens
ccagctgcaccccttcctgggc

SEQ ID NO: 1409803 - DNA, 23 bp, Homo sapiens
ccagctgcaccccttcctgggca

SEQ ID NO: 1409804 - DNA, 17 bp, Homo sapiens
ccagcttgggcagatct

SEQ ID NO: 1409805 - DNA, 13 bp, Homo sapiens
ccaggaagatgaa

SEQ ID NO: 1409806 - DNA, 17 bp, Homo sapiens
ccaggaagatgaatcct

SEQ ID NO: 1409807 - DNA, 16 bp, Homo sapiens
ccaggactagagcaca

SEQ ID NO: 1409808 - DNA, 11 bp, Homo sapiens
ccaggactctg

SEQ ID NO: 1409809 - DNA, 14 bp, Homo sapiens
ccaggactctgacc

SEQ ID NO: 1409810 - DNA, 18 bp, Homo sapiens
ccaggactctgaccccag

SEQ ID NO: 1409811 - DNA, 21 bp, Homo sapiens
ccagtgctagttctgacccaa

SEQ ID NO: 1409812 - DNA, 15 bp, Homo sapiens
ccatattaacaaatt

SEQ ID NO: 1409813 - DNA, 14 bp, Homo sapiens
ccatctctgctcca

SEQ ID NO: 1409814 - DNA, 12 bp, Homo sapiens
ccatctggagag

SEQ ID NO: 1409815 - DNA, 18 bp, Homo sapiens
ccatggccggctttcagg

SEQ ID NO: 1409816 - DNA, 11 bp, Homo sapiens
ccatgtgtatg

SEQ ID NO: 1409817 - DNA, 22 bp, Homo sapiens
ccatttccatgtcccctcccag

SEQ ID NO: 1409818 - DNA, 13 bp, Homo sapiens
cccaccatctgct

SEQ ID NO: 1409819 - DNA, 14 bp, Homo sapiens
cccaccatctgctg

SEQ ID NO: 1409820 - DNA, 16 bp, Homo sapiens
cccaccatctgctgtc

SEQ ID NO: 1409821 - DNA, 14 bp, Homo sapiens
cccactcagccttt

SEQ ID NO: 1409822 - DNA, 15 bp, Homo sapiens
cccagagtcccccca

SEQ ID NO: 1409823 - DNA, 17 bp, Homo sapiens
cccagcatcgcactctg

SEQ ID NO: 1409824 - DNA, 15 bp, Homo sapiens
cccagcattctcagg

SEQ ID NO: 1409825 - DNA, 17 bp, Homo sapiens
cccagcattctcaggca

SEQ ID NO: 1409826 - DNA, 15 bp, Homo sapiens
cccagccactcccca

SEQ ID NO: 1409827 - DNA, 15 bp, Homo sapiens
cccaggactctgacc

SEQ ID NO: 1409828 - DNA, 18 bp, Homo sapiens
cccaggtcgcccacctgt

SEQ ID NO: 1409829 - DNA, 23 bp, Homo sapiens
cccatattaacaaattgcatttg

SEQ ID NO: 1409830 - DNA, 20 bp, Homo sapiens
cccatctcgctccctcccag

SEQ ID NO: 1409831 - DNA, 21 bp, Homo sapiens
cccatctcgctccctcccagg

SEQ ID NO: 1409832 - DNA, 23 bp, Homo sapiens
cccatggccggctttcaggagct

SEQ ID NO: 1409833 - DNA, 11 bp, Homo sapiens
cccatgtgtat

SEQ ID NO: 1409834 - DNA, 18 bp, Homo sapiens
ccccaccatctgctgtct

SEQ ID NO: 1409835 - DNA, 13 bp, Homo sapiens
ccccactcccagc

SEQ ID NO: 1409836 - DNA, 15 bp, Homo sapiens
ccccactcccagcat

SEQ ID NO: 1409837 - DNA, 18 bp, Homo sapiens
ccccagcattctcaggca

SEQ ID NO: 1409838 - DNA, 19 bp, Homo sapiens
ccccagcattctcaggcac

SEQ ID NO: 1409839 - DNA, 20 bp, Homo sapiens
ccccagcattctcaggcacc

SEQ ID NO: 1409840 - DNA, 21 bp, Homo sapiens
ccccagcattctcaggcacca

SEQ ID NO: 1409841 - DNA, 16 bp, Homo sapiens
ccccagccagcctggc

SEQ ID NO: 1409842 - DNA, 18 bp, Homo sapiens
ccccagccagcctggctg

SEQ ID NO: 1409843 - DNA, 21 bp, Homo sapiens
cccccatcttcgggaccagga

SEQ ID NO: 1409844 - DNA, 19 bp, Homo sapiens
ccccctcccccagccactc

SEQ ID NO: 1409845 - DNA, 12 bp, Homo sapiens
cccctcccagag

SEQ ID NO: 1409846 - DNA, 17 bp, Homo sapiens
cccctcccccagccact

SEQ ID NO: 1409847 - DNA, 18 bp, Homo sapiens
cccctcccccagccactc

SEQ ID NO: 1409848 - DNA, 15 bp, Homo sapiens
cccctgccctgtggg

SEQ ID NO: 1409849 - DNA, 11 bp, Homo sapiens
cccctggcctt

SEQ ID NO: 1409850 - DNA, 14 bp, Homo sapiens
ccccttcctaccac

SEQ ID NO: 1409851 - DNA, 19 bp, Homo sapiens
cccgacgtgctcccctgct

SEQ ID NO: 1409852 - DNA, 15 bp, Homo sapiens
ccctcccccagccac

SEQ ID NO: 1409853 - DNA, 12 bp, Homo sapiens
ccctgccctgtg

SEQ ID NO: 1409854 - DNA, 15 bp, Homo sapiens
ccctgccctgtgggg

SEQ ID NO: 1409855 - DNA, 21 bp, Homo sapiens
ccctgtccggaatgccaccca

SEQ ID NO: 1409856 - DNA, 20 bp, Homo sapiens
cccttactttaaccctttct

SEQ ID NO: 1409857 - DNA, 15 bp, Homo sapiens
ccgggggaggggcgc

SEQ ID NO: 1409858 - DNA, 20 bp, Homo sapiens
ccgggggaggggcgcgggag

SEQ ID NO: 1409859 - DNA, 20 bp, Homo sapiens
cctaccacccggtccccact

SEQ ID NO: 1409860 - DNA, 14 bp, Homo sapiens
cctagcttcttcca

SEQ ID NO: 1409861 - DNA, 22 bp, Homo sapiens
cctatgagggtgagctggtccc

SEQ ID NO: 1409862 - DNA, 11 bp, Homo sapiens
cctcacactgc

SEQ ID NO: 1409863 - DNA, 14 bp, Homo sapiens
cctcccactgccca

SEQ ID NO: 1409864 - DNA, 15 bp, Homo sapiens
cctcccactgcccac

SEQ ID NO: 1409865 - DNA, 18 bp, Homo sapiens
cctccctctccagcaggc

SEQ ID NO: 1409866 - DNA, 20 bp, Homo sapiens
cctccgtcactacctggctg

SEQ ID NO: 1409867 - DNA, 14 bp, Homo sapiens
cctcctcccactgc

SEQ ID NO: 1409868 - DNA, 19 bp, Homo sapiens
cctcttgtagtcttggcta

SEQ ID NO: 1409869 - DNA, 22 bp, Homo sapiens
cctgacaccaggcaagaaaagc

SEQ ID NO: 1409870 - DNA, 16 bp, Homo sapiens
cctgactgggggcaga

SEQ ID NO: 1409871 - DNA, 19 bp, Homo sapiens
cctgactgggggcagacat

SEQ ID NO: 1409872 - DNA, 17 bp, Homo sapiens
cctgcagccaagcaaat

SEQ ID NO: 1409873 - DNA, 20 bp, Homo sapiens
cctgcagccaagcaaatgcc

SEQ ID NO: 1409874 - DNA, 12 bp, Homo sapiens
cctggcatttgg

SEQ ID NO: 1409875 - DNA, 18 bp, Homo sapiens
cctgggcacacgctgctc

SEQ ID NO: 1409876 - DNA, 23 bp, Homo sapiens
cctgtacacacacagacacacaa

SEQ ID NO: 1409877 - DNA, 17 bp, Homo sapiens
ccttcctgggcacacgc

SEQ ID NO: 1409878 - DNA, 15 bp, Homo sapiens
ccttcggtacccacc

SEQ ID NO: 1409879 - DNA, 17 bp, Homo sapiens
ccttcggtacccaccac

SEQ ID NO: 1409880 - DNA, 16 bp, Homo sapiens
ccttctggaaactgtg

SEQ ID NO: 1409881 - DNA, 19 bp, Homo sapiens
ccttctggaaactgtgaag

SEQ ID NO: 1409882 - DNA, 16 bp, Homo sapiens
cctttatttctgtatc

SEQ ID NO: 1409883 - DNA, 18 bp, Homo sapiens
cctttatttctgtatctg

SEQ ID NO: 1409884 - DNA, 21 bp, Homo sapiens
cctttctcggggtcaggttct

SEQ ID NO: 1409885 - DNA, 16 bp, Homo sapiens
cctttgggtgctgttt

SEQ ID NO: 1409886 - DNA, 13 bp, Homo sapiens
cgaaatgctgtct

SEQ ID NO: 1409887 - DNA, 17 bp, Homo sapiens
cgaagtctgatccctgc

SEQ ID NO: 1409888 - DNA, 16 bp, Homo sapiens
cgacgtgctcccctgc

SEQ ID NO: 1409889 - DNA, 13 bp, Homo sapiens
cgatgtaaattat

SEQ ID NO: 1409890 - DNA, 20 bp, Homo sapiens
cgcaattgtatatatatgtg

SEQ ID NO: 1409891 - DNA, 21 bp, Homo sapiens
cgcagagaaatcggtgtctga

SEQ ID NO: 1409892 - DNA, 12 bp, Homo sapiens
cgcccacctgtg

SEQ ID NO: 1409893 - DNA, 14 bp, Homo sapiens
cgcgggagggggcg

SEQ ID NO: 1409894 - DNA, 14 bp, Homo sapiens
cggcaccgccagcc

SEQ ID NO: 1409895 - DNA, 18 bp, Homo sapiens
cggggggccgggggaggg

SEQ ID NO: 1409896 - DNA, 14 bp, Homo sapiens
cggtgtccccacca

SEQ ID NO: 1409897 - DNA, 16 bp, Homo sapiens
cggtgtccccaccatc

SEQ ID NO: 1409898 - DNA, 19 bp, Homo sapiens
cggtgtccccaccatctgc

SEQ ID NO: 1409899 - DNA, 19 bp, Homo sapiens
cgtgtatatgaggatgtat

SEQ ID NO: 1409900 - DNA, 22 bp, Homo sapiens
cgtgtatatgaggatgtatgtg

SEQ ID NO: 1409901 - DNA, 18 bp, Homo sapiens
cgttaactgcattttaca

SEQ ID NO: 1409902 - DNA, 17 bp, Homo sapiens
ctaaagaccatttaatc

SEQ ID NO: 1409903 - DNA, 22 bp, Homo sapiens
ctaagtaatctcacagcatttg

SEQ ID NO: 1409904 - DNA, 15 bp, Homo sapiens
ctactttctgttatc

SEQ ID NO: 1409905 - DNA, 18 bp, Homo sapiens
ctagagcacaacataatt

SEQ ID NO: 1409906 - DNA, 12 bp, Homo sapiens
ctagccagccag

SEQ ID NO: 1409907 - DNA, 20 bp, Homo sapiens
ctatataaccacatttctaa

SEQ ID NO: 1409908 - DNA, 16 bp, Homo sapiens
ctatatatacatcata

SEQ ID NO: 1409909 - DNA, 17 bp, Homo sapiens
ctattcggcaaggaagt

SEQ ID NO: 1409910 - DNA, 13 bp, Homo sapiens
ctattgaataatg

SEQ ID NO: 1409911 - DNA, 14 bp, Homo sapiens
ctcagcatatatat

SEQ ID NO: 1409912 - DNA, 21 bp, Homo sapiens
ctcagcatatatataaaatac

SEQ ID NO: 1409913 - DNA, 20 bp, Homo sapiens
ctcagcttggcactcaggtg

SEQ ID NO: 1409914 - DNA, 21 bp, Homo sapiens
ctcagcttggcactcaggtgc

SEQ ID NO: 1409915 - DNA, 23 bp, Homo sapiens
ctcagcttggcactcaggtgctg

SEQ ID NO: 1409916 - DNA, 22 bp, Homo sapiens
ctcaggaatcatctcctttgca

SEQ ID NO: 1409917 - DNA, 12 bp, Homo sapiens
ctcaggaccagg

SEQ ID NO: 1409918 - DNA, 14 bp, Homo sapiens
ctcaggcaccagtc

SEQ ID NO: 1409919 - DNA, 15 bp, Homo sapiens
ctcatcgggagtgaa

SEQ ID NO: 1409920 - DNA, 19 bp, Homo sapiens
ctcatgcctttatactttg

SEQ ID NO: 1409921 - DNA, 14 bp, Homo sapiens
ctccaccttccaaa

SEQ ID NO: 1409922 - DNA, 16 bp, Homo sapiens
ctccaccttccaaaga

SEQ ID NO: 1409923 - DNA, 17 bp, Homo sapiens
ctccatacacacgctgc

SEQ ID NO: 1409924 - DNA, 17 bp, Homo sapiens
ctcccaatatccaattt

SEQ ID NO: 1409925 - DNA, 22 bp, Homo sapiens
ctcccagagctggtggacccag

SEQ ID NO: 1409926 - DNA, 13 bp, Homo sapiens
ctcccagcatcgc

SEQ ID NO: 1409927 - DNA, 19 bp, Homo sapiens
ctcccagcatcgcactctg

SEQ ID NO: 1409928 - DNA, 16 bp, Homo sapiens
ctccccagccagcctg

SEQ ID NO: 1409929 - DNA, 16 bp, Homo sapiens
ctcccccagccactcc

SEQ ID NO: 1409930 - DNA, 14 bp, Homo sapiens
ctccctcccaggac

SEQ ID NO: 1409931 - DNA, 16 bp, Homo sapiens
ctccgaaatgctgtct

SEQ ID NO: 1409932 - DNA, 18 bp, Homo sapiens
ctccgaaatgctgtcttt

SEQ ID NO: 1409933 - DNA, 16 bp, Homo sapiens
ctccgtcactacctgg

SEQ ID NO: 1409934 - DNA, 17 bp, Homo sapiens
ctccgtcactacctggc

SEQ ID NO: 1409935 - DNA, 12 bp, Homo sapiens
ctcctcaggacc

SEQ ID NO: 1409936 - DNA, 13 bp, Homo sapiens
ctcctcaggacca

SEQ ID NO: 1409937 - DNA, 12 bp, Homo sapiens
ctcctcccactg

SEQ ID NO: 1409938 - DNA, 14 bp, Homo sapiens
ctcctcccactgcc

SEQ ID NO: 1409939 - DNA, 17 bp, Homo sapiens
ctcctgcatagcttttc

SEQ ID NO: 1409940 - DNA, 15 bp, Homo sapiens
ctcgctccctcccag

SEQ ID NO: 1409941 - DNA, 13 bp, Homo sapiens
ctcggtgtcccca

SEQ ID NO: 1409942 - DNA, 22 bp, Homo sapiens
ctcggtgtccccaccatctgct

SEQ ID NO: 1409943 - DNA, 16 bp, Homo sapiens
ctctccagcaggccca

SEQ ID NO: 1409944 - DNA, 22 bp, Homo sapiens
ctctggcagcaccgcctcttcc

SEQ ID NO: 1409945 - DNA, 23 bp, Homo sapiens
ctcttcccgccgcccagcccacc

SEQ ID NO: 1409946 - DNA, 21 bp, Homo sapiens
ctgaagggtaatatggactca

SEQ ID NO: 1409947 - DNA, 18 bp, Homo sapiens
ctgatcagcaggagccaa

SEQ ID NO: 1409948 - DNA, 16 bp, Homo sapiens
ctgatttatggtcaga

SEQ ID NO: 1409949 - DNA, 16 bp, Homo sapiens
ctgcaccccttcctgg

SEQ ID NO: 1409950 - DNA, 19 bp, Homo sapiens
ctgccccagcttgggcaga

SEQ ID NO: 1409951 - DNA, 19 bp, Homo sapiens
ctgccccccccccccatct

SEQ ID NO: 1409952 - DNA, 20 bp, Homo sapiens
ctgctatgtatttgcaaggc

SEQ ID NO: 1409953 - DNA, 23 bp, Homo sapiens
ctgctccaaccgggatgggagcc

SEQ ID NO: 1409954 - DNA, 22 bp, Homo sapiens
ctgctctgccccagcttgggca

SEQ ID NO: 1409955 - DNA, 16 bp, Homo sapiens
ctggagagcccagagt

SEQ ID NO: 1409956 - DNA, 21 bp, Homo sapiens
ctggcagcaccgcctcttccc

SEQ ID NO: 1409957 - DNA, 16 bp, Homo sapiens
ctggcatttggcctct

SEQ ID NO: 1409958 - DNA, 15 bp, Homo sapiens
ctggctgggactggg

SEQ ID NO: 1409959 - DNA, 16 bp, Homo sapiens
ctggcttaacttagta

SEQ ID NO: 1409960 - DNA, 14 bp, Homo sapiens
ctgggaacagaact

SEQ ID NO: 1409961 - DNA, 15 bp, Homo sapiens
ctgggaacagaactc

SEQ ID NO: 1409962 - DNA, 15 bp, Homo sapiens
ctgggcacacgctgc

SEQ ID NO: 1409963 - DNA, 18 bp, Homo sapiens
ctgggcacacgctgctct

SEQ ID NO: 1409964 - DNA, 20 bp, Homo sapiens
ctgggcacacgctgctctgc

SEQ ID NO: 1409965 - DNA, 22 bp, Homo sapiens
ctgggcacacgctgctctgccc

SEQ ID NO: 1409966 - DNA, 12 bp, Homo sapiens
ctgtacacacac

SEQ ID NO: 1409967 - DNA, 20 bp, Homo sapiens
ctgtacttgatttttcaaag

SEQ ID NO: 1409968 - DNA, 23 bp, Homo sapiens
ctgtacttgatttttcaaagact

SEQ ID NO: 1409969 - DNA, 16 bp, Homo sapiens
ctgtatctgacatatt

SEQ ID NO: 1409970 - DNA, 18 bp, Homo sapiens
ctgtcaagtttttatacc

SEQ ID NO: 1409971 - DNA, 20 bp, Homo sapiens
ctgtcatgtgcgaacacagt

SEQ ID NO: 1409972 - DNA, 14 bp, Homo sapiens
ctgtctttcttgct

SEQ ID NO: 1409973 - DNA, 17 bp, Homo sapiens
ctgtctttcttgctccc

SEQ ID NO: 1409974 - DNA, 23 bp, Homo sapiens
ctgtctttcttgctccctgactg

SEQ ID NO: 1409975 - DNA, 14 bp, Homo sapiens
ctgtgaagatctca

SEQ ID NO: 1409976 - DNA, 13 bp, Homo sapiens
ctgtgggccagcc

SEQ ID NO: 1409977 - DNA, 16 bp, Homo sapiens
ctgttgtctgaaacat

SEQ ID NO: 1409978 - DNA, 17 bp, Homo sapiens
cttaactttactaagta

SEQ ID NO: 1409979 - DNA, 23 bp, Homo sapiens
cttagtatattattattaattac

SEQ ID NO: 1409980 - DNA, 14 bp, Homo sapiens
cttataacattgta

SEQ ID NO: 1409981 - DNA, 23 bp, Homo sapiens
cttcatatcctctcgttcagttt

SEQ ID NO: 1409982 - DNA, 14 bp, Homo sapiens
cttcatttaacact

SEQ ID NO: 1409983 - DNA, 21 bp, Homo sapiens
cttcatttaacactgagtgaa

SEQ ID NO: 1409984 - DNA, 13 bp, Homo sapiens
cttccccctcccc

SEQ ID NO: 1409985 - DNA, 20 bp, Homo sapiens
cttcccgccgcccagcccac

SEQ ID NO: 1409986 - DNA, 22 bp, Homo sapiens
aagtatcatctaaatattatgc

SEQ ID NO: 1409987 - DNA, 20 bp, Homo sapiens
aagtctattgaataatgtag

SEQ ID NO: 1409988 - DNA, 18 bp, Homo sapiens
aagttagatgttttagtt

SEQ ID NO: 1409989 - DNA, 17 bp, Homo sapiens
aagttagtttttaatct

SEQ ID NO: 1409990 - DNA, 14 bp, Homo sapiens
aagtttttatacct

SEQ ID NO: 1409991 - DNA, 18 bp, Homo sapiens
aataaatattatttgatg

SEQ ID NO: 1409992 - DNA, 20 bp, Homo sapiens
aataaggacacaaactttca

SEQ ID NO: 1409993 - DNA, 17 bp, Homo sapiens
aataatagcacatgatt

SEQ ID NO: 1409994 - DNA, 18 bp, Homo sapiens
aataatattcatgaagag

SEQ ID NO: 1409995 - DNA, 16 bp, Homo sapiens
aatacacatacatata

SEQ ID NO: 1409996 - DNA, 17 bp, Homo sapiens
aatacctggcctcattt

SEQ ID NO: 1409997 - DNA, 17 bp, Homo sapiens
aatatcccttactttaa

SEQ ID NO: 1409998 - DNA, 23 bp, Homo sapiens
aatatgcatatatatgtatattt

SEQ ID NO: 1409999 - DNA, 12 bp, Homo sapiens
aatatggactca

SEQ ID NO: 1410000 - DNA, 17 bp, Homo sapiens
aatatggactcagcctt

SEQ ID NO: 1410001 - DNA, 18 bp, Homo sapiens
aatattcatgaagagttg

SEQ ID NO: 1410002 - DNA, 14 bp, Homo sapiens
aatcagaaagacat

SEQ ID NO: 1410003 - DNA, 14 bp, Homo sapiens
aatctcacagcatt

SEQ ID NO: 1410004 - DNA, 19 bp, Homo sapiens
aatctctccaccttccaaa

SEQ ID NO: 1410005 - DNA, 20 bp, Homo sapiens
aatctctccaccttccaaag

SEQ ID NO: 1410006 - DNA, 18 bp, Homo sapiens
aatcttgaaggaacacaa

SEQ ID NO: 1410007 - DNA, 17 bp, Homo sapiens
aatgagggcgtgaaaca

SEQ ID NO: 1410008 - DNA, 23 bp, Homo sapiens
aatgcattttgctagacagttaa

SEQ ID NO: 1410009 - DNA, 12 bp, Homo sapiens
aatgcctgccaa

SEQ ID NO: 1410010 - DNA, 20 bp, Homo sapiens
aatgtcaaatgaaacctaca

SEQ ID NO: 1410011 - DNA, 23 bp, Homo sapiens
aattaagattgaagctaaaacac

SEQ ID NO: 1410012 - DNA, 18 bp, Homo sapiens
aattaagctctcatagct

SEQ ID NO: 1410013 - DNA, 21 bp, Homo sapiens
aattctaacgcaaaaatagct

SEQ ID NO: 1410014 - DNA, 9 bp, Homo sapiens
aattgaaag

SEQ ID NO: 1410015 - DNA, 22 bp, Homo sapiens
aattgaaagggacaagtatcat

SEQ ID NO: 1410016 - DNA, 17 bp, Homo sapiens
aattgtatatatatgtg

SEQ ID NO: 1410017 - DNA, 18 bp, Homo sapiens
aattgtatatatatgtga

SEQ ID NO: 1410018 - DNA, 17 bp, Homo sapiens
aatttaagatacaaata

SEQ ID NO: 1410019 - DNA, 23 bp, Homo sapiens
aatttaccacaggatgcatatta

SEQ ID NO: 1410020 - DNA, 21 bp, Homo sapiens
atacatttaaagatttaaagt

SEQ ID NO: 1410021 - DNA, 19 bp, Homo sapiens
atacctggcctcatttaaa

SEQ ID NO: 1410022 - DNA, 15 bp, Homo sapiens
atacctgtacacaca

SEQ ID NO: 1410023 - DNA, 18 bp, Homo sapiens
atacctgtacacacacag

SEQ ID NO: 1410024 - DNA, 17 bp, Homo sapiens
atacgcaattgtatata

SEQ ID NO: 1410025 - DNA, 18 bp, Homo sapiens
atacgcaattgtatatat

SEQ ID NO: 1410026 - DNA, 19 bp, Homo sapiens
atactaggaagtaaagtga

SEQ ID NO: 1410027 - DNA, 21 bp, Homo sapiens
atactccaccagtgaaaattg

SEQ ID NO: 1410028 - DNA, 13 bp, Homo sapiens
atacttaacttta

SEQ ID NO: 1410029 - DNA, 19 bp, Homo sapiens
atactttgctgttgaagaa

SEQ ID NO: 1410030 - DNA, 22 bp, Homo sapiens
atactttgctgttgaagaaact

SEQ ID NO: 1410031 - DNA, 17 bp, Homo sapiens
atagaaggactgcagcc

SEQ ID NO: 1410032 - DNA, 19 bp, Homo sapiens
atagacgcaaccttaactt

SEQ ID NO: 1410033 - DNA, 17 bp, Homo sapiens
atagcatttctagaaca

SEQ ID NO: 1410034 - DNA, 21 bp, Homo sapiens
atagcatttctagaacaatta

SEQ ID NO: 1410035 - DNA, 12 bp, Homo sapiens
atagctcataag

SEQ ID NO: 1410036 - DNA, 17 bp, Homo sapiens
atataaccacatttcta

SEQ ID NO: 1410037 - DNA, 16 bp, Homo sapiens
atatacagtgtgtagt

SEQ ID NO: 1410038 - DNA, 19 bp, Homo sapiens
atatagaaggactgcagcc

SEQ ID NO: 1410039 - DNA, 17 bp, Homo sapiens
atatataaaatacacgt

SEQ ID NO: 1410040 - DNA, 13 bp, Homo sapiens
atatatacatacg

SEQ ID NO: 1410041 - DNA, 12 bp, Homo sapiens
atatatatgtga

SEQ ID NO: 1410042 - DNA, 14 bp, Homo sapiens
atatatgtatattt

SEQ ID NO: 1410043 - DNA, 21 bp, Homo sapiens
atatatgtgaactttctcagc

SEQ ID NO: 1410044 - DNA, 18 bp, Homo sapiens
atatatttgcataatatg

SEQ ID NO: 1410045 - DNA, 21 bp, Homo sapiens
atatcatccccaaatgtgtct

SEQ ID NO: 1410046 - DNA, 18 bp, Homo sapiens
atatccaattttaaaatg

SEQ ID NO: 1410047 - DNA, 14 bp, Homo sapiens
atatgaggatgtat

SEQ ID NO: 1410048 - DNA, 16 bp, Homo sapiens
atatgaggatgtatgt

SEQ ID NO: 1410049 - DNA, 20 bp, Homo sapiens
atatgaggatgtatgtgtat

SEQ ID NO: 1410050 - DNA, 16 bp, Homo sapiens
atatgcaataaatatt

SEQ ID NO: 1410051 - DNA, 14 bp, Homo sapiens
atatgcatatatat

SEQ ID NO: 1410052 - DNA, 18 bp, Homo sapiens
atatgcatatatatgtat

SEQ ID NO: 1410053 - DNA, 19 bp, Homo sapiens
atatgcatatatatgtata

SEQ ID NO: 1410054 - DNA, 15 bp, Homo sapiens
atatggactcagcct

SEQ ID NO: 1410055 - DNA, 20 bp, Homo sapiens
atatgtctagggtgtgattt

SEQ ID NO: 1410056 - DNA, 19 bp, Homo sapiens
atatgtgaactttctcagc

SEQ ID NO: 1410057 - DNA, 18 bp, Homo sapiens
atatgtttatacacacag

SEQ ID NO: 1410058 - DNA, 22 bp, Homo sapiens
atattaacaaattgcatttgtg

SEQ ID NO: 1410059 - DNA, 20 bp, Homo sapiens
atattatgccttgagaatga

SEQ ID NO: 1410060 - DNA, 15 bp, Homo sapiens
caattgtatatatat

SEQ ID NO: 1410061 - DNA, 17 bp, Homo sapiens
caattgtatatatatgt

SEQ ID NO: 1410062 - DNA, 22 bp, Homo sapiens
caattgtatatatatgtgaact

SEQ ID NO: 1410063 - DNA, 21 bp, Homo sapiens
caatttcagttttaaaaatga

SEQ ID NO: 1410064 - DNA, 17 bp, Homo sapiens
caattttaaaatgaaat

SEQ ID NO: 1410065 - DNA, 19 bp, Homo sapiens
cacaaactttcaagtatta

SEQ ID NO: 1410066 - DNA, 15 bp, Homo sapiens
cacaaagatcaaatg

SEQ ID NO: 1410067 - DNA, 15 bp, Homo sapiens
cacaaatggctacat

SEQ ID NO: 1410068 - DNA, 20 bp, Homo sapiens
cacaagcagacacacacata

SEQ ID NO: 1410069 - DNA, 22 bp, Homo sapiens
cacacaagcagacacacacata

SEQ ID NO: 1410070 - DNA, 14 bp, Homo sapiens
cacacagacacaca

SEQ ID NO: 1410071 - DNA, 19 bp, Homo sapiens
cacacatatatacatacgc

SEQ ID NO: 1410072 - DNA, 20 bp, Homo sapiens
cacaccacgcgtcacccaac

SEQ ID NO: 1410073 - DNA, 12 bp, Homo sapiens
cacacctcctcc

SEQ ID NO: 1410074 - DNA, 14 bp, Homo sapiens
cacacctcctccca

SEQ ID NO: 1410075 - DNA, 17 bp, Homo sapiens
cacacgctgctctgccc

SEQ ID NO: 1410076 - DNA, 19 bp, Homo sapiens
cacagatgttcccccatct

SEQ ID NO: 1410077 - DNA, 18 bp, Homo sapiens
cacatatatacatacgca

SEQ ID NO: 1410078 - DNA, 13 bp, Homo sapiens
cacatatttcaaa

SEQ ID NO: 1410079 - DNA, 14 bp, Homo sapiens
cacatgatttgggc

SEQ ID NO: 1410080 - DNA, 16 bp, Homo sapiens
caccaggcaagaaaag

SEQ ID NO: 1410081 - DNA, 17 bp, Homo sapiens
caccaggcaagaaaagc

SEQ ID NO: 1410082 - DNA, 20 bp, Homo sapiens
caccagtccctgtccggaat

SEQ ID NO: 1410083 - DNA, 23 bp, Homo sapiens
cacccggtccccactttattgcc

SEQ ID NO: 1410084 - DNA, 13 bp, Homo sapiens
caccgcctcttcc

SEQ ID NO: 1410085 - DNA, 17 bp, Homo sapiens
caccgcctcttcccgcc

SEQ ID NO: 1410086 - DNA, 16 bp, Homo sapiens
cacctctttgctccct

SEQ ID NO: 1410087 - DNA, 23 bp, Homo sapiens
cacctgcagccaagcaaatgcct

SEQ ID NO: 1410088 - DNA, 22 bp, Homo sapiens
cacgctgccttcggtacccacc

SEQ ID NO: 1410089 - DNA, 21 bp, Homo sapiens
cacgctgctctgccccagctt

SEQ ID NO: 1410090 - DNA, 19 bp, Homo sapiens
cacggatcacgatgtaaat

SEQ ID NO: 1410091 - DNA, 12 bp, Homo sapiens
cacgtgtatatg

SEQ ID NO: 1410092 - DNA, 12 bp, Homo sapiens
cactcccagcat

SEQ ID NO: 1410093 - DNA, 21 bp, Homo sapiens
cactccccagccagcctggct

SEQ ID NO: 1410094 - DNA, 22 bp, Homo sapiens
cactctccgaagtctgatccct

SEQ ID NO: 1410095 - DNA, 23 bp, Homo sapiens
cactctccgaagtctgatccctg

SEQ ID NO: 1410096 - DNA, 13 bp, Homo sapiens
cactgcccactgg

SEQ ID NO: 1410097 - DNA, 21 bp, Homo sapiens
cagaactcggtgtccccacca

SEQ ID NO: 1410098 - DNA, 22 bp, Homo sapiens
cagaactcggtgtccccaccat

SEQ ID NO: 1410099 - DNA, 17 bp, Homo sapiens
cagaatttccctctgat

SEQ ID NO: 1410100 - DNA, 22 bp, Homo sapiens
cagacatggtggggtctcctca

SEQ ID NO: 1410101 - DNA, 17 bp, Homo sapiens
cagagctggtggaccca

SEQ ID NO: 1410102 - DNA, 21 bp, Homo sapiens
cagagctggtggacccaggga

SEQ ID NO: 1410103 - DNA, 21 bp, Homo sapiens
cagaggagaacttgctgcctc

SEQ ID NO: 1410104 - DNA, 13 bp, Homo sapiens
cagaggatgctga

SEQ ID NO: 1410105 - DNA, 22 bp, Homo sapiens
cagaggatgctgacatcatttg

SEQ ID NO: 1410106 - DNA, 14 bp, Homo sapiens
cagagtccccccac

SEQ ID NO: 1410107 - DNA, 22 bp, Homo sapiens
cagagtccccccactcccagca

SEQ ID NO: 1410108 - DNA, 21 bp, Homo sapiens
cagattccccactcagccttt

SEQ ID NO: 1410109 - DNA, 12 bp, Homo sapiens
cagcaaacacag

SEQ ID NO: 1410110 - DNA, 18 bp, Homo sapiens
cagcatgcgatgtcatat

SEQ ID NO: 1410111 - DNA, 15 bp, Homo sapiens
cagcatttgccaagt

SEQ ID NO: 1410112 - DNA, 21 bp, Homo sapiens
cagccaagcaaatgcctgcca

SEQ ID NO: 1410113 - DNA, 21 bp, Homo sapiens
cagccactcccctccactctc

SEQ ID NO: 1410114 - DNA, 21 bp, Homo sapiens
cagccactgattctctcttgt

SEQ ID NO: 1410115 - DNA, 14 bp, Homo sapiens
cagccagcctggct

SEQ ID NO: 1410116 - DNA, 15 bp, Homo sapiens
cagccagcctggctg

SEQ ID NO: 1410117 - DNA, 20 bp, Homo sapiens
cagccgattcctccagccct

SEQ ID NO: 1410118 - DNA, 14 bp, Homo sapiens
cagcctggctggga

SEQ ID NO: 1410119 - DNA, 12 bp, Homo sapiens
cagctgcacccc

SEQ ID NO: 1410120 - DNA, 16 bp, Homo sapiens
cagctgcaccccttcc

SEQ ID NO: 1410121 - DNA, 13 bp, Homo sapiens
cagcttgggcaga

SEQ ID NO: 1410122 - DNA, 17 bp, Homo sapiens
cagcttgggcagatctc

SEQ ID NO: 1410123 - DNA, 22 bp, Homo sapiens
caggaccagggttggcaccttc

SEQ ID NO: 1410124 - DNA, 16 bp, Homo sapiens
caggactagagcacaa

SEQ ID NO: 1410125 - DNA, 17 bp, Homo sapiens
caggagatgctgtgccc

SEQ ID NO: 1410126 - DNA, 19 bp, Homo sapiens
caggagatgctgtgcccct

SEQ ID NO: 1410127 - DNA, 23 bp, Homo sapiens
caggagatgctgtgcccctggcc

SEQ ID NO: 1410128 - DNA, 12 bp, Homo sapiens
caggatgcatat

SEQ ID NO: 1410129 - DNA, 18 bp, Homo sapiens
caggatgcatattaaaga

SEQ ID NO: 1410130 - DNA, 15 bp, Homo sapiens
caggatttgcacaga

SEQ ID NO: 1410131 - DNA, 16 bp, Homo sapiens
caggatttgcacagaa

SEQ ID NO: 1410132 - DNA, 22 bp, Homo sapiens
caggatttgcacagaagcacat

SEQ ID NO: 1410133 - DNA, 21 bp, Homo sapiens
caggcaagaaaagcgcagaga

SEQ ID NO: 1410134 - DNA, 14 bp, Homo sapiens
caggggaggccatc

SEQ ID NO: 1410135 - DNA, 16 bp, Homo sapiens
caggtcccctttcaga

SEQ ID NO: 1410136 - DNA, 13 bp, Homo sapiens
caggtcgcccacc

SEQ ID NO: 1410137 - DNA, 16 bp, Homo sapiens
caggtcgcccacctgt

SEQ ID NO: 1410138 - DNA, 13 bp, Homo sapiens
caggttcaggtcc

SEQ ID NO: 1410139 - DNA, 12 bp, Homo sapiens
cagtcatcattt

SEQ ID NO: 1410140 - DNA, 14 bp, Homo sapiens
atattatttgatga

SEQ ID NO: 1410141 - DNA, 16 bp, Homo sapiens
atattcatgaagagtt

SEQ ID NO: 1410142 - DNA, 23 bp, Homo sapiens
atattcatgaagagttgtttata

SEQ ID NO: 1410143 - DNA, 15 bp, Homo sapiens
atatttgcataatat

SEQ ID NO: 1410144 - DNA, 21 bp, Homo sapiens
atattttcctttatgtgatgt

SEQ ID NO: 1410145 - DNA, 15 bp, Homo sapiens
atcaaataatattca

SEQ ID NO: 1410146 - DNA, 15 bp, Homo sapiens
atcacgatgtaaatt

SEQ ID NO: 1410147 - DNA, 19 bp, Homo sapiens
atcagaaagacattcttag

SEQ ID NO: 1410148 - DNA, 13 bp, Homo sapiens
atcatacttaact

SEQ ID NO: 1410149 - DNA, 18 bp, Homo sapiens
atcatccccaaatgtgtc

SEQ ID NO: 1410150 - DNA, 16 bp, Homo sapiens
atcatctaaatattat

SEQ ID NO: 1410151 - DNA, 16 bp, Homo sapiens
atcattacaatacagt

SEQ ID NO: 1410152 - DNA, 22 bp, Homo sapiens
atcattcttataacattgtatg

SEQ ID NO: 1410153 - DNA, 12 bp, Homo sapiens
atccaagtggcc

SEQ ID NO: 1410154 - DNA, 21 bp, Homo sapiens
atccaggcccctccctctcca

SEQ ID NO: 1410155 - DNA, 11 bp, Homo sapiens
atccccttcct

SEQ ID NO: 1410156 - DNA, 18 bp, Homo sapiens
atccccttcctaccaccc

SEQ ID NO: 1410157 - DNA, 13 bp, Homo sapiens
atctaaatattat

SEQ ID NO: 1410158 - DNA, 18 bp, Homo sapiens
atctaaggtccccagcag

SEQ ID NO: 1410159 - DNA, 18 bp, Homo sapiens
atctcaatttaagataca

SEQ ID NO: 1410160 - DNA, 16 bp, Homo sapiens
atctcactctgccccc

SEQ ID NO: 1410161 - DNA, 13 bp, Homo sapiens
atctgctgtcttt

SEQ ID NO: 1410162 - DNA, 21 bp, Homo sapiens
atgaaagcagtgaagcaattt

SEQ ID NO: 1410163 - DNA, 13 bp, Homo sapiens
atgaagagttgtt

SEQ ID NO: 1410164 - DNA, 17 bp, Homo sapiens
atgaagagttgtttata

SEQ ID NO: 1410165 - DNA, 23 bp, Homo sapiens
atgaagatcggctttcatgtaat

SEQ ID NO: 1410166 - DNA, 15 bp, Homo sapiens
atgagatatgcaata

SEQ ID NO: 1410167 - DNA, 18 bp, Homo sapiens
atgaggatgtatgtgtat

SEQ ID NO: 1410168 - DNA, 13 bp, Homo sapiens
atgcaataaatat

SEQ ID NO: 1410169 - DNA, 15 bp, Homo sapiens
atgcaataaatatta

SEQ ID NO: 1410170 - DNA, 16 bp, Homo sapiens
atgcaataaatattat

SEQ ID NO: 1410171 - DNA, 14 bp, Homo sapiens
atgcatatatatgt

SEQ ID NO: 1410172 - DNA, 15 bp, Homo sapiens
atgcatatatatgta

SEQ ID NO: 1410173 - DNA, 21 bp, Homo sapiens
atgcatattaaagaaagtcat

SEQ ID NO: 1410174 - DNA, 14 bp, Homo sapiens
atgcctttatactt

SEQ ID NO: 1410175 - DNA, 20 bp, Homo sapiens
atgctgtctttcttgctccc

SEQ ID NO: 1410176 - DNA, 14 bp, Homo sapiens
atgctgtgcccctg

SEQ ID NO: 1410177 - DNA, 18 bp, Homo sapiens
atggaagacaaatacaca

SEQ ID NO: 1410178 - DNA, 16 bp, Homo sapiens
atggacaatttaccac

SEQ ID NO: 1410179 - DNA, 18 bp, Homo sapiens
atggacaatttaccacag

SEQ ID NO: 1410180 - DNA, 13 bp, Homo sapiens
atggatgtaattc

SEQ ID NO: 1410181 - DNA, 15 bp, Homo sapiens
atgggaggctggagt

SEQ ID NO: 1410182 - DNA, 19 bp, Homo sapiens
atggggaaactgagggcag

SEQ ID NO: 1410183 - DNA, 22 bp, Homo sapiens
atggtcagaatttccctctgat

SEQ ID NO: 1410184 - DNA, 16 bp, Homo sapiens
atgtaaacaaatattt

SEQ ID NO: 1410185 - DNA, 22 bp, Homo sapiens
atgtaattatctagtagttgta

SEQ ID NO: 1410186 - DNA, 21 bp, Homo sapiens
atgtagttttgtgatgcattt

SEQ ID NO: 1410187 - DNA, 14 bp, Homo sapiens
atgtatatttacca

SEQ ID NO: 1410188 - DNA, 17 bp, Homo sapiens
atgtatgtgtatatgtt

SEQ ID NO: 1410189 - DNA, 12 bp, Homo sapiens
atgtatttgcaa

SEQ ID NO: 1410190 - DNA, 14 bp, Homo sapiens
atgtatttgcaagg

SEQ ID NO: 1410191 - DNA, 17 bp, Homo sapiens
atgtctcctgcatagct

SEQ ID NO: 1410192 - DNA, 15 bp, Homo sapiens
atgtgcgaacacagt

SEQ ID NO: 1410193 - DNA, 21 bp, Homo sapiens
atgtgtatatgtttatacaca

SEQ ID NO: 1410194 - DNA, 21 bp, Homo sapiens
atgttaatagaaaatatattt

SEQ ID NO: 1410195 - DNA, 14 bp, Homo sapiens
atgtttatacacac

SEQ ID NO: 1410196 - DNA, 16 bp, Homo sapiens
atgtttatacacacag

SEQ ID NO: 1410197 - DNA, 17 bp, Homo sapiens
atgtttatacacacagg

SEQ ID NO: 1410198 - DNA, 20 bp, Homo sapiens
atgttttagtttaaaaatca

SEQ ID NO: 1410199 - DNA, 16 bp, Homo sapiens
attaaagaaagtcata

SEQ ID NO: 1410200 - DNA, 18 bp, Homo sapiens
attaacaaattgcatttg

SEQ ID NO: 1410201 - DNA, 19 bp, Homo sapiens
attaagctctcatagctca

SEQ ID NO: 1410202 - DNA, 15 bp, Homo sapiens
attaattacaatgta

SEQ ID NO: 1410203 - DNA, 20 bp, Homo sapiens
attatctagtagttgtagaa

SEQ ID NO: 1410204 - DNA, 16 bp, Homo sapiens
attatgccttgagaat

SEQ ID NO: 1410205 - DNA, 18 bp, Homo sapiens
attatgccttgagaatga

SEQ ID NO: 1410206 - DNA, 13 bp, Homo sapiens
attatgttccaag

SEQ ID NO: 1410207 - DNA, 20 bp, Homo sapiens
attctaacgcaaaaatagct

SEQ ID NO: 1410208 - DNA, 15 bp, Homo sapiens
attcttagcaaaaaa

SEQ ID NO: 1410209 - DNA, 17 bp, Homo sapiens
attcttagttaatcttt

SEQ ID NO: 1410210 - DNA, 18 bp, Homo sapiens
attcttataacattgtat

SEQ ID NO: 1410211 - DNA, 15 bp, Homo sapiens
attgaaagggacaag

SEQ ID NO: 1410212 - DNA, 18 bp, Homo sapiens
attgaaagggacaagtat

SEQ ID NO: 1410213 - DNA, 16 bp, Homo sapiens
attgacagttgaacag

SEQ ID NO: 1410214 - DNA, 23 bp, Homo sapiens
attgacagttgaacagagctaga

SEQ ID NO: 1410215 - DNA, 18 bp, Homo sapiens
attgccaaaacccagctg

SEQ ID NO: 1410216 - DNA, 20 bp, Homo sapiens
attgccaaaacccagctgca

SEQ ID NO: 1410217 - DNA, 19 bp, Homo sapiens
attgtatatatatgtgaac

SEQ ID NO: 1410218 - DNA, 20 bp, Homo sapiens
attgtatatatatgtgaact

SEQ ID NO: 1410219 - DNA, 21 bp, Homo sapiens
attgtatatatatgtgaactt

SEQ ID NO: 1410220 - DNA, 13 bp, Homo sapiens
attgtatgttaat

SEQ ID NO: 1410221 - DNA, 16 bp, Homo sapiens
atttaaagatttaaag

SEQ ID NO: 1410222 - DNA, 20 bp, Homo sapiens
atttaaagtgccttatcaaa

SEQ ID NO: 1410223 - DNA, 20 bp, Homo sapiens
atttaagacaagttcaacaa

SEQ ID NO: 1410224 - DNA, 13 bp, Homo sapiens
atttcaatcactg

SEQ ID NO: 1410225 - DNA, 15 bp, Homo sapiens
ccaaacccaggctat

SEQ ID NO: 1410226 - DNA, 17 bp, Homo sapiens
ccaacaagttgaagaag

SEQ ID NO: 1410227 - DNA, 18 bp, Homo sapiens
ccaatatcccttacttta

SEQ ID NO: 1410228 - DNA, 23 bp, Homo sapiens
ccacagaggatgctgacatcatt

SEQ ID NO: 1410229 - DNA, 12 bp, Homo sapiens
ccacatatttca

SEQ ID NO: 1410230 - DNA, 23 bp, Homo sapiens
ccacatatttcaaaaacatgctt

SEQ ID NO: 1410231 - DNA, 16 bp, Homo sapiens
ccacatgccaggggcc

SEQ ID NO: 1410232 - DNA, 17 bp, Homo sapiens
ccacatttctaagcctt

SEQ ID NO: 1410233 - DNA, 14 bp, Homo sapiens
ccaccatctgctgt

SEQ ID NO: 1410234 - DNA, 15 bp, Homo sapiens
ccaccatctgctgtc

SEQ ID NO: 1410235 - DNA, 17 bp, Homo sapiens
ccactctctaccagata

SEQ ID NO: 1410236 - DNA, 14 bp, Homo sapiens
ccagagctggtgga

SEQ ID NO: 1410237 - DNA, 12 bp, Homo sapiens
ccagcaggccca

SEQ ID NO: 1410238 - DNA, 16 bp, Homo sapiens
ccagcattctcaggca

SEQ ID NO: 1410239 - DNA, 20 bp, Homo sapiens
ccagcattctcaggcaccag

SEQ ID NO: 1410240 - DNA, 22 bp, Homo sapiens
ccagccactccccagccagcct

SEQ ID NO: 1410241 - DNA, 16 bp, Homo sapiens
ccagccagcctggctg

SEQ ID NO: 1410242 - DNA, 17 bp, Homo sapiens
ccagccaggaagatgaa

SEQ ID NO: 1410243 - DNA, 17 bp, Homo sapiens
ccagcccaccccatggc

SEQ ID NO: 1410244 - DNA, 18 bp, Homo sapiens
ccagcccatttgggcaga

SEQ ID NO: 1410245 - DNA, 17 bp, Homo sapiens
ccagccgattcctccag

SEQ ID NO: 1410246 - DNA, 20 bp, Homo sapiens
ccagctgcaccccttcctgg

SEQ ID NO: 1410247 - DNA, 22 bp, Homo sapiens
ccaggactctgaccccagcatt

SEQ ID NO: 1410248 - DNA, 14 bp, Homo sapiens
ccaggcaagaaaag

SEQ ID NO: 1410249 - DNA, 15 bp, Homo sapiens
ccaggcaagaaaagc

SEQ ID NO: 1410250 - DNA, 20 bp, Homo sapiens
ccaggcaagaaaagcgcaga

SEQ ID NO: 1410251 - DNA, 22 bp, Homo sapiens
ccaggcaagaaaagcgcagaga

SEQ ID NO: 1410252 - DNA, 16 bp, Homo sapiens
ccaggggcctttgggt

SEQ ID NO: 1410253 - DNA, 23 bp, Homo sapiens
ccaggggcctttgggtgctgttt

SEQ ID NO: 1410254 - DNA, 19 bp, Homo sapiens
ccagggttggcaccttccc

SEQ ID NO: 1410255 - DNA, 14 bp, Homo sapiens
ccagtcccctttct

SEQ ID NO: 1410256 - DNA, 15 bp, Homo sapiens
ccagtcccctttctc

SEQ ID NO: 1410257 - DNA, 18 bp, Homo sapiens
ccagtccctgtccggaat

SEQ ID NO: 1410258 - DNA, 14 bp, Homo sapiens
ccagtttcacctct

SEQ ID NO: 1410259 - DNA, 14 bp, Homo sapiens
ccatacaccccctc

SEQ ID NO: 1410260 - DNA, 22 bp, Homo sapiens
ccatattaacaaattgcatttg

SEQ ID NO: 1410261 - DNA, 20 bp, Homo sapiens
ccatctaggatgattttccc

SEQ ID NO: 1410262 - DNA, 19 bp, Homo sapiens
ccatctggagagcccagag

SEQ ID NO: 1410263 - DNA, 21 bp, Homo sapiens
ccatggccggctttcaggagc

SEQ ID NO: 1410264 - DNA, 22 bp, Homo sapiens
ccatggccggctttcaggagct

SEQ ID NO: 1410265 - DNA, 17 bp, Homo sapiens
ccatgggaggctggagt

SEQ ID NO: 1410266 - DNA, 15 bp, Homo sapiens
ccatgtcccctccca

SEQ ID NO: 1410267 - DNA, 16 bp, Homo sapiens
ccatgtcccctcccag

SEQ ID NO: 1410268 - DNA, 15 bp, Homo sapiens
ccatgtctcctgcat

SEQ ID NO: 1410269 - DNA, 12 bp, Homo sapiens
cccaccatctgc

SEQ ID NO: 1410270 - DNA, 15 bp, Homo sapiens
cccaccatctgctgt

SEQ ID NO: 1410271 - DNA, 19 bp, Homo sapiens
cccacctgtgggccagccg

SEQ ID NO: 1410272 - DNA, 23 bp, Homo sapiens
cccagagctggtggacccaggga

SEQ ID NO: 1410273 - DNA, 18 bp, Homo sapiens
cccagctgcaccccttcc

SEQ ID NO: 1410274 - DNA, 20 bp, Homo sapiens
cccagctgcaccccttcctg

SEQ ID NO: 1410275 - DNA, 21 bp, Homo sapiens
cccatattaacaaattgcatt

SEQ ID NO: 1410276 - DNA, 22 bp, Homo sapiens
cccatctcgctccctcccagga

SEQ ID NO: 1410277 - DNA, 23 bp, Homo sapiens
cccatctcgctccctcccaggac

SEQ ID NO: 1410278 - DNA, 15 bp, Homo sapiens
cccatcttcgggacc

SEQ ID NO: 1410279 - DNA, 16 bp, Homo sapiens
cccatgggaggctgga

SEQ ID NO: 1410280 - DNA, 13 bp, Homo sapiens
cccatttgggcag

SEQ ID NO: 1410281 - DNA, 13 bp, Homo sapiens
ccccaccatctgc

SEQ ID NO: 1410282 - DNA, 19 bp, Homo sapiens
ccccaccatctgctgtctt

SEQ ID NO: 1410283 - DNA, 22 bp, Homo sapiens
ccccagcattctcaggcaccag

SEQ ID NO: 1410284 - DNA, 12 bp, Homo sapiens
ccccagccactc

SEQ ID NO: 1410285 - DNA, 14 bp, Homo sapiens
ccccagccactccc

SEQ ID NO: 1410286 - DNA, 21 bp, Homo sapiens
ccccagccactccccagccag

SEQ ID NO: 1410287 - DNA, 15 bp, Homo sapiens
ccccagcttgggcag

SEQ ID NO: 1410288 - DNA, 22 bp, Homo sapiens
ccccatctcgctccctcccagg

SEQ ID NO: 1410289 - DNA, 16 bp, Homo sapiens
ccccatcttcgggacc

SEQ ID NO: 1410290 - DNA, 18 bp, Homo sapiens
ccccatcttcgggaccag

SEQ ID NO: 1410291 - DNA, 13 bp, Homo sapiens
ccccccactccca

SEQ ID NO: 1410292 - DNA, 14 bp, Homo sapiens
cccctccctctcca

SEQ ID NO: 1410293 - DNA, 15 bp, Homo sapiens
cccctccctctccag

SEQ ID NO: 1410294 - DNA, 15 bp, Homo sapiens
cccctggccttggga

SEQ ID NO: 1410295 - DNA, 12 bp, Homo sapiens
ccctccactctc

SEQ ID NO: 1410296 - DNA, 20 bp, Homo sapiens
ccctcccaggactctgaccc

SEQ ID NO: 1410297 - DNA, 14 bp, Homo sapiens
ccctccctctccag

SEQ ID NO: 1410298 - DNA, 14 bp, Homo sapiens
ccctcttctgagca

SEQ ID NO: 1410299 - DNA, 18 bp, Homo sapiens
ccctggcatttggcctct

SEQ ID NO: 1410300 - DNA, 22 bp, Homo sapiens
ccctgtccggaatgccacccac

SEQ ID NO: 1410301 - DNA, 18 bp, Homo sapiens
cccttactttaacccttt

SEQ ID NO: 1410302 - DNA, 20 bp, Homo sapiens
ctaggaagtaaagtgaagaa

SEQ ID NO: 1410303 - DNA, 21 bp, Homo sapiens
ctaggaagtaaagtgaagaat

SEQ ID NO: 1410304 - DNA, 12 bp, Homo sapiens
ctatttttgtac

SEQ ID NO: 1410305 - DNA, 14 bp, Homo sapiens
ctcacagcatttgc

SEQ ID NO: 1410306 - DNA, 23 bp, Homo sapiens
ctcagcatatatataaaatacac

SEQ ID NO: 1410307 - DNA, 12 bp, Homo sapiens
ctcagccttgca

SEQ ID NO: 1410308 - DNA, 15 bp, Homo sapiens
ctcagccttttggga

SEQ ID NO: 1410309 - DNA, 23 bp, Homo sapiens
ctcatgaggaggggcccccctgc

SEQ ID NO: 1410310 - DNA, 19 bp, Homo sapiens
ctccaaccgggatgggagc

SEQ ID NO: 1410311 - DNA, 22 bp, Homo sapiens
ctccagcaggcccatgggaggc

SEQ ID NO: 1410312 - DNA, 18 bp, Homo sapiens
ctccagtttcacctcttt

SEQ ID NO: 1410313 - DNA, 19 bp, Homo sapiens
ctccatacacacgctgcct

SEQ ID NO: 1410314 - DNA, 13 bp, Homo sapiens
ctcccccagccac

SEQ ID NO: 1410315 - DNA, 17 bp, Homo sapiens
ctccctcccaggactct

SEQ ID NO: 1410316 - DNA, 16 bp, Homo sapiens
ctccctctccagcagg

SEQ ID NO: 1410317 - DNA, 22 bp, Homo sapiens
ctccctgactgggggcagacat

SEQ ID NO: 1410318 - DNA, 18 bp, Homo sapiens
ctcgctccctcccaggac

SEQ ID NO: 1410319 - DNA, 15 bp, Homo sapiens
ctcggatccccttcc

SEQ ID NO: 1410320 - DNA, 23 bp, Homo sapiens
ctcggatccccttcctaccaccc

SEQ ID NO: 1410321 - DNA, 16 bp, Homo sapiens
ctcggtgtccccacca

SEQ ID NO: 1410322 - DNA, 20 bp, Homo sapiens
ctcggtgtccccaccatctg

SEQ ID NO: 1410323 - DNA, 20 bp, Homo sapiens
ctctaccagataactgagga

SEQ ID NO: 1410324 - DNA, 17 bp, Homo sapiens
ctctatatatacatcat

SEQ ID NO: 1410325 - DNA, 21 bp, Homo sapiens
ctctatatatacatcatactt

SEQ ID NO: 1410326 - DNA, 21 bp, Homo sapiens
ctctccgaagtctgatccctg

SEQ ID NO: 1410327 - DNA, 22 bp, Homo sapiens
ctctccgaagtctgatccctgc

SEQ ID NO: 1410328 - DNA, 21 bp, Homo sapiens
ctcttgtagtcttggctaagg

SEQ ID NO: 1410329 - DNA, 15 bp, Homo sapiens
ctgaaacatagatag

SEQ ID NO: 1410330 - DNA, 16 bp, Homo sapiens
ctgacagcaaacacag

SEQ ID NO: 1410331 - DNA, 21 bp, Homo sapiens
ctgacatatttcataagcaca

SEQ ID NO: 1410332 - DNA, 22 bp, Homo sapiens
ctgacatatttcataagcacat

SEQ ID NO: 1410333 - DNA, 12 bp, Homo sapiens
ctgacatcattt

SEQ ID NO: 1410334 - DNA, 14 bp, Homo sapiens
ctgactgggggcag

SEQ ID NO: 1410335 - DNA, 15 bp, Homo sapiens
ctgactgggggcaga

SEQ ID NO: 1410336 - DNA, 11 bp, Homo sapiens
ctgagcacaga

SEQ ID NO: 1410337 - DNA, 13 bp, Homo sapiens
ctgagcacagatg

SEQ ID NO: 1410338 - DNA, 13 bp, Homo sapiens
ctgaggaggggag

SEQ ID NO: 1410339 - DNA, 13 bp, Homo sapiens
ctgagggcagaga

SEQ ID NO: 1410340 - DNA, 22 bp, Homo sapiens
ctgagggcagagaggttaacag

SEQ ID NO: 1410341 - DNA, 14 bp, Homo sapiens
ctgcaccccttcct

SEQ ID NO: 1410342 - DNA, 15 bp, Homo sapiens
ctgcaccccttcctg

SEQ ID NO: 1410343 - DNA, 19 bp, Homo sapiens
ctgcaccccttcctgggca

SEQ ID NO: 1410344 - DNA, 21 bp, Homo sapiens
ctgcaccccttcctgggcaca

SEQ ID NO: 1410345 - DNA, 13 bp, Homo sapiens
ctgcatagctttt

SEQ ID NO: 1410346 - DNA, 20 bp, Homo sapiens
ctgcatagcttttccctgtc

SEQ ID NO: 1410347 - DNA, 15 bp, Homo sapiens
ctgcctgtcaagttt

SEQ ID NO: 1410348 - DNA, 19 bp, Homo sapiens
ctgccttcggtacccacca

SEQ ID NO: 1410349 - DNA, 19 bp, Homo sapiens
ctgcggggcgggcacacct

SEQ ID NO: 1410350 - DNA, 22 bp, Homo sapiens
ctgctccagtttcacctctttg

SEQ ID NO: 1410351 - DNA, 19 bp, Homo sapiens
ctgctcggcaccgccagcc

SEQ ID NO: 1410352 - DNA, 16 bp, Homo sapiens
ctggagttggggcaga

SEQ ID NO: 1410353 - DNA, 19 bp, Homo sapiens
ctggcagcaccgcctcttc

SEQ ID NO: 1410354 - DNA, 19 bp, Homo sapiens
ctggccttgggatccaggc

SEQ ID NO: 1410355 - DNA, 20 bp, Homo sapiens
ctggccttgggatccaggcc

SEQ ID NO: 1410356 - DNA, 22 bp, Homo sapiens
ctggccttgggatccaggcccc

SEQ ID NO: 1410357 - DNA, 18 bp, Homo sapiens
ctggctgcggggcgggca

SEQ ID NO: 1410358 - DNA, 15 bp, Homo sapiens
ctggtggacccaggg

SEQ ID NO: 1410359 - DNA, 15 bp, Homo sapiens
ctgtacacacacaga

SEQ ID NO: 1410360 - DNA, 21 bp, Homo sapiens
ctgtacacacacagacacaca

SEQ ID NO: 1410361 - DNA, 20 bp, Homo sapiens
ctgtcctgacaccaggcaag

SEQ ID NO: 1410362 - DNA, 18 bp, Homo sapiens
ctgtgcccctggccttgg

SEQ ID NO: 1410363 - DNA, 22 bp, Homo sapiens
ctgtggggtcaacccttctgga

SEQ ID NO: 1410364 - DNA, 13 bp, Homo sapiens
cttaaaataaagt

SEQ ID NO: 1410365 - DNA, 19 bp, Homo sapiens
cttaaaataaagttaaact

SEQ ID NO: 1410366 - DNA, 20 bp, Homo sapiens
cttaccagggagatttgctc

SEQ ID NO: 1410367 - DNA, 18 bp, Homo sapiens
cttactttaaccctttct

SEQ ID NO: 1410368 - DNA, 15 bp, Homo sapiens
cttagtactcttcta

SEQ ID NO: 1410369 - DNA, 22 bp, Homo sapiens
cttcactgtcatgtgcgaacac

SEQ ID NO: 1410370 - DNA, 24 bp, Homo sapiens
cttccctttaaccctcacactgct

SEQ ID NO: 1410371 - DNA, 21 bp, Homo sapiens
cttcctgggcacacgctgctc

SEQ ID NO: 1410372 - DNA, 22 bp, Homo sapiens
cttcctgggcacacgctgctct

SEQ ID NO: 1410373 - DNA, 17 bp, Homo sapiens
taatattcatgaagagt

SEQ ID NO: 1410374 - DNA, 22 bp, Homo sapiens
taatctcaatttaagatacaaa

SEQ ID NO: 1410375 - DNA, 14 bp, Homo sapiens
taatctcacagcat

SEQ ID NO: 1410376 - DNA, 20 bp, Homo sapiens
taatctctccaccttccaaa

SEQ ID NO: 1410377 - DNA, 20 bp, Homo sapiens
taatcttgaaggaacacaaa

SEQ ID NO: 1410378 - DNA, 21 bp, Homo sapiens
taatctttgaaaactcataca

SEQ ID NO: 1410379 - DNA, 13 bp, Homo sapiens
taatgtcaaatga

SEQ ID NO: 1410380 - DNA, 14 bp, Homo sapiens
tacacacacagaca

SEQ ID NO: 1410381 - DNA, 16 bp, Homo sapiens
tacacacacagacaca

SEQ ID NO: 1410382 - DNA, 13 bp, Homo sapiens
tacacatacatat

SEQ ID NO: 1410383 - DNA, 14 bp, Homo sapiens
tacacatacatata

SEQ ID NO: 1410384 - DNA, 17 bp, Homo sapiens
tacacatacatatatac

SEQ ID NO: 1410385 - DNA, 20 bp, Homo sapiens
tacacatacatatatacatt

SEQ ID NO: 1410386 - DNA, 20 bp, Homo sapiens
tacaccccctcttctgagca

SEQ ID NO: 1410387 - DNA, 22 bp, Homo sapiens
tacaccccctcttctgagcaca

SEQ ID NO: 1410388 - DNA, 23 bp, Homo sapiens
tacagtggccttgagcttcaaaa

SEQ ID NO: 1410389 - DNA, 19 bp, Homo sapiens
tacatatatacattttgca

SEQ ID NO: 1410390 - DNA, 20 bp, Homo sapiens
tacatatatacattttgcag

SEQ ID NO: 1410391 - DNA, 13 bp, Homo sapiens
tacatctccaaat

SEQ ID NO: 1410392 - DNA, 14 bp, Homo sapiens
tacatctccaaata

SEQ ID NO: 1410393 - DNA, 14 bp, Homo sapiens
taccacaggatgca

SEQ ID NO: 1410394 - DNA, 16 bp, Homo sapiens
tacctgtacacacaca

SEQ ID NO: 1410395 - DNA, 19 bp, Homo sapiens
tacctgttgtctgaaacat

SEQ ID NO: 1410396 - DNA, 20 bp, Homo sapiens
tacgcaattgtatatatatg

SEQ ID NO: 1410397 - DNA, 13 bp, Homo sapiens
tacgttttctgca

SEQ ID NO: 1410398 - DNA, 22 bp, Homo sapiens
tactaagtaatctcacagcatt

SEQ ID NO: 1410399 - DNA, 13 bp, Homo sapiens
tactacagagaag

SEQ ID NO: 1410400 - DNA, 19 bp, Homo sapiens
tactctaaggtaaaaccat

SEQ ID NO: 1410401 - DNA, 16 bp, Homo sapiens
tacttgatttttcaaa

SEQ ID NO: 1410402 - DNA, 17 bp, Homo sapiens
tagaaacaagacaaggt

SEQ ID NO: 1410403 - DNA, 15 bp, Homo sapiens
tagaaattaagattg

SEQ ID NO: 1410404 - DNA, 17 bp, Homo sapiens
tagaagaaaatttaatt

SEQ ID NO: 1410405 - DNA, 20 bp, Homo sapiens
tagaagaaaatttaattatt

SEQ ID NO: 1410406 - DNA, 16 bp, Homo sapiens
tagcaaaaaatgaaca

SEQ ID NO: 1410407 - DNA, 20 bp, Homo sapiens
tagcacatgatttgggctct

SEQ ID NO: 1410408 - DNA, 21 bp, Homo sapiens
tagcatttagatctacactct

SEQ ID NO: 1410409 - DNA, 11 bp, Homo sapiens
tagccagccag

SEQ ID NO: 1410410 - DNA, 19 bp, Homo sapiens
tagccagtgctagttctga

SEQ ID NO: 1410411 - DNA, 15 bp, Homo sapiens
tagctttaattaagc

SEQ ID NO: 1410412 - DNA, 12 bp, Homo sapiens
tagtcttggcta

SEQ ID NO: 1410413 - DNA, 13 bp, Homo sapiens
tagtcttggctaa

SEQ ID NO: 1410414 - DNA, 16 bp, Homo sapiens
tagttagtgattatat

SEQ ID NO: 1410415 - DNA, 19 bp, Homo sapiens
tagttttgtgatgcatttt

SEQ ID NO: 1410416 - DNA, 14 bp, Homo sapiens
tataaaatacacgt

SEQ ID NO: 1410417 - DNA, 14 bp, Homo sapiens
tataaccacatttc

SEQ ID NO: 1410418 - DNA, 18 bp, Homo sapiens
tataaccacatttctaag

SEQ ID NO: 1410419 - DNA, 12 bp, Homo sapiens
tatacacacagg

SEQ ID NO: 1410420 - DNA, 20 bp, Homo sapiens
tatacatacgcaattgtata

SEQ ID NO: 1410421 - DNA, 22 bp, Homo sapiens
tatacatacgcaattgtatata

SEQ ID NO: 1410422 - DNA, 14 bp, Homo sapiens
tatacatttaaaga

SEQ ID NO: 1410423 - DNA, 19 bp, Homo sapiens
tatactttgctgttgaaga

SEQ ID NO: 1410424 - DNA, 20 bp, Homo sapiens
tatactttgctgttgaagaa

SEQ ID NO: 1410425 - DNA, 18 bp, Homo sapiens
tatataaccacatttcta

SEQ ID NO: 1410426 - DNA, 21 bp, Homo sapiens
tatatacatcatacttaactt

SEQ ID NO: 1410427 - DNA, 13 bp, Homo sapiens
tatatataaaata

SEQ ID NO: 1410428 - DNA, 20 bp, Homo sapiens
tatatatgtgaactttctca

SEQ ID NO: 1410429 - DNA, 16 bp, Homo sapiens
tatatgtgaactttct

SEQ ID NO: 1410430 - DNA, 15 bp, Homo sapiens
tatatgtttatacac

SEQ ID NO: 1410431 - DNA, 20 bp, Homo sapiens
tatcatcacaaatggctaca

SEQ ID NO: 1410432 - DNA, 12 bp, Homo sapiens
tatcatctaaat

SEQ ID NO: 1410433 - DNA, 17 bp, Homo sapiens
tatcatctaaatattat

SEQ ID NO: 1410434 - DNA, 21 bp, Homo sapiens
tatcatggcagcatgcgatgt

SEQ ID NO: 1410435 - DNA, 16 bp, Homo sapiens
tatcattcttataaca

SEQ ID NO: 1410436 - DNA, 22 bp, Homo sapiens
tatcattcttataacattgtat

SEQ ID NO: 1410437 - DNA, 14 bp, Homo sapiens
tgtatgtgtatatg

SEQ ID NO: 1410438 - DNA, 11 bp, Homo sapiens
tgtccccacca

SEQ ID NO: 1410439 - DNA, 14 bp, Homo sapiens
tgtccccaccatct

SEQ ID NO: 1410440 - DNA, 17 bp, Homo sapiens
tgtccccaccatctgct

SEQ ID NO: 1410441 - DNA, 12 bp, Homo sapiens
tgtcccctccca

SEQ ID NO: 1410442 - DNA, 13 bp, Homo sapiens
tgtcccctcccag

SEQ ID NO: 1410443 - DNA, 17 bp, Homo sapiens
tgtccggaatgccaccc

SEQ ID NO: 1410444 - DNA, 18 bp, Homo sapiens
tgtctagggtgtgattta

SEQ ID NO: 1410445 - DNA, 16 bp, Homo sapiens
tgtcttgtattatcat

SEQ ID NO: 1410446 - DNA, 17 bp, Homo sapiens
tgtgaactttctcagca

SEQ ID NO: 1410447 - DNA, 24 bp, Homo sapiens
tgtgggccagccgattcctccagc

SEQ ID NO: 1410448 - DNA, 20 bp, Homo sapiens
tgtgtatatgtttatacaca

SEQ ID NO: 1410449 - DNA, 20 bp, Homo sapiens
tgtgtatggaagacaaatac

SEQ ID NO: 1410450 - DNA, 20 bp, Homo sapiens
tgttagaagaggtggcccca

SEQ ID NO: 1410451 - DNA, 22 bp, Homo sapiens
tgttgagacctcagcttggcac

SEQ ID NO: 1410452 - DNA, 16 bp, Homo sapiens
tgttttgccagcccat

SEQ ID NO: 1410453 - DNA, 17 bp, Homo sapiens
tgttttgccagcccatt

SEQ ID NO: 1410454 - DNA, 19 bp, Homo sapiens
ttaaaaagcatcattacaa

SEQ ID NO: 1410455 - DNA, 15 bp, Homo sapiens
ttaaaatgaaatgca

SEQ ID NO: 1410456 - DNA, 20 bp, Homo sapiens
ttaacactgagtgaaatatt

SEQ ID NO: 1410457 - DNA, 13 bp, Homo sapiens
ttaacagatttat

SEQ ID NO: 1410458 - DNA, 20 bp, Homo sapiens
ttaactgcattttacacatt

SEQ ID NO: 1410459 - DNA, 22 bp, Homo sapiens
ttaagattgaagctaaaacact

SEQ ID NO: 1410460 - DNA, 16 bp, Homo sapiens
ttaagctctcatagct

SEQ ID NO: 1410461 - DNA, 20 bp, Homo sapiens
ttaatcttgaaggaacacaa

SEQ ID NO: 1410462 - DNA, 12 bp, Homo sapiens
ttaattgaaagg

SEQ ID NO: 1410463 - DNA, 17 bp, Homo sapiens
ttaccacaggatgcata

SEQ ID NO: 1410464 - DNA, 17 bp, Homo sapiens
ttactttaaccctttct

SEQ ID NO: 1410465 - DNA, 14 bp, Homo sapiens
ttagctttaattaa

SEQ ID NO: 1410466 - DNA, 19 bp, Homo sapiens
ttagctttaattaagctct

SEQ ID NO: 1410467 - DNA, 20 bp, Homo sapiens
ttatctaaggtccccagcag

SEQ ID NO: 1410468 - DNA, 22 bp, Homo sapiens
ttattgccaaaacccagctgca

SEQ ID NO: 1410469 - DNA, 18 bp, Homo sapiens
ttatttttggcaaagcca

SEQ ID NO: 1410470 - DNA, 17 bp, Homo sapiens
ttcacctctttgctccc

SEQ ID NO: 1410471 - DNA, 21 bp, Homo sapiens
ttcagattccccactcagcct

SEQ ID NO: 1410472 - DNA, 16 bp, Homo sapiens
ttcatttaacactgag

SEQ ID NO: 1410473 - DNA, 23 bp, Homo sapiens
ttcatttaacactgagtgaaata

SEQ ID NO: 1410474 - DNA, 16 bp, Homo sapiens
ttccagtcccctttct

SEQ ID NO: 1410475 - DNA, 17 bp, Homo sapiens
ttccagtcccctttctc

SEQ ID NO: 1410476 - DNA, 17 bp, Homo sapiens
ttccccactcagccttt

SEQ ID NO: 1410477 - DNA, 19 bp, Homo sapiens
ttcccgccgcccagcccac

SEQ ID NO: 1410478 - DNA, 23 bp, Homo sapiens
ttccctttaaccctcacactgct

SEQ ID NO: 1410479 - DNA, 18 bp, Homo sapiens
ttctactgttcaatttca

SEQ ID NO: 1410480 - DNA, 13 bp, Homo sapiens
ttctgggatgcaa

SEQ ID NO: 1410481 - DNA, 19 bp, Homo sapiens
ttctgggatgcaatactag

SEQ ID NO: 1410482 - DNA, 19 bp, Homo sapiens
ttctttgccatctctgctc

SEQ ID NO: 1410483 - DNA, 17 bp, Homo sapiens
ttcttttttaattgaaa

SEQ ID NO: 1410484 - DNA, 16 bp, Homo sapiens
ttgaagctaaaacact

SEQ ID NO: 1410485 - DNA, 13 bp, Homo sapiens
ttgacaatgacaa

SEQ ID NO: 1410486 - DNA, 20 bp, Homo sapiens
ttgatttttcaaagacttca

SEQ ID NO: 1410487 - DNA, 15 bp, Homo sapiens
ttgcacctgcagcca

SEQ ID NO: 1410488 - DNA, 22 bp, Homo sapiens
ttgcacctgcagccaagcaaat

SEQ ID NO: 1410489 - DNA, 18 bp, Homo sapiens
ttgccaaaacccagctgc

SEQ ID NO: 1410490 - DNA, 23 bp, Homo sapiens
ttgccaaaacccagctgcacccc

SEQ ID NO: 1410491 - DNA, 20 bp, Homo sapiens
ttggcctcttgtagtcttgg

SEQ ID NO: 1410492 - DNA, 19 bp, Homo sapiens
ttgggctctagaattccag

SEQ ID NO: 1410493 - DNA, 20 bp, Homo sapiens
ttgtagaagaaaatttaatt

SEQ ID NO: 1410494 - DNA, 15 bp, Homo sapiens
ttgtatatatatgtg

SEQ ID NO: 1410495 - DNA, 20 bp, Homo sapiens
ttgttatacatttaaagatt

SEQ ID NO: 1410496 - DNA, 19 bp, Homo sapiens
tttaaaatgaaatgcattt

SEQ ID NO: 1410497 - DNA, 14 bp, Homo sapiens
tttaagatacaaat

SEQ ID NO: 1410498 - DNA, 19 bp, Homo sapiens
tttataatgtcaaatgaaa

SEQ ID NO: 1410499 - DNA, 19 bp, Homo sapiens
tttatacctgtacacacac

SEQ ID NO: 1410500 - DNA, 17 bp, Homo sapiens
tttatctaaggtcccca

SEQ ID NO: 1410501 - DNA, 21 bp, Homo sapiens
tttatctaaggtccccagcag

SEQ ID NO: 1410502 - DNA, 12 bp, Homo sapiens
tttatttatctt

SEQ ID NO: 1410503 - DNA, 19 bp, Homo sapiens
tttcaaagacttcatttaa

SEQ ID NO: 1410504 - DNA, 20 bp, Homo sapiens
tttcaaagacttcatttaac

SEQ ID NO: 1410505 - DNA, 17 bp, Homo sapiens
tttcaatcactgaaaat

SEQ ID NO: 1410506 - DNA, 20 bp, Homo sapiens
tttcacccatctctcaggaa

SEQ ID NO: 1410507 - DNA, 15 bp, Homo sapiens
tttctcagcatatat

SEQ ID NO: 1410508 - DNA, 15 bp, Homo sapiens
tttctttgccatctc

SEQ ID NO: 1410509 - DNA, 18 bp, Homo sapiens
tttcttttttaattgaaa

SEQ ID NO: 1410510 - DNA, 20 bp, Homo sapiens
tttgcagaatgatgcaggtt

SEQ ID NO: 1410511 - DNA, 13 bp, Homo sapiens
tagtttgtttctg

SEQ ID NO: 1410512 - DNA, 20 bp, Homo sapiens
tataaaatacacgtgtatat

SEQ ID NO: 1410513 - DNA, 21 bp, Homo sapiens
tataaaatacacgtgtatatg

SEQ ID NO: 1410514 - DNA, 23 bp, Homo sapiens
tataaaatacacgtgtatatgag

SEQ ID NO: 1410515 - DNA, 16 bp, Homo sapiens
tatacagtgtgtagtt

SEQ ID NO: 1410516 - DNA, 21 bp, Homo sapiens
tatacatacgcaattgtatat

SEQ ID NO: 1410517 - DNA, 16 bp, Homo sapiens
tatacctgtacacaca

SEQ ID NO: 1410518 - DNA, 18 bp, Homo sapiens
tatacctgtacacacaca

SEQ ID NO: 1410519 - DNA, 15 bp, Homo sapiens
tatataaaatacacg

SEQ ID NO: 1410520 - DNA, 17 bp, Homo sapiens
tatataaaatacacgtg

SEQ ID NO: 1410521 - DNA, 20 bp, Homo sapiens
tatataaaatacacgtgtat

SEQ ID NO: 1410522 - DNA, 21 bp, Homo sapiens
tatataaaatacacgtgtata

SEQ ID NO: 1410523 - DNA, 22 bp, Homo sapiens
tatataaaatacacgtgtatat

SEQ ID NO: 1410524 - DNA, 22 bp, Homo sapiens
tatatataaaatacacgtgtat

SEQ ID NO: 1410525 - DNA, 13 bp, Homo sapiens
tatatatatgtga

SEQ ID NO: 1410526 - DNA, 22 bp, Homo sapiens
tatatgtatatttaccaagatt

SEQ ID NO: 1410527 - DNA, 16 bp, Homo sapiens
tatatgtttatacaca

SEQ ID NO: 1410528 - DNA, 16 bp, Homo sapiens
tatcaaataatattca

SEQ ID NO: 1410529 - DNA, 20 bp, Homo sapiens
tatcatccccaaatgtgtct

SEQ ID NO: 1410530 - DNA, 21 bp, Homo sapiens
tatccaattttaaaatgaaat

SEQ ID NO: 1410531 - DNA, 23 bp, Homo sapiens
tatcccttactttaaccctttct

SEQ ID NO: 1410532 - DNA, 23 bp, Homo sapiens
tatctctttagttagtgattata

SEQ ID NO: 1410533 - DNA, 16 bp, Homo sapiens
tatgaggatgtatgtg

SEQ ID NO: 1410534 - DNA, 19 bp, Homo sapiens
tatgaggatgtatgtgtat

SEQ ID NO: 1410535 - DNA, 16 bp, Homo sapiens
tatgcaataaatatta

SEQ ID NO: 1410536 - DNA, 21 bp, Homo sapiens
tatggaagacaaatacacata

SEQ ID NO: 1410537 - DNA, 22 bp, Homo sapiens
tatggaagacaaatacacatac

SEQ ID NO: 1410538 - DNA, 19 bp, Homo sapiens
tatggacaatttaccacag

SEQ ID NO: 1410539 - DNA, 10 bp, Homo sapiens
tatgtgtata

SEQ ID NO: 1410540 - DNA, 16 bp, Homo sapiens
tatgtttatacacaca

SEQ ID NO: 1410541 - DNA, 17 bp, Homo sapiens
tatgtttatacacacag

SEQ ID NO: 1410542 - DNA, 18 bp, Homo sapiens
tattaacaaattgcattt

SEQ ID NO: 1410543 - DNA, 20 bp, Homo sapiens
tattaacaaattgcatttgt

SEQ ID NO: 1410544 - DNA, 16 bp, Homo sapiens
tattatgccttgagaa

SEQ ID NO: 1410545 - DNA, 15 bp, Homo sapiens
tattttatttatctt

SEQ ID NO: 1410546 - DNA, 16 bp, Homo sapiens
tatttttggcaaagcc

SEQ ID NO: 1410547 - DNA, 21 bp, Homo sapiens
tcaaaaacatgcttttccaaa

SEQ ID NO: 1410548 - DNA, 20 bp, Homo sapiens
tcaaagacttcatttaacac

SEQ ID NO: 1410549 - DNA, 23 bp, Homo sapiens
tcaaagacttcatttaacactga

SEQ ID NO: 1410550 - DNA, 23 bp, Homo sapiens
tcaaataatattcatgaagagtt

SEQ ID NO: 1410551 - DNA, 23 bp, Homo sapiens
tcaaatgaaacctacaggaatct

SEQ ID NO: 1410552 - DNA, 16 bp, Homo sapiens
tcaatacctggcctca

SEQ ID NO: 1410553 - DNA, 15 bp, Homo sapiens
tcaatcactgaaaat

SEQ ID NO: 1410554 - DNA, 23 bp, Homo sapiens
tcaatttcagaaactaagaatca

SEQ ID NO: 1410555 - DNA, 13 bp, Homo sapiens
tcacagcatttgc

SEQ ID NO: 1410556 - DNA, 16 bp, Homo sapiens
tcacctctttgctccc

SEQ ID NO: 1410557 - DNA, 17 bp, Homo sapiens
tcacctctttgctccct

SEQ ID NO: 1410558 - DNA, 18 bp, Homo sapiens
tcagaatggaatgctctg

SEQ ID NO: 1410559 - DNA, 15 bp, Homo sapiens
tcagaatttccctct

SEQ ID NO: 1410560 - DNA, 14 bp, Homo sapiens
tcagattccccact

SEQ ID NO: 1410561 - DNA, 20 bp, Homo sapiens
tccccagccagcctggctgg

SEQ ID NO: 1410562 - DNA, 14 bp, Homo sapiens
tcccccagccactc

SEQ ID NO: 1410563 - DNA, 23 bp, Homo sapiens
tcccccatctcgctccctcccag

SEQ ID NO: 1410564 - DNA, 14 bp, Homo sapiens
tccccctcccccag

SEQ ID NO: 1410565 - DNA, 13 bp, Homo sapiens
tcccctcccagag

SEQ ID NO: 1410566 - DNA, 21 bp, Homo sapiens
tcccctgctcggcaccgccag

SEQ ID NO: 1410567 - DNA, 14 bp, Homo sapiens
tccctcccaggact

SEQ ID NO: 1410568 - DNA, 15 bp, Homo sapiens
tccctctccagcagg

SEQ ID NO: 1410569 - DNA, 12 bp, Homo sapiens
tccctgactggg

SEQ ID NO: 1410570 - DNA, 17 bp, Homo sapiens
tccgaaatgctgtcttt

SEQ ID NO: 1410571 - DNA, 16 bp, Homo sapiens
tccgtcactacctggc

SEQ ID NO: 1410572 - DNA, 22 bp, Homo sapiens
tcctgacaccaggcaagaaaag

SEQ ID NO: 1410573 - DNA, 22 bp, Homo sapiens
tcctgcatagcttttccctgtc

SEQ ID NO: 1410574 - DNA, 15 bp, Homo sapiens
tcctgggcacacgct

SEQ ID NO: 1410575 - DNA, 15 bp, Homo sapiens
tccttcacatcaccc

SEQ ID NO: 1410576 - DNA, 19 bp, Homo sapiens
tcctttatgtgatgtaact

SEQ ID NO: 1410577 - DNA, 19 bp, Homo sapiens
tcgcccacctgtgggccag

SEQ ID NO: 1410578 - DNA, 15 bp, Homo sapiens
tcgctccctcccagg

SEQ ID NO: 1410579 - DNA, 17 bp, Homo sapiens
tcgctccctcccaggac

SEQ ID NO: 1410580 - DNA, 13 bp, Homo sapiens
tcggatccccttc

SEQ ID NO: 1410581 - DNA, 20 bp, Homo sapiens
tcggtgtccccaccatctgc

SEQ ID NO: 1410582 - DNA, 15 bp, Homo sapiens
tcgtatggatttcta

SEQ ID NO: 1410583 - DNA, 17 bp, Homo sapiens
tctaagcctttgagact

SEQ ID NO: 1410584 - DNA, 17 bp, Homo sapiens
tctagaacaattacatg

SEQ ID NO: 1410585 - DNA, 20 bp, Homo sapiens
tctatatatacatcatactt

SEQ ID NO: 1410586 - DNA, 13 bp, Homo sapiens
tctattgaataat

SEQ ID NO: 1410587 - DNA, 14 bp, Homo sapiens
tctccaccttccaa

SEQ ID NO: 1410588 - DNA, 17 bp, Homo sapiens
tctccgaaatgctgtct

SEQ ID NO: 1410589 - DNA, 14 bp, Homo sapiens
tctcctcaggacca

SEQ ID NO: 1410590 - DNA, 13 bp, Homo sapiens
tctctaccagata

SEQ ID NO: 1410591 - DNA, 23 bp, Homo sapiens
tctgacgattttggaaatgagaa

SEQ ID NO: 1410592 - DNA, 18 bp, Homo sapiens
tctgccccagcttgggca

SEQ ID NO: 1410593 - DNA, 20 bp, Homo sapiens
tctgccccccccccccatct

SEQ ID NO: 1410594 - DNA, 20 bp, Homo sapiens
tcttaccagggagatttgct

SEQ ID NO: 1410595 - DNA, 18 bp, Homo sapiens
tcttagcaaaaaatgaac

SEQ ID NO: 1410596 - DNA, 18 bp, Homo sapiens
tcttataacattgtatgt

SEQ ID NO: 1410597 - DNA, 21 bp, Homo sapiens
tcttataacattgtatgttaa

SEQ ID NO: 1410598 - DNA, 21 bp, Homo sapiens
tctttagttagtgattatatt

SEQ ID NO: 1410599 - DNA, 14 bp, Homo sapiens
tctttgaaaactca

SEQ ID NO: 1410600 - DNA, 13 bp, Homo sapiens
tctttgccatctc

SEQ ID NO: 1410601 - DNA, 18 bp, Homo sapiens
tcttttctttgccatctc

SEQ ID NO: 1410602 - DNA, 20 bp, Homo sapiens
tcttttctttgccatctctg

SEQ ID NO: 1410603 - DNA, 15 bp, Homo sapiens
tcttttgaaaactca

SEQ ID NO: 1410604 - DNA, 16 bp, Homo sapiens
tgaaaactcatcggga

SEQ ID NO: 1410605 - DNA, 14 bp, Homo sapiens
tgaaacacaatatc

SEQ ID NO: 1410606 - DNA, 12 bp, Homo sapiens
tgaaatgcattt

SEQ ID NO: 1410607 - DNA, 13 bp, Homo sapiens
tgaaatgcatttt

SEQ ID NO: 1410608 - DNA, 22 bp, Homo sapiens
tgaagatcggctttcatgtaat

SEQ ID NO: 1410609 - DNA, 14 bp, Homo sapiens
tgaagctaaaacac

SEQ ID NO: 1410610 - DNA, 23 bp, Homo sapiens
tgaaggaacacaaagatcaaatg

SEQ ID NO: 1410611 - DNA, 23 bp, Homo sapiens
tgaatggcatctcgttgtaagta

SEQ ID NO: 1410612 - DNA, 15 bp, Homo sapiens
tgacagcaaacacag

SEQ ID NO: 1410613 - DNA, 18 bp, Homo sapiens
tgacagcaaacacagtca

SEQ ID NO: 1410614 - DNA, 22 bp, Homo sapiens
tgacatttcaatcactgaaaat

SEQ ID NO: 1410615 - DNA, 16 bp, Homo sapiens
tgacgattttggaaat

SEQ ID NO: 1410616 - DNA, 22 bp, Homo sapiens
tgagaatgagggcgtgaaacac

SEQ ID NO: 1410617 - DNA, 16 bp, Homo sapiens
tgagctggtcccctct

SEQ ID NO: 1410618 - DNA, 16 bp, Homo sapiens
tgagcttcaaaatgag

SEQ ID NO: 1410619 - DNA, 14 bp, Homo sapiens
tgaggatgtatgtg

SEQ ID NO: 1410620 - DNA, 17 bp, Homo sapiens
tgaggatgtatgtgtat

SEQ ID NO: 1410621 - DNA, 18 bp, Homo sapiens
tgaggatgtatgtgtata

SEQ ID NO: 1410622 - DNA, 18 bp, Homo sapiens
tgagggcgtgaaacacaa

SEQ ID NO: 1410623 - DNA, 19 bp, Homo sapiens
tgagggcgtgaaacacaat

SEQ ID NO: 1410624 - DNA, 15 bp, Homo sapiens
tgagtgaaatattac

SEQ ID NO: 1410625 - DNA, 21 bp, Homo sapiens
tgatatccaacagaaagcata

SEQ ID NO: 1410626 - DNA, 15 bp, Homo sapiens
tgatccctgccaaaa

SEQ ID NO: 1410627 - DNA, 15 bp, Homo sapiens
tgatgctaagtgatg

SEQ ID NO: 1410628 - DNA, 21 bp, Homo sapiens
tgattcttagcaaaaaatgaa

SEQ ID NO: 1410629 - DNA, 20 bp, Homo sapiens
tgatttttcaaagacttcat

SEQ ID NO: 1410630 - DNA, 10 bp, Homo sapiens
aaaaaaaaga

SEQ ID NO: 1410631 - DNA, 10 bp, Homo sapiens
aaaaaaagaa

SEQ ID NO: 1410632 - DNA, 16 bp, Homo sapiens
aaaaatcagaaagaca

SEQ ID NO: 1410633 - DNA, 16 bp, Homo sapiens
aaaacatgcttttcca

SEQ ID NO: 1410634 - DNA, 16 bp, Homo sapiens
aaaagatctttcattt

SEQ ID NO: 1410635 - DNA, 18 bp, Homo sapiens
aaaagatctttcattttg

SEQ ID NO: 1410636 - DNA, 21 bp, Homo sapiens
aaaatcagaatggaatgctct

SEQ ID NO: 1410637 - DNA, 17 bp, Homo sapiens
aaaatgaaatgcatttt

SEQ ID NO: 1410638 - DNA, 15 bp, Homo sapiens
aaaatgagatatgca

SEQ ID NO: 1410639 - DNA, 18 bp, Homo sapiens
aaaatgagatatgcaata

SEQ ID NO: 1410640 - DNA, 14 bp, Homo sapiens
aaaattgatgctaa

SEQ ID NO: 1410641 - DNA, 11 bp, Homo sapiens
aaaatttaatt

SEQ ID NO: 1410642 - DNA, 18 bp, Homo sapiens
aaacatgcttttccaaac

SEQ ID NO: 1410643 - DNA, 18 bp, Homo sapiens
aaacatttgctctggggg

SEQ ID NO: 1410644 - DNA, 19 bp, Homo sapiens
aaactttcaagtattatat

SEQ ID NO: 1410645 - DNA, 21 bp, Homo sapiens
aaactttcaagtattatattt

SEQ ID NO: 1410646 - DNA, 9 bp, Homo sapiens
aaagaaaag

SEQ ID NO: 1410647 - DNA, 14 bp, Homo sapiens
aaagaaaagagaaa

SEQ ID NO: 1410648 - DNA, 15 bp, Homo sapiens
aaagaaaagagaaaa

SEQ ID NO: 1410649 - DNA, 13 bp, Homo sapiens
aaagaaagtcata

SEQ ID NO: 1410650 - DNA, 21 bp, Homo sapiens
aaagacttcatttaacactga

SEQ ID NO: 1410651 - DNA, 14 bp, Homo sapiens
aaagatctttcatt

SEQ ID NO: 1410652 - DNA, 16 bp, Homo sapiens
aaaggcttcttggctt

SEQ ID NO: 1410653 - DNA, 21 bp, Homo sapiens
aaagtgccttatcaaataata

SEQ ID NO: 1410654 - DNA, 22 bp, Homo sapiens
aaagtgccttatcaaataatat

SEQ ID NO: 1410655 - DNA, 21 bp, Homo sapiens
aaataatattcatgaagagtt

SEQ ID NO: 1410656 - DNA, 16 bp, Homo sapiens
aaatacacatacatat

SEQ ID NO: 1410657 - DNA, 15 bp, Homo sapiens
aaatagctcttgctt

SEQ ID NO: 1410658 - DNA, 21 bp, Homo sapiens
aaatagctcttgctttgactt

SEQ ID NO: 1410659 - DNA, 12 bp, Homo sapiens
aaatattatgcc

SEQ ID NO: 1410660 - DNA, 14 bp, Homo sapiens
aaatgaaatgcatt

SEQ ID NO: 1410661 - DNA, 15 bp, Homo sapiens
aaatgaaatgcattt

SEQ ID NO: 1410662 - DNA, 17 bp, Homo sapiens
aaatgtgtcttgtatta

SEQ ID NO: 1410663 - DNA, 12 bp, Homo sapiens
aaattgcatttg

SEQ ID NO: 1410664 - DNA, 15 bp, Homo sapiens
aaatttaattatttg

SEQ ID NO: 1410665 - DNA, 17 bp, Homo sapiens
aaatttcaacagttatt

SEQ ID NO: 1410666 - DNA, 15 bp, Homo sapiens
aaatttgcttttatt

SEQ ID NO: 1410667 - DNA, 14 bp, Homo sapiens
aacaagacttcaga

SEQ ID NO: 1410668 - DNA, 17 bp, Homo sapiens
aacaagacttcagattc

SEQ ID NO: 1410669 - DNA, 22 bp, Homo sapiens
aacaattacatgtaaacaaata

SEQ ID NO: 1410670 - DNA, 21 bp, Homo sapiens
aacacagatgtgttgcaaagg

SEQ ID NO: 1410671 - DNA, 15 bp, Homo sapiens
aacagaaagcataga

SEQ ID NO: 1410672 - DNA, 18 bp, Homo sapiens
aacagccactcccctcca

SEQ ID NO: 1410673 - DNA, 24 bp, Homo sapiens
aacatccaagtggcctccgtcact

SEQ ID NO: 1410674 - DNA, 11 bp, Homo sapiens
aacccagctgc

SEQ ID NO: 1410675 - DNA, 21 bp, Homo sapiens
aacccagctgcaccccttcct

SEQ ID NO: 1410676 - DNA, 14 bp, Homo sapiens
aaccctggcatttg

SEQ ID NO: 1410677 - DNA, 13 bp, Homo sapiens
aaccgggatggga

SEQ ID NO: 1410678 - DNA, 21 bp, Homo sapiens
aactactaatctcaatttaag

SEQ ID NO: 1410679 - DNA, 12 bp, Homo sapiens
aactcatacagt

SEQ ID NO: 1410680 - DNA, 16 bp, Homo sapiens
aactcggtgtccccac

SEQ ID NO: 1410681 - DNA, 23 bp, Homo sapiens
aactcggtgtccccaccatctgc

SEQ ID NO: 1410682 - DNA, 16 bp, Homo sapiens
aactgagggcagagag

SEQ ID NO: 1410683 - DNA, 20 bp, Homo sapiens
aactgagggcagagaggtta

SEQ ID NO: 1410684 - DNA, 20 bp, Homo sapiens
aactttcaagtattatattt

SEQ ID NO: 1410685 - DNA, 21 bp, Homo sapiens
aactttctcagcatatatata

SEQ ID NO: 1410686 - DNA, 20 bp, Homo sapiens
aagaaatttcaacagttatt

SEQ ID NO: 1410687 - DNA, 15 bp, Homo sapiens
aagacattcttagtt

SEQ ID NO: 1410688 - DNA, 14 bp, Homo sapiens
aagacccagacagg

SEQ ID NO: 1410689 - DNA, 15 bp, Homo sapiens
aagactagccagcca

SEQ ID NO: 1410690 - DNA, 14 bp, Homo sapiens
aagacttcagattc

SEQ ID NO: 1410691 - DNA, 15 bp, Homo sapiens
aagacttcagattcc

SEQ ID NO: 1410692 - DNA, 11 bp, Homo sapiens
aagagaaaaaa

SEQ ID NO: 1410693 - DNA, 20 bp, Homo sapiens
aagaggtggccccatattaa

SEQ ID NO: 1410694 - DNA, 17 bp, Homo sapiens
aagagtaacagtcatca

SEQ ID NO: 1410695 - DNA, 23 bp, Homo sapiens
aagagtgctaagcattagcttta

SEQ ID NO: 1410696 - DNA, 13 bp, Homo sapiens
aagatacaaataa

SEQ ID NO: 1410697 - DNA, 20 bp, Homo sapiens
aagatcggctttcatgtaat

SEQ ID NO: 1410698 - DNA, 22 bp, Homo sapiens
aagatctttcattttgcacctg

SEQ ID NO: 1410699 - DNA, 18 bp, Homo sapiens
aagcaaatgcctgccaaa

SEQ ID NO: 1410700 - DNA, 18 bp, Homo sapiens
aagcaatttcagttttaa

SEQ ID NO: 1410701 - DNA, 22 bp, Homo sapiens
aagcaatttcagttttaaaaat

SEQ ID NO: 1410702 - DNA, 22 bp, Homo sapiens
aagcagacacacacatatatac

SEQ ID NO: 1410703 - DNA, 20 bp, Homo sapiens
aagcagtgaagcaatttcag

SEQ ID NO: 1410704 - DNA, 15 bp, Homo sapiens
aagcattagctttaa

SEQ ID NO: 1410705 - DNA, 19 bp, Homo sapiens
aagcctttgagactgttcc

SEQ ID NO: 1410706 - DNA, 16 bp, Homo sapiens
aagctctcatagctca

SEQ ID NO: 1410707 - DNA, 17 bp, Homo sapiens
aagctctcatagctcat

SEQ ID NO: 1410708 - DNA, 14 bp, Homo sapiens
aaggaaattctaac

SEQ ID NO: 1410709 - DNA, 16 bp, Homo sapiens
aaggtccccagcagaa

SEQ ID NO: 1410710 - DNA, 21 bp, Homo sapiens
aagtatcatctaaatattatg

SEQ ID NO: 1410711 - DNA, 22 bp, Homo sapiens
aagtattatattttatttatct

SEQ ID NO: 1410712 - DNA, 20 bp, Homo sapiens
aagtctcccaatatccaatt

SEQ ID NO: 1410713 - DNA, 19 bp, Homo sapiens
aagtgccttatcaaataat

SEQ ID NO: 1410714 - DNA, 23 bp, Homo sapiens
aagtggcctccgtcactacctgg

SEQ ID NO: 1410715 - DNA, 13 bp, Homo sapiens
aagtggctggaag

SEQ ID NO: 1410716 - DNA, 18 bp, Homo sapiens
aagtggctggaagagtcc

SEQ ID NO: 1410717 - DNA, 14 bp, Homo sapiens
aagttaaactgatt

SEQ ID NO: 1410718 - DNA, 23 bp, Homo sapiens
aagtttttatacctgtacacaca

SEQ ID NO: 1410719 - DNA, 13 bp, Homo sapiens
aataaatattatt

SEQ ID NO: 1410720 - DNA, 20 bp, Homo sapiens
aataaatttgcttttatttt

SEQ ID NO: 1410721 - DNA, 17 bp, Homo sapiens
aatacacatacatatat

SEQ ID NO: 1410722 - DNA, 16 bp, Homo sapiens
aatacacgtgtatatg

SEQ ID NO: 1410723 - DNA, 17 bp, Homo sapiens
aatacacgtgtatatga

SEQ ID NO: 1410724 - DNA, 20 bp, Homo sapiens
aatacacgtgtatatgagga

SEQ ID NO: 1410725 - DNA, 15 bp, Homo sapiens
aatagaaaatatatt

SEQ ID NO: 1410726 - DNA, 11 bp, Homo sapiens
aatagctcttg

SEQ ID NO: 1410727 - DNA, 18 bp, Homo sapiens
aatatatttgcataatat

SEQ ID NO: 1410728 - DNA, 14 bp, Homo sapiens
aatatgcatatata

SEQ ID NO: 1410729 - DNA, 16 bp, Homo sapiens
aatatgcatatatatg

SEQ ID NO: 1410730 - DNA, 21 bp, Homo sapiens
aatatgcatatatatgtatat

SEQ ID NO: 1410731 - DNA, 13 bp, Homo sapiens
aatcagaaagaca

SEQ ID NO: 1410732 - DNA, 14 bp, Homo sapiens
aatcagaatggaat

SEQ ID NO: 1410733 - DNA, 18 bp, Homo sapiens
aatcatcctcatgccttt

SEQ ID NO: 1410734 - DNA, 15 bp, Homo sapiens
aatctcacagcattt

SEQ ID NO: 1410735 - DNA, 15 bp, Homo sapiens
aatctctccaccttc

SEQ ID NO: 1410736 - DNA, 14 bp, Homo sapiens
aatgaaatgcattt

SEQ ID NO: 1410737 - DNA, 15 bp, Homo sapiens
aatgaaatgcatttt

SEQ ID NO: 1410738 - DNA, 22 bp, Homo sapiens
aatgaagatcggctttcatgta

SEQ ID NO: 1410739 - DNA, 20 bp, Homo sapiens
aatgagggcgtgaaacacaa

SEQ ID NO: 1410740 - DNA, 22 bp, Homo sapiens
aatgagggcgtgaaacacaata

SEQ ID NO: 1410741 - DNA, 17 bp, Homo sapiens
aatgctgtctttcttgc

SEQ ID NO: 1410742 - DNA, 21 bp, Homo sapiens
aatgctgtctttcttgctccc

SEQ ID NO: 1410743 - DNA, 18 bp, Homo sapiens
aatggctacatctccaaa

SEQ ID NO: 1410744 - DNA, 18 bp, Homo sapiens
aatgtaatagaagcttaa

SEQ ID NO: 1410745 - DNA, 22 bp, Homo sapiens
aatgtagttttgtgatgcattt

SEQ ID NO: 1410746 - DNA, 17 bp, Homo sapiens
aatgtgtcttgtattat

SEQ ID NO: 1410747 - DNA, 18 bp, Homo sapiens
aattacatgtaaacaaat

SEQ ID NO: 1410748 - DNA, 20 bp, Homo sapiens
aattacatgtaaacaaatat

SEQ ID NO: 1410749 - DNA, 12 bp, Homo sapiens
aattgcatttgt

SEQ ID NO: 1410750 - DNA, 13 bp, Homo sapiens
aattgcatttgtg

SEQ ID NO: 1410751 - DNA, 21 bp, Homo sapiens
aatttaccacaggatgcatat

SEQ ID NO: 1410752 - DNA, 21 bp, Homo sapiens
aatttcagttttaaaaatgaa

SEQ ID NO: 1410753 - DNA, 16 bp, Homo sapiens
aatttccctctgatat

SEQ ID NO: 1410754 - DNA, 15 bp, Homo sapiens
acaaagatcaaatga

SEQ ID NO: 1410755 - DNA, 14 bp, Homo sapiens
acaaatacacatac

SEQ ID NO: 1410756 - DNA, 15 bp, Homo sapiens
acaaatacacataca

SEQ ID NO: 1410757 - DNA, 14 bp, Homo sapiens
acaaattgcatttg

SEQ ID NO: 1410758 - DNA, 14 bp, Homo sapiens
acaagcagacacac

SEQ ID NO: 1410759 - DNA, 16 bp, Homo sapiens
acaagcagacacacac

SEQ ID NO: 1410760 - DNA, 18 bp, Homo sapiens
acaagcagacacacacat

SEQ ID NO: 1410761 - DNA, 15 bp, Homo sapiens
acaagtatcatctaa

SEQ ID NO: 1410762 - DNA, 18 bp, Homo sapiens
acaagtatcatctaaata

SEQ ID NO: 1410763 - DNA, 17 bp, Homo sapiens
acaatacagtatttctt

SEQ ID NO: 1410764 - DNA, 20 bp, Homo sapiens
acaatgacaaaaagaagatg

SEQ ID NO: 1410765 - DNA, 21 bp, Homo sapiens
acaattacatgtaaacaaata

SEQ ID NO: 1410766 - DNA, 13 bp, Homo sapiens
acacaaactttca

SEQ ID NO: 1410767 - DNA, 19 bp, Homo sapiens
acacaagcagacacacaca

SEQ ID NO: 1410768 - DNA, 13 bp, Homo sapiens
acacacacagaca

SEQ ID NO: 1410769 - DNA, 13 bp, Homo sapiens
acacacatatata

SEQ ID NO: 1410770 - DNA, 18 bp, Homo sapiens
acacacatatatacatac

SEQ ID NO: 1410771 - DNA, 17 bp, Homo sapiens
acacatacatatataca

SEQ ID NO: 1410772 - DNA, 19 bp, Homo sapiens
acacatacatatatacatt

SEQ ID NO: 1410773 - DNA, 13 bp, Homo sapiens
acacatatataca

SEQ ID NO: 1410774 - DNA, 15 bp, Homo sapiens
acacatatatacata

SEQ ID NO: 1410775 - DNA, 15 bp, Homo sapiens
acacattgacaatga

SEQ ID NO: 1410776 - DNA, 20 bp, Homo sapiens
acacctcctcccactgccca

SEQ ID NO: 1410777 - DNA, 22 bp, Homo sapiens
acacctcctcccactgcccact

SEQ ID NO: 1410778 - DNA, 13 bp, Homo sapiens
acacgtgtatatg

SEQ ID NO: 1410779 - DNA, 15 bp, Homo sapiens
acactgagtgaaata

SEQ ID NO: 1410780 - DNA, 18 bp, Homo sapiens
acactgagtgaaatatta

SEQ ID NO: 1410781 - DNA, 16 bp, Homo sapiens
acagaaagcatagacg

SEQ ID NO: 1410782 - DNA, 19 bp, Homo sapiens
acagaactcggtgtcccca

SEQ ID NO: 1410783 - DNA, 22 bp, Homo sapiens
acagaactcggtgtccccacca

SEQ ID NO: 1410784 - DNA, 14 bp, Homo sapiens
acagaagcacatgc

SEQ ID NO: 1410785 - DNA, 11 bp, Homo sapiens
acagacacaca

SEQ ID NO: 1410786 - DNA, 23 bp, Homo sapiens
acagaggatgctgacatcatttg

SEQ ID NO: 1410787 - DNA, 13 bp, Homo sapiens
acagcaaacacag

SEQ ID NO: 1410788 - DNA, 14 bp, Homo sapiens
acagcatttgccaa

SEQ ID NO: 1410789 - DNA, 20 bp, Homo sapiens
acagccactcccctccactc

SEQ ID NO: 1410790 - DNA, 21 bp, Homo sapiens
acagttaaactggcttaactt

SEQ ID NO: 1410791 - DNA, 20 bp, Homo sapiens
acagttattgggcttaaaaa

SEQ ID NO: 1410792 - DNA, 13 bp, Homo sapiens
acatacatatata

SEQ ID NO: 1410793 - DNA, 15 bp, Homo sapiens
acatacatatataca

SEQ ID NO: 1410794 - DNA, 18 bp, Homo sapiens
acatacgcaattgtatat

SEQ ID NO: 1410795 - DNA, 14 bp, Homo sapiens
acatatatacattt

SEQ ID NO: 1410796 - DNA, 15 bp, Homo sapiens
acatatttcataagc

SEQ ID NO: 1410797 - DNA, 22 bp, Homo sapiens
acatatttcataagcacatcca

SEQ ID NO: 1410798 - DNA, 16 bp, Homo sapiens
acatcatacttaactt

SEQ ID NO: 1410799 - DNA, 23 bp, Homo sapiens
acatcatttgtattatgttccaa

SEQ ID NO: 1410800 - DNA, 23 bp, Homo sapiens
acatctccaaatatcagtgggct

SEQ ID NO: 1410801 - DNA, 18 bp, Homo sapiens
acatgacccgtacacacc

SEQ ID NO: 1410802 - DNA, 20 bp, Homo sapiens
acatgacccgtacacaccac

SEQ ID NO: 1410803 - DNA, 15 bp, Homo sapiens
acatgccaggggcct

SEQ ID NO: 1410804 - DNA, 13 bp, Homo sapiens
acatgcttttcca

SEQ ID NO: 1410805 - DNA, 18 bp, Homo sapiens
accacatttctaagcctt

SEQ ID NO: 1410806 - DNA, 17 bp, Homo sapiens
accacctacaaggagat

SEQ ID NO: 1410807 - DNA, 22 bp, Homo sapiens
accacgttaactgcattttaca

SEQ ID NO: 1410808 - DNA, 22 bp, Homo sapiens
accagatatatagaaggactgc

SEQ ID NO: 1410809 - DNA, 18 bp, Homo sapiens
accatctaggatgatttt

SEQ ID NO: 1410810 - DNA, 16 bp, Homo sapiens
acccaaccacagagga

SEQ ID NO: 1410811 - DNA, 13 bp, Homo sapiens
acccagggaacag

SEQ ID NO: 1410812 - DNA, 22 bp, Homo sapiens
acccagggaacagccactcccc

SEQ ID NO: 1410813 - DNA, 22 bp, Homo sapiens
acccatgttgagacctcagctt

SEQ ID NO: 1410814 - DNA, 22 bp, Homo sapiens
accccagcattctcaggcacca

SEQ ID NO: 1410815 - DNA, 23 bp, Homo sapiens
accccagcattctcaggcaccag

SEQ ID NO: 1410816 - DNA, 20 bp, Homo sapiens
accccctcttctgagcacag

SEQ ID NO: 1410817 - DNA, 21 bp, Homo sapiens
accccctcttctgagcacaga

SEQ ID NO: 1410818 - DNA, 22 bp, Homo sapiens
accccttcctgggcacacgctg

SEQ ID NO: 1410819 - DNA, 14 bp, Homo sapiens
accctcacactgct

SEQ ID NO: 1410820 - DNA, 15 bp, Homo sapiens
acctacccatacacc

SEQ ID NO: 1410821 - DNA, 17 bp, Homo sapiens
acctgacagcaaacaca

SEQ ID NO: 1410822 - DNA, 14 bp, Homo sapiens
acctggcctcattt

SEQ ID NO: 1410823 - DNA, 13 bp, Homo sapiens
acctgtacacaca

SEQ ID NO: 1410824 - DNA, 23 bp, Homo sapiens
acctgtacacacacagacacaca

SEQ ID NO: 1410825 - DNA, 17 bp, Homo sapiens
accttccccctccccca

SEQ ID NO: 1410826 - DNA, 18 bp, Homo sapiens
acgcaaaaatagctcttg

SEQ ID NO: 1410827 - DNA, 22 bp, Homo sapiens
acgcaattgtatatatatgtga

SEQ ID NO: 1410828 - DNA, 16 bp, Homo sapiens
acgctgctctgcccca

SEQ ID NO: 1410829 - DNA, 22 bp, Homo sapiens
acgtgtatatgaggatgtatgt

SEQ ID NO: 1410830 - DNA, 17 bp, Homo sapiens
actaagaatcatcctca

SEQ ID NO: 1410831 - DNA, 18 bp, Homo sapiens
actaatctcaatttaaga

SEQ ID NO: 1410832 - DNA, 14 bp, Homo sapiens
actacctggctgcg

SEQ ID NO: 1410833 - DNA, 17 bp, Homo sapiens
actactaatctcaattt

SEQ ID NO: 1410834 - DNA, 22 bp, Homo sapiens
actaggaagtaaagtgaagaat

SEQ ID NO: 1410835 - DNA, 19 bp, Homo sapiens
actcagccttgcaaatagc

SEQ ID NO: 1410836 - DNA, 22 bp, Homo sapiens
actcagccttttgggaataata

SEQ ID NO: 1410837 - DNA, 17 bp, Homo sapiens
actcatcgggagtgaat

SEQ ID NO: 1410838 - DNA, 22 bp, Homo sapiens
actcggtgtccccaccatctgc

SEQ ID NO: 1410839 - DNA, 23 bp, Homo sapiens
actcggtgtccccaccatctgct

SEQ ID NO: 1410840 - DNA, 15 bp, Homo sapiens
actctaatatacagt

SEQ ID NO: 1410841 - DNA, 17 bp, Homo sapiens
actctaatatacagtgt

SEQ ID NO: 1410842 - DNA, 13 bp, Homo sapiens
actctgccccccc

SEQ ID NO: 1410843 - DNA, 12 bp, Homo sapiens
actgagggcaga

SEQ ID NO: 1410844 - DNA, 15 bp, Homo sapiens
actgagggcagagag

SEQ ID NO: 1410845 - DNA, 13 bp, Homo sapiens
actgagtgaaata

SEQ ID NO: 1410846 - DNA, 22 bp, Homo sapiens
actgctccagtttcacctcttt

SEQ ID NO: 1410847 - DNA, 16 bp, Homo sapiens
actgggaacagaactc

SEQ ID NO: 1410848 - DNA, 12 bp, Homo sapiens
actgttcaattt

SEQ ID NO: 1410849 - DNA, 18 bp, Homo sapiens
actgttcctgagccttca

SEQ ID NO: 1410850 - DNA, 17 bp, Homo sapiens
acttcatttaacactga

SEQ ID NO: 1410851 - DNA, 14 bp, Homo sapiens
acttgatttttcaa

SEQ ID NO: 1410852 - DNA, 17 bp, Homo sapiens
acttgatttttcaaaga

SEQ ID NO: 1410853 - DNA, 13 bp, Homo sapiens
acttgctgcctcg

SEQ ID NO: 1410854 - DNA, 18 bp, Homo sapiens
actttcaagtattatatt

SEQ ID NO: 1410855 - DNA, 20 bp, Homo sapiens
actttcaagtattatatttt

SEQ ID NO: 1410856 - DNA, 12 bp, Homo sapiens
actttctcagca

SEQ ID NO: 1410857 - DNA, 14 bp, Homo sapiens
agaaactaagaatc

SEQ ID NO: 1410858 - DNA, 13 bp, Homo sapiens
agaaagacattct

SEQ ID NO: 1410859 - DNA, 15 bp, Homo sapiens
agaaagacattctta

SEQ ID NO: 1410860 - DNA, 13 bp, Homo sapiens
agaaagtcatagt

SEQ ID NO: 1410861 - DNA, 22 bp, Homo sapiens
agaacaattacatgtaaacaaa

SEQ ID NO: 1410862 - DNA, 15 bp, Homo sapiens
agaagaaaatttaat

SEQ ID NO: 1410863 - DNA, 22 bp, Homo sapiens
agaagaaaatttaattatttgt

SEQ ID NO: 1410864 - DNA, 21 bp, Homo sapiens
agaagaggtggccccatatta

SEQ ID NO: 1410865 - DNA, 14 bp, Homo sapiens
agaagcttaaaata

SEQ ID NO: 1410866 - DNA, 16 bp, Homo sapiens
agaagcttaaaataaa

SEQ ID NO: 1410867 - DNA, 13 bp, Homo sapiens
agaaggactgcag

SEQ ID NO: 1410868 - DNA, 22 bp, Homo sapiens
agaaggactgcagccactgatt

SEQ ID NO: 1410869 - DNA, 19 bp, Homo sapiens
agaagtaggggtggcccga

SEQ ID NO: 1410870 - DNA, 14 bp, Homo sapiens
agaatatttttccc

SEQ ID NO: 1410871 - DNA, 22 bp, Homo sapiens
agaatgagggcgtgaaacacaa

SEQ ID NO: 1410872 - DNA, 20 bp, Homo sapiens
agaattgacagttgaacaga

SEQ ID NO: 1410873 - DNA, 16 bp, Homo sapiens
agacaaatacacatac

SEQ ID NO: 1410874 - DNA, 17 bp, Homo sapiens
agacaaatacacataca

SEQ ID NO: 1410875 - DNA, 17 bp, Homo sapiens
agacacacaagcagaca

SEQ ID NO: 1410876 - DNA, 13 bp, Homo sapiens
agacacacacata

SEQ ID NO: 1410877 - DNA, 20 bp, Homo sapiens
agacacacacatatatacat

SEQ ID NO: 1410878 - DNA, 15 bp, Homo sapiens
agactagccagccag

SEQ ID NO: 1410879 - DNA, 19 bp, Homo sapiens
agactgttcctgagccttc

SEQ ID NO: 1410880 - DNA, 14 bp, Homo sapiens
agacttcagattcc

SEQ ID NO: 1410881 - DNA, 15 bp, Homo sapiens
agacttcatttaaca

SEQ ID NO: 1410882 - DNA, 15 bp, Homo sapiens
agagcccagagtccc

SEQ ID NO: 1410883 - DNA, 22 bp, Homo sapiens
agagcccagagtccccccactc

SEQ ID NO: 1410884 - DNA, 14 bp, Homo sapiens
agagctagaggcca

SEQ ID NO: 1410885 - DNA, 17 bp, Homo sapiens
agaggccatgtctcctg

SEQ ID NO: 1410886 - DNA, 21 bp, Homo sapiens
agagtccccccactcccagca

SEQ ID NO: 1410887 - DNA, 21 bp, Homo sapiens
agagtgctaagcattagcttt

SEQ ID NO: 1410888 - DNA, 17 bp, Homo sapiens
agatcccacatatttca

SEQ ID NO: 1410889 - DNA, 20 bp, Homo sapiens
agatcggctttcatgtaatt

SEQ ID NO: 1410890 - DNA, 15 bp, Homo sapiens
agatgctgtgcccct

SEQ ID NO: 1410891 - DNA, 14 bp, Homo sapiens
agatgttcccccat

SEQ ID NO: 1410892 - DNA, 18 bp, Homo sapiens
agattgaagctaaaacac

SEQ ID NO: 1410893 - DNA, 22 bp, Homo sapiens
agatttaaagtgccttatcaaa

SEQ ID NO: 1410894 - DNA, 17 bp, Homo sapiens
agcaaatgcctgccaaa

SEQ ID NO: 1410895 - DNA, 18 bp, Homo sapiens
agcaaatgcctgccaaat

SEQ ID NO: 1410896 - DNA, 20 bp, Homo sapiens
agcaatttcagttttaaaaa

SEQ ID NO: 1410897 - DNA, 19 bp, Homo sapiens
agcacatgatttgggctct

SEQ ID NO: 1410898 - DNA, 12 bp, Homo sapiens
agcagacacaca

SEQ ID NO: 1410899 - DNA, 14 bp, Homo sapiens
agcagacacacaca

SEQ ID NO: 1410900 - DNA, 16 bp, Homo sapiens
agcagacacacacata

SEQ ID NO: 1410901 - DNA, 22 bp, Homo sapiens
agcagacacacacatatataca

SEQ ID NO: 1410902 - DNA, 18 bp, Homo sapiens
agcatatatataaaatac

SEQ ID NO: 1410903 - DNA, 22 bp, Homo sapiens
agcatcattacaatacagtatt

SEQ ID NO: 1410904 - DNA, 20 bp, Homo sapiens
agcatttctagaacaattac

SEQ ID NO: 1410905 - DNA, 14 bp, Homo sapiens
agccaagcaaatgc

SEQ ID NO: 1410906 - DNA, 22 bp, Homo sapiens
agccaatatcccttactttaac

SEQ ID NO: 1410907 - DNA, 23 bp, Homo sapiens
agccactccccagccagcctggc

SEQ ID NO: 1410908 - DNA, 14 bp, Homo sapiens
agccactcccctcc

SEQ ID NO: 1410909 - DNA, 15 bp, Homo sapiens
agccactcccctcca

SEQ ID NO: 1410910 - DNA, 17 bp, Homo sapiens
agccagcctggctggga

SEQ ID NO: 1410911 - DNA, 17 bp, Homo sapiens
agcccagagtcccccca

SEQ ID NO: 1410912 - DNA, 20 bp, Homo sapiens
agcccagagtccccccactc

SEQ ID NO: 1410913 - DNA, 15 bp, Homo sapiens
agccgattcctccag

SEQ ID NO: 1410914 - DNA, 19 bp, Homo sapiens
agccgattcctccagccct

SEQ ID NO: 1410915 - DNA, 21 bp, Homo sapiens
agccgattcctccagccctgg

SEQ ID NO: 1410916 - DNA, 14 bp, Homo sapiens
agccgccttccctt

SEQ ID NO: 1410917 - DNA, 18 bp, Homo sapiens
agcctaaagaccatttaa

SEQ ID NO: 1410918 - DNA, 19 bp, Homo sapiens
agcctaaagaccatttaat

SEQ ID NO: 1410919 - DNA, 20 bp, Homo sapiens
agcctaaagaccatttaatc

SEQ ID NO: 1410920 - DNA, 16 bp, Homo sapiens
agccttcagcactaac

SEQ ID NO: 1410921 - DNA, 13 bp, Homo sapiens
agcgcagagaaat

SEQ ID NO: 1410922 - DNA, 15 bp, Homo sapiens
agctatggacaattt

SEQ ID NO: 1410923 - DNA, 13 bp, Homo sapiens
agctctcatagct

SEQ ID NO: 1410924 - DNA, 13 bp, Homo sapiens
agctgcacccctt

SEQ ID NO: 1410925 - DNA, 13 bp, Homo sapiens
agcttttccctgt

SEQ ID NO: 1410926 - DNA, 14 bp, Homo sapiens
agcttttccctgtc

SEQ ID NO: 1410927 - DNA, 20 bp, Homo sapiens
aggaacatgacccgtacaca

SEQ ID NO: 1410928 - DNA, 16 bp, Homo sapiens
aggaagctgagatgaa

SEQ ID NO: 1410929 - DNA, 22 bp, Homo sapiens
aggaagttagtttttaatctct

SEQ ID NO: 1410930 - DNA, 23 bp, Homo sapiens
aggaatcatctcctttgcagaat

SEQ ID NO: 1410931 - DNA, 16 bp, Homo sapiens
aggacaggagatgctg

SEQ ID NO: 1410932 - DNA, 22 bp, Homo sapiens
aggactagagcacaacataatt

SEQ ID NO: 1410933 - DNA, 16 bp, Homo sapiens
aggactgcagagggct

SEQ ID NO: 1410934 - DNA, 17 bp, Homo sapiens
aggagaacttgctgcct

SEQ ID NO: 1410935 - DNA, 19 bp, Homo sapiens
aggagaacttgctgcctcg

SEQ ID NO: 1410936 - DNA, 15 bp, Homo sapiens
aggagatgctgtgcc

SEQ ID NO: 1410937 - DNA, 22 bp, Homo sapiens
aggagctccatacacacgctgc

SEQ ID NO: 1410938 - DNA, 21 bp, Homo sapiens
aggaggggcccccctgccctg

SEQ ID NO: 1410939 - DNA, 18 bp, Homo sapiens
aggatgctgacatcattt

SEQ ID NO: 1410940 - DNA, 22 bp, Homo sapiens
aggcaagaaaagcgcagagaaa

SEQ ID NO: 1410941 - DNA, 15 bp, Homo sapiens
aggcaccagtccctg

SEQ ID NO: 1410942 - DNA, 10 bp, Homo sapiens
aggccatctg

SEQ ID NO: 1410943 - DNA, 16 bp, Homo sapiens
aggccatctggagagc

SEQ ID NO: 1410944 - DNA, 20 bp, Homo sapiens
aggccatctggagagcccag

SEQ ID NO: 1410945 - DNA, 21 bp, Homo sapiens
aggccatctggagagcccaga

SEQ ID NO: 1410946 - DNA, 12 bp, Homo sapiens
aggctgatttat

SEQ ID NO: 1410947 - DNA, 19 bp, Homo sapiens
aggctgcctgctatgtatt

SEQ ID NO: 1410948 - DNA, 14 bp, Homo sapiens
agggaaaacacaga

SEQ ID NO: 1410949 - DNA, 15 bp, Homo sapiens
agggcgtgaaacaca

SEQ ID NO: 1410950 - DNA, 22 bp, Homo sapiens
agggcgtgaaacacaatatcat

SEQ ID NO: 1410951 - DNA, 20 bp, Homo sapiens
aggggaggccatctggagag

SEQ ID NO: 1410952 - DNA, 20 bp, Homo sapiens
aggggcccccctgccctgtg

SEQ ID NO: 1410953 - DNA, 21 bp, Homo sapiens
aggggcccccctgccctgtgg

SEQ ID NO: 1410954 - DNA, 16 bp, Homo sapiens
aggggcgcgggagggg

SEQ ID NO: 1410955 - DNA, 23 bp, Homo sapiens
agggtgtgatttaggtcagtaga

SEQ ID NO: 1410956 - DNA, 19 bp, Homo sapiens
aggtcccctttcagagata

SEQ ID NO: 1410957 - DNA, 20 bp, Homo sapiens
aggtgcaccggtttcataga

SEQ ID NO: 1410958 - DNA, 23 bp, Homo sapiens
aggtggccccatattaacaaatt

SEQ ID NO: 1410959 - DNA, 16 bp, Homo sapiens
aggttaacagatttat

SEQ ID NO: 1410960 - DNA, 14 bp, Homo sapiens
agtaaagtgaagaa

SEQ ID NO: 1410961 - DNA, 16 bp, Homo sapiens
agtaacagtcatcatt

SEQ ID NO: 1410962 - DNA, 18 bp, Homo sapiens
agtaatctcacagcattt

SEQ ID NO: 1410963 - DNA, 20 bp, Homo sapiens
agtactcttctagcatttag

SEQ ID NO: 1410964 - DNA, 19 bp, Homo sapiens
agtattatattttatttat

SEQ ID NO: 1410965 - DNA, 21 bp, Homo sapiens
agtatttctttgttatacatt

SEQ ID NO: 1410966 - DNA, 22 bp, Homo sapiens
agtctattgaataatgtagttt

SEQ ID NO: 1410967 - DNA, 16 bp, Homo sapiens
agtctgatccctgcca

SEQ ID NO: 1410968 - DNA, 15 bp, Homo sapiens
agtgaagaatttatc

SEQ ID NO: 1410969 - DNA, 18 bp, Homo sapiens
agtggagatcccacatat

SEQ ID NO: 1410970 - DNA, 18 bp, Homo sapiens
agtggctggaagagtccc

SEQ ID NO: 1410971 - DNA, 17 bp, Homo sapiens
agttaatctttgaaaac

SEQ ID NO: 1410972 - DNA, 23 bp, Homo sapiens
agttaatctttgaaaactcatac

SEQ ID NO: 1410973 - DNA, 21 bp, Homo sapiens
agttctgacccaaccacagag

SEQ ID NO: 1410974 - DNA, 21 bp, Homo sapiens
agttgaacagagctagaggcc

SEQ ID NO: 1410975 - DNA, 21 bp, Homo sapiens
agtttaaaaatcagaaagaca

SEQ ID NO: 1410976 - DNA, 14 bp, Homo sapiens
agttttaaaaatga

SEQ ID NO: 1410977 - DNA, 20 bp, Homo sapiens
agtttttatacctgtacaca

SEQ ID NO: 1410978 - DNA, 17 bp, Homo sapiens
ataaaatacacgtgtat

SEQ ID NO: 1410979 - DNA, 15 bp, Homo sapiens
ataaatattatttga

SEQ ID NO: 1410980 - DNA, 15 bp, Homo sapiens
ataacattgtatgtt

SEQ ID NO: 1410981 - DNA, 22 bp, Homo sapiens
ataagcccaacaagttgaagaa

SEQ ID NO: 1410982 - DNA, 11 bp, Homo sapiens
atacacacagg

SEQ ID NO: 1410983 - DNA, 13 bp, Homo sapiens
atacacacaggag

SEQ ID NO: 1410984 - DNA, 13 bp, Homo sapiens
atacacatacata

SEQ ID NO: 1410985 - DNA, 14 bp, Homo sapiens
atacacatacatat

SEQ ID NO: 1410986 - DNA, 19 bp, Homo sapiens
atacacatacatatataca

SEQ ID NO: 1410987 - DNA, 22 bp, Homo sapiens
atacacatacatatatacattt

SEQ ID NO: 1410988 - DNA, 14 bp, Homo sapiens
atacacgtgtatat

SEQ ID NO: 1410989 - DNA, 16 bp, Homo sapiens
atacacgtgtatatga

SEQ ID NO: 1410990 - DNA, 23 bp, Homo sapiens
atacagtatttctttgttataca

SEQ ID NO: 1410991 - DNA, 15 bp, Homo sapiens
atacagtgtgtagtt

SEQ ID NO: 1410992 - DNA, 18 bp, Homo sapiens
atacatacgcaattgtat

SEQ ID NO: 1410993 - DNA, 20 bp, Homo sapiens
atacatacgcaattgtatat

SEQ ID NO: 1410994 - DNA, 21 bp, Homo sapiens
atacatacgcaattgtatata

SEQ ID NO: 1410995 - DNA, 20 bp, Homo sapiens
atacatatatacattttgca

SEQ ID NO: 1410996 - DNA, 20 bp, Homo sapiens
atacatcatacttaacttta

SEQ ID NO: 1410997 - DNA, 13 bp, Homo sapiens
atacattttgcag

SEQ ID NO: 1410998 - DNA, 13 bp, Homo sapiens
atacctggcctca

SEQ ID NO: 1410999 - DNA, 21 bp, Homo sapiens
atacctgtacacacacagaca

SEQ ID NO: 1411000 - DNA, 23 bp, Homo sapiens
atacctgtacacacacagacaca

SEQ ID NO: 1411001 - DNA, 22 bp, Homo sapiens
atacgcaattgtatatatatgt

SEQ ID NO: 1411002 - DNA, 19 bp, Homo sapiens
atactccaccagtgaaaat

SEQ ID NO: 1411003 - DNA, 19 bp, Homo sapiens
atagaagcttaaaataaag

SEQ ID NO: 1411004 - DNA, 16 bp, Homo sapiens
atataaccacatttct

SEQ ID NO: 1411005 - DNA, 18 bp, Homo sapiens
atataaccacatttctaa

SEQ ID NO: 1411006 - DNA, 21 bp, Homo sapiens
atatacatacgcaattgtata

SEQ ID NO: 1411007 - DNA, 20 bp, Homo sapiens
atatagaaggactgcagcca

SEQ ID NO: 1411008 - DNA, 21 bp, Homo sapiens
atatataaaatacacgtgtat

SEQ ID NO: 1411009 - DNA, 22 bp, Homo sapiens
atatataaaatacacgtgtata

SEQ ID NO: 1411010 - DNA, 23 bp, Homo sapiens
atatataaaatacacgtgtatat

SEQ ID NO: 1411011 - DNA, 12 bp, Homo sapiens
atatatacatac

SEQ ID NO: 1411012 - DNA, 22 bp, Homo sapiens
atatatacatacgcaattgtat

SEQ ID NO: 1411013 - DNA, 13 bp, Homo sapiens
atatatatgtgaa

SEQ ID NO: 1411014 - DNA, 19 bp, Homo sapiens
atatatgtgaactttctca

SEQ ID NO: 1411015 - DNA, 14 bp, Homo sapiens
atatatttgcataa

SEQ ID NO: 1411016 - DNA, 15 bp, Homo sapiens
atatatttgcataat

SEQ ID NO: 1411017 - DNA, 22 bp, Homo sapiens
atatatttgcataatatgcata

SEQ ID NO: 1411018 - DNA, 22 bp, Homo sapiens
atatcagtgggctctcttacca

SEQ ID NO: 1411019 - DNA, 20 bp, Homo sapiens
atatcatccccaaatgtgtc

SEQ ID NO: 1411020 - DNA, 21 bp, Homo sapiens
atatccaattttaaaatgaaa

SEQ ID NO: 1411021 - DNA, 17 bp, Homo sapiens
atatgaggatgtatgtg

SEQ ID NO: 1411022 - DNA, 19 bp, Homo sapiens
atatgaggatgtatgtgta

SEQ ID NO: 1411023 - DNA, 21 bp, Homo sapiens
atatgaggatgtatgtgtata

SEQ ID NO: 1411024 - DNA, 17 bp, Homo sapiens
atatgcaataaatatta

SEQ ID NO: 1411025 - DNA, 17 bp, Homo sapiens
atatgcatatatatgta

SEQ ID NO: 1411026 - DNA, 23 bp, Homo sapiens
atatgtgaactttctcagcatat

SEQ ID NO: 1411027 - DNA, 15 bp, Homo sapiens
atattaaagaaagtc

SEQ ID NO: 1411028 - DNA, 18 bp, Homo sapiens
atattaaagaaagtcata

SEQ ID NO: 1411029 - DNA, 23 bp, Homo sapiens
atattactctgcctgtcaagttt

SEQ ID NO: 1411030 - DNA, 18 bp, Homo sapiens
atattatttgatgatact

SEQ ID NO: 1411031 - DNA, 17 bp, Homo sapiens
atattttctttatttgt

SEQ ID NO: 1411032 - DNA, 18 bp, Homo sapiens
atattttctttatttgta

SEQ ID NO: 1411033 - DNA, 20 bp, Homo sapiens
atcaaatgaaaagtaaaaca

SEQ ID NO: 1411034 - DNA, 18 bp, Homo sapiens
atcacgatgtaaattatt

SEQ ID NO: 1411035 - DNA, 13 bp, Homo sapiens
atcagaaagacat

SEQ ID NO: 1411036 - DNA, 17 bp, Homo sapiens
atcagaaagacattctt

SEQ ID NO: 1411037 - DNA, 21 bp, Homo sapiens
atcagtatttggactttttaa

SEQ ID NO: 1411038 - DNA, 19 bp, Homo sapiens
atcatacttaactttacta

SEQ ID NO: 1411039 - DNA, 16 bp, Homo sapiens
atcatcacaaatggct

SEQ ID NO: 1411040 - DNA, 17 bp, Homo sapiens
atcatccccaaatgtgt

SEQ ID NO: 1411041 - DNA, 18 bp, Homo sapiens
atcatctcctttgcagaa

SEQ ID NO: 1411042 - DNA, 19 bp, Homo sapiens
atcattacaatacagtatt

SEQ ID NO: 1411043 - DNA, 15 bp, Homo sapiens
atcattcttataaca

SEQ ID NO: 1411044 - DNA, 18 bp, Homo sapiens
atccaacagaaagcatag

SEQ ID NO: 1411045 - DNA, 17 bp, Homo sapiens
atccaattttaaaatga

SEQ ID NO: 1411046 - DNA, 20 bp, Homo sapiens
atccaattttaaaatgaaat

SEQ ID NO: 1411047 - DNA, 21 bp, Homo sapiens
atccaattttaaaatgaaatg

SEQ ID NO: 1411048 - DNA, 14 bp, Homo sapiens
atccaggcccctcc

SEQ ID NO: 1411049 - DNA, 15 bp, Homo sapiens
atcccacatatttca

SEQ ID NO: 1411050 - DNA, 22 bp, Homo sapiens
atcccacatatttcaaaaacat

SEQ ID NO: 1411051 - DNA, 22 bp, Homo sapiens
atcccacgttgatgtctgaacg

SEQ ID NO: 1411052 - DNA, 16 bp, Homo sapiens
atccccaaatgtgtct

SEQ ID NO: 1411053 - DNA, 21 bp, Homo sapiens
atccccaaatgtgtcttgtat

SEQ ID NO: 1411054 - DNA, 16 bp, Homo sapiens
atccctgccaaaaagt

SEQ ID NO: 1411055 - DNA, 20 bp, Homo sapiens
atcccttactttaacccttt

SEQ ID NO: 1411056 - DNA, 22 bp, Homo sapiens
atcccttactttaaccctttct

SEQ ID NO: 1411057 - DNA, 22 bp, Homo sapiens
atcggctttcatgtaattatct

SEQ ID NO: 1411058 - DNA, 14 bp, Homo sapiens
atctaaatattatg

SEQ ID NO: 1411059 - DNA, 23 bp, Homo sapiens
atctagtagttgtagaagaaaat

SEQ ID NO: 1411060 - DNA, 13 bp, Homo sapiens
atctcaatttaag

SEQ ID NO: 1411061 - DNA, 12 bp, Homo sapiens
atctcactctgc

SEQ ID NO: 1411062 - DNA, 14 bp, Homo sapiens
atctcactctgccc

SEQ ID NO: 1411063 - DNA, 21 bp, Homo sapiens
atctcccacatgccaggggcc

SEQ ID NO: 1411064 - DNA, 17 bp, Homo sapiens
atctcgctccctcccag

SEQ ID NO: 1411065 - DNA, 17 bp, Homo sapiens
atctctccaccttccaa

SEQ ID NO: 1411066 - DNA, 13 bp, Homo sapiens
atctctgattaca

SEQ ID NO: 1411067 - DNA, 17 bp, Homo sapiens
atctgacatatttcata

SEQ ID NO: 1411068 - DNA, 12 bp, Homo sapiens
atctgctgtctt

SEQ ID NO: 1411069 - DNA, 22 bp, Homo sapiens
atctgctgtcttttctttgcca

SEQ ID NO: 1411070 - DNA, 21 bp, Homo sapiens
atcttggactcatgaggaggg

SEQ ID NO: 1411071 - DNA, 19 bp, Homo sapiens
atctttgaaaactcataca

SEQ ID NO: 1411072 - DNA, 17 bp, Homo sapiens
atgaaagcagtgaagca

SEQ ID NO: 1411073 - DNA, 12 bp, Homo sapiens
atgaaatgcatt

SEQ ID NO: 1411074 - DNA, 16 bp, Homo sapiens
atgaaatgcattttgc

SEQ ID NO: 1411075 - DNA, 16 bp, Homo sapiens
atgaaccctggcattt

SEQ ID NO: 1411076 - DNA, 17 bp, Homo sapiens
atgaaccctggcatttg

SEQ ID NO: 1411077 - DNA, 15 bp, Homo sapiens
atgaggatgtatgtg

SEQ ID NO: 1411078 - DNA, 17 bp, Homo sapiens
atgaggatgtatgtgta

SEQ ID NO: 1411079 - DNA, 18 bp, Homo sapiens
atgagggcgtgaaacaca

SEQ ID NO: 1411080 - DNA, 22 bp, Homo sapiens
atgatttgggctctagaattcc

SEQ ID NO: 1411081 - DNA, 12 bp, Homo sapiens
atgcaataaata

SEQ ID NO: 1411082 - DNA, 23 bp, Homo sapiens
atgcaggttcaggtcccctttca

SEQ ID NO: 1411083 - DNA, 12 bp, Homo sapiens
atgcatatatat

SEQ ID NO: 1411084 - DNA, 18 bp, Homo sapiens
atgcattttgctagacag

SEQ ID NO: 1411085 - DNA, 13 bp, Homo sapiens
atgccaggggcct

SEQ ID NO: 1411086 - DNA, 22 bp, Homo sapiens
atgcctttatttctgtatctga

SEQ ID NO: 1411087 - DNA, 15 bp, Homo sapiens
atgctgacatcattt

SEQ ID NO: 1411088 - DNA, 16 bp, Homo sapiens
atgctgacatcatttg

SEQ ID NO: 1411089 - DNA, 23 bp, Homo sapiens
atgctgtctttcttgctccctga

SEQ ID NO: 1411090 - DNA, 15 bp, Homo sapiens
atggaagacaaatac

SEQ ID NO: 1411091 - DNA, 15 bp, Homo sapiens
atggactcagccttg

SEQ ID NO: 1411092 - DNA, 14 bp, Homo sapiens
atggatgtaattct

SEQ ID NO: 1411093 - DNA, 22 bp, Homo sapiens
atggcagcatgcgatgtcatat

SEQ ID NO: 1411094 - DNA, 16 bp, Homo sapiens
atggctacatctccaa

SEQ ID NO: 1411095 - DNA, 15 bp, Homo sapiens
atgggagccgggcaa

SEQ ID NO: 1411096 - DNA, 21 bp, Homo sapiens
atgggattttcaattatactg

SEQ ID NO: 1411097 - DNA, 22 bp, Homo sapiens
atggggaaactgagggcagaga

SEQ ID NO: 1411098 - DNA, 17 bp, Homo sapiens
atgtaatagaagcttaa

SEQ ID NO: 1411099 - DNA, 19 bp, Homo sapiens
atgtaattatctagtagtt

SEQ ID NO: 1411100 - DNA, 17 bp, Homo sapiens
atgtaattctcatgaaa

SEQ ID NO: 1411101 - DNA, 12 bp, Homo sapiens
atgtatgtgtat

SEQ ID NO: 1411102 - DNA, 13 bp, Homo sapiens
atgtatgtgtata

SEQ ID NO: 1411103 - DNA, 14 bp, Homo sapiens
atgtatgtgtatat

SEQ ID NO: 1411104 - DNA, 15 bp, Homo sapiens
atgtatgtgtatatg

SEQ ID NO: 1411105 - DNA, 19 bp, Homo sapiens
atgtatgtgtatatgttta

SEQ ID NO: 1411106 - DNA, 20 bp, Homo sapiens
atgtatgtgtatatgtttat

SEQ ID NO: 1411107 - DNA, 21 bp, Homo sapiens
atgtcatattttcctttatgt

SEQ ID NO: 1411108 - DNA, 16 bp, Homo sapiens
atgtgaactttctcag

SEQ ID NO: 1411109 - DNA, 21 bp, Homo sapiens
atgtgaactttctcagcatat

SEQ ID NO: 1411110 - DNA, 13 bp, Homo sapiens
atgtgatgtaact

SEQ ID NO: 1411111 - DNA, 23 bp, Homo sapiens
atgtgtatatgtttatacacaca

SEQ ID NO: 1411112 - DNA, 12 bp, Homo sapiens
atgtgtatggaa

SEQ ID NO: 1411113 - DNA, 16 bp, Homo sapiens
atgttatcattcttat

SEQ ID NO: 1411114 - DNA, 15 bp, Homo sapiens
atgtttatacacaca

SEQ ID NO: 1411115 - DNA, 15 bp, Homo sapiens
attaaagaaagtcat

SEQ ID NO: 1411116 - DNA, 15 bp, Homo sapiens
attaacaaattgcat

SEQ ID NO: 1411117 - DNA, 16 bp, Homo sapiens
attaacaaattgcatt

SEQ ID NO: 1411118 - DNA, 14 bp, Homo sapiens
attacatgtaaaca

SEQ ID NO: 1411119 - DNA, 15 bp, Homo sapiens
attacatgtaaacaa

SEQ ID NO: 1411120 - DNA, 16 bp, Homo sapiens
attacatgtaaacaaa

SEQ ID NO: 1411121 - DNA, 15 bp, Homo sapiens
attatactgaagcta

SEQ ID NO: 1411122 - DNA, 21 bp, Homo sapiens
attatatttcacccatctctc

SEQ ID NO: 1411123 - DNA, 15 bp, Homo sapiens
attattattaattac

SEQ ID NO: 1411124 - DNA, 13 bp, Homo sapiens
attcatgaagagt

SEQ ID NO: 1411125 - DNA, 21 bp, Homo sapiens
attcatgaagagttgtttata

SEQ ID NO: 1411126 - DNA, 13 bp, Homo sapiens
attctcaggcacc

SEQ ID NO: 1411127 - DNA, 14 bp, Homo sapiens
attcttagcaaaaa

SEQ ID NO: 1411128 - DNA, 16 bp, Homo sapiens
attcttagcaaaaaat

SEQ ID NO: 1411129 - DNA, 15 bp, Homo sapiens
attcttagttaatct

SEQ ID NO: 1411130 - DNA, 22 bp, Homo sapiens
attcttataacattgtatgtta

SEQ ID NO: 1411131 - DNA, 17 bp, Homo sapiens
attgaaagggacaagta

SEQ ID NO: 1411132 - DNA, 19 bp, Homo sapiens
attgaaagggacaagtatc

SEQ ID NO: 1411133 - DNA, 15 bp, Homo sapiens
attgacaatgacaaa

SEQ ID NO: 1411134 - DNA, 19 bp, Homo sapiens
attgccaaaacccagctgc

SEQ ID NO: 1411135 - DNA, 22 bp, Homo sapiens
attgccaaaacccagctgcacc

SEQ ID NO: 1411136 - DNA, 16 bp, Homo sapiens
attgtatatatatgtg

SEQ ID NO: 1411137 - DNA, 18 bp, Homo sapiens
atttaaaacaagacttca

SEQ ID NO: 1411138 - DNA, 20 bp, Homo sapiens
atttaacactgagtgaaata

SEQ ID NO: 1411139 - DNA, 22 bp, Homo sapiens
atttaatcttgaaggaacacaa

SEQ ID NO: 1411140 - DNA, 14 bp, Homo sapiens
atttaccacaggat

SEQ ID NO: 1411141 - DNA, 23 bp, Homo sapiens
atttaggtcagtagactgtgatt

SEQ ID NO: 1411142 - DNA, 15 bp, Homo sapiens
atttcaacagttatt

SEQ ID NO: 1411143 - DNA, 14 bp, Homo sapiens
atttcaatcactga

SEQ ID NO: 1411144 - DNA, 14 bp, Homo sapiens
atttcataagcaca

SEQ ID NO: 1411145 - DNA, 23 bp, Homo sapiens
atttccatgtcccctcccagagc

SEQ ID NO: 1411146 - DNA, 16 bp, Homo sapiens
atttctaagcctttga

SEQ ID NO: 1411147 - DNA, 16 bp, Homo sapiens
atttgcaaggctgatt

SEQ ID NO: 1411148 - DNA, 23 bp, Homo sapiens
atttgcacagaagcacatgcacc

SEQ ID NO: 1411149 - DNA, 18 bp, Homo sapiens
atttgcataatatgcata

SEQ ID NO: 1411150 - DNA, 19 bp, Homo sapiens
atttgcataatatgcatat

SEQ ID NO: 1411151 - DNA, 21 bp, Homo sapiens
atttgccaagtctcccaatat

SEQ ID NO: 1411152 - DNA, 14 bp, Homo sapiens
atttgggcagagag

SEQ ID NO: 1411153 - DNA, 21 bp, Homo sapiens
atttgtagccaaagaaatttc

SEQ ID NO: 1411154 - DNA, 22 bp, Homo sapiens
atttgtagccaaagaaatttca

SEQ ID NO: 1411155 - DNA, 21 bp, Homo sapiens
atttgtattatgttccaaggc

SEQ ID NO: 1411156 - DNA, 17 bp, Homo sapiens
attttacacattgacaa

SEQ ID NO: 1411157 - DNA, 20 bp, Homo sapiens
attttagatttaccttgtta

SEQ ID NO: 1411158 - DNA, 21 bp, Homo sapiens
attttcccccttgcagttatg

SEQ ID NO: 1411159 - DNA, 20 bp, Homo sapiens
attttctttatttgtagcca

SEQ ID NO: 1411160 - DNA, 17 bp, Homo sapiens
caaaaatagctcttgct

SEQ ID NO: 1411161 - DNA, 22 bp, Homo sapiens
caaagacttcatttaacactga

SEQ ID NO: 1411162 - DNA, 14 bp, Homo sapiens
caaagatcaaatga

SEQ ID NO: 1411163 - DNA, 15 bp, Homo sapiens
caaataatattcatg

SEQ ID NO: 1411164 - DNA, 18 bp, Homo sapiens
caaatacacatacatata

SEQ ID NO: 1411165 - DNA, 21 bp, Homo sapiens
caaatacacatacatatatac

SEQ ID NO: 1411166 - DNA, 16 bp, Homo sapiens
caaatgcctgccaaat

SEQ ID NO: 1411167 - DNA, 20 bp, Homo sapiens
caaatgtgtcttgtattatc

SEQ ID NO: 1411168 - DNA, 12 bp, Homo sapiens
caacaacaaaac

SEQ ID NO: 1411169 - DNA, 14 bp, Homo sapiens
caacactcaagtct

SEQ ID NO: 1411170 - DNA, 23 bp, Homo sapiens
caacctgacagcaaacacagtca

SEQ ID NO: 1411171 - DNA, 19 bp, Homo sapiens
caagaaaagcgcagagaaa

SEQ ID NO: 1411172 - DNA, 16 bp, Homo sapiens
caaggagataagaaag

SEQ ID NO: 1411173 - DNA, 13 bp, Homo sapiens
caaggctgattta

SEQ ID NO: 1411174 - DNA, 18 bp, Homo sapiens
caagtatcatctaaatat

SEQ ID NO: 1411175 - DNA, 23 bp, Homo sapiens
caatagcatttctagaacaatta

SEQ ID NO: 1411176 - DNA, 17 bp, Homo sapiens
caatgacaaaaagaaga

SEQ ID NO: 1411177 - DNA, 23 bp, Homo sapiens
caatgtaatagaagcttaaaata

SEQ ID NO: 1411178 - DNA, 18 bp, Homo sapiens
caattgtatatatatgtg

SEQ ID NO: 1411179 - DNA, 22 bp, Homo sapiens
caatttaccacaggatgcatat

SEQ ID NO: 1411180 - DNA, 22 bp, Homo sapiens
caatttcagttttaaaaatgaa

SEQ ID NO: 1411181 - DNA, 22 bp, Homo sapiens
caattttaaaatgaaatgcatt

SEQ ID NO: 1411182 - DNA, 24 bp, Homo sapiens
caattttaaaatgaaatgcatttt

SEQ ID NO: 1411183 - DNA, 20 bp, Homo sapiens
cacaaactttcaagtattat

SEQ ID NO: 1411184 - DNA, 23 bp, Homo sapiens
cacaaactttcaagtattatatt

SEQ ID NO: 1411185 - DNA, 13 bp, Homo sapiens
cacaagcagacac

SEQ ID NO: 1411186 - DNA, 14 bp, Homo sapiens
cacacacagacaca

SEQ ID NO: 1411187 - DNA, 17 bp, Homo sapiens
cacacagacacacaagc

SEQ ID NO: 1411188 - DNA, 16 bp, Homo sapiens
cacacctcctcccact

SEQ ID NO: 1411189 - DNA, 19 bp, Homo sapiens
cacacctcctcccactgcc

SEQ ID NO: 1411190 - DNA, 22 bp, Homo sapiens
cacacctcctcccactgcccac

SEQ ID NO: 1411191 - DNA, 23 bp, Homo sapiens
cacacctcctcccactgcccact

SEQ ID NO: 1411192 - DNA, 14 bp, Homo sapiens
cacacgctgccttc

SEQ ID NO: 1411193 - DNA, 16 bp, Homo sapiens
cacacgctgctctgcc

SEQ ID NO: 1411194 - DNA, 17 bp, Homo sapiens
cacaggatgcatattaa

SEQ ID NO: 1411195 - DNA, 16 bp, Homo sapiens
cacagtgacacgtttg

SEQ ID NO: 1411196 - DNA, 14 bp, Homo sapiens
cacatccaactact

SEQ ID NO: 1411197 - DNA, 19 bp, Homo sapiens
cacatgccaggggcctttg

SEQ ID NO: 1411198 - DNA, 15 bp, Homo sapiens
cacatttctaagcct

SEQ ID NO: 1411199 - DNA, 14 bp, Homo sapiens
caccagtccctgtc

SEQ ID NO: 1411200 - DNA, 22 bp, Homo sapiens
cacccatgttgagacctcagct

SEQ ID NO: 1411201 - DNA, 16 bp, Homo sapiens
caccccttcctgggca

SEQ ID NO: 1411202 - DNA, 19 bp, Homo sapiens
caccccttcctgggcacac

SEQ ID NO: 1411203 - DNA, 16 bp, Homo sapiens
cacctcctcccactgc

SEQ ID NO: 1411204 - DNA, 14 bp, Homo sapiens
cacctgtgggccag

SEQ ID NO: 1411205 - DNA, 21 bp, Homo sapiens
cacctgtgggccagccgattc

SEQ ID NO: 1411206 - DNA, 10 bp, Homo sapiens
caccttccaa

SEQ ID NO: 1411207 - DNA, 16 bp, Homo sapiens
cacgctgctctgcccc

SEQ ID NO: 1411208 - DNA, 14 bp, Homo sapiens
cactccccagccag

SEQ ID NO: 1411209 - DNA, 16 bp, Homo sapiens
cactctaaataaattt

SEQ ID NO: 1411210 - DNA, 11 bp, Homo sapiens
cactctgcccc

SEQ ID NO: 1411211 - DNA, 14 bp, Homo sapiens
cactctggcagcac

SEQ ID NO: 1411212 - DNA, 22 bp, Homo sapiens
cactctggcagcaccgcctctt

SEQ ID NO: 1411213 - DNA, 17 bp, Homo sapiens
cactgagtgaaatatta

SEQ ID NO: 1411214 - DNA, 18 bp, Homo sapiens
cagaactcggtgtcccca

SEQ ID NO: 1411215 - DNA, 19 bp, Homo sapiens
cagaactcggtgtccccac

SEQ ID NO: 1411216 - DNA, 22 bp, Homo sapiens
cagaattgacagttgaacagag

SEQ ID NO: 1411217 - DNA, 13 bp, Homo sapiens
cagacacacacat

SEQ ID NO: 1411218 - DNA, 14 bp, Homo sapiens
cagacacacacata

SEQ ID NO: 1411219 - DNA, 15 bp, Homo sapiens
cagacacacacatat

SEQ ID NO: 1411220 - DNA, 20 bp, Homo sapiens
cagacacacacatatataca

SEQ ID NO: 1411221 - DNA, 20 bp, Homo sapiens
cagagatataataagcccaa

SEQ ID NO: 1411222 - DNA, 12 bp, Homo sapiens
cagagctagagg

SEQ ID NO: 1411223 - DNA, 20 bp, Homo sapiens
cagaggagaacttgctgcct

SEQ ID NO: 1411224 - DNA, 15 bp, Homo sapiens
cagagtccccccact

SEQ ID NO: 1411225 - DNA, 13 bp, Homo sapiens
cagataactgagg

SEQ ID NO: 1411226 - DNA, 20 bp, Homo sapiens
cagataactgaggaggggag

SEQ ID NO: 1411227 - DNA, 13 bp, Homo sapiens
cagatctcccaca

SEQ ID NO: 1411228 - DNA, 19 bp, Homo sapiens
cagatcttggactcatgag

SEQ ID NO: 1411229 - DNA, 20 bp, Homo sapiens
cagatcttggactcatgagg

SEQ ID NO: 1411230 - DNA, 14 bp, Homo sapiens
cagcaaacacagtc

SEQ ID NO: 1411231 - DNA, 15 bp, Homo sapiens
cagcaaacacagtca

SEQ ID NO: 1411232 - DNA, 13 bp, Homo sapiens
cagcaccgcctct

SEQ ID NO: 1411233 - DNA, 11 bp, Homo sapiens
cagcatatata

SEQ ID NO: 1411234 - DNA, 12 bp, Homo sapiens
cagcatatatat

SEQ ID NO: 1411235 - DNA, 19 bp, Homo sapiens
cagcatcgcactctggcag

SEQ ID NO: 1411236 - DNA, 21 bp, Homo sapiens
cagcatcgcactctggcagca

SEQ ID NO: 1411237 - DNA, 20 bp, Homo sapiens
cagcattctcaggcaccagt

SEQ ID NO: 1411238 - DNA, 17 bp, Homo sapiens
cagcatttgccaagtct

SEQ ID NO: 1411239 - DNA, 16 bp, Homo sapiens
cagccactccccagcc

SEQ ID NO: 1411240 - DNA, 17 bp, Homo sapiens
cagccactccccagcca

SEQ ID NO: 1411241 - DNA, 20 bp, Homo sapiens
cagccactccccagccagcc

SEQ ID NO: 1411242 - DNA, 13 bp, Homo sapiens
cagccagcctggc

SEQ ID NO: 1411243 - DNA, 16 bp, Homo sapiens
cagccagcctggctgg

SEQ ID NO: 1411244 - DNA, 11 bp, Homo sapiens
cagcccacccc

SEQ ID NO: 1411245 - DNA, 21 bp, Homo sapiens
cagccgattcctccagccctg

SEQ ID NO: 1411246 - DNA, 13 bp, Homo sapiens
cagcctcatcagt

SEQ ID NO: 1411247 - DNA, 22 bp, Homo sapiens
cagctatggacaatttaccaca

SEQ ID NO: 1411248 - DNA, 20 bp, Homo sapiens
cagcttgggcagatctccca

SEQ ID NO: 1411249 - DNA, 23 bp, Homo sapiens
caggaccagggttggcaccttcc

SEQ ID NO: 1411250 - DNA, 15 bp, Homo sapiens
caggactagagcaca

SEQ ID NO: 1411251 - DNA, 12 bp, Homo sapiens
caggactctgac

SEQ ID NO: 1411252 - DNA, 14 bp, Homo sapiens
caggactctgaccc

SEQ ID NO: 1411253 - DNA, 18 bp, Homo sapiens
caggactgcagagggctc

SEQ ID NO: 1411254 - DNA, 19 bp, Homo sapiens
caggagctccatacacacg

SEQ ID NO: 1411255 - DNA, 15 bp, Homo sapiens
caggatgcatattaa

SEQ ID NO: 1411256 - DNA, 14 bp, Homo sapiens
caggcaagaaaagc

SEQ ID NO: 1411257 - DNA, 20 bp, Homo sapiens
caggcaagaaaagcgcagag

SEQ ID NO: 1411258 - DNA, 21 bp, Homo sapiens
caggcccatgggaggctggag

SEQ ID NO: 1411259 - DNA, 23 bp, Homo sapiens
caggcccctccctctccagcagg

SEQ ID NO: 1411260 - DNA, 14 bp, Homo sapiens
cagggaaaacacag

SEQ ID NO: 1411261 - DNA, 18 bp, Homo sapiens
cagggaaaacacagatgt

SEQ ID NO: 1411262 - DNA, 22 bp, Homo sapiens
cagggagatttgctcaatacct

SEQ ID NO: 1411263 - DNA, 16 bp, Homo sapiens
caggggaggccatctg

SEQ ID NO: 1411264 - DNA, 21 bp, Homo sapiens
caggggaggccatctggagag

SEQ ID NO: 1411265 - DNA, 22 bp, Homo sapiens
caggggcctttgggtgctgttt

SEQ ID NO: 1411266 - DNA, 18 bp, Homo sapiens
caggtcccctttcagaga

SEQ ID NO: 1411267 - DNA, 15 bp, Homo sapiens
cagtcatcatttatc

SEQ ID NO: 1411268 - DNA, 22 bp, Homo sapiens
cagtgaagcaatttcagtttta

SEQ ID NO: 1411269 - DNA, 17 bp, Homo sapiens
cagtgcccatgtgtatg

SEQ ID NO: 1411270 - DNA, 20 bp, Homo sapiens
cagtgtgcttacctgttgtc

SEQ ID NO: 1411271 - DNA, 17 bp, Homo sapiens
cagttgaacagagctag

SEQ ID NO: 1411272 - DNA, 18 bp, Homo sapiens
cagttttaaaaatgaaga

SEQ ID NO: 1411273 - DNA, 16 bp, Homo sapiens
cataatatgcatatat

SEQ ID NO: 1411274 - DNA, 17 bp, Homo sapiens
cataatatgcatatata

SEQ ID NO: 1411275 - DNA, 23 bp, Homo sapiens
cataatatgcatatatatgtata

SEQ ID NO: 1411276 - DNA, 16 bp, Homo sapiens
catacacacgctgcct

SEQ ID NO: 1411277 - DNA, 17 bp, Homo sapiens
catacacacgctgcctt

SEQ ID NO: 1411278 - DNA, 21 bp, Homo sapiens
catacaccccctcttctgagc

SEQ ID NO: 1411279 - DNA, 16 bp, Homo sapiens
catacgcaattgtata

SEQ ID NO: 1411280 - DNA, 14 bp, Homo sapiens
catacttaacttta

SEQ ID NO: 1411281 - DNA, 12 bp, Homo sapiens
catatatacata

SEQ ID NO: 1411282 - DNA, 17 bp, Homo sapiens
catatatataaaataca

SEQ ID NO: 1411283 - DNA, 14 bp, Homo sapiens
catatatatgtata

SEQ ID NO: 1411284 - DNA, 15 bp, Homo sapiens
catatatatgtatat

SEQ ID NO: 1411285 - DNA, 14 bp, Homo sapiens
catattaacaaatt

SEQ ID NO: 1411286 - DNA, 17 bp, Homo sapiens
catattaacaaattgca

SEQ ID NO: 1411287 - DNA, 20 bp, Homo sapiens
catattaacaaattgcattt

SEQ ID NO: 1411288 - DNA, 21 bp, Homo sapiens
catatttcataagcacatcca

SEQ ID NO: 1411289 - DNA, 19 bp, Homo sapiens
catattttcctttatgtga

SEQ ID NO: 1411290 - DNA, 17 bp, Homo sapiens
catcacaaatggctaca

SEQ ID NO: 1411291 - DNA, 16 bp, Homo sapiens
catcatacttaacttt

SEQ ID NO: 1411292 - DNA, 22 bp, Homo sapiens
catctccaaatatcagtgggct

SEQ ID NO: 1411293 - DNA, 13 bp, Homo sapiens
catctcctttgca

SEQ ID NO: 1411294 - DNA, 15 bp, Homo sapiens
catctcctttgcaga

SEQ ID NO: 1411295 - DNA, 17 bp, Homo sapiens
catctcgctccctccca

SEQ ID NO: 1411296 - DNA, 20 bp, Homo sapiens
catctcgctccctcccagga

SEQ ID NO: 1411297 - DNA, 22 bp, Homo sapiens
catctcgctccctcccaggact

SEQ ID NO: 1411298 - DNA, 12 bp, Homo sapiens
catctggagagc

SEQ ID NO: 1411299 - DNA, 15 bp, Homo sapiens
catcttcgggaccag

SEQ ID NO: 1411300 - DNA, 15 bp, Homo sapiens
catgacccgtacaca

SEQ ID NO: 1411301 - DNA, 13 bp, Homo sapiens
catgaggaggggc

SEQ ID NO: 1411302 - DNA, 16 bp, Homo sapiens
catgcctttatacttt

SEQ ID NO: 1411303 - DNA, 20 bp, Homo sapiens
catgcctttatttctgtatc

SEQ ID NO: 1411304 - DNA, 21 bp, Homo sapiens
catggtggggtctcctcagga

SEQ ID NO: 1411305 - DNA, 17 bp, Homo sapiens
catgtaaacaaatattt

SEQ ID NO: 1411306 - DNA, 18 bp, Homo sapiens
catgtaaacaaatatttt

SEQ ID NO: 1411307 - DNA, 12 bp, Homo sapiens
catgtaattatc

SEQ ID NO: 1411308 - DNA, 23 bp, Homo sapiens
catgtaattatctagtagttgta

SEQ ID NO: 1411309 - DNA, 18 bp, Homo sapiens
catgtcccctcccagagc

SEQ ID NO: 1411310 - DNA, 16 bp, Homo sapiens
catgtgagaatatttt

SEQ ID NO: 1411311 - DNA, 14 bp, Homo sapiens
catgtgcgaacaca

SEQ ID NO: 1411312 - DNA, 17 bp, Homo sapiens
catgtgcgaacacagtg

SEQ ID NO: 1411313 - DNA, 13 bp, Homo sapiens
catgtgtatggaa

SEQ ID NO: 1411314 - DNA, 20 bp, Homo sapiens
catgttgagacctcagcttg

SEQ ID NO: 1411315 - DNA, 19 bp, Homo sapiens
cattacaatacagtatttc

SEQ ID NO: 1411316 - DNA, 17 bp, Homo sapiens
cattagctttaattaag

SEQ ID NO: 1411317 - DNA, 17 bp, Homo sapiens
cattctcaggcaccagt

SEQ ID NO: 1411318 - DNA, 11 bp, Homo sapiens
cattgtatgtt

SEQ ID NO: 1411319 - DNA, 13 bp, Homo sapiens
catttaacactga

SEQ ID NO: 1411320 - DNA, 21 bp, Homo sapiens
catttaacactgagtgaaata

SEQ ID NO: 1411321 - DNA, 20 bp, Homo sapiens
catttctagaacaattacat

SEQ ID NO: 1411322 - DNA, 23 bp, Homo sapiens
catttctagaacaattacatgta

SEQ ID NO: 1411323 - DNA, 16 bp, Homo sapiens
catttgggcagagagg

SEQ ID NO: 1411324 - DNA, 18 bp, Homo sapiens
cattttacacattgacaa

SEQ ID NO: 1411325 - DNA, 22 bp, Homo sapiens
cattttatagaatgtgtcacac

SEQ ID NO: 1411326 - DNA, 16 bp, Homo sapiens
cattttgcacctgcag

SEQ ID NO: 1411327 - DNA, 14 bp, Homo sapiens
ccaaagagtgctaa

SEQ ID NO: 1411328 - DNA, 19 bp, Homo sapiens
ccaaatatcagtgggctct

SEQ ID NO: 1411329 - DNA, 17 bp, Homo sapiens
ccaacgacccatgaccg

SEQ ID NO: 1411330 - DNA, 15 bp, Homo sapiens
ccaagcaaatgcctg

SEQ ID NO: 1411331 - DNA, 19 bp, Homo sapiens
ccaagcaaatgcctgccaa

SEQ ID NO: 1411332 - DNA, 17 bp, Homo sapiens
ccaattttaaaatgaaa

SEQ ID NO: 1411333 - DNA, 18 bp, Homo sapiens
ccaattttaaaatgaaat

SEQ ID NO: 1411334 - DNA, 15 bp, Homo sapiens
ccacaggatgcatat

SEQ ID NO: 1411335 - DNA, 22 bp, Homo sapiens
ccactcccagcatcgcactctg

SEQ ID NO: 1411336 - DNA, 22 bp, Homo sapiens
ccactccccagccagcctggct

SEQ ID NO: 1411337 - DNA, 17 bp, Homo sapiens
ccactgcccactggccg

SEQ ID NO: 1411338 - DNA, 22 bp, Homo sapiens
ccagagctggtggacccaggga

SEQ ID NO: 1411339 - DNA, 21 bp, Homo sapiens
ccagagtccccccactcccag

SEQ ID NO: 1411340 - DNA, 22 bp, Homo sapiens
ccagagtccccccactcccagc

SEQ ID NO: 1411341 - DNA, 23 bp, Homo sapiens
ccagagtggagatcccacatatt

SEQ ID NO: 1411342 - DNA, 14 bp, Homo sapiens
ccagcattctcagg

SEQ ID NO: 1411343 - DNA, 18 bp, Homo sapiens
ccagcccaccccatggcc

SEQ ID NO: 1411344 - DNA, 15 bp, Homo sapiens
ccagccgattcctcc

SEQ ID NO: 1411345 - DNA, 13 bp, Homo sapiens
ccagctgcacccc

SEQ ID NO: 1411346 - DNA, 14 bp, Homo sapiens
ccagctgcacccct

SEQ ID NO: 1411347 - DNA, 17 bp, Homo sapiens
ccagctgcaccccttcc

SEQ ID NO: 1411348 - DNA, 17 bp, Homo sapiens
ccaggatttgcacagaa

SEQ ID NO: 1411349 - DNA, 13 bp, Homo sapiens
ccaggcaagaaaa

SEQ ID NO: 1411350 - DNA, 12 bp, Homo sapiens
ccaggcccctcc

SEQ ID NO: 1411351 - DNA, 18 bp, Homo sapiens
ccaggcccctccctctcc

SEQ ID NO: 1411352 - DNA, 13 bp, Homo sapiens
ccagtccctgtcc

SEQ ID NO: 1411353 - DNA, 12 bp, Homo sapiens
ccatacacacgc

SEQ ID NO: 1411354 - DNA, 18 bp, Homo sapiens
ccatacacacgctgcctt

SEQ ID NO: 1411355 - DNA, 20 bp, Homo sapiens
ccatattaacaaattgcatt

SEQ ID NO: 1411356 - DNA, 13 bp, Homo sapiens
ccatctctgctcc

SEQ ID NO: 1411357 - DNA, 22 bp, Homo sapiens
ccatctgctgtcttttctttgc

SEQ ID NO: 1411358 - DNA, 18 bp, Homo sapiens
ccatcttcgggaccagga

SEQ ID NO: 1411359 - DNA, 20 bp, Homo sapiens
ccatcttcgggaccaggatt

SEQ ID NO: 1411360 - DNA, 13 bp, Homo sapiens
ccatgtcccctcc

SEQ ID NO: 1411361 - DNA, 18 bp, Homo sapiens
cccacatgccaggggcct

SEQ ID NO: 1411362 - DNA, 13 bp, Homo sapiens
cccaccacacaac

SEQ ID NO: 1411363 - DNA, 14 bp, Homo sapiens
cccaccacacaaca

SEQ ID NO: 1411364 - DNA, 19 bp, Homo sapiens
cccaccatctgctgtcttt

SEQ ID NO: 1411365 - DNA, 21 bp, Homo sapiens
cccaccatctgctgtcttttc

SEQ ID NO: 1411366 - DNA, 20 bp, Homo sapiens
cccagagctggtggacccag

SEQ ID NO: 1411367 - DNA, 16 bp, Homo sapiens
cccagcattctcaggc

SEQ ID NO: 1411368 - DNA, 14 bp, Homo sapiens
cccagccactcccc

SEQ ID NO: 1411369 - DNA, 16 bp, Homo sapiens
cccagcccaccccatg

SEQ ID NO: 1411370 - DNA, 12 bp, Homo sapiens
cccagctgcacc

SEQ ID NO: 1411371 - DNA, 13 bp, Homo sapiens
cccagctgcaccc

SEQ ID NO: 1411372 - DNA, 14 bp, Homo sapiens
cccagcttgggcag

SEQ ID NO: 1411373 - DNA, 23 bp, Homo sapiens
cccaggactctgaccccagcatt

SEQ ID NO: 1411374 - DNA, 18 bp, Homo sapiens
cccatattaacaaattgc

SEQ ID NO: 1411375 - DNA, 17 bp, Homo sapiens
cccatcttcgggaccag

SEQ ID NO: 1411376 - DNA, 21 bp, Homo sapiens
cccatcttcgggaccaggatt

SEQ ID NO: 1411377 - DNA, 13 bp, Homo sapiens
cccatgaccgttc

SEQ ID NO: 1411378 - DNA, 12 bp, Homo sapiens
cccatgtgtatg

SEQ ID NO: 1411379 - DNA, 15 bp, Homo sapiens
ccccaccatctgctg

SEQ ID NO: 1411380 - DNA, 19 bp, Homo sapiens
ccccatcttcgggaccagg

SEQ ID NO: 1411381 - DNA, 19 bp, Homo sapiens
ccccatggccggctttcag

SEQ ID NO: 1411382 - DNA, 24 bp, Homo sapiens
ccccatggccggctttcaggagct

SEQ ID NO: 1411383 - DNA, 15 bp, Homo sapiens
ccccgacgtgctccc

SEQ ID NO: 1411384 - DNA, 12 bp, Homo sapiens
cccctgccctgt

SEQ ID NO: 1411385 - DNA, 14 bp, Homo sapiens
cccctgccctgtgg

SEQ ID NO: 1411386 - DNA, 13 bp, Homo sapiens
cccgacgtgctcc

SEQ ID NO: 1411387 - DNA, 17 bp, Homo sapiens
cccgacgtgctcccctg

SEQ ID NO: 1411388 - DNA, 17 bp, Homo sapiens
cccgccgcccagcccac

SEQ ID NO: 1411389 - DNA, 12 bp, Homo sapiens
ccctgactgggg

SEQ ID NO: 1411390 - DNA, 14 bp, Homo sapiens
ccctgccctgtggg

SEQ ID NO: 1411391 - DNA, 22 bp, Homo sapiens
cccttcctgggcacacgctgct

SEQ ID NO: 1411392 - DNA, 15 bp, Homo sapiens
ccgaaatgctgtctt

SEQ ID NO: 1411393 - DNA, 18 bp, Homo sapiens
ccgacgtgctcccctgct

SEQ ID NO: 1411394 - DNA, 15 bp, Homo sapiens
ccggctttcaggagc

SEQ ID NO: 1411395 - DNA, 17 bp, Homo sapiens
ccgtcactacctggctg

SEQ ID NO: 1411396 - DNA, 19 bp, Homo sapiens
cctaaagaccatttaatct

SEQ ID NO: 1411397 - DNA, 15 bp, Homo sapiens
cctagcttcttccat

SEQ ID NO: 1411398 - DNA, 11 bp, Homo sapiens
cctcaggacca

SEQ ID NO: 1411399 - DNA, 21 bp, Homo sapiens
cctccatgtgagaatattttt

SEQ ID NO: 1411400 - DNA, 19 bp, Homo sapiens
cctcccactgcccactggc

SEQ ID NO: 1411401 - DNA, 23 bp, Homo sapiens
cctcccactgcccactggccggc

SEQ ID NO: 1411402 - DNA, 17 bp, Homo sapiens
cctcccaggactctgac

SEQ ID NO: 1411403 - DNA, 22 bp, Homo sapiens
cctcccaggactctgaccccag

SEQ ID NO: 1411404 - DNA, 19 bp, Homo sapiens
cctccgtcactacctggct

SEQ ID NO: 1411405 - DNA, 15 bp, Homo sapiens
cctcctcccactgcc

SEQ ID NO: 1411406 - DNA, 17 bp, Homo sapiens
cctcggatccccttcct

SEQ ID NO: 1411407 - DNA, 17 bp, Homo sapiens
cctgacagcaaacacag

SEQ ID NO: 1411408 - DNA, 18 bp, Homo sapiens
cctgacagcaaacacagt

SEQ ID NO: 1411409 - DNA, 19 bp, Homo sapiens
cctgacagcaaacacagtc

SEQ ID NO: 1411410 - DNA, 16 bp, Homo sapiens
cctgatatccaacaga

SEQ ID NO: 1411411 - DNA, 22 bp, Homo sapiens
cctgctcggcaccgccagccgc

SEQ ID NO: 1411412 - DNA, 17 bp, Homo sapiens
cctggcatttggcctct

SEQ ID NO: 1411413 - DNA, 21 bp, Homo sapiens
cctggcatttggcctcttgta

SEQ ID NO: 1411414 - DNA, 22 bp, Homo sapiens
cctggctgcggggcgggcacac

SEQ ID NO: 1411415 - DNA, 18 bp, Homo sapiens
cctggctgggactgggaa

SEQ ID NO: 1411416 - DNA, 21 bp, Homo sapiens
cctggctgggactgggaacag

SEQ ID NO: 1411417 - DNA, 15 bp, Homo sapiens
cctgggcacacgctg

SEQ ID NO: 1411418 - DNA, 19 bp, Homo sapiens
cctgggcacacgctgctct

SEQ ID NO: 1411419 - DNA, 23 bp, Homo sapiens
cctgggcacacgctgctctgccc

SEQ ID NO: 1411420 - DNA, 14 bp, Homo sapiens
cctgtacacacaca

SEQ ID NO: 1411421 - DNA, 15 bp, Homo sapiens
cctgtacacacacag

SEQ ID NO: 1411422 - DNA, 13 bp, Homo sapiens
cctgtgggccagc

SEQ ID NO: 1411423 - DNA, 21 bp, Homo sapiens
cctgtggggtcaacccttctg

SEQ ID NO: 1411424 - DNA, 22 bp, Homo sapiens
ccttccccctcccccagccact

SEQ ID NO: 1411425 - DNA, 14 bp, Homo sapiens
ccttcctaccaccc

SEQ ID NO: 1411426 - DNA, 21 bp, Homo sapiens
ccttcctgggcacacgctgct

SEQ ID NO: 1411427 - DNA, 22 bp, Homo sapiens
ccttcctgggcacacgctgctc

SEQ ID NO: 1411428 - DNA, 20 bp, Homo sapiens
cctttctcggggtcaggttc

SEQ ID NO: 1411429 - DNA, 21 bp, Homo sapiens
cctttgggtgctgttttgcca

SEQ ID NO: 1411430 - DNA, 18 bp, Homo sapiens
cgattcctccagccctgg

SEQ ID NO: 1411431 - DNA, 19 bp, Homo sapiens
cgcaaaaatagctcttgct

SEQ ID NO: 1411432 - DNA, 14 bp, Homo sapiens
cgcaattgtatata

SEQ ID NO: 1411433 - DNA, 17 bp, Homo sapiens
cgcaattgtatatatat

SEQ ID NO: 1411434 - DNA, 19 bp, Homo sapiens
cgcaattgtatatatatgt

SEQ ID NO: 1411435 - DNA, 15 bp, Homo sapiens
cgccgcccagcccac

SEQ ID NO: 1411436 - DNA, 15 bp, Homo sapiens
cgctccctcccagga

SEQ ID NO: 1411437 - DNA, 21 bp, Homo sapiens
cgctccctcccaggactctga

SEQ ID NO: 1411438 - DNA, 15 bp, Homo sapiens
cggcaccgccagccg

SEQ ID NO: 1411439 - DNA, 18 bp, Homo sapiens
cgggggaggggcgcggga

SEQ ID NO: 1411440 - DNA, 23 bp, Homo sapiens
cgggggcaggggaggccatctgg

SEQ ID NO: 1411441 - DNA, 14 bp, Homo sapiens
cggggtcaggttct

SEQ ID NO: 1411442 - DNA, 13 bp, Homo sapiens
cggtacccaccac

SEQ ID NO: 1411443 - DNA, 15 bp, Homo sapiens
ctaaagaccatttaa

SEQ ID NO: 1411444 - DNA, 23 bp, Homo sapiens
ctaacgcaaaaatagctcttgct

SEQ ID NO: 1411445 - DNA, 10 bp, Homo sapiens
ctaaggaaat

SEQ ID NO: 1411446 - DNA, 20 bp, Homo sapiens
ctaagtaatctcacagcatt

SEQ ID NO: 1411447 - DNA, 23 bp, Homo sapiens
ctaagtaatctcacagcatttgc

SEQ ID NO: 1411448 - DNA, 14 bp, Homo sapiens
ctaatatacagtgt

SEQ ID NO: 1411449 - DNA, 16 bp, Homo sapiens
ctaatctcaatttaag

SEQ ID NO: 1411450 - DNA, 17 bp, Homo sapiens
ctaatctcaatttaaga

SEQ ID NO: 1411451 - DNA, 17 bp, Homo sapiens
ctacaaggagataagaa

SEQ ID NO: 1411452 - DNA, 20 bp, Homo sapiens
ctacagagaaggctgcctgc

SEQ ID NO: 1411453 - DNA, 22 bp, Homo sapiens
ctacaggaatctctgattacag

SEQ ID NO: 1411454 - DNA, 17 bp, Homo sapiens
ctaccctccatgtgaga

SEQ ID NO: 1411455 - DNA, 14 bp, Homo sapiens
ctagagcacaacat

SEQ ID NO: 1411456 - DNA, 19 bp, Homo sapiens
ctagagcacaacataattt

SEQ ID NO: 1411457 - DNA, 13 bp, Homo sapiens
ctagaggccatgt

SEQ ID NO: 1411458 - DNA, 13 bp, Homo sapiens
ctagccagccagg

SEQ ID NO: 1411459 - DNA, 14 bp, Homo sapiens
ctagcttcttccat

SEQ ID NO: 1411460 - DNA, 16 bp, Homo sapiens
ctatggacaatttacc

SEQ ID NO: 1411461 - DNA, 23 bp, Homo sapiens
ctatgtatttgcaaggctgattt

SEQ ID NO: 1411462 - DNA, 17 bp, Homo sapiens
ctattgaataatgtagt

SEQ ID NO: 1411463 - DNA, 17 bp, Homo sapiens
ctcaatacctggcctca

SEQ ID NO: 1411464 - DNA, 22 bp, Homo sapiens
ctcaatacctggcctcatttaa

SEQ ID NO: 1411465 - DNA, 16 bp, Homo sapiens
ctcagcttggcactca

SEQ ID NO: 1411466 - DNA, 22 bp, Homo sapiens
ctcagcttggcactcaggtgct

SEQ ID NO: 1411467 - DNA, 18 bp, Homo sapiens
ctcatgcctttatacttt

SEQ ID NO: 1411468 - DNA, 19 bp, Homo sapiens
ctccactctctaccagata

SEQ ID NO: 1411469 - DNA, 16 bp, Homo sapiens
ctccagtttcacctct

SEQ ID NO: 1411470 - DNA, 21 bp, Homo sapiens
ctccatgtgagaatatttttc

SEQ ID NO: 1411471 - DNA, 15 bp, Homo sapiens
ctcccactgcccact

SEQ ID NO: 1411472 - DNA, 17 bp, Homo sapiens
ctcccactgcccactgg

SEQ ID NO: 1411473 - DNA, 21 bp, Homo sapiens
ctcccaggactctgaccccag

SEQ ID NO: 1411474 - DNA, 15 bp, Homo sapiens
ctccccagccagcct

SEQ ID NO: 1411475 - DNA, 18 bp, Homo sapiens
ctccccagccagcctggc

SEQ ID NO: 1411476 - DNA, 13 bp, Homo sapiens
ctccctcccagga

SEQ ID NO: 1411477 - DNA, 15 bp, Homo sapiens
ctccgaaatgctgtc

SEQ ID NO: 1411478 - DNA, 17 bp, Homo sapiens
ctccgaaatgctgtctt

SEQ ID NO: 1411479 - DNA, 19 bp, Homo sapiens
ctccgaagtctgatccctg

SEQ ID NO: 1411480 - DNA, 19 bp, Homo sapiens
ctccgtcactacctggctg

SEQ ID NO: 1411481 - DNA, 15 bp, Homo sapiens
ctcctcccactgccc

SEQ ID NO: 1411482 - DNA, 18 bp, Homo sapiens
ctcctcccactgcccact

SEQ ID NO: 1411483 - DNA, 18 bp, Homo sapiens
ctcggcaccgccagccgc

SEQ ID NO: 1411484 - DNA, 24 bp, Homo sapiens
ctctaaggtaaaaccatctaggat

SEQ ID NO: 1411485 - DNA, 23 bp, Homo sapiens
ctctaccagataactgaggaggg

SEQ ID NO: 1411486 - DNA, 17 bp, Homo sapiens
ctctccaccttccaaag

SEQ ID NO: 1411487 - DNA, 15 bp, Homo sapiens
ctctgccccagcttg

SEQ ID NO: 1411488 - DNA, 13 bp, Homo sapiens
ctctggcagcacc

SEQ ID NO: 1411489 - DNA, 14 bp, Homo sapiens
ctctggcagcaccg

SEQ ID NO: 1411490 - DNA, 16 bp, Homo sapiens
ctctggcagcaccgcc

SEQ ID NO: 1411491 - DNA, 15 bp, Homo sapiens
ctctggggggcaggg

SEQ ID NO: 1411492 - DNA, 17 bp, Homo sapiens
ctgacatatttcataag

SEQ ID NO: 1411493 - DNA, 13 bp, Homo sapiens
ctgacatcatttg

SEQ ID NO: 1411494 - DNA, 18 bp, Homo sapiens
ctgagatgaaccctggca

SEQ ID NO: 1411495 - DNA, 23 bp, Homo sapiens
ctgagatgaaccctggcatttgg

SEQ ID NO: 1411496 - DNA, 14 bp, Homo sapiens
ctgagggcagagag

SEQ ID NO: 1411497 - DNA, 13 bp, Homo sapiens
ctgagtgaaatat

SEQ ID NO: 1411498 - DNA, 21 bp, Homo sapiens
ctgatatccaacagaaagcat

SEQ ID NO: 1411499 - DNA, 23 bp, Homo sapiens
ctgatatgtctagggtgtgattt

SEQ ID NO: 1411500 - DNA, 17 bp, Homo sapiens
ctgcaccccttcctggg

SEQ ID NO: 1411501 - DNA, 11 bp, Homo sapiens
ctgccctgtgg

SEQ ID NO: 1411502 - DNA, 20 bp, Homo sapiens
ctgccttcggtacccaccac

SEQ ID NO: 1411503 - DNA, 17 bp, Homo sapiens
ctgctatgtatttgcaa

SEQ ID NO: 1411504 - DNA, 19 bp, Homo sapiens
ctgctatgtatttgcaagg

SEQ ID NO: 1411505 - DNA, 17 bp, Homo sapiens
ctgctcggcaccgccag

SEQ ID NO: 1411506 - DNA, 15 bp, Homo sapiens
ctgctctgccccagc

SEQ ID NO: 1411507 - DNA, 19 bp, Homo sapiens
ctgctgtcttttctttgcc

SEQ ID NO: 1411508 - DNA, 17 bp, Homo sapiens
ctggagagcccagagtc

SEQ ID NO: 1411509 - DNA, 15 bp, Homo sapiens
ctggcagcaccgcct

SEQ ID NO: 1411510 - DNA, 14 bp, Homo sapiens
ctgggcacacgctg

SEQ ID NO: 1411511 - DNA, 21 bp, Homo sapiens
ctgggcacacgctgctctgcc

SEQ ID NO: 1411512 - DNA, 20 bp, Homo sapiens
ctggtctatataaccacatt

SEQ ID NO: 1411513 - DNA, 21 bp, Homo sapiens
ctggtctatataaccacattt

SEQ ID NO: 1411514 - DNA, 23 bp, Homo sapiens
ctgtacacacacagacacacaag

SEQ ID NO: 1411515 - DNA, 15 bp, Homo sapiens
ctgtatctgacatat

SEQ ID NO: 1411516 - DNA, 19 bp, Homo sapiens
ctgtcatgtgcgaacacag

SEQ ID NO: 1411517 - DNA, 21 bp, Homo sapiens
ctgtcatgtgcgaacacagtg

SEQ ID NO: 1411518 - DNA, 21 bp, Homo sapiens
ctgtccggaatgccacccaca

SEQ ID NO: 1411519 - DNA, 20 bp, Homo sapiens
ctgtctttcttgctccctga

SEQ ID NO: 1411520 - DNA, 22 bp, Homo sapiens
ctgtctttcttgctccctgact

SEQ ID NO: 1411521 - DNA, 21 bp, Homo sapiens
ctgtcttttctttgccatctc

SEQ ID NO: 1411522 - DNA, 20 bp, Homo sapiens
ctgtgaagatctcactctgc

SEQ ID NO: 1411523 - DNA, 21 bp, Homo sapiens
ctgtgaagatctcactctgcc

SEQ ID NO: 1411524 - DNA, 22 bp, Homo sapiens
ctgtgcccctggccttgggatc

SEQ ID NO: 1411525 - DNA, 19 bp, Homo sapiens
ctgtggcctgatcagcagg

SEQ ID NO: 1411526 - DNA, 12 bp, Homo sapiens
ctgtgggccagc

SEQ ID NO: 1411527 - DNA, 20 bp, Homo sapiens
ctgtggtttgggggagaaga

SEQ ID NO: 1411528 - DNA, 17 bp, Homo sapiens
ctgttatctagaaatta

SEQ ID NO: 1411529 - DNA, 19 bp, Homo sapiens
cttaaaaagcatcattaca

SEQ ID NO: 1411530 - DNA, 21 bp, Homo sapiens
cttaaaataaagttaaactga

SEQ ID NO: 1411531 - DNA, 12 bp, Homo sapiens
cttaacttagta

SEQ ID NO: 1411532 - DNA, 17 bp, Homo sapiens
cttagcaaaaaatgaac

SEQ ID NO: 1411533 - DNA, 15 bp, Homo sapiens
cttataacattgtat

SEQ ID NO: 1411534 - DNA, 18 bp, Homo sapiens
cttataacattgtatgtt

SEQ ID NO: 1411535 - DNA, 15 bp, Homo sapiens
cttatcaaataatat

SEQ ID NO: 1411536 - DNA, 23 bp, Homo sapiens
cttcagattccccactcagcctt

SEQ ID NO: 1411537 - DNA, 13 bp, Homo sapiens
cttcatttaacac

SEQ ID NO: 1411538 - DNA, 16 bp, Homo sapiens
cttcatttaacactga

SEQ ID NO: 1411539 - DNA, 23 bp, Homo sapiens
cttcctaccacccggtccccact

SEQ ID NO: 1411540 - DNA, 19 bp, Homo sapiens
cttcctgggcacacgctgc

SEQ ID NO: 1411541 - DNA, 20 bp, Homo sapiens
cttcctgggcacacgctgct

SEQ ID NO: 1411542 - DNA, 23 bp, Homo sapiens
cttcctgggcacacgctgctctg

SEQ ID NO: 1411543 - DNA, 16 bp, Homo sapiens
cttcggtacccaccac

SEQ ID NO: 1411544 - DNA, 15 bp, Homo sapiens
cttctgagcacagat

SEQ ID NO: 1411545 - DNA, 18 bp, Homo sapiens
cttctggaaactgtgaag

SEQ ID NO: 1411546 - DNA, 15 bp, Homo sapiens
cttgctccctgactg

SEQ ID NO: 1411547 - DNA, 17 bp, Homo sapiens
cttgctccctgactggg

SEQ ID NO: 1411548 - DNA, 14 bp, Homo sapiens
cttgggcagatctc

SEQ ID NO: 1411549 - DNA, 12 bp, Homo sapiens
cttgtagtcttg

SEQ ID NO: 1411550 - DNA, 22 bp, Homo sapiens
ctttaaccctcacactgctcca

SEQ ID NO: 1411551 - DNA, 15 bp, Homo sapiens
ctttaaccctttctg

SEQ ID NO: 1411552 - DNA, 19 bp, Homo sapiens
ctttaattaagctctcata

SEQ ID NO: 1411553 - DNA, 16 bp, Homo sapiens
ctttactaagtaatct

SEQ ID NO: 1411554 - DNA, 23 bp, Homo sapiens
ctttagttagtgattatatttca

SEQ ID NO: 1411555 - DNA, 13 bp, Homo sapiens
ctttatactttgc

SEQ ID NO: 1411556 - DNA, 18 bp, Homo sapiens
ctttatgtgatgtaacta

SEQ ID NO: 1411557 - DNA, 22 bp, Homo sapiens
ctttattgccaaaacccagctg

SEQ ID NO: 1411558 - DNA, 23 bp, Homo sapiens
ctttattgccaaaacccagctgc

SEQ ID NO: 1411559 - DNA, 22 bp, Homo sapiens
ctttatttgtagccaaagaaat

SEQ ID NO: 1411560 - DNA, 17 bp, Homo sapiens
ctttcaagtattatatt

SEQ ID NO: 1411561 - DNA, 19 bp, Homo sapiens
ctttcaggagctccataca

SEQ ID NO: 1411562 - DNA, 21 bp, Homo sapiens
ctttcatgtaattatctagta

SEQ ID NO: 1411563 - DNA, 22 bp, Homo sapiens
ctttcattttgcacctgcagcc

SEQ ID NO: 1411564 - DNA, 13 bp, Homo sapiens
ctttgagactgtt

SEQ ID NO: 1411565 - DNA, 23 bp, Homo sapiens
ctttgctgttgaagaaactacta

SEQ ID NO: 1411566 - DNA, 17 bp, Homo sapiens
ctttgttatacatttaa

SEQ ID NO: 1411567 - DNA, 22 bp, Homo sapiens
cttttctttgccatctctgctc

SEQ ID NO: 1411568 - DNA, 17 bp, Homo sapiens
cttttttaattgaaagg

SEQ ID NO: 1411569 - DNA, 13 bp, Homo sapiens
gaaaatatatttg

SEQ ID NO: 1411570 - DNA, 15 bp, Homo sapiens
gaaaatttaattatt

SEQ ID NO: 1411571 - DNA, 22 bp, Homo sapiens
gaaactactaatctcaatttaa

SEQ ID NO: 1411572 - DNA, 15 bp, Homo sapiens
gaaactgagggcaga

SEQ ID NO: 1411573 - DNA, 18 bp, Homo sapiens
gaaactgagggcagagag

SEQ ID NO: 1411574 - DNA, 19 bp, Homo sapiens
gaaactgagggcagagagg

SEQ ID NO: 1411575 - DNA, 12 bp, Homo sapiens
gaaagggtctcc

SEQ ID NO: 1411576 - DNA, 12 bp, Homo sapiens
gaaatgcatttt

SEQ ID NO: 1411577 - DNA, 16 bp, Homo sapiens
gaacaattacatgtaa

SEQ ID NO: 1411578 - DNA, 15 bp, Homo sapiens
gaacatgacccgtac

SEQ ID NO: 1411579 - DNA, 22 bp, Homo sapiens
gaacatgacccgtacacaccac

SEQ ID NO: 1411580 - DNA, 23 bp, Homo sapiens
gaactttctcagcatatatataa

SEQ ID NO: 1411581 - DNA, 14 bp, Homo sapiens
gaagaaaatttaat

SEQ ID NO: 1411582 - DNA, 16 bp, Homo sapiens
gaagacaaatacacat

SEQ ID NO: 1411583 - DNA, 23 bp, Homo sapiens
gaagacaaatacacatacatata

SEQ ID NO: 1411584 - DNA, 21 bp, Homo sapiens
gaagatctcactctgcccccc

SEQ ID NO: 1411585 - DNA, 13 bp, Homo sapiens
gaagctaaaacac

SEQ ID NO: 1411586 - DNA, 22 bp, Homo sapiens
gaagctgagatgaaccctggca

SEQ ID NO: 1411587 - DNA, 14 bp, Homo sapiens
gaagcttaaaataa

SEQ ID NO: 1411588 - DNA, 23 bp, Homo sapiens
gaaggaacacaaagatcaaatga

SEQ ID NO: 1411589 - DNA, 15 bp, Homo sapiens
gaaggactgcagcca

SEQ ID NO: 1411590 - DNA, 17 bp, Homo sapiens
gaagtaaagtgaagaat

SEQ ID NO: 1411591 - DNA, 16 bp, Homo sapiens
gaagtctgatccctgc

SEQ ID NO: 1411592 - DNA, 18 bp, Homo sapiens
gaagtctgatccctgcca

SEQ ID NO: 1411593 - DNA, 19 bp, Homo sapiens
gaataatagcacatgattt

SEQ ID NO: 1411594 - DNA, 19 bp, Homo sapiens
gaatgagggcgtgaaacac

SEQ ID NO: 1411595 - DNA, 22 bp, Homo sapiens
gaatgagggcgtgaaacacaat

SEQ ID NO: 1411596 - DNA, 14 bp, Homo sapiens
gaatttatctcttt

SEQ ID NO: 1411597 - DNA, 17 bp, Homo sapiens
gacaaatacacatacat

SEQ ID NO: 1411598 - DNA, 22 bp, Homo sapiens
gacaaatacacatacatatata

SEQ ID NO: 1411599 - DNA, 21 bp, Homo sapiens
gacacacacatatatacatac

SEQ ID NO: 1411600 - DNA, 22 bp, Homo sapiens
gacacgtttggccagtgacatt

SEQ ID NO: 1411601 - DNA, 14 bp, Homo sapiens
gacagcaaacacag

SEQ ID NO: 1411602 - DNA, 16 bp, Homo sapiens
gacagcaaacacagtc

SEQ ID NO: 1411603 - DNA, 14 bp, Homo sapiens
gacaggactgcaga

SEQ ID NO: 1411604 - DNA, 19 bp, Homo sapiens
gacaggagatgctgtgccc

SEQ ID NO: 1411605 - DNA, 20 bp, Homo sapiens
gaccagggttggcaccttcc

SEQ ID NO: 1411606 - DNA, 17 bp, Homo sapiens
gacccagggaacagcca

SEQ ID NO: 1411607 - DNA, 14 bp, Homo sapiens
gacgtgctcccctg

SEQ ID NO: 1411608 - DNA, 15 bp, Homo sapiens
gacgtgctcccctgc

SEQ ID NO: 1411609 - DNA, 14 bp, Homo sapiens
gactagccagccag

SEQ ID NO: 1411610 - DNA, 22 bp, Homo sapiens
gactagccagccaggaagatga

SEQ ID NO: 1411611 - DNA, 18 bp, Homo sapiens
gactcatgaggaggggcc

SEQ ID NO: 1411612 - DNA, 16 bp, Homo sapiens
gactgggggcagacat

SEQ ID NO: 1411613 - DNA, 22 bp, Homo sapiens
gagaatgagggcgtgaaacaca

SEQ ID NO: 1411614 - DNA, 13 bp, Homo sapiens
gagaggctgtggt

SEQ ID NO: 1411615 - DNA, 21 bp, Homo sapiens
gagaggctgtggtttggggga

SEQ ID NO: 1411616 - DNA, 18 bp, Homo sapiens
gagatcccacatatttca

SEQ ID NO: 1411617 - DNA, 16 bp, Homo sapiens
gagcccagagtccccc

SEQ ID NO: 1411618 - DNA, 20 bp, Homo sapiens
gagccgggcaaactggccgc

SEQ ID NO: 1411619 - DNA, 23 bp, Homo sapiens
gagctccatacacacgctgcctt

SEQ ID NO: 1411620 - DNA, 18 bp, Homo sapiens
gaggccatctggagagcc

SEQ ID NO: 1411621 - DNA, 17 bp, Homo sapiens
gaggccatgtctcctgc

SEQ ID NO: 1411622 - DNA, 11 bp, Homo sapiens
gaggggcgcgg

SEQ ID NO: 1411623 - DNA, 14 bp, Homo sapiens
gaggggcgcgggag

SEQ ID NO: 1411624 - DNA, 18 bp, Homo sapiens
gaggggcgcgggaggggg

SEQ ID NO: 1411625 - DNA, 19 bp, Homo sapiens
gaggggcgcgggagggggc

SEQ ID NO: 1411626 - DNA, 20 bp, Homo sapiens
gagtcagtgcccatgtgtat

SEQ ID NO: 1411627 - DNA, 23 bp, Homo sapiens
gagtcccttagtactcttctagc

SEQ ID NO: 1411628 - DNA, 19 bp, Homo sapiens
gagtgctaagcattagctt

SEQ ID NO: 1411629 - DNA, 21 bp, Homo sapiens
gatatatagaaggactgcagc

SEQ ID NO: 1411630 - DNA, 16 bp, Homo sapiens
gatccccttcctacca

SEQ ID NO: 1411631 - DNA, 18 bp, Homo sapiens
gatccccttcctaccacc

SEQ ID NO: 1411632 - DNA, 13 bp, Homo sapiens
gatctcactctgc

SEQ ID NO: 1411633 - DNA, 15 bp, Homo sapiens
gatctcactctgccc

SEQ ID NO: 1411634 - DNA, 17 bp, Homo sapiens
gatgaaccctggcattt

SEQ ID NO: 1411635 - DNA, 21 bp, Homo sapiens
gatgaatcctagcttcttcca

SEQ ID NO: 1411636 - DNA, 20 bp, Homo sapiens
gatgcattttatagaatgtg

SEQ ID NO: 1411637 - DNA, 21 bp, Homo sapiens
gatggggaaactgagggcaga

SEQ ID NO: 1411638 - DNA, 15 bp, Homo sapiens
gatgtatgtgtatat

SEQ ID NO: 1411639 - DNA, 22 bp, Homo sapiens
gatttcttttgtaataaactat

SEQ ID NO: 1411640 - DNA, 23 bp, Homo sapiens
gatttcttttgtaataaactatt

SEQ ID NO: 1411641 - DNA, 14 bp, Homo sapiens
gcaaaaatagctct

SEQ ID NO: 1411642 - DNA, 22 bp, Homo sapiens
gcaaaggagggcaacctgacag

SEQ ID NO: 1411643 - DNA, 15 bp, Homo sapiens
gcaaatgcctgccaa

SEQ ID NO: 1411644 - DNA, 21 bp, Homo sapiens
gcaacctgacagcaaacacag

SEQ ID NO: 1411645 - DNA, 20 bp, Homo sapiens
gcaagaaaagcgcagagaaa

SEQ ID NO: 1411646 - DNA, 16 bp, Homo sapiens
gcaataaatattattt

SEQ ID NO: 1411647 - DNA, 18 bp, Homo sapiens
gcaataaatattatttga

SEQ ID NO: 1411648 - DNA, 22 bp, Homo sapiens
gcacacctcctcccactgccca

SEQ ID NO: 1411649 - DNA, 12 bp, Homo sapiens
gcacacgctgct

SEQ ID NO: 1411650 - DNA, 15 bp, Homo sapiens
gcacacgctgctctg

SEQ ID NO: 1411651 - DNA, 17 bp, Homo sapiens
gcacacgctgctctgcc

SEQ ID NO: 1411652 - DNA, 14 bp, Homo sapiens
gcaccccttcctgg

SEQ ID NO: 1411653 - DNA, 15 bp, Homo sapiens
gcacctgcagccaag

SEQ ID NO: 1411654 - DNA, 14 bp, Homo sapiens
gcagaattgacagt

SEQ ID NO: 1411655 - DNA, 12 bp, Homo sapiens
gcagacacacac

SEQ ID NO: 1411656 - DNA, 20 bp, Homo sapiens
gcagacatggtggggtctcc

SEQ ID NO: 1411657 - DNA, 22 bp, Homo sapiens
gcagaggagaacttgctgcctc

SEQ ID NO: 1411658 - DNA, 16 bp, Homo sapiens
gcagatcttggactca

SEQ ID NO: 1411659 - DNA, 16 bp, Homo sapiens
gcagggaaaacacaga

SEQ ID NO: 1411660 - DNA, 15 bp, Homo sapiens
gcaggggaggccatc

SEQ ID NO: 1411661 - DNA, 21 bp, Homo sapiens
gcaggggaggccatctggaga

SEQ ID NO: 1411662 - DNA, 19 bp, Homo sapiens
gcatatatataaaatacac

SEQ ID NO: 1411663 - DNA, 12 bp, Homo sapiens
gcatatatatgt

SEQ ID NO: 1411664 - DNA, 14 bp, Homo sapiens
gcatattaaagaaa

SEQ ID NO: 1411665 - DNA, 16 bp, Homo sapiens
gcatgcgatgtcatat

SEQ ID NO: 1411666 - DNA, 14 bp, Homo sapiens
gcatttgccaagtc

SEQ ID NO: 1411667 - DNA, 13 bp, Homo sapiens
gcatttggcctct

SEQ ID NO: 1411668 - DNA, 13 bp, Homo sapiens
gccaaaacccagc

SEQ ID NO: 1411669 - DNA, 20 bp, Homo sapiens
gccaatatcccttactttaa

SEQ ID NO: 1411670 - DNA, 13 bp, Homo sapiens
gccactccccagc

SEQ ID NO: 1411671 - DNA, 16 bp, Homo sapiens
gccactcccctccact

SEQ ID NO: 1411672 - DNA, 19 bp, Homo sapiens
gccagcccatttgggcaga

SEQ ID NO: 1411673 - DNA, 12 bp, Homo sapiens
gccagcctggct

SEQ ID NO: 1411674 - DNA, 13 bp, Homo sapiens
gccagcctggctg

SEQ ID NO: 1411675 - DNA, 12 bp, Homo sapiens
gccatctctgct

SEQ ID NO: 1411676 - DNA, 13 bp, Homo sapiens
gccatctggagag

SEQ ID NO: 1411677 - DNA, 14 bp, Homo sapiens
gccatctggagagc

SEQ ID NO: 1411678 - DNA, 19 bp, Homo sapiens
gcccaacaagttgaagaag

SEQ ID NO: 1411679 - DNA, 16 bp, Homo sapiens
gcccagagtcccccca

SEQ ID NO: 1411680 - DNA, 23 bp, Homo sapiens
gcccagagtccccccactcccag

SEQ ID NO: 1411681 - DNA, 17 bp, Homo sapiens
gcccatgtgtatggaag

SEQ ID NO: 1411682 - DNA, 18 bp, Homo sapiens
gcccatttgggcagagag

SEQ ID NO: 1411683 - DNA, 20 bp, Homo sapiens
gcccatttgggcagagaggc

SEQ ID NO: 1411684 - DNA, 16 bp, Homo sapiens
gccgattcctccagcc

SEQ ID NO: 1411685 - DNA, 20 bp, Homo sapiens
gcctccgtcactacctggct

SEQ ID NO: 1411686 - DNA, 21 bp, Homo sapiens
gcctccgtcactacctggctg

SEQ ID NO: 1411687 - DNA, 18 bp, Homo sapiens
gcctcggatccccttcct

SEQ ID NO: 1411688 - DNA, 22 bp, Homo sapiens
gcctcggatccccttcctacca

SEQ ID NO: 1411689 - DNA, 20 bp, Homo sapiens
gcctcttcccgccgcccagc

SEQ ID NO: 1411690 - DNA, 14 bp, Homo sapiens
gcctcttgtagtct

SEQ ID NO: 1411691 - DNA, 15 bp, Homo sapiens
gcctttgagactgtt

SEQ ID NO: 1411692 - DNA, 17 bp, Homo sapiens
gcgggcacacctcctcc

SEQ ID NO: 1411693 - DNA, 22 bp, Homo sapiens
gcgggcacacctcctcccactg

SEQ ID NO: 1411694 - DNA, 13 bp, Homo sapiens
gcgtgaaacacaa

SEQ ID NO: 1411695 - DNA, 18 bp, Homo sapiens
gctcaatacctggcctca

SEQ ID NO: 1411696 - DNA, 20 bp, Homo sapiens
gctccatacacacgctgcct

SEQ ID NO: 1411697 - DNA, 21 bp, Homo sapiens
gctcccctgctcggcaccgcc

SEQ ID NO: 1411698 - DNA, 14 bp, Homo sapiens
gctccctcccagga

SEQ ID NO: 1411699 - DNA, 13 bp, Homo sapiens
gctcggcaccgcc

SEQ ID NO: 1411700 - DNA, 13 bp, Homo sapiens
gctctcatagctc

SEQ ID NO: 1411701 - DNA, 15 bp, Homo sapiens
gctgcaccccttcct

SEQ ID NO: 1411702 - DNA, 21 bp, Homo sapiens
gctgcctcggatccccttcct

SEQ ID NO: 1411703 - DNA, 23 bp, Homo sapiens
gctgctctgccccagcttgggca

SEQ ID NO: 1411704 - DNA, 17 bp, Homo sapiens
gctggagttggggcaga

SEQ ID NO: 1411705 - DNA, 20 bp, Homo sapiens
gctggagttggggcagagga

SEQ ID NO: 1411706 - DNA, 21 bp, Homo sapiens
gctggtggacccagggaacag

SEQ ID NO: 1411707 - DNA, 16 bp, Homo sapiens
gctgtctttcttgctc

SEQ ID NO: 1411708 - DNA, 17 bp, Homo sapiens
gctgtctttcttgctcc

SEQ ID NO: 1411709 - DNA, 19 bp, Homo sapiens
gctgtctttcttgctccct

SEQ ID NO: 1411710 - DNA, 20 bp, Homo sapiens
gctgtctttcttgctccctg

SEQ ID NO: 1411711 - DNA, 23 bp, Homo sapiens
gcttacctgttgtctgaaacata

SEQ ID NO: 1411712 - DNA, 16 bp, Homo sapiens
gcttgggcagatctcc

SEQ ID NO: 1411713 - DNA, 15 bp, Homo sapiens
gctttcatgtaatta

SEQ ID NO: 1411714 - DNA, 12 bp, Homo sapiens
gcttttccaaac

SEQ ID NO: 1411715 - DNA, 20 bp, Homo sapiens
ggaaactgagggcagagagg

SEQ ID NO: 1411716 - DNA, 19 bp, Homo sapiens
ggaagacaaatacacatac

SEQ ID NO: 1411717 - DNA, 19 bp, Homo sapiens
ggacaggagatgctgtgcc

SEQ ID NO: 1411718 - DNA, 17 bp, Homo sapiens
ggaccagggttggcacc

SEQ ID NO: 1411719 - DNA, 16 bp, Homo sapiens
ggacccagggaacagc

SEQ ID NO: 1411720 - DNA, 22 bp, Homo sapiens
ggacccagggaacagccactcc

SEQ ID NO: 1411721 - DNA, 16 bp, Homo sapiens
ggactcagccttgcaa

SEQ ID NO: 1411722 - DNA, 21 bp, Homo sapiens
ggactgcagagggctccagag

SEQ ID NO: 1411723 - DNA, 17 bp, Homo sapiens
ggactgggaacagaact

SEQ ID NO: 1411724 - DNA, 18 bp, Homo sapiens
ggagaacttgctgcctcg

SEQ ID NO: 1411725 - DNA, 13 bp, Homo sapiens
ggaggccatctgg

SEQ ID NO: 1411726 - DNA, 17 bp, Homo sapiens
ggatccaggcccctccc

SEQ ID NO: 1411727 - DNA, 12 bp, Homo sapiens
ggatccccttcc

SEQ ID NO: 1411728 - DNA, 17 bp, Homo sapiens
ggatgctgacatcattt

SEQ ID NO: 1411729 - DNA, 13 bp, Homo sapiens
ggatgtatgtgta

SEQ ID NO: 1411730 - DNA, 15 bp, Homo sapiens
ggatgtatgtgtata

SEQ ID NO: 1411731 - DNA, 22 bp, Homo sapiens
ggcaagaaaagcgcagagaaat

SEQ ID NO: 1411732 - DNA, 11 bp, Homo sapiens
ggcaaggaagt

SEQ ID NO: 1411733 - DNA, 16 bp, Homo sapiens
ggcacacctcctccca

SEQ ID NO: 1411734 - DNA, 15 bp, Homo sapiens
ggcaccagtccctgt

SEQ ID NO: 1411735 - DNA, 16 bp, Homo sapiens
ggcagacatggtgggg

SEQ ID NO: 1411736 - DNA, 21 bp, Homo sapiens
ggcagaggagaacttgctgcc

SEQ ID NO: 1411737 - DNA, 22 bp, Homo sapiens
ggcagaggagaacttgctgcct

SEQ ID NO: 1411738 - DNA, 19 bp, Homo sapiens
ggcagatctcccacatgcc

SEQ ID NO: 1411739 - DNA, 19 bp, Homo sapiens
ggcaggggaggccatctgg

SEQ ID NO: 1411740 - DNA, 20 bp, Homo sapiens
ggccatctggagagcccaga

SEQ ID NO: 1411741 - DNA, 14 bp, Homo sapiens
ggcccccctgccct

SEQ ID NO: 1411742 - DNA, 16 bp, Homo sapiens
ggcccccctgccctgt

SEQ ID NO: 1411743 - DNA, 18 bp, Homo sapiens
ggccggctttcaggagct

SEQ ID NO: 1411744 - DNA, 13 bp, Homo sapiens
ggccgggggaggg

SEQ ID NO: 1411745 - DNA, 17 bp, Homo sapiens
ggccgggggaggggcgc

SEQ ID NO: 1411746 - DNA, 14 bp, Homo sapiens
ggcgtgaaacacaa

SEQ ID NO: 1411747 - DNA, 16 bp, Homo sapiens
ggctctagaattccag

SEQ ID NO: 1411748 - DNA, 18 bp, Homo sapiens
ggctttcatgtaattatc

SEQ ID NO: 1411749 - DNA, 20 bp, Homo sapiens
ggctttcatgtaattatcta

SEQ ID NO: 1411750 - DNA, 15 bp, Homo sapiens
gggaaaacacagatg

SEQ ID NO: 1411751 - DNA, 20 bp, Homo sapiens
gggaaactgagggcagagag

SEQ ID NO: 1411752 - DNA, 22 bp, Homo sapiens
gggaacagccactcccctccac

SEQ ID NO: 1411753 - DNA, 20 bp, Homo sapiens
gggagccgggcaaactggcc

SEQ ID NO: 1411754 - DNA, 15 bp, Homo sapiens
gggatgggagccggg

SEQ ID NO: 1411755 - DNA, 23 bp, Homo sapiens
gggcaacctgacagcaaacacag

SEQ ID NO: 1411756 - DNA, 15 bp, Homo sapiens
gggcacacctcctcc

SEQ ID NO: 1411757 - DNA, 18 bp, Homo sapiens
gggcacacgctgctctgc

SEQ ID NO: 1411758 - DNA, 11 bp, Homo sapiens
gggcagagagg

SEQ ID NO: 1411759 - DNA, 18 bp, Homo sapiens
gggcagagaggctgtggt

SEQ ID NO: 1411760 - DNA, 17 bp, Homo sapiens
gggcccccctgccctgt

SEQ ID NO: 1411761 - DNA, 16 bp, Homo sapiens
gggcgtgaaacacaat

SEQ ID NO: 1411762 - DNA, 17 bp, Homo sapiens
gggtctcctcaggacca

SEQ ID NO: 1411763 - DNA, 13 bp, Homo sapiens
ggtccccagcaga

SEQ ID NO: 1411764 - DNA, 19 bp, Homo sapiens
ggtctcctcaggaccaggg

SEQ ID NO: 1411765 - DNA, 16 bp, Homo sapiens
gtaacagtcatcattt

SEQ ID NO: 1411766 - DNA, 22 bp, Homo sapiens
gtaatagaagcttaaaataaag

SEQ ID NO: 1411767 - DNA, 21 bp, Homo sapiens
gtacttgatttttcaaagact

SEQ ID NO: 1411768 - DNA, 15 bp, Homo sapiens
gtagaagaaaattta

SEQ ID NO: 1411769 - DNA, 15 bp, Homo sapiens
gtaggggtggcccga

SEQ ID NO: 1411770 - DNA, 18 bp, Homo sapiens
gtatatgtttatacacac

SEQ ID NO: 1411771 - DNA, 20 bp, Homo sapiens
gtatatgtttatacacacag

SEQ ID NO: 1411772 - DNA, 20 bp, Homo sapiens
gtatggaagacaaatacaca

SEQ ID NO: 1411773 - DNA, 20 bp, Homo sapiens
gtattatattttatttatct

SEQ ID NO: 1411774 - DNA, 15 bp, Homo sapiens
gtcaacccttctgga

SEQ ID NO: 1411775 - DNA, 13 bp, Homo sapiens
gtcaagtttttat

SEQ ID NO: 1411776 - DNA, 16 bp, Homo sapiens
gtcactacctggctgc

SEQ ID NO: 1411777 - DNA, 13 bp, Homo sapiens
gtcatagtttttt

SEQ ID NO: 1411778 - DNA, 19 bp, Homo sapiens
gtcatgtgcgaacacagtg

SEQ ID NO: 1411779 - DNA, 13 bp, Homo sapiens
gtccccagcagaa

SEQ ID NO: 1411780 - DNA, 22 bp, Homo sapiens
gtcccctcccagagctggtgga

SEQ ID NO: 1411781 - DNA, 16 bp, Homo sapiens
gtccggaatgccaccc

SEQ ID NO: 1411782 - DNA, 16 bp, Homo sapiens
gtctccgaaatgctgt

SEQ ID NO: 1411783 - DNA, 15 bp, Homo sapiens
gtctcctcaggacca

SEQ ID NO: 1411784 - DNA, 17 bp, Homo sapiens
gtgattcttagcaaaaa

SEQ ID NO: 1411785 - DNA, 16 bp, Homo sapiens
gtgcccatgtgtatgg

SEQ ID NO: 1411786 - DNA, 13 bp, Homo sapiens
gtgctcccctgct

SEQ ID NO: 1411787 - DNA, 21 bp, Homo sapiens
gtggagatcccacatatttca

SEQ ID NO: 1411788 - DNA, 22 bp, Homo sapiens
gtggccttgagcttcaaaatga

SEQ ID NO: 1411789 - DNA, 17 bp, Homo sapiens
gtgtatatgtttataca

SEQ ID NO: 1411790 - DNA, 20 bp, Homo sapiens
gtgtatatgtttatacacac

SEQ ID NO: 1411791 - DNA, 11 bp, Homo sapiens
gtgtccccacc

SEQ ID NO: 1411792 - DNA, 23 bp, Homo sapiens
gttaatctttgaaaactcataca

SEQ ID NO: 1411793 - DNA, 19 bp, Homo sapiens
gttatcattcttataacat

SEQ ID NO: 1411794 - DNA, 15 bp, Homo sapiens
gtttaaaaatcagaa

SEQ ID NO: 1411795 - DNA, 18 bp, Homo sapiens
gtttaaaaatcagaaaga

SEQ ID NO: 1411796 - DNA, 20 bp, Homo sapiens
gtttgtttctgttgttcact

SEQ ID NO: 1411797 - DNA, 13 bp, Homo sapiens
gttttagtttaaa

SEQ ID NO: 1411798 - DNA, 19 bp, Homo sapiens
gtttttatacctgtacaca

SEQ ID NO: 1411799 - DNA, 23 bp, Homo sapiens
gtttttttcttttttaattgaaa

SEQ ID NO: 1411800 - DNA, 16 bp, Homo sapiens
taaaatgaaatgcatt

SEQ ID NO: 1411801 - DNA, 18 bp, Homo sapiens
taaaatgaaatgcatttt

SEQ ID NO: 1411802 - DNA, 18 bp, Homo sapiens
taaacaaatattttcttt

SEQ ID NO: 1411803 - DNA, 12 bp, Homo sapiens
taaactggctta

SEQ ID NO: 1411804 - DNA, 16 bp, Homo sapiens
taaactggcttaactt

SEQ ID NO: 1411805 - DNA, 15 bp, Homo sapiens
taaagaccatttaat

SEQ ID NO: 1411806 - DNA, 18 bp, Homo sapiens
taaagatggggaaactga

SEQ ID NO: 1411807 - DNA, 22 bp, Homo sapiens
taaagatggggaaactgagggc

SEQ ID NO: 1411808 - DNA, 14 bp, Homo sapiens
taaatattatgcct

SEQ ID NO: 1411809 - DNA, 18 bp, Homo sapiens
taacactgagtgaaatat

SEQ ID NO: 1411810 - DNA, 16 bp, Homo sapiens
taacagtcatcattta

SEQ ID NO: 1411811 - DNA, 15 bp, Homo sapiens
taaccacatttctaa

SEQ ID NO: 1411812 - DNA, 22 bp, Homo sapiens
taaccacatttctaagcctttg

SEQ ID NO: 1411813 - DNA, 23 bp, Homo sapiens
taaccacctacaaggagataaga

SEQ ID NO: 1411814 - DNA, 20 bp, Homo sapiens
taacgcaaaaatagctcttg

SEQ ID NO: 1411815 - DNA, 14 bp, Homo sapiens
taactgcattttac

SEQ ID NO: 1411816 - DNA, 23 bp, Homo sapiens
taagacaagttcaacaacaaaac

SEQ ID NO: 1411817 - DNA, 13 bp, Homo sapiens
taagatacaaata

SEQ ID NO: 1411818 - DNA, 19 bp, Homo sapiens
taagattgaagctaaaaca

SEQ ID NO: 1411819 - DNA, 22 bp, Homo sapiens
taagcccaacaagttgaagaag

SEQ ID NO: 1411820 - DNA, 14 bp, Homo sapiens
taaggaaattctaa

SEQ ID NO: 1411821 - DNA, 15 bp, Homo sapiens
taaggacacaaactt

SEQ ID NO: 1411822 - DNA, 18 bp, Homo sapiens
taaggtccccagcagaat

SEQ ID NO: 1411823 - DNA, 12 bp, Homo sapiens
taagtaatctca

SEQ ID NO: 1411824 - DNA, 14 bp, Homo sapiens
taatatacagtgtg

SEQ ID NO: 1411825 - DNA, 20 bp, Homo sapiens
taatatacagtgtgtagttt

SEQ ID NO: 1411826 - DNA, 16 bp, Homo sapiens
taatctcacagcattt

SEQ ID NO: 1411827 - DNA, 18 bp, Homo sapiens
tacaatacagtatttctt

SEQ ID NO: 1411828 - DNA, 19 bp, Homo sapiens
tacacacacagacacacaa

SEQ ID NO: 1411829 - DNA, 14 bp, Homo sapiens
tacacacgctgcct

SEQ ID NO: 1411830 - DNA, 17 bp, Homo sapiens
tacacacgctgccttcg

SEQ ID NO: 1411831 - DNA, 14 bp, Homo sapiens
tacacgtgtatatg

SEQ ID NO: 1411832 - DNA, 17 bp, Homo sapiens
tacatacgcaattgtat

SEQ ID NO: 1411833 - DNA, 21 bp, Homo sapiens
tacattttgcagctatggaca

SEQ ID NO: 1411834 - DNA, 20 bp, Homo sapiens
taccacaggatgcatattaa

SEQ ID NO: 1411835 - DNA, 18 bp, Homo sapiens
taccacccggtccccact

SEQ ID NO: 1411836 - DNA, 16 bp, Homo sapiens
tacccatacaccccct

SEQ ID NO: 1411837 - DNA, 23 bp, Homo sapiens
tacccatacaccccctcttctga

SEQ ID NO: 1411838 - DNA, 14 bp, Homo sapiens
tacctgtacacaca

SEQ ID NO: 1411839 - DNA, 15 bp, Homo sapiens
tacctgtacacacac

SEQ ID NO: 1411840 - DNA, 16 bp, Homo sapiens
tacgcaattgtatata

SEQ ID NO: 1411841 - DNA, 16 bp, Homo sapiens
tactccaccagtgaaa

SEQ ID NO: 1411842 - DNA, 16 bp, Homo sapiens
tactctaatatacagt

SEQ ID NO: 1411843 - DNA, 15 bp, Homo sapiens
tactttaaccctttc

SEQ ID NO: 1411844 - DNA, 19 bp, Homo sapiens
tactttctgttatctagaa

SEQ ID NO: 1411845 - DNA, 19 bp, Homo sapiens
tactttgctgttgaagaaa

SEQ ID NO: 1411846 - DNA, 15 bp, Homo sapiens
tagaaaatatatttg

SEQ ID NO: 1411847 - DNA, 16 bp, Homo sapiens
tagaagaaaatttaat

SEQ ID NO: 1411848 - DNA, 20 bp, Homo sapiens
tagaagaggtggccccatat

SEQ ID NO: 1411849 - DNA, 16 bp, Homo sapiens
tagaaggactgcagcc

SEQ ID NO: 1411850 - DNA, 18 bp, Homo sapiens
tagaggccatgtctcctg

SEQ ID NO: 1411851 - DNA, 21 bp, Homo sapiens
tagatcccacgttgatgtctg

SEQ ID NO: 1411852 - DNA, 13 bp, Homo sapiens
tagcacatgattt

SEQ ID NO: 1411853 - DNA, 23 bp, Homo sapiens
tagccaaagaaatttcaacagtt

SEQ ID NO: 1411854 - DNA, 14 bp, Homo sapiens
tagcttttccctgt

SEQ ID NO: 1411855 - DNA, 20 bp, Homo sapiens
taggaagtaaagtgaagaat

SEQ ID NO: 1411856 - DNA, 21 bp, Homo sapiens
tagtactcttctagcatttag

SEQ ID NO: 1411857 - DNA, 22 bp, Homo sapiens
tagtagttgtagaagaaaattt

SEQ ID NO: 1411858 - DNA, 17 bp, Homo sapiens
tagtcttggctaaggaa

SEQ ID NO: 1411859 - DNA, 20 bp, Homo sapiens
tagttttgtgatgcatttta

SEQ ID NO: 1411860 - DNA, 13 bp, Homo sapiens
tataaaatacacg

SEQ ID NO: 1411861 - DNA, 19 bp, Homo sapiens
tataacattgtatgttaat

SEQ ID NO: 1411862 - DNA, 15 bp, Homo sapiens
tataatgtcaaatga

SEQ ID NO: 1411863 - DNA, 19 bp, Homo sapiens
tataatgtcaaatgaaacc

SEQ ID NO: 1411864 - DNA, 13 bp, Homo sapiens
tatacatacgcaa

SEQ ID NO: 1411865 - DNA, 19 bp, Homo sapiens
tatacatacgcaattgtat

SEQ ID NO: 1411866 - DNA, 17 bp, Homo sapiens
tatacatttaaagattt

SEQ ID NO: 1411867 - DNA, 12 bp, Homo sapiens
tatatacatacg

SEQ ID NO: 1411868 - DNA, 17 bp, Homo sapiens
tatatataaaatacacg

SEQ ID NO: 1411869 - DNA, 20 bp, Homo sapiens
tatatataaaatacacgtgt

SEQ ID NO: 1411870 - DNA, 12 bp, Homo sapiens
tatatatatgtg

SEQ ID NO: 1411871 - DNA, 14 bp, Homo sapiens
tatatatatgtgaa

SEQ ID NO: 1411872 - DNA, 13 bp, Homo sapiens
tatatatgtgaac

SEQ ID NO: 1411873 - DNA, 15 bp, Homo sapiens
tatatgaggatgtat

SEQ ID NO: 1411874 - DNA, 18 bp, Homo sapiens
tatatgaggatgtatgtg

SEQ ID NO: 1411875 - DNA, 12 bp, Homo sapiens
tatatgtatatt

SEQ ID NO: 1411876 - DNA, 14 bp, Homo sapiens
tatatgtgaacttt

SEQ ID NO: 1411877 - DNA, 14 bp, Homo sapiens
tatatgtttataca

SEQ ID NO: 1411878 - DNA, 20 bp, Homo sapiens
tatatgtttatacacacagg

SEQ ID NO: 1411879 - DNA, 21 bp, Homo sapiens
tatcattcttataacattgta

SEQ ID NO: 1411880 - DNA, 20 bp, Homo sapiens
tatgcatatatatgtatatt

SEQ ID NO: 1411881 - DNA, 19 bp, Homo sapiens
tatggaagacaaatacaca

SEQ ID NO: 1411882 - DNA, 15 bp, Homo sapiens
tatggactcagcctt

SEQ ID NO: 1411883 - DNA, 19 bp, Homo sapiens
tatggactcagccttgcaa

SEQ ID NO: 1411884 - DNA, 21 bp, Homo sapiens
tatggactcagccttgcaaat

SEQ ID NO: 1411885 - DNA, 13 bp, Homo sapiens
tatggatttctag

SEQ ID NO: 1411886 - DNA, 21 bp, Homo sapiens
tatgtctagggtgtgatttag

SEQ ID NO: 1411887 - DNA, 14 bp, Homo sapiens
tatgtgatgtaact

SEQ ID NO: 1411888 - DNA, 12 bp, Homo sapiens
tatgtgtatatg

SEQ ID NO: 1411889 - DNA, 13 bp, Homo sapiens
tatgtgtatatgt

SEQ ID NO: 1411890 - DNA, 14 bp, Homo sapiens
tatgtgtatatgtt

SEQ ID NO: 1411891 - DNA, 14 bp, Homo sapiens
tatgtttatacaca

SEQ ID NO: 1411892 - DNA, 23 bp, Homo sapiens
tattatattttatttatctttgt

SEQ ID NO: 1411893 - DNA, 12 bp, Homo sapiens
tattattaatta

SEQ ID NO: 1411894 - DNA, 19 bp, Homo sapiens
tattgccaaaacccagctg

SEQ ID NO: 1411895 - DNA, 20 bp, Homo sapiens
tattgccaaaacccagctgc

SEQ ID NO: 1411896 - DNA, 19 bp, Homo sapiens
tatttcaaaaacatgcttt

SEQ ID NO: 1411897 - DNA, 19 bp, Homo sapiens
tatttgcaaggctgattta

SEQ ID NO: 1411898 - DNA, 18 bp, Homo sapiens
tatttgcataatatgcat

SEQ ID NO: 1411899 - DNA, 18 bp, Homo sapiens
tcaaaatgagatatgcaa

SEQ ID NO: 1411900 - DNA, 15 bp, Homo sapiens
tcaaataatattcat

SEQ ID NO: 1411901 - DNA, 22 bp, Homo sapiens
tcaacagttattgggcttaaaa

SEQ ID NO: 1411902 - DNA, 21 bp, Homo sapiens
tcaatacctggcctcatttaa

SEQ ID NO: 1411903 - DNA, 22 bp, Homo sapiens
tcaatacctggcctcatttaaa

SEQ ID NO: 1411904 - DNA, 14 bp, Homo sapiens
tcaatttcagaaac

SEQ ID NO: 1411905 - DNA, 20 bp, Homo sapiens
tcagagatataataagccca

SEQ ID NO: 1411906 - DNA, 19 bp, Homo sapiens
tcagcatatatataaaata

SEQ ID NO: 1411907 - DNA, 14 bp, Homo sapiens
tcaggaatcatctc

SEQ ID NO: 1411908 - DNA, 18 bp, Homo sapiens
tcaggcaccagtccctgt

SEQ ID NO: 1411909 - DNA, 12 bp, Homo sapiens
tcaggtgctgaa

SEQ ID NO: 1411910 - DNA, 17 bp, Homo sapiens
tcagtgcccatgtgtat

SEQ ID NO: 1411911 - DNA, 18 bp, Homo sapiens
tcagtgcccatgtgtatg

SEQ ID NO: 1411912 - DNA, 19 bp, Homo sapiens
tcagtgcccatgtgtatgg

SEQ ID NO: 1411913 - DNA, 19 bp, Homo sapiens
tcataagagtaacagtcat

SEQ ID NO: 1411914 - DNA, 20 bp, Homo sapiens
tcatatcctctcgttcagtt

SEQ ID NO: 1411915 - DNA, 21 bp, Homo sapiens
tcatattttcctttatgtgat

SEQ ID NO: 1411916 - DNA, 15 bp, Homo sapiens
tcatgaaagcagtga

SEQ ID NO: 1411917 - DNA, 23 bp, Homo sapiens
tcatgaaagcagtgaagcaattt

SEQ ID NO: 1411918 - DNA, 12 bp, Homo sapiens
tcatgtaattat

SEQ ID NO: 1411919 - DNA, 23 bp, Homo sapiens
tcatttatcatcacaaatggcta

SEQ ID NO: 1411920 - DNA, 20 bp, Homo sapiens
tccaaggctactacagagaa

SEQ ID NO: 1411921 - DNA, 15 bp, Homo sapiens
tccaccttccaaaga

SEQ ID NO: 1411922 - DNA, 15 bp, Homo sapiens
tccagcaggcccatg

SEQ ID NO: 1411923 - DNA, 14 bp, Homo sapiens
tccatacacacgct

SEQ ID NO: 1411924 - DNA, 21 bp, Homo sapiens
tcccagagctggtggacccag

SEQ ID NO: 1411925 - DNA, 17 bp, Homo sapiens
tcccagcatcgcactct

SEQ ID NO: 1411926 - DNA, 19 bp, Homo sapiens
tcccaggtcgcccacctgt

SEQ ID NO: 1411927 - DNA, 14 bp, Homo sapiens
tccccaccatctgc

SEQ ID NO: 1411928 - DNA, 14 bp, Homo sapiens
tccccagcagaatt

SEQ ID NO: 1411929 - DNA, 15 bp, Homo sapiens
tcccccagccactcc

SEQ ID NO: 1411930 - DNA, 21 bp, Homo sapiens
tccccctcccccagccactcc

SEQ ID NO: 1411931 - DNA, 16 bp, Homo sapiens
tccccttcctaccacc

SEQ ID NO: 1411932 - DNA, 13 bp, Homo sapiens
tccctcccaggac

SEQ ID NO: 1411933 - DNA, 23 bp, Homo sapiens
tccctgactgggggcagacatgg

SEQ ID NO: 1411934 - DNA, 17 bp, Homo sapiens
tccctgagttcactctc

SEQ ID NO: 1411935 - DNA, 18 bp, Homo sapiens
tcccttagtactcttcta

SEQ ID NO: 1411936 - DNA, 14 bp, Homo sapiens
tccgtcactacctg

SEQ ID NO: 1411937 - DNA, 15 bp, Homo sapiens
tccgtcactacctgg

SEQ ID NO: 1411938 - DNA, 17 bp, Homo sapiens
tccgtcactacctggct

SEQ ID NO: 1411939 - DNA, 18 bp, Homo sapiens
tccgtcactacctggctg

SEQ ID NO: 1411940 - DNA, 16 bp, Homo sapiens
tcctcccactgcccac

SEQ ID NO: 1411941 - DNA, 23 bp, Homo sapiens
tcctgacaccaggcaagaaaagc

SEQ ID NO: 1411942 - DNA, 15 bp, Homo sapiens
tcctttatgtgatgt

SEQ ID NO: 1411943 - DNA, 19 bp, Homo sapiens
tcgcactctggcagcaccg

SEQ ID NO: 1411944 - DNA, 21 bp, Homo sapiens
tcgcactctggcagcaccgcc

SEQ ID NO: 1411945 - DNA, 13 bp, Homo sapiens
tcgctccctccca

SEQ ID NO: 1411946 - DNA, 15 bp, Homo sapiens
tcggatccccttcct

SEQ ID NO: 1411947 - DNA, 13 bp, Homo sapiens
tcggcaaggaagt

SEQ ID NO: 1411948 - DNA, 16 bp, Homo sapiens
tcggtgtccccaccat

SEQ ID NO: 1411949 - DNA, 22 bp, Homo sapiens
tctaacgcaaaaatagctcttg

SEQ ID NO: 1411950 - DNA, 23 bp, Homo sapiens
tctaacgcaaaaatagctcttgc

SEQ ID NO: 1411951 - DNA, 13 bp, Homo sapiens
tctagaattccag

SEQ ID NO: 1411952 - DNA, 21 bp, Homo sapiens
tctatataaccacatttctaa

SEQ ID NO: 1411953 - DNA, 16 bp, Homo sapiens
tctcagcatatatata

SEQ ID NO: 1411954 - DNA, 17 bp, Homo sapiens
tctcagcatatatataa

SEQ ID NO: 1411955 - DNA, 23 bp, Homo sapiens
tctcagcatatatataaaataca

SEQ ID NO: 1411956 - DNA, 23 bp, Homo sapiens
tctcaggaatcatctcctttgca

SEQ ID NO: 1411957 - DNA, 20 bp, Homo sapiens
tctcaggcaccagtccctgt

SEQ ID NO: 1411958 - DNA, 14 bp, Homo sapiens
tctcatagctcata

SEQ ID NO: 1411959 - DNA, 19 bp, Homo sapiens
tctcatgaaagcagtgaag

SEQ ID NO: 1411960 - DNA, 11 bp, Homo sapiens
tctccagcagg

SEQ ID NO: 1411961 - DNA, 14 bp, Homo sapiens
tctccagcaggccc

SEQ ID NO: 1411962 - DNA, 14 bp, Homo sapiens
tctcccacatgcca

SEQ ID NO: 1411963 - DNA, 23 bp, Homo sapiens
tctccgaaatgctgtctttcttg

SEQ ID NO: 1411964 - DNA, 18 bp, Homo sapiens
tctcgctccctcccagga

SEQ ID NO: 1411965 - DNA, 17 bp, Homo sapiens
tctcggggtcaggttct

SEQ ID NO: 1411966 - DNA, 17 bp, Homo sapiens
tctcgtatggatttcta

SEQ ID NO: 1411967 - DNA, 23 bp, Homo sapiens
tctctcaggaatcatctcctttg

SEQ ID NO: 1411968 - DNA, 19 bp, Homo sapiens
tctctccaccttccaaaga

SEQ ID NO: 1411969 - DNA, 13 bp, Homo sapiens
tctctcttgtcct

SEQ ID NO: 1411970 - DNA, 16 bp, Homo sapiens
tctctgattacagtgg

SEQ ID NO: 1411971 - DNA, 14 bp, Homo sapiens
tctgaaacatagat

SEQ ID NO: 1411972 - DNA, 15 bp, Homo sapiens
tctgcctgtcaagtt

SEQ ID NO: 1411973 - DNA, 14 bp, Homo sapiens
tctggagagcccag

SEQ ID NO: 1411974 - DNA, 22 bp, Homo sapiens
tctggcagcaccgcctcttccc

SEQ ID NO: 1411975 - DNA, 19 bp, Homo sapiens
tcttataacattgtatgtt

SEQ ID NO: 1411976 - DNA, 14 bp, Homo sapiens
tcttcgggaccagg

SEQ ID NO: 1411977 - DNA, 17 bp, Homo sapiens
tcttgtagtcttggcta

SEQ ID NO: 1411978 - DNA, 19 bp, Homo sapiens
tctttcttgctccctgact

SEQ ID NO: 1411979 - DNA, 19 bp, Homo sapiens
tctttgccatctctgctcc

SEQ ID NO: 1411980 - DNA, 19 bp, Homo sapiens
tcttttgtaataaactatt

SEQ ID NO: 1411981 - DNA, 12 bp, Homo sapiens
tgaaacacaata

SEQ ID NO: 1411982 - DNA, 15 bp, Homo sapiens
tgaaagggacaagta

SEQ ID NO: 1411983 - DNA, 16 bp, Homo sapiens
tgaaagggacaagtat

SEQ ID NO: 1411984 - DNA, 13 bp, Homo sapiens
tgaaatattactc

SEQ ID NO: 1411985 - DNA, 14 bp, Homo sapiens
tgaaatgcattttg

SEQ ID NO: 1411986 - DNA, 21 bp, Homo sapiens
tgaactttctcagcatatata

SEQ ID NO: 1411987 - DNA, 22 bp, Homo sapiens
tgaagcaatttcagttttaaaa

SEQ ID NO: 1411988 - DNA, 14 bp, Homo sapiens
tgacaatgacaaaa

SEQ ID NO: 1411989 - DNA, 19 bp, Homo sapiens
tgacaccaggcaagaaaag

SEQ ID NO: 1411990 - DNA, 13 bp, Homo sapiens
tgacccgtacaca

SEQ ID NO: 1411991 - DNA, 15 bp, Homo sapiens
tgacccgtacacacc

SEQ ID NO: 1411992 - DNA, 14 bp, Homo sapiens
tgagacctcagctt

SEQ ID NO: 1411993 - DNA, 22 bp, Homo sapiens
tgagacctcagcttggcactca

SEQ ID NO: 1411994 - DNA, 18 bp, Homo sapiens
tgagatatgcaataaata

SEQ ID NO: 1411995 - DNA, 20 bp, Homo sapiens
tgagatatgcaataaatatt

SEQ ID NO: 1411996 - DNA, 15 bp, Homo sapiens
tgagatctttctaaa

SEQ ID NO: 1411997 - DNA, 22 bp, Homo sapiens
tgagatgaaccctggcatttgg

SEQ ID NO: 1411998 - DNA, 16 bp, Homo sapiens
tgagggcgtgaaacac

SEQ ID NO: 1411999 - DNA, 21 bp, Homo sapiens
tgatactccaccagtgaaaat

SEQ ID NO: 1412000 - DNA, 11 bp, Homo sapiens
tgatgcatttt

SEQ ID NO: 1412001 - DNA, 12 bp, Homo sapiens
tgatgcatttta

SEQ ID NO: 1412002 - DNA, 14 bp, Homo sapiens
tgattatatttcac

SEQ ID NO: 1412003 - DNA, 19 bp, Homo sapiens
tgatttaggtcagtagact

SEQ ID NO: 1412004 - DNA, 16 bp, Homo sapiens
tgcaataaatattatt

SEQ ID NO: 1412005 - DNA, 17 bp, Homo sapiens
tgcacaggaagctgaga

SEQ ID NO: 1412006 - DNA, 19 bp, Homo sapiens
tgcaccccttcctgggcac

SEQ ID NO: 1412007 - DNA, 19 bp, Homo sapiens
tgcaccggtttcatagacg

SEQ ID NO: 1412008 - DNA, 23 bp, Homo sapiens
tgcacctacccatacaccccctc

SEQ ID NO: 1412009 - DNA, 14 bp, Homo sapiens
tgcacctgcagcca

SEQ ID NO: 1412010 - DNA, 23 bp, Homo sapiens
tgcagagggctccagagtggaga

SEQ ID NO: 1412011 - DNA, 15 bp, Homo sapiens
tgcataatatgcata

SEQ ID NO: 1412012 - DNA, 18 bp, Homo sapiens
tgcataatatgcatatat

SEQ ID NO: 1412013 - DNA, 14 bp, Homo sapiens
tgcatatatatgta

SEQ ID NO: 1412014 - DNA, 16 bp, Homo sapiens
tgcatatatatgtata

SEQ ID NO: 1412015 - DNA, 17 bp, Homo sapiens
tgcatatatatgtatat

SEQ ID NO: 1412016 - DNA, 20 bp, Homo sapiens
tgcattttacacattgacaa

SEQ ID NO: 1412017 - DNA, 15 bp, Homo sapiens
tgcattttatagaat

SEQ ID NO: 1412018 - DNA, 19 bp, Homo sapiens
tgcattttgctagacagtt

SEQ ID NO: 1412019 - DNA, 20 bp, Homo sapiens
tgcattttgctagacagtta

SEQ ID NO: 1412020 - DNA, 17 bp, Homo sapiens
tgccaaaacccagctgc

SEQ ID NO: 1412021 - DNA, 15 bp, Homo sapiens
tgccatctctgctcc

SEQ ID NO: 1412022 - DNA, 16 bp, Homo sapiens
tgccatctctgctcca

SEQ ID NO: 1412023 - DNA, 14 bp, Homo sapiens
tgcccatgtgtatg

SEQ ID NO: 1412024 - DNA, 19 bp, Homo sapiens
tgcccctggccttgggatc

SEQ ID NO: 1412025 - DNA, 16 bp, Homo sapiens
tgcctgctatgtattt

SEQ ID NO: 1412026 - DNA, 14 bp, Homo sapiens
tgcctgtcaagttt

SEQ ID NO: 1412027 - DNA, 18 bp, Homo sapiens
tgccttatcaaataatat

SEQ ID NO: 1412028 - DNA, 18 bp, Homo sapiens
tgcggggcgggcacacct

SEQ ID NO: 1412029 - DNA, 18 bp, Homo sapiens
tgctcaatacctggcctc

SEQ ID NO: 1412030 - DNA, 13 bp, Homo sapiens
tgctccctgactg

SEQ ID NO: 1412031 - DNA, 14 bp, Homo sapiens
tgctctacatctcg

SEQ ID NO: 1412032 - DNA, 22 bp, Homo sapiens
tgctgcctcggatccccttcct

SEQ ID NO: 1412033 - DNA, 23 bp, Homo sapiens
tgctgtcttttctttgccatctc

SEQ ID NO: 1412034 - DNA, 16 bp, Homo sapiens
tggaagacaaatacac

SEQ ID NO: 1412035 - DNA, 13 bp, Homo sapiens
tggactcagcctt

SEQ ID NO: 1412036 - DNA, 16 bp, Homo sapiens
tggagatcccacatat

SEQ ID NO: 1412037 - DNA, 16 bp, Homo sapiens
tggatttcttttgtaa

SEQ ID NO: 1412038 - DNA, 12 bp, Homo sapiens
tggcaaagccag

SEQ ID NO: 1412039 - DNA, 14 bp, Homo sapiens
tggcaaagccagaa

SEQ ID NO: 1412040 - DNA, 13 bp, Homo sapiens
tggcaccttcccc

SEQ ID NO: 1412041 - DNA, 21 bp, Homo sapiens
tggcaccttccccctccccca

SEQ ID NO: 1412042 - DNA, 15 bp, Homo sapiens
tggcatttggcctct

SEQ ID NO: 1412043 - DNA, 17 bp, Homo sapiens
tggcatttggcctcttg

SEQ ID NO: 1412044 - DNA, 20 bp, Homo sapiens
tggcctcatttaaaacaaga

SEQ ID NO: 1412045 - DNA, 17 bp, Homo sapiens
tggcctcttgtagtctt

SEQ ID NO: 1412046 - DNA, 22 bp, Homo sapiens
tggcctgatcagcaggagccaa

SEQ ID NO: 1412047 - DNA, 18 bp, Homo sapiens
tggccttgggatccaggc

SEQ ID NO: 1412048 - DNA, 20 bp, Homo sapiens
tgggactgggaacagaactc

SEQ ID NO: 1412049 - DNA, 12 bp, Homo sapiens
tgggcacacgct

SEQ ID NO: 1412050 - DNA, 20 bp, Homo sapiens
tgggcacacgctgctctgcc

SEQ ID NO: 1412051 - DNA, 23 bp, Homo sapiens
tgggcacacgctgctctgcccca

SEQ ID NO: 1412052 - DNA, 22 bp, Homo sapiens
tgggcagatctcccacatgcca

SEQ ID NO: 1412053 - DNA, 20 bp, Homo sapiens
tgggccagccgattcctcca

SEQ ID NO: 1412054 - DNA, 19 bp, Homo sapiens
tgggggcaaaatcagaatg

SEQ ID NO: 1412055 - DNA, 19 bp, Homo sapiens
tggggtctcctcaggacca

SEQ ID NO: 1412056 - DNA, 21 bp, Homo sapiens
tgtaagtactctaatatacag

SEQ ID NO: 1412057 - DNA, 23 bp, Homo sapiens
tgtaagtactctaatatacagtg

SEQ ID NO: 1412058 - DNA, 15 bp, Homo sapiens
tgtaatagaagctta

SEQ ID NO: 1412059 - DNA, 11 bp, Homo sapiens
tgtacacacac

SEQ ID NO: 1412060 - DNA, 19 bp, Homo sapiens
tgtacacacacagacacac

SEQ ID NO: 1412061 - DNA, 22 bp, Homo sapiens
tgtacttgatttttcaaagact

SEQ ID NO: 1412062 - DNA, 19 bp, Homo sapiens
tgtagcctaaagaccattt

SEQ ID NO: 1412063 - DNA, 13 bp, Homo sapiens
tgtatatatatgt

SEQ ID NO: 1412064 - DNA, 16 bp, Homo sapiens
tgtatatatatgtgaa

SEQ ID NO: 1412065 - DNA, 21 bp, Homo sapiens
tgtatatgaggatgtatgtgt

SEQ ID NO: 1412066 - DNA, 22 bp, Homo sapiens
tgtatatgaggatgtatgtgta

SEQ ID NO: 1412067 - DNA, 18 bp, Homo sapiens
tgtatatgtttatacaca

SEQ ID NO: 1412068 - DNA, 15 bp, Homo sapiens
tgtatctgacatatt

SEQ ID NO: 1412069 - DNA, 20 bp, Homo sapiens
tgtatggaagacaaatacac

SEQ ID NO: 1412070 - DNA, 16 bp, Homo sapiens
tgtatgtgtatatgtt

SEQ ID NO: 1412071 - DNA, 19 bp, Homo sapiens
tgtcaagtttttatacctg

SEQ ID NO: 1412072 - DNA, 22 bp, Homo sapiens
tgtcaagtttttatacctgtac

SEQ ID NO: 1412073 - DNA, 22 bp, Homo sapiens
tgtcatattttcctttatgtga

SEQ ID NO: 1412074 - DNA, 19 bp, Homo sapiens
tgtcatgtgcgaacacagt

SEQ ID NO: 1412075 - DNA, 21 bp, Homo sapiens
tgtccccaccatctgctgtct

SEQ ID NO: 1412076 - DNA, 15 bp, Homo sapiens
tgtctgaaacataga

SEQ ID NO: 1412077 - DNA, 17 bp, Homo sapiens
tgtgatgcattttatag

SEQ ID NO: 1412078 - DNA, 13 bp, Homo sapiens
tgtgcgaacacag

SEQ ID NO: 1412079 - DNA, 23 bp, Homo sapiens
tgtgctctacatctcgtatggat

SEQ ID NO: 1412080 - DNA, 20 bp, Homo sapiens
tgtgtcacactgtggcctga

SEQ ID NO: 1412081 - DNA, 12 bp, Homo sapiens
tgtgttgcaaag

SEQ ID NO: 1412082 - DNA, 17 bp, Homo sapiens
tgttgagacctcagctt

SEQ ID NO: 1412083 - DNA, 17 bp, Homo sapiens
tgttgtctgaaacatag

SEQ ID NO: 1412084 - DNA, 17 bp, Homo sapiens
tgtttataatgtcaaat

SEQ ID NO: 1412085 - DNA, 22 bp, Homo sapiens
tgtttcttacgcttgctatcat

SEQ ID NO: 1412086 - DNA, 14 bp, Homo sapiens
ttaaaaatgaagat

SEQ ID NO: 1412087 - DNA, 19 bp, Homo sapiens
ttaaaatgaaatgcatttt

SEQ ID NO: 1412088 - DNA, 20 bp, Homo sapiens
ttaaagtgccttatcaaata

SEQ ID NO: 1412089 - DNA, 13 bp, Homo sapiens
ttaacaaattgca

SEQ ID NO: 1412090 - DNA, 17 bp, Homo sapiens
ttaacaaattgcatttg

SEQ ID NO: 1412091 - DNA, 20 bp, Homo sapiens
ttaatctctccaccttccaa

SEQ ID NO: 1412092 - DNA, 19 bp, Homo sapiens
ttaccacaggatgcatatt

SEQ ID NO: 1412093 - DNA, 17 bp, Homo sapiens
ttacctgttgtctgaaa

SEQ ID NO: 1412094 - DNA, 21 bp, Homo sapiens
ttacctgttgtctgaaacata

SEQ ID NO: 1412095 - DNA, 20 bp, Homo sapiens
ttactctgcctgtcaagttt

SEQ ID NO: 1412096 - DNA, 24 bp, Homo sapiens
ttagtatattattattaattacaa

SEQ ID NO: 1412097 - DNA, 23 bp, Homo sapiens
ttagttaatctttgaaaactcat

SEQ ID NO: 1412098 - DNA, 17 bp, Homo sapiens
ttataacattgtatgtt

SEQ ID NO: 1412099 - DNA, 13 bp, Homo sapiens
ttataatgtcaaa

SEQ ID NO: 1412100 - DNA, 18 bp, Homo sapiens
ttataatgtcaaatgaaa

SEQ ID NO: 1412101 - DNA, 16 bp, Homo sapiens
ttatacctgtacacac

SEQ ID NO: 1412102 - DNA, 18 bp, Homo sapiens
ttatacctgtacacacac

SEQ ID NO: 1412103 - DNA, 18 bp, Homo sapiens
ttatcaaataatattcat

SEQ ID NO: 1412104 - DNA, 21 bp, Homo sapiens
ttattgccaaaacccagctgc

SEQ ID NO: 1412105 - DNA, 18 bp, Homo sapiens
ttcaacaacaaaacattt

SEQ ID NO: 1412106 - DNA, 12 bp, Homo sapiens
ttcatgaagagt

SEQ ID NO: 1412107 - DNA, 12 bp, Homo sapiens
ttcatttaacac

SEQ ID NO: 1412108 - DNA, 19 bp, Homo sapiens
ttcatttaacactgagtga

SEQ ID NO: 1412109 - DNA, 21 bp, Homo sapiens
ttcattttgcacctgcagcca

SEQ ID NO: 1412110 - DNA, 18 bp, Homo sapiens
ttccaaacccaggctatt

SEQ ID NO: 1412111 - DNA, 19 bp, Homo sapiens
ttccattggaaaatttaag

SEQ ID NO: 1412112 - DNA, 22 bp, Homo sapiens
ttcctgggcacacgctgctctg

SEQ ID NO: 1412113 - DNA, 15 bp, Homo sapiens
ttctttgccatctct

SEQ ID NO: 1412114 - DNA, 21 bp, Homo sapiens
ttctttgccatctctgctcca

SEQ ID NO: 1412115 - DNA, 16 bp, Homo sapiens
ttgaacagagctagag

SEQ ID NO: 1412116 - DNA, 20 bp, Homo sapiens
ttgacttaggtgtgaagacc

SEQ ID NO: 1412117 - DNA, 16 bp, Homo sapiens
ttgagcttcaaaatga

SEQ ID NO: 1412118 - DNA, 14 bp, Homo sapiens
ttgcacctgcagcc

SEQ ID NO: 1412119 - DNA, 14 bp, Homo sapiens
ttgcagttatgtta

SEQ ID NO: 1412120 - DNA, 17 bp, Homo sapiens
ttgcataatatgcatat

SEQ ID NO: 1412121 - DNA, 19 bp, Homo sapiens
ttgccaaaacccagctgca

SEQ ID NO: 1412122 - DNA, 15 bp, Homo sapiens
ttgccagcccatttg

SEQ ID NO: 1412123 - DNA, 18 bp, Homo sapiens
ttgctcaatacctggcct

SEQ ID NO: 1412124 - DNA, 9 bp, Homo sapiens
ttgctctgg

SEQ ID NO: 1412125 - DNA, 22 bp, Homo sapiens
ttgctgcctcggatccccttcc

SEQ ID NO: 1412126 - DNA, 13 bp, Homo sapiens
ttggaaatgagaa

SEQ ID NO: 1412127 - DNA, 23 bp, Homo sapiens
ttggcaccttccccctcccccag

SEQ ID NO: 1412128 - DNA, 19 bp, Homo sapiens
ttgtagaagaaaatttaat

SEQ ID NO: 1412129 - DNA, 14 bp, Homo sapiens
ttgtatatatatgt

SEQ ID NO: 1412130 - DNA, 22 bp, Homo sapiens
ttgtatgttaatagaaaatata

SEQ ID NO: 1412131 - DNA, 13 bp, Homo sapiens
ttgtctgaaacat

SEQ ID NO: 1412132 - DNA, 17 bp, Homo sapiens
tttaaaatgaaatgcat

SEQ ID NO: 1412133 - DNA, 20 bp, Homo sapiens
tttaaaatgaaatgcatttt

SEQ ID NO: 1412134 - DNA, 20 bp, Homo sapiens
tttaaagtgccttatcaaat

SEQ ID NO: 1412135 - DNA, 17 bp, Homo sapiens
tttaacactgagtgaaa

SEQ ID NO: 1412136 - DNA, 13 bp, Homo sapiens
tttaaccctcaca

SEQ ID NO: 1412137 - DNA, 21 bp, Homo sapiens
tttaagatacaaataaggaca

SEQ ID NO: 1412138 - DNA, 23 bp, Homo sapiens
tttaatctctccaccttccaaag

SEQ ID NO: 1412139 - DNA, 22 bp, Homo sapiens
tttataatgtcaaatgaaacct

SEQ ID NO: 1412140 - DNA, 16 bp, Homo sapiens
tttatacacacaggag

SEQ ID NO: 1412141 - DNA, 20 bp, Homo sapiens
tttatacctgtacacacaca

SEQ ID NO: 1412142 - DNA, 15 bp, Homo sapiens
tttatgtgatgtaac

SEQ ID NO: 1412143 - DNA, 16 bp, Homo sapiens
tttatgtgatgtaact

SEQ ID NO: 1412144 - DNA, 17 bp, Homo sapiens
tttcacccatctctcag

SEQ ID NO: 1412145 - DNA, 19 bp, Homo sapiens
tttcattttgcacctgcag

SEQ ID NO: 1412146 - DNA, 17 bp, Homo sapiens
tttctcagcatatatat

SEQ ID NO: 1412147 - DNA, 22 bp, Homo sapiens
tttctttgccatctctgctcca

SEQ ID NO: 1412148 - DNA, 13 bp, Homo sapiens
tttcttttttaat

SEQ ID NO: 1412149 - DNA, 14 bp, Homo sapiens
tttgaaaactcatc

SEQ ID NO: 1412150 - DNA, 16 bp, Homo sapiens
tttgctgttgaagaaa

SEQ ID NO: 1412151 - DNA, 14 bp, Homo sapiens
tttgtgatgcattt

SEQ ID NO: 1412152 - DNA, 21 bp, Homo sapiens
tttgtttctgttgttcacttg

SEQ ID NO: 1412153 - DNA, 17 bp, Homo sapiens
tttgtttcttacgcttg

SEQ ID NO: 1412154 - DNA, 19 bp, Homo sapiens
ttttaaaatgaaatgcatt

SEQ ID NO: 1412155 - DNA, 17 bp, Homo sapiens
ttttatacctgtacaca

SEQ ID NO: 1412156 - DNA, 22 bp, Homo sapiens
ttttatttttggcaaagccaga

SEQ ID NO: 1412157 - DNA, 15 bp, Homo sapiens
ttttcaaagacttca

SEQ ID NO: 1412158 - DNA, 14 bp, Homo sapiens
ttttcaattatact

SEQ ID NO: 1412159 - DNA, 20 bp, Homo sapiens
ttttctttgccatctctgct

SEQ ID NO: 1412160 - DNA, 19 bp, Homo sapiens
ttttcttttttaattgaaa

SEQ ID NO: 1412161 - DNA, 19 bp, Homo sapiens
tttttatttttggcaaagc

SEQ ID NO: 1412162 - DNA, 17 bp, Homo sapiens
tttttggcaaagccaga

SEQ ID NO: 1412163 - DNA, 17 bp, Homo sapiens
aaaaagcatcattacaa

SEQ ID NO: 1412164 - DNA, 12 bp, Homo sapiens
aaaaatgaagat

SEQ ID NO: 1412165 - DNA, 19 bp, Homo sapiens
aaaacccagctgcacccct

SEQ ID NO: 1412166 - DNA, 18 bp, Homo sapiens
aaaagtggctggaagagt

SEQ ID NO: 1412167 - DNA, 17 bp, Homo sapiens
aaaatagctcttgcttt

SEQ ID NO: 1412168 - DNA, 13 bp, Homo sapiens
aaaatcagaatgg

SEQ ID NO: 1412169 - DNA, 17 bp, Homo sapiens
aaacatgcttttccaaa

SEQ ID NO: 1412170 - DNA, 22 bp, Homo sapiens
aaacccagctgcaccccttcct

SEQ ID NO: 1412171 - DNA, 23 bp, Homo sapiens
aaacccagctgcaccccttcctg

SEQ ID NO: 1412172 - DNA, 18 bp, Homo sapiens
aaactcatacagtggtat

SEQ ID NO: 1412173 - DNA, 19 bp, Homo sapiens
aaactggcttaacttagta

SEQ ID NO: 1412174 - DNA, 16 bp, Homo sapiens
aaagacattcttagtt

SEQ ID NO: 1412175 - DNA, 13 bp, Homo sapiens
aaagaccatttaa

SEQ ID NO: 1412176 - DNA, 14 bp, Homo sapiens
aaagaccatttaat

SEQ ID NO: 1412177 - DNA, 12 bp, Homo sapiens
aaagagaaaaaa

SEQ ID NO: 1412178 - DNA, 16 bp, Homo sapiens
aaagatcaaatgaaaa

SEQ ID NO: 1412179 - DNA, 22 bp, Homo sapiens
aaagcagtgaagcaatttcagt

SEQ ID NO: 1412180 - DNA, 21 bp, Homo sapiens
aaataaagttaaactgattat

SEQ ID NO: 1412181 - DNA, 14 bp, Homo sapiens
aaataaggacacaa

SEQ ID NO: 1412182 - DNA, 12 bp, Homo sapiens
aaataatattca

SEQ ID NO: 1412183 - DNA, 13 bp, Homo sapiens
aaataatattcat

SEQ ID NO: 1412184 - DNA, 13 bp, Homo sapiens
aaatacacataca

SEQ ID NO: 1412185 - DNA, 15 bp, Homo sapiens
aaatacacatacata

SEQ ID NO: 1412186 - DNA, 20 bp, Homo sapiens
aaatacacatacatatatac

SEQ ID NO: 1412187 - DNA, 14 bp, Homo sapiens
aaatacacgtgtat

SEQ ID NO: 1412188 - DNA, 16 bp, Homo sapiens
aaatacacgtgtatat

SEQ ID NO: 1412189 - DNA, 15 bp, Homo sapiens
aaatcagaaagacat

SEQ ID NO: 1412190 - DNA, 17 bp, Homo sapiens
aaatgaaatgcattttg

SEQ ID NO: 1412191 - DNA, 17 bp, Homo sapiens
aaatgcattttgctaga

SEQ ID NO: 1412192 - DNA, 14 bp, Homo sapiens
aaatgcctgccaaa

SEQ ID NO: 1412193 - DNA, 20 bp, Homo sapiens
aaatgtgtcttgtattatca

SEQ ID NO: 1412194 - DNA, 14 bp, Homo sapiens
aaattgcatttgtg

SEQ ID NO: 1412195 - DNA, 13 bp, Homo sapiens
aaatttaattatt

SEQ ID NO: 1412196 - DNA, 14 bp, Homo sapiens
aaattttagattta

SEQ ID NO: 1412197 - DNA, 18 bp, Homo sapiens
aacaaaacatttgctctg

SEQ ID NO: 1412198 - DNA, 15 bp, Homo sapiens
aacaaattgcatttg

SEQ ID NO: 1412199 - DNA, 13 bp, Homo sapiens
aacaagacaaggt

SEQ ID NO: 1412200 - DNA, 14 bp, Homo sapiens
aacaagttgaagaa

SEQ ID NO: 1412201 - DNA, 14 bp, Homo sapiens
aacacaaagatcaa

SEQ ID NO: 1412202 - DNA, 15 bp, Homo sapiens
aacactgagtgaaat

SEQ ID NO: 1412203 - DNA, 17 bp, Homo sapiens
aacactgagtgaaatat

SEQ ID NO: 1412204 - DNA, 21 bp, Homo sapiens
aacactgagtgaaatattact

SEQ ID NO: 1412205 - DNA, 15 bp, Homo sapiens
aacagtcatcattta

SEQ ID NO: 1412206 - DNA, 17 bp, Homo sapiens
aacatgcttttccaaac

SEQ ID NO: 1412207 - DNA, 14 bp, Homo sapiens
aacattgtatgtta

SEQ ID NO: 1412208 - DNA, 23 bp, Homo sapiens
aacccagctgcaccccttcctgg

SEQ ID NO: 1412209 - DNA, 18 bp, Homo sapiens
aacctgacagcaaacaca

SEQ ID NO: 1412210 - DNA, 19 bp, Homo sapiens
aacctgacagcaaacacag

SEQ ID NO: 1412211 - DNA, 18 bp, Homo sapiens
aactactaatctcaattt

SEQ ID NO: 1412212 - DNA, 20 bp, Homo sapiens
aactactaatctcaatttaa

SEQ ID NO: 1412213 - DNA, 17 bp, Homo sapiens
aactcggtgtccccacc

SEQ ID NO: 1412214 - DNA, 18 bp, Homo sapiens
aactcggtgtccccacca

SEQ ID NO: 1412215 - DNA, 19 bp, Homo sapiens
aactcggtgtccccaccat

SEQ ID NO: 1412216 - DNA, 21 bp, Homo sapiens
aactcggtgtccccaccatct

SEQ ID NO: 1412217 - DNA, 13 bp, Homo sapiens
aactgcattttac

SEQ ID NO: 1412218 - DNA, 18 bp, Homo sapiens
aactggcttaacttagta

SEQ ID NO: 1412219 - DNA, 18 bp, Homo sapiens
aactttctcagcatatat

SEQ ID NO: 1412220 - DNA, 18 bp, Homo sapiens
aagaagatggatgtaatt

SEQ ID NO: 1412221 - DNA, 14 bp, Homo sapiens
aagacaaatacaca

SEQ ID NO: 1412222 - DNA, 21 bp, Homo sapiens
aagacccagacaggactgcag

SEQ ID NO: 1412223 - DNA, 14 bp, Homo sapiens
aagagttgtttata

SEQ ID NO: 1412224 - DNA, 16 bp, Homo sapiens
aagatcaaatgaaaag

SEQ ID NO: 1412225 - DNA, 14 bp, Homo sapiens
aagatggatgtaat

SEQ ID NO: 1412226 - DNA, 19 bp, Homo sapiens
aagatggggaaactgaggg

SEQ ID NO: 1412227 - DNA, 16 bp, Homo sapiens
aagcaaatgcctgcca

SEQ ID NO: 1412228 - DNA, 14 bp, Homo sapiens
aagcagacacacac

SEQ ID NO: 1412229 - DNA, 16 bp, Homo sapiens
aagcagacacacacat

SEQ ID NO: 1412230 - DNA, 18 bp, Homo sapiens
aagcagacacacacatat

SEQ ID NO: 1412231 - DNA, 16 bp, Homo sapiens
aagcatagacgtctca

SEQ ID NO: 1412232 - DNA, 16 bp, Homo sapiens
aagcatcattacaata

SEQ ID NO: 1412233 - DNA, 22 bp, Homo sapiens
aagcatcattacaatacagtat

SEQ ID NO: 1412234 - DNA, 23 bp, Homo sapiens
aagcatcattacaatacagtatt

SEQ ID NO: 1412235 - DNA, 14 bp, Homo sapiens
aagcgcagagaaat

SEQ ID NO: 1412236 - DNA, 14 bp, Homo sapiens
aagctaaaacactt

SEQ ID NO: 1412237 - DNA, 24 bp, Homo sapiens
aagctgagatgaaccctggcattt

SEQ ID NO: 1412238 - DNA, 19 bp, Homo sapiens
aaggctactacagagaagg

SEQ ID NO: 1412239 - DNA, 21 bp, Homo sapiens
aaggctactacagagaaggct

SEQ ID NO: 1412240 - DNA, 13 bp, Homo sapiens
aaggctgcctgct

SEQ ID NO: 1412241 - DNA, 24 bp, Homo sapiens
aagggtctccgaaatgctgtcttt

SEQ ID NO: 1412242 - DNA, 19 bp, Homo sapiens
aagtaatctcacagcattt

SEQ ID NO: 1412243 - DNA, 19 bp, Homo sapiens
aagtatcatctaaatatta

SEQ ID NO: 1412244 - DNA, 21 bp, Homo sapiens
gtatatgtttatacacacagg

SEQ ID NO: 1412245 - DNA, 21 bp, Homo sapiens
gtatggaagacaaatacacat

SEQ ID NO: 1412246 - DNA, 22 bp, Homo sapiens
gtatggaagacaaatacacata

SEQ ID NO: 1412247 - DNA, 12 bp, Homo sapiens
gtatgtgtatat

SEQ ID NO: 1412248 - DNA, 16 bp, Homo sapiens
gtatgtgtatatgttt

SEQ ID NO: 1412249 - DNA, 17 bp, Homo sapiens
gtcaacccttctggaaa

SEQ ID NO: 1412250 - DNA, 14 bp, Homo sapiens
gtcagtagactgtg

SEQ ID NO: 1412251 - DNA, 20 bp, Homo sapiens
gtcatagtttttttcttttt

SEQ ID NO: 1412252 - DNA, 18 bp, Homo sapiens
gtcatgtgcgaacacagt

SEQ ID NO: 1412253 - DNA, 16 bp, Homo sapiens
gtccccaccatctgct

SEQ ID NO: 1412254 - DNA, 14 bp, Homo sapiens
gtccccagcagaat

SEQ ID NO: 1412255 - DNA, 14 bp, Homo sapiens
gtcctgacaccagg

SEQ ID NO: 1412256 - DNA, 23 bp, Homo sapiens
gtcctgacaccaggcaagaaaag

SEQ ID NO: 1412257 - DNA, 22 bp, Homo sapiens
gtcgcccacctgtgggccagcc

SEQ ID NO: 1412258 - DNA, 17 bp, Homo sapiens
gtctagggtgtgattta

SEQ ID NO: 1412259 - DNA, 22 bp, Homo sapiens
gtctatataaccacatttctaa

SEQ ID NO: 1412260 - DNA, 18 bp, Homo sapiens
gtctccgaaatgctgtct

SEQ ID NO: 1412261 - DNA, 16 bp, Homo sapiens
gtctttcttgctccct

SEQ ID NO: 1412262 - DNA, 14 bp, Homo sapiens
gtgaaacacaatat

SEQ ID NO: 1412263 - DNA, 19 bp, Homo sapiens
gtgaagatctcactctgcc

SEQ ID NO: 1412264 - DNA, 14 bp, Homo sapiens
gtgaagcaatttca

SEQ ID NO: 1412265 - DNA, 12 bp, Homo sapiens
gtgatgcatttt

SEQ ID NO: 1412266 - DNA, 15 bp, Homo sapiens
gtgatgcattttata

SEQ ID NO: 1412267 - DNA, 15 bp, Homo sapiens
gtgatgggattttca

SEQ ID NO: 1412268 - DNA, 21 bp, Homo sapiens
gtgctctacatctcgtatgga

SEQ ID NO: 1412269 - DNA, 20 bp, Homo sapiens
gtggggtctcctcaggacca

SEQ ID NO: 1412270 - DNA, 22 bp, Homo sapiens
gtgtatatgtttatacacacag

SEQ ID NO: 1412271 - DNA, 20 bp, Homo sapiens
gtgtatggaagacaaataca

SEQ ID NO: 1412272 - DNA, 21 bp, Homo sapiens
gtgtatggaagacaaatacac

SEQ ID NO: 1412273 - DNA, 12 bp, Homo sapiens
gtgtccccacca

SEQ ID NO: 1412274 - DNA, 17 bp, Homo sapiens
gtgtccccaccatctgc

SEQ ID NO: 1412275 - DNA, 19 bp, Homo sapiens
gttagaagaggtggcccca

SEQ ID NO: 1412276 - DNA, 14 bp, Homo sapiens
gttatctagaaatt

SEQ ID NO: 1412277 - DNA, 18 bp, Homo sapiens
gttgaagaaactactaat

SEQ ID NO: 1412278 - DNA, 23 bp, Homo sapiens
gttgcaaaggtaggttgaaggga

SEQ ID NO: 1412279 - DNA, 16 bp, Homo sapiens
gttggcaccttccccc

SEQ ID NO: 1412280 - DNA, 17 bp, Homo sapiens
gttttaaaaatgaagat

SEQ ID NO: 1412281 - DNA, 20 bp, Homo sapiens
gttttgtgatgcattttata

SEQ ID NO: 1412282 - DNA, 23 bp, Homo sapiens
gtttttatacctgtacacacaca

SEQ ID NO: 1412283 - DNA, 14 bp, Homo sapiens
taaaaatcagaaag

SEQ ID NO: 1412284 - DNA, 23 bp, Homo sapiens
taaaatacacgtgtatatgagga

SEQ ID NO: 1412285 - DNA, 14 bp, Homo sapiens
taaacaaatatttt

SEQ ID NO: 1412286 - DNA, 15 bp, Homo sapiens
taaagaaagtcatag

SEQ ID NO: 1412287 - DNA, 22 bp, Homo sapiens
taaagctcgtagaaacaagaca

SEQ ID NO: 1412288 - DNA, 13 bp, Homo sapiens
taaagtgaagaat

SEQ ID NO: 1412289 - DNA, 18 bp, Homo sapiens
taaagttaaactgattat

SEQ ID NO: 1412290 - DNA, 20 bp, Homo sapiens
taaatattatgccttgagaa

SEQ ID NO: 1412291 - DNA, 17 bp, Homo sapiens
taacaaattgcatttgt

SEQ ID NO: 1412292 - DNA, 14 bp, Homo sapiens
taacactgagtgaa

SEQ ID NO: 1412293 - DNA, 17 bp, Homo sapiens
taacactgagtgaaata

SEQ ID NO: 1412294 - DNA, 15 bp, Homo sapiens
taaccacctacaagg

SEQ ID NO: 1412295 - DNA, 11 bp, Homo sapiens
taaccctttct

SEQ ID NO: 1412296 - DNA, 22 bp, Homo sapiens
taaccctttctgggatgcaata

SEQ ID NO: 1412297 - DNA, 19 bp, Homo sapiens
taacgcaaaaatagctctt

SEQ ID NO: 1412298 - DNA, 18 bp, Homo sapiens
taactactttctgttatc

SEQ ID NO: 1412299 - DNA, 16 bp, Homo sapiens
taacttactatttaga

SEQ ID NO: 1412300 - DNA, 21 bp, Homo sapiens
taactttactaagtaatctca

SEQ ID NO: 1412301 - DNA, 19 bp, Homo sapiens
taagagtaacagtcatcat

SEQ ID NO: 1412302 - DNA, 14 bp, Homo sapiens
taagatacaaataa

SEQ ID NO: 1412303 - DNA, 17 bp, Homo sapiens
taagattgaagctaaaa

SEQ ID NO: 1412304 - DNA, 13 bp, Homo sapiens
taagcattagctt

SEQ ID NO: 1412305 - DNA, 21 bp, Homo sapiens
taagcattagctttaattaag

SEQ ID NO: 1412306 - DNA, 16 bp, Homo sapiens
taatatacagtgtgta

SEQ ID NO: 1412307 - DNA, 20 bp, Homo sapiens
tatgaggatgtatgtgtata

SEQ ID NO: 1412308 - DNA, 14 bp, Homo sapiens
tatgcaataaatat

SEQ ID NO: 1412309 - DNA, 15 bp, Homo sapiens
tatgcatatatatgt

SEQ ID NO: 1412310 - DNA, 15 bp, Homo sapiens
tatggaagacaaata

SEQ ID NO: 1412311 - DNA, 14 bp, Homo sapiens
tatggactcagcct

SEQ ID NO: 1412312 - DNA, 18 bp, Homo sapiens
tatggactcagccttgca

SEQ ID NO: 1412313 - DNA, 22 bp, Homo sapiens
tatgtgtatatgtttatacaca

SEQ ID NO: 1412314 - DNA, 14 bp, Homo sapiens
tatgttccaaggct

SEQ ID NO: 1412315 - DNA, 15 bp, Homo sapiens
tatgtttatacacac

SEQ ID NO: 1412316 - DNA, 16 bp, Homo sapiens
tattaacaaattgcat

SEQ ID NO: 1412317 - DNA, 12 bp, Homo sapiens
tattaattacaa

SEQ ID NO: 1412318 - DNA, 17 bp, Homo sapiens
tattatgccttgagaat

SEQ ID NO: 1412319 - DNA, 17 bp, Homo sapiens
tattatttgatgatact

SEQ ID NO: 1412320 - DNA, 13 bp, Homo sapiens
tattcatgaagag

SEQ ID NO: 1412321 - DNA, 14 bp, Homo sapiens
tattcggcaaggaa

SEQ ID NO: 1412322 - DNA, 21 bp, Homo sapiens
tattgccaaaacccagctgca

SEQ ID NO: 1412323 - DNA, 17 bp, Homo sapiens
tatttctgtatctgaca

SEQ ID NO: 1412324 - DNA, 21 bp, Homo sapiens
tatttgcaaggctgatttatg

SEQ ID NO: 1412325 - DNA, 21 bp, Homo sapiens
tatttgtagccaaagaaattt

SEQ ID NO: 1412326 - DNA, 16 bp, Homo sapiens
tcaacccttctggaaa

SEQ ID NO: 1412327 - DNA, 20 bp, Homo sapiens
tcaatacctggcctcattta

SEQ ID NO: 1412328 - DNA, 19 bp, Homo sapiens
tcaatttaagatacaaata

SEQ ID NO: 1412329 - DNA, 21 bp, Homo sapiens
tcaatttcagaaactaagaat

SEQ ID NO: 1412330 - DNA, 15 bp, Homo sapiens
tcagagatataataa

SEQ ID NO: 1412331 - DNA, 21 bp, Homo sapiens
tcagattccccactcagcctt

SEQ ID NO: 1412332 - DNA, 22 bp, Homo sapiens
tcagattccccactcagccttt

SEQ ID NO: 1412333 - DNA, 13 bp, Homo sapiens
tcagcatatatat

SEQ ID NO: 1412334 - DNA, 21 bp, Homo sapiens
tcagcatatatataaaataca

SEQ ID NO: 1412335 - DNA, 15 bp, Homo sapiens
tcagccttttgggaa

SEQ ID NO: 1412336 - DNA, 22 bp, Homo sapiens
tcaggagctccatacacacgct

SEQ ID NO: 1412337 - DNA, 22 bp, Homo sapiens
tcaggtgctgaagggtaatatg

SEQ ID NO: 1412338 - DNA, 19 bp, Homo sapiens
tcagtagactgtgattctt

SEQ ID NO: 1412339 - DNA, 15 bp, Homo sapiens
tcagttttaaaaatg

SEQ ID NO: 1412340 - DNA, 22 bp, Homo sapiens
tcataagttagatgttttagtt

SEQ ID NO: 1412341 - DNA, 15 bp, Homo sapiens
tcatcacaaatggct

SEQ ID NO: 1412342 - DNA, 19 bp, Homo sapiens
tcatccccaaatgtgtctt

SEQ ID NO: 1412343 - DNA, 19 bp, Homo sapiens
tcatctcctttgcagaatg

SEQ ID NO: 1412344 - DNA, 21 bp, Homo sapiens
tcatgcctttatttctgtatc

SEQ ID NO: 1412345 - DNA, 17 bp, Homo sapiens
tcatgtgcgaacacagt

SEQ ID NO: 1412346 - DNA, 23 bp, Homo sapiens
tcattcttataacattgtatgtt

SEQ ID NO: 1412347 - DNA, 22 bp, Homo sapiens
tcattttgcacctgcagccaag

SEQ ID NO: 1412348 - DNA, 24 bp, Homo sapiens
tcattttgcacctgcagccaagca

SEQ ID NO: 1412349 - DNA, 13 bp, Homo sapiens
tccaaagagtgct

SEQ ID NO: 1412350 - DNA, 12 bp, Homo sapiens
tccagcaggccc

SEQ ID NO: 1412351 - DNA, 22 bp, Homo sapiens
tccagcaggcccatgggaggct

SEQ ID NO: 1412352 - DNA, 20 bp, Homo sapiens
tccagcttcactgtcatgtg

SEQ ID NO: 1412353 - DNA, 22 bp, Homo sapiens
tccaggacaggagatgctgtgc

SEQ ID NO: 1412354 - DNA, 19 bp, Homo sapiens
tccatacacacgctgcctt

SEQ ID NO: 1412355 - DNA, 16 bp, Homo sapiens
tccatgtcccctccca

SEQ ID NO: 1412356 - DNA, 18 bp, Homo sapiens
tccatgtcccctcccaga

SEQ ID NO: 1412357 - DNA, 18 bp, Homo sapiens
tccatgtgagaatatttt

SEQ ID NO: 1412358 - DNA, 13 bp, Homo sapiens
tcccactgcccac

SEQ ID NO: 1412359 - DNA, 22 bp, Homo sapiens
tcccagagctggtggacccagg

SEQ ID NO: 1412360 - DNA, 15 bp, Homo sapiens
tccccaccatctgct

SEQ ID NO: 1412361 - DNA, 18 bp, Homo sapiens
tccccaccatctgctgtc

SEQ ID NO: 1412362 - DNA, 19 bp, Homo sapiens
tccccaccatctgctgtct

SEQ ID NO: 1412363 - DNA, 18 bp, Homo sapiens
tccccactcagccttttg

SEQ ID NO: 1412364 - DNA, 13 bp, Homo sapiens
tgcaaatagccag

SEQ ID NO: 1412365 - DNA, 17 bp, Homo sapiens
tgcaacactcaagtcta

SEQ ID NO: 1412366 - DNA, 19 bp, Homo sapiens
tgcaacactcaagtctatt

SEQ ID NO: 1412367 - DNA, 12 bp, Homo sapiens
tgcaataaatat

SEQ ID NO: 1412368 - DNA, 14 bp, Homo sapiens
tgcacagaagcaca

SEQ ID NO: 1412369 - DNA, 15 bp, Homo sapiens
tgcaccccttcctgg

SEQ ID NO: 1412370 - DNA, 16 bp, Homo sapiens
tgcaccccttcctggg

SEQ ID NO: 1412371 - DNA, 17 bp, Homo sapiens
tgcaccccttcctgggc

SEQ ID NO: 1412372 - DNA, 13 bp, Homo sapiens
tgcacctgcagcc

SEQ ID NO: 1412373 - DNA, 16 bp, Homo sapiens
tgcagccactgattct

SEQ ID NO: 1412374 - DNA, 18 bp, Homo sapiens
tgcagctatggacaattt

SEQ ID NO: 1412375 - DNA, 16 bp, Homo sapiens
tgcataatatgcatat

SEQ ID NO: 1412376 - DNA, 20 bp, Homo sapiens
tgcataatatgcatatatat

SEQ ID NO: 1412377 - DNA, 20 bp, Homo sapiens
tgcatagcttttccctgtcc

SEQ ID NO: 1412378 - DNA, 18 bp, Homo sapiens
tgccaaaacccagctgca

SEQ ID NO: 1412379 - DNA, 21 bp, Homo sapiens
tgccaaaacccagctgcaccc

SEQ ID NO: 1412380 - DNA, 13 bp, Homo sapiens
tgccatctctgct

SEQ ID NO: 1412381 - DNA, 13 bp, Homo sapiens
tgcccatgtgtat

SEQ ID NO: 1412382 - DNA, 15 bp, Homo sapiens
tgccccagcttgggc

SEQ ID NO: 1412383 - DNA, 15 bp, Homo sapiens
tgcccctggccttgg

SEQ ID NO: 1412384 - DNA, 22 bp, Homo sapiens
tgccttatcaaataatattcat

SEQ ID NO: 1412385 - DNA, 16 bp, Homo sapiens
tgcgaacacagtgaca

SEQ ID NO: 1412386 - DNA, 21 bp, Homo sapiens
tgcgaacacagtgacacgttt

SEQ ID NO: 1412387 - DNA, 16 bp, Homo sapiens
tgctatgtatttgcaa

SEQ ID NO: 1412388 - DNA, 22 bp, Homo sapiens
tgctcaatacctggcctcattt

SEQ ID NO: 1412389 - DNA, 18 bp, Homo sapiens
tgctccagtttcacctct

SEQ ID NO: 1412390 - DNA, 14 bp, Homo sapiens
tgctccctgactgg

SEQ ID NO: 1412391 - DNA, 17 bp, Homo sapiens
tgctgacatcatttgta

SEQ ID NO: 1412392 - DNA, 21 bp, Homo sapiens
tgctgtctttcttgctccctg

SEQ ID NO: 1412393 - DNA, 14 bp, Homo sapiens
tgctgtcttttctt

SEQ ID NO: 1412394 - DNA, 16 bp, Homo sapiens
tgctgtgcccctggcc

SEQ ID NO: 1412395 - DNA, 14 bp, Homo sapiens
tgctgttgaagaaa

SEQ ID NO: 1412396 - DNA, 15 bp, Homo sapiens
tggaaatgagaacaa

SEQ ID NO: 1412397 - DNA, 22 bp, Homo sapiens
tggagtccaggacaggagatgc

SEQ ID NO: 1412398 - DNA, 19 bp, Homo sapiens
tggagttggggcagaggag

SEQ ID NO: 1412399 - DNA, 13 bp, Homo sapiens
tggcaaagccaga

SEQ ID NO: 1412400 - DNA, 18 bp, Homo sapiens
tggccccatattaacaaa

SEQ ID NO: 1412401 - DNA, 13 bp, Homo sapiens
tggctacatctcc

SEQ ID NO: 1412402 - DNA, 22 bp, Homo sapiens
tgggaataatagcacatgattt

SEQ ID NO: 1412403 - DNA, 13 bp, Homo sapiens
tgggagccgggca

SEQ ID NO: 1412404 - DNA, 18 bp, Homo sapiens
tgggatccaggcccctcc

SEQ ID NO: 1412405 - DNA, 22 bp, Homo sapiens
tgggcacacgctgctctgcccc

SEQ ID NO: 1412406 - DNA, 17 bp, Homo sapiens
tggtctatataaccaca

SEQ ID NO: 1412407 - DNA, 23 bp, Homo sapiens
tggtggggtctcctcaggaccag

SEQ ID NO: 1412408 - DNA, 17 bp, Homo sapiens
tggtttgggggagaaga

SEQ ID NO: 1412409 - DNA, 20 bp, Homo sapiens
tgtaagtactctaatataca

SEQ ID NO: 1412410 - DNA, 12 bp, Homo sapiens
tgtaattatcta

SEQ ID NO: 1412411 - DNA, 16 bp, Homo sapiens
tgtacacacacagaca

SEQ ID NO: 1412412 - DNA, 19 bp, Homo sapiens
tgtatatgtttatacacac

SEQ ID NO: 1412413 - DNA, 18 bp, Homo sapiens
tgtatggaagacaaatac

SEQ ID NO: 1412414 - DNA, 19 bp, Homo sapiens
tgtatggaagacaaataca

SEQ ID NO: 1412415 - DNA, 22 bp, Homo sapiens
tgtatggaagacaaatacacat

SEQ ID NO: 1412416 - DNA, 12 bp, Homo sapiens
tgtatgtgtata

SEQ ID NO: 1412417 - DNA, 18 bp, Homo sapiens
gaggccatgtctcctgca

SEQ ID NO: 1412418 - DNA, 19 bp, Homo sapiens
gaggctggagttggggcag

SEQ ID NO: 1412419 - DNA, 17 bp, Homo sapiens
gaggggcccccctgccc

SEQ ID NO: 1412420 - DNA, 18 bp, Homo sapiens
gagtaacagtcatcattt

SEQ ID NO: 1412421 - DNA, 19 bp, Homo sapiens
gagtaacagtcatcattta

SEQ ID NO: 1412422 - DNA, 13 bp, Homo sapiens
gagtgaaatatta

SEQ ID NO: 1412423 - DNA, 14 bp, Homo sapiens
gataagaaagcagg

SEQ ID NO: 1412424 - DNA, 21 bp, Homo sapiens
gatccaggcccctccctctcc

SEQ ID NO: 1412425 - DNA, 15 bp, Homo sapiens
gatgctgacatcatt

SEQ ID NO: 1412426 - DNA, 16 bp, Homo sapiens
gatgctgacatcattt

SEQ ID NO: 1412427 - DNA, 13 bp, Homo sapiens
gatgtatgtgtat

SEQ ID NO: 1412428 - DNA, 16 bp, Homo sapiens
gcaaaaatagctcttg

SEQ ID NO: 1412429 - DNA, 23 bp, Homo sapiens
gcaaaatcagaatggaatgctct

SEQ ID NO: 1412430 - DNA, 11 bp, Homo sapiens
gcaaacacagt

SEQ ID NO: 1412431 - DNA, 10 bp, Homo sapiens
gcaaagccag

SEQ ID NO: 1412432 - DNA, 18 bp, Homo sapiens
gcaacctgacagcaaaca

SEQ ID NO: 1412433 - DNA, 20 bp, Homo sapiens
gcaacctgacagcaaacaca

SEQ ID NO: 1412434 - DNA, 17 bp, Homo sapiens
gcaagaaaagcgcagag

SEQ ID NO: 1412435 - DNA, 14 bp, Homo sapiens
gcaaggctgattta

SEQ ID NO: 1412436 - DNA, 19 bp, Homo sapiens
gcaatactaggaagtaaag

SEQ ID NO: 1412437 - DNA, 18 bp, Homo sapiens
gcaattgtatatatatgt

SEQ ID NO: 1412438 - DNA, 15 bp, Homo sapiens
gcacacctcctccca

SEQ ID NO: 1412439 - DNA, 20 bp, Homo sapiens
gcacacctcctcccactgcc

SEQ ID NO: 1412440 - DNA, 14 bp, Homo sapiens
gcacacgctgctct

SEQ ID NO: 1412441 - DNA, 18 bp, Homo sapiens
gcacacgctgctctgccc

SEQ ID NO: 1412442 - DNA, 17 bp, Homo sapiens
gcacagaagcacatgca

SEQ ID NO: 1412443 - DNA, 17 bp, Homo sapiens
gcacatgcacctaccca

SEQ ID NO: 1412444 - DNA, 14 bp, Homo sapiens
gcaccttccccctc

SEQ ID NO: 1412445 - DNA, 16 bp, Homo sapiens
gcagacacacacatat

SEQ ID NO: 1412446 - DNA, 10 bp, Homo sapiens
gcagagaaat

SEQ ID NO: 1412447 - DNA, 14 bp, Homo sapiens
gcagagaggctgtg

SEQ ID NO: 1412448 - DNA, 19 bp, Homo sapiens
gcagcaccgcctcttcccg

SEQ ID NO: 1412449 - DNA, 14 bp, Homo sapiens
gcagccaagcaaat

SEQ ID NO: 1412450 - DNA, 15 bp, Homo sapiens
gcataatatgcatat

SEQ ID NO: 1412451 - DNA, 13 bp, Homo sapiens
gcatatatataaa

SEQ ID NO: 1412452 - DNA, 17 bp, Homo sapiens
gccaaattttagattta

SEQ ID NO: 1412453 - DNA, 13 bp, Homo sapiens
gccactgattctc

SEQ ID NO: 1412454 - DNA, 14 bp, Homo sapiens
gccatgtctcctgc

SEQ ID NO: 1412455 - DNA, 16 bp, Homo sapiens
gcccagcccaccccat

SEQ ID NO: 1412456 - DNA, 13 bp, Homo sapiens
gcccatgtgtatg

SEQ ID NO: 1412457 - DNA, 17 bp, Homo sapiens
gccccagcttgggcaga

SEQ ID NO: 1412458 - DNA, 17 bp, Homo sapiens
gccgggggaggggcgcg

SEQ ID NO: 1412459 - DNA, 19 bp, Homo sapiens
gcctaaagaccatttaatc

SEQ ID NO: 1412460 - DNA, 19 bp, Homo sapiens
gcctcttgtagtcttggct

SEQ ID NO: 1412461 - DNA, 17 bp, Homo sapiens
gctaagcattagcttta

SEQ ID NO: 1412462 - DNA, 16 bp, Homo sapiens
gctaaggaaattctaa

SEQ ID NO: 1412463 - DNA, 16 bp, Homo sapiens
gctacatctccaaata

SEQ ID NO: 1412464 - DNA, 22 bp, Homo sapiens
gctatggacaatttaccacagg

SEQ ID NO: 1412465 - DNA, 20 bp, Homo sapiens
gctccaaccgggatgggagc

SEQ ID NO: 1412466 - DNA, 20 bp, Homo sapiens
gctccagtttcacctctttg

SEQ ID NO: 1412467 - DNA, 21 bp, Homo sapiens
gctccatacacacgctgcctt

SEQ ID NO: 1412468 - DNA, 15 bp, Homo sapiens
gctccctcccaggac

SEQ ID NO: 1412469 - DNA, 18 bp, Homo sapiens
gctccctcccaggactct

SEQ ID NO: 1412470 - DNA, 13 bp, Homo sapiens
gctccctgactgg

SEQ ID NO: 1412471 - DNA, 18 bp, Homo sapiens
gctcggcaccgccagccg

SEQ ID NO: 1412472 - DNA, 15 bp, Homo sapiens
gctctggggggcagg

SEQ ID NO: 1412473 - DNA, 16 bp, Homo sapiens
gctgacatcatttgta

SEQ ID NO: 1412474 - DNA, 14 bp, Homo sapiens
gctgcaccccttcc

SEQ ID NO: 1412475 - DNA, 20 bp, Homo sapiens
gctgcaccccttcctgggca

SEQ ID NO: 1412476 - DNA, 21 bp, Homo sapiens
gctgcaccccttcctgggcac

SEQ ID NO: 1412477 - DNA, 22 bp, Homo sapiens
gctgcctcggatccccttccta

SEQ ID NO: 1412478 - DNA, 20 bp, Homo sapiens
gctgccttcggtacccacca

SEQ ID NO: 1412479 - DNA, 14 bp, Homo sapiens
gctgggactgggaa

SEQ ID NO: 1412480 - DNA, 18 bp, Homo sapiens
gctgtctttcttgctccc

SEQ ID NO: 1412481 - DNA, 18 bp, Homo sapiens
gctgtcttttctttgcca

SEQ ID NO: 1412482 - DNA, 18 bp, Homo sapiens
gctgttgaagaaactact

SEQ ID NO: 1412483 - DNA, 19 bp, Homo sapiens
gctttaattaagctctcat

SEQ ID NO: 1412484 - DNA, 18 bp, Homo sapiens
gctttcatgtaattatct

SEQ ID NO: 1412485 - DNA, 22 bp, Homo sapiens
ggaaacttaaccacctacaagg

SEQ ID NO: 1412486 - DNA, 17 bp, Homo sapiens
ggaagtaaagtgaagaa

SEQ ID NO: 1412487 - DNA, 21 bp, Homo sapiens
ggaatcatctcctttgcagaa

SEQ ID NO: 1412488 - DNA, 18 bp, Homo sapiens
ggacaggagatgctgtgc

SEQ ID NO: 1412489 - DNA, 16 bp, Homo sapiens
ggagataagaaagcag

SEQ ID NO: 1412490 - DNA, 14 bp, Homo sapiens
ggagatgctgtgcc

SEQ ID NO: 1412491 - DNA, 20 bp, Homo sapiens
ggagtccaggacaggagatg

SEQ ID NO: 1412492 - DNA, 18 bp, Homo sapiens
ggatccaggcccctccct

SEQ ID NO: 1412493 - DNA, 14 bp, Homo sapiens
ggatccccttccta

SEQ ID NO: 1412494 - DNA, 11 bp, Homo sapiens
ggatgcatatt

SEQ ID NO: 1412495 - DNA, 22 bp, Homo sapiens
ggatttgcacagaagcacatgc

SEQ ID NO: 1412496 - DNA, 13 bp, Homo sapiens
ggcaaagccagaa

SEQ ID NO: 1412497 - DNA, 12 bp, Homo sapiens
ggcaagaaaagc

SEQ ID NO: 1412498 - DNA, 18 bp, Homo sapiens
ggcacacgctgctctgcc

SEQ ID NO: 1412499 - DNA, 15 bp, Homo sapiens
ggcaccgccagccgc

SEQ ID NO: 1412500 - DNA, 13 bp, Homo sapiens
ggcagatctccca

SEQ ID NO: 1412501 - DNA, 12 bp, Homo sapiens
ggcagcaccgcc

SEQ ID NO: 1412502 - DNA, 20 bp, Homo sapiens
ggcagcatgcgatgtcatat

SEQ ID NO: 1412503 - DNA, 14 bp, Homo sapiens
ggcatttggcctct

SEQ ID NO: 1412504 - DNA, 16 bp, Homo sapiens
ggccatctggagagcc

SEQ ID NO: 1412505 - DNA, 14 bp, Homo sapiens
ggccatgtctcctg

SEQ ID NO: 1412506 - DNA, 22 bp, Homo sapiens
ggccccatattaacaaattgca

SEQ ID NO: 1412507 - DNA, 16 bp, Homo sapiens
ggccgcgggggcaggg

SEQ ID NO: 1412508 - DNA, 19 bp, Homo sapiens
ggcctgatatccaacagaa

SEQ ID NO: 1412509 - DNA, 15 bp, Homo sapiens
ggcgcgggagggggc

SEQ ID NO: 1412510 - DNA, 15 bp, Homo sapiens
ggcgtgaaacacaat

SEQ ID NO: 1412511 - DNA, 23 bp, Homo sapiens
ggctttcaggagctccatacaca

SEQ ID NO: 1412512 - DNA, 21 bp, Homo sapiens
gggaggggcgcgggagggggc

SEQ ID NO: 1412513 - DNA, 16 bp, Homo sapiens
gggatgggagccgggc

SEQ ID NO: 1412514 - DNA, 13 bp, Homo sapiens
gggcacacgctgc

SEQ ID NO: 1412515 - DNA, 20 bp, Homo sapiens
gggcacacgctgctctgccc

SEQ ID NO: 1412516 - DNA, 22 bp, Homo sapiens
gggcacacgctgctctgcccca

SEQ ID NO: 1412517 - DNA, 14 bp, Homo sapiens
gggcagagaggctg

SEQ ID NO: 1412518 - DNA, 18 bp, Homo sapiens
gggcagatcttggactca

SEQ ID NO: 1412519 - DNA, 19 bp, Homo sapiens
gggcaggggaggccatctg

SEQ ID NO: 1412520 - DNA, 19 bp, Homo sapiens
gggccgggggaggggcgcg

SEQ ID NO: 1412521 - DNA, 16 bp, Homo sapiens
gggcgcgggagggggc

SEQ ID NO: 1412522 - DNA, 15 bp, Homo sapiens
gggcgtgaaacacaa

SEQ ID NO: 1412523 - DNA, 22 bp, Homo sapiens
ggggaaactgagggcagagagg

SEQ ID NO: 1412524 - DNA, 20 bp, Homo sapiens
ggggcagatcttggactcat

SEQ ID NO: 1412525 - DNA, 22 bp, Homo sapiens
gggggcagatcttggactcatg

SEQ ID NO: 1412526 - DNA, 12 bp, Homo sapiens
ggtccccagcag

SEQ ID NO: 1412527 - DNA, 18 bp, Homo sapiens
ggtgctgttttgccagcc

SEQ ID NO: 1412528 - DNA, 13 bp, Homo sapiens
ggtggacccaggg

SEQ ID NO: 1412529 - DNA, 18 bp, Homo sapiens
gtaacagtcatcatttat

SEQ ID NO: 1412530 - DNA, 19 bp, Homo sapiens
gtaacagtcatcatttatc

SEQ ID NO: 1412531 - DNA, 12 bp, Homo sapiens
gtaataaactat

SEQ ID NO: 1412532 - DNA, 11 bp, Homo sapiens
gtacacacaca

SEQ ID NO: 1412533 - DNA, 12 bp, Homo sapiens
gtacacacacag

SEQ ID NO: 1412534 - DNA, 19 bp, Homo sapiens
gtacacacacagacacaca

SEQ ID NO: 1412535 - DNA, 20 bp, Homo sapiens
gtacttgatttttcaaagac

SEQ ID NO: 1412536 - DNA, 18 bp, Homo sapiens
gtagaagaaaatttaatt

SEQ ID NO: 1412537 - DNA, 20 bp, Homo sapiens
gtagaagaaaatttaattat

SEQ ID NO: 1412538 - DNA, 20 bp, Homo sapiens
gtagtcttggctaaggaaat

SEQ ID NO: 1412539 - DNA, 12 bp, Homo sapiens
gtagttgtagaa

SEQ ID NO: 1412540 - DNA, 20 bp, Homo sapiens
gtagttttgtgatgcatttt

SEQ ID NO: 1412541 - DNA, 18 bp, Homo sapiens
gtatactgggggcaaaat

SEQ ID NO: 1412542 - DNA, 14 bp, Homo sapiens
gtatatatatgtga

SEQ ID NO: 1412543 - DNA, 17 bp, Homo sapiens
gtatatgtttatacaca

SEQ ID NO: 1412544 - DNA, 19 bp, Homo sapiens
gtatatgtttatacacaca

SEQ ID NO: 1412545 - DNA, 17 bp, Homo sapiens
tttgcataatatgcata

SEQ ID NO: 1412546 - DNA, 16 bp, Homo sapiens
tttgccaagtctccca

SEQ ID NO: 1412547 - DNA, 10 bp, Homo sapiens
tttgccagcc

SEQ ID NO: 1412548 - DNA, 17 bp, Homo sapiens
tttgccagcccatttgg

SEQ ID NO: 1412549 - DNA, 18 bp, Homo sapiens
tttgccatctctgctcca

SEQ ID NO: 1412550 - DNA, 17 bp, Homo sapiens
tttgggcagagaggctg

SEQ ID NO: 1412551 - DNA, 16 bp, Homo sapiens
tttgtagccaaagaaa

SEQ ID NO: 1412552 - DNA, 19 bp, Homo sapiens
tttgttatacatttaaaga

SEQ ID NO: 1412553 - DNA, 21 bp, Homo sapiens
ttttaaaatgaaatgcatttt

SEQ ID NO: 1412554 - DNA, 22 bp, Homo sapiens
ttttaaagctcgtagaaacaag

SEQ ID NO: 1412555 - DNA, 20 bp, Homo sapiens
ttttatacctgtacacacac

SEQ ID NO: 1412556 - DNA, 14 bp, Homo sapiens
ttttgaaaactcat

SEQ ID NO: 1412557 - DNA, 19 bp, Homo sapiens
ttttgcacctgcagccaag

SEQ ID NO: 1412558 - DNA, 16 bp, Homo sapiens
tttttatttttggcaa

SEQ ID NO: 1412559 - DNA, 17 bp, Homo sapiens
tttttcaaagacttcat

SEQ ID NO: 1412560 - DNA, 14 bp, Homo sapiens
agagtccccccact

SEQ ID NO: 1412561 - DNA, 18 bp, Homo sapiens
agagtccccccactccca

SEQ ID NO: 1412562 - DNA, 22 bp, Homo sapiens
agagtgctaagcattagcttta

SEQ ID NO: 1412563 - DNA, 21 bp, Homo sapiens
agagttgtttataatgtcaaa

SEQ ID NO: 1412564 - DNA, 21 bp, Homo sapiens
agatacaaataaggacacaaa

SEQ ID NO: 1412565 - DNA, 15 bp, Homo sapiens
agatatgcaataaat

SEQ ID NO: 1412566 - DNA, 21 bp, Homo sapiens
agatatgcaataaatattatt

SEQ ID NO: 1412567 - DNA, 21 bp, Homo sapiens
agatctcccacatgccagggg

SEQ ID NO: 1412568 - DNA, 20 bp, Homo sapiens
agatgctgtgcccctggcct

SEQ ID NO: 1412569 - DNA, 15 bp, Homo sapiens
agatgttttagttta

SEQ ID NO: 1412570 - DNA, 19 bp, Homo sapiens
agattgaagctaaaacact

SEQ ID NO: 1412571 - DNA, 14 bp, Homo sapiens
agcaaaaaatgaac

SEQ ID NO: 1412572 - DNA, 19 bp, Homo sapiens
agcacaacataatttttat

SEQ ID NO: 1412573 - DNA, 15 bp, Homo sapiens
agcagaattgacagt

SEQ ID NO: 1412574 - DNA, 13 bp, Homo sapiens
agcagacacacac

SEQ ID NO: 1412575 - DNA, 15 bp, Homo sapiens
agcagacacacacat

SEQ ID NO: 1412576 - DNA, 23 bp, Homo sapiens
agcaggcccatgggaggctggag

SEQ ID NO: 1412577 - DNA, 22 bp, Homo sapiens
agcatatatataaaatacacgt

SEQ ID NO: 1412578 - DNA, 18 bp, Homo sapiens
agcattagctttaattaa

SEQ ID NO: 1412579 - DNA, 13 bp, Homo sapiens
agccactccccag

SEQ ID NO: 1412580 - DNA, 17 bp, Homo sapiens
agccactccccagccag

SEQ ID NO: 1412581 - DNA, 22 bp, Homo sapiens
agccactccccagccagcctgg

SEQ ID NO: 1412582 - DNA, 15 bp, Homo sapiens
agccagcctggctgg

SEQ ID NO: 1412583 - DNA, 18 bp, Homo sapiens
agccttgcaaatagccag

SEQ ID NO: 1412584 - DNA, 15 bp, Homo sapiens
agcctttgagactgt

SEQ ID NO: 1412585 - DNA, 12 bp, Homo sapiens
agcgcagagaaa

SEQ ID NO: 1412586 - DNA, 19 bp, Homo sapiens
agctccatacacacgctgc

SEQ ID NO: 1412587 - DNA, 23 bp, Homo sapiens
agctccatacacacgctgccttc

SEQ ID NO: 1412588 - DNA, 14 bp, Homo sapiens
agctcgtagaaaca

SEQ ID NO: 1412589 - DNA, 16 bp, Homo sapiens
agctcgtagaaacaag

SEQ ID NO: 1412590 - DNA, 18 bp, Homo sapiens
agcttcttccattggaaa

SEQ ID NO: 1412591 - DNA, 17 bp, Homo sapiens
agcttgggcagatctcc

SEQ ID NO: 1412592 - DNA, 23 bp, Homo sapiens
agcttgggcagatctcccacatg

SEQ ID NO: 1412593 - DNA, 16 bp, Homo sapiens
agctttaattaagctc

SEQ ID NO: 1412594 - DNA, 22 bp, Homo sapiens
aggaacatgacccgtacacacc

SEQ ID NO: 1412595 - DNA, 23 bp, Homo sapiens
aggactagagcacaacataattt

SEQ ID NO: 1412596 - DNA, 17 bp, Homo sapiens
aggactgcagagggctc

SEQ ID NO: 1412597 - DNA, 23 bp, Homo sapiens
aggactgcagagggctccagagt

SEQ ID NO: 1412598 - DNA, 16 bp, Homo sapiens
aggagaacttgctgcc

SEQ ID NO: 1412599 - DNA, 18 bp, Homo sapiens
aggagaacttgctgcctc

SEQ ID NO: 1412600 - DNA, 13 bp, Homo sapiens
aggagataagaaa

SEQ ID NO: 1412601 - DNA, 17 bp, Homo sapiens
aggagataagaaagcag

SEQ ID NO: 1412602 - DNA, 22 bp, Homo sapiens
aggagtcagtgcccatgtgtat

SEQ ID NO: 1412603 - DNA, 22 bp, Homo sapiens
aggatgctgacatcatttgtat

SEQ ID NO: 1412604 - DNA, 15 bp, Homo sapiens
aggatgtatgtgtat

SEQ ID NO: 1412605 - DNA, 12 bp, Homo sapiens
aggcaagaaaag

SEQ ID NO: 1412606 - DNA, 21 bp, Homo sapiens
aggcaagaaaagcgcagagaa

SEQ ID NO: 1412607 - DNA, 15 bp, Homo sapiens
aggccatctggagag

SEQ ID NO: 1412608 - DNA, 18 bp, Homo sapiens
aggcccatgggaggctgg

SEQ ID NO: 1412609 - DNA, 20 bp, Homo sapiens
aggcccctccctctccagca

SEQ ID NO: 1412610 - DNA, 21 bp, Homo sapiens
aggctactacagagaaggctg

SEQ ID NO: 1412611 - DNA, 23 bp, Homo sapiens
aggctgatttatggtcagaattt

SEQ ID NO: 1412612 - DNA, 16 bp, Homo sapiens
agggcgtgaaacacaa

SEQ ID NO: 1412613 - DNA, 17 bp, Homo sapiens
agggctccagagtggag

SEQ ID NO: 1412614 - DNA, 14 bp, Homo sapiens
aggggcgcgggagg

SEQ ID NO: 1412615 - DNA, 20 bp, Homo sapiens
agggttggcaccttccccct

SEQ ID NO: 1412616 - DNA, 15 bp, Homo sapiens
agtaaagtgaagaat

SEQ ID NO: 1412617 - DNA, 18 bp, Homo sapiens
agtactctaatatacagt

SEQ ID NO: 1412618 - DNA, 13 bp, Homo sapiens
agtatcatctaaa

SEQ ID NO: 1412619 - DNA, 22 bp, Homo sapiens
agtatttctttgttatacattt

SEQ ID NO: 1412620 - DNA, 19 bp, Homo sapiens
agtcagtgcccatgtgtat

SEQ ID NO: 1412621 - DNA, 20 bp, Homo sapiens
agtcagtgcccatgtgtatg

SEQ ID NO: 1412622 - DNA, 22 bp, Homo sapiens
agtcagtgcccatgtgtatgga

SEQ ID NO: 1412623 - DNA, 12 bp, Homo sapiens
agtcccctttct

SEQ ID NO: 1412624 - DNA, 20 bp, Homo sapiens
agtcccttagtactcttcta

SEQ ID NO: 1412625 - DNA, 15 bp, Homo sapiens
agtctattgaataat

SEQ ID NO: 1412626 - DNA, 14 bp, Homo sapiens
agtctgatccctgc

SEQ ID NO: 1412627 - DNA, 15 bp, Homo sapiens
agtcttggctaagga

SEQ ID NO: 1412628 - DNA, 11 bp, Homo sapiens
agtgaaaattg

SEQ ID NO: 1412629 - DNA, 17 bp, Homo sapiens
agtgacatttcaatcac

SEQ ID NO: 1412630 - DNA, 16 bp, Homo sapiens
agtgattatatttcac

SEQ ID NO: 1412631 - DNA, 14 bp, Homo sapiens
agtgcccatgtgta

SEQ ID NO: 1412632 - DNA, 15 bp, Homo sapiens
agtgcccatgtgtat

SEQ ID NO: 1412633 - DNA, 21 bp, Homo sapiens
agtgccttatcaaataatatt

SEQ ID NO: 1412634 - DNA, 22 bp, Homo sapiens
agtgccttatcaaataatattc

SEQ ID NO: 1412635 - DNA, 18 bp, Homo sapiens
agtgctaagcattagctt

SEQ ID NO: 1412636 - DNA, 19 bp, Homo sapiens
agtggagatcccacatatt

SEQ ID NO: 1412637 - DNA, 21 bp, Homo sapiens
agtggcctccgtcactacctg

SEQ ID NO: 1412638 - DNA, 16 bp, Homo sapiens
agtgtgcttacctgtt

SEQ ID NO: 1412639 - DNA, 20 bp, Homo sapiens
agttaaactggcttaactta

SEQ ID NO: 1412640 - DNA, 21 bp, Homo sapiens
agttaatctttgaaaactcat

SEQ ID NO: 1412641 - DNA, 17 bp, Homo sapiens
agttattgggcttaaaa

SEQ ID NO: 1412642 - DNA, 16 bp, Homo sapiens
agttggggcagaggag

SEQ ID NO: 1412643 - DNA, 21 bp, Homo sapiens
agttgtagaagaaaatttaat

SEQ ID NO: 1412644 - DNA, 22 bp, Homo sapiens
agtttcacctctttgctccctg

SEQ ID NO: 1412645 - DNA, 16 bp, Homo sapiens
agttttaaaaatgaag

SEQ ID NO: 1412646 - DNA, 19 bp, Homo sapiens
agttttaaaaatgaagatc

SEQ ID NO: 1412647 - DNA, 15 bp, Homo sapiens
ataaaatacacgtgt

SEQ ID NO: 1412648 - DNA, 15 bp, Homo sapiens
ataaagttaaactga

SEQ ID NO: 1412649 - DNA, 12 bp, Homo sapiens
ataacattgtat

SEQ ID NO: 1412650 - DNA, 14 bp, Homo sapiens
ataacattgtatgt

SEQ ID NO: 1412651 - DNA, 16 bp, Homo sapiens
ataacattgtatgtta

SEQ ID NO: 1412652 - DNA, 23 bp, Homo sapiens
ataagagtaacagtcatcattta

SEQ ID NO: 1412653 - DNA, 23 bp, Homo sapiens
ataagcccaacaagttgaagaag

SEQ ID NO: 1412654 - DNA, 23 bp, Homo sapiens
ataataagcccaacaagttgaag

SEQ ID NO: 1412655 - DNA, 21 bp, Homo sapiens
ataatttttatttttggcaaa

SEQ ID NO: 1412656 - DNA, 18 bp, Homo sapiens
atacaaataaggacacaa

SEQ ID NO: 1412657 - DNA, 16 bp, Homo sapiens
atacacacgctgcctt

SEQ ID NO: 1412658 - DNA, 19 bp, Homo sapiens
atacatacgcaattgtata

SEQ ID NO: 1412659 - DNA, 19 bp, Homo sapiens
atacatttaaagatttaaa

SEQ ID NO: 1412660 - DNA, 22 bp, Homo sapiens
atacctggcctcatttaaaaca

SEQ ID NO: 1412661 - DNA, 20 bp, Homo sapiens
atacctgtacacacacagac

SEQ ID NO: 1412662 - DNA, 14 bp, Homo sapiens
atacgcaattgtat

SEQ ID NO: 1412663 - DNA, 19 bp, Homo sapiens
atacgcaattgtatatata

SEQ ID NO: 1412664 - DNA, 21 bp, Homo sapiens
atacgcaattgtatatatatg

SEQ ID NO: 1412665 - DNA, 16 bp, Homo sapiens
atacttaactttacta

SEQ ID NO: 1412666 - DNA, 21 bp, Homo sapiens
atacttaactttactaagtaa

SEQ ID NO: 1412667 - DNA, 16 bp, Homo sapiens
atactttgctgttgaa

SEQ ID NO: 1412668 - DNA, 20 bp, Homo sapiens
atagatcccacgttgatgtc

SEQ ID NO: 1412669 - DNA, 21 bp, Homo sapiens
atagtttttttcttttttaat

SEQ ID NO: 1412670 - DNA, 13 bp, Homo sapiens
atataaaatacac

SEQ ID NO: 1412671 - DNA, 14 bp, Homo sapiens
atataaaatacacg

SEQ ID NO: 1412672 - DNA, 21 bp, Homo sapiens
atataaaatacacgtgtatat

SEQ ID NO: 1412673 - DNA, 20 bp, Homo sapiens
atataaccacatttctaagc

SEQ ID NO: 1412674 - DNA, 23 bp, Homo sapiens
atatacatacgcaattgtatata

SEQ ID NO: 1412675 - DNA, 13 bp, Homo sapiens
atatacatcatac

SEQ ID NO: 1412676 - DNA, 20 bp, Homo sapiens
atatacatcatacttaactt

SEQ ID NO: 1412677 - DNA, 22 bp, Homo sapiens
atatacatcatacttaacttta

SEQ ID NO: 1412678 - DNA, 13 bp, Homo sapiens
atatacattttgc

SEQ ID NO: 1412679 - DNA, 15 bp, Homo sapiens
atatataaaatacac

SEQ ID NO: 1412680 - DNA, 15 bp, Homo sapiens
atatatacatacgca

SEQ ID NO: 1412681 - DNA, 14 bp, Homo sapiens
atatatacatcata

SEQ ID NO: 1412682 - DNA, 13 bp, Homo sapiens
atatatatgtata

SEQ ID NO: 1412683 - DNA, 12 bp, Homo sapiens
cgctgctctgcc

SEQ ID NO: 1412684 - DNA, 17 bp, Homo sapiens
cggctttcatgtaatta

SEQ ID NO: 1412685 - DNA, 22 bp, Homo sapiens
cgggatgggagccgggcaaact

SEQ ID NO: 1412686 - DNA, 15 bp, Homo sapiens
cgggcacacctcctc

SEQ ID NO: 1412687 - DNA, 16 bp, Homo sapiens
cgggggaggggcgcgg

SEQ ID NO: 1412688 - DNA, 22 bp, Homo sapiens
cggtgtccccaccatctgctgt

SEQ ID NO: 1412689 - DNA, 13 bp, Homo sapiens
cgtagaaacaaga

SEQ ID NO: 1412690 - DNA, 14 bp, Homo sapiens
cgtgaaacacaata

SEQ ID NO: 1412691 - DNA, 13 bp, Homo sapiens
cgtgctcccctgc

SEQ ID NO: 1412692 - DNA, 21 bp, Homo sapiens
cgttaactgcattttacacat

SEQ ID NO: 1412693 - DNA, 20 bp, Homo sapiens
ctaaataaatttgcttttat

SEQ ID NO: 1412694 - DNA, 12 bp, Homo sapiens
ctaaatattatg

SEQ ID NO: 1412695 - DNA, 13 bp, Homo sapiens
ctaaatattatgc

SEQ ID NO: 1412696 - DNA, 14 bp, Homo sapiens
ctaaatattatgcc

SEQ ID NO: 1412697 - DNA, 21 bp, Homo sapiens
ctaacgcaaaaatagctcttg

SEQ ID NO: 1412698 - DNA, 22 bp, Homo sapiens
ctaacgcaaaaatagctcttgc

SEQ ID NO: 1412699 - DNA, 18 bp, Homo sapiens
ctaaggtccccagcagaa

SEQ ID NO: 1412700 - DNA, 18 bp, Homo sapiens
ctacatctccaaatatca

SEQ ID NO: 1412701 - DNA, 18 bp, Homo sapiens
ctaccagataactgagga

SEQ ID NO: 1412702 - DNA, 14 bp, Homo sapiens
ctagaacaattaca

SEQ ID NO: 1412703 - DNA, 19 bp, Homo sapiens
ctatataaccacatttcta

SEQ ID NO: 1412704 - DNA, 14 bp, Homo sapiens
ctatggacaattta

SEQ ID NO: 1412705 - DNA, 19 bp, Homo sapiens
ctcaagtctattgaataat

SEQ ID NO: 1412706 - DNA, 13 bp, Homo sapiens
ctcacagcatttg

SEQ ID NO: 1412707 - DNA, 22 bp, Homo sapiens
ctcacagcatttgccaagtctc

SEQ ID NO: 1412708 - DNA, 13 bp, Homo sapiens
ctcagcatatata

SEQ ID NO: 1412709 - DNA, 20 bp, Homo sapiens
ctcagccttgcaaatagcca

SEQ ID NO: 1412710 - DNA, 20 bp, Homo sapiens
ctcataagagtaacagtcat

SEQ ID NO: 1412711 - DNA, 23 bp, Homo sapiens
ctcatgaaagcagtgaagcaatt

SEQ ID NO: 1412712 - DNA, 17 bp, Homo sapiens
ctcatgaggaggggccc

SEQ ID NO: 1412713 - DNA, 22 bp, Homo sapiens
ctccaaccgggatgggagccgg

SEQ ID NO: 1412714 - DNA, 14 bp, Homo sapiens
ctccactctctacc

SEQ ID NO: 1412715 - DNA, 14 bp, Homo sapiens
ctccagcaggccca

SEQ ID NO: 1412716 - DNA, 20 bp, Homo sapiens
ctccatacacacgctgcctt

SEQ ID NO: 1412717 - DNA, 17 bp, Homo sapiens
ctcccagagctggtgga

SEQ ID NO: 1412718 - DNA, 17 bp, Homo sapiens
ctccccagccagcctgg

SEQ ID NO: 1412719 - DNA, 20 bp, Homo sapiens
ctccccagccagcctggctg

SEQ ID NO: 1412720 - DNA, 14 bp, Homo sapiens
ctcccccagccact

SEQ ID NO: 1412721 - DNA, 21 bp, Homo sapiens
ctccctctccagcaggcccat

SEQ ID NO: 1412722 - DNA, 24 bp, Homo sapiens
ctccctgactgggggcagacatgg

SEQ ID NO: 1412723 - DNA, 13 bp, Homo sapiens
ctcctcccactgc

SEQ ID NO: 1412724 - DNA, 17 bp, Homo sapiens
ctcctcccactgcccac

SEQ ID NO: 1412725 - DNA, 20 bp, Homo sapiens
ctcctttgcagaatgatgca

SEQ ID NO: 1412726 - DNA, 15 bp, Homo sapiens
ctcggtgtccccacc

SEQ ID NO: 1412727 - DNA, 21 bp, Homo sapiens
ctcggtgtccccaccatctgc

SEQ ID NO: 1412728 - DNA, 23 bp, Homo sapiens
ctcggtgtccccaccatctgctg

SEQ ID NO: 1412729 - DNA, 21 bp, Homo sapiens
ctctaccagataactgaggag

SEQ ID NO: 1412730 - DNA, 12 bp, Homo sapiens
ctctccagcagg

SEQ ID NO: 1412731 - DNA, 20 bp, Homo sapiens
ctctgaccccagcattctca

SEQ ID NO: 1412732 - DNA, 20 bp, Homo sapiens
ctctgatatgtctagggtgt

SEQ ID NO: 1412733 - DNA, 13 bp, Homo sapiens
ctctgccccagct

SEQ ID NO: 1412734 - DNA, 21 bp, Homo sapiens
ctctgccccagcttgggcaga

SEQ ID NO: 1412735 - DNA, 22 bp, Homo sapiens
ctctgctccaaccgggatggga

SEQ ID NO: 1412736 - DNA, 21 bp, Homo sapiens
ctcttcccgccgcccagccca

SEQ ID NO: 1412737 - DNA, 17 bp, Homo sapiens
ctcttgtagtcttggct

SEQ ID NO: 1412738 - DNA, 11 bp, Homo sapiens
ctgacaccagg

SEQ ID NO: 1412739 - DNA, 15 bp, Homo sapiens
ctgacagcaaacaca

SEQ ID NO: 1412740 - DNA, 17 bp, Homo sapiens
ctgacagcaaacacagt

SEQ ID NO: 1412741 - DNA, 19 bp, Homo sapiens
ctgacagcaaacacagtca

SEQ ID NO: 1412742 - DNA, 16 bp, Homo sapiens
ctgacatcatttgtat

SEQ ID NO: 1412743 - DNA, 17 bp, Homo sapiens
ctgactgggggcagaca

SEQ ID NO: 1412744 - DNA, 16 bp, Homo sapiens
ctgagggcagagaggt

SEQ ID NO: 1412745 - DNA, 20 bp, Homo sapiens
ctgcaccccttcctgggcac

SEQ ID NO: 1412746 - DNA, 20 bp, Homo sapiens
ctgcagagggctccagagtg

SEQ ID NO: 1412747 - DNA, 15 bp, Homo sapiens
ctgcagccaagcaaa

SEQ ID NO: 1412748 - DNA, 19 bp, Homo sapiens
ctgcagccaagcaaatgcc

SEQ ID NO: 1412749 - DNA, 20 bp, Homo sapiens
ctgcagccaagcaaatgcct

SEQ ID NO: 1412750 - DNA, 19 bp, Homo sapiens
ctgcatagcttttccctgt

SEQ ID NO: 1412751 - DNA, 21 bp, Homo sapiens
ctgccaaaaagtggctggaag

SEQ ID NO: 1412752 - DNA, 16 bp, Homo sapiens
ctgcccactggccggc

SEQ ID NO: 1412753 - DNA, 20 bp, Homo sapiens
ctgcctcggatccccttcct

SEQ ID NO: 1412754 - DNA, 18 bp, Homo sapiens
ctgccttcggtacccacc

SEQ ID NO: 1412755 - DNA, 22 bp, Homo sapiens
ctgcggggcgggcacacctcct

SEQ ID NO: 1412756 - DNA, 21 bp, Homo sapiens
ctgctcggcaccgccagccgc

SEQ ID NO: 1412757 - DNA, 13 bp, Homo sapiens
ctgctctgcccca

SEQ ID NO: 1412758 - DNA, 17 bp, Homo sapiens
ctgctctgccccagctt

SEQ ID NO: 1412759 - DNA, 20 bp, Homo sapiens
ctggcagcaccgcctcttcc

SEQ ID NO: 1412760 - DNA, 20 bp, Homo sapiens
ctggcatttggcctcttgta

SEQ ID NO: 1412761 - DNA, 12 bp, Homo sapiens
ctggctgcgggg

SEQ ID NO: 1412762 - DNA, 17 bp, Homo sapiens
ctggctgggactgggaa

SEQ ID NO: 1412763 - DNA, 13 bp, Homo sapiens
ctgggactgggaa

SEQ ID NO: 1412764 - DNA, 16 bp, Homo sapiens
ctgggcacacgctgct

SEQ ID NO: 1412765 - DNA, 20 bp, Homo sapiens
ctgggggcaaaatcagaatg

SEQ ID NO: 1412766 - DNA, 12 bp, Homo sapiens
ctggggggcagg

SEQ ID NO: 1412767 - DNA, 13 bp, Homo sapiens
ctgtacacacaca

SEQ ID NO: 1412768 - DNA, 14 bp, Homo sapiens
ctgtacacacacag

SEQ ID NO: 1412769 - DNA, 17 bp, Homo sapiens
ctgtacacacacagaca

SEQ ID NO: 1412770 - DNA, 19 bp, Homo sapiens
ctgtacacacacagacaca

SEQ ID NO: 1412771 - DNA, 20 bp, Homo sapiens
ctgtacacacacagacacac

SEQ ID NO: 1412772 - DNA, 20 bp, Homo sapiens
ctgtccggaatgccacccac

SEQ ID NO: 1412773 - DNA, 18 bp, Homo sapiens
ctgtcctgacaccaggca

SEQ ID NO: 1412774 - DNA, 15 bp, Homo sapiens
ctgtctttcttgctc

SEQ ID NO: 1412775 - DNA, 18 bp, Homo sapiens
ctgtctttcttgctccct

SEQ ID NO: 1412776 - DNA, 17 bp, Homo sapiens
ctgtcttttctttgcca

SEQ ID NO: 1412777 - DNA, 15 bp, Homo sapiens
ctgtgcccctggcct

SEQ ID NO: 1412778 - DNA, 14 bp, Homo sapiens
ctgtgggccagccg

SEQ ID NO: 1412779 - DNA, 15 bp, Homo sapiens
ctgttgtctgaaaca

SEQ ID NO: 1412780 - DNA, 14 bp, Homo sapiens
ctgttttgccagcc

SEQ ID NO: 1412781 - DNA, 21 bp, Homo sapiens
cttaaaaagcatcattacaat

SEQ ID NO: 1412782 - DNA, 19 bp, Homo sapiens
cttagttaatctttgaaaa

SEQ ID NO: 1412783 - DNA, 11 bp, Homo sapiens
cttcagattcc

SEQ ID NO: 1412784 - DNA, 12 bp, Homo sapiens
cttcgggaccag

SEQ ID NO: 1412785 - DNA, 18 bp, Homo sapiens
cttcttccattggaaaat

SEQ ID NO: 1412786 - DNA, 16 bp, Homo sapiens
cttgcagttatgttat

SEQ ID NO: 1412787 - DNA, 10 bp, Homo sapiens
cttgctgcct

SEQ ID NO: 1412788 - DNA, 11 bp, Homo sapiens
cttgctgcctc

SEQ ID NO: 1412789 - DNA, 14 bp, Homo sapiens
ctttaaccctttct

SEQ ID NO: 1412790 - DNA, 16 bp, Homo sapiens
ctttaattaagctctc

SEQ ID NO: 1412791 - DNA, 23 bp, Homo sapiens
ctttatactttgctgttgaagaa

SEQ ID NO: 1412792 - DNA, 14 bp, Homo sapiens
ctttcattttgcac

SEQ ID NO: 1412793 - DNA, 13 bp, Homo sapiens
ctttcttgctccc

SEQ ID NO: 1412794 - DNA, 15 bp, Homo sapiens
ctttcttgctccctg

SEQ ID NO: 1412795 - DNA, 14 bp, Homo sapiens
ctttgccatctctg

SEQ ID NO: 1412796 - DNA, 18 bp, Homo sapiens
ctttgccatctctgctcc

SEQ ID NO: 1412797 - DNA, 21 bp, Homo sapiens
cttttctttgccatctctgct

SEQ ID NO: 1412798 - DNA, 12 bp, Homo sapiens
cttttgtaataa

SEQ ID NO: 1412799 - DNA, 14 bp, Homo sapiens
cttttgtaataaac

SEQ ID NO: 1412800 - DNA, 14 bp, Homo sapiens
gaaaaagatctttc

SEQ ID NO: 1412801 - DNA, 20 bp, Homo sapiens
gaaaaagatctttcattttg

SEQ ID NO: 1412802 - DNA, 13 bp, Homo sapiens
gaaaagagaaaaa

SEQ ID NO: 1412803 - DNA, 14 bp, Homo sapiens
gaaaagcgcagaga

SEQ ID NO: 1412804 - DNA, 15 bp, Homo sapiens
gaaaagcgcagagaa

SEQ ID NO: 1412805 - DNA, 11 bp, Homo sapiens
gaaaatttaat

SEQ ID NO: 1412806 - DNA, 23 bp, Homo sapiens
gaaactactaatctcaatttaag

SEQ ID NO: 1412807 - DNA, 17 bp, Homo sapiens
gaaactgagggcagaga

SEQ ID NO: 1412808 - DNA, 22 bp, Homo sapiens
taatatggactcagccttgcaa

SEQ ID NO: 1412809 - DNA, 19 bp, Homo sapiens
taatctctccaccttccaa

SEQ ID NO: 1412810 - DNA, 22 bp, Homo sapiens
taatgtagttttgtgatgcatt

SEQ ID NO: 1412811 - DNA, 14 bp, Homo sapiens
taattaagctctca

SEQ ID NO: 1412812 - DNA, 22 bp, Homo sapiens
taattaagctctcatagctcat

SEQ ID NO: 1412813 - DNA, 16 bp, Homo sapiens
taattgaaagggacaa

SEQ ID NO: 1412814 - DNA, 19 bp, Homo sapiens
taattgaaagggacaagta

SEQ ID NO: 1412815 - DNA, 22 bp, Homo sapiens
taattgaaagggacaagtatca

SEQ ID NO: 1412816 - DNA, 23 bp, Homo sapiens
taatttttatttttggcaaagcc

SEQ ID NO: 1412817 - DNA, 16 bp, Homo sapiens
tacaatacagtatttc

SEQ ID NO: 1412818 - DNA, 13 bp, Homo sapiens
tacacacacagac

SEQ ID NO: 1412819 - DNA, 16 bp, Homo sapiens
tacacatacatatata

SEQ ID NO: 1412820 - DNA, 18 bp, Homo sapiens
tacacatacatatataca

SEQ ID NO: 1412821 - DNA, 15 bp, Homo sapiens
tacacgtgtatatga

SEQ ID NO: 1412822 - DNA, 22 bp, Homo sapiens
tacagtatttctttgttataca

SEQ ID NO: 1412823 - DNA, 14 bp, Homo sapiens
tacagtgtgtagtt

SEQ ID NO: 1412824 - DNA, 18 bp, Homo sapiens
tacatacgcaattgtata

SEQ ID NO: 1412825 - DNA, 18 bp, Homo sapiens
tacatgtaaacaaatatt

SEQ ID NO: 1412826 - DNA, 22 bp, Homo sapiens
tacattttgcagctatggacaa

SEQ ID NO: 1412827 - DNA, 17 bp, Homo sapiens
taccacaggatgcatat

SEQ ID NO: 1412828 - DNA, 18 bp, Homo sapiens
taccacaggatgcatatt

SEQ ID NO: 1412829 - DNA, 21 bp, Homo sapiens
taccacaggatgcatattaaa

SEQ ID NO: 1412830 - DNA, 18 bp, Homo sapiens
tacctgtacacacacaga

SEQ ID NO: 1412831 - DNA, 15 bp, Homo sapiens
tacgcaattgtatat

SEQ ID NO: 1412832 - DNA, 18 bp, Homo sapiens
tacgcaattgtatatata

SEQ ID NO: 1412833 - DNA, 17 bp, Homo sapiens
tactctaaggtaaaacc

SEQ ID NO: 1412834 - DNA, 13 bp, Homo sapiens
tactctaatatac

SEQ ID NO: 1412835 - DNA, 19 bp, Homo sapiens
tactctgcctgtcaagttt

SEQ ID NO: 1412836 - DNA, 21 bp, Homo sapiens
tactgggggcaaaatcagaat

SEQ ID NO: 1412837 - DNA, 14 bp, Homo sapiens
tacttgatttttca

SEQ ID NO: 1412838 - DNA, 17 bp, Homo sapiens
tactttaaccctttctg

SEQ ID NO: 1412839 - DNA, 21 bp, Homo sapiens
tagaacaattacatgtaaaca

SEQ ID NO: 1412840 - DNA, 13 bp, Homo sapiens
tagaagaaaattt

SEQ ID NO: 1412841 - DNA, 18 bp, Homo sapiens
tagatctacactctcgag

SEQ ID NO: 1412842 - DNA, 14 bp, Homo sapiens
tagcacatgatttg

SEQ ID NO: 1412843 - DNA, 11 bp, Homo sapiens
tagctcttgct

SEQ ID NO: 1412844 - DNA, 17 bp, Homo sapiens
taggtcagtagactgtg

SEQ ID NO: 1412845 - DNA, 23 bp, Homo sapiens
tagttagtgattatatttcaccc

SEQ ID NO: 1412846 - DNA, 22 bp, Homo sapiens
tagttgtagaagaaaatttaat

SEQ ID NO: 1412847 - DNA, 18 bp, Homo sapiens
tagttttgtgatgcattt

SEQ ID NO: 1412848 - DNA, 18 bp, Homo sapiens
tataaaatacacgtgtat

SEQ ID NO: 1412849 - DNA, 13 bp, Homo sapiens
tataacattgtat

SEQ ID NO: 1412850 - DNA, 22 bp, Homo sapiens
tataaccacatttctaagcctt

SEQ ID NO: 1412851 - DNA, 23 bp, Homo sapiens
tatacatacgcaattgtatatat

SEQ ID NO: 1412852 - DNA, 12 bp, Homo sapiens
tatacatttaaa

SEQ ID NO: 1412853 - DNA, 14 bp, Homo sapiens
tatacctgtacaca

SEQ ID NO: 1412854 - DNA, 17 bp, Homo sapiens
tatacctgtacacacac

SEQ ID NO: 1412855 - DNA, 20 bp, Homo sapiens
tatacctgtacacacacaga

SEQ ID NO: 1412856 - DNA, 23 bp, Homo sapiens
tatactgggggcaaaatcagaat

SEQ ID NO: 1412857 - DNA, 13 bp, Homo sapiens
tatataaaataca

SEQ ID NO: 1412858 - DNA, 14 bp, Homo sapiens
tatataaaatacac

SEQ ID NO: 1412859 - DNA, 16 bp, Homo sapiens
tatataaaatacacgt

SEQ ID NO: 1412860 - DNA, 23 bp, Homo sapiens
tatataaaatacacgtgtatatg

SEQ ID NO: 1412861 - DNA, 20 bp, Homo sapiens
tatataaccacatttctaag

SEQ ID NO: 1412862 - DNA, 21 bp, Homo sapiens
tatatacatacgcaattgtat

SEQ ID NO: 1412863 - DNA, 16 bp, Homo sapiens
tatatataaaatacac

SEQ ID NO: 1412864 - DNA, 14 bp, Homo sapiens
tatatatacatcat

SEQ ID NO: 1412865 - DNA, 22 bp, Homo sapiens
tatatgaggatgtatgtgtata

SEQ ID NO: 1412866 - DNA, 17 bp, Homo sapiens
tatatgtttatacacac

SEQ ID NO: 1412867 - DNA, 18 bp, Homo sapiens
tatatgtttatacacaca

SEQ ID NO: 1412868 - DNA, 19 bp, Homo sapiens
tatatgtttatacacacag

SEQ ID NO: 1412869 - DNA, 13 bp, Homo sapiens
tatgcatatatat

SEQ ID NO: 1412870 - DNA, 16 bp, Homo sapiens
tatgcatatatatgta

SEQ ID NO: 1412871 - DNA, 17 bp, Homo sapiens
tatgcatatatatgtat

SEQ ID NO: 1412872 - DNA, 20 bp, Homo sapiens
tatggaagacaaatacacat

SEQ ID NO: 1412873 - DNA, 16 bp, Homo sapiens
tatgtgaactttctca

SEQ ID NO: 1412874 - DNA, 22 bp, Homo sapiens
tatgtgaactttctcagcatat

SEQ ID NO: 1412875 - DNA, 18 bp, Homo sapiens
tatgtgtatatgtttata

SEQ ID NO: 1412876 - DNA, 19 bp, Homo sapiens
tattaacaaattgcatttg

SEQ ID NO: 1412877 - DNA, 16 bp, Homo sapiens
tattatttgatgatac

SEQ ID NO: 1412878 - DNA, 19 bp, Homo sapiens
tattcatgaagagttgttt

SEQ ID NO: 1412879 - DNA, 18 bp, Homo sapiens
tattgccaaaacccagct

SEQ ID NO: 1412880 - DNA, 14 bp, Homo sapiens
tatttaccaagatt

SEQ ID NO: 1412881 - DNA, 18 bp, Homo sapiens
tatttcacccatctctca

SEQ ID NO: 1412882 - DNA, 17 bp, Homo sapiens
tatttcataagcacatc

SEQ ID NO: 1412883 - DNA, 23 bp, Homo sapiens
tatttctttgttatacatttaaa

SEQ ID NO: 1412884 - DNA, 13 bp, Homo sapiens
tatttgcaaggct

SEQ ID NO: 1412885 - DNA, 18 bp, Homo sapiens
tatttgcaaggctgattt

SEQ ID NO: 1412886 - DNA, 20 bp, Homo sapiens
tcaaaaacatgcttttccaa

SEQ ID NO: 1412887 - DNA, 23 bp, Homo sapiens
tcaacaacaaaacatttgctctg

SEQ ID NO: 1412888 - DNA, 23 bp, Homo sapiens
tcacactgtggcctgatcagcag

SEQ ID NO: 1412889 - DNA, 20 bp, Homo sapiens
tcacatcacccatgttgaga

SEQ ID NO: 1412890 - DNA, 18 bp, Homo sapiens
tcacctctttgctccctg

SEQ ID NO: 1412891 - DNA, 23 bp, Homo sapiens
tcactctccgaagtctgatccct

SEQ ID NO: 1412892 - DNA, 23 bp, Homo sapiens
tcactgtcatgtgcgaacacagt

SEQ ID NO: 1412893 - DNA, 20 bp, Homo sapiens
tcagaaagacattcttagtt

SEQ ID NO: 1412894 - DNA, 17 bp, Homo sapiens
tcagagatataataagc

SEQ ID NO: 1412895 - DNA, 17 bp, Homo sapiens
tcagcaggagccaatat

SEQ ID NO: 1412896 - DNA, 12 bp, Homo sapiens
tcagcatatata

SEQ ID NO: 1412897 - DNA, 13 bp, Homo sapiens
tcagccttgcaaa

SEQ ID NO: 1412898 - DNA, 15 bp, Homo sapiens
tcaggtcccctttca

SEQ ID NO: 1412899 - DNA, 22 bp, Homo sapiens
tcatacagtggtattgctagtt

SEQ ID NO: 1412900 - DNA, 19 bp, Homo sapiens
tcatacttaactttactaa

SEQ ID NO: 1412901 - DNA, 17 bp, Homo sapiens
tcatagctcataagagt

SEQ ID NO: 1412902 - DNA, 20 bp, Homo sapiens
tcatattttcctttatgtga

SEQ ID NO: 1412903 - DNA, 18 bp, Homo sapiens
tcatctcctttgcagaat

SEQ ID NO: 1412904 - DNA, 18 bp, Homo sapiens
tcatgaagagttgtttat

SEQ ID NO: 1412905 - DNA, 23 bp, Homo sapiens
tcatgcctttatttctgtatctg

SEQ ID NO: 1412906 - DNA, 16 bp, Homo sapiens
tcatgtgcgaacacag

SEQ ID NO: 1412907 - DNA, 23 bp, Homo sapiens
tcatttaacactgagtgaaatat

SEQ ID NO: 1412908 - DNA, 22 bp, Homo sapiens
tcatttatcatcacaaatggct

SEQ ID NO: 1412909 - DNA, 20 bp, Homo sapiens
tccaagtggcctccgtcact

SEQ ID NO: 1412910 - DNA, 22 bp, Homo sapiens
tccaagtggcctccgtcactac

SEQ ID NO: 1412911 - DNA, 17 bp, Homo sapiens
tccaattttaaaatgaa

SEQ ID NO: 1412912 - DNA, 22 bp, Homo sapiens
tccaattttaaaatgaaatgca

SEQ ID NO: 1412913 - DNA, 13 bp, Homo sapiens
tccagcaggccca

SEQ ID NO: 1412914 - DNA, 17 bp, Homo sapiens
tccaggcccctccctct

SEQ ID NO: 1412915 - DNA, 19 bp, Homo sapiens
tcccagagctggtggaccc

SEQ ID NO: 1412916 - DNA, 22 bp, Homo sapiens
tcccaggactagagcacaacat

SEQ ID NO: 1412917 - DNA, 13 bp, Homo sapiens
tccccagccagcc

SEQ ID NO: 1412918 - DNA, 13 bp, Homo sapiens
tcccccagccact

SEQ ID NO: 1412919 - DNA, 19 bp, Homo sapiens
tccccttcctaccacccgg

SEQ ID NO: 1412920 - DNA, 15 bp, Homo sapiens
tcccctttcagagat

SEQ ID NO: 1412921 - DNA, 16 bp, Homo sapiens
tcccttagtactcttc

SEQ ID NO: 1412922 - DNA, 20 bp, Homo sapiens
tccgaaatgctgtctttctt

SEQ ID NO: 1412923 - DNA, 18 bp, Homo sapiens
tccggaatgccacccaca

SEQ ID NO: 1412924 - DNA, 21 bp, Homo sapiens
tcctaccacccggtccccact

SEQ ID NO: 1412925 - DNA, 23 bp, Homo sapiens
tcctgcatagcttttccctgtcc

SEQ ID NO: 1412926 - DNA, 19 bp, Homo sapiens
tcctgggcacacgctgctc

SEQ ID NO: 1412927 - DNA, 23 bp, Homo sapiens
tcctgggcacacgctgctctgcc

SEQ ID NO: 1412928 - DNA, 14 bp, Homo sapiens
tcgctccctcccag

SEQ ID NO: 1412929 - DNA, 15 bp, Homo sapiens
tcggtacccaccaca

SEQ ID NO: 1412930 - DNA, 11 bp, Homo sapiens
aaaaagaaaag

SEQ ID NO: 1412931 - DNA, 12 bp, Homo sapiens
aaaacccagctg

SEQ ID NO: 1412932 - DNA, 14 bp, Homo sapiens
aaaacccagctgca

SEQ ID NO: 1412933 - DNA, 14 bp, Homo sapiens
aaaagatctttcat

SEQ ID NO: 1412934 - DNA, 17 bp, Homo sapiens
aaaagatctttcatttt

SEQ ID NO: 1412935 - DNA, 21 bp, Homo sapiens
aaaagtggctggaagagtccc

SEQ ID NO: 1412936 - DNA, 18 bp, Homo sapiens
aaacactctaaataaatt

SEQ ID NO: 1412937 - DNA, 19 bp, Homo sapiens
aaacactctaaataaattt

SEQ ID NO: 1412938 - DNA, 16 bp, Homo sapiens
aaacatgcttttccaa

SEQ ID NO: 1412939 - DNA, 14 bp, Homo sapiens
aaacctacaggaat

SEQ ID NO: 1412940 - DNA, 19 bp, Homo sapiens
aaactactaatctcaattt

SEQ ID NO: 1412941 - DNA, 18 bp, Homo sapiens
aaagaaatttcaacagtt

SEQ ID NO: 1412942 - DNA, 20 bp, Homo sapiens
aaagactagccagccaggaa

SEQ ID NO: 1412943 - DNA, 14 bp, Homo sapiens
aaagacttcattta

SEQ ID NO: 1412944 - DNA, 15 bp, Homo sapiens
aaagacttcatttaa

SEQ ID NO: 1412945 - DNA, 22 bp, Homo sapiens
aaagacttcatttaacactgag

SEQ ID NO: 1412946 - DNA, 22 bp, Homo sapiens
aaagatggggaaactgagggca

SEQ ID NO: 1412947 - DNA, 20 bp, Homo sapiens
aaagctcgtagaaacaagac

SEQ ID NO: 1412948 - DNA, 22 bp, Homo sapiens
aaagggtctccgaaatgctgtc

SEQ ID NO: 1412949 - DNA, 18 bp, Homo sapiens
aaagtgaagaatttatct

SEQ ID NO: 1412950 - DNA, 21 bp, Homo sapiens
aaagtgaagaatttatctctt

SEQ ID NO: 1412951 - DNA, 15 bp, Homo sapiens
aaatacacgtgtata

SEQ ID NO: 1412952 - DNA, 17 bp, Homo sapiens
aaatacacgtgtatatg

SEQ ID NO: 1412953 - DNA, 18 bp, Homo sapiens
aaatacacgtgtatatga

SEQ ID NO: 1412954 - DNA, 19 bp, Homo sapiens
aaatacacgtgtatatgag

SEQ ID NO: 1412955 - DNA, 17 bp, Homo sapiens
aaatagccagtgctagt

SEQ ID NO: 1412956 - DNA, 12 bp, Homo sapiens
aaatagctcttg

SEQ ID NO: 1412957 - DNA, 16 bp, Homo sapiens
aaatgaaatgcatttt

SEQ ID NO: 1412958 - DNA, 21 bp, Homo sapiens
aaatgagatatgcaataaata

SEQ ID NO: 1412959 - DNA, 22 bp, Homo sapiens
aaatgctgtctttcttgctccc

SEQ ID NO: 1412960 - DNA, 14 bp, Homo sapiens
aacaaattgcattt

SEQ ID NO: 1412961 - DNA, 17 bp, Homo sapiens
aacaaattgcatttgtg

SEQ ID NO: 1412962 - DNA, 18 bp, Homo sapiens
aacaagacttcagattcc

SEQ ID NO: 1412963 - DNA, 15 bp, Homo sapiens
aacaagttgaagaag

SEQ ID NO: 1412964 - DNA, 14 bp, Homo sapiens
aacactgagtgaaa

SEQ ID NO: 1412965 - DNA, 19 bp, Homo sapiens
aacactgagtgaaatatta

SEQ ID NO: 1412966 - DNA, 14 bp, Homo sapiens
aacagaaagcatag

SEQ ID NO: 1412967 - DNA, 23 bp, Homo sapiens
aacagaactcggtgtccccacca

SEQ ID NO: 1412968 - DNA, 15 bp, Homo sapiens
aacagccactcccct

SEQ ID NO: 1412969 - DNA, 14 bp, Homo sapiens
aacagtcatcattt

SEQ ID NO: 1412970 - DNA, 21 bp, Homo sapiens
aacagttattgggcttaaaaa

SEQ ID NO: 1412971 - DNA, 20 bp, Homo sapiens
aacataatttttatttttgg

SEQ ID NO: 1412972 - DNA, 19 bp, Homo sapiens
aacatgacccgtacacacc

SEQ ID NO: 1412973 - DNA, 13 bp, Homo sapiens
aacattgtatgtt

SEQ ID NO: 1412974 - DNA, 23 bp, Homo sapiens
aacatttgctctggggggcaggg

SEQ ID NO: 1412975 - DNA, 15 bp, Homo sapiens
aaccctggcatttgg

SEQ ID NO: 1412976 - DNA, 23 bp, Homo sapiens
aacctgacagcaaacacagtcac

SEQ ID NO: 1412977 - DNA, 20 bp, Homo sapiens
aacgaccgtcttttgaaaac

SEQ ID NO: 1412978 - DNA, 18 bp, Homo sapiens
aacgcaaaaatagctctt

SEQ ID NO: 1412979 - DNA, 15 bp, Homo sapiens
aactactaatctcaa

SEQ ID NO: 1412980 - DNA, 22 bp, Homo sapiens
aactactaatctcaatttaaga

SEQ ID NO: 1412981 - DNA, 22 bp, Homo sapiens
aactcggtgtccccaccatctg

SEQ ID NO: 1412982 - DNA, 24 bp, Homo sapiens
aactcggtgtccccaccatctgct

SEQ ID NO: 1412983 - DNA, 12 bp, Homo sapiens
aacttgctgcct

SEQ ID NO: 1412984 - DNA, 14 bp, Homo sapiens
aacttgctgcctcg

SEQ ID NO: 1412985 - DNA, 15 bp, Homo sapiens
aactttctcagcata

SEQ ID NO: 1412986 - DNA, 16 bp, Homo sapiens
aagcattagctttaat

SEQ ID NO: 1412987 - DNA, 13 bp, Homo sapiens
aagcgcagagaaa

SEQ ID NO: 1412988 - DNA, 13 bp, Homo sapiens
aagctaaaacact

SEQ ID NO: 1412989 - DNA, 18 bp, Homo sapiens
aagctcgtagaaacaaga

SEQ ID NO: 1412990 - DNA, 22 bp, Homo sapiens
aagctcgtagaaacaagacaag

SEQ ID NO: 1412991 - DNA, 18 bp, Homo sapiens
aagctctcatagctcata

SEQ ID NO: 1412992 - DNA, 17 bp, Homo sapiens
aaggagataagaaagca

SEQ ID NO: 1412993 - DNA, 14 bp, Homo sapiens
aaggctgatttatg

SEQ ID NO: 1412994 - DNA, 15 bp, Homo sapiens
aaggtccccagcaga

SEQ ID NO: 1412995 - DNA, 22 bp, Homo sapiens
aagtaaaacactctaaataaat

SEQ ID NO: 1412996 - DNA, 16 bp, Homo sapiens
aagtaaagtgaagaat

SEQ ID NO: 1412997 - DNA, 21 bp, Homo sapiens
aagtaatctcacagcatttgc

SEQ ID NO: 1412998 - DNA, 17 bp, Homo sapiens
aagtactctaatataca

SEQ ID NO: 1412999 - DNA, 15 bp, Homo sapiens
aagtattatatttta

SEQ ID NO: 1413000 - DNA, 19 bp, Homo sapiens
aagtcatagtttttttctt

SEQ ID NO: 1413001 - DNA, 18 bp, Homo sapiens
aagtgccttatcaaataa

SEQ ID NO: 1413002 - DNA, 22 bp, Homo sapiens
aataagcccaacaagttgaaga

SEQ ID NO: 1413003 - DNA, 23 bp, Homo sapiens
aataagcccaacaagttgaagaa

SEQ ID NO: 1413004 - DNA, 18 bp, Homo sapiens
aataaggacacaaacttt

SEQ ID NO: 1413005 - DNA, 18 bp, Homo sapiens
aataatagcacatgattt

SEQ ID NO: 1413006 - DNA, 24 bp, Homo sapiens
aataatgtagttttgtgatgcatt

SEQ ID NO: 1413007 - DNA, 13 bp, Homo sapiens
aatacacatacat

SEQ ID NO: 1413008 - DNA, 16 bp, Homo sapiens
aatacagtatttcttt

SEQ ID NO: 1413009 - DNA, 24 bp, Homo sapiens
aatacagtatttctttgttataca

SEQ ID NO: 1413010 - DNA, 14 bp, Homo sapiens
aatacctggcctca

SEQ ID NO: 1413011 - DNA, 19 bp, Homo sapiens
aatacctggcctcatttaa

SEQ ID NO: 1413012 - DNA, 12 bp, Homo sapiens
aatagaaaatat

SEQ ID NO: 1413013 - DNA, 17 bp, Homo sapiens
aatatacagtgtgtagt

SEQ ID NO: 1413014 - DNA, 22 bp, Homo sapiens
aatatcatccccaaatgtgtct

SEQ ID NO: 1413015 - DNA, 15 bp, Homo sapiens
aatatgcatatatat

SEQ ID NO: 1413016 - DNA, 22 bp, Homo sapiens
aatattactctgcctgtcaagt

SEQ ID NO: 1413017 - DNA, 18 bp, Homo sapiens
aatcatctcctttgcaga

SEQ ID NO: 1413018 - DNA, 16 bp, Homo sapiens
aatctcacagcatttg

SEQ ID NO: 1413019 - DNA, 22 bp, Homo sapiens
aatcttgaaggaacacaaagat

SEQ ID NO: 1413020 - DNA, 20 bp, Homo sapiens
aatgagatatgcaataaata

SEQ ID NO: 1413021 - DNA, 19 bp, Homo sapiens
aatgagggcgtgaaacaca

SEQ ID NO: 1413022 - DNA, 23 bp, Homo sapiens
aatgagggcgtgaaacacaatat

SEQ ID NO: 1413023 - DNA, 19 bp, Homo sapiens
aatgctgtctttcttgctc

SEQ ID NO: 1413024 - DNA, 22 bp, Homo sapiens
aatgctgtctttcttgctccct

SEQ ID NO: 1413025 - DNA, 23 bp, Homo sapiens
aatgtagttttgtgatgcatttt

SEQ ID NO: 1413026 - DNA, 21 bp, Homo sapiens
aatgtgtcttgtattatcata

SEQ ID NO: 1413027 - DNA, 12 bp, Homo sapiens
aattacatgtaa

SEQ ID NO: 1413028 - DNA, 15 bp, Homo sapiens
aattacatgtaaaca

SEQ ID NO: 1413029 - DNA, 22 bp, Homo sapiens
aattacatgtaaacaaatattt

SEQ ID NO: 1413030 - DNA, 23 bp, Homo sapiens
aattctaacgcaaaaatagctct

SEQ ID NO: 1413031 - DNA, 15 bp, Homo sapiens
aattgaaagggacaa

SEQ ID NO: 1413032 - DNA, 19 bp, Homo sapiens
aattgaaagggacaagtat

SEQ ID NO: 1413033 - DNA, 21 bp, Homo sapiens
aattgaaagggacaagtatca

SEQ ID NO: 1413034 - DNA, 23 bp, Homo sapiens
aattgatgctaagtgatgggatt

SEQ ID NO: 1413035 - DNA, 20 bp, Homo sapiens
aattgtatatatatgtgaac

SEQ ID NO: 1413036 - DNA, 21 bp, Homo sapiens
aattgtatatatatgtgaact

SEQ ID NO: 1413037 - DNA, 18 bp, Homo sapiens
aatttaagatacaaataa

SEQ ID NO: 1413038 - DNA, 14 bp, Homo sapiens
aatttaattatttg

SEQ ID NO: 1413039 - DNA, 16 bp, Homo sapiens
aatttaattatttgtt

SEQ ID NO: 1413040 - DNA, 24 bp, Homo sapiens
aatttatctctttagttagtgatt

SEQ ID NO: 1413041 - DNA, 12 bp, Homo sapiens
acaaatacacat

SEQ ID NO: 1413042 - DNA, 15 bp, Homo sapiens
acaaatattttcttt

SEQ ID NO: 1413043 - DNA, 15 bp, Homo sapiens
acaagcagacacaca

SEQ ID NO: 1413044 - DNA, 15 bp, Homo sapiens
acaagttgaagaagc

SEQ ID NO: 1413045 - DNA, 16 bp, Homo sapiens
acaagttgaagaagct

SEQ ID NO: 1413046 - DNA, 12 bp, Homo sapiens
acaatacagtat

SEQ ID NO: 1413047 - DNA, 23 bp, Homo sapiens
acaatagcatttctagaacaatt

SEQ ID NO: 1413048 - DNA, 14 bp, Homo sapiens
acaatatcatcccc

SEQ ID NO: 1413049 - DNA, 17 bp, Homo sapiens
acaattacatgtaaaca

SEQ ID NO: 1413050 - DNA, 23 bp, Homo sapiens
acaatttaccacaggatgcatat

SEQ ID NO: 1413051 - DNA, 20 bp, Homo sapiens
acacaagcagacacacacat

SEQ ID NO: 1413052 - DNA, 15 bp, Homo sapiens
acacacaagcagaca

SEQ ID NO: 1413053 - DNA, 12 bp, Homo sapiens
acacacacagac

SEQ ID NO: 1413054 - DNA, 15 bp, Homo sapiens
acacacacatatata

SEQ ID NO: 1413055 - DNA, 21 bp, Homo sapiens
acacacatatatacatacgca

SEQ ID NO: 1413056 - DNA, 16 bp, Homo sapiens
acacagtgacacgttt

SEQ ID NO: 1413057 - DNA, 18 bp, Homo sapiens
acacatatatacatacgc

SEQ ID NO: 1413058 - DNA, 19 bp, Homo sapiens
acacatatatacatacgca

SEQ ID NO: 1413059 - DNA, 15 bp, Homo sapiens
acacctcctcccact

SEQ ID NO: 1413060 - DNA, 17 bp, Homo sapiens
acacgctgctctgcccc

SEQ ID NO: 1413061 - DNA, 18 bp, Homo sapiens
acagaagcacatgcacct

SEQ ID NO: 1413062 - DNA, 15 bp, Homo sapiens
acagagctagaggcc

SEQ ID NO: 1413063 - DNA, 22 bp, Homo sapiens
acagaggatgctgacatcattt

SEQ ID NO: 1413064 - DNA, 20 bp, Homo sapiens
acagcaaacacagtcactgt

SEQ ID NO: 1413065 - DNA, 18 bp, Homo sapiens
acaggagatgctgtgccc

SEQ ID NO: 1413066 - DNA, 19 bp, Homo sapiens
acaggagatgctgtgcccc

SEQ ID NO: 1413067 - DNA, 16 bp, Homo sapiens
acaggatgcatattaa

SEQ ID NO: 1413068 - DNA, 12 bp, Homo sapiens
acagtatttctt

SEQ ID NO: 1413069 - DNA, 23 bp, Homo sapiens
acagtatttctttgttatacatt

SEQ ID NO: 1413070 - DNA, 19 bp, Homo sapiens
acatatatacatacgcaat

SEQ ID NO: 1413071 - DNA, 20 bp, Homo sapiens
acatatttcataagcacatc

SEQ ID NO: 1413072 - DNA, 13 bp, Homo sapiens
acatcatttgtat

SEQ ID NO: 1413073 - DNA, 24 bp, Homo sapiens
acatcttccatttccatgtcccct

SEQ ID NO: 1413074 - DNA, 17 bp, Homo sapiens
acatgacccgtacacac

SEQ ID NO: 1413075 - DNA, 23 bp, Homo sapiens
acatggtggggtctcctcaggac

SEQ ID NO: 1413076 - DNA, 18 bp, Homo sapiens
acatgtaaacaaatattt

SEQ ID NO: 1413077 - DNA, 21 bp, Homo sapiens
acattttgcagctatggacaa

SEQ ID NO: 1413078 - DNA, 15 bp, Homo sapiens
accacgcgtcaccca

SEQ ID NO: 1413079 - DNA, 22 bp, Homo sapiens
accaggcaagaaaagcgcagag

SEQ ID NO: 1413080 - DNA, 14 bp, Homo sapiens
accatctgctgtct

SEQ ID NO: 1413081 - DNA, 15 bp, Homo sapiens
accatctgctgtctt

SEQ ID NO: 1413082 - DNA, 12 bp, Homo sapiens
acccaccacaca

SEQ ID NO: 1413083 - DNA, 13 bp, Homo sapiens
acccagctgcacc

SEQ ID NO: 1413084 - DNA, 20 bp, Homo sapiens
acccagctgcaccccttcct

SEQ ID NO: 1413085 - DNA, 14 bp, Homo sapiens
acccatacaccccc

SEQ ID NO: 1413086 - DNA, 20 bp, Homo sapiens
accccatggccggctttcag

SEQ ID NO: 1413087 - DNA, 17 bp, Homo sapiens
acccccgacgtgctccc

SEQ ID NO: 1413088 - DNA, 15 bp, Homo sapiens
accccttcctgggca

SEQ ID NO: 1413089 - DNA, 19 bp, Homo sapiens
accctggcatttggcctct

SEQ ID NO: 1413090 - DNA, 14 bp, Homo sapiens
accgcctcttcccg

SEQ ID NO: 1413091 - DNA, 15 bp, Homo sapiens
acctcctcccactgc

SEQ ID NO: 1413092 - DNA, 16 bp, Homo sapiens
acctcctcccactgcc

SEQ ID NO: 1413093 - DNA, 19 bp, Homo sapiens
acctgacagcaaacacagt

SEQ ID NO: 1413094 - DNA, 11 bp, Homo sapiens
acctggcctca

SEQ ID NO: 1413095 - DNA, 14 bp, Homo sapiens
acctgtacacacac

SEQ ID NO: 1413096 - DNA, 16 bp, Homo sapiens
acctgtacacacacag

SEQ ID NO: 1413097 - DNA, 17 bp, Homo sapiens
acctgtacacacacaga

SEQ ID NO: 1413098 - DNA, 20 bp, Homo sapiens
acgcaattgtatatatatgt

SEQ ID NO: 1413099 - DNA, 18 bp, Homo sapiens
agttttaaaaatgaagat

SEQ ID NO: 1413100 - DNA, 18 bp, Homo sapiens
attgtatatatatgtgaa

SEQ ID NO: 1413101 - DNA, 21 bp, Homo sapiens
atttaaagtgccttatcaaat

SEQ ID NO: 1413102 - DNA, 22 bp, Homo sapiens
atttaaagtgccttatcaaata

SEQ ID NO: 1413103 - DNA, 17 bp, Homo sapiens
atttaccacaggatgca

SEQ ID NO: 1413104 - DNA, 22 bp, Homo sapiens
atttaccacaggatgcatatta

SEQ ID NO: 1413105 - DNA, 18 bp, Homo sapiens
atttatctttgtagccta

SEQ ID NO: 1413106 - DNA, 16 bp, Homo sapiens
atttcaaaaacatgct

SEQ ID NO: 1413107 - DNA, 23 bp, Homo sapiens
atttcaaaaacatgcttttccaa

SEQ ID NO: 1413108 - DNA, 22 bp, Homo sapiens
atttcagaaactaagaatcatc

SEQ ID NO: 1413109 - DNA, 17 bp, Homo sapiens
atttcagttttaaaaat

SEQ ID NO: 1413110 - DNA, 18 bp, Homo sapiens
atttcagttttaaaaatg

SEQ ID NO: 1413111 - DNA, 20 bp, Homo sapiens
atttccatgtcccctcccag

SEQ ID NO: 1413112 - DNA, 15 bp, Homo sapiens
atttccctctgatat

SEQ ID NO: 1413113 - DNA, 20 bp, Homo sapiens
atttctagaacaattacatg

SEQ ID NO: 1413114 - DNA, 14 bp, Homo sapiens
atttctttgttata

SEQ ID NO: 1413115 - DNA, 20 bp, Homo sapiens
atttctttgttatacattta

SEQ ID NO: 1413116 - DNA, 17 bp, Homo sapiens
atttgcaaggctgattt

SEQ ID NO: 1413117 - DNA, 21 bp, Homo sapiens
atttgcaaggctgatttatgg

SEQ ID NO: 1413118 - DNA, 11 bp, Homo sapiens
atttgctctgg

SEQ ID NO: 1413119 - DNA, 23 bp, Homo sapiens
atttgtagccaaagaaatttcaa

SEQ ID NO: 1413120 - DNA, 21 bp, Homo sapiens
attttaaaatgaaatgcattt

SEQ ID NO: 1413121 - DNA, 22 bp, Homo sapiens
attttaaaatgaaatgcatttt

SEQ ID NO: 1413122 - DNA, 15 bp, Homo sapiens
attttatttatcttt

SEQ ID NO: 1413123 - DNA, 18 bp, Homo sapiens
attttatttatctttgta

SEQ ID NO: 1413124 - DNA, 15 bp, Homo sapiens
attttcctttatgtg

SEQ ID NO: 1413125 - DNA, 22 bp, Homo sapiens
attttgcacctgcagccaagca

SEQ ID NO: 1413126 - DNA, 21 bp, Homo sapiens
attttgctagacagttaaact

SEQ ID NO: 1413127 - DNA, 15 bp, Homo sapiens
atttttggcaaagcc

SEQ ID NO: 1413128 - DNA, 17 bp, Homo sapiens
atttttggcaaagccag

SEQ ID NO: 1413129 - DNA, 21 bp, Homo sapiens
caaaaacatgcttttccaaac

SEQ ID NO: 1413130 - DNA, 22 bp, Homo sapiens
caaaaagaagatggatgtaatt

SEQ ID NO: 1413131 - DNA, 14 bp, Homo sapiens
caaaacccagctgc

SEQ ID NO: 1413132 - DNA, 15 bp, Homo sapiens
caaaacccagctgca

SEQ ID NO: 1413133 - DNA, 21 bp, Homo sapiens
caaaacccagctgcacccctt

SEQ ID NO: 1413134 - DNA, 20 bp, Homo sapiens
caaactggccgcgggggcag

SEQ ID NO: 1413135 - DNA, 20 bp, Homo sapiens
caaagacttcatttaacact

SEQ ID NO: 1413136 - DNA, 19 bp, Homo sapiens
caaaggtaggttgaaggga

SEQ ID NO: 1413137 - DNA, 14 bp, Homo sapiens
caaataatattcat

SEQ ID NO: 1413138 - DNA, 17 bp, Homo sapiens
caaatacacatacatat

SEQ ID NO: 1413139 - DNA, 23 bp, Homo sapiens
caaatatcagtgggctctcttac

SEQ ID NO: 1413140 - DNA, 17 bp, Homo sapiens
caaatattttctttatt

SEQ ID NO: 1413141 - DNA, 14 bp, Homo sapiens
caaatgaaaagtaa

SEQ ID NO: 1413142 - DNA, 15 bp, Homo sapiens
caaatgcctgccaaa

SEQ ID NO: 1413143 - DNA, 19 bp, Homo sapiens
caaatgtgtcttgtattat

SEQ ID NO: 1413144 - DNA, 21 bp, Homo sapiens
caaatgtgtcttgtattatca

SEQ ID NO: 1413145 - DNA, 14 bp, Homo sapiens
caaattgcatttgt

SEQ ID NO: 1413146 - DNA, 23 bp, Homo sapiens
caacaacaaaacatttgctctgg

SEQ ID NO: 1413147 - DNA, 12 bp, Homo sapiens
caacagttattg

SEQ ID NO: 1413148 - DNA, 20 bp, Homo sapiens
caacctgacagcaaacacag

SEQ ID NO: 1413149 - DNA, 23 bp, Homo sapiens
caagattttgtttcttacgcttg

SEQ ID NO: 1413150 - DNA, 17 bp, Homo sapiens
caagcagacacacacat

SEQ ID NO: 1413151 - DNA, 21 bp, Homo sapiens
caagtatcatctaaatattat

SEQ ID NO: 1413152 - DNA, 14 bp, Homo sapiens
caagtattatattt

SEQ ID NO: 1413153 - DNA, 18 bp, Homo sapiens
caagtattatattttatt

SEQ ID NO: 1413154 - DNA, 13 bp, Homo sapiens
caataaatattat

SEQ ID NO: 1413155 - DNA, 21 bp, Homo sapiens
caatacctggcctcatttaaa

SEQ ID NO: 1413156 - DNA, 23 bp, Homo sapiens
caatactaggaagtaaagtgaag

SEQ ID NO: 1413157 - DNA, 15 bp, Homo sapiens
caatatcccttactt

SEQ ID NO: 1413158 - DNA, 17 bp, Homo sapiens
caatatcccttacttta

SEQ ID NO: 1413159 - DNA, 14 bp, Homo sapiens
caattacatgtaaa

SEQ ID NO: 1413160 - DNA, 20 bp, Homo sapiens
caattacatgtaaacaaata

SEQ ID NO: 1413161 - DNA, 19 bp, Homo sapiens
caattgtatatatatgtga

SEQ ID NO: 1413162 - DNA, 18 bp, Homo sapiens
caatttaagatacaaata

SEQ ID NO: 1413163 - DNA, 18 bp, Homo sapiens
caattttaaaatgaaatg

SEQ ID NO: 1413164 - DNA, 16 bp, Homo sapiens
cacaaagatcaaatga

SEQ ID NO: 1413165 - DNA, 17 bp, Homo sapiens
cacaagcagacacacac

SEQ ID NO: 1413166 - DNA, 13 bp, Homo sapiens
cacacacagacac

SEQ ID NO: 1413167 - DNA, 16 bp, Homo sapiens
cacacatatatacata

SEQ ID NO: 1413168 - DNA, 21 bp, Homo sapiens
cacacctcctcccactgccca

SEQ ID NO: 1413169 - DNA, 13 bp, Homo sapiens
cacacgctgcctt

SEQ ID NO: 1413170 - DNA, 19 bp, Homo sapiens
cacacgctgctctgcccca

SEQ ID NO: 1413171 - DNA, 15 bp, Homo sapiens
cacactgtggcctga

SEQ ID NO: 1413172 - DNA, 22 bp, Homo sapiens
cacagaggatgctgacatcatt

SEQ ID NO: 1413173 - DNA, 14 bp, Homo sapiens
cacaggatgcatat

SEQ ID NO: 1413174 - DNA, 17 bp, Homo sapiens
cacatatatacatacgc

SEQ ID NO: 1413175 - DNA, 17 bp, Homo sapiens
cacatgatttgggctct

SEQ ID NO: 1413176 - DNA, 17 bp, Homo sapiens
cacatttctaagccttt

SEQ ID NO: 1413177 - DNA, 20 bp, Homo sapiens
caccacgttaactgcatttt

SEQ ID NO: 1413178 - DNA, 10 bp, Homo sapiens
caccatctgc

SEQ ID NO: 1413179 - DNA, 15 bp, Homo sapiens
caccatctgctgtct

SEQ ID NO: 1413180 - DNA, 19 bp, Homo sapiens
caccatctgctgtcttttc

SEQ ID NO: 1413181 - DNA, 15 bp, Homo sapiens
caccccttcctgggc

SEQ ID NO: 1413182 - DNA, 13 bp, Homo sapiens
caccgccagccgc

SEQ ID NO: 1413183 - DNA, 17 bp, Homo sapiens
caccgccagccgccttc

SEQ ID NO: 1413184 - DNA, 15 bp, Homo sapiens
caccgcctcttcccg

SEQ ID NO: 1413185 - DNA, 16 bp, Homo sapiens
caccgcctcttcccgc

SEQ ID NO: 1413186 - DNA, 17 bp, Homo sapiens
cacctacaaggagataa

SEQ ID NO: 1413187 - DNA, 17 bp, Homo sapiens
cacctctttgctccctg

SEQ ID NO: 1413188 - DNA, 14 bp, Homo sapiens
cacctgcagccaag

SEQ ID NO: 1413189 - DNA, 17 bp, Homo sapiens
cacctgtgggccagccg

SEQ ID NO: 1413190 - DNA, 13 bp, Homo sapiens
caccttccaaaga

SEQ ID NO: 1413191 - DNA, 22 bp, Homo sapiens
caccttccaaagagtgctaagc

SEQ ID NO: 1413192 - DNA, 23 bp, Homo sapiens
cacgtgtatatgaggatgtatgt

SEQ ID NO: 1413193 - DNA, 16 bp, Homo sapiens
cactcccctccactct

SEQ ID NO: 1413194 - DNA, 15 bp, Homo sapiens
cactctctaccagat

SEQ ID NO: 1413195 - DNA, 23 bp, Homo sapiens
cactctgccccccccccccatct

SEQ ID NO: 1413196 - DNA, 13 bp, Homo sapiens
cactctggcagca

SEQ ID NO: 1413197 - DNA, 16 bp, Homo sapiens
cactgagtgaaatatt

SEQ ID NO: 1413198 - DNA, 20 bp, Homo sapiens
cactgtggcctgatcagcag

SEQ ID NO: 1413199 - DNA, 14 bp, Homo sapiens
cagaaaaagatctt

SEQ ID NO: 1413200 - DNA, 16 bp, Homo sapiens
cagaatggaatgctct

SEQ ID NO: 1413201 - DNA, 17 bp, Homo sapiens
cagacatggtggggtct

SEQ ID NO: 1413202 - DNA, 23 bp, Homo sapiens
cagacatggtggggtctcctcag

SEQ ID NO: 1413203 - DNA, 16 bp, Homo sapiens
cagagaggttaacaga

SEQ ID NO: 1413204 - DNA, 20 bp, Homo sapiens
cagagctggtggacccaggg

SEQ ID NO: 1413205 - DNA, 18 bp, Homo sapiens
cagatcttggactcatga

SEQ ID NO: 1413206 - DNA, 22 bp, Homo sapiens
cagatcttggactcatgaggag

SEQ ID NO: 1413207 - DNA, 16 bp, Homo sapiens
cagcaaacacagtcac

SEQ ID NO: 1413208 - DNA, 15 bp, Homo sapiens
cagcaccgcctcttc

SEQ ID NO: 1413209 - DNA, 14 bp, Homo sapiens
cagcaggcccatgg

SEQ ID NO: 1413210 - DNA, 13 bp, Homo sapiens
cagcatatatata

SEQ ID NO: 1413211 - DNA, 20 bp, Homo sapiens
cagcatatatataaaataca

SEQ ID NO: 1413212 - DNA, 18 bp, Homo sapiens
cagcatcgcactctggca

SEQ ID NO: 1413213 - DNA, 19 bp, Homo sapiens
cagcattctcaggcaccag

SEQ ID NO: 1413214 - DNA, 22 bp, Homo sapiens
cagccaagcaaatgcctgccaa

SEQ ID NO: 1413215 - DNA, 17 bp, Homo sapiens
cagcccatttgggcaga

SEQ ID NO: 1413216 - DNA, 22 bp, Homo sapiens
cagcccatttgggcagagaggc

SEQ ID NO: 1413217 - DNA, 14 bp, Homo sapiens
cagccgccttccct

SEQ ID NO: 1413218 - DNA, 17 bp, Homo sapiens
gcaccgcctcttcccgc

SEQ ID NO: 1413219 - DNA, 13 bp, Homo sapiens
gcactctggcagc

SEQ ID NO: 1413220 - DNA, 22 bp, Homo sapiens
gcagaattgacagttgaacaga

SEQ ID NO: 1413221 - DNA, 13 bp, Homo sapiens
gcagacacacaca

SEQ ID NO: 1413222 - DNA, 14 bp, Homo sapiens
gcagacacacacat

SEQ ID NO: 1413223 - DNA, 15 bp, Homo sapiens
gcagacacacacata

SEQ ID NO: 1413224 - DNA, 13 bp, Homo sapiens
gcagagaggctgt

SEQ ID NO: 1413225 - DNA, 17 bp, Homo sapiens
gcagagaggttaacaga

SEQ ID NO: 1413226 - DNA, 21 bp, Homo sapiens
gcagaggagaacttgctgcct

SEQ ID NO: 1413227 - DNA, 22 bp, Homo sapiens
gcagatctcccacatgccaggg

SEQ ID NO: 1413228 - DNA, 19 bp, Homo sapiens
gcagcatgcgatgtcatat

SEQ ID NO: 1413229 - DNA, 13 bp, Homo sapiens
gcagctatggaca

SEQ ID NO: 1413230 - DNA, 17 bp, Homo sapiens
gcaggcccatgggaggc

SEQ ID NO: 1413231 - DNA, 22 bp, Homo sapiens
gcaggcccatgggaggctggag

SEQ ID NO: 1413232 - DNA, 18 bp, Homo sapiens
gcaggggaggccatctgg

SEQ ID NO: 1413233 - DNA, 18 bp, Homo sapiens
gcagtgtgcttacctgtt

SEQ ID NO: 1413234 - DNA, 19 bp, Homo sapiens
gcataatatgcatatatat

SEQ ID NO: 1413235 - DNA, 17 bp, Homo sapiens
gcattagctttaattaa

SEQ ID NO: 1413236 - DNA, 19 bp, Homo sapiens
gccaaaacccagctgcacc

SEQ ID NO: 1413237 - DNA, 19 bp, Homo sapiens
gccagccaggaagatgaat

SEQ ID NO: 1413238 - DNA, 17 bp, Homo sapiens
gccagcccatttgggca

SEQ ID NO: 1413239 - DNA, 18 bp, Homo sapiens
gccagcccatttgggcag

SEQ ID NO: 1413240 - DNA, 9 bp, Homo sapiens
aaaaaaaga

SEQ ID NO: 1413241 - DNA, 14 bp, Homo sapiens
aaaaaatgaacagt

SEQ ID NO: 1413242 - DNA, 16 bp, Homo sapiens
aaaaatagctcttgct

SEQ ID NO: 1413243 - DNA, 22 bp, Homo sapiens
aaaacccagctgcaccccttcc

SEQ ID NO: 1413244 - DNA, 19 bp, Homo sapiens
aaaatacacgtgtatatga

SEQ ID NO: 1413245 - DNA, 16 bp, Homo sapiens
aaaatcagaaagacat

SEQ ID NO: 1413246 - DNA, 20 bp, Homo sapiens
aaaatcagaaagacattctt

SEQ ID NO: 1413247 - DNA, 13 bp, Homo sapiens
aaaatgaaatgca

SEQ ID NO: 1413248 - DNA, 16 bp, Homo sapiens
aaaatgaaatgcattt

SEQ ID NO: 1413249 - DNA, 24 bp, Homo sapiens
aaaatgagatatgcaataaatatt

SEQ ID NO: 1413250 - DNA, 14 bp, Homo sapiens
aaaatttaattatt

SEQ ID NO: 1413251 - DNA, 13 bp, Homo sapiens
aaactaagaatca

SEQ ID NO: 1413252 - DNA, 12 bp, Homo sapiens
aaagaccattta

SEQ ID NO: 1413253 - DNA, 18 bp, Homo sapiens
aaagactagccagccagg

SEQ ID NO: 1413254 - DNA, 10 bp, Homo sapiens
aaagagaaaa

SEQ ID NO: 1413255 - DNA, 20 bp, Homo sapiens
aaagatctttcattttgcac

SEQ ID NO: 1413256 - DNA, 16 bp, Homo sapiens
aaagcatcattacaat

SEQ ID NO: 1413257 - DNA, 18 bp, Homo sapiens
aaatacacatacatatat

SEQ ID NO: 1413258 - DNA, 12 bp, Homo sapiens
aaatgaaatgca

SEQ ID NO: 1413259 - DNA, 22 bp, Homo sapiens
aaatgagatatgcaataaatat

SEQ ID NO: 1413260 - DNA, 21 bp, Homo sapiens
aaatgagtcacttacttcata

SEQ ID NO: 1413261 - DNA, 23 bp, Homo sapiens
aaatgctgtctttcttgctccct

SEQ ID NO: 1413262 - DNA, 21 bp, Homo sapiens
aaatggctacatctccaaata

SEQ ID NO: 1413263 - DNA, 13 bp, Homo sapiens
aaattgcatttgt

SEQ ID NO: 1413264 - DNA, 14 bp, Homo sapiens
aaatttaattattt

SEQ ID NO: 1413265 - DNA, 14 bp, Homo sapiens
aaatttcaacagtt

SEQ ID NO: 1413266 - DNA, 16 bp, Homo sapiens
aaatttcaacagttat

SEQ ID NO: 1413267 - DNA, 15 bp, Homo sapiens
aacaaatattttctt

SEQ ID NO: 1413268 - DNA, 20 bp, Homo sapiens
aacaattacatgtaaacaaa

SEQ ID NO: 1413269 - DNA, 16 bp, Homo sapiens
aacagagctagaggcc

SEQ ID NO: 1413270 - DNA, 16 bp, Homo sapiens
aacagtcatcatttat

SEQ ID NO: 1413271 - DNA, 16 bp, Homo sapiens
aacatccaagtggcct

SEQ ID NO: 1413272 - DNA, 17 bp, Homo sapiens
aacatccaagtggcctc

SEQ ID NO: 1413273 - DNA, 16 bp, Homo sapiens
aacatgcttttccaaa

SEQ ID NO: 1413274 - DNA, 15 bp, Homo sapiens
aacattgtatgttaa

SEQ ID NO: 1413275 - DNA, 20 bp, Homo sapiens
aaccacatttctaagccttt

SEQ ID NO: 1413276 - DNA, 15 bp, Homo sapiens
aacccagctgcaccc

SEQ ID NO: 1413277 - DNA, 16 bp, Homo sapiens
aacccagctgcacccc

SEQ ID NO: 1413278 - DNA, 21 bp, Homo sapiens
aacctgacagcaaacacagtc

SEQ ID NO: 1413279 - DNA, 17 bp, Homo sapiens
aacgaccgtcttttgaa

SEQ ID NO: 1413280 - DNA, 19 bp, Homo sapiens
aactactaatctcaattta

SEQ ID NO: 1413281 - DNA, 16 bp, Homo sapiens
aactttctcagcatat

SEQ ID NO: 1413282 - DNA, 17 bp, Homo sapiens
aactttctcagcatata

SEQ ID NO: 1413283 - DNA, 19 bp, Homo sapiens
aactttctcagcatatata

SEQ ID NO: 1413284 - DNA, 9 bp, Homo sapiens
aagaaaaga

SEQ ID NO: 1413285 - DNA, 14 bp, Homo sapiens
aagaaaagagaaaa

SEQ ID NO: 1413286 - DNA, 13 bp, Homo sapiens
aagaaaatttaat

SEQ ID NO: 1413287 - DNA, 17 bp, Homo sapiens
aagaaaatttaattatt

SEQ ID NO: 1413288 - DNA, 23 bp, Homo sapiens
aagaaactactaatctcaattta

SEQ ID NO: 1413289 - DNA, 18 bp, Homo sapiens
aagaaatttcaacagtta

SEQ ID NO: 1413290 - DNA, 15 bp, Homo sapiens
aagaatttatctctt

SEQ ID NO: 1413291 - DNA, 18 bp, Homo sapiens
aagacaaatacacataca

SEQ ID NO: 1413292 - DNA, 21 bp, Homo sapiens
aagacattcttagttaatctt

SEQ ID NO: 1413293 - DNA, 20 bp, Homo sapiens
aagactagccagccaggaag

SEQ ID NO: 1413294 - DNA, 9 bp, Homo sapiens
aagagaaaa

SEQ ID NO: 1413295 - DNA, 14 bp, Homo sapiens
aagaggtggcccca

SEQ ID NO: 1413296 - DNA, 20 bp, Homo sapiens
aagagtaacagtcatcattt

SEQ ID NO: 1413297 - DNA, 17 bp, Homo sapiens
aagagtgctaagcatta

SEQ ID NO: 1413298 - DNA, 14 bp, Homo sapiens
aagatacaaataag

SEQ ID NO: 1413299 - DNA, 13 bp, Homo sapiens
aagatcaaatgaa

SEQ ID NO: 1413300 - DNA, 21 bp, Homo sapiens
aagatctcactctgccccccc

SEQ ID NO: 1413301 - DNA, 15 bp, Homo sapiens
aagatggatgtaatt

SEQ ID NO: 1413302 - DNA, 20 bp, Homo sapiens
aagatggggaaactgagggc

SEQ ID NO: 1413303 - DNA, 21 bp, Homo sapiens
aagcaaatgcctgccaaattt

SEQ ID NO: 1413304 - DNA, 17 bp, Homo sapiens
aagcaatttcagtttta

SEQ ID NO: 1413305 - DNA, 21 bp, Homo sapiens
aagcaatttcagttttaaaaa

SEQ ID NO: 1413306 - DNA, 15 bp, Homo sapiens
aagcagacacacaca

SEQ ID NO: 1413307 - DNA, 17 bp, Homo sapiens
aagcagacacacacata

SEQ ID NO: 1413308 - DNA, 20 bp, Homo sapiens
aagcagacacacacatatat

SEQ ID NO: 1413309 - DNA, 18 bp, Homo sapiens
aagcaggtgcaacactca

SEQ ID NO: 1413310 - DNA, 17 bp, Homo sapiens
aagcctttgagactgtt

SEQ ID NO: 1413311 - DNA, 14 bp, Homo sapiens
aagctctcatagct

SEQ ID NO: 1413312 - DNA, 14 bp, Homo sapiens
aaggacacaaactt

SEQ ID NO: 1413313 - DNA, 19 bp, Homo sapiens
aaggagataagaaagcagg

SEQ ID NO: 1413314 - DNA, 21 bp, Homo sapiens
aaggctgcctgctatgtattt

SEQ ID NO: 1413315 - DNA, 23 bp, Homo sapiens
aagggtctccgaaatgctgtctt

SEQ ID NO: 1413316 - DNA, 17 bp, Homo sapiens
aaggtccccagcagaat

SEQ ID NO: 1413317 - DNA, 18 bp, Homo sapiens
aagtaatctcacagcatt

SEQ ID NO: 1413318 - DNA, 16 bp, Homo sapiens
aagtatcatctaaata

SEQ ID NO: 1413319 - DNA, 15 bp, Homo sapiens
aagtctgatccctgc

SEQ ID NO: 1413320 - DNA, 21 bp, Homo sapiens
aagtgaagaatttatctcttt

SEQ ID NO: 1413321 - DNA, 21 bp, Homo sapiens
aagtgccttatcaaataatat

SEQ ID NO: 1413322 - DNA, 18 bp, Homo sapiens
aagttagtttttaatctc

SEQ ID NO: 1413323 - DNA, 14 bp, Homo sapiens
aagttgaagaagct

SEQ ID NO: 1413324 - DNA, 18 bp, Homo sapiens
aataaagttaaactgatt

SEQ ID NO: 1413325 - DNA, 19 bp, Homo sapiens
aataaagttaaactgatta

SEQ ID NO: 1413326 - DNA, 14 bp, Homo sapiens
aatacacgtgtata

SEQ ID NO: 1413327 - DNA, 20 bp, Homo sapiens
aatacctggcctcatttaaa

SEQ ID NO: 1413328 - DNA, 21 bp, Homo sapiens
aatagaagcttaaaataaagt

SEQ ID NO: 1413329 - DNA, 23 bp, Homo sapiens
aatatatttgcataatatgcata

SEQ ID NO: 1413330 - DNA, 24 bp, Homo sapiens
aatatatttgcataatatgcatat

SEQ ID NO: 1413331 - DNA, 16 bp, Homo sapiens
aatatcccttacttta

SEQ ID NO: 1413332 - DNA, 17 bp, Homo sapiens
aatatgcatatatatgt

SEQ ID NO: 1413333 - DNA, 18 bp, Homo sapiens
aatatgcatatatatgta

SEQ ID NO: 1413334 - DNA, 19 bp, Homo sapiens
aatatgcatatatatgtat

SEQ ID NO: 1413335 - DNA, 21 bp, Homo sapiens
aatatggactcagccttgcaa

SEQ ID NO: 1413336 - DNA, 19 bp, Homo sapiens
aatattatttgatgatact

SEQ ID NO: 1413337 - DNA, 15 bp, Homo sapiens
aatattcatgaagag

SEQ ID NO: 1413338 - DNA, 13 bp, Homo sapiens
aatcactgaaaat

SEQ ID NO: 1413339 - DNA, 20 bp, Homo sapiens
aatcatctcctttgcagaat

SEQ ID NO: 1413340 - DNA, 15 bp, Homo sapiens
aatctcaatttaaga

SEQ ID NO: 1413341 - DNA, 18 bp, Homo sapiens
aatctctccaccttccaa

SEQ ID NO: 1413342 - DNA, 21 bp, Homo sapiens
aatctctccaccttccaaaga

SEQ ID NO: 1413343 - DNA, 12 bp, Homo sapiens
aatgaaatgcat

SEQ ID NO: 1413344 - DNA, 16 bp, Homo sapiens
aatgaaatgcattttg

SEQ ID NO: 1413345 - DNA, 12 bp, Homo sapiens
aatgagaacaat

SEQ ID NO: 1413346 - DNA, 21 bp, Homo sapiens
aatgagatatgcaataaatat

SEQ ID NO: 1413347 - DNA, 18 bp, Homo sapiens
aatgagggcgtgaaacac

SEQ ID NO: 1413348 - DNA, 19 bp, Homo sapiens
aatgcctgccaaattttag

SEQ ID NO: 1413349 - DNA, 21 bp, Homo sapiens
aatggcatctcgttgtaagta

SEQ ID NO: 1413350 - DNA, 20 bp, Homo sapiens
aatggctacatctccaaata

SEQ ID NO: 1413351 - DNA, 13 bp, Homo sapiens
aatgtcaaatgaa

SEQ ID NO: 1413352 - DNA, 21 bp, Homo sapiens
aattatctagtagttgtagaa

SEQ ID NO: 1413353 - DNA, 10 bp, Homo sapiens
aattgaaagg

SEQ ID NO: 1413354 - DNA, 12 bp, Homo sapiens
aattgtatatat

SEQ ID NO: 1413355 - DNA, 14 bp, Homo sapiens
aattgtatatatat

SEQ ID NO: 1413356 - DNA, 15 bp, Homo sapiens
aattgtatatatatg

SEQ ID NO: 1413357 - DNA, 16 bp, Homo sapiens
aattgtatatatatgt

SEQ ID NO: 1413358 - DNA, 23 bp, Homo sapiens
atatatttgcataatatgcatat

SEQ ID NO: 1413359 - DNA, 15 bp, Homo sapiens
atatccaattttaaa

SEQ ID NO: 1413360 - DNA, 17 bp, Homo sapiens
atatccaattttaaaat

SEQ ID NO: 1413361 - DNA, 14 bp, Homo sapiens
atatcccttacttt

SEQ ID NO: 1413362 - DNA, 15 bp, Homo sapiens
atatgaggatgtatg

SEQ ID NO: 1413363 - DNA, 15 bp, Homo sapiens
atatgcaataaatat

SEQ ID NO: 1413364 - DNA, 16 bp, Homo sapiens
atatgcatatatatgt

SEQ ID NO: 1413365 - DNA, 20 bp, Homo sapiens
atatggactcagccttgcaa

SEQ ID NO: 1413366 - DNA, 17 bp, Homo sapiens
atatgtgaactttctca

SEQ ID NO: 1413367 - DNA, 15 bp, Homo sapiens
atatgtttatacaca

SEQ ID NO: 1413368 - DNA, 16 bp, Homo sapiens
atatgtttatacacac

SEQ ID NO: 1413369 - DNA, 17 bp, Homo sapiens
atatgtttatacacaca

SEQ ID NO: 1413370 - DNA, 16 bp, Homo sapiens
atattaacaaattgca

SEQ ID NO: 1413371 - DNA, 19 bp, Homo sapiens
atattaacaaattgcattt

SEQ ID NO: 1413372 - DNA, 17 bp, Homo sapiens
atattactctgcctgtc

SEQ ID NO: 1413373 - DNA, 20 bp, Homo sapiens
atatttgcataatatgcata

SEQ ID NO: 1413374 - DNA, 17 bp, Homo sapiens
atattttatttatcttt

SEQ ID NO: 1413375 - DNA, 18 bp, Homo sapiens
atattttcctttatgtga

SEQ ID NO: 1413376 - DNA, 15 bp, Homo sapiens
atatttttcccagga

SEQ ID NO: 1413377 - DNA, 14 bp, Homo sapiens
atcaaataatattc

SEQ ID NO: 1413378 - DNA, 15 bp, Homo sapiens
atcaaatgaaaagta

SEQ ID NO: 1413379 - DNA, 19 bp, Homo sapiens
atcacgatgtaaattatta

SEQ ID NO: 1413380 - DNA, 13 bp, Homo sapiens
atcatcacaaatg

SEQ ID NO: 1413381 - DNA, 17 bp, Homo sapiens
atcccacatatttcaaa

SEQ ID NO: 1413382 - DNA, 16 bp, Homo sapiens
atcctagcttcttcca

SEQ ID NO: 1413383 - DNA, 17 bp, Homo sapiens
atcctctcgttcagttt

SEQ ID NO: 1413384 - DNA, 17 bp, Homo sapiens
atcgcactctggcagca

SEQ ID NO: 1413385 - DNA, 20 bp, Homo sapiens
atcgcactctggcagcaccg

SEQ ID NO: 1413386 - DNA, 19 bp, Homo sapiens
atctaaggtccccagcaga

SEQ ID NO: 1413387 - DNA, 13 bp, Homo sapiens
atctcccacatgc

SEQ ID NO: 1413388 - DNA, 18 bp, Homo sapiens
atctcctttgcagaatga

SEQ ID NO: 1413389 - DNA, 19 bp, Homo sapiens
atctcgctccctcccagga

SEQ ID NO: 1413390 - DNA, 19 bp, Homo sapiens
atctctcaggaatcatctc

SEQ ID NO: 1413391 - DNA, 18 bp, Homo sapiens
atctctccaccttccaaa

SEQ ID NO: 1413392 - DNA, 22 bp, Homo sapiens
atctttcattttgcacctgcag

SEQ ID NO: 1413393 - DNA, 20 bp, Homo sapiens
atctttgtagcctaaagacc

SEQ ID NO: 1413394 - DNA, 15 bp, Homo sapiens
atgaaatgcattttg

SEQ ID NO: 1413395 - DNA, 16 bp, Homo sapiens
atgacccgtacacacc

SEQ ID NO: 1413396 - DNA, 20 bp, Homo sapiens
atgagggcgtgaaacacaat

SEQ ID NO: 1413397 - DNA, 15 bp, Homo sapiens
atgagtcacttactt

SEQ ID NO: 1413398 - DNA, 19 bp, Homo sapiens
atgcattttatagaatgtg

SEQ ID NO: 1413399 - DNA, 15 bp, Homo sapiens
atgccacccacatct

SEQ ID NO: 1413400 - DNA, 14 bp, Homo sapiens
atgcgatgtcatat

SEQ ID NO: 1413401 - DNA, 18 bp, Homo sapiens
atgctgtctttcttgctc

SEQ ID NO: 1413402 - DNA, 13 bp, Homo sapiens
atgctgtgcccct

SEQ ID NO: 1413403 - DNA, 17 bp, Homo sapiens
atgctgtgcccctggcc

SEQ ID NO: 1413404 - DNA, 18 bp, Homo sapiens
atgctgtgcccctggcct

SEQ ID NO: 1413405 - DNA, 14 bp, Homo sapiens
atggaagacaaata

SEQ ID NO: 1413406 - DNA, 16 bp, Homo sapiens
atggaagacaaataca

SEQ ID NO: 1413407 - DNA, 22 bp, Homo sapiens
atggaagacaaatacacataca

SEQ ID NO: 1413408 - DNA, 19 bp, Homo sapiens
atggactcagccttgcaaa

SEQ ID NO: 1413409 - DNA, 16 bp, Homo sapiens
atggtggggtctcctc

SEQ ID NO: 1413410 - DNA, 23 bp, Homo sapiens
atggtggggtctcctcaggacca

SEQ ID NO: 1413411 - DNA, 16 bp, Homo sapiens
atgtatgtgtatatgt

SEQ ID NO: 1413412 - DNA, 22 bp, Homo sapiens
atgtatgtgtatatgtttatac

SEQ ID NO: 1413413 - DNA, 22 bp, Homo sapiens
atgtatttgcaaggctgattta

SEQ ID NO: 1413414 - DNA, 14 bp, Homo sapiens
atgtcccctcccag

SEQ ID NO: 1413415 - DNA, 22 bp, Homo sapiens
atgtgaactttctcagcatata

SEQ ID NO: 1413416 - DNA, 23 bp, Homo sapiens
atgtgaactttctcagcatatat

SEQ ID NO: 1413417 - DNA, 14 bp, Homo sapiens
atgtgcgaacacag

SEQ ID NO: 1413418 - DNA, 19 bp, Homo sapiens
atgtgcgaacacagtgaca

SEQ ID NO: 1413419 - DNA, 22 bp, Homo sapiens
atgtgtatggaagacaaataca

SEQ ID NO: 1413420 - DNA, 16 bp, Homo sapiens
atgtgtcttgtattat

SEQ ID NO: 1413421 - DNA, 19 bp, Homo sapiens
atgttaatagaaaatatat

SEQ ID NO: 1413422 - DNA, 17 bp, Homo sapiens
attaacaaattgcattt

SEQ ID NO: 1413423 - DNA, 16 bp, Homo sapiens
attacaatacagtatt

SEQ ID NO: 1413424 - DNA, 19 bp, Homo sapiens
attacaatacagtatttct

SEQ ID NO: 1413425 - DNA, 12 bp, Homo sapiens
attacatgtaaa

SEQ ID NO: 1413426 - DNA, 22 bp, Homo sapiens
attactctgcctgtcaagtttt

SEQ ID NO: 1413427 - DNA, 17 bp, Homo sapiens
attccagtcccctttct

SEQ ID NO: 1413428 - DNA, 18 bp, Homo sapiens
attccagtcccctttctc

SEQ ID NO: 1413429 - DNA, 17 bp, Homo sapiens
attccccactcagcctt

SEQ ID NO: 1413430 - DNA, 18 bp, Homo sapiens
attccccactcagccttt

SEQ ID NO: 1413431 - DNA, 22 bp, Homo sapiens
attcttagcaaaaaatgaacag

SEQ ID NO: 1413432 - DNA, 16 bp, Homo sapiens
attcttagttaatctt

SEQ ID NO: 1413433 - DNA, 17 bp, Homo sapiens
attgaagctaaaacact

SEQ ID NO: 1413434 - DNA, 17 bp, Homo sapiens
attgacagttgaacaga

SEQ ID NO: 1413435 - DNA, 15 bp, Homo sapiens
atttaagatacaaat
